United States Patent 7,691,997 (FUNCTIONAL AND HYPERFUNCTIONAL SIRNA) - sequence listing, part 21

SEQ ID NO: 838381 - RNA, 19 nt, Homo sapiens
ggagacaaaccacauaaau

SEQ ID NO: 838382 - RNA, 19 nt, Homo sapiens
caaagauacugcugcuaga

SEQ ID NO: 838383 - RNA, 19 nt, Homo sapiens
gaugaaauguuugaagcaa

SEQ ID NO: 838384 - RNA, 19 nt, Homo sapiens
ggagucaacuaaagcuguu

SEQ ID NO: 838385 - RNA, 19 nt, Homo sapiens
cguaauagucugauucuuu

SEQ ID NO: 838386 - RNA, 19 nt, Homo sapiens
uaagugaagcugcauguuu

SEQ ID NO: 838387 - RNA, 19 nt, Homo sapiens
gaauaacacaugcacuuga

SEQ ID NO: 838388 - RNA, 19 nt, Homo sapiens
uuacugcaaugccaccuua

SEQ ID NO: 838389 - RNA, 19 nt, Homo sapiens
aggaagaaauggauucaaa

SEQ ID NO: 838390 - RNA, 19 nt, Homo sapiens
gaaauugaccaagcagauu

SEQ ID NO: 838391 - RNA, 19 nt, Homo sapiens
gaaagaguacauugaugaa

SEQ ID NO: 838392 - RNA, 19 nt, Homo sapiens
uaauugaaaugcugugguu

SEQ ID NO: 838393 - RNA, 19 nt, Homo sapiens
uaacacaugcacuugauuu

SEQ ID NO: 838394 - RNA, 19 nt, Homo sapiens
cuaaauacaucucuuucug

SEQ ID NO: 838395 - RNA, 19 nt, Homo sapiens
caacaguacuaugguuuau

SEQ ID NO: 838396 - RNA, 19 nt, Homo sapiens
uaaugacagugacuaugua

SEQ ID NO: 838397 - RNA, 19 nt, Homo sapiens
agaaagcugucauuaggaa

SEQ ID NO: 838398 - RNA, 19 nt, Homo sapiens
ugaaauguuugaagcaaga

SEQ ID NO: 838399 - RNA, 19 nt, Homo sapiens
gcacaggucaugcauuuag

SEQ ID NO: 838400 - RNA, 19 nt, Homo sapiens
uaacauccagucucucuaa

SEQ ID NO: 838401 - RNA, 19 nt, Homo sapiens
ugaagaagugccuaauaua

SEQ ID NO: 838402 - RNA, 19 nt, Homo sapiens
gcauguuuguauugaagua

SEQ ID NO: 838403 - RNA, 19 nt, Homo sapiens
gaacaguacaacaucuaaa

SEQ ID NO: 838404 - RNA, 19 nt, Homo sapiens
gcaaagcguugacaaauca

SEQ ID NO: 838405 - RNA, 19 nt, Homo sapiens
gaggaccgcugauagguua

SEQ ID NO: 838406 - RNA, 19 nt, Homo sapiens
gaaaggaaacugaagguaa

SEQ ID NO: 838407 - RNA, 19 nt, Homo sapiens
gcagaaaggugaauguaca

SEQ ID NO: 838408 - RNA, 19 nt, Homo sapiens
caagaaagaagacuaguaa

SEQ ID NO: 838409 - RNA, 19 nt, Homo sapiens
ggacgagaauggaaacuug

SEQ ID NO: 838410 - RNA, 19 nt, Homo sapiens
ggacggagaucggagcuuu

SEQ ID NO: 838411 - RNA, 19 nt, Homo sapiens
gaucucaaauucacaaaug

SEQ ID NO: 838412 - RNA, 19 nt, Homo sapiens
gauguguugugacuaaaua

SEQ ID NO: 838413 - RNA, 19 nt, Homo sapiens
uaaauugucugccuccuau

SEQ ID NO: 838414 - RNA, 19 nt, Homo sapiens
ggagaggaauaauugagaa

SEQ ID NO: 838415 - RNA, 19 nt, Homo sapiens
ggaaacuguuaaaugcaua

SEQ ID NO: 838416 - RNA, 19 nt, Homo sapiens
gagcaucauugaaggacua

SEQ ID NO: 838417 - RNA, 19 nt, Homo sapiens
ucacacggaucucaaauuc

SEQ ID NO: 838418 - RNA, 19 nt, Homo sapiens
gacgagaccggaucaauaa

SEQ ID NO: 838419 - RNA, 19 nt, Homo sapiens
uggcagaaguugcgcguua

SEQ ID NO: 838420 - RNA, 19 nt, Homo sapiens
gaccguggaucaccugaaa

SEQ ID NO: 838421 - RNA, 19 nt, Homo sapiens
gaacugugguugccaaggu

SEQ ID NO: 838422 - RNA, 19 nt, Homo sapiens
gaucagcuuuauccaagaa

SEQ ID NO: 838423 - RNA, 19 nt, Homo sapiens
aaaggaaacugaagguaau

SEQ ID NO: 838424 - RNA, 19 nt, Homo sapiens
cgacgagaccggaucaaua

SEQ ID NO: 838425 - RNA, 19 nt, Homo sapiens
gaguauaagccaacacuuu

SEQ ID NO: 838426 - RNA, 19 nt, Homo sapiens
guauaguuauggucuguuu

SEQ ID NO: 838427 - RNA, 19 nt, Homo sapiens
gaaguugcgcguuaucuga

SEQ ID NO: 838428 - RNA, 19 nt, Homo sapiens
aagguacacuuucagauaa

SEQ ID NO: 838429 - RNA, 19 nt, Homo sapiens
uaacauggauaagugauca

SEQ ID NO: 838430 - RNA, 19 nt, Homo sapiens
gcugauagguuaggucuca

SEQ ID NO: 838431 - RNA, 19 nt, Homo sapiens
gagcaaagcguugacaaau

SEQ ID NO: 838432 - RNA, 19 nt, Homo sapiens
guacugauguguugugacu

SEQ ID NO: 838433 - RNA, 19 nt, Homo sapiens
gcuauggacuaucggaguu

SEQ ID NO: 838434 - RNA, 19 nt, Homo sapiens
uagaauacgccugcauuua

SEQ ID NO: 838435 - RNA, 19 nt, Homo sapiens
aaaccacuaugcuuaaugu

SEQ ID NO: 838436 - RNA, 19 nt, Homo sapiens
gugccuaauuuacuuugua

SEQ ID NO: 838437 - RNA, 19 nt, Homo sapiens
gacuaaagguuuguugguu

SEQ ID NO: 838438 - RNA, 19 nt, Homo sapiens
uaaacgaccuccacugaac

SEQ ID NO: 838439 - RNA, 19 nt, Homo sapiens
gaaacugaagguaauugaa

SEQ ID NO: 838440 - RNA, 19 nt, Homo sapiens
ggaaacugaagguaauuga

SEQ ID NO: 838441 - RNA, 19 nt, Homo sapiens
ggaaaggaaacugaaggua

SEQ ID NO: 838442 - RNA, 19 nt, Homo sapiens
ggucucauuuggaguguug

SEQ ID NO: 838443 - RNA, 19 nt, Homo sapiens
ccaagaaagaagacuagua

SEQ ID NO: 838444 - RNA, 19 nt, Homo sapiens
aagaacugauguagaauga

SEQ ID NO: 838445 - RNA, 19 nt, Homo sapiens
agacggagaggaauaauug

SEQ ID NO: 838446 - RNA, 19 nt, Homo sapiens
ggacugccauauuuucuuu

SEQ ID NO: 838447 - RNA, 19 nt, Homo sapiens
uggcaguucugauuuaguu

SEQ ID NO: 838448 - RNA, 19 nt, Homo sapiens
acuaaagguuuguugguuu

SEQ ID NO: 838449 - RNA, 19 nt, Homo sapiens
ucaauaacaguuugucuga

SEQ ID NO: 838450 - RNA, 19 nt, Homo sapiens
guuaaacgaccuccacuga

SEQ ID NO: 838451 - RNA, 19 nt, Homo sapiens
cagauuaagguguuguaua

SEQ ID NO: 838452 - RNA, 19 nt, Homo sapiens
ugucauguauuagcaguuu

SEQ ID NO: 838453 - RNA, 19 nt, Homo sapiens
uuucgcaucucaacaacua

SEQ ID NO: 838454 - RNA, 19 nt, Homo sapiens
gccgagauccugcagauga

SEQ ID NO: 838455 - RNA, 19 nt, Homo sapiens
uggggaaucuuaacauuua

SEQ ID NO: 838456 - RNA, 19 nt, Homo sapiens
acugauguguugugacuaa

SEQ ID NO: 838457 - RNA, 19 nt, Homo sapiens
ccagcaacacaaagaauuu

SEQ ID NO: 838458 - RNA, 19 nt, Homo sapiens
guaaauugucugccuccua

SEQ ID NO: 838459 - RNA, 19 nt, Homo sapiens
uagguuaggucucauuugg

SEQ ID NO: 838460 - RNA, 19 nt, Homo sapiens
cgacugguuucgcaucuca

SEQ ID NO: 838461 - RNA, 19 nt, Homo sapiens
ccaucgagguggagaagga

SEQ ID NO: 838462 - RNA, 19 nt, Homo sapiens
gaugaucagcuuuauccaa

SEQ ID NO: 838463 - RNA, 19 nt, Homo sapiens
ccaaaccacuaugcuuaau

SEQ ID NO: 838464 - RNA, 19 nt, Homo sapiens
ggcaagcccuauagaccuu

SEQ ID NO: 838465 - RNA, 19 nt, Homo sapiens
ggagagugcggacgagaau

SEQ ID NO: 838466 - RNA, 19 nt, Homo sapiens
gaguguugguggaaaggaa

SEQ ID NO: 838467 - RNA, 19 nt, Homo sapiens
gauagguuaggucucauuu

SEQ ID NO: 838468 - RNA, 19 nt, Homo sapiens
ggggaacuauauugaauuu

SEQ ID NO: 838469 - RNA, 19 nt, Homo sapiens
gguacacuuucagauaauu

SEQ ID NO: 838470 - RNA, 19 nt, Homo sapiens
aguggucaauugaguagua

SEQ ID NO: 838471 - RNA, 19 nt, Homo sapiens
uuuguacugugccuaauuu

SEQ ID NO: 838472 - RNA, 19 nt, Homo sapiens
aaaggugaauguacaaacu

SEQ ID NO: 838473 - RNA, 19 nt, Homo sapiens
ugugauagguuuguacugu

SEQ ID NO: 838474 - RNA, 19 nt, Homo sapiens
ggaggaccgcugauagguu

SEQ ID NO: 838475 - RNA, 19 nt, Homo sapiens
gcauacggcaggagggaaa

SEQ ID NO: 838476 - RNA, 19 nt, Homo sapiens
ggguuugaccucuguugua

SEQ ID NO: 838477 - RNA, 19 nt, Homo sapiens
gaauacgccugcauuuacc

SEQ ID NO: 838478 - RNA, 19 nt, Homo sapiens
gaccggaucaauaacaguu

SEQ ID NO: 838479 - RNA, 19 nt, Homo sapiens
gaaaggugaauguacaaac

SEQ ID NO: 838480 - RNA, 19 nt, Homo sapiens
aagccaacacuuugugaua

SEQ ID NO: 838481 - RNA, 19 nt, Homo sapiens
uaucugagcaucauugaag

SEQ ID NO: 838482 - RNA, 19 nt, Homo sapiens
uaucggaguuugggauuuc

SEQ ID NO: 838483 - RNA, 19 nt, Homo sapiens
ccacugaacuggguuugac

SEQ ID NO: 838484 - RNA, 19 nt, Homo sapiens
acacggaucucaaauucac

SEQ ID NO: 838485 - RNA, 19 nt, Homo sapiens
agaauacgccugcauuuac

SEQ ID NO: 838486 - RNA, 19 nt, Homo sapiens
gaggggaacuauauugaau

SEQ ID NO: 838487 - RNA, 19 nt, Homo sapiens
uuucggcuccuuccacuua

SEQ ID NO: 838488 - RNA, 19 nt, Homo sapiens
gcgaguggucaauugagua

SEQ ID NO: 838489 - RNA, 19 nt, Homo sapiens
uuccaaaccacuaugcuua

SEQ ID NO: 838490 - RNA, 19 nt, Homo sapiens
guacugugccuaauuuacu

SEQ ID NO: 838491 - RNA, 19 nt, Homo sapiens
ggucaccuccgccuccaaa

SEQ ID NO: 838492 - RNA, 19 nt, Homo sapiens
aguggaaacuguuaaaugc

SEQ ID NO: 838493 - RNA, 19 nt, Homo sapiens
gggaucugcuaagcuagaa

SEQ ID NO: 838494 - RNA, 19 nt, Homo sapiens
gugaauguacaaacuguug

SEQ ID NO: 838495 - RNA, 19 nt, Homo sapiens
uccugggacugccauauuu

SEQ ID NO: 838496 - RNA, 19 nt, Homo sapiens
gagaccggaucaauaacag

SEQ ID NO: 838497 - RNA, 19 nt, Homo sapiens
guuaggaggaccgcugaua

SEQ ID NO: 838498 - RNA, 19 nt, Homo sapiens
gccaacaucaccuuaaagu

SEQ ID NO: 838499 - RNA, 19 nt, Homo sapiens
gguuugaccucuguuguac

SEQ ID NO: 838500 - RNA, 19 nt, Homo sapiens
uagcagaaaggugaaugua

SEQ ID NO: 838501 - RNA, 19 nt, Homo sapiens
ugagcaaagcguugacaaa

SEQ ID NO: 838502 - RNA, 19 nt, Homo sapiens
aguauaagccaacacuuug

SEQ ID NO: 838503 - RNA, 19 nt, Homo sapiens
uugccaacaucaccuuaaa

SEQ ID NO: 838504 - RNA, 19 nt, Homo sapiens
gaagaaaucucacuaauuc

SEQ ID NO: 838505 - RNA, 19 nt, Homo sapiens
gaacaaagcuaccuggaaa

SEQ ID NO: 838506 - RNA, 19 nt, Homo sapiens
gaagaacaaugucaaaugu

SEQ ID NO: 838507 - RNA, 19 nt, Homo sapiens
gcagacauuugguuaauug

SEQ ID NO: 838508 - RNA, 19 nt, Homo sapiens
gaagaagugugaaugugaa

SEQ ID NO: 838509 - RNA, 19 nt, Homo sapiens
caacuaagauucagucagu

SEQ ID NO: 838510 - RNA, 19 nt, Homo sapiens
aaucauagcuacauaccua

SEQ ID NO: 838511 - RNA, 19 nt, Homo sapiens
gcaaaucacagcaauauuc

SEQ ID NO: 838512 - RNA, 19 nt, Homo sapiens
gaagaagaaaucucacuaa

SEQ ID NO: 838513 - RNA, 19 nt, Homo sapiens
gaaaauagguacugucaga

SEQ ID NO: 838514 - RNA, 19 nt, Homo sapiens
ugaaaucuguacuguauga

SEQ ID NO: 838515 - RNA, 19 nt, Homo sapiens
gaaugucacucaagaccaa

SEQ ID NO: 838516 - RNA, 19 nt, Homo sapiens
aggaguaccuggaguauaa

SEQ ID NO: 838517 - RNA, 19 nt, Homo sapiens
gcacuuucuuccugccuua

SEQ ID NO: 838518 - RNA, 19 nt, Homo sapiens
ggacugagaagaacaaugu

SEQ ID NO: 838519 - RNA, 19 nt, Homo sapiens
gcaugaacaucuauacaau

SEQ ID NO: 838520 - RNA, 19 nt, Homo sapiens
cgacaucaaugaaaucugu

SEQ ID NO: 838521 - RNA, 19 nt, Homo sapiens
gagaguaaguuggcuuuga

SEQ ID NO: 838522 - RNA, 19 nt, Homo sapiens
gcacaccacugucccuuca

SEQ ID NO: 838523 - RNA, 19 nt, Homo sapiens
gagcauauacaacuacaaa

SEQ ID NO: 838524 - RNA, 19 nt, Homo sapiens
gaguguaaguaaaggauaa

SEQ ID NO: 838525 - RNA, 19 nt, Homo sapiens
gugagacgcuggcuucauu

SEQ ID NO: 838526 - RNA, 19 nt, Homo sapiens
ccaagcagauugacucuca

SEQ ID NO: 838527 - RNA, 19 nt, Homo sapiens
gcuuuaaccucuuuauuuc

SEQ ID NO: 838528 - RNA, 19 nt, Homo sapiens
gaacagaagaagaagaaau

SEQ ID NO: 838529 - RNA, 19 nt, Homo sapiens
ucacagauacugauuauuc

SEQ ID NO: 838530 - RNA, 19 nt, Homo sapiens
gacaggauuugguaaguga

SEQ ID NO: 838531 - RNA, 19 nt, Homo sapiens
gcggcacgcugcuaaguuu

SEQ ID NO: 838532 - RNA, 19 nt, Homo sapiens
ggagcgacaucaaugaaau

SEQ ID NO: 838533 - RNA, 19 nt, Homo sapiens
ggagcagucuguccuuaug

SEQ ID NO: 838534 - RNA, 19 nt, Homo sapiens
uagcugcucuuucuucuug

SEQ ID NO: 838535 - RNA, 19 nt, Homo sapiens
ggccagaacugaagcagau

SEQ ID NO: 838536 - RNA, 19 nt, Homo sapiens
gaaucagguuaaugaggua

SEQ ID NO: 838537 - RNA, 19 nt, Homo sapiens
gguuagaguucacacuuga

SEQ ID NO: 838538 - RNA, 19 nt, Homo sapiens
ggacaggauuugguaagug

SEQ ID NO: 838539 - RNA, 19 nt, Homo sapiens
gaagugcugcucuccguuu

SEQ ID NO: 838540 - RNA, 19 nt, Homo sapiens
caaaggagcaucaguuucu

SEQ ID NO: 838541 - RNA, 19 nt, Homo sapiens
gggcagacauuugguuaau

SEQ ID NO: 838542 - RNA, 19 nt, Homo sapiens
aaagggauuugagcauaua

SEQ ID NO: 838543 - RNA, 19 nt, Homo sapiens
uaccauagcuuauauucuc

SEQ ID NO: 838544 - RNA, 19 nt, Homo sapiens
aagaagugcuuacugaaug

SEQ ID NO: 838545 - RNA, 19 nt, Homo sapiens
caucccuucuguucauuua

SEQ ID NO: 838546 - RNA, 19 nt, Homo sapiens
ggaaacagcauagagugaa

SEQ ID NO: 838547 - RNA, 19 nt, Homo sapiens
acagcgcccuccagaguua

SEQ ID NO: 838548 - RNA, 19 nt, Homo sapiens
ucacagggcugcugauggu

SEQ ID NO: 838549 - RNA, 19 nt, Homo sapiens
ggucucagcuccuguuguc

SEQ ID NO: 838550 - RNA, 19 nt, Homo sapiens
gaaacagcauagagugaag

SEQ ID NO: 838551 - RNA, 19 nt, Homo sapiens
gagcaucaguuucuuuuga

SEQ ID NO: 838552 - RNA, 19 nt, Homo sapiens
gggcaaaucacagcaauau

SEQ ID NO: 838553 - RNA, 19 nt, Homo sapiens
gcuuacggguucauugauu

SEQ ID NO: 838554 - RNA, 19 nt, Homo sapiens
ucaaugaaaucuguacugu

SEQ ID NO: 838555 - RNA, 19 nt, Homo sapiens
gcauauacaacuacaaauc

SEQ ID NO: 838556 - RNA, 19 nt, Homo sapiens
gagaggaguaccuggagua

SEQ ID NO: 838557 - RNA, 19 nt, Homo sapiens
uccaagaagugcuuacuga

SEQ ID NO: 838558 - RNA, 19 nt, Homo sapiens
gcauuuacaaccuuucauu

SEQ ID NO: 838559 - RNA, 19 nt, Homo sapiens
gaggagccacuaaaccuuu

SEQ ID NO: 838560 - RNA, 19 nt, Homo sapiens
gugcguggccuuaaacauu

SEQ ID NO: 838561 - RNA, 19 nt, Homo sapiens
auaaguagcaguacacauu

SEQ ID NO: 838562 - RNA, 19 nt, Homo sapiens
uacaguagcugcucuuucu

SEQ ID NO: 838563 - RNA, 19 nt, Homo sapiens
cagccaagaugaacuccuu

SEQ ID NO: 838564 - RNA, 19 nt, Homo sapiens
cauugucccucaugucauu

SEQ ID NO: 838565 - RNA, 19 nt, Homo sapiens
ggagucacuuuggcuggua

SEQ ID NO: 838566 - RNA, 19 nt, Homo sapiens
ccucuuagcaggacagaaa

SEQ ID NO: 838567 - RNA, 19 nt, Homo sapiens
caagaagugcuuacugaau

SEQ ID NO: 838568 - RNA, 19 nt, Homo sapiens
gcaaguaagccuagauaac

SEQ ID NO: 838569 - RNA, 19 nt, Homo sapiens
ccacauggauuuucuuaau

SEQ ID NO: 838570 - RNA, 19 nt, Homo sapiens
ugaagaagugugaauguga

SEQ ID NO: 838571 - RNA, 19 nt, Homo sapiens
caaguaagccuagauaacu

SEQ ID NO: 838572 - RNA, 19 nt, Homo sapiens
cagcaaguaagccuagaua

SEQ ID NO: 838573 - RNA, 19 nt, Homo sapiens
guacaugugcucccuguca

SEQ ID NO: 838574 - RNA, 19 nt, Homo sapiens
acacaucgaagcuuuaaga

SEQ ID NO: 838575 - RNA, 19 nt, Homo sapiens
ccagaacugaagcagauua

SEQ ID NO: 838576 - RNA, 19 nt, Homo sapiens
uggagaaucagguuaauga

SEQ ID NO: 838577 - RNA, 19 nt, Homo sapiens
gugcugcucuccguuuauu

SEQ ID NO: 838578 - RNA, 19 nt, Homo sapiens
ccuuaaacauugagaagug

SEQ ID NO: 838579 - RNA, 19 nt, Homo sapiens
gcaaggagaggaacugaac

SEQ ID NO: 838580 - RNA, 19 nt, Homo sapiens
guagugguuuggcaagguu

SEQ ID NO: 838581 - RNA, 19 nt, Homo sapiens
gagaagaacaaugucaaau

SEQ ID NO: 838582 - RNA, 19 nt, Homo sapiens
agucacacaucgaagcuuu

SEQ ID NO: 838583 - RNA, 19 nt, Homo sapiens
acagcuggcuccaauuuca

SEQ ID NO: 838584 - RNA, 19 nt, Homo sapiens
uagauuucauggcuuaaug

SEQ ID NO: 838585 - RNA, 19 nt, Homo sapiens
agaagaagaagaaaucuca

SEQ ID NO: 838586 - RNA, 19 nt, Homo sapiens
guuuacagcuggcuccaau

SEQ ID NO: 838587 - RNA, 19 nt, Homo sapiens
caaugaaaucuguacugua

SEQ ID NO: 838588 - RNA, 19 nt, Homo sapiens
gggauuugauucucauuuu

SEQ ID NO: 838589 - RNA, 19 nt, Homo sapiens
cagcuccuguugucaguga

SEQ ID NO: 838590 - RNA, 19 nt, Homo sapiens
gcaacacuccacagcagaa

SEQ ID NO: 838591 - RNA, 19 nt, Homo sapiens
aaucacagccuggaguaua

SEQ ID NO: 838592 - RNA, 19 nt, Homo sapiens
gguuucggcauccuucuua

SEQ ID NO: 838593 - RNA, 19 nt, Homo sapiens
uuacagcuggcuccaauuu

SEQ ID NO: 838594 - RNA, 19 nt, Homo sapiens
agaagaacaaugucaaaug

SEQ ID NO: 838595 - RNA, 19 nt, Homo sapiens
guaaguuggcuuugaguca

SEQ ID NO: 838596 - RNA, 19 nt, Homo sapiens
cgcuuuaaccucuuuauuu

SEQ ID NO: 838597 - RNA, 19 nt, Homo sapiens
ucacucuucuggaauguca

SEQ ID NO: 838598 - RNA, 19 nt, Homo sapiens
ccacgggccugccuuucau

SEQ ID NO: 838599 - RNA, 19 nt, Homo sapiens
ugauuauucuuuccaguuc

SEQ ID NO: 838600 - RNA, 19 nt, Homo sapiens
ugucauuguuccacuauuc

SEQ ID NO: 838601 - RNA, 19 nt, Homo sapiens
gaggccagaguguaaguaa

SEQ ID NO: 838602 - RNA, 19 nt, Homo sapiens
uuaaggacaggauuuggua

SEQ ID NO: 838603 - RNA, 19 nt, Homo sapiens
caagaugaacuccuuaagg

SEQ ID NO: 838604 - RNA, 19 nt, Homo sapiens
gaagaaaucucacuaauuc

SEQ ID NO: 838605 - RNA, 19 nt, Homo sapiens
gaacaaagcuaccuggaaa

SEQ ID NO: 838606 - RNA, 19 nt, Homo sapiens
gaagaacaaugucaaaugu

SEQ ID NO: 838607 - RNA, 19 nt, Homo sapiens
gcagacauuugguuaauug

SEQ ID NO: 838608 - RNA, 19 nt, Homo sapiens
gaagaagugugaaugugaa

SEQ ID NO: 838609 - RNA, 19 nt, Homo sapiens
caacuaagauucagucagu

SEQ ID NO: 838610 - RNA, 19 nt, Homo sapiens
aaucauagcuacauaccua

SEQ ID NO: 838611 - RNA, 19 nt, Homo sapiens
gcaaaucacagcaauauuc

SEQ ID NO: 838612 - RNA, 19 nt, Homo sapiens
gaagaagaaaucucacuaa

SEQ ID NO: 838613 - RNA, 19 nt, Homo sapiens
gaaaauagguacugucaga

SEQ ID NO: 838614 - RNA, 19 nt, Homo sapiens
ugaaaucuguacuguauga

SEQ ID NO: 838615 - RNA, 19 nt, Homo sapiens
gaaugucacucaagaccaa

SEQ ID NO: 838616 - RNA, 19 nt, Homo sapiens
aggaguaccuggaguauaa

SEQ ID NO: 838617 - RNA, 19 nt, Homo sapiens
gcacuuucuuccugccuua

SEQ ID NO: 838618 - RNA, 19 nt, Homo sapiens
ggacugagaagaacaaugu

SEQ ID NO: 838619 - RNA, 19 nt, Homo sapiens
gcaugaacaucuauacaau

SEQ ID NO: 838620 - RNA, 19 nt, Homo sapiens
cgacaucaaugaaaucugu

SEQ ID NO: 838621 - RNA, 19 nt, Homo sapiens
gagaguaaguuggcuuuga

SEQ ID NO: 838622 - RNA, 19 nt, Homo sapiens
gcacaccacugucccuuca

SEQ ID NO: 838623 - RNA, 19 nt, Homo sapiens
gagcauauacaacuacaaa

SEQ ID NO: 838624 - RNA, 19 nt, Homo sapiens
gaguguaaguaaaggauaa

SEQ ID NO: 838625 - RNA, 19 nt, Homo sapiens
gugagacgcuggcuucauu

SEQ ID NO: 838626 - RNA, 19 nt, Homo sapiens
ccaagcagauugacucuca

SEQ ID NO: 838627 - RNA, 19 nt, Homo sapiens
gcuuuaaccucuuuauuuc

SEQ ID NO: 838628 - RNA, 19 nt, Homo sapiens
gaacagaagaagaagaaau

SEQ ID NO: 838629 - RNA, 19 nt, Homo sapiens
ucacagauacugauuauuc

SEQ ID NO: 838630 - RNA, 19 nt, Homo sapiens
gacaggauuugguaaguga

SEQ ID NO: 838631 - RNA, 19 nt, Homo sapiens
gcggcacgcugcuaaguuu

SEQ ID NO: 838632 - RNA, 19 nt, Homo sapiens
ggagcgacaucaaugaaau

SEQ ID NO: 838633 - RNA, 19 nt, Homo sapiens
ggagcagucuguccuuaug

SEQ ID NO: 838634 - RNA, 19 nt, Homo sapiens
uagcugcucuuucuucuug

SEQ ID NO: 838635 - RNA, 19 nt, Homo sapiens
ggccagaacugaagcagau

SEQ ID NO: 838636 - RNA, 19 nt, Homo sapiens
gaaucagguuaaugaggua

SEQ ID NO: 838637 - RNA, 19 nt, Homo sapiens
gguuagaguucacacuuga

SEQ ID NO: 838638 - RNA, 19 nt, Homo sapiens
ggacaggauuugguaagug

SEQ ID NO: 838639 - RNA, 19 nt, Homo sapiens
gaagugcugcucuccguuu

SEQ ID NO: 838640 - RNA, 19 nt, Homo sapiens
caaaggagcaucaguuucu

SEQ ID NO: 838641 - RNA, 19 nt, Homo sapiens
gggcagacauuugguuaau

SEQ ID NO: 838642 - RNA, 19 nt, Homo sapiens
aaagggauuugagcauaua

SEQ ID NO: 838643 - RNA, 19 nt, Homo sapiens
uaccauagcuuauauucuc

SEQ ID NO: 838644 - RNA, 19 nt, Homo sapiens
aagaagugcuuacugaaug

SEQ ID NO: 838645 - RNA, 19 nt, Homo sapiens
caucccuucuguucauuua

SEQ ID NO: 838646 - RNA, 19 nt, Homo sapiens
ggaaacagcauagagugaa

SEQ ID NO: 838647 - RNA, 19 nt, Homo sapiens
acagcgcccuccagaguua

SEQ ID NO: 838648 - RNA, 19 nt, Homo sapiens
ucacagggcugcugauggu

SEQ ID NO: 838649 - RNA, 19 nt, Homo sapiens
ggucucagcuccuguuguc

SEQ ID NO: 838650 - RNA, 19 nt, Homo sapiens
gaaacagcauagagugaag

SEQ ID NO: 838651 - RNA, 19 nt, Homo sapiens
gagcaucaguuucuuuuga

SEQ ID NO: 838652 - RNA, 19 nt, Homo sapiens
gggcaaaucacagcaauau

SEQ ID NO: 838653 - RNA, 19 nt, Homo sapiens
gcuuacggguucauugauu

SEQ ID NO: 838654 - RNA, 19 nt, Homo sapiens
ucaaugaaaucuguacugu

SEQ ID NO: 838655 - RNA, 19 nt, Homo sapiens
gcauauacaacuacaaauc

SEQ ID NO: 838656 - RNA, 19 nt, Homo sapiens
gagaggaguaccuggagua

SEQ ID NO: 838657 - RNA, 19 nt, Homo sapiens
uccaagaagugcuuacuga

SEQ ID NO: 838658 - RNA, 19 nt, Homo sapiens
gcauuuacaaccuuucauu

SEQ ID NO: 838659 - RNA, 19 nt, Homo sapiens
gaggagccacuaaaccuuu

SEQ ID NO: 838660 - RNA, 19 nt, Homo sapiens
gugcguggccuuaaacauu

SEQ ID NO: 838661 - RNA, 19 nt, Homo sapiens
auaaguagcaguacacauu

SEQ ID NO: 838662 - RNA, 19 nt, Homo sapiens
uacaguagcugcucuuucu

SEQ ID NO: 838663 - RNA, 19 nt, Homo sapiens
agucugaccuggauaugaa

SEQ ID NO: 838664 - RNA, 19 nt, Homo sapiens
cagccaagaugaacuccuu

SEQ ID NO: 838665 - RNA, 19 nt, Homo sapiens
cauugucccucaugucauu

SEQ ID NO: 838666 - RNA, 19 nt, Homo sapiens
ccucuuagcaggacagaaa

SEQ ID NO: 838667 - RNA, 19 nt, Homo sapiens
caagaagugcuuacugaau

SEQ ID NO: 838668 - RNA, 19 nt, Homo sapiens
gcaaguaagccuagauaac

SEQ ID NO: 838669 - RNA, 19 nt, Homo sapiens
ccacauggauuuucuuaau

SEQ ID NO: 838670 - RNA, 19 nt, Homo sapiens
ugaagaagugugaauguga

SEQ ID NO: 838671 - RNA, 19 nt, Homo sapiens
caaguaagccuagauaacu

SEQ ID NO: 838672 - RNA, 19 nt, Homo sapiens
cagcaaguaagccuagaua

SEQ ID NO: 838673 - RNA, 19 nt, Homo sapiens
acacaucgaagcuuuaaga

SEQ ID NO: 838674 - RNA, 19 nt, Homo sapiens
ccagaacugaagcagauua

SEQ ID NO: 838675 - RNA, 19 nt, Homo sapiens
guacaugugcucccuguca

SEQ ID NO: 838676 - RNA, 19 nt, Homo sapiens
uggagaaucagguuaauga

SEQ ID NO: 838677 - RNA, 19 nt, Homo sapiens
gugcugcucuccguuuauu

SEQ ID NO: 838678 - RNA, 19 nt, Homo sapiens
ccuuaaacauugagaagug

SEQ ID NO: 838679 - RNA, 19 nt, Homo sapiens
gcaaggagaggaacugaac

SEQ ID NO: 838680 - RNA, 19 nt, Homo sapiens
guagugguuuggcaagguu

SEQ ID NO: 838681 - RNA, 19 nt, Homo sapiens
gagaagaacaaugucaaau

SEQ ID NO: 838682 - RNA, 19 nt, Homo sapiens
agucacacaucgaagcuuu

SEQ ID NO: 838683 - RNA, 19 nt, Homo sapiens
acagcuggcuccaauuuca

SEQ ID NO: 838684 - RNA, 19 nt, Homo sapiens
uagauuucauggcuuaaug

SEQ ID NO: 838685 - RNA, 19 nt, Homo sapiens
agaagaagaagaaaucuca

SEQ ID NO: 838686 - RNA, 19 nt, Homo sapiens
guuuacagcuggcuccaau

SEQ ID NO: 838687 - RNA, 19 nt, Homo sapiens
caaugaaaucuguacugua

SEQ ID NO: 838688 - RNA, 19 nt, Homo sapiens
gggauuugauucucauuuu

SEQ ID NO: 838689 - RNA, 19 nt, Homo sapiens
cagcuccuguugucaguga

SEQ ID NO: 838690 - RNA, 19 nt, Homo sapiens
gcaacacuccacagcagaa

SEQ ID NO: 838691 - RNA, 19 nt, Homo sapiens
gguuucggcauccuucuua

SEQ ID NO: 838692 - RNA, 19 nt, Homo sapiens
uuacagcuggcuccaauuu

SEQ ID NO: 838693 - RNA, 19 nt, Homo sapiens
aaucacagccuggaguaua

SEQ ID NO: 838694 - RNA, 19 nt, Homo sapiens
agaagaacaaugucaaaug

SEQ ID NO: 838695 - RNA, 19 nt, Homo sapiens
guaaguuggcuuugaguca

SEQ ID NO: 838696 - RNA, 19 nt, Homo sapiens
cgcuuuaaccucuuuauuu

SEQ ID NO: 838697 - RNA, 19 nt, Homo sapiens
ucacucuucuggaauguca

SEQ ID NO: 838698 - RNA, 19 nt, Homo sapiens
ccacgggccugccuuucau

SEQ ID NO: 838699 - RNA, 19 nt, Homo sapiens
ugauuauucuuuccaguuc

SEQ ID NO: 838700 - RNA, 19 nt, Homo sapiens
ugucauuguuccacuauuc

SEQ ID NO: 838701 - RNA, 19 nt, Homo sapiens
gaggccagaguguaaguaa

SEQ ID NO: 838702 - RNA, 19 nt, Homo sapiens
uuaaggacaggauuuggua

SEQ ID NO: 838703 - RNA, 19 nt, Homo sapiens
caagaugaacuccuuaagg

SEQ ID NO: 838704 - RNA, 19 nt, Homo sapiens
ggacauggccgaccuagaa

SEQ ID NO: 838705 - RNA, 19 nt, Homo sapiens
acaagaaucuagaagcaaa

SEQ ID NO: 838706 - RNA, 19 nt, Homo sapiens
ggccauaccucuucuccaa

SEQ ID NO: 838707 - RNA, 19 nt, Homo sapiens
ccacaagaaucuagaagca

SEQ ID NO: 838708 - RNA, 19 nt, Homo sapiens
acccagagguuccguagua

SEQ ID NO: 838709 - RNA, 19 nt, Homo sapiens
caaaggagguuuucgauca

SEQ ID NO: 838710 - RNA, 19 nt, Homo sapiens
gcugagggcugugagaaug

SEQ ID NO: 838711 - RNA, 19 nt, Homo sapiens
gugagaaugugaaacaaca

SEQ ID NO: 838712 - RNA, 19 nt, Homo sapiens
gcauagcgaggaagacauu

SEQ ID NO: 838713 - RNA, 19 nt, Homo sapiens
gaaccaugccuccaucauc

SEQ ID NO: 838714 - RNA, 19 nt, Homo sapiens
gcugcuggcuucacuaucu

SEQ ID NO: 838715 - RNA, 19 nt, Homo sapiens
gagguuccguaguaagaug

SEQ ID NO: 838716 - RNA, 19 nt, Homo sapiens
uaacuucugugccaacaac

SEQ ID NO: 838717 - RNA, 19 nt, Homo sapiens
gaacccagagcauccacaa

SEQ ID NO: 838718 - RNA, 19 nt, Homo sapiens
ggagcuggcacuuggaaga

SEQ ID NO: 838719 - RNA, 19 nt, Homo sapiens
ccauaccucuucuccaaca

SEQ ID NO: 838720 - RNA, 19 nt, Homo sapiens
gcugugagaaugugaaaca

SEQ ID NO: 838721 - RNA, 19 nt, Homo sapiens
uaacaccauuguccagucu

SEQ ID NO: 838722 - RNA, 19 nt, Homo sapiens
gaaugugaaacaacagugu

SEQ ID NO: 838723 - RNA, 19 nt, Homo sapiens
cggaugacaugcugaagag

SEQ ID NO: 838724 - RNA, 19 nt, Homo sapiens
gugcaaggcccacaaguac

SEQ ID NO: 838725 - RNA, 19 nt, Homo sapiens
gugaaacaacagugugaaa

SEQ ID NO: 838726 - RNA, 19 nt, Homo sapiens
gcggaugacaugcugaaga

SEQ ID NO: 838727 - RNA, 19 nt, Homo sapiens
gaaacaacagugugaaaau

SEQ ID NO: 838728 - RNA, 19 nt, Homo sapiens
gcccugagcucuggguaag

SEQ ID NO: 838729 - RNA, 19 nt, Homo sapiens
cagagguuccguaguaaga

SEQ ID NO: 838730 - RNA, 19 nt, Homo sapiens
ggcccuagaucugcugaug

SEQ ID NO: 838731 - RNA, 19 nt, Homo sapiens
gagcauccacaagaaucua

SEQ ID NO: 838732 - RNA, 19 nt, Homo sapiens
cccagagcauccacaagaa

SEQ ID NO: 838733 - RNA, 19 nt, Homo sapiens
ccugagcucuggguaagga

SEQ ID NO: 838734 - RNA, 19 nt, Homo sapiens
gaugagcugcuggguguga

SEQ ID NO: 838735 - RNA, 19 nt, Homo sapiens
ccucagcucgguccgcuuu

SEQ ID NO: 838736 - RNA, 19 nt, Homo sapiens
gagaaugugaaacaacagu

SEQ ID NO: 838737 - RNA, 19 nt, Homo sapiens
ccucucgcauggcggauga

SEQ ID NO: 838738 - RNA, 19 nt, Homo sapiens
acaccauuguccagucuau

SEQ ID NO: 838739 - RNA, 19 nt, Homo sapiens
gagaggcaucuuugucauc

SEQ ID NO: 838740 - RNA, 19 nt, Homo sapiens
ugcaggcucuggaggaguu

SEQ ID NO: 838741 - RNA, 19 nt, Homo sapiens
cccagagguuccguaguaa

SEQ ID NO: 838742 - RNA, 19 nt, Homo sapiens
gauauggugcccuggucuu

SEQ ID NO: 838743 - RNA, 19 nt, Homo sapiens
ucagcucgguccgcuuuau

SEQ ID NO: 838744 - RNA, 19 nt, Homo sapiens
ccagagcauccacaagaau

SEQ ID NO: 838745 - RNA, 19 nt, Homo sapiens
gcaggaggcccagaagcau

SEQ ID NO: 838746 - RNA, 19 nt, Homo sapiens
cguggaggccuucguggaa

SEQ ID NO: 838747 - RNA, 19 nt, Homo sapiens
acccagagcauccacaaga

SEQ ID NO: 838748 - RNA, 19 nt, Homo sapiens
agagaggcaucuuugucau

SEQ ID NO: 838749 - RNA, 19 nt, Homo sapiens
gaagagugagcgggucauc

SEQ ID NO: 838750 - RNA, 19 nt, Homo sapiens
cagagcauccacaagaauc

SEQ ID NO: 838751 - RNA, 19 nt, Homo sapiens
gcccacaaguaccgcuauc

SEQ ID NO: 838752 - RNA, 19 nt, Homo sapiens
gggcugugagaaugugaaa

SEQ ID NO: 838753 - RNA, 19 nt, Homo sapiens
ggucuucccugcucgauuu

SEQ ID NO: 838754 - RNA, 19 nt, Homo sapiens
gaaagggacgcaucgagua

SEQ ID NO: 838755 - RNA, 19 nt, Homo sapiens
acaggaaagugaaagaauu

SEQ ID NO: 838756 - RNA, 19 nt, Homo sapiens
caggaaagugaaagaauua

SEQ ID NO: 838757 - RNA, 19 nt, Homo sapiens
acacagauccgccacauga

SEQ ID NO: 838758 - RNA, 19 nt, Homo sapiens
ucgaguaccuggugaaaug

SEQ ID NO: 838759 - RNA, 19 nt, Homo sapiens
guaaagaaguuguguuuuc

SEQ ID NO: 838760 - RNA, 19 nt, Homo sapiens
ccugagaguucgugucauu

SEQ ID NO: 838761 - RNA, 19 nt, Homo sapiens
ucagaacccuagcgccuuu

SEQ ID NO: 838762 - RNA, 19 nt, Homo sapiens
uuacagguguuuccagaga

SEQ ID NO: 838763 - RNA, 19 nt, Homo sapiens
ggacgaggccuaaguagac

SEQ ID NO: 838764 - RNA, 19 nt, Homo sapiens
gaccuucacuucacaucau

SEQ ID NO: 838765 - RNA, 19 nt, Homo sapiens
ccaccugucucucuagcuu

SEQ ID NO: 838766 - RNA, 19 nt, Homo sapiens
gaugugcauuucucuguca

SEQ ID NO: 838767 - RNA, 19 nt, Homo sapiens
gcugguauuucuccucugu

SEQ ID NO: 838768 - RNA, 19 nt, Homo sapiens
guacacagauccgccacau

SEQ ID NO: 838769 - RNA, 19 nt, Homo sapiens
ggccgaauccaucaucaaa

SEQ ID NO: 838770 - RNA, 19 nt, Homo sapiens
ccacggaggcuuucucaca

SEQ ID NO: 838771 - RNA, 19 nt, Homo sapiens
ggaaccgcaucauccugaa

SEQ ID NO: 838772 - RNA, 19 nt, Homo sapiens
ccagagaccauagaaaugu

SEQ ID NO: 838773 - RNA, 19 nt, Homo sapiens
acgagaaccugccguggaa

SEQ ID NO: 838774 - RNA, 19 nt, Homo sapiens
caucccaccugucucucua

SEQ ID NO: 838775 - RNA, 19 nt, Homo sapiens
gcuugggucuggagguuug

SEQ ID NO: 838776 - RNA, 19 nt, Homo sapiens
ucaccgaugucaccagcaa

SEQ ID NO: 838777 - RNA, 19 nt, Homo sapiens
gcucauugcagccuucgaa

SEQ ID NO: 838778 - RNA, 19 nt, Homo sapiens
gcaggaggccgaucagaac

SEQ ID NO: 838779 - RNA, 19 nt, Homo sapiens
guccguggguucauacaug

SEQ ID NO: 838780 - RNA, 19 nt, Homo sapiens
ucaaacggcggauccgaaa

SEQ ID NO: 838781 - RNA, 19 nt, Homo sapiens
gagguuugcuguggaaguc

SEQ ID NO: 838782 - RNA, 19 nt, Homo sapiens
ggaaagugaaagaauuagu

SEQ ID NO: 838783 - RNA, 19 nt, Homo sapiens
gacaggaaagugaaagaau

SEQ ID NO: 838784 - RNA, 19 nt, Homo sapiens
gguguuggucccagaauug

SEQ ID NO: 838785 - RNA, 19 nt, Homo sapiens
gcaucauccugaaccugaa

SEQ ID NO: 838786 - RNA, 19 nt, Homo sapiens
gagggagcgugagcuguau

SEQ ID NO: 838787 - RNA, 19 nt, Homo sapiens
agagggagcgugagcugua

SEQ ID NO: 838788 - RNA, 19 nt, Homo sapiens
ggcaggaggccgaucagaa

SEQ ID NO: 838789 - RNA, 19 nt, Homo sapiens
ggguguuggucccagaauu

SEQ ID NO: 838790 - RNA, 19 nt, Homo sapiens
gaaccugccguggaaacuu

SEQ ID NO: 838791 - RNA, 19 nt, Homo sapiens
aggcagaggccaaggauga

SEQ ID NO: 838792 - RNA, 19 nt, Homo sapiens
ggcaagagcaagaaguuca

SEQ ID NO: 838793 - RNA, 19 nt, Homo sapiens
gggaggaugcugaagaauc

SEQ ID NO: 838794 - RNA, 19 nt, Homo sapiens
auacaugcauugggugcua

SEQ ID NO: 838795 - RNA, 19 nt, Homo sapiens
ucagugaugugcauuucuc

SEQ ID NO: 838796 - RNA, 19 nt, Homo sapiens
cagagaccauagaaaugug

SEQ ID NO: 838797 - RNA, 19 nt, Homo sapiens
guggcacccuuuacaguuc

SEQ ID NO: 838798 - RNA, 19 nt, Homo sapiens
gaugucacccugcuccaau

SEQ ID NO: 838799 - RNA, 19 nt, Homo sapiens
ggugggcgaucaaguacag

SEQ ID NO: 838800 - RNA, 19 nt, Homo sapiens
cagccugccugaagcaaag

SEQ ID NO: 838801 - RNA, 19 nt, Homo sapiens
ccuccugcccgaagucaua

SEQ ID NO: 838802 - RNA, 19 nt, Homo sapiens
cuacaccacaguccucuga

SEQ ID NO: 838803 - RNA, 19 nt, Homo sapiens
guauuucuccucuguccuu

SEQ ID NO: 838804 - RNA, 19 nt, Homo sapiens
gccagggcaucagaaguug

SEQ ID NO: 838805 - RNA, 19 nt, Homo sapiens
gagggcuuccugccuguuu

SEQ ID NO: 838806 - RNA, 19 nt, Homo sapiens
uggaaagcccuagaaacua

SEQ ID NO: 838807 - RNA, 19 nt, Homo sapiens
ggaccuucacuucacauca

SEQ ID NO: 838808 - RNA, 19 nt, Homo sapiens
cauugcagccuucgaacaa

SEQ ID NO: 838809 - RNA, 19 nt, Homo sapiens
ccacaucccaccugucucu

SEQ ID NO: 838810 - RNA, 19 nt, Homo sapiens
gacccaaacccaaaacuuu

SEQ ID NO: 838811 - RNA, 19 nt, Homo sapiens
ugacaggaaagugaaagaa

SEQ ID NO: 838812 - RNA, 19 nt, Homo sapiens
gcccgaagucauacucuug

SEQ ID NO: 838813 - RNA, 19 nt, Homo sapiens
cugcaacccugaggauuuc

SEQ ID NO: 838814 - RNA, 19 nt, Homo sapiens
ucugcaacccugaggauuu

SEQ ID NO: 838815 - RNA, 19 nt, Homo sapiens
guuauaggcaagagcaaga

SEQ ID NO: 838816 - RNA, 19 nt, Homo sapiens
ccgaauccaucaucaaacg

SEQ ID NO: 838817 - RNA, 19 nt, Homo sapiens
guuuguccguggguucaua

SEQ ID NO: 838818 - RNA, 19 nt, Homo sapiens
cuucaguucuugaccaaag

SEQ ID NO: 838819 - RNA, 19 nt, Homo sapiens
ucugauuucucggugcuaa

SEQ ID NO: 838820 - RNA, 19 nt, Homo sapiens
ccugugcggcgucugauuu

SEQ ID NO: 838821 - RNA, 19 nt, Homo sapiens
ggauggggcuggguaguug

SEQ ID NO: 838822 - RNA, 19 nt, Homo sapiens
ccuuuacaguuccuuugaa

SEQ ID NO: 838823 - RNA, 19 nt, Homo sapiens
uuucagaggugauuuuaug

SEQ ID NO: 838824 - RNA, 19 nt, Homo sapiens
gagaguucgugucauucgu

SEQ ID NO: 838825 - RNA, 19 nt, Homo sapiens
ccaaaggugcuacgagaac

SEQ ID NO: 838826 - RNA, 19 nt, Homo sapiens
cuggaaagcccuagaaacu

SEQ ID NO: 838827 - RNA, 19 nt, Homo sapiens
gagacggugcgcaucauca

SEQ ID NO: 838828 - RNA, 19 nt, Homo sapiens
ccaggagaaugaggguguu

SEQ ID NO: 838829 - RNA, 19 nt, Homo sapiens
gaccacggaggcuuucuca

SEQ ID NO: 838830 - RNA, 19 nt, Homo sapiens
ccuagcgccuuugguccua

SEQ ID NO: 838831 - RNA, 19 nt, Homo sapiens
ccaaaacuuuccuccugaa

SEQ ID NO: 838832 - RNA, 19 nt, Homo sapiens
caucagccagggcaucaga

SEQ ID NO: 838833 - RNA, 19 nt, Homo sapiens
uaggcaagagcaagaaguu

SEQ ID NO: 838834 - RNA, 19 nt, Homo sapiens
cuugggagcccgaggagaa

SEQ ID NO: 838835 - RNA, 19 nt, Homo sapiens
gugaugugcauuucucugu

SEQ ID NO: 838836 - RNA, 19 nt, Homo sapiens
cgccuuugguccuaagaau

SEQ ID NO: 838837 - RNA, 19 nt, Homo sapiens
ggagaaugaggguguuggu

SEQ ID NO: 838838 - RNA, 19 nt, Homo sapiens
gcuccucccuccacaucag

SEQ ID NO: 838839 - RNA, 19 nt, Homo sapiens
uuccagagaccauagaaau

SEQ ID NO: 838840 - RNA, 19 nt, Homo sapiens
ucccuacccugcccugugu

SEQ ID NO: 838841 - RNA, 19 nt, Homo sapiens
aaccugccguggaaacuuc

SEQ ID NO: 838842 - RNA, 19 nt, Homo sapiens
caucgaguaccuggugaaa

SEQ ID NO: 838843 - RNA, 19 nt, Homo sapiens
gcacuggaguugucucuua

SEQ ID NO: 838844 - RNA, 19 nt, Homo sapiens
ggucaagugucucaucaua

SEQ ID NO: 838845 - RNA, 19 nt, Homo sapiens
ggugugagcuucucuguga

SEQ ID NO: 838846 - RNA, 19 nt, Homo sapiens
gagaagaccuugguuccua

SEQ ID NO: 838847 - RNA, 19 nt, Homo sapiens
ccacagggcuugaagugaa

SEQ ID NO: 838848 - RNA, 19 nt, Homo sapiens
guacauaaauugacaugag

SEQ ID NO: 838849 - RNA, 19 nt, Homo sapiens
ucaaucagcuagcaaguga

SEQ ID NO: 838850 - RNA, 19 nt, Homo sapiens
gagcaagacuccaucucaa

SEQ ID NO: 838851 - RNA, 19 nt, Homo sapiens
ccacagauuuggacaggaa

SEQ ID NO: 838852 - RNA, 19 nt, Homo sapiens
acaacacaguucuaaguua

SEQ ID NO: 838853 - RNA, 19 nt, Homo sapiens
ccagaugccuucaagauca

SEQ ID NO: 838854 - RNA, 19 nt, Homo sapiens
ggaggagcgucucaaguga

SEQ ID NO: 838855 - RNA, 19 nt, Homo sapiens
ccacuuagccugagacaug

SEQ ID NO: 838856 - RNA, 19 nt, Homo sapiens
gagccgagaucacgccauu

SEQ ID NO: 838857 - RNA, 19 nt, Homo sapiens
ccucaugcauggauuguaa

SEQ ID NO: 838858 - RNA, 19 nt, Homo sapiens
gcacugcacuggaguuguc

SEQ ID NO: 838859 - RNA, 19 nt, Homo sapiens
caacgagauuguacugcua

SEQ ID NO: 838860 - RNA, 19 nt, Homo sapiens
gaaagaggagucagacaug

SEQ ID NO: 838861 - RNA, 19 nt, Homo sapiens
gcaucuugcuugugagaaa

SEQ ID NO: 838862 - RNA, 19 nt, Homo sapiens
gcagugggaucucgaugga

SEQ ID NO: 838863 - RNA, 19 nt, Homo sapiens
gagcuucagcccuucuuua

SEQ ID NO: 838864 - RNA, 19 nt, Homo sapiens
ccauggagcugcugaucaa

SEQ ID NO: 838865 - RNA, 19 nt, Homo sapiens
ggagaaggauggggucuua

SEQ ID NO: 838866 - RNA, 19 nt, Homo sapiens
gagagugucagaaucuuaa

SEQ ID NO: 838867 - RNA, 19 nt, Homo sapiens
gcccagauuucaaaccaaa

SEQ ID NO: 838868 - RNA, 19 nt, Homo sapiens
gaggucagaugcuuuccaa

SEQ ID NO: 838869 - RNA, 19 nt, Homo sapiens
ggccaaagcccucauuuua

SEQ ID NO: 838870 - RNA, 19 nt, Homo sapiens
ggacucgccugcgcucauu

SEQ ID NO: 838871 - RNA, 19 nt, Homo sapiens
gccaagcccugcaccaguu

SEQ ID NO: 838872 - RNA, 19 nt, Homo sapiens
gcacagagaggugauguca

SEQ ID NO: 838873 - RNA, 19 nt, Homo sapiens
ggaaagaggagucagacau

SEQ ID NO: 838874 - RNA, 19 nt, Homo sapiens
guaagucccugcccucucu

SEQ ID NO: 838875 - RNA, 19 nt, Homo sapiens
ugagugagcaugucaaguu

SEQ ID NO: 838876 - RNA, 19 nt, Homo sapiens
caugacaccugaacaucuu

SEQ ID NO: 838877 - RNA, 19 nt, Homo sapiens
cugaacaucuuccuuuaug

SEQ ID NO: 838878 - RNA, 19 nt, Homo sapiens
gagugagcaugucaaguug

SEQ ID NO: 838879 - RNA, 19 nt, Homo sapiens
ccaaguccuuuaugcuuug

SEQ ID NO: 838880 - RNA, 19 nt, Homo sapiens
gaacaucuuccuuuaugca

SEQ ID NO: 838881 - RNA, 19 nt, Homo sapiens
ccucuuuccuccucucuuu

SEQ ID NO: 838882 - RNA, 19 nt, Homo sapiens
ccugagacaugaugcaaga

SEQ ID NO: 838883 - RNA, 19 nt, Homo sapiens
ccaagagagugucagaauc

SEQ ID NO: 838884 - RNA, 19 nt, Homo sapiens
gucauuugcucuccagauu

SEQ ID NO: 838885 - RNA, 19 nt, Homo sapiens
cagaugcuuuccaacauga

SEQ ID NO: 838886 - RNA, 19 nt, Homo sapiens
ugaguucagucuacaccua

SEQ ID NO: 838887 - RNA, 19 nt, Homo sapiens
caacaugacaccugaacau

SEQ ID NO: 838888 - RNA, 19 nt, Homo sapiens
caacagagcaagacuccau

SEQ ID NO: 838889 - RNA, 19 nt, Homo sapiens
gagacaggcagaucacuug

SEQ ID NO: 838890 - RNA, 19 nt, Homo sapiens
gggaggagcgucucaagug

SEQ ID NO: 838891 - RNA, 19 nt, Homo sapiens
ucaagugucucaucauacu

SEQ ID NO: 838892 - RNA, 19 nt, Homo sapiens
gaaaccccaucuucacuaa

SEQ ID NO: 838893 - RNA, 19 nt, Homo sapiens
gagcccagauuucaaacca

SEQ ID NO: 838894 - RNA, 19 nt, Homo sapiens
cccaaguccuuuaugcuuu

SEQ ID NO: 838895 - RNA, 19 nt, Homo sapiens
gguaacagccaaagacauc

SEQ ID NO: 838896 - RNA, 19 nt, Homo sapiens
caucagagguuagacuuac

SEQ ID NO: 838897 - RNA, 19 nt, Homo sapiens
ggucagaugcuuuccaaca

SEQ ID NO: 838898 - RNA, 19 nt, Homo sapiens
caagagagugucagaaucu

SEQ ID NO: 838899 - RNA, 19 nt, Homo sapiens
gauggccacugguauaguc

SEQ ID NO: 838900 - RNA, 19 nt, Homo sapiens
cacaagggauggccuaugg

SEQ ID NO: 838901 - RNA, 19 nt, Homo sapiens
ucagaugcuuuccaacaug

SEQ ID NO: 838902 - RNA, 19 nt, Homo sapiens
gcaucugacucccucuuca

SEQ ID NO: 838903 - RNA, 19 nt, Homo sapiens
gcaccacagcugcaucuug

SEQ ID NO: 838904 - RNA, 19 nt, Homo sapiens
ggucaggaguucgaaguca

SEQ ID NO: 838905 - RNA, 19 nt, Homo sapiens
aggguaggauuguguauga

SEQ ID NO: 838906 - RNA, 19 nt, Homo sapiens
ucacaacacaguucuaagu

SEQ ID NO: 838907 - RNA, 19 nt, Homo sapiens
ugagaccucugacguccaa

SEQ ID NO: 838908 - RNA, 19 nt, Homo sapiens
gcagaauucagaacuucaa

SEQ ID NO: 838909 - RNA, 19 nt, Homo sapiens
gcaacacccaaacaucuug

SEQ ID NO: 838910 - RNA, 19 nt, Homo sapiens
gaaauugcugcuucuccaa

SEQ ID NO: 838911 - RNA, 19 nt, Homo sapiens
gugaagaugagaccucuga

SEQ ID NO: 838912 - RNA, 19 nt, Homo sapiens
cgccaagcuugauguguuu

SEQ ID NO: 838913 - RNA, 19 nt, Homo sapiens
gagcagcccuaagguagag

SEQ ID NO: 838914 - RNA, 19 nt, Homo sapiens
gcccaucaacuguaucuga

SEQ ID NO: 838915 - RNA, 19 nt, Homo sapiens
ccaaagcccucauuuuaca

SEQ ID NO: 838916 - RNA, 19 nt, Homo sapiens
gcagaggcaggaaguggaa

SEQ ID NO: 838917 - RNA, 19 nt, Homo sapiens
cgauggagcccguguuugu

SEQ ID NO: 838918 - RNA, 19 nt, Homo sapiens
guacaaucccacuggaaga

SEQ ID NO: 838919 - RNA, 19 nt, Homo sapiens
caccugaacaucuuccuuu

SEQ ID NO: 838920 - RNA, 19 nt, Homo sapiens
gaagaccuuugaguucagu

SEQ ID NO: 838921 - RNA, 19 nt, Homo sapiens
ggcccucgcuuuggucauu

SEQ ID NO: 838922 - RNA, 19 nt, Homo sapiens
acgaggacaucagagguua

SEQ ID NO: 838923 - RNA, 19 nt, Homo sapiens
gucugacacugugacauua

SEQ ID NO: 838924 - RNA, 19 nt, Homo sapiens
aaaggaagcugagcaucuc

SEQ ID NO: 838925 - RNA, 19 nt, Homo sapiens
aaagggaacaggaacaaau

SEQ ID NO: 838926 - RNA, 19 nt, Homo sapiens
acgccaagcuugauguguu

SEQ ID NO: 838927 - RNA, 19 nt, Homo sapiens
aggaagggcucugagaaga

SEQ ID NO: 838928 - RNA, 19 nt, Homo sapiens
caccugggaccacagauuu

SEQ ID NO: 838929 - RNA, 19 nt, Homo sapiens
gcgcccagauccugcuuuc

SEQ ID NO: 838930 - RNA, 19 nt, Homo sapiens
gagcuucucugugauucca

SEQ ID NO: 838931 - RNA, 19 nt, Homo sapiens
gagggaaauugcugcuucu

SEQ ID NO: 838932 - RNA, 19 nt, Homo sapiens
caucauacuggcacuguug

SEQ ID NO: 838933 - RNA, 19 nt, Homo sapiens
caucuuccuuuaugcaaca

SEQ ID NO: 838934 - RNA, 19 nt, Homo sapiens
gaguucagucuacaccuaa

SEQ ID NO: 838935 - RNA, 19 nt, Homo sapiens
ugcccgagcucuacgcauu

SEQ ID NO: 838936 - RNA, 19 nt, Homo sapiens
ugugaucugugucaugguu

SEQ ID NO: 838937 - RNA, 19 nt, Homo sapiens
gggaacaggaacaaauuuc

SEQ ID NO: 838938 - RNA, 19 nt, Homo sapiens
gcuguguggccuucuguaa

SEQ ID NO: 838939 - RNA, 19 nt, Homo sapiens
ggugacauugcccaguuua

SEQ ID NO: 838940 - RNA, 19 nt, Homo sapiens
gcaccguccuguugaucuc

SEQ ID NO: 838941 - RNA, 19 nt, Homo sapiens
cggcagaauucagaacuuc

SEQ ID NO: 838942 - RNA, 19 nt, Homo sapiens
ggugacggcagaauucaga

SEQ ID NO: 838943 - RNA, 19 nt, Homo sapiens
gcacuggaguugucucuua

SEQ ID NO: 838944 - RNA, 19 nt, Homo sapiens
ggucaagugucucaucaua

SEQ ID NO: 838945 - RNA, 19 nt, Homo sapiens
ggugugagcuucucuguga

SEQ ID NO: 838946 - RNA, 19 nt, Homo sapiens
gagaagaccuugguuccua

SEQ ID NO: 838947 - RNA, 19 nt, Homo sapiens
ccacagggcuugaagugaa

SEQ ID NO: 838948 - RNA, 19 nt, Homo sapiens
guacauaaauugacaugag

SEQ ID NO: 838949 - RNA, 19 nt, Homo sapiens
ucaaucagcuagcaaguga

SEQ ID NO: 838950 - RNA, 19 nt, Homo sapiens
gagcaagacuccaucucaa

SEQ ID NO: 838951 - RNA, 19 nt, Homo sapiens
ccacagauuuggacaggaa

SEQ ID NO: 838952 - RNA, 19 nt, Homo sapiens
acaacacaguucuaaguua

SEQ ID NO: 838953 - RNA, 19 nt, Homo sapiens
ccagaugccuucaagauca

SEQ ID NO: 838954 - RNA, 19 nt, Homo sapiens
ggaggagcgucucaaguga

SEQ ID NO: 838955 - RNA, 19 nt, Homo sapiens
ccacuuagccugagacaug

SEQ ID NO: 838956 - RNA, 19 nt, Homo sapiens
gagccgagaucacgccauu

SEQ ID NO: 838957 - RNA, 19 nt, Homo sapiens
ccucaugcauggauuguaa

SEQ ID NO: 838958 - RNA, 19 nt, Homo sapiens
gcacugcacuggaguuguc

SEQ ID NO: 838959 - RNA, 19 nt, Homo sapiens
caacgagauuguacugcua

SEQ ID NO: 838960 - RNA, 19 nt, Homo sapiens
gaaagaggagucagacaug

SEQ ID NO: 838961 - RNA, 19 nt, Homo sapiens
gcaucuugcuugugagaaa

SEQ ID NO: 838962 - RNA, 19 nt, Homo sapiens
gcagugggaucucgaugga

SEQ ID NO: 838963 - RNA, 19 nt, Homo sapiens
gagcuucagcccuucuuua

SEQ ID NO: 838964 - RNA, 19 nt, Homo sapiens
ccauggagcugcugaucaa

SEQ ID NO: 838965 - RNA, 19 nt, Homo sapiens
ggagaaggauggggucuua

SEQ ID NO: 838966 - RNA, 19 nt, Homo sapiens
gagagugucagaaucuuaa

SEQ ID NO: 838967 - RNA, 19 nt, Homo sapiens
gcccagauuucaaaccaaa

SEQ ID NO: 838968 - RNA, 19 nt, Homo sapiens
gaggucagaugcuuuccaa

SEQ ID NO: 838969 - RNA, 19 nt, Homo sapiens
ggccaaagcccucauuuua

SEQ ID NO: 838970 - RNA, 19 nt, Homo sapiens
ggacucgccugcgcucauu

SEQ ID NO: 838971 - RNA, 19 nt, Homo sapiens
gccaagcccugcaccaguu

SEQ ID NO: 838972 - RNA, 19 nt, Homo sapiens
gcacagagaggugauguca

SEQ ID NO: 838973 - RNA, 19 nt, Homo sapiens
ggaaagaggagucagacau

SEQ ID NO: 838974 - RNA, 19 nt, Homo sapiens
guaagucccugcccucucu

SEQ ID NO: 838975 - RNA, 19 nt, Homo sapiens
ugagugagcaugucaaguu

SEQ ID NO: 838976 - RNA, 19 nt, Homo sapiens
caugacaccugaacaucuu

SEQ ID NO: 838977 - RNA, 19 nt, Homo sapiens
cugaacaucuuccuuuaug

SEQ ID NO: 838978 - RNA, 19 nt, Homo sapiens
gagugagcaugucaaguug

SEQ ID NO: 838979 - RNA, 19 nt, Homo sapiens
ccaaguccuuuaugcuuug

SEQ ID NO: 838980 - RNA, 19 nt, Homo sapiens
gaacaucuuccuuuaugca

SEQ ID NO: 838981 - RNA, 19 nt, Homo sapiens
ccucuuuccuccucucuuu

SEQ ID NO: 838982 - RNA, 19 nt, Homo sapiens
ccugagacaugaugcaaga

SEQ ID NO: 838983 - RNA, 19 nt, Homo sapiens
ccaagagagugucagaauc

SEQ ID NO: 838984 - RNA, 19 nt, Homo sapiens
gucauuugcucuccagauu

SEQ ID NO: 838985 - RNA, 19 nt, Homo sapiens
cagaugcuuuccaacauga

SEQ ID NO: 838986 - RNA, 19 nt, Homo sapiens
ugaguucagucuacaccua

SEQ ID NO: 838987 - RNA, 19 nt, Homo sapiens
caacaugacaccugaacau

SEQ ID NO: 838988 - RNA, 19 nt, Homo sapiens
caacagagcaagacuccau

SEQ ID NO: 838989 - RNA, 19 nt, Homo sapiens
gagacaggcagaucacuug

SEQ ID NO: 838990 - RNA, 19 nt, Homo sapiens
gggaggagcgucucaagug

SEQ ID NO: 838991 - RNA, 19 nt, Homo sapiens
ucaagugucucaucauacu

SEQ ID NO: 838992 - RNA, 19 nt, Homo sapiens
gaaaccccaucuucacuaa

SEQ ID NO: 838993 - RNA, 19 nt, Homo sapiens
gagcccagauuucaaacca

SEQ ID NO: 838994 - RNA, 19 nt, Homo sapiens
cccaaguccuuuaugcuuu

SEQ ID NO: 838995 - RNA, 19 nt, Homo sapiens
gguaacagccaaagacauc

SEQ ID NO: 838996 - RNA, 19 nt, Homo sapiens
caucagagguuagacuuac

SEQ ID NO: 838997 - RNA, 19 nt, Homo sapiens
ggucagaugcuuuccaaca

SEQ ID NO: 838998 - RNA, 19 nt, Homo sapiens
caagagagugucagaaucu

SEQ ID NO: 838999 - RNA, 19 nt, Homo sapiens
gauggccacugguauaguc

SEQ ID NO: 839000 - RNA, 19 nt, Homo sapiens
cacaagggauggccuaugg

SEQ ID NO: 839001 - RNA, 19 nt, Homo sapiens
ucagaugcuuuccaacaug

SEQ ID NO: 839002 - RNA, 19 nt, Homo sapiens
gcaucugacucccucuuca

SEQ ID NO: 839003 - RNA, 19 nt, Homo sapiens
gcaccacagcugcaucuug

SEQ ID NO: 839004 - RNA, 19 nt, Homo sapiens
ggucaggaguucgaaguca

SEQ ID NO: 839005 - RNA, 19 nt, Homo sapiens
aggguaggauuguguauga

SEQ ID NO: 839006 - RNA, 19 nt, Homo sapiens
ucacaacacaguucuaagu

SEQ ID NO: 839007 - RNA, 19 nt, Homo sapiens
ugagaccucugacguccaa

SEQ ID NO: 839008 - RNA, 19 nt, Homo sapiens
gcagaauucagaacuucaa

SEQ ID NO: 839009 - RNA, 19 nt, Homo sapiens
gcaacacccaaacaucuug

SEQ ID NO: 839010 - RNA, 19 nt, Homo sapiens
gaaauugcugcuucuccaa

SEQ ID NO: 839011 - RNA, 19 nt, Homo sapiens
gugaagaugagaccucuga

SEQ ID NO: 839012 - RNA, 19 nt, Homo sapiens
cgccaagcuugauguguuu

SEQ ID NO: 839013 - RNA, 19 nt, Homo sapiens
gagcagcccuaagguagag

SEQ ID NO: 839014 - RNA, 19 nt, Homo sapiens
gcccaucaacuguaucuga

SEQ ID NO: 839015 - RNA, 19 nt, Homo sapiens
ccaaagcccucauuuuaca

SEQ ID NO: 839016 - RNA, 19 nt, Homo sapiens
gcagaggcaggaaguggaa

SEQ ID NO: 839017 - RNA, 19 nt, Homo sapiens
cgauggagcccguguuugu

SEQ ID NO: 839018 - RNA, 19 nt, Homo sapiens
guacaaucccacuggaaga

SEQ ID NO: 839019 - RNA, 19 nt, Homo sapiens
caccugaacaucuuccuuu

SEQ ID NO: 839020 - RNA, 19 nt, Homo sapiens
gaagaccuuugaguucagu

SEQ ID NO: 839021 - RNA, 19 nt, Homo sapiens
ggcccucgcuuuggucauu

SEQ ID NO: 839022 - RNA, 19 nt, Homo sapiens
acgaggacaucagagguua

SEQ ID NO: 839023 - RNA, 19 nt, Homo sapiens
gucugacacugugacauua

SEQ ID NO: 839024 - RNA, 19 nt, Homo sapiens
aaaggaagcugagcaucuc

SEQ ID NO: 839025 - RNA, 19 nt, Homo sapiens
aaagggaacaggaacaaau

SEQ ID NO: 839026 - RNA, 19 nt, Homo sapiens
acgccaagcuugauguguu

SEQ ID NO: 839027 - RNA, 19 nt, Homo sapiens
aggaagggcucugagaaga

SEQ ID NO: 839028 - RNA, 19 nt, Homo sapiens
caccugggaccacagauuu

SEQ ID NO: 839029 - RNA, 19 nt, Homo sapiens
gcgcccagauccugcuuuc

SEQ ID NO: 839030 - RNA, 19 nt, Homo sapiens
gagcuucucugugauucca

SEQ ID NO: 839031 - RNA, 19 nt, Homo sapiens
gagggaaauugcugcuucu

SEQ ID NO: 839032 - RNA, 19 nt, Homo sapiens
caucauacuggcacuguug

SEQ ID NO: 839033 - RNA, 19 nt, Homo sapiens
caucuuccuuuaugcaaca

SEQ ID NO: 839034 - RNA, 19 nt, Homo sapiens
gaguucagucuacaccuaa

SEQ ID NO: 839035 - RNA, 19 nt, Homo sapiens
ugcccgagcucuacgcauu

SEQ ID NO: 839036 - RNA, 19 nt, Homo sapiens
ugugaucugugucaugguu

SEQ ID NO: 839037 - RNA, 19 nt, Homo sapiens
gggaacaggaacaaauuuc

SEQ ID NO: 839038 - RNA, 19 nt, Homo sapiens
gcuguguggccuucuguaa

SEQ ID NO: 839039 - RNA, 19 nt, Homo sapiens
ggugacauugcccaguuua

SEQ ID NO: 839040 - RNA, 19 nt, Homo sapiens
gcaccguccuguugaucuc

SEQ ID NO: 839041 - RNA, 19 nt, Homo sapiens
cggcagaauucagaacuuc

SEQ ID NO: 839042 - RNA, 19 nt, Homo sapiens
ggugacggcagaauucaga

SEQ ID NO: 839043 - RNA, 19 nt, Homo sapiens
gcccugagcuaauuucuga

SEQ ID NO: 839044 - RNA, 19 nt, Homo sapiens
gaaaguaacaagaggaaau

SEQ ID NO: 839045 - RNA, 19 nt, Homo sapiens
gggauggucucugucauuu

SEQ ID NO: 839046 - RNA, 19 nt, Homo sapiens
ggauugcccugagcuaauu

SEQ ID NO: 839047 - RNA, 19 nt, Homo sapiens
caaguggaauaucuacuga

SEQ ID NO: 839048 - RNA, 19 nt, Homo sapiens
cuaaugaaauggaaagaca

SEQ ID NO: 839049 - RNA, 19 nt, Homo sapiens
uggaauaucuacugaagug

SEQ ID NO: 839050 - RNA, 19 nt, Homo sapiens
agaugaagcugaccugguu

SEQ ID NO: 839051 - RNA, 19 nt, Homo sapiens
gauggucucugucauuucu

SEQ ID NO: 839052 - RNA, 19 nt, Homo sapiens
gggagaagucagaaaguaa

SEQ ID NO: 839053 - RNA, 19 nt, Homo sapiens
gaaggagggugaaaauaau

SEQ ID NO: 839054 - RNA, 19 nt, Homo sapiens
gaacagggcagacguuagc

SEQ ID NO: 839055 - RNA, 19 nt, Homo sapiens
gagagcagagcaaugauau

SEQ ID NO: 839056 - RNA, 19 nt, Homo sapiens
gcggacagcugacaguucu

SEQ ID NO: 839057 - RNA, 19 nt, Homo sapiens
gaaauggaaagacacagau

SEQ ID NO: 839058 - RNA, 19 nt, Homo sapiens
gaaagacacagaugaagcu

SEQ ID NO: 839059 - RNA, 19 nt, Homo sapiens
agagagagcagagcaauga

SEQ ID NO: 839060 - RNA, 19 nt, Homo sapiens
agauuccuguggugauuua

SEQ ID NO: 839061 - RNA, 19 nt, Homo sapiens
gaagcugaccugguucuug

SEQ ID NO: 839062 - RNA, 19 nt, Homo sapiens
guaacaagaggaaauccaa

SEQ ID NO: 839063 - RNA, 19 nt, Homo sapiens
agggagaagucagaaagua

SEQ ID NO: 839064 - RNA, 19 nt, Homo sapiens
gagaaagaaacagcaaaga

SEQ ID NO: 839065 - RNA, 19 nt, Homo sapiens
aggaguauguuguggagaa

SEQ ID NO: 839066 - RNA, 19 nt, Homo sapiens
gugaaauguccacaaauug

SEQ ID NO: 839067 - RNA, 19 nt, Homo sapiens
gaagucagaaaguaacaag

SEQ ID NO: 839068 - RNA, 19 nt, Homo sapiens
gcacaauacuugggaaccu

SEQ ID NO: 839069 - RNA, 19 nt, Homo sapiens
gaaacagcaaagagcuaaa

SEQ ID NO: 839070 - RNA, 19 nt, Homo sapiens
ugaaggagggugaaaauaa

SEQ ID NO: 839071 - RNA, 19 nt, Homo sapiens
caaaagaagcuaaugugaa

SEQ ID NO: 839072 - RNA, 19 nt, Homo sapiens
gcaaaagaagcuaauguga

SEQ ID NO: 839073 - RNA, 19 nt, Homo sapiens
gacguuagcgugagugauc

SEQ ID NO: 839074 - RNA, 19 nt, Homo sapiens
cugaggagcacaauacuug

SEQ ID NO: 839075 - RNA, 19 nt, Homo sapiens
cagaggaugaggaggagua

SEQ ID NO: 839076 - RNA, 19 nt, Homo sapiens
aaaaugugcuuaucacugu

SEQ ID NO: 839077 - RNA, 19 nt, Homo sapiens
ugaaauggaaagacacaga

SEQ ID NO: 839078 - RNA, 19 nt, Homo sapiens
gagcagagcaaugauaucg

SEQ ID NO: 839079 - RNA, 19 nt, Homo sapiens
agagagcagagcaaugaua

SEQ ID NO: 839080 - RNA, 19 nt, Homo sapiens
ggacaaguggaauaucuac

SEQ ID NO: 839081 - RNA, 19 nt, Homo sapiens
ggacagcugacaguucuuc

SEQ ID NO: 839082 - RNA, 19 nt, Homo sapiens
uuaagggacaaguggaaua

SEQ ID NO: 839083 - RNA, 19 nt, Homo sapiens
ucugucauuucucuuugua

SEQ ID NO: 839084 - RNA, 19 nt, Homo sapiens
agaaacagcaaagagcuaa

SEQ ID NO: 839085 - RNA, 19 nt, Homo sapiens
cagaaaguaacaagaggaa

SEQ ID NO: 839086 - RNA, 19 nt, Homo sapiens
ggagaagucagaaaguaac

SEQ ID NO: 839087 - RNA, 19 nt, Homo sapiens
cuagacaggcgcgugguua

SEQ ID NO: 839088 - RNA, 19 nt, Homo sapiens
ugucauuucucuuuguaca

SEQ ID NO: 839089 - RNA, 19 nt, Homo sapiens
gaagaugaaggagggugaa

SEQ ID NO: 839090 - RNA, 19 nt, Homo sapiens
aauaucuacugaaguggaa

SEQ ID NO: 839091 - RNA, 19 nt, Homo sapiens
gggacaaguggaauaucua

SEQ ID NO: 839092 - RNA, 19 nt, Homo sapiens
uaagggacaaguggaauau

SEQ ID NO: 839093 - RNA, 19 nt, Homo sapiens
gaugaggaggaguauguug

SEQ ID NO: 839094 - RNA, 19 nt, Homo sapiens
uauccuaaacacauccaua

SEQ ID NO: 839095 - RNA, 19 nt, Homo sapiens
ggugauuuaauguuccuaa

SEQ ID NO: 839096 - RNA, 19 nt, Homo sapiens
ucucaaacagugccgauga

SEQ ID NO: 839097 - RNA, 19 nt, Homo sapiens
cagcugacaguucuucuuc

SEQ ID NO: 839098 - RNA, 19 nt, Homo sapiens
agaaagaaacagcaaagag

SEQ ID NO: 839099 - RNA, 19 nt, Homo sapiens
aagaagcuaaugugaaaug

SEQ ID NO: 839100 - RNA, 19 nt, Homo sapiens
aaagagaaagaaacagcaa

SEQ ID NO: 839101 - RNA, 19 nt, Homo sapiens
gaagcuaaugugaaauguc

SEQ ID NO: 839102 - RNA, 19 nt, Homo sapiens
aacaagaggaaauccaauu

SEQ ID NO: 839103 - RNA, 19 nt, Homo sapiens
uaacaagaggaaauccaau

SEQ ID NO: 839104 - RNA, 19 nt, Homo sapiens
auaauaaacccagggagaa

SEQ ID NO: 839105 - RNA, 19 nt, Homo sapiens
ggaguauguuguggagaag

SEQ ID NO: 839106 - RNA, 19 nt, Homo sapiens
uagacaggcgcgugguuaa

SEQ ID NO: 839107 - RNA, 19 nt, Homo sapiens
ccagggagaagucagaaag

SEQ ID NO: 839108 - RNA, 19 nt, Homo sapiens
aguauaagaagaugaagga

SEQ ID NO: 839109 - RNA, 19 nt, Homo sapiens
ucucugucauuucucuuug

SEQ ID NO: 839110 - RNA, 19 nt, Homo sapiens
gguuaagggacaaguggaa

SEQ ID NO: 839111 - RNA, 19 nt, Homo sapiens
ggaacagggcagacguuag

SEQ ID NO: 839112 - RNA, 19 nt, Homo sapiens
gagaagucagaaaguaaca

SEQ ID NO: 839113 - RNA, 19 nt, Homo sapiens
ggaaaacaaagagaaagaa

SEQ ID NO: 839114 - RNA, 19 nt, Homo sapiens
aguggaauaucuacugaag

SEQ ID NO: 839115 - RNA, 19 nt, Homo sapiens
acaaguggaauaucuacug

SEQ ID NO: 839116 - RNA, 19 nt, Homo sapiens
aagaaacagcaaagagcua

SEQ ID NO: 839117 - RNA, 19 nt, Homo sapiens
agggacaaguggaauaucu

SEQ ID NO: 839118 - RNA, 19 nt, Homo sapiens
aaagagagagcagagcaau

SEQ ID NO: 839119 - RNA, 19 nt, Homo sapiens
ccuaaacacauccauaaaa

SEQ ID NO: 839120 - RNA, 19 nt, Homo sapiens
gauagcauuuuaugaagag

SEQ ID NO: 839121 - RNA, 19 nt, Homo sapiens
aauggaaagacacagauga

SEQ ID NO: 839122 - RNA, 19 nt, Homo sapiens
auccuaaacacauccauaa

SEQ ID NO: 839123 - RNA, 19 nt, Homo sapiens
ggaugaggaggaguauguu

SEQ ID NO: 839124 - RNA, 19 nt, Homo sapiens
agagaaagaaacagcaaag

SEQ ID NO: 839125 - RNA, 19 nt, Homo sapiens
gaucauagcuccucauuug

SEQ ID NO: 839126 - RNA, 19 nt, Homo sapiens
ggacacagaugcuaaauau

SEQ ID NO: 839127 - RNA, 19 nt, Homo sapiens
uaacauagcuaccauaaga

SEQ ID NO: 839128 - RNA, 19 nt, Homo sapiens
ggaaguaacugauggugaa

SEQ ID NO: 839129 - RNA, 19 nt, Homo sapiens
gaaauaaaccucagcagaa

SEQ ID NO: 839130 - RNA, 19 nt, Homo sapiens
gaaacgaaauacugaugua

SEQ ID NO: 839131 - RNA, 19 nt, Homo sapiens
caaagaauaugucugugua

SEQ ID NO: 839132 - RNA, 19 nt, Homo sapiens
ggaagaggauaaacugaaa

SEQ ID NO: 839133 - RNA, 19 nt, Homo sapiens
cagcaaaccuucaggauga

SEQ ID NO: 839134 - RNA, 19 nt, Homo sapiens
cgaaauagcggacaaauug

SEQ ID NO: 839135 - RNA, 19 nt, Homo sapiens
aaaccaagcucauucugua

SEQ ID NO: 839136 - RNA, 19 nt, Homo sapiens
aaagaaagauugccugcua

SEQ ID NO: 839137 - RNA, 19 nt, Homo sapiens
ggacaaagaacgagagaaa

SEQ ID NO: 839138 - RNA, 19 nt, Homo sapiens
ucaaguagguggcaggaua

SEQ ID NO: 839139 - RNA, 19 nt, Homo sapiens
gaaagagucuacaacuguu

SEQ ID NO: 839140 - RNA, 19 nt, Homo sapiens
ccaagcaacuucauaauca

SEQ ID NO: 839141 - RNA, 19 nt, Homo sapiens
ggagauaguugccggaaug

SEQ ID NO: 839142 - RNA, 19 nt, Homo sapiens
gaaaugauagcaacaagaa

SEQ ID NO: 839143 - RNA, 19 nt, Homo sapiens
ggagucagguuaaagaaga

SEQ ID NO: 839144 - RNA, 19 nt, Homo sapiens
gaacuuaagggacaaggua

SEQ ID NO: 839145 - RNA, 19 nt, Homo sapiens
aaacagacauaccauagaa

SEQ ID NO: 839146 - RNA, 19 nt, Homo sapiens
ugaaggaguuguuaaagaa

SEQ ID NO: 839147 - RNA, 19 nt, Homo sapiens
ggaugaagauggauuagau

SEQ ID NO: 839148 - RNA, 19 nt, Homo sapiens
guaagaaguuugcgacaga

SEQ ID NO: 839149 - RNA, 19 nt, Homo sapiens
ucacaagcaucaagguaua

SEQ ID NO: 839150 - RNA, 19 nt, Homo sapiens
ggaucaaacuuuaguacaa

SEQ ID NO: 839151 - RNA, 19 nt, Homo sapiens
gaagagacuuacagacuca

SEQ ID NO: 839152 - RNA, 19 nt, Homo sapiens
uaccaacggucccuaguua

SEQ ID NO: 839153 - RNA, 19 nt, Homo sapiens
ugaagcagguuaaagauau

SEQ ID NO: 839154 - RNA, 19 nt, Homo sapiens
gaaagaaccucaucauccu

SEQ ID NO: 839155 - RNA, 19 nt, Homo sapiens
gaacacccuugaaagaaau

SEQ ID NO: 839156 - RNA, 19 nt, Homo sapiens
gaaggaugaagauggauua

SEQ ID NO: 839157 - RNA, 19 nt, Homo sapiens
ucagugagaucuccaagaa

SEQ ID NO: 839158 - RNA, 19 nt, Homo sapiens
gcacuuaacagaacaaauc

SEQ ID NO: 839159 - RNA, 19 nt, Homo sapiens
gcuuuaaucugcacucauu

SEQ ID NO: 839160 - RNA, 19 nt, Homo sapiens
aaugugagcuguagugaaa

SEQ ID NO: 839161 - RNA, 19 nt, Homo sapiens
caacacagacagcaucuuu

SEQ ID NO: 839162 - RNA, 19 nt, Homo sapiens
gaaauacuagauccagaua

SEQ ID NO: 839163 - RNA, 19 nt, Homo sapiens
gagaugugaugacugguuu

SEQ ID NO: 839164 - RNA, 19 nt, Homo sapiens
gaagaugcggagucuaaua

SEQ ID NO: 839165 - RNA, 19 nt, Homo sapiens
ccaugaagaugaccauauu

SEQ ID NO: 839166 - RNA, 19 nt, Homo sapiens
caaguaaccaguucuguuu

SEQ ID NO: 839167 - RNA, 19 nt, Homo sapiens
gaaguugagucuaccuuuc

SEQ ID NO: 839168 - RNA, 19 nt, Homo sapiens
caaugaagcagaaaguaua

SEQ ID NO: 839169 - RNA, 19 nt, Homo sapiens
aaaccaagcuacaguugaa

SEQ ID NO: 839170 - RNA, 19 nt, Homo sapiens
gcccuuaacucauucuuug

SEQ ID NO: 839171 - RNA, 19 nt, Homo sapiens
ggaaaguaauaucuuggaa

SEQ ID NO: 839172 - RNA, 19 nt, Homo sapiens
gaagccagauaaaccuaaa

SEQ ID NO: 839173 - RNA, 19 nt, Homo sapiens
aaacacauguccaucagaa

SEQ ID NO: 839174 - RNA, 19 nt, Homo sapiens
gaaaacagauaauguggaa

SEQ ID NO: 839175 - RNA, 19 nt, Homo sapiens
ccauagaaaugauugagaa

SEQ ID NO: 839176 - RNA, 19 nt, Homo sapiens
gaacuagcuucuaaagagu

SEQ ID NO: 839177 - RNA, 19 nt, Homo sapiens
gaggauaaacugaaacuga

SEQ ID NO: 839178 - RNA, 19 nt, Homo sapiens
ggagagcacugaguuuaau

SEQ ID NO: 839179 - RNA, 19 nt, Homo sapiens
caucuugucuugaaaugaa

SEQ ID NO: 839180 - RNA, 19 nt, Homo sapiens
guaggaauguagacaagaa

SEQ ID NO: 839181 - RNA, 19 nt, Homo sapiens
gauaacauagcuaccauaa

SEQ ID NO: 839182 - RNA, 19 nt, Homo sapiens
ccagaaaggagucagguua

SEQ ID NO: 839183 - RNA, 19 nt, Homo sapiens
uaaagaaaguggcaaugau

SEQ ID NO: 839184 - RNA, 19 nt, Homo sapiens
guaggguccucuuccauuu

SEQ ID NO: 839185 - RNA, 19 nt, Homo sapiens
gagguugacucuaugucua

SEQ ID NO: 839186 - RNA, 19 nt, Homo sapiens
cagaaugaguccagaagaa

SEQ ID NO: 839187 - RNA, 19 nt, Homo sapiens
uaaauucuguguguuggua

SEQ ID NO: 839188 - RNA, 19 nt, Homo sapiens
ggacgaagucagccuguaa

SEQ ID NO: 839189 - RNA, 19 nt, Homo sapiens
gauaaccagacuucaaaua

SEQ ID NO: 839190 - RNA, 19 nt, Homo sapiens
gaaagugcaccaccaauag

SEQ ID NO: 839191 - RNA, 19 nt, Homo sapiens
caaggaaauuugugugguu

SEQ ID NO: 839192 - RNA, 19 nt, Homo sapiens
ccacauggcaacagguuua

SEQ ID NO: 839193 - RNA, 19 nt, Homo sapiens
gcaaagauggagauaguug

SEQ ID NO: 839194 - RNA, 19 nt, Homo sapiens
gaagucagccuguaacuac

SEQ ID NO: 839195 - RNA, 19 nt, Homo sapiens
ucaggaagaucaagagaau

SEQ ID NO: 839196 - RNA, 19 nt, Homo sapiens
uaccaaagccuauccagua

SEQ ID NO: 839197 - RNA, 19 nt, Homo sapiens
agaaacagccagucaagua

SEQ ID NO: 839198 - RNA, 19 nt, Homo sapiens
cgauaaggauccuaugcua

SEQ ID NO: 839199 - RNA, 19 nt, Homo sapiens
acaaaucaauguagaggaa

SEQ ID NO: 839200 - RNA, 19 nt, Homo sapiens
gauaucaccucagacaguu

SEQ ID NO: 839201 - RNA, 19 nt, Homo sapiens
ucagcagagugacaauuua

SEQ ID NO: 839202 - RNA, 19 nt, Homo sapiens
auacuuugcucuuugcaua

SEQ ID NO: 839203 - RNA, 19 nt, Homo sapiens
ugugccaucucaugaauua

SEQ ID NO: 839204 - RNA, 19 nt, Homo sapiens
aaagaaaguggcaaugaua

SEQ ID NO: 839205 - RNA, 19 nt, Homo sapiens
gcaauaaaggcuuagaaau

SEQ ID NO: 839206 - RNA, 19 nt, Homo sapiens
gcaacuggauaggccauuu

SEQ ID NO: 839207 - RNA, 19 nt, Homo sapiens
gacucuaugucuaaagaua

SEQ ID NO: 839208 - RNA, 19 nt, Homo sapiens
gcacaaacuggacauguau

SEQ ID NO: 839209 - RNA, 19 nt, Homo sapiens
gcagcaaaguaugaaguaa

SEQ ID NO: 839210 - RNA, 19 nt, Homo sapiens
ccacagaugcuccgaagaa

SEQ ID NO: 839211 - RNA, 19 nt, Homo sapiens
gacgcuggaucuucugaua

SEQ ID NO: 839212 - RNA, 19 nt, Homo sapiens
aaaugaagcuuugauggaa

SEQ ID NO: 839213 - RNA, 19 nt, Homo sapiens
gcaaguaaccaguucuguu

SEQ ID NO: 839214 - RNA, 19 nt, Homo sapiens
uacuuaagcuuguacauga

SEQ ID NO: 839215 - RNA, 19 nt, Homo sapiens
caucaucccuucuucauac

SEQ ID NO: 839216 - RNA, 19 nt, Homo sapiens
gaggaagggcacaaagaua

SEQ ID NO: 839217 - RNA, 19 nt, Homo sapiens
ucaaauaguucuccaugca

SEQ ID NO: 839218 - RNA, 19 nt, Homo sapiens
caccagauguuucuacaga

SEQ ID NO: 839219 - RNA, 19 nt, Homo sapiens
aaguauagcagaugcauua

SEQ ID NO: 839220 - RNA, 19 nt, Homo sapiens
ugaagugacugaauguaau

SEQ ID NO: 839221 - RNA, 19 nt, Homo sapiens
cagaacaaaucaauguaga

SEQ ID NO: 839222 - RNA, 19 nt, Homo sapiens
gaaauagaaacaucaguag

SEQ ID NO: 839223 - RNA, 19 nt, Homo sapiens
uaagucagcagaaauagaa

SEQ ID NO: 839224 - RNA, 19 nt, Homo sapiens
ugaaagugcaccaccaaua

SEQ ID NO: 839225 - RNA, 19 nt, Homo sapiens
gaacuugaaucaucuagga

SEQ ID NO: 839226 - RNA, 19 nt, Homo sapiens
guagcucucuguagcauua

SEQ ID NO: 839227 - RNA, 19 nt, Homo sapiens
cauaaugccuacuugauuu

SEQ ID NO: 839228 - RNA, 19 nt, Homo sapiens
gacaaugugcuuuauguua

SEQ ID NO: 839229 - RNA, 19 nt, Homo sapiens
gaacaauugugugcuuuau

SEQ ID NO: 839230 - RNA, 19 nt, Homo sapiens
uaagcuaccugccuucaaa

SEQ ID NO: 839231 - RNA, 19 nt, Homo sapiens
gaagaagaaaccaacagua

SEQ ID NO: 839232 - RNA, 19 nt, Homo sapiens
agaacaagcuacugaauca

SEQ ID NO: 839233 - RNA, 19 nt, Homo sapiens
ggagggaacauucugcuuu

SEQ ID NO: 839234 - RNA, 19 nt, Homo sapiens
ggcaaaagcuucuaucauu

SEQ ID NO: 839235 - RNA, 19 nt, Homo sapiens
ccuauuagaucugcaguuu

SEQ ID NO: 839236 - RNA, 19 nt, Homo sapiens
cuaaugauuuggagagaaa

SEQ ID NO: 839237 - RNA, 19 nt, Homo sapiens
gaaucagugucccuuuauu

SEQ ID NO: 839238 - RNA, 19 nt, Homo sapiens
gcaaaagcuucuaucauuu

SEQ ID NO: 839239 - RNA, 19 nt, Homo sapiens
gaaaccaacaguaacuaaa

SEQ ID NO: 839240 - RNA, 19 nt, Homo sapiens
uaucacagcuggcuuacug

SEQ ID NO: 839241 - RNA, 19 nt, Homo sapiens
uaaugaaucuggucagcuu

SEQ ID NO: 839242 - RNA, 19 nt, Homo sapiens
ggaacaauugugugcuuua

SEQ ID NO: 839243 - RNA, 19 nt, Homo sapiens
cccauaaccugaugacauu

SEQ ID NO: 839244 - RNA, 19 nt, Homo sapiens
ggaggauuauugcuaugaa

SEQ ID NO: 839245 - RNA, 19 nt, Homo sapiens
gagcuuaccuuuugaacuu

SEQ ID NO: 839246 - RNA, 19 nt, Homo sapiens
gaagaaaccaacaguaacu

SEQ ID NO: 839247 - RNA, 19 nt, Homo sapiens
aagaagaaaccaacaguaa

SEQ ID NO: 839248 - RNA, 19 nt, Homo sapiens
cagugucccuuuauuacua

SEQ ID NO: 839249 - RNA, 19 nt, Homo sapiens
aaacuggcauuauacugaa

SEQ ID NO: 839250 - RNA, 19 nt, Homo sapiens
ccacauuucccgccuguuu

SEQ ID NO: 839251 - RNA, 19 nt, Homo sapiens
gaagaacaagcuacugaau

SEQ ID NO: 839252 - RNA, 19 nt, Homo sapiens
agaguggccuguucuaaga

SEQ ID NO: 839253 - RNA, 19 nt, Homo sapiens
uagcuuuggucccaucuuu

SEQ ID NO: 839254 - RNA, 19 nt, Homo sapiens
agucugugcucuuugauuu

SEQ ID NO: 839255 - RNA, 19 nt, Homo sapiens
uguguuagcuguuagaauc

SEQ ID NO: 839256 - RNA, 19 nt, Homo sapiens
ccacauugcuggagcuuac

SEQ ID NO: 839257 - RNA, 19 nt, Homo sapiens
agacugacagguaauuaua

SEQ ID NO: 839258 - RNA, 19 nt, Homo sapiens
gguagugguuauuaguauu

SEQ ID NO: 839259 - RNA, 19 nt, Homo sapiens
caccagcugugaagaagaa

SEQ ID NO: 839260 - RNA, 19 nt, Homo sapiens
gaacucuacuuccagaaaa

SEQ ID NO: 839261 - RNA, 19 nt, Homo sapiens
gaagguggagggaacauuc

SEQ ID NO: 839262 - RNA, 19 nt, Homo sapiens
gcacauucauucucaucuc

SEQ ID NO: 839263 - RNA, 19 nt, Homo sapiens
aaucagugucccuuuauua

SEQ ID NO: 839264 - RNA, 19 nt, Homo sapiens
cagaagaacaagcuacuga

SEQ ID NO: 839265 - RNA, 19 nt, Homo sapiens
gaguuucaguggaaccaaa

SEQ ID NO: 839266 - RNA, 19 nt, Homo sapiens
gggcucauaauaaguuuaa

SEQ ID NO: 839267 - RNA, 19 nt, Homo sapiens
gaagcuggauuucaguacu

SEQ ID NO: 839268 - RNA, 19 nt, Homo sapiens
cuuacuggcuucaugcuuu

SEQ ID NO: 839269 - RNA, 19 nt, Homo sapiens
cgaaugcacuucuccaaaa

SEQ ID NO: 839270 - RNA, 19 nt, Homo sapiens
gcuaguggcgauaauuauu

SEQ ID NO: 839271 - RNA, 19 nt, Homo sapiens
acuauggcaucaaagauuu

SEQ ID NO: 839272 - RNA, 19 nt, Homo sapiens
gcagaguggccuguucuaa

SEQ ID NO: 839273 - RNA, 19 nt, Homo sapiens
aagacaaugugcuuuaugu

SEQ ID NO: 839274 - RNA, 19 nt, Homo sapiens
ggauuauugcuaugaauga

SEQ ID NO: 839275 - RNA, 19 nt, Homo sapiens
gaggauuauugcuaugaau

SEQ ID NO: 839276 - RNA, 19 nt, Homo sapiens
aaaggcagaucuucuaaaa

SEQ ID NO: 839277 - RNA, 19 nt, Homo sapiens
gcuuuggucccaucuuuaa

SEQ ID NO: 839278 - RNA, 19 nt, Homo sapiens
aaacauaaugccuacuuga

SEQ ID NO: 839279 - RNA, 19 nt, Homo sapiens
gcgaaugcacuucuccaaa

SEQ ID NO: 839280 - RNA, 19 nt, Homo sapiens
guggauaaauagucuuaca

SEQ ID NO: 839281 - RNA, 19 nt, Homo sapiens
uaaaaucaccggaacaauu

SEQ ID NO: 839282 - RNA, 19 nt, Homo sapiens
gagggaacauucugcuuuu

SEQ ID NO: 839283 - RNA, 19 nt, Homo sapiens
cuauaaaguuggaugucaa

SEQ ID NO: 839284 - RNA, 19 nt, Homo sapiens
acuggaaacuucaaugugu

SEQ ID NO: 839285 - RNA, 19 nt, Homo sapiens
guacuggaaacuucaaugu

SEQ ID NO: 839286 - RNA, 19 nt, Homo sapiens
cacagcaaguuuaaugaau

SEQ ID NO: 839287 - RNA, 19 nt, Homo sapiens
aaaaguugcagaccuauua

SEQ ID NO: 839288 - RNA, 19 nt, Homo sapiens
ggucccaucuuuaauugag

SEQ ID NO: 839289 - RNA, 19 nt, Homo sapiens
cuuucuagcuguuaaccua

SEQ ID NO: 839290 - RNA, 19 nt, Homo sapiens
gacagguaauuauauuugg

SEQ ID NO: 839291 - RNA, 19 nt, Homo sapiens
ucagugauacaauuucuug

SEQ ID NO: 839292 - RNA, 19 nt, Homo sapiens
ggaccaccaccauauuuua

SEQ ID NO: 839293 - RNA, 19 nt, Homo sapiens
uaaaggcagaucuucuaaa

SEQ ID NO: 839294 - RNA, 19 nt, Homo sapiens
cagcaaguuuaaugaaucu

SEQ ID NO: 839295 - RNA, 19 nt, Homo sapiens
uuauggaguuucaguggaa

SEQ ID NO: 839296 - RNA, 19 nt, Homo sapiens
acauaaugccuacuugauu

SEQ ID NO: 839297 - RNA, 19 nt, Homo sapiens
gcuauuguacgguuucaug

SEQ ID NO: 839298 - RNA, 19 nt, Homo sapiens
gaaaauggugugaauggaa

SEQ ID NO: 839299 - RNA, 19 nt, Homo sapiens
uucaauguguuagcuguua

SEQ ID NO: 839300 - RNA, 19 nt, Homo sapiens
acauaucacagcuggcuua

SEQ ID NO: 839301 - RNA, 19 nt, Homo sapiens
cuuagugcguucuaccuuu

SEQ ID NO: 839302 - RNA, 19 nt, Homo sapiens
acagcaaguuuaaugaauc

SEQ ID NO: 839303 - RNA, 19 nt, Homo sapiens
aggaaaaucugacauauag

SEQ ID NO: 839304 - RNA, 19 nt, Homo sapiens
uacaacacguggaguuuua

SEQ ID NO: 839305 - RNA, 19 nt, Homo sapiens
gguaacauggaaauacuau

SEQ ID NO: 839306 - RNA, 19 nt, Homo sapiens
cuaaaggcagaucuucuaa

SEQ ID NO: 839307 - RNA, 19 nt, Homo sapiens
acucaggcauuuaugaugu

SEQ ID NO: 839308 - RNA, 19 nt, Homo sapiens
gcacuucuccaaaacaaaa

SEQ ID NO: 839309 - RNA, 19 nt, Homo sapiens
agaaaccaacaguaacuaa

SEQ ID NO: 839310 - RNA, 19 nt, Homo sapiens
caagaguauauguuggaua

SEQ ID NO: 839311 - RNA, 19 nt, Homo sapiens
guagcauuauggaguuuca

SEQ ID NO: 839312 - RNA, 19 nt, Homo sapiens
ucagguggauaaauagucu

SEQ ID NO: 839313 - RNA, 19 nt, Homo sapiens
aaagacugacagguaauua

SEQ ID NO: 839314 - RNA, 19 nt, Homo sapiens
ccaccaccauauuuuauuu

SEQ ID NO: 839315 - RNA, 19 nt, Homo sapiens
acuaaaggcagaucuucua

SEQ ID NO: 839316 - RNA, 19 nt, Homo sapiens
ugauguggaaguucauuaa

SEQ ID NO: 839317 - RNA, 19 nt, Homo sapiens
uggaaacuucaauguguua

SEQ ID NO: 839318 - RNA, 19 nt, Homo sapiens
aaagauuuggcuacuguuu

SEQ ID NO: 839319 - RNA, 19 nt, Homo sapiens
agacccaacuaucuuaugg

SEQ ID NO: 839320 - RNA, 19 nt, Homo sapiens
uugcagaccuauuagaucu

SEQ ID NO: 839321 - RNA, 19 nt, Homo sapiens
ucuuauagcuacauuuggu

SEQ ID NO: 839322 - RNA, 19 nt, Homo sapiens
guaaacuggaaaucagaaa

SEQ ID NO: 839323 - RNA, 19 nt, Homo sapiens
cggaacaauugugugcuuu

SEQ ID NO: 839324 - RNA, 19 nt, Homo sapiens
gcaaugaaaaguaucagaa

SEQ ID NO: 839325 - RNA, 19 nt, Homo sapiens
gauaauugaugaccaguua

SEQ ID NO: 839326 - RNA, 19 nt, Homo sapiens
caagaaaggugauaauuga

SEQ ID NO: 839327 - RNA, 19 nt, Homo sapiens
gcacaagccuuaauuuaug

SEQ ID NO: 839328 - RNA, 19 nt, Homo sapiens
uaacagcccucauuauuug

SEQ ID NO: 839329 - RNA, 19 nt, Homo sapiens
gaauugcucuguucuuauu

SEQ ID NO: 839330 - RNA, 19 nt, Homo sapiens
gaaaggugauaauugauga

SEQ ID NO: 839331 - RNA, 19 nt, Homo sapiens
ugaaagaccucagucauuu

SEQ ID NO: 839332 - RNA, 19 nt, Homo sapiens
gcuaaucccuuccuugaaa

SEQ ID NO: 839333 - RNA, 19 nt, Homo sapiens
gaaguuaauuaccggcaua

SEQ ID NO: 839334 - RNA, 19 nt, Homo sapiens
cagaagaccucaccaacaa

SEQ ID NO: 839335 - RNA, 19 nt, Homo sapiens
gaauuaacagcccucauua

SEQ ID NO: 839336 - RNA, 19 nt, Homo sapiens
gcaaggaccugugaaagau

SEQ ID NO: 839337 - RNA, 19 nt, Homo sapiens
gaugaucucugccaguauu

SEQ ID NO: 839338 - RNA, 19 nt, Homo sapiens
gaaaauagacaacggaaua

SEQ ID NO: 839339 - RNA, 19 nt, Homo sapiens
ggauccaacuccaauauug

SEQ ID NO: 839340 - RNA, 19 nt, Homo sapiens
gaaagaccucagucauuua

SEQ ID NO: 839341 - RNA, 19 nt, Homo sapiens
uaacagacaaggaugauuu

SEQ ID NO: 839342 - RNA, 19 nt, Homo sapiens
ugaagaugcuauagaauug

SEQ ID NO: 839343 - RNA, 19 nt, Homo sapiens
caacuucagugauggagaa

SEQ ID NO: 839344 - RNA, 19 nt, Homo sapiens
caacauguauucacaguac

SEQ ID NO: 839345 - RNA, 19 nt, Homo sapiens
gggaugaucucugccagua

SEQ ID NO: 839346 - RNA, 19 nt, Homo sapiens
aaaggaagauacagugaaa

SEQ ID NO: 839347 - RNA, 19 nt, Homo sapiens
caacuggaaugaugacaga

SEQ ID NO: 839348 - RNA, 19 nt, Homo sapiens
ccaaugccuuucugugaua

SEQ ID NO: 839349 - RNA, 19 nt, Homo sapiens
auacacagcagaagaaaua

SEQ ID NO: 839350 - RNA, 19 nt, Homo sapiens
gauaaaguccugcaaaaua

SEQ ID NO: 839351 - RNA, 19 nt, Homo sapiens
gaaagaauugcuaugcauu

SEQ ID NO: 839352 - RNA, 19 nt, Homo sapiens
agaccucagucauuuauaa

SEQ ID NO: 839353 - RNA, 19 nt, Homo sapiens
gagcagaagcgcugaguga

SEQ ID NO: 839354 - RNA, 19 nt, Homo sapiens
caaagauuccuucaccaua

SEQ ID NO: 839355 - RNA, 19 nt, Homo sapiens
aaacagaacacaauccauu

SEQ ID NO: 839356 - RNA, 19 nt, Homo sapiens
gcgaauaaucgagaauuua

SEQ ID NO: 839357 - RNA, 19 nt, Homo sapiens
gaaaggaagauacagugaa

SEQ ID NO: 839358 - RNA, 19 nt, Homo sapiens
gcaauauagcguuggauuu

SEQ ID NO: 839359 - RNA, 19 nt, Homo sapiens
cauuagugguuucucaaua

SEQ ID NO: 839360 - RNA, 19 nt, Homo sapiens
ucaauggugucccaagaaa

SEQ ID NO: 839361 - RNA, 19 nt, Homo sapiens
gauuugagguuguaacagu

SEQ ID NO: 839362 - RNA, 19 nt, Homo sapiens
cgaauuaacagcccucauu

SEQ ID NO: 839363 - RNA, 19 nt, Homo sapiens
auacaagacugaugggaaa

SEQ ID NO: 839364 - RNA, 19 nt, Homo sapiens
caacaaaagugaauuaugg

SEQ ID NO: 839365 - RNA, 19 nt, Homo sapiens
gaugaccaguuaccuguug

SEQ ID NO: 839366 - RNA, 19 nt, Homo sapiens
ccaagaaaggugauaauug

SEQ ID NO: 839367 - RNA, 19 nt, Homo sapiens
cagugcagcuuaugaaaga

SEQ ID NO: 839368 - RNA, 19 nt, Homo sapiens
gcauaaagcagacaauagu

SEQ ID NO: 839369 - RNA, 19 nt, Homo sapiens
gaauauguuccuuucauga

SEQ ID NO: 839370 - RNA, 19 nt, Homo sapiens
gaucaagccuagaaaauau

SEQ ID NO: 839371 - RNA, 19 nt, Homo sapiens
ggaagcugcacaagccuua

SEQ ID NO: 839372 - RNA, 19 nt, Homo sapiens
ugacccaccuccauacauu

SEQ ID NO: 839373 - RNA, 19 nt, Homo sapiens
caaauaaggacgcaaaucu

SEQ ID NO: 839374 - RNA, 19 nt, Homo sapiens
ucugggaucuucaauauca

SEQ ID NO: 839375 - RNA, 19 nt, Homo sapiens
caauauagcguuggauuug

SEQ ID NO: 839376 - RNA, 19 nt, Homo sapiens
gaagauacagugaaaauga

SEQ ID NO: 839377 - RNA, 19 nt, Homo sapiens
gcagaacaaucagaaugga

SEQ ID NO: 839378 - RNA, 19 nt, Homo sapiens
ucagauagccaaacuuuca

SEQ ID NO: 839379 - RNA, 19 nt, Homo sapiens
gagauacacagcagaagaa

SEQ ID NO: 839380 - RNA, 19 nt, Homo sapiens
ugaaacugcugauaaaguc

SEQ ID NO: 839381 - RNA, 19 nt, Homo sapiens
gaacaaucagaauggaauu

SEQ ID NO: 839382 - RNA, 19 nt, Homo sapiens
ggaaaggaagauacaguga

SEQ ID NO: 839383 - RNA, 19 nt, Homo sapiens
gcgcuaaucccuuccuuga

SEQ ID NO: 839384 - RNA, 19 nt, Homo sapiens
uaucauuccuaguaccuuu

SEQ ID NO: 839385 - RNA, 19 nt, Homo sapiens
gcuggaggauguggaaauu

SEQ ID NO: 839386 - RNA, 19 nt, Homo sapiens
caucaguucuucaaauaag

SEQ ID NO: 839387 - RNA, 19 nt, Homo sapiens
cuucugggaucuucaauau

SEQ ID NO: 839388 - RNA, 19 nt, Homo sapiens
ucagagugcuggaggaugu

SEQ ID NO: 839389 - RNA, 19 nt, Homo sapiens
caaaacggauuaauggaaa

SEQ ID NO: 839390 - RNA, 19 nt, Homo sapiens
gcacccauaccuuuacauu

SEQ ID NO: 839391 - RNA, 19 nt, Homo sapiens
ccaguauuaugaugugauu

SEQ ID NO: 839392 - RNA, 19 nt, Homo sapiens
guagacacauaacagacaa

SEQ ID NO: 839393 - RNA, 19 nt, Homo sapiens
gcacaaggacagagauaca

SEQ ID NO: 839394 - RNA, 19 nt, Homo sapiens
gagaauuuaucacaauggu

SEQ ID NO: 839395 - RNA, 19 nt, Homo sapiens
gaaagucaugggaggauau

SEQ ID NO: 839396 - RNA, 19 nt, Homo sapiens
gaauguugaagaugcuaua

SEQ ID NO: 839397 - RNA, 19 nt, Homo sapiens
guaagcagaacaaucagaa

SEQ ID NO: 839398 - RNA, 19 nt, Homo sapiens
acaguaagcagaacaauca

SEQ ID NO: 839399 - RNA, 19 nt, Homo sapiens
caccauacaccuuaucaaa

SEQ ID NO: 839400 - RNA, 19 nt, Homo sapiens
uuaacagcccucauuauuu

SEQ ID NO: 839401 - RNA, 19 nt, Homo sapiens
ccgaacagcucagaaaaua

SEQ ID NO: 839402 - RNA, 19 nt, Homo sapiens
gaaccagaauacaauccau

SEQ ID NO: 839403 - RNA, 19 nt, Homo sapiens
uguugaagaugcuauagaa

SEQ ID NO: 839404 - RNA, 19 nt, Homo sapiens
ccgaggcgguguuuuauua

SEQ ID NO: 839405 - RNA, 19 nt, Homo sapiens
ggaaguauaugguaaaacu

SEQ ID NO: 839406 - RNA, 19 nt, Homo sapiens
ggcauaauuuacccucaaa

SEQ ID NO: 839407 - RNA, 19 nt, Homo sapiens
ccaaagccaccuccaguga

SEQ ID NO: 839408 - RNA, 19 nt, Homo sapiens
ccaaacaucaguucuucaa

SEQ ID NO: 839409 - RNA, 19 nt, Homo sapiens
aaagauuccuucaccauac

SEQ ID NO: 839410 - RNA, 19 nt, Homo sapiens
acccauaccuuuacauuag

SEQ ID NO: 839411 - RNA, 19 nt, Homo sapiens
ccuauagccuggccaacaa

SEQ ID NO: 839412 - RNA, 19 nt, Homo sapiens
gaacagcucagaaaauaga

SEQ ID NO: 839413 - RNA, 19 nt, Homo sapiens
gauccaacuccaauauuga

SEQ ID NO: 839414 - RNA, 19 nt, Homo sapiens
gaaguacucaggacaacau

SEQ ID NO: 839415 - RNA, 19 nt, Homo sapiens
gaagaaauagaaguacuca

SEQ ID NO: 839416 - RNA, 19 nt, Homo sapiens
ugagugagccuuugaccaa

SEQ ID NO: 839417 - RNA, 19 nt, Homo sapiens
cuauagaauuguacacaga

SEQ ID NO: 839418 - RNA, 19 nt, Homo sapiens
caaaucuucaggacaguaa

SEQ ID NO: 839419 - RNA, 19 nt, Homo sapiens
uguaacaguuucuacucua

SEQ ID NO: 839420 - RNA, 19 nt, Homo sapiens
gaaauuuccaagagacuca

SEQ ID NO: 839421 - RNA, 19 nt, Homo sapiens
cugcacaagccuuaauuua

SEQ ID NO: 839422 - RNA, 19 nt, Homo sapiens
caaacuuucaguaaggaua

SEQ ID NO: 839423 - RNA, 19 nt, Homo sapiens
cagaaagaauugcuaugca

SEQ ID NO: 839424 - RNA, 19 nt, Homo sapiens
caauauugaucuucaugca

SEQ ID NO: 839425 - RNA, 19 nt, Homo sapiens
gaaaagaucuucacacuuc

SEQ ID NO: 839426 - RNA, 19 nt, Homo sapiens
gcagauagacuuugcuguu

SEQ ID NO: 839427 - RNA, 19 nt, Homo sapiens
cccuggagcucccuaaaua

SEQ ID NO: 839428 - RNA, 19 nt, Homo sapiens
gaucuacccugcucacgau

SEQ ID NO: 839429 - RNA, 19 nt, Homo sapiens
gccuaaaccucagcagaua

SEQ ID NO: 839430 - RNA, 19 nt, Homo sapiens
ucugucaucucccgccuua

SEQ ID NO: 839431 - RNA, 19 nt, Homo sapiens
cagauagacuuugcuguuc

SEQ ID NO: 839432 - RNA, 19 nt, Homo sapiens
ccugugagcugcaccuuca

SEQ ID NO: 839433 - RNA, 19 nt, Homo sapiens
caggcugacuuacacauug

SEQ ID NO: 839434 - RNA, 19 nt, Homo sapiens
uaccauggguucacagugu

SEQ ID NO: 839435 - RNA, 19 nt, Homo sapiens
ucaccuucguccugaauga

SEQ ID NO: 839436 - RNA, 19 nt, Homo sapiens
ugccugaucucacuucugu

SEQ ID NO: 839437 - RNA, 19 nt, Homo sapiens
cacuggagaugcccuguug

SEQ ID NO: 839438 - RNA, 19 nt, Homo sapiens
augcucccauccacuauua

SEQ ID NO: 839439 - RNA, 19 nt, Homo sapiens
aaccugaacuugccuaaac

SEQ ID NO: 839440 - RNA, 19 nt, Homo sapiens
gauagacuuugcuguucca

SEQ ID NO: 839441 - RNA, 19 nt, Homo sapiens
gggaggccguucugaucga

SEQ ID NO: 839442 - RNA, 19 nt, Homo sapiens
guaccacucgguccaugaa

SEQ ID NO: 839443 - RNA, 19 nt, Homo sapiens
gcugcucuaugcugugaau

SEQ ID NO: 839444 - RNA, 19 nt, Homo sapiens
gcggacagacuuccagcaa

SEQ ID NO: 839445 - RNA, 19 nt, Homo sapiens
cuaaaccucagcagauaga

SEQ ID NO: 839446 - RNA, 19 nt, Homo sapiens
cuggagcucccuaaauaaa

SEQ ID NO: 839447 - RNA, 19 nt, Homo sapiens
cggcugcucuaugcuguga

SEQ ID NO: 839448 - RNA, 19 nt, Homo sapiens
gacacugcaccucuccuuu

SEQ ID NO: 839449 - RNA, 19 nt, Homo sapiens
ugacuuacacauugaggau

SEQ ID NO: 839450 - RNA, 19 nt, Homo sapiens
aggcugacuuacacauuga

SEQ ID NO: 839451 - RNA, 19 nt, Homo sapiens
acacugcaccucuccuuuc

SEQ ID NO: 839452 - RNA, 19 nt, Homo sapiens
gacacccacugccugaucu

SEQ ID NO: 839453 - RNA, 19 nt, Homo sapiens
caaccugaacuugccuaaa

SEQ ID NO: 839454 - RNA, 19 nt, Homo sapiens
gcucccauccacuauuaau

SEQ ID NO: 839455 - RNA, 19 nt, Homo sapiens
gggaugcccagcugaucaa

SEQ ID NO: 839456 - RNA, 19 nt, Homo sapiens
gcugugaggaguuugucaa

SEQ ID NO: 839457 - RNA, 19 nt, Homo sapiens
gaccacagcauggccuuca

SEQ ID NO: 839458 - RNA, 19 nt, Homo sapiens
ccuggagcucccuaaauaa

SEQ ID NO: 839459 - RNA, 19 nt, Homo sapiens
augcccagcugaucaagga

SEQ ID NO: 839460 - RNA, 19 nt, Homo sapiens
ggugugggcggacagacuu

SEQ ID NO: 839461 - RNA, 19 nt, Homo sapiens
ccaggcugacuuacacauu

SEQ ID NO: 839462 - RNA, 19 nt, Homo sapiens
ccacgcggaccacauuaca

SEQ ID NO: 839463 - RNA, 19 nt, Homo sapiens
ggcccaggcugacuuacac

SEQ ID NO: 839464 - RNA, 19 nt, Homo sapiens
ccugaucucacuucuguca

SEQ ID NO: 839465 - RNA, 19 nt, Homo sapiens
ugagcugcaccuucacgua

SEQ ID NO: 839466 - RNA, 19 nt, Homo sapiens
caacucaacugccaagucu

SEQ ID NO: 839467 - RNA, 19 nt, Homo sapiens
uuucuucgaugccauauuu

SEQ ID NO: 839468 - RNA, 19 nt, Homo sapiens
gcucaucucaguuuccuaa

SEQ ID NO: 839469 - RNA, 19 nt, Homo sapiens
ucaguuuccuaaucuguaa

SEQ ID NO: 839470 - RNA, 19 nt, Homo sapiens
ugacaccggccauggguua

SEQ ID NO: 839471 - RNA, 19 nt, Homo sapiens
caucucaguuuccuaaucu

SEQ ID NO: 839472 - RNA, 19 nt, Homo sapiens
aaaugggucuaauaaagga

SEQ ID NO: 839473 - RNA, 19 nt, Homo sapiens
ugggagggcuggugauguu

SEQ ID NO: 839474 - RNA, 19 nt, Homo sapiens
cuggugauguugaaggaua

SEQ ID NO: 839475 - RNA, 19 nt, Homo sapiens
caacacaccagcccagaca

SEQ ID NO: 839476 - RNA, 19 nt, Homo sapiens
ggucccagcccuugauuuc

SEQ ID NO: 839477 - RNA, 19 nt, Homo sapiens
guugaaggauaaccaugug

SEQ ID NO: 839478 - RNA, 19 nt, Homo sapiens
gagggcuggugauguugaa

SEQ ID NO: 839479 - RNA, 19 nt, Homo sapiens
gaacggguggcccucaaca

SEQ ID NO: 839480 - RNA, 19 nt, Homo sapiens
ccucugcucaucucaguuu

SEQ ID NO: 839481 - RNA, 19 nt, Homo sapiens
gcacauuuggcacuagcuu

SEQ ID NO: 839482 - RNA, 19 nt, Homo sapiens
gcggcugacuucgcucuga

SEQ ID NO: 839483 - RNA, 19 nt, Homo sapiens
ggagggcuggugauguuga

SEQ ID NO: 839484 - RNA, 19 nt, Homo sapiens
ccagacaggcggcugacuu

SEQ ID NO: 839485 - RNA, 19 nt, Homo sapiens
acauagacgucaucuccau

SEQ ID NO: 839486 - RNA, 19 nt, Homo sapiens
uagggucagugaacaaugg

SEQ ID NO: 839487 - RNA, 19 nt, Homo sapiens
cggcugacuucgcucugaa

SEQ ID NO: 839488 - RNA, 19 nt, Homo sapiens
gcuuccggcugguggagaa

SEQ ID NO: 839489 - RNA, 19 nt, Homo sapiens
ucaucucaguuuccuaauc

SEQ ID NO: 839490 - RNA, 19 nt, Homo sapiens
gaagguggaaguggaaugc

SEQ ID NO: 839491 - RNA, 19 nt, Homo sapiens
caaaauccacuaguccuaa

SEQ ID NO: 839492 - RNA, 19 nt, Homo sapiens
cuaaaccggaagaggauga

SEQ ID NO: 839493 - RNA, 19 nt, Homo sapiens
gcaucacccuggacaaccu

SEQ ID NO: 839494 - RNA, 19 nt, Homo sapiens
cuaauaaaggaucaaccaa

SEQ ID NO: 839495 - RNA, 19 nt, Homo sapiens
caccucugcucaucucagu

SEQ ID NO: 839496 - RNA, 19 nt, Homo sapiens
acauuuggcacuagcuuga

SEQ ID NO: 839497 - RNA, 19 nt, Homo sapiens
aaaauccacuaguccuaaa

SEQ ID NO: 839498 - RNA, 19 nt, Homo sapiens
uggugauguugaaggauaa

SEQ ID NO: 839499 - RNA, 19 nt, Homo sapiens
cagggcagccuuucuucga

SEQ ID NO: 839500 - RNA, 19 nt, Homo sapiens
gacuucaccucugcucauc

SEQ ID NO: 839501 - RNA, 19 nt, Homo sapiens
cagacaggcggcugacuuc

SEQ ID NO: 839502 - RNA, 19 nt, Homo sapiens
ggcuggugauguugaagga

SEQ ID NO: 839503 - RNA, 19 nt, Homo sapiens
gaaaugcgcuuugccaaga

SEQ ID NO: 839504 - RNA, 19 nt, Homo sapiens
gaaccucccugauuacuau

SEQ ID NO: 839505 - RNA, 19 nt, Homo sapiens
ggacacggacucuuaauaa

SEQ ID NO: 839506 - RNA, 19 nt, Homo sapiens
uaaaugagcuacccacaga

SEQ ID NO: 839507 - RNA, 19 nt, Homo sapiens
ggacaggacuccaucaagu

SEQ ID NO: 839508 - RNA, 19 nt, Homo sapiens
gcaagccuauguccuauga

SEQ ID NO: 839509 - RNA, 19 nt, Homo sapiens
gaaaagcucuucuugcaaa

SEQ ID NO: 839510 - RNA, 19 nt, Homo sapiens
ugagaaaguugaugugauu

SEQ ID NO: 839511 - RNA, 19 nt, Homo sapiens
gaagaaaccgagaucauga

SEQ ID NO: 839512 - RNA, 19 nt, Homo sapiens
gagaugacauagucuuaau

SEQ ID NO: 839513 - RNA, 19 nt, Homo sapiens
ugagaaaucugccaguaau

SEQ ID NO: 839514 - RNA, 19 nt, Homo sapiens
gacacggacucuuaauaaa

SEQ ID NO: 839515 - RNA, 19 nt, Homo sapiens
gauaaggagugggagcuuu

SEQ ID NO: 839516 - RNA, 19 nt, Homo sapiens
ggaaugcucaggaauguau

SEQ ID NO: 839517 - RNA, 19 nt, Homo sapiens
guacaacccuccugaccau

SEQ ID NO: 839518 - RNA, 19 nt, Homo sapiens
gauaugggaacaauaaaga

SEQ ID NO: 839519 - RNA, 19 nt, Homo sapiens
acuagaaacuucccaaaug

SEQ ID NO: 839520 - RNA, 19 nt, Homo sapiens
gcccaggccucucugugua

SEQ ID NO: 839521 - RNA, 19 nt, Homo sapiens
gcagaacaaaccaaagaaa

SEQ ID NO: 839522 - RNA, 19 nt, Homo sapiens
ggacgugggaggaaagaaa

SEQ ID NO: 839523 - RNA, 19 nt, Homo sapiens
caacaagccuggagaugac

SEQ ID NO: 839524 - RNA, 19 nt, Homo sapiens
aaaccgagaucaugauagu

SEQ ID NO: 839525 - RNA, 19 nt, Homo sapiens
cuagaaacuucccaaaugu

SEQ ID NO: 839526 - RNA, 19 nt, Homo sapiens
gaauacuacugcuagaagu

SEQ ID NO: 839527 - RNA, 19 nt, Homo sapiens
gggauggacuagaaacuuc

SEQ ID NO: 839528 - RNA, 19 nt, Homo sapiens
ggucuucaguuccagauuc

SEQ ID NO: 839529 - RNA, 19 nt, Homo sapiens
ggagaugacauagucuuaa

SEQ ID NO: 839530 - RNA, 19 nt, Homo sapiens
ggagauguuugccaagaag

SEQ ID NO: 839531 - RNA, 19 nt, Homo sapiens
ugagcacaaucaagucuaa

SEQ ID NO: 839532 - RNA, 19 nt, Homo sapiens
ggacuuuggacccuaacua

SEQ ID NO: 839533 - RNA, 19 nt, Homo sapiens
ggaaguggaagagaauaaa

SEQ ID NO: 839534 - RNA, 19 nt, Homo sapiens
aaagacccguguaggauga

SEQ ID NO: 839535 - RNA, 19 nt, Homo sapiens
cgacuacugugacaucauc

SEQ ID NO: 839536 - RNA, 19 nt, Homo sapiens
gcucaagacacuauggaaa

SEQ ID NO: 839537 - RNA, 19 nt, Homo sapiens
aagaggaaguggaagagaa

SEQ ID NO: 839538 - RNA, 19 nt, Homo sapiens
cagcagaacaaaccaaaga

SEQ ID NO: 839539 - RNA, 19 nt, Homo sapiens
ggacuagaaacuucccaaa

SEQ ID NO: 839540 - RNA, 19 nt, Homo sapiens
ccagauuccuucccagcaa

SEQ ID NO: 839541 - RNA, 19 nt, Homo sapiens
gacaugagcacaaucaagu

SEQ ID NO: 839542 - RNA, 19 nt, Homo sapiens
ugugaaaccuccaaagaag

SEQ ID NO: 839543 - RNA, 19 nt, Homo sapiens
ggaauacuacugcuagaag

SEQ ID NO: 839544 - RNA, 19 nt, Homo sapiens
acaggacuccaucaaguua

SEQ ID NO: 839545 - RNA, 19 nt, Homo sapiens
agaagggagugaagaggaa

SEQ ID NO: 839546 - RNA, 19 nt, Homo sapiens
gaagaggacgugggaggaa

SEQ ID NO: 839547 - RNA, 19 nt, Homo sapiens
cauuggacacggacucuua

SEQ ID NO: 839548 - RNA, 19 nt, Homo sapiens
uaaagaagcgcuuggaaaa

SEQ ID NO: 839549 - RNA, 19 nt, Homo sapiens
gaugggaucacuagcaugu

SEQ ID NO: 839550 - RNA, 19 nt, Homo sapiens
gaaagggacaggacuccau

SEQ ID NO: 839551 - RNA, 19 nt, Homo sapiens
gcaaugugagcaagaagga

SEQ ID NO: 839552 - RNA, 19 nt, Homo sapiens
gaaaagaggaaguggaaga

SEQ ID NO: 839553 - RNA, 19 nt, Homo sapiens
uuacuggaaugcucaggaa

SEQ ID NO: 839554 - RNA, 19 nt, Homo sapiens
agcugaaccucccugauua

SEQ ID NO: 839555 - RNA, 19 nt, Homo sapiens
gaaacuucccaaaugucua

SEQ ID NO: 839556 - RNA, 19 nt, Homo sapiens
agaacacucugaccucuag

SEQ ID NO: 839557 - RNA, 19 nt, Homo sapiens
cagcgaagacuccgaaaca

SEQ ID NO: 839558 - RNA, 19 nt, Homo sapiens
aagcugaaccucccugauu

SEQ ID NO: 839559 - RNA, 19 nt, Homo sapiens
gugcuacucugugugcaaa

SEQ ID NO: 839560 - RNA, 19 nt, Homo sapiens
ggacaugagcacaaucaag

SEQ ID NO: 839561 - RNA, 19 nt, Homo sapiens
ucaagacacuauggaaaca

SEQ ID NO: 839562 - RNA, 19 nt, Homo sapiens
ugcaauaccugcucagagu

SEQ ID NO: 839563 - RNA, 19 nt, Homo sapiens
gacaggacuccaucaaguu

SEQ ID NO: 839564 - RNA, 19 nt, Homo sapiens
gaguccagcuccucugaca

SEQ ID NO: 839565 - RNA, 19 nt, Homo sapiens
ccaaagacccguguaggau

SEQ ID NO: 839566 - RNA, 19 nt, Homo sapiens
uugagugccuggugaagaa

SEQ ID NO: 839567 - RNA, 19 nt, Homo sapiens
gccaaagacccguguagga

SEQ ID NO: 839568 - RNA, 19 nt, Homo sapiens
acaacaagccuggagauga

SEQ ID NO: 839569 - RNA, 19 nt, Homo sapiens
auaaagaagcgcuuggaaa

SEQ ID NO: 839570 - RNA, 19 nt, Homo sapiens
ucucacuggugcccuguaa

SEQ ID NO: 839571 - RNA, 19 nt, Homo sapiens
gagcuacccacagaagaaa

SEQ ID NO: 839572 - RNA, 19 nt, Homo sapiens
gaugacauagucuuaaugg

SEQ ID NO: 839573 - RNA, 19 nt, Homo sapiens
agagaaggcaggccacuga

SEQ ID NO: 839574 - RNA, 19 nt, Homo sapiens
gcuccaggauguguucgaa

SEQ ID NO: 839575 - RNA, 19 nt, Homo sapiens
cuacacgacuacugugaca

SEQ ID NO: 839576 - RNA, 19 nt, Homo sapiens
caaagaagggagugaagag

SEQ ID NO: 839577 - RNA, 19 nt, Homo sapiens
guaccaaacacaacucaag

SEQ ID NO: 839578 - RNA, 19 nt, Homo sapiens
agaaaccgagaucaugaua

SEQ ID NO: 839579 - RNA, 19 nt, Homo sapiens
agaccaaccaacugcaaua

SEQ ID NO: 839580 - RNA, 19 nt, Homo sapiens
auaaggagugggagcuuua

SEQ ID NO: 839581 - RNA, 19 nt, Homo sapiens
gcuaugucaccuccuguuu

SEQ ID NO: 839582 - RNA, 19 nt, Homo sapiens
gagcuggagcgcuauguca

SEQ ID NO: 839583 - RNA, 19 nt, Homo sapiens
gaaaagcacaaaagaaaag

SEQ ID NO: 839584 - RNA, 19 nt, Homo sapiens
gauguucuccaacugcuau

SEQ ID NO: 839585 - RNA, 19 nt, Homo sapiens
gaaccuugcagugacauca

SEQ ID NO: 839586 - RNA, 19 nt, Homo sapiens
gugcaagccuauguccuau

SEQ ID NO: 839587 - RNA, 19 nt, Homo sapiens
gcacccagcaccagagaag

SEQ ID NO: 839588 - RNA, 19 nt, Homo sapiens
agaagaaaccgagaucaug

SEQ ID NO: 839589 - RNA, 19 nt, Homo sapiens
gccuggagaugacauaguc

SEQ ID NO: 839590 - RNA, 19 nt, Homo sapiens
gacuagaaacuucccaaau

SEQ ID NO: 839591 - RNA, 19 nt, Homo sapiens
gaauguauccaggacuuca

SEQ ID NO: 839592 - RNA, 19 nt, Homo sapiens
ggauaugggaacaauaaag

SEQ ID NO: 839593 - RNA, 19 nt, Homo sapiens
gugcauuuccaaagcuuaa

SEQ ID NO: 839594 - RNA, 19 nt, Homo sapiens
gcugagaaaguugauguga

SEQ ID NO: 839595 - RNA, 19 nt, Homo sapiens
aaggagauguuugccaaga

SEQ ID NO: 839596 - RNA, 19 nt, Homo sapiens
ugaaaccuccaaagaagga

SEQ ID NO: 839597 - RNA, 19 nt, Homo sapiens
ccuggagggugaugacaau

SEQ ID NO: 839598 - RNA, 19 nt, Homo sapiens
ccaggccucucuguguaaa

SEQ ID NO: 839599 - RNA, 19 nt, Homo sapiens
gacaagugcaagccuaugu

SEQ ID NO: 839600 - RNA, 19 nt, Homo sapiens
cgauugauguucuccaacu

SEQ ID NO: 839601 - RNA, 19 nt, Homo sapiens
gcacaaucaagucuaaacu

SEQ ID NO: 839602 - RNA, 19 nt, Homo sapiens
caagucacauagggaaagu

SEQ ID NO: 839603 - RNA, 19 nt, Homo sapiens
gaaaugcgcuuugccaaga

SEQ ID NO: 839604 - RNA, 19 nt, Homo sapiens
gaaccucccugauuacuau

SEQ ID NO: 839605 - RNA, 19 nt, Homo sapiens
uaaaugagcuacccacaga

SEQ ID NO: 839606 - RNA, 19 nt, Homo sapiens
gcaagccuauguccuauga

SEQ ID NO: 839607 - RNA, 19 nt, Homo sapiens
gaaaagcucuucuugcaaa

SEQ ID NO: 839608 - RNA, 19 nt, Homo sapiens
ccaaaugucuacacaguau

SEQ ID NO: 839609 - RNA, 19 nt, Homo sapiens
ugagaaaguugaugugauu

SEQ ID NO: 839610 - RNA, 19 nt, Homo sapiens
gaagaaaccgagaucauga

SEQ ID NO: 839611 - RNA, 19 nt, Homo sapiens
gcacugacuuugccuugaa

SEQ ID NO: 839612 - RNA, 19 nt, Homo sapiens
cuagguggcuucugacuuu

SEQ ID NO: 839613 - RNA, 19 nt, Homo sapiens
gagaugacauagucuuaau

SEQ ID NO: 839614 - RNA, 19 nt, Homo sapiens
ugagaaaucugccaguaau

SEQ ID NO: 839615 - RNA, 19 nt, Homo sapiens
ccacaagccuuuaauugag

SEQ ID NO: 839616 - RNA, 19 nt, Homo sapiens
ggaaugcucaggaauguau

SEQ ID NO: 839617 - RNA, 19 nt, Homo sapiens
guacaacccuccugaccau

SEQ ID NO: 839618 - RNA, 19 nt, Homo sapiens
gauaugggaacaauaaaga

SEQ ID NO: 839619 - RNA, 19 nt, Homo sapiens
acuagaaacuucccaaaug

SEQ ID NO: 839620 - RNA, 19 nt, Homo sapiens
gcagaacaaaccaaagaaa

SEQ ID NO: 839621 - RNA, 19 nt, Homo sapiens
ggacgugggaggaaagaaa

SEQ ID NO: 839622 - RNA, 19 nt, Homo sapiens
caacaagccuggagaugac

SEQ ID NO: 839623 - RNA, 19 nt, Homo sapiens
ccagagugaucuauuguca

SEQ ID NO: 839624 - RNA, 19 nt, Homo sapiens
aaaccgagaucaugauagu

SEQ ID NO: 839625 - RNA, 19 nt, Homo sapiens
cuagaaacuucccaaaugu

SEQ ID NO: 839626 - RNA, 19 nt, Homo sapiens
gaauacuacugcuagaagu

SEQ ID NO: 839627 - RNA, 19 nt, Homo sapiens
gggauggacuagaaacuuc

SEQ ID NO: 839628 - RNA, 19 nt, Homo sapiens
ugacaugaauuuccagagu

SEQ ID NO: 839629 - RNA, 19 nt, Homo sapiens
ggagaugacauagucuuaa

SEQ ID NO: 839630 - RNA, 19 nt, Homo sapiens
ggagauguuugccaagaag

SEQ ID NO: 839631 - RNA, 19 nt, Homo sapiens
ggagggagcagaagaagca

SEQ ID NO: 839632 - RNA, 19 nt, Homo sapiens
ugagcacaaucaagucuaa

SEQ ID NO: 839633 - RNA, 19 nt, Homo sapiens
gugaucgucuccucauuga

SEQ ID NO: 839634 - RNA, 19 nt, Homo sapiens
ugacaaggacaaacagaaa

SEQ ID NO: 839635 - RNA, 19 nt, Homo sapiens
ggaaguggaagagaauaaa

SEQ ID NO: 839636 - RNA, 19 nt, Homo sapiens
cagcuaccauugacaugaa

SEQ ID NO: 839637 - RNA, 19 nt, Homo sapiens
aaagacccguguaggauga

SEQ ID NO: 839638 - RNA, 19 nt, Homo sapiens
cgacuacugugacaucauc

SEQ ID NO: 839639 - RNA, 19 nt, Homo sapiens
gaaagaggagcgugagaag

SEQ ID NO: 839640 - RNA, 19 nt, Homo sapiens
ucaccagccuugacccaaa

SEQ ID NO: 839641 - RNA, 19 nt, Homo sapiens
gcucaagacacuauggaaa

SEQ ID NO: 839642 - RNA, 19 nt, Homo sapiens
agaagaagcaccaucauca

SEQ ID NO: 839643 - RNA, 19 nt, Homo sapiens
aagaggaaguggaagagaa

SEQ ID NO: 839644 - RNA, 19 nt, Homo sapiens
cagcagaacaaaccaaaga

SEQ ID NO: 839645 - RNA, 19 nt, Homo sapiens
ggacuagaaacuucccaaa

SEQ ID NO: 839646 - RNA, 19 nt, Homo sapiens
caaccaaagucaguuccuu

SEQ ID NO: 839647 - RNA, 19 nt, Homo sapiens
gacaugagcacaaucaagu

SEQ ID NO: 839648 - RNA, 19 nt, Homo sapiens
agagauggcuccgaaguca

SEQ ID NO: 839649 - RNA, 19 nt, Homo sapiens
ggaauacuacugcuagaag

SEQ ID NO: 839650 - RNA, 19 nt, Homo sapiens
ugugaaaccuccaaagaag

SEQ ID NO: 839651 - RNA, 19 nt, Homo sapiens
aaaaggaccugaaaaucaa

SEQ ID NO: 839652 - RNA, 19 nt, Homo sapiens
aaaugaagccuguggaugu

SEQ ID NO: 839653 - RNA, 19 nt, Homo sapiens
agaagggagugaagaggaa

SEQ ID NO: 839654 - RNA, 19 nt, Homo sapiens
gaagaggacgugggaggaa

SEQ ID NO: 839655 - RNA, 19 nt, Homo sapiens
aaacauugacuuuccauag

SEQ ID NO: 839656 - RNA, 19 nt, Homo sapiens
gaugggaucacuagcaugu

SEQ ID NO: 839657 - RNA, 19 nt, Homo sapiens
uaaagaagcgcuuggaaaa

SEQ ID NO: 839658 - RNA, 19 nt, Homo sapiens
gacacaauggcacugcuua

SEQ ID NO: 839659 - RNA, 19 nt, Homo sapiens
cacaagccuuuaauugaga

SEQ ID NO: 839660 - RNA, 19 nt, Homo sapiens
ggaaaugaagccuguggau

SEQ ID NO: 839661 - RNA, 19 nt, Homo sapiens
gcaaugugagcaagaagga

SEQ ID NO: 839662 - RNA, 19 nt, Homo sapiens
gaaaagaggaaguggaaga

SEQ ID NO: 839663 - RNA, 19 nt, Homo sapiens
uuacuggaaugcucaggaa

SEQ ID NO: 839664 - RNA, 19 nt, Homo sapiens
agcugaaccucccugauua

SEQ ID NO: 839665 - RNA, 19 nt, Homo sapiens
gaaacuucccaaaugucua

SEQ ID NO: 839666 - RNA, 19 nt, Homo sapiens
gcgaagacuccgaaacaga

SEQ ID NO: 839667 - RNA, 19 nt, Homo sapiens
cagcgaagacuccgaaaca

SEQ ID NO: 839668 - RNA, 19 nt, Homo sapiens
aagcugaaccucccugauu

SEQ ID NO: 839669 - RNA, 19 nt, Homo sapiens
acaugaauuuccagaguga

SEQ ID NO: 839670 - RNA, 19 nt, Homo sapiens
gcagcuaccauugacauga

SEQ ID NO: 839671 - RNA, 19 nt, Homo sapiens
ggacaugagcacaaucaag

SEQ ID NO: 839672 - RNA, 19 nt, Homo sapiens
ucaagacacuauggaaaca

SEQ ID NO: 839673 - RNA, 19 nt, Homo sapiens
ugcaauaccugcucagagu

SEQ ID NO: 839674 - RNA, 19 nt, Homo sapiens
ccaccuguguuucuguuuc

SEQ ID NO: 839675 - RNA, 19 nt, Homo sapiens
ggagugaggccaccaacca

SEQ ID NO: 839676 - RNA, 19 nt, Homo sapiens
cccacaagccuuuaauuga

SEQ ID NO: 839677 - RNA, 19 nt, Homo sapiens
gaguccagcuccucugaca

SEQ ID NO: 839678 - RNA, 19 nt, Homo sapiens
ccaaagacccguguaggau

SEQ ID NO: 839679 - RNA, 19 nt, Homo sapiens
uugagugccuggugaagaa

SEQ ID NO: 839680 - RNA, 19 nt, Homo sapiens
gccaaagacccguguagga

SEQ ID NO: 839681 - RNA, 19 nt, Homo sapiens
acaacaagccuggagauga

SEQ ID NO: 839682 - RNA, 19 nt, Homo sapiens
auaaagaagcgcuuggaaa

SEQ ID NO: 839683 - RNA, 19 nt, Homo sapiens
gcucagcacacgccuuguu

SEQ ID NO: 839684 - RNA, 19 nt, Homo sapiens
gagcuacccacagaagaaa

SEQ ID NO: 839685 - RNA, 19 nt, Homo sapiens
gaugacauagucuuaaugg

SEQ ID NO: 839686 - RNA, 19 nt, Homo sapiens
agagaaggcaggccacuga

SEQ ID NO: 839687 - RNA, 19 nt, Homo sapiens
caauggcacugcuuaucuc

SEQ ID NO: 839688 - RNA, 19 nt, Homo sapiens
cgccaaaugucuacacagu

SEQ ID NO: 839689 - RNA, 19 nt, Homo sapiens
gggccagccuagugcagaa

SEQ ID NO: 839690 - RNA, 19 nt, Homo sapiens
ggucucuccuccagcuuug

SEQ ID NO: 839691 - RNA, 19 nt, Homo sapiens
gcuccaggauguguucgaa

SEQ ID NO: 839692 - RNA, 19 nt, Homo sapiens
cuacacgacuacugugaca

SEQ ID NO: 839693 - RNA, 19 nt, Homo sapiens
caaagaagggagugaagag

SEQ ID NO: 839694 - RNA, 19 nt, Homo sapiens
guaccaaacacaacucaag

SEQ ID NO: 839695 - RNA, 19 nt, Homo sapiens
agaaaccgagaucaugaua

SEQ ID NO: 839696 - RNA, 19 nt, Homo sapiens
agaccaaccaacugcaaua

SEQ ID NO: 839697 - RNA, 19 nt, Homo sapiens
gcacugcuuaucuccgaaa

SEQ ID NO: 839698 - RNA, 19 nt, Homo sapiens
gcuaugucaccuccuguuu

SEQ ID NO: 839699 - RNA, 19 nt, Homo sapiens
gagcuggagcgcuauguca

SEQ ID NO: 839700 - RNA, 19 nt, Homo sapiens
gaaaagcacaaaagaaaag

SEQ ID NO: 839701 - RNA, 19 nt, Homo sapiens
gauguucuccaacugcuau

SEQ ID NO: 839702 - RNA, 19 nt, Homo sapiens
caaaugucuacacaguaua

SEQ ID NO: 839703 - RNA, 19 nt, Homo sapiens
gaagagagauuccuauagu

SEQ ID NO: 839704 - RNA, 19 nt, Homo sapiens
gguaauaacuggaagugaa

SEQ ID NO: 839705 - RNA, 19 nt, Homo sapiens
gaucuucucuuucuaacaa

SEQ ID NO: 839706 - RNA, 19 nt, Homo sapiens
gcacugguuugcauuaguu

SEQ ID NO: 839707 - RNA, 19 nt, Homo sapiens
ggacaacauuggcuagaga

SEQ ID NO: 839708 - RNA, 19 nt, Homo sapiens
ucacaggauuucauaauug

SEQ ID NO: 839709 - RNA, 19 nt, Homo sapiens
cgucauaccuccuucuauu

SEQ ID NO: 839710 - RNA, 19 nt, Homo sapiens
gaaccugcauuucauagag

SEQ ID NO: 839711 - RNA, 19 nt, Homo sapiens
uaacaaaucgaguugaaga

SEQ ID NO: 839712 - RNA, 19 nt, Homo sapiens
gggauuuguuccuuauauu

SEQ ID NO: 839713 - RNA, 19 nt, Homo sapiens
gacccgagcuccaguaguc

SEQ ID NO: 839714 - RNA, 19 nt, Homo sapiens
gaccaaaggagauaauaau

SEQ ID NO: 839715 - RNA, 19 nt, Homo sapiens
gauagaaggaagagagauu

SEQ ID NO: 839716 - RNA, 19 nt, Homo sapiens
acagagacuuguaaaugaa

SEQ ID NO: 839717 - RNA, 19 nt, Homo sapiens
gcauggaaccugcauuuca

SEQ ID NO: 839718 - RNA, 19 nt, Homo sapiens
gaagugaaaguccgauugu

SEQ ID NO: 839719 - RNA, 19 nt, Homo sapiens
gucacaggauuucauaauu

SEQ ID NO: 839720 - RNA, 19 nt, Homo sapiens
uaaguaugcaguucucuuu

SEQ ID NO: 839721 - RNA, 19 nt, Homo sapiens
gagauaauaaugcgguuga

SEQ ID NO: 839722 - RNA, 19 nt, Homo sapiens
ggaagugaaaguccgauug

SEQ ID NO: 839723 - RNA, 19 nt, Homo sapiens
guaauaacuggaagugaaa

SEQ ID NO: 839724 - RNA, 19 nt, Homo sapiens
ucuaacaaaucgaguugaa

SEQ ID NO: 839725 - RNA, 19 nt, Homo sapiens
cagcauggaaccugcauuu

SEQ ID NO: 839726 - RNA, 19 nt, Homo sapiens
gcugguucaucgugaguaa

SEQ ID NO: 839727 - RNA, 19 nt, Homo sapiens
ggauuuguuccuuauauug

SEQ ID NO: 839728 - RNA, 19 nt, Homo sapiens
ugaccgaggccucuauaaa

SEQ ID NO: 839729 - RNA, 19 nt, Homo sapiens
aaaugggcauaucaaguuu

SEQ ID NO: 839730 - RNA, 19 nt, Homo sapiens
cugggaagaugccauaguu

SEQ ID NO: 839731 - RNA, 19 nt, Homo sapiens
cauggaaccugcauuucau

SEQ ID NO: 839732 - RNA, 19 nt, Homo sapiens
uaaagugccuacagagacu

SEQ ID NO: 839733 - RNA, 19 nt, Homo sapiens
cacaggauuucauaauugu

SEQ ID NO: 839734 - RNA, 19 nt, Homo sapiens
guagcacugguuugcauua

SEQ ID NO: 839735 - RNA, 19 nt, Homo sapiens
guaagaagccugccuugcu

SEQ ID NO: 839736 - RNA, 19 nt, Homo sapiens
cuucuaaagugccuacaga

SEQ ID NO: 839737 - RNA, 19 nt, Homo sapiens
ugaccaaaggagauaauaa

SEQ ID NO: 839738 - RNA, 19 nt, Homo sapiens
gucauaccuccuucuauua

SEQ ID NO: 839739 - RNA, 19 nt, Homo sapiens
gaugaccgaggccucuaua

SEQ ID NO: 839740 - RNA, 19 nt, Homo sapiens
auaauaaugcgguugauga

SEQ ID NO: 839741 - RNA, 19 nt, Homo sapiens
gaagauucaugaaaagcaa

SEQ ID NO: 839742 - RNA, 19 nt, Homo sapiens
gagagauuccuauaguuca

SEQ ID NO: 839743 - RNA, 19 nt, Homo sapiens
aagagagauuccuauaguu

SEQ ID NO: 839744 - RNA, 19 nt, Homo sapiens
gaccgaggccucuauaaac

SEQ ID NO: 839745 - RNA, 19 nt, Homo sapiens
ucagucacaggauuucaua

SEQ ID NO: 839746 - RNA, 19 nt, Homo sapiens
gaaaccgucauaccuccuu

SEQ ID NO: 839747 - RNA, 19 nt, Homo sapiens
gauaauaaugcgguugaug

SEQ ID NO: 839748 - RNA, 19 nt, Homo sapiens
auacugagguggucguaag

SEQ ID NO: 839749 - RNA, 19 nt, Homo sapiens
uauuaggaauggcauauac

SEQ ID NO: 839750 - RNA, 19 nt, Homo sapiens
gcucugcacgaguuugaaa

SEQ ID NO: 839751 - RNA, 19 nt, Homo sapiens
ggguagcacugguuugcau

SEQ ID NO: 839752 - RNA, 19 nt, Homo sapiens
gugacgauccucaugaaug

SEQ ID NO: 839753 - RNA, 19 nt, Homo sapiens
uaaacaaggacaacauugg

SEQ ID NO: 839754 - RNA, 19 nt, Homo sapiens
ggaaccugcauuucauaga

SEQ ID NO: 839755 - RNA, 19 nt, Homo sapiens
cauacgagugggagaaauu

SEQ ID NO: 839756 - RNA, 19 nt, Homo sapiens
caucggcacuaaugaucug

SEQ ID NO: 839757 - RNA, 19 nt, Homo sapiens
caugaaugacuauccuaaa

SEQ ID NO: 839758 - RNA, 19 nt, Homo sapiens
ccaaaggagauaauaaugc

SEQ ID NO: 839759 - RNA, 19 nt, Homo sapiens
agccaagcuucacuucuaa

SEQ ID NO: 839760 - RNA, 19 nt, Homo sapiens
gggaagaugccauaguuuu

SEQ ID NO: 839761 - RNA, 19 nt, Homo sapiens
agagagauuccuauaguuc

SEQ ID NO: 839762 - RNA, 19 nt, Homo sapiens
cgaggccucuauaaacaag

SEQ ID NO: 839763 - RNA, 19 nt, Homo sapiens
uggaagggguuaaugguaa

SEQ ID NO: 839764 - RNA, 19 nt, Homo sapiens
gguuugcauuaguuuaugu

SEQ ID NO: 839765 - RNA, 19 nt, Homo sapiens
aaaaugggcauaucaaguu

SEQ ID NO: 839766 - RNA, 19 nt, Homo sapiens
gugaaaguccgauuguagu

SEQ ID NO: 839767 - RNA, 19 nt, Homo sapiens
ccaggggauuuguuccuua

SEQ ID NO: 839768 - RNA, 19 nt, Homo sapiens
gacaacauuggcuagagaa

SEQ ID NO: 839769 - RNA, 19 nt, Homo sapiens
aagugaaaguccgauugua

SEQ ID NO: 839770 - RNA, 19 nt, Homo sapiens
cgagugggagaaauuguug

SEQ ID NO: 839771 - RNA, 19 nt, Homo sapiens
cagagacuuguaaaugaaa

SEQ ID NO: 839772 - RNA, 19 nt, Homo sapiens
ggucugugauugguggaau

SEQ ID NO: 839773 - RNA, 19 nt, Homo sapiens
ggggauuuguuccuuauau

SEQ ID NO: 839774 - RNA, 19 nt, Homo sapiens
ugggagaaauuguuguuuu

SEQ ID NO: 839775 - RNA, 19 nt, Homo sapiens
cggcacuaaugaucuggaa

SEQ ID NO: 839776 - RNA, 19 nt, Homo sapiens
caggauuucauaauuguca

SEQ ID NO: 839777 - RNA, 19 nt, Homo sapiens
uuucguuacuggauguuug

SEQ ID NO: 839778 - RNA, 19 nt, Homo sapiens
ucuaaagugccuacagaga

SEQ ID NO: 839779 - RNA, 19 nt, Homo sapiens
gcucaguggcagcauggaa

SEQ ID NO: 839780 - RNA, 19 nt, Homo sapiens
uagauacuggucugugauu

SEQ ID NO: 839781 - RNA, 19 nt, Homo sapiens
ccgccaugcugucucuaga

SEQ ID NO: 839782 - RNA, 19 nt, Homo sapiens
accgaggccucuauaaaca

SEQ ID NO: 839783 - RNA, 19 nt, Homo sapiens
ucauaccuccuucuauuag

SEQ ID NO: 839784 - RNA, 19 nt, Homo sapiens
aguugaagaucccauacga

SEQ ID NO: 839785 - RNA, 19 nt, Homo sapiens
ggaagggguuaaugguaau

SEQ ID NO: 839786 - RNA, 19 nt, Homo sapiens
gauacuggucugugauugg

SEQ ID NO: 839787 - RNA, 19 nt, Homo sapiens
ggaagaugccauaguuuuc

SEQ ID NO: 839788 - RNA, 19 nt, Homo sapiens
gauuuguuccuuauauugg

SEQ ID NO: 839789 - RNA, 19 nt, Homo sapiens
gaaaagcaaaaugggcaua

SEQ ID NO: 839790 - RNA, 19 nt, Homo sapiens
ugaaaguccgauuguagug

SEQ ID NO: 839791 - RNA, 19 nt, Homo sapiens
uaggaauggcauauacuga

SEQ ID NO: 839792 - RNA, 19 nt, Homo sapiens
auuaaaagguugagccaaa

SEQ ID NO: 839793 - RNA, 19 nt, Homo sapiens
ugucucaucggcacuaaug

SEQ ID NO: 839794 - RNA, 19 nt, Homo sapiens
cagcucugcacgaguuuga

SEQ ID NO: 839795 - RNA, 19 nt, Homo sapiens
guagauacuggucugugau

SEQ ID NO: 839796 - RNA, 19 nt, Homo sapiens
gaagccugccuugcuguuc

SEQ ID NO: 839797 - RNA, 19 nt, Homo sapiens
gaagguaucucaaaucugu

SEQ ID NO: 839798 - RNA, 19 nt, Homo sapiens
aaacagaucugcgcauaua

SEQ ID NO: 839799 - RNA, 19 nt, Homo sapiens
ucaaaucugugaaguauug

SEQ ID NO: 839800 - RNA, 19 nt, Homo sapiens
gaggaagccuugacuauca

SEQ ID NO: 839801 - RNA, 19 nt, Homo sapiens
gcacaauacuugcuguuca

SEQ ID NO: 839802 - RNA, 19 nt, Homo sapiens
gaaauuaccaguagaaugc

SEQ ID NO: 839803 - RNA, 19 nt, Homo sapiens
gauagaaccaauuguugua

SEQ ID NO: 839804 - RNA, 19 nt, Homo sapiens
acacagauaucgccaagga

SEQ ID NO: 839805 - RNA, 19 nt, Homo sapiens
gauuguggaugcuagguuu

SEQ ID NO: 839806 - RNA, 19 nt, Homo sapiens
gaaauuacagauucaagug

SEQ ID NO: 839807 - RNA, 19 nt, Homo sapiens
gcagucaccuuagauguuc

SEQ ID NO: 839808 - RNA, 19 nt, Homo sapiens
ugaauccugugguuucuuu

SEQ ID NO: 839809 - RNA, 19 nt, Homo sapiens
ucucaaaucugugaaguau

SEQ ID NO: 839810 - RNA, 19 nt, Homo sapiens
acaagaagguaucucaaau

SEQ ID NO: 839811 - RNA, 19 nt, Homo sapiens
cuacucagguuguugauca

SEQ ID NO: 839812 - RNA, 19 nt, Homo sapiens
gaaccaauuguuguacaua

SEQ ID NO: 839813 - RNA, 19 nt, Homo sapiens
ggaaauuaccaguagaaug

SEQ ID NO: 839814 - RNA, 19 nt, Homo sapiens
gcaauugccuccagcucau

SEQ ID NO: 839815 - RNA, 19 nt, Homo sapiens
ugacaugaguguagaccuu

SEQ ID NO: 839816 - RNA, 19 nt, Homo sapiens
guggugacguaaugaaauu

SEQ ID NO: 839817 - RNA, 19 nt, Homo sapiens
auacacaguuucauuguuc

SEQ ID NO: 839818 - RNA, 19 nt, Homo sapiens
caccuuagauguucagaag

SEQ ID NO: 839819 - RNA, 19 nt, Homo sapiens
cugaaugggugaaaggaaa

SEQ ID NO: 839820 - RNA, 19 nt, Homo sapiens
uaaaacagaucugcgcaua

SEQ ID NO: 839821 - RNA, 19 nt, Homo sapiens
gaagugcauaaguaucuaa

SEQ ID NO: 839822 - RNA, 19 nt, Homo sapiens
cccgugaagugcauaagua

SEQ ID NO: 839823 - RNA, 19 nt, Homo sapiens
acagaucugcgcauauaua

SEQ ID NO: 839824 - RNA, 19 nt, Homo sapiens
gcuccaugcuggcugaaga

SEQ ID NO: 839825 - RNA, 19 nt, Homo sapiens
gccuuggucugaauauuug

SEQ ID NO: 839826 - RNA, 19 nt, Homo sapiens
aagaagguaucucaaaucu

SEQ ID NO: 839827 - RNA, 19 nt, Homo sapiens
guagaaugccuuggucuga

SEQ ID NO: 839828 - RNA, 19 nt, Homo sapiens
gauaaugaaguugcaaguu

SEQ ID NO: 839829 - RNA, 19 nt, Homo sapiens
ggaggaagccuugacuauc

SEQ ID NO: 839830 - RNA, 19 nt, Homo sapiens
gcccgacucuaucacaaga

SEQ ID NO: 839831 - RNA, 19 nt, Homo sapiens
gcugugcagucaccuuaga

SEQ ID NO: 839832 - RNA, 19 nt, Homo sapiens
cgcccuggcugauuacaaa

SEQ ID NO: 839833 - RNA, 19 nt, Homo sapiens
uagaaugccuuggucugaa

SEQ ID NO: 839834 - RNA, 19 nt, Homo sapiens
caagaagguaucucaaauc

SEQ ID NO: 839835 - RNA, 19 nt, Homo sapiens
cacaagaagguaucucaaa

SEQ ID NO: 839836 - RNA, 19 nt, Homo sapiens
ucagguuguugaucauuau

SEQ ID NO: 839837 - RNA, 19 nt, Homo sapiens
ggucacaaaugguucucau

SEQ ID NO: 839838 - RNA, 19 nt, Homo sapiens
gaaguugcaaguuuugaua

SEQ ID NO: 839839 - RNA, 19 nt, Homo sapiens
ccacugaagagcuaugaga

SEQ ID NO: 839840 - RNA, 19 nt, Homo sapiens
gagaggcagagaagaaaug

SEQ ID NO: 839841 - RNA, 19 nt, Homo sapiens
caagcaaaauacacaguuu

SEQ ID NO: 839842 - RNA, 19 nt, Homo sapiens
ugaagugcauaaguaucua

SEQ ID NO: 839843 - RNA, 19 nt, Homo sapiens
aauacuugcuguucacguu

SEQ ID NO: 839844 - RNA, 19 nt, Homo sapiens
ggucugaauauuugauaga

SEQ ID NO: 839845 - RNA, 19 nt, Homo sapiens
gaaugccuuggucugaaua

SEQ ID NO: 839846 - RNA, 19 nt, Homo sapiens
cucagguuguugaucauua

SEQ ID NO: 839847 - RNA, 19 nt, Homo sapiens
ggcugaagaugcaaucaag

SEQ ID NO: 839848 - RNA, 19 nt, Homo sapiens
agaaugccuuggucugaau

SEQ ID NO: 839849 - RNA, 19 nt, Homo sapiens
ccuggcugauuacaaauug

SEQ ID NO: 839850 - RNA, 19 nt, Homo sapiens
cagaucugcgcauauauau

SEQ ID NO: 839851 - RNA, 19 nt, Homo sapiens
uagaaccaauuguuguaca

SEQ ID NO: 839852 - RNA, 19 nt, Homo sapiens
gauagcccgugaagugcau

SEQ ID NO: 839853 - RNA, 19 nt, Homo sapiens
uuugauagcccgugaagug

SEQ ID NO: 839854 - RNA, 19 nt, Homo sapiens
ugacucucaugcaagcaaa

SEQ ID NO: 839855 - RNA, 19 nt, Homo sapiens
uggcugugguuccgcaauu

SEQ ID NO: 839856 - RNA, 19 nt, Homo sapiens
ugauagaaccaauuguugu

SEQ ID NO: 839857 - RNA, 19 nt, Homo sapiens
gacaugaguguagaccuuu

SEQ ID NO: 839858 - RNA, 19 nt, Homo sapiens
gugaagugcauaaguaucu

SEQ ID NO: 839859 - RNA, 19 nt, Homo sapiens
ggagaggcagagaagaaau

SEQ ID NO: 839860 - RNA, 19 nt, Homo sapiens
aaggagaggcagagaagaa

SEQ ID NO: 839861 - RNA, 19 nt, Homo sapiens
caugcuggcugaagaugca

SEQ ID NO: 839862 - RNA, 19 nt, Homo sapiens
acugaagagcuaugagaua

SEQ ID NO: 839863 - RNA, 19 nt, Homo sapiens
uccagcauguggugacgua

SEQ ID NO: 839864 - RNA, 19 nt, Homo sapiens
ugccuuggucugaauauuu

SEQ ID NO: 839865 - RNA, 19 nt, Homo sapiens
uggaggaagccuugacuau

SEQ ID NO: 839866 - RNA, 19 nt, Homo sapiens
gggaagauuguggaugcua

SEQ ID NO: 839867 - RNA, 19 nt, Homo sapiens
uaucucaaaucugugaagu

SEQ ID NO: 839868 - RNA, 19 nt, Homo sapiens
ccagcucauuagccacuga

SEQ ID NO: 839869 - RNA, 19 nt, Homo sapiens
gaugaaaaggggaagauug

SEQ ID NO: 839870 - RNA, 19 nt, Homo sapiens
ucacaagaagguaucucaa

SEQ ID NO: 839871 - RNA, 19 nt, Homo sapiens
gccgcuuccucuccacuga

SEQ ID NO: 839872 - RNA, 19 nt, Homo sapiens
agaaccaauuguuguacau

SEQ ID NO: 839873 - RNA, 19 nt, Homo sapiens
guucugaauccugugguuu

SEQ ID NO: 839874 - RNA, 19 nt, Homo sapiens
auacuugcuguucacguua

SEQ ID NO: 839875 - RNA, 19 nt, Homo sapiens
gcaggccacaccagcuguu

SEQ ID NO: 839876 - RNA, 19 nt, Homo sapiens
gcacuaaaccugauagaaa

SEQ ID NO: 839877 - RNA, 19 nt, Homo sapiens
caaauuugccuguauguuu

SEQ ID NO: 839878 - RNA, 19 nt, Homo sapiens
gaaacucacagaauacaaa

SEQ ID NO: 839879 - RNA, 19 nt, Homo sapiens
guugguggcugaauacauu

SEQ ID NO: 839880 - RNA, 19 nt, Homo sapiens
gaaaagaauuccagaagau

SEQ ID NO: 839881 - RNA, 19 nt, Homo sapiens
gggauucauuggcuucuuu

SEQ ID NO: 839882 - RNA, 19 nt, Homo sapiens
ccaagucggcaguuuguaa

SEQ ID NO: 839883 - RNA, 19 nt, Homo sapiens
ggcaacagcaauaggauuu

SEQ ID NO: 839884 - RNA, 19 nt, Homo sapiens
gguaggcagucauggauca

SEQ ID NO: 839885 - RNA, 19 nt, Homo sapiens
cauuguugguggcugaaua

SEQ ID NO: 839886 - RNA, 19 nt, Homo sapiens
uucauuggcuucuuuguga

SEQ ID NO: 839887 - RNA, 19 nt, Homo sapiens
gaucagguaaugcaguuug

SEQ ID NO: 839888 - RNA, 19 nt, Homo sapiens
agagauuggugaacaagug

SEQ ID NO: 839889 - RNA, 19 nt, Homo sapiens
gauuugcuauaaugggauu

SEQ ID NO: 839890 - RNA, 19 nt, Homo sapiens
caagucggcaguuuguaaa

SEQ ID NO: 839891 - RNA, 19 nt, Homo sapiens
ugaaauugauccauauucc

SEQ ID NO: 839892 - RNA, 19 nt, Homo sapiens
aaagaauuccagaagauug

SEQ ID NO: 839893 - RNA, 19 nt, Homo sapiens
guuaaaagaugcacuaaac

SEQ ID NO: 839894 - RNA, 19 nt, Homo sapiens
agucauggaucagguaaug

SEQ ID NO: 839895 - RNA, 19 nt, Homo sapiens
gagccaagucggcaguuug

SEQ ID NO: 839896 - RNA, 19 nt, Homo sapiens
gagaaacucacagaauaca

SEQ ID NO: 839897 - RNA, 19 nt, Homo sapiens
gcagucauggaucagguaa

SEQ ID NO: 839898 - RNA, 19 nt, Homo sapiens
cacuaaaccugauagaaaa

SEQ ID NO: 839899 - RNA, 19 nt, Homo sapiens
cuacgugucccuggcauuu

SEQ ID NO: 839900 - RNA, 19 nt, Homo sapiens
uggaucagguaaugcaguu

SEQ ID NO: 839901 - RNA, 19 nt, Homo sapiens
ggacuccauucggcugguu

SEQ ID NO: 839902 - RNA, 19 nt, Homo sapiens
agaaaagaauuccagaaga

SEQ ID NO: 839903 - RNA, 19 nt, Homo sapiens
cagguaaugcaguuuguug

SEQ ID NO: 839904 - RNA, 19 nt, Homo sapiens
gcaacagcaauaggauuug

SEQ ID NO: 839905 - RNA, 19 nt, Homo sapiens
gaaauugauccauauuccu

SEQ ID NO: 839906 - RNA, 19 nt, Homo sapiens
uggcuucuuugugaaauug

SEQ ID NO: 839907 - RNA, 19 nt, Homo sapiens
ugagccaagucggcaguuu

SEQ ID NO: 839908 - RNA, 19 nt, Homo sapiens
gcaguuuguugagccaagu

SEQ ID NO: 839909 - RNA, 19 nt, Homo sapiens
gaauacauuuuggaagaga

SEQ ID NO: 839910 - RNA, 19 nt, Homo sapiens
cugaauacauuuuggaaga

SEQ ID NO: 839911 - RNA, 19 nt, Homo sapiens
gugaaauugauccauauuc

SEQ ID NO: 839912 - RNA, 19 nt, Homo sapiens
gucggcaguuuguaaagga

SEQ ID NO: 839913 - RNA, 19 nt, Homo sapiens
caagugugagggugugaga

SEQ ID NO: 839914 - RNA, 19 nt, Homo sapiens
gagauuggugaacaagugu

SEQ ID NO: 839915 - RNA, 19 nt, Homo sapiens
cuuagagauuggugaacaa

SEQ ID NO: 839916 - RNA, 19 nt, Homo sapiens
ucuuagagauuggugaaca

SEQ ID NO: 839917 - RNA, 19 nt, Homo sapiens
gauuggugaacaaguguga

SEQ ID NO: 839918 - RNA, 19 nt, Homo sapiens
aagaugcacuaaaccugau

SEQ ID NO: 839919 - RNA, 19 nt, Homo sapiens
ucacagaauacaaauuugc

SEQ ID NO: 839920 - RNA, 19 nt, Homo sapiens
ucauuggcuucuuugugaa

SEQ ID NO: 839921 - RNA, 19 nt, Homo sapiens
cauggcaacagcaauagga

SEQ ID NO: 839922 - RNA, 19 nt, Homo sapiens
gguaaugcaguuuguugag

SEQ ID NO: 839923 - RNA, 19 nt, Homo sapiens
ggauucauuggcuucuuug

SEQ ID NO: 839924 - RNA, 19 nt, Homo sapiens
ccaacaagcuggcggagaa

SEQ ID NO: 839925 - RNA, 19 nt, Homo sapiens
gaacaaagcccggaagaag

SEQ ID NO: 839926 - RNA, 19 nt, Homo sapiens
ugaagaagcgggagaagua

SEQ ID NO: 839927 - RNA, 19 nt, Homo sapiens
caacgaaggugauggugau

SEQ ID NO: 839928 - RNA, 19 nt, Homo sapiens
gaaggaaggagauuacguu

SEQ ID NO: 839929 - RNA, 19 nt, Homo sapiens
cagcagaccucagucauug

SEQ ID NO: 839930 - RNA, 19 nt, Homo sapiens
ccuugaagcuggaggauaa

SEQ ID NO: 839931 - RNA, 19 nt, Homo sapiens
gagcuuggcugacuuuagg

SEQ ID NO: 839932 - RNA, 19 nt, Homo sapiens
acaauaagcccaacuacaa

SEQ ID NO: 839933 - RNA, 19 nt, Homo sapiens
gggagcauuuguuauuaaa

SEQ ID NO: 839934 - RNA, 19 nt, Homo sapiens
ggaacacuguagagcguuu

SEQ ID NO: 839935 - RNA, 19 nt, Homo sapiens
ucaacaaguuccgugaaua

SEQ ID NO: 839936 - RNA, 19 nt, Homo sapiens
ccagaggaccuaaguguga

SEQ ID NO: 839937 - RNA, 19 nt, Homo sapiens
ccaagcgccuggccauuau

SEQ ID NO: 839938 - RNA, 19 nt, Homo sapiens
cgaaggugauggugaugaa

SEQ ID NO: 839939 - RNA, 19 nt, Homo sapiens
uaucaaagacaucagguuu

SEQ ID NO: 839940 - RNA, 19 nt, Homo sapiens
gaagaagaaguaugaacga

SEQ ID NO: 839941 - RNA, 19 nt, Homo sapiens
ggaaguggagcucccugua

SEQ ID NO: 839942 - RNA, 19 nt, Homo sapiens
ccauuaugaugaugaagaa

SEQ ID NO: 839943 - RNA, 19 nt, Homo sapiens
cgacagacguggacuacag

SEQ ID NO: 839944 - RNA, 19 nt, Homo sapiens
caauaagcccaacuacaaa

SEQ ID NO: 839945 - RNA, 19 nt, Homo sapiens
caaguuccgugaauacaag

SEQ ID NO: 839946 - RNA, 19 nt, Homo sapiens
gcuggugccuggucagaga

SEQ ID NO: 839947 - RNA, 19 nt, Homo sapiens
ucacuucuccuccuccuuu

SEQ ID NO: 839948 - RNA, 19 nt, Homo sapiens
gcagcagaccucagucauu

SEQ ID NO: 839949 - RNA, 19 nt, Homo sapiens
ucaaaggcauuuacuacca

SEQ ID NO: 839950 - RNA, 19 nt, Homo sapiens
aaacacaagaagaagguua

SEQ ID NO: 839951 - RNA, 19 nt, Homo sapiens
gcccuggccuucaucauca

SEQ ID NO: 839952 - RNA, 19 nt, Homo sapiens
ugggaggccuugagaagaa

SEQ ID NO: 839953 - RNA, 19 nt, Homo sapiens
ucaaagacaucagguuucu

SEQ ID NO: 839954 - RNA, 19 nt, Homo sapiens
gcggugaggucugagaaga

SEQ ID NO: 839955 - RNA, 19 nt, Homo sapiens
ggaagaagcccagggugau

SEQ ID NO: 839956 - RNA, 19 nt, Homo sapiens
gaguucaugcacuacauua

SEQ ID NO: 839957 - RNA, 19 nt, Homo sapiens
gaacccaaacacaagaaga

SEQ ID NO: 839958 - RNA, 19 nt, Homo sapiens
cagaagaggaggaggaaga

SEQ ID NO: 839959 - RNA, 19 nt, Homo sapiens
gaacacuguagagcguuua

SEQ ID NO: 839960 - RNA, 19 nt, Homo sapiens
caacaaguuccgugaauac

SEQ ID NO: 839961 - RNA, 19 nt, Homo sapiens
acaagaagaagguuaacaa

SEQ ID NO: 839962 - RNA, 19 nt, Homo sapiens
uuaaaugacuggacuuuug

SEQ ID NO: 839963 - RNA, 19 nt, Homo sapiens
ccacaccuuucacccuuug

SEQ ID NO: 839964 - RNA, 19 nt, Homo sapiens
ggaacaaagcccggaagaa

SEQ ID NO: 839965 - RNA, 19 nt, Homo sapiens
gaagaagcccagggugaug

SEQ ID NO: 839966 - RNA, 19 nt, Homo sapiens
ggaagaggacgacaacaac

SEQ ID NO: 839967 - RNA, 19 nt, Homo sapiens
ccgcaucacccaucagauu

SEQ ID NO: 839968 - RNA, 19 nt, Homo sapiens
gcccgaacguuuuaccuua

SEQ ID NO: 839969 - RNA, 19 nt, Homo sapiens
caucaaaggcauuuacuac

SEQ ID NO: 839970 - RNA, 19 nt, Homo sapiens
gggaagagcgaguggaaca

SEQ ID NO: 839971 - RNA, 19 nt, Homo sapiens
gcagaggcugguucagaaa

SEQ ID NO: 839972 - RNA, 19 nt, Homo sapiens
ugcagaggcugguucagaa

SEQ ID NO: 839973 - RNA, 19 nt, Homo sapiens
gucaacaaguuccgugaau

SEQ ID NO: 839974 - RNA, 19 nt, Homo sapiens
gcggaaagcccacgaugag

SEQ ID NO: 839975 - RNA, 19 nt, Homo sapiens
gacaauaagcccaacuaca

SEQ ID NO: 839976 - RNA, 19 nt, Homo sapiens
cuacaucacccggaacaaa

SEQ ID NO: 839977 - RNA, 19 nt, Homo sapiens
gaugggaggccuugagaag

SEQ ID NO: 839978 - RNA, 19 nt, Homo sapiens
ggugaggucugagaagaag

SEQ ID NO: 839979 - RNA, 19 nt, Homo sapiens
caaacucgaccacaucauc

SEQ ID NO: 839980 - RNA, 19 nt, Homo sapiens
gaaguggagcucccuguac

SEQ ID NO: 839981 - RNA, 19 nt, Homo sapiens
gccuugagaagaagaagua

SEQ ID NO: 839982 - RNA, 19 nt, Homo sapiens
caacaacgaaggugauggu

SEQ ID NO: 839983 - RNA, 19 nt, Homo sapiens
ggaguucaugcacuacauu

SEQ ID NO: 839984 - RNA, 19 nt, Homo sapiens
gaggcucggccaccaacua

SEQ ID NO: 839985 - RNA, 19 nt, Homo sapiens
ccuaugccuucucccauga

SEQ ID NO: 839986 - RNA, 19 nt, Homo sapiens
gacgaugcccucuccaugu

SEQ ID NO: 839987 - RNA, 19 nt, Homo sapiens
uugagaagaagaaguauga

SEQ ID NO: 839988 - RNA, 19 nt, Homo sapiens
uacagcagcccgaacguuu

SEQ ID NO: 839989 - RNA, 19 nt, Homo sapiens
ggggagcauuuguuauuaa

SEQ ID NO: 839990 - RNA, 19 nt, Homo sapiens
ggccagaggaccuaagugu

SEQ ID NO: 839991 - RNA, 19 nt, Homo sapiens
uuugucaacuuccgccuuu

SEQ ID NO: 839992 - RNA, 19 nt, Homo sapiens
gcugggcuuugucaacuuc

SEQ ID NO: 839993 - RNA, 19 nt, Homo sapiens
caagaagaagguuaacaag

SEQ ID NO: 839994 - RNA, 19 nt, Homo sapiens
guaccagaagaucauguuu

SEQ ID NO: 839995 - RNA, 19 nt, Homo sapiens
gccauuaugaugaugaaga

SEQ ID NO: 839996 - RNA, 19 nt, Homo sapiens
ggaggaagaggacgacaac

SEQ ID NO: 839997 - RNA, 19 nt, Homo sapiens
gagaagaagaaguaugaac

SEQ ID NO: 839998 - RNA, 19 nt, Homo sapiens
cgagaguuguauggagaaa

SEQ ID NO: 839999 - RNA, 19 nt, Homo sapiens
gcaaggucuuccuguccau

SEQ ID NO: 840000 - RNA, 19 nt, Homo sapiens
ggacaauaagcccaacuac

SEQ ID NO: 840001 - RNA, 19 nt, Homo sapiens
gaaggcaaggccggaguga

SEQ ID NO: 840002 - RNA, 19 nt, Homo sapiens
ggacgacaacaacgaaggu

SEQ ID NO: 840003 - RNA, 19 nt, Homo sapiens
ccgagaaggaaggagauua

SEQ ID NO: 840004 - RNA, 19 nt, Homo sapiens
ccaaacacaagaagaaggu

SEQ ID NO: 840005 - RNA, 19 nt, Homo sapiens
guucaugcacuacauuauc

SEQ ID NO: 840006 - RNA, 19 nt, Homo sapiens
gcgccuggccauuaugaug

SEQ ID NO: 840007 - RNA, 19 nt, Homo sapiens
cgacaacaacgaaggugau

SEQ ID NO: 840008 - RNA, 19 nt, Homo sapiens
aggccgagguggaugaguu

SEQ ID NO: 840009 - RNA, 19 nt, Homo sapiens
cuacaaacucgaccacauc

SEQ ID NO: 840010 - RNA, 19 nt, Homo sapiens
ccacgaacccauugucaac

SEQ ID NO: 840011 - RNA, 19 nt, Homo sapiens
accagaagaucauguuugg

SEQ ID NO: 840012 - RNA, 19 nt, Homo sapiens
gcgaugggaggccuugaga

SEQ ID NO: 840013 - RNA, 19 nt, Homo sapiens
ggccaccuaugacgucaca

SEQ ID NO: 840014 - RNA, 19 nt, Homo sapiens
gaugucagcgcaggaggaa

SEQ ID NO: 840015 - RNA, 19 nt, Homo sapiens
gcugagcuuggcugacuuu

SEQ ID NO: 840016 - RNA, 19 nt, Homo sapiens
ccacgcugcugggcuuugu

SEQ ID NO: 840017 - RNA, 19 nt, Homo sapiens
ccaucaaaggcauuuacua

SEQ ID NO: 840018 - RNA, 19 nt, Homo sapiens
caucaucaaggaacgguau

SEQ ID NO: 840019 - RNA, 19 nt, Homo sapiens
aggcggcugugcauucuga

SEQ ID NO: 840020 - RNA, 19 nt, Homo sapiens
cguuuuaccuuaucaaaga

SEQ ID NO: 840021 - RNA, 19 nt, Homo sapiens
cagaggaccuaagugugau

SEQ ID NO: 840022 - RNA, 19 nt, Homo sapiens
aagaucauguuuggcaaga

SEQ ID NO: 840023 - RNA, 19 nt, Homo sapiens
cgagaaggaaggagauuac

SEQ ID NO: 840024 - RNA, 19 nt, Homo sapiens
gaaauuaagugaccaaaug

SEQ ID NO: 840025 - RNA, 19 nt, Homo sapiens
gaaagucucugaaauguuc

SEQ ID NO: 840026 - RNA, 19 nt, Homo sapiens
caaaugaagugcacucuuu

SEQ ID NO: 840027 - RNA, 19 nt, Homo sapiens
gaaaccaggugaaauuuau

SEQ ID NO: 840028 - RNA, 19 nt, Homo sapiens
caauauaaguuuccaguug

SEQ ID NO: 840029 - RNA, 19 nt, Homo sapiens
cagcacagaugaaguauau

SEQ ID NO: 840030 - RNA, 19 nt, Homo sapiens
gaucauaaaucuagacaag

SEQ ID NO: 840031 - RNA, 19 nt, Homo sapiens
gacaugagauacccaauga

SEQ ID NO: 840032 - RNA, 19 nt, Homo sapiens
guacgugccuuugaguuua

SEQ ID NO: 840033 - RNA, 19 nt, Homo sapiens
gcagaaugccucaaucuuu

SEQ ID NO: 840034 - RNA, 19 nt, Homo sapiens
guacuggcauagaauuuaa

SEQ ID NO: 840035 - RNA, 19 nt, Homo sapiens
acaagaaacuuccuuuaug

SEQ ID NO: 840036 - RNA, 19 nt, Homo sapiens
gaagugcacucuuuucuuu

SEQ ID NO: 840037 - RNA, 19 nt, Homo sapiens
ggaaaccaggugaaauuua

SEQ ID NO: 840038 - RNA, 19 nt, Homo sapiens
ggaagauuauccaaacuau

SEQ ID NO: 840039 - RNA, 19 nt, Homo sapiens
gguaagugcugcucaugaa

SEQ ID NO: 840040 - RNA, 19 nt, Homo sapiens
ggaaauaauagguguagaa

SEQ ID NO: 840041 - RNA, 19 nt, Homo sapiens
cagaaugccucaaucuuug

SEQ ID NO: 840042 - RNA, 19 nt, Homo sapiens
ggaaagaaggaauaaagaa

SEQ ID NO: 840043 - RNA, 19 nt, Homo sapiens
gaacuaauacaacugauca

SEQ ID NO: 840044 - RNA, 19 nt, Homo sapiens
ggucagggcuucaaacaag

SEQ ID NO: 840045 - RNA, 19 nt, Homo sapiens
uaaagugccuuggaaagaa

SEQ ID NO: 840046 - RNA, 19 nt, Homo sapiens
ccacaucaauauccagaaa

SEQ ID NO: 840047 - RNA, 19 nt, Homo sapiens
acaagaagcaguaauguuu

SEQ ID NO: 840048 - RNA, 19 nt, Homo sapiens
gaguggagaaguuuauuua

SEQ ID NO: 840049 - RNA, 19 nt, Homo sapiens
agagaaguguguaaaguuu

SEQ ID NO: 840050 - RNA, 19 nt, Homo sapiens
ccaaagaacuaauacaacu

SEQ ID NO: 840051 - RNA, 19 nt, Homo sapiens
ggcaauauaggaugucuua

SEQ ID NO: 840052 - RNA, 19 nt, Homo sapiens
ucaaagagaccaauucaga

SEQ ID NO: 840053 - RNA, 19 nt, Homo sapiens
uaagaaagucucugaaaug

SEQ ID NO: 840054 - RNA, 19 nt, Homo sapiens
caagaagcaguaauguuua

SEQ ID NO: 840055 - RNA, 19 nt, Homo sapiens
gaacucagugccuaagaaa

SEQ ID NO: 840056 - RNA, 19 nt, Homo sapiens
gaccuaaagugccuuggaa

SEQ ID NO: 840057 - RNA, 19 nt, Homo sapiens
caagaaacuuccuuuaugc

SEQ ID NO: 840058 - RNA, 19 nt, Homo sapiens
gauugucucuuuaguggaa

SEQ ID NO: 840059 - RNA, 19 nt, Homo sapiens
cuaagaaagucucugaaau

SEQ ID NO: 840060 - RNA, 19 nt, Homo sapiens
gccaagugguaugaaauua

SEQ ID NO: 840061 - RNA, 19 nt, Homo sapiens
guggagaaguuuauuuaug

SEQ ID NO: 840062 - RNA, 19 nt, Homo sapiens
gaagaaaguuauccuaccu

SEQ ID NO: 840063 - RNA, 19 nt, Homo sapiens
uaagagaaguguguaaagu

SEQ ID NO: 840064 - RNA, 19 nt, Homo sapiens
cacauaugauugucucuuu

SEQ ID NO: 840065 - RNA, 19 nt, Homo sapiens
gaucaaagagaccaauuca

SEQ ID NO: 840066 - RNA, 19 nt, Homo sapiens
gaguuuaccuauguuaaug

SEQ ID NO: 840067 - RNA, 19 nt, Homo sapiens
uagacaagcuggauuacug

SEQ ID NO: 840068 - RNA, 19 nt, Homo sapiens
guagaagacucucccuaag

SEQ ID NO: 840069 - RNA, 19 nt, Homo sapiens
caagugguaugaaauuaag

SEQ ID NO: 840070 - RNA, 19 nt, Homo sapiens
cagaaaagguuauuccaaa

SEQ ID NO: 840071 - RNA, 19 nt, Homo sapiens
acauguagaucuuucauuc

SEQ ID NO: 840072 - RNA, 19 nt, Homo sapiens
aauaauagguguagaagac

SEQ ID NO: 840073 - RNA, 19 nt, Homo sapiens
acaaacacauguagaucuu

SEQ ID NO: 840074 - RNA, 19 nt, Homo sapiens
ggaacaaaauagaagcaua

SEQ ID NO: 840075 - RNA, 19 nt, Homo sapiens
caaacaagaaacuuccuuu

SEQ ID NO: 840076 - RNA, 19 nt, Homo sapiens
gcacagaugaaguauaugg

SEQ ID NO: 840077 - RNA, 19 nt, Homo sapiens
aaacacauguagaucuuuc

SEQ ID NO: 840078 - RNA, 19 nt, Homo sapiens
aagaaagucucugaaaugu

SEQ ID NO: 840079 - RNA, 19 nt, Homo sapiens
ccaagugguaugaaauuaa

SEQ ID NO: 840080 - RNA, 19 nt, Homo sapiens
ugaacucagugccuaagaa

SEQ ID NO: 840081 - RNA, 19 nt, Homo sapiens
uuagaacccuuuccgguau

SEQ ID NO: 840082 - RNA, 19 nt, Homo sapiens
ccaccaaugacaugagaua

SEQ ID NO: 840083 - RNA, 19 nt, Homo sapiens
gaaauaauagguguagaag

SEQ ID NO: 840084 - RNA, 19 nt, Homo sapiens
gaguuucaguacuggcaua

SEQ ID NO: 840085 - RNA, 19 nt, Homo sapiens
uauccuaccucgccaagug

SEQ ID NO: 840086 - RNA, 19 nt, Homo sapiens
ccgguauaaucaccauuua

SEQ ID NO: 840087 - RNA, 19 nt, Homo sapiens
uuucagaccauacucuuua

SEQ ID NO: 840088 - RNA, 19 nt, Homo sapiens
ggagaaguuuauuuauguc

SEQ ID NO: 840089 - RNA, 19 nt, Homo sapiens
uauacagggugacauaugu

SEQ ID NO: 840090 - RNA, 19 nt, Homo sapiens
cggcggugcugguuucauu

SEQ ID NO: 840091 - RNA, 19 nt, Homo sapiens
gcuaucauugccuuaauaa

SEQ ID NO: 840092 - RNA, 19 nt, Homo sapiens
uauaacaucggaaccaauu

SEQ ID NO: 840093 - RNA, 19 nt, Homo sapiens
agaagcauaucuaacacuu

SEQ ID NO: 840094 - RNA, 19 nt, Homo sapiens
uuucacaacuggaagaaug

SEQ ID NO: 840095 - RNA, 19 nt, Homo sapiens
gauacccaaugaagucaga

SEQ ID NO: 840096 - RNA, 19 nt, Homo sapiens
uacaaauccuuaugcauca

SEQ ID NO: 840097 - RNA, 19 nt, Homo sapiens
gaagcauaucuaacacuuu

SEQ ID NO: 840098 - RNA, 19 nt, Homo sapiens
auacauggcuuaggaugga

SEQ ID NO: 840099 - RNA, 19 nt, Homo sapiens
uaugguggcagucuugaua

SEQ ID NO: 840100 - RNA, 19 nt, Homo sapiens
gaacuucccugcgcuuuuc

SEQ ID NO: 840101 - RNA, 19 nt, Homo sapiens
ccuaagaaagucucugaaa

SEQ ID NO: 840102 - RNA, 19 nt, Homo sapiens
uguagaagacucucccuaa

SEQ ID NO: 840103 - RNA, 19 nt, Homo sapiens
gaaacuaggaaauaauagg

SEQ ID NO: 840104 - RNA, 19 nt, Homo sapiens
gggaaaccaggugaaauuu

SEQ ID NO: 840105 - RNA, 19 nt, Homo sapiens
ugucagcacagaugaagua

SEQ ID NO: 840106 - RNA, 19 nt, Homo sapiens
gcacaaacacauguagauc

SEQ ID NO: 840107 - RNA, 19 nt, Homo sapiens
uagaacccuuuccgguaua

SEQ ID NO: 840108 - RNA, 19 nt, Homo sapiens
uuucaguacuggcauagaa

SEQ ID NO: 840109 - RNA, 19 nt, Homo sapiens
ucauaaaucuagacaagcu

SEQ ID NO: 840110 - RNA, 19 nt, Homo sapiens
ccaaacaaccuacaaaucc

SEQ ID NO: 840111 - RNA, 19 nt, Homo sapiens
ugugcaagcuugaagaauc

SEQ ID NO: 840112 - RNA, 19 nt, Homo sapiens
ccuuugaguuuaccuaugu

SEQ ID NO: 840113 - RNA, 19 nt, Homo sapiens
ggcauagaauuuaaauguc

SEQ ID NO: 840114 - RNA, 19 nt, Homo sapiens
uaagugaccaaaugaagug

SEQ ID NO: 840115 - RNA, 19 nt, Homo sapiens
gugcaagcuugaagaaucu

SEQ ID NO: 840116 - RNA, 19 nt, Homo sapiens
cuaaagugccuuggaaaga

SEQ ID NO: 840117 - RNA, 19 nt, Homo sapiens
caaacaaccuacaaauccu

SEQ ID NO: 840118 - RNA, 19 nt, Homo sapiens
cuaacaaacagaacuacaa

SEQ ID NO: 840119 - RNA, 19 nt, Homo sapiens
ccuaauucaccauuucuuu

SEQ ID NO: 840120 - RNA, 19 nt, Homo sapiens
ugagauacccaaugaaguc

SEQ ID NO: 840121 - RNA, 19 nt, Homo sapiens
gauagacccaccaaugaca

SEQ ID NO: 840122 - RNA, 19 nt, Homo sapiens
aaugauagacccaccaaug

SEQ ID NO: 840123 - RNA, 19 nt, Homo sapiens
gaagcaguaauguuuaugg

SEQ ID NO: 840124 - RNA, 19 nt, Homo sapiens
gaaaguggcuugugguauu

SEQ ID NO: 840125 - RNA, 19 nt, Homo sapiens
gaacuugccaucuuucuua

SEQ ID NO: 840126 - RNA, 19 nt, Homo sapiens
gagacuugcugaaggauua

SEQ ID NO: 840127 - RNA, 19 nt, Homo sapiens
gaucugcuguuuccuuaua

SEQ ID NO: 840128 - RNA, 19 nt, Homo sapiens
gaugugcccuuccaauaua

SEQ ID NO: 840129 - RNA, 19 nt, Homo sapiens
guaaggaacuugccaucuu

SEQ ID NO: 840130 - RNA, 19 nt, Homo sapiens
gaguaacgcuuguaaggaa

SEQ ID NO: 840131 - RNA, 19 nt, Homo sapiens
uaacagcugcguauuauuu

SEQ ID NO: 840132 - RNA, 19 nt, Homo sapiens
uaacuuaagccaugacuuu

SEQ ID NO: 840133 - RNA, 19 nt, Homo sapiens
caugauagaucugcuguuu

SEQ ID NO: 840134 - RNA, 19 nt, Homo sapiens
guauaccucugaacuguuu

SEQ ID NO: 840135 - RNA, 19 nt, Homo sapiens
gagggacaguuguauguuu

SEQ ID NO: 840136 - RNA, 19 nt, Homo sapiens
uaaggaacuugccaucuuu

SEQ ID NO: 840137 - RNA, 19 nt, Homo sapiens
ugacuuauuugguauguug

SEQ ID NO: 840138 - RNA, 19 nt, Homo sapiens
uauagcagcuucagaaaca

SEQ ID NO: 840139 - RNA, 19 nt, Homo sapiens
gaagauuaguggaugauac

SEQ ID NO: 840140 - RNA, 19 nt, Homo sapiens
uagaucugcuguuuccuua

SEQ ID NO: 840141 - RNA, 19 nt, Homo sapiens
uuagagagcuggugagaca

SEQ ID NO: 840142 - RNA, 19 nt, Homo sapiens
cuaucaaccuuucauguuu

SEQ ID NO: 840143 - RNA, 19 nt, Homo sapiens
guaaucauuugcauugguu

SEQ ID NO: 840144 - RNA, 19 nt, Homo sapiens
ggaaaagcuugacugauuu

SEQ ID NO: 840145 - RNA, 19 nt, Homo sapiens
caagaagauuaguggauga

SEQ ID NO: 840146 - RNA, 19 nt, Homo sapiens
guucagauuucaagaggaa

SEQ ID NO: 840147 - RNA, 19 nt, Homo sapiens
ugaaauuugugaucuccua

SEQ ID NO: 840148 - RNA, 19 nt, Homo sapiens
gauacaacauuaccauucu

SEQ ID NO: 840149 - RNA, 19 nt, Homo sapiens
gcuaguuacuugagauaug

SEQ ID NO: 840150 - RNA, 19 nt, Homo sapiens
ccacuuggccacagacuuu

SEQ ID NO: 840151 - RNA, 19 nt, Homo sapiens
cugcauagcaagaagauua

SEQ ID NO: 840152 - RNA, 19 nt, Homo sapiens
aaaguggcuugugguauua

SEQ ID NO: 840153 - RNA, 19 nt, Homo sapiens
aaccaggcaugaucaauuu

SEQ ID NO: 840154 - RNA, 19 nt, Homo sapiens
ggugcucccuucucacuuu

SEQ ID NO: 840155 - RNA, 19 nt, Homo sapiens
ugacugauuucacacuuau

SEQ ID NO: 840156 - RNA, 19 nt, Homo sapiens
gaaacacagucaucuuugc

SEQ ID NO: 840157 - RNA, 19 nt, Homo sapiens
ggaaacacagucaucuuug

SEQ ID NO: 840158 - RNA, 19 nt, Homo sapiens
caacauuaccauucuucua

SEQ ID NO: 840159 - RNA, 19 nt, Homo sapiens
ggaugugcccuuccaauau

SEQ ID NO: 840160 - RNA, 19 nt, Homo sapiens
caaauggacuuccugucau

SEQ ID NO: 840161 - RNA, 19 nt, Homo sapiens
auacagaugcuaugaguaa

SEQ ID NO: 840162 - RNA, 19 nt, Homo sapiens
ucuuugaccuuguauacua

SEQ ID NO: 840163 - RNA, 19 nt, Homo sapiens
ucuaacagcugcguauuau

SEQ ID NO: 840164 - RNA, 19 nt, Homo sapiens
acacuuaucuauaguaugc

SEQ ID NO: 840165 - RNA, 19 nt, Homo sapiens
gugguguccugcugaauuu

SEQ ID NO: 840166 - RNA, 19 nt, Homo sapiens
uaaccaggcaugaucaauu

SEQ ID NO: 840167 - RNA, 19 nt, Homo sapiens
uggaaaagcuugacugauu

SEQ ID NO: 840168 - RNA, 19 nt, Homo sapiens
caggcaugaucaauuuaua

SEQ ID NO: 840169 - RNA, 19 nt, Homo sapiens
caucauauaugccagaaaa

SEQ ID NO: 840170 - RNA, 19 nt, Homo sapiens
aagccaaguuuccuguaua

SEQ ID NO: 840171 - RNA, 19 nt, Homo sapiens
ucaaauggacuuccuguca

SEQ ID NO: 840172 - RNA, 19 nt, Homo sapiens
uaagccaaguuuccuguau

SEQ ID NO: 840173 - RNA, 19 nt, Homo sapiens
acagucaucuuugcaacua

SEQ ID NO: 840174 - RNA, 19 nt, Homo sapiens
gcauugucgugucagcuuu

SEQ ID NO: 840175 - RNA, 19 nt, Homo sapiens
cuaguuacuugagauauga

SEQ ID NO: 840176 - RNA, 19 nt, Homo sapiens
gaucuccuaucaaccuuuc

SEQ ID NO: 840177 - RNA, 19 nt, Homo sapiens
cguuaaggguuguugguuu

SEQ ID NO: 840178 - RNA, 19 nt, Homo sapiens
uggacucccuauuguauuu

SEQ ID NO: 840179 - RNA, 19 nt, Homo sapiens
uggcaggcaucaaagcuuu

SEQ ID NO: 840180 - RNA, 19 nt, Homo sapiens
ucaaguuggucugacagua

SEQ ID NO: 840181 - RNA, 19 nt, Homo sapiens
aauaugcacugauacaaca

SEQ ID NO: 840182 - RNA, 19 nt, Homo sapiens
gacauugaaauuccaguuu

SEQ ID NO: 840183 - RNA, 19 nt, Homo sapiens
uagccuccauuauuacaaa

SEQ ID NO: 840184 - RNA, 19 nt, Homo sapiens
uuacauccuuucaccuauu

SEQ ID NO: 840185 - RNA, 19 nt, Homo sapiens
acagagacuugcugaagga

SEQ ID NO: 840186 - RNA, 19 nt, Homo sapiens
ggaagcaggacgaaauauc

SEQ ID NO: 840187 - RNA, 19 nt, Homo sapiens
cuauauagcagcuucagaa

SEQ ID NO: 840188 - RNA, 19 nt, Homo sapiens
gcuaugccguacauucaga

SEQ ID NO: 840189 - RNA, 19 nt, Homo sapiens
gcacuuguucucacaggaa

SEQ ID NO: 840190 - RNA, 19 nt, Homo sapiens
ugauacagaugcuaugagu

SEQ ID NO: 840191 - RNA, 19 nt, Homo sapiens
auagugcugucucugauuu

SEQ ID NO: 840192 - RNA, 19 nt, Homo sapiens
caaguuggucugacaguau

SEQ ID NO: 840193 - RNA, 19 nt, Homo sapiens
gauuuagaccaugguaaua

SEQ ID NO: 840194 - RNA, 19 nt, Homo sapiens
agucaucuuugcaacuaua

SEQ ID NO: 840195 - RNA, 19 nt, Homo sapiens
ggaaucaauaugcaauguu

SEQ ID NO: 840196 - RNA, 19 nt, Homo sapiens
aagcuugacugauuucaca

SEQ ID NO: 840197 - RNA, 19 nt, Homo sapiens
gaaggugcagguacacaug

SEQ ID NO: 840198 - RNA, 19 nt, Homo sapiens
ggucguuuacaucuaauaa

SEQ ID NO: 840199 - RNA, 19 nt, Homo sapiens
ggagcaaucggacugaugu

SEQ ID NO: 840200 - RNA, 19 nt, Homo sapiens
ccucugaacuguuuugauu

SEQ ID NO: 840201 - RNA, 19 nt, Homo sapiens
uuucaggaguggguuauaa

SEQ ID NO: 840202 - RNA, 19 nt, Homo sapiens
acugaacuauugucaaaug

SEQ ID NO: 840203 - RNA, 19 nt, Homo sapiens
gaugauacagaugcuauga

SEQ ID NO: 840204 - RNA, 19 nt, Homo sapiens
gaauaugcacugauacaac

SEQ ID NO: 840205 - RNA, 19 nt, Homo sapiens
gaagcaggacgaaauaucg

SEQ ID NO: 840206 - RNA, 19 nt, Homo sapiens
uugauuaguuuguccuuug

SEQ ID NO: 840207 - RNA, 19 nt, Homo sapiens
aguggucguuuacaucuaa

SEQ ID NO: 840208 - RNA, 19 nt, Homo sapiens
ugauagaucugcuguuucc

SEQ ID NO: 840209 - RNA, 19 nt, Homo sapiens
ggacuuccugucauuuguu

SEQ ID NO: 840210 - RNA, 19 nt, Homo sapiens
uaauugcauuggcagcauu

SEQ ID NO: 840211 - RNA, 19 nt, Homo sapiens
agaggaaggugcagguaca

SEQ ID NO: 840212 - RNA, 19 nt, Homo sapiens
cuuguuagucuuacagaua

SEQ ID NO: 840213 - RNA, 19 nt, Homo sapiens
gaaauuugugaucuccuau

SEQ ID NO: 840214 - RNA, 19 nt, Homo sapiens
caguuaaugcugaauggua

SEQ ID NO: 840215 - RNA, 19 nt, Homo sapiens
ccuaucaaccuuucauguu

SEQ ID NO: 840216 - RNA, 19 nt, Homo sapiens
uagagugaguugcaaugug

SEQ ID NO: 840217 - RNA, 19 nt, Homo sapiens
caucuuugcaacuauacua

SEQ ID NO: 840218 - RNA, 19 nt, Homo sapiens
aggaaacacagucaucuuu

SEQ ID NO: 840219 - RNA, 19 nt, Homo sapiens
ggaacuugccaucuuucuu

SEQ ID NO: 840220 - RNA, 19 nt, Homo sapiens
gugcacugcuacuguuuua

SEQ ID NO: 840221 - RNA, 19 nt, Homo sapiens
uaauugcuaugccguacau

SEQ ID NO: 840222 - RNA, 19 nt, Homo sapiens
gaugagggacaguuguaug

SEQ ID NO: 840223 - RNA, 19 nt, Homo sapiens
gcaaugugggaagaaauga

SEQ ID NO: 840224 - RNA, 19 nt, Homo sapiens
ggacacaucuuuccucuua

SEQ ID NO: 840225 - RNA, 19 nt, Homo sapiens
ggaauggaaucuagaggaa

SEQ ID NO: 840226 - RNA, 19 nt, Homo sapiens
caagagcgcuuccuuugca

SEQ ID NO: 840227 - RNA, 19 nt, Homo sapiens
gcacaagagcgcuuccuuu

SEQ ID NO: 840228 - RNA, 19 nt, Homo sapiens
gcacaugccuuugcugagu

SEQ ID NO: 840229 - RNA, 19 nt, Homo sapiens
aauggaaucuagaggaaua

SEQ ID NO: 840230 - RNA, 19 nt, Homo sapiens
guaagagacuguauagcau

SEQ ID NO: 840231 - RNA, 19 nt, Homo sapiens
ggacaccaccauuaucauu

SEQ ID NO: 840232 - RNA, 19 nt, Homo sapiens
ggugggacuuccagagaua

SEQ ID NO: 840233 - RNA, 19 nt, Homo sapiens
cagagaggcuucuauccuu

SEQ ID NO: 840234 - RNA, 19 nt, Homo sapiens
gagaagaucccacuacucu

SEQ ID NO: 840235 - RNA, 19 nt, Homo sapiens
ucaauugggucuuuaccuu

SEQ ID NO: 840236 - RNA, 19 nt, Homo sapiens
gguaagagacuguauagca

SEQ ID NO: 840237 - RNA, 19 nt, Homo sapiens
gaaagcauuugcccaucug

SEQ ID NO: 840238 - RNA, 19 nt, Homo sapiens
ggaggaaggguugagguua

SEQ ID NO: 840239 - RNA, 19 nt, Homo sapiens
ucaauucagugcuuccauu

SEQ ID NO: 840240 - RNA, 19 nt, Homo sapiens
ucgaguaucuggugaagug

SEQ ID NO: 840241 - RNA, 19 nt, Homo sapiens
gcauuacccuucgcgugua

SEQ ID NO: 840242 - RNA, 19 nt, Homo sapiens
ggucucuaguugaauguuu

SEQ ID NO: 840243 - RNA, 19 nt, Homo sapiens
gaggaaggguugagguuac

SEQ ID NO: 840244 - RNA, 19 nt, Homo sapiens
guacugacauugguaagag

SEQ ID NO: 840245 - RNA, 19 nt, Homo sapiens
gcaaggagagggugauucu

SEQ ID NO: 840246 - RNA, 19 nt, Homo sapiens
gcauacagaugugguuucu

SEQ ID NO: 840247 - RNA, 19 nt, Homo sapiens
guagagcgcgguuuuauuu

SEQ ID NO: 840248 - RNA, 19 nt, Homo sapiens
cacaagagcgcuuccuuug

SEQ ID NO: 840249 - RNA, 19 nt, Homo sapiens
cagcggagguaaagaugau

SEQ ID NO: 840250 - RNA, 19 nt, Homo sapiens
ccuccucgaucuuuaguug

SEQ ID NO: 840251 - RNA, 19 nt, Homo sapiens
gcuaaguugugugauguau

SEQ ID NO: 840252 - RNA, 19 nt, Homo sapiens
ggaaggguaaagucgagua

SEQ ID NO: 840253 - RNA, 19 nt, Homo sapiens
gcacgugggagccagaaga

SEQ ID NO: 840254 - RNA, 19 nt, Homo sapiens
cgagcuuuguucagacuaa

SEQ ID NO: 840255 - RNA, 19 nt, Homo sapiens
gggcacgaguugauuccaa

SEQ ID NO: 840256 - RNA, 19 nt, Homo sapiens
gcuucgagcuuuguucaga

SEQ ID NO: 840257 - RNA, 19 nt, Homo sapiens
gcgcuuccuuugcacagaa

SEQ ID NO: 840258 - RNA, 19 nt, Homo sapiens
gcuaccugcuugcggcuuu

SEQ ID NO: 840259 - RNA, 19 nt, Homo sapiens
caaacccucucccuugagu

SEQ ID NO: 840260 - RNA, 19 nt, Homo sapiens
cccaaacccucucccuuga

SEQ ID NO: 840261 - RNA, 19 nt, Homo sapiens
cagacuaaaugaauguauc

SEQ ID NO: 840262 - RNA, 19 nt, Homo sapiens
gagcuuuguucagacuaaa

SEQ ID NO: 840263 - RNA, 19 nt, Homo sapiens
aaggagagggugauucuuu

SEQ ID NO: 840264 - RNA, 19 nt, Homo sapiens
ccaccugcccuuucucuga

SEQ ID NO: 840265 - RNA, 19 nt, Homo sapiens
gcagugggaaguucugaau

SEQ ID NO: 840266 - RNA, 19 nt, Homo sapiens
guggagagcauccggaaga

SEQ ID NO: 840267 - RNA, 19 nt, Homo sapiens
ggacaaggagcggcaggaa

SEQ ID NO: 840268 - RNA, 19 nt, Homo sapiens
cugcagacguguccacaug

SEQ ID NO: 840269 - RNA, 19 nt, Homo sapiens
cccgaaaggcccacaagua

SEQ ID NO: 840270 - RNA, 19 nt, Homo sapiens
gggugggucuggacaagga

SEQ ID NO: 840271 - RNA, 19 nt, Homo sapiens
gaaggguugagguuacuug

SEQ ID NO: 840272 - RNA, 19 nt, Homo sapiens
gaaggguaaagucgaguau

SEQ ID NO: 840273 - RNA, 19 nt, Homo sapiens
gcccaugacuuuggaacau

SEQ ID NO: 840274 - RNA, 19 nt, Homo sapiens
ccuccgggaugaccugauu

SEQ ID NO: 840275 - RNA, 19 nt, Homo sapiens
aaagaacuauuugcgcaau

SEQ ID NO: 840276 - RNA, 19 nt, Homo sapiens
ggagugcggccagcaaguu

SEQ ID NO: 840277 - RNA, 19 nt, Homo sapiens
gcacuuguuuucugguuug

SEQ ID NO: 840278 - RNA, 19 nt, Homo sapiens
ucaccuggccugugcagaa

SEQ ID NO: 840279 - RNA, 19 nt, Homo sapiens
agugggaaguucugaauca

SEQ ID NO: 840280 - RNA, 19 nt, Homo sapiens
gucaggcugugcuguguga

SEQ ID NO: 840281 - RNA, 19 nt, Homo sapiens
caccuggccugugcagaaa

SEQ ID NO: 840282 - RNA, 19 nt, Homo sapiens
agaaagcauuugcccaucu

SEQ ID NO: 840283 - RNA, 19 nt, Homo sapiens
acaaggagcggcaggaauc

SEQ ID NO: 840284 - RNA, 19 nt, Homo sapiens
gaaaggcccacaaguaccu

SEQ ID NO: 840285 - RNA, 19 nt, Homo sapiens
aauugggucuuuaccuuga

SEQ ID NO: 840286 - RNA, 19 nt, Homo sapiens
gcagcugguucugggaguu

SEQ ID NO: 840287 - RNA, 19 nt, Homo sapiens
gcugucagagucaggguaa

SEQ ID NO: 840288 - RNA, 19 nt, Homo sapiens
gcguguacguucccaugug

SEQ ID NO: 840289 - RNA, 19 nt, Homo sapiens
gagugcggccagcaaguuu

SEQ ID NO: 840290 - RNA, 19 nt, Homo sapiens
ccgaaaggcccacaaguac

SEQ ID NO: 840291 - RNA, 19 nt, Homo sapiens
cauuaucauucuccucuag

SEQ ID NO: 840292 - RNA, 19 nt, Homo sapiens
gggugggacuuccagagau

SEQ ID NO: 840293 - RNA, 19 nt, Homo sapiens
gagagucagaguggaugua

SEQ ID NO: 840294 - RNA, 19 nt, Homo sapiens
ccugcuuccuggucacuuu

SEQ ID NO: 840295 - RNA, 19 nt, Homo sapiens
ugacucaggugacuuuuca

SEQ ID NO: 840296 - RNA, 19 nt, Homo sapiens
gcuccaggcauacagaugu

SEQ ID NO: 840297 - RNA, 19 nt, Homo sapiens
ccauuaucauucuccucua

SEQ ID NO: 840298 - RNA, 19 nt, Homo sapiens
uaaaaggccaguacucuug

SEQ ID NO: 840299 - RNA, 19 nt, Homo sapiens
acacaucuuuccucuuacu

SEQ ID NO: 840300 - RNA, 19 nt, Homo sapiens
gagucagaguggauguaga

SEQ ID NO: 840301 - RNA, 19 nt, Homo sapiens
ccucuuacucagcccuuua

SEQ ID NO: 840302 - RNA, 19 nt, Homo sapiens
aggagagggugauucuuuc

SEQ ID NO: 840303 - RNA, 19 nt, Homo sapiens
gaagucacagagucuacug

SEQ ID NO: 840304 - RNA, 19 nt, Homo sapiens
gacaccaccauuaucauuc

SEQ ID NO: 840305 - RNA, 19 nt, Homo sapiens
agagacccgugggcacuuu

SEQ ID NO: 840306 - RNA, 19 nt, Homo sapiens
ggcagcccuugacuccuaa

SEQ ID NO: 840307 - RNA, 19 nt, Homo sapiens
ucugcuaaguugugugaug

SEQ ID NO: 840308 - RNA, 19 nt, Homo sapiens
acaccaccauuaucauucu

SEQ ID NO: 840309 - RNA, 19 nt, Homo sapiens
ggagaagaucccacuacuc

SEQ ID NO: 840310 - RNA, 19 nt, Homo sapiens
caccaggucucagcacaag

SEQ ID NO: 840311 - RNA, 19 nt, Homo sapiens
gugcuucugugaggugguu

SEQ ID NO: 840312 - RNA, 19 nt, Homo sapiens
gaauggaaucuagaggaau

SEQ ID NO: 840313 - RNA, 19 nt, Homo sapiens
cagcugguucugggaguua

SEQ ID NO: 840314 - RNA, 19 nt, Homo sapiens
gacaaggagcggcaggaau

SEQ ID NO: 840315 - RNA, 19 nt, Homo sapiens
gaucccugagucucucuuu

SEQ ID NO: 840316 - RNA, 19 nt, Homo sapiens
ggguucuuguucuuucuga

SEQ ID NO: 840317 - RNA, 19 nt, Homo sapiens
aggguaaagucgaguaucu

SEQ ID NO: 840318 - RNA, 19 nt, Homo sapiens
ucugugaggugguuuagcu

SEQ ID NO: 840319 - RNA, 19 nt, Homo sapiens
gaggguuuagaaagcauuu

SEQ ID NO: 840320 - RNA, 19 nt, Homo sapiens
gcagcaggacacaucuuuc

SEQ ID NO: 840321 - RNA, 19 nt, Homo sapiens
cugcuaaguugugugaugu

SEQ ID NO: 840322 - RNA, 19 nt, Homo sapiens
cgggacaccaccauuauca

SEQ ID NO: 840323 - RNA, 19 nt, Homo sapiens
gcccaucugccuuucuuuc

SEQ ID NO: 840324 - RNA, 19 nt, Homo sapiens
ggacagaagucuugcaaua

SEQ ID NO: 840325 - RNA, 19 nt, Homo sapiens
gcaauaggcugcagacauu

SEQ ID NO: 840326 - RNA, 19 nt, Homo sapiens
acaaggaucugcaaaguua

SEQ ID NO: 840327 - RNA, 19 nt, Homo sapiens
ggacauacauauauagaga

SEQ ID NO: 840328 - RNA, 19 nt, Homo sapiens
gaaaugugguauucucuuu

SEQ ID NO: 840329 - RNA, 19 nt, Homo sapiens
gcugaaauauugcaaauga

SEQ ID NO: 840330 - RNA, 19 nt, Homo sapiens
ggagagggauuauagagaa

SEQ ID NO: 840331 - RNA, 19 nt, Homo sapiens
ggacagaaguuggagcuuu

SEQ ID NO: 840332 - RNA, 19 nt, Homo sapiens
gcaauuauuucaucaguuc

SEQ ID NO: 840333 - RNA, 19 nt, Homo sapiens
ggagaaagcaauaaacauu

SEQ ID NO: 840334 - RNA, 19 nt, Homo sapiens
gaugggacauacauauaua

SEQ ID NO: 840335 - RNA, 19 nt, Homo sapiens
gaggauagguuaagaaagg

SEQ ID NO: 840336 - RNA, 19 nt, Homo sapiens
gcaaugggauguacauaag

SEQ ID NO: 840337 - RNA, 19 nt, Homo sapiens
gaagguagccauacagaug

SEQ ID NO: 840338 - RNA, 19 nt, Homo sapiens
gaaagggacagaagucuug

SEQ ID NO: 840339 - RNA, 19 nt, Homo sapiens
ucacacuuguuaccauuua

SEQ ID NO: 840340 - RNA, 19 nt, Homo sapiens
gccaagaggugacauuuag

SEQ ID NO: 840341 - RNA, 19 nt, Homo sapiens
gaacuucuugcaauaguaa

SEQ ID NO: 840342 - RNA, 19 nt, Homo sapiens
guaggaguuugguuuaauu

SEQ ID NO: 840343 - RNA, 19 nt, Homo sapiens
caaaaugacugcugaaaau

SEQ ID NO: 840344 - RNA, 19 nt, Homo sapiens
caagaugaauguaugcaau

SEQ ID NO: 840345 - RNA, 19 nt, Homo sapiens
caccagaggcuauuuaauu

SEQ ID NO: 840346 - RNA, 19 nt, Homo sapiens
aguacuagcucugugauua

SEQ ID NO: 840347 - RNA, 19 nt, Homo sapiens
ggagggagcacuaggaaga

SEQ ID NO: 840348 - RNA, 19 nt, Homo sapiens
caaaggaacaauaaagcua

SEQ ID NO: 840349 - RNA, 19 nt, Homo sapiens
gcaguggaacaaacaauaa

SEQ ID NO: 840350 - RNA, 19 nt, Homo sapiens
gauaagagacacagcaugu

SEQ ID NO: 840351 - RNA, 19 nt, Homo sapiens
gcacuucauuucucuacug

SEQ ID NO: 840352 - RNA, 19 nt, Homo sapiens
gcaguugccuaccaugugu

SEQ ID NO: 840353 - RNA, 19 nt, Homo sapiens
gaagaguauucugcugaaa

SEQ ID NO: 840354 - RNA, 19 nt, Homo sapiens
cgacagauccacaaaggaa

SEQ ID NO: 840355 - RNA, 19 nt, Homo sapiens
gagagagucguguuucgua

SEQ ID NO: 840356 - RNA, 19 nt, Homo sapiens
aaacaaggaucugcaaagu

SEQ ID NO: 840357 - RNA, 19 nt, Homo sapiens
gagagggauuauagagaaa

SEQ ID NO: 840358 - RNA, 19 nt, Homo sapiens
cuaaacuagugcuauguaa

SEQ ID NO: 840359 - RNA, 19 nt, Homo sapiens
ccauacagaugccgacaga

SEQ ID NO: 840360 - RNA, 19 nt, Homo sapiens
gacaguggaucauuugaag

SEQ ID NO: 840361 - RNA, 19 nt, Homo sapiens
gaaauuacuguaccuaguc

SEQ ID NO: 840362 - RNA, 19 nt, Homo sapiens
agagacacagcauguauua

SEQ ID NO: 840363 - RNA, 19 nt, Homo sapiens
gaaaggaaagggacagaag

SEQ ID NO: 840364 - RNA, 19 nt, Homo sapiens
gagagugccuaacagaagu

SEQ ID NO: 840365 - RNA, 19 nt, Homo sapiens
caaguuagugauugcauuu

SEQ ID NO: 840366 - RNA, 19 nt, Homo sapiens
gaaaacuucacacuuguua

SEQ ID NO: 840367 - RNA, 19 nt, Homo sapiens
uaucuuaguuugccuucuu

SEQ ID NO: 840368 - RNA, 19 nt, Homo sapiens
gcccaugccuaaacuagug

SEQ ID NO: 840369 - RNA, 19 nt, Homo sapiens
guucucagauuaacaagca

SEQ ID NO: 840370 - RNA, 19 nt, Homo sapiens
gugauuagauugaauucuc

SEQ ID NO: 840371 - RNA, 19 nt, Homo sapiens
caaggcagcucgguaacug

SEQ ID NO: 840372 - RNA, 19 nt, Homo sapiens
gauuauggcaagaaagaaa

SEQ ID NO: 840373 - RNA, 19 nt, Homo sapiens
ugaaauuacuguaccuagu

SEQ ID NO: 840374 - RNA, 19 nt, Homo sapiens
agacacagcauguauuaug

SEQ ID NO: 840375 - RNA, 19 nt, Homo sapiens
guaaugggguugugguuuu

SEQ ID NO: 840376 - RNA, 19 nt, Homo sapiens
caaaguacuagcucuguga

SEQ ID NO: 840377 - RNA, 19 nt, Homo sapiens
gaguggaaaugugguauuc

SEQ ID NO: 840378 - RNA, 19 nt, Homo sapiens
uaagagacacagcauguau

SEQ ID NO: 840379 - RNA, 19 nt, Homo sapiens
aaacuagugcuauguaaug

SEQ ID NO: 840380 - RNA, 19 nt, Homo sapiens
guucaaggcagcucgguaa

SEQ ID NO: 840381 - RNA, 19 nt, Homo sapiens
ccacaaaggaacaauaaag

SEQ ID NO: 840382 - RNA, 19 nt, Homo sapiens
ucaaguuagugauugcauu

SEQ ID NO: 840383 - RNA, 19 nt, Homo sapiens
gaagagaaaagcuacaauu

SEQ ID NO: 840384 - RNA, 19 nt, Homo sapiens
gagacuagaugggacauac

SEQ ID NO: 840385 - RNA, 19 nt, Homo sapiens
gauccacaaaggaacaaua

SEQ ID NO: 840386 - RNA, 19 nt, Homo sapiens
ggaacaaacaauaaaccuu

SEQ ID NO: 840387 - RNA, 19 nt, Homo sapiens
uuaauaccaugccagagaa

SEQ ID NO: 840388 - RNA, 19 nt, Homo sapiens
ggaaagggacagaagucuu

SEQ ID NO: 840389 - RNA, 19 nt, Homo sapiens
aaaauauggugcugcuuua

SEQ ID NO: 840390 - RNA, 19 nt, Homo sapiens
uagaugggacauacauaua

SEQ ID NO: 840391 - RNA, 19 nt, Homo sapiens
aaaaugcccugacugaauu

SEQ ID NO: 840392 - RNA, 19 nt, Homo sapiens
ggaaaugugguauucucuu

SEQ ID NO: 840393 - RNA, 19 nt, Homo sapiens
ugaacuucuugcaauagua

SEQ ID NO: 840394 - RNA, 19 nt, Homo sapiens
uucaucaguucucagauua

SEQ ID NO: 840395 - RNA, 19 nt, Homo sapiens
uuucaucaguucucagauu

SEQ ID NO: 840396 - RNA, 19 nt, Homo sapiens
caaguugaaagaucuaguu

SEQ ID NO: 840397 - RNA, 19 nt, Homo sapiens
gaguguggaggauagguua

SEQ ID NO: 840398 - RNA, 19 nt, Homo sapiens
ugccugagcuuaggaaguu

SEQ ID NO: 840399 - RNA, 19 nt, Homo sapiens
cagauuauggcaagaaaga

SEQ ID NO: 840400 - RNA, 19 nt, Homo sapiens
gcucugugauuagauugaa

SEQ ID NO: 840401 - RNA, 19 nt, Homo sapiens
gaagacgaguguggaggau

SEQ ID NO: 840402 - RNA, 19 nt, Homo sapiens
gaucggauaaauaacaguu

SEQ ID NO: 840403 - RNA, 19 nt, Homo sapiens
agagagucguguuucguaa

SEQ ID NO: 840404 - RNA, 19 nt, Homo sapiens
cagcagaccagcaguggaa

SEQ ID NO: 840405 - RNA, 19 nt, Homo sapiens
caguuuaucugaguugaga

SEQ ID NO: 840406 - RNA, 19 nt, Homo sapiens
cgauuucguuuaaugacaa

SEQ ID NO: 840407 - RNA, 19 nt, Homo sapiens
gucgggaucggauaaauaa

SEQ ID NO: 840408 - RNA, 19 nt, Homo sapiens
aaugggauguacauaaguu

SEQ ID NO: 840409 - RNA, 19 nt, Homo sapiens
acagaagucuugcaauagg

SEQ ID NO: 840410 - RNA, 19 nt, Homo sapiens
ucuugaacuucuugcaaua

SEQ ID NO: 840411 - RNA, 19 nt, Homo sapiens
gacagaaguuggagcuuuu

SEQ ID NO: 840412 - RNA, 19 nt, Homo sapiens
uagauugaauucuccaaca

SEQ ID NO: 840413 - RNA, 19 nt, Homo sapiens
aauauggugcugcuuuaua

SEQ ID NO: 840414 - RNA, 19 nt, Homo sapiens
uagcagugcauugguauaa

SEQ ID NO: 840415 - RNA, 19 nt, Homo sapiens
cuagcucugugauuagauu

SEQ ID NO: 840416 - RNA, 19 nt, Homo sapiens
gaccagcaguggaacaaac

SEQ ID NO: 840417 - RNA, 19 nt, Homo sapiens
caaaauauggugcugcuuu

SEQ ID NO: 840418 - RNA, 19 nt, Homo sapiens
uuaguuugccuucuuugua

SEQ ID NO: 840419 - RNA, 19 nt, Homo sapiens
cuucauuucucuacugugu

SEQ ID NO: 840420 - RNA, 19 nt, Homo sapiens
cagaggcuauuuaauucau

SEQ ID NO: 840421 - RNA, 19 nt, Homo sapiens
accagaggcuauuuaauuc

SEQ ID NO: 840422 - RNA, 19 nt, Homo sapiens
gcagugcauugguauaagc

SEQ ID NO: 840423 - RNA, 19 nt, Homo sapiens
agacgaguguggaggauag

SEQ ID NO: 840424 - RNA, 19 nt, Homo sapiens
ggaaagaggcagagaagga

SEQ ID NO: 840425 - RNA, 19 nt, Homo sapiens
gcacagaggcucagaagca

SEQ ID NO: 840426 - RNA, 19 nt, Homo sapiens
gaaagagacaggcagagaa

SEQ ID NO: 840427 - RNA, 19 nt, Homo sapiens
gaaagaggcagagaaggaa

SEQ ID NO: 840428 - RNA, 19 nt, Homo sapiens
ggacagcacccuaagcaau

SEQ ID NO: 840429 - RNA, 19 nt, Homo sapiens
uaagcaaugugcauacuuc

SEQ ID NO: 840430 - RNA, 19 nt, Homo sapiens
ggaaagagacaggcagaga

SEQ ID NO: 840431 - RNA, 19 nt, Homo sapiens
gggcccaggugcauaaaug

SEQ ID NO: 840432 - RNA, 19 nt, Homo sapiens
gcaaggagcaaggcaaguu

SEQ ID NO: 840433 - RNA, 19 nt, Homo sapiens
gcaaugugcauacuucugu

SEQ ID NO: 840434 - RNA, 19 nt, Homo sapiens
ggagagagggacagagaga

SEQ ID NO: 840435 - RNA, 19 nt, Homo sapiens
gcagagagggagagaaaca

SEQ ID NO: 840436 - RNA, 19 nt, Homo sapiens
ggagagaggcagagagaca

SEQ ID NO: 840437 - RNA, 19 nt, Homo sapiens
gcagcugcccuuccucaaa

SEQ ID NO: 840438 - RNA, 19 nt, Homo sapiens
ggccaagucuucccaggau

SEQ ID NO: 840439 - RNA, 19 nt, Homo sapiens
gggaagguaccaaggauug

SEQ ID NO: 840440 - RNA, 19 nt, Homo sapiens
caccagagcucaggagaca

SEQ ID NO: 840441 - RNA, 19 nt, Homo sapiens
gagcaaggcaaguucuaug

SEQ ID NO: 840442 - RNA, 19 nt, Homo sapiens
uaaccacacgugcaauaaa

SEQ ID NO: 840443 - RNA, 19 nt, Homo sapiens
agagagauaugaggagaga

SEQ ID NO: 840444 - RNA, 19 nt, Homo sapiens
gagaaacagaggagacaga

SEQ ID NO: 840445 - RNA, 19 nt, Homo sapiens
agacagagagggagagaga

SEQ ID NO: 840446 - RNA, 19 nt, Homo sapiens
gacagcacccuaagcaaug

SEQ ID NO: 840447 - RNA, 19 nt, Homo sapiens
gacaguggccuuggcauug

SEQ ID NO: 840448 - RNA, 19 nt, Homo sapiens
guggagaccugcagcuucu

SEQ ID NO: 840449 - RNA, 19 nt, Homo sapiens
caaguucuaugaccaucuc

SEQ ID NO: 840450 - RNA, 19 nt, Homo sapiens
ccuaaccacacgugcaaua

SEQ ID NO: 840451 - RNA, 19 nt, Homo sapiens
gcagagaaggaaagagaca

SEQ ID NO: 840452 - RNA, 19 nt, Homo sapiens
gagggaaagaggcagagaa

SEQ ID NO: 840453 - RNA, 19 nt, Homo sapiens
gaaacagaggagacagaga

SEQ ID NO: 840454 - RNA, 19 nt, Homo sapiens
cacagaggcucagaagcaa

SEQ ID NO: 840455 - RNA, 19 nt, Homo sapiens
ucagacaacucgggaaggu

SEQ ID NO: 840456 - RNA, 19 nt, Homo sapiens
ggagcaaggcaaguucuau

SEQ ID NO: 840457 - RNA, 19 nt, Homo sapiens
gagagaaacagaggagaca

SEQ ID NO: 840458 - RNA, 19 nt, Homo sapiens
cagcugcccuuccucaaaa

SEQ ID NO: 840459 - RNA, 19 nt, Homo sapiens
agacagagggagagagaga

SEQ ID NO: 840460 - RNA, 19 nt, Homo sapiens
aaccacacgugcaauaaag

SEQ ID NO: 840461 - RNA, 19 nt, Homo sapiens
aggcagagagggagagaaa

SEQ ID NO: 840462 - RNA, 19 nt, Homo sapiens
agagauaugaggagagaga

SEQ ID NO: 840463 - RNA, 19 nt, Homo sapiens
guggagaaguugaaaacaa

SEQ ID NO: 840464 - RNA, 19 nt, Homo sapiens
acagcggaguggagaaguu

SEQ ID NO: 840465 - RNA, 19 nt, Homo sapiens
ggaccaggaggagcgcuuu

SEQ ID NO: 840466 - RNA, 19 nt, Homo sapiens
cagcugugccuccaucugu

SEQ ID NO: 840467 - RNA, 19 nt, Homo sapiens
agacaguggccuuggcauu

SEQ ID NO: 840468 - RNA, 19 nt, Homo sapiens
cuaaccacacgugcaauaa

SEQ ID NO: 840469 - RNA, 19 nt, Homo sapiens
caaggagcaaggcaaguuc

SEQ ID NO: 840470 - RNA, 19 nt, Homo sapiens
agagggacagagagagaua

SEQ ID NO: 840471 - RNA, 19 nt, Homo sapiens
aggcagagaaggaaagaga

SEQ ID NO: 840472 - RNA, 19 nt, Homo sapiens
acaguggccuuggcauugu

SEQ ID NO: 840473 - RNA, 19 nt, Homo sapiens
aaagagacaggcagagaag

SEQ ID NO: 840474 - RNA, 19 nt, Homo sapiens
ggagacagagagggagaga

SEQ ID NO: 840475 - RNA, 19 nt, Homo sapiens
ccaagucuucccaggauca

SEQ ID NO: 840476 - RNA, 19 nt, Homo sapiens
gaaaacaauucagacaacu

SEQ ID NO: 840477 - RNA, 19 nt, Homo sapiens
agagacagagggagagaga

SEQ ID NO: 840478 - RNA, 19 nt, Homo sapiens
acagagagggagagagaga

SEQ ID NO: 840479 - RNA, 19 nt, Homo sapiens
aaaggaggagggagagaga

SEQ ID NO: 840480 - RNA, 19 nt, Homo sapiens
ggaaaggaggagggagaga

SEQ ID NO: 840481 - RNA, 19 nt, Homo sapiens
agagagggacagagagaga

SEQ ID NO: 840482 - RNA, 19 nt, Homo sapiens
agagacaggcagagaagga

SEQ ID NO: 840483 - RNA, 19 nt, Homo sapiens
gaggagggagagagaugga

SEQ ID NO: 840484 - RNA, 19 nt, Homo sapiens
caccuaaccacacgugcaa

SEQ ID NO: 840485 - RNA, 19 nt, Homo sapiens
gcaaggcaaguucuaugac

SEQ ID NO: 840486 - RNA, 19 nt, Homo sapiens
guggacagcacccuaagca

SEQ ID NO: 840487 - RNA, 19 nt, Homo sapiens
aaaguccggccaagucuuc

SEQ ID NO: 840488 - RNA, 19 nt, Homo sapiens
caaaguccggccaagucuu

SEQ ID NO: 840489 - RNA, 19 nt, Homo sapiens
ccacagaccugcacauugu

SEQ ID NO: 840490 - RNA, 19 nt, Homo sapiens
ccaagaaggcccucaauaa

SEQ ID NO: 840491 - RNA, 19 nt, Homo sapiens
gaaggacuaucacaucgaa

SEQ ID NO: 840492 - RNA, 19 nt, Homo sapiens
caagaaggcccucaauaaa

SEQ ID NO: 840493 - RNA, 19 nt, Homo sapiens
cgaagagggugaagaggua

SEQ ID NO: 840494 - RNA, 19 nt, Homo sapiens
ccacagagguuugccaaca

SEQ ID NO: 840495 - RNA, 19 nt, Homo sapiens
ccauggacguucuguuuga

SEQ ID NO: 840496 - RNA, 19 nt, Homo sapiens
uagaugggcucagguacua

SEQ ID NO: 840497 - RNA, 19 nt, Homo sapiens
gcgaaggccugagacagaa

SEQ ID NO: 840498 - RNA, 19 nt, Homo sapiens
gcacaccacucagccuguu

SEQ ID NO: 840499 - RNA, 19 nt, Homo sapiens
gagccaccauucccucuga

SEQ ID NO: 840500 - RNA, 19 nt, Homo sapiens
caccauggacguucuguuu

SEQ ID NO: 840501 - RNA, 19 nt, Homo sapiens
agaaggcccucaauaaagg

SEQ ID NO: 840502 - RNA, 19 nt, Homo sapiens
gggccugggugaaggagaa

SEQ ID NO: 840503 - RNA, 19 nt, Homo sapiens
gcuccucgguggugacaau

SEQ ID NO: 840504 - RNA, 19 nt, Homo sapiens
gagcaguacagaacaggaa

SEQ ID NO: 840505 - RNA, 19 nt, Homo sapiens
cccacuaccucucugugua

SEQ ID NO: 840506 - RNA, 19 nt, Homo sapiens
gagcacacgauccaucaug

SEQ ID NO: 840507 - RNA, 19 nt, Homo sapiens
ugccaucccugccaaacaa

SEQ ID NO: 840508 - RNA, 19 nt, Homo sapiens
aagaaggcccucaauaaag

SEQ ID NO: 840509 - RNA, 19 nt, Homo sapiens
cugaccagcugcucaagga

SEQ ID NO: 840510 - RNA, 19 nt, Homo sapiens
acaccgggauguggucauu

SEQ ID NO: 840511 - RNA, 19 nt, Homo sapiens
ggaaggacuaucacaucga

SEQ ID NO: 840512 - RNA, 19 nt, Homo sapiens
gaaggccugagacagaaug

SEQ ID NO: 840513 - RNA, 19 nt, Homo sapiens
ccacucaccacagagguuu

SEQ ID NO: 840514 - RNA, 19 nt, Homo sapiens
caggaaggacuaucacauc

SEQ ID NO: 840515 - RNA, 19 nt, Homo sapiens
cagcagcgaaggccugaga

SEQ ID NO: 840516 - RNA, 19 nt, Homo sapiens
gaugggcucagguacuaug

SEQ ID NO: 840517 - RNA, 19 nt, Homo sapiens
gcagcucaaagucauguuc

SEQ ID NO: 840518 - RNA, 19 nt, Homo sapiens
caucgaagagggugaagag

SEQ ID NO: 840519 - RNA, 19 nt, Homo sapiens
gaagagggugaagagguau

SEQ ID NO: 840520 - RNA, 19 nt, Homo sapiens
accaagaaggcccucaaua

SEQ ID NO: 840521 - RNA, 19 nt, Homo sapiens
ccaggaaggacuaucacau

SEQ ID NO: 840522 - RNA, 19 nt, Homo sapiens
ggacccugccugcaagaag

SEQ ID NO: 840523 - RNA, 19 nt, Homo sapiens
ccaacaccaggaaggacua

SEQ ID NO: 840524 - RNA, 19 nt, Homo sapiens
ggacuaucacaucgaagag

SEQ ID NO: 840525 - RNA, 19 nt, Homo sapiens
gcuggagggagacaugguu

SEQ ID NO: 840526 - RNA, 19 nt, Homo sapiens
caggaaagcuuuaagaaua

SEQ ID NO: 840527 - RNA, 19 nt, Homo sapiens
ggacaagaauucaguguuu

SEQ ID NO: 840528 - RNA, 19 nt, Homo sapiens
ggaaagaugucccagaauu

SEQ ID NO: 840529 - RNA, 19 nt, Homo sapiens
gcaaugagcuucuugaauc

SEQ ID NO: 840530 - RNA, 19 nt, Homo sapiens
cagaagagcugacaacaaa

SEQ ID NO: 840531 - RNA, 19 nt, Homo sapiens
ccaaugaacuguuuagaaa

SEQ ID NO: 840532 - RNA, 19 nt, Homo sapiens
gcuaagagcucaacaggaa

SEQ ID NO: 840533 - RNA, 19 nt, Homo sapiens
ggucaaagguuaugagauu

SEQ ID NO: 840534 - RNA, 19 nt, Homo sapiens
aaacauguaugcccaaaua

SEQ ID NO: 840535 - RNA, 19 nt, Homo sapiens
gaacaagucucugaagcua

SEQ ID NO: 840536 - RNA, 19 nt, Homo sapiens
gcacugaccucaauacugu

SEQ ID NO: 840537 - RNA, 19 nt, Homo sapiens
gcacaaggcucuggaagaa

SEQ ID NO: 840538 - RNA, 19 nt, Homo sapiens
gaaauuacuucucugaguu

SEQ ID NO: 840539 - RNA, 19 nt, Homo sapiens
gcaauacugucuuuggaua

SEQ ID NO: 840540 - RNA, 19 nt, Homo sapiens
gaacugauguuaaagaaag

SEQ ID NO: 840541 - RNA, 19 nt, Homo sapiens
gaauguagaucaagcuauu

SEQ ID NO: 840542 - RNA, 19 nt, Homo sapiens
gaacacaaaccucauauug

SEQ ID NO: 840543 - RNA, 19 nt, Homo sapiens
gggagaaguuauauuguua

SEQ ID NO: 840544 - RNA, 19 nt, Homo sapiens
gaauagugcugcugacauu

SEQ ID NO: 840545 - RNA, 19 nt, Homo sapiens
caaaggaacuggcagagaa

SEQ ID NO: 840546 - RNA, 19 nt, Homo sapiens
gcaaugaccugccuagugu

SEQ ID NO: 840547 - RNA, 19 nt, Homo sapiens
caacaaagcuggcaaugag

SEQ ID NO: 840548 - RNA, 19 nt, Homo sapiens
ggaagagacuuauaaucaa

SEQ ID NO: 840549 - RNA, 19 nt, Homo sapiens
gaaaguagauggacugaac

SEQ ID NO: 840550 - RNA, 19 nt, Homo sapiens
gcaagcagccuguguauga

SEQ ID NO: 840551 - RNA, 19 nt, Homo sapiens
caacucagcacgugaaaua

SEQ ID NO: 840552 - RNA, 19 nt, Homo sapiens
guaaagaccuugaccuugu

SEQ ID NO: 840553 - RNA, 19 nt, Homo sapiens
caaaggcuaugcugaauga

SEQ ID NO: 840554 - RNA, 19 nt, Homo sapiens
acaaauaucugagcaauug

SEQ ID NO: 840555 - RNA, 19 nt, Homo sapiens
uuaugaagcugccuuauuu

SEQ ID NO: 840556 - RNA, 19 nt, Homo sapiens
gaaagaagaauguagauca

SEQ ID NO: 840557 - RNA, 19 nt, Homo sapiens
gaagcagagugucgacaua

SEQ ID NO: 840558 - RNA, 19 nt, Homo sapiens
caaagaaccaucagaaauu

SEQ ID NO: 840559 - RNA, 19 nt, Homo sapiens
ggaacuaucugcguaaaga

SEQ ID NO: 840560 - RNA, 19 nt, Homo sapiens
gaucaaacagcauacaaua

SEQ ID NO: 840561 - RNA, 19 nt, Homo sapiens
gaacauugaccgaguuaaa

SEQ ID NO: 840562 - RNA, 19 nt, Homo sapiens
gaacuacuuucacuugaga

SEQ ID NO: 840563 - RNA, 19 nt, Homo sapiens
ccacacagauuacagaguu

SEQ ID NO: 840564 - RNA, 19 nt, Homo sapiens
gagaagggcuggauaaacu

SEQ ID NO: 840565 - RNA, 19 nt, Homo sapiens
gaagacaguuaaagagaga

SEQ ID NO: 840566 - RNA, 19 nt, Homo sapiens
uaagaauccugcaguguuu

SEQ ID NO: 840567 - RNA, 19 nt, Homo sapiens
gagaauaaauaccgguuug

SEQ ID NO: 840568 - RNA, 19 nt, Homo sapiens
gcaguaagauggaagaaag

SEQ ID NO: 840569 - RNA, 19 nt, Homo sapiens
ggaccugguuggaugauaa

SEQ ID NO: 840570 - RNA, 19 nt, Homo sapiens
ugaaagagaauacugcuua

SEQ ID NO: 840571 - RNA, 19 nt, Homo sapiens
gaacaaacaguguggcaaa

SEQ ID NO: 840572 - RNA, 19 nt, Homo sapiens
gaaaucagccagaucaaga

SEQ ID NO: 840573 - RNA, 19 nt, Homo sapiens
aaaaguagcucgugacaua

SEQ ID NO: 840574 - RNA, 19 nt, Homo sapiens
gacaguugauguuauagua

SEQ ID NO: 840575 - RNA, 19 nt, Homo sapiens
gaaagagaauacugcuuau

SEQ ID NO: 840576 - RNA, 19 nt, Homo sapiens
gggaacagcuugauacaca

SEQ ID NO: 840577 - RNA, 19 nt, Homo sapiens
gaagagcauugaugagaug

SEQ ID NO: 840578 - RNA, 19 nt, Homo sapiens
ugacggagauccaguguga

SEQ ID NO: 840579 - RNA, 19 nt, Homo sapiens
gcaaagaaccaucagaaau

SEQ ID NO: 840580 - RNA, 19 nt, Homo sapiens
agaaagagcuggagaacau

SEQ ID NO: 840581 - RNA, 19 nt, Homo sapiens
gaaagaugucccagaauuu

SEQ ID NO: 840582 - RNA, 19 nt, Homo sapiens
gugauuaucucaauugguu

SEQ ID NO: 840583 - RNA, 19 nt, Homo sapiens
ggacucagaacuagagaua

SEQ ID NO: 840584 - RNA, 19 nt, Homo sapiens
gcucauagccaaucagaaa

SEQ ID NO: 840585 - RNA, 19 nt, Homo sapiens
uagaagagaugcagaugaa

SEQ ID NO: 840586 - RNA, 19 nt, Homo sapiens
ccacgagccuguucugaaa

SEQ ID NO: 840587 - RNA, 19 nt, Homo sapiens
gauaacacgucaggaguuu

SEQ ID NO: 840588 - RNA, 19 nt, Homo sapiens
gccgagagcugauugagaa

SEQ ID NO: 840589 - RNA, 19 nt, Homo sapiens
ccaccaagccugauucuaa

SEQ ID NO: 840590 - RNA, 19 nt, Homo sapiens
ccacaggcauguucaagaa

SEQ ID NO: 840591 - RNA, 19 nt, Homo sapiens
gaacauguggagaagguua

SEQ ID NO: 840592 - RNA, 19 nt, Homo sapiens
ggaccaggaugggaagaua

SEQ ID NO: 840593 - RNA, 19 nt, Homo sapiens
gaucaaugcucgauggaau

SEQ ID NO: 840594 - RNA, 19 nt, Homo sapiens
gauagaagauuguaaagcu

SEQ ID NO: 840595 - RNA, 19 nt, Homo sapiens
ggcaucagcugcauguuaa

SEQ ID NO: 840596 - RNA, 19 nt, Homo sapiens
acacaaagauucaauggau

SEQ ID NO: 840597 - RNA, 19 nt, Homo sapiens
ccaccuggcuuuaaaugaa

SEQ ID NO: 840598 - RNA, 19 nt, Homo sapiens
caaaggagacuugagauuu

SEQ ID NO: 840599 - RNA, 19 nt, Homo sapiens
cacgagagcuggagucauu

SEQ ID NO: 840600 - RNA, 19 nt, Homo sapiens
guacauccaugccaucuuc

SEQ ID NO: 840601 - RNA, 19 nt, Homo sapiens
gaacuuagagagaaauuca

SEQ ID NO: 840602 - RNA, 19 nt, Homo sapiens
ugucagaacugguggcuaa

SEQ ID NO: 840603 - RNA, 19 nt, Homo sapiens
ggaagagaccagugaaauu

SEQ ID NO: 840604 - RNA, 19 nt, Homo sapiens
caauggaacuggaggagaa

SEQ ID NO: 840605 - RNA, 19 nt, Homo sapiens
ggaggaagcccugcucuuu

SEQ ID NO: 840606 - RNA, 19 nt, Homo sapiens
gacaaaggguggaugaaau

SEQ ID NO: 840607 - RNA, 19 nt, Homo sapiens
gaagagaccagugaaauuc

SEQ ID NO: 840608 - RNA, 19 nt, Homo sapiens
cagaaaugguugaaagaaa

SEQ ID NO: 840609 - RNA, 19 nt, Homo sapiens
gaguugaucugguugaaug

SEQ ID NO: 840610 - RNA, 19 nt, Homo sapiens
gagcagaucggagagaaua

SEQ ID NO: 840611 - RNA, 19 nt, Homo sapiens
ugaaagaauuugccaacuu

SEQ ID NO: 840612 - RNA, 19 nt, Homo sapiens
cucagaaacuugacaauuu

SEQ ID NO: 840613 - RNA, 19 nt, Homo sapiens
ggacagagacauuauacga

SEQ ID NO: 840614 - RNA, 19 nt, Homo sapiens
ggaauuaaacccugaggaa

SEQ ID NO: 840615 - RNA, 19 nt, Homo sapiens
gaucaaaggcuaugcugaa

SEQ ID NO: 840616 - RNA, 19 nt, Homo sapiens
caagacagguuccauacug

SEQ ID NO: 840617 - RNA, 19 nt, Homo sapiens
aaaggagacuugagauuug

SEQ ID NO: 840618 - RNA, 19 nt, Homo sapiens
ggagaagguuaaagaacuu

SEQ ID NO: 840619 - RNA, 19 nt, Homo sapiens
ugaaguccauggagaauga

SEQ ID NO: 840620 - RNA, 19 nt, Homo sapiens
ggaaagcucaucauagaga

SEQ ID NO: 840621 - RNA, 19 nt, Homo sapiens
uaaagaaagcuacugauga

SEQ ID NO: 840622 - RNA, 19 nt, Homo sapiens
acaaggaucuggcugcaaa

SEQ ID NO: 840623 - RNA, 19 nt, Homo sapiens
cagcugagccuauuucuga

SEQ ID NO: 840624 - RNA, 19 nt, Homo sapiens
uggcagaccuggaugauga

SEQ ID NO: 840625 - RNA, 19 nt, Homo sapiens
gaacucugguggaagaaau

SEQ ID NO: 840626 - RNA, 19 nt, Homo sapiens
gggagaaguuauauuguua

SEQ ID NO: 840627 - RNA, 19 nt, Homo sapiens
uuaugaagcugccuuauuu

SEQ ID NO: 840628 - RNA, 19 nt, Homo sapiens
gagaauaaauaccgguuug

SEQ ID NO: 840629 - RNA, 19 nt, Homo sapiens
guacauccaugccaucuuc

SEQ ID NO: 840630 - RNA, 19 nt, Homo sapiens
gaacuuagagagaaauuca

SEQ ID NO: 840631 - RNA, 19 nt, Homo sapiens
gagcagaucggagagaaua

SEQ ID NO: 840632 - RNA, 19 nt, Homo sapiens
gaaccaagacuucacuuca

SEQ ID NO: 840633 - RNA, 19 nt, Homo sapiens
ggguguauauuuauucuga

SEQ ID NO: 840634 - RNA, 19 nt, Homo sapiens
ccaagccacuauccacuuu

SEQ ID NO: 840635 - RNA, 19 nt, Homo sapiens
gaauccugcuccauacauu

SEQ ID NO: 840636 - RNA, 19 nt, Homo sapiens
aaacaaaccuuccaaaauc

SEQ ID NO: 840637 - RNA, 19 nt, Homo sapiens
gaggauggauggccuugga

SEQ ID NO: 840638 - RNA, 19 nt, Homo sapiens
ggugauaccagcaauaguu

SEQ ID NO: 840639 - RNA, 19 nt, Homo sapiens
cgggagaaguuauauuguu

SEQ ID NO: 840640 - RNA, 19 nt, Homo sapiens
gaacgggagaaguuauauu

SEQ ID NO: 840641 - RNA, 19 nt, Homo sapiens
cgauaacacugucuaagca

SEQ ID NO: 840642 - RNA, 19 nt, Homo sapiens
ggagagggcuaaacaaacc

SEQ ID NO: 840643 - RNA, 19 nt, Homo sapiens
ggucgaagguccaaaccau

SEQ ID NO: 840644 - RNA, 19 nt, Homo sapiens
ucaguucucucgcuguuau

SEQ ID NO: 840645 - RNA, 19 nt, Homo sapiens
aagaugagguuacaagaca

SEQ ID NO: 840646 - RNA, 19 nt, Homo sapiens
acaaguggcucagugcaaa

SEQ ID NO: 840647 - RNA, 19 nt, Homo sapiens
ccaaccaugucuaagaaga

SEQ ID NO: 840648 - RNA, 19 nt, Homo sapiens
ggauggccuuggaugaauu

SEQ ID NO: 840649 - RNA, 19 nt, Homo sapiens
cgagguagaacuaacauug

SEQ ID NO: 840650 - RNA, 19 nt, Homo sapiens
aaacuugacuugcuaucuc

SEQ ID NO: 840651 - RNA, 19 nt, Homo sapiens
gagguagaacuaacauuga

SEQ ID NO: 840652 - RNA, 19 nt, Homo sapiens
gcagaucggagagaauaaa

SEQ ID NO: 840653 - RNA, 19 nt, Homo sapiens
gaaaaggucaagauacaaa

SEQ ID NO: 840654 - RNA, 19 nt, Homo sapiens
guuaucccaucaucaggua

SEQ ID NO: 840655 - RNA, 19 nt, Homo sapiens
caggagagggcuaaacaaa

SEQ ID NO: 840656 - RNA, 19 nt, Homo sapiens
gaucggagagaauaaauac

SEQ ID NO: 840657 - RNA, 19 nt, Homo sapiens
guuaugaagcugccuuauu

SEQ ID NO: 840658 - RNA, 19 nt, Homo sapiens
cagaguaaccacagcugua

SEQ ID NO: 840659 - RNA, 19 nt, Homo sapiens
acauugaacuuagagagaa

SEQ ID NO: 840660 - RNA, 19 nt, Homo sapiens
gcacgagguagaacuaaca

SEQ ID NO: 840661 - RNA, 19 nt, Homo sapiens
gcuaaacaaaccuuccaaa

SEQ ID NO: 840662 - RNA, 19 nt, Homo sapiens
ucccaaccaugucuaagaa

SEQ ID NO: 840663 - RNA, 19 nt, Homo sapiens
gaagaugagguuacaagac

SEQ ID NO: 840664 - RNA, 19 nt, Homo sapiens
gugaaaaggucaagauaca

SEQ ID NO: 840665 - RNA, 19 nt, Homo sapiens
agacuucacuucaguucuc

SEQ ID NO: 840666 - RNA, 19 nt, Homo sapiens
gauggauggccuuggauga

SEQ ID NO: 840667 - RNA, 19 nt, Homo sapiens
aaucgaagaugagguuaca

SEQ ID NO: 840668 - RNA, 19 nt, Homo sapiens
ccagugcuagucagaguaa

SEQ ID NO: 840669 - RNA, 19 nt, Homo sapiens
cauugaacuuagagagaaa

SEQ ID NO: 840670 - RNA, 19 nt, Homo sapiens
agguagaacuaacauugaa

SEQ ID NO: 840671 - RNA, 19 nt, Homo sapiens
ccugguugguaaacaguaa

SEQ ID NO: 840672 - RNA, 19 nt, Homo sapiens
aagccacuauccacuuuga

SEQ ID NO: 840673 - RNA, 19 nt, Homo sapiens
gaaacgaccaacaccaacu

SEQ ID NO: 840674 - RNA, 19 nt, Homo sapiens
ggaaccaagacuucacuuc

SEQ ID NO: 840675 - RNA, 19 nt, Homo sapiens
gagcacgagguagaacuaa

SEQ ID NO: 840676 - RNA, 19 nt, Homo sapiens
gguuucagguggagcagau

SEQ ID NO: 840677 - RNA, 19 nt, Homo sapiens
gauaccagcaauaguucuu

SEQ ID NO: 840678 - RNA, 19 nt, Homo sapiens
gagguuaucccaucaucag

SEQ ID NO: 840679 - RNA, 19 nt, Homo sapiens
gcgcagcaccgugaugguu

SEQ ID NO: 840680 - RNA, 19 nt, Homo sapiens
caucagguagcaaguugaa

SEQ ID NO: 840681 - RNA, 19 nt, Homo sapiens
cgaagaugagguuacaaga

SEQ ID NO: 840682 - RNA, 19 nt, Homo sapiens
ccacaggugccaaaacuaa

SEQ ID NO: 840683 - RNA, 19 nt, Homo sapiens
aaccacagcuguacaucca

SEQ ID NO: 840684 - RNA, 19 nt, Homo sapiens
gauggccuuggaugaauuu

SEQ ID NO: 840685 - RNA, 19 nt, Homo sapiens
gacaaguggcucagugcaa

SEQ ID NO: 840686 - RNA, 19 nt, Homo sapiens
caagcgauaacacugucua

SEQ ID NO: 840687 - RNA, 19 nt, Homo sapiens
caagacuucacuucaguuc

SEQ ID NO: 840688 - RNA, 19 nt, Homo sapiens
cguuccagcuccagugcua

SEQ ID NO: 840689 - RNA, 19 nt, Homo sapiens
ggucaagauacaaaugugu

SEQ ID NO: 840690 - RNA, 19 nt, Homo sapiens
gcgauaacacugucuaagc

SEQ ID NO: 840691 - RNA, 19 nt, Homo sapiens
cuucaguucucucgcuguu

SEQ ID NO: 840692 - RNA, 19 nt, Homo sapiens
cgagcacgagguagaacua

SEQ ID NO: 840693 - RNA, 19 nt, Homo sapiens
ccaguggaaccaagacuuc

SEQ ID NO: 840694 - RNA, 19 nt, Homo sapiens
ggauuauuccuaaaugcau

SEQ ID NO: 840695 - RNA, 19 nt, Homo sapiens
ugguaacccuguaauggau

SEQ ID NO: 840696 - RNA, 19 nt, Homo sapiens
uaaaaucgaagaugagguu

SEQ ID NO: 840697 - RNA, 19 nt, Homo sapiens
aacgggagaaguuauauug

SEQ ID NO: 840698 - RNA, 19 nt, Homo sapiens
cugaacgggagaaguuaua

SEQ ID NO: 840699 - RNA, 19 nt, Homo sapiens
cuuugaauccugcuccaua

SEQ ID NO: 840700 - RNA, 19 nt, Homo sapiens
aaacgaccaacaccaacuu

SEQ ID NO: 840701 - RNA, 19 nt, Homo sapiens
gcgcggugcaggguuguaa

SEQ ID NO: 840702 - RNA, 19 nt, Homo sapiens
aaaauuugccuccugguaa

SEQ ID NO: 840703 - RNA, 19 nt, Homo sapiens
uggauggccuuggaugaau

SEQ ID NO: 840704 - RNA, 19 nt, Homo sapiens
uggagcagaucggagagaa

SEQ ID NO: 840705 - RNA, 19 nt, Homo sapiens
gccacuauccacuuugaau

SEQ ID NO: 840706 - RNA, 19 nt, Homo sapiens
uagagagaaauucauccua

SEQ ID NO: 840707 - RNA, 19 nt, Homo sapiens
aaauuugccuccugguaac

SEQ ID NO: 840708 - RNA, 19 nt, Homo sapiens
ccacuauccacuuugaauc

SEQ ID NO: 840709 - RNA, 19 nt, Homo sapiens
guagaacuaacauugaacu

SEQ ID NO: 840710 - RNA, 19 nt, Homo sapiens
cuccaggucccaagcgaua

SEQ ID NO: 840711 - RNA, 19 nt, Homo sapiens
caucaucagguagcaaguu

SEQ ID NO: 840712 - RNA, 19 nt, Homo sapiens
aaaggucaagauacaaaug

SEQ ID NO: 840713 - RNA, 19 nt, Homo sapiens
uaaaauuugccuccuggua

SEQ ID NO: 840714 - RNA, 19 nt, Homo sapiens
uaaucgggcagacccuaaa

SEQ ID NO: 840715 - RNA, 19 nt, Homo sapiens
ccaagacuucacuucaguu

SEQ ID NO: 840716 - RNA, 19 nt, Homo sapiens
aaccaagacuucacuucag

SEQ ID NO: 840717 - RNA, 19 nt, Homo sapiens
cuaaacaaaccuuccaaaa

SEQ ID NO: 840718 - RNA, 19 nt, Homo sapiens
cuaaucgggcagacccuaa

SEQ ID NO: 840719 - RNA, 19 nt, Homo sapiens
ggacaagaauucaguguuu

SEQ ID NO: 840720 - RNA, 19 nt, Homo sapiens
ggaaagaugucccagaauu

SEQ ID NO: 840721 - RNA, 19 nt, Homo sapiens
cagaagagcugacaacaaa

SEQ ID NO: 840722 - RNA, 19 nt, Homo sapiens
ggucaaagguuaugagauu

SEQ ID NO: 840723 - RNA, 19 nt, Homo sapiens
gaacaagucucugaagcua

SEQ ID NO: 840724 - RNA, 19 nt, Homo sapiens
gaaaucaauugcaaaggua

SEQ ID NO: 840725 - RNA, 19 nt, Homo sapiens
gaaauuacuucucugaguu

SEQ ID NO: 840726 - RNA, 19 nt, Homo sapiens
caaaggaacuggcagagaa

SEQ ID NO: 840727 - RNA, 19 nt, Homo sapiens
gcaaugaccugccuagugu

SEQ ID NO: 840728 - RNA, 19 nt, Homo sapiens
caacucagcacgugaaaua

SEQ ID NO: 840729 - RNA, 19 nt, Homo sapiens
guaaagaccuugaccuugu

SEQ ID NO: 840730 - RNA, 19 nt, Homo sapiens
acaaauaucugagcaauug

SEQ ID NO: 840731 - RNA, 19 nt, Homo sapiens
caaagaaccaucagaaauu

SEQ ID NO: 840732 - RNA, 19 nt, Homo sapiens
ggaacuaucugcguaaaga

SEQ ID NO: 840733 - RNA, 19 nt, Homo sapiens
gaucaaacagcauacaaua

SEQ ID NO: 840734 - RNA, 19 nt, Homo sapiens
gaacuacuuucacuugaga

SEQ ID NO: 840735 - RNA, 19 nt, Homo sapiens
gaagacaguuaaagagaga

SEQ ID NO: 840736 - RNA, 19 nt, Homo sapiens
ugaaagagaauacugcuua

SEQ ID NO: 840737 - RNA, 19 nt, Homo sapiens
gaaaucagccagaucaaga

SEQ ID NO: 840738 - RNA, 19 nt, Homo sapiens
aaaaguagcucgugacaua

SEQ ID NO: 840739 - RNA, 19 nt, Homo sapiens
gacaguugauguuauagua

SEQ ID NO: 840740 - RNA, 19 nt, Homo sapiens
gaaagagaauacugcuuau

SEQ ID NO: 840741 - RNA, 19 nt, Homo sapiens
gcaaagaaccaucagaaau

SEQ ID NO: 840742 - RNA, 19 nt, Homo sapiens
agaaagagcuggagaacau

SEQ ID NO: 840743 - RNA, 19 nt, Homo sapiens
gaaagaugucccagaauuu

SEQ ID NO: 840744 - RNA, 19 nt, Homo sapiens
uagaagagaugcagaugaa

SEQ ID NO: 840745 - RNA, 19 nt, Homo sapiens
ccacaggcauguucaagaa

SEQ ID NO: 840746 - RNA, 19 nt, Homo sapiens
gaacauguggagaagguua

SEQ ID NO: 840747 - RNA, 19 nt, Homo sapiens
gaacuaguugucccacuua

SEQ ID NO: 840748 - RNA, 19 nt, Homo sapiens
ggcaucagcugcauguuaa

SEQ ID NO: 840749 - RNA, 19 nt, Homo sapiens
caaaggagacuugagauuu

SEQ ID NO: 840750 - RNA, 19 nt, Homo sapiens
cacgagagcuggagucauu

SEQ ID NO: 840751 - RNA, 19 nt, Homo sapiens
caauggaacuggaggagaa

SEQ ID NO: 840752 - RNA, 19 nt, Homo sapiens
cagaaaugguugaaagaaa

SEQ ID NO: 840753 - RNA, 19 nt, Homo sapiens
gaguugaucugguugaaug

SEQ ID NO: 840754 - RNA, 19 nt, Homo sapiens
aaaggagacuugagauuug

SEQ ID NO: 840755 - RNA, 19 nt, Homo sapiens
ggagaagguuaaagaacuu

SEQ ID NO: 840756 - RNA, 19 nt, Homo sapiens
ugaaguccauggagaauga

SEQ ID NO: 840757 - RNA, 19 nt, Homo sapiens
ggaaagcucaucauagaga

SEQ ID NO: 840758 - RNA, 19 nt, Homo sapiens
gaacucugguggaagaaau

SEQ ID NO: 840759 - RNA, 19 nt, Homo sapiens
aaucugagcuagaaaguau

SEQ ID NO: 840760 - RNA, 19 nt, Homo sapiens
uaugaaaugugacagcuuu

SEQ ID NO: 840761 - RNA, 19 nt, Homo sapiens
ggacaaugcauuaaggauu

SEQ ID NO: 840762 - RNA, 19 nt, Homo sapiens
gccaucagauuaugaagaa

SEQ ID NO: 840763 - RNA, 19 nt, Homo sapiens
gaaccuagauacucuugag

SEQ ID NO: 840764 - RNA, 19 nt, Homo sapiens
caacagaugcugcaacaga

SEQ ID NO: 840765 - RNA, 19 nt, Homo sapiens
uaaagaccuugaccuugua

SEQ ID NO: 840766 - RNA, 19 nt, Homo sapiens
gcauaugacuggagugaca

SEQ ID NO: 840767 - RNA, 19 nt, Homo sapiens
uguaugaacuacugucuuu

SEQ ID NO: 840768 - RNA, 19 nt, Homo sapiens
ggaacaagcuuuugaagug

SEQ ID NO: 840769 - RNA, 19 nt, Homo sapiens
ucacugaacugagcucuug

SEQ ID NO: 840770 - RNA, 19 nt, Homo sapiens
gcaauugaaugcccuaaac

SEQ ID NO: 840771 - RNA, 19 nt, Homo sapiens
cgaacaaucuuaucagaag

SEQ ID NO: 840772 - RNA, 19 nt, Homo sapiens
gacacaguauuguaaauug

SEQ ID NO: 840773 - RNA, 19 nt, Homo sapiens
ggguaagcaucaucuuuaa

SEQ ID NO: 840774 - RNA, 19 nt, Homo sapiens
gaaggcccgucaccaagaa

SEQ ID NO: 840775 - RNA, 19 nt, Homo sapiens
ggucauaagcucucagaaa

SEQ ID NO: 840776 - RNA, 19 nt, Homo sapiens
caaagaaucaacagacauu

SEQ ID NO: 840777 - RNA, 19 nt, Homo sapiens
gagcuggagucauucuuga

SEQ ID NO: 840778 - RNA, 19 nt, Homo sapiens
gcagaacuacuuucacuug

SEQ ID NO: 840779 - RNA, 19 nt, Homo sapiens
agucagaugucauuaugua

SEQ ID NO: 840780 - RNA, 19 nt, Homo sapiens
cuaaugauguggaagaaga

SEQ ID NO: 840781 - RNA, 19 nt, Homo sapiens
ggugacagcugguuacaca

SEQ ID NO: 840782 - RNA, 19 nt, Homo sapiens
gaagaaaucaauugcaaag

SEQ ID NO: 840783 - RNA, 19 nt, Homo sapiens
acacugcucuccacucaaa

SEQ ID NO: 840784 - RNA, 19 nt, Homo sapiens
uaaacaaggcuuaccauga

SEQ ID NO: 840785 - RNA, 19 nt, Homo sapiens
gaaagaacaagucucugaa

SEQ ID NO: 840786 - RNA, 19 nt, Homo sapiens
gaagagcugacaacaaaga

SEQ ID NO: 840787 - RNA, 19 nt, Homo sapiens
gaaauugagagaaaucaga

SEQ ID NO: 840788 - RNA, 19 nt, Homo sapiens
gaacaccauuucugucaag

SEQ ID NO: 840789 - RNA, 19 nt, Homo sapiens
ucacagagcuacagaagac

SEQ ID NO: 840790 - RNA, 19 nt, Homo sapiens
gcaggaucauaaagaguuu

SEQ ID NO: 840791 - RNA, 19 nt, Homo sapiens
gaaaguauccaggaaguuc

SEQ ID NO: 840792 - RNA, 19 nt, Homo sapiens
uaaacugccucaagguuau

SEQ ID NO: 840793 - RNA, 19 nt, Homo sapiens
gagaugccuccuuauauaa

SEQ ID NO: 840794 - RNA, 19 nt, Homo sapiens
cuagaugacugggcaagua

SEQ ID NO: 840795 - RNA, 19 nt, Homo sapiens
aaagaaccaucagaaauug

SEQ ID NO: 840796 - RNA, 19 nt, Homo sapiens
cagagaaacuggacaagca

SEQ ID NO: 840797 - RNA, 19 nt, Homo sapiens
acaagucucugaagcuauu

SEQ ID NO: 840798 - RNA, 19 nt, Homo sapiens
ccuccaagauuccauuaaa

SEQ ID NO: 840799 - RNA, 19 nt, Homo sapiens
gcacauccauacgagugua

SEQ ID NO: 840800 - RNA, 19 nt, Homo sapiens
guuccacccucuacuuuaa

SEQ ID NO: 840801 - RNA, 19 nt, Homo sapiens
ggaagcaggugucaucacu

SEQ ID NO: 840802 - RNA, 19 nt, Homo sapiens
caucagaaauuggaaacuu

SEQ ID NO: 840803 - RNA, 19 nt, Homo sapiens
gcagagaacaagaagaaga

SEQ ID NO: 840804 - RNA, 19 nt, Homo sapiens
aaacaaggcuuaccaugac

SEQ ID NO: 840805 - RNA, 19 nt, Homo sapiens
ugacaacaauuccaauauc

SEQ ID NO: 840806 - RNA, 19 nt, Homo sapiens
ccaaaacccuguugaacua

SEQ ID NO: 840807 - RNA, 19 nt, Homo sapiens
uaagggaacucugguggaa

SEQ ID NO: 840808 - RNA, 19 nt, Homo sapiens
gaagggaguauuccaccua

SEQ ID NO: 840809 - RNA, 19 nt, Homo sapiens
acacauuucuuccaacaga

SEQ ID NO: 840810 - RNA, 19 nt, Homo sapiens
gaguaaagcagcaaaggaa

SEQ ID NO: 840811 - RNA, 19 nt, Homo sapiens
gcuagaaaguauccaggaa

SEQ ID NO: 840812 - RNA, 19 nt, Homo sapiens
gauguacauuucagaguug

SEQ ID NO: 840813 - RNA, 19 nt, Homo sapiens
ccacaaaggagacuugaga

SEQ ID NO: 840814 - RNA, 19 nt, Homo sapiens
gacaagcaaugugagauga

SEQ ID NO: 840815 - RNA, 19 nt, Homo sapiens
ggagcuagcuuggagaaag

SEQ ID NO: 840816 - RNA, 19 nt, Homo sapiens
gaucgaugcucuccuggau

SEQ ID NO: 840817 - RNA, 19 nt, Homo sapiens
cagcugaguugaucugguu

SEQ ID NO: 840818 - RNA, 19 nt, Homo sapiens
gacaaccgguacaauguga

SEQ ID NO: 840819 - RNA, 19 nt, Homo sapiens
gaggagaacuugcucaaua

SEQ ID NO: 840820 - RNA, 19 nt, Homo sapiens
ggauuaagcuucaacauga

SEQ ID NO: 840821 - RNA, 19 nt, Homo sapiens
ggaguucccugaagcaaua

SEQ ID NO: 840822 - RNA, 19 nt, Homo sapiens
ggacaucauuuauagagua

SEQ ID NO: 840823 - RNA, 19 nt, Homo sapiens
ggagucagcuggcauagaa

SEQ ID NO: 840824 - RNA, 19 nt, Homo sapiens
gaagaaugggugacuauua

SEQ ID NO: 840825 - RNA, 19 nt, Homo sapiens
gaagaaauccaguaucuga

SEQ ID NO: 840826 - RNA, 19 nt, Homo sapiens
aaacggaacugucugauug

SEQ ID NO: 840827 - RNA, 19 nt, Homo sapiens
ugacauagauuccggcaaa

SEQ ID NO: 840828 - RNA, 19 nt, Homo sapiens
gaagcaaacugguuguguu

SEQ ID NO: 840829 - RNA, 19 nt, Homo sapiens
ccacaucacucuugaaauc

SEQ ID NO: 840830 - RNA, 19 nt, Homo sapiens
ggaacugucugauuguuga

SEQ ID NO: 840831 - RNA, 19 nt, Homo sapiens
gaaauccaguaucugagua

SEQ ID NO: 840832 - RNA, 19 nt, Homo sapiens
cagaaacugucccuugaua

SEQ ID NO: 840833 - RNA, 19 nt, Homo sapiens
agaaacagcuccauugguu

SEQ ID NO: 840834 - RNA, 19 nt, Homo sapiens
gaaggacagguaauaguua

SEQ ID NO: 840835 - RNA, 19 nt, Homo sapiens
ucaaggaacuuuaucuuuc

SEQ ID NO: 840836 - RNA, 19 nt, Homo sapiens
ugaguuaacugaaauggaa

SEQ ID NO: 840837 - RNA, 19 nt, Homo sapiens
ggugagcugucaaaccuua

SEQ ID NO: 840838 - RNA, 19 nt, Homo sapiens
caacaacaauauugagaug

SEQ ID NO: 840839 - RNA, 19 nt, Homo sapiens
gaagagaucauuagcuuuc

SEQ ID NO: 840840 - RNA, 19 nt, Homo sapiens
gagauggugugucuaagaa

SEQ ID NO: 840841 - RNA, 19 nt, Homo sapiens
gcaaacugguuguguugaa

SEQ ID NO: 840842 - RNA, 19 nt, Homo sapiens
ucaaggagcuucgugugua

SEQ ID NO: 840843 - RNA, 19 nt, Homo sapiens
cagcaguacuccuauauug

SEQ ID NO: 840844 - RNA, 19 nt, Homo sapiens
caagggaaagucaugauua

SEQ ID NO: 840845 - RNA, 19 nt, Homo sapiens
guaauuaccuggaaacacu

SEQ ID NO: 840846 - RNA, 19 nt, Homo sapiens
aaacagaucaaccucaaua

SEQ ID NO: 840847 - RNA, 19 nt, Homo sapiens
caacaugaauucugaagag

SEQ ID NO: 840848 - RNA, 19 nt, Homo sapiens
gaucagcugugaccuggaa

SEQ ID NO: 840849 - RNA, 19 nt, Homo sapiens
gucagaaggugaucucuuu

SEQ ID NO: 840850 - RNA, 19 nt, Homo sapiens
gguaauaguuaaccucuuc

SEQ ID NO: 840851 - RNA, 19 nt, Homo sapiens
gaugaaccauaacuaaaug

SEQ ID NO: 840852 - RNA, 19 nt, Homo sapiens
agaaggacaucauuuauag

SEQ ID NO: 840853 - RNA, 19 nt, Homo sapiens
cagaagaaauccaguaucu

SEQ ID NO: 840854 - RNA, 19 nt, Homo sapiens
cgacagcaguacuccuaua

SEQ ID NO: 840855 - RNA, 19 nt, Homo sapiens
uaaggacccuguacuugaa

SEQ ID NO: 840856 - RNA, 19 nt, Homo sapiens
ggugaucucuuuaaugcuu

SEQ ID NO: 840857 - RNA, 19 nt, Homo sapiens
ggaaggacagguaauaguu

SEQ ID NO: 840858 - RNA, 19 nt, Homo sapiens
gcacuaaaucccaucauug

SEQ ID NO: 840859 - RNA, 19 nt, Homo sapiens
gaaacugucccuugauaau

SEQ ID NO: 840860 - RNA, 19 nt, Homo sapiens
cagaaggacaucauuuaua

SEQ ID NO: 840861 - RNA, 19 nt, Homo sapiens
guuccaggcucgagcauuu

SEQ ID NO: 840862 - RNA, 19 nt, Homo sapiens
aagaaugggugacuauuau

SEQ ID NO: 840863 - RNA, 19 nt, Homo sapiens
ggagggcuuucaggacuua

SEQ ID NO: 840864 - RNA, 19 nt, Homo sapiens
gaucaaggaaggacaggua

SEQ ID NO: 840865 - RNA, 19 nt, Homo sapiens
gaagcaauauuccuuugag

SEQ ID NO: 840866 - RNA, 19 nt, Homo sapiens
ggugggacgucuucuggua

SEQ ID NO: 840867 - RNA, 19 nt, Homo sapiens
agaucaaccucaauaauga

SEQ ID NO: 840868 - RNA, 19 nt, Homo sapiens
ugaaacagaucaaccucaa

SEQ ID NO: 840869 - RNA, 19 nt, Homo sapiens
gcagaaggacaucauuuau

SEQ ID NO: 840870 - RNA, 19 nt, Homo sapiens
caaggaaggacagguaaua

SEQ ID NO: 840871 - RNA, 19 nt, Homo sapiens
cagaaucuuuccugcuuaa

SEQ ID NO: 840872 - RNA, 19 nt, Homo sapiens
gagcagaaggacaucauuu

SEQ ID NO: 840873 - RNA, 19 nt, Homo sapiens
guguagaccuccugacuga

SEQ ID NO: 840874 - RNA, 19 nt, Homo sapiens
gaaugaagacaaacacaga

SEQ ID NO: 840875 - RNA, 19 nt, Homo sapiens
uaaagcaacugagugucua

SEQ ID NO: 840876 - RNA, 19 nt, Homo sapiens
uggaagagaucauuagcuu

SEQ ID NO: 840877 - RNA, 19 nt, Homo sapiens
ucaagaaucucaaggaacu

SEQ ID NO: 840878 - RNA, 19 nt, Homo sapiens
aauaaugaauggacaguug

SEQ ID NO: 840879 - RNA, 19 nt, Homo sapiens
gagaacaaacugaaacaga

SEQ ID NO: 840880 - RNA, 19 nt, Homo sapiens
uccaguaucugaguaauuu

SEQ ID NO: 840881 - RNA, 19 nt, Homo sapiens
uaucagaggucagugagaa

SEQ ID NO: 840882 - RNA, 19 nt, Homo sapiens
uaguuaaccucuucuguga

SEQ ID NO: 840883 - RNA, 19 nt, Homo sapiens
uccaaacgcuucuccauau

SEQ ID NO: 840884 - RNA, 19 nt, Homo sapiens
ccagucaucuuaucacauc

SEQ ID NO: 840885 - RNA, 19 nt, Homo sapiens
gagacuaauugcagagguu

SEQ ID NO: 840886 - RNA, 19 nt, Homo sapiens
gaaggugaucucuuuaaug

SEQ ID NO: 840887 - RNA, 19 nt, Homo sapiens
guuaaccucuucugugaga

SEQ ID NO: 840888 - RNA, 19 nt, Homo sapiens
gaugaagaaugggugacua

SEQ ID NO: 840889 - RNA, 19 nt, Homo sapiens
ugucaaaccuuacucaucu

SEQ ID NO: 840890 - RNA, 19 nt, Homo sapiens
ggaaagucaugauuacacu

SEQ ID NO: 840891 - RNA, 19 nt, Homo sapiens
gaaugggugacuauuauga

SEQ ID NO: 840892 - RNA, 19 nt, Homo sapiens
ucaagauacuacagauuug

SEQ ID NO: 840893 - RNA, 19 nt, Homo sapiens
agaacaaacugaaacagau

SEQ ID NO: 840894 - RNA, 19 nt, Homo sapiens
ccaaacgcuucuccauauu

SEQ ID NO: 840895 - RNA, 19 nt, Homo sapiens
gaagacaaacacagagaug

SEQ ID NO: 840896 - RNA, 19 nt, Homo sapiens
gacaaauguugacuuaaag

SEQ ID NO: 840897 - RNA, 19 nt, Homo sapiens
aagcugcaguguuuacuuu

SEQ ID NO: 840898 - RNA, 19 nt, Homo sapiens
ucagaaucuuuccugcuua

SEQ ID NO: 840899 - RNA, 19 nt, Homo sapiens
ggcacuaaaucccaucauu

SEQ ID NO: 840900 - RNA, 19 nt, Homo sapiens
uuacagacgugcuuagaca

SEQ ID NO: 840901 - RNA, 19 nt, Homo sapiens
ccugaacaguugaguacua

SEQ ID NO: 840902 - RNA, 19 nt, Homo sapiens
cgccugaaauuuacugaaa

SEQ ID NO: 840903 - RNA, 19 nt, Homo sapiens
uaacccacaucacucuuga

SEQ ID NO: 840904 - RNA, 19 nt, Homo sapiens
gcaugcauguggagcagaa

SEQ ID NO: 840905 - RNA, 19 nt, Homo sapiens
gcaugaacacauccucuaa

SEQ ID NO: 840906 - RNA, 19 nt, Homo sapiens
caacaauauugagaugcua

SEQ ID NO: 840907 - RNA, 19 nt, Homo sapiens
ccucaagaaucucaaggaa

SEQ ID NO: 840908 - RNA, 19 nt, Homo sapiens
cagaucaaccucaauaaug

SEQ ID NO: 840909 - RNA, 19 nt, Homo sapiens
gaacaaacugaaacagauc

SEQ ID NO: 840910 - RNA, 19 nt, Homo sapiens
gcaguacuccuauauugau

SEQ ID NO: 840911 - RNA, 19 nt, Homo sapiens
ugaacaugguguaggagua

SEQ ID NO: 840912 - RNA, 19 nt, Homo sapiens
acacaaacauccaaaccau

SEQ ID NO: 840913 - RNA, 19 nt, Homo sapiens
ggacugggagcuaugaaau

SEQ ID NO: 840914 - RNA, 19 nt, Homo sapiens
uuauugagauguugcaaga

SEQ ID NO: 840915 - RNA, 19 nt, Homo sapiens
cuaaucaccuccuaaaugc

SEQ ID NO: 840916 - RNA, 19 nt, Homo sapiens
ucaguaugauccucuuuau

SEQ ID NO: 840917 - RNA, 19 nt, Homo sapiens
gaacacauccucuaauccu

SEQ ID NO: 840918 - RNA, 19 nt, Homo sapiens
uaacugagcuaaaaugcuu

SEQ ID NO: 840919 - RNA, 19 nt, Homo sapiens
gguaagaccucucugaaga

SEQ ID NO: 840920 - RNA, 19 nt, Homo sapiens
gcucagaggucacacugua

SEQ ID NO: 840921 - RNA, 19 nt, Homo sapiens
gaagagcugucaugaagga

SEQ ID NO: 840922 - RNA, 19 nt, Homo sapiens
ggaaauaggagcugucauu

SEQ ID NO: 840923 - RNA, 19 nt, Homo sapiens
gauacaaggucaugacuau

SEQ ID NO: 840924 - RNA, 19 nt, Homo sapiens
ggaaaugauuagauucuga

SEQ ID NO: 840925 - RNA, 19 nt, Homo sapiens
gaaauaggagcugucauua

SEQ ID NO: 840926 - RNA, 19 nt, Homo sapiens
aaauguggcuguugauuaa

SEQ ID NO: 840927 - RNA, 19 nt, Homo sapiens
gaacacaggccacuacaga

SEQ ID NO: 840928 - RNA, 19 nt, Homo sapiens
gaagugaauuuguuagauc

SEQ ID NO: 840929 - RNA, 19 nt, Homo sapiens
caaauguggcuguugauua

SEQ ID NO: 840930 - RNA, 19 nt, Homo sapiens
guagcuggcuggcugauuu

SEQ ID NO: 840931 - RNA, 19 nt, Homo sapiens
ccagaagccaucagaauua

SEQ ID NO: 840932 - RNA, 19 nt, Homo sapiens
ggucaugacuauccuagaa

SEQ ID NO: 840933 - RNA, 19 nt, Homo sapiens
guacaacagucuugcauuc

SEQ ID NO: 840934 - RNA, 19 nt, Homo sapiens
ggcauucucuuauuuauuc

SEQ ID NO: 840935 - RNA, 19 nt, Homo sapiens
aaagugaccuuaacugaau

SEQ ID NO: 840936 - RNA, 19 nt, Homo sapiens
ugaaggaggugggaaauga

SEQ ID NO: 840937 - RNA, 19 nt, Homo sapiens
ggugggaaaugauuagauu

SEQ ID NO: 840938 - RNA, 19 nt, Homo sapiens
caaaggccauugcauugaa

SEQ ID NO: 840939 - RNA, 19 nt, Homo sapiens
uaagauaaauucccagaag

SEQ ID NO: 840940 - RNA, 19 nt, Homo sapiens
gaggaguguuccauaguuu

SEQ ID NO: 840941 - RNA, 19 nt, Homo sapiens
guuguaaacuugaaagaga

SEQ ID NO: 840942 - RNA, 19 nt, Homo sapiens
ggugaauuaucucuacuaa

SEQ ID NO: 840943 - RNA, 19 nt, Homo sapiens
uggccaacauggugaauua

SEQ ID NO: 840944 - RNA, 19 nt, Homo sapiens
gaaccaggccgaucacuuc

SEQ ID NO: 840945 - RNA, 19 nt, Homo sapiens
gaaagaaagggcaccagaa

SEQ ID NO: 840946 - RNA, 19 nt, Homo sapiens
aauaggagcugucauuauc

SEQ ID NO: 840947 - RNA, 19 nt, Homo sapiens
gcuaaagcauguauauaag

SEQ ID NO: 840948 - RNA, 19 nt, Homo sapiens
aggagaaacuguacagaaa

SEQ ID NO: 840949 - RNA, 19 nt, Homo sapiens
uauaagagcacguuguaaa

SEQ ID NO: 840950 - RNA, 19 nt, Homo sapiens
uaucaaagaucucaaacag

SEQ ID NO: 840951 - RNA, 19 nt, Homo sapiens
gacaaaggccauugcauug

SEQ ID NO: 840952 - RNA, 19 nt, Homo sapiens
ggcaugagcugauucacau

SEQ ID NO: 840953 - RNA, 19 nt, Homo sapiens
cagaucagcuaaagcaugu

SEQ ID NO: 840954 - RNA, 19 nt, Homo sapiens
cuacagaaguacaugguau

SEQ ID NO: 840955 - RNA, 19 nt, Homo sapiens
cugaagagcugucaugaag

SEQ ID NO: 840956 - RNA, 19 nt, Homo sapiens
acacuaggcacacacuuua

SEQ ID NO: 840957 - RNA, 19 nt, Homo sapiens
gagaaggagcugcagauga

SEQ ID NO: 840958 - RNA, 19 nt, Homo sapiens
gaagccaucagaauuauca

SEQ ID NO: 840959 - RNA, 19 nt, Homo sapiens
cgaggaguguuccauaguu

SEQ ID NO: 840960 - RNA, 19 nt, Homo sapiens
uauguagccuggauaaaug

SEQ ID NO: 840961 - RNA, 19 nt, Homo sapiens
agacaaaggccauugcauu

SEQ ID NO: 840962 - RNA, 19 nt, Homo sapiens
cuacugauuccgagaguua

SEQ ID NO: 840963 - RNA, 19 nt, Homo sapiens
ccagagccaguuuccauua

SEQ ID NO: 840964 - RNA, 19 nt, Homo sapiens
agaaggagcugcagaugag

SEQ ID NO: 840965 - RNA, 19 nt, Homo sapiens
ggucucaaaugcugcaguu

SEQ ID NO: 840966 - RNA, 19 nt, Homo sapiens
ccaaggcucugaccucaca

SEQ ID NO: 840967 - RNA, 19 nt, Homo sapiens
gagaaacuguacagaaagg

SEQ ID NO: 840968 - RNA, 19 nt, Homo sapiens
uaaagugaccuuaacugaa

SEQ ID NO: 840969 - RNA, 19 nt, Homo sapiens
cuagaacucucugugguuu

SEQ ID NO: 840970 - RNA, 19 nt, Homo sapiens
gcaacugugucuccuccuu

SEQ ID NO: 840971 - RNA, 19 nt, Homo sapiens
uauauaagagcacguugua

SEQ ID NO: 840972 - RNA, 19 nt, Homo sapiens
ggagugcaguggcaugauc

SEQ ID NO: 840973 - RNA, 19 nt, Homo sapiens
uaaacacuaugcaaaugga

SEQ ID NO: 840974 - RNA, 19 nt, Homo sapiens
gauaaauucccagaaguga

SEQ ID NO: 840975 - RNA, 19 nt, Homo sapiens
agaaagggcaccagaaguu

SEQ ID NO: 840976 - RNA, 19 nt, Homo sapiens
gccaacaccaugaggcuua

SEQ ID NO: 840977 - RNA, 19 nt, Homo sapiens
acucuucccuuccaaugua

SEQ ID NO: 840978 - RNA, 19 nt, Homo sapiens
ccaggccgaucacuucuug

SEQ ID NO: 840979 - RNA, 19 nt, Homo sapiens
caaaggcccagaucagcua

SEQ ID NO: 840980 - RNA, 19 nt, Homo sapiens
cagaagccaucagaauuau

SEQ ID NO: 840981 - RNA, 19 nt, Homo sapiens
guauguagccuggauaaau

SEQ ID NO: 840982 - RNA, 19 nt, Homo sapiens
ggagaggcccagauucaug

SEQ ID NO: 840983 - RNA, 19 nt, Homo sapiens
cagcgaagcccagauaaga

SEQ ID NO: 840984 - RNA, 19 nt, Homo sapiens
gaggugggcagaucacuug

SEQ ID NO: 840985 - RNA, 19 nt, Homo sapiens
cuagaaaguagaagaugua

SEQ ID NO: 840986 - RNA, 19 nt, Homo sapiens
gaaucaagcguaaagucuu

SEQ ID NO: 840987 - RNA, 19 nt, Homo sapiens
cauaucagcaguaauaauc

SEQ ID NO: 840988 - RNA, 19 nt, Homo sapiens
guaccuaaagugaccuuaa

SEQ ID NO: 840989 - RNA, 19 nt, Homo sapiens
gaacaauggagccagagau

SEQ ID NO: 840990 - RNA, 19 nt, Homo sapiens
caacagagcgagacuccau

SEQ ID NO: 840991 - RNA, 19 nt, Homo sapiens
ggagagagaaagggugaaa

SEQ ID NO: 840992 - RNA, 19 nt, Homo sapiens
ucagccaccuuaccuucua

SEQ ID NO: 840993 - RNA, 19 nt, Homo sapiens
gcuguaaacacuaugcaaa

SEQ ID NO: 840994 - RNA, 19 nt, Homo sapiens
cuaaagugaccuuaacuga

SEQ ID NO: 840995 - RNA, 19 nt, Homo sapiens
gcacgugcuuucugcucuu

SEQ ID NO: 840996 - RNA, 19 nt, Homo sapiens
ucccagaagugaauuuguu

SEQ ID NO: 840997 - RNA, 19 nt, Homo sapiens
gagcugauucacauucuga

SEQ ID NO: 840998 - RNA, 19 nt, Homo sapiens
ggccauggcaggaagcuuu

SEQ ID NO: 840999 - RNA, 19 nt, Homo sapiens
gaggucacacuguaucaaa

SEQ ID NO: 841000 - RNA, 19 nt, Homo sapiens
cuucagugcuuccuacaga

SEQ ID NO: 841001 - RNA, 19 nt, Homo sapiens
caugugaguuucaacaagu

SEQ ID NO: 841002 - RNA, 19 nt, Homo sapiens
gcaggagaauggcuugaac

SEQ ID NO: 841003 - RNA, 19 nt, Homo sapiens
ccaacauggugaauuaucu

SEQ ID NO: 841004 - RNA, 19 nt, Homo sapiens
gaccagugcagggcuguua

SEQ ID NO: 841005 - RNA, 19 nt, Homo sapiens
uagaugagcccagguaaga

SEQ ID NO: 841006 - RNA, 19 nt, Homo sapiens
gagagaaucaagcguaaag

SEQ ID NO: 841007 - RNA, 19 nt, Homo sapiens
gaaagggcaccagaaguuc

SEQ ID NO: 841008 - RNA, 19 nt, Homo sapiens
ggaauucauuugccaucca

SEQ ID NO: 841009 - RNA, 19 nt, Homo sapiens
acaggccacuacagaagua

SEQ ID NO: 841010 - RNA, 19 nt, Homo sapiens
guuggaugguugcucagua

SEQ ID NO: 841011 - RNA, 19 nt, Homo sapiens
gguauggucagacgaaaug

SEQ ID NO: 841012 - RNA, 19 nt, Homo sapiens
ugggaucaguuucauguga

SEQ ID NO: 841013 - RNA, 19 nt, Homo sapiens
ggaguguuccauaguuuau

SEQ ID NO: 841014 - RNA, 19 nt, Homo sapiens
cuggauaaaugcucuuaau

SEQ ID NO: 841015 - RNA, 19 nt, Homo sapiens
gagcaggcgagcugacauu

SEQ ID NO: 841016 - RNA, 19 nt, Homo sapiens
gcauucagcagguguuugu

SEQ ID NO: 841017 - RNA, 19 nt, Homo sapiens
ggagguuacccaagaaaca

SEQ ID NO: 841018 - RNA, 19 nt, Homo sapiens
caggagaaacuguacagaa

SEQ ID NO: 841019 - RNA, 19 nt, Homo sapiens
gagaaucacuccuguguua

SEQ ID NO: 841020 - RNA, 19 nt, Homo sapiens
guaaacagauguagagaaa

SEQ ID NO: 841021 - RNA, 19 nt, Homo sapiens
guacuuguccuuaauguua

SEQ ID NO: 841022 - RNA, 19 nt, Homo sapiens
ucaaagcacuuggcauuua

SEQ ID NO: 841023 - RNA, 19 nt, Homo sapiens
gcucaggucuguuuguaaa

SEQ ID NO: 841024 - RNA, 19 nt, Homo sapiens
aaacagauguagagaaaug

SEQ ID NO: 841025 - RNA, 19 nt, Homo sapiens
caaagcacuuggcauuuaa

SEQ ID NO: 841026 - RNA, 19 nt, Homo sapiens
gacgucauccugauaauua

SEQ ID NO: 841027 - RNA, 19 nt, Homo sapiens
gggcaaagguaaacagaug

SEQ ID NO: 841028 - RNA, 19 nt, Homo sapiens
uuaaauaacuucccaaggu

SEQ ID NO: 841029 - RNA, 19 nt, Homo sapiens
gcacaggccgugaaacauu

SEQ ID NO: 841030 - RNA, 19 nt, Homo sapiens
ugagauaguucaugaagug

SEQ ID NO: 841031 - RNA, 19 nt, Homo sapiens
gcagggaacauacuaauuc

SEQ ID NO: 841032 - RNA, 19 nt, Homo sapiens
gaaagaccaugggcuuaga

SEQ ID NO: 841033 - RNA, 19 nt, Homo sapiens
gaaccaggccgaucacuuc

SEQ ID NO: 841034 - RNA, 19 nt, Homo sapiens
ggucaaagcacuuggcauu

SEQ ID NO: 841035 - RNA, 19 nt, Homo sapiens
guggaucacuugagccuaa

SEQ ID NO: 841036 - RNA, 19 nt, Homo sapiens
ucacuccuguguuaccuua

SEQ ID NO: 841037 - RNA, 19 nt, Homo sapiens
caugaaguggguauuauua

SEQ ID NO: 841038 - RNA, 19 nt, Homo sapiens
gaaguggguauuauuauca

SEQ ID NO: 841039 - RNA, 19 nt, Homo sapiens
gcaaagguaaacagaugua

SEQ ID NO: 841040 - RNA, 19 nt, Homo sapiens
caagguggguggaucacuu

SEQ ID NO: 841041 - RNA, 19 nt, Homo sapiens
uaacaacagcuaagauuca

SEQ ID NO: 841042 - RNA, 19 nt, Homo sapiens
ggccaauggugauguguga

SEQ ID NO: 841043 - RNA, 19 nt, Homo sapiens
cagcucaggucuguuugua

SEQ ID NO: 841044 - RNA, 19 nt, Homo sapiens
gauaauuauuggacguguu

SEQ ID NO: 841045 - RNA, 19 nt, Homo sapiens
ugaaguggguauuauuauc

SEQ ID NO: 841046 - RNA, 19 nt, Homo sapiens
gcacuuggcauuuaauagg

SEQ ID NO: 841047 - RNA, 19 nt, Homo sapiens
cacaggccgugaaacauuu

SEQ ID NO: 841048 - RNA, 19 nt, Homo sapiens
ccaggccgaucacuucuug

SEQ ID NO: 841049 - RNA, 19 nt, Homo sapiens
gggaacauacuaauucaug

SEQ ID NO: 841050 - RNA, 19 nt, Homo sapiens
cagcgaagcccagauaaga

SEQ ID NO: 841051 - RNA, 19 nt, Homo sapiens
gcccagugaaguuaaauaa

SEQ ID NO: 841052 - RNA, 19 nt, Homo sapiens
guuauagcauggcaggaaa

SEQ ID NO: 841053 - RNA, 19 nt, Homo sapiens
guucaugaaguggguauua

SEQ ID NO: 841054 - RNA, 19 nt, Homo sapiens
ggaaagaccaugggcuuag

SEQ ID NO: 841055 - RNA, 19 nt, Homo sapiens
cuucagugcuuccuacaga

SEQ ID NO: 841056 - RNA, 19 nt, Homo sapiens
caugugaguuucaacaagu

SEQ ID NO: 841057 - RNA, 19 nt, Homo sapiens
cagggaacauacuaauuca

SEQ ID NO: 841058 - RNA, 19 nt, Homo sapiens
acaauaaucagcauagugu

SEQ ID NO: 841059 - RNA, 19 nt, Homo sapiens
ugggaucaguuucauguga

SEQ ID NO: 841060 - RNA, 19 nt, Homo sapiens
gaaggcagacauugguuag

SEQ ID NO: 841061 - RNA, 19 nt, Homo sapiens
ggacguguuuauuaauugc

SEQ ID NO: 841062 - RNA, 19 nt, Homo sapiens
caaggucauugagcuguug

SEQ ID NO: 841063 - RNA, 19 nt, Homo sapiens
gguaaacagauguagagaa

SEQ ID NO: 841064 - RNA, 19 nt, Homo sapiens
gggcacaggccgugaaaca

SEQ ID NO: 841065 - RNA, 19 nt, Homo sapiens
gcccagcgaagcccagaua

SEQ ID NO: 841066 - RNA, 19 nt, Homo sapiens
auaguguacuuguccuuaa

SEQ ID NO: 841067 - RNA, 19 nt, Homo sapiens
ccgguuaccugcucuacug

SEQ ID NO: 841068 - RNA, 19 nt, Homo sapiens
uaauucaugugcggucaaa

SEQ ID NO: 841069 - RNA, 19 nt, Homo sapiens
ccaauggugaugugugaaa

SEQ ID NO: 841070 - RNA, 19 nt, Homo sapiens
ggaaccaggccgaucacuu

SEQ ID NO: 841071 - RNA, 19 nt, Homo sapiens
gcggguggcauacugcuuu

SEQ ID NO: 841072 - RNA, 19 nt, Homo sapiens
gucaucagcuuggaggauu

SEQ ID NO: 841073 - RNA, 19 nt, Homo sapiens
ccaaggucauugagcuguu

SEQ ID NO: 841074 - RNA, 19 nt, Homo sapiens
uuuaauagggcaaagguaa

SEQ ID NO: 841075 - RNA, 19 nt, Homo sapiens
cauaguguacuuguccuua

SEQ ID NO: 841076 - RNA, 19 nt, Homo sapiens
gacaauaaucagcauagug

SEQ ID NO: 841077 - RNA, 19 nt, Homo sapiens
agaaggcagacauugguua

SEQ ID NO: 841078 - RNA, 19 nt, Homo sapiens
ucuaggagcuauggucuca

SEQ ID NO: 841079 - RNA, 19 nt, Homo sapiens
uggaggauuucauggagaa

SEQ ID NO: 841080 - RNA, 19 nt, Homo sapiens
gccagaggcgugagaauca

SEQ ID NO: 841081 - RNA, 19 nt, Homo sapiens
ggcauuuccuucagugcuu

SEQ ID NO: 841082 - RNA, 19 nt, Homo sapiens
cugagaagcggguggcaua

SEQ ID NO: 841083 - RNA, 19 nt, Homo sapiens
ggauugaguaccagcauca

SEQ ID NO: 841084 - RNA, 19 nt, Homo sapiens
acuuugagauaguucauga

SEQ ID NO: 841085 - RNA, 19 nt, Homo sapiens
caucacaagccuccuuuca

SEQ ID NO: 841086 - RNA, 19 nt, Homo sapiens
ucaggucuguuuguaaauc

SEQ ID NO: 841087 - RNA, 19 nt, Homo sapiens
ccuguaaucccagcacuuu

SEQ ID NO: 841088 - RNA, 19 nt, Homo sapiens
uggacguguuuauuaauug

SEQ ID NO: 841089 - RNA, 19 nt, Homo sapiens
gcgaagcccagauaagaag

SEQ ID NO: 841090 - RNA, 19 nt, Homo sapiens
caacagcuaagauucaaaa

SEQ ID NO: 841091 - RNA, 19 nt, Homo sapiens
ugagcccagugaaguuaaa

SEQ ID NO: 841092 - RNA, 19 nt, Homo sapiens
guuauuacucacaugcuuu

SEQ ID NO: 841093 - RNA, 19 nt, Homo sapiens
aguguuggcugucaguguu

SEQ ID NO: 841094 - RNA, 19 nt, Homo sapiens
ugagauagccagcgcugau

SEQ ID NO: 841095 - RNA, 19 nt, Homo sapiens
aggcagacauugguuagga

SEQ ID NO: 841096 - RNA, 19 nt, Homo sapiens
ggcugucccuccuuggauu

SEQ ID NO: 841097 - RNA, 19 nt, Homo sapiens
aacaacagcuaagauucaa

SEQ ID NO: 841098 - RNA, 19 nt, Homo sapiens
ugacaauaaucagcauagu

SEQ ID NO: 841099 - RNA, 19 nt, Homo sapiens
agaagcggguggcauacug

SEQ ID NO: 841100 - RNA, 19 nt, Homo sapiens
ucaugaaguggguauuauu

SEQ ID NO: 841101 - RNA, 19 nt, Homo sapiens
ugaagugcaugucauacac

SEQ ID NO: 841102 - RNA, 19 nt, Homo sapiens
caauaaucagcauagugua

SEQ ID NO: 841103 - RNA, 19 nt, Homo sapiens
cagcuuggaggauuucaug

SEQ ID NO: 841104 - RNA, 19 nt, Homo sapiens
ucaucagcuuggaggauuu

SEQ ID NO: 841105 - RNA, 19 nt, Homo sapiens
ggucuguuuguaaaucuuu

SEQ ID NO: 841106 - RNA, 19 nt, Homo sapiens
cuaagcagccagccagugu

SEQ ID NO: 841107 - RNA, 19 nt, Homo sapiens
aaagguaaacagauguaga

SEQ ID NO: 841108 - RNA, 19 nt, Homo sapiens
uuaauagggcaaagguaaa

SEQ ID NO: 841109 - RNA, 19 nt, Homo sapiens
uaaucagcauaguguacuu

SEQ ID NO: 841110 - RNA, 19 nt, Homo sapiens
ucaugugaguuucaacaag

SEQ ID NO: 841111 - RNA, 19 nt, Homo sapiens
ggaucaguuucaugugagu

SEQ ID NO: 841112 - RNA, 19 nt, Homo sapiens
uaacuucccaaggucauug

SEQ ID NO: 841113 - RNA, 19 nt, Homo sapiens
gcauuugcaaagcugcuaa

SEQ ID NO: 841114 - RNA, 19 nt, Homo sapiens
uaguguacuuguccuuaau

SEQ ID NO: 841115 - RNA, 19 nt, Homo sapiens
cuugggcucucuggcauuu

SEQ ID NO: 841116 - RNA, 19 nt, Homo sapiens
aagaagacgugccccauga

SEQ ID NO: 841117 - RNA, 19 nt, Homo sapiens
gagaucaaggcugcaguga

SEQ ID NO: 841118 - RNA, 19 nt, Homo sapiens
guaaucagaggccaauggu

SEQ ID NO: 841119 - RNA, 19 nt, Homo sapiens
gaaaugcuauguugguuua

SEQ ID NO: 841120 - RNA, 19 nt, Homo sapiens
gauguaaguuguccaauaa

SEQ ID NO: 841121 - RNA, 19 nt, Homo sapiens
gaagagaguuuaauggaau

SEQ ID NO: 841122 - RNA, 19 nt, Homo sapiens
gaagaaauccuguaagaug

SEQ ID NO: 841123 - RNA, 19 nt, Homo sapiens
gaagggauauauaagcuuu

SEQ ID NO: 841124 - RNA, 19 nt, Homo sapiens
gaacaccuaucacacauau

SEQ ID NO: 841125 - RNA, 19 nt, Homo sapiens
gcaacaaacugaagcaaga

SEQ ID NO: 841126 - RNA, 19 nt, Homo sapiens
ggauguaaguuguccaaua

SEQ ID NO: 841127 - RNA, 19 nt, Homo sapiens
gcacagaacucuuacuuac

SEQ ID NO: 841128 - RNA, 19 nt, Homo sapiens
gaucaaugcugcuguaaau

SEQ ID NO: 841129 - RNA, 19 nt, Homo sapiens
gaacagcaaagaacauaua

SEQ ID NO: 841130 - RNA, 19 nt, Homo sapiens
agauguagguguagaauua

SEQ ID NO: 841131 - RNA, 19 nt, Homo sapiens
ggaaguagauagugaagau

SEQ ID NO: 841132 - RNA, 19 nt, Homo sapiens
guuaugcucuuaaugcuua

SEQ ID NO: 841133 - RNA, 19 nt, Homo sapiens
ggaaacagauagugucuca

SEQ ID NO: 841134 - RNA, 19 nt, Homo sapiens
gaauuuaugucgaaacuuc

SEQ ID NO: 841135 - RNA, 19 nt, Homo sapiens
gcacauauuugcaguugga

SEQ ID NO: 841136 - RNA, 19 nt, Homo sapiens
ggaaagaacgcauuugaga

SEQ ID NO: 841137 - RNA, 19 nt, Homo sapiens
gaacaaacaucaaaaggaa

SEQ ID NO: 841138 - RNA, 19 nt, Homo sapiens
gcaaggaugucuuuguaau

SEQ ID NO: 841139 - RNA, 19 nt, Homo sapiens
caaagaacauauaguagug

SEQ ID NO: 841140 - RNA, 19 nt, Homo sapiens
aaacaagccugguucaguu

SEQ ID NO: 841141 - RNA, 19 nt, Homo sapiens
gguguagaauuauugcuua

SEQ ID NO: 841142 - RNA, 19 nt, Homo sapiens
caaaugaugaguucuagua

SEQ ID NO: 841143 - RNA, 19 nt, Homo sapiens
gaaauccuguaagaugaua

SEQ ID NO: 841144 - RNA, 19 nt, Homo sapiens
cagcaaagaacauauagua

SEQ ID NO: 841145 - RNA, 19 nt, Homo sapiens
gauuugucauccaguauua

SEQ ID NO: 841146 - RNA, 19 nt, Homo sapiens
gacaaacacugaaauuaca

SEQ ID NO: 841147 - RNA, 19 nt, Homo sapiens
caucgaaacuccagaacaa

SEQ ID NO: 841148 - RNA, 19 nt, Homo sapiens
ucucauagcaccaauauuu

SEQ ID NO: 841149 - RNA, 19 nt, Homo sapiens
cagaugcaguucccuauuu

SEQ ID NO: 841150 - RNA, 19 nt, Homo sapiens
gaaaggagagcaagaaucu

SEQ ID NO: 841151 - RNA, 19 nt, Homo sapiens
ggaagaauguccaauaagc

SEQ ID NO: 841152 - RNA, 19 nt, Homo sapiens
gccauauggugaagucuua

SEQ ID NO: 841153 - RNA, 19 nt, Homo sapiens
aaagaaggcuagcauuguu

SEQ ID NO: 841154 - RNA, 19 nt, Homo sapiens
gcacugugguugaguaaca

SEQ ID NO: 841155 - RNA, 19 nt, Homo sapiens
uaagcugacuugaaucauu

SEQ ID NO: 841156 - RNA, 19 nt, Homo sapiens
ggacaaacacugaaauuac

SEQ ID NO: 841157 - RNA, 19 nt, Homo sapiens
ggaagaagagaguuuaaug

SEQ ID NO: 841158 - RNA, 19 nt, Homo sapiens
gguaagcucuccaaaugau

SEQ ID NO: 841159 - RNA, 19 nt, Homo sapiens
ugauuugacuggucuuuaa

SEQ ID NO: 841160 - RNA, 19 nt, Homo sapiens
gcaaagaacauauaguagu

SEQ ID NO: 841161 - RNA, 19 nt, Homo sapiens
gauuacagaccauuuguuu

SEQ ID NO: 841162 - RNA, 19 nt, Homo sapiens
agagaaagcuuuggaaaca

SEQ ID NO: 841163 - RNA, 19 nt, Homo sapiens
caggagagaccaaugauaa

SEQ ID NO: 841164 - RNA, 19 nt, Homo sapiens
ggacaggagagaccaauga

SEQ ID NO: 841165 - RNA, 19 nt, Homo sapiens
uaguagaucucgagcguuu

SEQ ID NO: 841166 - RNA, 19 nt, Homo sapiens
cauuacagauuccuugauu

SEQ ID NO: 841167 - RNA, 19 nt, Homo sapiens
cuacagaucuacaaacaag

SEQ ID NO: 841168 - RNA, 19 nt, Homo sapiens
ggaccuacguugcaguuca

SEQ ID NO: 841169 - RNA, 19 nt, Homo sapiens
gcguuuaucucgggcuuua

SEQ ID NO: 841170 - RNA, 19 nt, Homo sapiens
acagauuccuugauuggua

SEQ ID NO: 841171 - RNA, 19 nt, Homo sapiens
gggaauucauccucuaaga

SEQ ID NO: 841172 - RNA, 19 nt, Homo sapiens
gcaagcaugucugaauuuc

SEQ ID NO: 841173 - RNA, 19 nt, Homo sapiens
ccaaaccucuugccacuag

SEQ ID NO: 841174 - RNA, 19 nt, Homo sapiens
gauaagccaucaccaaacu

SEQ ID NO: 841175 - RNA, 19 nt, Homo sapiens
cagcuuacguuuacugguu

SEQ ID NO: 841176 - RNA, 19 nt, Homo sapiens
cuaauggugucuucagaaa

SEQ ID NO: 841177 - RNA, 19 nt, Homo sapiens
gaacgcauuugagauuuua

SEQ ID NO: 841178 - RNA, 19 nt, Homo sapiens
aaagaacgcauuugagauu

SEQ ID NO: 841179 - RNA, 19 nt, Homo sapiens
acagugaaaugcuauguug

SEQ ID NO: 841180 - RNA, 19 nt, Homo sapiens
ggaaguagaacagcaaaga

SEQ ID NO: 841181 - RNA, 19 nt, Homo sapiens
caacggaccaguuaagaga

SEQ ID NO: 841182 - RNA, 19 nt, Homo sapiens
aaagaaaggauguaaguug

SEQ ID NO: 841183 - RNA, 19 nt, Homo sapiens
aagaaauccuguaagauga

SEQ ID NO: 841184 - RNA, 19 nt, Homo sapiens
aauggugucuucagaaauu

SEQ ID NO: 841185 - RNA, 19 nt, Homo sapiens
agaaagaagugaugaaacu

SEQ ID NO: 841186 - RNA, 19 nt, Homo sapiens
aagcugacuugaaucauuu

SEQ ID NO: 841187 - RNA, 19 nt, Homo sapiens
gaaagaacgcauuugagau

SEQ ID NO: 841188 - RNA, 19 nt, Homo sapiens
ggaauucauccucuaagaa

SEQ ID NO: 841189 - RNA, 19 nt, Homo sapiens
gagaacaccuaucacacau

SEQ ID NO: 841190 - RNA, 19 nt, Homo sapiens
cuaaagcugugcacauaug

SEQ ID NO: 841191 - RNA, 19 nt, Homo sapiens
cagcaugcaugacuuuaau

SEQ ID NO: 841192 - RNA, 19 nt, Homo sapiens
gaaguagaacagcaaagaa

SEQ ID NO: 841193 - RNA, 19 nt, Homo sapiens
gaacugccgcaaacuuuau

SEQ ID NO: 841194 - RNA, 19 nt, Homo sapiens
gaaguagccaugcaggaaa

SEQ ID NO: 841195 - RNA, 19 nt, Homo sapiens
gaaccuaguaacagccaua

SEQ ID NO: 841196 - RNA, 19 nt, Homo sapiens
uugaagaaauccuguaaga

SEQ ID NO: 841197 - RNA, 19 nt, Homo sapiens
cacaagaaauggaaguaga

SEQ ID NO: 841198 - RNA, 19 nt, Homo sapiens
ccauagugauaccugcuua

SEQ ID NO: 841199 - RNA, 19 nt, Homo sapiens
caucuuaaacucugccaua

SEQ ID NO: 841200 - RNA, 19 nt, Homo sapiens
gacuacagaucuacaaaca

SEQ ID NO: 841201 - RNA, 19 nt, Homo sapiens
gaagaagagaguuuaaugg

SEQ ID NO: 841202 - RNA, 19 nt, Homo sapiens
uugcaaggaugucuuugua

SEQ ID NO: 841203 - RNA, 19 nt, Homo sapiens
aagcaugucugaauuucuu

SEQ ID NO: 841204 - RNA, 19 nt, Homo sapiens
aagcaagcaugucugaauu

SEQ ID NO: 841205 - RNA, 19 nt, Homo sapiens
caagagaugaccugcauug

SEQ ID NO: 841206 - RNA, 19 nt, Homo sapiens
agaagagaguuuaauggaa

SEQ ID NO: 841207 - RNA, 19 nt, Homo sapiens
gagcaagaaucucauagcu

SEQ ID NO: 841208 - RNA, 19 nt, Homo sapiens
acagaacucuuacuuacau

SEQ ID NO: 841209 - RNA, 19 nt, Homo sapiens
uaacaagcaccaauagguu

SEQ ID NO: 841210 - RNA, 19 nt, Homo sapiens
gauaagcugacuugaauca

SEQ ID NO: 841211 - RNA, 19 nt, Homo sapiens
cuacuucacuucauuaugc

SEQ ID NO: 841212 - RNA, 19 nt, Homo sapiens
guuaagagaacaccuauca

SEQ ID NO: 841213 - RNA, 19 nt, Homo sapiens
cagauuccuugauugguaa

SEQ ID NO: 841214 - RNA, 19 nt, Homo sapiens
gucaauagauaaagcuguu

SEQ ID NO: 841215 - RNA, 19 nt, Homo sapiens
gaaacuucaugcuucaucu

SEQ ID NO: 841216 - RNA, 19 nt, Homo sapiens
cugaauuucuugaaucuga

SEQ ID NO: 841217 - RNA, 19 nt, Homo sapiens
aaaggauacuccaaaugaa

SEQ ID NO: 841218 - RNA, 19 nt, Homo sapiens
aaauggaaguagauaguga

SEQ ID NO: 841219 - RNA, 19 nt, Homo sapiens
ggacacaccucacuacaaa

SEQ ID NO: 841220 - RNA, 19 nt, Homo sapiens
ccaauaaccugcugauaga

SEQ ID NO: 841221 - RNA, 19 nt, Homo sapiens
aaacagggcugaagaggaa

SEQ ID NO: 841222 - RNA, 19 nt, Homo sapiens
ggacuuugcugaggaguug

SEQ ID NO: 841223 - RNA, 19 nt, Homo sapiens
ggaggaggauggagaagug

SEQ ID NO: 841224 - RNA, 19 nt, Homo sapiens
gagggaagauggcugaauc

SEQ ID NO: 841225 - RNA, 19 nt, Homo sapiens
gggagaaccugcucaaguc

SEQ ID NO: 841226 - RNA, 19 nt, Homo sapiens
ggaacgauaucccugagau

SEQ ID NO: 841227 - RNA, 19 nt, Homo sapiens
gaccgcguccucucuauua

SEQ ID NO: 841228 - RNA, 19 nt, Homo sapiens
gaaccucucugagcugauc

SEQ ID NO: 841229 - RNA, 19 nt, Homo sapiens
gaggagaucuaccgcuaca

SEQ ID NO: 841230 - RNA, 19 nt, Homo sapiens
ggacgacgagggcauauuc

SEQ ID NO: 841231 - RNA, 19 nt, Homo sapiens
gcaaggacacaccucacua

SEQ ID NO: 841232 - RNA, 19 nt, Homo sapiens
ugacuaagcugaccaaccu

SEQ ID NO: 841233 - RNA, 19 nt, Homo sapiens
ggagauccgucugccaaga

SEQ ID NO: 841234 - RNA, 19 nt, Homo sapiens
aagcagcuauccauccuaa

SEQ ID NO: 841235 - RNA, 19 nt, Homo sapiens
gcgagacuguaacuaguga

SEQ ID NO: 841236 - RNA, 19 nt, Homo sapiens
gccaauaaccugcugauag

SEQ ID NO: 841237 - RNA, 19 nt, Homo sapiens
gcacugaggaggaggacaa

SEQ ID NO: 841238 - RNA, 19 nt, Homo sapiens
gacuguaacuagugauguu

SEQ ID NO: 841239 - RNA, 19 nt, Homo sapiens
ggaacagccuggagagcau

SEQ ID NO: 841240 - RNA, 19 nt, Homo sapiens
ugaagacucucgcccaucu

SEQ ID NO: 841241 - RNA, 19 nt, Homo sapiens
ccagcgagcucaaggugau

SEQ ID NO: 841242 - RNA, 19 nt, Homo sapiens
ggaggaagccagaaaacua

SEQ ID NO: 841243 - RNA, 19 nt, Homo sapiens
ggaggaagacgccgaagag

SEQ ID NO: 841244 - RNA, 19 nt, Homo sapiens
ccagaaaacuacagcagaa

SEQ ID NO: 841245 - RNA, 19 nt, Homo sapiens
ggaaccgccugcagagucu

SEQ ID NO: 841246 - RNA, 19 nt, Homo sapiens
gcagcuauccauccuaaag

SEQ ID NO: 841247 - RNA, 19 nt, Homo sapiens
cagcgucccugucauuucu

SEQ ID NO: 841248 - RNA, 19 nt, Homo sapiens
gcaggaggaggauggagaa

SEQ ID NO: 841249 - RNA, 19 nt, Homo sapiens
guacaaccaaagacucuau

SEQ ID NO: 841250 - RNA, 19 nt, Homo sapiens
agaaguggcucuggugcuu

SEQ ID NO: 841251 - RNA, 19 nt, Homo sapiens
gcaccaagaagcagucagu

SEQ ID NO: 841252 - RNA, 19 nt, Homo sapiens
ugacugaggccaggcauga

SEQ ID NO: 841253 - RNA, 19 nt, Homo sapiens
ucacccaccucaaucucaa

SEQ ID NO: 841254 - RNA, 19 nt, Homo sapiens
gaagaugcaggaggaggaa

SEQ ID NO: 841255 - RNA, 19 nt, Homo sapiens
gagcucaaggugaugaaga

SEQ ID NO: 841256 - RNA, 19 nt, Homo sapiens
ggaagaggaggaggaggaa

SEQ ID NO: 841257 - RNA, 19 nt, Homo sapiens
gguguuagcauuuuaaaga

SEQ ID NO: 841258 - RNA, 19 nt, Homo sapiens
cgagguggccaacuucaug

SEQ ID NO: 841259 - RNA, 19 nt, Homo sapiens
ggccugggcaucagcauug

SEQ ID NO: 841260 - RNA, 19 nt, Homo sapiens
cguuugaccaggccaauaa

SEQ ID NO: 841261 - RNA, 19 nt, Homo sapiens
gagaauaaaguugacuaca

SEQ ID NO: 841262 - RNA, 19 nt, Homo sapiens
gaacgauaucccugagauc

SEQ ID NO: 841263 - RNA, 19 nt, Homo sapiens
ggcuggugcugcucacuga

SEQ ID NO: 841264 - RNA, 19 nt, Homo sapiens
ggaguugaggucccuggaa

SEQ ID NO: 841265 - RNA, 19 nt, Homo sapiens
gacgagggcauauucaucu

SEQ ID NO: 841266 - RNA, 19 nt, Homo sapiens
gcgagcugcccaagccuuu

SEQ ID NO: 841267 - RNA, 19 nt, Homo sapiens
ccagcccucugccacauuc

SEQ ID NO: 841268 - RNA, 19 nt, Homo sapiens
ugucaagggaguuucguuu

SEQ ID NO: 841269 - RNA, 19 nt, Homo sapiens
cggcgagacuguaacuagu

SEQ ID NO: 841270 - RNA, 19 nt, Homo sapiens
caccaucgcccugcuguug

SEQ ID NO: 841271 - RNA, 19 nt, Homo sapiens
gcuauccauccuaaaggua

SEQ ID NO: 841272 - RNA, 19 nt, Homo sapiens
gggaggcaacgaucuggaa

SEQ ID NO: 841273 - RNA, 19 nt, Homo sapiens
uaacuagugauguuuguac

SEQ ID NO: 841274 - RNA, 19 nt, Homo sapiens
guaacuagugauguuugua

SEQ ID NO: 841275 - RNA, 19 nt, Homo sapiens
cugcaaggcucuggagauc

SEQ ID NO: 841276 - RNA, 19 nt, Homo sapiens
gacgugucccggaacgaua

SEQ ID NO: 841277 - RNA, 19 nt, Homo sapiens
gggagcggcagaaguacuu

SEQ ID NO: 841278 - RNA, 19 nt, Homo sapiens
gacgagggcaucuucaucu

SEQ ID NO: 841279 - RNA, 19 nt, Homo sapiens
ggaugccacgcaccaagaa

SEQ ID NO: 841280 - RNA, 19 nt, Homo sapiens
gaccgcauccuggcaguga

SEQ ID NO: 841281 - RNA, 19 nt, Homo sapiens
caagggaguuucguuugac

SEQ ID NO: 841282 - RNA, 19 nt, Homo sapiens
gaagcagcuauccauccua

SEQ ID NO: 841283 - RNA, 19 nt, Homo sapiens
ggagaauaaaguugacuac

SEQ ID NO: 841284 - RNA, 19 nt, Homo sapiens
caaccaaagacucuauuuu

SEQ ID NO: 841285 - RNA, 19 nt, Homo sapiens
gcugacgaccugcggaaga

SEQ ID NO: 841286 - RNA, 19 nt, Homo sapiens
cgcguccucucuauuaaug

SEQ ID NO: 841287 - RNA, 19 nt, Homo sapiens
gcgaccgcguccucucuau

SEQ ID NO: 841288 - RNA, 19 nt, Homo sapiens
gggaggaagacgccgaaga

SEQ ID NO: 841289 - RNA, 19 nt, Homo sapiens
uggcucaccuggcccugaa

SEQ ID NO: 841290 - RNA, 19 nt, Homo sapiens
gagacuguaacuagugaug

SEQ ID NO: 841291 - RNA, 19 nt, Homo sapiens
gggaugccacgcaccaaga

SEQ ID NO: 841292 - RNA, 19 nt, Homo sapiens
cguccucucuauuaaugga

SEQ ID NO: 841293 - RNA, 19 nt, Homo sapiens
cgacgagggcauauucauc

SEQ ID NO: 841294 - RNA, 19 nt, Homo sapiens
gaagaggaggaggaggaaa

SEQ ID NO: 841295 - RNA, 19 nt, Homo sapiens
caaggacacaccucacuac

SEQ ID NO: 841296 - RNA, 19 nt, Homo sapiens
ugaagcagcuauccauccu

SEQ ID NO: 841297 - RNA, 19 nt, Homo sapiens
gagaacgcggucaccauca

SEQ ID NO: 841298 - RNA, 19 nt, Homo sapiens
aggcaacgaucuggaagug

SEQ ID NO: 841299 - RNA, 19 nt, Homo sapiens
uaaggagaauaaaguugac

SEQ ID NO: 841300 - RNA, 19 nt, Homo sapiens
acaaccaaagacucuauuu

SEQ ID NO: 841301 - RNA, 19 nt, Homo sapiens
cgggagaaccugcucaagu

SEQ ID NO: 841302 - RNA, 19 nt, Homo sapiens
uccgggagcggcagaagua

SEQ ID NO: 841303 - RNA, 19 nt, Homo sapiens
ggagggaagauggcugaau

SEQ ID NO: 841304 - RNA, 19 nt, Homo sapiens
ccaucgcccugcuguugga

SEQ ID NO: 841305 - RNA, 19 nt, Homo sapiens
caucuucgucucccgcauu

SEQ ID NO: 841306 - RNA, 19 nt, Homo sapiens
uccuaaagguagaccagaa

SEQ ID NO: 841307 - RNA, 19 nt, Homo sapiens
ucuggccugugacuaacua

SEQ ID NO: 841308 - RNA, 19 nt, Homo sapiens
gcugugggcccugaagaug

SEQ ID NO: 841309 - RNA, 19 nt, Homo sapiens
aggaggaacaggaggauga

SEQ ID NO: 841310 - RNA, 19 nt, Homo sapiens
gcagaagagagcgcagaug

SEQ ID NO: 841311 - RNA, 19 nt, Homo sapiens
ggccaauaaccugcugaua

SEQ ID NO: 841312 - RNA, 19 nt, Homo sapiens
ggaggaggaggaggaggaa

SEQ ID NO: 841313 - RNA, 19 nt, Homo sapiens
cuagugauguuuguacaac

SEQ ID NO: 841314 - RNA, 19 nt, Homo sapiens
uguaacuagugauguuugu

SEQ ID NO: 841315 - RNA, 19 nt, Homo sapiens
caccuggcccugaaugaug

SEQ ID NO: 841316 - RNA, 19 nt, Homo sapiens
gucaagggaguuucguuug

SEQ ID NO: 841317 - RNA, 19 nt, Homo sapiens
ugucauuucuggucaagcu

SEQ ID NO: 841318 - RNA, 19 nt, Homo sapiens
ugaggacgcugaggaagcu

SEQ ID NO: 841319 - RNA, 19 nt, Homo sapiens
gaagaugguugaagaagua

SEQ ID NO: 841320 - RNA, 19 nt, Homo sapiens
caagagagauauuguguuu

SEQ ID NO: 841321 - RNA, 19 nt, Homo sapiens
gaagaaguauucaguaaug

SEQ ID NO: 841322 - RNA, 19 nt, Homo sapiens
gucaauaacugaagacuua

SEQ ID NO: 841323 - RNA, 19 nt, Homo sapiens
gaacauguacuuccucuuu

SEQ ID NO: 841324 - RNA, 19 nt, Homo sapiens
uaagagagauguagauuuc

SEQ ID NO: 841325 - RNA, 19 nt, Homo sapiens
gacagcagcuugccaaauu

SEQ ID NO: 841326 - RNA, 19 nt, Homo sapiens
gguaaagaauucagaagaa

SEQ ID NO: 841327 - RNA, 19 nt, Homo sapiens
acaaauggaugaacucaaa

SEQ ID NO: 841328 - RNA, 19 nt, Homo sapiens
gcacagauugcaauagaua

SEQ ID NO: 841329 - RNA, 19 nt, Homo sapiens
gaugauagaggaauuguaa

SEQ ID NO: 841330 - RNA, 19 nt, Homo sapiens
gaaagaagcccaggauaga

SEQ ID NO: 841331 - RNA, 19 nt, Homo sapiens
uuacagagguuccgaaguu

SEQ ID NO: 841332 - RNA, 19 nt, Homo sapiens
gaacaguccuacaaaugga

SEQ ID NO: 841333 - RNA, 19 nt, Homo sapiens
gaggauuauuuaccacuua

SEQ ID NO: 841334 - RNA, 19 nt, Homo sapiens
caagagaauucuagugaga

SEQ ID NO: 841335 - RNA, 19 nt, Homo sapiens
gaaacuguguauacgcuuu

SEQ ID NO: 841336 - RNA, 19 nt, Homo sapiens
cuagugagaugcccaaauu

SEQ ID NO: 841337 - RNA, 19 nt, Homo sapiens
gaaugaaggagaugacuuu

SEQ ID NO: 841338 - RNA, 19 nt, Homo sapiens
ggaauuaacaugccagcua

SEQ ID NO: 841339 - RNA, 19 nt, Homo sapiens
gaaagauugugaagccuau

SEQ ID NO: 841340 - RNA, 19 nt, Homo sapiens
acacugagcuggaaaauaa

SEQ ID NO: 841341 - RNA, 19 nt, Homo sapiens
ucacaaugauccaaauuug

SEQ ID NO: 841342 - RNA, 19 nt, Homo sapiens
gacaauagacagaguguuu

SEQ ID NO: 841343 - RNA, 19 nt, Homo sapiens
ggagaggaauggaugauag

SEQ ID NO: 841344 - RNA, 19 nt, Homo sapiens
gauuacaguugacuacaaa

SEQ ID NO: 841345 - RNA, 19 nt, Homo sapiens
gaaggcagcauaauucguu

SEQ ID NO: 841346 - RNA, 19 nt, Homo sapiens
caagaacaguccuacaaau

SEQ ID NO: 841347 - RNA, 19 nt, Homo sapiens
caauuaaggcucugaguaa

SEQ ID NO: 841348 - RNA, 19 nt, Homo sapiens
uaaucagucuguucuagua

SEQ ID NO: 841349 - RNA, 19 nt, Homo sapiens
gaacucaaaugucgcaaac

SEQ ID NO: 841350 - RNA, 19 nt, Homo sapiens
aaaggaccaucaaauguuu

SEQ ID NO: 841351 - RNA, 19 nt, Homo sapiens
gcauuggccuuaagggaaa

SEQ ID NO: 841352 - RNA, 19 nt, Homo sapiens
gcaagaacaguccuacaaa

SEQ ID NO: 841353 - RNA, 19 nt, Homo sapiens
ggaaagaagcccaggauag

SEQ ID NO: 841354 - RNA, 19 nt, Homo sapiens
uagagaagguaaagaauuc

SEQ ID NO: 841355 - RNA, 19 nt, Homo sapiens
gaaguugcuuggguuauau

SEQ ID NO: 841356 - RNA, 19 nt, Homo sapiens
acgaguggcuugugagaua

SEQ ID NO: 841357 - RNA, 19 nt, Homo sapiens
gaagaugauuauggaaaga

SEQ ID NO: 841358 - RNA, 19 nt, Homo sapiens
cuaaaggaaugugagauuu

SEQ ID NO: 841359 - RNA, 19 nt, Homo sapiens
caacaugguuuugaacuua

SEQ ID NO: 841360 - RNA, 19 nt, Homo sapiens
aaagcagcguguaauauuu

SEQ ID NO: 841361 - RNA, 19 nt, Homo sapiens
gaaaagcugcuaaggaaua

SEQ ID NO: 841362 - RNA, 19 nt, Homo sapiens
ggagcuacauuugcccaua

SEQ ID NO: 841363 - RNA, 19 nt, Homo sapiens
agucaaauguuaagccuaa

SEQ ID NO: 841364 - RNA, 19 nt, Homo sapiens
gaaagugugguuaucuauu

SEQ ID NO: 841365 - RNA, 19 nt, Homo sapiens
aagaugagcccaacaauug

SEQ ID NO: 841366 - RNA, 19 nt, Homo sapiens
gcccauaucugcaaaauga

SEQ ID NO: 841367 - RNA, 19 nt, Homo sapiens
ggauuugccauuuacauaa

SEQ ID NO: 841368 - RNA, 19 nt, Homo sapiens
agaaguugcuuggguuaua

SEQ ID NO: 841369 - RNA, 19 nt, Homo sapiens
gagcuacauuugcccauau

SEQ ID NO: 841370 - RNA, 19 nt, Homo sapiens
guagagaagguaaagaauu

SEQ ID NO: 841371 - RNA, 19 nt, Homo sapiens
ugaacuggauccuuuguau

SEQ ID NO: 841372 - RNA, 19 nt, Homo sapiens
gguaaagaaugaaggagau

SEQ ID NO: 841373 - RNA, 19 nt, Homo sapiens
uaacguccacuaugucuuu

SEQ ID NO: 841374 - RNA, 19 nt, Homo sapiens
gaugaggaaacuuaucuaa

SEQ ID NO: 841375 - RNA, 19 nt, Homo sapiens
aagcacagauugcaauaga

SEQ ID NO: 841376 - RNA, 19 nt, Homo sapiens
ggaaauugaugaggaaacu

SEQ ID NO: 841377 - RNA, 19 nt, Homo sapiens
uuaagaagguugggauuug

SEQ ID NO: 841378 - RNA, 19 nt, Homo sapiens
gagaggccauucagugugu

SEQ ID NO: 841379 - RNA, 19 nt, Homo sapiens
gcuaaaggaaugugagauu

SEQ ID NO: 841380 - RNA, 19 nt, Homo sapiens
ggaaugugcuaaaagaauu

SEQ ID NO: 841381 - RNA, 19 nt, Homo sapiens
acaggcaacagcauuauua

SEQ ID NO: 841382 - RNA, 19 nt, Homo sapiens
gaauucagaagaacaguau

SEQ ID NO: 841383 - RNA, 19 nt, Homo sapiens
gaagguaaagaauucagaa

SEQ ID NO: 841384 - RNA, 19 nt, Homo sapiens
ccacuuaaaccacgaguug

SEQ ID NO: 841385 - RNA, 19 nt, Homo sapiens
gcaggaaugugcuaaaaga

SEQ ID NO: 841386 - RNA, 19 nt, Homo sapiens
ugguaaagguaaagaauga

SEQ ID NO: 841387 - RNA, 19 nt, Homo sapiens
aagaaagugugguuaucua

SEQ ID NO: 841388 - RNA, 19 nt, Homo sapiens
caacacagaugaagaaaag

SEQ ID NO: 841389 - RNA, 19 nt, Homo sapiens
ccaauuaaggcucugagua

SEQ ID NO: 841390 - RNA, 19 nt, Homo sapiens
gcaaagcgagaacugaaga

SEQ ID NO: 841391 - RNA, 19 nt, Homo sapiens
cagcuaaaccugaugagaa

SEQ ID NO: 841392 - RNA, 19 nt, Homo sapiens
gaaguuaugagagaaguug

SEQ ID NO: 841393 - RNA, 19 nt, Homo sapiens
uugaccaccuguuugauua

SEQ ID NO: 841394 - RNA, 19 nt, Homo sapiens
ucuaccaguuucagcauua

SEQ ID NO: 841395 - RNA, 19 nt, Homo sapiens
gggcuccgcugauccucua

SEQ ID NO: 841396 - RNA, 19 nt, Homo sapiens
cuggugauguuacuauuaa

SEQ ID NO: 841397 - RNA, 19 nt, Homo sapiens
guucuaguaucugcacaua

SEQ ID NO: 841398 - RNA, 19 nt, Homo sapiens
guugaaggguguacacaug

SEQ ID NO: 841399 - RNA, 19 nt, Homo sapiens
gaacaggcaacagcauuau

SEQ ID NO: 841400 - RNA, 19 nt, Homo sapiens
gaacugaagaaagcaagaa

SEQ ID NO: 841401 - RNA, 19 nt, Homo sapiens
ccacggagaccuuugcuau

SEQ ID NO: 841402 - RNA, 19 nt, Homo sapiens
aaaagaagaugguugaaga

SEQ ID NO: 841403 - RNA, 19 nt, Homo sapiens
gcaacuggagcuacauuug

SEQ ID NO: 841404 - RNA, 19 nt, Homo sapiens
ucacuuaauggauguagua

SEQ ID NO: 841405 - RNA, 19 nt, Homo sapiens
gauauuaaaucugcaaagc

SEQ ID NO: 841406 - RNA, 19 nt, Homo sapiens
gauaugggcauucaagauc

SEQ ID NO: 841407 - RNA, 19 nt, Homo sapiens
acaguuugcugaauggauu

SEQ ID NO: 841408 - RNA, 19 nt, Homo sapiens
gauagaagagucaauaacu

SEQ ID NO: 841409 - RNA, 19 nt, Homo sapiens
agagucagcuaaaggaaug

SEQ ID NO: 841410 - RNA, 19 nt, Homo sapiens
gcaggaccacuucgucaaa

SEQ ID NO: 841411 - RNA, 19 nt, Homo sapiens
gcaacagcauuauuaagcu

SEQ ID NO: 841412 - RNA, 19 nt, Homo sapiens
gcugaugagcuccuucuaa

SEQ ID NO: 841413 - RNA, 19 nt, Homo sapiens
gaaagcaagaacaguccua

SEQ ID NO: 841414 - RNA, 19 nt, Homo sapiens
uauuagacccuauugauga

SEQ ID NO: 841415 - RNA, 19 nt, Homo sapiens
gaagaaagugugguuaucu

SEQ ID NO: 841416 - RNA, 19 nt, Homo sapiens
ggaaaacaauuacuuaagg

SEQ ID NO: 841417 - RNA, 19 nt, Homo sapiens
ggaaaagcagcguguaaua

SEQ ID NO: 841418 - RNA, 19 nt, Homo sapiens
gauguagauuucgaaggua

SEQ ID NO: 841419 - RNA, 19 nt, Homo sapiens
gggaaggucuuggaaauua

SEQ ID NO: 841420 - RNA, 19 nt, Homo sapiens
gcagacagguuaucaaguu

SEQ ID NO: 841421 - RNA, 19 nt, Homo sapiens
ucagggagaucuacaaaua

SEQ ID NO: 841422 - RNA, 19 nt, Homo sapiens
ucaaaugccuccuaacuuu

SEQ ID NO: 841423 - RNA, 19 nt, Homo sapiens
gcaaggagauuccagguau

SEQ ID NO: 841424 - RNA, 19 nt, Homo sapiens
gaaugaugcugcugaaauu

SEQ ID NO: 841425 - RNA, 19 nt, Homo sapiens
gcauagaucuacaugaauu

SEQ ID NO: 841426 - RNA, 19 nt, Homo sapiens
ccaaugacaucuuaccaua

SEQ ID NO: 841427 - RNA, 19 nt, Homo sapiens
gcacugaagaaacaaauua

SEQ ID NO: 841428 - RNA, 19 nt, Homo sapiens
aagaauaccugaucagaaa

SEQ ID NO: 841429 - RNA, 19 nt, Homo sapiens
ggaagucugucauaguaaa

SEQ ID NO: 841430 - RNA, 19 nt, Homo sapiens
ggaguccaguuguguauaa

SEQ ID NO: 841431 - RNA, 19 nt, Homo sapiens
cgccagauauuuagaguua

SEQ ID NO: 841432 - RNA, 19 nt, Homo sapiens
gcacagcccucaacucagu

SEQ ID NO: 841433 - RNA, 19 nt, Homo sapiens
ggacagaaguguguagaau

SEQ ID NO: 841434 - RNA, 19 nt, Homo sapiens
gagcuucuguuaacauuau

SEQ ID NO: 841435 - RNA, 19 nt, Homo sapiens
acagaaguguguagaauuu

SEQ ID NO: 841436 - RNA, 19 nt, Homo sapiens
gaaaccugcuguaaccaaa

SEQ ID NO: 841437 - RNA, 19 nt, Homo sapiens
ucagacagcucucuucgaa

SEQ ID NO: 841438 - RNA, 19 nt, Homo sapiens
gagaauacguuugaaagau

SEQ ID NO: 841439 - RNA, 19 nt, Homo sapiens
gauuacagaugguucacua

SEQ ID NO: 841440 - RNA, 19 nt, Homo sapiens
gaugagugcuggaaacuuc

SEQ ID NO: 841441 - RNA, 19 nt, Homo sapiens
ucagaaugauacagaguua

SEQ ID NO: 841442 - RNA, 19 nt, Homo sapiens
gcaagaagcacuaugacuu

SEQ ID NO: 841443 - RNA, 19 nt, Homo sapiens
ggaaauuacugaacuacca

SEQ ID NO: 841444 - RNA, 19 nt, Homo sapiens
guagggcccuuuccuuauu

SEQ ID NO: 841445 - RNA, 19 nt, Homo sapiens
gcccacaaauagaggauua

SEQ ID NO: 841446 - RNA, 19 nt, Homo sapiens
gcaaaucuauagaagaaag

SEQ ID NO: 841447 - RNA, 19 nt, Homo sapiens
gaggaugucugauacuguu

SEQ ID NO: 841448 - RNA, 19 nt, Homo sapiens
uaagaagagcccacaaaua

SEQ ID NO: 841449 - RNA, 19 nt, Homo sapiens
gaucagaacaaguacaauu

SEQ ID NO: 841450 - RNA, 19 nt, Homo sapiens
gaauacguuugaaagauga

SEQ ID NO: 841451 - RNA, 19 nt, Homo sapiens
gaacaagcaagaagcacua

SEQ ID NO: 841452 - RNA, 19 nt, Homo sapiens
ccacagcagucugguuaua

SEQ ID NO: 841453 - RNA, 19 nt, Homo sapiens
cuuaagugcuuuacaguuu

SEQ ID NO: 841454 - RNA, 19 nt, Homo sapiens
uuaauucccuuucguaaga

SEQ ID NO: 841455 - RNA, 19 nt, Homo sapiens
gcacugagaaugaguugaa

SEQ ID NO: 841456 - RNA, 19 nt, Homo sapiens
ggacaucaaagauucauug

SEQ ID NO: 841457 - RNA, 19 nt, Homo sapiens
caagaagcacuaugacuuu

SEQ ID NO: 841458 - RNA, 19 nt, Homo sapiens
uggaauaacucgcauggaa

SEQ ID NO: 841459 - RNA, 19 nt, Homo sapiens
gacagguuaucaaguuaua

SEQ ID NO: 841460 - RNA, 19 nt, Homo sapiens
uggcauagaucuacaugaa

SEQ ID NO: 841461 - RNA, 19 nt, Homo sapiens
caaguacaauuuccucgaa

SEQ ID NO: 841462 - RNA, 19 nt, Homo sapiens
ccaguuaacacaaucauuu

SEQ ID NO: 841463 - RNA, 19 nt, Homo sapiens
caagcucccuguagaauuc

SEQ ID NO: 841464 - RNA, 19 nt, Homo sapiens
gacaagaggugauaguucu

SEQ ID NO: 841465 - RNA, 19 nt, Homo sapiens
ugggaagucugucauagua

SEQ ID NO: 841466 - RNA, 19 nt, Homo sapiens
gugauaaguugcccagaaa

SEQ ID NO: 841467 - RNA, 19 nt, Homo sapiens
gcccuuuccuuauucauuu

SEQ ID NO: 841468 - RNA, 19 nt, Homo sapiens
ggaauccacaucagaauga

SEQ ID NO: 841469 - RNA, 19 nt, Homo sapiens
gcacuaugacuuucacauu

SEQ ID NO: 841470 - RNA, 19 nt, Homo sapiens
auacauaacucuuccuugu

SEQ ID NO: 841471 - RNA, 19 nt, Homo sapiens
guacaauccuccugcuguu

SEQ ID NO: 841472 - RNA, 19 nt, Homo sapiens
gaaugccuguuuacuauag

SEQ ID NO: 841473 - RNA, 19 nt, Homo sapiens
ucaagguucucaaggaauu

SEQ ID NO: 841474 - RNA, 19 nt, Homo sapiens
cagaggcgccagauauuua

SEQ ID NO: 841475 - RNA, 19 nt, Homo sapiens
ggagugaaauaaccaaguc

SEQ ID NO: 841476 - RNA, 19 nt, Homo sapiens
cacuaugacuuucacauuu

SEQ ID NO: 841477 - RNA, 19 nt, Homo sapiens
caaacaauccacaaucuug

SEQ ID NO: 841478 - RNA, 19 nt, Homo sapiens
cuaaugaggaugucugaua

SEQ ID NO: 841479 - RNA, 19 nt, Homo sapiens
gcaaggcuguacaaugugu

SEQ ID NO: 841480 - RNA, 19 nt, Homo sapiens
gcauucuccuuguggauuu

SEQ ID NO: 841481 - RNA, 19 nt, Homo sapiens
aagaagagcccacaaauag

SEQ ID NO: 841482 - RNA, 19 nt, Homo sapiens
gauccaaagcucuauugua

SEQ ID NO: 841483 - RNA, 19 nt, Homo sapiens
agaaugcacugaagaaaca

SEQ ID NO: 841484 - RNA, 19 nt, Homo sapiens
gccagcagcuucaguggaa

SEQ ID NO: 841485 - RNA, 19 nt, Homo sapiens
aauaaugagucuccacgua

SEQ ID NO: 841486 - RNA, 19 nt, Homo sapiens
caauuuaagcucuucagua

SEQ ID NO: 841487 - RNA, 19 nt, Homo sapiens
caucaaagcagcacugaga

SEQ ID NO: 841488 - RNA, 19 nt, Homo sapiens
cagacagguuaucaaguua

SEQ ID NO: 841489 - RNA, 19 nt, Homo sapiens
uaaugagucuccacguaaa

SEQ ID NO: 841490 - RNA, 19 nt, Homo sapiens
ugaacuaccagauggaaua

SEQ ID NO: 841491 - RNA, 19 nt, Homo sapiens
auacuucagugccaacaua

SEQ ID NO: 841492 - RNA, 19 nt, Homo sapiens
uaaccuagggucucaguuu

SEQ ID NO: 841493 - RNA, 19 nt, Homo sapiens
gaugaaacugcaacaauga

SEQ ID NO: 841494 - RNA, 19 nt, Homo sapiens
uugcaaggcuguacaaugu

SEQ ID NO: 841495 - RNA, 19 nt, Homo sapiens
caaagauucauugcacuua

SEQ ID NO: 841496 - RNA, 19 nt, Homo sapiens
gcggaucacuggacaucaa

SEQ ID NO: 841497 - RNA, 19 nt, Homo sapiens
gaaugcaggagugaaauaa

SEQ ID NO: 841498 - RNA, 19 nt, Homo sapiens
guauuuggagcuucuguua

SEQ ID NO: 841499 - RNA, 19 nt, Homo sapiens
caagcaagaagcacuauga

SEQ ID NO: 841500 - RNA, 19 nt, Homo sapiens
gcacagaaugcacugaaga

SEQ ID NO: 841501 - RNA, 19 nt, Homo sapiens
gaacuaccagauggaauaa

SEQ ID NO: 841502 - RNA, 19 nt, Homo sapiens
gcagaggcgccagauauuu

SEQ ID NO: 841503 - RNA, 19 nt, Homo sapiens
cagaagaagcaaaucuaua

SEQ ID NO: 841504 - RNA, 19 nt, Homo sapiens
cugcaacaaugaaggauuu

SEQ ID NO: 841505 - RNA, 19 nt, Homo sapiens
uagguagugugaacauuaa

SEQ ID NO: 841506 - RNA, 19 nt, Homo sapiens
auacagaguuagcagguuu

SEQ ID NO: 841507 - RNA, 19 nt, Homo sapiens
ggggaacucuuuaaaauug

SEQ ID NO: 841508 - RNA, 19 nt, Homo sapiens
aggaaugccuguuuacuau

SEQ ID NO: 841509 - RNA, 19 nt, Homo sapiens
gcaaaacuaccaaggaaua

SEQ ID NO: 841510 - RNA, 19 nt, Homo sapiens
gcagucugguuauaucaug

SEQ ID NO: 841511 - RNA, 19 nt, Homo sapiens
gaagcaaaucuauagaaga

SEQ ID NO: 841512 - RNA, 19 nt, Homo sapiens
ggacuccuccugccagauu

SEQ ID NO: 841513 - RNA, 19 nt, Homo sapiens
gaagagcccacaaauagag

SEQ ID NO: 841514 - RNA, 19 nt, Homo sapiens
caacauaucagguuucacu

SEQ ID NO: 841515 - RNA, 19 nt, Homo sapiens
aaccuagggucucaguuua

SEQ ID NO: 841516 - RNA, 19 nt, Homo sapiens
agaauacguuugaaagaug

SEQ ID NO: 841517 - RNA, 19 nt, Homo sapiens
gaauaccugaucagaaauu

SEQ ID NO: 841518 - RNA, 19 nt, Homo sapiens
agaugaaacugcaacaaug

SEQ ID NO: 841519 - RNA, 19 nt, Homo sapiens
uaaccaaccugaacaacua

SEQ ID NO: 841520 - RNA, 19 nt, Homo sapiens
ggacaacagucagucaaau

SEQ ID NO: 841521 - RNA, 19 nt, Homo sapiens
ccucacagaugaauuugaa

SEQ ID NO: 841522 - RNA, 19 nt, Homo sapiens
uuaagaagcuugaacuaag

SEQ ID NO: 841523 - RNA, 19 nt, Homo sapiens
ccaaaccucauacaucuaa

SEQ ID NO: 841524 - RNA, 19 nt, Homo sapiens
uuaaagaccucagcacaau

SEQ ID NO: 841525 - RNA, 19 nt, Homo sapiens
uggaaggccucacagauga

SEQ ID NO: 841526 - RNA, 19 nt, Homo sapiens
guccaaaccucauacaucu

SEQ ID NO: 841527 - RNA, 19 nt, Homo sapiens
ggagaugggcaaauggauu

SEQ ID NO: 841528 - RNA, 19 nt, Homo sapiens
ucagucaaaugaaggcaaa

SEQ ID NO: 841529 - RNA, 19 nt, Homo sapiens
caaaugaaggcaaauugga

SEQ ID NO: 841530 - RNA, 19 nt, Homo sapiens
ggccucaccucaauugcaa

SEQ ID NO: 841531 - RNA, 19 nt, Homo sapiens
gcuuagaccuuuucacuug

SEQ ID NO: 841532 - RNA, 19 nt, Homo sapiens
cuagaaguauuggcagaaa

SEQ ID NO: 841533 - RNA, 19 nt, Homo sapiens
ucaccucaauugcaaacuu

SEQ ID NO: 841534 - RNA, 19 nt, Homo sapiens
gagaugggcaaauggauuc

SEQ ID NO: 841535 - RNA, 19 nt, Homo sapiens
uaaagaccucagcacaaua

SEQ ID NO: 841536 - RNA, 19 nt, Homo sapiens
cucgagagcuuagaccuuu

SEQ ID NO: 841537 - RNA, 19 nt, Homo sapiens
acauaggccucaccucaau

SEQ ID NO: 841538 - RNA, 19 nt, Homo sapiens
ucacagaugaauuugaaga

SEQ ID NO: 841539 - RNA, 19 nt, Homo sapiens
caacagucagucaaaugaa

SEQ ID NO: 841540 - RNA, 19 nt, Homo sapiens
gacaacagucagucaaaug

SEQ ID NO: 841541 - RNA, 19 nt, Homo sapiens
caccucaauugcaaacuug

SEQ ID NO: 841542 - RNA, 19 nt, Homo sapiens
cagaugaauuugaagaacu

SEQ ID NO: 841543 - RNA, 19 nt, Homo sapiens
caaauuggaaggccucaca

SEQ ID NO: 841544 - RNA, 19 nt, Homo sapiens
caaccugaacaacuacuga

SEQ ID NO: 841545 - RNA, 19 nt, Homo sapiens
acaacagucagucaaauga

SEQ ID NO: 841546 - RNA, 19 nt, Homo sapiens
cuuaagaagcuugaacuaa

SEQ ID NO: 841547 - RNA, 19 nt, Homo sapiens
uagaaaaccucgagagcuu

SEQ ID NO: 841548 - RNA, 19 nt, Homo sapiens
aaaugaaggcaaauuggaa

SEQ ID NO: 841549 - RNA, 19 nt, Homo sapiens
gcccuccgaugugaaagaa

SEQ ID NO: 841550 - RNA, 19 nt, Homo sapiens
caaaccucauacaucuaaa

SEQ ID NO: 841551 - RNA, 19 nt, Homo sapiens
ucagugggccuagaaguau

SEQ ID NO: 841552 - RNA, 19 nt, Homo sapiens
aaagaccucagcacaauag

SEQ ID NO: 841553 - RNA, 19 nt, Homo sapiens
ggaaggccucacagaugaa

SEQ ID NO: 841554 - RNA, 19 nt, Homo sapiens
cagugggccuagaaguauu

SEQ ID NO: 841555 - RNA, 19 nt, Homo sapiens
ugaauuugaagaacuggaa

SEQ ID NO: 841556 - RNA, 19 nt, Homo sapiens
agaugaauuugaagaacug

SEQ ID NO: 841557 - RNA, 19 nt, Homo sapiens
gucaaaugaaggcaaauug

SEQ ID NO: 841558 - RNA, 19 nt, Homo sapiens
aaaguguccaaaccucaua

SEQ ID NO: 841559 - RNA, 19 nt, Homo sapiens
ugaacuaagcaguaacaga

SEQ ID NO: 841560 - RNA, 19 nt, Homo sapiens
guaaccaaccugaacaacu

SEQ ID NO: 841561 - RNA, 19 nt, Homo sapiens
ucaaaugaaggcaaauugg

SEQ ID NO: 841562 - RNA, 19 nt, Homo sapiens
gaaggccucacagaugaau

SEQ ID NO: 841563 - RNA, 19 nt, Homo sapiens
gcagaaaaguguccaaacc

SEQ ID NO: 841564 - RNA, 19 nt, Homo sapiens
acaggacgcccuccgaugu

SEQ ID NO: 841565 - RNA, 19 nt, Homo sapiens
gcaguaacagagccucagu

SEQ ID NO: 841566 - RNA, 19 nt, Homo sapiens
gaauuugaagaacuggaau

SEQ ID NO: 841567 - RNA, 19 nt, Homo sapiens
gagccucagugggccuaga

SEQ ID NO: 841568 - RNA, 19 nt, Homo sapiens
cucagugggccuagaagua

SEQ ID NO: 841569 - RNA, 19 nt, Homo sapiens
acagaugaauuugaagaac

SEQ ID NO: 841570 - RNA, 19 nt, Homo sapiens
cacagaugaauuugaagaa

SEQ ID NO: 841571 - RNA, 19 nt, Homo sapiens
aggccucacagaugaauuu

SEQ ID NO: 841572 - RNA, 19 nt, Homo sapiens
gaacuggaauucuuaagua

SEQ ID NO: 841573 - RNA, 19 nt, Homo sapiens
uaaccaaccugaacgacua

SEQ ID NO: 841574 - RNA, 19 nt, Homo sapiens
gcagacggauucauucaga

SEQ ID NO: 841575 - RNA, 19 nt, Homo sapiens
ugaagaagguuauaacgau

SEQ ID NO: 841576 - RNA, 19 nt, Homo sapiens
ccucacgcaucuauauuua

SEQ ID NO: 841577 - RNA, 19 nt, Homo sapiens
ugaugaagaugcucaggua

SEQ ID NO: 841578 - RNA, 19 nt, Homo sapiens
ggaggaguaugaugaagau

SEQ ID NO: 841579 - RNA, 19 nt, Homo sapiens
aagaagagcuuggugaaga

SEQ ID NO: 841580 - RNA, 19 nt, Homo sapiens
ccucacagaugaauuugaa

SEQ ID NO: 841581 - RNA, 19 nt, Homo sapiens
cgaggaagaugaagaagag

SEQ ID NO: 841582 - RNA, 19 nt, Homo sapiens
caauagagccacugaaaca

SEQ ID NO: 841583 - RNA, 19 nt, Homo sapiens
uuaaagaccucagcacaau

SEQ ID NO: 841584 - RNA, 19 nt, Homo sapiens
ucgaagcccucacagauga

SEQ ID NO: 841585 - RNA, 19 nt, Homo sapiens
gaaugaaggcaaacucgaa

SEQ ID NO: 841586 - RNA, 19 nt, Homo sapiens
uuauaacgauggagaggua

SEQ ID NO: 841587 - RNA, 19 nt, Homo sapiens
gcuuagaccuuuucaauug

SEQ ID NO: 841588 - RNA, 19 nt, Homo sapiens
agagguagauggcgaggaa

SEQ ID NO: 841589 - RNA, 19 nt, Homo sapiens
ggacaacagucggucgaau

SEQ ID NO: 841590 - RNA, 19 nt, Homo sapiens
cucaagagcuuagaccuuu

SEQ ID NO: 841591 - RNA, 19 nt, Homo sapiens
ucacgcaucuauauuuaag

SEQ ID NO: 841592 - RNA, 19 nt, Homo sapiens
gagaugggcagacggauuc

SEQ ID NO: 841593 - RNA, 19 nt, Homo sapiens
cacaauagagccacugaaa

SEQ ID NO: 841594 - RNA, 19 nt, Homo sapiens
guccaaaccucacgcaucu

SEQ ID NO: 841595 - RNA, 19 nt, Homo sapiens
ggagaugggcagacggauu

SEQ ID NO: 841596 - RNA, 19 nt, Homo sapiens
agaagagcuuggugaagaa

SEQ ID NO: 841597 - RNA, 19 nt, Homo sapiens
ugaagaugcucagguagug

SEQ ID NO: 841598 - RNA, 19 nt, Homo sapiens
uaaagaccucagcacaaua

SEQ ID NO: 841599 - RNA, 19 nt, Homo sapiens
guugagaaagcuugaacua

SEQ ID NO: 841600 - RNA, 19 nt, Homo sapiens
aaaccucacgcaucuauau

SEQ ID NO: 841601 - RNA, 19 nt, Homo sapiens
ccaaaccucacgcaucuau

SEQ ID NO: 841602 - RNA, 19 nt, Homo sapiens
ucacagaugaauuugaaga

SEQ ID NO: 841603 - RNA, 19 nt, Homo sapiens
ugaagaagagcuuggugaa

SEQ ID NO: 841604 - RNA, 19 nt, Homo sapiens
ggaguaugaugaagaugcu

SEQ ID NO: 841605 - RNA, 19 nt, Homo sapiens
gacaacagucggucgaaug

SEQ ID NO: 841606 - RNA, 19 nt, Homo sapiens
uagaaaaccucaagagcuu

SEQ ID NO: 841607 - RNA, 19 nt, Homo sapiens
cagaugaauuugaagaacu

SEQ ID NO: 841608 - RNA, 19 nt, Homo sapiens
gaagaagagcuuggugaag

SEQ ID NO: 841609 - RNA, 19 nt, Homo sapiens
ggaagaugaagaagagcuu

SEQ ID NO: 841610 - RNA, 19 nt, Homo sapiens
gcgaggaagaugaagaaga

SEQ ID NO: 841611 - RNA, 19 nt, Homo sapiens
guucaagcuucuccugcaa

SEQ ID NO: 841612 - RNA, 19 nt, Homo sapiens
caccucaaucucagacuua

SEQ ID NO: 841613 - RNA, 19 nt, Homo sapiens
ucaccucaaucucagacuu

SEQ ID NO: 841614 - RNA, 19 nt, Homo sapiens
ggaggaggaggaaggugaa

SEQ ID NO: 841615 - RNA, 19 nt, Homo sapiens
gagaaaacguguucaagcu

SEQ ID NO: 841616 - RNA, 19 nt, Homo sapiens
gagcuuagaccuuuucaau

SEQ ID NO: 841617 - RNA, 19 nt, Homo sapiens
gcacaauagagccacugaa

SEQ ID NO: 841618 - RNA, 19 nt, Homo sapiens
agagcuuggugaagaagaa

SEQ ID NO: 841619 - RNA, 19 nt, Homo sapiens
ggaugaagaagguuauaac

SEQ ID NO: 841620 - RNA, 19 nt, Homo sapiens
gaggaugaagaagguuaua

SEQ ID NO: 841621 - RNA, 19 nt, Homo sapiens
ggaggagggugagcaugag

SEQ ID NO: 841622 - RNA, 19 nt, Homo sapiens
ccucugaugugaaagaacu

SEQ ID NO: 841623 - RNA, 19 nt, Homo sapiens
acgcaucuauauuuaagug

SEQ ID NO: 841624 - RNA, 19 nt, Homo sapiens
ggaggaugaagaagguuau

SEQ ID NO: 841625 - RNA, 19 nt, Homo sapiens
acaacagucggucgaauga

SEQ ID NO: 841626 - RNA, 19 nt, Homo sapiens
aaagaccucagcacaauag

SEQ ID NO: 841627 - RNA, 19 nt, Homo sapiens
gggcagacggauucauuca

SEQ ID NO: 841628 - RNA, 19 nt, Homo sapiens
uaccaaaguuaaaguugag

SEQ ID NO: 841629 - RNA, 19 nt, Homo sapiens
agaugaauuugaagaacug

SEQ ID NO: 841630 - RNA, 19 nt, Homo sapiens
ugaauuugaagaacuggaa

SEQ ID NO: 841631 - RNA, 19 nt, Homo sapiens
ggaggaggaaggugaagag

SEQ ID NO: 841632 - RNA, 19 nt, Homo sapiens
gaggaggaguaugaugaag

SEQ ID NO: 841633 - RNA, 19 nt, Homo sapiens
uaaaguugagaaagcuuga

SEQ ID NO: 841634 - RNA, 19 nt, Homo sapiens
guagauggcgaggaagaug

SEQ ID NO: 841635 - RNA, 19 nt, Homo sapiens
ugaggaggaguaugaugaa

SEQ ID NO: 841636 - RNA, 19 nt, Homo sapiens
ccugaacgacuacggagaa

SEQ ID NO: 841637 - RNA, 19 nt, Homo sapiens
caaaccucacgcaucuaua

SEQ ID NO: 841638 - RNA, 19 nt, Homo sapiens
gcagaaaaguguccaaacc

SEQ ID NO: 841639 - RNA, 19 nt, Homo sapiens
aagcuucuccugcaacuca

SEQ ID NO: 841640 - RNA, 19 nt, Homo sapiens
ccaaaguuaaaguugagaa

SEQ ID NO: 841641 - RNA, 19 nt, Homo sapiens
caaacucgaagcccucaca

SEQ ID NO: 841642 - RNA, 19 nt, Homo sapiens
acucgaagcccucacagau

SEQ ID NO: 841643 - RNA, 19 nt, Homo sapiens
gaauuugaagaacuggaau

SEQ ID NO: 841644 - RNA, 19 nt, Homo sapiens
gcccucugaugugaaagaa

SEQ ID NO: 841645 - RNA, 19 nt, Homo sapiens
cuggaaguauuggcagaaa

SEQ ID NO: 841646 - RNA, 19 nt, Homo sapiens
gugagcaugaggaggagua

SEQ ID NO: 841647 - RNA, 19 nt, Homo sapiens
aacagucggucgaaugaag

SEQ ID NO: 841648 - RNA, 19 nt, Homo sapiens
agaagguuauaacgaugga

SEQ ID NO: 841649 - RNA, 19 nt, Homo sapiens
gaugaagaagguuauaacg

SEQ ID NO: 841650 - RNA, 19 nt, Homo sapiens
cacagaugaauuugaagaa

SEQ ID NO: 841651 - RNA, 19 nt, Homo sapiens
acagaugaauuugaagaac

SEQ ID NO: 841652 - RNA, 19 nt, Homo sapiens
gagcuuggugaagaagaaa

SEQ ID NO: 841653 - RNA, 19 nt, Homo sapiens
agcaugaggaggaguauga

SEQ ID NO: 841654 - RNA, 19 nt, Homo sapiens
uugagaaagcuugaacuaa

SEQ ID NO: 841655 - RNA, 19 nt, Homo sapiens
ccucaagagcuuagaccuu

SEQ ID NO: 841656 - RNA, 19 nt, Homo sapiens
gaaauagacugggaagaug

SEQ ID NO: 841657 - RNA, 19 nt, Homo sapiens
ggaaacaggccgagaagaa

SEQ ID NO: 841658 - RNA, 19 nt, Homo sapiens
caucguggcuaaacaggua

SEQ ID NO: 841659 - RNA, 19 nt, Homo sapiens
ggagggcccuaucuuguga

SEQ ID NO: 841660 - RNA, 19 nt, Homo sapiens
gcaagcggaugaacaccaa

SEQ ID NO: 841661 - RNA, 19 nt, Homo sapiens
gagcaaccaguuacuauga

SEQ ID NO: 841662 - RNA, 19 nt, Homo sapiens
gaagagcaaccaguuacua

SEQ ID NO: 841663 - RNA, 19 nt, Homo sapiens
ggaaagagaaagccaagau

SEQ ID NO: 841664 - RNA, 19 nt, Homo sapiens
gaaacaaguugaaguaccu

SEQ ID NO: 841665 - RNA, 19 nt, Homo sapiens
gcaggugucauuuaucuau

SEQ ID NO: 841666 - RNA, 19 nt, Homo sapiens
gcaugagcuugcuguugua

SEQ ID NO: 841667 - RNA, 19 nt, Homo sapiens
cauauacucugcagcuguu

SEQ ID NO: 841668 - RNA, 19 nt, Homo sapiens
gugaaggcaucaacauuuc

SEQ ID NO: 841669 - RNA, 19 nt, Homo sapiens
acagaaacaaguugaagua

SEQ ID NO: 841670 - RNA, 19 nt, Homo sapiens
guacacaggguauuucuag

SEQ ID NO: 841671 - RNA, 19 nt, Homo sapiens
gaauugugcaggugucauu

SEQ ID NO: 841672 - RNA, 19 nt, Homo sapiens
gagcaaggaaagggucuua

SEQ ID NO: 841673 - RNA, 19 nt, Homo sapiens
gugcaggugucauuuaucu

SEQ ID NO: 841674 - RNA, 19 nt, Homo sapiens
gaaagagaaagccaagauc

SEQ ID NO: 841675 - RNA, 19 nt, Homo sapiens
gcaaccaguuacuaugagu

SEQ ID NO: 841676 - RNA, 19 nt, Homo sapiens
ggagaagaggaaagagaaa

SEQ ID NO: 841677 - RNA, 19 nt, Homo sapiens
gaggagaagaggaaagaga

SEQ ID NO: 841678 - RNA, 19 nt, Homo sapiens
gcaaggaaagggucuuagu

SEQ ID NO: 841679 - RNA, 19 nt, Homo sapiens
ugugaaggcaucaacauuu

SEQ ID NO: 841680 - RNA, 19 nt, Homo sapiens
ggaaagggucuuagucacu

SEQ ID NO: 841681 - RNA, 19 nt, Homo sapiens
gaagcugggagcaaggaaa

SEQ ID NO: 841682 - RNA, 19 nt, Homo sapiens
gaagaagaaacagcucaug

SEQ ID NO: 841683 - RNA, 19 nt, Homo sapiens
agaaauagacugggaagau

SEQ ID NO: 841684 - RNA, 19 nt, Homo sapiens
ggagccagaagacugauug

SEQ ID NO: 841685 - RNA, 19 nt, Homo sapiens
ugaaguaccuggcuuuccu

SEQ ID NO: 841686 - RNA, 19 nt, Homo sapiens
gggcaucuguuggacuuuc

SEQ ID NO: 841687 - RNA, 19 nt, Homo sapiens
uaggaagagcaaccaguua

SEQ ID NO: 841688 - RNA, 19 nt, Homo sapiens
acacaggguauuucuagaa

SEQ ID NO: 841689 - RNA, 19 nt, Homo sapiens
gaaacaggccgagaagaac

SEQ ID NO: 841690 - RNA, 19 nt, Homo sapiens
aagaagaaacagcucauga

SEQ ID NO: 841691 - RNA, 19 nt, Homo sapiens
cgucugaagccuacaagaa

SEQ ID NO: 841692 - RNA, 19 nt, Homo sapiens
gucugaagccuacaagaaa

SEQ ID NO: 841693 - RNA, 19 nt, Homo sapiens
caggguauuucuagaagca

SEQ ID NO: 841694 - RNA, 19 nt, Homo sapiens
ccaguuacuaugagugaaa

SEQ ID NO: 841695 - RNA, 19 nt, Homo sapiens
gaaggcaucaacauuucug

SEQ ID NO: 841696 - RNA, 19 nt, Homo sapiens
gucacugccucccgaaguu

SEQ ID NO: 841697 - RNA, 19 nt, Homo sapiens
gaaguaccaggcagugaca

SEQ ID NO: 841698 - RNA, 19 nt, Homo sapiens
caaggaaagggucuuaguc

SEQ ID NO: 841699 - RNA, 19 nt, Homo sapiens
gcucaugaggcuacggaaa

SEQ ID NO: 841700 - RNA, 19 nt, Homo sapiens
ggaagaagaaacagcucau

SEQ ID NO: 841701 - RNA, 19 nt, Homo sapiens
gaagccuacaagaaaguuu

SEQ ID NO: 841702 - RNA, 19 nt, Homo sapiens
cacaggguauuucuagaag

SEQ ID NO: 841703 - RNA, 19 nt, Homo sapiens
cuuuccaccuggucauaua

SEQ ID NO: 841704 - RNA, 19 nt, Homo sapiens
gugaaagggagccagaaga

SEQ ID NO: 841705 - RNA, 19 nt, Homo sapiens
gagaagaggaaagagaaag

SEQ ID NO: 841706 - RNA, 19 nt, Homo sapiens
aaggaaagggucuuaguca

SEQ ID NO: 841707 - RNA, 19 nt, Homo sapiens
uacaagaaaguuugccuau

SEQ ID NO: 841708 - RNA, 19 nt, Homo sapiens
ugccugcccuuccuccauu

SEQ ID NO: 841709 - RNA, 19 nt, Homo sapiens
caggugucauuuaucuaug

SEQ ID NO: 841710 - RNA, 19 nt, Homo sapiens
ucugaagccuacaagaaag

SEQ ID NO: 841711 - RNA, 19 nt, Homo sapiens
ucaugaggcuacggaaaca

SEQ ID NO: 841712 - RNA, 19 nt, Homo sapiens
gauuggagggcccuaucuu

SEQ ID NO: 841713 - RNA, 19 nt, Homo sapiens
gaaagggagccagaagacu

SEQ ID NO: 841714 - RNA, 19 nt, Homo sapiens
aagagcaaccaguuacuau

SEQ ID NO: 841715 - RNA, 19 nt, Homo sapiens
cucccgaaguugcuugaaa

SEQ ID NO: 841716 - RNA, 19 nt, Homo sapiens
gcccaauaaagacuguuaa

SEQ ID NO: 841717 - RNA, 19 nt, Homo sapiens
ggaagagcaaccaguuacu

SEQ ID NO: 841718 - RNA, 19 nt, Homo sapiens
agaagaaacagcucaugag

SEQ ID NO: 841719 - RNA, 19 nt, Homo sapiens
aggagaagaggaaagagaa

SEQ ID NO: 841720 - RNA, 19 nt, Homo sapiens
ucccgaaguugcuugaaag

SEQ ID NO: 841721 - RNA, 19 nt, Homo sapiens
cugggaagaugcacaacca

SEQ ID NO: 841722 - RNA, 19 nt, Homo sapiens
ugagaaagcugcacaaaua

SEQ ID NO: 841723 - RNA, 19 nt, Homo sapiens
gaacauggcugcaucaaau

SEQ ID NO: 841724 - RNA, 19 nt, Homo sapiens
caagagagauggcagauuu

SEQ ID NO: 841725 - RNA, 19 nt, Homo sapiens
ggaauacucuguccauuug

SEQ ID NO: 841726 - RNA, 19 nt, Homo sapiens
ggaaacggcucuucacaga

SEQ ID NO: 841727 - RNA, 19 nt, Homo sapiens
cagaacagcugcuccuaua

SEQ ID NO: 841728 - RNA, 19 nt, Homo sapiens
gcgaacaacuuuccuuaaa

SEQ ID NO: 841729 - RNA, 19 nt, Homo sapiens
gcaaggaagucgauacaga

SEQ ID NO: 841730 - RNA, 19 nt, Homo sapiens
caagaaauccugucaacua

SEQ ID NO: 841731 - RNA, 19 nt, Homo sapiens
cgacagaaguacugaauga

SEQ ID NO: 841732 - RNA, 19 nt, Homo sapiens
uauaaugucuccugcauaa

SEQ ID NO: 841733 - RNA, 19 nt, Homo sapiens
gcagaaaugcugauaauau

SEQ ID NO: 841734 - RNA, 19 nt, Homo sapiens
gcaaggauuuggacgguuu

SEQ ID NO: 841735 - RNA, 19 nt, Homo sapiens
ccagaaaucuccacggaaa

SEQ ID NO: 841736 - RNA, 19 nt, Homo sapiens
acaggaauaugcaagauua

SEQ ID NO: 841737 - RNA, 19 nt, Homo sapiens
gauauuagaagucgguuua

SEQ ID NO: 841738 - RNA, 19 nt, Homo sapiens
gcaguuaacuaauacacuu

SEQ ID NO: 841739 - RNA, 19 nt, Homo sapiens
caacagagaccauuucaga

SEQ ID NO: 841740 - RNA, 19 nt, Homo sapiens
ggaagaagaagaagaagaa

SEQ ID NO: 841741 - RNA, 19 nt, Homo sapiens
gaagaggauuuggauguuu

SEQ ID NO: 841742 - RNA, 19 nt, Homo sapiens
ugaagaacauagagaagua

SEQ ID NO: 841743 - RNA, 19 nt, Homo sapiens
caagaaguguggaugguuu

SEQ ID NO: 841744 - RNA, 19 nt, Homo sapiens
ggaagaagaggaagaagaa

SEQ ID NO: 841745 - RNA, 19 nt, Homo sapiens
gaugaaggauccaugaaug

SEQ ID NO: 841746 - RNA, 19 nt, Homo sapiens
gauagaggauuucauaugg

SEQ ID NO: 841747 - RNA, 19 nt, Homo sapiens
ggacacccauccuguuuga

SEQ ID NO: 841748 - RNA, 19 nt, Homo sapiens
guaaugaucuccgcaaugu

SEQ ID NO: 841749 - RNA, 19 nt, Homo sapiens
gcaaucaccugcaaaagua

SEQ ID NO: 841750 - RNA, 19 nt, Homo sapiens
ggaugaugauacugaaaua

SEQ ID NO: 841751 - RNA, 19 nt, Homo sapiens
ggucuugauuucccaguua

SEQ ID NO: 841752 - RNA, 19 nt, Homo sapiens
ggaagucgauacagaguuc

SEQ ID NO: 841753 - RNA, 19 nt, Homo sapiens
cagaaaugcugauaauaug

SEQ ID NO: 841754 - RNA, 19 nt, Homo sapiens
gauuucagcuauuugcuuu

SEQ ID NO: 841755 - RNA, 19 nt, Homo sapiens
acaagaaagugcagaugua

SEQ ID NO: 841756 - RNA, 19 nt, Homo sapiens
ggacaucacggcuacauga

SEQ ID NO: 841757 - RNA, 19 nt, Homo sapiens
caacagcaguguaacaaca

SEQ ID NO: 841758 - RNA, 19 nt, Homo sapiens
gcugucaucugguuggaua

SEQ ID NO: 841759 - RNA, 19 nt, Homo sapiens
ggaaaccagucccaugaug

SEQ ID NO: 841760 - RNA, 19 nt, Homo sapiens
gcaaacaaguguggccaaa

SEQ ID NO: 841761 - RNA, 19 nt, Homo sapiens
ggauaccucucuaaggaaa

SEQ ID NO: 841762 - RNA, 19 nt, Homo sapiens
gaagucgguuuauuucuca

SEQ ID NO: 841763 - RNA, 19 nt, Homo sapiens
ggaagccaguccugagaaa

SEQ ID NO: 841764 - RNA, 19 nt, Homo sapiens
gaggugaaauuauagacuu

SEQ ID NO: 841765 - RNA, 19 nt, Homo sapiens
ccaccacgcucgacgauug

SEQ ID NO: 841766 - RNA, 19 nt, Homo sapiens
gaagagcugcccagagaaa

SEQ ID NO: 841767 - RNA, 19 nt, Homo sapiens
acaaggaugucguuacuga

SEQ ID NO: 841768 - RNA, 19 nt, Homo sapiens
gacgacaccuuucaggauu

SEQ ID NO: 841769 - RNA, 19 nt, Homo sapiens
gaggaagaccggauuuaaa

SEQ ID NO: 841770 - RNA, 19 nt, Homo sapiens
gagccuaccugugagauug

SEQ ID NO: 841771 - RNA, 19 nt, Homo sapiens
gaaauccugucaacuagag

SEQ ID NO: 841772 - RNA, 19 nt, Homo sapiens
caaacccacuuuauacaga

SEQ ID NO: 841773 - RNA, 19 nt, Homo sapiens
ccacagcaaucauggcuau

SEQ ID NO: 841774 - RNA, 19 nt, Homo sapiens
caaaucagcccagaucaaa

SEQ ID NO: 841775 - RNA, 19 nt, Homo sapiens
gcagauuugucaucauuag

SEQ ID NO: 841776 - RNA, 19 nt, Homo sapiens
gacgguuucucauugauuu

SEQ ID NO: 841777 - RNA, 19 nt, Homo sapiens
ggagaaggaggaacaagaa

SEQ ID NO: 841778 - RNA, 19 nt, Homo sapiens
caagauuaccaaagcuuua

SEQ ID NO: 841779 - RNA, 19 nt, Homo sapiens
gcacuaucguccaaggaaa

SEQ ID NO: 841780 - RNA, 19 nt, Homo sapiens
gaacaaagcgcggucuauc

SEQ ID NO: 841781 - RNA, 19 nt, Homo sapiens
gagaaagcugcacaaauaa

SEQ ID NO: 841782 - RNA, 19 nt, Homo sapiens
aggaagagcugcccagaga

SEQ ID NO: 841783 - RNA, 19 nt, Homo sapiens
caaacgcgcugugaauaau

SEQ ID NO: 841784 - RNA, 19 nt, Homo sapiens
gaccaaaguccacagauug

SEQ ID NO: 841785 - RNA, 19 nt, Homo sapiens
gaacccagaggucuuaaug

SEQ ID NO: 841786 - RNA, 19 nt, Homo sapiens
ugaaugagcccuuugacaa

SEQ ID NO: 841787 - RNA, 19 nt, Homo sapiens
gcuauuugcuuucuagaag

SEQ ID NO: 841788 - RNA, 19 nt, Homo sapiens
gcaccaaaggcaaggauuu

SEQ ID NO: 841789 - RNA, 19 nt, Homo sapiens
gaugggcuuucucauacua

SEQ ID NO: 841790 - RNA, 19 nt, Homo sapiens
gaaccucuauggguaacuu

SEQ ID NO: 841791 - RNA, 19 nt, Homo sapiens
gagcacaacugagaacuac

SEQ ID NO: 841792 - RNA, 19 nt, Homo sapiens
ccauggaaaucgacucuga

SEQ ID NO: 841793 - RNA, 19 nt, Homo sapiens
ggaagaagaggaggaagaa

SEQ ID NO: 841794 - RNA, 19 nt, Homo sapiens
gcgagaagcugagaaagag

SEQ ID NO: 841795 - RNA, 19 nt, Homo sapiens
ugagcagccuuaccacuaa

SEQ ID NO: 841796 - RNA, 19 nt, Homo sapiens
gaaaacuacuucaugagaa

SEQ ID NO: 841797 - RNA, 19 nt, Homo sapiens
ggucaauuaugggagcuua

SEQ ID NO: 841798 - RNA, 19 nt, Homo sapiens
ccaagcagcuacgauucua

SEQ ID NO: 841799 - RNA, 19 nt, Homo sapiens
gaaagaaggcaguaaagac

SEQ ID NO: 841800 - RNA, 19 nt, Homo sapiens
ucuccuaccuggcauauug

SEQ ID NO: 841801 - RNA, 19 nt, Homo sapiens
gaaauuuaccgaaggaaag

SEQ ID NO: 841802 - RNA, 19 nt, Homo sapiens
ucaaagcacuaucguccaa

SEQ ID NO: 841803 - RNA, 19 nt, Homo sapiens
ccaaacgcgcugugaauaa

SEQ ID NO: 841804 - RNA, 19 nt, Homo sapiens
agaaguaucucagaaguca

SEQ ID NO: 841805 - RNA, 19 nt, Homo sapiens
gaacacaggcauguccaaa

SEQ ID NO: 841806 - RNA, 19 nt, Homo sapiens
uaagacaaccaucaacauu

SEQ ID NO: 841807 - RNA, 19 nt, Homo sapiens
gaucauucauugccuuaca

SEQ ID NO: 841808 - RNA, 19 nt, Homo sapiens
gaaaacagcuacgcccaaa

SEQ ID NO: 841809 - RNA, 19 nt, Homo sapiens
agaagacucugcacguuug

SEQ ID NO: 841810 - RNA, 19 nt, Homo sapiens
gaaggaggaacaagaaauc

SEQ ID NO: 841811 - RNA, 19 nt, Homo sapiens
aaacaaggaugucguuacu

SEQ ID NO: 841812 - RNA, 19 nt, Homo sapiens
gugcaaguucuguuaaaua

SEQ ID NO: 841813 - RNA, 19 nt, Homo sapiens
cucaauggcuccuacauga

SEQ ID NO: 841814 - RNA, 19 nt, Homo sapiens
gaagaaggaggaggaaaug

SEQ ID NO: 841815 - RNA, 19 nt, Homo sapiens
ggaagaagaggaagaagag

SEQ ID NO: 841816 - RNA, 19 nt, Homo sapiens
ggaagaggaagaagaggaa

SEQ ID NO: 841817 - RNA, 19 nt, Homo sapiens
ggaagaagaggaagaggau

SEQ ID NO: 841818 - RNA, 19 nt, Homo sapiens
agagagcagugaagaagaa

SEQ ID NO: 841819 - RNA, 19 nt, Homo sapiens
gcaagauuaccaaagcuuu

SEQ ID NO: 841820 - RNA, 19 nt, Homo sapiens
caagaaagugcagauguaa

SEQ ID NO: 841821 - RNA, 19 nt, Homo sapiens
acacagggcuuguucaacu

SEQ ID NO: 841822 - RNA, 19 nt, Homo sapiens
ggaagaagauuucagaaga

SEQ ID NO: 841823 - RNA, 19 nt, Homo sapiens
ccaaugagcugaagaguga

SEQ ID NO: 841824 - RNA, 19 nt, Homo sapiens
gaacacagcccacgaguau

SEQ ID NO: 841825 - RNA, 19 nt, Homo sapiens
gaaggaggcugcagaagga

SEQ ID NO: 841826 - RNA, 19 nt, Homo sapiens
caaagucucugccuacauu

SEQ ID NO: 841827 - RNA, 19 nt, Homo sapiens
gagaagagcuggcgagagu

SEQ ID NO: 841828 - RNA, 19 nt, Homo sapiens
gaagagaauugccaccauu

SEQ ID NO: 841829 - RNA, 19 nt, Homo sapiens
gaaggacucucucagaaug

SEQ ID NO: 841830 - RNA, 19 nt, Homo sapiens
gcaaagggcugguccucaa

SEQ ID NO: 841831 - RNA, 19 nt, Homo sapiens
gaaacacccugggcugaua

SEQ ID NO: 841832 - RNA, 19 nt, Homo sapiens
ggagauaaauccaagaaag

SEQ ID NO: 841833 - RNA, 19 nt, Homo sapiens
gcaagacacuucuguugga

SEQ ID NO: 841834 - RNA, 19 nt, Homo sapiens
gaauguuccucaaauguga

SEQ ID NO: 841835 - RNA, 19 nt, Homo sapiens
ccaagacccuuccugaauu

SEQ ID NO: 841836 - RNA, 19 nt, Homo sapiens
caacaugucuguacuucau

SEQ ID NO: 841837 - RNA, 19 nt, Homo sapiens
ggagacgccuggagaguug

SEQ ID NO: 841838 - RNA, 19 nt, Homo sapiens
gcagguggaucuuauaugg

SEQ ID NO: 841839 - RNA, 19 nt, Homo sapiens
ccacgucucuucagugcua

SEQ ID NO: 841840 - RNA, 19 nt, Homo sapiens
gaacuguccugcugguaug

SEQ ID NO: 841841 - RNA, 19 nt, Homo sapiens
caagacccuuccugaauuu

SEQ ID NO: 841842 - RNA, 19 nt, Homo sapiens
gaagaagauuucagaagag

SEQ ID NO: 841843 - RNA, 19 nt, Homo sapiens
gaacuucuuuccugugaca

SEQ ID NO: 841844 - RNA, 19 nt, Homo sapiens
gaucaugaaggaagcuuua

SEQ ID NO: 841845 - RNA, 19 nt, Homo sapiens
cauaaugacucugugguuu

SEQ ID NO: 841846 - RNA, 19 nt, Homo sapiens
gcaacaagcacaucaagga

SEQ ID NO: 841847 - RNA, 19 nt, Homo sapiens
gagaagaggcugcccauuc

SEQ ID NO: 841848 - RNA, 19 nt, Homo sapiens
uggaggagauugauaagaa

SEQ ID NO: 841849 - RNA, 19 nt, Homo sapiens
cagaaaugcuccagaguuc

SEQ ID NO: 841850 - RNA, 19 nt, Homo sapiens
caacgcaggacuucuuuaa

SEQ ID NO: 841851 - RNA, 19 nt, Homo sapiens
gaacacacccaaagcuuca

SEQ ID NO: 841852 - RNA, 19 nt, Homo sapiens
ggauugauuugucggacua

SEQ ID NO: 841853 - RNA, 19 nt, Homo sapiens
gguauaagauuggacaugu

SEQ ID NO: 841854 - RNA, 19 nt, Homo sapiens
ccaagaagauccacuacca

SEQ ID NO: 841855 - RNA, 19 nt, Homo sapiens
gaauuugacagcuauaaga

SEQ ID NO: 841856 - RNA, 19 nt, Homo sapiens
gaaucucucugaauaugau

SEQ ID NO: 841857 - RNA, 19 nt, Homo sapiens
caacuugucccuauggauu

SEQ ID NO: 841858 - RNA, 19 nt, Homo sapiens
ccaaggccaucaaguucua

SEQ ID NO: 841859 - RNA, 19 nt, Homo sapiens
gaugucaaccucugguaua

SEQ ID NO: 841860 - RNA, 19 nt, Homo sapiens
gaaggagccggaccugaaa

SEQ ID NO: 841861 - RNA, 19 nt, Homo sapiens
gauucgaauugcagccuua

SEQ ID NO: 841862 - RNA, 19 nt, Homo sapiens
cggaaggacucucucagaa

SEQ ID NO: 841863 - RNA, 19 nt, Homo sapiens
gggcugauacugaaauauu

SEQ ID NO: 841864 - RNA, 19 nt, Homo sapiens
agaaggguguggccuauga

SEQ ID NO: 841865 - RNA, 19 nt, Homo sapiens
agacagccauggaguucua

SEQ ID NO: 841866 - RNA, 19 nt, Homo sapiens
ggagcaggcugugaaguuc

SEQ ID NO: 841867 - RNA, 19 nt, Homo sapiens
gaagguguccuccaugcuu

SEQ ID NO: 841868 - RNA, 19 nt, Homo sapiens
gagaggaacaagaccaauu

SEQ ID NO: 841869 - RNA, 19 nt, Homo sapiens
acgcaggacuucuuuaaug

SEQ ID NO: 841870 - RNA, 19 nt, Homo sapiens
acacagcccacgaguauuu

SEQ ID NO: 841871 - RNA, 19 nt, Homo sapiens
cacaggcgauuguagauga

SEQ ID NO: 841872 - RNA, 19 nt, Homo sapiens
gagaagaacacacccaaag

SEQ ID NO: 841873 - RNA, 19 nt, Homo sapiens
caccugagcuggccaugga

SEQ ID NO: 841874 - RNA, 19 nt, Homo sapiens
gaaggacuaucggcagugu

SEQ ID NO: 841875 - RNA, 19 nt, Homo sapiens
uccaggagcuucugaugaa

SEQ ID NO: 841876 - RNA, 19 nt, Homo sapiens
gucaaccucugguauaaga

SEQ ID NO: 841877 - RNA, 19 nt, Homo sapiens
gugcagagguccuggucaa

SEQ ID NO: 841878 - RNA, 19 nt, Homo sapiens
gcgauucuaugugcgagua

SEQ ID NO: 841879 - RNA, 19 nt, Homo sapiens
gugcuacccuggaucauuc

SEQ ID NO: 841880 - RNA, 19 nt, Homo sapiens
uauggugaauggcagauuu

SEQ ID NO: 841881 - RNA, 19 nt, Homo sapiens
gaagucagccauccuuucu

SEQ ID NO: 841882 - RNA, 19 nt, Homo sapiens
gaugaugcgcuaccugaaa

SEQ ID NO: 841883 - RNA, 19 nt, Homo sapiens
ucagaauguuccucaaaug

SEQ ID NO: 841884 - RNA, 19 nt, Homo sapiens
ggaaggacucucucagaau

SEQ ID NO: 841885 - RNA, 19 nt, Homo sapiens
gcuccaccauugaggauga

SEQ ID NO: 841886 - RNA, 19 nt, Homo sapiens
caagcacuguuucacauca

SEQ ID NO: 841887 - RNA, 19 nt, Homo sapiens
caccgugucugcugacuug

SEQ ID NO: 841888 - RNA, 19 nt, Homo sapiens
ccaccgaugucucacacaa

SEQ ID NO: 841889 - RNA, 19 nt, Homo sapiens
ggaacuguccugcugguau

SEQ ID NO: 841890 - RNA, 19 nt, Homo sapiens
ccuaaucacuguccuguac

SEQ ID NO: 841891 - RNA, 19 nt, Homo sapiens
ugcugaaucucucugaaua

SEQ ID NO: 841892 - RNA, 19 nt, Homo sapiens
gaggagucauuggagagua

SEQ ID NO: 841893 - RNA, 19 nt, Homo sapiens
ggaaauccuacacagagaa

SEQ ID NO: 841894 - RNA, 19 nt, Homo sapiens
cgcaggacuucuuuaauga

SEQ ID NO: 841895 - RNA, 19 nt, Homo sapiens
ugaacgagcuuuacuaccu

SEQ ID NO: 841896 - RNA, 19 nt, Homo sapiens
gaugcacuguucauguuug

SEQ ID NO: 841897 - RNA, 19 nt, Homo sapiens
ugcccaaccuccauaauga

SEQ ID NO: 841898 - RNA, 19 nt, Homo sapiens
gaagauuucagaagagagu

SEQ ID NO: 841899 - RNA, 19 nt, Homo sapiens
ggacagcacagccguagca

SEQ ID NO: 841900 - RNA, 19 nt, Homo sapiens
gccaagcacuguuucacau

SEQ ID NO: 841901 - RNA, 19 nt, Homo sapiens
gaacuccaaugagcugaag

SEQ ID NO: 841902 - RNA, 19 nt, Homo sapiens
ucaaggacaugaugcugau

SEQ ID NO: 841903 - RNA, 19 nt, Homo sapiens
uguacacccucagugauua

SEQ ID NO: 841904 - RNA, 19 nt, Homo sapiens
uggauaaccuaaucacugu

SEQ ID NO: 841905 - RNA, 19 nt, Homo sapiens
gaccagaggcccacaugga

SEQ ID NO: 841906 - RNA, 19 nt, Homo sapiens
agaagagaguggagaaaca

SEQ ID NO: 841907 - RNA, 19 nt, Homo sapiens
gagccggaccugaaacuug

SEQ ID NO: 841908 - RNA, 19 nt, Homo sapiens
gaagaacacacccaaagcu

SEQ ID NO: 841909 - RNA, 19 nt, Homo sapiens
ggagaagaacacacccaaa

SEQ ID NO: 841910 - RNA, 19 nt, Homo sapiens
gaagauccacuaccacaac

SEQ ID NO: 841911 - RNA, 19 nt, Homo sapiens
cauugaggaugaucaugaa

SEQ ID NO: 841912 - RNA, 19 nt, Homo sapiens
ccagaaggguguggccuau

SEQ ID NO: 841913 - RNA, 19 nt, Homo sapiens
agaggaacaagaccaauuu

SEQ ID NO: 841914 - RNA, 19 nt, Homo sapiens
ggcaacaacugcagcacau

SEQ ID NO: 841915 - RNA, 19 nt, Homo sapiens
gagcagcggcaguuucuca

SEQ ID NO: 841916 - RNA, 19 nt, Homo sapiens
uuaaugagcccaccagcuu

SEQ ID NO: 841917 - RNA, 19 nt, Homo sapiens
gcucaacgcaggacuucuu

SEQ ID NO: 841918 - RNA, 19 nt, Homo sapiens
gacgaggacucccacucuu

SEQ ID NO: 841919 - RNA, 19 nt, Homo sapiens
ugaggaugaucaugaagga

SEQ ID NO: 841920 - RNA, 19 nt, Homo sapiens
gguagcauccugaagguau

SEQ ID NO: 841921 - RNA, 19 nt, Homo sapiens
agaaggagccggaccugaa

SEQ ID NO: 841922 - RNA, 19 nt, Homo sapiens
gagcaaaucucaaacauca

SEQ ID NO: 841923 - RNA, 19 nt, Homo sapiens
aaagaaauguccacaagua

SEQ ID NO: 841924 - RNA, 19 nt, Homo sapiens
cgaaagcggucucgaagua

SEQ ID NO: 841925 - RNA, 19 nt, Homo sapiens
ugaaucaucuccugaagua

SEQ ID NO: 841926 - RNA, 19 nt, Homo sapiens
ccacagaucugauacuuca

SEQ ID NO: 841927 - RNA, 19 nt, Homo sapiens
gaaagaagcgggucagaau

SEQ ID NO: 841928 - RNA, 19 nt, Homo sapiens
acacagcaguucugaguua

SEQ ID NO: 841929 - RNA, 19 nt, Homo sapiens
cgacgcaggucucguagua

SEQ ID NO: 841930 - RNA, 19 nt, Homo sapiens
gaaacucgcucuagaacuc

SEQ ID NO: 841931 - RNA, 19 nt, Homo sapiens
gcauccagaucuccaauaa

SEQ ID NO: 841932 - RNA, 19 nt, Homo sapiens
gguaaacgguccuuaacaa

SEQ ID NO: 841933 - RNA, 19 nt, Homo sapiens
gcagggaugucuucaaauc

SEQ ID NO: 841934 - RNA, 19 nt, Homo sapiens
aagccaagaugaagaguua

SEQ ID NO: 841935 - RNA, 19 nt, Homo sapiens
cagaacaucucaaagaaga

SEQ ID NO: 841936 - RNA, 19 nt, Homo sapiens
cgaggaagaucccgcagua

SEQ ID NO: 841937 - RNA, 19 nt, Homo sapiens
ggaaguaguucugaucguu

SEQ ID NO: 841938 - RNA, 19 nt, Homo sapiens
uggaucaccuuuagaauuu

SEQ ID NO: 841939 - RNA, 19 nt, Homo sapiens
gaagugagacagagucauu

SEQ ID NO: 841940 - RNA, 19 nt, Homo sapiens
gcaauaauaucaccaagac

SEQ ID NO: 841941 - RNA, 19 nt, Homo sapiens
gagcagaaauacccagaga

SEQ ID NO: 841942 - RNA, 19 nt, Homo sapiens
caaagugaaggcaauaaua

SEQ ID NO: 841943 - RNA, 19 nt, Homo sapiens
gagcaggucucucucuuca

SEQ ID NO: 841944 - RNA, 19 nt, Homo sapiens
ggacucgaauucucucuug

SEQ ID NO: 841945 - RNA, 19 nt, Homo sapiens
gagaugcgccuuucaguga

SEQ ID NO: 841946 - RNA, 19 nt, Homo sapiens
gaacauaaagaacugucua

SEQ ID NO: 841947 - RNA, 19 nt, Homo sapiens
gaacagcaaauucaggaaa

SEQ ID NO: 841948 - RNA, 19 nt, Homo sapiens
uuaaucagcuggaaacaga

SEQ ID NO: 841949 - RNA, 19 nt, Homo sapiens
uagaacaccucaaagaaga

SEQ ID NO: 841950 - RNA, 19 nt, Homo sapiens
ccagauuguugccaagaua

SEQ ID NO: 841951 - RNA, 19 nt, Homo sapiens
ccaaagagcaaacguaaau

SEQ ID NO: 841952 - RNA, 19 nt, Homo sapiens
uaggauggcuccagcauug

SEQ ID NO: 841953 - RNA, 19 nt, Homo sapiens
gcccagaaaugaagaaauc

SEQ ID NO: 841954 - RNA, 19 nt, Homo sapiens
uaauggaggugguagagaa

SEQ ID NO: 841955 - RNA, 19 nt, Homo sapiens
gcacuugcccugacagcua

SEQ ID NO: 841956 - RNA, 19 nt, Homo sapiens
gaagaaaggccugcugugu

SEQ ID NO: 841957 - RNA, 19 nt, Homo sapiens
ggccaaauccugucucauu

SEQ ID NO: 841958 - RNA, 19 nt, Homo sapiens
agacaaagauaaagacaag

SEQ ID NO: 841959 - RNA, 19 nt, Homo sapiens
gaggauacaguucaggaua

SEQ ID NO: 841960 - RNA, 19 nt, Homo sapiens
aaagaugguuuacccagaa

SEQ ID NO: 841961 - RNA, 19 nt, Homo sapiens
ggacacagcaguucugagu

SEQ ID NO: 841962 - RNA, 19 nt, Homo sapiens
agacaaauuuagucccuuu

SEQ ID NO: 841963 - RNA, 19 nt, Homo sapiens
caaagucacucagggucua

SEQ ID NO: 841964 - RNA, 19 nt, Homo sapiens
gaagaagcagguccaauuc

SEQ ID NO: 841965 - RNA, 19 nt, Homo sapiens
gagcaaacguaaaucuaag

SEQ ID NO: 841966 - RNA, 19 nt, Homo sapiens
caaagcagaagaagaagaa

SEQ ID NO: 841967 - RNA, 19 nt, Homo sapiens
gacagcaaaucucgacuau

SEQ ID NO: 841968 - RNA, 19 nt, Homo sapiens
ggaaugaaagauauaccua

SEQ ID NO: 841969 - RNA, 19 nt, Homo sapiens
guugaaaucuggaaugucu

SEQ ID NO: 841970 - RNA, 19 nt, Homo sapiens
gaaacaccgccaagacaaa

SEQ ID NO: 841971 - RNA, 19 nt, Homo sapiens
uggaagaucucacucuaga

SEQ ID NO: 841972 - RNA, 19 nt, Homo sapiens
cgacgaagaucccggucaa

SEQ ID NO: 841973 - RNA, 19 nt, Homo sapiens
cagcaaaucucgacuaucc

SEQ ID NO: 841974 - RNA, 19 nt, Homo sapiens
aaagaacaaucgacaagau

SEQ ID NO: 841975 - RNA, 19 nt, Homo sapiens
gaauggaccguuucuuaau

SEQ ID NO: 841976 - RNA, 19 nt, Homo sapiens
auaaagaacugucuaacuc

SEQ ID NO: 841977 - RNA, 19 nt, Homo sapiens
gaccacagaucugauacuu

SEQ ID NO: 841978 - RNA, 19 nt, Homo sapiens
ucuaaagacucacuaguuc

SEQ ID NO: 841979 - RNA, 19 nt, Homo sapiens
aaaucucgcuugucuuuga

SEQ ID NO: 841980 - RNA, 19 nt, Homo sapiens
gcacucaacaguuccagaa

SEQ ID NO: 841981 - RNA, 19 nt, Homo sapiens
uuaaagaaauguccacaag

SEQ ID NO: 841982 - RNA, 19 nt, Homo sapiens
gagacagagucauucagaa

SEQ ID NO: 841983 - RNA, 19 nt, Homo sapiens
ggaagaucccgcaguagaa

SEQ ID NO: 841984 - RNA, 19 nt, Homo sapiens
ccaagccaaucuaggauga

SEQ ID NO: 841985 - RNA, 19 nt, Homo sapiens
gaaagaacaaucgacaaga

SEQ ID NO: 841986 - RNA, 19 nt, Homo sapiens
ugaauggaccguuucuuaa

SEQ ID NO: 841987 - RNA, 19 nt, Homo sapiens
gaaaggacaaucucaaacu

SEQ ID NO: 841988 - RNA, 19 nt, Homo sapiens
agaagaagcagguccaauu

SEQ ID NO: 841989 - RNA, 19 nt, Homo sapiens
gcacacaacggccuaguag

SEQ ID NO: 841990 - RNA, 19 nt, Homo sapiens
aaucuaggaugaccucuga

SEQ ID NO: 841991 - RNA, 19 nt, Homo sapiens
guccagaucucgaacuuca

SEQ ID NO: 841992 - RNA, 19 nt, Homo sapiens
gggauccucucaagaacuu

SEQ ID NO: 841993 - RNA, 19 nt, Homo sapiens
ggucaucuccagaaacaaa

SEQ ID NO: 841994 - RNA, 19 nt, Homo sapiens
guucaucuccucauccuaa

SEQ ID NO: 841995 - RNA, 19 nt, Homo sapiens
aaacgguccuuaacaagau

SEQ ID NO: 841996 - RNA, 19 nt, Homo sapiens
gaucaucuccagagguuga

SEQ ID NO: 841997 - RNA, 19 nt, Homo sapiens
gggagaagcgaaugugauu

SEQ ID NO: 841998 - RNA, 19 nt, Homo sapiens
ggaucaccuuuagaauuua

SEQ ID NO: 841999 - RNA, 19 nt, Homo sapiens
cagggucuauuucaccaua

SEQ ID NO: 842000 - RNA, 19 nt, Homo sapiens
caccuaaacagaaaucuaa

SEQ ID NO: 842001 - RNA, 19 nt, Homo sapiens
gcagaaauacccagagaag

SEQ ID NO: 842002 - RNA, 19 nt, Homo sapiens
ggagggagaugcgccuuuc

SEQ ID NO: 842003 - RNA, 19 nt, Homo sapiens
cuccaggucuccauaaauu

SEQ ID NO: 842004 - RNA, 19 nt, Homo sapiens
gcacuaagacaaccucaag

SEQ ID NO: 842005 - RNA, 19 nt, Homo sapiens
agaacacccucgagagaaa

SEQ ID NO: 842006 - RNA, 19 nt, Homo sapiens
ggagaacagcuuuggauca

SEQ ID NO: 842007 - RNA, 19 nt, Homo sapiens
uggaggagaugauggaaga

SEQ ID NO: 842008 - RNA, 19 nt, Homo sapiens
aaaggacaaucucaaacuu

SEQ ID NO: 842009 - RNA, 19 nt, Homo sapiens
aagaaaagcucaaagaaga

SEQ ID NO: 842010 - RNA, 19 nt, Homo sapiens
cagaucaccuggaaugcuu

SEQ ID NO: 842011 - RNA, 19 nt, Homo sapiens
ucauuugucuucagaacuu

SEQ ID NO: 842012 - RNA, 19 nt, Homo sapiens
guucaaaguugcccuggau

SEQ ID NO: 842013 - RNA, 19 nt, Homo sapiens
ccaagaaacguaagcauag

SEQ ID NO: 842014 - RNA, 19 nt, Homo sapiens
ugaaagauauaccuagaac

SEQ ID NO: 842015 - RNA, 19 nt, Homo sapiens
aggcagggaugucuucaaa

SEQ ID NO: 842016 - RNA, 19 nt, Homo sapiens
ggagacugcugaaucaaaa

SEQ ID NO: 842017 - RNA, 19 nt, Homo sapiens
ggaggucgguccaggucuu

SEQ ID NO: 842018 - RNA, 19 nt, Homo sapiens
agacagagcccaucuaggu

SEQ ID NO: 842019 - RNA, 19 nt, Homo sapiens
caaccuaaagcuaaaucua

SEQ ID NO: 842020 - RNA, 19 nt, Homo sapiens
cgacguagguccagaucuc

SEQ ID NO: 842021 - RNA, 19 nt, Homo sapiens
ccaguuggcagaauuaaau

SEQ ID NO: 842022 - RNA, 19 nt, Homo sapiens
gaaguucagucuagauuua

SEQ ID NO: 842023 - RNA, 19 nt, Homo sapiens
gauaugaucuguuuaguga

SEQ ID NO: 842024 - RNA, 19 nt, Homo sapiens
cagagaagcuggauaagaa

SEQ ID NO: 842025 - RNA, 19 nt, Homo sapiens
uauaauggcuguacaggua

SEQ ID NO: 842026 - RNA, 19 nt, Homo sapiens
gcagguauguuuauuccua

SEQ ID NO: 842027 - RNA, 19 nt, Homo sapiens
ggaaaugaguccaaagaga

SEQ ID NO: 842028 - RNA, 19 nt, Homo sapiens
gaaacauugugaagacaua

SEQ ID NO: 842029 - RNA, 19 nt, Homo sapiens
ucaaggauaugaucuguuu

SEQ ID NO: 842030 - RNA, 19 nt, Homo sapiens
ggaaggauaucuguucaaa

SEQ ID NO: 842031 - RNA, 19 nt, Homo sapiens
ggaaugauguuauaaaucg

SEQ ID NO: 842032 - RNA, 19 nt, Homo sapiens
uaacguagaugcugcaaau

SEQ ID NO: 842033 - RNA, 19 nt, Homo sapiens
gaaaugaguccaaagagaa

SEQ ID NO: 842034 - RNA, 19 nt, Homo sapiens
gaacuuggacccuacauga

SEQ ID NO: 842035 - RNA, 19 nt, Homo sapiens
gcaaauaaacaguucauga

SEQ ID NO: 842036 - RNA, 19 nt, Homo sapiens
gagcauagcuguggaagca

SEQ ID NO: 842037 - RNA, 19 nt, Homo sapiens
gagaggaaauuuguggaua

SEQ ID NO: 842038 - RNA, 19 nt, Homo sapiens
cagggaugauucuaaauua

SEQ ID NO: 842039 - RNA, 19 nt, Homo sapiens
gaaaagaggcugagcauuu

SEQ ID NO: 842040 - RNA, 19 nt, Homo sapiens
ggacauauuucgugauuuu

SEQ ID NO: 842041 - RNA, 19 nt, Homo sapiens
gauaagaaaucaucuccau

SEQ ID NO: 842042 - RNA, 19 nt, Homo sapiens
uuaaagggcuauuucugua

SEQ ID NO: 842043 - RNA, 19 nt, Homo sapiens
caaauggcauccaauaauc

SEQ ID NO: 842044 - RNA, 19 nt, Homo sapiens
gauauugaauggcuuggaa

SEQ ID NO: 842045 - RNA, 19 nt, Homo sapiens
cuucuuaggugacagguua

SEQ ID NO: 842046 - RNA, 19 nt, Homo sapiens
gaaaagagguacccauuca

SEQ ID NO: 842047 - RNA, 19 nt, Homo sapiens
ccagcaagauucacagaaa

SEQ ID NO: 842048 - RNA, 19 nt, Homo sapiens
gaaggaggcauauaucaga

SEQ ID NO: 842049 - RNA, 19 nt, Homo sapiens
gagcgacgauucugcuuug

SEQ ID NO: 842050 - RNA, 19 nt, Homo sapiens
acacauagcccucgauuau

SEQ ID NO: 842051 - RNA, 19 nt, Homo sapiens
gauuaugugcuucagauua

SEQ ID NO: 842052 - RNA, 19 nt, Homo sapiens
gaggaaauuuguggauaaa

SEQ ID NO: 842053 - RNA, 19 nt, Homo sapiens
gaaauagguguguguguug

SEQ ID NO: 842054 - RNA, 19 nt, Homo sapiens
gaagaagccaccaacauuc

SEQ ID NO: 842055 - RNA, 19 nt, Homo sapiens
ggaaucagaaggacuuuau

SEQ ID NO: 842056 - RNA, 19 nt, Homo sapiens
gaccauaauucaguccuuu

SEQ ID NO: 842057 - RNA, 19 nt, Homo sapiens
uaaccuagcuuucauacac

SEQ ID NO: 842058 - RNA, 19 nt, Homo sapiens
agaggaaauuuguggauaa

SEQ ID NO: 842059 - RNA, 19 nt, Homo sapiens
caaaauauguggagaggaa

SEQ ID NO: 842060 - RNA, 19 nt, Homo sapiens
ugaagaagccaccaacauu

SEQ ID NO: 842061 - RNA, 19 nt, Homo sapiens
caggacauauuucgugauu

SEQ ID NO: 842062 - RNA, 19 nt, Homo sapiens
gcaccaugccaccgucuua

SEQ ID NO: 842063 - RNA, 19 nt, Homo sapiens
gagguggucucgccaacaa

SEQ ID NO: 842064 - RNA, 19 nt, Homo sapiens
ccaaauggcauccaauaau

SEQ ID NO: 842065 - RNA, 19 nt, Homo sapiens
uagcaagaaugaaugaaga

SEQ ID NO: 842066 - RNA, 19 nt, Homo sapiens
gaagcuggauaagaaauca

SEQ ID NO: 842067 - RNA, 19 nt, Homo sapiens
gaucagaaauccuaaaauc

SEQ ID NO: 842068 - RNA, 19 nt, Homo sapiens
gcacagcuucaguaacuuu

SEQ ID NO: 842069 - RNA, 19 nt, Homo sapiens
acacagggcagguauguuu

SEQ ID NO: 842070 - RNA, 19 nt, Homo sapiens
caaagaaacaaacaacaug

SEQ ID NO: 842071 - RNA, 19 nt, Homo sapiens
agaaauagguguguguguu

SEQ ID NO: 842072 - RNA, 19 nt, Homo sapiens
aaagagguacccauucaua

SEQ ID NO: 842073 - RNA, 19 nt, Homo sapiens
gcucuuuggugacguguga

SEQ ID NO: 842074 - RNA, 19 nt, Homo sapiens
guaaugaugcugucguuga

SEQ ID NO: 842075 - RNA, 19 nt, Homo sapiens
ugacagauguaucgaugga

SEQ ID NO: 842076 - RNA, 19 nt, Homo sapiens
caaacucagagaucaauuu

SEQ ID NO: 842077 - RNA, 19 nt, Homo sapiens
acacaauccuguugccaaa

SEQ ID NO: 842078 - RNA, 19 nt, Homo sapiens
agacaaguuugaccaaguu

SEQ ID NO: 842079 - RNA, 19 nt, Homo sapiens
gagacaaguuugaccaagu

SEQ ID NO: 842080 - RNA, 19 nt, Homo sapiens
ccagagaaacuaaaucguu

SEQ ID NO: 842081 - RNA, 19 nt, Homo sapiens
ugauauagucaccuuguua

SEQ ID NO: 842082 - RNA, 19 nt, Homo sapiens
gacgugaacugggccaauu

SEQ ID NO: 842083 - RNA, 19 nt, Homo sapiens
gguacccauucauauauuu

SEQ ID NO: 842084 - RNA, 19 nt, Homo sapiens
uauagggcgucauaugaaa

SEQ ID NO: 842085 - RNA, 19 nt, Homo sapiens
gaaggagaaaggcaagauu

SEQ ID NO: 842086 - RNA, 19 nt, Homo sapiens
aaaguucagucagaaguaa

SEQ ID NO: 842087 - RNA, 19 nt, Homo sapiens
aaucagagaagcuggauaa

SEQ ID NO: 842088 - RNA, 19 nt, Homo sapiens
guccaguacuuuaauguau

SEQ ID NO: 842089 - RNA, 19 nt, Homo sapiens
uaaaugcggucgguuauac

SEQ ID NO: 842090 - RNA, 19 nt, Homo sapiens
ucauaaaugcggucgguua

SEQ ID NO: 842091 - RNA, 19 nt, Homo sapiens
gagguacccauucauauau

SEQ ID NO: 842092 - RNA, 19 nt, Homo sapiens
gaaacaaacaacaugaagu

SEQ ID NO: 842093 - RNA, 19 nt, Homo sapiens
guuauuguccaguacuuua

SEQ ID NO: 842094 - RNA, 19 nt, Homo sapiens
aagaaugaaugaagagaug

SEQ ID NO: 842095 - RNA, 19 nt, Homo sapiens
gagaaggaggcauauauca

SEQ ID NO: 842096 - RNA, 19 nt, Homo sapiens
gacaggagaaggaggcaua

SEQ ID NO: 842097 - RNA, 19 nt, Homo sapiens
uuaugaagcuaauguggaa

SEQ ID NO: 842098 - RNA, 19 nt, Homo sapiens
guucagaccaguauugcua

SEQ ID NO: 842099 - RNA, 19 nt, Homo sapiens
acucagagaucaauuuaag

SEQ ID NO: 842100 - RNA, 19 nt, Homo sapiens
guacagguagaccauaauu

SEQ ID NO: 842101 - RNA, 19 nt, Homo sapiens
gauaggagguuagacaaaa

SEQ ID NO: 842102 - RNA, 19 nt, Homo sapiens
agagguacccauucauaua

SEQ ID NO: 842103 - RNA, 19 nt, Homo sapiens
gagcucugaugauggaaga

SEQ ID NO: 842104 - RNA, 19 nt, Homo sapiens
ggaggcaggaugaagauga

SEQ ID NO: 842105 - RNA, 19 nt, Homo sapiens
aagcaugucuucaucaagu

SEQ ID NO: 842106 - RNA, 19 nt, Homo sapiens
ucaagcaugucuucaucaa

SEQ ID NO: 842107 - RNA, 19 nt, Homo sapiens
ggagaggaaccuaguuuag

SEQ ID NO: 842108 - RNA, 19 nt, Homo sapiens
cagggcagcuuuggaagaa

SEQ ID NO: 842109 - RNA, 19 nt, Homo sapiens
aaacaaagcgacaccacuu

SEQ ID NO: 842110 - RNA, 19 nt, Homo sapiens
caaaguucagucagaagua

SEQ ID NO: 842111 - RNA, 19 nt, Homo sapiens
gcccaaaguucagucagaa

SEQ ID NO: 842112 - RNA, 19 nt, Homo sapiens
ccagggaugauucuaaauu

SEQ ID NO: 842113 - RNA, 19 nt, Homo sapiens
gaugauaggagguuagaca

SEQ ID NO: 842114 - RNA, 19 nt, Homo sapiens
cagcaagauucacagaaau

SEQ ID NO: 842115 - RNA, 19 nt, Homo sapiens
ugaaacuuaucaggacaua

SEQ ID NO: 842116 - RNA, 19 nt, Homo sapiens
ccaaucaacaugccacuga

SEQ ID NO: 842117 - RNA, 19 nt, Homo sapiens
gagcaucugcccaaaguuc

SEQ ID NO: 842118 - RNA, 19 nt, Homo sapiens
aaagagaaauggagcaaaa

SEQ ID NO: 842119 - RNA, 19 nt, Homo sapiens
auaaacaguucaugaaugg

SEQ ID NO: 842120 - RNA, 19 nt, Homo sapiens
uugauaagcuugugaaacu

SEQ ID NO: 842121 - RNA, 19 nt, Homo sapiens
gauaagcuugugaaacuug

SEQ ID NO: 842122 - RNA, 19 nt, Homo sapiens
ggaguuagcuagccagaua

SEQ ID NO: 842123 - RNA, 19 nt, Homo sapiens
gggaauagcccaaauguuu

SEQ ID NO: 842124 - RNA, 19 nt, Homo sapiens
gcaccaccgugacguauua

SEQ ID NO: 842125 - RNA, 19 nt, Homo sapiens
ggacuucagugucagauuu

SEQ ID NO: 842126 - RNA, 19 nt, Homo sapiens
ccaaugaccuuuaucacua

SEQ ID NO: 842127 - RNA, 19 nt, Homo sapiens
ccagauagauccucagaaa

SEQ ID NO: 842128 - RNA, 19 nt, Homo sapiens
gcagaaagaauacagauaa

SEQ ID NO: 842129 - RNA, 19 nt, Homo sapiens
ggacaugacuuucaagaag

SEQ ID NO: 842130 - RNA, 19 nt, Homo sapiens
ggagcuggaugaucugaua

SEQ ID NO: 842131 - RNA, 19 nt, Homo sapiens
ggacacgguuuccaauuug

SEQ ID NO: 842132 - RNA, 19 nt, Homo sapiens
gaaauugacuagccagaag

SEQ ID NO: 842133 - RNA, 19 nt, Homo sapiens
gaucaauacuccaacaaau

SEQ ID NO: 842134 - RNA, 19 nt, Homo sapiens
gaacaacguaucagauuga

SEQ ID NO: 842135 - RNA, 19 nt, Homo sapiens
caaacaccuucaaaugaua

SEQ ID NO: 842136 - RNA, 19 nt, Homo sapiens
gaggauccuuucaauauug

SEQ ID NO: 842137 - RNA, 19 nt, Homo sapiens
aaaggaagcagaaagaaua

SEQ ID NO: 842138 - RNA, 19 nt, Homo sapiens
gaaguggaccauagaguaa

SEQ ID NO: 842139 - RNA, 19 nt, Homo sapiens
caaguauguugcaagaaua

SEQ ID NO: 842140 - RNA, 19 nt, Homo sapiens
ccaaacaccuucaaaugau

SEQ ID NO: 842141 - RNA, 19 nt, Homo sapiens
gaacuuugcacaagcguuu

SEQ ID NO: 842142 - RNA, 19 nt, Homo sapiens
ggagacauguccucauuca

SEQ ID NO: 842143 - RNA, 19 nt, Homo sapiens
caaauaugaugucugaugu

SEQ ID NO: 842144 - RNA, 19 nt, Homo sapiens
gaggcaccauugucacuua

SEQ ID NO: 842145 - RNA, 19 nt, Homo sapiens
gaacuuagagacuucauca

SEQ ID NO: 842146 - RNA, 19 nt, Homo sapiens
agacauguccucauucaua

SEQ ID NO: 842147 - RNA, 19 nt, Homo sapiens
gcggagacauguccucauu

SEQ ID NO: 842148 - RNA, 19 nt, Homo sapiens
gcaccauugucacuuauug

SEQ ID NO: 842149 - RNA, 19 nt, Homo sapiens
caucaaaccauaccaauau

SEQ ID NO: 842150 - RNA, 19 nt, Homo sapiens
caacguaucagauugagaa

SEQ ID NO: 842151 - RNA, 19 nt, Homo sapiens
gcaagaauacuccaaauac

SEQ ID NO: 842152 - RNA, 19 nt, Homo sapiens
ggucagauaaguaguaauu

SEQ ID NO: 842153 - RNA, 19 nt, Homo sapiens
ggaaauacaaguucuucaa

SEQ ID NO: 842154 - RNA, 19 nt, Homo sapiens
ucaacaggcuuucagauuc

SEQ ID NO: 842155 - RNA, 19 nt, Homo sapiens
gaaaggaagcagaaagaau

SEQ ID NO: 842156 - RNA, 19 nt, Homo sapiens
guaagugagccauguagua

SEQ ID NO: 842157 - RNA, 19 nt, Homo sapiens
caaacaaggucagauaagu

SEQ ID NO: 842158 - RNA, 19 nt, Homo sapiens
caaugaccuuuaucacuaa

SEQ ID NO: 842159 - RNA, 19 nt, Homo sapiens
cagaagaacuuagagacuu

SEQ ID NO: 842160 - RNA, 19 nt, Homo sapiens
agaauugguucaagaagaa

SEQ ID NO: 842161 - RNA, 19 nt, Homo sapiens
cagaauugguucaagaaga

SEQ ID NO: 842162 - RNA, 19 nt, Homo sapiens
ggagaacacucagaauugg

SEQ ID NO: 842163 - RNA, 19 nt, Homo sapiens
gauuccaucucaggaguua

SEQ ID NO: 842164 - RNA, 19 nt, Homo sapiens
guggugaagucauaguuaa

SEQ ID NO: 842165 - RNA, 19 nt, Homo sapiens
aaacaaggucagauaagua

SEQ ID NO: 842166 - RNA, 19 nt, Homo sapiens
uaugaugucugauguaagu

SEQ ID NO: 842167 - RNA, 19 nt, Homo sapiens
gcguuugguucucaguuua

SEQ ID NO: 842168 - RNA, 19 nt, Homo sapiens
gaucucagccaggucuuua

SEQ ID NO: 842169 - RNA, 19 nt, Homo sapiens
ugagaacacugccauugga

SEQ ID NO: 842170 - RNA, 19 nt, Homo sapiens
gaggucuucuaauguaauu

SEQ ID NO: 842171 - RNA, 19 nt, Homo sapiens
aagaggauccuuucaauau

SEQ ID NO: 842172 - RNA, 19 nt, Homo sapiens
uagaugaacugcagaagag

SEQ ID NO: 842173 - RNA, 19 nt, Homo sapiens
cacauguggugaagucaua

SEQ ID NO: 842174 - RNA, 19 nt, Homo sapiens
gcuguucgcuggagcugaa

SEQ ID NO: 842175 - RNA, 19 nt, Homo sapiens
cguaucagauugagaacuu

SEQ ID NO: 842176 - RNA, 19 nt, Homo sapiens
gcucuaaaugcugaaauua

SEQ ID NO: 842177 - RNA, 19 nt, Homo sapiens
gaggacacauaguggagaa

SEQ ID NO: 842178 - RNA, 19 nt, Homo sapiens
cuggaggucuucuaaugua

SEQ ID NO: 842179 - RNA, 19 nt, Homo sapiens
caaggucagauaaguagua

SEQ ID NO: 842180 - RNA, 19 nt, Homo sapiens
uaacuuugugucaccauua

SEQ ID NO: 842181 - RNA, 19 nt, Homo sapiens
gaaauacaaguucuucaag

SEQ ID NO: 842182 - RNA, 19 nt, Homo sapiens
gaaguaccauauggagaga

SEQ ID NO: 842183 - RNA, 19 nt, Homo sapiens
caaagcaggacacuaaugu

SEQ ID NO: 842184 - RNA, 19 nt, Homo sapiens
ucagauuucucaggguaua

SEQ ID NO: 842185 - RNA, 19 nt, Homo sapiens
ggacugauagauuguugaa

SEQ ID NO: 842186 - RNA, 19 nt, Homo sapiens
ucagccaggucuuuauuug

SEQ ID NO: 842187 - RNA, 19 nt, Homo sapiens
agaaauccuugucuggaaa

SEQ ID NO: 842188 - RNA, 19 nt, Homo sapiens
gaaccugggucaucaaacc

SEQ ID NO: 842189 - RNA, 19 nt, Homo sapiens
gaaauaccuacuacagaga

SEQ ID NO: 842190 - RNA, 19 nt, Homo sapiens
gauuuuagcucuguuugua

SEQ ID NO: 842191 - RNA, 19 nt, Homo sapiens
agauagauccucagaaaga

SEQ ID NO: 842192 - RNA, 19 nt, Homo sapiens
caggagaacacucagaauu

SEQ ID NO: 842193 - RNA, 19 nt, Homo sapiens
agaggauccuuucaauauu

SEQ ID NO: 842194 - RNA, 19 nt, Homo sapiens
caaaucagaaagccagaaa

SEQ ID NO: 842195 - RNA, 19 nt, Homo sapiens
gaugagguuuuacaaagua

SEQ ID NO: 842196 - RNA, 19 nt, Homo sapiens
gaauagaugaacugcagaa

SEQ ID NO: 842197 - RNA, 19 nt, Homo sapiens
gcgcacauguggugaaguc

SEQ ID NO: 842198 - RNA, 19 nt, Homo sapiens
gagaagccauuuggaugug

SEQ ID NO: 842199 - RNA, 19 nt, Homo sapiens
ggccaaagccagaaucuca

SEQ ID NO: 842200 - RNA, 19 nt, Homo sapiens
gcacugaggagccaaagca

SEQ ID NO: 842201 - RNA, 19 nt, Homo sapiens
ggcuggaggucuucuaaug

SEQ ID NO: 842202 - RNA, 19 nt, Homo sapiens
gaccauagaguaaggacuu

SEQ ID NO: 842203 - RNA, 19 nt, Homo sapiens
agaaguggaccauagagua

SEQ ID NO: 842204 - RNA, 19 nt, Homo sapiens
caucagcaguugacaccuu

SEQ ID NO: 842205 - RNA, 19 nt, Homo sapiens
ugauaaagcaaguauguug

SEQ ID NO: 842206 - RNA, 19 nt, Homo sapiens
ggaucaauacuccaacaaa

SEQ ID NO: 842207 - RNA, 19 nt, Homo sapiens
caacagugccuuuucuaua

SEQ ID NO: 842208 - RNA, 19 nt, Homo sapiens
aguaaggacuucaguguca

SEQ ID NO: 842209 - RNA, 19 nt, Homo sapiens
agaacaacguaucagauug

SEQ ID NO: 842210 - RNA, 19 nt, Homo sapiens
uagaacaacguaucagauu

SEQ ID NO: 842211 - RNA, 19 nt, Homo sapiens
agacauaguaggacagaaa

SEQ ID NO: 842212 - RNA, 19 nt, Homo sapiens
gagaaaagccauauaagug

SEQ ID NO: 842213 - RNA, 19 nt, Homo sapiens
gaaucaaagccaagaggaa

SEQ ID NO: 842214 - RNA, 19 nt, Homo sapiens
ugacaauguuuagcaauca

SEQ ID NO: 842215 - RNA, 19 nt, Homo sapiens
guccucaucucagaaauug

SEQ ID NO: 842216 - RNA, 19 nt, Homo sapiens
cccaaacaccuucaaauga

SEQ ID NO: 842217 - RNA, 19 nt, Homo sapiens
ucaauacuccaacaaauca

SEQ ID NO: 842218 - RNA, 19 nt, Homo sapiens
gcacuggaauagaugaacu

SEQ ID NO: 842219 - RNA, 19 nt, Homo sapiens
cauaauuggcacuggaaua

SEQ ID NO: 842220 - RNA, 19 nt, Homo sapiens
gaauagcccaaauguuuua

SEQ ID NO: 842221 - RNA, 19 nt, Homo sapiens
aaacuuagagucuucaaca

SEQ ID NO: 842222 - RNA, 19 nt, Homo sapiens
gaauugucuuccaguauua

SEQ ID NO: 842223 - RNA, 19 nt, Homo sapiens
gcucauggcuucugacuuc

SEQ ID NO: 842224 - RNA, 19 nt, Homo sapiens
ccaaaucacucuauacauc

SEQ ID NO: 842225 - RNA, 19 nt, Homo sapiens
cgaauugucuuccaguauu

SEQ ID NO: 842226 - RNA, 19 nt, Homo sapiens
gcacagaguggcaaacaaa

SEQ ID NO: 842227 - RNA, 19 nt, Homo sapiens
cauuggaggugcccuauaa

SEQ ID NO: 842228 - RNA, 19 nt, Homo sapiens
aaacaaacaugguggcaau

SEQ ID NO: 842229 - RNA, 19 nt, Homo sapiens
gaaaguuuacaaugcagua

SEQ ID NO: 842230 - RNA, 19 nt, Homo sapiens
gauggguguugcucccuua

SEQ ID NO: 842231 - RNA, 19 nt, Homo sapiens
ucaaccggcucaagaagaa

SEQ ID NO: 842232 - RNA, 19 nt, Homo sapiens
ggaccuaucugaacuaccu

SEQ ID NO: 842233 - RNA, 19 nt, Homo sapiens
gagggagugugaagugguu

SEQ ID NO: 842234 - RNA, 19 nt, Homo sapiens
gcccuguccuguccuguuu

SEQ ID NO: 842235 - RNA, 19 nt, Homo sapiens
cucuaaguguguuguauua

SEQ ID NO: 842236 - RNA, 19 nt, Homo sapiens
gguggcaauucuacacaaa

SEQ ID NO: 842237 - RNA, 19 nt, Homo sapiens
gaccuugccucgaauuguc

SEQ ID NO: 842238 - RNA, 19 nt, Homo sapiens
ggcgaagccucaaugacaa

SEQ ID NO: 842239 - RNA, 19 nt, Homo sapiens
cuauaaaccagaagagaaa

SEQ ID NO: 842240 - RNA, 19 nt, Homo sapiens
aaacaugguggcaauucua

SEQ ID NO: 842241 - RNA, 19 nt, Homo sapiens
caaacaugguggcaauucu

SEQ ID NO: 842242 - RNA, 19 nt, Homo sapiens
cagggccacuguugacuug

SEQ ID NO: 842243 - RNA, 19 nt, Homo sapiens
ccugaaaguuuacaaugca

SEQ ID NO: 842244 - RNA, 19 nt, Homo sapiens
ccuauaaaccagaagagaa

SEQ ID NO: 842245 - RNA, 19 nt, Homo sapiens
ggaggugcccuauaaacca

SEQ ID NO: 842246 - RNA, 19 nt, Homo sapiens
acagugacuuccuccagaa

SEQ ID NO: 842247 - RNA, 19 nt, Homo sapiens
aaacccugcucccacuuug

SEQ ID NO: 842248 - RNA, 19 nt, Homo sapiens
caaacccugcucccacuuu

SEQ ID NO: 842249 - RNA, 19 nt, Homo sapiens
cauggcuucugacuucuga

SEQ ID NO: 842250 - RNA, 19 nt, Homo sapiens
gcugggaccuaucugaacu

SEQ ID NO: 842251 - RNA, 19 nt, Homo sapiens
cuucugaccuucuccucuu

SEQ ID NO: 842252 - RNA, 19 nt, Homo sapiens
gcauuggaggugcccuaua

SEQ ID NO: 842253 - RNA, 19 nt, Homo sapiens
ucaacgagccagacuucaa

SEQ ID NO: 842254 - RNA, 19 nt, Homo sapiens
guauuacggugccucuucu

SEQ ID NO: 842255 - RNA, 19 nt, Homo sapiens
uggcgaagccucaaugaca

SEQ ID NO: 842256 - RNA, 19 nt, Homo sapiens
gggccacuguugacuugga

SEQ ID NO: 842257 - RNA, 19 nt, Homo sapiens
gaagagaaaauacugaaag

SEQ ID NO: 842258 - RNA, 19 nt, Homo sapiens
ugugagagccagcccugua

SEQ ID NO: 842259 - RNA, 19 nt, Homo sapiens
gcgaagccucaaugacaaa

SEQ ID NO: 842260 - RNA, 19 nt, Homo sapiens
ggaccuugccucgaauugu

SEQ ID NO: 842261 - RNA, 19 nt, Homo sapiens
gcuucugacuucugaccuu

SEQ ID NO: 842262 - RNA, 19 nt, Homo sapiens
gacucuaaguguguuguau

SEQ ID NO: 842263 - RNA, 19 nt, Homo sapiens
caaagcacagaguggcaaa

SEQ ID NO: 842264 - RNA, 19 nt, Homo sapiens
caacgagccagacuucaac

SEQ ID NO: 842265 - RNA, 19 nt, Homo sapiens
caccacacaugccuuucug

SEQ ID NO: 842266 - RNA, 19 nt, Homo sapiens
gugagccucuggcccuuuc

SEQ ID NO: 842267 - RNA, 19 nt, Homo sapiens
aaagagaugagauuaacag

SEQ ID NO: 842268 - RNA, 19 nt, Homo sapiens
uagccacaccacaggauuu

SEQ ID NO: 842269 - RNA, 19 nt, Homo sapiens
cacccacucaugacucuaa

SEQ ID NO: 842270 - RNA, 19 nt, Homo sapiens
gcagugccagcucucaauc

SEQ ID NO: 842271 - RNA, 19 nt, Homo sapiens
aucaggaccuugccucgaa

SEQ ID NO: 842272 - RNA, 19 nt, Homo sapiens
ccaauucaggaaacaaaca

SEQ ID NO: 842273 - RNA, 19 nt, Homo sapiens
gacuucaaccggcucaaga

SEQ ID NO: 842274 - RNA, 19 nt, Homo sapiens
auacauccaauucaggaaa

SEQ ID NO: 842275 - RNA, 19 nt, Homo sapiens
gugagagccagcccuguau

SEQ ID NO: 842276 - RNA, 19 nt, Homo sapiens
ggacuucaaccggcucaag

SEQ ID NO: 842277 - RNA, 19 nt, Homo sapiens
caccaccacacaugccuuu

SEQ ID NO: 842278 - RNA, 19 nt, Homo sapiens
cauggccuccugcuucuug

SEQ ID NO: 842279 - RNA, 19 nt, Homo sapiens
ggagaacucuacauucaua

SEQ ID NO: 842280 - RNA, 19 nt, Homo sapiens
gaaggaagguucaguuguu

SEQ ID NO: 842281 - RNA, 19 nt, Homo sapiens
gaagaucccaacucuauua

SEQ ID NO: 842282 - RNA, 19 nt, Homo sapiens
gaugaaagaugguaaagug

SEQ ID NO: 842283 - RNA, 19 nt, Homo sapiens
ggaaggcacuuacucaaug

SEQ ID NO: 842284 - RNA, 19 nt, Homo sapiens
caggaacgcugauuaguuu

SEQ ID NO: 842285 - RNA, 19 nt, Homo sapiens
uagcaaagcucuuggagaa

SEQ ID NO: 842286 - RNA, 19 nt, Homo sapiens
gaucccaacucuauuauug

SEQ ID NO: 842287 - RNA, 19 nt, Homo sapiens
gaaagaugguaaagugauu

SEQ ID NO: 842288 - RNA, 19 nt, Homo sapiens
gaacuguagugaugaaaga

SEQ ID NO: 842289 - RNA, 19 nt, Homo sapiens
gggcgaagcuuccaaguuc

SEQ ID NO: 842290 - RNA, 19 nt, Homo sapiens
caaagcaggugauuguuau

SEQ ID NO: 842291 - RNA, 19 nt, Homo sapiens
caaaagagauguccaaaga

SEQ ID NO: 842292 - RNA, 19 nt, Homo sapiens
caacauggcaaaccuauug

SEQ ID NO: 842293 - RNA, 19 nt, Homo sapiens
caucgugggugcacucaua

SEQ ID NO: 842294 - RNA, 19 nt, Homo sapiens
caggagaacucuacauuca

SEQ ID NO: 842295 - RNA, 19 nt, Homo sapiens
ggaacaggcaaauaaagua

SEQ ID NO: 842296 - RNA, 19 nt, Homo sapiens
uaagggaauuacucacaua

SEQ ID NO: 842297 - RNA, 19 nt, Homo sapiens
gaaacucuuugcucaacaa

SEQ ID NO: 842298 - RNA, 19 nt, Homo sapiens
cuacagugguuauaacauu

SEQ ID NO: 842299 - RNA, 19 nt, Homo sapiens
ggaaauuucuggcacacau

SEQ ID NO: 842300 - RNA, 19 nt, Homo sapiens
gacccaagcuuuacuacug

SEQ ID NO: 842301 - RNA, 19 nt, Homo sapiens
ucacagggauacuggguuu

SEQ ID NO: 842302 - RNA, 19 nt, Homo sapiens
uagaggaacuguagugaug

SEQ ID NO: 842303 - RNA, 19 nt, Homo sapiens
caagaacugugguguaaag

SEQ ID NO: 842304 - RNA, 19 nt, Homo sapiens
gaacaggcaaauaaaguau

SEQ ID NO: 842305 - RNA, 19 nt, Homo sapiens
uggaugagaucaaccauga

SEQ ID NO: 842306 - RNA, 19 nt, Homo sapiens
ucaaagcaggugauuguua

SEQ ID NO: 842307 - RNA, 19 nt, Homo sapiens
ggaaauggaugagaucaac

SEQ ID NO: 842308 - RNA, 19 nt, Homo sapiens
cagcuaagauucugauagu

SEQ ID NO: 842309 - RNA, 19 nt, Homo sapiens
ucaugaagcugaccuuuua

SEQ ID NO: 842310 - RNA, 19 nt, Homo sapiens
guucucagaugaucacuau

SEQ ID NO: 842311 - RNA, 19 nt, Homo sapiens
aaccaggaauuccauauaa

SEQ ID NO: 842312 - RNA, 19 nt, Homo sapiens
ucaagaagaucccaacucu

SEQ ID NO: 842313 - RNA, 19 nt, Homo sapiens
caacauugcagguggcuuu

SEQ ID NO: 842314 - RNA, 19 nt, Homo sapiens
cauauccucugucaacauu

SEQ ID NO: 842315 - RNA, 19 nt, Homo sapiens
ccaaagagauauuccaaaa

SEQ ID NO: 842316 - RNA, 19 nt, Homo sapiens
uuauaaggcuguuguccua

SEQ ID NO: 842317 - RNA, 19 nt, Homo sapiens
guucaguuguuguggauuu

SEQ ID NO: 842318 - RNA, 19 nt, Homo sapiens
aaagagauguccaaagagu

SEQ ID NO: 842319 - RNA, 19 nt, Homo sapiens
gcaaagcucuuggagaaaa

SEQ ID NO: 842320 - RNA, 19 nt, Homo sapiens
gagcuaaugacacuguuaa

SEQ ID NO: 842321 - RNA, 19 nt, Homo sapiens
cauaugacauuguguugga

SEQ ID NO: 842322 - RNA, 19 nt, Homo sapiens
gcacacauacggaaaucaa

SEQ ID NO: 842323 - RNA, 19 nt, Homo sapiens
uugcauagcugaguacauu

SEQ ID NO: 842324 - RNA, 19 nt, Homo sapiens
gccaaacgcauccagauuu

SEQ ID NO: 842325 - RNA, 19 nt, Homo sapiens
gcucuccacucaccacuga

SEQ ID NO: 842326 - RNA, 19 nt, Homo sapiens
gcuaagauucugauaguug

SEQ ID NO: 842327 - RNA, 19 nt, Homo sapiens
gagaauccuaucagaagua

SEQ ID NO: 842328 - RNA, 19 nt, Homo sapiens
gcauucauauccucuguca

SEQ ID NO: 842329 - RNA, 19 nt, Homo sapiens
ggacaaggaggauaugcaa

SEQ ID NO: 842330 - RNA, 19 nt, Homo sapiens
aauccagaguugcuaaaua

SEQ ID NO: 842331 - RNA, 19 nt, Homo sapiens
gaaauuucuggcacacaua

SEQ ID NO: 842332 - RNA, 19 nt, Homo sapiens
gaggaacuguagugaugaa

SEQ ID NO: 842333 - RNA, 19 nt, Homo sapiens
gagguggacuugaaggaau

SEQ ID NO: 842334 - RNA, 19 nt, Homo sapiens
gcaguaaucccucaauuuu

SEQ ID NO: 842335 - RNA, 19 nt, Homo sapiens
ccaaacgcauccagauuuc

SEQ ID NO: 842336 - RNA, 19 nt, Homo sapiens
agagaaugcuggacauguu

SEQ ID NO: 842337 - RNA, 19 nt, Homo sapiens
gucaacggcuucugcauau

SEQ ID NO: 842338 - RNA, 19 nt, Homo sapiens
aagaagaucccaacucuau

SEQ ID NO: 842339 - RNA, 19 nt, Homo sapiens
gacaguggcugagcuggaa

SEQ ID NO: 842340 - RNA, 19 nt, Homo sapiens
cuaaugacacuguuaauuc

SEQ ID NO: 842341 - RNA, 19 nt, Homo sapiens
gcuaaugacacuguuaauu

SEQ ID NO: 842342 - RNA, 19 nt, Homo sapiens
ugguaaagaugcucacuga

SEQ ID NO: 842343 - RNA, 19 nt, Homo sapiens
gauaguugguggugguguu

SEQ ID NO: 842344 - RNA, 19 nt, Homo sapiens
auccagaguugcuaaauaa

SEQ ID NO: 842345 - RNA, 19 nt, Homo sapiens
aaagucagguuuggaauuc

SEQ ID NO: 842346 - RNA, 19 nt, Homo sapiens
gaugggaggacauuuguau

SEQ ID NO: 842347 - RNA, 19 nt, Homo sapiens
guuagagaauccuaucaga

SEQ ID NO: 842348 - RNA, 19 nt, Homo sapiens
caaagucgaugggugcaau

SEQ ID NO: 842349 - RNA, 19 nt, Homo sapiens
cuacaguucugacaaugga

SEQ ID NO: 842350 - RNA, 19 nt, Homo sapiens
ggucaugucauuagaggaa

SEQ ID NO: 842351 - RNA, 19 nt, Homo sapiens
gaaaaguuccuccagcuaa

SEQ ID NO: 842352 - RNA, 19 nt, Homo sapiens
gcaggugauuguuaugaag

SEQ ID NO: 842353 - RNA, 19 nt, Homo sapiens
uacgaugggucaugucauu

SEQ ID NO: 842354 - RNA, 19 nt, Homo sapiens
aaaccaggaauuccauaua

SEQ ID NO: 842355 - RNA, 19 nt, Homo sapiens
uggccuaccucggcacuua

SEQ ID NO: 842356 - RNA, 19 nt, Homo sapiens
gauacuggguuugggcauu

SEQ ID NO: 842357 - RNA, 19 nt, Homo sapiens
ccaacaacaucaccaaacu

SEQ ID NO: 842358 - RNA, 19 nt, Homo sapiens
uggccaacauugcggguua

SEQ ID NO: 842359 - RNA, 19 nt, Homo sapiens
gaagacugaagaaagcaaa

SEQ ID NO: 842360 - RNA, 19 nt, Homo sapiens
gaaaguuagagaauccuau

SEQ ID NO: 842361 - RNA, 19 nt, Homo sapiens
gcuauccugucauacauca

SEQ ID NO: 842362 - RNA, 19 nt, Homo sapiens
ggagguagacauccuuauc

SEQ ID NO: 842363 - RNA, 19 nt, Homo sapiens
caacauugcggguuauaag

SEQ ID NO: 842364 - RNA, 19 nt, Homo sapiens
ggagcuaaugacacuguua

SEQ ID NO: 842365 - RNA, 19 nt, Homo sapiens
ccgaaugccuggucagcuu

SEQ ID NO: 842366 - RNA, 19 nt, Homo sapiens
ucaauuaguugcugcuuuu

SEQ ID NO: 842367 - RNA, 19 nt, Homo sapiens
gaugggucaugucauuaga

SEQ ID NO: 842368 - RNA, 19 nt, Homo sapiens
gagguagacauccuuauca

SEQ ID NO: 842369 - RNA, 19 nt, Homo sapiens
cacaauugcucagggauau

SEQ ID NO: 842370 - RNA, 19 nt, Homo sapiens
uuaauucgcagcucaagaa

SEQ ID NO: 842371 - RNA, 19 nt, Homo sapiens
ggaaaacccauggaaauuu

SEQ ID NO: 842372 - RNA, 19 nt, Homo sapiens
gcacugaugggaggacauu

SEQ ID NO: 842373 - RNA, 19 nt, Homo sapiens
cagcacuuauuccagguaa

SEQ ID NO: 842374 - RNA, 19 nt, Homo sapiens
agaauccuaucagaaguaa

SEQ ID NO: 842375 - RNA, 19 nt, Homo sapiens
gaaggcacuuacucaaugc

SEQ ID NO: 842376 - RNA, 19 nt, Homo sapiens
gaaacuuugaaaccacuaa

SEQ ID NO: 842377 - RNA, 19 nt, Homo sapiens
aagcaguaaucccucaauu

SEQ ID NO: 842378 - RNA, 19 nt, Homo sapiens
gcauagcugaguacauuau

SEQ ID NO: 842379 - RNA, 19 nt, Homo sapiens
ggaacuagaugcauaaauu

SEQ ID NO: 842380 - RNA, 19 nt, Homo sapiens
gcacugacuuuauaucuuu

SEQ ID NO: 842381 - RNA, 19 nt, Homo sapiens
uaacugcacugacuuuaua

SEQ ID NO: 842382 - RNA, 19 nt, Homo sapiens
guaaugggcugaucaaaug

SEQ ID NO: 842383 - RNA, 19 nt, Homo sapiens
gguauuugcuggcgaguua

SEQ ID NO: 842384 - RNA, 19 nt, Homo sapiens
cauuauaccucuucugaua

SEQ ID NO: 842385 - RNA, 19 nt, Homo sapiens
ugaccaaucuguacuaauu

SEQ ID NO: 842386 - RNA, 19 nt, Homo sapiens
gcaguuguauugccuguuu

SEQ ID NO: 842387 - RNA, 19 nt, Homo sapiens
ggacagaacuuacacuacu

SEQ ID NO: 842388 - RNA, 19 nt, Homo sapiens
guuaauaguugcuuuguug

SEQ ID NO: 842389 - RNA, 19 nt, Homo sapiens
guuuagaacucucugauuu

SEQ ID NO: 842390 - RNA, 19 nt, Homo sapiens
gguagaaacucauguaucu

SEQ ID NO: 842391 - RNA, 19 nt, Homo sapiens
gcaaauaaauaagguagug

SEQ ID NO: 842392 - RNA, 19 nt, Homo sapiens
gaggaaccauuuauguauu

SEQ ID NO: 842393 - RNA, 19 nt, Homo sapiens
gugcugauauugccuguuu

SEQ ID NO: 842394 - RNA, 19 nt, Homo sapiens
ugauuaaucucucuuguug

SEQ ID NO: 842395 - RNA, 19 nt, Homo sapiens
uaaggugguugaacucuuu

SEQ ID NO: 842396 - RNA, 19 nt, Homo sapiens
ccaaaccacuaauauguau

SEQ ID NO: 842397 - RNA, 19 nt, Homo sapiens
gaaggacucugaauagacu

SEQ ID NO: 842398 - RNA, 19 nt, Homo sapiens
gaaauaccuuuaccgaagu

SEQ ID NO: 842399 - RNA, 19 nt, Homo sapiens
ggaggaaccauuuauguau

SEQ ID NO: 842400 - RNA, 19 nt, Homo sapiens
cauuuaaggucuacucaaa

SEQ ID NO: 842401 - RNA, 19 nt, Homo sapiens
uuacugauguggcuuuaaa

SEQ ID NO: 842402 - RNA, 19 nt, Homo sapiens
gaauagacuuggccaacug

SEQ ID NO: 842403 - RNA, 19 nt, Homo sapiens
ggagcaagcagucaacauu

SEQ ID NO: 842404 - RNA, 19 nt, Homo sapiens
uaaaggcuguguucuggaa

SEQ ID NO: 842405 - RNA, 19 nt, Homo sapiens
gaucaaugcgguucaagaa

SEQ ID NO: 842406 - RNA, 19 nt, Homo sapiens
cagcauggauuuauggaau

SEQ ID NO: 842407 - RNA, 19 nt, Homo sapiens
gaacuagaugcauaaauuc

SEQ ID NO: 842408 - RNA, 19 nt, Homo sapiens
cacaaacgaacaaacauua

SEQ ID NO: 842409 - RNA, 19 nt, Homo sapiens
ccucacagcaaauaaauaa

SEQ ID NO: 842410 - RNA, 19 nt, Homo sapiens
gcuaugaacaugcugcuaa

SEQ ID NO: 842411 - RNA, 19 nt, Homo sapiens
gcagucaacauuccacaaa

SEQ ID NO: 842412 - RNA, 19 nt, Homo sapiens
ggugagagcuaaacauugc

SEQ ID NO: 842413 - RNA, 19 nt, Homo sapiens
caaaugaucaguggaauuc

SEQ ID NO: 842414 - RNA, 19 nt, Homo sapiens
ggagugagaaacagaagaa

SEQ ID NO: 842415 - RNA, 19 nt, Homo sapiens
ucaguggaauucuugguuu

SEQ ID NO: 842416 - RNA, 19 nt, Homo sapiens
ucaaugcgguucaagaauc

SEQ ID NO: 842417 - RNA, 19 nt, Homo sapiens
acagugagcaguuguauug

SEQ ID NO: 842418 - RNA, 19 nt, Homo sapiens
gcuggaaacuccugaagag

SEQ ID NO: 842419 - RNA, 19 nt, Homo sapiens
ucucauaugcguugguuua

SEQ ID NO: 842420 - RNA, 19 nt, Homo sapiens
aaagauaacagcauggauu

SEQ ID NO: 842421 - RNA, 19 nt, Homo sapiens
ucaguggagugauauuuau

SEQ ID NO: 842422 - RNA, 19 nt, Homo sapiens
ugaauucagugcugcuuug

SEQ ID NO: 842423 - RNA, 19 nt, Homo sapiens
gcaagguacccagugauaa

SEQ ID NO: 842424 - RNA, 19 nt, Homo sapiens
ggaaacuccugaagagcau

SEQ ID NO: 842425 - RNA, 19 nt, Homo sapiens
gccaacugauguuuacaaa

SEQ ID NO: 842426 - RNA, 19 nt, Homo sapiens
ccaaaccaguauuauuuca

SEQ ID NO: 842427 - RNA, 19 nt, Homo sapiens
cagaagaagugguauuugc

SEQ ID NO: 842428 - RNA, 19 nt, Homo sapiens
agaaacagaagaaguggua

SEQ ID NO: 842429 - RNA, 19 nt, Homo sapiens
ggaauucuugguuugauga

SEQ ID NO: 842430 - RNA, 19 nt, Homo sapiens
guggagugauauuuaugua

SEQ ID NO: 842431 - RNA, 19 nt, Homo sapiens
acacacgcauuccucauug

SEQ ID NO: 842432 - RNA, 19 nt, Homo sapiens
ccacaaacgaacaaacauu

SEQ ID NO: 842433 - RNA, 19 nt, Homo sapiens
ugaacaugcugcuaacugu

SEQ ID NO: 842434 - RNA, 19 nt, Homo sapiens
gguccucauucauguugua

SEQ ID NO: 842435 - RNA, 19 nt, Homo sapiens
gacagaacuuacacuacuu

SEQ ID NO: 842436 - RNA, 19 nt, Homo sapiens
ggcaagguacccagugaua

SEQ ID NO: 842437 - RNA, 19 nt, Homo sapiens
uagaucgggugcugauauu

SEQ ID NO: 842438 - RNA, 19 nt, Homo sapiens
aagcauuguuugacaggua

SEQ ID NO: 842439 - RNA, 19 nt, Homo sapiens
gccaaccucuuacucugaa

SEQ ID NO: 842440 - RNA, 19 nt, Homo sapiens
uaaagaaucauggacagaa

SEQ ID NO: 842441 - RNA, 19 nt, Homo sapiens
cuccaaaccaguauuauuu

SEQ ID NO: 842442 - RNA, 19 nt, Homo sapiens
cauaugcguugguuuaucu

SEQ ID NO: 842443 - RNA, 19 nt, Homo sapiens
cuuugcaucuucucauaua

SEQ ID NO: 842444 - RNA, 19 nt, Homo sapiens
cugaagagcauuauguauu

SEQ ID NO: 842445 - RNA, 19 nt, Homo sapiens
ccucauucauguuguaaau

SEQ ID NO: 842446 - RNA, 19 nt, Homo sapiens
ucaugaaggacucugaaua

SEQ ID NO: 842447 - RNA, 19 nt, Homo sapiens
gcagcuggaggaaccauuu

SEQ ID NO: 842448 - RNA, 19 nt, Homo sapiens
cuucauugcugcuucuuau

SEQ ID NO: 842449 - RNA, 19 nt, Homo sapiens
gaagagcauuauguauuac

SEQ ID NO: 842450 - RNA, 19 nt, Homo sapiens
cuaauucuccaaaccagua

SEQ ID NO: 842451 - RNA, 19 nt, Homo sapiens
guuguuacuuggauuuguu

SEQ ID NO: 842452 - RNA, 19 nt, Homo sapiens
ucugaugacugcugggaaa

SEQ ID NO: 842453 - RNA, 19 nt, Homo sapiens
cauguuucaucuuggcaua

SEQ ID NO: 842454 - RNA, 19 nt, Homo sapiens
gcuccaugguuaaaucuuc

SEQ ID NO: 842455 - RNA, 19 nt, Homo sapiens
guccaaaccacuaauaugu

SEQ ID NO: 842456 - RNA, 19 nt, Homo sapiens
ccaucgagcuccagccaau

SEQ ID NO: 842457 - RNA, 19 nt, Homo sapiens
agaaacucauguaucugua

SEQ ID NO: 842458 - RNA, 19 nt, Homo sapiens
ugacaguauuguugugaug

SEQ ID NO: 842459 - RNA, 19 nt, Homo sapiens
gagcaagcagucaacauuc

SEQ ID NO: 842460 - RNA, 19 nt, Homo sapiens
caauaacaaaccuuccuuu

SEQ ID NO: 842461 - RNA, 19 nt, Homo sapiens
gcaauaacaaaccuuccuu

SEQ ID NO: 842462 - RNA, 19 nt, Homo sapiens
caugaaggacucugaauag

SEQ ID NO: 842463 - RNA, 19 nt, Homo sapiens
aauauaaggugguugaacu

SEQ ID NO: 842464 - RNA, 19 nt, Homo sapiens
gcaugauucugaacaucug

SEQ ID NO: 842465 - RNA, 19 nt, Homo sapiens
ucauguaucuguaguccau

SEQ ID NO: 842466 - RNA, 19 nt, Homo sapiens
gugcauuacuacgccauuu

SEQ ID NO: 842467 - RNA, 19 nt, Homo sapiens
aaauugugcuguauacuac

SEQ ID NO: 842468 - RNA, 19 nt, Homo sapiens
gaggaucaaugcgguucaa

SEQ ID NO: 842469 - RNA, 19 nt, Homo sapiens
gaaaguauaaaggcugugu

SEQ ID NO: 842470 - RNA, 19 nt, Homo sapiens
acuccuaucugcaugauuc

SEQ ID NO: 842471 - RNA, 19 nt, Homo sapiens
aaacagaagaagugguauu

SEQ ID NO: 842472 - RNA, 19 nt, Homo sapiens
ucuauuacuuucccauuca

SEQ ID NO: 842473 - RNA, 19 nt, Homo sapiens
guauaaaggcuguguucug

SEQ ID NO: 842474 - RNA, 19 nt, Homo sapiens
ugacaucaaugaacaacac

SEQ ID NO: 842475 - RNA, 19 nt, Homo sapiens
guggugacaucaaugaaca

SEQ ID NO: 842476 - RNA, 19 nt, Homo sapiens
uggaggaaccauuuaugua

SEQ ID NO: 842477 - RNA, 19 nt, Homo sapiens
gugagaaacagaagaagug

SEQ ID NO: 842478 - RNA, 19 nt, Homo sapiens
ugauauugccuguuuccua

SEQ ID NO: 842479 - RNA, 19 nt, Homo sapiens
gaaacccucucaauaacua

SEQ ID NO: 842480 - RNA, 19 nt, Homo sapiens
ggaaguacauguaggaguu

SEQ ID NO: 842481 - RNA, 19 nt, Homo sapiens
guaagaagcugaagauuuu

SEQ ID NO: 842482 - RNA, 19 nt, Homo sapiens
agacaaauguucaguguga

SEQ ID NO: 842483 - RNA, 19 nt, Homo sapiens
caacaaagcagccacaguu

SEQ ID NO: 842484 - RNA, 19 nt, Homo sapiens
gauguugacuugaggaguu

SEQ ID NO: 842485 - RNA, 19 nt, Homo sapiens
ggaauuccaucuccauauc

SEQ ID NO: 842486 - RNA, 19 nt, Homo sapiens
gaaagugaagcgaaagaaa

SEQ ID NO: 842487 - RNA, 19 nt, Homo sapiens
gaaggugccugugaugaau

SEQ ID NO: 842488 - RNA, 19 nt, Homo sapiens
ucagacaaauguucaguga

SEQ ID NO: 842489 - RNA, 19 nt, Homo sapiens
gcaaugcccaugcaggaua

SEQ ID NO: 842490 - RNA, 19 nt, Homo sapiens
guacuacgccugugcugua

SEQ ID NO: 842491 - RNA, 19 nt, Homo sapiens
gcacauaucaaaugcuuca

SEQ ID NO: 842492 - RNA, 19 nt, Homo sapiens
ccaugcaucuuccuacauu

SEQ ID NO: 842493 - RNA, 19 nt, Homo sapiens
ggaaggugccugugaugaa

SEQ ID NO: 842494 - RNA, 19 nt, Homo sapiens
gggccagucuguacucauu

SEQ ID NO: 842495 - RNA, 19 nt, Homo sapiens
ucagggaguugcuguguga

SEQ ID NO: 842496 - RNA, 19 nt, Homo sapiens
caaggaaggugccugugau

SEQ ID NO: 842497 - RNA, 19 nt, Homo sapiens
gaagcaaugugaagcaaaa

SEQ ID NO: 842498 - RNA, 19 nt, Homo sapiens
guagacuguuguaaagaaa

SEQ ID NO: 842499 - RNA, 19 nt, Homo sapiens
cuaaguguccugagucuaa

SEQ ID NO: 842500 - RNA, 19 nt, Homo sapiens
caaagcagccacaguuuca

SEQ ID NO: 842501 - RNA, 19 nt, Homo sapiens
cugcauacuuggacacuaa

SEQ ID NO: 842502 - RNA, 19 nt, Homo sapiens
gcucccagcuuacaaccuu

SEQ ID NO: 842503 - RNA, 19 nt, Homo sapiens
auaacuaacugccggcuuu

SEQ ID NO: 842504 - RNA, 19 nt, Homo sapiens
gugaugaauuguucuccua

SEQ ID NO: 842505 - RNA, 19 nt, Homo sapiens
cagccuaagucgcuucaaa

SEQ ID NO: 842506 - RNA, 19 nt, Homo sapiens
gagaagcaaugugaagcaa

SEQ ID NO: 842507 - RNA, 19 nt, Homo sapiens
ucagacaaauguucagugu

SEQ ID NO: 842508 - RNA, 19 nt, Homo sapiens
ggacucuauugaagauuug

SEQ ID NO: 842509 - RNA, 19 nt, Homo sapiens
uguaagaagcugaagauuu

SEQ ID NO: 842510 - RNA, 19 nt, Homo sapiens
gaaguacauguaggaguua

SEQ ID NO: 842511 - RNA, 19 nt, Homo sapiens
ugacugagaccuagaaauc

SEQ ID NO: 842512 - RNA, 19 nt, Homo sapiens
ggugaacucucugaggaaa

SEQ ID NO: 842513 - RNA, 19 nt, Homo sapiens
gaaucugaauuucuaaagg

SEQ ID NO: 842514 - RNA, 19 nt, Homo sapiens
gugcacauaucaaaugcuu

SEQ ID NO: 842515 - RNA, 19 nt, Homo sapiens
auaaagagaagcaauguga

SEQ ID NO: 842516 - RNA, 19 nt, Homo sapiens
uuggaaacccucucaauaa

SEQ ID NO: 842517 - RNA, 19 nt, Homo sapiens
uguagacuguuguaaagaa

SEQ ID NO: 842518 - RNA, 19 nt, Homo sapiens
cagcuggacucuauugaag

SEQ ID NO: 842519 - RNA, 19 nt, Homo sapiens
caguagaggugcucguaga

SEQ ID NO: 842520 - RNA, 19 nt, Homo sapiens
gcagagcagcccuucauuc

SEQ ID NO: 842521 - RNA, 19 nt, Homo sapiens
cuauguggacucuuuauuu

SEQ ID NO: 842522 - RNA, 19 nt, Homo sapiens
gagaaggaagagcaguaua

SEQ ID NO: 842523 - RNA, 19 nt, Homo sapiens
gcuggacucuauugaagau

SEQ ID NO: 842524 - RNA, 19 nt, Homo sapiens
gggaguugcugugugaguu

SEQ ID NO: 842525 - RNA, 19 nt, Homo sapiens
gaaggaagagcaguauauc

SEQ ID NO: 842526 - RNA, 19 nt, Homo sapiens
uggacucuauugaagauuu

SEQ ID NO: 842527 - RNA, 19 nt, Homo sapiens
gcagcuggacucuauugaa

SEQ ID NO: 842528 - RNA, 19 nt, Homo sapiens
gaacucucaucaggacuuc

SEQ ID NO: 842529 - RNA, 19 nt, Homo sapiens
ggaguuaaucccuguguag

SEQ ID NO: 842530 - RNA, 19 nt, Homo sapiens
gugcaugcaucuugaagca

SEQ ID NO: 842531 - RNA, 19 nt, Homo sapiens
cuuggaaacccucucaaua

SEQ ID NO: 842532 - RNA, 19 nt, Homo sapiens
ggagaaggaagagcaguau

SEQ ID NO: 842533 - RNA, 19 nt, Homo sapiens
gagaaagugaagcgaaaga

SEQ ID NO: 842534 - RNA, 19 nt, Homo sapiens
cccaggagguggaaacuuc

SEQ ID NO: 842535 - RNA, 19 nt, Homo sapiens
agaaggaagagcaguauau

SEQ ID NO: 842536 - RNA, 19 nt, Homo sapiens
caaugcccaugcaggauau

SEQ ID NO: 842537 - RNA, 19 nt, Homo sapiens
cuacgccugugcuguaaga

SEQ ID NO: 842538 - RNA, 19 nt, Homo sapiens
ggagaguuaugaggacauc

SEQ ID NO: 842539 - RNA, 19 nt, Homo sapiens
gggaauuccaucuccauau

SEQ ID NO: 842540 - RNA, 19 nt, Homo sapiens
caggacuucuggacuguau

SEQ ID NO: 842541 - RNA, 19 nt, Homo sapiens
gccagacccugaaggcaau

SEQ ID NO: 842542 - RNA, 19 nt, Homo sapiens
ccaguucaccucucaguuc

SEQ ID NO: 842543 - RNA, 19 nt, Homo sapiens
ccuggaagcuacccaccuu

SEQ ID NO: 842544 - RNA, 19 nt, Homo sapiens
uugagaaagugaagcgaaa

SEQ ID NO: 842545 - RNA, 19 nt, Homo sapiens
ucaaggaaggugccuguga

SEQ ID NO: 842546 - RNA, 19 nt, Homo sapiens
uguguagacuguuguaaag

SEQ ID NO: 842547 - RNA, 19 nt, Homo sapiens
uaugaggacauccauggua

SEQ ID NO: 842548 - RNA, 19 nt, Homo sapiens
cuaagucgcuucaaaaugg

SEQ ID NO: 842549 - RNA, 19 nt, Homo sapiens
uggaaacccucucaauaac

SEQ ID NO: 842550 - RNA, 19 nt, Homo sapiens
gaugauuaaucugcguaga

SEQ ID NO: 842551 - RNA, 19 nt, Homo sapiens
uauugaagauuuggaagug

SEQ ID NO: 842552 - RNA, 19 nt, Homo sapiens
auucagagccgauacauca

SEQ ID NO: 842553 - RNA, 19 nt, Homo sapiens
gcuguaagaagcugaagau

SEQ ID NO: 842554 - RNA, 19 nt, Homo sapiens
gcuucauucugcauacuug

SEQ ID NO: 842555 - RNA, 19 nt, Homo sapiens
gugcuggauuuacggaaga

SEQ ID NO: 842556 - RNA, 19 nt, Homo sapiens
uaaagagaagcaaugugaa

SEQ ID NO: 842557 - RNA, 19 nt, Homo sapiens
agccacaguuucagacaaa

SEQ ID NO: 842558 - RNA, 19 nt, Homo sapiens
agccacugcucccagcuua

SEQ ID NO: 842559 - RNA, 19 nt, Homo sapiens
uggugcagcuggacucuau

SEQ ID NO: 842560 - RNA, 19 nt, Homo sapiens
guacauguaggaguuaauc

SEQ ID NO: 842561 - RNA, 19 nt, Homo sapiens
gcugggugcacauaucaaa

SEQ ID NO: 842562 - RNA, 19 nt, Homo sapiens
gccagucuguacucauuuc

SEQ ID NO: 842563 - RNA, 19 nt, Homo sapiens
guuaaucccuguguagacu

SEQ ID NO: 842564 - RNA, 19 nt, Homo sapiens
ggaguugcugugugaguug

SEQ ID NO: 842565 - RNA, 19 nt, Homo sapiens
agugugggaucacggauga

SEQ ID NO: 842566 - RNA, 19 nt, Homo sapiens
ggaaacccucucaauaacu

SEQ ID NO: 842567 - RNA, 19 nt, Homo sapiens
cagccacaguuucagacaa

SEQ ID NO: 842568 - RNA, 19 nt, Homo sapiens
caugcaggauaucaagaug

SEQ ID NO: 842569 - RNA, 19 nt, Homo sapiens
gcaacaaagcagccacagu

SEQ ID NO: 842570 - RNA, 19 nt, Homo sapiens
ucguagaccuguuccucaa

SEQ ID NO: 842571 - RNA, 19 nt, Homo sapiens
aaagagaagcaaugugaag

SEQ ID NO: 842572 - RNA, 19 nt, Homo sapiens
gaguuaaucccuguguaga

SEQ ID NO: 842573 - RNA, 19 nt, Homo sapiens
caaauguucagugaggaaa

SEQ ID NO: 842574 - RNA, 19 nt, Homo sapiens
aaacauguucagugaggaa

SEQ ID NO: 842575 - RNA, 19 nt, Homo sapiens
agagccugcugaaggauga

SEQ ID NO: 842576 - RNA, 19 nt, Homo sapiens
gcucuucccgccacucuuc

SEQ ID NO: 842577 - RNA, 19 nt, Homo sapiens
ggacuucuggacuguaugg

SEQ ID NO: 842578 - RNA, 19 nt, Homo sapiens
aggaaaacauguucaguga

SEQ ID NO: 842579 - RNA, 19 nt, Homo sapiens
ggagaaggauggguaaauu

SEQ ID NO: 842580 - RNA, 19 nt, Homo sapiens
gaaagauccugcagagugu

SEQ ID NO: 842581 - RNA, 19 nt, Homo sapiens
ccaaugacaucucccacua

SEQ ID NO: 842582 - RNA, 19 nt, Homo sapiens
gcacaucgcagaucaaagu

SEQ ID NO: 842583 - RNA, 19 nt, Homo sapiens
gaaagcaacagcuaucaga

SEQ ID NO: 842584 - RNA, 19 nt, Homo sapiens
gaagggcuuuaaccagauu

SEQ ID NO: 842585 - RNA, 19 nt, Homo sapiens
cgacagagaucuucaucca

SEQ ID NO: 842586 - RNA, 19 nt, Homo sapiens
ccucuaacacuacagauua

SEQ ID NO: 842587 - RNA, 19 nt, Homo sapiens
gggcucaggugauugaaau

SEQ ID NO: 842588 - RNA, 19 nt, Homo sapiens
cauccuggcugacaugcua

SEQ ID NO: 842589 - RNA, 19 nt, Homo sapiens
ugaagucccugaccauuag

SEQ ID NO: 842590 - RNA, 19 nt, Homo sapiens
gaccaccucucccugcaaa

SEQ ID NO: 842591 - RNA, 19 nt, Homo sapiens
ugaccuggccuguuccuua

SEQ ID NO: 842592 - RNA, 19 nt, Homo sapiens
gggaggagagcaccaauga

SEQ ID NO: 842593 - RNA, 19 nt, Homo sapiens
gaaggagaaggauggguaa

SEQ ID NO: 842594 - RNA, 19 nt, Homo sapiens
gaggagagcaccaaugaca

SEQ ID NO: 842595 - RNA, 19 nt, Homo sapiens
gagaaggauggguaaauug

SEQ ID NO: 842596 - RNA, 19 nt, Homo sapiens
uggcagagcuugaggacau

SEQ ID NO: 842597 - RNA, 19 nt, Homo sapiens
gcucuucuauuccacuguu

SEQ ID NO: 842598 - RNA, 19 nt, Homo sapiens
uaaauugaccucugaaguc

SEQ ID NO: 842599 - RNA, 19 nt, Homo sapiens
gaggaggacuuggaaacug

SEQ ID NO: 842600 - RNA, 19 nt, Homo sapiens
gcaaacaccacacacacau

SEQ ID NO: 842601 - RNA, 19 nt, Homo sapiens
acacgguucuucaaacuuc

SEQ ID NO: 842602 - RNA, 19 nt, Homo sapiens
cagggaagcuccacaccau

SEQ ID NO: 842603 - RNA, 19 nt, Homo sapiens
guggagcucugcccuagug

SEQ ID NO: 842604 - RNA, 19 nt, Homo sapiens
gaucucugcucccuucucu

SEQ ID NO: 842605 - RNA, 19 nt, Homo sapiens
ggaccaggaugagagaaag

SEQ ID NO: 842606 - RNA, 19 nt, Homo sapiens
ggagagcaccaaugacauc

SEQ ID NO: 842607 - RNA, 19 nt, Homo sapiens
ggcagaaguucaucaggau

SEQ ID NO: 842608 - RNA, 19 nt, Homo sapiens
guaaauugaccucugaagu

SEQ ID NO: 842609 - RNA, 19 nt, Homo sapiens
agaccgagcugaccuucau

SEQ ID NO: 842610 - RNA, 19 nt, Homo sapiens
caggaucuauaaacucuuc

SEQ ID NO: 842611 - RNA, 19 nt, Homo sapiens
gggagaagacgacagagau

SEQ ID NO: 842612 - RNA, 19 nt, Homo sapiens
acucggaucuccuucugaa

SEQ ID NO: 842613 - RNA, 19 nt, Homo sapiens
cugaagucccugaccauua

SEQ ID NO: 842614 - RNA, 19 nt, Homo sapiens
agaaggauggguaaauuga

SEQ ID NO: 842615 - RNA, 19 nt, Homo sapiens
cccauagccucuuagauuc

SEQ ID NO: 842616 - RNA, 19 nt, Homo sapiens
cccgagagguccaggagaa

SEQ ID NO: 842617 - RNA, 19 nt, Homo sapiens
gaccuggccuguuccuuac

SEQ ID NO: 842618 - RNA, 19 nt, Homo sapiens
uggcugacaugcuacucua

SEQ ID NO: 842619 - RNA, 19 nt, Homo sapiens
cugcucaccuucauugaug

SEQ ID NO: 842620 - RNA, 19 nt, Homo sapiens
ucacacgguucuucaaacu

SEQ ID NO: 842621 - RNA, 19 nt, Homo sapiens
acauuucucuacuucaaga

SEQ ID NO: 842622 - RNA, 19 nt, Homo sapiens
ugauugaaauguggaugaa

SEQ ID NO: 842623 - RNA, 19 nt, Homo sapiens
ugacagaaguggugaaaag

SEQ ID NO: 842624 - RNA, 19 nt, Homo sapiens
uggaggcccugacgcuaaa

SEQ ID NO: 842625 - RNA, 19 nt, Homo sapiens
ccugggagaugaugaagag

SEQ ID NO: 842626 - RNA, 19 nt, Homo sapiens
uggguaaauugaccucuga

SEQ ID NO: 842627 - RNA, 19 nt, Homo sapiens
uuacucagcgcaucugcua

SEQ ID NO: 842628 - RNA, 19 nt, Homo sapiens
ggccaucaguggacgaagu

SEQ ID NO: 842629 - RNA, 19 nt, Homo sapiens
ggagaagacgacagagauc

SEQ ID NO: 842630 - RNA, 19 nt, Homo sapiens
ggaagugcaggccgaguuc

SEQ ID NO: 842631 - RNA, 19 nt, Homo sapiens
ucaccgugcugcugcugaa

SEQ ID NO: 842632 - RNA, 19 nt, Homo sapiens
uuagauuccuggcaguaga

SEQ ID NO: 842633 - RNA, 19 nt, Homo sapiens
gaacuccaaauccaagaag

SEQ ID NO: 842634 - RNA, 19 nt, Homo sapiens
guaccuccgugaaccucaa

SEQ ID NO: 842635 - RNA, 19 nt, Homo sapiens
aggaggacuuggaaacuga

SEQ ID NO: 842636 - RNA, 19 nt, Homo sapiens
ccaagaagggcuuuaacca

SEQ ID NO: 842637 - RNA, 19 nt, Homo sapiens
gcucuuuggcgucccauga

SEQ ID NO: 842638 - RNA, 19 nt, Homo sapiens
ggcaguagaaggagaagga

SEQ ID NO: 842639 - RNA, 19 nt, Homo sapiens
aggcagaacuccaaaucca

SEQ ID NO: 842640 - RNA, 19 nt, Homo sapiens
caacccagcugcccauccu

SEQ ID NO: 842641 - RNA, 19 nt, Homo sapiens
gauccugggagaugaugaa

SEQ ID NO: 842642 - RNA, 19 nt, Homo sapiens
gcuacaagccagagaagag

SEQ ID NO: 842643 - RNA, 19 nt, Homo sapiens
gaccggugcugcugcaacu

SEQ ID NO: 842644 - RNA, 19 nt, Homo sapiens
gccaucugcugacuuccuu

SEQ ID NO: 842645 - RNA, 19 nt, Homo sapiens
ccacuuccuuauccuccuu

SEQ ID NO: 842646 - RNA, 19 nt, Homo sapiens
gguaugagcgcaauguacu

SEQ ID NO: 842647 - RNA, 19 nt, Homo sapiens
cuauuccacuguucuuugu

SEQ ID NO: 842648 - RNA, 19 nt, Homo sapiens
gcuacguguuguggucuuu

SEQ ID NO: 842649 - RNA, 19 nt, Homo sapiens
guuccuugcuguagccaau

SEQ ID NO: 842650 - RNA, 19 nt, Homo sapiens
cgcuaaaccugacagaagu

SEQ ID NO: 842651 - RNA, 19 nt, Homo sapiens
gcaauguacugggccucau

SEQ ID NO: 842652 - RNA, 19 nt, Homo sapiens
gcccugcucuucuauucca

SEQ ID NO: 842653 - RNA, 19 nt, Homo sapiens
ggagguggaggaggacuug

SEQ ID NO: 842654 - RNA, 19 nt, Homo sapiens
gugauugaaauguggauga

SEQ ID NO: 842655 - RNA, 19 nt, Homo sapiens
gcagaguguagucagaugu

SEQ ID NO: 842656 - RNA, 19 nt, Homo sapiens
ggacaaggugcagaucauc

SEQ ID NO: 842657 - RNA, 19 nt, Homo sapiens
cugacaugcuacucuacua

SEQ ID NO: 842658 - RNA, 19 nt, Homo sapiens
guucaucaggaucuauaaa

SEQ ID NO: 842659 - RNA, 19 nt, Homo sapiens
gaaguucaucaggaucuau

SEQ ID NO: 842660 - RNA, 19 nt, Homo sapiens
ggggauggcuugggccuuu

SEQ ID NO: 842661 - RNA, 19 nt, Homo sapiens
uagcacaucgcagaucaaa

SEQ ID NO: 842662 - RNA, 19 nt, Homo sapiens
agaagggcuuuaaccagau

SEQ ID NO: 842663 - RNA, 19 nt, Homo sapiens
cacuacagauuauuuacag

SEQ ID NO: 842664 - RNA, 19 nt, Homo sapiens
ucccaugacuccaccuugu

SEQ ID NO: 842665 - RNA, 19 nt, Homo sapiens
aagcaacagcuaucagaga

SEQ ID NO: 842666 - RNA, 19 nt, Homo sapiens
ggaaagcaacagcuaucag

SEQ ID NO: 842667 - RNA, 19 nt, Homo sapiens
aaaggcagaacuccaaauc

SEQ ID NO: 842668 - RNA, 19 nt, Homo sapiens
ccucacacgguucuucaaa

SEQ ID NO: 842669 - RNA, 19 nt, Homo sapiens
ucaucaggaucuauaaacu

SEQ ID NO: 842670 - RNA, 19 nt, Homo sapiens
agaaguucaucaggaucua

SEQ ID NO: 842671 - RNA, 19 nt, Homo sapiens
caaacaccacacacacaug

SEQ ID NO: 842672 - RNA, 19 nt, Homo sapiens
gcucaggugauugaaaugu

SEQ ID NO: 842673 - RNA, 19 nt, Homo sapiens
gcaacagcuaucagagaga

SEQ ID NO: 842674 - RNA, 19 nt, Homo sapiens
gccugcccaucaugacuuu

SEQ ID NO: 842675 - RNA, 19 nt, Homo sapiens
agacucggaucuccuucug

SEQ ID NO: 842676 - RNA, 19 nt, Homo sapiens
gagaagacgacagagaucu

SEQ ID NO: 842677 - RNA, 19 nt, Homo sapiens
uuccugaccuggccuguuc

SEQ ID NO: 842678 - RNA, 19 nt, Homo sapiens
gggaaagcaacagcuauca

SEQ ID NO: 842679 - RNA, 19 nt, Homo sapiens
gcaaugaugugacuucuuu

SEQ ID NO: 842680 - RNA, 19 nt, Homo sapiens
gcacagaaauuauagaaga

SEQ ID NO: 842681 - RNA, 19 nt, Homo sapiens
gcagugauauuuaggcaua

SEQ ID NO: 842682 - RNA, 19 nt, Homo sapiens
gcagcuggcuuuagcaaua

SEQ ID NO: 842683 - RNA, 19 nt, Homo sapiens
ggagauccuuacaguguua

SEQ ID NO: 842684 - RNA, 19 nt, Homo sapiens
ucacauggcucagcacuuu

SEQ ID NO: 842685 - RNA, 19 nt, Homo sapiens
gaagaagacuuugaauuac

SEQ ID NO: 842686 - RNA, 19 nt, Homo sapiens
caggaaauauggccaguuu

SEQ ID NO: 842687 - RNA, 19 nt, Homo sapiens
uaucagaccugguaaagga

SEQ ID NO: 842688 - RNA, 19 nt, Homo sapiens
ugaggagacugaugacuuu

SEQ ID NO: 842689 - RNA, 19 nt, Homo sapiens
ggaugaauauggcauggaa

SEQ ID NO: 842690 - RNA, 19 nt, Homo sapiens
gaaucacccugacacugua

SEQ ID NO: 842691 - RNA, 19 nt, Homo sapiens
gaagggaugugugcaaaca

SEQ ID NO: 842692 - RNA, 19 nt, Homo sapiens
acaaacaacuuacagacuu

SEQ ID NO: 842693 - RNA, 19 nt, Homo sapiens
gaagugcucugggagauca

SEQ ID NO: 842694 - RNA, 19 nt, Homo sapiens
gcagaauggucuccagaau

SEQ ID NO: 842695 - RNA, 19 nt, Homo sapiens
gaucucagaccaguuguua

SEQ ID NO: 842696 - RNA, 19 nt, Homo sapiens
agaauggucuccagaauca

SEQ ID NO: 842697 - RNA, 19 nt, Homo sapiens
gcaauggcauauccucaga

SEQ ID NO: 842698 - RNA, 19 nt, Homo sapiens
ggaaauauggccaguuuua

SEQ ID NO: 842699 - RNA, 19 nt, Homo sapiens
aguguuaccugaagaagua

SEQ ID NO: 842700 - RNA, 19 nt, Homo sapiens
gaaagucauacaggaaaua

SEQ ID NO: 842701 - RNA, 19 nt, Homo sapiens
caaagccauucauaacauu

SEQ ID NO: 842702 - RNA, 19 nt, Homo sapiens
cuucauggcuaacaauaaa

SEQ ID NO: 842703 - RNA, 19 nt, Homo sapiens
uuacgggacucauugcuaa

SEQ ID NO: 842704 - RNA, 19 nt, Homo sapiens
ccaaagccauucauaacau

SEQ ID NO: 842705 - RNA, 19 nt, Homo sapiens
cugaauuacugccguauuu

SEQ ID NO: 842706 - RNA, 19 nt, Homo sapiens
aaagacuugucaccuguua

SEQ ID NO: 842707 - RNA, 19 nt, Homo sapiens
gcacagaccaugaaaauga

SEQ ID NO: 842708 - RNA, 19 nt, Homo sapiens
uauccgagacucuaaauaa

SEQ ID NO: 842709 - RNA, 19 nt, Homo sapiens
ggagaucucagaccaguug

SEQ ID NO: 842710 - RNA, 19 nt, Homo sapiens
ggacuugauuuucuugaua

SEQ ID NO: 842711 - RNA, 19 nt, Homo sapiens
guacaaaacuaacgaugaa

SEQ ID NO: 842712 - RNA, 19 nt, Homo sapiens
cuacgagaccucauucaua

SEQ ID NO: 842713 - RNA, 19 nt, Homo sapiens
ugaggaauguaaacaaguu

SEQ ID NO: 842714 - RNA, 19 nt, Homo sapiens
ccaaugaucaugaagaaga

SEQ ID NO: 842715 - RNA, 19 nt, Homo sapiens
uggauaagauuaccgaaug

SEQ ID NO: 842716 - RNA, 19 nt, Homo sapiens
gaaauccucaguuccuuga

SEQ ID NO: 842717 - RNA, 19 nt, Homo sapiens
gaagaaguacauagucguu

SEQ ID NO: 842718 - RNA, 19 nt, Homo sapiens
gaacuugaaagacuuguca

SEQ ID NO: 842719 - RNA, 19 nt, Homo sapiens
aguaguaucucuauugaug

SEQ ID NO: 842720 - RNA, 19 nt, Homo sapiens
gcuaaucggcgcacagaaa

SEQ ID NO: 842721 - RNA, 19 nt, Homo sapiens
gauguggagucaugcuauu

SEQ ID NO: 842722 - RNA, 19 nt, Homo sapiens
gaggguaucagaccuggua

SEQ ID NO: 842723 - RNA, 19 nt, Homo sapiens
guacaguaguaucucuauu

SEQ ID NO: 842724 - RNA, 19 nt, Homo sapiens
gauuuggccuucuacucua

SEQ ID NO: 842725 - RNA, 19 nt, Homo sapiens
ucaccagguuguuucgaua

SEQ ID NO: 842726 - RNA, 19 nt, Homo sapiens
uagcagaucuugcccuaca

SEQ ID NO: 842727 - RNA, 19 nt, Homo sapiens
ugaauugguuggagagaug

SEQ ID NO: 842728 - RNA, 19 nt, Homo sapiens
acaaaguucugaauuacug

SEQ ID NO: 842729 - RNA, 19 nt, Homo sapiens
uaacccauauccagaacuu

SEQ ID NO: 842730 - RNA, 19 nt, Homo sapiens
caaacaacuuacagacuuc

SEQ ID NO: 842731 - RNA, 19 nt, Homo sapiens
ggauaagauuaccgaaugu

SEQ ID NO: 842732 - RNA, 19 nt, Homo sapiens
ugaagucguugaucgaaau

SEQ ID NO: 842733 - RNA, 19 nt, Homo sapiens
acaguaguaucucuauuga

SEQ ID NO: 842734 - RNA, 19 nt, Homo sapiens
uugagaauguggagacuaa

SEQ ID NO: 842735 - RNA, 19 nt, Homo sapiens
acaguaacuucauggcuaa

SEQ ID NO: 842736 - RNA, 19 nt, Homo sapiens
uaacgcagcuggcuuuagc

SEQ ID NO: 842737 - RNA, 19 nt, Homo sapiens
gagacugccuaucauaugg

SEQ ID NO: 842738 - RNA, 19 nt, Homo sapiens
ggagacugccuaucauaug

SEQ ID NO: 842739 - RNA, 19 nt, Homo sapiens
gaagauucagaccucauuu

SEQ ID NO: 842740 - RNA, 19 nt, Homo sapiens
ggaaaacaauccaacacuu

SEQ ID NO: 842741 - RNA, 19 nt, Homo sapiens
uagggucuauggaguguuu

SEQ ID NO: 842742 - RNA, 19 nt, Homo sapiens
cuucaaagcuuacauucag

SEQ ID NO: 842743 - RNA, 19 nt, Homo sapiens
gugcaggccauccucaaua

SEQ ID NO: 842744 - RNA, 19 nt, Homo sapiens
ggcaggauguggagucaug

SEQ ID NO: 842745 - RNA, 19 nt, Homo sapiens
gcugaggaauguaaacaag

SEQ ID NO: 842746 - RNA, 19 nt, Homo sapiens
gguagccaaugaucaugaa

SEQ ID NO: 842747 - RNA, 19 nt, Homo sapiens
guucuuagaucgccuugca

SEQ ID NO: 842748 - RNA, 19 nt, Homo sapiens
agagaugagugaagucguu

SEQ ID NO: 842749 - RNA, 19 nt, Homo sapiens
gugaagauuuagacaaagu

SEQ ID NO: 842750 - RNA, 19 nt, Homo sapiens
cuugucaccuguuauugua

SEQ ID NO: 842751 - RNA, 19 nt, Homo sapiens
ccaccgggaugccaauugu

SEQ ID NO: 842752 - RNA, 19 nt, Homo sapiens
ggucaucccuaucuuacag

SEQ ID NO: 842753 - RNA, 19 nt, Homo sapiens
guguugggcuauuugauga

SEQ ID NO: 842754 - RNA, 19 nt, Homo sapiens
guaaaggacuugauuuucu

SEQ ID NO: 842755 - RNA, 19 nt, Homo sapiens
cauggcaucuucaaagcuu

SEQ ID NO: 842756 - RNA, 19 nt, Homo sapiens
agacaaaguucugaauuac

SEQ ID NO: 842757 - RNA, 19 nt, Homo sapiens
gcgcacagaaauuauagaa

SEQ ID NO: 842758 - RNA, 19 nt, Homo sapiens
guacauagucguuccuuac

SEQ ID NO: 842759 - RNA, 19 nt, Homo sapiens
cgacauugcagcucgugua

SEQ ID NO: 842760 - RNA, 19 nt, Homo sapiens
cagaaagucauacaggaaa

SEQ ID NO: 842761 - RNA, 19 nt, Homo sapiens
cagccaaagccauucauaa

SEQ ID NO: 842762 - RNA, 19 nt, Homo sapiens
guaacuucauggcuaacaa

SEQ ID NO: 842763 - RNA, 19 nt, Homo sapiens
aaucggcgcacagaaauua

SEQ ID NO: 842764 - RNA, 19 nt, Homo sapiens
gaucaugcagguugacaga

SEQ ID NO: 842765 - RNA, 19 nt, Homo sapiens
uacgagaccucauucauac

SEQ ID NO: 842766 - RNA, 19 nt, Homo sapiens
ucagaccaguuguuacaga

SEQ ID NO: 842767 - RNA, 19 nt, Homo sapiens
gcagccaaagccauucaua

SEQ ID NO: 842768 - RNA, 19 nt, Homo sapiens
ggagacuaacuugccauua

SEQ ID NO: 842769 - RNA, 19 nt, Homo sapiens
gaauguggagacuaacuug

SEQ ID NO: 842770 - RNA, 19 nt, Homo sapiens
uuacagacuuccacaagca

SEQ ID NO: 842771 - RNA, 19 nt, Homo sapiens
gccaaguggucaucccuau

SEQ ID NO: 842772 - RNA, 19 nt, Homo sapiens
gugaagucguugaucgaaa

SEQ ID NO: 842773 - RNA, 19 nt, Homo sapiens
gaaaacaauccaacacuug

SEQ ID NO: 842774 - RNA, 19 nt, Homo sapiens
acgugaagauuuagacaaa

SEQ ID NO: 842775 - RNA, 19 nt, Homo sapiens
gaugaaaggccugugugaa

SEQ ID NO: 842776 - RNA, 19 nt, Homo sapiens
gaagcgguucucuuuauca

SEQ ID NO: 842777 - RNA, 19 nt, Homo sapiens
agacucucaugccucuuua

SEQ ID NO: 842778 - RNA, 19 nt, Homo sapiens
gaauauggcauggaagaag

SEQ ID NO: 842779 - RNA, 19 nt, Homo sapiens
gcagucagauuuacuauuu

SEQ ID NO: 842780 - RNA, 19 nt, Homo sapiens
gaacuuagagcaagcuaua

SEQ ID NO: 842781 - RNA, 19 nt, Homo sapiens
gagcugaaaugauguuuga

SEQ ID NO: 842782 - RNA, 19 nt, Homo sapiens
ggaaauguuugcucuggua

SEQ ID NO: 842783 - RNA, 19 nt, Homo sapiens
ggagacauccucaaugaua

SEQ ID NO: 842784 - RNA, 19 nt, Homo sapiens
gaaacccugucucuacuaa

SEQ ID NO: 842785 - RNA, 19 nt, Homo sapiens
gaaggaguuuccaaaggua

SEQ ID NO: 842786 - RNA, 19 nt, Homo sapiens
ggacugcccuggacuuguu

SEQ ID NO: 842787 - RNA, 19 nt, Homo sapiens
gcgcacaccuguaauccua

SEQ ID NO: 842788 - RNA, 19 nt, Homo sapiens
cuucggaguucaagaauua

SEQ ID NO: 842789 - RNA, 19 nt, Homo sapiens
aaaggaguguggaaacuua

SEQ ID NO: 842790 - RNA, 19 nt, Homo sapiens
gcaucucuguuguguaaua

SEQ ID NO: 842791 - RNA, 19 nt, Homo sapiens
ggaacaugaugcuuugaaa

SEQ ID NO: 842792 - RNA, 19 nt, Homo sapiens
gagcagccuuuggauguua

SEQ ID NO: 842793 - RNA, 19 nt, Homo sapiens
gagaaucaaagaucuagua

SEQ ID NO: 842794 - RNA, 19 nt, Homo sapiens
gauggaaucuggaacuuag

SEQ ID NO: 842795 - RNA, 19 nt, Homo sapiens
gaacauucuuucugagcuu

SEQ ID NO: 842796 - RNA, 19 nt, Homo sapiens
ucagaaacccaccggauua

SEQ ID NO: 842797 - RNA, 19 nt, Homo sapiens
gaacggagacauccucaau

SEQ ID NO: 842798 - RNA, 19 nt, Homo sapiens
gcagugcggugcaggcaaa

SEQ ID NO: 842799 - RNA, 19 nt, Homo sapiens
aaacuauacugccuuguga

SEQ ID NO: 842800 - RNA, 19 nt, Homo sapiens
ggaucaggcugcccaagaa

SEQ ID NO: 842801 - RNA, 19 nt, Homo sapiens
gcuaugcuaugaacacuau

SEQ ID NO: 842802 - RNA, 19 nt, Homo sapiens
gauuaagccuguuuguguu

SEQ ID NO: 842803 - RNA, 19 nt, Homo sapiens
ugaaagaguucuguccaaa

SEQ ID NO: 842804 - RNA, 19 nt, Homo sapiens
gaaugugucugcuuuacca

SEQ ID NO: 842805 - RNA, 19 nt, Homo sapiens
ggaagcuccuggaaaugaa

SEQ ID NO: 842806 - RNA, 19 nt, Homo sapiens
uuauugagcugaaaugaug

SEQ ID NO: 842807 - RNA, 19 nt, Homo sapiens
gaaaucagaguuuggaaca

SEQ ID NO: 842808 - RNA, 19 nt, Homo sapiens
uugcaucucuguuguguaa

SEQ ID NO: 842809 - RNA, 19 nt, Homo sapiens
cagggaacauucuuucuga

SEQ ID NO: 842810 - RNA, 19 nt, Homo sapiens
ucaaagaucuaguaacacu

SEQ ID NO: 842811 - RNA, 19 nt, Homo sapiens
ccacgcaggacaagucuua

SEQ ID NO: 842812 - RNA, 19 nt, Homo sapiens
gaaagccagcaaagaauga

SEQ ID NO: 842813 - RNA, 19 nt, Homo sapiens
aauggcaucucacuaauga

SEQ ID NO: 842814 - RNA, 19 nt, Homo sapiens
caggacaagucuuagcuuu

SEQ ID NO: 842815 - RNA, 19 nt, Homo sapiens
gaaacccaccggauuauca

SEQ ID NO: 842816 - RNA, 19 nt, Homo sapiens
ugacagacguuuauagaac

SEQ ID NO: 842817 - RNA, 19 nt, Homo sapiens
gaaugaaggcaacaaagga

SEQ ID NO: 842818 - RNA, 19 nt, Homo sapiens
cuacauugauucagcaaau

SEQ ID NO: 842819 - RNA, 19 nt, Homo sapiens
cuaaugaccucacuaucug

SEQ ID NO: 842820 - RNA, 19 nt, Homo sapiens
ugcagaagcuggauaccua

SEQ ID NO: 842821 - RNA, 19 nt, Homo sapiens
caaagugacagacguuuau

SEQ ID NO: 842822 - RNA, 19 nt, Homo sapiens
agagaaagccagcaaagaa

SEQ ID NO: 842823 - RNA, 19 nt, Homo sapiens
ggacuuguucucagaggua

SEQ ID NO: 842824 - RNA, 19 nt, Homo sapiens
gaacuggagccaagugugu

SEQ ID NO: 842825 - RNA, 19 nt, Homo sapiens
ccuggaagcuccuggaaau

SEQ ID NO: 842826 - RNA, 19 nt, Homo sapiens
ucucagagguaucaggaaa

SEQ ID NO: 842827 - RNA, 19 nt, Homo sapiens
caagugagaaggaaauguu

SEQ ID NO: 842828 - RNA, 19 nt, Homo sapiens
caggcaagaucccaaauca

SEQ ID NO: 842829 - RNA, 19 nt, Homo sapiens
ccacagggaacaacaaaga

SEQ ID NO: 842830 - RNA, 19 nt, Homo sapiens
ccaaagugacagacguuua

SEQ ID NO: 842831 - RNA, 19 nt, Homo sapiens
gagaaagccagcaaagaau

SEQ ID NO: 842832 - RNA, 19 nt, Homo sapiens
ugacuuccauuguguuuua

SEQ ID NO: 842833 - RNA, 19 nt, Homo sapiens
ccaagagaaucaaagaucu

SEQ ID NO: 842834 - RNA, 19 nt, Homo sapiens
gaaacagccaagagaauca

SEQ ID NO: 842835 - RNA, 19 nt, Homo sapiens
uaaaauggcaucucacuaa

SEQ ID NO: 842836 - RNA, 19 nt, Homo sapiens
gcagagagcacugauugga

SEQ ID NO: 842837 - RNA, 19 nt, Homo sapiens
uguccugucuucagaaauu

SEQ ID NO: 842838 - RNA, 19 nt, Homo sapiens
gagacauccucaaugauag

SEQ ID NO: 842839 - RNA, 19 nt, Homo sapiens
ugugaugccucccuagaaa

SEQ ID NO: 842840 - RNA, 19 nt, Homo sapiens
ggaaacagccaagagaauc

SEQ ID NO: 842841 - RNA, 19 nt, Homo sapiens
caaaguggaacucuucaga

SEQ ID NO: 842842 - RNA, 19 nt, Homo sapiens
acggagacauccucaauga

SEQ ID NO: 842843 - RNA, 19 nt, Homo sapiens
caagagaaucaaagaucua

SEQ ID NO: 842844 - RNA, 19 nt, Homo sapiens
gagcuuugcaucucuguug

SEQ ID NO: 842845 - RNA, 19 nt, Homo sapiens
gcaagugacaaaggaaauu

SEQ ID NO: 842846 - RNA, 19 nt, Homo sapiens
gauaagccggugcaaguga

SEQ ID NO: 842847 - RNA, 19 nt, Homo sapiens
gcaggagaauugcuugaac

SEQ ID NO: 842848 - RNA, 19 nt, Homo sapiens
gccagguggucuucauaaa

SEQ ID NO: 842849 - RNA, 19 nt, Homo sapiens
guaguuaaaucagggaaca

SEQ ID NO: 842850 - RNA, 19 nt, Homo sapiens
agaaggaguuuccaaaggu

SEQ ID NO: 842851 - RNA, 19 nt, Homo sapiens
ugauuaagccuguuugugu

SEQ ID NO: 842852 - RNA, 19 nt, Homo sapiens
ucaauuaugugagacagau

SEQ ID NO: 842853 - RNA, 19 nt, Homo sapiens
gcucagcuaugcuaugaac

SEQ ID NO: 842854 - RNA, 19 nt, Homo sapiens
cagaaggaguuuccaaagg

SEQ ID NO: 842855 - RNA, 19 nt, Homo sapiens
cuguuuagaugucucaauu

SEQ ID NO: 842856 - RNA, 19 nt, Homo sapiens
aaucagaguuuggaacaug

SEQ ID NO: 842857 - RNA, 19 nt, Homo sapiens
uaucugacuuccauugugu

SEQ ID NO: 842858 - RNA, 19 nt, Homo sapiens
ggugaaacccugucucuac

SEQ ID NO: 842859 - RNA, 19 nt, Homo sapiens
cagcucaccaucagaguuu

SEQ ID NO: 842860 - RNA, 19 nt, Homo sapiens
gcuguccugucuucagaaa

SEQ ID NO: 842861 - RNA, 19 nt, Homo sapiens
cucccuggcucuaggaaua

SEQ ID NO: 842862 - RNA, 19 nt, Homo sapiens
gcagaaaaguggcccaauc

SEQ ID NO: 842863 - RNA, 19 nt, Homo sapiens
aaaggaaacagccaagaga

SEQ ID NO: 842864 - RNA, 19 nt, Homo sapiens
ucacuaaugaccucacuau

SEQ ID NO: 842865 - RNA, 19 nt, Homo sapiens
uagccaugcugaggucaua

SEQ ID NO: 842866 - RNA, 19 nt, Homo sapiens
aaccaugaguggacauuau

SEQ ID NO: 842867 - RNA, 19 nt, Homo sapiens
gagcuguaagggucacaua

SEQ ID NO: 842868 - RNA, 19 nt, Homo sapiens
agacuuggcugaagcuaac

SEQ ID NO: 842869 - RNA, 19 nt, Homo sapiens
ccaaaucagcaaaguggaa

SEQ ID NO: 842870 - RNA, 19 nt, Homo sapiens
ccugucagcuguggucauu

SEQ ID NO: 842871 - RNA, 19 nt, Homo sapiens
cagguggucuucauaaacu

SEQ ID NO: 842872 - RNA, 19 nt, Homo sapiens
uggcagcgguggugaagau

SEQ ID NO: 842873 - RNA, 19 nt, Homo sapiens
gccaagagaaucaaagauc

SEQ ID NO: 842874 - RNA, 19 nt, Homo sapiens
guggaacucuucagaucau

SEQ ID NO: 842875 - RNA, 19 nt, Homo sapiens
gacagacguuuauagaacu

SEQ ID NO: 842876 - RNA, 19 nt, Homo sapiens
cagcaaaguggaacucuuc

SEQ ID NO: 842877 - RNA, 19 nt, Homo sapiens
ccaaaaggcuucggaguuc

SEQ ID NO: 842878 - RNA, 19 nt, Homo sapiens
uaaacuauacugccuugug

SEQ ID NO: 842879 - RNA, 19 nt, Homo sapiens
ggaauauucugguuuaaug

SEQ ID NO: 842880 - RNA, 19 nt, Homo sapiens
gaaggaggcuagguuuaaa

SEQ ID NO: 842881 - RNA, 19 nt, Homo sapiens
caugagcccuuguacauuu

SEQ ID NO: 842882 - RNA, 19 nt, Homo sapiens
gcaaagaccacacagauuc

SEQ ID NO: 842883 - RNA, 19 nt, Homo sapiens
caaagaugcuuggaauauu

SEQ ID NO: 842884 - RNA, 19 nt, Homo sapiens
gaaacuagcagcagcaaau

SEQ ID NO: 842885 - RNA, 19 nt, Homo sapiens
ccauuuaucucauugcuau

SEQ ID NO: 842886 - RNA, 19 nt, Homo sapiens
gcauauggccauugugaaa

SEQ ID NO: 842887 - RNA, 19 nt, Homo sapiens
uaaugugccugaaaucuau

SEQ ID NO: 842888 - RNA, 19 nt, Homo sapiens
gagcauauggccauuguga

SEQ ID NO: 842889 - RNA, 19 nt, Homo sapiens
caacaucacagucuacaug

SEQ ID NO: 842890 - RNA, 19 nt, Homo sapiens
ccauggcccuggaccguua

SEQ ID NO: 842891 - RNA, 19 nt, Homo sapiens
ccacacagauucgcauuca

SEQ ID NO: 842892 - RNA, 19 nt, Homo sapiens
cagcaaauguucaagucaa

SEQ ID NO: 842893 - RNA, 19 nt, Homo sapiens
aaagaugcuuggaauauuc

SEQ ID NO: 842894 - RNA, 19 nt, Homo sapiens
gcuaggagccacagacauu

SEQ ID NO: 842895 - RNA, 19 nt, Homo sapiens
ggccaucuguuauccacua

SEQ ID NO: 842896 - RNA, 19 nt, Homo sapiens
cuuggaauauucugguuua

SEQ ID NO: 842897 - RNA, 19 nt, Homo sapiens
uaaagugccgguuucaauu

SEQ ID NO: 842898 - RNA, 19 nt, Homo sapiens
gauuugaccucacauucau

SEQ ID NO: 842899 - RNA, 19 nt, Homo sapiens
ucaauccacuugucuaugg

SEQ ID NO: 842900 - RNA, 19 nt, Homo sapiens
cuacaugcccucuguguug

SEQ ID NO: 842901 - RNA, 19 nt, Homo sapiens
gaggcuagguuuaaagcau

SEQ ID NO: 842902 - RNA, 19 nt, Homo sapiens
ggauugggauuccauucug

SEQ ID NO: 842903 - RNA, 19 nt, Homo sapiens
caucuguuauccacuaaga

SEQ ID NO: 842904 - RNA, 19 nt, Homo sapiens
guuauguggccaucuguua

SEQ ID NO: 842905 - RNA, 19 nt, Homo sapiens
gguuuaaugugccugaaau

SEQ ID NO: 842906 - RNA, 19 nt, Homo sapiens
ggauuugaccucacauuca

SEQ ID NO: 842907 - RNA, 19 nt, Homo sapiens
agaaggaggcuagguuuaa

SEQ ID NO: 842908 - RNA, 19 nt, Homo sapiens
acucagggcugcuauucuu

SEQ ID NO: 842909 - RNA, 19 nt, Homo sapiens
cagaaggaggcuagguuua

SEQ ID NO: 842910 - RNA, 19 nt, Homo sapiens
ccagaaggaggcuagguuu

SEQ ID NO: 842911 - RNA, 19 nt, Homo sapiens
uguccuacauccagauauu

SEQ ID NO: 842912 - RNA, 19 nt, Homo sapiens
aaagugccgguuucaauuu

SEQ ID NO: 842913 - RNA, 19 nt, Homo sapiens
gauuccugcuugcuucaaa

SEQ ID NO: 842914 - RNA, 19 nt, Homo sapiens
gugcaaagaccacacagau

SEQ ID NO: 842915 - RNA, 19 nt, Homo sapiens
cugcauugcucacaucugu

SEQ ID NO: 842916 - RNA, 19 nt, Homo sapiens
acuaagacaugccaacauc

SEQ ID NO: 842917 - RNA, 19 nt, Homo sapiens
uuaaugugccugaaaucua

SEQ ID NO: 842918 - RNA, 19 nt, Homo sapiens
gauucgcauucauguggua

SEQ ID NO: 842919 - RNA, 19 nt, Homo sapiens
gugagcauauggccauugu

SEQ ID NO: 842920 - RNA, 19 nt, Homo sapiens
ccacuugucuauggugcaa

SEQ ID NO: 842921 - RNA, 19 nt, Homo sapiens
ucacauucaucacauuguc

SEQ ID NO: 842922 - RNA, 19 nt, Homo sapiens
gaccucacauucaucacau

SEQ ID NO: 842923 - RNA, 19 nt, Homo sapiens
acacagauucgcauucaug

SEQ ID NO: 842924 - RNA, 19 nt, Homo sapiens
cagggcugcuauucuugua

SEQ ID NO: 842925 - RNA, 19 nt, Homo sapiens
gccuaguacugauaaagug

SEQ ID NO: 842926 - RNA, 19 nt, Homo sapiens
gauugggauuccauucugu

SEQ ID NO: 842927 - RNA, 19 nt, Homo sapiens
cccaccagcuugucauuca

SEQ ID NO: 842928 - RNA, 19 nt, Homo sapiens
ugagcaucaucaaaucuga

SEQ ID NO: 842929 - RNA, 19 nt, Homo sapiens
gaucccaggccuagaaucu

SEQ ID NO: 842930 - RNA, 19 nt, Homo sapiens
gauaaagugccgguuucaa

SEQ ID NO: 842931 - RNA, 19 nt, Homo sapiens
aggcuagguuuaaagcauu

SEQ ID NO: 842932 - RNA, 19 nt, Homo sapiens
auaaagugccgguuucaau

SEQ ID NO: 842933 - RNA, 19 nt, Homo sapiens
cuucugagcaucaucaaau

SEQ ID NO: 842934 - RNA, 19 nt, Homo sapiens
guacucagggcugcuauuc

SEQ ID NO: 842935 - RNA, 19 nt, Homo sapiens
cugauaaagugccgguuuc

SEQ ID NO: 842936 - RNA, 19 nt, Homo sapiens
gcuggucccuccauuucuc

SEQ ID NO: 842937 - RNA, 19 nt, Homo sapiens
guuuguggccuucacugua

SEQ ID NO: 842938 - RNA, 19 nt, Homo sapiens
gcagcaaauguucaaguca

SEQ ID NO: 842939 - RNA, 19 nt, Homo sapiens
uccauucugugccauuuau

SEQ ID NO: 842940 - RNA, 19 nt, Homo sapiens
ggaacuauggucguacuca

SEQ ID NO: 842941 - RNA, 19 nt, Homo sapiens
cagcuugucauucagauag

SEQ ID NO: 842942 - RNA, 19 nt, Homo sapiens
cauauucucuuuucuagca

SEQ ID NO: 842943 - RNA, 19 nt, Homo sapiens
caucuucacccaccagcuu

SEQ ID NO: 842944 - RNA, 19 nt, Homo sapiens
gccaucuguuauccacuaa

SEQ ID NO: 842945 - RNA, 19 nt, Homo sapiens
uacaugcccucuguguuga

SEQ ID NO: 842946 - RNA, 19 nt, Homo sapiens
ucugugcagugcuggauug

SEQ ID NO: 842947 - RNA, 19 nt, Homo sapiens
uccuacauccagauauuua

SEQ ID NO: 842948 - RNA, 19 nt, Homo sapiens
ucccaggccuagaaucugu

SEQ ID NO: 842949 - RNA, 19 nt, Homo sapiens
ccacuaagacaugccaaca

SEQ ID NO: 842950 - RNA, 19 nt, Homo sapiens
ccacacauugcaggguaua

SEQ ID NO: 842951 - RNA, 19 nt, Homo sapiens
uuuccaacaucacagucua

SEQ ID NO: 842952 - RNA, 19 nt, Homo sapiens
cuucuucacacauagguuu

SEQ ID NO: 842953 - RNA, 19 nt, Homo sapiens
cuaccuccuugccuucuuc

SEQ ID NO: 842954 - RNA, 19 nt, Homo sapiens
gcagugcuggauugggauu

SEQ ID NO: 842955 - RNA, 19 nt, Homo sapiens
gaccacacagauucgcauu

SEQ ID NO: 842956 - RNA, 19 nt, Homo sapiens
ccaugagcccuuguacauu

SEQ ID NO: 842957 - RNA, 19 nt, Homo sapiens
cagucuacaugcccucugu

SEQ ID NO: 842958 - RNA, 19 nt, Homo sapiens
ccauuucucaauccacuug

SEQ ID NO: 842959 - RNA, 19 nt, Homo sapiens
cacauagguuugggucuca

SEQ ID NO: 842960 - RNA, 19 nt, Homo sapiens
gguuuaaagcauucaauac

SEQ ID NO: 842961 - RNA, 19 nt, Homo sapiens
uccaugagcccuuguacau

SEQ ID NO: 842962 - RNA, 19 nt, Homo sapiens
ccugcuugcuucaaaugug

SEQ ID NO: 842963 - RNA, 19 nt, Homo sapiens
gcuuggaauauucugguuu

SEQ ID NO: 842964 - RNA, 19 nt, Homo sapiens
ugcaaagaccacacagauu

SEQ ID NO: 842965 - RNA, 19 nt, Homo sapiens
uuuguggccuucacuguag

SEQ ID NO: 842966 - RNA, 19 nt, Homo sapiens
acacauugcaggguauaga

SEQ ID NO: 842967 - RNA, 19 nt, Homo sapiens
acaggaaacuggugauaaa

SEQ ID NO: 842968 - RNA, 19 nt, Homo sapiens
ccacagaaccagaaauaga

SEQ ID NO: 842969 - RNA, 19 nt, Homo sapiens
gcccacagaaccagaaaua

SEQ ID NO: 842970 - RNA, 19 nt, Homo sapiens
ggaacugccucccucaucu

SEQ ID NO: 842971 - RNA, 19 nt, Homo sapiens
ggaaacuggugauaaagcu

SEQ ID NO: 842972 - RNA, 19 nt, Homo sapiens
caacaggaaacuggugaua

SEQ ID NO: 842973 - RNA, 19 nt, Homo sapiens
gcacgucccguaucuguuc

SEQ ID NO: 842974 - RNA, 19 nt, Homo sapiens
uggaugcguugaagaacua

SEQ ID NO: 842975 - RNA, 19 nt, Homo sapiens
ugaggacgcugaggcugaa

SEQ ID NO: 842976 - RNA, 19 nt, Homo sapiens
gcaugauccuagcuuccuu

SEQ ID NO: 842977 - RNA, 19 nt, Homo sapiens
uugaagaacuaugagauca

SEQ ID NO: 842978 - RNA, 19 nt, Homo sapiens
ccauccugcuggugaacua

SEQ ID NO: 842979 - RNA, 19 nt, Homo sapiens
gaacugccucccucaucug

SEQ ID NO: 842980 - RNA, 19 nt, Homo sapiens
ccagugaagcugcuaugga

SEQ ID NO: 842981 - RNA, 19 nt, Homo sapiens
ggaacacagcuucuugucu

SEQ ID NO: 842982 - RNA, 19 nt, Homo sapiens
ccaaagccgugagcgucuu

SEQ ID NO: 842983 - RNA, 19 nt, Homo sapiens
cacagcuucuugucucaga

SEQ ID NO: 842984 - RNA, 19 nt, Homo sapiens
gcuauggagcaacaggaaa

SEQ ID NO: 842985 - RNA, 19 nt, Homo sapiens
gcaguucgaggugcucaug

SEQ ID NO: 842986 - RNA, 19 nt, Homo sapiens
ccagugacuugggaacaca

SEQ ID NO: 842987 - RNA, 19 nt, Homo sapiens
uguacgccgucaccaaguu

SEQ ID NO: 842988 - RNA, 19 nt, Homo sapiens
guggaugcguugaagaacu

SEQ ID NO: 842989 - RNA, 19 nt, Homo sapiens
cacagaaccagaaauagag

SEQ ID NO: 842990 - RNA, 19 nt, Homo sapiens
guugaagaacuaugagauc

SEQ ID NO: 842991 - RNA, 19 nt, Homo sapiens
aacaggaaacuggugauaa

SEQ ID NO: 842992 - RNA, 19 nt, Homo sapiens
gaaacuugcuccuaaauga

SEQ ID NO: 842993 - RNA, 19 nt, Homo sapiens
gaacacagcgugcagauuu

SEQ ID NO: 842994 - RNA, 19 nt, Homo sapiens
ggugaaagauugggacuua

SEQ ID NO: 842995 - RNA, 19 nt, Homo sapiens
gaaauaacaccuucuccua

SEQ ID NO: 842996 - RNA, 19 nt, Homo sapiens
gcuccuaaaugaacacaua

SEQ ID NO: 842997 - RNA, 19 nt, Homo sapiens
uuacaacgcuguuaggaaa

SEQ ID NO: 842998 - RNA, 19 nt, Homo sapiens
ggacagaccucaggagcuu

SEQ ID NO: 842999 - RNA, 19 nt, Homo sapiens
aauaacaccuucuccuaua

SEQ ID NO: 843000 - RNA, 19 nt, Homo sapiens
ggaucugucuguccuguaa

SEQ ID NO: 843001 - RNA, 19 nt, Homo sapiens
gaucagaaacucuuccaaa

SEQ ID NO: 843002 - RNA, 19 nt, Homo sapiens
gcaaauccaagaucaacua

SEQ ID NO: 843003 - RNA, 19 nt, Homo sapiens
aaacaaagcgccagggaaa

SEQ ID NO: 843004 - RNA, 19 nt, Homo sapiens
gaaacucuuccaaacauuu

SEQ ID NO: 843005 - RNA, 19 nt, Homo sapiens
ggaggccuauggagaguuu

SEQ ID NO: 843006 - RNA, 19 nt, Homo sapiens
gaacacauaaguuuagauc

SEQ ID NO: 843007 - RNA, 19 nt, Homo sapiens
cggccugccucuuugauua

SEQ ID NO: 843008 - RNA, 19 nt, Homo sapiens
cagaaacucuuccaaacau

SEQ ID NO: 843009 - RNA, 19 nt, Homo sapiens
ccacacggccugccucuuu

SEQ ID NO: 843010 - RNA, 19 nt, Homo sapiens
gagaccaucaccauaauuu

SEQ ID NO: 843011 - RNA, 19 nt, Homo sapiens
ggaggaagguggagaccau

SEQ ID NO: 843012 - RNA, 19 nt, Homo sapiens
ggacauugacaacaucauu

SEQ ID NO: 843013 - RNA, 19 nt, Homo sapiens
gauugggacuuaacacuuc

SEQ ID NO: 843014 - RNA, 19 nt, Homo sapiens
gacaaagccucagaagaga

SEQ ID NO: 843015 - RNA, 19 nt, Homo sapiens
ggaaggagguuuuacugaa

SEQ ID NO: 843016 - RNA, 19 nt, Homo sapiens
gaguuucucugcauguuug

SEQ ID NO: 843017 - RNA, 19 nt, Homo sapiens
gacauugacaacaucauua

SEQ ID NO: 843018 - RNA, 19 nt, Homo sapiens
gggagaauguccaggaugu

SEQ ID NO: 843019 - RNA, 19 nt, Homo sapiens
guccucagguggcaguuua

SEQ ID NO: 843020 - RNA, 19 nt, Homo sapiens
ggagcuuucauuucaguua

SEQ ID NO: 843021 - RNA, 19 nt, Homo sapiens
gaaggagguuuuacugaaa

SEQ ID NO: 843022 - RNA, 19 nt, Homo sapiens
cagaggugauccaacagua

SEQ ID NO: 843023 - RNA, 19 nt, Homo sapiens
agacaaagccucagaagag

SEQ ID NO: 843024 - RNA, 19 nt, Homo sapiens
gacaacaccuacagcuuca

SEQ ID NO: 843025 - RNA, 19 nt, Homo sapiens
ugacugacccugauggaaa

SEQ ID NO: 843026 - RNA, 19 nt, Homo sapiens
gcagugauccuggcaucua

SEQ ID NO: 843027 - RNA, 19 nt, Homo sapiens
gaauccagaugacuauuuu

SEQ ID NO: 843028 - RNA, 19 nt, Homo sapiens
cagaagagaagaugaaaca

SEQ ID NO: 843029 - RNA, 19 nt, Homo sapiens
guggagaccaucaccauaa

SEQ ID NO: 843030 - RNA, 19 nt, Homo sapiens
cucaggagcuuucauuuca

SEQ ID NO: 843031 - RNA, 19 nt, Homo sapiens
ccaagaaggucaauuucac

SEQ ID NO: 843032 - RNA, 19 nt, Homo sapiens
ugaaacagcaguaugaaca

SEQ ID NO: 843033 - RNA, 19 nt, Homo sapiens
gaaacacugaagcgucuuu

SEQ ID NO: 843034 - RNA, 19 nt, Homo sapiens
gguggcaguuuaugucaga

SEQ ID NO: 843035 - RNA, 19 nt, Homo sapiens
ucaaacccuuccugaguga

SEQ ID NO: 843036 - RNA, 19 nt, Homo sapiens
caucaaacccuuccugagu

SEQ ID NO: 843037 - RNA, 19 nt, Homo sapiens
ggacgagucugugcuccau

SEQ ID NO: 843038 - RNA, 19 nt, Homo sapiens
gagcuuucauuucaguuag

SEQ ID NO: 843039 - RNA, 19 nt, Homo sapiens
gaaagauugggacuuaaca

SEQ ID NO: 843040 - RNA, 19 nt, Homo sapiens
gaauaaagcaacguucagu

SEQ ID NO: 843041 - RNA, 19 nt, Homo sapiens
caagcaguccuccauguga

SEQ ID NO: 843042 - RNA, 19 nt, Homo sapiens
agaaaagggugaaagauug

SEQ ID NO: 843043 - RNA, 19 nt, Homo sapiens
cgaauccagaugacuauuu

SEQ ID NO: 843044 - RNA, 19 nt, Homo sapiens
gugcugggcuuuagagaac

SEQ ID NO: 843045 - RNA, 19 nt, Homo sapiens
ccacaggugcugggcuuua

SEQ ID NO: 843046 - RNA, 19 nt, Homo sapiens
uguaaacugugccaacuuc

SEQ ID NO: 843047 - RNA, 19 nt, Homo sapiens
caacaccuacagcuucauu

SEQ ID NO: 843048 - RNA, 19 nt, Homo sapiens
ugaggacacucguaagaag

SEQ ID NO: 843049 - RNA, 19 nt, Homo sapiens
gagaaacuugcuccuaaau

SEQ ID NO: 843050 - RNA, 19 nt, Homo sapiens
ggaaaauuaucccgaaaca

SEQ ID NO: 843051 - RNA, 19 nt, Homo sapiens
gggugggagugaaugcuaa

SEQ ID NO: 843052 - RNA, 19 nt, Homo sapiens
gugaaagauugggacuuaa

SEQ ID NO: 843053 - RNA, 19 nt, Homo sapiens
ccaagggucugcuguucuc

SEQ ID NO: 843054 - RNA, 19 nt, Homo sapiens
aaauaacaccuucuccuau

SEQ ID NO: 843055 - RNA, 19 nt, Homo sapiens
ccaagaugcgggaguguga

SEQ ID NO: 843056 - RNA, 19 nt, Homo sapiens
gaccucaggagcuuucauu

SEQ ID NO: 843057 - RNA, 19 nt, Homo sapiens
gguccugcuuccagacaaa

SEQ ID NO: 843058 - RNA, 19 nt, Homo sapiens
ggagaccaucaccauaauu

SEQ ID NO: 843059 - RNA, 19 nt, Homo sapiens
gugagcugcuucugcaaga

SEQ ID NO: 843060 - RNA, 19 nt, Homo sapiens
caacccgcuuccugacuga

SEQ ID NO: 843061 - RNA, 19 nt, Homo sapiens
ggaggcauuggccaaguuu

SEQ ID NO: 843062 - RNA, 19 nt, Homo sapiens
ccuauaaccucaucaaacc

SEQ ID NO: 843063 - RNA, 19 nt, Homo sapiens
ccgcuguucuccaugcaaa

SEQ ID NO: 843064 - RNA, 19 nt, Homo sapiens
agaaacucuuccaaacauu

SEQ ID NO: 843065 - RNA, 19 nt, Homo sapiens
ucagaaacucuuccaaaca

SEQ ID NO: 843066 - RNA, 19 nt, Homo sapiens
gccaagaaggucaauuuca

SEQ ID NO: 843067 - RNA, 19 nt, Homo sapiens
caccaugacugacccugau

SEQ ID NO: 843068 - RNA, 19 nt, Homo sapiens
caaagcgccagggaaauga

SEQ ID NO: 843069 - RNA, 19 nt, Homo sapiens
gaaagcaaaaggacauuga

SEQ ID NO: 843070 - RNA, 19 nt, Homo sapiens
gcaaauuggaaggagguuu

SEQ ID NO: 843071 - RNA, 19 nt, Homo sapiens
gaggacacucguaagaaga

SEQ ID NO: 843072 - RNA, 19 nt, Homo sapiens
agaccaucaccauaauuua

SEQ ID NO: 843073 - RNA, 19 nt, Homo sapiens
uacuaaugauugucaguga

SEQ ID NO: 843074 - RNA, 19 nt, Homo sapiens
ugagucagcacacaucuuc

SEQ ID NO: 843075 - RNA, 19 nt, Homo sapiens
aaaggacauugacaacauc

SEQ ID NO: 843076 - RNA, 19 nt, Homo sapiens
cuccagaggugauccaaca

SEQ ID NO: 843077 - RNA, 19 nt, Homo sapiens
aaacagcaguaugaacaca

SEQ ID NO: 843078 - RNA, 19 nt, Homo sapiens
aaacuugcuccuaaaugaa

SEQ ID NO: 843079 - RNA, 19 nt, Homo sapiens
ucaguuaggcagaggaaga

SEQ ID NO: 843080 - RNA, 19 nt, Homo sapiens
ccaccagaccacaaaguug

SEQ ID NO: 843081 - RNA, 19 nt, Homo sapiens
uuacuaagcagucccaucu

SEQ ID NO: 843082 - RNA, 19 nt, Homo sapiens
acaaagcgccagggaaaug

SEQ ID NO: 843083 - RNA, 19 nt, Homo sapiens
gaggugauccaacaguauc

SEQ ID NO: 843084 - RNA, 19 nt, Homo sapiens
ucuaucaaauaccuaagga

SEQ ID NO: 843085 - RNA, 19 nt, Homo sapiens
ccucagaagagaagaugaa

SEQ ID NO: 843086 - RNA, 19 nt, Homo sapiens
ccaaguggaguaugagauc

SEQ ID NO: 843087 - RNA, 19 nt, Homo sapiens
ccaaguuucgggagaaugu

SEQ ID NO: 843088 - RNA, 19 nt, Homo sapiens
gcuggccucucccucacuu

SEQ ID NO: 843089 - RNA, 19 nt, Homo sapiens
ugggguagcuuuuggcuuu

SEQ ID NO: 843090 - RNA, 19 nt, Homo sapiens
ugucuguccuguaaacugu

SEQ ID NO: 843091 - RNA, 19 nt, Homo sapiens
caggagcuuucauuucagu

SEQ ID NO: 843092 - RNA, 19 nt, Homo sapiens
gaugaucgaugacaaugaa

SEQ ID NO: 843093 - RNA, 19 nt, Homo sapiens
ggaagaauuugacgacgaa

SEQ ID NO: 843094 - RNA, 19 nt, Homo sapiens
ccaagaaguuccucaaugu

SEQ ID NO: 843095 - RNA, 19 nt, Homo sapiens
ggacuucgcccuccucaga

SEQ ID NO: 843096 - RNA, 19 nt, Homo sapiens
ggacauaagccuggaagaa

SEQ ID NO: 843097 - RNA, 19 nt, Homo sapiens
ggacagcccugaccucacu

SEQ ID NO: 843098 - RNA, 19 nt, Homo sapiens
caucgaggcugaccugaga

SEQ ID NO: 843099 - RNA, 19 nt, Homo sapiens
cugcaaaccuuauccucua

SEQ ID NO: 843100 - RNA, 19 nt, Homo sapiens
acauaagccuggaagaauu

SEQ ID NO: 843101 - RNA, 19 nt, Homo sapiens
gcccaggacucccuaaaca

SEQ ID NO: 843102 - RNA, 19 nt, Homo sapiens
aaacaacaacggaggcuuu

SEQ ID NO: 843103 - RNA, 19 nt, Homo sapiens
gacauaagccuggaagaau

SEQ ID NO: 843104 - RNA, 19 nt, Homo sapiens
caugggaccuuacgcuugu

SEQ ID NO: 843105 - RNA, 19 nt, Homo sapiens
gcgccuuccuggaguacua

SEQ ID NO: 843106 - RNA, 19 nt, Homo sapiens
caaaccuuauccucuauuc

SEQ ID NO: 843107 - RNA, 19 nt, Homo sapiens
aaugucggcuuccaaguga

SEQ ID NO: 843108 - RNA, 19 nt, Homo sapiens
gaccucacuuucuccaaga

SEQ ID NO: 843109 - RNA, 19 nt, Homo sapiens
cauaagccuggaagaauuu

SEQ ID NO: 843110 - RNA, 19 nt, Homo sapiens
uccaagaaguuccucaaug

SEQ ID NO: 843111 - RNA, 19 nt, Homo sapiens
cgaagaggacgacgaggaa

SEQ ID NO: 843112 - RNA, 19 nt, Homo sapiens
gaggagacccuggcucaga

SEQ ID NO: 843113 - RNA, 19 nt, Homo sapiens
ucagauccguucuuucucu

SEQ ID NO: 843114 - RNA, 19 nt, Homo sapiens
aguuugagaugaucgauga

SEQ ID NO: 843115 - RNA, 19 nt, Homo sapiens
gauugccacugcccggaaa

SEQ ID NO: 843116 - RNA, 19 nt, Homo sapiens
gcguggagcugguggacau

SEQ ID NO: 843117 - RNA, 19 nt, Homo sapiens
gcccauggccucaauaaac

SEQ ID NO: 843118 - RNA, 19 nt, Homo sapiens
gcaaaccuuauccucuauu

SEQ ID NO: 843119 - RNA, 19 nt, Homo sapiens
gcccugaccucacuuucuc

SEQ ID NO: 843120 - RNA, 19 nt, Homo sapiens
ggacgaugaggacgaggaa

SEQ ID NO: 843121 - RNA, 19 nt, Homo sapiens
ccucagauccguucuuucu

SEQ ID NO: 843122 - RNA, 19 nt, Homo sapiens
cgcaacagcugcuauuucg

SEQ ID NO: 843123 - RNA, 19 nt, Homo sapiens
gcagccauuucuuccagau

SEQ ID NO: 843124 - RNA, 19 nt, Homo sapiens
agaaguuccucaaugucuu

SEQ ID NO: 843125 - RNA, 19 nt, Homo sapiens
cgcaugaucucguccaucu

SEQ ID NO: 843126 - RNA, 19 nt, Homo sapiens
gagaugaucgaugacaaug

SEQ ID NO: 843127 - RNA, 19 nt, Homo sapiens
agccauuucuuccagauga

SEQ ID NO: 843128 - RNA, 19 nt, Homo sapiens
uuccagcgcugcagccauu

SEQ ID NO: 843129 - RNA, 19 nt, Homo sapiens
acacgcuggugguggauga

SEQ ID NO: 843130 - RNA, 19 nt, Homo sapiens
ggcuaggagugguucuuga

SEQ ID NO: 843131 - RNA, 19 nt, Homo sapiens
uauccucuauucuucacuu

SEQ ID NO: 843132 - RNA, 19 nt, Homo sapiens
ccucuauucuucacuuugg

SEQ ID NO: 843133 - RNA, 19 nt, Homo sapiens
acgcgucgcugguguacga

SEQ ID NO: 843134 - RNA, 19 nt, Homo sapiens
uaaugucggcuuccaagug

SEQ ID NO: 843135 - RNA, 19 nt, Homo sapiens
gggcaacggcauccugugu

SEQ ID NO: 843136 - RNA, 19 nt, Homo sapiens
gcgcugcagccauuucuuc

SEQ ID NO: 843137 - RNA, 19 nt, Homo sapiens
gcagccaugcagaagauug

SEQ ID NO: 843138 - RNA, 19 nt, Homo sapiens
aauaaacucucugcuuggu

SEQ ID NO: 843139 - RNA, 19 nt, Homo sapiens
cccauggccucaauaaacu

SEQ ID NO: 843140 - RNA, 19 nt, Homo sapiens
aaccuuauccucuauucuu

SEQ ID NO: 843141 - RNA, 19 nt, Homo sapiens
aggaugacuuccaggaguu

SEQ ID NO: 843142 - RNA, 19 nt, Homo sapiens
uguacgacgcggucaagua

SEQ ID NO: 843143 - RNA, 19 nt, Homo sapiens
ccucgcaccucaccaacuc

SEQ ID NO: 843144 - RNA, 19 nt, Homo sapiens
caacaacggaggcuuugac

SEQ ID NO: 843145 - RNA, 19 nt, Homo sapiens
gcuaggagugguucuugau

SEQ ID NO: 843146 - RNA, 19 nt, Homo sapiens
gccauuucuuccagaugaa

SEQ ID NO: 843147 - RNA, 19 nt, Homo sapiens
caagaaguuccucaauguc

SEQ ID NO: 843148 - RNA, 19 nt, Homo sapiens
uggaggaggugcggcucua

SEQ ID NO: 843149 - RNA, 19 nt, Homo sapiens
ccugugaccucgagaucuc

SEQ ID NO: 843150 - RNA, 19 nt, Homo sapiens
gccacugcccggaaacuga

SEQ ID NO: 843151 - RNA, 19 nt, Homo sapiens
gacgaagaucugucugaga

SEQ ID NO: 843152 - RNA, 19 nt, Homo sapiens
ggaugacuuccaggaguuu

SEQ ID NO: 843153 - RNA, 19 nt, Homo sapiens
gcucuagggacagguaaug

SEQ ID NO: 843154 - RNA, 19 nt, Homo sapiens
ccgcaacagcugcuauuuc

SEQ ID NO: 843155 - RNA, 19 nt, Homo sapiens
ugagaugaucgaugacaau

SEQ ID NO: 843156 - RNA, 19 nt, Homo sapiens
agaauuugacgacgaagau

SEQ ID NO: 843157 - RNA, 19 nt, Homo sapiens
uccaggaguuugagaugau

SEQ ID NO: 843158 - RNA, 19 nt, Homo sapiens
cuacgacucagaccacugu

SEQ ID NO: 843159 - RNA, 19 nt, Homo sapiens
gaucgaugacaaugaagag

SEQ ID NO: 843160 - RNA, 19 nt, Homo sapiens
uuccucagauccguucuuu

SEQ ID NO: 843161 - RNA, 19 nt, Homo sapiens
augaagaggaggacgauga

SEQ ID NO: 843162 - RNA, 19 nt, Homo sapiens
ccgaggaggaggacgaaga

SEQ ID NO: 843163 - RNA, 19 nt, Homo sapiens
gcuccucgcaccucaccaa

SEQ ID NO: 843164 - RNA, 19 nt, Homo sapiens
ccaggacucccuaaacaac

SEQ ID NO: 843165 - RNA, 19 nt, Homo sapiens
gaugaucgaugacaaugaa

SEQ ID NO: 843166 - RNA, 19 nt, Homo sapiens
ccaagaaguuccucaaugu

SEQ ID NO: 843167 - RNA, 19 nt, Homo sapiens
ggacuucgcccuccucaga

SEQ ID NO: 843168 - RNA, 19 nt, Homo sapiens
ggacagcccugaccucacu

SEQ ID NO: 843169 - RNA, 19 nt, Homo sapiens
caucgaggcugaccugaga

SEQ ID NO: 843170 - RNA, 19 nt, Homo sapiens
cugcaaaccuuauccucua

SEQ ID NO: 843171 - RNA, 19 nt, Homo sapiens
gcccaggacucccuaaaca

SEQ ID NO: 843172 - RNA, 19 nt, Homo sapiens
aaacaacaacggaggcuuu

SEQ ID NO: 843173 - RNA, 19 nt, Homo sapiens
caugggaccuuacgcuugu

SEQ ID NO: 843174 - RNA, 19 nt, Homo sapiens
gcgccuuccuggaguacua

SEQ ID NO: 843175 - RNA, 19 nt, Homo sapiens
caaaccuuauccucuauuc

SEQ ID NO: 843176 - RNA, 19 nt, Homo sapiens
aaugucggcuuccaaguga

SEQ ID NO: 843177 - RNA, 19 nt, Homo sapiens
gaccucacuuucuccaaga

SEQ ID NO: 843178 - RNA, 19 nt, Homo sapiens
uccaagaaguuccucaaug

SEQ ID NO: 843179 - RNA, 19 nt, Homo sapiens
cgaagaggacgacgaggaa

SEQ ID NO: 843180 - RNA, 19 nt, Homo sapiens
gaggagacccuggcucaga

SEQ ID NO: 843181 - RNA, 19 nt, Homo sapiens
ucagauccguucuuucucu

SEQ ID NO: 843182 - RNA, 19 nt, Homo sapiens
aguuugagaugaucgauga

SEQ ID NO: 843183 - RNA, 19 nt, Homo sapiens
gauugccacugcccggaaa

SEQ ID NO: 843184 - RNA, 19 nt, Homo sapiens
gcguggagcugguggacau

SEQ ID NO: 843185 - RNA, 19 nt, Homo sapiens
gcccauggccucaauaaac

SEQ ID NO: 843186 - RNA, 19 nt, Homo sapiens
gcaaaccuuauccucuauu

SEQ ID NO: 843187 - RNA, 19 nt, Homo sapiens
gcccugaccucacuuucuc

SEQ ID NO: 843188 - RNA, 19 nt, Homo sapiens
ggacgaugaggacgaggaa

SEQ ID NO: 843189 - RNA, 19 nt, Homo sapiens
ccucagauccguucuuucu

SEQ ID NO: 843190 - RNA, 19 nt, Homo sapiens
cgcaacagcugcuauuucg

SEQ ID NO: 843191 - RNA, 19 nt, Homo sapiens
gcagccauuucuuccagau

SEQ ID NO: 843192 - RNA, 19 nt, Homo sapiens
gagaugaucgaugacaaug

SEQ ID NO: 843193 - RNA, 19 nt, Homo sapiens
agaaguuccucaaugucuu

SEQ ID NO: 843194 - RNA, 19 nt, Homo sapiens
cgcaugaucucguccaucu

SEQ ID NO: 843195 - RNA, 19 nt, Homo sapiens
agccauuucuuccagauga

SEQ ID NO: 843196 - RNA, 19 nt, Homo sapiens
uuccagcgcugcagccauu

SEQ ID NO: 843197 - RNA, 19 nt, Homo sapiens
acacgcuggugguggauga

SEQ ID NO: 843198 - RNA, 19 nt, Homo sapiens
ggcuaggagugguucuuga

SEQ ID NO: 843199 - RNA, 19 nt, Homo sapiens
uauccucuauucuucacuu

SEQ ID NO: 843200 - RNA, 19 nt, Homo sapiens
ccucuauucuucacuuugg

SEQ ID NO: 843201 - RNA, 19 nt, Homo sapiens
acgcgucgcugguguacga

SEQ ID NO: 843202 - RNA, 19 nt, Homo sapiens
uaaugucggcuuccaagug

SEQ ID NO: 843203 - RNA, 19 nt, Homo sapiens
gggcaacggcauccugugu

SEQ ID NO: 843204 - RNA, 19 nt, Homo sapiens
gcgcugcagccauuucuuc

SEQ ID NO: 843205 - RNA, 19 nt, Homo sapiens
gcagccaugcagaagauug

SEQ ID NO: 843206 - RNA, 19 nt, Homo sapiens
aauaaacucucugcuuggu

SEQ ID NO: 843207 - RNA, 19 nt, Homo sapiens
cccauggccucaauaaacu

SEQ ID NO: 843208 - RNA, 19 nt, Homo sapiens
aaccuuauccucuauucuu

SEQ ID NO: 843209 - RNA, 19 nt, Homo sapiens
aggaugacuuccaggaguu

SEQ ID NO: 843210 - RNA, 19 nt, Homo sapiens
uguacgacgcggucaagua

SEQ ID NO: 843211 - RNA, 19 nt, Homo sapiens
ccucgcaccucaccaacuc

SEQ ID NO: 843212 - RNA, 19 nt, Homo sapiens
caacaacggaggcuuugac

SEQ ID NO: 843213 - RNA, 19 nt, Homo sapiens
gcuaggagugguucuugau

SEQ ID NO: 843214 - RNA, 19 nt, Homo sapiens
gccauuucuuccagaugaa

SEQ ID NO: 843215 - RNA, 19 nt, Homo sapiens
caagaaguuccucaauguc

SEQ ID NO: 843216 - RNA, 19 nt, Homo sapiens
uggaggaggugcggcucua

SEQ ID NO: 843217 - RNA, 19 nt, Homo sapiens
ggaugacuuccaggaguuu

SEQ ID NO: 843218 - RNA, 19 nt, Homo sapiens
ccugugaccucgagaucuc

SEQ ID NO: 843219 - RNA, 19 nt, Homo sapiens
gccacugcccggaaacuga

SEQ ID NO: 843220 - RNA, 19 nt, Homo sapiens
gcucuagggacagguaaug

SEQ ID NO: 843221 - RNA, 19 nt, Homo sapiens
uccaggaguuugagaugau

SEQ ID NO: 843222 - RNA, 19 nt, Homo sapiens
ugagaugaucgaugacaau

SEQ ID NO: 843223 - RNA, 19 nt, Homo sapiens
ccgcaacagcugcuauuuc

SEQ ID NO: 843224 - RNA, 19 nt, Homo sapiens
gaucgaugacaaugaagag

SEQ ID NO: 843225 - RNA, 19 nt, Homo sapiens
augaagaggaggacgauga

SEQ ID NO: 843226 - RNA, 19 nt, Homo sapiens
uuccucagauccguucuuu

SEQ ID NO: 843227 - RNA, 19 nt, Homo sapiens
ccgaggaggaggacgaaga

SEQ ID NO: 843228 - RNA, 19 nt, Homo sapiens
ccaggacucccuaaacaac

SEQ ID NO: 843229 - RNA, 19 nt, Homo sapiens
gcuccucgcaccucaccaa

SEQ ID NO: 843230 - RNA, 19 nt, Homo sapiens
gaugaucgaugacaaugaa

SEQ ID NO: 843231 - RNA, 19 nt, Homo sapiens
ggaagaauuugacgacgaa

SEQ ID NO: 843232 - RNA, 19 nt, Homo sapiens
ccaagaaguuccucaaugu

SEQ ID NO: 843233 - RNA, 19 nt, Homo sapiens
ggacauaagccuggaagaa

SEQ ID NO: 843234 - RNA, 19 nt, Homo sapiens
ggacagcccugaccucacu

SEQ ID NO: 843235 - RNA, 19 nt, Homo sapiens
cugcaaaccuuauccucua

SEQ ID NO: 843236 - RNA, 19 nt, Homo sapiens
acauaagccuggaagaauu

SEQ ID NO: 843237 - RNA, 19 nt, Homo sapiens
gacauaagccuggaagaau

SEQ ID NO: 843238 - RNA, 19 nt, Homo sapiens
caugggaccuuacgcuugu

SEQ ID NO: 843239 - RNA, 19 nt, Homo sapiens
gcgccuuccuggaguacua

SEQ ID NO: 843240 - RNA, 19 nt, Homo sapiens
caaaccuuauccucuauuc

SEQ ID NO: 843241 - RNA, 19 nt, Homo sapiens
aaugucggcuuccaaguga

SEQ ID NO: 843242 - RNA, 19 nt, Homo sapiens
cauaagccuggaagaauuu

SEQ ID NO: 843243 - RNA, 19 nt, Homo sapiens
gaccucacuuucuccaaga

SEQ ID NO: 843244 - RNA, 19 nt, Homo sapiens
uccaagaaguuccucaaug

SEQ ID NO: 843245 - RNA, 19 nt, Homo sapiens
cgaagaggacgacgaggaa

SEQ ID NO: 843246 - RNA, 19 nt, Homo sapiens
ucagauccguucuuucucu

SEQ ID NO: 843247 - RNA, 19 nt, Homo sapiens
aguuugagaugaucgauga

SEQ ID NO: 843248 - RNA, 19 nt, Homo sapiens
gauugccacugcccggaaa

SEQ ID NO: 843249 - RNA, 19 nt, Homo sapiens
gcccauggccucaauaaac

SEQ ID NO: 843250 - RNA, 19 nt, Homo sapiens
gcaaaccuuauccucuauu

SEQ ID NO: 843251 - RNA, 19 nt, Homo sapiens
gcccugaccucacuuucuc

SEQ ID NO: 843252 - RNA, 19 nt, Homo sapiens
ccucagauccguucuuucu

SEQ ID NO: 843253 - RNA, 19 nt, Homo sapiens
cgcaacagcugcuauuucg

SEQ ID NO: 843254 - RNA, 19 nt, Homo sapiens
gcagccauuucuuccagau

SEQ ID NO: 843255 - RNA, 19 nt, Homo sapiens
agaaguuccucaaugucuu

SEQ ID NO: 843256 - RNA, 19 nt, Homo sapiens
gagaugaucgaugacaaug

SEQ ID NO: 843257 - RNA, 19 nt, Homo sapiens
agccauuucuuccagauga

SEQ ID NO: 843258 - RNA, 19 nt, Homo sapiens
uuccagcgcugcagccauu

SEQ ID NO: 843259 - RNA, 19 nt, Homo sapiens
acacgcuggugguggauga

SEQ ID NO: 843260 - RNA, 19 nt, Homo sapiens
ggcuaggagugguucuuga

SEQ ID NO: 843261 - RNA, 19 nt, Homo sapiens
uauccucuauucuucacuu

SEQ ID NO: 843262 - RNA, 19 nt, Homo sapiens
ccucuauucuucacuuugg

SEQ ID NO: 843263 - RNA, 19 nt, Homo sapiens
acgcgucgcugguguacga

SEQ ID NO: 843264 - RNA, 19 nt, Homo sapiens
uaaugucggcuuccaagug

SEQ ID NO: 843265 - RNA, 19 nt, Homo sapiens
gggcaacggcauccugugu

SEQ ID NO: 843266 - RNA, 19 nt, Homo sapiens
gcgcugcagccauuucuuc

SEQ ID NO: 843267 - RNA, 19 nt, Homo sapiens
gcagccaugcagaagauug

SEQ ID NO: 843268 - RNA, 19 nt, Homo sapiens
aauaaacucucugcuuggu

SEQ ID NO: 843269 - RNA, 19 nt, Homo sapiens
cccauggccucaauaaacu

SEQ ID NO: 843270 - RNA, 19 nt, Homo sapiens
aggaugacuuccaggaguu

SEQ ID NO: 843271 - RNA, 19 nt, Homo sapiens
aaccuuauccucuauucuu

SEQ ID NO: 843272 - RNA, 19 nt, Homo sapiens
uguacgacgcggucaagua

SEQ ID NO: 843273 - RNA, 19 nt, Homo sapiens
gcuaggagugguucuugau

SEQ ID NO: 843274 - RNA, 19 nt, Homo sapiens
gccauuucuuccagaugaa

SEQ ID NO: 843275 - RNA, 19 nt, Homo sapiens
caagaaguuccucaauguc

SEQ ID NO: 843276 - RNA, 19 nt, Homo sapiens
caaugaagaggaggacgaa

SEQ ID NO: 843277 - RNA, 19 nt, Homo sapiens
uggaggaggugcggcucua

SEQ ID NO: 843278 - RNA, 19 nt, Homo sapiens
gacgaagaucugucugaga

SEQ ID NO: 843279 - RNA, 19 nt, Homo sapiens
ccugugaccucgagaucuc

SEQ ID NO: 843280 - RNA, 19 nt, Homo sapiens
gccacugcccggaaacuga

SEQ ID NO: 843281 - RNA, 19 nt, Homo sapiens
ggaugacuuccaggaguuu

SEQ ID NO: 843282 - RNA, 19 nt, Homo sapiens
gcucuagggacagguaaug

SEQ ID NO: 843283 - RNA, 19 nt, Homo sapiens
uccaggaguuugagaugau

SEQ ID NO: 843284 - RNA, 19 nt, Homo sapiens
agaauuugacgacgaagau

SEQ ID NO: 843285 - RNA, 19 nt, Homo sapiens
ccgcaacagcugcuauuuc

SEQ ID NO: 843286 - RNA, 19 nt, Homo sapiens
ugagaugaucgaugacaau

SEQ ID NO: 843287 - RNA, 19 nt, Homo sapiens
gaucgaugacaaugaagag

SEQ ID NO: 843288 - RNA, 19 nt, Homo sapiens
cuacgacucagaccacugu

SEQ ID NO: 843289 - RNA, 19 nt, Homo sapiens
uuccucagauccguucuuu

SEQ ID NO: 843290 - RNA, 19 nt, Homo sapiens
gcaaaugguuggaaauuaa

SEQ ID NO: 843291 - RNA, 19 nt, Homo sapiens
uuacaaagcaggagaauua

SEQ ID NO: 843292 - RNA, 19 nt, Homo sapiens
gaaaucagcagacagaauu

SEQ ID NO: 843293 - RNA, 19 nt, Homo sapiens
gaaauuaagcccaguaguu

SEQ ID NO: 843294 - RNA, 19 nt, Homo sapiens
gcaacaggauauucuucua

SEQ ID NO: 843295 - RNA, 19 nt, Homo sapiens
gcagagggcggacaguaua

SEQ ID NO: 843296 - RNA, 19 nt, Homo sapiens
gaggaacucuauagcaaga

SEQ ID NO: 843297 - RNA, 19 nt, Homo sapiens
guucguaacuuucgagaau

SEQ ID NO: 843298 - RNA, 19 nt, Homo sapiens
ggaggaaggagagacauua

SEQ ID NO: 843299 - RNA, 19 nt, Homo sapiens
gugcuuagcuuauucuauc

SEQ ID NO: 843300 - RNA, 19 nt, Homo sapiens
gcacguguaaugaccaaua

SEQ ID NO: 843301 - RNA, 19 nt, Homo sapiens
gauaugcagccuacagaua

SEQ ID NO: 843302 - RNA, 19 nt, Homo sapiens
gcagauguuugggcaguuu

SEQ ID NO: 843303 - RNA, 19 nt, Homo sapiens
gcugauagauaggaauuug

SEQ ID NO: 843304 - RNA, 19 nt, Homo sapiens
gaucagaaaucagcagaca

SEQ ID NO: 843305 - RNA, 19 nt, Homo sapiens
uuccaaagauugugcauuu

SEQ ID NO: 843306 - RNA, 19 nt, Homo sapiens
gaucaauuacccacccuua

SEQ ID NO: 843307 - RNA, 19 nt, Homo sapiens
gagcauaaccugacacucu

SEQ ID NO: 843308 - RNA, 19 nt, Homo sapiens
cugcaugucucuaauauuc

SEQ ID NO: 843309 - RNA, 19 nt, Homo sapiens
cuucuagucuucugaguuu

SEQ ID NO: 843310 - RNA, 19 nt, Homo sapiens
cuacugaagugacgugaga

SEQ ID NO: 843311 - RNA, 19 nt, Homo sapiens
ggaaaacgguauaaagaga

SEQ ID NO: 843312 - RNA, 19 nt, Homo sapiens
gaauccacaugcugauaga

SEQ ID NO: 843313 - RNA, 19 nt, Homo sapiens
ggaaggagagacauuagga

SEQ ID NO: 843314 - RNA, 19 nt, Homo sapiens
ggaacucuauagcaagaug

SEQ ID NO: 843315 - RNA, 19 nt, Homo sapiens
caacaacuccugacgcaau

SEQ ID NO: 843316 - RNA, 19 nt, Homo sapiens
gcuuuccucuccuccuuua

SEQ ID NO: 843317 - RNA, 19 nt, Homo sapiens
guaaugaccaauaagaaga

SEQ ID NO: 843318 - RNA, 19 nt, Homo sapiens
ucaauuacccacccuuaaa

SEQ ID NO: 843319 - RNA, 19 nt, Homo sapiens
gauaggaauuugugcuuac

SEQ ID NO: 843320 - RNA, 19 nt, Homo sapiens
gacauuaggagccgauaaa

SEQ ID NO: 843321 - RNA, 19 nt, Homo sapiens
ugcaaaugguuggaaauua

SEQ ID NO: 843322 - RNA, 19 nt, Homo sapiens
gcauuuccaugucuguaug

SEQ ID NO: 843323 - RNA, 19 nt, Homo sapiens
gauucggguucguaacuuu

SEQ ID NO: 843324 - RNA, 19 nt, Homo sapiens
agacagaauuaccaaagug

SEQ ID NO: 843325 - RNA, 19 nt, Homo sapiens
caacacuuacauuccuuua

SEQ ID NO: 843326 - RNA, 19 nt, Homo sapiens
gccacacacucaagacuau

SEQ ID NO: 843327 - RNA, 19 nt, Homo sapiens
agauaggaauuugugcuua

SEQ ID NO: 843328 - RNA, 19 nt, Homo sapiens
ggauauucuucuagucuuc

SEQ ID NO: 843329 - RNA, 19 nt, Homo sapiens
ucagaaaucagcagacaga

SEQ ID NO: 843330 - RNA, 19 nt, Homo sapiens
gcagacagaauuaccaaag

SEQ ID NO: 843331 - RNA, 19 nt, Homo sapiens
aagcagaaguggaagagau

SEQ ID NO: 843332 - RNA, 19 nt, Homo sapiens
gggacaagcagaaguggaa

SEQ ID NO: 843333 - RNA, 19 nt, Homo sapiens
aaauuaagcccaguaguug

SEQ ID NO: 843334 - RNA, 19 nt, Homo sapiens
ggucacaccauaugcaaau

SEQ ID NO: 843335 - RNA, 19 nt, Homo sapiens
gguaucaacacuuacauuc

SEQ ID NO: 843336 - RNA, 19 nt, Homo sapiens
cacguguaaugaccaauaa

SEQ ID NO: 843337 - RNA, 19 nt, Homo sapiens
caucuauccguuugguuua

SEQ ID NO: 843338 - RNA, 19 nt, Homo sapiens
ggaauccacaugcugauag

SEQ ID NO: 843339 - RNA, 19 nt, Homo sapiens
uguauaugguccggaguua

SEQ ID NO: 843340 - RNA, 19 nt, Homo sapiens
ucacagacacaaaguagug

SEQ ID NO: 843341 - RNA, 19 nt, Homo sapiens
auagcaagaugaagaggaa

SEQ ID NO: 843342 - RNA, 19 nt, Homo sapiens
gccgauaaaugcaucugau

SEQ ID NO: 843343 - RNA, 19 nt, Homo sapiens
cccaguaguuggagcugua

SEQ ID NO: 843344 - RNA, 19 nt, Homo sapiens
caacaggauauucuucuag

SEQ ID NO: 843345 - RNA, 19 nt, Homo sapiens
cagacagaauuaccaaagu

SEQ ID NO: 843346 - RNA, 19 nt, Homo sapiens
aaaucgaggugaauaaugc

SEQ ID NO: 843347 - RNA, 19 nt, Homo sapiens
uuaaugaacguggcucuaa

SEQ ID NO: 843348 - RNA, 19 nt, Homo sapiens
gcaaaauccuagauguaga

SEQ ID NO: 843349 - RNA, 19 nt, Homo sapiens
caaagcaggagaauuaaaa

SEQ ID NO: 843350 - RNA, 19 nt, Homo sapiens
ccuuuaaauuucugccuuu

SEQ ID NO: 843351 - RNA, 19 nt, Homo sapiens
ggauucggguucguaacuu

SEQ ID NO: 843352 - RNA, 19 nt, Homo sapiens
acgcaaugguucagccuuu

SEQ ID NO: 843353 - RNA, 19 nt, Homo sapiens
caauuacccacccuuaaau

SEQ ID NO: 843354 - RNA, 19 nt, Homo sapiens
ggcugcaugucucuaauau

SEQ ID NO: 843355 - RNA, 19 nt, Homo sapiens
caacucacccagcacacaa

SEQ ID NO: 843356 - RNA, 19 nt, Homo sapiens
cugaguuucuggucuuuga

SEQ ID NO: 843357 - RNA, 19 nt, Homo sapiens
cagaauuaccaaaguguau

SEQ ID NO: 843358 - RNA, 19 nt, Homo sapiens
aauaaugcauuuccauguc

SEQ ID NO: 843359 - RNA, 19 nt, Homo sapiens
ccgcuuacagugacgguua

SEQ ID NO: 843360 - RNA, 19 nt, Homo sapiens
gaguaaaucuaccccgaaa

SEQ ID NO: 843361 - RNA, 19 nt, Homo sapiens
agcauaaccugacacucua

SEQ ID NO: 843362 - RNA, 19 nt, Homo sapiens
ucaucuauccguuugguuu

SEQ ID NO: 843363 - RNA, 19 nt, Homo sapiens
uguaucuggugcugaauga

SEQ ID NO: 843364 - RNA, 19 nt, Homo sapiens
guauguccgugcuuagcuu

SEQ ID NO: 843365 - RNA, 19 nt, Homo sapiens
uaaugaacguggcucuaag

SEQ ID NO: 843366 - RNA, 19 nt, Homo sapiens
gaaggaaaacgguauaaag

SEQ ID NO: 843367 - RNA, 19 nt, Homo sapiens
gaacucuauagcaagauga

SEQ ID NO: 843368 - RNA, 19 nt, Homo sapiens
caugaggccuggcuauugc

SEQ ID NO: 843369 - RNA, 19 nt, Homo sapiens
uaucaacacuuacauuccu

SEQ ID NO: 843370 - RNA, 19 nt, Homo sapiens
aaguguaucuggugcugaa

SEQ ID NO: 843371 - RNA, 19 nt, Homo sapiens
ggccagaccggugagcaua

SEQ ID NO: 843372 - RNA, 19 nt, Homo sapiens
ggaauucccacagaguaug

SEQ ID NO: 843373 - RNA, 19 nt, Homo sapiens
cgauaaaugcaucugauca

SEQ ID NO: 843374 - RNA, 19 nt, Homo sapiens
gccgcuagcuauggaguug

SEQ ID NO: 843375 - RNA, 19 nt, Homo sapiens
gauaaaugcaucugaucag

SEQ ID NO: 843376 - RNA, 19 nt, Homo sapiens
cggaagaggcagucaagga

SEQ ID NO: 843377 - RNA, 19 nt, Homo sapiens
auaccucacuauguucuuu

SEQ ID NO: 843378 - RNA, 19 nt, Homo sapiens
gcacagccugcuacugcaa

SEQ ID NO: 843379 - RNA, 19 nt, Homo sapiens
acccuuaaauagcuagauu

SEQ ID NO: 843380 - RNA, 19 nt, Homo sapiens
uuuaucaucuauccguuug

SEQ ID NO: 843381 - RNA, 19 nt, Homo sapiens
gcgcuguggcgaguuuaua

SEQ ID NO: 843382 - RNA, 19 nt, Homo sapiens
acaaagcaggagaauuaaa

SEQ ID NO: 843383 - RNA, 19 nt, Homo sapiens
gaggaaggagagacauuag

SEQ ID NO: 843384 - RNA, 19 nt, Homo sapiens
agacagggccagggagaaa

SEQ ID NO: 843385 - RNA, 19 nt, Homo sapiens
cgagaauagugcugaugca

SEQ ID NO: 843386 - RNA, 19 nt, Homo sapiens
gcaaugguucagccuuuua

SEQ ID NO: 843387 - RNA, 19 nt, Homo sapiens
gucuguauguccgugcuua

SEQ ID NO: 843388 - RNA, 19 nt, Homo sapiens
ucaugaggccuggcuauug

SEQ ID NO: 843389 - RNA, 19 nt, Homo sapiens
cagcacguguaaugaccaa

SEQ ID NO: 843390 - RNA, 19 nt, Homo sapiens
caaacuaacuggugucuuu

SEQ ID NO: 843391 - RNA, 19 nt, Homo sapiens
gaaaggagaaguugguuua

SEQ ID NO: 843392 - RNA, 19 nt, Homo sapiens
gcaaagagcacccugaaga

SEQ ID NO: 843393 - RNA, 19 nt, Homo sapiens
ggaaagggccagggauuua

SEQ ID NO: 843394 - RNA, 19 nt, Homo sapiens
gagcaacagugacaucuug

SEQ ID NO: 843395 - RNA, 19 nt, Homo sapiens
gcgcuaagaugcugacaug

SEQ ID NO: 843396 - RNA, 19 nt, Homo sapiens
ggccagggauuuaucauga

SEQ ID NO: 843397 - RNA, 19 nt, Homo sapiens
ggacaaaggugagaaugag

SEQ ID NO: 843398 - RNA, 19 nt, Homo sapiens
gguuuaggguuucauuuaa

SEQ ID NO: 843399 - RNA, 19 nt, Homo sapiens
caagucagcucuucucuac

SEQ ID NO: 843400 - RNA, 19 nt, Homo sapiens
cacaagaugucgcuacuau

SEQ ID NO: 843401 - RNA, 19 nt, Homo sapiens
gacccgaccuauaacauug

SEQ ID NO: 843402 - RNA, 19 nt, Homo sapiens
caagaugucgcuacuauuc

SEQ ID NO: 843403 - RNA, 19 nt, Homo sapiens
gagaggcaguccuggcaaa

SEQ ID NO: 843404 - RNA, 19 nt, Homo sapiens
ggaggagccuacauuuaca

SEQ ID NO: 843405 - RNA, 19 nt, Homo sapiens
cauccgacccgaccuauaa

SEQ ID NO: 843406 - RNA, 19 nt, Homo sapiens
gaacauggcccuggcuauc

SEQ ID NO: 843407 - RNA, 19 nt, Homo sapiens
gaaacugccuucgcucaag

SEQ ID NO: 843408 - RNA, 19 nt, Homo sapiens
gcacauacaacgugacagu

SEQ ID NO: 843409 - RNA, 19 nt, Homo sapiens
ccagcucucugcaguguga

SEQ ID NO: 843410 - RNA, 19 nt, Homo sapiens
aacaaaggguuacggguuu

SEQ ID NO: 843411 - RNA, 19 nt, Homo sapiens
gggaggagccuacauuuac

SEQ ID NO: 843412 - RNA, 19 nt, Homo sapiens
gaaagggccagggauuuau

SEQ ID NO: 843413 - RNA, 19 nt, Homo sapiens
gagaaaggccacugcuaug

SEQ ID NO: 843414 - RNA, 19 nt, Homo sapiens
accacuaccuccaccauua

SEQ ID NO: 843415 - RNA, 19 nt, Homo sapiens
acauagagguaucaaggaa

SEQ ID NO: 843416 - RNA, 19 nt, Homo sapiens
gauauccaguuccugaauc

SEQ ID NO: 843417 - RNA, 19 nt, Homo sapiens
cauccgauuugaagcguuu

SEQ ID NO: 843418 - RNA, 19 nt, Homo sapiens
ugagaaaggccacugcuau

SEQ ID NO: 843419 - RNA, 19 nt, Homo sapiens
cauacaacgugacagucua

SEQ ID NO: 843420 - RNA, 19 nt, Homo sapiens
ggagaaaggagaaguuggu

SEQ ID NO: 843421 - RNA, 19 nt, Homo sapiens
cguggaaggugaagauugu

SEQ ID NO: 843422 - RNA, 19 nt, Homo sapiens
gggagaugcuagcccuuug

SEQ ID NO: 843423 - RNA, 19 nt, Homo sapiens
gaagauccacgugggagaa

SEQ ID NO: 843424 - RNA, 19 nt, Homo sapiens
ucacucgacccgcuuaauu

SEQ ID NO: 843425 - RNA, 19 nt, Homo sapiens
cagaaucaccuaccagugu

SEQ ID NO: 843426 - RNA, 19 nt, Homo sapiens
ccuauaacauugggacuau

SEQ ID NO: 843427 - RNA, 19 nt, Homo sapiens
cccgagacauuuauccaaa

SEQ ID NO: 843428 - RNA, 19 nt, Homo sapiens
cuucuuagauauccaguuc

SEQ ID NO: 843429 - RNA, 19 nt, Homo sapiens
ccacgugggagaagagaaa

SEQ ID NO: 843430 - RNA, 19 nt, Homo sapiens
aaugggaacuucacuacau

SEQ ID NO: 843431 - RNA, 19 nt, Homo sapiens
gauuugaagcguuugagaa

SEQ ID NO: 843432 - RNA, 19 nt, Homo sapiens
ucacuucgcagcccuaugu

SEQ ID NO: 843433 - RNA, 19 nt, Homo sapiens
ggauuuaucaugaacuaca

SEQ ID NO: 843434 - RNA, 19 nt, Homo sapiens
gaaaggccacugcuaugag

SEQ ID NO: 843435 - RNA, 19 nt, Homo sapiens
aaaccgagagugucccuuu

SEQ ID NO: 843436 - RNA, 19 nt, Homo sapiens
ccaacaccaucuccgucua

SEQ ID NO: 843437 - RNA, 19 nt, Homo sapiens
agugugagcuucuccaauc

SEQ ID NO: 843438 - RNA, 19 nt, Homo sapiens
gaagagagagugguaacag

SEQ ID NO: 843439 - RNA, 19 nt, Homo sapiens
gaagggagggagggagaaa

SEQ ID NO: 843440 - RNA, 19 nt, Homo sapiens
gaacuacauagagguauca

SEQ ID NO: 843441 - RNA, 19 nt, Homo sapiens
gcuaugagcccuacaucca

SEQ ID NO: 843442 - RNA, 19 nt, Homo sapiens
auagagguaucaaggaaug

SEQ ID NO: 843443 - RNA, 19 nt, Homo sapiens
agacuuaaccauccaguuc

SEQ ID NO: 843444 - RNA, 19 nt, Homo sapiens
ucaaugugcgggacccaua

SEQ ID NO: 843445 - RNA, 19 nt, Homo sapiens
gcaggugaagguccuaaau

SEQ ID NO: 843446 - RNA, 19 nt, Homo sapiens
agucagcucuucucuacga

SEQ ID NO: 843447 - RNA, 19 nt, Homo sapiens
gccagggauuuaucaugaa

SEQ ID NO: 843448 - RNA, 19 nt, Homo sapiens
caucaucgaaugcaucaau

SEQ ID NO: 843449 - RNA, 19 nt, Homo sapiens
gcuaagaugcugacaugca

SEQ ID NO: 843450 - RNA, 19 nt, Homo sapiens
augcugagcugcaacuuuc

SEQ ID NO: 843451 - RNA, 19 nt, Homo sapiens
gcugggaggagccuacauu

SEQ ID NO: 843452 - RNA, 19 nt, Homo sapiens
ccacuucucacacggaguu

SEQ ID NO: 843453 - RNA, 19 nt, Homo sapiens
cccaaaagguuuaggguuu

SEQ ID NO: 843454 - RNA, 19 nt, Homo sapiens
ugggaggagccuacauuua

SEQ ID NO: 843455 - RNA, 19 nt, Homo sapiens
guucucuucugaccugcua

SEQ ID NO: 843456 - RNA, 19 nt, Homo sapiens
cuaaaucuccccaaacuaa

SEQ ID NO: 843457 - RNA, 19 nt, Homo sapiens
aaggagaaguugguuuaga

SEQ ID NO: 843458 - RNA, 19 nt, Homo sapiens
ggaccaccauccaauacac

SEQ ID NO: 843459 - RNA, 19 nt, Homo sapiens
agagcacccugaagagaga

SEQ ID NO: 843460 - RNA, 19 nt, Homo sapiens
caugaacuacauagaggua

SEQ ID NO: 843461 - RNA, 19 nt, Homo sapiens
cgacccgaccuauaacauu

SEQ ID NO: 843462 - RNA, 19 nt, Homo sapiens
agaaaggccacugcuauga

SEQ ID NO: 843463 - RNA, 19 nt, Homo sapiens
caacaagucagcucuucuc

SEQ ID NO: 843464 - RNA, 19 nt, Homo sapiens
cgaggaggcaucagaagug

SEQ ID NO: 843465 - RNA, 19 nt, Homo sapiens
gagccuacauuuacaucac

SEQ ID NO: 843466 - RNA, 19 nt, Homo sapiens
gagccagaaucaccuacca

SEQ ID NO: 843467 - RNA, 19 nt, Homo sapiens
ggaccuuccagcuucacua

SEQ ID NO: 843468 - RNA, 19 nt, Homo sapiens
caccaucuccgucuacuuc

SEQ ID NO: 843469 - RNA, 19 nt, Homo sapiens
uacccgagauccagaaugg

SEQ ID NO: 843470 - RNA, 19 nt, Homo sapiens
agggauuuaucaugaacua

SEQ ID NO: 843471 - RNA, 19 nt, Homo sapiens
gacccauacuggaaugaca

SEQ ID NO: 843472 - RNA, 19 nt, Homo sapiens
cagaaugggaacuucacua

SEQ ID NO: 843473 - RNA, 19 nt, Homo sapiens
caaaugggagccaauucug

SEQ ID NO: 843474 - RNA, 19 nt, Homo sapiens
caaagagcacccugaagag

SEQ ID NO: 843475 - RNA, 19 nt, Homo sapiens
caccagcucucugcagugu

SEQ ID NO: 843476 - RNA, 19 nt, Homo sapiens
gagggagaaaggagaaguu

SEQ ID NO: 843477 - RNA, 19 nt, Homo sapiens
agguuuaggguuucauuua

SEQ ID NO: 843478 - RNA, 19 nt, Homo sapiens
ugaacuacauagagguauc

SEQ ID NO: 843479 - RNA, 19 nt, Homo sapiens
acagugacaucuugaccau

SEQ ID NO: 843480 - RNA, 19 nt, Homo sapiens
uaacauugggacuauagug

SEQ ID NO: 843481 - RNA, 19 nt, Homo sapiens
cgagacauuuauccaaagg

SEQ ID NO: 843482 - RNA, 19 nt, Homo sapiens
aaagagcacccugaagaga

SEQ ID NO: 843483 - RNA, 19 nt, Homo sapiens
ggcccuggcuaucuucauc

SEQ ID NO: 843484 - RNA, 19 nt, Homo sapiens
ggaacauggcccuggcuau

SEQ ID NO: 843485 - RNA, 19 nt, Homo sapiens
gagaaaggagaaguugguu

SEQ ID NO: 843486 - RNA, 19 nt, Homo sapiens
gaaugggaacuucacuaca

SEQ ID NO: 843487 - RNA, 19 nt, Homo sapiens
ccacuaccuccaccauuau

SEQ ID NO: 843488 - RNA, 19 nt, Homo sapiens
cacucgacccgcuuaauuu

SEQ ID NO: 843489 - RNA, 19 nt, Homo sapiens
ggaucacucgacccgcuua

SEQ ID NO: 843490 - RNA, 19 nt, Homo sapiens
ggaagaaguucaacauuua

SEQ ID NO: 843491 - RNA, 19 nt, Homo sapiens
gaagauggauguagagaaa

SEQ ID NO: 843492 - RNA, 19 nt, Homo sapiens
gcagaaaccuccagaguug

SEQ ID NO: 843493 - RNA, 19 nt, Homo sapiens
caacaagcuuucagauuua

SEQ ID NO: 843494 - RNA, 19 nt, Homo sapiens
ccaacaagcuuucagauuu

SEQ ID NO: 843495 - RNA, 19 nt, Homo sapiens
gaagaggugugaagagcua

SEQ ID NO: 843496 - RNA, 19 nt, Homo sapiens
gaaacagguucuagaaaug

SEQ ID NO: 843497 - RNA, 19 nt, Homo sapiens
guagagaaauggcguguga

SEQ ID NO: 843498 - RNA, 19 nt, Homo sapiens
gcaccaaauuuguuccuuu

SEQ ID NO: 843499 - RNA, 19 nt, Homo sapiens
gcgauucuuuguuggauua

SEQ ID NO: 843500 - RNA, 19 nt, Homo sapiens
ugacauagccaaauaauuc

SEQ ID NO: 843501 - RNA, 19 nt, Homo sapiens
gaggagggcucgagagaga

SEQ ID NO: 843502 - RNA, 19 nt, Homo sapiens
ugagagaagucacuaagaa

SEQ ID NO: 843503 - RNA, 19 nt, Homo sapiens
ggagaaugaccauguuaua

SEQ ID NO: 843504 - RNA, 19 nt, Homo sapiens
ccacaaaucgccucacuuu

SEQ ID NO: 843505 - RNA, 19 nt, Homo sapiens
ugaaacagguucuagaaau

SEQ ID NO: 843506 - RNA, 19 nt, Homo sapiens
caucaaaguucaauaacga

SEQ ID NO: 843507 - RNA, 19 nt, Homo sapiens
ggaagggcuuucugcguuu

SEQ ID NO: 843508 - RNA, 19 nt, Homo sapiens
gaaagauagugaggaagaa

SEQ ID NO: 843509 - RNA, 19 nt, Homo sapiens
ggaaagauagugaggaaga

SEQ ID NO: 843510 - RNA, 19 nt, Homo sapiens
aggaagaaguucaacauuu

SEQ ID NO: 843511 - RNA, 19 nt, Homo sapiens
gggaauauuuaaccacuug

SEQ ID NO: 843512 - RNA, 19 nt, Homo sapiens
ccacaagguuaagaagaua

SEQ ID NO: 843513 - RNA, 19 nt, Homo sapiens
gcauugauccuauuuggaa

SEQ ID NO: 843514 - RNA, 19 nt, Homo sapiens
agagagcgauucuuuguug

SEQ ID NO: 843515 - RNA, 19 nt, Homo sapiens
gcuacacacuuauaaggaa

SEQ ID NO: 843516 - RNA, 19 nt, Homo sapiens
gcaggaguauguccagaga

SEQ ID NO: 843517 - RNA, 19 nt, Homo sapiens
ucagauuuauggagaauga

SEQ ID NO: 843518 - RNA, 19 nt, Homo sapiens
caaauuuguuccuuucuca

SEQ ID NO: 843519 - RNA, 19 nt, Homo sapiens
gugaagagcuagagcgaau

SEQ ID NO: 843520 - RNA, 19 nt, Homo sapiens
caaagucagucaaccuguu

SEQ ID NO: 843521 - RNA, 19 nt, Homo sapiens
cuaaaucagucacaagaga

SEQ ID NO: 843522 - RNA, 19 nt, Homo sapiens
gcagcuggauccaagcauu

SEQ ID NO: 843523 - RNA, 19 nt, Homo sapiens
gaacaaauucuacguuggu

SEQ ID NO: 843524 - RNA, 19 nt, Homo sapiens
gguggaagauggauguaga

SEQ ID NO: 843525 - RNA, 19 nt, Homo sapiens
ugaggcaagugcuauguaa

SEQ ID NO: 843526 - RNA, 19 nt, Homo sapiens
auaagaagauggugcuuug

SEQ ID NO: 843527 - RNA, 19 nt, Homo sapiens
caagagaucaugaggaugu

SEQ ID NO: 843528 - RNA, 19 nt, Homo sapiens
gguagaauuucagaacaaa

SEQ ID NO: 843529 - RNA, 19 nt, Homo sapiens
cacaagagaucaugaggau

SEQ ID NO: 843530 - RNA, 19 nt, Homo sapiens
gccaaauaauucuguaaga

SEQ ID NO: 843531 - RNA, 19 nt, Homo sapiens
gaaauggcgugugaagagu

SEQ ID NO: 843532 - RNA, 19 nt, Homo sapiens
gaaccggaguggcuacaca

SEQ ID NO: 843533 - RNA, 19 nt, Homo sapiens
cagauuggccacaagguua

SEQ ID NO: 843534 - RNA, 19 nt, Homo sapiens
gaagagcuagagcgaauau

SEQ ID NO: 843535 - RNA, 19 nt, Homo sapiens
acacuggccucaucuacaa

SEQ ID NO: 843536 - RNA, 19 nt, Homo sapiens
gaacugagagaagucacua

SEQ ID NO: 843537 - RNA, 19 nt, Homo sapiens
caucaucaccuucccguuu

SEQ ID NO: 843538 - RNA, 19 nt, Homo sapiens
ugaacccacuuaugaagaa

SEQ ID NO: 843539 - RNA, 19 nt, Homo sapiens
gcugggaagccaagauaua

SEQ ID NO: 843540 - RNA, 19 nt, Homo sapiens
caucuucauuacugccuua

SEQ ID NO: 843541 - RNA, 19 nt, Homo sapiens
gacuuucacuuaugucaga

SEQ ID NO: 843542 - RNA, 19 nt, Homo sapiens
gccacaagguuaagaagau

SEQ ID NO: 843543 - RNA, 19 nt, Homo sapiens
gcucgagguugaacugaga

SEQ ID NO: 843544 - RNA, 19 nt, Homo sapiens
gaaugaccauguuauagac

SEQ ID NO: 843545 - RNA, 19 nt, Homo sapiens
ggguagaauuucagaacaa

SEQ ID NO: 843546 - RNA, 19 nt, Homo sapiens
ggaaauuaauagagcugau

SEQ ID NO: 843547 - RNA, 19 nt, Homo sapiens
ugcagaagcucgagguuga

SEQ ID NO: 843548 - RNA, 19 nt, Homo sapiens
aaggaaagauagugaggaa

SEQ ID NO: 843549 - RNA, 19 nt, Homo sapiens
gaaaaucaucccagacuaa

SEQ ID NO: 843550 - RNA, 19 nt, Homo sapiens
ccagcucucuuuaccauca

SEQ ID NO: 843551 - RNA, 19 nt, Homo sapiens
guucaacauuuaccugguu

SEQ ID NO: 843552 - RNA, 19 nt, Homo sapiens
gaacgugucggccauguac

SEQ ID NO: 843553 - RNA, 19 nt, Homo sapiens
gagagcagauuggccacaa

SEQ ID NO: 843554 - RNA, 19 nt, Homo sapiens
ggauuugugucuggccuaa

SEQ ID NO: 843555 - RNA, 19 nt, Homo sapiens
agaauucccuuccuuagag

SEQ ID NO: 843556 - RNA, 19 nt, Homo sapiens
ucacuaagaacaaggagaa

SEQ ID NO: 843557 - RNA, 19 nt, Homo sapiens
gagaaugaccauguuauag

SEQ ID NO: 843558 - RNA, 19 nt, Homo sapiens
ucagucuacuuucaucaaa

SEQ ID NO: 843559 - RNA, 19 nt, Homo sapiens
gcagauuggccacaagguu

SEQ ID NO: 843560 - RNA, 19 nt, Homo sapiens
gaauucccuuccuuagaga

SEQ ID NO: 843561 - RNA, 19 nt, Homo sapiens
agaaugaccauguuauaga

SEQ ID NO: 843562 - RNA, 19 nt, Homo sapiens
ugaggaagaaguuucauug

SEQ ID NO: 843563 - RNA, 19 nt, Homo sapiens
gcuuugacgugaccaacaa

SEQ ID NO: 843564 - RNA, 19 nt, Homo sapiens
cgacgacaguguggcauga

SEQ ID NO: 843565 - RNA, 19 nt, Homo sapiens
caccaaauuuguuccuuuc

SEQ ID NO: 843566 - RNA, 19 nt, Homo sapiens
ggaagauggauguagagaa

SEQ ID NO: 843567 - RNA, 19 nt, Homo sapiens
cuacacacuuauaaggaaa

SEQ ID NO: 843568 - RNA, 19 nt, Homo sapiens
gagaagucacuaagaacaa

SEQ ID NO: 843569 - RNA, 19 nt, Homo sapiens
agaagauggugcuuuggaa

SEQ ID NO: 843570 - RNA, 19 nt, Homo sapiens
ccgcagagcauaagaagau

SEQ ID NO: 843571 - RNA, 19 nt, Homo sapiens
aaaugaaggccaucuauca

SEQ ID NO: 843572 - RNA, 19 nt, Homo sapiens
gggaagccaagauauagaa

SEQ ID NO: 843573 - RNA, 19 nt, Homo sapiens
acacagggcaggaguaugu

SEQ ID NO: 843574 - RNA, 19 nt, Homo sapiens
gagagagaguggugcuaca

SEQ ID NO: 843575 - RNA, 19 nt, Homo sapiens
ucuuguggguguuaaauga

SEQ ID NO: 843576 - RNA, 19 nt, Homo sapiens
gcaugaucauauugcugua

SEQ ID NO: 843577 - RNA, 19 nt, Homo sapiens
gaccucaaccagaacguaa

SEQ ID NO: 843578 - RNA, 19 nt, Homo sapiens
cgugugaagaguuuaauuu

SEQ ID NO: 843579 - RNA, 19 nt, Homo sapiens
uccgagaccucaaccagaa

SEQ ID NO: 843580 - RNA, 19 nt, Homo sapiens
gaagccaagauauagaaga

SEQ ID NO: 843581 - RNA, 19 nt, Homo sapiens
aagcauuccuggaguguuc

SEQ ID NO: 843582 - RNA, 19 nt, Homo sapiens
gcacaaaaccgaggacuau

SEQ ID NO: 843583 - RNA, 19 nt, Homo sapiens
ugaccauguuauagacuuu

SEQ ID NO: 843584 - RNA, 19 nt, Homo sapiens
gcucccagcauucugauug

SEQ ID NO: 843585 - RNA, 19 nt, Homo sapiens
gaagaaguucaacauuuac

SEQ ID NO: 843586 - RNA, 19 nt, Homo sapiens
guacaggaaauuaauagag

SEQ ID NO: 843587 - RNA, 19 nt, Homo sapiens
gauccgcaccaacaaauuc

SEQ ID NO: 843588 - RNA, 19 nt, Homo sapiens
gaaaaugaaggccaucuau

SEQ ID NO: 843589 - RNA, 19 nt, Homo sapiens
uccaggaucucuacacugu

SEQ ID NO: 843590 - RNA, 19 nt, Homo sapiens
uaugaugccugacaacuaa

SEQ ID NO: 843591 - RNA, 19 nt, Homo sapiens
ccaaaucaauaaagagaga

SEQ ID NO: 843592 - RNA, 19 nt, Homo sapiens
cagcgaagccgugcaguuu

SEQ ID NO: 843593 - RNA, 19 nt, Homo sapiens
ggagaccgcgauucuaaga

SEQ ID NO: 843594 - RNA, 19 nt, Homo sapiens
cagcguggccugcagcuuu

SEQ ID NO: 843595 - RNA, 19 nt, Homo sapiens
gcuguucucugggcaguug

SEQ ID NO: 843596 - RNA, 19 nt, Homo sapiens
cagcuccacugcauucuca

SEQ ID NO: 843597 - RNA, 19 nt, Homo sapiens
cagauuggcccuccagaga

SEQ ID NO: 843598 - RNA, 19 nt, Homo sapiens
gcgaagccgugcaguuucu

SEQ ID NO: 843599 - RNA, 19 nt, Homo sapiens
gagaauccucccuccagaa

SEQ ID NO: 843600 - RNA, 19 nt, Homo sapiens
uccaggaccuccgaaauga

SEQ ID NO: 843601 - RNA, 19 nt, Homo sapiens
gauuggcccuccagagaag

SEQ ID NO: 843602 - RNA, 19 nt, Homo sapiens
gcccucaggugacgcagau

SEQ ID NO: 843603 - RNA, 19 nt, Homo sapiens
cccaacagccugaguuaug

SEQ ID NO: 843604 - RNA, 19 nt, Homo sapiens
gaugccugacaacuaaaua

SEQ ID NO: 843605 - RNA, 19 nt, Homo sapiens
ccaacagccugaguuaugc

SEQ ID NO: 843606 - RNA, 19 nt, Homo sapiens
ugagaaggcccaagaccau

SEQ ID NO: 843607 - RNA, 19 nt, Homo sapiens
cuaugaugccugacaacua

SEQ ID NO: 843608 - RNA, 19 nt, Homo sapiens
acaagcgcuuccuggauga

SEQ ID NO: 843609 - RNA, 19 nt, Homo sapiens
ccucagcacugccauucca

SEQ ID NO: 843610 - RNA, 19 nt, Homo sapiens
caacuaaauauccuuaucc

SEQ ID NO: 843611 - RNA, 19 nt, Homo sapiens
gaagccgugcaguuucuga

SEQ ID NO: 843612 - RNA, 19 nt, Homo sapiens
ggggagaccgcgauucuaa

SEQ ID NO: 843613 - RNA, 19 nt, Homo sapiens
caggaccuccgaaaugaug

SEQ ID NO: 843614 - RNA, 19 nt, Homo sapiens
acacaggagacccgcauug

SEQ ID NO: 843615 - RNA, 19 nt, Homo sapiens
aaacagcugccaugcacau

SEQ ID NO: 843616 - RNA, 19 nt, Homo sapiens
gccauuccagguccuuaaa

SEQ ID NO: 843617 - RNA, 19 nt, Homo sapiens
ucugggcaguugucugguu

SEQ ID NO: 843618 - RNA, 19 nt, Homo sapiens
ggaagugucugcugagaau

SEQ ID NO: 843619 - RNA, 19 nt, Homo sapiens
ggacaaugcacccuucaga

SEQ ID NO: 843620 - RNA, 19 nt, Homo sapiens
ggauaaagagggaaacuca

SEQ ID NO: 843621 - RNA, 19 nt, Homo sapiens
acacaaccauggaaaguuc

SEQ ID NO: 843622 - RNA, 19 nt, Homo sapiens
gauguucacuuuccuucug

SEQ ID NO: 843623 - RNA, 19 nt, Homo sapiens
gggacccgauguucacuuu

SEQ ID NO: 843624 - RNA, 19 nt, Homo sapiens
ugacagacccucccucuca

SEQ ID NO: 843625 - RNA, 19 nt, Homo sapiens
gcagggcgauaucacuguu

SEQ ID NO: 843626 - RNA, 19 nt, Homo sapiens
gguaccgucuggauaaaga

SEQ ID NO: 843627 - RNA, 19 nt, Homo sapiens
gaacaugcagggcgauauc

SEQ ID NO: 843628 - RNA, 19 nt, Homo sapiens
ucacuuuccuucugaccaa

SEQ ID NO: 843629 - RNA, 19 nt, Homo sapiens
cugaggagguucuggaaga

SEQ ID NO: 843630 - RNA, 19 nt, Homo sapiens
gaacucacaccaacacaac

SEQ ID NO: 843631 - RNA, 19 nt, Homo sapiens
guggugaccucaggaguga

SEQ ID NO: 843632 - RNA, 19 nt, Homo sapiens
caacagggguacauucaga

SEQ ID NO: 843633 - RNA, 19 nt, Homo sapiens
ccauuaaacuguggugcuu

SEQ ID NO: 843634 - RNA, 19 nt, Homo sapiens
gaaggugacccugcugugu

SEQ ID NO: 843635 - RNA, 19 nt, Homo sapiens
gcucagcacagccagagaa

SEQ ID NO: 843636 - RNA, 19 nt, Homo sapiens
caacacaaccauggaaagu

SEQ ID NO: 843637 - RNA, 19 nt, Homo sapiens
gcagguucacucugauuga

SEQ ID NO: 843638 - RNA, 19 nt, Homo sapiens
ccucgggauucuguuauuu

SEQ ID NO: 843639 - RNA, 19 nt, Homo sapiens
auaaguaccaggcugaauu

SEQ ID NO: 843640 - RNA, 19 nt, Homo sapiens
gaaucugacccuccagugu

SEQ ID NO: 843641 - RNA, 19 nt, Homo sapiens
ugucaggcgugucuaggaa

SEQ ID NO: 843642 - RNA, 19 nt, Homo sapiens
caauguacggagcucauaa

SEQ ID NO: 843643 - RNA, 19 nt, Homo sapiens
ucgggauucuguuauuuga

SEQ ID NO: 843644 - RNA, 19 nt, Homo sapiens
ccccacaccuccaggauua

SEQ ID NO: 843645 - RNA, 19 nt, Homo sapiens
ggcgauaucacuguuacua

SEQ ID NO: 843646 - RNA, 19 nt, Homo sapiens
ugucgaggcacauauuaaa

SEQ ID NO: 843647 - RNA, 19 nt, Homo sapiens
gauaaagagggaaacucaa

SEQ ID NO: 843648 - RNA, 19 nt, Homo sapiens
gaugcuuccuccauuaaac

SEQ ID NO: 843649 - RNA, 19 nt, Homo sapiens
cugaugaucugaggagguu

SEQ ID NO: 843650 - RNA, 19 nt, Homo sapiens
uaaagagggaaacucaaug

SEQ ID NO: 843651 - RNA, 19 nt, Homo sapiens
gcacaaaagaagucagauu

SEQ ID NO: 843652 - RNA, 19 nt, Homo sapiens
ucacgguccugaucugucu

SEQ ID NO: 843653 - RNA, 19 nt, Homo sapiens
gacccucaauccagcacaa

SEQ ID NO: 843654 - RNA, 19 nt, Homo sapiens
uaaguaccaggcugaauuc

SEQ ID NO: 843655 - RNA, 19 nt, Homo sapiens
gcgauaucacuguuacuau

SEQ ID NO: 843656 - RNA, 19 nt, Homo sapiens
aaagagggaaacucaaugu

SEQ ID NO: 843657 - RNA, 19 nt, Homo sapiens
cugggcagguucacucuga

SEQ ID NO: 843658 - RNA, 19 nt, Homo sapiens
gaagugucugcugagaaua

SEQ ID NO: 843659 - RNA, 19 nt, Homo sapiens
gggaagugucugcugagaa

SEQ ID NO: 843660 - RNA, 19 nt, Homo sapiens
guuccucgggauucuguua

SEQ ID NO: 843661 - RNA, 19 nt, Homo sapiens
ugggucaggugcaggaaga

SEQ ID NO: 843662 - RNA, 19 nt, Homo sapiens
ucaauguacggagcucaua

SEQ ID NO: 843663 - RNA, 19 nt, Homo sapiens
cagaugcuacggcuaugaa

SEQ ID NO: 843664 - RNA, 19 nt, Homo sapiens
ccuggacccugaacucaca

SEQ ID NO: 843665 - RNA, 19 nt, Homo sapiens
auaaagagggaaacucaau

SEQ ID NO: 843666 - RNA, 19 nt, Homo sapiens
ggaacaugcagggcgauau

SEQ ID NO: 843667 - RNA, 19 nt, Homo sapiens
cugggugucuguagaagau

SEQ ID NO: 843668 - RNA, 19 nt, Homo sapiens
gggcagguucacucugauu

SEQ ID NO: 843669 - RNA, 19 nt, Homo sapiens
gcagaaaaccuacccaaac

SEQ ID NO: 843670 - RNA, 19 nt, Homo sapiens
acaaugcacccuucagagu

SEQ ID NO: 843671 - RNA, 19 nt, Homo sapiens
uaucacuguuacuaucaga

SEQ ID NO: 843672 - RNA, 19 nt, Homo sapiens
aagaugcuuccuccauuaa

SEQ ID NO: 843673 - RNA, 19 nt, Homo sapiens
gugaucaccuggcauaacc

SEQ ID NO: 843674 - RNA, 19 nt, Homo sapiens
gaaaacaaggucaaacucu

SEQ ID NO: 843675 - RNA, 19 nt, Homo sapiens
gaggcaaacagcagaaagg

SEQ ID NO: 843676 - RNA, 19 nt, Homo sapiens
gggaacaugcagggcgaua

SEQ ID NO: 843677 - RNA, 19 nt, Homo sapiens
cagcagaaaggacaaugca

SEQ ID NO: 843678 - RNA, 19 nt, Homo sapiens
caaaagaagucagauucca

SEQ ID NO: 843679 - RNA, 19 nt, Homo sapiens
uguacggagcucauaagua

SEQ ID NO: 843680 - RNA, 19 nt, Homo sapiens
gacccgauguucacuuucc

SEQ ID NO: 843681 - RNA, 19 nt, Homo sapiens
auuaaacuguggugcuuuc

SEQ ID NO: 843682 - RNA, 19 nt, Homo sapiens
ggaggcaaacagcagaaag

SEQ ID NO: 843683 - RNA, 19 nt, Homo sapiens
ggauuacacaguggagaau

SEQ ID NO: 843684 - RNA, 19 nt, Homo sapiens
ggaaacaacuuacuucuug

SEQ ID NO: 843685 - RNA, 19 nt, Homo sapiens
guaaacagcugaaggauga

SEQ ID NO: 843686 - RNA, 19 nt, Homo sapiens
gaaaugcugucucaacuuu

SEQ ID NO: 843687 - RNA, 19 nt, Homo sapiens
guaaauagguaucuagaga

SEQ ID NO: 843688 - RNA, 19 nt, Homo sapiens
ggaugaagcacuacaguua

SEQ ID NO: 843689 - RNA, 19 nt, Homo sapiens
gaagacaguuucagcaaau

SEQ ID NO: 843690 - RNA, 19 nt, Homo sapiens
gcuaaugucucuucaugaa

SEQ ID NO: 843691 - RNA, 19 nt, Homo sapiens
gguuauauguggaaucuuu

SEQ ID NO: 843692 - RNA, 19 nt, Homo sapiens
uaaaggaagugugugauuu

SEQ ID NO: 843693 - RNA, 19 nt, Homo sapiens
caaaugaugcuacccuaua

SEQ ID NO: 843694 - RNA, 19 nt, Homo sapiens
ggaagauacuauuggugua

SEQ ID NO: 843695 - RNA, 19 nt, Homo sapiens
ggaauaugcuuugauaagu

SEQ ID NO: 843696 - RNA, 19 nt, Homo sapiens
gaaauauacugcgcuuaau

SEQ ID NO: 843697 - RNA, 19 nt, Homo sapiens
gcacuacaguuaacuccaa

SEQ ID NO: 843698 - RNA, 19 nt, Homo sapiens
ggaaugugauuuauaguac

SEQ ID NO: 843699 - RNA, 19 nt, Homo sapiens
auacugcgcuuaauauuug

SEQ ID NO: 843700 - RNA, 19 nt, Homo sapiens
uguuggagcuuauaaguaa

SEQ ID NO: 843701 - RNA, 19 nt, Homo sapiens
gagugccaaugaauaaaua

SEQ ID NO: 843702 - RNA, 19 nt, Homo sapiens
acagauagguuaaugacaa

SEQ ID NO: 843703 - RNA, 19 nt, Homo sapiens
cauagaaauuggaauguga

SEQ ID NO: 843704 - RNA, 19 nt, Homo sapiens
guacucaacauuugguaua

SEQ ID NO: 843705 - RNA, 19 nt, Homo sapiens
guagcccgcuuuauguuaa

SEQ ID NO: 843706 - RNA, 19 nt, Homo sapiens
gaucaauguuacugaaaug

SEQ ID NO: 843707 - RNA, 19 nt, Homo sapiens
gaaaguccacagucauauu

SEQ ID NO: 843708 - RNA, 19 nt, Homo sapiens
caacuuacuucuugcuugu

SEQ ID NO: 843709 - RNA, 19 nt, Homo sapiens
gagaacuccugguuguaaa

SEQ ID NO: 843710 - RNA, 19 nt, Homo sapiens
gaaauggccguccagcaaa

SEQ ID NO: 843711 - RNA, 19 nt, Homo sapiens
gacauuuacucuggagaua

SEQ ID NO: 843712 - RNA, 19 nt, Homo sapiens
gaagguagcacagaggauu

SEQ ID NO: 843713 - RNA, 19 nt, Homo sapiens
ccaaugaacccugaaauau

SEQ ID NO: 843714 - RNA, 19 nt, Homo sapiens
agaaauauacugcgcuuaa

SEQ ID NO: 843715 - RNA, 19 nt, Homo sapiens
gagauaauccuggcaauuc

SEQ ID NO: 843716 - RNA, 19 nt, Homo sapiens
gcaggauuauuguauagug

SEQ ID NO: 843717 - RNA, 19 nt, Homo sapiens
cauagagacuguaacugaa

SEQ ID NO: 843718 - RNA, 19 nt, Homo sapiens
ccauagagacuguaacuga

SEQ ID NO: 843719 - RNA, 19 nt, Homo sapiens
cuucacaucuauccaauga

SEQ ID NO: 843720 - RNA, 19 nt, Homo sapiens
ugaaggcugugcugagaaa

SEQ ID NO: 843721 - RNA, 19 nt, Homo sapiens
ccacagucauauucacaaa

SEQ ID NO: 843722 - RNA, 19 nt, Homo sapiens
gcuugugucuuuccauuug

SEQ ID NO: 843723 - RNA, 19 nt, Homo sapiens
gugcuaaugucucuucaug

SEQ ID NO: 843724 - RNA, 19 nt, Homo sapiens
gaugaagcacuacaguuaa

SEQ ID NO: 843725 - RNA, 19 nt, Homo sapiens
guuauuagagugccaauga

SEQ ID NO: 843726 - RNA, 19 nt, Homo sapiens
ugacaauuguacugcuaua

SEQ ID NO: 843727 - RNA, 19 nt, Homo sapiens
gaagcaguaugcauaggau

SEQ ID NO: 843728 - RNA, 19 nt, Homo sapiens
cgaugaagcaguaugcaua

SEQ ID NO: 843729 - RNA, 19 nt, Homo sapiens
caacuugguuuaggagaga

SEQ ID NO: 843730 - RNA, 19 nt, Homo sapiens
acaguuaacuccaaaugau

SEQ ID NO: 843731 - RNA, 19 nt, Homo sapiens
gaaacuacucagugaaaug

SEQ ID NO: 843732 - RNA, 19 nt, Homo sapiens
uuacugaaaugcugucuca

SEQ ID NO: 843733 - RNA, 19 nt, Homo sapiens
caaugaacccugaaauaug

SEQ ID NO: 843734 - RNA, 19 nt, Homo sapiens
ucaaguagcccuucacauc

SEQ ID NO: 843735 - RNA, 19 nt, Homo sapiens
auaguugucuccuucagua

SEQ ID NO: 843736 - RNA, 19 nt, Homo sapiens
gcacuugccuugaaaagau

SEQ ID NO: 843737 - RNA, 19 nt, Homo sapiens
ggagauagauaggagaacu

SEQ ID NO: 843738 - RNA, 19 nt, Homo sapiens
agaagacaguuucagcaaa

SEQ ID NO: 843739 - RNA, 19 nt, Homo sapiens
gagaaagagaagacaguuu

SEQ ID NO: 843740 - RNA, 19 nt, Homo sapiens
gggaggcaauucagaagug

SEQ ID NO: 843741 - RNA, 19 nt, Homo sapiens
aaguagggcuguuauuaga

SEQ ID NO: 843742 - RNA, 19 nt, Homo sapiens
uaaaauggcaggauuauug

SEQ ID NO: 843743 - RNA, 19 nt, Homo sapiens
gagaagacaguuucagcaa

SEQ ID NO: 843744 - RNA, 19 nt, Homo sapiens
ugaagcaccagcugaagua

SEQ ID NO: 843745 - RNA, 19 nt, Homo sapiens
uauacgagaugaaaucaca

SEQ ID NO: 843746 - RNA, 19 nt, Homo sapiens
uuacuacuguuggagcuua

SEQ ID NO: 843747 - RNA, 19 nt, Homo sapiens
aguacaaucucaugaguau

SEQ ID NO: 843748 - RNA, 19 nt, Homo sapiens
guugucuccuucaguauuu

SEQ ID NO: 843749 - RNA, 19 nt, Homo sapiens
ugaaagugaugagauuguu

SEQ ID NO: 843750 - RNA, 19 nt, Homo sapiens
aaugaacccugaaauaugg

SEQ ID NO: 843751 - RNA, 19 nt, Homo sapiens
gaaaucacaggugcuaaug

SEQ ID NO: 843752 - RNA, 19 nt, Homo sapiens
gaugaaaucacaggugcua

SEQ ID NO: 843753 - RNA, 19 nt, Homo sapiens
aaaauuagcucugguuaga

SEQ ID NO: 843754 - RNA, 19 nt, Homo sapiens
acaaaccaauacugucauu

SEQ ID NO: 843755 - RNA, 19 nt, Homo sapiens
uuagagugccaaugaauaa

SEQ ID NO: 843756 - RNA, 19 nt, Homo sapiens
gaaagugaugagauuguug

SEQ ID NO: 843757 - RNA, 19 nt, Homo sapiens
ucacaucuauccaaugaac

SEQ ID NO: 843758 - RNA, 19 nt, Homo sapiens
gagcuuauaaguaaugauc

SEQ ID NO: 843759 - RNA, 19 nt, Homo sapiens
ucacaaaccaauacuguca

SEQ ID NO: 843760 - RNA, 19 nt, Homo sapiens
guagggcuguuauuagagu

SEQ ID NO: 843761 - RNA, 19 nt, Homo sapiens
cauuuacucuggagauaga

SEQ ID NO: 843762 - RNA, 19 nt, Homo sapiens
ccugaaauauggaaagaag

SEQ ID NO: 843763 - RNA, 19 nt, Homo sapiens
agaaggauguaguugacaa

SEQ ID NO: 843764 - RNA, 19 nt, Homo sapiens
aaaguaaacagcugaagga

SEQ ID NO: 843765 - RNA, 19 nt, Homo sapiens
aaacuacucagugaaauga

SEQ ID NO: 843766 - RNA, 19 nt, Homo sapiens
gauagguuaaugacaauug

SEQ ID NO: 843767 - RNA, 19 nt, Homo sapiens
uugauugccucuugaaguu

SEQ ID NO: 843768 - RNA, 19 nt, Homo sapiens
aaagcccgaugaagcagua

SEQ ID NO: 843769 - RNA, 19 nt, Homo sapiens
agaaauggccguccagcaa

SEQ ID NO: 843770 - RNA, 19 nt, Homo sapiens
ugaaauguucccagcagua

SEQ ID NO: 843771 - RNA, 19 nt, Homo sapiens
gaguaauggauguuuguuu

SEQ ID NO: 843772 - RNA, 19 nt, Homo sapiens
gagagauaauccuggcaau

SEQ ID NO: 843773 - RNA, 19 nt, Homo sapiens
ggaugaaggagccaguuug

SEQ ID NO: 843774 - RNA, 19 nt, Homo sapiens
auagguaucuagagaagug

SEQ ID NO: 843775 - RNA, 19 nt, Homo sapiens
cagauagguuaaugacaau

SEQ ID NO: 843776 - RNA, 19 nt, Homo sapiens
aaauagguaucuagagaag

SEQ ID NO: 843777 - RNA, 19 nt, Homo sapiens
aauuagcacuugccuugaa

SEQ ID NO: 843778 - RNA, 19 nt, Homo sapiens
ugucagaaagcuugaauau

SEQ ID NO: 843779 - RNA, 19 nt, Homo sapiens
aaacuaaaauggcaggauu

SEQ ID NO: 843780 - RNA, 19 nt, Homo sapiens
gaugagauuguugcuguuu

SEQ ID NO: 843781 - RNA, 19 nt, Homo sapiens
aaguagcccuucacaucua

SEQ ID NO: 843782 - RNA, 19 nt, Homo sapiens
ucaggaagauacuauuggu

SEQ ID NO: 843783 - RNA, 19 nt, Homo sapiens
uuucagaugaggcauauaa

SEQ ID NO: 843784 - RNA, 19 nt, Homo sapiens
gaagcuggauuauuaaagu

SEQ ID NO: 843785 - RNA, 19 nt, Homo sapiens
gaacuccuccaccaucaua

SEQ ID NO: 843786 - RNA, 19 nt, Homo sapiens
caucauagcuuuugcugua

SEQ ID NO: 843787 - RNA, 19 nt, Homo sapiens
ggauugagcccucuuggaa

SEQ ID NO: 843788 - RNA, 19 nt, Homo sapiens
gagagcaaguacuucauga

SEQ ID NO: 843789 - RNA, 19 nt, Homo sapiens
ucaaggagacugagaaaug

SEQ ID NO: 843790 - RNA, 19 nt, Homo sapiens
gaacagcaagcaacgcuau

SEQ ID NO: 843791 - RNA, 19 nt, Homo sapiens
ccaacuaccuggacaagca

SEQ ID NO: 843792 - RNA, 19 nt, Homo sapiens
gagcuguucccuucucuaa

SEQ ID NO: 843793 - RNA, 19 nt, Homo sapiens
ggucuuggguggugccuau

SEQ ID NO: 843794 - RNA, 19 nt, Homo sapiens
gaaccaccauuggaccuau

SEQ ID NO: 843795 - RNA, 19 nt, Homo sapiens
cugcaggccuugauagauu

SEQ ID NO: 843796 - RNA, 19 nt, Homo sapiens
gagaaccaccggccuuuau

SEQ ID NO: 843797 - RNA, 19 nt, Homo sapiens
caaggagacugagaaaugg

SEQ ID NO: 843798 - RNA, 19 nt, Homo sapiens
ggagaaccaccggccuuua

SEQ ID NO: 843799 - RNA, 19 nt, Homo sapiens
gaaauaucaacgagaacuu

SEQ ID NO: 843800 - RNA, 19 nt, Homo sapiens
ccaaggacauaguggagau

SEQ ID NO: 843801 - RNA, 19 nt, Homo sapiens
gaaccaccggccuuuauuc

SEQ ID NO: 843802 - RNA, 19 nt, Homo sapiens
ggacaagcaugaggagaac

SEQ ID NO: 843803 - RNA, 19 nt, Homo sapiens
ggaccuaucuuggcuucuc

SEQ ID NO: 843804 - RNA, 19 nt, Homo sapiens
gcaacgcuaugcuucaaac

SEQ ID NO: 843805 - RNA, 19 nt, Homo sapiens
caacuggccaugcacucua

SEQ ID NO: 843806 - RNA, 19 nt, Homo sapiens
ugaucaaggugaacagcaa

SEQ ID NO: 843807 - RNA, 19 nt, Homo sapiens
ccauccaucugcagcgaaa

SEQ ID NO: 843808 - RNA, 19 nt, Homo sapiens
gcugaagcuggauuauuaa

SEQ ID NO: 843809 - RNA, 19 nt, Homo sapiens
gauugagcccucuuggaaa

SEQ ID NO: 843810 - RNA, 19 nt, Homo sapiens
gaucuggagcaccugguuu

SEQ ID NO: 843811 - RNA, 19 nt, Homo sapiens
gagacugagaaauggaaua

SEQ ID NO: 843812 - RNA, 19 nt, Homo sapiens
caucugcagcgaaauauca

SEQ ID NO: 843813 - RNA, 19 nt, Homo sapiens
ccuccaccaucauagcuuu

SEQ ID NO: 843814 - RNA, 19 nt, Homo sapiens
uccgagagguggccaacaa

SEQ ID NO: 843815 - RNA, 19 nt, Homo sapiens
cccaaguccuucaugauca

SEQ ID NO: 843816 - RNA, 19 nt, Homo sapiens
auacccaaguccuucauga

SEQ ID NO: 843817 - RNA, 19 nt, Homo sapiens
gagagguggccaacaaagu

SEQ ID NO: 843818 - RNA, 19 nt, Homo sapiens
gcgcauggucacacucuau

SEQ ID NO: 843819 - RNA, 19 nt, Homo sapiens
gagccagggccucucaaug

SEQ ID NO: 843820 - RNA, 19 nt, Homo sapiens
agcgaaauaucaacgagaa

SEQ ID NO: 843821 - RNA, 19 nt, Homo sapiens
ggaaccaccauuggaccua

SEQ ID NO: 843822 - RNA, 19 nt, Homo sapiens
gaucucaugguccggaaug

SEQ ID NO: 843823 - RNA, 19 nt, Homo sapiens
gaggaagccauacccaagu

SEQ ID NO: 843824 - RNA, 19 nt, Homo sapiens
gcuggacgcgucauuguca

SEQ ID NO: 843825 - RNA, 19 nt, Homo sapiens
cacacucuaugacaacgaa

SEQ ID NO: 843826 - RNA, 19 nt, Homo sapiens
cgagagcaaguacuucaug

SEQ ID NO: 843827 - RNA, 19 nt, Homo sapiens
ggaccugcaaagcuaguga

SEQ ID NO: 843828 - RNA, 19 nt, Homo sapiens
ggcugcgggugcuggauuu

SEQ ID NO: 843829 - RNA, 19 nt, Homo sapiens
uggaugagcggcaccauuc

SEQ ID NO: 843830 - RNA, 19 nt, Homo sapiens
agacugagaaauggaauau

SEQ ID NO: 843831 - RNA, 19 nt, Homo sapiens
gggcuucuuugagcuguuc

SEQ ID NO: 843832 - RNA, 19 nt, Homo sapiens
gcaccauucgguccucaug

SEQ ID NO: 843833 - RNA, 19 nt, Homo sapiens
gcauggucacacucuauga

SEQ ID NO: 843834 - RNA, 19 nt, Homo sapiens
ccucuucaagggcuucuuu

SEQ ID NO: 843835 - RNA, 19 nt, Homo sapiens
cuucaaacgcggugucaga

SEQ ID NO: 843836 - RNA, 19 nt, Homo sapiens
uggacaagcaugaggagaa

SEQ ID NO: 843837 - RNA, 19 nt, Homo sapiens
aagcuggauuauuaaagug

SEQ ID NO: 843838 - RNA, 19 nt, Homo sapiens
ccaaguccuucaugaucag

SEQ ID NO: 843839 - RNA, 19 nt, Homo sapiens
ccaggugggcuuccagcaa

SEQ ID NO: 843840 - RNA, 19 nt, Homo sapiens
gagguggccaacaaaguca

SEQ ID NO: 843841 - RNA, 19 nt, Homo sapiens
auauuaagcccgagagcaa

SEQ ID NO: 843842 - RNA, 19 nt, Homo sapiens
agaaccaccggccuuuauu

SEQ ID NO: 843843 - RNA, 19 nt, Homo sapiens
caaggugaacagcaagcaa

SEQ ID NO: 843844 - RNA, 19 nt, Homo sapiens
cccgacagccuucgaggaa

SEQ ID NO: 843845 - RNA, 19 nt, Homo sapiens
caccauuggaccuaucuug

SEQ ID NO: 843846 - RNA, 19 nt, Homo sapiens
gagaaauggaauauuaagc

SEQ ID NO: 843847 - RNA, 19 nt, Homo sapiens
cgaaauaucaacgagaacu

SEQ ID NO: 843848 - RNA, 19 nt, Homo sapiens
gaacucagcacuuguuuga

SEQ ID NO: 843849 - RNA, 19 nt, Homo sapiens
ccaauggguugcacaauaa

SEQ ID NO: 843850 - RNA, 19 nt, Homo sapiens
ggaggagacuuauuucaau

SEQ ID NO: 843851 - RNA, 19 nt, Homo sapiens
ggacaccgaugaacucuuc

SEQ ID NO: 843852 - RNA, 19 nt, Homo sapiens
gaaggagguucucuauguu

SEQ ID NO: 843853 - RNA, 19 nt, Homo sapiens
gaagauguuccacaccuua

SEQ ID NO: 843854 - RNA, 19 nt, Homo sapiens
ggacggcgcugcuaucagu

SEQ ID NO: 843855 - RNA, 19 nt, Homo sapiens
gaugaugggugacuacaga

SEQ ID NO: 843856 - RNA, 19 nt, Homo sapiens
gagacaagcuagcuaaugg

SEQ ID NO: 843857 - RNA, 19 nt, Homo sapiens
gcucaaggcugggcugaaa

SEQ ID NO: 843858 - RNA, 19 nt, Homo sapiens
gaugaaacagucucacaua

SEQ ID NO: 843859 - RNA, 19 nt, Homo sapiens
cccugaagcuuuccuaaua

SEQ ID NO: 843860 - RNA, 19 nt, Homo sapiens
cagggacucuugagaaauu

SEQ ID NO: 843861 - RNA, 19 nt, Homo sapiens
gagaaccagugcuuauguu

SEQ ID NO: 843862 - RNA, 19 nt, Homo sapiens
ggaaggaguaccuggagua

SEQ ID NO: 843863 - RNA, 19 nt, Homo sapiens
gaagaacaaugacuuuagc

SEQ ID NO: 843864 - RNA, 19 nt, Homo sapiens
gcagaagaacaaugacuuu

SEQ ID NO: 843865 - RNA, 19 nt, Homo sapiens
gcgaggaaguaaagaguga

SEQ ID NO: 843866 - RNA, 19 nt, Homo sapiens
gaaccgcaaucagcuguga

SEQ ID NO: 843867 - RNA, 19 nt, Homo sapiens
caccacagcucaggcauuu

SEQ ID NO: 843868 - RNA, 19 nt, Homo sapiens
ggacagaacauugggaaga

SEQ ID NO: 843869 - RNA, 19 nt, Homo sapiens
gaggagacuuauuucaaug

SEQ ID NO: 843870 - RNA, 19 nt, Homo sapiens
ugugggagcuggaaaguga

SEQ ID NO: 843871 - RNA, 19 nt, Homo sapiens
caacagagcagagcugaug

SEQ ID NO: 843872 - RNA, 19 nt, Homo sapiens
gaggugaggacuugacuuu

SEQ ID NO: 843873 - RNA, 19 nt, Homo sapiens
ggaaagugagccagauuug

SEQ ID NO: 843874 - RNA, 19 nt, Homo sapiens
gaggagagcauguucuuca

SEQ ID NO: 843875 - RNA, 19 nt, Homo sapiens
ggagagugcccaagggaaa

SEQ ID NO: 843876 - RNA, 19 nt, Homo sapiens
gcaaucaugcugcuuaaca

SEQ ID NO: 843877 - RNA, 19 nt, Homo sapiens
gagcugccaggaauucaua

SEQ ID NO: 843878 - RNA, 19 nt, Homo sapiens
agaguggccucauuuccua

SEQ ID NO: 843879 - RNA, 19 nt, Homo sapiens
gagcugauggcaugaguga

SEQ ID NO: 843880 - RNA, 19 nt, Homo sapiens
gagggaugguucucuacuu

SEQ ID NO: 843881 - RNA, 19 nt, Homo sapiens
cagaagaacaaugacuuua

SEQ ID NO: 843882 - RNA, 19 nt, Homo sapiens
gcacaauaaauaacagguu

SEQ ID NO: 843883 - RNA, 19 nt, Homo sapiens
ccacagcucaggagaguug

SEQ ID NO: 843884 - RNA, 19 nt, Homo sapiens
gugcaaucaugcugcuuaa

SEQ ID NO: 843885 - RNA, 19 nt, Homo sapiens
ggaaguaaagagugaagga

SEQ ID NO: 843886 - RNA, 19 nt, Homo sapiens
uggaaauucucaaccugua

SEQ ID NO: 843887 - RNA, 19 nt, Homo sapiens
ggagggaccagccaccauu

SEQ ID NO: 843888 - RNA, 19 nt, Homo sapiens
aagcguggcuggaagaugu

SEQ ID NO: 843889 - RNA, 19 nt, Homo sapiens
ccacagugcccaccuacaa

SEQ ID NO: 843890 - RNA, 19 nt, Homo sapiens
cuaagguccugcccacuga

SEQ ID NO: 843891 - RNA, 19 nt, Homo sapiens
gaaguaaagagugaaggaa

SEQ ID NO: 843892 - RNA, 19 nt, Homo sapiens
gagcacguccacacaggua

SEQ ID NO: 843893 - RNA, 19 nt, Homo sapiens
gaaccuaccggaagaucau

SEQ ID NO: 843894 - RNA, 19 nt, Homo sapiens
gcagggagaagaccacugu

SEQ ID NO: 843895 - RNA, 19 nt, Homo sapiens
gagcaugagcugccaggaa

SEQ ID NO: 843896 - RNA, 19 nt, Homo sapiens
ccacugacccuccugaauc

SEQ ID NO: 843897 - RNA, 19 nt, Homo sapiens
gagguucucuauguucaga

SEQ ID NO: 843898 - RNA, 19 nt, Homo sapiens
ccugaagcuuuccuaauau

SEQ ID NO: 843899 - RNA, 19 nt, Homo sapiens
ggagacaagcuagcuaaug

SEQ ID NO: 843900 - RNA, 19 nt, Homo sapiens
ggagcagggucgcuaaggu

SEQ ID NO: 843901 - RNA, 19 nt, Homo sapiens
acaacaagguagccuggaa

SEQ ID NO: 843902 - RNA, 19 nt, Homo sapiens
gcuaauggcgucaggaaca

SEQ ID NO: 843903 - RNA, 19 nt, Homo sapiens
gagccuagcagcccagaau

SEQ ID NO: 843904 - RNA, 19 nt, Homo sapiens
uggagaggauagagaggua

SEQ ID NO: 843905 - RNA, 19 nt, Homo sapiens
ggucuugcucugggaauua

SEQ ID NO: 843906 - RNA, 19 nt, Homo sapiens
agagggaggugaggacuug

SEQ ID NO: 843907 - RNA, 19 nt, Homo sapiens
gccaggaauucauaaccaa

SEQ ID NO: 843908 - RNA, 19 nt, Homo sapiens
gaaccuaccagacaaaaug

SEQ ID NO: 843909 - RNA, 19 nt, Homo sapiens
cugaagcuuuccuaauauu

SEQ ID NO: 843910 - RNA, 19 nt, Homo sapiens
gcuugcaccuccacaaagu

SEQ ID NO: 843911 - RNA, 19 nt, Homo sapiens
gcgaguccuugcucagaga

SEQ ID NO: 843912 - RNA, 19 nt, Homo sapiens
ggagacuuauuucaaugag

SEQ ID NO: 843913 - RNA, 19 nt, Homo sapiens
ggaccugcauggacagaac

SEQ ID NO: 843914 - RNA, 19 nt, Homo sapiens
ccagacgcuuccaccauug

SEQ ID NO: 843915 - RNA, 19 nt, Homo sapiens
uccagacgcuuccaccauu

SEQ ID NO: 843916 - RNA, 19 nt, Homo sapiens
gcuaggccaugcacccaau

SEQ ID NO: 843917 - RNA, 19 nt, Homo sapiens
gguaaaagguggcgacagu

SEQ ID NO: 843918 - RNA, 19 nt, Homo sapiens
gagaggauagagagguaaa

SEQ ID NO: 843919 - RNA, 19 nt, Homo sapiens
ucagaccacuggagaggau

SEQ ID NO: 843920 - RNA, 19 nt, Homo sapiens
gacagaacauugggaagag

SEQ ID NO: 843921 - RNA, 19 nt, Homo sapiens
caggaugugucggaucuga

SEQ ID NO: 843922 - RNA, 19 nt, Homo sapiens
gagaacucagcacuuguuu

SEQ ID NO: 843923 - RNA, 19 nt, Homo sapiens
ggaggagcccagcuucuuc

SEQ ID NO: 843924 - RNA, 19 nt, Homo sapiens
gcuaucagugggcauugua

SEQ ID NO: 843925 - RNA, 19 nt, Homo sapiens
gaaagugagccagauuugg

SEQ ID NO: 843926 - RNA, 19 nt, Homo sapiens
ccagauguguguccuagac

SEQ ID NO: 843927 - RNA, 19 nt, Homo sapiens
gggcuugcaccuccacaaa

SEQ ID NO: 843928 - RNA, 19 nt, Homo sapiens
aaucagggacucuugagaa

SEQ ID NO: 843929 - RNA, 19 nt, Homo sapiens
ggugaggacuugacuuucc

SEQ ID NO: 843930 - RNA, 19 nt, Homo sapiens
ucagccaagugugcaagua

SEQ ID NO: 843931 - RNA, 19 nt, Homo sapiens
accggaagaucaucccuaa

SEQ ID NO: 843932 - RNA, 19 nt, Homo sapiens
cgcagaaccuaccggaaga

SEQ ID NO: 843933 - RNA, 19 nt, Homo sapiens
gaaucagggacucuugaga

SEQ ID NO: 843934 - RNA, 19 nt, Homo sapiens
gggcuguggcugaggagua

SEQ ID NO: 843935 - RNA, 19 nt, Homo sapiens
gcauugaccugggaaucag

SEQ ID NO: 843936 - RNA, 19 nt, Homo sapiens
gcccuuggaggccauguuu

SEQ ID NO: 843937 - RNA, 19 nt, Homo sapiens
gaaauucucaaccuguacu

SEQ ID NO: 843938 - RNA, 19 nt, Homo sapiens
agcaugagcugccaggaau

SEQ ID NO: 843939 - RNA, 19 nt, Homo sapiens
aaucugaggacaccgauga

SEQ ID NO: 843940 - RNA, 19 nt, Homo sapiens
aggaggagcuggagaagac

SEQ ID NO: 843941 - RNA, 19 nt, Homo sapiens
gccaggcucgggagacuuu

SEQ ID NO: 843942 - RNA, 19 nt, Homo sapiens
gaugggugacuacagauuc

SEQ ID NO: 843943 - RNA, 19 nt, Homo sapiens
gagcaagcccuuccuucag

SEQ ID NO: 843944 - RNA, 19 nt, Homo sapiens
ugagcaagcccuuccuuca

SEQ ID NO: 843945 - RNA, 19 nt, Homo sapiens
cuaauggcgucaggaacaa

SEQ ID NO: 843946 - RNA, 19 nt, Homo sapiens
aguaaagagugaaggaaca

SEQ ID NO: 843947 - RNA, 19 nt, Homo sapiens
cagccaccauugucucugu

SEQ ID NO: 843948 - RNA, 19 nt, Homo sapiens
ggaaaucauuguacuguaa

SEQ ID NO: 843949 - RNA, 19 nt, Homo sapiens
caucagcucuuaacaagua

SEQ ID NO: 843950 - RNA, 19 nt, Homo sapiens
ccauugagcuccacgguuu

SEQ ID NO: 843951 - RNA, 19 nt, Homo sapiens
gaaccaggcugcccucuac

SEQ ID NO: 843952 - RNA, 19 nt, Homo sapiens
gaucuucuauugggucuuu

SEQ ID NO: 843953 - RNA, 19 nt, Homo sapiens
gaaccuuagugaucuucua

SEQ ID NO: 843954 - RNA, 19 nt, Homo sapiens
gcucguuccucaagcauuu

SEQ ID NO: 843955 - RNA, 19 nt, Homo sapiens
gagccaugaugaagacuuu

SEQ ID NO: 843956 - RNA, 19 nt, Homo sapiens
ggacuuccaccguaaggua

SEQ ID NO: 843957 - RNA, 19 nt, Homo sapiens
guucagagaggguaaguaa

SEQ ID NO: 843958 - RNA, 19 nt, Homo sapiens
cgacaguugugcuuuguug

SEQ ID NO: 843959 - RNA, 19 nt, Homo sapiens
gaggauugcugcgucauau

SEQ ID NO: 843960 - RNA, 19 nt, Homo sapiens
acacagauguacacacaga

SEQ ID NO: 843961 - RNA, 19 nt, Homo sapiens
acacacagauguacacaca

SEQ ID NO: 843962 - RNA, 19 nt, Homo sapiens
caccauggaucuccgugua

SEQ ID NO: 843963 - RNA, 19 nt, Homo sapiens
ggacacagaaggccagaug

SEQ ID NO: 843964 - RNA, 19 nt, Homo sapiens
agaccacgcccaccacuua

SEQ ID NO: 843965 - RNA, 19 nt, Homo sapiens
ggguacagcuccaccuaga

SEQ ID NO: 843966 - RNA, 19 nt, Homo sapiens
cagcugcgccugacauuga

SEQ ID NO: 843967 - RNA, 19 nt, Homo sapiens
ucugcagccucaagaguua

SEQ ID NO: 843968 - RNA, 19 nt, Homo sapiens
acagugaccucaaguacau

SEQ ID NO: 843969 - RNA, 19 nt, Homo sapiens
ggucaucuguggcaacaag

SEQ ID NO: 843970 - RNA, 19 nt, Homo sapiens
cguguacacuaucaauaaa

SEQ ID NO: 843971 - RNA, 19 nt, Homo sapiens
ggaucuccguguacacuau

SEQ ID NO: 843972 - RNA, 19 nt, Homo sapiens
ccucaacccucucccuaga

SEQ ID NO: 843973 - RNA, 19 nt, Homo sapiens
gucaucagcucuuaacaag

SEQ ID NO: 843974 - RNA, 19 nt, Homo sapiens
ggcagagacucaaguuaca

SEQ ID NO: 843975 - RNA, 19 nt, Homo sapiens
ccuuagugaucuucuauug

SEQ ID NO: 843976 - RNA, 19 nt, Homo sapiens
guuccucaagcauuuauua

SEQ ID NO: 843977 - RNA, 19 nt, Homo sapiens
guuugcagcuagacauuga

SEQ ID NO: 843978 - RNA, 19 nt, Homo sapiens
cagaaggccagaugagaaa

SEQ ID NO: 843979 - RNA, 19 nt, Homo sapiens
gaugugcucccucucuuga

SEQ ID NO: 843980 - RNA, 19 nt, Homo sapiens
cgugucauguauaguagua

SEQ ID NO: 843981 - RNA, 19 nt, Homo sapiens
caagugcaccauccaguga

SEQ ID NO: 843982 - RNA, 19 nt, Homo sapiens
ggguuuccguggccuguuu

SEQ ID NO: 843983 - RNA, 19 nt, Homo sapiens
gcuccacgguuuacagaca

SEQ ID NO: 843984 - RNA, 19 nt, Homo sapiens
gacauugaccuccgccauu

SEQ ID NO: 843985 - RNA, 19 nt, Homo sapiens
uggaaaucauuguacugua

SEQ ID NO: 843986 - RNA, 19 nt, Homo sapiens
ucuccucucuccuggcaua

SEQ ID NO: 843987 - RNA, 19 nt, Homo sapiens
caacagugaccucaaguac

SEQ ID NO: 843988 - RNA, 19 nt, Homo sapiens
gcugggcauucaguacaua

SEQ ID NO: 843989 - RNA, 19 nt, Homo sapiens
ggagggauccgacagaaaa

SEQ ID NO: 843990 - RNA, 19 nt, Homo sapiens
gcaagaucuccgugcagua

SEQ ID NO: 843991 - RNA, 19 nt, Homo sapiens
ccguguacacuaucaauaa

SEQ ID NO: 843992 - RNA, 19 nt, Homo sapiens
acucaggcaugguggguuu

SEQ ID NO: 843993 - RNA, 19 nt, Homo sapiens
ucgaggacuuccaccguaa

SEQ ID NO: 843994 - RNA, 19 nt, Homo sapiens
gcccgacaguugugcuuug

SEQ ID NO: 843995 - RNA, 19 nt, Homo sapiens
caacguggacgagauguuc

SEQ ID NO: 843996 - RNA, 19 nt, Homo sapiens
gucaaguccugccugaaga

SEQ ID NO: 843997 - RNA, 19 nt, Homo sapiens
ggucaaguccugccugaag

SEQ ID NO: 843998 - RNA, 19 nt, Homo sapiens
acauugaccuccgccauug

SEQ ID NO: 843999 - RNA, 19 nt, Homo sapiens
cauaacacccagcuugguu

SEQ ID NO: 844000 - RNA, 19 nt, Homo sapiens
ggugcuggguucacugugu

SEQ ID NO: 844001 - RNA, 19 nt, Homo sapiens
ccucaagcauuuauuaagc

SEQ ID NO: 844002 - RNA, 19 nt, Homo sapiens
acagaaggccagaugagaa

SEQ ID NO: 844003 - RNA, 19 nt, Homo sapiens
ugaagaacaagaccaagga

SEQ ID NO: 844004 - RNA, 19 nt, Homo sapiens
cagcagucuuguucacaga

SEQ ID NO: 844005 - RNA, 19 nt, Homo sapiens
gcuccaacccugccucugu

SEQ ID NO: 844006 - RNA, 19 nt, Homo sapiens
guauauacaaguacacaca

SEQ ID NO: 844007 - RNA, 19 nt, Homo sapiens
gagcuccacgguuuacaga

SEQ ID NO: 844008 - RNA, 19 nt, Homo sapiens
ugucauguauaguaguaga

SEQ ID NO: 844009 - RNA, 19 nt, Homo sapiens
gugucucgcuuccucaaug

SEQ ID NO: 844010 - RNA, 19 nt, Homo sapiens
ucagagaggguaaguaacu

SEQ ID NO: 844011 - RNA, 19 nt, Homo sapiens
guauaguaguagaaaugga

SEQ ID NO: 844012 - RNA, 19 nt, Homo sapiens
caagagcuccaucgugucu

SEQ ID NO: 844013 - RNA, 19 nt, Homo sapiens
gcacauucgucugccuucu

SEQ ID NO: 844014 - RNA, 19 nt, Homo sapiens
ucaacagugaccucaagua

SEQ ID NO: 844015 - RNA, 19 nt, Homo sapiens
cgagaacugcgccuacuuc

SEQ ID NO: 844016 - RNA, 19 nt, Homo sapiens
ucaacccucucccuagauc

SEQ ID NO: 844017 - RNA, 19 nt, Homo sapiens
guacagcuccaccuagaac

SEQ ID NO: 844018 - RNA, 19 nt, Homo sapiens
acaccaacguggacgagau

SEQ ID NO: 844019 - RNA, 19 nt, Homo sapiens
ccaagaagaacaccaacgu

SEQ ID NO: 844020 - RNA, 19 nt, Homo sapiens
caagcuagcgcugggcauu

SEQ ID NO: 844021 - RNA, 19 nt, Homo sapiens
uuucgugucauguauagua

SEQ ID NO: 844022 - RNA, 19 nt, Homo sapiens
caagaucuccgugcaguac

SEQ ID NO: 844023 - RNA, 19 nt, Homo sapiens
gaggucaagcgccuucaga

SEQ ID NO: 844024 - RNA, 19 nt, Homo sapiens
caauaaaaguggguuuguu

SEQ ID NO: 844025 - RNA, 19 nt, Homo sapiens
guugugcuuuguugugguu

SEQ ID NO: 844026 - RNA, 19 nt, Homo sapiens
uaacacccagcuugguuug

SEQ ID NO: 844027 - RNA, 19 nt, Homo sapiens
ggauugcugcgucauaugg

SEQ ID NO: 844028 - RNA, 19 nt, Homo sapiens
ccauggaucuccguguaca

SEQ ID NO: 844029 - RNA, 19 nt, Homo sapiens
ugaggauugcugcgucaua

SEQ ID NO: 844030 - RNA, 19 nt, Homo sapiens
ugucaucagcucuuaacaa

SEQ ID NO: 844031 - RNA, 19 nt, Homo sapiens
gggagggauccgacagaaa

SEQ ID NO: 844032 - RNA, 19 nt, Homo sapiens
gacgagaacugcgccuacu

SEQ ID NO: 844033 - RNA, 19 nt, Homo sapiens
aguccugccugaagaacaa

SEQ ID NO: 844034 - RNA, 19 nt, Homo sapiens
acauucgucugccuucuca

SEQ ID NO: 844035 - RNA, 19 nt, Homo sapiens
gcgcugggcauucaguaca

SEQ ID NO: 844036 - RNA, 19 nt, Homo sapiens
guaguagaaauggaaauca

SEQ ID NO: 844037 - RNA, 19 nt, Homo sapiens
gguucacuguguccuagga

SEQ ID NO: 844038 - RNA, 19 nt, Homo sapiens
gguggcagcugggagaacu

SEQ ID NO: 844039 - RNA, 19 nt, Homo sapiens
caagcugccacacgagaug

SEQ ID NO: 844040 - RNA, 19 nt, Homo sapiens
uggacgagauguucuacgu

SEQ ID NO: 844041 - RNA, 19 nt, Homo sapiens
auauacaaguacacacaga

SEQ ID NO: 844042 - RNA, 19 nt, Homo sapiens
ccucucuccuggcauaaca

SEQ ID NO: 844043 - RNA, 19 nt, Homo sapiens
cuucagggcuuugggacau

SEQ ID NO: 844044 - RNA, 19 nt, Homo sapiens
ugugcucccucucuugaug

SEQ ID NO: 844045 - RNA, 19 nt, Homo sapiens
cuuccucaauggccgcuuu

SEQ ID NO: 844046 - RNA, 19 nt, Homo sapiens
ugggagggauccgacagaa

SEQ ID NO: 844047 - RNA, 19 nt, Homo sapiens
ucaaguccugccugaagaa

SEQ ID NO: 844048 - RNA, 19 nt, Homo sapiens
agaagcagcuguguauuua

SEQ ID NO: 844049 - RNA, 19 nt, Homo sapiens
ucacugagcugccggacua

SEQ ID NO: 844050 - RNA, 19 nt, Homo sapiens
acaacaagaucuccuuuaa

SEQ ID NO: 844051 - RNA, 19 nt, Homo sapiens
gaaggaagauuugguuugg

SEQ ID NO: 844052 - RNA, 19 nt, Homo sapiens
gaaaugauggaaggacuua

SEQ ID NO: 844053 - RNA, 19 nt, Homo sapiens
gaaguggaguuuggaaguu

SEQ ID NO: 844054 - RNA, 19 nt, Homo sapiens
gcagcgggauggaccagua

SEQ ID NO: 844055 - RNA, 19 nt, Homo sapiens
gaggguagcaccaggcaua

SEQ ID NO: 844056 - RNA, 19 nt, Homo sapiens
ccaaggcucuccuccauca

SEQ ID NO: 844057 - RNA, 19 nt, Homo sapiens
ucagagccauuaaacacua

SEQ ID NO: 844058 - RNA, 19 nt, Homo sapiens
guuggaaacucaaguggaa

SEQ ID NO: 844059 - RNA, 19 nt, Homo sapiens
gaggagaaguggaguuugg

SEQ ID NO: 844060 - RNA, 19 nt, Homo sapiens
ggaaccagaugcagaagag

SEQ ID NO: 844061 - RNA, 19 nt, Homo sapiens
cagaagcagcuguguauuu

SEQ ID NO: 844062 - RNA, 19 nt, Homo sapiens
gaacgauauugaacagcuu

SEQ ID NO: 844063 - RNA, 19 nt, Homo sapiens
caagggaaauggcuaaggu

SEQ ID NO: 844064 - RNA, 19 nt, Homo sapiens
ggaaggaagauuugguuug

SEQ ID NO: 844065 - RNA, 19 nt, Homo sapiens
ggagaagugcagagaguaa

SEQ ID NO: 844066 - RNA, 19 nt, Homo sapiens
ggacaaucaguauguggua

SEQ ID NO: 844067 - RNA, 19 nt, Homo sapiens
ggaaggacuuacgguauca

SEQ ID NO: 844068 - RNA, 19 nt, Homo sapiens
cgagauaguugcccucaag

SEQ ID NO: 844069 - RNA, 19 nt, Homo sapiens
caagaacgauauugaacag

SEQ ID NO: 844070 - RNA, 19 nt, Homo sapiens
cguggagacuggcgagaua

SEQ ID NO: 844071 - RNA, 19 nt, Homo sapiens
gcaagaacgauauugaaca

SEQ ID NO: 844072 - RNA, 19 nt, Homo sapiens
aaacacuaguucaguaugu

SEQ ID NO: 844073 - RNA, 19 nt, Homo sapiens
ucaaguggaaggaagauuu

SEQ ID NO: 844074 - RNA, 19 nt, Homo sapiens
uggccuggcucgagucuuu

SEQ ID NO: 844075 - RNA, 19 nt, Homo sapiens
ucaagaagguggcccuaag

SEQ ID NO: 844076 - RNA, 19 nt, Homo sapiens
gcagcuguguauuuaagga

SEQ ID NO: 844077 - RNA, 19 nt, Homo sapiens
gcuuugugcuggccuuuga

SEQ ID NO: 844078 - RNA, 19 nt, Homo sapiens
cgacgcagcuuccguucuc

SEQ ID NO: 844079 - RNA, 19 nt, Homo sapiens
gccagaagcagcuguguau

SEQ ID NO: 844080 - RNA, 19 nt, Homo sapiens
gggcaagaacgauauugaa

SEQ ID NO: 844081 - RNA, 19 nt, Homo sapiens
gaaggaaguggaaccagau

SEQ ID NO: 844082 - RNA, 19 nt, Homo sapiens
gaagcagcuguguauuuaa

SEQ ID NO: 844083 - RNA, 19 nt, Homo sapiens
caccaggcauagccacuuu

SEQ ID NO: 844084 - RNA, 19 nt, Homo sapiens
caucugagcugccgauucc

SEQ ID NO: 844085 - RNA, 19 nt, Homo sapiens
uugaacagcuuugcuaugu

SEQ ID NO: 844086 - RNA, 19 nt, Homo sapiens
aggcacaggucaagagcua

SEQ ID NO: 844087 - RNA, 19 nt, Homo sapiens
ggaggacaaucaguaugug

SEQ ID NO: 844088 - RNA, 19 nt, Homo sapiens
gagggacuccuguguacuu

SEQ ID NO: 844089 - RNA, 19 nt, Homo sapiens
gaagugagggagacagaag

SEQ ID NO: 844090 - RNA, 19 nt, Homo sapiens
ucagguggcucugccuuau

SEQ ID NO: 844091 - RNA, 19 nt, Homo sapiens
aggaagauuugguuugguu

SEQ ID NO: 844092 - RNA, 19 nt, Homo sapiens
gagcucugcugccagucaa

SEQ ID NO: 844093 - RNA, 19 nt, Homo sapiens
gauaguugcccucaagaag

SEQ ID NO: 844094 - RNA, 19 nt, Homo sapiens
ggaaaugauggaaggacuu

SEQ ID NO: 844095 - RNA, 19 nt, Homo sapiens
caacaagaucuccuuuaag

SEQ ID NO: 844096 - RNA, 19 nt, Homo sapiens
gcuaugugcuucgcaucuu

SEQ ID NO: 844097 - RNA, 19 nt, Homo sapiens
gauggaggacaaucaguau

SEQ ID NO: 844098 - RNA, 19 nt, Homo sapiens
uuaaggcucugcaggagau

SEQ ID NO: 844099 - RNA, 19 nt, Homo sapiens
caaguggaaggaagauuug

SEQ ID NO: 844100 - RNA, 19 nt, Homo sapiens
gagacuggcgagauaguug

SEQ ID NO: 844101 - RNA, 19 nt, Homo sapiens
guacccaucaggacaguga

SEQ ID NO: 844102 - RNA, 19 nt, Homo sapiens
ccaagaguaugagaacauc

SEQ ID NO: 844103 - RNA, 19 nt, Homo sapiens
gcagccgccucuacacaca

SEQ ID NO: 844104 - RNA, 19 nt, Homo sapiens
uggaaggacuuacgguauc

SEQ ID NO: 844105 - RNA, 19 nt, Homo sapiens
aagcagcuguguauuuaag

SEQ ID NO: 844106 - RNA, 19 nt, Homo sapiens
ggaagauuugguuugguuu

SEQ ID NO: 844107 - RNA, 19 nt, Homo sapiens
gaggacggcuucccuaacc

SEQ ID NO: 844108 - RNA, 19 nt, Homo sapiens
ggagaaguggaguuuggaa

SEQ ID NO: 844109 - RNA, 19 nt, Homo sapiens
ggagacccucugcacauga

SEQ ID NO: 844110 - RNA, 19 nt, Homo sapiens
uacaacaagaucuccuuua

SEQ ID NO: 844111 - RNA, 19 nt, Homo sapiens
ggaaguggaaccagaugca

SEQ ID NO: 844112 - RNA, 19 nt, Homo sapiens
ggaugagcgugagccagaa

SEQ ID NO: 844113 - RNA, 19 nt, Homo sapiens
uggcuaagguggcauuguc

SEQ ID NO: 844114 - RNA, 19 nt, Homo sapiens
aaggagaagugcagagagu

SEQ ID NO: 844115 - RNA, 19 nt, Homo sapiens
cagaagaggaaaugaugga

SEQ ID NO: 844116 - RNA, 19 nt, Homo sapiens
gaaacucaaguggaaggaa

SEQ ID NO: 844117 - RNA, 19 nt, Homo sapiens
ucugugugcuacugacgua

SEQ ID NO: 844118 - RNA, 19 nt, Homo sapiens
ccacucaguccaccuguuc

SEQ ID NO: 844119 - RNA, 19 nt, Homo sapiens
ugcaggagauggaggacaa

SEQ ID NO: 844120 - RNA, 19 nt, Homo sapiens
agaguaugauugugguuca

SEQ ID NO: 844121 - RNA, 19 nt, Homo sapiens
agauggaggacaaucagua

SEQ ID NO: 844122 - RNA, 19 nt, Homo sapiens
gagacccucugcacaugag

SEQ ID NO: 844123 - RNA, 19 nt, Homo sapiens
ccagggauggcuccaguug

SEQ ID NO: 844124 - RNA, 19 nt, Homo sapiens
gucuguuccuccuucauuu

SEQ ID NO: 844125 - RNA, 19 nt, Homo sapiens
gagcugauucggcccuuca

SEQ ID NO: 844126 - RNA, 19 nt, Homo sapiens
cuacaacaagaucuccuuu

SEQ ID NO: 844127 - RNA, 19 nt, Homo sapiens
ggagacuggcgagauaguu

SEQ ID NO: 844128 - RNA, 19 nt, Homo sapiens
ggugagccuuaccuucugu

SEQ ID NO: 844129 - RNA, 19 nt, Homo sapiens
caagagcuaccugcagaug

SEQ ID NO: 844130 - RNA, 19 nt, Homo sapiens
gugcuggccuuugaguuca

SEQ ID NO: 844131 - RNA, 19 nt, Homo sapiens
caaucaguaugugguacaa

SEQ ID NO: 844132 - RNA, 19 nt, Homo sapiens
gaguaugauugugguucaa

SEQ ID NO: 844133 - RNA, 19 nt, Homo sapiens
aauauaaucccagcuagug

SEQ ID NO: 844134 - RNA, 19 nt, Homo sapiens
ggacuccuguguacuucac

SEQ ID NO: 844135 - RNA, 19 nt, Homo sapiens
guucaguaugugagauaua

SEQ ID NO: 844136 - RNA, 19 nt, Homo sapiens
ucaaggagaagugcagaga

SEQ ID NO: 844137 - RNA, 19 nt, Homo sapiens
ccugagggacuccugugua

SEQ ID NO: 844138 - RNA, 19 nt, Homo sapiens
gcaccaggcauagccacuu

SEQ ID NO: 844139 - RNA, 19 nt, Homo sapiens
ggagauggaggacaaucag

SEQ ID NO: 844140 - RNA, 19 nt, Homo sapiens
guggaaggaagauuugguu

SEQ ID NO: 844141 - RNA, 19 nt, Homo sapiens
gagauaguugcccucaaga

SEQ ID NO: 844142 - RNA, 19 nt, Homo sapiens
ugaacagcuuugcuaugug

SEQ ID NO: 844143 - RNA, 19 nt, Homo sapiens
ggauggaccaguacugcau

SEQ ID NO: 844144 - RNA, 19 nt, Homo sapiens
caauauaaucccagcuagu

SEQ ID NO: 844145 - RNA, 19 nt, Homo sapiens
cccaauauaaucccagcua

SEQ ID NO: 844146 - RNA, 19 nt, Homo sapiens
caggagacccucugcacau

SEQ ID NO: 844147 - RNA, 19 nt, Homo sapiens
aagguggcauugucucaug

SEQ ID NO: 844148 - RNA, 19 nt, Homo sapiens
guacagagaugaaccuuua

SEQ ID NO: 844149 - RNA, 19 nt, Homo sapiens
gaccagagcugcugaggua

SEQ ID NO: 844150 - RNA, 19 nt, Homo sapiens
guacaaaggugaagcaguu

SEQ ID NO: 844151 - RNA, 19 nt, Homo sapiens
uaacugaccuucugaauuc

SEQ ID NO: 844152 - RNA, 19 nt, Homo sapiens
gaaggacaguuaaagcuuu

SEQ ID NO: 844153 - RNA, 19 nt, Homo sapiens
gaaggaaaccaucaaauug

SEQ ID NO: 844154 - RNA, 19 nt, Homo sapiens
gaugaagucuuacucuguu

SEQ ID NO: 844155 - RNA, 19 nt, Homo sapiens
ggacauccuuugccauuca

SEQ ID NO: 844156 - RNA, 19 nt, Homo sapiens
cagaagauacguaacauuu

SEQ ID NO: 844157 - RNA, 19 nt, Homo sapiens
cuucauggcuccuuauauu

SEQ ID NO: 844158 - RNA, 19 nt, Homo sapiens
ggaauuguguggccucuag

SEQ ID NO: 844159 - RNA, 19 nt, Homo sapiens
ggaaagaauguaucagcua

SEQ ID NO: 844160 - RNA, 19 nt, Homo sapiens
gaaaguauuaucugaagga

SEQ ID NO: 844161 - RNA, 19 nt, Homo sapiens
ucugaugccuccuuguuua

SEQ ID NO: 844162 - RNA, 19 nt, Homo sapiens
ugaaggaaaccaucaaauu

SEQ ID NO: 844163 - RNA, 19 nt, Homo sapiens
aauguacacuuccuccuua

SEQ ID NO: 844164 - RNA, 19 nt, Homo sapiens
caccgugccuugcuauuaa

SEQ ID NO: 844165 - RNA, 19 nt, Homo sapiens
gcauucaguugugagauaa

SEQ ID NO: 844166 - RNA, 19 nt, Homo sapiens
aaucaggaauuucuucuug

SEQ ID NO: 844167 - RNA, 19 nt, Homo sapiens
gaagauuccgccucucauu

SEQ ID NO: 844168 - RNA, 19 nt, Homo sapiens
guuugugaguucugauuua

SEQ ID NO: 844169 - RNA, 19 nt, Homo sapiens
uuacaucccugcugaagau

SEQ ID NO: 844170 - RNA, 19 nt, Homo sapiens
ggaauuucuucuugguuug

SEQ ID NO: 844171 - RNA, 19 nt, Homo sapiens
caacagauugggauacuau

SEQ ID NO: 844172 - RNA, 19 nt, Homo sapiens
ccaugaaaguauuaucuga

SEQ ID NO: 844173 - RNA, 19 nt, Homo sapiens
uaaagcagaagauacguaa

SEQ ID NO: 844174 - RNA, 19 nt, Homo sapiens
guacacuuccuccuuauug

SEQ ID NO: 844175 - RNA, 19 nt, Homo sapiens
gacgaagucuugaggaaca

SEQ ID NO: 844176 - RNA, 19 nt, Homo sapiens
cugcucgacuuccaauuua

SEQ ID NO: 844177 - RNA, 19 nt, Homo sapiens
uaaagucuaucucuugucu

SEQ ID NO: 844178 - RNA, 19 nt, Homo sapiens
caaaagauguuuacagaca

SEQ ID NO: 844179 - RNA, 19 nt, Homo sapiens
guugugagauaauugaguu

SEQ ID NO: 844180 - RNA, 19 nt, Homo sapiens
ggaguuuacugugaaagga

SEQ ID NO: 844181 - RNA, 19 nt, Homo sapiens
gaacaauggcaggugcaua

SEQ ID NO: 844182 - RNA, 19 nt, Homo sapiens
ugaagcaguuugugaguuc

SEQ ID NO: 844183 - RNA, 19 nt, Homo sapiens
ccacagaacauaaguuuac

SEQ ID NO: 844184 - RNA, 19 nt, Homo sapiens
ggaaugcuccaacagauca

SEQ ID NO: 844185 - RNA, 19 nt, Homo sapiens
ggagcugauugcagagaaa

SEQ ID NO: 844186 - RNA, 19 nt, Homo sapiens
ucaguggacuugcuguuau

SEQ ID NO: 844187 - RNA, 19 nt, Homo sapiens
gaaauaaagacggcugaug

SEQ ID NO: 844188 - RNA, 19 nt, Homo sapiens
gggcaggucuuuauuuuau

SEQ ID NO: 844189 - RNA, 19 nt, Homo sapiens
gaaaucccuuggagacagu

SEQ ID NO: 844190 - RNA, 19 nt, Homo sapiens
ggaacaaugagcucucuug

SEQ ID NO: 844191 - RNA, 19 nt, Homo sapiens
caguacaucucacuucaug

SEQ ID NO: 844192 - RNA, 19 nt, Homo sapiens
aagucuaucucuugucuaa

SEQ ID NO: 844193 - RNA, 19 nt, Homo sapiens
guuaaagcuuuguguuguu

SEQ ID NO: 844194 - RNA, 19 nt, Homo sapiens
caguggacuugcuguuaua

SEQ ID NO: 844195 - RNA, 19 nt, Homo sapiens
aggaauuucuucuugguuu

SEQ ID NO: 844196 - RNA, 19 nt, Homo sapiens
cuuaauaacugaccuucug

SEQ ID NO: 844197 - RNA, 19 nt, Homo sapiens
ccaccgugccuugcuauua

SEQ ID NO: 844198 - RNA, 19 nt, Homo sapiens
ggagcugcaggcauuguua

SEQ ID NO: 844199 - RNA, 19 nt, Homo sapiens
gaauauuuagccaaaguga

SEQ ID NO: 844200 - RNA, 19 nt, Homo sapiens
agacagaagucaagaaagc

SEQ ID NO: 844201 - RNA, 19 nt, Homo sapiens
ggacuugcuguuauagauu

SEQ ID NO: 844202 - RNA, 19 nt, Homo sapiens
gcauaaggaagauguggaa

SEQ ID NO: 844203 - RNA, 19 nt, Homo sapiens
gacuugcuguuauagauug

SEQ ID NO: 844204 - RNA, 19 nt, Homo sapiens
gaagauuucaguggacuug

SEQ ID NO: 844205 - RNA, 19 nt, Homo sapiens
gcagaagauacguaacauu

SEQ ID NO: 844206 - RNA, 19 nt, Homo sapiens
gagccaccgugccuugcua

SEQ ID NO: 844207 - RNA, 19 nt, Homo sapiens
gcugauugcagagaaauaa

SEQ ID NO: 844208 - RNA, 19 nt, Homo sapiens
gcccggaacuggaacucaa

SEQ ID NO: 844209 - RNA, 19 nt, Homo sapiens
ggcaaaaugucacuauauu

SEQ ID NO: 844210 - RNA, 19 nt, Homo sapiens
gcacuaaagcagaagauac

SEQ ID NO: 844211 - RNA, 19 nt, Homo sapiens
gauaugaaggagcugauug

SEQ ID NO: 844212 - RNA, 19 nt, Homo sapiens
auacagaccuggcagugau

SEQ ID NO: 844213 - RNA, 19 nt, Homo sapiens
gacaugaauuuaacugcau

SEQ ID NO: 844214 - RNA, 19 nt, Homo sapiens
cugcaggcauuguuauuug

SEQ ID NO: 844215 - RNA, 19 nt, Homo sapiens
ccaaauuucgggugcauga

SEQ ID NO: 844216 - RNA, 19 nt, Homo sapiens
gauaugggaaagaauguau

SEQ ID NO: 844217 - RNA, 19 nt, Homo sapiens
cgacuuccaauuuaucaaa

SEQ ID NO: 844218 - RNA, 19 nt, Homo sapiens
cuugggagcugcaggcauu

SEQ ID NO: 844219 - RNA, 19 nt, Homo sapiens
cagagaugaaccuuuauuu

SEQ ID NO: 844220 - RNA, 19 nt, Homo sapiens
augaggaucuccaccauga

SEQ ID NO: 844221 - RNA, 19 nt, Homo sapiens
gcacaaggugacuaaagga

SEQ ID NO: 844222 - RNA, 19 nt, Homo sapiens
aaagauguuuacagacaga

SEQ ID NO: 844223 - RNA, 19 nt, Homo sapiens
ggaguguaguggugugauc

SEQ ID NO: 844224 - RNA, 19 nt, Homo sapiens
gaucuagucagcaccauag

SEQ ID NO: 844225 - RNA, 19 nt, Homo sapiens
aacaauggcaggugcauaa

SEQ ID NO: 844226 - RNA, 19 nt, Homo sapiens
caaaagcuuucaugaagga

SEQ ID NO: 844227 - RNA, 19 nt, Homo sapiens
aaagcugaccaagauauua

SEQ ID NO: 844228 - RNA, 19 nt, Homo sapiens
agagugcacuaaagcagaa

SEQ ID NO: 844229 - RNA, 19 nt, Homo sapiens
gccauucaaccucugauuu

SEQ ID NO: 844230 - RNA, 19 nt, Homo sapiens
gugaagcaguuugugaguu

SEQ ID NO: 844231 - RNA, 19 nt, Homo sapiens
ucuaaagucuaucucuugu

SEQ ID NO: 844232 - RNA, 19 nt, Homo sapiens
ccauucaaccucugauuug

SEQ ID NO: 844233 - RNA, 19 nt, Homo sapiens
agcauucaguugugagaua

SEQ ID NO: 844234 - RNA, 19 nt, Homo sapiens
ucuccugguucacuaauga

SEQ ID NO: 844235 - RNA, 19 nt, Homo sapiens
cagaagucaagaaagcuua

SEQ ID NO: 844236 - RNA, 19 nt, Homo sapiens
aagcugaccaagauauuaa

SEQ ID NO: 844237 - RNA, 19 nt, Homo sapiens
uaucgaagcauucaguugu

SEQ ID NO: 844238 - RNA, 19 nt, Homo sapiens
acagacagaagucaagaaa

SEQ ID NO: 844239 - RNA, 19 nt, Homo sapiens
gaagcauucaguugugaga

SEQ ID NO: 844240 - RNA, 19 nt, Homo sapiens
agugauggcagauacauuu

SEQ ID NO: 844241 - RNA, 19 nt, Homo sapiens
ugauuuagggagcuacaua

SEQ ID NO: 844242 - RNA, 19 nt, Homo sapiens
ugacaucucaugauuaugc

SEQ ID NO: 844243 - RNA, 19 nt, Homo sapiens
cuaaaggaccagcagcaaa

SEQ ID NO: 844244 - RNA, 19 nt, Homo sapiens
gcaggugcauaaggaagau

SEQ ID NO: 844245 - RNA, 19 nt, Homo sapiens
aauggcaggugcauaagga

SEQ ID NO: 844246 - RNA, 19 nt, Homo sapiens
gcugcaggcauuguuauuu

SEQ ID NO: 844247 - RNA, 19 nt, Homo sapiens
gaggaacaaugagcucucu

SEQ ID NO: 844248 - RNA, 19 nt, Homo sapiens
ggucagauauggucacuuu

SEQ ID NO: 844249 - RNA, 19 nt, Homo sapiens
gcaaacagcuuuaauacac

SEQ ID NO: 844250 - RNA, 19 nt, Homo sapiens
caaaugauguccuugaaga

SEQ ID NO: 844251 - RNA, 19 nt, Homo sapiens
ccagauuccugcuguguua

SEQ ID NO: 844252 - RNA, 19 nt, Homo sapiens
gcuguuugcuguuuccuua

SEQ ID NO: 844253 - RNA, 19 nt, Homo sapiens
gcaauagucuccaagucaa

SEQ ID NO: 844254 - RNA, 19 nt, Homo sapiens
aaagaaaugucacagaaga

SEQ ID NO: 844255 - RNA, 19 nt, Homo sapiens
gaaguuugcuugucauuuu

SEQ ID NO: 844256 - RNA, 19 nt, Homo sapiens
ucagugaccuuuaucaaga

SEQ ID NO: 844257 - RNA, 19 nt, Homo sapiens
uaagugcuguggaguagua

SEQ ID NO: 844258 - RNA, 19 nt, Homo sapiens
aagccaggaugacaaauua

SEQ ID NO: 844259 - RNA, 19 nt, Homo sapiens
ccaguacaauggucagaua

SEQ ID NO: 844260 - RNA, 19 nt, Homo sapiens
gcaaacgagucacauaugg

SEQ ID NO: 844261 - RNA, 19 nt, Homo sapiens
ggaguaggauguggugaaa

SEQ ID NO: 844262 - RNA, 19 nt, Homo sapiens
gggacuaccuaaauaaugu

SEQ ID NO: 844263 - RNA, 19 nt, Homo sapiens
aaaccaagccugucaagaa

SEQ ID NO: 844264 - RNA, 19 nt, Homo sapiens
gaauguagucuggucuuua

SEQ ID NO: 844265 - RNA, 19 nt, Homo sapiens
caauauuggugacuaccua

SEQ ID NO: 844266 - RNA, 19 nt, Homo sapiens
gcucugggcucuguauuau

SEQ ID NO: 844267 - RNA, 19 nt, Homo sapiens
guagaacuguugaaaccaa

SEQ ID NO: 844268 - RNA, 19 nt, Homo sapiens
gaagggagccugggacaga

SEQ ID NO: 844269 - RNA, 19 nt, Homo sapiens
gcuguggaguaguauauuu

SEQ ID NO: 844270 - RNA, 19 nt, Homo sapiens
gaacuggcuuguggcguuu

SEQ ID NO: 844271 - RNA, 19 nt, Homo sapiens
gaagaucucagugaccuuu

SEQ ID NO: 844272 - RNA, 19 nt, Homo sapiens
gaaaauuuguccuguauag

SEQ ID NO: 844273 - RNA, 19 nt, Homo sapiens
gcuaacacauugucuuaag

SEQ ID NO: 844274 - RNA, 19 nt, Homo sapiens
gaugagggacuaccuaaau

SEQ ID NO: 844275 - RNA, 19 nt, Homo sapiens
agagcaagcuaacacauug

SEQ ID NO: 844276 - RNA, 19 nt, Homo sapiens
gaaaagaaaucuguugcuu

SEQ ID NO: 844277 - RNA, 19 nt, Homo sapiens
ggauggggcuucucccuua

SEQ ID NO: 844278 - RNA, 19 nt, Homo sapiens
cagagaagauuccgugaag

SEQ ID NO: 844279 - RNA, 19 nt, Homo sapiens
gaagaaaaccacaaacuug

SEQ ID NO: 844280 - RNA, 19 nt, Homo sapiens
gaaaauuaccagugugaua

SEQ ID NO: 844281 - RNA, 19 nt, Homo sapiens
gucaccaccuggacaauaa

SEQ ID NO: 844282 - RNA, 19 nt, Homo sapiens
ggacuggagccauaguaaa

SEQ ID NO: 844283 - RNA, 19 nt, Homo sapiens
gccaugauucucaccauua

SEQ ID NO: 844284 - RNA, 19 nt, Homo sapiens
gagaagauuccgugaagug

SEQ ID NO: 844285 - RNA, 19 nt, Homo sapiens
ucugggcucuguauuauga

SEQ ID NO: 844286 - RNA, 19 nt, Homo sapiens
guacaauggucagauaugg

SEQ ID NO: 844287 - RNA, 19 nt, Homo sapiens
caaacaggcccaccaggaa

SEQ ID NO: 844288 - RNA, 19 nt, Homo sapiens
cagcaugguuugauuagca

SEQ ID NO: 844289 - RNA, 19 nt, Homo sapiens
gaggcagcaugguuugauu

SEQ ID NO: 844290 - RNA, 19 nt, Homo sapiens
cagauauggucacuuugaa

SEQ ID NO: 844291 - RNA, 19 nt, Homo sapiens
caagaggguugugggaaga

SEQ ID NO: 844292 - RNA, 19 nt, Homo sapiens
aagcuaacacauugucuua

SEQ ID NO: 844293 - RNA, 19 nt, Homo sapiens
acacaaauccuggccauga

SEQ ID NO: 844294 - RNA, 19 nt, Homo sapiens
guccugggcuuauauuaca

SEQ ID NO: 844295 - RNA, 19 nt, Homo sapiens
caccuaagcauauacuauu

SEQ ID NO: 844296 - RNA, 19 nt, Homo sapiens
cagcuuuaauacacacuuu

SEQ ID NO: 844297 - RNA, 19 nt, Homo sapiens
caaacagcuuuaauacaca

SEQ ID NO: 844298 - RNA, 19 nt, Homo sapiens
gagaggaaccaaacaacug

SEQ ID NO: 844299 - RNA, 19 nt, Homo sapiens
gcuguuuccuuaucauugu

SEQ ID NO: 844300 - RNA, 19 nt, Homo sapiens
uggcaaauuacacagauua

SEQ ID NO: 844301 - RNA, 19 nt, Homo sapiens
acucagcgaucuauucuuc

SEQ ID NO: 844302 - RNA, 19 nt, Homo sapiens
gaccaaaugauguccuuga

SEQ ID NO: 844303 - RNA, 19 nt, Homo sapiens
ucagauauggucacuuuga

SEQ ID NO: 844304 - RNA, 19 nt, Homo sapiens
ggaaguuugcuugucauuu

SEQ ID NO: 844305 - RNA, 19 nt, Homo sapiens
caaacaagaagcaauaguc

SEQ ID NO: 844306 - RNA, 19 nt, Homo sapiens
cauaugaacaggaacuuau

SEQ ID NO: 844307 - RNA, 19 nt, Homo sapiens
augagggacuaccuaaaua

SEQ ID NO: 844308 - RNA, 19 nt, Homo sapiens
cucagaauauggaaagaaa

SEQ ID NO: 844309 - RNA, 19 nt, Homo sapiens
guagucuggucuuuaggaa

SEQ ID NO: 844310 - RNA, 19 nt, Homo sapiens
ugagauggaggaguuauaa

SEQ ID NO: 844311 - RNA, 19 nt, Homo sapiens
ugauguccuugaagaauga

SEQ ID NO: 844312 - RNA, 19 nt, Homo sapiens
ggccaugauucucaccauu

SEQ ID NO: 844313 - RNA, 19 nt, Homo sapiens
aaccaagccugucaagaau

SEQ ID NO: 844314 - RNA, 19 nt, Homo sapiens
gaucuauucuucugaugcu

SEQ ID NO: 844315 - RNA, 19 nt, Homo sapiens
ccaagccugucaagaaucu

SEQ ID NO: 844316 - RNA, 19 nt, Homo sapiens
ugaaagccaggaugacaaa

SEQ ID NO: 844317 - RNA, 19 nt, Homo sapiens
gguagaggaagcagucauu

SEQ ID NO: 844318 - RNA, 19 nt, Homo sapiens
ugagggacuaccuaaauaa

SEQ ID NO: 844319 - RNA, 19 nt, Homo sapiens
ccagugugauacauaggaa

SEQ ID NO: 844320 - RNA, 19 nt, Homo sapiens
aauguagucuggucuuuag

SEQ ID NO: 844321 - RNA, 19 nt, Homo sapiens
uagccuuuccuguuaauaa

SEQ ID NO: 844322 - RNA, 19 nt, Homo sapiens
ccugucaugucccucagua

SEQ ID NO: 844323 - RNA, 19 nt, Homo sapiens
gguuggaaaugacagagau

SEQ ID NO: 844324 - RNA, 19 nt, Homo sapiens
gaagcaauagucuccaagu

SEQ ID NO: 844325 - RNA, 19 nt, Homo sapiens
uaauacacacuuugagaug

SEQ ID NO: 844326 - RNA, 19 nt, Homo sapiens
gaaaccaagccugucaaga

SEQ ID NO: 844327 - RNA, 19 nt, Homo sapiens
agaauguagucuggucuuu

SEQ ID NO: 844328 - RNA, 19 nt, Homo sapiens
cacauugucuuaagcugau

SEQ ID NO: 844329 - RNA, 19 nt, Homo sapiens
gggacuggagccauaguaa

SEQ ID NO: 844330 - RNA, 19 nt, Homo sapiens
agaaaugucacagaagaaa

SEQ ID NO: 844331 - RNA, 19 nt, Homo sapiens
gagauggaggaguuauaaa

SEQ ID NO: 844332 - RNA, 19 nt, Homo sapiens
ugaagaaugacaacucuca

SEQ ID NO: 844333 - RNA, 19 nt, Homo sapiens
ugauugcuguuugcuguuu

SEQ ID NO: 844334 - RNA, 19 nt, Homo sapiens
gagggacuaccuaaauaau

SEQ ID NO: 844335 - RNA, 19 nt, Homo sapiens
gggaguaggauguggugaa

SEQ ID NO: 844336 - RNA, 19 nt, Homo sapiens
guuagagaauucccaggau

SEQ ID NO: 844337 - RNA, 19 nt, Homo sapiens
ggacauaugaacaggaacu

SEQ ID NO: 844338 - RNA, 19 nt, Homo sapiens
ggucaugauugcuguuugc

SEQ ID NO: 844339 - RNA, 19 nt, Homo sapiens
guagaggaagcagucauuu

SEQ ID NO: 844340 - RNA, 19 nt, Homo sapiens
ggugacuaccuaaauguga

SEQ ID NO: 844341 - RNA, 19 nt, Homo sapiens
gauuuacuucuaccaacua

SEQ ID NO: 844342 - RNA, 19 nt, Homo sapiens
cuguguagccuguguauga

SEQ ID NO: 844343 - RNA, 19 nt, Homo sapiens
uuaaaaugcugaagacaga

SEQ ID NO: 844344 - RNA, 19 nt, Homo sapiens
acacauccauggcaaacag

SEQ ID NO: 844345 - RNA, 19 nt, Homo sapiens
ggaugagggacuaccuaaa

SEQ ID NO: 844346 - RNA, 19 nt, Homo sapiens
ggaugacaaauuauggauu

SEQ ID NO: 844347 - RNA, 19 nt, Homo sapiens
gcucuacgcccucaaucug

SEQ ID NO: 844348 - RNA, 19 nt, Homo sapiens
gaagaggaauugagaacua

SEQ ID NO: 844349 - RNA, 19 nt, Homo sapiens
uaacaggaguuucugacua

SEQ ID NO: 844350 - RNA, 19 nt, Homo sapiens
gaauugagaacuacuauga

SEQ ID NO: 844351 - RNA, 19 nt, Homo sapiens
gaacuacuaugaugaucug

SEQ ID NO: 844352 - RNA, 19 nt, Homo sapiens
gggaagagcuguccaugca

SEQ ID NO: 844353 - RNA, 19 nt, Homo sapiens
ccaaccaguuuguuaauca

SEQ ID NO: 844354 - RNA, 19 nt, Homo sapiens
guacagauaacaggaguuu

SEQ ID NO: 844355 - RNA, 19 nt, Homo sapiens
gaacgacaacauucgaaga

SEQ ID NO: 844356 - RNA, 19 nt, Homo sapiens
aacaggaguuucugacuaa

SEQ ID NO: 844357 - RNA, 19 nt, Homo sapiens
aaucaaagcugguauuucc

SEQ ID NO: 844358 - RNA, 19 nt, Homo sapiens
caccauguguggcuacaaa

SEQ ID NO: 844359 - RNA, 19 nt, Homo sapiens
gaaccagaccauugacuuc

SEQ ID NO: 844360 - RNA, 19 nt, Homo sapiens
ggacaacuacaccaucaug

SEQ ID NO: 844361 - RNA, 19 nt, Homo sapiens
gcucagggcccauuucauc

SEQ ID NO: 844362 - RNA, 19 nt, Homo sapiens
caaccaguuuguuaaucaa

SEQ ID NO: 844363 - RNA, 19 nt, Homo sapiens
acaaggaccgucugggaua

SEQ ID NO: 844364 - RNA, 19 nt, Homo sapiens
ggaucugccucaucaugga

SEQ ID NO: 844365 - RNA, 19 nt, Homo sapiens
ggagcacucugucacugau

SEQ ID NO: 844366 - RNA, 19 nt, Homo sapiens
ggaaccagaccauugacuu

SEQ ID NO: 844367 - RNA, 19 nt, Homo sapiens
acaaggagcguuucagugu

SEQ ID NO: 844368 - RNA, 19 nt, Homo sapiens
cgaggcagcucuggaaucu

SEQ ID NO: 844369 - RNA, 19 nt, Homo sapiens
cauggacuuuguucagaaa

SEQ ID NO: 844370 - RNA, 19 nt, Homo sapiens
guugagcggcagaaauaua

SEQ ID NO: 844371 - RNA, 19 nt, Homo sapiens
guucauggucuccuucauu

SEQ ID NO: 844372 - RNA, 19 nt, Homo sapiens
ucauggacuuuguucagaa

SEQ ID NO: 844373 - RNA, 19 nt, Homo sapiens
aggcagcucuggaaucugu

SEQ ID NO: 844374 - RNA, 19 nt, Homo sapiens
gaggaauugagaacuacua

SEQ ID NO: 844375 - RNA, 19 nt, Homo sapiens
cuugggaucugccucauca

SEQ ID NO: 844376 - RNA, 19 nt, Homo sapiens
ugacuaaucaaagcuggua

SEQ ID NO: 844377 - RNA, 19 nt, Homo sapiens
aggaguuucugacuaauca

SEQ ID NO: 844378 - RNA, 19 nt, Homo sapiens
uggaggacaucaucaugga

SEQ ID NO: 844379 - RNA, 19 nt, Homo sapiens
gacaacauucgaagaggaa

SEQ ID NO: 844380 - RNA, 19 nt, Homo sapiens
augaugaucuggacuucaa

SEQ ID NO: 844381 - RNA, 19 nt, Homo sapiens
auugagaacuacuaugaug

SEQ ID NO: 844382 - RNA, 19 nt, Homo sapiens
gugacaaccuguaccuucu

SEQ ID NO: 844383 - RNA, 19 nt, Homo sapiens
agguugagcggcagaaaua

SEQ ID NO: 844384 - RNA, 19 nt, Homo sapiens
caaggaccgucugggauag

SEQ ID NO: 844385 - RNA, 19 nt, Homo sapiens
cgacaaggagcguuucagu

SEQ ID NO: 844386 - RNA, 19 nt, Homo sapiens
gagaacuacuaugaugauc

SEQ ID NO: 844387 - RNA, 19 nt, Homo sapiens
ccauugacuuccugaacga

SEQ ID NO: 844388 - RNA, 19 nt, Homo sapiens
cuaaucaaagcugguauuu

SEQ ID NO: 844389 - RNA, 19 nt, Homo sapiens
ggaauugagaacuacuaug

SEQ ID NO: 844390 - RNA, 19 nt, Homo sapiens
gaguuucugacuaaucaaa

SEQ ID NO: 844391 - RNA, 19 nt, Homo sapiens
ggaacacgacagaaguugu

SEQ ID NO: 844392 - RNA, 19 nt, Homo sapiens
uucauggucuccuucauug

SEQ ID NO: 844393 - RNA, 19 nt, Homo sapiens
cuacaaaacuaucgacaag

SEQ ID NO: 844394 - RNA, 19 nt, Homo sapiens
acagauaacaggaguuucu

SEQ ID NO: 844395 - RNA, 19 nt, Homo sapiens
ucacuuaucaucuauucca

SEQ ID NO: 844396 - RNA, 19 nt, Homo sapiens
ggagcaagaaucaguacca

SEQ ID NO: 844397 - RNA, 19 nt, Homo sapiens
caaccuguaccuucuccaa

SEQ ID NO: 844398 - RNA, 19 nt, Homo sapiens
gcaccaacgccgugaucau

SEQ ID NO: 844399 - RNA, 19 nt, Homo sapiens
acaaaacuaucgacaagga

SEQ ID NO: 844400 - RNA, 19 nt, Homo sapiens
ggaggacuaccgagauugg

SEQ ID NO: 844401 - RNA, 19 nt, Homo sapiens
uugagcggcagaaauauaa

SEQ ID NO: 844402 - RNA, 19 nt, Homo sapiens
ugagaacuacuaugaugau

SEQ ID NO: 844403 - RNA, 19 nt, Homo sapiens
gagguugagcggcagaaau

SEQ ID NO: 844404 - RNA, 19 nt, Homo sapiens
ccucugcccacacucagua

SEQ ID NO: 844405 - RNA, 19 nt, Homo sapiens
ccaacgccgugaucaucug

SEQ ID NO: 844406 - RNA, 19 nt, Homo sapiens
caggaacacgacagaaguu

SEQ ID NO: 844407 - RNA, 19 nt, Homo sapiens
gccuugagcccucuugcaa

SEQ ID NO: 844408 - RNA, 19 nt, Homo sapiens
ucugguucauggacaacua

SEQ ID NO: 844409 - RNA, 19 nt, Homo sapiens
ggggaggacuaccgagauu

SEQ ID NO: 844410 - RNA, 19 nt, Homo sapiens
ggcacgggaugcugcuugu

SEQ ID NO: 844411 - RNA, 19 nt, Homo sapiens
caucauggacuuuguucag

SEQ ID NO: 844412 - RNA, 19 nt, Homo sapiens
ggagggaagagcuguccau

SEQ ID NO: 844413 - RNA, 19 nt, Homo sapiens
ggaagggcaggagggaaga

SEQ ID NO: 844414 - RNA, 19 nt, Homo sapiens
gguggaggacaucaucaug

SEQ ID NO: 844415 - RNA, 19 nt, Homo sapiens
ucaggaacacgacagaagu

SEQ ID NO: 844416 - RNA, 19 nt, Homo sapiens
gcaucaggaacacgacaga

SEQ ID NO: 844417 - RNA, 19 nt, Homo sapiens
cccuacaccugcugcauca

SEQ ID NO: 844418 - RNA, 19 nt, Homo sapiens
cuaccucuggcucaaguuu

SEQ ID NO: 844419 - RNA, 19 nt, Homo sapiens
uaccgagauuggagcaaga

SEQ ID NO: 844420 - RNA, 19 nt, Homo sapiens
gaccauugacuuccugaac

SEQ ID NO: 844421 - RNA, 19 nt, Homo sapiens
ggaguucccuuuccucuua

SEQ ID NO: 844422 - RNA, 19 nt, Homo sapiens
gagaugagcuguagccuuu

SEQ ID NO: 844423 - RNA, 19 nt, Homo sapiens
gaaaucgugucuauguuua

SEQ ID NO: 844424 - RNA, 19 nt, Homo sapiens
gcagguauuugucauauuu

SEQ ID NO: 844425 - RNA, 19 nt, Homo sapiens
gcaauuugaugaugcauuu

SEQ ID NO: 844426 - RNA, 19 nt, Homo sapiens
caucaaggcuucaauaaga

SEQ ID NO: 844427 - RNA, 19 nt, Homo sapiens
gcaaggagcuaauucaucu

SEQ ID NO: 844428 - RNA, 19 nt, Homo sapiens
uaacaacacugaucucuuc

SEQ ID NO: 844429 - RNA, 19 nt, Homo sapiens
gaaaguaaauacacaugga

SEQ ID NO: 844430 - RNA, 19 nt, Homo sapiens
gggauaagcuccagaaaca

SEQ ID NO: 844431 - RNA, 19 nt, Homo sapiens
gaaacaguauuaugucuca

SEQ ID NO: 844432 - RNA, 19 nt, Homo sapiens
gcagagagcauguuuacaa

SEQ ID NO: 844433 - RNA, 19 nt, Homo sapiens
ccagacaucucucuaguga

SEQ ID NO: 844434 - RNA, 19 nt, Homo sapiens
gagaccacguuuauacaua

SEQ ID NO: 844435 - RNA, 19 nt, Homo sapiens
uaucagacauuauggcuuu

SEQ ID NO: 844436 - RNA, 19 nt, Homo sapiens
acaagaaacucuacaacaa

SEQ ID NO: 844437 - RNA, 19 nt, Homo sapiens
ggaauacccucccggcuau

SEQ ID NO: 844438 - RNA, 19 nt, Homo sapiens
gagagcauguuuacaaaug

SEQ ID NO: 844439 - RNA, 19 nt, Homo sapiens
ggaaugacuccucaguuua

SEQ ID NO: 844440 - RNA, 19 nt, Homo sapiens
ucaguugacuacucaguua

SEQ ID NO: 844441 - RNA, 19 nt, Homo sapiens
caacacugaucucuucaaa

SEQ ID NO: 844442 - RNA, 19 nt, Homo sapiens
gaagauuaguguuguuugu

SEQ ID NO: 844443 - RNA, 19 nt, Homo sapiens
ggauaaacauagaacaaga

SEQ ID NO: 844444 - RNA, 19 nt, Homo sapiens
ggaaacccucuguaauuua

SEQ ID NO: 844445 - RNA, 19 nt, Homo sapiens
gaaaaugacucagaagaaa

SEQ ID NO: 844446 - RNA, 19 nt, Homo sapiens
gaagcucucuuuccacuag

SEQ ID NO: 844447 - RNA, 19 nt, Homo sapiens
gcaaagaugaccucacuga

SEQ ID NO: 844448 - RNA, 19 nt, Homo sapiens
gagcaaagaugaccucacu

SEQ ID NO: 844449 - RNA, 19 nt, Homo sapiens
cagaugcacuuuacgaauu

SEQ ID NO: 844450 - RNA, 19 nt, Homo sapiens
uauggcagcuggcuugaua

SEQ ID NO: 844451 - RNA, 19 nt, Homo sapiens
cagcauacuucuuucauug

SEQ ID NO: 844452 - RNA, 19 nt, Homo sapiens
ggaagaggcuagaugucaa

SEQ ID NO: 844453 - RNA, 19 nt, Homo sapiens
ucgcacaacuucccacaua

SEQ ID NO: 844454 - RNA, 19 nt, Homo sapiens
ccugggaauugaaguauua

SEQ ID NO: 844455 - RNA, 19 nt, Homo sapiens
ggaaaauccuguagaguuu

SEQ ID NO: 844456 - RNA, 19 nt, Homo sapiens
ggacaagcaucagccacua

SEQ ID NO: 844457 - RNA, 19 nt, Homo sapiens
uguaacaucucucaugaaa

SEQ ID NO: 844458 - RNA, 19 nt, Homo sapiens
cauuuaaacugcuuucuga

SEQ ID NO: 844459 - RNA, 19 nt, Homo sapiens
uggaaugacuccucaguuu

SEQ ID NO: 844460 - RNA, 19 nt, Homo sapiens
gauaugcugcuguucuuua

SEQ ID NO: 844461 - RNA, 19 nt, Homo sapiens
gaaguggucucccuuugca

SEQ ID NO: 844462 - RNA, 19 nt, Homo sapiens
gguaugcgguucuaagaga

SEQ ID NO: 844463 - RNA, 19 nt, Homo sapiens
ucacacauaugacagauuc

SEQ ID NO: 844464 - RNA, 19 nt, Homo sapiens
gagcaccguuuauuaggaa

SEQ ID NO: 844465 - RNA, 19 nt, Homo sapiens
gcuaauucaucuugcauug

SEQ ID NO: 844466 - RNA, 19 nt, Homo sapiens
guauccaguucucuuauaa

SEQ ID NO: 844467 - RNA, 19 nt, Homo sapiens
gaagagcuauugguacauc

SEQ ID NO: 844468 - RNA, 19 nt, Homo sapiens
gggcgucaauguuguuauu

SEQ ID NO: 844469 - RNA, 19 nt, Homo sapiens
ccagauauccugccuaugu

SEQ ID NO: 844470 - RNA, 19 nt, Homo sapiens
gccaaaggauggaaggaaa

SEQ ID NO: 844471 - RNA, 19 nt, Homo sapiens
ugggauugcuuauacauuu

SEQ ID NO: 844472 - RNA, 19 nt, Homo sapiens
gaagaaacucagacuaugu

SEQ ID NO: 844473 - RNA, 19 nt, Homo sapiens
gcagcuggcuugauauugg

SEQ ID NO: 844474 - RNA, 19 nt, Homo sapiens
gaucuugccucugucuauu

SEQ ID NO: 844475 - RNA, 19 nt, Homo sapiens
guuaaggacuucuuucauc

SEQ ID NO: 844476 - RNA, 19 nt, Homo sapiens
ccuggaagcuguucuugaa

SEQ ID NO: 844477 - RNA, 19 nt, Homo sapiens
uaggaaacccucuguaauu

SEQ ID NO: 844478 - RNA, 19 nt, Homo sapiens
uggcugagcuggaaggaaa

SEQ ID NO: 844479 - RNA, 19 nt, Homo sapiens
gagagcaccugcagcaauc

SEQ ID NO: 844480 - RNA, 19 nt, Homo sapiens
cgaagaaacucagacuaug

SEQ ID NO: 844481 - RNA, 19 nt, Homo sapiens
cagagagcauguuuacaaa

SEQ ID NO: 844482 - RNA, 19 nt, Homo sapiens
gaugauggaguuaaagaaa

SEQ ID NO: 844483 - RNA, 19 nt, Homo sapiens
augcuaagcuuuccuggua

SEQ ID NO: 844484 - RNA, 19 nt, Homo sapiens
gugccaccgucaauauuua

SEQ ID NO: 844485 - RNA, 19 nt, Homo sapiens
ccacuaguguugucuuguu

SEQ ID NO: 844486 - RNA, 19 nt, Homo sapiens
guuguaacaucucucauga

SEQ ID NO: 844487 - RNA, 19 nt, Homo sapiens
guaaagaagugaagaaacc

SEQ ID NO: 844488 - RNA, 19 nt, Homo sapiens
gcacaaaggccuaaaauca

SEQ ID NO: 844489 - RNA, 19 nt, Homo sapiens
ccauguauguuguguauag

SEQ ID NO: 844490 - RNA, 19 nt, Homo sapiens
gaguggagauuggagaauu

SEQ ID NO: 844491 - RNA, 19 nt, Homo sapiens
aaagaaaucgugucuaugu

SEQ ID NO: 844492 - RNA, 19 nt, Homo sapiens
cugaugauguggaagauuu

SEQ ID NO: 844493 - RNA, 19 nt, Homo sapiens
gauauugcaccauugauga

SEQ ID NO: 844494 - RNA, 19 nt, Homo sapiens
aguaucagcucagcaauuu

SEQ ID NO: 844495 - RNA, 19 nt, Homo sapiens
guucuucgccuccaucuuu

SEQ ID NO: 844496 - RNA, 19 nt, Homo sapiens
aggaaacccucuguaauuu

SEQ ID NO: 844497 - RNA, 19 nt, Homo sapiens
gcuauugguacaucuguua

SEQ ID NO: 844498 - RNA, 19 nt, Homo sapiens
ccaaacaguucaacauuuu

SEQ ID NO: 844499 - RNA, 19 nt, Homo sapiens
gcccagauauccugccuau

SEQ ID NO: 844500 - RNA, 19 nt, Homo sapiens
gaagaugucagugcaguug

SEQ ID NO: 844501 - RNA, 19 nt, Homo sapiens
agaugcacuuuacgaauua

SEQ ID NO: 844502 - RNA, 19 nt, Homo sapiens
ggcaugaaauagugauuau

SEQ ID NO: 844503 - RNA, 19 nt, Homo sapiens
auaagaagauggauaugga

SEQ ID NO: 844504 - RNA, 19 nt, Homo sapiens
ccuauuaucacacauauga

SEQ ID NO: 844505 - RNA, 19 nt, Homo sapiens
ccagaaacaaccagucuuu

SEQ ID NO: 844506 - RNA, 19 nt, Homo sapiens
gcuuugaucuugccucugu

SEQ ID NO: 844507 - RNA, 19 nt, Homo sapiens
guaugaagcucucuuucca

SEQ ID NO: 844508 - RNA, 19 nt, Homo sapiens
ggaauugaaguauuaguuc

SEQ ID NO: 844509 - RNA, 19 nt, Homo sapiens
uuaaacugcuuucugauuc

SEQ ID NO: 844510 - RNA, 19 nt, Homo sapiens
cagucaggguguauuauuu

SEQ ID NO: 844511 - RNA, 19 nt, Homo sapiens
uggcagcucuucccaguga

SEQ ID NO: 844512 - RNA, 19 nt, Homo sapiens
cagguuaucuggaacaaag

SEQ ID NO: 844513 - RNA, 19 nt, Homo sapiens
aaaggaagagcuauuggua

SEQ ID NO: 844514 - RNA, 19 nt, Homo sapiens
acagaaaguuugaugaagu

SEQ ID NO: 844515 - RNA, 19 nt, Homo sapiens
caaagcagagagcauguuu

SEQ ID NO: 844516 - RNA, 19 nt, Homo sapiens
acauaucccugcagaguug

SEQ ID NO: 844517 - RNA, 19 nt, Homo sapiens
caagaaacucuacaacaau

SEQ ID NO: 844518 - RNA, 19 nt, Homo sapiens
caaccuaccuacuucuaag

SEQ ID NO: 844519 - RNA, 19 nt, Homo sapiens
uaacaucucucaugaaaag

SEQ ID NO: 844520 - RNA, 19 nt, Homo sapiens
cagaaaguuugaugaagug

SEQ ID NO: 844521 - RNA, 19 nt, Homo sapiens
ggacuuacauuaauuaugg

SEQ ID NO: 844522 - RNA, 19 nt, Homo sapiens
ccaaaggacuuacauuaau

SEQ ID NO: 844523 - RNA, 19 nt, Homo sapiens
caacagacaugcaaagauc

SEQ ID NO: 844524 - RNA, 19 nt, Homo sapiens
ccauagaccuucagacauu

SEQ ID NO: 844525 - RNA, 19 nt, Homo sapiens
gaacugugccgcauaaaug

SEQ ID NO: 844526 - RNA, 19 nt, Homo sapiens
ggaacaaauugacaaccua

SEQ ID NO: 844527 - RNA, 19 nt, Homo sapiens
gggcuuccuuuguauguua

SEQ ID NO: 844528 - RNA, 19 nt, Homo sapiens
gagcugaggccucuacuuu

SEQ ID NO: 844529 - RNA, 19 nt, Homo sapiens
aaagggagccguacaguuu

SEQ ID NO: 844530 - RNA, 19 nt, Homo sapiens
caaagugaaugaccucugu

SEQ ID NO: 844531 - RNA, 19 nt, Homo sapiens
gaaugagguucccaaagga

SEQ ID NO: 844532 - RNA, 19 nt, Homo sapiens
ggacucaguagcacaagua

SEQ ID NO: 844533 - RNA, 19 nt, Homo sapiens
gcaaagauccuaggagaca

SEQ ID NO: 844534 - RNA, 19 nt, Homo sapiens
ccgaagggcugcuggaguu

SEQ ID NO: 844535 - RNA, 19 nt, Homo sapiens
gaacgacugagacggcuaa

SEQ ID NO: 844536 - RNA, 19 nt, Homo sapiens
cauagaccuucagacauua

SEQ ID NO: 844537 - RNA, 19 nt, Homo sapiens
gcugcauacuugaggcuua

SEQ ID NO: 844538 - RNA, 19 nt, Homo sapiens
agaaugagguucccaaagg

SEQ ID NO: 844539 - RNA, 19 nt, Homo sapiens
gcacuucgucuuacccauu

SEQ ID NO: 844540 - RNA, 19 nt, Homo sapiens
gaauacaguagcaguguug

SEQ ID NO: 844541 - RNA, 19 nt, Homo sapiens
ucccaaaggacuuacauua

SEQ ID NO: 844542 - RNA, 19 nt, Homo sapiens
gaucuugaccccuauguua

SEQ ID NO: 844543 - RNA, 19 nt, Homo sapiens
gcaaagucaaagugaauga

SEQ ID NO: 844544 - RNA, 19 nt, Homo sapiens
ccaggcaaauaacagauga

SEQ ID NO: 844545 - RNA, 19 nt, Homo sapiens
gcagcucgacucucacgua

SEQ ID NO: 844546 - RNA, 19 nt, Homo sapiens
cgucuuacccauuuaugua

SEQ ID NO: 844547 - RNA, 19 nt, Homo sapiens
cccaaaggacuuacauuaa

SEQ ID NO: 844548 - RNA, 19 nt, Homo sapiens
caaccuagccacagaacug

SEQ ID NO: 844549 - RNA, 19 nt, Homo sapiens
guagcaguguugauagaau

SEQ ID NO: 844550 - RNA, 19 nt, Homo sapiens
gcaggcaaagucaaaguga

SEQ ID NO: 844551 - RNA, 19 nt, Homo sapiens
uaacagaugagccuaugga

SEQ ID NO: 844552 - RNA, 19 nt, Homo sapiens
gaagguggcccuggaucuu

SEQ ID NO: 844553 - RNA, 19 nt, Homo sapiens
cagaggggcuuccuuugua

SEQ ID NO: 844554 - RNA, 19 nt, Homo sapiens
guuaacaacauucuacaga

SEQ ID NO: 844555 - RNA, 19 nt, Homo sapiens
guagagcuccgggaacaaa

SEQ ID NO: 844556 - RNA, 19 nt, Homo sapiens
uacaguagcaguguugaua

SEQ ID NO: 844557 - RNA, 19 nt, Homo sapiens
cuacacacagccagaauga

SEQ ID NO: 844558 - RNA, 19 nt, Homo sapiens
caguagcaguguugauaga

SEQ ID NO: 844559 - RNA, 19 nt, Homo sapiens
ugaauacaguagcaguguu

SEQ ID NO: 844560 - RNA, 19 nt, Homo sapiens
gggaacaaauugacaaccu

SEQ ID NO: 844561 - RNA, 19 nt, Homo sapiens
guacacgccgucagagaga

SEQ ID NO: 844562 - RNA, 19 nt, Homo sapiens
gcgacgcguugucuugguu

SEQ ID NO: 844563 - RNA, 19 nt, Homo sapiens
gcucuugcuuccuuucaca

SEQ ID NO: 844564 - RNA, 19 nt, Homo sapiens
gagguucccaaaggacuua

SEQ ID NO: 844565 - RNA, 19 nt, Homo sapiens
ugucuugguuaacaacauu

SEQ ID NO: 844566 - RNA, 19 nt, Homo sapiens
caggcaaagucaaagugaa

SEQ ID NO: 844567 - RNA, 19 nt, Homo sapiens
cacuucgucuuacccauuu

SEQ ID NO: 844568 - RNA, 19 nt, Homo sapiens
ucacguacacgccgucaga

SEQ ID NO: 844569 - RNA, 19 nt, Homo sapiens
aauaacagaugagccuaug

SEQ ID NO: 844570 - RNA, 19 nt, Homo sapiens
uagcaguguugauagaauc

SEQ ID NO: 844571 - RNA, 19 nt, Homo sapiens
ugcagcagcucgacucuca

SEQ ID NO: 844572 - RNA, 19 nt, Homo sapiens
gcucgacucucacguacac

SEQ ID NO: 844573 - RNA, 19 nt, Homo sapiens
uuauugcacuggcuugaau

SEQ ID NO: 844574 - RNA, 19 nt, Homo sapiens
cgucagagagagccaggua

SEQ ID NO: 844575 - RNA, 19 nt, Homo sapiens
gagcuccgggaacaaauug

SEQ ID NO: 844576 - RNA, 19 nt, Homo sapiens
ucagagagagccagguaga

SEQ ID NO: 844577 - RNA, 19 nt, Homo sapiens
acagaaugcucaggaacga

SEQ ID NO: 844578 - RNA, 19 nt, Homo sapiens
gcauguccucuaccuguga

SEQ ID NO: 844579 - RNA, 19 nt, Homo sapiens
ccagcugccuuguuucaac

SEQ ID NO: 844580 - RNA, 19 nt, Homo sapiens
gacgcguugucuugguuaa

SEQ ID NO: 844581 - RNA, 19 nt, Homo sapiens
uuauggcucuugcuuccuu

SEQ ID NO: 844582 - RNA, 19 nt, Homo sapiens
ccagaaugagguucccaaa

SEQ ID NO: 844583 - RNA, 19 nt, Homo sapiens
ggagccguacaguuuguuu

SEQ ID NO: 844584 - RNA, 19 nt, Homo sapiens
uaccugugacuucucauuu

SEQ ID NO: 844585 - RNA, 19 nt, Homo sapiens
cgacgcguugucuugguua

SEQ ID NO: 844586 - RNA, 19 nt, Homo sapiens
ucuacagaaugcucaggaa

SEQ ID NO: 844587 - RNA, 19 nt, Homo sapiens
cuucaggacuaguuaacca

SEQ ID NO: 844588 - RNA, 19 nt, Homo sapiens
gccguacaguuuguuugaa

SEQ ID NO: 844589 - RNA, 19 nt, Homo sapiens
ucaacagacaugcaaagau

SEQ ID NO: 844590 - RNA, 19 nt, Homo sapiens
cgacugagacggcuaaacc

SEQ ID NO: 844591 - RNA, 19 nt, Homo sapiens
uugcuuccuuucacaaaug

SEQ ID NO: 844592 - RNA, 19 nt, Homo sapiens
uuaauuauggcucuugcuu

SEQ ID NO: 844593 - RNA, 19 nt, Homo sapiens
acuugaggcuuaccuucuu

SEQ ID NO: 844594 - RNA, 19 nt, Homo sapiens
uugacaaccuagccacaga

SEQ ID NO: 844595 - RNA, 19 nt, Homo sapiens
gagccguacaguuuguuug

SEQ ID NO: 844596 - RNA, 19 nt, Homo sapiens
ugacaaccuagccacagaa

SEQ ID NO: 844597 - RNA, 19 nt, Homo sapiens
ccguacaguuuguuugaag

SEQ ID NO: 844598 - RNA, 19 nt, Homo sapiens
gugaggagaugguuauuua

SEQ ID NO: 844599 - RNA, 19 nt, Homo sapiens
ggagaugguuauuuaaaga

SEQ ID NO: 844600 - RNA, 19 nt, Homo sapiens
gcgcuaacauucacucuug

SEQ ID NO: 844601 - RNA, 19 nt, Homo sapiens
gcggagugaucgucaauaa

SEQ ID NO: 844602 - RNA, 19 nt, Homo sapiens
cauaaacaauuaccaggaa

SEQ ID NO: 844603 - RNA, 19 nt, Homo sapiens
gaagugaggagaugguuau

SEQ ID NO: 844604 - RNA, 19 nt, Homo sapiens
ggucugaucauaaacaauu

SEQ ID NO: 844605 - RNA, 19 nt, Homo sapiens
gaucaagcagcccguauuu

SEQ ID NO: 844606 - RNA, 19 nt, Homo sapiens
gaggagaugguuauuuaaa

SEQ ID NO: 844607 - RNA, 19 nt, Homo sapiens
gaaagacugugagaucaag

SEQ ID NO: 844608 - RNA, 19 nt, Homo sapiens
ggagugaucgucaauaaca

SEQ ID NO: 844609 - RNA, 19 nt, Homo sapiens
gccagacccugcucacauu

SEQ ID NO: 844610 - RNA, 19 nt, Homo sapiens
cuauggcgcucaacaagaa

SEQ ID NO: 844611 - RNA, 19 nt, Homo sapiens
ucaaugacaugaagaacgu

SEQ ID NO: 844612 - RNA, 19 nt, Homo sapiens
cuccaggucugaucauaaa

SEQ ID NO: 844613 - RNA, 19 nt, Homo sapiens
gagagacuauggcgcucaa

SEQ ID NO: 844614 - RNA, 19 nt, Homo sapiens
gcugguguuucuggaauuu

SEQ ID NO: 844615 - RNA, 19 nt, Homo sapiens
caagaaaggcacugucuac

SEQ ID NO: 844616 - RNA, 19 nt, Homo sapiens
caugaaagacugugagauc

SEQ ID NO: 844617 - RNA, 19 nt, Homo sapiens
aagauaagaagacccagua

SEQ ID NO: 844618 - RNA, 19 nt, Homo sapiens
gcaauccucacaacgucua

SEQ ID NO: 844619 - RNA, 19 nt, Homo sapiens
augcaugucuguccacuug

SEQ ID NO: 844620 - RNA, 19 nt, Homo sapiens
gcauccuaauguccuauga

SEQ ID NO: 844621 - RNA, 19 nt, Homo sapiens
guuugcaccucgauuuguu

SEQ ID NO: 844622 - RNA, 19 nt, Homo sapiens
ccucaccucucacuuccuu

SEQ ID NO: 844623 - RNA, 19 nt, Homo sapiens
ucaagcagcccguauuugg

SEQ ID NO: 844624 - RNA, 19 nt, Homo sapiens
ucaaagggaccaagaaagg

SEQ ID NO: 844625 - RNA, 19 nt, Homo sapiens
gccaugaagugaggagaug

SEQ ID NO: 844626 - RNA, 19 nt, Homo sapiens
ccaagaaaggcacugucua

SEQ ID NO: 844627 - RNA, 19 nt, Homo sapiens
gccuauggcuacucuuaca

SEQ ID NO: 844628 - RNA, 19 nt, Homo sapiens
ugaagugaggagaugguua

SEQ ID NO: 844629 - RNA, 19 nt, Homo sapiens
gcaugucuguccacuuggu

SEQ ID NO: 844630 - RNA, 19 nt, Homo sapiens
aaacaauuaccaggaacua

SEQ ID NO: 844631 - RNA, 19 nt, Homo sapiens
gcuacacucagccucauga

SEQ ID NO: 844632 - RNA, 19 nt, Homo sapiens
caggucugaucauaaacaa

SEQ ID NO: 844633 - RNA, 19 nt, Homo sapiens
uaacaccgagagcauccua

SEQ ID NO: 844634 - RNA, 19 nt, Homo sapiens
gcucugcuuccuacaaguu

SEQ ID NO: 844635 - RNA, 19 nt, Homo sapiens
gcaccucgauuuguuugcu

SEQ ID NO: 844636 - RNA, 19 nt, Homo sapiens
ggaaccagagaaugcaugu

SEQ ID NO: 844637 - RNA, 19 nt, Homo sapiens
cagccgccagcgccuauua

SEQ ID NO: 844638 - RNA, 19 nt, Homo sapiens
ugaaagacugugagaucaa

SEQ ID NO: 844639 - RNA, 19 nt, Homo sapiens
ucacguggaacucacauuc

SEQ ID NO: 844640 - RNA, 19 nt, Homo sapiens
guccuaugaucacguggaa

SEQ ID NO: 844641 - RNA, 19 nt, Homo sapiens
uguccugggucauguuguu

SEQ ID NO: 844642 - RNA, 19 nt, Homo sapiens
cuagcauugugggacauua

SEQ ID NO: 844643 - RNA, 19 nt, Homo sapiens
gccagucgccaauggaaug

SEQ ID NO: 844644 - RNA, 19 nt, Homo sapiens
aggagaugguuauuuaaag

SEQ ID NO: 844645 - RNA, 19 nt, Homo sapiens
ugaggagaugguuauuuaa

SEQ ID NO: 844646 - RNA, 19 nt, Homo sapiens
gcacggagcauccccuguu

SEQ ID NO: 844647 - RNA, 19 nt, Homo sapiens
cuucaaagggaccaagaaa

SEQ ID NO: 844648 - RNA, 19 nt, Homo sapiens
ucaauaacaccgagagcau

SEQ ID NO: 844649 - RNA, 19 nt, Homo sapiens
ucccuggacuggccaugaa

SEQ ID NO: 844650 - RNA, 19 nt, Homo sapiens
gagaucaagcagcccguau

SEQ ID NO: 844651 - RNA, 19 nt, Homo sapiens
ccucaugagccacuucaga

SEQ ID NO: 844652 - RNA, 19 nt, Homo sapiens
acguggaacucacauucaa

SEQ ID NO: 844653 - RNA, 19 nt, Homo sapiens
augaaagacugugagauca

SEQ ID NO: 844654 - RNA, 19 nt, Homo sapiens
ccuguuugcaccucgauuu

SEQ ID NO: 844655 - RNA, 19 nt, Homo sapiens
gagaugguuauuuaaagag

SEQ ID NO: 844656 - RNA, 19 nt, Homo sapiens
ccucucacuuccuucuaga

SEQ ID NO: 844657 - RNA, 19 nt, Homo sapiens
gagacuauggcgcucaaca

SEQ ID NO: 844658 - RNA, 19 nt, Homo sapiens
ccuccaggucugaucauaa

SEQ ID NO: 844659 - RNA, 19 nt, Homo sapiens
ggaccaagaaaggcacugu

SEQ ID NO: 844660 - RNA, 19 nt, Homo sapiens
ccgagagcauccuaauguc

SEQ ID NO: 844661 - RNA, 19 nt, Homo sapiens
ccaggucugaucauaaaca

SEQ ID NO: 844662 - RNA, 19 nt, Homo sapiens
agagcauccuaauguccua

SEQ ID NO: 844663 - RNA, 19 nt, Homo sapiens
gacuauggcgcucaacaag

SEQ ID NO: 844664 - RNA, 19 nt, Homo sapiens
agacuauggcgcucaacaa

SEQ ID NO: 844665 - RNA, 19 nt, Homo sapiens
accgagagcauccuaaugu

SEQ ID NO: 844666 - RNA, 19 nt, Homo sapiens
ggacaucccauaaguaguu

SEQ ID NO: 844667 - RNA, 19 nt, Homo sapiens
cagcugcccugcccacuuu

SEQ ID NO: 844668 - RNA, 19 nt, Homo sapiens
ccuagaaucugccugaaag

SEQ ID NO: 844669 - RNA, 19 nt, Homo sapiens
gaggguggauggguuacuu

SEQ ID NO: 844670 - RNA, 19 nt, Homo sapiens
gacauacacaggagccuuu

SEQ ID NO: 844671 - RNA, 19 nt, Homo sapiens
ucaaggaggugaggguuag

SEQ ID NO: 844672 - RNA, 19 nt, Homo sapiens
acuaugagcucuggugguu

SEQ ID NO: 844673 - RNA, 19 nt, Homo sapiens
ugaaggaacaaauguggaa

SEQ ID NO: 844674 - RNA, 19 nt, Homo sapiens
ugagaggguggauggguua

SEQ ID NO: 844675 - RNA, 19 nt, Homo sapiens
gacaucccauaaguaguuu

SEQ ID NO: 844676 - RNA, 19 nt, Homo sapiens
gagcugugcccaggaguga

SEQ ID NO: 844677 - RNA, 19 nt, Homo sapiens
ggacugugcuagcuuuacc

SEQ ID NO: 844678 - RNA, 19 nt, Homo sapiens
cagcagcggcagcgugaaa

SEQ ID NO: 844679 - RNA, 19 nt, Homo sapiens
acaggagccuuugaucuca

SEQ ID NO: 844680 - RNA, 19 nt, Homo sapiens
ggcuguagguggagguaug

SEQ ID NO: 844681 - RNA, 19 nt, Homo sapiens
uaugagcucuggugguucu

SEQ ID NO: 844682 - RNA, 19 nt, Homo sapiens
gagccuuugaucucauuaa

SEQ ID NO: 844683 - RNA, 19 nt, Homo sapiens
gcccaggagugaacaacca

SEQ ID NO: 844684 - RNA, 19 nt, Homo sapiens
guuacuugcccaccagaaa

SEQ ID NO: 844685 - RNA, 19 nt, Homo sapiens
gucaaggaggugaggguua

SEQ ID NO: 844686 - RNA, 19 nt, Homo sapiens
cugccgcuaucgccguuua

SEQ ID NO: 844687 - RNA, 19 nt, Homo sapiens
agccuuugaucucauuaaa

SEQ ID NO: 844688 - RNA, 19 nt, Homo sapiens
caacuccuugcguuccuuu

SEQ ID NO: 844689 - RNA, 19 nt, Homo sapiens
aaacucaggcugcaacaac

SEQ ID NO: 844690 - RNA, 19 nt, Homo sapiens
cacaggagccuuugaucuc

SEQ ID NO: 844691 - RNA, 19 nt, Homo sapiens
uaacuggcgacuccgguau

SEQ ID NO: 844692 - RNA, 19 nt, Homo sapiens
gcugcugcaccuacuacua

SEQ ID NO: 844693 - RNA, 19 nt, Homo sapiens
cugcugcaccuacuacuau

SEQ ID NO: 844694 - RNA, 19 nt, Homo sapiens
gcccuagucccaacuccuu

SEQ ID NO: 844695 - RNA, 19 nt, Homo sapiens
agcgugaaaucaacuuguu

SEQ ID NO: 844696 - RNA, 19 nt, Homo sapiens
acacaggagccuuugaucu

SEQ ID NO: 844697 - RNA, 19 nt, Homo sapiens
gcacauggauuauaaguau

SEQ ID NO: 844698 - RNA, 19 nt, Homo sapiens
caacaagccucucauaguu

SEQ ID NO: 844699 - RNA, 19 nt, Homo sapiens
caacagaauuaccaugaua

SEQ ID NO: 844700 - RNA, 19 nt, Homo sapiens
ggaagaggauggaaacuga

SEQ ID NO: 844701 - RNA, 19 nt, Homo sapiens
ggacggaugugcacaguga

SEQ ID NO: 844702 - RNA, 19 nt, Homo sapiens
gcaagugcgucagcauuua

SEQ ID NO: 844703 - RNA, 19 nt, Homo sapiens
ccaaauacaucgcauuaga

SEQ ID NO: 844704 - RNA, 19 nt, Homo sapiens
aaauaaaccuccagaagaa

SEQ ID NO: 844705 - RNA, 19 nt, Homo sapiens
caacaaaugugaugugaag

SEQ ID NO: 844706 - RNA, 19 nt, Homo sapiens
gaagggaaauaaagugaau

SEQ ID NO: 844707 - RNA, 19 nt, Homo sapiens
ugaggaagguguuauuaaa

SEQ ID NO: 844708 - RNA, 19 nt, Homo sapiens
guacugggauuuaaugaau

SEQ ID NO: 844709 - RNA, 19 nt, Homo sapiens
ugaaugaggugcugaauag

SEQ ID NO: 844710 - RNA, 19 nt, Homo sapiens
gcuagaguguugcuguuua

SEQ ID NO: 844711 - RNA, 19 nt, Homo sapiens
gacaguguuuccacauuua

SEQ ID NO: 844712 - RNA, 19 nt, Homo sapiens
ggacaauguugcuaaagau

SEQ ID NO: 844713 - RNA, 19 nt, Homo sapiens
gauagacacguguuugaua

SEQ ID NO: 844714 - RNA, 19 nt, Homo sapiens
ggaaaugggagaugauuau

SEQ ID NO: 844715 - RNA, 19 nt, Homo sapiens
caucagaccucucuucauc

SEQ ID NO: 844716 - RNA, 19 nt, Homo sapiens
uagcugaacuuucugaaga

SEQ ID NO: 844717 - RNA, 19 nt, Homo sapiens
gauagacuuucacaaauuc

SEQ ID NO: 844718 - RNA, 19 nt, Homo sapiens
gaagaaugcucagaagaag

SEQ ID NO: 844719 - RNA, 19 nt, Homo sapiens
cgacaaggaucauuacaag

SEQ ID NO: 844720 - RNA, 19 nt, Homo sapiens
ggaagguguuauuaaaguu

SEQ ID NO: 844721 - RNA, 19 nt, Homo sapiens
cgaaagacuccaaccguua

SEQ ID NO: 844722 - RNA, 19 nt, Homo sapiens
gaauuaccaugauagacuu

SEQ ID NO: 844723 - RNA, 19 nt, Homo sapiens
gaagaaagccaagacuaug

SEQ ID NO: 844724 - RNA, 19 nt, Homo sapiens
gaaaugggagaugauuaua

SEQ ID NO: 844725 - RNA, 19 nt, Homo sapiens
caugauagacuuucacaaa

SEQ ID NO: 844726 - RNA, 19 nt, Homo sapiens
ugaaggauucccuguaaua

SEQ ID NO: 844727 - RNA, 19 nt, Homo sapiens
gaaagacuccaaccguuau

SEQ ID NO: 844728 - RNA, 19 nt, Homo sapiens
gaacaucagaccucucuuc

SEQ ID NO: 844729 - RNA, 19 nt, Homo sapiens
agacaguguuuccacauuu

SEQ ID NO: 844730 - RNA, 19 nt, Homo sapiens
uaaagacgaugcccauuac

SEQ ID NO: 844731 - RNA, 19 nt, Homo sapiens
cagaaguacugggauuuaa

SEQ ID NO: 844732 - RNA, 19 nt, Homo sapiens
caaagcaaauucgagagaa

SEQ ID NO: 844733 - RNA, 19 nt, Homo sapiens
ucugaaggauucccuguaa

SEQ ID NO: 844734 - RNA, 19 nt, Homo sapiens
gaagagaauagcugaacuu

SEQ ID NO: 844735 - RNA, 19 nt, Homo sapiens
caaggaucauuacaaguug

SEQ ID NO: 844736 - RNA, 19 nt, Homo sapiens
uguaagagcugggagcaaa

SEQ ID NO: 844737 - RNA, 19 nt, Homo sapiens
gaacugggaagauuuacug

SEQ ID NO: 844738 - RNA, 19 nt, Homo sapiens
gaguguugcuguuuauuuc

SEQ ID NO: 844739 - RNA, 19 nt, Homo sapiens
gaaguacugggauuuaaug

SEQ ID NO: 844740 - RNA, 19 nt, Homo sapiens
guucuaugcugauuugaug

SEQ ID NO: 844741 - RNA, 19 nt, Homo sapiens
gaguaucaguugcuucaga

SEQ ID NO: 844742 - RNA, 19 nt, Homo sapiens
gcaaagcaaauucgagaga

SEQ ID NO: 844743 - RNA, 19 nt, Homo sapiens
aaacuaugguuaacccuau

SEQ ID NO: 844744 - RNA, 19 nt, Homo sapiens
gaagaggaaagcugguaaa

SEQ ID NO: 844745 - RNA, 19 nt, Homo sapiens
caaaugugaugugaagaga

SEQ ID NO: 844746 - RNA, 19 nt, Homo sapiens
ugaagaaugcucagaagaa

SEQ ID NO: 844747 - RNA, 19 nt, Homo sapiens
gaagcagaguuuggaguau

SEQ ID NO: 844748 - RNA, 19 nt, Homo sapiens
auaaagacgaugcccauua

SEQ ID NO: 844749 - RNA, 19 nt, Homo sapiens
uaccaaauacaucgcauua

SEQ ID NO: 844750 - RNA, 19 nt, Homo sapiens
ucagaacugggaagauuua

SEQ ID NO: 844751 - RNA, 19 nt, Homo sapiens
ggagcucuguacaaacuga

SEQ ID NO: 844752 - RNA, 19 nt, Homo sapiens
guguugacauggacgauaa

SEQ ID NO: 844753 - RNA, 19 nt, Homo sapiens
acgaagagaugcuggaaau

SEQ ID NO: 844754 - RNA, 19 nt, Homo sapiens
cuagaacucuuccagaaca

SEQ ID NO: 844755 - RNA, 19 nt, Homo sapiens
acaaggaucauuacaaguu

SEQ ID NO: 844756 - RNA, 19 nt, Homo sapiens
ugaauauucucuacgacaa

SEQ ID NO: 844757 - RNA, 19 nt, Homo sapiens
ggaagaggaaagcugguaa

SEQ ID NO: 844758 - RNA, 19 nt, Homo sapiens
aaagcaaauucgagagaaa

SEQ ID NO: 844759 - RNA, 19 nt, Homo sapiens
gaaauuggagcucuguaca

SEQ ID NO: 844760 - RNA, 19 nt, Homo sapiens
ccaagacuaugaagaaugc

SEQ ID NO: 844761 - RNA, 19 nt, Homo sapiens
ugaagaaagccaagacuau

SEQ ID NO: 844762 - RNA, 19 nt, Homo sapiens
gaccucacguugucgaaga

SEQ ID NO: 844763 - RNA, 19 nt, Homo sapiens
gaugaaguauggcgacucu

SEQ ID NO: 844764 - RNA, 19 nt, Homo sapiens
gccaacaaaugugauguga

SEQ ID NO: 844765 - RNA, 19 nt, Homo sapiens
gugcugcgguccuguaugu

SEQ ID NO: 844766 - RNA, 19 nt, Homo sapiens
uuucagaacugggaagauu

SEQ ID NO: 844767 - RNA, 19 nt, Homo sapiens
agacacguguuugauauga

SEQ ID NO: 844768 - RNA, 19 nt, Homo sapiens
auacaucgcauuagacauu

SEQ ID NO: 844769 - RNA, 19 nt, Homo sapiens
caaccaggagggacgauaa

SEQ ID NO: 844770 - RNA, 19 nt, Homo sapiens
gcacauuacaacuucaaga

SEQ ID NO: 844771 - RNA, 19 nt, Homo sapiens
caucaacaagccucucaua

SEQ ID NO: 844772 - RNA, 19 nt, Homo sapiens
ggauuugucugagcagugu

SEQ ID NO: 844773 - RNA, 19 nt, Homo sapiens
gagcaagugcgucagcauu

SEQ ID NO: 844774 - RNA, 19 nt, Homo sapiens
gguacaguaugguuucaug

SEQ ID NO: 844775 - RNA, 19 nt, Homo sapiens
ucauagaccucacguuguc

SEQ ID NO: 844776 - RNA, 19 nt, Homo sapiens
ucagaccucucuucaucaa

SEQ ID NO: 844777 - RNA, 19 nt, Homo sapiens
gggagcagcuagaacucuu

SEQ ID NO: 844778 - RNA, 19 nt, Homo sapiens
uggcuucgcuagaguguug

SEQ ID NO: 844779 - RNA, 19 nt, Homo sapiens
ggaaggccauaauauagcu

SEQ ID NO: 844780 - RNA, 19 nt, Homo sapiens
ucagaaguacugggauuua

SEQ ID NO: 844781 - RNA, 19 nt, Homo sapiens
gaauagcugaacuuucuga

SEQ ID NO: 844782 - RNA, 19 nt, Homo sapiens
aauuggagcucuguacaaa

SEQ ID NO: 844783 - RNA, 19 nt, Homo sapiens
auagacacguguuugauau

SEQ ID NO: 844784 - RNA, 19 nt, Homo sapiens
ugaugaauauucucuacga

SEQ ID NO: 844785 - RNA, 19 nt, Homo sapiens
caugauaagauaccagaaa

SEQ ID NO: 844786 - RNA, 19 nt, Homo sapiens
caaccaagucucuguuugu

SEQ ID NO: 844787 - RNA, 19 nt, Homo sapiens
uggacaauguugcuaaaga

SEQ ID NO: 844788 - RNA, 19 nt, Homo sapiens
gagugaagacgaagagaug

SEQ ID NO: 844789 - RNA, 19 nt, Homo sapiens
gaagaagagcugagaacag

SEQ ID NO: 844790 - RNA, 19 nt, Homo sapiens
aaacugaggaguccaggaa

SEQ ID NO: 844791 - RNA, 19 nt, Homo sapiens
gugaaugaggugcugaaua

SEQ ID NO: 844792 - RNA, 19 nt, Homo sapiens
gaaggauucccuguaauag

SEQ ID NO: 844793 - RNA, 19 nt, Homo sapiens
gauuaugugcgacugauga

SEQ ID NO: 844794 - RNA, 19 nt, Homo sapiens
cuauauaggugugggaaau

SEQ ID NO: 844795 - RNA, 19 nt, Homo sapiens
cagccaucaugaagaaauu

SEQ ID NO: 844796 - RNA, 19 nt, Homo sapiens
gaagaagagggaacgagau

SEQ ID NO: 844797 - RNA, 19 nt, Homo sapiens
gaauaaaccuugcggaugu

SEQ ID NO: 844798 - RNA, 19 nt, Homo sapiens
ggauguggcuguuuaugaa

SEQ ID NO: 844799 - RNA, 19 nt, Homo sapiens
gaaauaagaggaggagaaa

SEQ ID NO: 844800 - RNA, 19 nt, Homo sapiens
gcgaggaaaugucuuuaga

SEQ ID NO: 844801 - RNA, 19 nt, Homo sapiens
ggaaauaagaggaggagaa

SEQ ID NO: 844802 - RNA, 19 nt, Homo sapiens
gguacaggcugaacgacua

SEQ ID NO: 844803 - RNA, 19 nt, Homo sapiens
agaaagcucucuauaccaa

SEQ ID NO: 844804 - RNA, 19 nt, Homo sapiens
ccaaggaaauaaugugaau

SEQ ID NO: 844805 - RNA, 19 nt, Homo sapiens
gcaugaaguuugagauugg

SEQ ID NO: 844806 - RNA, 19 nt, Homo sapiens
uuaugugggugauuugaua

SEQ ID NO: 844807 - RNA, 19 nt, Homo sapiens
gccaccagcugccuacaaa

SEQ ID NO: 844808 - RNA, 19 nt, Homo sapiens
ugaaagggcucuggaugga

SEQ ID NO: 844809 - RNA, 19 nt, Homo sapiens
gguuugugauccaggaaua

SEQ ID NO: 844810 - RNA, 19 nt, Homo sapiens
ccaacgacguggugcagaa

SEQ ID NO: 844811 - RNA, 19 nt, Homo sapiens
ggcaugaaguuugagauug

SEQ ID NO: 844812 - RNA, 19 nt, Homo sapiens
gcugaacgacuacguguga

SEQ ID NO: 844813 - RNA, 19 nt, Homo sapiens
gcacguugaucaccaccau

SEQ ID NO: 844814 - RNA, 19 nt, Homo sapiens
uugcggauguggcuguuua

SEQ ID NO: 844815 - RNA, 19 nt, Homo sapiens
gcacagcacaggcaucuac

SEQ ID NO: 844816 - RNA, 19 nt, Homo sapiens
cugccaggauuguaaguuu

SEQ ID NO: 844817 - RNA, 19 nt, Homo sapiens
ccagcggcaugaaguuuga

SEQ ID NO: 844818 - RNA, 19 nt, Homo sapiens
gguuccagcacaaaguuua

SEQ ID NO: 844819 - RNA, 19 nt, Homo sapiens
gaaagcucucuauaccaaa

SEQ ID NO: 844820 - RNA, 19 nt, Homo sapiens
ggccguguccuaccugaaa

SEQ ID NO: 844821 - RNA, 19 nt, Homo sapiens
gcacgugggcaccaacauc

SEQ ID NO: 844822 - RNA, 19 nt, Homo sapiens
uaaugugaaugcgaggaaa

SEQ ID NO: 844823 - RNA, 19 nt, Homo sapiens
guuuacuucugggcaauuu

SEQ ID NO: 844824 - RNA, 19 nt, Homo sapiens
gugggugauuugauaacaa

SEQ ID NO: 844825 - RNA, 19 nt, Homo sapiens
ccaccacgaccacugcaaa

SEQ ID NO: 844826 - RNA, 19 nt, Homo sapiens
gauguggcuguuuaugaaa

SEQ ID NO: 844827 - RNA, 19 nt, Homo sapiens
cggauguggcuguuuauga

SEQ ID NO: 844828 - RNA, 19 nt, Homo sapiens
aaagcucucuauaccaaag

SEQ ID NO: 844829 - RNA, 19 nt, Homo sapiens
caccagcugccuacaaaga

SEQ ID NO: 844830 - RNA, 19 nt, Homo sapiens
ggugauuugauaacaaguu

SEQ ID NO: 844831 - RNA, 19 nt, Homo sapiens
ccagcugccuacaaagaca

SEQ ID NO: 844832 - RNA, 19 nt, Homo sapiens
cggcaugaaguuugagauu

SEQ ID NO: 844833 - RNA, 19 nt, Homo sapiens
gcccagcggcaugaaguuu

SEQ ID NO: 844834 - RNA, 19 nt, Homo sapiens
ugaaugcgaggaaaugucu

SEQ ID NO: 844835 - RNA, 19 nt, Homo sapiens
ugggugauuugauaacaag

SEQ ID NO: 844836 - RNA, 19 nt, Homo sapiens
gaauaaaccuugcggaugu

SEQ ID NO: 844837 - RNA, 19 nt, Homo sapiens
ggaaggagaugcccagguu

SEQ ID NO: 844838 - RNA, 19 nt, Homo sapiens
ggauguggcuguuuaugaa

SEQ ID NO: 844839 - RNA, 19 nt, Homo sapiens
caucagggcuacacuuaaa

SEQ ID NO: 844840 - RNA, 19 nt, Homo sapiens
ggaaugagcuguggauuuu

SEQ ID NO: 844841 - RNA, 19 nt, Homo sapiens
gaaauaagaggaggagaaa

SEQ ID NO: 844842 - RNA, 19 nt, Homo sapiens
ggaagaagaaagaaacaaa

SEQ ID NO: 844843 - RNA, 19 nt, Homo sapiens
gcgaggaaaugucuuuaga

SEQ ID NO: 844844 - RNA, 19 nt, Homo sapiens
ggaaauaagaggaggagaa

SEQ ID NO: 844845 - RNA, 19 nt, Homo sapiens
gguacaggcugaacgacua

SEQ ID NO: 844846 - RNA, 19 nt, Homo sapiens
agaaagcucucuauaccaa

SEQ ID NO: 844847 - RNA, 19 nt, Homo sapiens
ccaaggaaauaaugugaau

SEQ ID NO: 844848 - RNA, 19 nt, Homo sapiens
gggcuacacuuaaaugaag

SEQ ID NO: 844849 - RNA, 19 nt, Homo sapiens
caaauacuccguccuggaa

SEQ ID NO: 844850 - RNA, 19 nt, Homo sapiens
ucagguguaucgugcauuu

SEQ ID NO: 844851 - RNA, 19 nt, Homo sapiens
gcaugaaguuugagauugg

SEQ ID NO: 844852 - RNA, 19 nt, Homo sapiens
gcucuuccauggcagauau

SEQ ID NO: 844853 - RNA, 19 nt, Homo sapiens
uuaugugggugauuugaua

SEQ ID NO: 844854 - RNA, 19 nt, Homo sapiens
aaacugagauuuagaacac

SEQ ID NO: 844855 - RNA, 19 nt, Homo sapiens
gggaaugagcuguggauuu

SEQ ID NO: 844856 - RNA, 19 nt, Homo sapiens
gccaccagcugccuacaaa

SEQ ID NO: 844857 - RNA, 19 nt, Homo sapiens
ugaaagggcucuggaugga

SEQ ID NO: 844858 - RNA, 19 nt, Homo sapiens
ggaacacuguaauugucua

SEQ ID NO: 844859 - RNA, 19 nt, Homo sapiens
gguuugugauccaggaaua

SEQ ID NO: 844860 - RNA, 19 nt, Homo sapiens
ccaacgacguggugcagaa

SEQ ID NO: 844861 - RNA, 19 nt, Homo sapiens
gaagaugagacucgagguu

SEQ ID NO: 844862 - RNA, 19 nt, Homo sapiens
caagccaccuccucucaug

SEQ ID NO: 844863 - RNA, 19 nt, Homo sapiens
ggcaugaaguuugagauug

SEQ ID NO: 844864 - RNA, 19 nt, Homo sapiens
gcugaacgacuacguguga

SEQ ID NO: 844865 - RNA, 19 nt, Homo sapiens
gcacguugaucaccaccau

SEQ ID NO: 844866 - RNA, 19 nt, Homo sapiens
caugcuagcuaaccaagug

SEQ ID NO: 844867 - RNA, 19 nt, Homo sapiens
uugcggauguggcuguuua

SEQ ID NO: 844868 - RNA, 19 nt, Homo sapiens
gcacagcacaggcaucuac

SEQ ID NO: 844869 - RNA, 19 nt, Homo sapiens
ggcaucagggcuacacuua

SEQ ID NO: 844870 - RNA, 19 nt, Homo sapiens
uaaggaacacuguaauugu

SEQ ID NO: 844871 - RNA, 19 nt, Homo sapiens
ggcguaggcuggacuaugg

SEQ ID NO: 844872 - RNA, 19 nt, Homo sapiens
cuaaggaacacuguaauug

SEQ ID NO: 844873 - RNA, 19 nt, Homo sapiens
cuacaacaaucaggcaguu

SEQ ID NO: 844874 - RNA, 19 nt, Homo sapiens
ccagcggcaugaaguuuga

SEQ ID NO: 844875 - RNA, 19 nt, Homo sapiens
gaagugcacaugcucaucu

SEQ ID NO: 844876 - RNA, 19 nt, Homo sapiens
gcaucagggcuacacuuaa

SEQ ID NO: 844877 - RNA, 19 nt, Homo sapiens
gauauucgcagaggcauca

SEQ ID NO: 844878 - RNA, 19 nt, Homo sapiens
gguuccagcacaaaguuua

SEQ ID NO: 844879 - RNA, 19 nt, Homo sapiens
gaaagcucucuauaccaaa

SEQ ID NO: 844880 - RNA, 19 nt, Homo sapiens
gcucagaggaggacacagu

SEQ ID NO: 844881 - RNA, 19 nt, Homo sapiens
ggccguguccuaccugaaa

SEQ ID NO: 844882 - RNA, 19 nt, Homo sapiens
aaggaacacuguaauuguc

SEQ ID NO: 844883 - RNA, 19 nt, Homo sapiens
ccacagugcagaaaugaca

SEQ ID NO: 844884 - RNA, 19 nt, Homo sapiens
gcacgugggcaccaacauc

SEQ ID NO: 844885 - RNA, 19 nt, Homo sapiens
uaaugugaaugcgaggaaa

SEQ ID NO: 844886 - RNA, 19 nt, Homo sapiens
guuuacuucugggcaauuu

SEQ ID NO: 844887 - RNA, 19 nt, Homo sapiens
gagcgcguguuaggaagga

SEQ ID NO: 844888 - RNA, 19 nt, Homo sapiens
gcugaguccucuugcacau

SEQ ID NO: 844889 - RNA, 19 nt, Homo sapiens
gugggugauuugauaacaa

SEQ ID NO: 844890 - RNA, 19 nt, Homo sapiens
ccaccacgaccacugcaaa

SEQ ID NO: 844891 - RNA, 19 nt, Homo sapiens
ucuaaggaacacuguaauu

SEQ ID NO: 844892 - RNA, 19 nt, Homo sapiens
gauguggcuguuuaugaaa

SEQ ID NO: 844893 - RNA, 19 nt, Homo sapiens
cggauguggcuguuuauga

SEQ ID NO: 844894 - RNA, 19 nt, Homo sapiens
aaagcucucuauaccaaag

SEQ ID NO: 844895 - RNA, 19 nt, Homo sapiens
gagaccagcaagagcuuug

SEQ ID NO: 844896 - RNA, 19 nt, Homo sapiens
caccagcugccuacaaaga

SEQ ID NO: 844897 - RNA, 19 nt, Homo sapiens
aagaugagacucgagguuu

SEQ ID NO: 844898 - RNA, 19 nt, Homo sapiens
ggugauuugauaacaaguu

SEQ ID NO: 844899 - RNA, 19 nt, Homo sapiens
ccagcugccuacaaagaca

SEQ ID NO: 844900 - RNA, 19 nt, Homo sapiens
cggcaugaaguuugagauu

SEQ ID NO: 844901 - RNA, 19 nt, Homo sapiens
gcucaucuacagcuuucuu

SEQ ID NO: 844902 - RNA, 19 nt, Homo sapiens
ucugguuggucuugaaugu

SEQ ID NO: 844903 - RNA, 19 nt, Homo sapiens
ccugagcgcguguuaggaa

SEQ ID NO: 844904 - RNA, 19 nt, Homo sapiens
acagggaagugagugugaa

SEQ ID NO: 844905 - RNA, 19 nt, Homo sapiens
gcccagcggcaugaaguuu

SEQ ID NO: 844906 - RNA, 19 nt, Homo sapiens
caucuacagcuuucuugga

SEQ ID NO: 844907 - RNA, 19 nt, Homo sapiens
guucagguguaucgugcau

SEQ ID NO: 844908 - RNA, 19 nt, Homo sapiens
gaacacuguaauugucuac

SEQ ID NO: 844909 - RNA, 19 nt, Homo sapiens
cgcaggccguucuaaggaa

SEQ ID NO: 844910 - RNA, 19 nt, Homo sapiens
gagggaaugagcuguggau

SEQ ID NO: 844911 - RNA, 19 nt, Homo sapiens
ugaaugcgaggaaaugucu

SEQ ID NO: 844912 - RNA, 19 nt, Homo sapiens
gccaagccaccuccucuca

SEQ ID NO: 844913 - RNA, 19 nt, Homo sapiens
ggagaccagcaagagcuuu

SEQ ID NO: 844914 - RNA, 19 nt, Homo sapiens
gcaggcguaggcuggacua

SEQ ID NO: 844915 - RNA, 19 nt, Homo sapiens
ucagggcuacacuuaaaug

SEQ ID NO: 844916 - RNA, 19 nt, Homo sapiens
gaccagcaagagcuuuguu

SEQ ID NO: 844917 - RNA, 19 nt, Homo sapiens
aucuacagcuuucuuggaa

SEQ ID NO: 844918 - RNA, 19 nt, Homo sapiens
aagugcacaugcucaucua

SEQ ID NO: 844919 - RNA, 19 nt, Homo sapiens
ugggugauuugauaacaag

SEQ ID NO: 844920 - RNA, 19 nt, Homo sapiens
gccaccuccucucaugcua

SEQ ID NO: 844921 - RNA, 19 nt, Homo sapiens
ccacgcaggccguucuaag

SEQ ID NO: 844922 - RNA, 19 nt, Homo sapiens
gcaguaagcugaaaucaug

SEQ ID NO: 844923 - RNA, 19 nt, Homo sapiens
ggaagcaggucccuacuau

SEQ ID NO: 844924 - RNA, 19 nt, Homo sapiens
gaacgaaagcucccaguga

SEQ ID NO: 844925 - RNA, 19 nt, Homo sapiens
agacaucucccauggauuu

SEQ ID NO: 844926 - RNA, 19 nt, Homo sapiens
uaagaagaccucuggcuuu

SEQ ID NO: 844927 - RNA, 19 nt, Homo sapiens
gggcaucgccugacugaga

SEQ ID NO: 844928 - RNA, 19 nt, Homo sapiens
gcguugcccuucacuaaga

SEQ ID NO: 844929 - RNA, 19 nt, Homo sapiens
ccacgguucuccagcaaga

SEQ ID NO: 844930 - RNA, 19 nt, Homo sapiens
ggcaaggacugcacguuuc

SEQ ID NO: 844931 - RNA, 19 nt, Homo sapiens
gagcugugguggccuagau

SEQ ID NO: 844932 - RNA, 19 nt, Homo sapiens
ggugcacucuucauggaaa

SEQ ID NO: 844933 - RNA, 19 nt, Homo sapiens
gugaggaacuggucuucug

SEQ ID NO: 844934 - RNA, 19 nt, Homo sapiens
caacauauccgugaucaac

SEQ ID NO: 844935 - RNA, 19 nt, Homo sapiens
gcaggucccuacuaucaac

SEQ ID NO: 844936 - RNA, 19 nt, Homo sapiens
gaagaccucuggcuuuccu

SEQ ID NO: 844937 - RNA, 19 nt, Homo sapiens
gggcgcagggaguaaguua

SEQ ID NO: 844938 - RNA, 19 nt, Homo sapiens
ucaaggaggugcgcuucuu

SEQ ID NO: 844939 - RNA, 19 nt, Homo sapiens
ggacugcacguuucuuucu

SEQ ID NO: 844940 - RNA, 19 nt, Homo sapiens
aagaagaccucuggcuuuc

SEQ ID NO: 844941 - RNA, 19 nt, Homo sapiens
caggugcacucuucaugga

SEQ ID NO: 844942 - RNA, 19 nt, Homo sapiens
gaccucacccauauuguug

SEQ ID NO: 844943 - RNA, 19 nt, Homo sapiens
ggcaucgccugacugagaa

SEQ ID NO: 844944 - RNA, 19 nt, Homo sapiens
gauucaaccaccuuaagaa

SEQ ID NO: 844945 - RNA, 19 nt, Homo sapiens
acuacgaccucacccauau

SEQ ID NO: 844946 - RNA, 19 nt, Homo sapiens
gaugcccgauacaacauau

SEQ ID NO: 844947 - RNA, 19 nt, Homo sapiens
aagcaggucccuacuauca

SEQ ID NO: 844948 - RNA, 19 nt, Homo sapiens
gaaagcucccagugaggaa

SEQ ID NO: 844949 - RNA, 19 nt, Homo sapiens
cgaccucacccauauuguu

SEQ ID NO: 844950 - RNA, 19 nt, Homo sapiens
aaagguggagguugcagua

SEQ ID NO: 844951 - RNA, 19 nt, Homo sapiens
ucaaccaccuuaagaagac

SEQ ID NO: 844952 - RNA, 19 nt, Homo sapiens
gacauggacguguuugaug

SEQ ID NO: 844953 - RNA, 19 nt, Homo sapiens
ggagcugccuucucaucag

SEQ ID NO: 844954 - RNA, 19 nt, Homo sapiens
ccaccugccuccugcucuu

SEQ ID NO: 844955 - RNA, 19 nt, Homo sapiens
ugagaacucugggccuuag

SEQ ID NO: 844956 - RNA, 19 nt, Homo sapiens
gaccugaugcgcucuaucu

SEQ ID NO: 844957 - RNA, 19 nt, Homo sapiens
ccugaugcgcucuaucuuu

SEQ ID NO: 844958 - RNA, 19 nt, Homo sapiens
gacuacgaccucacccaua

SEQ ID NO: 844959 - RNA, 19 nt, Homo sapiens
guggcacacuccuguaauc

SEQ ID NO: 844960 - RNA, 19 nt, Homo sapiens
gagacucuguguggcauag

SEQ ID NO: 844961 - RNA, 19 nt, Homo sapiens
ucaaaaguccugccgaaaa

SEQ ID NO: 844962 - RNA, 19 nt, Homo sapiens
gaggugggagaaucacuug

SEQ ID NO: 844963 - RNA, 19 nt, Homo sapiens
cuagaugcccgauacaaca

SEQ ID NO: 844964 - RNA, 19 nt, Homo sapiens
gcaaggacugcacguuucu

SEQ ID NO: 844965 - RNA, 19 nt, Homo sapiens
cgacauggacguguuugau

SEQ ID NO: 844966 - RNA, 19 nt, Homo sapiens
caucucccauggauuugug

SEQ ID NO: 844967 - RNA, 19 nt, Homo sapiens
uacaacauauccgugauca

SEQ ID NO: 844968 - RNA, 19 nt, Homo sapiens
ggugggagaaucacuugga

SEQ ID NO: 844969 - RNA, 19 nt, Homo sapiens
aggcaaggacugcacguuu

SEQ ID NO: 844970 - RNA, 19 nt, Homo sapiens
cauacuucgucuaggaaug

SEQ ID NO: 844971 - RNA, 19 nt, Homo sapiens
cguguuugaugccuacaug

SEQ ID NO: 844972 - RNA, 19 nt, Homo sapiens
cugaugcgcucuaucuuuu

SEQ ID NO: 844973 - RNA, 19 nt, Homo sapiens
ucccauggauuugugauca

SEQ ID NO: 844974 - RNA, 19 nt, Homo sapiens
ugauucaaccaccuuaaga

SEQ ID NO: 844975 - RNA, 19 nt, Homo sapiens
guuucuuucucuccugauu

SEQ ID NO: 844976 - RNA, 19 nt, Homo sapiens
gaagcaggucccuacuauc

SEQ ID NO: 844977 - RNA, 19 nt, Homo sapiens
acgcguugcccuucacuaa

SEQ ID NO: 844978 - RNA, 19 nt, Homo sapiens
cgacgucuucuaccugaug

SEQ ID NO: 844979 - RNA, 19 nt, Homo sapiens
gagugauucaaccaccuua

SEQ ID NO: 844980 - RNA, 19 nt, Homo sapiens
ucauggaaagcaacucuug

SEQ ID NO: 844981 - RNA, 19 nt, Homo sapiens
uggccuagaugcccgauac

SEQ ID NO: 844982 - RNA, 19 nt, Homo sapiens
cucaucaggugcacucuuc

SEQ ID NO: 844983 - RNA, 19 nt, Homo sapiens
uuccauacuucgucuagga

SEQ ID NO: 844984 - RNA, 19 nt, Homo sapiens
caaggaggugcgcuucuuc

SEQ ID NO: 844985 - RNA, 19 nt, Homo sapiens
gcaaagcaaaacucuauca

SEQ ID NO: 844986 - RNA, 19 nt, Homo sapiens
gguggagguugcaguaagc

SEQ ID NO: 844987 - RNA, 19 nt, Homo sapiens
gcauagagugauucaacca

SEQ ID NO: 844988 - RNA, 19 nt, Homo sapiens
uguguggcauagagugauu

SEQ ID NO: 844989 - RNA, 19 nt, Homo sapiens
gccacguggugcucaagga

SEQ ID NO: 844990 - RNA, 19 nt, Homo sapiens
cagccuggccaacauagug

SEQ ID NO: 844991 - RNA, 19 nt, Homo sapiens
ggaggugcgcuucuucaac

SEQ ID NO: 844992 - RNA, 19 nt, Homo sapiens
ggagacucuguguggcaua

SEQ ID NO: 844993 - RNA, 19 nt, Homo sapiens
gagguugcaguaagcugaa

SEQ ID NO: 844994 - RNA, 19 nt, Homo sapiens
gccuguaaucccagcauuu

SEQ ID NO: 844995 - RNA, 19 nt, Homo sapiens
gauacuggcacgcgacaac

SEQ ID NO: 844996 - RNA, 19 nt, Homo sapiens
ggagagagccucaauauug

SEQ ID NO: 844997 - RNA, 19 nt, Homo sapiens
ggagacaggugaagaaaca

SEQ ID NO: 844998 - RNA, 19 nt, Homo sapiens
gauagagaaugcugaauag

SEQ ID NO: 844999 - RNA, 19 nt, Homo sapiens
gcugacagaucacccauau

SEQ ID NO: 845000 - RNA, 19 nt, Homo sapiens
ggaaggaggguuagauaga

SEQ ID NO: 845001 - RNA, 19 nt, Homo sapiens
gagagagccucaauauugg

SEQ ID NO: 845002 - RNA, 19 nt, Homo sapiens
gauaguauaggaaguagaa

SEQ ID NO: 845003 - RNA, 19 nt, Homo sapiens
gaaggaggguuagauagag

SEQ ID NO: 845004 - RNA, 19 nt, Homo sapiens
gcuccgaauuguggaaaua

SEQ ID NO: 845005 - RNA, 19 nt, Homo sapiens
ggaaauaggagacgagaac

SEQ ID NO: 845006 - RNA, 19 nt, Homo sapiens
agauagagaaugcugaaua

SEQ ID NO: 845007 - RNA, 19 nt, Homo sapiens
gcacugacguucucuucac

SEQ ID NO: 845008 - RNA, 19 nt, Homo sapiens
gagcucgccuacacaagga

SEQ ID NO: 845009 - RNA, 19 nt, Homo sapiens
uauaugagcucgccuacac

SEQ ID NO: 845010 - RNA, 19 nt, Homo sapiens
caauggcagugcugacaga

SEQ ID NO: 845011 - RNA, 19 nt, Homo sapiens
uggcagugcugacagauca

SEQ ID NO: 845012 - RNA, 19 nt, Homo sapiens
ugacagaucacccauaugc

SEQ ID NO: 845013 - RNA, 19 nt, Homo sapiens
ggacucccuucuccaccaa

SEQ ID NO: 845014 - RNA, 19 nt, Homo sapiens
gggagagagccucaauauu

SEQ ID NO: 845015 - RNA, 19 nt, Homo sapiens
ggauggcacugacguucuc

SEQ ID NO: 845016 - RNA, 19 nt, Homo sapiens
ucguaggccucuccaaaug

SEQ ID NO: 845017 - RNA, 19 nt, Homo sapiens
uaggauaguauaggaagua

SEQ ID NO: 845018 - RNA, 19 nt, Homo sapiens
gcugcugacugccucuuuc

SEQ ID NO: 845019 - RNA, 19 nt, Homo sapiens
ugaauccucccucucagaa

SEQ ID NO: 845020 - RNA, 19 nt, Homo sapiens
ugggagagagccucaauau

SEQ ID NO: 845021 - RNA, 19 nt, Homo sapiens
gcuggagacaggugaagaa

SEQ ID NO: 845022 - RNA, 19 nt, Homo sapiens
ggcuacagcugcuagaacu

SEQ ID NO: 845023 - RNA, 19 nt, Homo sapiens
gggugaauccucccucuca

SEQ ID NO: 845024 - RNA, 19 nt, Homo sapiens
gcugacugccucuuucuuc

SEQ ID NO: 845025 - RNA, 19 nt, Homo sapiens
gugcugggagguaaacuga

SEQ ID NO: 845026 - RNA, 19 nt, Homo sapiens
gggaaggaggguuagauag

SEQ ID NO: 845027 - RNA, 19 nt, Homo sapiens
aaggaggguuagauagaga

SEQ ID NO: 845028 - RNA, 19 nt, Homo sapiens
gaucuggccaaagcucaaa

SEQ ID NO: 845029 - RNA, 19 nt, Homo sapiens
guaggauaguauaggaagu

SEQ ID NO: 845030 - RNA, 19 nt, Homo sapiens
gccaggaggcacugcagaa

SEQ ID NO: 845031 - RNA, 19 nt, Homo sapiens
gacaggugaagaaacaaga

SEQ ID NO: 845032 - RNA, 19 nt, Homo sapiens
uuagauagagaaugcugaa

SEQ ID NO: 845033 - RNA, 19 nt, Homo sapiens
caggugaagaaacaagaaa

SEQ ID NO: 845034 - RNA, 19 nt, Homo sapiens
caagaaaacuaagaaaucc

SEQ ID NO: 845035 - RNA, 19 nt, Homo sapiens
uuucguaggccucuccaaa

SEQ ID NO: 845036 - RNA, 19 nt, Homo sapiens
gugaauccucccucucaga

SEQ ID NO: 845037 - RNA, 19 nt, Homo sapiens
gaaugcugaauaggcagua

SEQ ID NO: 845038 - RNA, 19 nt, Homo sapiens
cccugacccucccagauga

SEQ ID NO: 845039 - RNA, 19 nt, Homo sapiens
guacauagaggauaguauu

SEQ ID NO: 845040 - RNA, 19 nt, Homo sapiens
ggacacccaugaagcuaau

SEQ ID NO: 845041 - RNA, 19 nt, Homo sapiens
ugaagacggugaugacugu

SEQ ID NO: 845042 - RNA, 19 nt, Homo sapiens
cagcaggaguuaccuuguu

SEQ ID NO: 845043 - RNA, 19 nt, Homo sapiens
uaacacaggcccaguuuca

SEQ ID NO: 845044 - RNA, 19 nt, Homo sapiens
ucuacuaccuguuggcuaa

SEQ ID NO: 845045 - RNA, 19 nt, Homo sapiens
gagaggcacaugucaauca

SEQ ID NO: 845046 - RNA, 19 nt, Homo sapiens
aauaggagcaacacugaua

SEQ ID NO: 845047 - RNA, 19 nt, Homo sapiens
acacugauacugucgauga

SEQ ID NO: 845048 - RNA, 19 nt, Homo sapiens
ccaugaagcuaaugaagac

SEQ ID NO: 845049 - RNA, 19 nt, Homo sapiens
ggaguuaccuuguuuucug

SEQ ID NO: 845050 - RNA, 19 nt, Homo sapiens
uaaaagcacuuccuaaacu

SEQ ID NO: 845051 - RNA, 19 nt, Homo sapiens
caacacugauacugucgau

SEQ ID NO: 845052 - RNA, 19 nt, Homo sapiens
caaggacgaggacauguau

SEQ ID NO: 845053 - RNA, 19 nt, Homo sapiens
gucgaugacuggacaggaa

SEQ ID NO: 845054 - RNA, 19 nt, Homo sapiens
ggagcaacacugauacugu

SEQ ID NO: 845055 - RNA, 19 nt, Homo sapiens
gccaguacauagaggauag

SEQ ID NO: 845056 - RNA, 19 nt, Homo sapiens
ggaugcggguccauagcaa

SEQ ID NO: 845057 - RNA, 19 nt, Homo sapiens
acacaggcccaguuucaaa

SEQ ID NO: 845058 - RNA, 19 nt, Homo sapiens
ucuaggauguucacuucuu

SEQ ID NO: 845059 - RNA, 19 nt, Homo sapiens
ggucaucgcggcagugauc

SEQ ID NO: 845060 - RNA, 19 nt, Homo sapiens
guucacuucuucuccacaa

SEQ ID NO: 845061 - RNA, 19 nt, Homo sapiens
acaaggacgaggacaugua

SEQ ID NO: 845062 - RNA, 19 nt, Homo sapiens
ccacaaugaaugaguguca

SEQ ID NO: 845063 - RNA, 19 nt, Homo sapiens
uuucuaggauguucacuuc

SEQ ID NO: 845064 - RNA, 19 nt, Homo sapiens
gcaauaaaagcacuuccua

SEQ ID NO: 845065 - RNA, 19 nt, Homo sapiens
ccucauggccuuccucauc

SEQ ID NO: 845066 - RNA, 19 nt, Homo sapiens
ccauuuacagcaggaguua

SEQ ID NO: 845067 - RNA, 19 nt, Homo sapiens
cugcuucccucaccaacuu

SEQ ID NO: 845068 - RNA, 19 nt, Homo sapiens
ucgcuggaauugccuaugu

SEQ ID NO: 845069 - RNA, 19 nt, Homo sapiens
gccuauguauuccugaugu

SEQ ID NO: 845070 - RNA, 19 nt, Homo sapiens
agcaggaguuaccuuguuu

SEQ ID NO: 845071 - RNA, 19 nt, Homo sapiens
gaugaucugcugcuucucu

SEQ ID NO: 845072 - RNA, 19 nt, Homo sapiens
gcucaacuccgucgugaac

SEQ ID NO: 845073 - RNA, 19 nt, Homo sapiens
gaggacacccaugaagcua

SEQ ID NO: 845074 - RNA, 19 nt, Homo sapiens
ggaggacacccaugaagcu

SEQ ID NO: 845075 - RNA, 19 nt, Homo sapiens
gaggaaaaccaacgucuug

SEQ ID NO: 845076 - RNA, 19 nt, Homo sapiens
caucaugguugugguguac

SEQ ID NO: 845077 - RNA, 19 nt, Homo sapiens
ugacaagcacauggacuuu

SEQ ID NO: 845078 - RNA, 19 nt, Homo sapiens
caucaucuacuccuacaag

SEQ ID NO: 845079 - RNA, 19 nt, Homo sapiens
cuaggauguucacuucuuc

SEQ ID NO: 845080 - RNA, 19 nt, Homo sapiens
gggugacacugcucauuuu

SEQ ID NO: 845081 - RNA, 19 nt, Homo sapiens
auaauaggagcaacacuga

SEQ ID NO: 845082 - RNA, 19 nt, Homo sapiens
cuaccuguuggcuaauuua

SEQ ID NO: 845083 - RNA, 19 nt, Homo sapiens
cauagaggauaguauuagc

SEQ ID NO: 845084 - RNA, 19 nt, Homo sapiens
caaagcuugugauuguuuu

SEQ ID NO: 845085 - RNA, 19 nt, Homo sapiens
ccaggugaugacugucuua

SEQ ID NO: 845086 - RNA, 19 nt, Homo sapiens
cuacaaggacgaggacaug

SEQ ID NO: 845087 - RNA, 19 nt, Homo sapiens
gccgauuucuucgcuggaa

SEQ ID NO: 845088 - RNA, 19 nt, Homo sapiens
ucaucaugguuguggugua

SEQ ID NO: 845089 - RNA, 19 nt, Homo sapiens
gagggugacacugcucauu

SEQ ID NO: 845090 - RNA, 19 nt, Homo sapiens
gcuggaauugccuauguau

SEQ ID NO: 845091 - RNA, 19 nt, Homo sapiens
ucacuucuucuccacaaug

SEQ ID NO: 845092 - RNA, 19 nt, Homo sapiens
cuaaugaagacggugauga

SEQ ID NO: 845093 - RNA, 19 nt, Homo sapiens
cucauggccuuccucauca

SEQ ID NO: 845094 - RNA, 19 nt, Homo sapiens
cacuucuucuccacaauga

SEQ ID NO: 845095 - RNA, 19 nt, Homo sapiens
ggauaguauuagccaaggu

SEQ ID NO: 845096 - RNA, 19 nt, Homo sapiens
cccaugaagcuaaugaaga

SEQ ID NO: 845097 - RNA, 19 nt, Homo sapiens
cgucuugucuccgcauaca

SEQ ID NO: 845098 - RNA, 19 nt, Homo sapiens
caauaaaagcacuuccuaa

SEQ ID NO: 845099 - RNA, 19 nt, Homo sapiens
gcaccaugaagaagaugau

SEQ ID NO: 845100 - RNA, 19 nt, Homo sapiens
ugacuggacaggaacaaag

SEQ ID NO: 845101 - RNA, 19 nt, Homo sapiens
ccuauguauuccugauguu

SEQ ID NO: 845102 - RNA, 19 nt, Homo sapiens
ugacacaggcagccaguac

SEQ ID NO: 845103 - RNA, 19 nt, Homo sapiens
gacggugaugacugucuua

SEQ ID NO: 845104 - RNA, 19 nt, Homo sapiens
agggugacacugcucauuu

SEQ ID NO: 845105 - RNA, 19 nt, Homo sapiens
cgcuggaauugccuaugua

SEQ ID NO: 845106 - RNA, 19 nt, Homo sapiens
acaggcagccaguacauag

SEQ ID NO: 845107 - RNA, 19 nt, Homo sapiens
ugguguaccugcggaucua

SEQ ID NO: 845108 - RNA, 19 nt, Homo sapiens
agaggcacaugucaaucau

SEQ ID NO: 845109 - RNA, 19 nt, Homo sapiens
ccaacaaagugaagagaua

SEQ ID NO: 845110 - RNA, 19 nt, Homo sapiens
cgaagaagcuagacucaga

SEQ ID NO: 845111 - RNA, 19 nt, Homo sapiens
gaagagauaccuagcaauc

SEQ ID NO: 845112 - RNA, 19 nt, Homo sapiens
gcgccuugcuuauuucuga

SEQ ID NO: 845113 - RNA, 19 nt, Homo sapiens
agaccaagcucaaacuaau

SEQ ID NO: 845114 - RNA, 19 nt, Homo sapiens
caaagaacuuaaagcugaa

SEQ ID NO: 845115 - RNA, 19 nt, Homo sapiens
ggaagacccacgcaaagaa

SEQ ID NO: 845116 - RNA, 19 nt, Homo sapiens
gugaagagauaccuagcaa

SEQ ID NO: 845117 - RNA, 19 nt, Homo sapiens
ugaagcagcaguccacuaa

SEQ ID NO: 845118 - RNA, 19 nt, Homo sapiens
gaucagaagagcagcagaa

SEQ ID NO: 845119 - RNA, 19 nt, Homo sapiens
caaugucucuucaccaaca

SEQ ID NO: 845120 - RNA, 19 nt, Homo sapiens
ugucauggcucaacaacau

SEQ ID NO: 845121 - RNA, 19 nt, Homo sapiens
gaugauagacccagacaag

SEQ ID NO: 845122 - RNA, 19 nt, Homo sapiens
gcaccagaauagagagaug

SEQ ID NO: 845123 - RNA, 19 nt, Homo sapiens
gaagagcagcagaagcaaa

SEQ ID NO: 845124 - RNA, 19 nt, Homo sapiens
gagaggaaguggagcacau

SEQ ID NO: 845125 - RNA, 19 nt, Homo sapiens
caaccaccuuggaagacua

SEQ ID NO: 845126 - RNA, 19 nt, Homo sapiens
gagaccaagcucaaacuaa

SEQ ID NO: 845127 - RNA, 19 nt, Homo sapiens
ggcaacccauucagaaaga

SEQ ID NO: 845128 - RNA, 19 nt, Homo sapiens
cauguaagauagugcugaa

SEQ ID NO: 845129 - RNA, 19 nt, Homo sapiens
caaaggcaacccauucaga

SEQ ID NO: 845130 - RNA, 19 nt, Homo sapiens
ugaacuccauagaacagua

SEQ ID NO: 845131 - RNA, 19 nt, Homo sapiens
gugcugaacuccauagaac

SEQ ID NO: 845132 - RNA, 19 nt, Homo sapiens
aaacaugccaacaaaguga

SEQ ID NO: 845133 - RNA, 19 nt, Homo sapiens
cagaagagcagcagaagca

SEQ ID NO: 845134 - RNA, 19 nt, Homo sapiens
ggagaccaagcucaaacua

SEQ ID NO: 845135 - RNA, 19 nt, Homo sapiens
gauagacccagacaaguuc

SEQ ID NO: 845136 - RNA, 19 nt, Homo sapiens
ggaaguggagcacaugauc

SEQ ID NO: 845137 - RNA, 19 nt, Homo sapiens
gaacaguaccaagcucaug

SEQ ID NO: 845138 - RNA, 19 nt, Homo sapiens
gcagaagcaaagacaagaa

SEQ ID NO: 845139 - RNA, 19 nt, Homo sapiens
gagcacaugauccagaaga

SEQ ID NO: 845140 - RNA, 19 nt, Homo sapiens
acaagaaccagucaccaaa

SEQ ID NO: 845141 - RNA, 19 nt, Homo sapiens
ugauagacccagacaaguu

SEQ ID NO: 845142 - RNA, 19 nt, Homo sapiens
gggaagacccacgcaaaga

SEQ ID NO: 845143 - RNA, 19 nt, Homo sapiens
aaaggcaacccauucagaa

SEQ ID NO: 845144 - RNA, 19 nt, Homo sapiens
cagaauagagagaugauag

SEQ ID NO: 845145 - RNA, 19 nt, Homo sapiens
guaagauagugcugaacuc

SEQ ID NO: 845146 - RNA, 19 nt, Homo sapiens
cagaagaaccaaugucucu

SEQ ID NO: 845147 - RNA, 19 nt, Homo sapiens
gaagcuagacucagaucag

SEQ ID NO: 845148 - RNA, 19 nt, Homo sapiens
caaagugaagagauaccua

SEQ ID NO: 845149 - RNA, 19 nt, Homo sapiens
gggaaacgaagaagcuaga

SEQ ID NO: 845150 - RNA, 19 nt, Homo sapiens
gaagaagcuagacucagau

SEQ ID NO: 845151 - RNA, 19 nt, Homo sapiens
agagauaccuagcaaucca

SEQ ID NO: 845152 - RNA, 19 nt, Homo sapiens
ggccagauuccaaugcaaa

SEQ ID NO: 845153 - RNA, 19 nt, Homo sapiens
ucauggcucaacaacauua

SEQ ID NO: 845154 - RNA, 19 nt, Homo sapiens
aagcuagacucagaucaga

SEQ ID NO: 845155 - RNA, 19 nt, Homo sapiens
gacccacgcaaagaacuua

SEQ ID NO: 845156 - RNA, 19 nt, Homo sapiens
accaaugucucuucaccaa

SEQ ID NO: 845157 - RNA, 19 nt, Homo sapiens
gucagcggcuucaaacaca

SEQ ID NO: 845158 - RNA, 19 nt, Homo sapiens
gaagcaaagacaagaacca

SEQ ID NO: 845159 - RNA, 19 nt, Homo sapiens
cacaagaaccagucaccaa

SEQ ID NO: 845160 - RNA, 19 nt, Homo sapiens
aaacuaauggcacgcuaug

SEQ ID NO: 845161 - RNA, 19 nt, Homo sapiens
gaccaagcucaaacuaaug

SEQ ID NO: 845162 - RNA, 19 nt, Homo sapiens
gaagacccacgcaaagaac

SEQ ID NO: 845163 - RNA, 19 nt, Homo sapiens
gaggaaguggagcacauga

SEQ ID NO: 845164 - RNA, 19 nt, Homo sapiens
gcacauuaccagagcaaaa

SEQ ID NO: 845165 - RNA, 19 nt, Homo sapiens
gauagugcugaacuccaua

SEQ ID NO: 845166 - RNA, 19 nt, Homo sapiens
caaacuaauggcacgcuau

SEQ ID NO: 845167 - RNA, 19 nt, Homo sapiens
ccucugccaugcaacuuuc

SEQ ID NO: 845168 - RNA, 19 nt, Homo sapiens
uggaagccuugcaccagaa

SEQ ID NO: 845169 - RNA, 19 nt, Homo sapiens
aagcagcaguccacuaagg

SEQ ID NO: 845170 - RNA, 19 nt, Homo sapiens
agauagugcugaacuccau

SEQ ID NO: 845171 - RNA, 19 nt, Homo sapiens
caaaacauguaagauagug

SEQ ID NO: 845172 - RNA, 19 nt, Homo sapiens
gaagccuugcaccagaaua

SEQ ID NO: 845173 - RNA, 19 nt, Homo sapiens
caacaaagugaagagauac

SEQ ID NO: 845174 - RNA, 19 nt, Homo sapiens
agacucaaccaccuuggaa

SEQ ID NO: 845175 - RNA, 19 nt, Homo sapiens
gagaugauagacccagaca

SEQ ID NO: 845176 - RNA, 19 nt, Homo sapiens
gaauagagagaugauagac

SEQ ID NO: 845177 - RNA, 19 nt, Homo sapiens
gccgguggguagagaggaa

SEQ ID NO: 845178 - RNA, 19 nt, Homo sapiens
gcuagacucagaucagaag

SEQ ID NO: 845179 - RNA, 19 nt, Homo sapiens
gggccagauuccaaugcaa

SEQ ID NO: 845180 - RNA, 19 nt, Homo sapiens
gaacuccauagaacaguac

SEQ ID NO: 845181 - RNA, 19 nt, Homo sapiens
ccagaauagagagaugaua

SEQ ID NO: 845182 - RNA, 19 nt, Homo sapiens
cagcagaagcaaagacaag

SEQ ID NO: 845183 - RNA, 19 nt, Homo sapiens
gaaacgaagaagcuagacu

SEQ ID NO: 845184 - RNA, 19 nt, Homo sapiens
gcaaaggcaacccauucag

SEQ ID NO: 845185 - RNA, 19 nt, Homo sapiens
cugcaaaacauguaagaua

SEQ ID NO: 845186 - RNA, 19 nt, Homo sapiens
gcaagaaacacagaaaaca

SEQ ID NO: 845187 - RNA, 19 nt, Homo sapiens
agaauagagagaugauaga

SEQ ID NO: 845188 - RNA, 19 nt, Homo sapiens
ugcugcgccuugcuuauuu

SEQ ID NO: 845189 - RNA, 19 nt, Homo sapiens
gcugcgccuugcuuauuuc

SEQ ID NO: 845190 - RNA, 19 nt, Homo sapiens
ggaagacuagaggugauuc

SEQ ID NO: 845191 - RNA, 19 nt, Homo sapiens
gauccagaagaaccaaugu

SEQ ID NO: 845192 - RNA, 19 nt, Homo sapiens
gcagcagaagcaaagacaa

SEQ ID NO: 845193 - RNA, 19 nt, Homo sapiens
gcacaugauccagaagaac

SEQ ID NO: 845194 - RNA, 19 nt, Homo sapiens
gaaauuucauggacaagua

SEQ ID NO: 845195 - RNA, 19 nt, Homo sapiens
ugaaguggcuggugacaua

SEQ ID NO: 845196 - RNA, 19 nt, Homo sapiens
ugaaacaccuucuuguauu

SEQ ID NO: 845197 - RNA, 19 nt, Homo sapiens
guacugaugugucacuuau

SEQ ID NO: 845198 - RNA, 19 nt, Homo sapiens
gaaacaccuucuuguauuc

SEQ ID NO: 845199 - RNA, 19 nt, Homo sapiens
ggaaagacugacucuguua

SEQ ID NO: 845200 - RNA, 19 nt, Homo sapiens
ggagacguccucuacauaa

SEQ ID NO: 845201 - RNA, 19 nt, Homo sapiens
ggaccuauuuauccugaaa

SEQ ID NO: 845202 - RNA, 19 nt, Homo sapiens
acugaugugucacuuauua

SEQ ID NO: 845203 - RNA, 19 nt, Homo sapiens
gacugacucuguuauguaa

SEQ ID NO: 845204 - RNA, 19 nt, Homo sapiens
gaacuuccaugauuaucca

SEQ ID NO: 845205 - RNA, 19 nt, Homo sapiens
gaugugaucuuggaacuuc

SEQ ID NO: 845206 - RNA, 19 nt, Homo sapiens
caacauuacagcaccauaa

SEQ ID NO: 845207 - RNA, 19 nt, Homo sapiens
aaacucaucuacacaccua

SEQ ID NO: 845208 - RNA, 19 nt, Homo sapiens
gguagggacucugcaguuu

SEQ ID NO: 845209 - RNA, 19 nt, Homo sapiens
ugcaaugugugguagauua

SEQ ID NO: 845210 - RNA, 19 nt, Homo sapiens
gcagguagagcacagcuuu

SEQ ID NO: 845211 - RNA, 19 nt, Homo sapiens
gaauguaugcugugugcua

SEQ ID NO: 845212 - RNA, 19 nt, Homo sapiens
gagacguccucuacauaaa

SEQ ID NO: 845213 - RNA, 19 nt, Homo sapiens
ccaauaggcucagcucaug

SEQ ID NO: 845214 - RNA, 19 nt, Homo sapiens
ggaugacgaguuccaguua

SEQ ID NO: 845215 - RNA, 19 nt, Homo sapiens
ugugguagauuacuuauca

SEQ ID NO: 845216 - RNA, 19 nt, Homo sapiens
cauaaaagcuccaugugaa

SEQ ID NO: 845217 - RNA, 19 nt, Homo sapiens
gagaauaaacucaucuaca

SEQ ID NO: 845218 - RNA, 19 nt, Homo sapiens
caagcucuguguuucugua

SEQ ID NO: 845219 - RNA, 19 nt, Homo sapiens
aagaaucuguacugacuuu

SEQ ID NO: 845220 - RNA, 19 nt, Homo sapiens
gaaagacugacucuguuau

SEQ ID NO: 845221 - RNA, 19 nt, Homo sapiens
gcuacaagcucuguguuuc

SEQ ID NO: 845222 - RNA, 19 nt, Homo sapiens
guaguucaauucccagugu

SEQ ID NO: 845223 - RNA, 19 nt, Homo sapiens
gcaguuucuuccugucaaa

SEQ ID NO: 845224 - RNA, 19 nt, Homo sapiens
gaagacacagaagagaaua

SEQ ID NO: 845225 - RNA, 19 nt, Homo sapiens
ggccacaguuucaguacuu

SEQ ID NO: 845226 - RNA, 19 nt, Homo sapiens
gaugacgaguuccaguuau

SEQ ID NO: 845227 - RNA, 19 nt, Homo sapiens
ggaugucaccagcccaaua

SEQ ID NO: 845228 - RNA, 19 nt, Homo sapiens
gcuuaguggugacuucauu

SEQ ID NO: 845229 - RNA, 19 nt, Homo sapiens
agaauaaacucaucuacac

SEQ ID NO: 845230 - RNA, 19 nt, Homo sapiens
uagaggacauuaucaugga

SEQ ID NO: 845231 - RNA, 19 nt, Homo sapiens
acauugacauucauuccua

SEQ ID NO: 845232 - RNA, 19 nt, Homo sapiens
cauaccugcugguguguaa

SEQ ID NO: 845233 - RNA, 19 nt, Homo sapiens
gguccuaccuccagccaau

SEQ ID NO: 845234 - RNA, 19 nt, Homo sapiens
cagaacacaucuuggaaag

SEQ ID NO: 845235 - RNA, 19 nt, Homo sapiens
ugacagaacacaucuugga

SEQ ID NO: 845236 - RNA, 19 nt, Homo sapiens
agagaaauuucauggacaa

SEQ ID NO: 845237 - RNA, 19 nt, Homo sapiens
gcugugugcuagaaauaga

SEQ ID NO: 845238 - RNA, 19 nt, Homo sapiens
uggaaagacugacucuguu

SEQ ID NO: 845239 - RNA, 19 nt, Homo sapiens
agaauuugaugcugugguu

SEQ ID NO: 845240 - RNA, 19 nt, Homo sapiens
aguacuaccuggaguuuga

SEQ ID NO: 845241 - RNA, 19 nt, Homo sapiens
aaagcuacuccuagucuua

SEQ ID NO: 845242 - RNA, 19 nt, Homo sapiens
gggcaccuaugaauguaug

SEQ ID NO: 845243 - RNA, 19 nt, Homo sapiens
agaacaaucugcggcacua

SEQ ID NO: 845244 - RNA, 19 nt, Homo sapiens
cugcucaccuucacagauu

SEQ ID NO: 845245 - RNA, 19 nt, Homo sapiens
auaagaaucuguacugacu

SEQ ID NO: 845246 - RNA, 19 nt, Homo sapiens
ugacgaguuccaguuauua

SEQ ID NO: 845247 - RNA, 19 nt, Homo sapiens
uaugucaucucuagaacga

SEQ ID NO: 845248 - RNA, 19 nt, Homo sapiens
ccugaaacaccuucuugua

SEQ ID NO: 845249 - RNA, 19 nt, Homo sapiens
gaauaaacucaucuacaca

SEQ ID NO: 845250 - RNA, 19 nt, Homo sapiens
guuuguaugcuuugguuua

SEQ ID NO: 845251 - RNA, 19 nt, Homo sapiens
ccaugauuauccacuuaaa

SEQ ID NO: 845252 - RNA, 19 nt, Homo sapiens
agacugacucuguuaugua

SEQ ID NO: 845253 - RNA, 19 nt, Homo sapiens
ucacuuggccauucugguu

SEQ ID NO: 845254 - RNA, 19 nt, Homo sapiens
uuaguguguuugcauguuu

SEQ ID NO: 845255 - RNA, 19 nt, Homo sapiens
ccuaguggaugugaucuug

SEQ ID NO: 845256 - RNA, 19 nt, Homo sapiens
cuccuagucuuaacauuug

SEQ ID NO: 845257 - RNA, 19 nt, Homo sapiens
gaguuccaguuauuacaga

SEQ ID NO: 845258 - RNA, 19 nt, Homo sapiens
caaguacuaccuggaguuu

SEQ ID NO: 845259 - RNA, 19 nt, Homo sapiens
guaggaaucaacagaagga

SEQ ID NO: 845260 - RNA, 19 nt, Homo sapiens
gaagagaauaaacucaucu

SEQ ID NO: 845261 - RNA, 19 nt, Homo sapiens
aagcauaguaguucaauuc

SEQ ID NO: 845262 - RNA, 19 nt, Homo sapiens
gauguagucccacuguuuc

SEQ ID NO: 845263 - RNA, 19 nt, Homo sapiens
ugauguagucccacuguuu

SEQ ID NO: 845264 - RNA, 19 nt, Homo sapiens
caagcccaguuugagauuu

SEQ ID NO: 845265 - RNA, 19 nt, Homo sapiens
caaguagacaccucucuca

SEQ ID NO: 845266 - RNA, 19 nt, Homo sapiens
gcagcggauuccugaguuc

SEQ ID NO: 845267 - RNA, 19 nt, Homo sapiens
caucuugucucggcuguag

SEQ ID NO: 845268 - RNA, 19 nt, Homo sapiens
ucacaugggccacaguuuc

SEQ ID NO: 845269 - RNA, 19 nt, Homo sapiens
guguguaaguguggacuaa

SEQ ID NO: 845270 - RNA, 19 nt, Homo sapiens
gccgaggacuggacuuaag

SEQ ID NO: 845271 - RNA, 19 nt, Homo sapiens
cuucagguguuucgcaaga

SEQ ID NO: 845272 - RNA, 19 nt, Homo sapiens
cagugugucccuuugauuu

SEQ ID NO: 845273 - RNA, 19 nt, Homo sapiens
guagagcacagcuuuacug

SEQ ID NO: 845274 - RNA, 19 nt, Homo sapiens
ggaguuugaagacacagaa

SEQ ID NO: 845275 - RNA, 19 nt, Homo sapiens
cugaaacaccuucuuguau

SEQ ID NO: 845276 - RNA, 19 nt, Homo sapiens
gacagaacacaucuuggaa

SEQ ID NO: 845277 - RNA, 19 nt, Homo sapiens
gaugucaccagcccaauag

SEQ ID NO: 845278 - RNA, 19 nt, Homo sapiens
guaagguucucuggguuag

SEQ ID NO: 845279 - RNA, 19 nt, Homo sapiens
uaacccuccuggaccuauu

SEQ ID NO: 845280 - RNA, 19 nt, Homo sapiens
agaagagaauaaacucauc

SEQ ID NO: 845281 - RNA, 19 nt, Homo sapiens
gcucuguguuucuguacug

SEQ ID NO: 845282 - RNA, 19 nt, Homo sapiens
ugaagacacagaagagaau

SEQ ID NO: 845283 - RNA, 19 nt, Homo sapiens
caagaugguguuccacugu

SEQ ID NO: 845284 - RNA, 19 nt, Homo sapiens
gauuauccacuuaaagauc

SEQ ID NO: 845285 - RNA, 19 nt, Homo sapiens
uugaugcugugguuggaua

SEQ ID NO: 845286 - RNA, 19 nt, Homo sapiens
guuaguguguuugcauguu

SEQ ID NO: 845287 - RNA, 19 nt, Homo sapiens
aggcuaaccuaguggaugu

SEQ ID NO: 845288 - RNA, 19 nt, Homo sapiens
caccuucuuguauucauua

SEQ ID NO: 845289 - RNA, 19 nt, Homo sapiens
acagaacacaucuuggaaa

SEQ ID NO: 845290 - RNA, 19 nt, Homo sapiens
agacacagaagagaauaaa

SEQ ID NO: 845291 - RNA, 19 nt, Homo sapiens
gguagauuacuuaucagaa

SEQ ID NO: 845292 - RNA, 19 nt, Homo sapiens
uguaagguucucuggguua

SEQ ID NO: 845293 - RNA, 19 nt, Homo sapiens
uuccaugauuauccacuua

SEQ ID NO: 845294 - RNA, 19 nt, Homo sapiens
cuaagaagcugcaauaaag

SEQ ID NO: 845295 - RNA, 19 nt, Homo sapiens
gaaggaguuucccaucaaa

SEQ ID NO: 845296 - RNA, 19 nt, Homo sapiens
ggucugagauggacaaagu

SEQ ID NO: 845297 - RNA, 19 nt, Homo sapiens
ccaaggacuucuucacaaa

SEQ ID NO: 845298 - RNA, 19 nt, Homo sapiens
gcucuaagaagcugcaaua

SEQ ID NO: 845299 - RNA, 19 nt, Homo sapiens
ugacuacucuggccaugaa

SEQ ID NO: 845300 - RNA, 19 nt, Homo sapiens
gcgaagaccugcaggacau

SEQ ID NO: 845301 - RNA, 19 nt, Homo sapiens
gaccagaagguucagauuu

SEQ ID NO: 845302 - RNA, 19 nt, Homo sapiens
gaggugacccugacgauga

SEQ ID NO: 845303 - RNA, 19 nt, Homo sapiens
aagaagaaauccacagguu

SEQ ID NO: 845304 - RNA, 19 nt, Homo sapiens
agucaaagcucuacucuac

SEQ ID NO: 845305 - RNA, 19 nt, Homo sapiens
ugaaggaguuucccaucaa

SEQ ID NO: 845306 - RNA, 19 nt, Homo sapiens
ccagagcugugaaagauca

SEQ ID NO: 845307 - RNA, 19 nt, Homo sapiens
ugacucagcuugacaucug

SEQ ID NO: 845308 - RNA, 19 nt, Homo sapiens
gaaagcccuucuccuucaa

SEQ ID NO: 845309 - RNA, 19 nt, Homo sapiens
ggagaucggcuacauccaa

SEQ ID NO: 845310 - RNA, 19 nt, Homo sapiens
gcaguggcuugcuuucuuc

SEQ ID NO: 845311 - RNA, 19 nt, Homo sapiens
caaacaagacauugagaga

SEQ ID NO: 845312 - RNA, 19 nt, Homo sapiens
acagaggccugaaggaguu

SEQ ID NO: 845313 - RNA, 19 nt, Homo sapiens
ggacaaagugaggguguuu

SEQ ID NO: 845314 - RNA, 19 nt, Homo sapiens
caggacaugucgcugauga

SEQ ID NO: 845315 - RNA, 19 nt, Homo sapiens
cugugaagcucuauucuga

SEQ ID NO: 845316 - RNA, 19 nt, Homo sapiens
ggacugcgaggaugaugaa

SEQ ID NO: 845317 - RNA, 19 nt, Homo sapiens
ucaacgacuucuucaccua

SEQ ID NO: 845318 - RNA, 19 nt, Homo sapiens
gaaagcacaacauggacuu

SEQ ID NO: 845319 - RNA, 19 nt, Homo sapiens
acacucaguucugcucuaa

SEQ ID NO: 845320 - RNA, 19 nt, Homo sapiens
ggccgagagugacaucauu

SEQ ID NO: 845321 - RNA, 19 nt, Homo sapiens
aaccagagcugugaaagau

SEQ ID NO: 845322 - RNA, 19 nt, Homo sapiens
ucuaagaagcugcaauaaa

SEQ ID NO: 845323 - RNA, 19 nt, Homo sapiens
agagaugcaucgacuggaa

SEQ ID NO: 845324 - RNA, 19 nt, Homo sapiens
ccagaagguucagauuuca

SEQ ID NO: 845325 - RNA, 19 nt, Homo sapiens
acucaguucugcucuaaga

SEQ ID NO: 845326 - RNA, 19 nt, Homo sapiens
gcaccuucaucaacgacuu

SEQ ID NO: 845327 - RNA, 19 nt, Homo sapiens
caaccagagcugugaaaga

SEQ ID NO: 845328 - RNA, 19 nt, Homo sapiens
gagcucuugugaauauugu

SEQ ID NO: 845329 - RNA, 19 nt, Homo sapiens
guguacgcgugcaguauuu

SEQ ID NO: 845330 - RNA, 19 nt, Homo sapiens
cccaaggacuucuucacaa

SEQ ID NO: 845331 - RNA, 19 nt, Homo sapiens
agaagguucagauuucaua

SEQ ID NO: 845332 - RNA, 19 nt, Homo sapiens
gagagugacaucauugaca

SEQ ID NO: 845333 - RNA, 19 nt, Homo sapiens
gcugcugccuggaggagaa

SEQ ID NO: 845334 - RNA, 19 nt, Homo sapiens
ucucuaaggcggaagcuuu

SEQ ID NO: 845335 - RNA, 19 nt, Homo sapiens
aaacaagacauugagagaa

SEQ ID NO: 845336 - RNA, 19 nt, Homo sapiens
guggaaagcacaacaugga

SEQ ID NO: 845337 - RNA, 19 nt, Homo sapiens
ggcaaacuguccuccaagu

SEQ ID NO: 845338 - RNA, 19 nt, Homo sapiens
gcacguccuucagcaucaa

SEQ ID NO: 845339 - RNA, 19 nt, Homo sapiens
cgaggaugaugaagugcuu

SEQ ID NO: 845340 - RNA, 19 nt, Homo sapiens
gcaccuugacucagcuuga

SEQ ID NO: 845341 - RNA, 19 nt, Homo sapiens
accagaagguucagauuuc

SEQ ID NO: 845342 - RNA, 19 nt, Homo sapiens
gaacauucugucaaacaag

SEQ ID NO: 845343 - RNA, 19 nt, Homo sapiens
gugaagcucuauucugacu

SEQ ID NO: 845344 - RNA, 19 nt, Homo sapiens
gcaaacuguccuccaagug

SEQ ID NO: 845345 - RNA, 19 nt, Homo sapiens
ucaaagcucuacucuaccu

SEQ ID NO: 845346 - RNA, 19 nt, Homo sapiens
agguucagauuucauacua

SEQ ID NO: 845347 - RNA, 19 nt, Homo sapiens
agagugacaucauugacau

SEQ ID NO: 845348 - RNA, 19 nt, Homo sapiens
agacauugagagaacauaa

SEQ ID NO: 845349 - RNA, 19 nt, Homo sapiens
guucgaagggaucaagaaa

SEQ ID NO: 845350 - RNA, 19 nt, Homo sapiens
uccaggagcagcagaauga

SEQ ID NO: 845351 - RNA, 19 nt, Homo sapiens
cgagugauggguccagauu

SEQ ID NO: 845352 - RNA, 19 nt, Homo sapiens
cugaaggaguuucccauca

SEQ ID NO: 845353 - RNA, 19 nt, Homo sapiens
gguguacgcgugcaguauu

SEQ ID NO: 845354 - RNA, 19 nt, Homo sapiens
gcugugguguuccaagaca

SEQ ID NO: 845355 - RNA, 19 nt, Homo sapiens
aacauucugucaaacaaga

SEQ ID NO: 845356 - RNA, 19 nt, Homo sapiens
ggacgaguuccugagcuuu

SEQ ID NO: 845357 - RNA, 19 nt, Homo sapiens
gcacaacauggacuucuac

SEQ ID NO: 845358 - RNA, 19 nt, Homo sapiens
cugcgaggaugaugaagug

SEQ ID NO: 845359 - RNA, 19 nt, Homo sapiens
gcacaggcgaccagaaggu

SEQ ID NO: 845360 - RNA, 19 nt, Homo sapiens
ccugugaugucccaguuuc

SEQ ID NO: 845361 - RNA, 19 nt, Homo sapiens
ccacagguuccuccacaug

SEQ ID NO: 845362 - RNA, 19 nt, Homo sapiens
aacaagacauugagagaac

SEQ ID NO: 845363 - RNA, 19 nt, Homo sapiens
aaauggagaucggcuacau

SEQ ID NO: 845364 - RNA, 19 nt, Homo sapiens
gagguguacgcgugcagua

SEQ ID NO: 845365 - RNA, 19 nt, Homo sapiens
ggaacagaggccugaagga

SEQ ID NO: 845366 - RNA, 19 nt, Homo sapiens
accaguggaugcaggauga

SEQ ID NO: 845367 - RNA, 19 nt, Homo sapiens
gaugaugaagugcuugaca

SEQ ID NO: 845368 - RNA, 19 nt, Homo sapiens
gacgaguuccugagcuuug

SEQ ID NO: 845369 - RNA, 19 nt, Homo sapiens
ggaugcaggaugaaaugga

SEQ ID NO: 845370 - RNA, 19 nt, Homo sapiens
aagaagcugcaauaaaguu

SEQ ID NO: 845371 - RNA, 19 nt, Homo sapiens
gacauugagagaacauaau

SEQ ID NO: 845372 - RNA, 19 nt, Homo sapiens
uaagaagcugcaauaaagu

SEQ ID NO: 845373 - RNA, 19 nt, Homo sapiens
uaauucauuuguggagaga

SEQ ID NO: 845374 - RNA, 19 nt, Homo sapiens
gagugauggguccagauuu

SEQ ID NO: 845375 - RNA, 19 nt, Homo sapiens
ugaugacccugagcacgaa

SEQ ID NO: 845376 - RNA, 19 nt, Homo sapiens
agaagcugcaauaaaguuu

SEQ ID NO: 845377 - RNA, 19 nt, Homo sapiens
cgaccagaagguucagauu

SEQ ID NO: 845378 - RNA, 19 nt, Homo sapiens
gcuuucuucuccugugaug

SEQ ID NO: 845379 - RNA, 19 nt, Homo sapiens
gcaaugacagccggcagau

SEQ ID NO: 845380 - RNA, 19 nt, Homo sapiens
aggaggagaacauggauga

SEQ ID NO: 845381 - RNA, 19 nt, Homo sapiens
cacacucaguucugcucua

SEQ ID NO: 845382 - RNA, 19 nt, Homo sapiens
ccaugaaagccaagugcaa

SEQ ID NO: 845383 - RNA, 19 nt, Homo sapiens
gaaauggagaucggcuaca

SEQ ID NO: 845384 - RNA, 19 nt, Homo sapiens
acaaagugaggguguuuca

SEQ ID NO: 845385 - RNA, 19 nt, Homo sapiens
gacaaucucgaaucuucug

SEQ ID NO: 845386 - RNA, 19 nt, Homo sapiens
ugacaucccgcagcucuuc

SEQ ID NO: 845387 - RNA, 19 nt, Homo sapiens
uggacgaguuccugagcuu

SEQ ID NO: 845388 - RNA, 19 nt, Homo sapiens
cauccaagccccacacaaa

SEQ ID NO: 845389 - RNA, 19 nt, Homo sapiens
guggaugcaggaugaaaug

SEQ ID NO: 845390 - RNA, 19 nt, Homo sapiens
ucauuacccucaccaucuc

SEQ ID NO: 845391 - RNA, 19 nt, Homo sapiens
agcacaacauggacuucua

SEQ ID NO: 845392 - RNA, 19 nt, Homo sapiens
uagcacaggcgaccagaag

SEQ ID NO: 845393 - RNA, 19 nt, Homo sapiens
cugaagaucccaacauggu

SEQ ID NO: 845394 - RNA, 19 nt, Homo sapiens
gcagauggguugcauuuga

SEQ ID NO: 845395 - RNA, 19 nt, Homo sapiens
gagcaugucugaacuggaa

SEQ ID NO: 845396 - RNA, 19 nt, Homo sapiens
gcugaaaucuuggcugaua

SEQ ID NO: 845397 - RNA, 19 nt, Homo sapiens
ggaaggagguugacaugau

SEQ ID NO: 845398 - RNA, 19 nt, Homo sapiens
gugcaaagguuuaugagaa

SEQ ID NO: 845399 - RNA, 19 nt, Homo sapiens
gcagcaaacuguauauauc

SEQ ID NO: 845400 - RNA, 19 nt, Homo sapiens
gaaggagguugacaugaug

SEQ ID NO: 845401 - RNA, 19 nt, Homo sapiens
ggaagaguauccagaaagu

SEQ ID NO: 845402 - RNA, 19 nt, Homo sapiens
caacaaagggcacgucuug

SEQ ID NO: 845403 - RNA, 19 nt, Homo sapiens
gaugaaagaagcauuagaa

SEQ ID NO: 845404 - RNA, 19 nt, Homo sapiens
uaguagagaugaaagauga

SEQ ID NO: 845405 - RNA, 19 nt, Homo sapiens
ugacauagcagcaaacugu

SEQ ID NO: 845406 - RNA, 19 nt, Homo sapiens
ucaacgaggugcugaaauc

SEQ ID NO: 845407 - RNA, 19 nt, Homo sapiens
caugaugaaagaagcauua

SEQ ID NO: 845408 - RNA, 19 nt, Homo sapiens
ccagaaagugcaaagguuu

SEQ ID NO: 845409 - RNA, 19 nt, Homo sapiens
cagauggguugcauuugaa

SEQ ID NO: 845410 - RNA, 19 nt, Homo sapiens
cagaaagugcaaagguuua

SEQ ID NO: 845411 - RNA, 19 nt, Homo sapiens
cacugugccugaugacaua

SEQ ID NO: 845412 - RNA, 19 nt, Homo sapiens
ugcaaagguuuaugagaaa

SEQ ID NO: 845413 - RNA, 19 nt, Homo sapiens
gguugcauuugaagaguuu

SEQ ID NO: 845414 - RNA, 19 nt, Homo sapiens
gaaacugaaggaccauaug

SEQ ID NO: 845415 - RNA, 19 nt, Homo sapiens
cauagcagcaaacuguaua

SEQ ID NO: 845416 - RNA, 19 nt, Homo sapiens
gaugaaagaugaaaaugca

SEQ ID NO: 845417 - RNA, 19 nt, Homo sapiens
aaacuucagcucaauauag

SEQ ID NO: 845418 - RNA, 19 nt, Homo sapiens
gaaggaccauaugcugauc

SEQ ID NO: 845419 - RNA, 19 nt, Homo sapiens
acgaggugcugaaaucuug

SEQ ID NO: 845420 - RNA, 19 nt, Homo sapiens
gaggaaggagguugacaug

SEQ ID NO: 845421 - RNA, 19 nt, Homo sapiens
aaagugcaaagguuuauga

SEQ ID NO: 845422 - RNA, 19 nt, Homo sapiens
aaucuuggcugauacuuuu

SEQ ID NO: 845423 - RNA, 19 nt, Homo sapiens
gaaaaugcaacuuuagaug

SEQ ID NO: 845424 - RNA, 19 nt, Homo sapiens
ccggaagaguauccagaaa

SEQ ID NO: 845425 - RNA, 19 nt, Homo sapiens
cuuaagaucaugcaacaga

SEQ ID NO: 845426 - RNA, 19 nt, Homo sapiens
uggcagauggguugcauuu

SEQ ID NO: 845427 - RNA, 19 nt, Homo sapiens
uccagaaagugcaaagguu

SEQ ID NO: 845428 - RNA, 19 nt, Homo sapiens
ggaggaaggagguugacau

SEQ ID NO: 845429 - RNA, 19 nt, Homo sapiens
caaacucacugugccugau

SEQ ID NO: 845430 - RNA, 19 nt, Homo sapiens
guagagaugaaagaugaaa

SEQ ID NO: 845431 - RNA, 19 nt, Homo sapiens
uuagauggcggagauguuu

SEQ ID NO: 845432 - RNA, 19 nt, Homo sapiens
gaaagugcaaagguuuaug

SEQ ID NO: 845433 - RNA, 19 nt, Homo sapiens
gagaaacugaaggaccaua

SEQ ID NO: 845434 - RNA, 19 nt, Homo sapiens
cagcaaacuguauauaucu

SEQ ID NO: 845435 - RNA, 19 nt, Homo sapiens
gacauagcagcaaacugua

SEQ ID NO: 845436 - RNA, 19 nt, Homo sapiens
cugaugacauagcagcaaa

SEQ ID NO: 845437 - RNA, 19 nt, Homo sapiens
agguugacaugaugaaaga

SEQ ID NO: 845438 - RNA, 19 nt, Homo sapiens
uagcagcaaacuguauaua

SEQ ID NO: 845439 - RNA, 19 nt, Homo sapiens
gagguugacaugaugaaag

SEQ ID NO: 845440 - RNA, 19 nt, Homo sapiens
ggguugcauuugaagaguu

SEQ ID NO: 845441 - RNA, 19 nt, Homo sapiens
uggcggagauguuuuauuc

SEQ ID NO: 845442 - RNA, 19 nt, Homo sapiens
ugaaggaccauaugcugau

SEQ ID NO: 845443 - RNA, 19 nt, Homo sapiens
gaagaguauccagaaagug

SEQ ID NO: 845444 - RNA, 19 nt, Homo sapiens
gcugcucaguuuuaauuaa

SEQ ID NO: 845445 - RNA, 19 nt, Homo sapiens
ggagguugacaugaugaaa

SEQ ID NO: 845446 - RNA, 19 nt, Homo sapiens
uaagaucaugcaacagaug

SEQ ID NO: 845447 - RNA, 19 nt, Homo sapiens
gcucaccugcugcucaguu

SEQ ID NO: 845448 - RNA, 19 nt, Homo sapiens
uuaagaucaugcaacagau

SEQ ID NO: 845449 - RNA, 19 nt, Homo sapiens
ugaccaccgcuacgacaaa

SEQ ID NO: 845450 - RNA, 19 nt, Homo sapiens
cccuuaagaucaugcaaca

SEQ ID NO: 845451 - RNA, 19 nt, Homo sapiens
aacuucagcucaauauagu

SEQ ID NO: 845452 - RNA, 19 nt, Homo sapiens
aaaucuuggcugauacuuu

SEQ ID NO: 845453 - RNA, 19 nt, Homo sapiens
gaccaccgcuacgacaaac

SEQ ID NO: 845454 - RNA, 19 nt, Homo sapiens
cuaaauauccccaacaaag

SEQ ID NO: 845455 - RNA, 19 nt, Homo sapiens
ucacugugccugaugacau

SEQ ID NO: 845456 - RNA, 19 nt, Homo sapiens
gaaaucuuggcugauacuu

SEQ ID NO: 845457 - RNA, 19 nt, Homo sapiens
cauaaauccuuguguguua

SEQ ID NO: 845458 - RNA, 19 nt, Homo sapiens
gaaguugaauguccugaug

SEQ ID NO: 845459 - RNA, 19 nt, Homo sapiens
gaccuuuccuggcuucuua

SEQ ID NO: 845460 - RNA, 19 nt, Homo sapiens
ggagaguccugcaucauag

SEQ ID NO: 845461 - RNA, 19 nt, Homo sapiens
gaggauagaaguugaaugu

SEQ ID NO: 845462 - RNA, 19 nt, Homo sapiens
caucauagccaccaaauag

SEQ ID NO: 845463 - RNA, 19 nt, Homo sapiens
ccagugaaauuguaagcuu

SEQ ID NO: 845464 - RNA, 19 nt, Homo sapiens
gaaggacacagcuguacaa

SEQ ID NO: 845465 - RNA, 19 nt, Homo sapiens
aaaguccagugaaauugua

SEQ ID NO: 845466 - RNA, 19 nt, Homo sapiens
gaaucaccauggccagcua

SEQ ID NO: 845467 - RNA, 19 nt, Homo sapiens
ggagaaggacacagcugua

SEQ ID NO: 845468 - RNA, 19 nt, Homo sapiens
gcaauuggucuucauucaa

SEQ ID NO: 845469 - RNA, 19 nt, Homo sapiens
ugagagagaucugucuaug

SEQ ID NO: 845470 - RNA, 19 nt, Homo sapiens
ucucagcccuguggaaauu

SEQ ID NO: 845471 - RNA, 19 nt, Homo sapiens
ggaaucugaccaagcauga

SEQ ID NO: 845472 - RNA, 19 nt, Homo sapiens
gaggagaggauagaaguug

SEQ ID NO: 845473 - RNA, 19 nt, Homo sapiens
caacugcaauuggucuuca

SEQ ID NO: 845474 - RNA, 19 nt, Homo sapiens
cccaggagcugcaggacaa

SEQ ID NO: 845475 - RNA, 19 nt, Homo sapiens
ugaccaagcaugagagaga

SEQ ID NO: 845476 - RNA, 19 nt, Homo sapiens
caaaguggaaucugaccaa

SEQ ID NO: 845477 - RNA, 19 nt, Homo sapiens
ggucagccaccuccaaguu

SEQ ID NO: 845478 - RNA, 19 nt, Homo sapiens
gagcagguccuuguaaugg

SEQ ID NO: 845479 - RNA, 19 nt, Homo sapiens
uggagaguccugcaucaua

SEQ ID NO: 845480 - RNA, 19 nt, Homo sapiens
caagcucugucccaaaugg

SEQ ID NO: 845481 - RNA, 19 nt, Homo sapiens
gaucacaguggcuauaucu

SEQ ID NO: 845482 - RNA, 19 nt, Homo sapiens
ggccaaaaguccagugaaa

SEQ ID NO: 845483 - RNA, 19 nt, Homo sapiens
gcaucauagccaccaaaua

SEQ ID NO: 845484 - RNA, 19 nt, Homo sapiens
gguggagaguccugcauca

SEQ ID NO: 845485 - RNA, 19 nt, Homo sapiens
ggagcagguccuuguaaug

SEQ ID NO: 845486 - RNA, 19 nt, Homo sapiens
ggagaggauagaaguugaa

SEQ ID NO: 845487 - RNA, 19 nt, Homo sapiens
guggcuauaucuccaugaa

SEQ ID NO: 845488 - RNA, 19 nt, Homo sapiens
gaccaagcaugagagagau

SEQ ID NO: 845489 - RNA, 19 nt, Homo sapiens
ccaaaaguccagugaaauu

SEQ ID NO: 845490 - RNA, 19 nt, Homo sapiens
gggcugaggccacacagau

SEQ ID NO: 845491 - RNA, 19 nt, Homo sapiens
ccauaaauccuuguguguu

SEQ ID NO: 845492 - RNA, 19 nt, Homo sapiens
ggagggcaguaugguagug

SEQ ID NO: 845493 - RNA, 19 nt, Homo sapiens
ggaggagaggauagaaguu

SEQ ID NO: 845494 - RNA, 19 nt, Homo sapiens
ucagaucacaguggcuaua

SEQ ID NO: 845495 - RNA, 19 nt, Homo sapiens
gauucugccacacccauaa

SEQ ID NO: 845496 - RNA, 19 nt, Homo sapiens
ggauucugccacacccaua

SEQ ID NO: 845497 - RNA, 19 nt, Homo sapiens
gagagagaucugucuaugg

SEQ ID NO: 845498 - RNA, 19 nt, Homo sapiens
aguggaaucugaccaagca

SEQ ID NO: 845499 - RNA, 19 nt, Homo sapiens
ggacaucucuucuuuuccu

SEQ ID NO: 845500 - RNA, 19 nt, Homo sapiens
ccaaccaucuguggagagu

SEQ ID NO: 845501 - RNA, 19 nt, Homo sapiens
agcaagcucugucccaaau

SEQ ID NO: 845502 - RNA, 19 nt, Homo sapiens
gaaccucuuccagcaguau

SEQ ID NO: 845503 - RNA, 19 nt, Homo sapiens
caagucaggccgcaucgau

SEQ ID NO: 845504 - RNA, 19 nt, Homo sapiens
ugcaauuggucuucauuca

SEQ ID NO: 845505 - RNA, 19 nt, Homo sapiens
ccuuguguguuaacuucua

SEQ ID NO: 845506 - RNA, 19 nt, Homo sapiens
cauagccaccaaauaguga

SEQ ID NO: 845507 - RNA, 19 nt, Homo sapiens
cauucucccuugcuugaug

SEQ ID NO: 845508 - RNA, 19 nt, Homo sapiens
ggaccaguggcuuggauuc

SEQ ID NO: 845509 - RNA, 19 nt, Homo sapiens
caugagagagaucugucua

SEQ ID NO: 845510 - RNA, 19 nt, Homo sapiens
aggagaggauagaaguuga

SEQ ID NO: 845511 - RNA, 19 nt, Homo sapiens
gcuaugacccaaccaucug

SEQ ID NO: 845512 - RNA, 19 nt, Homo sapiens
gaggacuucgucaccauga

SEQ ID NO: 845513 - RNA, 19 nt, Homo sapiens
gcugaggccacacagauag

SEQ ID NO: 845514 - RNA, 19 nt, Homo sapiens
ggcugaggccacacagaua

SEQ ID NO: 845515 - RNA, 19 nt, Homo sapiens
gacagcuucucggaugcua

SEQ ID NO: 845516 - RNA, 19 nt, Homo sapiens
ccauggccagcuauccuua

SEQ ID NO: 845517 - RNA, 19 nt, Homo sapiens
gcugagcuccacccugaug

SEQ ID NO: 845518 - RNA, 19 nt, Homo sapiens
caucggccuguuaccguua

SEQ ID NO: 845519 - RNA, 19 nt, Homo sapiens
guggacaucucuucuuuuc

SEQ ID NO: 845520 - RNA, 19 nt, Homo sapiens
gagaaggacacagcuguac

SEQ ID NO: 845521 - RNA, 19 nt, Homo sapiens
cagcaagcucugucccaaa

SEQ ID NO: 845522 - RNA, 19 nt, Homo sapiens
ucauagccaccaaauagug

SEQ ID NO: 845523 - RNA, 19 nt, Homo sapiens
uuuccuggcuucuuagagu

SEQ ID NO: 845524 - RNA, 19 nt, Homo sapiens
gcucgggcuccauuagcua

SEQ ID NO: 845525 - RNA, 19 nt, Homo sapiens
gagaggauagaaguugaau

SEQ ID NO: 845526 - RNA, 19 nt, Homo sapiens
ugauggccaugagcaguug

SEQ ID NO: 845527 - RNA, 19 nt, Homo sapiens
uccugucccucuagaagaa

SEQ ID NO: 845528 - RNA, 19 nt, Homo sapiens
ccaugaaggagcuaaagca

SEQ ID NO: 845529 - RNA, 19 nt, Homo sapiens
aaucugaccaagcaugaga

SEQ ID NO: 845530 - RNA, 19 nt, Homo sapiens
uagagugagagaaguaugu

SEQ ID NO: 845531 - RNA, 19 nt, Homo sapiens
cagcuucucggaugcuaug

SEQ ID NO: 845532 - RNA, 19 nt, Homo sapiens
gaacagcccucuucuucau

SEQ ID NO: 845533 - RNA, 19 nt, Homo sapiens
gaaggccagugcagaauau

SEQ ID NO: 845534 - RNA, 19 nt, Homo sapiens
aaacagugaggaaacauua

SEQ ID NO: 845535 - RNA, 19 nt, Homo sapiens
ccaguaagcugcccaagag

SEQ ID NO: 845536 - RNA, 19 nt, Homo sapiens
gcaccucccauagcuauua

SEQ ID NO: 845537 - RNA, 19 nt, Homo sapiens
ggaaggccagugcagaaua

SEQ ID NO: 845538 - RNA, 19 nt, Homo sapiens
gagguugacugccgguuau

SEQ ID NO: 845539 - RNA, 19 nt, Homo sapiens
gauggagaauggaaggaaa

SEQ ID NO: 845540 - RNA, 19 nt, Homo sapiens
ccaggacccuugauucaga

SEQ ID NO: 845541 - RNA, 19 nt, Homo sapiens
ggaccgagccuuaugaucu

SEQ ID NO: 845542 - RNA, 19 nt, Homo sapiens
gcaauauuuggaacacuua

SEQ ID NO: 845543 - RNA, 19 nt, Homo sapiens
gcacuaaacgcagcccuuu

SEQ ID NO: 845544 - RNA, 19 nt, Homo sapiens
ggacaccuccuuccucaau

SEQ ID NO: 845545 - RNA, 19 nt, Homo sapiens
caagacagccagacaagga

SEQ ID NO: 845546 - RNA, 19 nt, Homo sapiens
gcaaauuucagguagacaa

SEQ ID NO: 845547 - RNA, 19 nt, Homo sapiens
ggacuuggacuucagaucu

SEQ ID NO: 845548 - RNA, 19 nt, Homo sapiens
uuggaacacuuaugugaaa

SEQ ID NO: 845549 - RNA, 19 nt, Homo sapiens
gaggaaggccagugcagaa

SEQ ID NO: 845550 - RNA, 19 nt, Homo sapiens
gacaccuccuuccucaaua

SEQ ID NO: 845551 - RNA, 19 nt, Homo sapiens
gugcugaguuaaacgcaaa

SEQ ID NO: 845552 - RNA, 19 nt, Homo sapiens
ccauagcuauuaacaacug

SEQ ID NO: 845553 - RNA, 19 nt, Homo sapiens
gaguuaaacgcaaauuuca

SEQ ID NO: 845554 - RNA, 19 nt, Homo sapiens
gacucuagacacuaacuua

SEQ ID NO: 845555 - RNA, 19 nt, Homo sapiens
guacugacuacuucccuuu

SEQ ID NO: 845556 - RNA, 19 nt, Homo sapiens
gcuauuaacaacugaggaa

SEQ ID NO: 845557 - RNA, 19 nt, Homo sapiens
agcagaagcucggguauga

SEQ ID NO: 845558 - RNA, 19 nt, Homo sapiens
ccacuggacuuggacuuca

SEQ ID NO: 845559 - RNA, 19 nt, Homo sapiens
caaauuucagguagacaaa

SEQ ID NO: 845560 - RNA, 19 nt, Homo sapiens
aaacagagugcugaguuaa

SEQ ID NO: 845561 - RNA, 19 nt, Homo sapiens
aaaacagagugcugaguua

SEQ ID NO: 845562 - RNA, 19 nt, Homo sapiens
ggaggaggaggaugaaauc

SEQ ID NO: 845563 - RNA, 19 nt, Homo sapiens
cccaugcucuggaggauga

SEQ ID NO: 845564 - RNA, 19 nt, Homo sapiens
gccugacucuagacacuaa

SEQ ID NO: 845565 - RNA, 19 nt, Homo sapiens
ugaguuaaacgcaaauuuc

SEQ ID NO: 845566 - RNA, 19 nt, Homo sapiens
ugacuacuucccuuucuuu

SEQ ID NO: 845567 - RNA, 19 nt, Homo sapiens
uaaacgcaaauuucaggua

SEQ ID NO: 845568 - RNA, 19 nt, Homo sapiens
gcgagcaugugcacuaaac

SEQ ID NO: 845569 - RNA, 19 nt, Homo sapiens
gaccgagccuuaugaucuc

SEQ ID NO: 845570 - RNA, 19 nt, Homo sapiens
ucccauagcuauuaacaac

SEQ ID NO: 845571 - RNA, 19 nt, Homo sapiens
gagaagggcaccaguaagc

SEQ ID NO: 845572 - RNA, 19 nt, Homo sapiens
cggagaagggcaccaguaa

SEQ ID NO: 845573 - RNA, 19 nt, Homo sapiens
gcggagaagggcaccagua

SEQ ID NO: 845574 - RNA, 19 nt, Homo sapiens
gccugacucuccucucuug

SEQ ID NO: 845575 - RNA, 19 nt, Homo sapiens
gcaagaugccaauccucaa

SEQ ID NO: 845576 - RNA, 19 nt, Homo sapiens
ccuccacccuggccucaaa

SEQ ID NO: 845577 - RNA, 19 nt, Homo sapiens
ucucuugccugacucuaga

SEQ ID NO: 845578 - RNA, 19 nt, Homo sapiens
cgcaauauuuggaacacuu

SEQ ID NO: 845579 - RNA, 19 nt, Homo sapiens
cccuggaccuuguagauga

SEQ ID NO: 845580 - RNA, 19 nt, Homo sapiens
gugcuccuguuuccaauag

SEQ ID NO: 845581 - RNA, 19 nt, Homo sapiens
gcugcgagcaugugcacua

SEQ ID NO: 845582 - RNA, 19 nt, Homo sapiens
ugagguugacugccgguua

SEQ ID NO: 845583 - RNA, 19 nt, Homo sapiens
gcagccaggacccuugauu

SEQ ID NO: 845584 - RNA, 19 nt, Homo sapiens
cauggacccuggaccuugu

SEQ ID NO: 845585 - RNA, 19 nt, Homo sapiens
ccagcucggugcacuccaa

SEQ ID NO: 845586 - RNA, 19 nt, Homo sapiens
caccucccauagcuauuaa

SEQ ID NO: 845587 - RNA, 19 nt, Homo sapiens
ccgacuggcugccugacuu

SEQ ID NO: 845588 - RNA, 19 nt, Homo sapiens
acagugaggaaacauuaaa

SEQ ID NO: 845589 - RNA, 19 nt, Homo sapiens
acgaacagcccucuucuuc

SEQ ID NO: 845590 - RNA, 19 nt, Homo sapiens
cuacgcaccucccauagcu

SEQ ID NO: 845591 - RNA, 19 nt, Homo sapiens
ggauggagaauggaaggaa

SEQ ID NO: 845592 - RNA, 19 nt, Homo sapiens
gacuuggacuucagaucug

SEQ ID NO: 845593 - RNA, 19 nt, Homo sapiens
ucacagcaggaauagguuu

SEQ ID NO: 845594 - RNA, 19 nt, Homo sapiens
uaauaugccccacgcaaua

SEQ ID NO: 845595 - RNA, 19 nt, Homo sapiens
acagagugcugaguuaaac

SEQ ID NO: 845596 - RNA, 19 nt, Homo sapiens
ccaggguuggccagauuua

SEQ ID NO: 845597 - RNA, 19 nt, Homo sapiens
ggacucucggcucccauuu

SEQ ID NO: 845598 - RNA, 19 nt, Homo sapiens
gaauagguuuuccucuguu

SEQ ID NO: 845599 - RNA, 19 nt, Homo sapiens
ggacgaacagcccucuucu

SEQ ID NO: 845600 - RNA, 19 nt, Homo sapiens
gguaugagccccugagguu

SEQ ID NO: 845601 - RNA, 19 nt, Homo sapiens
agagcaggauggagaaugg

SEQ ID NO: 845602 - RNA, 19 nt, Homo sapiens
ggugacguccucagcauca

SEQ ID NO: 845603 - RNA, 19 nt, Homo sapiens
cggaguccaucauguccuu

SEQ ID NO: 845604 - RNA, 19 nt, Homo sapiens
ggagaagggcaccaguaag

SEQ ID NO: 845605 - RNA, 19 nt, Homo sapiens
acaccuccuuccucaauag

SEQ ID NO: 845606 - RNA, 19 nt, Homo sapiens
caagaugccaauccucaag

SEQ ID NO: 845607 - RNA, 19 nt, Homo sapiens
caaaacagagugcugaguu

SEQ ID NO: 845608 - RNA, 19 nt, Homo sapiens
gggaagagagcaggaugga

SEQ ID NO: 845609 - RNA, 19 nt, Homo sapiens
cgaacagcccucuucuuca

SEQ ID NO: 845610 - RNA, 19 nt, Homo sapiens
gagagcaggauggagaaug

SEQ ID NO: 845611 - RNA, 19 nt, Homo sapiens
ggacucggcccuguuuguc

SEQ ID NO: 845612 - RNA, 19 nt, Homo sapiens
ucagguagacaaaagauaa

SEQ ID NO: 845613 - RNA, 19 nt, Homo sapiens
gacccugguguguguguuu

SEQ ID NO: 845614 - RNA, 19 nt, Homo sapiens
cugcgagcaugugcacuaa

SEQ ID NO: 845615 - RNA, 19 nt, Homo sapiens
gacccuggaccuuguagau

SEQ ID NO: 845616 - RNA, 19 nt, Homo sapiens
cauagcuauuaacaacuga

SEQ ID NO: 845617 - RNA, 19 nt, Homo sapiens
ccacguacgggcugaagca

SEQ ID NO: 845618 - RNA, 19 nt, Homo sapiens
ccgugaagaaggccaauga

SEQ ID NO: 845619 - RNA, 19 nt, Homo sapiens
gauauugucaaaacaguga

SEQ ID NO: 845620 - RNA, 19 nt, Homo sapiens
gacgaacagcccucuucuu

SEQ ID NO: 845621 - RNA, 19 nt, Homo sapiens
gguugacugccgguuauuu

SEQ ID NO: 845622 - RNA, 19 nt, Homo sapiens
ccagcaagaugccaauccu

SEQ ID NO: 845623 - RNA, 19 nt, Homo sapiens
ggacccugguguguguguu

SEQ ID NO: 845624 - RNA, 19 nt, Homo sapiens
ccuccuuccucaauagcaa

SEQ ID NO: 845625 - RNA, 19 nt, Homo sapiens
ugucacagcaggaauaggu

SEQ ID NO: 845626 - RNA, 19 nt, Homo sapiens
gacccuugauucagaccau

SEQ ID NO: 845627 - RNA, 19 nt, Homo sapiens
acucggcccuguuugucaa

SEQ ID NO: 845628 - RNA, 19 nt, Homo sapiens
cucaauacccucaguacug

SEQ ID NO: 845629 - RNA, 19 nt, Homo sapiens
gggacucggcccuguuugu

SEQ ID NO: 845630 - RNA, 19 nt, Homo sapiens
ggcccuguuugucaagaau

SEQ ID NO: 845631 - RNA, 19 nt, Homo sapiens
cagccaggacccuugauuc

SEQ ID NO: 845632 - RNA, 19 nt, Homo sapiens
ggacauaucuuggaacuuc

SEQ ID NO: 845633 - RNA, 19 nt, Homo sapiens
gaaaggacauaucuuggaa

SEQ ID NO: 845634 - RNA, 19 nt, Homo sapiens
gagcuaagcccaaggugua

SEQ ID NO: 845635 - RNA, 19 nt, Homo sapiens
aagcagagcugguucaaga

SEQ ID NO: 845636 - RNA, 19 nt, Homo sapiens
gaagaggagaaauaugaua

SEQ ID NO: 845637 - RNA, 19 nt, Homo sapiens
gagaugagauugugauggu

SEQ ID NO: 845638 - RNA, 19 nt, Homo sapiens
cacaaaccaucccaacaua

SEQ ID NO: 845639 - RNA, 19 nt, Homo sapiens
gaggaaaggacauaucuug

SEQ ID NO: 845640 - RNA, 19 nt, Homo sapiens
acagaugccuugcacguuu

SEQ ID NO: 845641 - RNA, 19 nt, Homo sapiens
ggaaaggacauaucuugga

SEQ ID NO: 845642 - RNA, 19 nt, Homo sapiens
cuaccgacaugaucagaaa

SEQ ID NO: 845643 - RNA, 19 nt, Homo sapiens
cagaugccuugcacguuua

SEQ ID NO: 845644 - RNA, 19 nt, Homo sapiens
gaagaucccgucaguugug

SEQ ID NO: 845645 - RNA, 19 nt, Homo sapiens
ccaaagcacccuccggaaa

SEQ ID NO: 845646 - RNA, 19 nt, Homo sapiens
uggaagaggagaaauauga

SEQ ID NO: 845647 - RNA, 19 nt, Homo sapiens
gaagaggaaaggacauauc

SEQ ID NO: 845648 - RNA, 19 nt, Homo sapiens
ccacaaaccaucccaacau

SEQ ID NO: 845649 - RNA, 19 nt, Homo sapiens
guggauguguucacgaaga

SEQ ID NO: 845650 - RNA, 19 nt, Homo sapiens
cagcugagauucgaaagca

SEQ ID NO: 845651 - RNA, 19 nt, Homo sapiens
gcaauccgcggucuuugga

SEQ ID NO: 845652 - RNA, 19 nt, Homo sapiens
gcccaagguguacaucaua

SEQ ID NO: 845653 - RNA, 19 nt, Homo sapiens
caaaccaucccaacauaca

SEQ ID NO: 845654 - RNA, 19 nt, Homo sapiens
agaccuggaugcucuggaa

SEQ ID NO: 845655 - RNA, 19 nt, Homo sapiens
ucgaggcccugaacaacaa

SEQ ID NO: 845656 - RNA, 19 nt, Homo sapiens
caucaaagacagcccacaa

SEQ ID NO: 845657 - RNA, 19 nt, Homo sapiens
ggaagaucccgucaguugu

SEQ ID NO: 845658 - RNA, 19 nt, Homo sapiens
ggaagaggagaaauaugau

SEQ ID NO: 845659 - RNA, 19 nt, Homo sapiens
gaaaagcaaggaaaacgaa

SEQ ID NO: 845660 - RNA, 19 nt, Homo sapiens
gaaggaaaagcaaggaaaa

SEQ ID NO: 845661 - RNA, 19 nt, Homo sapiens
aaagacagcccacaaacca

SEQ ID NO: 845662 - RNA, 19 nt, Homo sapiens
ggaccccggugaaacagua

SEQ ID NO: 845663 - RNA, 19 nt, Homo sapiens
aaacgaacccugaaaucca

SEQ ID NO: 845664 - RNA, 19 nt, Homo sapiens
caaagcacccuccggaaac

SEQ ID NO: 845665 - RNA, 19 nt, Homo sapiens
gcccuaauacuguguguca

SEQ ID NO: 845666 - RNA, 19 nt, Homo sapiens
aacgaacccugaaauccaa

SEQ ID NO: 845667 - RNA, 19 nt, Homo sapiens
gcagagcugguucaagaag

SEQ ID NO: 845668 - RNA, 19 nt, Homo sapiens
gaaaacgaacccugaaauc

SEQ ID NO: 845669 - RNA, 19 nt, Homo sapiens
aauacugugugucaccaaa

SEQ ID NO: 845670 - RNA, 19 nt, Homo sapiens
ggaaaacgaacccugaaau

SEQ ID NO: 845671 - RNA, 19 nt, Homo sapiens
ugagcaauccgcggucuuu

SEQ ID NO: 845672 - RNA, 19 nt, Homo sapiens
gaaacaguagguggagaug

SEQ ID NO: 845673 - RNA, 19 nt, Homo sapiens
caaaggagaaaugagcaau

SEQ ID NO: 845674 - RNA, 19 nt, Homo sapiens
uggucaagcuggagaaucu

SEQ ID NO: 845675 - RNA, 19 nt, Homo sapiens
agagcugguucaagaagga

SEQ ID NO: 845676 - RNA, 19 nt, Homo sapiens
gaucagaaaggcucaugcu

SEQ ID NO: 845677 - RNA, 19 nt, Homo sapiens
ggcagaagcagagcugguu

SEQ ID NO: 845678 - RNA, 19 nt, Homo sapiens
uggaugcucuggaacacau

SEQ ID NO: 845679 - RNA, 19 nt, Homo sapiens
aacaguagguggagaugag

SEQ ID NO: 845680 - RNA, 19 nt, Homo sapiens
caguugugccuucguggua

SEQ ID NO: 845681 - RNA, 19 nt, Homo sapiens
gaaagcaccaugaaaagag

SEQ ID NO: 845682 - RNA, 19 nt, Homo sapiens
ugguggauguguucacgaa

SEQ ID NO: 845683 - RNA, 19 nt, Homo sapiens
auacaucgccuaccgacau

SEQ ID NO: 845684 - RNA, 19 nt, Homo sapiens
ccaaaggagaaaugagcaa

SEQ ID NO: 845685 - RNA, 19 nt, Homo sapiens
ucaaagacagcccacaaac

SEQ ID NO: 845686 - RNA, 19 nt, Homo sapiens
ugaaacaguagguggagau

SEQ ID NO: 845687 - RNA, 19 nt, Homo sapiens
gggagaagauggggagaug

SEQ ID NO: 845688 - RNA, 19 nt, Homo sapiens
gagcaauccgcggucuuug

SEQ ID NO: 845689 - RNA, 19 nt, Homo sapiens
aaggacauaucuuggaacu

SEQ ID NO: 845690 - RNA, 19 nt, Homo sapiens
acgaagaggaaaggacaua

SEQ ID NO: 845691 - RNA, 19 nt, Homo sapiens
cuuuggaagaggagaaaua

SEQ ID NO: 845692 - RNA, 19 nt, Homo sapiens
gaaagggagugccuaucua

SEQ ID NO: 845693 - RNA, 19 nt, Homo sapiens
uaggaaagcugccuuauuc

SEQ ID NO: 845694 - RNA, 19 nt, Homo sapiens
acaaugaccuuauuuccua

SEQ ID NO: 845695 - RNA, 19 nt, Homo sapiens
gcaguaaaguauguuguuu

SEQ ID NO: 845696 - RNA, 19 nt, Homo sapiens
gaagaaaauucggauguua

SEQ ID NO: 845697 - RNA, 19 nt, Homo sapiens
gagugaacuugaauuauga

SEQ ID NO: 845698 - RNA, 19 nt, Homo sapiens
gagugccuaucuauauuua

SEQ ID NO: 845699 - RNA, 19 nt, Homo sapiens
gagacacuauuaccaaaga

SEQ ID NO: 845700 - RNA, 19 nt, Homo sapiens
agagugaacuugaauuaug

SEQ ID NO: 845701 - RNA, 19 nt, Homo sapiens
aaagaaggcacuugaaauu

SEQ ID NO: 845702 - RNA, 19 nt, Homo sapiens
ggaagaaugugacccuuac

SEQ ID NO: 845703 - RNA, 19 nt, Homo sapiens
ugagaacaaugaccuuauu

SEQ ID NO: 845704 - RNA, 19 nt, Homo sapiens
gggagugccuaucuauauu

SEQ ID NO: 845705 - RNA, 19 nt, Homo sapiens
ggaugcacaugaagaaaug

SEQ ID NO: 845706 - RNA, 19 nt, Homo sapiens
gaaggaugcacaugaagaa

SEQ ID NO: 845707 - RNA, 19 nt, Homo sapiens
ggagcaggcuguggaagaa

SEQ ID NO: 845708 - RNA, 19 nt, Homo sapiens
gaaggcacuugaaauuaca

SEQ ID NO: 845709 - RNA, 19 nt, Homo sapiens
ucagagugaacuugaauua

SEQ ID NO: 845710 - RNA, 19 nt, Homo sapiens
ccucagauaccaagagaua

SEQ ID NO: 845711 - RNA, 19 nt, Homo sapiens
cuagaaugcuugcuggauu

SEQ ID NO: 845712 - RNA, 19 nt, Homo sapiens
gcccuaguguggaugauuu

SEQ ID NO: 845713 - RNA, 19 nt, Homo sapiens
acagauggcugacauugug

SEQ ID NO: 845714 - RNA, 19 nt, Homo sapiens
caagagacacuauuaccaa

SEQ ID NO: 845715 - RNA, 19 nt, Homo sapiens
gaugaaaucagcccuagug

SEQ ID NO: 845716 - RNA, 19 nt, Homo sapiens
ggaguuuaaucgagagaug

SEQ ID NO: 845717 - RNA, 19 nt, Homo sapiens
ccagauugacaccuauuua

SEQ ID NO: 845718 - RNA, 19 nt, Homo sapiens
ccacgacucugaccauagu

SEQ ID NO: 845719 - RNA, 19 nt, Homo sapiens
aaauggagcuagaaugcuu

SEQ ID NO: 845720 - RNA, 19 nt, Homo sapiens
uaaagaaggcacuugaaau

SEQ ID NO: 845721 - RNA, 19 nt, Homo sapiens
gcacagauggcugacauug

SEQ ID NO: 845722 - RNA, 19 nt, Homo sapiens
ggagugccuaucuauauuu

SEQ ID NO: 845723 - RNA, 19 nt, Homo sapiens
uggaucccuuuacuuauua

SEQ ID NO: 845724 - RNA, 19 nt, Homo sapiens
gagaacaaugaccuuauuu

SEQ ID NO: 845725 - RNA, 19 nt, Homo sapiens
ggucagaggacgaucaaga

SEQ ID NO: 845726 - RNA, 19 nt, Homo sapiens
acucuggccucuugaauga

SEQ ID NO: 845727 - RNA, 19 nt, Homo sapiens
gcagaugccucagauacca

SEQ ID NO: 845728 - RNA, 19 nt, Homo sapiens
gaccuuauuuccuacaaca

SEQ ID NO: 845729 - RNA, 19 nt, Homo sapiens
gaaagcugccuuauucucu

SEQ ID NO: 845730 - RNA, 19 nt, Homo sapiens
agaaggcacuugaaauuac

SEQ ID NO: 845731 - RNA, 19 nt, Homo sapiens
ugaccaagaauguggauuu

SEQ ID NO: 845732 - RNA, 19 nt, Homo sapiens
uagaaugcuugcuggauug

SEQ ID NO: 845733 - RNA, 19 nt, Homo sapiens
cugcgaaacuuguaucugu

SEQ ID NO: 845734 - RNA, 19 nt, Homo sapiens
aaugcuaacuugccaguga

SEQ ID NO: 845735 - RNA, 19 nt, Homo sapiens
aagaaggcacuugaaauua

SEQ ID NO: 845736 - RNA, 19 nt, Homo sapiens
uggcugacauuguggauau

SEQ ID NO: 845737 - RNA, 19 nt, Homo sapiens
caaccacaaucaugaggau

SEQ ID NO: 845738 - RNA, 19 nt, Homo sapiens
ugaaugauacugaggagaa

SEQ ID NO: 845739 - RNA, 19 nt, Homo sapiens
ggagaccaccgaggaguuu

SEQ ID NO: 845740 - RNA, 19 nt, Homo sapiens
uuggaucccuuuacuuauu

SEQ ID NO: 845741 - RNA, 19 nt, Homo sapiens
uuaaagaaggcacuugaaa

SEQ ID NO: 845742 - RNA, 19 nt, Homo sapiens
gaacaaugaccuuauuucc

SEQ ID NO: 845743 - RNA, 19 nt, Homo sapiens
aagagacacuauuaccaaa

SEQ ID NO: 845744 - RNA, 19 nt, Homo sapiens
ucuggccucuugaaugaua

SEQ ID NO: 845745 - RNA, 19 nt, Homo sapiens
gcaagagacacuauuacca

SEQ ID NO: 845746 - RNA, 19 nt, Homo sapiens
gcucauuuguacucucuuc

SEQ ID NO: 845747 - RNA, 19 nt, Homo sapiens
ggauguuaguggcagagaa

SEQ ID NO: 845748 - RNA, 19 nt, Homo sapiens
uaacuugccagugauuaaa

SEQ ID NO: 845749 - RNA, 19 nt, Homo sapiens
uuagcaagagacacuauua

SEQ ID NO: 845750 - RNA, 19 nt, Homo sapiens
gaaucaaggagcucacuca

SEQ ID NO: 845751 - RNA, 19 nt, Homo sapiens
aaucaggacuuguauuggu

SEQ ID NO: 845752 - RNA, 19 nt, Homo sapiens
ccagcaaucaggacuugua

SEQ ID NO: 845753 - RNA, 19 nt, Homo sapiens
cagauugacaccuauuuau

SEQ ID NO: 845754 - RNA, 19 nt, Homo sapiens
ggaaagcugccuuauucuc

SEQ ID NO: 845755 - RNA, 19 nt, Homo sapiens
aguuggaucccuuuacuua

SEQ ID NO: 845756 - RNA, 19 nt, Homo sapiens
gauaccaagagauaacaaa

SEQ ID NO: 845757 - RNA, 19 nt, Homo sapiens
uccaaagccugccugaaga

SEQ ID NO: 845758 - RNA, 19 nt, Homo sapiens
ccaagaauguggauuuugu

SEQ ID NO: 845759 - RNA, 19 nt, Homo sapiens
uggcucagcucauggaagu

SEQ ID NO: 845760 - RNA, 19 nt, Homo sapiens
ucugauaccugcuuuuaaa

SEQ ID NO: 845761 - RNA, 19 nt, Homo sapiens
caucaaggcauuuauugca

SEQ ID NO: 845762 - RNA, 19 nt, Homo sapiens
aaagcugccuuauucucuu

SEQ ID NO: 845763 - RNA, 19 nt, Homo sapiens
cuaggaaagcugccuuauu

SEQ ID NO: 845764 - RNA, 19 nt, Homo sapiens
aaugcuugcuggauugaaa

SEQ ID NO: 845765 - RNA, 19 nt, Homo sapiens
ggaucccuuuacuuauuaa

SEQ ID NO: 845766 - RNA, 19 nt, Homo sapiens
gaggagaacaacucugaca

SEQ ID NO: 845767 - RNA, 19 nt, Homo sapiens
gaauguggauuuugugaag

SEQ ID NO: 845768 - RNA, 19 nt, Homo sapiens
gccagcagaugccucagau

SEQ ID NO: 845769 - RNA, 19 nt, Homo sapiens
gauguuaguggcagagaau

SEQ ID NO: 845770 - RNA, 19 nt, Homo sapiens
ggagaacaacucugacaac

SEQ ID NO: 845771 - RNA, 19 nt, Homo sapiens
gauaccugcuuuuaaaaug

SEQ ID NO: 845772 - RNA, 19 nt, Homo sapiens
aaucaauucugcgaaacuu

SEQ ID NO: 845773 - RNA, 19 nt, Homo sapiens
gaucaagagcucauaaucc

SEQ ID NO: 845774 - RNA, 19 nt, Homo sapiens
ggacgaucaagagcucaua

SEQ ID NO: 845775 - RNA, 19 nt, Homo sapiens
uggaagaaugugacccuua

SEQ ID NO: 845776 - RNA, 19 nt, Homo sapiens
ugaaggaugcacaugaaga

SEQ ID NO: 845777 - RNA, 19 nt, Homo sapiens
cuaacuugccagugauuaa

SEQ ID NO: 845778 - RNA, 19 nt, Homo sapiens
gcuaacuugccagugauua

SEQ ID NO: 845779 - RNA, 19 nt, Homo sapiens
aagcugccuuauucucuuu

SEQ ID NO: 845780 - RNA, 19 nt, Homo sapiens
ugaaagggagugccuaucu

SEQ ID NO: 845781 - RNA, 19 nt, Homo sapiens
gcaugaauagaaucaagga

SEQ ID NO: 845782 - RNA, 19 nt, Homo sapiens
cacaggaaacccagaaguu

SEQ ID NO: 845783 - RNA, 19 nt, Homo sapiens
gaccaagaauguggauuuu

SEQ ID NO: 845784 - RNA, 19 nt, Homo sapiens
aaagggagugccuaucuau

SEQ ID NO: 845785 - RNA, 19 nt, Homo sapiens
aaucagcccuaguguggau

SEQ ID NO: 845786 - RNA, 19 nt, Homo sapiens
ccaaagccugccugaagaa

SEQ ID NO: 845787 - RNA, 19 nt, Homo sapiens
gaaugauacugaggagaac

SEQ ID NO: 845788 - RNA, 19 nt, Homo sapiens
gccaucaaggcauuuauug

SEQ ID NO: 845789 - RNA, 19 nt, Homo sapiens
cagcagaugccucagauac

SEQ ID NO: 845790 - RNA, 19 nt, Homo sapiens
aggcauuuauugcagugua

SEQ ID NO: 845791 - RNA, 19 nt, Homo sapiens
gacgaucaagagcucauaa

SEQ ID NO: 845792 - RNA, 19 nt, Homo sapiens
gaaagggagugccuaucua

SEQ ID NO: 845793 - RNA, 19 nt, Homo sapiens
uaggaaagcugccuuauuc

SEQ ID NO: 845794 - RNA, 19 nt, Homo sapiens
acaaugaccuuauuuccua

SEQ ID NO: 845795 - RNA, 19 nt, Homo sapiens
gcaguaaaguauguuguuu

SEQ ID NO: 845796 - RNA, 19 nt, Homo sapiens
gaagaaaauucggauguua

SEQ ID NO: 845797 - RNA, 19 nt, Homo sapiens
gagugaacuugaauuauga

SEQ ID NO: 845798 - RNA, 19 nt, Homo sapiens
gagugccuaucuauauuua

SEQ ID NO: 845799 - RNA, 19 nt, Homo sapiens
gagacacuauuaccaaaga

SEQ ID NO: 845800 - RNA, 19 nt, Homo sapiens
agagugaacuugaauuaug

SEQ ID NO: 845801 - RNA, 19 nt, Homo sapiens
aaagaaggcacuugaaauu

SEQ ID NO: 845802 - RNA, 19 nt, Homo sapiens
ggaagaaugugacccuuac

SEQ ID NO: 845803 - RNA, 19 nt, Homo sapiens
ugagaacaaugaccuuauu

SEQ ID NO: 845804 - RNA, 19 nt, Homo sapiens
gggagugccuaucuauauu

SEQ ID NO: 845805 - RNA, 19 nt, Homo sapiens
ggaugcacaugaagaaaug

SEQ ID NO: 845806 - RNA, 19 nt, Homo sapiens
gaaggaugcacaugaagaa

SEQ ID NO: 845807 - RNA, 19 nt, Homo sapiens
ggagcaggcuguggaagaa

SEQ ID NO: 845808 - RNA, 19 nt, Homo sapiens
gaaggcacuugaaauuaca

SEQ ID NO: 845809 - RNA, 19 nt, Homo sapiens
ucagagugaacuugaauua

SEQ ID NO: 845810 - RNA, 19 nt, Homo sapiens
ccucagauaccaagagaua

SEQ ID NO: 845811 - RNA, 19 nt, Homo sapiens
cuagaaugcuugcuggauu

SEQ ID NO: 845812 - RNA, 19 nt, Homo sapiens
gcccuaguguggaugauuu

SEQ ID NO: 845813 - RNA, 19 nt, Homo sapiens
caagagacacuauuaccaa

SEQ ID NO: 845814 - RNA, 19 nt, Homo sapiens
gaugaaaucagcccuagug

SEQ ID NO: 845815 - RNA, 19 nt, Homo sapiens
ccagauugacaccuauuua

SEQ ID NO: 845816 - RNA, 19 nt, Homo sapiens
ccacgacucugaccauagu

SEQ ID NO: 845817 - RNA, 19 nt, Homo sapiens
aaauggagcuagaaugcuu

SEQ ID NO: 845818 - RNA, 19 nt, Homo sapiens
uaaagaaggcacuugaaau

SEQ ID NO: 845819 - RNA, 19 nt, Homo sapiens
ggagugccuaucuauauuu

SEQ ID NO: 845820 - RNA, 19 nt, Homo sapiens
uggaucccuuuacuuauua

SEQ ID NO: 845821 - RNA, 19 nt, Homo sapiens
gagaacaaugaccuuauuu

SEQ ID NO: 845822 - RNA, 19 nt, Homo sapiens
uggaugacauuguggauau

SEQ ID NO: 845823 - RNA, 19 nt, Homo sapiens
ggucagaggacgaucaaga

SEQ ID NO: 845824 - RNA, 19 nt, Homo sapiens
acucuggccucuugaauga

SEQ ID NO: 845825 - RNA, 19 nt, Homo sapiens
gcagaugccucagauacca

SEQ ID NO: 845826 - RNA, 19 nt, Homo sapiens
gaccuuauuuccuacaaca

SEQ ID NO: 845827 - RNA, 19 nt, Homo sapiens
gaaagcugccuuauucucu

SEQ ID NO: 845828 - RNA, 19 nt, Homo sapiens
agaaggcacuugaaauuac

SEQ ID NO: 845829 - RNA, 19 nt, Homo sapiens
ugaccaagaauguggauuu

SEQ ID NO: 845830 - RNA, 19 nt, Homo sapiens
uagaaugcuugcuggauug

SEQ ID NO: 845831 - RNA, 19 nt, Homo sapiens
cugcgaaacuuguaucugu

SEQ ID NO: 845832 - RNA, 19 nt, Homo sapiens
aaugcuaacuugccaguga

SEQ ID NO: 845833 - RNA, 19 nt, Homo sapiens
aagaaggcacuugaaauua

SEQ ID NO: 845834 - RNA, 19 nt, Homo sapiens
caaccacaaucaugaggau

SEQ ID NO: 845835 - RNA, 19 nt, Homo sapiens
ugaaugauacugaggagaa

SEQ ID NO: 845836 - RNA, 19 nt, Homo sapiens
cugagagggugaaauagaa

SEQ ID NO: 845837 - RNA, 19 nt, Homo sapiens
uuggaucccuuuacuuauu

SEQ ID NO: 845838 - RNA, 19 nt, Homo sapiens
uuaaagaaggcacuugaaa

SEQ ID NO: 845839 - RNA, 19 nt, Homo sapiens
gaacaaugaccuuauuucc

SEQ ID NO: 845840 - RNA, 19 nt, Homo sapiens
aagagacacuauuaccaaa

SEQ ID NO: 845841 - RNA, 19 nt, Homo sapiens
ucuggccucuugaaugaua

SEQ ID NO: 845842 - RNA, 19 nt, Homo sapiens
gcaagagacacuauuacca

SEQ ID NO: 845843 - RNA, 19 nt, Homo sapiens
gcucauuuguacucucuuc

SEQ ID NO: 845844 - RNA, 19 nt, Homo sapiens
ggauguuaguggcagagaa

SEQ ID NO: 845845 - RNA, 19 nt, Homo sapiens
uaacuugccagugauuaaa

SEQ ID NO: 845846 - RNA, 19 nt, Homo sapiens
uuagcaagagacacuauua

SEQ ID NO: 845847 - RNA, 19 nt, Homo sapiens
gaaucaaggagcucacuca

SEQ ID NO: 845848 - RNA, 19 nt, Homo sapiens
ggaugacauuguggauauu

SEQ ID NO: 845849 - RNA, 19 nt, Homo sapiens
aaucaggacuuguauuggu

SEQ ID NO: 845850 - RNA, 19 nt, Homo sapiens
ccagcaaucaggacuugua

SEQ ID NO: 845851 - RNA, 19 nt, Homo sapiens
cagauugacaccuauuuau

SEQ ID NO: 845852 - RNA, 19 nt, Homo sapiens
ggaaagcugccuuauucuc

SEQ ID NO: 845853 - RNA, 19 nt, Homo sapiens
aguuggaucccuuuacuua

SEQ ID NO: 845854 - RNA, 19 nt, Homo sapiens
gaugacauuguggauauuu

SEQ ID NO: 845855 - RNA, 19 nt, Homo sapiens
uggcacagcuggaugacau

SEQ ID NO: 845856 - RNA, 19 nt, Homo sapiens
gauaccaagagauaacaaa

SEQ ID NO: 845857 - RNA, 19 nt, Homo sapiens
cgacauucgggaaguguuu

SEQ ID NO: 845858 - RNA, 19 nt, Homo sapiens
uccaaagccugccugaaga

SEQ ID NO: 845859 - RNA, 19 nt, Homo sapiens
ccaagaauguggauuuugu

SEQ ID NO: 845860 - RNA, 19 nt, Homo sapiens
uggcucagcucauggaagu

SEQ ID NO: 845861 - RNA, 19 nt, Homo sapiens
ucugauaccugcuuuuaaa

SEQ ID NO: 845862 - RNA, 19 nt, Homo sapiens
caucaaggcauuuauugca

SEQ ID NO: 845863 - RNA, 19 nt, Homo sapiens
aaagcugccuuauucucuu

SEQ ID NO: 845864 - RNA, 19 nt, Homo sapiens
cuaggaaagcugccuuauu

SEQ ID NO: 845865 - RNA, 19 nt, Homo sapiens
aaugcuugcuggauugaaa

SEQ ID NO: 845866 - RNA, 19 nt, Homo sapiens
ggaucccuuuacuuauuaa

SEQ ID NO: 845867 - RNA, 19 nt, Homo sapiens
gaggagaacaacucugaca

SEQ ID NO: 845868 - RNA, 19 nt, Homo sapiens
gaauguggauuuugugaag

SEQ ID NO: 845869 - RNA, 19 nt, Homo sapiens
gccagcagaugccucagau

SEQ ID NO: 845870 - RNA, 19 nt, Homo sapiens
gagagggugaaauagaauu

SEQ ID NO: 845871 - RNA, 19 nt, Homo sapiens
gauguuaguggcagagaau

SEQ ID NO: 845872 - RNA, 19 nt, Homo sapiens
ggagaacaacucugacaac

SEQ ID NO: 845873 - RNA, 19 nt, Homo sapiens
gauaccugcuuuuaaaaug

SEQ ID NO: 845874 - RNA, 19 nt, Homo sapiens
aaucaauucugcgaaacuu

SEQ ID NO: 845875 - RNA, 19 nt, Homo sapiens
gaucaagagcucauaaucc

SEQ ID NO: 845876 - RNA, 19 nt, Homo sapiens
ggacgaucaagagcucaua

SEQ ID NO: 845877 - RNA, 19 nt, Homo sapiens
uggaagaaugugacccuua

SEQ ID NO: 845878 - RNA, 19 nt, Homo sapiens
ugaaggaugcacaugaaga

SEQ ID NO: 845879 - RNA, 19 nt, Homo sapiens
cuaacuugccagugauuaa

SEQ ID NO: 845880 - RNA, 19 nt, Homo sapiens
gcuaacuugccagugauua

SEQ ID NO: 845881 - RNA, 19 nt, Homo sapiens
aagcugccuuauucucuuu

SEQ ID NO: 845882 - RNA, 19 nt, Homo sapiens
ugaaagggagugccuaucu

SEQ ID NO: 845883 - RNA, 19 nt, Homo sapiens
cacaggaaacccagaaguu

SEQ ID NO: 845884 - RNA, 19 nt, Homo sapiens
gcaugaauagaaucaagga

SEQ ID NO: 845885 - RNA, 19 nt, Homo sapiens
gaccaagaauguggauuuu

SEQ ID NO: 845886 - RNA, 19 nt, Homo sapiens
aaagggagugccuaucuau

SEQ ID NO: 845887 - RNA, 19 nt, Homo sapiens
gccaucaaggcauuuauug

SEQ ID NO: 845888 - RNA, 19 nt, Homo sapiens
gaauucuaaccucgacauu

SEQ ID NO: 845889 - RNA, 19 nt, Homo sapiens
aaucagcccuaguguggau

SEQ ID NO: 845890 - RNA, 19 nt, Homo sapiens
gcacagcuggaugacauug

SEQ ID NO: 845891 - RNA, 19 nt, Homo sapiens
ccaaagccugccugaagaa

SEQ ID NO: 845892 - RNA, 19 nt, Homo sapiens
ggaaauaucuugccaggau

SEQ ID NO: 845893 - RNA, 19 nt, Homo sapiens
ggaaacguauucuuugauc

SEQ ID NO: 845894 - RNA, 19 nt, Homo sapiens
ccaagcagaugacaacaca

SEQ ID NO: 845895 - RNA, 19 nt, Homo sapiens
gaaauuaagagugaacuuc

SEQ ID NO: 845896 - RNA, 19 nt, Homo sapiens
gaaagccuggccuacauuu

SEQ ID NO: 845897 - RNA, 19 nt, Homo sapiens
ucacagggaccaagacaaa

SEQ ID NO: 845898 - RNA, 19 nt, Homo sapiens
aaggucacguuuacuauuu

SEQ ID NO: 845899 - RNA, 19 nt, Homo sapiens
ccugauuccugcuuucuuu

SEQ ID NO: 845900 - RNA, 19 nt, Homo sapiens
gcugggaaacguauucuuu

SEQ ID NO: 845901 - RNA, 19 nt, Homo sapiens
cagaaagccuggccuacau

SEQ ID NO: 845902 - RNA, 19 nt, Homo sapiens
ccaagagcauccuaaacga

SEQ ID NO: 845903 - RNA, 19 nt, Homo sapiens
ccaaggaaagauugaauga

SEQ ID NO: 845904 - RNA, 19 nt, Homo sapiens
gauuaugagcuuacagaaa

SEQ ID NO: 845905 - RNA, 19 nt, Homo sapiens
gcagcuggaucagaggaaa

SEQ ID NO: 845906 - RNA, 19 nt, Homo sapiens
gaaacguauucuuugaucu

SEQ ID NO: 845907 - RNA, 19 nt, Homo sapiens
gcaugaacccuggaccuuu

SEQ ID NO: 845908 - RNA, 19 nt, Homo sapiens
caucccagcuuugaaacuu

SEQ ID NO: 845909 - RNA, 19 nt, Homo sapiens
ugggaaacguauucuuuga

SEQ ID NO: 845910 - RNA, 19 nt, Homo sapiens
cagaagaccuggcuuuuca

SEQ ID NO: 845911 - RNA, 19 nt, Homo sapiens
auuaugagcuuacagaaag

SEQ ID NO: 845912 - RNA, 19 nt, Homo sapiens
cguauucuuugaucuguug

SEQ ID NO: 845913 - RNA, 19 nt, Homo sapiens
uaaggucacguuuacuauu

SEQ ID NO: 845914 - RNA, 19 nt, Homo sapiens
ccuggaagcuuggcugaga

SEQ ID NO: 845915 - RNA, 19 nt, Homo sapiens
uuaauaaaccucucuaugc

SEQ ID NO: 845916 - RNA, 19 nt, Homo sapiens
ccacugcuguugaaaugag

SEQ ID NO: 845917 - RNA, 19 nt, Homo sapiens
cuuugaaacuuggaacuuu

SEQ ID NO: 845918 - RNA, 19 nt, Homo sapiens
ucuaaggucacguuuacua

SEQ ID NO: 845919 - RNA, 19 nt, Homo sapiens
cuucuaaggucacguuuac

SEQ ID NO: 845920 - RNA, 19 nt, Homo sapiens
gcaugggacacauucaaga

SEQ ID NO: 845921 - RNA, 19 nt, Homo sapiens
ggagccacaucgcaacuac

SEQ ID NO: 845922 - RNA, 19 nt, Homo sapiens
ugcagugccugucauguga

SEQ ID NO: 845923 - RNA, 19 nt, Homo sapiens
ggucacguuuacuauuuca

SEQ ID NO: 845924 - RNA, 19 nt, Homo sapiens
cagauuaugagcuuacaga

SEQ ID NO: 845925 - RNA, 19 nt, Homo sapiens
uaacuucuaaggucacguu

SEQ ID NO: 845926 - RNA, 19 nt, Homo sapiens
ucuacaaucccguggagua

SEQ ID NO: 845927 - RNA, 19 nt, Homo sapiens
ucuuugaucuguugaacug

SEQ ID NO: 845928 - RNA, 19 nt, Homo sapiens
ugccacugcuguugaaaug

SEQ ID NO: 845929 - RNA, 19 nt, Homo sapiens
gaacagcuucuugggaucu

SEQ ID NO: 845930 - RNA, 19 nt, Homo sapiens
caugaacccuggaccuuuu

SEQ ID NO: 845931 - RNA, 19 nt, Homo sapiens
aaucuaugcccucugcuuu

SEQ ID NO: 845932 - RNA, 19 nt, Homo sapiens
ucaagaccucgaagucauu

SEQ ID NO: 845933 - RNA, 19 nt, Homo sapiens
ugacacuacuccuguuugc

SEQ ID NO: 845934 - RNA, 19 nt, Homo sapiens
ucacguuuacuauuucaga

SEQ ID NO: 845935 - RNA, 19 nt, Homo sapiens
aaacguauucuuugaucug

SEQ ID NO: 845936 - RNA, 19 nt, Homo sapiens
gggaaacguauucuuugau

SEQ ID NO: 845937 - RNA, 19 nt, Homo sapiens
ggaggcaguggccaaggaa

SEQ ID NO: 845938 - RNA, 19 nt, Homo sapiens
cuguugaacugucuuccaa

SEQ ID NO: 845939 - RNA, 19 nt, Homo sapiens
ggagugcccacagucagaa

SEQ ID NO: 845940 - RNA, 19 nt, Homo sapiens
ccagcagauuaugagcuua

SEQ ID NO: 845941 - RNA, 19 nt, Homo sapiens
gccaaggaaagauugaaug

SEQ ID NO: 845942 - RNA, 19 nt, Homo sapiens
uuggauuucuuccucauca

SEQ ID NO: 845943 - RNA, 19 nt, Homo sapiens
ggaggcugcagcuggauca

SEQ ID NO: 845944 - RNA, 19 nt, Homo sapiens
ggccuacauuuuacucuuu

SEQ ID NO: 845945 - RNA, 19 nt, Homo sapiens
cuaaggucacguuuacuau

SEQ ID NO: 845946 - RNA, 19 nt, Homo sapiens
gaggucuucuuccaucacu

SEQ ID NO: 845947 - RNA, 19 nt, Homo sapiens
guggacagccugaggucuu

SEQ ID NO: 845948 - RNA, 19 nt, Homo sapiens
agucagaagaccuggcuuu

SEQ ID NO: 845949 - RNA, 19 nt, Homo sapiens
ccuguuugcccuccugauu

SEQ ID NO: 845950 - RNA, 19 nt, Homo sapiens
ggucuucuuccaucacugu

SEQ ID NO: 845951 - RNA, 19 nt, Homo sapiens
acagaaagccuggccuaca

SEQ ID NO: 845952 - RNA, 19 nt, Homo sapiens
ggacugguugggcauugug

SEQ ID NO: 845953 - RNA, 19 nt, Homo sapiens
cuacaaucccguggaguau

SEQ ID NO: 845954 - RNA, 19 nt, Homo sapiens
agaaagccuggccuacauu

SEQ ID NO: 845955 - RNA, 19 nt, Homo sapiens
gaccucgaagucauucuug

SEQ ID NO: 845956 - RNA, 19 nt, Homo sapiens
ggccaaggaaagauugaau

SEQ ID NO: 845957 - RNA, 19 nt, Homo sapiens
ggcaguggccaaggaaaga

SEQ ID NO: 845958 - RNA, 19 nt, Homo sapiens
guacucuuccugggcauga

SEQ ID NO: 845959 - RNA, 19 nt, Homo sapiens
accagcagauuaugagcuu

SEQ ID NO: 845960 - RNA, 19 nt, Homo sapiens
acaaucccguggaguaugc

SEQ ID NO: 845961 - RNA, 19 nt, Homo sapiens
caaucuaugcccucugcuu

SEQ ID NO: 845962 - RNA, 19 nt, Homo sapiens
aagccuggccuacauuuua

SEQ ID NO: 845963 - RNA, 19 nt, Homo sapiens
gcacugagaugcagcucuu

SEQ ID NO: 845964 - RNA, 19 nt, Homo sapiens
gagcugacccucucuguga

SEQ ID NO: 845965 - RNA, 19 nt, Homo sapiens
gaaccuaccucugccaagu

SEQ ID NO: 845966 - RNA, 19 nt, Homo sapiens
gagcugaccugcaccuaca

SEQ ID NO: 845967 - RNA, 19 nt, Homo sapiens
gcagcaugguucaagauga

SEQ ID NO: 845968 - RNA, 19 nt, Homo sapiens
caacaacccaccagauuuc

SEQ ID NO: 845969 - RNA, 19 nt, Homo sapiens
caacugguucuaagucaaa

SEQ ID NO: 845970 - RNA, 19 nt, Homo sapiens
ccagauuucuacaccaaug

SEQ ID NO: 845971 - RNA, 19 nt, Homo sapiens
ucaacaacccaccagauuu

SEQ ID NO: 845972 - RNA, 19 nt, Homo sapiens
caccagauuucuacaccaa

SEQ ID NO: 845973 - RNA, 19 nt, Homo sapiens
uaaagucuguggguaccaa

SEQ ID NO: 845974 - RNA, 19 nt, Homo sapiens
ucucugagcacacuuguau

SEQ ID NO: 845975 - RNA, 19 nt, Homo sapiens
gucaacaacccaccagauu

SEQ ID NO: 845976 - RNA, 19 nt, Homo sapiens
cagcaugguucaagaugag

SEQ ID NO: 845977 - RNA, 19 nt, Homo sapiens
gaagaagcccaaggagaca

SEQ ID NO: 845978 - RNA, 19 nt, Homo sapiens
ccaacugguucuaagucaa

SEQ ID NO: 845979 - RNA, 19 nt, Homo sapiens
gcccuggaguggagcuuug

SEQ ID NO: 845980 - RNA, 19 nt, Homo sapiens
cauccaauccuguacuuca

SEQ ID NO: 845981 - RNA, 19 nt, Homo sapiens
gggugcgucuuggaacuuu

SEQ ID NO: 845982 - RNA, 19 nt, Homo sapiens
ucugagcacacuuguauga

SEQ ID NO: 845983 - RNA, 19 nt, Homo sapiens
gggaaacccaucucugagu

SEQ ID NO: 845984 - RNA, 19 nt, Homo sapiens
gggucagccugcuucagaa

SEQ ID NO: 845985 - RNA, 19 nt, Homo sapiens
ggccaucuguauccaacug

SEQ ID NO: 845986 - RNA, 19 nt, Homo sapiens
guaugagggcugauucuag

SEQ ID NO: 845987 - RNA, 19 nt, Homo sapiens
gggcuaaucaaccuuacug

SEQ ID NO: 845988 - RNA, 19 nt, Homo sapiens
guauccaacugguucuaag

SEQ ID NO: 845989 - RNA, 19 nt, Homo sapiens
caacccaccagauuucuac

SEQ ID NO: 845990 - RNA, 19 nt, Homo sapiens
ccucagauacuggaaccua

SEQ ID NO: 845991 - RNA, 19 nt, Homo sapiens
ucaccaauggccaucugua

SEQ ID NO: 845992 - RNA, 19 nt, Homo sapiens
aguccaagcucccuauggu

SEQ ID NO: 845993 - RNA, 19 nt, Homo sapiens
caacugggugcgucuugga

SEQ ID NO: 845994 - RNA, 19 nt, Homo sapiens
caccaauggccaucuguau

SEQ ID NO: 845995 - RNA, 19 nt, Homo sapiens
gcaccgugacgaccaccaa

SEQ ID NO: 845996 - RNA, 19 nt, Homo sapiens
cgggucagccugcuucaga

SEQ ID NO: 845997 - RNA, 19 nt, Homo sapiens
ccaaguccaagcucccuau

SEQ ID NO: 845998 - RNA, 19 nt, Homo sapiens
agaagcccaaggagacaua

SEQ ID NO: 845999 - RNA, 19 nt, Homo sapiens
ugacgaccaccaaguccaa

SEQ ID NO: 846000 - RNA, 19 nt, Homo sapiens
gcucuacugcacugagaug

SEQ ID NO: 846001 - RNA, 19 nt, Homo sapiens
ccacacugaaacugacuga

SEQ ID NO: 846002 - RNA, 19 nt, Homo sapiens
gaacagaccauggaaauuu

SEQ ID NO: 846003 - RNA, 19 nt, Homo sapiens
gaucaagacucuccucaaa

SEQ ID NO: 846004 - RNA, 19 nt, Homo sapiens
aaagugcucugaagauuua

SEQ ID NO: 846005 - RNA, 19 nt, Homo sapiens
ugaguagcaugcuuuauua

SEQ ID NO: 846006 - RNA, 19 nt, Homo sapiens
acaauuagccuucggaaua

SEQ ID NO: 846007 - RNA, 19 nt, Homo sapiens
gacaagaguuaacugagua

SEQ ID NO: 846008 - RNA, 19 nt, Homo sapiens
gagaacaccuaaacaacaa

SEQ ID NO: 846009 - RNA, 19 nt, Homo sapiens
gagguuauguugcuaaaga

SEQ ID NO: 846010 - RNA, 19 nt, Homo sapiens
gcaucuauguggauucuuu

SEQ ID NO: 846011 - RNA, 19 nt, Homo sapiens
ucaagacucuccucaaaga

SEQ ID NO: 846012 - RNA, 19 nt, Homo sapiens
gaaagugcucugaagauuu

SEQ ID NO: 846013 - RNA, 19 nt, Homo sapiens
uaaacuggguuccauguug

SEQ ID NO: 846014 - RNA, 19 nt, Homo sapiens
ucaaacaggugcucgcauu

SEQ ID NO: 846015 - RNA, 19 nt, Homo sapiens
gcagugaacacaucugauu

SEQ ID NO: 846016 - RNA, 19 nt, Homo sapiens
uaucauagaugcagcuguu

SEQ ID NO: 846017 - RNA, 19 nt, Homo sapiens
gggcuggacugaccugaaa

SEQ ID NO: 846018 - RNA, 19 nt, Homo sapiens
ugaaagugcucugaagauu

SEQ ID NO: 846019 - RNA, 19 nt, Homo sapiens
ccacaaggacuaaguauca

SEQ ID NO: 846020 - RNA, 19 nt, Homo sapiens
caacuagaaugacaaacau

SEQ ID NO: 846021 - RNA, 19 nt, Homo sapiens
caaauguggucucuucugu

SEQ ID NO: 846022 - RNA, 19 nt, Homo sapiens
ccagaaugccuucaucuuu

SEQ ID NO: 846023 - RNA, 19 nt, Homo sapiens
gaacucuuguugucucuuc

SEQ ID NO: 846024 - RNA, 19 nt, Homo sapiens
caauuagccuucggaauau

SEQ ID NO: 846025 - RNA, 19 nt, Homo sapiens
gguaugcacuugauuaacu

SEQ ID NO: 846026 - RNA, 19 nt, Homo sapiens
gaucucugauugcaucuau

SEQ ID NO: 846027 - RNA, 19 nt, Homo sapiens
gcugguggauuaucauaga

SEQ ID NO: 846028 - RNA, 19 nt, Homo sapiens
uuuacaggcugguggauua

SEQ ID NO: 846029 - RNA, 19 nt, Homo sapiens
agaugcagcuguuauuuau

SEQ ID NO: 846030 - RNA, 19 nt, Homo sapiens
aacagaccauggaaauuua

SEQ ID NO: 846031 - RNA, 19 nt, Homo sapiens
gaagacuuauggcagugaa

SEQ ID NO: 846032 - RNA, 19 nt, Homo sapiens
ggaccacaguuugaaaugu

SEQ ID NO: 846033 - RNA, 19 nt, Homo sapiens
uggccgcacugaagacuua

SEQ ID NO: 846034 - RNA, 19 nt, Homo sapiens
uaacugaguagcaugcuuu

SEQ ID NO: 846035 - RNA, 19 nt, Homo sapiens
caacugagcacaaccucuu

SEQ ID NO: 846036 - RNA, 19 nt, Homo sapiens
ugacaaacauuagcuacug

SEQ ID NO: 846037 - RNA, 19 nt, Homo sapiens
cugaaccacuagccuaaua

SEQ ID NO: 846038 - RNA, 19 nt, Homo sapiens
uagaugcagcuguuauuua

SEQ ID NO: 846039 - RNA, 19 nt, Homo sapiens
ccagcacggucaacuagaa

SEQ ID NO: 846040 - RNA, 19 nt, Homo sapiens
aaccauagccuuccuaaug

SEQ ID NO: 846041 - RNA, 19 nt, Homo sapiens
aauauuugcugggugauuu

SEQ ID NO: 846042 - RNA, 19 nt, Homo sapiens
caaugaaagugcucugaag

SEQ ID NO: 846043 - RNA, 19 nt, Homo sapiens
cauaguauacccuggaauu

SEQ ID NO: 846044 - RNA, 19 nt, Homo sapiens
gaccacaguuugaaauguc

SEQ ID NO: 846045 - RNA, 19 nt, Homo sapiens
agacaagaguuaacugagu

SEQ ID NO: 846046 - RNA, 19 nt, Homo sapiens
gggaacagaccauggaaau

SEQ ID NO: 846047 - RNA, 19 nt, Homo sapiens
cagaaugccuucaucuuuu

SEQ ID NO: 846048 - RNA, 19 nt, Homo sapiens
gaggugauaguuacaguga

SEQ ID NO: 846049 - RNA, 19 nt, Homo sapiens
guagacaagaguuaacuga

SEQ ID NO: 846050 - RNA, 19 nt, Homo sapiens
uaucugcuuugcugaugua

SEQ ID NO: 846051 - RNA, 19 nt, Homo sapiens
ggagaagaucuuagagguu

SEQ ID NO: 846052 - RNA, 19 nt, Homo sapiens
gaauauugccuggugauca

SEQ ID NO: 846053 - RNA, 19 nt, Homo sapiens
uaauguaacuggcuuuuga

SEQ ID NO: 846054 - RNA, 19 nt, Homo sapiens
ggugauaguuacagugaag

SEQ ID NO: 846055 - RNA, 19 nt, Homo sapiens
gcacggucaacuagaauga

SEQ ID NO: 846056 - RNA, 19 nt, Homo sapiens
gaaccacuagccuaauaga

SEQ ID NO: 846057 - RNA, 19 nt, Homo sapiens
cuuuguaguuguucugaua

SEQ ID NO: 846058 - RNA, 19 nt, Homo sapiens
acuugacacuccagucuua

SEQ ID NO: 846059 - RNA, 19 nt, Homo sapiens
gacauaguauacccuggaa

SEQ ID NO: 846060 - RNA, 19 nt, Homo sapiens
ggaacagaccauggaaauu

SEQ ID NO: 846061 - RNA, 19 nt, Homo sapiens
ggagggaacagaccaugga

SEQ ID NO: 846062 - RNA, 19 nt, Homo sapiens
ccaugccugugguguuaua

SEQ ID NO: 846063 - RNA, 19 nt, Homo sapiens
aauauugccuggugaucaa

SEQ ID NO: 846064 - RNA, 19 nt, Homo sapiens
ugucauaucugagguccaa

SEQ ID NO: 846065 - RNA, 19 nt, Homo sapiens
cgagaacaccuaaacaaca

SEQ ID NO: 846066 - RNA, 19 nt, Homo sapiens
accauagccuuccuaauga

SEQ ID NO: 846067 - RNA, 19 nt, Homo sapiens
gcaaccauagccuuccuaa

SEQ ID NO: 846068 - RNA, 19 nt, Homo sapiens
cauguugcauuucaucugu

SEQ ID NO: 846069 - RNA, 19 nt, Homo sapiens
guaugcacuugauuaacuu

SEQ ID NO: 846070 - RNA, 19 nt, Homo sapiens
gccuuuggaucucugauug

SEQ ID NO: 846071 - RNA, 19 nt, Homo sapiens
cugaguagcaugcuuuauu

SEQ ID NO: 846072 - RNA, 19 nt, Homo sapiens
agaauaugcucagggaaug

SEQ ID NO: 846073 - RNA, 19 nt, Homo sapiens
caccuucucuuuucacaua

SEQ ID NO: 846074 - RNA, 19 nt, Homo sapiens
ucucuucugugucaaaugu

SEQ ID NO: 846075 - RNA, 19 nt, Homo sapiens
caaacaggugcucgcauuu

SEQ ID NO: 846076 - RNA, 19 nt, Homo sapiens
gggaaaagcgcaauacuau

SEQ ID NO: 846077 - RNA, 19 nt, Homo sapiens
gaaugccagccaccuugua

SEQ ID NO: 846078 - RNA, 19 nt, Homo sapiens
cauuucaucuguguacuga

SEQ ID NO: 846079 - RNA, 19 nt, Homo sapiens
uggguuccauguugcauuu

SEQ ID NO: 846080 - RNA, 19 nt, Homo sapiens
cagaauaugcucagggaau

SEQ ID NO: 846081 - RNA, 19 nt, Homo sapiens
gcugggugauuuaaaugug

SEQ ID NO: 846082 - RNA, 19 nt, Homo sapiens
auucaaauguggucucuuc

SEQ ID NO: 846083 - RNA, 19 nt, Homo sapiens
ggauuugucaauguaagua

SEQ ID NO: 846084 - RNA, 19 nt, Homo sapiens
gaguagcaugcuuuauuaa

SEQ ID NO: 846085 - RNA, 19 nt, Homo sapiens
ucaacuagaaugacaaaca

SEQ ID NO: 846086 - RNA, 19 nt, Homo sapiens
cauagaugcagcuguuauu

SEQ ID NO: 846087 - RNA, 19 nt, Homo sapiens
cauugcugcugguguacua

SEQ ID NO: 846088 - RNA, 19 nt, Homo sapiens
gaauauuugcugggugauu

SEQ ID NO: 846089 - RNA, 19 nt, Homo sapiens
ucuucugugucaaauguua

SEQ ID NO: 846090 - RNA, 19 nt, Homo sapiens
aauguggucucuucugugu

SEQ ID NO: 846091 - RNA, 19 nt, Homo sapiens
cuagagggcuugagaugcu

SEQ ID NO: 846092 - RNA, 19 nt, Homo sapiens
gauugcaucuauguggauu

SEQ ID NO: 846093 - RNA, 19 nt, Homo sapiens
ucacauaggagggaacaga

SEQ ID NO: 846094 - RNA, 19 nt, Homo sapiens
gaagaucuuagagguugaa

SEQ ID NO: 846095 - RNA, 19 nt, Homo sapiens
agacucuccucaaagaaau

SEQ ID NO: 846096 - RNA, 19 nt, Homo sapiens
gcucugaagauuuaaugug

SEQ ID NO: 846097 - RNA, 19 nt, Homo sapiens
ugugguaugcacuugauua

SEQ ID NO: 846098 - RNA, 19 nt, Homo sapiens
cuacugggaacucuuguug

SEQ ID NO: 846099 - RNA, 19 nt, Homo sapiens
caaaauucuuccucacuau

SEQ ID NO: 846100 - RNA, 19 nt, Homo sapiens
uguggucucuucuguguca

SEQ ID NO: 846101 - RNA, 19 nt, Homo sapiens
gugguaugcacuugauuaa

SEQ ID NO: 846102 - RNA, 19 nt, Homo sapiens
gauggaaacuucugacaua

SEQ ID NO: 846103 - RNA, 19 nt, Homo sapiens
cagaagaucuugaggauaa

SEQ ID NO: 846104 - RNA, 19 nt, Homo sapiens
gcaaagccuuggcauguua

SEQ ID NO: 846105 - RNA, 19 nt, Homo sapiens
gaagagagcaggauuugua

SEQ ID NO: 846106 - RNA, 19 nt, Homo sapiens
ggauaauacugaacuguaa

SEQ ID NO: 846107 - RNA, 19 nt, Homo sapiens
gcacagaaguguauauugg

SEQ ID NO: 846108 - RNA, 19 nt, Homo sapiens
gaugaagccuuggauuaua

SEQ ID NO: 846109 - RNA, 19 nt, Homo sapiens
agacauggguauagaguua

SEQ ID NO: 846110 - RNA, 19 nt, Homo sapiens
caacagagcucauaguacu

SEQ ID NO: 846111 - RNA, 19 nt, Homo sapiens
ugaaagaugcucuggauua

SEQ ID NO: 846112 - RNA, 19 nt, Homo sapiens
caaccgauaucauuucuga

SEQ ID NO: 846113 - RNA, 19 nt, Homo sapiens
gcagaaauguccaaaugau

SEQ ID NO: 846114 - RNA, 19 nt, Homo sapiens
caucagagauagucaagaa

SEQ ID NO: 846115 - RNA, 19 nt, Homo sapiens
gaaacuugcuuuggagaaa

SEQ ID NO: 846116 - RNA, 19 nt, Homo sapiens
ggaaacaaguaucugaguu

SEQ ID NO: 846117 - RNA, 19 nt, Homo sapiens
aaacaacacccguacaaua

SEQ ID NO: 846118 - RNA, 19 nt, Homo sapiens
cagcagaaauguccaaaug

SEQ ID NO: 846119 - RNA, 19 nt, Homo sapiens
gcaaucuugucauccuuua

SEQ ID NO: 846120 - RNA, 19 nt, Homo sapiens
gcaaagaccucgaaaacuu

SEQ ID NO: 846121 - RNA, 19 nt, Homo sapiens
ucaggaaugugaagaaauu

SEQ ID NO: 846122 - RNA, 19 nt, Homo sapiens
ccacaacacuaguaaacaa

SEQ ID NO: 846123 - RNA, 19 nt, Homo sapiens
cuacagauuugcucuacua

SEQ ID NO: 846124 - RNA, 19 nt, Homo sapiens
caacacccguacaauauga

SEQ ID NO: 846125 - RNA, 19 nt, Homo sapiens
cgaaucagaucccagugua

SEQ ID NO: 846126 - RNA, 19 nt, Homo sapiens
gaagcaguauuuagggaaa

SEQ ID NO: 846127 - RNA, 19 nt, Homo sapiens
gauaucagguccucaaucu

SEQ ID NO: 846128 - RNA, 19 nt, Homo sapiens
caagaagaguaccacuuaa

SEQ ID NO: 846129 - RNA, 19 nt, Homo sapiens
cacaguaguugcuugauaa

SEQ ID NO: 846130 - RNA, 19 nt, Homo sapiens
guacaagacauuugagauu

SEQ ID NO: 846131 - RNA, 19 nt, Homo sapiens
gauggcaggugcagagaaa

SEQ ID NO: 846132 - RNA, 19 nt, Homo sapiens
cagagaacaugagaacaua

SEQ ID NO: 846133 - RNA, 19 nt, Homo sapiens
aaacaaacauaguggguau

SEQ ID NO: 846134 - RNA, 19 nt, Homo sapiens
acaagaagaguaccacuua

SEQ ID NO: 846135 - RNA, 19 nt, Homo sapiens
gaaagaugcucuggauuac

SEQ ID NO: 846136 - RNA, 19 nt, Homo sapiens
ccaagaagauccagaaugc

SEQ ID NO: 846137 - RNA, 19 nt, Homo sapiens
gagcuuaguuugcgguuuc

SEQ ID NO: 846138 - RNA, 19 nt, Homo sapiens
aggaagaggugcaguauau

SEQ ID NO: 846139 - RNA, 19 nt, Homo sapiens
cagaugaagccuuggauua

SEQ ID NO: 846140 - RNA, 19 nt, Homo sapiens
gcaaagcacaaaugaguga

SEQ ID NO: 846141 - RNA, 19 nt, Homo sapiens
caaagagaaucugcaaaga

SEQ ID NO: 846142 - RNA, 19 nt, Homo sapiens
gcaaagagaaucugcaaag

SEQ ID NO: 846143 - RNA, 19 nt, Homo sapiens
acacaguaguugcuugaua

SEQ ID NO: 846144 - RNA, 19 nt, Homo sapiens
ccagaaugccagaaucuua

SEQ ID NO: 846145 - RNA, 19 nt, Homo sapiens
gaugauauuugaugaaugc

SEQ ID NO: 846146 - RNA, 19 nt, Homo sapiens
ggaaugccuucucagauca

SEQ ID NO: 846147 - RNA, 19 nt, Homo sapiens
cggauuagcgacaaauuua

SEQ ID NO: 846148 - RNA, 19 nt, Homo sapiens
uggagcaaguuguuuauaa

SEQ ID NO: 846149 - RNA, 19 nt, Homo sapiens
gcagagaaauugguggaau

SEQ ID NO: 846150 - RNA, 19 nt, Homo sapiens
gagaagauaccauuugauc

SEQ ID NO: 846151 - RNA, 19 nt, Homo sapiens
gggaaaagauucugcauau

SEQ ID NO: 846152 - RNA, 19 nt, Homo sapiens
acagaaauaugaacaaugg

SEQ ID NO: 846153 - RNA, 19 nt, Homo sapiens
gaacacagaaauaugaaca

SEQ ID NO: 846154 - RNA, 19 nt, Homo sapiens
ugaaagacauggguauaga

SEQ ID NO: 846155 - RNA, 19 nt, Homo sapiens
gaagaggugcaguauauuc

SEQ ID NO: 846156 - RNA, 19 nt, Homo sapiens
ucaacgggaugagguguua

SEQ ID NO: 846157 - RNA, 19 nt, Homo sapiens
ugacuguccuuucuacuug

SEQ ID NO: 846158 - RNA, 19 nt, Homo sapiens
gggcuucucucucuucuag

SEQ ID NO: 846159 - RNA, 19 nt, Homo sapiens
caacaaacacacaguaauc

SEQ ID NO: 846160 - RNA, 19 nt, Homo sapiens
uaguaaugcugguguaauu

SEQ ID NO: 846161 - RNA, 19 nt, Homo sapiens
ggagaucacaauauucuga

SEQ ID NO: 846162 - RNA, 19 nt, Homo sapiens
caguggagaucacaauauu

SEQ ID NO: 846163 - RNA, 19 nt, Homo sapiens
ggagcaaguuguuuauaag

SEQ ID NO: 846164 - RNA, 19 nt, Homo sapiens
ugaucugucugaauguuua

SEQ ID NO: 846165 - RNA, 19 nt, Homo sapiens
gaaacaaguaucugaguuc

SEQ ID NO: 846166 - RNA, 19 nt, Homo sapiens
gaauccaugugaaguacaa

SEQ ID NO: 846167 - RNA, 19 nt, Homo sapiens
caucuugcccuauuaauau

SEQ ID NO: 846168 - RNA, 19 nt, Homo sapiens
gagaacaugagaacauaaa

SEQ ID NO: 846169 - RNA, 19 nt, Homo sapiens
guugagcacucuucuugaa

SEQ ID NO: 846170 - RNA, 19 nt, Homo sapiens
ugggauagaugaaugaaug

SEQ ID NO: 846171 - RNA, 19 nt, Homo sapiens
agagucaacugccaacaaa

SEQ ID NO: 846172 - RNA, 19 nt, Homo sapiens
gaagauaccauuugaucca

SEQ ID NO: 846173 - RNA, 19 nt, Homo sapiens
caaagcaguuuucaaguuu

SEQ ID NO: 846174 - RNA, 19 nt, Homo sapiens
ggacgaagcaguauuuagg

SEQ ID NO: 846175 - RNA, 19 nt, Homo sapiens
guauagaguuacaggcauu

SEQ ID NO: 846176 - RNA, 19 nt, Homo sapiens
gaauucauguccaccuuca

SEQ ID NO: 846177 - RNA, 19 nt, Homo sapiens
ggaaggacuuucauuuuga

SEQ ID NO: 846178 - RNA, 19 nt, Homo sapiens
gcaaugagaauccuaaacu

SEQ ID NO: 846179 - RNA, 19 nt, Homo sapiens
uccaaggguucaauauaua

SEQ ID NO: 846180 - RNA, 19 nt, Homo sapiens
caaugagaauccuaaacuu

SEQ ID NO: 846181 - RNA, 19 nt, Homo sapiens
acucagagauuugaagaaa

SEQ ID NO: 846182 - RNA, 19 nt, Homo sapiens
ucgaugagauugagcaaga

SEQ ID NO: 846183 - RNA, 19 nt, Homo sapiens
guaaacaacacccguacaa

SEQ ID NO: 846184 - RNA, 19 nt, Homo sapiens
gccagaaucuuagugagaa

SEQ ID NO: 846185 - RNA, 19 nt, Homo sapiens
ggaaacuucugacauacag

SEQ ID NO: 846186 - RNA, 19 nt, Homo sapiens
gagcaacagcugagaaugu

SEQ ID NO: 846187 - RNA, 19 nt, Homo sapiens
gagcuugcuuugccugcua

SEQ ID NO: 846188 - RNA, 19 nt, Homo sapiens
gagaauucauguccaccuu

SEQ ID NO: 846189 - RNA, 19 nt, Homo sapiens
cauuugagauuccaguuau

SEQ ID NO: 846190 - RNA, 19 nt, Homo sapiens
acaauaauaugugcuccua

SEQ ID NO: 846191 - RNA, 19 nt, Homo sapiens
aaaaguacaugacacagua

SEQ ID NO: 846192 - RNA, 19 nt, Homo sapiens
ggcauucacgugucacuua

SEQ ID NO: 846193 - RNA, 19 nt, Homo sapiens
cuauacaucuugcccuauu

SEQ ID NO: 846194 - RNA, 19 nt, Homo sapiens
gguuauauguacucauguu

SEQ ID NO: 846195 - RNA, 19 nt, Homo sapiens
cauaguggguauaaucaug

SEQ ID NO: 846196 - RNA, 19 nt, Homo sapiens
ggaaaagauucugcauaua

SEQ ID NO: 846197 - RNA, 19 nt, Homo sapiens
gagcacuuguggacgcuuu

SEQ ID NO: 846198 - RNA, 19 nt, Homo sapiens
ccaucacuauccaucuuua

SEQ ID NO: 846199 - RNA, 19 nt, Homo sapiens
ccaauuagagcuugcuuug

SEQ ID NO: 846200 - RNA, 19 nt, Homo sapiens
gcuguccacuguagaguug

SEQ ID NO: 846201 - RNA, 19 nt, Homo sapiens
gccaacagagcucauagua

SEQ ID NO: 846202 - RNA, 19 nt, Homo sapiens
caagaaaucugcacugugu

SEQ ID NO: 846203 - RNA, 19 nt, Homo sapiens
caacucauuugaccuuuaa

SEQ ID NO: 846204 - RNA, 19 nt, Homo sapiens
cuacuccgauccucauaua

SEQ ID NO: 846205 - RNA, 19 nt, Homo sapiens
gugcugggcuugcuacaug

SEQ ID NO: 846206 - RNA, 19 nt, Homo sapiens
ucuaugagccagaugcuua

SEQ ID NO: 846207 - RNA, 19 nt, Homo sapiens
ucaacaaucggcugguuua

SEQ ID NO: 846208 - RNA, 19 nt, Homo sapiens
ccagccacaucuucuauga

SEQ ID NO: 846209 - RNA, 19 nt, Homo sapiens
ggaagaguuucgugaaggu

SEQ ID NO: 846210 - RNA, 19 nt, Homo sapiens
gaugacgaccuggauauuu

SEQ ID NO: 846211 - RNA, 19 nt, Homo sapiens
gagagagaagccagagaua

SEQ ID NO: 846212 - RNA, 19 nt, Homo sapiens
ggacgcaaguuggagaugu

SEQ ID NO: 846213 - RNA, 19 nt, Homo sapiens
gaggaagaguuucgugaag

SEQ ID NO: 846214 - RNA, 19 nt, Homo sapiens
acaacucauuugaccuuua

SEQ ID NO: 846215 - RNA, 19 nt, Homo sapiens
caccauugcucucgauuca

SEQ ID NO: 846216 - RNA, 19 nt, Homo sapiens
ccacaacucauuugaccuu

SEQ ID NO: 846217 - RNA, 19 nt, Homo sapiens
gacgcaaguuggagauguu

SEQ ID NO: 846218 - RNA, 19 nt, Homo sapiens
ggaccaagaagacccagau

SEQ ID NO: 846219 - RNA, 19 nt, Homo sapiens
gguuuaccaugacuucuuc

SEQ ID NO: 846220 - RNA, 19 nt, Homo sapiens
gauccugcccuuccaguuc

SEQ ID NO: 846221 - RNA, 19 nt, Homo sapiens
gaagugagcgaggaagagu

SEQ ID NO: 846222 - RNA, 19 nt, Homo sapiens
augaugaccuggaccaaga

SEQ ID NO: 846223 - RNA, 19 nt, Homo sapiens
gucaagaaaucugcacugu

SEQ ID NO: 846224 - RNA, 19 nt, Homo sapiens
uaucaacaaucggcugguu

SEQ ID NO: 846225 - RNA, 19 nt, Homo sapiens
gagagaagccagagauagc

SEQ ID NO: 846226 - RNA, 19 nt, Homo sapiens
augacgaccuggauauuug

SEQ ID NO: 846227 - RNA, 19 nt, Homo sapiens
gcaaguuggagauguugga

SEQ ID NO: 846228 - RNA, 19 nt, Homo sapiens
cgaggaagaguuucgugaa

SEQ ID NO: 846229 - RNA, 19 nt, Homo sapiens
gaucccacaacucauuuga

SEQ ID NO: 846230 - RNA, 19 nt, Homo sapiens
gauguuggacucgcuguug

SEQ ID NO: 846231 - RNA, 19 nt, Homo sapiens
ugagccagaugcuuaugau

SEQ ID NO: 846232 - RNA, 19 nt, Homo sapiens
cagaugacgaccuggauau

SEQ ID NO: 846233 - RNA, 19 nt, Homo sapiens
ugacucugauaucaacaau

SEQ ID NO: 846234 - RNA, 19 nt, Homo sapiens
ggaccggacgcaaguugga

SEQ ID NO: 846235 - RNA, 19 nt, Homo sapiens
ccauugcucucgauucacu

SEQ ID NO: 846236 - RNA, 19 nt, Homo sapiens
ccaagaagacccagaugac

SEQ ID NO: 846237 - RNA, 19 nt, Homo sapiens
acucugauaucaacaaucg

SEQ ID NO: 846238 - RNA, 19 nt, Homo sapiens
gaagaguuucgugaagguu

SEQ ID NO: 846239 - RNA, 19 nt, Homo sapiens
gccagaugcuuaugaugac

SEQ ID NO: 846240 - RNA, 19 nt, Homo sapiens
gcgcccaacugaccagacu

SEQ ID NO: 846241 - RNA, 19 nt, Homo sapiens
agccagaugcuuaugauga

SEQ ID NO: 846242 - RNA, 19 nt, Homo sapiens
ucauuugaccuuuaaccuu

SEQ ID NO: 846243 - RNA, 19 nt, Homo sapiens
agagagagaagccagagau

SEQ ID NO: 846244 - RNA, 19 nt, Homo sapiens
ugacgaccuggauauuuga

SEQ ID NO: 846245 - RNA, 19 nt, Homo sapiens
agccagagauagccugauc

SEQ ID NO: 846246 - RNA, 19 nt, Homo sapiens
ugagagccaugugcaagag

SEQ ID NO: 846247 - RNA, 19 nt, Homo sapiens
gugaagguuuugacucuga

SEQ ID NO: 846248 - RNA, 19 nt, Homo sapiens
cuaccagccacaucuucua

SEQ ID NO: 846249 - RNA, 19 nt, Homo sapiens
cacaacucauuugaccuuu

SEQ ID NO: 846250 - RNA, 19 nt, Homo sapiens
agugagcgaggaagaguuu

SEQ ID NO: 846251 - RNA, 19 nt, Homo sapiens
accaugacuucuucagaga

SEQ ID NO: 846252 - RNA, 19 nt, Homo sapiens
ggaguggaaugaauuaauu

SEQ ID NO: 846253 - RNA, 19 nt, Homo sapiens
ggaaugaucauguacauau

SEQ ID NO: 846254 - RNA, 19 nt, Homo sapiens
gagaagaacuauggaucua

SEQ ID NO: 846255 - RNA, 19 nt, Homo sapiens
caacacuucuggaucuuaa

SEQ ID NO: 846256 - RNA, 19 nt, Homo sapiens
ucacagagcugcacacagu

SEQ ID NO: 846257 - RNA, 19 nt, Homo sapiens
gauauuugccugaagauaa

SEQ ID NO: 846258 - RNA, 19 nt, Homo sapiens
uaacaacacuucuggaucu

SEQ ID NO: 846259 - RNA, 19 nt, Homo sapiens
gaagaacuauggaucuaca

SEQ ID NO: 846260 - RNA, 19 nt, Homo sapiens
aaucagagguuugguagua

SEQ ID NO: 846261 - RNA, 19 nt, Homo sapiens
gaauucaagucauccaaga

SEQ ID NO: 846262 - RNA, 19 nt, Homo sapiens
gaaggagaaguaauuguuu

SEQ ID NO: 846263 - RNA, 19 nt, Homo sapiens
uaacaccaguuucuucaga

SEQ ID NO: 846264 - RNA, 19 nt, Homo sapiens
caagaggcaauaccaauaa

SEQ ID NO: 846265 - RNA, 19 nt, Homo sapiens
aaauagaggcuucguguuu

SEQ ID NO: 846266 - RNA, 19 nt, Homo sapiens
gaucuuaaggcuucauaaa

SEQ ID NO: 846267 - RNA, 19 nt, Homo sapiens
caagaguaaucaagucaga

SEQ ID NO: 846268 - RNA, 19 nt, Homo sapiens
ccaagaggauggaaugauc

SEQ ID NO: 846269 - RNA, 19 nt, Homo sapiens
ucacagaguggcaucauuu

SEQ ID NO: 846270 - RNA, 19 nt, Homo sapiens
gcagucauuugcuuuaaag

SEQ ID NO: 846271 - RNA, 19 nt, Homo sapiens
ggaggcagguaucgagaug

SEQ ID NO: 846272 - RNA, 19 nt, Homo sapiens
gcaauaccaauaaguucua

SEQ ID NO: 846273 - RNA, 19 nt, Homo sapiens
guaucgagaugcuagaaug

SEQ ID NO: 846274 - RNA, 19 nt, Homo sapiens
ucaagaggcaauaccaaua

SEQ ID NO: 846275 - RNA, 19 nt, Homo sapiens
gccugaagauaaaguauug

SEQ ID NO: 846276 - RNA, 19 nt, Homo sapiens
cagaguggcaucauuugua

SEQ ID NO: 846277 - RNA, 19 nt, Homo sapiens
ucaggaagcugugcugugu

SEQ ID NO: 846278 - RNA, 19 nt, Homo sapiens
gaggauuuaccacugauaa

SEQ ID NO: 846279 - RNA, 19 nt, Homo sapiens
gccuauaacuacugguaaa

SEQ ID NO: 846280 - RNA, 19 nt, Homo sapiens
cagcaauccuguaaacauc

SEQ ID NO: 846281 - RNA, 19 nt, Homo sapiens
ugaaggagaaguaauuguu

SEQ ID NO: 846282 - RNA, 19 nt, Homo sapiens
gaaauagaggcuucguguu

SEQ ID NO: 846283 - RNA, 19 nt, Homo sapiens
cgaugaaggagaaguaauu

SEQ ID NO: 846284 - RNA, 19 nt, Homo sapiens
gaauuccuccaucaucaaa

SEQ ID NO: 846285 - RNA, 19 nt, Homo sapiens
ccaauaaguucuacaugcu

SEQ ID NO: 846286 - RNA, 19 nt, Homo sapiens
gaggcaauaccaauaaguu

SEQ ID NO: 846287 - RNA, 19 nt, Homo sapiens
gaacuauggaucuacaaca

SEQ ID NO: 846288 - RNA, 19 nt, Homo sapiens
aagaauugauugccaagga

SEQ ID NO: 846289 - RNA, 19 nt, Homo sapiens
caacauggagacuggaaga

SEQ ID NO: 846290 - RNA, 19 nt, Homo sapiens
agaguggcaucauuuguau

SEQ ID NO: 846291 - RNA, 19 nt, Homo sapiens
gagcugcacacaguaauga

SEQ ID NO: 846292 - RNA, 19 nt, Homo sapiens
gagaugcuagaaugaauga

SEQ ID NO: 846293 - RNA, 19 nt, Homo sapiens
ccaaaacacuuacuucaca

SEQ ID NO: 846294 - RNA, 19 nt, Homo sapiens
gggcauuguugguuagcaa

SEQ ID NO: 846295 - RNA, 19 nt, Homo sapiens
caagucagaggauuauaug

SEQ ID NO: 846296 - RNA, 19 nt, Homo sapiens
gugugggcauuguugguua

SEQ ID NO: 846297 - RNA, 19 nt, Homo sapiens
aauagaggcuucguguuug

SEQ ID NO: 846298 - RNA, 19 nt, Homo sapiens
gaggauggaaugaucaugu

SEQ ID NO: 846299 - RNA, 19 nt, Homo sapiens
cuacaagaguaaucaaguc

SEQ ID NO: 846300 - RNA, 19 nt, Homo sapiens
aaucauccauauaccgaaa

SEQ ID NO: 846301 - RNA, 19 nt, Homo sapiens
ggagccagccuauaacuac

SEQ ID NO: 846302 - RNA, 19 nt, Homo sapiens
aggauggaaugaucaugua

SEQ ID NO: 846303 - RNA, 19 nt, Homo sapiens
agaauugauugccaaggaa

SEQ ID NO: 846304 - RNA, 19 nt, Homo sapiens
cagaggauuauaugacuuu

SEQ ID NO: 846305 - RNA, 19 nt, Homo sapiens
gcaugugaauggccuagag

SEQ ID NO: 846306 - RNA, 19 nt, Homo sapiens
uggaggguauggauauuug

SEQ ID NO: 846307 - RNA, 19 nt, Homo sapiens
guuaaucagagguuuggua

SEQ ID NO: 846308 - RNA, 19 nt, Homo sapiens
gugcaacugucggaaauag

SEQ ID NO: 846309 - RNA, 19 nt, Homo sapiens
ggauauuugccugaagaua

SEQ ID NO: 846310 - RNA, 19 nt, Homo sapiens
ggaauuccuccaucaucaa

SEQ ID NO: 846311 - RNA, 19 nt, Homo sapiens
ucaagucagaggauuauau

SEQ ID NO: 846312 - RNA, 19 nt, Homo sapiens
gaugaaggagaaguaauug

SEQ ID NO: 846313 - RNA, 19 nt, Homo sapiens
guauggauauuugccugaa

SEQ ID NO: 846314 - RNA, 19 nt, Homo sapiens
aaagaaauguuagccaacu

SEQ ID NO: 846315 - RNA, 19 nt, Homo sapiens
uauaacuacugguaaagca

SEQ ID NO: 846316 - RNA, 19 nt, Homo sapiens
ggccagccuucgagagcua

SEQ ID NO: 846317 - RNA, 19 nt, Homo sapiens
ugccagcgaugaaggagaa

SEQ ID NO: 846318 - RNA, 19 nt, Homo sapiens
gaagcugugcugugugugu

SEQ ID NO: 846319 - RNA, 19 nt, Homo sapiens
gggaguggaaugaauuaau

SEQ ID NO: 846320 - RNA, 19 nt, Homo sapiens
gcaacugucggaaauagag

SEQ ID NO: 846321 - RNA, 19 nt, Homo sapiens
cuuggugucuggguauaua

SEQ ID NO: 846322 - RNA, 19 nt, Homo sapiens
ggaggauuuaccacugaua

SEQ ID NO: 846323 - RNA, 19 nt, Homo sapiens
ugcacacaguaaugaaaua

SEQ ID NO: 846324 - RNA, 19 nt, Homo sapiens
gaugcuagaaugaaugauc

SEQ ID NO: 846325 - RNA, 19 nt, Homo sapiens
ucagaggauuauaugacuu

SEQ ID NO: 846326 - RNA, 19 nt, Homo sapiens
cagcgaugaaggagaagua

SEQ ID NO: 846327 - RNA, 19 nt, Homo sapiens
gcccaugccugugcaacug

SEQ ID NO: 846328 - RNA, 19 nt, Homo sapiens
cagccuauaacuacuggua

SEQ ID NO: 846329 - RNA, 19 nt, Homo sapiens
ggaggacaccauucaagag

SEQ ID NO: 846330 - RNA, 19 nt, Homo sapiens
gcuacaagaguaaucaagu

SEQ ID NO: 846331 - RNA, 19 nt, Homo sapiens
ucugcgggcugacgacuug

SEQ ID NO: 846332 - RNA, 19 nt, Homo sapiens
ucgagaugcuagaaugaau

SEQ ID NO: 846333 - RNA, 19 nt, Homo sapiens
ccucaacgccgucccuuuc

SEQ ID NO: 846334 - RNA, 19 nt, Homo sapiens
gaauugauugccaaggaau

SEQ ID NO: 846335 - RNA, 19 nt, Homo sapiens
aagcugugcugugugugua

SEQ ID NO: 846336 - RNA, 19 nt, Homo sapiens
gauguuccuccuucuaugu

SEQ ID NO: 846337 - RNA, 19 nt, Homo sapiens
caaccaaaaucucuuguac

SEQ ID NO: 846338 - RNA, 19 nt, Homo sapiens
caugggaguggaaugaauu

SEQ ID NO: 846339 - RNA, 19 nt, Homo sapiens
caagaggauggaaugauca

SEQ ID NO: 846340 - RNA, 19 nt, Homo sapiens
aguggcaucauuuguauaa

SEQ ID NO: 846341 - RNA, 19 nt, Homo sapiens
gcacacaguaaugaaauac

SEQ ID NO: 846342 - RNA, 19 nt, Homo sapiens
gcugugcauuucucuccuu

SEQ ID NO: 846343 - RNA, 19 nt, Homo sapiens
gaucuuggcacucacuaac

SEQ ID NO: 846344 - RNA, 19 nt, Homo sapiens
uaaugccuaugaucaccuu

SEQ ID NO: 846345 - RNA, 19 nt, Homo sapiens
gcugcacacaguaaugaaa

SEQ ID NO: 846346 - RNA, 19 nt, Homo sapiens
acagagcugcacacaguaa

SEQ ID NO: 846347 - RNA, 19 nt, Homo sapiens
gugauguuccuccuucuau

SEQ ID NO: 846348 - RNA, 19 nt, Homo sapiens
ggugauguuccuccuucua

SEQ ID NO: 846349 - RNA, 19 nt, Homo sapiens
aggaagcugugcugugugu

SEQ ID NO: 846350 - RNA, 19 nt, Homo sapiens
gagguuugguaguaacaac

SEQ ID NO: 846351 - RNA, 19 nt, Homo sapiens
acugauaaacagccacuaa

SEQ ID NO: 846352 - RNA, 19 nt, Homo sapiens
gauggucccucucaaguau

SEQ ID NO: 846353 - RNA, 19 nt, Homo sapiens
caagggccauggcuucauu

SEQ ID NO: 846354 - RNA, 19 nt, Homo sapiens
cuacaaaggagucugcaaa

SEQ ID NO: 846355 - RNA, 19 nt, Homo sapiens
ggauggucccucucaagua

SEQ ID NO: 846356 - RNA, 19 nt, Homo sapiens
gcacagccuaugaccauug

SEQ ID NO: 846357 - RNA, 19 nt, Homo sapiens
acaaaggagucugcaaaug

SEQ ID NO: 846358 - RNA, 19 nt, Homo sapiens
caaaggagucugcaaaugc

SEQ ID NO: 846359 - RNA, 19 nt, Homo sapiens
gaagagcauuaaaagcauu

SEQ ID NO: 846360 - RNA, 19 nt, Homo sapiens
cagcagacacuggagauga

SEQ ID NO: 846361 - RNA, 19 nt, Homo sapiens
cagcacagccuaugaccau

SEQ ID NO: 846362 - RNA, 19 nt, Homo sapiens
cacuggagaugacauucuu

SEQ ID NO: 846363 - RNA, 19 nt, Homo sapiens
aaaggagucugcaaaugcu

SEQ ID NO: 846364 - RNA, 19 nt, Homo sapiens
ggaguaugucccaguggaa

SEQ ID NO: 846365 - RNA, 19 nt, Homo sapiens
gacaugucaucagcuccua

SEQ ID NO: 846366 - RNA, 19 nt, Homo sapiens
ggaggaggcagcagacacu

SEQ ID NO: 846367 - RNA, 19 nt, Homo sapiens
caccaggcaccaagcauga

SEQ ID NO: 846368 - RNA, 19 nt, Homo sapiens
uacaaaggagucugcaaau

SEQ ID NO: 846369 - RNA, 19 nt, Homo sapiens
ccaucccacccaagaauga

SEQ ID NO: 846370 - RNA, 19 nt, Homo sapiens
ccuaugaccauugcaacaa

SEQ ID NO: 846371 - RNA, 19 nt, Homo sapiens
caacagaacuuaaggaaau

SEQ ID NO: 846372 - RNA, 19 nt, Homo sapiens
gagaagacauucaagaaga

SEQ ID NO: 846373 - RNA, 19 nt, Homo sapiens
agacagagcucgacaguau

SEQ ID NO: 846374 - RNA, 19 nt, Homo sapiens
ggacuugacuugucucaga

SEQ ID NO: 846375 - RNA, 19 nt, Homo sapiens
guacugccaugaagcaaua

SEQ ID NO: 846376 - RNA, 19 nt, Homo sapiens
agaaagagaugcccucauu

SEQ ID NO: 846377 - RNA, 19 nt, Homo sapiens
gaaaugauccacacugcua

SEQ ID NO: 846378 - RNA, 19 nt, Homo sapiens
gaagaccgccagccugaua

SEQ ID NO: 846379 - RNA, 19 nt, Homo sapiens
gcaauaagagagaucagua

SEQ ID NO: 846380 - RNA, 19 nt, Homo sapiens
ggaaaucucugaguacuac

SEQ ID NO: 846381 - RNA, 19 nt, Homo sapiens
uuaaggaaaucucugagua

SEQ ID NO: 846382 - RNA, 19 nt, Homo sapiens
gguauuguuuacacuguua

SEQ ID NO: 846383 - RNA, 19 nt, Homo sapiens
cauaacaacucccgacaug

SEQ ID NO: 846384 - RNA, 19 nt, Homo sapiens
gaauacacuuuguuugcuu

SEQ ID NO: 846385 - RNA, 19 nt, Homo sapiens
gguuauaugugguauuguu

SEQ ID NO: 846386 - RNA, 19 nt, Homo sapiens
gaaaugaaugcuaugauca

SEQ ID NO: 846387 - RNA, 19 nt, Homo sapiens
gaagggacuugacuugucu

SEQ ID NO: 846388 - RNA, 19 nt, Homo sapiens
gacugugccuaaagaauuu

SEQ ID NO: 846389 - RNA, 19 nt, Homo sapiens
uaagagagaucaguaaacu

SEQ ID NO: 846390 - RNA, 19 nt, Homo sapiens
gcuggagauuuaauucuuu

SEQ ID NO: 846391 - RNA, 19 nt, Homo sapiens
gcagaagggacuugacuug

SEQ ID NO: 846392 - RNA, 19 nt, Homo sapiens
cacaagagauaaaugacaa

SEQ ID NO: 846393 - RNA, 19 nt, Homo sapiens
gcagcuaucuuaccagacu

SEQ ID NO: 846394 - RNA, 19 nt, Homo sapiens
ugacaacucuuucuguucu

SEQ ID NO: 846395 - RNA, 19 nt, Homo sapiens
ugucucagauacccuauuu

SEQ ID NO: 846396 - RNA, 19 nt, Homo sapiens
agaaauacaccgauccuuu

SEQ ID NO: 846397 - RNA, 19 nt, Homo sapiens
ugaaagauuugcacacuac

SEQ ID NO: 846398 - RNA, 19 nt, Homo sapiens
agaaaugaaugcuaugauc

SEQ ID NO: 846399 - RNA, 19 nt, Homo sapiens
uaaggccauuacacaaaua

SEQ ID NO: 846400 - RNA, 19 nt, Homo sapiens
guaaagcagucucuguucu

SEQ ID NO: 846401 - RNA, 19 nt, Homo sapiens
auacaccgauccuuucaaa

SEQ ID NO: 846402 - RNA, 19 nt, Homo sapiens
gcacgaauuggaaauacaa

SEQ ID NO: 846403 - RNA, 19 nt, Homo sapiens
ccaaguuauugaagauuug

SEQ ID NO: 846404 - RNA, 19 nt, Homo sapiens
ggaaaacacacaguuaaua

SEQ ID NO: 846405 - RNA, 19 nt, Homo sapiens
uaacaacucccgacaugug

SEQ ID NO: 846406 - RNA, 19 nt, Homo sapiens
caauaagagagaucaguaa

SEQ ID NO: 846407 - RNA, 19 nt, Homo sapiens
caguuugccuggagaugua

SEQ ID NO: 846408 - RNA, 19 nt, Homo sapiens
ccacacugcuagucugguu

SEQ ID NO: 846409 - RNA, 19 nt, Homo sapiens
ggaauacacuuuguuugcu

SEQ ID NO: 846410 - RNA, 19 nt, Homo sapiens
acaccugccuguccaaaug

SEQ ID NO: 846411 - RNA, 19 nt, Homo sapiens
uaaagcagucucuguucua

SEQ ID NO: 846412 - RNA, 19 nt, Homo sapiens
aaugacaacucuuucuguu

SEQ ID NO: 846413 - RNA, 19 nt, Homo sapiens
ugucagcaguucccagaaa

SEQ ID NO: 846414 - RNA, 19 nt, Homo sapiens
cccaaguuauugaagauuu

SEQ ID NO: 846415 - RNA, 19 nt, Homo sapiens
gagcaugcaauauucauca

SEQ ID NO: 846416 - RNA, 19 nt, Homo sapiens
gcccgagcaugcaauauuc

SEQ ID NO: 846417 - RNA, 19 nt, Homo sapiens
gcaguucccagaaaugaau

SEQ ID NO: 846418 - RNA, 19 nt, Homo sapiens
gaugauguauuggacuuca

SEQ ID NO: 846419 - RNA, 19 nt, Homo sapiens
ugcaugagaucgccuauca

SEQ ID NO: 846420 - RNA, 19 nt, Homo sapiens
agacugugccuaaagaauu

SEQ ID NO: 846421 - RNA, 19 nt, Homo sapiens
uaauaaaccaccugaaucu

SEQ ID NO: 846422 - RNA, 19 nt, Homo sapiens
aaagagaugcccucauuca

SEQ ID NO: 846423 - RNA, 19 nt, Homo sapiens
gaaagagaugcccucauuc

SEQ ID NO: 846424 - RNA, 19 nt, Homo sapiens
acacacaguuaauaagauc

SEQ ID NO: 846425 - RNA, 19 nt, Homo sapiens
gaugcaaguucucgaagag

SEQ ID NO: 846426 - RNA, 19 nt, Homo sapiens
gaaaggaaccccucauauc

SEQ ID NO: 846427 - RNA, 19 nt, Homo sapiens
agagagaucaguaaacuuc

SEQ ID NO: 846428 - RNA, 19 nt, Homo sapiens
gccuggagauguagacaga

SEQ ID NO: 846429 - RNA, 19 nt, Homo sapiens
ucccagaaaugaaugcuau

SEQ ID NO: 846430 - RNA, 19 nt, Homo sapiens
gguucacgaugacguuauu

SEQ ID NO: 846431 - RNA, 19 nt, Homo sapiens
gcaugcaauauucaucaua

SEQ ID NO: 846432 - RNA, 19 nt, Homo sapiens
guauaucacaguuucauca

SEQ ID NO: 846433 - RNA, 19 nt, Homo sapiens
uagaugauguauuggacuu

SEQ ID NO: 846434 - RNA, 19 nt, Homo sapiens
gccuuuagaccgauuauug

SEQ ID NO: 846435 - RNA, 19 nt, Homo sapiens
caacaacagaacuuaagga

SEQ ID NO: 846436 - RNA, 19 nt, Homo sapiens
agaagggacuugacuuguc

SEQ ID NO: 846437 - RNA, 19 nt, Homo sapiens
ugagaucgccuaucaguac

SEQ ID NO: 846438 - RNA, 19 nt, Homo sapiens
uguucuugcuggagauuua

SEQ ID NO: 846439 - RNA, 19 nt, Homo sapiens
gauaaaugacaacucuuuc

SEQ ID NO: 846440 - RNA, 19 nt, Homo sapiens
gaauuggaaauacaacugu

SEQ ID NO: 846441 - RNA, 19 nt, Homo sapiens
cgaugcaaguucucgaaga

SEQ ID NO: 846442 - RNA, 19 nt, Homo sapiens
uguaugaggguauuagaaa

SEQ ID NO: 846443 - RNA, 19 nt, Homo sapiens
cuguuaauauccacaugua

SEQ ID NO: 846444 - RNA, 19 nt, Homo sapiens
guaucuugaugguuauaug

SEQ ID NO: 846445 - RNA, 19 nt, Homo sapiens
acacuuuguuugcuucaug

SEQ ID NO: 846446 - RNA, 19 nt, Homo sapiens
gaggaaaacacacaguuaa

SEQ ID NO: 846447 - RNA, 19 nt, Homo sapiens
ggcccgagcaugcaauauu

SEQ ID NO: 846448 - RNA, 19 nt, Homo sapiens
guaugaggguauuagaaag

SEQ ID NO: 846449 - RNA, 19 nt, Homo sapiens
gcacacuaccuugagaaga

SEQ ID NO: 846450 - RNA, 19 nt, Homo sapiens
cuauagcucuggcacgaau

SEQ ID NO: 846451 - RNA, 19 nt, Homo sapiens
ccucauaucaacaacagaa

SEQ ID NO: 846452 - RNA, 19 nt, Homo sapiens
ccacugguccuguccuguu

SEQ ID NO: 846453 - RNA, 19 nt, Homo sapiens
guuaauauccacauguaag

SEQ ID NO: 846454 - RNA, 19 nt, Homo sapiens
uaaaugacaacucuuucug

SEQ ID NO: 846455 - RNA, 19 nt, Homo sapiens
gaagcaauaagagagauca

SEQ ID NO: 846456 - RNA, 19 nt, Homo sapiens
acagagugauggugugcaa

SEQ ID NO: 846457 - RNA, 19 nt, Homo sapiens
ccagaaaugaaugcuauga

SEQ ID NO: 846458 - RNA, 19 nt, Homo sapiens
cagcaguucccagaaauga

SEQ ID NO: 846459 - RNA, 19 nt, Homo sapiens
uuuggugcguggugaauuu

SEQ ID NO: 846460 - RNA, 19 nt, Homo sapiens
ggccauuacacaaauaaau

SEQ ID NO: 846461 - RNA, 19 nt, Homo sapiens
acacaguggugagaaauac

SEQ ID NO: 846462 - RNA, 19 nt, Homo sapiens
gaccagaugggcaaaccaa

SEQ ID NO: 846463 - RNA, 19 nt, Homo sapiens
ucucagauacccuauuuua

SEQ ID NO: 846464 - RNA, 19 nt, Homo sapiens
uuaauaaaccaccugaauc

SEQ ID NO: 846465 - RNA, 19 nt, Homo sapiens
acaacucuuucuguucuuu

SEQ ID NO: 846466 - RNA, 19 nt, Homo sapiens
gcucuggcacgaauuggaa

SEQ ID NO: 846467 - RNA, 19 nt, Homo sapiens
gcaaguucucgaagaggaa

SEQ ID NO: 846468 - RNA, 19 nt, Homo sapiens
cuagucugguucacgauga

SEQ ID NO: 846469 - RNA, 19 nt, Homo sapiens
cgccauagccuuaauugca

SEQ ID NO: 846470 - RNA, 19 nt, Homo sapiens
aauaagaucuggggugaaa

SEQ ID NO: 846471 - RNA, 19 nt, Homo sapiens
gaaugaagcagaaacgaaa

SEQ ID NO: 846472 - RNA, 19 nt, Homo sapiens
cguuugggaugguugauua

SEQ ID NO: 846473 - RNA, 19 nt, Homo sapiens
ggaaugaagcagaaacgaa

SEQ ID NO: 846474 - RNA, 19 nt, Homo sapiens
ugcacccgcuccuuuauua

SEQ ID NO: 846475 - RNA, 19 nt, Homo sapiens
caaagcaggucuccucacu

SEQ ID NO: 846476 - RNA, 19 nt, Homo sapiens
ucacucaccgggauagaua

SEQ ID NO: 846477 - RNA, 19 nt, Homo sapiens
caacagugcguuaaauaag

SEQ ID NO: 846478 - RNA, 19 nt, Homo sapiens
aagcaggucuccucacuca

SEQ ID NO: 846479 - RNA, 19 nt, Homo sapiens
guaagccgguggagaaguc

SEQ ID NO: 846480 - RNA, 19 nt, Homo sapiens
gauacaacagugcguuaaa

SEQ ID NO: 846481 - RNA, 19 nt, Homo sapiens
gaugguugauuaggacuug

SEQ ID NO: 846482 - RNA, 19 nt, Homo sapiens
gccauggaaugaagcagaa

SEQ ID NO: 846483 - RNA, 19 nt, Homo sapiens
acaacagugcguuaaauaa

SEQ ID NO: 846484 - RNA, 19 nt, Homo sapiens
guucacaggucucggucuu

SEQ ID NO: 846485 - RNA, 19 nt, Homo sapiens
uacaacagugcguuaaaua

SEQ ID NO: 846486 - RNA, 19 nt, Homo sapiens
gaaagccugccaguucuga

SEQ ID NO: 846487 - RNA, 19 nt, Homo sapiens
auacaacagugcguuaaau

SEQ ID NO: 846488 - RNA, 19 nt, Homo sapiens
ggcgguagcucaccaaucc

SEQ ID NO: 846489 - RNA, 19 nt, Homo sapiens
gcgugcacccgcuccuuua

SEQ ID NO: 846490 - RNA, 19 nt, Homo sapiens
gcuccuuuauuaggcuaua

SEQ ID NO: 846491 - RNA, 19 nt, Homo sapiens
gagcuaucaugucguaagc

SEQ ID NO: 846492 - RNA, 19 nt, Homo sapiens
acagugcguuaaauaagga

SEQ ID NO: 846493 - RNA, 19 nt, Homo sapiens
auugagcuaucaugucgua

SEQ ID NO: 846494 - RNA, 19 nt, Homo sapiens
aacgaaagccugccaguuc

SEQ ID NO: 846495 - RNA, 19 nt, Homo sapiens
gucguaagccgguggagaa

SEQ ID NO: 846496 - RNA, 19 nt, Homo sapiens
aaacgaaagccugccaguu

SEQ ID NO: 846497 - RNA, 19 nt, Homo sapiens
guagcucaccaauccaaug

SEQ ID NO: 846498 - RNA, 19 nt, Homo sapiens
gugcacccgcuccuuuauu

SEQ ID NO: 846499 - RNA, 19 nt, Homo sapiens
acgaaagccugccaguucu

SEQ ID NO: 846500 - RNA, 19 nt, Homo sapiens
ugauacaacagugcguuaa

SEQ ID NO: 846501 - RNA, 19 nt, Homo sapiens
ggcuugcucuggccaugga

SEQ ID NO: 846502 - RNA, 19 nt, Homo sapiens
ucaccgggauagauagaac

SEQ ID NO: 846503 - RNA, 19 nt, Homo sapiens
gagaaguccagggcuagug

SEQ ID NO: 846504 - RNA, 19 nt, Homo sapiens
ugaaacagcuggaauugua

SEQ ID NO: 846505 - RNA, 19 nt, Homo sapiens
gaggaagaauugacaaaua

SEQ ID NO: 846506 - RNA, 19 nt, Homo sapiens
ggauagagcuguugacuuc

SEQ ID NO: 846507 - RNA, 19 nt, Homo sapiens
gaacuucuccagcaauuua

SEQ ID NO: 846508 - RNA, 19 nt, Homo sapiens
guaaguggauguauaugua

SEQ ID NO: 846509 - RNA, 19 nt, Homo sapiens
gaggaacacugacuuuauu

SEQ ID NO: 846510 - RNA, 19 nt, Homo sapiens
ggaauaagguguguugguu

SEQ ID NO: 846511 - RNA, 19 nt, Homo sapiens
ccaaacaccuggaaguauu

SEQ ID NO: 846512 - RNA, 19 nt, Homo sapiens
gaacguuccagaagucuua

SEQ ID NO: 846513 - RNA, 19 nt, Homo sapiens
ggacuggccuaaccaauuc

SEQ ID NO: 846514 - RNA, 19 nt, Homo sapiens
gaaguuugauguaaucugu

SEQ ID NO: 846515 - RNA, 19 nt, Homo sapiens
gcaugaacuugcacagaua

SEQ ID NO: 846516 - RNA, 19 nt, Homo sapiens
caaggcagauguaugauau

SEQ ID NO: 846517 - RNA, 19 nt, Homo sapiens
gcagacagguauuaaagga

SEQ ID NO: 846518 - RNA, 19 nt, Homo sapiens
cauacgggcuccaaucaua

SEQ ID NO: 846519 - RNA, 19 nt, Homo sapiens
gaauacaucucugaacguu

SEQ ID NO: 846520 - RNA, 19 nt, Homo sapiens
gcacagauaaugcacguuu

SEQ ID NO: 846521 - RNA, 19 nt, Homo sapiens
gaaauuggcagauauugga

SEQ ID NO: 846522 - RNA, 19 nt, Homo sapiens
gaggaugucugcauuaaag

SEQ ID NO: 846523 - RNA, 19 nt, Homo sapiens
aaacaaggcagauguauga

SEQ ID NO: 846524 - RNA, 19 nt, Homo sapiens
gaaauucaccaccaaauag

SEQ ID NO: 846525 - RNA, 19 nt, Homo sapiens
guuccuagauaccguguua

SEQ ID NO: 846526 - RNA, 19 nt, Homo sapiens
gaagaaauuggcagauauu

SEQ ID NO: 846527 - RNA, 19 nt, Homo sapiens
gauauggugguaaagauua

SEQ ID NO: 846528 - RNA, 19 nt, Homo sapiens
uauaguaaaugcacgauug

SEQ ID NO: 846529 - RNA, 19 nt, Homo sapiens
gaugcacacuauucuguaa

SEQ ID NO: 846530 - RNA, 19 nt, Homo sapiens
gcuaaugagucuagaguuc

SEQ ID NO: 846531 - RNA, 19 nt, Homo sapiens
agaggcagcugcguauuua

SEQ ID NO: 846532 - RNA, 19 nt, Homo sapiens
ggagaacucagcauagaaa

SEQ ID NO: 846533 - RNA, 19 nt, Homo sapiens
ucaacaggcucccuucuga

SEQ ID NO: 846534 - RNA, 19 nt, Homo sapiens
uaaccagucuuccuguauu

SEQ ID NO: 846535 - RNA, 19 nt, Homo sapiens
aagaagaaauuggcagaua

SEQ ID NO: 846536 - RNA, 19 nt, Homo sapiens
ggucaagcauuucauuuag

SEQ ID NO: 846537 - RNA, 19 nt, Homo sapiens
ggacugacuuaccuaggaa

SEQ ID NO: 846538 - RNA, 19 nt, Homo sapiens
gcaccuuguuuaugaagaa

SEQ ID NO: 846539 - RNA, 19 nt, Homo sapiens
agauuuagguccugaauau

SEQ ID NO: 846540 - RNA, 19 nt, Homo sapiens
guucugaaguuugauguaa

SEQ ID NO: 846541 - RNA, 19 nt, Homo sapiens
gaugggaauguguauaaua

SEQ ID NO: 846542 - RNA, 19 nt, Homo sapiens
gugggcaccuuguuuauga

SEQ ID NO: 846543 - RNA, 19 nt, Homo sapiens
gaagaaagucugggauaga

SEQ ID NO: 846544 - RNA, 19 nt, Homo sapiens
uguacgcgauuccuuaaua

SEQ ID NO: 846545 - RNA, 19 nt, Homo sapiens
gcuuagugguuacaaauau

SEQ ID NO: 846546 - RNA, 19 nt, Homo sapiens
gaagaaauucaccaccaaa

SEQ ID NO: 846547 - RNA, 19 nt, Homo sapiens
gaauagguggugcagauuu

SEQ ID NO: 846548 - RNA, 19 nt, Homo sapiens
gaucaugaauguggcaguu

SEQ ID NO: 846549 - RNA, 19 nt, Homo sapiens
gagcucaguuaagccaaua

SEQ ID NO: 846550 - RNA, 19 nt, Homo sapiens
uaaacaugaugcacacuau

SEQ ID NO: 846551 - RNA, 19 nt, Homo sapiens
agaagaaauuggcagauau

SEQ ID NO: 846552 - RNA, 19 nt, Homo sapiens
ucugauaccaguuguaaua

SEQ ID NO: 846553 - RNA, 19 nt, Homo sapiens
ggaacacugacuuuauuaa

SEQ ID NO: 846554 - RNA, 19 nt, Homo sapiens
gaaacaaggcagauguaug

SEQ ID NO: 846555 - RNA, 19 nt, Homo sapiens
gaauaagguguguugguuu

SEQ ID NO: 846556 - RNA, 19 nt, Homo sapiens
ggauggagaacucagcaua

SEQ ID NO: 846557 - RNA, 19 nt, Homo sapiens
guuagugccucuguuauau

SEQ ID NO: 846558 - RNA, 19 nt, Homo sapiens
cuagggccaugacauagua

SEQ ID NO: 846559 - RNA, 19 nt, Homo sapiens
caaacaccuggaaguauua

SEQ ID NO: 846560 - RNA, 19 nt, Homo sapiens
ggugaaaguagucuuguuu

SEQ ID NO: 846561 - RNA, 19 nt, Homo sapiens
uggaaaagauguuggaaua

SEQ ID NO: 846562 - RNA, 19 nt, Homo sapiens
gaaaaccccuuuggugaaa

SEQ ID NO: 846563 - RNA, 19 nt, Homo sapiens
cagaugggaauguguauaa

SEQ ID NO: 846564 - RNA, 19 nt, Homo sapiens
gaacacugacuuuauuaag

SEQ ID NO: 846565 - RNA, 19 nt, Homo sapiens
aagaauagguggugcagau

SEQ ID NO: 846566 - RNA, 19 nt, Homo sapiens
caagacagaugggaaugug

SEQ ID NO: 846567 - RNA, 19 nt, Homo sapiens
ugaguagguaggauaauua

SEQ ID NO: 846568 - RNA, 19 nt, Homo sapiens
caaagggauuuagcaguga

SEQ ID NO: 846569 - RNA, 19 nt, Homo sapiens
agaaauucaccaccaaaua

SEQ ID NO: 846570 - RNA, 19 nt, Homo sapiens
gggacugacuuaccuagga

SEQ ID NO: 846571 - RNA, 19 nt, Homo sapiens
gauaccguguuaacgcuaa

SEQ ID NO: 846572 - RNA, 19 nt, Homo sapiens
uacuuaaacuggcuuugua

SEQ ID NO: 846573 - RNA, 19 nt, Homo sapiens
guggauguauauguacuua

SEQ ID NO: 846574 - RNA, 19 nt, Homo sapiens
caguuaagccaauacauuu

SEQ ID NO: 846575 - RNA, 19 nt, Homo sapiens
gaaaagauguuggaauaag

SEQ ID NO: 846576 - RNA, 19 nt, Homo sapiens
cuuaacugcugccugcuua

SEQ ID NO: 846577 - RNA, 19 nt, Homo sapiens
uaacagaaagcccuauugu

SEQ ID NO: 846578 - RNA, 19 nt, Homo sapiens
guaaacaugaugcacacua

SEQ ID NO: 846579 - RNA, 19 nt, Homo sapiens
gugccucaguauuuaauuu

SEQ ID NO: 846580 - RNA, 19 nt, Homo sapiens
ucacauugcaguagacaaa

SEQ ID NO: 846581 - RNA, 19 nt, Homo sapiens
uguaugauauggugguaaa

SEQ ID NO: 846582 - RNA, 19 nt, Homo sapiens
acaagacgcggaacaguaa

SEQ ID NO: 846583 - RNA, 19 nt, Homo sapiens
ccuacaggcuaauguggua

SEQ ID NO: 846584 - RNA, 19 nt, Homo sapiens
ucucucagcuccgccguua

SEQ ID NO: 846585 - RNA, 19 nt, Homo sapiens
cagcuggaauuguacaaau

SEQ ID NO: 846586 - RNA, 19 nt, Homo sapiens
uugcauggcucuugguuug

SEQ ID NO: 846587 - RNA, 19 nt, Homo sapiens
gcauuuggcaauucaagaa

SEQ ID NO: 846588 - RNA, 19 nt, Homo sapiens
gggaauguguauaauaacu

SEQ ID NO: 846589 - RNA, 19 nt, Homo sapiens
gauaccaguuguaauagag

SEQ ID NO: 846590 - RNA, 19 nt, Homo sapiens
ucaguuaagccaauacauu

SEQ ID NO: 846591 - RNA, 19 nt, Homo sapiens
gcuaacgugugaaaauaua

SEQ ID NO: 846592 - RNA, 19 nt, Homo sapiens
gcuuugugccucaguauuu

SEQ ID NO: 846593 - RNA, 19 nt, Homo sapiens
gccaugacauaguaccauu

SEQ ID NO: 846594 - RNA, 19 nt, Homo sapiens
cauaguuccuacaggcuaa

SEQ ID NO: 846595 - RNA, 19 nt, Homo sapiens
acagucaccugcauaguuc

SEQ ID NO: 846596 - RNA, 19 nt, Homo sapiens
gaauguggcaguucuaguc

SEQ ID NO: 846597 - RNA, 19 nt, Homo sapiens
ugcaggagaucaugaaugu

SEQ ID NO: 846598 - RNA, 19 nt, Homo sapiens
gcggaacaguaauaacaau

SEQ ID NO: 846599 - RNA, 19 nt, Homo sapiens
aauuugggcuuagugguua

SEQ ID NO: 846600 - RNA, 19 nt, Homo sapiens
guagucccauaauuucuug

SEQ ID NO: 846601 - RNA, 19 nt, Homo sapiens
cagauguggugguuguauu

SEQ ID NO: 846602 - RNA, 19 nt, Homo sapiens
acacugacuuuauuaagca

SEQ ID NO: 846603 - RNA, 19 nt, Homo sapiens
ugaagaaagucugggauag

SEQ ID NO: 846604 - RNA, 19 nt, Homo sapiens
caacaugaccuauaaguaa

SEQ ID NO: 846605 - RNA, 19 nt, Homo sapiens
cgaaaugacuguguuugua

SEQ ID NO: 846606 - RNA, 19 nt, Homo sapiens
gaagauagagccgaaauga

SEQ ID NO: 846607 - RNA, 19 nt, Homo sapiens
gaugacagcuccagugaca

SEQ ID NO: 846608 - RNA, 19 nt, Homo sapiens
uuacgaaacugaacagcua

SEQ ID NO: 846609 - RNA, 19 nt, Homo sapiens
ccugucaaauugcuuaaua

SEQ ID NO: 846610 - RNA, 19 nt, Homo sapiens
uaaagugcgugucuagugu

SEQ ID NO: 846611 - RNA, 19 nt, Homo sapiens
uaacuaucguggucuuuau

SEQ ID NO: 846612 - RNA, 19 nt, Homo sapiens
agucagaugucuucauuga

SEQ ID NO: 846613 - RNA, 19 nt, Homo sapiens
agagucagaugucuucauu

SEQ ID NO: 846614 - RNA, 19 nt, Homo sapiens
guuaugagauccgacacua

SEQ ID NO: 846615 - RNA, 19 nt, Homo sapiens
acaucaacaugaccuauaa

SEQ ID NO: 846616 - RNA, 19 nt, Homo sapiens
gagccgaaaugacuguguu

SEQ ID NO: 846617 - RNA, 19 nt, Homo sapiens
gaacaacuuuugacauuag

SEQ ID NO: 846618 - RNA, 19 nt, Homo sapiens
uuuagugagucuaccauua

SEQ ID NO: 846619 - RNA, 19 nt, Homo sapiens
gaaacugaacagcuacauu

SEQ ID NO: 846620 - RNA, 19 nt, Homo sapiens
gacaucaacaugaccuaua

SEQ ID NO: 846621 - RNA, 19 nt, Homo sapiens
aaacugaacagcuacauuc

SEQ ID NO: 846622 - RNA, 19 nt, Homo sapiens
guaaagugcgugucuagug

SEQ ID NO: 846623 - RNA, 19 nt, Homo sapiens
gaaaugacuguguuuguac

SEQ ID NO: 846624 - RNA, 19 nt, Homo sapiens
uaaguaaagugcgugucua

SEQ ID NO: 846625 - RNA, 19 nt, Homo sapiens
uaucauagacaucaacaug

SEQ ID NO: 846626 - RNA, 19 nt, Homo sapiens
gacauuagcaagcauuuua

SEQ ID NO: 846627 - RNA, 19 nt, Homo sapiens
ccauuaccauuucccugua

SEQ ID NO: 846628 - RNA, 19 nt, Homo sapiens
gagucuaccauuaccauuu

SEQ ID NO: 846629 - RNA, 19 nt, Homo sapiens
ucaacaugaccuauaagua

SEQ ID NO: 846630 - RNA, 19 nt, Homo sapiens
gcccggaaguuaugagauc

SEQ ID NO: 846631 - RNA, 19 nt, Homo sapiens
ccaaaagaaucaagaacaa

SEQ ID NO: 846632 - RNA, 19 nt, Homo sapiens
aaaggaaguucugcuguca

SEQ ID NO: 846633 - RNA, 19 nt, Homo sapiens
ccucugaacagcaauuuga

SEQ ID NO: 846634 - RNA, 19 nt, Homo sapiens
cagcuacauucaaggcaaa

SEQ ID NO: 846635 - RNA, 19 nt, Homo sapiens
gugcgugucuagugucuuc

SEQ ID NO: 846636 - RNA, 19 nt, Homo sapiens
aaaugaacccaccaaagaa

SEQ ID NO: 846637 - RNA, 19 nt, Homo sapiens
ucgaugagaagguuuacua

SEQ ID NO: 846638 - RNA, 19 nt, Homo sapiens
uaugagauccgacacuaug

SEQ ID NO: 846639 - RNA, 19 nt, Homo sapiens
aaaaugaacccaccaaaga

SEQ ID NO: 846640 - RNA, 19 nt, Homo sapiens
ugagaagguuuacuacacu

SEQ ID NO: 846641 - RNA, 19 nt, Homo sapiens
cagacgggcuuuacgaaac

SEQ ID NO: 846642 - RNA, 19 nt, Homo sapiens
gaugagaagguuuacuaca

SEQ ID NO: 846643 - RNA, 19 nt, Homo sapiens
ccagacgggcuuuacgaaa

SEQ ID NO: 846644 - RNA, 19 nt, Homo sapiens
uaacagaggacaguagucu

SEQ ID NO: 846645 - RNA, 19 nt, Homo sapiens
ucauaacuaucguggucuu

SEQ ID NO: 846646 - RNA, 19 nt, Homo sapiens
uuaucuacauacacaggua

SEQ ID NO: 846647 - RNA, 19 nt, Homo sapiens
acccaggccuuuagaguca

SEQ ID NO: 846648 - RNA, 19 nt, Homo sapiens
agucuaccauuaccauuuc

SEQ ID NO: 846649 - RNA, 19 nt, Homo sapiens
aaugaacccaccaaagaaa

SEQ ID NO: 846650 - RNA, 19 nt, Homo sapiens
auaacuaucguggucuuua

SEQ ID NO: 846651 - RNA, 19 nt, Homo sapiens
agauagagccgaaaugacu

SEQ ID NO: 846652 - RNA, 19 nt, Homo sapiens
cccuguauauucccucuga

SEQ ID NO: 846653 - RNA, 19 nt, Homo sapiens
gaaucaagaacaacuuuug

SEQ ID NO: 846654 - RNA, 19 nt, Homo sapiens
gguaacagaggacaguagu

SEQ ID NO: 846655 - RNA, 19 nt, Homo sapiens
aagggaagauggaaaaguu

SEQ ID NO: 846656 - RNA, 19 nt, Homo sapiens
uguacggucuuucgaugga

SEQ ID NO: 846657 - RNA, 19 nt, Homo sapiens
ugacagcuccagugacaag

SEQ ID NO: 846658 - RNA, 19 nt, Homo sapiens
cgagaaagagaugaaaaua

SEQ ID NO: 846659 - RNA, 19 nt, Homo sapiens
ccauuucccuguauauucc

SEQ ID NO: 846660 - RNA, 19 nt, Homo sapiens
cauuaccauuucccuguau

SEQ ID NO: 846661 - RNA, 19 nt, Homo sapiens
aaacgagaaagagaugaaa

SEQ ID NO: 846662 - RNA, 19 nt, Homo sapiens
gauccacccaggccuuuag

SEQ ID NO: 846663 - RNA, 19 nt, Homo sapiens
aagaugacagcuccaguga

SEQ ID NO: 846664 - RNA, 19 nt, Homo sapiens
ccgaaaugacuguguuugu

SEQ ID NO: 846665 - RNA, 19 nt, Homo sapiens
guucagguccuuuuaguga

SEQ ID NO: 846666 - RNA, 19 nt, Homo sapiens
agacgggcuuuacgaaacu

SEQ ID NO: 846667 - RNA, 19 nt, Homo sapiens
uaagcuuauuuccaaugug

SEQ ID NO: 846668 - RNA, 19 nt, Homo sapiens
ccacccaggccuuuagagu

SEQ ID NO: 846669 - RNA, 19 nt, Homo sapiens
gaacauggcuucaaagaua

SEQ ID NO: 846670 - RNA, 19 nt, Homo sapiens
ggacagggcuuauuuaauu

SEQ ID NO: 846671 - RNA, 19 nt, Homo sapiens
gaaagaagauagugguuga

SEQ ID NO: 846672 - RNA, 19 nt, Homo sapiens
uaucagagcugucuuaaau

SEQ ID NO: 846673 - RNA, 19 nt, Homo sapiens
agaccuagcuguacaguuu

SEQ ID NO: 846674 - RNA, 19 nt, Homo sapiens
cagagaaccuggagaugua

SEQ ID NO: 846675 - RNA, 19 nt, Homo sapiens
uagaggagaugccacauaa

SEQ ID NO: 846676 - RNA, 19 nt, Homo sapiens
guaaacaacuagagaagau

SEQ ID NO: 846677 - RNA, 19 nt, Homo sapiens
gagcgagacuuauagauag

SEQ ID NO: 846678 - RNA, 19 nt, Homo sapiens
gacagggcuuauuuaauua

SEQ ID NO: 846679 - RNA, 19 nt, Homo sapiens
ugacagagcgagacuuaua

SEQ ID NO: 846680 - RNA, 19 nt, Homo sapiens
caaaggaaauggagaaggu

SEQ ID NO: 846681 - RNA, 19 nt, Homo sapiens
cuaagacuguugccuuuaa

SEQ ID NO: 846682 - RNA, 19 nt, Homo sapiens
gacacaggauuaugaagaa

SEQ ID NO: 846683 - RNA, 19 nt, Homo sapiens
ggccugaauucaaauauug

SEQ ID NO: 846684 - RNA, 19 nt, Homo sapiens
cagccuaaguuaauaaaug

SEQ ID NO: 846685 - RNA, 19 nt, Homo sapiens
ccacagugccugauuggua

SEQ ID NO: 846686 - RNA, 19 nt, Homo sapiens
gguauagccuuaugugcuu

SEQ ID NO: 846687 - RNA, 19 nt, Homo sapiens
gcaagauucuaaagcugaa

SEQ ID NO: 846688 - RNA, 19 nt, Homo sapiens
ggcagucccuugucuuauu

SEQ ID NO: 846689 - RNA, 19 nt, Homo sapiens
gauuucagcuuccaaacug

SEQ ID NO: 846690 - RNA, 19 nt, Homo sapiens
gguauacauuccaaacuga

SEQ ID NO: 846691 - RNA, 19 nt, Homo sapiens
agagcugucuuaaaucuuu

SEQ ID NO: 846692 - RNA, 19 nt, Homo sapiens
ggugacagagcgagacuua

SEQ ID NO: 846693 - RNA, 19 nt, Homo sapiens
ggugacagagcgagacuua

SEQ ID NO: 846694 - RNA, 19 nt, Homo sapiens
uaagagaccuagcuguaca

SEQ ID NO: 846695 - RNA, 19 nt, Homo sapiens
aaacggaauuggagccauu

SEQ ID NO: 846696 - RNA, 19 nt, Homo sapiens
gacagcaggucgacagaga

SEQ ID NO: 846697 - RNA, 19 nt, Homo sapiens
gaaagcagaggaguacuug

SEQ ID NO: 846698 - RNA, 19 nt, Homo sapiens
ccaaacugauaguacauug

SEQ ID NO: 846699 - RNA, 19 nt, Homo sapiens
gaagaucugacacaggauu

SEQ ID NO: 846700 - RNA, 19 nt, Homo sapiens
caguuuagcuguauagaag

SEQ ID NO: 846701 - RNA, 19 nt, Homo sapiens
gggccugaauucaaauauu

SEQ ID NO: 846702 - RNA, 19 nt, Homo sapiens
gacaggagcaucacuugaa

SEQ ID NO: 846703 - RNA, 19 nt, Homo sapiens
gauaguacauugccaucuc

SEQ ID NO: 846704 - RNA, 19 nt, Homo sapiens
gaccagcagugcagucaug

SEQ ID NO: 846705 - RNA, 19 nt, Homo sapiens
aauaagagaccuagcugua

SEQ ID NO: 846706 - RNA, 19 nt, Homo sapiens
guacagccuaaguuaauaa

SEQ ID NO: 846707 - RNA, 19 nt, Homo sapiens
gcagucccuugucuuauuc

SEQ ID NO: 846708 - RNA, 19 nt, Homo sapiens
cgagacuuauagauagaua

SEQ ID NO: 846709 - RNA, 19 nt, Homo sapiens
uaagacuguugccuuuaaa

SEQ ID NO: 846710 - RNA, 19 nt, Homo sapiens
ggaaagcagaggaguacuu

SEQ ID NO: 846711 - RNA, 19 nt, Homo sapiens
guagaggagaugccacaua

SEQ ID NO: 846712 - RNA, 19 nt, Homo sapiens
ucagagcugucuuaaaucu

SEQ ID NO: 846713 - RNA, 19 nt, Homo sapiens
agagcgagacuuauagaua

SEQ ID NO: 846714 - RNA, 19 nt, Homo sapiens
ccacauaaaccacagaaag

SEQ ID NO: 846715 - RNA, 19 nt, Homo sapiens
gaucgacuguguaaacaac

SEQ ID NO: 846716 - RNA, 19 nt, Homo sapiens
gaauggcagucccuugucu

SEQ ID NO: 846717 - RNA, 19 nt, Homo sapiens
ggaauuguucgcuuuagug

SEQ ID NO: 846718 - RNA, 19 nt, Homo sapiens
gaaaccccaucucuacuaa

SEQ ID NO: 846719 - RNA, 19 nt, Homo sapiens
ccugauugguauagccuua

SEQ ID NO: 846720 - RNA, 19 nt, Homo sapiens
uaauaaggauccuaagacu

SEQ ID NO: 846721 - RNA, 19 nt, Homo sapiens
cagucugaauggcaucuua

SEQ ID NO: 846722 - RNA, 19 nt, Homo sapiens
ugacacaggauuaugaaga

SEQ ID NO: 846723 - RNA, 19 nt, Homo sapiens
cacagugccugauugguau

SEQ ID NO: 846724 - RNA, 19 nt, Homo sapiens
agacuguugccuuuaaaua

SEQ ID NO: 846725 - RNA, 19 nt, Homo sapiens
aaacugguauacauuccaa

SEQ ID NO: 846726 - RNA, 19 nt, Homo sapiens
gaagagaaagaagauagug

SEQ ID NO: 846727 - RNA, 19 nt, Homo sapiens
ggauagauagauagauaga

SEQ ID NO: 846728 - RNA, 19 nt, Homo sapiens
ugacagagcgagacuuauc

SEQ ID NO: 846729 - RNA, 19 nt, Homo sapiens
gauggugcaugccuguaau

SEQ ID NO: 846730 - RNA, 19 nt, Homo sapiens
cgacagagaaccuggagau

SEQ ID NO: 846731 - RNA, 19 nt, Homo sapiens
uauauuugaucgacugugu

SEQ ID NO: 846732 - RNA, 19 nt, Homo sapiens
ugaacaaggagacauauca

SEQ ID NO: 846733 - RNA, 19 nt, Homo sapiens
cuuaugugcuuuccuacaa

SEQ ID NO: 846734 - RNA, 19 nt, Homo sapiens
aggaagacuugacggcuuu

SEQ ID NO: 846735 - RNA, 19 nt, Homo sapiens
cacauaaaccacagaaaga

SEQ ID NO: 846736 - RNA, 19 nt, Homo sapiens
gaggagaugccacauaaac

SEQ ID NO: 846737 - RNA, 19 nt, Homo sapiens
gggaauuguucgcuuuagu

SEQ ID NO: 846738 - RNA, 19 nt, Homo sapiens
uguacagccuaaguuaaua

SEQ ID NO: 846739 - RNA, 19 nt, Homo sapiens
ucccuugucuuauucagaa

SEQ ID NO: 846740 - RNA, 19 nt, Homo sapiens
gcagugagccgagauugca

SEQ ID NO: 846741 - RNA, 19 nt, Homo sapiens
ggagaugccacauaaacca

SEQ ID NO: 846742 - RNA, 19 nt, Homo sapiens
cagcaaaggaaauggagaa

SEQ ID NO: 846743 - RNA, 19 nt, Homo sapiens
ccacggaagagaaagaaga

SEQ ID NO: 846744 - RNA, 19 nt, Homo sapiens
guagccacauccgguguaa

SEQ ID NO: 846745 - RNA, 19 nt, Homo sapiens
gaacaaggagacauaucag

SEQ ID NO: 846746 - RNA, 19 nt, Homo sapiens
gagaaagaagauagugguu

SEQ ID NO: 846747 - RNA, 19 nt, Homo sapiens
ggaagagaaagaagauagu

SEQ ID NO: 846748 - RNA, 19 nt, Homo sapiens
aaacaacuagagaagauug

SEQ ID NO: 846749 - RNA, 19 nt, Homo sapiens
uauuguacagccuaaguua

SEQ ID NO: 846750 - RNA, 19 nt, Homo sapiens
gagacaggagcaucacuug

SEQ ID NO: 846751 - RNA, 19 nt, Homo sapiens
aaucccagcuccucaguag

SEQ ID NO: 846752 - RNA, 19 nt, Homo sapiens
cagccacagugccugauug

SEQ ID NO: 846753 - RNA, 19 nt, Homo sapiens
auaaggauccuaagacugu

SEQ ID NO: 846754 - RNA, 19 nt, Homo sapiens
gaggaaagcagaggaguac

SEQ ID NO: 846755 - RNA, 19 nt, Homo sapiens
cacgggaauuguucgcuuu

SEQ ID NO: 846756 - RNA, 19 nt, Homo sapiens
gcuuugggauuuuguuuaa

SEQ ID NO: 846757 - RNA, 19 nt, Homo sapiens
cuugacggcuuugggauuu

SEQ ID NO: 846758 - RNA, 19 nt, Homo sapiens
gcuuucagcaugcaagauu

SEQ ID NO: 846759 - RNA, 19 nt, Homo sapiens
acauaucagagcugucuua

SEQ ID NO: 846760 - RNA, 19 nt, Homo sapiens
gaccuagcuguacaguuua

SEQ ID NO: 846761 - RNA, 19 nt, Homo sapiens
uuacugggccugaauucaa

SEQ ID NO: 846762 - RNA, 19 nt, Homo sapiens
caugcaagauucuaaagcu

SEQ ID NO: 846763 - RNA, 19 nt, Homo sapiens
ugaggaaagcagaggagua

SEQ ID NO: 846764 - RNA, 19 nt, Homo sapiens
cuuccaaacugguauacau

SEQ ID NO: 846765 - RNA, 19 nt, Homo sapiens
uauagaagcagugaacaug

SEQ ID NO: 846766 - RNA, 19 nt, Homo sapiens
uacugggccugaauucaaa

SEQ ID NO: 846767 - RNA, 19 nt, Homo sapiens
agccuuaugugcuuuccua

SEQ ID NO: 846768 - RNA, 19 nt, Homo sapiens
uccuaagacuguugccuuu

SEQ ID NO: 846769 - RNA, 19 nt, Homo sapiens
ggaggaaacacaauuauua

SEQ ID NO: 846770 - RNA, 19 nt, Homo sapiens
ggacugcuguguagauaua

SEQ ID NO: 846771 - RNA, 19 nt, Homo sapiens
gaaggaggaaacacaauua

SEQ ID NO: 846772 - RNA, 19 nt, Homo sapiens
ugagaugucuucauaaguu

SEQ ID NO: 846773 - RNA, 19 nt, Homo sapiens
gcuaaagauuguccagaua

SEQ ID NO: 846774 - RNA, 19 nt, Homo sapiens
gaacuucauugacugucua

SEQ ID NO: 846775 - RNA, 19 nt, Homo sapiens
guaagaagcaaaccaaauu

SEQ ID NO: 846776 - RNA, 19 nt, Homo sapiens
guccagauaugaaacauuu

SEQ ID NO: 846777 - RNA, 19 nt, Homo sapiens
gaacugaugaccauacuug

SEQ ID NO: 846778 - RNA, 19 nt, Homo sapiens
aaagaucucucugccaaua

SEQ ID NO: 846779 - RNA, 19 nt, Homo sapiens
cagcacagcuaagagaaua

SEQ ID NO: 846780 - RNA, 19 nt, Homo sapiens
gaaaugaaggaguuuagaa

SEQ ID NO: 846781 - RNA, 19 nt, Homo sapiens
ccucuucucuucccaagua

SEQ ID NO: 846782 - RNA, 19 nt, Homo sapiens
ugacuacgguacucgauaa

SEQ ID NO: 846783 - RNA, 19 nt, Homo sapiens
gaccagucauauuuacaua

SEQ ID NO: 846784 - RNA, 19 nt, Homo sapiens
agacagaccucuaucaucu

SEQ ID NO: 846785 - RNA, 19 nt, Homo sapiens
gucaacaucuccaugaauu

SEQ ID NO: 846786 - RNA, 19 nt, Homo sapiens
gugaguaaaucauucuuga

SEQ ID NO: 846787 - RNA, 19 nt, Homo sapiens
uauuagagcuguuucugaa

SEQ ID NO: 846788 - RNA, 19 nt, Homo sapiens
gaaguaagaagcaaaccaa

SEQ ID NO: 846789 - RNA, 19 nt, Homo sapiens
gagccucgaugaaaccaaa

SEQ ID NO: 846790 - RNA, 19 nt, Homo sapiens
cagaaguccuuauuggaaa

SEQ ID NO: 846791 - RNA, 19 nt, Homo sapiens
ggcaaaggaugaacugaug

SEQ ID NO: 846792 - RNA, 19 nt, Homo sapiens
ggaauacgcagagucagua

SEQ ID NO: 846793 - RNA, 19 nt, Homo sapiens
ugucacagaucaugauuug

SEQ ID NO: 846794 - RNA, 19 nt, Homo sapiens
caaacaggcauguaucaaa

SEQ ID NO: 846795 - RNA, 19 nt, Homo sapiens
gaaaagaacauaugggauu

SEQ ID NO: 846796 - RNA, 19 nt, Homo sapiens
ccagaacuaucacauuuag

SEQ ID NO: 846797 - RNA, 19 nt, Homo sapiens
ucuaaggguugcuuuguuu

SEQ ID NO: 846798 - RNA, 19 nt, Homo sapiens
gacuucagcuuucucuauu

SEQ ID NO: 846799 - RNA, 19 nt, Homo sapiens
ggacuucagcuuucucuau

SEQ ID NO: 846800 - RNA, 19 nt, Homo sapiens
ggaauagccacaucuccua

SEQ ID NO: 846801 - RNA, 19 nt, Homo sapiens
ugaaggauauggaaagcuu

SEQ ID NO: 846802 - RNA, 19 nt, Homo sapiens
agacacagccucuccauga

SEQ ID NO: 846803 - RNA, 19 nt, Homo sapiens
gagaaaauguugugaacuu

SEQ ID NO: 846804 - RNA, 19 nt, Homo sapiens
caccauauguagucucauu

SEQ ID NO: 846805 - RNA, 19 nt, Homo sapiens
uaaaacugcucacacauuu

SEQ ID NO: 846806 - RNA, 19 nt, Homo sapiens
gaccauacuugagaaaugu

SEQ ID NO: 846807 - RNA, 19 nt, Homo sapiens
cauacaaacugcaccuaga

SEQ ID NO: 846808 - RNA, 19 nt, Homo sapiens
gaagacagaccucuaucau

SEQ ID NO: 846809 - RNA, 19 nt, Homo sapiens
gcagucaacaucuccauga

SEQ ID NO: 846810 - RNA, 19 nt, Homo sapiens
agccagaacuaucacauuu

SEQ ID NO: 846811 - RNA, 19 nt, Homo sapiens
gcaguaucaucucuauugu

SEQ ID NO: 846812 - RNA, 19 nt, Homo sapiens
uaaagauuguccagauaug

SEQ ID NO: 846813 - RNA, 19 nt, Homo sapiens
ccaaagaggaggaaagugu

SEQ ID NO: 846814 - RNA, 19 nt, Homo sapiens
aaacaccuguggaguacuu

SEQ ID NO: 846815 - RNA, 19 nt, Homo sapiens
uaaguguccugugcuguaa

SEQ ID NO: 846816 - RNA, 19 nt, Homo sapiens
gaguuuagaagaaguaaga

SEQ ID NO: 846817 - RNA, 19 nt, Homo sapiens
ugaccauacuugagaaaug

SEQ ID NO: 846818 - RNA, 19 nt, Homo sapiens
ggaguaugcaucagucuug

SEQ ID NO: 846819 - RNA, 19 nt, Homo sapiens
caaauaagcaaagccagaa

SEQ ID NO: 846820 - RNA, 19 nt, Homo sapiens
guaaggagcaccugacuac

SEQ ID NO: 846821 - RNA, 19 nt, Homo sapiens
gaaggaguuuagaagaagu

SEQ ID NO: 846822 - RNA, 19 nt, Homo sapiens
ucagaaguccuuauuggaa

SEQ ID NO: 846823 - RNA, 19 nt, Homo sapiens
ccaaagaaagacacauuau

SEQ ID NO: 846824 - RNA, 19 nt, Homo sapiens
acagaagacugaccaugug

SEQ ID NO: 846825 - RNA, 19 nt, Homo sapiens
gaucagagaguuguacugu

SEQ ID NO: 846826 - RNA, 19 nt, Homo sapiens
ccaaugagagauauuugaa

SEQ ID NO: 846827 - RNA, 19 nt, Homo sapiens
caugauuucucaguucaaa

SEQ ID NO: 846828 - RNA, 19 nt, Homo sapiens
uaucaugauuucucaguuc

SEQ ID NO: 846829 - RNA, 19 nt, Homo sapiens
gaucaugauuugacauucg

SEQ ID NO: 846830 - RNA, 19 nt, Homo sapiens
gaccauguggcaagacuaa

SEQ ID NO: 846831 - RNA, 19 nt, Homo sapiens
caagaaugaagcacugaaa

SEQ ID NO: 846832 - RNA, 19 nt, Homo sapiens
gagaugucuucauaaguuc

SEQ ID NO: 846833 - RNA, 19 nt, Homo sapiens
guacuacaagacuucauaa

SEQ ID NO: 846834 - RNA, 19 nt, Homo sapiens
aaacaggcauguaucaaaa

SEQ ID NO: 846835 - RNA, 19 nt, Homo sapiens
gccagaacuaucacauuua

SEQ ID NO: 846836 - RNA, 19 nt, Homo sapiens
acucaacaauccuuacuau

SEQ ID NO: 846837 - RNA, 19 nt, Homo sapiens
caacaucuccaugaauuuc

SEQ ID NO: 846838 - RNA, 19 nt, Homo sapiens
gaaagcaaauaagcaaagc

SEQ ID NO: 846839 - RNA, 19 nt, Homo sapiens
gcgacuacaagaggaauua

SEQ ID NO: 846840 - RNA, 19 nt, Homo sapiens
ggaaaugaaggaguuuaga

SEQ ID NO: 846841 - RNA, 19 nt, Homo sapiens
gcaaaggaugaacugauga

SEQ ID NO: 846842 - RNA, 19 nt, Homo sapiens
gaugaaaucugaaaaugag

SEQ ID NO: 846843 - RNA, 19 nt, Homo sapiens
ccacaucuccuauuaucau

SEQ ID NO: 846844 - RNA, 19 nt, Homo sapiens
caaauuugaaguacucaga

SEQ ID NO: 846845 - RNA, 19 nt, Homo sapiens
cgaugaaaccaaagaagaa

SEQ ID NO: 846846 - RNA, 19 nt, Homo sapiens
uccaaucuuugucuuguaa

SEQ ID NO: 846847 - RNA, 19 nt, Homo sapiens
aaguugaucucacaguuga

SEQ ID NO: 846848 - RNA, 19 nt, Homo sapiens
cagaagaauucaagagacu

SEQ ID NO: 846849 - RNA, 19 nt, Homo sapiens
ugaaggaggaaacacaauu

SEQ ID NO: 846850 - RNA, 19 nt, Homo sapiens
caaagaggaggaaaguguu

SEQ ID NO: 846851 - RNA, 19 nt, Homo sapiens
gcucacacauuuuacugua

SEQ ID NO: 846852 - RNA, 19 nt, Homo sapiens
gaguguagcaggcucauca

SEQ ID NO: 846853 - RNA, 19 nt, Homo sapiens
ugaaggaguuuagaagaag

SEQ ID NO: 846854 - RNA, 19 nt, Homo sapiens
cuaagagaauagaggaguu

SEQ ID NO: 846855 - RNA, 19 nt, Homo sapiens
ccacaaaaguacuacaaga

SEQ ID NO: 846856 - RNA, 19 nt, Homo sapiens
uaaugucacaccauaugua

SEQ ID NO: 846857 - RNA, 19 nt, Homo sapiens
gaacuaucacauuuagcuu

SEQ ID NO: 846858 - RNA, 19 nt, Homo sapiens
ggacaguaagcuucgauuc

SEQ ID NO: 846859 - RNA, 19 nt, Homo sapiens
cuagaaagcaaauaagcaa

SEQ ID NO: 846860 - RNA, 19 nt, Homo sapiens
gaagaaguaagaagcaaac

SEQ ID NO: 846861 - RNA, 19 nt, Homo sapiens
uauuggaaaugaaggaguu

SEQ ID NO: 846862 - RNA, 19 nt, Homo sapiens
gcacagcuaagagaauaga

SEQ ID NO: 846863 - RNA, 19 nt, Homo sapiens
gaggaaacacaauuauuac

SEQ ID NO: 846864 - RNA, 19 nt, Homo sapiens
guccugugcuguaaucuuc

SEQ ID NO: 846865 - RNA, 19 nt, Homo sapiens
uaucaucucuauugugcau

SEQ ID NO: 846866 - RNA, 19 nt, Homo sapiens
gaauaaugucacaccauau

SEQ ID NO: 846867 - RNA, 19 nt, Homo sapiens
cuaccaaacagaagacuga

SEQ ID NO: 846868 - RNA, 19 nt, Homo sapiens
uccaugaggugguguacuu

SEQ ID NO: 846869 - RNA, 19 nt, Homo sapiens
gcuagaacauacugaauuu

SEQ ID NO: 846870 - RNA, 19 nt, Homo sapiens
gaauacccguucuauguaa

SEQ ID NO: 846871 - RNA, 19 nt, Homo sapiens
ggcaaacucccauauauuu

SEQ ID NO: 846872 - RNA, 19 nt, Homo sapiens
ggaauacccguucuaugua

SEQ ID NO: 846873 - RNA, 19 nt, Homo sapiens
uaaccgugcuggccuauga

SEQ ID NO: 846874 - RNA, 19 nt, Homo sapiens
ugaaguagcuagaacauac

SEQ ID NO: 846875 - RNA, 19 nt, Homo sapiens
caacucuucuuccaucauu

SEQ ID NO: 846876 - RNA, 19 nt, Homo sapiens
gaagaagugucuggaauac

SEQ ID NO: 846877 - RNA, 19 nt, Homo sapiens
caacgggugcuuuacauaa

SEQ ID NO: 846878 - RNA, 19 nt, Homo sapiens
ucaaggagauaauucuaga

SEQ ID NO: 846879 - RNA, 19 nt, Homo sapiens
gaagugaaaugcagaucag

SEQ ID NO: 846880 - RNA, 19 nt, Homo sapiens
ccuggucacuccaacaaua

SEQ ID NO: 846881 - RNA, 19 nt, Homo sapiens
caucuaacaucaucaucuu

SEQ ID NO: 846882 - RNA, 19 nt, Homo sapiens
caaggcaaacucccauaua

SEQ ID NO: 846883 - RNA, 19 nt, Homo sapiens
gaagaagaagugucuggaa

SEQ ID NO: 846884 - RNA, 19 nt, Homo sapiens
uuacauauacccgcuaaua

SEQ ID NO: 846885 - RNA, 19 nt, Homo sapiens
uuucguaccucuuugcuaa

SEQ ID NO: 846886 - RNA, 19 nt, Homo sapiens
caaaacacguaaugcauuu

SEQ ID NO: 846887 - RNA, 19 nt, Homo sapiens
cuaaaucgaacacuguaua

SEQ ID NO: 846888 - RNA, 19 nt, Homo sapiens
aaaagaaacuggccaaaau

SEQ ID NO: 846889 - RNA, 19 nt, Homo sapiens
aaggcaaacucccauauau

SEQ ID NO: 846890 - RNA, 19 nt, Homo sapiens
gagacaacuuugaauccuu

SEQ ID NO: 846891 - RNA, 19 nt, Homo sapiens
uaaauuggaugccacuuuu

SEQ ID NO: 846892 - RNA, 19 nt, Homo sapiens
caauucaagugaucaagau

SEQ ID NO: 846893 - RNA, 19 nt, Homo sapiens
acauauacccgcuaauaaa

SEQ ID NO: 846894 - RNA, 19 nt, Homo sapiens
caaagaggaguuucagaga

SEQ ID NO: 846895 - RNA, 19 nt, Homo sapiens
gaaauccgaauugcccaua

SEQ ID NO: 846896 - RNA, 19 nt, Homo sapiens
agaagaagugucuggaaua

SEQ ID NO: 846897 - RNA, 19 nt, Homo sapiens
ggagggccauuaccuacau

SEQ ID NO: 846898 - RNA, 19 nt, Homo sapiens
cuuugucgaugcuauauaa

SEQ ID NO: 846899 - RNA, 19 nt, Homo sapiens
uccuauaucugaucaaguu

SEQ ID NO: 846900 - RNA, 19 nt, Homo sapiens
ucuaauguguuggagauuu

SEQ ID NO: 846901 - RNA, 19 nt, Homo sapiens
uggaauacccguucuaugu

SEQ ID NO: 846902 - RNA, 19 nt, Homo sapiens
aagaagaagugucuggaau

SEQ ID NO: 846903 - RNA, 19 nt, Homo sapiens
ucuguuggaugccuuauau

SEQ ID NO: 846904 - RNA, 19 nt, Homo sapiens
gaaaagaaacuggccaaaa

SEQ ID NO: 846905 - RNA, 19 nt, Homo sapiens
cgccagcucuuugagauuu

SEQ ID NO: 846906 - RNA, 19 nt, Homo sapiens
uaauucaacgggugcuuua

SEQ ID NO: 846907 - RNA, 19 nt, Homo sapiens
aaugaaggauggcaacgaa

SEQ ID NO: 846908 - RNA, 19 nt, Homo sapiens
ugucauguccuauaucuga

SEQ ID NO: 846909 - RNA, 19 nt, Homo sapiens
ggaagugaaaugcagauca

SEQ ID NO: 846910 - RNA, 19 nt, Homo sapiens
gccagaggccugcuaaaga

SEQ ID NO: 846911 - RNA, 19 nt, Homo sapiens
ugccaacgauuccuccuuu

SEQ ID NO: 846912 - RNA, 19 nt, Homo sapiens
ucagugucauguccuauau

SEQ ID NO: 846913 - RNA, 19 nt, Homo sapiens
cagaucagacccauuguga

SEQ ID NO: 846914 - RNA, 19 nt, Homo sapiens
ccagaggccugcuaaagac

SEQ ID NO: 846915 - RNA, 19 nt, Homo sapiens
ccaaggaugccaacgauuc

SEQ ID NO: 846916 - RNA, 19 nt, Homo sapiens
ucaccuuccuggucuguug

SEQ ID NO: 846917 - RNA, 19 nt, Homo sapiens
cauauacccgcuaauaaau

SEQ ID NO: 846918 - RNA, 19 nt, Homo sapiens
ccaaguucguccuuuguag

SEQ ID NO: 846919 - RNA, 19 nt, Homo sapiens
gacgccagcucuuugagau

SEQ ID NO: 846920 - RNA, 19 nt, Homo sapiens
cagcaggaaauccgaauug

SEQ ID NO: 846921 - RNA, 19 nt, Homo sapiens
ucagacaauucaagugauc

SEQ ID NO: 846922 - RNA, 19 nt, Homo sapiens
uacauauacccgcuaauaa

SEQ ID NO: 846923 - RNA, 19 nt, Homo sapiens
gagaccagcaccagaggaa

SEQ ID NO: 846924 - RNA, 19 nt, Homo sapiens
caacuuugaauccuuguca

SEQ ID NO: 846925 - RNA, 19 nt, Homo sapiens
aagaggaguuucagagaca

SEQ ID NO: 846926 - RNA, 19 nt, Homo sapiens
caucaucaucuucuaaugu

SEQ ID NO: 846927 - RNA, 19 nt, Homo sapiens
uuaaauuggaugccacuuu

SEQ ID NO: 846928 - RNA, 19 nt, Homo sapiens
caacgauuccuccuuugug

SEQ ID NO: 846929 - RNA, 19 nt, Homo sapiens
uauuacauauacccgcuaa

SEQ ID NO: 846930 - RNA, 19 nt, Homo sapiens
ucaggaagagguugaacaa

SEQ ID NO: 846931 - RNA, 19 nt, Homo sapiens
aauccaaguucguccuuug

SEQ ID NO: 846932 - RNA, 19 nt, Homo sapiens
guuggacucuauucagugu

SEQ ID NO: 846933 - RNA, 19 nt, Homo sapiens
cuaacaucaucaucuucua

SEQ ID NO: 846934 - RNA, 19 nt, Homo sapiens
aggaagagguugaacaaaa

SEQ ID NO: 846935 - RNA, 19 nt, Homo sapiens
guagcuagaacauacugaa

SEQ ID NO: 846936 - RNA, 19 nt, Homo sapiens
cuucuaauguguuggagau

SEQ ID NO: 846937 - RNA, 19 nt, Homo sapiens
gaauugcccauaugcucuu

SEQ ID NO: 846938 - RNA, 19 nt, Homo sapiens
gcagaucagacccauugug

SEQ ID NO: 846939 - RNA, 19 nt, Homo sapiens
aaucgaacacuguauacaa

SEQ ID NO: 846940 - RNA, 19 nt, Homo sapiens
aaaauccucuuguuggaaa

SEQ ID NO: 846941 - RNA, 19 nt, Homo sapiens
ucaacgggugcuuuacaua

SEQ ID NO: 846942 - RNA, 19 nt, Homo sapiens
gaaugaaggauggcaacga

SEQ ID NO: 846943 - RNA, 19 nt, Homo sapiens
gaggccugcuaaagaccua

SEQ ID NO: 846944 - RNA, 19 nt, Homo sapiens
guaccucuuugcuaaaucg

SEQ ID NO: 846945 - RNA, 19 nt, Homo sapiens
cccguucuauguaauauca

SEQ ID NO: 846946 - RNA, 19 nt, Homo sapiens
cuucagacaauucaaguga

SEQ ID NO: 846947 - RNA, 19 nt, Homo sapiens
ucagagacaacuuugaauc

SEQ ID NO: 846948 - RNA, 19 nt, Homo sapiens
gcaucuaacaucaucaucu

SEQ ID NO: 846949 - RNA, 19 nt, Homo sapiens
ucaucauccuccugaagaa

SEQ ID NO: 846950 - RNA, 19 nt, Homo sapiens
gcugcacuguggacuggaa

SEQ ID NO: 846951 - RNA, 19 nt, Homo sapiens
uauauaagccagggaguuc

SEQ ID NO: 846952 - RNA, 19 nt, Homo sapiens
augccagagugaucaauuu

SEQ ID NO: 846953 - RNA, 19 nt, Homo sapiens
gaucuucagacaauucaag

SEQ ID NO: 846954 - RNA, 19 nt, Homo sapiens
gccaacgauuccuccuuug

SEQ ID NO: 846955 - RNA, 19 nt, Homo sapiens
gaccagcaccagaggaauc

SEQ ID NO: 846956 - RNA, 19 nt, Homo sapiens
gugaaguagcuagaacaua

SEQ ID NO: 846957 - RNA, 19 nt, Homo sapiens
caucaucuucuaauguguu

SEQ ID NO: 846958 - RNA, 19 nt, Homo sapiens
cgggugcuuuacauaauga

SEQ ID NO: 846959 - RNA, 19 nt, Homo sapiens
uaauccaaguucguccuuu

SEQ ID NO: 846960 - RNA, 19 nt, Homo sapiens
ggcagccucuucgggauug

SEQ ID NO: 846961 - RNA, 19 nt, Homo sapiens
guucuuugucgaugcuaua

SEQ ID NO: 846962 - RNA, 19 nt, Homo sapiens
gugcuuuucuuauuucuug

SEQ ID NO: 846963 - RNA, 19 nt, Homo sapiens
uauaagccagggaguucua

SEQ ID NO: 846964 - RNA, 19 nt, Homo sapiens
aggcaaacucccauauauu

SEQ ID NO: 846965 - RNA, 19 nt, Homo sapiens
gacaaagaggaguuucaga

SEQ ID NO: 846966 - RNA, 19 nt, Homo sapiens
uaacugucgcguacacaug

SEQ ID NO: 846967 - RNA, 19 nt, Homo sapiens
gugcuggccuaugaacguu

SEQ ID NO: 846968 - RNA, 19 nt, Homo sapiens
aauccgaauugcccauaug

SEQ ID NO: 846969 - RNA, 19 nt, Homo sapiens
gaaggacaguuauauugaa

SEQ ID NO: 846970 - RNA, 19 nt, Homo sapiens
gaaguucucuugccuuugg

SEQ ID NO: 846971 - RNA, 19 nt, Homo sapiens
ggacaguuauauugaaguu

SEQ ID NO: 846972 - RNA, 19 nt, Homo sapiens
gaggauguauucagccuuu

SEQ ID NO: 846973 - RNA, 19 nt, Homo sapiens
uuacagcccugguggauaa

SEQ ID NO: 846974 - RNA, 19 nt, Homo sapiens
gaacauagugagacccuuu

SEQ ID NO: 846975 - RNA, 19 nt, Homo sapiens
gcagugagcuaugaucaug

SEQ ID NO: 846976 - RNA, 19 nt, Homo sapiens
ggagaaugaaggacaguua

SEQ ID NO: 846977 - RNA, 19 nt, Homo sapiens
caagaugucuccuuuaucg

SEQ ID NO: 846978 - RNA, 19 nt, Homo sapiens
gccaagaugucuccuuuau

SEQ ID NO: 846979 - RNA, 19 nt, Homo sapiens
gcucauugcucuuucuuuc

SEQ ID NO: 846980 - RNA, 19 nt, Homo sapiens
gagaguccauguuguacuu

SEQ ID NO: 846981 - RNA, 19 nt, Homo sapiens
ugggaguucuuauuuguua

SEQ ID NO: 846982 - RNA, 19 nt, Homo sapiens
gaggagcucuuuagacaag

SEQ ID NO: 846983 - RNA, 19 nt, Homo sapiens
gaagugaagaugcaaaugu

SEQ ID NO: 846984 - RNA, 19 nt, Homo sapiens
ccaguuacauggugaugaa

SEQ ID NO: 846985 - RNA, 19 nt, Homo sapiens
cugaagaguuuggaaauuu

SEQ ID NO: 846986 - RNA, 19 nt, Homo sapiens
gaugucuccuuuaucgaua

SEQ ID NO: 846987 - RNA, 19 nt, Homo sapiens
ggauaagauugauaugugu

SEQ ID NO: 846988 - RNA, 19 nt, Homo sapiens
gggcagugagccugaauua

SEQ ID NO: 846989 - RNA, 19 nt, Homo sapiens
guuacauggugaugaauuu

SEQ ID NO: 846990 - RNA, 19 nt, Homo sapiens
gcccagaacaggacauuaa

SEQ ID NO: 846991 - RNA, 19 nt, Homo sapiens
gagaaauauuugacuguuc

SEQ ID NO: 846992 - RNA, 19 nt, Homo sapiens
gaaugaaggacaguuauau

SEQ ID NO: 846993 - RNA, 19 nt, Homo sapiens
gcaccuguagucccaguua

SEQ ID NO: 846994 - RNA, 19 nt, Homo sapiens
gaggaaggcauaugaacuu

SEQ ID NO: 846995 - RNA, 19 nt, Homo sapiens
ugaagaguuuggaaauuug

SEQ ID NO: 846996 - RNA, 19 nt, Homo sapiens
gaucuuuggugguuuccuu

SEQ ID NO: 846997 - RNA, 19 nt, Homo sapiens
acagugacgugguaucuga

SEQ ID NO: 846998 - RNA, 19 nt, Homo sapiens
gaacuugcgugggcuacug

SEQ ID NO: 846999 - RNA, 19 nt, Homo sapiens
uggauaagauugauaugug

SEQ ID NO: 847000 - RNA, 19 nt, Homo sapiens
gagccugaauuacgagaga

SEQ ID NO: 847001 - RNA, 19 nt, Homo sapiens
ggaagaaaggaaauuacuu

SEQ ID NO: 847002 - RNA, 19 nt, Homo sapiens
gcuuguagcuuuggugguu

SEQ ID NO: 847003 - RNA, 19 nt, Homo sapiens
gagaggaccaccauacaug

SEQ ID NO: 847004 - RNA, 19 nt, Homo sapiens
uaaguucaguggccauguu

SEQ ID NO: 847005 - RNA, 19 nt, Homo sapiens
ccgccaagaugucuccuuu

SEQ ID NO: 847006 - RNA, 19 nt, Homo sapiens
cagguaugcuuuacucaga

SEQ ID NO: 847007 - RNA, 19 nt, Homo sapiens
gcaggauucuugaggaucu

SEQ ID NO: 847008 - RNA, 19 nt, Homo sapiens
cguaagauuuggcaggauu

SEQ ID NO: 847009 - RNA, 19 nt, Homo sapiens
gaccugaucgaguguauug

SEQ ID NO: 847010 - RNA, 19 nt, Homo sapiens
ccuaagaacaccacauuug

SEQ ID NO: 847011 - RNA, 19 nt, Homo sapiens
gauccaaagacuauaaguu

SEQ ID NO: 847012 - RNA, 19 nt, Homo sapiens
agacauccauggaagugaa

SEQ ID NO: 847013 - RNA, 19 nt, Homo sapiens
ugaaggacaguuauauuga

SEQ ID NO: 847014 - RNA, 19 nt, Homo sapiens
gagauaaguugcgggagau

SEQ ID NO: 847015 - RNA, 19 nt, Homo sapiens
gaugcaaauguuccaguua

SEQ ID NO: 847016 - RNA, 19 nt, Homo sapiens
gaagacauccauggaagug

SEQ ID NO: 847017 - RNA, 19 nt, Homo sapiens
cagaacaggacauuaaguu

SEQ ID NO: 847018 - RNA, 19 nt, Homo sapiens
cauguugccucccaucuuc

SEQ ID NO: 847019 - RNA, 19 nt, Homo sapiens
ucacagguaugcuuuacuc

SEQ ID NO: 847020 - RNA, 19 nt, Homo sapiens
aaagaagugccauugguuu

SEQ ID NO: 847021 - RNA, 19 nt, Homo sapiens
gcagugagccugaauuacg

SEQ ID NO: 847022 - RNA, 19 nt, Homo sapiens
gcuugggaguucuuauuug

SEQ ID NO: 847023 - RNA, 19 nt, Homo sapiens
gagaaugaaggacaguuau

SEQ ID NO: 847024 - RNA, 19 nt, Homo sapiens
ucauugcucuuucuuucuu

SEQ ID NO: 847025 - RNA, 19 nt, Homo sapiens
aaucggaucuuuggugguu

SEQ ID NO: 847026 - RNA, 19 nt, Homo sapiens
caguguggauggagaauuc

SEQ ID NO: 847027 - RNA, 19 nt, Homo sapiens
ucagcacacuggauccaaa

SEQ ID NO: 847028 - RNA, 19 nt, Homo sapiens
gcacccugcguucgagaua

SEQ ID NO: 847029 - RNA, 19 nt, Homo sapiens
ccuuuaggaugaucagaaa

SEQ ID NO: 847030 - RNA, 19 nt, Homo sapiens
gaucgaguguauugauuuu

SEQ ID NO: 847031 - RNA, 19 nt, Homo sapiens
gcccagcgaccuugagaaa

SEQ ID NO: 847032 - RNA, 19 nt, Homo sapiens
aagugaagaugcaaauguu

SEQ ID NO: 847033 - RNA, 19 nt, Homo sapiens
ucuccuuuaucgauaguua

SEQ ID NO: 847034 - RNA, 19 nt, Homo sapiens
cauaguuucuuggcuaaau

SEQ ID NO: 847035 - RNA, 19 nt, Homo sapiens
ugaaggcaauggaagaaag

SEQ ID NO: 847036 - RNA, 19 nt, Homo sapiens
gugaguggauugcuugagu

SEQ ID NO: 847037 - RNA, 19 nt, Homo sapiens
ccacauuuguugaaaacua

SEQ ID NO: 847038 - RNA, 19 nt, Homo sapiens
ggaccaccauacaugagau

SEQ ID NO: 847039 - RNA, 19 nt, Homo sapiens
gagaccaugugaaggcaau

SEQ ID NO: 847040 - RNA, 19 nt, Homo sapiens
ucaaaacaccguaagauuu

SEQ ID NO: 847041 - RNA, 19 nt, Homo sapiens
agaaugaaggacaguuaua

SEQ ID NO: 847042 - RNA, 19 nt, Homo sapiens
gcccuaagaacaccacauu

SEQ ID NO: 847043 - RNA, 19 nt, Homo sapiens
gagagaaauauuugacugu

SEQ ID NO: 847044 - RNA, 19 nt, Homo sapiens
uugaaguucucuugccuuu

SEQ ID NO: 847045 - RNA, 19 nt, Homo sapiens
ggagaggaccaccauacau

SEQ ID NO: 847046 - RNA, 19 nt, Homo sapiens
guaaugguggcucgugauu

SEQ ID NO: 847047 - RNA, 19 nt, Homo sapiens
guaggagcauccacaaacu

SEQ ID NO: 847048 - RNA, 19 nt, Homo sapiens
cuaagaacaccacauuugu

SEQ ID NO: 847049 - RNA, 19 nt, Homo sapiens
gaacaaggggagaagaauu

SEQ ID NO: 847050 - RNA, 19 nt, Homo sapiens
gaguuugagucugcaguga

SEQ ID NO: 847051 - RNA, 19 nt, Homo sapiens
ccucaggagcggaacauuu

SEQ ID NO: 847052 - RNA, 19 nt, Homo sapiens
uugaggaucuugacagcuu

SEQ ID NO: 847053 - RNA, 19 nt, Homo sapiens
uauucagccuuuaggauga

SEQ ID NO: 847054 - RNA, 19 nt, Homo sapiens
ccacacaggaggaggaugu

SEQ ID NO: 847055 - RNA, 19 nt, Homo sapiens
cagcauacaaccaccaaug

SEQ ID NO: 847056 - RNA, 19 nt, Homo sapiens
gguaugcuuuacucagaau

SEQ ID NO: 847057 - RNA, 19 nt, Homo sapiens
ggcaauggaagaaaggaaa

SEQ ID NO: 847058 - RNA, 19 nt, Homo sapiens
gcaauggaagaaaggaaau

SEQ ID NO: 847059 - RNA, 19 nt, Homo sapiens
gaggagaggaccaccauac

SEQ ID NO: 847060 - RNA, 19 nt, Homo sapiens
cagcuugggaguucuuauu

SEQ ID NO: 847061 - RNA, 19 nt, Homo sapiens
ugaggugaguggauugcuu

SEQ ID NO: 847062 - RNA, 19 nt, Homo sapiens
gaucagaaaagcagaaaga

SEQ ID NO: 847063 - RNA, 19 nt, Homo sapiens
cgugguaucugaugaagac

SEQ ID NO: 847064 - RNA, 19 nt, Homo sapiens
ccauggaagugaagaugca

SEQ ID NO: 847065 - RNA, 19 nt, Homo sapiens
cagugagccugaauuacga

SEQ ID NO: 847066 - RNA, 19 nt, Homo sapiens
ggaagacauccauggaagu

SEQ ID NO: 847067 - RNA, 19 nt, Homo sapiens
uuuggugguuuccuuauga

SEQ ID NO: 847068 - RNA, 19 nt, Homo sapiens
acugaagaguuuggaaauu

SEQ ID NO: 847069 - RNA, 19 nt, Homo sapiens
ccaauggucuuuagaaaua

SEQ ID NO: 847070 - RNA, 19 nt, Homo sapiens
gcacggagaugcugcacaa

SEQ ID NO: 847071 - RNA, 19 nt, Homo sapiens
caacaaagaaggccagaaa

SEQ ID NO: 847072 - RNA, 19 nt, Homo sapiens
gcagguggcuugugagauc

SEQ ID NO: 847073 - RNA, 19 nt, Homo sapiens
ggcaagaucuuccgugaug

SEQ ID NO: 847074 - RNA, 19 nt, Homo sapiens
aaaccgcagucacacauua

SEQ ID NO: 847075 - RNA, 19 nt, Homo sapiens
cacauuaggguuaguauua

SEQ ID NO: 847076 - RNA, 19 nt, Homo sapiens
gaucuuccgugauguguau

SEQ ID NO: 847077 - RNA, 19 nt, Homo sapiens
gaacaaacacauccagaag

SEQ ID NO: 847078 - RNA, 19 nt, Homo sapiens
gguaagguguucacugaug

SEQ ID NO: 847079 - RNA, 19 nt, Homo sapiens
gugguaagguguucacuga

SEQ ID NO: 847080 - RNA, 19 nt, Homo sapiens
ggagggaagugauguuugg

SEQ ID NO: 847081 - RNA, 19 nt, Homo sapiens
ccaaaucuaugauauucug

SEQ ID NO: 847082 - RNA, 19 nt, Homo sapiens
ugagagcucugacuccuau

SEQ ID NO: 847083 - RNA, 19 nt, Homo sapiens
gaaauaucaaugagacuug

SEQ ID NO: 847084 - RNA, 19 nt, Homo sapiens
gaaaugcucacaucaggau

SEQ ID NO: 847085 - RNA, 19 nt, Homo sapiens
ucaagcaggugcacacuuc

SEQ ID NO: 847086 - RNA, 19 nt, Homo sapiens
gaaaagaccgcauguccua

SEQ ID NO: 847087 - RNA, 19 nt, Homo sapiens
ggacuugggcuucccuuug

SEQ ID NO: 847088 - RNA, 19 nt, Homo sapiens
ugaagucuauggaagaaau

SEQ ID NO: 847089 - RNA, 19 nt, Homo sapiens
gaccaguuguagugaauug

SEQ ID NO: 847090 - RNA, 19 nt, Homo sapiens
ugucagaccugcaaugcuu

SEQ ID NO: 847091 - RNA, 19 nt, Homo sapiens
gaauugcuacugaaagcua

SEQ ID NO: 847092 - RNA, 19 nt, Homo sapiens
gcauuugcgucaucuuuag

SEQ ID NO: 847093 - RNA, 19 nt, Homo sapiens
gaagugauguuuggguucu

SEQ ID NO: 847094 - RNA, 19 nt, Homo sapiens
gcugggaaaugcugugaau

SEQ ID NO: 847095 - RNA, 19 nt, Homo sapiens
ggccagaaaugcucacauc

SEQ ID NO: 847096 - RNA, 19 nt, Homo sapiens
ggaccuauggcaacaaaga

SEQ ID NO: 847097 - RNA, 19 nt, Homo sapiens
caucaaacaguccaacgua

SEQ ID NO: 847098 - RNA, 19 nt, Homo sapiens
gccaggaagucaucaaaca

SEQ ID NO: 847099 - RNA, 19 nt, Homo sapiens
caacguacagauccuggua

SEQ ID NO: 847100 - RNA, 19 nt, Homo sapiens
cccagcaacuucugcagua

SEQ ID NO: 847101 - RNA, 19 nt, Homo sapiens
gcuaguugauuguuugaag

SEQ ID NO: 847102 - RNA, 19 nt, Homo sapiens
ggugcucaauucuuaguga

SEQ ID NO: 847103 - RNA, 19 nt, Homo sapiens
gaagucuauggaagaaaua

SEQ ID NO: 847104 - RNA, 19 nt, Homo sapiens
uuuaguagauccugagguu

SEQ ID NO: 847105 - RNA, 19 nt, Homo sapiens
gaaguacccaugcccugaa

SEQ ID NO: 847106 - RNA, 19 nt, Homo sapiens
acuaucagcuccaagguau

SEQ ID NO: 847107 - RNA, 19 nt, Homo sapiens
gacauuguguaccucaguu

SEQ ID NO: 847108 - RNA, 19 nt, Homo sapiens
ggguuaguauuaaacuuug

SEQ ID NO: 847109 - RNA, 19 nt, Homo sapiens
ggcauuugcgucaucuuua

SEQ ID NO: 847110 - RNA, 19 nt, Homo sapiens
gcccuuggcucaccuuucu

SEQ ID NO: 847111 - RNA, 19 nt, Homo sapiens
acaaacacauccagaaggu

SEQ ID NO: 847112 - RNA, 19 nt, Homo sapiens
gggcuucccuuuggacaug

SEQ ID NO: 847113 - RNA, 19 nt, Homo sapiens
ucugggaccucagugauuu

SEQ ID NO: 847114 - RNA, 19 nt, Homo sapiens
acaaagaaggccagaaaug

SEQ ID NO: 847115 - RNA, 19 nt, Homo sapiens
caggaccuauggcaacaaa

SEQ ID NO: 847116 - RNA, 19 nt, Homo sapiens
uuucaguucuuacgugauu

SEQ ID NO: 847117 - RNA, 19 nt, Homo sapiens
ggguugcgguucaagagaa

SEQ ID NO: 847118 - RNA, 19 nt, Homo sapiens
ggagagcuuucccgaacuc

SEQ ID NO: 847119 - RNA, 19 nt, Homo sapiens
ccaccuggccugucaugaa

SEQ ID NO: 847120 - RNA, 19 nt, Homo sapiens
caaagaaggccagaaaugc

SEQ ID NO: 847121 - RNA, 19 nt, Homo sapiens
ugaggucgguuaucgagau

SEQ ID NO: 847122 - RNA, 19 nt, Homo sapiens
uaucagcuccaagguauuu

SEQ ID NO: 847123 - RNA, 19 nt, Homo sapiens
gaccuugugaugugaauug

SEQ ID NO: 847124 - RNA, 19 nt, Homo sapiens
gcagguagggacauugugu

SEQ ID NO: 847125 - RNA, 19 nt, Homo sapiens
ucccaauggucuuuagaaa

SEQ ID NO: 847126 - RNA, 19 nt, Homo sapiens
ugaacaaacacauccagaa

SEQ ID NO: 847127 - RNA, 19 nt, Homo sapiens
ccaauccuauacccaaauc

SEQ ID NO: 847128 - RNA, 19 nt, Homo sapiens
uccuggugcucaauucuua

SEQ ID NO: 847129 - RNA, 19 nt, Homo sapiens
aaaacaaaauggagucuga

SEQ ID NO: 847130 - RNA, 19 nt, Homo sapiens
cugcuggacucaauguuug

SEQ ID NO: 847131 - RNA, 19 nt, Homo sapiens
gagcuuucccgaacucaug

SEQ ID NO: 847132 - RNA, 19 nt, Homo sapiens
cuccaggccugaucacuug

SEQ ID NO: 847133 - RNA, 19 nt, Homo sapiens
ccaaccugcuggacucaau

SEQ ID NO: 847134 - RNA, 19 nt, Homo sapiens
gacuugggcuucccuuugg

SEQ ID NO: 847135 - RNA, 19 nt, Homo sapiens
guagggacauuguguaccu

SEQ ID NO: 847136 - RNA, 19 nt, Homo sapiens
guugauuguuugaagucua

SEQ ID NO: 847137 - RNA, 19 nt, Homo sapiens
cauccucccuucccauauc

SEQ ID NO: 847138 - RNA, 19 nt, Homo sapiens
cagaccaccugaagaagca

SEQ ID NO: 847139 - RNA, 19 nt, Homo sapiens
uggcagaccaccugaagaa

SEQ ID NO: 847140 - RNA, 19 nt, Homo sapiens
ugugagaucugcggcaaga

SEQ ID NO: 847141 - RNA, 19 nt, Homo sapiens
gccaaguuccugcugauga

SEQ ID NO: 847142 - RNA, 19 nt, Homo sapiens
acccaaaucuaugauauuc

SEQ ID NO: 847143 - RNA, 19 nt, Homo sapiens
ucaaugagacuugguaugg

SEQ ID NO: 847144 - RNA, 19 nt, Homo sapiens
uaguagauccugagguuga

SEQ ID NO: 847145 - RNA, 19 nt, Homo sapiens
caacuucugcaguaucugu

SEQ ID NO: 847146 - RNA, 19 nt, Homo sapiens
ccaaguuccugcugaugag

SEQ ID NO: 847147 - RNA, 19 nt, Homo sapiens
gugaauugcuacugaaagc

SEQ ID NO: 847148 - RNA, 19 nt, Homo sapiens
ccucgaguccuuuggguuu

SEQ ID NO: 847149 - RNA, 19 nt, Homo sapiens
gagcuggagaugcacacua

SEQ ID NO: 847150 - RNA, 19 nt, Homo sapiens
guaaaccgcagucacacau

SEQ ID NO: 847151 - RNA, 19 nt, Homo sapiens
gccagaagcaucccaugga

SEQ ID NO: 847152 - RNA, 19 nt, Homo sapiens
gggcagaaaacacuacaua

SEQ ID NO: 847153 - RNA, 19 nt, Homo sapiens
cuacuuaaagguccauguu

SEQ ID NO: 847154 - RNA, 19 nt, Homo sapiens
gcaagaucuuccgugaugu

SEQ ID NO: 847155 - RNA, 19 nt, Homo sapiens
cugaucagacuguauuaaa

SEQ ID NO: 847156 - RNA, 19 nt, Homo sapiens
caaugcggaugcccaacug

SEQ ID NO: 847157 - RNA, 19 nt, Homo sapiens
gguugcgguucaagagaaa

SEQ ID NO: 847158 - RNA, 19 nt, Homo sapiens
ggucuccaccuacuuauac

SEQ ID NO: 847159 - RNA, 19 nt, Homo sapiens
ccuauacccaaaucuauga

SEQ ID NO: 847160 - RNA, 19 nt, Homo sapiens
guacccaugcccugaaugu

SEQ ID NO: 847161 - RNA, 19 nt, Homo sapiens
caccuggccugucaugaag

SEQ ID NO: 847162 - RNA, 19 nt, Homo sapiens
ggacauuguguaccucagu

SEQ ID NO: 847163 - RNA, 19 nt, Homo sapiens
gggugaguguccuccaaga

SEQ ID NO: 847164 - RNA, 19 nt, Homo sapiens
ccaccuacuuauacaaugc

SEQ ID NO: 847165 - RNA, 19 nt, Homo sapiens
gcggagggaagugauguuu

SEQ ID NO: 847166 - RNA, 19 nt, Homo sapiens
gaccugcaaugcuucuuuu

SEQ ID NO: 847167 - RNA, 19 nt, Homo sapiens
ucacacauuaggguuagua

SEQ ID NO: 847168 - RNA, 19 nt, Homo sapiens
ugaagacgccagagaagca

SEQ ID NO: 847169 - RNA, 19 nt, Homo sapiens
ccaauggucuuuagaaaua

SEQ ID NO: 847170 - RNA, 19 nt, Homo sapiens
gcacggagaugcugcacaa

SEQ ID NO: 847171 - RNA, 19 nt, Homo sapiens
gcagguggcuugugagauc

SEQ ID NO: 847172 - RNA, 19 nt, Homo sapiens
ggcaagaucuuccgugaug

SEQ ID NO: 847173 - RNA, 19 nt, Homo sapiens
aaaccgcagucacacauua

SEQ ID NO: 847174 - RNA, 19 nt, Homo sapiens
cacauuaggguuaguauua

SEQ ID NO: 847175 - RNA, 19 nt, Homo sapiens
gaucuuccgugauguguau

SEQ ID NO: 847176 - RNA, 19 nt, Homo sapiens
gaacaaacacauccagaag

SEQ ID NO: 847177 - RNA, 19 nt, Homo sapiens
gguaagguguucacugaug

SEQ ID NO: 847178 - RNA, 19 nt, Homo sapiens
gugguaagguguucacuga

SEQ ID NO: 847179 - RNA, 19 nt, Homo sapiens
ggagggaagugauguuugg

SEQ ID NO: 847180 - RNA, 19 nt, Homo sapiens
ccaaaucuaugauauucug

SEQ ID NO: 847181 - RNA, 19 nt, Homo sapiens
ugagagcucugacuccuau

SEQ ID NO: 847182 - RNA, 19 nt, Homo sapiens
gaaauaucaaugagacuug

SEQ ID NO: 847183 - RNA, 19 nt, Homo sapiens
gaaaugcucacaucaggau

SEQ ID NO: 847184 - RNA, 19 nt, Homo sapiens
ucaagcaggugcacacuuc

SEQ ID NO: 847185 - RNA, 19 nt, Homo sapiens
gaaaagaccgcauguccua

SEQ ID NO: 847186 - RNA, 19 nt, Homo sapiens
ggacuugggcuucccuuug

SEQ ID NO: 847187 - RNA, 19 nt, Homo sapiens
ugaagucuauggaagaaau

SEQ ID NO: 847188 - RNA, 19 nt, Homo sapiens
gaccaguuguagugaauug

SEQ ID NO: 847189 - RNA, 19 nt, Homo sapiens
ugucagaccugcaaugcuu

SEQ ID NO: 847190 - RNA, 19 nt, Homo sapiens
gaauugcuacugaaagcua

SEQ ID NO: 847191 - RNA, 19 nt, Homo sapiens
gcauuugcgucaucuuuag

SEQ ID NO: 847192 - RNA, 19 nt, Homo sapiens
gaagugauguuuggguucu

SEQ ID NO: 847193 - RNA, 19 nt, Homo sapiens
gcugggaaaugcugugaau

SEQ ID NO: 847194 - RNA, 19 nt, Homo sapiens
ggccagaaaugcucacauc

SEQ ID NO: 847195 - RNA, 19 nt, Homo sapiens
caucaaacaguccaacgua

SEQ ID NO: 847196 - RNA, 19 nt, Homo sapiens
gccaggaagucaucaaaca

SEQ ID NO: 847197 - RNA, 19 nt, Homo sapiens
caacguacagauccuggua

SEQ ID NO: 847198 - RNA, 19 nt, Homo sapiens
cccagcaacuucugcagua

SEQ ID NO: 847199 - RNA, 19 nt, Homo sapiens
gcuaguugauuguuugaag

SEQ ID NO: 847200 - RNA, 19 nt, Homo sapiens
ggugcucaauucuuaguga

SEQ ID NO: 847201 - RNA, 19 nt, Homo sapiens
gaagucuauggaagaaaua

SEQ ID NO: 847202 - RNA, 19 nt, Homo sapiens
uuuaguagauccugagguu

SEQ ID NO: 847203 - RNA, 19 nt, Homo sapiens
gaaguacccaugcccugaa

SEQ ID NO: 847204 - RNA, 19 nt, Homo sapiens
uaaccgagaaggccagaaa

SEQ ID NO: 847205 - RNA, 19 nt, Homo sapiens
acuaucagcuccaagguau

SEQ ID NO: 847206 - RNA, 19 nt, Homo sapiens
gacauuguguaccucaguu

SEQ ID NO: 847207 - RNA, 19 nt, Homo sapiens
ggguuaguauuaaacuuug

SEQ ID NO: 847208 - RNA, 19 nt, Homo sapiens
ggcauuugcgucaucuuua

SEQ ID NO: 847209 - RNA, 19 nt, Homo sapiens
gcccuuggcucaccuuucu

SEQ ID NO: 847210 - RNA, 19 nt, Homo sapiens
acaaacacauccagaaggu

SEQ ID NO: 847211 - RNA, 19 nt, Homo sapiens
gggcuucccuuuggacaug

SEQ ID NO: 847212 - RNA, 19 nt, Homo sapiens
ucugggaccucagugauuu

SEQ ID NO: 847213 - RNA, 19 nt, Homo sapiens
uuucaguucuuacgugauu

SEQ ID NO: 847214 - RNA, 19 nt, Homo sapiens
ggguugcgguucaagagaa

SEQ ID NO: 847215 - RNA, 19 nt, Homo sapiens
ggagagcuuucccgaacuc

SEQ ID NO: 847216 - RNA, 19 nt, Homo sapiens
ccaccuggccugucaugaa

SEQ ID NO: 847217 - RNA, 19 nt, Homo sapiens
ugaggucgguuaucgagau

SEQ ID NO: 847218 - RNA, 19 nt, Homo sapiens
uaucagcuccaagguauuu

SEQ ID NO: 847219 - RNA, 19 nt, Homo sapiens
gaccuugugaugugaauug

SEQ ID NO: 847220 - RNA, 19 nt, Homo sapiens
gcagguagggacauugugu

SEQ ID NO: 847221 - RNA, 19 nt, Homo sapiens
ucccaauggucuuuagaaa

SEQ ID NO: 847222 - RNA, 19 nt, Homo sapiens
ugaacaaacacauccagaa

SEQ ID NO: 847223 - RNA, 19 nt, Homo sapiens
ccaauccuauacccaaauc

SEQ ID NO: 847224 - RNA, 19 nt, Homo sapiens
uccuggugcucaauucuua

SEQ ID NO: 847225 - RNA, 19 nt, Homo sapiens
aaaacaaaauggagucuga

SEQ ID NO: 847226 - RNA, 19 nt, Homo sapiens
cugcuggacucaauguuug

SEQ ID NO: 847227 - RNA, 19 nt, Homo sapiens
gagcuuucccgaacucaug

SEQ ID NO: 847228 - RNA, 19 nt, Homo sapiens
cuccaggccugaucacuug

SEQ ID NO: 847229 - RNA, 19 nt, Homo sapiens
ccaaccugcuggacucaau

SEQ ID NO: 847230 - RNA, 19 nt, Homo sapiens
gacuugggcuucccuuugg

SEQ ID NO: 847231 - RNA, 19 nt, Homo sapiens
guagggacauuguguaccu

SEQ ID NO: 847232 - RNA, 19 nt, Homo sapiens
guugauuguuugaagucua

SEQ ID NO: 847233 - RNA, 19 nt, Homo sapiens
cauccucccuucccauauc

SEQ ID NO: 847234 - RNA, 19 nt, Homo sapiens
cagaccaccugaagaagca

SEQ ID NO: 847235 - RNA, 19 nt, Homo sapiens
uggcagaccaccugaagaa

SEQ ID NO: 847236 - RNA, 19 nt, Homo sapiens
ugugagaucugcggcaaga

SEQ ID NO: 847237 - RNA, 19 nt, Homo sapiens
gccaaguuccugcugauga

SEQ ID NO: 847238 - RNA, 19 nt, Homo sapiens
acccaaaucuaugauauuc

SEQ ID NO: 847239 - RNA, 19 nt, Homo sapiens
ucaaugagacuugguaugg

SEQ ID NO: 847240 - RNA, 19 nt, Homo sapiens
uaguagauccugagguuga

SEQ ID NO: 847241 - RNA, 19 nt, Homo sapiens
caacuucugcaguaucugu

SEQ ID NO: 847242 - RNA, 19 nt, Homo sapiens
ccaaguuccugcugaugag

SEQ ID NO: 847243 - RNA, 19 nt, Homo sapiens
gagcuggagaugcacacua

SEQ ID NO: 847244 - RNA, 19 nt, Homo sapiens
gugaauugcuacugaaagc

SEQ ID NO: 847245 - RNA, 19 nt, Homo sapiens
ccucgaguccuuuggguuu

SEQ ID NO: 847246 - RNA, 19 nt, Homo sapiens
guaaaccgcagucacacau

SEQ ID NO: 847247 - RNA, 19 nt, Homo sapiens
gccagaagcaucccaugga

SEQ ID NO: 847248 - RNA, 19 nt, Homo sapiens
gggcagaaaacacuacaua

SEQ ID NO: 847249 - RNA, 19 nt, Homo sapiens
gcaagaucuuccgugaugu

SEQ ID NO: 847250 - RNA, 19 nt, Homo sapiens
cugaucagacuguauuaaa

SEQ ID NO: 847251 - RNA, 19 nt, Homo sapiens
caaugcggaugcccaacug

SEQ ID NO: 847252 - RNA, 19 nt, Homo sapiens
gguugcgguucaagagaaa

SEQ ID NO: 847253 - RNA, 19 nt, Homo sapiens
ggucuccaccuacuuauac

SEQ ID NO: 847254 - RNA, 19 nt, Homo sapiens
ccuauacccaaaucuauga

SEQ ID NO: 847255 - RNA, 19 nt, Homo sapiens
guacccaugcccugaaugu

SEQ ID NO: 847256 - RNA, 19 nt, Homo sapiens
caccuggccugucaugaag

SEQ ID NO: 847257 - RNA, 19 nt, Homo sapiens
ggacauuguguaccucagu

SEQ ID NO: 847258 - RNA, 19 nt, Homo sapiens
gggugaguguccuccaaga

SEQ ID NO: 847259 - RNA, 19 nt, Homo sapiens
ccaccuacuuauacaaugc

SEQ ID NO: 847260 - RNA, 19 nt, Homo sapiens
gcggagggaagugauguuu

SEQ ID NO: 847261 - RNA, 19 nt, Homo sapiens
caguaucuguaaccgagaa

SEQ ID NO: 847262 - RNA, 19 nt, Homo sapiens
gaccugcaaugcuucuuuu

SEQ ID NO: 847263 - RNA, 19 nt, Homo sapiens
ucacacauuaggguuagua

SEQ ID NO: 847264 - RNA, 19 nt, Homo sapiens
ugaagacgccagagaagca

SEQ ID NO: 847265 - RNA, 19 nt, Homo sapiens
ugccagagcugugggaaag

SEQ ID NO: 847266 - RNA, 19 nt, Homo sapiens
caagaucuuccgugaugug

SEQ ID NO: 847267 - RNA, 19 nt, Homo sapiens
gagggaggcaggcauccuu

SEQ ID NO: 847268 - RNA, 19 nt, Homo sapiens
gcgccgauauaaugcucuu

SEQ ID NO: 847269 - RNA, 19 nt, Homo sapiens
gaacaggagugaugauaaa

SEQ ID NO: 847270 - RNA, 19 nt, Homo sapiens
gaaccaaacuaaugaguag

SEQ ID NO: 847271 - RNA, 19 nt, Homo sapiens
gcacggagaugcugcacaa

SEQ ID NO: 847272 - RNA, 19 nt, Homo sapiens
ggaacuagccaccagcuua

SEQ ID NO: 847273 - RNA, 19 nt, Homo sapiens
gcagguggcuugugagauc

SEQ ID NO: 847274 - RNA, 19 nt, Homo sapiens
ggcaagaucuuccgugaug

SEQ ID NO: 847275 - RNA, 19 nt, Homo sapiens
gaucuuccgugauguguau

SEQ ID NO: 847276 - RNA, 19 nt, Homo sapiens
agagaagacuggcacaauu

SEQ ID NO: 847277 - RNA, 19 nt, Homo sapiens
gguaagguguucacugaug

SEQ ID NO: 847278 - RNA, 19 nt, Homo sapiens
gugguaagguguucacuga

SEQ ID NO: 847279 - RNA, 19 nt, Homo sapiens
ggaaccaaacuaaugagua

SEQ ID NO: 847280 - RNA, 19 nt, Homo sapiens
gaacuagccaccagcuuau

SEQ ID NO: 847281 - RNA, 19 nt, Homo sapiens
ucaagcaggugcacacuuc

SEQ ID NO: 847282 - RNA, 19 nt, Homo sapiens
gaaaagaccgcauguccua

SEQ ID NO: 847283 - RNA, 19 nt, Homo sapiens
ggacuugggcuucccuuug

SEQ ID NO: 847284 - RNA, 19 nt, Homo sapiens
caucaaacaguccaacgua

SEQ ID NO: 847285 - RNA, 19 nt, Homo sapiens
gccaggaagucaucaaaca

SEQ ID NO: 847286 - RNA, 19 nt, Homo sapiens
gagaagacuggcacaauuc

SEQ ID NO: 847287 - RNA, 19 nt, Homo sapiens
caacguacagauccuggua

SEQ ID NO: 847288 - RNA, 19 nt, Homo sapiens
acuaucagcuccaagguau

SEQ ID NO: 847289 - RNA, 19 nt, Homo sapiens
ucaggaaccaaacuaauga

SEQ ID NO: 847290 - RNA, 19 nt, Homo sapiens
gggcuucccuuuggacaug

SEQ ID NO: 847291 - RNA, 19 nt, Homo sapiens
augaguagcuuuauauugg

SEQ ID NO: 847292 - RNA, 19 nt, Homo sapiens
gccaccagcuuaucugcuu

SEQ ID NO: 847293 - RNA, 19 nt, Homo sapiens
ucuagauccugcuuucauu

SEQ ID NO: 847294 - RNA, 19 nt, Homo sapiens
gcacaauuccaacuagagu

SEQ ID NO: 847295 - RNA, 19 nt, Homo sapiens
cuagcgaccugccaucaug

SEQ ID NO: 847296 - RNA, 19 nt, Homo sapiens
ggguugcgguucaagagaa

SEQ ID NO: 847297 - RNA, 19 nt, Homo sapiens
ggagagcuuucccgaacuc

SEQ ID NO: 847298 - RNA, 19 nt, Homo sapiens
ugaacaggagugaugauaa

SEQ ID NO: 847299 - RNA, 19 nt, Homo sapiens
uuucauuucuggcuaguga

SEQ ID NO: 847300 - RNA, 19 nt, Homo sapiens
ugaggucgguuaucgagau

SEQ ID NO: 847301 - RNA, 19 nt, Homo sapiens
uaucagcuccaagguauuu

SEQ ID NO: 847302 - RNA, 19 nt, Homo sapiens
ccucugcccuucccacuca

SEQ ID NO: 847303 - RNA, 19 nt, Homo sapiens
gagggcagcagggccuuua

SEQ ID NO: 847304 - RNA, 19 nt, Homo sapiens
ucugggcucucuugccuuu

SEQ ID NO: 847305 - RNA, 19 nt, Homo sapiens
cugcuggacucaauguuug

SEQ ID NO: 847306 - RNA, 19 nt, Homo sapiens
gagcuuucccgaacucaug

SEQ ID NO: 847307 - RNA, 19 nt, Homo sapiens
gugaacaggagugaugaua

SEQ ID NO: 847308 - RNA, 19 nt, Homo sapiens
cuccaggccugaucacuug

SEQ ID NO: 847309 - RNA, 19 nt, Homo sapiens
ccaaccugcuggacucaau

SEQ ID NO: 847310 - RNA, 19 nt, Homo sapiens
gacuugggcuucccuuugg

SEQ ID NO: 847311 - RNA, 19 nt, Homo sapiens
cccuauagcauccaaguuu

SEQ ID NO: 847312 - RNA, 19 nt, Homo sapiens
ugugagaucugcggcaaga

SEQ ID NO: 847313 - RNA, 19 nt, Homo sapiens
gccaaguuccugcugauga

SEQ ID NO: 847314 - RNA, 19 nt, Homo sapiens
ccagcacacuccagcaaca

SEQ ID NO: 847315 - RNA, 19 nt, Homo sapiens
ccaaguuccugcugaugag

SEQ ID NO: 847316 - RNA, 19 nt, Homo sapiens
caggagugaugauaaaauu

SEQ ID NO: 847317 - RNA, 19 nt, Homo sapiens
caaacuaaugaguagcuuu

SEQ ID NO: 847318 - RNA, 19 nt, Homo sapiens
gcucaggaaccaaacuaau

SEQ ID NO: 847319 - RNA, 19 nt, Homo sapiens
ggucugcucaggaaccaaa

SEQ ID NO: 847320 - RNA, 19 nt, Homo sapiens
gagcuggagaugcacacua

SEQ ID NO: 847321 - RNA, 19 nt, Homo sapiens
ccuauagcauccaaguuuc

SEQ ID NO: 847322 - RNA, 19 nt, Homo sapiens
gcaagaucuuccgugaugu

SEQ ID NO: 847323 - RNA, 19 nt, Homo sapiens
gcauccaaguuucuuucug

SEQ ID NO: 847324 - RNA, 19 nt, Homo sapiens
gguugcgguucaagagaaa

SEQ ID NO: 847325 - RNA, 19 nt, Homo sapiens
gauccugcuuucauuucug

SEQ ID NO: 847326 - RNA, 19 nt, Homo sapiens
uggcaucacuucccauagg

SEQ ID NO: 847327 - RNA, 19 nt, Homo sapiens
ugccagagcugugggaaag

SEQ ID NO: 847328 - RNA, 19 nt, Homo sapiens
caagaucuuccgugaugug

SEQ ID NO: 847329 - RNA, 19 nt, Homo sapiens
gagggaggcaggcauccuu

SEQ ID NO: 847330 - RNA, 19 nt, Homo sapiens
gcgccgauauaaugcucuu

SEQ ID NO: 847331 - RNA, 19 nt, Homo sapiens
cuagauccugcuuucauuu

SEQ ID NO: 847332 - RNA, 19 nt, Homo sapiens
gcagacacagcacggagau

SEQ ID NO: 847333 - RNA, 19 nt, Homo sapiens
cagagaagacuggcacaau

SEQ ID NO: 847334 - RNA, 19 nt, Homo sapiens
gcaccugcgagacuacaga

SEQ ID NO: 847335 - RNA, 19 nt, Homo sapiens
cgccuucgccuucgccuuu

SEQ ID NO: 847336 - RNA, 19 nt, Homo sapiens
ccaaacuaaugaguagcuu

SEQ ID NO: 847337 - RNA, 19 nt, Homo sapiens
uggcacaauuccaacuaga

SEQ ID NO: 847338 - RNA, 19 nt, Homo sapiens
ugagucggccuccagagaa

SEQ ID NO: 847339 - RNA, 19 nt, Homo sapiens
ucaaacaguccaacguaca

SEQ ID NO: 847340 - RNA, 19 nt, Homo sapiens
ccauggagcgggugaacga

SEQ ID NO: 847341 - RNA, 19 nt, Homo sapiens
gagucggccuccagagaag

SEQ ID NO: 847342 - RNA, 19 nt, Homo sapiens
cggagucuuucccauguca

SEQ ID NO: 847343 - RNA, 19 nt, Homo sapiens
ucacuugaacggacauauc

SEQ ID NO: 847344 - RNA, 19 nt, Homo sapiens
gcacaagcugucccacucu

SEQ ID NO: 847345 - RNA, 19 nt, Homo sapiens
gguguucagcgcccaguug

SEQ ID NO: 847346 - RNA, 19 nt, Homo sapiens
gugagucggccuccagaga

SEQ ID NO: 847347 - RNA, 19 nt, Homo sapiens
gaucugccaggaagucauc

SEQ ID NO: 847348 - RNA, 19 nt, Homo sapiens
ggucgguuaucgagaucug

SEQ ID NO: 847349 - RNA, 19 nt, Homo sapiens
cugcugaugaggucgguua

SEQ ID NO: 847350 - RNA, 19 nt, Homo sapiens
caugcggucuaugugguaa

SEQ ID NO: 847351 - RNA, 19 nt, Homo sapiens
ccugcuggacucaauguuu

SEQ ID NO: 847352 - RNA, 19 nt, Homo sapiens
gaggucgguuaucgagauc

SEQ ID NO: 847353 - RNA, 19 nt, Homo sapiens
caagguauuuggggacauu

SEQ ID NO: 847354 - RNA, 19 nt, Homo sapiens
gguccgugggcaagccuua

SEQ ID NO: 847355 - RNA, 19 nt, Homo sapiens
caggaagucaucaaacagu

SEQ ID NO: 847356 - RNA, 19 nt, Homo sapiens
ccuggcaucacuucccaua

SEQ ID NO: 847357 - RNA, 19 nt, Homo sapiens
ggcuacccaucucugaaga

SEQ ID NO: 847358 - RNA, 19 nt, Homo sapiens
gccgauauaaugcucuuuc

SEQ ID NO: 847359 - RNA, 19 nt, Homo sapiens
cuuauuggugugcccuuua

SEQ ID NO: 847360 - RNA, 19 nt, Homo sapiens
cauaccaggugagcagaca

SEQ ID NO: 847361 - RNA, 19 nt, Homo sapiens
acaauuccaacuagaguca

SEQ ID NO: 847362 - RNA, 19 nt, Homo sapiens
cacuugaacggacauauca

SEQ ID NO: 847363 - RNA, 19 nt, Homo sapiens
gggcuacccaucucugaag

SEQ ID NO: 847364 - RNA, 19 nt, Homo sapiens
ccaauggucuuuagaaaua

SEQ ID NO: 847365 - RNA, 19 nt, Homo sapiens
gcacggagaugcugcacaa

SEQ ID NO: 847366 - RNA, 19 nt, Homo sapiens
caacaaagaaggccagaaa

SEQ ID NO: 847367 - RNA, 19 nt, Homo sapiens
gcagguggcuugugagauc

SEQ ID NO: 847368 - RNA, 19 nt, Homo sapiens
ggcaagaucuuccgugaug

SEQ ID NO: 847369 - RNA, 19 nt, Homo sapiens
aaaccgcagucacacauua

SEQ ID NO: 847370 - RNA, 19 nt, Homo sapiens
cacauuaggguuaguauua

SEQ ID NO: 847371 - RNA, 19 nt, Homo sapiens
gaucuuccgugauguguau

SEQ ID NO: 847372 - RNA, 19 nt, Homo sapiens
gaacaaacacauccagaag

SEQ ID NO: 847373 - RNA, 19 nt, Homo sapiens
gguaagguguucacugaug

SEQ ID NO: 847374 - RNA, 19 nt, Homo sapiens
gugguaagguguucacuga

SEQ ID NO: 847375 - RNA, 19 nt, Homo sapiens
ggagggaagugauguuugg

SEQ ID NO: 847376 - RNA, 19 nt, Homo sapiens
ccaaaucuaugauauucug

SEQ ID NO: 847377 - RNA, 19 nt, Homo sapiens
ugagagcucugacuccuau

SEQ ID NO: 847378 - RNA, 19 nt, Homo sapiens
gaaauaucaaugagacuug

SEQ ID NO: 847379 - RNA, 19 nt, Homo sapiens
gaaaugcucacaucaggau

SEQ ID NO: 847380 - RNA, 19 nt, Homo sapiens
ucaagcaggugcacacuuc

SEQ ID NO: 847381 - RNA, 19 nt, Homo sapiens
gaaaagaccgcauguccua

SEQ ID NO: 847382 - RNA, 19 nt, Homo sapiens
ggacuugggcuucccuuug

SEQ ID NO: 847383 - RNA, 19 nt, Homo sapiens
ugaagucuauggaagaaau

SEQ ID NO: 847384 - RNA, 19 nt, Homo sapiens
gaccaguuguagugaauug

SEQ ID NO: 847385 - RNA, 19 nt, Homo sapiens
ugucagaccugcaaugcuu

SEQ ID NO: 847386 - RNA, 19 nt, Homo sapiens
gaauugcuacugaaagcua

SEQ ID NO: 847387 - RNA, 19 nt, Homo sapiens
gcauuugcgucaucuuuag

SEQ ID NO: 847388 - RNA, 19 nt, Homo sapiens
gaagugauguuuggguucu

SEQ ID NO: 847389 - RNA, 19 nt, Homo sapiens
gcugggaaaugcugugaau

SEQ ID NO: 847390 - RNA, 19 nt, Homo sapiens
ggccagaaaugcucacauc

SEQ ID NO: 847391 - RNA, 19 nt, Homo sapiens
ggaccuauggcaacaaaga

SEQ ID NO: 847392 - RNA, 19 nt, Homo sapiens
caucaaacaguccaacgua

SEQ ID NO: 847393 - RNA, 19 nt, Homo sapiens
gccaggaagucaucaaaca

SEQ ID NO: 847394 - RNA, 19 nt, Homo sapiens
caacguacagauccuggua

SEQ ID NO: 847395 - RNA, 19 nt, Homo sapiens
cccagcaacuucugcagua

SEQ ID NO: 847396 - RNA, 19 nt, Homo sapiens
gcuaguugauuguuugaag

SEQ ID NO: 847397 - RNA, 19 nt, Homo sapiens
ggugcucaauucuuaguga

SEQ ID NO: 847398 - RNA, 19 nt, Homo sapiens
gaagucuauggaagaaaua

SEQ ID NO: 847399 - RNA, 19 nt, Homo sapiens
uuuaguagauccugagguu

SEQ ID NO: 847400 - RNA, 19 nt, Homo sapiens
gaaguacccaugcccugaa

SEQ ID NO: 847401 - RNA, 19 nt, Homo sapiens
acuaucagcuccaagguau

SEQ ID NO: 847402 - RNA, 19 nt, Homo sapiens
gacauuguguaccucaguu

SEQ ID NO: 847403 - RNA, 19 nt, Homo sapiens
ggguuaguauuaaacuuug

SEQ ID NO: 847404 - RNA, 19 nt, Homo sapiens
ggcauuugcgucaucuuua

SEQ ID NO: 847405 - RNA, 19 nt, Homo sapiens
gcccuuggcucaccuuucu

SEQ ID NO: 847406 - RNA, 19 nt, Homo sapiens
acaaacacauccagaaggu

SEQ ID NO: 847407 - RNA, 19 nt, Homo sapiens
gggcuucccuuuggacaug

SEQ ID NO: 847408 - RNA, 19 nt, Homo sapiens
ucugggaccucagugauuu

SEQ ID NO: 847409 - RNA, 19 nt, Homo sapiens
acaaagaaggccagaaaug

SEQ ID NO: 847410 - RNA, 19 nt, Homo sapiens
caggaccuauggcaacaaa

SEQ ID NO: 847411 - RNA, 19 nt, Homo sapiens
uuucaguucuuacgugauu

SEQ ID NO: 847412 - RNA, 19 nt, Homo sapiens
ggguugcgguucaagagaa

SEQ ID NO: 847413 - RNA, 19 nt, Homo sapiens
ggagagcuuucccgaacuc

SEQ ID NO: 847414 - RNA, 19 nt, Homo sapiens
ccaccuggccugucaugaa

SEQ ID NO: 847415 - RNA, 19 nt, Homo sapiens
caaagaaggccagaaaugc

SEQ ID NO: 847416 - RNA, 19 nt, Homo sapiens
ugaggucgguuaucgagau

SEQ ID NO: 847417 - RNA, 19 nt, Homo sapiens
uaucagcuccaagguauuu

SEQ ID NO: 847418 - RNA, 19 nt, Homo sapiens
gaccuugugaugugaauug

SEQ ID NO: 847419 - RNA, 19 nt, Homo sapiens
gcagguagggacauugugu

SEQ ID NO: 847420 - RNA, 19 nt, Homo sapiens
ucccaauggucuuuagaaa

SEQ ID NO: 847421 - RNA, 19 nt, Homo sapiens
ugaacaaacacauccagaa

SEQ ID NO: 847422 - RNA, 19 nt, Homo sapiens
ccaauccuauacccaaauc

SEQ ID NO: 847423 - RNA, 19 nt, Homo sapiens
uccuggugcucaauucuua

SEQ ID NO: 847424 - RNA, 19 nt, Homo sapiens
aaaacaaaauggagucuga

SEQ ID NO: 847425 - RNA, 19 nt, Homo sapiens
cugcuggacucaauguuug

SEQ ID NO: 847426 - RNA, 19 nt, Homo sapiens
gagcuuucccgaacucaug

SEQ ID NO: 847427 - RNA, 19 nt, Homo sapiens
cuccaggccugaucacuug

SEQ ID NO: 847428 - RNA, 19 nt, Homo sapiens
ccaaccugcuggacucaau

SEQ ID NO: 847429 - RNA, 19 nt, Homo sapiens
gacuugggcuucccuuugg

SEQ ID NO: 847430 - RNA, 19 nt, Homo sapiens
guagggacauuguguaccu

SEQ ID NO: 847431 - RNA, 19 nt, Homo sapiens
guugauuguuugaagucua

SEQ ID NO: 847432 - RNA, 19 nt, Homo sapiens
cauccucccuucccauauc

SEQ ID NO: 847433 - RNA, 19 nt, Homo sapiens
cagaccaccugaagaagca

SEQ ID NO: 847434 - RNA, 19 nt, Homo sapiens
uggcagaccaccugaagaa

SEQ ID NO: 847435 - RNA, 19 nt, Homo sapiens
ugugagaucugcggcaaga

SEQ ID NO: 847436 - RNA, 19 nt, Homo sapiens
gccaaguuccugcugauga

SEQ ID NO: 847437 - RNA, 19 nt, Homo sapiens
acccaaaucuaugauauuc

SEQ ID NO: 847438 - RNA, 19 nt, Homo sapiens
ucaaugagacuugguaugg

SEQ ID NO: 847439 - RNA, 19 nt, Homo sapiens
uaguagauccugagguuga

SEQ ID NO: 847440 - RNA, 19 nt, Homo sapiens
caacuucugcaguaucugu

SEQ ID NO: 847441 - RNA, 19 nt, Homo sapiens
ccaaguuccugcugaugag

SEQ ID NO: 847442 - RNA, 19 nt, Homo sapiens
gugaauugcuacugaaagc

SEQ ID NO: 847443 - RNA, 19 nt, Homo sapiens
ccucgaguccuuuggguuu

SEQ ID NO: 847444 - RNA, 19 nt, Homo sapiens
gagcuggagaugcacacua

SEQ ID NO: 847445 - RNA, 19 nt, Homo sapiens
guaaaccgcagucacacau

SEQ ID NO: 847446 - RNA, 19 nt, Homo sapiens
gccagaagcaucccaugga

SEQ ID NO: 847447 - RNA, 19 nt, Homo sapiens
gggcagaaaacacuacaua

SEQ ID NO: 847448 - RNA, 19 nt, Homo sapiens
gcaagaucuuccgugaugu

SEQ ID NO: 847449 - RNA, 19 nt, Homo sapiens
cugaucagacuguauuaaa

SEQ ID NO: 847450 - RNA, 19 nt, Homo sapiens
caaugcggaugcccaacug

SEQ ID NO: 847451 - RNA, 19 nt, Homo sapiens
gguugcgguucaagagaaa

SEQ ID NO: 847452 - RNA, 19 nt, Homo sapiens
ggucuccaccuacuuauac

SEQ ID NO: 847453 - RNA, 19 nt, Homo sapiens
ccuauacccaaaucuauga

SEQ ID NO: 847454 - RNA, 19 nt, Homo sapiens
guacccaugcccugaaugu

SEQ ID NO: 847455 - RNA, 19 nt, Homo sapiens
caccuggccugucaugaag

SEQ ID NO: 847456 - RNA, 19 nt, Homo sapiens
ggacauuguguaccucagu

SEQ ID NO: 847457 - RNA, 19 nt, Homo sapiens
gggugaguguccuccaaga

SEQ ID NO: 847458 - RNA, 19 nt, Homo sapiens
ccaccuacuuauacaaugc

SEQ ID NO: 847459 - RNA, 19 nt, Homo sapiens
gcggagggaagugauguuu

SEQ ID NO: 847460 - RNA, 19 nt, Homo sapiens
gaccugcaaugcuucuuuu

SEQ ID NO: 847461 - RNA, 19 nt, Homo sapiens
ucacacauuaggguuagua

SEQ ID NO: 847462 - RNA, 19 nt, Homo sapiens
ugaagacgccagagaagca

SEQ ID NO: 847463 - RNA, 19 nt, Homo sapiens
gaccuauggcaacaaagaa

SEQ ID NO: 847464 - RNA, 19 nt, Homo sapiens
ggagauacuugaagaauuu

SEQ ID NO: 847465 - RNA, 19 nt, Homo sapiens
gaagagauuuaucagcuua

SEQ ID NO: 847466 - RNA, 19 nt, Homo sapiens
ggaaggaacagcauauuua

SEQ ID NO: 847467 - RNA, 19 nt, Homo sapiens
gcuaagggcugcucaguuu

SEQ ID NO: 847468 - RNA, 19 nt, Homo sapiens
gaagaaguuugcagaugua

SEQ ID NO: 847469 - RNA, 19 nt, Homo sapiens
gaaguuugcagauguauuu

SEQ ID NO: 847470 - RNA, 19 nt, Homo sapiens
gaaggaacagcauauuuaa

SEQ ID NO: 847471 - RNA, 19 nt, Homo sapiens
gaaauguguuggcucacua

SEQ ID NO: 847472 - RNA, 19 nt, Homo sapiens
gguaaaagcuagucucuaa

SEQ ID NO: 847473 - RNA, 19 nt, Homo sapiens
ggccagaaaugaagaagaa

SEQ ID NO: 847474 - RNA, 19 nt, Homo sapiens
ccaguuugcuugauauauu

SEQ ID NO: 847475 - RNA, 19 nt, Homo sapiens
gcagauguauuugcaaaga

SEQ ID NO: 847476 - RNA, 19 nt, Homo sapiens
gaggaaaugccacaaauug

SEQ ID NO: 847477 - RNA, 19 nt, Homo sapiens
gaagacaucgauauacauu

SEQ ID NO: 847478 - RNA, 19 nt, Homo sapiens
gccacgauaucaacuauuu

SEQ ID NO: 847479 - RNA, 19 nt, Homo sapiens
gaucaaaggacuuggacua

SEQ ID NO: 847480 - RNA, 19 nt, Homo sapiens
caacaguuaucacacuuug

SEQ ID NO: 847481 - RNA, 19 nt, Homo sapiens
ggaacagcauauuuaaguu

SEQ ID NO: 847482 - RNA, 19 nt, Homo sapiens
cuacagugaugauugaauu

SEQ ID NO: 847483 - RNA, 19 nt, Homo sapiens
acagcaacauccagaaaua

SEQ ID NO: 847484 - RNA, 19 nt, Homo sapiens
caaaggacuuggacuaaag

SEQ ID NO: 847485 - RNA, 19 nt, Homo sapiens
gaacuucccaaucagauga

SEQ ID NO: 847486 - RNA, 19 nt, Homo sapiens
ggucauugaugcaaauaug

SEQ ID NO: 847487 - RNA, 19 nt, Homo sapiens
ugaauggguucuagugaaa

SEQ ID NO: 847488 - RNA, 19 nt, Homo sapiens
gcagaguggugucaaaucu

SEQ ID NO: 847489 - RNA, 19 nt, Homo sapiens
ugacuccgguucugacuuu

SEQ ID NO: 847490 - RNA, 19 nt, Homo sapiens
gaaaugaagaagaaguuug

SEQ ID NO: 847491 - RNA, 19 nt, Homo sapiens
ucaaaggacuuggacuaaa

SEQ ID NO: 847492 - RNA, 19 nt, Homo sapiens
caagugaauuugaauacug

SEQ ID NO: 847493 - RNA, 19 nt, Homo sapiens
cauuagggcuuuugauuua

SEQ ID NO: 847494 - RNA, 19 nt, Homo sapiens
gcaagggucaggucauuga

SEQ ID NO: 847495 - RNA, 19 nt, Homo sapiens
agaagaaguuugcagaugu

SEQ ID NO: 847496 - RNA, 19 nt, Homo sapiens
uguguuggcucacuacgua

SEQ ID NO: 847497 - RNA, 19 nt, Homo sapiens
agaguggugucaaaucuuu

SEQ ID NO: 847498 - RNA, 19 nt, Homo sapiens
uaagcacauuccaaacuuu

SEQ ID NO: 847499 - RNA, 19 nt, Homo sapiens
gaaacauggaggaacagua

SEQ ID NO: 847500 - RNA, 19 nt, Homo sapiens
gcaaauaugguggaaggaa

SEQ ID NO: 847501 - RNA, 19 nt, Homo sapiens
gcccacggcucaagugaau

SEQ ID NO: 847502 - RNA, 19 nt, Homo sapiens
cuaagcacauuccaaacuu

SEQ ID NO: 847503 - RNA, 19 nt, Homo sapiens
aaacauggaggaacaguau

SEQ ID NO: 847504 - RNA, 19 nt, Homo sapiens
uuuaucagcuuaacucaga

SEQ ID NO: 847505 - RNA, 19 nt, Homo sapiens
agaacacacugaggagaua

SEQ ID NO: 847506 - RNA, 19 nt, Homo sapiens
cuaccacucuaaucaagaa

SEQ ID NO: 847507 - RNA, 19 nt, Homo sapiens
ugucagguguucucucaaa

SEQ ID NO: 847508 - RNA, 19 nt, Homo sapiens
ccacggcucaagugaauuu

SEQ ID NO: 847509 - RNA, 19 nt, Homo sapiens
gaagaagaaguuugcagau

SEQ ID NO: 847510 - RNA, 19 nt, Homo sapiens
acaguuaucacacuuugua

SEQ ID NO: 847511 - RNA, 19 nt, Homo sapiens
ccagagggacagucaguuu

SEQ ID NO: 847512 - RNA, 19 nt, Homo sapiens
ggaaauguguuggcucacu

SEQ ID NO: 847513 - RNA, 19 nt, Homo sapiens
ucaccuguauugaaucaga

SEQ ID NO: 847514 - RNA, 19 nt, Homo sapiens
cgaagagauuuaucagcuu

SEQ ID NO: 847515 - RNA, 19 nt, Homo sapiens
gcaccuuucuauacgacuu

SEQ ID NO: 847516 - RNA, 19 nt, Homo sapiens
gcaaguucuggaucuuaua

SEQ ID NO: 847517 - RNA, 19 nt, Homo sapiens
ugaaacagagugauugguu

SEQ ID NO: 847518 - RNA, 19 nt, Homo sapiens
gaaaagaauuacagacucu

SEQ ID NO: 847519 - RNA, 19 nt, Homo sapiens
cagcuuaacucagauaaaa

SEQ ID NO: 847520 - RNA, 19 nt, Homo sapiens
uggcagaaguggugagaau

SEQ ID NO: 847521 - RNA, 19 nt, Homo sapiens
ccucuaagcacauuccaaa

SEQ ID NO: 847522 - RNA, 19 nt, Homo sapiens
ggaagcuucugccgguuag

SEQ ID NO: 847523 - RNA, 19 nt, Homo sapiens
agccaucccuucuuucaaa

SEQ ID NO: 847524 - RNA, 19 nt, Homo sapiens
ucuacgagcugcugaucaa

SEQ ID NO: 847525 - RNA, 19 nt, Homo sapiens
gcaacaguuaucacacuuu

SEQ ID NO: 847526 - RNA, 19 nt, Homo sapiens
aagaagaaguuugcagaug

SEQ ID NO: 847527 - RNA, 19 nt, Homo sapiens
acauggaggaacaguauua

SEQ ID NO: 847528 - RNA, 19 nt, Homo sapiens
ggauuuggccagucaggaa

SEQ ID NO: 847529 - RNA, 19 nt, Homo sapiens
gaugauuggccagaaauga

SEQ ID NO: 847530 - RNA, 19 nt, Homo sapiens
uaucaacuauuuggcuuug

SEQ ID NO: 847531 - RNA, 19 nt, Homo sapiens
ccgguuagcuggccacgau

SEQ ID NO: 847532 - RNA, 19 nt, Homo sapiens
gguagcaaguucuggaucu

SEQ ID NO: 847533 - RNA, 19 nt, Homo sapiens
uugaggagguuguucauca

SEQ ID NO: 847534 - RNA, 19 nt, Homo sapiens
cagauguauuugcaaagaa

SEQ ID NO: 847535 - RNA, 19 nt, Homo sapiens
caacauccagaaauaaagu

SEQ ID NO: 847536 - RNA, 19 nt, Homo sapiens
gaggagauacuugaagaau

SEQ ID NO: 847537 - RNA, 19 nt, Homo sapiens
cugaggagauacuugaaga

SEQ ID NO: 847538 - RNA, 19 nt, Homo sapiens
gagaacacacugaggagau

SEQ ID NO: 847539 - RNA, 19 nt, Homo sapiens
gaguggauuuggccaguca

SEQ ID NO: 847540 - RNA, 19 nt, Homo sapiens
aagcacauuccaaacuuua

SEQ ID NO: 847541 - RNA, 19 nt, Homo sapiens
guucaugaucucccucuaa

SEQ ID NO: 847542 - RNA, 19 nt, Homo sapiens
ggaggaacaguauuacagu

SEQ ID NO: 847543 - RNA, 19 nt, Homo sapiens
gaguaacacauaacauugu

SEQ ID NO: 847544 - RNA, 19 nt, Homo sapiens
aggagauacuugaagaauu

SEQ ID NO: 847545 - RNA, 19 nt, Homo sapiens
cagcaacauccagaaauaa

SEQ ID NO: 847546 - RNA, 19 nt, Homo sapiens
uugaagacaucgauauaca

SEQ ID NO: 847547 - RNA, 19 nt, Homo sapiens
acacugaggagauacuuga

SEQ ID NO: 847548 - RNA, 19 nt, Homo sapiens
cagaaaugaagaagaaguu

SEQ ID NO: 847549 - RNA, 19 nt, Homo sapiens
ggagcaccuuucuauacga

SEQ ID NO: 847550 - RNA, 19 nt, Homo sapiens
gaaucagaaugccuucaac

SEQ ID NO: 847551 - RNA, 19 nt, Homo sapiens
uugaauggguucuagugaa

SEQ ID NO: 847552 - RNA, 19 nt, Homo sapiens
cagugaugauugaauucua

SEQ ID NO: 847553 - RNA, 19 nt, Homo sapiens
gaugaacuucccaaucaga

SEQ ID NO: 847554 - RNA, 19 nt, Homo sapiens
uggcaagggucaggucauu

SEQ ID NO: 847555 - RNA, 19 nt, Homo sapiens
gaggacagaacauguugga

SEQ ID NO: 847556 - RNA, 19 nt, Homo sapiens
uagcaaguucuggaucuua

SEQ ID NO: 847557 - RNA, 19 nt, Homo sapiens
ugauaaaagucacgugaaa

SEQ ID NO: 847558 - RNA, 19 nt, Homo sapiens
uaacauuguaugcauggaa

SEQ ID NO: 847559 - RNA, 19 nt, Homo sapiens
ggauucagccgcgaagaga

SEQ ID NO: 847560 - RNA, 19 nt, Homo sapiens
uggaaggaacagcauauuu

SEQ ID NO: 847561 - RNA, 19 nt, Homo sapiens
gcaacauccagaaauaaag

SEQ ID NO: 847562 - RNA, 19 nt, Homo sapiens
uagcaacaguuaucacacu

SEQ ID NO: 847563 - RNA, 19 nt, Homo sapiens
ucaggucauugaugcaaau

SEQ ID NO: 847564 - RNA, 19 nt, Homo sapiens
cagaauaacugcaaacuuu

SEQ ID NO: 847565 - RNA, 19 nt, Homo sapiens
caacagaacucuagccaaa

SEQ ID NO: 847566 - RNA, 19 nt, Homo sapiens
ggaacagucucacagauuu

SEQ ID NO: 847567 - RNA, 19 nt, Homo sapiens
ggaaugaccuuauuucuac

SEQ ID NO: 847568 - RNA, 19 nt, Homo sapiens
aaacugagcuucuuucuuc

SEQ ID NO: 847569 - RNA, 19 nt, Homo sapiens
gaagagacacuuaagcuaa

SEQ ID NO: 847570 - RNA, 19 nt, Homo sapiens
ggaauaagcacauaguaaa

SEQ ID NO: 847571 - RNA, 19 nt, Homo sapiens
gggaguaacuguagaguga

SEQ ID NO: 847572 - RNA, 19 nt, Homo sapiens
gcaaagcccugaagagaca

SEQ ID NO: 847573 - RNA, 19 nt, Homo sapiens
uaaggaagaccauguauaa

SEQ ID NO: 847574 - RNA, 19 nt, Homo sapiens
gagguccgcuucuguagua

SEQ ID NO: 847575 - RNA, 19 nt, Homo sapiens
gaagaaaggcugagucuag

SEQ ID NO: 847576 - RNA, 19 nt, Homo sapiens
ucaauuugcuagaagcuua

SEQ ID NO: 847577 - RNA, 19 nt, Homo sapiens
gaucaucucugggcuuauu

SEQ ID NO: 847578 - RNA, 19 nt, Homo sapiens
gaacaaauccaccugagau

SEQ ID NO: 847579 - RNA, 19 nt, Homo sapiens
guaccuggcuguauuuguu

SEQ ID NO: 847580 - RNA, 19 nt, Homo sapiens
gaacuauacuugcaacucu

SEQ ID NO: 847581 - RNA, 19 nt, Homo sapiens
uaacugaugcugagaagua

SEQ ID NO: 847582 - RNA, 19 nt, Homo sapiens
gagcauuucugacugauca

SEQ ID NO: 847583 - RNA, 19 nt, Homo sapiens
ugagaagaaugccaaauga

SEQ ID NO: 847584 - RNA, 19 nt, Homo sapiens
ggaaacagggaguucauuu

SEQ ID NO: 847585 - RNA, 19 nt, Homo sapiens
caaccaggaugaucuuguu

SEQ ID NO: 847586 - RNA, 19 nt, Homo sapiens
ccaaucagaaucagaauuu

SEQ ID NO: 847587 - RNA, 19 nt, Homo sapiens
ggaagaaaggcaagaaaga

SEQ ID NO: 847588 - RNA, 19 nt, Homo sapiens
gaagagggauaaacauagg

SEQ ID NO: 847589 - RNA, 19 nt, Homo sapiens
caaguucucugacuguguu

SEQ ID NO: 847590 - RNA, 19 nt, Homo sapiens
gaacuugcuugaagggaau

SEQ ID NO: 847591 - RNA, 19 nt, Homo sapiens
gaagaaugccaaaugauca

SEQ ID NO: 847592 - RNA, 19 nt, Homo sapiens
ggaaauaauagucaccaaa

SEQ ID NO: 847593 - RNA, 19 nt, Homo sapiens
aaacauagguccugugacu

SEQ ID NO: 847594 - RNA, 19 nt, Homo sapiens
gacauuaggagaagcauuu

SEQ ID NO: 847595 - RNA, 19 nt, Homo sapiens
gaaauaauagucaccaaag

SEQ ID NO: 847596 - RNA, 19 nt, Homo sapiens
gggaguagauagggaauau

SEQ ID NO: 847597 - RNA, 19 nt, Homo sapiens
gaaacagggaguucauuug

SEQ ID NO: 847598 - RNA, 19 nt, Homo sapiens
gcuuaaaguuguuggaaug

SEQ ID NO: 847599 - RNA, 19 nt, Homo sapiens
ccaggaugaucuuguuaaa

SEQ ID NO: 847600 - RNA, 19 nt, Homo sapiens
gaacaucagggucaaaugg

SEQ ID NO: 847601 - RNA, 19 nt, Homo sapiens
gaaucagaauuucaacugu

SEQ ID NO: 847602 - RNA, 19 nt, Homo sapiens
gcauggccacuuacaauuu

SEQ ID NO: 847603 - RNA, 19 nt, Homo sapiens
ucacaagacaucagcuaua

SEQ ID NO: 847604 - RNA, 19 nt, Homo sapiens
gcaagccacugaauuugag

SEQ ID NO: 847605 - RNA, 19 nt, Homo sapiens
gaagggaauuaccagaagu

SEQ ID NO: 847606 - RNA, 19 nt, Homo sapiens
gacaucagcuauauacucu

SEQ ID NO: 847607 - RNA, 19 nt, Homo sapiens
cacaagacaucagcuauau

SEQ ID NO: 847608 - RNA, 19 nt, Homo sapiens
ggacagcagcauuguuuau

SEQ ID NO: 847609 - RNA, 19 nt, Homo sapiens
uuacuuaccuaucugucua

SEQ ID NO: 847610 - RNA, 19 nt, Homo sapiens
gauuugaaguugagaucuu

SEQ ID NO: 847611 - RNA, 19 nt, Homo sapiens
caauguagcacaguaauga

SEQ ID NO: 847612 - RNA, 19 nt, Homo sapiens
ggauuaccaugguggaaga

SEQ ID NO: 847613 - RNA, 19 nt, Homo sapiens
gaugagguccgcuucugua

SEQ ID NO: 847614 - RNA, 19 nt, Homo sapiens
ggucuuaauuuccuuacug

SEQ ID NO: 847615 - RNA, 19 nt, Homo sapiens
ugucagaacuugcuugaag

SEQ ID NO: 847616 - RNA, 19 nt, Homo sapiens
gauagucucuuaggcaaca

SEQ ID NO: 847617 - RNA, 19 nt, Homo sapiens
aagagacacuuaagcuaaa

SEQ ID NO: 847618 - RNA, 19 nt, Homo sapiens
gagccaaacacacuagauu

SEQ ID NO: 847619 - RNA, 19 nt, Homo sapiens
gaacucagacaacagaaag

SEQ ID NO: 847620 - RNA, 19 nt, Homo sapiens
ccaaggagccuggcacuga

SEQ ID NO: 847621 - RNA, 19 nt, Homo sapiens
ggaagagggauaaacauag

SEQ ID NO: 847622 - RNA, 19 nt, Homo sapiens
gacaucuagugauuucuuu

SEQ ID NO: 847623 - RNA, 19 nt, Homo sapiens
guaguugcuucacuuccua

SEQ ID NO: 847624 - RNA, 19 nt, Homo sapiens
gauaagugcuaccguugag

SEQ ID NO: 847625 - RNA, 19 nt, Homo sapiens
gaaguaauuuguguuugag

SEQ ID NO: 847626 - RNA, 19 nt, Homo sapiens
ccagaaguaauuuguguuu

SEQ ID NO: 847627 - RNA, 19 nt, Homo sapiens
gcaagaaagaggaagacaa

SEQ ID NO: 847628 - RNA, 19 nt, Homo sapiens
aaauggaaaucaccugaga

SEQ ID NO: 847629 - RNA, 19 nt, Homo sapiens
gguuaucucucguauagca

SEQ ID NO: 847630 - RNA, 19 nt, Homo sapiens
caagacaucagcuauauac

SEQ ID NO: 847631 - RNA, 19 nt, Homo sapiens
caagaaagaggaagacaag

SEQ ID NO: 847632 - RNA, 19 nt, Homo sapiens
cagcaaagcccugaagaga

SEQ ID NO: 847633 - RNA, 19 nt, Homo sapiens
gagaaaagguggcguugga

SEQ ID NO: 847634 - RNA, 19 nt, Homo sapiens
gggauuugguuuaaguuca

SEQ ID NO: 847635 - RNA, 19 nt, Homo sapiens
uaugugggauuugguuuaa

SEQ ID NO: 847636 - RNA, 19 nt, Homo sapiens
gaauaugugggauuugguu

SEQ ID NO: 847637 - RNA, 19 nt, Homo sapiens
uaacaauguagcacaguaa

SEQ ID NO: 847638 - RNA, 19 nt, Homo sapiens
gaagaaaggcaagaaagag

SEQ ID NO: 847639 - RNA, 19 nt, Homo sapiens
ggagacaggaucaguuuua

SEQ ID NO: 847640 - RNA, 19 nt, Homo sapiens
uagcgguccuugcccauuu

SEQ ID NO: 847641 - RNA, 19 nt, Homo sapiens
ggaaaaggauccacauugg

SEQ ID NO: 847642 - RNA, 19 nt, Homo sapiens
cagaacuuguuuacucauu

SEQ ID NO: 847643 - RNA, 19 nt, Homo sapiens
cagagacugugaagaagga

SEQ ID NO: 847644 - RNA, 19 nt, Homo sapiens
gaaguagcuuuucaauuug

SEQ ID NO: 847645 - RNA, 19 nt, Homo sapiens
uuucuaauaugcuguguga

SEQ ID NO: 847646 - RNA, 19 nt, Homo sapiens
gggaauaugugggauuugg

SEQ ID NO: 847647 - RNA, 19 nt, Homo sapiens
caucaggugucagaacuug

SEQ ID NO: 847648 - RNA, 19 nt, Homo sapiens
cggaauaagcacauaguaa

SEQ ID NO: 847649 - RNA, 19 nt, Homo sapiens
gaagggcugcucagggaaa

SEQ ID NO: 847650 - RNA, 19 nt, Homo sapiens
caaacacacuagauuucug

SEQ ID NO: 847651 - RNA, 19 nt, Homo sapiens
caggucgucuggccaauga

SEQ ID NO: 847652 - RNA, 19 nt, Homo sapiens
gcaauguuaccaaucagaa

SEQ ID NO: 847653 - RNA, 19 nt, Homo sapiens
cuucauccuucucccuuua

SEQ ID NO: 847654 - RNA, 19 nt, Homo sapiens
aaaucuaacugaugcaauc

SEQ ID NO: 847655 - RNA, 19 nt, Homo sapiens
cugguuaucucucguauag

SEQ ID NO: 847656 - RNA, 19 nt, Homo sapiens
uuagcaagccacugaauuu

SEQ ID NO: 847657 - RNA, 19 nt, Homo sapiens
uagggaauaugugggauuu

SEQ ID NO: 847658 - RNA, 19 nt, Homo sapiens
gaaaggcaagaaagaggaa

SEQ ID NO: 847659 - RNA, 19 nt, Homo sapiens
guacugagcauuucugacu

SEQ ID NO: 847660 - RNA, 19 nt, Homo sapiens
gagaugagguccgcuucug

SEQ ID NO: 847661 - RNA, 19 nt, Homo sapiens
gcagagccacccuagauca

SEQ ID NO: 847662 - RNA, 19 nt, Homo sapiens
cagcagagccacccuagau

SEQ ID NO: 847663 - RNA, 19 nt, Homo sapiens
gaguaacuguagagugaga

SEQ ID NO: 847664 - RNA, 19 nt, Homo sapiens
caacaaagcuccugcucua

SEQ ID NO: 847665 - RNA, 19 nt, Homo sapiens
gaucuuaguuuguagcuua

SEQ ID NO: 847666 - RNA, 19 nt, Homo sapiens
gcacaagacuggucgaauu

SEQ ID NO: 847667 - RNA, 19 nt, Homo sapiens
guuuguagcuuaugacuua

SEQ ID NO: 847668 - RNA, 19 nt, Homo sapiens
gcacaaaccuggucauuuu

SEQ ID NO: 847669 - RNA, 19 nt, Homo sapiens
gaaaguuacccugaucuua

SEQ ID NO: 847670 - RNA, 19 nt, Homo sapiens
gaaugaguauugagacuga

SEQ ID NO: 847671 - RNA, 19 nt, Homo sapiens
gagaaagugugaaccuauu

SEQ ID NO: 847672 - RNA, 19 nt, Homo sapiens
ggagaaagcacaugaagga

SEQ ID NO: 847673 - RNA, 19 nt, Homo sapiens
gggaagcccuuauaaacuu

SEQ ID NO: 847674 - RNA, 19 nt, Homo sapiens
gacauuccauuucagauuu

SEQ ID NO: 847675 - RNA, 19 nt, Homo sapiens
ggagaaugauagagaguga

SEQ ID NO: 847676 - RNA, 19 nt, Homo sapiens
ugacaaaucuuacccuaca

SEQ ID NO: 847677 - RNA, 19 nt, Homo sapiens
gaccucugcuguagcuuua

SEQ ID NO: 847678 - RNA, 19 nt, Homo sapiens
gauagagagugaagcagaa

SEQ ID NO: 847679 - RNA, 19 nt, Homo sapiens
ggcaaugacuuauauucaa

SEQ ID NO: 847680 - RNA, 19 nt, Homo sapiens
gagagaaagugugaaccua

SEQ ID NO: 847681 - RNA, 19 nt, Homo sapiens
cccaaagcauuguggauua

SEQ ID NO: 847682 - RNA, 19 nt, Homo sapiens
gaauuuugcuucucgguua

SEQ ID NO: 847683 - RNA, 19 nt, Homo sapiens
ugaaguggaucaugagaug

SEQ ID NO: 847684 - RNA, 19 nt, Homo sapiens
gaagggcugucugugauug

SEQ ID NO: 847685 - RNA, 19 nt, Homo sapiens
gcacuguguauguuuauaa

SEQ ID NO: 847686 - RNA, 19 nt, Homo sapiens
ggacugcacggucauggua

SEQ ID NO: 847687 - RNA, 19 nt, Homo sapiens
agaagaggacagugaauua

SEQ ID NO: 847688 - RNA, 19 nt, Homo sapiens
gcaugggacuggcuggaaa

SEQ ID NO: 847689 - RNA, 19 nt, Homo sapiens
gaagggaauucuugcacau

SEQ ID NO: 847690 - RNA, 19 nt, Homo sapiens
gacuugauguuaacaaaug

SEQ ID NO: 847691 - RNA, 19 nt, Homo sapiens
ggagggcaagggaaaguua

SEQ ID NO: 847692 - RNA, 19 nt, Homo sapiens
gcaugugguucaaagagaa

SEQ ID NO: 847693 - RNA, 19 nt, Homo sapiens
gaucaugagauguaaagaa

SEQ ID NO: 847694 - RNA, 19 nt, Homo sapiens
cagcaucauuuacuuaugu

SEQ ID NO: 847695 - RNA, 19 nt, Homo sapiens
gcagcuggcucucuggaau

SEQ ID NO: 847696 - RNA, 19 nt, Homo sapiens
gaaaauggacucacccuuu

SEQ ID NO: 847697 - RNA, 19 nt, Homo sapiens
gaccugggauaguuccuuu

SEQ ID NO: 847698 - RNA, 19 nt, Homo sapiens
ugucuaagauucaguagug

SEQ ID NO: 847699 - RNA, 19 nt, Homo sapiens
gauugaacgugaaaugugu

SEQ ID NO: 847700 - RNA, 19 nt, Homo sapiens
uuacacaccuaggaucaua

SEQ ID NO: 847701 - RNA, 19 nt, Homo sapiens
ucaagguggucaagaagaa

SEQ ID NO: 847702 - RNA, 19 nt, Homo sapiens
aaugugagauugccagauu

SEQ ID NO: 847703 - RNA, 19 nt, Homo sapiens
gagcaaguuucggcaugua

SEQ ID NO: 847704 - RNA, 19 nt, Homo sapiens
ggacagugaauuacuccua

SEQ ID NO: 847705 - RNA, 19 nt, Homo sapiens
caauaauggcaaugacuua

SEQ ID NO: 847706 - RNA, 19 nt, Homo sapiens
gagcguauuuccaaguuag

SEQ ID NO: 847707 - RNA, 19 nt, Homo sapiens
gacacaaucugcaaucaag

SEQ ID NO: 847708 - RNA, 19 nt, Homo sapiens
gaacgugaaauguguagug

SEQ ID NO: 847709 - RNA, 19 nt, Homo sapiens
ccaccgcucucauuucaug

SEQ ID NO: 847710 - RNA, 19 nt, Homo sapiens
cuuauaaacuuggacgaua

SEQ ID NO: 847711 - RNA, 19 nt, Homo sapiens
gccauaguguucugucaaa

SEQ ID NO: 847712 - RNA, 19 nt, Homo sapiens
ggaguaauguccguguaga

SEQ ID NO: 847713 - RNA, 19 nt, Homo sapiens
ucgguuagcuggaacuuug

SEQ ID NO: 847714 - RNA, 19 nt, Homo sapiens
gcuguagcuuuaaugcaua

SEQ ID NO: 847715 - RNA, 19 nt, Homo sapiens
ucacguggauucauauuac

SEQ ID NO: 847716 - RNA, 19 nt, Homo sapiens
caaguuggaugagauuuua

SEQ ID NO: 847717 - RNA, 19 nt, Homo sapiens
gggacuugauguuaacaaa

SEQ ID NO: 847718 - RNA, 19 nt, Homo sapiens
caauugcucuucaugagau

SEQ ID NO: 847719 - RNA, 19 nt, Homo sapiens
gcgauugaaugaguauuga

SEQ ID NO: 847720 - RNA, 19 nt, Homo sapiens
gaacagcagauggcaaaga

SEQ ID NO: 847721 - RNA, 19 nt, Homo sapiens
gaaagugugaaccuauuau

SEQ ID NO: 847722 - RNA, 19 nt, Homo sapiens
guuaacaaaugugagauug

SEQ ID NO: 847723 - RNA, 19 nt, Homo sapiens
gauaugcauucagacauga

SEQ ID NO: 847724 - RNA, 19 nt, Homo sapiens
ggaagcccuuauaaacuug

SEQ ID NO: 847725 - RNA, 19 nt, Homo sapiens
gccaugacaucccagaaga

SEQ ID NO: 847726 - RNA, 19 nt, Homo sapiens
gaucauauugcauucauca

SEQ ID NO: 847727 - RNA, 19 nt, Homo sapiens
ccaguaagaacucaauuug

SEQ ID NO: 847728 - RNA, 19 nt, Homo sapiens
ggaaagggugacagcagua

SEQ ID NO: 847729 - RNA, 19 nt, Homo sapiens
ggaaggccacucaaagaga

SEQ ID NO: 847730 - RNA, 19 nt, Homo sapiens
ccaaagcauuguggauuau

SEQ ID NO: 847731 - RNA, 19 nt, Homo sapiens
cagggcaucugaauguuug

SEQ ID NO: 847732 - RNA, 19 nt, Homo sapiens
aguaagaacucaauuuguc

SEQ ID NO: 847733 - RNA, 19 nt, Homo sapiens
caagaaagugagagucauu

SEQ ID NO: 847734 - RNA, 19 nt, Homo sapiens
cgauaugcauucagacaug

SEQ ID NO: 847735 - RNA, 19 nt, Homo sapiens
cauauugcauucaucacuu

SEQ ID NO: 847736 - RNA, 19 nt, Homo sapiens
gcaguuuguuacacaccua

SEQ ID NO: 847737 - RNA, 19 nt, Homo sapiens
gagaacaaucaaagcagua

SEQ ID NO: 847738 - RNA, 19 nt, Homo sapiens
gaaggagcaagacccauga

SEQ ID NO: 847739 - RNA, 19 nt, Homo sapiens
uuaagguucugauaucgaa

SEQ ID NO: 847740 - RNA, 19 nt, Homo sapiens
ucaaagcaguagccacaug

SEQ ID NO: 847741 - RNA, 19 nt, Homo sapiens
ggagacauuccauuucaga

SEQ ID NO: 847742 - RNA, 19 nt, Homo sapiens
ugacagcaguauucgcuau

SEQ ID NO: 847743 - RNA, 19 nt, Homo sapiens
guauugagacugaggagaa

SEQ ID NO: 847744 - RNA, 19 nt, Homo sapiens
gcauguguuucugcaguuu

SEQ ID NO: 847745 - RNA, 19 nt, Homo sapiens
gcacugccauuuggagaca

SEQ ID NO: 847746 - RNA, 19 nt, Homo sapiens
caaucaagaugagcguauu

SEQ ID NO: 847747 - RNA, 19 nt, Homo sapiens
gauguuaacaaaugugaga

SEQ ID NO: 847748 - RNA, 19 nt, Homo sapiens
gaaccaauugcucuucaug

SEQ ID NO: 847749 - RNA, 19 nt, Homo sapiens
gaaggagaaagcacaugaa

SEQ ID NO: 847750 - RNA, 19 nt, Homo sapiens
gaaagugagagucauugau

SEQ ID NO: 847751 - RNA, 19 nt, Homo sapiens
gacugaaccuguggugauu

SEQ ID NO: 847752 - RNA, 19 nt, Homo sapiens
ccagauuuguugccauaau

SEQ ID NO: 847753 - RNA, 19 nt, Homo sapiens
gcaaguuucggcauguauu

SEQ ID NO: 847754 - RNA, 19 nt, Homo sapiens
cauggagucuucugaucaa

SEQ ID NO: 847755 - RNA, 19 nt, Homo sapiens
uaccaccgcucucauuuca

SEQ ID NO: 847756 - RNA, 19 nt, Homo sapiens
gccagauucuucaaacuuc

SEQ ID NO: 847757 - RNA, 19 nt, Homo sapiens
gcacagcuuccaaagacaa

SEQ ID NO: 847758 - RNA, 19 nt, Homo sapiens
gaucugcacagcuuccaaa

SEQ ID NO: 847759 - RNA, 19 nt, Homo sapiens
ucccagauuuguugccaua

SEQ ID NO: 847760 - RNA, 19 nt, Homo sapiens
gagauggacacuagcaaug

SEQ ID NO: 847761 - RNA, 19 nt, Homo sapiens
gacaagaaagugagaguca

SEQ ID NO: 847762 - RNA, 19 nt, Homo sapiens
ggaaaguuacccugaucuu

SEQ ID NO: 847763 - RNA, 19 nt, Homo sapiens
gcauucaucacuuuaaaca

SEQ ID NO: 847764 - RNA, 19 nt, Homo sapiens
gaggagagcucuucgauuu

SEQ ID NO: 847765 - RNA, 19 nt, Homo sapiens
gaagauggaguugaauuua

SEQ ID NO: 847766 - RNA, 19 nt, Homo sapiens
ggaagcuucugguuaaaga

SEQ ID NO: 847767 - RNA, 19 nt, Homo sapiens
gggaauagccaucgacaaa

SEQ ID NO: 847768 - RNA, 19 nt, Homo sapiens
gcucuuaauucuccauaaa

SEQ ID NO: 847769 - RNA, 19 nt, Homo sapiens
gagaugggcccaaggaauu

SEQ ID NO: 847770 - RNA, 19 nt, Homo sapiens
ggaaacggcucacaaucca

SEQ ID NO: 847771 - RNA, 19 nt, Homo sapiens
aaaaugagcucacugauau

SEQ ID NO: 847772 - RNA, 19 nt, Homo sapiens
ggaauuuguugcuccagaa

SEQ ID NO: 847773 - RNA, 19 nt, Homo sapiens
gaaaauugcucacuuugau

SEQ ID NO: 847774 - RNA, 19 nt, Homo sapiens
gaacuaccuucacacaaag

SEQ ID NO: 847775 - RNA, 19 nt, Homo sapiens
aauagaagauggaguugaa

SEQ ID NO: 847776 - RNA, 19 nt, Homo sapiens
cgaaauagaagauggaguu

SEQ ID NO: 847777 - RNA, 19 nt, Homo sapiens
gaauagccaucgacaaacu

SEQ ID NO: 847778 - RNA, 19 nt, Homo sapiens
aggaaacacuggcaaauau

SEQ ID NO: 847779 - RNA, 19 nt, Homo sapiens
cagccaaguucaucaagaa

SEQ ID NO: 847780 - RNA, 19 nt, Homo sapiens
gcugacaccucaaucuuag

SEQ ID NO: 847781 - RNA, 19 nt, Homo sapiens
gaagguguccaguucaaga

SEQ ID NO: 847782 - RNA, 19 nt, Homo sapiens
gcagccaaguucaucaaga

SEQ ID NO: 847783 - RNA, 19 nt, Homo sapiens
gaaacacuggcaaauauca

SEQ ID NO: 847784 - RNA, 19 nt, Homo sapiens
ucccaaagcucuuaauucu

SEQ ID NO: 847785 - RNA, 19 nt, Homo sapiens
acaggaagguguccaguuc

SEQ ID NO: 847786 - RNA, 19 nt, Homo sapiens
gaacagggugauugaggaa

SEQ ID NO: 847787 - RNA, 19 nt, Homo sapiens
ggacaucgccaggaggaaa

SEQ ID NO: 847788 - RNA, 19 nt, Homo sapiens
cuccagaaauugugaacua

SEQ ID NO: 847789 - RNA, 19 nt, Homo sapiens
gagauggggucuuuagaaa

SEQ ID NO: 847790 - RNA, 19 nt, Homo sapiens
agacaagaauauucccauu

SEQ ID NO: 847791 - RNA, 19 nt, Homo sapiens
gcagugaguuacgacuuug

SEQ ID NO: 847792 - RNA, 19 nt, Homo sapiens
caggaaacacuggcaaaua

SEQ ID NO: 847793 - RNA, 19 nt, Homo sapiens
gagcagcaccuccuaacug

SEQ ID NO: 847794 - RNA, 19 nt, Homo sapiens
cgacuuugaugaggaauuc

SEQ ID NO: 847795 - RNA, 19 nt, Homo sapiens
gagagagaccauauccaaa

SEQ ID NO: 847796 - RNA, 19 nt, Homo sapiens
gcugacauguggagcauag

SEQ ID NO: 847797 - RNA, 19 nt, Homo sapiens
gaggccaccagcuucauua

SEQ ID NO: 847798 - RNA, 19 nt, Homo sapiens
uggucuggcucacgaaaua

SEQ ID NO: 847799 - RNA, 19 nt, Homo sapiens
caaagaaaauugcucacuu

SEQ ID NO: 847800 - RNA, 19 nt, Homo sapiens
cuuagacucuggccucaaa

SEQ ID NO: 847801 - RNA, 19 nt, Homo sapiens
gcaggaaagaccacaugaa

SEQ ID NO: 847802 - RNA, 19 nt, Homo sapiens
ugacagagagagaccauau

SEQ ID NO: 847803 - RNA, 19 nt, Homo sapiens
gggagucuguggucaaucu

SEQ ID NO: 847804 - RNA, 19 nt, Homo sapiens
uaaaaugagcucacugaua

SEQ ID NO: 847805 - RNA, 19 nt, Homo sapiens
gcacggggcuugaguaugc

SEQ ID NO: 847806 - RNA, 19 nt, Homo sapiens
ccugaugcuuggcuucuuu

SEQ ID NO: 847807 - RNA, 19 nt, Homo sapiens
uucggaagcuucugguuaa

SEQ ID NO: 847808 - RNA, 19 nt, Homo sapiens
caucaccuacauccucuua

SEQ ID NO: 847809 - RNA, 19 nt, Homo sapiens
cagaaauugugaacuacga

SEQ ID NO: 847810 - RNA, 19 nt, Homo sapiens
gaccaacaccucagaccuu

SEQ ID NO: 847811 - RNA, 19 nt, Homo sapiens
aaaaugggcuuuccucugu

SEQ ID NO: 847812 - RNA, 19 nt, Homo sapiens
ucaaugaggaguccaaaca

SEQ ID NO: 847813 - RNA, 19 nt, Homo sapiens
gcacuuugcaagagagaug

SEQ ID NO: 847814 - RNA, 19 nt, Homo sapiens
ucaccuacauccucuuaag

SEQ ID NO: 847815 - RNA, 19 nt, Homo sapiens
gaaauagaagauggaguug

SEQ ID NO: 847816 - RNA, 19 nt, Homo sapiens
ggaggagagcucuucgauu

SEQ ID NO: 847817 - RNA, 19 nt, Homo sapiens
agagagagaccauauccaa

SEQ ID NO: 847818 - RNA, 19 nt, Homo sapiens
ggacuuaggaaaacaauau

SEQ ID NO: 847819 - RNA, 19 nt, Homo sapiens
agaagauggaguugaauuu

SEQ ID NO: 847820 - RNA, 19 nt, Homo sapiens
gcagaagguggaggacuuu

SEQ ID NO: 847821 - RNA, 19 nt, Homo sapiens
gggugggaguguggacuua

SEQ ID NO: 847822 - RNA, 19 nt, Homo sapiens
ggagagcucuucgauuucc

SEQ ID NO: 847823 - RNA, 19 nt, Homo sapiens
ggaaacacuggcaaauauc

SEQ ID NO: 847824 - RNA, 19 nt, Homo sapiens
gcaggaaacacuggcaaau

SEQ ID NO: 847825 - RNA, 19 nt, Homo sapiens
gaauuuguugcuccagaaa

SEQ ID NO: 847826 - RNA, 19 nt, Homo sapiens
uaauugguguccuuauaag

SEQ ID NO: 847827 - RNA, 19 nt, Homo sapiens
ugaguuacgacuuugauga

SEQ ID NO: 847828 - RNA, 19 nt, Homo sapiens
gaaaccaacccugcugaca

SEQ ID NO: 847829 - RNA, 19 nt, Homo sapiens
caggaaagaccacaugaag

SEQ ID NO: 847830 - RNA, 19 nt, Homo sapiens
aaugaggaguccaaacaug

SEQ ID NO: 847831 - RNA, 19 nt, Homo sapiens
gguguccaguucaagagaa

SEQ ID NO: 847832 - RNA, 19 nt, Homo sapiens
uuacgacuuugaugaggaa

SEQ ID NO: 847833 - RNA, 19 nt, Homo sapiens
gaagucuuaacccuuggua

SEQ ID NO: 847834 - RNA, 19 nt, Homo sapiens
cgcaggcgguggaagcuuu

SEQ ID NO: 847835 - RNA, 19 nt, Homo sapiens
gcagggagucuguggucaa

SEQ ID NO: 847836 - RNA, 19 nt, Homo sapiens
uagaagauggaguugaauu

SEQ ID NO: 847837 - RNA, 19 nt, Homo sapiens
ggaggccaccagcuucauu

SEQ ID NO: 847838 - RNA, 19 nt, Homo sapiens
uauaaucccugcgcuuugg

SEQ ID NO: 847839 - RNA, 19 nt, Homo sapiens
gagcuggccaaggacuuua

SEQ ID NO: 847840 - RNA, 19 nt, Homo sapiens
ccuauaaucccugcgcuuu

SEQ ID NO: 847841 - RNA, 19 nt, Homo sapiens
ggaguguggacuuaggaaa

SEQ ID NO: 847842 - RNA, 19 nt, Homo sapiens
gcccaaggaauucagaaga

SEQ ID NO: 847843 - RNA, 19 nt, Homo sapiens
agauggaguugaauuuaag

SEQ ID NO: 847844 - RNA, 19 nt, Homo sapiens
gcacgacgucuaugagaac

SEQ ID NO: 847845 - RNA, 19 nt, Homo sapiens
ggacuuuauucggaagcuu

SEQ ID NO: 847846 - RNA, 19 nt, Homo sapiens
ccuccuugcuucccuaaca

SEQ ID NO: 847847 - RNA, 19 nt, Homo sapiens
gaugaggaccugaggaacu

SEQ ID NO: 847848 - RNA, 19 nt, Homo sapiens
cccgcucgcugaugaagaa

SEQ ID NO: 847849 - RNA, 19 nt, Homo sapiens
agcagugaguuacgacuuu

SEQ ID NO: 847850 - RNA, 19 nt, Homo sapiens
ggagacacgaagcaggaaa

SEQ ID NO: 847851 - RNA, 19 nt, Homo sapiens
ggagauggggucuuuagaa

SEQ ID NO: 847852 - RNA, 19 nt, Homo sapiens
gaagaagugccgggagaag

SEQ ID NO: 847853 - RNA, 19 nt, Homo sapiens
gggcagaaucucagaaggu

SEQ ID NO: 847854 - RNA, 19 nt, Homo sapiens
aagugaaccuuggguguga

SEQ ID NO: 847855 - RNA, 19 nt, Homo sapiens
gaccugaggaacugugaga

SEQ ID NO: 847856 - RNA, 19 nt, Homo sapiens
gagugugucucccuaaaau

SEQ ID NO: 847857 - RNA, 19 nt, Homo sapiens
ugagggaccaauccuguga

SEQ ID NO: 847858 - RNA, 19 nt, Homo sapiens
ggaucacgccgguggacaa

SEQ ID NO: 847859 - RNA, 19 nt, Homo sapiens
agugguggcucacgccuau

SEQ ID NO: 847860 - RNA, 19 nt, Homo sapiens
cagggagucuguggucaau

SEQ ID NO: 847861 - RNA, 19 nt, Homo sapiens
gaagguggaggacuuuuau

SEQ ID NO: 847862 - RNA, 19 nt, Homo sapiens
gaggaggccaccagcuuca

SEQ ID NO: 847863 - RNA, 19 nt, Homo sapiens
cugagugugucucccuaaa

SEQ ID NO: 847864 - RNA, 19 nt, Homo sapiens
gaaauaccgugauugguua

SEQ ID NO: 847865 - RNA, 19 nt, Homo sapiens
gaagggaguuugaaaguug

SEQ ID NO: 847866 - RNA, 19 nt, Homo sapiens
ugcagaagcuauauuguua

SEQ ID NO: 847867 - RNA, 19 nt, Homo sapiens
acagaaagcugaauguguu

SEQ ID NO: 847868 - RNA, 19 nt, Homo sapiens
gaauaacccugcacaacau

SEQ ID NO: 847869 - RNA, 19 nt, Homo sapiens
aaacuagacugauguggaa

SEQ ID NO: 847870 - RNA, 19 nt, Homo sapiens
gcacacagaacacuucauu

SEQ ID NO: 847871 - RNA, 19 nt, Homo sapiens
agagaaagguugaauagga

SEQ ID NO: 847872 - RNA, 19 nt, Homo sapiens
gaccugacccucaauaauu

SEQ ID NO: 847873 - RNA, 19 nt, Homo sapiens
ggagggauuuccuggcuuu

SEQ ID NO: 847874 - RNA, 19 nt, Homo sapiens
gauaggggcuuucugauuu

SEQ ID NO: 847875 - RNA, 19 nt, Homo sapiens
ggacaugaaagaagauaaa

SEQ ID NO: 847876 - RNA, 19 nt, Homo sapiens
guucaacccucacucuaaa

SEQ ID NO: 847877 - RNA, 19 nt, Homo sapiens
ugacacacauagccacuuu

SEQ ID NO: 847878 - RNA, 19 nt, Homo sapiens
gagcagcgguucucuuucu

SEQ ID NO: 847879 - RNA, 19 nt, Homo sapiens
gaaggagccuaugucacua

SEQ ID NO: 847880 - RNA, 19 nt, Homo sapiens
uaauaaagcuggguauagu

SEQ ID NO: 847881 - RNA, 19 nt, Homo sapiens
ggaaggagccuaugucacu

SEQ ID NO: 847882 - RNA, 19 nt, Homo sapiens
gagagaagguacacaaagg

SEQ ID NO: 847883 - RNA, 19 nt, Homo sapiens
cauagccacuuuagcauga

SEQ ID NO: 847884 - RNA, 19 nt, Homo sapiens
ugaaauaccgugauugguu

SEQ ID NO: 847885 - RNA, 19 nt, Homo sapiens
acacuucauuguugucuuu

SEQ ID NO: 847886 - RNA, 19 nt, Homo sapiens
gaagguacacaaagggaaa

SEQ ID NO: 847887 - RNA, 19 nt, Homo sapiens
caagagaaagguugaauag

SEQ ID NO: 847888 - RNA, 19 nt, Homo sapiens
caagugaagugugugcauu

SEQ ID NO: 847889 - RNA, 19 nt, Homo sapiens
gaagaagggaguuugaaag

SEQ ID NO: 847890 - RNA, 19 nt, Homo sapiens
aauaggacaugaaagaaga

SEQ ID NO: 847891 - RNA, 19 nt, Homo sapiens
aaacagaccgggcacagaa

SEQ ID NO: 847892 - RNA, 19 nt, Homo sapiens
ccaagagaaagguugaaua

SEQ ID NO: 847893 - RNA, 19 nt, Homo sapiens
cccauguccugcugaaaua

SEQ ID NO: 847894 - RNA, 19 nt, Homo sapiens
ggacaaaucacagagaucu

SEQ ID NO: 847895 - RNA, 19 nt, Homo sapiens
ggaccugacccucaauaau

SEQ ID NO: 847896 - RNA, 19 nt, Homo sapiens
gaauaggacaugaaagaag

SEQ ID NO: 847897 - RNA, 19 nt, Homo sapiens
uuagacaaauucucccauu

SEQ ID NO: 847898 - RNA, 19 nt, Homo sapiens
acacauagccacuuuagca

SEQ ID NO: 847899 - RNA, 19 nt, Homo sapiens
ucugcaagcuugucugcua

SEQ ID NO: 847900 - RNA, 19 nt, Homo sapiens
gaaggacaaaucacagaga

SEQ ID NO: 847901 - RNA, 19 nt, Homo sapiens
acacagaacacuucauugu

SEQ ID NO: 847902 - RNA, 19 nt, Homo sapiens
acucuaaacuuucccuguu

SEQ ID NO: 847903 - RNA, 19 nt, Homo sapiens
ugaagaagggaguuugaaa

SEQ ID NO: 847904 - RNA, 19 nt, Homo sapiens
guggaucuuuagacaaauu

SEQ ID NO: 847905 - RNA, 19 nt, Homo sapiens
acaccuuucucuucuaguu

SEQ ID NO: 847906 - RNA, 19 nt, Homo sapiens
gagagagaagguacacaaa

SEQ ID NO: 847907 - RNA, 19 nt, Homo sapiens
gauugguuauggaaaguau

SEQ ID NO: 847908 - RNA, 19 nt, Homo sapiens
aacccucacucuaaacuuu

SEQ ID NO: 847909 - RNA, 19 nt, Homo sapiens
aaacaccuuucucuucuag

SEQ ID NO: 847910 - RNA, 19 nt, Homo sapiens
agaagggaguuugaaaguu

SEQ ID NO: 847911 - RNA, 19 nt, Homo sapiens
ggagaugccaagugaagug

SEQ ID NO: 847912 - RNA, 19 nt, Homo sapiens
gaugccaagugaagugugu

SEQ ID NO: 847913 - RNA, 19 nt, Homo sapiens
agaauaacccugcacaaca

SEQ ID NO: 847914 - RNA, 19 nt, Homo sapiens
gagaauaacccugcacaac

SEQ ID NO: 847915 - RNA, 19 nt, Homo sapiens
gaagauaaaaccagaugaa

SEQ ID NO: 847916 - RNA, 19 nt, Homo sapiens
gguuguggaucuuuagaca

SEQ ID NO: 847917 - RNA, 19 nt, Homo sapiens
caaagaagagagagaaggu

SEQ ID NO: 847918 - RNA, 19 nt, Homo sapiens
gauaaaaccagaugaagga

SEQ ID NO: 847919 - RNA, 19 nt, Homo sapiens
ggaguuugaaaguuguuaa

SEQ ID NO: 847920 - RNA, 19 nt, Homo sapiens
cuacaaagaagagagagaa

SEQ ID NO: 847921 - RNA, 19 nt, Homo sapiens
ccagaugaaggacaaauca

SEQ ID NO: 847922 - RNA, 19 nt, Homo sapiens
cugcugaaauaccgugauu

SEQ ID NO: 847923 - RNA, 19 nt, Homo sapiens
gcccauguccugcugaaau

SEQ ID NO: 847924 - RNA, 19 nt, Homo sapiens
guugggaccugacccucaa

SEQ ID NO: 847925 - RNA, 19 nt, Homo sapiens
aaaugcagaagcuauauug

SEQ ID NO: 847926 - RNA, 19 nt, Homo sapiens
ccacugccaucaucaccau

SEQ ID NO: 847927 - RNA, 19 nt, Homo sapiens
agccagagcccaagccuaa

SEQ ID NO: 847928 - RNA, 19 nt, Homo sapiens
auaaagcuggguauaguuu

SEQ ID NO: 847929 - RNA, 19 nt, Homo sapiens
uugaauaggacaugaaaga

SEQ ID NO: 847930 - RNA, 19 nt, Homo sapiens
gaaagcugaauguguugga

SEQ ID NO: 847931 - RNA, 19 nt, Homo sapiens
ucaccaugcccaagagaaa

SEQ ID NO: 847932 - RNA, 19 nt, Homo sapiens
uaaaccugcuccuccaaag

SEQ ID NO: 847933 - RNA, 19 nt, Homo sapiens
gcugaaauaccgugauugg

SEQ ID NO: 847934 - RNA, 19 nt, Homo sapiens
caccuucagcauacacuua

SEQ ID NO: 847935 - RNA, 19 nt, Homo sapiens
ggagaauaacccugcacaa

SEQ ID NO: 847936 - RNA, 19 nt, Homo sapiens
cugcaagcuugucugcuaa

SEQ ID NO: 847937 - RNA, 19 nt, Homo sapiens
aagcugauauuggcaagga

SEQ ID NO: 847938 - RNA, 19 nt, Homo sapiens
gguugaauaggacaugaaa

SEQ ID NO: 847939 - RNA, 19 nt, Homo sapiens
ugaauaggacaugaaagaa

SEQ ID NO: 847940 - RNA, 19 nt, Homo sapiens
ucuggguuguggaucuuua

SEQ ID NO: 847941 - RNA, 19 nt, Homo sapiens
gucaggcaaucuggacuuu

SEQ ID NO: 847942 - RNA, 19 nt, Homo sapiens
ucacuaauagaaugucuuc

SEQ ID NO: 847943 - RNA, 19 nt, Homo sapiens
agagagagaagguacacaa

SEQ ID NO: 847944 - RNA, 19 nt, Homo sapiens
gcagaagcuauauuguuag

SEQ ID NO: 847945 - RNA, 19 nt, Homo sapiens
guguaccucugaugacugu

SEQ ID NO: 847946 - RNA, 19 nt, Homo sapiens
aaggacaaaucacagagau

SEQ ID NO: 847947 - RNA, 19 nt, Homo sapiens
gggcacagaaagcugaaug

SEQ ID NO: 847948 - RNA, 19 nt, Homo sapiens
cgugauugguuauggaaag

SEQ ID NO: 847949 - RNA, 19 nt, Homo sapiens
ucuaaacuuucccuguuca

SEQ ID NO: 847950 - RNA, 19 nt, Homo sapiens
gggaccugacccucaauaa

SEQ ID NO: 847951 - RNA, 19 nt, Homo sapiens
uuaauaaagcuggguauag

SEQ ID NO: 847952 - RNA, 19 nt, Homo sapiens
cgacaucccacugccauca

SEQ ID NO: 847953 - RNA, 19 nt, Homo sapiens
aaagaagagagagaaggua

SEQ ID NO: 847954 - RNA, 19 nt, Homo sapiens
aaagcuggguauaguuugg

SEQ ID NO: 847955 - RNA, 19 nt, Homo sapiens
aagaagggaguuugaaagu

SEQ ID NO: 847956 - RNA, 19 nt, Homo sapiens
guugaagaagggaguuuga

SEQ ID NO: 847957 - RNA, 19 nt, Homo sapiens
gggauuuccuggcuuugac

SEQ ID NO: 847958 - RNA, 19 nt, Homo sapiens
cuaaaccugcuccuccaaa

SEQ ID NO: 847959 - RNA, 19 nt, Homo sapiens
gcaagcuugucugcuaaac

SEQ ID NO: 847960 - RNA, 19 nt, Homo sapiens
uauguccucuuuucucuuu

SEQ ID NO: 847961 - RNA, 19 nt, Homo sapiens
ggaggggaaaacaaauuua

SEQ ID NO: 847962 - RNA, 19 nt, Homo sapiens
gacacacauagccacuuua

SEQ ID NO: 847963 - RNA, 19 nt, Homo sapiens
uaaagcuggguauaguuug

SEQ ID NO: 847964 - RNA, 19 nt, Homo sapiens
ggaaacagaugaugugaaa

SEQ ID NO: 847965 - RNA, 19 nt, Homo sapiens
gaacuuagagcccagauua

SEQ ID NO: 847966 - RNA, 19 nt, Homo sapiens
gaacaggccuuguguaaca

SEQ ID NO: 847967 - RNA, 19 nt, Homo sapiens
gaaauuauccuccagcuuu

SEQ ID NO: 847968 - RNA, 19 nt, Homo sapiens
ugacauagcuuccucagaa

SEQ ID NO: 847969 - RNA, 19 nt, Homo sapiens
guaaggaccuccaaagaaa

SEQ ID NO: 847970 - RNA, 19 nt, Homo sapiens
gaacauuauuugccuauga

SEQ ID NO: 847971 - RNA, 19 nt, Homo sapiens
gaaacuacagcacauauaa

SEQ ID NO: 847972 - RNA, 19 nt, Homo sapiens
ggagauaauccauuugaua

SEQ ID NO: 847973 - RNA, 19 nt, Homo sapiens
cagaauggaugaauuaguu

SEQ ID NO: 847974 - RNA, 19 nt, Homo sapiens
caagugcucucuagauuug

SEQ ID NO: 847975 - RNA, 19 nt, Homo sapiens
gaaaucaucaggaauguga

SEQ ID NO: 847976 - RNA, 19 nt, Homo sapiens
cuaaugaggucacuacuga

SEQ ID NO: 847977 - RNA, 19 nt, Homo sapiens
ggaaaggcaugggaaugua

SEQ ID NO: 847978 - RNA, 19 nt, Homo sapiens
gaaaucaagaugcuuauga

SEQ ID NO: 847979 - RNA, 19 nt, Homo sapiens
ggaguuuccuagcuauaua

SEQ ID NO: 847980 - RNA, 19 nt, Homo sapiens
gagugagggugaauuuaua

SEQ ID NO: 847981 - RNA, 19 nt, Homo sapiens
gagaagacaaugagaagua

SEQ ID NO: 847982 - RNA, 19 nt, Homo sapiens
gaaagugggagauauuauu

SEQ ID NO: 847983 - RNA, 19 nt, Homo sapiens
gagaacaggccuuguguaa

SEQ ID NO: 847984 - RNA, 19 nt, Homo sapiens
gagcaaaugaaguguaaua

SEQ ID NO: 847985 - RNA, 19 nt, Homo sapiens
ccaagaagcgucaguguaa

SEQ ID NO: 847986 - RNA, 19 nt, Homo sapiens
ucagcugacuuguuacuua

SEQ ID NO: 847987 - RNA, 19 nt, Homo sapiens
gagcccagauuauugaauu

SEQ ID NO: 847988 - RNA, 19 nt, Homo sapiens
caaacuaacucauggagau

SEQ ID NO: 847989 - RNA, 19 nt, Homo sapiens
cucauuaucuugucacuua

SEQ ID NO: 847990 - RNA, 19 nt, Homo sapiens
aaucaaagcuaaaguggaa

SEQ ID NO: 847991 - RNA, 19 nt, Homo sapiens
ucacagaauggaugaauua

SEQ ID NO: 847992 - RNA, 19 nt, Homo sapiens
uaccaaagccaguaauuua

SEQ ID NO: 847993 - RNA, 19 nt, Homo sapiens
gacaaucaguuaaaucaga

SEQ ID NO: 847994 - RNA, 19 nt, Homo sapiens
gaagagaagacaaugagaa

SEQ ID NO: 847995 - RNA, 19 nt, Homo sapiens
gaaaagauuuggaagaaga

SEQ ID NO: 847996 - RNA, 19 nt, Homo sapiens
ucacuuaguucuucauguu

SEQ ID NO: 847997 - RNA, 19 nt, Homo sapiens
gguaacagaugauggugaa

SEQ ID NO: 847998 - RNA, 19 nt, Homo sapiens
ggagaaaucaucaggaaug

SEQ ID NO: 847999 - RNA, 19 nt, Homo sapiens
agaaugagacaaucaguua

SEQ ID NO: 848000 - RNA, 19 nt, Homo sapiens
gaauuuaagucugaagaug

SEQ ID NO: 848001 - RNA, 19 nt, Homo sapiens
caaagccaguaauuuauug

SEQ ID NO: 848002 - RNA, 19 nt, Homo sapiens
gaaggaguauuuccagaca

SEQ ID NO: 848003 - RNA, 19 nt, Homo sapiens
gaauguucccugacaauuu

SEQ ID NO: 848004 - RNA, 19 nt, Homo sapiens
cagcaugguugacuauauu

SEQ ID NO: 848005 - RNA, 19 nt, Homo sapiens
gaauucuguuguugugaua

SEQ ID NO: 848006 - RNA, 19 nt, Homo sapiens
gagacacacaguaucauua

SEQ ID NO: 848007 - RNA, 19 nt, Homo sapiens
gaagccaucugaauuaaaa

SEQ ID NO: 848008 - RNA, 19 nt, Homo sapiens
ggaaguuucuagcauuuca

SEQ ID NO: 848009 - RNA, 19 nt, Homo sapiens
ccagauaaaugaacuugau

SEQ ID NO: 848010 - RNA, 19 nt, Homo sapiens
ggaguggaacccugaauaa

SEQ ID NO: 848011 - RNA, 19 nt, Homo sapiens
gaacuucagcugacuuguu

SEQ ID NO: 848012 - RNA, 19 nt, Homo sapiens
gcaauuacuuucuguuggu

SEQ ID NO: 848013 - RNA, 19 nt, Homo sapiens
agugugagguuuccuauuu

SEQ ID NO: 848014 - RNA, 19 nt, Homo sapiens
gaagaagagaagacaauga

SEQ ID NO: 848015 - RNA, 19 nt, Homo sapiens
ggaauuggauuuggagaca

SEQ ID NO: 848016 - RNA, 19 nt, Homo sapiens
acaaagcuguuaccuucua

SEQ ID NO: 848017 - RNA, 19 nt, Homo sapiens
gaaucuucauugccaaauu

SEQ ID NO: 848018 - RNA, 19 nt, Homo sapiens
cagcugacuuguuacuuaa

SEQ ID NO: 848019 - RNA, 19 nt, Homo sapiens
ggaaauagagaagcugaaa

SEQ ID NO: 848020 - RNA, 19 nt, Homo sapiens
uccaaagccugaacugaua

SEQ ID NO: 848021 - RNA, 19 nt, Homo sapiens
aaucaacacuggaacagaa

SEQ ID NO: 848022 - RNA, 19 nt, Homo sapiens
gagacaaucaguuaaauca

SEQ ID NO: 848023 - RNA, 19 nt, Homo sapiens
gcaauaaaaugaccaagug

SEQ ID NO: 848024 - RNA, 19 nt, Homo sapiens
guucagguauucuuugaga

SEQ ID NO: 848025 - RNA, 19 nt, Homo sapiens
cugcaaugcuguuuauauu

SEQ ID NO: 848026 - RNA, 19 nt, Homo sapiens
gaccugguguucauaaugu

SEQ ID NO: 848027 - RNA, 19 nt, Homo sapiens
caugaaaucaagaugcuua

SEQ ID NO: 848028 - RNA, 19 nt, Homo sapiens
acacaaguggguuuauuua

SEQ ID NO: 848029 - RNA, 19 nt, Homo sapiens
agaaugugcucaguaguuu

SEQ ID NO: 848030 - RNA, 19 nt, Homo sapiens
acaagaacauccaguagug

SEQ ID NO: 848031 - RNA, 19 nt, Homo sapiens
guggaacccugaauaacaa

SEQ ID NO: 848032 - RNA, 19 nt, Homo sapiens
ggauauaaacucugugugu

SEQ ID NO: 848033 - RNA, 19 nt, Homo sapiens
uaagggauauaaacucugu

SEQ ID NO: 848034 - RNA, 19 nt, Homo sapiens
aacuucagcugacuuguua

SEQ ID NO: 848035 - RNA, 19 nt, Homo sapiens
agacggaauucaaggauga

SEQ ID NO: 848036 - RNA, 19 nt, Homo sapiens
gaagcaacgcuaugaacuu

SEQ ID NO: 848037 - RNA, 19 nt, Homo sapiens
ccugaagccaucugaauua

SEQ ID NO: 848038 - RNA, 19 nt, Homo sapiens
cugcagagaagaaauauuu

SEQ ID NO: 848039 - RNA, 19 nt, Homo sapiens
aaaaugggcucuucuaaug

SEQ ID NO: 848040 - RNA, 19 nt, Homo sapiens
gcaaaugaaguguaauauc

SEQ ID NO: 848041 - RNA, 19 nt, Homo sapiens
gugaaagaauuagagguaa

SEQ ID NO: 848042 - RNA, 19 nt, Homo sapiens
gaaggcugguggaguggaa

SEQ ID NO: 848043 - RNA, 19 nt, Homo sapiens
caagaagcgucaguguaaa

SEQ ID NO: 848044 - RNA, 19 nt, Homo sapiens
gcuucugucuuaauacaaa

SEQ ID NO: 848045 - RNA, 19 nt, Homo sapiens
guagagugagggugaauuu

SEQ ID NO: 848046 - RNA, 19 nt, Homo sapiens
guaugacuaugaugcugua

SEQ ID NO: 848047 - RNA, 19 nt, Homo sapiens
agaagacaaugagaaguaa

SEQ ID NO: 848048 - RNA, 19 nt, Homo sapiens
gaauuguugugcauuguag

SEQ ID NO: 848049 - RNA, 19 nt, Homo sapiens
gacauagcuuccucagaaa

SEQ ID NO: 848050 - RNA, 19 nt, Homo sapiens
gaacuuaaugguaaagaag

SEQ ID NO: 848051 - RNA, 19 nt, Homo sapiens
gagaaaucaucaggaaugu

SEQ ID NO: 848052 - RNA, 19 nt, Homo sapiens
ccagauuauugaauuguug

SEQ ID NO: 848053 - RNA, 19 nt, Homo sapiens
ccaaagccaguaauuuauu

SEQ ID NO: 848054 - RNA, 19 nt, Homo sapiens
ccacaagucccacccaaga

SEQ ID NO: 848055 - RNA, 19 nt, Homo sapiens
gaaugagacaaucaguuaa

SEQ ID NO: 848056 - RNA, 19 nt, Homo sapiens
gaauguauaguucagguau

SEQ ID NO: 848057 - RNA, 19 nt, Homo sapiens
gaaaugccaguaaacaaca

SEQ ID NO: 848058 - RNA, 19 nt, Homo sapiens
acaguugaaugccuuuaaa

SEQ ID NO: 848059 - RNA, 19 nt, Homo sapiens
cauaagggauauaaacucu

SEQ ID NO: 848060 - RNA, 19 nt, Homo sapiens
cagauuagccuuuuaguaa

SEQ ID NO: 848061 - RNA, 19 nt, Homo sapiens
aaagagagacggaauucaa

SEQ ID NO: 848062 - RNA, 19 nt, Homo sapiens
aagcuaaaguggaaacaga

SEQ ID NO: 848063 - RNA, 19 nt, Homo sapiens
aacuaaagcuagauucuga

SEQ ID NO: 848064 - RNA, 19 nt, Homo sapiens
gaacauagcaaaccauuga

SEQ ID NO: 848065 - RNA, 19 nt, Homo sapiens
gcaaagcaguauauuggua

SEQ ID NO: 848066 - RNA, 19 nt, Homo sapiens
cuacagagcuaacuacaaa

SEQ ID NO: 848067 - RNA, 19 nt, Homo sapiens
gcauggagguggucuauga

SEQ ID NO: 848068 - RNA, 19 nt, Homo sapiens
gaccuaagcuggccaauag

SEQ ID NO: 848069 - RNA, 19 nt, Homo sapiens
gagauuagcuaaaguuaag

SEQ ID NO: 848070 - RNA, 19 nt, Homo sapiens
gaagcugagucaagaaauu

SEQ ID NO: 848071 - RNA, 19 nt, Homo sapiens
uaacaucaaugcagaguug

SEQ ID NO: 848072 - RNA, 19 nt, Homo sapiens
ggagaccgcugcagauaug

SEQ ID NO: 848073 - RNA, 19 nt, Homo sapiens
gauuggaaauuguaccuuu

SEQ ID NO: 848074 - RNA, 19 nt, Homo sapiens
guucuaagguguuuauugu

SEQ ID NO: 848075 - RNA, 19 nt, Homo sapiens
cagcgaggguacuguauuu

SEQ ID NO: 848076 - RNA, 19 nt, Homo sapiens
augaugagcuggaagauuu

SEQ ID NO: 848077 - RNA, 19 nt, Homo sapiens
gaaauuguaccuuuguguu

SEQ ID NO: 848078 - RNA, 19 nt, Homo sapiens
gaucuagccuuuccaguac

SEQ ID NO: 848079 - RNA, 19 nt, Homo sapiens
gaagagaagcagaaacuca

SEQ ID NO: 848080 - RNA, 19 nt, Homo sapiens
gaacaacagccacaacauc

SEQ ID NO: 848081 - RNA, 19 nt, Homo sapiens
ggugaaaucugcacaucug

SEQ ID NO: 848082 - RNA, 19 nt, Homo sapiens
gaaagaagagaagcagaaa

SEQ ID NO: 848083 - RNA, 19 nt, Homo sapiens
ucaagucucucaucgauag

SEQ ID NO: 848084 - RNA, 19 nt, Homo sapiens
ggucuuggauacacaguug

SEQ ID NO: 848085 - RNA, 19 nt, Homo sapiens
cauagaugcaguauucuua

SEQ ID NO: 848086 - RNA, 19 nt, Homo sapiens
ucaaccagauugcauuuau

SEQ ID NO: 848087 - RNA, 19 nt, Homo sapiens
ugacaacgaugaagaagag

SEQ ID NO: 848088 - RNA, 19 nt, Homo sapiens
cauaucaaaucgugcauug

SEQ ID NO: 848089 - RNA, 19 nt, Homo sapiens
ugacuuggaucuauagcaa

SEQ ID NO: 848090 - RNA, 19 nt, Homo sapiens
gaagaugagugggacuugu

SEQ ID NO: 848091 - RNA, 19 nt, Homo sapiens
gagugggacuuguuucaug

SEQ ID NO: 848092 - RNA, 19 nt, Homo sapiens
uaauggguuugcagugaua

SEQ ID NO: 848093 - RNA, 19 nt, Homo sapiens
caaacugggucuuggauac

SEQ ID NO: 848094 - RNA, 19 nt, Homo sapiens
gggcaaagcaguauauugg

SEQ ID NO: 848095 - RNA, 19 nt, Homo sapiens
guaguggaguaauggguuu

SEQ ID NO: 848096 - RNA, 19 nt, Homo sapiens
ggaccuaagcuggccaaua

SEQ ID NO: 848097 - RNA, 19 nt, Homo sapiens
gaagcacuuuucccaaaua

SEQ ID NO: 848098 - RNA, 19 nt, Homo sapiens
ggagguggucuaugagaaa

SEQ ID NO: 848099 - RNA, 19 nt, Homo sapiens
guacaggcacuuucugaga

SEQ ID NO: 848100 - RNA, 19 nt, Homo sapiens
cgaucuagccuuuccagua

SEQ ID NO: 848101 - RNA, 19 nt, Homo sapiens
caaccagauugcauuuaug

SEQ ID NO: 848102 - RNA, 19 nt, Homo sapiens
ggugcuguccuaagaauuu

SEQ ID NO: 848103 - RNA, 19 nt, Homo sapiens
cgaggguacuguauuuaug

SEQ ID NO: 848104 - RNA, 19 nt, Homo sapiens
cacccauucuuucacuuua

SEQ ID NO: 848105 - RNA, 19 nt, Homo sapiens
gguuaaaacuaccugguua

SEQ ID NO: 848106 - RNA, 19 nt, Homo sapiens
gagaggagccacagagaca

SEQ ID NO: 848107 - RNA, 19 nt, Homo sapiens
gggcugacauggugugagu

SEQ ID NO: 848108 - RNA, 19 nt, Homo sapiens
ccucaagucucucaucgau

SEQ ID NO: 848109 - RNA, 19 nt, Homo sapiens
guaauggguuugcagugau

SEQ ID NO: 848110 - RNA, 19 nt, Homo sapiens
gugugaauguguugagauu

SEQ ID NO: 848111 - RNA, 19 nt, Homo sapiens
gaagaauuccuugauugga

SEQ ID NO: 848112 - RNA, 19 nt, Homo sapiens
ucuaagguguuuauuguag

SEQ ID NO: 848113 - RNA, 19 nt, Homo sapiens
agacagacgugauucaaaa

SEQ ID NO: 848114 - RNA, 19 nt, Homo sapiens
ugcuagcucugucuauaua

SEQ ID NO: 848115 - RNA, 19 nt, Homo sapiens
uaaccagaaucagguguga

SEQ ID NO: 848116 - RNA, 19 nt, Homo sapiens
gcaaguggaggagugcuaa

SEQ ID NO: 848117 - RNA, 19 nt, Homo sapiens
gguuagccauagagguuaa

SEQ ID NO: 848118 - RNA, 19 nt, Homo sapiens
gagauguugcuuaugcuuu

SEQ ID NO: 848119 - RNA, 19 nt, Homo sapiens
ugugugggauaaacaguaa

SEQ ID NO: 848120 - RNA, 19 nt, Homo sapiens
ggaaauuguaccuuugugu

SEQ ID NO: 848121 - RNA, 19 nt, Homo sapiens
uaacacaaacugggucuug

SEQ ID NO: 848122 - RNA, 19 nt, Homo sapiens
cuagcucugucuauauaaa

SEQ ID NO: 848123 - RNA, 19 nt, Homo sapiens
guagguguguugcgucauc

SEQ ID NO: 848124 - RNA, 19 nt, Homo sapiens
gcaguauucuuagccuuag

SEQ ID NO: 848125 - RNA, 19 nt, Homo sapiens
gugaauguguugagauuuu

SEQ ID NO: 848126 - RNA, 19 nt, Homo sapiens
gaaauacaaggaggcaaug

SEQ ID NO: 848127 - RNA, 19 nt, Homo sapiens
agagcuaacuacaaaguca

SEQ ID NO: 848128 - RNA, 19 nt, Homo sapiens
uaaggaaggagacaacugu

SEQ ID NO: 848129 - RNA, 19 nt, Homo sapiens
aaucaggugugaauguguu

SEQ ID NO: 848130 - RNA, 19 nt, Homo sapiens
ggcgagauguugcuuaugc

SEQ ID NO: 848131 - RNA, 19 nt, Homo sapiens
agaaagaagagaagcagaa

SEQ ID NO: 848132 - RNA, 19 nt, Homo sapiens
gcgaagcugagucaagaaa

SEQ ID NO: 848133 - RNA, 19 nt, Homo sapiens
aguaauggguuugcaguga

SEQ ID NO: 848134 - RNA, 19 nt, Homo sapiens
uaagguguuuauuguagug

SEQ ID NO: 848135 - RNA, 19 nt, Homo sapiens
aaaccuuuguccucacuug

SEQ ID NO: 848136 - RNA, 19 nt, Homo sapiens
gaucuuaaagggcaaagca

SEQ ID NO: 848137 - RNA, 19 nt, Homo sapiens
uguguugcgucaucuguuu

SEQ ID NO: 848138 - RNA, 19 nt, Homo sapiens
aggcgaagcugagucaaga

SEQ ID NO: 848139 - RNA, 19 nt, Homo sapiens
gcgaggguacuguauuuau

SEQ ID NO: 848140 - RNA, 19 nt, Homo sapiens
gcaguauauugguaguugu

SEQ ID NO: 848141 - RNA, 19 nt, Homo sapiens
gacaguccguauaguguag

SEQ ID NO: 848142 - RNA, 19 nt, Homo sapiens
ucuguucccuacccuguaa

SEQ ID NO: 848143 - RNA, 19 nt, Homo sapiens
gguuugcagugauaaguca

SEQ ID NO: 848144 - RNA, 19 nt, Homo sapiens
gaccccagguucaaaagua

SEQ ID NO: 848145 - RNA, 19 nt, Homo sapiens
guaacacgaauuuaacugu

SEQ ID NO: 848146 - RNA, 19 nt, Homo sapiens
ccugaggaguguguuguuu

SEQ ID NO: 848147 - RNA, 19 nt, Homo sapiens
cggagauucuugugacaug

SEQ ID NO: 848148 - RNA, 19 nt, Homo sapiens
gcucagugaccaaggaaga

SEQ ID NO: 848149 - RNA, 19 nt, Homo sapiens
agugcuagcucugucuaua

SEQ ID NO: 848150 - RNA, 19 nt, Homo sapiens
ugacaguccguauagugua

SEQ ID NO: 848151 - RNA, 19 nt, Homo sapiens
ggagauucuugugacaugu

SEQ ID NO: 848152 - RNA, 19 nt, Homo sapiens
aaguuaaguuguuggaaga

SEQ ID NO: 848153 - RNA, 19 nt, Homo sapiens
guggguauuugccucauuc

SEQ ID NO: 848154 - RNA, 19 nt, Homo sapiens
uaaagggcaaagcaguaua

SEQ ID NO: 848155 - RNA, 19 nt, Homo sapiens
agagaggcauaacaucaau

SEQ ID NO: 848156 - RNA, 19 nt, Homo sapiens
ucaagugcauucgcaagug

SEQ ID NO: 848157 - RNA, 19 nt, Homo sapiens
cagcugcccuuuuguaaga

SEQ ID NO: 848158 - RNA, 19 nt, Homo sapiens
ccacccauucuuucacuuu

SEQ ID NO: 848159 - RNA, 19 nt, Homo sapiens
ucaaaacucuguucuaagg

SEQ ID NO: 848160 - RNA, 19 nt, Homo sapiens
agaaucaggugugaaugug

SEQ ID NO: 848161 - RNA, 19 nt, Homo sapiens
caggugcuguccuaagaau

SEQ ID NO: 848162 - RNA, 19 nt, Homo sapiens
gagaagcagaaacucauuc

SEQ ID NO: 848163 - RNA, 19 nt, Homo sapiens
gaaacaggaagaagcaacu

SEQ ID NO: 848164 - RNA, 19 nt, Homo sapiens
guacucaagugaucuauua

SEQ ID NO: 848165 - RNA, 19 nt, Homo sapiens
acaagaagcuuaaggauga

SEQ ID NO: 848166 - RNA, 19 nt, Homo sapiens
gaaaagaucugcauguuga

SEQ ID NO: 848167 - RNA, 19 nt, Homo sapiens
ggaaacagcucaguucuca

SEQ ID NO: 848168 - RNA, 19 nt, Homo sapiens
caaacaaaguggaaguaua

SEQ ID NO: 848169 - RNA, 19 nt, Homo sapiens
gcagaucacuugcagguau

SEQ ID NO: 848170 - RNA, 19 nt, Homo sapiens
gguauuagcugaguuuaga

SEQ ID NO: 848171 - RNA, 19 nt, Homo sapiens
caagugaucuauuaucuag

SEQ ID NO: 848172 - RNA, 19 nt, Homo sapiens
ggaagcaaaugucuuuauc

SEQ ID NO: 848173 - RNA, 19 nt, Homo sapiens
caguagagguuuacaaaga

SEQ ID NO: 848174 - RNA, 19 nt, Homo sapiens
gcaaucacacguacuguuu

SEQ ID NO: 848175 - RNA, 19 nt, Homo sapiens
ugaagagggugaacaaaug

SEQ ID NO: 848176 - RNA, 19 nt, Homo sapiens
gccauuacaccuaaauuua

SEQ ID NO: 848177 - RNA, 19 nt, Homo sapiens
gagaggagauuugggauuc

SEQ ID NO: 848178 - RNA, 19 nt, Homo sapiens
ggaacucggugcagauaug

SEQ ID NO: 848179 - RNA, 19 nt, Homo sapiens
ggaaucaucagaacccuaa

SEQ ID NO: 848180 - RNA, 19 nt, Homo sapiens
gagcucagaauuacuuuaa

SEQ ID NO: 848181 - RNA, 19 nt, Homo sapiens
uuagaguacuuucugcuua

SEQ ID NO: 848182 - RNA, 19 nt, Homo sapiens
gcacauuuccuguucuuga

SEQ ID NO: 848183 - RNA, 19 nt, Homo sapiens
gaacacacaaugcaaagug

SEQ ID NO: 848184 - RNA, 19 nt, Homo sapiens
gguggaagaucagaauaaa

SEQ ID NO: 848185 - RNA, 19 nt, Homo sapiens
gaugaaaucagcaaauguu

SEQ ID NO: 848186 - RNA, 19 nt, Homo sapiens
acaaagaguacaaagguua

SEQ ID NO: 848187 - RNA, 19 nt, Homo sapiens
ggaggugugugaaaucugu

SEQ ID NO: 848188 - RNA, 19 nt, Homo sapiens
auacagagcuuucaagaac

SEQ ID NO: 848189 - RNA, 19 nt, Homo sapiens
uaacaaacacccaaacugu

SEQ ID NO: 848190 - RNA, 19 nt, Homo sapiens
gcaccuuucuggaguggaa

SEQ ID NO: 848191 - RNA, 19 nt, Homo sapiens
ggaagucagugccuauucu

SEQ ID NO: 848192 - RNA, 19 nt, Homo sapiens
aaacccaaaucaucaagaa

SEQ ID NO: 848193 - RNA, 19 nt, Homo sapiens
gcaaagugagcgcagcaua

SEQ ID NO: 848194 - RNA, 19 nt, Homo sapiens
cagccaaggugacguguga

SEQ ID NO: 848195 - RNA, 19 nt, Homo sapiens
acugugagguucuuuaauu

SEQ ID NO: 848196 - RNA, 19 nt, Homo sapiens
gcacugugagguucuuuaa

SEQ ID NO: 848197 - RNA, 19 nt, Homo sapiens
uagaguacuuucugcuuaa

SEQ ID NO: 848198 - RNA, 19 nt, Homo sapiens
gggaagagugaaagauaua

SEQ ID NO: 848199 - RNA, 19 nt, Homo sapiens
gacaaagugugcaguaucu

SEQ ID NO: 848200 - RNA, 19 nt, Homo sapiens
cgaggucacugcauccauu

SEQ ID NO: 848201 - RNA, 19 nt, Homo sapiens
guaauuguauugagaacuc

SEQ ID NO: 848202 - RNA, 19 nt, Homo sapiens
ucacaugacuuggcaaaca

SEQ ID NO: 848203 - RNA, 19 nt, Homo sapiens
aaacaaaguggaaguauag

SEQ ID NO: 848204 - RNA, 19 nt, Homo sapiens
caagaacacacaaugcaaa

SEQ ID NO: 848205 - RNA, 19 nt, Homo sapiens
cauuaagucuuguccagaa

SEQ ID NO: 848206 - RNA, 19 nt, Homo sapiens
ggaaguauguaggauccaa

SEQ ID NO: 848207 - RNA, 19 nt, Homo sapiens
ggauuccucuauaguguau

SEQ ID NO: 848208 - RNA, 19 nt, Homo sapiens
gugcggagcuucccuguac

SEQ ID NO: 848209 - RNA, 19 nt, Homo sapiens
ucuauuaucuagcugcaaa

SEQ ID NO: 848210 - RNA, 19 nt, Homo sapiens
uagaucuucuucucccuua

SEQ ID NO: 848211 - RNA, 19 nt, Homo sapiens
caaagaguacaaagguuaa

SEQ ID NO: 848212 - RNA, 19 nt, Homo sapiens
caagcuggaauuuaucuaa

SEQ ID NO: 848213 - RNA, 19 nt, Homo sapiens
ucagaacccuaaagaguag

SEQ ID NO: 848214 - RNA, 19 nt, Homo sapiens
gaauucugcuccugaagag

SEQ ID NO: 848215 - RNA, 19 nt, Homo sapiens
uagggaggcucuugaagga

SEQ ID NO: 848216 - RNA, 19 nt, Homo sapiens
caucagaacccuaaagagu

SEQ ID NO: 848217 - RNA, 19 nt, Homo sapiens
gggauucucuccaauugca

SEQ ID NO: 848218 - RNA, 19 nt, Homo sapiens
gaaggaagucagugccuau

SEQ ID NO: 848219 - RNA, 19 nt, Homo sapiens
cuaauacuguugccuuaau

SEQ ID NO: 848220 - RNA, 19 nt, Homo sapiens
ggaagagugaaagauauaa

SEQ ID NO: 848221 - RNA, 19 nt, Homo sapiens
ggacaaagugugcaguauc

SEQ ID NO: 848222 - RNA, 19 nt, Homo sapiens
gcaaacaaaguggaaguau

SEQ ID NO: 848223 - RNA, 19 nt, Homo sapiens
ucucaagugucccaaauca

SEQ ID NO: 848224 - RNA, 19 nt, Homo sapiens
gaggaaggcucaugaaaag

SEQ ID NO: 848225 - RNA, 19 nt, Homo sapiens
gguauuaguggcaaauuau

SEQ ID NO: 848226 - RNA, 19 nt, Homo sapiens
caggguaauuguauugaga

SEQ ID NO: 848227 - RNA, 19 nt, Homo sapiens
ggaguggaaucaucagaac

SEQ ID NO: 848228 - RNA, 19 nt, Homo sapiens
gaagggcuacugugccuau

SEQ ID NO: 848229 - RNA, 19 nt, Homo sapiens
cacccaagguuucugauuc

SEQ ID NO: 848230 - RNA, 19 nt, Homo sapiens
ggacaagaagcuuaaggau

SEQ ID NO: 848231 - RNA, 19 nt, Homo sapiens
gggcacauuuccuguucuu

SEQ ID NO: 848232 - RNA, 19 nt, Homo sapiens
aguggcaaauuauagguua

SEQ ID NO: 848233 - RNA, 19 nt, Homo sapiens
uaagguauuagcugaguuu

SEQ ID NO: 848234 - RNA, 19 nt, Homo sapiens
caaaguggaaguauagauc

SEQ ID NO: 848235 - RNA, 19 nt, Homo sapiens
ggagucuucagcccuauaa

SEQ ID NO: 848236 - RNA, 19 nt, Homo sapiens
gguaacaacuaacaaacac

SEQ ID NO: 848237 - RNA, 19 nt, Homo sapiens
ggaagguauuaguggcaaa

SEQ ID NO: 848238 - RNA, 19 nt, Homo sapiens
guguauuucucuaguguau

SEQ ID NO: 848239 - RNA, 19 nt, Homo sapiens
caacuaacaaacacccaaa

SEQ ID NO: 848240 - RNA, 19 nt, Homo sapiens
guugugagcucagaauuac

SEQ ID NO: 848241 - RNA, 19 nt, Homo sapiens
aagcuguaccuaccaaaua

SEQ ID NO: 848242 - RNA, 19 nt, Homo sapiens
agguauuaguggcaaauua

SEQ ID NO: 848243 - RNA, 19 nt, Homo sapiens
uguauuggguggaagauca

SEQ ID NO: 848244 - RNA, 19 nt, Homo sapiens
ccaauugcaaucacacgua

SEQ ID NO: 848245 - RNA, 19 nt, Homo sapiens
gaacucggugcagauauga

SEQ ID NO: 848246 - RNA, 19 nt, Homo sapiens
cacauuuccuguucuugaa

SEQ ID NO: 848247 - RNA, 19 nt, Homo sapiens
gcggugugccgaacaguuu

SEQ ID NO: 848248 - RNA, 19 nt, Homo sapiens
gcagaggaaggcucaugaa

SEQ ID NO: 848249 - RNA, 19 nt, Homo sapiens
gggcuacugugccuaugga

SEQ ID NO: 848250 - RNA, 19 nt, Homo sapiens
gaccaucagauaacuguau

SEQ ID NO: 848251 - RNA, 19 nt, Homo sapiens
gcacccaagguuucugauu

SEQ ID NO: 848252 - RNA, 19 nt, Homo sapiens
guagaugguugcccugcau

SEQ ID NO: 848253 - RNA, 19 nt, Homo sapiens
ggguggaagaucagaauaa

SEQ ID NO: 848254 - RNA, 19 nt, Homo sapiens
uaucagaguuuguaauucc

SEQ ID NO: 848255 - RNA, 19 nt, Homo sapiens
agaugaagccgcauuccua

SEQ ID NO: 848256 - RNA, 19 nt, Homo sapiens
gaagagggugaacaaaugg

SEQ ID NO: 848257 - RNA, 19 nt, Homo sapiens
gcuggaauuuaucuaaucu

SEQ ID NO: 848258 - RNA, 19 nt, Homo sapiens
caaagugagcgcagcauag

SEQ ID NO: 848259 - RNA, 19 nt, Homo sapiens
cagaucacuugcagguauu

SEQ ID NO: 848260 - RNA, 19 nt, Homo sapiens
ugagaaaccucggaaacag

SEQ ID NO: 848261 - RNA, 19 nt, Homo sapiens
gcuagcagagccugagaaa

SEQ ID NO: 848262 - RNA, 19 nt, Homo sapiens
gaaguauguaggauccaaa

SEQ ID NO: 848263 - RNA, 19 nt, Homo sapiens
uuacaaagaguacaaaggu

SEQ ID NO: 848264 - RNA, 19 nt, Homo sapiens
caaaugaaaugcccugcaa

SEQ ID NO: 848265 - RNA, 19 nt, Homo sapiens
caaggcagcuucguuguuc

SEQ ID NO: 848266 - RNA, 19 nt, Homo sapiens
gcaccaucuuuccuucaug

SEQ ID NO: 848267 - RNA, 19 nt, Homo sapiens
cagaauggccuuggacuca

SEQ ID NO: 848268 - RNA, 19 nt, Homo sapiens
gccaacgccucaggaauca

SEQ ID NO: 848269 - RNA, 19 nt, Homo sapiens
gccauuagcauuucauguc

SEQ ID NO: 848270 - RNA, 19 nt, Homo sapiens
gguuuggccauuagcauuu

SEQ ID NO: 848271 - RNA, 19 nt, Homo sapiens
cgcuggagcugaaggaaug

SEQ ID NO: 848272 - RNA, 19 nt, Homo sapiens
gccuuggacucaccuugaa

SEQ ID NO: 848273 - RNA, 19 nt, Homo sapiens
acgcagggcugaggaugaa

SEQ ID NO: 848274 - RNA, 19 nt, Homo sapiens
ccauuagcauuucaugucu

SEQ ID NO: 848275 - RNA, 19 nt, Homo sapiens
gcagggcugaggaugaaga

SEQ ID NO: 848276 - RNA, 19 nt, Homo sapiens
aggaggcgcuggagcugaa

SEQ ID NO: 848277 - RNA, 19 nt, Homo sapiens
cggcuaccgugcucaagga

SEQ ID NO: 848278 - RNA, 19 nt, Homo sapiens
cccuaggccuggucaaguu

SEQ ID NO: 848279 - RNA, 19 nt, Homo sapiens
ucaaggcagcuucguuguu

SEQ ID NO: 848280 - RNA, 19 nt, Homo sapiens
gggagcugcugggccuaaa

SEQ ID NO: 848281 - RNA, 19 nt, Homo sapiens
ggccuuggacucaccuuga

SEQ ID NO: 848282 - RNA, 19 nt, Homo sapiens
ggguuuggccauuagcauu

SEQ ID NO: 848283 - RNA, 19 nt, Homo sapiens
gagccaacgccucaggaau

SEQ ID NO: 848284 - RNA, 19 nt, Homo sapiens
gggcgcaccaucuuuccuu

SEQ ID NO: 848285 - RNA, 19 nt, Homo sapiens
cauuagcauuucaugucuu

SEQ ID NO: 848286 - RNA, 19 nt, Homo sapiens
uggaagaucccggcuggaa

SEQ ID NO: 848287 - RNA, 19 nt, Homo sapiens
caaagaagguugucagaug

SEQ ID NO: 848288 - RNA, 19 nt, Homo sapiens
gaauacaucuuccauccaa

SEQ ID NO: 848289 - RNA, 19 nt, Homo sapiens
gagcuuggcugaagaggaa

SEQ ID NO: 848290 - RNA, 19 nt, Homo sapiens
uaaaugaaaucucggaaga

SEQ ID NO: 848291 - RNA, 19 nt, Homo sapiens
caagagcucuccgaaauga

SEQ ID NO: 848292 - RNA, 19 nt, Homo sapiens
gaacaugagaugaaugaaa

SEQ ID NO: 848293 - RNA, 19 nt, Homo sapiens
cgaaguauguccagaaugu

SEQ ID NO: 848294 - RNA, 19 nt, Homo sapiens
gaacacagaaacacuaaau

SEQ ID NO: 848295 - RNA, 19 nt, Homo sapiens
cgaaaugaaacacaacuua

SEQ ID NO: 848296 - RNA, 19 nt, Homo sapiens
gcucaccauugaacaguua

SEQ ID NO: 848297 - RNA, 19 nt, Homo sapiens
ugucauagauuuaggagaa

SEQ ID NO: 848298 - RNA, 19 nt, Homo sapiens
ugcaagagauggagguuua

SEQ ID NO: 848299 - RNA, 19 nt, Homo sapiens
ccucaugucuaaagaaauu

SEQ ID NO: 848300 - RNA, 19 nt, Homo sapiens
gcaaauagcgaaaguaguc

SEQ ID NO: 848301 - RNA, 19 nt, Homo sapiens
aaagaaaccuggcuuacug

SEQ ID NO: 848302 - RNA, 19 nt, Homo sapiens
gcaaagcugagauggauuu

SEQ ID NO: 848303 - RNA, 19 nt, Homo sapiens
ccgcugauauugccaagua

SEQ ID NO: 848304 - RNA, 19 nt, Homo sapiens
aaagagccaucugcuguua

SEQ ID NO: 848305 - RNA, 19 nt, Homo sapiens
ccacagagcuuggcugaag

SEQ ID NO: 848306 - RNA, 19 nt, Homo sapiens
gcaggucgaugcccgauuc

SEQ ID NO: 848307 - RNA, 19 nt, Homo sapiens
gaccauucccggaguaaua

SEQ ID NO: 848308 - RNA, 19 nt, Homo sapiens
gcagcauccugaaucuuaa

SEQ ID NO: 848309 - RNA, 19 nt, Homo sapiens
gagaacagccacuuucaga

SEQ ID NO: 848310 - RNA, 19 nt, Homo sapiens
caaagaaccaucucccaaa

SEQ ID NO: 848311 - RNA, 19 nt, Homo sapiens
gagcgaacuugucauagau

SEQ ID NO: 848312 - RNA, 19 nt, Homo sapiens
ugaaugaaaucgaaguaug

SEQ ID NO: 848313 - RNA, 19 nt, Homo sapiens
ggacagaugcauuccagaa

SEQ ID NO: 848314 - RNA, 19 nt, Homo sapiens
ugacagaaauauacaacga

SEQ ID NO: 848315 - RNA, 19 nt, Homo sapiens
caaacccaguggagauuaa

SEQ ID NO: 848316 - RNA, 19 nt, Homo sapiens
uaaccuggaucgaagcaaa

SEQ ID NO: 848317 - RNA, 19 nt, Homo sapiens
gaaaugaaacacaacuuag

SEQ ID NO: 848318 - RNA, 19 nt, Homo sapiens
ggauaaguauugacauuac

SEQ ID NO: 848319 - RNA, 19 nt, Homo sapiens
ggcagcauccugaaucuua

SEQ ID NO: 848320 - RNA, 19 nt, Homo sapiens
ugagaugaaugaaaucgaa

SEQ ID NO: 848321 - RNA, 19 nt, Homo sapiens
uauccuaccugcucaaguu

SEQ ID NO: 848322 - RNA, 19 nt, Homo sapiens
gcgaacuugucauagauuu

SEQ ID NO: 848323 - RNA, 19 nt, Homo sapiens
gcacagcgauucggaggau

SEQ ID NO: 848324 - RNA, 19 nt, Homo sapiens
aagcugagauggauuugaa

SEQ ID NO: 848325 - RNA, 19 nt, Homo sapiens
gcacaacugcaucauuuau

SEQ ID NO: 848326 - RNA, 19 nt, Homo sapiens
cagaaacacuaaauaaguc

SEQ ID NO: 848327 - RNA, 19 nt, Homo sapiens
gaacauccgcaggaaguuu

SEQ ID NO: 848328 - RNA, 19 nt, Homo sapiens
gagcagcagugaugagaag

SEQ ID NO: 848329 - RNA, 19 nt, Homo sapiens
aaaccuggcuuacugaaca

SEQ ID NO: 848330 - RNA, 19 nt, Homo sapiens
caucaacuguccagcagaa

SEQ ID NO: 848331 - RNA, 19 nt, Homo sapiens
gggccuggguuccaauaaa

SEQ ID NO: 848332 - RNA, 19 nt, Homo sapiens
gaaugaaaucgaaguaugu

SEQ ID NO: 848333 - RNA, 19 nt, Homo sapiens
gaacagcacccugacuaug

SEQ ID NO: 848334 - RNA, 19 nt, Homo sapiens
agaagcagcuggaguugga

SEQ ID NO: 848335 - RNA, 19 nt, Homo sapiens
gggauaaguauugacauua

SEQ ID NO: 848336 - RNA, 19 nt, Homo sapiens
ggacaagcagggaguuuau

SEQ ID NO: 848337 - RNA, 19 nt, Homo sapiens
caacagccaguaucaaaug

SEQ ID NO: 848338 - RNA, 19 nt, Homo sapiens
gcaucgagacccagaguaa

SEQ ID NO: 848339 - RNA, 19 nt, Homo sapiens
gagacgcccuccuccauuc

SEQ ID NO: 848340 - RNA, 19 nt, Homo sapiens
gaacuugucauagauuuag

SEQ ID NO: 848341 - RNA, 19 nt, Homo sapiens
aggauaaacugaagggaaa

SEQ ID NO: 848342 - RNA, 19 nt, Homo sapiens
caaagcacaauuaggcaua

SEQ ID NO: 848343 - RNA, 19 nt, Homo sapiens
ccauggacuuccuggauaa

SEQ ID NO: 848344 - RNA, 19 nt, Homo sapiens
acuaagacaugguccguuu

SEQ ID NO: 848345 - RNA, 19 nt, Homo sapiens
cauaaaggauaaacugaag

SEQ ID NO: 848346 - RNA, 19 nt, Homo sapiens
gcacaauuaggcauaaaug

SEQ ID NO: 848347 - RNA, 19 nt, Homo sapiens
ggucgaugcccgauucuuu

SEQ ID NO: 848348 - RNA, 19 nt, Homo sapiens
gcucgacccuugaccuuuc

SEQ ID NO: 848349 - RNA, 19 nt, Homo sapiens
ugaagaagcagcuggaguu

SEQ ID NO: 848350 - RNA, 19 nt, Homo sapiens
uaagaaggaacccaaagaa

SEQ ID NO: 848351 - RNA, 19 nt, Homo sapiens
gaacgagccagaagacaca

SEQ ID NO: 848352 - RNA, 19 nt, Homo sapiens
gaguugcaaagcacaauua

SEQ ID NO: 848353 - RNA, 19 nt, Homo sapiens
aaucacaaauugacgcaaa

SEQ ID NO: 848354 - RNA, 19 nt, Homo sapiens
gaacagcccagaaaagaaa

SEQ ID NO: 848355 - RNA, 19 nt, Homo sapiens
aagcaaagcugagauggau

SEQ ID NO: 848356 - RNA, 19 nt, Homo sapiens
ggauuuccuugucggauau

SEQ ID NO: 848357 - RNA, 19 nt, Homo sapiens
gaacagccacuuucagacu

SEQ ID NO: 848358 - RNA, 19 nt, Homo sapiens
agcaagagcucuccgaaau

SEQ ID NO: 848359 - RNA, 19 nt, Homo sapiens
agagcgaacuugucauaga

SEQ ID NO: 848360 - RNA, 19 nt, Homo sapiens
ccaagauccugaugagcaa

SEQ ID NO: 848361 - RNA, 19 nt, Homo sapiens
caaaagcucuaagggauaa

SEQ ID NO: 848362 - RNA, 19 nt, Homo sapiens
ccagaagcccguuccauug

SEQ ID NO: 848363 - RNA, 19 nt, Homo sapiens
ggaguaauaaauccaguug

SEQ ID NO: 848364 - RNA, 19 nt, Homo sapiens
ggagacgucagcugagaaa

SEQ ID NO: 848365 - RNA, 19 nt, Homo sapiens
gaaggaacccaaagaacca

SEQ ID NO: 848366 - RNA, 19 nt, Homo sapiens
cggauuuccuugucggaua

SEQ ID NO: 848367 - RNA, 19 nt, Homo sapiens
gagaacauccgcaggaagu

SEQ ID NO: 848368 - RNA, 19 nt, Homo sapiens
caaguuugccauucagaaa

SEQ ID NO: 848369 - RNA, 19 nt, Homo sapiens
ggaacaaugacagaaauau

SEQ ID NO: 848370 - RNA, 19 nt, Homo sapiens
gcaauaaaaggaacaauga

SEQ ID NO: 848371 - RNA, 19 nt, Homo sapiens
gauaguagcgauagugagu

SEQ ID NO: 848372 - RNA, 19 nt, Homo sapiens
gaagagccuccucccgaaa

SEQ ID NO: 848373 - RNA, 19 nt, Homo sapiens
gcaagagcucuccgaaaug

SEQ ID NO: 848374 - RNA, 19 nt, Homo sapiens
gcccugagccugagaagga

SEQ ID NO: 848375 - RNA, 19 nt, Homo sapiens
gguuccagcugaaucuuga

SEQ ID NO: 848376 - RNA, 19 nt, Homo sapiens
gaagcaaagcugagaugga

SEQ ID NO: 848377 - RNA, 19 nt, Homo sapiens
gaugaaugaaaucgaagua

SEQ ID NO: 848378 - RNA, 19 nt, Homo sapiens
agagccaucugcuguuaaa

SEQ ID NO: 848379 - RNA, 19 nt, Homo sapiens
gaccauagagaguugcaaa

SEQ ID NO: 848380 - RNA, 19 nt, Homo sapiens
gcgagucgguccagcaaca

SEQ ID NO: 848381 - RNA, 19 nt, Homo sapiens
gggacaagcagggaguuua

SEQ ID NO: 848382 - RNA, 19 nt, Homo sapiens
ucaccagccuccaccaaga

SEQ ID NO: 848383 - RNA, 19 nt, Homo sapiens
uaccucaugucuaaagaaa

SEQ ID NO: 848384 - RNA, 19 nt, Homo sapiens
aauaauugcuaccucaugu

SEQ ID NO: 848385 - RNA, 19 nt, Homo sapiens
ggccuggguuccaauaaau

SEQ ID NO: 848386 - RNA, 19 nt, Homo sapiens
guaaagccaugacaaugcu

SEQ ID NO: 848387 - RNA, 19 nt, Homo sapiens
guagauacaucaacaugcu

SEQ ID NO: 848388 - RNA, 19 nt, Homo sapiens
cggagcagauggcccagua

SEQ ID NO: 848389 - RNA, 19 nt, Homo sapiens
gcagauggcccaguacaca

SEQ ID NO: 848390 - RNA, 19 nt, Homo sapiens
guauggagaaagagacaaa

SEQ ID NO: 848391 - RNA, 19 nt, Homo sapiens
guguggcucuguugcugua

SEQ ID NO: 848392 - RNA, 19 nt, Homo sapiens
caauaaagcaagucaaagc

SEQ ID NO: 848393 - RNA, 19 nt, Homo sapiens
gcacaggcucaauaaagca

SEQ ID NO: 848394 - RNA, 19 nt, Homo sapiens
gaccaagccuaggcaugug

SEQ ID NO: 848395 - RNA, 19 nt, Homo sapiens
gcugagcuccguagauaca

SEQ ID NO: 848396 - RNA, 19 nt, Homo sapiens
gagcagauggcccaguaca

SEQ ID NO: 848397 - RNA, 19 nt, Homo sapiens
ugaccaagccuaggcaugu

SEQ ID NO: 848398 - RNA, 19 nt, Homo sapiens
ccuacaggcggauaugaaa

SEQ ID NO: 848399 - RNA, 19 nt, Homo sapiens
ccgcuggacuuguaacacu

SEQ ID NO: 848400 - RNA, 19 nt, Homo sapiens
cucaauaaagcaagucaaa

SEQ ID NO: 848401 - RNA, 19 nt, Homo sapiens
ggacacgcuggccuucuca

SEQ ID NO: 848402 - RNA, 19 nt, Homo sapiens
ccagguauggagaaagaga

SEQ ID NO: 848403 - RNA, 19 nt, Homo sapiens
acaucaacaugcugaccaa

SEQ ID NO: 848404 - RNA, 19 nt, Homo sapiens
gagcuccguagauacauca

SEQ ID NO: 848405 - RNA, 19 nt, Homo sapiens
cugcacaggcucaauaaag

SEQ ID NO: 848406 - RNA, 19 nt, Homo sapiens
cuccguagauacaucaaca

SEQ ID NO: 848407 - RNA, 19 nt, Homo sapiens
acgcuggccuucucagagu

SEQ ID NO: 848408 - RNA, 19 nt, Homo sapiens
ccugguccaucaucacuua

SEQ ID NO: 848409 - RNA, 19 nt, Homo sapiens
ccucagguaugggaaacua

SEQ ID NO: 848410 - RNA, 19 nt, Homo sapiens
ccaccucauuuacauguuc

SEQ ID NO: 848411 - RNA, 19 nt, Homo sapiens
guccuucccuggucccaaa

SEQ ID NO: 848412 - RNA, 19 nt, Homo sapiens
gaccacgcccaccucauuu

SEQ ID NO: 848413 - RNA, 19 nt, Homo sapiens
caucaagucacauaacauc

SEQ ID NO: 848414 - RNA, 19 nt, Homo sapiens
agaccacgcccaccucauu

SEQ ID NO: 848415 - RNA, 19 nt, Homo sapiens
aagagcggauugcacagaa

SEQ ID NO: 848416 - RNA, 19 nt, Homo sapiens
cugcucaucugcuucacaa

SEQ ID NO: 848417 - RNA, 19 nt, Homo sapiens
agugcgcccuugaaacuuu

SEQ ID NO: 848418 - RNA, 19 nt, Homo sapiens
cccaucaagucacauaaca

SEQ ID NO: 848419 - RNA, 19 nt, Homo sapiens
caaaauaaagagcggauug

SEQ ID NO: 848420 - RNA, 19 nt, Homo sapiens
aaacuuuccucgccuucca

SEQ ID NO: 848421 - RNA, 19 nt, Homo sapiens
ccacccugguccaucauca

SEQ ID NO: 848422 - RNA, 19 nt, Homo sapiens
gguccaucaucacuuacga

SEQ ID NO: 848423 - RNA, 19 nt, Homo sapiens
ggauuccuuucccuucgau

SEQ ID NO: 848424 - RNA, 19 nt, Homo sapiens
agagcggauugcacagaaa

SEQ ID NO: 848425 - RNA, 19 nt, Homo sapiens
gagcugcagggcugugugu

SEQ ID NO: 848426 - RNA, 19 nt, Homo sapiens
gcccaccucauuuacaugu

SEQ ID NO: 848427 - RNA, 19 nt, Homo sapiens
gagccgcugcuacgccuau

SEQ ID NO: 848428 - RNA, 19 nt, Homo sapiens
gcaugggccuccagccuuu

SEQ ID NO: 848429 - RNA, 19 nt, Homo sapiens
gggaaggccuuggagauga

SEQ ID NO: 848430 - RNA, 19 nt, Homo sapiens
uuguaaggcugguaaauaa

SEQ ID NO: 848431 - RNA, 19 nt, Homo sapiens
aggaggagcugaagaggaa

SEQ ID NO: 848432 - RNA, 19 nt, Homo sapiens
ccaggagccuugccucaga

SEQ ID NO: 848433 - RNA, 19 nt, Homo sapiens
ccaacugaguggcugguuu

SEQ ID NO: 848434 - RNA, 19 nt, Homo sapiens
ucaugaugcugcuuucuga

SEQ ID NO: 848435 - RNA, 19 nt, Homo sapiens
ggacaauccucuauuuccu

SEQ ID NO: 848436 - RNA, 19 nt, Homo sapiens
ggacuccuaugccaacuac

SEQ ID NO: 848437 - RNA, 19 nt, Homo sapiens
gaccuguaccacuuuguua

SEQ ID NO: 848438 - RNA, 19 nt, Homo sapiens
caggugcccucaaguccua

SEQ ID NO: 848439 - RNA, 19 nt, Homo sapiens
gcugugccauccagaauca

SEQ ID NO: 848440 - RNA, 19 nt, Homo sapiens
gaugacagccacccacuuc

SEQ ID NO: 848441 - RNA, 19 nt, Homo sapiens
agaggaaaguggagcaaug

SEQ ID NO: 848442 - RNA, 19 nt, Homo sapiens
guaaggcugguaaauaaau

SEQ ID NO: 848443 - RNA, 19 nt, Homo sapiens
caggagggcucaggacaau

SEQ ID NO: 848444 - RNA, 19 nt, Homo sapiens
uggcugagcugagggagaa

SEQ ID NO: 848445 - RNA, 19 nt, Homo sapiens
uggcugaccuguaccacuu

SEQ ID NO: 848446 - RNA, 19 nt, Homo sapiens
gggacugauucuucucuug

SEQ ID NO: 848447 - RNA, 19 nt, Homo sapiens
ggaaggaaggagagguuug

SEQ ID NO: 848448 - RNA, 19 nt, Homo sapiens
caacgugucaggccucuuc

SEQ ID NO: 848449 - RNA, 19 nt, Homo sapiens
gagcaggaggugaacaaga

SEQ ID NO: 848450 - RNA, 19 nt, Homo sapiens
ggccucuucucagcuguua

SEQ ID NO: 848451 - RNA, 19 nt, Homo sapiens
ccuucgaccucuaugauga

SEQ ID NO: 848452 - RNA, 19 nt, Homo sapiens
ggaaggccuuggagaugag

SEQ ID NO: 848453 - RNA, 19 nt, Homo sapiens
caucgaggccugcgucaug

SEQ ID NO: 848454 - RNA, 19 nt, Homo sapiens
cuacgggacugauucuucu

SEQ ID NO: 848455 - RNA, 19 nt, Homo sapiens
caacugaguggcugguuuc

SEQ ID NO: 848456 - RNA, 19 nt, Homo sapiens
ccaccggacucuccacucu

SEQ ID NO: 848457 - RNA, 19 nt, Homo sapiens
ccucuucccuggagacauc

SEQ ID NO: 848458 - RNA, 19 nt, Homo sapiens
ggagaaccacggccaagca

SEQ ID NO: 848459 - RNA, 19 nt, Homo sapiens
ccagcaacaucgccauagu

SEQ ID NO: 848460 - RNA, 19 nt, Homo sapiens
uaccaucgcaggucacuga

SEQ ID NO: 848461 - RNA, 19 nt, Homo sapiens
gcugguuucucccuaagca

SEQ ID NO: 848462 - RNA, 19 nt, Homo sapiens
gagcugugccauccagaau

SEQ ID NO: 848463 - RNA, 19 nt, Homo sapiens
cuggagacaucaacuucaa

SEQ ID NO: 848464 - RNA, 19 nt, Homo sapiens
ggaugcagccuccgugucu

SEQ ID NO: 848465 - RNA, 19 nt, Homo sapiens
gagcgcagacacccucuuc

SEQ ID NO: 848466 - RNA, 19 nt, Homo sapiens
auacgaccauggccaacaa

SEQ ID NO: 848467 - RNA, 19 nt, Homo sapiens
gaagaggaaaguggagcaa

SEQ ID NO: 848468 - RNA, 19 nt, Homo sapiens
uuuguaaggcugguaaaua

SEQ ID NO: 848469 - RNA, 19 nt, Homo sapiens
agcaggaggugaacaagau

SEQ ID NO: 848470 - RNA, 19 nt, Homo sapiens
gaccuucgaccucuaugau

SEQ ID NO: 848471 - RNA, 19 nt, Homo sapiens
gcugaccuguaccacuuug

SEQ ID NO: 848472 - RNA, 19 nt, Homo sapiens
guggcugguuucucccuaa

SEQ ID NO: 848473 - RNA, 19 nt, Homo sapiens
gcuguggccaccugagaaa

SEQ ID NO: 848474 - RNA, 19 nt, Homo sapiens
cagccauccucaaacacaa

SEQ ID NO: 848475 - RNA, 19 nt, Homo sapiens
gaaggaaggagagguuugc

SEQ ID NO: 848476 - RNA, 19 nt, Homo sapiens
uggacaagcgggugaagaa

SEQ ID NO: 848477 - RNA, 19 nt, Homo sapiens
uaugccaacuacuucauuc

SEQ ID NO: 848478 - RNA, 19 nt, Homo sapiens
gcaaugcagggacgaguac

SEQ ID NO: 848479 - RNA, 19 nt, Homo sapiens
gaauucaggcagcagucaa

SEQ ID NO: 848480 - RNA, 19 nt, Homo sapiens
ucagucaggcaaccaagaa

SEQ ID NO: 848481 - RNA, 19 nt, Homo sapiens
gguagucacagccauacga

SEQ ID NO: 848482 - RNA, 19 nt, Homo sapiens
gacuggaacacacucaaga

SEQ ID NO: 848483 - RNA, 19 nt, Homo sapiens
gaugaccuucgaccucuau

SEQ ID NO: 848484 - RNA, 19 nt, Homo sapiens
uggagauucaggccgauua

SEQ ID NO: 848485 - RNA, 19 nt, Homo sapiens
guggccaccugagaaagaa

SEQ ID NO: 848486 - RNA, 19 nt, Homo sapiens
ccgaggagcaggaggugaa

SEQ ID NO: 848487 - RNA, 19 nt, Homo sapiens
cugagggcaugaaggaaga

SEQ ID NO: 848488 - RNA, 19 nt, Homo sapiens
ugccagccauccucaaaca

SEQ ID NO: 848489 - RNA, 19 nt, Homo sapiens
ccaggagggcucaggacaa

SEQ ID NO: 848490 - RNA, 19 nt, Homo sapiens
gcaggaggugaacaagaug

SEQ ID NO: 848491 - RNA, 19 nt, Homo sapiens
ggacaagcgggugaagaag

SEQ ID NO: 848492 - RNA, 19 nt, Homo sapiens
cagcagcuaccaaggaaag

SEQ ID NO: 848493 - RNA, 19 nt, Homo sapiens
gcuggcaacccaccugcaa

SEQ ID NO: 848494 - RNA, 19 nt, Homo sapiens
ugaccuguaccacuuuguu

SEQ ID NO: 848495 - RNA, 19 nt, Homo sapiens
uucagcagcuaccaaggaa

SEQ ID NO: 848496 - RNA, 19 nt, Homo sapiens
ccacgauggcugagagcuu

SEQ ID NO: 848497 - RNA, 19 nt, Homo sapiens
uggcugagagcuucaagga

SEQ ID NO: 848498 - RNA, 19 nt, Homo sapiens
cauccucaaacacaagaaa

SEQ ID NO: 848499 - RNA, 19 nt, Homo sapiens
gcuccuacgggacugauuc

SEQ ID NO: 848500 - RNA, 19 nt, Homo sapiens
gcagcuaccaaggaaagga

SEQ ID NO: 848501 - RNA, 19 nt, Homo sapiens
gaugcagccuccgugucuu

SEQ ID NO: 848502 - RNA, 19 nt, Homo sapiens
cccacagccuggaggaguu

SEQ ID NO: 848503 - RNA, 19 nt, Homo sapiens
gcagaccacuccccuucga

SEQ ID NO: 848504 - RNA, 19 nt, Homo sapiens
acaagcgggugaagaagcu

SEQ ID NO: 848505 - RNA, 19 nt, Homo sapiens
gaagaaggguuacaucgua

SEQ ID NO: 848506 - RNA, 19 nt, Homo sapiens
ggacggaucuacaucauca

SEQ ID NO: 848507 - RNA, 19 nt, Homo sapiens
gaaaacaccuacugacuuu

SEQ ID NO: 848508 - RNA, 19 nt, Homo sapiens
gacaaggacuucaacauca

SEQ ID NO: 848509 - RNA, 19 nt, Homo sapiens
gaucaucgaccgcaagaaa

SEQ ID NO: 848510 - RNA, 19 nt, Homo sapiens
gcagguaggaucugaagaa

SEQ ID NO: 848511 - RNA, 19 nt, Homo sapiens
gcaagcaccuagcaugaca

SEQ ID NO: 848512 - RNA, 19 nt, Homo sapiens
caucaagacuuacgagauc

SEQ ID NO: 848513 - RNA, 19 nt, Homo sapiens
caauguggcugucaagauc

SEQ ID NO: 848514 - RNA, 19 nt, Homo sapiens
gcuccaucaucaagacuua

SEQ ID NO: 848515 - RNA, 19 nt, Homo sapiens
gcaccuagcaugacaaugg

SEQ ID NO: 848516 - RNA, 19 nt, Homo sapiens
ucaggaagaugcugcguau

SEQ ID NO: 848517 - RNA, 19 nt, Homo sapiens
gcagucggccuucacguaa

SEQ ID NO: 848518 - RNA, 19 nt, Homo sapiens
guaccgcgcugagugcaaa

SEQ ID NO: 848519 - RNA, 19 nt, Homo sapiens
uaaacuaaguaggcaggua

SEQ ID NO: 848520 - RNA, 19 nt, Homo sapiens
ggaucuacaucaucaugga

SEQ ID NO: 848521 - RNA, 19 nt, Homo sapiens
cgacaaggacuucaacauc

SEQ ID NO: 848522 - RNA, 19 nt, Homo sapiens
acaaggacuucaacaucaa

SEQ ID NO: 848523 - RNA, 19 nt, Homo sapiens
guaggcagguaggaucuga

SEQ ID NO: 848524 - RNA, 19 nt, Homo sapiens
ggaaagcaagcaccuagca

SEQ ID NO: 848525 - RNA, 19 nt, Homo sapiens
gcaaggguuccuacgcaaa

SEQ ID NO: 848526 - RNA, 19 nt, Homo sapiens
acaucaagcugucugacuu

SEQ ID NO: 848527 - RNA, 19 nt, Homo sapiens
ggaagaugcugcguaucca

SEQ ID NO: 848528 - RNA, 19 nt, Homo sapiens
gcggcuccaugcccuauga

SEQ ID NO: 848529 - RNA, 19 nt, Homo sapiens
ggaagaaggguuacaucgu

SEQ ID NO: 848530 - RNA, 19 nt, Homo sapiens
agacuuacgagaucuuuga

SEQ ID NO: 848531 - RNA, 19 nt, Homo sapiens
aaccacggcuccaucauca

SEQ ID NO: 848532 - RNA, 19 nt, Homo sapiens
ccaaagaccaucacaucuc

SEQ ID NO: 848533 - RNA, 19 nt, Homo sapiens
caucaagcugucugacuuu

SEQ ID NO: 848534 - RNA, 19 nt, Homo sapiens
gaaagcaagcaccuagcau

SEQ ID NO: 848535 - RNA, 19 nt, Homo sapiens
gcaagaaaacaccuacuga

SEQ ID NO: 848536 - RNA, 19 nt, Homo sapiens
aaacaccuacugacuuugu

SEQ ID NO: 848537 - RNA, 19 nt, Homo sapiens
caucguaggcaucaaucuu

SEQ ID NO: 848538 - RNA, 19 nt, Homo sapiens
caaccacggcuccaucauc

SEQ ID NO: 848539 - RNA, 19 nt, Homo sapiens
aagcaagcaccuagcauga

SEQ ID NO: 848540 - RNA, 19 nt, Homo sapiens
ggagcaccguguggacuuc

SEQ ID NO: 848541 - RNA, 19 nt, Homo sapiens
gugcaaggaccucaucuac

SEQ ID NO: 848542 - RNA, 19 nt, Homo sapiens
ccuaccagcccaaggugua

SEQ ID NO: 848543 - RNA, 19 nt, Homo sapiens
cagucggccuucacguaaa

SEQ ID NO: 848544 - RNA, 19 nt, Homo sapiens
caaacuggacaccaagaca

SEQ ID NO: 848545 - RNA, 19 nt, Homo sapiens
ucaauguggcugucaagau

SEQ ID NO: 848546 - RNA, 19 nt, Homo sapiens
uaugacgacuccgacauca

SEQ ID NO: 848547 - RNA, 19 nt, Homo sapiens
gcaaugggcgcaucauccu

SEQ ID NO: 848548 - RNA, 19 nt, Homo sapiens
gacgaugccacaguccuaa

SEQ ID NO: 848549 - RNA, 19 nt, Homo sapiens
cagguaggaucugaagaag

SEQ ID NO: 848550 - RNA, 19 nt, Homo sapiens
agugcaaacuggacaccaa

SEQ ID NO: 848551 - RNA, 19 nt, Homo sapiens
ccacggcuccaucaucaag

SEQ ID NO: 848552 - RNA, 19 nt, Homo sapiens
gccaaagaccaucacaucu

SEQ ID NO: 848553 - RNA, 19 nt, Homo sapiens
gagcgccucaaguucaaug

SEQ ID NO: 848554 - RNA, 19 nt, Homo sapiens
uaaggaagaaggguuacau

SEQ ID NO: 848555 - RNA, 19 nt, Homo sapiens
uuacaucguaggcaucaau

SEQ ID NO: 848556 - RNA, 19 nt, Homo sapiens
gaugcugcguauccagaag

SEQ ID NO: 848557 - RNA, 19 nt, Homo sapiens
gccugggcgugauccugua

SEQ ID NO: 848558 - RNA, 19 nt, Homo sapiens
gacggacggaucuacauca

SEQ ID NO: 848559 - RNA, 19 nt, Homo sapiens
ggacaaggcuucauucaua

SEQ ID NO: 848560 - RNA, 19 nt, Homo sapiens
gaacagugaucacauauau

SEQ ID NO: 848561 - RNA, 19 nt, Homo sapiens
ggagagaccuucaauaaga

SEQ ID NO: 848562 - RNA, 19 nt, Homo sapiens
caucuuaccuuuccaagua

SEQ ID NO: 848563 - RNA, 19 nt, Homo sapiens
gcgaagaccucaacacaaa

SEQ ID NO: 848564 - RNA, 19 nt, Homo sapiens
gaaagaggcgcuaucauuu

SEQ ID NO: 848565 - RNA, 19 nt, Homo sapiens
caaaggagcuauaccauuc

SEQ ID NO: 848566 - RNA, 19 nt, Homo sapiens
gguaaguccuuuauucaua

SEQ ID NO: 848567 - RNA, 19 nt, Homo sapiens
gagaagcucugugacuuua

SEQ ID NO: 848568 - RNA, 19 nt, Homo sapiens
gaaaaggcguucaccauua

SEQ ID NO: 848569 - RNA, 19 nt, Homo sapiens
gaagagagcaacaaauuug

SEQ ID NO: 848570 - RNA, 19 nt, Homo sapiens
ucucagaccuuaaugauaa

SEQ ID NO: 848571 - RNA, 19 nt, Homo sapiens
ggaagaagcccuuugaaug

SEQ ID NO: 848572 - RNA, 19 nt, Homo sapiens
gagagcagcuguaugaaug

SEQ ID NO: 848573 - RNA, 19 nt, Homo sapiens
ucacucugcuggagaauua

SEQ ID NO: 848574 - RNA, 19 nt, Homo sapiens
gcacuugucugccaccaaa

SEQ ID NO: 848575 - RNA, 19 nt, Homo sapiens
gaacaaauguaaggacuuc

SEQ ID NO: 848576 - RNA, 19 nt, Homo sapiens
gaaaugaauugguggaauc

SEQ ID NO: 848577 - RNA, 19 nt, Homo sapiens
gagaaaugcugccuccaaa

SEQ ID NO: 848578 - RNA, 19 nt, Homo sapiens
gcucaaauguccgugaaua

SEQ ID NO: 848579 - RNA, 19 nt, Homo sapiens
gagguuaucuuguggaaug

SEQ ID NO: 848580 - RNA, 19 nt, Homo sapiens
gaagaagcccuuugaaugu

SEQ ID NO: 848581 - RNA, 19 nt, Homo sapiens
uaacaucucuaaacucaga

SEQ ID NO: 848582 - RNA, 19 nt, Homo sapiens
gcacaguccucacuaaaca

SEQ ID NO: 848583 - RNA, 19 nt, Homo sapiens
uaagaaggauggcgaauuc

SEQ ID NO: 848584 - RNA, 19 nt, Homo sapiens
ccaaaccaauccaugauaa

SEQ ID NO: 848585 - RNA, 19 nt, Homo sapiens
acucacaccucauuucuua

SEQ ID NO: 848586 - RNA, 19 nt, Homo sapiens
cagcagaacuugcagauca

SEQ ID NO: 848587 - RNA, 19 nt, Homo sapiens
guaagaaucgcaacuauga

SEQ ID NO: 848588 - RNA, 19 nt, Homo sapiens
ccagaaggcucgugcuaaa

SEQ ID NO: 848589 - RNA, 19 nt, Homo sapiens
ggaugacccugaugacaaa

SEQ ID NO: 848590 - RNA, 19 nt, Homo sapiens
gcacagaaaccuucacuuc

SEQ ID NO: 848591 - RNA, 19 nt, Homo sapiens
agagggaucuggugaguuu

SEQ ID NO: 848592 - RNA, 19 nt, Homo sapiens
ggaagacccugaucaaacu

SEQ ID NO: 848593 - RNA, 19 nt, Homo sapiens
ccaaaucaacuguaaauga

SEQ ID NO: 848594 - RNA, 19 nt, Homo sapiens
agaaugagcccuaugagua

SEQ ID NO: 848595 - RNA, 19 nt, Homo sapiens
auucauagcucauuccuuu

SEQ ID NO: 848596 - RNA, 19 nt, Homo sapiens
ucagaagagucauacuaua

SEQ ID NO: 848597 - RNA, 19 nt, Homo sapiens
ggaagagagcaacaaauuu

SEQ ID NO: 848598 - RNA, 19 nt, Homo sapiens
agaaauacauugagcauag

SEQ ID NO: 848599 - RNA, 19 nt, Homo sapiens
gaaggaagggaauacagua

SEQ ID NO: 848600 - RNA, 19 nt, Homo sapiens
guaagaaucaggaauguga

SEQ ID NO: 848601 - RNA, 19 nt, Homo sapiens
acagaacagugaucacaua

SEQ ID NO: 848602 - RNA, 19 nt, Homo sapiens
gugggcagcucuucaauga

SEQ ID NO: 848603 - RNA, 19 nt, Homo sapiens
ucacguaacuguucauaag

SEQ ID NO: 848604 - RNA, 19 nt, Homo sapiens
guggagagaccuucaauaa

SEQ ID NO: 848605 - RNA, 19 nt, Homo sapiens
gcacacaucuuaccuuucc

SEQ ID NO: 848606 - RNA, 19 nt, Homo sapiens
ggacuugacccuuaccaaa

SEQ ID NO: 848607 - RNA, 19 nt, Homo sapiens
ggaagaagaagaagaagau

SEQ ID NO: 848608 - RNA, 19 nt, Homo sapiens
gaagagucauacuauaaca

SEQ ID NO: 848609 - RNA, 19 nt, Homo sapiens
cagaagagucauacuauaa

SEQ ID NO: 848610 - RNA, 19 nt, Homo sapiens
gcucaucccugaaagaaca

SEQ ID NO: 848611 - RNA, 19 nt, Homo sapiens
ugucuuagauccugagaaa

SEQ ID NO: 848612 - RNA, 19 nt, Homo sapiens
gcaaugagaccucuguaau

SEQ ID NO: 848613 - RNA, 19 nt, Homo sapiens
ucacaguagugccuaauga

SEQ ID NO: 848614 - RNA, 19 nt, Homo sapiens
cgaaaccucugccucgauu

SEQ ID NO: 848615 - RNA, 19 nt, Homo sapiens
uguaugagcuagacaguga

SEQ ID NO: 848616 - RNA, 19 nt, Homo sapiens
uuacacaccugacuuaaca

SEQ ID NO: 848617 - RNA, 19 nt, Homo sapiens
agaagaaggugaagaucaa

SEQ ID NO: 848618 - RNA, 19 nt, Homo sapiens
gagggaugcucuaugaaug

SEQ ID NO: 848619 - RNA, 19 nt, Homo sapiens
gagcauaggagcaaugaga

SEQ ID NO: 848620 - RNA, 19 nt, Homo sapiens
ggaaaugaauugguggaau

SEQ ID NO: 848621 - RNA, 19 nt, Homo sapiens
ugagaaaucugucauucau

SEQ ID NO: 848622 - RNA, 19 nt, Homo sapiens
aaacaaggguaaagugugu

SEQ ID NO: 848623 - RNA, 19 nt, Homo sapiens
gaacaucggaagauucaug

SEQ ID NO: 848624 - RNA, 19 nt, Homo sapiens
gcucucaugcuguaaauaa

SEQ ID NO: 848625 - RNA, 19 nt, Homo sapiens
caaaucaacuguaaaugac

SEQ ID NO: 848626 - RNA, 19 nt, Homo sapiens
uagcacacaucuuaccuuu

SEQ ID NO: 848627 - RNA, 19 nt, Homo sapiens
agaaagaggcgcuaucauu

SEQ ID NO: 848628 - RNA, 19 nt, Homo sapiens
ccuaaucuauguggaauuu

SEQ ID NO: 848629 - RNA, 19 nt, Homo sapiens
auucauagcucugcccuua

SEQ ID NO: 848630 - RNA, 19 nt, Homo sapiens
gcgaguaucagagagauua

SEQ ID NO: 848631 - RNA, 19 nt, Homo sapiens
guaaggacuucagacaauu

SEQ ID NO: 848632 - RNA, 19 nt, Homo sapiens
gagaauccuccauuuauau

SEQ ID NO: 848633 - RNA, 19 nt, Homo sapiens
gcccagcccuuaaugaguu

SEQ ID NO: 848634 - RNA, 19 nt, Homo sapiens
gaaaauauauggcaaagac

SEQ ID NO: 848635 - RNA, 19 nt, Homo sapiens
caggaaaccucacaacaca

SEQ ID NO: 848636 - RNA, 19 nt, Homo sapiens
gauaaguacuuuagcuucu

SEQ ID NO: 848637 - RNA, 19 nt, Homo sapiens
uaaauagucuugugaagcu

SEQ ID NO: 848638 - RNA, 19 nt, Homo sapiens
gaaccuaaucuauguggaa

SEQ ID NO: 848639 - RNA, 19 nt, Homo sapiens
gagcuaguauccuuagauc

SEQ ID NO: 848640 - RNA, 19 nt, Homo sapiens
gcuguaggcaugauagaua

SEQ ID NO: 848641 - RNA, 19 nt, Homo sapiens
guaaguccuuuauucauag

SEQ ID NO: 848642 - RNA, 19 nt, Homo sapiens
gaguacggguccuccuaua

SEQ ID NO: 848643 - RNA, 19 nt, Homo sapiens
agaaaucugucauucauag

SEQ ID NO: 848644 - RNA, 19 nt, Homo sapiens
cuaauaaccuuucaucacu

SEQ ID NO: 848645 - RNA, 19 nt, Homo sapiens
guaggagacuuaaccuuag

SEQ ID NO: 848646 - RNA, 19 nt, Homo sapiens
caaugagaccucuguaauu

SEQ ID NO: 848647 - RNA, 19 nt, Homo sapiens
gggaacaccucugaaggaa

SEQ ID NO: 848648 - RNA, 19 nt, Homo sapiens
uaugagaggucuguuauuc

SEQ ID NO: 848649 - RNA, 19 nt, Homo sapiens
ggagaagcucugugacuuu

SEQ ID NO: 848650 - RNA, 19 nt, Homo sapiens
gaaaauguaugguaaagag

SEQ ID NO: 848651 - RNA, 19 nt, Homo sapiens
gauggccacucccacauga

SEQ ID NO: 848652 - RNA, 19 nt, Homo sapiens
gcagaucacguaacuguuc

SEQ ID NO: 848653 - RNA, 19 nt, Homo sapiens
gagaauccaugaacaagac

SEQ ID NO: 848654 - RNA, 19 nt, Homo sapiens
guaugaauguccaaagugu

SEQ ID NO: 848655 - RNA, 19 nt, Homo sapiens
ggaagacccucagaaggau

SEQ ID NO: 848656 - RNA, 19 nt, Homo sapiens
gaagcucugugacuuuaca

SEQ ID NO: 848657 - RNA, 19 nt, Homo sapiens
cuuaacaucucuaaacuca

SEQ ID NO: 848658 - RNA, 19 nt, Homo sapiens
caagaagucacaauggaaa

SEQ ID NO: 848659 - RNA, 19 nt, Homo sapiens
gaacagcacccaucucuua

SEQ ID NO: 848660 - RNA, 19 nt, Homo sapiens
ggauacagcuucaggcuuu

SEQ ID NO: 848661 - RNA, 19 nt, Homo sapiens
cguaguagaugcucaauaa

SEQ ID NO: 848662 - RNA, 19 nt, Homo sapiens
aagaggaggugcucacuaa

SEQ ID NO: 848663 - RNA, 19 nt, Homo sapiens
gcacccaucucuuaguguu

SEQ ID NO: 848664 - RNA, 19 nt, Homo sapiens
ggacugacccacuguacaa

SEQ ID NO: 848665 - RNA, 19 nt, Homo sapiens
gaauguaaugcaagaauga

SEQ ID NO: 848666 - RNA, 19 nt, Homo sapiens
ggaccugaauguaaugcaa

SEQ ID NO: 848667 - RNA, 19 nt, Homo sapiens
gcaccgcgcuccaagucuu

SEQ ID NO: 848668 - RNA, 19 nt, Homo sapiens
gccuggagcugcugaguga

SEQ ID NO: 848669 - RNA, 19 nt, Homo sapiens
ugacuccucuucucuacaa

SEQ ID NO: 848670 - RNA, 19 nt, Homo sapiens
gcucauguacugcuacgua

SEQ ID NO: 848671 - RNA, 19 nt, Homo sapiens
gaagaggaggugcucacua

SEQ ID NO: 848672 - RNA, 19 nt, Homo sapiens
gaacagaacaagcaaaaug

SEQ ID NO: 848673 - RNA, 19 nt, Homo sapiens
ggaagaagaccuuuaucca

SEQ ID NO: 848674 - RNA, 19 nt, Homo sapiens
ccucaucacuaaucauuca

SEQ ID NO: 848675 - RNA, 19 nt, Homo sapiens
ugaaugugcugguguccuu

SEQ ID NO: 848676 - RNA, 19 nt, Homo sapiens
gcaagaaugaacagaacaa

SEQ ID NO: 848677 - RNA, 19 nt, Homo sapiens
uaacugcuuuccugaaugg

SEQ ID NO: 848678 - RNA, 19 nt, Homo sapiens
gcaaccucaucacuaauca

SEQ ID NO: 848679 - RNA, 19 nt, Homo sapiens
ugaauguaaugcaagaaug

SEQ ID NO: 848680 - RNA, 19 nt, Homo sapiens
ccagaaacccggaccugaa

SEQ ID NO: 848681 - RNA, 19 nt, Homo sapiens
gagccaucguggucaugua

SEQ ID NO: 848682 - RNA, 19 nt, Homo sapiens
caaaaugaccagcugcuua

SEQ ID NO: 848683 - RNA, 19 nt, Homo sapiens
ucacuaaucauucaagcuu

SEQ ID NO: 848684 - RNA, 19 nt, Homo sapiens
cagcacccaucucuuagug

SEQ ID NO: 848685 - RNA, 19 nt, Homo sapiens
gaaacccggaccugaaugu

SEQ ID NO: 848686 - RNA, 19 nt, Homo sapiens
ccuaauggauacagcuuca

SEQ ID NO: 848687 - RNA, 19 nt, Homo sapiens
cugacccacuguacaauuu

SEQ ID NO: 848688 - RNA, 19 nt, Homo sapiens
guauggaagaagaccuuua

SEQ ID NO: 848689 - RNA, 19 nt, Homo sapiens
gggcgugucucccaguucu

SEQ ID NO: 848690 - RNA, 19 nt, Homo sapiens
uguacaauuucuaccacua

SEQ ID NO: 848691 - RNA, 19 nt, Homo sapiens
gaaugaacagaacaagcaa

SEQ ID NO: 848692 - RNA, 19 nt, Homo sapiens
agaaugaacagaacaagca

SEQ ID NO: 848693 - RNA, 19 nt, Homo sapiens
cuccucagcuucaucguau

SEQ ID NO: 848694 - RNA, 19 nt, Homo sapiens
gaaccuggugcguaguaga

SEQ ID NO: 848695 - RNA, 19 nt, Homo sapiens
uuagucaccuggcaaagca

SEQ ID NO: 848696 - RNA, 19 nt, Homo sapiens
caauuucuaccacuacuuc

SEQ ID NO: 848697 - RNA, 19 nt, Homo sapiens
uauggaagaagaccuuuau

SEQ ID NO: 848698 - RNA, 19 nt, Homo sapiens
acuaacugcuuuccugaau

SEQ ID NO: 848699 - RNA, 19 nt, Homo sapiens
uggcaaagcaggugagcaa

SEQ ID NO: 848700 - RNA, 19 nt, Homo sapiens
ucuagagguucccagagaa

SEQ ID NO: 848701 - RNA, 19 nt, Homo sapiens
guaguagaugcucaauaaa

SEQ ID NO: 848702 - RNA, 19 nt, Homo sapiens
cagaaccuggugcguagua

SEQ ID NO: 848703 - RNA, 19 nt, Homo sapiens
uaaagaacagcacccaucu

SEQ ID NO: 848704 - RNA, 19 nt, Homo sapiens
cagaaacccggaccugaau

SEQ ID NO: 848705 - RNA, 19 nt, Homo sapiens
gcagccagggcgacuucua

SEQ ID NO: 848706 - RNA, 19 nt, Homo sapiens
cuaacugcuuuccugaaug

SEQ ID NO: 848707 - RNA, 19 nt, Homo sapiens
ccagggcgacuucuaucaa

SEQ ID NO: 848708 - RNA, 19 nt, Homo sapiens
gauacagcuucaggcuuug

SEQ ID NO: 848709 - RNA, 19 nt, Homo sapiens
ccaucguggucauguaugu

SEQ ID NO: 848710 - RNA, 19 nt, Homo sapiens
ccuuggcacuaacugcuuu

SEQ ID NO: 848711 - RNA, 19 nt, Homo sapiens
caggcucccucgucugugu

SEQ ID NO: 848712 - RNA, 19 nt, Homo sapiens
ccagagucccacccuaaug

SEQ ID NO: 848713 - RNA, 19 nt, Homo sapiens
acccggaccugaauguaau

SEQ ID NO: 848714 - RNA, 19 nt, Homo sapiens
guacaauuucuaccacuac

SEQ ID NO: 848715 - RNA, 19 nt, Homo sapiens
gcguaguagaugcucaaua

SEQ ID NO: 848716 - RNA, 19 nt, Homo sapiens
ucuguguaguggagauaaa

SEQ ID NO: 848717 - RNA, 19 nt, Homo sapiens
cagccagggcgacuucuau

SEQ ID NO: 848718 - RNA, 19 nt, Homo sapiens
gagcaaccucaucacuaau

SEQ ID NO: 848719 - RNA, 19 nt, Homo sapiens
ucagcuucaucguauggaa

SEQ ID NO: 848720 - RNA, 19 nt, Homo sapiens
gggccaaggugcuguucac

SEQ ID NO: 848721 - RNA, 19 nt, Homo sapiens
guaguggagauaaagaaca

SEQ ID NO: 848722 - RNA, 19 nt, Homo sapiens
ggagagcaccaccccauga

SEQ ID NO: 848723 - RNA, 19 nt, Homo sapiens
ucagagccaucguggucau

SEQ ID NO: 848724 - RNA, 19 nt, Homo sapiens
aagaacagcacccaucucu

SEQ ID NO: 848725 - RNA, 19 nt, Homo sapiens
gcucugcugagaaccauca

SEQ ID NO: 848726 - RNA, 19 nt, Homo sapiens
aaccucaucacuaaucauu

SEQ ID NO: 848727 - RNA, 19 nt, Homo sapiens
ucucccaguucuagagguu

SEQ ID NO: 848728 - RNA, 19 nt, Homo sapiens
gacccacuguacaauuucu

SEQ ID NO: 848729 - RNA, 19 nt, Homo sapiens
cagagucccacccuaaugg

SEQ ID NO: 848730 - RNA, 19 nt, Homo sapiens
uucuagagguucccagaga

SEQ ID NO: 848731 - RNA, 19 nt, Homo sapiens
gaaaggagaucauuuaguu

SEQ ID NO: 848732 - RNA, 19 nt, Homo sapiens
gcagaaaggagaucauuua

SEQ ID NO: 848733 - RNA, 19 nt, Homo sapiens
ggagaccucuucuaucuaa

SEQ ID NO: 848734 - RNA, 19 nt, Homo sapiens
guagcaagaucuuuacaua

SEQ ID NO: 848735 - RNA, 19 nt, Homo sapiens
ugucagagcuugauuagaa

SEQ ID NO: 848736 - RNA, 19 nt, Homo sapiens
ccacagagcaagugauuua

SEQ ID NO: 848737 - RNA, 19 nt, Homo sapiens
gaaauacagugcuuuaugg

SEQ ID NO: 848738 - RNA, 19 nt, Homo sapiens
caagaucauucuacaagua

SEQ ID NO: 848739 - RNA, 19 nt, Homo sapiens
gaagggagcugaggccauu

SEQ ID NO: 848740 - RNA, 19 nt, Homo sapiens
gcucggaacuuacugugua

SEQ ID NO: 848741 - RNA, 19 nt, Homo sapiens
gaagagaccaagcuuguuu

SEQ ID NO: 848742 - RNA, 19 nt, Homo sapiens
gcuaguaccuguaagcauu

SEQ ID NO: 848743 - RNA, 19 nt, Homo sapiens
ccacuuaacacaugaauuu

SEQ ID NO: 848744 - RNA, 19 nt, Homo sapiens
uaacauuggugcaaagauu

SEQ ID NO: 848745 - RNA, 19 nt, Homo sapiens
cagagcaagugauuuauaa

SEQ ID NO: 848746 - RNA, 19 nt, Homo sapiens
gagagcaacuggacuauag

SEQ ID NO: 848747 - RNA, 19 nt, Homo sapiens
gaaguucccugaugguuuc

SEQ ID NO: 848748 - RNA, 19 nt, Homo sapiens
ggucauaggcucacucuuu

SEQ ID NO: 848749 - RNA, 19 nt, Homo sapiens
caagagaaaugaggaagaa

SEQ ID NO: 848750 - RNA, 19 nt, Homo sapiens
gaaccacccuuuauucuac

SEQ ID NO: 848751 - RNA, 19 nt, Homo sapiens
gaaauucugcugcuugaaa

SEQ ID NO: 848752 - RNA, 19 nt, Homo sapiens
caagaaagaguaacacuga

SEQ ID NO: 848753 - RNA, 19 nt, Homo sapiens
cuuuauggcucuaacauua

SEQ ID NO: 848754 - RNA, 19 nt, Homo sapiens
gcaaggaguacaacuauga

SEQ ID NO: 848755 - RNA, 19 nt, Homo sapiens
gaacuggucuuccauuuug

SEQ ID NO: 848756 - RNA, 19 nt, Homo sapiens
ggagggagcaugaucauug

SEQ ID NO: 848757 - RNA, 19 nt, Homo sapiens
ccucagggcuuccuuaugu

SEQ ID NO: 848758 - RNA, 19 nt, Homo sapiens
ggaccugguuauguuguua

SEQ ID NO: 848759 - RNA, 19 nt, Homo sapiens
gaaacaauaugcuuuacac

SEQ ID NO: 848760 - RNA, 19 nt, Homo sapiens
uaugggagcuguuaucaug

SEQ ID NO: 848761 - RNA, 19 nt, Homo sapiens
gccauucccuguaggagua

SEQ ID NO: 848762 - RNA, 19 nt, Homo sapiens
uaucaguucuagcauagua

SEQ ID NO: 848763 - RNA, 19 nt, Homo sapiens
agacgacuguuacaaguuu

SEQ ID NO: 848764 - RNA, 19 nt, Homo sapiens
caauaaaccugggcaagug

SEQ ID NO: 848765 - RNA, 19 nt, Homo sapiens
agaaguagcaagaucuuua

SEQ ID NO: 848766 - RNA, 19 nt, Homo sapiens
gggaaauucugcugcuuga

SEQ ID NO: 848767 - RNA, 19 nt, Homo sapiens
cgaauuggcuuugcuguca

SEQ ID NO: 848768 - RNA, 19 nt, Homo sapiens
ggagaucaauggacaggau

SEQ ID NO: 848769 - RNA, 19 nt, Homo sapiens
caacauugcugccaucacu

SEQ ID NO: 848770 - RNA, 19 nt, Homo sapiens
gaacugcuaccaugaagug

SEQ ID NO: 848771 - RNA, 19 nt, Homo sapiens
gaagauggguguuguuuuc

SEQ ID NO: 848772 - RNA, 19 nt, Homo sapiens
acaauaugcuuuacacuca

SEQ ID NO: 848773 - RNA, 19 nt, Homo sapiens
gauugccucuugaauuaaa

SEQ ID NO: 848774 - RNA, 19 nt, Homo sapiens
gcuauuugcuuuagagaca

SEQ ID NO: 848775 - RNA, 19 nt, Homo sapiens
gagaagagaccaagcuugu

SEQ ID NO: 848776 - RNA, 19 nt, Homo sapiens
ccaaaugccucugccuuga

SEQ ID NO: 848777 - RNA, 19 nt, Homo sapiens
gcaccgaccugguaagcau

SEQ ID NO: 848778 - RNA, 19 nt, Homo sapiens
cuaauagagucacagcuuu

SEQ ID NO: 848779 - RNA, 19 nt, Homo sapiens
gaugaaagacaaagaagga

SEQ ID NO: 848780 - RNA, 19 nt, Homo sapiens
gauaggcagcacugaaaua

SEQ ID NO: 848781 - RNA, 19 nt, Homo sapiens
caagacgacuguuacaagu

SEQ ID NO: 848782 - RNA, 19 nt, Homo sapiens
uaaggcugcuguaaaguug

SEQ ID NO: 848783 - RNA, 19 nt, Homo sapiens
aaacaagaauacugaguca

SEQ ID NO: 848784 - RNA, 19 nt, Homo sapiens
cacaagccauaaaccaaua

SEQ ID NO: 848785 - RNA, 19 nt, Homo sapiens
uaggagaccucuucuaucu

SEQ ID NO: 848786 - RNA, 19 nt, Homo sapiens
gaaccuuuguccaccauuc

SEQ ID NO: 848787 - RNA, 19 nt, Homo sapiens
ccugauagcuacccacaga

SEQ ID NO: 848788 - RNA, 19 nt, Homo sapiens
cuacuaaccuggagacagu

SEQ ID NO: 848789 - RNA, 19 nt, Homo sapiens
caauagaacuggucuucca

SEQ ID NO: 848790 - RNA, 19 nt, Homo sapiens
ugagaaauacagugcuuua

SEQ ID NO: 848791 - RNA, 19 nt, Homo sapiens
gguaggagaccucuucuau

SEQ ID NO: 848792 - RNA, 19 nt, Homo sapiens
ugacugauccugaacaaga

SEQ ID NO: 848793 - RNA, 19 nt, Homo sapiens
ccaagacaguggcagcaaa

SEQ ID NO: 848794 - RNA, 19 nt, Homo sapiens
caacagcugaugcccuaua

SEQ ID NO: 848795 - RNA, 19 nt, Homo sapiens
cacaugaauuucugccaua

SEQ ID NO: 848796 - RNA, 19 nt, Homo sapiens
gauagcaucccaucucaga

SEQ ID NO: 848797 - RNA, 19 nt, Homo sapiens
uaaacaagccuaacauugg

SEQ ID NO: 848798 - RNA, 19 nt, Homo sapiens
gaugcacaguuugcuauuu

SEQ ID NO: 848799 - RNA, 19 nt, Homo sapiens
ucagacaaguucuucauca

SEQ ID NO: 848800 - RNA, 19 nt, Homo sapiens
uagaacuggucuuccauuu

SEQ ID NO: 848801 - RNA, 19 nt, Homo sapiens
gauaagggagagggaaaua

SEQ ID NO: 848802 - RNA, 19 nt, Homo sapiens
ggacuguaccuguaggaaa

SEQ ID NO: 848803 - RNA, 19 nt, Homo sapiens
gcaagugaggcaagagaaa

SEQ ID NO: 848804 - RNA, 19 nt, Homo sapiens
caggaagacuggagacugu

SEQ ID NO: 848805 - RNA, 19 nt, Homo sapiens
uaucuggguucucuucauu

SEQ ID NO: 848806 - RNA, 19 nt, Homo sapiens
gcagaaacacaaccacuca

SEQ ID NO: 848807 - RNA, 19 nt, Homo sapiens
ccagcagcaugaugacuuu

SEQ ID NO: 848808 - RNA, 19 nt, Homo sapiens
ggaagacuguggcuacaac

SEQ ID NO: 848809 - RNA, 19 nt, Homo sapiens
gggaaagggugaggacuuc

SEQ ID NO: 848810 - RNA, 19 nt, Homo sapiens
cuaacuuucuugcuucaaa

SEQ ID NO: 848811 - RNA, 19 nt, Homo sapiens
ggaaguccagcuccuuaaa

SEQ ID NO: 848812 - RNA, 19 nt, Homo sapiens
guacaaagacagggaauag

SEQ ID NO: 848813 - RNA, 19 nt, Homo sapiens
gcacucugcuggcgggaau

SEQ ID NO: 848814 - RNA, 19 nt, Homo sapiens
gaaaugaggaagaauccau

SEQ ID NO: 848815 - RNA, 19 nt, Homo sapiens
ccugcuaaguguggaauua

SEQ ID NO: 848816 - RNA, 19 nt, Homo sapiens
uaugggaccugcuaagugu

SEQ ID NO: 848817 - RNA, 19 nt, Homo sapiens
uauaagaaguagcaagauc

SEQ ID NO: 848818 - RNA, 19 nt, Homo sapiens
aaacaagccuaacauuggu

SEQ ID NO: 848819 - RNA, 19 nt, Homo sapiens
acaguuugcuauuugcuuu

SEQ ID NO: 848820 - RNA, 19 nt, Homo sapiens
ggaauugggaccugguuau

SEQ ID NO: 848821 - RNA, 19 nt, Homo sapiens
ccaaucacccuacaagaug

SEQ ID NO: 848822 - RNA, 19 nt, Homo sapiens
gcaagucccaucagccuau

SEQ ID NO: 848823 - RNA, 19 nt, Homo sapiens
gagcuggguuuuccuagua

SEQ ID NO: 848824 - RNA, 19 nt, Homo sapiens
ggagagcaacuggacuaua

SEQ ID NO: 848825 - RNA, 19 nt, Homo sapiens
gcacugaaauauccuaacc

SEQ ID NO: 848826 - RNA, 19 nt, Homo sapiens
aagcagagguggaaaauga

SEQ ID NO: 848827 - RNA, 19 nt, Homo sapiens
gcaagagaaaugaggaaga

SEQ ID NO: 848828 - RNA, 19 nt, Homo sapiens
aggagaggaugcacaguuu

SEQ ID NO: 848829 - RNA, 19 nt, Homo sapiens
gggcuucuacguugucuuu

SEQ ID NO: 848830 - RNA, 19 nt, Homo sapiens
uauccgacauguacugcua

SEQ ID NO: 848831 - RNA, 19 nt, Homo sapiens
gaaaggagaucauuuaguu

SEQ ID NO: 848832 - RNA, 19 nt, Homo sapiens
gcagaaaggagaucauuua

SEQ ID NO: 848833 - RNA, 19 nt, Homo sapiens
ggagaccucuucuaucuaa

SEQ ID NO: 848834 - RNA, 19 nt, Homo sapiens
guagcaagaucuuuacaua

SEQ ID NO: 848835 - RNA, 19 nt, Homo sapiens
ugucagagcuugauuagaa

SEQ ID NO: 848836 - RNA, 19 nt, Homo sapiens
ccacagagcaagugauuua

SEQ ID NO: 848837 - RNA, 19 nt, Homo sapiens
gaaauacagugcuuuaugg

SEQ ID NO: 848838 - RNA, 19 nt, Homo sapiens
caagaucauucuacaagua

SEQ ID NO: 848839 - RNA, 19 nt, Homo sapiens
gaagggagcugaggccauu

SEQ ID NO: 848840 - RNA, 19 nt, Homo sapiens
gcucggaacuuacugugua

SEQ ID NO: 848841 - RNA, 19 nt, Homo sapiens
gaagagaccaagcuuguuu

SEQ ID NO: 848842 - RNA, 19 nt, Homo sapiens
gcuaguaccuguaagcauu

SEQ ID NO: 848843 - RNA, 19 nt, Homo sapiens
ccacuuaacacaugaauuu

SEQ ID NO: 848844 - RNA, 19 nt, Homo sapiens
uaacauuggugcaaagauu

SEQ ID NO: 848845 - RNA, 19 nt, Homo sapiens
cagagcaagugauuuauaa

SEQ ID NO: 848846 - RNA, 19 nt, Homo sapiens
gagagcaacuggacuauag

SEQ ID NO: 848847 - RNA, 19 nt, Homo sapiens
gaaguucccugaugguuuc

SEQ ID NO: 848848 - RNA, 19 nt, Homo sapiens
ggucauaggcucacucuuu

SEQ ID NO: 848849 - RNA, 19 nt, Homo sapiens
caagagaaaugaggaagaa

SEQ ID NO: 848850 - RNA, 19 nt, Homo sapiens
gaaccacccuuuauucuac

SEQ ID NO: 848851 - RNA, 19 nt, Homo sapiens
gaaauucugcugcuugaaa

SEQ ID NO: 848852 - RNA, 19 nt, Homo sapiens
caagaaagaguaacacuga

SEQ ID NO: 848853 - RNA, 19 nt, Homo sapiens
cuuuauggcucuaacauua

SEQ ID NO: 848854 - RNA, 19 nt, Homo sapiens
gcaaggaguacaacuauga

SEQ ID NO: 848855 - RNA, 19 nt, Homo sapiens
gaacuggucuuccauuuug

SEQ ID NO: 848856 - RNA, 19 nt, Homo sapiens
ggagggagcaugaucauug

SEQ ID NO: 848857 - RNA, 19 nt, Homo sapiens
ccucagggcuuccuuaugu

SEQ ID NO: 848858 - RNA, 19 nt, Homo sapiens
ggaccugguuauguuguua

SEQ ID NO: 848859 - RNA, 19 nt, Homo sapiens
gaaacaauaugcuuuacac

SEQ ID NO: 848860 - RNA, 19 nt, Homo sapiens
uaugggagcuguuaucaug

SEQ ID NO: 848861 - RNA, 19 nt, Homo sapiens
gccauucccuguaggagua

SEQ ID NO: 848862 - RNA, 19 nt, Homo sapiens
uaucaguucuagcauagua

SEQ ID NO: 848863 - RNA, 19 nt, Homo sapiens
agacgacuguuacaaguuu

SEQ ID NO: 848864 - RNA, 19 nt, Homo sapiens
caauaaaccugggcaagug

SEQ ID NO: 848865 - RNA, 19 nt, Homo sapiens
agaaguagcaagaucuuua

SEQ ID NO: 848866 - RNA, 19 nt, Homo sapiens
gggaaauucugcugcuuga

SEQ ID NO: 848867 - RNA, 19 nt, Homo sapiens
cgaauuggcuuugcuguca

SEQ ID NO: 848868 - RNA, 19 nt, Homo sapiens
ggagaucaauggacaggau

SEQ ID NO: 848869 - RNA, 19 nt, Homo sapiens
gaacugcuaccaugaagug

SEQ ID NO: 848870 - RNA, 19 nt, Homo sapiens
gaagauggguguuguuuuc

SEQ ID NO: 848871 - RNA, 19 nt, Homo sapiens
acaauaugcuuuacacuca

SEQ ID NO: 848872 - RNA, 19 nt, Homo sapiens
gauugccucuugaauuaaa

SEQ ID NO: 848873 - RNA, 19 nt, Homo sapiens
gcuauuugcuuuagagaca

SEQ ID NO: 848874 - RNA, 19 nt, Homo sapiens
gagaagagaccaagcuugu

SEQ ID NO: 848875 - RNA, 19 nt, Homo sapiens
ccaaaugccucugccuuga

SEQ ID NO: 848876 - RNA, 19 nt, Homo sapiens
cuaauagagucacagcuuu

SEQ ID NO: 848877 - RNA, 19 nt, Homo sapiens
gaugaaagacaaagaagga

SEQ ID NO: 848878 - RNA, 19 nt, Homo sapiens
gauaggcagcacugaaaua

SEQ ID NO: 848879 - RNA, 19 nt, Homo sapiens
caagacgacuguuacaagu

SEQ ID NO: 848880 - RNA, 19 nt, Homo sapiens
uaaggcugcuguaaaguug

SEQ ID NO: 848881 - RNA, 19 nt, Homo sapiens
aaacaagaauacugaguca

SEQ ID NO: 848882 - RNA, 19 nt, Homo sapiens
cacaagccauaaaccaaua

SEQ ID NO: 848883 - RNA, 19 nt, Homo sapiens
uaggagaccucuucuaucu

SEQ ID NO: 848884 - RNA, 19 nt, Homo sapiens
gaaccuuuguccaccauuc

SEQ ID NO: 848885 - RNA, 19 nt, Homo sapiens
ccugauagcuacccacaga

SEQ ID NO: 848886 - RNA, 19 nt, Homo sapiens
cuacuaaccuggagacagu

SEQ ID NO: 848887 - RNA, 19 nt, Homo sapiens
caauagaacuggucuucca

SEQ ID NO: 848888 - RNA, 19 nt, Homo sapiens
ugagaaauacagugcuuua

SEQ ID NO: 848889 - RNA, 19 nt, Homo sapiens
gguaggagaccucuucuau

SEQ ID NO: 848890 - RNA, 19 nt, Homo sapiens
ugacugauccugaacaaga

SEQ ID NO: 848891 - RNA, 19 nt, Homo sapiens
ccaagacaguggcagcaaa

SEQ ID NO: 848892 - RNA, 19 nt, Homo sapiens
caacagcugaugcccuaua

SEQ ID NO: 848893 - RNA, 19 nt, Homo sapiens
cacaugaauuucugccaua

SEQ ID NO: 848894 - RNA, 19 nt, Homo sapiens
gauagcaucccaucucaga

SEQ ID NO: 848895 - RNA, 19 nt, Homo sapiens
uaaacaagccuaacauugg

SEQ ID NO: 848896 - RNA, 19 nt, Homo sapiens
gaugcacaguuugcuauuu

SEQ ID NO: 848897 - RNA, 19 nt, Homo sapiens
uagaacuggucuuccauuu

SEQ ID NO: 848898 - RNA, 19 nt, Homo sapiens
gauaagggagagggaaaua

SEQ ID NO: 848899 - RNA, 19 nt, Homo sapiens
ggacuguaccuguaggaaa

SEQ ID NO: 848900 - RNA, 19 nt, Homo sapiens
gcaagugaggcaagagaaa

SEQ ID NO: 848901 - RNA, 19 nt, Homo sapiens
caggaagacuggagacugu

SEQ ID NO: 848902 - RNA, 19 nt, Homo sapiens
uaucuggguucucuucauu

SEQ ID NO: 848903 - RNA, 19 nt, Homo sapiens
gcagaaacacaaccacuca

SEQ ID NO: 848904 - RNA, 19 nt, Homo sapiens
ccagcagcaugaugacuuu

SEQ ID NO: 848905 - RNA, 19 nt, Homo sapiens
ggaagacuguggcuacaac

SEQ ID NO: 848906 - RNA, 19 nt, Homo sapiens
gggaaagggugaggacuuc

SEQ ID NO: 848907 - RNA, 19 nt, Homo sapiens
cuaacuuucuugcuucaaa

SEQ ID NO: 848908 - RNA, 19 nt, Homo sapiens
ggaaguccagcuccuuaaa

SEQ ID NO: 848909 - RNA, 19 nt, Homo sapiens
guacaaagacagggaauag

SEQ ID NO: 848910 - RNA, 19 nt, Homo sapiens
gcacucugcuggcgggaau

SEQ ID NO: 848911 - RNA, 19 nt, Homo sapiens
gaaaugaggaagaauccau

SEQ ID NO: 848912 - RNA, 19 nt, Homo sapiens
ccugcuaaguguggaauua

SEQ ID NO: 848913 - RNA, 19 nt, Homo sapiens
uaugggaccugcuaagugu

SEQ ID NO: 848914 - RNA, 19 nt, Homo sapiens
uauaagaaguagcaagauc

SEQ ID NO: 848915 - RNA, 19 nt, Homo sapiens
aaacaagccuaacauuggu

SEQ ID NO: 848916 - RNA, 19 nt, Homo sapiens
acaguuugcuauuugcuuu

SEQ ID NO: 848917 - RNA, 19 nt, Homo sapiens
ggaauugggaccugguuau

SEQ ID NO: 848918 - RNA, 19 nt, Homo sapiens
ccaaucacccuacaagaug

SEQ ID NO: 848919 - RNA, 19 nt, Homo sapiens
gcaagucccaucagccuau

SEQ ID NO: 848920 - RNA, 19 nt, Homo sapiens
gagcuggguuuuccuagua

SEQ ID NO: 848921 - RNA, 19 nt, Homo sapiens
ggagagcaacuggacuaua

SEQ ID NO: 848922 - RNA, 19 nt, Homo sapiens
gcacugaaauauccuaacc

SEQ ID NO: 848923 - RNA, 19 nt, Homo sapiens
aagcagagguggaaaauga

SEQ ID NO: 848924 - RNA, 19 nt, Homo sapiens
gcaagagaaaugaggaaga

SEQ ID NO: 848925 - RNA, 19 nt, Homo sapiens
aggagaggaugcacaguuu

SEQ ID NO: 848926 - RNA, 19 nt, Homo sapiens
gggcuucuacguugucuuu

SEQ ID NO: 848927 - RNA, 19 nt, Homo sapiens
uauccgacauguacugcua

SEQ ID NO: 848928 - RNA, 19 nt, Homo sapiens
aaacuacgguaccaguguu

SEQ ID NO: 848929 - RNA, 19 nt, Homo sapiens
caugaugacuuugcugaug

SEQ ID NO: 848930 - RNA, 19 nt, Homo sapiens
ugucagcgcuugccaugug

SEQ ID NO: 848931 - RNA, 19 nt, Homo sapiens
gaaaggagaucauuuaguu

SEQ ID NO: 848932 - RNA, 19 nt, Homo sapiens
gcagaaaggagaucauuua

SEQ ID NO: 848933 - RNA, 19 nt, Homo sapiens
ggagaccucuucuaucuaa

SEQ ID NO: 848934 - RNA, 19 nt, Homo sapiens
guagcaagaucuuuacaua

SEQ ID NO: 848935 - RNA, 19 nt, Homo sapiens
ugucagagcuugauuagaa

SEQ ID NO: 848936 - RNA, 19 nt, Homo sapiens
ccacagagcaagugauuua

SEQ ID NO: 848937 - RNA, 19 nt, Homo sapiens
gaaauacagugcuuuaugg

SEQ ID NO: 848938 - RNA, 19 nt, Homo sapiens
caagaucauucuacaagua

SEQ ID NO: 848939 - RNA, 19 nt, Homo sapiens
gaagggagcugaggccauu

SEQ ID NO: 848940 - RNA, 19 nt, Homo sapiens
gcucggaacuuacugugua

SEQ ID NO: 848941 - RNA, 19 nt, Homo sapiens
gaagagaccaagcuuguuu

SEQ ID NO: 848942 - RNA, 19 nt, Homo sapiens
gcuaguaccuguaagcauu

SEQ ID NO: 848943 - RNA, 19 nt, Homo sapiens
ccacuuaacacaugaauuu

SEQ ID NO: 848944 - RNA, 19 nt, Homo sapiens
uaacauuggugcaaagauu

SEQ ID NO: 848945 - RNA, 19 nt, Homo sapiens
cagagcaagugauuuauaa

SEQ ID NO: 848946 - RNA, 19 nt, Homo sapiens
gagagcaacuggacuauag

SEQ ID NO: 848947 - RNA, 19 nt, Homo sapiens
gaaguucccugaugguuuc

SEQ ID NO: 848948 - RNA, 19 nt, Homo sapiens
ggucauaggcucacucuuu

SEQ ID NO: 848949 - RNA, 19 nt, Homo sapiens
caagagaaaugaggaagaa

SEQ ID NO: 848950 - RNA, 19 nt, Homo sapiens
gaaccacccuuuauucuac

SEQ ID NO: 848951 - RNA, 19 nt, Homo sapiens
gaaauucugcugcuugaaa

SEQ ID NO: 848952 - RNA, 19 nt, Homo sapiens
caagaaagaguaacacuga

SEQ ID NO: 848953 - RNA, 19 nt, Homo sapiens
cuuuauggcucuaacauua

SEQ ID NO: 848954 - RNA, 19 nt, Homo sapiens
gcaaggaguacaacuauga

SEQ ID NO: 848955 - RNA, 19 nt, Homo sapiens
gaacuggucuuccauuuug

SEQ ID NO: 848956 - RNA, 19 nt, Homo sapiens
ggagggagcaugaucauug

SEQ ID NO: 848957 - RNA, 19 nt, Homo sapiens
ccucagggcuuccuuaugu

SEQ ID NO: 848958 - RNA, 19 nt, Homo sapiens
ggaccugguuauguuguua

SEQ ID NO: 848959 - RNA, 19 nt, Homo sapiens
gaaacaauaugcuuuacac

SEQ ID NO: 848960 - RNA, 19 nt, Homo sapiens
uaugggagcuguuaucaug

SEQ ID NO: 848961 - RNA, 19 nt, Homo sapiens
gccauucccuguaggagua

SEQ ID NO: 848962 - RNA, 19 nt, Homo sapiens
uaucaguucuagcauagua

SEQ ID NO: 848963 - RNA, 19 nt, Homo sapiens
agacgacuguuacaaguuu

SEQ ID NO: 848964 - RNA, 19 nt, Homo sapiens
caauaaaccugggcaagug

SEQ ID NO: 848965 - RNA, 19 nt, Homo sapiens
agaaguagcaagaucuuua

SEQ ID NO: 848966 - RNA, 19 nt, Homo sapiens
gggaaauucugcugcuuga

SEQ ID NO: 848967 - RNA, 19 nt, Homo sapiens
cgaauuggcuuugcuguca

SEQ ID NO: 848968 - RNA, 19 nt, Homo sapiens
ggagaucaauggacaggau

SEQ ID NO: 848969 - RNA, 19 nt, Homo sapiens
caacauugcugccaucacu

SEQ ID NO: 848970 - RNA, 19 nt, Homo sapiens
gaacugcuaccaugaagug

SEQ ID NO: 848971 - RNA, 19 nt, Homo sapiens
gaagauggguguuguuuuc

SEQ ID NO: 848972 - RNA, 19 nt, Homo sapiens
acaauaugcuuuacacuca

SEQ ID NO: 848973 - RNA, 19 nt, Homo sapiens
gauugccucuugaauuaaa

SEQ ID NO: 848974 - RNA, 19 nt, Homo sapiens
gcuauuugcuuuagagaca

SEQ ID NO: 848975 - RNA, 19 nt, Homo sapiens
gagaagagaccaagcuugu

SEQ ID NO: 848976 - RNA, 19 nt, Homo sapiens
ccaaaugccucugccuuga

SEQ ID NO: 848977 - RNA, 19 nt, Homo sapiens
gcaccgaccugguaagcau

SEQ ID NO: 848978 - RNA, 19 nt, Homo sapiens
cuaauagagucacagcuuu

SEQ ID NO: 848979 - RNA, 19 nt, Homo sapiens
gaugaaagacaaagaagga

SEQ ID NO: 848980 - RNA, 19 nt, Homo sapiens
gauaggcagcacugaaaua

SEQ ID NO: 848981 - RNA, 19 nt, Homo sapiens
caagacgacuguuacaagu

SEQ ID NO: 848982 - RNA, 19 nt, Homo sapiens
uaaggcugcuguaaaguug

SEQ ID NO: 848983 - RNA, 19 nt, Homo sapiens
aaacaagaauacugaguca

SEQ ID NO: 848984 - RNA, 19 nt, Homo sapiens
cacaagccauaaaccaaua

SEQ ID NO: 848985 - RNA, 19 nt, Homo sapiens
uaggagaccucuucuaucu

SEQ ID NO: 848986 - RNA, 19 nt, Homo sapiens
gaaccuuuguccaccauuc

SEQ ID NO: 848987 - RNA, 19 nt, Homo sapiens
ccugauagcuacccacaga

SEQ ID NO: 848988 - RNA, 19 nt, Homo sapiens
cuacuaaccuggagacagu

SEQ ID NO: 848989 - RNA, 19 nt, Homo sapiens
caauagaacuggucuucca

SEQ ID NO: 848990 - RNA, 19 nt, Homo sapiens
ugagaaauacagugcuuua

SEQ ID NO: 848991 - RNA, 19 nt, Homo sapiens
gguaggagaccucuucuau

SEQ ID NO: 848992 - RNA, 19 nt, Homo sapiens
ugacugauccugaacaaga

SEQ ID NO: 848993 - RNA, 19 nt, Homo sapiens
ccaagacaguggcagcaaa

SEQ ID NO: 848994 - RNA, 19 nt, Homo sapiens
caacagcugaugcccuaua

SEQ ID NO: 848995 - RNA, 19 nt, Homo sapiens
cacaugaauuucugccaua

SEQ ID NO: 848996 - RNA, 19 nt, Homo sapiens
gauagcaucccaucucaga

SEQ ID NO: 848997 - RNA, 19 nt, Homo sapiens
uaaacaagccuaacauugg

SEQ ID NO: 848998 - RNA, 19 nt, Homo sapiens
gaugcacaguuugcuauuu

SEQ ID NO: 848999 - RNA, 19 nt, Homo sapiens
ucagacaaguucuucauca

SEQ ID NO: 849000 - RNA, 19 nt, Homo sapiens
uagaacuggucuuccauuu

SEQ ID NO: 849001 - RNA, 19 nt, Homo sapiens
gauaagggagagggaaaua

SEQ ID NO: 849002 - RNA, 19 nt, Homo sapiens
ggacuguaccuguaggaaa

SEQ ID NO: 849003 - RNA, 19 nt, Homo sapiens
gcaagugaggcaagagaaa

SEQ ID NO: 849004 - RNA, 19 nt, Homo sapiens
caggaagacuggagacugu

SEQ ID NO: 849005 - RNA, 19 nt, Homo sapiens
uaucuggguucucuucauu

SEQ ID NO: 849006 - RNA, 19 nt, Homo sapiens
gcagaaacacaaccacuca

SEQ ID NO: 849007 - RNA, 19 nt, Homo sapiens
ccagcagcaugaugacuuu

SEQ ID NO: 849008 - RNA, 19 nt, Homo sapiens
ggaagacuguggcuacaac

SEQ ID NO: 849009 - RNA, 19 nt, Homo sapiens
gggaaagggugaggacuuc

SEQ ID NO: 849010 - RNA, 19 nt, Homo sapiens
cuaacuuucuugcuucaaa

SEQ ID NO: 849011 - RNA, 19 nt, Homo sapiens
ggaaguccagcuccuuaaa

SEQ ID NO: 849012 - RNA, 19 nt, Homo sapiens
guacaaagacagggaauag

SEQ ID NO: 849013 - RNA, 19 nt, Homo sapiens
gcacucugcuggcgggaau

SEQ ID NO: 849014 - RNA, 19 nt, Homo sapiens
gaaaugaggaagaauccau

SEQ ID NO: 849015 - RNA, 19 nt, Homo sapiens
ccugcuaaguguggaauua

SEQ ID NO: 849016 - RNA, 19 nt, Homo sapiens
uaugggaccugcuaagugu

SEQ ID NO: 849017 - RNA, 19 nt, Homo sapiens
uauaagaaguagcaagauc

SEQ ID NO: 849018 - RNA, 19 nt, Homo sapiens
aaacaagccuaacauuggu

SEQ ID NO: 849019 - RNA, 19 nt, Homo sapiens
acaguuugcuauuugcuuu

SEQ ID NO: 849020 - RNA, 19 nt, Homo sapiens
ggaauugggaccugguuau

SEQ ID NO: 849021 - RNA, 19 nt, Homo sapiens
ccaaucacccuacaagaug

SEQ ID NO: 849022 - RNA, 19 nt, Homo sapiens
gcaagucccaucagccuau

SEQ ID NO: 849023 - RNA, 19 nt, Homo sapiens
gagcuggguuuuccuagua

SEQ ID NO: 849024 - RNA, 19 nt, Homo sapiens
ggagagcaacuggacuaua

SEQ ID NO: 849025 - RNA, 19 nt, Homo sapiens
gcacugaaauauccuaacc

SEQ ID NO: 849026 - RNA, 19 nt, Homo sapiens
aagcagagguggaaaauga

SEQ ID NO: 849027 - RNA, 19 nt, Homo sapiens
gcaagagaaaugaggaaga

SEQ ID NO: 849028 - RNA, 19 nt, Homo sapiens
aggagaggaugcacaguuu

SEQ ID NO: 849029 - RNA, 19 nt, Homo sapiens
gggcuucuacguugucuuu

SEQ ID NO: 849030 - RNA, 19 nt, Homo sapiens
uauccgacauguacugcua

SEQ ID NO: 849031 - RNA, 19 nt, Homo sapiens
gaaaggagaucauuuaguu

SEQ ID NO: 849032 - RNA, 19 nt, Homo sapiens
gcagaaaggagaucauuua

SEQ ID NO: 849033 - RNA, 19 nt, Homo sapiens
ggagaccucuucuaucuaa

SEQ ID NO: 849034 - RNA, 19 nt, Homo sapiens
guagcaagaucuuuacaua

SEQ ID NO: 849035 - RNA, 19 nt, Homo sapiens
ugucagagcuugauuagaa

SEQ ID NO: 849036 - RNA, 19 nt, Homo sapiens
ccacagagcaagugauuua

SEQ ID NO: 849037 - RNA, 19 nt, Homo sapiens
gaaauacagugcuuuaugg

SEQ ID NO: 849038 - RNA, 19 nt, Homo sapiens
caagaucauucuacaagua

SEQ ID NO: 849039 - RNA, 19 nt, Homo sapiens
gaagggagcugaggccauu

SEQ ID NO: 849040 - RNA, 19 nt, Homo sapiens
gcucggaacuuacugugua

SEQ ID NO: 849041 - RNA, 19 nt, Homo sapiens
gaagagaccaagcuuguuu

SEQ ID NO: 849042 - RNA, 19 nt, Homo sapiens
gcuaguaccuguaagcauu

SEQ ID NO: 849043 - RNA, 19 nt, Homo sapiens
ccacuuaacacaugaauuu

SEQ ID NO: 849044 - RNA, 19 nt, Homo sapiens
uaacauuggugcaaagauu

SEQ ID NO: 849045 - RNA, 19 nt, Homo sapiens
cagagcaagugauuuauaa

SEQ ID NO: 849046 - RNA, 19 nt, Homo sapiens
gagagcaacuggacuauag

SEQ ID NO: 849047 - RNA, 19 nt, Homo sapiens
gaaguucccugaugguuuc

SEQ ID NO: 849048 - RNA, 19 nt, Homo sapiens
ggucauaggcucacucuuu

SEQ ID NO: 849049 - RNA, 19 nt, Homo sapiens
caagagaaaugaggaagaa

SEQ ID NO: 849050 - RNA, 19 nt, Homo sapiens
gaaccacccuuuauucuac

SEQ ID NO: 849051 - RNA, 19 nt, Homo sapiens
gaaauucugcugcuugaaa

SEQ ID NO: 849052 - RNA, 19 nt, Homo sapiens
caagaaagaguaacacuga

SEQ ID NO: 849053 - RNA, 19 nt, Homo sapiens
cuuuauggcucuaacauua

SEQ ID NO: 849054 - RNA, 19 nt, Homo sapiens
gcaaggaguacaacuauga

SEQ ID NO: 849055 - RNA, 19 nt, Homo sapiens
gaacuggucuuccauuuug

SEQ ID NO: 849056 - RNA, 19 nt, Homo sapiens
ggagggagcaugaucauug

SEQ ID NO: 849057 - RNA, 19 nt, Homo sapiens
ccucagggcuuccuuaugu

SEQ ID NO: 849058 - RNA, 19 nt, Homo sapiens
ggaccugguuauguuguua

SEQ ID NO: 849059 - RNA, 19 nt, Homo sapiens
gaaacaauaugcuuuacac

SEQ ID NO: 849060 - RNA, 19 nt, Homo sapiens
uaugggagcuguuaucaug

SEQ ID NO: 849061 - RNA, 19 nt, Homo sapiens
gccauucccuguaggagua

SEQ ID NO: 849062 - RNA, 19 nt, Homo sapiens
uaucaguucuagcauagua

SEQ ID NO: 849063 - RNA, 19 nt, Homo sapiens
agacgacuguuacaaguuu

SEQ ID NO: 849064 - RNA, 19 nt, Homo sapiens
caauaaaccugggcaagug

SEQ ID NO: 849065 - RNA, 19 nt, Homo sapiens
agaaguagcaagaucuuua

SEQ ID NO: 849066 - RNA, 19 nt, Homo sapiens
gggaaauucugcugcuuga

SEQ ID NO: 849067 - RNA, 19 nt, Homo sapiens
cgaauuggcuuugcuguca

SEQ ID NO: 849068 - RNA, 19 nt, Homo sapiens
ggagaucaauggacaggau

SEQ ID NO: 849069 - RNA, 19 nt, Homo sapiens
gaacugcuaccaugaagug

SEQ ID NO: 849070 - RNA, 19 nt, Homo sapiens
gaagauggguguuguuuuc

SEQ ID NO: 849071 - RNA, 19 nt, Homo sapiens
acaauaugcuuuacacuca

SEQ ID NO: 849072 - RNA, 19 nt, Homo sapiens
gauugccucuugaauuaaa

SEQ ID NO: 849073 - RNA, 19 nt, Homo sapiens
gcuauuugcuuuagagaca

SEQ ID NO: 849074 - RNA, 19 nt, Homo sapiens
gagaagagaccaagcuugu

SEQ ID NO: 849075 - RNA, 19 nt, Homo sapiens
ccaaaugccucugccuuga

SEQ ID NO: 849076 - RNA, 19 nt, Homo sapiens
cuaauagagucacagcuuu

SEQ ID NO: 849077 - RNA, 19 nt, Homo sapiens
gaugaaagacaaagaagga

SEQ ID NO: 849078 - RNA, 19 nt, Homo sapiens
gauaggcagcacugaaaua

SEQ ID NO: 849079 - RNA, 19 nt, Homo sapiens
caagacgacuguuacaagu

SEQ ID NO: 849080 - RNA, 19 nt, Homo sapiens
uaaggcugcuguaaaguug

SEQ ID NO: 849081 - RNA, 19 nt, Homo sapiens
aaacaagaauacugaguca

SEQ ID NO: 849082 - RNA, 19 nt, Homo sapiens
cacaagccauaaaccaaua

SEQ ID NO: 849083 - RNA, 19 nt, Homo sapiens
uaggagaccucuucuaucu

SEQ ID NO: 849084 - RNA, 19 nt, Homo sapiens
gaaccuuuguccaccauuc

SEQ ID NO: 849085 - RNA, 19 nt, Homo sapiens
ccugauagcuacccacaga

SEQ ID NO: 849086 - RNA, 19 nt, Homo sapiens
cuacuaaccuggagacagu

SEQ ID NO: 849087 - RNA, 19 nt, Homo sapiens
caauagaacuggucuucca

SEQ ID NO: 849088 - RNA, 19 nt, Homo sapiens
ugagaaauacagugcuuua

SEQ ID NO: 849089 - RNA, 19 nt, Homo sapiens
gguaggagaccucuucuau

SEQ ID NO: 849090 - RNA, 19 nt, Homo sapiens
ugacugauccugaacaaga

SEQ ID NO: 849091 - RNA, 19 nt, Homo sapiens
ccaagacaguggcagcaaa

SEQ ID NO: 849092 - RNA, 19 nt, Homo sapiens
caacagcugaugcccuaua

SEQ ID NO: 849093 - RNA, 19 nt, Homo sapiens
cacaugaauuucugccaua

SEQ ID NO: 849094 - RNA, 19 nt, Homo sapiens
gauagcaucccaucucaga

SEQ ID NO: 849095 - RNA, 19 nt, Homo sapiens
uaaacaagccuaacauugg

SEQ ID NO: 849096 - RNA, 19 nt, Homo sapiens
gaugcacaguuugcuauuu

SEQ ID NO: 849097 - RNA, 19 nt, Homo sapiens
uagaacuggucuuccauuu

SEQ ID NO: 849098 - RNA, 19 nt, Homo sapiens
gauaagggagagggaaaua

SEQ ID NO: 849099 - RNA, 19 nt, Homo sapiens
ggacuguaccuguaggaaa

SEQ ID NO: 849100 - RNA, 19 nt, Homo sapiens
gcaagugaggcaagagaaa

SEQ ID NO: 849101 - RNA, 19 nt, Homo sapiens
caggaagacuggagacugu

SEQ ID NO: 849102 - RNA, 19 nt, Homo sapiens
uaucuggguucucuucauu

SEQ ID NO: 849103 - RNA, 19 nt, Homo sapiens
gcagaaacacaaccacuca

SEQ ID NO: 849104 - RNA, 19 nt, Homo sapiens
ccagcagcaugaugacuuu

SEQ ID NO: 849105 - RNA, 19 nt, Homo sapiens
ggaagacuguggcuacaac

SEQ ID NO: 849106 - RNA, 19 nt, Homo sapiens
gggaaagggugaggacuuc

SEQ ID NO: 849107 - RNA, 19 nt, Homo sapiens
cuaacuuucuugcuucaaa

SEQ ID NO: 849108 - RNA, 19 nt, Homo sapiens
ggaaguccagcuccuuaaa

SEQ ID NO: 849109 - RNA, 19 nt, Homo sapiens
guacaaagacagggaauag

SEQ ID NO: 849110 - RNA, 19 nt, Homo sapiens
gcacucugcuggcgggaau

SEQ ID NO: 849111 - RNA, 19 nt, Homo sapiens
gaaaugaggaagaauccau

SEQ ID NO: 849112 - RNA, 19 nt, Homo sapiens
ccugcuaaguguggaauua

SEQ ID NO: 849113 - RNA, 19 nt, Homo sapiens
uaugggaccugcuaagugu

SEQ ID NO: 849114 - RNA, 19 nt, Homo sapiens
uauaagaaguagcaagauc

SEQ ID NO: 849115 - RNA, 19 nt, Homo sapiens
aaacaagccuaacauuggu

SEQ ID NO: 849116 - RNA, 19 nt, Homo sapiens
acaguuugcuauuugcuuu

SEQ ID NO: 849117 - RNA, 19 nt, Homo sapiens
ggaauugggaccugguuau

SEQ ID NO: 849118 - RNA, 19 nt, Homo sapiens
ccaaucacccuacaagaug

SEQ ID NO: 849119 - RNA, 19 nt, Homo sapiens
gcaagucccaucagccuau

SEQ ID NO: 849120 - RNA, 19 nt, Homo sapiens
gagcuggguuuuccuagua

SEQ ID NO: 849121 - RNA, 19 nt, Homo sapiens
ggagagcaacuggacuaua

SEQ ID NO: 849122 - RNA, 19 nt, Homo sapiens
gcacugaaauauccuaacc

SEQ ID NO: 849123 - RNA, 19 nt, Homo sapiens
aagcagagguggaaaauga

SEQ ID NO: 849124 - RNA, 19 nt, Homo sapiens
gcaagagaaaugaggaaga

SEQ ID NO: 849125 - RNA, 19 nt, Homo sapiens
aggagaggaugcacaguuu

SEQ ID NO: 849126 - RNA, 19 nt, Homo sapiens
gggcuucuacguugucuuu

SEQ ID NO: 849127 - RNA, 19 nt, Homo sapiens
uauccgacauguacugcua

SEQ ID NO: 849128 - RNA, 19 nt, Homo sapiens
aaacuacgguaccaguguu

SEQ ID NO: 849129 - RNA, 19 nt, Homo sapiens
caugaugacuuugcugaug

SEQ ID NO: 849130 - RNA, 19 nt, Homo sapiens
ugucagcgcuugccaugug

SEQ ID NO: 849131 - RNA, 19 nt, Homo sapiens
caaguugccuguauugaua

SEQ ID NO: 849132 - RNA, 19 nt, Homo sapiens
ggaauggaauggccaguga

SEQ ID NO: 849133 - RNA, 19 nt, Homo sapiens
ggugaaaucugcucuucuu

SEQ ID NO: 849134 - RNA, 19 nt, Homo sapiens
ggaauugcccuccagguaa

SEQ ID NO: 849135 - RNA, 19 nt, Homo sapiens
ccacgucuguuucugcuaa

SEQ ID NO: 849136 - RNA, 19 nt, Homo sapiens
gaauugcccuccagguaau

SEQ ID NO: 849137 - RNA, 19 nt, Homo sapiens
ggguauaccucccuuguuc

SEQ ID NO: 849138 - RNA, 19 nt, Homo sapiens
gaaaucugcucuucuucca

SEQ ID NO: 849139 - RNA, 19 nt, Homo sapiens
gauaauguacucacucaug

SEQ ID NO: 849140 - RNA, 19 nt, Homo sapiens
ugcaagaccugaccaguug

SEQ ID NO: 849141 - RNA, 19 nt, Homo sapiens
aaucugcucuucuuccaaa

SEQ ID NO: 849142 - RNA, 19 nt, Homo sapiens
cagguaaucccuuuccuuu

SEQ ID NO: 849143 - RNA, 19 nt, Homo sapiens
gaacccugcccacagauga

SEQ ID NO: 849144 - RNA, 19 nt, Homo sapiens
cauugucggugcucacuuu

SEQ ID NO: 849145 - RNA, 19 nt, Homo sapiens
agagaacccugcccacaga

SEQ ID NO: 849146 - RNA, 19 nt, Homo sapiens
ccaauaaaguaugggaguu

SEQ ID NO: 849147 - RNA, 19 nt, Homo sapiens
gagaauggagcccuaaagu

SEQ ID NO: 849148 - RNA, 19 nt, Homo sapiens
cagcgucuccguugauaaa

SEQ ID NO: 849149 - RNA, 19 nt, Homo sapiens
gcucuucuuccaaauauau

SEQ ID NO: 849150 - RNA, 19 nt, Homo sapiens
uaaaguaugggaguugaaa

SEQ ID NO: 849151 - RNA, 19 nt, Homo sapiens
gauaaaaucaucucgcauu

SEQ ID NO: 849152 - RNA, 19 nt, Homo sapiens
caccaucccagaagcauuu

SEQ ID NO: 849153 - RNA, 19 nt, Homo sapiens
auaccucccuuguucugua

SEQ ID NO: 849154 - RNA, 19 nt, Homo sapiens
gacugcagcugaagaaggu

SEQ ID NO: 849155 - RNA, 19 nt, Homo sapiens
uguacucacucaugcugua

SEQ ID NO: 849156 - RNA, 19 nt, Homo sapiens
gaacaccaucccagaagca

SEQ ID NO: 849157 - RNA, 19 nt, Homo sapiens
aauaaaguaugggaguuga

SEQ ID NO: 849158 - RNA, 19 nt, Homo sapiens
ccaaguugccuguauugau

SEQ ID NO: 849159 - RNA, 19 nt, Homo sapiens
cuccaucccucccaaguug

SEQ ID NO: 849160 - RNA, 19 nt, Homo sapiens
gauccuggaguccguaguu

SEQ ID NO: 849161 - RNA, 19 nt, Homo sapiens
caauaaaguaugggaguug

SEQ ID NO: 849162 - RNA, 19 nt, Homo sapiens
cuuccuaucuaucugcaaa

SEQ ID NO: 849163 - RNA, 19 nt, Homo sapiens
gcaguuggagcugugguuu

SEQ ID NO: 849164 - RNA, 19 nt, Homo sapiens
ggccuguggugaugguuug

SEQ ID NO: 849165 - RNA, 19 nt, Homo sapiens
gaagugcugcgugucauca

SEQ ID NO: 849166 - RNA, 19 nt, Homo sapiens
gaccugaccaguugagcuu

SEQ ID NO: 849167 - RNA, 19 nt, Homo sapiens
ugaucacacugcugcaaga

SEQ ID NO: 849168 - RNA, 19 nt, Homo sapiens
uguguuggcucuugugaag

SEQ ID NO: 849169 - RNA, 19 nt, Homo sapiens
gucagcgucuccguugaua

SEQ ID NO: 849170 - RNA, 19 nt, Homo sapiens
ucaugggacugcagcugaa

SEQ ID NO: 849171 - RNA, 19 nt, Homo sapiens
gugaguguguuggcucuug

SEQ ID NO: 849172 - RNA, 19 nt, Homo sapiens
ugucuuccuuccuaucuau

SEQ ID NO: 849173 - RNA, 19 nt, Homo sapiens
cugcucuucuuccaaauau

SEQ ID NO: 849174 - RNA, 19 nt, Homo sapiens
uauauaagggaaugucuuc

SEQ ID NO: 849175 - RNA, 19 nt, Homo sapiens
aggaauugcccuccaggua

SEQ ID NO: 849176 - RNA, 19 nt, Homo sapiens
gaauggaauggccagugaa

SEQ ID NO: 849177 - RNA, 19 nt, Homo sapiens
ccaccuggaccugcucuuu

SEQ ID NO: 849178 - RNA, 19 nt, Homo sapiens
uugauaauguacucacuca

SEQ ID NO: 849179 - RNA, 19 nt, Homo sapiens
ccucccaaguugccuguau

SEQ ID NO: 849180 - RNA, 19 nt, Homo sapiens
aaucuagaccuccuucuuc

SEQ ID NO: 849181 - RNA, 19 nt, Homo sapiens
ccgcuuccaugccuuuauc

SEQ ID NO: 849182 - RNA, 19 nt, Homo sapiens
gucuguuucugcuaauauu

SEQ ID NO: 849183 - RNA, 19 nt, Homo sapiens
gaaggugcacaggagagaa

SEQ ID NO: 849184 - RNA, 19 nt, Homo sapiens
ccuccuuugucccaauaaa

SEQ ID NO: 849185 - RNA, 19 nt, Homo sapiens
gggaagugcugcgugucau

SEQ ID NO: 849186 - RNA, 19 nt, Homo sapiens
acucacucaugcuguacua

SEQ ID NO: 849187 - RNA, 19 nt, Homo sapiens
ccuccuucuucauccauaa

SEQ ID NO: 849188 - RNA, 19 nt, Homo sapiens
aaggugaaaucugcucuuc

SEQ ID NO: 849189 - RNA, 19 nt, Homo sapiens
cugcaagaccugaccaguu

SEQ ID NO: 849190 - RNA, 19 nt, Homo sapiens
caagccaugcugcacuuug

SEQ ID NO: 849191 - RNA, 19 nt, Homo sapiens
ccagguaaucccuuuccuu

SEQ ID NO: 849192 - RNA, 19 nt, Homo sapiens
gcaagaccugaccaguuga

SEQ ID NO: 849193 - RNA, 19 nt, Homo sapiens
uugccuguauugauaaugu

SEQ ID NO: 849194 - RNA, 19 nt, Homo sapiens
gaaugucuuccuuccuauc

SEQ ID NO: 849195 - RNA, 19 nt, Homo sapiens
ggaagugcugcgugucauc

SEQ ID NO: 849196 - RNA, 19 nt, Homo sapiens
accuggaccugcucuuuga

SEQ ID NO: 849197 - RNA, 19 nt, Homo sapiens
caccuggaccugcucuuug

SEQ ID NO: 849198 - RNA, 19 nt, Homo sapiens
aaaucuagaccuccuucuu

SEQ ID NO: 849199 - RNA, 19 nt, Homo sapiens
gacccuuuccugcguaugu

SEQ ID NO: 849200 - RNA, 19 nt, Homo sapiens
gcaagccaugcugcacuuu

SEQ ID NO: 849201 - RNA, 19 nt, Homo sapiens
ucuagucuccuuccugugu

SEQ ID NO: 849202 - RNA, 19 nt, Homo sapiens
cuagaccuccuucuucauc

SEQ ID NO: 849203 - RNA, 19 nt, Homo sapiens
ccuccuauacccaccugua

SEQ ID NO: 849204 - RNA, 19 nt, Homo sapiens
gugaacaccaucccagaag

SEQ ID NO: 849205 - RNA, 19 nt, Homo sapiens
gaacagcagugaccaggaa

SEQ ID NO: 849206 - RNA, 19 nt, Homo sapiens
caacaaggaugugaagauu

SEQ ID NO: 849207 - RNA, 19 nt, Homo sapiens
gaccaucccugccaacaaa

SEQ ID NO: 849208 - RNA, 19 nt, Homo sapiens
acaaggaugugaagauuga

SEQ ID NO: 849209 - RNA, 19 nt, Homo sapiens
ggccaacacuccucaagaa

SEQ ID NO: 849210 - RNA, 19 nt, Homo sapiens
gagacaagccaggcaguua

SEQ ID NO: 849211 - RNA, 19 nt, Homo sapiens
gaaaugcccagccgaaagu

SEQ ID NO: 849212 - RNA, 19 nt, Homo sapiens
caacacuccucaagaacug

SEQ ID NO: 849213 - RNA, 19 nt, Homo sapiens
gcaacaaggaugugaagau

SEQ ID NO: 849214 - RNA, 19 nt, Homo sapiens
gaaagugagacuccuaaag

SEQ ID NO: 849215 - RNA, 19 nt, Homo sapiens
cauuugagcucugcaagau

SEQ ID NO: 849216 - RNA, 19 nt, Homo sapiens
gcagugggccaucggcuau

SEQ ID NO: 849217 - RNA, 19 nt, Homo sapiens
guugugaaaccgaaauaaa

SEQ ID NO: 849218 - RNA, 19 nt, Homo sapiens
gccaggcaguuacaucuuc

SEQ ID NO: 849219 - RNA, 19 nt, Homo sapiens
gcugggaggccgugaguau

SEQ ID NO: 849220 - RNA, 19 nt, Homo sapiens
gggacuuucuacucaucua

SEQ ID NO: 849221 - RNA, 19 nt, Homo sapiens
ugcaagaucugugcugaga

SEQ ID NO: 849222 - RNA, 19 nt, Homo sapiens
aaagugagacuccuaaagg

SEQ ID NO: 849223 - RNA, 19 nt, Homo sapiens
gggaggccgugaguaucua

SEQ ID NO: 849224 - RNA, 19 nt, Homo sapiens
ucaucuaccuggccaaucu

SEQ ID NO: 849225 - RNA, 19 nt, Homo sapiens
caagcuggccaucaucuuc

SEQ ID NO: 849226 - RNA, 19 nt, Homo sapiens
ugccaagccuggucuguca

SEQ ID NO: 849227 - RNA, 19 nt, Homo sapiens
gagcaacaaggaugugaag

SEQ ID NO: 849228 - RNA, 19 nt, Homo sapiens
ccuuucggcuccuccauug

SEQ ID NO: 849229 - RNA, 19 nt, Homo sapiens
uggccuuccucaccuauga

SEQ ID NO: 849230 - RNA, 19 nt, Homo sapiens
ccaggaagcccagaaaugc

SEQ ID NO: 849231 - RNA, 19 nt, Homo sapiens
gagagcaacaaggauguga

SEQ ID NO: 849232 - RNA, 19 nt, Homo sapiens
gcgggcacguguccaucuu

SEQ ID NO: 849233 - RNA, 19 nt, Homo sapiens
cgaaagugagacuccuaaa

SEQ ID NO: 849234 - RNA, 19 nt, Homo sapiens
cagaaaugcccagccgaaa

SEQ ID NO: 849235 - RNA, 19 nt, Homo sapiens
ggacggcuucuaccucuac

SEQ ID NO: 849236 - RNA, 19 nt, Homo sapiens
ccgaaagugagacuccuaa

SEQ ID NO: 849237 - RNA, 19 nt, Homo sapiens
ccaagccuggucugucaaa

SEQ ID NO: 849238 - RNA, 19 nt, Homo sapiens
uucgagagguggcccauuc

SEQ ID NO: 849239 - RNA, 19 nt, Homo sapiens
ccaggaaggcagggaguug

SEQ ID NO: 849240 - RNA, 19 nt, Homo sapiens
uuugagcucugcaagaucu

SEQ ID NO: 849241 - RNA, 19 nt, Homo sapiens
ccacaacccagaccugacu

SEQ ID NO: 849242 - RNA, 19 nt, Homo sapiens
ccuaugaugagguccaaga

SEQ ID NO: 849243 - RNA, 19 nt, Homo sapiens
agaaaugcccagccgaaag

SEQ ID NO: 849244 - RNA, 19 nt, Homo sapiens
ccgugaguaucuaccaguu

SEQ ID NO: 849245 - RNA, 19 nt, Homo sapiens
gacaagccaggcaguuaca

SEQ ID NO: 849246 - RNA, 19 nt, Homo sapiens
gcgcguagauaaauaaaua

SEQ ID NO: 849247 - RNA, 19 nt, Homo sapiens
cgaaacugccaaacucuuu

SEQ ID NO: 849248 - RNA, 19 nt, Homo sapiens
acaaacaccugugccaaga

SEQ ID NO: 849249 - RNA, 19 nt, Homo sapiens
uaaauacacucagcgucaa

SEQ ID NO: 849250 - RNA, 19 nt, Homo sapiens
gcaaaaggcucagaaacuc

SEQ ID NO: 849251 - RNA, 19 nt, Homo sapiens
cgugcuggauauuuaaauu

SEQ ID NO: 849252 - RNA, 19 nt, Homo sapiens
gccaagaccugagcuucug

SEQ ID NO: 849253 - RNA, 19 nt, Homo sapiens
caaacucuuucuccugucu

SEQ ID NO: 849254 - RNA, 19 nt, Homo sapiens
gguacagccucugcucaug

SEQ ID NO: 849255 - RNA, 19 nt, Homo sapiens
gccccgugcuggauauuua

SEQ ID NO: 849256 - RNA, 19 nt, Homo sapiens
aggcgaaacugccaaacuc

SEQ ID NO: 849257 - RNA, 19 nt, Homo sapiens
ggagggccaggcauguauu

SEQ ID NO: 849258 - RNA, 19 nt, Homo sapiens
cggcaagcccucagacuuc

SEQ ID NO: 849259 - RNA, 19 nt, Homo sapiens
gcgaaacugccaaacucuu

SEQ ID NO: 849260 - RNA, 19 nt, Homo sapiens
ucagcggccuccuuaaugc

SEQ ID NO: 849261 - RNA, 19 nt, Homo sapiens
ccucagcggccuccuuaau

SEQ ID NO: 849262 - RNA, 19 nt, Homo sapiens
caggagggccaggcaugua

SEQ ID NO: 849263 - RNA, 19 nt, Homo sapiens
gucaauccaggacuacaaa

SEQ ID NO: 849264 - RNA, 19 nt, Homo sapiens
cuccaguucuuccacaugu

SEQ ID NO: 849265 - RNA, 19 nt, Homo sapiens
caacuaauguuaacgcaua

SEQ ID NO: 849266 - RNA, 19 nt, Homo sapiens
gaagauggcaccaaaguga

SEQ ID NO: 849267 - RNA, 19 nt, Homo sapiens
gcuccuagaugacaacuuu

SEQ ID NO: 849268 - RNA, 19 nt, Homo sapiens
gaucuaaacacaagacuuu

SEQ ID NO: 849269 - RNA, 19 nt, Homo sapiens
ggaggagucuacauauauu

SEQ ID NO: 849270 - RNA, 19 nt, Homo sapiens
uaagauacaucgaggaaga

SEQ ID NO: 849271 - RNA, 19 nt, Homo sapiens
ccacauggcauagaaauaa

SEQ ID NO: 849272 - RNA, 19 nt, Homo sapiens
gguaguuucuucuuacauu

SEQ ID NO: 849273 - RNA, 19 nt, Homo sapiens
gaaagggaguuccugaucu

SEQ ID NO: 849274 - RNA, 19 nt, Homo sapiens
caaaugcuguacuccaauu

SEQ ID NO: 849275 - RNA, 19 nt, Homo sapiens
cgaggaagauggcaccaaa

SEQ ID NO: 849276 - RNA, 19 nt, Homo sapiens
gcaccaaagugaauuguac

SEQ ID NO: 849277 - RNA, 19 nt, Homo sapiens
guacagagcaacacuuaug

SEQ ID NO: 849278 - RNA, 19 nt, Homo sapiens
caaaugaaacuugacagua

SEQ ID NO: 849279 - RNA, 19 nt, Homo sapiens
gaaacugugggauacauuu

SEQ ID NO: 849280 - RNA, 19 nt, Homo sapiens
ucaaggaggagucuacaua

SEQ ID NO: 849281 - RNA, 19 nt, Homo sapiens
acagucaacucuuugguaa

SEQ ID NO: 849282 - RNA, 19 nt, Homo sapiens
aaagggaguuccugaucua

SEQ ID NO: 849283 - RNA, 19 nt, Homo sapiens
ccagaaagaucaaaaguga

SEQ ID NO: 849284 - RNA, 19 nt, Homo sapiens
caacacuuaugcaaccaaa

SEQ ID NO: 849285 - RNA, 19 nt, Homo sapiens
aggcagaaauucaagcuuu

SEQ ID NO: 849286 - RNA, 19 nt, Homo sapiens
gaauuuaguuacagaugca

SEQ ID NO: 849287 - RNA, 19 nt, Homo sapiens
aaggaggagucuacauaua

SEQ ID NO: 849288 - RNA, 19 nt, Homo sapiens
gcaccugcauucacgauag

SEQ ID NO: 849289 - RNA, 19 nt, Homo sapiens
cugaggagaccuuauguua

SEQ ID NO: 849290 - RNA, 19 nt, Homo sapiens
ccaaaagggacauauauua

SEQ ID NO: 849291 - RNA, 19 nt, Homo sapiens
gcauagaaauaaugugcau

SEQ ID NO: 849292 - RNA, 19 nt, Homo sapiens
gaucuaugucuaugucuuu

SEQ ID NO: 849293 - RNA, 19 nt, Homo sapiens
gaaauaauggcagacucua

SEQ ID NO: 849294 - RNA, 19 nt, Homo sapiens
gcugugccaucgaauauuc

SEQ ID NO: 849295 - RNA, 19 nt, Homo sapiens
gaggagucuacauauauua

SEQ ID NO: 849296 - RNA, 19 nt, Homo sapiens
gcuggcaacuuaagauaca

SEQ ID NO: 849297 - RNA, 19 nt, Homo sapiens
gccagaggcuuuucauuaa

SEQ ID NO: 849298 - RNA, 19 nt, Homo sapiens
gaggagaccuuauguuacc

SEQ ID NO: 849299 - RNA, 19 nt, Homo sapiens
ucaagaaacugugggauac

SEQ ID NO: 849300 - RNA, 19 nt, Homo sapiens
ggucuuacuccauuaauuc

SEQ ID NO: 849301 - RNA, 19 nt, Homo sapiens
guccgguaguuucuucuua

SEQ ID NO: 849302 - RNA, 19 nt, Homo sapiens
ggcagaaauucaagcuuug

SEQ ID NO: 849303 - RNA, 19 nt, Homo sapiens
gggaccaaaugaaacuuga

SEQ ID NO: 849304 - RNA, 19 nt, Homo sapiens
aguuacagaugcaaaguuu

SEQ ID NO: 849305 - RNA, 19 nt, Homo sapiens
gacagucaacucuuuggua

SEQ ID NO: 849306 - RNA, 19 nt, Homo sapiens
gauuaucuuuccagagugu

SEQ ID NO: 849307 - RNA, 19 nt, Homo sapiens
ugacuuuccuaucaucaga

SEQ ID NO: 849308 - RNA, 19 nt, Homo sapiens
ggaucuaugucuaugucuu

SEQ ID NO: 849309 - RNA, 19 nt, Homo sapiens
gucaagaaacugugggaua

SEQ ID NO: 849310 - RNA, 19 nt, Homo sapiens
ggaaauaauggcagacucu

SEQ ID NO: 849311 - RNA, 19 nt, Homo sapiens
gcaucaugauuacgggaaa

SEQ ID NO: 849312 - RNA, 19 nt, Homo sapiens
caaggaggagucuacauau

SEQ ID NO: 849313 - RNA, 19 nt, Homo sapiens
gggucuuacuccauuaauu

SEQ ID NO: 849314 - RNA, 19 nt, Homo sapiens
aauaauggcagacucuaaa

SEQ ID NO: 849315 - RNA, 19 nt, Homo sapiens
ucucacaguuccagcuauu

SEQ ID NO: 849316 - RNA, 19 nt, Homo sapiens
gggaguuccugaucuaaac

SEQ ID NO: 849317 - RNA, 19 nt, Homo sapiens
uaguacagagcaacacuua

SEQ ID NO: 849318 - RNA, 19 nt, Homo sapiens
gaguguacuuaccuaacaa

SEQ ID NO: 849319 - RNA, 19 nt, Homo sapiens
gaugacaacuuuugcaaca

SEQ ID NO: 849320 - RNA, 19 nt, Homo sapiens
aacaaaugcuguacuccaa

SEQ ID NO: 849321 - RNA, 19 nt, Homo sapiens
guaccuaaagauaguuuga

SEQ ID NO: 849322 - RNA, 19 nt, Homo sapiens
cgauacaacuaauguuaac

SEQ ID NO: 849323 - RNA, 19 nt, Homo sapiens
agaguguacuuaccuaaca

SEQ ID NO: 849324 - RNA, 19 nt, Homo sapiens
uauguuaccugccaaccau

SEQ ID NO: 849325 - RNA, 19 nt, Homo sapiens
guauggaucuaugucuaug

SEQ ID NO: 849326 - RNA, 19 nt, Homo sapiens
aaguauggaucuaugucua

SEQ ID NO: 849327 - RNA, 19 nt, Homo sapiens
ccuuugccuuuauacuuua

SEQ ID NO: 849328 - RNA, 19 nt, Homo sapiens
cuauaaguauggaucuaug

SEQ ID NO: 849329 - RNA, 19 nt, Homo sapiens
uccuuugccuuuauacuuu

SEQ ID NO: 849330 - RNA, 19 nt, Homo sapiens
uuuggaggauggauauaaa

SEQ ID NO: 849331 - RNA, 19 nt, Homo sapiens
ugagguucuugcaucuaua

SEQ ID NO: 849332 - RNA, 19 nt, Homo sapiens
ggaagauggcaccaaagug

SEQ ID NO: 849333 - RNA, 19 nt, Homo sapiens
gagauguugcaaaugaauu

SEQ ID NO: 849334 - RNA, 19 nt, Homo sapiens
gauaguuugauuccacuga

SEQ ID NO: 849335 - RNA, 19 nt, Homo sapiens
ggucuucucccuucugauc

SEQ ID NO: 849336 - RNA, 19 nt, Homo sapiens
caaaacaaaugcuguacuc

SEQ ID NO: 849337 - RNA, 19 nt, Homo sapiens
guuaacgcauaaaguaucu

SEQ ID NO: 849338 - RNA, 19 nt, Homo sapiens
gcucaucaucucacaguuc

SEQ ID NO: 849339 - RNA, 19 nt, Homo sapiens
cgucgacaauauuaucaau

SEQ ID NO: 849340 - RNA, 19 nt, Homo sapiens
aaauaauggcagacucuaa

SEQ ID NO: 849341 - RNA, 19 nt, Homo sapiens
ccaaaugaaacuugacagu

SEQ ID NO: 849342 - RNA, 19 nt, Homo sapiens
cugagguucuugcaucuau

SEQ ID NO: 849343 - RNA, 19 nt, Homo sapiens
gguguccgguaguuucuuc

SEQ ID NO: 849344 - RNA, 19 nt, Homo sapiens
ccuauccucuaaagcaaau

SEQ ID NO: 849345 - RNA, 19 nt, Homo sapiens
ugauccacauggcauagaa

SEQ ID NO: 849346 - RNA, 19 nt, Homo sapiens
ucuccuugcaucaugauua

SEQ ID NO: 849347 - RNA, 19 nt, Homo sapiens
aggaggagucuacauauau

SEQ ID NO: 849348 - RNA, 19 nt, Homo sapiens
gccuuauucuugccucuau

SEQ ID NO: 849349 - RNA, 19 nt, Homo sapiens
cacauggcauagaaauaau

SEQ ID NO: 849350 - RNA, 19 nt, Homo sapiens
uuucuguccuauccucuaa

SEQ ID NO: 849351 - RNA, 19 nt, Homo sapiens
aaugaaacuugacaguauc

SEQ ID NO: 849352 - RNA, 19 nt, Homo sapiens
gaccaaaugaaacuugaca

SEQ ID NO: 849353 - RNA, 19 nt, Homo sapiens
caaccaaaagggacauaua

SEQ ID NO: 849354 - RNA, 19 nt, Homo sapiens
guccuauccucuaaagcaa

SEQ ID NO: 849355 - RNA, 19 nt, Homo sapiens
cagaggcuuuucauuaauu

SEQ ID NO: 849356 - RNA, 19 nt, Homo sapiens
cacgauagacaacagauca

SEQ ID NO: 849357 - RNA, 19 nt, Homo sapiens
uuagauggcuuggucuucu

SEQ ID NO: 849358 - RNA, 19 nt, Homo sapiens
aaagggacauauauuacac

SEQ ID NO: 849359 - RNA, 19 nt, Homo sapiens
ugucaucaaagucuacaaa

SEQ ID NO: 849360 - RNA, 19 nt, Homo sapiens
aaauuuggaggauggauau

SEQ ID NO: 849361 - RNA, 19 nt, Homo sapiens
ccagaguguacuuaccuaa

SEQ ID NO: 849362 - RNA, 19 nt, Homo sapiens
caccugcauucacgauaga

SEQ ID NO: 849363 - RNA, 19 nt, Homo sapiens
gccaucgaauauucaagga

SEQ ID NO: 849364 - RNA, 19 nt, Homo sapiens
ugccagaggcuuuucauua

SEQ ID NO: 849365 - RNA, 19 nt, Homo sapiens
ccucaagcauugcgaguuu

SEQ ID NO: 849366 - RNA, 19 nt, Homo sapiens
gccgcaagcucgacauuga

SEQ ID NO: 849367 - RNA, 19 nt, Homo sapiens
gcacugcccagaucacuga

SEQ ID NO: 849368 - RNA, 19 nt, Homo sapiens
gagccgagggcaacaggua

SEQ ID NO: 849369 - RNA, 19 nt, Homo sapiens
aggcuaaugugaccaagga

SEQ ID NO: 849370 - RNA, 19 nt, Homo sapiens
gguacuacgaggccaacua

SEQ ID NO: 849371 - RNA, 19 nt, Homo sapiens
guacuacgaggccaacuac

SEQ ID NO: 849372 - RNA, 19 nt, Homo sapiens
gcaucaagcacagaaucaa

SEQ ID NO: 849373 - RNA, 19 nt, Homo sapiens
ccagaagccagacaacaag

SEQ ID NO: 849374 - RNA, 19 nt, Homo sapiens
gucaccggcugcaucaaug

SEQ ID NO: 849375 - RNA, 19 nt, Homo sapiens
ugaccaaggaggcauuugu

SEQ ID NO: 849376 - RNA, 19 nt, Homo sapiens
caagcucgacauugacuuc

SEQ ID NO: 849377 - RNA, 19 nt, Homo sapiens
gaccaaggaggcauuuguc

SEQ ID NO: 849378 - RNA, 19 nt, Homo sapiens
gggcaucaagcacagaauc

SEQ ID NO: 849379 - RNA, 19 nt, Homo sapiens
uccagaagccagacaacaa

SEQ ID NO: 849380 - RNA, 19 nt, Homo sapiens
cauuaugacuccacauuua

SEQ ID NO: 849381 - RNA, 19 nt, Homo sapiens
caagauuacccauauguua

SEQ ID NO: 849382 - RNA, 19 nt, Homo sapiens
gcaaggauaauucagauuu

SEQ ID NO: 849383 - RNA, 19 nt, Homo sapiens
guucuuauguaccgcauua

SEQ ID NO: 849384 - RNA, 19 nt, Homo sapiens
ccagaauacugcccuauga

SEQ ID NO: 849385 - RNA, 19 nt, Homo sapiens
uaaguuugcuuggauguuu

SEQ ID NO: 849386 - RNA, 19 nt, Homo sapiens
agacugaucuuccaagcaa

SEQ ID NO: 849387 - RNA, 19 nt, Homo sapiens
cagauaaguuugcuuggau

SEQ ID NO: 849388 - RNA, 19 nt, Homo sapiens
gcauuaugacuccacauuu

SEQ ID NO: 849389 - RNA, 19 nt, Homo sapiens
gacuccacauuuaugaaua

SEQ ID NO: 849390 - RNA, 19 nt, Homo sapiens
ccagguggcuuguuaacag

SEQ ID NO: 849391 - RNA, 19 nt, Homo sapiens
cugaccagguggcuuguua

SEQ ID NO: 849392 - RNA, 19 nt, Homo sapiens
caagcaaggauaauucaga

SEQ ID NO: 849393 - RNA, 19 nt, Homo sapiens
gcaauuucagcaaccauga

SEQ ID NO: 849394 - RNA, 19 nt, Homo sapiens
aaugacaacuggaagacuu

SEQ ID NO: 849395 - RNA, 19 nt, Homo sapiens
gugggaauuugaaagaaga

SEQ ID NO: 849396 - RNA, 19 nt, Homo sapiens
ccaggguuauauuugaauu

SEQ ID NO: 849397 - RNA, 19 nt, Homo sapiens
acagauaaguuugcuugga

SEQ ID NO: 849398 - RNA, 19 nt, Homo sapiens
aagcaaggauaauucagau

SEQ ID NO: 849399 - RNA, 19 nt, Homo sapiens
ccuaugagacugggaauga

SEQ ID NO: 849400 - RNA, 19 nt, Homo sapiens
gaucuuccaagcaauuuca

SEQ ID NO: 849401 - RNA, 19 nt, Homo sapiens
uaacagucagugggaauuu

SEQ ID NO: 849402 - RNA, 19 nt, Homo sapiens
acuccaggguuauauuuga

SEQ ID NO: 849403 - RNA, 19 nt, Homo sapiens
gaaagaagaaaaccagaug

SEQ ID NO: 849404 - RNA, 19 nt, Homo sapiens
ucagugggaauuugaaaga

SEQ ID NO: 849405 - RNA, 19 nt, Homo sapiens
gggaaugacaacuggaaga

SEQ ID NO: 849406 - RNA, 19 nt, Homo sapiens
uauggacccuggaguucuu

SEQ ID NO: 849407 - RNA, 19 nt, Homo sapiens
uaggagagccagaauacug

SEQ ID NO: 849408 - RNA, 19 nt, Homo sapiens
augccaagauuacccauau

SEQ ID NO: 849409 - RNA, 19 nt, Homo sapiens
ccaagauuacccauauguu

SEQ ID NO: 849410 - RNA, 19 nt, Homo sapiens
gccaagauuacccauaugu

SEQ ID NO: 849411 - RNA, 19 nt, Homo sapiens
ggauaaaaggaacaaagua

SEQ ID NO: 849412 - RNA, 19 nt, Homo sapiens
uuucagcaaccaugaguuu

SEQ ID NO: 849413 - RNA, 19 nt, Homo sapiens
acccuggaguucuuaugua

SEQ ID NO: 849414 - RNA, 19 nt, Homo sapiens
ucaaagaggauaaaaggaa

SEQ ID NO: 849415 - RNA, 19 nt, Homo sapiens
agaauacugcccuaugaga

SEQ ID NO: 849416 - RNA, 19 nt, Homo sapiens
ugacuccacauuuaugaau

SEQ ID NO: 849417 - RNA, 19 nt, Homo sapiens
cuuauguaccgcauuauga

SEQ ID NO: 849418 - RNA, 19 nt, Homo sapiens
aaaaccagauggaacaaga

SEQ ID NO: 849419 - RNA, 19 nt, Homo sapiens
cagugggaauuugaaagaa

SEQ ID NO: 849420 - RNA, 19 nt, Homo sapiens
cagcaaccaugaguuucug

SEQ ID NO: 849421 - RNA, 19 nt, Homo sapiens
gacccuggaguucuuaugu

SEQ ID NO: 849422 - RNA, 19 nt, Homo sapiens
gauaaguuugcuuggaugu

SEQ ID NO: 849423 - RNA, 19 nt, Homo sapiens
gccagaauacugcccuaug

SEQ ID NO: 849424 - RNA, 19 nt, Homo sapiens
uaugacuccacauuuauga

SEQ ID NO: 849425 - RNA, 19 nt, Homo sapiens
gguggcuuguuaacaguca

SEQ ID NO: 849426 - RNA, 19 nt, Homo sapiens
uccuguggaucccauugua

SEQ ID NO: 849427 - RNA, 19 nt, Homo sapiens
ggaaugacaacuggaagac

SEQ ID NO: 849428 - RNA, 19 nt, Homo sapiens
caagcaauuucagcaacca

SEQ ID NO: 849429 - RNA, 19 nt, Homo sapiens
cuccaggguuauauuugaa

SEQ ID NO: 849430 - RNA, 19 nt, Homo sapiens
ccagauggaacaagaagac

SEQ ID NO: 849431 - RNA, 19 nt, Homo sapiens
gcacugaacugaagcaaug

SEQ ID NO: 849432 - RNA, 19 nt, Homo sapiens
ggagggaaaugaucuauga

SEQ ID NO: 849433 - RNA, 19 nt, Homo sapiens
ccaaaugccucuccucuau

SEQ ID NO: 849434 - RNA, 19 nt, Homo sapiens
gaagagaccucagacaucu

SEQ ID NO: 849435 - RNA, 19 nt, Homo sapiens
ggacagagacaaaggaaau

SEQ ID NO: 849436 - RNA, 19 nt, Homo sapiens
gaaaugaagagaccucaga

SEQ ID NO: 849437 - RNA, 19 nt, Homo sapiens
gaacugaagcaaugcauuc

SEQ ID NO: 849438 - RNA, 19 nt, Homo sapiens
gggauagaaugaacuuaau

SEQ ID NO: 849439 - RNA, 19 nt, Homo sapiens
caucuucugcugaggauua

SEQ ID NO: 849440 - RNA, 19 nt, Homo sapiens
gaagcaaugcauucuauca

SEQ ID NO: 849441 - RNA, 19 nt, Homo sapiens
gcacauccaacugcacuaa

SEQ ID NO: 849442 - RNA, 19 nt, Homo sapiens
aaaugccucuccucuauug

SEQ ID NO: 849443 - RNA, 19 nt, Homo sapiens
ggaccagucugugggauag

SEQ ID NO: 849444 - RNA, 19 nt, Homo sapiens
ccucugcucucuugucuuc

SEQ ID NO: 849445 - RNA, 19 nt, Homo sapiens
cugcugaggauuaccauua

SEQ ID NO: 849446 - RNA, 19 nt, Homo sapiens
cugaagcaaugcauucuau

SEQ ID NO: 849447 - RNA, 19 nt, Homo sapiens
gaaugucagaggcagguaa

SEQ ID NO: 849448 - RNA, 19 nt, Homo sapiens
cgacgacgccuaucucuac

SEQ ID NO: 849449 - RNA, 19 nt, Homo sapiens
ggauagaaugaacuuaaug

SEQ ID NO: 849450 - RNA, 19 nt, Homo sapiens
gauagaaugaacuuaaugg

SEQ ID NO: 849451 - RNA, 19 nt, Homo sapiens
ugucagaggcagguaauaa

SEQ ID NO: 849452 - RNA, 19 nt, Homo sapiens
caaaugccucuccucuauu

SEQ ID NO: 849453 - RNA, 19 nt, Homo sapiens
ugggauagaaugaacuuaa

SEQ ID NO: 849454 - RNA, 19 nt, Homo sapiens
cuucauccguggaacuuga

SEQ ID NO: 849455 - RNA, 19 nt, Homo sapiens
cgacgccuaucucuacauc

SEQ ID NO: 849456 - RNA, 19 nt, Homo sapiens
ugaagagaccucagacauc

SEQ ID NO: 849457 - RNA, 19 nt, Homo sapiens
gucagaggcagguaauaaa

SEQ ID NO: 849458 - RNA, 19 nt, Homo sapiens
gccagggacugcucacucu

SEQ ID NO: 849459 - RNA, 19 nt, Homo sapiens
agagaccucagacaucuuu

SEQ ID NO: 849460 - RNA, 19 nt, Homo sapiens
uaaacugccucugcucucu

SEQ ID NO: 849461 - RNA, 19 nt, Homo sapiens
gacuccaaccguaugauuu

SEQ ID NO: 849462 - RNA, 19 nt, Homo sapiens
gagacaaaggaaaugaaga

SEQ ID NO: 849463 - RNA, 19 nt, Homo sapiens
ccaacacguccaacacuug

SEQ ID NO: 849464 - RNA, 19 nt, Homo sapiens
gccaguuucucccucuuca

SEQ ID NO: 849465 - RNA, 19 nt, Homo sapiens
ccucuccucuauugauuca

SEQ ID NO: 849466 - RNA, 19 nt, Homo sapiens
agcaaugcauucuaucaga

SEQ ID NO: 849467 - RNA, 19 nt, Homo sapiens
ugacuccaaccguaugauu

SEQ ID NO: 849468 - RNA, 19 nt, Homo sapiens
acacuuggcacugaacuga

SEQ ID NO: 849469 - RNA, 19 nt, Homo sapiens
agacaaaggaaaugaagag

SEQ ID NO: 849470 - RNA, 19 nt, Homo sapiens
agaggcagguaauaaaggu

SEQ ID NO: 849471 - RNA, 19 nt, Homo sapiens
gcugggugcuaccgcuguu

SEQ ID NO: 849472 - RNA, 19 nt, Homo sapiens
gacacuaggaccagucugu

SEQ ID NO: 849473 - RNA, 19 nt, Homo sapiens
gaauccaacacguccaaca

SEQ ID NO: 849474 - RNA, 19 nt, Homo sapiens
gcgacgacgccuaucucua

SEQ ID NO: 849475 - RNA, 19 nt, Homo sapiens
ugauucaguuguuauugca

SEQ ID NO: 849476 - RNA, 19 nt, Homo sapiens
gacgacgccuaucucuaca

SEQ ID NO: 849477 - RNA, 19 nt, Homo sapiens
cagagacaaaggaaaugaa

SEQ ID NO: 849478 - RNA, 19 nt, Homo sapiens
ccagcuuccaguugccuua

SEQ ID NO: 849479 - RNA, 19 nt, Homo sapiens
ccagugguaacgccugauu

SEQ ID NO: 849480 - RNA, 19 nt, Homo sapiens
gacaaaggaaaugaagaga

SEQ ID NO: 849481 - RNA, 19 nt, Homo sapiens
aagcaccaccuuacccauu

SEQ ID NO: 849482 - RNA, 19 nt, Homo sapiens
uccaacacguccaacacuu

SEQ ID NO: 849483 - RNA, 19 nt, Homo sapiens
ucagaggcagguaauaaag

SEQ ID NO: 849484 - RNA, 19 nt, Homo sapiens
ugguagcuaugccaucuuc

SEQ ID NO: 849485 - RNA, 19 nt, Homo sapiens
acagagacaaaggaaauga

SEQ ID NO: 849486 - RNA, 19 nt, Homo sapiens
gaaggcccuggaaggagaa

SEQ ID NO: 849487 - RNA, 19 nt, Homo sapiens
ggaaaucgcuguguuguua

SEQ ID NO: 849488 - RNA, 19 nt, Homo sapiens
gaauauagcuuaugaacac

SEQ ID NO: 849489 - RNA, 19 nt, Homo sapiens
cagaaacacuguaggagua

SEQ ID NO: 849490 - RNA, 19 nt, Homo sapiens
uauagaaggucccagauuu

SEQ ID NO: 849491 - RNA, 19 nt, Homo sapiens
gauaaagaguugcuguuga

SEQ ID NO: 849492 - RNA, 19 nt, Homo sapiens
ggacauuguucuccacaga

SEQ ID NO: 849493 - RNA, 19 nt, Homo sapiens
gcacaacaauggccacaca

SEQ ID NO: 849494 - RNA, 19 nt, Homo sapiens
gcaaagaggcagcaagaga

SEQ ID NO: 849495 - RNA, 19 nt, Homo sapiens
caagcaggauccucguaua

SEQ ID NO: 849496 - RNA, 19 nt, Homo sapiens
cuagaaagauucggaagaa

SEQ ID NO: 849497 - RNA, 19 nt, Homo sapiens
guaagcagauguccuccuu

SEQ ID NO: 849498 - RNA, 19 nt, Homo sapiens
ggucaacacuggacguaug

SEQ ID NO: 849499 - RNA, 19 nt, Homo sapiens
auaaagaguugcuguugaa

SEQ ID NO: 849500 - RNA, 19 nt, Homo sapiens
ggucuuugcuucuuucauc

SEQ ID NO: 849501 - RNA, 19 nt, Homo sapiens
caacagugaagccacauuu

SEQ ID NO: 849502 - RNA, 19 nt, Homo sapiens
uugcagagcuccacauugu

SEQ ID NO: 849503 - RNA, 19 nt, Homo sapiens
aagaguugcuguugaaguu

SEQ ID NO: 849504 - RNA, 19 nt, Homo sapiens
ccucuaagcuucugguaca

SEQ ID NO: 849505 - RNA, 19 nt, Homo sapiens
gaaggucccagauuucaau

SEQ ID NO: 849506 - RNA, 19 nt, Homo sapiens
gacagacagugugacauuu

SEQ ID NO: 849507 - RNA, 19 nt, Homo sapiens
uacaauggcucgcucacaa

SEQ ID NO: 849508 - RNA, 19 nt, Homo sapiens
agacagagacagcaagaaa

SEQ ID NO: 849509 - RNA, 19 nt, Homo sapiens
gcauaaauuccuucucaga

SEQ ID NO: 849510 - RNA, 19 nt, Homo sapiens
ggauaaagaguugcuguug

SEQ ID NO: 849511 - RNA, 19 nt, Homo sapiens
aggcauaaauuccuucuca

SEQ ID NO: 849512 - RNA, 19 nt, Homo sapiens
agagggagauaaagagaga

SEQ ID NO: 849513 - RNA, 19 nt, Homo sapiens
gcauggucuuugcuucuuu

SEQ ID NO: 849514 - RNA, 19 nt, Homo sapiens
gugccucccuucaaccuaa

SEQ ID NO: 849515 - RNA, 19 nt, Homo sapiens
gggcaaagaggcagcaaga

SEQ ID NO: 849516 - RNA, 19 nt, Homo sapiens
gcagagauaaauacacuca

SEQ ID NO: 849517 - RNA, 19 nt, Homo sapiens
uaaauuccuucucagauac

SEQ ID NO: 849518 - RNA, 19 nt, Homo sapiens
gaagucaggcauaaagauc

SEQ ID NO: 849519 - RNA, 19 nt, Homo sapiens
ggucagaacaccagaucaa

SEQ ID NO: 849520 - RNA, 19 nt, Homo sapiens
gaaaucgcuguguuguuaa

SEQ ID NO: 849521 - RNA, 19 nt, Homo sapiens
ggucccagauuucaaugga

SEQ ID NO: 849522 - RNA, 19 nt, Homo sapiens
caaagaggcagcaagagau

SEQ ID NO: 849523 - RNA, 19 nt, Homo sapiens
cagacagugugacauuuga

SEQ ID NO: 849524 - RNA, 19 nt, Homo sapiens
gagucuagguguaggaauc

SEQ ID NO: 849525 - RNA, 19 nt, Homo sapiens
ccaaacagcuggggcagua

SEQ ID NO: 849526 - RNA, 19 nt, Homo sapiens
ccaaacauguaggaggaaa

SEQ ID NO: 849527 - RNA, 19 nt, Homo sapiens
gaaagauucggaagaagag

SEQ ID NO: 849528 - RNA, 19 nt, Homo sapiens
gcaggauccucguauacca

SEQ ID NO: 849529 - RNA, 19 nt, Homo sapiens
gcagagggagauaaagaga

SEQ ID NO: 849530 - RNA, 19 nt, Homo sapiens
gggugagacuaagaauaua

SEQ ID NO: 849531 - RNA, 19 nt, Homo sapiens
ucuccuggcuguuuauuuc

SEQ ID NO: 849532 - RNA, 19 nt, Homo sapiens
caugauacccuacugaaca

SEQ ID NO: 849533 - RNA, 19 nt, Homo sapiens
gauccagaaacccaugaua

SEQ ID NO: 849534 - RNA, 19 nt, Homo sapiens
gaacacauucugagucacu

SEQ ID NO: 849535 - RNA, 19 nt, Homo sapiens
agacagacagugugacauu

SEQ ID NO: 849536 - RNA, 19 nt, Homo sapiens
gcuccacauuguacauuau

SEQ ID NO: 849537 - RNA, 19 nt, Homo sapiens
ccaucgauauucagacaga

SEQ ID NO: 849538 - RNA, 19 nt, Homo sapiens
gcccaucgauauucagaca

SEQ ID NO: 849539 - RNA, 19 nt, Homo sapiens
ccauggauguggaugacuu

SEQ ID NO: 849540 - RNA, 19 nt, Homo sapiens
ggugaaaugcugagucuag

SEQ ID NO: 849541 - RNA, 19 nt, Homo sapiens
agugugcucuggacaguuu

SEQ ID NO: 849542 - RNA, 19 nt, Homo sapiens
ggaagaagaggcuggaaaa

SEQ ID NO: 849543 - RNA, 19 nt, Homo sapiens
agaaagauucggaagaaga

SEQ ID NO: 849544 - RNA, 19 nt, Homo sapiens
gcagagcuccacauuguac

SEQ ID NO: 849545 - RNA, 19 nt, Homo sapiens
aagcagagauaaauacacu

SEQ ID NO: 849546 - RNA, 19 nt, Homo sapiens
gcuagaaagauucggaaga

SEQ ID NO: 849547 - RNA, 19 nt, Homo sapiens
gggcaguacuuccgcuaca

SEQ ID NO: 849548 - RNA, 19 nt, Homo sapiens
ugggugagacuaagaauau

SEQ ID NO: 849549 - RNA, 19 nt, Homo sapiens
gacauuugacccugauuug

SEQ ID NO: 849550 - RNA, 19 nt, Homo sapiens
cagcacaagccacgacuga

SEQ ID NO: 849551 - RNA, 19 nt, Homo sapiens
gcuguuuauuucauugcua

SEQ ID NO: 849552 - RNA, 19 nt, Homo sapiens
uuaugacucugauuccuau

SEQ ID NO: 849553 - RNA, 19 nt, Homo sapiens
gaguugcuguugaaguugu

SEQ ID NO: 849554 - RNA, 19 nt, Homo sapiens
ggucuucaccucagcacaa

SEQ ID NO: 849555 - RNA, 19 nt, Homo sapiens
caggugaaaugcugagucu

SEQ ID NO: 849556 - RNA, 19 nt, Homo sapiens
ugacauuugacccugauuu

SEQ ID NO: 849557 - RNA, 19 nt, Homo sapiens
cauuguacauuaugacucu

SEQ ID NO: 849558 - RNA, 19 nt, Homo sapiens
gaaaagcagagauaaauac

SEQ ID NO: 849559 - RNA, 19 nt, Homo sapiens
ugcaugaagucaggcauaa

SEQ ID NO: 849560 - RNA, 19 nt, Homo sapiens
guccugggcauccuaauug

SEQ ID NO: 849561 - RNA, 19 nt, Homo sapiens
gacccaggcugucauucca

SEQ ID NO: 849562 - RNA, 19 nt, Homo sapiens
cauaaauuccuucucagau

SEQ ID NO: 849563 - RNA, 19 nt, Homo sapiens
aaagagagagggcaaagag

SEQ ID NO: 849564 - RNA, 19 nt, Homo sapiens
aacaccagaucaacaguga

SEQ ID NO: 849565 - RNA, 19 nt, Homo sapiens
aaagaggcagcaagagauu

SEQ ID NO: 849566 - RNA, 19 nt, Homo sapiens
gaauggacccaggcuguca

SEQ ID NO: 849567 - RNA, 19 nt, Homo sapiens
aaacacuguaggaguagua

SEQ ID NO: 849568 - RNA, 19 nt, Homo sapiens
guauaccacaggugaaaug

SEQ ID NO: 849569 - RNA, 19 nt, Homo sapiens
ggacuuccccgaaaauaug

SEQ ID NO: 849570 - RNA, 19 nt, Homo sapiens
acugcgggaucucuccuua

SEQ ID NO: 849571 - RNA, 19 nt, Homo sapiens
gaggaaaucgcuguguugu

SEQ ID NO: 849572 - RNA, 19 nt, Homo sapiens
gauaaagagagagggcaaa

SEQ ID NO: 849573 - RNA, 19 nt, Homo sapiens
gaaacacuguaggaguagu

SEQ ID NO: 849574 - RNA, 19 nt, Homo sapiens
ucaggaagccucuaaaaug

SEQ ID NO: 849575 - RNA, 19 nt, Homo sapiens
ccaagcaggauccucguau

SEQ ID NO: 849576 - RNA, 19 nt, Homo sapiens
gcaguacuuccgcuacaau

SEQ ID NO: 849577 - RNA, 19 nt, Homo sapiens
gcacuggggucagaaagga

SEQ ID NO: 849578 - RNA, 19 nt, Homo sapiens
ugaggaaaucgcuguguug

SEQ ID NO: 849579 - RNA, 19 nt, Homo sapiens
aaacauguaggaggaaaug

SEQ ID NO: 849580 - RNA, 19 nt, Homo sapiens
ggccagaaacacuguagga

SEQ ID NO: 849581 - RNA, 19 nt, Homo sapiens
ucucagauaccauggaugu

SEQ ID NO: 849582 - RNA, 19 nt, Homo sapiens
ccacgacugaggcauaaau

SEQ ID NO: 849583 - RNA, 19 nt, Homo sapiens
caagaaaagcagagauaaa

SEQ ID NO: 849584 - RNA, 19 nt, Homo sapiens
cuuuggaccugcacaacaa

SEQ ID NO: 849585 - RNA, 19 nt, Homo sapiens
gcaagaaaagcagagauaa

SEQ ID NO: 849586 - RNA, 19 nt, Homo sapiens
ggcccuuucccuagauaua

SEQ ID NO: 849587 - RNA, 19 nt, Homo sapiens
ggacuaagguaaucaauuu

SEQ ID NO: 849588 - RNA, 19 nt, Homo sapiens
gcaaauaucuucccugugu

SEQ ID NO: 849589 - RNA, 19 nt, Homo sapiens
gaagcuugcuggacuauuu

SEQ ID NO: 849590 - RNA, 19 nt, Homo sapiens
gaaagacaauuaucgaaug

SEQ ID NO: 849591 - RNA, 19 nt, Homo sapiens
gcccagaccucuuuaguuu

SEQ ID NO: 849592 - RNA, 19 nt, Homo sapiens
gaagaacugucugucauuu

SEQ ID NO: 849593 - RNA, 19 nt, Homo sapiens
ggaaacugcucuccaaaga

SEQ ID NO: 849594 - RNA, 19 nt, Homo sapiens
gcacaaugauuacaaagug

SEQ ID NO: 849595 - RNA, 19 nt, Homo sapiens
ugaagaagcugccauguuc

SEQ ID NO: 849596 - RNA, 19 nt, Homo sapiens
caacagggcucaaauacag

SEQ ID NO: 849597 - RNA, 19 nt, Homo sapiens
gaagaaaugagacgaagaa

SEQ ID NO: 849598 - RNA, 19 nt, Homo sapiens
ggccauugaucuugaauuu

SEQ ID NO: 849599 - RNA, 19 nt, Homo sapiens
uuauagagcugcuuaauuc

SEQ ID NO: 849600 - RNA, 19 nt, Homo sapiens
caagagagaugguggagau

SEQ ID NO: 849601 - RNA, 19 nt, Homo sapiens
gaaaugagacgaagaagag

SEQ ID NO: 849602 - RNA, 19 nt, Homo sapiens
gaauuacgguagugcauug

SEQ ID NO: 849603 - RNA, 19 nt, Homo sapiens
gaagauccaggcagucaua

SEQ ID NO: 849604 - RNA, 19 nt, Homo sapiens
gaaugaagagcuauaagaa

SEQ ID NO: 849605 - RNA, 19 nt, Homo sapiens
aaacauagcuggagauagc

SEQ ID NO: 849606 - RNA, 19 nt, Homo sapiens
ccucuccuauuaucuauua

SEQ ID NO: 849607 - RNA, 19 nt, Homo sapiens
guaaucaauuugcaccuuu

SEQ ID NO: 849608 - RNA, 19 nt, Homo sapiens
gagauuacgucuugaacug

SEQ ID NO: 849609 - RNA, 19 nt, Homo sapiens
gaagaggaaugagaauugu

SEQ ID NO: 849610 - RNA, 19 nt, Homo sapiens
gaaauguggagcugauuaa

SEQ ID NO: 849611 - RNA, 19 nt, Homo sapiens
caaaggaggacuaagguaa

SEQ ID NO: 849612 - RNA, 19 nt, Homo sapiens
gaagcugccugggcucuaa

SEQ ID NO: 849613 - RNA, 19 nt, Homo sapiens
uuagguaggucaaucuuaa

SEQ ID NO: 849614 - RNA, 19 nt, Homo sapiens
ggagugagagugucaugua

SEQ ID NO: 849615 - RNA, 19 nt, Homo sapiens
guaauggauucgaagauug

SEQ ID NO: 849616 - RNA, 19 nt, Homo sapiens
ggagaaauguggagcugau

SEQ ID NO: 849617 - RNA, 19 nt, Homo sapiens
ugaagugucucaaguauac

SEQ ID NO: 849618 - RNA, 19 nt, Homo sapiens
ucuaaacccugaagaaaug

SEQ ID NO: 849619 - RNA, 19 nt, Homo sapiens
gacccaacuucauuuguuu

SEQ ID NO: 849620 - RNA, 19 nt, Homo sapiens
ggaaagacaauuaucgaau

SEQ ID NO: 849621 - RNA, 19 nt, Homo sapiens
ggccugagcuugguccuuu

SEQ ID NO: 849622 - RNA, 19 nt, Homo sapiens
gaagagcuauaagaacaau

SEQ ID NO: 849623 - RNA, 19 nt, Homo sapiens
gcaaguggcccucaaugga

SEQ ID NO: 849624 - RNA, 19 nt, Homo sapiens
gaacauccugcuuguauca

SEQ ID NO: 849625 - RNA, 19 nt, Homo sapiens
cgacccaacuucauuuguu

SEQ ID NO: 849626 - RNA, 19 nt, Homo sapiens
gaugcacaaugauuacaaa

SEQ ID NO: 849627 - RNA, 19 nt, Homo sapiens
gugagagugucauguauug

SEQ ID NO: 849628 - RNA, 19 nt, Homo sapiens
aaacccagcugccugcauu

SEQ ID NO: 849629 - RNA, 19 nt, Homo sapiens
ggaaacauagcuggagaua

SEQ ID NO: 849630 - RNA, 19 nt, Homo sapiens
uugcguaucuucccuguuu

SEQ ID NO: 849631 - RNA, 19 nt, Homo sapiens
uaauuggucucaagaggaa

SEQ ID NO: 849632 - RNA, 19 nt, Homo sapiens
cauccuuaauccuuuguua

SEQ ID NO: 849633 - RNA, 19 nt, Homo sapiens
uaguaaagcccaccuguuu

SEQ ID NO: 849634 - RNA, 19 nt, Homo sapiens
gaucgaaauccuucagaaa

SEQ ID NO: 849635 - RNA, 19 nt, Homo sapiens
uaaaggagagaaugucaaa

SEQ ID NO: 849636 - RNA, 19 nt, Homo sapiens
uaagaacaaugcucuaaac

SEQ ID NO: 849637 - RNA, 19 nt, Homo sapiens
gcucaggggucaauccuua

SEQ ID NO: 849638 - RNA, 19 nt, Homo sapiens
gaagcugccauguucgaua

SEQ ID NO: 849639 - RNA, 19 nt, Homo sapiens
ccagaugccucuucuuucu

SEQ ID NO: 849640 - RNA, 19 nt, Homo sapiens
ggaagaacugucugucauu

SEQ ID NO: 849641 - RNA, 19 nt, Homo sapiens
gaaguuaucaacacuccaa

SEQ ID NO: 849642 - RNA, 19 nt, Homo sapiens
guucagguacuuauuauug

SEQ ID NO: 849643 - RNA, 19 nt, Homo sapiens
cuacucaccuuccaaaugg

SEQ ID NO: 849644 - RNA, 19 nt, Homo sapiens
gagcacaggccuucagaug

SEQ ID NO: 849645 - RNA, 19 nt, Homo sapiens
accauucucuuacaguuua

SEQ ID NO: 849646 - RNA, 19 nt, Homo sapiens
ucaauggacuggagaacau

SEQ ID NO: 849647 - RNA, 19 nt, Homo sapiens
gcccagggaaagacaauua

SEQ ID NO: 849648 - RNA, 19 nt, Homo sapiens
gaagcgagagcaacaacuu

SEQ ID NO: 849649 - RNA, 19 nt, Homo sapiens
gaagcaguuugccuuguca

SEQ ID NO: 849650 - RNA, 19 nt, Homo sapiens
gggcugugguccuuccuuu

SEQ ID NO: 849651 - RNA, 19 nt, Homo sapiens
gcucuaaacccugaagaaa

SEQ ID NO: 849652 - RNA, 19 nt, Homo sapiens
gauuacgucuugaacuguu

SEQ ID NO: 849653 - RNA, 19 nt, Homo sapiens
cgaaugaagagcuauaaga

SEQ ID NO: 849654 - RNA, 19 nt, Homo sapiens
uaacacuccuuaccaaguc

SEQ ID NO: 849655 - RNA, 19 nt, Homo sapiens
aaaccauucucuuacaguu

SEQ ID NO: 849656 - RNA, 19 nt, Homo sapiens
gcuuauagaccuaaaguuc

SEQ ID NO: 849657 - RNA, 19 nt, Homo sapiens
gagugagagugucauguau

SEQ ID NO: 849658 - RNA, 19 nt, Homo sapiens
uguaauggauucgaagauu

SEQ ID NO: 849659 - RNA, 19 nt, Homo sapiens
ucacugggcugcaucaaac

SEQ ID NO: 849660 - RNA, 19 nt, Homo sapiens
ugaagaggaaugagaauug

SEQ ID NO: 849661 - RNA, 19 nt, Homo sapiens
uccaauagaugaaguuauc

SEQ ID NO: 849662 - RNA, 19 nt, Homo sapiens
ccauugaucuugaauuugc

SEQ ID NO: 849663 - RNA, 19 nt, Homo sapiens
ccagaccucuuuaguuugg

SEQ ID NO: 849664 - RNA, 19 nt, Homo sapiens
gcugggcccuuucuuaucu

SEQ ID NO: 849665 - RNA, 19 nt, Homo sapiens
acacagaaauuccggaaac

SEQ ID NO: 849666 - RNA, 19 nt, Homo sapiens
ggagcugauuaaugaagaa

SEQ ID NO: 849667 - RNA, 19 nt, Homo sapiens
aaacuuaguagccugcuuu

SEQ ID NO: 849668 - RNA, 19 nt, Homo sapiens
gaggcuaccaugaaacaaa

SEQ ID NO: 849669 - RNA, 19 nt, Homo sapiens
gguaaucaauuugcaccuu

SEQ ID NO: 849670 - RNA, 19 nt, Homo sapiens
acugaaagcugccgcugaa

SEQ ID NO: 849671 - RNA, 19 nt, Homo sapiens
auguggagcugauuaauga

SEQ ID NO: 849672 - RNA, 19 nt, Homo sapiens
gcauucagcuccggaagca

SEQ ID NO: 849673 - RNA, 19 nt, Homo sapiens
cuggguggauuacauauga

SEQ ID NO: 849674 - RNA, 19 nt, Homo sapiens
acgcuuggauugaguuauu

SEQ ID NO: 849675 - RNA, 19 nt, Homo sapiens
gagaugcucuuuucugaug

SEQ ID NO: 849676 - RNA, 19 nt, Homo sapiens
agaaauguggagcugauua

SEQ ID NO: 849677 - RNA, 19 nt, Homo sapiens
ccugaagugucucaaguau

SEQ ID NO: 849678 - RNA, 19 nt, Homo sapiens
ugacuguaauggauucgaa

SEQ ID NO: 849679 - RNA, 19 nt, Homo sapiens
guuccauccuuaauccuuu

SEQ ID NO: 849680 - RNA, 19 nt, Homo sapiens
uagagcugcuuaauucaga

SEQ ID NO: 849681 - RNA, 19 nt, Homo sapiens
ugaaauccaugcccuucug

SEQ ID NO: 849682 - RNA, 19 nt, Homo sapiens
guagugcauugccuuagug

SEQ ID NO: 849683 - RNA, 19 nt, Homo sapiens
gaaacuuaguagccugcuu

SEQ ID NO: 849684 - RNA, 19 nt, Homo sapiens
gcucuggaaccuucauaaa

SEQ ID NO: 849685 - RNA, 19 nt, Homo sapiens
cuguguaacucuuaucuug

SEQ ID NO: 849686 - RNA, 19 nt, Homo sapiens
augaagagcuauaagaaca

SEQ ID NO: 849687 - RNA, 19 nt, Homo sapiens
gaacucagauguuaugguu

SEQ ID NO: 849688 - RNA, 19 nt, Homo sapiens
gaaagagaauguacuguau

SEQ ID NO: 849689 - RNA, 19 nt, Homo sapiens
gaaguuagcacucuacgua

SEQ ID NO: 849690 - RNA, 19 nt, Homo sapiens
gagaaugacuccuccaaga

SEQ ID NO: 849691 - RNA, 19 nt, Homo sapiens
caacaaggacauccaaaua

SEQ ID NO: 849692 - RNA, 19 nt, Homo sapiens
ggaaagagaauguacugua

SEQ ID NO: 849693 - RNA, 19 nt, Homo sapiens
ucacaugaauggcucuuua

SEQ ID NO: 849694 - RNA, 19 nt, Homo sapiens
caugacaucuuaaguagaa

SEQ ID NO: 849695 - RNA, 19 nt, Homo sapiens
gaagaaagcggguccagau

SEQ ID NO: 849696 - RNA, 19 nt, Homo sapiens
ggagauauggacaguauuu

SEQ ID NO: 849697 - RNA, 19 nt, Homo sapiens
ggaccuaacagaccuaauu

SEQ ID NO: 849698 - RNA, 19 nt, Homo sapiens
gcaaaagccuuccaugauu

SEQ ID NO: 849699 - RNA, 19 nt, Homo sapiens
caacaaaugccaauucaau

SEQ ID NO: 849700 - RNA, 19 nt, Homo sapiens
ggaaccaccaggauucuua

SEQ ID NO: 849701 - RNA, 19 nt, Homo sapiens
guauaugucugcaaucaug

SEQ ID NO: 849702 - RNA, 19 nt, Homo sapiens
caagaauucucccaauaau

SEQ ID NO: 849703 - RNA, 19 nt, Homo sapiens
gacaguauuuccaagaauu

SEQ ID NO: 849704 - RNA, 19 nt, Homo sapiens
gcucagaaaucagcucaaa

SEQ ID NO: 849705 - RNA, 19 nt, Homo sapiens
ggaguggcauauuagaauu

SEQ ID NO: 849706 - RNA, 19 nt, Homo sapiens
gaaagcggguccagaugug

SEQ ID NO: 849707 - RNA, 19 nt, Homo sapiens
ccaagaauucucccaauaa

SEQ ID NO: 849708 - RNA, 19 nt, Homo sapiens
ccaccaggauucuuacauu

SEQ ID NO: 849709 - RNA, 19 nt, Homo sapiens
ggaauggagucacaucaca

SEQ ID NO: 849710 - RNA, 19 nt, Homo sapiens
caaaagccuuccaugauua

SEQ ID NO: 849711 - RNA, 19 nt, Homo sapiens
aaggugaacucagauguua

SEQ ID NO: 849712 - RNA, 19 nt, Homo sapiens
gagaauguacuguauaugu

SEQ ID NO: 849713 - RNA, 19 nt, Homo sapiens
caggagauauggacaguau

SEQ ID NO: 849714 - RNA, 19 nt, Homo sapiens
ggagucacaucacaugaau

SEQ ID NO: 849715 - RNA, 19 nt, Homo sapiens
cagcaucuccugggaauua

SEQ ID NO: 849716 - RNA, 19 nt, Homo sapiens
ggacaguauuuccaagaau

SEQ ID NO: 849717 - RNA, 19 nt, Homo sapiens
gcccuaaacugaacugcaa

SEQ ID NO: 849718 - RNA, 19 nt, Homo sapiens
acaaggacauccaaauaug

SEQ ID NO: 849719 - RNA, 19 nt, Homo sapiens
gcaaucauggauaggaaua

SEQ ID NO: 849720 - RNA, 19 nt, Homo sapiens
gaaucucagucacaccaaa

SEQ ID NO: 849721 - RNA, 19 nt, Homo sapiens
uguaggagcucagaaauca

SEQ ID NO: 849722 - RNA, 19 nt, Homo sapiens
uguacggaguggcauauua

SEQ ID NO: 849723 - RNA, 19 nt, Homo sapiens
ggugauaacauguauacuu

SEQ ID NO: 849724 - RNA, 19 nt, Homo sapiens
caacucuggugauaacaug

SEQ ID NO: 849725 - RNA, 19 nt, Homo sapiens
ggauccaacucgacaacaa

SEQ ID NO: 849726 - RNA, 19 nt, Homo sapiens
uccaagaauucucccaaua

SEQ ID NO: 849727 - RNA, 19 nt, Homo sapiens
agagagacgugaaacaugu

SEQ ID NO: 849728 - RNA, 19 nt, Homo sapiens
ucaucacaguguacaguua

SEQ ID NO: 849729 - RNA, 19 nt, Homo sapiens
uaccaagucuccucaugaa

SEQ ID NO: 849730 - RNA, 19 nt, Homo sapiens
uagaauugcccuaaacuga

SEQ ID NO: 849731 - RNA, 19 nt, Homo sapiens
gggagaaguuagcacucua

SEQ ID NO: 849732 - RNA, 19 nt, Homo sapiens
gaauaucugcuccauguag

SEQ ID NO: 849733 - RNA, 19 nt, Homo sapiens
cacaugacaucuuaaguag

SEQ ID NO: 849734 - RNA, 19 nt, Homo sapiens
aauaugagccugaguaauc

SEQ ID NO: 849735 - RNA, 19 nt, Homo sapiens
gaccuaacagaccuaauuu

SEQ ID NO: 849736 - RNA, 19 nt, Homo sapiens
cacaggacauuguaaaaua

SEQ ID NO: 849737 - RNA, 19 nt, Homo sapiens
gaauugcccuaaacugaac

SEQ ID NO: 849738 - RNA, 19 nt, Homo sapiens
gaacuauggaggugcaaug

SEQ ID NO: 849739 - RNA, 19 nt, Homo sapiens
agaaaucagcucaaacauu

SEQ ID NO: 849740 - RNA, 19 nt, Homo sapiens
cuauggaggugcaaugaga

SEQ ID NO: 849741 - RNA, 19 nt, Homo sapiens
augaauaucugcuccaugu

SEQ ID NO: 849742 - RNA, 19 nt, Homo sapiens
ucagaaaucagcucaaaca

SEQ ID NO: 849743 - RNA, 19 nt, Homo sapiens
cccaggaagucagccauua

SEQ ID NO: 849744 - RNA, 19 nt, Homo sapiens
ccaggauucuuacauucuu

SEQ ID NO: 849745 - RNA, 19 nt, Homo sapiens
agaauguacuguauaugug

SEQ ID NO: 849746 - RNA, 19 nt, Homo sapiens
gaacuacuacggaagaaaa

SEQ ID NO: 849747 - RNA, 19 nt, Homo sapiens
aauaauaugagccugagua

SEQ ID NO: 849748 - RNA, 19 nt, Homo sapiens
aguuagcacucuacguaua

SEQ ID NO: 849749 - RNA, 19 nt, Homo sapiens
gaauguacuguauaugugu

SEQ ID NO: 849750 - RNA, 19 nt, Homo sapiens
caaaggaaucucagucaca

SEQ ID NO: 849751 - RNA, 19 nt, Homo sapiens
gccaguagguccuguacca

SEQ ID NO: 849752 - RNA, 19 nt, Homo sapiens
aaaccaaccuuuucauuuc

SEQ ID NO: 849753 - RNA, 19 nt, Homo sapiens
caucacaguguacaguuaa

SEQ ID NO: 849754 - RNA, 19 nt, Homo sapiens
ugagucagcccuucacaga

SEQ ID NO: 849755 - RNA, 19 nt, Homo sapiens
guacggaguggcauauuag

SEQ ID NO: 849756 - RNA, 19 nt, Homo sapiens
ucuuuaggcucaggagaua

SEQ ID NO: 849757 - RNA, 19 nt, Homo sapiens
ggugaacucagauguuaug

SEQ ID NO: 849758 - RNA, 19 nt, Homo sapiens
caaaccaaccuuuucauuu

SEQ ID NO: 849759 - RNA, 19 nt, Homo sapiens
ucagagauaagaugggaaa

SEQ ID NO: 849760 - RNA, 19 nt, Homo sapiens
ccaauucaauaccauacuc

SEQ ID NO: 849761 - RNA, 19 nt, Homo sapiens
caccaggauucuuacauuc

SEQ ID NO: 849762 - RNA, 19 nt, Homo sapiens
cauugaggauaccuaauca

SEQ ID NO: 849763 - RNA, 19 nt, Homo sapiens
cccaacaaaugccaauuca

SEQ ID NO: 849764 - RNA, 19 nt, Homo sapiens
guccagaugugauucaaac

SEQ ID NO: 849765 - RNA, 19 nt, Homo sapiens
gcccuucacagaacuacua

SEQ ID NO: 849766 - RNA, 19 nt, Homo sapiens
ucccauggguggauuagga

SEQ ID NO: 849767 - RNA, 19 nt, Homo sapiens
ccauguaggagcucagaaa

SEQ ID NO: 849768 - RNA, 19 nt, Homo sapiens
aaauaugggugggccaaug

SEQ ID NO: 849769 - RNA, 19 nt, Homo sapiens
ccaguccagugcuaggaaa

SEQ ID NO: 849770 - RNA, 19 nt, Homo sapiens
uaaggugaacucagauguu

SEQ ID NO: 849771 - RNA, 19 nt, Homo sapiens
gcacucuacguauaugaau

SEQ ID NO: 849772 - RNA, 19 nt, Homo sapiens
agaauugcccuaaacugaa

SEQ ID NO: 849773 - RNA, 19 nt, Homo sapiens
gaggaauggugcccuuagg

SEQ ID NO: 849774 - RNA, 19 nt, Homo sapiens
gggccaaugcagagaauga

SEQ ID NO: 849775 - RNA, 19 nt, Homo sapiens
ccagaugugauucaaacaa

SEQ ID NO: 849776 - RNA, 19 nt, Homo sapiens
cacucuacguauaugaaua

SEQ ID NO: 849777 - RNA, 19 nt, Homo sapiens
acagacauauacacauaca

SEQ ID NO: 849778 - RNA, 19 nt, Homo sapiens
uaacagaccuaauuuucca

SEQ ID NO: 849779 - RNA, 19 nt, Homo sapiens
uggaaugccuggaaugaac

SEQ ID NO: 849780 - RNA, 19 nt, Homo sapiens
cuguguauaucacugcuuu

SEQ ID NO: 849781 - RNA, 19 nt, Homo sapiens
cagaugugauucaaacaac

SEQ ID NO: 849782 - RNA, 19 nt, Homo sapiens
aacaaggacauccaaauau

SEQ ID NO: 849783 - RNA, 19 nt, Homo sapiens
ucgcuuauuugagagcuuu

SEQ ID NO: 849784 - RNA, 19 nt, Homo sapiens
ugucugcaaucauggauag

SEQ ID NO: 849785 - RNA, 19 nt, Homo sapiens
ccagagagacgugaaacau

SEQ ID NO: 849786 - RNA, 19 nt, Homo sapiens
ggcaaaggcaagaguaaca

SEQ ID NO: 849787 - RNA, 19 nt, Homo sapiens
gaacagagcgggaucaaga

SEQ ID NO: 849788 - RNA, 19 nt, Homo sapiens
gagaagagguaagcgguua

SEQ ID NO: 849789 - RNA, 19 nt, Homo sapiens
gaucaagaauuucacagaa

SEQ ID NO: 849790 - RNA, 19 nt, Homo sapiens
agacuuggcucggaacuua

SEQ ID NO: 849791 - RNA, 19 nt, Homo sapiens
ggagacagcagccuaguuu

SEQ ID NO: 849792 - RNA, 19 nt, Homo sapiens
gagcgcagcuuccggauca

SEQ ID NO: 849793 - RNA, 19 nt, Homo sapiens
caaccucacuaaugccaua

SEQ ID NO: 849794 - RNA, 19 nt, Homo sapiens
uaacgucaguccacagaaa

SEQ ID NO: 849795 - RNA, 19 nt, Homo sapiens
gcuguuagauugugaguuc

SEQ ID NO: 849796 - RNA, 19 nt, Homo sapiens
gaaaggcaguuggagaaga

SEQ ID NO: 849797 - RNA, 19 nt, Homo sapiens
gcacuggaggguuuaauuu

SEQ ID NO: 849798 - RNA, 19 nt, Homo sapiens
ccaagcaucuuuuguauuu

SEQ ID NO: 849799 - RNA, 19 nt, Homo sapiens
gagaagugcugauggucuu

SEQ ID NO: 849800 - RNA, 19 nt, Homo sapiens
uaagagaaccuccaaguca

SEQ ID NO: 849801 - RNA, 19 nt, Homo sapiens
gcagcaaccucacuaaugc

SEQ ID NO: 849802 - RNA, 19 nt, Homo sapiens
ucaagaauuucacagaaga

SEQ ID NO: 849803 - RNA, 19 nt, Homo sapiens
caugaucgcugugugcuuu

SEQ ID NO: 849804 - RNA, 19 nt, Homo sapiens
gccaugagcggguuuaauu

SEQ ID NO: 849805 - RNA, 19 nt, Homo sapiens
gcagagacccacugucguu

SEQ ID NO: 849806 - RNA, 19 nt, Homo sapiens
agagcgggaucaagaauuu

SEQ ID NO: 849807 - RNA, 19 nt, Homo sapiens
ccuacaagcuggcugagaa

SEQ ID NO: 849808 - RNA, 19 nt, Homo sapiens
ggcuuugccuugaauuuaa

SEQ ID NO: 849809 - RNA, 19 nt, Homo sapiens
gcaacaaccacaccugcua

SEQ ID NO: 849810 - RNA, 19 nt, Homo sapiens
ggacgccugugaucucaau

SEQ ID NO: 849811 - RNA, 19 nt, Homo sapiens
ggccucggcugaagaaaga

SEQ ID NO: 849812 - RNA, 19 nt, Homo sapiens
gaacaaugaagcccagugu

SEQ ID NO: 849813 - RNA, 19 nt, Homo sapiens
ccuguaaucucagcacuuu

SEQ ID NO: 849814 - RNA, 19 nt, Homo sapiens
acaaugaagcccaguguaa

SEQ ID NO: 849815 - RNA, 19 nt, Homo sapiens
gggaaaggcaguuggagaa

SEQ ID NO: 849816 - RNA, 19 nt, Homo sapiens
gagcagagcgggaccaucu

SEQ ID NO: 849817 - RNA, 19 nt, Homo sapiens
guuaugcuauccugugcua

SEQ ID NO: 849818 - RNA, 19 nt, Homo sapiens
ugacugcccuugacaugau

SEQ ID NO: 849819 - RNA, 19 nt, Homo sapiens
gcacgcugaucgagaaugg

SEQ ID NO: 849820 - RNA, 19 nt, Homo sapiens
ggcagaagcuagcgguugu

SEQ ID NO: 849821 - RNA, 19 nt, Homo sapiens
gcaggagaaucacuugaac

SEQ ID NO: 849822 - RNA, 19 nt, Homo sapiens
gcaaagacggcaacaacca

SEQ ID NO: 849823 - RNA, 19 nt, Homo sapiens
ugaauucucugaaauaccu

SEQ ID NO: 849824 - RNA, 19 nt, Homo sapiens
ugaaagcuaaccaugcuaa

SEQ ID NO: 849825 - RNA, 19 nt, Homo sapiens
gaaaccccgucucuacuaa

SEQ ID NO: 849826 - RNA, 19 nt, Homo sapiens
gaagcuagcgguuguaucc

SEQ ID NO: 849827 - RNA, 19 nt, Homo sapiens
uaaccaugcuaaccaccaa

SEQ ID NO: 849828 - RNA, 19 nt, Homo sapiens
caagcuggcugagaacauc

SEQ ID NO: 849829 - RNA, 19 nt, Homo sapiens
uggagagccugaucaacaa

SEQ ID NO: 849830 - RNA, 19 nt, Homo sapiens
ggaucaagaauuucacaga

SEQ ID NO: 849831 - RNA, 19 nt, Homo sapiens
ucacaugacugcccuugac

SEQ ID NO: 849832 - RNA, 19 nt, Homo sapiens
gcuuugccuugaauuuaaa

SEQ ID NO: 849833 - RNA, 19 nt, Homo sapiens
ucuggaggcuucucauuca

SEQ ID NO: 849834 - RNA, 19 nt, Homo sapiens
gcugaauucucugaaauac

SEQ ID NO: 849835 - RNA, 19 nt, Homo sapiens
gguggcacuuguuaugcua

SEQ ID NO: 849836 - RNA, 19 nt, Homo sapiens
ggaaugcgcccuguugucu

SEQ ID NO: 849837 - RNA, 19 nt, Homo sapiens
uggaggaguuggucaagga

SEQ ID NO: 849838 - RNA, 19 nt, Homo sapiens
cggcuuugccuugaauuua

SEQ ID NO: 849839 - RNA, 19 nt, Homo sapiens
cccggucccugucacauuu

SEQ ID NO: 849840 - RNA, 19 nt, Homo sapiens
auacuuugcugaauucucu

SEQ ID NO: 849841 - RNA, 19 nt, Homo sapiens
guagcacccugagccugua

SEQ ID NO: 849842 - RNA, 19 nt, Homo sapiens
agugugagcuugugcuugu

SEQ ID NO: 849843 - RNA, 19 nt, Homo sapiens
caggagguguugcagugaa

SEQ ID NO: 849844 - RNA, 19 nt, Homo sapiens
caacugcuccaaccucauc

SEQ ID NO: 849845 - RNA, 19 nt, Homo sapiens
gcagcagcaaccucacuaa

SEQ ID NO: 849846 - RNA, 19 nt, Homo sapiens
gacuugaggucaggaguuc

SEQ ID NO: 849847 - RNA, 19 nt, Homo sapiens
ccggaucaccuuugacuga

SEQ ID NO: 849848 - RNA, 19 nt, Homo sapiens
ggcaggagaaucacuugaa

SEQ ID NO: 849849 - RNA, 19 nt, Homo sapiens
guaagagaaccuccaaguc

SEQ ID NO: 849850 - RNA, 19 nt, Homo sapiens
uggaggaggugaccaaggu

SEQ ID NO: 849851 - RNA, 19 nt, Homo sapiens
gauccucaaugcgcacaug

SEQ ID NO: 849852 - RNA, 19 nt, Homo sapiens
ggaccaggagcucgacuuc

SEQ ID NO: 849853 - RNA, 19 nt, Homo sapiens
cagcagcaccaccggcuuu

SEQ ID NO: 849854 - RNA, 19 nt, Homo sapiens
ccaugagcggguuuaauuu

SEQ ID NO: 849855 - RNA, 19 nt, Homo sapiens
cuuaguggcaccagaguaa

SEQ ID NO: 849856 - RNA, 19 nt, Homo sapiens
aaaggcaguuggagaagag

SEQ ID NO: 849857 - RNA, 19 nt, Homo sapiens
gcacccaccggcuuugugu

SEQ ID NO: 849858 - RNA, 19 nt, Homo sapiens
ggaacuggauuuucuuugg

SEQ ID NO: 849859 - RNA, 19 nt, Homo sapiens
gucccugucacauuuguua

SEQ ID NO: 849860 - RNA, 19 nt, Homo sapiens
caaauggagccuggagcua

SEQ ID NO: 849861 - RNA, 19 nt, Homo sapiens
ggagagccugaucaacaaa

SEQ ID NO: 849862 - RNA, 19 nt, Homo sapiens
aagcucagguggccuucuu

SEQ ID NO: 849863 - RNA, 19 nt, Homo sapiens
gcagacaccgacggauuug

SEQ ID NO: 849864 - RNA, 19 nt, Homo sapiens
ccuguugucuguaguuugg

SEQ ID NO: 849865 - RNA, 19 nt, Homo sapiens
ccaccggcuuugccuugaa

SEQ ID NO: 849866 - RNA, 19 nt, Homo sapiens
ucgucucgcuguuagauug

SEQ ID NO: 849867 - RNA, 19 nt, Homo sapiens
gcugaagaaagaagaaauc

SEQ ID NO: 849868 - RNA, 19 nt, Homo sapiens
gcccuguugucuguaguuu

SEQ ID NO: 849869 - RNA, 19 nt, Homo sapiens
gaucgagaauggagaaaag

SEQ ID NO: 849870 - RNA, 19 nt, Homo sapiens
cagccucuuugcgucaaua

SEQ ID NO: 849871 - RNA, 19 nt, Homo sapiens
gcaguuggagaagagguaa

SEQ ID NO: 849872 - RNA, 19 nt, Homo sapiens
aggcaaagcagcacagugu

SEQ ID NO: 849873 - RNA, 19 nt, Homo sapiens
gaacccaggagguguugca

SEQ ID NO: 849874 - RNA, 19 nt, Homo sapiens
cccaggaucucaaggacau

SEQ ID NO: 849875 - RNA, 19 nt, Homo sapiens
acuggacucucccucugua

SEQ ID NO: 849876 - RNA, 19 nt, Homo sapiens
ccaccggccuguucucacu

SEQ ID NO: 849877 - RNA, 19 nt, Homo sapiens
agacgacaggcuucacuuu

SEQ ID NO: 849878 - RNA, 19 nt, Homo sapiens
acaggcggguucacguuug

SEQ ID NO: 849879 - RNA, 19 nt, Homo sapiens
ugugaaagcuaaccaugcu

SEQ ID NO: 849880 - RNA, 19 nt, Homo sapiens
gcucaccccuguaaucuca

SEQ ID NO: 849881 - RNA, 19 nt, Homo sapiens
gcuuccggaucaccuuuga

SEQ ID NO: 849882 - RNA, 19 nt, Homo sapiens
ugcaguggaucgaccagaa

SEQ ID NO: 849883 - RNA, 19 nt, Homo sapiens
gcagaagcuagcgguugua

SEQ ID NO: 849884 - RNA, 19 nt, Homo sapiens
ggcacuggaggguuuaauu

SEQ ID NO: 849885 - RNA, 19 nt, Homo sapiens
aauggagccuggagcuaga

SEQ ID NO: 849886 - RNA, 19 nt, Homo sapiens
cuggagagccugaucaaca

SEQ ID NO: 849887 - RNA, 19 nt, Homo sapiens
gaacagagcgggaucaaga

SEQ ID NO: 849888 - RNA, 19 nt, Homo sapiens
gagaagagguaagcgguua

SEQ ID NO: 849889 - RNA, 19 nt, Homo sapiens
gaucaagaauuucacagaa

SEQ ID NO: 849890 - RNA, 19 nt, Homo sapiens
agacuuggcucggaacuua

SEQ ID NO: 849891 - RNA, 19 nt, Homo sapiens
ggagacagcagccuaguuu

SEQ ID NO: 849892 - RNA, 19 nt, Homo sapiens
gagcgcagcuuccggauca

SEQ ID NO: 849893 - RNA, 19 nt, Homo sapiens
caaccucacuaaugccaua

SEQ ID NO: 849894 - RNA, 19 nt, Homo sapiens
uaacgucaguccacagaaa

SEQ ID NO: 849895 - RNA, 19 nt, Homo sapiens
gcuguuagauugugaguuc

SEQ ID NO: 849896 - RNA, 19 nt, Homo sapiens
gaaaggcaguuggagaaga

SEQ ID NO: 849897 - RNA, 19 nt, Homo sapiens
gcacuggaggguuuaauuu

SEQ ID NO: 849898 - RNA, 19 nt, Homo sapiens
ccaagcaucuuuuguauuu

SEQ ID NO: 849899 - RNA, 19 nt, Homo sapiens
gagaagugcugauggucuu

SEQ ID NO: 849900 - RNA, 19 nt, Homo sapiens
uaagagaaccuccaaguca

SEQ ID NO: 849901 - RNA, 19 nt, Homo sapiens
gcagcaaccucacuaaugc

SEQ ID NO: 849902 - RNA, 19 nt, Homo sapiens
ggagagcgcaggcgugaaa

SEQ ID NO: 849903 - RNA, 19 nt, Homo sapiens
ucaagaauuucacagaaga

SEQ ID NO: 849904 - RNA, 19 nt, Homo sapiens
gaaucaagguccagagaag

SEQ ID NO: 849905 - RNA, 19 nt, Homo sapiens
caugaucgcugugugcuuu

SEQ ID NO: 849906 - RNA, 19 nt, Homo sapiens
gccaugagcggguuuaauu

SEQ ID NO: 849907 - RNA, 19 nt, Homo sapiens
gcagagacccacugucguu

SEQ ID NO: 849908 - RNA, 19 nt, Homo sapiens
agagcgggaucaagaauuu

SEQ ID NO: 849909 - RNA, 19 nt, Homo sapiens
ccuacaagcuggcugagaa

SEQ ID NO: 849910 - RNA, 19 nt, Homo sapiens
ggacaucccagcuggaguu

SEQ ID NO: 849911 - RNA, 19 nt, Homo sapiens
ggcuuugccuugaauuuaa

SEQ ID NO: 849912 - RNA, 19 nt, Homo sapiens
gcaacaaccacaccugcua

SEQ ID NO: 849913 - RNA, 19 nt, Homo sapiens
cagagaagguggaggaauc

SEQ ID NO: 849914 - RNA, 19 nt, Homo sapiens
ggccucggcugaagaaaga

SEQ ID NO: 849915 - RNA, 19 nt, Homo sapiens
ggacgccugugaucucaau

SEQ ID NO: 849916 - RNA, 19 nt, Homo sapiens
gaacaaugaagcccagugu

SEQ ID NO: 849917 - RNA, 19 nt, Homo sapiens
ccuguaaucucagcacuuu

SEQ ID NO: 849918 - RNA, 19 nt, Homo sapiens
acaaugaagcccaguguaa

SEQ ID NO: 849919 - RNA, 19 nt, Homo sapiens
gggaaaggcaguuggagaa

SEQ ID NO: 849920 - RNA, 19 nt, Homo sapiens
gagcagagcgggaccaucu

SEQ ID NO: 849921 - RNA, 19 nt, Homo sapiens
guuaugcuauccugugcua

SEQ ID NO: 849922 - RNA, 19 nt, Homo sapiens
ugacugcccuugacaugau

SEQ ID NO: 849923 - RNA, 19 nt, Homo sapiens
gcacgcugaucgagaaugg

SEQ ID NO: 849924 - RNA, 19 nt, Homo sapiens
ggcagaagcuagcgguugu

SEQ ID NO: 849925 - RNA, 19 nt, Homo sapiens
gcaggagaaucacuugaac

SEQ ID NO: 849926 - RNA, 19 nt, Homo sapiens
caucccagcuggaguucaa

SEQ ID NO: 849927 - RNA, 19 nt, Homo sapiens
gcaaagacggcaacaacca

SEQ ID NO: 849928 - RNA, 19 nt, Homo sapiens
ugaauucucugaaauaccu

SEQ ID NO: 849929 - RNA, 19 nt, Homo sapiens
ugaaagcuaaccaugcuaa

SEQ ID NO: 849930 - RNA, 19 nt, Homo sapiens
gaaaccccgucucuacuaa

SEQ ID NO: 849931 - RNA, 19 nt, Homo sapiens
gaagcuagcgguuguaucc

SEQ ID NO: 849932 - RNA, 19 nt, Homo sapiens
uaaccaugcuaaccaccaa

SEQ ID NO: 849933 - RNA, 19 nt, Homo sapiens
caagcuggcugagaacauc

SEQ ID NO: 849934 - RNA, 19 nt, Homo sapiens
uggagagccugaucaacaa

SEQ ID NO: 849935 - RNA, 19 nt, Homo sapiens
ggaucaagaauuucacaga

SEQ ID NO: 849936 - RNA, 19 nt, Homo sapiens
ucacaugacugcccuugac

SEQ ID NO: 849937 - RNA, 19 nt, Homo sapiens
gcuuugccuugaauuuaaa

SEQ ID NO: 849938 - RNA, 19 nt, Homo sapiens
ucuggaggcuucucauuca

SEQ ID NO: 849939 - RNA, 19 nt, Homo sapiens
gcugaauucucugaaauac

SEQ ID NO: 849940 - RNA, 19 nt, Homo sapiens
gguggcacuuguuaugcua

SEQ ID NO: 849941 - RNA, 19 nt, Homo sapiens
ggaaugcgcccuguugucu

SEQ ID NO: 849942 - RNA, 19 nt, Homo sapiens
caaccuucaucccuucugu

SEQ ID NO: 849943 - RNA, 19 nt, Homo sapiens
uggaggaguuggucaagga

SEQ ID NO: 849944 - RNA, 19 nt, Homo sapiens
cggcuuugccuugaauuua

SEQ ID NO: 849945 - RNA, 19 nt, Homo sapiens
cccggucccugucacauuu

SEQ ID NO: 849946 - RNA, 19 nt, Homo sapiens
auacuuugcugaauucucu

SEQ ID NO: 849947 - RNA, 19 nt, Homo sapiens
guagcacccugagccugua

SEQ ID NO: 849948 - RNA, 19 nt, Homo sapiens
agugugagcuugugcuugu

SEQ ID NO: 849949 - RNA, 19 nt, Homo sapiens
caggagguguugcagugaa

SEQ ID NO: 849950 - RNA, 19 nt, Homo sapiens
caacugcuccaaccucauc

SEQ ID NO: 849951 - RNA, 19 nt, Homo sapiens
gcagcagcaaccucacuaa

SEQ ID NO: 849952 - RNA, 19 nt, Homo sapiens
guuaggagacugaaucaag

SEQ ID NO: 849953 - RNA, 19 nt, Homo sapiens
gacuugaggucaggaguuc

SEQ ID NO: 849954 - RNA, 19 nt, Homo sapiens
ccggaucaccuuugacuga

SEQ ID NO: 849955 - RNA, 19 nt, Homo sapiens
gauacugagcgaaaucuuc

SEQ ID NO: 849956 - RNA, 19 nt, Homo sapiens
ggcaggagaaucacuugaa

SEQ ID NO: 849957 - RNA, 19 nt, Homo sapiens
guaagagaaccuccaaguc

SEQ ID NO: 849958 - RNA, 19 nt, Homo sapiens
uggaggaggugaccaaggu

SEQ ID NO: 849959 - RNA, 19 nt, Homo sapiens
gauccucaaugcgcacaug

SEQ ID NO: 849960 - RNA, 19 nt, Homo sapiens
ggaccaggagcucgacuuc

SEQ ID NO: 849961 - RNA, 19 nt, Homo sapiens
cagcagcaccaccggcuuu

SEQ ID NO: 849962 - RNA, 19 nt, Homo sapiens
cuuaguggcaccagaguaa

SEQ ID NO: 849963 - RNA, 19 nt, Homo sapiens
aaaggcaguuggagaagag

SEQ ID NO: 849964 - RNA, 19 nt, Homo sapiens
gcacccaccggcuuugugu

SEQ ID NO: 849965 - RNA, 19 nt, Homo sapiens
ggaacuggauuuucuuugg

SEQ ID NO: 849966 - RNA, 19 nt, Homo sapiens
ccaugagcggguuuaauuu

SEQ ID NO: 849967 - RNA, 19 nt, Homo sapiens
gucccugucacauuuguua

SEQ ID NO: 849968 - RNA, 19 nt, Homo sapiens
caaauggagccuggagcua

SEQ ID NO: 849969 - RNA, 19 nt, Homo sapiens
ggagagccugaucaacaaa

SEQ ID NO: 849970 - RNA, 19 nt, Homo sapiens
aagcucagguggccuucuu

SEQ ID NO: 849971 - RNA, 19 nt, Homo sapiens
ccuguugucuguaguuugg

SEQ ID NO: 849972 - RNA, 19 nt, Homo sapiens
gcagacaccgacggauuug

SEQ ID NO: 849973 - RNA, 19 nt, Homo sapiens
ccaccggcuuugccuugaa

SEQ ID NO: 849974 - RNA, 19 nt, Homo sapiens
ucgucucgcuguuagauug

SEQ ID NO: 849975 - RNA, 19 nt, Homo sapiens
gcccuguugucuguaguuu

SEQ ID NO: 849976 - RNA, 19 nt, Homo sapiens
gaucgagaauggagaaaag

SEQ ID NO: 849977 - RNA, 19 nt, Homo sapiens
cagccucuuugcgucaaua

SEQ ID NO: 849978 - RNA, 19 nt, Homo sapiens
gcaguuggagaagagguaa

SEQ ID NO: 849979 - RNA, 19 nt, Homo sapiens
aggcaaagcagcacagugu

SEQ ID NO: 849980 - RNA, 19 nt, Homo sapiens
gaacccaggagguguugca

SEQ ID NO: 849981 - RNA, 19 nt, Homo sapiens
cccaggaucucaaggacau

SEQ ID NO: 849982 - RNA, 19 nt, Homo sapiens
acuggacucucccucugua

SEQ ID NO: 849983 - RNA, 19 nt, Homo sapiens
agacgacaggcuucacuuu

SEQ ID NO: 849984 - RNA, 19 nt, Homo sapiens
ccaccggccuguucucacu

SEQ ID NO: 849985 - RNA, 19 nt, Homo sapiens
ugugaaagcuaaccaugcu

SEQ ID NO: 849986 - RNA, 19 nt, Homo sapiens
gcucaccccuguaaucuca

SEQ ID NO: 849987 - RNA, 19 nt, Homo sapiens
gaacagagcgggaucaaga

SEQ ID NO: 849988 - RNA, 19 nt, Homo sapiens
gagaagagguaagcgguua

SEQ ID NO: 849989 - RNA, 19 nt, Homo sapiens
gaucaagaauuucacagaa

SEQ ID NO: 849990 - RNA, 19 nt, Homo sapiens
agacuuggcucggaacuua

SEQ ID NO: 849991 - RNA, 19 nt, Homo sapiens
ggagacagcagccuaguuu

SEQ ID NO: 849992 - RNA, 19 nt, Homo sapiens
gagcgcagcuuccggauca

SEQ ID NO: 849993 - RNA, 19 nt, Homo sapiens
caaccucacuaaugccaua

SEQ ID NO: 849994 - RNA, 19 nt, Homo sapiens
uaacgucaguccacagaaa

SEQ ID NO: 849995 - RNA, 19 nt, Homo sapiens
gcuguuagauugugaguuc

SEQ ID NO: 849996 - RNA, 19 nt, Homo sapiens
gaaaggcaguuggagaaga

SEQ ID NO: 849997 - RNA, 19 nt, Homo sapiens
gcacuggaggguuuaauuu

SEQ ID NO: 849998 - RNA, 19 nt, Homo sapiens
ccaagcaucuuuuguauuu

SEQ ID NO: 849999 - RNA, 19 nt, Homo sapiens
gagaagugcugauggucuu

SEQ ID NO: 850000 - RNA, 19 nt, Homo sapiens
uaagagaaccuccaaguca

SEQ ID NO: 850001 - RNA, 19 nt, Homo sapiens
gcagcaaccucacuaaugc

SEQ ID NO: 850002 - RNA, 19 nt, Homo sapiens
ggagagcgcaggcgugaaa

SEQ ID NO: 850003 - RNA, 19 nt, Homo sapiens
ucaagaauuucacagaaga

SEQ ID NO: 850004 - RNA, 19 nt, Homo sapiens
caugaucgcugugugcuuu

SEQ ID NO: 850005 - RNA, 19 nt, Homo sapiens
gccaugagcggguuuaauu

SEQ ID NO: 850006 - RNA, 19 nt, Homo sapiens
gcagagacccacugucguu

SEQ ID NO: 850007 - RNA, 19 nt, Homo sapiens
agagcgggaucaagaauuu

SEQ ID NO: 850008 - RNA, 19 nt, Homo sapiens
ccuacaagcuggcugagaa

SEQ ID NO: 850009 - RNA, 19 nt, Homo sapiens
ggcuuugccuugaauuuaa

SEQ ID NO: 850010 - RNA, 19 nt, Homo sapiens
gcaacaaccacaccugcua

SEQ ID NO: 850011 - RNA, 19 nt, Homo sapiens
gcgcaggcgugaaaucuuc

SEQ ID NO: 850012 - RNA, 19 nt, Homo sapiens
ggccucggcugaagaaaga

SEQ ID NO: 850013 - RNA, 19 nt, Homo sapiens
ggacgccugugaucucaau

SEQ ID NO: 850014 - RNA, 19 nt, Homo sapiens
gaacaaugaagcccagugu

SEQ ID NO: 850015 - RNA, 19 nt, Homo sapiens
ccuguaaucucagcacuuu

SEQ ID NO: 850016 - RNA, 19 nt, Homo sapiens
acaaugaagcccaguguaa

SEQ ID NO: 850017 - RNA, 19 nt, Homo sapiens
gggaaaggcaguuggagaa

SEQ ID NO: 850018 - RNA, 19 nt, Homo sapiens
gagcagagcgggaccaucu

SEQ ID NO: 850019 - RNA, 19 nt, Homo sapiens
guuaugcuauccugugcua

SEQ ID NO: 850020 - RNA, 19 nt, Homo sapiens
ugacugcccuugacaugau

SEQ ID NO: 850021 - RNA, 19 nt, Homo sapiens
gcacgcugaucgagaaugg

SEQ ID NO: 850022 - RNA, 19 nt, Homo sapiens
ggcagaagcuagcgguugu

SEQ ID NO: 850023 - RNA, 19 nt, Homo sapiens
gcaggagaaucacuugaac

SEQ ID NO: 850024 - RNA, 19 nt, Homo sapiens
gcaaagacggcaacaacca

SEQ ID NO: 850025 - RNA, 19 nt, Homo sapiens
ugaauucucugaaauaccu

SEQ ID NO: 850026 - RNA, 19 nt, Homo sapiens
ugaaagcuaaccaugcuaa

SEQ ID NO: 850027 - RNA, 19 nt, Homo sapiens
gaaaccccgucucuacuaa

SEQ ID NO: 850028 - RNA, 19 nt, Homo sapiens
gaagcuagcgguuguaucc

SEQ ID NO: 850029 - RNA, 19 nt, Homo sapiens
uaaccaugcuaaccaccaa

SEQ ID NO: 850030 - RNA, 19 nt, Homo sapiens
caagcuggcugagaacauc

SEQ ID NO: 850031 - RNA, 19 nt, Homo sapiens
uggagagccugaucaacaa

SEQ ID NO: 850032 - RNA, 19 nt, Homo sapiens
ggaucaagaauuucacaga

SEQ ID NO: 850033 - RNA, 19 nt, Homo sapiens
ucacaugacugcccuugac

SEQ ID NO: 850034 - RNA, 19 nt, Homo sapiens
gcuuugccuugaauuuaaa

SEQ ID NO: 850035 - RNA, 19 nt, Homo sapiens
ucuggaggcuucucauuca

SEQ ID NO: 850036 - RNA, 19 nt, Homo sapiens
gcugaauucucugaaauac

SEQ ID NO: 850037 - RNA, 19 nt, Homo sapiens
gguggcacuuguuaugcua

SEQ ID NO: 850038 - RNA, 19 nt, Homo sapiens
ggaaugcgcccuguugucu

SEQ ID NO: 850039 - RNA, 19 nt, Homo sapiens
uggaggaguuggucaagga

SEQ ID NO: 850040 - RNA, 19 nt, Homo sapiens
cggcuuugccuugaauuua

SEQ ID NO: 850041 - RNA, 19 nt, Homo sapiens
cccggucccugucacauuu

SEQ ID NO: 850042 - RNA, 19 nt, Homo sapiens
auacuuugcugaauucucu

SEQ ID NO: 850043 - RNA, 19 nt, Homo sapiens
guagcacccugagccugua

SEQ ID NO: 850044 - RNA, 19 nt, Homo sapiens
agugugagcuugugcuugu

SEQ ID NO: 850045 - RNA, 19 nt, Homo sapiens
caggagguguugcagugaa

SEQ ID NO: 850046 - RNA, 19 nt, Homo sapiens
caacugcuccaaccucauc

SEQ ID NO: 850047 - RNA, 19 nt, Homo sapiens
gcagcagcaaccucacuaa

SEQ ID NO: 850048 - RNA, 19 nt, Homo sapiens
gacuugaggucaggaguuc

SEQ ID NO: 850049 - RNA, 19 nt, Homo sapiens
ccggaucaccuuugacuga

SEQ ID NO: 850050 - RNA, 19 nt, Homo sapiens
ggcaggagaaucacuugaa

SEQ ID NO: 850051 - RNA, 19 nt, Homo sapiens
guaagagaaccuccaaguc

SEQ ID NO: 850052 - RNA, 19 nt, Homo sapiens
uggaggaggugaccaaggu

SEQ ID NO: 850053 - RNA, 19 nt, Homo sapiens
gauccucaaugcgcacaug

SEQ ID NO: 850054 - RNA, 19 nt, Homo sapiens
ggaccaggagcucgacuuc

SEQ ID NO: 850055 - RNA, 19 nt, Homo sapiens
cagcagcaccaccggcuuu

SEQ ID NO: 850056 - RNA, 19 nt, Homo sapiens
cuuaguggcaccagaguaa

SEQ ID NO: 850057 - RNA, 19 nt, Homo sapiens
aaaggcaguuggagaagag

SEQ ID NO: 850058 - RNA, 19 nt, Homo sapiens
ccaugagcggguuuaauuu

SEQ ID NO: 850059 - RNA, 19 nt, Homo sapiens
gcacccaccggcuuugugu

SEQ ID NO: 850060 - RNA, 19 nt, Homo sapiens
ggaacuggauuuucuuugg

SEQ ID NO: 850061 - RNA, 19 nt, Homo sapiens
gucccugucacauuuguua

SEQ ID NO: 850062 - RNA, 19 nt, Homo sapiens
caaauggagccuggagcua

SEQ ID NO: 850063 - RNA, 19 nt, Homo sapiens
ggagagccugaucaacaaa

SEQ ID NO: 850064 - RNA, 19 nt, Homo sapiens
gcagacaccgacggauuug

SEQ ID NO: 850065 - RNA, 19 nt, Homo sapiens
aagcucagguggccuucuu

SEQ ID NO: 850066 - RNA, 19 nt, Homo sapiens
ccuguugucuguaguuugg

SEQ ID NO: 850067 - RNA, 19 nt, Homo sapiens
ccaccggcuuugccuugaa

SEQ ID NO: 850068 - RNA, 19 nt, Homo sapiens
ucgucucgcuguuagauug

SEQ ID NO: 850069 - RNA, 19 nt, Homo sapiens
gcccuguugucuguaguuu

SEQ ID NO: 850070 - RNA, 19 nt, Homo sapiens
gaucgagaauggagaaaag

SEQ ID NO: 850071 - RNA, 19 nt, Homo sapiens
cagccucuuugcgucaaua

SEQ ID NO: 850072 - RNA, 19 nt, Homo sapiens
gcaguuggagaagagguaa

SEQ ID NO: 850073 - RNA, 19 nt, Homo sapiens
aggcaaagcagcacagugu

SEQ ID NO: 850074 - RNA, 19 nt, Homo sapiens
gaacccaggagguguugca

SEQ ID NO: 850075 - RNA, 19 nt, Homo sapiens
cccaggaucucaaggacau

SEQ ID NO: 850076 - RNA, 19 nt, Homo sapiens
acuggacucucccucugua

SEQ ID NO: 850077 - RNA, 19 nt, Homo sapiens
ccaccggccuguucucacu

SEQ ID NO: 850078 - RNA, 19 nt, Homo sapiens
agacgacaggcuucacuuu

SEQ ID NO: 850079 - RNA, 19 nt, Homo sapiens
acaggcggguucacguuug

SEQ ID NO: 850080 - RNA, 19 nt, Homo sapiens
ugugaaagcuaaccaugcu

SEQ ID NO: 850081 - RNA, 19 nt, Homo sapiens
gcucaccccuguaaucuca

SEQ ID NO: 850082 - RNA, 19 nt, Homo sapiens
gcuuccggaucaccuuuga

SEQ ID NO: 850083 - RNA, 19 nt, Homo sapiens
ugcaguggaucgaccagaa

SEQ ID NO: 850084 - RNA, 19 nt, Homo sapiens
gcagaagcuagcgguugua

SEQ ID NO: 850085 - RNA, 19 nt, Homo sapiens
aauggagccuggagcuaga

SEQ ID NO: 850086 - RNA, 19 nt, Homo sapiens
cuggagagccugaucaaca

SEQ ID NO: 850087 - RNA, 19 nt, Homo sapiens
gaacagagcgggaucaaga

SEQ ID NO: 850088 - RNA, 19 nt, Homo sapiens
gagaagagguaagcgguua

SEQ ID NO: 850089 - RNA, 19 nt, Homo sapiens
gaucaagaauuucacagaa

SEQ ID NO: 850090 - RNA, 19 nt, Homo sapiens
agacuuggcucggaacuua

SEQ ID NO: 850091 - RNA, 19 nt, Homo sapiens
ggagacagcagccuaguuu

SEQ ID NO: 850092 - RNA, 19 nt, Homo sapiens
gagcgcagcuuccggauca

SEQ ID NO: 850093 - RNA, 19 nt, Homo sapiens
caaccucacuaaugccaua

SEQ ID NO: 850094 - RNA, 19 nt, Homo sapiens
uaacgucaguccacagaaa

SEQ ID NO: 850095 - RNA, 19 nt, Homo sapiens
gcuguuagauugugaguuc

SEQ ID NO: 850096 - RNA, 19 nt, Homo sapiens
gaaaggcaguuggagaaga

SEQ ID NO: 850097 - RNA, 19 nt, Homo sapiens
gcacuggaggguuuaauuu

SEQ ID NO: 850098 - RNA, 19 nt, Homo sapiens
ccaagcaucuuuuguauuu

SEQ ID NO: 850099 - RNA, 19 nt, Homo sapiens
gagaagugcugauggucuu

SEQ ID NO: 850100 - RNA, 19 nt, Homo sapiens
uaagagaaccuccaaguca

SEQ ID NO: 850101 - RNA, 19 nt, Homo sapiens
gcagcaaccucacuaaugc

SEQ ID NO: 850102 - RNA, 19 nt, Homo sapiens
ucaagaauuucacagaaga

SEQ ID NO: 850103 - RNA, 19 nt, Homo sapiens
gaaucaagguccagagaag

SEQ ID NO: 850104 - RNA, 19 nt, Homo sapiens
caugaucgcugugugcuuu

SEQ ID NO: 850105 - RNA, 19 nt, Homo sapiens
gccaugagcggguuuaauu

SEQ ID NO: 850106 - RNA, 19 nt, Homo sapiens
gcagagacccacugucguu

SEQ ID NO: 850107 - RNA, 19 nt, Homo sapiens
agagcgggaucaagaauuu

SEQ ID NO: 850108 - RNA, 19 nt, Homo sapiens
ccuacaagcuggcugagaa

SEQ ID NO: 850109 - RNA, 19 nt, Homo sapiens
ggacaucccagcuggaguu

SEQ ID NO: 850110 - RNA, 19 nt, Homo sapiens
ggcuuugccuugaauuuaa

SEQ ID NO: 850111 - RNA, 19 nt, Homo sapiens
gcaacaaccacaccugcua

SEQ ID NO: 850112 - RNA, 19 nt, Homo sapiens
cagagaagguggaggaauc

SEQ ID NO: 850113 - RNA, 19 nt, Homo sapiens
ggacgccugugaucucaau

SEQ ID NO: 850114 - RNA, 19 nt, Homo sapiens
ggccucggcugaagaaaga

SEQ ID NO: 850115 - RNA, 19 nt, Homo sapiens
gaacaaugaagcccagugu

SEQ ID NO: 850116 - RNA, 19 nt, Homo sapiens
ccuguaaucucagcacuuu

SEQ ID NO: 850117 - RNA, 19 nt, Homo sapiens
acaaugaagcccaguguaa

SEQ ID NO: 850118 - RNA, 19 nt, Homo sapiens
gggaaaggcaguuggagaa

SEQ ID NO: 850119 - RNA, 19 nt, Homo sapiens
gagcagagcgggaccaucu

SEQ ID NO: 850120 - RNA, 19 nt, Homo sapiens
guuaugcuauccugugcua

SEQ ID NO: 850121 - RNA, 19 nt, Homo sapiens
ugacugcccuugacaugau

SEQ ID NO: 850122 - RNA, 19 nt, Homo sapiens
gcacgcugaucgagaaugg

SEQ ID NO: 850123 - RNA, 19 nt, Homo sapiens
ggcagaagcuagcgguugu

SEQ ID NO: 850124 - RNA, 19 nt, Homo sapiens
gcaggagaaucacuugaac

SEQ ID NO: 850125 - RNA, 19 nt, Homo sapiens
caucccagcuggaguucaa

SEQ ID NO: 850126 - RNA, 19 nt, Homo sapiens
gcaaagacggcaacaacca

SEQ ID NO: 850127 - RNA, 19 nt, Homo sapiens
ugaauucucugaaauaccu

SEQ ID NO: 850128 - RNA, 19 nt, Homo sapiens
ugaaagcuaaccaugcuaa

SEQ ID NO: 850129 - RNA, 19 nt, Homo sapiens
gaaaccccgucucuacuaa

SEQ ID NO: 850130 - RNA, 19 nt, Homo sapiens
gaagcuagcgguuguaucc

SEQ ID NO: 850131 - RNA, 19 nt, Homo sapiens
uaaccaugcuaaccaccaa

SEQ ID NO: 850132 - RNA, 19 nt, Homo sapiens
caagcuggcugagaacauc

SEQ ID NO: 850133 - RNA, 19 nt, Homo sapiens
uggagagccugaucaacaa

SEQ ID NO: 850134 - RNA, 19 nt, Homo sapiens
ggaucaagaauuucacaga

SEQ ID NO: 850135 - RNA, 19 nt, Homo sapiens
ucacaugacugcccuugac

SEQ ID NO: 850136 - RNA, 19 nt, Homo sapiens
gcuuugccuugaauuuaaa

SEQ ID NO: 850137 - RNA, 19 nt, Homo sapiens
ucuggaggcuucucauuca

SEQ ID NO: 850138 - RNA, 19 nt, Homo sapiens
gcugaauucucugaaauac

SEQ ID NO: 850139 - RNA, 19 nt, Homo sapiens
gguggcacuuguuaugcua

SEQ ID NO: 850140 - RNA, 19 nt, Homo sapiens
ggaaugcgcccuguugucu

SEQ ID NO: 850141 - RNA, 19 nt, Homo sapiens
caaccuucaucccuucugu

SEQ ID NO: 850142 - RNA, 19 nt, Homo sapiens
uggaggaguuggucaagga

SEQ ID NO: 850143 - RNA, 19 nt, Homo sapiens
cggcuuugccuugaauuua

SEQ ID NO: 850144 - RNA, 19 nt, Homo sapiens
cccggucccugucacauuu

SEQ ID NO: 850145 - RNA, 19 nt, Homo sapiens
auacuuugcugaauucucu

SEQ ID NO: 850146 - RNA, 19 nt, Homo sapiens
guagcacccugagccugua

SEQ ID NO: 850147 - RNA, 19 nt, Homo sapiens
cgagguggauguccgucuu

SEQ ID NO: 850148 - RNA, 19 nt, Homo sapiens
agugugagcuugugcuugu

SEQ ID NO: 850149 - RNA, 19 nt, Homo sapiens
caggagguguugcagugaa

SEQ ID NO: 850150 - RNA, 19 nt, Homo sapiens
caacugcuccaaccucauc

SEQ ID NO: 850151 - RNA, 19 nt, Homo sapiens
gcagcagcaaccucacuaa

SEQ ID NO: 850152 - RNA, 19 nt, Homo sapiens
guuaggagacugaaucaag

SEQ ID NO: 850153 - RNA, 19 nt, Homo sapiens
gacuugaggucaggaguuc

SEQ ID NO: 850154 - RNA, 19 nt, Homo sapiens
ccggaucaccuuugacuga

SEQ ID NO: 850155 - RNA, 19 nt, Homo sapiens
gauacugagcgaaaucuuc

SEQ ID NO: 850156 - RNA, 19 nt, Homo sapiens
ggcaggagaaucacuugaa

SEQ ID NO: 850157 - RNA, 19 nt, Homo sapiens
guaagagaaccuccaaguc

SEQ ID NO: 850158 - RNA, 19 nt, Homo sapiens
uggaggaggugaccaaggu

SEQ ID NO: 850159 - RNA, 19 nt, Homo sapiens
gauccucaaugcgcacaug

SEQ ID NO: 850160 - RNA, 19 nt, Homo sapiens
ggaccaggagcucgacuuc

SEQ ID NO: 850161 - RNA, 19 nt, Homo sapiens
cagcagcaccaccggcuuu

SEQ ID NO: 850162 - RNA, 19 nt, Homo sapiens
cuuaguggcaccagaguaa

SEQ ID NO: 850163 - RNA, 19 nt, Homo sapiens
aaaggcaguuggagaagag

SEQ ID NO: 850164 - RNA, 19 nt, Homo sapiens
gcacccaccggcuuugugu

SEQ ID NO: 850165 - RNA, 19 nt, Homo sapiens
ggaacuggauuuucuuugg

SEQ ID NO: 850166 - RNA, 19 nt, Homo sapiens
ccaugagcggguuuaauuu

SEQ ID NO: 850167 - RNA, 19 nt, Homo sapiens
gucccugucacauuuguua

SEQ ID NO: 850168 - RNA, 19 nt, Homo sapiens
caaauggagccuggagcua

SEQ ID NO: 850169 - RNA, 19 nt, Homo sapiens
ggagagccugaucaacaaa

SEQ ID NO: 850170 - RNA, 19 nt, Homo sapiens
aagcucagguggccuucuu

SEQ ID NO: 850171 - RNA, 19 nt, Homo sapiens
ccuguugucuguaguuugg

SEQ ID NO: 850172 - RNA, 19 nt, Homo sapiens
ccaccggcuuugccuugaa

SEQ ID NO: 850173 - RNA, 19 nt, Homo sapiens
gcagacaccgacggauuug

SEQ ID NO: 850174 - RNA, 19 nt, Homo sapiens
ucgucucgcuguuagauug

SEQ ID NO: 850175 - RNA, 19 nt, Homo sapiens
gcccuguugucuguaguuu

SEQ ID NO: 850176 - RNA, 19 nt, Homo sapiens
gaucgagaauggagaaaag

SEQ ID NO: 850177 - RNA, 19 nt, Homo sapiens
cagccucuuugcgucaaua

SEQ ID NO: 850178 - RNA, 19 nt, Homo sapiens
gcaguuggagaagagguaa

SEQ ID NO: 850179 - RNA, 19 nt, Homo sapiens
aggcaaagcagcacagugu

SEQ ID NO: 850180 - RNA, 19 nt, Homo sapiens
gaacccaggagguguugca

SEQ ID NO: 850181 - RNA, 19 nt, Homo sapiens
cccaggaucucaaggacau

SEQ ID NO: 850182 - RNA, 19 nt, Homo sapiens
acuggacucucccucugua

SEQ ID NO: 850183 - RNA, 19 nt, Homo sapiens
agacgacaggcuucacuuu

SEQ ID NO: 850184 - RNA, 19 nt, Homo sapiens
ccaccggccuguucucacu

SEQ ID NO: 850185 - RNA, 19 nt, Homo sapiens
ugugaaagcuaaccaugcu

SEQ ID NO: 850186 - RNA, 19 nt, Homo sapiens
gcucaccccuguaaucuca

SEQ ID NO: 850187 - RNA, 19 nt, Homo sapiens
ggacagagcucccucacuu

SEQ ID NO: 850188 - RNA, 19 nt, Homo sapiens
ggacaagauuccuuauaua

SEQ ID NO: 850189 - RNA, 19 nt, Homo sapiens
gauggaaagucguauguua

SEQ ID NO: 850190 - RNA, 19 nt, Homo sapiens
gaagaaacuccuaaagaua

SEQ ID NO: 850191 - RNA, 19 nt, Homo sapiens
ggacacggaugaagagaaa

SEQ ID NO: 850192 - RNA, 19 nt, Homo sapiens
gaccacagcuguagauuug

SEQ ID NO: 850193 - RNA, 19 nt, Homo sapiens
guacaaaccucacuguuca

SEQ ID NO: 850194 - RNA, 19 nt, Homo sapiens
gaaugugucugaaggaauu

SEQ ID NO: 850195 - RNA, 19 nt, Homo sapiens
acacugagcuccauaaaga

SEQ ID NO: 850196 - RNA, 19 nt, Homo sapiens
gaauuagccugcaacauga

SEQ ID NO: 850197 - RNA, 19 nt, Homo sapiens
ggaauuagccugcaacaug

SEQ ID NO: 850198 - RNA, 19 nt, Homo sapiens
ggaaagucguauguuauua

SEQ ID NO: 850199 - RNA, 19 nt, Homo sapiens
agaagagucugcucaguua

SEQ ID NO: 850200 - RNA, 19 nt, Homo sapiens
gagacaccaucuacaaaua

SEQ ID NO: 850201 - RNA, 19 nt, Homo sapiens
gaauaggcgucuacaagaa

SEQ ID NO: 850202 - RNA, 19 nt, Homo sapiens
ggacuuggaacaccauuua

SEQ ID NO: 850203 - RNA, 19 nt, Homo sapiens
aaacagaaguugauugaug

SEQ ID NO: 850204 - RNA, 19 nt, Homo sapiens
gaaguuguaugcuuggaaa

SEQ ID NO: 850205 - RNA, 19 nt, Homo sapiens
gcagagcucuucagaauac

SEQ ID NO: 850206 - RNA, 19 nt, Homo sapiens
gacaugcacuuauuagauu

SEQ ID NO: 850207 - RNA, 19 nt, Homo sapiens
auaaagaacuugccauuga

SEQ ID NO: 850208 - RNA, 19 nt, Homo sapiens
gagaugagccuaccaguga

SEQ ID NO: 850209 - RNA, 19 nt, Homo sapiens
gagaugggccucuuucuaa

SEQ ID NO: 850210 - RNA, 19 nt, Homo sapiens
ugaagaaacuccuaaagau

SEQ ID NO: 850211 - RNA, 19 nt, Homo sapiens
gaguggaucuggugaugua

SEQ ID NO: 850212 - RNA, 19 nt, Homo sapiens
aaacaggacucaagauugu

SEQ ID NO: 850213 - RNA, 19 nt, Homo sapiens
ugacaaggcuucuguugga

SEQ ID NO: 850214 - RNA, 19 nt, Homo sapiens
ggacagacagugcuuuaaa

SEQ ID NO: 850215 - RNA, 19 nt, Homo sapiens
cugcugaucugcacaauuu

SEQ ID NO: 850216 - RNA, 19 nt, Homo sapiens
gcagauuuguucucaguug

SEQ ID NO: 850217 - RNA, 19 nt, Homo sapiens
gaaguugauugaugcagaa

SEQ ID NO: 850218 - RNA, 19 nt, Homo sapiens
gcuguaagccggauacuuu

SEQ ID NO: 850219 - RNA, 19 nt, Homo sapiens
gcacuuaauuucacucaag

SEQ ID NO: 850220 - RNA, 19 nt, Homo sapiens
aaacuacccuaucuacaaa

SEQ ID NO: 850221 - RNA, 19 nt, Homo sapiens
gacaaacacugaaauagca

SEQ ID NO: 850222 - RNA, 19 nt, Homo sapiens
uaaagaacuugccauugaa

SEQ ID NO: 850223 - RNA, 19 nt, Homo sapiens
gagacuggauuauaacaug

SEQ ID NO: 850224 - RNA, 19 nt, Homo sapiens
ggaaagagacuugcugaga

SEQ ID NO: 850225 - RNA, 19 nt, Homo sapiens
gcaguugucauccuuagua

SEQ ID NO: 850226 - RNA, 19 nt, Homo sapiens
uaaauaggaggguuucaua

SEQ ID NO: 850227 - RNA, 19 nt, Homo sapiens
gcccuuggauuauuaaaga

SEQ ID NO: 850228 - RNA, 19 nt, Homo sapiens
guaagacuacugauacuaa

SEQ ID NO: 850229 - RNA, 19 nt, Homo sapiens
gccaaggaauugauaagaa

SEQ ID NO: 850230 - RNA, 19 nt, Homo sapiens
guagagaaauaccgcauuc

SEQ ID NO: 850231 - RNA, 19 nt, Homo sapiens
gaagccaccugguucuguu

SEQ ID NO: 850232 - RNA, 19 nt, Homo sapiens
gaacauucccagcccauga

SEQ ID NO: 850233 - RNA, 19 nt, Homo sapiens
caaacuacccuaucuacaa

SEQ ID NO: 850234 - RNA, 19 nt, Homo sapiens
acacugaaauagcaaacua

SEQ ID NO: 850235 - RNA, 19 nt, Homo sapiens
gcuagcagauguacugaug

SEQ ID NO: 850236 - RNA, 19 nt, Homo sapiens
agaaagagacgcucaagaa

SEQ ID NO: 850237 - RNA, 19 nt, Homo sapiens
gaaagugaaucagaaagag

SEQ ID NO: 850238 - RNA, 19 nt, Homo sapiens
ggaaagugaaucagaaaga

SEQ ID NO: 850239 - RNA, 19 nt, Homo sapiens
guggaagccuuaaggauga

SEQ ID NO: 850240 - RNA, 19 nt, Homo sapiens
ggagaugggccucuuucua

SEQ ID NO: 850241 - RNA, 19 nt, Homo sapiens
cauuaacccugugccauua

SEQ ID NO: 850242 - RNA, 19 nt, Homo sapiens
gagaauaggcgucuacaag

SEQ ID NO: 850243 - RNA, 19 nt, Homo sapiens
caaagggagagaaagaaua

SEQ ID NO: 850244 - RNA, 19 nt, Homo sapiens
gagaagcacuuuguuuuaa

SEQ ID NO: 850245 - RNA, 19 nt, Homo sapiens
ccaagaagacgugguuuaa

SEQ ID NO: 850246 - RNA, 19 nt, Homo sapiens
ccaaacagaaguugauuga

SEQ ID NO: 850247 - RNA, 19 nt, Homo sapiens
uggacaagauuccuuauau

SEQ ID NO: 850248 - RNA, 19 nt, Homo sapiens
gggaucagaaauucaaaua

SEQ ID NO: 850249 - RNA, 19 nt, Homo sapiens
gaacacugagcuccauaaa

SEQ ID NO: 850250 - RNA, 19 nt, Homo sapiens
ugagagaaauggagcuaga

SEQ ID NO: 850251 - RNA, 19 nt, Homo sapiens
ccaaggagguuuuagauga

SEQ ID NO: 850252 - RNA, 19 nt, Homo sapiens
uuaaagacuucgaaagaug

SEQ ID NO: 850253 - RNA, 19 nt, Homo sapiens
aaaccucacuguucagaug

SEQ ID NO: 850254 - RNA, 19 nt, Homo sapiens
gaguaugccuggguacaaa

SEQ ID NO: 850255 - RNA, 19 nt, Homo sapiens
gaagaagagucugcucagu

SEQ ID NO: 850256 - RNA, 19 nt, Homo sapiens
ggugauguauccaaagaau

SEQ ID NO: 850257 - RNA, 19 nt, Homo sapiens
gaaaagauguacgaaauag

SEQ ID NO: 850258 - RNA, 19 nt, Homo sapiens
agacagugcuuuaaacuac

SEQ ID NO: 850259 - RNA, 19 nt, Homo sapiens
gggcaagggaucagaaauu

SEQ ID NO: 850260 - RNA, 19 nt, Homo sapiens
gaauguaccuaagucagau

SEQ ID NO: 850261 - RNA, 19 nt, Homo sapiens
ucaguugagugaaagauug

SEQ ID NO: 850262 - RNA, 19 nt, Homo sapiens
aaagggagagaaagaauaa

SEQ ID NO: 850263 - RNA, 19 nt, Homo sapiens
gcacuuauuagauuuggaa

SEQ ID NO: 850264 - RNA, 19 nt, Homo sapiens
ucaaagcuauggaauggau

SEQ ID NO: 850265 - RNA, 19 nt, Homo sapiens
caacaaagaagggcgugua

SEQ ID NO: 850266 - RNA, 19 nt, Homo sapiens
gacggcaggucgggcauua

SEQ ID NO: 850267 - RNA, 19 nt, Homo sapiens
agaggaagauaaugaugaa

SEQ ID NO: 850268 - RNA, 19 nt, Homo sapiens
ccaaggaauugauaagaag

SEQ ID NO: 850269 - RNA, 19 nt, Homo sapiens
aaaaggagcuugugaaaag

SEQ ID NO: 850270 - RNA, 19 nt, Homo sapiens
ggcaagggaucagaaauuc

SEQ ID NO: 850271 - RNA, 19 nt, Homo sapiens
guugauugaugcagaagaa

SEQ ID NO: 850272 - RNA, 19 nt, Homo sapiens
uaagagauaccgcucagaa

SEQ ID NO: 850273 - RNA, 19 nt, Homo sapiens
uacaaccacuuccuggaua

SEQ ID NO: 850274 - RNA, 19 nt, Homo sapiens
uaauuucacucaagguuca

SEQ ID NO: 850275 - RNA, 19 nt, Homo sapiens
ggagaagcacuuuguuuua

SEQ ID NO: 850276 - RNA, 19 nt, Homo sapiens
ggggagaacuguugucaaa

SEQ ID NO: 850277 - RNA, 19 nt, Homo sapiens
gcuguagauuugguaauaa

SEQ ID NO: 850278 - RNA, 19 nt, Homo sapiens
gcagcaaacaacuaauaaa

SEQ ID NO: 850279 - RNA, 19 nt, Homo sapiens
gugcagcaaacaacuaaua

SEQ ID NO: 850280 - RNA, 19 nt, Homo sapiens
augcagagcucuucagaau

SEQ ID NO: 850281 - RNA, 19 nt, Homo sapiens
gugggugacuugacuguga

SEQ ID NO: 850282 - RNA, 19 nt, Homo sapiens
gaaaacaggacucaagauu

SEQ ID NO: 850283 - RNA, 19 nt, Homo sapiens
gccaagaagacgugguuua

SEQ ID NO: 850284 - RNA, 19 nt, Homo sapiens
gaaagaugaccugcuguug

SEQ ID NO: 850285 - RNA, 19 nt, Homo sapiens
gcaaagggagagaaagaau

SEQ ID NO: 850286 - RNA, 19 nt, Homo sapiens
uaaacuacgccaaggaauu

SEQ ID NO: 850287 - RNA, 19 nt, Homo sapiens
gaaauuagacgaugacuug

SEQ ID NO: 850288 - RNA, 19 nt, Homo sapiens
gcaggacuauucaguaauu

SEQ ID NO: 850289 - RNA, 19 nt, Homo sapiens
gaauaagcccuguuuguuu

SEQ ID NO: 850290 - RNA, 19 nt, Homo sapiens
aauaagcccuguuuguuua

SEQ ID NO: 850291 - RNA, 19 nt, Homo sapiens
ggaaagcccuaaaugugaa

SEQ ID NO: 850292 - RNA, 19 nt, Homo sapiens
gaacccaugugcuuccuuu

SEQ ID NO: 850293 - RNA, 19 nt, Homo sapiens
gaacacaacacaaagaaau

SEQ ID NO: 850294 - RNA, 19 nt, Homo sapiens
ggaagaggcucagaggaaa

SEQ ID NO: 850295 - RNA, 19 nt, Homo sapiens
gagccaaacucaaggaaga

SEQ ID NO: 850296 - RNA, 19 nt, Homo sapiens
gaaauagagccuucagaaa

SEQ ID NO: 850297 - RNA, 19 nt, Homo sapiens
ggacuuugaucacugaaga

SEQ ID NO: 850298 - RNA, 19 nt, Homo sapiens
caaagaaauuagacgauga

SEQ ID NO: 850299 - RNA, 19 nt, Homo sapiens
uaaagugguuggaugguaa

SEQ ID NO: 850300 - RNA, 19 nt, Homo sapiens
ggaauaagcccuguuuguu

SEQ ID NO: 850301 - RNA, 19 nt, Homo sapiens
uagcaacucuuccacaauu

SEQ ID NO: 850302 - RNA, 19 nt, Homo sapiens
cagaaaggauuaaggcauu

SEQ ID NO: 850303 - RNA, 19 nt, Homo sapiens
gaagugaaacccgauagua

SEQ ID NO: 850304 - RNA, 19 nt, Homo sapiens
gauaaauggugccgggauu

SEQ ID NO: 850305 - RNA, 19 nt, Homo sapiens
gaagcaagcacauggagaa

SEQ ID NO: 850306 - RNA, 19 nt, Homo sapiens
cacagaagaucuuauuaga

SEQ ID NO: 850307 - RNA, 19 nt, Homo sapiens
gagcagagaacaaacaaau

SEQ ID NO: 850308 - RNA, 19 nt, Homo sapiens
gcacauggagaaacuagaa

SEQ ID NO: 850309 - RNA, 19 nt, Homo sapiens
gggaaagcccuaaauguga

SEQ ID NO: 850310 - RNA, 19 nt, Homo sapiens
gcaagcacauggagaaacu

SEQ ID NO: 850311 - RNA, 19 nt, Homo sapiens
gaguaaugaucaaaggaaa

SEQ ID NO: 850312 - RNA, 19 nt, Homo sapiens
ggauaccucuuuaaucgau

SEQ ID NO: 850313 - RNA, 19 nt, Homo sapiens
gguagcaacucuuccacaa

SEQ ID NO: 850314 - RNA, 19 nt, Homo sapiens
ugaaggagcucuuucucau

SEQ ID NO: 850315 - RNA, 19 nt, Homo sapiens
gacuagaacacauugauaa

SEQ ID NO: 850316 - RNA, 19 nt, Homo sapiens
gcaagaaauagaaagacua

SEQ ID NO: 850317 - RNA, 19 nt, Homo sapiens
gcagagaacaaacaaauac

SEQ ID NO: 850318 - RNA, 19 nt, Homo sapiens
gaucaaaggaaagccauuu

SEQ ID NO: 850319 - RNA, 19 nt, Homo sapiens
guaauugaaccacaaauca

SEQ ID NO: 850320 - RNA, 19 nt, Homo sapiens
gaaagacuagaacacauug

SEQ ID NO: 850321 - RNA, 19 nt, Homo sapiens
aaacuugaccugacuguga

SEQ ID NO: 850322 - RNA, 19 nt, Homo sapiens
gaagugccuccgcugauuu

SEQ ID NO: 850323 - RNA, 19 nt, Homo sapiens
guuggaugguaaagaaaua

SEQ ID NO: 850324 - RNA, 19 nt, Homo sapiens
gugguuggaugguaaagaa

SEQ ID NO: 850325 - RNA, 19 nt, Homo sapiens
cagcgagcauucaaaucua

SEQ ID NO: 850326 - RNA, 19 nt, Homo sapiens
gcaacucuuccacaauuaa

SEQ ID NO: 850327 - RNA, 19 nt, Homo sapiens
uaucgcugcuccaguguuu

SEQ ID NO: 850328 - RNA, 19 nt, Homo sapiens
gaggaagacccaaccuuug

SEQ ID NO: 850329 - RNA, 19 nt, Homo sapiens
gcuaaaagaucucagacaa

SEQ ID NO: 850330 - RNA, 19 nt, Homo sapiens
agaaauagagccuucagaa

SEQ ID NO: 850331 - RNA, 19 nt, Homo sapiens
ugaagugccuccgcugauu

SEQ ID NO: 850332 - RNA, 19 nt, Homo sapiens
caagguaggagaaguaauc

SEQ ID NO: 850333 - RNA, 19 nt, Homo sapiens
gauaguaguucugcuaaaa

SEQ ID NO: 850334 - RNA, 19 nt, Homo sapiens
ggaccuugcugucuauagg

SEQ ID NO: 850335 - RNA, 19 nt, Homo sapiens
gagcaaagaccaccuacag

SEQ ID NO: 850336 - RNA, 19 nt, Homo sapiens
uugcaggacuauucaguaa

SEQ ID NO: 850337 - RNA, 19 nt, Homo sapiens
ugaggaagacccaaccuuu

SEQ ID NO: 850338 - RNA, 19 nt, Homo sapiens
aaauagagccuucagaaag

SEQ ID NO: 850339 - RNA, 19 nt, Homo sapiens
acacagaguuauuugucaa

SEQ ID NO: 850340 - RNA, 19 nt, Homo sapiens
ggacaggagcagagaacaa

SEQ ID NO: 850341 - RNA, 19 nt, Homo sapiens
ccaggacuuugaucacuga

SEQ ID NO: 850342 - RNA, 19 nt, Homo sapiens
ggacguugguacacagaca

SEQ ID NO: 850343 - RNA, 19 nt, Homo sapiens
gacaggagcagagaacaaa

SEQ ID NO: 850344 - RNA, 19 nt, Homo sapiens
uuaaagugguuggauggua

SEQ ID NO: 850345 - RNA, 19 nt, Homo sapiens
aagacgaccugaacccaaa

SEQ ID NO: 850346 - RNA, 19 nt, Homo sapiens
ggaacacaacacaaagaaa

SEQ ID NO: 850347 - RNA, 19 nt, Homo sapiens
uagaggaacacaacacaaa

SEQ ID NO: 850348 - RNA, 19 nt, Homo sapiens
gaaguaacgcaggcuuuga

SEQ ID NO: 850349 - RNA, 19 nt, Homo sapiens
gagaaguaacgcaggcuuu

SEQ ID NO: 850350 - RNA, 19 nt, Homo sapiens
ggaagacccaaccuuugaa

SEQ ID NO: 850351 - RNA, 19 nt, Homo sapiens
ucacagaagaucuuauuag

SEQ ID NO: 850352 - RNA, 19 nt, Homo sapiens
gcagaagugaaacccgaua

SEQ ID NO: 850353 - RNA, 19 nt, Homo sapiens
gaagaugggaaagcccuaa

SEQ ID NO: 850354 - RNA, 19 nt, Homo sapiens
gaggaacacaacacaaaga

SEQ ID NO: 850355 - RNA, 19 nt, Homo sapiens
augcuacucuuuccucuuu

SEQ ID NO: 850356 - RNA, 19 nt, Homo sapiens
ugaaugagcccaaaauuga

SEQ ID NO: 850357 - RNA, 19 nt, Homo sapiens
caagaaauagaaagacuag

SEQ ID NO: 850358 - RNA, 19 nt, Homo sapiens
agacaucaaugcuacucuu

SEQ ID NO: 850359 - RNA, 19 nt, Homo sapiens
gaaauagaaagacuagaac

SEQ ID NO: 850360 - RNA, 19 nt, Homo sapiens
gaaggagcucuuucucaug

SEQ ID NO: 850361 - RNA, 19 nt, Homo sapiens
uggagaaacuagaaguaga

SEQ ID NO: 850362 - RNA, 19 nt, Homo sapiens
gaaacccgauaguaguucu

SEQ ID NO: 850363 - RNA, 19 nt, Homo sapiens
gaugggaaagcccuaaaug

SEQ ID NO: 850364 - RNA, 19 nt, Homo sapiens
gaggaaacaccaagaagag

SEQ ID NO: 850365 - RNA, 19 nt, Homo sapiens
ggaaacucuuagacacaug

SEQ ID NO: 850366 - RNA, 19 nt, Homo sapiens
uaacgcaggcuuugaugga

SEQ ID NO: 850367 - RNA, 19 nt, Homo sapiens
uaaacgagccaaacucaag

SEQ ID NO: 850368 - RNA, 19 nt, Homo sapiens
uagaaagacuagaacacau

SEQ ID NO: 850369 - RNA, 19 nt, Homo sapiens
gacccaaccuuugaagaca

SEQ ID NO: 850370 - RNA, 19 nt, Homo sapiens
cgauaguaguucugcuaaa

SEQ ID NO: 850371 - RNA, 19 nt, Homo sapiens
gaucuuauuagacggaaug

SEQ ID NO: 850372 - RNA, 19 nt, Homo sapiens
caacggaagaaacaggaaa

SEQ ID NO: 850373 - RNA, 19 nt, Homo sapiens
caaaucagagagcaggaaa

SEQ ID NO: 850374 - RNA, 19 nt, Homo sapiens
agacuagaacacauugaua

SEQ ID NO: 850375 - RNA, 19 nt, Homo sapiens
gagaacaaacaaauacaag

SEQ ID NO: 850376 - RNA, 19 nt, Homo sapiens
agaaagacuagaacacauu

SEQ ID NO: 850377 - RNA, 19 nt, Homo sapiens
ggucagcgagcauucaaau

SEQ ID NO: 850378 - RNA, 19 nt, Homo sapiens
gguaggagaaguaaucaca

SEQ ID NO: 850379 - RNA, 19 nt, Homo sapiens
ucagacaacgggucauuug

SEQ ID NO: 850380 - RNA, 19 nt, Homo sapiens
uuuaaucgauguugaugug

SEQ ID NO: 850381 - RNA, 19 nt, Homo sapiens
caacucuuccacaauuaaa

SEQ ID NO: 850382 - RNA, 19 nt, Homo sapiens
cuggauaaacacagaguua

SEQ ID NO: 850383 - RNA, 19 nt, Homo sapiens
ugaccugacugugaauuuc

SEQ ID NO: 850384 - RNA, 19 nt, Homo sapiens
ugccuccgcugauuugaaa

SEQ ID NO: 850385 - RNA, 19 nt, Homo sapiens
ugaaaccacccaggacuuu

SEQ ID NO: 850386 - RNA, 19 nt, Homo sapiens
gacgaugacuuggaauucu

SEQ ID NO: 850387 - RNA, 19 nt, Homo sapiens
ccacacagcucuuccaaua

SEQ ID NO: 850388 - RNA, 19 nt, Homo sapiens
gaaaccagguggcuucuug

SEQ ID NO: 850389 - RNA, 19 nt, Homo sapiens
acacagcucuuccaauaaa

SEQ ID NO: 850390 - RNA, 19 nt, Homo sapiens
caauaaagguguuucucuu

SEQ ID NO: 850391 - RNA, 19 nt, Homo sapiens
gagcuggaguucugugaaa

SEQ ID NO: 850392 - RNA, 19 nt, Homo sapiens
ggacaaugccgcagacuuc

SEQ ID NO: 850393 - RNA, 19 nt, Homo sapiens
gggccacccugaacacaaa

SEQ ID NO: 850394 - RNA, 19 nt, Homo sapiens
gggaggagguggagcagau

SEQ ID NO: 850395 - RNA, 19 nt, Homo sapiens
gcagggcuuugaccagcua

SEQ ID NO: 850396 - RNA, 19 nt, Homo sapiens
gccagacccuccuccagaa

SEQ ID NO: 850397 - RNA, 19 nt, Homo sapiens
gggagacccucaagaaucg

SEQ ID NO: 850398 - RNA, 19 nt, Homo sapiens
ggacggcuucucuguguug

SEQ ID NO: 850399 - RNA, 19 nt, Homo sapiens
gaagcucaaggucaaauca

SEQ ID NO: 850400 - RNA, 19 nt, Homo sapiens
gugagaacauggacaaugc

SEQ ID NO: 850401 - RNA, 19 nt, Homo sapiens
gcggacgacuuugucugua

SEQ ID NO: 850402 - RNA, 19 nt, Homo sapiens
acaaacggcccaugucaga

SEQ ID NO: 850403 - RNA, 19 nt, Homo sapiens
ugcagaagcucaaggucaa

SEQ ID NO: 850404 - RNA, 19 nt, Homo sapiens
ucacaaacggcccauguca

SEQ ID NO: 850405 - RNA, 19 nt, Homo sapiens
aggaggagcuggaguucug

SEQ ID NO: 850406 - RNA, 19 nt, Homo sapiens
ccaauaaagguguuucucu

SEQ ID NO: 850407 - RNA, 19 nt, Homo sapiens
acacauucuucccuucuuc

SEQ ID NO: 850408 - RNA, 19 nt, Homo sapiens
cggcuucucuguguugaug

SEQ ID NO: 850409 - RNA, 19 nt, Homo sapiens
cuccagaaccgaugaguga

SEQ ID NO: 850410 - RNA, 19 nt, Homo sapiens
gaccaccuucucccucuaa

SEQ ID NO: 850411 - RNA, 19 nt, Homo sapiens
caaggucaaaucagcauuc

SEQ ID NO: 850412 - RNA, 19 nt, Homo sapiens
cuccuucacugccgccuuu

SEQ ID NO: 850413 - RNA, 19 nt, Homo sapiens
cagcauggaucggugaaac

SEQ ID NO: 850414 - RNA, 19 nt, Homo sapiens
gcuuugaccagcuacuuga

SEQ ID NO: 850415 - RNA, 19 nt, Homo sapiens
cgaccugugugagaacaug

SEQ ID NO: 850416 - RNA, 19 nt, Homo sapiens
gcacggguuuaagggacuu

SEQ ID NO: 850417 - RNA, 19 nt, Homo sapiens
cuggacggcuucucugugu

SEQ ID NO: 850418 - RNA, 19 nt, Homo sapiens
gcagccuggugacagacuu

SEQ ID NO: 850419 - RNA, 19 nt, Homo sapiens
ggagcuggaguucugugaa

SEQ ID NO: 850420 - RNA, 19 nt, Homo sapiens
gcagaagcucaaggucaaa

SEQ ID NO: 850421 - RNA, 19 nt, Homo sapiens
gaggagguggagcagauga

SEQ ID NO: 850422 - RNA, 19 nt, Homo sapiens
auucuucccuucuucacaa

SEQ ID NO: 850423 - RNA, 19 nt, Homo sapiens
ugaccaccuucucccucua

SEQ ID NO: 850424 - RNA, 19 nt, Homo sapiens
uaacacauucuucccuucu

SEQ ID NO: 850425 - RNA, 19 nt, Homo sapiens
aauaaagguguuucucuuc

SEQ ID NO: 850426 - RNA, 19 nt, Homo sapiens
gcagcagcaugaggaguac

SEQ ID NO: 850427 - RNA, 19 nt, Homo sapiens
uggccgaccugugugagaa

SEQ ID NO: 850428 - RNA, 19 nt, Homo sapiens
cggacgacuuugucuguag

SEQ ID NO: 850429 - RNA, 19 nt, Homo sapiens
gagguggagcagaugaaga

SEQ ID NO: 850430 - RNA, 19 nt, Homo sapiens
cacacagcucuuccaauaa

SEQ ID NO: 850431 - RNA, 19 nt, Homo sapiens
ugcagcagcaugaggagua

SEQ ID NO: 850432 - RNA, 19 nt, Homo sapiens
gucaggugcggacgacuuu

SEQ ID NO: 850433 - RNA, 19 nt, Homo sapiens
gaacuaugcugccacuuca

SEQ ID NO: 850434 - RNA, 19 nt, Homo sapiens
aagaggaggaugauuauua

SEQ ID NO: 850435 - RNA, 19 nt, Homo sapiens
aagaagaggaggaugauua

SEQ ID NO: 850436 - RNA, 19 nt, Homo sapiens
gaagguggcauuccuaauc

SEQ ID NO: 850437 - RNA, 19 nt, Homo sapiens
aggaauagcgcuccaguua

SEQ ID NO: 850438 - RNA, 19 nt, Homo sapiens
gaacagccagcucauggaa

SEQ ID NO: 850439 - RNA, 19 nt, Homo sapiens
gcuuacaucuucccagaga

SEQ ID NO: 850440 - RNA, 19 nt, Homo sapiens
gaauagcgcuccaguuacc

SEQ ID NO: 850441 - RNA, 19 nt, Homo sapiens
gcccagcuccucaauacua

SEQ ID NO: 850442 - RNA, 19 nt, Homo sapiens
cugcuaaucugaacugugu

SEQ ID NO: 850443 - RNA, 19 nt, Homo sapiens
cagcccagcuccucaauac

SEQ ID NO: 850444 - RNA, 19 nt, Homo sapiens
agaggaggaugauuauuag

SEQ ID NO: 850445 - RNA, 19 nt, Homo sapiens
gagaugaaacagugcuuug

SEQ ID NO: 850446 - RNA, 19 nt, Homo sapiens
gccaaauuguugacacuuc

SEQ ID NO: 850447 - RNA, 19 nt, Homo sapiens
cgucuuacaugcucgugaa

SEQ ID NO: 850448 - RNA, 19 nt, Homo sapiens
uuucagacauugauuugga

SEQ ID NO: 850449 - RNA, 19 nt, Homo sapiens
cgaagacgacgacgacgaa

SEQ ID NO: 850450 - RNA, 19 nt, Homo sapiens
acagaugugugcauuugga

SEQ ID NO: 850451 - RNA, 19 nt, Homo sapiens
ccucaauacuaccuggaaa

SEQ ID NO: 850452 - RNA, 19 nt, Homo sapiens
ccaaauuguugacacuucu

SEQ ID NO: 850453 - RNA, 19 nt, Homo sapiens
ggaccaaccuggaaaaugc

SEQ ID NO: 850454 - RNA, 19 nt, Homo sapiens
gaagaggaggaugauuauu

SEQ ID NO: 850455 - RNA, 19 nt, Homo sapiens
cgucugcucucucucuuca

SEQ ID NO: 850456 - RNA, 19 nt, Homo sapiens
gaagaagaggaggaugauu

SEQ ID NO: 850457 - RNA, 19 nt, Homo sapiens
agacgacgacgacgaagaa

SEQ ID NO: 850458 - RNA, 19 nt, Homo sapiens
ucgcaaugguggaugaguu

SEQ ID NO: 850459 - RNA, 19 nt, Homo sapiens
gcagcagucccacagaugu

SEQ ID NO: 850460 - RNA, 19 nt, Homo sapiens
ccuacagacuaccaccuuu

SEQ ID NO: 850461 - RNA, 19 nt, Homo sapiens
gcaacgacgccaugaaggu

SEQ ID NO: 850462 - RNA, 19 nt, Homo sapiens
gcuuggaagugucaucuac

SEQ ID NO: 850463 - RNA, 19 nt, Homo sapiens
uggcugggaugacgacgaa

SEQ ID NO: 850464 - RNA, 19 nt, Homo sapiens
cguucagccugguuaguuu

SEQ ID NO: 850465 - RNA, 19 nt, Homo sapiens
cugccaggcuuacaucuuc

SEQ ID NO: 850466 - RNA, 19 nt, Homo sapiens
gaagugcuuggaaguguca

SEQ ID NO: 850467 - RNA, 19 nt, Homo sapiens
cggaagugcuuggaagugu

SEQ ID NO: 850468 - RNA, 19 nt, Homo sapiens
acagccagcucauggaaca

SEQ ID NO: 850469 - RNA, 19 nt, Homo sapiens
ucugcucucucucuucauu

SEQ ID NO: 850470 - RNA, 19 nt, Homo sapiens
agaagaggaggaugauuau

SEQ ID NO: 850471 - RNA, 19 nt, Homo sapiens
aagguggcauuccuaauca

SEQ ID NO: 850472 - RNA, 19 nt, Homo sapiens
ggaauagcgcuccaguuac

SEQ ID NO: 850473 - RNA, 19 nt, Homo sapiens
ccguagugcuugucuuugu

SEQ ID NO: 850474 - RNA, 19 nt, Homo sapiens
cagaguuggcuaugccuuu

SEQ ID NO: 850475 - RNA, 19 nt, Homo sapiens
cguagugcuugucuuuguu

SEQ ID NO: 850476 - RNA, 19 nt, Homo sapiens
gaugugugcauuuggacaa

SEQ ID NO: 850477 - RNA, 19 nt, Homo sapiens
cgacgacgacgaagaagag

SEQ ID NO: 850478 - RNA, 19 nt, Homo sapiens
cacauccacucaccacauc

SEQ ID NO: 850479 - RNA, 19 nt, Homo sapiens
gggccuuccucgaugagau

SEQ ID NO: 850480 - RNA, 19 nt, Homo sapiens
gcauuggcauuauuuucaa

SEQ ID NO: 850481 - RNA, 19 nt, Homo sapiens
caucccaccuacagacuac

SEQ ID NO: 850482 - RNA, 19 nt, Homo sapiens
agaacuaugcugccacuuc

SEQ ID NO: 850483 - RNA, 19 nt, Homo sapiens
gggccguucagccugguua

SEQ ID NO: 850484 - RNA, 19 nt, Homo sapiens
caugaagguggcauuccua

SEQ ID NO: 850485 - RNA, 19 nt, Homo sapiens
cgaagaagaggaggaugau

SEQ ID NO: 850486 - RNA, 19 nt, Homo sapiens
acgaagaagaggaggauga

SEQ ID NO: 850487 - RNA, 19 nt, Homo sapiens
gcugggaugacgacgaaga

SEQ ID NO: 850488 - RNA, 19 nt, Homo sapiens
cuuccucgaugagaugaaa

SEQ ID NO: 850489 - RNA, 19 nt, Homo sapiens
cagccaaauuguugacacu

SEQ ID NO: 850490 - RNA, 19 nt, Homo sapiens
ucacauccacucaccacau

SEQ ID NO: 850491 - RNA, 19 nt, Homo sapiens
caucuucccagagaacuau

SEQ ID NO: 850492 - RNA, 19 nt, Homo sapiens
ccaugaagguggcauuccu

SEQ ID NO: 850493 - RNA, 19 nt, Homo sapiens
cgacgaagaagaggaggau

SEQ ID NO: 850494 - RNA, 19 nt, Homo sapiens
ugagaugaaacagugcuuu

SEQ ID NO: 850495 - RNA, 19 nt, Homo sapiens
ggaagagucugaugauuag

SEQ ID NO: 850496 - RNA, 19 nt, Homo sapiens
ggagagauuuaaagcaauu

SEQ ID NO: 850497 - RNA, 19 nt, Homo sapiens
guaaagcuuuggagauauu

SEQ ID NO: 850498 - RNA, 19 nt, Homo sapiens
gaaguuauuugccgaggau

SEQ ID NO: 850499 - RNA, 19 nt, Homo sapiens
ucauacaccuacugugaua

SEQ ID NO: 850500 - RNA, 19 nt, Homo sapiens
gaggaucugaugacgauua

SEQ ID NO: 850501 - RNA, 19 nt, Homo sapiens
ccaaagcgcaaagaaguua

SEQ ID NO: 850502 - RNA, 19 nt, Homo sapiens
gauccucuuugcauuugua

SEQ ID NO: 850503 - RNA, 19 nt, Homo sapiens
ugaaucauguuaccauuuc

SEQ ID NO: 850504 - RNA, 19 nt, Homo sapiens
aaggagagauuuaaagcaa

SEQ ID NO: 850505 - RNA, 19 nt, Homo sapiens
agagucugaugauuaguua

SEQ ID NO: 850506 - RNA, 19 nt, Homo sapiens
aggaagagucugaugauua

SEQ ID NO: 850507 - RNA, 19 nt, Homo sapiens
cauguuaccauuucuguuu

SEQ ID NO: 850508 - RNA, 19 nt, Homo sapiens
uuguaaagcuuuggagaua

SEQ ID NO: 850509 - RNA, 19 nt, Homo sapiens
acaccaaccuaauucaaau

SEQ ID NO: 850510 - RNA, 19 nt, Homo sapiens
gacugugaauacaacaaua

SEQ ID NO: 850511 - RNA, 19 nt, Homo sapiens
gaagggagagacugugaau

SEQ ID NO: 850512 - RNA, 19 nt, Homo sapiens
ggagagacugugaauacaa

SEQ ID NO: 850513 - RNA, 19 nt, Homo sapiens
caauaucauucuccuucaa

SEQ ID NO: 850514 - RNA, 19 nt, Homo sapiens
gagagacugugaauacaac

SEQ ID NO: 850515 - RNA, 19 nt, Homo sapiens
ccgaggaucugaugacgau

SEQ ID NO: 850516 - RNA, 19 nt, Homo sapiens
ggagauauugaaucauguu

SEQ ID NO: 850517 - RNA, 19 nt, Homo sapiens
gggagagacugugaauaca

SEQ ID NO: 850518 - RNA, 19 nt, Homo sapiens
gaauugaaaggauccaaag

SEQ ID NO: 850519 - RNA, 19 nt, Homo sapiens
caaauguguuguugaagcu

SEQ ID NO: 850520 - RNA, 19 nt, Homo sapiens
uuggagauauugaaucaug

SEQ ID NO: 850521 - RNA, 19 nt, Homo sapiens
caaaggauuauugcacauu

SEQ ID NO: 850522 - RNA, 19 nt, Homo sapiens
gggcacgagguaaaucuuu

SEQ ID NO: 850523 - RNA, 19 nt, Homo sapiens
caccaugaaucuuccaaag

SEQ ID NO: 850524 - RNA, 19 nt, Homo sapiens
gguaaaucuuuucugcuua

SEQ ID NO: 850525 - RNA, 19 nt, Homo sapiens
gauauugaaucauguuacc

SEQ ID NO: 850526 - RNA, 19 nt, Homo sapiens
ccaaaggauuauugcacau

SEQ ID NO: 850527 - RNA, 19 nt, Homo sapiens
ccgaugcaaguauuucaua

SEQ ID NO: 850528 - RNA, 19 nt, Homo sapiens
uuucauacaccuacuguga

SEQ ID NO: 850529 - RNA, 19 nt, Homo sapiens
acaauaucauucuccuuca

SEQ ID NO: 850530 - RNA, 19 nt, Homo sapiens
gaucugaugacgauuacuc

SEQ ID NO: 850531 - RNA, 19 nt, Homo sapiens
cuuuggagauauugaauca

SEQ ID NO: 850532 - RNA, 19 nt, Homo sapiens
aaggaagagucugaugauu

SEQ ID NO: 850533 - RNA, 19 nt, Homo sapiens
aaaggaagagucugaugau

SEQ ID NO: 850534 - RNA, 19 nt, Homo sapiens
aagcucagaagcaguauug

SEQ ID NO: 850535 - RNA, 19 nt, Homo sapiens
ucugaugauuaguuacuga

SEQ ID NO: 850536 - RNA, 19 nt, Homo sapiens
uuacugauccucuuugcau

SEQ ID NO: 850537 - RNA, 19 nt, Homo sapiens
cugaugacgauuacucuuu

SEQ ID NO: 850538 - RNA, 19 nt, Homo sapiens
uguaaagcuuuggagauau

SEQ ID NO: 850539 - RNA, 19 nt, Homo sapiens
uacaccaaccuaauucaaa

SEQ ID NO: 850540 - RNA, 19 nt, Homo sapiens
ccuguuuucuuccauauuu

SEQ ID NO: 850541 - RNA, 19 nt, Homo sapiens
ggaaaauacaaauguguug

SEQ ID NO: 850542 - RNA, 19 nt, Homo sapiens
gucaacaccaugaaucuuc

SEQ ID NO: 850543 - RNA, 19 nt, Homo sapiens
caaggagagauuuaaagca

SEQ ID NO: 850544 - RNA, 19 nt, Homo sapiens
ugcaauacccaauuucaau

SEQ ID NO: 850545 - RNA, 19 nt, Homo sapiens
auacaccuacugugauaaa

SEQ ID NO: 850546 - RNA, 19 nt, Homo sapiens
ugaugacgauuacucuuuu

SEQ ID NO: 850547 - RNA, 19 nt, Homo sapiens
agaauugaaaggauccaaa

SEQ ID NO: 850548 - RNA, 19 nt, Homo sapiens
gaagcucagaagcaguauu

SEQ ID NO: 850549 - RNA, 19 nt, Homo sapiens
gaaucauguuaccauuucu

SEQ ID NO: 850550 - RNA, 19 nt, Homo sapiens
caacaauaucauucuccuu

SEQ ID NO: 850551 - RNA, 19 nt, Homo sapiens
ccaaggagagauuuaaagc

SEQ ID NO: 850552 - RNA, 19 nt, Homo sapiens
cuacaccaaccuaauucaa

SEQ ID NO: 850553 - RNA, 19 nt, Homo sapiens
gaaaaggaagagucugaug

SEQ ID NO: 850554 - RNA, 19 nt, Homo sapiens
uaacugucaacaccaugaa

SEQ ID NO: 850555 - RNA, 19 nt, Homo sapiens
cugauccucuuugcauuug

SEQ ID NO: 850556 - RNA, 19 nt, Homo sapiens
guuaaccccuguauagaau

SEQ ID NO: 850557 - RNA, 19 nt, Homo sapiens
guauugggucugcaacuca

SEQ ID NO: 850558 - RNA, 19 nt, Homo sapiens
agggagagacugugaauac

SEQ ID NO: 850559 - RNA, 19 nt, Homo sapiens
ggcacgagguaaaucuuuu

SEQ ID NO: 850560 - RNA, 19 nt, Homo sapiens
aagagucugaugauuaguu

SEQ ID NO: 850561 - RNA, 19 nt, Homo sapiens
gauaguaccucagcaaaca

SEQ ID NO: 850562 - RNA, 19 nt, Homo sapiens
ccaaggagguggagauugu

SEQ ID NO: 850563 - RNA, 19 nt, Homo sapiens
gauggcagccugacaauga

SEQ ID NO: 850564 - RNA, 19 nt, Homo sapiens
gaaccgagaguuaaagaug

SEQ ID NO: 850565 - RNA, 19 nt, Homo sapiens
ggacuggccagcacuaauu

SEQ ID NO: 850566 - RNA, 19 nt, Homo sapiens
ccauuaaccugcaagagaa

SEQ ID NO: 850567 - RNA, 19 nt, Homo sapiens
caaggagucuggagccuau

SEQ ID NO: 850568 - RNA, 19 nt, Homo sapiens
ggaauggccuucaggaaaa

SEQ ID NO: 850569 - RNA, 19 nt, Homo sapiens
ccacgaggacuucacauuu

SEQ ID NO: 850570 - RNA, 19 nt, Homo sapiens
gcacgccacugaaccacuu

SEQ ID NO: 850571 - RNA, 19 nt, Homo sapiens
ggacaucccugagauugca

SEQ ID NO: 850572 - RNA, 19 nt, Homo sapiens
gggaugagaucaagaagac

SEQ ID NO: 850573 - RNA, 19 nt, Homo sapiens
gaaacaagacccugauguc

SEQ ID NO: 850574 - RNA, 19 nt, Homo sapiens
gaagacagucccuccaugu

SEQ ID NO: 850575 - RNA, 19 nt, Homo sapiens
cacccaagcucaagaggaa

SEQ ID NO: 850576 - RNA, 19 nt, Homo sapiens
gaccagaaccgagaguuaa

SEQ ID NO: 850577 - RNA, 19 nt, Homo sapiens
ggauggagaucggcauaau

SEQ ID NO: 850578 - RNA, 19 nt, Homo sapiens
cacgaggacuucacauuug

SEQ ID NO: 850579 - RNA, 19 nt, Homo sapiens
cuaaggcacugcaagaugu

SEQ ID NO: 850580 - RNA, 19 nt, Homo sapiens
ggaagguccucuaugugau

SEQ ID NO: 850581 - RNA, 19 nt, Homo sapiens
gcaacucaguggcuaccaa

SEQ ID NO: 850582 - RNA, 19 nt, Homo sapiens
ggucacggcuggccuuuac

SEQ ID NO: 850583 - RNA, 19 nt, Homo sapiens
gauggagaucggcauaaua

SEQ ID NO: 850584 - RNA, 19 nt, Homo sapiens
gcgcuuggcucugguuaau

SEQ ID NO: 850585 - RNA, 19 nt, Homo sapiens
cuagaaagccacaugaaga

SEQ ID NO: 850586 - RNA, 19 nt, Homo sapiens
aaagugaccaugaugauga

SEQ ID NO: 850587 - RNA, 19 nt, Homo sapiens
ggaccaugccacccauuaa

SEQ ID NO: 850588 - RNA, 19 nt, Homo sapiens
gcaaagugaccaugaugau

SEQ ID NO: 850589 - RNA, 19 nt, Homo sapiens
gagcuuugguauccagguu

SEQ ID NO: 850590 - RNA, 19 nt, Homo sapiens
caacucacuuggcaaagca

SEQ ID NO: 850591 - RNA, 19 nt, Homo sapiens
ccacaugggcuccguuaug

SEQ ID NO: 850592 - RNA, 19 nt, Homo sapiens
uucuggagguuccuuauua

SEQ ID NO: 850593 - RNA, 19 nt, Homo sapiens
gcagaaagccccaggaaug

SEQ ID NO: 850594 - RNA, 19 nt, Homo sapiens
ccaagcugcucaaguccaa

SEQ ID NO: 850595 - RNA, 19 nt, Homo sapiens
gaaccucacccaagcucaa

SEQ ID NO: 850596 - RNA, 19 nt, Homo sapiens
gcagcacccuggcagaaag

SEQ ID NO: 850597 - RNA, 19 nt, Homo sapiens
uuaaagaugugguguacag

SEQ ID NO: 850598 - RNA, 19 nt, Homo sapiens
gaccacaugggcuccguua

SEQ ID NO: 850599 - RNA, 19 nt, Homo sapiens
ugaccagaaccgagaguua

SEQ ID NO: 850600 - RNA, 19 nt, Homo sapiens
ggaccucaauggacuucug

SEQ ID NO: 850601 - RNA, 19 nt, Homo sapiens
gagcagcugcagacacauu

SEQ ID NO: 850602 - RNA, 19 nt, Homo sapiens
gagggcagcaugaaagaga

SEQ ID NO: 850603 - RNA, 19 nt, Homo sapiens
gcccacagcaccugacauu

SEQ ID NO: 850604 - RNA, 19 nt, Homo sapiens
gaagguccucuaugugaug

SEQ ID NO: 850605 - RNA, 19 nt, Homo sapiens
cggaagguccucuauguga

SEQ ID NO: 850606 - RNA, 19 nt, Homo sapiens
gagcaaagugaccaugaug

SEQ ID NO: 850607 - RNA, 19 nt, Homo sapiens
ccacagcaccugacauuac

SEQ ID NO: 850608 - RNA, 19 nt, Homo sapiens
ugacaaccauaagaaacaa

SEQ ID NO: 850609 - RNA, 19 nt, Homo sapiens
guaccuggccuguggaugu

SEQ ID NO: 850610 - RNA, 19 nt, Homo sapiens
agcagugacucuagcauuu

SEQ ID NO: 850611 - RNA, 19 nt, Homo sapiens
ccgagcagcugcagacaca

SEQ ID NO: 850612 - RNA, 19 nt, Homo sapiens
ucuccaagcugcucaaguc

SEQ ID NO: 850613 - RNA, 19 nt, Homo sapiens
aaagaugugguguacagua

SEQ ID NO: 850614 - RNA, 19 nt, Homo sapiens
gcuuggcucugguuaaugg

SEQ ID NO: 850615 - RNA, 19 nt, Homo sapiens
agaagcaggucaucugucu

SEQ ID NO: 850616 - RNA, 19 nt, Homo sapiens
aagaugugguguacaguau

SEQ ID NO: 850617 - RNA, 19 nt, Homo sapiens
acacaacucacuuggcaaa

SEQ ID NO: 850618 - RNA, 19 nt, Homo sapiens
ugauggagcugcugcaaaa

SEQ ID NO: 850619 - RNA, 19 nt, Homo sapiens
cgauggcuaugucaaguuc

SEQ ID NO: 850620 - RNA, 19 nt, Homo sapiens
caguggcccugcugcauga

SEQ ID NO: 850621 - RNA, 19 nt, Homo sapiens
gugguagucagaagguuua

SEQ ID NO: 850622 - RNA, 19 nt, Homo sapiens
aacggaagguccucuaugu

SEQ ID NO: 850623 - RNA, 19 nt, Homo sapiens
caacggaagguccucuaug

SEQ ID NO: 850624 - RNA, 19 nt, Homo sapiens
ggaccucucagcagaauac

SEQ ID NO: 850625 - RNA, 19 nt, Homo sapiens
gaggagagcagcccaacag

SEQ ID NO: 850626 - RNA, 19 nt, Homo sapiens
gccgucaccuccagcauca

SEQ ID NO: 850627 - RNA, 19 nt, Homo sapiens
gcacugucgucagcuguag

SEQ ID NO: 850628 - RNA, 19 nt, Homo sapiens
gugcugagcuuugguaucc

SEQ ID NO: 850629 - RNA, 19 nt, Homo sapiens
ggacacaggaauacuugca

SEQ ID NO: 850630 - RNA, 19 nt, Homo sapiens
caaagugaccaugaugaug

SEQ ID NO: 850631 - RNA, 19 nt, Homo sapiens
aggaauggccuucaggaaa

SEQ ID NO: 850632 - RNA, 19 nt, Homo sapiens
gaguuaaagauguggugua

SEQ ID NO: 850633 - RNA, 19 nt, Homo sapiens
cagguacagcgcaucguua

SEQ ID NO: 850634 - RNA, 19 nt, Homo sapiens
gcuagaaagccacaugaag

SEQ ID NO: 850635 - RNA, 19 nt, Homo sapiens
aggagcagcugacacaaca

SEQ ID NO: 850636 - RNA, 19 nt, Homo sapiens
cugaggagcugaccuugag

SEQ ID NO: 850637 - RNA, 19 nt, Homo sapiens
gcaacggaagguccucuau

SEQ ID NO: 850638 - RNA, 19 nt, Homo sapiens
gaguggaaaccucaugaug

SEQ ID NO: 850639 - RNA, 19 nt, Homo sapiens
cacaugggcuccguuaugg

SEQ ID NO: 850640 - RNA, 19 nt, Homo sapiens
guacagcgcaucguuaagg

SEQ ID NO: 850641 - RNA, 19 nt, Homo sapiens
ugagcaaagugaccaugau

SEQ ID NO: 850642 - RNA, 19 nt, Homo sapiens
agaccaagcccaaguugau

SEQ ID NO: 850643 - RNA, 19 nt, Homo sapiens
ccgcucugcucaggugaua

SEQ ID NO: 850644 - RNA, 19 nt, Homo sapiens
gauaucuucagcucaguga

SEQ ID NO: 850645 - RNA, 19 nt, Homo sapiens
gcagggcuucauuguggua

SEQ ID NO: 850646 - RNA, 19 nt, Homo sapiens
caaccugauugcugugucu

SEQ ID NO: 850647 - RNA, 19 nt, Homo sapiens
gcagcuggcaucugaccuu

SEQ ID NO: 850648 - RNA, 19 nt, Homo sapiens
ggaaaagcaagaaggauga

SEQ ID NO: 850649 - RNA, 19 nt, Homo sapiens
aguagcagcagcucccuua

SEQ ID NO: 850650 - RNA, 19 nt, Homo sapiens
gcagcuagaaagccacaug

SEQ ID NO: 850651 - RNA, 19 nt, Homo sapiens
cccauuaaccugcaagaga

SEQ ID NO: 850652 - RNA, 19 nt, Homo sapiens
guagaacgugcccuugaga

SEQ ID NO: 850653 - RNA, 19 nt, Homo sapiens
gcaggucaucugucucuca

SEQ ID NO: 850654 - RNA, 19 nt, Homo sapiens
cauucgggcugccaacaau

SEQ ID NO: 850655 - RNA, 19 nt, Homo sapiens
gaccuuggcacucgaacug

SEQ ID NO: 850656 - RNA, 19 nt, Homo sapiens
gcagcagggccaccucaau

SEQ ID NO: 850657 - RNA, 19 nt, Homo sapiens
gagaccaagcccaaguuga

SEQ ID NO: 850658 - RNA, 19 nt, Homo sapiens
gcagugacucuagcauuuc

SEQ ID NO: 850659 - RNA, 19 nt, Homo sapiens
cagugacucuagcauuuca

SEQ ID NO: 850660 - RNA, 19 nt, Homo sapiens
ugaaccuggugcuguaugu

SEQ ID NO: 850661 - RNA, 19 nt, Homo sapiens
ugaagaagcuguaaagaaa

SEQ ID NO: 850662 - RNA, 19 nt, Homo sapiens
gaaggucacuguccauuuc

SEQ ID NO: 850663 - RNA, 19 nt, Homo sapiens
uaaggaagaugauucagaa

SEQ ID NO: 850664 - RNA, 19 nt, Homo sapiens
ccaacugguuugccuauaa

SEQ ID NO: 850665 - RNA, 19 nt, Homo sapiens
ggaagaagaugaggacagu

SEQ ID NO: 850666 - RNA, 19 nt, Homo sapiens
cgaagaaacugggaaagga

SEQ ID NO: 850667 - RNA, 19 nt, Homo sapiens
ggaagaugauucagaagca

SEQ ID NO: 850668 - RNA, 19 nt, Homo sapiens
ggagggaguuaacaaguuc

SEQ ID NO: 850669 - RNA, 19 nt, Homo sapiens
gaagaugaggacagugaua

SEQ ID NO: 850670 - RNA, 19 nt, Homo sapiens
agagugaggucaagccuuu

SEQ ID NO: 850671 - RNA, 19 nt, Homo sapiens
ggaagucaauuugcagaug

SEQ ID NO: 850672 - RNA, 19 nt, Homo sapiens
ggacacagaggaagaggaa

SEQ ID NO: 850673 - RNA, 19 nt, Homo sapiens
ggaggaagaugaggaugug

SEQ ID NO: 850674 - RNA, 19 nt, Homo sapiens
gaguuaacaaguucucuua

SEQ ID NO: 850675 - RNA, 19 nt, Homo sapiens
gcagggaagucaauuugca

SEQ ID NO: 850676 - RNA, 19 nt, Homo sapiens
ggaggaggacgaugaagaa

SEQ ID NO: 850677 - RNA, 19 nt, Homo sapiens
caacugguuugccuauaau

SEQ ID NO: 850678 - RNA, 19 nt, Homo sapiens
ggaggaagaugaggacagu

SEQ ID NO: 850679 - RNA, 19 nt, Homo sapiens
ggacagugacucuggauca

SEQ ID NO: 850680 - RNA, 19 nt, Homo sapiens
ggaagaggaagaugaggaa

SEQ ID NO: 850681 - RNA, 19 nt, Homo sapiens
ggagaaagccgaggaagag

SEQ ID NO: 850682 - RNA, 19 nt, Homo sapiens
gaaaagagacagaggaaga

SEQ ID NO: 850683 - RNA, 19 nt, Homo sapiens
guuaacaaguucucuuauc

SEQ ID NO: 850684 - RNA, 19 nt, Homo sapiens
agaggaagaugaggaagaa

SEQ ID NO: 850685 - RNA, 19 nt, Homo sapiens
ggaggacgaugaagaagcu

SEQ ID NO: 850686 - RNA, 19 nt, Homo sapiens
aaagaaagaagcucacaga

SEQ ID NO: 850687 - RNA, 19 nt, Homo sapiens
ggaaaaggcacacgaagaa

SEQ ID NO: 850688 - RNA, 19 nt, Homo sapiens
aagaagcuguaaagaaaga

SEQ ID NO: 850689 - RNA, 19 nt, Homo sapiens
ggauaaggaagaugauuca

SEQ ID NO: 850690 - RNA, 19 nt, Homo sapiens
gaagcagccuuaggagaag

SEQ ID NO: 850691 - RNA, 19 nt, Homo sapiens
agaagcagccuuaggagaa

SEQ ID NO: 850692 - RNA, 19 nt, Homo sapiens
gaaguaaaggagccaggaa

SEQ ID NO: 850693 - RNA, 19 nt, Homo sapiens
gggcagggaagucaauuug

SEQ ID NO: 850694 - RNA, 19 nt, Homo sapiens
ggacgaugaagaagcugua

SEQ ID NO: 850695 - RNA, 19 nt, Homo sapiens
cuaaguguggguuuauaua

SEQ ID NO: 850696 - RNA, 19 nt, Homo sapiens
ggaagagggaguugcugaa

SEQ ID NO: 850697 - RNA, 19 nt, Homo sapiens
ggauguggauagugaggau

SEQ ID NO: 850698 - RNA, 19 nt, Homo sapiens
gaagaugaggauguggaua

SEQ ID NO: 850699 - RNA, 19 nt, Homo sapiens
cagaggaggaggaagauga

SEQ ID NO: 850700 - RNA, 19 nt, Homo sapiens
ggacacagaggaggaggaa

SEQ ID NO: 850701 - RNA, 19 nt, Homo sapiens
gaacagaaagaaguaaagg

SEQ ID NO: 850702 - RNA, 19 nt, Homo sapiens
agaggaggcugaagacagu

SEQ ID NO: 850703 - RNA, 19 nt, Homo sapiens
ccucaggaacccaccuuua

SEQ ID NO: 850704 - RNA, 19 nt, Homo sapiens
gcucacagaaccucuacuu

SEQ ID NO: 850705 - RNA, 19 nt, Homo sapiens
gaagcucacagaaccucua

SEQ ID NO: 850706 - RNA, 19 nt, Homo sapiens
cugguuugccuauaauuua

SEQ ID NO: 850707 - RNA, 19 nt, Homo sapiens
acacagaggaggaggaaga

SEQ ID NO: 850708 - RNA, 19 nt, Homo sapiens
ggaagaugaggaagaagau

SEQ ID NO: 850709 - RNA, 19 nt, Homo sapiens
gagaggacacagaggaaga

SEQ ID NO: 850710 - RNA, 19 nt, Homo sapiens
ugagaaggauggagaagcu

SEQ ID NO: 850711 - RNA, 19 nt, Homo sapiens
gaagaagcuguaaagaaag

SEQ ID NO: 850712 - RNA, 19 nt, Homo sapiens
ggaggaggaggacgaugaa

SEQ ID NO: 850713 - RNA, 19 nt, Homo sapiens
gagaaggucacuguccauu

SEQ ID NO: 850714 - RNA, 19 nt, Homo sapiens
cuauguaccuggagagaag

SEQ ID NO: 850715 - RNA, 19 nt, Homo sapiens
ggauggagaagcugagugu

SEQ ID NO: 850716 - RNA, 19 nt, Homo sapiens
ggaguuaacaaguucucuu

SEQ ID NO: 850717 - RNA, 19 nt, Homo sapiens
ugaugaugauggcauguau

SEQ ID NO: 850718 - RNA, 19 nt, Homo sapiens
ccgaguggccaucuaugua

SEQ ID NO: 850719 - RNA, 19 nt, Homo sapiens
cagaggaagaggaagauga

SEQ ID NO: 850720 - RNA, 19 nt, Homo sapiens
gaagaggagggaguuaaca

SEQ ID NO: 850721 - RNA, 19 nt, Homo sapiens
acacugcaagguucugaua

SEQ ID NO: 850722 - RNA, 19 nt, Homo sapiens
ucucccagccuucugauaa

SEQ ID NO: 850723 - RNA, 19 nt, Homo sapiens
gugaggauaaggaagauga

SEQ ID NO: 850724 - RNA, 19 nt, Homo sapiens
ggauagugaggauaaggaa

SEQ ID NO: 850725 - RNA, 19 nt, Homo sapiens
augaggauguggauaguga

SEQ ID NO: 850726 - RNA, 19 nt, Homo sapiens
gaaagagaagcugagacuu

SEQ ID NO: 850727 - RNA, 19 nt, Homo sapiens
aagaagaugaggacaguga

SEQ ID NO: 850728 - RNA, 19 nt, Homo sapiens
gagaggcguccgaggagaa

SEQ ID NO: 850729 - RNA, 19 nt, Homo sapiens
aggagggaguuaacaaguu

SEQ ID NO: 850730 - RNA, 19 nt, Homo sapiens
aagagggaguugcugaaga

SEQ ID NO: 850731 - RNA, 19 nt, Homo sapiens
gaagagggaguugcugaag

SEQ ID NO: 850732 - RNA, 19 nt, Homo sapiens
ugauucagaagcagccuua

SEQ ID NO: 850733 - RNA, 19 nt, Homo sapiens
gaugaaagagaagcugaga

SEQ ID NO: 850734 - RNA, 19 nt, Homo sapiens
acacagaggaagaggaaga

SEQ ID NO: 850735 - RNA, 19 nt, Homo sapiens
gaugaagaagcuguaaaga

SEQ ID NO: 850736 - RNA, 19 nt, Homo sapiens
gaggagggaguuaacaagu

SEQ ID NO: 850737 - RNA, 19 nt, Homo sapiens
gaggauaaggaagaugauu

SEQ ID NO: 850738 - RNA, 19 nt, Homo sapiens
ugaaagagaagcugagacu

SEQ ID NO: 850739 - RNA, 19 nt, Homo sapiens
gugaugaagaggagaguga

SEQ ID NO: 850740 - RNA, 19 nt, Homo sapiens
agagggaguugcugaagag

SEQ ID NO: 850741 - RNA, 19 nt, Homo sapiens
ggaagaugaggauguggau

SEQ ID NO: 850742 - RNA, 19 nt, Homo sapiens
ggaggaggaagaugaggau

SEQ ID NO: 850743 - RNA, 19 nt, Homo sapiens
cggaggaggaggaagauga

SEQ ID NO: 850744 - RNA, 19 nt, Homo sapiens
gaagaugaggaagaagaug

SEQ ID NO: 850745 - RNA, 19 nt, Homo sapiens
caucccaguuguugaucuu

SEQ ID NO: 850746 - RNA, 19 nt, Homo sapiens
cugcaagguucugauaaga

SEQ ID NO: 850747 - RNA, 19 nt, Homo sapiens
ggaggagaaagccgaggaa

SEQ ID NO: 850748 - RNA, 19 nt, Homo sapiens
ggacacugcaagguucuga

SEQ ID NO: 850749 - RNA, 19 nt, Homo sapiens
acacggaggaggaggaaga

SEQ ID NO: 850750 - RNA, 19 nt, Homo sapiens
ggacacggaggaggaggaa

SEQ ID NO: 850751 - RNA, 19 nt, Homo sapiens
caggaucagccgaggauga

SEQ ID NO: 850752 - RNA, 19 nt, Homo sapiens
gaggauaaaagaacagaaa

SEQ ID NO: 850753 - RNA, 19 nt, Homo sapiens
augaagaagcuguaaagaa

SEQ ID NO: 850754 - RNA, 19 nt, Homo sapiens
ggcaaccagugucccuaga

SEQ ID NO: 850755 - RNA, 19 nt, Homo sapiens
agaaggucacuguccauuu

SEQ ID NO: 850756 - RNA, 19 nt, Homo sapiens
gaucagccgaggaugaaag

SEQ ID NO: 850757 - RNA, 19 nt, Homo sapiens
aagaugaggaagaagauga

SEQ ID NO: 850758 - RNA, 19 nt, Homo sapiens
cugaaggccuggguguauu

SEQ ID NO: 850759 - RNA, 19 nt, Homo sapiens
acacgaagaaacugggaaa

SEQ ID NO: 850760 - RNA, 19 nt, Homo sapiens
agaaagaagcucacagaac

SEQ ID NO: 850761 - RNA, 19 nt, Homo sapiens
ccaaugagcugcccaugaa

SEQ ID NO: 850762 - RNA, 19 nt, Homo sapiens
gagggaagaugaagccuaa

SEQ ID NO: 850763 - RNA, 19 nt, Homo sapiens
ugacucagcuguuucuaug

SEQ ID NO: 850764 - RNA, 19 nt, Homo sapiens
gaugaagccuaaacugaug

SEQ ID NO: 850765 - RNA, 19 nt, Homo sapiens
acaaguacauggugacuga

SEQ ID NO: 850766 - RNA, 19 nt, Homo sapiens
ggacaucgccuccuucuac

SEQ ID NO: 850767 - RNA, 19 nt, Homo sapiens
caacuggucuggcaacuac

SEQ ID NO: 850768 - RNA, 19 nt, Homo sapiens
gaagaugaagccuaaacug

SEQ ID NO: 850769 - RNA, 19 nt, Homo sapiens
gacaaugcccggaguuuca

SEQ ID NO: 850770 - RNA, 19 nt, Homo sapiens
ugaacuaccugcccacucu

SEQ ID NO: 850771 - RNA, 19 nt, Homo sapiens
cuacgucgcugucaugaac

SEQ ID NO: 850772 - RNA, 19 nt, Homo sapiens
ggagaucugccucaaugga

SEQ ID NO: 850773 - RNA, 19 nt, Homo sapiens
gagcugcccaugaaugaga

SEQ ID NO: 850774 - RNA, 19 nt, Homo sapiens
ugacugaacgcgccaccua

SEQ ID NO: 850775 - RNA, 19 nt, Homo sapiens
ggacaaugcccggaguuuc

SEQ ID NO: 850776 - RNA, 19 nt, Homo sapiens
gagaucugccucaauggaa

SEQ ID NO: 850777 - RNA, 19 nt, Homo sapiens
ggaauacggcgacuugcau

SEQ ID NO: 850778 - RNA, 19 nt, Homo sapiens
gcucgagaccugaccaaga

SEQ ID NO: 850779 - RNA, 19 nt, Homo sapiens
ccugaaggcucuacucaac

SEQ ID NO: 850780 - RNA, 19 nt, Homo sapiens
caauggagaucugccucaa

SEQ ID NO: 850781 - RNA, 19 nt, Homo sapiens
aagaugaagccuaaacuga

SEQ ID NO: 850782 - RNA, 19 nt, Homo sapiens
caacauggacuggcguuca

SEQ ID NO: 850783 - RNA, 19 nt, Homo sapiens
ggaccagacccacuucuac

SEQ ID NO: 850784 - RNA, 19 nt, Homo sapiens
caaccaagagacaccaaug

SEQ ID NO: 850785 - RNA, 19 nt, Homo sapiens
ugacaaccauacccacucu

SEQ ID NO: 850786 - RNA, 19 nt, Homo sapiens
ugacacacccaccuucuca

SEQ ID NO: 850787 - RNA, 19 nt, Homo sapiens
auggagaucugccucaaug

SEQ ID NO: 850788 - RNA, 19 nt, Homo sapiens
gaccugaccaagaucuuug

SEQ ID NO: 850789 - RNA, 19 nt, Homo sapiens
gccaaugagcugcccauga

SEQ ID NO: 850790 - RNA, 19 nt, Homo sapiens
ugaaggcucuacucaacgu

SEQ ID NO: 850791 - RNA, 19 nt, Homo sapiens
aaagggcccaggguuauaa

SEQ ID NO: 850792 - RNA, 19 nt, Homo sapiens
cucgagaccugaccaagau

SEQ ID NO: 850793 - RNA, 19 nt, Homo sapiens
ggacccucaccaacaauga

SEQ ID NO: 850794 - RNA, 19 nt, Homo sapiens
gaccugaaggcucuacuca

SEQ ID NO: 850795 - RNA, 19 nt, Homo sapiens
gcagcuccaucccaucaac

SEQ ID NO: 850796 - RNA, 19 nt, Homo sapiens
ggaagaugaagccuaaacu

SEQ ID NO: 850797 - RNA, 19 nt, Homo sapiens
gcacagcagccuggacauc

SEQ ID NO: 850798 - RNA, 19 nt, Homo sapiens
acucugacauccaggugaa

SEQ ID NO: 850799 - RNA, 19 nt, Homo sapiens
gagcugggcguggucaugu

SEQ ID NO: 850800 - RNA, 19 nt, Homo sapiens
gugucaaccacaacaagua

SEQ ID NO: 850801 - RNA, 19 nt, Homo sapiens
agacaccaauggagaucug

SEQ ID NO: 850802 - RNA, 19 nt, Homo sapiens
ugcagacccuggcaccaaa

SEQ ID NO: 850803 - RNA, 19 nt, Homo sapiens
cuaugacccuugcgaagca

SEQ ID NO: 850804 - RNA, 19 nt, Homo sapiens
cuacgagcguggcgucaag

SEQ ID NO: 850805 - RNA, 19 nt, Homo sapiens
ggaaggcugcggaaaagaa

SEQ ID NO: 850806 - RNA, 19 nt, Homo sapiens
agaugaagccuaaacugau

SEQ ID NO: 850807 - RNA, 19 nt, Homo sapiens
acuggacccucaccaacaa

SEQ ID NO: 850808 - RNA, 19 nt, Homo sapiens
ggacuccccuuacauucau

SEQ ID NO: 850809 - RNA, 19 nt, Homo sapiens
caucuacgucgcugucaug

SEQ ID NO: 850810 - RNA, 19 nt, Homo sapiens
agccuaaacugauguacca

SEQ ID NO: 850811 - RNA, 19 nt, Homo sapiens
ucaacgugguggacaaugc

SEQ ID NO: 850812 - RNA, 19 nt, Homo sapiens
gacaucgccuccuucuacu

SEQ ID NO: 850813 - RNA, 19 nt, Homo sapiens
gggaauacggcgacuugca

SEQ ID NO: 850814 - RNA, 19 nt, Homo sapiens
acaaccauacccacucuga

SEQ ID NO: 850815 - RNA, 19 nt, Homo sapiens
gggaagaugaagccuaaac

SEQ ID NO: 850816 - RNA, 19 nt, Homo sapiens
gaugaggcccaggcucgaa

SEQ ID NO: 850817 - RNA, 19 nt, Homo sapiens
acccauggcguccugcaua

SEQ ID NO: 850818 - RNA, 19 nt, Homo sapiens
ccaacuggucuggcaacua

SEQ ID NO: 850819 - RNA, 19 nt, Homo sapiens
ucaccugggcucugcguau

SEQ ID NO: 850820 - RNA, 19 nt, Homo sapiens
gcccaugaaugagauugag

SEQ ID NO: 850821 - RNA, 19 nt, Homo sapiens
ccaaugauguugcgucuaa

SEQ ID NO: 850822 - RNA, 19 nt, Homo sapiens
caaagcaacuguuaucaga

SEQ ID NO: 850823 - RNA, 19 nt, Homo sapiens
guacauccuuugucacuug

SEQ ID NO: 850824 - RNA, 19 nt, Homo sapiens
gcacaaagcaacuguuauc

SEQ ID NO: 850825 - RNA, 19 nt, Homo sapiens
ggaggaauuuggcuacaau

SEQ ID NO: 850826 - RNA, 19 nt, Homo sapiens
aaacuacuaugcaagaaug

SEQ ID NO: 850827 - RNA, 19 nt, Homo sapiens
agacgaagcgcaaguauga

SEQ ID NO: 850828 - RNA, 19 nt, Homo sapiens
ggacccaaccucaaugaaa

SEQ ID NO: 850829 - RNA, 19 nt, Homo sapiens
ggacaugguacauccuuug

SEQ ID NO: 850830 - RNA, 19 nt, Homo sapiens
gcuuagagcccaagaagau

SEQ ID NO: 850831 - RNA, 19 nt, Homo sapiens
caugguacauccuuuguca

SEQ ID NO: 850832 - RNA, 19 nt, Homo sapiens
gugcacaaagcaacuguua

SEQ ID NO: 850833 - RNA, 19 nt, Homo sapiens
ccaauggcaucacucuuca

SEQ ID NO: 850834 - RNA, 19 nt, Homo sapiens
gaaacuacuaugcaagaau

SEQ ID NO: 850835 - RNA, 19 nt, Homo sapiens
cacagaaacuacuaugcaa

SEQ ID NO: 850836 - RNA, 19 nt, Homo sapiens
gacccaaccucaaugaaac

SEQ ID NO: 850837 - RNA, 19 nt, Homo sapiens
gccgugaacuucuuugucu

SEQ ID NO: 850838 - RNA, 19 nt, Homo sapiens
gcuaggagccgugaacuuc

SEQ ID NO: 850839 - RNA, 19 nt, Homo sapiens
ucucuagcaucaacacauu

SEQ ID NO: 850840 - RNA, 19 nt, Homo sapiens
cagaaacuacuaugcaaga

SEQ ID NO: 850841 - RNA, 19 nt, Homo sapiens
gcagagacacagaaacuac

SEQ ID NO: 850842 - RNA, 19 nt, Homo sapiens
ccacccacccaguuuaauu

SEQ ID NO: 850843 - RNA, 19 nt, Homo sapiens
aagacacgcucaugacugu

SEQ ID NO: 850844 - RNA, 19 nt, Homo sapiens
ucaccaagaccauggaaga

SEQ ID NO: 850845 - RNA, 19 nt, Homo sapiens
ggaaggcagccacaaugga

SEQ ID NO: 850846 - RNA, 19 nt, Homo sapiens
ucaaggugaugcacaagca

SEQ ID NO: 850847 - RNA, 19 nt, Homo sapiens
ggaauuuggcuacaaugca

SEQ ID NO: 850848 - RNA, 19 nt, Homo sapiens
gcaucaacaccuauaagug

SEQ ID NO: 850849 - RNA, 19 nt, Homo sapiens
uugcuggccuugcaucuga

SEQ ID NO: 850850 - RNA, 19 nt, Homo sapiens
ccaaugacagagccugaaa

SEQ ID NO: 850851 - RNA, 19 nt, Homo sapiens
agaaguugcugcccugucu

SEQ ID NO: 850852 - RNA, 19 nt, Homo sapiens
cauugugucugguggcuau

SEQ ID NO: 850853 - RNA, 19 nt, Homo sapiens
ucuaauacccuuugucucu

SEQ ID NO: 850854 - RNA, 19 nt, Homo sapiens
ugugcucccugaccaauga

SEQ ID NO: 850855 - RNA, 19 nt, Homo sapiens
cugcugcucuuccacaaug

SEQ ID NO: 850856 - RNA, 19 nt, Homo sapiens
caacuguuaucagaacgau

SEQ ID NO: 850857 - RNA, 19 nt, Homo sapiens
gaaggggacugggaccaaa

SEQ ID NO: 850858 - RNA, 19 nt, Homo sapiens
ggaagacacgcucaugacu

SEQ ID NO: 850859 - RNA, 19 nt, Homo sapiens
acacagaaacuacuaugca

SEQ ID NO: 850860 - RNA, 19 nt, Homo sapiens
ccaguuuaauugugcuuag

SEQ ID NO: 850861 - RNA, 19 nt, Homo sapiens
agaaacuacuaugcaagaa

SEQ ID NO: 850862 - RNA, 19 nt, Homo sapiens
gagacgaagcgcaaguaug

SEQ ID NO: 850863 - RNA, 19 nt, Homo sapiens
gggcauugcuggagaaaag

SEQ ID NO: 850864 - RNA, 19 nt, Homo sapiens
acuguuaucagaacgauuu

SEQ ID NO: 850865 - RNA, 19 nt, Homo sapiens
uaggagccgugaacuucuu

SEQ ID NO: 850866 - RNA, 19 nt, Homo sapiens
gagaaaaguuugacaucgu

SEQ ID NO: 850867 - RNA, 19 nt, Homo sapiens
ccacaauggagaucccuau

SEQ ID NO: 850868 - RNA, 19 nt, Homo sapiens
aagcaacuguuaucagaac

SEQ ID NO: 850869 - RNA, 19 nt, Homo sapiens
aaugauguugcgucuaaua

SEQ ID NO: 850870 - RNA, 19 nt, Homo sapiens
gggcuucauucccagaucu

SEQ ID NO: 850871 - RNA, 19 nt, Homo sapiens
gaaguugcugcccugucua

SEQ ID NO: 850872 - RNA, 19 nt, Homo sapiens
gacacgcucaugacuguga

SEQ ID NO: 850873 - RNA, 19 nt, Homo sapiens
ucacccacccacccaguuu

SEQ ID NO: 850874 - RNA, 19 nt, Homo sapiens
ugacagagccugaaaaugc

SEQ ID NO: 850875 - RNA, 19 nt, Homo sapiens
gugaacuucuuugucucua

SEQ ID NO: 850876 - RNA, 19 nt, Homo sapiens
caaugcagagacacagaaa

SEQ ID NO: 850877 - RNA, 19 nt, Homo sapiens
ggagauuggacaugguaca

SEQ ID NO: 850878 - RNA, 19 nt, Homo sapiens
ccaucaagcucaaguuccu

SEQ ID NO: 850879 - RNA, 19 nt, Homo sapiens
ggcaucaacaccuauaagu

SEQ ID NO: 850880 - RNA, 19 nt, Homo sapiens
caguuuaauugugcuuaga

SEQ ID NO: 850881 - RNA, 19 nt, Homo sapiens
gguacauccuuugucacuu

SEQ ID NO: 850882 - RNA, 19 nt, Homo sapiens
ugcacugggugaugccuuu

SEQ ID NO: 850883 - RNA, 19 nt, Homo sapiens
gaagcgcaaguaugagagu

SEQ ID NO: 850884 - RNA, 19 nt, Homo sapiens
uugcugcccugucuaucuu

SEQ ID NO: 850885 - RNA, 19 nt, Homo sapiens
ggacacguggucgacuuga

SEQ ID NO: 850886 - RNA, 19 nt, Homo sapiens
uaugaugccuaccgaacag

SEQ ID NO: 850887 - RNA, 19 nt, Homo sapiens
uggcuacaaugcagagaca

SEQ ID NO: 850888 - RNA, 19 nt, Homo sapiens
gugagacgaagcgcaagua

SEQ ID NO: 850889 - RNA, 19 nt, Homo sapiens
cacccacccaguuuaauug

SEQ ID NO: 850890 - RNA, 19 nt, Homo sapiens
acacguggucgacuugaga

SEQ ID NO: 850891 - RNA, 19 nt, Homo sapiens
gggaaggcagccacaaugg

SEQ ID NO: 850892 - RNA, 19 nt, Homo sapiens
gagacacagaaacuacuau

SEQ ID NO: 850893 - RNA, 19 nt, Homo sapiens
agagacacagaaacuacua

SEQ ID NO: 850894 - RNA, 19 nt, Homo sapiens
uuagagcccaagaagauug

SEQ ID NO: 850895 - RNA, 19 nt, Homo sapiens
gugcuuagagcccaagaag

SEQ ID NO: 850896 - RNA, 19 nt, Homo sapiens
ucucacagcaccacuccuu

SEQ ID NO: 850897 - RNA, 19 nt, Homo sapiens
gacaugguacauccuuugu

SEQ ID NO: 850898 - RNA, 19 nt, Homo sapiens
gaaacccuccuggcuagag

SEQ ID NO: 850899 - RNA, 19 nt, Homo sapiens
ggccaucaagcucaaguuc

SEQ ID NO: 850900 - RNA, 19 nt, Homo sapiens
ugaacuucuuugucucuag

SEQ ID NO: 850901 - RNA, 19 nt, Homo sapiens
agacacagaaacuacuaug

SEQ ID NO: 850902 - RNA, 19 nt, Homo sapiens
gggcaucaacaccuauaag

SEQ ID NO: 850903 - RNA, 19 nt, Homo sapiens
gcaacuguuaucagaacga

SEQ ID NO: 850904 - RNA, 19 nt, Homo sapiens
cacccacccacccaguuua

SEQ ID NO: 850905 - RNA, 19 nt, Homo sapiens
gcgugcccauugcagagaa

SEQ ID NO: 850906 - RNA, 19 nt, Homo sapiens
cgucuaauacccuuugucu

SEQ ID NO: 850907 - RNA, 19 nt, Homo sapiens
caucgggacaaguaugaga

SEQ ID NO: 850908 - RNA, 19 nt, Homo sapiens
gaagugaggugucauuauc

SEQ ID NO: 850909 - RNA, 19 nt, Homo sapiens
gacaacaucuacacaauga

SEQ ID NO: 850910 - RNA, 19 nt, Homo sapiens
uaacagugcuaacucaauu

SEQ ID NO: 850911 - RNA, 19 nt, Homo sapiens
gggaagaugccagaaauua

SEQ ID NO: 850912 - RNA, 19 nt, Homo sapiens
gaagaugccagaaauuaug

SEQ ID NO: 850913 - RNA, 19 nt, Homo sapiens
gagagacacuugugaacau

SEQ ID NO: 850914 - RNA, 19 nt, Homo sapiens
gaaauuaugcaagaaguga

SEQ ID NO: 850915 - RNA, 19 nt, Homo sapiens
caacauaaguggcauuagc

SEQ ID NO: 850916 - RNA, 19 nt, Homo sapiens
gaggaucaaugcagagaau

SEQ ID NO: 850917 - RNA, 19 nt, Homo sapiens
ggaagaugccagaaauuau

SEQ ID NO: 850918 - RNA, 19 nt, Homo sapiens
gaacuuccuccacuccuuu

SEQ ID NO: 850919 - RNA, 19 nt, Homo sapiens
caacaucuacacaaugauu

SEQ ID NO: 850920 - RNA, 19 nt, Homo sapiens
gcgggaagaugccagaaau

SEQ ID NO: 850921 - RNA, 19 nt, Homo sapiens
gaaaggagagacacuugug

SEQ ID NO: 850922 - RNA, 19 nt, Homo sapiens
caacaugggaggaucaaug

SEQ ID NO: 850923 - RNA, 19 nt, Homo sapiens
cuuuauacgucuacgaaua

SEQ ID NO: 850924 - RNA, 19 nt, Homo sapiens
ugccagaaauuaugcaaga

SEQ ID NO: 850925 - RNA, 19 nt, Homo sapiens
caagaagugaggugucauu

SEQ ID NO: 850926 - RNA, 19 nt, Homo sapiens
gugacaacaucuacacaau

SEQ ID NO: 850927 - RNA, 19 nt, Homo sapiens
gacccuggcccaauccuaa

SEQ ID NO: 850928 - RNA, 19 nt, Homo sapiens
cagaaauuaugcaagaagu

SEQ ID NO: 850929 - RNA, 19 nt, Homo sapiens
gaucaaugcagagaaugaa

SEQ ID NO: 850930 - RNA, 19 nt, Homo sapiens
ggaucaaugcagagaauga

SEQ ID NO: 850931 - RNA, 19 nt, Homo sapiens
caacaaauuccagugacaa

SEQ ID NO: 850932 - RNA, 19 nt, Homo sapiens
ggagagacacuugugaaca

SEQ ID NO: 850933 - RNA, 19 nt, Homo sapiens
cgacauagacggacuucca

SEQ ID NO: 850934 - RNA, 19 nt, Homo sapiens
ucaacaaauuccagugaca

SEQ ID NO: 850935 - RNA, 19 nt, Homo sapiens
ccuuucagaacgacaauua

SEQ ID NO: 850936 - RNA, 19 nt, Homo sapiens
gacaauuauucuccaagca

SEQ ID NO: 850937 - RNA, 19 nt, Homo sapiens
ugacaacaucuacacaaug

SEQ ID NO: 850938 - RNA, 19 nt, Homo sapiens
gcacagccuccaccucaca

SEQ ID NO: 850939 - RNA, 19 nt, Homo sapiens
gccagaaauuaugcaagaa

SEQ ID NO: 850940 - RNA, 19 nt, Homo sapiens
ugagagagcaggcauugca

SEQ ID NO: 850941 - RNA, 19 nt, Homo sapiens
aaacaucacguugggagaa

SEQ ID NO: 850942 - RNA, 19 nt, Homo sapiens
gcugagagagcaggcauug

SEQ ID NO: 850943 - RNA, 19 nt, Homo sapiens
caaauuccagugacaacau

SEQ ID NO: 850944 - RNA, 19 nt, Homo sapiens
agagacacuugugaacauu

SEQ ID NO: 850945 - RNA, 19 nt, Homo sapiens
ucuccaagcaugacgauga

SEQ ID NO: 850946 - RNA, 19 nt, Homo sapiens
gcauggagccacaccacau

SEQ ID NO: 850947 - RNA, 19 nt, Homo sapiens
gugcuaacucaauuccaua

SEQ ID NO: 850948 - RNA, 19 nt, Homo sapiens
gagccacaccacaugaaug

SEQ ID NO: 850949 - RNA, 19 nt, Homo sapiens
ccuccaggaacacccauua

SEQ ID NO: 850950 - RNA, 19 nt, Homo sapiens
ccucuucccugcaaaccau

SEQ ID NO: 850951 - RNA, 19 nt, Homo sapiens
gacauagacggacuuccaa

SEQ ID NO: 850952 - RNA, 19 nt, Homo sapiens
ucccgcagauucaacaaau

SEQ ID NO: 850953 - RNA, 19 nt, Homo sapiens
aagaagugaggugucauua

SEQ ID NO: 850954 - RNA, 19 nt, Homo sapiens
uaacaacauaaguggcauu

SEQ ID NO: 850955 - RNA, 19 nt, Homo sapiens
ccacaccacaugaauggau

SEQ ID NO: 850956 - RNA, 19 nt, Homo sapiens
ggagccacaccacaugaau

SEQ ID NO: 850957 - RNA, 19 nt, Homo sapiens
ccgcagauucaacaaauuc

SEQ ID NO: 850958 - RNA, 19 nt, Homo sapiens
cuaacucaauuccauacuc

SEQ ID NO: 850959 - RNA, 19 nt, Homo sapiens
ccaggaacacccauuaugc

SEQ ID NO: 850960 - RNA, 19 nt, Homo sapiens
aaaggagagacacuuguga

SEQ ID NO: 850961 - RNA, 19 nt, Homo sapiens
ccagaaauuaugcaagaag

SEQ ID NO: 850962 - RNA, 19 nt, Homo sapiens
cucaucaccugguaccuau

SEQ ID NO: 850963 - RNA, 19 nt, Homo sapiens
ccucaucaccugguaccua

SEQ ID NO: 850964 - RNA, 19 nt, Homo sapiens
agaagugaggugucauuau

SEQ ID NO: 850965 - RNA, 19 nt, Homo sapiens
ugcaagaagugagguguca

SEQ ID NO: 850966 - RNA, 19 nt, Homo sapiens
ggaggaucaaugcagagaa

SEQ ID NO: 850967 - RNA, 19 nt, Homo sapiens
auaaguggcauuagcaauc

SEQ ID NO: 850968 - RNA, 19 nt, Homo sapiens
aacaacauaaguggcauua

SEQ ID NO: 850969 - RNA, 19 nt, Homo sapiens
ugaaaggagagacacuugu

SEQ ID NO: 850970 - RNA, 19 nt, Homo sapiens
aaauuccagugacaacauc

SEQ ID NO: 850971 - RNA, 19 nt, Homo sapiens
caagcaugacgaugagugu

SEQ ID NO: 850972 - RNA, 19 nt, Homo sapiens
gcccagucccgcagauuca

SEQ ID NO: 850973 - RNA, 19 nt, Homo sapiens
aaggagagacacuugugaa

SEQ ID NO: 850974 - RNA, 19 nt, Homo sapiens
caucaccugguaccuaugu

SEQ ID NO: 850975 - RNA, 19 nt, Homo sapiens
gggaggaucaaugcagaga

SEQ ID NO: 850976 - RNA, 19 nt, Homo sapiens
gaagugaggugucauuauc

SEQ ID NO: 850977 - RNA, 19 nt, Homo sapiens
gacaacaucuacacaauga

SEQ ID NO: 850978 - RNA, 19 nt, Homo sapiens
uaacagugcuaacucaauu

SEQ ID NO: 850979 - RNA, 19 nt, Homo sapiens
ccucuaugcuuucuucuua

SEQ ID NO: 850980 - RNA, 19 nt, Homo sapiens
gggaagaugccagaaauua

SEQ ID NO: 850981 - RNA, 19 nt, Homo sapiens
caaucaaccucuaugcuuu

SEQ ID NO: 850982 - RNA, 19 nt, Homo sapiens
gaagaugccagaaauuaug

SEQ ID NO: 850983 - RNA, 19 nt, Homo sapiens
gagagacacuugugaacau

SEQ ID NO: 850984 - RNA, 19 nt, Homo sapiens
gaaauuaugcaagaaguga

SEQ ID NO: 850985 - RNA, 19 nt, Homo sapiens
caacauaaguggcauuagc

SEQ ID NO: 850986 - RNA, 19 nt, Homo sapiens
gaggaucaaugcagagaau

SEQ ID NO: 850987 - RNA, 19 nt, Homo sapiens
uacaaucguugguuucuuu

SEQ ID NO: 850988 - RNA, 19 nt, Homo sapiens
ggaagaugccagaaauuau

SEQ ID NO: 850989 - RNA, 19 nt, Homo sapiens
gaacuuccuccacuccuuu

SEQ ID NO: 850990 - RNA, 19 nt, Homo sapiens
caacaucuacacaaugauu

SEQ ID NO: 850991 - RNA, 19 nt, Homo sapiens
caaccucuaugcuuucuuc

SEQ ID NO: 850992 - RNA, 19 nt, Homo sapiens
gcgggaagaugccagaaau

SEQ ID NO: 850993 - RNA, 19 nt, Homo sapiens
gaaaggagagacacuugug

SEQ ID NO: 850994 - RNA, 19 nt, Homo sapiens
cuuuauacgucuacgaaua

SEQ ID NO: 850995 - RNA, 19 nt, Homo sapiens
caacaugggaggaucaaug

SEQ ID NO: 850996 - RNA, 19 nt, Homo sapiens
ugccagaaauuaugcaaga

SEQ ID NO: 850997 - RNA, 19 nt, Homo sapiens
gagcccacauugucuguag

SEQ ID NO: 850998 - RNA, 19 nt, Homo sapiens
caagaagugaggugucauu

SEQ ID NO: 850999 - RNA, 19 nt, Homo sapiens
ccaaucaaccucuaugcuu

SEQ ID NO: 851000 - RNA, 19 nt, Homo sapiens
gugacaacaucuacacaau

SEQ ID NO: 851001 - RNA, 19 nt, Homo sapiens
gacccuggcccaauccuaa

SEQ ID NO: 851002 - RNA, 19 nt, Homo sapiens
cagaaauuaugcaagaagu

SEQ ID NO: 851003 - RNA, 19 nt, Homo sapiens
gaucaaugcagagaaugaa

SEQ ID NO: 851004 - RNA, 19 nt, Homo sapiens
ggaucaaugcagagaauga

SEQ ID NO: 851005 - RNA, 19 nt, Homo sapiens
caacaaauuccagugacaa

SEQ ID NO: 851006 - RNA, 19 nt, Homo sapiens
ggagagacacuugugaaca

SEQ ID NO: 851007 - RNA, 19 nt, Homo sapiens
cgacauagacggacuucca

SEQ ID NO: 851008 - RNA, 19 nt, Homo sapiens
ucaacaaauuccagugaca

SEQ ID NO: 851009 - RNA, 19 nt, Homo sapiens
ccuuucagaacgacaauua

SEQ ID NO: 851010 - RNA, 19 nt, Homo sapiens
gacaauuauucuccaagca

SEQ ID NO: 851011 - RNA, 19 nt, Homo sapiens
ugacaacaucuacacaaug

SEQ ID NO: 851012 - RNA, 19 nt, Homo sapiens
gcacagccuccaccucaca

SEQ ID NO: 851013 - RNA, 19 nt, Homo sapiens
gccagaaauuaugcaagaa

SEQ ID NO: 851014 - RNA, 19 nt, Homo sapiens
aaacaucacguugggagaa

SEQ ID NO: 851015 - RNA, 19 nt, Homo sapiens
ugagagagcaggcauugca

SEQ ID NO: 851016 - RNA, 19 nt, Homo sapiens
aaucguugguuucuuucaa

SEQ ID NO: 851017 - RNA, 19 nt, Homo sapiens
ccaagcccuuccaccagaa

SEQ ID NO: 851018 - RNA, 19 nt, Homo sapiens
gcugagagagcaggcauug

SEQ ID NO: 851019 - RNA, 19 nt, Homo sapiens
caaauuccagugacaacau

SEQ ID NO: 851020 - RNA, 19 nt, Homo sapiens
agagacacuugugaacauu

SEQ ID NO: 851021 - RNA, 19 nt, Homo sapiens
ucuccaagcaugacgauga

SEQ ID NO: 851022 - RNA, 19 nt, Homo sapiens
gcauggagccacaccacau

SEQ ID NO: 851023 - RNA, 19 nt, Homo sapiens
gugcuaacucaauuccaua

SEQ ID NO: 851024 - RNA, 19 nt, Homo sapiens
gagccacaccacaugaaug

SEQ ID NO: 851025 - RNA, 19 nt, Homo sapiens
ccuccaggaacacccauua

SEQ ID NO: 851026 - RNA, 19 nt, Homo sapiens
gacauagacggacuuccaa

SEQ ID NO: 851027 - RNA, 19 nt, Homo sapiens
ucccgcagauucaacaaau

SEQ ID NO: 851028 - RNA, 19 nt, Homo sapiens
uaaauggaagcuucuagca

SEQ ID NO: 851029 - RNA, 19 nt, Homo sapiens
aagaagugaggugucauua

SEQ ID NO: 851030 - RNA, 19 nt, Homo sapiens
uaacaacauaaguggcauu

SEQ ID NO: 851031 - RNA, 19 nt, Homo sapiens
ccacaccacaugaauggau

SEQ ID NO: 851032 - RNA, 19 nt, Homo sapiens
ggagccacaccacaugaau

SEQ ID NO: 851033 - RNA, 19 nt, Homo sapiens
ccgcagauucaacaaauuc

SEQ ID NO: 851034 - RNA, 19 nt, Homo sapiens
cuaacucaauuccauacuc

SEQ ID NO: 851035 - RNA, 19 nt, Homo sapiens
aaaggagagacacuuguga

SEQ ID NO: 851036 - RNA, 19 nt, Homo sapiens
ccaggaacacccauuaugc

SEQ ID NO: 851037 - RNA, 19 nt, Homo sapiens
ccagaaauuaugcaagaag

SEQ ID NO: 851038 - RNA, 19 nt, Homo sapiens
cucaucaccugguaccuau

SEQ ID NO: 851039 - RNA, 19 nt, Homo sapiens
ccucaucaccugguaccua

SEQ ID NO: 851040 - RNA, 19 nt, Homo sapiens
aaauggaagcuucuagcaa

SEQ ID NO: 851041 - RNA, 19 nt, Homo sapiens
agaagugaggugucauuau

SEQ ID NO: 851042 - RNA, 19 nt, Homo sapiens
ugcaagaagugagguguca

SEQ ID NO: 851043 - RNA, 19 nt, Homo sapiens
ggaggaucaaugcagagaa

SEQ ID NO: 851044 - RNA, 19 nt, Homo sapiens
aguuuacaaucguugguuu

SEQ ID NO: 851045 - RNA, 19 nt, Homo sapiens
auaaguggcauuagcaauc

SEQ ID NO: 851046 - RNA, 19 nt, Homo sapiens
ugaaaggagagacacuugu

SEQ ID NO: 851047 - RNA, 19 nt, Homo sapiens
aacaacauaaguggcauua

SEQ ID NO: 851048 - RNA, 19 nt, Homo sapiens
aaauuccagugacaacauc

SEQ ID NO: 851049 - RNA, 19 nt, Homo sapiens
uuacaaucguugguuucuu

SEQ ID NO: 851050 - RNA, 19 nt, Homo sapiens
caagcaugacgaugagugu

SEQ ID NO: 851051 - RNA, 19 nt, Homo sapiens
aaggagagacacuugugaa

SEQ ID NO: 851052 - RNA, 19 nt, Homo sapiens
gcccagucccgcagauuca

SEQ ID NO: 851053 - RNA, 19 nt, Homo sapiens
caucaccugguaccuaugu

SEQ ID NO: 851054 - RNA, 19 nt, Homo sapiens
cugcacagacuuucuuauc

SEQ ID NO: 851055 - RNA, 19 nt, Homo sapiens
gggaggaucaaugcagaga

SEQ ID NO: 851056 - RNA, 19 nt, Homo sapiens
uaucugagcuuaaggaaua

SEQ ID NO: 851057 - RNA, 19 nt, Homo sapiens
caaggaacauuacaagauu

SEQ ID NO: 851058 - RNA, 19 nt, Homo sapiens
cgagaaggcuuugugauuu

SEQ ID NO: 851059 - RNA, 19 nt, Homo sapiens
aaauacaacucacgaagua

SEQ ID NO: 851060 - RNA, 19 nt, Homo sapiens
ugaagaggaugcagacuuu

SEQ ID NO: 851061 - RNA, 19 nt, Homo sapiens
gaacaacaagucagugauu

SEQ ID NO: 851062 - RNA, 19 nt, Homo sapiens
gaaauccucuugaacucuu

SEQ ID NO: 851063 - RNA, 19 nt, Homo sapiens
ggagugaucuucggcuuga

SEQ ID NO: 851064 - RNA, 19 nt, Homo sapiens
ugagagaugugcaccauga

SEQ ID NO: 851065 - RNA, 19 nt, Homo sapiens
gcagcgaacucaaggaaca

SEQ ID NO: 851066 - RNA, 19 nt, Homo sapiens
guucugaccuguaagauag

SEQ ID NO: 851067 - RNA, 19 nt, Homo sapiens
aagaagacauggccauuga

SEQ ID NO: 851068 - RNA, 19 nt, Homo sapiens
gaaacuuguugccaccaaa

SEQ ID NO: 851069 - RNA, 19 nt, Homo sapiens
acaaauccauguuucagaa

SEQ ID NO: 851070 - RNA, 19 nt, Homo sapiens
gcgagaaggcuuugugauu

SEQ ID NO: 851071 - RNA, 19 nt, Homo sapiens
gagaagugguuaccuccuu

SEQ ID NO: 851072 - RNA, 19 nt, Homo sapiens
uaauugaaguggaagaaga

SEQ ID NO: 851073 - RNA, 19 nt, Homo sapiens
gugacaaggugaacaguug

SEQ ID NO: 851074 - RNA, 19 nt, Homo sapiens
gaccauacaccacaucuga

SEQ ID NO: 851075 - RNA, 19 nt, Homo sapiens
gcgaggaggcucuaauuga

SEQ ID NO: 851076 - RNA, 19 nt, Homo sapiens
gaaauacaacucacgaagu

SEQ ID NO: 851077 - RNA, 19 nt, Homo sapiens
ggauuuaucugagcuuaag

SEQ ID NO: 851078 - RNA, 19 nt, Homo sapiens
guggagaauugucuacuga

SEQ ID NO: 851079 - RNA, 19 nt, Homo sapiens
gaaugaggagggaauggua

SEQ ID NO: 851080 - RNA, 19 nt, Homo sapiens
cggaggagcugcagaucuu

SEQ ID NO: 851081 - RNA, 19 nt, Homo sapiens
gaacuuggcagcgaacuca

SEQ ID NO: 851082 - RNA, 19 nt, Homo sapiens
gaaguucugaccuguaaga

SEQ ID NO: 851083 - RNA, 19 nt, Homo sapiens
gagcuacaaauccauguuu

SEQ ID NO: 851084 - RNA, 19 nt, Homo sapiens
ggaaacuuguugccaccaa

SEQ ID NO: 851085 - RNA, 19 nt, Homo sapiens
ucaaguuucucuccaagug

SEQ ID NO: 851086 - RNA, 19 nt, Homo sapiens
ggagcuagagacauuguuu

SEQ ID NO: 851087 - RNA, 19 nt, Homo sapiens
ggaagaagaagaggaaauc

SEQ ID NO: 851088 - RNA, 19 nt, Homo sapiens
uaugagucguucuauguuu

SEQ ID NO: 851089 - RNA, 19 nt, Homo sapiens
gaggagaucaguaguucuu

SEQ ID NO: 851090 - RNA, 19 nt, Homo sapiens
gagaaggcuuugugauuuu

SEQ ID NO: 851091 - RNA, 19 nt, Homo sapiens
agacauggccauugacuau

SEQ ID NO: 851092 - RNA, 19 nt, Homo sapiens
cgaggaggcucuaauugag

SEQ ID NO: 851093 - RNA, 19 nt, Homo sapiens
gcucccaccuugucuuugu

SEQ ID NO: 851094 - RNA, 19 nt, Homo sapiens
augaacagguggagaauug

SEQ ID NO: 851095 - RNA, 19 nt, Homo sapiens
gcccuuuccuggaugcuaa

SEQ ID NO: 851096 - RNA, 19 nt, Homo sapiens
acgggaagcugaacaacaa

SEQ ID NO: 851097 - RNA, 19 nt, Homo sapiens
gaacauuacaagauugaag

SEQ ID NO: 851098 - RNA, 19 nt, Homo sapiens
ucaaggaacauuacaagau

SEQ ID NO: 851099 - RNA, 19 nt, Homo sapiens
gcuacucccucccagaaau

SEQ ID NO: 851100 - RNA, 19 nt, Homo sapiens
ugcaggagcuagagacauu

SEQ ID NO: 851101 - RNA, 19 nt, Homo sapiens
ugacaaguccauuugaaga

SEQ ID NO: 851102 - RNA, 19 nt, Homo sapiens
aggcagagcccaugcauug

SEQ ID NO: 851103 - RNA, 19 nt, Homo sapiens
cagugucuacgaacaauua

SEQ ID NO: 851104 - RNA, 19 nt, Homo sapiens
aggaggagcuggaaacauc

SEQ ID NO: 851105 - RNA, 19 nt, Homo sapiens
ggaaugguaggcgagcuua

SEQ ID NO: 851106 - RNA, 19 nt, Homo sapiens
cuggacagguuguaauuau

SEQ ID NO: 851107 - RNA, 19 nt, Homo sapiens
cagauuggcugugauagca

SEQ ID NO: 851108 - RNA, 19 nt, Homo sapiens
cuagagacauuguuuccau

SEQ ID NO: 851109 - RNA, 19 nt, Homo sapiens
acacauaaaguuggccuua

SEQ ID NO: 851110 - RNA, 19 nt, Homo sapiens
agaaauugguagagcuuug

SEQ ID NO: 851111 - RNA, 19 nt, Homo sapiens
ggacagguuguaauuaugg

SEQ ID NO: 851112 - RNA, 19 nt, Homo sapiens
gagacauuguuuccauuca

SEQ ID NO: 851113 - RNA, 19 nt, Homo sapiens
gaaacaacuuuuggagaaa

SEQ ID NO: 851114 - RNA, 19 nt, Homo sapiens
agaaacaacuuuuggagaa

SEQ ID NO: 851115 - RNA, 19 nt, Homo sapiens
agacauagcccugugacaa

SEQ ID NO: 851116 - RNA, 19 nt, Homo sapiens
acauggccauugacuauga

SEQ ID NO: 851117 - RNA, 19 nt, Homo sapiens
uaacugggagcuacaaauc

SEQ ID NO: 851118 - RNA, 19 nt, Homo sapiens
gcacagggaguaucuuggu

SEQ ID NO: 851119 - RNA, 19 nt, Homo sapiens
cagcuacucucaccgucaa

SEQ ID NO: 851120 - RNA, 19 nt, Homo sapiens
gauuucugcucccuccauu

SEQ ID NO: 851121 - RNA, 19 nt, Homo sapiens
agacauuguuuccauucaa

SEQ ID NO: 851122 - RNA, 19 nt, Homo sapiens
augagucguucuauguuua

SEQ ID NO: 851123 - RNA, 19 nt, Homo sapiens
caagaagacauggccauug

SEQ ID NO: 851124 - RNA, 19 nt, Homo sapiens
ccgaggagaucaguaguuc

SEQ ID NO: 851125 - RNA, 19 nt, Homo sapiens
caucugacagcaucacgua

SEQ ID NO: 851126 - RNA, 19 nt, Homo sapiens
gcaaagcaugguccugguu

SEQ ID NO: 851127 - RNA, 19 nt, Homo sapiens
guggauuuaucugagcuua

SEQ ID NO: 851128 - RNA, 19 nt, Homo sapiens
gguuaccuccuucggcuua

SEQ ID NO: 851129 - RNA, 19 nt, Homo sapiens
gaaucaaacacagaaacaa

SEQ ID NO: 851130 - RNA, 19 nt, Homo sapiens
gaaauugguagagcuuugu

SEQ ID NO: 851131 - RNA, 19 nt, Homo sapiens
gcccgacucuaccuuagga

SEQ ID NO: 851132 - RNA, 19 nt, Homo sapiens
gcaacgggaagcugaacaa

SEQ ID NO: 851133 - RNA, 19 nt, Homo sapiens
uuacaagauugaagcuuuc

SEQ ID NO: 851134 - RNA, 19 nt, Homo sapiens
gaacucaaggaacauuaca

SEQ ID NO: 851135 - RNA, 19 nt, Homo sapiens
uagagacauuguuuccauu

SEQ ID NO: 851136 - RNA, 19 nt, Homo sapiens
ucgaaagccaggcauagua

SEQ ID NO: 851137 - RNA, 19 nt, Homo sapiens
caaacacagaaacaacuuu

SEQ ID NO: 851138 - RNA, 19 nt, Homo sapiens
caagcagugucuacgaaca

SEQ ID NO: 851139 - RNA, 19 nt, Homo sapiens
gguggagaauugucuacug

SEQ ID NO: 851140 - RNA, 19 nt, Homo sapiens
gcgaacucaaggaacauua

SEQ ID NO: 851141 - RNA, 19 nt, Homo sapiens
gacauuguuuccauucaag

SEQ ID NO: 851142 - RNA, 19 nt, Homo sapiens
ggaugcagacuuugagcaa

SEQ ID NO: 851143 - RNA, 19 nt, Homo sapiens
cuacugacaaguccauuug

SEQ ID NO: 851144 - RNA, 19 nt, Homo sapiens
gaacagguggagaauuguc

SEQ ID NO: 851145 - RNA, 19 nt, Homo sapiens
caccagcacacauaaaguu

SEQ ID NO: 851146 - RNA, 19 nt, Homo sapiens
caaggacaguggccaugca

SEQ ID NO: 851147 - RNA, 19 nt, Homo sapiens
ccugcagccucuccauaaa

SEQ ID NO: 851148 - RNA, 19 nt, Homo sapiens
gaagcugaacaacaaguca

SEQ ID NO: 851149 - RNA, 19 nt, Homo sapiens
gaggaggcucuaauugaga

SEQ ID NO: 851150 - RNA, 19 nt, Homo sapiens
gcaugaguuucugagcaaa

SEQ ID NO: 851151 - RNA, 19 nt, Homo sapiens
gaagacauggccauugacu

SEQ ID NO: 851152 - RNA, 19 nt, Homo sapiens
ccacagaucugcuuuucca

SEQ ID NO: 851153 - RNA, 19 nt, Homo sapiens
guaauuauggaaggaauca

SEQ ID NO: 851154 - RNA, 19 nt, Homo sapiens
cagaagcgagcuaucucua

SEQ ID NO: 851155 - RNA, 19 nt, Homo sapiens
agagcuaauugaaguggaa

SEQ ID NO: 851156 - RNA, 19 nt, Homo sapiens
gagccaaggugcugcauga

SEQ ID NO: 851157 - RNA, 19 nt, Homo sapiens
ggaauuuggugcauugaug

SEQ ID NO: 851158 - RNA, 19 nt, Homo sapiens
gcaggaauuuggugcauug

SEQ ID NO: 851159 - RNA, 19 nt, Homo sapiens
gcucuugccuucuaagcua

SEQ ID NO: 851160 - RNA, 19 nt, Homo sapiens
gaucauggaugcucuggau

SEQ ID NO: 851161 - RNA, 19 nt, Homo sapiens
cagcuaccauuuaccauuu

SEQ ID NO: 851162 - RNA, 19 nt, Homo sapiens
ccauuugccuacagaauuu

SEQ ID NO: 851163 - RNA, 19 nt, Homo sapiens
gaagagauacuccauguac

SEQ ID NO: 851164 - RNA, 19 nt, Homo sapiens
caacaaaggcaacgggauu

SEQ ID NO: 851165 - RNA, 19 nt, Homo sapiens
ccagaagaauuucaacaau

SEQ ID NO: 851166 - RNA, 19 nt, Homo sapiens
gauaaagaauucccuuaac

SEQ ID NO: 851167 - RNA, 19 nt, Homo sapiens
gagauaaagaauucccuua

SEQ ID NO: 851168 - RNA, 19 nt, Homo sapiens
gagaaggaccgcaucaaga

SEQ ID NO: 851169 - RNA, 19 nt, Homo sapiens
gaauucccuuaacaugaua

SEQ ID NO: 851170 - RNA, 19 nt, Homo sapiens
gccaagauauuccucuguu

SEQ ID NO: 851171 - RNA, 19 nt, Homo sapiens
cagaagaauuucaacaauc

SEQ ID NO: 851172 - RNA, 19 nt, Homo sapiens
gaagccacccguuaccuuu

SEQ ID NO: 851173 - RNA, 19 nt, Homo sapiens
cagcgacucuguguuguuu

SEQ ID NO: 851174 - RNA, 19 nt, Homo sapiens
gccaagaagccacccguua

SEQ ID NO: 851175 - RNA, 19 nt, Homo sapiens
ucagggugcucaaggauug

SEQ ID NO: 851176 - RNA, 19 nt, Homo sapiens
gagcugcgcaaguccauuu

SEQ ID NO: 851177 - RNA, 19 nt, Homo sapiens
agaauucccuuaacaugau

SEQ ID NO: 851178 - RNA, 19 nt, Homo sapiens
ggaaaccucucagugucuu

SEQ ID NO: 851179 - RNA, 19 nt, Homo sapiens
gauggaaaccucucagugu

SEQ ID NO: 851180 - RNA, 19 nt, Homo sapiens
ccaaggagaccacccagaa

SEQ ID NO: 851181 - RNA, 19 nt, Homo sapiens
gaccugagccguaacuuca

SEQ ID NO: 851182 - RNA, 19 nt, Homo sapiens
gggagcagcugcauagcau

SEQ ID NO: 851183 - RNA, 19 nt, Homo sapiens
ggacaucucccgucucaac

SEQ ID NO: 851184 - RNA, 19 nt, Homo sapiens
cugcugagauaaagaauuc

SEQ ID NO: 851185 - RNA, 19 nt, Homo sapiens
gaauuuggugcauugauga

SEQ ID NO: 851186 - RNA, 19 nt, Homo sapiens
caucagcgacucuguguug

SEQ ID NO: 851187 - RNA, 19 nt, Homo sapiens
gaccuuagccaagauauuc

SEQ ID NO: 851188 - RNA, 19 nt, Homo sapiens
gaccaucgcuaugugaaca

SEQ ID NO: 851189 - RNA, 19 nt, Homo sapiens
gugaacaacuacacgaaca

SEQ ID NO: 851190 - RNA, 19 nt, Homo sapiens
cggacaccaugaagagaua

SEQ ID NO: 851191 - RNA, 19 nt, Homo sapiens
guaacuucauugagaggaa

SEQ ID NO: 851192 - RNA, 19 nt, Homo sapiens
gcaggaugcuguggaccaa

SEQ ID NO: 851193 - RNA, 19 nt, Homo sapiens
ggagaaggaccgcaucaag

SEQ ID NO: 851194 - RNA, 19 nt, Homo sapiens
cagcauggacucuauggaa

SEQ ID NO: 851195 - RNA, 19 nt, Homo sapiens
uggcugggcugaccgcaaa

SEQ ID NO: 851196 - RNA, 19 nt, Homo sapiens
ggacgaccugcucaaugua

SEQ ID NO: 851197 - RNA, 19 nt, Homo sapiens
gauauaauccacccaugca

SEQ ID NO: 851198 - RNA, 19 nt, Homo sapiens
ggagggagacauccagcuu

SEQ ID NO: 851199 - RNA, 19 nt, Homo sapiens
aaagaauucccuuaacaug

SEQ ID NO: 851200 - RNA, 19 nt, Homo sapiens
caucauuccugugcucaga

SEQ ID NO: 851201 - RNA, 19 nt, Homo sapiens
caaucucuauggcaccaaa

SEQ ID NO: 851202 - RNA, 19 nt, Homo sapiens
agccguaacuucauugaga

SEQ ID NO: 851203 - RNA, 19 nt, Homo sapiens
uauagacguuucucuccaa

SEQ ID NO: 851204 - RNA, 19 nt, Homo sapiens
gagaccacccagaagaauu

SEQ ID NO: 851205 - RNA, 19 nt, Homo sapiens
gcaccggacaccaugaaga

SEQ ID NO: 851206 - RNA, 19 nt, Homo sapiens
caggagcacaagaaucaua

SEQ ID NO: 851207 - RNA, 19 nt, Homo sapiens
caagcacccugcgauggaa

SEQ ID NO: 851208 - RNA, 19 nt, Homo sapiens
aagaauucccuuaacauga

SEQ ID NO: 851209 - RNA, 19 nt, Homo sapiens
ccaagauauuccucuguuc

SEQ ID NO: 851210 - RNA, 19 nt, Homo sapiens
cugcugcucuugccuucua

SEQ ID NO: 851211 - RNA, 19 nt, Homo sapiens
agaccacccagaagaauuu

SEQ ID NO: 851212 - RNA, 19 nt, Homo sapiens
cgagacgccugccagaaag

SEQ ID NO: 851213 - RNA, 19 nt, Homo sapiens
gaguacuccuccagcauuc

SEQ ID NO: 851214 - RNA, 19 nt, Homo sapiens
gacagucacuaggcaacuu

SEQ ID NO: 851215 - RNA, 19 nt, Homo sapiens
ccgagacgccugccagaaa

SEQ ID NO: 851216 - RNA, 19 nt, Homo sapiens
ggaccugagccguaacuuc

SEQ ID NO: 851217 - RNA, 19 nt, Homo sapiens
aggacgaccugcucaaugu

SEQ ID NO: 851218 - RNA, 19 nt, Homo sapiens
gagcagcugcauagcauca

SEQ ID NO: 851219 - RNA, 19 nt, Homo sapiens
agaaguggcagaaggagaa

SEQ ID NO: 851220 - RNA, 19 nt, Homo sapiens
uauaauccacccaugcaaa

SEQ ID NO: 851221 - RNA, 19 nt, Homo sapiens
ccagcuaccauuuaccauu

SEQ ID NO: 851222 - RNA, 19 nt, Homo sapiens
gaugaccuuagccaagaua

SEQ ID NO: 851223 - RNA, 19 nt, Homo sapiens
ccaagaagccacccguuac

SEQ ID NO: 851224 - RNA, 19 nt, Homo sapiens
gccauucuacgucaacaaa

SEQ ID NO: 851225 - RNA, 19 nt, Homo sapiens
augaagagauacuccaugu

SEQ ID NO: 851226 - RNA, 19 nt, Homo sapiens
ccugagccguaacuucauu

SEQ ID NO: 851227 - RNA, 19 nt, Homo sapiens
ucaagagcuucaccaccaa

SEQ ID NO: 851228 - RNA, 19 nt, Homo sapiens
gaaggagacggagcuguca

SEQ ID NO: 851229 - RNA, 19 nt, Homo sapiens
aggaugaccuuagccaaga

SEQ ID NO: 851230 - RNA, 19 nt, Homo sapiens
ccacuggccacacuccauu

SEQ ID NO: 851231 - RNA, 19 nt, Homo sapiens
ccaagcacccugcgaugga

SEQ ID NO: 851232 - RNA, 19 nt, Homo sapiens
ggauuggagaggagacaaa

SEQ ID NO: 851233 - RNA, 19 nt, Homo sapiens
uucauucagucuacacuuu

SEQ ID NO: 851234 - RNA, 19 nt, Homo sapiens
ggagaccacccagaagaau

SEQ ID NO: 851235 - RNA, 19 nt, Homo sapiens
aggcggaccugagccguaa

SEQ ID NO: 851236 - RNA, 19 nt, Homo sapiens
aagugaaggugaucaugga

SEQ ID NO: 851237 - RNA, 19 nt, Homo sapiens
ggaugaccuuagccaagau

SEQ ID NO: 851238 - RNA, 19 nt, Homo sapiens
ccacagccacuuugagucu

SEQ ID NO: 851239 - RNA, 19 nt, Homo sapiens
ccaauguugucagcagaug

SEQ ID NO: 851240 - RNA, 19 nt, Homo sapiens
uggccacacuccauucaga

SEQ ID NO: 851241 - RNA, 19 nt, Homo sapiens
gcgacucuguguuguuucu

SEQ ID NO: 851242 - RNA, 19 nt, Homo sapiens
caacgggucgagcccagaa

SEQ ID NO: 851243 - RNA, 19 nt, Homo sapiens
caagaucauugagauugag

SEQ ID NO: 851244 - RNA, 19 nt, Homo sapiens
cgugcucucucucguccua

SEQ ID NO: 851245 - RNA, 19 nt, Homo sapiens
ggagugcaccggacaccau

SEQ ID NO: 851246 - RNA, 19 nt, Homo sapiens
agaggaaccacauggagaa

SEQ ID NO: 851247 - RNA, 19 nt, Homo sapiens
cccuuaacaugauauaauc

SEQ ID NO: 851248 - RNA, 19 nt, Homo sapiens
ugaagagauacuccaugua

SEQ ID NO: 851249 - RNA, 19 nt, Homo sapiens
uccaggagcacaagaauca

SEQ ID NO: 851250 - RNA, 19 nt, Homo sapiens
ugccuccuccuucugauua

SEQ ID NO: 851251 - RNA, 19 nt, Homo sapiens
guuccggccucuccgacuu

SEQ ID NO: 851252 - RNA, 19 nt, Homo sapiens
ggcgacccaucauccaguu

SEQ ID NO: 851253 - RNA, 19 nt, Homo sapiens
ucugcgagcugcaucucaa

SEQ ID NO: 851254 - RNA, 19 nt, Homo sapiens
uaauccacccaugcaaaua

SEQ ID NO: 851255 - RNA, 19 nt, Homo sapiens
cgacccaucauccaguuug

SEQ ID NO: 851256 - RNA, 19 nt, Homo sapiens
gaagggugcucaaggauug

SEQ ID NO: 851257 - RNA, 19 nt, Homo sapiens
gagccaaggugcugcauga

SEQ ID NO: 851258 - RNA, 19 nt, Homo sapiens
agacuaugcuggugguuua

SEQ ID NO: 851259 - RNA, 19 nt, Homo sapiens
ggaauuuggugcauugaug

SEQ ID NO: 851260 - RNA, 19 nt, Homo sapiens
gcaggaauuuggugcauug

SEQ ID NO: 851261 - RNA, 19 nt, Homo sapiens
gaucauggaugcucuggau

SEQ ID NO: 851262 - RNA, 19 nt, Homo sapiens
gaagagauacuccauguac

SEQ ID NO: 851263 - RNA, 19 nt, Homo sapiens
caacaaaggcaacgggauu

SEQ ID NO: 851264 - RNA, 19 nt, Homo sapiens
ccagaagaauuucaacaau

SEQ ID NO: 851265 - RNA, 19 nt, Homo sapiens
gagaaggaccgcaucaaga

SEQ ID NO: 851266 - RNA, 19 nt, Homo sapiens
cagaagaauuucaacaauc

SEQ ID NO: 851267 - RNA, 19 nt, Homo sapiens
gaagccacccguuaccuuu

SEQ ID NO: 851268 - RNA, 19 nt, Homo sapiens
cagcgacucuguguuguuu

SEQ ID NO: 851269 - RNA, 19 nt, Homo sapiens
gcggaagggugcucaagga

SEQ ID NO: 851270 - RNA, 19 nt, Homo sapiens
gccaagaagccacccguua

SEQ ID NO: 851271 - RNA, 19 nt, Homo sapiens
gagcugcgcaaguccauuu

SEQ ID NO: 851272 - RNA, 19 nt, Homo sapiens
ccaaggagaccacccagaa

SEQ ID NO: 851273 - RNA, 19 nt, Homo sapiens
gaccugagccguaacuuca

SEQ ID NO: 851274 - RNA, 19 nt, Homo sapiens
gggagcagcugcauagcau

SEQ ID NO: 851275 - RNA, 19 nt, Homo sapiens
ggaagggugcucaaggauu

SEQ ID NO: 851276 - RNA, 19 nt, Homo sapiens
ggacaucucccgucucaac

SEQ ID NO: 851277 - RNA, 19 nt, Homo sapiens
gaauuuggugcauugauga

SEQ ID NO: 851278 - RNA, 19 nt, Homo sapiens
caucagcgacucuguguug

SEQ ID NO: 851279 - RNA, 19 nt, Homo sapiens
gaccaucgcuaugugaaca

SEQ ID NO: 851280 - RNA, 19 nt, Homo sapiens
gugaacaacuacacgaaca

SEQ ID NO: 851281 - RNA, 19 nt, Homo sapiens
cggacaccaugaagagaua

SEQ ID NO: 851282 - RNA, 19 nt, Homo sapiens
guaacuucauugagaggaa

SEQ ID NO: 851283 - RNA, 19 nt, Homo sapiens
gcaggaugcuguggaccaa

SEQ ID NO: 851284 - RNA, 19 nt, Homo sapiens
ggagaaggaccgcaucaag

SEQ ID NO: 851285 - RNA, 19 nt, Homo sapiens
cagcauggacucuauggaa

SEQ ID NO: 851286 - RNA, 19 nt, Homo sapiens
ggacgaccugcucaaugua

SEQ ID NO: 851287 - RNA, 19 nt, Homo sapiens
ggagggagacauccagcuu

SEQ ID NO: 851288 - RNA, 19 nt, Homo sapiens
caaucucuauggcaccaaa

SEQ ID NO: 851289 - RNA, 19 nt, Homo sapiens
agccguaacuucauugaga

SEQ ID NO: 851290 - RNA, 19 nt, Homo sapiens
gagaccacccagaagaauu

SEQ ID NO: 851291 - RNA, 19 nt, Homo sapiens
gcaccggacaccaugaaga

SEQ ID NO: 851292 - RNA, 19 nt, Homo sapiens
caggagcacaagaaucaua

SEQ ID NO: 851293 - RNA, 19 nt, Homo sapiens
caagcacccugcgauggaa

SEQ ID NO: 851294 - RNA, 19 nt, Homo sapiens
cgagacgccugccagaaag

SEQ ID NO: 851295 - RNA, 19 nt, Homo sapiens
agaccacccagaagaauuu

SEQ ID NO: 851296 - RNA, 19 nt, Homo sapiens
gaguacuccuccagcauuc

SEQ ID NO: 851297 - RNA, 19 nt, Homo sapiens
gacagucacuaggcaacuu

SEQ ID NO: 851298 - RNA, 19 nt, Homo sapiens
ccgagacgccugccagaaa

SEQ ID NO: 851299 - RNA, 19 nt, Homo sapiens
ggaccugagccguaacuuc

SEQ ID NO: 851300 - RNA, 19 nt, Homo sapiens
aggacgaccugcucaaugu

SEQ ID NO: 851301 - RNA, 19 nt, Homo sapiens
gagcagcugcauagcauca

SEQ ID NO: 851302 - RNA, 19 nt, Homo sapiens
agaaguggcagaaggagaa

SEQ ID NO: 851303 - RNA, 19 nt, Homo sapiens
gccauucuacgucaacaaa

SEQ ID NO: 851304 - RNA, 19 nt, Homo sapiens
ccaagaagccacccguuac

SEQ ID NO: 851305 - RNA, 19 nt, Homo sapiens
augaagagauacuccaugu

SEQ ID NO: 851306 - RNA, 19 nt, Homo sapiens
ccugagccguaacuucauu

SEQ ID NO: 851307 - RNA, 19 nt, Homo sapiens
ucaagagcuucaccaccaa

SEQ ID NO: 851308 - RNA, 19 nt, Homo sapiens
gaaggagacggagcuguca

SEQ ID NO: 851309 - RNA, 19 nt, Homo sapiens
ccaagcacccugcgaugga

SEQ ID NO: 851310 - RNA, 19 nt, Homo sapiens
ggauuggagaggagacaaa

SEQ ID NO: 851311 - RNA, 19 nt, Homo sapiens
ggagaccacccagaagaau

SEQ ID NO: 851312 - RNA, 19 nt, Homo sapiens
aggcggaccugagccguaa

SEQ ID NO: 851313 - RNA, 19 nt, Homo sapiens
aagugaaggugaucaugga

SEQ ID NO: 851314 - RNA, 19 nt, Homo sapiens
caacgggucgagcccagaa

SEQ ID NO: 851315 - RNA, 19 nt, Homo sapiens
gcgacucuguguuguuucu

SEQ ID NO: 851316 - RNA, 19 nt, Homo sapiens
caagaucauugagauugag

SEQ ID NO: 851317 - RNA, 19 nt, Homo sapiens
ggagugcaccggacaccau

SEQ ID NO: 851318 - RNA, 19 nt, Homo sapiens
agaggaaccacauggagaa

SEQ ID NO: 851319 - RNA, 19 nt, Homo sapiens
gcaguguacccuugagucu

SEQ ID NO: 851320 - RNA, 19 nt, Homo sapiens
ugaagagauacuccaugua

SEQ ID NO: 851321 - RNA, 19 nt, Homo sapiens
uccaggagcacaagaauca

SEQ ID NO: 851322 - RNA, 19 nt, Homo sapiens
ggcgacccaucauccaguu

SEQ ID NO: 851323 - RNA, 19 nt, Homo sapiens
ucugcgagcugcaucucaa

SEQ ID NO: 851324 - RNA, 19 nt, Homo sapiens
gaccaggaggugucaguuc

SEQ ID NO: 851325 - RNA, 19 nt, Homo sapiens
cgacccaucauccaguuug

SEQ ID NO: 851326 - RNA, 19 nt, Homo sapiens
gagcacaagaaucauagca

SEQ ID NO: 851327 - RNA, 19 nt, Homo sapiens
cccguuaccuuugccgaaa

SEQ ID NO: 851328 - RNA, 19 nt, Homo sapiens
cccagaagaauuucaacaa

SEQ ID NO: 851329 - RNA, 19 nt, Homo sapiens
gacccaucauccaguuugu

SEQ ID NO: 851330 - RNA, 19 nt, Homo sapiens
gacgaccugcucaauguau

SEQ ID NO: 851331 - RNA, 19 nt, Homo sapiens
caaggacgaccugcucaau

SEQ ID NO: 851332 - RNA, 19 nt, Homo sapiens
gaucauugagauugaggau

SEQ ID NO: 851333 - RNA, 19 nt, Homo sapiens
aaggagaccacccagaaga

SEQ ID NO: 851334 - RNA, 19 nt, Homo sapiens
uguuguuucugcaggaauu

SEQ ID NO: 851335 - RNA, 19 nt, Homo sapiens
agaaggaccgcaucaagag

SEQ ID NO: 851336 - RNA, 19 nt, Homo sapiens
ccuuuggaauaaaccauug

SEQ ID NO: 851337 - RNA, 19 nt, Homo sapiens
ucuauggcaccaaagguaa

SEQ ID NO: 851338 - RNA, 19 nt, Homo sapiens
ccacccagaagaauuucaa

SEQ ID NO: 851339 - RNA, 19 nt, Homo sapiens
gcgccacguugagaagaug

SEQ ID NO: 851340 - RNA, 19 nt, Homo sapiens
guggcagccuggagaaugg

SEQ ID NO: 851341 - RNA, 19 nt, Homo sapiens
gagcuucaccaccaaugag

SEQ ID NO: 851342 - RNA, 19 nt, Homo sapiens
acggagcugucacugcaaa

SEQ ID NO: 851343 - RNA, 19 nt, Homo sapiens
gcuccuccuucucccugaa

SEQ ID NO: 851344 - RNA, 19 nt, Homo sapiens
caaggagaccacccagaag

SEQ ID NO: 851345 - RNA, 19 nt, Homo sapiens
ucugcuaccuuugcauguu

SEQ ID NO: 851346 - RNA, 19 nt, Homo sapiens
cauucuacgucaacaaagg

SEQ ID NO: 851347 - RNA, 19 nt, Homo sapiens
gcaugcgccacguugagaa

SEQ ID NO: 851348 - RNA, 19 nt, Homo sapiens
gagcccauccgggacuuug

SEQ ID NO: 851349 - RNA, 19 nt, Homo sapiens
cagacuaugcuggugguuu

SEQ ID NO: 851350 - RNA, 19 nt, Homo sapiens
ccgcaagugucccgugcau

SEQ ID NO: 851351 - RNA, 19 nt, Homo sapiens
gcaccaaagguaacuacac

SEQ ID NO: 851352 - RNA, 19 nt, Homo sapiens
acaacuacacgaacagcuu

SEQ ID NO: 851353 - RNA, 19 nt, Homo sapiens
ggugaccaucgcuauguga

SEQ ID NO: 851354 - RNA, 19 nt, Homo sapiens
gaaacagcucagccaagca

SEQ ID NO: 851355 - RNA, 19 nt, Homo sapiens
gaaguacuaugacgagauc

SEQ ID NO: 851356 - RNA, 19 nt, Homo sapiens
agaagaugguggaggauua

SEQ ID NO: 851357 - RNA, 19 nt, Homo sapiens
cgucaaaggucaagugaga

SEQ ID NO: 851358 - RNA, 19 nt, Homo sapiens
caagagaggcagcgugaaa

SEQ ID NO: 851359 - RNA, 19 nt, Homo sapiens
ucaacacccuuaugcacua

SEQ ID NO: 851360 - RNA, 19 nt, Homo sapiens
ugaagguccucaacuguga

SEQ ID NO: 851361 - RNA, 19 nt, Homo sapiens
caucaaacaucagguggaa

SEQ ID NO: 851362 - RNA, 19 nt, Homo sapiens
gggugaacauccucaagaa

SEQ ID NO: 851363 - RNA, 19 nt, Homo sapiens
ucaaggccaucaaacauca

SEQ ID NO: 851364 - RNA, 19 nt, Homo sapiens
gaagacaccauccacaucu

SEQ ID NO: 851365 - RNA, 19 nt, Homo sapiens
acacacaccuggcagagau

SEQ ID NO: 851366 - RNA, 19 nt, Homo sapiens
uccaccagcucuaccaaua

SEQ ID NO: 851367 - RNA, 19 nt, Homo sapiens
gcacgcgcacggagcauaa

SEQ ID NO: 851368 - RNA, 19 nt, Homo sapiens
ccaucugccuguaccagua

SEQ ID NO: 851369 - RNA, 19 nt, Homo sapiens
aaucaaauacagcgucuuu

SEQ ID NO: 851370 - RNA, 19 nt, Homo sapiens
gguggaggauuacuacaag

SEQ ID NO: 851371 - RNA, 19 nt, Homo sapiens
guacuacacggacaucaug

SEQ ID NO: 851372 - RNA, 19 nt, Homo sapiens
caagugagacguaggucaa

SEQ ID NO: 851373 - RNA, 19 nt, Homo sapiens
ccgcugcacuggagaacaa

SEQ ID NO: 851374 - RNA, 19 nt, Homo sapiens
gguguucacugucgagucu

SEQ ID NO: 851375 - RNA, 19 nt, Homo sapiens
acacgcagaaguacuauga

SEQ ID NO: 851376 - RNA, 19 nt, Homo sapiens
gaggcagcgugaaagagaa

SEQ ID NO: 851377 - RNA, 19 nt, Homo sapiens
ccaaguacacucucaacga

SEQ ID NO: 851378 - RNA, 19 nt, Homo sapiens
ugacgcggcugcucucagu

SEQ ID NO: 851379 - RNA, 19 nt, Homo sapiens
cgaaggccaucaccgagau

SEQ ID NO: 851380 - RNA, 19 nt, Homo sapiens
uacagaagaaggccaagua

SEQ ID NO: 851381 - RNA, 19 nt, Homo sapiens
gcaaguucccagauccuau

SEQ ID NO: 851382 - RNA, 19 nt, Homo sapiens
caucuuccucugagcaaua

SEQ ID NO: 851383 - RNA, 19 nt, Homo sapiens
cagacaggcugcccuagag

SEQ ID NO: 851384 - RNA, 19 nt, Homo sapiens
cgucuagacuguagcaucu

SEQ ID NO: 851385 - RNA, 19 nt, Homo sapiens
gaagaaggccaaguacacu

SEQ ID NO: 851386 - RNA, 19 nt, Homo sapiens
uggaugcgguacagaagaa

SEQ ID NO: 851387 - RNA, 19 nt, Homo sapiens
caccagcucuaccaauaca

SEQ ID NO: 851388 - RNA, 19 nt, Homo sapiens
gcacacggacuccuugaac

SEQ ID NO: 851389 - RNA, 19 nt, Homo sapiens
caccugcagucaaguacuu

SEQ ID NO: 851390 - RNA, 19 nt, Homo sapiens
accaauacacgcagaagua

SEQ ID NO: 851391 - RNA, 19 nt, Homo sapiens
gagaugggaggaggagaaa

SEQ ID NO: 851392 - RNA, 19 nt, Homo sapiens
gcucuucaaggccaucaaa

SEQ ID NO: 851393 - RNA, 19 nt, Homo sapiens
gaucuccaccuacaagaag

SEQ ID NO: 851394 - RNA, 19 nt, Homo sapiens
agaggaugcuguccaacug

SEQ ID NO: 851395 - RNA, 19 nt, Homo sapiens
cgagaugggaggaggagaa

SEQ ID NO: 851396 - RNA, 19 nt, Homo sapiens
caaguucccagauccuaug

SEQ ID NO: 851397 - RNA, 19 nt, Homo sapiens
aauacacgcagaaguacua

SEQ ID NO: 851398 - RNA, 19 nt, Homo sapiens
aaaggucaagugagacgua

SEQ ID NO: 851399 - RNA, 19 nt, Homo sapiens
gagaggaugcuguccaacu

SEQ ID NO: 851400 - RNA, 19 nt, Homo sapiens
guucccagauccuaugucu

SEQ ID NO: 851401 - RNA, 19 nt, Homo sapiens
agucucgagugauuugaaa

SEQ ID NO: 851402 - RNA, 19 nt, Homo sapiens
gcgauucucccagcaacaa

SEQ ID NO: 851403 - RNA, 19 nt, Homo sapiens
gacgagggcaaguccaaga

SEQ ID NO: 851404 - RNA, 19 nt, Homo sapiens
ggucaaggagaagaucauu

SEQ ID NO: 851405 - RNA, 19 nt, Homo sapiens
ggugaagguccucaacugu

SEQ ID NO: 851406 - RNA, 19 nt, Homo sapiens
ucagacaggcugcccuaga

SEQ ID NO: 851407 - RNA, 19 nt, Homo sapiens
agacugugguggagaggau

SEQ ID NO: 851408 - RNA, 19 nt, Homo sapiens
gaagaugguggaggauuac

SEQ ID NO: 851409 - RNA, 19 nt, Homo sapiens
acugaccucugaccuacaa

SEQ ID NO: 851410 - RNA, 19 nt, Homo sapiens
cacacggacuccuugaaca

SEQ ID NO: 851411 - RNA, 19 nt, Homo sapiens
cagagaagcacaacaucca

SEQ ID NO: 851412 - RNA, 19 nt, Homo sapiens
agaggcagcgugaaagaga

SEQ ID NO: 851413 - RNA, 19 nt, Homo sapiens
cggugaagguccucaacug

SEQ ID NO: 851414 - RNA, 19 nt, Homo sapiens
ccacgucaaaggucaagug

SEQ ID NO: 851415 - RNA, 19 nt, Homo sapiens
cagggcaaguucccagauc

SEQ ID NO: 851416 - RNA, 19 nt, Homo sapiens
gaugguggaggauuacuac

SEQ ID NO: 851417 - RNA, 19 nt, Homo sapiens
ggacgagcaggcagagaag

SEQ ID NO: 851418 - RNA, 19 nt, Homo sapiens
ucuagacuguagcaucuuc

SEQ ID NO: 851419 - RNA, 19 nt, Homo sapiens
ugaagacaccauccacauc

SEQ ID NO: 851420 - RNA, 19 nt, Homo sapiens
ucaaacaucagguggaaaa

SEQ ID NO: 851421 - RNA, 19 nt, Homo sapiens
gagaucuccaccuacaaga

SEQ ID NO: 851422 - RNA, 19 nt, Homo sapiens
cauaagcugagccgcgauu

SEQ ID NO: 851423 - RNA, 19 nt, Homo sapiens
gaucauugaccagguguac

SEQ ID NO: 851424 - RNA, 19 nt, Homo sapiens
cagaagaaggccaaguaca

SEQ ID NO: 851425 - RNA, 19 nt, Homo sapiens
uggagaacaaggucacuga

SEQ ID NO: 851426 - RNA, 19 nt, Homo sapiens
ucagcgaccaggacaugaa

SEQ ID NO: 851427 - RNA, 19 nt, Homo sapiens
ggucaagugagacguaggu

SEQ ID NO: 851428 - RNA, 19 nt, Homo sapiens
agagaggcagcgugaaaga

SEQ ID NO: 851429 - RNA, 19 nt, Homo sapiens
ggaagagauucaaguauua

SEQ ID NO: 851430 - RNA, 19 nt, Homo sapiens
gcaaagaaccuucaaauug

SEQ ID NO: 851431 - RNA, 19 nt, Homo sapiens
ggaagucuuugguccauua

SEQ ID NO: 851432 - RNA, 19 nt, Homo sapiens
gaaagugaauaugcaguua

SEQ ID NO: 851433 - RNA, 19 nt, Homo sapiens
gggcauaacuguagugaug

SEQ ID NO: 851434 - RNA, 19 nt, Homo sapiens
ggaguuaugcagcuaauua

SEQ ID NO: 851435 - RNA, 19 nt, Homo sapiens
gggaacaacuauaaagaaa

SEQ ID NO: 851436 - RNA, 19 nt, Homo sapiens
gaaaugucgcuguaaauaa

SEQ ID NO: 851437 - RNA, 19 nt, Homo sapiens
ucccauaucuguaaucaua

SEQ ID NO: 851438 - RNA, 19 nt, Homo sapiens
cugaaagucuagagaauua

SEQ ID NO: 851439 - RNA, 19 nt, Homo sapiens
gaggagagaaagaaauuua

SEQ ID NO: 851440 - RNA, 19 nt, Homo sapiens
gagaaucuguggauaagug

SEQ ID NO: 851441 - RNA, 19 nt, Homo sapiens
gaaacuguccagauuaauu

SEQ ID NO: 851442 - RNA, 19 nt, Homo sapiens
uaacaaacacucaugcuuu

SEQ ID NO: 851443 - RNA, 19 nt, Homo sapiens
gaauugggaacaacuauaa

SEQ ID NO: 851444 - RNA, 19 nt, Homo sapiens
aaagaaaugucgcuguaaa

SEQ ID NO: 851445 - RNA, 19 nt, Homo sapiens
caacuuuggugauaaacaa

SEQ ID NO: 851446 - RNA, 19 nt, Homo sapiens
gcacaauucuugagucucu

SEQ ID NO: 851447 - RNA, 19 nt, Homo sapiens
ugacaaauguggccuacuu

SEQ ID NO: 851448 - RNA, 19 nt, Homo sapiens
gguauuaaauccucauuag

SEQ ID NO: 851449 - RNA, 19 nt, Homo sapiens
aacaaacacucaugcuuua

SEQ ID NO: 851450 - RNA, 19 nt, Homo sapiens
caugaacggugguguguuu

SEQ ID NO: 851451 - RNA, 19 nt, Homo sapiens
gcuaugugcugacaaaugu

SEQ ID NO: 851452 - RNA, 19 nt, Homo sapiens
gaaaugagaaucuguggau

SEQ ID NO: 851453 - RNA, 19 nt, Homo sapiens
gcaaagaggagagaaagaa

SEQ ID NO: 851454 - RNA, 19 nt, Homo sapiens
cgauacaaaugcccagaua

SEQ ID NO: 851455 - RNA, 19 nt, Homo sapiens
ccagaaauccucuccauga

SEQ ID NO: 851456 - RNA, 19 nt, Homo sapiens
ggaggucauuacacauaua

SEQ ID NO: 851457 - RNA, 19 nt, Homo sapiens
gaugaaacuguccagauua

SEQ ID NO: 851458 - RNA, 19 nt, Homo sapiens
guagugaugguccuaaaua

SEQ ID NO: 851459 - RNA, 19 nt, Homo sapiens
ccaccuguuucacuaauaa

SEQ ID NO: 851460 - RNA, 19 nt, Homo sapiens
gcucacagcaauucugaua

SEQ ID NO: 851461 - RNA, 19 nt, Homo sapiens
uaucuaggcuuugucagua

SEQ ID NO: 851462 - RNA, 19 nt, Homo sapiens
caaaagaaaugucgcugua

SEQ ID NO: 851463 - RNA, 19 nt, Homo sapiens
ggucaaacgcagaacuuua

SEQ ID NO: 851464 - RNA, 19 nt, Homo sapiens
gaaauaaccaacaaagaag

SEQ ID NO: 851465 - RNA, 19 nt, Homo sapiens
ucacagcaauucugauaau

SEQ ID NO: 851466 - RNA, 19 nt, Homo sapiens
caggaguuauguuuaagua

SEQ ID NO: 851467 - RNA, 19 nt, Homo sapiens
acugggaaauuucucauua

SEQ ID NO: 851468 - RNA, 19 nt, Homo sapiens
aggaagagauucaaguauu

SEQ ID NO: 851469 - RNA, 19 nt, Homo sapiens
cuaaauagcaugaguguca

SEQ ID NO: 851470 - RNA, 19 nt, Homo sapiens
agaugaaacuguccagauu

SEQ ID NO: 851471 - RNA, 19 nt, Homo sapiens
ugagagaaauaaccaacaa

SEQ ID NO: 851472 - RNA, 19 nt, Homo sapiens
caacuuuguuacugaagaa

SEQ ID NO: 851473 - RNA, 19 nt, Homo sapiens
caaauaauacuggaaguug

SEQ ID NO: 851474 - RNA, 19 nt, Homo sapiens
caaaaggagucaguuauuu

SEQ ID NO: 851475 - RNA, 19 nt, Homo sapiens
caugguggcuuacaucugu

SEQ ID NO: 851476 - RNA, 19 nt, Homo sapiens
caaaagagacaacugauaa

SEQ ID NO: 851477 - RNA, 19 nt, Homo sapiens
guuaugaacuaauggacuu

SEQ ID NO: 851478 - RNA, 19 nt, Homo sapiens
gggauuggcuucgucauca

SEQ ID NO: 851479 - RNA, 19 nt, Homo sapiens
guaaucauaucuacaugca

SEQ ID NO: 851480 - RNA, 19 nt, Homo sapiens
gagaaauaaccaacaaaga

SEQ ID NO: 851481 - RNA, 19 nt, Homo sapiens
cuaauggacuugagaucuu

SEQ ID NO: 851482 - RNA, 19 nt, Homo sapiens
aaagaaaucuggaggucau

SEQ ID NO: 851483 - RNA, 19 nt, Homo sapiens
agaaaugucgcuguaaaua

SEQ ID NO: 851484 - RNA, 19 nt, Homo sapiens
gaaucuucaucucuccuaa

SEQ ID NO: 851485 - RNA, 19 nt, Homo sapiens
cauuacagcugugggcaua

SEQ ID NO: 851486 - RNA, 19 nt, Homo sapiens
gguggaacuccucauaaua

SEQ ID NO: 851487 - RNA, 19 nt, Homo sapiens
gagucuaucuaaacauaug

SEQ ID NO: 851488 - RNA, 19 nt, Homo sapiens
aaacacucaugcuuuaaug

SEQ ID NO: 851489 - RNA, 19 nt, Homo sapiens
gaacuuuaaagacgcguuu

SEQ ID NO: 851490 - RNA, 19 nt, Homo sapiens
uauagucccuggaguuaug

SEQ ID NO: 851491 - RNA, 19 nt, Homo sapiens
guggauaaguguuuguguu

SEQ ID NO: 851492 - RNA, 19 nt, Homo sapiens
aaaugucgcuguaaauaag

SEQ ID NO: 851493 - RNA, 19 nt, Homo sapiens
acaaccaccuguuucacua

SEQ ID NO: 851494 - RNA, 19 nt, Homo sapiens
gucaaacgcagaacuuuaa

SEQ ID NO: 851495 - RNA, 19 nt, Homo sapiens
ggguggaacuccucauaau

SEQ ID NO: 851496 - RNA, 19 nt, Homo sapiens
agagacaacugauaagaag

SEQ ID NO: 851497 - RNA, 19 nt, Homo sapiens
ggcaaagaaccuucaaauu

SEQ ID NO: 851498 - RNA, 19 nt, Homo sapiens
gcaauguuaguaauucuga

SEQ ID NO: 851499 - RNA, 19 nt, Homo sapiens
ugagacacauccaggaguu

SEQ ID NO: 851500 - RNA, 19 nt, Homo sapiens
caaagaggagagaaagaaa

SEQ ID NO: 851501 - RNA, 19 nt, Homo sapiens
guucaucccagcuuuguuu

SEQ ID NO: 851502 - RNA, 19 nt, Homo sapiens
gagggucaccuuccagaaa

SEQ ID NO: 851503 - RNA, 19 nt, Homo sapiens
guauauccauggccauugu

SEQ ID NO: 851504 - RNA, 19 nt, Homo sapiens
gaacuaauggacuugagau

SEQ ID NO: 851505 - RNA, 19 nt, Homo sapiens
cccaggugguuuagaauaa

SEQ ID NO: 851506 - RNA, 19 nt, Homo sapiens
gagcaggaaucuucaucuc

SEQ ID NO: 851507 - RNA, 19 nt, Homo sapiens
gagcugcugcuuucaaaug

SEQ ID NO: 851508 - RNA, 19 nt, Homo sapiens
aaacgcagaacuuuaaaga

SEQ ID NO: 851509 - RNA, 19 nt, Homo sapiens
gcaugucucugaccaucug

SEQ ID NO: 851510 - RNA, 19 nt, Homo sapiens
caauuacuauguggucauu

SEQ ID NO: 851511 - RNA, 19 nt, Homo sapiens
acaaauguggccuacuuua

SEQ ID NO: 851512 - RNA, 19 nt, Homo sapiens
gcaggagaauugcuugaac

SEQ ID NO: 851513 - RNA, 19 nt, Homo sapiens
gaaaccccaucucuacuaa

SEQ ID NO: 851514 - RNA, 19 nt, Homo sapiens
ucuaccagcuguuauuguu

SEQ ID NO: 851515 - RNA, 19 nt, Homo sapiens
ucaggaagagauucaagua

SEQ ID NO: 851516 - RNA, 19 nt, Homo sapiens
ggauaaguguuuguguuca

SEQ ID NO: 851517 - RNA, 19 nt, Homo sapiens
gucauucucuacaacauau

SEQ ID NO: 851518 - RNA, 19 nt, Homo sapiens
cuagagaauuacaacuuug

SEQ ID NO: 851519 - RNA, 19 nt, Homo sapiens
gacuugagaucuuggcaau

SEQ ID NO: 851520 - RNA, 19 nt, Homo sapiens
cagaaauccucuccaugau

SEQ ID NO: 851521 - RNA, 19 nt, Homo sapiens
gaguuaugcagcuaauuaa

SEQ ID NO: 851522 - RNA, 19 nt, Homo sapiens
gcuacauucuggaaccauu

SEQ ID NO: 851523 - RNA, 19 nt, Homo sapiens
gcaaaagagacaacugaua

SEQ ID NO: 851524 - RNA, 19 nt, Homo sapiens
augaaacuguccagauuaa

SEQ ID NO: 851525 - RNA, 19 nt, Homo sapiens
ccugaugagucuaucuaaa

SEQ ID NO: 851526 - RNA, 19 nt, Homo sapiens
ggucauucucuacaacaua

SEQ ID NO: 851527 - RNA, 19 nt, Homo sapiens
cugaggagcugcugcuuuc

SEQ ID NO: 851528 - RNA, 19 nt, Homo sapiens
uuccacaccuuaauuauca

SEQ ID NO: 851529 - RNA, 19 nt, Homo sapiens
ggacaaauguauaggauca

SEQ ID NO: 851530 - RNA, 19 nt, Homo sapiens
gaaggaagaaggauuacua

SEQ ID NO: 851531 - RNA, 19 nt, Homo sapiens
ggaagaaggauuacuaaau

SEQ ID NO: 851532 - RNA, 19 nt, Homo sapiens
gaagagugauaaggaaauu

SEQ ID NO: 851533 - RNA, 19 nt, Homo sapiens
agaaggaccugaaguguga

SEQ ID NO: 851534 - RNA, 19 nt, Homo sapiens
gaugaagagugauaaggaa

SEQ ID NO: 851535 - RNA, 19 nt, Homo sapiens
aaagcuaaguuucccguua

SEQ ID NO: 851536 - RNA, 19 nt, Homo sapiens
ccagaaggaagaaggauua

SEQ ID NO: 851537 - RNA, 19 nt, Homo sapiens
aaccggaaaugaucacuua

SEQ ID NO: 851538 - RNA, 19 nt, Homo sapiens
gaacaggugcauuuaaaca

SEQ ID NO: 851539 - RNA, 19 nt, Homo sapiens
ggaagugcuuugaagaugu

SEQ ID NO: 851540 - RNA, 19 nt, Homo sapiens
ggaaauuguugguacucuu

SEQ ID NO: 851541 - RNA, 19 nt, Homo sapiens
gaagugcuuugaagaugug

SEQ ID NO: 851542 - RNA, 19 nt, Homo sapiens
ggaaaugaucacuuagaaa

SEQ ID NO: 851543 - RNA, 19 nt, Homo sapiens
gaagauguguacccauuuu

SEQ ID NO: 851544 - RNA, 19 nt, Homo sapiens
cggaaaugaucacuuagaa

SEQ ID NO: 851545 - RNA, 19 nt, Homo sapiens
guaguuauuuugccacuua

SEQ ID NO: 851546 - RNA, 19 nt, Homo sapiens
aagcuaaguuucccguuaa

SEQ ID NO: 851547 - RNA, 19 nt, Homo sapiens
gauuugaacaggugcauuu

SEQ ID NO: 851548 - RNA, 19 nt, Homo sapiens
gggaagugcuuugaagaug

SEQ ID NO: 851549 - RNA, 19 nt, Homo sapiens
uguauaggaucaagaauuc

SEQ ID NO: 851550 - RNA, 19 nt, Homo sapiens
ucuaggauuugaugacuuu

SEQ ID NO: 851551 - RNA, 19 nt, Homo sapiens
ucauuuacgugaccauuug

SEQ ID NO: 851552 - RNA, 19 nt, Homo sapiens
uugaacaggugcauuuaaa

SEQ ID NO: 851553 - RNA, 19 nt, Homo sapiens
uggaagaugucacugaguu

SEQ ID NO: 851554 - RNA, 19 nt, Homo sapiens
gaucaagaauucacaucgu

SEQ ID NO: 851555 - RNA, 19 nt, Homo sapiens
gaaugaguuuccuugacuu

SEQ ID NO: 851556 - RNA, 19 nt, Homo sapiens
gaagaugucacugaguuug

SEQ ID NO: 851557 - RNA, 19 nt, Homo sapiens
gaaaucacaccagaaggaa

SEQ ID NO: 851558 - RNA, 19 nt, Homo sapiens
gaaauuguugguacucuuc

SEQ ID NO: 851559 - RNA, 19 nt, Homo sapiens
ggaccugaagugugaauga

SEQ ID NO: 851560 - RNA, 19 nt, Homo sapiens
gauaaggaaauuguuggua

SEQ ID NO: 851561 - RNA, 19 nt, Homo sapiens
ugaaugaguuuccuugacu

SEQ ID NO: 851562 - RNA, 19 nt, Homo sapiens
ggaagaugucacugaguuu

SEQ ID NO: 851563 - RNA, 19 nt, Homo sapiens
gaugaacuuugauuugaac

SEQ ID NO: 851564 - RNA, 19 nt, Homo sapiens
uugaagauguguacccauu

SEQ ID NO: 851565 - RNA, 19 nt, Homo sapiens
ugaaaucacaccagaagga

SEQ ID NO: 851566 - RNA, 19 nt, Homo sapiens
ucaauaugguacuggaaga

SEQ ID NO: 851567 - RNA, 19 nt, Homo sapiens
gcauuuaaacaaccggaaa

SEQ ID NO: 851568 - RNA, 19 nt, Homo sapiens
ccugaagugugaaugaguu

SEQ ID NO: 851569 - RNA, 19 nt, Homo sapiens
ggagaaggaccugaagugu

SEQ ID NO: 851570 - RNA, 19 nt, Homo sapiens
uaaacaaccggaaaugauc

SEQ ID NO: 851571 - RNA, 19 nt, Homo sapiens
guggacaaauguauaggau

SEQ ID NO: 851572 - RNA, 19 nt, Homo sapiens
guacucuucuaggauuuga

SEQ ID NO: 851573 - RNA, 19 nt, Homo sapiens
ugaguuuccuugacuuaca

SEQ ID NO: 851574 - RNA, 19 nt, Homo sapiens
uuaaacaaccggaaaugau

SEQ ID NO: 851575 - RNA, 19 nt, Homo sapiens
ucacugaguuugaaaucac

SEQ ID NO: 851576 - RNA, 19 nt, Homo sapiens
uaaggaaauuguugguacu

SEQ ID NO: 851577 - RNA, 19 nt, Homo sapiens
ugaugaagagugauaagga

SEQ ID NO: 851578 - RNA, 19 nt, Homo sapiens
gaccugaagugugaaugag

SEQ ID NO: 851579 - RNA, 19 nt, Homo sapiens
gcaguagccaguggaacaa

SEQ ID NO: 851580 - RNA, 19 nt, Homo sapiens
ugaagauguguacccauuu

SEQ ID NO: 851581 - RNA, 19 nt, Homo sapiens
uaaaucccauaaagcuaag

SEQ ID NO: 851582 - RNA, 19 nt, Homo sapiens
cccacuuucuaauguuuaa

SEQ ID NO: 851583 - RNA, 19 nt, Homo sapiens
ggcuuauaaugacaagaaa

SEQ ID NO: 851584 - RNA, 19 nt, Homo sapiens
uggcuuauaaugacaagaa

SEQ ID NO: 851585 - RNA, 19 nt, Homo sapiens
gugaaugaguuuccuugac

SEQ ID NO: 851586 - RNA, 19 nt, Homo sapiens
aaggaagaaggauuacuaa

SEQ ID NO: 851587 - RNA, 19 nt, Homo sapiens
uugguacucuucuaggauu

SEQ ID NO: 851588 - RNA, 19 nt, Homo sapiens
aaucacaccagaaggaaga

SEQ ID NO: 851589 - RNA, 19 nt, Homo sapiens
agaugucacugaguuugaa

SEQ ID NO: 851590 - RNA, 19 nt, Homo sapiens
aaacaaccggaaaugauca

SEQ ID NO: 851591 - RNA, 19 nt, Homo sapiens
acaaauguauaggaucaag

SEQ ID NO: 851592 - RNA, 19 nt, Homo sapiens
uuacgugaccauuugauuc

SEQ ID NO: 851593 - RNA, 19 nt, Homo sapiens
ugaagagugauaaggaaau

SEQ ID NO: 851594 - RNA, 19 nt, Homo sapiens
aaugaguuuccuugacuua

SEQ ID NO: 851595 - RNA, 19 nt, Homo sapiens
caaauguauaggaucaaga

SEQ ID NO: 851596 - RNA, 19 nt, Homo sapiens
acaggugcauuuaaacaac

SEQ ID NO: 851597 - RNA, 19 nt, Homo sapiens
ccggaaaugaucacuuaga

SEQ ID NO: 851598 - RNA, 19 nt, Homo sapiens
caaccggaaaugaucacuu

SEQ ID NO: 851599 - RNA, 19 nt, Homo sapiens
agagugauaaggaaauugu

SEQ ID NO: 851600 - RNA, 19 nt, Homo sapiens
cgugaccauuugauucuca

SEQ ID NO: 851601 - RNA, 19 nt, Homo sapiens
gguuaacugucauuuuguu

SEQ ID NO: 851602 - RNA, 19 nt, Homo sapiens
uuccuugacuuacacuaga

SEQ ID NO: 851603 - RNA, 19 nt, Homo sapiens
gaggagaaggaccugaagu

SEQ ID NO: 851604 - RNA, 19 nt, Homo sapiens
gaugucacugaguuugaaa

SEQ ID NO: 851605 - RNA, 19 nt, Homo sapiens
ggaggagaaggaccugaag

SEQ ID NO: 851606 - RNA, 19 nt, Homo sapiens
cggcuaacgcuacuaccaa

SEQ ID NO: 851607 - RNA, 19 nt, Homo sapiens
gggaagugcuguuuguuau

SEQ ID NO: 851608 - RNA, 19 nt, Homo sapiens
gaaagcuacuucacaaucu

SEQ ID NO: 851609 - RNA, 19 nt, Homo sapiens
gaagaaggaagaaaugaga

SEQ ID NO: 851610 - RNA, 19 nt, Homo sapiens
ggacaucggcuuugaagau

SEQ ID NO: 851611 - RNA, 19 nt, Homo sapiens
gacaauaucaggcugguuu

SEQ ID NO: 851612 - RNA, 19 nt, Homo sapiens
ccaagaagaccgaaagcua

SEQ ID NO: 851613 - RNA, 19 nt, Homo sapiens
gaacugcugugaccuuagg

SEQ ID NO: 851614 - RNA, 19 nt, Homo sapiens
gagcugcaccucuugcuaa

SEQ ID NO: 851615 - RNA, 19 nt, Homo sapiens
ggacuagcccagaaacuug

SEQ ID NO: 851616 - RNA, 19 nt, Homo sapiens
gcuggucccuggugauuug

SEQ ID NO: 851617 - RNA, 19 nt, Homo sapiens
ggacugugguuccaaggau

SEQ ID NO: 851618 - RNA, 19 nt, Homo sapiens
caagaaugcugcugauggu

SEQ ID NO: 851619 - RNA, 19 nt, Homo sapiens
gaacugcugcugccuguca

SEQ ID NO: 851620 - RNA, 19 nt, Homo sapiens
cagcguggguuccuauuuc

SEQ ID NO: 851621 - RNA, 19 nt, Homo sapiens
gcugcugccugucaucauu

SEQ ID NO: 851622 - RNA, 19 nt, Homo sapiens
agucagggcugccuucaug

SEQ ID NO: 851623 - RNA, 19 nt, Homo sapiens
cagcaggcauggagaguca

SEQ ID NO: 851624 - RNA, 19 nt, Homo sapiens
gaagaaaugagagucuaga

SEQ ID NO: 851625 - RNA, 19 nt, Homo sapiens
gacacuggauggcaagaau

SEQ ID NO: 851626 - RNA, 19 nt, Homo sapiens
cagacuccuucuacuauga

SEQ ID NO: 851627 - RNA, 19 nt, Homo sapiens
cagcugcacugccucuaug

SEQ ID NO: 851628 - RNA, 19 nt, Homo sapiens
gugcagacacccacaauca

SEQ ID NO: 851629 - RNA, 19 nt, Homo sapiens
ccaccacccuggccuaucu

SEQ ID NO: 851630 - RNA, 19 nt, Homo sapiens
gagaaagggaauccaagga

SEQ ID NO: 851631 - RNA, 19 nt, Homo sapiens
gcauucaagcucuggauug

SEQ ID NO: 851632 - RNA, 19 nt, Homo sapiens
uggaacugcugugaccuua

SEQ ID NO: 851633 - RNA, 19 nt, Homo sapiens
gaagugcuguuuguuaucc

SEQ ID NO: 851634 - RNA, 19 nt, Homo sapiens
ugucauggcccacgcguuu

SEQ ID NO: 851635 - RNA, 19 nt, Homo sapiens
ggagauguaccagcuguau

SEQ ID NO: 851636 - RNA, 19 nt, Homo sapiens
cgaaagcuacuucacaauc

SEQ ID NO: 851637 - RNA, 19 nt, Homo sapiens
uaucuggauucuggcaaua

SEQ ID NO: 851638 - RNA, 19 nt, Homo sapiens
gcagcgagcacaucgagau

SEQ ID NO: 851639 - RNA, 19 nt, Homo sapiens
gcagcguggguuccuauuu

SEQ ID NO: 851640 - RNA, 19 nt, Homo sapiens
gggaaccuauggagaaagg

SEQ ID NO: 851641 - RNA, 19 nt, Homo sapiens
ccagacuccuucuacuaug

SEQ ID NO: 851642 - RNA, 19 nt, Homo sapiens
cauguacacgcucuacuuu

SEQ ID NO: 851643 - RNA, 19 nt, Homo sapiens
caggcugguuuacaacaaa

SEQ ID NO: 851644 - RNA, 19 nt, Homo sapiens
ugaaugggacccugagaga

SEQ ID NO: 851645 - RNA, 19 nt, Homo sapiens
gcaguuuguugcguucuuc

SEQ ID NO: 851646 - RNA, 19 nt, Homo sapiens
gcgagaugaucgaggagau

SEQ ID NO: 851647 - RNA, 19 nt, Homo sapiens
gggacuagcccagaaacuu

SEQ ID NO: 851648 - RNA, 19 nt, Homo sapiens
agaaagggaauccaaggaa

SEQ ID NO: 851649 - RNA, 19 nt, Homo sapiens
caccagacuccuucuacua

SEQ ID NO: 851650 - RNA, 19 nt, Homo sapiens
ggaagaaaugagagucuag

SEQ ID NO: 851651 - RNA, 19 nt, Homo sapiens
caucauugacugcuggauu

SEQ ID NO: 851652 - RNA, 19 nt, Homo sapiens
ucuggauucuggcaauaaa

SEQ ID NO: 851653 - RNA, 19 nt, Homo sapiens
guaucuggauucuggcaau

SEQ ID NO: 851654 - RNA, 19 nt, Homo sapiens
gaccgaaagcuacuucaca

SEQ ID NO: 851655 - RNA, 19 nt, Homo sapiens
gcuggcugcugcccuacaa

SEQ ID NO: 851656 - RNA, 19 nt, Homo sapiens
gcgaugguacugugaacuu

SEQ ID NO: 851657 - RNA, 19 nt, Homo sapiens
gcaaguucuuccaggacau

SEQ ID NO: 851658 - RNA, 19 nt, Homo sapiens
gcagacacccacaaucaac

SEQ ID NO: 851659 - RNA, 19 nt, Homo sapiens
ccuggaaggacaaguauau

SEQ ID NO: 851660 - RNA, 19 nt, Homo sapiens
accgaaagcuacuucacaa

SEQ ID NO: 851661 - RNA, 19 nt, Homo sapiens
ggauugggcagcagaugug

SEQ ID NO: 851662 - RNA, 19 nt, Homo sapiens
aggaagaaaugagagucua

SEQ ID NO: 851663 - RNA, 19 nt, Homo sapiens
gccaggagcaccaaguguu

SEQ ID NO: 851664 - RNA, 19 nt, Homo sapiens
guacgugucccuggcuuug

SEQ ID NO: 851665 - RNA, 19 nt, Homo sapiens
ucccugagcugcaccucuu

SEQ ID NO: 851666 - RNA, 19 nt, Homo sapiens
ccacacaccagccacagau

SEQ ID NO: 851667 - RNA, 19 nt, Homo sapiens
gcagugaagaaggaagaaa

SEQ ID NO: 851668 - RNA, 19 nt, Homo sapiens
cacccuggccuaucugaaa

SEQ ID NO: 851669 - RNA, 19 nt, Homo sapiens
gaugguacugugaacuuga

SEQ ID NO: 851670 - RNA, 19 nt, Homo sapiens
uguacacgcucuacuuucu

SEQ ID NO: 851671 - RNA, 19 nt, Homo sapiens
ucaggcugguuuacaacaa

SEQ ID NO: 851672 - RNA, 19 nt, Homo sapiens
acaucucacuccacuccua

SEQ ID NO: 851673 - RNA, 19 nt, Homo sapiens
ggaagugcuguuuguuauc

SEQ ID NO: 851674 - RNA, 19 nt, Homo sapiens
ccaggagcaccaaguguug

SEQ ID NO: 851675 - RNA, 19 nt, Homo sapiens
cgaugguacugugaacuug

SEQ ID NO: 851676 - RNA, 19 nt, Homo sapiens
auaucaggcugguuuacaa

SEQ ID NO: 851677 - RNA, 19 nt, Homo sapiens
gcagcuggauuuucucugu

SEQ ID NO: 851678 - RNA, 19 nt, Homo sapiens
gugaagaaggaagaaauga

SEQ ID NO: 851679 - RNA, 19 nt, Homo sapiens
ggacacuggauggcaagaa

SEQ ID NO: 851680 - RNA, 19 nt, Homo sapiens
uaccucugcuccaagaaga

SEQ ID NO: 851681 - RNA, 19 nt, Homo sapiens
ggggaagugcuguuuguua

SEQ ID NO: 851682 - RNA, 19 nt, Homo sapiens
gagaugaucgaggagaugu

SEQ ID NO: 851683 - RNA, 19 nt, Homo sapiens
acaauaucaggcugguuua

SEQ ID NO: 851684 - RNA, 19 nt, Homo sapiens
aaagcuacuucacaaucug

SEQ ID NO: 851685 - RNA, 19 nt, Homo sapiens
ucugggaaccuauggagaa

SEQ ID NO: 851686 - RNA, 19 nt, Homo sapiens
ccacaccagacuccuucua

SEQ ID NO: 851687 - RNA, 19 nt, Homo sapiens
gggacuaccgcaaguucuu

SEQ ID NO: 851688 - RNA, 19 nt, Homo sapiens
gacuagcccagaaacuuga

SEQ ID NO: 851689 - RNA, 19 nt, Homo sapiens
gaugguggaacugcuguga

SEQ ID NO: 851690 - RNA, 19 nt, Homo sapiens
aucauugacugcuggauug

SEQ ID NO: 851691 - RNA, 19 nt, Homo sapiens
cacuaccucugcuccaaga

SEQ ID NO: 851692 - RNA, 19 nt, Homo sapiens
ggacuaccgcaaguucuuc

SEQ ID NO: 851693 - RNA, 19 nt, Homo sapiens
agacacccacaaucaacua

SEQ ID NO: 851694 - RNA, 19 nt, Homo sapiens
cauucaagcucuggauugg

SEQ ID NO: 851695 - RNA, 19 nt, Homo sapiens
gagauguaccagcuguaug

SEQ ID NO: 851696 - RNA, 19 nt, Homo sapiens
caauaaaaguacucuggau

SEQ ID NO: 851697 - RNA, 19 nt, Homo sapiens
cugggaaccuauggagaaa

SEQ ID NO: 851698 - RNA, 19 nt, Homo sapiens
ggcaguuuguugcguucuu

SEQ ID NO: 851699 - RNA, 19 nt, Homo sapiens
acacauggucaccugagaa

SEQ ID NO: 851700 - RNA, 19 nt, Homo sapiens
guacucuggaugcuguaaa

SEQ ID NO: 851701 - RNA, 19 nt, Homo sapiens
uggcaagaaugcugcugau

SEQ ID NO: 851702 - RNA, 19 nt, Homo sapiens
guacugugaacuugaagag

SEQ ID NO: 851703 - RNA, 19 nt, Homo sapiens
ucauggcaguaggcucuaa

SEQ ID NO: 851704 - RNA, 19 nt, Homo sapiens
gauuuccucggaugugcua

SEQ ID NO: 851705 - RNA, 19 nt, Homo sapiens
cagugaagaaggaagaaau

SEQ ID NO: 851706 - RNA, 19 nt, Homo sapiens
uccaggacaucggcuuuga

SEQ ID NO: 851707 - RNA, 19 nt, Homo sapiens
caaaggcguuucccaaaua

SEQ ID NO: 851708 - RNA, 19 nt, Homo sapiens
gaaagaggaugacaugugu

SEQ ID NO: 851709 - RNA, 19 nt, Homo sapiens
gcaaaguuguggacuguuu

SEQ ID NO: 851710 - RNA, 19 nt, Homo sapiens
ggacagaucccauaaauac

SEQ ID NO: 851711 - RNA, 19 nt, Homo sapiens
ggagaaacccuacaaaugu

SEQ ID NO: 851712 - RNA, 19 nt, Homo sapiens
gaaauagaccucuccugua

SEQ ID NO: 851713 - RNA, 19 nt, Homo sapiens
gggaaagccuucagaguga

SEQ ID NO: 851714 - RNA, 19 nt, Homo sapiens
gcagaauccuucccagaaa

SEQ ID NO: 851715 - RNA, 19 nt, Homo sapiens
gagagacccuucaagugua

SEQ ID NO: 851716 - RNA, 19 nt, Homo sapiens
ggagagagaccacauaaau

SEQ ID NO: 851717 - RNA, 19 nt, Homo sapiens
gaggacagaucccauaaau

SEQ ID NO: 851718 - RNA, 19 nt, Homo sapiens
guaacaacuucaagcauuu

SEQ ID NO: 851719 - RNA, 19 nt, Homo sapiens
gaagucacaucuuaaucaa

SEQ ID NO: 851720 - RNA, 19 nt, Homo sapiens
cagcugggauugaaaguaa

SEQ ID NO: 851721 - RNA, 19 nt, Homo sapiens
gagggcagcuaaacccaua

SEQ ID NO: 851722 - RNA, 19 nt, Homo sapiens
ccucugaguuggaaugaua

SEQ ID NO: 851723 - RNA, 19 nt, Homo sapiens
ggagagacccuucaagugu

SEQ ID NO: 851724 - RNA, 19 nt, Homo sapiens
ggagaaggcugugaguuuc

SEQ ID NO: 851725 - RNA, 19 nt, Homo sapiens
caaauagguugaaauccuu

SEQ ID NO: 851726 - RNA, 19 nt, Homo sapiens
acucugaagucacaucuua

SEQ ID NO: 851727 - RNA, 19 nt, Homo sapiens
gggaaaagcuucauucaga

SEQ ID NO: 851728 - RNA, 19 nt, Homo sapiens
gaacaucacccugaaagug

SEQ ID NO: 851729 - RNA, 19 nt, Homo sapiens
gggaaaccauacuccuaua

SEQ ID NO: 851730 - RNA, 19 nt, Homo sapiens
gggcacagaugcagcgauu

SEQ ID NO: 851731 - RNA, 19 nt, Homo sapiens
ggaaagaggaugacaugug

SEQ ID NO: 851732 - RNA, 19 nt, Homo sapiens
gagaagcccuaucaaugug

SEQ ID NO: 851733 - RNA, 19 nt, Homo sapiens
gaacuucggucgccauucg

SEQ ID NO: 851734 - RNA, 19 nt, Homo sapiens
gaacgcagacagcagauug

SEQ ID NO: 851735 - RNA, 19 nt, Homo sapiens
aaauagaccucuccuguag

SEQ ID NO: 851736 - RNA, 19 nt, Homo sapiens
acaagaagauugaguuaca

SEQ ID NO: 851737 - RNA, 19 nt, Homo sapiens
gacauucagucuucacuug

SEQ ID NO: 851738 - RNA, 19 nt, Homo sapiens
caacaucagagaauccaua

SEQ ID NO: 851739 - RNA, 19 nt, Homo sapiens
gggagaaacccuacaaaug

SEQ ID NO: 851740 - RNA, 19 nt, Homo sapiens
ucacagacaucagcccuaa

SEQ ID NO: 851741 - RNA, 19 nt, Homo sapiens
cccaacaccugguucauuu

SEQ ID NO: 851742 - RNA, 19 nt, Homo sapiens
ugacuugccuggcuuacaa

SEQ ID NO: 851743 - RNA, 19 nt, Homo sapiens
cagaaugaguuucaguuug

SEQ ID NO: 851744 - RNA, 19 nt, Homo sapiens
ggagaacccacaauaauag

SEQ ID NO: 851745 - RNA, 19 nt, Homo sapiens
gagaagacaggcaaaguug

SEQ ID NO: 851746 - RNA, 19 nt, Homo sapiens
gagaaaugcuuuaguuagc

SEQ ID NO: 851747 - RNA, 19 nt, Homo sapiens
gugcacaucuuauucaaca

SEQ ID NO: 851748 - RNA, 19 nt, Homo sapiens
caaagaggaugaacuacag

SEQ ID NO: 851749 - RNA, 19 nt, Homo sapiens
gagaaacccuacaaauguc

SEQ ID NO: 851750 - RNA, 19 nt, Homo sapiens
ggagaacuaugggaguauu

SEQ ID NO: 851751 - RNA, 19 nt, Homo sapiens
ccaucaaacucacaaauag

SEQ ID NO: 851752 - RNA, 19 nt, Homo sapiens
ggaaaccauacuccuauaa

SEQ ID NO: 851753 - RNA, 19 nt, Homo sapiens
gcagagaagcccuaucaau

SEQ ID NO: 851754 - RNA, 19 nt, Homo sapiens
ggaauucccaugaaagaga

SEQ ID NO: 851755 - RNA, 19 nt, Homo sapiens
ucccagaagucccuuuaua

SEQ ID NO: 851756 - RNA, 19 nt, Homo sapiens
gcucacagcucuuguucuc

SEQ ID NO: 851757 - RNA, 19 nt, Homo sapiens
guucugagccuguuugcua

SEQ ID NO: 851758 - RNA, 19 nt, Homo sapiens
gaacccacaauaauagaaa

SEQ ID NO: 851759 - RNA, 19 nt, Homo sapiens
cagagaagcccuaucaaug

SEQ ID NO: 851760 - RNA, 19 nt, Homo sapiens
aaagggaucuggaugcaau

SEQ ID NO: 851761 - RNA, 19 nt, Homo sapiens
ucaaaggcguuucccaaau

SEQ ID NO: 851762 - RNA, 19 nt, Homo sapiens
aggaacagcuucaugaguu

SEQ ID NO: 851763 - RNA, 19 nt, Homo sapiens
gaccgaaucccgagaaguu

SEQ ID NO: 851764 - RNA, 19 nt, Homo sapiens
cggagaacccacaauaaua

SEQ ID NO: 851765 - RNA, 19 nt, Homo sapiens
cgagagaaaucccaucagu

SEQ ID NO: 851766 - RNA, 19 nt, Homo sapiens
cuccaagccucaaacuuua

SEQ ID NO: 851767 - RNA, 19 nt, Homo sapiens
guacaacccgccaacguuu

SEQ ID NO: 851768 - RNA, 19 nt, Homo sapiens
gaauugcccucaggagaug

SEQ ID NO: 851769 - RNA, 19 nt, Homo sapiens
aaaccauacuccuauaaug

SEQ ID NO: 851770 - RNA, 19 nt, Homo sapiens
aaggcaagcuggauagaaa

SEQ ID NO: 851771 - RNA, 19 nt, Homo sapiens
guggugauauacagaauga

SEQ ID NO: 851772 - RNA, 19 nt, Homo sapiens
gugaaacacucuaccuugu

SEQ ID NO: 851773 - RNA, 19 nt, Homo sapiens
gaaaccauacuccuauaau

SEQ ID NO: 851774 - RNA, 19 nt, Homo sapiens
gaacucauacagcagagaa

SEQ ID NO: 851775 - RNA, 19 nt, Homo sapiens
ugacagugauugaagacaa

SEQ ID NO: 851776 - RNA, 19 nt, Homo sapiens
gaacuugacagugauugaa

SEQ ID NO: 851777 - RNA, 19 nt, Homo sapiens
uaacacagccagccucgaa

SEQ ID NO: 851778 - RNA, 19 nt, Homo sapiens
guaguucaguuugucaauu

SEQ ID NO: 851779 - RNA, 19 nt, Homo sapiens
caaugaaccuuuucuagaa

SEQ ID NO: 851780 - RNA, 19 nt, Homo sapiens
gcaggaagaccuuuucaua

SEQ ID NO: 851781 - RNA, 19 nt, Homo sapiens
aguaacaacuucaagcauu

SEQ ID NO: 851782 - RNA, 19 nt, Homo sapiens
gcacagaugcagcgauugu

SEQ ID NO: 851783 - RNA, 19 nt, Homo sapiens
gacaucagcccuaagcaaa

SEQ ID NO: 851784 - RNA, 19 nt, Homo sapiens
ggaccaaggcgaauuacga

SEQ ID NO: 851785 - RNA, 19 nt, Homo sapiens
gaagacaggcaaaguugug

SEQ ID NO: 851786 - RNA, 19 nt, Homo sapiens
ggaguuguagccucuuuaa

SEQ ID NO: 851787 - RNA, 19 nt, Homo sapiens
ccaccuggcuggacaucuu

SEQ ID NO: 851788 - RNA, 19 nt, Homo sapiens
gagagagaccacauaaaug

SEQ ID NO: 851789 - RNA, 19 nt, Homo sapiens
ccuccaagccucaaacuuu

SEQ ID NO: 851790 - RNA, 19 nt, Homo sapiens
aauuucagcuggaguugua

SEQ ID NO: 851791 - RNA, 19 nt, Homo sapiens
acagugaagucccauaugu

SEQ ID NO: 851792 - RNA, 19 nt, Homo sapiens
aaaggcguuucccaaauaa

SEQ ID NO: 851793 - RNA, 19 nt, Homo sapiens
gcuaagcucucucccuucu

SEQ ID NO: 851794 - RNA, 19 nt, Homo sapiens
gguugaaauccuuuaguua

SEQ ID NO: 851795 - RNA, 19 nt, Homo sapiens
caagaagauugaguuacaa

SEQ ID NO: 851796 - RNA, 19 nt, Homo sapiens
ccuguagaguggugauaua

SEQ ID NO: 851797 - RNA, 19 nt, Homo sapiens
ggacauggucgaggaauuc

SEQ ID NO: 851798 - RNA, 19 nt, Homo sapiens
ggaaaucuagacaagaaga

SEQ ID NO: 851799 - RNA, 19 nt, Homo sapiens
gagggaaaccauacuccua

SEQ ID NO: 851800 - RNA, 19 nt, Homo sapiens
guuguagccucuuuaaaca

SEQ ID NO: 851801 - RNA, 19 nt, Homo sapiens
ggaaugauaaugaccgaau

SEQ ID NO: 851802 - RNA, 19 nt, Homo sapiens
cgacuccacucccgagaga

SEQ ID NO: 851803 - RNA, 19 nt, Homo sapiens
cgccaacguuugagacuuu

SEQ ID NO: 851804 - RNA, 19 nt, Homo sapiens
gaaaaugcccuuccuguuc

SEQ ID NO: 851805 - RNA, 19 nt, Homo sapiens
aaagaauuccuuagcauga

SEQ ID NO: 851806 - RNA, 19 nt, Homo sapiens
cuucaugaguucaguagaa

SEQ ID NO: 851807 - RNA, 19 nt, Homo sapiens
caaaggcguuucccaaaua

SEQ ID NO: 851808 - RNA, 19 nt, Homo sapiens
gaaagaggaugacaugugu

SEQ ID NO: 851809 - RNA, 19 nt, Homo sapiens
gcaaaguuguggacuguuu

SEQ ID NO: 851810 - RNA, 19 nt, Homo sapiens
ggacagaucccauaaauac

SEQ ID NO: 851811 - RNA, 19 nt, Homo sapiens
ggagaaacccuacaaaugu

SEQ ID NO: 851812 - RNA, 19 nt, Homo sapiens
gaaauagaccucuccugua

SEQ ID NO: 851813 - RNA, 19 nt, Homo sapiens
gggaaagccuucagaguga

SEQ ID NO: 851814 - RNA, 19 nt, Homo sapiens
gcagaauccuucccagaaa

SEQ ID NO: 851815 - RNA, 19 nt, Homo sapiens
gagagacccuucaagugua

SEQ ID NO: 851816 - RNA, 19 nt, Homo sapiens
ggagagagaccacauaaau

SEQ ID NO: 851817 - RNA, 19 nt, Homo sapiens
gaggacagaucccauaaau

SEQ ID NO: 851818 - RNA, 19 nt, Homo sapiens
guaacaacuucaagcauuu

SEQ ID NO: 851819 - RNA, 19 nt, Homo sapiens
gaagucacaucuuaaucaa

SEQ ID NO: 851820 - RNA, 19 nt, Homo sapiens
cagcugggauugaaaguaa

SEQ ID NO: 851821 - RNA, 19 nt, Homo sapiens
gagggcagcuaaacccaua

SEQ ID NO: 851822 - RNA, 19 nt, Homo sapiens
ccucugaguuggaaugaua

SEQ ID NO: 851823 - RNA, 19 nt, Homo sapiens
ggagagacccuucaagugu

SEQ ID NO: 851824 - RNA, 19 nt, Homo sapiens
ggagaaggcugugaguuuc

SEQ ID NO: 851825 - RNA, 19 nt, Homo sapiens
caaauagguugaaauccuu

SEQ ID NO: 851826 - RNA, 19 nt, Homo sapiens
acucugaagucacaucuua

SEQ ID NO: 851827 - RNA, 19 nt, Homo sapiens
gggaaaagcuucauucaga

SEQ ID NO: 851828 - RNA, 19 nt, Homo sapiens
gaacaucacccugaaagug

SEQ ID NO: 851829 - RNA, 19 nt, Homo sapiens
gggaaaccauacuccuaua

SEQ ID NO: 851830 - RNA, 19 nt, Homo sapiens
gggcacagaugcagcgauu

SEQ ID NO: 851831 - RNA, 19 nt, Homo sapiens
ggaaagaggaugacaugug

SEQ ID NO: 851832 - RNA, 19 nt, Homo sapiens
gagaagcccuaucaaugug

SEQ ID NO: 851833 - RNA, 19 nt, Homo sapiens
gaacuucggucgccauucg

SEQ ID NO: 851834 - RNA, 19 nt, Homo sapiens
gaacgcagacagcagauug

SEQ ID NO: 851835 - RNA, 19 nt, Homo sapiens
aaauagaccucuccuguag

SEQ ID NO: 851836 - RNA, 19 nt, Homo sapiens
acaagaagauugaguuaca

SEQ ID NO: 851837 - RNA, 19 nt, Homo sapiens
gacauucagucuucacuug

SEQ ID NO: 851838 - RNA, 19 nt, Homo sapiens
caacaucagagaauccaua

SEQ ID NO: 851839 - RNA, 19 nt, Homo sapiens
gggagaaacccuacaaaug

SEQ ID NO: 851840 - RNA, 19 nt, Homo sapiens
ucacagacaucagcccuaa

SEQ ID NO: 851841 - RNA, 19 nt, Homo sapiens
cccaacaccugguucauuu

SEQ ID NO: 851842 - RNA, 19 nt, Homo sapiens
ugacuugccuggcuuacaa

SEQ ID NO: 851843 - RNA, 19 nt, Homo sapiens
cagaaugaguuucaguuug

SEQ ID NO: 851844 - RNA, 19 nt, Homo sapiens
ggagaacccacaauaauag

SEQ ID NO: 851845 - RNA, 19 nt, Homo sapiens
gagaagacaggcaaaguug

SEQ ID NO: 851846 - RNA, 19 nt, Homo sapiens
gagaaaugcuuuaguuagc

SEQ ID NO: 851847 - RNA, 19 nt, Homo sapiens
gugcacaucuuauucaaca

SEQ ID NO: 851848 - RNA, 19 nt, Homo sapiens
caaagaggaugaacuacag

SEQ ID NO: 851849 - RNA, 19 nt, Homo sapiens
gagaaacccuacaaauguc

SEQ ID NO: 851850 - RNA, 19 nt, Homo sapiens
ggagaacuaugggaguauu

SEQ ID NO: 851851 - RNA, 19 nt, Homo sapiens
ccaucaaacucacaaauag

SEQ ID NO: 851852 - RNA, 19 nt, Homo sapiens
ggaaaccauacuccuauaa

SEQ ID NO: 851853 - RNA, 19 nt, Homo sapiens
gcagagaagcccuaucaau

SEQ ID NO: 851854 - RNA, 19 nt, Homo sapiens
ggaauucccaugaaagaga

SEQ ID NO: 851855 - RNA, 19 nt, Homo sapiens
ucccagaagucccuuuaua

SEQ ID NO: 851856 - RNA, 19 nt, Homo sapiens
gcucacagcucuuguucuc

SEQ ID NO: 851857 - RNA, 19 nt, Homo sapiens
guucugagccuguuugcua

SEQ ID NO: 851858 - RNA, 19 nt, Homo sapiens
gaacccacaauaauagaaa

SEQ ID NO: 851859 - RNA, 19 nt, Homo sapiens
cagagaagcccuaucaaug

SEQ ID NO: 851860 - RNA, 19 nt, Homo sapiens
aaagggaucuggaugcaau

SEQ ID NO: 851861 - RNA, 19 nt, Homo sapiens
ucaaaggcguuucccaaau

SEQ ID NO: 851862 - RNA, 19 nt, Homo sapiens
aggaacagcuucaugaguu

SEQ ID NO: 851863 - RNA, 19 nt, Homo sapiens
gaccgaaucccgagaaguu

SEQ ID NO: 851864 - RNA, 19 nt, Homo sapiens
cggagaacccacaauaaua

SEQ ID NO: 851865 - RNA, 19 nt, Homo sapiens
cgagagaaaucccaucagu

SEQ ID NO: 851866 - RNA, 19 nt, Homo sapiens
cuccaagccucaaacuuua

SEQ ID NO: 851867 - RNA, 19 nt, Homo sapiens
guacaacccgccaacguuu

SEQ ID NO: 851868 - RNA, 19 nt, Homo sapiens
gaauugcccucaggagaug

SEQ ID NO: 851869 - RNA, 19 nt, Homo sapiens
aaaccauacuccuauaaug

SEQ ID NO: 851870 - RNA, 19 nt, Homo sapiens
aaggcaagcuggauagaaa

SEQ ID NO: 851871 - RNA, 19 nt, Homo sapiens
guggugauauacagaauga

SEQ ID NO: 851872 - RNA, 19 nt, Homo sapiens
gugaaacacucuaccuugu

SEQ ID NO: 851873 - RNA, 19 nt, Homo sapiens
uaacacagccagccucgaa

SEQ ID NO: 851874 - RNA, 19 nt, Homo sapiens
gaaaccauacuccuauaau

SEQ ID NO: 851875 - RNA, 19 nt, Homo sapiens
gaacucauacagcagagaa

SEQ ID NO: 851876 - RNA, 19 nt, Homo sapiens
ugacagugauugaagacaa

SEQ ID NO: 851877 - RNA, 19 nt, Homo sapiens
gaacuugacagugauugaa

SEQ ID NO: 851878 - RNA, 19 nt, Homo sapiens
guaguucaguuugucaauu

SEQ ID NO: 851879 - RNA, 19 nt, Homo sapiens
caaugaaccuuuucuagaa

SEQ ID NO: 851880 - RNA, 19 nt, Homo sapiens
aguaacaacuucaagcauu

SEQ ID NO: 851881 - RNA, 19 nt, Homo sapiens
gcacagaugcagcgauugu

SEQ ID NO: 851882 - RNA, 19 nt, Homo sapiens
gacaucagcccuaagcaaa

SEQ ID NO: 851883 - RNA, 19 nt, Homo sapiens
gcaggaagaccuuuucaua

SEQ ID NO: 851884 - RNA, 19 nt, Homo sapiens
ggaccaaggcgaauuacga

SEQ ID NO: 851885 - RNA, 19 nt, Homo sapiens
gaagacaggcaaaguugug

SEQ ID NO: 851886 - RNA, 19 nt, Homo sapiens
ggaguuguagccucuuuaa

SEQ ID NO: 851887 - RNA, 19 nt, Homo sapiens
ccaccuggcuggacaucuu

SEQ ID NO: 851888 - RNA, 19 nt, Homo sapiens
gagagagaccacauaaaug

SEQ ID NO: 851889 - RNA, 19 nt, Homo sapiens
ccuccaagccucaaacuuu

SEQ ID NO: 851890 - RNA, 19 nt, Homo sapiens
ggugugacguugaagaugu

SEQ ID NO: 851891 - RNA, 19 nt, Homo sapiens
aauuucagcuggaguugua

SEQ ID NO: 851892 - RNA, 19 nt, Homo sapiens
acagugaagucccauaugu

SEQ ID NO: 851893 - RNA, 19 nt, Homo sapiens
aaaggcguuucccaaauaa

SEQ ID NO: 851894 - RNA, 19 nt, Homo sapiens
gcuaagcucucucccuucu

SEQ ID NO: 851895 - RNA, 19 nt, Homo sapiens
gguugaaauccuuuaguua

SEQ ID NO: 851896 - RNA, 19 nt, Homo sapiens
caagaagauugaguuacaa

SEQ ID NO: 851897 - RNA, 19 nt, Homo sapiens
ccuguagaguggugauaua

SEQ ID NO: 851898 - RNA, 19 nt, Homo sapiens
cgccaacguuugagacuuu

SEQ ID NO: 851899 - RNA, 19 nt, Homo sapiens
ggacauggucgaggaauuc

SEQ ID NO: 851900 - RNA, 19 nt, Homo sapiens
ggaaaucuagacaagaaga

SEQ ID NO: 851901 - RNA, 19 nt, Homo sapiens
gagggaaaccauacuccua

SEQ ID NO: 851902 - RNA, 19 nt, Homo sapiens
guuguagccucuuuaaaca

SEQ ID NO: 851903 - RNA, 19 nt, Homo sapiens
cgacuccacucccgagaga

SEQ ID NO: 851904 - RNA, 19 nt, Homo sapiens
ggaaugauaaugaccgaau

SEQ ID NO: 851905 - RNA, 19 nt, Homo sapiens
gaaaaugcccuuccuguuc

SEQ ID NO: 851906 - RNA, 19 nt, Homo sapiens
gaaugauaaugaccgaauc

SEQ ID NO: 851907 - RNA, 19 nt, Homo sapiens
acaaauggcuugcuaauaa

SEQ ID NO: 851908 - RNA, 19 nt, Homo sapiens
gcaauuggcuuccucauga

SEQ ID NO: 851909 - RNA, 19 nt, Homo sapiens
aaagauggauccagaaaua

SEQ ID NO: 851910 - RNA, 19 nt, Homo sapiens
ccagaagccucgaacauua

SEQ ID NO: 851911 - RNA, 19 nt, Homo sapiens
gcacaugggugagaucaua

SEQ ID NO: 851912 - RNA, 19 nt, Homo sapiens
cgauaaaccuuucuaauug

SEQ ID NO: 851913 - RNA, 19 nt, Homo sapiens
gagacuaacuguaacuuaa

SEQ ID NO: 851914 - RNA, 19 nt, Homo sapiens
gcacaugucuuaaucaaag

SEQ ID NO: 851915 - RNA, 19 nt, Homo sapiens
ggacaauagugcaagauuu

SEQ ID NO: 851916 - RNA, 19 nt, Homo sapiens
gaacaugaaccucuuuaaa

SEQ ID NO: 851917 - RNA, 19 nt, Homo sapiens
ccagaaagcuuaaugauac

SEQ ID NO: 851918 - RNA, 19 nt, Homo sapiens
caaaccagcucaucuuuau

SEQ ID NO: 851919 - RNA, 19 nt, Homo sapiens
gaaaguaugccaacauuug

SEQ ID NO: 851920 - RNA, 19 nt, Homo sapiens
gagauaaaguguuuggaaa

SEQ ID NO: 851921 - RNA, 19 nt, Homo sapiens
gagcagcccugugacuuua

SEQ ID NO: 851922 - RNA, 19 nt, Homo sapiens
ggaaguauauugggacaaa

SEQ ID NO: 851923 - RNA, 19 nt, Homo sapiens
caaagggaguaccauauuu

SEQ ID NO: 851924 - RNA, 19 nt, Homo sapiens
caacaagaaugacuggauu

SEQ ID NO: 851925 - RNA, 19 nt, Homo sapiens
gagcucaacugaauauuuc

SEQ ID NO: 851926 - RNA, 19 nt, Homo sapiens
gaaagugagagauuugaua

SEQ ID NO: 851927 - RNA, 19 nt, Homo sapiens
gagcaggaauuacggcuuu

SEQ ID NO: 851928 - RNA, 19 nt, Homo sapiens
ccacaugucucucugaaug

SEQ ID NO: 851929 - RNA, 19 nt, Homo sapiens
ugaaugagaucuuaccuau

SEQ ID NO: 851930 - RNA, 19 nt, Homo sapiens
uggaagaacugcaaagaaa

SEQ ID NO: 851931 - RNA, 19 nt, Homo sapiens
gaaguuuaaugcucaguug

SEQ ID NO: 851932 - RNA, 19 nt, Homo sapiens
auacagacaugcaacauuu

SEQ ID NO: 851933 - RNA, 19 nt, Homo sapiens
ggaagucuguucuugguau

SEQ ID NO: 851934 - RNA, 19 nt, Homo sapiens
caaaggaagucuguucuug

SEQ ID NO: 851935 - RNA, 19 nt, Homo sapiens
gauaagaacuccauauucc

SEQ ID NO: 851936 - RNA, 19 nt, Homo sapiens
gaacagaggaauacuuugu

SEQ ID NO: 851937 - RNA, 19 nt, Homo sapiens
caaauggcuugcuaauaaa

SEQ ID NO: 851938 - RNA, 19 nt, Homo sapiens
gggauucaguggaaacuuu

SEQ ID NO: 851939 - RNA, 19 nt, Homo sapiens
caaguuaccuuuggcuauu

SEQ ID NO: 851940 - RNA, 19 nt, Homo sapiens
ucaaagugcuaccgauaaa

SEQ ID NO: 851941 - RNA, 19 nt, Homo sapiens
gaggagaaauaaagcaguu

SEQ ID NO: 851942 - RNA, 19 nt, Homo sapiens
gagcacaagaggagaaaua

SEQ ID NO: 851943 - RNA, 19 nt, Homo sapiens
gcacaggucuauguacaga

SEQ ID NO: 851944 - RNA, 19 nt, Homo sapiens
guggugacguggauuauaa

SEQ ID NO: 851945 - RNA, 19 nt, Homo sapiens
aacaggacguucccaauua

SEQ ID NO: 851946 - RNA, 19 nt, Homo sapiens
ggaaggcucuugcccaaag

SEQ ID NO: 851947 - RNA, 19 nt, Homo sapiens
caaagcaaguuguuaucaa

SEQ ID NO: 851948 - RNA, 19 nt, Homo sapiens
gaagaauuccuggcagaua

SEQ ID NO: 851949 - RNA, 19 nt, Homo sapiens
ugacguggauuauaaagga

SEQ ID NO: 851950 - RNA, 19 nt, Homo sapiens
gcacagacuauuccaugua

SEQ ID NO: 851951 - RNA, 19 nt, Homo sapiens
gaaaaucccagaaagcuua

SEQ ID NO: 851952 - RNA, 19 nt, Homo sapiens
caucacagcuucucaaggu

SEQ ID NO: 851953 - RNA, 19 nt, Homo sapiens
gcaggcggcuucaggaguu

SEQ ID NO: 851954 - RNA, 19 nt, Homo sapiens
gaauugggauccaggacaa

SEQ ID NO: 851955 - RNA, 19 nt, Homo sapiens
gagucaagcuucagccaaa

SEQ ID NO: 851956 - RNA, 19 nt, Homo sapiens
gaauaggacugaccuuugc

SEQ ID NO: 851957 - RNA, 19 nt, Homo sapiens
gcaaugaauccgugagaaa

SEQ ID NO: 851958 - RNA, 19 nt, Homo sapiens
gauggauccagaaauauua

SEQ ID NO: 851959 - RNA, 19 nt, Homo sapiens
gggcagccuuugaggauuu

SEQ ID NO: 851960 - RNA, 19 nt, Homo sapiens
gggaauaccucuguuugga

SEQ ID NO: 851961 - RNA, 19 nt, Homo sapiens
gaagcuaaauuugcuagau

SEQ ID NO: 851962 - RNA, 19 nt, Homo sapiens
gugaaaguaugccaacauu

SEQ ID NO: 851963 - RNA, 19 nt, Homo sapiens
caagucagaugaaggugaa

SEQ ID NO: 851964 - RNA, 19 nt, Homo sapiens
ccgauaaaccuuucuaauu

SEQ ID NO: 851965 - RNA, 19 nt, Homo sapiens
cauccaagcuguguaaaug

SEQ ID NO: 851966 - RNA, 19 nt, Homo sapiens
uuagaggcuuucagauuua

SEQ ID NO: 851967 - RNA, 19 nt, Homo sapiens
ggaauaggacugaccuuug

SEQ ID NO: 851968 - RNA, 19 nt, Homo sapiens
gcaaugaguacagauaauu

SEQ ID NO: 851969 - RNA, 19 nt, Homo sapiens
gcacaaaggaagucuguuc

SEQ ID NO: 851970 - RNA, 19 nt, Homo sapiens
gagcagaucucuuauuccu

SEQ ID NO: 851971 - RNA, 19 nt, Homo sapiens
aagaauuccuggcagauaa

SEQ ID NO: 851972 - RNA, 19 nt, Homo sapiens
gaaguaacaguguaucaug

SEQ ID NO: 851973 - RNA, 19 nt, Homo sapiens
gauuugauacccaugaaua

SEQ ID NO: 851974 - RNA, 19 nt, Homo sapiens
uaauuucacuuuccucuuc

SEQ ID NO: 851975 - RNA, 19 nt, Homo sapiens
acuaguaccucugggauua

SEQ ID NO: 851976 - RNA, 19 nt, Homo sapiens
ggagaaauaaagcaguuaa

SEQ ID NO: 851977 - RNA, 19 nt, Homo sapiens
uguaggcacuggaggaaua

SEQ ID NO: 851978 - RNA, 19 nt, Homo sapiens
gcugauggccucuaccuuu

SEQ ID NO: 851979 - RNA, 19 nt, Homo sapiens
ggcgauacccuguucauuu

SEQ ID NO: 851980 - RNA, 19 nt, Homo sapiens
ccagaaauauuacuuugag

SEQ ID NO: 851981 - RNA, 19 nt, Homo sapiens
gggcacaugucuuaaucaa

SEQ ID NO: 851982 - RNA, 19 nt, Homo sapiens
ggucagaggaggagauauu

SEQ ID NO: 851983 - RNA, 19 nt, Homo sapiens
gcagagcucaacugaauau

SEQ ID NO: 851984 - RNA, 19 nt, Homo sapiens
gaaaagaaagcguuugaaa

SEQ ID NO: 851985 - RNA, 19 nt, Homo sapiens
caauuccagucaccugaua

SEQ ID NO: 851986 - RNA, 19 nt, Homo sapiens
auuagaggcuuucagauuu

SEQ ID NO: 851987 - RNA, 19 nt, Homo sapiens
uaauggagcuugggucaga

SEQ ID NO: 851988 - RNA, 19 nt, Homo sapiens
caugcgagauaaaguguuu

SEQ ID NO: 851989 - RNA, 19 nt, Homo sapiens
gagaauacucagaacauga

SEQ ID NO: 851990 - RNA, 19 nt, Homo sapiens
ccaaaccagcucaucuuua

SEQ ID NO: 851991 - RNA, 19 nt, Homo sapiens
guaccagccugucgucaug

SEQ ID NO: 851992 - RNA, 19 nt, Homo sapiens
aaccagaacucacuccauu

SEQ ID NO: 851993 - RNA, 19 nt, Homo sapiens
cauagacgguguagacaug

SEQ ID NO: 851994 - RNA, 19 nt, Homo sapiens
aaucagggccuaaguuaaa

SEQ ID NO: 851995 - RNA, 19 nt, Homo sapiens
gauggccucuaccuuugua

SEQ ID NO: 851996 - RNA, 19 nt, Homo sapiens
gaagucuguucuugguauu

SEQ ID NO: 851997 - RNA, 19 nt, Homo sapiens
gcacaagaggagaaauaaa

SEQ ID NO: 851998 - RNA, 19 nt, Homo sapiens
gaaguuugguccacauguc

SEQ ID NO: 851999 - RNA, 19 nt, Homo sapiens
aaggcuggcuuauuuauug

SEQ ID NO: 852000 - RNA, 19 nt, Homo sapiens
ggacaaauggcuugcuaau

SEQ ID NO: 852001 - RNA, 19 nt, Homo sapiens
gagauuugauacccaugaa

SEQ ID NO: 852002 - RNA, 19 nt, Homo sapiens
gacguuguuuguauuugua

SEQ ID NO: 852003 - RNA, 19 nt, Homo sapiens
ugacaaagggaguaccaua

SEQ ID NO: 852004 - RNA, 19 nt, Homo sapiens
gccaagagguaucugaauc

SEQ ID NO: 852005 - RNA, 19 nt, Homo sapiens
gagcugagguuggaauucu

SEQ ID NO: 852006 - RNA, 19 nt, Homo sapiens
caugagagcugagguugga

SEQ ID NO: 852007 - RNA, 19 nt, Homo sapiens
gaugggaaaucuuaugaua

SEQ ID NO: 852008 - RNA, 19 nt, Homo sapiens
gacaagagaucuacacaug

SEQ ID NO: 852009 - RNA, 19 nt, Homo sapiens
caagagaucuacacauguu

SEQ ID NO: 852010 - RNA, 19 nt, Homo sapiens
gauaaugcaugccaaauca

SEQ ID NO: 852011 - RNA, 19 nt, Homo sapiens
ucccagagcucccuccuua

SEQ ID NO: 852012 - RNA, 19 nt, Homo sapiens
gagcuuggacuacacaaua

SEQ ID NO: 852013 - RNA, 19 nt, Homo sapiens
gcacuacaguucagacaau

SEQ ID NO: 852014 - RNA, 19 nt, Homo sapiens
ggacuacaguguucuauac

SEQ ID NO: 852015 - RNA, 19 nt, Homo sapiens
gaacagauuaugcagagaa

SEQ ID NO: 852016 - RNA, 19 nt, Homo sapiens
gaauugcucugguuaugau

SEQ ID NO: 852017 - RNA, 19 nt, Homo sapiens
caagauaacacaacuacaa

SEQ ID NO: 852018 - RNA, 19 nt, Homo sapiens
gaggaugucuggugugugu

SEQ ID NO: 852019 - RNA, 19 nt, Homo sapiens
caccaacaccuguaaauuu

SEQ ID NO: 852020 - RNA, 19 nt, Homo sapiens
gauaacacaacuacaacua

SEQ ID NO: 852021 - RNA, 19 nt, Homo sapiens
caugaaggcucuggagaaa

SEQ ID NO: 852022 - RNA, 19 nt, Homo sapiens
cagagaaugcuaacaaauu

SEQ ID NO: 852023 - RNA, 19 nt, Homo sapiens
gcgacaggcugcaugcaaa

SEQ ID NO: 852024 - RNA, 19 nt, Homo sapiens
guacuacagcuauauuuga

SEQ ID NO: 852025 - RNA, 19 nt, Homo sapiens
agaagaaagugccagagaa

SEQ ID NO: 852026 - RNA, 19 nt, Homo sapiens
gcaacagaauucacagaca

SEQ ID NO: 852027 - RNA, 19 nt, Homo sapiens
aaagaagcaucgugucaga

SEQ ID NO: 852028 - RNA, 19 nt, Homo sapiens
ugacgaagaugccgaggau

SEQ ID NO: 852029 - RNA, 19 nt, Homo sapiens
gaauaagacaagagaucua

SEQ ID NO: 852030 - RNA, 19 nt, Homo sapiens
gcuaccagaaugaguguua

SEQ ID NO: 852031 - RNA, 19 nt, Homo sapiens
gcaggugugaugcugguua

SEQ ID NO: 852032 - RNA, 19 nt, Homo sapiens
caacaccuguaaauuugau

SEQ ID NO: 852033 - RNA, 19 nt, Homo sapiens
ggaagugugagcauucuau

SEQ ID NO: 852034 - RNA, 19 nt, Homo sapiens
uaacacaacuacaacuacu

SEQ ID NO: 852035 - RNA, 19 nt, Homo sapiens
cauguugccuugcauuugu

SEQ ID NO: 852036 - RNA, 19 nt, Homo sapiens
ugugagcauucuaucaaua

SEQ ID NO: 852037 - RNA, 19 nt, Homo sapiens
uaccuuguccggaacauua

SEQ ID NO: 852038 - RNA, 19 nt, Homo sapiens
cuacaacuacuaagucuga

SEQ ID NO: 852039 - RNA, 19 nt, Homo sapiens
ggagaaaauugaagucaug

SEQ ID NO: 852040 - RNA, 19 nt, Homo sapiens
ccaguuuggugcagaaugu

SEQ ID NO: 852041 - RNA, 19 nt, Homo sapiens
cuacaguguucuauacguu

SEQ ID NO: 852042 - RNA, 19 nt, Homo sapiens
gcagagaaugcuaacaaau

SEQ ID NO: 852043 - RNA, 19 nt, Homo sapiens
ugaaggcucuggagaaacu

SEQ ID NO: 852044 - RNA, 19 nt, Homo sapiens
gcaaacagcagagugagau

SEQ ID NO: 852045 - RNA, 19 nt, Homo sapiens
gaacaccacauaccuuguc

SEQ ID NO: 852046 - RNA, 19 nt, Homo sapiens
gugcaacaaugacuaugug

SEQ ID NO: 852047 - RNA, 19 nt, Homo sapiens
accaacaccuguaaauuug

SEQ ID NO: 852048 - RNA, 19 nt, Homo sapiens
ggaauugcucugguuauga

SEQ ID NO: 852049 - RNA, 19 nt, Homo sapiens
ccacgagguuaaucuaaag

SEQ ID NO: 852050 - RNA, 19 nt, Homo sapiens
gaagaaagugccagagaac

SEQ ID NO: 852051 - RNA, 19 nt, Homo sapiens
acacaacuacaacuacuaa

SEQ ID NO: 852052 - RNA, 19 nt, Homo sapiens
caacuacaacuacuaaguc

SEQ ID NO: 852053 - RNA, 19 nt, Homo sapiens
caacuacuaagucugaaga

SEQ ID NO: 852054 - RNA, 19 nt, Homo sapiens
uguguaauauugacuguuc

SEQ ID NO: 852055 - RNA, 19 nt, Homo sapiens
uugggucgaugucaagaua

SEQ ID NO: 852056 - RNA, 19 nt, Homo sapiens
ccagagcucccuccuuaug

SEQ ID NO: 852057 - RNA, 19 nt, Homo sapiens
gacauccaccugugauauu

SEQ ID NO: 852058 - RNA, 19 nt, Homo sapiens
aaagggagcauguuucaca

SEQ ID NO: 852059 - RNA, 19 nt, Homo sapiens
ucaaagaagcaucguguca

SEQ ID NO: 852060 - RNA, 19 nt, Homo sapiens
cuucugaugggaaaucuua

SEQ ID NO: 852061 - RNA, 19 nt, Homo sapiens
caagagcguccacgagguu

SEQ ID NO: 852062 - RNA, 19 nt, Homo sapiens
gagacauccaccugugaua

SEQ ID NO: 852063 - RNA, 19 nt, Homo sapiens
gguaaucuacaccaaugaa

SEQ ID NO: 852064 - RNA, 19 nt, Homo sapiens
cuacacauguugccuugca

SEQ ID NO: 852065 - RNA, 19 nt, Homo sapiens
ugugauauuugccaguuug

SEQ ID NO: 852066 - RNA, 19 nt, Homo sapiens
ugagauacuugugguguca

SEQ ID NO: 852067 - RNA, 19 nt, Homo sapiens
guaaucuacaccaaugaaa

SEQ ID NO: 852068 - RNA, 19 nt, Homo sapiens
gcuggaauugcucugguua

SEQ ID NO: 852069 - RNA, 19 nt, Homo sapiens
ugccagagaacaccacaua

SEQ ID NO: 852070 - RNA, 19 nt, Homo sapiens
agaagcaucgugucagaaa

SEQ ID NO: 852071 - RNA, 19 nt, Homo sapiens
acauccaccugugauauuu

SEQ ID NO: 852072 - RNA, 19 nt, Homo sapiens
caaacagcagagugagaua

SEQ ID NO: 852073 - RNA, 19 nt, Homo sapiens
ggggagagcuaccagaaug

SEQ ID NO: 852074 - RNA, 19 nt, Homo sapiens
cuaaagggagcauguuuca

SEQ ID NO: 852075 - RNA, 19 nt, Homo sapiens
uccacgagguuaaucuaaa

SEQ ID NO: 852076 - RNA, 19 nt, Homo sapiens
uaaugcaugccaaaucaaa

SEQ ID NO: 852077 - RNA, 19 nt, Homo sapiens
ccaugaaggcucuggagaa

SEQ ID NO: 852078 - RNA, 19 nt, Homo sapiens
caagugcaacaaugacuau

SEQ ID NO: 852079 - RNA, 19 nt, Homo sapiens
gauggggaauguuuaagaa

SEQ ID NO: 852080 - RNA, 19 nt, Homo sapiens
uggaauugcucugguuaug

SEQ ID NO: 852081 - RNA, 19 nt, Homo sapiens
cacuacaguucagacaaua

SEQ ID NO: 852082 - RNA, 19 nt, Homo sapiens
ccuguacgauuucaguaug

SEQ ID NO: 852083 - RNA, 19 nt, Homo sapiens
caugggaagugugagcauu

SEQ ID NO: 852084 - RNA, 19 nt, Homo sapiens
uagaagaaagugccagaga

SEQ ID NO: 852085 - RNA, 19 nt, Homo sapiens
ugcagagaaugcuaacaaa

SEQ ID NO: 852086 - RNA, 19 nt, Homo sapiens
ugccacagaugcaggauca

SEQ ID NO: 852087 - RNA, 19 nt, Homo sapiens
cagcagagugagauacuug

SEQ ID NO: 852088 - RNA, 19 nt, Homo sapiens
ggagacauccaccugugau

SEQ ID NO: 852089 - RNA, 19 nt, Homo sapiens
auacagggcacuacaguuc

SEQ ID NO: 852090 - RNA, 19 nt, Homo sapiens
gugagcauucuaucaauau

SEQ ID NO: 852091 - RNA, 19 nt, Homo sapiens
gaagcaucgugucagaaac

SEQ ID NO: 852092 - RNA, 19 nt, Homo sapiens
ugguguguguguaauauug

SEQ ID NO: 852093 - RNA, 19 nt, Homo sapiens
caggugugaugcugguuau

SEQ ID NO: 852094 - RNA, 19 nt, Homo sapiens
gcaugcaugggaaguguga

SEQ ID NO: 852095 - RNA, 19 nt, Homo sapiens
cugaaacucucgagaucau

SEQ ID NO: 852096 - RNA, 19 nt, Homo sapiens
ucaagugcaacaaugacua

SEQ ID NO: 852097 - RNA, 19 nt, Homo sapiens
caguucaagugcaacaaug

SEQ ID NO: 852098 - RNA, 19 nt, Homo sapiens
cgauuucaguaugucuuaa

SEQ ID NO: 852099 - RNA, 19 nt, Homo sapiens
ucccgguccuguacgauuu

SEQ ID NO: 852100 - RNA, 19 nt, Homo sapiens
gaagugugagcauucuauc

SEQ ID NO: 852101 - RNA, 19 nt, Homo sapiens
gaugucuggugugugugua

SEQ ID NO: 852102 - RNA, 19 nt, Homo sapiens
ugcagaaugugacgaagau

SEQ ID NO: 852103 - RNA, 19 nt, Homo sapiens
ggggaauguuuaagaauug

SEQ ID NO: 852104 - RNA, 19 nt, Homo sapiens
ccugugauauuugccaguu

SEQ ID NO: 852105 - RNA, 19 nt, Homo sapiens
gacaccaacaccuguaaau

SEQ ID NO: 852106 - RNA, 19 nt, Homo sapiens
caugcaaacagcagaguga

SEQ ID NO: 852107 - RNA, 19 nt, Homo sapiens
ggauugaugugaagaaaua

SEQ ID NO: 852108 - RNA, 19 nt, Homo sapiens
ggauaagacugcaugaaua

SEQ ID NO: 852109 - RNA, 19 nt, Homo sapiens
gaaauggccuguuuguaca

SEQ ID NO: 852110 - RNA, 19 nt, Homo sapiens
gcaaugugccuaacgauuu

SEQ ID NO: 852111 - RNA, 19 nt, Homo sapiens
ggacuucccuuaggcagua

SEQ ID NO: 852112 - RNA, 19 nt, Homo sapiens
gaacaaauuagcccauaaa

SEQ ID NO: 852113 - RNA, 19 nt, Homo sapiens
gaagauggauucaauagcu

SEQ ID NO: 852114 - RNA, 19 nt, Homo sapiens
uagcagaaauggccuguuu

SEQ ID NO: 852115 - RNA, 19 nt, Homo sapiens
gaaauaaagaggcagaaga

SEQ ID NO: 852116 - RNA, 19 nt, Homo sapiens
uaucggaaauccagaauau

SEQ ID NO: 852117 - RNA, 19 nt, Homo sapiens
gcaugaauaugucgaaaca

SEQ ID NO: 852118 - RNA, 19 nt, Homo sapiens
gaacaguaguaggaagaaa

SEQ ID NO: 852119 - RNA, 19 nt, Homo sapiens
ucggaaauccagaauauua

SEQ ID NO: 852120 - RNA, 19 nt, Homo sapiens
ccaaggagcuuuguauucu

SEQ ID NO: 852121 - RNA, 19 nt, Homo sapiens
ggcagaagauggauucaau

SEQ ID NO: 852122 - RNA, 19 nt, Homo sapiens
gauaagacugcaugaauau

SEQ ID NO: 852123 - RNA, 19 nt, Homo sapiens
gcaccucacagaacaaauu

SEQ ID NO: 852124 - RNA, 19 nt, Homo sapiens
gcagaagauggauucaaua

SEQ ID NO: 852125 - RNA, 19 nt, Homo sapiens
cagaacaaauuagcccaua

SEQ ID NO: 852126 - RNA, 19 nt, Homo sapiens
cuaguuggcuguauuucuu

SEQ ID NO: 852127 - RNA, 19 nt, Homo sapiens
cagccaguuuccaauguua

SEQ ID NO: 852128 - RNA, 19 nt, Homo sapiens
agaaugauauggcaaugug

SEQ ID NO: 852129 - RNA, 19 nt, Homo sapiens
ggcuguauuucuuacuuua

SEQ ID NO: 852130 - RNA, 19 nt, Homo sapiens
gggauaagacugcaugaau

SEQ ID NO: 852131 - RNA, 19 nt, Homo sapiens
gcagaaauggccuguuugu

SEQ ID NO: 852132 - RNA, 19 nt, Homo sapiens
ggcaguaaacaaauacaua

SEQ ID NO: 852133 - RNA, 19 nt, Homo sapiens
cuuaggcaguaaacaaaua

SEQ ID NO: 852134 - RNA, 19 nt, Homo sapiens
gagaggcacagagcuauuu

SEQ ID NO: 852135 - RNA, 19 nt, Homo sapiens
ucacuaaacuuuguaugag

SEQ ID NO: 852136 - RNA, 19 nt, Homo sapiens
ggagggauaugauuuuaug

SEQ ID NO: 852137 - RNA, 19 nt, Homo sapiens
ggagaaugauauggcaaug

SEQ ID NO: 852138 - RNA, 19 nt, Homo sapiens
agaacaaauuagcccauaa

SEQ ID NO: 852139 - RNA, 19 nt, Homo sapiens
uaaagaggcagaagaugga

SEQ ID NO: 852140 - RNA, 19 nt, Homo sapiens
ccaaagcugaacaguagua

SEQ ID NO: 852141 - RNA, 19 nt, Homo sapiens
gaggagggauaugauuuua

SEQ ID NO: 852142 - RNA, 19 nt, Homo sapiens
uuauaucucuuccuucuag

SEQ ID NO: 852143 - RNA, 19 nt, Homo sapiens
agaaauggccuguuuguac

SEQ ID NO: 852144 - RNA, 19 nt, Homo sapiens
agaauguacuccugaagug

SEQ ID NO: 852145 - RNA, 19 nt, Homo sapiens
caaggagcuuuguauucuu

SEQ ID NO: 852146 - RNA, 19 nt, Homo sapiens
uggccuguuuguacauuua

SEQ ID NO: 852147 - RNA, 19 nt, Homo sapiens
ggaaugcguuuuaguucuu

SEQ ID NO: 852148 - RNA, 19 nt, Homo sapiens
cggaaauccagaauauuaa

SEQ ID NO: 852149 - RNA, 19 nt, Homo sapiens
gcagucaaucuaucggaaa

SEQ ID NO: 852150 - RNA, 19 nt, Homo sapiens
gaggagaagaagccaauuc

SEQ ID NO: 852151 - RNA, 19 nt, Homo sapiens
uuagagccauccaggcaaa

SEQ ID NO: 852152 - RNA, 19 nt, Homo sapiens
uaagacugcaugaauaugu

SEQ ID NO: 852153 - RNA, 19 nt, Homo sapiens
ggagaggcacagagcuauu

SEQ ID NO: 852154 - RNA, 19 nt, Homo sapiens
aaauaaagaggcagaagau

SEQ ID NO: 852155 - RNA, 19 nt, Homo sapiens
aaggagcuuuguauucuug

SEQ ID NO: 852156 - RNA, 19 nt, Homo sapiens
gaccugcagucaaucuauc

SEQ ID NO: 852157 - RNA, 19 nt, Homo sapiens
ggaccugcagucaaucuau

SEQ ID NO: 852158 - RNA, 19 nt, Homo sapiens
gucacuaaacuuuguauga

SEQ ID NO: 852159 - RNA, 19 nt, Homo sapiens
ggauucaauagcucacuaa

SEQ ID NO: 852160 - RNA, 19 nt, Homo sapiens
cagaagauggauucaauag

SEQ ID NO: 852161 - RNA, 19 nt, Homo sapiens
ccaagcuacuuccuacagu

SEQ ID NO: 852162 - RNA, 19 nt, Homo sapiens
caaugugccuaacgauuuu

SEQ ID NO: 852163 - RNA, 19 nt, Homo sapiens
caccucacagaacaaauua

SEQ ID NO: 852164 - RNA, 19 nt, Homo sapiens
gccugagacucuagcagaa

SEQ ID NO: 852165 - RNA, 19 nt, Homo sapiens
uaaaauauguccccaaagc

SEQ ID NO: 852166 - RNA, 19 nt, Homo sapiens
acauaaagcagggauaaga

SEQ ID NO: 852167 - RNA, 19 nt, Homo sapiens
uggcuguauuucuuacuuu

SEQ ID NO: 852168 - RNA, 19 nt, Homo sapiens
auacauaaagcagggauaa

SEQ ID NO: 852169 - RNA, 19 nt, Homo sapiens
aaggauugaugugaagaaa

SEQ ID NO: 852170 - RNA, 19 nt, Homo sapiens
cagaaauggccuguuugua

SEQ ID NO: 852171 - RNA, 19 nt, Homo sapiens
uggauucaauagcucacua

SEQ ID NO: 852172 - RNA, 19 nt, Homo sapiens
cagucaaucuaucggaaau

SEQ ID NO: 852173 - RNA, 19 nt, Homo sapiens
gagccauccaggcaaauau

SEQ ID NO: 852174 - RNA, 19 nt, Homo sapiens
aagcugaacaguaguagga

SEQ ID NO: 852175 - RNA, 19 nt, Homo sapiens
ccccaaagcugaacaguag

SEQ ID NO: 852176 - RNA, 19 nt, Homo sapiens
cugaaugccugagacucua

SEQ ID NO: 852177 - RNA, 19 nt, Homo sapiens
gccuguuuguacauuuaua

SEQ ID NO: 852178 - RNA, 19 nt, Homo sapiens
gagaaugauauggcaaugu

SEQ ID NO: 852179 - RNA, 19 nt, Homo sapiens
cugagacucuagcagaaau

SEQ ID NO: 852180 - RNA, 19 nt, Homo sapiens
acagccaguuuccaauguu

SEQ ID NO: 852181 - RNA, 19 nt, Homo sapiens
cacuaaacuuuguaugagu

SEQ ID NO: 852182 - RNA, 19 nt, Homo sapiens
ugaaaagcaucggaauuga

SEQ ID NO: 852183 - RNA, 19 nt, Homo sapiens
gauucaauagcucacuaaa

SEQ ID NO: 852184 - RNA, 19 nt, Homo sapiens
gaugugaagaaauaaagag

SEQ ID NO: 852185 - RNA, 19 nt, Homo sapiens
aaaagaauguacuccugaa

SEQ ID NO: 852186 - RNA, 19 nt, Homo sapiens
cgggagaggcacagagcua

SEQ ID NO: 852187 - RNA, 19 nt, Homo sapiens
gauugugaaccuccugaau

SEQ ID NO: 852188 - RNA, 19 nt, Homo sapiens
acuaaaauauguccccaaa

SEQ ID NO: 852189 - RNA, 19 nt, Homo sapiens
ccuucuaguuggcuguauu

SEQ ID NO: 852190 - RNA, 19 nt, Homo sapiens
uaucucuuccuucuaguug

SEQ ID NO: 852191 - RNA, 19 nt, Homo sapiens
gggagaggcacagagcuau

SEQ ID NO: 852192 - RNA, 19 nt, Homo sapiens
ggagaagaagccaauucca

SEQ ID NO: 852193 - RNA, 19 nt, Homo sapiens
caauauuuggaaugcguuu

SEQ ID NO: 852194 - RNA, 19 nt, Homo sapiens
uugaggagggauaugauuu

SEQ ID NO: 852195 - RNA, 19 nt, Homo sapiens
cauccaggcaaauaucaau

SEQ ID NO: 852196 - RNA, 19 nt, Homo sapiens
gaagaaauaugaagccuua

SEQ ID NO: 852197 - RNA, 19 nt, Homo sapiens
ggaaggaagucauaguuua

SEQ ID NO: 852198 - RNA, 19 nt, Homo sapiens
gaaaggugguaucuaauuu

SEQ ID NO: 852199 - RNA, 19 nt, Homo sapiens
gggcagagcuggauaguga

SEQ ID NO: 852200 - RNA, 19 nt, Homo sapiens
ugagaaaggugguaucuaa

SEQ ID NO: 852201 - RNA, 19 nt, Homo sapiens
caaaggagguuucucaaga

SEQ ID NO: 852202 - RNA, 19 nt, Homo sapiens
gaaagugucagccgagaua

SEQ ID NO: 852203 - RNA, 19 nt, Homo sapiens
uaacaacacugagaacaaa

SEQ ID NO: 852204 - RNA, 19 nt, Homo sapiens
gagacgagcuuuaaugaca

SEQ ID NO: 852205 - RNA, 19 nt, Homo sapiens
gaaacauguuacuuccuua

SEQ ID NO: 852206 - RNA, 19 nt, Homo sapiens
gaauagcacuggcaacauc

SEQ ID NO: 852207 - RNA, 19 nt, Homo sapiens
gggaagggaucuaugagaa

SEQ ID NO: 852208 - RNA, 19 nt, Homo sapiens
gcaaauuccucacguacau

SEQ ID NO: 852209 - RNA, 19 nt, Homo sapiens
agagugaagucccgcauua

SEQ ID NO: 852210 - RNA, 19 nt, Homo sapiens
guaauaacccuuucuggaa

SEQ ID NO: 852211 - RNA, 19 nt, Homo sapiens
guaaguugcucaagacugu

SEQ ID NO: 852212 - RNA, 19 nt, Homo sapiens
ccaaucaucccaccauaua

SEQ ID NO: 852213 - RNA, 19 nt, Homo sapiens
uaaaugaccauccauagaa

SEQ ID NO: 852214 - RNA, 19 nt, Homo sapiens
ccaacgagcucucugacuu

SEQ ID NO: 852215 - RNA, 19 nt, Homo sapiens
ccaaccagacuuuaaauaa

SEQ ID NO: 852216 - RNA, 19 nt, Homo sapiens
gugcagacaugcuguguga

SEQ ID NO: 852217 - RNA, 19 nt, Homo sapiens
cagcagaucuccaugaaag

SEQ ID NO: 852218 - RNA, 19 nt, Homo sapiens
gagcuuuaaugacaucaaa

SEQ ID NO: 852219 - RNA, 19 nt, Homo sapiens
gagaccaucuaucaccuuu

SEQ ID NO: 852220 - RNA, 19 nt, Homo sapiens
gaagggaucuaugagaaag

SEQ ID NO: 852221 - RNA, 19 nt, Homo sapiens
gaagaacgaagucgggaaa

SEQ ID NO: 852222 - RNA, 19 nt, Homo sapiens
gaaaaccucuaucaucuug

SEQ ID NO: 852223 - RNA, 19 nt, Homo sapiens
gcacacaacaccaccgaaa

SEQ ID NO: 852224 - RNA, 19 nt, Homo sapiens
ugaaacauguuacuuccuu

SEQ ID NO: 852225 - RNA, 19 nt, Homo sapiens
ggcagaagcuucagcaucu

SEQ ID NO: 852226 - RNA, 19 nt, Homo sapiens
gcaggaggaaggacugaua

SEQ ID NO: 852227 - RNA, 19 nt, Homo sapiens
agacaaacaucgugugcaa

SEQ ID NO: 852228 - RNA, 19 nt, Homo sapiens
uaccggaacucaacacuga

SEQ ID NO: 852229 - RNA, 19 nt, Homo sapiens
gaagaccaacggacugaaa

SEQ ID NO: 852230 - RNA, 19 nt, Homo sapiens
gaaagcagccaugaguuga

SEQ ID NO: 852231 - RNA, 19 nt, Homo sapiens
uaauaacccuuucuggaau

SEQ ID NO: 852232 - RNA, 19 nt, Homo sapiens
guaaaugaccauccauaga

SEQ ID NO: 852233 - RNA, 19 nt, Homo sapiens
ggguacagcucauucuuuc

SEQ ID NO: 852234 - RNA, 19 nt, Homo sapiens
gcguaugacuucuuacuca

SEQ ID NO: 852235 - RNA, 19 nt, Homo sapiens
gaaccaggacacacaauuc

SEQ ID NO: 852236 - RNA, 19 nt, Homo sapiens
ccaaucacauagcuuucua

SEQ ID NO: 852237 - RNA, 19 nt, Homo sapiens
gugugggacuucaucaaua

SEQ ID NO: 852238 - RNA, 19 nt, Homo sapiens
gaaggaagucauaguuuag

SEQ ID NO: 852239 - RNA, 19 nt, Homo sapiens
gccaauagauuagaaagca

SEQ ID NO: 852240 - RNA, 19 nt, Homo sapiens
gaaccugccgcucaccuuu

SEQ ID NO: 852241 - RNA, 19 nt, Homo sapiens
ggacccugcucauggagaa

SEQ ID NO: 852242 - RNA, 19 nt, Homo sapiens
caaaaccaguugcaccuua

SEQ ID NO: 852243 - RNA, 19 nt, Homo sapiens
gcaagaaccaggacacaca

SEQ ID NO: 852244 - RNA, 19 nt, Homo sapiens
ggaagggaucuaugagaaa

SEQ ID NO: 852245 - RNA, 19 nt, Homo sapiens
ugggauaacuggaggaaga

SEQ ID NO: 852246 - RNA, 19 nt, Homo sapiens
cauauaaccuucgauugug

SEQ ID NO: 852247 - RNA, 19 nt, Homo sapiens
ggacucugaucuuggugaa

SEQ ID NO: 852248 - RNA, 19 nt, Homo sapiens
ccauauaaccuucgauugu

SEQ ID NO: 852249 - RNA, 19 nt, Homo sapiens
acacacaauucgccaauca

SEQ ID NO: 852250 - RNA, 19 nt, Homo sapiens
ugugggacuucaucaauaa

SEQ ID NO: 852251 - RNA, 19 nt, Homo sapiens
gcucguugccaaucacaua

SEQ ID NO: 852252 - RNA, 19 nt, Homo sapiens
guacccaaccagacuuuaa

SEQ ID NO: 852253 - RNA, 19 nt, Homo sapiens
gcagacaugcugugugaau

SEQ ID NO: 852254 - RNA, 19 nt, Homo sapiens
gggcaaaggagguuucuca

SEQ ID NO: 852255 - RNA, 19 nt, Homo sapiens
ggacugauacuggcaaauc

SEQ ID NO: 852256 - RNA, 19 nt, Homo sapiens
caaacucugcauuucauuu

SEQ ID NO: 852257 - RNA, 19 nt, Homo sapiens
gccaaacucugcauuucau

SEQ ID NO: 852258 - RNA, 19 nt, Homo sapiens
gagccuugguggccacuga

SEQ ID NO: 852259 - RNA, 19 nt, Homo sapiens
guaacaacacugagaacaa

SEQ ID NO: 852260 - RNA, 19 nt, Homo sapiens
ccucaaguuugguaaguug

SEQ ID NO: 852261 - RNA, 19 nt, Homo sapiens
gggaagcaccaguucguuu

SEQ ID NO: 852262 - RNA, 19 nt, Homo sapiens
gaaggaagggccauauguc

SEQ ID NO: 852263 - RNA, 19 nt, Homo sapiens
cugaaacguuguauagcua

SEQ ID NO: 852264 - RNA, 19 nt, Homo sapiens
cagagacgagcuuuaauga

SEQ ID NO: 852265 - RNA, 19 nt, Homo sapiens
agaaaggugguaucuaauu

SEQ ID NO: 852266 - RNA, 19 nt, Homo sapiens
uguggaagccugcguauga

SEQ ID NO: 852267 - RNA, 19 nt, Homo sapiens
guacaguaauaacccuuuc

SEQ ID NO: 852268 - RNA, 19 nt, Homo sapiens
acagcgguaugauugauaa

SEQ ID NO: 852269 - RNA, 19 nt, Homo sapiens
agagugaggugauccuuag

SEQ ID NO: 852270 - RNA, 19 nt, Homo sapiens
gaaggaggacuguaacaac

SEQ ID NO: 852271 - RNA, 19 nt, Homo sapiens
ccaaaguggugcgaggauu

SEQ ID NO: 852272 - RNA, 19 nt, Homo sapiens
uggcaaaucaguagaguga

SEQ ID NO: 852273 - RNA, 19 nt, Homo sapiens
gggauggacagaugacaaa

SEQ ID NO: 852274 - RNA, 19 nt, Homo sapiens
cuacaaaaguugcaguaaa

SEQ ID NO: 852275 - RNA, 19 nt, Homo sapiens
cgaggccauuguacuguuu

SEQ ID NO: 852276 - RNA, 19 nt, Homo sapiens
gcaaaggagguuucucaag

SEQ ID NO: 852277 - RNA, 19 nt, Homo sapiens
cgcuggagcucaacaguga

SEQ ID NO: 852278 - RNA, 19 nt, Homo sapiens
ggacacacaauucgccaau

SEQ ID NO: 852279 - RNA, 19 nt, Homo sapiens
guauagcuacuuauucaga

SEQ ID NO: 852280 - RNA, 19 nt, Homo sapiens
caacgugccaggacacuuc

SEQ ID NO: 852281 - RNA, 19 nt, Homo sapiens
cacaaugcgucguagaugu

SEQ ID NO: 852282 - RNA, 19 nt, Homo sapiens
cugagaagcuggccaaggu

SEQ ID NO: 852283 - RNA, 19 nt, Homo sapiens
acaaagaacggaaguccuu

SEQ ID NO: 852284 - RNA, 19 nt, Homo sapiens
aaaccucuaucaucuugga

SEQ ID NO: 852285 - RNA, 19 nt, Homo sapiens
ggaacucuccguccuccaa

SEQ ID NO: 852286 - RNA, 19 nt, Homo sapiens
gaagcaagcgcuccuacag

SEQ ID NO: 852287 - RNA, 19 nt, Homo sapiens
gaaaugcaaaggaagugau

SEQ ID NO: 852288 - RNA, 19 nt, Homo sapiens
ggaagucauaguuuagaug

SEQ ID NO: 852289 - RNA, 19 nt, Homo sapiens
ucagagacgagcuuuaaug

SEQ ID NO: 852290 - RNA, 19 nt, Homo sapiens
guacagcucauucuuucug

SEQ ID NO: 852291 - RNA, 19 nt, Homo sapiens
ggccacacuuugcauuuca

SEQ ID NO: 852292 - RNA, 19 nt, Homo sapiens
gaucucaaggucuguaugu

SEQ ID NO: 852293 - RNA, 19 nt, Homo sapiens
guaccaggaagaaacauau

SEQ ID NO: 852294 - RNA, 19 nt, Homo sapiens
cagacgagguagccaagga

SEQ ID NO: 852295 - RNA, 19 nt, Homo sapiens
ccacugacucucgugcuua

SEQ ID NO: 852296 - RNA, 19 nt, Homo sapiens
ccaaagaucugaaggguaa

SEQ ID NO: 852297 - RNA, 19 nt, Homo sapiens
ucacaaagcucuuauuaug

SEQ ID NO: 852298 - RNA, 19 nt, Homo sapiens
gcagaucauuuaagaagua

SEQ ID NO: 852299 - RNA, 19 nt, Homo sapiens
gagaguaacuacagaagaa

SEQ ID NO: 852300 - RNA, 19 nt, Homo sapiens
guacaugguuguuuaagaa

SEQ ID NO: 852301 - RNA, 19 nt, Homo sapiens
caacuaacuuacaugcuua

SEQ ID NO: 852302 - RNA, 19 nt, Homo sapiens
aagaagagguuuacuguuu

SEQ ID NO: 852303 - RNA, 19 nt, Homo sapiens
gggaagaagugaaugguuu

SEQ ID NO: 852304 - RNA, 19 nt, Homo sapiens
gagcaggacuaaacgaauu

SEQ ID NO: 852305 - RNA, 19 nt, Homo sapiens
gaagauuccugccaagaga

SEQ ID NO: 852306 - RNA, 19 nt, Homo sapiens
gaagaaacaguuccauauu

SEQ ID NO: 852307 - RNA, 19 nt, Homo sapiens
gaaacuggauggaaaauuu

SEQ ID NO: 852308 - RNA, 19 nt, Homo sapiens
ggacugaaacuucuauuug

SEQ ID NO: 852309 - RNA, 19 nt, Homo sapiens
gaaacccuaucucuacaaa

SEQ ID NO: 852310 - RNA, 19 nt, Homo sapiens
caggagauaugcagaguuu

SEQ ID NO: 852311 - RNA, 19 nt, Homo sapiens
gaaagcugcccaaguguaa

SEQ ID NO: 852312 - RNA, 19 nt, Homo sapiens
gaagagguuuacuguuuau

SEQ ID NO: 852313 - RNA, 19 nt, Homo sapiens
gaacaagcaucccuuccau

SEQ ID NO: 852314 - RNA, 19 nt, Homo sapiens
gcagauguguauucaguau

SEQ ID NO: 852315 - RNA, 19 nt, Homo sapiens
gggauuaaaugcaaagaga

SEQ ID NO: 852316 - RNA, 19 nt, Homo sapiens
gaggaucacuugagccuau

SEQ ID NO: 852317 - RNA, 19 nt, Homo sapiens
ggaggcagaugaugcauuc

SEQ ID NO: 852318 - RNA, 19 nt, Homo sapiens
aaacagcccuaugacaaua

SEQ ID NO: 852319 - RNA, 19 nt, Homo sapiens
agaagagguuuacuguuua

SEQ ID NO: 852320 - RNA, 19 nt, Homo sapiens
agaaaaggcuuaaugguua

SEQ ID NO: 852321 - RNA, 19 nt, Homo sapiens
ugaaauugcuagugcauug

SEQ ID NO: 852322 - RNA, 19 nt, Homo sapiens
gaaucuuccuuuagaggua

SEQ ID NO: 852323 - RNA, 19 nt, Homo sapiens
ccaacuaacuuacaugcuu

SEQ ID NO: 852324 - RNA, 19 nt, Homo sapiens
gcuauuaagucauucugaa

SEQ ID NO: 852325 - RNA, 19 nt, Homo sapiens
cacauuggcugcuaguuaa

SEQ ID NO: 852326 - RNA, 19 nt, Homo sapiens
gaagauuccaccaccauuu

SEQ ID NO: 852327 - RNA, 19 nt, Homo sapiens
caacugacuuugauuucuu

SEQ ID NO: 852328 - RNA, 19 nt, Homo sapiens
gcugaaauguaugacaaua

SEQ ID NO: 852329 - RNA, 19 nt, Homo sapiens
ucucagaucacaagaaaua

SEQ ID NO: 852330 - RNA, 19 nt, Homo sapiens
gagccgagaucgcaccauu

SEQ ID NO: 852331 - RNA, 19 nt, Homo sapiens
ugacaccacuaccacauuu

SEQ ID NO: 852332 - RNA, 19 nt, Homo sapiens
uaaccuaccaacuaacuua

SEQ ID NO: 852333 - RNA, 19 nt, Homo sapiens
gaugauaucagaaacuuug

SEQ ID NO: 852334 - RNA, 19 nt, Homo sapiens
ggagauaugcagaguuuga

SEQ ID NO: 852335 - RNA, 19 nt, Homo sapiens
ccauguaugucuugagaaa

SEQ ID NO: 852336 - RNA, 19 nt, Homo sapiens
ggaaagcugcccaagugua

SEQ ID NO: 852337 - RNA, 19 nt, Homo sapiens
ggaaacagaccuuaaaauu

SEQ ID NO: 852338 - RNA, 19 nt, Homo sapiens
caaauugugggucaaagua

SEQ ID NO: 852339 - RNA, 19 nt, Homo sapiens
aaggaaagcugcccaagug

SEQ ID NO: 852340 - RNA, 19 nt, Homo sapiens
gacugaaacuucuauuugu

SEQ ID NO: 852341 - RNA, 19 nt, Homo sapiens
aagcaucccuuccauguau

SEQ ID NO: 852342 - RNA, 19 nt, Homo sapiens
ugacaccucauuucuauuu

SEQ ID NO: 852343 - RNA, 19 nt, Homo sapiens
gaacguaaugugcucuuga

SEQ ID NO: 852344 - RNA, 19 nt, Homo sapiens
uauuugagcucaggaguuu

SEQ ID NO: 852345 - RNA, 19 nt, Homo sapiens
acacauuggcugcuaguua

SEQ ID NO: 852346 - RNA, 19 nt, Homo sapiens
gcccgaagguugcaugaug

SEQ ID NO: 852347 - RNA, 19 nt, Homo sapiens
caguucagcuaacauauau

SEQ ID NO: 852348 - RNA, 19 nt, Homo sapiens
aagaaacaguuccauauuc

SEQ ID NO: 852349 - RNA, 19 nt, Homo sapiens
ugacacagcauuuacagaa

SEQ ID NO: 852350 - RNA, 19 nt, Homo sapiens
gauaugcagaguuugauaa

SEQ ID NO: 852351 - RNA, 19 nt, Homo sapiens
gcacaggaaacagaccuua

SEQ ID NO: 852352 - RNA, 19 nt, Homo sapiens
gaaaacagcccuaugacaa

SEQ ID NO: 852353 - RNA, 19 nt, Homo sapiens
gcauuggguuacuuacauu

SEQ ID NO: 852354 - RNA, 19 nt, Homo sapiens
gagguaagacuuuaauauc

SEQ ID NO: 852355 - RNA, 19 nt, Homo sapiens
aaaauaagcuuaccuugga

SEQ ID NO: 852356 - RNA, 19 nt, Homo sapiens
gaaaagaaaaggcuuaaug

SEQ ID NO: 852357 - RNA, 19 nt, Homo sapiens
guguguaucuucugacuau

SEQ ID NO: 852358 - RNA, 19 nt, Homo sapiens
gaccagaugauaucagaaa

SEQ ID NO: 852359 - RNA, 19 nt, Homo sapiens
gaaacagaccuuaaaauug

SEQ ID NO: 852360 - RNA, 19 nt, Homo sapiens
gguacaugguuguuuaaga

SEQ ID NO: 852361 - RNA, 19 nt, Homo sapiens
ggugugcucuugagggauu

SEQ ID NO: 852362 - RNA, 19 nt, Homo sapiens
ccaccaccauuuaauccua

SEQ ID NO: 852363 - RNA, 19 nt, Homo sapiens
caacauggcgaaacccuau

SEQ ID NO: 852364 - RNA, 19 nt, Homo sapiens
gcaguuugccauucagaaa

SEQ ID NO: 852365 - RNA, 19 nt, Homo sapiens
cagaagaaacaguuccaua

SEQ ID NO: 852366 - RNA, 19 nt, Homo sapiens
caccugaaguaauuagaaa

SEQ ID NO: 852367 - RNA, 19 nt, Homo sapiens
gauggaauuugaacauuac

SEQ ID NO: 852368 - RNA, 19 nt, Homo sapiens
gacaccucauuucuauuua

SEQ ID NO: 852369 - RNA, 19 nt, Homo sapiens
gggcugaccuuguacaaaa

SEQ ID NO: 852370 - RNA, 19 nt, Homo sapiens
gggcuguucuguaugaaau

SEQ ID NO: 852371 - RNA, 19 nt, Homo sapiens
ggccgaggcaggcagauua

SEQ ID NO: 852372 - RNA, 19 nt, Homo sapiens
gaugaugcauucguugguu

SEQ ID NO: 852373 - RNA, 19 nt, Homo sapiens
cagaugauaucagaaacuu

SEQ ID NO: 852374 - RNA, 19 nt, Homo sapiens
gacaauauccuucacaaac

SEQ ID NO: 852375 - RNA, 19 nt, Homo sapiens
gaaagaaaucacagaagca

SEQ ID NO: 852376 - RNA, 19 nt, Homo sapiens
ggaauuugaacauuacuuc

SEQ ID NO: 852377 - RNA, 19 nt, Homo sapiens
uauagugaaugccagugua

SEQ ID NO: 852378 - RNA, 19 nt, Homo sapiens
acacagcauuuacagaaga

SEQ ID NO: 852379 - RNA, 19 nt, Homo sapiens
gccgagauguugcugaaau

SEQ ID NO: 852380 - RNA, 19 nt, Homo sapiens
aagaaggaauugcuauuuc

SEQ ID NO: 852381 - RNA, 19 nt, Homo sapiens
agaagaaacaguuccauau

SEQ ID NO: 852382 - RNA, 19 nt, Homo sapiens
uuagguauccagaacuuua

SEQ ID NO: 852383 - RNA, 19 nt, Homo sapiens
gcgaaacccuaucucuaca

SEQ ID NO: 852384 - RNA, 19 nt, Homo sapiens
cgaggcaggcagauuauuu

SEQ ID NO: 852385 - RNA, 19 nt, Homo sapiens
ucaguucagcuaacauaua

SEQ ID NO: 852386 - RNA, 19 nt, Homo sapiens
uacccaagauagacuguuu

SEQ ID NO: 852387 - RNA, 19 nt, Homo sapiens
uauaacuagugccucauuu

SEQ ID NO: 852388 - RNA, 19 nt, Homo sapiens
gcaccugaaguaauuagaa

SEQ ID NO: 852389 - RNA, 19 nt, Homo sapiens
guaaagaaggaauugcuau

SEQ ID NO: 852390 - RNA, 19 nt, Homo sapiens
ggaagaagugaaugguuug

SEQ ID NO: 852391 - RNA, 19 nt, Homo sapiens
gauggaaguugcagugaac

SEQ ID NO: 852392 - RNA, 19 nt, Homo sapiens
gguaugaucgaaauguaaa

SEQ ID NO: 852393 - RNA, 19 nt, Homo sapiens
gagaucacaccauggacua

SEQ ID NO: 852394 - RNA, 19 nt, Homo sapiens
gagauguugcugaaaugua

SEQ ID NO: 852395 - RNA, 19 nt, Homo sapiens
caaagacgagcaggacuaa

SEQ ID NO: 852396 - RNA, 19 nt, Homo sapiens
ccaaagaucugaaggguaa

SEQ ID NO: 852397 - RNA, 19 nt, Homo sapiens
ucacaaagcucuuauuaug

SEQ ID NO: 852398 - RNA, 19 nt, Homo sapiens
gcagaucauuuaagaagua

SEQ ID NO: 852399 - RNA, 19 nt, Homo sapiens
gagaguaacuacagaagaa

SEQ ID NO: 852400 - RNA, 19 nt, Homo sapiens
guacaugguuguuuaagaa

SEQ ID NO: 852401 - RNA, 19 nt, Homo sapiens
caacuaacuuacaugcuua

SEQ ID NO: 852402 - RNA, 19 nt, Homo sapiens
aagaagagguuuacuguuu

SEQ ID NO: 852403 - RNA, 19 nt, Homo sapiens
gggaagaagugaaugguuu

SEQ ID NO: 852404 - RNA, 19 nt, Homo sapiens
gagcaggacuaaacgaauu

SEQ ID NO: 852405 - RNA, 19 nt, Homo sapiens
gaagauuccugccaagaga

SEQ ID NO: 852406 - RNA, 19 nt, Homo sapiens
gaagaaacaguuccauauu

SEQ ID NO: 852407 - RNA, 19 nt, Homo sapiens
gaaacuggauggaaaauuu

SEQ ID NO: 852408 - RNA, 19 nt, Homo sapiens
ggacugaaacuucuauuug

SEQ ID NO: 852409 - RNA, 19 nt, Homo sapiens
gaaacccuaucucuacaaa

SEQ ID NO: 852410 - RNA, 19 nt, Homo sapiens
caggagauaugcagaguuu

SEQ ID NO: 852411 - RNA, 19 nt, Homo sapiens
gaaagcugcccaaguguaa

SEQ ID NO: 852412 - RNA, 19 nt, Homo sapiens
gaagagguuuacuguuuau

SEQ ID NO: 852413 - RNA, 19 nt, Homo sapiens
gaacaagcaucccuuccau

SEQ ID NO: 852414 - RNA, 19 nt, Homo sapiens
gcagauguguauucaguau

SEQ ID NO: 852415 - RNA, 19 nt, Homo sapiens
gggauuaaaugcaaagaga

SEQ ID NO: 852416 - RNA, 19 nt, Homo sapiens
gaggaucacuugagccuau

SEQ ID NO: 852417 - RNA, 19 nt, Homo sapiens
ggaggcagaugaugcauuc

SEQ ID NO: 852418 - RNA, 19 nt, Homo sapiens
agaagagguuuacuguuua

SEQ ID NO: 852419 - RNA, 19 nt, Homo sapiens
agaaaaggcuuaaugguua

SEQ ID NO: 852420 - RNA, 19 nt, Homo sapiens
ugaaauugcuagugcauug

SEQ ID NO: 852421 - RNA, 19 nt, Homo sapiens
gaaucuuccuuuagaggua

SEQ ID NO: 852422 - RNA, 19 nt, Homo sapiens
ccaacuaacuuacaugcuu

SEQ ID NO: 852423 - RNA, 19 nt, Homo sapiens
gcuauuaagucauucugaa

SEQ ID NO: 852424 - RNA, 19 nt, Homo sapiens
cacauuggcugcuaguuaa

SEQ ID NO: 852425 - RNA, 19 nt, Homo sapiens
gaagauuccaccaccauuu

SEQ ID NO: 852426 - RNA, 19 nt, Homo sapiens
caacugacuuugauuucuu

SEQ ID NO: 852427 - RNA, 19 nt, Homo sapiens
gcugaaauguaugacaaua

SEQ ID NO: 852428 - RNA, 19 nt, Homo sapiens
ucucagaucacaagaaaua

SEQ ID NO: 852429 - RNA, 19 nt, Homo sapiens
gagccgagaucgcaccauu

SEQ ID NO: 852430 - RNA, 19 nt, Homo sapiens
ugacaccacuaccacauuu

SEQ ID NO: 852431 - RNA, 19 nt, Homo sapiens
uaaccuaccaacuaacuua

SEQ ID NO: 852432 - RNA, 19 nt, Homo sapiens
gaugauaucagaaacuuug

SEQ ID NO: 852433 - RNA, 19 nt, Homo sapiens
ggagauaugcagaguuuga

SEQ ID NO: 852434 - RNA, 19 nt, Homo sapiens
ccauguaugucuugagaaa

SEQ ID NO: 852435 - RNA, 19 nt, Homo sapiens
ggaaagcugcccaagugua

SEQ ID NO: 852436 - RNA, 19 nt, Homo sapiens
ggaaacagaccuuaaaauu

SEQ ID NO: 852437 - RNA, 19 nt, Homo sapiens
caaauugugggucaaagua

SEQ ID NO: 852438 - RNA, 19 nt, Homo sapiens
aaggaaagcugcccaagug

SEQ ID NO: 852439 - RNA, 19 nt, Homo sapiens
gacugaaacuucuauuugu

SEQ ID NO: 852440 - RNA, 19 nt, Homo sapiens
aagcaucccuuccauguau

SEQ ID NO: 852441 - RNA, 19 nt, Homo sapiens
ugacaccucauuucuauuu

SEQ ID NO: 852442 - RNA, 19 nt, Homo sapiens
gaacguaaugugcucuuga

SEQ ID NO: 852443 - RNA, 19 nt, Homo sapiens
uauuugagcucaggaguuu

SEQ ID NO: 852444 - RNA, 19 nt, Homo sapiens
acacauuggcugcuaguua

SEQ ID NO: 852445 - RNA, 19 nt, Homo sapiens
gcccgaagguugcaugaug

SEQ ID NO: 852446 - RNA, 19 nt, Homo sapiens
caguucagcuaacauauau

SEQ ID NO: 852447 - RNA, 19 nt, Homo sapiens
aagaaacaguuccauauuc

SEQ ID NO: 852448 - RNA, 19 nt, Homo sapiens
ugacacagcauuuacagaa

SEQ ID NO: 852449 - RNA, 19 nt, Homo sapiens
gauaugcagaguuugauaa

SEQ ID NO: 852450 - RNA, 19 nt, Homo sapiens
gcacaggaaacagaccuua

SEQ ID NO: 852451 - RNA, 19 nt, Homo sapiens
gcauuggguuacuuacauu

SEQ ID NO: 852452 - RNA, 19 nt, Homo sapiens
gagguaagacuuuaauauc

SEQ ID NO: 852453 - RNA, 19 nt, Homo sapiens
aaaauaagcuuaccuugga

SEQ ID NO: 852454 - RNA, 19 nt, Homo sapiens
gaaaagaaaaggcuuaaug

SEQ ID NO: 852455 - RNA, 19 nt, Homo sapiens
guguguaucuucugacuau

SEQ ID NO: 852456 - RNA, 19 nt, Homo sapiens
gaccagaugauaucagaaa

SEQ ID NO: 852457 - RNA, 19 nt, Homo sapiens
ggugugcucuugagggauu

SEQ ID NO: 852458 - RNA, 19 nt, Homo sapiens
gaaacagaccuuaaaauug

SEQ ID NO: 852459 - RNA, 19 nt, Homo sapiens
gguacaugguuguuuaaga

SEQ ID NO: 852460 - RNA, 19 nt, Homo sapiens
ccaccaccauuuaauccua

SEQ ID NO: 852461 - RNA, 19 nt, Homo sapiens
caacauggcgaaacccuau

SEQ ID NO: 852462 - RNA, 19 nt, Homo sapiens
gcaguuugccauucagaaa

SEQ ID NO: 852463 - RNA, 19 nt, Homo sapiens
cagaagaaacaguuccaua

SEQ ID NO: 852464 - RNA, 19 nt, Homo sapiens
gauggaauuugaacauuac

SEQ ID NO: 852465 - RNA, 19 nt, Homo sapiens
gacaccucauuucuauuua

SEQ ID NO: 852466 - RNA, 19 nt, Homo sapiens
gggcugaccuuguacaaaa

SEQ ID NO: 852467 - RNA, 19 nt, Homo sapiens
ggccgaggcaggcagauua

SEQ ID NO: 852468 - RNA, 19 nt, Homo sapiens
gaugaugcauucguugguu

SEQ ID NO: 852469 - RNA, 19 nt, Homo sapiens
cagaugauaucagaaacuu

SEQ ID NO: 852470 - RNA, 19 nt, Homo sapiens
gacaauauccuucacaaac

SEQ ID NO: 852471 - RNA, 19 nt, Homo sapiens
gaaagaaaucacagaagca

SEQ ID NO: 852472 - RNA, 19 nt, Homo sapiens
ggaauuugaacauuacuuc

SEQ ID NO: 852473 - RNA, 19 nt, Homo sapiens
uauagugaaugccagugua

SEQ ID NO: 852474 - RNA, 19 nt, Homo sapiens
acacagcauuuacagaaga

SEQ ID NO: 852475 - RNA, 19 nt, Homo sapiens
gccgagauguugcugaaau

SEQ ID NO: 852476 - RNA, 19 nt, Homo sapiens
aagaaggaauugcuauuuc

SEQ ID NO: 852477 - RNA, 19 nt, Homo sapiens
agaagaaacaguuccauau

SEQ ID NO: 852478 - RNA, 19 nt, Homo sapiens
uuagguauccagaacuuua

SEQ ID NO: 852479 - RNA, 19 nt, Homo sapiens
gcgaaacccuaucucuaca

SEQ ID NO: 852480 - RNA, 19 nt, Homo sapiens
cgaggcaggcagauuauuu

SEQ ID NO: 852481 - RNA, 19 nt, Homo sapiens
ucaguucagcuaacauaua

SEQ ID NO: 852482 - RNA, 19 nt, Homo sapiens
uacccaagauagacuguuu

SEQ ID NO: 852483 - RNA, 19 nt, Homo sapiens
uauaacuagugccucauuu

SEQ ID NO: 852484 - RNA, 19 nt, Homo sapiens
guaaagaaggaauugcuau

SEQ ID NO: 852485 - RNA, 19 nt, Homo sapiens
ggaagaagugaaugguuug

SEQ ID NO: 852486 - RNA, 19 nt, Homo sapiens
gauggaaguugcagugaac

SEQ ID NO: 852487 - RNA, 19 nt, Homo sapiens
gguaugaucgaaauguaaa

SEQ ID NO: 852488 - RNA, 19 nt, Homo sapiens
gagaucacaccauggacua

SEQ ID NO: 852489 - RNA, 19 nt, Homo sapiens
gagauguugcugaaaugua

SEQ ID NO: 852490 - RNA, 19 nt, Homo sapiens
caaagacgagcaggacuaa

SEQ ID NO: 852491 - RNA, 19 nt, Homo sapiens
cacugaaucuuccuuuaga

SEQ ID NO: 852492 - RNA, 19 nt, Homo sapiens
uacacugaaucuuccuuua

SEQ ID NO: 852493 - RNA, 19 nt, Homo sapiens
agugacaccucauuucuau

SEQ ID NO: 852494 - RNA, 19 nt, Homo sapiens
agauguugcugaaauguau

SEQ ID NO: 852495 - RNA, 19 nt, Homo sapiens
gaagcauuucucaccaaua

SEQ ID NO: 852496 - RNA, 19 nt, Homo sapiens
gcaaaggccucaagucuua

SEQ ID NO: 852497 - RNA, 19 nt, Homo sapiens
caaacuagcugucaaguca

SEQ ID NO: 852498 - RNA, 19 nt, Homo sapiens
gaaaagacaugccuccaua

SEQ ID NO: 852499 - RNA, 19 nt, Homo sapiens
ggaaggaugugcucaugaa

SEQ ID NO: 852500 - RNA, 19 nt, Homo sapiens
gcaaaugagugugaccuaa

SEQ ID NO: 852501 - RNA, 19 nt, Homo sapiens
caagaaagauuuggaaaca

SEQ ID NO: 852502 - RNA, 19 nt, Homo sapiens
ugaguuagcucuuuggaau

SEQ ID NO: 852503 - RNA, 19 nt, Homo sapiens
cauaugugccuuucuguua

SEQ ID NO: 852504 - RNA, 19 nt, Homo sapiens
gaacaauggccucaagaug

SEQ ID NO: 852505 - RNA, 19 nt, Homo sapiens
ggauagauauaccacaugu

SEQ ID NO: 852506 - RNA, 19 nt, Homo sapiens
guaaacgucaggauagaua

SEQ ID NO: 852507 - RNA, 19 nt, Homo sapiens
caaguuaagucucccuaau

SEQ ID NO: 852508 - RNA, 19 nt, Homo sapiens
agaaagauuuggaaacaug

SEQ ID NO: 852509 - RNA, 19 nt, Homo sapiens
ggauaucgcaggucaagaa

SEQ ID NO: 852510 - RNA, 19 nt, Homo sapiens
guuacaaacuucugucaug

SEQ ID NO: 852511 - RNA, 19 nt, Homo sapiens
ugacaggccuauuaaguag

SEQ ID NO: 852512 - RNA, 19 nt, Homo sapiens
uaucgcaggucaagaaaga

SEQ ID NO: 852513 - RNA, 19 nt, Homo sapiens
uggcuuaacugaauauugu

SEQ ID NO: 852514 - RNA, 19 nt, Homo sapiens
ugaaacacauacuugcaaa

SEQ ID NO: 852515 - RNA, 19 nt, Homo sapiens
ggagcacgguuucguagga

SEQ ID NO: 852516 - RNA, 19 nt, Homo sapiens
gaagcuaugggugcauuua

SEQ ID NO: 852517 - RNA, 19 nt, Homo sapiens
agagagaaauagcaaaugu

SEQ ID NO: 852518 - RNA, 19 nt, Homo sapiens
gagaagcuaugggugcauu

SEQ ID NO: 852519 - RNA, 19 nt, Homo sapiens
gagggucuauuaccgagaa

SEQ ID NO: 852520 - RNA, 19 nt, Homo sapiens
gaacaaacuagcugucaag

SEQ ID NO: 852521 - RNA, 19 nt, Homo sapiens
gggaagaccaguaucauca

SEQ ID NO: 852522 - RNA, 19 nt, Homo sapiens
gaagaccaguaucaucaag

SEQ ID NO: 852523 - RNA, 19 nt, Homo sapiens
aauguuggcuuaacugaau

SEQ ID NO: 852524 - RNA, 19 nt, Homo sapiens
acaauggccucaagaugga

SEQ ID NO: 852525 - RNA, 19 nt, Homo sapiens
gaaagauuuggaaacauga

SEQ ID NO: 852526 - RNA, 19 nt, Homo sapiens
gcaaauguucuuucuaugc

SEQ ID NO: 852527 - RNA, 19 nt, Homo sapiens
ugaaacaucagcaaaggaa

SEQ ID NO: 852528 - RNA, 19 nt, Homo sapiens
caaauguucuuucuaugcu

SEQ ID NO: 852529 - RNA, 19 nt, Homo sapiens
gcacaaggagcaccuguac

SEQ ID NO: 852530 - RNA, 19 nt, Homo sapiens
aaaugagugugaccuaaug

SEQ ID NO: 852531 - RNA, 19 nt, Homo sapiens
caaggagcacgguuucgua

SEQ ID NO: 852532 - RNA, 19 nt, Homo sapiens
acaaggagcaccuguacaa

SEQ ID NO: 852533 - RNA, 19 nt, Homo sapiens
gaacuucuccucgcacuac

SEQ ID NO: 852534 - RNA, 19 nt, Homo sapiens
caggauagauauaccacau

SEQ ID NO: 852535 - RNA, 19 nt, Homo sapiens
gcacuguuauuugcuucuu

SEQ ID NO: 852536 - RNA, 19 nt, Homo sapiens
acaaacuucugucauguag

SEQ ID NO: 852537 - RNA, 19 nt, Homo sapiens
gcuggugucugguaggaau

SEQ ID NO: 852538 - RNA, 19 nt, Homo sapiens
aggagcaccuguacaaguu

SEQ ID NO: 852539 - RNA, 19 nt, Homo sapiens
ggccucaagucuuaaaaua

SEQ ID NO: 852540 - RNA, 19 nt, Homo sapiens
gagagaaauagcaaauguu

SEQ ID NO: 852541 - RNA, 19 nt, Homo sapiens
caaaugagugugaccuaau

SEQ ID NO: 852542 - RNA, 19 nt, Homo sapiens
gcuaugggugcauuuauug

SEQ ID NO: 852543 - RNA, 19 nt, Homo sapiens
acacauacuugcaaaugag

SEQ ID NO: 852544 - RNA, 19 nt, Homo sapiens
aaacacauacuugcaaaug

SEQ ID NO: 852545 - RNA, 19 nt, Homo sapiens
acaaguugcuggugauugg

SEQ ID NO: 852546 - RNA, 19 nt, Homo sapiens
gaccuaauggagucuauug

SEQ ID NO: 852547 - RNA, 19 nt, Homo sapiens
ggucaagaaagauuuggaa

SEQ ID NO: 852548 - RNA, 19 nt, Homo sapiens
ggaagaccaguaucaucaa

SEQ ID NO: 852549 - RNA, 19 nt, Homo sapiens
acaugacgagggucuauua

SEQ ID NO: 852550 - RNA, 19 nt, Homo sapiens
gaauguuggcuuaacugaa

SEQ ID NO: 852551 - RNA, 19 nt, Homo sapiens
uggccugaauguuggcuua

SEQ ID NO: 852552 - RNA, 19 nt, Homo sapiens
cagcaaaggccucaagucu

SEQ ID NO: 852553 - RNA, 19 nt, Homo sapiens
ucauguagcugaccaaaau

SEQ ID NO: 852554 - RNA, 19 nt, Homo sapiens
uuacaaacuucugucaugu

SEQ ID NO: 852555 - RNA, 19 nt, Homo sapiens
aaacgucaggauagauaua

SEQ ID NO: 852556 - RNA, 19 nt, Homo sapiens
ggguaaacgucaggauaga

SEQ ID NO: 852557 - RNA, 19 nt, Homo sapiens
gaugugcucaugaacaaug

SEQ ID NO: 852558 - RNA, 19 nt, Homo sapiens
ccucugaguuagcucuuug

SEQ ID NO: 852559 - RNA, 19 nt, Homo sapiens
cugacaggccuauuaagua

SEQ ID NO: 852560 - RNA, 19 nt, Homo sapiens
aaacuucugucauguagcu

SEQ ID NO: 852561 - RNA, 19 nt, Homo sapiens
agaacaaacuagcugucaa

SEQ ID NO: 852562 - RNA, 19 nt, Homo sapiens
ucaucacaguguuuacaaa

SEQ ID NO: 852563 - RNA, 19 nt, Homo sapiens
gaaacacauacuugcaaau

SEQ ID NO: 852564 - RNA, 19 nt, Homo sapiens
gaaacaucagcaaaggaaa

SEQ ID NO: 852565 - RNA, 19 nt, Homo sapiens
caugaacaauggccucaag

SEQ ID NO: 852566 - RNA, 19 nt, Homo sapiens
aggaugugcucaugaacaa

SEQ ID NO: 852567 - RNA, 19 nt, Homo sapiens
caagaugaccuccauucuc

SEQ ID NO: 852568 - RNA, 19 nt, Homo sapiens
agagaaauagcaaauguuc

SEQ ID NO: 852569 - RNA, 19 nt, Homo sapiens
ugagagagaaauagcaaau

SEQ ID NO: 852570 - RNA, 19 nt, Homo sapiens
gcaggucaagaaagauuug

SEQ ID NO: 852571 - RNA, 19 nt, Homo sapiens
aacacauacuugcaaauga

SEQ ID NO: 852572 - RNA, 19 nt, Homo sapiens
aaagacaugccuccauaug

SEQ ID NO: 852573 - RNA, 19 nt, Homo sapiens
ugccauggccugaauguug

SEQ ID NO: 852574 - RNA, 19 nt, Homo sapiens
uauauuguccuuguccuaa

SEQ ID NO: 852575 - RNA, 19 nt, Homo sapiens
gauaucgcaggucaagaaa

SEQ ID NO: 852576 - RNA, 19 nt, Homo sapiens
caccaggccagccacauuu

SEQ ID NO: 852577 - RNA, 19 nt, Homo sapiens
gcuccucuauacaugcuau

SEQ ID NO: 852578 - RNA, 19 nt, Homo sapiens
gugaaacacauacuugcaa

SEQ ID NO: 852579 - RNA, 19 nt, Homo sapiens
ucuguuagcucucuuugac

SEQ ID NO: 852580 - RNA, 19 nt, Homo sapiens
gagcacgguuucguaggau

SEQ ID NO: 852581 - RNA, 19 nt, Homo sapiens
ggugugcuauauuguccuu

SEQ ID NO: 852582 - RNA, 19 nt, Homo sapiens
gagagagaaauagcaaaug

SEQ ID NO: 852583 - RNA, 19 nt, Homo sapiens
gugcauuuauugucuucga

SEQ ID NO: 852584 - RNA, 19 nt, Homo sapiens
gccucaagauggaccaguu

SEQ ID NO: 852585 - RNA, 19 nt, Homo sapiens
ccuauuaaguagaugugau

SEQ ID NO: 852586 - RNA, 19 nt, Homo sapiens
gaaacaugacgagggucua

SEQ ID NO: 852587 - RNA, 19 nt, Homo sapiens
ucaccaggccagccacauu

SEQ ID NO: 852588 - RNA, 19 nt, Homo sapiens
gggaaggaugugcucauga

SEQ ID NO: 852589 - RNA, 19 nt, Homo sapiens
gcaaggagcacgguuucgu

SEQ ID NO: 852590 - RNA, 19 nt, Homo sapiens
gccugcagcucugggauau

SEQ ID NO: 852591 - RNA, 19 nt, Homo sapiens
ccaaguuaagucucccuaa

SEQ ID NO: 852592 - RNA, 19 nt, Homo sapiens
uugaagcaguggcaaagug

SEQ ID NO: 852593 - RNA, 19 nt, Homo sapiens
acaggccuauuaaguagau

SEQ ID NO: 852594 - RNA, 19 nt, Homo sapiens
guacaaguugcuggugauu

SEQ ID NO: 852595 - RNA, 19 nt, Homo sapiens
ggagaagaacaaacuagcu

SEQ ID NO: 852596 - RNA, 19 nt, Homo sapiens
ggaagaagauccuuaauca

SEQ ID NO: 852597 - RNA, 19 nt, Homo sapiens
ggacugauauuaagagaaa

SEQ ID NO: 852598 - RNA, 19 nt, Homo sapiens
gaacgagucuuuguaguaa

SEQ ID NO: 852599 - RNA, 19 nt, Homo sapiens
ggaaagaucacaaagauuu

SEQ ID NO: 852600 - RNA, 19 nt, Homo sapiens
gcgggaaacugaauaauaa

SEQ ID NO: 852601 - RNA, 19 nt, Homo sapiens
gaucagauauguaugaaug

SEQ ID NO: 852602 - RNA, 19 nt, Homo sapiens
ggaaauacaugcauacaca

SEQ ID NO: 852603 - RNA, 19 nt, Homo sapiens
ggagauauguuggaaauga

SEQ ID NO: 852604 - RNA, 19 nt, Homo sapiens
ggauguggcuauuaaagua

SEQ ID NO: 852605 - RNA, 19 nt, Homo sapiens
ggagggauguggcuauuaa

SEQ ID NO: 852606 - RNA, 19 nt, Homo sapiens
gaggaugacuucccaguuu

SEQ ID NO: 852607 - RNA, 19 nt, Homo sapiens
acaauaggcucacuuaauu

SEQ ID NO: 852608 - RNA, 19 nt, Homo sapiens
ggaaugcaguguaaagauu

SEQ ID NO: 852609 - RNA, 19 nt, Homo sapiens
uaguauggcucuaaucuua

SEQ ID NO: 852610 - RNA, 19 nt, Homo sapiens
gggaacagauacagauaua

SEQ ID NO: 852611 - RNA, 19 nt, Homo sapiens
gagccuauuucuaguauaa

SEQ ID NO: 852612 - RNA, 19 nt, Homo sapiens
gaagguguccuaucaaauu

SEQ ID NO: 852613 - RNA, 19 nt, Homo sapiens
gagcuaaccuaaauaagga

SEQ ID NO: 852614 - RNA, 19 nt, Homo sapiens
gagaagguguccuaucaaa

SEQ ID NO: 852615 - RNA, 19 nt, Homo sapiens
gaaugaaucuggaucaaag

SEQ ID NO: 852616 - RNA, 19 nt, Homo sapiens
gaacgauguuuguuugcua

SEQ ID NO: 852617 - RNA, 19 nt, Homo sapiens
ggacaaaugauguuacaaa

SEQ ID NO: 852618 - RNA, 19 nt, Homo sapiens
ucacugagcuaaccuaaau

SEQ ID NO: 852619 - RNA, 19 nt, Homo sapiens
acuggaagcuugauaauaa

SEQ ID NO: 852620 - RNA, 19 nt, Homo sapiens
gaagaguacugcuggucua

SEQ ID NO: 852621 - RNA, 19 nt, Homo sapiens
ccaaagcacuucauuaugg

SEQ ID NO: 852622 - RNA, 19 nt, Homo sapiens
gaagaucagauauguauga

SEQ ID NO: 852623 - RNA, 19 nt, Homo sapiens
gaagauccuuaaucacuga

SEQ ID NO: 852624 - RNA, 19 nt, Homo sapiens
ccaaauccauggagagaaa

SEQ ID NO: 852625 - RNA, 19 nt, Homo sapiens
gaggauagcucagugaugu

SEQ ID NO: 852626 - RNA, 19 nt, Homo sapiens
gaagaggauuucaccuuga

SEQ ID NO: 852627 - RNA, 19 nt, Homo sapiens
gaaagagacgucugucaaa

SEQ ID NO: 852628 - RNA, 19 nt, Homo sapiens
gcauacaguuucauuucua

SEQ ID NO: 852629 - RNA, 19 nt, Homo sapiens
uaaaggcacugucagagaa

SEQ ID NO: 852630 - RNA, 19 nt, Homo sapiens
gcaacagcuucuaagauaa

SEQ ID NO: 852631 - RNA, 19 nt, Homo sapiens
ugcaacagcuucuaagaua

SEQ ID NO: 852632 - RNA, 19 nt, Homo sapiens
gagaaggccuuucgacauc

SEQ ID NO: 852633 - RNA, 19 nt, Homo sapiens
gaucucggcuuuacacaau

SEQ ID NO: 852634 - RNA, 19 nt, Homo sapiens
ggaguuaucaucuauguga

SEQ ID NO: 852635 - RNA, 19 nt, Homo sapiens
aagaaacaguggcuuauuu

SEQ ID NO: 852636 - RNA, 19 nt, Homo sapiens
gaaagucaacuccguaaug

SEQ ID NO: 852637 - RNA, 19 nt, Homo sapiens
gaaauucuccgcauaucuu

SEQ ID NO: 852638 - RNA, 19 nt, Homo sapiens
gaaaguuccacacacauuu

SEQ ID NO: 852639 - RNA, 19 nt, Homo sapiens
gguaauuuguccuucuaua

SEQ ID NO: 852640 - RNA, 19 nt, Homo sapiens
gaaucuggaucaaaguauu

SEQ ID NO: 852641 - RNA, 19 nt, Homo sapiens
uaaacaaucugcuucaagu

SEQ ID NO: 852642 - RNA, 19 nt, Homo sapiens
ccacucugcugcuaaauau

SEQ ID NO: 852643 - RNA, 19 nt, Homo sapiens
ugaagcaauugaucugaua

SEQ ID NO: 852644 - RNA, 19 nt, Homo sapiens
guguaaagauugcaaauuc

SEQ ID NO: 852645 - RNA, 19 nt, Homo sapiens
gccaaggaaugcaguguaa

SEQ ID NO: 852646 - RNA, 19 nt, Homo sapiens
cagaugauauggaagaaga

SEQ ID NO: 852647 - RNA, 19 nt, Homo sapiens
acaaguaucucuguaucua

SEQ ID NO: 852648 - RNA, 19 nt, Homo sapiens
gucaaggacugaaauguga

SEQ ID NO: 852649 - RNA, 19 nt, Homo sapiens
gagccucaguggcacauuu

SEQ ID NO: 852650 - RNA, 19 nt, Homo sapiens
gguaggaacuccagcauac

SEQ ID NO: 852651 - RNA, 19 nt, Homo sapiens
guaaugaaguggcuauuuu

SEQ ID NO: 852652 - RNA, 19 nt, Homo sapiens
cagaggaaauaaagaaguu

SEQ ID NO: 852653 - RNA, 19 nt, Homo sapiens
uguauaaccugcauaacuu

SEQ ID NO: 852654 - RNA, 19 nt, Homo sapiens
guuguuaaaugccuaagaa

SEQ ID NO: 852655 - RNA, 19 nt, Homo sapiens
ucaccaaagucuguuuaua

SEQ ID NO: 852656 - RNA, 19 nt, Homo sapiens
gauuuaagguguggacauu

SEQ ID NO: 852657 - RNA, 19 nt, Homo sapiens
ucgacaggcuuguauuuaa

SEQ ID NO: 852658 - RNA, 19 nt, Homo sapiens
aaagucaacuccguaauga

SEQ ID NO: 852659 - RNA, 19 nt, Homo sapiens
ugagaaagaggcauuauug

SEQ ID NO: 852660 - RNA, 19 nt, Homo sapiens
caaauucaacugccauaaa

SEQ ID NO: 852661 - RNA, 19 nt, Homo sapiens
gggagaguguuaccauuga

SEQ ID NO: 852662 - RNA, 19 nt, Homo sapiens
gcuguacuaucuacccaua

SEQ ID NO: 852663 - RNA, 19 nt, Homo sapiens
cuaggaaaguguuaacuau

SEQ ID NO: 852664 - RNA, 19 nt, Homo sapiens
gcugggaaauacaugcaua

SEQ ID NO: 852665 - RNA, 19 nt, Homo sapiens
uaagagaaauaggaccuuu

SEQ ID NO: 852666 - RNA, 19 nt, Homo sapiens
caaccauuaugcuguacua

SEQ ID NO: 852667 - RNA, 19 nt, Homo sapiens
gcaguacuccuguguucua

SEQ ID NO: 852668 - RNA, 19 nt, Homo sapiens
uaauuugucuucccauuuc

SEQ ID NO: 852669 - RNA, 19 nt, Homo sapiens
ccaguacuguaguucauaa

SEQ ID NO: 852670 - RNA, 19 nt, Homo sapiens
gcagcaauccacacuguuu

SEQ ID NO: 852671 - RNA, 19 nt, Homo sapiens
cauuugcuguucacucuua

SEQ ID NO: 852672 - RNA, 19 nt, Homo sapiens
uaacuguaguggaguaaga

SEQ ID NO: 852673 - RNA, 19 nt, Homo sapiens
ccuucaagauuccaaauaa

SEQ ID NO: 852674 - RNA, 19 nt, Homo sapiens
gaucuugugugcuccauag

SEQ ID NO: 852675 - RNA, 19 nt, Homo sapiens
uaagcuacgucaacucuau

SEQ ID NO: 852676 - RNA, 19 nt, Homo sapiens
gauaaacaaucugcuucaa

SEQ ID NO: 852677 - RNA, 19 nt, Homo sapiens
ggacagcucucauaauccu

SEQ ID NO: 852678 - RNA, 19 nt, Homo sapiens
ugaaggcuguggauuaaau

SEQ ID NO: 852679 - RNA, 19 nt, Homo sapiens
ggauagcucagugauguua

SEQ ID NO: 852680 - RNA, 19 nt, Homo sapiens
gcacagcaaauuaaagaau

SEQ ID NO: 852681 - RNA, 19 nt, Homo sapiens
auacaugcauacacacaua

SEQ ID NO: 852682 - RNA, 19 nt, Homo sapiens
gaacguuacauuacacaug

SEQ ID NO: 852683 - RNA, 19 nt, Homo sapiens
cauaaacgcugugcaucaa

SEQ ID NO: 852684 - RNA, 19 nt, Homo sapiens
gccauaguguuaagucauu

SEQ ID NO: 852685 - RNA, 19 nt, Homo sapiens
gaaagaauaguagcaaaca

SEQ ID NO: 852686 - RNA, 19 nt, Homo sapiens
cgacaucccugaagcuagu

SEQ ID NO: 852687 - RNA, 19 nt, Homo sapiens
guaugaaugcagucaaaua

SEQ ID NO: 852688 - RNA, 19 nt, Homo sapiens
gugaagaucagauauguau

SEQ ID NO: 852689 - RNA, 19 nt, Homo sapiens
gaagcugugugacuuugga

SEQ ID NO: 852690 - RNA, 19 nt, Homo sapiens
guuaaaugccuaagaaguu

SEQ ID NO: 852691 - RNA, 19 nt, Homo sapiens
ggaaucaaggugaagcuuu

SEQ ID NO: 852692 - RNA, 19 nt, Homo sapiens
ugaggaaucugcauuuuaa

SEQ ID NO: 852693 - RNA, 19 nt, Homo sapiens
guggauaucaguacuguuu

SEQ ID NO: 852694 - RNA, 19 nt, Homo sapiens
acagauauaccaauggaua

SEQ ID NO: 852695 - RNA, 19 nt, Homo sapiens
caaucaaucuacugugguu

SEQ ID NO: 852696 - RNA, 19 nt, Homo sapiens
ggagaaagcuggagaucug

SEQ ID NO: 852697 - RNA, 19 nt, Homo sapiens
gagaacauccaucagaauu

SEQ ID NO: 852698 - RNA, 19 nt, Homo sapiens
gaauuuggcgggaugauau

SEQ ID NO: 852699 - RNA, 19 nt, Homo sapiens
gaugauaugcuugccauuu

SEQ ID NO: 852700 - RNA, 19 nt, Homo sapiens
caacgaguacuucuacauu

SEQ ID NO: 852701 - RNA, 19 nt, Homo sapiens
gaagagacccuugguaaac

SEQ ID NO: 852702 - RNA, 19 nt, Homo sapiens
gaacauccaucagaauucc

SEQ ID NO: 852703 - RNA, 19 nt, Homo sapiens
ccaagaggcgggagaagaa

SEQ ID NO: 852704 - RNA, 19 nt, Homo sapiens
cggagaacauccaucagaa

SEQ ID NO: 852705 - RNA, 19 nt, Homo sapiens
gagagaggaaagacaguuu

SEQ ID NO: 852706 - RNA, 19 nt, Homo sapiens
gcugagagacuaguuguga

SEQ ID NO: 852707 - RNA, 19 nt, Homo sapiens
gaucugaacccagcccauu

SEQ ID NO: 852708 - RNA, 19 nt, Homo sapiens
ggacgugcaccucaccauu

SEQ ID NO: 852709 - RNA, 19 nt, Homo sapiens
gaaccagcaccuccaagga

SEQ ID NO: 852710 - RNA, 19 nt, Homo sapiens
ugaagagacccuugguaaa

SEQ ID NO: 852711 - RNA, 19 nt, Homo sapiens
ggagaacauccaucagaau

SEQ ID NO: 852712 - RNA, 19 nt, Homo sapiens
gaaggguccucggagaaca

SEQ ID NO: 852713 - RNA, 19 nt, Homo sapiens
gcaauggcaacgaguacuu

SEQ ID NO: 852714 - RNA, 19 nt, Homo sapiens
cagcccauuugcacacuaa

SEQ ID NO: 852715 - RNA, 19 nt, Homo sapiens
gacuaguugugauuugcua

SEQ ID NO: 852716 - RNA, 19 nt, Homo sapiens
gagagacuaguugugauuu

SEQ ID NO: 852717 - RNA, 19 nt, Homo sapiens
uugaagagacccuugguaa

SEQ ID NO: 852718 - RNA, 19 nt, Homo sapiens
cacaguggguuacaagcuu

SEQ ID NO: 852719 - RNA, 19 nt, Homo sapiens
guacuucuacauucugguu

SEQ ID NO: 852720 - RNA, 19 nt, Homo sapiens
cugauuggcuguaaguauc

SEQ ID NO: 852721 - RNA, 19 nt, Homo sapiens
acaagcuucuuuuggauua

SEQ ID NO: 852722 - RNA, 19 nt, Homo sapiens
gcaacgaguacuucuacau

SEQ ID NO: 852723 - RNA, 19 nt, Homo sapiens
gaucugauuggcuguaagu

SEQ ID NO: 852724 - RNA, 19 nt, Homo sapiens
ugagagacuaguugugauu

SEQ ID NO: 852725 - RNA, 19 nt, Homo sapiens
ggaggugccugugguuugc

SEQ ID NO: 852726 - RNA, 19 nt, Homo sapiens
gcgaaggguccucggagaa

SEQ ID NO: 852727 - RNA, 19 nt, Homo sapiens
gaaucaugcugggcuacau

SEQ ID NO: 852728 - RNA, 19 nt, Homo sapiens
gagacuaguugugauuugc

SEQ ID NO: 852729 - RNA, 19 nt, Homo sapiens
agagacuaguugugauuug

SEQ ID NO: 852730 - RNA, 19 nt, Homo sapiens
gggaggugccugugguuug

SEQ ID NO: 852731 - RNA, 19 nt, Homo sapiens
gccagcaaccuuagagaga

SEQ ID NO: 852732 - RNA, 19 nt, Homo sapiens
guuacaagcuucuuuugga

SEQ ID NO: 852733 - RNA, 19 nt, Homo sapiens
uagaucugauuggcuguaa

SEQ ID NO: 852734 - RNA, 19 nt, Homo sapiens
gagcuuuguccuucuagau

SEQ ID NO: 852735 - RNA, 19 nt, Homo sapiens
cagggcugccgaaugcuua

SEQ ID NO: 852736 - RNA, 19 nt, Homo sapiens
gguuugcacccaccacuga

SEQ ID NO: 852737 - RNA, 19 nt, Homo sapiens
gacgugcaccucaccauuc

SEQ ID NO: 852738 - RNA, 19 nt, Homo sapiens
aacgaguacuucuacauuc

SEQ ID NO: 852739 - RNA, 19 nt, Homo sapiens
gcgcguacacugacuuugg

SEQ ID NO: 852740 - RNA, 19 nt, Homo sapiens
gagaaagcuggagaucuga

SEQ ID NO: 852741 - RNA, 19 nt, Homo sapiens
aaauggagccucugaacag

SEQ ID NO: 852742 - RNA, 19 nt, Homo sapiens
agaauuuggcgggaugaua

SEQ ID NO: 852743 - RNA, 19 nt, Homo sapiens
aaagacaguuuucaagugu

SEQ ID NO: 852744 - RNA, 19 nt, Homo sapiens
ccaucagccagcaaccuua

SEQ ID NO: 852745 - RNA, 19 nt, Homo sapiens
gcuuuguccuucuagaucu

SEQ ID NO: 852746 - RNA, 19 nt, Homo sapiens
ucggagaacauccaucaga

SEQ ID NO: 852747 - RNA, 19 nt, Homo sapiens
ccucggagaacauccauca

SEQ ID NO: 852748 - RNA, 19 nt, Homo sapiens
gcggcaauggcaacgagua

SEQ ID NO: 852749 - RNA, 19 nt, Homo sapiens
cucuuggacuggacgauuu

SEQ ID NO: 852750 - RNA, 19 nt, Homo sapiens
augcugggcuacaugaaau

SEQ ID NO: 852751 - RNA, 19 nt, Homo sapiens
aggacacgcugagagacua

SEQ ID NO: 852752 - RNA, 19 nt, Homo sapiens
gaaaauggagccucugaac

SEQ ID NO: 852753 - RNA, 19 nt, Homo sapiens
ccucaaugcugaaaaugga

SEQ ID NO: 852754 - RNA, 19 nt, Homo sapiens
gaaagcuggagaucugaac

SEQ ID NO: 852755 - RNA, 19 nt, Homo sapiens
acuggacgauuugggaauu

SEQ ID NO: 852756 - RNA, 19 nt, Homo sapiens
ccagcccauuugcacacua

SEQ ID NO: 852757 - RNA, 19 nt, Homo sapiens
guugugauuugcuauuuug

SEQ ID NO: 852758 - RNA, 19 nt, Homo sapiens
ggaaucaugcugggcuaca

SEQ ID NO: 852759 - RNA, 19 nt, Homo sapiens
ugggcuacaugaaauccaa

SEQ ID NO: 852760 - RNA, 19 nt, Homo sapiens
gacagaaacuaaacucuua

SEQ ID NO: 852761 - RNA, 19 nt, Homo sapiens
ggagucacguuaccauuua

SEQ ID NO: 852762 - RNA, 19 nt, Homo sapiens
ggaacggacugguauguaa

SEQ ID NO: 852763 - RNA, 19 nt, Homo sapiens
ggaaagcucacucggauua

SEQ ID NO: 852764 - RNA, 19 nt, Homo sapiens
gaagucaacugcacugcua

SEQ ID NO: 852765 - RNA, 19 nt, Homo sapiens
guacauacuucacucauga

SEQ ID NO: 852766 - RNA, 19 nt, Homo sapiens
gagagucgaugaugaaaug

SEQ ID NO: 852767 - RNA, 19 nt, Homo sapiens
gcagugaacucaaaguauc

SEQ ID NO: 852768 - RNA, 19 nt, Homo sapiens
gaauuugccugcugggauu

SEQ ID NO: 852769 - RNA, 19 nt, Homo sapiens
ugacaaacgucucaauuuc

SEQ ID NO: 852770 - RNA, 19 nt, Homo sapiens
ucagugaccuugaacauau

SEQ ID NO: 852771 - RNA, 19 nt, Homo sapiens
gcgagaaauucguguguuu

SEQ ID NO: 852772 - RNA, 19 nt, Homo sapiens
ggauuuaguuucaguagau

SEQ ID NO: 852773 - RNA, 19 nt, Homo sapiens
ggucagacauguacacugu

SEQ ID NO: 852774 - RNA, 19 nt, Homo sapiens
gaaaguacacucugcuguu

SEQ ID NO: 852775 - RNA, 19 nt, Homo sapiens
agacacagcuauaaucaau

SEQ ID NO: 852776 - RNA, 19 nt, Homo sapiens
gaugaucgauauccagaga

SEQ ID NO: 852777 - RNA, 19 nt, Homo sapiens
aagaagggcugguauuguu

SEQ ID NO: 852778 - RNA, 19 nt, Homo sapiens
gaaagaguacuucaucuag

SEQ ID NO: 852779 - RNA, 19 nt, Homo sapiens
ucagaugacuuauccucua

SEQ ID NO: 852780 - RNA, 19 nt, Homo sapiens
ggacagaaacuaaacucuu

SEQ ID NO: 852781 - RNA, 19 nt, Homo sapiens
ucaaugagguguccaacug

SEQ ID NO: 852782 - RNA, 19 nt, Homo sapiens
cagaacaacuccgaagaaa

SEQ ID NO: 852783 - RNA, 19 nt, Homo sapiens
gaugguaacuugggugaga

SEQ ID NO: 852784 - RNA, 19 nt, Homo sapiens
ccaacaggcagaccauuua

SEQ ID NO: 852785 - RNA, 19 nt, Homo sapiens
cagcacagcuuaggauuuc

SEQ ID NO: 852786 - RNA, 19 nt, Homo sapiens
ggagaaccagcacagcuua

SEQ ID NO: 852787 - RNA, 19 nt, Homo sapiens
aaacuuggauacuuggauu

SEQ ID NO: 852788 - RNA, 19 nt, Homo sapiens
aaaguacacucugcuguuu

SEQ ID NO: 852789 - RNA, 19 nt, Homo sapiens
gaagaguggucagacaugu

SEQ ID NO: 852790 - RNA, 19 nt, Homo sapiens
guaaucugaugaucgauau

SEQ ID NO: 852791 - RNA, 19 nt, Homo sapiens
gauagaaccauugcaauau

SEQ ID NO: 852792 - RNA, 19 nt, Homo sapiens
gcaaaucggagguggaaga

SEQ ID NO: 852793 - RNA, 19 nt, Homo sapiens
ugauagaaccauugcaaua

SEQ ID NO: 852794 - RNA, 19 nt, Homo sapiens
cgaaagacgugacagugau

SEQ ID NO: 852795 - RNA, 19 nt, Homo sapiens
uauaaucaaugcagaagga

SEQ ID NO: 852796 - RNA, 19 nt, Homo sapiens
cggauuauaugcuguaugu

SEQ ID NO: 852797 - RNA, 19 nt, Homo sapiens
gaacggacugguauguaaa

SEQ ID NO: 852798 - RNA, 19 nt, Homo sapiens
guagacggcucaguauaga

SEQ ID NO: 852799 - RNA, 19 nt, Homo sapiens
ggacagcagguuucaguug

SEQ ID NO: 852800 - RNA, 19 nt, Homo sapiens
caaagggugagaaucauuu

SEQ ID NO: 852801 - RNA, 19 nt, Homo sapiens
cugcauguacuguauauua

SEQ ID NO: 852802 - RNA, 19 nt, Homo sapiens
uaugguaacugcuuucugu

SEQ ID NO: 852803 - RNA, 19 nt, Homo sapiens
uauuggaacuugcgagaaa

SEQ ID NO: 852804 - RNA, 19 nt, Homo sapiens
caacuggcccuauuuagau

SEQ ID NO: 852805 - RNA, 19 nt, Homo sapiens
ccagcgguaucuagaagua

SEQ ID NO: 852806 - RNA, 19 nt, Homo sapiens
gcauguuguugaaagguuu

SEQ ID NO: 852807 - RNA, 19 nt, Homo sapiens
gagaaucauuuagcauguu

SEQ ID NO: 852808 - RNA, 19 nt, Homo sapiens
ggacugguauguaaaagaa

SEQ ID NO: 852809 - RNA, 19 nt, Homo sapiens
aaagcaaguucgucuguug

SEQ ID NO: 852810 - RNA, 19 nt, Homo sapiens
guaaagauuugggugaaca

SEQ ID NO: 852811 - RNA, 19 nt, Homo sapiens
aaagaguacuucaucuaga

SEQ ID NO: 852812 - RNA, 19 nt, Homo sapiens
gguggaaggugaggagauu

SEQ ID NO: 852813 - RNA, 19 nt, Homo sapiens
gagagacacugcgguggaa

SEQ ID NO: 852814 - RNA, 19 nt, Homo sapiens
acuaaacucuuaccauaug

SEQ ID NO: 852815 - RNA, 19 nt, Homo sapiens
gaaacuaaacucuuaccau

SEQ ID NO: 852816 - RNA, 19 nt, Homo sapiens
gcagacacagcuauaauca

SEQ ID NO: 852817 - RNA, 19 nt, Homo sapiens
aaagcucacucggauuaua

SEQ ID NO: 852818 - RNA, 19 nt, Homo sapiens
gaaaguuacaccaccauca

SEQ ID NO: 852819 - RNA, 19 nt, Homo sapiens
acauaaagguacauacuuc

SEQ ID NO: 852820 - RNA, 19 nt, Homo sapiens
uaucaaagggugagaauca

SEQ ID NO: 852821 - RNA, 19 nt, Homo sapiens
cgaccauaguauaaucaua

SEQ ID NO: 852822 - RNA, 19 nt, Homo sapiens
ccuaggcacuuaaccaaga

SEQ ID NO: 852823 - RNA, 19 nt, Homo sapiens
acaggcagaccauuuauuu

SEQ ID NO: 852824 - RNA, 19 nt, Homo sapiens
gggauuccuuagacucuuu

SEQ ID NO: 852825 - RNA, 19 nt, Homo sapiens
ccaaccuguucaucaauaa

SEQ ID NO: 852826 - RNA, 19 nt, Homo sapiens
caagugcacauucagauga

SEQ ID NO: 852827 - RNA, 19 nt, Homo sapiens
ucagacauguacacuguga

SEQ ID NO: 852828 - RNA, 19 nt, Homo sapiens
aaacuuucauuccuucaga

SEQ ID NO: 852829 - RNA, 19 nt, Homo sapiens
gaccaucaguugccaaguc

SEQ ID NO: 852830 - RNA, 19 nt, Homo sapiens
gagcagugaagacuagaaa

SEQ ID NO: 852831 - RNA, 19 nt, Homo sapiens
uaaagagacagugauauug

SEQ ID NO: 852832 - RNA, 19 nt, Homo sapiens
gaugauaaagagacaguga

SEQ ID NO: 852833 - RNA, 19 nt, Homo sapiens
gaacaacuccgaagaaaag

SEQ ID NO: 852834 - RNA, 19 nt, Homo sapiens
uuuauaaucugcagcucua

SEQ ID NO: 852835 - RNA, 19 nt, Homo sapiens
gcccauguuucaaauacuu

SEQ ID NO: 852836 - RNA, 19 nt, Homo sapiens
agucaaacuuggauacuug

SEQ ID NO: 852837 - RNA, 19 nt, Homo sapiens
ugauaaagagacagugaua

SEQ ID NO: 852838 - RNA, 19 nt, Homo sapiens
ccaacuggcccuauuuaga

SEQ ID NO: 852839 - RNA, 19 nt, Homo sapiens
caaucggccuuacuucuca

SEQ ID NO: 852840 - RNA, 19 nt, Homo sapiens
guucugcucugguuguuuc

SEQ ID NO: 852841 - RNA, 19 nt, Homo sapiens
agacggcucaguauagaua

SEQ ID NO: 852842 - RNA, 19 nt, Homo sapiens
cccaaccuguucaucaaua

SEQ ID NO: 852843 - RNA, 19 nt, Homo sapiens
gcgcuugaguuaacaugug

SEQ ID NO: 852844 - RNA, 19 nt, Homo sapiens
gugcauagcuacuaaaauc

SEQ ID NO: 852845 - RNA, 19 nt, Homo sapiens
ccuuacuucucacuaauuu

SEQ ID NO: 852846 - RNA, 19 nt, Homo sapiens
agaaagaguacuucaucua

SEQ ID NO: 852847 - RNA, 19 nt, Homo sapiens
aaagaaagaguacuucauc

SEQ ID NO: 852848 - RNA, 19 nt, Homo sapiens
gguacauacuucacucaug

SEQ ID NO: 852849 - RNA, 19 nt, Homo sapiens
gaugacuuauccucuacaa

SEQ ID NO: 852850 - RNA, 19 nt, Homo sapiens
ucacugaaacgucuaggaa

SEQ ID NO: 852851 - RNA, 19 nt, Homo sapiens
acaaacgucucaauuucug

SEQ ID NO: 852852 - RNA, 19 nt, Homo sapiens
uaaaaucagugaccuugaa

SEQ ID NO: 852853 - RNA, 19 nt, Homo sapiens
ggucagagcagagguggaa

SEQ ID NO: 852854 - RNA, 19 nt, Homo sapiens
acagugauauuggaacuug

SEQ ID NO: 852855 - RNA, 19 nt, Homo sapiens
ggcccuauuuagaugauaa

SEQ ID NO: 852856 - RNA, 19 nt, Homo sapiens
ggcccaaccuguucaucaa

SEQ ID NO: 852857 - RNA, 19 nt, Homo sapiens
ggugagagucgaugaugaa

SEQ ID NO: 852858 - RNA, 19 nt, Homo sapiens
ucauuuagcauguuguuga

SEQ ID NO: 852859 - RNA, 19 nt, Homo sapiens
ugagaaucauuuagcaugu

SEQ ID NO: 852860 - RNA, 19 nt, Homo sapiens
aaagaacacuggagaaaua

SEQ ID NO: 852861 - RNA, 19 nt, Homo sapiens
ggagaaauaugaaagagaa

SEQ ID NO: 852862 - RNA, 19 nt, Homo sapiens
gaaagaacacguaaaugua

SEQ ID NO: 852863 - RNA, 19 nt, Homo sapiens
ggaaauggcccuagaagaa

SEQ ID NO: 852864 - RNA, 19 nt, Homo sapiens
gaagggaauugaagaagaa

SEQ ID NO: 852865 - RNA, 19 nt, Homo sapiens
gaaacaagaucaaguaugc

SEQ ID NO: 852866 - RNA, 19 nt, Homo sapiens
gagaaggacuaagcaauuu

SEQ ID NO: 852867 - RNA, 19 nt, Homo sapiens
cgagagauaugaagaaugu

SEQ ID NO: 852868 - RNA, 19 nt, Homo sapiens
ggaauacuuucugaugaua

SEQ ID NO: 852869 - RNA, 19 nt, Homo sapiens
guaauugccuacaguaaug

SEQ ID NO: 852870 - RNA, 19 nt, Homo sapiens
ggacugaccggagcaaaua

SEQ ID NO: 852871 - RNA, 19 nt, Homo sapiens
uuaaagagcagucagauuu

SEQ ID NO: 852872 - RNA, 19 nt, Homo sapiens
ggucaucucugccaggaaa

SEQ ID NO: 852873 - RNA, 19 nt, Homo sapiens
gaaaguggccaggaaauga

SEQ ID NO: 852874 - RNA, 19 nt, Homo sapiens
guaauagcuuuguaaguga

SEQ ID NO: 852875 - RNA, 19 nt, Homo sapiens
guugagaucuguuauguca

SEQ ID NO: 852876 - RNA, 19 nt, Homo sapiens
guggauaaguacaaagaua

SEQ ID NO: 852877 - RNA, 19 nt, Homo sapiens
acacguaaauguaguauuc

SEQ ID NO: 852878 - RNA, 19 nt, Homo sapiens
gaggagaauugacagcaaa

SEQ ID NO: 852879 - RNA, 19 nt, Homo sapiens
agagaaaccugguauuugu

SEQ ID NO: 852880 - RNA, 19 nt, Homo sapiens
gaacacuggagaaauauga

SEQ ID NO: 852881 - RNA, 19 nt, Homo sapiens
gcacugugguccugggaaa

SEQ ID NO: 852882 - RNA, 19 nt, Homo sapiens
gaagaaaguggccaggaaa

SEQ ID NO: 852883 - RNA, 19 nt, Homo sapiens
ggagcacaguaaagaagua

SEQ ID NO: 852884 - RNA, 19 nt, Homo sapiens
ggacguaauugccuacagu

SEQ ID NO: 852885 - RNA, 19 nt, Homo sapiens
caaguuuccuuccucugua

SEQ ID NO: 852886 - RNA, 19 nt, Homo sapiens
gaauuuacccucaaguuuc

SEQ ID NO: 852887 - RNA, 19 nt, Homo sapiens
gagcacaaauccaucaucu

SEQ ID NO: 852888 - RNA, 19 nt, Homo sapiens
uacacuggauuaccauuua

SEQ ID NO: 852889 - RNA, 19 nt, Homo sapiens
aaaguaggcuucaguccaa

SEQ ID NO: 852890 - RNA, 19 nt, Homo sapiens
gaaagagaagcuaaggaaa

SEQ ID NO: 852891 - RNA, 19 nt, Homo sapiens
aguaauagcuuuguaagug

SEQ ID NO: 852892 - RNA, 19 nt, Homo sapiens
ugaaauuggucccagagaa

SEQ ID NO: 852893 - RNA, 19 nt, Homo sapiens
caagcacaauguagaaguu

SEQ ID NO: 852894 - RNA, 19 nt, Homo sapiens
gguaagaccauugcaauug

SEQ ID NO: 852895 - RNA, 19 nt, Homo sapiens
ugaagggaauugaagaaga

SEQ ID NO: 852896 - RNA, 19 nt, Homo sapiens
caaacaagcacaauguaga

SEQ ID NO: 852897 - RNA, 19 nt, Homo sapiens
gaaacagaaaggaaacauu

SEQ ID NO: 852898 - RNA, 19 nt, Homo sapiens
cgaagugggucgugccuau

SEQ ID NO: 852899 - RNA, 19 nt, Homo sapiens
agaaagaacacguaaaugu

SEQ ID NO: 852900 - RNA, 19 nt, Homo sapiens
gaaauggcccuagaagaau

SEQ ID NO: 852901 - RNA, 19 nt, Homo sapiens
guucagauagugauuauug

SEQ ID NO: 852902 - RNA, 19 nt, Homo sapiens
gaccggagcaaauauuaaa

SEQ ID NO: 852903 - RNA, 19 nt, Homo sapiens
ugaaagagaagcuaaggaa

SEQ ID NO: 852904 - RNA, 19 nt, Homo sapiens
uaagugauguggacguaau

SEQ ID NO: 852905 - RNA, 19 nt, Homo sapiens
agagaaauuucacagcaaa

SEQ ID NO: 852906 - RNA, 19 nt, Homo sapiens
ggacgcacguuugauguuc

SEQ ID NO: 852907 - RNA, 19 nt, Homo sapiens
agaagaaaguggccaggaa

SEQ ID NO: 852908 - RNA, 19 nt, Homo sapiens
guaagaccauugcaauugg

SEQ ID NO: 852909 - RNA, 19 nt, Homo sapiens
ugaauuuacccucaaguuu

SEQ ID NO: 852910 - RNA, 19 nt, Homo sapiens
gaaauuggucccagagaag

SEQ ID NO: 852911 - RNA, 19 nt, Homo sapiens
ucgagacguucaaagauuu

SEQ ID NO: 852912 - RNA, 19 nt, Homo sapiens
caagaucaaguaugcauug

SEQ ID NO: 852913 - RNA, 19 nt, Homo sapiens
gccguaagcucaacgucaa

SEQ ID NO: 852914 - RNA, 19 nt, Homo sapiens
gaaaaguucugaaauuggu

SEQ ID NO: 852915 - RNA, 19 nt, Homo sapiens
cacguuugauguucagaua

SEQ ID NO: 852916 - RNA, 19 nt, Homo sapiens
gaugaucccacaguaaauu

SEQ ID NO: 852917 - RNA, 19 nt, Homo sapiens
ucuguuaugucacugauga

SEQ ID NO: 852918 - RNA, 19 nt, Homo sapiens
acaaagauaugggcacugu

SEQ ID NO: 852919 - RNA, 19 nt, Homo sapiens
ggacagacaagagaacaug

SEQ ID NO: 852920 - RNA, 19 nt, Homo sapiens
uguagacgcuggcaaguca

SEQ ID NO: 852921 - RNA, 19 nt, Homo sapiens
caccuacucuuauuuacug

SEQ ID NO: 852922 - RNA, 19 nt, Homo sapiens
ggacuaagcaauuuucuug

SEQ ID NO: 852923 - RNA, 19 nt, Homo sapiens
aaacaagcacaauguagaa

SEQ ID NO: 852924 - RNA, 19 nt, Homo sapiens
gccagcagcucgugaugau

SEQ ID NO: 852925 - RNA, 19 nt, Homo sapiens
guacacuggauuaccauuu

SEQ ID NO: 852926 - RNA, 19 nt, Homo sapiens
ugacuggaaugguugacaa

SEQ ID NO: 852927 - RNA, 19 nt, Homo sapiens
agagaaggacuaagcaauu

SEQ ID NO: 852928 - RNA, 19 nt, Homo sapiens
cuuccaggauucauacuuu

SEQ ID NO: 852929 - RNA, 19 nt, Homo sapiens
acagagaaaccugguauuu

SEQ ID NO: 852930 - RNA, 19 nt, Homo sapiens
caccaccuacucuuauuua

SEQ ID NO: 852931 - RNA, 19 nt, Homo sapiens
gauguucagauagugauua

SEQ ID NO: 852932 - RNA, 19 nt, Homo sapiens
cuaguaaccucugccauuc

SEQ ID NO: 852933 - RNA, 19 nt, Homo sapiens
gagcaucgagagauaugaa

SEQ ID NO: 852934 - RNA, 19 nt, Homo sapiens
uucagaaccuguuguagaa

SEQ ID NO: 852935 - RNA, 19 nt, Homo sapiens
cgugaaacaagaucaagua

SEQ ID NO: 852936 - RNA, 19 nt, Homo sapiens
cagagaaaccugguauuug

SEQ ID NO: 852937 - RNA, 19 nt, Homo sapiens
aaacagagaaaccugguau

SEQ ID NO: 852938 - RNA, 19 nt, Homo sapiens
gacaauaucaguaauagcu

SEQ ID NO: 852939 - RNA, 19 nt, Homo sapiens
caagauacugugaggagaa

SEQ ID NO: 852940 - RNA, 19 nt, Homo sapiens
ugaggaaguugagauaaca

SEQ ID NO: 852941 - RNA, 19 nt, Homo sapiens
aaagaacacguaaauguag

SEQ ID NO: 852942 - RNA, 19 nt, Homo sapiens
gcacaguaaagaaguaagu

SEQ ID NO: 852943 - RNA, 19 nt, Homo sapiens
ugucagcuuucucauguug

SEQ ID NO: 852944 - RNA, 19 nt, Homo sapiens
gaacuuucagaaccuguug

SEQ ID NO: 852945 - RNA, 19 nt, Homo sapiens
ccuaguaaccucugccauu

SEQ ID NO: 852946 - RNA, 19 nt, Homo sapiens
gaugauacugaaacugauu

SEQ ID NO: 852947 - RNA, 19 nt, Homo sapiens
ggauaaguacaaagauaug

SEQ ID NO: 852948 - RNA, 19 nt, Homo sapiens
ugccaauuguggauaagua

SEQ ID NO: 852949 - RNA, 19 nt, Homo sapiens
gacugccaauuguggauaa

SEQ ID NO: 852950 - RNA, 19 nt, Homo sapiens
cuuauuuacugcccauuga

SEQ ID NO: 852951 - RNA, 19 nt, Homo sapiens
gauacugugaggagaauug

SEQ ID NO: 852952 - RNA, 19 nt, Homo sapiens
aguaugcauugcucguuua

SEQ ID NO: 852953 - RNA, 19 nt, Homo sapiens
aaucaugggagcacaguaa

SEQ ID NO: 852954 - RNA, 19 nt, Homo sapiens
ccaagcccuucgugccuaa

SEQ ID NO: 852955 - RNA, 19 nt, Homo sapiens
gaucuguuaugucacugau

SEQ ID NO: 852956 - RNA, 19 nt, Homo sapiens
ugaggagaauugacagcaa

SEQ ID NO: 852957 - RNA, 19 nt, Homo sapiens
uaagaccauugcaauugga

SEQ ID NO: 852958 - RNA, 19 nt, Homo sapiens
caggauucauacuuuguga

SEQ ID NO: 852959 - RNA, 19 nt, Homo sapiens
uggaauacuuucugaugau

SEQ ID NO: 852960 - RNA, 19 nt, Homo sapiens
gaagacaucuagaaacauu

SEQ ID NO: 852961 - RNA, 19 nt, Homo sapiens
gcacaggaaugcuacauga

SEQ ID NO: 852962 - RNA, 19 nt, Homo sapiens
gaauugcacucagacauga

SEQ ID NO: 852963 - RNA, 19 nt, Homo sapiens
ggacguuucugcagcuauu

SEQ ID NO: 852964 - RNA, 19 nt, Homo sapiens
ggaaaugugugugucaguu

SEQ ID NO: 852965 - RNA, 19 nt, Homo sapiens
gacaugacauuucaauuca

SEQ ID NO: 852966 - RNA, 19 nt, Homo sapiens
uaauaagucucaggcauuu

SEQ ID NO: 852967 - RNA, 19 nt, Homo sapiens
acagggaucucuuaccuuu

SEQ ID NO: 852968 - RNA, 19 nt, Homo sapiens
ugaaggugguugugauuaa

SEQ ID NO: 852969 - RNA, 19 nt, Homo sapiens
gugaagacaucuagaaaca

SEQ ID NO: 852970 - RNA, 19 nt, Homo sapiens
gacagaaggugaagacauc

SEQ ID NO: 852971 - RNA, 19 nt, Homo sapiens
gacaacaacccagaaauuu

SEQ ID NO: 852972 - RNA, 19 nt, Homo sapiens
gaagagaauccaccugaga

SEQ ID NO: 852973 - RNA, 19 nt, Homo sapiens
aaagagacccacuguaauu

SEQ ID NO: 852974 - RNA, 19 nt, Homo sapiens
gaaaagauccggaagaaau

SEQ ID NO: 852975 - RNA, 19 nt, Homo sapiens
gcaaguaugaaguaaggua

SEQ ID NO: 852976 - RNA, 19 nt, Homo sapiens
caaaagagacccacuguaa

SEQ ID NO: 852977 - RNA, 19 nt, Homo sapiens
ccacugcagcugcuaguua

SEQ ID NO: 852978 - RNA, 19 nt, Homo sapiens
cuuagcaucuccucuagua

SEQ ID NO: 852979 - RNA, 19 nt, Homo sapiens
caacaacccagaaauuuag

SEQ ID NO: 852980 - RNA, 19 nt, Homo sapiens
acaacaacccagaaauuua

SEQ ID NO: 852981 - RNA, 19 nt, Homo sapiens
gcauuaaacuggaauugac

SEQ ID NO: 852982 - RNA, 19 nt, Homo sapiens
caauucaucucugcuaaug

SEQ ID NO: 852983 - RNA, 19 nt, Homo sapiens
ucucaggcauuuccaauug

SEQ ID NO: 852984 - RNA, 19 nt, Homo sapiens
gcaugaaggugguugugau

SEQ ID NO: 852985 - RNA, 19 nt, Homo sapiens
ggaauugacaagaguguug

SEQ ID NO: 852986 - RNA, 19 nt, Homo sapiens
gucaggagguggacaaguu

SEQ ID NO: 852987 - RNA, 19 nt, Homo sapiens
gagaaaagauccggaagaa

SEQ ID NO: 852988 - RNA, 19 nt, Homo sapiens
gcacucagacaugacauuu

SEQ ID NO: 852989 - RNA, 19 nt, Homo sapiens
cugcuucccuccuugguua

SEQ ID NO: 852990 - RNA, 19 nt, Homo sapiens
ggaagacuauuuucuguau

SEQ ID NO: 852991 - RNA, 19 nt, Homo sapiens
ggaauugcacucagacaug

SEQ ID NO: 852992 - RNA, 19 nt, Homo sapiens
gggcaaguaugaaguaagg

SEQ ID NO: 852993 - RNA, 19 nt, Homo sapiens
gagcaucccugucuaaccu

SEQ ID NO: 852994 - RNA, 19 nt, Homo sapiens
gcccugcggugcaucauga

SEQ ID NO: 852995 - RNA, 19 nt, Homo sapiens
agacaacaacccagaaauu

SEQ ID NO: 852996 - RNA, 19 nt, Homo sapiens
ccacuguaauugaugcauu

SEQ ID NO: 852997 - RNA, 19 nt, Homo sapiens
ggccaguucuacuucuuaa

SEQ ID NO: 852998 - RNA, 19 nt, Homo sapiens
agacaugacauuucaauuc

SEQ ID NO: 852999 - RNA, 19 nt, Homo sapiens
gaaggugguugugauuaag

SEQ ID NO: 853000 - RNA, 19 nt, Homo sapiens
cuagugcccucugaccuua

SEQ ID NO: 853001 - RNA, 19 nt, Homo sapiens
ucaggcauuuccaauugua

SEQ ID NO: 853002 - RNA, 19 nt, Homo sapiens
acucagacaugacauuuca

SEQ ID NO: 853003 - RNA, 19 nt, Homo sapiens
aaacuggaauugacaagag

SEQ ID NO: 853004 - RNA, 19 nt, Homo sapiens
ucaugaaguuccaguacaa

SEQ ID NO: 853005 - RNA, 19 nt, Homo sapiens
gcuguuggauuggcuuuga

SEQ ID NO: 853006 - RNA, 19 nt, Homo sapiens
gagagugucuaugggaaau

SEQ ID NO: 853007 - RNA, 19 nt, Homo sapiens
gagugucuaugggaaauga

SEQ ID NO: 853008 - RNA, 19 nt, Homo sapiens
ugaggacaaucaugaggaa

SEQ ID NO: 853009 - RNA, 19 nt, Homo sapiens
uagcaucuccucuaguauu

SEQ ID NO: 853010 - RNA, 19 nt, Homo sapiens
ggaccaucccuuugaguau

SEQ ID NO: 853011 - RNA, 19 nt, Homo sapiens
gagacccacuguaauugau

SEQ ID NO: 853012 - RNA, 19 nt, Homo sapiens
gaccugaggacgccuuauu

SEQ ID NO: 853013 - RNA, 19 nt, Homo sapiens
gaaaugugugugucaguuc

SEQ ID NO: 853014 - RNA, 19 nt, Homo sapiens
ugacaagaguguugagcau

SEQ ID NO: 853015 - RNA, 19 nt, Homo sapiens
guagacaacaacccagaaa

SEQ ID NO: 853016 - RNA, 19 nt, Homo sapiens
ucacucagacaucacagua

SEQ ID NO: 853017 - RNA, 19 nt, Homo sapiens
gaggacgccuuauucuucu

SEQ ID NO: 853018 - RNA, 19 nt, Homo sapiens
caaguaugaaguaagguaa

SEQ ID NO: 853019 - RNA, 19 nt, Homo sapiens
ugucuaaccugcucuuucu

SEQ ID NO: 853020 - RNA, 19 nt, Homo sapiens
gaccaucccuuugaguauc

SEQ ID NO: 853021 - RNA, 19 nt, Homo sapiens
gaugggagcaccuggacuu

SEQ ID NO: 853022 - RNA, 19 nt, Homo sapiens
ugaggacgccuuauucuuc

SEQ ID NO: 853023 - RNA, 19 nt, Homo sapiens
ggacgccuuauucuucuuu

SEQ ID NO: 853024 - RNA, 19 nt, Homo sapiens
ggaggaccaucccuuugag

SEQ ID NO: 853025 - RNA, 19 nt, Homo sapiens
gaauggggaugauguaagu

SEQ ID NO: 853026 - RNA, 19 nt, Homo sapiens
cucacaagcucuagcgaaa

SEQ ID NO: 853027 - RNA, 19 nt, Homo sapiens
gcugcuaguuagaaagguu

SEQ ID NO: 853028 - RNA, 19 nt, Homo sapiens
uuaauaagucucaggcauu

SEQ ID NO: 853029 - RNA, 19 nt, Homo sapiens
uaaccugcucuuucucuuu

SEQ ID NO: 853030 - RNA, 19 nt, Homo sapiens
ggaaaggggacuuguggua

SEQ ID NO: 853031 - RNA, 19 nt, Homo sapiens
aaccugcucuuucucuuug

SEQ ID NO: 853032 - RNA, 19 nt, Homo sapiens
caagaggaaguaccuagug

SEQ ID NO: 853033 - RNA, 19 nt, Homo sapiens
caucaggccaaggaaauaa

SEQ ID NO: 853034 - RNA, 19 nt, Homo sapiens
gaauugacaagaguguuga

SEQ ID NO: 853035 - RNA, 19 nt, Homo sapiens
caagacagguagggaaagg

SEQ ID NO: 853036 - RNA, 19 nt, Homo sapiens
guugugcaguuucauagau

SEQ ID NO: 853037 - RNA, 19 nt, Homo sapiens
ggacaaucaugaggaagac

SEQ ID NO: 853038 - RNA, 19 nt, Homo sapiens
ggagggaugacuuuuagua

SEQ ID NO: 853039 - RNA, 19 nt, Homo sapiens
caaucucacucagacauca

SEQ ID NO: 853040 - RNA, 19 nt, Homo sapiens
gaggaagacuauuuucugu

SEQ ID NO: 853041 - RNA, 19 nt, Homo sapiens
guucuuguauaaugaaguc

SEQ ID NO: 853042 - RNA, 19 nt, Homo sapiens
agacagggaucucuuaccu

SEQ ID NO: 853043 - RNA, 19 nt, Homo sapiens
uaauuguugugcaguuuca

SEQ ID NO: 853044 - RNA, 19 nt, Homo sapiens
uucacaugcucaauugaua

SEQ ID NO: 853045 - RNA, 19 nt, Homo sapiens
ccaguucuacuucuuaauc

SEQ ID NO: 853046 - RNA, 19 nt, Homo sapiens
caaggagacagaaggugaa

SEQ ID NO: 853047 - RNA, 19 nt, Homo sapiens
ggacaagaggaaguaccua

SEQ ID NO: 853048 - RNA, 19 nt, Homo sapiens
cacuguaauugaugcauug

SEQ ID NO: 853049 - RNA, 19 nt, Homo sapiens
ccugugcucccuucucuuu

SEQ ID NO: 853050 - RNA, 19 nt, Homo sapiens
cacacaccgucaucacauu

SEQ ID NO: 853051 - RNA, 19 nt, Homo sapiens
ccaucuggcucuccucuac

SEQ ID NO: 853052 - RNA, 19 nt, Homo sapiens
ggagacagaaggugaagac

SEQ ID NO: 853053 - RNA, 19 nt, Homo sapiens
uauguggccuacagugaug

SEQ ID NO: 853054 - RNA, 19 nt, Homo sapiens
cauuuccaauuguagacua

SEQ ID NO: 853055 - RNA, 19 nt, Homo sapiens
ucacaugcucaauugauau

SEQ ID NO: 853056 - RNA, 19 nt, Homo sapiens
gaaggugaagacaucuaga

SEQ ID NO: 853057 - RNA, 19 nt, Homo sapiens
gugaugagagugucuaugg

SEQ ID NO: 853058 - RNA, 19 nt, Homo sapiens
ccaacuguaugaggacaau

SEQ ID NO: 853059 - RNA, 19 nt, Homo sapiens
gugauuaagaagaugguuu

SEQ ID NO: 853060 - RNA, 19 nt, Homo sapiens
gaacuuaccuucagaacau

SEQ ID NO: 853061 - RNA, 19 nt, Homo sapiens
ggagacaccucaaccagaa

SEQ ID NO: 853062 - RNA, 19 nt, Homo sapiens
gcaaccaucuucuggcuuu

SEQ ID NO: 853063 - RNA, 19 nt, Homo sapiens
gcaaaugccugaucacucu

SEQ ID NO: 853064 - RNA, 19 nt, Homo sapiens
gagagcagaucaaugugua

SEQ ID NO: 853065 - RNA, 19 nt, Homo sapiens
gggcagaacuucccacaug

SEQ ID NO: 853066 - RNA, 19 nt, Homo sapiens
ggagugcgcuguccaggaa

SEQ ID NO: 853067 - RNA, 19 nt, Homo sapiens
gagcugagaucgcgccauu

SEQ ID NO: 853068 - RNA, 19 nt, Homo sapiens
gcaaugugcuggccacguu

SEQ ID NO: 853069 - RNA, 19 nt, Homo sapiens
gaugcuggcuguucggaua

SEQ ID NO: 853070 - RNA, 19 nt, Homo sapiens
gcagguaguuuauucaaag

SEQ ID NO: 853071 - RNA, 19 nt, Homo sapiens
gaacauacucuaauaaugc

SEQ ID NO: 853072 - RNA, 19 nt, Homo sapiens
gcagaaacauccauuugag

SEQ ID NO: 853073 - RNA, 19 nt, Homo sapiens
caaccacggucugacaaua

SEQ ID NO: 853074 - RNA, 19 nt, Homo sapiens
ucuggaagcucuaagauga

SEQ ID NO: 853075 - RNA, 19 nt, Homo sapiens
gaaggcagguugcgagaag

SEQ ID NO: 853076 - RNA, 19 nt, Homo sapiens
gacucugucucauaaauaa

SEQ ID NO: 853077 - RNA, 19 nt, Homo sapiens
ccaaacgacugcugugaau

SEQ ID NO: 853078 - RNA, 19 nt, Homo sapiens
agccaaagcuggaacguaa

SEQ ID NO: 853079 - RNA, 19 nt, Homo sapiens
ggccaaaugucagauacua

SEQ ID NO: 853080 - RNA, 19 nt, Homo sapiens
gagagcaaaugccugauca

SEQ ID NO: 853081 - RNA, 19 nt, Homo sapiens
gcagaucaauguguacuuc

SEQ ID NO: 853082 - RNA, 19 nt, Homo sapiens
ccugggagcuauuuacaaa

SEQ ID NO: 853083 - RNA, 19 nt, Homo sapiens
ggaguggccuugggugauu

SEQ ID NO: 853084 - RNA, 19 nt, Homo sapiens
aaacgacugcugugaauuu

SEQ ID NO: 853085 - RNA, 19 nt, Homo sapiens
ccaaaugucagauacuaaa

SEQ ID NO: 853086 - RNA, 19 nt, Homo sapiens
guuguaagccuucuuguga

SEQ ID NO: 853087 - RNA, 19 nt, Homo sapiens
ucagccagaucccaaauga

SEQ ID NO: 853088 - RNA, 19 nt, Homo sapiens
ugaaauaucgcccagaguu

SEQ ID NO: 853089 - RNA, 19 nt, Homo sapiens
gaaacauccauuugaguug

SEQ ID NO: 853090 - RNA, 19 nt, Homo sapiens
gguaguuuauucaaagaga

SEQ ID NO: 853091 - RNA, 19 nt, Homo sapiens
acagagagcagaucaaugu

SEQ ID NO: 853092 - RNA, 19 nt, Homo sapiens
ggagagagagagcaugaga

SEQ ID NO: 853093 - RNA, 19 nt, Homo sapiens
ccaagaacuuaccuucaga

SEQ ID NO: 853094 - RNA, 19 nt, Homo sapiens
ggucugacaauauuaaaug

SEQ ID NO: 853095 - RNA, 19 nt, Homo sapiens
uccagagucuugugccuua

SEQ ID NO: 853096 - RNA, 19 nt, Homo sapiens
gcuccuggcucagcagaaa

SEQ ID NO: 853097 - RNA, 19 nt, Homo sapiens
ucaaccagaaggaaucuua

SEQ ID NO: 853098 - RNA, 19 nt, Homo sapiens
ugaagaauccacuguguau

SEQ ID NO: 853099 - RNA, 19 nt, Homo sapiens
cagaguuccugaaguccua

SEQ ID NO: 853100 - RNA, 19 nt, Homo sapiens
gccaagaacuuaccuucag

SEQ ID NO: 853101 - RNA, 19 nt, Homo sapiens
gcccagaguuccugaaguc

SEQ ID NO: 853102 - RNA, 19 nt, Homo sapiens
gaaauaucgcccagaguuc

SEQ ID NO: 853103 - RNA, 19 nt, Homo sapiens
ggaaaauucuucaaacagu

SEQ ID NO: 853104 - RNA, 19 nt, Homo sapiens
caucugugguucaccugua

SEQ ID NO: 853105 - RNA, 19 nt, Homo sapiens
ggacagaugcaguucucaa

SEQ ID NO: 853106 - RNA, 19 nt, Homo sapiens
gugcuuccuuuaagugaaa

SEQ ID NO: 853107 - RNA, 19 nt, Homo sapiens
gaggacagaugcaguucuc

SEQ ID NO: 853108 - RNA, 19 nt, Homo sapiens
gcagugugauggagagucu

SEQ ID NO: 853109 - RNA, 19 nt, Homo sapiens
ggccaaggcugugaaugga

SEQ ID NO: 853110 - RNA, 19 nt, Homo sapiens
gcaaaccgucccuguguuc

SEQ ID NO: 853111 - RNA, 19 nt, Homo sapiens
gagcuugguuugggagguu

SEQ ID NO: 853112 - RNA, 19 nt, Homo sapiens
cagcagaaacauccauuug

SEQ ID NO: 853113 - RNA, 19 nt, Homo sapiens
ggcagguaguuuauucaaa

SEQ ID NO: 853114 - RNA, 19 nt, Homo sapiens
ccaaagcaccagaguagug

SEQ ID NO: 853115 - RNA, 19 nt, Homo sapiens
guucggauaugccaaagag

SEQ ID NO: 853116 - RNA, 19 nt, Homo sapiens
gcgaauuccuggccucucu

SEQ ID NO: 853117 - RNA, 19 nt, Homo sapiens
uguaagccuucuugugauu

SEQ ID NO: 853118 - RNA, 19 nt, Homo sapiens
agaaacauccauuugaguu

SEQ ID NO: 853119 - RNA, 19 nt, Homo sapiens
guacuucagacaccagaaa

SEQ ID NO: 853120 - RNA, 19 nt, Homo sapiens
guugaagaauccacugugu

SEQ ID NO: 853121 - RNA, 19 nt, Homo sapiens
cagccgaagucucaucuca

SEQ ID NO: 853122 - RNA, 19 nt, Homo sapiens
caaagcaccagaguaguga

SEQ ID NO: 853123 - RNA, 19 nt, Homo sapiens
gcagucguauucucucucu

SEQ ID NO: 853124 - RNA, 19 nt, Homo sapiens
gccgaggcauuguucagaa

SEQ ID NO: 853125 - RNA, 19 nt, Homo sapiens
gccgaagucucaucucagu

SEQ ID NO: 853126 - RNA, 19 nt, Homo sapiens
gaagaauccacuguguauu

SEQ ID NO: 853127 - RNA, 19 nt, Homo sapiens
gagcaggaugugaguagaa

SEQ ID NO: 853128 - RNA, 19 nt, Homo sapiens
ggaagcagucguauucucu

SEQ ID NO: 853129 - RNA, 19 nt, Homo sapiens
augagugccuuccgaaauu

SEQ ID NO: 853130 - RNA, 19 nt, Homo sapiens
gaaccugcacuccaugcuu

SEQ ID NO: 853131 - RNA, 19 nt, Homo sapiens
cuucuagacucccaaagga

SEQ ID NO: 853132 - RNA, 19 nt, Homo sapiens
ggagcaggaugugaguaga

SEQ ID NO: 853133 - RNA, 19 nt, Homo sapiens
gaagaaaacagucauaugc

SEQ ID NO: 853134 - RNA, 19 nt, Homo sapiens
gugaaaagaugggaagaaa

SEQ ID NO: 853135 - RNA, 19 nt, Homo sapiens
gagaaaccguaaggugcuu

SEQ ID NO: 853136 - RNA, 19 nt, Homo sapiens
ugaucacucuggccaaaug

SEQ ID NO: 853137 - RNA, 19 nt, Homo sapiens
cagaugcaguucucaacau

SEQ ID NO: 853138 - RNA, 19 nt, Homo sapiens
ggcagaacuucccacaugu

SEQ ID NO: 853139 - RNA, 19 nt, Homo sapiens
guagugaugcugguaguga

SEQ ID NO: 853140 - RNA, 19 nt, Homo sapiens
gggaagcagucguauucuc

SEQ ID NO: 853141 - RNA, 19 nt, Homo sapiens
gcagcaggcaggcucagaa

SEQ ID NO: 853142 - RNA, 19 nt, Homo sapiens
gaucaauguguacuucaga

SEQ ID NO: 853143 - RNA, 19 nt, Homo sapiens
caucucggccaagaacuua

SEQ ID NO: 853144 - RNA, 19 nt, Homo sapiens
gggcagcucuggucaugcu

SEQ ID NO: 853145 - RNA, 19 nt, Homo sapiens
cguagaucauccucagaaa

SEQ ID NO: 853146 - RNA, 19 nt, Homo sapiens
auacuaaagcccauucuug

SEQ ID NO: 853147 - RNA, 19 nt, Homo sapiens
cgaagucucaucucagugu

SEQ ID NO: 853148 - RNA, 19 nt, Homo sapiens
ccagaggacagaugcaguu

SEQ ID NO: 853149 - RNA, 19 nt, Homo sapiens
gagccaaagcuggaacgua

SEQ ID NO: 853150 - RNA, 19 nt, Homo sapiens
acagucauaugcugaaucu

SEQ ID NO: 853151 - RNA, 19 nt, Homo sapiens
gaaaagaugggaagaaaac

SEQ ID NO: 853152 - RNA, 19 nt, Homo sapiens
ccaaagagaaaccguaagg

SEQ ID NO: 853153 - RNA, 19 nt, Homo sapiens
gcauuguucugagcagugu

SEQ ID NO: 853154 - RNA, 19 nt, Homo sapiens
agucuugugccuuaaauaa

SEQ ID NO: 853155 - RNA, 19 nt, Homo sapiens
cagguaguuuauucaaaga

SEQ ID NO: 853156 - RNA, 19 nt, Homo sapiens
gagcaugagagcacaguag

SEQ ID NO: 853157 - RNA, 19 nt, Homo sapiens
caagaacuuaccuucagaa

SEQ ID NO: 853158 - RNA, 19 nt, Homo sapiens
gccuggagguugaagaauc

SEQ ID NO: 853159 - RNA, 19 nt, Homo sapiens
gccuugcccugguguucua

SEQ ID NO: 853160 - RNA, 19 nt, Homo sapiens
gcaauacucugauuuguua

SEQ ID NO: 853161 - RNA, 19 nt, Homo sapiens
ggacagcccuucucaauuu

SEQ ID NO: 853162 - RNA, 19 nt, Homo sapiens
gaacaauacugcuguaauu

SEQ ID NO: 853163 - RNA, 19 nt, Homo sapiens
caacagagaucaaguggua

SEQ ID NO: 853164 - RNA, 19 nt, Homo sapiens
gaagaaauccaacauguua

SEQ ID NO: 853165 - RNA, 19 nt, Homo sapiens
cagcauaaauuccauguua

SEQ ID NO: 853166 - RNA, 19 nt, Homo sapiens
gcacaugacucuaaaugaa

SEQ ID NO: 853167 - RNA, 19 nt, Homo sapiens
guacagaacuuggucauaa

SEQ ID NO: 853168 - RNA, 19 nt, Homo sapiens
gcucaagucucaaagauaa

SEQ ID NO: 853169 - RNA, 19 nt, Homo sapiens
caaauacaguggugauaua

SEQ ID NO: 853170 - RNA, 19 nt, Homo sapiens
cuagacaucugguuucuua

SEQ ID NO: 853171 - RNA, 19 nt, Homo sapiens
cuaaaucgcuugcagauga

SEQ ID NO: 853172 - RNA, 19 nt, Homo sapiens
gcauacagaucucuuuauu

SEQ ID NO: 853173 - RNA, 19 nt, Homo sapiens
gauaggaacucuucuuuua

SEQ ID NO: 853174 - RNA, 19 nt, Homo sapiens
caagagauguuaauagaug

SEQ ID NO: 853175 - RNA, 19 nt, Homo sapiens
uaaacuaccugcuguuaaa

SEQ ID NO: 853176 - RNA, 19 nt, Homo sapiens
aaacacagcuugagaguuc

SEQ ID NO: 853177 - RNA, 19 nt, Homo sapiens
gagauaaggugaacaauac

SEQ ID NO: 853178 - RNA, 19 nt, Homo sapiens
gaagacuuguccuauagua

SEQ ID NO: 853179 - RNA, 19 nt, Homo sapiens
gaagagggcuuucacuuuu

SEQ ID NO: 853180 - RNA, 19 nt, Homo sapiens
ggagauaaggugaacaaua

SEQ ID NO: 853181 - RNA, 19 nt, Homo sapiens
ccagaaagcaaguauauuu

SEQ ID NO: 853182 - RNA, 19 nt, Homo sapiens
gagaagacaucccuaaugg

SEQ ID NO: 853183 - RNA, 19 nt, Homo sapiens
uagcagcagugauguaaua

SEQ ID NO: 853184 - RNA, 19 nt, Homo sapiens
ccuaagaagucacugauaa

SEQ ID NO: 853185 - RNA, 19 nt, Homo sapiens
gagaaacgcuaccaugugu

SEQ ID NO: 853186 - RNA, 19 nt, Homo sapiens
guauggcacuuuauaguuu

SEQ ID NO: 853187 - RNA, 19 nt, Homo sapiens
gaagacaucccuaauggaa

SEQ ID NO: 853188 - RNA, 19 nt, Homo sapiens
ggagaucacucauaagaag

SEQ ID NO: 853189 - RNA, 19 nt, Homo sapiens
ggaguagacugcauacaga

SEQ ID NO: 853190 - RNA, 19 nt, Homo sapiens
caacuaaugugcaaauaca

SEQ ID NO: 853191 - RNA, 19 nt, Homo sapiens
gagaucaagugguaugaaa

SEQ ID NO: 853192 - RNA, 19 nt, Homo sapiens
ggaagagggcuuucacuuu

SEQ ID NO: 853193 - RNA, 19 nt, Homo sapiens
gaggaagguuuacagaauu

SEQ ID NO: 853194 - RNA, 19 nt, Homo sapiens
uggagaagauguuagauaa

SEQ ID NO: 853195 - RNA, 19 nt, Homo sapiens
ggaagcaaauccugauaau

SEQ ID NO: 853196 - RNA, 19 nt, Homo sapiens
gggaagaaauccaacaugu

SEQ ID NO: 853197 - RNA, 19 nt, Homo sapiens
guacguugaugaaguagaa

SEQ ID NO: 853198 - RNA, 19 nt, Homo sapiens
gaacagaccguacguugau

SEQ ID NO: 853199 - RNA, 19 nt, Homo sapiens
gcuauuccacugaguauua

SEQ ID NO: 853200 - RNA, 19 nt, Homo sapiens
cuaaggaaguucaaauuug

SEQ ID NO: 853201 - RNA, 19 nt, Homo sapiens
agaaagacccaaauucaua

SEQ ID NO: 853202 - RNA, 19 nt, Homo sapiens
caaaauggcuggcuucuau

SEQ ID NO: 853203 - RNA, 19 nt, Homo sapiens
gagaauggauaacucacaa

SEQ ID NO: 853204 - RNA, 19 nt, Homo sapiens
cuacugauguaacuucuuu

SEQ ID NO: 853205 - RNA, 19 nt, Homo sapiens
uggcagagcuuucccuuga

SEQ ID NO: 853206 - RNA, 19 nt, Homo sapiens
gaaagaagcauuccagcau

SEQ ID NO: 853207 - RNA, 19 nt, Homo sapiens
guagaagucauuucaguaa

SEQ ID NO: 853208 - RNA, 19 nt, Homo sapiens
agauguaacucucauugua

SEQ ID NO: 853209 - RNA, 19 nt, Homo sapiens
gaacaugcuauuacacauu

SEQ ID NO: 853210 - RNA, 19 nt, Homo sapiens
ccagagugcuucacagcua

SEQ ID NO: 853211 - RNA, 19 nt, Homo sapiens
gcuaaacucuagauucugu

SEQ ID NO: 853212 - RNA, 19 nt, Homo sapiens
cacaucagcuuucauauag

SEQ ID NO: 853213 - RNA, 19 nt, Homo sapiens
aaucucagguguagcaaua

SEQ ID NO: 853214 - RNA, 19 nt, Homo sapiens
ccagguccuucuucuaaua

SEQ ID NO: 853215 - RNA, 19 nt, Homo sapiens
uaaccuaccuuuacauucu

SEQ ID NO: 853216 - RNA, 19 nt, Homo sapiens
ugauugaagucacaaguaa

SEQ ID NO: 853217 - RNA, 19 nt, Homo sapiens
uuagguaacugaaguguau

SEQ ID NO: 853218 - RNA, 19 nt, Homo sapiens
cugaauggcagaucuauua

SEQ ID NO: 853219 - RNA, 19 nt, Homo sapiens
gaaugggacuucuaaaauu

SEQ ID NO: 853220 - RNA, 19 nt, Homo sapiens
gauguaauaucacccugaa

SEQ ID NO: 853221 - RNA, 19 nt, Homo sapiens
aaugaagacuuguccuaua

SEQ ID NO: 853222 - RNA, 19 nt, Homo sapiens
ucacaucagcuuucauaua

SEQ ID NO: 853223 - RNA, 19 nt, Homo sapiens
gcacaaaggacagaaguug

SEQ ID NO: 853224 - RNA, 19 nt, Homo sapiens
ugaggaagguuuacagaau

SEQ ID NO: 853225 - RNA, 19 nt, Homo sapiens
uagauuuggucacuaagua

SEQ ID NO: 853226 - RNA, 19 nt, Homo sapiens
uaaaacaucucccuaagaa

SEQ ID NO: 853227 - RNA, 19 nt, Homo sapiens
ccacuuugguuaucuaugu

SEQ ID NO: 853228 - RNA, 19 nt, Homo sapiens
uaagauggcuugaaaaguu

SEQ ID NO: 853229 - RNA, 19 nt, Homo sapiens
cuaacaacguguaucagua

SEQ ID NO: 853230 - RNA, 19 nt, Homo sapiens
gaaggaaugcugaguuugu

SEQ ID NO: 853231 - RNA, 19 nt, Homo sapiens
ucacagcuaugaucaggaa

SEQ ID NO: 853232 - RNA, 19 nt, Homo sapiens
guaauaucacccugaaaua

SEQ ID NO: 853233 - RNA, 19 nt, Homo sapiens
gcugaacccuuucuacugu

SEQ ID NO: 853234 - RNA, 19 nt, Homo sapiens
gcaaucaucgguccuauuc

SEQ ID NO: 853235 - RNA, 19 nt, Homo sapiens
gguccuucuucuaauauua

SEQ ID NO: 853236 - RNA, 19 nt, Homo sapiens
guuaugagccggaauguga

SEQ ID NO: 853237 - RNA, 19 nt, Homo sapiens
gauauuguuuccuuuguuc

SEQ ID NO: 853238 - RNA, 19 nt, Homo sapiens
ugagaaacauggcccuuga

SEQ ID NO: 853239 - RNA, 19 nt, Homo sapiens
gcucuuagccagaucauau

SEQ ID NO: 853240 - RNA, 19 nt, Homo sapiens
caucacaucagcuuucaua

SEQ ID NO: 853241 - RNA, 19 nt, Homo sapiens
gcauagugcuuuacauuuu

SEQ ID NO: 853242 - RNA, 19 nt, Homo sapiens
uaaauacccucuguucuca

SEQ ID NO: 853243 - RNA, 19 nt, Homo sapiens
auacaguggugauauauug

SEQ ID NO: 853244 - RNA, 19 nt, Homo sapiens
cagguaugcuccucucuuu

SEQ ID NO: 853245 - RNA, 19 nt, Homo sapiens
gaaggccucuugcucuuag

SEQ ID NO: 853246 - RNA, 19 nt, Homo sapiens
gaagucacaaguaauuuga

SEQ ID NO: 853247 - RNA, 19 nt, Homo sapiens
gaagaaaacuagugacauc

SEQ ID NO: 853248 - RNA, 19 nt, Homo sapiens
caagcaauacucagaaauu

SEQ ID NO: 853249 - RNA, 19 nt, Homo sapiens
ggaagaaauccaacauguu

SEQ ID NO: 853250 - RNA, 19 nt, Homo sapiens
gcauaaauaucagguucuu

SEQ ID NO: 853251 - RNA, 19 nt, Homo sapiens
gcacggugguguggcuaua

SEQ ID NO: 853252 - RNA, 19 nt, Homo sapiens
aaucuacucugacauauca

SEQ ID NO: 853253 - RNA, 19 nt, Homo sapiens
cuucauaccaucagcauua

SEQ ID NO: 853254 - RNA, 19 nt, Homo sapiens
ccagugaagugggugauaa

SEQ ID NO: 853255 - RNA, 19 nt, Homo sapiens
caagagaguguacacauga

SEQ ID NO: 853256 - RNA, 19 nt, Homo sapiens
gcaaauacaguggugauau

SEQ ID NO: 853257 - RNA, 19 nt, Homo sapiens
uccaagagauguuaauaga

SEQ ID NO: 853258 - RNA, 19 nt, Homo sapiens
ggacuuugagugugcauuu

SEQ ID NO: 853259 - RNA, 19 nt, Homo sapiens
uuaaagggcugcuaaaucg

SEQ ID NO: 853260 - RNA, 19 nt, Homo sapiens
guaguuagaugcuguuaaa

SEQ ID NO: 853261 - RNA, 19 nt, Homo sapiens
gaacucggcugugaugaga

SEQ ID NO: 853262 - RNA, 19 nt, Homo sapiens
gaacaguuauucuaucaac

SEQ ID NO: 853263 - RNA, 19 nt, Homo sapiens
ccaagagcaucugaaauuu

SEQ ID NO: 853264 - RNA, 19 nt, Homo sapiens
ggacugaaagcuuaagaaa

SEQ ID NO: 853265 - RNA, 19 nt, Homo sapiens
gugaugagauuauugauag

SEQ ID NO: 853266 - RNA, 19 nt, Homo sapiens
ggacccaacuuuccgcuau

SEQ ID NO: 853267 - RNA, 19 nt, Homo sapiens
gaaaacaaaccauugcuua

SEQ ID NO: 853268 - RNA, 19 nt, Homo sapiens
gguuucagaugcauuauga

SEQ ID NO: 853269 - RNA, 19 nt, Homo sapiens
gcaccagcauuggagauaa

SEQ ID NO: 853270 - RNA, 19 nt, Homo sapiens
gaacacaauaggacaguga

SEQ ID NO: 853271 - RNA, 19 nt, Homo sapiens
gaagaacucggcugugaug

SEQ ID NO: 853272 - RNA, 19 nt, Homo sapiens
ugaagaagccgacaagaug

SEQ ID NO: 853273 - RNA, 19 nt, Homo sapiens
ggacgagggcgaggaauuu

SEQ ID NO: 853274 - RNA, 19 nt, Homo sapiens
guacauguaucuugaucau

SEQ ID NO: 853275 - RNA, 19 nt, Homo sapiens
uauuuggacugaaagcuua

SEQ ID NO: 853276 - RNA, 19 nt, Homo sapiens
gaauaagucaugaccaaga

SEQ ID NO: 853277 - RNA, 19 nt, Homo sapiens
gaugaaggacuuuaguuga

SEQ ID NO: 853278 - RNA, 19 nt, Homo sapiens
cuaaaugugugugaaugua

SEQ ID NO: 853279 - RNA, 19 nt, Homo sapiens
ccacugugaucuauaaauc

SEQ ID NO: 853280 - RNA, 19 nt, Homo sapiens
ugaguuauuuggacugaaa

SEQ ID NO: 853281 - RNA, 19 nt, Homo sapiens
gauagagaguaguuagaug

SEQ ID NO: 853282 - RNA, 19 nt, Homo sapiens
ggaaacggagccuugcuaa

SEQ ID NO: 853283 - RNA, 19 nt, Homo sapiens
gcuguuauauacuagagaa

SEQ ID NO: 853284 - RNA, 19 nt, Homo sapiens
aagaauaagucaugaccaa

SEQ ID NO: 853285 - RNA, 19 nt, Homo sapiens
uaaagccacugugaucuau

SEQ ID NO: 853286 - RNA, 19 nt, Homo sapiens
uaagauguguuuccaagag

SEQ ID NO: 853287 - RNA, 19 nt, Homo sapiens
gacaaacugccaauacaaa

SEQ ID NO: 853288 - RNA, 19 nt, Homo sapiens
ggaggacgacuacgacuau

SEQ ID NO: 853289 - RNA, 19 nt, Homo sapiens
gcuuugacuuuguuauuga

SEQ ID NO: 853290 - RNA, 19 nt, Homo sapiens
uguccgagcuguaugaaga

SEQ ID NO: 853291 - RNA, 19 nt, Homo sapiens
ucaaucgucugaccgaaga

SEQ ID NO: 853292 - RNA, 19 nt, Homo sapiens
ucaguuagcuuuuaucgaa

SEQ ID NO: 853293 - RNA, 19 nt, Homo sapiens
gaagaagccgacaagaugu

SEQ ID NO: 853294 - RNA, 19 nt, Homo sapiens
aagccacugugaucuauaa

SEQ ID NO: 853295 - RNA, 19 nt, Homo sapiens
uccaagagcaucugaaauu

SEQ ID NO: 853296 - RNA, 19 nt, Homo sapiens
uaaaccugcccagaaauua

SEQ ID NO: 853297 - RNA, 19 nt, Homo sapiens
gaaaauccauugucauaac

SEQ ID NO: 853298 - RNA, 19 nt, Homo sapiens
uaacuugacagaugaagga

SEQ ID NO: 853299 - RNA, 19 nt, Homo sapiens
aaacaaaccauugcuuaug

SEQ ID NO: 853300 - RNA, 19 nt, Homo sapiens
uaucacgugugcuuuguau

SEQ ID NO: 853301 - RNA, 19 nt, Homo sapiens
ggacacauaucuuuugagu

SEQ ID NO: 853302 - RNA, 19 nt, Homo sapiens
ucagaugcauuaugagaag

SEQ ID NO: 853303 - RNA, 19 nt, Homo sapiens
gcccagaaauuaccuuggu

SEQ ID NO: 853304 - RNA, 19 nt, Homo sapiens
guuuguacauguaucuuga

SEQ ID NO: 853305 - RNA, 19 nt, Homo sapiens
caagacaaacugccaauac

SEQ ID NO: 853306 - RNA, 19 nt, Homo sapiens
gauuauugauagagaguag

SEQ ID NO: 853307 - RNA, 19 nt, Homo sapiens
augaaggacuuuaguugaa

SEQ ID NO: 853308 - RNA, 19 nt, Homo sapiens
caacuaggacacauaucuu

SEQ ID NO: 853309 - RNA, 19 nt, Homo sapiens
ccaacuuuccgcuaucuuu

SEQ ID NO: 853310 - RNA, 19 nt, Homo sapiens
ugucggaaauggcugaguu

SEQ ID NO: 853311 - RNA, 19 nt, Homo sapiens
aagacaaacugccaauaca

SEQ ID NO: 853312 - RNA, 19 nt, Homo sapiens
ggcuuugacuuuguuauug

SEQ ID NO: 853313 - RNA, 19 nt, Homo sapiens
gugugaauguacaaagaaa

SEQ ID NO: 853314 - RNA, 19 nt, Homo sapiens
gggaaacggagccuugcua

SEQ ID NO: 853315 - RNA, 19 nt, Homo sapiens
gcugugaugagauuauuga

SEQ ID NO: 853316 - RNA, 19 nt, Homo sapiens
gcggguuucagaugcauua

SEQ ID NO: 853317 - RNA, 19 nt, Homo sapiens
cagcauuggagauaauaaa

SEQ ID NO: 853318 - RNA, 19 nt, Homo sapiens
ugacagaugaaggacuuua

SEQ ID NO: 853319 - RNA, 19 nt, Homo sapiens
aaccauugcuuaugcuguu

SEQ ID NO: 853320 - RNA, 19 nt, Homo sapiens
gaggagggacccaacuuuc

SEQ ID NO: 853321 - RNA, 19 nt, Homo sapiens
gugugugaauguacaaaga

SEQ ID NO: 853322 - RNA, 19 nt, Homo sapiens
ucaagaaaauccauuguca

SEQ ID NO: 853323 - RNA, 19 nt, Homo sapiens
guuaucaaaggcuacauuu

SEQ ID NO: 853324 - RNA, 19 nt, Homo sapiens
gauaaauggaugaguaaac

SEQ ID NO: 853325 - RNA, 19 nt, Homo sapiens
gcccacugauacuaauuau

SEQ ID NO: 853326 - RNA, 19 nt, Homo sapiens
guuagaugcuguuaaaaga

SEQ ID NO: 853327 - RNA, 19 nt, Homo sapiens
uuaaaccugcccagaaauu

SEQ ID NO: 853328 - RNA, 19 nt, Homo sapiens
ucaagccacaguuaucaaa

SEQ ID NO: 853329 - RNA, 19 nt, Homo sapiens
ccucuaauuaagcuuguua

SEQ ID NO: 853330 - RNA, 19 nt, Homo sapiens
cgugugcuuuguaucuuaa

SEQ ID NO: 853331 - RNA, 19 nt, Homo sapiens
ccaacuaggacacauaucu

SEQ ID NO: 853332 - RNA, 19 nt, Homo sapiens
ccaagacaaacugccaaua

SEQ ID NO: 853333 - RNA, 19 nt, Homo sapiens
uaaagaugguuuugcaaga

SEQ ID NO: 853334 - RNA, 19 nt, Homo sapiens
cagaauagaacacaauagg

SEQ ID NO: 853335 - RNA, 19 nt, Homo sapiens
caccagcauuggagauaau

SEQ ID NO: 853336 - RNA, 19 nt, Homo sapiens
gggaggacgacuacgacua

SEQ ID NO: 853337 - RNA, 19 nt, Homo sapiens
ucaagaacguccuaaaaca

SEQ ID NO: 853338 - RNA, 19 nt, Homo sapiens
guugagcgguuugcacaau

SEQ ID NO: 853339 - RNA, 19 nt, Homo sapiens
ugucuccuccucuaauuaa

SEQ ID NO: 853340 - RNA, 19 nt, Homo sapiens
ggugccggcuacagaguau

SEQ ID NO: 853341 - RNA, 19 nt, Homo sapiens
cuugacagaugaaggacuu

SEQ ID NO: 853342 - RNA, 19 nt, Homo sapiens
cuacgacuaucccgaagag

SEQ ID NO: 853343 - RNA, 19 nt, Homo sapiens
ugaggagggacccaacuuu

SEQ ID NO: 853344 - RNA, 19 nt, Homo sapiens
cgacaagauguuucugaga

SEQ ID NO: 853345 - RNA, 19 nt, Homo sapiens
cagaugaaggacuuuaguu

SEQ ID NO: 853346 - RNA, 19 nt, Homo sapiens
cauugcuuaugcuguuaua

SEQ ID NO: 853347 - RNA, 19 nt, Homo sapiens
caaagaaaacaaaccauug

SEQ ID NO: 853348 - RNA, 19 nt, Homo sapiens
ucuagucaagccacaguua

SEQ ID NO: 853349 - RNA, 19 nt, Homo sapiens
agacaaacugccaauacaa

SEQ ID NO: 853350 - RNA, 19 nt, Homo sapiens
acucggcugugaugagauu

SEQ ID NO: 853351 - RNA, 19 nt, Homo sapiens
gagaagaccccguuugauc

SEQ ID NO: 853352 - RNA, 19 nt, Homo sapiens
auaaagccacugugaucua

SEQ ID NO: 853353 - RNA, 19 nt, Homo sapiens
caccuauggcuuugacuuu

SEQ ID NO: 853354 - RNA, 19 nt, Homo sapiens
gaguaucagccgcucuuga

SEQ ID NO: 853355 - RNA, 19 nt, Homo sapiens
agaugaaggacuuuaguug

SEQ ID NO: 853356 - RNA, 19 nt, Homo sapiens
caaaucuagacacuaaaug

SEQ ID NO: 853357 - RNA, 19 nt, Homo sapiens
aagagcaucugaaauuuug

SEQ ID NO: 853358 - RNA, 19 nt, Homo sapiens
aaagcccacugauacuaau

SEQ ID NO: 853359 - RNA, 19 nt, Homo sapiens
uuuguuugcuguaaagaug

SEQ ID NO: 853360 - RNA, 19 nt, Homo sapiens
gaaagaggaugccugauga

SEQ ID NO: 853361 - RNA, 19 nt, Homo sapiens
gcaaagacuucuggauuua

SEQ ID NO: 853362 - RNA, 19 nt, Homo sapiens
gaagagcccugaguauaaa

SEQ ID NO: 853363 - RNA, 19 nt, Homo sapiens
aaaggaggcucuuauaauu

SEQ ID NO: 853364 - RNA, 19 nt, Homo sapiens
gaaaggaggcucuuauaau

SEQ ID NO: 853365 - RNA, 19 nt, Homo sapiens
gaguuaacaucaccauaua

SEQ ID NO: 853366 - RNA, 19 nt, Homo sapiens
gagaagagcccugaguaua

SEQ ID NO: 853367 - RNA, 19 nt, Homo sapiens
ggaaaugucuaccacaagu

SEQ ID NO: 853368 - RNA, 19 nt, Homo sapiens
aaacagagaccaugacaaa

SEQ ID NO: 853369 - RNA, 19 nt, Homo sapiens
caacauuccuguauuugga

SEQ ID NO: 853370 - RNA, 19 nt, Homo sapiens
gaaguuggcugcggaagug

SEQ ID NO: 853371 - RNA, 19 nt, Homo sapiens
gguagacccugaaguaguu

SEQ ID NO: 853372 - RNA, 19 nt, Homo sapiens
gagaaaggaggcucuuaua

SEQ ID NO: 853373 - RNA, 19 nt, Homo sapiens
gcagaaucuuggaggauaa

SEQ ID NO: 853374 - RNA, 19 nt, Homo sapiens
ggaaagaggaugccugaug

SEQ ID NO: 853375 - RNA, 19 nt, Homo sapiens
ccacuacuauggacaagaa

SEQ ID NO: 853376 - RNA, 19 nt, Homo sapiens
uagcaacauuccuguauuu

SEQ ID NO: 853377 - RNA, 19 nt, Homo sapiens
gcauugggcacaccuguua

SEQ ID NO: 853378 - RNA, 19 nt, Homo sapiens
agaaguaccucccauuuua

SEQ ID NO: 853379 - RNA, 19 nt, Homo sapiens
aaacgcaucugcccaccua

SEQ ID NO: 853380 - RNA, 19 nt, Homo sapiens
caagaaguaccucccauuu

SEQ ID NO: 853381 - RNA, 19 nt, Homo sapiens
gagcagcgccucucacuuc

SEQ ID NO: 853382 - RNA, 19 nt, Homo sapiens
gaaaauagcauucacaauc

SEQ ID NO: 853383 - RNA, 19 nt, Homo sapiens
ccagacaccuccacuuuag

SEQ ID NO: 853384 - RNA, 19 nt, Homo sapiens
ccagacaccuccacuuuag

SEQ ID NO: 853385 - RNA, 19 nt, Homo sapiens
gaggaugccugaugagaag

SEQ ID NO: 853386 - RNA, 19 nt, Homo sapiens
gaagagugaagaaggauga

SEQ ID NO: 853387 - RNA, 19 nt, Homo sapiens
agaagagcccugaguauaa

SEQ ID NO: 853388 - RNA, 19 nt, Homo sapiens
caggagaacucaacauugg

SEQ ID NO: 853389 - RNA, 19 nt, Homo sapiens
cagcaaagacuucuggauu

SEQ ID NO: 853390 - RNA, 19 nt, Homo sapiens
ggugaucagucuaaugaga

SEQ ID NO: 853391 - RNA, 19 nt, Homo sapiens
ccagaagagugaagaagga

SEQ ID NO: 853392 - RNA, 19 nt, Homo sapiens
cagaauucaugcaguggua

SEQ ID NO: 853393 - RNA, 19 nt, Homo sapiens
gcccaagucuccaccaguu

SEQ ID NO: 853394 - RNA, 19 nt, Homo sapiens
ucccuaagcuccagaguga

SEQ ID NO: 853395 - RNA, 19 nt, Homo sapiens
gaagggcccagaagaguga

SEQ ID NO: 853396 - RNA, 19 nt, Homo sapiens
gauaggagaccaaccacaa

SEQ ID NO: 853397 - RNA, 19 nt, Homo sapiens
ccagcaagccuaugaauuc

SEQ ID NO: 853398 - RNA, 19 nt, Homo sapiens
cggaagugcugaaugaaga

SEQ ID NO: 853399 - RNA, 19 nt, Homo sapiens
guccaaggcuccaccaguu

SEQ ID NO: 853400 - RNA, 19 nt, Homo sapiens
guaccuuacugguuggaaa

SEQ ID NO: 853401 - RNA, 19 nt, Homo sapiens
agcaaagacuucuggauuu

SEQ ID NO: 853402 - RNA, 19 nt, Homo sapiens
caaauucccaaauacauug

SEQ ID NO: 853403 - RNA, 19 nt, Homo sapiens
gaaaacagcaugagugaga

SEQ ID NO: 853404 - RNA, 19 nt, Homo sapiens
cagcacacauggacagaga

SEQ ID NO: 853405 - RNA, 19 nt, Homo sapiens
ggagaagagcccugaguau

SEQ ID NO: 853406 - RNA, 19 nt, Homo sapiens
cuacacaccuuggagaaga

SEQ ID NO: 853407 - RNA, 19 nt, Homo sapiens
ggagaagcaucguccacau

SEQ ID NO: 853408 - RNA, 19 nt, Homo sapiens
ucucccaaauucccaaaua

SEQ ID NO: 853409 - RNA, 19 nt, Homo sapiens
agaaaggaggcucuuauaa

SEQ ID NO: 853410 - RNA, 19 nt, Homo sapiens
aaagacuucuggauuuaga

SEQ ID NO: 853411 - RNA, 19 nt, Homo sapiens
ccaaauucccaaauacauu

SEQ ID NO: 853412 - RNA, 19 nt, Homo sapiens
cagcgccucucacuucuga

SEQ ID NO: 853413 - RNA, 19 nt, Homo sapiens
ugagcucucucccaaauuc

SEQ ID NO: 853414 - RNA, 19 nt, Homo sapiens
cugcggaagugcugaauga

SEQ ID NO: 853415 - RNA, 19 nt, Homo sapiens
gcccuuguguuccugcuuu

SEQ ID NO: 853416 - RNA, 19 nt, Homo sapiens
ggaggaguacauccgauuu

SEQ ID NO: 853417 - RNA, 19 nt, Homo sapiens
uauccaagccugccauuga

SEQ ID NO: 853418 - RNA, 19 nt, Homo sapiens
ggcaccagauccauaguug

SEQ ID NO: 853419 - RNA, 19 nt, Homo sapiens
caggauccaucucucauuc

SEQ ID NO: 853420 - RNA, 19 nt, Homo sapiens
ugacaccagugacaugaau

SEQ ID NO: 853421 - RNA, 19 nt, Homo sapiens
caucucagguuguuauuuu

SEQ ID NO: 853422 - RNA, 19 nt, Homo sapiens
cauccaaaccucccauuga

SEQ ID NO: 853423 - RNA, 19 nt, Homo sapiens
caacuuccagccauccuuu

SEQ ID NO: 853424 - RNA, 19 nt, Homo sapiens
gcagauaggagaccaacca

SEQ ID NO: 853425 - RNA, 19 nt, Homo sapiens
gaauuccacgucagucauu

SEQ ID NO: 853426 - RNA, 19 nt, Homo sapiens
ccaagaagggcccagaaga

SEQ ID NO: 853427 - RNA, 19 nt, Homo sapiens
gggcacaccuguuaaugcu

SEQ ID NO: 853428 - RNA, 19 nt, Homo sapiens
ccgccuacauuccugguuu

SEQ ID NO: 853429 - RNA, 19 nt, Homo sapiens
cuagcaacauuccuguauu

SEQ ID NO: 853430 - RNA, 19 nt, Homo sapiens
gcuagcaacauuccuguau

SEQ ID NO: 853431 - RNA, 19 nt, Homo sapiens
gaaaugucuaccacaaguu

SEQ ID NO: 853432 - RNA, 19 nt, Homo sapiens
acacauggacagagagaaa

SEQ ID NO: 853433 - RNA, 19 nt, Homo sapiens
gaacucaacauuggacaag

SEQ ID NO: 853434 - RNA, 19 nt, Homo sapiens
gcauaauuccaccagguuu

SEQ ID NO: 853435 - RNA, 19 nt, Homo sapiens
gcacacauggacagagaga

SEQ ID NO: 853436 - RNA, 19 nt, Homo sapiens
agaguuaacaucaccauau

SEQ ID NO: 853437 - RNA, 19 nt, Homo sapiens
gagccuuccuaucaugguu

SEQ ID NO: 853438 - RNA, 19 nt, Homo sapiens
aggaggcucuuauaauuca

SEQ ID NO: 853439 - RNA, 19 nt, Homo sapiens
ggagaccaaccacaacuuc

SEQ ID NO: 853440 - RNA, 19 nt, Homo sapiens
agacguggccuccuucaga

SEQ ID NO: 853441 - RNA, 19 nt, Homo sapiens
ugagaaaggaggcucuuau

SEQ ID NO: 853442 - RNA, 19 nt, Homo sapiens
cuacauuccugguuuagac

SEQ ID NO: 853443 - RNA, 19 nt, Homo sapiens
caagaagggcccagaagag

SEQ ID NO: 853444 - RNA, 19 nt, Homo sapiens
gaguacauccgauuuuaua

SEQ ID NO: 853445 - RNA, 19 nt, Homo sapiens
ccaagaaguaccucccauu

SEQ ID NO: 853446 - RNA, 19 nt, Homo sapiens
gacguggccuccuucagau

SEQ ID NO: 853447 - RNA, 19 nt, Homo sapiens
ugaucagucuaaugagaaa

SEQ ID NO: 853448 - RNA, 19 nt, Homo sapiens
caaccauccuuuaaaucca

SEQ ID NO: 853449 - RNA, 19 nt, Homo sapiens
acagagaccaugacaaaca

SEQ ID NO: 853450 - RNA, 19 nt, Homo sapiens
cgccuacauuccugguuua

SEQ ID NO: 853451 - RNA, 19 nt, Homo sapiens
auccaaaccucccauugaa

SEQ ID NO: 853452 - RNA, 19 nt, Homo sapiens
ccacuuccauuuauauucc

SEQ ID NO: 853453 - RNA, 19 nt, Homo sapiens
agcagaaucuuggaggaua

SEQ ID NO: 853454 - RNA, 19 nt, Homo sapiens
caguuugccugcacaguca

SEQ ID NO: 853455 - RNA, 19 nt, Homo sapiens
ccgcugauguccggaaaga

SEQ ID NO: 853456 - RNA, 19 nt, Homo sapiens
ucccuaggcuugccgauuc

SEQ ID NO: 853457 - RNA, 19 nt, Homo sapiens
gcaacauuccuguauuugg

SEQ ID NO: 853458 - RNA, 19 nt, Homo sapiens
ccacugaugggcagcagaa

SEQ ID NO: 853459 - RNA, 19 nt, Homo sapiens
ggacacccagcaccacuuc

SEQ ID NO: 853460 - RNA, 19 nt, Homo sapiens
gauggcagcuuucucauua

SEQ ID NO: 853461 - RNA, 19 nt, Homo sapiens
ggaugaagcuagaauuaaa

SEQ ID NO: 853462 - RNA, 19 nt, Homo sapiens
ugacuaagcuagauacuug

SEQ ID NO: 853463 - RNA, 19 nt, Homo sapiens
ggaaguggcuggcaaaggu

SEQ ID NO: 853464 - RNA, 19 nt, Homo sapiens
caaaggcaaucccaaagaa

SEQ ID NO: 853465 - RNA, 19 nt, Homo sapiens
gaugauagagcaacacuaa

SEQ ID NO: 853466 - RNA, 19 nt, Homo sapiens
gaaauaaucgaacaggaaa

SEQ ID NO: 853467 - RNA, 19 nt, Homo sapiens
gagcaacacuaaacuaaag

SEQ ID NO: 853468 - RNA, 19 nt, Homo sapiens
gaaagaaaacccugaaaua

SEQ ID NO: 853469 - RNA, 19 nt, Homo sapiens
caaaugucaugcagacuuu

SEQ ID NO: 853470 - RNA, 19 nt, Homo sapiens
acccaaagcuagugaauaa

SEQ ID NO: 853471 - RNA, 19 nt, Homo sapiens
gaagagaggcuaugugaag

SEQ ID NO: 853472 - RNA, 19 nt, Homo sapiens
gagaagagaggcuauguga

SEQ ID NO: 853473 - RNA, 19 nt, Homo sapiens
gauuggagauggcagcuuu

SEQ ID NO: 853474 - RNA, 19 nt, Homo sapiens
cgauggagcucaugaagga

SEQ ID NO: 853475 - RNA, 19 nt, Homo sapiens
gaaagcaagugggaagaug

SEQ ID NO: 853476 - RNA, 19 nt, Homo sapiens
acacuaaacuaaagcaaug

SEQ ID NO: 853477 - RNA, 19 nt, Homo sapiens
gcuagauacuugaggauga

SEQ ID NO: 853478 - RNA, 19 nt, Homo sapiens
uaccagagaugcaaagaga

SEQ ID NO: 853479 - RNA, 19 nt, Homo sapiens
gggugaauuugacacuuua

SEQ ID NO: 853480 - RNA, 19 nt, Homo sapiens
ccagaaggaugaagcuaga

SEQ ID NO: 853481 - RNA, 19 nt, Homo sapiens
ccaaagcuagugaauaauu

SEQ ID NO: 853482 - RNA, 19 nt, Homo sapiens
acaaauaccagaaggauga

SEQ ID NO: 853483 - RNA, 19 nt, Homo sapiens
acaagugugugcauauuga

SEQ ID NO: 853484 - RNA, 19 nt, Homo sapiens
ggagacaugcaugauauaa

SEQ ID NO: 853485 - RNA, 19 nt, Homo sapiens
gaaacccugucucuaccaa

SEQ ID NO: 853486 - RNA, 19 nt, Homo sapiens
ucacugagacccaaagcua

SEQ ID NO: 853487 - RNA, 19 nt, Homo sapiens
gagggagacaugcaugaua

SEQ ID NO: 853488 - RNA, 19 nt, Homo sapiens
gcaguuaccaugugcauag

SEQ ID NO: 853489 - RNA, 19 nt, Homo sapiens
ccucaagccugaccuggaa

SEQ ID NO: 853490 - RNA, 19 nt, Homo sapiens
gauagacccguggcaguua

SEQ ID NO: 853491 - RNA, 19 nt, Homo sapiens
gaaggaugaagcuagaauu

SEQ ID NO: 853492 - RNA, 19 nt, Homo sapiens
gacaacagcuagaaguuuu

SEQ ID NO: 853493 - RNA, 19 nt, Homo sapiens
gagccgagaucaggccauu

SEQ ID NO: 853494 - RNA, 19 nt, Homo sapiens
gcugaaagcgcaccucaug

SEQ ID NO: 853495 - RNA, 19 nt, Homo sapiens
guuuaacuauccaaaguga

SEQ ID NO: 853496 - RNA, 19 nt, Homo sapiens
ugaagaucaugaagaauag

SEQ ID NO: 853497 - RNA, 19 nt, Homo sapiens
ugaaauaaucgaacaggaa

SEQ ID NO: 853498 - RNA, 19 nt, Homo sapiens
aauguggacuucuugauug

SEQ ID NO: 853499 - RNA, 19 nt, Homo sapiens
gaagugguuuggacaugca

SEQ ID NO: 853500 - RNA, 19 nt, Homo sapiens
ggcgugaacugccgcuuug

SEQ ID NO: 853501 - RNA, 19 nt, Homo sapiens
cgacaacagcuagaaguuu

SEQ ID NO: 853502 - RNA, 19 nt, Homo sapiens
ugucaaagccagacuucua

SEQ ID NO: 853503 - RNA, 19 nt, Homo sapiens
uaaaugcugcugccuguga

SEQ ID NO: 853504 - RNA, 19 nt, Homo sapiens
uagagcaacacuaaacuaa

SEQ ID NO: 853505 - RNA, 19 nt, Homo sapiens
ugaagaauagccaaacuug

SEQ ID NO: 853506 - RNA, 19 nt, Homo sapiens
aaggaugaagcuagaauua

SEQ ID NO: 853507 - RNA, 19 nt, Homo sapiens
ccagacaucaauauacaaa

SEQ ID NO: 853508 - RNA, 19 nt, Homo sapiens
caagugggaagauguaaau

SEQ ID NO: 853509 - RNA, 19 nt, Homo sapiens
gcaagugggaagauguaaa

SEQ ID NO: 853510 - RNA, 19 nt, Homo sapiens
ucacauggaauucuugaga

SEQ ID NO: 853511 - RNA, 19 nt, Homo sapiens
gaagaauagccaaacuugu

SEQ ID NO: 853512 - RNA, 19 nt, Homo sapiens
cuuugaagaucaugaagaa

SEQ ID NO: 853513 - RNA, 19 nt, Homo sapiens
ccaagaacuuacuguccaa

SEQ ID NO: 853514 - RNA, 19 nt, Homo sapiens
gcaggagaaucgcuugaac

SEQ ID NO: 853515 - RNA, 19 nt, Homo sapiens
ccaaaggcaaucccaaaga

SEQ ID NO: 853516 - RNA, 19 nt, Homo sapiens
agaacuuacuguccaauca

SEQ ID NO: 853517 - RNA, 19 nt, Homo sapiens
uuguggaucucccagaaua

SEQ ID NO: 853518 - RNA, 19 nt, Homo sapiens
gcagcuuucucauuacucu

SEQ ID NO: 853519 - RNA, 19 nt, Homo sapiens
ggugaaacccugucucuac

SEQ ID NO: 853520 - RNA, 19 nt, Homo sapiens
caagugacuaagcuagaua

SEQ ID NO: 853521 - RNA, 19 nt, Homo sapiens
ucuaaggaguagugaaaga

SEQ ID NO: 853522 - RNA, 19 nt, Homo sapiens
gaacuuacuguccaaucau

SEQ ID NO: 853523 - RNA, 19 nt, Homo sapiens
gggaagugguuuggacaug

SEQ ID NO: 853524 - RNA, 19 nt, Homo sapiens
agggagacaugcaugauau

SEQ ID NO: 853525 - RNA, 19 nt, Homo sapiens
cgagagaggcaccuuguuc

SEQ ID NO: 853526 - RNA, 19 nt, Homo sapiens
agaaaacccugaaauaauc

SEQ ID NO: 853527 - RNA, 19 nt, Homo sapiens
gucaaagccagacuucuaa

SEQ ID NO: 853528 - RNA, 19 nt, Homo sapiens
gaagggaguauugggagaa

SEQ ID NO: 853529 - RNA, 19 nt, Homo sapiens
ucaaaugucaugcagacuu

SEQ ID NO: 853530 - RNA, 19 nt, Homo sapiens
ucaagugacuaagcuagau

SEQ ID NO: 853531 - RNA, 19 nt, Homo sapiens
gacccaaagcuagugaaua

SEQ ID NO: 853532 - RNA, 19 nt, Homo sapiens
uaaggaguagugaaagaaa

SEQ ID NO: 853533 - RNA, 19 nt, Homo sapiens
gcacaccaaacccuggauu

SEQ ID NO: 853534 - RNA, 19 nt, Homo sapiens
cagaggcagugauagaaca

SEQ ID NO: 853535 - RNA, 19 nt, Homo sapiens
aaauguggacuucuugauu

SEQ ID NO: 853536 - RNA, 19 nt, Homo sapiens
agggugaauuugacacuuu

SEQ ID NO: 853537 - RNA, 19 nt, Homo sapiens
gauuugagcccuaccacau

SEQ ID NO: 853538 - RNA, 19 nt, Homo sapiens
gagcuccugcugugguuaa

SEQ ID NO: 853539 - RNA, 19 nt, Homo sapiens
agagcaggaucaaauguca

SEQ ID NO: 853540 - RNA, 19 nt, Homo sapiens
gggagacaugcaugauaua

SEQ ID NO: 853541 - RNA, 19 nt, Homo sapiens
ugccagacaucaauauaca

SEQ ID NO: 853542 - RNA, 19 nt, Homo sapiens
gaucaggccauugcacuuc

SEQ ID NO: 853543 - RNA, 19 nt, Homo sapiens
gauggcgggugccuguaau

SEQ ID NO: 853544 - RNA, 19 nt, Homo sapiens
gagggugaauuugacacuu

SEQ ID NO: 853545 - RNA, 19 nt, Homo sapiens
aagaauagccaaacuuguc

SEQ ID NO: 853546 - RNA, 19 nt, Homo sapiens
guuuguggaucucccagaa

SEQ ID NO: 853547 - RNA, 19 nt, Homo sapiens
ugaagacgauggagcucau

SEQ ID NO: 853548 - RNA, 19 nt, Homo sapiens
ggaaagcaagugggaagau

SEQ ID NO: 853549 - RNA, 19 nt, Homo sapiens
ccagugaggacaauaugga

SEQ ID NO: 853550 - RNA, 19 nt, Homo sapiens
ggagaagagaggcuaugug

SEQ ID NO: 853551 - RNA, 19 nt, Homo sapiens
caccaaacccuggauuaga

SEQ ID NO: 853552 - RNA, 19 nt, Homo sapiens
cccagaauaucccuuugga

SEQ ID NO: 853553 - RNA, 19 nt, Homo sapiens
gugcauuccuuugaagauc

SEQ ID NO: 853554 - RNA, 19 nt, Homo sapiens
gagagaggcaccuuguucu

SEQ ID NO: 853555 - RNA, 19 nt, Homo sapiens
cuucuaaggaguagugaaa

SEQ ID NO: 853556 - RNA, 19 nt, Homo sapiens
cacaccaaacccuggauua

SEQ ID NO: 853557 - RNA, 19 nt, Homo sapiens
gccaccagaugggauauuc

SEQ ID NO: 853558 - RNA, 19 nt, Homo sapiens
agacaugcaugauauaacc

SEQ ID NO: 853559 - RNA, 19 nt, Homo sapiens
agaccagccugaccaacau

SEQ ID NO: 853560 - RNA, 19 nt, Homo sapiens
gagccaagaucacgucauu

SEQ ID NO: 853561 - RNA, 19 nt, Homo sapiens
gaaaucggcucuucaagcu

SEQ ID NO: 853562 - RNA, 19 nt, Homo sapiens
gaaaccucaucucuacuaa

SEQ ID NO: 853563 - RNA, 19 nt, Homo sapiens
ggugaaaccucaucucuac

SEQ ID NO: 853564 - RNA, 19 nt, Homo sapiens
uaaggaaccugcagaccaa

SEQ ID NO: 853565 - RNA, 19 nt, Homo sapiens
guacagaagagcuuaugaa

SEQ ID NO: 853566 - RNA, 19 nt, Homo sapiens
gcucugauccuuucucaug

SEQ ID NO: 853567 - RNA, 19 nt, Homo sapiens
gccagugccugcugaagaa

SEQ ID NO: 853568 - RNA, 19 nt, Homo sapiens
gaagaaggaggaguacuau

SEQ ID NO: 853569 - RNA, 19 nt, Homo sapiens
ugaagaaggaggaguacua

SEQ ID NO: 853570 - RNA, 19 nt, Homo sapiens
ucaauacucugauccucaa

SEQ ID NO: 853571 - RNA, 19 nt, Homo sapiens
uggagaagaugaucaauac

SEQ ID NO: 853572 - RNA, 19 nt, Homo sapiens
gccaucaucugccuaagga

SEQ ID NO: 853573 - RNA, 19 nt, Homo sapiens
agaaggaggaguacuauga

SEQ ID NO: 853574 - RNA, 19 nt, Homo sapiens
acagaagagcuuaugaaua

SEQ ID NO: 853575 - RNA, 19 nt, Homo sapiens
gaaaucaaagucagacaca

SEQ ID NO: 853576 - RNA, 19 nt, Homo sapiens
ggucacuucugguucgauu

SEQ ID NO: 853577 - RNA, 19 nt, Homo sapiens
gcaggagaauugauugaac

SEQ ID NO: 853578 - RNA, 19 nt, Homo sapiens
acgcagagguguggaauga

SEQ ID NO: 853579 - RNA, 19 nt, Homo sapiens
gcacaccagugauauucuc

SEQ ID NO: 853580 - RNA, 19 nt, Homo sapiens
ggcugaagcuggagaagau

SEQ ID NO: 853581 - RNA, 19 nt, Homo sapiens
ggaggccucuuccaaguac

SEQ ID NO: 853582 - RNA, 19 nt, Homo sapiens
ugaaaccucaucucuacua

SEQ ID NO: 853583 - RNA, 19 nt, Homo sapiens
gagcaaucaugagaagaug

SEQ ID NO: 853584 - RNA, 19 nt, Homo sapiens
uggacgagcugcagaagga

SEQ ID NO: 853585 - RNA, 19 nt, Homo sapiens
cgagugaucuuucauuucc

SEQ ID NO: 853586 - RNA, 19 nt, Homo sapiens
uuuagugggucuugaugua

SEQ ID NO: 853587 - RNA, 19 nt, Homo sapiens
gaaucccacugacuuuagu

SEQ ID NO: 853588 - RNA, 19 nt, Homo sapiens
gagcacaccagugauauuc

SEQ ID NO: 853589 - RNA, 19 nt, Homo sapiens
gagaagaugaucaauacuc

SEQ ID NO: 853590 - RNA, 19 nt, Homo sapiens
ccuauaaucccagcacuuu

SEQ ID NO: 853591 - RNA, 19 nt, Homo sapiens
cccgagugaucuuucauuu

SEQ ID NO: 853592 - RNA, 19 nt, Homo sapiens
cgggcgagcucccaaacuu

SEQ ID NO: 853593 - RNA, 19 nt, Homo sapiens
ggagcacaccagugauauu

SEQ ID NO: 853594 - RNA, 19 nt, Homo sapiens
uagaaucccacugacuuua

SEQ ID NO: 853595 - RNA, 19 nt, Homo sapiens
ccuggaaccugagcaauca

SEQ ID NO: 853596 - RNA, 19 nt, Homo sapiens
gaguaaaacuucaucucaa

SEQ ID NO: 853597 - RNA, 19 nt, Homo sapiens
ucagacacacccaugguaa

SEQ ID NO: 853598 - RNA, 19 nt, Homo sapiens
caaggcggaccuccagaaa

SEQ ID NO: 853599 - RNA, 19 nt, Homo sapiens
agaagaugaucaauacucu

SEQ ID NO: 853600 - RNA, 19 nt, Homo sapiens
cacgguggcucacgccuau

SEQ ID NO: 853601 - RNA, 19 nt, Homo sapiens
aggcggaccuccagaaagu

SEQ ID NO: 853602 - RNA, 19 nt, Homo sapiens
gaaggaggaguacuaugag

SEQ ID NO: 853603 - RNA, 19 nt, Homo sapiens
auacucugauccucaacua

SEQ ID NO: 853604 - RNA, 19 nt, Homo sapiens
gaugaggagcggacaguca

SEQ ID NO: 853605 - RNA, 19 nt, Homo sapiens
caacaagaguaaaacuuca

SEQ ID NO: 853606 - RNA, 19 nt, Homo sapiens
aagaugaucaauacucuga

SEQ ID NO: 853607 - RNA, 19 nt, Homo sapiens
ucacuucugguucgauuga

SEQ ID NO: 853608 - RNA, 19 nt, Homo sapiens
cuggagaagaugaucaaua

SEQ ID NO: 853609 - RNA, 19 nt, Homo sapiens
ugaggcaggagaauugauu

SEQ ID NO: 853610 - RNA, 19 nt, Homo sapiens
cuagaaucccacugacuuu

SEQ ID NO: 853611 - RNA, 19 nt, Homo sapiens
ucuagaaucccacugacuu

SEQ ID NO: 853612 - RNA, 19 nt, Homo sapiens
gaggagcggacagucauug

SEQ ID NO: 853613 - RNA, 19 nt, Homo sapiens
ccaaggcggaccuccagaa

SEQ ID NO: 853614 - RNA, 19 nt, Homo sapiens
caucaucaucggaaacaug

SEQ ID NO: 853615 - RNA, 19 nt, Homo sapiens
ggaaccugagcaaucauga

SEQ ID NO: 853616 - RNA, 19 nt, Homo sapiens
ccuauaaucccagcuacuu

SEQ ID NO: 853617 - RNA, 19 nt, Homo sapiens
caucaucggaaacauguuc

SEQ ID NO: 853618 - RNA, 19 nt, Homo sapiens
cagacacacccaugguaaa

SEQ ID NO: 853619 - RNA, 19 nt, Homo sapiens
cugcagagccagccacaga

SEQ ID NO: 853620 - RNA, 19 nt, Homo sapiens
ccugagcaaucaugagaag

SEQ ID NO: 853621 - RNA, 19 nt, Homo sapiens
ugacuuuagugggucuuga

SEQ ID NO: 853622 - RNA, 19 nt, Homo sapiens
uugaugcucugauccuuuc

SEQ ID NO: 853623 - RNA, 19 nt, Homo sapiens
gcgccuauaaucccagcua

SEQ ID NO: 853624 - RNA, 19 nt, Homo sapiens
aaccucaucucuacuaaaa

SEQ ID NO: 853625 - RNA, 19 nt, Homo sapiens
acuuuacgcaggacacuua

SEQ ID NO: 853626 - RNA, 19 nt, Homo sapiens
uacagaagagcuuaugaau

SEQ ID NO: 853627 - RNA, 19 nt, Homo sapiens
ggaaccugcagaccaagga

SEQ ID NO: 853628 - RNA, 19 nt, Homo sapiens
ugagcaaucaugagaagau

SEQ ID NO: 853629 - RNA, 19 nt, Homo sapiens
ucggaaacauguucaagcu

SEQ ID NO: 853630 - RNA, 19 nt, Homo sapiens
gccaagaucacgucauugc

SEQ ID NO: 853631 - RNA, 19 nt, Homo sapiens
ggcugaggcaggagaauug

SEQ ID NO: 853632 - RNA, 19 nt, Homo sapiens
gcacaucaucaucggaaac

SEQ ID NO: 853633 - RNA, 19 nt, Homo sapiens
ggccagcccaugcacauca

SEQ ID NO: 853634 - RNA, 19 nt, Homo sapiens
gagggaaaucggcucuuca

SEQ ID NO: 853635 - RNA, 19 nt, Homo sapiens
ggcaggagaauugauugaa

SEQ ID NO: 853636 - RNA, 19 nt, Homo sapiens
uauaaucccagcacuuugg

SEQ ID NO: 853637 - RNA, 19 nt, Homo sapiens
aaggcaagcgccaguggua

SEQ ID NO: 853638 - RNA, 19 nt, Homo sapiens
gguacagaagagcuuauga

SEQ ID NO: 853639 - RNA, 19 nt, Homo sapiens
gucagacacacccauggua

SEQ ID NO: 853640 - RNA, 19 nt, Homo sapiens
gaaccugagcaaucaugag

SEQ ID NO: 853641 - RNA, 19 nt, Homo sapiens
gaggcaggagaauugauug

SEQ ID NO: 853642 - RNA, 19 nt, Homo sapiens
aaaccucaucucuacuaaa

SEQ ID NO: 853643 - RNA, 19 nt, Homo sapiens
ggggucaucucggugauuu

SEQ ID NO: 853644 - RNA, 19 nt, Homo sapiens
ucugggagauccugcuuac

SEQ ID NO: 853645 - RNA, 19 nt, Homo sapiens
ugcacgagguggccgaguu

SEQ ID NO: 853646 - RNA, 19 nt, Homo sapiens
ggcgagcucccaaacuuca

SEQ ID NO: 853647 - RNA, 19 nt, Homo sapiens
caaggguacagaagagcuu

SEQ ID NO: 853648 - RNA, 19 nt, Homo sapiens
ggccuggucacuucugguu

SEQ ID NO: 853649 - RNA, 19 nt, Homo sapiens
ucaagugccuuugugauua

SEQ ID NO: 853650 - RNA, 19 nt, Homo sapiens
caagugccuuugugauuaa

SEQ ID NO: 853651 - RNA, 19 nt, Homo sapiens
aaagaauguuggucuauga

SEQ ID NO: 853652 - RNA, 19 nt, Homo sapiens
uaaagaauguuggucuaug

SEQ ID NO: 853653 - RNA, 19 nt, Homo sapiens
gcagagacuuuggguuugu

SEQ ID NO: 853654 - RNA, 19 nt, Homo sapiens
gugcugaagcugcucaaua

SEQ ID NO: 853655 - RNA, 19 nt, Homo sapiens
gcgacgaccuggaccuaug

SEQ ID NO: 853656 - RNA, 19 nt, Homo sapiens
uggcagagacuuuggguuu

SEQ ID NO: 853657 - RNA, 19 nt, Homo sapiens
gcacucgcacgacaucaaa

SEQ ID NO: 853658 - RNA, 19 nt, Homo sapiens
cgucgccgcuguccaacaa

SEQ ID NO: 853659 - RNA, 19 nt, Homo sapiens
ggcagagacuuuggguuug

SEQ ID NO: 853660 - RNA, 19 nt, Homo sapiens
ugaggcugcugugcgcuua

SEQ ID NO: 853661 - RNA, 19 nt, Homo sapiens
cagagacuuuggguuugua

SEQ ID NO: 853662 - RNA, 19 nt, Homo sapiens
ugcugaagcugcucaauac

SEQ ID NO: 853663 - RNA, 19 nt, Homo sapiens
cucaagugccuuugugauu

SEQ ID NO: 853664 - RNA, 19 nt, Homo sapiens
acucgcacgacaucaaaua

SEQ ID NO: 853665 - RNA, 19 nt, Homo sapiens
guccucaagugccuuugug

SEQ ID NO: 853666 - RNA, 19 nt, Homo sapiens
caugugggcaccucugugu

SEQ ID NO: 853667 - RNA, 19 nt, Homo sapiens
caacaggucucaauucuuc

SEQ ID NO: 853668 - RNA, 19 nt, Homo sapiens
gcaagaagcauuauuacga

SEQ ID NO: 853669 - RNA, 19 nt, Homo sapiens
gcugaacgcugcccacuau

SEQ ID NO: 853670 - RNA, 19 nt, Homo sapiens
gauugugguuuccucuuua

SEQ ID NO: 853671 - RNA, 19 nt, Homo sapiens
ccaaacaggacccgucuua

SEQ ID NO: 853672 - RNA, 19 nt, Homo sapiens
gaagacacagcucaaggua

SEQ ID NO: 853673 - RNA, 19 nt, Homo sapiens
caagaagcauuauuacgau

SEQ ID NO: 853674 - RNA, 19 nt, Homo sapiens
uuccauggcuuaagaagua

SEQ ID NO: 853675 - RNA, 19 nt, Homo sapiens
gaagccagaucucccacaa

SEQ ID NO: 853676 - RNA, 19 nt, Homo sapiens
gaggagauccgcauugaug

SEQ ID NO: 853677 - RNA, 19 nt, Homo sapiens
ugacagccauggagaaugu

SEQ ID NO: 853678 - RNA, 19 nt, Homo sapiens
gcaguggaacagcuaaaua

SEQ ID NO: 853679 - RNA, 19 nt, Homo sapiens
ggaggccgaugcccagauu

SEQ ID NO: 853680 - RNA, 19 nt, Homo sapiens
aaacaggacccgucuuauu

SEQ ID NO: 853681 - RNA, 19 nt, Homo sapiens
caaugucucuaacuucuau

SEQ ID NO: 853682 - RNA, 19 nt, Homo sapiens
gaagcgagcagcagaggaa

SEQ ID NO: 853683 - RNA, 19 nt, Homo sapiens
aacaggacccgucuuauua

SEQ ID NO: 853684 - RNA, 19 nt, Homo sapiens
gugccuaccuggacaagaa

SEQ ID NO: 853685 - RNA, 19 nt, Homo sapiens
gcacaaggccugcccuaca

SEQ ID NO: 853686 - RNA, 19 nt, Homo sapiens
gcuaccaguuugugaagaa

SEQ ID NO: 853687 - RNA, 19 nt, Homo sapiens
ggacggcagcauugaguuu

SEQ ID NO: 853688 - RNA, 19 nt, Homo sapiens
cuacagccgugcaccacua

SEQ ID NO: 853689 - RNA, 19 nt, Homo sapiens
uggaacagcuaaauaucaa

SEQ ID NO: 853690 - RNA, 19 nt, Homo sapiens
aauaauagacccagaugaa

SEQ ID NO: 853691 - RNA, 19 nt, Homo sapiens
uggagaauguggagaguga

SEQ ID NO: 853692 - RNA, 19 nt, Homo sapiens
ugcaggagcucuacaagga

SEQ ID NO: 853693 - RNA, 19 nt, Homo sapiens
ggaggucccugaucaagcu

SEQ ID NO: 853694 - RNA, 19 nt, Homo sapiens
ggacagccuauuuauacaa

SEQ ID NO: 853695 - RNA, 19 nt, Homo sapiens
ggacccgucuuauuaucug

SEQ ID NO: 853696 - RNA, 19 nt, Homo sapiens
ccagaucucccacaaacaa

SEQ ID NO: 853697 - RNA, 19 nt, Homo sapiens
uggcaucgucuuugacuua

SEQ ID NO: 853698 - RNA, 19 nt, Homo sapiens
gugcugcgcuaccaguuug

SEQ ID NO: 853699 - RNA, 19 nt, Homo sapiens
uaauagacccagaugaaga

SEQ ID NO: 853700 - RNA, 19 nt, Homo sapiens
guacauuaccugugcugaa

SEQ ID NO: 853701 - RNA, 19 nt, Homo sapiens
ggacugugucuccagauug

SEQ ID NO: 853702 - RNA, 19 nt, Homo sapiens
aaacugaccgcccuaagga

SEQ ID NO: 853703 - RNA, 19 nt, Homo sapiens
ucugaaggcugguguugga

SEQ ID NO: 853704 - RNA, 19 nt, Homo sapiens
agauugugguuuccucuuu

SEQ ID NO: 853705 - RNA, 19 nt, Homo sapiens
ggaagacacagcucaaggu

SEQ ID NO: 853706 - RNA, 19 nt, Homo sapiens
caccugggcuucaucucaa

SEQ ID NO: 853707 - RNA, 19 nt, Homo sapiens
gacugugucuccagauugu

SEQ ID NO: 853708 - RNA, 19 nt, Homo sapiens
gaucucccacaaacaaauu

SEQ ID NO: 853709 - RNA, 19 nt, Homo sapiens
caacaagggcgaccucaac

SEQ ID NO: 853710 - RNA, 19 nt, Homo sapiens
gggacagccuauuuauaca

SEQ ID NO: 853711 - RNA, 19 nt, Homo sapiens
cagggacagccuauuuaua

SEQ ID NO: 853712 - RNA, 19 nt, Homo sapiens
ucucagggacagccuauuu

SEQ ID NO: 853713 - RNA, 19 nt, Homo sapiens
ucucuaacuucuaucaugu

SEQ ID NO: 853714 - RNA, 19 nt, Homo sapiens
caaguucaaugucucuaac

SEQ ID NO: 853715 - RNA, 19 nt, Homo sapiens
uacauuaccugugcugaau

SEQ ID NO: 853716 - RNA, 19 nt, Homo sapiens
gccauuaccugggacaagu

SEQ ID NO: 853717 - RNA, 19 nt, Homo sapiens
gcaacaggucucaauucuu

SEQ ID NO: 853718 - RNA, 19 nt, Homo sapiens
ucaucaggcuuugcaagaa

SEQ ID NO: 853719 - RNA, 19 nt, Homo sapiens
agaagaaaguggacaagcu

SEQ ID NO: 853720 - RNA, 19 nt, Homo sapiens
gggaagcgacagcaccaaa

SEQ ID NO: 853721 - RNA, 19 nt, Homo sapiens
caguggaacagcuaaauau

SEQ ID NO: 853722 - RNA, 19 nt, Homo sapiens
caccugcucuggcugugaa

SEQ ID NO: 853723 - RNA, 19 nt, Homo sapiens
ccagugcaguggugugauc

SEQ ID NO: 853724 - RNA, 19 nt, Homo sapiens
caucaggcuuugcaagaag

SEQ ID NO: 853725 - RNA, 19 nt, Homo sapiens
ucuaacuucuaucauguga

SEQ ID NO: 853726 - RNA, 19 nt, Homo sapiens
aggaggagauccgcauuga

SEQ ID NO: 853727 - RNA, 19 nt, Homo sapiens
guggaacagcuaaauauca

SEQ ID NO: 853728 - RNA, 19 nt, Homo sapiens
caaacaaauuuucgucguu

SEQ ID NO: 853729 - RNA, 19 nt, Homo sapiens
ucccaucccuuaaccuguu

SEQ ID NO: 853730 - RNA, 19 nt, Homo sapiens
cagcaacaggucucaauuc

SEQ ID NO: 853731 - RNA, 19 nt, Homo sapiens
ggagaccacacaugaagca

SEQ ID NO: 853732 - RNA, 19 nt, Homo sapiens
uaaauaucaaggccaagaa

SEQ ID NO: 853733 - RNA, 19 nt, Homo sapiens
caucgucuuugacuuacug

SEQ ID NO: 853734 - RNA, 19 nt, Homo sapiens
guauaugucugguuuucuu

SEQ ID NO: 853735 - RNA, 19 nt, Homo sapiens
agacccagaugaagagaag

SEQ ID NO: 853736 - RNA, 19 nt, Homo sapiens
gacaagaagcauaccaucu

SEQ ID NO: 853737 - RNA, 19 nt, Homo sapiens
gaaaacuucaucaggcuuu

SEQ ID NO: 853738 - RNA, 19 nt, Homo sapiens
gucucuaacuucuaucaug

SEQ ID NO: 853739 - RNA, 19 nt, Homo sapiens
aagcugaacuuuuccaaga

SEQ ID NO: 853740 - RNA, 19 nt, Homo sapiens
gacagccuauuuauacaac

SEQ ID NO: 853741 - RNA, 19 nt, Homo sapiens
gugcaguggugugaucaug

SEQ ID NO: 853742 - RNA, 19 nt, Homo sapiens
gaagaagaaaguggacaag

SEQ ID NO: 853743 - RNA, 19 nt, Homo sapiens
ccaccugggcuucaucuca

SEQ ID NO: 853744 - RNA, 19 nt, Homo sapiens
gguguuggacggcagcauu

SEQ ID NO: 853745 - RNA, 19 nt, Homo sapiens
ucagggacagccuauuuau

SEQ ID NO: 853746 - RNA, 19 nt, Homo sapiens
guccacaucuccauuucca

SEQ ID NO: 853747 - RNA, 19 nt, Homo sapiens
gaaaauaauagacccagau

SEQ ID NO: 853748 - RNA, 19 nt, Homo sapiens
cuaaauaucaaggccaaga

SEQ ID NO: 853749 - RNA, 19 nt, Homo sapiens
cugaauacacucacuuuua

SEQ ID NO: 853750 - RNA, 19 nt, Homo sapiens
gaagcauaccaucuuugga

SEQ ID NO: 853751 - RNA, 19 nt, Homo sapiens
acagauccauccggaacuu

SEQ ID NO: 853752 - RNA, 19 nt, Homo sapiens
gaaaguggacaagcugaac

SEQ ID NO: 853753 - RNA, 19 nt, Homo sapiens
caggacccgucuuauuauc

SEQ ID NO: 853754 - RNA, 19 nt, Homo sapiens
cuacuucugucaucuucuc

SEQ ID NO: 853755 - RNA, 19 nt, Homo sapiens
ucaauucuucaucacguuu

SEQ ID NO: 853756 - RNA, 19 nt, Homo sapiens
uaucaaggccaagaacuuc

SEQ ID NO: 853757 - RNA, 19 nt, Homo sapiens
gcugugagaacaaguggau

SEQ ID NO: 853758 - RNA, 19 nt, Homo sapiens
acugcgaccugacaccaaa

SEQ ID NO: 853759 - RNA, 19 nt, Homo sapiens
gaacgcugcccacuauucc

SEQ ID NO: 853760 - RNA, 19 nt, Homo sapiens
caaacaggacccgucuuau

SEQ ID NO: 853761 - RNA, 19 nt, Homo sapiens
acaaguucaaugucucuaa

SEQ ID NO: 853762 - RNA, 19 nt, Homo sapiens
ugaucaagcugaacuuuuc

SEQ ID NO: 853763 - RNA, 19 nt, Homo sapiens
agggacagccuauuuauac

SEQ ID NO: 853764 - RNA, 19 nt, Homo sapiens
cauuaccugugcugaauac

SEQ ID NO: 853765 - RNA, 19 nt, Homo sapiens
guucaaugucucuaacuuc

SEQ ID NO: 853766 - RNA, 19 nt, Homo sapiens
caacgucuacgccuaugag

SEQ ID NO: 853767 - RNA, 19 nt, Homo sapiens
caacaggucucaauucuuc

SEQ ID NO: 853768 - RNA, 19 nt, Homo sapiens
gcaagaagcauuauuacga

SEQ ID NO: 853769 - RNA, 19 nt, Homo sapiens
gcugaacgcugcccacuau

SEQ ID NO: 853770 - RNA, 19 nt, Homo sapiens
ccacugagggcacgauuua

SEQ ID NO: 853771 - RNA, 19 nt, Homo sapiens
ccaaacaggacccgucuua

SEQ ID NO: 853772 - RNA, 19 nt, Homo sapiens
gaagacacagcucaaggua

SEQ ID NO: 853773 - RNA, 19 nt, Homo sapiens
caagaagcauuauuacgau

SEQ ID NO: 853774 - RNA, 19 nt, Homo sapiens
guaaaccucacacagauaa

SEQ ID NO: 853775 - RNA, 19 nt, Homo sapiens
gggcacgauuuaaacauuu

SEQ ID NO: 853776 - RNA, 19 nt, Homo sapiens
uuccauggcuuaagaagua

SEQ ID NO: 853777 - RNA, 19 nt, Homo sapiens
gaagccagaucucccacaa

SEQ ID NO: 853778 - RNA, 19 nt, Homo sapiens
gacaucagaagcuuuauuu

SEQ ID NO: 853779 - RNA, 19 nt, Homo sapiens
gaggagauccgcauugaug

SEQ ID NO: 853780 - RNA, 19 nt, Homo sapiens
ugacagccauggagaaugu

SEQ ID NO: 853781 - RNA, 19 nt, Homo sapiens
gcaguggaacagcuaaaua

SEQ ID NO: 853782 - RNA, 19 nt, Homo sapiens
ggaggccgaugcccagauu

SEQ ID NO: 853783 - RNA, 19 nt, Homo sapiens
aaacaggacccgucuuauu

SEQ ID NO: 853784 - RNA, 19 nt, Homo sapiens
caaugucucuaacuucuau

SEQ ID NO: 853785 - RNA, 19 nt, Homo sapiens
gaagcgagcagcagaggaa

SEQ ID NO: 853786 - RNA, 19 nt, Homo sapiens
aacaggacccgucuuauua

SEQ ID NO: 853787 - RNA, 19 nt, Homo sapiens
gugccuaccuggacaagaa

SEQ ID NO: 853788 - RNA, 19 nt, Homo sapiens
gcuaccaguuugugaagaa

SEQ ID NO: 853789 - RNA, 19 nt, Homo sapiens
uguauucucuggccacauu

SEQ ID NO: 853790 - RNA, 19 nt, Homo sapiens
uggaacagcuaaauaucaa

SEQ ID NO: 853791 - RNA, 19 nt, Homo sapiens
caucagaagcuuuauuugu

SEQ ID NO: 853792 - RNA, 19 nt, Homo sapiens
aauaauagacccagaugaa

SEQ ID NO: 853793 - RNA, 19 nt, Homo sapiens
uggagaauguggagaguga

SEQ ID NO: 853794 - RNA, 19 nt, Homo sapiens
ugcaggagcucuacaagga

SEQ ID NO: 853795 - RNA, 19 nt, Homo sapiens
ggaggucccugaucaagcu

SEQ ID NO: 853796 - RNA, 19 nt, Homo sapiens
ggagggagaagcagguuug

SEQ ID NO: 853797 - RNA, 19 nt, Homo sapiens
ggacccgucuuauuaucug

SEQ ID NO: 853798 - RNA, 19 nt, Homo sapiens
ccagaucucccacaaacaa

SEQ ID NO: 853799 - RNA, 19 nt, Homo sapiens
uggcaucgucuuugacuua

SEQ ID NO: 853800 - RNA, 19 nt, Homo sapiens
gugcugcgcuaccaguuug

SEQ ID NO: 853801 - RNA, 19 nt, Homo sapiens
uaauagacccagaugaaga

SEQ ID NO: 853802 - RNA, 19 nt, Homo sapiens
gaugaccacuagagguaug

SEQ ID NO: 853803 - RNA, 19 nt, Homo sapiens
guacauuaccugugcugaa

SEQ ID NO: 853804 - RNA, 19 nt, Homo sapiens
aaacugaccgcccuaagga

SEQ ID NO: 853805 - RNA, 19 nt, Homo sapiens
agacagcccucugcucuca

SEQ ID NO: 853806 - RNA, 19 nt, Homo sapiens
ggaagacacagcucaaggu

SEQ ID NO: 853807 - RNA, 19 nt, Homo sapiens
ggcccugacugacuguauu

SEQ ID NO: 853808 - RNA, 19 nt, Homo sapiens
gaucucccacaaacaaauu

SEQ ID NO: 853809 - RNA, 19 nt, Homo sapiens
ucacacagauaaggaccaa

SEQ ID NO: 853810 - RNA, 19 nt, Homo sapiens
caacaagggcgaccucaac

SEQ ID NO: 853811 - RNA, 19 nt, Homo sapiens
uacauuaccugugcugaau

SEQ ID NO: 853812 - RNA, 19 nt, Homo sapiens
ucucuaacuucuaucaugu

SEQ ID NO: 853813 - RNA, 19 nt, Homo sapiens
caaguucaaugucucuaac

SEQ ID NO: 853814 - RNA, 19 nt, Homo sapiens
gcaacaggucucaauucuu

SEQ ID NO: 853815 - RNA, 19 nt, Homo sapiens
ucaucaggcuuugcaagaa

SEQ ID NO: 853816 - RNA, 19 nt, Homo sapiens
agaagaaaguggacaagcu

SEQ ID NO: 853817 - RNA, 19 nt, Homo sapiens
gggaagcgacagcaccaaa

SEQ ID NO: 853818 - RNA, 19 nt, Homo sapiens
ggcacgauuuaaacauuug

SEQ ID NO: 853819 - RNA, 19 nt, Homo sapiens
caguggaacagcuaaauau

SEQ ID NO: 853820 - RNA, 19 nt, Homo sapiens
gcacaguaggacacaguga

SEQ ID NO: 853821 - RNA, 19 nt, Homo sapiens
guaccucugcccuuccuuu

SEQ ID NO: 853822 - RNA, 19 nt, Homo sapiens
caucaggcuuugcaagaag

SEQ ID NO: 853823 - RNA, 19 nt, Homo sapiens
ucuaacuucuaucauguga

SEQ ID NO: 853824 - RNA, 19 nt, Homo sapiens
aggaggagauccgcauuga

SEQ ID NO: 853825 - RNA, 19 nt, Homo sapiens
caaacaaauuuucgucguu

SEQ ID NO: 853826 - RNA, 19 nt, Homo sapiens
guggaacagcuaaauauca

SEQ ID NO: 853827 - RNA, 19 nt, Homo sapiens
ugacaucagaagcuuuauu

SEQ ID NO: 853828 - RNA, 19 nt, Homo sapiens
gcucuagagugacuuuuga

SEQ ID NO: 853829 - RNA, 19 nt, Homo sapiens
cagcaacaggucucaauuc

SEQ ID NO: 853830 - RNA, 19 nt, Homo sapiens
ggagaccacacaugaagca

SEQ ID NO: 853831 - RNA, 19 nt, Homo sapiens
uaaauaucaaggccaagaa

SEQ ID NO: 853832 - RNA, 19 nt, Homo sapiens
caucgucuuugacuuacug

SEQ ID NO: 853833 - RNA, 19 nt, Homo sapiens
agacccagaugaagagaag

SEQ ID NO: 853834 - RNA, 19 nt, Homo sapiens
cugaugaccacuagaggua

SEQ ID NO: 853835 - RNA, 19 nt, Homo sapiens
gacaagaagcauaccaucu

SEQ ID NO: 853836 - RNA, 19 nt, Homo sapiens
gaaaacuucaucaggcuuu

SEQ ID NO: 853837 - RNA, 19 nt, Homo sapiens
gucucuaacuucuaucaug

SEQ ID NO: 853838 - RNA, 19 nt, Homo sapiens
aagcugaacuuuuccaaga

SEQ ID NO: 853839 - RNA, 19 nt, Homo sapiens
cugcaggccugagcccuuu

SEQ ID NO: 853840 - RNA, 19 nt, Homo sapiens
gaagaagaaaguggacaag

SEQ ID NO: 853841 - RNA, 19 nt, Homo sapiens
uuugacaucagaagcuuua

SEQ ID NO: 853842 - RNA, 19 nt, Homo sapiens
gaaaauaauagacccagau

SEQ ID NO: 853843 - RNA, 19 nt, Homo sapiens
cuaaauaucaaggccaaga

SEQ ID NO: 853844 - RNA, 19 nt, Homo sapiens
gcacgauuuaaacauuuga

SEQ ID NO: 853845 - RNA, 19 nt, Homo sapiens
agggcacgauuuaaacauu

SEQ ID NO: 853846 - RNA, 19 nt, Homo sapiens
gugcagcccuggcaguaac

SEQ ID NO: 853847 - RNA, 19 nt, Homo sapiens
cugaauacacucacuuuua

SEQ ID NO: 853848 - RNA, 19 nt, Homo sapiens
gaagcauaccaucuuugga

SEQ ID NO: 853849 - RNA, 19 nt, Homo sapiens
acagauccauccggaacuu

SEQ ID NO: 853850 - RNA, 19 nt, Homo sapiens
gaaaguggacaagcugaac

SEQ ID NO: 853851 - RNA, 19 nt, Homo sapiens
caggacccgucuuauuauc

SEQ ID NO: 853852 - RNA, 19 nt, Homo sapiens
uuguaaaccucacacagau

SEQ ID NO: 853853 - RNA, 19 nt, Homo sapiens
ucaauucuucaucacguuu

SEQ ID NO: 853854 - RNA, 19 nt, Homo sapiens
uaucaaggccaagaacuuc

SEQ ID NO: 853855 - RNA, 19 nt, Homo sapiens
acugagggcacgauuuaaa

SEQ ID NO: 853856 - RNA, 19 nt, Homo sapiens
acugcgaccugacaccaaa

SEQ ID NO: 853857 - RNA, 19 nt, Homo sapiens
gaacgcugcccacuauucc

SEQ ID NO: 853858 - RNA, 19 nt, Homo sapiens
caaacaggacccgucuuau

SEQ ID NO: 853859 - RNA, 19 nt, Homo sapiens
acaaguucaaugucucuaa

SEQ ID NO: 853860 - RNA, 19 nt, Homo sapiens
ugaucaagcugaacuuuuc

SEQ ID NO: 853861 - RNA, 19 nt, Homo sapiens
ucacccugcugcacaccaa

SEQ ID NO: 853862 - RNA, 19 nt, Homo sapiens
guucaaugucucuaacuuc

SEQ ID NO: 853863 - RNA, 19 nt, Homo sapiens
caacgucuacgccuaugag

SEQ ID NO: 853864 - RNA, 19 nt, Homo sapiens
cauuaccugugcugaauac

SEQ ID NO: 853865 - RNA, 19 nt, Homo sapiens
uguaaaccucacacagaua

SEQ ID NO: 853866 - RNA, 19 nt, Homo sapiens
gaccagggagggagaagca

SEQ ID NO: 853867 - RNA, 19 nt, Homo sapiens
caacaggucucaauucuuc

SEQ ID NO: 853868 - RNA, 19 nt, Homo sapiens
gcaagaagcauuauuacga

SEQ ID NO: 853869 - RNA, 19 nt, Homo sapiens
gcugaacgcugcccacuau

SEQ ID NO: 853870 - RNA, 19 nt, Homo sapiens
ccacugagggcacgauuua

SEQ ID NO: 853871 - RNA, 19 nt, Homo sapiens
ccaaacaggacccgucuua

SEQ ID NO: 853872 - RNA, 19 nt, Homo sapiens
gaagacacagcucaaggua

SEQ ID NO: 853873 - RNA, 19 nt, Homo sapiens
caagaagcauuauuacgau

SEQ ID NO: 853874 - RNA, 19 nt, Homo sapiens
guaaaccucacacagauaa

SEQ ID NO: 853875 - RNA, 19 nt, Homo sapiens
gggcacgauuuaaacauuu

SEQ ID NO: 853876 - RNA, 19 nt, Homo sapiens
uuccauggcuuaagaagua

SEQ ID NO: 853877 - RNA, 19 nt, Homo sapiens
gaagccagaucucccacaa

SEQ ID NO: 853878 - RNA, 19 nt, Homo sapiens
gacaucagaagcuuuauuu

SEQ ID NO: 853879 - RNA, 19 nt, Homo sapiens
gaggagauccgcauugaug

SEQ ID NO: 853880 - RNA, 19 nt, Homo sapiens
ugacagccauggagaaugu

SEQ ID NO: 853881 - RNA, 19 nt, Homo sapiens
gcaguggaacagcuaaaua

SEQ ID NO: 853882 - RNA, 19 nt, Homo sapiens
ggaggccgaugcccagauu

SEQ ID NO: 853883 - RNA, 19 nt, Homo sapiens
aaacaggacccgucuuauu

SEQ ID NO: 853884 - RNA, 19 nt, Homo sapiens
caaugucucuaacuucuau

SEQ ID NO: 853885 - RNA, 19 nt, Homo sapiens
aacaggacccgucuuauua

SEQ ID NO: 853886 - RNA, 19 nt, Homo sapiens
gugccuaccuggacaagaa

SEQ ID NO: 853887 - RNA, 19 nt, Homo sapiens
gcuaccaguuugugaagaa

SEQ ID NO: 853888 - RNA, 19 nt, Homo sapiens
uguauucucuggccacauu

SEQ ID NO: 853889 - RNA, 19 nt, Homo sapiens
uggaacagcuaaauaucaa

SEQ ID NO: 853890 - RNA, 19 nt, Homo sapiens
caucagaagcuuuauuugu

SEQ ID NO: 853891 - RNA, 19 nt, Homo sapiens
aauaauagacccagaugaa

SEQ ID NO: 853892 - RNA, 19 nt, Homo sapiens
uggagaauguggagaguga

SEQ ID NO: 853893 - RNA, 19 nt, Homo sapiens
ugcaggagcucuacaagga

SEQ ID NO: 853894 - RNA, 19 nt, Homo sapiens
ggaggucccugaucaagcu

SEQ ID NO: 853895 - RNA, 19 nt, Homo sapiens
ggagggagaagcagguuug

SEQ ID NO: 853896 - RNA, 19 nt, Homo sapiens
ggacccgucuuauuaucug

SEQ ID NO: 853897 - RNA, 19 nt, Homo sapiens
ccagaucucccacaaacaa

SEQ ID NO: 853898 - RNA, 19 nt, Homo sapiens
uggcaucgucuuugacuua

SEQ ID NO: 853899 - RNA, 19 nt, Homo sapiens
gugcugcgcuaccaguuug

SEQ ID NO: 853900 - RNA, 19 nt, Homo sapiens
uaauagacccagaugaaga

SEQ ID NO: 853901 - RNA, 19 nt, Homo sapiens
gaugaccacuagagguaug

SEQ ID NO: 853902 - RNA, 19 nt, Homo sapiens
guacauuaccugugcugaa

SEQ ID NO: 853903 - RNA, 19 nt, Homo sapiens
aaacugaccgcccuaagga

SEQ ID NO: 853904 - RNA, 19 nt, Homo sapiens
agacagcccucugcucuca

SEQ ID NO: 853905 - RNA, 19 nt, Homo sapiens
ggaagacacagcucaaggu

SEQ ID NO: 853906 - RNA, 19 nt, Homo sapiens
ggcccugacugacuguauu

SEQ ID NO: 853907 - RNA, 19 nt, Homo sapiens
ccaccgagcagcagaggaa

SEQ ID NO: 853908 - RNA, 19 nt, Homo sapiens
gaucucccacaaacaaauu

SEQ ID NO: 853909 - RNA, 19 nt, Homo sapiens
ucacacagauaaggaccaa

SEQ ID NO: 853910 - RNA, 19 nt, Homo sapiens
caacaagggcgaccucaac

SEQ ID NO: 853911 - RNA, 19 nt, Homo sapiens
ucucuaacuucuaucaugu

SEQ ID NO: 853912 - RNA, 19 nt, Homo sapiens
caaguucaaugucucuaac

SEQ ID NO: 853913 - RNA, 19 nt, Homo sapiens
uacauuaccugugcugaau

SEQ ID NO: 853914 - RNA, 19 nt, Homo sapiens
gcaacaggucucaauucuu

SEQ ID NO: 853915 - RNA, 19 nt, Homo sapiens
ucaucaggcuuugcaagaa

SEQ ID NO: 853916 - RNA, 19 nt, Homo sapiens
agaagaaaguggacaagcu

SEQ ID NO: 853917 - RNA, 19 nt, Homo sapiens
ggcacgauuuaaacauuug

SEQ ID NO: 853918 - RNA, 19 nt, Homo sapiens
gggaagcgacagcaccaaa

SEQ ID NO: 853919 - RNA, 19 nt, Homo sapiens
caguggaacagcuaaauau

SEQ ID NO: 853920 - RNA, 19 nt, Homo sapiens
gcacaguaggacacaguga

SEQ ID NO: 853921 - RNA, 19 nt, Homo sapiens
caucaggcuuugcaagaag

SEQ ID NO: 853922 - RNA, 19 nt, Homo sapiens
ucuaacuucuaucauguga

SEQ ID NO: 853923 - RNA, 19 nt, Homo sapiens
aggaggagauccgcauuga

SEQ ID NO: 853924 - RNA, 19 nt, Homo sapiens
guggaacagcuaaauauca

SEQ ID NO: 853925 - RNA, 19 nt, Homo sapiens
caaacaaauuuucgucguu

SEQ ID NO: 853926 - RNA, 19 nt, Homo sapiens
ugacaucagaagcuuuauu

SEQ ID NO: 853927 - RNA, 19 nt, Homo sapiens
gcucuagagugacuuuuga

SEQ ID NO: 853928 - RNA, 19 nt, Homo sapiens
cagcaacaggucucaauuc

SEQ ID NO: 853929 - RNA, 19 nt, Homo sapiens
ggagaccacacaugaagca

SEQ ID NO: 853930 - RNA, 19 nt, Homo sapiens
uaaauaucaaggccaagaa

SEQ ID NO: 853931 - RNA, 19 nt, Homo sapiens
caucgucuuugacuuacug

SEQ ID NO: 853932 - RNA, 19 nt, Homo sapiens
agacccagaugaagagaag

SEQ ID NO: 853933 - RNA, 19 nt, Homo sapiens
cugaugaccacuagaggua

SEQ ID NO: 853934 - RNA, 19 nt, Homo sapiens
gacaagaagcauaccaucu

SEQ ID NO: 853935 - RNA, 19 nt, Homo sapiens
gaaaacuucaucaggcuuu

SEQ ID NO: 853936 - RNA, 19 nt, Homo sapiens
gucucuaacuucuaucaug

SEQ ID NO: 853937 - RNA, 19 nt, Homo sapiens
aagcugaacuuuuccaaga

SEQ ID NO: 853938 - RNA, 19 nt, Homo sapiens
gaagaagaaaguggacaag

SEQ ID NO: 853939 - RNA, 19 nt, Homo sapiens
uuugacaucagaagcuuua

SEQ ID NO: 853940 - RNA, 19 nt, Homo sapiens
gaaaauaauagacccagau

SEQ ID NO: 853941 - RNA, 19 nt, Homo sapiens
cuaaauaucaaggccaaga

SEQ ID NO: 853942 - RNA, 19 nt, Homo sapiens
gcacgauuuaaacauuuga

SEQ ID NO: 853943 - RNA, 19 nt, Homo sapiens
agggcacgauuuaaacauu

SEQ ID NO: 853944 - RNA, 19 nt, Homo sapiens
gugcagcccuggcaguaac

SEQ ID NO: 853945 - RNA, 19 nt, Homo sapiens
cugaauacacucacuuuua

SEQ ID NO: 853946 - RNA, 19 nt, Homo sapiens
gaagcauaccaucuuugga

SEQ ID NO: 853947 - RNA, 19 nt, Homo sapiens
acagauccauccggaacuu

SEQ ID NO: 853948 - RNA, 19 nt, Homo sapiens
gaaaguggacaagcugaac

SEQ ID NO: 853949 - RNA, 19 nt, Homo sapiens
caggacccgucuuauuauc

SEQ ID NO: 853950 - RNA, 19 nt, Homo sapiens
uuguaaaccucacacagau

SEQ ID NO: 853951 - RNA, 19 nt, Homo sapiens
ucaauucuucaucacguuu

SEQ ID NO: 853952 - RNA, 19 nt, Homo sapiens
uaucaaggccaagaacuuc

SEQ ID NO: 853953 - RNA, 19 nt, Homo sapiens
acugagggcacgauuuaaa

SEQ ID NO: 853954 - RNA, 19 nt, Homo sapiens
acugcgaccugacaccaaa

SEQ ID NO: 853955 - RNA, 19 nt, Homo sapiens
gaacgcugcccacuauucc

SEQ ID NO: 853956 - RNA, 19 nt, Homo sapiens
caaacaggacccgucuuau

SEQ ID NO: 853957 - RNA, 19 nt, Homo sapiens
acaaguucaaugucucuaa

SEQ ID NO: 853958 - RNA, 19 nt, Homo sapiens
ugaucaagcugaacuuuuc

SEQ ID NO: 853959 - RNA, 19 nt, Homo sapiens
ucacccugcugcacaccaa

SEQ ID NO: 853960 - RNA, 19 nt, Homo sapiens
cauuaccugugcugaauac

SEQ ID NO: 853961 - RNA, 19 nt, Homo sapiens
guucaaugucucuaacuuc

SEQ ID NO: 853962 - RNA, 19 nt, Homo sapiens
caacgucuacgccuaugag

SEQ ID NO: 853963 - RNA, 19 nt, Homo sapiens
uguaaaccucacacagaua

SEQ ID NO: 853964 - RNA, 19 nt, Homo sapiens
gaccagggagggagaagca

SEQ ID NO: 853965 - RNA, 19 nt, Homo sapiens
agccagaucucccacaaac

SEQ ID NO: 853966 - RNA, 19 nt, Homo sapiens
agaagaagaaaguggacaa

SEQ ID NO: 853967 - RNA, 19 nt, Homo sapiens
ccucagagcucacaugaua

SEQ ID NO: 853968 - RNA, 19 nt, Homo sapiens
gaacaauuguaacgaauga

SEQ ID NO: 853969 - RNA, 19 nt, Homo sapiens
cgaggaagauuauugcuaa

SEQ ID NO: 853970 - RNA, 19 nt, Homo sapiens
ggaaggauguguaggauca

SEQ ID NO: 853971 - RNA, 19 nt, Homo sapiens
gaugacgguuucugauuua

SEQ ID NO: 853972 - RNA, 19 nt, Homo sapiens
gauguaaacucugaaugua

SEQ ID NO: 853973 - RNA, 19 nt, Homo sapiens
gcauaugucuguagcugua

SEQ ID NO: 853974 - RNA, 19 nt, Homo sapiens
gauaggauauaguuaguga

SEQ ID NO: 853975 - RNA, 19 nt, Homo sapiens
gaaugaaccuuaugagaag

SEQ ID NO: 853976 - RNA, 19 nt, Homo sapiens
uaacaacuguggagauuug

SEQ ID NO: 853977 - RNA, 19 nt, Homo sapiens
agaaggaauugaagucuua

SEQ ID NO: 853978 - RNA, 19 nt, Homo sapiens
gagcucacaugauaggaua

SEQ ID NO: 853979 - RNA, 19 nt, Homo sapiens
caaugaaucugggauguaa

SEQ ID NO: 853980 - RNA, 19 nt, Homo sapiens
agaagaaucugaccaguau

SEQ ID NO: 853981 - RNA, 19 nt, Homo sapiens
gcaguagacucccacagaa

SEQ ID NO: 853982 - RNA, 19 nt, Homo sapiens
gaagggauuaguacaauuu

SEQ ID NO: 853983 - RNA, 19 nt, Homo sapiens
gcagauagaagucaaguug

SEQ ID NO: 853984 - RNA, 19 nt, Homo sapiens
gacgguuucugauuuauaa

SEQ ID NO: 853985 - RNA, 19 nt, Homo sapiens
gcauugcaauacccuguua

SEQ ID NO: 853986 - RNA, 19 nt, Homo sapiens
ccuggaagcuugaauagaa

SEQ ID NO: 853987 - RNA, 19 nt, Homo sapiens
guagaacaauuguaacgaa

SEQ ID NO: 853988 - RNA, 19 nt, Homo sapiens
cuacaaagcugaugaagac

SEQ ID NO: 853989 - RNA, 19 nt, Homo sapiens
ggaaauauagcacuucaug

SEQ ID NO: 853990 - RNA, 19 nt, Homo sapiens
ugacugcaauguaauacua

SEQ ID NO: 853991 - RNA, 19 nt, Homo sapiens
aaaguaaggagcaaaguua

SEQ ID NO: 853992 - RNA, 19 nt, Homo sapiens
gaugugcucucaaguagga

SEQ ID NO: 853993 - RNA, 19 nt, Homo sapiens
gggaauguguggugaaugu

SEQ ID NO: 853994 - RNA, 19 nt, Homo sapiens
ugagagugcuggucagaaa

SEQ ID NO: 853995 - RNA, 19 nt, Homo sapiens
gcacaaaauuuaucaccua

SEQ ID NO: 853996 - RNA, 19 nt, Homo sapiens
gaauaggcaucaugagagu

SEQ ID NO: 853997 - RNA, 19 nt, Homo sapiens
ccacguguguauauaugua

SEQ ID NO: 853998 - RNA, 19 nt, Homo sapiens
gcuggcaucuguaguauca

SEQ ID NO: 853999 - RNA, 19 nt, Homo sapiens
ggaagauggugcugaucaa

SEQ ID NO: 854000 - RNA, 19 nt, Homo sapiens
gauagugacuuugagauag

SEQ ID NO: 854001 - RNA, 19 nt, Homo sapiens
caaacacauugaugaagaa

SEQ ID NO: 854002 - RNA, 19 nt, Homo sapiens
acaaacacauugaugaaga

SEQ ID NO: 854003 - RNA, 19 nt, Homo sapiens
gaaagaacuagaaacaaug

SEQ ID NO: 854004 - RNA, 19 nt, Homo sapiens
gagaaggaauugaagucuu

SEQ ID NO: 854005 - RNA, 19 nt, Homo sapiens
gaacaagcgcagccaguga

SEQ ID NO: 854006 - RNA, 19 nt, Homo sapiens
ggaagaaggagcuggcaaa

SEQ ID NO: 854007 - RNA, 19 nt, Homo sapiens
gccagucucuuguguaaau

SEQ ID NO: 854008 - RNA, 19 nt, Homo sapiens
gauaggaacaguuuaagau

SEQ ID NO: 854009 - RNA, 19 nt, Homo sapiens
gucuguagcuguauauaaa

SEQ ID NO: 854010 - RNA, 19 nt, Homo sapiens
gcagucaaaucacauuagu

SEQ ID NO: 854011 - RNA, 19 nt, Homo sapiens
ugaugaagacccagcauua

SEQ ID NO: 854012 - RNA, 19 nt, Homo sapiens
ggauggucauuaucuugua

SEQ ID NO: 854013 - RNA, 19 nt, Homo sapiens
uaagauagguuuugucaga

SEQ ID NO: 854014 - RNA, 19 nt, Homo sapiens
cauaaucauugucugcaaa

SEQ ID NO: 854015 - RNA, 19 nt, Homo sapiens
gaacaauagcuagguaaga

SEQ ID NO: 854016 - RNA, 19 nt, Homo sapiens
gggaugugcucucaaguag

SEQ ID NO: 854017 - RNA, 19 nt, Homo sapiens
guacauacagacauacuga

SEQ ID NO: 854018 - RNA, 19 nt, Homo sapiens
agaaugaaccuuaugagaa

SEQ ID NO: 854019 - RNA, 19 nt, Homo sapiens
gaauguguggugaauguaa

SEQ ID NO: 854020 - RNA, 19 nt, Homo sapiens
ugucagagcauaaucauug

SEQ ID NO: 854021 - RNA, 19 nt, Homo sapiens
cagaaacggcugccacuuu

SEQ ID NO: 854022 - RNA, 19 nt, Homo sapiens
gaggagauagugacuuuga

SEQ ID NO: 854023 - RNA, 19 nt, Homo sapiens
guagccaaauuugacaaua

SEQ ID NO: 854024 - RNA, 19 nt, Homo sapiens
guacaauuucuccaaagua

SEQ ID NO: 854025 - RNA, 19 nt, Homo sapiens
uaaagcgcauguagagcua

SEQ ID NO: 854026 - RNA, 19 nt, Homo sapiens
ggaaaacuguugaaauugu

SEQ ID NO: 854027 - RNA, 19 nt, Homo sapiens
guacaugguuuagauccaa

SEQ ID NO: 854028 - RNA, 19 nt, Homo sapiens
gauuguaggcuguguagaa

SEQ ID NO: 854029 - RNA, 19 nt, Homo sapiens
agaugacgguuucugauuu

SEQ ID NO: 854030 - RNA, 19 nt, Homo sapiens
gagaugacgguuucugauu

SEQ ID NO: 854031 - RNA, 19 nt, Homo sapiens
ggauguaaacucugaaugu

SEQ ID NO: 854032 - RNA, 19 nt, Homo sapiens
gaugugugcuugugaugau

SEQ ID NO: 854033 - RNA, 19 nt, Homo sapiens
agaaggagcuggcaaacag

SEQ ID NO: 854034 - RNA, 19 nt, Homo sapiens
cauguucuguucaggagua

SEQ ID NO: 854035 - RNA, 19 nt, Homo sapiens
ugagauaggaacaguuuaa

SEQ ID NO: 854036 - RNA, 19 nt, Homo sapiens
caaaguuacaggccaguuu

SEQ ID NO: 854037 - RNA, 19 nt, Homo sapiens
acacacacaugcacagguu

SEQ ID NO: 854038 - RNA, 19 nt, Homo sapiens
uaggaucacuacugcauug

SEQ ID NO: 854039 - RNA, 19 nt, Homo sapiens
ggaagcuugaauagaauua

SEQ ID NO: 854040 - RNA, 19 nt, Homo sapiens
aggaggagauagugacuuu

SEQ ID NO: 854041 - RNA, 19 nt, Homo sapiens
agacgagacucagaaagaa

SEQ ID NO: 854042 - RNA, 19 nt, Homo sapiens
ggaagacgagacucagaaa

SEQ ID NO: 854043 - RNA, 19 nt, Homo sapiens
gagcuuaggcgcacaugga

SEQ ID NO: 854044 - RNA, 19 nt, Homo sapiens
gcauaaucauugucugcaa

SEQ ID NO: 854045 - RNA, 19 nt, Homo sapiens
caauagcuagguaagauuu

SEQ ID NO: 854046 - RNA, 19 nt, Homo sapiens
gcacgucggcugcugaugu

SEQ ID NO: 854047 - RNA, 19 nt, Homo sapiens
gagcaaagugccugcauuc

SEQ ID NO: 854048 - RNA, 19 nt, Homo sapiens
ucuaacaacuguggagauu

SEQ ID NO: 854049 - RNA, 19 nt, Homo sapiens
gagucuagcccucuccuuu

SEQ ID NO: 854050 - RNA, 19 nt, Homo sapiens
caacaaaacccacauuuca

SEQ ID NO: 854051 - RNA, 19 nt, Homo sapiens
caaggaaggauguguagga

SEQ ID NO: 854052 - RNA, 19 nt, Homo sapiens
ggagauagugacuuugaga

SEQ ID NO: 854053 - RNA, 19 nt, Homo sapiens
aaauggagaugacgguuuc

SEQ ID NO: 854054 - RNA, 19 nt, Homo sapiens
gcuccuugguguuucauga

SEQ ID NO: 854055 - RNA, 19 nt, Homo sapiens
agacugauguuuacucucu

SEQ ID NO: 854056 - RNA, 19 nt, Homo sapiens
cagaagcuaguaagaauga

SEQ ID NO: 854057 - RNA, 19 nt, Homo sapiens
ccaagagacugguggacau

SEQ ID NO: 854058 - RNA, 19 nt, Homo sapiens
ucaaccacguguguauaua

SEQ ID NO: 854059 - RNA, 19 nt, Homo sapiens
ucagaaagaacuagaaaca

SEQ ID NO: 854060 - RNA, 19 nt, Homo sapiens
gggcagcuuuacucuguug

SEQ ID NO: 854061 - RNA, 19 nt, Homo sapiens
aaauauagcacuucaugga

SEQ ID NO: 854062 - RNA, 19 nt, Homo sapiens
gagggaauguguggugaau

SEQ ID NO: 854063 - RNA, 19 nt, Homo sapiens
gcgcauggauuuuaauguu

SEQ ID NO: 854064 - RNA, 19 nt, Homo sapiens
ggaacacacacuucaagga

SEQ ID NO: 854065 - RNA, 19 nt, Homo sapiens
uaaaguaaggagcaaaguu

SEQ ID NO: 854066 - RNA, 19 nt, Homo sapiens
ugaagggauuaguacaauu

SEQ ID NO: 854067 - RNA, 19 nt, Homo sapiens
gggcaaagcuggauucauu

SEQ ID NO: 854068 - RNA, 19 nt, Homo sapiens
ggagagacaucauugaauu

SEQ ID NO: 854069 - RNA, 19 nt, Homo sapiens
gaaaguugcugcuauugau

SEQ ID NO: 854070 - RNA, 19 nt, Homo sapiens
ggagacuucugaacaguaa

SEQ ID NO: 854071 - RNA, 19 nt, Homo sapiens
ggaaggauccucaacuuug

SEQ ID NO: 854072 - RNA, 19 nt, Homo sapiens
gaacagugauaaagacaag

SEQ ID NO: 854073 - RNA, 19 nt, Homo sapiens
ccacauaucccuacaugaa

SEQ ID NO: 854074 - RNA, 19 nt, Homo sapiens
ugaugacacugauuaauga

SEQ ID NO: 854075 - RNA, 19 nt, Homo sapiens
ggaaugaucucagucacau

SEQ ID NO: 854076 - RNA, 19 nt, Homo sapiens
gcccacagcuggugauaug

SEQ ID NO: 854077 - RNA, 19 nt, Homo sapiens
ggaagggaaugagcucuau

SEQ ID NO: 854078 - RNA, 19 nt, Homo sapiens
gaaggauccucaacuuugg

SEQ ID NO: 854079 - RNA, 19 nt, Homo sapiens
ggaaaguugcugcuauuga

SEQ ID NO: 854080 - RNA, 19 nt, Homo sapiens
caugaaauaugggaaaguu

SEQ ID NO: 854081 - RNA, 19 nt, Homo sapiens
gcagaacagugauaaagac

SEQ ID NO: 854082 - RNA, 19 nt, Homo sapiens
ggacucugcuagugucuuc

SEQ ID NO: 854083 - RNA, 19 nt, Homo sapiens
acacugaugacacugauua

SEQ ID NO: 854084 - RNA, 19 nt, Homo sapiens
gcaagggcuccuacaauga

SEQ ID NO: 854085 - RNA, 19 nt, Homo sapiens
ccagguaggacuugaauga

SEQ ID NO: 854086 - RNA, 19 nt, Homo sapiens
uggaggaccugcaucacua

SEQ ID NO: 854087 - RNA, 19 nt, Homo sapiens
gaccgaaccuucaguuggu

SEQ ID NO: 854088 - RNA, 19 nt, Homo sapiens
gagagacaucauugaauuu

SEQ ID NO: 854089 - RNA, 19 nt, Homo sapiens
ccacacagccuucgugaca

SEQ ID NO: 854090 - RNA, 19 nt, Homo sapiens
gauaaagacaaggaucuaa

SEQ ID NO: 854091 - RNA, 19 nt, Homo sapiens
ggacagggccagauuucau

SEQ ID NO: 854092 - RNA, 19 nt, Homo sapiens
ggacacugaugacacugau

SEQ ID NO: 854093 - RNA, 19 nt, Homo sapiens
gaaacauggcuucuucuca

SEQ ID NO: 854094 - RNA, 19 nt, Homo sapiens
ucacugaaccugccucaug

SEQ ID NO: 854095 - RNA, 19 nt, Homo sapiens
caccucauccugcucuuua

SEQ ID NO: 854096 - RNA, 19 nt, Homo sapiens
ccaccgagacugaaccaaa

SEQ ID NO: 854097 - RNA, 19 nt, Homo sapiens
ugggaaaguugcugcuauu

SEQ ID NO: 854098 - RNA, 19 nt, Homo sapiens
ugacacugauuaaugauac

SEQ ID NO: 854099 - RNA, 19 nt, Homo sapiens
agaagaggcagaacaguga

SEQ ID NO: 854100 - RNA, 19 nt, Homo sapiens
gcaggagagacaucauuga

SEQ ID NO: 854101 - RNA, 19 nt, Homo sapiens
gacccuugguggauaguug

SEQ ID NO: 854102 - RNA, 19 nt, Homo sapiens
agaggacccuugguggaua

SEQ ID NO: 854103 - RNA, 19 nt, Homo sapiens
ccucauggcaccagaguga

SEQ ID NO: 854104 - RNA, 19 nt, Homo sapiens
gauuaaugauacagaccuu

SEQ ID NO: 854105 - RNA, 19 nt, Homo sapiens
agcaagggcuccuacaaug

SEQ ID NO: 854106 - RNA, 19 nt, Homo sapiens
ggaucuaaaugggcaagga

SEQ ID NO: 854107 - RNA, 19 nt, Homo sapiens
caggagagacaucauugaa

SEQ ID NO: 854108 - RNA, 19 nt, Homo sapiens
acauaucccuacaugaaau

SEQ ID NO: 854109 - RNA, 19 nt, Homo sapiens
agguaggacuugaaugauu

SEQ ID NO: 854110 - RNA, 19 nt, Homo sapiens
ccaaggacuucaauuucca

SEQ ID NO: 854111 - RNA, 19 nt, Homo sapiens
ccauucgcaucuacuuuga

SEQ ID NO: 854112 - RNA, 19 nt, Homo sapiens
gcaggguggcuuuguacaa

SEQ ID NO: 854113 - RNA, 19 nt, Homo sapiens
uggcagcccugacccucua

SEQ ID NO: 854114 - RNA, 19 nt, Homo sapiens
cagcaagggcuccuacaau

SEQ ID NO: 854115 - RNA, 19 nt, Homo sapiens
cuggaaacauggcuucuuc

SEQ ID NO: 854116 - RNA, 19 nt, Homo sapiens
gggagacuucugaacagua

SEQ ID NO: 854117 - RNA, 19 nt, Homo sapiens
ggcagaacagugauaaaga

SEQ ID NO: 854118 - RNA, 19 nt, Homo sapiens
gggaagggaaugagcucua

SEQ ID NO: 854119 - RNA, 19 nt, Homo sapiens
gaggaaagaggaaaacaaa

SEQ ID NO: 854120 - RNA, 19 nt, Homo sapiens
gggccagauuucauguuga

SEQ ID NO: 854121 - RNA, 19 nt, Homo sapiens
cuacaugaaauaugggaaa

SEQ ID NO: 854122 - RNA, 19 nt, Homo sapiens
cccaucaccugagcuguuu

SEQ ID NO: 854123 - RNA, 19 nt, Homo sapiens
cauggcuucuucucacuga

SEQ ID NO: 854124 - RNA, 19 nt, Homo sapiens
caugaggccauccagguaa

SEQ ID NO: 854125 - RNA, 19 nt, Homo sapiens
ccaugaggccauccaggua

SEQ ID NO: 854126 - RNA, 19 nt, Homo sapiens
aaacagagugagggucuuu

SEQ ID NO: 854127 - RNA, 19 nt, Homo sapiens
gaggacccuugguggauag

SEQ ID NO: 854128 - RNA, 19 nt, Homo sapiens
ugaggacacugaugacacu

SEQ ID NO: 854129 - RNA, 19 nt, Homo sapiens
caccugagcuguuuucugu

SEQ ID NO: 854130 - RNA, 19 nt, Homo sapiens
gaaugagcucuaucacugu

SEQ ID NO: 854131 - RNA, 19 nt, Homo sapiens
gggaugcugugaauuucuc

SEQ ID NO: 854132 - RNA, 19 nt, Homo sapiens
ucauccugcucuuuagaaa

SEQ ID NO: 854133 - RNA, 19 nt, Homo sapiens
ucaagagggaggcccauga

SEQ ID NO: 854134 - RNA, 19 nt, Homo sapiens
gagucucuuuccugauuau

SEQ ID NO: 854135 - RNA, 19 nt, Homo sapiens
gacagggccagauuucaug

SEQ ID NO: 854136 - RNA, 19 nt, Homo sapiens
cauaucccuacaugaaaua

SEQ ID NO: 854137 - RNA, 19 nt, Homo sapiens
gcaggcaagaccaaucaau

SEQ ID NO: 854138 - RNA, 19 nt, Homo sapiens
uugggagucugaccaggua

SEQ ID NO: 854139 - RNA, 19 nt, Homo sapiens
ggacagaaaauccgcuuug

SEQ ID NO: 854140 - RNA, 19 nt, Homo sapiens
ugacgcacaccaauagaga

SEQ ID NO: 854141 - RNA, 19 nt, Homo sapiens
ggaaacauggcuucuucuc

SEQ ID NO: 854142 - RNA, 19 nt, Homo sapiens
ggcaaagcuggauucauuu

SEQ ID NO: 854143 - RNA, 19 nt, Homo sapiens
caggguggcuuuguacaag

SEQ ID NO: 854144 - RNA, 19 nt, Homo sapiens
aaacaaagggagugaucga

SEQ ID NO: 854145 - RNA, 19 nt, Homo sapiens
uggaaaaccugucccaguu

SEQ ID NO: 854146 - RNA, 19 nt, Homo sapiens
gcaaagcuggauucauuuu

SEQ ID NO: 854147 - RNA, 19 nt, Homo sapiens
cugaugacacugauuaaug

SEQ ID NO: 854148 - RNA, 19 nt, Homo sapiens
ggccugcacagcgugauua

SEQ ID NO: 854149 - RNA, 19 nt, Homo sapiens
cacauaucccuacaugaaa

SEQ ID NO: 854150 - RNA, 19 nt, Homo sapiens
gacggaagagccugcauuc

SEQ ID NO: 854151 - RNA, 19 nt, Homo sapiens
gaucucagucacauuugga

SEQ ID NO: 854152 - RNA, 19 nt, Homo sapiens
aaagacaaggaucuaaaug

SEQ ID NO: 854153 - RNA, 19 nt, Homo sapiens
gaaaacaggacagaaaauc

SEQ ID NO: 854154 - RNA, 19 nt, Homo sapiens
accgggaccugcacacaaa

SEQ ID NO: 854155 - RNA, 19 nt, Homo sapiens
ggccagauuucauguugac

SEQ ID NO: 854156 - RNA, 19 nt, Homo sapiens
cagcaggcaagaccaauca

SEQ ID NO: 854157 - RNA, 19 nt, Homo sapiens
uuaaugauacagaccuuug

SEQ ID NO: 854158 - RNA, 19 nt, Homo sapiens
ccacagcuggugauaugga

SEQ ID NO: 854159 - RNA, 19 nt, Homo sapiens
gaccagguaggacuugaau

SEQ ID NO: 854160 - RNA, 19 nt, Homo sapiens
gaccgggaccugcacacaa

SEQ ID NO: 854161 - RNA, 19 nt, Homo sapiens
gagcucuucugccauaacg

SEQ ID NO: 854162 - RNA, 19 nt, Homo sapiens
cuguacaucuggacguuug

SEQ ID NO: 854163 - RNA, 19 nt, Homo sapiens
gcaagaccaaucaaucacu

SEQ ID NO: 854164 - RNA, 19 nt, Homo sapiens
ugauaaagacaaggaucua

SEQ ID NO: 854165 - RNA, 19 nt, Homo sapiens
uggaaggauccucaacuuu

SEQ ID NO: 854166 - RNA, 19 nt, Homo sapiens
caccgagacugaaccaaac

SEQ ID NO: 854167 - RNA, 19 nt, Homo sapiens
gaacauguacuacuucuca

SEQ ID NO: 854168 - RNA, 19 nt, Homo sapiens
gaagauaccgaguacuuug

SEQ ID NO: 854169 - RNA, 19 nt, Homo sapiens
gaagagcaccucaacuguu

SEQ ID NO: 854170 - RNA, 19 nt, Homo sapiens
gagcucagcagacaaugua

SEQ ID NO: 854171 - RNA, 19 nt, Homo sapiens
ugacaggaguggugaguga

SEQ ID NO: 854172 - RNA, 19 nt, Homo sapiens
guacuuugaugccauggaa

SEQ ID NO: 854173 - RNA, 19 nt, Homo sapiens
aagcaagacuggcauaugu

SEQ ID NO: 854174 - RNA, 19 nt, Homo sapiens
gaaaauacaucuccaucau

SEQ ID NO: 854175 - RNA, 19 nt, Homo sapiens
gcccaaggguucauccaaa

SEQ ID NO: 854176 - RNA, 19 nt, Homo sapiens
ggaggacucuugugguauc

SEQ ID NO: 854177 - RNA, 19 nt, Homo sapiens
ggagauggccuguguguac

SEQ ID NO: 854178 - RNA, 19 nt, Homo sapiens
ggaagcagaagacagugua

SEQ ID NO: 854179 - RNA, 19 nt, Homo sapiens
gcuccaaggucaugcauag

SEQ ID NO: 854180 - RNA, 19 nt, Homo sapiens
ugacagaggaccuggagua

SEQ ID NO: 854181 - RNA, 19 nt, Homo sapiens
ggacucuugugguaucuug

SEQ ID NO: 854182 - RNA, 19 nt, Homo sapiens
gcgccacccuugcaacaaa

SEQ ID NO: 854183 - RNA, 19 nt, Homo sapiens
gcuaggugccauccacuua

SEQ ID NO: 854184 - RNA, 19 nt, Homo sapiens
gcacuuggaggaaaccauu

SEQ ID NO: 854185 - RNA, 19 nt, Homo sapiens
cggagaacauguacuacuu

SEQ ID NO: 854186 - RNA, 19 nt, Homo sapiens
ggacagugaggaagaugaa

SEQ ID NO: 854187 - RNA, 19 nt, Homo sapiens
gaagguagcaccgggacaa

SEQ ID NO: 854188 - RNA, 19 nt, Homo sapiens
ccucuugacucccaaagga

SEQ ID NO: 854189 - RNA, 19 nt, Homo sapiens
gaaucuuucccugaaguua

SEQ ID NO: 854190 - RNA, 19 nt, Homo sapiens
gaagcaagacuggcauaug

SEQ ID NO: 854191 - RNA, 19 nt, Homo sapiens
ggaagagcaccucaacugu

SEQ ID NO: 854192 - RNA, 19 nt, Homo sapiens
cagaggaccuggaguacca

SEQ ID NO: 854193 - RNA, 19 nt, Homo sapiens
cuacagaaaucagggugaa

SEQ ID NO: 854194 - RNA, 19 nt, Homo sapiens
ggagaacgcggagaacaug

SEQ ID NO: 854195 - RNA, 19 nt, Homo sapiens
ccaagcugcuguggaagaa

SEQ ID NO: 854196 - RNA, 19 nt, Homo sapiens
aagagcaccucaacuguuc

SEQ ID NO: 854197 - RNA, 19 nt, Homo sapiens
acggaggacucuuguggua

SEQ ID NO: 854198 - RNA, 19 nt, Homo sapiens
gagaagcaagacuggcaua

SEQ ID NO: 854199 - RNA, 19 nt, Homo sapiens
gagucaagcucagguguag

SEQ ID NO: 854200 - RNA, 19 nt, Homo sapiens
gagauacacagucggaaau

SEQ ID NO: 854201 - RNA, 19 nt, Homo sapiens
aagcccaacuacagccuua

SEQ ID NO: 854202 - RNA, 19 nt, Homo sapiens
gagaggacagugaggaaga

SEQ ID NO: 854203 - RNA, 19 nt, Homo sapiens
gcagggacuucuuggaacu

SEQ ID NO: 854204 - RNA, 19 nt, Homo sapiens
ccaaaggagaggacaguga

SEQ ID NO: 854205 - RNA, 19 nt, Homo sapiens
gagauggccuguguguaca

SEQ ID NO: 854206 - RNA, 19 nt, Homo sapiens
ucgagauugugaaccauaa

SEQ ID NO: 854207 - RNA, 19 nt, Homo sapiens
ggagaacauguacuacuuc

SEQ ID NO: 854208 - RNA, 19 nt, Homo sapiens
cuacagcuacuucuccaaa

SEQ ID NO: 854209 - RNA, 19 nt, Homo sapiens
gcagacaauguacuagaug

SEQ ID NO: 854210 - RNA, 19 nt, Homo sapiens
gagcgcgaccuuucucaga

SEQ ID NO: 854211 - RNA, 19 nt, Homo sapiens
ccaacaagcccaacuacag

SEQ ID NO: 854212 - RNA, 19 nt, Homo sapiens
gguagcaccgggacaaguu

SEQ ID NO: 854213 - RNA, 19 nt, Homo sapiens
gaacuagcagagauacaca

SEQ ID NO: 854214 - RNA, 19 nt, Homo sapiens
gagcuggacggccucaaga

SEQ ID NO: 854215 - RNA, 19 nt, Homo sapiens
gaccucagcacgugcaaug

SEQ ID NO: 854216 - RNA, 19 nt, Homo sapiens
acagcuacuucuccaaaga

SEQ ID NO: 854217 - RNA, 19 nt, Homo sapiens
gagauugugaaccauaaga

SEQ ID NO: 854218 - RNA, 19 nt, Homo sapiens
gcaccucaacuguucacaa

SEQ ID NO: 854219 - RNA, 19 nt, Homo sapiens
gaucaccgaggccaaggaa

SEQ ID NO: 854220 - RNA, 19 nt, Homo sapiens
ucaaguggaccaacuaucu

SEQ ID NO: 854221 - RNA, 19 nt, Homo sapiens
cuuaaccucuggagcauca

SEQ ID NO: 854222 - RNA, 19 nt, Homo sapiens
gacuggagcucagcagaca

SEQ ID NO: 854223 - RNA, 19 nt, Homo sapiens
ggacaucgagauugugaac

SEQ ID NO: 854224 - RNA, 19 nt, Homo sapiens
ggagcaucaugaagaacug

SEQ ID NO: 854225 - RNA, 19 nt, Homo sapiens
ucaccgaggccaaggaaga

SEQ ID NO: 854226 - RNA, 19 nt, Homo sapiens
gauaccgaguacuuugaug

SEQ ID NO: 854227 - RNA, 19 nt, Homo sapiens
ugaagauaccgaguacuuu

SEQ ID NO: 854228 - RNA, 19 nt, Homo sapiens
gauacacagucggaaaugg

SEQ ID NO: 854229 - RNA, 19 nt, Homo sapiens
gguuugcucucuuacuaca

SEQ ID NO: 854230 - RNA, 19 nt, Homo sapiens
ucuggagcaucaugaagaa

SEQ ID NO: 854231 - RNA, 19 nt, Homo sapiens
cagcagacaauguacuaga

SEQ ID NO: 854232 - RNA, 19 nt, Homo sapiens
aagaugaagauaccgagua

SEQ ID NO: 854233 - RNA, 19 nt, Homo sapiens
caucacauccaaugcuaug

SEQ ID NO: 854234 - RNA, 19 nt, Homo sapiens
gcaccacacccugaagaau

SEQ ID NO: 854235 - RNA, 19 nt, Homo sapiens
ugaaccauaagaccaauga

SEQ ID NO: 854236 - RNA, 19 nt, Homo sapiens
uaggugccauccacuuaga

SEQ ID NO: 854237 - RNA, 19 nt, Homo sapiens
ccaaggaagacagcagaaa

SEQ ID NO: 854238 - RNA, 19 nt, Homo sapiens
gcucgugggaugaacaaau

SEQ ID NO: 854239 - RNA, 19 nt, Homo sapiens
caccucaacuguucacaac

SEQ ID NO: 854240 - RNA, 19 nt, Homo sapiens
augguuugcucucuuacua

SEQ ID NO: 854241 - RNA, 19 nt, Homo sapiens
caagaggcgaguccgcauu

SEQ ID NO: 854242 - RNA, 19 nt, Homo sapiens
ugaggaagaugaagauacc

SEQ ID NO: 854243 - RNA, 19 nt, Homo sapiens
agcugaagguggugaauga

SEQ ID NO: 854244 - RNA, 19 nt, Homo sapiens
gcucggaggaagagaagga

SEQ ID NO: 854245 - RNA, 19 nt, Homo sapiens
gcagcucggaggaagagaa

SEQ ID NO: 854246 - RNA, 19 nt, Homo sapiens
gaacgcggagaacauguac

SEQ ID NO: 854247 - RNA, 19 nt, Homo sapiens
ugaaguuccugcccuacag

SEQ ID NO: 854248 - RNA, 19 nt, Homo sapiens
agagauacacagucggaaa

SEQ ID NO: 854249 - RNA, 19 nt, Homo sapiens
gccaagcugcuguggaaga

SEQ ID NO: 854250 - RNA, 19 nt, Homo sapiens
agaugaagauaccgaguac

SEQ ID NO: 854251 - RNA, 19 nt, Homo sapiens
ccuccaagagcuucauuga

SEQ ID NO: 854252 - RNA, 19 nt, Homo sapiens
ggacuucuuggaacuagca

SEQ ID NO: 854253 - RNA, 19 nt, Homo sapiens
gagcgccacccuugcaaca

SEQ ID NO: 854254 - RNA, 19 nt, Homo sapiens
acgcggagaacauguacua

SEQ ID NO: 854255 - RNA, 19 nt, Homo sapiens
caaggaagacagcagaaaa

SEQ ID NO: 854256 - RNA, 19 nt, Homo sapiens
uugagcagcuggcgaagca

SEQ ID NO: 854257 - RNA, 19 nt, Homo sapiens
agcgggcacugcaguauga

SEQ ID NO: 854258 - RNA, 19 nt, Homo sapiens
cauccaaugcuaugaucaa

SEQ ID NO: 854259 - RNA, 19 nt, Homo sapiens
caccacacccugaagaauc

SEQ ID NO: 854260 - RNA, 19 nt, Homo sapiens
aggaagagcaccucaacug

SEQ ID NO: 854261 - RNA, 19 nt, Homo sapiens
ggaaaauacaucuccauca

SEQ ID NO: 854262 - RNA, 19 nt, Homo sapiens
cagcugcgcacuacguguu

SEQ ID NO: 854263 - RNA, 19 nt, Homo sapiens
ggaacuagcagagauacac

SEQ ID NO: 854264 - RNA, 19 nt, Homo sapiens
cagaaaucagggugaaaug

SEQ ID NO: 854265 - RNA, 19 nt, Homo sapiens
agaacgcggagaacaugua

SEQ ID NO: 854266 - RNA, 19 nt, Homo sapiens
cucgugggaugaacaaaug

SEQ ID NO: 854267 - RNA, 19 nt, Homo sapiens
gcccuuggcugaaaguuua

SEQ ID NO: 854268 - RNA, 19 nt, Homo sapiens
cagcaaagcucuaaagauc

SEQ ID NO: 854269 - RNA, 19 nt, Homo sapiens
gcaaagcucuaaagaucaa

SEQ ID NO: 854270 - RNA, 19 nt, Homo sapiens
gcacggaucuaaguuauuc

SEQ ID NO: 854271 - RNA, 19 nt, Homo sapiens
ggaaacugcucuuauugug

SEQ ID NO: 854272 - RNA, 19 nt, Homo sapiens
ggacagggacucagaaaug

SEQ ID NO: 854273 - RNA, 19 nt, Homo sapiens
guuaucgucuucuguauuu

SEQ ID NO: 854274 - RNA, 19 nt, Homo sapiens
ggacugcuguggcaaauag

SEQ ID NO: 854275 - RNA, 19 nt, Homo sapiens
gcaaauagggagacaagga

SEQ ID NO: 854276 - RNA, 19 nt, Homo sapiens
gcaaaauccugucucaaaa

SEQ ID NO: 854277 - RNA, 19 nt, Homo sapiens
gacagacccugcaguccua

SEQ ID NO: 854278 - RNA, 19 nt, Homo sapiens
gcugagaaauugcacugaa

SEQ ID NO: 854279 - RNA, 19 nt, Homo sapiens
ggccugaggucacauuuca

SEQ ID NO: 854280 - RNA, 19 nt, Homo sapiens
gaaauugcacugaagagau

SEQ ID NO: 854281 - RNA, 19 nt, Homo sapiens
ugaggucacauuucacuua

SEQ ID NO: 854282 - RNA, 19 nt, Homo sapiens
gcaggaggaucacuuaagc

SEQ ID NO: 854283 - RNA, 19 nt, Homo sapiens
gcacacacauucccuucgu

SEQ ID NO: 854284 - RNA, 19 nt, Homo sapiens
gacagggacucagaaaugu

SEQ ID NO: 854285 - RNA, 19 nt, Homo sapiens
cuuggaaacugcucuuauu

SEQ ID NO: 854286 - RNA, 19 nt, Homo sapiens
gaaggcagagguuguagug

SEQ ID NO: 854287 - RNA, 19 nt, Homo sapiens
aaauugcacugaagagaug

SEQ ID NO: 854288 - RNA, 19 nt, Homo sapiens
cgaguuaucgucuucugua

SEQ ID NO: 854289 - RNA, 19 nt, Homo sapiens
gagauacagagccggcuua

SEQ ID NO: 854290 - RNA, 19 nt, Homo sapiens
gcaagcgaguuaucgucuu

SEQ ID NO: 854291 - RNA, 19 nt, Homo sapiens
caagcgaguuaucgucuuc

SEQ ID NO: 854292 - RNA, 19 nt, Homo sapiens
gaggcaggaggaucacuua

SEQ ID NO: 854293 - RNA, 19 nt, Homo sapiens
gaggucacauuucacuuag

SEQ ID NO: 854294 - RNA, 19 nt, Homo sapiens
gaagcucgccuuacaacuc

SEQ ID NO: 854295 - RNA, 19 nt, Homo sapiens
aaacaggccugaggucaca

SEQ ID NO: 854296 - RNA, 19 nt, Homo sapiens
ccgggaagcucgccuuaca

SEQ ID NO: 854297 - RNA, 19 nt, Homo sapiens
ccagaaggcagagguugua

SEQ ID NO: 854298 - RNA, 19 nt, Homo sapiens
gagggcaccuucugcaaac

SEQ ID NO: 854299 - RNA, 19 nt, Homo sapiens
ggaucgcccuuggcugaaa

SEQ ID NO: 854300 - RNA, 19 nt, Homo sapiens
aggaggagcugcagaagca

SEQ ID NO: 854301 - RNA, 19 nt, Homo sapiens
gaguuaucgucuucuguau

SEQ ID NO: 854302 - RNA, 19 nt, Homo sapiens
gaaggugacacggauggaa

SEQ ID NO: 854303 - RNA, 19 nt, Homo sapiens
auacagagccggcuuagag

SEQ ID NO: 854304 - RNA, 19 nt, Homo sapiens
uccaaacccucccaggauu

SEQ ID NO: 854305 - RNA, 19 nt, Homo sapiens
ggugggaagacuagugaaa

SEQ ID NO: 854306 - RNA, 19 nt, Homo sapiens
gaaagccggagagcaacaa

SEQ ID NO: 854307 - RNA, 19 nt, Homo sapiens
gugccaauaugcccuccaa

SEQ ID NO: 854308 - RNA, 19 nt, Homo sapiens
agaaggaggagcugcagaa

SEQ ID NO: 854309 - RNA, 19 nt, Homo sapiens
ugagaaauugcacugaaga

SEQ ID NO: 854310 - RNA, 19 nt, Homo sapiens
uugcacggaucuaaguuau

SEQ ID NO: 854311 - RNA, 19 nt, Homo sapiens
gauggaagagugggaagga

SEQ ID NO: 854312 - RNA, 19 nt, Homo sapiens
ccagcaaagcucuaaagau

SEQ ID NO: 854313 - RNA, 19 nt, Homo sapiens
ucgcuugaguccaggaguu

SEQ ID NO: 854314 - RNA, 19 nt, Homo sapiens
cgcgguggcucacaucugu

SEQ ID NO: 854315 - RNA, 19 nt, Homo sapiens
ggaaagccggagagcaaca

SEQ ID NO: 854316 - RNA, 19 nt, Homo sapiens
gggcuggccagucagagaa

SEQ ID NO: 854317 - RNA, 19 nt, Homo sapiens
aaaccuggguguccucacu

SEQ ID NO: 854318 - RNA, 19 nt, Homo sapiens
ucuguaaucccagcacuuu

SEQ ID NO: 854319 - RNA, 19 nt, Homo sapiens
gcagagggagagagaaggu

SEQ ID NO: 854320 - RNA, 19 nt, Homo sapiens
agcgagagcugagcgagaa

SEQ ID NO: 854321 - RNA, 19 nt, Homo sapiens
ggagugggguccuaagaag

SEQ ID NO: 854322 - RNA, 19 nt, Homo sapiens
gaucgcccuuggcugaaag

SEQ ID NO: 854323 - RNA, 19 nt, Homo sapiens
agagggcaccuucugcaaa

SEQ ID NO: 854324 - RNA, 19 nt, Homo sapiens
ccuccccacuguuuauuua

SEQ ID NO: 854325 - RNA, 19 nt, Homo sapiens
ccaaacugggaccgaauga

SEQ ID NO: 854326 - RNA, 19 nt, Homo sapiens
gcccaggucccauuucucu

SEQ ID NO: 854327 - RNA, 19 nt, Homo sapiens
acuuacagcaagcgaguua

SEQ ID NO: 854328 - RNA, 19 nt, Homo sapiens
agggaaagccggagagcaa

SEQ ID NO: 854329 - RNA, 19 nt, Homo sapiens
agaaauugcacugaagaga

SEQ ID NO: 854330 - RNA, 19 nt, Homo sapiens
gaaggaggagcugcagaag

SEQ ID NO: 854331 - RNA, 19 nt, Homo sapiens
agaagcagagggagagaga

SEQ ID NO: 854332 - RNA, 19 nt, Homo sapiens
gggaagcucgccuuacaac

SEQ ID NO: 854333 - RNA, 19 nt, Homo sapiens
gccaauaugcccuccaaac

SEQ ID NO: 854334 - RNA, 19 nt, Homo sapiens
gugcccaggucccauuucu

SEQ ID NO: 854335 - RNA, 19 nt, Homo sapiens
uggaaacugcucuuauugu

SEQ ID NO: 854336 - RNA, 19 nt, Homo sapiens
gagaaauugcacugaagag

SEQ ID NO: 854337 - RNA, 19 nt, Homo sapiens
cugagaaauugcacugaag

SEQ ID NO: 854338 - RNA, 19 nt, Homo sapiens
ugaagcgcgugugccagaa

SEQ ID NO: 854339 - RNA, 19 nt, Homo sapiens
ggcaggaggaucacuuaag

SEQ ID NO: 854340 - RNA, 19 nt, Homo sapiens
ccugagcugggcuuuauau

SEQ ID NO: 854341 - RNA, 19 nt, Homo sapiens
cucccaggauucaaagcua

SEQ ID NO: 854342 - RNA, 19 nt, Homo sapiens
ccaaacccucccaggauuc

SEQ ID NO: 854343 - RNA, 19 nt, Homo sapiens
gcaaagaccuaaaugauga

SEQ ID NO: 854344 - RNA, 19 nt, Homo sapiens
gcccuuggcugaaaguuua

SEQ ID NO: 854345 - RNA, 19 nt, Homo sapiens
cagcaaagcucuaaagauc

SEQ ID NO: 854346 - RNA, 19 nt, Homo sapiens
gcaaagcucuaaagaucaa

SEQ ID NO: 854347 - RNA, 19 nt, Homo sapiens
gcacggaucuaaguuauuc

SEQ ID NO: 854348 - RNA, 19 nt, Homo sapiens
ggaaacugcucuuauugug

SEQ ID NO: 854349 - RNA, 19 nt, Homo sapiens
ggacagggacucagaaaug

SEQ ID NO: 854350 - RNA, 19 nt, Homo sapiens
guuaucgucuucuguauuu

SEQ ID NO: 854351 - RNA, 19 nt, Homo sapiens
ggacugcuguggcaaauag

SEQ ID NO: 854352 - RNA, 19 nt, Homo sapiens
ggaaggagccauucaagga

SEQ ID NO: 854353 - RNA, 19 nt, Homo sapiens
gcaaauagggagacaagga

SEQ ID NO: 854354 - RNA, 19 nt, Homo sapiens
gcaaaauccugucucaaaa

SEQ ID NO: 854355 - RNA, 19 nt, Homo sapiens
gacagacccugcaguccua

SEQ ID NO: 854356 - RNA, 19 nt, Homo sapiens
gcugagaaauugcacugaa

SEQ ID NO: 854357 - RNA, 19 nt, Homo sapiens
ggccugaggucacauuuca

SEQ ID NO: 854358 - RNA, 19 nt, Homo sapiens
gaaauugcacugaagagau

SEQ ID NO: 854359 - RNA, 19 nt, Homo sapiens
ugaggucacauuucacuua

SEQ ID NO: 854360 - RNA, 19 nt, Homo sapiens
gggcaaagaccuaaaugau

SEQ ID NO: 854361 - RNA, 19 nt, Homo sapiens
gcaggaggaucacuuaagc

SEQ ID NO: 854362 - RNA, 19 nt, Homo sapiens
gcacacacauucccuucgu

SEQ ID NO: 854363 - RNA, 19 nt, Homo sapiens
gacagggacucagaaaugu

SEQ ID NO: 854364 - RNA, 19 nt, Homo sapiens
cuuggaaacugcucuuauu

SEQ ID NO: 854365 - RNA, 19 nt, Homo sapiens
gaaggcagagguuguagug

SEQ ID NO: 854366 - RNA, 19 nt, Homo sapiens
aaauugcacugaagagaug

SEQ ID NO: 854367 - RNA, 19 nt, Homo sapiens
cgaguuaucgucuucugua

SEQ ID NO: 854368 - RNA, 19 nt, Homo sapiens
gagauacagagccggcuua

SEQ ID NO: 854369 - RNA, 19 nt, Homo sapiens
gcaagcgaguuaucgucuu

SEQ ID NO: 854370 - RNA, 19 nt, Homo sapiens
caagcgaguuaucgucuuc

SEQ ID NO: 854371 - RNA, 19 nt, Homo sapiens
gaggcaggaggaucacuua

SEQ ID NO: 854372 - RNA, 19 nt, Homo sapiens
ggcaaagaccuaaaugaug

SEQ ID NO: 854373 - RNA, 19 nt, Homo sapiens
gaggucacauuucacuuag

SEQ ID NO: 854374 - RNA, 19 nt, Homo sapiens
aaacaggccugaggucaca

SEQ ID NO: 854375 - RNA, 19 nt, Homo sapiens
ggaggccuguggaccaaug

SEQ ID NO: 854376 - RNA, 19 nt, Homo sapiens
ccagaaggcagagguugua

SEQ ID NO: 854377 - RNA, 19 nt, Homo sapiens
ggaucgcccuuggcugaaa

SEQ ID NO: 854378 - RNA, 19 nt, Homo sapiens
aggaggagcugcagaagca

SEQ ID NO: 854379 - RNA, 19 nt, Homo sapiens
gagggcaccuucugcaaac

SEQ ID NO: 854380 - RNA, 19 nt, Homo sapiens
gaguuaucgucuucuguau

SEQ ID NO: 854381 - RNA, 19 nt, Homo sapiens
gaaggugacacggauggaa

SEQ ID NO: 854382 - RNA, 19 nt, Homo sapiens
auacagagccggcuuagag

SEQ ID NO: 854383 - RNA, 19 nt, Homo sapiens
uccaaacccucccaggauu

SEQ ID NO: 854384 - RNA, 19 nt, Homo sapiens
gaggugacauugggcaaag

SEQ ID NO: 854385 - RNA, 19 nt, Homo sapiens
gacauugggcaaagaccua

SEQ ID NO: 854386 - RNA, 19 nt, Homo sapiens
ggugggaagacuagugaaa

SEQ ID NO: 854387 - RNA, 19 nt, Homo sapiens
gaaagccggagagcaacaa

SEQ ID NO: 854388 - RNA, 19 nt, Homo sapiens
gugccaauaugcccuccaa

SEQ ID NO: 854389 - RNA, 19 nt, Homo sapiens
agaaggaggagcugcagaa

SEQ ID NO: 854390 - RNA, 19 nt, Homo sapiens
ccuaaaugaugaggaguca

SEQ ID NO: 854391 - RNA, 19 nt, Homo sapiens
ugagaaauugcacugaaga

SEQ ID NO: 854392 - RNA, 19 nt, Homo sapiens
ggaggugacauugggcaaa

SEQ ID NO: 854393 - RNA, 19 nt, Homo sapiens
uugcacggaucuaaguuau

SEQ ID NO: 854394 - RNA, 19 nt, Homo sapiens
gauggaagagugggaagga

SEQ ID NO: 854395 - RNA, 19 nt, Homo sapiens
ucgcuugaguccaggaguu

SEQ ID NO: 854396 - RNA, 19 nt, Homo sapiens
cgcgguggcucacaucugu

SEQ ID NO: 854397 - RNA, 19 nt, Homo sapiens
ggaaagccggagagcaaca

SEQ ID NO: 854398 - RNA, 19 nt, Homo sapiens
gggcuggccagucagagaa

SEQ ID NO: 854399 - RNA, 19 nt, Homo sapiens
aaaccuggguguccucacu

SEQ ID NO: 854400 - RNA, 19 nt, Homo sapiens
ccagcaaagcucuaaagau

SEQ ID NO: 854401 - RNA, 19 nt, Homo sapiens
ucuguaaucccagcacuuu

SEQ ID NO: 854402 - RNA, 19 nt, Homo sapiens
gcagagggagagagaaggu

SEQ ID NO: 854403 - RNA, 19 nt, Homo sapiens
ggagugggguccuaagaag

SEQ ID NO: 854404 - RNA, 19 nt, Homo sapiens
gcuggaaggagccauucaa

SEQ ID NO: 854405 - RNA, 19 nt, Homo sapiens
ccauggggcuagaacagua

SEQ ID NO: 854406 - RNA, 19 nt, Homo sapiens
gaucgcccuuggcugaaag

SEQ ID NO: 854407 - RNA, 19 nt, Homo sapiens
agcgagagcugagcgagaa

SEQ ID NO: 854408 - RNA, 19 nt, Homo sapiens
ccuccccacuguuuauuua

SEQ ID NO: 854409 - RNA, 19 nt, Homo sapiens
agagggcaccuucugcaaa

SEQ ID NO: 854410 - RNA, 19 nt, Homo sapiens
ccaaacugggaccgaauga

SEQ ID NO: 854411 - RNA, 19 nt, Homo sapiens
gcccaggucccauuucucu

SEQ ID NO: 854412 - RNA, 19 nt, Homo sapiens
acuuacagcaagcgaguua

SEQ ID NO: 854413 - RNA, 19 nt, Homo sapiens
agggaaagccggagagcaa

SEQ ID NO: 854414 - RNA, 19 nt, Homo sapiens
agaaauugcacugaagaga

SEQ ID NO: 854415 - RNA, 19 nt, Homo sapiens
agaagcagagggagagaga

SEQ ID NO: 854416 - RNA, 19 nt, Homo sapiens
gaaggaggagcugcagaag

SEQ ID NO: 854417 - RNA, 19 nt, Homo sapiens
gccaauaugcccuccaaac

SEQ ID NO: 854418 - RNA, 19 nt, Homo sapiens
uggaaacugcucuuauugu

SEQ ID NO: 854419 - RNA, 19 nt, Homo sapiens
gugcccaggucccauuucu

SEQ ID NO: 854420 - RNA, 19 nt, Homo sapiens
gagaaauugcacugaagag

SEQ ID NO: 854421 - RNA, 19 nt, Homo sapiens
cugagaaauugcacugaag

SEQ ID NO: 854422 - RNA, 19 nt, Homo sapiens
ggcaggaggaucacuuaag

SEQ ID NO: 854423 - RNA, 19 nt, Homo sapiens
ccugagcugggcuuuauau

SEQ ID NO: 854424 - RNA, 19 nt, Homo sapiens
cucccaggauucaaagcua

SEQ ID NO: 854425 - RNA, 19 nt, Homo sapiens
ccaaacccucccaggauuc

SEQ ID NO: 854426 - RNA, 19 nt, Homo sapiens
ugaagcgcgugugccagaa

SEQ ID NO: 854427 - RNA, 19 nt, Homo sapiens
gaacgaaucuacccauuac

SEQ ID NO: 854428 - RNA, 19 nt, Homo sapiens
gaacaccaaugaacguuug

SEQ ID NO: 854429 - RNA, 19 nt, Homo sapiens
ggaacgaaucuacccauua

SEQ ID NO: 854430 - RNA, 19 nt, Homo sapiens
gagccgagauugugccauu

SEQ ID NO: 854431 - RNA, 19 nt, Homo sapiens
acacaugccuguaguccua

SEQ ID NO: 854432 - RNA, 19 nt, Homo sapiens
ccucgagggugcagaguua

SEQ ID NO: 854433 - RNA, 19 nt, Homo sapiens
gcaggagaauugcuugaau

SEQ ID NO: 854434 - RNA, 19 nt, Homo sapiens
gcaccuacguagucugcua

SEQ ID NO: 854435 - RNA, 19 nt, Homo sapiens
ucacggaaauggaggaaga

SEQ ID NO: 854436 - RNA, 19 nt, Homo sapiens
caaaggaccugcagaucca

SEQ ID NO: 854437 - RNA, 19 nt, Homo sapiens
aggcaucccuccuaacuuu

SEQ ID NO: 854438 - RNA, 19 nt, Homo sapiens
gagcaacucuaagaucauc

SEQ ID NO: 854439 - RNA, 19 nt, Homo sapiens
gaaccacaguugcuuugag

SEQ ID NO: 854440 - RNA, 19 nt, Homo sapiens
ggagaaccacaguugcuuu

SEQ ID NO: 854441 - RNA, 19 nt, Homo sapiens
cagaaccaauuccggacua

SEQ ID NO: 854442 - RNA, 19 nt, Homo sapiens
aaagaaagccucagaacgu

SEQ ID NO: 854443 - RNA, 19 nt, Homo sapiens
gcagugagccgagauugug

SEQ ID NO: 854444 - RNA, 19 nt, Homo sapiens
aauaugaggugaccguuca

SEQ ID NO: 854445 - RNA, 19 nt, Homo sapiens
ugugugaaauguaggcuuu

SEQ ID NO: 854446 - RNA, 19 nt, Homo sapiens
gaaauagcguccucuuccu

SEQ ID NO: 854447 - RNA, 19 nt, Homo sapiens
acagugaugacaccaaaua

SEQ ID NO: 854448 - RNA, 19 nt, Homo sapiens
gggauaccaagauaaauug

SEQ ID NO: 854449 - RNA, 19 nt, Homo sapiens
gagcagcaguggcaaagcu

SEQ ID NO: 854450 - RNA, 19 nt, Homo sapiens
auacagugaugacaccaaa

SEQ ID NO: 854451 - RNA, 19 nt, Homo sapiens
caacgucacacucacucua

SEQ ID NO: 854452 - RNA, 19 nt, Homo sapiens
caaaccaccaguccaagaa

SEQ ID NO: 854453 - RNA, 19 nt, Homo sapiens
caggagaauugcuugaauc

SEQ ID NO: 854454 - RNA, 19 nt, Homo sapiens
gaaaccccaucuccacuaa

SEQ ID NO: 854455 - RNA, 19 nt, Homo sapiens
guucgugugugaaauguag

SEQ ID NO: 854456 - RNA, 19 nt, Homo sapiens
gagugugugugcacguauu

SEQ ID NO: 854457 - RNA, 19 nt, Homo sapiens
gagaaccacaguugcuuug

SEQ ID NO: 854458 - RNA, 19 nt, Homo sapiens
gguuugaguuucuguccaa

SEQ ID NO: 854459 - RNA, 19 nt, Homo sapiens
aagaaagccucagaacguu

SEQ ID NO: 854460 - RNA, 19 nt, Homo sapiens
gaaccucuacucagcagau

SEQ ID NO: 854461 - RNA, 19 nt, Homo sapiens
cccaggagcuaaugguaga

SEQ ID NO: 854462 - RNA, 19 nt, Homo sapiens
ugugaaauguaggcuuuaa

SEQ ID NO: 854463 - RNA, 19 nt, Homo sapiens
gaauaguaccugccuggau

SEQ ID NO: 854464 - RNA, 19 nt, Homo sapiens
ccgagggacucacggaaau

SEQ ID NO: 854465 - RNA, 19 nt, Homo sapiens
uaaacugcacggucaagaa

SEQ ID NO: 854466 - RNA, 19 nt, Homo sapiens
gcagauccagcccuucuuc

SEQ ID NO: 854467 - RNA, 19 nt, Homo sapiens
gcccagaccagaagaguuc

SEQ ID NO: 854468 - RNA, 19 nt, Homo sapiens
gcacauggagaaccacagu

SEQ ID NO: 854469 - RNA, 19 nt, Homo sapiens
aauggacacugcagacaga

SEQ ID NO: 854470 - RNA, 19 nt, Homo sapiens
gcaccucgaaggcuugaug

SEQ ID NO: 854471 - RNA, 19 nt, Homo sapiens
guaaccacgccaugcauga

SEQ ID NO: 854472 - RNA, 19 nt, Homo sapiens
ugggauaccaagauaaauu

SEQ ID NO: 854473 - RNA, 19 nt, Homo sapiens
gcagcggucugguuaucgu

SEQ ID NO: 854474 - RNA, 19 nt, Homo sapiens
aaacugcacggucaagaau

SEQ ID NO: 854475 - RNA, 19 nt, Homo sapiens
ccaaaccaccaguccaaga

SEQ ID NO: 854476 - RNA, 19 nt, Homo sapiens
ggugacacaugccuguagu

SEQ ID NO: 854477 - RNA, 19 nt, Homo sapiens
guucauucagcauuuauug

SEQ ID NO: 854478 - RNA, 19 nt, Homo sapiens
uguauauguucguguguga

SEQ ID NO: 854479 - RNA, 19 nt, Homo sapiens
ccgacugguucgaauguga

SEQ ID NO: 854480 - RNA, 19 nt, Homo sapiens
gccagacacuccagaacca

SEQ ID NO: 854481 - RNA, 19 nt, Homo sapiens
gcacgagggcggaaaagaa

SEQ ID NO: 854482 - RNA, 19 nt, Homo sapiens
aggaaggucuggaucaucu

SEQ ID NO: 854483 - RNA, 19 nt, Homo sapiens
uggaacgaaucuacccauu

SEQ ID NO: 854484 - RNA, 19 nt, Homo sapiens
cacaggcgguggcguuuua

SEQ ID NO: 854485 - RNA, 19 nt, Homo sapiens
uaucuguccugcagcugaa

SEQ ID NO: 854486 - RNA, 19 nt, Homo sapiens
gugcagcggucugguuauc

SEQ ID NO: 854487 - RNA, 19 nt, Homo sapiens
ucccaggcaucccuccuaa

SEQ ID NO: 854488 - RNA, 19 nt, Homo sapiens
gcacaugcaccacauaccu

SEQ ID NO: 854489 - RNA, 19 nt, Homo sapiens
guauucaucuguguguaca

SEQ ID NO: 854490 - RNA, 19 nt, Homo sapiens
aaccaccaguccaagaauu

SEQ ID NO: 854491 - RNA, 19 nt, Homo sapiens
gcuccauuauucguucauu

SEQ ID NO: 854492 - RNA, 19 nt, Homo sapiens
gcaguagacccgccauggu

SEQ ID NO: 854493 - RNA, 19 nt, Homo sapiens
ggacgaagagguguuugag

SEQ ID NO: 854494 - RNA, 19 nt, Homo sapiens
uagcugggccuggaaguga

SEQ ID NO: 854495 - RNA, 19 nt, Homo sapiens
gugcgucagguuugaguuu

SEQ ID NO: 854496 - RNA, 19 nt, Homo sapiens
uauauguucgugugugaaa

SEQ ID NO: 854497 - RNA, 19 nt, Homo sapiens
gcgaaauagcguccucuuc

SEQ ID NO: 854498 - RNA, 19 nt, Homo sapiens
gaggagcagcaguggcaaa

SEQ ID NO: 854499 - RNA, 19 nt, Homo sapiens
gagcacaugcaccacauac

SEQ ID NO: 854500 - RNA, 19 nt, Homo sapiens
uguccaaacugaggcauca

SEQ ID NO: 854501 - RNA, 19 nt, Homo sapiens
gaaaagaaagccucagaac

SEQ ID NO: 854502 - RNA, 19 nt, Homo sapiens
gcggucugguuaucgucua

SEQ ID NO: 854503 - RNA, 19 nt, Homo sapiens
gcuugaugcucucgcucuu

SEQ ID NO: 854504 - RNA, 19 nt, Homo sapiens
ggaaggucuggaucaucua

SEQ ID NO: 854505 - RNA, 19 nt, Homo sapiens
agauccugcugaccaguuu

SEQ ID NO: 854506 - RNA, 19 nt, Homo sapiens
ucauucagcauuuauugug

SEQ ID NO: 854507 - RNA, 19 nt, Homo sapiens
gugaaauguaggcuuuaaa

SEQ ID NO: 854508 - RNA, 19 nt, Homo sapiens
ggaggaagaggaggaagag

SEQ ID NO: 854509 - RNA, 19 nt, Homo sapiens
ggaaaagaaagccucagaa

SEQ ID NO: 854510 - RNA, 19 nt, Homo sapiens
ggcugaggcaggagaauug

SEQ ID NO: 854511 - RNA, 19 nt, Homo sapiens
gcagcugaacaccaaugaa

SEQ ID NO: 854512 - RNA, 19 nt, Homo sapiens
auucguucauucagcauuu

SEQ ID NO: 854513 - RNA, 19 nt, Homo sapiens
uccgccagcugcagaagaa

SEQ ID NO: 854514 - RNA, 19 nt, Homo sapiens
gaaggucuggaucaucuac

SEQ ID NO: 854515 - RNA, 19 nt, Homo sapiens
ugaacaccaaugaacguuu

SEQ ID NO: 854516 - RNA, 19 nt, Homo sapiens
cccuggaccugcuggaaga

SEQ ID NO: 854517 - RNA, 19 nt, Homo sapiens
agacacuccgcgacuguuu

SEQ ID NO: 854518 - RNA, 19 nt, Homo sapiens
acauggagaaccacaguug

SEQ ID NO: 854519 - RNA, 19 nt, Homo sapiens
cagcugaacaccaaugaac

SEQ ID NO: 854520 - RNA, 19 nt, Homo sapiens
aaaguggagccgacucgaa

SEQ ID NO: 854521 - RNA, 19 nt, Homo sapiens
gaaccaauuccggacuaca

SEQ ID NO: 854522 - RNA, 19 nt, Homo sapiens
gcacggucaagaauaguac

SEQ ID NO: 854523 - RNA, 19 nt, Homo sapiens
ccuccuaacuuuucuuugu

SEQ ID NO: 854524 - RNA, 19 nt, Homo sapiens
ccaggcaucccuccuaacu

SEQ ID NO: 854525 - RNA, 19 nt, Homo sapiens
uggguguacugguucauca

SEQ ID NO: 854526 - RNA, 19 nt, Homo sapiens
agacacuccagaaccaauu

SEQ ID NO: 854527 - RNA, 19 nt, Homo sapiens
gaacuacgcuuggaugaua

SEQ ID NO: 854528 - RNA, 19 nt, Homo sapiens
gaagcuaccuuguauaaag

SEQ ID NO: 854529 - RNA, 19 nt, Homo sapiens
gaaggaggaguuuguaaua

SEQ ID NO: 854530 - RNA, 19 nt, Homo sapiens
ggacaacucuauccuggaa

SEQ ID NO: 854531 - RNA, 19 nt, Homo sapiens
ggagaugccugaacacaau

SEQ ID NO: 854532 - RNA, 19 nt, Homo sapiens
ucaaggaacugugcauaua

SEQ ID NO: 854533 - RNA, 19 nt, Homo sapiens
aaucaggacugcauucaua

SEQ ID NO: 854534 - RNA, 19 nt, Homo sapiens
gcaaugaacccaucucgaa

SEQ ID NO: 854535 - RNA, 19 nt, Homo sapiens
ccaaacagccagauauuaa

SEQ ID NO: 854536 - RNA, 19 nt, Homo sapiens
ugaguaagaugacuuguug

SEQ ID NO: 854537 - RNA, 19 nt, Homo sapiens
gaaacuugcucuaccuaug

SEQ ID NO: 854538 - RNA, 19 nt, Homo sapiens
gcagaacuguuugauugua

SEQ ID NO: 854539 - RNA, 19 nt, Homo sapiens
cuaccaaccucccaaagua

SEQ ID NO: 854540 - RNA, 19 nt, Homo sapiens
gaacaaucaugguuuaggu

SEQ ID NO: 854541 - RNA, 19 nt, Homo sapiens
guacgugacugguuacaau

SEQ ID NO: 854542 - RNA, 19 nt, Homo sapiens
ccacaacaguuuagaugaa

SEQ ID NO: 854543 - RNA, 19 nt, Homo sapiens
ugagauccuuguaguauaa

SEQ ID NO: 854544 - RNA, 19 nt, Homo sapiens
guugaacaaucaugguuua

SEQ ID NO: 854545 - RNA, 19 nt, Homo sapiens
ggacugcauucauaugaga

SEQ ID NO: 854546 - RNA, 19 nt, Homo sapiens
gaacugugcauauagcaaa

SEQ ID NO: 854547 - RNA, 19 nt, Homo sapiens
ucagauaaccacugcaaua

SEQ ID NO: 854548 - RNA, 19 nt, Homo sapiens
gcacaaaccugaggaagcu

SEQ ID NO: 854549 - RNA, 19 nt, Homo sapiens
ccaauucacugucaaugga

SEQ ID NO: 854550 - RNA, 19 nt, Homo sapiens
gaagaaaggaugacuaugc

SEQ ID NO: 854551 - RNA, 19 nt, Homo sapiens
guaagcaccauucagauaa

SEQ ID NO: 854552 - RNA, 19 nt, Homo sapiens
gagaagaaaggaugacuau

SEQ ID NO: 854553 - RNA, 19 nt, Homo sapiens
aaucgcauauccacuauuu

SEQ ID NO: 854554 - RNA, 19 nt, Homo sapiens
gcugaaaguagaaagaaua

SEQ ID NO: 854555 - RNA, 19 nt, Homo sapiens
uaacggaagcuaccuugua

SEQ ID NO: 854556 - RNA, 19 nt, Homo sapiens
gcccaggacuauagaagaa

SEQ ID NO: 854557 - RNA, 19 nt, Homo sapiens
guaaucaccuuagcacaau

SEQ ID NO: 854558 - RNA, 19 nt, Homo sapiens
cuacaacucucuaccuuca

SEQ ID NO: 854559 - RNA, 19 nt, Homo sapiens
ucaaguagcaccucuauca

SEQ ID NO: 854560 - RNA, 19 nt, Homo sapiens
caacacugcugaccaugau

SEQ ID NO: 854561 - RNA, 19 nt, Homo sapiens
cuaauggaaugaaucugua

SEQ ID NO: 854562 - RNA, 19 nt, Homo sapiens
ccagcaaccucuaccuauu

SEQ ID NO: 854563 - RNA, 19 nt, Homo sapiens
gacaauauaacacaacuga

SEQ ID NO: 854564 - RNA, 19 nt, Homo sapiens
gcgaugcggguuucauuua

SEQ ID NO: 854565 - RNA, 19 nt, Homo sapiens
caggguaucuuugaugauu

SEQ ID NO: 854566 - RNA, 19 nt, Homo sapiens
ccauugcccuucuugcuuu

SEQ ID NO: 854567 - RNA, 19 nt, Homo sapiens
caauggaauuacagcuaua

SEQ ID NO: 854568 - RNA, 19 nt, Homo sapiens
augcagaacuguuugauug

SEQ ID NO: 854569 - RNA, 19 nt, Homo sapiens
caaggucucacuagucuaa

SEQ ID NO: 854570 - RNA, 19 nt, Homo sapiens
ucaauggaauuacagcuau

SEQ ID NO: 854571 - RNA, 19 nt, Homo sapiens
cagaacuguuugauuguaa

SEQ ID NO: 854572 - RNA, 19 nt, Homo sapiens
caagauaaccacaucaauc

SEQ ID NO: 854573 - RNA, 19 nt, Homo sapiens
caaccuaguuaauuugaca

SEQ ID NO: 854574 - RNA, 19 nt, Homo sapiens
cauaugagauccuuguagu

SEQ ID NO: 854575 - RNA, 19 nt, Homo sapiens
gcaaagggaggagaagaaa

SEQ ID NO: 854576 - RNA, 19 nt, Homo sapiens
gaauggaucgcucuucuca

SEQ ID NO: 854577 - RNA, 19 nt, Homo sapiens
ggaucgcucuucucaagga

SEQ ID NO: 854578 - RNA, 19 nt, Homo sapiens
gagccugauucacccuaua

SEQ ID NO: 854579 - RNA, 19 nt, Homo sapiens
agacucagcuggcuuaaac

SEQ ID NO: 854580 - RNA, 19 nt, Homo sapiens
gaacaaucaggacugcauu

SEQ ID NO: 854581 - RNA, 19 nt, Homo sapiens
ccauuuacuuuguguucua

SEQ ID NO: 854582 - RNA, 19 nt, Homo sapiens
ggaacgcagugaguacuug

SEQ ID NO: 854583 - RNA, 19 nt, Homo sapiens
gcauuuggaucuauaacag

SEQ ID NO: 854584 - RNA, 19 nt, Homo sapiens
gaugacuuguugacuguga

SEQ ID NO: 854585 - RNA, 19 nt, Homo sapiens
ggagaagaaaggaugacua

SEQ ID NO: 854586 - RNA, 19 nt, Homo sapiens
agagaaagaaccuuacaaa

SEQ ID NO: 854587 - RNA, 19 nt, Homo sapiens
cggaagcuaccuuguauaa

SEQ ID NO: 854588 - RNA, 19 nt, Homo sapiens
gaccaaacagccagauauu

SEQ ID NO: 854589 - RNA, 19 nt, Homo sapiens
gaguuacauuugcaagaaa

SEQ ID NO: 854590 - RNA, 19 nt, Homo sapiens
gaaaucagggaaacuucuu

SEQ ID NO: 854591 - RNA, 19 nt, Homo sapiens
ugauucacccuauaaagua

SEQ ID NO: 854592 - RNA, 19 nt, Homo sapiens
caauuacugugaagucugu

SEQ ID NO: 854593 - RNA, 19 nt, Homo sapiens
gcacuaagaaggacaacuc

SEQ ID NO: 854594 - RNA, 19 nt, Homo sapiens
cagcaaccucuaccuauuu

SEQ ID NO: 854595 - RNA, 19 nt, Homo sapiens
uaaggacagugggauugua

SEQ ID NO: 854596 - RNA, 19 nt, Homo sapiens
aaauugggcuguuccuuca

SEQ ID NO: 854597 - RNA, 19 nt, Homo sapiens
agaguuacauuugcaagaa

SEQ ID NO: 854598 - RNA, 19 nt, Homo sapiens
cuucagaacaaccaaauaa

SEQ ID NO: 854599 - RNA, 19 nt, Homo sapiens
gauucacccuauaaaguau

SEQ ID NO: 854600 - RNA, 19 nt, Homo sapiens
ggguaucuuugaugauuug

SEQ ID NO: 854601 - RNA, 19 nt, Homo sapiens
gcuaaauccuguccaucug

SEQ ID NO: 854602 - RNA, 19 nt, Homo sapiens
cuacagagacagugguauu

SEQ ID NO: 854603 - RNA, 19 nt, Homo sapiens
cauauuuccuccuaaugga

SEQ ID NO: 854604 - RNA, 19 nt, Homo sapiens
cuaagaaggacaacucuau

SEQ ID NO: 854605 - RNA, 19 nt, Homo sapiens
ccauucauaucucuuggaa

SEQ ID NO: 854606 - RNA, 19 nt, Homo sapiens
cauauccacuauuucauca

SEQ ID NO: 854607 - RNA, 19 nt, Homo sapiens
ucauaucucuuggaaacuu

SEQ ID NO: 854608 - RNA, 19 nt, Homo sapiens
uguaagcaccauucagaua

SEQ ID NO: 854609 - RNA, 19 nt, Homo sapiens
ggauggcuauuaaggaucu

SEQ ID NO: 854610 - RNA, 19 nt, Homo sapiens
ugguuuaggugacaaaguu

SEQ ID NO: 854611 - RNA, 19 nt, Homo sapiens
gcaccucuaucaguuaugg

SEQ ID NO: 854612 - RNA, 19 nt, Homo sapiens
ggcaguguauauaggauug

SEQ ID NO: 854613 - RNA, 19 nt, Homo sapiens
aaacuugcucuaccuauga

SEQ ID NO: 854614 - RNA, 19 nt, Homo sapiens
uagaugaauuuccuaccaa

SEQ ID NO: 854615 - RNA, 19 nt, Homo sapiens
uaucaguuauggcuaaauc

SEQ ID NO: 854616 - RNA, 19 nt, Homo sapiens
aaugaucgcuuucugacau

SEQ ID NO: 854617 - RNA, 19 nt, Homo sapiens
aacggaagcuaccuuguau

SEQ ID NO: 854618 - RNA, 19 nt, Homo sapiens
uggaaugaaucuguacaaa

SEQ ID NO: 854619 - RNA, 19 nt, Homo sapiens
aagaaaggaugacuaugca

SEQ ID NO: 854620 - RNA, 19 nt, Homo sapiens
caacgugcgugggcucaug

SEQ ID NO: 854621 - RNA, 19 nt, Homo sapiens
caacugauucuucgcaaca

SEQ ID NO: 854622 - RNA, 19 nt, Homo sapiens
gcauauccacuauuucauc

SEQ ID NO: 854623 - RNA, 19 nt, Homo sapiens
uagaagaacuacgcuugga

SEQ ID NO: 854624 - RNA, 19 nt, Homo sapiens
acauuuagaugacaacucu

SEQ ID NO: 854625 - RNA, 19 nt, Homo sapiens
guagcaccucuaucaguua

SEQ ID NO: 854626 - RNA, 19 nt, Homo sapiens
ucagguuacugcugcgauu

SEQ ID NO: 854627 - RNA, 19 nt, Homo sapiens
guacuuagcuggauaauuc

SEQ ID NO: 854628 - RNA, 19 nt, Homo sapiens
gaacaaggaugaagagguu

SEQ ID NO: 854629 - RNA, 19 nt, Homo sapiens
cagaauggcucaaauauau

SEQ ID NO: 854630 - RNA, 19 nt, Homo sapiens
gagaggauguccaugcuua

SEQ ID NO: 854631 - RNA, 19 nt, Homo sapiens
gauagaaucugaucccauu

SEQ ID NO: 854632 - RNA, 19 nt, Homo sapiens
caacagagauauauucuag

SEQ ID NO: 854633 - RNA, 19 nt, Homo sapiens
caagaagacucccuuuaaa

SEQ ID NO: 854634 - RNA, 19 nt, Homo sapiens
gcaagaagacucccuuuaa

SEQ ID NO: 854635 - RNA, 19 nt, Homo sapiens
gcaaagacugcuaagauua

SEQ ID NO: 854636 - RNA, 19 nt, Homo sapiens
ccaaucaucucccauauau

SEQ ID NO: 854637 - RNA, 19 nt, Homo sapiens
ggaccagucugauguugua

SEQ ID NO: 854638 - RNA, 19 nt, Homo sapiens
ucaccaagcucaaggaauu

SEQ ID NO: 854639 - RNA, 19 nt, Homo sapiens
gcaaccaacuggacgaauu

SEQ ID NO: 854640 - RNA, 19 nt, Homo sapiens
guuaauaccugcuuguuug

SEQ ID NO: 854641 - RNA, 19 nt, Homo sapiens
cagaucgucuccuuaaaua

SEQ ID NO: 854642 - RNA, 19 nt, Homo sapiens
aaauauaacugcagcugua

SEQ ID NO: 854643 - RNA, 19 nt, Homo sapiens
aaacuucacucuacacuau

SEQ ID NO: 854644 - RNA, 19 nt, Homo sapiens
gagaugagauuugaaagga

SEQ ID NO: 854645 - RNA, 19 nt, Homo sapiens
gaaagcacgugauggaauc

SEQ ID NO: 854646 - RNA, 19 nt, Homo sapiens
ggcaaagacugcuaagauu

SEQ ID NO: 854647 - RNA, 19 nt, Homo sapiens
ucaaauauaucccuucauc

SEQ ID NO: 854648 - RNA, 19 nt, Homo sapiens
ggaacuuugucuacuguaa

SEQ ID NO: 854649 - RNA, 19 nt, Homo sapiens
gaucagugguucuguuaug

SEQ ID NO: 854650 - RNA, 19 nt, Homo sapiens
agaaauggcccgauaguuu

SEQ ID NO: 854651 - RNA, 19 nt, Homo sapiens
caaagacugcuaagauuaa

SEQ ID NO: 854652 - RNA, 19 nt, Homo sapiens
cauaaagacacgcagauua

SEQ ID NO: 854653 - RNA, 19 nt, Homo sapiens
gaaaaugggccacaguuua

SEQ ID NO: 854654 - RNA, 19 nt, Homo sapiens
gaagagauugaaccuagua

SEQ ID NO: 854655 - RNA, 19 nt, Homo sapiens
gggcuuaaaugguacaaug

SEQ ID NO: 854656 - RNA, 19 nt, Homo sapiens
gaucacauacguuaucaaa

SEQ ID NO: 854657 - RNA, 19 nt, Homo sapiens
uguugaagcugucagaaua

SEQ ID NO: 854658 - RNA, 19 nt, Homo sapiens
gcauuugaauacucuguaa

SEQ ID NO: 854659 - RNA, 19 nt, Homo sapiens
ccaugaaccuucccaagaa

SEQ ID NO: 854660 - RNA, 19 nt, Homo sapiens
ugaugugucuucuuuguaa

SEQ ID NO: 854661 - RNA, 19 nt, Homo sapiens
gaagcugucagaauaaauu

SEQ ID NO: 854662 - RNA, 19 nt, Homo sapiens
acacgcagauuacauuuga

SEQ ID NO: 854663 - RNA, 19 nt, Homo sapiens
gaacggauccagcucucua

SEQ ID NO: 854664 - RNA, 19 nt, Homo sapiens
ugucuaaugugucuuauga

SEQ ID NO: 854665 - RNA, 19 nt, Homo sapiens
ggugaucaguguagcagua

SEQ ID NO: 854666 - RNA, 19 nt, Homo sapiens
cuacauccuucucugauuu

SEQ ID NO: 854667 - RNA, 19 nt, Homo sapiens
gggaauggaugcuucacuu

SEQ ID NO: 854668 - RNA, 19 nt, Homo sapiens
ggggagauauguuugauua

SEQ ID NO: 854669 - RNA, 19 nt, Homo sapiens
ugauauaucugcucugugu

SEQ ID NO: 854670 - RNA, 19 nt, Homo sapiens
uacaguaccuuguugauau

SEQ ID NO: 854671 - RNA, 19 nt, Homo sapiens
gcacaugcuuguacacaca

SEQ ID NO: 854672 - RNA, 19 nt, Homo sapiens
uagcccaacuuauauguuu

SEQ ID NO: 854673 - RNA, 19 nt, Homo sapiens
ggauguccaugcuuaauuc

SEQ ID NO: 854674 - RNA, 19 nt, Homo sapiens
ggagggcuaaucaaucuua

SEQ ID NO: 854675 - RNA, 19 nt, Homo sapiens
gcacaaagcaaggccauug

SEQ ID NO: 854676 - RNA, 19 nt, Homo sapiens
gaagaggcauagucaugau

SEQ ID NO: 854677 - RNA, 19 nt, Homo sapiens
ugaaguaaaugucacaauc

SEQ ID NO: 854678 - RNA, 19 nt, Homo sapiens
ugaaagggcagauuaaaug

SEQ ID NO: 854679 - RNA, 19 nt, Homo sapiens
uuaaaugggucacagaaug

SEQ ID NO: 854680 - RNA, 19 nt, Homo sapiens
ugucaaaccuugccugaug

SEQ ID NO: 854681 - RNA, 19 nt, Homo sapiens
ggugaucaauguuuggaaa

SEQ ID NO: 854682 - RNA, 19 nt, Homo sapiens
ucacagaauggcucaaaua

SEQ ID NO: 854683 - RNA, 19 nt, Homo sapiens
ccauuggugucuuugcuua

SEQ ID NO: 854684 - RNA, 19 nt, Homo sapiens
caugcucacuggccaauaa

SEQ ID NO: 854685 - RNA, 19 nt, Homo sapiens
uggaaucugugaugucuaa

SEQ ID NO: 854686 - RNA, 19 nt, Homo sapiens
gaaguaaaugucacaauca

SEQ ID NO: 854687 - RNA, 19 nt, Homo sapiens
caucaaagcuggccaaaau

SEQ ID NO: 854688 - RNA, 19 nt, Homo sapiens
gcuaauaaagggaagaauu

SEQ ID NO: 854689 - RNA, 19 nt, Homo sapiens
gcucaaauauaucccuuca

SEQ ID NO: 854690 - RNA, 19 nt, Homo sapiens
guaaaggugucccuggaau

SEQ ID NO: 854691 - RNA, 19 nt, Homo sapiens
ugaagagguuccugucauu

SEQ ID NO: 854692 - RNA, 19 nt, Homo sapiens
gcuaauaauucuguaagga

SEQ ID NO: 854693 - RNA, 19 nt, Homo sapiens
gcaaauucuugucuuccaa

SEQ ID NO: 854694 - RNA, 19 nt, Homo sapiens
gcggaaagaugauuauugc

SEQ ID NO: 854695 - RNA, 19 nt, Homo sapiens
cgacauggccuuccagaau

SEQ ID NO: 854696 - RNA, 19 nt, Homo sapiens
ugucagaguucuccauuug

SEQ ID NO: 854697 - RNA, 19 nt, Homo sapiens
ggaagaggcauagucauga

SEQ ID NO: 854698 - RNA, 19 nt, Homo sapiens
ggaagaacaaggaugaaga

SEQ ID NO: 854699 - RNA, 19 nt, Homo sapiens
acacaagaauugaaacugu

SEQ ID NO: 854700 - RNA, 19 nt, Homo sapiens
gguccuaugugauaacaga

SEQ ID NO: 854701 - RNA, 19 nt, Homo sapiens
ggauacacaucaaccacuu

SEQ ID NO: 854702 - RNA, 19 nt, Homo sapiens
gaauggaugcuucacuuga

SEQ ID NO: 854703 - RNA, 19 nt, Homo sapiens
cagcugacuuuguuaguau

SEQ ID NO: 854704 - RNA, 19 nt, Homo sapiens
cagaugaaagggcagauua

SEQ ID NO: 854705 - RNA, 19 nt, Homo sapiens
gauaaauguuacacagaug

SEQ ID NO: 854706 - RNA, 19 nt, Homo sapiens
gaacaacggcagcaacaca

SEQ ID NO: 854707 - RNA, 19 nt, Homo sapiens
ccaccuaucggauuuguuu

SEQ ID NO: 854708 - RNA, 19 nt, Homo sapiens
ugacugggauggcagagaa

SEQ ID NO: 854709 - RNA, 19 nt, Homo sapiens
caucacacauccucugaga

SEQ ID NO: 854710 - RNA, 19 nt, Homo sapiens
gaacaugagaauagcaguu

SEQ ID NO: 854711 - RNA, 19 nt, Homo sapiens
acaaggagacauuacauuu

SEQ ID NO: 854712 - RNA, 19 nt, Homo sapiens
aaaguuagguccacacagu

SEQ ID NO: 854713 - RNA, 19 nt, Homo sapiens
cuauagaucacauacguua

SEQ ID NO: 854714 - RNA, 19 nt, Homo sapiens
aacaagaaauggcccgaua

SEQ ID NO: 854715 - RNA, 19 nt, Homo sapiens
cagauuaaauggacucauc

SEQ ID NO: 854716 - RNA, 19 nt, Homo sapiens
gucagggaauuaaauauga

SEQ ID NO: 854717 - RNA, 19 nt, Homo sapiens
gaugcugccuggccaaaug

SEQ ID NO: 854718 - RNA, 19 nt, Homo sapiens
gaugauuagucaagaguca

SEQ ID NO: 854719 - RNA, 19 nt, Homo sapiens
guaccuuguugauauauuc

SEQ ID NO: 854720 - RNA, 19 nt, Homo sapiens
gaagagguuccugucauuu

SEQ ID NO: 854721 - RNA, 19 nt, Homo sapiens
acaauuagacucuugagaa

SEQ ID NO: 854722 - RNA, 19 nt, Homo sapiens
gaugacaacuccauaucca

SEQ ID NO: 854723 - RNA, 19 nt, Homo sapiens
ggagaaagaguuuuguaua

SEQ ID NO: 854724 - RNA, 19 nt, Homo sapiens
gauaauucccuucuacugu

SEQ ID NO: 854725 - RNA, 19 nt, Homo sapiens
gagacaacaccuucagaaa

SEQ ID NO: 854726 - RNA, 19 nt, Homo sapiens
aaauaacgaucaacuccuu

SEQ ID NO: 854727 - RNA, 19 nt, Homo sapiens
gcagaaacauggcaucuuu

SEQ ID NO: 854728 - RNA, 19 nt, Homo sapiens
cgacauuguugaagacaua

SEQ ID NO: 854729 - RNA, 19 nt, Homo sapiens
gaacaaucauguagucgau

SEQ ID NO: 854730 - RNA, 19 nt, Homo sapiens
gaacacaacagugacaauu

SEQ ID NO: 854731 - RNA, 19 nt, Homo sapiens
gauacuaccuguacaacau

SEQ ID NO: 854732 - RNA, 19 nt, Homo sapiens
cuacguagcugaugagaca

SEQ ID NO: 854733 - RNA, 19 nt, Homo sapiens
gaccagcaaugccuacgua

SEQ ID NO: 854734 - RNA, 19 nt, Homo sapiens
agaaugaccuggaugaguu

SEQ ID NO: 854735 - RNA, 19 nt, Homo sapiens
ccauuucccuugcagauuu

SEQ ID NO: 854736 - RNA, 19 nt, Homo sapiens
ggaaaaggaugacuauaug

SEQ ID NO: 854737 - RNA, 19 nt, Homo sapiens
gaaauuccaugggugacuu

SEQ ID NO: 854738 - RNA, 19 nt, Homo sapiens
ccgcagauaucccugauga

SEQ ID NO: 854739 - RNA, 19 nt, Homo sapiens
gagauaugguccugaaauc

SEQ ID NO: 854740 - RNA, 19 nt, Homo sapiens
ggaauucgacauuguugaa

SEQ ID NO: 854741 - RNA, 19 nt, Homo sapiens
ggagauaugguccugaaau

SEQ ID NO: 854742 - RNA, 19 nt, Homo sapiens
ggaaggauacuaccuguac

SEQ ID NO: 854743 - RNA, 19 nt, Homo sapiens
ucaaggccaucacaaagga

SEQ ID NO: 854744 - RNA, 19 nt, Homo sapiens
ggggagggcugacgauuuu

SEQ ID NO: 854745 - RNA, 19 nt, Homo sapiens
gaaggauacuaccuguaca

SEQ ID NO: 854746 - RNA, 19 nt, Homo sapiens
gaagcagccggcucucaaa

SEQ ID NO: 854747 - RNA, 19 nt, Homo sapiens
agacuacuccuacacauga

SEQ ID NO: 854748 - RNA, 19 nt, Homo sapiens
ggacauuaccagcgagaug

SEQ ID NO: 854749 - RNA, 19 nt, Homo sapiens
acaacacgcuggccaagau

SEQ ID NO: 854750 - RNA, 19 nt, Homo sapiens
gagcaaggaagagaaauuc

SEQ ID NO: 854751 - RNA, 19 nt, Homo sapiens
gcaucccgcugcuggagaa

SEQ ID NO: 854752 - RNA, 19 nt, Homo sapiens
gcgacccgauggaagguuu

SEQ ID NO: 854753 - RNA, 19 nt, Homo sapiens
gacaacggcuucaucuacu

SEQ ID NO: 854754 - RNA, 19 nt, Homo sapiens
caagagagcaaggaagaga

SEQ ID NO: 854755 - RNA, 19 nt, Homo sapiens
ggacaccucaugcucuguu

SEQ ID NO: 854756 - RNA, 19 nt, Homo sapiens
acacaacagugacaauuuu

SEQ ID NO: 854757 - RNA, 19 nt, Homo sapiens
cgacaacggcuucaucuac

SEQ ID NO: 854758 - RNA, 19 nt, Homo sapiens
gacauagacuacuccuaca

SEQ ID NO: 854759 - RNA, 19 nt, Homo sapiens
ggcaguggcucuggucuuc

SEQ ID NO: 854760 - RNA, 19 nt, Homo sapiens
caaaggagagagggaagaa

SEQ ID NO: 854761 - RNA, 19 nt, Homo sapiens
ccaccuacaucaucugcau

SEQ ID NO: 854762 - RNA, 19 nt, Homo sapiens
ucaucuaccuauacgagaa

SEQ ID NO: 854763 - RNA, 19 nt, Homo sapiens
ucacugcauucuuugaaca

SEQ ID NO: 854764 - RNA, 19 nt, Homo sapiens
aaacauggcaucuuucacu

SEQ ID NO: 854765 - RNA, 19 nt, Homo sapiens
ggaccaagaaggauaacuc

SEQ ID NO: 854766 - RNA, 19 nt, Homo sapiens
agagacagccgacagcuau

SEQ ID NO: 854767 - RNA, 19 nt, Homo sapiens
gggaaaaggaugacuauau

SEQ ID NO: 854768 - RNA, 19 nt, Homo sapiens
gagaaugaccuggaugagu

SEQ ID NO: 854769 - RNA, 19 nt, Homo sapiens
cccaggaccucaagaccaa

SEQ ID NO: 854770 - RNA, 19 nt, Homo sapiens
ccaagacccuggccaucca

SEQ ID NO: 854771 - RNA, 19 nt, Homo sapiens
gaacaaccagaucaacaac

SEQ ID NO: 854772 - RNA, 19 nt, Homo sapiens
gauaugguccugaaaucuc

SEQ ID NO: 854773 - RNA, 19 nt, Homo sapiens
gcagccggcucucaaagcu

SEQ ID NO: 854774 - RNA, 19 nt, Homo sapiens
ucagggaccaagaaggaua

SEQ ID NO: 854775 - RNA, 19 nt, Homo sapiens
ggaaccaccugagcagcau

SEQ ID NO: 854776 - RNA, 19 nt, Homo sapiens
gcagggcuggguuggguuu

SEQ ID NO: 854777 - RNA, 19 nt, Homo sapiens
uggcaucuuucacugcauu

SEQ ID NO: 854778 - RNA, 19 nt, Homo sapiens
gcagauuugcagaaacaug

SEQ ID NO: 854779 - RNA, 19 nt, Homo sapiens
ccaagaaggauaacuccau

SEQ ID NO: 854780 - RNA, 19 nt, Homo sapiens
gcauggccaucaaggacau

SEQ ID NO: 854781 - RNA, 19 nt, Homo sapiens
agaacaaccagaucaacaa

SEQ ID NO: 854782 - RNA, 19 nt, Homo sapiens
gcgagauggacgaguguuu

SEQ ID NO: 854783 - RNA, 19 nt, Homo sapiens
gcgcccaccugcagaaacu

SEQ ID NO: 854784 - RNA, 19 nt, Homo sapiens
gccuggugcuggacgguaa

SEQ ID NO: 854785 - RNA, 19 nt, Homo sapiens
cuggagauaugguccugaa

SEQ ID NO: 854786 - RNA, 19 nt, Homo sapiens
guucaaggccaucacaaag

SEQ ID NO: 854787 - RNA, 19 nt, Homo sapiens
cagaacaaccagaucaaca

SEQ ID NO: 854788 - RNA, 19 nt, Homo sapiens
caaguccaccuacaucauc

SEQ ID NO: 854789 - RNA, 19 nt, Homo sapiens
gagcccaaguccaccuaca

SEQ ID NO: 854790 - RNA, 19 nt, Homo sapiens
guagaacacaacagugaca

SEQ ID NO: 854791 - RNA, 19 nt, Homo sapiens
ccccugaacuggaaggaua

SEQ ID NO: 854792 - RNA, 19 nt, Homo sapiens
guaaccugcuggccaacca

SEQ ID NO: 854793 - RNA, 19 nt, Homo sapiens
gcaccugcaggacaacaau

SEQ ID NO: 854794 - RNA, 19 nt, Homo sapiens
ugcauucuuugaacaauca

SEQ ID NO: 854795 - RNA, 19 nt, Homo sapiens
gcgacaacggcuucaucua

SEQ ID NO: 854796 - RNA, 19 nt, Homo sapiens
ggauacuaccuguacaaca

SEQ ID NO: 854797 - RNA, 19 nt, Homo sapiens
agagagcaaggaagagaaa

SEQ ID NO: 854798 - RNA, 19 nt, Homo sapiens
caaggccacacacaccauu

SEQ ID NO: 854799 - RNA, 19 nt, Homo sapiens
gaaugaccuggaugaguuc

SEQ ID NO: 854800 - RNA, 19 nt, Homo sapiens
agaagcagccggcucucaa

SEQ ID NO: 854801 - RNA, 19 nt, Homo sapiens
aauucgacauuguugaaga

SEQ ID NO: 854802 - RNA, 19 nt, Homo sapiens
gggaauucgacauuguuga

SEQ ID NO: 854803 - RNA, 19 nt, Homo sapiens
auacgagaaugaccuggau

SEQ ID NO: 854804 - RNA, 19 nt, Homo sapiens
cagagacagccgacagcua

SEQ ID NO: 854805 - RNA, 19 nt, Homo sapiens
gcagacuccauccgcauca

SEQ ID NO: 854806 - RNA, 19 nt, Homo sapiens
aacacaacagugacaauuu

SEQ ID NO: 854807 - RNA, 19 nt, Homo sapiens
agagcaaggaagagaaauu

SEQ ID NO: 854808 - RNA, 19 nt, Homo sapiens
cagggaccaagaaggauaa

SEQ ID NO: 854809 - RNA, 19 nt, Homo sapiens
caacgugcaggucaucuac

SEQ ID NO: 854810 - RNA, 19 nt, Homo sapiens
uuugaacaaucauguaguc

SEQ ID NO: 854811 - RNA, 19 nt, Homo sapiens
uccaagagagcaaggaaga

SEQ ID NO: 854812 - RNA, 19 nt, Homo sapiens
cauagacuacuccuacaca

SEQ ID NO: 854813 - RNA, 19 nt, Homo sapiens
ccaagaccacggccagcaa

SEQ ID NO: 854814 - RNA, 19 nt, Homo sapiens
ucaacgugcaggucaucua

SEQ ID NO: 854815 - RNA, 19 nt, Homo sapiens
agucagggaccaagaagga

SEQ ID NO: 854816 - RNA, 19 nt, Homo sapiens
cagcaaugccuacguagcu

SEQ ID NO: 854817 - RNA, 19 nt, Homo sapiens
cccucuaucugcagaacaa

SEQ ID NO: 854818 - RNA, 19 nt, Homo sapiens
gcagaacaaccagaucaac

SEQ ID NO: 854819 - RNA, 19 nt, Homo sapiens
cgccuucgccgacagcaaa

SEQ ID NO: 854820 - RNA, 19 nt, Homo sapiens
gcccaaguccaccuacauc

SEQ ID NO: 854821 - RNA, 19 nt, Homo sapiens
ccaaugcggcugccaagac

SEQ ID NO: 854822 - RNA, 19 nt, Homo sapiens
caacacgcuggccaagaug

SEQ ID NO: 854823 - RNA, 19 nt, Homo sapiens
gagcugcggcuggaugaca

SEQ ID NO: 854824 - RNA, 19 nt, Homo sapiens
ucucaaagcuggugaagaa

SEQ ID NO: 854825 - RNA, 19 nt, Homo sapiens
ggaacgggcuguugaggaa

SEQ ID NO: 854826 - RNA, 19 nt, Homo sapiens
gcacggagaccgccuugua

SEQ ID NO: 854827 - RNA, 19 nt, Homo sapiens
ggaagaggaugaccugagu

SEQ ID NO: 854828 - RNA, 19 nt, Homo sapiens
gcacagcuccugcaguuga

SEQ ID NO: 854829 - RNA, 19 nt, Homo sapiens
gccaggaacugaccaccua

SEQ ID NO: 854830 - RNA, 19 nt, Homo sapiens
agacgucgcuggagaaugg

SEQ ID NO: 854831 - RNA, 19 nt, Homo sapiens
aggcacagcuccugcaguu

SEQ ID NO: 854832 - RNA, 19 nt, Homo sapiens
ccauggaaguggcuguuug

SEQ ID NO: 854833 - RNA, 19 nt, Homo sapiens
caacaucaaggcucucuuc

SEQ ID NO: 854834 - RNA, 19 nt, Homo sapiens
caaagcuggugaagaagca

SEQ ID NO: 854835 - RNA, 19 nt, Homo sapiens
ggaagaggaggaagaggau

SEQ ID NO: 854836 - RNA, 19 nt, Homo sapiens
aagaguggcuggacauucu

SEQ ID NO: 854837 - RNA, 19 nt, Homo sapiens
gaagaguggcuggacauuc

SEQ ID NO: 854838 - RNA, 19 nt, Homo sapiens
ucacugcugacuccaagua

SEQ ID NO: 854839 - RNA, 19 nt, Homo sapiens
ugaagugucugaacaaccu

SEQ ID NO: 854840 - RNA, 19 nt, Homo sapiens
ggaggaagaggaggaggaa

SEQ ID NO: 854841 - RNA, 19 nt, Homo sapiens
ccuacgaccucgccaucaa

SEQ ID NO: 854842 - RNA, 19 nt, Homo sapiens
ccaaaguggacaugacguu

SEQ ID NO: 854843 - RNA, 19 nt, Homo sapiens
gcaccagccagacaacauc

SEQ ID NO: 854844 - RNA, 19 nt, Homo sapiens
aaggugaagugucugaaca

SEQ ID NO: 854845 - RNA, 19 nt, Homo sapiens
ggccugaccuggagaugcu

SEQ ID NO: 854846 - RNA, 19 nt, Homo sapiens
gccuggaggugacccugaa

SEQ ID NO: 854847 - RNA, 19 nt, Homo sapiens
gaaggugaagugucugaac

SEQ ID NO: 854848 - RNA, 19 nt, Homo sapiens
ggaggaagaggaggaagag

SEQ ID NO: 854849 - RNA, 19 nt, Homo sapiens
ggaggaggaagaggaggaa

SEQ ID NO: 854850 - RNA, 19 nt, Homo sapiens
ccgccacagugaaauaaag

SEQ ID NO: 854851 - RNA, 19 nt, Homo sapiens
ggaagaggaggaggaagag

SEQ ID NO: 854852 - RNA, 19 nt, Homo sapiens
aagaggaugaccugaguga

SEQ ID NO: 854853 - RNA, 19 nt, Homo sapiens
gcgccaaaguggacaugac

SEQ ID NO: 854854 - RNA, 19 nt, Homo sapiens
aggaagaggaggaggaaga

SEQ ID NO: 854855 - RNA, 19 nt, Homo sapiens
ccacgcagagcucucaaag

SEQ ID NO: 854856 - RNA, 19 nt, Homo sapiens
gauccacgcagagcucuca

SEQ ID NO: 854857 - RNA, 19 nt, Homo sapiens
ggugaagugucugaacaac

SEQ ID NO: 854858 - RNA, 19 nt, Homo sapiens
cacagcuccugcaguugaa

SEQ ID NO: 854859 - RNA, 19 nt, Homo sapiens
aagaggaggaagaggauga

SEQ ID NO: 854860 - RNA, 19 nt, Homo sapiens
cagcaggagcccauacauc

SEQ ID NO: 854861 - RNA, 19 nt, Homo sapiens
gcagacgucgcuggagaau

SEQ ID NO: 854862 - RNA, 19 nt, Homo sapiens
ggaaagagguuagcuguga

SEQ ID NO: 854863 - RNA, 19 nt, Homo sapiens
ggaggccucugaauauuua

SEQ ID NO: 854864 - RNA, 19 nt, Homo sapiens
ugaaggagguaccagauua

SEQ ID NO: 854865 - RNA, 19 nt, Homo sapiens
guacaucacuugcagauca

SEQ ID NO: 854866 - RNA, 19 nt, Homo sapiens
ccaaagagaagcugaagua

SEQ ID NO: 854867 - RNA, 19 nt, Homo sapiens
guuagaagcucaaggguau

SEQ ID NO: 854868 - RNA, 19 nt, Homo sapiens
gguggaaacugacaugcua

SEQ ID NO: 854869 - RNA, 19 nt, Homo sapiens
gaugaaggcugccaaagag

SEQ ID NO: 854870 - RNA, 19 nt, Homo sapiens
gaaagaccgcuuacuguga

SEQ ID NO: 854871 - RNA, 19 nt, Homo sapiens
ccgcagagguuaaauagga

SEQ ID NO: 854872 - RNA, 19 nt, Homo sapiens
acaacgagguggaguauga

SEQ ID NO: 854873 - RNA, 19 nt, Homo sapiens
gauaagcuguacauguuug

SEQ ID NO: 854874 - RNA, 19 nt, Homo sapiens
gggaagacguggacagguu

SEQ ID NO: 854875 - RNA, 19 nt, Homo sapiens
ggagguaccagauuauuug

SEQ ID NO: 854876 - RNA, 19 nt, Homo sapiens
aagacgggauguaaauuua

SEQ ID NO: 854877 - RNA, 19 nt, Homo sapiens
gcaauagaaacuuuggaua

SEQ ID NO: 854878 - RNA, 19 nt, Homo sapiens
gaaaguguauucauuugcu

SEQ ID NO: 854879 - RNA, 19 nt, Homo sapiens
ggacuggugugugguggua

SEQ ID NO: 854880 - RNA, 19 nt, Homo sapiens
cagaguaccacuuauuuaa

SEQ ID NO: 854881 - RNA, 19 nt, Homo sapiens
gaccaagucugaugagaag

SEQ ID NO: 854882 - RNA, 19 nt, Homo sapiens
ugagagagcugcuggacau

SEQ ID NO: 854883 - RNA, 19 nt, Homo sapiens
aagagaagcugaaguacug

SEQ ID NO: 854884 - RNA, 19 nt, Homo sapiens
gaaaagagagcucgguuaa

SEQ ID NO: 854885 - RNA, 19 nt, Homo sapiens
uuacacagaguaccacuua

SEQ ID NO: 854886 - RNA, 19 nt, Homo sapiens
uugauaagcuguacauguu

SEQ ID NO: 854887 - RNA, 19 nt, Homo sapiens
uaagacgggauguaaauuu

SEQ ID NO: 854888 - RNA, 19 nt, Homo sapiens
ugacgaaacuauagacaag

SEQ ID NO: 854889 - RNA, 19 nt, Homo sapiens
gaccucaccugcgcuauga

SEQ ID NO: 854890 - RNA, 19 nt, Homo sapiens
aaagagagcucgguuaaaa

SEQ ID NO: 854891 - RNA, 19 nt, Homo sapiens
gaugguagagauagaaauu

SEQ ID NO: 854892 - RNA, 19 nt, Homo sapiens
uaggguggguuuccaaauu

SEQ ID NO: 854893 - RNA, 19 nt, Homo sapiens
cgugugcgcuccuuauauu

SEQ ID NO: 854894 - RNA, 19 nt, Homo sapiens
ggcuggagaucgucaauga

SEQ ID NO: 854895 - RNA, 19 nt, Homo sapiens
gaccuacgcucaagcucaa

SEQ ID NO: 854896 - RNA, 19 nt, Homo sapiens
ucaagcggcuguccaggaa

SEQ ID NO: 854897 - RNA, 19 nt, Homo sapiens
gaaugguacuuuguggaaa

SEQ ID NO: 854898 - RNA, 19 nt, Homo sapiens
gagaucauauuggaagaug

SEQ ID NO: 854899 - RNA, 19 nt, Homo sapiens
gaacacuuugguagcaaua

SEQ ID NO: 854900 - RNA, 19 nt, Homo sapiens
auagauaacugcaugaagu

SEQ ID NO: 854901 - RNA, 19 nt, Homo sapiens
ggcaguggcuuccuaaguc

SEQ ID NO: 854902 - RNA, 19 nt, Homo sapiens
aaauugcccuucuccgaaa

SEQ ID NO: 854903 - RNA, 19 nt, Homo sapiens
gguaccagauuauuuggau

SEQ ID NO: 854904 - RNA, 19 nt, Homo sapiens
gaaggagguaccagauuau

SEQ ID NO: 854905 - RNA, 19 nt, Homo sapiens
cauccaaggucaggaagaa

SEQ ID NO: 854906 - RNA, 19 nt, Homo sapiens
gagguuagcugugaguuuu

SEQ ID NO: 854907 - RNA, 19 nt, Homo sapiens
gagguaaagcauuauguug

SEQ ID NO: 854908 - RNA, 19 nt, Homo sapiens
uaugguaccugugauguau

SEQ ID NO: 854909 - RNA, 19 nt, Homo sapiens
uuaauaagacgggauguaa

SEQ ID NO: 854910 - RNA, 19 nt, Homo sapiens
gggaaaguccugcaacugu

SEQ ID NO: 854911 - RNA, 19 nt, Homo sapiens
aaagaccgcuuacugugau

SEQ ID NO: 854912 - RNA, 19 nt, Homo sapiens
ggacaacgagguggaguau

SEQ ID NO: 854913 - RNA, 19 nt, Homo sapiens
ccgaggaacuggacaacga

SEQ ID NO: 854914 - RNA, 19 nt, Homo sapiens
ggcgucacuuucuuugaua

SEQ ID NO: 854915 - RNA, 19 nt, Homo sapiens
ggacagcaucggcuuggaa

SEQ ID NO: 854916 - RNA, 19 nt, Homo sapiens
ccuccugucugcuuaagaa

SEQ ID NO: 854917 - RNA, 19 nt, Homo sapiens
ugguagagauagaaauuga

SEQ ID NO: 854918 - RNA, 19 nt, Homo sapiens
acagaguaccacuuauuua

SEQ ID NO: 854919 - RNA, 19 nt, Homo sapiens
caauagaaacuuuggauac

SEQ ID NO: 854920 - RNA, 19 nt, Homo sapiens
ccucccagcggauuauuua

SEQ ID NO: 854921 - RNA, 19 nt, Homo sapiens
acacagaguaccacuuauu

SEQ ID NO: 854922 - RNA, 19 nt, Homo sapiens
ucaaaggaugguagagaua

SEQ ID NO: 854923 - RNA, 19 nt, Homo sapiens
cccagcggauuauuuauug

SEQ ID NO: 854924 - RNA, 19 nt, Homo sapiens
ucagggagguguuguucug

SEQ ID NO: 854925 - RNA, 19 nt, Homo sapiens
cagaaagaccgcuuacugu

SEQ ID NO: 854926 - RNA, 19 nt, Homo sapiens
cacagaguaccacuuauuu

SEQ ID NO: 854927 - RNA, 19 nt, Homo sapiens
ggucuuguccauaguguug

SEQ ID NO: 854928 - RNA, 19 nt, Homo sapiens
ggagaugaaggcugccaaa

SEQ ID NO: 854929 - RNA, 19 nt, Homo sapiens
gaagcucacagcagagaga

SEQ ID NO: 854930 - RNA, 19 nt, Homo sapiens
ucagaaagaccgcuuacug

SEQ ID NO: 854931 - RNA, 19 nt, Homo sapiens
aaauggagcccgugaagga

SEQ ID NO: 854932 - RNA, 19 nt, Homo sapiens
aaaugacucuggccugugu

SEQ ID NO: 854933 - RNA, 19 nt, Homo sapiens
gggagcacaugcagaccaa

SEQ ID NO: 854934 - RNA, 19 nt, Homo sapiens
gcaacgugauccucuucug

SEQ ID NO: 854935 - RNA, 19 nt, Homo sapiens
ccugucugcuuaagaacua

SEQ ID NO: 854936 - RNA, 19 nt, Homo sapiens
ccucacugcucaagagaug

SEQ ID NO: 854937 - RNA, 19 nt, Homo sapiens
cugcguagaauuaccuuua

SEQ ID NO: 854938 - RNA, 19 nt, Homo sapiens
uaauaagacgggauguaaa

SEQ ID NO: 854939 - RNA, 19 nt, Homo sapiens
ccacugagcaugccugucu

SEQ ID NO: 854940 - RNA, 19 nt, Homo sapiens
aggguggguuuccaaauuu

SEQ ID NO: 854941 - RNA, 19 nt, Homo sapiens
gggcaaaccggcucuugug

SEQ ID NO: 854942 - RNA, 19 nt, Homo sapiens
uagauaacugcaugaagua

SEQ ID NO: 854943 - RNA, 19 nt, Homo sapiens
cagauuauuuggaucacau

SEQ ID NO: 854944 - RNA, 19 nt, Homo sapiens
gcucaaaggaugguagaga

SEQ ID NO: 854945 - RNA, 19 nt, Homo sapiens
gggaaaguaggguggguuu

SEQ ID NO: 854946 - RNA, 19 nt, Homo sapiens
cagcggauuauuuauugua

SEQ ID NO: 854947 - RNA, 19 nt, Homo sapiens
ugaaugguacuuuguggaa

SEQ ID NO: 854948 - RNA, 19 nt, Homo sapiens
uuaaacaucccauggacuu

SEQ ID NO: 854949 - RNA, 19 nt, Homo sapiens
ccggaggccucugaauauu

SEQ ID NO: 854950 - RNA, 19 nt, Homo sapiens
ugacaugcuaccucuguaa

SEQ ID NO: 854951 - RNA, 19 nt, Homo sapiens
ugaccucacugcucaagag

SEQ ID NO: 854952 - RNA, 19 nt, Homo sapiens
acacuuugguagcaauaga

SEQ ID NO: 854953 - RNA, 19 nt, Homo sapiens
ggaaagaggggagaauaaa

SEQ ID NO: 854954 - RNA, 19 nt, Homo sapiens
guugauaagcuguacaugu

SEQ ID NO: 854955 - RNA, 19 nt, Homo sapiens
gguauugacgaaacuauag

SEQ ID NO: 854956 - RNA, 19 nt, Homo sapiens
gagcuuuaaugcgcccaaa

SEQ ID NO: 854957 - RNA, 19 nt, Homo sapiens
ccagcccgguggaaacuga

SEQ ID NO: 854958 - RNA, 19 nt, Homo sapiens
aaaggaugguagagauaga

SEQ ID NO: 854959 - RNA, 19 nt, Homo sapiens
ccugugauguauauagaau

SEQ ID NO: 854960 - RNA, 19 nt, Homo sapiens
uaccugugauguauauaga

SEQ ID NO: 854961 - RNA, 19 nt, Homo sapiens
guaugguaccugugaugua

SEQ ID NO: 854962 - RNA, 19 nt, Homo sapiens
ggacaagauucgcuucuau

SEQ ID NO: 854963 - RNA, 19 nt, Homo sapiens
gcagagaccugggacuucu

SEQ ID NO: 854964 - RNA, 19 nt, Homo sapiens
gggacaagauucgcuucua

SEQ ID NO: 854965 - RNA, 19 nt, Homo sapiens
gggacgugcuggccaagaa

SEQ ID NO: 854966 - RNA, 19 nt, Homo sapiens
agaagguggugucgccaua

SEQ ID NO: 854967 - RNA, 19 nt, Homo sapiens
guccacaccugcccacaga

SEQ ID NO: 854968 - RNA, 19 nt, Homo sapiens
gcaucugagucggcguuua

SEQ ID NO: 854969 - RNA, 19 nt, Homo sapiens
gcucggcccaggucuguuu

SEQ ID NO: 854970 - RNA, 19 nt, Homo sapiens
gcucuggcauguccgacuu

SEQ ID NO: 854971 - RNA, 19 nt, Homo sapiens
cgccauaccugggcaccua

SEQ ID NO: 854972 - RNA, 19 nt, Homo sapiens
gaccugggacuucuucuuc

SEQ ID NO: 854973 - RNA, 19 nt, Homo sapiens
cggaguaccugcagaacca

SEQ ID NO: 854974 - RNA, 19 nt, Homo sapiens
gacaagauucgcuucuaug

SEQ ID NO: 854975 - RNA, 19 nt, Homo sapiens
ucacuggccuuggucacuu

SEQ ID NO: 854976 - RNA, 19 nt, Homo sapiens
caacacgccucugcugaac

SEQ ID NO: 854977 - RNA, 19 nt, Homo sapiens
acaagauucgcuucuauga

SEQ ID NO: 854978 - RNA, 19 nt, Homo sapiens
ccauguggcguguguguga

SEQ ID NO: 854979 - RNA, 19 nt, Homo sapiens
cugcugcacuuccggaaug

SEQ ID NO: 854980 - RNA, 19 nt, Homo sapiens
ucagugaccugggcaagag

SEQ ID NO: 854981 - RNA, 19 nt, Homo sapiens
gggcgugacugaggacuac

SEQ ID NO: 854982 - RNA, 19 nt, Homo sapiens
gggacuucuucuucaguga

SEQ ID NO: 854983 - RNA, 19 nt, Homo sapiens
gguccuucuucacggagua

SEQ ID NO: 854984 - RNA, 19 nt, Homo sapiens
gaagggauuuucauugacu

SEQ ID NO: 854985 - RNA, 19 nt, Homo sapiens
ucacggaguaccugcagaa

SEQ ID NO: 854986 - RNA, 19 nt, Homo sapiens
uggccuuggucacuuugua

SEQ ID NO: 854987 - RNA, 19 nt, Homo sapiens
ccacaccugcccacagaga

SEQ ID NO: 854988 - RNA, 19 nt, Homo sapiens
ucacagcuggccuugaguu

SEQ ID NO: 854989 - RNA, 19 nt, Homo sapiens
gagcugggguccuucuuca

SEQ ID NO: 854990 - RNA, 19 nt, Homo sapiens
acaacacgccucugcugaa

SEQ ID NO: 854991 - RNA, 19 nt, Homo sapiens
agacagagcugggguccuu

SEQ ID NO: 854992 - RNA, 19 nt, Homo sapiens
caucugagucggcguuuac

SEQ ID NO: 854993 - RNA, 19 nt, Homo sapiens
ccucgucacuggccuuggu

SEQ ID NO: 854994 - RNA, 19 nt, Homo sapiens
gaauaaaaccugucaaccu

SEQ ID NO: 854995 - RNA, 19 nt, Homo sapiens
cuuggucacuuuguauuuc

SEQ ID NO: 854996 - RNA, 19 nt, Homo sapiens
ccacuucccugucauguga

SEQ ID NO: 854997 - RNA, 19 nt, Homo sapiens
uagaagaaaucaacugcuu

SEQ ID NO: 854998 - RNA, 19 nt, Homo sapiens
gaagaaaucaacugcuuag

SEQ ID NO: 854999 - RNA, 19 nt, Homo sapiens
gacaaaggccugggaauug

SEQ ID NO: 855000 - RNA, 19 nt, Homo sapiens
gcagagaccugggacuucu

SEQ ID NO: 855001 - RNA, 19 nt, Homo sapiens
ggaauuggcagcugucauc

SEQ ID NO: 855002 - RNA, 19 nt, Homo sapiens
caguagguguucuguguuu

SEQ ID NO: 855003 - RNA, 19 nt, Homo sapiens
ccaaguucccugugccuua

SEQ ID NO: 855004 - RNA, 19 nt, Homo sapiens
gggacgugcuggccaagaa

SEQ ID NO: 855005 - RNA, 19 nt, Homo sapiens
ugacaaaggccugggaauu

SEQ ID NO: 855006 - RNA, 19 nt, Homo sapiens
gagacuaggaugugaguug

SEQ ID NO: 855007 - RNA, 19 nt, Homo sapiens
agaagguggugucgccaua

SEQ ID NO: 855008 - RNA, 19 nt, Homo sapiens
cugcuuagccggguuguua

SEQ ID NO: 855009 - RNA, 19 nt, Homo sapiens
guccacaccugcccacaga

SEQ ID NO: 855010 - RNA, 19 nt, Homo sapiens
gcaucugagucggcguuua

SEQ ID NO: 855011 - RNA, 19 nt, Homo sapiens
agacuaggaugugaguuga

SEQ ID NO: 855012 - RNA, 19 nt, Homo sapiens
agaagaaaucaacugcuua

SEQ ID NO: 855013 - RNA, 19 nt, Homo sapiens
gugcgggucucaccugugu

SEQ ID NO: 855014 - RNA, 19 nt, Homo sapiens
gcucggcccaggucuguuu

SEQ ID NO: 855015 - RNA, 19 nt, Homo sapiens
gcucuggcauguccgacuu

SEQ ID NO: 855016 - RNA, 19 nt, Homo sapiens
caaguucccugugccuuag

SEQ ID NO: 855017 - RNA, 19 nt, Homo sapiens
gugugggucugguauguga

SEQ ID NO: 855018 - RNA, 19 nt, Homo sapiens
ggaggucgguggguagaag

SEQ ID NO: 855019 - RNA, 19 nt, Homo sapiens
cgccauaccugggcaccua

SEQ ID NO: 855020 - RNA, 19 nt, Homo sapiens
gaccugggacuucuucuuc

SEQ ID NO: 855021 - RNA, 19 nt, Homo sapiens
aauggaagacugagguuaa

SEQ ID NO: 855022 - RNA, 19 nt, Homo sapiens
ucacuggccuuggucacuu

SEQ ID NO: 855023 - RNA, 19 nt, Homo sapiens
caacacgccucugcugaac

SEQ ID NO: 855024 - RNA, 19 nt, Homo sapiens
ucccuuuacugccacauuu

SEQ ID NO: 855025 - RNA, 19 nt, Homo sapiens
gaucugaugagacuaggau

SEQ ID NO: 855026 - RNA, 19 nt, Homo sapiens
ggaagacugagguuaagca

SEQ ID NO: 855027 - RNA, 19 nt, Homo sapiens
acaaaggccugggaauugg

SEQ ID NO: 855028 - RNA, 19 nt, Homo sapiens
gcgugggucucaccugugu

SEQ ID NO: 855029 - RNA, 19 nt, Homo sapiens
acuaggaugugaguugaaa

SEQ ID NO: 855030 - RNA, 19 nt, Homo sapiens
ccauguggcguguguguga

SEQ ID NO: 855031 - RNA, 19 nt, Homo sapiens
cugcugcacuuccggaaug

SEQ ID NO: 855032 - RNA, 19 nt, Homo sapiens
gggcgugacugaggacuac

SEQ ID NO: 855033 - RNA, 19 nt, Homo sapiens
ccacugcccuuaugauccu

SEQ ID NO: 855034 - RNA, 19 nt, Homo sapiens
gggacuucuucuucaguga

SEQ ID NO: 855035 - RNA, 19 nt, Homo sapiens
ggaggccaaucccuuuacu

SEQ ID NO: 855036 - RNA, 19 nt, Homo sapiens
gaggaucugaugagacuag

SEQ ID NO: 855037 - RNA, 19 nt, Homo sapiens
gaagggauuuucauugacu

SEQ ID NO: 855038 - RNA, 19 nt, Homo sapiens
ggucugguaugugacaaag

SEQ ID NO: 855039 - RNA, 19 nt, Homo sapiens
guguggcucucacuugugu

SEQ ID NO: 855040 - RNA, 19 nt, Homo sapiens
ugaugagacuaggauguga

SEQ ID NO: 855041 - RNA, 19 nt, Homo sapiens
uuaggaggaucugaugaga

SEQ ID NO: 855042 - RNA, 19 nt, Homo sapiens
uggccuuggucacuuugua

SEQ ID NO: 855043 - RNA, 19 nt, Homo sapiens
ccacaccugcccacagaga

SEQ ID NO: 855044 - RNA, 19 nt, Homo sapiens
ucacagcuggccuugaguu

SEQ ID NO: 855045 - RNA, 19 nt, Homo sapiens
aggaggaucugaugagacu

SEQ ID NO: 855046 - RNA, 19 nt, Homo sapiens
uaaauggaagacugagguu

SEQ ID NO: 855047 - RNA, 19 nt, Homo sapiens
acaacacgccucugcugaa

SEQ ID NO: 855048 - RNA, 19 nt, Homo sapiens
aaauggaagacugagguua

SEQ ID NO: 855049 - RNA, 19 nt, Homo sapiens
caucugagucggcguuuac

SEQ ID NO: 855050 - RNA, 19 nt, Homo sapiens
ccucgucacuggccuuggu

SEQ ID NO: 855051 - RNA, 19 nt, Homo sapiens
guagguguucuguguuugu

SEQ ID NO: 855052 - RNA, 19 nt, Homo sapiens
gaauaaaaccugucaaccu

SEQ ID NO: 855053 - RNA, 19 nt, Homo sapiens
ccuggccacugcccuuaug

SEQ ID NO: 855054 - RNA, 19 nt, Homo sapiens
cuuggucacuuuguauuuc

SEQ ID NO: 855055 - RNA, 19 nt, Homo sapiens
uagguguucuguguuuguu

SEQ ID NO: 855056 - RNA, 19 nt, Homo sapiens
ggagcuggacaucgaccuu

SEQ ID NO: 855057 - RNA, 19 nt, Homo sapiens
cuguggagcuggacaucga

SEQ ID NO: 855058 - RNA, 19 nt, Homo sapiens
ucucaccugugccgagugu

SEQ ID NO: 855059 - RNA, 19 nt, Homo sapiens
gaacauccgugccaucaga

SEQ ID NO: 855060 - RNA, 19 nt, Homo sapiens
ccagagagcaguaucuuua

SEQ ID NO: 855061 - RNA, 19 nt, Homo sapiens
guaaacagucagaagauua

SEQ ID NO: 855062 - RNA, 19 nt, Homo sapiens
aaagggagcuugaggauca

SEQ ID NO: 855063 - RNA, 19 nt, Homo sapiens
ugaacaagcuugcaaguca

SEQ ID NO: 855064 - RNA, 19 nt, Homo sapiens
ggacgugucugguuauuac

SEQ ID NO: 855065 - RNA, 19 nt, Homo sapiens
ugaaagcaguuuagcauug

SEQ ID NO: 855066 - RNA, 19 nt, Homo sapiens
uagcaaaggugaugaagga

SEQ ID NO: 855067 - RNA, 19 nt, Homo sapiens
gaacgaggguuaaggaaaa

SEQ ID NO: 855068 - RNA, 19 nt, Homo sapiens
ccaauaaacucaccuacuc

SEQ ID NO: 855069 - RNA, 19 nt, Homo sapiens
gagagaaucugcuacaacu

SEQ ID NO: 855070 - RNA, 19 nt, Homo sapiens
gagaguaucugagaaccaa

SEQ ID NO: 855071 - RNA, 19 nt, Homo sapiens
caaaggugaugaaggaguu

SEQ ID NO: 855072 - RNA, 19 nt, Homo sapiens
gaugaagccuggaauggau

SEQ ID NO: 855073 - RNA, 19 nt, Homo sapiens
ggaaugggaagaaguaguu

SEQ ID NO: 855074 - RNA, 19 nt, Homo sapiens
gcaaugagaaggccaggaa

SEQ ID NO: 855075 - RNA, 19 nt, Homo sapiens
cggaggacgugucugguua

SEQ ID NO: 855076 - RNA, 19 nt, Homo sapiens
gaaagcaguuuagcauugg

SEQ ID NO: 855077 - RNA, 19 nt, Homo sapiens
guuagugacuuuggcauuu

SEQ ID NO: 855078 - RNA, 19 nt, Homo sapiens
gaagcuggaacgaggguua

SEQ ID NO: 855079 - RNA, 19 nt, Homo sapiens
ccacacagcucagaacagu

SEQ ID NO: 855080 - RNA, 19 nt, Homo sapiens
gaauauauugggcgaagaa

SEQ ID NO: 855081 - RNA, 19 nt, Homo sapiens
gaccaaagcggcaccaaug

SEQ ID NO: 855082 - RNA, 19 nt, Homo sapiens
ugaaggcggugaacagguu

SEQ ID NO: 855083 - RNA, 19 nt, Homo sapiens
gcaggaaccagcaaugaga

SEQ ID NO: 855084 - RNA, 19 nt, Homo sapiens
ggaacgaggguuaaggaaa

SEQ ID NO: 855085 - RNA, 19 nt, Homo sapiens
uaaguaaacagucagaaga

SEQ ID NO: 855086 - RNA, 19 nt, Homo sapiens
gagagcaguaucuuuauug

SEQ ID NO: 855087 - RNA, 19 nt, Homo sapiens
agaaagagcugaaaaugga

SEQ ID NO: 855088 - RNA, 19 nt, Homo sapiens
ggauaaggagggcaaggua

SEQ ID NO: 855089 - RNA, 19 nt, Homo sapiens
ucaccaagauccaugagau

SEQ ID NO: 855090 - RNA, 19 nt, Homo sapiens
gcaccaauguagcaaaggu

SEQ ID NO: 855091 - RNA, 19 nt, Homo sapiens
ccaaagcggcaccaaugua

SEQ ID NO: 855092 - RNA, 19 nt, Homo sapiens
gcaagugcaccaaggagaa

SEQ ID NO: 855093 - RNA, 19 nt, Homo sapiens
gauaaggagggcaagguaa

SEQ ID NO: 855094 - RNA, 19 nt, Homo sapiens
ggagugcaguggcucaauc

SEQ ID NO: 855095 - RNA, 19 nt, Homo sapiens
ccaauguucuuaccuuagu

SEQ ID NO: 855096 - RNA, 19 nt, Homo sapiens
aaacucaccuacucaccaa

SEQ ID NO: 855097 - RNA, 19 nt, Homo sapiens
ccaaagugcugggauuaca

SEQ ID NO: 855098 - RNA, 19 nt, Homo sapiens
ucacagaaggaaucaguuu

SEQ ID NO: 855099 - RNA, 19 nt, Homo sapiens
gaggauuaccuuaaguauu

SEQ ID NO: 855100 - RNA, 19 nt, Homo sapiens
agagaggacuggagagugu

SEQ ID NO: 855101 - RNA, 19 nt, Homo sapiens
ccacagaggcaccaccauu

SEQ ID NO: 855102 - RNA, 19 nt, Homo sapiens
agaaacagcagcuccacua

SEQ ID NO: 855103 - RNA, 19 nt, Homo sapiens
gauggagucucgcucuauc

SEQ ID NO: 855104 - RNA, 19 nt, Homo sapiens
guucuuaccuuaguugaca

SEQ ID NO: 855105 - RNA, 19 nt, Homo sapiens
ggagcagcguguuuacugu

SEQ ID NO: 855106 - RNA, 19 nt, Homo sapiens
agagagcaguaucuuuauu

SEQ ID NO: 855107 - RNA, 19 nt, Homo sapiens
guguguaagucccaauaaa

SEQ ID NO: 855108 - RNA, 19 nt, Homo sapiens
ucagaagauuagcaugaaa

SEQ ID NO: 855109 - RNA, 19 nt, Homo sapiens
gaaaagaaagagcugaaaa

SEQ ID NO: 855110 - RNA, 19 nt, Homo sapiens
gaacugaguguuagugacu

SEQ ID NO: 855111 - RNA, 19 nt, Homo sapiens
caagguaaagcuuauggaa

SEQ ID NO: 855112 - RNA, 19 nt, Homo sapiens
uacaacugcugacugauga

SEQ ID NO: 855113 - RNA, 19 nt, Homo sapiens
ugauguccuuccaagaaua

SEQ ID NO: 855114 - RNA, 19 nt, Homo sapiens
ucagaacaguuggaucuug

SEQ ID NO: 855115 - RNA, 19 nt, Homo sapiens
gcagaugagcuccguaaag

SEQ ID NO: 855116 - RNA, 19 nt, Homo sapiens
gagggcaagguaaagcuua

SEQ ID NO: 855117 - RNA, 19 nt, Homo sapiens
aaucucggcucacugcaaa

SEQ ID NO: 855118 - RNA, 19 nt, Homo sapiens
gggcgaaucucagcugaag

SEQ ID NO: 855119 - RNA, 19 nt, Homo sapiens
uuacugugcuuggucauga

SEQ ID NO: 855120 - RNA, 19 nt, Homo sapiens
ggauugaccuguguguaag

SEQ ID NO: 855121 - RNA, 19 nt, Homo sapiens
gucagaagauuagcaugaa

SEQ ID NO: 855122 - RNA, 19 nt, Homo sapiens
ggauacaggagaagaaaca

SEQ ID NO: 855123 - RNA, 19 nt, Homo sapiens
gaggacgugucugguuauu

SEQ ID NO: 855124 - RNA, 19 nt, Homo sapiens
ggacuaaagaauauauugg

SEQ ID NO: 855125 - RNA, 19 nt, Homo sapiens
gcucagaacaguuggaucu

SEQ ID NO: 855126 - RNA, 19 nt, Homo sapiens
gguagaacuaguaaacaaa

SEQ ID NO: 855127 - RNA, 19 nt, Homo sapiens
cagaugagcuccguaaagc

SEQ ID NO: 855128 - RNA, 19 nt, Homo sapiens
acacagcucagaacaguug

SEQ ID NO: 855129 - RNA, 19 nt, Homo sapiens
gauguccuuccaagaauaa

SEQ ID NO: 855130 - RNA, 19 nt, Homo sapiens
ucacuuucccuuucgaauu

SEQ ID NO: 855131 - RNA, 19 nt, Homo sapiens
gcaaugagcagaggaacca

SEQ ID NO: 855132 - RNA, 19 nt, Homo sapiens
ugguagaacuaguaaacaa

SEQ ID NO: 855133 - RNA, 19 nt, Homo sapiens
gagcuugaggaucacauaa

SEQ ID NO: 855134 - RNA, 19 nt, Homo sapiens
agagcaguaucuuuauuga

SEQ ID NO: 855135 - RNA, 19 nt, Homo sapiens
ucugagaaccaaccaauga

SEQ ID NO: 855136 - RNA, 19 nt, Homo sapiens
ucaacuuucucaccaagau

SEQ ID NO: 855137 - RNA, 19 nt, Homo sapiens
gagcagaggaaccaugauc

SEQ ID NO: 855138 - RNA, 19 nt, Homo sapiens
caaagcggcaccaauguag

SEQ ID NO: 855139 - RNA, 19 nt, Homo sapiens
gacuuucacuuucccuuuc

SEQ ID NO: 855140 - RNA, 19 nt, Homo sapiens
ggagcuugaggaucacaua

SEQ ID NO: 855141 - RNA, 19 nt, Homo sapiens
ccaagucacacaagggauu

SEQ ID NO: 855142 - RNA, 19 nt, Homo sapiens
guaagucccaauaaacuca

SEQ ID NO: 855143 - RNA, 19 nt, Homo sapiens
cuuauggaacugaguguua

SEQ ID NO: 855144 - RNA, 19 nt, Homo sapiens
cagagccaacccucaguua

SEQ ID NO: 855145 - RNA, 19 nt, Homo sapiens
uuaccuuaguugacaauug

SEQ ID NO: 855146 - RNA, 19 nt, Homo sapiens
cacuuucccuuucgaauuc

SEQ ID NO: 855147 - RNA, 19 nt, Homo sapiens
caugaaagcaguuuagcau

SEQ ID NO: 855148 - RNA, 19 nt, Homo sapiens
guaaguaaacagucagaag

SEQ ID NO: 855149 - RNA, 19 nt, Homo sapiens
cacaagggauugggaggaa

SEQ ID NO: 855150 - RNA, 19 nt, Homo sapiens
gaagcuccgugcccuugca

SEQ ID NO: 855151 - RNA, 19 nt, Homo sapiens
caagugagcagagagaauc

SEQ ID NO: 855152 - RNA, 19 nt, Homo sapiens
ggaggaagcacagaucucu

SEQ ID NO: 855153 - RNA, 19 nt, Homo sapiens
ggagaaaaccagaguuaga

SEQ ID NO: 855154 - RNA, 19 nt, Homo sapiens
ggaccaaagcggcaccaau

SEQ ID NO: 855155 - RNA, 19 nt, Homo sapiens
ccaaugugguguccaacuc

SEQ ID NO: 855156 - RNA, 19 nt, Homo sapiens
uaaacagucagaagauuag

SEQ ID NO: 855157 - RNA, 19 nt, Homo sapiens
aacccaaacuucccagaga

SEQ ID NO: 855158 - RNA, 19 nt, Homo sapiens
gggcacaggccaggacaaa

SEQ ID NO: 855159 - RNA, 19 nt, Homo sapiens
gaacauccgugccaucaga

SEQ ID NO: 855160 - RNA, 19 nt, Homo sapiens
ccagagagcaguaucuuua

SEQ ID NO: 855161 - RNA, 19 nt, Homo sapiens
guaaacagucagaagauua

SEQ ID NO: 855162 - RNA, 19 nt, Homo sapiens
aaagggagcuugaggauca

SEQ ID NO: 855163 - RNA, 19 nt, Homo sapiens
ugaacaagcuugcaaguca

SEQ ID NO: 855164 - RNA, 19 nt, Homo sapiens
ggacgugucugguuauuac

SEQ ID NO: 855165 - RNA, 19 nt, Homo sapiens
ugaaagcaguuuagcauug

SEQ ID NO: 855166 - RNA, 19 nt, Homo sapiens
uagcaaaggugaugaagga

SEQ ID NO: 855167 - RNA, 19 nt, Homo sapiens
gaacgaggguuaaggaaaa

SEQ ID NO: 855168 - RNA, 19 nt, Homo sapiens
ccaauaaacucaccuacuc

SEQ ID NO: 855169 - RNA, 19 nt, Homo sapiens
gagagaaucugcuacaacu

SEQ ID NO: 855170 - RNA, 19 nt, Homo sapiens
gagaguaucugagaaccaa

SEQ ID NO: 855171 - RNA, 19 nt, Homo sapiens
caaaggugaugaaggaguu

SEQ ID NO: 855172 - RNA, 19 nt, Homo sapiens
gaugaagccuggaauggau

SEQ ID NO: 855173 - RNA, 19 nt, Homo sapiens
ggaaugggaagaaguaguu

SEQ ID NO: 855174 - RNA, 19 nt, Homo sapiens
gcaaugagaaggccaggaa

SEQ ID NO: 855175 - RNA, 19 nt, Homo sapiens
cggaggacgugucugguua

SEQ ID NO: 855176 - RNA, 19 nt, Homo sapiens
gaauugcacugaggcuuga

SEQ ID NO: 855177 - RNA, 19 nt, Homo sapiens
gaaagcaguuuagcauugg

SEQ ID NO: 855178 - RNA, 19 nt, Homo sapiens
guuagugacuuuggcauuu

SEQ ID NO: 855179 - RNA, 19 nt, Homo sapiens
gaagcuggaacgaggguua

SEQ ID NO: 855180 - RNA, 19 nt, Homo sapiens
ccacacagcucagaacagu

SEQ ID NO: 855181 - RNA, 19 nt, Homo sapiens
gaauauauugggcgaagaa

SEQ ID NO: 855182 - RNA, 19 nt, Homo sapiens
gaccaaagcggcaccaaug

SEQ ID NO: 855183 - RNA, 19 nt, Homo sapiens
ugaaggcggugaacagguu

SEQ ID NO: 855184 - RNA, 19 nt, Homo sapiens
gcaggaaccagcaaugaga

SEQ ID NO: 855185 - RNA, 19 nt, Homo sapiens
ggaacgaggguuaaggaaa

SEQ ID NO: 855186 - RNA, 19 nt, Homo sapiens
uaaguaaacagucagaaga

SEQ ID NO: 855187 - RNA, 19 nt, Homo sapiens
gagagcaguaucuuuauug

SEQ ID NO: 855188 - RNA, 19 nt, Homo sapiens
agaaagagcugaaaaugga

SEQ ID NO: 855189 - RNA, 19 nt, Homo sapiens
ggauaaggagggcaaggua

SEQ ID NO: 855190 - RNA, 19 nt, Homo sapiens
ucaccaagauccaugagau

SEQ ID NO: 855191 - RNA, 19 nt, Homo sapiens
gcaccaauguagcaaaggu

SEQ ID NO: 855192 - RNA, 19 nt, Homo sapiens
ccaaagcggcaccaaugua

SEQ ID NO: 855193 - RNA, 19 nt, Homo sapiens
gcaagugcaccaaggagaa

SEQ ID NO: 855194 - RNA, 19 nt, Homo sapiens
gauaaggagggcaagguaa

SEQ ID NO: 855195 - RNA, 19 nt, Homo sapiens
ggagugcaguggcucaauc

SEQ ID NO: 855196 - RNA, 19 nt, Homo sapiens
ccaauguucuuaccuuagu

SEQ ID NO: 855197 - RNA, 19 nt, Homo sapiens
aaacucaccuacucaccaa

SEQ ID NO: 855198 - RNA, 19 nt, Homo sapiens
ugacacagcagaccuugaa

SEQ ID NO: 855199 - RNA, 19 nt, Homo sapiens
ccaaagugcugggauuaca

SEQ ID NO: 855200 - RNA, 19 nt, Homo sapiens
ucacagaaggaaucaguuu

SEQ ID NO: 855201 - RNA, 19 nt, Homo sapiens
gaggauuaccuuaaguauu

SEQ ID NO: 855202 - RNA, 19 nt, Homo sapiens
agagaggacuggagagugu

SEQ ID NO: 855203 - RNA, 19 nt, Homo sapiens
ccacagaggcaccaccauu

SEQ ID NO: 855204 - RNA, 19 nt, Homo sapiens
agaaacagcagcuccacua

SEQ ID NO: 855205 - RNA, 19 nt, Homo sapiens
gauggagucucgcucuauc

SEQ ID NO: 855206 - RNA, 19 nt, Homo sapiens
guucuuaccuuaguugaca

SEQ ID NO: 855207 - RNA, 19 nt, Homo sapiens
agagagcaguaucuuuauu

SEQ ID NO: 855208 - RNA, 19 nt, Homo sapiens
guguguaagucccaauaaa

SEQ ID NO: 855209 - RNA, 19 nt, Homo sapiens
ucagaagauuagcaugaaa

SEQ ID NO: 855210 - RNA, 19 nt, Homo sapiens
gaaaagaaagagcugaaaa

SEQ ID NO: 855211 - RNA, 19 nt, Homo sapiens
gaacugaguguuagugacu

SEQ ID NO: 855212 - RNA, 19 nt, Homo sapiens
caagguaaagcuuauggaa

SEQ ID NO: 855213 - RNA, 19 nt, Homo sapiens
uacaacugcugacugauga

SEQ ID NO: 855214 - RNA, 19 nt, Homo sapiens
ugauguccuuccaagaaua

SEQ ID NO: 855215 - RNA, 19 nt, Homo sapiens
gcagaugagcuccguaaag

SEQ ID NO: 855216 - RNA, 19 nt, Homo sapiens
ucagaacaguuggaucuug

SEQ ID NO: 855217 - RNA, 19 nt, Homo sapiens
gagggcaagguaaagcuua

SEQ ID NO: 855218 - RNA, 19 nt, Homo sapiens
aaucucggcucacugcaaa

SEQ ID NO: 855219 - RNA, 19 nt, Homo sapiens
gggcgaaucucagcugaag

SEQ ID NO: 855220 - RNA, 19 nt, Homo sapiens
cacugaggcuugagucuga

SEQ ID NO: 855221 - RNA, 19 nt, Homo sapiens
ggauugaccuguguguaag

SEQ ID NO: 855222 - RNA, 19 nt, Homo sapiens
gucagaagauuagcaugaa

SEQ ID NO: 855223 - RNA, 19 nt, Homo sapiens
ggauacaggagaagaaaca

SEQ ID NO: 855224 - RNA, 19 nt, Homo sapiens
ggacuaaagaauauauugg

SEQ ID NO: 855225 - RNA, 19 nt, Homo sapiens
gaggacgugucugguuauu

SEQ ID NO: 855226 - RNA, 19 nt, Homo sapiens
gguagaacuaguaaacaaa

SEQ ID NO: 855227 - RNA, 19 nt, Homo sapiens
gcucagaacaguuggaucu

SEQ ID NO: 855228 - RNA, 19 nt, Homo sapiens
cagaugagcuccguaaagc

SEQ ID NO: 855229 - RNA, 19 nt, Homo sapiens
gauguccuuccaagaauaa

SEQ ID NO: 855230 - RNA, 19 nt, Homo sapiens
acacagcucagaacaguug

SEQ ID NO: 855231 - RNA, 19 nt, Homo sapiens
gcaaugagcagaggaacca

SEQ ID NO: 855232 - RNA, 19 nt, Homo sapiens
ugguagaacuaguaaacaa

SEQ ID NO: 855233 - RNA, 19 nt, Homo sapiens
gagcuugaggaucacauaa

SEQ ID NO: 855234 - RNA, 19 nt, Homo sapiens
agagcaguaucuuuauuga

SEQ ID NO: 855235 - RNA, 19 nt, Homo sapiens
ucugagaaccaaccaauga

SEQ ID NO: 855236 - RNA, 19 nt, Homo sapiens
ucaacuuucucaccaagau

SEQ ID NO: 855237 - RNA, 19 nt, Homo sapiens
gagcagaggaaccaugauc

SEQ ID NO: 855238 - RNA, 19 nt, Homo sapiens
caaagcggcaccaauguag

SEQ ID NO: 855239 - RNA, 19 nt, Homo sapiens
ggagcuugaggaucacaua

SEQ ID NO: 855240 - RNA, 19 nt, Homo sapiens
ccaagucacacaagggauu

SEQ ID NO: 855241 - RNA, 19 nt, Homo sapiens
caccugcugugcccuuaaa

SEQ ID NO: 855242 - RNA, 19 nt, Homo sapiens
guaagucccaauaaacuca

SEQ ID NO: 855243 - RNA, 19 nt, Homo sapiens
gaugugaggcaggguauau

SEQ ID NO: 855244 - RNA, 19 nt, Homo sapiens
cuuauggaacugaguguua

SEQ ID NO: 855245 - RNA, 19 nt, Homo sapiens
cagagccaacccucaguua

SEQ ID NO: 855246 - RNA, 19 nt, Homo sapiens
uuaccuuaguugacaauug

SEQ ID NO: 855247 - RNA, 19 nt, Homo sapiens
cggcucagauggguucaaa

SEQ ID NO: 855248 - RNA, 19 nt, Homo sapiens
caugaaagcaguuuagcau

SEQ ID NO: 855249 - RNA, 19 nt, Homo sapiens
guaaguaaacagucagaag

SEQ ID NO: 855250 - RNA, 19 nt, Homo sapiens
cacaagggauugggaggaa

SEQ ID NO: 855251 - RNA, 19 nt, Homo sapiens
gaagcuccgugcccuugca

SEQ ID NO: 855252 - RNA, 19 nt, Homo sapiens
caagugagcagagagaauc

SEQ ID NO: 855253 - RNA, 19 nt, Homo sapiens
ggaggaagcacagaucucu

SEQ ID NO: 855254 - RNA, 19 nt, Homo sapiens
ggagaaaaccagaguuaga

SEQ ID NO: 855255 - RNA, 19 nt, Homo sapiens
ggaccaaagcggcaccaau

SEQ ID NO: 855256 - RNA, 19 nt, Homo sapiens
ccaaugugguguccaacuc

SEQ ID NO: 855257 - RNA, 19 nt, Homo sapiens
uaaacagucagaagauuag

SEQ ID NO: 855258 - RNA, 19 nt, Homo sapiens
aacccaaacuucccagaga

SEQ ID NO: 855259 - RNA, 19 nt, Homo sapiens
gagaacaacuccucuaauu

SEQ ID NO: 855260 - RNA, 19 nt, Homo sapiens
ugacauaccuggaggacua

SEQ ID NO: 855261 - RNA, 19 nt, Homo sapiens
cagaaacgcugcugaguga

SEQ ID NO: 855262 - RNA, 19 nt, Homo sapiens
gcaaguaacucuggcuaga

SEQ ID NO: 855263 - RNA, 19 nt, Homo sapiens
gaacaacuccucuaauucu

SEQ ID NO: 855264 - RNA, 19 nt, Homo sapiens
cgaaauauguacacagaga

SEQ ID NO: 855265 - RNA, 19 nt, Homo sapiens
ggacugcacuguuccucuu

SEQ ID NO: 855266 - RNA, 19 nt, Homo sapiens
cgacaacucuggacaaguc

SEQ ID NO: 855267 - RNA, 19 nt, Homo sapiens
gagaguguccuaaauauca

SEQ ID NO: 855268 - RNA, 19 nt, Homo sapiens
uguauuggcuggaauuuga

SEQ ID NO: 855269 - RNA, 19 nt, Homo sapiens
ccaguuagaucauaauucu

SEQ ID NO: 855270 - RNA, 19 nt, Homo sapiens
gaaauucccagcugagaga

SEQ ID NO: 855271 - RNA, 19 nt, Homo sapiens
ggaauacccuggaaucacu

SEQ ID NO: 855272 - RNA, 19 nt, Homo sapiens
caacugaaccuacugaagu

SEQ ID NO: 855273 - RNA, 19 nt, Homo sapiens
acacguggcuugguuuaaa

SEQ ID NO: 855274 - RNA, 19 nt, Homo sapiens
ggaagaauugggauagaaa

SEQ ID NO: 855275 - RNA, 19 nt, Homo sapiens
gaaagcagcaacaacugaa

SEQ ID NO: 855276 - RNA, 19 nt, Homo sapiens
ucugagagcuuaccugugu

SEQ ID NO: 855277 - RNA, 19 nt, Homo sapiens
uagagaguguccuaaauau

SEQ ID NO: 855278 - RNA, 19 nt, Homo sapiens
gcaagucuauacugcuguu

SEQ ID NO: 855279 - RNA, 19 nt, Homo sapiens
gcacacguggcuugguuua

SEQ ID NO: 855280 - RNA, 19 nt, Homo sapiens
gaagagaaagacagaagga

SEQ ID NO: 855281 - RNA, 19 nt, Homo sapiens
gcacuggaacccacagaaa

SEQ ID NO: 855282 - RNA, 19 nt, Homo sapiens
caagggaaccugacacaga

SEQ ID NO: 855283 - RNA, 19 nt, Homo sapiens
gagagaagagugagaacaa

SEQ ID NO: 855284 - RNA, 19 nt, Homo sapiens
cagaagugaucacaguuga

SEQ ID NO: 855285 - RNA, 19 nt, Homo sapiens
gaagugaucacaguugaga

SEQ ID NO: 855286 - RNA, 19 nt, Homo sapiens
acacagaagugaucacagu

SEQ ID NO: 855287 - RNA, 19 nt, Homo sapiens
gcaagaggcacuuccugaa

SEQ ID NO: 855288 - RNA, 19 nt, Homo sapiens
ggauggucccugucuauaa

SEQ ID NO: 855289 - RNA, 19 nt, Homo sapiens
gagagaggguuuacuuagg

SEQ ID NO: 855290 - RNA, 19 nt, Homo sapiens
guggaacacucugggauaa

SEQ ID NO: 855291 - RNA, 19 nt, Homo sapiens
gggcacacguggcuugguu

SEQ ID NO: 855292 - RNA, 19 nt, Homo sapiens
gagaaagacagaaggaugu

SEQ ID NO: 855293 - RNA, 19 nt, Homo sapiens
gaaauagagaguguccuaa

SEQ ID NO: 855294 - RNA, 19 nt, Homo sapiens
gauguaagguuggaguugu

SEQ ID NO: 855295 - RNA, 19 nt, Homo sapiens
aaaucucccuaaagcaaua

SEQ ID NO: 855296 - RNA, 19 nt, Homo sapiens
gaucccagcccuaaaggaa

SEQ ID NO: 855297 - RNA, 19 nt, Homo sapiens
gagagaacaugugucuugu

SEQ ID NO: 855298 - RNA, 19 nt, Homo sapiens
gcgagagaggguuuacuua

SEQ ID NO: 855299 - RNA, 19 nt, Homo sapiens
ggaguuguauuggcuggaa

SEQ ID NO: 855300 - RNA, 19 nt, Homo sapiens
ggaagagagccuuguggaa

SEQ ID NO: 855301 - RNA, 19 nt, Homo sapiens
ugaaauagagaguguccua

SEQ ID NO: 855302 - RNA, 19 nt, Homo sapiens
gaaauauguacacagagaa

SEQ ID NO: 855303 - RNA, 19 nt, Homo sapiens
uggaaucacugcagaagau

SEQ ID NO: 855304 - RNA, 19 nt, Homo sapiens
gaggaggaauacccuggaa

SEQ ID NO: 855305 - RNA, 19 nt, Homo sapiens
gcacuguguuuagucuuga

SEQ ID NO: 855306 - RNA, 19 nt, Homo sapiens
gaaacgcugcugagugaga

SEQ ID NO: 855307 - RNA, 19 nt, Homo sapiens
uguagaacuugaugaagaa

SEQ ID NO: 855308 - RNA, 19 nt, Homo sapiens
ugcaauggauccugaagaa

SEQ ID NO: 855309 - RNA, 19 nt, Homo sapiens
acagaaagccugccagugu

SEQ ID NO: 855310 - RNA, 19 nt, Homo sapiens
uaguuuggcuuucagaguu

SEQ ID NO: 855311 - RNA, 19 nt, Homo sapiens
auagagaguguccuaaaua

SEQ ID NO: 855312 - RNA, 19 nt, Homo sapiens
agagaggguuuacuuagga

SEQ ID NO: 855313 - RNA, 19 nt, Homo sapiens
ggccuccgcucaugcuaaa

SEQ ID NO: 855314 - RNA, 19 nt, Homo sapiens
gaaagacagaaggauguaa

SEQ ID NO: 855315 - RNA, 19 nt, Homo sapiens
aagggaaccugacacagaa

SEQ ID NO: 855316 - RNA, 19 nt, Homo sapiens
gauggucccugucuauaac

SEQ ID NO: 855317 - RNA, 19 nt, Homo sapiens
agagagaacaugugucuug

SEQ ID NO: 855318 - RNA, 19 nt, Homo sapiens
gagaggguuuacuuaggaa

SEQ ID NO: 855319 - RNA, 19 nt, Homo sapiens
gaaccugacacagaaguga

SEQ ID NO: 855320 - RNA, 19 nt, Homo sapiens
gaagaauugggauagaaau

SEQ ID NO: 855321 - RNA, 19 nt, Homo sapiens
acauucaucugacuguaaa

SEQ ID NO: 855322 - RNA, 19 nt, Homo sapiens
gacagaaggauguaagguu

SEQ ID NO: 855323 - RNA, 19 nt, Homo sapiens
aagagagccuuguggaaga

SEQ ID NO: 855324 - RNA, 19 nt, Homo sapiens
caacaacugaaccuacuga

SEQ ID NO: 855325 - RNA, 19 nt, Homo sapiens
aauagagaguguccuaaau

SEQ ID NO: 855326 - RNA, 19 nt, Homo sapiens
ugagugagaaggagauaaa

SEQ ID NO: 855327 - RNA, 19 nt, Homo sapiens
ggaggaauacccuggaauc

SEQ ID NO: 855328 - RNA, 19 nt, Homo sapiens
ggcagcagauugcaaugga

SEQ ID NO: 855329 - RNA, 19 nt, Homo sapiens
aaauagagaguguccuaaa

SEQ ID NO: 855330 - RNA, 19 nt, Homo sapiens
ggaaucuucgaaauaugua

SEQ ID NO: 855331 - RNA, 19 nt, Homo sapiens
gggaaucuucgaaauaugu

SEQ ID NO: 855332 - RNA, 19 nt, Homo sapiens
ccagagaugacaaacgaaa

SEQ ID NO: 855333 - RNA, 19 nt, Homo sapiens
ucccagagaugacaaacga

SEQ ID NO: 855334 - RNA, 19 nt, Homo sapiens
gcucugcagauucuaguuu

SEQ ID NO: 855335 - RNA, 19 nt, Homo sapiens
caugcuaaauugagaaucu

SEQ ID NO: 855336 - RNA, 19 nt, Homo sapiens
ucacauucaucugacugua

SEQ ID NO: 855337 - RNA, 19 nt, Homo sapiens
uuguagaacuugaugaaga

SEQ ID NO: 855338 - RNA, 19 nt, Homo sapiens
gagaaauccagcccugcua

SEQ ID NO: 855339 - RNA, 19 nt, Homo sapiens
gugagaacaacuccucuaa

SEQ ID NO: 855340 - RNA, 19 nt, Homo sapiens
caauggauccugaagaagu

SEQ ID NO: 855341 - RNA, 19 nt, Homo sapiens
ggaaucacugcagaagaua

SEQ ID NO: 855342 - RNA, 19 nt, Homo sapiens
agucagaggaggaggaaua

SEQ ID NO: 855343 - RNA, 19 nt, Homo sapiens
uaucaggcauuucgggaau

SEQ ID NO: 855344 - RNA, 19 nt, Homo sapiens
ggcacuguguuuagucuug

SEQ ID NO: 855345 - RNA, 19 nt, Homo sapiens
gccagcaacaucucuauug

SEQ ID NO: 855346 - RNA, 19 nt, Homo sapiens
ugaaagcagcaacaacuga

SEQ ID NO: 855347 - RNA, 19 nt, Homo sapiens
gaucacaguugagaaaucc

SEQ ID NO: 855348 - RNA, 19 nt, Homo sapiens
uagagccaguuagaucaua

SEQ ID NO: 855349 - RNA, 19 nt, Homo sapiens
gcuuauagagccaguuaga

SEQ ID NO: 855350 - RNA, 19 nt, Homo sapiens
cgagagaggguuuacuuag

SEQ ID NO: 855351 - RNA, 19 nt, Homo sapiens
gagcuggagagaagaguga

SEQ ID NO: 855352 - RNA, 19 nt, Homo sapiens
guacaucauucagcaaggu

SEQ ID NO: 855353 - RNA, 19 nt, Homo sapiens
uugggaaucuucgaaauau

SEQ ID NO: 855354 - RNA, 19 nt, Homo sapiens
ggcauucacauucaucuga

SEQ ID NO: 855355 - RNA, 19 nt, Homo sapiens
uaagguuggaguuguauug

SEQ ID NO: 855356 - RNA, 19 nt, Homo sapiens
auaugggaccuuagucuua

SEQ ID NO: 855357 - RNA, 19 nt, Homo sapiens
aaacgcugcugagugagaa

SEQ ID NO: 855358 - RNA, 19 nt, Homo sapiens
ggugaaagcagcaacaacu

SEQ ID NO: 855359 - RNA, 19 nt, Homo sapiens
gcaaguggaugguaagaua

SEQ ID NO: 855360 - RNA, 19 nt, Homo sapiens
caacaaggaugauaugaag

SEQ ID NO: 855361 - RNA, 19 nt, Homo sapiens
gggcuucaguuccauauuu

SEQ ID NO: 855362 - RNA, 19 nt, Homo sapiens
ggaguaaccugaaucaucu

SEQ ID NO: 855363 - RNA, 19 nt, Homo sapiens
ugaagaaaguugugaagga

SEQ ID NO: 855364 - RNA, 19 nt, Homo sapiens
ccucaucucccgcaaauaa

SEQ ID NO: 855365 - RNA, 19 nt, Homo sapiens
gguaagauuugaccucauc

SEQ ID NO: 855366 - RNA, 19 nt, Homo sapiens
ccaaguacaucgugcaagu

SEQ ID NO: 855367 - RNA, 19 nt, Homo sapiens
gaccucaucucccgcaaau

SEQ ID NO: 855368 - RNA, 19 nt, Homo sapiens
gaaaucaugcaacuacuca

SEQ ID NO: 855369 - RNA, 19 nt, Homo sapiens
gcagaucagugucucuagu

SEQ ID NO: 855370 - RNA, 19 nt, Homo sapiens
gcacguggccaccaucaug

SEQ ID NO: 855371 - RNA, 19 nt, Homo sapiens
gggauucuucguuggauua

SEQ ID NO: 855372 - RNA, 19 nt, Homo sapiens
gcagagggccagagaaugg

SEQ ID NO: 855373 - RNA, 19 nt, Homo sapiens
ccaacgcccucucuacugu

SEQ ID NO: 855374 - RNA, 19 nt, Homo sapiens
aggaagggcugcugggauu

SEQ ID NO: 855375 - RNA, 19 nt, Homo sapiens
gcccagcucugccuguguu

SEQ ID NO: 855376 - RNA, 19 nt, Homo sapiens
ccaacaaggaugauaugaa

SEQ ID NO: 855377 - RNA, 19 nt, Homo sapiens
gcaucauucuccugcuuug

SEQ ID NO: 855378 - RNA, 19 nt, Homo sapiens
gaacaacugcgggcugcaa

SEQ ID NO: 855379 - RNA, 19 nt, Homo sapiens
ggugaugccucgcguacag

SEQ ID NO: 855380 - RNA, 19 nt, Homo sapiens
ccccauaccucgcagauuu

SEQ ID NO: 855381 - RNA, 19 nt, Homo sapiens
guaaccugcuggcccacuu

SEQ ID NO: 855382 - RNA, 19 nt, Homo sapiens
gaugagauugagcagguuu

SEQ ID NO: 855383 - RNA, 19 nt, Homo sapiens
gggcagaucagugucucua

SEQ ID NO: 855384 - RNA, 19 nt, Homo sapiens
ucaugcaacuacucagaau

SEQ ID NO: 855385 - RNA, 19 nt, Homo sapiens
caucaugucuaggccuaug

SEQ ID NO: 855386 - RNA, 19 nt, Homo sapiens
ggcuucaguuccauauuug

SEQ ID NO: 855387 - RNA, 19 nt, Homo sapiens
gagcuccauugggaagauu

SEQ ID NO: 855388 - RNA, 19 nt, Homo sapiens
gcaacuacucagaaugugu

SEQ ID NO: 855389 - RNA, 19 nt, Homo sapiens
ucaucaggaucaugcuuug

SEQ ID NO: 855390 - RNA, 19 nt, Homo sapiens
ggaaaucaugcaacuacuc

SEQ ID NO: 855391 - RNA, 19 nt, Homo sapiens
gugcagagggccagagaau

SEQ ID NO: 855392 - RNA, 19 nt, Homo sapiens
uggauucacugcuggaagu

SEQ ID NO: 855393 - RNA, 19 nt, Homo sapiens
ccucauggcugugaacaac

SEQ ID NO: 855394 - RNA, 19 nt, Homo sapiens
ccuacgagaugaugaugca

SEQ ID NO: 855395 - RNA, 19 nt, Homo sapiens
uugagcagguuuccaacaa

SEQ ID NO: 855396 - RNA, 19 nt, Homo sapiens
guacaucgugcaaguggau

SEQ ID NO: 855397 - RNA, 19 nt, Homo sapiens
cugguuaccugugcaguug

SEQ ID NO: 855398 - RNA, 19 nt, Homo sapiens
cagaauguguccuccucau

SEQ ID NO: 855399 - RNA, 19 nt, Homo sapiens
augccuaccugguggauga

SEQ ID NO: 855400 - RNA, 19 nt, Homo sapiens
uggaguaaccugaaucauc

SEQ ID NO: 855401 - RNA, 19 nt, Homo sapiens
cagugagcaugcugaccua

SEQ ID NO: 855402 - RNA, 19 nt, Homo sapiens
augcucaucuguuuaaugg

SEQ ID NO: 855403 - RNA, 19 nt, Homo sapiens
ucgcagauuugcugagucu

SEQ ID NO: 855404 - RNA, 19 nt, Homo sapiens
ccugugcaguugugaauac

SEQ ID NO: 855405 - RNA, 19 nt, Homo sapiens
gggaaaucaugcaacuacu

SEQ ID NO: 855406 - RNA, 19 nt, Homo sapiens
gcccuggaguaaccugaau

SEQ ID NO: 855407 - RNA, 19 nt, Homo sapiens
gcuaguuggcgaccucaug

SEQ ID NO: 855408 - RNA, 19 nt, Homo sapiens
ccggagcuauaccaaguuc

SEQ ID NO: 855409 - RNA, 19 nt, Homo sapiens
gcugcaugguccaguuugu

SEQ ID NO: 855410 - RNA, 19 nt, Homo sapiens
gguagcaugaagaagguuu

SEQ ID NO: 855411 - RNA, 19 nt, Homo sapiens
ucauggcugugaacaacug

SEQ ID NO: 855412 - RNA, 19 nt, Homo sapiens
gcgcugcaugguccaguuu

SEQ ID NO: 855413 - RNA, 19 nt, Homo sapiens
agauugagcagguuuccaa

SEQ ID NO: 855414 - RNA, 19 nt, Homo sapiens
ucucuaguccuacccaguu

SEQ ID NO: 855415 - RNA, 19 nt, Homo sapiens
gguuaccugugcaguugug

SEQ ID NO: 855416 - RNA, 19 nt, Homo sapiens
gucaucaggaucaugcuuu

SEQ ID NO: 855417 - RNA, 19 nt, Homo sapiens
gcagguuuccaacaaggau

SEQ ID NO: 855418 - RNA, 19 nt, Homo sapiens
aucagugucucuaguccua

SEQ ID NO: 855419 - RNA, 19 nt, Homo sapiens
aaugggaaaucaugcaacu

SEQ ID NO: 855420 - RNA, 19 nt, Homo sapiens
gggcugcacccaguggauu

SEQ ID NO: 855421 - RNA, 19 nt, Homo sapiens
uuccauauuugccaugugu

SEQ ID NO: 855422 - RNA, 19 nt, Homo sapiens
auucuucguuggauuaauc

SEQ ID NO: 855423 - RNA, 19 nt, Homo sapiens
agaugaugaugcagugugu

SEQ ID NO: 855424 - RNA, 19 nt, Homo sapiens
ucgugcaaguggaugguaa

SEQ ID NO: 855425 - RNA, 19 nt, Homo sapiens
ccaacaacaaccagaugug

SEQ ID NO: 855426 - RNA, 19 nt, Homo sapiens
gcuggaaguaccugagugu

SEQ ID NO: 855427 - RNA, 19 nt, Homo sapiens
gagaccuccuacgagauga

SEQ ID NO: 855428 - RNA, 19 nt, Homo sapiens
ugagcagguuuccaacaag

SEQ ID NO: 855429 - RNA, 19 nt, Homo sapiens
aaucaugcaacuacucaga

SEQ ID NO: 855430 - RNA, 19 nt, Homo sapiens
ugaaugggaaaucaugcaa

SEQ ID NO: 855431 - RNA, 19 nt, Homo sapiens
caaguggaugguaagauag

SEQ ID NO: 855432 - RNA, 19 nt, Homo sapiens
ccucgcagauuugcugagu

SEQ ID NO: 855433 - RNA, 19 nt, Homo sapiens
ggauucacugcuggaagua

SEQ ID NO: 855434 - RNA, 19 nt, Homo sapiens
ggagcuauaccaaguucgu

SEQ ID NO: 855435 - RNA, 19 nt, Homo sapiens
ggauucuucguuggauuaa

SEQ ID NO: 855436 - RNA, 19 nt, Homo sapiens
ggacgggaggccaaguaca

SEQ ID NO: 855437 - RNA, 19 nt, Homo sapiens
gaacugugguccaugguaa

SEQ ID NO: 855438 - RNA, 19 nt, Homo sapiens
gugcuugucuccaaucuua

SEQ ID NO: 855439 - RNA, 19 nt, Homo sapiens
ggagacaacucgagagaug

SEQ ID NO: 855440 - RNA, 19 nt, Homo sapiens
guuaggaccuggaaaugua

SEQ ID NO: 855441 - RNA, 19 nt, Homo sapiens
ugacaagggugaggaguua

SEQ ID NO: 855442 - RNA, 19 nt, Homo sapiens
gaagagggcauucuaggau

SEQ ID NO: 855443 - RNA, 19 nt, Homo sapiens
uaggugacauccuuucuuu

SEQ ID NO: 855444 - RNA, 19 nt, Homo sapiens
aauaugagccgaggaaaua

SEQ ID NO: 855445 - RNA, 19 nt, Homo sapiens
ccaacaauaggacgaaaua

SEQ ID NO: 855446 - RNA, 19 nt, Homo sapiens
gggagagaauguugauuuc

SEQ ID NO: 855447 - RNA, 19 nt, Homo sapiens
ugagaucuaugguacaguu

SEQ ID NO: 855448 - RNA, 19 nt, Homo sapiens
gaagaguuauucucaagcu

SEQ ID NO: 855449 - RNA, 19 nt, Homo sapiens
uuccuggucucuuuaguua

SEQ ID NO: 855450 - RNA, 19 nt, Homo sapiens
gagccgaggaaauagcuua

SEQ ID NO: 855451 - RNA, 19 nt, Homo sapiens
ggaguuaggaccuggaaau

SEQ ID NO: 855452 - RNA, 19 nt, Homo sapiens
gaauaugagccgaggaaau

SEQ ID NO: 855453 - RNA, 19 nt, Homo sapiens
gcgaguauguugaccuauc

SEQ ID NO: 855454 - RNA, 19 nt, Homo sapiens
gaaaugaagaguuauucuc

SEQ ID NO: 855455 - RNA, 19 nt, Homo sapiens
ggaagagggcauucuagga

SEQ ID NO: 855456 - RNA, 19 nt, Homo sapiens
gaaauguacagaaagaagu

SEQ ID NO: 855457 - RNA, 19 nt, Homo sapiens
gggaagacuuauuguugug

SEQ ID NO: 855458 - RNA, 19 nt, Homo sapiens
gcacauugccaguaucgau

SEQ ID NO: 855459 - RNA, 19 nt, Homo sapiens
caacaacuguggucuugcu

SEQ ID NO: 855460 - RNA, 19 nt, Homo sapiens
gcagagaauccaaguacug

SEQ ID NO: 855461 - RNA, 19 nt, Homo sapiens
ggaaauguacagaaagaag

SEQ ID NO: 855462 - RNA, 19 nt, Homo sapiens
caauauauacgucuuggau

SEQ ID NO: 855463 - RNA, 19 nt, Homo sapiens
gucaacaacuguggucuug

SEQ ID NO: 855464 - RNA, 19 nt, Homo sapiens
ggugacauccuuucuuugu

SEQ ID NO: 855465 - RNA, 19 nt, Homo sapiens
ucccagaugcacagaauua

SEQ ID NO: 855466 - RNA, 19 nt, Homo sapiens
ccuggucucuuuaguuaug

SEQ ID NO: 855467 - RNA, 19 nt, Homo sapiens
ucagcuuccuggucucuuu

SEQ ID NO: 855468 - RNA, 19 nt, Homo sapiens
gcagggacagugacauuuc

SEQ ID NO: 855469 - RNA, 19 nt, Homo sapiens
agagggcauucuaggauuu

SEQ ID NO: 855470 - RNA, 19 nt, Homo sapiens
ggacuuugugauuccauaa

SEQ ID NO: 855471 - RNA, 19 nt, Homo sapiens
ggaacugugguccauggua

SEQ ID NO: 855472 - RNA, 19 nt, Homo sapiens
ugggagagaauguugauuu

SEQ ID NO: 855473 - RNA, 19 nt, Homo sapiens
gggcagggacagugacauu

SEQ ID NO: 855474 - RNA, 19 nt, Homo sapiens
gggaauaugagccgaggaa

SEQ ID NO: 855475 - RNA, 19 nt, Homo sapiens
cuggaaauguacagaaaga

SEQ ID NO: 855476 - RNA, 19 nt, Homo sapiens
ugggaagacuuauuguugu

SEQ ID NO: 855477 - RNA, 19 nt, Homo sapiens
auauauacgucuuggauag

SEQ ID NO: 855478 - RNA, 19 nt, Homo sapiens
gcugguggaugcccuccuu

SEQ ID NO: 855479 - RNA, 19 nt, Homo sapiens
gagaugaucgcucguucug

SEQ ID NO: 855480 - RNA, 19 nt, Homo sapiens
gcucagcacauugccagua

SEQ ID NO: 855481 - RNA, 19 nt, Homo sapiens
guugauuucuauacagugu

SEQ ID NO: 855482 - RNA, 19 nt, Homo sapiens
caucacacaucccuuccau

SEQ ID NO: 855483 - RNA, 19 nt, Homo sapiens
uauguugaccuaucccuuu

SEQ ID NO: 855484 - RNA, 19 nt, Homo sapiens
uaccaugaaugaaaugaag

SEQ ID NO: 855485 - RNA, 19 nt, Homo sapiens
aagagggcauucuaggauu

SEQ ID NO: 855486 - RNA, 19 nt, Homo sapiens
gaucuaugguacaguucau

SEQ ID NO: 855487 - RNA, 19 nt, Homo sapiens
uggccuaccucgucaauac

SEQ ID NO: 855488 - RNA, 19 nt, Homo sapiens
ggaagacuuauuguuguga

SEQ ID NO: 855489 - RNA, 19 nt, Homo sapiens
ggguuucuaccaugaauga

SEQ ID NO: 855490 - RNA, 19 nt, Homo sapiens
guaacucacuggccuaccu

SEQ ID NO: 855491 - RNA, 19 nt, Homo sapiens
ugugguccaugguaaaguu

SEQ ID NO: 855492 - RNA, 19 nt, Homo sapiens
gccucuuccuccaacaaua

SEQ ID NO: 855493 - RNA, 19 nt, Homo sapiens
gaauuaugggagagaaugu

SEQ ID NO: 855494 - RNA, 19 nt, Homo sapiens
guugugaccugaaaauguu

SEQ ID NO: 855495 - RNA, 19 nt, Homo sapiens
acaguucauuggcagagaa

SEQ ID NO: 855496 - RNA, 19 nt, Homo sapiens
cagaugcacagaauuaugg

SEQ ID NO: 855497 - RNA, 19 nt, Homo sapiens
ccagaugcacagaauuaug

SEQ ID NO: 855498 - RNA, 19 nt, Homo sapiens
ggaauaugagccgaggaaa

SEQ ID NO: 855499 - RNA, 19 nt, Homo sapiens
gcucauguacgugaaagug

SEQ ID NO: 855500 - RNA, 19 nt, Homo sapiens
acagaaagaagucucaucu

SEQ ID NO: 855501 - RNA, 19 nt, Homo sapiens
cagcuuccuggucucuuua

SEQ ID NO: 855502 - RNA, 19 nt, Homo sapiens
ucuuauggcugucaacaac

SEQ ID NO: 855503 - RNA, 19 nt, Homo sapiens
uugcgaguauguugaccua

SEQ ID NO: 855504 - RNA, 19 nt, Homo sapiens
gugacauccuuucuuugug

SEQ ID NO: 855505 - RNA, 19 nt, Homo sapiens
cugcuacccucaucacaca

SEQ ID NO: 855506 - RNA, 19 nt, Homo sapiens
gagacaacucgagagauga

SEQ ID NO: 855507 - RNA, 19 nt, Homo sapiens
gaccuggaaauguacagaa

SEQ ID NO: 855508 - RNA, 19 nt, Homo sapiens
caacaauaggacgaaauau

SEQ ID NO: 855509 - RNA, 19 nt, Homo sapiens
ugucccagccgcucaugua

SEQ ID NO: 855510 - RNA, 19 nt, Homo sapiens
cagggacagugacauuucu

SEQ ID NO: 855511 - RNA, 19 nt, Homo sapiens
uugggaagacuuauuguug

SEQ ID NO: 855512 - RNA, 19 nt, Homo sapiens
guugaccuaucccuuugug

SEQ ID NO: 855513 - RNA, 19 nt, Homo sapiens
gaguuaggaccuggaaaug

SEQ ID NO: 855514 - RNA, 19 nt, Homo sapiens
acagaauuaugggagagaa

SEQ ID NO: 855515 - RNA, 19 nt, Homo sapiens
uuauuguugugaccugaaa

SEQ ID NO: 855516 - RNA, 19 nt, Homo sapiens
ggugggauaugagccucuu

SEQ ID NO: 855517 - RNA, 19 nt, Homo sapiens
ccaaucuuauggcugucaa

SEQ ID NO: 855518 - RNA, 19 nt, Homo sapiens
gaccuaucccuuugugcuu

SEQ ID NO: 855519 - RNA, 19 nt, Homo sapiens
gugauuccauaauaaccau

SEQ ID NO: 855520 - RNA, 19 nt, Homo sapiens
cagagaauccaaguacugu

SEQ ID NO: 855521 - RNA, 19 nt, Homo sapiens
caugugaucacucugagau

SEQ ID NO: 855522 - RNA, 19 nt, Homo sapiens
ggcagggacagugacauuu

SEQ ID NO: 855523 - RNA, 19 nt, Homo sapiens
ccuuugugcuugucuccaa

SEQ ID NO: 855524 - RNA, 19 nt, Homo sapiens
ccuucuaggugacauccuu

SEQ ID NO: 855525 - RNA, 19 nt, Homo sapiens
gcaagugugucagcuuccu

SEQ ID NO: 855526 - RNA, 19 nt, Homo sapiens
augaagaguuauucucaag

SEQ ID NO: 855527 - RNA, 19 nt, Homo sapiens
gugacaagggugaggaguu

SEQ ID NO: 855528 - RNA, 19 nt, Homo sapiens
agucccagaugcacagaau

SEQ ID NO: 855529 - RNA, 19 nt, Homo sapiens
gagccucuuccuccaacaa

SEQ ID NO: 855530 - RNA, 19 nt, Homo sapiens
cucagcacauugccaguau

SEQ ID NO: 855531 - RNA, 19 nt, Homo sapiens
uggcagagaauccaaguac

SEQ ID NO: 855532 - RNA, 19 nt, Homo sapiens
gaggaguuaggaccuggaa

SEQ ID NO: 855533 - RNA, 19 nt, Homo sapiens
accuggaaauguacagaaa

SEQ ID NO: 855534 - RNA, 19 nt, Homo sapiens
gaacaaagcguuacugaaa

SEQ ID NO: 855535 - RNA, 19 nt, Homo sapiens
gaagggacauuuaguuuga

SEQ ID NO: 855536 - RNA, 19 nt, Homo sapiens
gguaauagccauacucuua

SEQ ID NO: 855537 - RNA, 19 nt, Homo sapiens
gaaagaagaugcugagaag

SEQ ID NO: 855538 - RNA, 19 nt, Homo sapiens
gaaagaaacuuccagaaac

SEQ ID NO: 855539 - RNA, 19 nt, Homo sapiens
gcaagaagcccaaguagaa

SEQ ID NO: 855540 - RNA, 19 nt, Homo sapiens
ggaaugagguugugaucuu

SEQ ID NO: 855541 - RNA, 19 nt, Homo sapiens
aaacaacgcugggagaaua

SEQ ID NO: 855542 - RNA, 19 nt, Homo sapiens
gaaacgaaauugagguuau

SEQ ID NO: 855543 - RNA, 19 nt, Homo sapiens
gcaauugauuacccaguua

SEQ ID NO: 855544 - RNA, 19 nt, Homo sapiens
ggacagagcaagcgaauga

SEQ ID NO: 855545 - RNA, 19 nt, Homo sapiens
cuacagagauuccaaguug

SEQ ID NO: 855546 - RNA, 19 nt, Homo sapiens
gaagggaauuccuguaaga

SEQ ID NO: 855547 - RNA, 19 nt, Homo sapiens
gaaagcagccugaaacaga

SEQ ID NO: 855548 - RNA, 19 nt, Homo sapiens
gaaagauccuggcucaaga

SEQ ID NO: 855549 - RNA, 19 nt, Homo sapiens
caacugacuuuccuauuga

SEQ ID NO: 855550 - RNA, 19 nt, Homo sapiens
cuaaggagcugguugaguu

SEQ ID NO: 855551 - RNA, 19 nt, Homo sapiens
ugaaugaccuccuugaaga

SEQ ID NO: 855552 - RNA, 19 nt, Homo sapiens
ccagacagcugaacuuaau

SEQ ID NO: 855553 - RNA, 19 nt, Homo sapiens
gagauaggaucaugaagga

SEQ ID NO: 855554 - RNA, 19 nt, Homo sapiens
ccaacugacuuuccuauug

SEQ ID NO: 855555 - RNA, 19 nt, Homo sapiens
gaaaagagacaaagaagua

SEQ ID NO: 855556 - RNA, 19 nt, Homo sapiens
gaccaggaauugaaagaaa

SEQ ID NO: 855557 - RNA, 19 nt, Homo sapiens
caaggaugcucuccagaaa

SEQ ID NO: 855558 - RNA, 19 nt, Homo sapiens
uaaaugacuucucuggauu

SEQ ID NO: 855559 - RNA, 19 nt, Homo sapiens
gaaugagguugugaucuuu

SEQ ID NO: 855560 - RNA, 19 nt, Homo sapiens
ccaaggcuuucuuaucuuu

SEQ ID NO: 855561 - RNA, 19 nt, Homo sapiens
guuaaugcgucaaaugaaa

SEQ ID NO: 855562 - RNA, 19 nt, Homo sapiens
ggaagaugacucagaauga

SEQ ID NO: 855563 - RNA, 19 nt, Homo sapiens
gaacagggcaacaacucua

SEQ ID NO: 855564 - RNA, 19 nt, Homo sapiens
gcaagagaaugaaccaaca

SEQ ID NO: 855565 - RNA, 19 nt, Homo sapiens
ggccaaggcuuucuuaucu

SEQ ID NO: 855566 - RNA, 19 nt, Homo sapiens
ucagaaagcuccuucaaac

SEQ ID NO: 855567 - RNA, 19 nt, Homo sapiens
cgagauagagacagaguua

SEQ ID NO: 855568 - RNA, 19 nt, Homo sapiens
gaagaggcccacugaaguu

SEQ ID NO: 855569 - RNA, 19 nt, Homo sapiens
ugaaagaaacuuccagaaa

SEQ ID NO: 855570 - RNA, 19 nt, Homo sapiens
gcaagauccugaaagagau

SEQ ID NO: 855571 - RNA, 19 nt, Homo sapiens
gcagauaagcggaaagaga

SEQ ID NO: 855572 - RNA, 19 nt, Homo sapiens
ugaaagagaugugcgaugu

SEQ ID NO: 855573 - RNA, 19 nt, Homo sapiens
caacaagcgucucaaggau

SEQ ID NO: 855574 - RNA, 19 nt, Homo sapiens
ccaaacuucugaaacuaaa

SEQ ID NO: 855575 - RNA, 19 nt, Homo sapiens
gauccuggcucaagaugug

SEQ ID NO: 855576 - RNA, 19 nt, Homo sapiens
ucaaauugcugaucugaag

SEQ ID NO: 855577 - RNA, 19 nt, Homo sapiens
cagcugaacuuaaucaucu

SEQ ID NO: 855578 - RNA, 19 nt, Homo sapiens
caaucuagaggaaacauua

SEQ ID NO: 855579 - RNA, 19 nt, Homo sapiens
gagagaaccaacugacuuu

SEQ ID NO: 855580 - RNA, 19 nt, Homo sapiens
ccaagugugcccugaaaua

SEQ ID NO: 855581 - RNA, 19 nt, Homo sapiens
cuaggaagaugacucagaa

SEQ ID NO: 855582 - RNA, 19 nt, Homo sapiens
caaguugacucgacugcuu

SEQ ID NO: 855583 - RNA, 19 nt, Homo sapiens
ugacaagaauagcagcuuu

SEQ ID NO: 855584 - RNA, 19 nt, Homo sapiens
uaauacaacugcucuucaa

SEQ ID NO: 855585 - RNA, 19 nt, Homo sapiens
aaagaaacuuccagaaaca

SEQ ID NO: 855586 - RNA, 19 nt, Homo sapiens
gacccucucugaauuaugu

SEQ ID NO: 855587 - RNA, 19 nt, Homo sapiens
gacagaaacaucuuccuaa

SEQ ID NO: 855588 - RNA, 19 nt, Homo sapiens
ccaaugugcucagacguaa

SEQ ID NO: 855589 - RNA, 19 nt, Homo sapiens
ggagcaagaagcccaagua

SEQ ID NO: 855590 - RNA, 19 nt, Homo sapiens
ggaugaagaacuugagaaa

SEQ ID NO: 855591 - RNA, 19 nt, Homo sapiens
gggaagggacauuuaguuu

SEQ ID NO: 855592 - RNA, 19 nt, Homo sapiens
gaagugcguggucaaguuu

SEQ ID NO: 855593 - RNA, 19 nt, Homo sapiens
ggaagggacauuuaguuug

SEQ ID NO: 855594 - RNA, 19 nt, Homo sapiens
aaagaaggaugccaaccaa

SEQ ID NO: 855595 - RNA, 19 nt, Homo sapiens
auaaagcgcuugcacugaa

SEQ ID NO: 855596 - RNA, 19 nt, Homo sapiens
uuaaaugacuucucuggau

SEQ ID NO: 855597 - RNA, 19 nt, Homo sapiens
gcccugaaauauuugauug

SEQ ID NO: 855598 - RNA, 19 nt, Homo sapiens
gaauuggcuuggaaacgaa

SEQ ID NO: 855599 - RNA, 19 nt, Homo sapiens
aauaugagcugcugaaacu

SEQ ID NO: 855600 - RNA, 19 nt, Homo sapiens
gcugagaaguuuagacagu

SEQ ID NO: 855601 - RNA, 19 nt, Homo sapiens
gaagaugcugagaaguuua

SEQ ID NO: 855602 - RNA, 19 nt, Homo sapiens
agaagaugcugagaaguuu

SEQ ID NO: 855603 - RNA, 19 nt, Homo sapiens
ugaagugcguggucaaguu

SEQ ID NO: 855604 - RNA, 19 nt, Homo sapiens
agauguggcucaacucaaa

SEQ ID NO: 855605 - RNA, 19 nt, Homo sapiens
gugaagaauuggcuuggaa

SEQ ID NO: 855606 - RNA, 19 nt, Homo sapiens
cauaaaagagccagaauua

SEQ ID NO: 855607 - RNA, 19 nt, Homo sapiens
gaagaugacucagaaugac

SEQ ID NO: 855608 - RNA, 19 nt, Homo sapiens
gaucagaaagacagaagaa

SEQ ID NO: 855609 - RNA, 19 nt, Homo sapiens
gcaguagcgccacucauaa

SEQ ID NO: 855610 - RNA, 19 nt, Homo sapiens
gggaugaggccaaggcuuu

SEQ ID NO: 855611 - RNA, 19 nt, Homo sapiens
guuaauguguccaggaaga

SEQ ID NO: 855612 - RNA, 19 nt, Homo sapiens
uugcugaucugaagaagaa

SEQ ID NO: 855613 - RNA, 19 nt, Homo sapiens
guagaaaccaguccagaga

SEQ ID NO: 855614 - RNA, 19 nt, Homo sapiens
ggaagaccaggaauugaaa

SEQ ID NO: 855615 - RNA, 19 nt, Homo sapiens
uaaggaaggcauaaagauu

SEQ ID NO: 855616 - RNA, 19 nt, Homo sapiens
ccuauugacucaucaggaa

SEQ ID NO: 855617 - RNA, 19 nt, Homo sapiens
agugugcccugaaauauuu

SEQ ID NO: 855618 - RNA, 19 nt, Homo sapiens
ggagaauauugccaccauu

SEQ ID NO: 855619 - RNA, 19 nt, Homo sapiens
ccuagagacugaaauggaa

SEQ ID NO: 855620 - RNA, 19 nt, Homo sapiens
aggcguacauucucccuua

SEQ ID NO: 855621 - RNA, 19 nt, Homo sapiens
ugaagaagaaacugaauga

SEQ ID NO: 855622 - RNA, 19 nt, Homo sapiens
ccaaaaccuucucguguua

SEQ ID NO: 855623 - RNA, 19 nt, Homo sapiens
uugaauauguccagccuaa

SEQ ID NO: 855624 - RNA, 19 nt, Homo sapiens
ccaauaccaggauaacaua

SEQ ID NO: 855625 - RNA, 19 nt, Homo sapiens
uacaaucccugauggagaa

SEQ ID NO: 855626 - RNA, 19 nt, Homo sapiens
ccaaacgccaucugaauga

SEQ ID NO: 855627 - RNA, 19 nt, Homo sapiens
ggaaacgaaauugagguua

SEQ ID NO: 855628 - RNA, 19 nt, Homo sapiens
gaagucaucaaucugcaaa

SEQ ID NO: 855629 - RNA, 19 nt, Homo sapiens
cgaggcagcuggucagaca

SEQ ID NO: 855630 - RNA, 19 nt, Homo sapiens
gaagaaucagucccuggua

SEQ ID NO: 855631 - RNA, 19 nt, Homo sapiens
ugacucgacugcuucaaga

SEQ ID NO: 855632 - RNA, 19 nt, Homo sapiens
agaccucgcuggaucagaa

SEQ ID NO: 855633 - RNA, 19 nt, Homo sapiens
caacgguccuggccuaugg

SEQ ID NO: 855634 - RNA, 19 nt, Homo sapiens
gaacaaagcucucgaacuu

SEQ ID NO: 855635 - RNA, 19 nt, Homo sapiens
gaacgagacucuauguuug

SEQ ID NO: 855636 - RNA, 19 nt, Homo sapiens
ggaacaagcagaagaaaua

SEQ ID NO: 855637 - RNA, 19 nt, Homo sapiens
ggaaugaucuuuacucaag

SEQ ID NO: 855638 - RNA, 19 nt, Homo sapiens
ccagauaacagcuauauua

SEQ ID NO: 855639 - RNA, 19 nt, Homo sapiens
gaaauugucuaccaagaga

SEQ ID NO: 855640 - RNA, 19 nt, Homo sapiens
gaaauugggagaaaugaua

SEQ ID NO: 855641 - RNA, 19 nt, Homo sapiens
caguguaucucacguauua

SEQ ID NO: 855642 - RNA, 19 nt, Homo sapiens
caagugcucugaagaaauu

SEQ ID NO: 855643 - RNA, 19 nt, Homo sapiens
gcacugaaguccugaccua

SEQ ID NO: 855644 - RNA, 19 nt, Homo sapiens
ggaagacauugaucuguuu

SEQ ID NO: 855645 - RNA, 19 nt, Homo sapiens
ggaauuuacuuaaggaaga

SEQ ID NO: 855646 - RNA, 19 nt, Homo sapiens
guacauaacuucuaucacu

SEQ ID NO: 855647 - RNA, 19 nt, Homo sapiens
ggaggaaaguauuaucaaa

SEQ ID NO: 855648 - RNA, 19 nt, Homo sapiens
gauaacagcuauauuaagg

SEQ ID NO: 855649 - RNA, 19 nt, Homo sapiens
ggaacgagacucuauguuu

SEQ ID NO: 855650 - RNA, 19 nt, Homo sapiens
caacagaccuaaaggaaag

SEQ ID NO: 855651 - RNA, 19 nt, Homo sapiens
gcucagaaguauacaggua

SEQ ID NO: 855652 - RNA, 19 nt, Homo sapiens
gggaaugucuguaagaaau

SEQ ID NO: 855653 - RNA, 19 nt, Homo sapiens
ugaagaagcucagaaguau

SEQ ID NO: 855654 - RNA, 19 nt, Homo sapiens
gcauugugcuaaauacuuu

SEQ ID NO: 855655 - RNA, 19 nt, Homo sapiens
gaaaggcuguuacccugaa

SEQ ID NO: 855656 - RNA, 19 nt, Homo sapiens
gcaagaacacucagacaaa

SEQ ID NO: 855657 - RNA, 19 nt, Homo sapiens
uaauguggcuucucuaaug

SEQ ID NO: 855658 - RNA, 19 nt, Homo sapiens
gaagaaauccuggaccaaa

SEQ ID NO: 855659 - RNA, 19 nt, Homo sapiens
ugagauuucugcacuuuaa

SEQ ID NO: 855660 - RNA, 19 nt, Homo sapiens
aaucuagacuugcucuuua

SEQ ID NO: 855661 - RNA, 19 nt, Homo sapiens
gagcugauuucaucugcua

SEQ ID NO: 855662 - RNA, 19 nt, Homo sapiens
gaacccagauaacagcuau

SEQ ID NO: 855663 - RNA, 19 nt, Homo sapiens
gcugggcacucuugaaauu

SEQ ID NO: 855664 - RNA, 19 nt, Homo sapiens
gaaguauacagguaagaua

SEQ ID NO: 855665 - RNA, 19 nt, Homo sapiens
acaaacaucagauccauua

SEQ ID NO: 855666 - RNA, 19 nt, Homo sapiens
cauaaccgaugaucacaaa

SEQ ID NO: 855667 - RNA, 19 nt, Homo sapiens
gaacaagcagaagaaauaa

SEQ ID NO: 855668 - RNA, 19 nt, Homo sapiens
gaauauccaguuugcauuu

SEQ ID NO: 855669 - RNA, 19 nt, Homo sapiens
ggaagggaaugaucuuuac

SEQ ID NO: 855670 - RNA, 19 nt, Homo sapiens
gacaagugcucugaagaaa

SEQ ID NO: 855671 - RNA, 19 nt, Homo sapiens
auacugccauccaucauua

SEQ ID NO: 855672 - RNA, 19 nt, Homo sapiens
ugccauccaucauuauuua

SEQ ID NO: 855673 - RNA, 19 nt, Homo sapiens
gaacauaaccgaugaucac

SEQ ID NO: 855674 - RNA, 19 nt, Homo sapiens
ggcaacagcuugaauuucu

SEQ ID NO: 855675 - RNA, 19 nt, Homo sapiens
gcuccgacuuuccauuuaa

SEQ ID NO: 855676 - RNA, 19 nt, Homo sapiens
gggcacaaaugauccaaau

SEQ ID NO: 855677 - RNA, 19 nt, Homo sapiens
gcuaugcuaucacagugua

SEQ ID NO: 855678 - RNA, 19 nt, Homo sapiens
gaaauuuggaggaaaguau

SEQ ID NO: 855679 - RNA, 19 nt, Homo sapiens
gaaauaauccagcaagaac

SEQ ID NO: 855680 - RNA, 19 nt, Homo sapiens
gaaugucuguaagaaauug

SEQ ID NO: 855681 - RNA, 19 nt, Homo sapiens
caacagcuugaauuucuua

SEQ ID NO: 855682 - RNA, 19 nt, Homo sapiens
ccucaaacuuggcuacgua

SEQ ID NO: 855683 - RNA, 19 nt, Homo sapiens
gccauuagaucugugcuuu

SEQ ID NO: 855684 - RNA, 19 nt, Homo sapiens
gcaagcugcugaguacuau

SEQ ID NO: 855685 - RNA, 19 nt, Homo sapiens
ucagauccauuaccacuau

SEQ ID NO: 855686 - RNA, 19 nt, Homo sapiens
acacagaccuggccaacau

SEQ ID NO: 855687 - RNA, 19 nt, Homo sapiens
uuaccaagguuucagugua

SEQ ID NO: 855688 - RNA, 19 nt, Homo sapiens
gaggcaagcugcugaguac

SEQ ID NO: 855689 - RNA, 19 nt, Homo sapiens
gagacucuauguuugcauu

SEQ ID NO: 855690 - RNA, 19 nt, Homo sapiens
gagaaaggcugggcacucu

SEQ ID NO: 855691 - RNA, 19 nt, Homo sapiens
gaagaagcucagaaguaua

SEQ ID NO: 855692 - RNA, 19 nt, Homo sapiens
caaugaaucuagaugcaau

SEQ ID NO: 855693 - RNA, 19 nt, Homo sapiens
gcgcugccaucaugaguga

SEQ ID NO: 855694 - RNA, 19 nt, Homo sapiens
ucacuugccacauaauuaa

SEQ ID NO: 855695 - RNA, 19 nt, Homo sapiens
cuagugacuucaauaaaga

SEQ ID NO: 855696 - RNA, 19 nt, Homo sapiens
gagcuccgacuuuccauuu

SEQ ID NO: 855697 - RNA, 19 nt, Homo sapiens
gcagccaaguucuauagga

SEQ ID NO: 855698 - RNA, 19 nt, Homo sapiens
caagaacacucagacaaag

SEQ ID NO: 855699 - RNA, 19 nt, Homo sapiens
ugaagaaauugucuaccaa

SEQ ID NO: 855700 - RNA, 19 nt, Homo sapiens
gaaaggcugggcacucuug

SEQ ID NO: 855701 - RNA, 19 nt, Homo sapiens
uaaagcagccauugggaaa

SEQ ID NO: 855702 - RNA, 19 nt, Homo sapiens
uaucucugcucuuugaauu

SEQ ID NO: 855703 - RNA, 19 nt, Homo sapiens
ugagaaggcucuggaagug

SEQ ID NO: 855704 - RNA, 19 nt, Homo sapiens
cuucaucaguucauagaaa

SEQ ID NO: 855705 - RNA, 19 nt, Homo sapiens
gaaggaggccaguauagca

SEQ ID NO: 855706 - RNA, 19 nt, Homo sapiens
gauagagaagggucuguaa

SEQ ID NO: 855707 - RNA, 19 nt, Homo sapiens
uaaccuacacccauagauu

SEQ ID NO: 855708 - RNA, 19 nt, Homo sapiens
ugggagaaaugauaaacaa

SEQ ID NO: 855709 - RNA, 19 nt, Homo sapiens
gaaaggauaaacuaaaggu

SEQ ID NO: 855710 - RNA, 19 nt, Homo sapiens
gcaacagcuugaauuucuu

SEQ ID NO: 855711 - RNA, 19 nt, Homo sapiens
gaaacuaugccugggugua

SEQ ID NO: 855712 - RNA, 19 nt, Homo sapiens
uauguaaacuuccagaucu

SEQ ID NO: 855713 - RNA, 19 nt, Homo sapiens
gcauuaugaugaaucuugu

SEQ ID NO: 855714 - RNA, 19 nt, Homo sapiens
ccuauuggccuaugugaaa

SEQ ID NO: 855715 - RNA, 19 nt, Homo sapiens
gaaauccuaaguuccuuga

SEQ ID NO: 855716 - RNA, 19 nt, Homo sapiens
caaacuuggcuacguauug

SEQ ID NO: 855717 - RNA, 19 nt, Homo sapiens
ucagacaguuaaucauaga

SEQ ID NO: 855718 - RNA, 19 nt, Homo sapiens
uagcaaagcaggccauuuc

SEQ ID NO: 855719 - RNA, 19 nt, Homo sapiens
gcucuuugaauuucucaua

SEQ ID NO: 855720 - RNA, 19 nt, Homo sapiens
ugacaagugcucugaagaa

SEQ ID NO: 855721 - RNA, 19 nt, Homo sapiens
ucaggaauuucaccguaaa

SEQ ID NO: 855722 - RNA, 19 nt, Homo sapiens
gacaccaacuucuucuuuc

SEQ ID NO: 855723 - RNA, 19 nt, Homo sapiens
agagaagggucuguaaaga

SEQ ID NO: 855724 - RNA, 19 nt, Homo sapiens
aauaaaagcugccugaguu

SEQ ID NO: 855725 - RNA, 19 nt, Homo sapiens
acacaauuauguaccauca

SEQ ID NO: 855726 - RNA, 19 nt, Homo sapiens
ugagguagaagauacaauu

SEQ ID NO: 855727 - RNA, 19 nt, Homo sapiens
ucuagugacuucaauaaag

SEQ ID NO: 855728 - RNA, 19 nt, Homo sapiens
cguaaaccuuugauaccua

SEQ ID NO: 855729 - RNA, 19 nt, Homo sapiens
ugacaccaacuucuucuuu

SEQ ID NO: 855730 - RNA, 19 nt, Homo sapiens
gaaauccuggaccaaauau

SEQ ID NO: 855731 - RNA, 19 nt, Homo sapiens
gccugacaauccagaauuu

SEQ ID NO: 855732 - RNA, 19 nt, Homo sapiens
gauagggaaugucuguaag

SEQ ID NO: 855733 - RNA, 19 nt, Homo sapiens
guacgaagccuggucacuu

SEQ ID NO: 855734 - RNA, 19 nt, Homo sapiens
ggaaaucucacaucuacuu

SEQ ID NO: 855735 - RNA, 19 nt, Homo sapiens
uggcaaaguucaccuguuu

SEQ ID NO: 855736 - RNA, 19 nt, Homo sapiens
cgaaguaugugcugugugu

SEQ ID NO: 855737 - RNA, 19 nt, Homo sapiens
ugacaaauguggccuucuu

SEQ ID NO: 855738 - RNA, 19 nt, Homo sapiens
ggacggcacugauaucaac

SEQ ID NO: 855739 - RNA, 19 nt, Homo sapiens
ggcaaggccucuuugagaa

SEQ ID NO: 855740 - RNA, 19 nt, Homo sapiens
ggcuucagcugaugacuuu

SEQ ID NO: 855741 - RNA, 19 nt, Homo sapiens
gcaaugaacagaucucagu

SEQ ID NO: 855742 - RNA, 19 nt, Homo sapiens
gcagccaugugacaaaugu

SEQ ID NO: 855743 - RNA, 19 nt, Homo sapiens
acagaagucucuauuuauc

SEQ ID NO: 855744 - RNA, 19 nt, Homo sapiens
ccgaguagaguaauauaua

SEQ ID NO: 855745 - RNA, 19 nt, Homo sapiens
auaaagacacguacacuaa

SEQ ID NO: 855746 - RNA, 19 nt, Homo sapiens
gaugucaagugcuccaaug

SEQ ID NO: 855747 - RNA, 19 nt, Homo sapiens
ccacacagacggcaaugaa

SEQ ID NO: 855748 - RNA, 19 nt, Homo sapiens
uaaagacacguacacuaaa

SEQ ID NO: 855749 - RNA, 19 nt, Homo sapiens
gcaaggccucuuugagaaa

SEQ ID NO: 855750 - RNA, 19 nt, Homo sapiens
ggagauaguguacuuugug

SEQ ID NO: 855751 - RNA, 19 nt, Homo sapiens
gcaaaguucaccuguuuag

SEQ ID NO: 855752 - RNA, 19 nt, Homo sapiens
cgggaaaucucacaucuac

SEQ ID NO: 855753 - RNA, 19 nt, Homo sapiens
gauaagcuggugcaucuau

SEQ ID NO: 855754 - RNA, 19 nt, Homo sapiens
gcaaaggugggaaccguau

SEQ ID NO: 855755 - RNA, 19 nt, Homo sapiens
ccagaaauaaagacacgua

SEQ ID NO: 855756 - RNA, 19 nt, Homo sapiens
ugaauccaaugaucacaug

SEQ ID NO: 855757 - RNA, 19 nt, Homo sapiens
gaggguagacugacauaca

SEQ ID NO: 855758 - RNA, 19 nt, Homo sapiens
gaaauaaagacacguacac

SEQ ID NO: 855759 - RNA, 19 nt, Homo sapiens
cgaguagaguaauauauac

SEQ ID NO: 855760 - RNA, 19 nt, Homo sapiens
acuaugagauucuguacug

SEQ ID NO: 855761 - RNA, 19 nt, Homo sapiens
gcucgggccauuccaguuu

SEQ ID NO: 855762 - RNA, 19 nt, Homo sapiens
aggauaagcuggugcaucu

SEQ ID NO: 855763 - RNA, 19 nt, Homo sapiens
cggcaaggccucuuugaga

SEQ ID NO: 855764 - RNA, 19 nt, Homo sapiens
gaggauggcuccgugaaaa

SEQ ID NO: 855765 - RNA, 19 nt, Homo sapiens
gagggagucacaucgcuuu

SEQ ID NO: 855766 - RNA, 19 nt, Homo sapiens
cccaugaccugguggcuau

SEQ ID NO: 855767 - RNA, 19 nt, Homo sapiens
gggagauaguguacuuugu

SEQ ID NO: 855768 - RNA, 19 nt, Homo sapiens
agaugucuauugccgagua

SEQ ID NO: 855769 - RNA, 19 nt, Homo sapiens
ugugugggcuucuccaaau

SEQ ID NO: 855770 - RNA, 19 nt, Homo sapiens
gacacuaccugggacacaa

SEQ ID NO: 855771 - RNA, 19 nt, Homo sapiens
gggccaaccuuuauuugcu

SEQ ID NO: 855772 - RNA, 19 nt, Homo sapiens
aauaaagacacguacacua

SEQ ID NO: 855773 - RNA, 19 nt, Homo sapiens
cauacagaagucucuauuu

SEQ ID NO: 855774 - RNA, 19 nt, Homo sapiens
acaacuugguguacgugua

SEQ ID NO: 855775 - RNA, 19 nt, Homo sapiens
ccaaggugguggaugucaa

SEQ ID NO: 855776 - RNA, 19 nt, Homo sapiens
cagcagccaugugacaaau

SEQ ID NO: 855777 - RNA, 19 nt, Homo sapiens
aaguucaccuguuuagcua

SEQ ID NO: 855778 - RNA, 19 nt, Homo sapiens
ggcaagugcucgggccauu

SEQ ID NO: 855779 - RNA, 19 nt, Homo sapiens
agacggcaaugaacagauc

SEQ ID NO: 855780 - RNA, 19 nt, Homo sapiens
caaauguggccuucuugug

SEQ ID NO: 855781 - RNA, 19 nt, Homo sapiens
ggacccggcuaccuguaag

SEQ ID NO: 855782 - RNA, 19 nt, Homo sapiens
gcagcugcuuugucaccaa

SEQ ID NO: 855783 - RNA, 19 nt, Homo sapiens
ugucagggcaggaauucua

SEQ ID NO: 855784 - RNA, 19 nt, Homo sapiens
gaaaucucacaucuacuuc

SEQ ID NO: 855785 - RNA, 19 nt, Homo sapiens
aaagacacguacacuaaaa

SEQ ID NO: 855786 - RNA, 19 nt, Homo sapiens
gggcaggaauucuauuuuc

SEQ ID NO: 855787 - RNA, 19 nt, Homo sapiens
ggcaaaguucaccuguuua

SEQ ID NO: 855788 - RNA, 19 nt, Homo sapiens
caugagaaaccgaaguaug

SEQ ID NO: 855789 - RNA, 19 nt, Homo sapiens
gcuuaucaccugcgggaaa

SEQ ID NO: 855790 - RNA, 19 nt, Homo sapiens
aguaauauauacccagagu

SEQ ID NO: 855791 - RNA, 19 nt, Homo sapiens
gggacuaugagauucugua

SEQ ID NO: 855792 - RNA, 19 nt, Homo sapiens
guaauauauacccagagua

SEQ ID NO: 855793 - RNA, 19 nt, Homo sapiens
cagggcaggaauucuauuu

SEQ ID NO: 855794 - RNA, 19 nt, Homo sapiens
gagcagaggcagcgacacu

SEQ ID NO: 855795 - RNA, 19 nt, Homo sapiens
gggaagagggagucacauc

SEQ ID NO: 855796 - RNA, 19 nt, Homo sapiens
gggcggacggcacugauau

SEQ ID NO: 855797 - RNA, 19 nt, Homo sapiens
ggaaugggccacagcuacu

SEQ ID NO: 855798 - RNA, 19 nt, Homo sapiens
ccacggagacacacuguac

SEQ ID NO: 855799 - RNA, 19 nt, Homo sapiens
gcgggaaaucucacaucua

SEQ ID NO: 855800 - RNA, 19 nt, Homo sapiens
gguagacugacauacagaa

SEQ ID NO: 855801 - RNA, 19 nt, Homo sapiens
caguuucccucuccaccuu

SEQ ID NO: 855802 - RNA, 19 nt, Homo sapiens
gugcggaugcugugaggaa

SEQ ID NO: 855803 - RNA, 19 nt, Homo sapiens
gggacccggcuaccuguaa

SEQ ID NO: 855804 - RNA, 19 nt, Homo sapiens
gcgcaucugggacucaguu

SEQ ID NO: 855805 - RNA, 19 nt, Homo sapiens
gacaaauguggccuucuug

SEQ ID NO: 855806 - RNA, 19 nt, Homo sapiens
aacaugagaaaccgaagua

SEQ ID NO: 855807 - RNA, 19 nt, Homo sapiens
gggcuucuccaaaucuaau

SEQ ID NO: 855808 - RNA, 19 nt, Homo sapiens
ucaaaugcuuggccaucca

SEQ ID NO: 855809 - RNA, 19 nt, Homo sapiens
gaaugggccacagcuacuu

SEQ ID NO: 855810 - RNA, 19 nt, Homo sapiens
acacagacggcaaugaaca

SEQ ID NO: 855811 - RNA, 19 nt, Homo sapiens
caaggccucuuugagaaac

SEQ ID NO: 855812 - RNA, 19 nt, Homo sapiens
gugggcuucuccaaaucua

SEQ ID NO: 855813 - RNA, 19 nt, Homo sapiens
ggccauccacccagauaug

SEQ ID NO: 855814 - RNA, 19 nt, Homo sapiens
gcagaggcagcgacacuac

SEQ ID NO: 855815 - RNA, 19 nt, Homo sapiens
augagaaaccgaaguaugu

SEQ ID NO: 855816 - RNA, 19 nt, Homo sapiens
caagcggcaaggccucuuu

SEQ ID NO: 855817 - RNA, 19 nt, Homo sapiens
aaucucacaucuacuucug

SEQ ID NO: 855818 - RNA, 19 nt, Homo sapiens
ggacuaugagauucuguac

SEQ ID NO: 855819 - RNA, 19 nt, Homo sapiens
gcuccaaugaggcuguauu

SEQ ID NO: 855820 - RNA, 19 nt, Homo sapiens
auccauugguguuugguuu

SEQ ID NO: 855821 - RNA, 19 nt, Homo sapiens
acauacagaagucucuauu

SEQ ID NO: 855822 - RNA, 19 nt, Homo sapiens
gacauacagaagucucuau

SEQ ID NO: 855823 - RNA, 19 nt, Homo sapiens
aaaguucaccuguuuagcu

SEQ ID NO: 855824 - RNA, 19 nt, Homo sapiens
gggcucccacgacaacuug

SEQ ID NO: 855825 - RNA, 19 nt, Homo sapiens
ggcgggaaccacuaaggaa

SEQ ID NO: 855826 - RNA, 19 nt, Homo sapiens
gggauccauugguguuugg

SEQ ID NO: 855827 - RNA, 19 nt, Homo sapiens
ggcaaaaccaaagaaguua

SEQ ID NO: 855828 - RNA, 19 nt, Homo sapiens
gcggacggcacugauauca

SEQ ID NO: 855829 - RNA, 19 nt, Homo sapiens
gcaagugcucgggccauuc

SEQ ID NO: 855830 - RNA, 19 nt, Homo sapiens
cuuaucaccugcgggaaau

SEQ ID NO: 855831 - RNA, 19 nt, Homo sapiens
ggucuuaccucuucuuuaa

SEQ ID NO: 855832 - RNA, 19 nt, Homo sapiens
gaaaugaguuguucaccuu

SEQ ID NO: 855833 - RNA, 19 nt, Homo sapiens
gaccugagcuccuaugauu

SEQ ID NO: 855834 - RNA, 19 nt, Homo sapiens
ccuguaaguugauguauua

SEQ ID NO: 855835 - RNA, 19 nt, Homo sapiens
caacaaaucacaguaguaa

SEQ ID NO: 855836 - RNA, 19 nt, Homo sapiens
ggaaagaaaccaugaaagu

SEQ ID NO: 855837 - RNA, 19 nt, Homo sapiens
uauaaaugcuggcaacaaa

SEQ ID NO: 855838 - RNA, 19 nt, Homo sapiens
gauccacgaugccgaguuu

SEQ ID NO: 855839 - RNA, 19 nt, Homo sapiens
gauagcagauccuguaagu

SEQ ID NO: 855840 - RNA, 19 nt, Homo sapiens
ggaagacaaugaaaugagu

SEQ ID NO: 855841 - RNA, 19 nt, Homo sapiens
caacaacccugaagacaac

SEQ ID NO: 855842 - RNA, 19 nt, Homo sapiens
cugauuauguccagaauuu

SEQ ID NO: 855843 - RNA, 19 nt, Homo sapiens
ggaccacccugcuccgaaa

SEQ ID NO: 855844 - RNA, 19 nt, Homo sapiens
gagaucauccagcacuuua

SEQ ID NO: 855845 - RNA, 19 nt, Homo sapiens
gauaaggaauuccaacucu

SEQ ID NO: 855846 - RNA, 19 nt, Homo sapiens
ccauucaucugguuacuga

SEQ ID NO: 855847 - RNA, 19 nt, Homo sapiens
uagcagauccuguaaguug

SEQ ID NO: 855848 - RNA, 19 nt, Homo sapiens
gcaacaacccugaagacaa

SEQ ID NO: 855849 - RNA, 19 nt, Homo sapiens
gcaacaaaucacaguagua

SEQ ID NO: 855850 - RNA, 19 nt, Homo sapiens
gaaagaaaccaugaaaguc

SEQ ID NO: 855851 - RNA, 19 nt, Homo sapiens
uagccuuacucccaaguua

SEQ ID NO: 855852 - RNA, 19 nt, Homo sapiens
aaccggaacuuguugauga

SEQ ID NO: 855853 - RNA, 19 nt, Homo sapiens
gauggaagacaaugaaaug

SEQ ID NO: 855854 - RNA, 19 nt, Homo sapiens
uaaccggucuccaugaugu

SEQ ID NO: 855855 - RNA, 19 nt, Homo sapiens
ggaacuuguugaugaacuu

SEQ ID NO: 855856 - RNA, 19 nt, Homo sapiens
cuaaaggcagggauucuua

SEQ ID NO: 855857 - RNA, 19 nt, Homo sapiens
gaggagggaucugcaacaa

SEQ ID NO: 855858 - RNA, 19 nt, Homo sapiens
gaagacaacaaggaaagaa

SEQ ID NO: 855859 - RNA, 19 nt, Homo sapiens
gagcaacuggugugugaaa

SEQ ID NO: 855860 - RNA, 19 nt, Homo sapiens
cagcaacuguaauguaaca

SEQ ID NO: 855861 - RNA, 19 nt, Homo sapiens
ggaguguccugauuauguc

SEQ ID NO: 855862 - RNA, 19 nt, Homo sapiens
ccauuacgcuggcaaacug

SEQ ID NO: 855863 - RNA, 19 nt, Homo sapiens
uccaugauguugaugagua

SEQ ID NO: 855864 - RNA, 19 nt, Homo sapiens
aauaucaucucaucaacga

SEQ ID NO: 855865 - RNA, 19 nt, Homo sapiens
caacuggugugugaaaugg

SEQ ID NO: 855866 - RNA, 19 nt, Homo sapiens
aaugauagcagauccugua

SEQ ID NO: 855867 - RNA, 19 nt, Homo sapiens
ggacuacgaacacaaacug

SEQ ID NO: 855868 - RNA, 19 nt, Homo sapiens
aaaagggcaucuugaagua

SEQ ID NO: 855869 - RNA, 19 nt, Homo sapiens
cucagaaacugcucaaugu

SEQ ID NO: 855870 - RNA, 19 nt, Homo sapiens
ugacggggcucacguugua

SEQ ID NO: 855871 - RNA, 19 nt, Homo sapiens
uaaaggcagggauucuuaa

SEQ ID NO: 855872 - RNA, 19 nt, Homo sapiens
ugacggggcuccugaugua

SEQ ID NO: 855873 - RNA, 19 nt, Homo sapiens
gaagacaaugaaaugaguu

SEQ ID NO: 855874 - RNA, 19 nt, Homo sapiens
ggagaucauccagcacuuu

SEQ ID NO: 855875 - RNA, 19 nt, Homo sapiens
caagcgggaugucuacuac

SEQ ID NO: 855876 - RNA, 19 nt, Homo sapiens
aagggcaucuugaaguauu

SEQ ID NO: 855877 - RNA, 19 nt, Homo sapiens
ccaugaaagucugucugua

SEQ ID NO: 855878 - RNA, 19 nt, Homo sapiens
aaagaaaccaugaaagucu

SEQ ID NO: 855879 - RNA, 19 nt, Homo sapiens
cagcagaguggacacguuu

SEQ ID NO: 855880 - RNA, 19 nt, Homo sapiens
ggugguagcccauucaucu

SEQ ID NO: 855881 - RNA, 19 nt, Homo sapiens
ucauauuugucaccucuug

SEQ ID NO: 855882 - RNA, 19 nt, Homo sapiens
gcauucggguggacuacga

SEQ ID NO: 855883 - RNA, 19 nt, Homo sapiens
gcaacuggugugugaaaug

SEQ ID NO: 855884 - RNA, 19 nt, Homo sapiens
gauccuguaaguugaugua

SEQ ID NO: 855885 - RNA, 19 nt, Homo sapiens
aaacugcuacaacuggaua

SEQ ID NO: 855886 - RNA, 19 nt, Homo sapiens
uugagcaacugguguguga

SEQ ID NO: 855887 - RNA, 19 nt, Homo sapiens
ggcaacaaaucacaguagu

SEQ ID NO: 855888 - RNA, 19 nt, Homo sapiens
cagaaacugcucaauguca

SEQ ID NO: 855889 - RNA, 19 nt, Homo sapiens
aaugaguuguucaccuuaa

SEQ ID NO: 855890 - RNA, 19 nt, Homo sapiens
gagauggaagacaaugaaa

SEQ ID NO: 855891 - RNA, 19 nt, Homo sapiens
uaaggaauuccaacucuuc

SEQ ID NO: 855892 - RNA, 19 nt, Homo sapiens
gccuuacucccaaguuaua

SEQ ID NO: 855893 - RNA, 19 nt, Homo sapiens
ugagauggaagacaaugaa

SEQ ID NO: 855894 - RNA, 19 nt, Homo sapiens
caccaauacaaaccaguua

SEQ ID NO: 855895 - RNA, 19 nt, Homo sapiens
uaaaugcuggcaacaaauc

SEQ ID NO: 855896 - RNA, 19 nt, Homo sapiens
ggguaaccaugaacuugau

SEQ ID NO: 855897 - RNA, 19 nt, Homo sapiens
ugauacaacucagaaacug

SEQ ID NO: 855898 - RNA, 19 nt, Homo sapiens
ccuccuagcugcucugaac

SEQ ID NO: 855899 - RNA, 19 nt, Homo sapiens
ccaugauguugaugaguau

SEQ ID NO: 855900 - RNA, 19 nt, Homo sapiens
cagcaaugaaacugaaauu

SEQ ID NO: 855901 - RNA, 19 nt, Homo sapiens
gcagugggaauucuugagu

SEQ ID NO: 855902 - RNA, 19 nt, Homo sapiens
gguaggugguagcccauuc

SEQ ID NO: 855903 - RNA, 19 nt, Homo sapiens
caaggaaagaaaccaugaa

SEQ ID NO: 855904 - RNA, 19 nt, Homo sapiens
gaucauccagcacuuuaag

SEQ ID NO: 855905 - RNA, 19 nt, Homo sapiens
gguggacuacgaacacaaa

SEQ ID NO: 855906 - RNA, 19 nt, Homo sapiens
guacugcagugggaauucu

SEQ ID NO: 855907 - RNA, 19 nt, Homo sapiens
ggucccacccgcaucauug

SEQ ID NO: 855908 - RNA, 19 nt, Homo sapiens
uagcugcucugaacauugc

SEQ ID NO: 855909 - RNA, 19 nt, Homo sapiens
caacaaggaaagaaaccau

SEQ ID NO: 855910 - RNA, 19 nt, Homo sapiens
gaacuuguugaugaacuug

SEQ ID NO: 855911 - RNA, 19 nt, Homo sapiens
ggcuauggcuccacuacca

SEQ ID NO: 855912 - RNA, 19 nt, Homo sapiens
ggauaaggaauuccaacuc

SEQ ID NO: 855913 - RNA, 19 nt, Homo sapiens
ccaccaauacaaaccaguu

SEQ ID NO: 855914 - RNA, 19 nt, Homo sapiens
auucuugagugaggucuua

SEQ ID NO: 855915 - RNA, 19 nt, Homo sapiens
caugaaagucugucuguac

SEQ ID NO: 855916 - RNA, 19 nt, Homo sapiens
aaggaaagaaaccaugaaa

SEQ ID NO: 855917 - RNA, 19 nt, Homo sapiens
acaaggaaagaaaccauga

SEQ ID NO: 855918 - RNA, 19 nt, Homo sapiens
acaacuggauaaggaauuc

SEQ ID NO: 855919 - RNA, 19 nt, Homo sapiens
agugggaauucuugaguga

SEQ ID NO: 855920 - RNA, 19 nt, Homo sapiens
aacgaggccuggacaaaca

SEQ ID NO: 855921 - RNA, 19 nt, Homo sapiens
ucaacgaggccuggacaaa

SEQ ID NO: 855922 - RNA, 19 nt, Homo sapiens
ggacuugucgcccguuugc

SEQ ID NO: 855923 - RNA, 19 nt, Homo sapiens
gccaggugcugagccagaa

SEQ ID NO: 855924 - RNA, 19 nt, Homo sapiens
caacgaggccuggacaaac

SEQ ID NO: 855925 - RNA, 19 nt, Homo sapiens
ucagcagaguggacacguu

SEQ ID NO: 855926 - RNA, 19 nt, Homo sapiens
ggaccugagcuccuaugau

SEQ ID NO: 855927 - RNA, 19 nt, Homo sapiens
ccuagcugcucugaacauu

SEQ ID NO: 855928 - RNA, 19 nt, Homo sapiens
auaaggaauuccaacucuu

SEQ ID NO: 855929 - RNA, 19 nt, Homo sapiens
gcagauccuguaaguugau

SEQ ID NO: 855930 - RNA, 19 nt, Homo sapiens
ucgcagcgccuucaaacug

SEQ ID NO: 855931 - RNA, 19 nt, Homo sapiens
caacauagcuacaaucaaa

SEQ ID NO: 855932 - RNA, 19 nt, Homo sapiens
gcuaggcgcucacagaaua

SEQ ID NO: 855933 - RNA, 19 nt, Homo sapiens
gggagacucuuucggauuu

SEQ ID NO: 855934 - RNA, 19 nt, Homo sapiens
ggacacagcuggcuuaucc

SEQ ID NO: 855935 - RNA, 19 nt, Homo sapiens
ucucaggccuuuccacuaa

SEQ ID NO: 855936 - RNA, 19 nt, Homo sapiens
gaaaaucucucaggccuuu

SEQ ID NO: 855937 - RNA, 19 nt, Homo sapiens
uacaauggcucaaaucaug

SEQ ID NO: 855938 - RNA, 19 nt, Homo sapiens
acagcuggcuuauccuaua

SEQ ID NO: 855939 - RNA, 19 nt, Homo sapiens
ugguaacacucgcgauuua

SEQ ID NO: 855940 - RNA, 19 nt, Homo sapiens
gaaagugauucaugcuucu

SEQ ID NO: 855941 - RNA, 19 nt, Homo sapiens
ggacagaucccaguauaag

SEQ ID NO: 855942 - RNA, 19 nt, Homo sapiens
gaagaaucaaucuguguga

SEQ ID NO: 855943 - RNA, 19 nt, Homo sapiens
ggagaaaacccacuucaaa

SEQ ID NO: 855944 - RNA, 19 nt, Homo sapiens
ucacagaacaggccgauau

SEQ ID NO: 855945 - RNA, 19 nt, Homo sapiens
uggcuuguguccaugcuua

SEQ ID NO: 855946 - RNA, 19 nt, Homo sapiens
gcagccaaauuuauuguac

SEQ ID NO: 855947 - RNA, 19 nt, Homo sapiens
caugguggcuuggcuuuga

SEQ ID NO: 855948 - RNA, 19 nt, Homo sapiens
gaaauggcaauuauucucu

SEQ ID NO: 855949 - RNA, 19 nt, Homo sapiens
ggugaaauggcaauuauuc

SEQ ID NO: 855950 - RNA, 19 nt, Homo sapiens
ccaacuggaucagguagaa

SEQ ID NO: 855951 - RNA, 19 nt, Homo sapiens
cgacuaauguaacuaugca

SEQ ID NO: 855952 - RNA, 19 nt, Homo sapiens
gcaacuacguagaucugau

SEQ ID NO: 855953 - RNA, 19 nt, Homo sapiens
aaucauggcagaacaagaa

SEQ ID NO: 855954 - RNA, 19 nt, Homo sapiens
gcagaguuguuuggacuuc

SEQ ID NO: 855955 - RNA, 19 nt, Homo sapiens
gugauugucuugggaaugu

SEQ ID NO: 855956 - RNA, 19 nt, Homo sapiens
gaucagguagaacaacaaa

SEQ ID NO: 855957 - RNA, 19 nt, Homo sapiens
agucggagcugcaaguguu

SEQ ID NO: 855958 - RNA, 19 nt, Homo sapiens
gaaaacgacuaauguaacu

SEQ ID NO: 855959 - RNA, 19 nt, Homo sapiens
gggagcaacuggaagaaac

SEQ ID NO: 855960 - RNA, 19 nt, Homo sapiens
uauuguaccuuaugaugug

SEQ ID NO: 855961 - RNA, 19 nt, Homo sapiens
ccauuucacuggccucuag

SEQ ID NO: 855962 - RNA, 19 nt, Homo sapiens
ugucaaugcacacagaaua

SEQ ID NO: 855963 - RNA, 19 nt, Homo sapiens
gcaauaaaugccacuugga

SEQ ID NO: 855964 - RNA, 19 nt, Homo sapiens
cagaagacggucaccauga

SEQ ID NO: 855965 - RNA, 19 nt, Homo sapiens
gcugggaaguccuaugagu

SEQ ID NO: 855966 - RNA, 19 nt, Homo sapiens
caaaguuuagggauugaaa

SEQ ID NO: 855967 - RNA, 19 nt, Homo sapiens
agaagacggucaccaugau

SEQ ID NO: 855968 - RNA, 19 nt, Homo sapiens
cgacagacuucgaguucuc

SEQ ID NO: 855969 - RNA, 19 nt, Homo sapiens
cuccugauguuguuccaua

SEQ ID NO: 855970 - RNA, 19 nt, Homo sapiens
uggcuuauccuauacaguu

SEQ ID NO: 855971 - RNA, 19 nt, Homo sapiens
cccuuuagguucagaagaa

SEQ ID NO: 855972 - RNA, 19 nt, Homo sapiens
gagcaauaaaugccacuug

SEQ ID NO: 855973 - RNA, 19 nt, Homo sapiens
aaacaggccuggguaucug

SEQ ID NO: 855974 - RNA, 19 nt, Homo sapiens
cauccaaccuuuugacauu

SEQ ID NO: 855975 - RNA, 19 nt, Homo sapiens
gcacugcgaguauggaucu

SEQ ID NO: 855976 - RNA, 19 nt, Homo sapiens
gcaagaccccugaaaguga

SEQ ID NO: 855977 - RNA, 19 nt, Homo sapiens
ucgcgcauaugcacucaaa

SEQ ID NO: 855978 - RNA, 19 nt, Homo sapiens
cacgagauacaccaacaua

SEQ ID NO: 855979 - RNA, 19 nt, Homo sapiens
gaaguccuaugagugucaa

SEQ ID NO: 855980 - RNA, 19 nt, Homo sapiens
aaaggaaagccacaacaug

SEQ ID NO: 855981 - RNA, 19 nt, Homo sapiens
caagcucaacaaaccauuu

SEQ ID NO: 855982 - RNA, 19 nt, Homo sapiens
uaauguaacuaugcagagu

SEQ ID NO: 855983 - RNA, 19 nt, Homo sapiens
agggugaaauggcaauuau

SEQ ID NO: 855984 - RNA, 19 nt, Homo sapiens
acaccaacauagcuacaau

SEQ ID NO: 855985 - RNA, 19 nt, Homo sapiens
ucagugaagagcauaaaug

SEQ ID NO: 855986 - RNA, 19 nt, Homo sapiens
uaaaggaaagccacaacau

SEQ ID NO: 855987 - RNA, 19 nt, Homo sapiens
guaaaggaaagccacaaca

SEQ ID NO: 855988 - RNA, 19 nt, Homo sapiens
gaguucuccugauguuguu

SEQ ID NO: 855989 - RNA, 19 nt, Homo sapiens
aaggaaagccacaacaugu

SEQ ID NO: 855990 - RNA, 19 nt, Homo sapiens
cgacaccgaguccuagcua

SEQ ID NO: 855991 - RNA, 19 nt, Homo sapiens
auaaaugcccaguggauga

SEQ ID NO: 855992 - RNA, 19 nt, Homo sapiens
ggaaguccuaugaguguca

SEQ ID NO: 855993 - RNA, 19 nt, Homo sapiens
cauucugcauguuuaguga

SEQ ID NO: 855994 - RNA, 19 nt, Homo sapiens
ggagacucuuucggauuug

SEQ ID NO: 855995 - RNA, 19 nt, Homo sapiens
caaacaggccuggguaucu

SEQ ID NO: 855996 - RNA, 19 nt, Homo sapiens
ccuauacaguugucaaugc

SEQ ID NO: 855997 - RNA, 19 nt, Homo sapiens
ccacuccagcggcgacuuu

SEQ ID NO: 855998 - RNA, 19 nt, Homo sapiens
caugguaacacucgcgauu

SEQ ID NO: 855999 - RNA, 19 nt, Homo sapiens
gcuggcauucugcauguuu

SEQ ID NO: 856000 - RNA, 19 nt, Homo sapiens
uagcuaggcgcucacagaa

SEQ ID NO: 856001 - RNA, 19 nt, Homo sapiens
cauacaauggcucaaauca

SEQ ID NO: 856002 - RNA, 19 nt, Homo sapiens
cgaguucuccugauguugu

SEQ ID NO: 856003 - RNA, 19 nt, Homo sapiens
gaagacggucaccaugauc

SEQ ID NO: 856004 - RNA, 19 nt, Homo sapiens
gcggcgacuuugagggauu

SEQ ID NO: 856005 - RNA, 19 nt, Homo sapiens
cagaaaacgacuaauguaa

SEQ ID NO: 856006 - RNA, 19 nt, Homo sapiens
cuccaaagagcaauaaaug

SEQ ID NO: 856007 - RNA, 19 nt, Homo sapiens
cuggcauucugcauguuua

SEQ ID NO: 856008 - RNA, 19 nt, Homo sapiens
acacagcuggcuuauccua

SEQ ID NO: 856009 - RNA, 19 nt, Homo sapiens
acaggccgauaucgcauug

SEQ ID NO: 856010 - RNA, 19 nt, Homo sapiens
gaaaacaugcuucuuugag

SEQ ID NO: 856011 - RNA, 19 nt, Homo sapiens
ugaaauggcaauuauucuc

SEQ ID NO: 856012 - RNA, 19 nt, Homo sapiens
gagacucuuucggauuugu

SEQ ID NO: 856013 - RNA, 19 nt, Homo sapiens
gagauacaccaacauagcu

SEQ ID NO: 856014 - RNA, 19 nt, Homo sapiens
ccgcugggaaguccuauga

SEQ ID NO: 856015 - RNA, 19 nt, Homo sapiens
ucaaaucauggcagaacaa

SEQ ID NO: 856016 - RNA, 19 nt, Homo sapiens
ccagaaaacgacuaaugua

SEQ ID NO: 856017 - RNA, 19 nt, Homo sapiens
ugggaauguuucacugcua

SEQ ID NO: 856018 - RNA, 19 nt, Homo sapiens
gauugucuugggaauguuu

SEQ ID NO: 856019 - RNA, 19 nt, Homo sapiens
gcauucugcauguuuagug

SEQ ID NO: 856020 - RNA, 19 nt, Homo sapiens
cuauacaguugucaaugca

SEQ ID NO: 856021 - RNA, 19 nt, Homo sapiens
ggcagaacaagaaguggaa

SEQ ID NO: 856022 - RNA, 19 nt, Homo sapiens
gagugucaagcucaacaaa

SEQ ID NO: 856023 - RNA, 19 nt, Homo sapiens
cgacuuggaggcugagcaa

SEQ ID NO: 856024 - RNA, 19 nt, Homo sapiens
uggcuggcauucugcaugu

SEQ ID NO: 856025 - RNA, 19 nt, Homo sapiens
gcuucuggcuggcauucug

SEQ ID NO: 856026 - RNA, 19 nt, Homo sapiens
caauuauucucuccaugcu

SEQ ID NO: 856027 - RNA, 19 nt, Homo sapiens
uagggugaaauggcaauua

SEQ ID NO: 856028 - RNA, 19 nt, Homo sapiens
uggaucagguagaacaaca

SEQ ID NO: 856029 - RNA, 19 nt, Homo sapiens
cuucaaagacgcagucagu

SEQ ID NO: 856030 - RNA, 19 nt, Homo sapiens
cuggguggaucgcgcauau

SEQ ID NO: 856031 - RNA, 19 nt, Homo sapiens
gcaaggaacugucuuucug

SEQ ID NO: 856032 - RNA, 19 nt, Homo sapiens
gaaccuggauccugugcau

SEQ ID NO: 856033 - RNA, 19 nt, Homo sapiens
aaccagagaugaccuucaa

SEQ ID NO: 856034 - RNA, 19 nt, Homo sapiens
gagcugauccugaguacca

SEQ ID NO: 856035 - RNA, 19 nt, Homo sapiens
gcuuuaaccugggcauguu

SEQ ID NO: 856036 - RNA, 19 nt, Homo sapiens
gaccaggugcacuucuaua

SEQ ID NO: 856037 - RNA, 19 nt, Homo sapiens
caguguggcugaauaaagg

SEQ ID NO: 856038 - RNA, 19 nt, Homo sapiens
ccagagaugaccuucaauc

SEQ ID NO: 856039 - RNA, 19 nt, Homo sapiens
aaaccugacugcccaagcu

SEQ ID NO: 856040 - RNA, 19 nt, Homo sapiens
cugaauaaaggcucucuug

SEQ ID NO: 856041 - RNA, 19 nt, Homo sapiens
ugaagcagcacccguugug

SEQ ID NO: 856042 - RNA, 19 nt, Homo sapiens
acuguggucugaagagaug

SEQ ID NO: 856043 - RNA, 19 nt, Homo sapiens
gagacacaauaucaaaaug

SEQ ID NO: 856044 - RNA, 19 nt, Homo sapiens
ggagacacaauaucaaaau

SEQ ID NO: 856045 - RNA, 19 nt, Homo sapiens
gcuggagacacaauaucaa

SEQ ID NO: 856046 - RNA, 19 nt, Homo sapiens
ccacaugccaaccagagau

SEQ ID NO: 856047 - RNA, 19 nt, Homo sapiens
cugucuuucugguucaaua

SEQ ID NO: 856048 - RNA, 19 nt, Homo sapiens
cuggagacacaauaucaaa

SEQ ID NO: 856049 - RNA, 19 nt, Homo sapiens
aaagccugcuggagacaca

SEQ ID NO: 856050 - RNA, 19 nt, Homo sapiens
ucaauccugguccaacuga

SEQ ID NO: 856051 - RNA, 19 nt, Homo sapiens
ggacagagguaucauuaaa

SEQ ID NO: 856052 - RNA, 19 nt, Homo sapiens
gcacauggaugcauucuau

SEQ ID NO: 856053 - RNA, 19 nt, Homo sapiens
gcaagaagaagcccaaaua

SEQ ID NO: 856054 - RNA, 19 nt, Homo sapiens
uaagagggauguacuguaa

SEQ ID NO: 856055 - RNA, 19 nt, Homo sapiens
gcaggaaucuuuauaccaa

SEQ ID NO: 856056 - RNA, 19 nt, Homo sapiens
ggaagucgauguucucaga

SEQ ID NO: 856057 - RNA, 19 nt, Homo sapiens
gaagauaccuacucauuuu

SEQ ID NO: 856058 - RNA, 19 nt, Homo sapiens
gcaaaggaguucucuguag

SEQ ID NO: 856059 - RNA, 19 nt, Homo sapiens
ggaagauucugaugacgaa

SEQ ID NO: 856060 - RNA, 19 nt, Homo sapiens
caccaaggauccagauaua

SEQ ID NO: 856061 - RNA, 19 nt, Homo sapiens
gggauguacuguaaauaaa

SEQ ID NO: 856062 - RNA, 19 nt, Homo sapiens
gcacaacguucccgaugau

SEQ ID NO: 856063 - RNA, 19 nt, Homo sapiens
cauagcagccuucccuuua

SEQ ID NO: 856064 - RNA, 19 nt, Homo sapiens
gggaagggaugaucucugu

SEQ ID NO: 856065 - RNA, 19 nt, Homo sapiens
ugggauaaauuuccacuuu

SEQ ID NO: 856066 - RNA, 19 nt, Homo sapiens
gaucaucucuaaguggaaa

SEQ ID NO: 856067 - RNA, 19 nt, Homo sapiens
gcgcagggcucaagaaagg

SEQ ID NO: 856068 - RNA, 19 nt, Homo sapiens
ggaaaagccuccuagagaa

SEQ ID NO: 856069 - RNA, 19 nt, Homo sapiens
ggacugugauacuaagaau

SEQ ID NO: 856070 - RNA, 19 nt, Homo sapiens
caaaggaguucucuguagu

SEQ ID NO: 856071 - RNA, 19 nt, Homo sapiens
ucaguaacagcccaaauua

SEQ ID NO: 856072 - RNA, 19 nt, Homo sapiens
ggacagacagcaagagaga

SEQ ID NO: 856073 - RNA, 19 nt, Homo sapiens
cuaagaagauaccuacuca

SEQ ID NO: 856074 - RNA, 19 nt, Homo sapiens
caacguuggugccuacaug

SEQ ID NO: 856075 - RNA, 19 nt, Homo sapiens
gauaguugggugcacauua

SEQ ID NO: 856076 - RNA, 19 nt, Homo sapiens
acuaagagaugcauuaaag

SEQ ID NO: 856077 - RNA, 19 nt, Homo sapiens
gggagaacauugccuaucu

SEQ ID NO: 856078 - RNA, 19 nt, Homo sapiens
gggaugaucucugucucua

SEQ ID NO: 856079 - RNA, 19 nt, Homo sapiens
gaugagaggcccagcuuug

SEQ ID NO: 856080 - RNA, 19 nt, Homo sapiens
gaaacucccaaauaucuau

SEQ ID NO: 856081 - RNA, 19 nt, Homo sapiens
ucccgaaacucccaaauau

SEQ ID NO: 856082 - RNA, 19 nt, Homo sapiens
ccaaaucuuucauggacuu

SEQ ID NO: 856083 - RNA, 19 nt, Homo sapiens
gaacuuuaaggaccucauu

SEQ ID NO: 856084 - RNA, 19 nt, Homo sapiens
guaacagcccaaauuauga

SEQ ID NO: 856085 - RNA, 19 nt, Homo sapiens
gaagaagcccaaauacucu

SEQ ID NO: 856086 - RNA, 19 nt, Homo sapiens
ggaagaaugcacaagguau

SEQ ID NO: 856087 - RNA, 19 nt, Homo sapiens
guggacagagguaucauua

SEQ ID NO: 856088 - RNA, 19 nt, Homo sapiens
uuggugagcuagucauuaa

SEQ ID NO: 856089 - RNA, 19 nt, Homo sapiens
gaaccaaaucuuucaugga

SEQ ID NO: 856090 - RNA, 19 nt, Homo sapiens
aaaagaaucugggaucuaa

SEQ ID NO: 856091 - RNA, 19 nt, Homo sapiens
ggacagccaaguugauguu

SEQ ID NO: 856092 - RNA, 19 nt, Homo sapiens
aaacaggacagccaaguug

SEQ ID NO: 856093 - RNA, 19 nt, Homo sapiens
gcauugaugaugaugauga

SEQ ID NO: 856094 - RNA, 19 nt, Homo sapiens
aaucugggaucuaagaaga

SEQ ID NO: 856095 - RNA, 19 nt, Homo sapiens
ccaaggauccagauauaau

SEQ ID NO: 856096 - RNA, 19 nt, Homo sapiens
gauguucuuuccuggcaaa

SEQ ID NO: 856097 - RNA, 19 nt, Homo sapiens
gaagaaugcacaagguauc

SEQ ID NO: 856098 - RNA, 19 nt, Homo sapiens
caaggauccagauauaauu

SEQ ID NO: 856099 - RNA, 19 nt, Homo sapiens
gcaagguccuggagauggu

SEQ ID NO: 856100 - RNA, 19 nt, Homo sapiens
aagaggaguuucagaagga

SEQ ID NO: 856101 - RNA, 19 nt, Homo sapiens
ggaggaaccaaaucuuuca

SEQ ID NO: 856102 - RNA, 19 nt, Homo sapiens
gggaaggccgcauugauga

SEQ ID NO: 856103 - RNA, 19 nt, Homo sapiens
aagaagauaccuacucauu

SEQ ID NO: 856104 - RNA, 19 nt, Homo sapiens
caucgucuauccacucaug

SEQ ID NO: 856105 - RNA, 19 nt, Homo sapiens
gggaagaaugcacaaggua

SEQ ID NO: 856106 - RNA, 19 nt, Homo sapiens
ucacaguccugauaaucug

SEQ ID NO: 856107 - RNA, 19 nt, Homo sapiens
ccucaaagacugcacuuau

SEQ ID NO: 856108 - RNA, 19 nt, Homo sapiens
agaagauaccuacucauuu

SEQ ID NO: 856109 - RNA, 19 nt, Homo sapiens
ggauggugaagcugaauuu

SEQ ID NO: 856110 - RNA, 19 nt, Homo sapiens
gauccgagcgcaccacuca

SEQ ID NO: 856111 - RNA, 19 nt, Homo sapiens
cgggagaacuuugagauca

SEQ ID NO: 856112 - RNA, 19 nt, Homo sapiens
acaacgaguucagucagua

SEQ ID NO: 856113 - RNA, 19 nt, Homo sapiens
agagggauguacuguaaau

SEQ ID NO: 856114 - RNA, 19 nt, Homo sapiens
ggagugggauccccucaaa

SEQ ID NO: 856115 - RNA, 19 nt, Homo sapiens
acaagaccguggaagaguu

SEQ ID NO: 856116 - RNA, 19 nt, Homo sapiens
agaagaagcccaaauacuc

SEQ ID NO: 856117 - RNA, 19 nt, Homo sapiens
ggauccagauauaauucuu

SEQ ID NO: 856118 - RNA, 19 nt, Homo sapiens
caggaggaaccaaaucuuu

SEQ ID NO: 856119 - RNA, 19 nt, Homo sapiens
aggcagaguuggaagauuc

SEQ ID NO: 856120 - RNA, 19 nt, Homo sapiens
ggacaguggauaucaugga

SEQ ID NO: 856121 - RNA, 19 nt, Homo sapiens
gaucuucucucuuguuccu

SEQ ID NO: 856122 - RNA, 19 nt, Homo sapiens
gcgggaggcugagaacaug

SEQ ID NO: 856123 - RNA, 19 nt, Homo sapiens
gaagagaaaccuguuaagc

SEQ ID NO: 856124 - RNA, 19 nt, Homo sapiens
caaggacaguggauaucau

SEQ ID NO: 856125 - RNA, 19 nt, Homo sapiens
ggaguucucuguaguuccu

SEQ ID NO: 856126 - RNA, 19 nt, Homo sapiens
cagccaaguugauguucuu

SEQ ID NO: 856127 - RNA, 19 nt, Homo sapiens
gaagggaugaucucugucu

SEQ ID NO: 856128 - RNA, 19 nt, Homo sapiens
auaguugggugcacauuau

SEQ ID NO: 856129 - RNA, 19 nt, Homo sapiens
gagaaugaccagcucuugu

SEQ ID NO: 856130 - RNA, 19 nt, Homo sapiens
gcacuuauggcaccgagau

SEQ ID NO: 856131 - RNA, 19 nt, Homo sapiens
ucgaaacccugcaggacaa

SEQ ID NO: 856132 - RNA, 19 nt, Homo sapiens
gggagcagaaggucuacua

SEQ ID NO: 856133 - RNA, 19 nt, Homo sapiens
cauguauugugaagucuga

SEQ ID NO: 856134 - RNA, 19 nt, Homo sapiens
gaaccaguggacagaggua

SEQ ID NO: 856135 - RNA, 19 nt, Homo sapiens
gguccucacaguccugaua

SEQ ID NO: 856136 - RNA, 19 nt, Homo sapiens
gcauugugaucuacaucga

SEQ ID NO: 856137 - RNA, 19 nt, Homo sapiens
uuaaugaggcacuugauau

SEQ ID NO: 856138 - RNA, 19 nt, Homo sapiens
caaauuuaaugaggcacuu

SEQ ID NO: 856139 - RNA, 19 nt, Homo sapiens
gcaagacuucccugugguu

SEQ ID NO: 856140 - RNA, 19 nt, Homo sapiens
gacgaagagaaaccuguua

SEQ ID NO: 856141 - RNA, 19 nt, Homo sapiens
ccaccaaggauccagauau

SEQ ID NO: 856142 - RNA, 19 nt, Homo sapiens
aguaacagcccaaauuaug

SEQ ID NO: 856143 - RNA, 19 nt, Homo sapiens
gcucuuggcucaguaacag

SEQ ID NO: 856144 - RNA, 19 nt, Homo sapiens
gggaagcauucauggucaa

SEQ ID NO: 856145 - RNA, 19 nt, Homo sapiens
caggagaucauccagaaug

SEQ ID NO: 856146 - RNA, 19 nt, Homo sapiens
cuaagugacuggccauguc

SEQ ID NO: 856147 - RNA, 19 nt, Homo sapiens
caaguggaagcaagaagaa

SEQ ID NO: 856148 - RNA, 19 nt, Homo sapiens
gaaagacacacaaaaggaa

SEQ ID NO: 856149 - RNA, 19 nt, Homo sapiens
cuucagauagucacaguaa

SEQ ID NO: 856150 - RNA, 19 nt, Homo sapiens
gcucugugcccaugaacuu

SEQ ID NO: 856151 - RNA, 19 nt, Homo sapiens
gaagacagauguucucaaa

SEQ ID NO: 856152 - RNA, 19 nt, Homo sapiens
uaagugaggucaagucaua

SEQ ID NO: 856153 - RNA, 19 nt, Homo sapiens
gaacacaggaguauuuaaa

SEQ ID NO: 856154 - RNA, 19 nt, Homo sapiens
cgaccuauguccuaaguua

SEQ ID NO: 856155 - RNA, 19 nt, Homo sapiens
caggagaucucgauuggua

SEQ ID NO: 856156 - RNA, 19 nt, Homo sapiens
gaagaacacuuugccugaa

SEQ ID NO: 856157 - RNA, 19 nt, Homo sapiens
guaucuaccugggcuauua

SEQ ID NO: 856158 - RNA, 19 nt, Homo sapiens
gaucagggcacauaaguga

SEQ ID NO: 856159 - RNA, 19 nt, Homo sapiens
uaacgugaguuucuuaugu

SEQ ID NO: 856160 - RNA, 19 nt, Homo sapiens
caagauggauguuguugau

SEQ ID NO: 856161 - RNA, 19 nt, Homo sapiens
ggaaaucccguaaccacua

SEQ ID NO: 856162 - RNA, 19 nt, Homo sapiens
gaagaaugguuuaugaacu

SEQ ID NO: 856163 - RNA, 19 nt, Homo sapiens
gaagaaugcccgacagaga

SEQ ID NO: 856164 - RNA, 19 nt, Homo sapiens
gaaaucccguaaccacuau

SEQ ID NO: 856165 - RNA, 19 nt, Homo sapiens
gagcaguacuugaagacaa

SEQ ID NO: 856166 - RNA, 19 nt, Homo sapiens
cagaagacauuaauucagu

SEQ ID NO: 856167 - RNA, 19 nt, Homo sapiens
agacagauguucucaaagu

SEQ ID NO: 856168 - RNA, 19 nt, Homo sapiens
ggaagcaccugagagauag

SEQ ID NO: 856169 - RNA, 19 nt, Homo sapiens
ccaagacagugaaacuaaa

SEQ ID NO: 856170 - RNA, 19 nt, Homo sapiens
gacauuggcgugcuucaua

SEQ ID NO: 856171 - RNA, 19 nt, Homo sapiens
caagaacaauuagucaaga

SEQ ID NO: 856172 - RNA, 19 nt, Homo sapiens
auacaagugucuuaaggua

SEQ ID NO: 856173 - RNA, 19 nt, Homo sapiens
gcaaguaacuauguguaag

SEQ ID NO: 856174 - RNA, 19 nt, Homo sapiens
cgacaugggauuuaauuug

SEQ ID NO: 856175 - RNA, 19 nt, Homo sapiens
caagcacuuuggaagauuu

SEQ ID NO: 856176 - RNA, 19 nt, Homo sapiens
gacaugggauuuaauuugg

SEQ ID NO: 856177 - RNA, 19 nt, Homo sapiens
ugacaaaccuuggcaugau

SEQ ID NO: 856178 - RNA, 19 nt, Homo sapiens
ggaaauggugaucaacaaa

SEQ ID NO: 856179 - RNA, 19 nt, Homo sapiens
uuaagguacuggagaauau

SEQ ID NO: 856180 - RNA, 19 nt, Homo sapiens
cagauguucucaaagugua

SEQ ID NO: 856181 - RNA, 19 nt, Homo sapiens
ucacagaagacauuaauuc

SEQ ID NO: 856182 - RNA, 19 nt, Homo sapiens
ccacggagcccaaguucaa

SEQ ID NO: 856183 - RNA, 19 nt, Homo sapiens
uaaagacuguuagacaaga

SEQ ID NO: 856184 - RNA, 19 nt, Homo sapiens
ggauucuucuugcugauga

SEQ ID NO: 856185 - RNA, 19 nt, Homo sapiens
caaauaauggagagaagaa

SEQ ID NO: 856186 - RNA, 19 nt, Homo sapiens
acaggaguauuuaaaguga

SEQ ID NO: 856187 - RNA, 19 nt, Homo sapiens
ugacaucacagaagacauu

SEQ ID NO: 856188 - RNA, 19 nt, Homo sapiens
agcauucacuggcuaauaa

SEQ ID NO: 856189 - RNA, 19 nt, Homo sapiens
gagacaagacccagagcua

SEQ ID NO: 856190 - RNA, 19 nt, Homo sapiens
ggagcaauaccuuucugua

SEQ ID NO: 856191 - RNA, 19 nt, Homo sapiens
uaauggaaauggugaucaa

SEQ ID NO: 856192 - RNA, 19 nt, Homo sapiens
uguaaguccucaucaaaug

SEQ ID NO: 856193 - RNA, 19 nt, Homo sapiens
ucacagcugguuugcaaua

SEQ ID NO: 856194 - RNA, 19 nt, Homo sapiens
gcaauuaaggcugcaaaga

SEQ ID NO: 856195 - RNA, 19 nt, Homo sapiens
cuuaaagacuguuagacaa

SEQ ID NO: 856196 - RNA, 19 nt, Homo sapiens
gcagaaagacaagaacaau

SEQ ID NO: 856197 - RNA, 19 nt, Homo sapiens
cgagcucucuuuacauugu

SEQ ID NO: 856198 - RNA, 19 nt, Homo sapiens
auacugagcaugucuuauu

SEQ ID NO: 856199 - RNA, 19 nt, Homo sapiens
ccucuacaaucucuucuug

SEQ ID NO: 856200 - RNA, 19 nt, Homo sapiens
aaacaagcacuuuggaaga

SEQ ID NO: 856201 - RNA, 19 nt, Homo sapiens
gaaagacaagaacaauuag

SEQ ID NO: 856202 - RNA, 19 nt, Homo sapiens
ugaaguuuaucauggaaga

SEQ ID NO: 856203 - RNA, 19 nt, Homo sapiens
cauauuugcucagacuuga

SEQ ID NO: 856204 - RNA, 19 nt, Homo sapiens
acacaggaguauuuaaagu

SEQ ID NO: 856205 - RNA, 19 nt, Homo sapiens
gcaaauaauggagagaaga

SEQ ID NO: 856206 - RNA, 19 nt, Homo sapiens
gaggucaagucauacaagu

SEQ ID NO: 856207 - RNA, 19 nt, Homo sapiens
guuuacaaccgugcaauua

SEQ ID NO: 856208 - RNA, 19 nt, Homo sapiens
cagcugguuugcaauaaau

SEQ ID NO: 856209 - RNA, 19 nt, Homo sapiens
uuucacagcugguuugcaa

SEQ ID NO: 856210 - RNA, 19 nt, Homo sapiens
ggauguuguugauggcaaa

SEQ ID NO: 856211 - RNA, 19 nt, Homo sapiens
caaugcuacuccugacaaa

SEQ ID NO: 856212 - RNA, 19 nt, Homo sapiens
cugcugacacucaucauua

SEQ ID NO: 856213 - RNA, 19 nt, Homo sapiens
cgguuucucuguuaucaaa

SEQ ID NO: 856214 - RNA, 19 nt, Homo sapiens
cagugaaacuaaagcaaau

SEQ ID NO: 856215 - RNA, 19 nt, Homo sapiens
ggucaagucauacaagugu

SEQ ID NO: 856216 - RNA, 19 nt, Homo sapiens
cagcugcuccucauauuug

SEQ ID NO: 856217 - RNA, 19 nt, Homo sapiens
gcagcugcuccucauauuu

SEQ ID NO: 856218 - RNA, 19 nt, Homo sapiens
cacuguggcugcauaaguu

SEQ ID NO: 856219 - RNA, 19 nt, Homo sapiens
acacuuugccugaauguga

SEQ ID NO: 856220 - RNA, 19 nt, Homo sapiens
ggaacacaggaguauuuaa

SEQ ID NO: 856221 - RNA, 19 nt, Homo sapiens
ccugagagauaguaaacug

SEQ ID NO: 856222 - RNA, 19 nt, Homo sapiens
ggaagaaugguuuaugaac

SEQ ID NO: 856223 - RNA, 19 nt, Homo sapiens
gacaaaccuuggcaugauc

SEQ ID NO: 856224 - RNA, 19 nt, Homo sapiens
caagugcugcucugacuga

SEQ ID NO: 856225 - RNA, 19 nt, Homo sapiens
aaccuuggcugauggaaau

SEQ ID NO: 856226 - RNA, 19 nt, Homo sapiens
gagcaauaccuuucuguac

SEQ ID NO: 856227 - RNA, 19 nt, Homo sapiens
cagaaagacaagaacaauu

SEQ ID NO: 856228 - RNA, 19 nt, Homo sapiens
aggaagcaccugagagaua

SEQ ID NO: 856229 - RNA, 19 nt, Homo sapiens
uggaaauggugaucaacaa

SEQ ID NO: 856230 - RNA, 19 nt, Homo sapiens
ucuacaaucucuucuugga

SEQ ID NO: 856231 - RNA, 19 nt, Homo sapiens
gacagauguucucaaagug

SEQ ID NO: 856232 - RNA, 19 nt, Homo sapiens
gaguuugugugcagcauca

SEQ ID NO: 856233 - RNA, 19 nt, Homo sapiens
cauggaagaacuugacaaa

SEQ ID NO: 856234 - RNA, 19 nt, Homo sapiens
gaguacguguucucggauu

SEQ ID NO: 856235 - RNA, 19 nt, Homo sapiens
auaguaaacugcagcaagu

SEQ ID NO: 856236 - RNA, 19 nt, Homo sapiens
gagaagaaugcccgacaga

SEQ ID NO: 856237 - RNA, 19 nt, Homo sapiens
uuacaaccgugcaauuaag

SEQ ID NO: 856238 - RNA, 19 nt, Homo sapiens
gacauuaauucagucacuu

SEQ ID NO: 856239 - RNA, 19 nt, Homo sapiens
gaagacauuaauucaguca

SEQ ID NO: 856240 - RNA, 19 nt, Homo sapiens
ggagcuggcuguggacaag

SEQ ID NO: 856241 - RNA, 19 nt, Homo sapiens
caucacagaagacauuaau

SEQ ID NO: 856242 - RNA, 19 nt, Homo sapiens
guacuugaagacaaagaaa

SEQ ID NO: 856243 - RNA, 19 nt, Homo sapiens
aauuaaggcugcaaagagu

SEQ ID NO: 856244 - RNA, 19 nt, Homo sapiens
caauuaaggcugcaaagag

SEQ ID NO: 856245 - RNA, 19 nt, Homo sapiens
gacaagaacaauuagucaa

SEQ ID NO: 856246 - RNA, 19 nt, Homo sapiens
gaucaagauggauguuguu

SEQ ID NO: 856247 - RNA, 19 nt, Homo sapiens
guacuggagaauauuaaga

SEQ ID NO: 856248 - RNA, 19 nt, Homo sapiens
ucuaaaggauauucacagu

SEQ ID NO: 856249 - RNA, 19 nt, Homo sapiens
cucgagcucucuuuacauu

SEQ ID NO: 856250 - RNA, 19 nt, Homo sapiens
auggaagaaugguuuauga

SEQ ID NO: 856251 - RNA, 19 nt, Homo sapiens
gaacugcucuugggaaguc

SEQ ID NO: 856252 - RNA, 19 nt, Homo sapiens
gcagaaacgccuacgugua

SEQ ID NO: 856253 - RNA, 19 nt, Homo sapiens
ggaaaccuuuggcuucuuc

SEQ ID NO: 856254 - RNA, 19 nt, Homo sapiens
gcacguuuguauuguguau

SEQ ID NO: 856255 - RNA, 19 nt, Homo sapiens
gaccugagcccgaggaaga

SEQ ID NO: 856256 - RNA, 19 nt, Homo sapiens
ccaacaccaucuucgagaa

SEQ ID NO: 856257 - RNA, 19 nt, Homo sapiens
caacaucacccgggacuuc

SEQ ID NO: 856258 - RNA, 19 nt, Homo sapiens
ggaacgucaucaccaccaa

SEQ ID NO: 856259 - RNA, 19 nt, Homo sapiens
gaaggcgacagcagcuuug

SEQ ID NO: 856260 - RNA, 19 nt, Homo sapiens
gcgcaggcuuagcucauuc

SEQ ID NO: 856261 - RNA, 19 nt, Homo sapiens
ucgcauaucuccccucuga

SEQ ID NO: 856262 - RNA, 19 nt, Homo sapiens
gcuuagcucauuccucuga

SEQ ID NO: 856263 - RNA, 19 nt, Homo sapiens
gcucuugggaagucgcaua

SEQ ID NO: 856264 - RNA, 19 nt, Homo sapiens
ggcccucucuggguauauu

SEQ ID NO: 856265 - RNA, 19 nt, Homo sapiens
gcgccucacugaucuccau

SEQ ID NO: 856266 - RNA, 19 nt, Homo sapiens
guggaaaccuuuggcuucu

SEQ ID NO: 856267 - RNA, 19 nt, Homo sapiens
cgauggcuguggaaaccuu

SEQ ID NO: 856268 - RNA, 19 nt, Homo sapiens
agaaggcgacagcagcuuu

SEQ ID NO: 856269 - RNA, 19 nt, Homo sapiens
guggagcgccucacugauc

SEQ ID NO: 856270 - RNA, 19 nt, Homo sapiens
gcaggagggaggcagaaag

SEQ ID NO: 856271 - RNA, 19 nt, Homo sapiens
ccgcacguuuguauugugu

SEQ ID NO: 856272 - RNA, 19 nt, Homo sapiens
cuugggaagucgcauaucu

SEQ ID NO: 856273 - RNA, 19 nt, Homo sapiens
ggcagaggcugaggcugau

SEQ ID NO: 856274 - RNA, 19 nt, Homo sapiens
gggugacucugccaaacag

SEQ ID NO: 856275 - RNA, 19 nt, Homo sapiens
ugacucugccaaacagcua

SEQ ID NO: 856276 - RNA, 19 nt, Homo sapiens
cuggaucccucaucuucug

SEQ ID NO: 856277 - RNA, 19 nt, Homo sapiens
ggcuggaucccucaucuuc

SEQ ID NO: 856278 - RNA, 19 nt, Homo sapiens
aagcagagagacccacaga

SEQ ID NO: 856279 - RNA, 19 nt, Homo sapiens
ugguacgccuucaacauca

SEQ ID NO: 856280 - RNA, 19 nt, Homo sapiens
ccaccaacaccaucuucga

SEQ ID NO: 856281 - RNA, 19 nt, Homo sapiens
gagcaggagggaggcagaa

SEQ ID NO: 856282 - RNA, 19 nt, Homo sapiens
ggagggacuucgaagauaa

SEQ ID NO: 856283 - RNA, 19 nt, Homo sapiens
gaaacccugucucuacuaa

SEQ ID NO: 856284 - RNA, 19 nt, Homo sapiens
ggaggcgucuugcaaguug

SEQ ID NO: 856285 - RNA, 19 nt, Homo sapiens
gggagggacuucgaagaua

SEQ ID NO: 856286 - RNA, 19 nt, Homo sapiens
caucuaaucuccucuccaa

SEQ ID NO: 856287 - RNA, 19 nt, Homo sapiens
ggaaaccuuuggcuucuuc

SEQ ID NO: 856288 - RNA, 19 nt, Homo sapiens
gaagggaggcgucuugcaa

SEQ ID NO: 856289 - RNA, 19 nt, Homo sapiens
gaccugagcccgaggaaga

SEQ ID NO: 856290 - RNA, 19 nt, Homo sapiens
guaaggaggcggugugugu

SEQ ID NO: 856291 - RNA, 19 nt, Homo sapiens
ugagguggguggauuacuu

SEQ ID NO: 856292 - RNA, 19 nt, Homo sapiens
caucggcaguguuucuuga

SEQ ID NO: 856293 - RNA, 19 nt, Homo sapiens
ccaacaccaucuucgagaa

SEQ ID NO: 856294 - RNA, 19 nt, Homo sapiens
gaguuagggugcacgcuau

SEQ ID NO: 856295 - RNA, 19 nt, Homo sapiens
ggacuucgaagauaagagu

SEQ ID NO: 856296 - RNA, 19 nt, Homo sapiens
uccgggagcuuacauccua

SEQ ID NO: 856297 - RNA, 19 nt, Homo sapiens
cuaaucuccucuccaauuc

SEQ ID NO: 856298 - RNA, 19 nt, Homo sapiens
ucuaaucuccucuccaauu

SEQ ID NO: 856299 - RNA, 19 nt, Homo sapiens
ggugaaacccugucucuac

SEQ ID NO: 856300 - RNA, 19 nt, Homo sapiens
ggaacgucaucaccaccaa

SEQ ID NO: 856301 - RNA, 19 nt, Homo sapiens
cggcugaugucuauaaagg

SEQ ID NO: 856302 - RNA, 19 nt, Homo sapiens
ccaauucccacuccucaug

SEQ ID NO: 856303 - RNA, 19 nt, Homo sapiens
gcuuuguccucaucuaauc

SEQ ID NO: 856304 - RNA, 19 nt, Homo sapiens
gugaaacccugucucuacu

SEQ ID NO: 856305 - RNA, 19 nt, Homo sapiens
cagaucuccuggcugcaaa

SEQ ID NO: 856306 - RNA, 19 nt, Homo sapiens
ccuguaaucccagcacuuu

SEQ ID NO: 856307 - RNA, 19 nt, Homo sapiens
gagguggguggauuacuug

SEQ ID NO: 856308 - RNA, 19 nt, Homo sapiens
guggaaaccuuuggcuucu

SEQ ID NO: 856309 - RNA, 19 nt, Homo sapiens
cgauggcuguggaaaccuu

SEQ ID NO: 856310 - RNA, 19 nt, Homo sapiens
cagcccaucggcaguguuu

SEQ ID NO: 856311 - RNA, 19 nt, Homo sapiens
gcugcuuuguccucaucua

SEQ ID NO: 856312 - RNA, 19 nt, Homo sapiens
gggcacuggucuccuuguc

SEQ ID NO: 856313 - RNA, 19 nt, Homo sapiens
ugaaacccugucucuacua

SEQ ID NO: 856314 - RNA, 19 nt, Homo sapiens
aggcugagguggguggauu

SEQ ID NO: 856315 - RNA, 19 nt, Homo sapiens
guccggcugaugucuauaa

SEQ ID NO: 856316 - RNA, 19 nt, Homo sapiens
ggcagaggcugaggcugau

SEQ ID NO: 856317 - RNA, 19 nt, Homo sapiens
gggugacucugccaaacag

SEQ ID NO: 856318 - RNA, 19 nt, Homo sapiens
ugacucugccaaacagcua

SEQ ID NO: 856319 - RNA, 19 nt, Homo sapiens
ccaccaacaccaucuucga

SEQ ID NO: 856320 - RNA, 19 nt, Homo sapiens
gggaggcgucuugcaaguu

SEQ ID NO: 856321 - RNA, 19 nt, Homo sapiens
gaauuuaccuucucuguau

SEQ ID NO: 856322 - RNA, 19 nt, Homo sapiens
cugcagaccuugacaauuu

SEQ ID NO: 856323 - RNA, 19 nt, Homo sapiens
gagcagggcugugacauug

SEQ ID NO: 856324 - RNA, 19 nt, Homo sapiens
gcacuaagucaaauaauga

SEQ ID NO: 856325 - RNA, 19 nt, Homo sapiens
gcgaggcccugucuuacua

SEQ ID NO: 856326 - RNA, 19 nt, Homo sapiens
cauaaagugugguguaaau

SEQ ID NO: 856327 - RNA, 19 nt, Homo sapiens
caauuugccugacucauuc

SEQ ID NO: 856328 - RNA, 19 nt, Homo sapiens
gcaugugggacaaguauaa

SEQ ID NO: 856329 - RNA, 19 nt, Homo sapiens
ggcgagaaguguaacauuc

SEQ ID NO: 856330 - RNA, 19 nt, Homo sapiens
ggucagcuguaugcacuaa

SEQ ID NO: 856331 - RNA, 19 nt, Homo sapiens
uaccuucucuguauauaug

SEQ ID NO: 856332 - RNA, 19 nt, Homo sapiens
caacuucgaccggcucgua

SEQ ID NO: 856333 - RNA, 19 nt, Homo sapiens
ccaaccgacuggcccguuu

SEQ ID NO: 856334 - RNA, 19 nt, Homo sapiens
acaauuugccugacucauu

SEQ ID NO: 856335 - RNA, 19 nt, Homo sapiens
ggagcagggcugugacauu

SEQ ID NO: 856336 - RNA, 19 nt, Homo sapiens
gugcauaaaguguggugua

SEQ ID NO: 856337 - RNA, 19 nt, Homo sapiens
gauguucaccagaaggaaa

SEQ ID NO: 856338 - RNA, 19 nt, Homo sapiens
acgaugauguucaccagaa

SEQ ID NO: 856339 - RNA, 19 nt, Homo sapiens
acucauuccugaccucuug

SEQ ID NO: 856340 - RNA, 19 nt, Homo sapiens
ggucugggacuuaguguca

SEQ ID NO: 856341 - RNA, 19 nt, Homo sapiens
ugacaacgaugauguucac

SEQ ID NO: 856342 - RNA, 19 nt, Homo sapiens
ugcauaaagugugguguaa

SEQ ID NO: 856343 - RNA, 19 nt, Homo sapiens
acaauggaccgacuuaauc

SEQ ID NO: 856344 - RNA, 19 nt, Homo sapiens
ggagcugguggaccuagua

SEQ ID NO: 856345 - RNA, 19 nt, Homo sapiens
gcauaaagugugguguaaa

SEQ ID NO: 856346 - RNA, 19 nt, Homo sapiens
ugcacuaagucaaauaaug

SEQ ID NO: 856347 - RNA, 19 nt, Homo sapiens
gauuggauccgaagaaacu

SEQ ID NO: 856348 - RNA, 19 nt, Homo sapiens
gaacucaccgaggcgagaa

SEQ ID NO: 856349 - RNA, 19 nt, Homo sapiens
gcaggcaugugggacaagu

SEQ ID NO: 856350 - RNA, 19 nt, Homo sapiens
guacaauggaccgacuuaa

SEQ ID NO: 856351 - RNA, 19 nt, Homo sapiens
cguuugagccguugagcua

SEQ ID NO: 856352 - RNA, 19 nt, Homo sapiens
gcugguggaccuaguacaa

SEQ ID NO: 856353 - RNA, 19 nt, Homo sapiens
uggaccgacuuaauccuuu

SEQ ID NO: 856354 - RNA, 19 nt, Homo sapiens
gcucguaagcaaccucuuc

SEQ ID NO: 856355 - RNA, 19 nt, Homo sapiens
ggaccgacuuaauccuuuu

SEQ ID NO: 856356 - RNA, 19 nt, Homo sapiens
ucagcuguaugcacuaagu

SEQ ID NO: 856357 - RNA, 19 nt, Homo sapiens
gcagucagugugcguguuc

SEQ ID NO: 856358 - RNA, 19 nt, Homo sapiens
gcaucaacccggagcagau

SEQ ID NO: 856359 - RNA, 19 nt, Homo sapiens
uacaauggaccgacuuaau

SEQ ID NO: 856360 - RNA, 19 nt, Homo sapiens
ccuguguucucccuuuguu

SEQ ID NO: 856361 - RNA, 19 nt, Homo sapiens
ggcccugucuuacuaucug

SEQ ID NO: 856362 - RNA, 19 nt, Homo sapiens
caucaacccggagcagauu

SEQ ID NO: 856363 - RNA, 19 nt, Homo sapiens
guaugcacuaagucaaaua

SEQ ID NO: 856364 - RNA, 19 nt, Homo sapiens
gagaugcaccccauucuug

SEQ ID NO: 856365 - RNA, 19 nt, Homo sapiens
ccacgcuguuuccuuucaa

SEQ ID NO: 856366 - RNA, 19 nt, Homo sapiens
gcggcucccugaaaacuuu

SEQ ID NO: 856367 - RNA, 19 nt, Homo sapiens
ccacccagcuuauaaaagg

SEQ ID NO: 856368 - RNA, 19 nt, Homo sapiens
ugguggaccuaguacaaug

SEQ ID NO: 856369 - RNA, 19 nt, Homo sapiens
cuuccuguguucucccuuu

SEQ ID NO: 856370 - RNA, 19 nt, Homo sapiens
uagcaggcaugugggacaa

SEQ ID NO: 856371 - RNA, 19 nt, Homo sapiens
uguaugcacuaagucaaau

SEQ ID NO: 856372 - RNA, 19 nt, Homo sapiens
aaauucagggucagcugua

SEQ ID NO: 856373 - RNA, 19 nt, Homo sapiens
guauaacgagccgcuguug

SEQ ID NO: 856374 - RNA, 19 nt, Homo sapiens
ugcagaccuugacaauuug

SEQ ID NO: 856375 - RNA, 19 nt, Homo sapiens
aucccacgcuguuuccuuu

SEQ ID NO: 856376 - RNA, 19 nt, Homo sapiens
ggaaagcccucgagcaugu

SEQ ID NO: 856377 - RNA, 19 nt, Homo sapiens
cgagaaagaugaugaggaa

SEQ ID NO: 856378 - RNA, 19 nt, Homo sapiens
caaaugacccuguggauga

SEQ ID NO: 856379 - RNA, 19 nt, Homo sapiens
gcuguguccuccuucauua

SEQ ID NO: 856380 - RNA, 19 nt, Homo sapiens
agaaggagaugauggagaa

SEQ ID NO: 856381 - RNA, 19 nt, Homo sapiens
ggaagaaccugaagaugcu

SEQ ID NO: 856382 - RNA, 19 nt, Homo sapiens
ggauuuaaauuccaugauc

SEQ ID NO: 856383 - RNA, 19 nt, Homo sapiens
gggagaacauuccuacaga

SEQ ID NO: 856384 - RNA, 19 nt, Homo sapiens
gcucggaaccuuaucauga

SEQ ID NO: 856385 - RNA, 19 nt, Homo sapiens
agagaaauaucguauggaa

SEQ ID NO: 856386 - RNA, 19 nt, Homo sapiens
ugaagaacaucgcaaauac

SEQ ID NO: 856387 - RNA, 19 nt, Homo sapiens
gagaagauugggcagcuua

SEQ ID NO: 856388 - RNA, 19 nt, Homo sapiens
gcaaagggagaaagaagaa

SEQ ID NO: 856389 - RNA, 19 nt, Homo sapiens
ccaauuacgaugaguuuaa

SEQ ID NO: 856390 - RNA, 19 nt, Homo sapiens
ggaggaugcugacaguugu

SEQ ID NO: 856391 - RNA, 19 nt, Homo sapiens
ggagaaagaagaaauagag

SEQ ID NO: 856392 - RNA, 19 nt, Homo sapiens
uggcaaggcuggagaccua

SEQ ID NO: 856393 - RNA, 19 nt, Homo sapiens
ggacauucgugcaaagaag

SEQ ID NO: 856394 - RNA, 19 nt, Homo sapiens
gaaagaugaugaggaagca

SEQ ID NO: 856395 - RNA, 19 nt, Homo sapiens
ggaacacucugauggacau

SEQ ID NO: 856396 - RNA, 19 nt, Homo sapiens
gaaguuggcagaagucaca

SEQ ID NO: 856397 - RNA, 19 nt, Homo sapiens
ccaaggacaucgccaacug

SEQ ID NO: 856398 - RNA, 19 nt, Homo sapiens
ugaagaugcuagaaucaug

SEQ ID NO: 856399 - RNA, 19 nt, Homo sapiens
acaaguagcucggaaccuu

SEQ ID NO: 856400 - RNA, 19 nt, Homo sapiens
gagcguggaugcccugaag

SEQ ID NO: 856401 - RNA, 19 nt, Homo sapiens
aaacggacauucgugcaaa

SEQ ID NO: 856402 - RNA, 19 nt, Homo sapiens
uaaaugacaccaauuacga

SEQ ID NO: 856403 - RNA, 19 nt, Homo sapiens
ggaaaagucucgucugaag

SEQ ID NO: 856404 - RNA, 19 nt, Homo sapiens
acacgcagaugguggagaa

SEQ ID NO: 856405 - RNA, 19 nt, Homo sapiens
ggaaugacgccaggacuga

SEQ ID NO: 856406 - RNA, 19 nt, Homo sapiens
uggcagaagucacagaaga

SEQ ID NO: 856407 - RNA, 19 nt, Homo sapiens
gauggaggaugcugacagu

SEQ ID NO: 856408 - RNA, 19 nt, Homo sapiens
aaggcuaccugacggauuu

SEQ ID NO: 856409 - RNA, 19 nt, Homo sapiens
aaggauggaugaaagaaga

SEQ ID NO: 856410 - RNA, 19 nt, Homo sapiens
ggaucuaaaugacaccaau

SEQ ID NO: 856411 - RNA, 19 nt, Homo sapiens
gaagaacaucgcaaauaca

SEQ ID NO: 856412 - RNA, 19 nt, Homo sapiens
ggaggaagaucggaagcau

SEQ ID NO: 856413 - RNA, 19 nt, Homo sapiens
gggagccucuucucaagug

SEQ ID NO: 856414 - RNA, 19 nt, Homo sapiens
ccaccgcacugugaagauu

SEQ ID NO: 856415 - RNA, 19 nt, Homo sapiens
cgucaugcgugccgugauu

SEQ ID NO: 856416 - RNA, 19 nt, Homo sapiens
gaaacggacauucgugcaa

SEQ ID NO: 856417 - RNA, 19 nt, Homo sapiens
caaguagcucggaaccuua

SEQ ID NO: 856418 - RNA, 19 nt, Homo sapiens
caaguggacccuacgagaa

SEQ ID NO: 856419 - RNA, 19 nt, Homo sapiens
caggugagcuggacaugag

SEQ ID NO: 856420 - RNA, 19 nt, Homo sapiens
gaggaagaucggaagcaua

SEQ ID NO: 856421 - RNA, 19 nt, Homo sapiens
agaagucacugggaagcua

SEQ ID NO: 856422 - RNA, 19 nt, Homo sapiens
gagagaaccauaccucagu

SEQ ID NO: 856423 - RNA, 19 nt, Homo sapiens
gaagaagaaaccguuccua

SEQ ID NO: 856424 - RNA, 19 nt, Homo sapiens
ugaagaagugugagcauga

SEQ ID NO: 856425 - RNA, 19 nt, Homo sapiens
cugaagaacaucgcaaaua

SEQ ID NO: 856426 - RNA, 19 nt, Homo sapiens
gagcuggacaugaggaaga

SEQ ID NO: 856427 - RNA, 19 nt, Homo sapiens
gagaaagaagaaauagaga

SEQ ID NO: 856428 - RNA, 19 nt, Homo sapiens
gaagaagugugagcaugac

SEQ ID NO: 856429 - RNA, 19 nt, Homo sapiens
cccaagcuguggaugauga

SEQ ID NO: 856430 - RNA, 19 nt, Homo sapiens
gagcaaagggagaaagaag

SEQ ID NO: 856431 - RNA, 19 nt, Homo sapiens
aaagaaagacgggagcaaa

SEQ ID NO: 856432 - RNA, 19 nt, Homo sapiens
cgacgaggaucuaaaugac

SEQ ID NO: 856433 - RNA, 19 nt, Homo sapiens
gaucuaaaugacaccaauu

SEQ ID NO: 856434 - RNA, 19 nt, Homo sapiens
uggaugcccugaagaagug

SEQ ID NO: 856435 - RNA, 19 nt, Homo sapiens
caucgcaaauacacucaug

SEQ ID NO: 856436 - RNA, 19 nt, Homo sapiens
caaacucgguucgcuugug

SEQ ID NO: 856437 - RNA, 19 nt, Homo sapiens
gaaccauaccucaguggau

SEQ ID NO: 856438 - RNA, 19 nt, Homo sapiens
ggagaagauugggcagcuu

SEQ ID NO: 856439 - RNA, 19 nt, Homo sapiens
auagagaaauaucguaugg

SEQ ID NO: 856440 - RNA, 19 nt, Homo sapiens
ugucaggauuuacaucaga

SEQ ID NO: 856441 - RNA, 19 nt, Homo sapiens
gaacccacgcuaugagaag

SEQ ID NO: 856442 - RNA, 19 nt, Homo sapiens
gcugggagccucuucucaa

SEQ ID NO: 856443 - RNA, 19 nt, Homo sapiens
ggacgucgaagccuagagu

SEQ ID NO: 856444 - RNA, 19 nt, Homo sapiens
gaagcuggaguccgagaau

SEQ ID NO: 856445 - RNA, 19 nt, Homo sapiens
ugauugggauugggauuga

SEQ ID NO: 856446 - RNA, 19 nt, Homo sapiens
ccaacgguguggagaucaa

SEQ ID NO: 856447 - RNA, 19 nt, Homo sapiens
ugacgacgaggaucuaaau

SEQ ID NO: 856448 - RNA, 19 nt, Homo sapiens
agaggaaguuggcagaagu

SEQ ID NO: 856449 - RNA, 19 nt, Homo sapiens
ccaacuggcagaagaagau

SEQ ID NO: 856450 - RNA, 19 nt, Homo sapiens
ugacaccaauuacgaugag

SEQ ID NO: 856451 - RNA, 19 nt, Homo sapiens
ccaugaacaagaagaagaa

SEQ ID NO: 856452 - RNA, 19 nt, Homo sapiens
cucggaaccuuaucaugaa

SEQ ID NO: 856453 - RNA, 19 nt, Homo sapiens
ggaacccacgcuaugagaa

SEQ ID NO: 856454 - RNA, 19 nt, Homo sapiens
gcaguucucagaccucaag

SEQ ID NO: 856455 - RNA, 19 nt, Homo sapiens
ccgccaccaugaacaagaa

SEQ ID NO: 856456 - RNA, 19 nt, Homo sapiens
gcuggaagaaccugaagau

SEQ ID NO: 856457 - RNA, 19 nt, Homo sapiens
caccaauuacgaugaguuu

SEQ ID NO: 856458 - RNA, 19 nt, Homo sapiens
ugacggauuuaaauuccau

SEQ ID NO: 856459 - RNA, 19 nt, Homo sapiens
caagcgaggaacacucuga

SEQ ID NO: 856460 - RNA, 19 nt, Homo sapiens
ggucuuaacacacccuauc

SEQ ID NO: 856461 - RNA, 19 nt, Homo sapiens
caauuuggaggucuuaaca

SEQ ID NO: 856462 - RNA, 19 nt, Homo sapiens
gauaaaaggauggaugaaa

SEQ ID NO: 856463 - RNA, 19 nt, Homo sapiens
ggccuucuucuacaaguuu

SEQ ID NO: 856464 - RNA, 19 nt, Homo sapiens
uggagugggugcaagacaa

SEQ ID NO: 856465 - RNA, 19 nt, Homo sapiens
ggacuaaacacuccauacc

SEQ ID NO: 856466 - RNA, 19 nt, Homo sapiens
ggcagaagucacagaagaa

SEQ ID NO: 856467 - RNA, 19 nt, Homo sapiens
gggagaaagaagaaauaga

SEQ ID NO: 856468 - RNA, 19 nt, Homo sapiens
gacccuacgagaaagauga

SEQ ID NO: 856469 - RNA, 19 nt, Homo sapiens
ccacaaugcccuggagugu

SEQ ID NO: 856470 - RNA, 19 nt, Homo sapiens
ggccaacgguguggagauc

SEQ ID NO: 856471 - RNA, 19 nt, Homo sapiens
ucgguucgcuuguggaaag

SEQ ID NO: 856472 - RNA, 19 nt, Homo sapiens
acacggaggagacaucaau

SEQ ID NO: 856473 - RNA, 19 nt, Homo sapiens
cgaggaacacucugaugga

SEQ ID NO: 856474 - RNA, 19 nt, Homo sapiens
gcagaagucacagaagaag

SEQ ID NO: 856475 - RNA, 19 nt, Homo sapiens
gggagcaaagggagaaaga

SEQ ID NO: 856476 - RNA, 19 nt, Homo sapiens
gaacgaaacucaccuaauc

SEQ ID NO: 856477 - RNA, 19 nt, Homo sapiens
gcucagaucuugggaauua

SEQ ID NO: 856478 - RNA, 19 nt, Homo sapiens
gaaaagagcuuaaggauca

SEQ ID NO: 856479 - RNA, 19 nt, Homo sapiens
gaaaucagaugcccagaug

SEQ ID NO: 856480 - RNA, 19 nt, Homo sapiens
gaagaucucugaaacuugu

SEQ ID NO: 856481 - RNA, 19 nt, Homo sapiens
ccagaaagcuugcugaaau

SEQ ID NO: 856482 - RNA, 19 nt, Homo sapiens
caaagaaucucagaaguug

SEQ ID NO: 856483 - RNA, 19 nt, Homo sapiens
ggagaaggauggccacaaa

SEQ ID NO: 856484 - RNA, 19 nt, Homo sapiens
gcaaguagaugaugacagu

SEQ ID NO: 856485 - RNA, 19 nt, Homo sapiens
gcaaggaguuucaguuguu

SEQ ID NO: 856486 - RNA, 19 nt, Homo sapiens
gggaagaggugauucuaaa

SEQ ID NO: 856487 - RNA, 19 nt, Homo sapiens
gaagcuaggucuuuacuca

SEQ ID NO: 856488 - RNA, 19 nt, Homo sapiens
gaagugaaacuccaaguaa

SEQ ID NO: 856489 - RNA, 19 nt, Homo sapiens
gagcuaaagcgcaaacuua

SEQ ID NO: 856490 - RNA, 19 nt, Homo sapiens
gggaugaccugacugauga

SEQ ID NO: 856491 - RNA, 19 nt, Homo sapiens
ucacucauaugcacaauaa

SEQ ID NO: 856492 - RNA, 19 nt, Homo sapiens
caaaguggcucagaucuug

SEQ ID NO: 856493 - RNA, 19 nt, Homo sapiens
gaaauggucaguuguagaa

SEQ ID NO: 856494 - RNA, 19 nt, Homo sapiens
ggauaugccuguugauuuc

SEQ ID NO: 856495 - RNA, 19 nt, Homo sapiens
aaacagcccuccauuccua

SEQ ID NO: 856496 - RNA, 19 nt, Homo sapiens
gaauaaauaccuagagcua

SEQ ID NO: 856497 - RNA, 19 nt, Homo sapiens
gcaaagaaucucagaaguu

SEQ ID NO: 856498 - RNA, 19 nt, Homo sapiens
gaagagauucuagaaagua

SEQ ID NO: 856499 - RNA, 19 nt, Homo sapiens
ccaaguaucucuaaagaag

SEQ ID NO: 856500 - RNA, 19 nt, Homo sapiens
cuaacuggcucaccacaua

SEQ ID NO: 856501 - RNA, 19 nt, Homo sapiens
gguuaaagcuccaguguca

SEQ ID NO: 856502 - RNA, 19 nt, Homo sapiens
ggacaaagaggauggcaaa

SEQ ID NO: 856503 - RNA, 19 nt, Homo sapiens
ccaugcagcuugagaguuu

SEQ ID NO: 856504 - RNA, 19 nt, Homo sapiens
gagaaaugcugcgcaagaa

SEQ ID NO: 856505 - RNA, 19 nt, Homo sapiens
ggauugagguggacauaau

SEQ ID NO: 856506 - RNA, 19 nt, Homo sapiens
caagaaauauguggaugaa

SEQ ID NO: 856507 - RNA, 19 nt, Homo sapiens
cagcugaccucuccaguug

SEQ ID NO: 856508 - RNA, 19 nt, Homo sapiens
aaagugagauagagacaaa

SEQ ID NO: 856509 - RNA, 19 nt, Homo sapiens
caacagaccuugggcuuca

SEQ ID NO: 856510 - RNA, 19 nt, Homo sapiens
guacagaagucucaaacuc

SEQ ID NO: 856511 - RNA, 19 nt, Homo sapiens
uagcagagauuagucaauu

SEQ ID NO: 856512 - RNA, 19 nt, Homo sapiens
gauauacagugcaaagaau

SEQ ID NO: 856513 - RNA, 19 nt, Homo sapiens
gaaggaaucaccaacauca

SEQ ID NO: 856514 - RNA, 19 nt, Homo sapiens
gaaggacauugcagagcua

SEQ ID NO: 856515 - RNA, 19 nt, Homo sapiens
caagggagcagguaauuga

SEQ ID NO: 856516 - RNA, 19 nt, Homo sapiens
gaacacaccaggcccuuga

SEQ ID NO: 856517 - RNA, 19 nt, Homo sapiens
cagaucagcuauguguuua

SEQ ID NO: 856518 - RNA, 19 nt, Homo sapiens
caaaggaggagaagaaaga

SEQ ID NO: 856519 - RNA, 19 nt, Homo sapiens
ugagucggcuucaggauaa

SEQ ID NO: 856520 - RNA, 19 nt, Homo sapiens
caaagcaggccuuaugaaa

SEQ ID NO: 856521 - RNA, 19 nt, Homo sapiens
ggcaaaggcugugaaagaa

SEQ ID NO: 856522 - RNA, 19 nt, Homo sapiens
aaagcgcacugacaagaua

SEQ ID NO: 856523 - RNA, 19 nt, Homo sapiens
caagcaagaugccauaaag

SEQ ID NO: 856524 - RNA, 19 nt, Homo sapiens
aaugaccacuucuguguua

SEQ ID NO: 856525 - RNA, 19 nt, Homo sapiens
caaggaguuucaguuguua

SEQ ID NO: 856526 - RNA, 19 nt, Homo sapiens
ggaagugaaacuccaagua

SEQ ID NO: 856527 - RNA, 19 nt, Homo sapiens
gccaagagcuccguaaauc

SEQ ID NO: 856528 - RNA, 19 nt, Homo sapiens
uagaagaucucugaaacuu

SEQ ID NO: 856529 - RNA, 19 nt, Homo sapiens
ggaaauaaacauggaagaa

SEQ ID NO: 856530 - RNA, 19 nt, Homo sapiens
ccagacaaaucgauaacaa

SEQ ID NO: 856531 - RNA, 19 nt, Homo sapiens
gcaaggcccuagaagacuu

SEQ ID NO: 856532 - RNA, 19 nt, Homo sapiens
gacaaacacugaacuaaaa

SEQ ID NO: 856533 - RNA, 19 nt, Homo sapiens
ucagacaccucuucuacuu

SEQ ID NO: 856534 - RNA, 19 nt, Homo sapiens
gcuaaguggugguccauug

SEQ ID NO: 856535 - RNA, 19 nt, Homo sapiens
gaaauuagaagaccaacuc

SEQ ID NO: 856536 - RNA, 19 nt, Homo sapiens
gcgcaaacuuagugagaaa

SEQ ID NO: 856537 - RNA, 19 nt, Homo sapiens
gaugaggacuaccgaacaa

SEQ ID NO: 856538 - RNA, 19 nt, Homo sapiens
gcaaugaccacuucugugu

SEQ ID NO: 856539 - RNA, 19 nt, Homo sapiens
gugaguagcucuuuuguuu

SEQ ID NO: 856540 - RNA, 19 nt, Homo sapiens
gcugaacaguccaauaaau

SEQ ID NO: 856541 - RNA, 19 nt, Homo sapiens
cagcccaacuugcuaauga

SEQ ID NO: 856542 - RNA, 19 nt, Homo sapiens
ccaagggccucucaguuug

SEQ ID NO: 856543 - RNA, 19 nt, Homo sapiens
gaagagaccaauccagaau

SEQ ID NO: 856544 - RNA, 19 nt, Homo sapiens
gaaccuacaccaagagaug

SEQ ID NO: 856545 - RNA, 19 nt, Homo sapiens
gaaagugugugaagaaaau

SEQ ID NO: 856546 - RNA, 19 nt, Homo sapiens
gaaauccaccucagagaau

SEQ ID NO: 856547 - RNA, 19 nt, Homo sapiens
gcacauaccagcccuugga

SEQ ID NO: 856548 - RNA, 19 nt, Homo sapiens
ggagaaaugcugcgcaaga

SEQ ID NO: 856549 - RNA, 19 nt, Homo sapiens
gaacggcgacggcuuagug

SEQ ID NO: 856550 - RNA, 19 nt, Homo sapiens
cuuugaagcuacagacuua

SEQ ID NO: 856551 - RNA, 19 nt, Homo sapiens
gacagacacuuuggccaua

SEQ ID NO: 856552 - RNA, 19 nt, Homo sapiens
caaccucucuagaaccaaa

SEQ ID NO: 856553 - RNA, 19 nt, Homo sapiens
gccaagggccucucaguuu

SEQ ID NO: 856554 - RNA, 19 nt, Homo sapiens
ggaugaagaagaggauuua

SEQ ID NO: 856555 - RNA, 19 nt, Homo sapiens
ccacaaggauaauuuggau

SEQ ID NO: 856556 - RNA, 19 nt, Homo sapiens
gcaucgaucugauuauagu

SEQ ID NO: 856557 - RNA, 19 nt, Homo sapiens
ggucuugagcgauauauuu

SEQ ID NO: 856558 - RNA, 19 nt, Homo sapiens
gguagaagaucucugaaac

SEQ ID NO: 856559 - RNA, 19 nt, Homo sapiens
ccaacugucuugugucaga

SEQ ID NO: 856560 - RNA, 19 nt, Homo sapiens
gcacauagauccccaacug

SEQ ID NO: 856561 - RNA, 19 nt, Homo sapiens
gggauaugccuguugauuu

SEQ ID NO: 856562 - RNA, 19 nt, Homo sapiens
gagcaaggaguuucaguug

SEQ ID NO: 856563 - RNA, 19 nt, Homo sapiens
caaguaaaguagugaucaa

SEQ ID NO: 856564 - RNA, 19 nt, Homo sapiens
gauauaauccagagaagau

SEQ ID NO: 856565 - RNA, 19 nt, Homo sapiens
agaagaagcccaaguccua

SEQ ID NO: 856566 - RNA, 19 nt, Homo sapiens
aaacccauauguauccuuu

SEQ ID NO: 856567 - RNA, 19 nt, Homo sapiens
gaguuucaguuguuaguga

SEQ ID NO: 856568 - RNA, 19 nt, Homo sapiens
ccaacuugcuaaugauuga

SEQ ID NO: 856569 - RNA, 19 nt, Homo sapiens
caaaggcugugaaagaagu

SEQ ID NO: 856570 - RNA, 19 nt, Homo sapiens
ccacuaagcaguuggauca

SEQ ID NO: 856571 - RNA, 19 nt, Homo sapiens
gagaugcauuguccugcua

SEQ ID NO: 856572 - RNA, 19 nt, Homo sapiens
ggaugggccugccuuaaca

SEQ ID NO: 856573 - RNA, 19 nt, Homo sapiens
aaauuuaccuccuuuccuu

SEQ ID NO: 856574 - RNA, 19 nt, Homo sapiens
gaccauguuugauuucuuc

SEQ ID NO: 856575 - RNA, 19 nt, Homo sapiens
aaucugaacuggacaaagu

SEQ ID NO: 856576 - RNA, 19 nt, Homo sapiens
uauaauagcugccuucaaa

SEQ ID NO: 856577 - RNA, 19 nt, Homo sapiens
ucacgcaucucuugaauug

SEQ ID NO: 856578 - RNA, 19 nt, Homo sapiens
ccaaaucucuccugcugaa

SEQ ID NO: 856579 - RNA, 19 nt, Homo sapiens
gagaggagccuugcuguuu

SEQ ID NO: 856580 - RNA, 19 nt, Homo sapiens
gagccuugcuguuuccaaa

SEQ ID NO: 856581 - RNA, 19 nt, Homo sapiens
ccucagauuggauaaauua

SEQ ID NO: 856582 - RNA, 19 nt, Homo sapiens
guaaggcucuguucauuuu

SEQ ID NO: 856583 - RNA, 19 nt, Homo sapiens
ggacaucucucuggagcau

SEQ ID NO: 856584 - RNA, 19 nt, Homo sapiens
guuaaguacugcacgacua

SEQ ID NO: 856585 - RNA, 19 nt, Homo sapiens
uaacugucguuuguccuua

SEQ ID NO: 856586 - RNA, 19 nt, Homo sapiens
caugagcguguuuauaaua

SEQ ID NO: 856587 - RNA, 19 nt, Homo sapiens
guucgaaguuugauaccuu

SEQ ID NO: 856588 - RNA, 19 nt, Homo sapiens
uaauagcugccuucaaauu

SEQ ID NO: 856589 - RNA, 19 nt, Homo sapiens
cgucagacuuucuccaaga

SEQ ID NO: 856590 - RNA, 19 nt, Homo sapiens
cgacuacucgcuucugaaa

SEQ ID NO: 856591 - RNA, 19 nt, Homo sapiens
gcaguucucaggccucuug

SEQ ID NO: 856592 - RNA, 19 nt, Homo sapiens
gauggcuacugccugcuuu

SEQ ID NO: 856593 - RNA, 19 nt, Homo sapiens
cucaugagcguguuuauaa

SEQ ID NO: 856594 - RNA, 19 nt, Homo sapiens
guuugcagcuguuaguuau

SEQ ID NO: 856595 - RNA, 19 nt, Homo sapiens
gacuacaacucccaguaug

SEQ ID NO: 856596 - RNA, 19 nt, Homo sapiens
gagacuacaacucccagua

SEQ ID NO: 856597 - RNA, 19 nt, Homo sapiens
agucaucugccuuuaauaa

SEQ ID NO: 856598 - RNA, 19 nt, Homo sapiens
caacccaucuaauucuucu

SEQ ID NO: 856599 - RNA, 19 nt, Homo sapiens
gcaauauggccuugguaug

SEQ ID NO: 856600 - RNA, 19 nt, Homo sapiens
guccuuaacgucagacuuu

SEQ ID NO: 856601 - RNA, 19 nt, Homo sapiens
acgcaucucuugaauugga

SEQ ID NO: 856602 - RNA, 19 nt, Homo sapiens
ucucuaaggcuguguuuau

SEQ ID NO: 856603 - RNA, 19 nt, Homo sapiens
ggagaggagccuugcuguu

SEQ ID NO: 856604 - RNA, 19 nt, Homo sapiens
cuaugucucuguuucugaa

SEQ ID NO: 856605 - RNA, 19 nt, Homo sapiens
caauauggccuugguaugg

SEQ ID NO: 856606 - RNA, 19 nt, Homo sapiens
cucuggagcaucaauauua

SEQ ID NO: 856607 - RNA, 19 nt, Homo sapiens
cggcuaguuucaccuggua

SEQ ID NO: 856608 - RNA, 19 nt, Homo sapiens
cuaaggcuguguuuauuuu

SEQ ID NO: 856609 - RNA, 19 nt, Homo sapiens
agaggagccuugcuguuuc

SEQ ID NO: 856610 - RNA, 19 nt, Homo sapiens
caucugccuuuaauaacug

SEQ ID NO: 856611 - RNA, 19 nt, Homo sapiens
ucaugagcguguuuauaau

SEQ ID NO: 856612 - RNA, 19 nt, Homo sapiens
cugcugcuuuccuaaauug

SEQ ID NO: 856613 - RNA, 19 nt, Homo sapiens
ugccguggcugucacaaau

SEQ ID NO: 856614 - RNA, 19 nt, Homo sapiens
uugcagcuguuaguuauug

SEQ ID NO: 856615 - RNA, 19 nt, Homo sapiens
ccucaugagcguguuuaua

SEQ ID NO: 856616 - RNA, 19 nt, Homo sapiens
cuguaaggcucuguucauu

SEQ ID NO: 856617 - RNA, 19 nt, Homo sapiens
gcugcgugguccauaucua

SEQ ID NO: 856618 - RNA, 19 nt, Homo sapiens
ccuggagacuguauacaag

SEQ ID NO: 856619 - RNA, 19 nt, Homo sapiens
ucuaaggcuguguuuauuu

SEQ ID NO: 856620 - RNA, 19 nt, Homo sapiens
guauacaagacuggauuaa

SEQ ID NO: 856621 - RNA, 19 nt, Homo sapiens
agacuacaacucccaguau

SEQ ID NO: 856622 - RNA, 19 nt, Homo sapiens
uguaaggcucuguucauuu

SEQ ID NO: 856623 - RNA, 19 nt, Homo sapiens
cacgacuacucgcuucuga

SEQ ID NO: 856624 - RNA, 19 nt, Homo sapiens
gacuuucccaccaguguaa

SEQ ID NO: 856625 - RNA, 19 nt, Homo sapiens
gagcguguuuauaauagcu

SEQ ID NO: 856626 - RNA, 19 nt, Homo sapiens
ccaccaguguaauaaagag

SEQ ID NO: 856627 - RNA, 19 nt, Homo sapiens
uagcugccuucaaauucuu

SEQ ID NO: 856628 - RNA, 19 nt, Homo sapiens
caaguuugcagcuguuagu

SEQ ID NO: 856629 - RNA, 19 nt, Homo sapiens
ggggauucguggaucuuua

SEQ ID NO: 856630 - RNA, 19 nt, Homo sapiens
ucaucugccuuuaauaacu

SEQ ID NO: 856631 - RNA, 19 nt, Homo sapiens
uguauacaagacuggauua

SEQ ID NO: 856632 - RNA, 19 nt, Homo sapiens
gcagggcagacgcacaaga

SEQ ID NO: 856633 - RNA, 19 nt, Homo sapiens
gaacucccggaacgguuga

SEQ ID NO: 856634 - RNA, 19 nt, Homo sapiens
ugucugccguuuacaucuu

SEQ ID NO: 856635 - RNA, 19 nt, Homo sapiens
gcaacccaucuaauucuuc

SEQ ID NO: 856636 - RNA, 19 nt, Homo sapiens
ccugcugcuuuccuaaauu

SEQ ID NO: 856637 - RNA, 19 nt, Homo sapiens
ugucucuguuucugaacua

SEQ ID NO: 856638 - RNA, 19 nt, Homo sapiens
ugaagagacauuggagcua

SEQ ID NO: 856639 - RNA, 19 nt, Homo sapiens
ccucuccucaggcucaaua

SEQ ID NO: 856640 - RNA, 19 nt, Homo sapiens
gccugcugcuuuccuaaau

SEQ ID NO: 856641 - RNA, 19 nt, Homo sapiens
acaucucucuggagcauca

SEQ ID NO: 856642 - RNA, 19 nt, Homo sapiens
acuacucgcuucugaaacu

SEQ ID NO: 856643 - RNA, 19 nt, Homo sapiens
gagacuuucccaccagugu

SEQ ID NO: 856644 - RNA, 19 nt, Homo sapiens
aauagcugccuucaaauuc

SEQ ID NO: 856645 - RNA, 19 nt, Homo sapiens
cuugucauguucgaaguuu

SEQ ID NO: 856646 - RNA, 19 nt, Homo sapiens
ggaccagacaccagaacuc

SEQ ID NO: 856647 - RNA, 19 nt, Homo sapiens
ugucauguucgaaguuuga

SEQ ID NO: 856648 - RNA, 19 nt, Homo sapiens
gcuaugucucuguuucuga

SEQ ID NO: 856649 - RNA, 19 nt, Homo sapiens
cucuaaggcuguguuuauu

SEQ ID NO: 856650 - RNA, 19 nt, Homo sapiens
gccuugcuguuuccaaauc

SEQ ID NO: 856651 - RNA, 19 nt, Homo sapiens
ggccgugauuaaugcaguu

SEQ ID NO: 856652 - RNA, 19 nt, Homo sapiens
uccucgagcugcaggcuuu

SEQ ID NO: 856653 - RNA, 19 nt, Homo sapiens
uuacaucuuggacaucuug

SEQ ID NO: 856654 - RNA, 19 nt, Homo sapiens
guuuacaucuuggacaucu

SEQ ID NO: 856655 - RNA, 19 nt, Homo sapiens
ccaucuaauucuucugucu

SEQ ID NO: 856656 - RNA, 19 nt, Homo sapiens
ugucuucacgcaucucuug

SEQ ID NO: 856657 - RNA, 19 nt, Homo sapiens
uuucucugcugauguuuca

SEQ ID NO: 856658 - RNA, 19 nt, Homo sapiens
ccucuccucagauuggaua

SEQ ID NO: 856659 - RNA, 19 nt, Homo sapiens
uccucaggcucaauaauuc

SEQ ID NO: 856660 - RNA, 19 nt, Homo sapiens
cuccucaggcucaauaauu

SEQ ID NO: 856661 - RNA, 19 nt, Homo sapiens
cagcuguuaguuauugauu

SEQ ID NO: 856662 - RNA, 19 nt, Homo sapiens
gggauucguggaucuuuag

SEQ ID NO: 856663 - RNA, 19 nt, Homo sapiens
gaaucuccgugggacaucu

SEQ ID NO: 856664 - RNA, 19 nt, Homo sapiens
gugucucgauuuccuguca

SEQ ID NO: 856665 - RNA, 19 nt, Homo sapiens
auaauuccaugggucucua

SEQ ID NO: 856666 - RNA, 19 nt, Homo sapiens
cuccucagauuggauaaau

SEQ ID NO: 856667 - RNA, 19 nt, Homo sapiens
gcucuguucauuuucuuua

SEQ ID NO: 856668 - RNA, 19 nt, Homo sapiens
aguuucaccugguaauugu

SEQ ID NO: 856669 - RNA, 19 nt, Homo sapiens
gaggagccuugcuguuucc

SEQ ID NO: 856670 - RNA, 19 nt, Homo sapiens
uauaauagcugccuucaaa

SEQ ID NO: 856671 - RNA, 19 nt, Homo sapiens
ucacgcaucucuugaauug

SEQ ID NO: 856672 - RNA, 19 nt, Homo sapiens
ccaaaucucuccugcugaa

SEQ ID NO: 856673 - RNA, 19 nt, Homo sapiens
gagaggagccuugcuguuu

SEQ ID NO: 856674 - RNA, 19 nt, Homo sapiens
gagccuugcuguuuccaaa

SEQ ID NO: 856675 - RNA, 19 nt, Homo sapiens
ccucagauuggauaaauua

SEQ ID NO: 856676 - RNA, 19 nt, Homo sapiens
guaaggcucuguucauuuu

SEQ ID NO: 856677 - RNA, 19 nt, Homo sapiens
ggacaucucucuggagcau

SEQ ID NO: 856678 - RNA, 19 nt, Homo sapiens
guuaaguacugcacgacua

SEQ ID NO: 856679 - RNA, 19 nt, Homo sapiens
ccgcaggguugucaaguuu

SEQ ID NO: 856680 - RNA, 19 nt, Homo sapiens
uaacugucguuuguccuua

SEQ ID NO: 856681 - RNA, 19 nt, Homo sapiens
caugagcguguuuauaaua

SEQ ID NO: 856682 - RNA, 19 nt, Homo sapiens
guucgaaguuugauaccuu

SEQ ID NO: 856683 - RNA, 19 nt, Homo sapiens
uaauagcugccuucaaauu

SEQ ID NO: 856684 - RNA, 19 nt, Homo sapiens
cgucagacuuucuccaaga

SEQ ID NO: 856685 - RNA, 19 nt, Homo sapiens
cgacuacucgcuucugaaa

SEQ ID NO: 856686 - RNA, 19 nt, Homo sapiens
gauggcuacugccugcuuu

SEQ ID NO: 856687 - RNA, 19 nt, Homo sapiens
cucaugagcguguuuauaa

SEQ ID NO: 856688 - RNA, 19 nt, Homo sapiens
guuugcagcuguuaguuau

SEQ ID NO: 856689 - RNA, 19 nt, Homo sapiens
gacuacaacucccaguaug

SEQ ID NO: 856690 - RNA, 19 nt, Homo sapiens
gagacuacaacucccagua

SEQ ID NO: 856691 - RNA, 19 nt, Homo sapiens
agucaucugccuuuaauaa

SEQ ID NO: 856692 - RNA, 19 nt, Homo sapiens
caacccaucuaauucuucu

SEQ ID NO: 856693 - RNA, 19 nt, Homo sapiens
gggauucguggaucuuuaa

SEQ ID NO: 856694 - RNA, 19 nt, Homo sapiens
guccuuaacgucagacuuu

SEQ ID NO: 856695 - RNA, 19 nt, Homo sapiens
acgcaucucuugaauugga

SEQ ID NO: 856696 - RNA, 19 nt, Homo sapiens
ucucuaaggcuguguuuau

SEQ ID NO: 856697 - RNA, 19 nt, Homo sapiens
ggagaggagccuugcuguu

SEQ ID NO: 856698 - RNA, 19 nt, Homo sapiens
cuaugucucuguuucugaa

SEQ ID NO: 856699 - RNA, 19 nt, Homo sapiens
caauauggccuugguaugg

SEQ ID NO: 856700 - RNA, 19 nt, Homo sapiens
cucuggagcaucaauauua

SEQ ID NO: 856701 - RNA, 19 nt, Homo sapiens
cggcuaguuucaccuggua

SEQ ID NO: 856702 - RNA, 19 nt, Homo sapiens
cuaaggcuguguuuauuuu

SEQ ID NO: 856703 - RNA, 19 nt, Homo sapiens
agaggagccuugcuguuuc

SEQ ID NO: 856704 - RNA, 19 nt, Homo sapiens
caucugccuuuaauaacug

SEQ ID NO: 856705 - RNA, 19 nt, Homo sapiens
ucaugagcguguuuauaau

SEQ ID NO: 856706 - RNA, 19 nt, Homo sapiens
gccgcaggguugucaaguu

SEQ ID NO: 856707 - RNA, 19 nt, Homo sapiens
uugcagcuguuaguuauug

SEQ ID NO: 856708 - RNA, 19 nt, Homo sapiens
ccucaugagcguguuuaua

SEQ ID NO: 856709 - RNA, 19 nt, Homo sapiens
cuguaaggcucuguucauu

SEQ ID NO: 856710 - RNA, 19 nt, Homo sapiens
ccuggagacuguauacaag

SEQ ID NO: 856711 - RNA, 19 nt, Homo sapiens
ucuaaggcuguguuuauuu

SEQ ID NO: 856712 - RNA, 19 nt, Homo sapiens
guauacaagacuggauuaa

SEQ ID NO: 856713 - RNA, 19 nt, Homo sapiens
agacuacaacucccaguau

SEQ ID NO: 856714 - RNA, 19 nt, Homo sapiens
uguaaggcucuguucauuu

SEQ ID NO: 856715 - RNA, 19 nt, Homo sapiens
cacgacuacucgcuucuga

SEQ ID NO: 856716 - RNA, 19 nt, Homo sapiens
gagcguguuuauaauagcu

SEQ ID NO: 856717 - RNA, 19 nt, Homo sapiens
uagcugccuucaaauucuu

SEQ ID NO: 856718 - RNA, 19 nt, Homo sapiens
caaguuugcagcuguuagu

SEQ ID NO: 856719 - RNA, 19 nt, Homo sapiens
ggggauucguggaucuuua

SEQ ID NO: 856720 - RNA, 19 nt, Homo sapiens
ucaucugccuuuaauaacu

SEQ ID NO: 856721 - RNA, 19 nt, Homo sapiens
uguauacaagacuggauua

SEQ ID NO: 856722 - RNA, 19 nt, Homo sapiens
gaacucccggaacgguuga

SEQ ID NO: 856723 - RNA, 19 nt, Homo sapiens
cacaauauggccuugguau

SEQ ID NO: 856724 - RNA, 19 nt, Homo sapiens
gcagggcagacgcacaaga

SEQ ID NO: 856725 - RNA, 19 nt, Homo sapiens
ugucugccguuuacaucuu

SEQ ID NO: 856726 - RNA, 19 nt, Homo sapiens
gcaacccaucuaauucuuc

SEQ ID NO: 856727 - RNA, 19 nt, Homo sapiens
cugcugcuuuccuaaauca

SEQ ID NO: 856728 - RNA, 19 nt, Homo sapiens
ugaagagacauuggagcua

SEQ ID NO: 856729 - RNA, 19 nt, Homo sapiens
ugucucuguuucugaacua

SEQ ID NO: 856730 - RNA, 19 nt, Homo sapiens
ccucuccucaggcucaaua

SEQ ID NO: 856731 - RNA, 19 nt, Homo sapiens
gccugcugcuuuccuaaau

SEQ ID NO: 856732 - RNA, 19 nt, Homo sapiens
acaucucucuggagcauca

SEQ ID NO: 856733 - RNA, 19 nt, Homo sapiens
acuacucgcuucugaaacu

SEQ ID NO: 856734 - RNA, 19 nt, Homo sapiens
aauagcugccuucaaauuc

SEQ ID NO: 856735 - RNA, 19 nt, Homo sapiens
gcuaugucucuguuucuga

SEQ ID NO: 856736 - RNA, 19 nt, Homo sapiens
cucuaaggcuguguuuauu

SEQ ID NO: 856737 - RNA, 19 nt, Homo sapiens
uccucgagcugcaggcuuu

SEQ ID NO: 856738 - RNA, 19 nt, Homo sapiens
gccuugcuguuuccaaauc

SEQ ID NO: 856739 - RNA, 19 nt, Homo sapiens
cuugucauguucgaaguuu

SEQ ID NO: 856740 - RNA, 19 nt, Homo sapiens
ggaccagacaccagaacuc

SEQ ID NO: 856741 - RNA, 19 nt, Homo sapiens
ugucauguucgaaguuuga

SEQ ID NO: 856742 - RNA, 19 nt, Homo sapiens
aagggucgguggccucuca

SEQ ID NO: 856743 - RNA, 19 nt, Homo sapiens
uuacaucuuggacaucuug

SEQ ID NO: 856744 - RNA, 19 nt, Homo sapiens
guuuacaucuuggacaucu

SEQ ID NO: 856745 - RNA, 19 nt, Homo sapiens
ccaucuaauucuucugucu

SEQ ID NO: 856746 - RNA, 19 nt, Homo sapiens
ucacaauauggccuuggua

SEQ ID NO: 856747 - RNA, 19 nt, Homo sapiens
ugucuucacgcaucucuug

SEQ ID NO: 856748 - RNA, 19 nt, Homo sapiens
uuucucugcugauguuuca

SEQ ID NO: 856749 - RNA, 19 nt, Homo sapiens
ccucuccucagauuggaua

SEQ ID NO: 856750 - RNA, 19 nt, Homo sapiens
uccucaggcucaauaauuc

SEQ ID NO: 856751 - RNA, 19 nt, Homo sapiens
cuccucaggcucaauaauu

SEQ ID NO: 856752 - RNA, 19 nt, Homo sapiens
cagcuguuaguuauugauu

SEQ ID NO: 856753 - RNA, 19 nt, Homo sapiens
gaaucuccgugggacaucu

SEQ ID NO: 856754 - RNA, 19 nt, Homo sapiens
auaauuccaugggucucua

SEQ ID NO: 856755 - RNA, 19 nt, Homo sapiens
aguuucaccugguaauugu

SEQ ID NO: 856756 - RNA, 19 nt, Homo sapiens
cuccucagauuggauaaau

SEQ ID NO: 856757 - RNA, 19 nt, Homo sapiens
gcucuguucauuuucuuua

SEQ ID NO: 856758 - RNA, 19 nt, Homo sapiens
gaggagccuugcuguuucc

SEQ ID NO: 856759 - RNA, 19 nt, Homo sapiens
gaauuuaagugacccauua

SEQ ID NO: 856760 - RNA, 19 nt, Homo sapiens
caagacagcuuaugaauau

SEQ ID NO: 856761 - RNA, 19 nt, Homo sapiens
gaaggaagaucuggagcua

SEQ ID NO: 856762 - RNA, 19 nt, Homo sapiens
gcaggaaucgcuugaaauu

SEQ ID NO: 856763 - RNA, 19 nt, Homo sapiens
gagacuaacugaauuuaag

SEQ ID NO: 856764 - RNA, 19 nt, Homo sapiens
gaagaucuggagcuaauaa

SEQ ID NO: 856765 - RNA, 19 nt, Homo sapiens
ugacugagauggagauauc

SEQ ID NO: 856766 - RNA, 19 nt, Homo sapiens
gaucuggagcuaauaauga

SEQ ID NO: 856767 - RNA, 19 nt, Homo sapiens
agaaggagauccagaguuc

SEQ ID NO: 856768 - RNA, 19 nt, Homo sapiens
ccaagacagcuuaugaaua

SEQ ID NO: 856769 - RNA, 19 nt, Homo sapiens
guacucaaauggcaugugu

SEQ ID NO: 856770 - RNA, 19 nt, Homo sapiens
guggagaauuuauauguug

SEQ ID NO: 856771 - RNA, 19 nt, Homo sapiens
gacuagcucucaacaguau

SEQ ID NO: 856772 - RNA, 19 nt, Homo sapiens
ccuacaacaugcuugauuu

SEQ ID NO: 856773 - RNA, 19 nt, Homo sapiens
gagcugagaucacacuacu

SEQ ID NO: 856774 - RNA, 19 nt, Homo sapiens
guagaagaauaccucaugu

SEQ ID NO: 856775 - RNA, 19 nt, Homo sapiens
caaauauaccuacuggauu

SEQ ID NO: 856776 - RNA, 19 nt, Homo sapiens
ggagacuaacugaauuuaa

SEQ ID NO: 856777 - RNA, 19 nt, Homo sapiens
cauaggccaccuugaguua

SEQ ID NO: 856778 - RNA, 19 nt, Homo sapiens
ccuaggagccacuauauau

SEQ ID NO: 856779 - RNA, 19 nt, Homo sapiens
ccuauguuguggagaauuu

SEQ ID NO: 856780 - RNA, 19 nt, Homo sapiens
gaugcgugcuuucucaaau

SEQ ID NO: 856781 - RNA, 19 nt, Homo sapiens
gagcuaauaaugacugaga

SEQ ID NO: 856782 - RNA, 19 nt, Homo sapiens
ggaaucgcuugaaauugga

SEQ ID NO: 856783 - RNA, 19 nt, Homo sapiens
guuggagacuaacugaauu

SEQ ID NO: 856784 - RNA, 19 nt, Homo sapiens
ucaaauauaccuacuggau

SEQ ID NO: 856785 - RNA, 19 nt, Homo sapiens
gaaggucccgggagcagaa

SEQ ID NO: 856786 - RNA, 19 nt, Homo sapiens
gagaagccacggaaacaug

SEQ ID NO: 856787 - RNA, 19 nt, Homo sapiens
aggaaucgcuugaaauugg

SEQ ID NO: 856788 - RNA, 19 nt, Homo sapiens
uauccuauguuguggagaa

SEQ ID NO: 856789 - RNA, 19 nt, Homo sapiens
aggaagaucuggagcuaau

SEQ ID NO: 856790 - RNA, 19 nt, Homo sapiens
ccuacuggauuaauuuaug

SEQ ID NO: 856791 - RNA, 19 nt, Homo sapiens
ggcggaagcugugucaguu

SEQ ID NO: 856792 - RNA, 19 nt, Homo sapiens
agaaagaacuggcaaaagu

SEQ ID NO: 856793 - RNA, 19 nt, Homo sapiens
acacuacuguacuacugua

SEQ ID NO: 856794 - RNA, 19 nt, Homo sapiens
gcugagaucacacuacugu

SEQ ID NO: 856795 - RNA, 19 nt, Homo sapiens
ucacacuacuguacuacug

SEQ ID NO: 856796 - RNA, 19 nt, Homo sapiens
agauagauguagguuauga

SEQ ID NO: 856797 - RNA, 19 nt, Homo sapiens
cuaggagccacuauauaua

SEQ ID NO: 856798 - RNA, 19 nt, Homo sapiens
caacaguauucaagguaca

SEQ ID NO: 856799 - RNA, 19 nt, Homo sapiens
ccaccuugaguuagaauuu

SEQ ID NO: 856800 - RNA, 19 nt, Homo sapiens
gacagcuuaugaauaucua

SEQ ID NO: 856801 - RNA, 19 nt, Homo sapiens
uagcacaccuguaugaaaa

SEQ ID NO: 856802 - RNA, 19 nt, Homo sapiens
gcacaaaacacuguacaaa

SEQ ID NO: 856803 - RNA, 19 nt, Homo sapiens
gagaaggagauccagaguu

SEQ ID NO: 856804 - RNA, 19 nt, Homo sapiens
gaacuggagcagaaagaag

SEQ ID NO: 856805 - RNA, 19 nt, Homo sapiens
aggcaggaaucgcuugaaa

SEQ ID NO: 856806 - RNA, 19 nt, Homo sapiens
caagguacaucuggagucu

SEQ ID NO: 856807 - RNA, 19 nt, Homo sapiens
ccucuaaucccagcacuuu

SEQ ID NO: 856808 - RNA, 19 nt, Homo sapiens
acacaugggcaacguggua

SEQ ID NO: 856809 - RNA, 19 nt, Homo sapiens
gcaaaagucacuaucaaga

SEQ ID NO: 856810 - RNA, 19 nt, Homo sapiens
ggccaugucugugauugga

SEQ ID NO: 856811 - RNA, 19 nt, Homo sapiens
gaucacgaggucaggaauu

SEQ ID NO: 856812 - RNA, 19 nt, Homo sapiens
ggucgaggcagguagauca

SEQ ID NO: 856813 - RNA, 19 nt, Homo sapiens
uaggagccacuauauauau

SEQ ID NO: 856814 - RNA, 19 nt, Homo sapiens
uggagucucagcagaguua

SEQ ID NO: 856815 - RNA, 19 nt, Homo sapiens
cgaaaggaagucugagaga

SEQ ID NO: 856816 - RNA, 19 nt, Homo sapiens
cugacuagcucucaacagu

SEQ ID NO: 856817 - RNA, 19 nt, Homo sapiens
guaccuacaacaugcuuga

SEQ ID NO: 856818 - RNA, 19 nt, Homo sapiens
ccuauaaucccagcuauuc

SEQ ID NO: 856819 - RNA, 19 nt, Homo sapiens
ugacuagcucucaacagua

SEQ ID NO: 856820 - RNA, 19 nt, Homo sapiens
gaauaccucaugugcagau

SEQ ID NO: 856821 - RNA, 19 nt, Homo sapiens
ggaagaucuggagcuaaua

SEQ ID NO: 856822 - RNA, 19 nt, Homo sapiens
gccagucucauucaucuga

SEQ ID NO: 856823 - RNA, 19 nt, Homo sapiens
aaaucuagcacaccuguau

SEQ ID NO: 856824 - RNA, 19 nt, Homo sapiens
augcgugcuuucucaaaua

SEQ ID NO: 856825 - RNA, 19 nt, Homo sapiens
agaucacacuacuguacua

SEQ ID NO: 856826 - RNA, 19 nt, Homo sapiens
uaggccaccuugaguuaga

SEQ ID NO: 856827 - RNA, 19 nt, Homo sapiens
gcaggccagucucauucau

SEQ ID NO: 856828 - RNA, 19 nt, Homo sapiens
cuacuggauuaauuuaugg

SEQ ID NO: 856829 - RNA, 19 nt, Homo sapiens
gaaaccccgucuccacuga

SEQ ID NO: 856830 - RNA, 19 nt, Homo sapiens
gcuaauaaugacugagaug

SEQ ID NO: 856831 - RNA, 19 nt, Homo sapiens
ggaggucgaggcagguaga

SEQ ID NO: 856832 - RNA, 19 nt, Homo sapiens
guucauaggccaccuugag

SEQ ID NO: 856833 - RNA, 19 nt, Homo sapiens
ggagaaggagauccagagu

SEQ ID NO: 856834 - RNA, 19 nt, Homo sapiens
gauagauguagguuaugaa

SEQ ID NO: 856835 - RNA, 19 nt, Homo sapiens
gccuaggagccacuauaua

SEQ ID NO: 856836 - RNA, 19 nt, Homo sapiens
aacaggagcgggagaaaga

SEQ ID NO: 856837 - RNA, 19 nt, Homo sapiens
cagccuggccaacauguga

SEQ ID NO: 856838 - RNA, 19 nt, Homo sapiens
gcucucaacaguauucaag

SEQ ID NO: 856839 - RNA, 19 nt, Homo sapiens
cuagcacaccuguaugaaa

SEQ ID NO: 856840 - RNA, 19 nt, Homo sapiens
ucuccaagacagcuuauga

SEQ ID NO: 856841 - RNA, 19 nt, Homo sapiens
uguagaagaauaccucaug

SEQ ID NO: 856842 - RNA, 19 nt, Homo sapiens
caacugaugcgugcuuucu

SEQ ID NO: 856843 - RNA, 19 nt, Homo sapiens
uaauaaugacugagaugga

SEQ ID NO: 856844 - RNA, 19 nt, Homo sapiens
ggagaaagaacuggcaaaa

SEQ ID NO: 856845 - RNA, 19 nt, Homo sapiens
uguacaaacccgaaaggaa

SEQ ID NO: 856846 - RNA, 19 nt, Homo sapiens
acaacaugcuugauuuuga

SEQ ID NO: 856847 - RNA, 19 nt, Homo sapiens
caaaagucacuaucaagaa

SEQ ID NO: 856848 - RNA, 19 nt, Homo sapiens
gcgccuauaaucccagcua

SEQ ID NO: 856849 - RNA, 19 nt, Homo sapiens
ggagaagccacggaaacau

SEQ ID NO: 856850 - RNA, 19 nt, Homo sapiens
gggagaaagaacuggcaaa

SEQ ID NO: 856851 - RNA, 19 nt, Homo sapiens
caaacaggagcgggagaaa

SEQ ID NO: 856852 - RNA, 19 nt, Homo sapiens
ccaaacaggagcgggagaa

SEQ ID NO: 856853 - RNA, 19 nt, Homo sapiens
gggcggaagcugugucagu

SEQ ID NO: 856854 - RNA, 19 nt, Homo sapiens
ugagaucacacuacuguac

SEQ ID NO: 856855 - RNA, 19 nt, Homo sapiens
agaagccacggaaacauga

SEQ ID NO: 856856 - RNA, 19 nt, Homo sapiens
gcggcguggugaaauagau

SEQ ID NO: 856857 - RNA, 19 nt, Homo sapiens
agguacaucuggagucuca

SEQ ID NO: 856858 - RNA, 19 nt, Homo sapiens
ucucaacaguauucaaggu

SEQ ID NO: 856859 - RNA, 19 nt, Homo sapiens
gaaguuaauucgagucuua

SEQ ID NO: 856860 - RNA, 19 nt, Homo sapiens
gaagggagguucagagaaa

SEQ ID NO: 856861 - RNA, 19 nt, Homo sapiens
gaacuuggaucauauggaa

SEQ ID NO: 856862 - RNA, 19 nt, Homo sapiens
gaagaaaugucauguggau

SEQ ID NO: 856863 - RNA, 19 nt, Homo sapiens
gaaauucaacguccaagua

SEQ ID NO: 856864 - RNA, 19 nt, Homo sapiens
ggaaaucucucccacaaca

SEQ ID NO: 856865 - RNA, 19 nt, Homo sapiens
gcaauaaggucgucaaggu

SEQ ID NO: 856866 - RNA, 19 nt, Homo sapiens
ggaaugaucuacauguuca

SEQ ID NO: 856867 - RNA, 19 nt, Homo sapiens
ggauugcaguauucucuua

SEQ ID NO: 856868 - RNA, 19 nt, Homo sapiens
ccgaagaacuuggaucaua

SEQ ID NO: 856869 - RNA, 19 nt, Homo sapiens
caacaaagcaccaccauca

SEQ ID NO: 856870 - RNA, 19 nt, Homo sapiens
gaggagagauggauucaca

SEQ ID NO: 856871 - RNA, 19 nt, Homo sapiens
cagcacagauguugaaaug

SEQ ID NO: 856872 - RNA, 19 nt, Homo sapiens
gcacagauguugaaaugac

SEQ ID NO: 856873 - RNA, 19 nt, Homo sapiens
gcacaggguuaccaucaga

SEQ ID NO: 856874 - RNA, 19 nt, Homo sapiens
caagucacguuucugauug

SEQ ID NO: 856875 - RNA, 19 nt, Homo sapiens
cgaagaacuuggaucauau

SEQ ID NO: 856876 - RNA, 19 nt, Homo sapiens
cauuagcacugucucauuu

SEQ ID NO: 856877 - RNA, 19 nt, Homo sapiens
gcaagucacguuucugauu

SEQ ID NO: 856878 - RNA, 19 nt, Homo sapiens
guucauagccuuagccauu

SEQ ID NO: 856879 - RNA, 19 nt, Homo sapiens
gaaggcgagucugagaaua

SEQ ID NO: 856880 - RNA, 19 nt, Homo sapiens
ggauggaucugcaacaaag

SEQ ID NO: 856881 - RNA, 19 nt, Homo sapiens
caaaugauaaaccgcaaua

SEQ ID NO: 856882 - RNA, 19 nt, Homo sapiens
ucacuucccuagagaaaug

SEQ ID NO: 856883 - RNA, 19 nt, Homo sapiens
gcaagcaagucacguuucu

SEQ ID NO: 856884 - RNA, 19 nt, Homo sapiens
gcagaagacauuauagugu

SEQ ID NO: 856885 - RNA, 19 nt, Homo sapiens
gaucuuaucaccaguguca

SEQ ID NO: 856886 - RNA, 19 nt, Homo sapiens
augacaagauucuggauua

SEQ ID NO: 856887 - RNA, 19 nt, Homo sapiens
gcaaguggcgaaugaacaa

SEQ ID NO: 856888 - RNA, 19 nt, Homo sapiens
ccaaggagacuacccgaaa

SEQ ID NO: 856889 - RNA, 19 nt, Homo sapiens
aaauugagcuuccaaacag

SEQ ID NO: 856890 - RNA, 19 nt, Homo sapiens
uggcaugugugcucuguuu

SEQ ID NO: 856891 - RNA, 19 nt, Homo sapiens
gacaagauucuggauuaua

SEQ ID NO: 856892 - RNA, 19 nt, Homo sapiens
caagaucgccaagaagaaa

SEQ ID NO: 856893 - RNA, 19 nt, Homo sapiens
aauuguagguucagcagua

SEQ ID NO: 856894 - RNA, 19 nt, Homo sapiens
ggagaggccaguguuguaa

SEQ ID NO: 856895 - RNA, 19 nt, Homo sapiens
gaaaugguguuuggaugag

SEQ ID NO: 856896 - RNA, 19 nt, Homo sapiens
aauagcaucuuccaacuca

SEQ ID NO: 856897 - RNA, 19 nt, Homo sapiens
ucacagcaacguuggcaua

SEQ ID NO: 856898 - RNA, 19 nt, Homo sapiens
uggcaucagugaagagauu

SEQ ID NO: 856899 - RNA, 19 nt, Homo sapiens
guuggaagaucaccauauc

SEQ ID NO: 856900 - RNA, 19 nt, Homo sapiens
gaagaacuuggaucauaug

SEQ ID NO: 856901 - RNA, 19 nt, Homo sapiens
acaacagucucaugaggaa

SEQ ID NO: 856902 - RNA, 19 nt, Homo sapiens
cuagagaaaugguguuugg

SEQ ID NO: 856903 - RNA, 19 nt, Homo sapiens
gcaccagguuggagagaca

SEQ ID NO: 856904 - RNA, 19 nt, Homo sapiens
acaagauucuggauuauac

SEQ ID NO: 856905 - RNA, 19 nt, Homo sapiens
ggaaggcgagucugagaau

SEQ ID NO: 856906 - RNA, 19 nt, Homo sapiens
caacauugaaggugcagaa

SEQ ID NO: 856907 - RNA, 19 nt, Homo sapiens
gaugaguucuuuguuccuu

SEQ ID NO: 856908 - RNA, 19 nt, Homo sapiens
ccacagccaccucuuucua

SEQ ID NO: 856909 - RNA, 19 nt, Homo sapiens
ugacaagauucuggauuau

SEQ ID NO: 856910 - RNA, 19 nt, Homo sapiens
cgagaugugucuuucuaca

SEQ ID NO: 856911 - RNA, 19 nt, Homo sapiens
caaggagacuacccgaaag

SEQ ID NO: 856912 - RNA, 19 nt, Homo sapiens
ggaccuccaucccugaucu

SEQ ID NO: 856913 - RNA, 19 nt, Homo sapiens
uuaccuggauugcaguauu

SEQ ID NO: 856914 - RNA, 19 nt, Homo sapiens
caccaucacuucccuagag

SEQ ID NO: 856915 - RNA, 19 nt, Homo sapiens
uggcauaggcacaauugua

SEQ ID NO: 856916 - RNA, 19 nt, Homo sapiens
caggauggaucugcaacaa

SEQ ID NO: 856917 - RNA, 19 nt, Homo sapiens
caucuuccaacucaugaua

SEQ ID NO: 856918 - RNA, 19 nt, Homo sapiens
uaucaccagugucauagug

SEQ ID NO: 856919 - RNA, 19 nt, Homo sapiens
caaagcaccaccaucacuu

SEQ ID NO: 856920 - RNA, 19 nt, Homo sapiens
uggauaaugucaucaugug

SEQ ID NO: 856921 - RNA, 19 nt, Homo sapiens
cuacauuguugacuugauc

SEQ ID NO: 856922 - RNA, 19 nt, Homo sapiens
cacaagaucgccaagaaga

SEQ ID NO: 856923 - RNA, 19 nt, Homo sapiens
caugaggaauagcaucuuc

SEQ ID NO: 856924 - RNA, 19 nt, Homo sapiens
gggugaagcaaaugauaaa

SEQ ID NO: 856925 - RNA, 19 nt, Homo sapiens
cuacauguucauagccuua

SEQ ID NO: 856926 - RNA, 19 nt, Homo sapiens
gcacaggagaggccagugu

SEQ ID NO: 856927 - RNA, 19 nt, Homo sapiens
ggagagacaauuggcauca

SEQ ID NO: 856928 - RNA, 19 nt, Homo sapiens
agaaaugguguuuggauga

SEQ ID NO: 856929 - RNA, 19 nt, Homo sapiens
cuagagaaaucuuaaaccu

SEQ ID NO: 856930 - RNA, 19 nt, Homo sapiens
gaaacccgcaagcaaguca

SEQ ID NO: 856931 - RNA, 19 nt, Homo sapiens
uccacaagaucgccaagaa

SEQ ID NO: 856932 - RNA, 19 nt, Homo sapiens
gucuaaaguuggaagauca

SEQ ID NO: 856933 - RNA, 19 nt, Homo sapiens
ugugaugaguucuuuguuc

SEQ ID NO: 856934 - RNA, 19 nt, Homo sapiens
caccauauccaccagaaga

SEQ ID NO: 856935 - RNA, 19 nt, Homo sapiens
caauuggcaucagugaaga

SEQ ID NO: 856936 - RNA, 19 nt, Homo sapiens
cuucaauucuccacaagau

SEQ ID NO: 856937 - RNA, 19 nt, Homo sapiens
guucuuuguuccuucuuug

SEQ ID NO: 856938 - RNA, 19 nt, Homo sapiens
ccuuagccauugucuguga

SEQ ID NO: 856939 - RNA, 19 nt, Homo sapiens
gagacuacccgaaagacau

SEQ ID NO: 856940 - RNA, 19 nt, Homo sapiens
caucauguuuggccucuac

SEQ ID NO: 856941 - RNA, 19 nt, Homo sapiens
aagcaagucacguuucuga

SEQ ID NO: 856942 - RNA, 19 nt, Homo sapiens
caagaagaaaugucaugug

SEQ ID NO: 856943 - RNA, 19 nt, Homo sapiens
guucagcaguauucaacau

SEQ ID NO: 856944 - RNA, 19 nt, Homo sapiens
acacugggcccauucacuu

SEQ ID NO: 856945 - RNA, 19 nt, Homo sapiens
gagaacgagcggcagaaug

SEQ ID NO: 856946 - RNA, 19 nt, Homo sapiens
caucacuucccuagagaaa

SEQ ID NO: 856947 - RNA, 19 nt, Homo sapiens
ucacguuucugauuguuuu

SEQ ID NO: 856948 - RNA, 19 nt, Homo sapiens
gguugagucuaaaguugga

SEQ ID NO: 856949 - RNA, 19 nt, Homo sapiens
caccagaagcccaagcaaa

SEQ ID NO: 856950 - RNA, 19 nt, Homo sapiens
gucaucauguggugggaaa

SEQ ID NO: 856951 - RNA, 19 nt, Homo sapiens
ugucugugaugaguucuuu

SEQ ID NO: 856952 - RNA, 19 nt, Homo sapiens
gaucauucugcaugucauu

SEQ ID NO: 856953 - RNA, 19 nt, Homo sapiens
cuaaggaaggcgagucuga

SEQ ID NO: 856954 - RNA, 19 nt, Homo sapiens
gucccuccuuggugaauuu

SEQ ID NO: 856955 - RNA, 19 nt, Homo sapiens
cauguuuggccucuacuuu

SEQ ID NO: 856956 - RNA, 19 nt, Homo sapiens
gcaaaccuucaucgaggaa

SEQ ID NO: 856957 - RNA, 19 nt, Homo sapiens
auggaaaucucucccacaa

SEQ ID NO: 856958 - RNA, 19 nt, Homo sapiens
ggcauaggcacaauuguag

SEQ ID NO: 856959 - RNA, 19 nt, Homo sapiens
ggacagauaugcugaacau

SEQ ID NO: 856960 - RNA, 19 nt, Homo sapiens
guaaggaacccauuaauug

SEQ ID NO: 856961 - RNA, 19 nt, Homo sapiens
caagaaauggcccaaguua

SEQ ID NO: 856962 - RNA, 19 nt, Homo sapiens
gugcaaagcagaacauuaa

SEQ ID NO: 856963 - RNA, 19 nt, Homo sapiens
ggcggcaacugaagaauaa

SEQ ID NO: 856964 - RNA, 19 nt, Homo sapiens
gacaguccaucuuauuaaa

SEQ ID NO: 856965 - RNA, 19 nt, Homo sapiens
caaggacgauucagugaug

SEQ ID NO: 856966 - RNA, 19 nt, Homo sapiens
agaaauggcccaaguuaaa

SEQ ID NO: 856967 - RNA, 19 nt, Homo sapiens
gaacaugugcaaagcagaa

SEQ ID NO: 856968 - RNA, 19 nt, Homo sapiens
guaaagaaaguucaaagga

SEQ ID NO: 856969 - RNA, 19 nt, Homo sapiens
aacaagaacucaugggauu

SEQ ID NO: 856970 - RNA, 19 nt, Homo sapiens
gaaauaugcacccaaucaa

SEQ ID NO: 856971 - RNA, 19 nt, Homo sapiens
uaaggcaacugaaauaugc

SEQ ID NO: 856972 - RNA, 19 nt, Homo sapiens
aaacacaacuuugcaccuu

SEQ ID NO: 856973 - RNA, 19 nt, Homo sapiens
gcaaggccauuaaacaaaa

SEQ ID NO: 856974 - RNA, 19 nt, Homo sapiens
cgacaguccaucuuauuaa

SEQ ID NO: 856975 - RNA, 19 nt, Homo sapiens
gcaaagcagaacauuaaug

SEQ ID NO: 856976 - RNA, 19 nt, Homo sapiens
ggacugcuauguggacuca

SEQ ID NO: 856977 - RNA, 19 nt, Homo sapiens
gggcaaggccauuaaacaa

SEQ ID NO: 856978 - RNA, 19 nt, Homo sapiens
agacaggugacuagaaaua

SEQ ID NO: 856979 - RNA, 19 nt, Homo sapiens
acaggugacuagaaauauu

SEQ ID NO: 856980 - RNA, 19 nt, Homo sapiens
cagauaugcugaacaugug

SEQ ID NO: 856981 - RNA, 19 nt, Homo sapiens
gcaggaggcaucagagaga

SEQ ID NO: 856982 - RNA, 19 nt, Homo sapiens
caggugacuagaaauauua

SEQ ID NO: 856983 - RNA, 19 nt, Homo sapiens
ccaaugcuguggaauccuu

SEQ ID NO: 856984 - RNA, 19 nt, Homo sapiens
ugaaauaugcacccaauca

SEQ ID NO: 856985 - RNA, 19 nt, Homo sapiens
caucagagagaguaaagaa

SEQ ID NO: 856986 - RNA, 19 nt, Homo sapiens
cagcaucccuaucuaugga

SEQ ID NO: 856987 - RNA, 19 nt, Homo sapiens
gagcugggcaaggccauua

SEQ ID NO: 856988 - RNA, 19 nt, Homo sapiens
gaaaagaaacuucaucagu

SEQ ID NO: 856989 - RNA, 19 nt, Homo sapiens
gaaauggcccaaguuaaag

SEQ ID NO: 856990 - RNA, 19 nt, Homo sapiens
ggcaaggccauuaaacaaa

SEQ ID NO: 856991 - RNA, 19 nt, Homo sapiens
cgaggagccuguacucaag

SEQ ID NO: 856992 - RNA, 19 nt, Homo sapiens
gggaggcucuuugcaguca

SEQ ID NO: 856993 - RNA, 19 nt, Homo sapiens
ccaccaccaugcaaguuug

SEQ ID NO: 856994 - RNA, 19 nt, Homo sapiens
ccgacaguccaucuuauua

SEQ ID NO: 856995 - RNA, 19 nt, Homo sapiens
uguaaggaacccauuaauu

SEQ ID NO: 856996 - RNA, 19 nt, Homo sapiens
caaagcagaacauuaaugc

SEQ ID NO: 856997 - RNA, 19 nt, Homo sapiens
ggaggcaucagagagagua

SEQ ID NO: 856998 - RNA, 19 nt, Homo sapiens
uuacuaagcuagcgaaaau

SEQ ID NO: 856999 - RNA, 19 nt, Homo sapiens
cagagagaguaaagaaagu

SEQ ID NO: 857000 - RNA, 19 nt, Homo sapiens
acagauaugcugaacaugu

SEQ ID NO: 857001 - RNA, 19 nt, Homo sapiens
ucagagagaguaaagaaag

SEQ ID NO: 857002 - RNA, 19 nt, Homo sapiens
cgaagagauuaaagcacaa

SEQ ID NO: 857003 - RNA, 19 nt, Homo sapiens
gagaguaaagaaaguucaa

SEQ ID NO: 857004 - RNA, 19 nt, Homo sapiens
gaaggaaaacucucgaaga

SEQ ID NO: 857005 - RNA, 19 nt, Homo sapiens
gaguguugcuuccugaaac

SEQ ID NO: 857006 - RNA, 19 nt, Homo sapiens
guuguaaggaacccauuaa

SEQ ID NO: 857007 - RNA, 19 nt, Homo sapiens
cuugggaaguuguaaggaa

SEQ ID NO: 857008 - RNA, 19 nt, Homo sapiens
caagaacucaugggauuag

SEQ ID NO: 857009 - RNA, 19 nt, Homo sapiens
aagaaauggcccaaguuaa

SEQ ID NO: 857010 - RNA, 19 nt, Homo sapiens
ucaagaaauggcccaaguu

SEQ ID NO: 857011 - RNA, 19 nt, Homo sapiens
gagccaaugcuguggaauc

SEQ ID NO: 857012 - RNA, 19 nt, Homo sapiens
uaaagcacaaggacgauuc

SEQ ID NO: 857013 - RNA, 19 nt, Homo sapiens
acugaaauaugcacccaau

SEQ ID NO: 857014 - RNA, 19 nt, Homo sapiens
acaagaacucaugggauua

SEQ ID NO: 857015 - RNA, 19 nt, Homo sapiens
gagccuguacucaagaaau

SEQ ID NO: 857016 - RNA, 19 nt, Homo sapiens
gaguaaagaaaguucaaag

SEQ ID NO: 857017 - RNA, 19 nt, Homo sapiens
aauaugcacccaaucaaug

SEQ ID NO: 857018 - RNA, 19 nt, Homo sapiens
cagcuaccacuuccucuug

SEQ ID NO: 857019 - RNA, 19 nt, Homo sapiens
ggccagaacaugugcaaag

SEQ ID NO: 857020 - RNA, 19 nt, Homo sapiens
caccggcucucaccaacau

SEQ ID NO: 857021 - RNA, 19 nt, Homo sapiens
uaaggaacccauuaauugc

SEQ ID NO: 857022 - RNA, 19 nt, Homo sapiens
gacaggugacuagaaauau

SEQ ID NO: 857023 - RNA, 19 nt, Homo sapiens
gaggacagauaugcugaac

SEQ ID NO: 857024 - RNA, 19 nt, Homo sapiens
gagagaguaaagaaaguuc

SEQ ID NO: 857025 - RNA, 19 nt, Homo sapiens
ggcccaaguuaaagagcaa

SEQ ID NO: 857026 - RNA, 19 nt, Homo sapiens
uuaaggcaacugaaauaug

SEQ ID NO: 857027 - RNA, 19 nt, Homo sapiens
aaauaugcacccaaucaau

SEQ ID NO: 857028 - RNA, 19 nt, Homo sapiens
cacaaggacgauucaguga

SEQ ID NO: 857029 - RNA, 19 nt, Homo sapiens
gcaaguuuggagaaggaaa

SEQ ID NO: 857030 - RNA, 19 nt, Homo sapiens
cucaagaaauggcccaagu

SEQ ID NO: 857031 - RNA, 19 nt, Homo sapiens
caaaagagacagcaguugu

SEQ ID NO: 857032 - RNA, 19 nt, Homo sapiens
uaacaguccgccaagaucu

SEQ ID NO: 857033 - RNA, 19 nt, Homo sapiens
ucaugggauuagaguauuc

SEQ ID NO: 857034 - RNA, 19 nt, Homo sapiens
ugugcaaagcagaacauua

SEQ ID NO: 857035 - RNA, 19 nt, Homo sapiens
cgaguguugcuuccugaaa

SEQ ID NO: 857036 - RNA, 19 nt, Homo sapiens
gcacccaaucaaugugaga

SEQ ID NO: 857037 - RNA, 19 nt, Homo sapiens
gaagagauuaaagcacaag

SEQ ID NO: 857038 - RNA, 19 nt, Homo sapiens
agccuguacucaagaaaug

SEQ ID NO: 857039 - RNA, 19 nt, Homo sapiens
gaggagccuguacucaaga

SEQ ID NO: 857040 - RNA, 19 nt, Homo sapiens
aggcggcaacugaagaaua

SEQ ID NO: 857041 - RNA, 19 nt, Homo sapiens
acuccgacaguccaucuua

SEQ ID NO: 857042 - RNA, 19 nt, Homo sapiens
gcugggcaaggccauuaaa

SEQ ID NO: 857043 - RNA, 19 nt, Homo sapiens
acgaggagccuguacucaa

SEQ ID NO: 857044 - RNA, 19 nt, Homo sapiens
gaaaggaucuuguucauau

SEQ ID NO: 857045 - RNA, 19 nt, Homo sapiens
ggaaggaaauacuagaaga

SEQ ID NO: 857046 - RNA, 19 nt, Homo sapiens
ggaagcuccucucagguua

SEQ ID NO: 857047 - RNA, 19 nt, Homo sapiens
acacggaccuugaggaauu

SEQ ID NO: 857048 - RNA, 19 nt, Homo sapiens
ucucauaccuacucugaaa

SEQ ID NO: 857049 - RNA, 19 nt, Homo sapiens
ggccagggcuucagcagaa

SEQ ID NO: 857050 - RNA, 19 nt, Homo sapiens
gaaggaaauacuagaagaa

SEQ ID NO: 857051 - RNA, 19 nt, Homo sapiens
ucucgucacuccuuucuuu

SEQ ID NO: 857052 - RNA, 19 nt, Homo sapiens
caauguccuugccaaauga

SEQ ID NO: 857053 - RNA, 19 nt, Homo sapiens
ugagauaccugcaguuugc

SEQ ID NO: 857054 - RNA, 19 nt, Homo sapiens
caaccugggauucaaauga

SEQ ID NO: 857055 - RNA, 19 nt, Homo sapiens
ggaccaacacgaagugaga

SEQ ID NO: 857056 - RNA, 19 nt, Homo sapiens
ccgcagaggugcugugcaa

SEQ ID NO: 857057 - RNA, 19 nt, Homo sapiens
caacacggaccuugaggaa

SEQ ID NO: 857058 - RNA, 19 nt, Homo sapiens
ucuguugagugaaagaaua

SEQ ID NO: 857059 - RNA, 19 nt, Homo sapiens
ucuauucuguugagugaaa

SEQ ID NO: 857060 - RNA, 19 nt, Homo sapiens
ggucuagggcugacaaaga

SEQ ID NO: 857061 - RNA, 19 nt, Homo sapiens
caggacaacuacaccuuug

SEQ ID NO: 857062 - RNA, 19 nt, Homo sapiens
gcaccuggaccaacacgaa

SEQ ID NO: 857063 - RNA, 19 nt, Homo sapiens
gaggaaggaaauacuagaa

SEQ ID NO: 857064 - RNA, 19 nt, Homo sapiens
acaggcagauccacauaga

SEQ ID NO: 857065 - RNA, 19 nt, Homo sapiens
aaacuucuauucuguugag

SEQ ID NO: 857066 - RNA, 19 nt, Homo sapiens
ugaacaaccugcugaugag

SEQ ID NO: 857067 - RNA, 19 nt, Homo sapiens
gaacucgugagccggauug

SEQ ID NO: 857068 - RNA, 19 nt, Homo sapiens
ggaggaaggaaauacuaga

SEQ ID NO: 857069 - RNA, 19 nt, Homo sapiens
cuucuauucuguugaguga

SEQ ID NO: 857070 - RNA, 19 nt, Homo sapiens
uaccuacucugaaaugcaa

SEQ ID NO: 857071 - RNA, 19 nt, Homo sapiens
cccaaucacuacaagaaau

SEQ ID NO: 857072 - RNA, 19 nt, Homo sapiens
caucucauaccuacucuga

SEQ ID NO: 857073 - RNA, 19 nt, Homo sapiens
gcagaggugcugugcaaca

SEQ ID NO: 857074 - RNA, 19 nt, Homo sapiens
ccaaccgugugcugcguaa

SEQ ID NO: 857075 - RNA, 19 nt, Homo sapiens
ccaagagggucagcaccuu

SEQ ID NO: 857076 - RNA, 19 nt, Homo sapiens
caaaacuucuauucuguug

SEQ ID NO: 857077 - RNA, 19 nt, Homo sapiens
gagauggaggaaggaaaua

SEQ ID NO: 857078 - RNA, 19 nt, Homo sapiens
gcaccuuccaggaguuuga

SEQ ID NO: 857079 - RNA, 19 nt, Homo sapiens
gcagauccacauagacauc

SEQ ID NO: 857080 - RNA, 19 nt, Homo sapiens
cacggaccuugaggaauua

SEQ ID NO: 857081 - RNA, 19 nt, Homo sapiens
ccucccggcucgacaaguu

SEQ ID NO: 857082 - RNA, 19 nt, Homo sapiens
uauaaaugaucucgucacu

SEQ ID NO: 857083 - RNA, 19 nt, Homo sapiens
gagccggauugaugagcaa

SEQ ID NO: 857084 - RNA, 19 nt, Homo sapiens
ucaggacaacuacaccuuu

SEQ ID NO: 857085 - RNA, 19 nt, Homo sapiens
auagacaucccucgcauga

SEQ ID NO: 857086 - RNA, 19 nt, Homo sapiens
gguaguggccaucucauac

SEQ ID NO: 857087 - RNA, 19 nt, Homo sapiens
acagggacagccuuuguuu

SEQ ID NO: 857088 - RNA, 19 nt, Homo sapiens
ccaaucacuacaagaaaug

SEQ ID NO: 857089 - RNA, 19 nt, Homo sapiens
ggccuaccgccucaaguuu

SEQ ID NO: 857090 - RNA, 19 nt, Homo sapiens
ggacggcuuuucucauuuc

SEQ ID NO: 857091 - RNA, 19 nt, Homo sapiens
gaggaauuacggagguuga

SEQ ID NO: 857092 - RNA, 19 nt, Homo sapiens
gaacuccgagguggucaug

SEQ ID NO: 857093 - RNA, 19 nt, Homo sapiens
gacagggacagccuuuguu

SEQ ID NO: 857094 - RNA, 19 nt, Homo sapiens
acuguuacauggcacuuug

SEQ ID NO: 857095 - RNA, 19 nt, Homo sapiens
ugagauggaggaaggaaau

SEQ ID NO: 857096 - RNA, 19 nt, Homo sapiens
uuucucauuuccacuugua

SEQ ID NO: 857097 - RNA, 19 nt, Homo sapiens
aaaggaucuuguucauaug

SEQ ID NO: 857098 - RNA, 19 nt, Homo sapiens
uugcauuuauugagcacua

SEQ ID NO: 857099 - RNA, 19 nt, Homo sapiens
caggggagcuggugaagau

SEQ ID NO: 857100 - RNA, 19 nt, Homo sapiens
gaugaacaaccugcugaug

SEQ ID NO: 857101 - RNA, 19 nt, Homo sapiens
cgucacuccuuucuuugug

SEQ ID NO: 857102 - RNA, 19 nt, Homo sapiens
uggaagcuccucucagguu

SEQ ID NO: 857103 - RNA, 19 nt, Homo sapiens
cagcauccagcacguguau

SEQ ID NO: 857104 - RNA, 19 nt, Homo sapiens
ggacaccuaccagucugaa

SEQ ID NO: 857105 - RNA, 19 nt, Homo sapiens
ggacagccuuuguuuucug

SEQ ID NO: 857106 - RNA, 19 nt, Homo sapiens
gcauccagcacguguaugg

SEQ ID NO: 857107 - RNA, 19 nt, Homo sapiens
cagaggugcugugcaacau

SEQ ID NO: 857108 - RNA, 19 nt, Homo sapiens
ggacacauacaggcagauc

SEQ ID NO: 857109 - RNA, 19 nt, Homo sapiens
uuucugagauaccaaagag

SEQ ID NO: 857110 - RNA, 19 nt, Homo sapiens
augaacaaccugcugauga

SEQ ID NO: 857111 - RNA, 19 nt, Homo sapiens
uggauggcauucaggacaa

SEQ ID NO: 857112 - RNA, 19 nt, Homo sapiens
uccaggaguuugagagcaa

SEQ ID NO: 857113 - RNA, 19 nt, Homo sapiens
uuauugagcacuauuacga

SEQ ID NO: 857114 - RNA, 19 nt, Homo sapiens
gcauuuauugagcacuauu

SEQ ID NO: 857115 - RNA, 19 nt, Homo sapiens
cgagguaguggccaucuca

SEQ ID NO: 857116 - RNA, 19 nt, Homo sapiens
agacagggacagccuuugu

SEQ ID NO: 857117 - RNA, 19 nt, Homo sapiens
guccuguccugcagaaagu

SEQ ID NO: 857118 - RNA, 19 nt, Homo sapiens
ugagcacuauuacgauucu

SEQ ID NO: 857119 - RNA, 19 nt, Homo sapiens
auugagcacuauuacgauu

SEQ ID NO: 857120 - RNA, 19 nt, Homo sapiens
gcaaaacuucuauucuguu

SEQ ID NO: 857121 - RNA, 19 nt, Homo sapiens
auacaggcagauccacaua

SEQ ID NO: 857122 - RNA, 19 nt, Homo sapiens
gagcacuauuacgauucua

SEQ ID NO: 857123 - RNA, 19 nt, Homo sapiens
ucauaccuacucugaaaug

SEQ ID NO: 857124 - RNA, 19 nt, Homo sapiens
gugagauaccugcaguuug

SEQ ID NO: 857125 - RNA, 19 nt, Homo sapiens
uuuguggucuucauuugug

SEQ ID NO: 857126 - RNA, 19 nt, Homo sapiens
ucuuuguggucuucauuug

SEQ ID NO: 857127 - RNA, 19 nt, Homo sapiens
gcagcauccagcacgugua

SEQ ID NO: 857128 - RNA, 19 nt, Homo sapiens
ggaagcgcagcaacagcaa

SEQ ID NO: 857129 - RNA, 19 nt, Homo sapiens
gaaguucaccaggacacau

SEQ ID NO: 857130 - RNA, 19 nt, Homo sapiens
acuccgagguggucaugga

SEQ ID NO: 857131 - RNA, 19 nt, Homo sapiens
ccggacggcuuuucucauu

SEQ ID NO: 857132 - RNA, 19 nt, Homo sapiens
gccuuccgcuggaugaaca

SEQ ID NO: 857133 - RNA, 19 nt, Homo sapiens
gaucucgucacuccuuucu

SEQ ID NO: 857134 - RNA, 19 nt, Homo sapiens
guucaggguauaaaugauc

SEQ ID NO: 857135 - RNA, 19 nt, Homo sapiens
gaaaguugcugaucccaaa

SEQ ID NO: 857136 - RNA, 19 nt, Homo sapiens
ccucaaagaugggaaauuu

SEQ ID NO: 857137 - RNA, 19 nt, Homo sapiens
uauaaugucuuccucaaca

SEQ ID NO: 857138 - RNA, 19 nt, Homo sapiens
ggaggcccaugaucgacua

SEQ ID NO: 857139 - RNA, 19 nt, Homo sapiens
gauggagcaugcaguggaa

SEQ ID NO: 857140 - RNA, 19 nt, Homo sapiens
ccacagcaaagaauacauu

SEQ ID NO: 857141 - RNA, 19 nt, Homo sapiens
gaacagccugcagcucuuu

SEQ ID NO: 857142 - RNA, 19 nt, Homo sapiens
caaagaauacauugacauc

SEQ ID NO: 857143 - RNA, 19 nt, Homo sapiens
uauuggcucuggccucuuu

SEQ ID NO: 857144 - RNA, 19 nt, Homo sapiens
gcagccaacuauaaugucu

SEQ ID NO: 857145 - RNA, 19 nt, Homo sapiens
caacuguucuuugccuaau

SEQ ID NO: 857146 - RNA, 19 nt, Homo sapiens
gcaaagaauacauugacau

SEQ ID NO: 857147 - RNA, 19 nt, Homo sapiens
guaugcagguggagcugaa

SEQ ID NO: 857148 - RNA, 19 nt, Homo sapiens
uugcugaucccaaagauaa

SEQ ID NO: 857149 - RNA, 19 nt, Homo sapiens
uggaagaggugaagaacag

SEQ ID NO: 857150 - RNA, 19 nt, Homo sapiens
gaggaaguuucagcugaga

SEQ ID NO: 857151 - RNA, 19 nt, Homo sapiens
ugagccaccuuccuuaaag

SEQ ID NO: 857152 - RNA, 19 nt, Homo sapiens
acuguucuuugccuaauaa

SEQ ID NO: 857153 - RNA, 19 nt, Homo sapiens
cgaagaagcaugacaucca

SEQ ID NO: 857154 - RNA, 19 nt, Homo sapiens
gcagguggagcugaauauu

SEQ ID NO: 857155 - RNA, 19 nt, Homo sapiens
uggauucaauggucaagga

SEQ ID NO: 857156 - RNA, 19 nt, Homo sapiens
ggcccaugaucgacuaaug

SEQ ID NO: 857157 - RNA, 19 nt, Homo sapiens
gcagcucuuugaggaguau

SEQ ID NO: 857158 - RNA, 19 nt, Homo sapiens
cagguggagcugaauauug

SEQ ID NO: 857159 - RNA, 19 nt, Homo sapiens
ggaaguuucagcugagaag

SEQ ID NO: 857160 - RNA, 19 nt, Homo sapiens
ucaauggucaaggagaaua

SEQ ID NO: 857161 - RNA, 19 nt, Homo sapiens
acuauaaugucuuccucaa

SEQ ID NO: 857162 - RNA, 19 nt, Homo sapiens
gaagcaugacauccaguuc

SEQ ID NO: 857163 - RNA, 19 nt, Homo sapiens
guuuguggaucugcugaaa

SEQ ID NO: 857164 - RNA, 19 nt, Homo sapiens
cccuggagcucuacaugga

SEQ ID NO: 857165 - RNA, 19 nt, Homo sapiens
aaucugagccaccuuccuu

SEQ ID NO: 857166 - RNA, 19 nt, Homo sapiens
agguggagcugaauauugg

SEQ ID NO: 857167 - RNA, 19 nt, Homo sapiens
agaacagccugcagcucuu

SEQ ID NO: 857168 - RNA, 19 nt, Homo sapiens
acauggcccuggagcucua

SEQ ID NO: 857169 - RNA, 19 nt, Homo sapiens
cagcaaagaauacauugac

SEQ ID NO: 857170 - RNA, 19 nt, Homo sapiens
auucaauggucaaggagaa

SEQ ID NO: 857171 - RNA, 19 nt, Homo sapiens
cugaguugcugaagaagag

SEQ ID NO: 857172 - RNA, 19 nt, Homo sapiens
cuacauggaccugcuguca

SEQ ID NO: 857173 - RNA, 19 nt, Homo sapiens
caaagaugggaaauuuauc

SEQ ID NO: 857174 - RNA, 19 nt, Homo sapiens
uaaagaacuggaacaacca

SEQ ID NO: 857175 - RNA, 19 nt, Homo sapiens
gaaguuucagcugagaaga

SEQ ID NO: 857176 - RNA, 19 nt, Homo sapiens
gccgugccgucuacaucuu

SEQ ID NO: 857177 - RNA, 19 nt, Homo sapiens
caauggucaaggagaauau

SEQ ID NO: 857178 - RNA, 19 nt, Homo sapiens
agcaugacauccaguucaa

SEQ ID NO: 857179 - RNA, 19 nt, Homo sapiens
ccgucuacaucuucucgaa

SEQ ID NO: 857180 - RNA, 19 nt, Homo sapiens
gggaaauuuaucuuaagug

SEQ ID NO: 857181 - RNA, 19 nt, Homo sapiens
cucaaagaugggaaauuua

SEQ ID NO: 857182 - RNA, 19 nt, Homo sapiens
gcaaagaccucaucacauu

SEQ ID NO: 857183 - RNA, 19 nt, Homo sapiens
gaaugaugcuuuccuugua

SEQ ID NO: 857184 - RNA, 19 nt, Homo sapiens
gagcugcccuguuaauauu

SEQ ID NO: 857185 - RNA, 19 nt, Homo sapiens
gaaaugggaaugaugcuuu

SEQ ID NO: 857186 - RNA, 19 nt, Homo sapiens
guaucaaccugacuucuuu

SEQ ID NO: 857187 - RNA, 19 nt, Homo sapiens
ccacagagcuggauuucuc

SEQ ID NO: 857188 - RNA, 19 nt, Homo sapiens
caagaagacugcugaccaa

SEQ ID NO: 857189 - RNA, 19 nt, Homo sapiens
caacagggcugcaucaaaa

SEQ ID NO: 857190 - RNA, 19 nt, Homo sapiens
ggacuccacuccagguuug

SEQ ID NO: 857191 - RNA, 19 nt, Homo sapiens
gaggaaagcuuuuggauuc

SEQ ID NO: 857192 - RNA, 19 nt, Homo sapiens
gaagauggaaccagaacaa

SEQ ID NO: 857193 - RNA, 19 nt, Homo sapiens
gaccaagcccgaacacuaa

SEQ ID NO: 857194 - RNA, 19 nt, Homo sapiens
gaucggaauugcagacuuc

SEQ ID NO: 857195 - RNA, 19 nt, Homo sapiens
gagcuggauuucucccuuu

SEQ ID NO: 857196 - RNA, 19 nt, Homo sapiens
gauggaaccagaacaauuc

SEQ ID NO: 857197 - RNA, 19 nt, Homo sapiens
gagcgaagaagguaaugaa

SEQ ID NO: 857198 - RNA, 19 nt, Homo sapiens
gcugcccuguuaauauuua

SEQ ID NO: 857199 - RNA, 19 nt, Homo sapiens
ggagcugcccuguuaauau

SEQ ID NO: 857200 - RNA, 19 nt, Homo sapiens
ccaggaagaucagaggaaa

SEQ ID NO: 857201 - RNA, 19 nt, Homo sapiens
cgaagaagguaaugaacuc

SEQ ID NO: 857202 - RNA, 19 nt, Homo sapiens
gagcaccacuaugcaaaga

SEQ ID NO: 857203 - RNA, 19 nt, Homo sapiens
ugaccaagcccgaacacua

SEQ ID NO: 857204 - RNA, 19 nt, Homo sapiens
caugacaacucaagaggau

SEQ ID NO: 857205 - RNA, 19 nt, Homo sapiens
cugaaagucuaggauauuu

SEQ ID NO: 857206 - RNA, 19 nt, Homo sapiens
gcucugaaagucuaggaua

SEQ ID NO: 857207 - RNA, 19 nt, Homo sapiens
ccauaaagcgcccaacaga

SEQ ID NO: 857208 - RNA, 19 nt, Homo sapiens
gaagaucagaggaaagcuu

SEQ ID NO: 857209 - RNA, 19 nt, Homo sapiens
ggaaccagaacaauucgaa

SEQ ID NO: 857210 - RNA, 19 nt, Homo sapiens
gaacuccuacuucauagca

SEQ ID NO: 857211 - RNA, 19 nt, Homo sapiens
gguaaugaacuccuacuuc

SEQ ID NO: 857212 - RNA, 19 nt, Homo sapiens
gaagaccagcagacaaugu

SEQ ID NO: 857213 - RNA, 19 nt, Homo sapiens
gcauucugccgacccauuu

SEQ ID NO: 857214 - RNA, 19 nt, Homo sapiens
auaaagcgcccaacagaug

SEQ ID NO: 857215 - RNA, 19 nt, Homo sapiens
ggagggcacagaagggaaa

SEQ ID NO: 857216 - RNA, 19 nt, Homo sapiens
aggcaagguuucaguauca

SEQ ID NO: 857217 - RNA, 19 nt, Homo sapiens
agaagguaaugaacuccua

SEQ ID NO: 857218 - RNA, 19 nt, Homo sapiens
gucccuggcuuaacucaga

SEQ ID NO: 857219 - RNA, 19 nt, Homo sapiens
gcaggugcucaauaaauau

SEQ ID NO: 857220 - RNA, 19 nt, Homo sapiens
ggauuucucccuuucuuca

SEQ ID NO: 857221 - RNA, 19 nt, Homo sapiens
ggauuccugccacaccuua

SEQ ID NO: 857222 - RNA, 19 nt, Homo sapiens
ccacuuacuagcucugaaa

SEQ ID NO: 857223 - RNA, 19 nt, Homo sapiens
gcuacuacgcugucucuug

SEQ ID NO: 857224 - RNA, 19 nt, Homo sapiens
uaaagcgcccaacagauga

SEQ ID NO: 857225 - RNA, 19 nt, Homo sapiens
gaaagucuaggauauuuug

SEQ ID NO: 857226 - RNA, 19 nt, Homo sapiens
gggagcaccacuaugcaaa

SEQ ID NO: 857227 - RNA, 19 nt, Homo sapiens
acaagucuuuggaccaugu

SEQ ID NO: 857228 - RNA, 19 nt, Homo sapiens
gcccgaacacuaaaucaau

SEQ ID NO: 857229 - RNA, 19 nt, Homo sapiens
acacagggagcaccacuau

SEQ ID NO: 857230 - RNA, 19 nt, Homo sapiens
uacuagcucugaaagucua

SEQ ID NO: 857231 - RNA, 19 nt, Homo sapiens
aaaugggaaugaugcuuuc

SEQ ID NO: 857232 - RNA, 19 nt, Homo sapiens
cccgaacacuaaaucaaug

SEQ ID NO: 857233 - RNA, 19 nt, Homo sapiens
caaccugacuucuuuugga

SEQ ID NO: 857234 - RNA, 19 nt, Homo sapiens
uacgcugucucuugguuaa

SEQ ID NO: 857235 - RNA, 19 nt, Homo sapiens
uggcuuaacucagaaagag

SEQ ID NO: 857236 - RNA, 19 nt, Homo sapiens
uaaggcaagguuucaguau

SEQ ID NO: 857237 - RNA, 19 nt, Homo sapiens
acaacagggcugcaucaaa

SEQ ID NO: 857238 - RNA, 19 nt, Homo sapiens
agauggaaccagaacaauu

SEQ ID NO: 857239 - RNA, 19 nt, Homo sapiens
cuuacuagcucugaaaguc

SEQ ID NO: 857240 - RNA, 19 nt, Homo sapiens
gagggagccaggaagauca

SEQ ID NO: 857241 - RNA, 19 nt, Homo sapiens
caaagaccucaucacauuc

SEQ ID NO: 857242 - RNA, 19 nt, Homo sapiens
aagaucagaggaaagcuuu

SEQ ID NO: 857243 - RNA, 19 nt, Homo sapiens
uggaagaccagcagacaau

SEQ ID NO: 857244 - RNA, 19 nt, Homo sapiens
aaagaccucaucacauuca

SEQ ID NO: 857245 - RNA, 19 nt, Homo sapiens
uuaaggcaagguuucagua

SEQ ID NO: 857246 - RNA, 19 nt, Homo sapiens
gcgaagaagguaaugaacu

SEQ ID NO: 857247 - RNA, 19 nt, Homo sapiens
aaugaugcuuuccuuguag

SEQ ID NO: 857248 - RNA, 19 nt, Homo sapiens
cauuucagucccuggcuua

SEQ ID NO: 857249 - RNA, 19 nt, Homo sapiens
caccuuacauuagcaacau

SEQ ID NO: 857250 - RNA, 19 nt, Homo sapiens
ggaagaccagcagacaaug

SEQ ID NO: 857251 - RNA, 19 nt, Homo sapiens
cauaaagcgcccaacagau

SEQ ID NO: 857252 - RNA, 19 nt, Homo sapiens
caaaaugcagccucuaaga

SEQ ID NO: 857253 - RNA, 19 nt, Homo sapiens
ccugccacaccuuacauua

SEQ ID NO: 857254 - RNA, 19 nt, Homo sapiens
gagcaaaacagaucggaau

SEQ ID NO: 857255 - RNA, 19 nt, Homo sapiens
ggagcgaagaagguaauga

SEQ ID NO: 857256 - RNA, 19 nt, Homo sapiens
aaacgagugaugccgaaga

SEQ ID NO: 857257 - RNA, 19 nt, Homo sapiens
ggcaagguuucaguaucaa

SEQ ID NO: 857258 - RNA, 19 nt, Homo sapiens
gagcagagcaaaacagauc

SEQ ID NO: 857259 - RNA, 19 nt, Homo sapiens
gagaaaaccagcugagaca

SEQ ID NO: 857260 - RNA, 19 nt, Homo sapiens
ugacaacucaagaggauac

SEQ ID NO: 857261 - RNA, 19 nt, Homo sapiens
gcaaaacagaucggaauug

SEQ ID NO: 857262 - RNA, 19 nt, Homo sapiens
caaaacagaucggaauugc

SEQ ID NO: 857263 - RNA, 19 nt, Homo sapiens
gccaggaagaucagaggaa

SEQ ID NO: 857264 - RNA, 19 nt, Homo sapiens
aaggcaagguuucaguauc

SEQ ID NO: 857265 - RNA, 19 nt, Homo sapiens
gcuccuggguacauuccau

SEQ ID NO: 857266 - RNA, 19 nt, Homo sapiens
ucugaaagucuaggauauu

SEQ ID NO: 857267 - RNA, 19 nt, Homo sapiens
caacucaagaggauacaac

SEQ ID NO: 857268 - RNA, 19 nt, Homo sapiens
caaaugacugaaugcaucu

SEQ ID NO: 857269 - RNA, 19 nt, Homo sapiens
ggaagauggaaccagaaca

SEQ ID NO: 857270 - RNA, 19 nt, Homo sapiens
cuacgcugucucuugguua

SEQ ID NO: 857271 - RNA, 19 nt, Homo sapiens
ggagcaccacuaugcaaag

SEQ ID NO: 857272 - RNA, 19 nt, Homo sapiens
acagggagcaccacuaugc

SEQ ID NO: 857273 - RNA, 19 nt, Homo sapiens
cuggauuucucccuuucuu

SEQ ID NO: 857274 - RNA, 19 nt, Homo sapiens
caagaccuggagcgaagaa

SEQ ID NO: 857275 - RNA, 19 nt, Homo sapiens
gcccaacagaugagcauuc

SEQ ID NO: 857276 - RNA, 19 nt, Homo sapiens
gaaaguggacaucuuauua

SEQ ID NO: 857277 - RNA, 19 nt, Homo sapiens
ggaagagaguaucauauaa

SEQ ID NO: 857278 - RNA, 19 nt, Homo sapiens
acacacaugucccagaaua

SEQ ID NO: 857279 - RNA, 19 nt, Homo sapiens
gcaggccucucucuucuug

SEQ ID NO: 857280 - RNA, 19 nt, Homo sapiens
ccacaacaacacuauauuu

SEQ ID NO: 857281 - RNA, 19 nt, Homo sapiens
aaacacacaugucccagaa

SEQ ID NO: 857282 - RNA, 19 nt, Homo sapiens
ggauguggcugagugcuuu

SEQ ID NO: 857283 - RNA, 19 nt, Homo sapiens
gcugaaaguggacaucuua

SEQ ID NO: 857284 - RNA, 19 nt, Homo sapiens
aauagaaggugacauggaa

SEQ ID NO: 857285 - RNA, 19 nt, Homo sapiens
gcaccagccuuccacaaca

SEQ ID NO: 857286 - RNA, 19 nt, Homo sapiens
ucuccaaccugcauucuuu

SEQ ID NO: 857287 - RNA, 19 nt, Homo sapiens
uggaagagaguaucauaua

SEQ ID NO: 857288 - RNA, 19 nt, Homo sapiens
gaagggagcacuggcuuug

SEQ ID NO: 857289 - RNA, 19 nt, Homo sapiens
guggacaucuuauuagaca

SEQ ID NO: 857290 - RNA, 19 nt, Homo sapiens
gcggcucucuuggcucuua

SEQ ID NO: 857291 - RNA, 19 nt, Homo sapiens
uauuagacaugcuuucaga

SEQ ID NO: 857292 - RNA, 19 nt, Homo sapiens
agaaggaacuggaugaacu

SEQ ID NO: 857293 - RNA, 19 nt, Homo sapiens
ggacaucuuauuagacaug

SEQ ID NO: 857294 - RNA, 19 nt, Homo sapiens
gggagaagcggcuggaguu

SEQ ID NO: 857295 - RNA, 19 nt, Homo sapiens
caaccugcauucuuuggau

SEQ ID NO: 857296 - RNA, 19 nt, Homo sapiens
gaaaauggccaguggauag

SEQ ID NO: 857297 - RNA, 19 nt, Homo sapiens
gcacuggcuuugcuuucau

SEQ ID NO: 857298 - RNA, 19 nt, Homo sapiens
ggcaauagaaggugacaug

SEQ ID NO: 857299 - RNA, 19 nt, Homo sapiens
ugaaaguggacaucuuauu

SEQ ID NO: 857300 - RNA, 19 nt, Homo sapiens
ucucucuucuugccuuuaa

SEQ ID NO: 857301 - RNA, 19 nt, Homo sapiens
gaauacggauccccgacua

SEQ ID NO: 857302 - RNA, 19 nt, Homo sapiens
gaaggaacuggaugaacug

SEQ ID NO: 857303 - RNA, 19 nt, Homo sapiens
ggagaaggaacuggaugaa

SEQ ID NO: 857304 - RNA, 19 nt, Homo sapiens
cggauucaguccuggaaga

SEQ ID NO: 857305 - RNA, 19 nt, Homo sapiens
gagcugggcuuggaauacg

SEQ ID NO: 857306 - RNA, 19 nt, Homo sapiens
ccacacacaagcucgcaaa

SEQ ID NO: 857307 - RNA, 19 nt, Homo sapiens
gaaggugacauggaaugga

SEQ ID NO: 857308 - RNA, 19 nt, Homo sapiens
caauagaaggugacaugga

SEQ ID NO: 857309 - RNA, 19 nt, Homo sapiens
aaguggacaucuuauuaga

SEQ ID NO: 857310 - RNA, 19 nt, Homo sapiens
caccagccuuccacaacaa

SEQ ID NO: 857311 - RNA, 19 nt, Homo sapiens
agaagcggcuggaguucau

SEQ ID NO: 857312 - RNA, 19 nt, Homo sapiens
ccuggaagagaguaucaua

SEQ ID NO: 857313 - RNA, 19 nt, Homo sapiens
uuaugcuacuuuccuguuu

SEQ ID NO: 857314 - RNA, 19 nt, Homo sapiens
gagaagcggcuggaguuca

SEQ ID NO: 857315 - RNA, 19 nt, Homo sapiens
ggaucagccggaagagaaa

SEQ ID NO: 857316 - RNA, 19 nt, Homo sapiens
aaaguggacaucuuauuag

SEQ ID NO: 857317 - RNA, 19 nt, Homo sapiens
cacacaagcucgcaaacac

SEQ ID NO: 857318 - RNA, 19 nt, Homo sapiens
uaugcuacuuuccuguuug

SEQ ID NO: 857319 - RNA, 19 nt, Homo sapiens
ggcugaaaguggacaucuu

SEQ ID NO: 857320 - RNA, 19 nt, Homo sapiens
gaaccagcaguuggaggaa

SEQ ID NO: 857321 - RNA, 19 nt, Homo sapiens
cggcaucucucuccaaccu

SEQ ID NO: 857322 - RNA, 19 nt, Homo sapiens
gcaguuggaggaagagaac

SEQ ID NO: 857323 - RNA, 19 nt, Homo sapiens
gcaggcggaaccagcaguu

SEQ ID NO: 857324 - RNA, 19 nt, Homo sapiens
aggaucagccggaagagaa

SEQ ID NO: 857325 - RNA, 19 nt, Homo sapiens
cggcuggaguucauucucu

SEQ ID NO: 857326 - RNA, 19 nt, Homo sapiens
gaggaucagccggaagaga

SEQ ID NO: 857327 - RNA, 19 nt, Homo sapiens
uagaaggugacauggaaug

SEQ ID NO: 857328 - RNA, 19 nt, Homo sapiens
ggagaagcggcuggaguuc

SEQ ID NO: 857329 - RNA, 19 nt, Homo sapiens
gaagaccccagagacauuu

SEQ ID NO: 857330 - RNA, 19 nt, Homo sapiens
caucuuauuagacaugcuu

SEQ ID NO: 857331 - RNA, 19 nt, Homo sapiens
uggagaaggaacuggauga

SEQ ID NO: 857332 - RNA, 19 nt, Homo sapiens
ccacuuaauggagaaggaa

SEQ ID NO: 857333 - RNA, 19 nt, Homo sapiens
gcugaaucccacuuaaugg

SEQ ID NO: 857334 - RNA, 19 nt, Homo sapiens
ggagaaagcugcaaugaau

SEQ ID NO: 857335 - RNA, 19 nt, Homo sapiens
aaagauaccuggauguuua

SEQ ID NO: 857336 - RNA, 19 nt, Homo sapiens
gcaaugauaugcauguuaa

SEQ ID NO: 857337 - RNA, 19 nt, Homo sapiens
ugacaggaaugaucuauua

SEQ ID NO: 857338 - RNA, 19 nt, Homo sapiens
gaacacagaagcuuuauuu

SEQ ID NO: 857339 - RNA, 19 nt, Homo sapiens
ggaagaaacguguuaauaa

SEQ ID NO: 857340 - RNA, 19 nt, Homo sapiens
cgugaaagcucuccuaaua

SEQ ID NO: 857341 - RNA, 19 nt, Homo sapiens
gaaacugccuuccacaauu

SEQ ID NO: 857342 - RNA, 19 nt, Homo sapiens
acaaagaacuggaaugaaa

SEQ ID NO: 857343 - RNA, 19 nt, Homo sapiens
ggaaugaaaugacagaguu

SEQ ID NO: 857344 - RNA, 19 nt, Homo sapiens
caaaguaguuccagugauu

SEQ ID NO: 857345 - RNA, 19 nt, Homo sapiens
gaaugccucucaccacuua

SEQ ID NO: 857346 - RNA, 19 nt, Homo sapiens
gaaguuuccugcagaguuu

SEQ ID NO: 857347 - RNA, 19 nt, Homo sapiens
gcauugagauguuugauga

SEQ ID NO: 857348 - RNA, 19 nt, Homo sapiens
gcaaacagcaaucuaagua

SEQ ID NO: 857349 - RNA, 19 nt, Homo sapiens
gaagucaucacaaaguuua

SEQ ID NO: 857350 - RNA, 19 nt, Homo sapiens
aaacugccuuccacaauua

SEQ ID NO: 857351 - RNA, 19 nt, Homo sapiens
gcaaagaccuccugguucu

SEQ ID NO: 857352 - RNA, 19 nt, Homo sapiens
gggcagaagucaucacaaa

SEQ ID NO: 857353 - RNA, 19 nt, Homo sapiens
gaucuugguuugauucgua

SEQ ID NO: 857354 - RNA, 19 nt, Homo sapiens
gggcuaaaguguauauauu

SEQ ID NO: 857355 - RNA, 19 nt, Homo sapiens
gaacuggaaugaaaugaca

SEQ ID NO: 857356 - RNA, 19 nt, Homo sapiens
gaugugaaguuaucaguug

SEQ ID NO: 857357 - RNA, 19 nt, Homo sapiens
cuacacaguugcuaugaua

SEQ ID NO: 857358 - RNA, 19 nt, Homo sapiens
acacaagucuuaccaauuc

SEQ ID NO: 857359 - RNA, 19 nt, Homo sapiens
gcacuaacaucgcugacuu

SEQ ID NO: 857360 - RNA, 19 nt, Homo sapiens
gcacuugcauugagauguu

SEQ ID NO: 857361 - RNA, 19 nt, Homo sapiens
gauguugguuucauguaua

SEQ ID NO: 857362 - RNA, 19 nt, Homo sapiens
uaagauuccugaaguagaa

SEQ ID NO: 857363 - RNA, 19 nt, Homo sapiens
gaccagaacuuaacauuuu

SEQ ID NO: 857364 - RNA, 19 nt, Homo sapiens
gagacuauccuuucaauau

SEQ ID NO: 857365 - RNA, 19 nt, Homo sapiens
uaacaucgcugacuugcau

SEQ ID NO: 857366 - RNA, 19 nt, Homo sapiens
aagaugaaaugauggcuua

SEQ ID NO: 857367 - RNA, 19 nt, Homo sapiens
cgacugcgauggcuucaaa

SEQ ID NO: 857368 - RNA, 19 nt, Homo sapiens
uuaaagaucugcuacuuca

SEQ ID NO: 857369 - RNA, 19 nt, Homo sapiens
ccaaccagauuuacagauu

SEQ ID NO: 857370 - RNA, 19 nt, Homo sapiens
caaagacuguguuauguag

SEQ ID NO: 857371 - RNA, 19 nt, Homo sapiens
gagaauugacccuaacuaa

SEQ ID NO: 857372 - RNA, 19 nt, Homo sapiens
caggauggccuaauuagua

SEQ ID NO: 857373 - RNA, 19 nt, Homo sapiens
ggaaauuaguggagucugu

SEQ ID NO: 857374 - RNA, 19 nt, Homo sapiens
gagaaacucugaagaaagc

SEQ ID NO: 857375 - RNA, 19 nt, Homo sapiens
gaucaggauggccuaauua

SEQ ID NO: 857376 - RNA, 19 nt, Homo sapiens
ggacagaggagaacaaagu

SEQ ID NO: 857377 - RNA, 19 nt, Homo sapiens
guauuuaucuuccacugaa

SEQ ID NO: 857378 - RNA, 19 nt, Homo sapiens
gcagugauucuucuaauga

SEQ ID NO: 857379 - RNA, 19 nt, Homo sapiens
gaagaaagggaacacagaa

SEQ ID NO: 857380 - RNA, 19 nt, Homo sapiens
gaaagauaccuggauguuu

SEQ ID NO: 857381 - RNA, 19 nt, Homo sapiens
ggaucucauucacugauua

SEQ ID NO: 857382 - RNA, 19 nt, Homo sapiens
gauuaaagaucugcuacuu

SEQ ID NO: 857383 - RNA, 19 nt, Homo sapiens
ggagagagaacuugauuca

SEQ ID NO: 857384 - RNA, 19 nt, Homo sapiens
gaaagcagcaacauuagau

SEQ ID NO: 857385 - RNA, 19 nt, Homo sapiens
gacagagaauugacccuaa

SEQ ID NO: 857386 - RNA, 19 nt, Homo sapiens
ggaccagaacuuaacauuu

SEQ ID NO: 857387 - RNA, 19 nt, Homo sapiens
gcaaagggcagaagucauc

SEQ ID NO: 857388 - RNA, 19 nt, Homo sapiens
gguacuggauucugaaguu

SEQ ID NO: 857389 - RNA, 19 nt, Homo sapiens
cuacuacuauccauaaaug

SEQ ID NO: 857390 - RNA, 19 nt, Homo sapiens
gaaaguauagcugccaauu

SEQ ID NO: 857391 - RNA, 19 nt, Homo sapiens
ugggaaagcagcaacauua

SEQ ID NO: 857392 - RNA, 19 nt, Homo sapiens
gcuacuaggugaaaugcaa

SEQ ID NO: 857393 - RNA, 19 nt, Homo sapiens
cuaggaagcucaucagaca

SEQ ID NO: 857394 - RNA, 19 nt, Homo sapiens
gcaaggauacaaaugcaaa

SEQ ID NO: 857395 - RNA, 19 nt, Homo sapiens
ucgcugacuugcaugauua

SEQ ID NO: 857396 - RNA, 19 nt, Homo sapiens
gaacgugccaucuguaaag

SEQ ID NO: 857397 - RNA, 19 nt, Homo sapiens
caaccagauuuacagauug

SEQ ID NO: 857398 - RNA, 19 nt, Homo sapiens
ggaauuuguuuguauuugg

SEQ ID NO: 857399 - RNA, 19 nt, Homo sapiens
gcaaaacaaccaucaauuu

SEQ ID NO: 857400 - RNA, 19 nt, Homo sapiens
aaagcucuccuaauacuua

SEQ ID NO: 857401 - RNA, 19 nt, Homo sapiens
gacccuaacuaacuaugaa

SEQ ID NO: 857402 - RNA, 19 nt, Homo sapiens
ggaaagauaccuggauguu

SEQ ID NO: 857403 - RNA, 19 nt, Homo sapiens
gaaauuaguggagucugua

SEQ ID NO: 857404 - RNA, 19 nt, Homo sapiens
gcacauaaggaaauuagug

SEQ ID NO: 857405 - RNA, 19 nt, Homo sapiens
ggaguacacuugaaagacu

SEQ ID NO: 857406 - RNA, 19 nt, Homo sapiens
caacggcaauuacugcaau

SEQ ID NO: 857407 - RNA, 19 nt, Homo sapiens
uaauuuggaucuugguuug

SEQ ID NO: 857408 - RNA, 19 nt, Homo sapiens
gaauugacccuaacuaacu

SEQ ID NO: 857409 - RNA, 19 nt, Homo sapiens
caacauggauuugaucaac

SEQ ID NO: 857410 - RNA, 19 nt, Homo sapiens
guacuggauucugaaguuu

SEQ ID NO: 857411 - RNA, 19 nt, Homo sapiens
gcauuaaggcaaaguaguu

SEQ ID NO: 857412 - RNA, 19 nt, Homo sapiens
ucauguaucuuucucuaga

SEQ ID NO: 857413 - RNA, 19 nt, Homo sapiens
ggaccucuaucacacugaa

SEQ ID NO: 857414 - RNA, 19 nt, Homo sapiens
gagaacaaagugaacauug

SEQ ID NO: 857415 - RNA, 19 nt, Homo sapiens
gagaacgugccaucuguaa

SEQ ID NO: 857416 - RNA, 19 nt, Homo sapiens
cagaugaugugaaguuauc

SEQ ID NO: 857417 - RNA, 19 nt, Homo sapiens
gggcaggucccacgcuaua

SEQ ID NO: 857418 - RNA, 19 nt, Homo sapiens
ugaaagcucuccuaauacu

SEQ ID NO: 857419 - RNA, 19 nt, Homo sapiens
gaaacugaaggcaauaaug

SEQ ID NO: 857420 - RNA, 19 nt, Homo sapiens
caaagacuguggagccaau

SEQ ID NO: 857421 - RNA, 19 nt, Homo sapiens
cagaagucaucacaaaguu

SEQ ID NO: 857422 - RNA, 19 nt, Homo sapiens
aaacuucucugcauguauc

SEQ ID NO: 857423 - RNA, 19 nt, Homo sapiens
aaacagcaaucuaaguaca

SEQ ID NO: 857424 - RNA, 19 nt, Homo sapiens
gaaauacugcagaugaugu

SEQ ID NO: 857425 - RNA, 19 nt, Homo sapiens
gcaaaguaguuccagugau

SEQ ID NO: 857426 - RNA, 19 nt, Homo sapiens
ucacacaagucuuaccaau

SEQ ID NO: 857427 - RNA, 19 nt, Homo sapiens
gaacaguuaacaaggaguu

SEQ ID NO: 857428 - RNA, 19 nt, Homo sapiens
gcagaagucaucacaaagu

SEQ ID NO: 857429 - RNA, 19 nt, Homo sapiens
ggaaagcagcaacauuaga

SEQ ID NO: 857430 - RNA, 19 nt, Homo sapiens
gaagaaaauucaggaagaa

SEQ ID NO: 857431 - RNA, 19 nt, Homo sapiens
gaggagagagaacuugauu

SEQ ID NO: 857432 - RNA, 19 nt, Homo sapiens
acaaggaguuuauuuagag

SEQ ID NO: 857433 - RNA, 19 nt, Homo sapiens
gaaguaauaagaagaaagg

SEQ ID NO: 857434 - RNA, 19 nt, Homo sapiens
ggagaaagcugcaaugaau

SEQ ID NO: 857435 - RNA, 19 nt, Homo sapiens
aaagauaccuggauguuua

SEQ ID NO: 857436 - RNA, 19 nt, Homo sapiens
ugacaggaaugaucuauua

SEQ ID NO: 857437 - RNA, 19 nt, Homo sapiens
ggaagaaacguguuaauaa

SEQ ID NO: 857438 - RNA, 19 nt, Homo sapiens
cgugaaagcucuccuaaua

SEQ ID NO: 857439 - RNA, 19 nt, Homo sapiens
gaaacugccuuccacaauu

SEQ ID NO: 857440 - RNA, 19 nt, Homo sapiens
acaaagaacuggaaugaaa

SEQ ID NO: 857441 - RNA, 19 nt, Homo sapiens
ggaaugaaaugacagaguu

SEQ ID NO: 857442 - RNA, 19 nt, Homo sapiens
caaaguaguuccagugauu

SEQ ID NO: 857443 - RNA, 19 nt, Homo sapiens
gaaugccucucaccacuua

SEQ ID NO: 857444 - RNA, 19 nt, Homo sapiens
gaaguuuccugcagaguuu

SEQ ID NO: 857445 - RNA, 19 nt, Homo sapiens
gcauugagauguuugauga

SEQ ID NO: 857446 - RNA, 19 nt, Homo sapiens
gcaaacagcaaucuaagua

SEQ ID NO: 857447 - RNA, 19 nt, Homo sapiens
gaagucaucacaaaguuua

SEQ ID NO: 857448 - RNA, 19 nt, Homo sapiens
aaacugccuuccacaauua

SEQ ID NO: 857449 - RNA, 19 nt, Homo sapiens
gcaaagaccuccugguucu

SEQ ID NO: 857450 - RNA, 19 nt, Homo sapiens
gggcagaagucaucacaaa

SEQ ID NO: 857451 - RNA, 19 nt, Homo sapiens
gaucuugguuugauucgua

SEQ ID NO: 857452 - RNA, 19 nt, Homo sapiens
gggcuaaaguguauauauu

SEQ ID NO: 857453 - RNA, 19 nt, Homo sapiens
gaacuggaaugaaaugaca

SEQ ID NO: 857454 - RNA, 19 nt, Homo sapiens
gaugugaaguuaucaguug

SEQ ID NO: 857455 - RNA, 19 nt, Homo sapiens
cuacacaguugcuaugaua

SEQ ID NO: 857456 - RNA, 19 nt, Homo sapiens
acacaagucuuaccaauuc

SEQ ID NO: 857457 - RNA, 19 nt, Homo sapiens
gcacuaacaucgcugacuu

SEQ ID NO: 857458 - RNA, 19 nt, Homo sapiens
gcacuugcauugagauguu

SEQ ID NO: 857459 - RNA, 19 nt, Homo sapiens
gaugcuaacugcccuuaaa

SEQ ID NO: 857460 - RNA, 19 nt, Homo sapiens
gauguugguuucauguaua

SEQ ID NO: 857461 - RNA, 19 nt, Homo sapiens
uaagauuccugaaguagaa

SEQ ID NO: 857462 - RNA, 19 nt, Homo sapiens
gaccagaacuuaacauuuu

SEQ ID NO: 857463 - RNA, 19 nt, Homo sapiens
gagacuauccuuucaauau

SEQ ID NO: 857464 - RNA, 19 nt, Homo sapiens
uaacaucgcugacuugcau

SEQ ID NO: 857465 - RNA, 19 nt, Homo sapiens
aagaugaaaugauggcuua

SEQ ID NO: 857466 - RNA, 19 nt, Homo sapiens
cgacugcgauggcuucaaa

SEQ ID NO: 857467 - RNA, 19 nt, Homo sapiens
uuaaagaucugcuacuuca

SEQ ID NO: 857468 - RNA, 19 nt, Homo sapiens
ccaaccagauuuacagauu

SEQ ID NO: 857469 - RNA, 19 nt, Homo sapiens
caaagacuguguuauguag

SEQ ID NO: 857470 - RNA, 19 nt, Homo sapiens
gagaauugacccuaacuaa

SEQ ID NO: 857471 - RNA, 19 nt, Homo sapiens
caggauggccuaauuagua

SEQ ID NO: 857472 - RNA, 19 nt, Homo sapiens
ggaaauuaguggagucugu

SEQ ID NO: 857473 - RNA, 19 nt, Homo sapiens
gagaaacucugaagaaagc

SEQ ID NO: 857474 - RNA, 19 nt, Homo sapiens
gaucaggauggccuaauua

SEQ ID NO: 857475 - RNA, 19 nt, Homo sapiens
ggacagaggagaacaaagu

SEQ ID NO: 857476 - RNA, 19 nt, Homo sapiens
guauuuaucuuccacugaa

SEQ ID NO: 857477 - RNA, 19 nt, Homo sapiens
gcagugauucuucuaauga

SEQ ID NO: 857478 - RNA, 19 nt, Homo sapiens
gugaugaaguggaaagaaa

SEQ ID NO: 857479 - RNA, 19 nt, Homo sapiens
gaaagauaccuggauguuu

SEQ ID NO: 857480 - RNA, 19 nt, Homo sapiens
ggaucucauucacugauua

SEQ ID NO: 857481 - RNA, 19 nt, Homo sapiens
gauuaaagaucugcuacuu

SEQ ID NO: 857482 - RNA, 19 nt, Homo sapiens
ggagagagaacuugauuca

SEQ ID NO: 857483 - RNA, 19 nt, Homo sapiens
gaaagcagcaacauuagau

SEQ ID NO: 857484 - RNA, 19 nt, Homo sapiens
gacagagaauugacccuaa

SEQ ID NO: 857485 - RNA, 19 nt, Homo sapiens
ggaccagaacuuaacauuu

SEQ ID NO: 857486 - RNA, 19 nt, Homo sapiens
gcaaagggcagaagucauc

SEQ ID NO: 857487 - RNA, 19 nt, Homo sapiens
gguacuggauucugaaguu

SEQ ID NO: 857488 - RNA, 19 nt, Homo sapiens
cuacuacuauccauaaaug

SEQ ID NO: 857489 - RNA, 19 nt, Homo sapiens
gaaaguauagcugccaauu

SEQ ID NO: 857490 - RNA, 19 nt, Homo sapiens
ugggaaagcagcaacauua

SEQ ID NO: 857491 - RNA, 19 nt, Homo sapiens
gcuacuaggugaaaugcaa

SEQ ID NO: 857492 - RNA, 19 nt, Homo sapiens
cuaggaagcucaucagaca

SEQ ID NO: 857493 - RNA, 19 nt, Homo sapiens
gaacuagauuugggcaaug

SEQ ID NO: 857494 - RNA, 19 nt, Homo sapiens
gcaaggauacaaaugcaaa

SEQ ID NO: 857495 - RNA, 19 nt, Homo sapiens
ucgcugacuugcaugauua

SEQ ID NO: 857496 - RNA, 19 nt, Homo sapiens
ccauuuggauucucugauu

SEQ ID NO: 857497 - RNA, 19 nt, Homo sapiens
gaucaacauuauugcaguu

SEQ ID NO: 857498 - RNA, 19 nt, Homo sapiens
gaacgugccaucuguaaag

SEQ ID NO: 857499 - RNA, 19 nt, Homo sapiens
caaccagauuuacagauug

SEQ ID NO: 857500 - RNA, 19 nt, Homo sapiens
ggaauuuguuuguauuugg

SEQ ID NO: 857501 - RNA, 19 nt, Homo sapiens
gcaaaacaaccaucaauuu

SEQ ID NO: 857502 - RNA, 19 nt, Homo sapiens
aaagcucuccuaauacuua

SEQ ID NO: 857503 - RNA, 19 nt, Homo sapiens
gacccuaacuaacuaugaa

SEQ ID NO: 857504 - RNA, 19 nt, Homo sapiens
ggaaagauaccuggauguu

SEQ ID NO: 857505 - RNA, 19 nt, Homo sapiens
gaaauuaguggagucugua

SEQ ID NO: 857506 - RNA, 19 nt, Homo sapiens
gcacauaaggaaauuagug

SEQ ID NO: 857507 - RNA, 19 nt, Homo sapiens
ggaguacacuugaaagacu

SEQ ID NO: 857508 - RNA, 19 nt, Homo sapiens
cuuagcagcuucaauguug

SEQ ID NO: 857509 - RNA, 19 nt, Homo sapiens
caacggcaauuacugcaau

SEQ ID NO: 857510 - RNA, 19 nt, Homo sapiens
uaauuuggaucuugguuug

SEQ ID NO: 857511 - RNA, 19 nt, Homo sapiens
gaauugacccuaacuaacu

SEQ ID NO: 857512 - RNA, 19 nt, Homo sapiens
caacauggauuugaucaac

SEQ ID NO: 857513 - RNA, 19 nt, Homo sapiens
guacuggauucugaaguuu

SEQ ID NO: 857514 - RNA, 19 nt, Homo sapiens
gaagacagaacaggaauuc

SEQ ID NO: 857515 - RNA, 19 nt, Homo sapiens
gcauuaaggcaaaguaguu

SEQ ID NO: 857516 - RNA, 19 nt, Homo sapiens
ucauguaucuuucucuaga

SEQ ID NO: 857517 - RNA, 19 nt, Homo sapiens
ggaccucuaucacacugaa

SEQ ID NO: 857518 - RNA, 19 nt, Homo sapiens
gagaacaaagugaacauug

SEQ ID NO: 857519 - RNA, 19 nt, Homo sapiens
cuauagggaucaacauuau

SEQ ID NO: 857520 - RNA, 19 nt, Homo sapiens
gagaacgugccaucuguaa

SEQ ID NO: 857521 - RNA, 19 nt, Homo sapiens
cagaugaugugaaguuauc

SEQ ID NO: 857522 - RNA, 19 nt, Homo sapiens
gggcaggucccacgcuaua

SEQ ID NO: 857523 - RNA, 19 nt, Homo sapiens
ugaaagcucuccuaauacu

SEQ ID NO: 857524 - RNA, 19 nt, Homo sapiens
gaaacugaaggcaauaaug

SEQ ID NO: 857525 - RNA, 19 nt, Homo sapiens
caaagacuguggagccaau

SEQ ID NO: 857526 - RNA, 19 nt, Homo sapiens
cagaagucaucacaaaguu

SEQ ID NO: 857527 - RNA, 19 nt, Homo sapiens
aaacuucucugcauguauc

SEQ ID NO: 857528 - RNA, 19 nt, Homo sapiens
ugauuucacugccaagauu

SEQ ID NO: 857529 - RNA, 19 nt, Homo sapiens
aaacagcaaucuaaguaca

SEQ ID NO: 857530 - RNA, 19 nt, Homo sapiens
gaaacuugcuagaggugau

SEQ ID NO: 857531 - RNA, 19 nt, Homo sapiens
gaaauacugcagaugaugu

SEQ ID NO: 857532 - RNA, 19 nt, Homo sapiens
gcaaaguaguuccagugau

SEQ ID NO: 857533 - RNA, 19 nt, Homo sapiens
ucacacaagucuuaccaau

SEQ ID NO: 857534 - RNA, 19 nt, Homo sapiens
gcaagaagcugccuaacaa

SEQ ID NO: 857535 - RNA, 19 nt, Homo sapiens
gauaaauacugccaaauug

SEQ ID NO: 857536 - RNA, 19 nt, Homo sapiens
gcagugagcugagauggua

SEQ ID NO: 857537 - RNA, 19 nt, Homo sapiens
gcagugagcugaaauugug

SEQ ID NO: 857538 - RNA, 19 nt, Homo sapiens
gagcauggcuuaacuagca

SEQ ID NO: 857539 - RNA, 19 nt, Homo sapiens
gagcugaaauugugcuauu

SEQ ID NO: 857540 - RNA, 19 nt, Homo sapiens
gguauaaguugcagaaaug

SEQ ID NO: 857541 - RNA, 19 nt, Homo sapiens
uauauaagguccaagcuuu

SEQ ID NO: 857542 - RNA, 19 nt, Homo sapiens
caucaagacuucacaccua

SEQ ID NO: 857543 - RNA, 19 nt, Homo sapiens
gcagugagcuauuauugca

SEQ ID NO: 857544 - RNA, 19 nt, Homo sapiens
gaacaacacagaccugaug

SEQ ID NO: 857545 - RNA, 19 nt, Homo sapiens
guuagaaugugcauaaguu

SEQ ID NO: 857546 - RNA, 19 nt, Homo sapiens
gaaggaaacucugauuggu

SEQ ID NO: 857547 - RNA, 19 nt, Homo sapiens
gcucuucgcucgugucugu

SEQ ID NO: 857548 - RNA, 19 nt, Homo sapiens
aaagagggcaagaucauua

SEQ ID NO: 857549 - RNA, 19 nt, Homo sapiens
ugucugaguuugaaaguuu

SEQ ID NO: 857550 - RNA, 19 nt, Homo sapiens
gaaacccugucuguacuaa

SEQ ID NO: 857551 - RNA, 19 nt, Homo sapiens
gagaucagccuggccaaua

SEQ ID NO: 857552 - RNA, 19 nt, Homo sapiens
ggaucuguccuuucucuua

SEQ ID NO: 857553 - RNA, 19 nt, Homo sapiens
gaaagggaaggaaauguau

SEQ ID NO: 857554 - RNA, 19 nt, Homo sapiens
gggaggauuuacagcauaa

SEQ ID NO: 857555 - RNA, 19 nt, Homo sapiens
ccaaguagcugggauuaag

SEQ ID NO: 857556 - RNA, 19 nt, Homo sapiens
ugaaggagaucaccaacug

SEQ ID NO: 857557 - RNA, 19 nt, Homo sapiens
caagaaggcagccaaguug

SEQ ID NO: 857558 - RNA, 19 nt, Homo sapiens
gugauagacucaaacauuc

SEQ ID NO: 857559 - RNA, 19 nt, Homo sapiens
ggaaugggcugugauagac

SEQ ID NO: 857560 - RNA, 19 nt, Homo sapiens
cacccucucugauaucaua

SEQ ID NO: 857561 - RNA, 19 nt, Homo sapiens
gcacggagucugucuggaa

SEQ ID NO: 857562 - RNA, 19 nt, Homo sapiens
gaaccaaaucuguuucuuc

SEQ ID NO: 857563 - RNA, 19 nt, Homo sapiens
gagugugcccucaguguua

SEQ ID NO: 857564 - RNA, 19 nt, Homo sapiens
caaauaaugcuguggugaa

SEQ ID NO: 857565 - RNA, 19 nt, Homo sapiens
cagacuauuuccuuaggua

SEQ ID NO: 857566 - RNA, 19 nt, Homo sapiens
gagaggagggcaccaagaa

SEQ ID NO: 857567 - RNA, 19 nt, Homo sapiens
aaaguuugcucgacuguuc

SEQ ID NO: 857568 - RNA, 19 nt, Homo sapiens
gaucuguccuuucucuuag

SEQ ID NO: 857569 - RNA, 19 nt, Homo sapiens
ccaaaucuguuucuuccau

SEQ ID NO: 857570 - RNA, 19 nt, Homo sapiens
acaccuaagugcucacauu

SEQ ID NO: 857571 - RNA, 19 nt, Homo sapiens
uggcuuaacuagcagcuuu

SEQ ID NO: 857572 - RNA, 19 nt, Homo sapiens
gugaacaucuuggugcaaa

SEQ ID NO: 857573 - RNA, 19 nt, Homo sapiens
gcuaucaguuucuuauaag

SEQ ID NO: 857574 - RNA, 19 nt, Homo sapiens
caacaacaucucuacaaga

SEQ ID NO: 857575 - RNA, 19 nt, Homo sapiens
gcucugacuuuacaacauc

SEQ ID NO: 857576 - RNA, 19 nt, Homo sapiens
gugcucacauuuccucuga

SEQ ID NO: 857577 - RNA, 19 nt, Homo sapiens
ggugggaucuguccuuucu

SEQ ID NO: 857578 - RNA, 19 nt, Homo sapiens
gcagaaaugagauuaaagg

SEQ ID NO: 857579 - RNA, 19 nt, Homo sapiens
gaaagaaggaaacucugau

SEQ ID NO: 857580 - RNA, 19 nt, Homo sapiens
uaggagagacugacacaaa

SEQ ID NO: 857581 - RNA, 19 nt, Homo sapiens
ggacugggcaccaacaaca

SEQ ID NO: 857582 - RNA, 19 nt, Homo sapiens
guagguggaguuaguauau

SEQ ID NO: 857583 - RNA, 19 nt, Homo sapiens
ccaacaacaucucuacaag

SEQ ID NO: 857584 - RNA, 19 nt, Homo sapiens
uuugaaggauggcauguuu

SEQ ID NO: 857585 - RNA, 19 nt, Homo sapiens
agaaagggaaggaaaugua

SEQ ID NO: 857586 - RNA, 19 nt, Homo sapiens
gggcugugauagacucaaa

SEQ ID NO: 857587 - RNA, 19 nt, Homo sapiens
cagccugggugacauauca

SEQ ID NO: 857588 - RNA, 19 nt, Homo sapiens
aaacuaggcaugucugaga

SEQ ID NO: 857589 - RNA, 19 nt, Homo sapiens
cuacacggcuccugacaag

SEQ ID NO: 857590 - RNA, 19 nt, Homo sapiens
gaggugggcagaucacuug

SEQ ID NO: 857591 - RNA, 19 nt, Homo sapiens
caauggcucaugucucuaa

SEQ ID NO: 857592 - RNA, 19 nt, Homo sapiens
guggucaccuguaguccua

SEQ ID NO: 857593 - RNA, 19 nt, Homo sapiens
ggucaggaguuugagauca

SEQ ID NO: 857594 - RNA, 19 nt, Homo sapiens
ugugauagacucaaacauu

SEQ ID NO: 857595 - RNA, 19 nt, Homo sapiens
uacaacaucuuccaguuca

SEQ ID NO: 857596 - RNA, 19 nt, Homo sapiens
gcaggagaaucacuugaac

SEQ ID NO: 857597 - RNA, 19 nt, Homo sapiens
agaaagacaccaaggagaa

SEQ ID NO: 857598 - RNA, 19 nt, Homo sapiens
gcagaaagggaaggaaaug

SEQ ID NO: 857599 - RNA, 19 nt, Homo sapiens
caagugauccgcccaccuu

SEQ ID NO: 857600 - RNA, 19 nt, Homo sapiens
gugaugacaugaaggagau

SEQ ID NO: 857601 - RNA, 19 nt, Homo sapiens
gaagggcuguguguggaau

SEQ ID NO: 857602 - RNA, 19 nt, Homo sapiens
ugaaagaaggaaacucuga

SEQ ID NO: 857603 - RNA, 19 nt, Homo sapiens
ugucccagcucugacuuua

SEQ ID NO: 857604 - RNA, 19 nt, Homo sapiens
cacauggucugaauuccaa

SEQ ID NO: 857605 - RNA, 19 nt, Homo sapiens
cagccugggugacagacua

SEQ ID NO: 857606 - RNA, 19 nt, Homo sapiens
ggugaaacccugucuguac

SEQ ID NO: 857607 - RNA, 19 nt, Homo sapiens
gaucacaaggucaggaguu

SEQ ID NO: 857608 - RNA, 19 nt, Homo sapiens
uagguggaguuaguauaua

SEQ ID NO: 857609 - RNA, 19 nt, Homo sapiens
ugacaaagagggcaagauc

SEQ ID NO: 857610 - RNA, 19 nt, Homo sapiens
uacaagaggugaacaagac

SEQ ID NO: 857611 - RNA, 19 nt, Homo sapiens
gacuccaucuccacacaaa

SEQ ID NO: 857612 - RNA, 19 nt, Homo sapiens
caagaccuguuugggagaa

SEQ ID NO: 857613 - RNA, 19 nt, Homo sapiens
aaaagaaaaugcagacaga

SEQ ID NO: 857614 - RNA, 19 nt, Homo sapiens
ucagggauauggccaugug

SEQ ID NO: 857615 - RNA, 19 nt, Homo sapiens
gagucugucuggaaacuag

SEQ ID NO: 857616 - RNA, 19 nt, Homo sapiens
aggcugcagugagcuauua

SEQ ID NO: 857617 - RNA, 19 nt, Homo sapiens
gcaggagaaucgcgugaac

SEQ ID NO: 857618 - RNA, 19 nt, Homo sapiens
gacuauuuccuuagguaua

SEQ ID NO: 857619 - RNA, 19 nt, Homo sapiens
ccacuccugcuaucaguuu

SEQ ID NO: 857620 - RNA, 19 nt, Homo sapiens
caaucucggcucacuguaa

SEQ ID NO: 857621 - RNA, 19 nt, Homo sapiens
ccaagagacuagugagcau

SEQ ID NO: 857622 - RNA, 19 nt, Homo sapiens
ggucacauggucugaauuc

SEQ ID NO: 857623 - RNA, 19 nt, Homo sapiens
ccaaguauggcucaccaaa

SEQ ID NO: 857624 - RNA, 19 nt, Homo sapiens
uuuaggugguuucuaguuu

SEQ ID NO: 857625 - RNA, 19 nt, Homo sapiens
ugacauaucaagaccuguu

SEQ ID NO: 857626 - RNA, 19 nt, Homo sapiens
gcuucacccucucugauau

SEQ ID NO: 857627 - RNA, 19 nt, Homo sapiens
ucacauuuccucugagaau

SEQ ID NO: 857628 - RNA, 19 nt, Homo sapiens
acaagaaggcagccaaguu

SEQ ID NO: 857629 - RNA, 19 nt, Homo sapiens
caaagagggcaagaucauu

SEQ ID NO: 857630 - RNA, 19 nt, Homo sapiens
gacucaaacauucuacuuu

SEQ ID NO: 857631 - RNA, 19 nt, Homo sapiens
gaaguugcagugagcugaa

SEQ ID NO: 857632 - RNA, 19 nt, Homo sapiens
cuuaguagguggaguuagu

SEQ ID NO: 857633 - RNA, 19 nt, Homo sapiens
guaggugggugggaucugu

SEQ ID NO: 857634 - RNA, 19 nt, Homo sapiens
gcaagaagcugccuaacaa

SEQ ID NO: 857635 - RNA, 19 nt, Homo sapiens
gcacacgcuuguaaucuua

SEQ ID NO: 857636 - RNA, 19 nt, Homo sapiens
gguauaaguugcagaaaug

SEQ ID NO: 857637 - RNA, 19 nt, Homo sapiens
caucaagacuucacaccua

SEQ ID NO: 857638 - RNA, 19 nt, Homo sapiens
gcagugagcuauuauugca

SEQ ID NO: 857639 - RNA, 19 nt, Homo sapiens
gaaaugggaggaucacuug

SEQ ID NO: 857640 - RNA, 19 nt, Homo sapiens
guuagaaugugcauaaguu

SEQ ID NO: 857641 - RNA, 19 nt, Homo sapiens
agagcaagauucugucuaa

SEQ ID NO: 857642 - RNA, 19 nt, Homo sapiens
gaaggaaacucugauuggu

SEQ ID NO: 857643 - RNA, 19 nt, Homo sapiens
gcucuucgcucgugucugu

SEQ ID NO: 857644 - RNA, 19 nt, Homo sapiens
cgaauuggguauauaaauc

SEQ ID NO: 857645 - RNA, 19 nt, Homo sapiens
aaagagggcaagaucauua

SEQ ID NO: 857646 - RNA, 19 nt, Homo sapiens
ggaucuguccuuucucuua

SEQ ID NO: 857647 - RNA, 19 nt, Homo sapiens
gaaagggaaggaaauguau

SEQ ID NO: 857648 - RNA, 19 nt, Homo sapiens
gggaggauuuacagcauaa

SEQ ID NO: 857649 - RNA, 19 nt, Homo sapiens
ugaaggagaucaccaacug

SEQ ID NO: 857650 - RNA, 19 nt, Homo sapiens
caagaaggcagccaaguug

SEQ ID NO: 857651 - RNA, 19 nt, Homo sapiens
gugauagacucaaacauuc

SEQ ID NO: 857652 - RNA, 19 nt, Homo sapiens
ggaaugggcugugauagac

SEQ ID NO: 857653 - RNA, 19 nt, Homo sapiens
cacccucucugauaucaua

SEQ ID NO: 857654 - RNA, 19 nt, Homo sapiens
gcacggagucugucuggaa

SEQ ID NO: 857655 - RNA, 19 nt, Homo sapiens
gaaccaaaucuguuucuuc

SEQ ID NO: 857656 - RNA, 19 nt, Homo sapiens
cuacccagauguacauaaa

SEQ ID NO: 857657 - RNA, 19 nt, Homo sapiens
gagugugcccucaguguua

SEQ ID NO: 857658 - RNA, 19 nt, Homo sapiens
caaauaaugcuguggugaa

SEQ ID NO: 857659 - RNA, 19 nt, Homo sapiens
cagacuauuuccuuaggua

SEQ ID NO: 857660 - RNA, 19 nt, Homo sapiens
gagaggagggcaccaagaa

SEQ ID NO: 857661 - RNA, 19 nt, Homo sapiens
gaucuguccuuucucuuag

SEQ ID NO: 857662 - RNA, 19 nt, Homo sapiens
ccaaaucuguuucuuccau

SEQ ID NO: 857663 - RNA, 19 nt, Homo sapiens
gagcaagauucugucuaaa

SEQ ID NO: 857664 - RNA, 19 nt, Homo sapiens
acaccuaagugcucacauu

SEQ ID NO: 857665 - RNA, 19 nt, Homo sapiens
gugaacaucuuggugcaaa

SEQ ID NO: 857666 - RNA, 19 nt, Homo sapiens
gcuaucaguuucuuauaag

SEQ ID NO: 857667 - RNA, 19 nt, Homo sapiens
caacaacaucucuacaaga

SEQ ID NO: 857668 - RNA, 19 nt, Homo sapiens
gcucugacuuuacaacauc

SEQ ID NO: 857669 - RNA, 19 nt, Homo sapiens
gugcucacauuuccucuga

SEQ ID NO: 857670 - RNA, 19 nt, Homo sapiens
ggugggaucuguccuuucu

SEQ ID NO: 857671 - RNA, 19 nt, Homo sapiens
gaaacuacccagauguaca

SEQ ID NO: 857672 - RNA, 19 nt, Homo sapiens
gaaagaaggaaacucugau

SEQ ID NO: 857673 - RNA, 19 nt, Homo sapiens
uaggagagacugacacaaa

SEQ ID NO: 857674 - RNA, 19 nt, Homo sapiens
guagguggaguuaguauau

SEQ ID NO: 857675 - RNA, 19 nt, Homo sapiens
ccaacaacaucucuacaag

SEQ ID NO: 857676 - RNA, 19 nt, Homo sapiens
ggacugggcaccaacaaca

SEQ ID NO: 857677 - RNA, 19 nt, Homo sapiens
uuugaaggauggcauguuu

SEQ ID NO: 857678 - RNA, 19 nt, Homo sapiens
agaaagggaaggaaaugua

SEQ ID NO: 857679 - RNA, 19 nt, Homo sapiens
gggcugugauagacucaaa

SEQ ID NO: 857680 - RNA, 19 nt, Homo sapiens
aaacuaggcaugucugaga

SEQ ID NO: 857681 - RNA, 19 nt, Homo sapiens
cuacacggcuccugacaag

SEQ ID NO: 857682 - RNA, 19 nt, Homo sapiens
cagccugggugacauauca

SEQ ID NO: 857683 - RNA, 19 nt, Homo sapiens
ugugauagacucaaacauu

SEQ ID NO: 857684 - RNA, 19 nt, Homo sapiens
guagugagccgagaucaug

SEQ ID NO: 857685 - RNA, 19 nt, Homo sapiens
uacaacaucuuccaguuca

SEQ ID NO: 857686 - RNA, 19 nt, Homo sapiens
agaaagacaccaaggagaa

SEQ ID NO: 857687 - RNA, 19 nt, Homo sapiens
aaagcgaauuggguauaua

SEQ ID NO: 857688 - RNA, 19 nt, Homo sapiens
ggcacacgcuuguaaucuu

SEQ ID NO: 857689 - RNA, 19 nt, Homo sapiens
gcagaaagggaaggaaaug

SEQ ID NO: 857690 - RNA, 19 nt, Homo sapiens
caagugauccgcccaccuu

SEQ ID NO: 857691 - RNA, 19 nt, Homo sapiens
gugaugacaugaaggagau

SEQ ID NO: 857692 - RNA, 19 nt, Homo sapiens
cacuagaggucaggaguuu

SEQ ID NO: 857693 - RNA, 19 nt, Homo sapiens
uagaaacuacccagaugua

SEQ ID NO: 857694 - RNA, 19 nt, Homo sapiens
gcagcacuuuugaucauua

SEQ ID NO: 857695 - RNA, 19 nt, Homo sapiens
gaagggcuguguguggaau

SEQ ID NO: 857696 - RNA, 19 nt, Homo sapiens
ugaaagaaggaaacucuga

SEQ ID NO: 857697 - RNA, 19 nt, Homo sapiens
ugucccagcucugacuuua

SEQ ID NO: 857698 - RNA, 19 nt, Homo sapiens
uaaaauccccucucuacua

SEQ ID NO: 857699 - RNA, 19 nt, Homo sapiens
gcgaauuggguauauaaau

SEQ ID NO: 857700 - RNA, 19 nt, Homo sapiens
aaaauccccucucuacuaa

SEQ ID NO: 857701 - RNA, 19 nt, Homo sapiens
ucccaaaguguuaggauua

SEQ ID NO: 857702 - RNA, 19 nt, Homo sapiens
uagguggaguuaguauaua

SEQ ID NO: 857703 - RNA, 19 nt, Homo sapiens
ugacaaagagggcaagauc

SEQ ID NO: 857704 - RNA, 19 nt, Homo sapiens
uacaagaggugaacaagac

SEQ ID NO: 857705 - RNA, 19 nt, Homo sapiens
aggcugcagugagcuauua

SEQ ID NO: 857706 - RNA, 19 nt, Homo sapiens
aaaagaaaaugcagacaga

SEQ ID NO: 857707 - RNA, 19 nt, Homo sapiens
caagaccuguuugggagaa

SEQ ID NO: 857708 - RNA, 19 nt, Homo sapiens
gagucugucuggaaacuag

SEQ ID NO: 857709 - RNA, 19 nt, Homo sapiens
aaagcuugcucgacuguuc

SEQ ID NO: 857710 - RNA, 19 nt, Homo sapiens
gacuauuuccuuagguaua

SEQ ID NO: 857711 - RNA, 19 nt, Homo sapiens
ccacuccugcuaucaguuu

SEQ ID NO: 857712 - RNA, 19 nt, Homo sapiens
ccaaguauggcucaccaaa

SEQ ID NO: 857713 - RNA, 19 nt, Homo sapiens
ugucugaguuugaaagcuu

SEQ ID NO: 857714 - RNA, 19 nt, Homo sapiens
ugacauaucaagaccuguu

SEQ ID NO: 857715 - RNA, 19 nt, Homo sapiens
uuuaggugguuucuaguuu

SEQ ID NO: 857716 - RNA, 19 nt, Homo sapiens
gcuucacccucucugauau

SEQ ID NO: 857717 - RNA, 19 nt, Homo sapiens
ucacauuuccucugagaau

SEQ ID NO: 857718 - RNA, 19 nt, Homo sapiens
acaagaaggcagccaaguu

SEQ ID NO: 857719 - RNA, 19 nt, Homo sapiens
caaagagggcaagaucauu

SEQ ID NO: 857720 - RNA, 19 nt, Homo sapiens
gacucaaacauucuacuuu

SEQ ID NO: 857721 - RNA, 19 nt, Homo sapiens
cuuaguagguggaguuagu

SEQ ID NO: 857722 - RNA, 19 nt, Homo sapiens
guaggugggugggaucugu

SEQ ID NO: 857723 - RNA, 19 nt, Homo sapiens
ggaaacuaggcaugucuga

SEQ ID NO: 857724 - RNA, 19 nt, Homo sapiens
aaagaaggaaacucugauu

SEQ ID NO: 857725 - RNA, 19 nt, Homo sapiens
uguguuagaaugugcauaa

SEQ ID NO: 857726 - RNA, 19 nt, Homo sapiens
cacggagucugucuggaaa

SEQ ID NO: 857727 - RNA, 19 nt, Homo sapiens
ccacagccaagcccaaaga

SEQ ID NO: 857728 - RNA, 19 nt, Homo sapiens
gaaagacaccaaggagaag

SEQ ID NO: 857729 - RNA, 19 nt, Homo sapiens
caacccugccuuuggcuuu

SEQ ID NO: 857730 - RNA, 19 nt, Homo sapiens
aagcgaauuggguauauaa

SEQ ID NO: 857731 - RNA, 19 nt, Homo sapiens
uuaggugguuucuaguuug

SEQ ID NO: 857732 - RNA, 19 nt, Homo sapiens
ugggaggauuuacagcaua

SEQ ID NO: 857733 - RNA, 19 nt, Homo sapiens
agguggaguuaguauauaa

SEQ ID NO: 857734 - RNA, 19 nt, Homo sapiens
gaauaaagauccagaggaa

SEQ ID NO: 857735 - RNA, 19 nt, Homo sapiens
caaagaagguguuaacaga

SEQ ID NO: 857736 - RNA, 19 nt, Homo sapiens
gcaauauggucuagccuua

SEQ ID NO: 857737 - RNA, 19 nt, Homo sapiens
caaauuggauggauucaaa

SEQ ID NO: 857738 - RNA, 19 nt, Homo sapiens
ggaauacguucuuaguuaa

SEQ ID NO: 857739 - RNA, 19 nt, Homo sapiens
gcacagauaucaaacaaca

SEQ ID NO: 857740 - RNA, 19 nt, Homo sapiens
gaacguucccuuccauuua

SEQ ID NO: 857741 - RNA, 19 nt, Homo sapiens
ugaaacagcuggaggauug

SEQ ID NO: 857742 - RNA, 19 nt, Homo sapiens
uggaauacguucuuaguua

SEQ ID NO: 857743 - RNA, 19 nt, Homo sapiens
aaacaucacucagacuuua

SEQ ID NO: 857744 - RNA, 19 nt, Homo sapiens
ggauguagcuagaggaauu

SEQ ID NO: 857745 - RNA, 19 nt, Homo sapiens
ggucaaagaucccacagaa

SEQ ID NO: 857746 - RNA, 19 nt, Homo sapiens
cgacaacaguucuuauuga

SEQ ID NO: 857747 - RNA, 19 nt, Homo sapiens
gaaaauaagugaagaggaa

SEQ ID NO: 857748 - RNA, 19 nt, Homo sapiens
cccauuagcuguaagauuu

SEQ ID NO: 857749 - RNA, 19 nt, Homo sapiens
gaagacugccuccaauaua

SEQ ID NO: 857750 - RNA, 19 nt, Homo sapiens
acaagaaccugaagaagaa

SEQ ID NO: 857751 - RNA, 19 nt, Homo sapiens
ccauaucucuuccuucuuu

SEQ ID NO: 857752 - RNA, 19 nt, Homo sapiens
aaacaaaugucaacucugu

SEQ ID NO: 857753 - RNA, 19 nt, Homo sapiens
uaaauacccugcaaccaaa

SEQ ID NO: 857754 - RNA, 19 nt, Homo sapiens
gugcaacccuggcuaaauu

SEQ ID NO: 857755 - RNA, 19 nt, Homo sapiens
guacuuggcugaaagcaau

SEQ ID NO: 857756 - RNA, 19 nt, Homo sapiens
ucaaagaccuaacuucaau

SEQ ID NO: 857757 - RNA, 19 nt, Homo sapiens
gcacugaugauguggaaua

SEQ ID NO: 857758 - RNA, 19 nt, Homo sapiens
gaagaaacuagcagccuua

SEQ ID NO: 857759 - RNA, 19 nt, Homo sapiens
guagccaaguggauauuua

SEQ ID NO: 857760 - RNA, 19 nt, Homo sapiens
gcuggaggauugucucaua

SEQ ID NO: 857761 - RNA, 19 nt, Homo sapiens
caaacaacaugacagagaa

SEQ ID NO: 857762 - RNA, 19 nt, Homo sapiens
ugauaaagaugguguguug

SEQ ID NO: 857763 - RNA, 19 nt, Homo sapiens
caacaguucuuauugaaag

SEQ ID NO: 857764 - RNA, 19 nt, Homo sapiens
acacagcaaugacaucuuu

SEQ ID NO: 857765 - RNA, 19 nt, Homo sapiens
ucaaucugcugucuucaua

SEQ ID NO: 857766 - RNA, 19 nt, Homo sapiens
ggaaacuccuucugaaaca

SEQ ID NO: 857767 - RNA, 19 nt, Homo sapiens
gacaacaguucuuauugaa

SEQ ID NO: 857768 - RNA, 19 nt, Homo sapiens
ugacuuggcucuguuacua

SEQ ID NO: 857769 - RNA, 19 nt, Homo sapiens
gaacuugagucuguugaug

SEQ ID NO: 857770 - RNA, 19 nt, Homo sapiens
gggaagcacacaaccauua

SEQ ID NO: 857771 - RNA, 19 nt, Homo sapiens
aacaacagcuaaacuagua

SEQ ID NO: 857772 - RNA, 19 nt, Homo sapiens
gcccaucaccuucaaguua

SEQ ID NO: 857773 - RNA, 19 nt, Homo sapiens
gaugguguguugccuguaa

SEQ ID NO: 857774 - RNA, 19 nt, Homo sapiens
gauaaugacuuggcucugu

SEQ ID NO: 857775 - RNA, 19 nt, Homo sapiens
gaaaggaagaaaugcaauu

SEQ ID NO: 857776 - RNA, 19 nt, Homo sapiens
ccaaugaucuuauggugau

SEQ ID NO: 857777 - RNA, 19 nt, Homo sapiens
ggaaggaccaaucuccaua

SEQ ID NO: 857778 - RNA, 19 nt, Homo sapiens
cuauggaguugaccacuua

SEQ ID NO: 857779 - RNA, 19 nt, Homo sapiens
uaacagaaguuuccuugag

SEQ ID NO: 857780 - RNA, 19 nt, Homo sapiens
gaaacuagcagccuuacug

SEQ ID NO: 857781 - RNA, 19 nt, Homo sapiens
ucaaagaucccacagaaga

SEQ ID NO: 857782 - RNA, 19 nt, Homo sapiens
uaucagagauggagaugga

SEQ ID NO: 857783 - RNA, 19 nt, Homo sapiens
gaugaaggauugcuacagu

SEQ ID NO: 857784 - RNA, 19 nt, Homo sapiens
gcuacauacuuaauggaua

SEQ ID NO: 857785 - RNA, 19 nt, Homo sapiens
ccaaguggauauuuaaaca

SEQ ID NO: 857786 - RNA, 19 nt, Homo sapiens
gggaggcacuuucucuuga

SEQ ID NO: 857787 - RNA, 19 nt, Homo sapiens
gagaaucagagauguguaa

SEQ ID NO: 857788 - RNA, 19 nt, Homo sapiens
gacacaccauucucugaua

SEQ ID NO: 857789 - RNA, 19 nt, Homo sapiens
ggaaauauagugauaaagg

SEQ ID NO: 857790 - RNA, 19 nt, Homo sapiens
gcuccaagauuguguuuua

SEQ ID NO: 857791 - RNA, 19 nt, Homo sapiens
gaagaaagagaugcagaaa

SEQ ID NO: 857792 - RNA, 19 nt, Homo sapiens
gaugauuucggcagaguua

SEQ ID NO: 857793 - RNA, 19 nt, Homo sapiens
gaagaagaaggaaauacuu

SEQ ID NO: 857794 - RNA, 19 nt, Homo sapiens
gaaaaugccuuuguuguca

SEQ ID NO: 857795 - RNA, 19 nt, Homo sapiens
gauguggaauacguucuua

SEQ ID NO: 857796 - RNA, 19 nt, Homo sapiens
gaaguuuccuugagguauc

SEQ ID NO: 857797 - RNA, 19 nt, Homo sapiens
gaauauguggcuuuaggua

SEQ ID NO: 857798 - RNA, 19 nt, Homo sapiens
gcacacaaccauuauuauc

SEQ ID NO: 857799 - RNA, 19 nt, Homo sapiens
gcuguuggcuggagugguu

SEQ ID NO: 857800 - RNA, 19 nt, Homo sapiens
cuacaaguguuuaggaaau

SEQ ID NO: 857801 - RNA, 19 nt, Homo sapiens
gguucaagaucaucauauu

SEQ ID NO: 857802 - RNA, 19 nt, Homo sapiens
gagaacaccaggacaaaug

SEQ ID NO: 857803 - RNA, 19 nt, Homo sapiens
acaaaugucaacucuguua

SEQ ID NO: 857804 - RNA, 19 nt, Homo sapiens
ggauuuagcccaucaccuu

SEQ ID NO: 857805 - RNA, 19 nt, Homo sapiens
gcauugcacugaugaugug

SEQ ID NO: 857806 - RNA, 19 nt, Homo sapiens
gaaacaucacucagacuuu

SEQ ID NO: 857807 - RNA, 19 nt, Homo sapiens
ucgaguagcucaauuccuu

SEQ ID NO: 857808 - RNA, 19 nt, Homo sapiens
gaaauggggucuacaagau

SEQ ID NO: 857809 - RNA, 19 nt, Homo sapiens
aguaagaccuggaauuuua

SEQ ID NO: 857810 - RNA, 19 nt, Homo sapiens
acacuuaccuacuggaaau

SEQ ID NO: 857811 - RNA, 19 nt, Homo sapiens
gugaagauguuguuagaag

SEQ ID NO: 857812 - RNA, 19 nt, Homo sapiens
caagugaacguuuaccauu

SEQ ID NO: 857813 - RNA, 19 nt, Homo sapiens
gcacaaauuggauggauuc

SEQ ID NO: 857814 - RNA, 19 nt, Homo sapiens
cauacaaccaccaccauua

SEQ ID NO: 857815 - RNA, 19 nt, Homo sapiens
augcagaaccuaugaaaua

SEQ ID NO: 857816 - RNA, 19 nt, Homo sapiens
aagaauggguucaagauca

SEQ ID NO: 857817 - RNA, 19 nt, Homo sapiens
gaacuggcccuugaacaga

SEQ ID NO: 857818 - RNA, 19 nt, Homo sapiens
uaugagcaguuuccuugua

SEQ ID NO: 857819 - RNA, 19 nt, Homo sapiens
ggugaaagcauaugucugu

SEQ ID NO: 857820 - RNA, 19 nt, Homo sapiens
ugacugagcagaaugaaga

SEQ ID NO: 857821 - RNA, 19 nt, Homo sapiens
uaaaggaaaggaagaaaug

SEQ ID NO: 857822 - RNA, 19 nt, Homo sapiens
aaacccagaugaacccaaa

SEQ ID NO: 857823 - RNA, 19 nt, Homo sapiens
agaggaauauguggcuuua

SEQ ID NO: 857824 - RNA, 19 nt, Homo sapiens
aggcauuacuagagaaaua

SEQ ID NO: 857825 - RNA, 19 nt, Homo sapiens
caacagacugggaagauga

SEQ ID NO: 857826 - RNA, 19 nt, Homo sapiens
caacuuaaaugcagaaccu

SEQ ID NO: 857827 - RNA, 19 nt, Homo sapiens
gcaaaguuguauccacauc

SEQ ID NO: 857828 - RNA, 19 nt, Homo sapiens
ggaagaauggguucaagau

SEQ ID NO: 857829 - RNA, 19 nt, Homo sapiens
agaaggaaauacuugcaaa

SEQ ID NO: 857830 - RNA, 19 nt, Homo sapiens
auagaacacuugaagcaaa

SEQ ID NO: 857831 - RNA, 19 nt, Homo sapiens
ggaggauugucucauacuu

SEQ ID NO: 857832 - RNA, 19 nt, Homo sapiens
ggcuuuagguaguuucuuu

SEQ ID NO: 857833 - RNA, 19 nt, Homo sapiens
agacuuuaauggacacuuu

SEQ ID NO: 857834 - RNA, 19 nt, Homo sapiens
acacaaaccuugaacauuu

SEQ ID NO: 857835 - RNA, 19 nt, Homo sapiens
gaagaggcauugguuauaa

SEQ ID NO: 857836 - RNA, 19 nt, Homo sapiens
caagacaucugaacauauu

SEQ ID NO: 857837 - RNA, 19 nt, Homo sapiens
gaauguagcucaacuugug

SEQ ID NO: 857838 - RNA, 19 nt, Homo sapiens
ccacaaaguugaagaauuc

SEQ ID NO: 857839 - RNA, 19 nt, Homo sapiens
ggagagauggucagaaaua

SEQ ID NO: 857840 - RNA, 19 nt, Homo sapiens
gaacuucgaccuacugaaa

SEQ ID NO: 857841 - RNA, 19 nt, Homo sapiens
agaaugaucugcaagaauu

SEQ ID NO: 857842 - RNA, 19 nt, Homo sapiens
auaaauaucucccaccuaa

SEQ ID NO: 857843 - RNA, 19 nt, Homo sapiens
cuacaacccucuccuguuu

SEQ ID NO: 857844 - RNA, 19 nt, Homo sapiens
gaagcuuggugaauaauug

SEQ ID NO: 857845 - RNA, 19 nt, Homo sapiens
gaagaaaguacuagagaaa

SEQ ID NO: 857846 - RNA, 19 nt, Homo sapiens
gaagagggccaaacacuga

SEQ ID NO: 857847 - RNA, 19 nt, Homo sapiens
gugaaaggaucaagauauu

SEQ ID NO: 857848 - RNA, 19 nt, Homo sapiens
gaagaacagugccauuaag

SEQ ID NO: 857849 - RNA, 19 nt, Homo sapiens
ggucacgacugcugaauau

SEQ ID NO: 857850 - RNA, 19 nt, Homo sapiens
gagcuauucuugcugauga

SEQ ID NO: 857851 - RNA, 19 nt, Homo sapiens
uggaggaucucacuuaauu

SEQ ID NO: 857852 - RNA, 19 nt, Homo sapiens
uagaagaacccaagaaauu

SEQ ID NO: 857853 - RNA, 19 nt, Homo sapiens
gcagauuguugauggcuuu

SEQ ID NO: 857854 - RNA, 19 nt, Homo sapiens
gaaauggguuuagggaaga

SEQ ID NO: 857855 - RNA, 19 nt, Homo sapiens
gagaaugaauggcagaugu

SEQ ID NO: 857856 - RNA, 19 nt, Homo sapiens
gaaaauaguccccaucuaa

SEQ ID NO: 857857 - RNA, 19 nt, Homo sapiens
ggaagaggcauugguuaua

SEQ ID NO: 857858 - RNA, 19 nt, Homo sapiens
gaaaucugauagccuaguu

SEQ ID NO: 857859 - RNA, 19 nt, Homo sapiens
guuuaaaucugccuaguga

SEQ ID NO: 857860 - RNA, 19 nt, Homo sapiens
ucagaaagaaggaaucaua

SEQ ID NO: 857861 - RNA, 19 nt, Homo sapiens
gguguaagccuucaaagaa

SEQ ID NO: 857862 - RNA, 19 nt, Homo sapiens
uagcucaacuugugauaaa

SEQ ID NO: 857863 - RNA, 19 nt, Homo sapiens
agauugagcuuuaucgaaa

SEQ ID NO: 857864 - RNA, 19 nt, Homo sapiens
gcaagccaguaauaaagaa

SEQ ID NO: 857865 - RNA, 19 nt, Homo sapiens
gaaaguucagauuguguua

SEQ ID NO: 857866 - RNA, 19 nt, Homo sapiens
gaagaacccaagaaauuau

SEQ ID NO: 857867 - RNA, 19 nt, Homo sapiens
ccuggaagcuuggugaaua

SEQ ID NO: 857868 - RNA, 19 nt, Homo sapiens
agugaaagauuacuucuga

SEQ ID NO: 857869 - RNA, 19 nt, Homo sapiens
guucaacucuauaaaggaa

SEQ ID NO: 857870 - RNA, 19 nt, Homo sapiens
gcuguuaaauucucagguu

SEQ ID NO: 857871 - RNA, 19 nt, Homo sapiens
gaacagugccauuaagaca

SEQ ID NO: 857872 - RNA, 19 nt, Homo sapiens
guaaugggaaugagaauga

SEQ ID NO: 857873 - RNA, 19 nt, Homo sapiens
aaaccaaguucaaaggaaa

SEQ ID NO: 857874 - RNA, 19 nt, Homo sapiens
gaucuuagaauaugcaguu

SEQ ID NO: 857875 - RNA, 19 nt, Homo sapiens
cagauuguguuacucauga

SEQ ID NO: 857876 - RNA, 19 nt, Homo sapiens
uacaaaggcuugcuaagug

SEQ ID NO: 857877 - RNA, 19 nt, Homo sapiens
agaagaacccaagaaauua

SEQ ID NO: 857878 - RNA, 19 nt, Homo sapiens
guacugcuaucucgcauuc

SEQ ID NO: 857879 - RNA, 19 nt, Homo sapiens
ggaaggugaugcuguucuu

SEQ ID NO: 857880 - RNA, 19 nt, Homo sapiens
cugauagccuaguuaaaua

SEQ ID NO: 857881 - RNA, 19 nt, Homo sapiens
gagagauggucagaaauau

SEQ ID NO: 857882 - RNA, 19 nt, Homo sapiens
ugaagaaaguacuagagaa

SEQ ID NO: 857883 - RNA, 19 nt, Homo sapiens
cacuacagauugagcuuua

SEQ ID NO: 857884 - RNA, 19 nt, Homo sapiens
ggaguuaggagaaagaaga

SEQ ID NO: 857885 - RNA, 19 nt, Homo sapiens
gaucaggaccacaaaguug

SEQ ID NO: 857886 - RNA, 19 nt, Homo sapiens
ggaucaagauauuuacugu

SEQ ID NO: 857887 - RNA, 19 nt, Homo sapiens
gauugauccuuaccuugua

SEQ ID NO: 857888 - RNA, 19 nt, Homo sapiens
ggccaaacacugaugauuu

SEQ ID NO: 857889 - RNA, 19 nt, Homo sapiens
ucagaaauauccuguacau

SEQ ID NO: 857890 - RNA, 19 nt, Homo sapiens
uaaaccaaguucaaaggaa

SEQ ID NO: 857891 - RNA, 19 nt, Homo sapiens
gaaaaggaguuaggagaaa

SEQ ID NO: 857892 - RNA, 19 nt, Homo sapiens
ucauuagccuuucuuguga

SEQ ID NO: 857893 - RNA, 19 nt, Homo sapiens
gaagaauucaucaagucua

SEQ ID NO: 857894 - RNA, 19 nt, Homo sapiens
gaagugaaaggaucaagau

SEQ ID NO: 857895 - RNA, 19 nt, Homo sapiens
guguaagccuucaaagaaa

SEQ ID NO: 857896 - RNA, 19 nt, Homo sapiens
gaaagcuguuaaauucuca

SEQ ID NO: 857897 - RNA, 19 nt, Homo sapiens
uaucaaaggcagaucagua

SEQ ID NO: 857898 - RNA, 19 nt, Homo sapiens
ggucagaaauauccuguac

SEQ ID NO: 857899 - RNA, 19 nt, Homo sapiens
caggagcacuacagauuga

SEQ ID NO: 857900 - RNA, 19 nt, Homo sapiens
cgucauggauaugcuuaua

SEQ ID NO: 857901 - RNA, 19 nt, Homo sapiens
gggcaucguuugaagaaca

SEQ ID NO: 857902 - RNA, 19 nt, Homo sapiens
gaggcaagccaguaauaaa

SEQ ID NO: 857903 - RNA, 19 nt, Homo sapiens
caccuacacuggcaacauu

SEQ ID NO: 857904 - RNA, 19 nt, Homo sapiens
ccacaucaccagaaaucua

SEQ ID NO: 857905 - RNA, 19 nt, Homo sapiens
acuggacucuuuauccuua

SEQ ID NO: 857906 - RNA, 19 nt, Homo sapiens
caagaagagaaaucugaua

SEQ ID NO: 857907 - RNA, 19 nt, Homo sapiens
gaaaguacuagagaaauca

SEQ ID NO: 857908 - RNA, 19 nt, Homo sapiens
ggcacauagugaaagauua

SEQ ID NO: 857909 - RNA, 19 nt, Homo sapiens
gaaaucuaacucccugaaa

SEQ ID NO: 857910 - RNA, 19 nt, Homo sapiens
ucuaugacauugauuggaa

SEQ ID NO: 857911 - RNA, 19 nt, Homo sapiens
uauguaagcgucauggaua

SEQ ID NO: 857912 - RNA, 19 nt, Homo sapiens
ugaagaacagugccauuaa

SEQ ID NO: 857913 - RNA, 19 nt, Homo sapiens
caaggaacaagaagagaaa

SEQ ID NO: 857914 - RNA, 19 nt, Homo sapiens
ucauucggcuccuaaagaa

SEQ ID NO: 857915 - RNA, 19 nt, Homo sapiens
agagauaauugcaguggaa

SEQ ID NO: 857916 - RNA, 19 nt, Homo sapiens
gaaaaggaauguagcucaa

SEQ ID NO: 857917 - RNA, 19 nt, Homo sapiens
gugaauaauuggaagaaag

SEQ ID NO: 857918 - RNA, 19 nt, Homo sapiens
ggaggcaagccaguaauaa

SEQ ID NO: 857919 - RNA, 19 nt, Homo sapiens
ggcaaugucuagaguaugg

SEQ ID NO: 857920 - RNA, 19 nt, Homo sapiens
uggauaugcuuauacaaga

SEQ ID NO: 857921 - RNA, 19 nt, Homo sapiens
cgaaagcuguuaaauucuc

SEQ ID NO: 857922 - RNA, 19 nt, Homo sapiens
aucgaaagcuguuaaauuc

SEQ ID NO: 857923 - RNA, 19 nt, Homo sapiens
gaauauaaccacucaagcu

SEQ ID NO: 857924 - RNA, 19 nt, Homo sapiens
gaauccagccacugacauu

SEQ ID NO: 857925 - RNA, 19 nt, Homo sapiens
gaucucacuuaauucucua

SEQ ID NO: 857926 - RNA, 19 nt, Homo sapiens
ggaucucacuuaauucucu

SEQ ID NO: 857927 - RNA, 19 nt, Homo sapiens
cuucaaggguuguuggaaa

SEQ ID NO: 857928 - RNA, 19 nt, Homo sapiens
uggcagauguggagcuauu

SEQ ID NO: 857929 - RNA, 19 nt, Homo sapiens
gaaggugaugcuguucuua

SEQ ID NO: 857930 - RNA, 19 nt, Homo sapiens
agaaaguacuagagaaauc

SEQ ID NO: 857931 - RNA, 19 nt, Homo sapiens
gcacauagugaaagauuac

SEQ ID NO: 857932 - RNA, 19 nt, Homo sapiens
gaaaagagucuauacaaag

SEQ ID NO: 857933 - RNA, 19 nt, Homo sapiens
ggaagugaaaggaucaaga

SEQ ID NO: 857934 - RNA, 19 nt, Homo sapiens
acacaaaccuugaacauuu

SEQ ID NO: 857935 - RNA, 19 nt, Homo sapiens
gaagaggcauugguuauaa

SEQ ID NO: 857936 - RNA, 19 nt, Homo sapiens
caagacaucugaacauauu

SEQ ID NO: 857937 - RNA, 19 nt, Homo sapiens
gaauguagcucaacuugug

SEQ ID NO: 857938 - RNA, 19 nt, Homo sapiens
ggagagauggucagaaaua

SEQ ID NO: 857939 - RNA, 19 nt, Homo sapiens
gaacuucgaccuacugaaa

SEQ ID NO: 857940 - RNA, 19 nt, Homo sapiens
agaaugaucugcaagaauu

SEQ ID NO: 857941 - RNA, 19 nt, Homo sapiens
auaaauaucucccaccuaa

SEQ ID NO: 857942 - RNA, 19 nt, Homo sapiens
cuacaacccucuccuguuu

SEQ ID NO: 857943 - RNA, 19 nt, Homo sapiens
gaagcuuggugaauaauug

SEQ ID NO: 857944 - RNA, 19 nt, Homo sapiens
gaagaaaguacuagagaaa

SEQ ID NO: 857945 - RNA, 19 nt, Homo sapiens
gaagagggccaaacacuga

SEQ ID NO: 857946 - RNA, 19 nt, Homo sapiens
gugaaaggaucaagauauu

SEQ ID NO: 857947 - RNA, 19 nt, Homo sapiens
gaagaacagugccauuaag

SEQ ID NO: 857948 - RNA, 19 nt, Homo sapiens
gagcuauucuugcugauga

SEQ ID NO: 857949 - RNA, 19 nt, Homo sapiens
ggucacgacugcugaauau

SEQ ID NO: 857950 - RNA, 19 nt, Homo sapiens
uggaggaucucacuuaauu

SEQ ID NO: 857951 - RNA, 19 nt, Homo sapiens
uagaagaacccaagaaauu

SEQ ID NO: 857952 - RNA, 19 nt, Homo sapiens
gcagauuguugauggcuuu

SEQ ID NO: 857953 - RNA, 19 nt, Homo sapiens
gaaauggguuuagggaaga

SEQ ID NO: 857954 - RNA, 19 nt, Homo sapiens
gagaaugaauggcagaugu

SEQ ID NO: 857955 - RNA, 19 nt, Homo sapiens
gaaaauaguccccaucuaa

SEQ ID NO: 857956 - RNA, 19 nt, Homo sapiens
ggaagaggcauugguuaua

SEQ ID NO: 857957 - RNA, 19 nt, Homo sapiens
gaaaucugauagccuaguu

SEQ ID NO: 857958 - RNA, 19 nt, Homo sapiens
guuuaaaucugccuaguga

SEQ ID NO: 857959 - RNA, 19 nt, Homo sapiens
ucagaaagaaggaaucaua

SEQ ID NO: 857960 - RNA, 19 nt, Homo sapiens
gguguaagccuucaaagaa

SEQ ID NO: 857961 - RNA, 19 nt, Homo sapiens
uagcucaacuugugauaaa

SEQ ID NO: 857962 - RNA, 19 nt, Homo sapiens
agauugagcuuuaucgaaa

SEQ ID NO: 857963 - RNA, 19 nt, Homo sapiens
gcaagccaguaauaaagaa

SEQ ID NO: 857964 - RNA, 19 nt, Homo sapiens
gaaaguucagauuguguua

SEQ ID NO: 857965 - RNA, 19 nt, Homo sapiens
gaagaacccaagaaauuau

SEQ ID NO: 857966 - RNA, 19 nt, Homo sapiens
ccuggaagcuuggugaaua

SEQ ID NO: 857967 - RNA, 19 nt, Homo sapiens
agugaaagauuacuucuga

SEQ ID NO: 857968 - RNA, 19 nt, Homo sapiens
guucaacucuauaaaggaa

SEQ ID NO: 857969 - RNA, 19 nt, Homo sapiens
gcuguuaaauucucagguu

SEQ ID NO: 857970 - RNA, 19 nt, Homo sapiens
gaacagugccauuaagaca

SEQ ID NO: 857971 - RNA, 19 nt, Homo sapiens
guaaugggaaugagaauga

SEQ ID NO: 857972 - RNA, 19 nt, Homo sapiens
aaaccaaguucaaaggaaa

SEQ ID NO: 857973 - RNA, 19 nt, Homo sapiens
gaucuuagaauaugcaguu

SEQ ID NO: 857974 - RNA, 19 nt, Homo sapiens
cagauuguguuacucauga

SEQ ID NO: 857975 - RNA, 19 nt, Homo sapiens
uacaaaggcuugcuaagug

SEQ ID NO: 857976 - RNA, 19 nt, Homo sapiens
agaagaacccaagaaauua

SEQ ID NO: 857977 - RNA, 19 nt, Homo sapiens
guacugcuaucucgcauuc

SEQ ID NO: 857978 - RNA, 19 nt, Homo sapiens
ggaaggugaugcuguucuu

SEQ ID NO: 857979 - RNA, 19 nt, Homo sapiens
cugauagccuaguuaaaua

SEQ ID NO: 857980 - RNA, 19 nt, Homo sapiens
gagagauggucagaaauau

SEQ ID NO: 857981 - RNA, 19 nt, Homo sapiens
ugaagaaaguacuagagaa

SEQ ID NO: 857982 - RNA, 19 nt, Homo sapiens
cacuacagauugagcuuua

SEQ ID NO: 857983 - RNA, 19 nt, Homo sapiens
ggaguuaggagaaagaaga

SEQ ID NO: 857984 - RNA, 19 nt, Homo sapiens
ggaucaagauauuuacugu

SEQ ID NO: 857985 - RNA, 19 nt, Homo sapiens
gauugauccuuaccuugua

SEQ ID NO: 857986 - RNA, 19 nt, Homo sapiens
ggccaaacacugaugauuu

SEQ ID NO: 857987 - RNA, 19 nt, Homo sapiens
ucagaaauauccuguacau

SEQ ID NO: 857988 - RNA, 19 nt, Homo sapiens
guugaucaguuaugaaaug

SEQ ID NO: 857989 - RNA, 19 nt, Homo sapiens
uaaaccaaguucaaaggaa

SEQ ID NO: 857990 - RNA, 19 nt, Homo sapiens
gaaaaggaguuaggagaaa

SEQ ID NO: 857991 - RNA, 19 nt, Homo sapiens
ucauuagccuuucuuguga

SEQ ID NO: 857992 - RNA, 19 nt, Homo sapiens
gaagugaaaggaucaagau

SEQ ID NO: 857993 - RNA, 19 nt, Homo sapiens
guguaagccuucaaagaaa

SEQ ID NO: 857994 - RNA, 19 nt, Homo sapiens
gaaagcuguuaaauucuca

SEQ ID NO: 857995 - RNA, 19 nt, Homo sapiens
uaucaaaggcagaucagua

SEQ ID NO: 857996 - RNA, 19 nt, Homo sapiens
ggucagaaauauccuguac

SEQ ID NO: 857997 - RNA, 19 nt, Homo sapiens
caggagcacuacagauuga

SEQ ID NO: 857998 - RNA, 19 nt, Homo sapiens
cgucauggauaugcuuaua

SEQ ID NO: 857999 - RNA, 19 nt, Homo sapiens
gggcaucguuugaagaaca

SEQ ID NO: 858000 - RNA, 19 nt, Homo sapiens
gaggcaagccaguaauaaa

SEQ ID NO: 858001 - RNA, 19 nt, Homo sapiens
caccuacacuggcaacauu

SEQ ID NO: 858002 - RNA, 19 nt, Homo sapiens
ccacaucaccagaaaucua

SEQ ID NO: 858003 - RNA, 19 nt, Homo sapiens
acuggacucuuuauccuua

SEQ ID NO: 858004 - RNA, 19 nt, Homo sapiens
caagaagagaaaucugaua

SEQ ID NO: 858005 - RNA, 19 nt, Homo sapiens
gaaaguacuagagaaauca

SEQ ID NO: 858006 - RNA, 19 nt, Homo sapiens
ggcacauagugaaagauua

SEQ ID NO: 858007 - RNA, 19 nt, Homo sapiens
gaaaucuaacucccugaaa

SEQ ID NO: 858008 - RNA, 19 nt, Homo sapiens
ucuaugacauugauuggaa

SEQ ID NO: 858009 - RNA, 19 nt, Homo sapiens
uauguaagcgucauggaua

SEQ ID NO: 858010 - RNA, 19 nt, Homo sapiens
ugaagaacagugccauuaa

SEQ ID NO: 858011 - RNA, 19 nt, Homo sapiens
caaggaacaagaagagaaa

SEQ ID NO: 858012 - RNA, 19 nt, Homo sapiens
ucauucggcuccuaaagaa

SEQ ID NO: 858013 - RNA, 19 nt, Homo sapiens
agagauaauugcaguggaa

SEQ ID NO: 858014 - RNA, 19 nt, Homo sapiens
gaaaaggaauguagcucaa

SEQ ID NO: 858015 - RNA, 19 nt, Homo sapiens
gugaauaauuggaagaaag

SEQ ID NO: 858016 - RNA, 19 nt, Homo sapiens
ggaggcaagccaguaauaa

SEQ ID NO: 858017 - RNA, 19 nt, Homo sapiens
ggcaaugucuagaguaugg

SEQ ID NO: 858018 - RNA, 19 nt, Homo sapiens
uggauaugcuuauacaaga

SEQ ID NO: 858019 - RNA, 19 nt, Homo sapiens
cgaaagcuguuaaauucuc

SEQ ID NO: 858020 - RNA, 19 nt, Homo sapiens
aucgaaagcuguuaaauuc

SEQ ID NO: 858021 - RNA, 19 nt, Homo sapiens
gaauauaaccacucaagcu

SEQ ID NO: 858022 - RNA, 19 nt, Homo sapiens
gaauccagccacugacauu

SEQ ID NO: 858023 - RNA, 19 nt, Homo sapiens
gaucucacuuaauucucua

SEQ ID NO: 858024 - RNA, 19 nt, Homo sapiens
ggaucucacuuaauucucu

SEQ ID NO: 858025 - RNA, 19 nt, Homo sapiens
cuucaaggguuguuggaaa

SEQ ID NO: 858026 - RNA, 19 nt, Homo sapiens
uggcagauguggagcuauu

SEQ ID NO: 858027 - RNA, 19 nt, Homo sapiens
gaaggugaugcuguucuua

SEQ ID NO: 858028 - RNA, 19 nt, Homo sapiens
agaaaguacuagagaaauc

SEQ ID NO: 858029 - RNA, 19 nt, Homo sapiens
gcacauagugaaagauuac

SEQ ID NO: 858030 - RNA, 19 nt, Homo sapiens
ucacgacugcugaauauga

SEQ ID NO: 858031 - RNA, 19 nt, Homo sapiens
gaaaagagucuauacaaag

SEQ ID NO: 858032 - RNA, 19 nt, Homo sapiens
ggaagugaaaggaucaaga

SEQ ID NO: 858033 - RNA, 19 nt, Homo sapiens
cuagagaaaucaauaacag

SEQ ID NO: 858034 - RNA, 19 nt, Homo sapiens
gacaaugacuuccucaguu

SEQ ID NO: 858035 - RNA, 19 nt, Homo sapiens
gcacaagggcuucaugaug

SEQ ID NO: 858036 - RNA, 19 nt, Homo sapiens
caacucagcccagggauuu

SEQ ID NO: 858037 - RNA, 19 nt, Homo sapiens
acaaugacuuccucaguug

SEQ ID NO: 858038 - RNA, 19 nt, Homo sapiens
cauacuacuugcagacuga

SEQ ID NO: 858039 - RNA, 19 nt, Homo sapiens
ggacaaugacuuccucagu

SEQ ID NO: 858040 - RNA, 19 nt, Homo sapiens
ccaaugccacccaaacuga

SEQ ID NO: 858041 - RNA, 19 nt, Homo sapiens
gccaagauccgagucaaga

SEQ ID NO: 858042 - RNA, 19 nt, Homo sapiens
uuguguggcuuucugagua

SEQ ID NO: 858043 - RNA, 19 nt, Homo sapiens
aggccaagguggagucuga

SEQ ID NO: 858044 - RNA, 19 nt, Homo sapiens
gaagagccacaggacaaug

SEQ ID NO: 858045 - RNA, 19 nt, Homo sapiens
cagcacaagggcuucauga

SEQ ID NO: 858046 - RNA, 19 nt, Homo sapiens
ccacccaaacugaguguga

SEQ ID NO: 858047 - RNA, 19 nt, Homo sapiens
gcagacugacaaugggaaa

SEQ ID NO: 858048 - RNA, 19 nt, Homo sapiens
acaagggcuucaugaugga

SEQ ID NO: 858049 - RNA, 19 nt, Homo sapiens
cguggaagccuaugugaag

SEQ ID NO: 858050 - RNA, 19 nt, Homo sapiens
cugaagagccacaggacaa

SEQ ID NO: 858051 - RNA, 19 nt, Homo sapiens
ccuccgagucucccuauga

SEQ ID NO: 858052 - RNA, 19 nt, Homo sapiens
cacccaaacugagugugaa

SEQ ID NO: 858053 - RNA, 19 nt, Homo sapiens
gccagcaccucaaguucca

SEQ ID NO: 858054 - RNA, 19 nt, Homo sapiens
caccuggacauacuacuug

SEQ ID NO: 858055 - RNA, 19 nt, Homo sapiens
cagagcagcaggccuguag

SEQ ID NO: 858056 - RNA, 19 nt, Homo sapiens
caagguggagucugaagag

SEQ ID NO: 858057 - RNA, 19 nt, Homo sapiens
ccaccuggacauacuacuu

SEQ ID NO: 858058 - RNA, 19 nt, Homo sapiens
gcacugguuccuccuuguc

SEQ ID NO: 858059 - RNA, 19 nt, Homo sapiens
ccaagguggagucugaaga

SEQ ID NO: 858060 - RNA, 19 nt, Homo sapiens
gcagagcagcaggccugua

SEQ ID NO: 858061 - RNA, 19 nt, Homo sapiens
gaaccccaguccuguguca

SEQ ID NO: 858062 - RNA, 19 nt, Homo sapiens
guuucagacucagcccaua

SEQ ID NO: 858063 - RNA, 19 nt, Homo sapiens
ccucugcaaugaccuuguc

SEQ ID NO: 858064 - RNA, 19 nt, Homo sapiens
uuuccacccucugcaauga

SEQ ID NO: 858065 - RNA, 19 nt, Homo sapiens
agccggagcagaagagaaa

SEQ ID NO: 858066 - RNA, 19 nt, Homo sapiens
uguguggcuuucugaguau

SEQ ID NO: 858067 - RNA, 19 nt, Homo sapiens
ggaccugaccaagcuguag

SEQ ID NO: 858068 - RNA, 19 nt, Homo sapiens
gcagcacaagggcuucaug

SEQ ID NO: 858069 - RNA, 19 nt, Homo sapiens
aagagccacaggacaauga

SEQ ID NO: 858070 - RNA, 19 nt, Homo sapiens
aaaguggugguguuucaga

SEQ ID NO: 858071 - RNA, 19 nt, Homo sapiens
gaaagaagaucaugaaaca

SEQ ID NO: 858072 - RNA, 19 nt, Homo sapiens
ggaagaagauggaaacaga

SEQ ID NO: 858073 - RNA, 19 nt, Homo sapiens
gaagauggcucgagaagca

SEQ ID NO: 858074 - RNA, 19 nt, Homo sapiens
gagaacagauugagaagga

SEQ ID NO: 858075 - RNA, 19 nt, Homo sapiens
gaacgaaggcagcaacaaa

SEQ ID NO: 858076 - RNA, 19 nt, Homo sapiens
cauaauugcugcuaaccua

SEQ ID NO: 858077 - RNA, 19 nt, Homo sapiens
cggcagaaauccauucaaa

SEQ ID NO: 858078 - RNA, 19 nt, Homo sapiens
gaaccggauugccaccuuu

SEQ ID NO: 858079 - RNA, 19 nt, Homo sapiens
agaaggagaugguguggaa

SEQ ID NO: 858080 - RNA, 19 nt, Homo sapiens
ccuagacauuucauaguua

SEQ ID NO: 858081 - RNA, 19 nt, Homo sapiens
gagaagcgguuggaucaga

SEQ ID NO: 858082 - RNA, 19 nt, Homo sapiens
gagaaguacugcauugaag

SEQ ID NO: 858083 - RNA, 19 nt, Homo sapiens
gaagaugcaagcugagauu

SEQ ID NO: 858084 - RNA, 19 nt, Homo sapiens
gaggaaagaauuagaggaa

SEQ ID NO: 858085 - RNA, 19 nt, Homo sapiens
gaaggaagccaccauggau

SEQ ID NO: 858086 - RNA, 19 nt, Homo sapiens
gagauaagcauacccuuca

SEQ ID NO: 858087 - RNA, 19 nt, Homo sapiens
uccaacaggucaaggaaua

SEQ ID NO: 858088 - RNA, 19 nt, Homo sapiens
gcagaaauccauucaaagg

SEQ ID NO: 858089 - RNA, 19 nt, Homo sapiens
gagauuaagcgcaucaaug

SEQ ID NO: 858090 - RNA, 19 nt, Homo sapiens
gcuaacauccugccagcua

SEQ ID NO: 858091 - RNA, 19 nt, Homo sapiens
ucgaugagaucaagaggaa

SEQ ID NO: 858092 - RNA, 19 nt, Homo sapiens
ugauggaguuuaccaagaa

SEQ ID NO: 858093 - RNA, 19 nt, Homo sapiens
gagaugguguggaacaaca

SEQ ID NO: 858094 - RNA, 19 nt, Homo sapiens
gcaagauuauccucaaugc

SEQ ID NO: 858095 - RNA, 19 nt, Homo sapiens
gagcaagauuauccucaau

SEQ ID NO: 858096 - RNA, 19 nt, Homo sapiens
gcagugaugacacgaaaga

SEQ ID NO: 858097 - RNA, 19 nt, Homo sapiens
ccaaagccgugagcucuga

SEQ ID NO: 858098 - RNA, 19 nt, Homo sapiens
gaugcaagcugagauuaag

SEQ ID NO: 858099 - RNA, 19 nt, Homo sapiens
caaagaggaggcccagaaa

SEQ ID NO: 858100 - RNA, 19 nt, Homo sapiens
gcucagagagaacagauug

SEQ ID NO: 858101 - RNA, 19 nt, Homo sapiens
gggaugaguucgagaggau

SEQ ID NO: 858102 - RNA, 19 nt, Homo sapiens
ccaacaagcugcggaugga

SEQ ID NO: 858103 - RNA, 19 nt, Homo sapiens
caccauggaugcagugaug

SEQ ID NO: 858104 - RNA, 19 nt, Homo sapiens
gcuuacagcaugccaauga

SEQ ID NO: 858105 - RNA, 19 nt, Homo sapiens
gaggagggaggaaagaauu

SEQ ID NO: 858106 - RNA, 19 nt, Homo sapiens
gaacuggacacagaagaga

SEQ ID NO: 858107 - RNA, 19 nt, Homo sapiens
agauuaagcgcaucaauga

SEQ ID NO: 858108 - RNA, 19 nt, Homo sapiens
aagauuauccucaaugcua

SEQ ID NO: 858109 - RNA, 19 nt, Homo sapiens
gaggaaggcggcaaauugu

SEQ ID NO: 858110 - RNA, 19 nt, Homo sapiens
ucaaagaggaggcccagaa

SEQ ID NO: 858111 - RNA, 19 nt, Homo sapiens
gacagagaguggcgcagaa

SEQ ID NO: 858112 - RNA, 19 nt, Homo sapiens
aggagaaggcccaggauua

SEQ ID NO: 858113 - RNA, 19 nt, Homo sapiens
gugauggaguuuaccaaga

SEQ ID NO: 858114 - RNA, 19 nt, Homo sapiens
cauugaagcugagcgcaaa

SEQ ID NO: 858115 - RNA, 19 nt, Homo sapiens
agaggaaggcggcaaauug

SEQ ID NO: 858116 - RNA, 19 nt, Homo sapiens
gaaguggagcggcagaaau

SEQ ID NO: 858117 - RNA, 19 nt, Homo sapiens
gauaagcauacccuucaaa

SEQ ID NO: 858118 - RNA, 19 nt, Homo sapiens
gaagaagauggcucgagaa

SEQ ID NO: 858119 - RNA, 19 nt, Homo sapiens
aggaggaacuggagaggaa

SEQ ID NO: 858120 - RNA, 19 nt, Homo sapiens
ucaaggacaugagcaagau

SEQ ID NO: 858121 - RNA, 19 nt, Homo sapiens
aagaagaucaugaaacaga

SEQ ID NO: 858122 - RNA, 19 nt, Homo sapiens
uaaccuagacauuucauag

SEQ ID NO: 858123 - RNA, 19 nt, Homo sapiens
gcgcaucgaugagaucaag

SEQ ID NO: 858124 - RNA, 19 nt, Homo sapiens
agagagaacagauugagaa

SEQ ID NO: 858125 - RNA, 19 nt, Homo sapiens
ccaggagguugcagacaga

SEQ ID NO: 858126 - RNA, 19 nt, Homo sapiens
gcaaauuguggaacagaug

SEQ ID NO: 858127 - RNA, 19 nt, Homo sapiens
cagcagaaguccggaguca

SEQ ID NO: 858128 - RNA, 19 nt, Homo sapiens
ggagggagaaagagaagga

SEQ ID NO: 858129 - RNA, 19 nt, Homo sapiens
gaagaggagggaggaaaga

SEQ ID NO: 858130 - RNA, 19 nt, Homo sapiens
ggaauaaggcucgcuaucg

SEQ ID NO: 858131 - RNA, 19 nt, Homo sapiens
uggaggagguggccaagga

SEQ ID NO: 858132 - RNA, 19 nt, Homo sapiens
gaggagaugccacuaagca

SEQ ID NO: 858133 - RNA, 19 nt, Homo sapiens
gcgagaaccagcagaagga

SEQ ID NO: 858134 - RNA, 19 nt, Homo sapiens
ucgaacagguggcuuucaa

SEQ ID NO: 858135 - RNA, 19 nt, Homo sapiens
ggagaaggcccaggauuac

SEQ ID NO: 858136 - RNA, 19 nt, Homo sapiens
gagaagcagcagauccaaa

SEQ ID NO: 858137 - RNA, 19 nt, Homo sapiens
agauuauccucaaugcuaa

SEQ ID NO: 858138 - RNA, 19 nt, Homo sapiens
agaagaucaugaaacagaa

SEQ ID NO: 858139 - RNA, 19 nt, Homo sapiens
cugcuaaccuagacauuuc

SEQ ID NO: 858140 - RNA, 19 nt, Homo sapiens
cgagaaguacugcauugaa

SEQ ID NO: 858141 - RNA, 19 nt, Homo sapiens
ggaaguggagcggcagaaa

SEQ ID NO: 858142 - RNA, 19 nt, Homo sapiens
gacauuucauaguuacaga

SEQ ID NO: 858143 - RNA, 19 nt, Homo sapiens
gcugcuaaccuagacauuu

SEQ ID NO: 858144 - RNA, 19 nt, Homo sapiens
gaaaaugcgcggaagaaga

SEQ ID NO: 858145 - RNA, 19 nt, Homo sapiens
cauccauaauugcugcuaa

SEQ ID NO: 858146 - RNA, 19 nt, Homo sapiens
ucucugggcauccauaauu

SEQ ID NO: 858147 - RNA, 19 nt, Homo sapiens
gcuccaagaggaagaucua

SEQ ID NO: 858148 - RNA, 19 nt, Homo sapiens
gccgugagcgcaucgauga

SEQ ID NO: 858149 - RNA, 19 nt, Homo sapiens
gaagugcagaaccggauug

SEQ ID NO: 858150 - RNA, 19 nt, Homo sapiens
gaaacagaaagcagaacug

SEQ ID NO: 858151 - RNA, 19 nt, Homo sapiens
gcagaugcuggaauauaug

SEQ ID NO: 858152 - RNA, 19 nt, Homo sapiens
ggaagaggagggaggaaag

SEQ ID NO: 858153 - RNA, 19 nt, Homo sapiens
gugaugacacgaaagaaga

SEQ ID NO: 858154 - RNA, 19 nt, Homo sapiens
ugagggccaugcaggagaa

SEQ ID NO: 858155 - RNA, 19 nt, Homo sapiens
gcugaggagaugccacuaa

SEQ ID NO: 858156 - RNA, 19 nt, Homo sapiens
ccaagaggaagaucuaaag

SEQ ID NO: 858157 - RNA, 19 nt, Homo sapiens
gcagaaaggaaaaggaaaa

SEQ ID NO: 858158 - RNA, 19 nt, Homo sapiens
gagaguggcgcagaaagga

SEQ ID NO: 858159 - RNA, 19 nt, Homo sapiens
aagagaagcgguuggauca

SEQ ID NO: 858160 - RNA, 19 nt, Homo sapiens
aaggacaugagcaagauua

SEQ ID NO: 858161 - RNA, 19 nt, Homo sapiens
aggaggagcucaaggacau

SEQ ID NO: 858162 - RNA, 19 nt, Homo sapiens
acaacaagaagcucaguga

SEQ ID NO: 858163 - RNA, 19 nt, Homo sapiens
cgaaagaagaucaugaaac

SEQ ID NO: 858164 - RNA, 19 nt, Homo sapiens
gagccucuuuggagauauc

SEQ ID NO: 858165 - RNA, 19 nt, Homo sapiens
gggaccaggccuucaagaa

SEQ ID NO: 858166 - RNA, 19 nt, Homo sapiens
gguccgagaacucauuguu

SEQ ID NO: 858167 - RNA, 19 nt, Homo sapiens
gaguggcgcagaaaggaaa

SEQ ID NO: 858168 - RNA, 19 nt, Homo sapiens
gaguuuaccaagaagaaga

SEQ ID NO: 858169 - RNA, 19 nt, Homo sapiens
ccagaaacagaaagcagaa

SEQ ID NO: 858170 - RNA, 19 nt, Homo sapiens
aggaagaucuaaaggacau

SEQ ID NO: 858171 - RNA, 19 nt, Homo sapiens
gcagagagcuuugcuuuua

SEQ ID NO: 858172 - RNA, 19 nt, Homo sapiens
ugaagucgcuugagaaaga

SEQ ID NO: 858173 - RNA, 19 nt, Homo sapiens
caggugagguccagagaua

SEQ ID NO: 858174 - RNA, 19 nt, Homo sapiens
uugagaaccugcagaaaua

SEQ ID NO: 858175 - RNA, 19 nt, Homo sapiens
ggaagaggaugaugaggau

SEQ ID NO: 858176 - RNA, 19 nt, Homo sapiens
gagcugaagucgcuugaga

SEQ ID NO: 858177 - RNA, 19 nt, Homo sapiens
gaaaggauucuucuucuca

SEQ ID NO: 858178 - RNA, 19 nt, Homo sapiens
aagaagagaucgagguuga

SEQ ID NO: 858179 - RNA, 19 nt, Homo sapiens
cagaagagcccacagagaa

SEQ ID NO: 858180 - RNA, 19 nt, Homo sapiens
gaugccaccugaugcagua

SEQ ID NO: 858181 - RNA, 19 nt, Homo sapiens
ccagagauauauccagaga

SEQ ID NO: 858182 - RNA, 19 nt, Homo sapiens
ccaaggcgcuggugcaaca

SEQ ID NO: 858183 - RNA, 19 nt, Homo sapiens
caacuggccacuccaaauu

SEQ ID NO: 858184 - RNA, 19 nt, Homo sapiens
agaaauugcuggccaagau

SEQ ID NO: 858185 - RNA, 19 nt, Homo sapiens
ccacaagauugccaaacaa

SEQ ID NO: 858186 - RNA, 19 nt, Homo sapiens
gagucugccuggaaacuuu

SEQ ID NO: 858187 - RNA, 19 nt, Homo sapiens
ggacacaggaccacaagau

SEQ ID NO: 858188 - RNA, 19 nt, Homo sapiens
ggacacaccagaagaccaa

SEQ ID NO: 858189 - RNA, 19 nt, Homo sapiens
aaacagagcgagagagaug

SEQ ID NO: 858190 - RNA, 19 nt, Homo sapiens
ggugagguccagagauaua

SEQ ID NO: 858191 - RNA, 19 nt, Homo sapiens
cagaggacaucgccaagga

SEQ ID NO: 858192 - RNA, 19 nt, Homo sapiens
gcugggaccuccuccuguu

SEQ ID NO: 858193 - RNA, 19 nt, Homo sapiens
gaagucgcuugagaaagaa

SEQ ID NO: 858194 - RNA, 19 nt, Homo sapiens
caccagagcagacccauga

SEQ ID NO: 858195 - RNA, 19 nt, Homo sapiens
ccagaucugcuaaugcuuu

SEQ ID NO: 858196 - RNA, 19 nt, Homo sapiens
gaucgagguugaggaggaa

SEQ ID NO: 858197 - RNA, 19 nt, Homo sapiens
gaggaccacuucauuacag

SEQ ID NO: 858198 - RNA, 19 nt, Homo sapiens
gcugaagucgcuugagaaa

SEQ ID NO: 858199 - RNA, 19 nt, Homo sapiens
ccacagcagccgcuucuga

SEQ ID NO: 858200 - RNA, 19 nt, Homo sapiens
accagaagaccaagauuua

SEQ ID NO: 858201 - RNA, 19 nt, Homo sapiens
gcgcucaacccgccucaaa

SEQ ID NO: 858202 - RNA, 19 nt, Homo sapiens
gaaauugcuggccaagaug

SEQ ID NO: 858203 - RNA, 19 nt, Homo sapiens
gaggacaucgccaaggaaa

SEQ ID NO: 858204 - RNA, 19 nt, Homo sapiens
uuaggagucugccuggaaa

SEQ ID NO: 858205 - RNA, 19 nt, Homo sapiens
agccaaagcugcagaagca

SEQ ID NO: 858206 - RNA, 19 nt, Homo sapiens
caccagaagaccaagauuu

SEQ ID NO: 858207 - RNA, 19 nt, Homo sapiens
agaagcagguccagacaca

SEQ ID NO: 858208 - RNA, 19 nt, Homo sapiens
ggaugacaguaccgaaaca

SEQ ID NO: 858209 - RNA, 19 nt, Homo sapiens
agacaaugccuguggaaga

SEQ ID NO: 858210 - RNA, 19 nt, Homo sapiens
acacaggaccacaagauug

SEQ ID NO: 858211 - RNA, 19 nt, Homo sapiens
gaaaacagagcgagagaga

SEQ ID NO: 858212 - RNA, 19 nt, Homo sapiens
ccacagcaacacuggguaa

SEQ ID NO: 858213 - RNA, 19 nt, Homo sapiens
ggcuauaucugccgcaucu

SEQ ID NO: 858214 - RNA, 19 nt, Homo sapiens
gcauggaagagauucagaa

SEQ ID NO: 858215 - RNA, 19 nt, Homo sapiens
ggaagggcucggagaccua

SEQ ID NO: 858216 - RNA, 19 nt, Homo sapiens
gcaggugcagccacaggua

SEQ ID NO: 858217 - RNA, 19 nt, Homo sapiens
cccaagugcugccacgauu

SEQ ID NO: 858218 - RNA, 19 nt, Homo sapiens
gacacaggaccacaagauu

SEQ ID NO: 858219 - RNA, 19 nt, Homo sapiens
gggagaaugugaaaacaga

SEQ ID NO: 858220 - RNA, 19 nt, Homo sapiens
ggauucuucuucucagaca

SEQ ID NO: 858221 - RNA, 19 nt, Homo sapiens
cgaaaggauucuucuucuc

SEQ ID NO: 858222 - RNA, 19 nt, Homo sapiens
ccaugaacccuucccaguu

SEQ ID NO: 858223 - RNA, 19 nt, Homo sapiens
uggaaacuuugacaugguu

SEQ ID NO: 858224 - RNA, 19 nt, Homo sapiens
cgacccuucugcaccguuu

SEQ ID NO: 858225 - RNA, 19 nt, Homo sapiens
gacaaugccuguggaagac

SEQ ID NO: 858226 - RNA, 19 nt, Homo sapiens
guccagaucugcuaaugcu

SEQ ID NO: 858227 - RNA, 19 nt, Homo sapiens
gaugugggagaaugugaaa

SEQ ID NO: 858228 - RNA, 19 nt, Homo sapiens
caagucagcauggaagaga

SEQ ID NO: 858229 - RNA, 19 nt, Homo sapiens
gcacccaagucagcaugga

SEQ ID NO: 858230 - RNA, 19 nt, Homo sapiens
ucgaaaggauucuucuucu

SEQ ID NO: 858231 - RNA, 19 nt, Homo sapiens
caaauuugcaacaguucuu

SEQ ID NO: 858232 - RNA, 19 nt, Homo sapiens
ugaagaagagaucgagguu

SEQ ID NO: 858233 - RNA, 19 nt, Homo sapiens
ugaagaagaggaagaggau

SEQ ID NO: 858234 - RNA, 19 nt, Homo sapiens
cugcagagagcuuugcuuu

SEQ ID NO: 858235 - RNA, 19 nt, Homo sapiens
gcaggacacaggaccacaa

SEQ ID NO: 858236 - RNA, 19 nt, Homo sapiens
gggacguccuggagacaga

SEQ ID NO: 858237 - RNA, 19 nt, Homo sapiens
uaagcaggcccuccaguuc

SEQ ID NO: 858238 - RNA, 19 nt, Homo sapiens
cagcgcaggugucaguaca

SEQ ID NO: 858239 - RNA, 19 nt, Homo sapiens
ugaugaggaugaagaagag

SEQ ID NO: 858240 - RNA, 19 nt, Homo sapiens
ggaugaugaggaugaagaa

SEQ ID NO: 858241 - RNA, 19 nt, Homo sapiens
aagaagaggaagaggauga

SEQ ID NO: 858242 - RNA, 19 nt, Homo sapiens
ggagaugccaccugaugca

SEQ ID NO: 858243 - RNA, 19 nt, Homo sapiens
cgagggugaugaagaagag

SEQ ID NO: 858244 - RNA, 19 nt, Homo sapiens
ccagagcaaacaccaguug

SEQ ID NO: 858245 - RNA, 19 nt, Homo sapiens
guaccgaaacagacacaga

SEQ ID NO: 858246 - RNA, 19 nt, Homo sapiens
ggauggacacaccagaaga

SEQ ID NO: 858247 - RNA, 19 nt, Homo sapiens
cuccaaauuugcaacaguu

SEQ ID NO: 858248 - RNA, 19 nt, Homo sapiens
gcccaacacccaggacaaa

SEQ ID NO: 858249 - RNA, 19 nt, Homo sapiens
ggaguuccaggaccacaug

SEQ ID NO: 858250 - RNA, 19 nt, Homo sapiens
gcagaagcagguccagaca

SEQ ID NO: 858251 - RNA, 19 nt, Homo sapiens
caaugccuguggaagacaa

SEQ ID NO: 858252 - RNA, 19 nt, Homo sapiens
agcagcagcuccagcaguu

SEQ ID NO: 858253 - RNA, 19 nt, Homo sapiens
gcaucugccacaaguucua

SEQ ID NO: 858254 - RNA, 19 nt, Homo sapiens
gcagcagcuccagcaguua

SEQ ID NO: 858255 - RNA, 19 nt, Homo sapiens
cuaagcaggcccuccaguu

SEQ ID NO: 858256 - RNA, 19 nt, Homo sapiens
gaagaggaagaggaugaug

SEQ ID NO: 858257 - RNA, 19 nt, Homo sapiens
uaccagcacucccucuaag

SEQ ID NO: 858258 - RNA, 19 nt, Homo sapiens
guacagccacaggcacauu

SEQ ID NO: 858259 - RNA, 19 nt, Homo sapiens
ucagaagagcccacagaga

SEQ ID NO: 858260 - RNA, 19 nt, Homo sapiens
gaaacuuugacaugguuca

SEQ ID NO: 858261 - RNA, 19 nt, Homo sapiens
cuaccagcacucccucuaa

SEQ ID NO: 858262 - RNA, 19 nt, Homo sapiens
aggcagagccgcugaagca

SEQ ID NO: 858263 - RNA, 19 nt, Homo sapiens
acuuagugcugcaacagaa

SEQ ID NO: 858264 - RNA, 19 nt, Homo sapiens
gacaguaccgaaacagaca

SEQ ID NO: 858265 - RNA, 19 nt, Homo sapiens
aagaggaugaugaggauga

SEQ ID NO: 858266 - RNA, 19 nt, Homo sapiens
aagaggaagaggaugauga

SEQ ID NO: 858267 - RNA, 19 nt, Homo sapiens
ccugccagcucuacuacau

SEQ ID NO: 858268 - RNA, 19 nt, Homo sapiens
gcuaccagcacucccucua

SEQ ID NO: 858269 - RNA, 19 nt, Homo sapiens
gccuagaugugggagaaug

SEQ ID NO: 858270 - RNA, 19 nt, Homo sapiens
ggaggcagagccacagaag

SEQ ID NO: 858271 - RNA, 19 nt, Homo sapiens
ggaaagaacuguacaggaa

SEQ ID NO: 858272 - RNA, 19 nt, Homo sapiens
gaaacucucucgccucuuu

SEQ ID NO: 858273 - RNA, 19 nt, Homo sapiens
gugcugaucucgaguguua

SEQ ID NO: 858274 - RNA, 19 nt, Homo sapiens
gaaccuaccagauguauuu

SEQ ID NO: 858275 - RNA, 19 nt, Homo sapiens
gcaagugccacauucauua

SEQ ID NO: 858276 - RNA, 19 nt, Homo sapiens
gaccaacacuucccuaugu

SEQ ID NO: 858277 - RNA, 19 nt, Homo sapiens
gaaugacgacaguauguua

SEQ ID NO: 858278 - RNA, 19 nt, Homo sapiens
gcacugaaccuaccagaug

SEQ ID NO: 858279 - RNA, 19 nt, Homo sapiens
aaugacagauuucccuuua

SEQ ID NO: 858280 - RNA, 19 nt, Homo sapiens
acaaagaucuucagaaacu

SEQ ID NO: 858281 - RNA, 19 nt, Homo sapiens
gaaaccugauuguuguaaa

SEQ ID NO: 858282 - RNA, 19 nt, Homo sapiens
ugacagauuucccuuuaga

SEQ ID NO: 858283 - RNA, 19 nt, Homo sapiens
uuagagaccuuguaucaau

SEQ ID NO: 858284 - RNA, 19 nt, Homo sapiens
gaacugaaacuacggaucu

SEQ ID NO: 858285 - RNA, 19 nt, Homo sapiens
gaagaggcacauacaaaga

SEQ ID NO: 858286 - RNA, 19 nt, Homo sapiens
cuacagaugucaacuccuu

SEQ ID NO: 858287 - RNA, 19 nt, Homo sapiens
ccaaucaguucacucauuc

SEQ ID NO: 858288 - RNA, 19 nt, Homo sapiens
gaccaaagaccaacacuuc

SEQ ID NO: 858289 - RNA, 19 nt, Homo sapiens
agacacagauuggaaagaa

SEQ ID NO: 858290 - RNA, 19 nt, Homo sapiens
guugauacaucuucucaug

SEQ ID NO: 858291 - RNA, 19 nt, Homo sapiens
gggugaauaugaccaaaga

SEQ ID NO: 858292 - RNA, 19 nt, Homo sapiens
ccagaaaccuuuuaagaga

SEQ ID NO: 858293 - RNA, 19 nt, Homo sapiens
acaaugagauuagaagugu

SEQ ID NO: 858294 - RNA, 19 nt, Homo sapiens
gaagcugagucaauucaag

SEQ ID NO: 858295 - RNA, 19 nt, Homo sapiens
gaugaacaaccaagugauu

SEQ ID NO: 858296 - RNA, 19 nt, Homo sapiens
ggaagaggcacauacaaag

SEQ ID NO: 858297 - RNA, 19 nt, Homo sapiens
ucaaucagcugacuguucu

SEQ ID NO: 858298 - RNA, 19 nt, Homo sapiens
gacuugauauguuugauuc

SEQ ID NO: 858299 - RNA, 19 nt, Homo sapiens
gaauaugaccaaagaccaa

SEQ ID NO: 858300 - RNA, 19 nt, Homo sapiens
ccacugagaccacgcuuug

SEQ ID NO: 858301 - RNA, 19 nt, Homo sapiens
ucuaauacccgauuuacaa

SEQ ID NO: 858302 - RNA, 19 nt, Homo sapiens
cugagucaauucaagauaa

SEQ ID NO: 858303 - RNA, 19 nt, Homo sapiens
gaaagggcgguuugugaug

SEQ ID NO: 858304 - RNA, 19 nt, Homo sapiens
ggacuugauauguuugauu

SEQ ID NO: 858305 - RNA, 19 nt, Homo sapiens
caacucacaccauuccauu

SEQ ID NO: 858306 - RNA, 19 nt, Homo sapiens
aaagaacuguacaggaaga

SEQ ID NO: 858307 - RNA, 19 nt, Homo sapiens
gccaccagcuccaaucaga

SEQ ID NO: 858308 - RNA, 19 nt, Homo sapiens
gcucuugguucuccucuag

SEQ ID NO: 858309 - RNA, 19 nt, Homo sapiens
ggagacgcccagccaguuu

SEQ ID NO: 858310 - RNA, 19 nt, Homo sapiens
ucacaccauuccauucuau

SEQ ID NO: 858311 - RNA, 19 nt, Homo sapiens
gaaacuaggggaaaaugua

SEQ ID NO: 858312 - RNA, 19 nt, Homo sapiens
ggaaaccugauuguuguaa

SEQ ID NO: 858313 - RNA, 19 nt, Homo sapiens
aaugaugccuugauagugu

SEQ ID NO: 858314 - RNA, 19 nt, Homo sapiens
cauuagagaccuuguauca

SEQ ID NO: 858315 - RNA, 19 nt, Homo sapiens
gaacccaugcucuguagug

SEQ ID NO: 858316 - RNA, 19 nt, Homo sapiens
gacauuccagcgccuaaua

SEQ ID NO: 858317 - RNA, 19 nt, Homo sapiens
ccggagaaguggaaguuga

SEQ ID NO: 858318 - RNA, 19 nt, Homo sapiens
ugccaaugaugccuugaua

SEQ ID NO: 858319 - RNA, 19 nt, Homo sapiens
cccaaucaguucacucauu

SEQ ID NO: 858320 - RNA, 19 nt, Homo sapiens
ggauguucguuccgucuug

SEQ ID NO: 858321 - RNA, 19 nt, Homo sapiens
uagccaacauauacaaaga

SEQ ID NO: 858322 - RNA, 19 nt, Homo sapiens
ugggaaaccugauuguugu

SEQ ID NO: 858323 - RNA, 19 nt, Homo sapiens
aagagaccuuggcuucaua

SEQ ID NO: 858324 - RNA, 19 nt, Homo sapiens
agacuagcauacaggauga

SEQ ID NO: 858325 - RNA, 19 nt, Homo sapiens
auaaugagcaacccucuuu

SEQ ID NO: 858326 - RNA, 19 nt, Homo sapiens
cccaaagguuccucuguga

SEQ ID NO: 858327 - RNA, 19 nt, Homo sapiens
ugacuguucugaugccaau

SEQ ID NO: 858328 - RNA, 19 nt, Homo sapiens
ggaaugacgacaguauguu

SEQ ID NO: 858329 - RNA, 19 nt, Homo sapiens
gccaacauauacaaagauc

SEQ ID NO: 858330 - RNA, 19 nt, Homo sapiens
ccgcuacucucaccugugu

SEQ ID NO: 858331 - RNA, 19 nt, Homo sapiens
ucaagacacagauuggaaa

SEQ ID NO: 858332 - RNA, 19 nt, Homo sapiens
ccucuuuacugcuucaaau

SEQ ID NO: 858333 - RNA, 19 nt, Homo sapiens
ccaaugaugccuugauagu

SEQ ID NO: 858334 - RNA, 19 nt, Homo sapiens
acaaccaagugauucauuc

SEQ ID NO: 858335 - RNA, 19 nt, Homo sapiens
ccgaaagggcgguuuguga

SEQ ID NO: 858336 - RNA, 19 nt, Homo sapiens
agaggcacauacaaagaaa

SEQ ID NO: 858337 - RNA, 19 nt, Homo sapiens
caagauaaugcgcauaugg

SEQ ID NO: 858338 - RNA, 19 nt, Homo sapiens
cgaaagggcgguuugugau

SEQ ID NO: 858339 - RNA, 19 nt, Homo sapiens
gcacauacaaagaaaagaa

SEQ ID NO: 858340 - RNA, 19 nt, Homo sapiens
guuggagucagguuacaua

SEQ ID NO: 858341 - RNA, 19 nt, Homo sapiens
caaagguuccucugugaca

SEQ ID NO: 858342 - RNA, 19 nt, Homo sapiens
gguuugucgugaccucuuu

SEQ ID NO: 858343 - RNA, 19 nt, Homo sapiens
gcugagucaauucaagaua

SEQ ID NO: 858344 - RNA, 19 nt, Homo sapiens
uagcauacaggaugaacaa

SEQ ID NO: 858345 - RNA, 19 nt, Homo sapiens
ccacagauucagagcauuc

SEQ ID NO: 858346 - RNA, 19 nt, Homo sapiens
gcugaucucgaguguuauu

SEQ ID NO: 858347 - RNA, 19 nt, Homo sapiens
cccaugcucuguagugaau

SEQ ID NO: 858348 - RNA, 19 nt, Homo sapiens
guacaggaagaggcacaua

SEQ ID NO: 858349 - RNA, 19 nt, Homo sapiens
gacccaaucaguucacuca

SEQ ID NO: 858350 - RNA, 19 nt, Homo sapiens
aggaagaggcacauacaaa

SEQ ID NO: 858351 - RNA, 19 nt, Homo sapiens
gauuagaagugugaaaaga

SEQ ID NO: 858352 - RNA, 19 nt, Homo sapiens
gaacaaccaagugauucau

SEQ ID NO: 858353 - RNA, 19 nt, Homo sapiens
cauacaggaugaacaacca

SEQ ID NO: 858354 - RNA, 19 nt, Homo sapiens
guuccucugugacaagguu

SEQ ID NO: 858355 - RNA, 19 nt, Homo sapiens
cgugaccucuuuacugcuu

SEQ ID NO: 858356 - RNA, 19 nt, Homo sapiens
uggcagagggcacagguuu

SEQ ID NO: 858357 - RNA, 19 nt, Homo sapiens
ccucuagauugaaguuugu

SEQ ID NO: 858358 - RNA, 19 nt, Homo sapiens
caaugacagauuucccuuu

SEQ ID NO: 858359 - RNA, 19 nt, Homo sapiens
caacaaugagauuagaagu

SEQ ID NO: 858360 - RNA, 19 nt, Homo sapiens
gccaaucucccugcucuug

SEQ ID NO: 858361 - RNA, 19 nt, Homo sapiens
cauuccagcgccuaauaua

SEQ ID NO: 858362 - RNA, 19 nt, Homo sapiens
gcagagggcacagguuucu

SEQ ID NO: 858363 - RNA, 19 nt, Homo sapiens
gaaaagaauccccgaaagg

SEQ ID NO: 858364 - RNA, 19 nt, Homo sapiens
aagaggcacauacaaagaa

SEQ ID NO: 858365 - RNA, 19 nt, Homo sapiens
gauguucguuccgucuugu

SEQ ID NO: 858366 - RNA, 19 nt, Homo sapiens
uagagaccuuguaucaauc

SEQ ID NO: 858367 - RNA, 19 nt, Homo sapiens
gggaaaccugauuguugua

SEQ ID NO: 858368 - RNA, 19 nt, Homo sapiens
ggguguauaagcugcagua

SEQ ID NO: 858369 - RNA, 19 nt, Homo sapiens
ucagggcaccgaagccaaa

SEQ ID NO: 858370 - RNA, 19 nt, Homo sapiens
ucaagauaaugcgcauaug

SEQ ID NO: 858371 - RNA, 19 nt, Homo sapiens
ggaccgcgcuuugggagua

SEQ ID NO: 858372 - RNA, 19 nt, Homo sapiens
gcaaggaugagcucuuuga

SEQ ID NO: 858373 - RNA, 19 nt, Homo sapiens
gcugagagcuucggcuuca

SEQ ID NO: 858374 - RNA, 19 nt, Homo sapiens
ccaaccagcuggacaccaa

SEQ ID NO: 858375 - RNA, 19 nt, Homo sapiens
gcuacacgcuggaguucaa

SEQ ID NO: 858376 - RNA, 19 nt, Homo sapiens
ggacuucgucuucgaguuc

SEQ ID NO: 858377 - RNA, 19 nt, Homo sapiens
uggcaaggaugagcucuuu

SEQ ID NO: 858378 - RNA, 19 nt, Homo sapiens
aggaugagcucuuugaucu

SEQ ID NO: 858379 - RNA, 19 nt, Homo sapiens
ccacgagaccuuccugaug

SEQ ID NO: 858380 - RNA, 19 nt, Homo sapiens
gccugaagaugccgacgaa

SEQ ID NO: 858381 - RNA, 19 nt, Homo sapiens
aaauugaccaggagacaaa

SEQ ID NO: 858382 - RNA, 19 nt, Homo sapiens
cgacgguacugccucaagu

SEQ ID NO: 858383 - RNA, 19 nt, Homo sapiens
gcaaauugaccaggagaca

SEQ ID NO: 858384 - RNA, 19 nt, Homo sapiens
cgggcaagcuggccuucaa

SEQ ID NO: 858385 - RNA, 19 nt, Homo sapiens
gacggaggguucugguaca

SEQ ID NO: 858386 - RNA, 19 nt, Homo sapiens
agaccuuccugaugcaaau

SEQ ID NO: 858387 - RNA, 19 nt, Homo sapiens
acgaagaguucacccucaa

SEQ ID NO: 858388 - RNA, 19 nt, Homo sapiens
cggcaaggacgaagaguuc

SEQ ID NO: 858389 - RNA, 19 nt, Homo sapiens
caaauugaccaggagacaa

SEQ ID NO: 858390 - RNA, 19 nt, Homo sapiens
ggucaacgucucagccaau

SEQ ID NO: 858391 - RNA, 19 nt, Homo sapiens
uggcggcuaucagcgauuu

SEQ ID NO: 858392 - RNA, 19 nt, Homo sapiens
cgccacagccacacaaguu

SEQ ID NO: 858393 - RNA, 19 nt, Homo sapiens
gccacagccacacaaguuu

SEQ ID NO: 858394 - RNA, 19 nt, Homo sapiens
ggaacccgacccaggacaa

SEQ ID NO: 858395 - RNA, 19 nt, Homo sapiens
ccacagccacacaaguuuc

SEQ ID NO: 858396 - RNA, 19 nt, Homo sapiens
agacaaagaagugcaccuu

SEQ ID NO: 858397 - RNA, 19 nt, Homo sapiens
ucaggaugaugaacuagac

SEQ ID NO: 858398 - RNA, 19 nt, Homo sapiens
gugcugaagauccaguuug

SEQ ID NO: 858399 - RNA, 19 nt, Homo sapiens
cagccugucgcgcauuaaa

SEQ ID NO: 858400 - RNA, 19 nt, Homo sapiens
accagccugucgcgcauua

SEQ ID NO: 858401 - RNA, 19 nt, Homo sapiens
acacaaguuucugccaaca

SEQ ID NO: 858402 - RNA, 19 nt, Homo sapiens
gagaccuuccugaugcaaa

SEQ ID NO: 858403 - RNA, 19 nt, Homo sapiens
gaccaggagacaaagaagu

SEQ ID NO: 858404 - RNA, 19 nt, Homo sapiens
ccgaggacuucgucuucga

SEQ ID NO: 858405 - RNA, 19 nt, Homo sapiens
caacgucucagccaaucag

SEQ ID NO: 858406 - RNA, 19 nt, Homo sapiens
cacgcgaccuggcaaggau

SEQ ID NO: 858407 - RNA, 19 nt, Homo sapiens
caaggcagcuguucugaag

SEQ ID NO: 858408 - RNA, 19 nt, Homo sapiens
gagaagcauuccacuuugu

SEQ ID NO: 858409 - RNA, 19 nt, Homo sapiens
cgagaagcauuccacuuug

SEQ ID NO: 858410 - RNA, 19 nt, Homo sapiens
ggucacaccugcucacucu

SEQ ID NO: 858411 - RNA, 19 nt, Homo sapiens
gauuguggcucccaucagu

SEQ ID NO: 858412 - RNA, 19 nt, Homo sapiens
ucgagaagcauuccacuuu

SEQ ID NO: 858413 - RNA, 19 nt, Homo sapiens
gcacgaacugucaucuuug

SEQ ID NO: 858414 - RNA, 19 nt, Homo sapiens
aaaggagcguugcuggaaa

SEQ ID NO: 858415 - RNA, 19 nt, Homo sapiens
gaaacugugcugguucuug

SEQ ID NO: 858416 - RNA, 19 nt, Homo sapiens
gcaaggcagcuguucugaa

SEQ ID NO: 858417 - RNA, 19 nt, Homo sapiens
agcacgaacugucaucuuu

SEQ ID NO: 858418 - RNA, 19 nt, Homo sapiens
gggaaacugugcugguucu

SEQ ID NO: 858419 - RNA, 19 nt, Homo sapiens
ccagaaagccaggugauca

SEQ ID NO: 858420 - RNA, 19 nt, Homo sapiens
gcucuggacauccggauau

SEQ ID NO: 858421 - RNA, 19 nt, Homo sapiens
cuggacauccggauauuaa

SEQ ID NO: 858422 - RNA, 19 nt, Homo sapiens
cacgaacugucaucuuugu

SEQ ID NO: 858423 - RNA, 19 nt, Homo sapiens
gcugaggacuacgccaaga

SEQ ID NO: 858424 - RNA, 19 nt, Homo sapiens
ucuccgggcucuccuuuca

SEQ ID NO: 858425 - RNA, 19 nt, Homo sapiens
ggacauccggauauuaaaa

SEQ ID NO: 858426 - RNA, 19 nt, Homo sapiens
gaagcauuccacuuuguag

SEQ ID NO: 858427 - RNA, 19 nt, Homo sapiens
agaagcauuccacuuugua

SEQ ID NO: 858428 - RNA, 19 nt, Homo sapiens
ccgggaaacugugcugguu

SEQ ID NO: 858429 - RNA, 19 nt, Homo sapiens
uccgggcucuccuuucaaa

SEQ ID NO: 858430 - RNA, 19 nt, Homo sapiens
gcugagacaggcauuccaa

SEQ ID NO: 858431 - RNA, 19 nt, Homo sapiens
uacaggagcgggagaagau

SEQ ID NO: 858432 - RNA, 19 nt, Homo sapiens
ucacaccugcucacucuuc

SEQ ID NO: 858433 - RNA, 19 nt, Homo sapiens
gaaggcaaggcagcuguuc

SEQ ID NO: 858434 - RNA, 19 nt, Homo sapiens
ugaccgugcccuucgagaa

SEQ ID NO: 858435 - RNA, 19 nt, Homo sapiens
gagcacguacggccucuac

SEQ ID NO: 858436 - RNA, 19 nt, Homo sapiens
gcuguucugaagcgcauuu

SEQ ID NO: 858437 - RNA, 19 nt, Homo sapiens
ggaacuugcucgugccuua

SEQ ID NO: 858438 - RNA, 19 nt, Homo sapiens
gauauuguguccuaaauug

SEQ ID NO: 858439 - RNA, 19 nt, Homo sapiens
ggaaauagacaccuucuug

SEQ ID NO: 858440 - RNA, 19 nt, Homo sapiens
cgaaagacuucaagcaauu

SEQ ID NO: 858441 - RNA, 19 nt, Homo sapiens
gcaaugauguuggaacuug

SEQ ID NO: 858442 - RNA, 19 nt, Homo sapiens
acacuuagcugcaaagaug

SEQ ID NO: 858443 - RNA, 19 nt, Homo sapiens
ggccagaggagaagaauua

SEQ ID NO: 858444 - RNA, 19 nt, Homo sapiens
gcucaaggaucacucuuug

SEQ ID NO: 858445 - RNA, 19 nt, Homo sapiens
cagcugaucuucuuugaug

SEQ ID NO: 858446 - RNA, 19 nt, Homo sapiens
ggcgguauuuccagaauua

SEQ ID NO: 858447 - RNA, 19 nt, Homo sapiens
gaaauagacaccuucuuga

SEQ ID NO: 858448 - RNA, 19 nt, Homo sapiens
uagguagccuuucgaauuu

SEQ ID NO: 858449 - RNA, 19 nt, Homo sapiens
uguccuaaauugcucauua

SEQ ID NO: 858450 - RNA, 19 nt, Homo sapiens
aagaagagguguuccaguu

SEQ ID NO: 858451 - RNA, 19 nt, Homo sapiens
ggaugaccauauuccauuu

SEQ ID NO: 858452 - RNA, 19 nt, Homo sapiens
cuaugggucucgacacuua

SEQ ID NO: 858453 - RNA, 19 nt, Homo sapiens
gaagagguguuccaguucu

SEQ ID NO: 858454 - RNA, 19 nt, Homo sapiens
guaccggucuuucucaaau

SEQ ID NO: 858455 - RNA, 19 nt, Homo sapiens
gcaccaguaucucugaaau

SEQ ID NO: 858456 - RNA, 19 nt, Homo sapiens
guggaaaucuauuacaugu

SEQ ID NO: 858457 - RNA, 19 nt, Homo sapiens
cagaauaauuguguuguga

SEQ ID NO: 858458 - RNA, 19 nt, Homo sapiens
gaggugugauucaggauga

SEQ ID NO: 858459 - RNA, 19 nt, Homo sapiens
gagaaaucuuuguagaguu

SEQ ID NO: 858460 - RNA, 19 nt, Homo sapiens
cuagguagccuuucgaauu

SEQ ID NO: 858461 - RNA, 19 nt, Homo sapiens
gacaaaugcuguguggaaa

SEQ ID NO: 858462 - RNA, 19 nt, Homo sapiens
caccauggaugacaaugaa

SEQ ID NO: 858463 - RNA, 19 nt, Homo sapiens
ucacuggucuccucaagau

SEQ ID NO: 858464 - RNA, 19 nt, Homo sapiens
ugagaaaucuuuguagagu

SEQ ID NO: 858465 - RNA, 19 nt, Homo sapiens
guccuaaauugcucauuaa

SEQ ID NO: 858466 - RNA, 19 nt, Homo sapiens
guggaaacaucuauccuau

SEQ ID NO: 858467 - RNA, 19 nt, Homo sapiens
gcagaaggcaccaguaucu

SEQ ID NO: 858468 - RNA, 19 nt, Homo sapiens
guugugauauuguguccua

SEQ ID NO: 858469 - RNA, 19 nt, Homo sapiens
gauucaggaugaccauauu

SEQ ID NO: 858470 - RNA, 19 nt, Homo sapiens
gaucuucuuugauggugaa

SEQ ID NO: 858471 - RNA, 19 nt, Homo sapiens
caaaugcuguguggaaaca

SEQ ID NO: 858472 - RNA, 19 nt, Homo sapiens
gaggcaccguguaaagaaa

SEQ ID NO: 858473 - RNA, 19 nt, Homo sapiens
cacgauagcuaaacaguac

SEQ ID NO: 858474 - RNA, 19 nt, Homo sapiens
ggauuuauuggucuuauug

SEQ ID NO: 858475 - RNA, 19 nt, Homo sapiens
ggaacuagguagccuuucg

SEQ ID NO: 858476 - RNA, 19 nt, Homo sapiens
ucuuaugugucuuugguua

SEQ ID NO: 858477 - RNA, 19 nt, Homo sapiens
aaagucaaggcaucauuua

SEQ ID NO: 858478 - RNA, 19 nt, Homo sapiens
gcucgugccuuagacaaga

SEQ ID NO: 858479 - RNA, 19 nt, Homo sapiens
agacaaaugcuguguggaa

SEQ ID NO: 858480 - RNA, 19 nt, Homo sapiens
gaaagacuucaagcaauug

SEQ ID NO: 858481 - RNA, 19 nt, Homo sapiens
ucgaaagacuucaagcaau

SEQ ID NO: 858482 - RNA, 19 nt, Homo sapiens
acccaacguuucccaauuu

SEQ ID NO: 858483 - RNA, 19 nt, Homo sapiens
gaucauccuauucuuaugu

SEQ ID NO: 858484 - RNA, 19 nt, Homo sapiens
guuaucagaucaauuacag

SEQ ID NO: 858485 - RNA, 19 nt, Homo sapiens
ggucuuauuggauuugauu

SEQ ID NO: 858486 - RNA, 19 nt, Homo sapiens
cacuaugacuccaaguauu

SEQ ID NO: 858487 - RNA, 19 nt, Homo sapiens
ugacugggucuuggaaaua

SEQ ID NO: 858488 - RNA, 19 nt, Homo sapiens
gugauauuguguccuaaau

SEQ ID NO: 858489 - RNA, 19 nt, Homo sapiens
agucaaggcaucauuuaaa

SEQ ID NO: 858490 - RNA, 19 nt, Homo sapiens
ccacuaugacuccaaguau

SEQ ID NO: 858491 - RNA, 19 nt, Homo sapiens
ucaaggaucacucuuugga

SEQ ID NO: 858492 - RNA, 19 nt, Homo sapiens
gaacuagguagccuuucga

SEQ ID NO: 858493 - RNA, 19 nt, Homo sapiens
gggcgguauuuccagaauu

SEQ ID NO: 858494 - RNA, 19 nt, Homo sapiens
ucagccaggugguucgaaa

SEQ ID NO: 858495 - RNA, 19 nt, Homo sapiens
gguccucgccugccacuau

SEQ ID NO: 858496 - RNA, 19 nt, Homo sapiens
gcggucagauuucuuugag

SEQ ID NO: 858497 - RNA, 19 nt, Homo sapiens
caaggaucaucaucacgau

SEQ ID NO: 858498 - RNA, 19 nt, Homo sapiens
ugaauuggguuugcucaag

SEQ ID NO: 858499 - RNA, 19 nt, Homo sapiens
uaccggucuuucucaaaua

SEQ ID NO: 858500 - RNA, 19 nt, Homo sapiens
aaauagcgguuggaacuag

SEQ ID NO: 858501 - RNA, 19 nt, Homo sapiens
uuaaauagcgguuggaacu

SEQ ID NO: 858502 - RNA, 19 nt, Homo sapiens
caucggcucuucggcaaau

SEQ ID NO: 858503 - RNA, 19 nt, Homo sapiens
gcauggauuuauuggucuu

SEQ ID NO: 858504 - RNA, 19 nt, Homo sapiens
ucacgauagcuaaacagua

SEQ ID NO: 858505 - RNA, 19 nt, Homo sapiens
gcacaucaugcagcgaauu

SEQ ID NO: 858506 - RNA, 19 nt, Homo sapiens
ccuuaaagacuguuucaga

SEQ ID NO: 858507 - RNA, 19 nt, Homo sapiens
caugugcaaugauguugga

SEQ ID NO: 858508 - RNA, 19 nt, Homo sapiens
acuaugacuccaaguauuu

SEQ ID NO: 858509 - RNA, 19 nt, Homo sapiens
caucaucacgauagcuaaa

SEQ ID NO: 858510 - RNA, 19 nt, Homo sapiens
ggaugacaaugaagaaaau

SEQ ID NO: 858511 - RNA, 19 nt, Homo sapiens
gcaauugaacaugaacuuc

SEQ ID NO: 858512 - RNA, 19 nt, Homo sapiens
gguagccuuucgaauuuua

SEQ ID NO: 858513 - RNA, 19 nt, Homo sapiens
acagaauaauuguguugug

SEQ ID NO: 858514 - RNA, 19 nt, Homo sapiens
uuggaugaaucaaccauug

SEQ ID NO: 858515 - RNA, 19 nt, Homo sapiens
gacugggucuuggaaauag

SEQ ID NO: 858516 - RNA, 19 nt, Homo sapiens
ccucaagauucucucuaug

SEQ ID NO: 858517 - RNA, 19 nt, Homo sapiens
uaaauagcgguuggaacua

SEQ ID NO: 858518 - RNA, 19 nt, Homo sapiens
gucaaggcaucauuuaaaa

SEQ ID NO: 858519 - RNA, 19 nt, Homo sapiens
aacccaacguuucccaauu

SEQ ID NO: 858520 - RNA, 19 nt, Homo sapiens
gccacuaugacuccaagua

SEQ ID NO: 858521 - RNA, 19 nt, Homo sapiens
ugaaggcggucagauuucu

SEQ ID NO: 858522 - RNA, 19 nt, Homo sapiens
accaguaucucugaaaugu

SEQ ID NO: 858523 - RNA, 19 nt, Homo sapiens
gugcaaugauguuggaacu

SEQ ID NO: 858524 - RNA, 19 nt, Homo sapiens
gacaccuucuugagucaga

SEQ ID NO: 858525 - RNA, 19 nt, Homo sapiens
caaucccacugcuaaacga

SEQ ID NO: 858526 - RNA, 19 nt, Homo sapiens
guuugaaggcggucagauu

SEQ ID NO: 858527 - RNA, 19 nt, Homo sapiens
gauagcuaaacaguacuua

SEQ ID NO: 858528 - RNA, 19 nt, Homo sapiens
uggaaacaucuauccuaua

SEQ ID NO: 858529 - RNA, 19 nt, Homo sapiens
caucugauaccgucuccuu

SEQ ID NO: 858530 - RNA, 19 nt, Homo sapiens
uggguuugcucaaggauca

SEQ ID NO: 858531 - RNA, 19 nt, Homo sapiens
agagauggcaggcggaaga

SEQ ID NO: 858532 - RNA, 19 nt, Homo sapiens
uguaggagccacugauuca

SEQ ID NO: 858533 - RNA, 19 nt, Homo sapiens
uuugaaggcggucagauuu

SEQ ID NO: 858534 - RNA, 19 nt, Homo sapiens
gcacaccauggaugacaau

SEQ ID NO: 858535 - RNA, 19 nt, Homo sapiens
gccgugccaugugcaauga

SEQ ID NO: 858536 - RNA, 19 nt, Homo sapiens
aaagaggcaccguguaaag

SEQ ID NO: 858537 - RNA, 19 nt, Homo sapiens
ugagaaaggugagaaauaa

SEQ ID NO: 858538 - RNA, 19 nt, Homo sapiens
gcucaugacaacucaauaa

SEQ ID NO: 858539 - RNA, 19 nt, Homo sapiens
gaaaggugagaaauaaugu

SEQ ID NO: 858540 - RNA, 19 nt, Homo sapiens
caugacaacucaauaaagc

SEQ ID NO: 858541 - RNA, 19 nt, Homo sapiens
agaaaggugagaaauaaug

SEQ ID NO: 858542 - RNA, 19 nt, Homo sapiens
gcccgaggcucaugacaac

SEQ ID NO: 858543 - RNA, 19 nt, Homo sapiens
gagaaaggugagaaauaau

SEQ ID NO: 858544 - RNA, 19 nt, Homo sapiens
cuucaggacuguuuuguaa

SEQ ID NO: 858545 - RNA, 19 nt, Homo sapiens
uugagaaaggugagaaaua

SEQ ID NO: 858546 - RNA, 19 nt, Homo sapiens
gauuaagcuucaggacugu

SEQ ID NO: 858547 - RNA, 19 nt, Homo sapiens
cgaggcucaugacaacuca

SEQ ID NO: 858548 - RNA, 19 nt, Homo sapiens
ccuacacccagcucucuuu

SEQ ID NO: 858549 - RNA, 19 nt, Homo sapiens
gcaucuuccuggccaucau

SEQ ID NO: 858550 - RNA, 19 nt, Homo sapiens
ggacagagcugaauaggaa

SEQ ID NO: 858551 - RNA, 19 nt, Homo sapiens
ggacagagcuaggaugaug

SEQ ID NO: 858552 - RNA, 19 nt, Homo sapiens
gagcuaggaugauggcuuu

SEQ ID NO: 858553 - RNA, 19 nt, Homo sapiens
uaugacagcuguacacaaa

SEQ ID NO: 858554 - RNA, 19 nt, Homo sapiens
gauguuaacuucagacaag

SEQ ID NO: 858555 - RNA, 19 nt, Homo sapiens
ggacaggauuugccaguuc

SEQ ID NO: 858556 - RNA, 19 nt, Homo sapiens
ggcaaggccuuccggcaua

SEQ ID NO: 858557 - RNA, 19 nt, Homo sapiens
cauuaucccuccucaauug

SEQ ID NO: 858558 - RNA, 19 nt, Homo sapiens
ccacgagcuuucccagaua

SEQ ID NO: 858559 - RNA, 19 nt, Homo sapiens
gcaaaguguucgugaagag

SEQ ID NO: 858560 - RNA, 19 nt, Homo sapiens
gcagcaaaguguucgugaa

SEQ ID NO: 858561 - RNA, 19 nt, Homo sapiens
cgacugaccuccccgcuua

SEQ ID NO: 858562 - RNA, 19 nt, Homo sapiens
ggauguggcuguguacuuc

SEQ ID NO: 858563 - RNA, 19 nt, Homo sapiens
gacagaggauagagauguu

SEQ ID NO: 858564 - RNA, 19 nt, Homo sapiens
gaauaggaaagacuugcua

SEQ ID NO: 858565 - RNA, 19 nt, Homo sapiens
gagaauggccacgagcuuu

SEQ ID NO: 858566 - RNA, 19 nt, Homo sapiens
gugaggaggaggcuuuaua

SEQ ID NO: 858567 - RNA, 19 nt, Homo sapiens
cuagacaacuucgcacuug

SEQ ID NO: 858568 - RNA, 19 nt, Homo sapiens
gaugugaggaggaggcuuu

SEQ ID NO: 858569 - RNA, 19 nt, Homo sapiens
gcuccgaccuccucaagca

SEQ ID NO: 858570 - RNA, 19 nt, Homo sapiens
gccacgagcuuucccagau

SEQ ID NO: 858571 - RNA, 19 nt, Homo sapiens
uaggaaagacuugcuauug

SEQ ID NO: 858572 - RNA, 19 nt, Homo sapiens
ccagauggccuuugaggau

SEQ ID NO: 858573 - RNA, 19 nt, Homo sapiens
gacaggauuugccaguuca

SEQ ID NO: 858574 - RNA, 19 nt, Homo sapiens
gcccuggccuucugugaau

SEQ ID NO: 858575 - RNA, 19 nt, Homo sapiens
gcauauguccucugcagau

SEQ ID NO: 858576 - RNA, 19 nt, Homo sapiens
gggaugauguuaacuucag

SEQ ID NO: 858577 - RNA, 19 nt, Homo sapiens
cgugguggcugaacucuag

SEQ ID NO: 858578 - RNA, 19 nt, Homo sapiens
ggugcggcuucaugugaua

SEQ ID NO: 858579 - RNA, 19 nt, Homo sapiens
gcagauccacagcagagaa

SEQ ID NO: 858580 - RNA, 19 nt, Homo sapiens
gaugacuacuagcgucuuc

SEQ ID NO: 858581 - RNA, 19 nt, Homo sapiens
acaugugacucucagcauu

SEQ ID NO: 858582 - RNA, 19 nt, Homo sapiens
ccgaaugggugcaguuugg

SEQ ID NO: 858583 - RNA, 19 nt, Homo sapiens
caccugggaugacuacuag

SEQ ID NO: 858584 - RNA, 19 nt, Homo sapiens
gagccucaccuccaaggaa

SEQ ID NO: 858585 - RNA, 19 nt, Homo sapiens
ggaugauguuaacuucaga

SEQ ID NO: 858586 - RNA, 19 nt, Homo sapiens
cgacuuggaagaugaggaa

SEQ ID NO: 858587 - RNA, 19 nt, Homo sapiens
ugacagcuguacacaaacu

SEQ ID NO: 858588 - RNA, 19 nt, Homo sapiens
gauaugacaguggaugcua

SEQ ID NO: 858589 - RNA, 19 nt, Homo sapiens
ccacagaucacaccuccau

SEQ ID NO: 858590 - RNA, 19 nt, Homo sapiens
ccugaguacugggaaguuu

SEQ ID NO: 858591 - RNA, 19 nt, Homo sapiens
cagccuagcagacaagaga

SEQ ID NO: 858592 - RNA, 19 nt, Homo sapiens
ccaguucacccacagauca

SEQ ID NO: 858593 - RNA, 19 nt, Homo sapiens
gcaaggccuuccggcauag

SEQ ID NO: 858594 - RNA, 19 nt, Homo sapiens
ggagaauggccacgagcuu

SEQ ID NO: 858595 - RNA, 19 nt, Homo sapiens
aagacuugcuauugccuaa

SEQ ID NO: 858596 - RNA, 19 nt, Homo sapiens
gcugguaucccgacuugga

SEQ ID NO: 858597 - RNA, 19 nt, Homo sapiens
gggacaggauuugccaguu

SEQ ID NO: 858598 - RNA, 19 nt, Homo sapiens
ugacagaggauagagaugu

SEQ ID NO: 858599 - RNA, 19 nt, Homo sapiens
ugaaucccuuccacagcua

SEQ ID NO: 858600 - RNA, 19 nt, Homo sapiens
ccaccugggaugacuacua

SEQ ID NO: 858601 - RNA, 19 nt, Homo sapiens
uugaggauguggcugugua

SEQ ID NO: 858602 - RNA, 19 nt, Homo sapiens
gcggaggucugaggucaca

SEQ ID NO: 858603 - RNA, 19 nt, Homo sapiens
ccugguuccuggaguuuga

SEQ ID NO: 858604 - RNA, 19 nt, Homo sapiens
gcgugaugcuagacaacuu

SEQ ID NO: 858605 - RNA, 19 nt, Homo sapiens
uggaagaugaggaaacuga

SEQ ID NO: 858606 - RNA, 19 nt, Homo sapiens
uggcugguaucccgacuug

SEQ ID NO: 858607 - RNA, 19 nt, Homo sapiens
gaugcccgcugaggguauu

SEQ ID NO: 858608 - RNA, 19 nt, Homo sapiens
ggaaggacagagcuaggau

SEQ ID NO: 858609 - RNA, 19 nt, Homo sapiens
gggugucggugaucuacug

SEQ ID NO: 858610 - RNA, 19 nt, Homo sapiens
aggaaagacuugcuauugc

SEQ ID NO: 858611 - RNA, 19 nt, Homo sapiens
gcagacaagagaccacaag

SEQ ID NO: 858612 - RNA, 19 nt, Homo sapiens
acuagcgucuucccuguug

SEQ ID NO: 858613 - RNA, 19 nt, Homo sapiens
ucaacccacugccucuguu

SEQ ID NO: 858614 - RNA, 19 nt, Homo sapiens
ccagggcuccucgcucuuu

SEQ ID NO: 858615 - RNA, 19 nt, Homo sapiens
gcacgagcguacgcacaca

SEQ ID NO: 858616 - RNA, 19 nt, Homo sapiens
uaacuucagacaagaugga

SEQ ID NO: 858617 - RNA, 19 nt, Homo sapiens
gggccagccuagcagacaa

SEQ ID NO: 858618 - RNA, 19 nt, Homo sapiens
guucauccaagacuuccua

SEQ ID NO: 858619 - RNA, 19 nt, Homo sapiens
ggaggcccuuuggcuguga

SEQ ID NO: 858620 - RNA, 19 nt, Homo sapiens
ggcaggagccucauagacu

SEQ ID NO: 858621 - RNA, 19 nt, Homo sapiens
aggaccagauggccuuuga

SEQ ID NO: 858622 - RNA, 19 nt, Homo sapiens
ggaguuugacagaggauag

SEQ ID NO: 858623 - RNA, 19 nt, Homo sapiens
auaugacaguggaugcuaa

SEQ ID NO: 858624 - RNA, 19 nt, Homo sapiens
agccagacgucgcacuuga

SEQ ID NO: 858625 - RNA, 19 nt, Homo sapiens
ccauuaucccuccucaauu

SEQ ID NO: 858626 - RNA, 19 nt, Homo sapiens
caugugacucucagcauug

SEQ ID NO: 858627 - RNA, 19 nt, Homo sapiens
uggccuggcuucacacaca

SEQ ID NO: 858628 - RNA, 19 nt, Homo sapiens
gcuagacaacuucgcacuu

SEQ ID NO: 858629 - RNA, 19 nt, Homo sapiens
cagcaaaguguucgugaag

SEQ ID NO: 858630 - RNA, 19 nt, Homo sapiens
cccauuaucccuccucaau

SEQ ID NO: 858631 - RNA, 19 nt, Homo sapiens
guggugcggcuucauguga

SEQ ID NO: 858632 - RNA, 19 nt, Homo sapiens
cagauccacagcagagaaa

SEQ ID NO: 858633 - RNA, 19 nt, Homo sapiens
ccaguguaauggcccuuca

SEQ ID NO: 858634 - RNA, 19 nt, Homo sapiens
gcaacucgcaccugaucca

SEQ ID NO: 858635 - RNA, 19 nt, Homo sapiens
agccucaccuccaaggaaa

SEQ ID NO: 858636 - RNA, 19 nt, Homo sapiens
ccugaagcccugugagaug

SEQ ID NO: 858637 - RNA, 19 nt, Homo sapiens
cauauguccucugcagauc

SEQ ID NO: 858638 - RNA, 19 nt, Homo sapiens
gacuugcuauugccuaagg

SEQ ID NO: 858639 - RNA, 19 nt, Homo sapiens
aaggacagagcuaggauga

SEQ ID NO: 858640 - RNA, 19 nt, Homo sapiens
cugggaaguuucuccugaa

SEQ ID NO: 858641 - RNA, 19 nt, Homo sapiens
uaaugagagccaacacaug

SEQ ID NO: 858642 - RNA, 19 nt, Homo sapiens
cuaaugagagccaacacau

SEQ ID NO: 858643 - RNA, 19 nt, Homo sapiens
gucccgugcuugcuaguca

SEQ ID NO: 858644 - RNA, 19 nt, Homo sapiens
gcuccuguccugaguacug

SEQ ID NO: 858645 - RNA, 19 nt, Homo sapiens
gggaaaagacacucacaga

SEQ ID NO: 858646 - RNA, 19 nt, Homo sapiens
gagcuccgaccuccucaag

SEQ ID NO: 858647 - RNA, 19 nt, Homo sapiens
gaaacuuaugacagcugua

SEQ ID NO: 858648 - RNA, 19 nt, Homo sapiens
ggacgugguggcugaacuc

SEQ ID NO: 858649 - RNA, 19 nt, Homo sapiens
cuuuggcugugauuucauu

SEQ ID NO: 858650 - RNA, 19 nt, Homo sapiens
gaaguuaucuguaaucuug

SEQ ID NO: 858651 - RNA, 19 nt, Homo sapiens
gaagugaccucaacugugu

SEQ ID NO: 858652 - RNA, 19 nt, Homo sapiens
gaaaguagauacagaugau

SEQ ID NO: 858653 - RNA, 19 nt, Homo sapiens
gcgaggaaguuaucuguaa

SEQ ID NO: 858654 - RNA, 19 nt, Homo sapiens
ugaaggaacucacuuucua

SEQ ID NO: 858655 - RNA, 19 nt, Homo sapiens
ucaaauuucuccugaguuu

SEQ ID NO: 858656 - RNA, 19 nt, Homo sapiens
gagcaucacucugaccaua

SEQ ID NO: 858657 - RNA, 19 nt, Homo sapiens
ggaacucacuuucuagaga

SEQ ID NO: 858658 - RNA, 19 nt, Homo sapiens
guacaacacugucucugaa

SEQ ID NO: 858659 - RNA, 19 nt, Homo sapiens
ugacuuugcuguucuacua

SEQ ID NO: 858660 - RNA, 19 nt, Homo sapiens
gaugcuagaucuugucuga

SEQ ID NO: 858661 - RNA, 19 nt, Homo sapiens
gugauggccugcacaauuu

SEQ ID NO: 858662 - RNA, 19 nt, Homo sapiens
ccaaagaccuauucauuac

SEQ ID NO: 858663 - RNA, 19 nt, Homo sapiens
caucaaagcuacugacauc

SEQ ID NO: 858664 - RNA, 19 nt, Homo sapiens
caagagcccucccacuuug

SEQ ID NO: 858665 - RNA, 19 nt, Homo sapiens
gaagaaaccugaaaaugau

SEQ ID NO: 858666 - RNA, 19 nt, Homo sapiens
gaucuugucugauucauac

SEQ ID NO: 858667 - RNA, 19 nt, Homo sapiens
gaauauugcugucuguuac

SEQ ID NO: 858668 - RNA, 19 nt, Homo sapiens
gaaagugccuauuuugauu

SEQ ID NO: 858669 - RNA, 19 nt, Homo sapiens
gaccaugacucagauaguu

SEQ ID NO: 858670 - RNA, 19 nt, Homo sapiens
uaagcaggcuguccuuuau

SEQ ID NO: 858671 - RNA, 19 nt, Homo sapiens
cacaggaagucuacaauga

SEQ ID NO: 858672 - RNA, 19 nt, Homo sapiens
agaagcaguuguccaagua

SEQ ID NO: 858673 - RNA, 19 nt, Homo sapiens
gaacaugccagugguagaa

SEQ ID NO: 858674 - RNA, 19 nt, Homo sapiens
gcugaaaucccuccaaaga

SEQ ID NO: 858675 - RNA, 19 nt, Homo sapiens
caagagauuuggcaugaca

SEQ ID NO: 858676 - RNA, 19 nt, Homo sapiens
cugaaaugcugcacaauga

SEQ ID NO: 858677 - RNA, 19 nt, Homo sapiens
ggaagucuacaaugaauau

SEQ ID NO: 858678 - RNA, 19 nt, Homo sapiens
caaaugaaucugugaguga

SEQ ID NO: 858679 - RNA, 19 nt, Homo sapiens
gaguuuguaugcuguacua

SEQ ID NO: 858680 - RNA, 19 nt, Homo sapiens
agaagaagaggucaugaua

SEQ ID NO: 858681 - RNA, 19 nt, Homo sapiens
uagaagaaagugccuauuu

SEQ ID NO: 858682 - RNA, 19 nt, Homo sapiens
ggugauggccugcacaauu

SEQ ID NO: 858683 - RNA, 19 nt, Homo sapiens
ccauuuccaucaucaguuu

SEQ ID NO: 858684 - RNA, 19 nt, Homo sapiens
guacuucuguugcuguguu

SEQ ID NO: 858685 - RNA, 19 nt, Homo sapiens
caacaaaugaggagaaagu

SEQ ID NO: 858686 - RNA, 19 nt, Homo sapiens
gaagaaccagcaauggaaa

SEQ ID NO: 858687 - RNA, 19 nt, Homo sapiens
gaaucuggcauuaauguug

SEQ ID NO: 858688 - RNA, 19 nt, Homo sapiens
caaaugaggagaaaguaga

SEQ ID NO: 858689 - RNA, 19 nt, Homo sapiens
ccaaauugaugcuagaucu

SEQ ID NO: 858690 - RNA, 19 nt, Homo sapiens
caaccaaauugaugcuaga

SEQ ID NO: 858691 - RNA, 19 nt, Homo sapiens
caaagcuacugacaucuca

SEQ ID NO: 858692 - RNA, 19 nt, Homo sapiens
gaauccauauacaccauga

SEQ ID NO: 858693 - RNA, 19 nt, Homo sapiens
uaugcagcguuuaaaguua

SEQ ID NO: 858694 - RNA, 19 nt, Homo sapiens
uccaaagaccuauucauua

SEQ ID NO: 858695 - RNA, 19 nt, Homo sapiens
gaaaugcugcacaaugaug

SEQ ID NO: 858696 - RNA, 19 nt, Homo sapiens
gaaggcuuaucaagugguu

SEQ ID NO: 858697 - RNA, 19 nt, Homo sapiens
gaagaagaggucaugauag

SEQ ID NO: 858698 - RNA, 19 nt, Homo sapiens
gcaucacucugaccauaau

SEQ ID NO: 858699 - RNA, 19 nt, Homo sapiens
ugaauauugcugucuguua

SEQ ID NO: 858700 - RNA, 19 nt, Homo sapiens
ggaauggcaacaggaauuu

SEQ ID NO: 858701 - RNA, 19 nt, Homo sapiens
cccagagggugcaagaaua

SEQ ID NO: 858702 - RNA, 19 nt, Homo sapiens
aacaagagauuuggcauga

SEQ ID NO: 858703 - RNA, 19 nt, Homo sapiens
aauguugacuuggcaauuu

SEQ ID NO: 858704 - RNA, 19 nt, Homo sapiens
ccagagggugcaagaauaa

SEQ ID NO: 858705 - RNA, 19 nt, Homo sapiens
caggaagucuacaaugaau

SEQ ID NO: 858706 - RNA, 19 nt, Homo sapiens
ggagaaaguagauacagau

SEQ ID NO: 858707 - RNA, 19 nt, Homo sapiens
guuuaaaguuaguggguuu

SEQ ID NO: 858708 - RNA, 19 nt, Homo sapiens
uuaagcaggcuguccuuua

SEQ ID NO: 858709 - RNA, 19 nt, Homo sapiens
ugaauuaggugacuuugcu

SEQ ID NO: 858710 - RNA, 19 nt, Homo sapiens
acugaaggcuuaucaagug

SEQ ID NO: 858711 - RNA, 19 nt, Homo sapiens
ggaagaagaagaggucaug

SEQ ID NO: 858712 - RNA, 19 nt, Homo sapiens
gcaauaucaucuacaacag

SEQ ID NO: 858713 - RNA, 19 nt, Homo sapiens
ucagauaguucagguaaag

SEQ ID NO: 858714 - RNA, 19 nt, Homo sapiens
augaugauguggagauuaa

SEQ ID NO: 858715 - RNA, 19 nt, Homo sapiens
agucaucugucuucucaaa

SEQ ID NO: 858716 - RNA, 19 nt, Homo sapiens
ugaagaaccagcaauggaa

SEQ ID NO: 858717 - RNA, 19 nt, Homo sapiens
ccucaggaguguuucaaug

SEQ ID NO: 858718 - RNA, 19 nt, Homo sapiens
auagggagaugaguuugua

SEQ ID NO: 858719 - RNA, 19 nt, Homo sapiens
ugucauaguuucaguaggu

SEQ ID NO: 858720 - RNA, 19 nt, Homo sapiens
acaagagcccucccacuuu

SEQ ID NO: 858721 - RNA, 19 nt, Homo sapiens
ucucaacuuucaacaaaug

SEQ ID NO: 858722 - RNA, 19 nt, Homo sapiens
gaauugggaaucuggcauu

SEQ ID NO: 858723 - RNA, 19 nt, Homo sapiens
caucaucaguuuccugucu

SEQ ID NO: 858724 - RNA, 19 nt, Homo sapiens
gacaauagagacuccaaga

SEQ ID NO: 858725 - RNA, 19 nt, Homo sapiens
guagaaggaaugucaagga

SEQ ID NO: 858726 - RNA, 19 nt, Homo sapiens
guaaagauccuagaaacag

SEQ ID NO: 858727 - RNA, 19 nt, Homo sapiens
ccagucagacgaucucauu

SEQ ID NO: 858728 - RNA, 19 nt, Homo sapiens
gaagaaagugccuauuuug

SEQ ID NO: 858729 - RNA, 19 nt, Homo sapiens
agaagaaagugccuauuuu

SEQ ID NO: 858730 - RNA, 19 nt, Homo sapiens
gaaccagcaauggaaauga

SEQ ID NO: 858731 - RNA, 19 nt, Homo sapiens
ugcuagaucuugucugauu

SEQ ID NO: 858732 - RNA, 19 nt, Homo sapiens
cgaggaaguuaucuguaau

SEQ ID NO: 858733 - RNA, 19 nt, Homo sapiens
aaucuggcauuaauguuga

SEQ ID NO: 858734 - RNA, 19 nt, Homo sapiens
gcaagucaccaccauaguc

SEQ ID NO: 858735 - RNA, 19 nt, Homo sapiens
gaaggaacucacuuucuag

SEQ ID NO: 858736 - RNA, 19 nt, Homo sapiens
cacaagagcccucccacuu

SEQ ID NO: 858737 - RNA, 19 nt, Homo sapiens
ugaucgaacugaaggcuau

SEQ ID NO: 858738 - RNA, 19 nt, Homo sapiens
ggcaauaucaucuacaaca

SEQ ID NO: 858739 - RNA, 19 nt, Homo sapiens
gaaucucaacuuucaacaa

SEQ ID NO: 858740 - RNA, 19 nt, Homo sapiens
gaugaugauguggagauua

SEQ ID NO: 858741 - RNA, 19 nt, Homo sapiens
ucucaugaaucggguguuu

SEQ ID NO: 858742 - RNA, 19 nt, Homo sapiens
gugcaauucaccgguauua

SEQ ID NO: 858743 - RNA, 19 nt, Homo sapiens
uuaagaagcaguuguccaa

SEQ ID NO: 858744 - RNA, 19 nt, Homo sapiens
ggaggccuguauuucaugu

SEQ ID NO: 858745 - RNA, 19 nt, Homo sapiens
uggcauuaauguugacuug

SEQ ID NO: 858746 - RNA, 19 nt, Homo sapiens
gcauccagguuccgcugaa

SEQ ID NO: 858747 - RNA, 19 nt, Homo sapiens
ggacaguguuagugcuagu

SEQ ID NO: 858748 - RNA, 19 nt, Homo sapiens
gggaaucuggcauuaaugu

SEQ ID NO: 858749 - RNA, 19 nt, Homo sapiens
ucacaaauccccuucauga

SEQ ID NO: 858750 - RNA, 19 nt, Homo sapiens
gaagagacacugugaauuc

SEQ ID NO: 858751 - RNA, 19 nt, Homo sapiens
gcagauaguucaaagcaau

SEQ ID NO: 858752 - RNA, 19 nt, Homo sapiens
uuggaaaccugcagaauua

SEQ ID NO: 858753 - RNA, 19 nt, Homo sapiens
ccucaaacauuaacuacua

SEQ ID NO: 858754 - RNA, 19 nt, Homo sapiens
caacaagggucugcgaauu

SEQ ID NO: 858755 - RNA, 19 nt, Homo sapiens
gaacuggacuacuuuaaaa

SEQ ID NO: 858756 - RNA, 19 nt, Homo sapiens
gagacacugugaauucuuu

SEQ ID NO: 858757 - RNA, 19 nt, Homo sapiens
ggaggaggguuuggaaauu

SEQ ID NO: 858758 - RNA, 19 nt, Homo sapiens
gaggaggguuuggaaauuu

SEQ ID NO: 858759 - RNA, 19 nt, Homo sapiens
ugacagauuucuuuaggaa

SEQ ID NO: 858760 - RNA, 19 nt, Homo sapiens
ugaaguggaugcugaagaa

SEQ ID NO: 858761 - RNA, 19 nt, Homo sapiens
gaagacauaguucaccuaa

SEQ ID NO: 858762 - RNA, 19 nt, Homo sapiens
gaauuaugauugccauguu

SEQ ID NO: 858763 - RNA, 19 nt, Homo sapiens
gaacuucagagauguuuga

SEQ ID NO: 858764 - RNA, 19 nt, Homo sapiens
uagcaagaauggcagaauu

SEQ ID NO: 858765 - RNA, 19 nt, Homo sapiens
gaaaccugcagaauuauga

SEQ ID NO: 858766 - RNA, 19 nt, Homo sapiens
gugacuccguguauacuua

SEQ ID NO: 858767 - RNA, 19 nt, Homo sapiens
gggauuuaaugcauucaaa

SEQ ID NO: 858768 - RNA, 19 nt, Homo sapiens
gcaauuugaaugcuuagaa

SEQ ID NO: 858769 - RNA, 19 nt, Homo sapiens
ggucugcgaauuucauaua

SEQ ID NO: 858770 - RNA, 19 nt, Homo sapiens
cagcauauucagacacuua

SEQ ID NO: 858771 - RNA, 19 nt, Homo sapiens
uguuaaaccucuucccuuu

SEQ ID NO: 858772 - RNA, 19 nt, Homo sapiens
gaaaagagaccacuugcaa

SEQ ID NO: 858773 - RNA, 19 nt, Homo sapiens
agacauaguucaccuaaaa

SEQ ID NO: 858774 - RNA, 19 nt, Homo sapiens
gcagggcacuauggcaauu

SEQ ID NO: 858775 - RNA, 19 nt, Homo sapiens
gacacagucuggaauuaau

SEQ ID NO: 858776 - RNA, 19 nt, Homo sapiens
ggacagccagugccagaaa

SEQ ID NO: 858777 - RNA, 19 nt, Homo sapiens
gcauugacagauuucuuua

SEQ ID NO: 858778 - RNA, 19 nt, Homo sapiens
ggaacuuacucucccuuca

SEQ ID NO: 858779 - RNA, 19 nt, Homo sapiens
aaaauuaucucccuaguuc

SEQ ID NO: 858780 - RNA, 19 nt, Homo sapiens
agaaacaggcccagcuaua

SEQ ID NO: 858781 - RNA, 19 nt, Homo sapiens
guuaaacguuauagcaaga

SEQ ID NO: 858782 - RNA, 19 nt, Homo sapiens
cuuaaugccuggaaggaaa

SEQ ID NO: 858783 - RNA, 19 nt, Homo sapiens
gaaacaggcccagcuauac

SEQ ID NO: 858784 - RNA, 19 nt, Homo sapiens
gcuggugacuccguguaua

SEQ ID NO: 858785 - RNA, 19 nt, Homo sapiens
gaagaagugaacuggacua

SEQ ID NO: 858786 - RNA, 19 nt, Homo sapiens
aguagaacaucaugaguug

SEQ ID NO: 858787 - RNA, 19 nt, Homo sapiens
agauggaaguggcacagua

SEQ ID NO: 858788 - RNA, 19 nt, Homo sapiens
gugccauguuuguaauaua

SEQ ID NO: 858789 - RNA, 19 nt, Homo sapiens
auacuuaucugaagguuac

SEQ ID NO: 858790 - RNA, 19 nt, Homo sapiens
cuucaugacuguugaucaa

SEQ ID NO: 858791 - RNA, 19 nt, Homo sapiens
ugaacuggacuacuuuaaa

SEQ ID NO: 858792 - RNA, 19 nt, Homo sapiens
caucaugaguugcgucaag

SEQ ID NO: 858793 - RNA, 19 nt, Homo sapiens
cguccuauuucauuaguga

SEQ ID NO: 858794 - RNA, 19 nt, Homo sapiens
ugacacagucuggaauuaa

SEQ ID NO: 858795 - RNA, 19 nt, Homo sapiens
acaaguaauuaaccacuca

SEQ ID NO: 858796 - RNA, 19 nt, Homo sapiens
ggaaaccugcagaauuaug

SEQ ID NO: 858797 - RNA, 19 nt, Homo sapiens
gcacuauggcaauuugaau

SEQ ID NO: 858798 - RNA, 19 nt, Homo sapiens
ugaguugcgucaagccauu

SEQ ID NO: 858799 - RNA, 19 nt, Homo sapiens
gaagccaaauaaugaaagc

SEQ ID NO: 858800 - RNA, 19 nt, Homo sapiens
uuaaaccucuucccuuucu

SEQ ID NO: 858801 - RNA, 19 nt, Homo sapiens
gcaacaagggucugcgaau

SEQ ID NO: 858802 - RNA, 19 nt, Homo sapiens
gugugaagcuucgagcauu

SEQ ID NO: 858803 - RNA, 19 nt, Homo sapiens
gcacaguagaacaucauga

SEQ ID NO: 858804 - RNA, 19 nt, Homo sapiens
gcuaugggcagcucuuaau

SEQ ID NO: 858805 - RNA, 19 nt, Homo sapiens
acaagggucugcgaauuuc

SEQ ID NO: 858806 - RNA, 19 nt, Homo sapiens
aaagagaccacuugcaaca

SEQ ID NO: 858807 - RNA, 19 nt, Homo sapiens
cgucaagccauuggucuua

SEQ ID NO: 858808 - RNA, 19 nt, Homo sapiens
ugaaauaagacuacagaag

SEQ ID NO: 858809 - RNA, 19 nt, Homo sapiens
cuauacuccucgauggaua

SEQ ID NO: 858810 - RNA, 19 nt, Homo sapiens
uguaguuggugguguuuga

SEQ ID NO: 858811 - RNA, 19 nt, Homo sapiens
ucaugacuguugaucaaga

SEQ ID NO: 858812 - RNA, 19 nt, Homo sapiens
cuaguucaaucuguaguga

SEQ ID NO: 858813 - RNA, 19 nt, Homo sapiens
ccagaaacaggcccagcua

SEQ ID NO: 858814 - RNA, 19 nt, Homo sapiens
guuccuugaucaaauaauc

SEQ ID NO: 858815 - RNA, 19 nt, Homo sapiens
uaaugaaagccuagggaaa

SEQ ID NO: 858816 - RNA, 19 nt, Homo sapiens
gaacuuacucucccuucag

SEQ ID NO: 858817 - RNA, 19 nt, Homo sapiens
uuagaggaauguacuuuac

SEQ ID NO: 858818 - RNA, 19 nt, Homo sapiens
uuugagguauuacugcuuu

SEQ ID NO: 858819 - RNA, 19 nt, Homo sapiens
cuucgagcauugacagauu

SEQ ID NO: 858820 - RNA, 19 nt, Homo sapiens
gauuguauaagaagccaaa

SEQ ID NO: 858821 - RNA, 19 nt, Homo sapiens
gggauacggaggaggguuu

SEQ ID NO: 858822 - RNA, 19 nt, Homo sapiens
gagcauugacagauuucuu

SEQ ID NO: 858823 - RNA, 19 nt, Homo sapiens
caguagaacaucaugaguu

SEQ ID NO: 858824 - RNA, 19 nt, Homo sapiens
cagauaguucaaagcaaua

SEQ ID NO: 858825 - RNA, 19 nt, Homo sapiens
aacaagggucugcgaauuu

SEQ ID NO: 858826 - RNA, 19 nt, Homo sapiens
gaaguggcacaguagaaca

SEQ ID NO: 858827 - RNA, 19 nt, Homo sapiens
ggaauuaauggaacuuacu

SEQ ID NO: 858828 - RNA, 19 nt, Homo sapiens
cauauucagacacuuauuc

SEQ ID NO: 858829 - RNA, 19 nt, Homo sapiens
uauguugcuugcuguguga

SEQ ID NO: 858830 - RNA, 19 nt, Homo sapiens
ucugcguccuauuucauua

SEQ ID NO: 858831 - RNA, 19 nt, Homo sapiens
gaaaauuaucucccuaguu

SEQ ID NO: 858832 - RNA, 19 nt, Homo sapiens
ugccauguuuguaauauag

SEQ ID NO: 858833 - RNA, 19 nt, Homo sapiens
ucaagccauuggucuuaug

SEQ ID NO: 858834 - RNA, 19 nt, Homo sapiens
auagagaucacacaggaaa

SEQ ID NO: 858835 - RNA, 19 nt, Homo sapiens
uugacacagucuggaauua

SEQ ID NO: 858836 - RNA, 19 nt, Homo sapiens
gaggguuggcuagaaauga

SEQ ID NO: 858837 - RNA, 19 nt, Homo sapiens
gaaaacuucaugacuguug

SEQ ID NO: 858838 - RNA, 19 nt, Homo sapiens
ugauugccauguuggauag

SEQ ID NO: 858839 - RNA, 19 nt, Homo sapiens
gcauccugcucugaaucua

SEQ ID NO: 858840 - RNA, 19 nt, Homo sapiens
aggguuggcuagaaaugaa

SEQ ID NO: 858841 - RNA, 19 nt, Homo sapiens
uuugaggguuggcuagaaa

SEQ ID NO: 858842 - RNA, 19 nt, Homo sapiens
ugaagagacacugugaauu

SEQ ID NO: 858843 - RNA, 19 nt, Homo sapiens
gauggaaguggcacaguag

SEQ ID NO: 858844 - RNA, 19 nt, Homo sapiens
aauuaugauugccauguug

SEQ ID NO: 858845 - RNA, 19 nt, Homo sapiens
uauaguuuguuccuugauc

SEQ ID NO: 858846 - RNA, 19 nt, Homo sapiens
agaaaugaaagccuggauu

SEQ ID NO: 858847 - RNA, 19 nt, Homo sapiens
ugugaagcuucgagcauug

SEQ ID NO: 858848 - RNA, 19 nt, Homo sapiens
ggucuuauggguuauaggu

SEQ ID NO: 858849 - RNA, 19 nt, Homo sapiens
ggaaguggcacaguagaac

SEQ ID NO: 858850 - RNA, 19 nt, Homo sapiens
ccagagagguuaacuaaua

SEQ ID NO: 858851 - RNA, 19 nt, Homo sapiens
caagaagaaugaacccuua

SEQ ID NO: 858852 - RNA, 19 nt, Homo sapiens
gcagaagacucuccacuga

SEQ ID NO: 858853 - RNA, 19 nt, Homo sapiens
gaaagaggaugaugagaag

SEQ ID NO: 858854 - RNA, 19 nt, Homo sapiens
gaaguggagugacuauuug

SEQ ID NO: 858855 - RNA, 19 nt, Homo sapiens
ccaaagcccucuccaaaga

SEQ ID NO: 858856 - RNA, 19 nt, Homo sapiens
ugaaggagguggccaagaa

SEQ ID NO: 858857 - RNA, 19 nt, Homo sapiens
caagacagaugccaagaau

SEQ ID NO: 858858 - RNA, 19 nt, Homo sapiens
gaaugaacccuuacaugaa

SEQ ID NO: 858859 - RNA, 19 nt, Homo sapiens
gagaauagcacccauaucu

SEQ ID NO: 858860 - RNA, 19 nt, Homo sapiens
gaauagcuguguaucuguu

SEQ ID NO: 858861 - RNA, 19 nt, Homo sapiens
ccaaaguccaggcuaauua

SEQ ID NO: 858862 - RNA, 19 nt, Homo sapiens
gaacucccgugaccagcua

SEQ ID NO: 858863 - RNA, 19 nt, Homo sapiens
ccaaagaacucacccaaaa

SEQ ID NO: 858864 - RNA, 19 nt, Homo sapiens
cagcuggacuugaagguuu

SEQ ID NO: 858865 - RNA, 19 nt, Homo sapiens
ggucagggcugcaguggau

SEQ ID NO: 858866 - RNA, 19 nt, Homo sapiens
gcaagcaaguggagaccaa

SEQ ID NO: 858867 - RNA, 19 nt, Homo sapiens
gaauagcacccauaucugu

SEQ ID NO: 858868 - RNA, 19 nt, Homo sapiens
uggagaaccugaagaauuc

SEQ ID NO: 858869 - RNA, 19 nt, Homo sapiens
ggcacuagcuagaugcuuu

SEQ ID NO: 858870 - RNA, 19 nt, Homo sapiens
aaugaacccuuacaugaaa

SEQ ID NO: 858871 - RNA, 19 nt, Homo sapiens
gcagagaaguggagugacu

SEQ ID NO: 858872 - RNA, 19 nt, Homo sapiens
ucaagcagcucaagaaggu

SEQ ID NO: 858873 - RNA, 19 nt, Homo sapiens
agaaugaacccuuacauga

SEQ ID NO: 858874 - RNA, 19 nt, Homo sapiens
gaaggaagaggagaagaaa

SEQ ID NO: 858875 - RNA, 19 nt, Homo sapiens
ccuuaucucuucucacuuu

SEQ ID NO: 858876 - RNA, 19 nt, Homo sapiens
gccaagaugucuagaguag

SEQ ID NO: 858877 - RNA, 19 nt, Homo sapiens
gcccagagagguuaacuaa

SEQ ID NO: 858878 - RNA, 19 nt, Homo sapiens
caagaucgcugugcuaggu

SEQ ID NO: 858879 - RNA, 19 nt, Homo sapiens
guacauggagcucagguuu

SEQ ID NO: 858880 - RNA, 19 nt, Homo sapiens
gggcugcaguggauaagaa

SEQ ID NO: 858881 - RNA, 19 nt, Homo sapiens
gaaaccagacggagaaaca

SEQ ID NO: 858882 - RNA, 19 nt, Homo sapiens
gugcugggauggcuauauu

SEQ ID NO: 858883 - RNA, 19 nt, Homo sapiens
uggaggagcuggagaagga

SEQ ID NO: 858884 - RNA, 19 nt, Homo sapiens
gagguuaacuaauauaucc

SEQ ID NO: 858885 - RNA, 19 nt, Homo sapiens
cagagagguuaacuaauau

SEQ ID NO: 858886 - RNA, 19 nt, Homo sapiens
gcacuagcuagaugcuuua

SEQ ID NO: 858887 - RNA, 19 nt, Homo sapiens
gaagaugggagacaaaguc

SEQ ID NO: 858888 - RNA, 19 nt, Homo sapiens
caucacaaaugagaucuug

SEQ ID NO: 858889 - RNA, 19 nt, Homo sapiens
cagacugcaucacaaauga

SEQ ID NO: 858890 - RNA, 19 nt, Homo sapiens
gccaagaaauaaauucaca

SEQ ID NO: 858891 - RNA, 19 nt, Homo sapiens
ccaagcugcugaaggagaa

SEQ ID NO: 858892 - RNA, 19 nt, Homo sapiens
aaaggaggaugagaaggua

SEQ ID NO: 858893 - RNA, 19 nt, Homo sapiens
ugagguggauaccaauauu

SEQ ID NO: 858894 - RNA, 19 nt, Homo sapiens
gcacugggcacuagcuaga

SEQ ID NO: 858895 - RNA, 19 nt, Homo sapiens
ugucuagaguagccaaaua

SEQ ID NO: 858896 - RNA, 19 nt, Homo sapiens
agaaguggagugacuauuu

SEQ ID NO: 858897 - RNA, 19 nt, Homo sapiens
uaaauucacauccucagaa

SEQ ID NO: 858898 - RNA, 19 nt, Homo sapiens
aaauucacauccucagaaa

SEQ ID NO: 858899 - RNA, 19 nt, Homo sapiens
agaaagaggaugaugagaa

SEQ ID NO: 858900 - RNA, 19 nt, Homo sapiens
ccaagaaagaggaugauga

SEQ ID NO: 858901 - RNA, 19 nt, Homo sapiens
gcaggaggcacagcaguuu

SEQ ID NO: 858902 - RNA, 19 nt, Homo sapiens
gaaaagagggugagaagau

SEQ ID NO: 858903 - RNA, 19 nt, Homo sapiens
gaaggagguggccaagaaa

SEQ ID NO: 858904 - RNA, 19 nt, Homo sapiens
aggaaaaucugaacucuaa

SEQ ID NO: 858905 - RNA, 19 nt, Homo sapiens
gcaaaggcaggcacaggaa

SEQ ID NO: 858906 - RNA, 19 nt, Homo sapiens
gaacacagacaccagaaaa

SEQ ID NO: 858907 - RNA, 19 nt, Homo sapiens
ucgccaagcugcugaagga

SEQ ID NO: 858908 - RNA, 19 nt, Homo sapiens
caacucagacugcaucaca

SEQ ID NO: 858909 - RNA, 19 nt, Homo sapiens
aaggagaccaagaaacuua

SEQ ID NO: 858910 - RNA, 19 nt, Homo sapiens
gggaggccaugcucaacuu

SEQ ID NO: 858911 - RNA, 19 nt, Homo sapiens
gaaggcggcaggcagagaa

SEQ ID NO: 858912 - RNA, 19 nt, Homo sapiens
agagggagauguccaugga

SEQ ID NO: 858913 - RNA, 19 nt, Homo sapiens
caugaucacacagcuaaua

SEQ ID NO: 858914 - RNA, 19 nt, Homo sapiens
ugaguuggccaagaaauaa

SEQ ID NO: 858915 - RNA, 19 nt, Homo sapiens
uauuugaguuggccaagaa

SEQ ID NO: 858916 - RNA, 19 nt, Homo sapiens
ggaagugcccaaacugcuu

SEQ ID NO: 858917 - RNA, 19 nt, Homo sapiens
gaagaaugaacccuuacau

SEQ ID NO: 858918 - RNA, 19 nt, Homo sapiens
ucacacagcuaauaaaagu

SEQ ID NO: 858919 - RNA, 19 nt, Homo sapiens
gcaguuucaccaucuuuga

SEQ ID NO: 858920 - RNA, 19 nt, Homo sapiens
acacccaccugcugcugua

SEQ ID NO: 858921 - RNA, 19 nt, Homo sapiens
caagaaagaggaugaugag

SEQ ID NO: 858922 - RNA, 19 nt, Homo sapiens
gcugauccuucaacucugu

SEQ ID NO: 858923 - RNA, 19 nt, Homo sapiens
gcaggaaugcugacaaugc

SEQ ID NO: 858924 - RNA, 19 nt, Homo sapiens
gagcagggacaaggauaaa

SEQ ID NO: 858925 - RNA, 19 nt, Homo sapiens
gcuagagcuuccacuguca

SEQ ID NO: 858926 - RNA, 19 nt, Homo sapiens
gagaggagacagacacaca

SEQ ID NO: 858927 - RNA, 19 nt, Homo sapiens
ccagucaccuaagcaauca

SEQ ID NO: 858928 - RNA, 19 nt, Homo sapiens
ggagugacuauuuggagaa

SEQ ID NO: 858929 - RNA, 19 nt, Homo sapiens
gacaagaagaguccuuuua

SEQ ID NO: 858930 - RNA, 19 nt, Homo sapiens
ggaacacagacaccagaaa

SEQ ID NO: 858931 - RNA, 19 nt, Homo sapiens
cuagcuagaugcuuuaggu

SEQ ID NO: 858932 - RNA, 19 nt, Homo sapiens
caacauggacaagcagaga

SEQ ID NO: 858933 - RNA, 19 nt, Homo sapiens
gcaagacggagauggagau

SEQ ID NO: 858934 - RNA, 19 nt, Homo sapiens
guucaacacugugguuaag

SEQ ID NO: 858935 - RNA, 19 nt, Homo sapiens
gcagcucccagcauauuug

SEQ ID NO: 858936 - RNA, 19 nt, Homo sapiens
agacagaugccaagaaugg

SEQ ID NO: 858937 - RNA, 19 nt, Homo sapiens
ggagauguccauggaugaa

SEQ ID NO: 858938 - RNA, 19 nt, Homo sapiens
augcucaacuucugugaaa

SEQ ID NO: 858939 - RNA, 19 nt, Homo sapiens
uuacugaggcucuggaguu

SEQ ID NO: 858940 - RNA, 19 nt, Homo sapiens
ccaagaaggaagaggagaa

SEQ ID NO: 858941 - RNA, 19 nt, Homo sapiens
guggauaccaauauucuau

SEQ ID NO: 858942 - RNA, 19 nt, Homo sapiens
agagaaaccagacggagaa

SEQ ID NO: 858943 - RNA, 19 nt, Homo sapiens
gagcaggugggaacacaga

SEQ ID NO: 858944 - RNA, 19 nt, Homo sapiens
gggcaguggccaccaagaa

SEQ ID NO: 858945 - RNA, 19 nt, Homo sapiens
ucugugagguggauaccaa

SEQ ID NO: 858946 - RNA, 19 nt, Homo sapiens
cagcugauccuucaacucu

SEQ ID NO: 858947 - RNA, 19 nt, Homo sapiens
caaaguccaggcuaauuag

SEQ ID NO: 858948 - RNA, 19 nt, Homo sapiens
uggcugaccugcuguggau

SEQ ID NO: 858949 - RNA, 19 nt, Homo sapiens
gaagguggaagugcccaaa

SEQ ID NO: 858950 - RNA, 19 nt, Homo sapiens
gggaauggauaauaaagau

SEQ ID NO: 858951 - RNA, 19 nt, Homo sapiens
uuagguggcucaacaagga

SEQ ID NO: 858952 - RNA, 19 nt, Homo sapiens
gcgaagugcucaaggacau

SEQ ID NO: 858953 - RNA, 19 nt, Homo sapiens
uaaagauacuagagaacug

SEQ ID NO: 858954 - RNA, 19 nt, Homo sapiens
gcaccaggcagcuaacaga

SEQ ID NO: 858955 - RNA, 19 nt, Homo sapiens
ccagcaaugugcagaagug

SEQ ID NO: 858956 - RNA, 19 nt, Homo sapiens
gcuccauccgccaguauua

SEQ ID NO: 858957 - RNA, 19 nt, Homo sapiens
gagcagugcccggucauug

SEQ ID NO: 858958 - RNA, 19 nt, Homo sapiens
ggcagugacucgacaaagg

SEQ ID NO: 858959 - RNA, 19 nt, Homo sapiens
ccugcaagcugcucaacau

SEQ ID NO: 858960 - RNA, 19 nt, Homo sapiens
gagguggacucaucaugcu

SEQ ID NO: 858961 - RNA, 19 nt, Homo sapiens
gcaagcugcucaacaucac

SEQ ID NO: 858962 - RNA, 19 nt, Homo sapiens
ggaagucagcggccuggau

SEQ ID NO: 858963 - RNA, 19 nt, Homo sapiens
uauggccgcuucauuaggu

SEQ ID NO: 858964 - RNA, 19 nt, Homo sapiens
acagcgagguggacucauc

SEQ ID NO: 858965 - RNA, 19 nt, Homo sapiens
gcuauggccgcuucauuag

SEQ ID NO: 858966 - RNA, 19 nt, Homo sapiens
agcuauggccgcuucauua

SEQ ID NO: 858967 - RNA, 19 nt, Homo sapiens
ccuucuaccucuccuacuu

SEQ ID NO: 858968 - RNA, 19 nt, Homo sapiens
cagcuauggccgcuucauu

SEQ ID NO: 858969 - RNA, 19 nt, Homo sapiens
cagagcagagccuacagaa

SEQ ID NO: 858970 - RNA, 19 nt, Homo sapiens
ucagcggccuggaugaaag

SEQ ID NO: 858971 - RNA, 19 nt, Homo sapiens
aagggcaucuucaaaauug

SEQ ID NO: 858972 - RNA, 19 nt, Homo sapiens
uucauuagguggcucaaca

SEQ ID NO: 858973 - RNA, 19 nt, Homo sapiens
ccagagcagagccuacaga

SEQ ID NO: 858974 - RNA, 19 nt, Homo sapiens
gaaccgucccgccaugaac

SEQ ID NO: 858975 - RNA, 19 nt, Homo sapiens
cgacagcgagguggacuca

SEQ ID NO: 858976 - RNA, 19 nt, Homo sapiens
gcucugcugcucugaccuu

SEQ ID NO: 858977 - RNA, 19 nt, Homo sapiens
cgggaauggauaauaaaga

SEQ ID NO: 858978 - RNA, 19 nt, Homo sapiens
cagcugcccacaccucuuc

SEQ ID NO: 858979 - RNA, 19 nt, Homo sapiens
acaacuggaugaacauuaa

SEQ ID NO: 858980 - RNA, 19 nt, Homo sapiens
aaagcuggcuggauuccua

SEQ ID NO: 858981 - RNA, 19 nt, Homo sapiens
ucccaaagcuggcuggauu

SEQ ID NO: 858982 - RNA, 19 nt, Homo sapiens
gaaauguuacuugguguuu

SEQ ID NO: 858983 - RNA, 19 nt, Homo sapiens
gcaccaugcuucccuuguc

SEQ ID NO: 858984 - RNA, 19 nt, Homo sapiens
gacaacuggaugaacauua

SEQ ID NO: 858985 - RNA, 19 nt, Homo sapiens
gcaaccagacgggagauuu

SEQ ID NO: 858986 - RNA, 19 nt, Homo sapiens
gcagaggccagccagagaa

SEQ ID NO: 858987 - RNA, 19 nt, Homo sapiens
gaacauuaaccugcgagaa

SEQ ID NO: 858988 - RNA, 19 nt, Homo sapiens
ugaagacggcucagaauca

SEQ ID NO: 858989 - RNA, 19 nt, Homo sapiens
gcccuucgcuuccucucuu

SEQ ID NO: 858990 - RNA, 19 nt, Homo sapiens
gaagacggcucagaaucac

SEQ ID NO: 858991 - RNA, 19 nt, Homo sapiens
caaaauugccuucaaaaca

SEQ ID NO: 858992 - RNA, 19 nt, Homo sapiens
ucucuuguguuauggaaau

SEQ ID NO: 858993 - RNA, 19 nt, Homo sapiens
cgcuuccucucuuguguua

SEQ ID NO: 858994 - RNA, 19 nt, Homo sapiens
gugaaacggccgucccaaa

SEQ ID NO: 858995 - RNA, 19 nt, Homo sapiens
gaggccagccagagaagaa

SEQ ID NO: 858996 - RNA, 19 nt, Homo sapiens
ugaaacggccgucccaaag

SEQ ID NO: 858997 - RNA, 19 nt, Homo sapiens
ucaucgacauggucaagga

SEQ ID NO: 858998 - RNA, 19 nt, Homo sapiens
caccaugcuucccuuguca

SEQ ID NO: 858999 - RNA, 19 nt, Homo sapiens
cuuccucucuuguguuaug

SEQ ID NO: 859000 - RNA, 19 nt, Homo sapiens
cgauuccgcuccacagucu

SEQ ID NO: 859001 - RNA, 19 nt, Homo sapiens
cugacagccugcaggguuu

SEQ ID NO: 859002 - RNA, 19 nt, Homo sapiens
agaagaagccuggcagaca

SEQ ID NO: 859003 - RNA, 19 nt, Homo sapiens
cggcaauucuccgguuaga

SEQ ID NO: 859004 - RNA, 19 nt, Homo sapiens
gaaacggccgucccaaagc

SEQ ID NO: 859005 - RNA, 19 nt, Homo sapiens
ccgacgagaucaucgacau

SEQ ID NO: 859006 - RNA, 19 nt, Homo sapiens
gcggcagcaccaucaagua

SEQ ID NO: 859007 - RNA, 19 nt, Homo sapiens
ccauguugguggagcugaa

SEQ ID NO: 859008 - RNA, 19 nt, Homo sapiens
aaacggccgucccaaagcu

SEQ ID NO: 859009 - RNA, 19 nt, Homo sapiens
gaucaucgacauggucaag

SEQ ID NO: 859010 - RNA, 19 nt, Homo sapiens
acauuaaccugcgagaagu

SEQ ID NO: 859011 - RNA, 19 nt, Homo sapiens
ugcgacaacuggaugaaca

SEQ ID NO: 859012 - RNA, 19 nt, Homo sapiens
gcagcaccaucaaguaccu

SEQ ID NO: 859013 - RNA, 19 nt, Homo sapiens
uggcuggauuccuagaaga

SEQ ID NO: 859014 - RNA, 19 nt, Homo sapiens
cagcagaagcagcagaaag

SEQ ID NO: 859015 - RNA, 19 nt, Homo sapiens
cgacaacuggaugaacauu

SEQ ID NO: 859016 - RNA, 19 nt, Homo sapiens
ccucucuuguguuauggaa

SEQ ID NO: 859017 - RNA, 19 nt, Homo sapiens
caaccagacgggagauuuu

SEQ ID NO: 859018 - RNA, 19 nt, Homo sapiens
ggaauugaguaccuaaaua

SEQ ID NO: 859019 - RNA, 19 nt, Homo sapiens
gcagaaaccuuaucaccaa

SEQ ID NO: 859020 - RNA, 19 nt, Homo sapiens
gaacuacacuuacugaaca

SEQ ID NO: 859021 - RNA, 19 nt, Homo sapiens
gcaaacagaaucuuggaua

SEQ ID NO: 859022 - RNA, 19 nt, Homo sapiens
gaugguagcagaaaccuua

SEQ ID NO: 859023 - RNA, 19 nt, Homo sapiens
gaagacaugugcaauuaca

SEQ ID NO: 859024 - RNA, 19 nt, Homo sapiens
gcuucuacaucuugauuua

SEQ ID NO: 859025 - RNA, 19 nt, Homo sapiens
caagggagcuggaauugag

SEQ ID NO: 859026 - RNA, 19 nt, Homo sapiens
gcacagacuuaaauacagu

SEQ ID NO: 859027 - RNA, 19 nt, Homo sapiens
caaacagaaucuuggauau

SEQ ID NO: 859028 - RNA, 19 nt, Homo sapiens
ggagcugacuucuuccaaa

SEQ ID NO: 859029 - RNA, 19 nt, Homo sapiens
cacgagaacugcugucuga

SEQ ID NO: 859030 - RNA, 19 nt, Homo sapiens
gaagcuggaauucguauga

SEQ ID NO: 859031 - RNA, 19 nt, Homo sapiens
augaagacaugugcaauua

SEQ ID NO: 859032 - RNA, 19 nt, Homo sapiens
cacuuuaucugaagacaaa

SEQ ID NO: 859033 - RNA, 19 nt, Homo sapiens
caggagcacuuuaucugaa

SEQ ID NO: 859034 - RNA, 19 nt, Homo sapiens
acagagggcugcacgaugu

SEQ ID NO: 859035 - RNA, 19 nt, Homo sapiens
ggaaugcugucaugaagac

SEQ ID NO: 859036 - RNA, 19 nt, Homo sapiens
gcaccaccauacccacauu

SEQ ID NO: 859037 - RNA, 19 nt, Homo sapiens
gaaggauuauuugcacaga

SEQ ID NO: 859038 - RNA, 19 nt, Homo sapiens
gcagaccucagcaacgaua

SEQ ID NO: 859039 - RNA, 19 nt, Homo sapiens
gagcugacuucuuccaaag

SEQ ID NO: 859040 - RNA, 19 nt, Homo sapiens
gaaacagguaucagcauga

SEQ ID NO: 859041 - RNA, 19 nt, Homo sapiens
auaagaggcugcaggauca

SEQ ID NO: 859042 - RNA, 19 nt, Homo sapiens
ugcaggagcugacuucuuc

SEQ ID NO: 859043 - RNA, 19 nt, Homo sapiens
gguuauauguguaaaucug

SEQ ID NO: 859044 - RNA, 19 nt, Homo sapiens
guaagcuucuacaucuuga

SEQ ID NO: 859045 - RNA, 19 nt, Homo sapiens
gaggaugcuucgaagugaa

SEQ ID NO: 859046 - RNA, 19 nt, Homo sapiens
ggacaggagcacuuuaucu

SEQ ID NO: 859047 - RNA, 19 nt, Homo sapiens
gauuauuugcacagacuua

SEQ ID NO: 859048 - RNA, 19 nt, Homo sapiens
ugaggaugcuucgaaguga

SEQ ID NO: 859049 - RNA, 19 nt, Homo sapiens
ucacggacaccauuccaaa

SEQ ID NO: 859050 - RNA, 19 nt, Homo sapiens
gaucgccacuccagcuaca

SEQ ID NO: 859051 - RNA, 19 nt, Homo sapiens
gcucagcgccugcuucucu

SEQ ID NO: 859052 - RNA, 19 nt, Homo sapiens
ucuuggauauuucuucuga

SEQ ID NO: 859053 - RNA, 19 nt, Homo sapiens
cugaagacaaacucauuua

SEQ ID NO: 859054 - RNA, 19 nt, Homo sapiens
gacaggagcacuuuaucug

SEQ ID NO: 859055 - RNA, 19 nt, Homo sapiens
uaucugaacuacacuuacu

SEQ ID NO: 859056 - RNA, 19 nt, Homo sapiens
aagcagaccucagcaacga

SEQ ID NO: 859057 - RNA, 19 nt, Homo sapiens
ccacugguuauauguguaa

SEQ ID NO: 859058 - RNA, 19 nt, Homo sapiens
agagaagacuuuguacaca

SEQ ID NO: 859059 - RNA, 19 nt, Homo sapiens
ggagcacuuuaucugaaga

SEQ ID NO: 859060 - RNA, 19 nt, Homo sapiens
aacagaugcucucccguuu

SEQ ID NO: 859061 - RNA, 19 nt, Homo sapiens
gacggagucuuaucugaac

SEQ ID NO: 859062 - RNA, 19 nt, Homo sapiens
ugacggagucuuaucugaa

SEQ ID NO: 859063 - RNA, 19 nt, Homo sapiens
caccauacccacauuggaa

SEQ ID NO: 859064 - RNA, 19 nt, Homo sapiens
ggacaaggaaacagguauc

SEQ ID NO: 859065 - RNA, 19 nt, Homo sapiens
gagcuggaauugaguaccu

SEQ ID NO: 859066 - RNA, 19 nt, Homo sapiens
ucaccaggguuauuugcau

SEQ ID NO: 859067 - RNA, 19 nt, Homo sapiens
ccagcuacaucuucaucug

SEQ ID NO: 859068 - RNA, 19 nt, Homo sapiens
gaacagcuugaaggccuuu

SEQ ID NO: 859069 - RNA, 19 nt, Homo sapiens
uguagccacugguuauaug

SEQ ID NO: 859070 - RNA, 19 nt, Homo sapiens
aagauccucucgcuuguuc

SEQ ID NO: 859071 - RNA, 19 nt, Homo sapiens
cagaugcucucccguuugc

SEQ ID NO: 859072 - RNA, 19 nt, Homo sapiens
agacaucugccaagccaaa

SEQ ID NO: 859073 - RNA, 19 nt, Homo sapiens
aaaaugaccucugcaaaca

SEQ ID NO: 859074 - RNA, 19 nt, Homo sapiens
gguagcagaaaccuuauca

SEQ ID NO: 859075 - RNA, 19 nt, Homo sapiens
gcacuuuaucugaagacaa

SEQ ID NO: 859076 - RNA, 19 nt, Homo sapiens
aaggugaaauucgaugcua

SEQ ID NO: 859077 - RNA, 19 nt, Homo sapiens
gauccucagaacucaaauu

SEQ ID NO: 859078 - RNA, 19 nt, Homo sapiens
acagaaucuuggauauuuc

SEQ ID NO: 859079 - RNA, 19 nt, Homo sapiens
gccacugguuauaugugua

SEQ ID NO: 859080 - RNA, 19 nt, Homo sapiens
gcacgggaagcuggaauuc

SEQ ID NO: 859081 - RNA, 19 nt, Homo sapiens
ggucauugccgugcccauu

SEQ ID NO: 859082 - RNA, 19 nt, Homo sapiens
gaaucuuggauauuucuuc

SEQ ID NO: 859083 - RNA, 19 nt, Homo sapiens
gcccugaggaugcuucgaa

SEQ ID NO: 859084 - RNA, 19 nt, Homo sapiens
gcugcacgauguucucucu

SEQ ID NO: 859085 - RNA, 19 nt, Homo sapiens
agacaugugcaauuacaga

SEQ ID NO: 859086 - RNA, 19 nt, Homo sapiens
agucuuaucugaacuacac

SEQ ID NO: 859087 - RNA, 19 nt, Homo sapiens
ccaagggagcuggaauuga

SEQ ID NO: 859088 - RNA, 19 nt, Homo sapiens
acaggagcacuuuaucuga

SEQ ID NO: 859089 - RNA, 19 nt, Homo sapiens
ugucugaccugugauaaaa

SEQ ID NO: 859090 - RNA, 19 nt, Homo sapiens
gagcucagcgccugcuucu

SEQ ID NO: 859091 - RNA, 19 nt, Homo sapiens
ucugaagacaaacucauuu

SEQ ID NO: 859092 - RNA, 19 nt, Homo sapiens
gaccucagcaacgauaaga

SEQ ID NO: 859093 - RNA, 19 nt, Homo sapiens
ggggcagguugcaaaguua

SEQ ID NO: 859094 - RNA, 19 nt, Homo sapiens
gacaaggaaacagguauca

SEQ ID NO: 859095 - RNA, 19 nt, Homo sapiens
cacacugucaccaggguua

SEQ ID NO: 859096 - RNA, 19 nt, Homo sapiens
ccacuccagcuacaucuuc

SEQ ID NO: 859097 - RNA, 19 nt, Homo sapiens
auaagauccucucgcuugu

SEQ ID NO: 859098 - RNA, 19 nt, Homo sapiens
ugccuggacucucuugcaa

SEQ ID NO: 859099 - RNA, 19 nt, Homo sapiens
uagcgugcgucccuagagu

SEQ ID NO: 859100 - RNA, 19 nt, Homo sapiens
cugcuucucuagacuucuu

SEQ ID NO: 859101 - RNA, 19 nt, Homo sapiens
acugcugucugaccuguga

SEQ ID NO: 859102 - RNA, 19 nt, Homo sapiens
gcaugaugguagcagaaac

SEQ ID NO: 859103 - RNA, 19 nt, Homo sapiens
cugguuauauguguaaauc

SEQ ID NO: 859104 - RNA, 19 nt, Homo sapiens
gcuggacaggagcacuuua

SEQ ID NO: 859105 - RNA, 19 nt, Homo sapiens
gacaagcagaccucagcaa

SEQ ID NO: 859106 - RNA, 19 nt, Homo sapiens
caggaucagcggcaacaga

SEQ ID NO: 859107 - RNA, 19 nt, Homo sapiens
agaagacuuuguacacacu

SEQ ID NO: 859108 - RNA, 19 nt, Homo sapiens
aaucaucuuugagagacaa

SEQ ID NO: 859109 - RNA, 19 nt, Homo sapiens
gggaagcuggaauucguau

SEQ ID NO: 859110 - RNA, 19 nt, Homo sapiens
uuggaaugcugucaugaag

SEQ ID NO: 859111 - RNA, 19 nt, Homo sapiens
uggaauugaguaccuaaau

SEQ ID NO: 859112 - RNA, 19 nt, Homo sapiens
gcuggaauugaguaccuaa

SEQ ID NO: 859113 - RNA, 19 nt, Homo sapiens
ugaaauucgaugcuacugu

SEQ ID NO: 859114 - RNA, 19 nt, Homo sapiens
caaaaugaccucugcaaac

SEQ ID NO: 859115 - RNA, 19 nt, Homo sapiens
ggagucuuaucugaacuac

SEQ ID NO: 859116 - RNA, 19 nt, Homo sapiens
guaugacggagucuuaucu

SEQ ID NO: 859117 - RNA, 19 nt, Homo sapiens
acgggaagcuggaauucgu

SEQ ID NO: 859118 - RNA, 19 nt, Homo sapiens
caagaaagcuaacacuuaa

SEQ ID NO: 859119 - RNA, 19 nt, Homo sapiens
gcaagaaagcuaacacuua

SEQ ID NO: 859120 - RNA, 19 nt, Homo sapiens
gcaccaagcagaagaaaga

SEQ ID NO: 859121 - RNA, 19 nt, Homo sapiens
gaaauuguccugccuaagg

SEQ ID NO: 859122 - RNA, 19 nt, Homo sapiens
gggaaauuguccugccuaa

SEQ ID NO: 859123 - RNA, 19 nt, Homo sapiens
ggaaaacaaugacaagaag

SEQ ID NO: 859124 - RNA, 19 nt, Homo sapiens
gugcgugagugcaguguga

SEQ ID NO: 859125 - RNA, 19 nt, Homo sapiens
agaaagcuaacacuuaaga

SEQ ID NO: 859126 - RNA, 19 nt, Homo sapiens
gagcagagaccuggagaag

SEQ ID NO: 859127 - RNA, 19 nt, Homo sapiens
ucugccagcugucugcuuu

SEQ ID NO: 859128 - RNA, 19 nt, Homo sapiens
gugugucucucacugaaau

SEQ ID NO: 859129 - RNA, 19 nt, Homo sapiens
acaaugacaagaagggaaa

SEQ ID NO: 859130 - RNA, 19 nt, Homo sapiens
agaaagaccagagcagaga

SEQ ID NO: 859131 - RNA, 19 nt, Homo sapiens
aaagggacaauucgggaaa

SEQ ID NO: 859132 - RNA, 19 nt, Homo sapiens
gugugugucucucacugaa

SEQ ID NO: 859133 - RNA, 19 nt, Homo sapiens
cacagcaccuucccagucu

SEQ ID NO: 859134 - RNA, 19 nt, Homo sapiens
gcagugugagugugugugu

SEQ ID NO: 859135 - RNA, 19 nt, Homo sapiens
agagacucgugaccaaaug

SEQ ID NO: 859136 - RNA, 19 nt, Homo sapiens
cagagacucgugaccaaau

SEQ ID NO: 859137 - RNA, 19 nt, Homo sapiens
uuccagcgcugccaguaug

SEQ ID NO: 859138 - RNA, 19 nt, Homo sapiens
ccacaggggcaccuccuua

SEQ ID NO: 859139 - RNA, 19 nt, Homo sapiens
uaagacucccacccuguga

SEQ ID NO: 859140 - RNA, 19 nt, Homo sapiens
gaugccaaagggacaauuc

SEQ ID NO: 859141 - RNA, 19 nt, Homo sapiens
ccaaggaaauugaguaucu

SEQ ID NO: 859142 - RNA, 19 nt, Homo sapiens
gaguaucucugcaaaguca

SEQ ID NO: 859143 - RNA, 19 nt, Homo sapiens
aaacugaggcccaaggaaa

SEQ ID NO: 859144 - RNA, 19 nt, Homo sapiens
caccauggcuguccaaguc

SEQ ID NO: 859145 - RNA, 19 nt, Homo sapiens
ccuaguacguguuuagaau

SEQ ID NO: 859146 - RNA, 19 nt, Homo sapiens
gagcuccuacucugucuaa

SEQ ID NO: 859147 - RNA, 19 nt, Homo sapiens
caaagucaccagcugaguu

SEQ ID NO: 859148 - RNA, 19 nt, Homo sapiens
ccucccggcuucccaguaa

SEQ ID NO: 859149 - RNA, 19 nt, Homo sapiens
gcuaagggcugggcugcau

SEQ ID NO: 859150 - RNA, 19 nt, Homo sapiens
gaaacugaggcccaaggaa

SEQ ID NO: 859151 - RNA, 19 nt, Homo sapiens
cggcagcuguggauacaug

SEQ ID NO: 859152 - RNA, 19 nt, Homo sapiens
cuccuacucugucuaaaga

SEQ ID NO: 859153 - RNA, 19 nt, Homo sapiens
gaaucuccguccuugucuu

SEQ ID NO: 859154 - RNA, 19 nt, Homo sapiens
cuaguacguguuuagaaua

SEQ ID NO: 859155 - RNA, 19 nt, Homo sapiens
ggaaacugaggcccaagga

SEQ ID NO: 859156 - RNA, 19 nt, Homo sapiens
guccuugucuuuccauucu

SEQ ID NO: 859157 - RNA, 19 nt, Homo sapiens
caaccuggaccuccuugga

SEQ ID NO: 859158 - RNA, 19 nt, Homo sapiens
ggccuuggaugagcagaug

SEQ ID NO: 859159 - RNA, 19 nt, Homo sapiens
ggugugcgcggaauggauu

SEQ ID NO: 859160 - RNA, 19 nt, Homo sapiens
gcaggcccuugggugcuaa

SEQ ID NO: 859161 - RNA, 19 nt, Homo sapiens
gaagaaucuccguccuugu

SEQ ID NO: 859162 - RNA, 19 nt, Homo sapiens
uugaguaucucugcaaagu

SEQ ID NO: 859163 - RNA, 19 nt, Homo sapiens
gcccaaggaaauugaguau

SEQ ID NO: 859164 - RNA, 19 nt, Homo sapiens
guccugaugcugcugauga

SEQ ID NO: 859165 - RNA, 19 nt, Homo sapiens
caaggaaauugaguaucuc

SEQ ID NO: 859166 - RNA, 19 nt, Homo sapiens
gucaccagcugaguucgaa

SEQ ID NO: 859167 - RNA, 19 nt, Homo sapiens
aaagucaccagcugaguuc

SEQ ID NO: 859168 - RNA, 19 nt, Homo sapiens
ggcccaaggaaauugagua

SEQ ID NO: 859169 - RNA, 19 nt, Homo sapiens
aauugaguaucucugcaaa

SEQ ID NO: 859170 - RNA, 19 nt, Homo sapiens
auccaggccucgcuucuug

SEQ ID NO: 859171 - RNA, 19 nt, Homo sapiens
gcaccauggcuguccaagu

SEQ ID NO: 859172 - RNA, 19 nt, Homo sapiens
gccggcagcuguggauaca

SEQ ID NO: 859173 - RNA, 19 nt, Homo sapiens
ugaguucgaaccagacaga

SEQ ID NO: 859174 - RNA, 19 nt, Homo sapiens
gcuccuacucugucuaaag

SEQ ID NO: 859175 - RNA, 19 nt, Homo sapiens
gcaaagucaccagcugagu

SEQ ID NO: 859176 - RNA, 19 nt, Homo sapiens
aaucuccguccuugucuuu

SEQ ID NO: 859177 - RNA, 19 nt, Homo sapiens
ggaaggagcuggagaaaga

SEQ ID NO: 859178 - RNA, 19 nt, Homo sapiens
gcucucagaugaccaaaua

SEQ ID NO: 859179 - RNA, 19 nt, Homo sapiens
ggaaggaccugauggugaa

SEQ ID NO: 859180 - RNA, 19 nt, Homo sapiens
gauaucggcucucagauga

SEQ ID NO: 859181 - RNA, 19 nt, Homo sapiens
gcaaggaggugaccagcaa

SEQ ID NO: 859182 - RNA, 19 nt, Homo sapiens
ccacugcgcuguuacaugu

SEQ ID NO: 859183 - RNA, 19 nt, Homo sapiens
ccuaagcccuguaaauaaa

SEQ ID NO: 859184 - RNA, 19 nt, Homo sapiens
gcaaguggacagugaguaa

SEQ ID NO: 859185 - RNA, 19 nt, Homo sapiens
gcaauuacgagauucugua

SEQ ID NO: 859186 - RNA, 19 nt, Homo sapiens
gcacugcuuugaaugcuau

SEQ ID NO: 859187 - RNA, 19 nt, Homo sapiens
ucaacaagcucucacagau

SEQ ID NO: 859188 - RNA, 19 nt, Homo sapiens
cgugaucucucucuauauu

SEQ ID NO: 859189 - RNA, 19 nt, Homo sapiens
aguacaaccugauuaauga

SEQ ID NO: 859190 - RNA, 19 nt, Homo sapiens
caacgucgccauccagaaa

SEQ ID NO: 859191 - RNA, 19 nt, Homo sapiens
uacgugaucucucucuaua

SEQ ID NO: 859192 - RNA, 19 nt, Homo sapiens
guagaggaguuccggaaga

SEQ ID NO: 859193 - RNA, 19 nt, Homo sapiens
ggaacaagucgccaccuaa

SEQ ID NO: 859194 - RNA, 19 nt, Homo sapiens
caacaucgccgucccgaau

SEQ ID NO: 859195 - RNA, 19 nt, Homo sapiens
gaaauguguucagcguuga

SEQ ID NO: 859196 - RNA, 19 nt, Homo sapiens
uaaaaugggucacugauau

SEQ ID NO: 859197 - RNA, 19 nt, Homo sapiens
ugucagugccuauggauua

SEQ ID NO: 859198 - RNA, 19 nt, Homo sapiens
ucacugauaucgagaaguc

SEQ ID NO: 859199 - RNA, 19 nt, Homo sapiens
ucaaguacaaccugauuaa

SEQ ID NO: 859200 - RNA, 19 nt, Homo sapiens
uaaggaagccuacgugauc

SEQ ID NO: 859201 - RNA, 19 nt, Homo sapiens
ccaaaccacuaugaacuga

SEQ ID NO: 859202 - RNA, 19 nt, Homo sapiens
gaacaagucgccaccuaag

SEQ ID NO: 859203 - RNA, 19 nt, Homo sapiens
gauuauggcagggaaagua

SEQ ID NO: 859204 - RNA, 19 nt, Homo sapiens
gugcaaaccauccgaaaug

SEQ ID NO: 859205 - RNA, 19 nt, Homo sapiens
caucuucguuugugucuca

SEQ ID NO: 859206 - RNA, 19 nt, Homo sapiens
gcaucuuccuuaucaacaa

SEQ ID NO: 859207 - RNA, 19 nt, Homo sapiens
gaccaaauagucaaccauu

SEQ ID NO: 859208 - RNA, 19 nt, Homo sapiens
ggauaucggcucucagaug

SEQ ID NO: 859209 - RNA, 19 nt, Homo sapiens
auuacgagauucuguauga

SEQ ID NO: 859210 - RNA, 19 nt, Homo sapiens
caaaccauccgaaaugugu

SEQ ID NO: 859211 - RNA, 19 nt, Homo sapiens
ugaaaucccagacugcaaa

SEQ ID NO: 859212 - RNA, 19 nt, Homo sapiens
aacaagcucucacagauca

SEQ ID NO: 859213 - RNA, 19 nt, Homo sapiens
ccaccuggaccuuaucaaa

SEQ ID NO: 859214 - RNA, 19 nt, Homo sapiens
ucuguaugaugaagaauug

SEQ ID NO: 859215 - RNA, 19 nt, Homo sapiens
ugaguaaccugcggcucua

SEQ ID NO: 859216 - RNA, 19 nt, Homo sapiens
gacaacauguucguucauc

SEQ ID NO: 859217 - RNA, 19 nt, Homo sapiens
uggaacaagucgccaccua

SEQ ID NO: 859218 - RNA, 19 nt, Homo sapiens
gcuacgacaucaucaucga

SEQ ID NO: 859219 - RNA, 19 nt, Homo sapiens
aacaacccguuacuaauug

SEQ ID NO: 859220 - RNA, 19 nt, Homo sapiens
gcuguuacauguacaagcu

SEQ ID NO: 859221 - RNA, 19 nt, Homo sapiens
acgagauucuguaugauga

SEQ ID NO: 859222 - RNA, 19 nt, Homo sapiens
gaccgaauccucaaguaca

SEQ ID NO: 859223 - RNA, 19 nt, Homo sapiens
gagaggauggguccaagug

SEQ ID NO: 859224 - RNA, 19 nt, Homo sapiens
caacaagcucucacagauc

SEQ ID NO: 859225 - RNA, 19 nt, Homo sapiens
uuccuaagcccuguaaaua

SEQ ID NO: 859226 - RNA, 19 nt, Homo sapiens
cgccggugaugaacaauga

SEQ ID NO: 859227 - RNA, 19 nt, Homo sapiens
gcaagcuguucgacgagau

SEQ ID NO: 859228 - RNA, 19 nt, Homo sapiens
ggaugagugugcaaaccau

SEQ ID NO: 859229 - RNA, 19 nt, Homo sapiens
gagcaggccgaucgagaga

SEQ ID NO: 859230 - RNA, 19 nt, Homo sapiens
gcaggccgaucgagagacu

SEQ ID NO: 859231 - RNA, 19 nt, Homo sapiens
gcaaaccauccgaaaugug

SEQ ID NO: 859232 - RNA, 19 nt, Homo sapiens
gagauucuguaugaugaag

SEQ ID NO: 859233 - RNA, 19 nt, Homo sapiens
guuugugucucaaucuaau

SEQ ID NO: 859234 - RNA, 19 nt, Homo sapiens
gaaauuucccuuuuguaga

SEQ ID NO: 859235 - RNA, 19 nt, Homo sapiens
acaagucgccaccuaagga

SEQ ID NO: 859236 - RNA, 19 nt, Homo sapiens
gaaaucccagacugcaaau

SEQ ID NO: 859237 - RNA, 19 nt, Homo sapiens
gugcugaucaauaacuuug

SEQ ID NO: 859238 - RNA, 19 nt, Homo sapiens
gugaucucucucuauauua

SEQ ID NO: 859239 - RNA, 19 nt, Homo sapiens
guaaaaugggucacugaua

SEQ ID NO: 859240 - RNA, 19 nt, Homo sapiens
caauuacgagauucuguau

SEQ ID NO: 859241 - RNA, 19 nt, Homo sapiens
aaguacaaccugauuaaug

SEQ ID NO: 859242 - RNA, 19 nt, Homo sapiens
gcacugccaaugaccgaau

SEQ ID NO: 859243 - RNA, 19 nt, Homo sapiens
uccuaagcccuguaaauaa

SEQ ID NO: 859244 - RNA, 19 nt, Homo sapiens
ggaaguccucggcaauuac

SEQ ID NO: 859245 - RNA, 19 nt, Homo sapiens
ggucacugauaucgagaag

SEQ ID NO: 859246 - RNA, 19 nt, Homo sapiens
ggacaacauguucguucau

SEQ ID NO: 859247 - RNA, 19 nt, Homo sapiens
gaaggagcuggagaaagaa

SEQ ID NO: 859248 - RNA, 19 nt, Homo sapiens
caagucgccaccuaaggaa

SEQ ID NO: 859249 - RNA, 19 nt, Homo sapiens
uaaugacacccucaacauc

SEQ ID NO: 859250 - RNA, 19 nt, Homo sapiens
caaguacaaccugauuaau

SEQ ID NO: 859251 - RNA, 19 nt, Homo sapiens
ccaaugaccgaauccucaa

SEQ ID NO: 859252 - RNA, 19 nt, Homo sapiens
auaccucuaucuggacuuu

SEQ ID NO: 859253 - RNA, 19 nt, Homo sapiens
gacugcaaauggaacaagu

SEQ ID NO: 859254 - RNA, 19 nt, Homo sapiens
ccucaaguacaaccugauu

SEQ ID NO: 859255 - RNA, 19 nt, Homo sapiens
caacauguucguucaucuc

SEQ ID NO: 859256 - RNA, 19 nt, Homo sapiens
uggacaacauguucguuca

SEQ ID NO: 859257 - RNA, 19 nt, Homo sapiens
gaccugauggugaagaaca

SEQ ID NO: 859258 - RNA, 19 nt, Homo sapiens
cuaauuggcgggaggaagu

SEQ ID NO: 859259 - RNA, 19 nt, Homo sapiens
gucucaaucuaauaaggaa

SEQ ID NO: 859260 - RNA, 19 nt, Homo sapiens
caagcucucacagaucaaa

SEQ ID NO: 859261 - RNA, 19 nt, Homo sapiens
ccagggaaagggcaucuuc

SEQ ID NO: 859262 - RNA, 19 nt, Homo sapiens
uuaaugacacccucaacau

SEQ ID NO: 859263 - RNA, 19 nt, Homo sapiens
gucagugccuauggauuau

SEQ ID NO: 859264 - RNA, 19 nt, Homo sapiens
acaggaaggagcuggagaa

SEQ ID NO: 859265 - RNA, 19 nt, Homo sapiens
cuacgugaucucucucuau

SEQ ID NO: 859266 - RNA, 19 nt, Homo sapiens
caucuuccuuaucaacaag

SEQ ID NO: 859267 - RNA, 19 nt, Homo sapiens
gguucugcacagugaaaua

SEQ ID NO: 859268 - RNA, 19 nt, Homo sapiens
ugccgguucugcacaguga

SEQ ID NO: 859269 - RNA, 19 nt, Homo sapiens
aaagagaggauggguccaa

SEQ ID NO: 859270 - RNA, 19 nt, Homo sapiens
ccuacgugaucucucucua

SEQ ID NO: 859271 - RNA, 19 nt, Homo sapiens
ucguuugugucucaaucua

SEQ ID NO: 859272 - RNA, 19 nt, Homo sapiens
uagaggaguuccggaagag

SEQ ID NO: 859273 - RNA, 19 nt, Homo sapiens
guccagcacugccaaugac

SEQ ID NO: 859274 - RNA, 19 nt, Homo sapiens
ucaccaacgucgccaucca

SEQ ID NO: 859275 - RNA, 19 nt, Homo sapiens
ugcaaaccauccgaaaugu

SEQ ID NO: 859276 - RNA, 19 nt, Homo sapiens
cauguacaagcuuggguuu

SEQ ID NO: 859277 - RNA, 19 nt, Homo sapiens
gaacaaggcguggcacuuc

SEQ ID NO: 859278 - RNA, 19 nt, Homo sapiens
gcccagaggucagaaauca

SEQ ID NO: 859279 - RNA, 19 nt, Homo sapiens
gauggaggcccuucacauu

SEQ ID NO: 859280 - RNA, 19 nt, Homo sapiens
ggaaugacuccuccacauc

SEQ ID NO: 859281 - RNA, 19 nt, Homo sapiens
ccagaggucagaaaucaga

SEQ ID NO: 859282 - RNA, 19 nt, Homo sapiens
gaauccuggugaucagaga

SEQ ID NO: 859283 - RNA, 19 nt, Homo sapiens
ccaagagaauccuggugau

SEQ ID NO: 859284 - RNA, 19 nt, Homo sapiens
uggaggcccuucacauuuc

SEQ ID NO: 859285 - RNA, 19 nt, Homo sapiens
gaugcugccaccucccuua

SEQ ID NO: 859286 - RNA, 19 nt, Homo sapiens
gguaccgggucacuguuga

SEQ ID NO: 859287 - RNA, 19 nt, Homo sapiens
gcccaguacacacaaguuu

SEQ ID NO: 859288 - RNA, 19 nt, Homo sapiens
gaggucagaaaucagauau

SEQ ID NO: 859289 - RNA, 19 nt, Homo sapiens
uaaagcacccaguauggau

SEQ ID NO: 859290 - RNA, 19 nt, Homo sapiens
gacccuagaguccaagaga

SEQ ID NO: 859291 - RNA, 19 nt, Homo sapiens
ggauggaggcccuucacau

SEQ ID NO: 859292 - RNA, 19 nt, Homo sapiens
cagggaagauaguguugag

SEQ ID NO: 859293 - RNA, 19 nt, Homo sapiens
ggaggcccuucacauuucu

SEQ ID NO: 859294 - RNA, 19 nt, Homo sapiens
gcacagcaggagacacaca

SEQ ID NO: 859295 - RNA, 19 nt, Homo sapiens
ucacggccuucccacacuu

SEQ ID NO: 859296 - RNA, 19 nt, Homo sapiens
gcugccaccucccuuagag

SEQ ID NO: 859297 - RNA, 19 nt, Homo sapiens
ccugccaccucuucccauu

SEQ ID NO: 859298 - RNA, 19 nt, Homo sapiens
cuaaagcacccaguaugga

SEQ ID NO: 859299 - RNA, 19 nt, Homo sapiens
caagagaauccuggugauc

SEQ ID NO: 859300 - RNA, 19 nt, Homo sapiens
gaggucagaaccagagauc

SEQ ID NO: 859301 - RNA, 19 nt, Homo sapiens
agacacacaagucccaaga

SEQ ID NO: 859302 - RNA, 19 nt, Homo sapiens
gcaggacaaggacccuaga

SEQ ID NO: 859303 - RNA, 19 nt, Homo sapiens
ccacauccgaggccucuag

SEQ ID NO: 859304 - RNA, 19 nt, Homo sapiens
aagagaauccuggugauca

SEQ ID NO: 859305 - RNA, 19 nt, Homo sapiens
cacacuuuguccucacuug

SEQ ID NO: 859306 - RNA, 19 nt, Homo sapiens
agaggucagaaaucagaua

SEQ ID NO: 859307 - RNA, 19 nt, Homo sapiens
gagaauccuggugaucaga

SEQ ID NO: 859308 - RNA, 19 nt, Homo sapiens
gaacaagcaacucauauuu

SEQ ID NO: 859309 - RNA, 19 nt, Homo sapiens
ucacugaaaucaucucuuu

SEQ ID NO: 859310 - RNA, 19 nt, Homo sapiens
agaagaagcugaauuuguu

SEQ ID NO: 859311 - RNA, 19 nt, Homo sapiens
gaacugggcugccucucaa

SEQ ID NO: 859312 - RNA, 19 nt, Homo sapiens
ccaaauggguuagacguua

SEQ ID NO: 859313 - RNA, 19 nt, Homo sapiens
gauaagccgucaagcauug

SEQ ID NO: 859314 - RNA, 19 nt, Homo sapiens
gaaacgcgguucagcgauu

SEQ ID NO: 859315 - RNA, 19 nt, Homo sapiens
gaacacacuucuuucucaa

SEQ ID NO: 859316 - RNA, 19 nt, Homo sapiens
acaagcaacucauauuuga

SEQ ID NO: 859317 - RNA, 19 nt, Homo sapiens
gguuagacguuaccuuuga

SEQ ID NO: 859318 - RNA, 19 nt, Homo sapiens
gagaggugcuuugcugaaa

SEQ ID NO: 859319 - RNA, 19 nt, Homo sapiens
gagaagaagcugaauuugu

SEQ ID NO: 859320 - RNA, 19 nt, Homo sapiens
ccaaagcucauauucguaa

SEQ ID NO: 859321 - RNA, 19 nt, Homo sapiens
cgaacacacuucuuucuca

SEQ ID NO: 859322 - RNA, 19 nt, Homo sapiens
uaacugaauugaggagauu

SEQ ID NO: 859323 - RNA, 19 nt, Homo sapiens
gcugaaaguuaaccaggaa

SEQ ID NO: 859324 - RNA, 19 nt, Homo sapiens
gaaagcggacauucacuga

SEQ ID NO: 859325 - RNA, 19 nt, Homo sapiens
gguuggaacuuaauuacug

SEQ ID NO: 859326 - RNA, 19 nt, Homo sapiens
gagcgaaggagacuaccua

SEQ ID NO: 859327 - RNA, 19 nt, Homo sapiens
ggaaacuucgaaagaaauu

SEQ ID NO: 859328 - RNA, 19 nt, Homo sapiens
caaugaaggcaguauggua

SEQ ID NO: 859329 - RNA, 19 nt, Homo sapiens
ccggaaacuucgaaagaaa

SEQ ID NO: 859330 - RNA, 19 nt, Homo sapiens
gaacaaaagaaacuucgua

SEQ ID NO: 859331 - RNA, 19 nt, Homo sapiens
ggacuuggaaggacuaaag

SEQ ID NO: 859332 - RNA, 19 nt, Homo sapiens
guaacugaauugaggagau

SEQ ID NO: 859333 - RNA, 19 nt, Homo sapiens
agacguuaccuuugaagua

SEQ ID NO: 859334 - RNA, 19 nt, Homo sapiens
gaagaagcugaauuuguug

SEQ ID NO: 859335 - RNA, 19 nt, Homo sapiens
ugaacaagcaacucauauu

SEQ ID NO: 859336 - RNA, 19 nt, Homo sapiens
gaaggacuaaagaugauau

SEQ ID NO: 859337 - RNA, 19 nt, Homo sapiens
guucagcgauucuuugacu

SEQ ID NO: 859338 - RNA, 19 nt, Homo sapiens
cgaaggagacuaccuaggu

SEQ ID NO: 859339 - RNA, 19 nt, Homo sapiens
ggagaggugcuuugcugaa

SEQ ID NO: 859340 - RNA, 19 nt, Homo sapiens
gaagcugaauuuguugaag

SEQ ID NO: 859341 - RNA, 19 nt, Homo sapiens
caccaugguuggaaacaau

SEQ ID NO: 859342 - RNA, 19 nt, Homo sapiens
ggaaggacuaaagaugaua

SEQ ID NO: 859343 - RNA, 19 nt, Homo sapiens
gaaguugagccugaagcua

SEQ ID NO: 859344 - RNA, 19 nt, Homo sapiens
acagacaggcgacaggaua

SEQ ID NO: 859345 - RNA, 19 nt, Homo sapiens
aggagaagaagcugaauuu

SEQ ID NO: 859346 - RNA, 19 nt, Homo sapiens
caaauggguuagacguuac

SEQ ID NO: 859347 - RNA, 19 nt, Homo sapiens
gaagcuaaacaggaaauuc

SEQ ID NO: 859348 - RNA, 19 nt, Homo sapiens
gccucaagcuuccuaaucu

SEQ ID NO: 859349 - RNA, 19 nt, Homo sapiens
ggagaagaagcugaauuug

SEQ ID NO: 859350 - RNA, 19 nt, Homo sapiens
ucaaggugaugacgcacuu

SEQ ID NO: 859351 - RNA, 19 nt, Homo sapiens
gaaaccccgucaauaaaug

SEQ ID NO: 859352 - RNA, 19 nt, Homo sapiens
gaaggcguauggcgagaac

SEQ ID NO: 859353 - RNA, 19 nt, Homo sapiens
gcccggaaacuucgaaaga

SEQ ID NO: 859354 - RNA, 19 nt, Homo sapiens
cguauggccuguccuucuu

SEQ ID NO: 859355 - RNA, 19 nt, Homo sapiens
guuagacguuaccuuugaa

SEQ ID NO: 859356 - RNA, 19 nt, Homo sapiens
gaugacgcacuuccaaaug

SEQ ID NO: 859357 - RNA, 19 nt, Homo sapiens
aaguugagccugaagcuaa

SEQ ID NO: 859358 - RNA, 19 nt, Homo sapiens
acaaguggauguuuugauu

SEQ ID NO: 859359 - RNA, 19 nt, Homo sapiens
gcuaaacaggaaauucuug

SEQ ID NO: 859360 - RNA, 19 nt, Homo sapiens
gugauaagccgucaagcau

SEQ ID NO: 859361 - RNA, 19 nt, Homo sapiens
caaaagaaacuucguaugg

SEQ ID NO: 859362 - RNA, 19 nt, Homo sapiens
gaaacaaugaaggcaguau

SEQ ID NO: 859363 - RNA, 19 nt, Homo sapiens
caacucauauuugauucag

SEQ ID NO: 859364 - RNA, 19 nt, Homo sapiens
ggaagaccagccacacugu

SEQ ID NO: 859365 - RNA, 19 nt, Homo sapiens
ggagacggacagaggaaug

SEQ ID NO: 859366 - RNA, 19 nt, Homo sapiens
ccuuugaaguaacugaauu

SEQ ID NO: 859367 - RNA, 19 nt, Homo sapiens
uggaaggacuaaagaugau

SEQ ID NO: 859368 - RNA, 19 nt, Homo sapiens
cuaaacaggaaauucuuga

SEQ ID NO: 859369 - RNA, 19 nt, Homo sapiens
cccggaaacuucgaaagaa

SEQ ID NO: 859370 - RNA, 19 nt, Homo sapiens
guaaugcggaaaucucaug

SEQ ID NO: 859371 - RNA, 19 nt, Homo sapiens
ggugauaagccgucaagca

SEQ ID NO: 859372 - RNA, 19 nt, Homo sapiens
aagcugaauuuguugaagu

SEQ ID NO: 859373 - RNA, 19 nt, Homo sapiens
caagcuuccuaaucuucuu

SEQ ID NO: 859374 - RNA, 19 nt, Homo sapiens
cugaauuuguugaaguuga

SEQ ID NO: 859375 - RNA, 19 nt, Homo sapiens
ggaaacaaugaaggcagua

SEQ ID NO: 859376 - RNA, 19 nt, Homo sapiens
uggguuagacguuaccuuu

SEQ ID NO: 859377 - RNA, 19 nt, Homo sapiens
ccucaagcuuccuaaucuu

SEQ ID NO: 859378 - RNA, 19 nt, Homo sapiens
ucugcaaccucaacuaugg

SEQ ID NO: 859379 - RNA, 19 nt, Homo sapiens
gcaacucauauuugauuca

SEQ ID NO: 859380 - RNA, 19 nt, Homo sapiens
gaggaaugucagcugagua

SEQ ID NO: 859381 - RNA, 19 nt, Homo sapiens
gcaguuauaacaccauggu

SEQ ID NO: 859382 - RNA, 19 nt, Homo sapiens
gaguacaguuuucccauau

SEQ ID NO: 859383 - RNA, 19 nt, Homo sapiens
gggaaaccccgucaauaaa

SEQ ID NO: 859384 - RNA, 19 nt, Homo sapiens
ugaauuuguugaaguugag

SEQ ID NO: 859385 - RNA, 19 nt, Homo sapiens
gaaaagaaagcggacauuc

SEQ ID NO: 859386 - RNA, 19 nt, Homo sapiens
auaacaccaugguuggaaa

SEQ ID NO: 859387 - RNA, 19 nt, Homo sapiens
aaauugcuccgucuuggaa

SEQ ID NO: 859388 - RNA, 19 nt, Homo sapiens
ggaaaccccgucaauaaau

SEQ ID NO: 859389 - RNA, 19 nt, Homo sapiens
ucgcucgguuggaacuuaa

SEQ ID NO: 859390 - RNA, 19 nt, Homo sapiens
ggaacuggcaggcuacacu

SEQ ID NO: 859391 - RNA, 19 nt, Homo sapiens
caagugggaaggcguaugg

SEQ ID NO: 859392 - RNA, 19 nt, Homo sapiens
ugaguacaguuuucccaua

SEQ ID NO: 859393 - RNA, 19 nt, Homo sapiens
ggugaugacgcacuuccaa

SEQ ID NO: 859394 - RNA, 19 nt, Homo sapiens
uguuaaagacacacucaaa

SEQ ID NO: 859395 - RNA, 19 nt, Homo sapiens
guuuggagcugggauaagg

SEQ ID NO: 859396 - RNA, 19 nt, Homo sapiens
aacaagcaacucauauuug

SEQ ID NO: 859397 - RNA, 19 nt, Homo sapiens
ugucagcugaguacaguuu

SEQ ID NO: 859398 - RNA, 19 nt, Homo sapiens
aaacaaugaaggcaguaug

SEQ ID NO: 859399 - RNA, 19 nt, Homo sapiens
gugauggcguccaguuugg

SEQ ID NO: 859400 - RNA, 19 nt, Homo sapiens
ugauaagccgucaagcauu

SEQ ID NO: 859401 - RNA, 19 nt, Homo sapiens
aaagaaagcggacauucac

SEQ ID NO: 859402 - RNA, 19 nt, Homo sapiens
gaaugucagcugaguacag

SEQ ID NO: 859403 - RNA, 19 nt, Homo sapiens
aaacgcgguucagcgauuc

SEQ ID NO: 859404 - RNA, 19 nt, Homo sapiens
caccgucucucgaggaaac

SEQ ID NO: 859405 - RNA, 19 nt, Homo sapiens
ccucaggcuuggcaacauc

SEQ ID NO: 859406 - RNA, 19 nt, Homo sapiens
caggaaaccucugcaaccu

SEQ ID NO: 859407 - RNA, 19 nt, Homo sapiens
ggaaggcguauggcgagaa

SEQ ID NO: 859408 - RNA, 19 nt, Homo sapiens
gcagaugcaucccuacuua

SEQ ID NO: 859409 - RNA, 19 nt, Homo sapiens
gcaaguguuugaagauuua

SEQ ID NO: 859410 - RNA, 19 nt, Homo sapiens
ccacaaacaucuucaguaa

SEQ ID NO: 859411 - RNA, 19 nt, Homo sapiens
uaaaugagcuggaugguau

SEQ ID NO: 859412 - RNA, 19 nt, Homo sapiens
gaauggccguucuugauua

SEQ ID NO: 859413 - RNA, 19 nt, Homo sapiens
gauagaacgugcauuuaaa

SEQ ID NO: 859414 - RNA, 19 nt, Homo sapiens
ggaaaucuguguuacaaga

SEQ ID NO: 859415 - RNA, 19 nt, Homo sapiens
gaacgugcauuuaaagaau

SEQ ID NO: 859416 - RNA, 19 nt, Homo sapiens
agaaagaguuacacuguua

SEQ ID NO: 859417 - RNA, 19 nt, Homo sapiens
ugaaagaacuggaggagaa

SEQ ID NO: 859418 - RNA, 19 nt, Homo sapiens
guacaaauuugggaacaua

SEQ ID NO: 859419 - RNA, 19 nt, Homo sapiens
ggauagaacgugcauuuaa

SEQ ID NO: 859420 - RNA, 19 nt, Homo sapiens
gaaccucaauauugcaauu

SEQ ID NO: 859421 - RNA, 19 nt, Homo sapiens
uuacaucccuuaaucauga

SEQ ID NO: 859422 - RNA, 19 nt, Homo sapiens
gaaaguaacugaguguucu

SEQ ID NO: 859423 - RNA, 19 nt, Homo sapiens
ugaaugaacuacauccaaa

SEQ ID NO: 859424 - RNA, 19 nt, Homo sapiens
gaauaaagauaaccaagac

SEQ ID NO: 859425 - RNA, 19 nt, Homo sapiens
gaaaucuucucaugcuguu

SEQ ID NO: 859426 - RNA, 19 nt, Homo sapiens
gaagauucccagucuauug

SEQ ID NO: 859427 - RNA, 19 nt, Homo sapiens
uaauguaacugugugguuu

SEQ ID NO: 859428 - RNA, 19 nt, Homo sapiens
guaacugaguguucucuug

SEQ ID NO: 859429 - RNA, 19 nt, Homo sapiens
caagaaagaguuacacugu

SEQ ID NO: 859430 - RNA, 19 nt, Homo sapiens
gagcuugccugcagagauc

SEQ ID NO: 859431 - RNA, 19 nt, Homo sapiens
guuuaagucucaucucauu

SEQ ID NO: 859432 - RNA, 19 nt, Homo sapiens
ccaauggguuuaagucuca

SEQ ID NO: 859433 - RNA, 19 nt, Homo sapiens
ugucauagaugcuuaccaa

SEQ ID NO: 859434 - RNA, 19 nt, Homo sapiens
gaacaaucaagaaagaguu

SEQ ID NO: 859435 - RNA, 19 nt, Homo sapiens
uggccguucuugauuauua

SEQ ID NO: 859436 - RNA, 19 nt, Homo sapiens
gcgaaaagcugauccugaa

SEQ ID NO: 859437 - RNA, 19 nt, Homo sapiens
ccaaagaguucuggauauc

SEQ ID NO: 859438 - RNA, 19 nt, Homo sapiens
gaaggugacaucuccaaug

SEQ ID NO: 859439 - RNA, 19 nt, Homo sapiens
uaguagaguuuaacgugua

SEQ ID NO: 859440 - RNA, 19 nt, Homo sapiens
gaaaugacugugaauacug

SEQ ID NO: 859441 - RNA, 19 nt, Homo sapiens
gaaaagcccggaauuggua

SEQ ID NO: 859442 - RNA, 19 nt, Homo sapiens
caacaucagugacaguaac

SEQ ID NO: 859443 - RNA, 19 nt, Homo sapiens
caacauugccucacggaau

SEQ ID NO: 859444 - RNA, 19 nt, Homo sapiens
gaaacagcacccaggacua

SEQ ID NO: 859445 - RNA, 19 nt, Homo sapiens
aguguucucuuguuucuuu

SEQ ID NO: 859446 - RNA, 19 nt, Homo sapiens
aaaugacugugaauacuga

SEQ ID NO: 859447 - RNA, 19 nt, Homo sapiens
gaacuuggauacgauuggu

SEQ ID NO: 859448 - RNA, 19 nt, Homo sapiens
gcagagauccaucccaagu

SEQ ID NO: 859449 - RNA, 19 nt, Homo sapiens
guaaaugagcuggauggua

SEQ ID NO: 859450 - RNA, 19 nt, Homo sapiens
gcaagacugugcucaagcu

SEQ ID NO: 859451 - RNA, 19 nt, Homo sapiens
uagccaagauaacgaguga

SEQ ID NO: 859452 - RNA, 19 nt, Homo sapiens
uaugugaaauugcaagugu

SEQ ID NO: 859453 - RNA, 19 nt, Homo sapiens
ggguuuaagucucaucuca

SEQ ID NO: 859454 - RNA, 19 nt, Homo sapiens
cgaaaugacugugaauacu

SEQ ID NO: 859455 - RNA, 19 nt, Homo sapiens
gaaauugcaaguguuugaa

SEQ ID NO: 859456 - RNA, 19 nt, Homo sapiens
gaaaucuguguuacaagaa

SEQ ID NO: 859457 - RNA, 19 nt, Homo sapiens
gaaaagaaaccacaaacau

SEQ ID NO: 859458 - RNA, 19 nt, Homo sapiens
gaggcacuggcuacaauua

SEQ ID NO: 859459 - RNA, 19 nt, Homo sapiens
gcucacggcgcucuucaaa

SEQ ID NO: 859460 - RNA, 19 nt, Homo sapiens
caagguaaaugagcuggau

SEQ ID NO: 859461 - RNA, 19 nt, Homo sapiens
aagcugauccugaaaucua

SEQ ID NO: 859462 - RNA, 19 nt, Homo sapiens
caauguggccaauggguuu

SEQ ID NO: 859463 - RNA, 19 nt, Homo sapiens
ucauguagcuggaaaagaa

SEQ ID NO: 859464 - RNA, 19 nt, Homo sapiens
gauuauuacagaccucuuu

SEQ ID NO: 859465 - RNA, 19 nt, Homo sapiens
ugccuacucuucaaugauu

SEQ ID NO: 859466 - RNA, 19 nt, Homo sapiens
ugaaauugcaaguguuuga

SEQ ID NO: 859467 - RNA, 19 nt, Homo sapiens
uccgaaaccuuaccgaaga

SEQ ID NO: 859468 - RNA, 19 nt, Homo sapiens
acuguuagaccuuaugaua

SEQ ID NO: 859469 - RNA, 19 nt, Homo sapiens
aagaaagaguuacacuguu

SEQ ID NO: 859470 - RNA, 19 nt, Homo sapiens
uugcaaagauggaggaaca

SEQ ID NO: 859471 - RNA, 19 nt, Homo sapiens
guuacacuguuagaccuua

SEQ ID NO: 859472 - RNA, 19 nt, Homo sapiens
gauucccagucuauuguuu

SEQ ID NO: 859473 - RNA, 19 nt, Homo sapiens
gcuguugauuugauucuuc

SEQ ID NO: 859474 - RNA, 19 nt, Homo sapiens
gauaauaaaccagucucuu

SEQ ID NO: 859475 - RNA, 19 nt, Homo sapiens
gacagcagauaauaaacca

SEQ ID NO: 859476 - RNA, 19 nt, Homo sapiens
caaacaucuucaguaauug

SEQ ID NO: 859477 - RNA, 19 nt, Homo sapiens
aaagaaaccacaaacaucu

SEQ ID NO: 859478 - RNA, 19 nt, Homo sapiens
acugaacaaucaagaaaga

SEQ ID NO: 859479 - RNA, 19 nt, Homo sapiens
caaacugaacaaucaagaa

SEQ ID NO: 859480 - RNA, 19 nt, Homo sapiens
gcaauugaugucauagaug

SEQ ID NO: 859481 - RNA, 19 nt, Homo sapiens
ggugcaugcuuucccagaa

SEQ ID NO: 859482 - RNA, 19 nt, Homo sapiens
gagcagcggaaccgagaaa

SEQ ID NO: 859483 - RNA, 19 nt, Homo sapiens
gcauagaguguucugugaa

SEQ ID NO: 859484 - RNA, 19 nt, Homo sapiens
auaauaaaccagucucuug

SEQ ID NO: 859485 - RNA, 19 nt, Homo sapiens
aaaccaagauuugauugca

SEQ ID NO: 859486 - RNA, 19 nt, Homo sapiens
aaacagcacccaggacuau

SEQ ID NO: 859487 - RNA, 19 nt, Homo sapiens
uaauugugguugcgugaga

SEQ ID NO: 859488 - RNA, 19 nt, Homo sapiens
ugcaaguguuugaagauuu

SEQ ID NO: 859489 - RNA, 19 nt, Homo sapiens
gaaugaacuacauccaaau

SEQ ID NO: 859490 - RNA, 19 nt, Homo sapiens
gcaacaucagugacaguaa

SEQ ID NO: 859491 - RNA, 19 nt, Homo sapiens
ucauucgucugauuggaaa

SEQ ID NO: 859492 - RNA, 19 nt, Homo sapiens
cgauugguguugcuguuga

SEQ ID NO: 859493 - RNA, 19 nt, Homo sapiens
ugugacagcagauaauaaa

SEQ ID NO: 859494 - RNA, 19 nt, Homo sapiens
ccaggacuaucuuccaaag

SEQ ID NO: 859495 - RNA, 19 nt, Homo sapiens
caucuucuaccguauguga

SEQ ID NO: 859496 - RNA, 19 nt, Homo sapiens
gcgaaaugacugugaauac

SEQ ID NO: 859497 - RNA, 19 nt, Homo sapiens
gaaagaguuacacuguuag

SEQ ID NO: 859498 - RNA, 19 nt, Homo sapiens
ugauauaugccauccgaaa

SEQ ID NO: 859499 - RNA, 19 nt, Homo sapiens
ucaaucaggaacuuggaua

SEQ ID NO: 859500 - RNA, 19 nt, Homo sapiens
cuggacaacugcaacauca

SEQ ID NO: 859501 - RNA, 19 nt, Homo sapiens
agaauucaaucaggaacuu

SEQ ID NO: 859502 - RNA, 19 nt, Homo sapiens
uaacugaguguucucuugu

SEQ ID NO: 859503 - RNA, 19 nt, Homo sapiens
gauaaccaagacaagguaa

SEQ ID NO: 859504 - RNA, 19 nt, Homo sapiens
uuggaaaucuguguuacaa

SEQ ID NO: 859505 - RNA, 19 nt, Homo sapiens
caagcaccuuuguggauca

SEQ ID NO: 859506 - RNA, 19 nt, Homo sapiens
ucaggaacuuggauacgau

SEQ ID NO: 859507 - RNA, 19 nt, Homo sapiens
uggaaucuguuucauggau

SEQ ID NO: 859508 - RNA, 19 nt, Homo sapiens
uaagaaggcuugauaaaga

SEQ ID NO: 859509 - RNA, 19 nt, Homo sapiens
gaagaaaguucaucagcuu

SEQ ID NO: 859510 - RNA, 19 nt, Homo sapiens
ccacagaugucuuuaauuc

SEQ ID NO: 859511 - RNA, 19 nt, Homo sapiens
gagaaauacugcuaaagaa

SEQ ID NO: 859512 - RNA, 19 nt, Homo sapiens
gcacaugaguuaagauugu

SEQ ID NO: 859513 - RNA, 19 nt, Homo sapiens
cauaugagcacaugaguua

SEQ ID NO: 859514 - RNA, 19 nt, Homo sapiens
cagagaagaucaucaagaa

SEQ ID NO: 859515 - RNA, 19 nt, Homo sapiens
gaguuaagauugugacuga

SEQ ID NO: 859516 - RNA, 19 nt, Homo sapiens
guagugaggugcuggauga

SEQ ID NO: 859517 - RNA, 19 nt, Homo sapiens
ggagaaauacugcuaaaga

SEQ ID NO: 859518 - RNA, 19 nt, Homo sapiens
gaauugaguucuccuuuua

SEQ ID NO: 859519 - RNA, 19 nt, Homo sapiens
gaaauguaaugguguguca

SEQ ID NO: 859520 - RNA, 19 nt, Homo sapiens
gcacauuggauauuucuaa

SEQ ID NO: 859521 - RNA, 19 nt, Homo sapiens
caaggaaggccuaggcuua

SEQ ID NO: 859522 - RNA, 19 nt, Homo sapiens
guaacaaucuucauucuac

SEQ ID NO: 859523 - RNA, 19 nt, Homo sapiens
cuaaagaacaugagcauaa

SEQ ID NO: 859524 - RNA, 19 nt, Homo sapiens
uauccaggcuguuaaauga

SEQ ID NO: 859525 - RNA, 19 nt, Homo sapiens
gaauaugcuucuggaauug

SEQ ID NO: 859526 - RNA, 19 nt, Homo sapiens
gagagaugcugcaccaaau

SEQ ID NO: 859527 - RNA, 19 nt, Homo sapiens
uagcauugauggagaaauu

SEQ ID NO: 859528 - RNA, 19 nt, Homo sapiens
cuuaaacacuggcauauau

SEQ ID NO: 859529 - RNA, 19 nt, Homo sapiens
gaaauacugcuaaagaaca

SEQ ID NO: 859530 - RNA, 19 nt, Homo sapiens
guaaguagcauuaagaaag

SEQ ID NO: 859531 - RNA, 19 nt, Homo sapiens
ucacauggacggguuaaua

SEQ ID NO: 859532 - RNA, 19 nt, Homo sapiens
gagaacauaugagcacaug

SEQ ID NO: 859533 - RNA, 19 nt, Homo sapiens
gcauugauggagaaauuua

SEQ ID NO: 859534 - RNA, 19 nt, Homo sapiens
ggccacagaugucuuuaau

SEQ ID NO: 859535 - RNA, 19 nt, Homo sapiens
gcagagaagaucaucaaga

SEQ ID NO: 859536 - RNA, 19 nt, Homo sapiens
cuagauuggucuugauauu

SEQ ID NO: 859537 - RNA, 19 nt, Homo sapiens
gccuugaaaugcuugcuua

SEQ ID NO: 859538 - RNA, 19 nt, Homo sapiens
uuaaaugaaugcagagaga

SEQ ID NO: 859539 - RNA, 19 nt, Homo sapiens
ucaagaaccucaucaagac

SEQ ID NO: 859540 - RNA, 19 nt, Homo sapiens
gaacauaugagcacaugag

SEQ ID NO: 859541 - RNA, 19 nt, Homo sapiens
ggaugaagagaacauauga

SEQ ID NO: 859542 - RNA, 19 nt, Homo sapiens
ugaaaucaguacuguggaa

SEQ ID NO: 859543 - RNA, 19 nt, Homo sapiens
ggaauugaguucuccuuuu

SEQ ID NO: 859544 - RNA, 19 nt, Homo sapiens
gguggcacauuggauauuu

SEQ ID NO: 859545 - RNA, 19 nt, Homo sapiens
gauaugugguuggguaaug

SEQ ID NO: 859546 - RNA, 19 nt, Homo sapiens
gagcacaugaguuaagauu

SEQ ID NO: 859547 - RNA, 19 nt, Homo sapiens
agauuggucuugauauuga

SEQ ID NO: 859548 - RNA, 19 nt, Homo sapiens
caucgacauucaggauuua

SEQ ID NO: 859549 - RNA, 19 nt, Homo sapiens
ucaucgacauucaggauuu

SEQ ID NO: 859550 - RNA, 19 nt, Homo sapiens
ugugacugaucaugauuua

SEQ ID NO: 859551 - RNA, 19 nt, Homo sapiens
ccaccucacugccaaguca

SEQ ID NO: 859552 - RNA, 19 nt, Homo sapiens
ggauauuucuaacauguac

SEQ ID NO: 859553 - RNA, 19 nt, Homo sapiens
gauugugacugaucaugau

SEQ ID NO: 859554 - RNA, 19 nt, Homo sapiens
gacccaaccaccagcaaua

SEQ ID NO: 859555 - RNA, 19 nt, Homo sapiens
ugugugguguuucuauaua

SEQ ID NO: 859556 - RNA, 19 nt, Homo sapiens
aagaaggcuugauaaagaa

SEQ ID NO: 859557 - RNA, 19 nt, Homo sapiens
gcguuucaguguuuaagaa

SEQ ID NO: 859558 - RNA, 19 nt, Homo sapiens
uaaguagcauuaagaaagg

SEQ ID NO: 859559 - RNA, 19 nt, Homo sapiens
aagaugagcuagcauugau

SEQ ID NO: 859560 - RNA, 19 nt, Homo sapiens
ucaguacuguggaaaugaa

SEQ ID NO: 859561 - RNA, 19 nt, Homo sapiens
ccacucgacucagagauug

SEQ ID NO: 859562 - RNA, 19 nt, Homo sapiens
gcacuccgaagcagaagaa

SEQ ID NO: 859563 - RNA, 19 nt, Homo sapiens
gaguacaugugagcgguaa

SEQ ID NO: 859564 - RNA, 19 nt, Homo sapiens
gguaacaaucuucauucua

SEQ ID NO: 859565 - RNA, 19 nt, Homo sapiens
ggaaaugaacuauauuagc

SEQ ID NO: 859566 - RNA, 19 nt, Homo sapiens
guagucaacccucaggaaa

SEQ ID NO: 859567 - RNA, 19 nt, Homo sapiens
uaacagaccaugggagaga

SEQ ID NO: 859568 - RNA, 19 nt, Homo sapiens
gaaaucaguacuguggaaa

SEQ ID NO: 859569 - RNA, 19 nt, Homo sapiens
cacauggacggguuaauaa

SEQ ID NO: 859570 - RNA, 19 nt, Homo sapiens
ggccagcuauguccucuag

SEQ ID NO: 859571 - RNA, 19 nt, Homo sapiens
gcuuaaacacuggcauaua

SEQ ID NO: 859572 - RNA, 19 nt, Homo sapiens
ucuaacauguacaaagcua

SEQ ID NO: 859573 - RNA, 19 nt, Homo sapiens
cuccagaccugaggacuuu

SEQ ID NO: 859574 - RNA, 19 nt, Homo sapiens
caagcuggccauucuuuau

SEQ ID NO: 859575 - RNA, 19 nt, Homo sapiens
gugugguguuucuauauaa

SEQ ID NO: 859576 - RNA, 19 nt, Homo sapiens
caagaugagcuagcauuga

SEQ ID NO: 859577 - RNA, 19 nt, Homo sapiens
caucgccaccaccuuaaua

SEQ ID NO: 859578 - RNA, 19 nt, Homo sapiens
acagaugucuuuaauucca

SEQ ID NO: 859579 - RNA, 19 nt, Homo sapiens
guaaaaugguguccaaauc

SEQ ID NO: 859580 - RNA, 19 nt, Homo sapiens
caccagcaauaaacauuuc

SEQ ID NO: 859581 - RNA, 19 nt, Homo sapiens
gaaggaggcagagaagauc

SEQ ID NO: 859582 - RNA, 19 nt, Homo sapiens
aaucaguacuguggaaaug

SEQ ID NO: 859583 - RNA, 19 nt, Homo sapiens
uaacauguacaaagcuaug

SEQ ID NO: 859584 - RNA, 19 nt, Homo sapiens
aagcuggccauucuuuaua

SEQ ID NO: 859585 - RNA, 19 nt, Homo sapiens
ucaucaagcuggccauucu

SEQ ID NO: 859586 - RNA, 19 nt, Homo sapiens
uuaauagacgacacaagua

SEQ ID NO: 859587 - RNA, 19 nt, Homo sapiens
ccaccagcaauaaacauuu

SEQ ID NO: 859588 - RNA, 19 nt, Homo sapiens
gaaaugacagacccaacca

SEQ ID NO: 859589 - RNA, 19 nt, Homo sapiens
gggcaaaaggggagaaaua

SEQ ID NO: 859590 - RNA, 19 nt, Homo sapiens
cuguggaaaugaacuauau

SEQ ID NO: 859591 - RNA, 19 nt, Homo sapiens
guugguggcacauuggaua

SEQ ID NO: 859592 - RNA, 19 nt, Homo sapiens
gagaugcugcaccaaauca

SEQ ID NO: 859593 - RNA, 19 nt, Homo sapiens
ucaagcuggccauucuuua

SEQ ID NO: 859594 - RNA, 19 nt, Homo sapiens
gaacuuucucuugcuauca

SEQ ID NO: 859595 - RNA, 19 nt, Homo sapiens
gcacugcugauuuaugaag

SEQ ID NO: 859596 - RNA, 19 nt, Homo sapiens
uggcauauauggagagaac

SEQ ID NO: 859597 - RNA, 19 nt, Homo sapiens
gcuaaagaacaugagcaua

SEQ ID NO: 859598 - RNA, 19 nt, Homo sapiens
gcuuagggcuucuuuuaug

SEQ ID NO: 859599 - RNA, 19 nt, Homo sapiens
guacuguggaaaugaacua

SEQ ID NO: 859600 - RNA, 19 nt, Homo sapiens
guagacacccaaagaacug

SEQ ID NO: 859601 - RNA, 19 nt, Homo sapiens
gaaggcuuguuuuauuuga

SEQ ID NO: 859602 - RNA, 19 nt, Homo sapiens
agagagaugcugcaccaaa

SEQ ID NO: 859603 - RNA, 19 nt, Homo sapiens
acaagaaggaggcagagaa

SEQ ID NO: 859604 - RNA, 19 nt, Homo sapiens
ugaguagacacccaaagaa

SEQ ID NO: 859605 - RNA, 19 nt, Homo sapiens
gcuggugaauuuuccauuu

SEQ ID NO: 859606 - RNA, 19 nt, Homo sapiens
uaucauugcuccuuuugaa

SEQ ID NO: 859607 - RNA, 19 nt, Homo sapiens
uuaagauugugacugauca

SEQ ID NO: 859608 - RNA, 19 nt, Homo sapiens
ccagagauguugagaaugu

SEQ ID NO: 859609 - RNA, 19 nt, Homo sapiens
gaagaauucgucccacuaa

SEQ ID NO: 859610 - RNA, 19 nt, Homo sapiens
acaaugauguuuccuguga

SEQ ID NO: 859611 - RNA, 19 nt, Homo sapiens
gaccgugucucucuaguug

SEQ ID NO: 859612 - RNA, 19 nt, Homo sapiens
aaacugaacagaagaauuc

SEQ ID NO: 859613 - RNA, 19 nt, Homo sapiens
gcacaggccugagaagucu

SEQ ID NO: 859614 - RNA, 19 nt, Homo sapiens
acacgaaccucugcaaguu

SEQ ID NO: 859615 - RNA, 19 nt, Homo sapiens
ggccauggcuacagcaaga

SEQ ID NO: 859616 - RNA, 19 nt, Homo sapiens
gaauucgucccacuaaaga

SEQ ID NO: 859617 - RNA, 19 nt, Homo sapiens
caacgucuccucucauugu

SEQ ID NO: 859618 - RNA, 19 nt, Homo sapiens
agaaauaaacugagaagug

SEQ ID NO: 859619 - RNA, 19 nt, Homo sapiens
gaggguggcucagcaggaa

SEQ ID NO: 859620 - RNA, 19 nt, Homo sapiens
acuccuaucuucugaauuc

SEQ ID NO: 859621 - RNA, 19 nt, Homo sapiens
ucccagagauguugagaau

SEQ ID NO: 859622 - RNA, 19 nt, Homo sapiens
cggcugagcugggagcaaa

SEQ ID NO: 859623 - RNA, 19 nt, Homo sapiens
ccaaguggauccaggaaac

SEQ ID NO: 859624 - RNA, 19 nt, Homo sapiens
gcagcucugacccaaauuu

SEQ ID NO: 859625 - RNA, 19 nt, Homo sapiens
ccucauuccuucccagaga

SEQ ID NO: 859626 - RNA, 19 nt, Homo sapiens
cuccagugcuugaauauca

SEQ ID NO: 859627 - RNA, 19 nt, Homo sapiens
cagcucugacccaaauuua

SEQ ID NO: 859628 - RNA, 19 nt, Homo sapiens
gcacuuucauccucaagcu

SEQ ID NO: 859629 - RNA, 19 nt, Homo sapiens
caaacugaacagaagaauu

SEQ ID NO: 859630 - RNA, 19 nt, Homo sapiens
cugcagcucugacccaaau

SEQ ID NO: 859631 - RNA, 19 nt, Homo sapiens
guccuccagugcuugaaua

SEQ ID NO: 859632 - RNA, 19 nt, Homo sapiens
gaucacagccuugcuucug

SEQ ID NO: 859633 - RNA, 19 nt, Homo sapiens
ccuaucuucugaauucuau

SEQ ID NO: 859634 - RNA, 19 nt, Homo sapiens
ccaaauuuagucccagaaa

SEQ ID NO: 859635 - RNA, 19 nt, Homo sapiens
ucaucaaacugaacagaag

SEQ ID NO: 859636 - RNA, 19 nt, Homo sapiens
cugcuagacuccuaucuuc

SEQ ID NO: 859637 - RNA, 19 nt, Homo sapiens
gcucugacccaaauuuagu

SEQ ID NO: 859638 - RNA, 19 nt, Homo sapiens
ucccagaaauaaacugaga

SEQ ID NO: 859639 - RNA, 19 nt, Homo sapiens
guugaacccugggaacaau

SEQ ID NO: 859640 - RNA, 19 nt, Homo sapiens
cuagacuccuaucuucuga

SEQ ID NO: 859641 - RNA, 19 nt, Homo sapiens
gaauaucagcgugcuaagu

SEQ ID NO: 859642 - RNA, 19 nt, Homo sapiens
agacuccuaucuucugaau

SEQ ID NO: 859643 - RNA, 19 nt, Homo sapiens
aagaauucgucccacuaaa

SEQ ID NO: 859644 - RNA, 19 nt, Homo sapiens
gaugguggcccguccuugu

SEQ ID NO: 859645 - RNA, 19 nt, Homo sapiens
cuaagguccuccagugcuu

SEQ ID NO: 859646 - RNA, 19 nt, Homo sapiens
gcagccgcaucaucaaugg

SEQ ID NO: 859647 - RNA, 19 nt, Homo sapiens
guccugcacccacaucuuu

SEQ ID NO: 859648 - RNA, 19 nt, Homo sapiens
aaaggugcgaggaugcuua

SEQ ID NO: 859649 - RNA, 19 nt, Homo sapiens
gacagcagcagccgcauca

SEQ ID NO: 859650 - RNA, 19 nt, Homo sapiens
gauagaugacaccauguuc

SEQ ID NO: 859651 - RNA, 19 nt, Homo sapiens
agaagaauucgucccacua

SEQ ID NO: 859652 - RNA, 19 nt, Homo sapiens
cuaacgaccucaugcucau

SEQ ID NO: 859653 - RNA, 19 nt, Homo sapiens
gcuagacuccuaucuucug

SEQ ID NO: 859654 - RNA, 19 nt, Homo sapiens
ccgugucucucuaguugaa

SEQ ID NO: 859655 - RNA, 19 nt, Homo sapiens
gcaaguucaccaaguggau

SEQ ID NO: 859656 - RNA, 19 nt, Homo sapiens
ugucaccaguuuaugaauc

SEQ ID NO: 859657 - RNA, 19 nt, Homo sapiens
gcugcuagacuccuaucuu

SEQ ID NO: 859658 - RNA, 19 nt, Homo sapiens
gggcugaccgugucucucu

SEQ ID NO: 859659 - RNA, 19 nt, Homo sapiens
uuucagacccucauuccuu

SEQ ID NO: 859660 - RNA, 19 nt, Homo sapiens
cagagauguugagaauguu

SEQ ID NO: 859661 - RNA, 19 nt, Homo sapiens
caucaaacugaacagaaga

SEQ ID NO: 859662 - RNA, 19 nt, Homo sapiens
gggaaggagaggugucugu

SEQ ID NO: 859663 - RNA, 19 nt, Homo sapiens
ccagaaauaaacugagaag

SEQ ID NO: 859664 - RNA, 19 nt, Homo sapiens
ugaacccugggaacaauuu

SEQ ID NO: 859665 - RNA, 19 nt, Homo sapiens
gcagcagccgcaucaucaa

SEQ ID NO: 859666 - RNA, 19 nt, Homo sapiens
aauaaacugagaaguggaa

SEQ ID NO: 859667 - RNA, 19 nt, Homo sapiens
gaacaauuuccaaaacugu

SEQ ID NO: 859668 - RNA, 19 nt, Homo sapiens
ucugcaaguucaccaagug

SEQ ID NO: 859669 - RNA, 19 nt, Homo sapiens
agaauucgucccacuaaag

SEQ ID NO: 859670 - RNA, 19 nt, Homo sapiens
gcucaucaaacugaacaga

SEQ ID NO: 859671 - RNA, 19 nt, Homo sapiens
aauaucagcgugcuaaguc

SEQ ID NO: 859672 - RNA, 19 nt, Homo sapiens
ggugcucugugcucugauc

SEQ ID NO: 859673 - RNA, 19 nt, Homo sapiens
ugggugcucugugcucuga

SEQ ID NO: 859674 - RNA, 19 nt, Homo sapiens
gucaccaguuuaugaaucu

SEQ ID NO: 859675 - RNA, 19 nt, Homo sapiens
gaugcuuacccgagacaga

SEQ ID NO: 859676 - RNA, 19 nt, Homo sapiens
uugaauaucagcgugcuaa

SEQ ID NO: 859677 - RNA, 19 nt, Homo sapiens
agauagaugacaccauguu

SEQ ID NO: 859678 - RNA, 19 nt, Homo sapiens
gauuacaucugguauucua

SEQ ID NO: 859679 - RNA, 19 nt, Homo sapiens
cagaagaggucuacaaaca

SEQ ID NO: 859680 - RNA, 19 nt, Homo sapiens
ggaaacaaauaggauaaga

SEQ ID NO: 859681 - RNA, 19 nt, Homo sapiens
ggaaguuucuaucauuuca

SEQ ID NO: 859682 - RNA, 19 nt, Homo sapiens
gcacucaaaugggaagaaa

SEQ ID NO: 859683 - RNA, 19 nt, Homo sapiens
ggacuuucauaaauacuug

SEQ ID NO: 859684 - RNA, 19 nt, Homo sapiens
gaagaaaggaaaugucuca

SEQ ID NO: 859685 - RNA, 19 nt, Homo sapiens
gaagaggucuacaaacacu

SEQ ID NO: 859686 - RNA, 19 nt, Homo sapiens
gcugugaccuccuucagaa

SEQ ID NO: 859687 - RNA, 19 nt, Homo sapiens
gaggaaggauagaaacaug

SEQ ID NO: 859688 - RNA, 19 nt, Homo sapiens
cuaccagccugauauauug

SEQ ID NO: 859689 - RNA, 19 nt, Homo sapiens
ugacagccaugacauugaa

SEQ ID NO: 859690 - RNA, 19 nt, Homo sapiens
ggaaucugauggacuuuca

SEQ ID NO: 859691 - RNA, 19 nt, Homo sapiens
gguacaagcagacucuaua

SEQ ID NO: 859692 - RNA, 19 nt, Homo sapiens
caaauaggauaagacaaug

SEQ ID NO: 859693 - RNA, 19 nt, Homo sapiens
ugaggaaucugauggacuu

SEQ ID NO: 859694 - RNA, 19 nt, Homo sapiens
caacagaagaggucuacaa

SEQ ID NO: 859695 - RNA, 19 nt, Homo sapiens
gugugugacuucagcuuua

SEQ ID NO: 859696 - RNA, 19 nt, Homo sapiens
gauagaaacaugggaaguu

SEQ ID NO: 859697 - RNA, 19 nt, Homo sapiens
caaaugggaagaaaggaaa

SEQ ID NO: 859698 - RNA, 19 nt, Homo sapiens
ccaccugucucuagugugu

SEQ ID NO: 859699 - RNA, 19 nt, Homo sapiens
ggaguacaguggccugauc

SEQ ID NO: 859700 - RNA, 19 nt, Homo sapiens
gaggacagauugcccuagu

SEQ ID NO: 859701 - RNA, 19 nt, Homo sapiens
gauggacuuucauaaauac

SEQ ID NO: 859702 - RNA, 19 nt, Homo sapiens
cugauggacuuucauaaau

SEQ ID NO: 859703 - RNA, 19 nt, Homo sapiens
gucaacagugccaauauua

SEQ ID NO: 859704 - RNA, 19 nt, Homo sapiens
ugggaaguuucuaucauuu

SEQ ID NO: 859705 - RNA, 19 nt, Homo sapiens
ucaggaaacaaauaggaua

SEQ ID NO: 859706 - RNA, 19 nt, Homo sapiens
caucugguauucuaaacau

SEQ ID NO: 859707 - RNA, 19 nt, Homo sapiens
ggagucaggccgacaguuc

SEQ ID NO: 859708 - RNA, 19 nt, Homo sapiens
agucaacagugccaauauu

SEQ ID NO: 859709 - RNA, 19 nt, Homo sapiens
acacaacaauggaccagau

SEQ ID NO: 859710 - RNA, 19 nt, Homo sapiens
gaccaccugucucuagugu

SEQ ID NO: 859711 - RNA, 19 nt, Homo sapiens
caggaaacaaauaggauaa

SEQ ID NO: 859712 - RNA, 19 nt, Homo sapiens
gguuaccuuccuucaauua

SEQ ID NO: 859713 - RNA, 19 nt, Homo sapiens
ggacagauugcccuaguac

SEQ ID NO: 859714 - RNA, 19 nt, Homo sapiens
uggauuacaucugguauuc

SEQ ID NO: 859715 - RNA, 19 nt, Homo sapiens
gauucaagcuagucaacag

SEQ ID NO: 859716 - RNA, 19 nt, Homo sapiens
agaugguugugccuuauuu

SEQ ID NO: 859717 - RNA, 19 nt, Homo sapiens
ccagaugguugugccuuau

SEQ ID NO: 859718 - RNA, 19 nt, Homo sapiens
gcccauugauccuaaagag

SEQ ID NO: 859719 - RNA, 19 nt, Homo sapiens
caacagugccaauauuagg

SEQ ID NO: 859720 - RNA, 19 nt, Homo sapiens
guacaagcagacucuauag

SEQ ID NO: 859721 - RNA, 19 nt, Homo sapiens
ccuaccagccugauauauu

SEQ ID NO: 859722 - RNA, 19 nt, Homo sapiens
caugggaaguuucuaucau

SEQ ID NO: 859723 - RNA, 19 nt, Homo sapiens
ucugauggacuuucauaaa

SEQ ID NO: 859724 - RNA, 19 nt, Homo sapiens
acaagcagacucuauagug

SEQ ID NO: 859725 - RNA, 19 nt, Homo sapiens
gagccaagauuccccuuau

SEQ ID NO: 859726 - RNA, 19 nt, Homo sapiens
ucaguagacuaggcuauca

SEQ ID NO: 859727 - RNA, 19 nt, Homo sapiens
ucaccacgcccagcuaauu

SEQ ID NO: 859728 - RNA, 19 nt, Homo sapiens
cacagacccuggagugcaa

SEQ ID NO: 859729 - RNA, 19 nt, Homo sapiens
gggaagaaaggaaaugucu

SEQ ID NO: 859730 - RNA, 19 nt, Homo sapiens
ucaaaugggaagaaaggaa

SEQ ID NO: 859731 - RNA, 19 nt, Homo sapiens
gaaacaaauaggauaagac

SEQ ID NO: 859732 - RNA, 19 nt, Homo sapiens
ggagcccauugauccuaaa

SEQ ID NO: 859733 - RNA, 19 nt, Homo sapiens
cccaaacccuggucaccuu

SEQ ID NO: 859734 - RNA, 19 nt, Homo sapiens
gaacauccucgcccaagcu

SEQ ID NO: 859735 - RNA, 19 nt, Homo sapiens
gagcaucuggagcccauug

SEQ ID NO: 859736 - RNA, 19 nt, Homo sapiens
gaaaugucucauccuggaa

SEQ ID NO: 859737 - RNA, 19 nt, Homo sapiens
gagaaggcaaagacaacuu

SEQ ID NO: 859738 - RNA, 19 nt, Homo sapiens
ucaggguuaugcaauggaa

SEQ ID NO: 859739 - RNA, 19 nt, Homo sapiens
caccacgcccagcuaauuu

SEQ ID NO: 859740 - RNA, 19 nt, Homo sapiens
cagagcaacugggacaaca

SEQ ID NO: 859741 - RNA, 19 nt, Homo sapiens
aaucugauggacuuucaua

SEQ ID NO: 859742 - RNA, 19 nt, Homo sapiens
augggaaguuucuaucauu

SEQ ID NO: 859743 - RNA, 19 nt, Homo sapiens
gccagaggaaggauagaaa

SEQ ID NO: 859744 - RNA, 19 nt, Homo sapiens
cuccugaccuugaaucaca

SEQ ID NO: 859745 - RNA, 19 nt, Homo sapiens
ucgaucugcucacugaaga

SEQ ID NO: 859746 - RNA, 19 nt, Homo sapiens
ggcacacccuggauuacau

SEQ ID NO: 859747 - RNA, 19 nt, Homo sapiens
gauguagaacacaacaaug

SEQ ID NO: 859748 - RNA, 19 nt, Homo sapiens
gcucacugaagaacagauu

SEQ ID NO: 859749 - RNA, 19 nt, Homo sapiens
cuaucaggguuaugcaaug

SEQ ID NO: 859750 - RNA, 19 nt, Homo sapiens
caaugcagagccaacagaa

SEQ ID NO: 859751 - RNA, 19 nt, Homo sapiens
ccaaccagguggccauugc

SEQ ID NO: 859752 - RNA, 19 nt, Homo sapiens
uggagcccauugauccuaa

SEQ ID NO: 859753 - RNA, 19 nt, Homo sapiens
ggccuaccagccugauaua

SEQ ID NO: 859754 - RNA, 19 nt, Homo sapiens
cagcuuuacugaggaaucu

SEQ ID NO: 859755 - RNA, 19 nt, Homo sapiens
uuaccuuccuucaauuauc

SEQ ID NO: 859756 - RNA, 19 nt, Homo sapiens
aaggucagcucucgaucug

SEQ ID NO: 859757 - RNA, 19 nt, Homo sapiens
aacagaagaggucuacaaa

SEQ ID NO: 859758 - RNA, 19 nt, Homo sapiens
gcaucgcuguuacccaucu

SEQ ID NO: 859759 - RNA, 19 nt, Homo sapiens
ccuaguacccacccaccua

SEQ ID NO: 859760 - RNA, 19 nt, Homo sapiens
ccuccagccucaaccugaa

SEQ ID NO: 859761 - RNA, 19 nt, Homo sapiens
gggaaguuucuaucauuuc

SEQ ID NO: 859762 - RNA, 19 nt, Homo sapiens
gacaaugccagaggaagga

SEQ ID NO: 859763 - RNA, 19 nt, Homo sapiens
cccagcacccagaguauuu

SEQ ID NO: 859764 - RNA, 19 nt, Homo sapiens
cuagucaacagugccaaua

SEQ ID NO: 859765 - RNA, 19 nt, Homo sapiens
cuggucaccuugucuagau

SEQ ID NO: 859766 - RNA, 19 nt, Homo sapiens
uaagacaaugccagaggaa

SEQ ID NO: 859767 - RNA, 19 nt, Homo sapiens
ccagagggauuuuguggau

SEQ ID NO: 859768 - RNA, 19 nt, Homo sapiens
uagccaggauggucucgau

SEQ ID NO: 859769 - RNA, 19 nt, Homo sapiens
agaggucuacaaacacuuu

SEQ ID NO: 859770 - RNA, 19 nt, Homo sapiens
aagaaauccuggccuacca

SEQ ID NO: 859771 - RNA, 19 nt, Homo sapiens
augcagagccaacagaaga

SEQ ID NO: 859772 - RNA, 19 nt, Homo sapiens
uuuaaucacaggagucuau

SEQ ID NO: 859773 - RNA, 19 nt, Homo sapiens
uaucaggguuaugcaaugg

SEQ ID NO: 859774 - RNA, 19 nt, Homo sapiens
gcacacccuggauuacauc

SEQ ID NO: 859775 - RNA, 19 nt, Homo sapiens
ccacuccucaguagacuag

SEQ ID NO: 859776 - RNA, 19 nt, Homo sapiens
aggacagauugcccuagua

SEQ ID NO: 859777 - RNA, 19 nt, Homo sapiens
ggccugaucucggcucacu

SEQ ID NO: 859778 - RNA, 19 nt, Homo sapiens
gaacuacccuaacucguau

SEQ ID NO: 859779 - RNA, 19 nt, Homo sapiens
caaaugccaugucacaauu

SEQ ID NO: 859780 - RNA, 19 nt, Homo sapiens
gcaaucgacuguuaaagug

SEQ ID NO: 859781 - RNA, 19 nt, Homo sapiens
gugcuggagugaauauuua

SEQ ID NO: 859782 - RNA, 19 nt, Homo sapiens
cgagauauuucccaagauu

SEQ ID NO: 859783 - RNA, 19 nt, Homo sapiens
ccacacucauguacacuua

SEQ ID NO: 859784 - RNA, 19 nt, Homo sapiens
aaagguagauaaaccauug

SEQ ID NO: 859785 - RNA, 19 nt, Homo sapiens
aagaauaaccaguccauua

SEQ ID NO: 859786 - RNA, 19 nt, Homo sapiens
acacuuaugucuucgcuuu

SEQ ID NO: 859787 - RNA, 19 nt, Homo sapiens
guaagugguuaaagaaaug

SEQ ID NO: 859788 - RNA, 19 nt, Homo sapiens
ggauaugccuugucagauc

SEQ ID NO: 859789 - RNA, 19 nt, Homo sapiens
ccaagcagaucuagagaau

SEQ ID NO: 859790 - RNA, 19 nt, Homo sapiens
ugucagaucugcuacuuga

SEQ ID NO: 859791 - RNA, 19 nt, Homo sapiens
gaucacagauucaaaaguu

SEQ ID NO: 859792 - RNA, 19 nt, Homo sapiens
gagaauggcccugcauaaa

SEQ ID NO: 859793 - RNA, 19 nt, Homo sapiens
agagugcaaucgacuguua

SEQ ID NO: 859794 - RNA, 19 nt, Homo sapiens
ccaauauccugaugcuaaa

SEQ ID NO: 859795 - RNA, 19 nt, Homo sapiens
gaaggauggugguuguaau

SEQ ID NO: 859796 - RNA, 19 nt, Homo sapiens
ucaacgaggucauccagaa

SEQ ID NO: 859797 - RNA, 19 nt, Homo sapiens
gaagaaggcaguugauguc

SEQ ID NO: 859798 - RNA, 19 nt, Homo sapiens
ggauauaaagcagaaagua

SEQ ID NO: 859799 - RNA, 19 nt, Homo sapiens
gaacacgccagaugaauac

SEQ ID NO: 859800 - RNA, 19 nt, Homo sapiens
gagaagcucuuugcugagu

SEQ ID NO: 859801 - RNA, 19 nt, Homo sapiens
gcaacuaucacaagaauac

SEQ ID NO: 859802 - RNA, 19 nt, Homo sapiens
cagcaacuaucacaagaau

SEQ ID NO: 859803 - RNA, 19 nt, Homo sapiens
gagagucgacgaaggguuu

SEQ ID NO: 859804 - RNA, 19 nt, Homo sapiens
cauguacacuuaugucuuc

SEQ ID NO: 859805 - RNA, 19 nt, Homo sapiens
ugaacuacccuaacucgua

SEQ ID NO: 859806 - RNA, 19 nt, Homo sapiens
cgaacacgccagaugaaua

SEQ ID NO: 859807 - RNA, 19 nt, Homo sapiens
ccacuucaauugggauaaa

SEQ ID NO: 859808 - RNA, 19 nt, Homo sapiens
aagauucucugcaggauau

SEQ ID NO: 859809 - RNA, 19 nt, Homo sapiens
acaaaggaaugucccaaau

SEQ ID NO: 859810 - RNA, 19 nt, Homo sapiens
aaagagaagcuaauggaaa

SEQ ID NO: 859811 - RNA, 19 nt, Homo sapiens
uaaccaguccauuaucuuu

SEQ ID NO: 859812 - RNA, 19 nt, Homo sapiens
gaggugcaguuccugaaga

SEQ ID NO: 859813 - RNA, 19 nt, Homo sapiens
cacaacauguccuggauug

SEQ ID NO: 859814 - RNA, 19 nt, Homo sapiens
aaacaaacacaaacaagga

SEQ ID NO: 859815 - RNA, 19 nt, Homo sapiens
gaauaaccaagcagaucua

SEQ ID NO: 859816 - RNA, 19 nt, Homo sapiens
agagguaccuguucuacug

SEQ ID NO: 859817 - RNA, 19 nt, Homo sapiens
gcaaaggcagcaagagaug

SEQ ID NO: 859818 - RNA, 19 nt, Homo sapiens
gaagcucuuugcugagugu

SEQ ID NO: 859819 - RNA, 19 nt, Homo sapiens
aagagaagcuaauggaaag

SEQ ID NO: 859820 - RNA, 19 nt, Homo sapiens
ggaguacauugaggacuga

SEQ ID NO: 859821 - RNA, 19 nt, Homo sapiens
uaaccagaauuguaaagca

SEQ ID NO: 859822 - RNA, 19 nt, Homo sapiens
gauggugguuguaaucaca

SEQ ID NO: 859823 - RNA, 19 nt, Homo sapiens
ugagaaggauggugguugu

SEQ ID NO: 859824 - RNA, 19 nt, Homo sapiens
gaauggcccugcauaaaau

SEQ ID NO: 859825 - RNA, 19 nt, Homo sapiens
caaaggaaugucccaaaug

SEQ ID NO: 859826 - RNA, 19 nt, Homo sapiens
uguaguaccagaauuguuu

SEQ ID NO: 859827 - RNA, 19 nt, Homo sapiens
gcagaaaguacaagacaag

SEQ ID NO: 859828 - RNA, 19 nt, Homo sapiens
gagcagauucuacaacaca

SEQ ID NO: 859829 - RNA, 19 nt, Homo sapiens
ccaaaugccaugucacaau

SEQ ID NO: 859830 - RNA, 19 nt, Homo sapiens
aaaggaaugucccaaaugc

SEQ ID NO: 859831 - RNA, 19 nt, Homo sapiens
uacaagacaaguacagaua

SEQ ID NO: 859832 - RNA, 19 nt, Homo sapiens
aagcagaucuagagaaugc

SEQ ID NO: 859833 - RNA, 19 nt, Homo sapiens
uccaauauccugaugcuaa

SEQ ID NO: 859834 - RNA, 19 nt, Homo sapiens
ggacgagggcuacaacuac

SEQ ID NO: 859835 - RNA, 19 nt, Homo sapiens
cacaggauaugccuuguca

SEQ ID NO: 859836 - RNA, 19 nt, Homo sapiens
ggacgaugauacccuggau

SEQ ID NO: 859837 - RNA, 19 nt, Homo sapiens
uaaugaggaugaugcaaag

SEQ ID NO: 859838 - RNA, 19 nt, Homo sapiens
uacccuaacucguauuuca

SEQ ID NO: 859839 - RNA, 19 nt, Homo sapiens
gagaauaaccaagcagauc

SEQ ID NO: 859840 - RNA, 19 nt, Homo sapiens
gcacaacauguccuggauu

SEQ ID NO: 859841 - RNA, 19 nt, Homo sapiens
gaauuguaaagcagaguuu

SEQ ID NO: 859842 - RNA, 19 nt, Homo sapiens
gauaugccuugucagaucu

SEQ ID NO: 859843 - RNA, 19 nt, Homo sapiens
ucacaagaauacuccuuag

SEQ ID NO: 859844 - RNA, 19 nt, Homo sapiens
guacauugaggacugagaa

SEQ ID NO: 859845 - RNA, 19 nt, Homo sapiens
uaaccaagcagaucuagag

SEQ ID NO: 859846 - RNA, 19 nt, Homo sapiens
acagugaaaccuccaauug

SEQ ID NO: 859847 - RNA, 19 nt, Homo sapiens
guggaugacaacacaguua

SEQ ID NO: 859848 - RNA, 19 nt, Homo sapiens
ugagaauggcccugcauaa

SEQ ID NO: 859849 - RNA, 19 nt, Homo sapiens
gauauaaagcagaaaguac

SEQ ID NO: 859850 - RNA, 19 nt, Homo sapiens
ggauugcagccaacacaaa

SEQ ID NO: 859851 - RNA, 19 nt, Homo sapiens
ggauaaagagaagcuaaug

SEQ ID NO: 859852 - RNA, 19 nt, Homo sapiens
caauugggauaaagagaag

SEQ ID NO: 859853 - RNA, 19 nt, Homo sapiens
aacgagauauuucccaaga

SEQ ID NO: 859854 - RNA, 19 nt, Homo sapiens
uacaacacaugguggaaug

SEQ ID NO: 859855 - RNA, 19 nt, Homo sapiens
ccuguucgcugcaaaugug

SEQ ID NO: 859856 - RNA, 19 nt, Homo sapiens
uaaagagaagcuaauggaa

SEQ ID NO: 859857 - RNA, 19 nt, Homo sapiens
gaauacuccuuagccacuu

SEQ ID NO: 859858 - RNA, 19 nt, Homo sapiens
ucaauugggauaaagagaa

SEQ ID NO: 859859 - RNA, 19 nt, Homo sapiens
ccgagcagauucuacaaca

SEQ ID NO: 859860 - RNA, 19 nt, Homo sapiens
ugaagaaggcaguugaugu

SEQ ID NO: 859861 - RNA, 19 nt, Homo sapiens
ugucguaaccagaauugua

SEQ ID NO: 859862 - RNA, 19 nt, Homo sapiens
ccagauugccaccauguug

SEQ ID NO: 859863 - RNA, 19 nt, Homo sapiens
agaaaguacaagacaagua

SEQ ID NO: 859864 - RNA, 19 nt, Homo sapiens
uaaagcagaaaguacaaga

SEQ ID NO: 859865 - RNA, 19 nt, Homo sapiens
caagauucucugcaggaua

SEQ ID NO: 859866 - RNA, 19 nt, Homo sapiens
acacucauguacacuuaug

SEQ ID NO: 859867 - RNA, 19 nt, Homo sapiens
cuacuguaaucgcuauaug

SEQ ID NO: 859868 - RNA, 19 nt, Homo sapiens
gguaccuguucuacuguaa

SEQ ID NO: 859869 - RNA, 19 nt, Homo sapiens
ggagaaaauuggcaugauc

SEQ ID NO: 859870 - RNA, 19 nt, Homo sapiens
caggauaugccuugucaga

SEQ ID NO: 859871 - RNA, 19 nt, Homo sapiens
agaagcuaauggaaaggua

SEQ ID NO: 859872 - RNA, 19 nt, Homo sapiens
agagugcucaugcaauuaa

SEQ ID NO: 859873 - RNA, 19 nt, Homo sapiens
gucguaaccagaauuguaa

SEQ ID NO: 859874 - RNA, 19 nt, Homo sapiens
ggauugaggugcaguuccu

SEQ ID NO: 859875 - RNA, 19 nt, Homo sapiens
aaagugugaugaugacagu

SEQ ID NO: 859876 - RNA, 19 nt, Homo sapiens
cagaauccagcaacuauca

SEQ ID NO: 859877 - RNA, 19 nt, Homo sapiens
guucuacuguaaucgcuau

SEQ ID NO: 859878 - RNA, 19 nt, Homo sapiens
ggagaaagcuaaagugauu

SEQ ID NO: 859879 - RNA, 19 nt, Homo sapiens
ggagggagcuguagaagau

SEQ ID NO: 859880 - RNA, 19 nt, Homo sapiens
caagacugaucaauacuua

SEQ ID NO: 859881 - RNA, 19 nt, Homo sapiens
ccaaagaguccauuaauuu

SEQ ID NO: 859882 - RNA, 19 nt, Homo sapiens
gaagaccacucaacgaaga

SEQ ID NO: 859883 - RNA, 19 nt, Homo sapiens
gaaagagcuuguuggauga

SEQ ID NO: 859884 - RNA, 19 nt, Homo sapiens
aagaucagcugccauguua

SEQ ID NO: 859885 - RNA, 19 nt, Homo sapiens
ggaaguagaugccuuggau

SEQ ID NO: 859886 - RNA, 19 nt, Homo sapiens
guagagagcuggcugaaag

SEQ ID NO: 859887 - RNA, 19 nt, Homo sapiens
gagagagaguuauagcuuu

SEQ ID NO: 859888 - RNA, 19 nt, Homo sapiens
gagcucagauugauaggaa

SEQ ID NO: 859889 - RNA, 19 nt, Homo sapiens
ggucagaugucauguaauc

SEQ ID NO: 859890 - RNA, 19 nt, Homo sapiens
gaaccauaccgcauguuua

SEQ ID NO: 859891 - RNA, 19 nt, Homo sapiens
gccaaagaguccauuaauu

SEQ ID NO: 859892 - RNA, 19 nt, Homo sapiens
ugucagagcucucgauguu

SEQ ID NO: 859893 - RNA, 19 nt, Homo sapiens
ccagaggcuucuauaagua

SEQ ID NO: 859894 - RNA, 19 nt, Homo sapiens
gagagacagugaaccuaaa

SEQ ID NO: 859895 - RNA, 19 nt, Homo sapiens
uggaugagauuguccuuaa

SEQ ID NO: 859896 - RNA, 19 nt, Homo sapiens
gcagacagacuucaagaga

SEQ ID NO: 859897 - RNA, 19 nt, Homo sapiens
ggacucugcuccucacuca

SEQ ID NO: 859898 - RNA, 19 nt, Homo sapiens
uaaagggaguucagcaaga

SEQ ID NO: 859899 - RNA, 19 nt, Homo sapiens
gcagauuugccuacucaua

SEQ ID NO: 859900 - RNA, 19 nt, Homo sapiens
gaagacagucggcuaugaa

SEQ ID NO: 859901 - RNA, 19 nt, Homo sapiens
cauccaagacugaucaaua

SEQ ID NO: 859902 - RNA, 19 nt, Homo sapiens
gaagaucagcugccauguu

SEQ ID NO: 859903 - RNA, 19 nt, Homo sapiens
ccaugaaguucgagagaaa

SEQ ID NO: 859904 - RNA, 19 nt, Homo sapiens
gcuacgguguucaguauga

SEQ ID NO: 859905 - RNA, 19 nt, Homo sapiens
ccacagggguuaucuauga

SEQ ID NO: 859906 - RNA, 19 nt, Homo sapiens
aaacucaacaugcagauuu

SEQ ID NO: 859907 - RNA, 19 nt, Homo sapiens
agacagacuucaagagaga

SEQ ID NO: 859908 - RNA, 19 nt, Homo sapiens
gaacagaagguuacauagg

SEQ ID NO: 859909 - RNA, 19 nt, Homo sapiens
ggauuaagccagaagauca

SEQ ID NO: 859910 - RNA, 19 nt, Homo sapiens
gacagucggcuaugaauga

SEQ ID NO: 859911 - RNA, 19 nt, Homo sapiens
agaagccacuuaugaauca

SEQ ID NO: 859912 - RNA, 19 nt, Homo sapiens
aaauagaagccacuuauga

SEQ ID NO: 859913 - RNA, 19 nt, Homo sapiens
guuggaaccugaaggaaug

SEQ ID NO: 859914 - RNA, 19 nt, Homo sapiens
ggaucagccuucuauagga

SEQ ID NO: 859915 - RNA, 19 nt, Homo sapiens
gaacaugcagaaagaaauc

SEQ ID NO: 859916 - RNA, 19 nt, Homo sapiens
caucggaaagggacauuua

SEQ ID NO: 859917 - RNA, 19 nt, Homo sapiens
gaauaaaacucaacaugca

SEQ ID NO: 859918 - RNA, 19 nt, Homo sapiens
aaacugaaccuggaauaaa

SEQ ID NO: 859919 - RNA, 19 nt, Homo sapiens
ccagagcccuugaagaagu

SEQ ID NO: 859920 - RNA, 19 nt, Homo sapiens
caaagaguccauuaauuuc

SEQ ID NO: 859921 - RNA, 19 nt, Homo sapiens
ccuauuaagucuaccaaau

SEQ ID NO: 859922 - RNA, 19 nt, Homo sapiens
cgaagacagucggcuauga

SEQ ID NO: 859923 - RNA, 19 nt, Homo sapiens
gaaaauagaagccacuuau

SEQ ID NO: 859924 - RNA, 19 nt, Homo sapiens
caacaacgauaugaaagag

SEQ ID NO: 859925 - RNA, 19 nt, Homo sapiens
gaucagccuucuauaggau

SEQ ID NO: 859926 - RNA, 19 nt, Homo sapiens
gaaggcauuucuguguuga

SEQ ID NO: 859927 - RNA, 19 nt, Homo sapiens
uuacauaggagucuugauu

SEQ ID NO: 859928 - RNA, 19 nt, Homo sapiens
ggaaucaacgccagucuuc

SEQ ID NO: 859929 - RNA, 19 nt, Homo sapiens
auaggaaacucuacaaaca

SEQ ID NO: 859930 - RNA, 19 nt, Homo sapiens
ucaaagagagagacaguga

SEQ ID NO: 859931 - RNA, 19 nt, Homo sapiens
ucgauguucugaaguauga

SEQ ID NO: 859932 - RNA, 19 nt, Homo sapiens
cagcugaguuacaagagaa

SEQ ID NO: 859933 - RNA, 19 nt, Homo sapiens
gauacugucccuccauuga

SEQ ID NO: 859934 - RNA, 19 nt, Homo sapiens
cgagagaaacuacauuuua

SEQ ID NO: 859935 - RNA, 19 nt, Homo sapiens
aacagaagguuacauagga

SEQ ID NO: 859936 - RNA, 19 nt, Homo sapiens
gcuaccagcugaguuacaa

SEQ ID NO: 859937 - RNA, 19 nt, Homo sapiens
cgugucagcuucaaaguca

SEQ ID NO: 859938 - RNA, 19 nt, Homo sapiens
aaugagacaguauggauua

SEQ ID NO: 859939 - RNA, 19 nt, Homo sapiens
gcauccagcaggacguuua

SEQ ID NO: 859940 - RNA, 19 nt, Homo sapiens
ucggucagaugucauguaa

SEQ ID NO: 859941 - RNA, 19 nt, Homo sapiens
gugcaguguucaucaaaga

SEQ ID NO: 859942 - RNA, 19 nt, Homo sapiens
gagugggacagaaauuaua

SEQ ID NO: 859943 - RNA, 19 nt, Homo sapiens
agaugaagcucuccaacug

SEQ ID NO: 859944 - RNA, 19 nt, Homo sapiens
gaugagauuguccuuaaga

SEQ ID NO: 859945 - RNA, 19 nt, Homo sapiens
aaacagaacaugcagaaag

SEQ ID NO: 859946 - RNA, 19 nt, Homo sapiens
gagagaaacuacauuuuag

SEQ ID NO: 859947 - RNA, 19 nt, Homo sapiens
gauaugaaagagcuuguug

SEQ ID NO: 859948 - RNA, 19 nt, Homo sapiens
ccgaacagaagguuacaua

SEQ ID NO: 859949 - RNA, 19 nt, Homo sapiens
caucagaggcuuggagaaa

SEQ ID NO: 859950 - RNA, 19 nt, Homo sapiens
gacgcuaccagcugaguua

SEQ ID NO: 859951 - RNA, 19 nt, Homo sapiens
cagcugccauguuacuuga

SEQ ID NO: 859952 - RNA, 19 nt, Homo sapiens
acauaggagucuugauuga

SEQ ID NO: 859953 - RNA, 19 nt, Homo sapiens
ggauggaagcacaguauau

SEQ ID NO: 859954 - RNA, 19 nt, Homo sapiens
aacagaacaugcagaaaga

SEQ ID NO: 859955 - RNA, 19 nt, Homo sapiens
uaucagggaugugucuuug

SEQ ID NO: 859956 - RNA, 19 nt, Homo sapiens
gaccuagauuauuugacua

SEQ ID NO: 859957 - RNA, 19 nt, Homo sapiens
gaaccugaaggaauggauu

SEQ ID NO: 859958 - RNA, 19 nt, Homo sapiens
gacaauccauccauaccau

SEQ ID NO: 859959 - RNA, 19 nt, Homo sapiens
gugaagaccacucaacgaa

SEQ ID NO: 859960 - RNA, 19 nt, Homo sapiens
caucaucaaucugcugaga

SEQ ID NO: 859961 - RNA, 19 nt, Homo sapiens
cagagcccuugaagaagua

SEQ ID NO: 859962 - RNA, 19 nt, Homo sapiens
ugaggaaguugacauggau

SEQ ID NO: 859963 - RNA, 19 nt, Homo sapiens
cccagaggcuucuauaagu

SEQ ID NO: 859964 - RNA, 19 nt, Homo sapiens
cgaguagaguuccguuugu

SEQ ID NO: 859965 - RNA, 19 nt, Homo sapiens
uccauaccauucagcuuua

SEQ ID NO: 859966 - RNA, 19 nt, Homo sapiens
ugagaggcaugauuguaau

SEQ ID NO: 859967 - RNA, 19 nt, Homo sapiens
agucugguguacauuauaa

SEQ ID NO: 859968 - RNA, 19 nt, Homo sapiens
aauagaagccacuuaugaa

SEQ ID NO: 859969 - RNA, 19 nt, Homo sapiens
guucaacgacucuucuuug

SEQ ID NO: 859970 - RNA, 19 nt, Homo sapiens
gauggaagcacaguauaug

SEQ ID NO: 859971 - RNA, 19 nt, Homo sapiens
uugaauacaccacugcuua

SEQ ID NO: 859972 - RNA, 19 nt, Homo sapiens
agagagaguuauagcuuuc

SEQ ID NO: 859973 - RNA, 19 nt, Homo sapiens
agaccuagauuauuugacu

SEQ ID NO: 859974 - RNA, 19 nt, Homo sapiens
ucagagcucucgauguucu

SEQ ID NO: 859975 - RNA, 19 nt, Homo sapiens
ccaacaacgauaugaaaga

SEQ ID NO: 859976 - RNA, 19 nt, Homo sapiens
auaggagucuugauugaug

SEQ ID NO: 859977 - RNA, 19 nt, Homo sapiens
auacaccacugcuuacugu

SEQ ID NO: 859978 - RNA, 19 nt, Homo sapiens
ggagaaagcuaaagugauu

SEQ ID NO: 859979 - RNA, 19 nt, Homo sapiens
ggagggagcuguagaagau

SEQ ID NO: 859980 - RNA, 19 nt, Homo sapiens
caagacugaucaauacuua

SEQ ID NO: 859981 - RNA, 19 nt, Homo sapiens
ccaaagaguccauuaauuu

SEQ ID NO: 859982 - RNA, 19 nt, Homo sapiens
gaagaccacucaacgaaga

SEQ ID NO: 859983 - RNA, 19 nt, Homo sapiens
gaaagagcuuguuggauga

SEQ ID NO: 859984 - RNA, 19 nt, Homo sapiens
aagaucagcugccauguua

SEQ ID NO: 859985 - RNA, 19 nt, Homo sapiens
ggaaguagaugccuuggau

SEQ ID NO: 859986 - RNA, 19 nt, Homo sapiens
guagagagcuggcugaaag

SEQ ID NO: 859987 - RNA, 19 nt, Homo sapiens
gagagagaguuauagcuuu

SEQ ID NO: 859988 - RNA, 19 nt, Homo sapiens
gagcucagauugauaggaa

SEQ ID NO: 859989 - RNA, 19 nt, Homo sapiens
uaucaaagcccuuaaauuc

SEQ ID NO: 859990 - RNA, 19 nt, Homo sapiens
ggucagaugucauguaauc

SEQ ID NO: 859991 - RNA, 19 nt, Homo sapiens
gaaccauaccgcauguuua

SEQ ID NO: 859992 - RNA, 19 nt, Homo sapiens
gccaaagaguccauuaauu

SEQ ID NO: 859993 - RNA, 19 nt, Homo sapiens
ugucagagcucucgauguu

SEQ ID NO: 859994 - RNA, 19 nt, Homo sapiens
ccagaggcuucuauaagua

SEQ ID NO: 859995 - RNA, 19 nt, Homo sapiens
ucaccauuguuuccuauua

SEQ ID NO: 859996 - RNA, 19 nt, Homo sapiens
ggugaaaguugacagaaau

SEQ ID NO: 859997 - RNA, 19 nt, Homo sapiens
caguguggauggauacuua

SEQ ID NO: 859998 - RNA, 19 nt, Homo sapiens
gagagacagugaaccuaaa

SEQ ID NO: 859999 - RNA, 19 nt, Homo sapiens
uggaugagauuguccuuaa

SEQ ID NO: 860000 - RNA, 19 nt, Homo sapiens
gcagacagacuucaagaga

SEQ ID NO: 860001 - RNA, 19 nt, Homo sapiens
ggacucugcuccucacuca

SEQ ID NO: 860002 - RNA, 19 nt, Homo sapiens
uaaagggaguucagcaaga

SEQ ID NO: 860003 - RNA, 19 nt, Homo sapiens
gacuaaagacuugagauua

SEQ ID NO: 860004 - RNA, 19 nt, Homo sapiens
gcagauuugccuacucaua

SEQ ID NO: 860005 - RNA, 19 nt, Homo sapiens
gaagacagucggcuaugaa

SEQ ID NO: 860006 - RNA, 19 nt, Homo sapiens
cauccaagacugaucaaua

SEQ ID NO: 860007 - RNA, 19 nt, Homo sapiens
gaagaucagcugccauguu

SEQ ID NO: 860008 - RNA, 19 nt, Homo sapiens
ccaugaaguucgagagaaa

SEQ ID NO: 860009 - RNA, 19 nt, Homo sapiens
gcuacgguguucaguauga

SEQ ID NO: 860010 - RNA, 19 nt, Homo sapiens
ccacagggguuaucuauga

SEQ ID NO: 860011 - RNA, 19 nt, Homo sapiens
gaaauccucacugguaauu

SEQ ID NO: 860012 - RNA, 19 nt, Homo sapiens
aaacucaacaugcagauuu

SEQ ID NO: 860013 - RNA, 19 nt, Homo sapiens
agacagacuucaagagaga

SEQ ID NO: 860014 - RNA, 19 nt, Homo sapiens
gaacagaagguuacauagg

SEQ ID NO: 860015 - RNA, 19 nt, Homo sapiens
ggauuaagccagaagauca

SEQ ID NO: 860016 - RNA, 19 nt, Homo sapiens
ggagaauugaguaacguua

SEQ ID NO: 860017 - RNA, 19 nt, Homo sapiens
gggugaaaguugacagaaa

SEQ ID NO: 860018 - RNA, 19 nt, Homo sapiens
gacagucggcuaugaauga

SEQ ID NO: 860019 - RNA, 19 nt, Homo sapiens
agaagccacuuaugaauca

SEQ ID NO: 860020 - RNA, 19 nt, Homo sapiens
aaauagaagccacuuauga

SEQ ID NO: 860021 - RNA, 19 nt, Homo sapiens
guuggaaccugaaggaaug

SEQ ID NO: 860022 - RNA, 19 nt, Homo sapiens
ggaucagccuucuauagga

SEQ ID NO: 860023 - RNA, 19 nt, Homo sapiens
gaacaugcagaaagaaauc

SEQ ID NO: 860024 - RNA, 19 nt, Homo sapiens
caucggaaagggacauuua

SEQ ID NO: 860025 - RNA, 19 nt, Homo sapiens
gaauaaaacucaacaugca

SEQ ID NO: 860026 - RNA, 19 nt, Homo sapiens
aaacugaaccuggaauaaa

SEQ ID NO: 860027 - RNA, 19 nt, Homo sapiens
ccagagcccuugaagaagu

SEQ ID NO: 860028 - RNA, 19 nt, Homo sapiens
caaagaguccauuaauuuc

SEQ ID NO: 860029 - RNA, 19 nt, Homo sapiens
guggauggauacuuauuug

SEQ ID NO: 860030 - RNA, 19 nt, Homo sapiens
ucaaagcccuuaaauucuc

SEQ ID NO: 860031 - RNA, 19 nt, Homo sapiens
ccuauuaagucuaccaaau

SEQ ID NO: 860032 - RNA, 19 nt, Homo sapiens
cgaagacagucggcuauga

SEQ ID NO: 860033 - RNA, 19 nt, Homo sapiens
gaaaauagaagccacuuau

SEQ ID NO: 860034 - RNA, 19 nt, Homo sapiens
caacaacgauaugaaagag

SEQ ID NO: 860035 - RNA, 19 nt, Homo sapiens
gaucagccuucuauaggau

SEQ ID NO: 860036 - RNA, 19 nt, Homo sapiens
gaaggcauuucuguguuga

SEQ ID NO: 860037 - RNA, 19 nt, Homo sapiens
uuacauaggagucuugauu

SEQ ID NO: 860038 - RNA, 19 nt, Homo sapiens
ggaaucaacgccagucuuc

SEQ ID NO: 860039 - RNA, 19 nt, Homo sapiens
auaggaaacucuacaaaca

SEQ ID NO: 860040 - RNA, 19 nt, Homo sapiens
ucaaagagagagacaguga

SEQ ID NO: 860041 - RNA, 19 nt, Homo sapiens
ucgauguucugaaguauga

SEQ ID NO: 860042 - RNA, 19 nt, Homo sapiens
cagcugaguuacaagagaa

SEQ ID NO: 860043 - RNA, 19 nt, Homo sapiens
gauacugucccuccauuga

SEQ ID NO: 860044 - RNA, 19 nt, Homo sapiens
cgugucagcuucaaaguca

SEQ ID NO: 860045 - RNA, 19 nt, Homo sapiens
cgagagaaacuacauuuua

SEQ ID NO: 860046 - RNA, 19 nt, Homo sapiens
aacagaagguuacauagga

SEQ ID NO: 860047 - RNA, 19 nt, Homo sapiens
gcuaccagcugaguuacaa

SEQ ID NO: 860048 - RNA, 19 nt, Homo sapiens
aaugagacaguauggauua

SEQ ID NO: 860049 - RNA, 19 nt, Homo sapiens
gcauccagcaggacguuua

SEQ ID NO: 860050 - RNA, 19 nt, Homo sapiens
ucggucagaugucauguaa

SEQ ID NO: 860051 - RNA, 19 nt, Homo sapiens
gugcaguguucaucaaaga

SEQ ID NO: 860052 - RNA, 19 nt, Homo sapiens
gagugggacagaaauuaua

SEQ ID NO: 860053 - RNA, 19 nt, Homo sapiens
agaugaagcucuccaacug

SEQ ID NO: 860054 - RNA, 19 nt, Homo sapiens
gaucucggcucaccacaac

SEQ ID NO: 860055 - RNA, 19 nt, Homo sapiens
gaugagauuguccuuaaga

SEQ ID NO: 860056 - RNA, 19 nt, Homo sapiens
aaacagaacaugcagaaag

SEQ ID NO: 860057 - RNA, 19 nt, Homo sapiens
uauguagggugaaaguuga

SEQ ID NO: 860058 - RNA, 19 nt, Homo sapiens
gcuaggaagcaauaucaaa

SEQ ID NO: 860059 - RNA, 19 nt, Homo sapiens
gagagaaacuacauuuuag

SEQ ID NO: 860060 - RNA, 19 nt, Homo sapiens
gauaugaaagagcuuguug

SEQ ID NO: 860061 - RNA, 19 nt, Homo sapiens
ccgaacagaagguuacaua

SEQ ID NO: 860062 - RNA, 19 nt, Homo sapiens
caucagaggcuuggagaaa

SEQ ID NO: 860063 - RNA, 19 nt, Homo sapiens
gacgcuaccagcugaguua

SEQ ID NO: 860064 - RNA, 19 nt, Homo sapiens
cagcugccauguuacuuga

SEQ ID NO: 860065 - RNA, 19 nt, Homo sapiens
auacuuauuuggugaccua

SEQ ID NO: 860066 - RNA, 19 nt, Homo sapiens
acauaggagucuugauuga

SEQ ID NO: 860067 - RNA, 19 nt, Homo sapiens
ggauggaagcacaguauau

SEQ ID NO: 860068 - RNA, 19 nt, Homo sapiens
aacagaacaugcagaaaga

SEQ ID NO: 860069 - RNA, 19 nt, Homo sapiens
uaucagggaugugucuuug

SEQ ID NO: 860070 - RNA, 19 nt, Homo sapiens
gaccuagauuauuugacua

SEQ ID NO: 860071 - RNA, 19 nt, Homo sapiens
gaaccugaaggaauggauu

SEQ ID NO: 860072 - RNA, 19 nt, Homo sapiens
gacaauccauccauaccau

SEQ ID NO: 860073 - RNA, 19 nt, Homo sapiens
guauguagggugaaaguug

SEQ ID NO: 860074 - RNA, 19 nt, Homo sapiens
gugaagaccacucaacgaa

SEQ ID NO: 860075 - RNA, 19 nt, Homo sapiens
caucaucaaucugcugaga

SEQ ID NO: 860076 - RNA, 19 nt, Homo sapiens
cagagcccuugaagaagua

SEQ ID NO: 860077 - RNA, 19 nt, Homo sapiens
ugaggaaguugacauggau

SEQ ID NO: 860078 - RNA, 19 nt, Homo sapiens
gaauggguuuguaaaguuu

SEQ ID NO: 860079 - RNA, 19 nt, Homo sapiens
caacaucccugcugacauc

SEQ ID NO: 860080 - RNA, 19 nt, Homo sapiens
guauaaaggucauagugaa

SEQ ID NO: 860081 - RNA, 19 nt, Homo sapiens
ugaagcuacucauuucuua

SEQ ID NO: 860082 - RNA, 19 nt, Homo sapiens
caagacagauccuuaagca

SEQ ID NO: 860083 - RNA, 19 nt, Homo sapiens
ggaagauggccuugaagua

SEQ ID NO: 860084 - RNA, 19 nt, Homo sapiens
ugaauggguuuguaaaguu

SEQ ID NO: 860085 - RNA, 19 nt, Homo sapiens
uuagccagcuugauguuua

SEQ ID NO: 860086 - RNA, 19 nt, Homo sapiens
gguaauggcacacauauuc

SEQ ID NO: 860087 - RNA, 19 nt, Homo sapiens
ggagaaaggagagaggaua

SEQ ID NO: 860088 - RNA, 19 nt, Homo sapiens
gaagauauguagagauucc

SEQ ID NO: 860089 - RNA, 19 nt, Homo sapiens
ccuaugaugugcuaaguga

SEQ ID NO: 860090 - RNA, 19 nt, Homo sapiens
gagaaaggagagaggauaa

SEQ ID NO: 860091 - RNA, 19 nt, Homo sapiens
gacaagauccugcacauag

SEQ ID NO: 860092 - RNA, 19 nt, Homo sapiens
gaaaggagagaggauaaga

SEQ ID NO: 860093 - RNA, 19 nt, Homo sapiens
ggacagggcccaucuacca

SEQ ID NO: 860094 - RNA, 19 nt, Homo sapiens
gaagauggccuugaaguac

SEQ ID NO: 860095 - RNA, 19 nt, Homo sapiens
aaaguucgcuucccagaca

SEQ ID NO: 860096 - RNA, 19 nt, Homo sapiens
gagagugaccugagugcua

SEQ ID NO: 860097 - RNA, 19 nt, Homo sapiens
ggacaagauccugcacaua

SEQ ID NO: 860098 - RNA, 19 nt, Homo sapiens
uaaaggucauagugaagaa

SEQ ID NO: 860099 - RNA, 19 nt, Homo sapiens
gaaggaaggcaccaagauc

SEQ ID NO: 860100 - RNA, 19 nt, Homo sapiens
gauaagaagggaaaguuca

SEQ ID NO: 860101 - RNA, 19 nt, Homo sapiens
caagguaauggcacacaua

SEQ ID NO: 860102 - RNA, 19 nt, Homo sapiens
ggagaaguuuaaggagauu

SEQ ID NO: 860103 - RNA, 19 nt, Homo sapiens
gauucagggucacagguuu

SEQ ID NO: 860104 - RNA, 19 nt, Homo sapiens
ccugagguauuaaggcuaa

SEQ ID NO: 860105 - RNA, 19 nt, Homo sapiens
caacgaggaugagaucaag

SEQ ID NO: 860106 - RNA, 19 nt, Homo sapiens
gggaaaagauuauuacaag

SEQ ID NO: 860107 - RNA, 19 nt, Homo sapiens
gauauguagagauuccuua

SEQ ID NO: 860108 - RNA, 19 nt, Homo sapiens
gaagaugaggacccauuug

SEQ ID NO: 860109 - RNA, 19 nt, Homo sapiens
gagaggauaagaagggaaa

SEQ ID NO: 860110 - RNA, 19 nt, Homo sapiens
agacaagacagauccuuaa

SEQ ID NO: 860111 - RNA, 19 nt, Homo sapiens
cagacaagacagauccuua

SEQ ID NO: 860112 - RNA, 19 nt, Homo sapiens
ggaaggaaggcaccaagau

SEQ ID NO: 860113 - RNA, 19 nt, Homo sapiens
ccaccaagcgcauugaaga

SEQ ID NO: 860114 - RNA, 19 nt, Homo sapiens
ccaagcgcauugaagauca

SEQ ID NO: 860115 - RNA, 19 nt, Homo sapiens
ggauguggaugaagaugag

SEQ ID NO: 860116 - RNA, 19 nt, Homo sapiens
uaugugaagcuacucauuu

SEQ ID NO: 860117 - RNA, 19 nt, Homo sapiens
ugcaguggcuggagaguga

SEQ ID NO: 860118 - RNA, 19 nt, Homo sapiens
gggccuguaugaccaguau

SEQ ID NO: 860119 - RNA, 19 nt, Homo sapiens
aagaaagccuaccggaaga

SEQ ID NO: 860120 - RNA, 19 nt, Homo sapiens
aagaagcacucaccuagag

SEQ ID NO: 860121 - RNA, 19 nt, Homo sapiens
gagugcuacuugaagauau

SEQ ID NO: 860122 - RNA, 19 nt, Homo sapiens
acuggacacuggcaacuuu

SEQ ID NO: 860123 - RNA, 19 nt, Homo sapiens
cugcagagcuggagguucu

SEQ ID NO: 860124 - RNA, 19 nt, Homo sapiens
ugaccugagugcuacuuga

SEQ ID NO: 860125 - RNA, 19 nt, Homo sapiens
gcucuacagugcccugauc

SEQ ID NO: 860126 - RNA, 19 nt, Homo sapiens
gcacacuuccgccgagaug

SEQ ID NO: 860127 - RNA, 19 nt, Homo sapiens
caagaagcacucaccuaga

SEQ ID NO: 860128 - RNA, 19 nt, Homo sapiens
uagccagcuugauguuuaa

SEQ ID NO: 860129 - RNA, 19 nt, Homo sapiens
ggacccauuuggcgcuuuc

SEQ ID NO: 860130 - RNA, 19 nt, Homo sapiens
gaaguaccacccagacaag

SEQ ID NO: 860131 - RNA, 19 nt, Homo sapiens
ucgcuucccagacagauua

SEQ ID NO: 860132 - RNA, 19 nt, Homo sapiens
ugacccagaugacauggau

SEQ ID NO: 860133 - RNA, 19 nt, Homo sapiens
caccuuugccuccuucuuu

SEQ ID NO: 860134 - RNA, 19 nt, Homo sapiens
ggauaagaagggaaaguuc

SEQ ID NO: 860135 - RNA, 19 nt, Homo sapiens
acauauucaugcacaagaa

SEQ ID NO: 860136 - RNA, 19 nt, Homo sapiens
ccugagugcuacuugaaga

SEQ ID NO: 860137 - RNA, 19 nt, Homo sapiens
ugaaguaccacccagacaa

SEQ ID NO: 860138 - RNA, 19 nt, Homo sapiens
guaauggcacacauauuca

SEQ ID NO: 860139 - RNA, 19 nt, Homo sapiens
ugaagaugaggacccauuu

SEQ ID NO: 860140 - RNA, 19 nt, Homo sapiens
gaccugagugcuacuugaa

SEQ ID NO: 860141 - RNA, 19 nt, Homo sapiens
cagauuaacaccacagaca

SEQ ID NO: 860142 - RNA, 19 nt, Homo sapiens
uggcugcacugugaacauu

SEQ ID NO: 860143 - RNA, 19 nt, Homo sapiens
acaagauccugcacauagu

SEQ ID NO: 860144 - RNA, 19 nt, Homo sapiens
gucacuagcuuucaaucca

SEQ ID NO: 860145 - RNA, 19 nt, Homo sapiens
ggucaauguucaugucacu

SEQ ID NO: 860146 - RNA, 19 nt, Homo sapiens
uaacaccacagacaagaca

SEQ ID NO: 860147 - RNA, 19 nt, Homo sapiens
cugcugacaucgucuuugu

SEQ ID NO: 860148 - RNA, 19 nt, Homo sapiens
acgcacaccuugacaacau

SEQ ID NO: 860149 - RNA, 19 nt, Homo sapiens
gaaagccuaccggaagaug

SEQ ID NO: 860150 - RNA, 19 nt, Homo sapiens
gguggggucuuuagguuuu

SEQ ID NO: 860151 - RNA, 19 nt, Homo sapiens
cugaauggguuuguaaagu

SEQ ID NO: 860152 - RNA, 19 nt, Homo sapiens
acgcugaggagaaguuuaa

SEQ ID NO: 860153 - RNA, 19 nt, Homo sapiens
uguauaaaggucauaguga

SEQ ID NO: 860154 - RNA, 19 nt, Homo sapiens
guagagauuccuuauccau

SEQ ID NO: 860155 - RNA, 19 nt, Homo sapiens
ugagugcuacuugaagaua

SEQ ID NO: 860156 - RNA, 19 nt, Homo sapiens
ucaugucacuagcuuucaa

SEQ ID NO: 860157 - RNA, 19 nt, Homo sapiens
cuguguggcugcacuguga

SEQ ID NO: 860158 - RNA, 19 nt, Homo sapiens
ggagauugcagaggccuau

SEQ ID NO: 860159 - RNA, 19 nt, Homo sapiens
aggagaaguuuaaggagau

SEQ ID NO: 860160 - RNA, 19 nt, Homo sapiens
aggaugagaucaagaaagc

SEQ ID NO: 860161 - RNA, 19 nt, Homo sapiens
ccaacgaggaugagaucaa

SEQ ID NO: 860162 - RNA, 19 nt, Homo sapiens
gugaagcuacucauuucuu

SEQ ID NO: 860163 - RNA, 19 nt, Homo sapiens
uaccagccuucaucaggaa

SEQ ID NO: 860164 - RNA, 19 nt, Homo sapiens
cacaagaagcacucaccua

SEQ ID NO: 860165 - RNA, 19 nt, Homo sapiens
gcuggagagugaccugagu

SEQ ID NO: 860166 - RNA, 19 nt, Homo sapiens
guucaugucacuagcuuuc

SEQ ID NO: 860167 - RNA, 19 nt, Homo sapiens
guaccacccagacaagaau

SEQ ID NO: 860168 - RNA, 19 nt, Homo sapiens
agaggccuaugaugugcua

SEQ ID NO: 860169 - RNA, 19 nt, Homo sapiens
gacgcugaauggguuugua

SEQ ID NO: 860170 - RNA, 19 nt, Homo sapiens
cuucuuagccagcuugaug

SEQ ID NO: 860171 - RNA, 19 nt, Homo sapiens
ccacuuuugugauauguga

SEQ ID NO: 860172 - RNA, 19 nt, Homo sapiens
gaauggggccugagguauu

SEQ ID NO: 860173 - RNA, 19 nt, Homo sapiens
aaaggagagaggauaagaa

SEQ ID NO: 860174 - RNA, 19 nt, Homo sapiens
ccaagguaauggcacacau

SEQ ID NO: 860175 - RNA, 19 nt, Homo sapiens
gguccacaguguccaaggu

SEQ ID NO: 860176 - RNA, 19 nt, Homo sapiens
ccccucagcuuugcuaaua

SEQ ID NO: 860177 - RNA, 19 nt, Homo sapiens
caagaucaccuuccccaaa

SEQ ID NO: 860178 - RNA, 19 nt, Homo sapiens
gaacuggagaucacuuugu

SEQ ID NO: 860179 - RNA, 19 nt, Homo sapiens
gaauccaagugcauuucuu

SEQ ID NO: 860180 - RNA, 19 nt, Homo sapiens
ccuccuggcuggcuuauuc

SEQ ID NO: 860181 - RNA, 19 nt, Homo sapiens
gggcagguauucaagugau

SEQ ID NO: 860182 - RNA, 19 nt, Homo sapiens
gcaggaauccaagugcauu

SEQ ID NO: 860183 - RNA, 19 nt, Homo sapiens
aauccaagugcauuucuua

SEQ ID NO: 860184 - RNA, 19 nt, Homo sapiens
ggugcaggcuggcauugug

SEQ ID NO: 860185 - RNA, 19 nt, Homo sapiens
uaaaagcacacgaaacaaa

SEQ ID NO: 860186 - RNA, 19 nt, Homo sapiens
ggaacuggagaucacuuug

SEQ ID NO: 860187 - RNA, 19 nt, Homo sapiens
gggaacuggagaucacuuu

SEQ ID NO: 860188 - RNA, 19 nt, Homo sapiens
ucaagugauucucccaucu

SEQ ID NO: 860189 - RNA, 19 nt, Homo sapiens
ggcagguauucaagugauu

SEQ ID NO: 860190 - RNA, 19 nt, Homo sapiens
ggaggccucagaugacuuc

SEQ ID NO: 860191 - RNA, 19 nt, Homo sapiens
caucucggucuccugagua

SEQ ID NO: 860192 - RNA, 19 nt, Homo sapiens
ccgggucccugaacucauc

SEQ ID NO: 860193 - RNA, 19 nt, Homo sapiens
ucacagcugcccacugcuu

SEQ ID NO: 860194 - RNA, 19 nt, Homo sapiens
uccaagugcauuucuuaaa

SEQ ID NO: 860195 - RNA, 19 nt, Homo sapiens
ggaauccaagugcauuucu

SEQ ID NO: 860196 - RNA, 19 nt, Homo sapiens
gcagguauucaagugauuc

SEQ ID NO: 860197 - RNA, 19 nt, Homo sapiens
gaauuuaaaagcacacgaa

SEQ ID NO: 860198 - RNA, 19 nt, Homo sapiens
caggaauccaagugcauuu

SEQ ID NO: 860199 - RNA, 19 nt, Homo sapiens
uacaggugcaugccacuaa

SEQ ID NO: 860200 - RNA, 19 nt, Homo sapiens
uugcaacauuuaaccugaa

SEQ ID NO: 860201 - RNA, 19 nt, Homo sapiens
gcaucagauuauugcaaca

SEQ ID NO: 860202 - RNA, 19 nt, Homo sapiens
ccaucucggucuccugagu

SEQ ID NO: 860203 - RNA, 19 nt, Homo sapiens
gauggcaggaauccaagug

SEQ ID NO: 860204 - RNA, 19 nt, Homo sapiens
ucccggaggccucagauga

SEQ ID NO: 860205 - RNA, 19 nt, Homo sapiens
gaaggagacagacuuauua

SEQ ID NO: 860206 - RNA, 19 nt, Homo sapiens
ggagacagacuuauuacua

SEQ ID NO: 860207 - RNA, 19 nt, Homo sapiens
caagaagggugugcuguuu

SEQ ID NO: 860208 - RNA, 19 nt, Homo sapiens
gcaauaaacacuugugguu

SEQ ID NO: 860209 - RNA, 19 nt, Homo sapiens
ggaaggagacagacuuauu

SEQ ID NO: 860210 - RNA, 19 nt, Homo sapiens
gagacagacuuauuacuag

SEQ ID NO: 860211 - RNA, 19 nt, Homo sapiens
gcaagacggugcagugaag

SEQ ID NO: 860212 - RNA, 19 nt, Homo sapiens
gcaagaagggugugcuguu

SEQ ID NO: 860213 - RNA, 19 nt, Homo sapiens
gguacaggauggcauagug

SEQ ID NO: 860214 - RNA, 19 nt, Homo sapiens
agacagacuuauuacuaga

SEQ ID NO: 860215 - RNA, 19 nt, Homo sapiens
gaguguuaaugaugccuuu

SEQ ID NO: 860216 - RNA, 19 nt, Homo sapiens
guacaggauggcauaguga

SEQ ID NO: 860217 - RNA, 19 nt, Homo sapiens
ggugguacaggauggcaua

SEQ ID NO: 860218 - RNA, 19 nt, Homo sapiens
cacccaauaucaucucaca

SEQ ID NO: 860219 - RNA, 19 nt, Homo sapiens
acagacuuauuacuagaug

SEQ ID NO: 860220 - RNA, 19 nt, Homo sapiens
agaagggugugcuguuugg

SEQ ID NO: 860221 - RNA, 19 nt, Homo sapiens
gcccugcaauuggaauguu

SEQ ID NO: 860222 - RNA, 19 nt, Homo sapiens
ucgcugguguccaucuuug

SEQ ID NO: 860223 - RNA, 19 nt, Homo sapiens
guuaaugaugccuuuguga

SEQ ID NO: 860224 - RNA, 19 nt, Homo sapiens
ggugugcuguuuggaguuc

SEQ ID NO: 860225 - RNA, 19 nt, Homo sapiens
ugggaaggagacagacuua

SEQ ID NO: 860226 - RNA, 19 nt, Homo sapiens
cagcaguggagguguuuga

SEQ ID NO: 860227 - RNA, 19 nt, Homo sapiens
ggugguggccugucugagu

SEQ ID NO: 860228 - RNA, 19 nt, Homo sapiens
cagcaagacggugcaguga

SEQ ID NO: 860229 - RNA, 19 nt, Homo sapiens
uggccugucugaguguuaa

SEQ ID NO: 860230 - RNA, 19 nt, Homo sapiens
uagugaaggcccugaaugu

SEQ ID NO: 860231 - RNA, 19 nt, Homo sapiens
gcaguggagguguuugaag

SEQ ID NO: 860232 - RNA, 19 nt, Homo sapiens
cagacuuauuacuagauga

SEQ ID NO: 860233 - RNA, 19 nt, Homo sapiens
gcauagugaaggcccugaa

SEQ ID NO: 860234 - RNA, 19 nt, Homo sapiens
caaggcggaaggcaagguu

SEQ ID NO: 860235 - RNA, 19 nt, Homo sapiens
gcucagcgggcuauauacu

SEQ ID NO: 860236 - RNA, 19 nt, Homo sapiens
ugucugaguguuaaugaug

SEQ ID NO: 860237 - RNA, 19 nt, Homo sapiens
gaacucagcuauuaagaaa

SEQ ID NO: 860238 - RNA, 19 nt, Homo sapiens
gaaccaaguuuguauaaag

SEQ ID NO: 860239 - RNA, 19 nt, Homo sapiens
agacaucgcuggaaaugaa

SEQ ID NO: 860240 - RNA, 19 nt, Homo sapiens
gagaagaacuugcccaacu

SEQ ID NO: 860241 - RNA, 19 nt, Homo sapiens
gggauuaaauggaauggaa

SEQ ID NO: 860242 - RNA, 19 nt, Homo sapiens
ggucagacaucgcuggaaa

SEQ ID NO: 860243 - RNA, 19 nt, Homo sapiens
ccagaugccuucuagauuc

SEQ ID NO: 860244 - RNA, 19 nt, Homo sapiens
uuaauugccuuugagguua

SEQ ID NO: 860245 - RNA, 19 nt, Homo sapiens
ucacauaugcuuacucuug

SEQ ID NO: 860246 - RNA, 19 nt, Homo sapiens
ggaaacaccuuggucuuac

SEQ ID NO: 860247 - RNA, 19 nt, Homo sapiens
gggaagaccucgucaccau

SEQ ID NO: 860248 - RNA, 19 nt, Homo sapiens
accaugaacucagcuauua

SEQ ID NO: 860249 - RNA, 19 nt, Homo sapiens
gaauugaaccaaguuugua

SEQ ID NO: 860250 - RNA, 19 nt, Homo sapiens
ccaaaggcuucaauacuuc

SEQ ID NO: 860251 - RNA, 19 nt, Homo sapiens
cccaaaggcuucaauacuu

SEQ ID NO: 860252 - RNA, 19 nt, Homo sapiens
ggaaaucuccucuuuugua

SEQ ID NO: 860253 - RNA, 19 nt, Homo sapiens
caggaaggcuugcaguaug

SEQ ID NO: 860254 - RNA, 19 nt, Homo sapiens
caacggagguagucuuguc

SEQ ID NO: 860255 - RNA, 19 nt, Homo sapiens
ggaauugaaccaaguuugu

SEQ ID NO: 860256 - RNA, 19 nt, Homo sapiens
agaauucucugaugguuuc

SEQ ID NO: 860257 - RNA, 19 nt, Homo sapiens
gagccagaauucacuagga

SEQ ID NO: 860258 - RNA, 19 nt, Homo sapiens
gaaauucgggacucgaguu

SEQ ID NO: 860259 - RNA, 19 nt, Homo sapiens
gaagaacuugcccaacuug

SEQ ID NO: 860260 - RNA, 19 nt, Homo sapiens
uaaaggagacaucugguau

SEQ ID NO: 860261 - RNA, 19 nt, Homo sapiens
ggauguagccagcaacugu

SEQ ID NO: 860262 - RNA, 19 nt, Homo sapiens
cggaaacaccuuggucuua

SEQ ID NO: 860263 - RNA, 19 nt, Homo sapiens
acacguacuuugacacaga

SEQ ID NO: 860264 - RNA, 19 nt, Homo sapiens
cuacauagacacguacuuu

SEQ ID NO: 860265 - RNA, 19 nt, Homo sapiens
agaagaacuugcccaacuu

SEQ ID NO: 860266 - RNA, 19 nt, Homo sapiens
ggucaaagugguacaggaa

SEQ ID NO: 860267 - RNA, 19 nt, Homo sapiens
gaucgaugguggcgcuuuc

SEQ ID NO: 860268 - RNA, 19 nt, Homo sapiens
acccugaggucgucaauga

SEQ ID NO: 860269 - RNA, 19 nt, Homo sapiens
acagagaggucuagcacau

SEQ ID NO: 860270 - RNA, 19 nt, Homo sapiens
uaucacauaugcuuacucu

SEQ ID NO: 860271 - RNA, 19 nt, Homo sapiens
gccaaagugucuacaugug

SEQ ID NO: 860272 - RNA, 19 nt, Homo sapiens
guacuaccagauagaaauu

SEQ ID NO: 860273 - RNA, 19 nt, Homo sapiens
gcucccagaugccuucuag

SEQ ID NO: 860274 - RNA, 19 nt, Homo sapiens
gcugcagugucugaaauuu

SEQ ID NO: 860275 - RNA, 19 nt, Homo sapiens
gaaacaccuuggucuuacu

SEQ ID NO: 860276 - RNA, 19 nt, Homo sapiens
ugucuuggguggaauugaa

SEQ ID NO: 860277 - RNA, 19 nt, Homo sapiens
gugcugaacugugcaucaa

SEQ ID NO: 860278 - RNA, 19 nt, Homo sapiens
ucucuucucucuucaaucu

SEQ ID NO: 860279 - RNA, 19 nt, Homo sapiens
ugccucagcuuuacauuca

SEQ ID NO: 860280 - RNA, 19 nt, Homo sapiens
aaaggagacaucugguaua

SEQ ID NO: 860281 - RNA, 19 nt, Homo sapiens
acccaauacuuauguugua

SEQ ID NO: 860282 - RNA, 19 nt, Homo sapiens
gaauacuuggccuagcuua

SEQ ID NO: 860283 - RNA, 19 nt, Homo sapiens
gagaguauaacgcagacaa

SEQ ID NO: 860284 - RNA, 19 nt, Homo sapiens
ccacuaucacauaugcuua

SEQ ID NO: 860285 - RNA, 19 nt, Homo sapiens
gcuggccacuaucacauau

SEQ ID NO: 860286 - RNA, 19 nt, Homo sapiens
caacuucuuggccauggua

SEQ ID NO: 860287 - RNA, 19 nt, Homo sapiens
aggaaggcuugcaguauga

SEQ ID NO: 860288 - RNA, 19 nt, Homo sapiens
ucucuucaaucucuggaaa

SEQ ID NO: 860289 - RNA, 19 nt, Homo sapiens
cagaugccuucuagauuca

SEQ ID NO: 860290 - RNA, 19 nt, Homo sapiens
gugcugcagugucugaaau

SEQ ID NO: 860291 - RNA, 19 nt, Homo sapiens
acauagacacguacuuuga

SEQ ID NO: 860292 - RNA, 19 nt, Homo sapiens
ggguuucucugugcucuga

SEQ ID NO: 860293 - RNA, 19 nt, Homo sapiens
cagaggauguagccagcaa

SEQ ID NO: 860294 - RNA, 19 nt, Homo sapiens
gaagcuacagauucucguu

SEQ ID NO: 860295 - RNA, 19 nt, Homo sapiens
uaugcuuacucuugcuuaa

SEQ ID NO: 860296 - RNA, 19 nt, Homo sapiens
gcaucaaccaggaagaguu

SEQ ID NO: 860297 - RNA, 19 nt, Homo sapiens
gaagauggaaggccuuuug

SEQ ID NO: 860298 - RNA, 19 nt, Homo sapiens
uagauucacugucuuuuga

SEQ ID NO: 860299 - RNA, 19 nt, Homo sapiens
ugaacucagcuauuaagaa

SEQ ID NO: 860300 - RNA, 19 nt, Homo sapiens
caagggcuuugacgucaca

SEQ ID NO: 860301 - RNA, 19 nt, Homo sapiens
uaauugccuuugagguuau

SEQ ID NO: 860302 - RNA, 19 nt, Homo sapiens
uuucaaauccucccuacuu

SEQ ID NO: 860303 - RNA, 19 nt, Homo sapiens
gcuacuaccuggagaugcu

SEQ ID NO: 860304 - RNA, 19 nt, Homo sapiens
gggcagcggagaagaacuu

SEQ ID NO: 860305 - RNA, 19 nt, Homo sapiens
ccacaaaugcgcuggugau

SEQ ID NO: 860306 - RNA, 19 nt, Homo sapiens
ugucaacauugccacuauu

SEQ ID NO: 860307 - RNA, 19 nt, Homo sapiens
agagaggucuagcacauac

SEQ ID NO: 860308 - RNA, 19 nt, Homo sapiens
gaaaucuccucuuuuguac

SEQ ID NO: 860309 - RNA, 19 nt, Homo sapiens
ccgcagaagcuacagauuc

SEQ ID NO: 860310 - RNA, 19 nt, Homo sapiens
cggccugaauuaugaaugu

SEQ ID NO: 860311 - RNA, 19 nt, Homo sapiens
ugccugggauuaaauggaa

SEQ ID NO: 860312 - RNA, 19 nt, Homo sapiens
caacagccaagacccaaca

SEQ ID NO: 860313 - RNA, 19 nt, Homo sapiens
guucucuucucucuucaau

SEQ ID NO: 860314 - RNA, 19 nt, Homo sapiens
gagccauccuccuugucuu

SEQ ID NO: 860315 - RNA, 19 nt, Homo sapiens
cccaacaggugcugaacug

SEQ ID NO: 860316 - RNA, 19 nt, Homo sapiens
ccucacaagccucuucuga

SEQ ID NO: 860317 - RNA, 19 nt, Homo sapiens
ccaccaacauaaaacaaaa

SEQ ID NO: 860318 - RNA, 19 nt, Homo sapiens
ccacccgucuucaaucucu

SEQ ID NO: 860319 - RNA, 19 nt, Homo sapiens
caauccugccucagcuuua

SEQ ID NO: 860320 - RNA, 19 nt, Homo sapiens
ggucauuccguaucacaau

SEQ ID NO: 860321 - RNA, 19 nt, Homo sapiens
ggucuuacuucccuaaaau

SEQ ID NO: 860322 - RNA, 19 nt, Homo sapiens
gggcuucuacgucaucuuc

SEQ ID NO: 860323 - RNA, 19 nt, Homo sapiens
gccugaauuaugaauguua

SEQ ID NO: 860324 - RNA, 19 nt, Homo sapiens
cggagguagucuugucuug

SEQ ID NO: 860325 - RNA, 19 nt, Homo sapiens
cagagaggucuagcacaua

SEQ ID NO: 860326 - RNA, 19 nt, Homo sapiens
gcccacccgucuucaaucu

SEQ ID NO: 860327 - RNA, 19 nt, Homo sapiens
ccaugaacucagcuauuaa

SEQ ID NO: 860328 - RNA, 19 nt, Homo sapiens
cauccuccuugucuuaauc

SEQ ID NO: 860329 - RNA, 19 nt, Homo sapiens
acuccuacauagacacgua

SEQ ID NO: 860330 - RNA, 19 nt, Homo sapiens
auaaaggagacaucuggua

SEQ ID NO: 860331 - RNA, 19 nt, Homo sapiens
gucaacauugccacuauuu

SEQ ID NO: 860332 - RNA, 19 nt, Homo sapiens
caaccgaugguccucacaa

SEQ ID NO: 860333 - RNA, 19 nt, Homo sapiens
acagugaaguacacacaag

SEQ ID NO: 860334 - RNA, 19 nt, Homo sapiens
aaggagacaucugguauac

SEQ ID NO: 860335 - RNA, 19 nt, Homo sapiens
ggaauacuuggccuagcuu

SEQ ID NO: 860336 - RNA, 19 nt, Homo sapiens
caaccaggaagaguucuau

SEQ ID NO: 860337 - RNA, 19 nt, Homo sapiens
gaacucagcuauuaagaaa

SEQ ID NO: 860338 - RNA, 19 nt, Homo sapiens
gaaccaaguuuguauaaag

SEQ ID NO: 860339 - RNA, 19 nt, Homo sapiens
agacaucgcuggaaaugaa

SEQ ID NO: 860340 - RNA, 19 nt, Homo sapiens
gagaagaacuugcccaacu

SEQ ID NO: 860341 - RNA, 19 nt, Homo sapiens
gggauuaaauggaauggaa

SEQ ID NO: 860342 - RNA, 19 nt, Homo sapiens
ggucagacaucgcuggaaa

SEQ ID NO: 860343 - RNA, 19 nt, Homo sapiens
ccagaugccuucuagauuc

SEQ ID NO: 860344 - RNA, 19 nt, Homo sapiens
uuaauugccuuugagguua

SEQ ID NO: 860345 - RNA, 19 nt, Homo sapiens
ucacauaugcuuacucuug

SEQ ID NO: 860346 - RNA, 19 nt, Homo sapiens
gcgcaucucugcuuuacau

SEQ ID NO: 860347 - RNA, 19 nt, Homo sapiens
gggaagaccucgucaccau

SEQ ID NO: 860348 - RNA, 19 nt, Homo sapiens
accaugaacucagcuauua

SEQ ID NO: 860349 - RNA, 19 nt, Homo sapiens
gaauugaaccaaguuugua

SEQ ID NO: 860350 - RNA, 19 nt, Homo sapiens
ccaaaggcuucaauacuuc

SEQ ID NO: 860351 - RNA, 19 nt, Homo sapiens
cccaaaggcuucaauacuu

SEQ ID NO: 860352 - RNA, 19 nt, Homo sapiens
ggaaaucuccucuuuugua

SEQ ID NO: 860353 - RNA, 19 nt, Homo sapiens
caggaaggcuugcaguaug

SEQ ID NO: 860354 - RNA, 19 nt, Homo sapiens
caacggagguagucuuguc

SEQ ID NO: 860355 - RNA, 19 nt, Homo sapiens
ggaauugaaccaaguuugu

SEQ ID NO: 860356 - RNA, 19 nt, Homo sapiens
gagccagaauucacuagga

SEQ ID NO: 860357 - RNA, 19 nt, Homo sapiens
gaaauucgggacucgaguu

SEQ ID NO: 860358 - RNA, 19 nt, Homo sapiens
gaagaacuugcccaacuug

SEQ ID NO: 860359 - RNA, 19 nt, Homo sapiens
uaaaggagacaucugguau

SEQ ID NO: 860360 - RNA, 19 nt, Homo sapiens
ggauguagccagcaacugu

SEQ ID NO: 860361 - RNA, 19 nt, Homo sapiens
caucucugcuuuacauuca

SEQ ID NO: 860362 - RNA, 19 nt, Homo sapiens
acacguacuuugacacaga

SEQ ID NO: 860363 - RNA, 19 nt, Homo sapiens
cuacauagacacguacuuu

SEQ ID NO: 860364 - RNA, 19 nt, Homo sapiens
agaagaacuugcccaacuu

SEQ ID NO: 860365 - RNA, 19 nt, Homo sapiens
ggucaaagugguacaggaa

SEQ ID NO: 860366 - RNA, 19 nt, Homo sapiens
gaucgaugguggcgcuuuc

SEQ ID NO: 860367 - RNA, 19 nt, Homo sapiens
acccugaggucgucaauga

SEQ ID NO: 860368 - RNA, 19 nt, Homo sapiens
acagagaggucuagcacau

SEQ ID NO: 860369 - RNA, 19 nt, Homo sapiens
uaucacauaugcuuacucu

SEQ ID NO: 860370 - RNA, 19 nt, Homo sapiens
gccaaagugucuacaugug

SEQ ID NO: 860371 - RNA, 19 nt, Homo sapiens
guacuaccagauagaaauu

SEQ ID NO: 860372 - RNA, 19 nt, Homo sapiens
gcucccagaugccuucuag

SEQ ID NO: 860373 - RNA, 19 nt, Homo sapiens
gcugcagugucugaaauuu

SEQ ID NO: 860374 - RNA, 19 nt, Homo sapiens
ugucuuggguggaauugaa

SEQ ID NO: 860375 - RNA, 19 nt, Homo sapiens
gugcugaacugugcaucaa

SEQ ID NO: 860376 - RNA, 19 nt, Homo sapiens
ucucuucucucuucaaucu

SEQ ID NO: 860377 - RNA, 19 nt, Homo sapiens
aaaggagacaucugguaua

SEQ ID NO: 860378 - RNA, 19 nt, Homo sapiens
acccaauacuuauguugua

SEQ ID NO: 860379 - RNA, 19 nt, Homo sapiens
gaauacuuggccuagcuua

SEQ ID NO: 860380 - RNA, 19 nt, Homo sapiens
gagaguauaacgcagacaa

SEQ ID NO: 860381 - RNA, 19 nt, Homo sapiens
ccacuaucacauaugcuua

SEQ ID NO: 860382 - RNA, 19 nt, Homo sapiens
gcuggccacuaucacauau

SEQ ID NO: 860383 - RNA, 19 nt, Homo sapiens
caacuucuuggccauggua

SEQ ID NO: 860384 - RNA, 19 nt, Homo sapiens
aggaaggcuugcaguauga

SEQ ID NO: 860385 - RNA, 19 nt, Homo sapiens
ucucuucaaucucuggaaa

SEQ ID NO: 860386 - RNA, 19 nt, Homo sapiens
cagaugccuucuagauuca

SEQ ID NO: 860387 - RNA, 19 nt, Homo sapiens
gugcugcagugucugaaau

SEQ ID NO: 860388 - RNA, 19 nt, Homo sapiens
gaagcuacagauucucguu

SEQ ID NO: 860389 - RNA, 19 nt, Homo sapiens
ggguuucucugugcucuga

SEQ ID NO: 860390 - RNA, 19 nt, Homo sapiens
acauagacacguacuuuga

SEQ ID NO: 860391 - RNA, 19 nt, Homo sapiens
cagaggauguagccagcaa

SEQ ID NO: 860392 - RNA, 19 nt, Homo sapiens
uaugcuuacucuugcuuaa

SEQ ID NO: 860393 - RNA, 19 nt, Homo sapiens
gcaucaaccaggaagaguu

SEQ ID NO: 860394 - RNA, 19 nt, Homo sapiens
gaagauggaaggccuuuug

SEQ ID NO: 860395 - RNA, 19 nt, Homo sapiens
uagauucacugucuuuuga

SEQ ID NO: 860396 - RNA, 19 nt, Homo sapiens
ugaacucagcuauuaagaa

SEQ ID NO: 860397 - RNA, 19 nt, Homo sapiens
caagggcuuugacgucaca

SEQ ID NO: 860398 - RNA, 19 nt, Homo sapiens
uaauugccuuugagguuau

SEQ ID NO: 860399 - RNA, 19 nt, Homo sapiens
uuucaaauccucccuacuu

SEQ ID NO: 860400 - RNA, 19 nt, Homo sapiens
gggcagcggagaagaacuu

SEQ ID NO: 860401 - RNA, 19 nt, Homo sapiens
ccacaaaugcgcuggugau

SEQ ID NO: 860402 - RNA, 19 nt, Homo sapiens
gcuacuaccuggagaugcu

SEQ ID NO: 860403 - RNA, 19 nt, Homo sapiens
ugucaacauugccacuauu

SEQ ID NO: 860404 - RNA, 19 nt, Homo sapiens
ccgcagaagcuacagauuc

SEQ ID NO: 860405 - RNA, 19 nt, Homo sapiens
gaaaucuccucuuuuguac

SEQ ID NO: 860406 - RNA, 19 nt, Homo sapiens
agagaggucuagcacauac

SEQ ID NO: 860407 - RNA, 19 nt, Homo sapiens
cggccugaauuaugaaugu

SEQ ID NO: 860408 - RNA, 19 nt, Homo sapiens
ugccugggauuaaauggaa

SEQ ID NO: 860409 - RNA, 19 nt, Homo sapiens
caacagccaagacccaaca

SEQ ID NO: 860410 - RNA, 19 nt, Homo sapiens
guucucuucucucuucaau

SEQ ID NO: 860411 - RNA, 19 nt, Homo sapiens
gagccauccuccuugucuu

SEQ ID NO: 860412 - RNA, 19 nt, Homo sapiens
cccaacaggugcugaacug

SEQ ID NO: 860413 - RNA, 19 nt, Homo sapiens
ccucacaagccucuucuga

SEQ ID NO: 860414 - RNA, 19 nt, Homo sapiens
ccaccaacauaaaacaaaa

SEQ ID NO: 860415 - RNA, 19 nt, Homo sapiens
ccacccgucuucaaucucu

SEQ ID NO: 860416 - RNA, 19 nt, Homo sapiens
gggcuucuacgucaucuuc

SEQ ID NO: 860417 - RNA, 19 nt, Homo sapiens
gccugaauuaugaauguua

SEQ ID NO: 860418 - RNA, 19 nt, Homo sapiens
cagagaggucuagcacaua

SEQ ID NO: 860419 - RNA, 19 nt, Homo sapiens
cggagguagucuugucuug

SEQ ID NO: 860420 - RNA, 19 nt, Homo sapiens
gcccacccgucuucaaucu

SEQ ID NO: 860421 - RNA, 19 nt, Homo sapiens
ccaugaacucagcuauuaa

SEQ ID NO: 860422 - RNA, 19 nt, Homo sapiens
cauccuccuugucuuaauc

SEQ ID NO: 860423 - RNA, 19 nt, Homo sapiens
auaaaggagacaucuggua

SEQ ID NO: 860424 - RNA, 19 nt, Homo sapiens
acuccuacauagacacgua

SEQ ID NO: 860425 - RNA, 19 nt, Homo sapiens
gucaacauugccacuauuu

SEQ ID NO: 860426 - RNA, 19 nt, Homo sapiens
acagugaaguacacacaag

SEQ ID NO: 860427 - RNA, 19 nt, Homo sapiens
caaccgaugguccucacaa

SEQ ID NO: 860428 - RNA, 19 nt, Homo sapiens
aaggagacaucugguauac

SEQ ID NO: 860429 - RNA, 19 nt, Homo sapiens
ggaauacuuggccuagcuu

SEQ ID NO: 860430 - RNA, 19 nt, Homo sapiens
caaccaggaagaguucuau

SEQ ID NO: 860431 - RNA, 19 nt, Homo sapiens
caucaaccaggaagaguuc

SEQ ID NO: 860432 - RNA, 19 nt, Homo sapiens
uauuguuggugcgaaagua

SEQ ID NO: 860433 - RNA, 19 nt, Homo sapiens
gcaaccaugaacucagcua

SEQ ID NO: 860434 - RNA, 19 nt, Homo sapiens
gcaucucugcuuuacauuc

SEQ ID NO: 860435 - RNA, 19 nt, Homo sapiens
gccaagccaucaaguucuc

SEQ ID NO: 860436 - RNA, 19 nt, Homo sapiens
caagcuggccacuaucaca

SEQ ID NO: 860437 - RNA, 19 nt, Homo sapiens
gaacucagcuauuaagaaa

SEQ ID NO: 860438 - RNA, 19 nt, Homo sapiens
gaaccaaguuuguauaaag

SEQ ID NO: 860439 - RNA, 19 nt, Homo sapiens
agacaucgcuggaaaugaa

SEQ ID NO: 860440 - RNA, 19 nt, Homo sapiens
gagaagaacuugcccaacu

SEQ ID NO: 860441 - RNA, 19 nt, Homo sapiens
gggauuaaauggaauggaa

SEQ ID NO: 860442 - RNA, 19 nt, Homo sapiens
ggucagacaucgcuggaaa

SEQ ID NO: 860443 - RNA, 19 nt, Homo sapiens
ccagaugccuucuagauuc

SEQ ID NO: 860444 - RNA, 19 nt, Homo sapiens
uuaauugccuuugagguua

SEQ ID NO: 860445 - RNA, 19 nt, Homo sapiens
ucacauaugcuuacucuug

SEQ ID NO: 860446 - RNA, 19 nt, Homo sapiens
ggaaacaccuuggucuuac

SEQ ID NO: 860447 - RNA, 19 nt, Homo sapiens
gggaagaccucgucaccau

SEQ ID NO: 860448 - RNA, 19 nt, Homo sapiens
accaugaacucagcuauua

SEQ ID NO: 860449 - RNA, 19 nt, Homo sapiens
gaauugaaccaaguuugua

SEQ ID NO: 860450 - RNA, 19 nt, Homo sapiens
ccaaaggcuucaauacuuc

SEQ ID NO: 860451 - RNA, 19 nt, Homo sapiens
cccaaaggcuucaauacuu

SEQ ID NO: 860452 - RNA, 19 nt, Homo sapiens
ggaaaucuccucuuuugua

SEQ ID NO: 860453 - RNA, 19 nt, Homo sapiens
ucacaauccugccucagaa

SEQ ID NO: 860454 - RNA, 19 nt, Homo sapiens
caggaaggcuugcaguaug

SEQ ID NO: 860455 - RNA, 19 nt, Homo sapiens
caacggagguagucuuguc

SEQ ID NO: 860456 - RNA, 19 nt, Homo sapiens
ggaauugaaccaaguuugu

SEQ ID NO: 860457 - RNA, 19 nt, Homo sapiens
agaauucucugaugguuuc

SEQ ID NO: 860458 - RNA, 19 nt, Homo sapiens
gagccagaauucacuagga

SEQ ID NO: 860459 - RNA, 19 nt, Homo sapiens
gaaauucgggacucgaguu

SEQ ID NO: 860460 - RNA, 19 nt, Homo sapiens
gaagaacuugcccaacuug

SEQ ID NO: 860461 - RNA, 19 nt, Homo sapiens
uaaaggagacaucugguau

SEQ ID NO: 860462 - RNA, 19 nt, Homo sapiens
ggauguagccagcaacugu

SEQ ID NO: 860463 - RNA, 19 nt, Homo sapiens
cggaaacaccuuggucuua

SEQ ID NO: 860464 - RNA, 19 nt, Homo sapiens
acacguacuuugacacaga

SEQ ID NO: 860465 - RNA, 19 nt, Homo sapiens
cuacauagacacguacuuu

SEQ ID NO: 860466 - RNA, 19 nt, Homo sapiens
agaagaacuugcccaacuu

SEQ ID NO: 860467 - RNA, 19 nt, Homo sapiens
ggucaaagugguacaggaa

SEQ ID NO: 860468 - RNA, 19 nt, Homo sapiens
gaucgaugguggcgcuuuc

SEQ ID NO: 860469 - RNA, 19 nt, Homo sapiens
acccugaggucgucaauga

SEQ ID NO: 860470 - RNA, 19 nt, Homo sapiens
acagagaggucuagcacau

SEQ ID NO: 860471 - RNA, 19 nt, Homo sapiens
uaucacauaugcuuacucu

SEQ ID NO: 860472 - RNA, 19 nt, Homo sapiens
gccaaagugucuacaugug

SEQ ID NO: 860473 - RNA, 19 nt, Homo sapiens
guacuaccagauagaaauu

SEQ ID NO: 860474 - RNA, 19 nt, Homo sapiens
gcucccagaugccuucuag

SEQ ID NO: 860475 - RNA, 19 nt, Homo sapiens
gcugcagugucugaaauuu

SEQ ID NO: 860476 - RNA, 19 nt, Homo sapiens
gaaacaccuuggucuuacu

SEQ ID NO: 860477 - RNA, 19 nt, Homo sapiens
ugucuuggguggaauugaa

SEQ ID NO: 860478 - RNA, 19 nt, Homo sapiens
gugcugaacugugcaucaa

SEQ ID NO: 860479 - RNA, 19 nt, Homo sapiens
ucucuucucucuucaaucu

SEQ ID NO: 860480 - RNA, 19 nt, Homo sapiens
aaaggagacaucugguaua

SEQ ID NO: 860481 - RNA, 19 nt, Homo sapiens
acccaauacuuauguugua

SEQ ID NO: 860482 - RNA, 19 nt, Homo sapiens
gaauacuuggccuagcuua

SEQ ID NO: 860483 - RNA, 19 nt, Homo sapiens
gagaguauaacgcagacaa

SEQ ID NO: 860484 - RNA, 19 nt, Homo sapiens
ccacuaucacauaugcuua

SEQ ID NO: 860485 - RNA, 19 nt, Homo sapiens
gcuggccacuaucacauau

SEQ ID NO: 860486 - RNA, 19 nt, Homo sapiens
caacuucuuggccauggua

SEQ ID NO: 860487 - RNA, 19 nt, Homo sapiens
aggaaggcuugcaguauga

SEQ ID NO: 860488 - RNA, 19 nt, Homo sapiens
ucucuucaaucucuggaaa

SEQ ID NO: 860489 - RNA, 19 nt, Homo sapiens
cagaugccuucuagauuca

SEQ ID NO: 860490 - RNA, 19 nt, Homo sapiens
gugcugcagugucugaaau

SEQ ID NO: 860491 - RNA, 19 nt, Homo sapiens
acauagacacguacuuuga

SEQ ID NO: 860492 - RNA, 19 nt, Homo sapiens
ggguuucucugugcucuga

SEQ ID NO: 860493 - RNA, 19 nt, Homo sapiens
gaagcuacagauucucguu

SEQ ID NO: 860494 - RNA, 19 nt, Homo sapiens
cagaggauguagccagcaa

SEQ ID NO: 860495 - RNA, 19 nt, Homo sapiens
uaugcuuacucuugcuuaa

SEQ ID NO: 860496 - RNA, 19 nt, Homo sapiens
gcaucaaccaggaagaguu

SEQ ID NO: 860497 - RNA, 19 nt, Homo sapiens
gaagauggaaggccuuuug

SEQ ID NO: 860498 - RNA, 19 nt, Homo sapiens
uagauucacugucuuuuga

SEQ ID NO: 860499 - RNA, 19 nt, Homo sapiens
ugaacucagcuauuaagaa

SEQ ID NO: 860500 - RNA, 19 nt, Homo sapiens
aauccugccucagaaauug

SEQ ID NO: 860501 - RNA, 19 nt, Homo sapiens
caagggcuuugacgucaca

SEQ ID NO: 860502 - RNA, 19 nt, Homo sapiens
gcuacuaccuggagaugcu

SEQ ID NO: 860503 - RNA, 19 nt, Homo sapiens
uaauugccuuugagguuau

SEQ ID NO: 860504 - RNA, 19 nt, Homo sapiens
uuucaaauccucccuacuu

SEQ ID NO: 860505 - RNA, 19 nt, Homo sapiens
gggcagcggagaagaacuu

SEQ ID NO: 860506 - RNA, 19 nt, Homo sapiens
ugucaacauugccacuauu

SEQ ID NO: 860507 - RNA, 19 nt, Homo sapiens
agagaggucuagcacauac

SEQ ID NO: 860508 - RNA, 19 nt, Homo sapiens
gaaaucuccucuuuuguac

SEQ ID NO: 860509 - RNA, 19 nt, Homo sapiens
ccgcagaagcuacagauuc

SEQ ID NO: 860510 - RNA, 19 nt, Homo sapiens
ugccugggauuaaauggaa

SEQ ID NO: 860511 - RNA, 19 nt, Homo sapiens
caacagccaagacccaaca

SEQ ID NO: 860512 - RNA, 19 nt, Homo sapiens
guucucuucucucuucaau

SEQ ID NO: 860513 - RNA, 19 nt, Homo sapiens
gagccauccuccuugucuu

SEQ ID NO: 860514 - RNA, 19 nt, Homo sapiens
cccaacaggugcugaacug

SEQ ID NO: 860515 - RNA, 19 nt, Homo sapiens
ccucacaagccucuucuga

SEQ ID NO: 860516 - RNA, 19 nt, Homo sapiens
ccaccaacauaaaacaaaa

SEQ ID NO: 860517 - RNA, 19 nt, Homo sapiens
ccacccgucuucaaucucu

SEQ ID NO: 860518 - RNA, 19 nt, Homo sapiens
ggucauuccguaucacaau

SEQ ID NO: 860519 - RNA, 19 nt, Homo sapiens
ggucuuacuucccuaaaau

SEQ ID NO: 860520 - RNA, 19 nt, Homo sapiens
cagagaggucuagcacaua

SEQ ID NO: 860521 - RNA, 19 nt, Homo sapiens
caauccugccucagaaauu

SEQ ID NO: 860522 - RNA, 19 nt, Homo sapiens
cggagguagucuugucuug

SEQ ID NO: 860523 - RNA, 19 nt, Homo sapiens
acuccuacauagacacgua

SEQ ID NO: 860524 - RNA, 19 nt, Homo sapiens
gcccacccgucuucaaucu

SEQ ID NO: 860525 - RNA, 19 nt, Homo sapiens
ccaugaacucagcuauuaa

SEQ ID NO: 860526 - RNA, 19 nt, Homo sapiens
cauccuccuugucuuaauc

SEQ ID NO: 860527 - RNA, 19 nt, Homo sapiens
auaaaggagacaucuggua

SEQ ID NO: 860528 - RNA, 19 nt, Homo sapiens
gucaacauugccacuauuu

SEQ ID NO: 860529 - RNA, 19 nt, Homo sapiens
caaccgaugguccucacaa

SEQ ID NO: 860530 - RNA, 19 nt, Homo sapiens
acagugaaguacacacaag

SEQ ID NO: 860531 - RNA, 19 nt, Homo sapiens
aaggagacaucugguauac

SEQ ID NO: 860532 - RNA, 19 nt, Homo sapiens
ggaauacuuggccuagcuu

SEQ ID NO: 860533 - RNA, 19 nt, Homo sapiens
caaccaggaagaguucuau

SEQ ID NO: 860534 - RNA, 19 nt, Homo sapiens
caucaaccaggaagaguuc

SEQ ID NO: 860535 - RNA, 19 nt, Homo sapiens
uauuguuggugcgaaagua

SEQ ID NO: 860536 - RNA, 19 nt, Homo sapiens
gcaaccaugaacucagcua

SEQ ID NO: 860537 - RNA, 19 nt, Homo sapiens
gcacagaacugccgaaaca

SEQ ID NO: 860538 - RNA, 19 nt, Homo sapiens
ggaaaggcauuuacaggua

SEQ ID NO: 860539 - RNA, 19 nt, Homo sapiens
ggaagcaacuggcaaagaa

SEQ ID NO: 860540 - RNA, 19 nt, Homo sapiens
gcacacaguuagaagauga

SEQ ID NO: 860541 - RNA, 19 nt, Homo sapiens
gaagaaugcauccugauaa

SEQ ID NO: 860542 - RNA, 19 nt, Homo sapiens
gaaggcauguuaauagguu

SEQ ID NO: 860543 - RNA, 19 nt, Homo sapiens
gaucugaccuccugugugu

SEQ ID NO: 860544 - RNA, 19 nt, Homo sapiens
caaagugacuguacugcaa

SEQ ID NO: 860545 - RNA, 19 nt, Homo sapiens
gccgaaacauugaacauuu

SEQ ID NO: 860546 - RNA, 19 nt, Homo sapiens
ugacuguacugcaaauuaa

SEQ ID NO: 860547 - RNA, 19 nt, Homo sapiens
gaugaaggccuuauuaaca

SEQ ID NO: 860548 - RNA, 19 nt, Homo sapiens
ccaguggccuacuuuaauu

SEQ ID NO: 860549 - RNA, 19 nt, Homo sapiens
aaaccuggaucucuuaaga

SEQ ID NO: 860550 - RNA, 19 nt, Homo sapiens
gggcucagcucccucaugu

SEQ ID NO: 860551 - RNA, 19 nt, Homo sapiens
uauagagacuuauguggaa

SEQ ID NO: 860552 - RNA, 19 nt, Homo sapiens
ucugucaacuugucauaua

SEQ ID NO: 860553 - RNA, 19 nt, Homo sapiens
guuaauagguuuccaugag

SEQ ID NO: 860554 - RNA, 19 nt, Homo sapiens
gcucacguaucacggauga

SEQ ID NO: 860555 - RNA, 19 nt, Homo sapiens
ucacugacagcacguguua

SEQ ID NO: 860556 - RNA, 19 nt, Homo sapiens
gagcagggucuucaccuuu

SEQ ID NO: 860557 - RNA, 19 nt, Homo sapiens
ugaagaaugcauccugaua

SEQ ID NO: 860558 - RNA, 19 nt, Homo sapiens
guuccaagcugaaacaucu

SEQ ID NO: 860559 - RNA, 19 nt, Homo sapiens
aaacucagaucaguaagug

SEQ ID NO: 860560 - RNA, 19 nt, Homo sapiens
guaaaagacuucuguaugg

SEQ ID NO: 860561 - RNA, 19 nt, Homo sapiens
gcccgaugcucccauuuga

SEQ ID NO: 860562 - RNA, 19 nt, Homo sapiens
guuauagccuuagcagauu

SEQ ID NO: 860563 - RNA, 19 nt, Homo sapiens
aaaaucagguuacaccaua

SEQ ID NO: 860564 - RNA, 19 nt, Homo sapiens
cauaaugccugauaguuuu

SEQ ID NO: 860565 - RNA, 19 nt, Homo sapiens
ucauaaugccugauaguuu

SEQ ID NO: 860566 - RNA, 19 nt, Homo sapiens
cuuaagagauugguaccua

SEQ ID NO: 860567 - RNA, 19 nt, Homo sapiens
gcuaggaccaugccagaaa

SEQ ID NO: 860568 - RNA, 19 nt, Homo sapiens
ggagcagggucuucaccuu

SEQ ID NO: 860569 - RNA, 19 nt, Homo sapiens
gugacuguacugcaaauua

SEQ ID NO: 860570 - RNA, 19 nt, Homo sapiens
aaagacuucuguauggauu

SEQ ID NO: 860571 - RNA, 19 nt, Homo sapiens
ucagcucccucaugucaaa

SEQ ID NO: 860572 - RNA, 19 nt, Homo sapiens
gaaccucucuuggugugau

SEQ ID NO: 860573 - RNA, 19 nt, Homo sapiens
ccgaaacauugaacauuug

SEQ ID NO: 860574 - RNA, 19 nt, Homo sapiens
cuacagcacauaacacauu

SEQ ID NO: 860575 - RNA, 19 nt, Homo sapiens
uagaagcucugguguaugc

SEQ ID NO: 860576 - RNA, 19 nt, Homo sapiens
uuaauagguuuccaugaga

SEQ ID NO: 860577 - RNA, 19 nt, Homo sapiens
aguagaagcucugguguau

SEQ ID NO: 860578 - RNA, 19 nt, Homo sapiens
ggacaacugccuccucauc

SEQ ID NO: 860579 - RNA, 19 nt, Homo sapiens
gaagguguggugcagauau

SEQ ID NO: 860580 - RNA, 19 nt, Homo sapiens
gcucagcucccucauguca

SEQ ID NO: 860581 - RNA, 19 nt, Homo sapiens
ugaaggccuuauuaacaaa

SEQ ID NO: 860582 - RNA, 19 nt, Homo sapiens
gauggaagcaacuggcaaa

SEQ ID NO: 860583 - RNA, 19 nt, Homo sapiens
gaagcgaugcgguggauuc

SEQ ID NO: 860584 - RNA, 19 nt, Homo sapiens
cagaaaccuggaucucuua

SEQ ID NO: 860585 - RNA, 19 nt, Homo sapiens
caugacaaguggucucaau

SEQ ID NO: 860586 - RNA, 19 nt, Homo sapiens
caaagccuugugucaguua

SEQ ID NO: 860587 - RNA, 19 nt, Homo sapiens
aaugaugaaggccuuauua

SEQ ID NO: 860588 - RNA, 19 nt, Homo sapiens
gaaacaaucaaaucaaagc

SEQ ID NO: 860589 - RNA, 19 nt, Homo sapiens
gaacugccgaaacauugaa

SEQ ID NO: 860590 - RNA, 19 nt, Homo sapiens
ugaagaccuuugcacagaa

SEQ ID NO: 860591 - RNA, 19 nt, Homo sapiens
uuacagcccuggguuugaa

SEQ ID NO: 860592 - RNA, 19 nt, Homo sapiens
gaagaccuuugcacagaac

SEQ ID NO: 860593 - RNA, 19 nt, Homo sapiens
augaaggccuuauuaacaa

SEQ ID NO: 860594 - RNA, 19 nt, Homo sapiens
uacagcacauaacacauuu

SEQ ID NO: 860595 - RNA, 19 nt, Homo sapiens
gacaaguggucucaaugca

SEQ ID NO: 860596 - RNA, 19 nt, Homo sapiens
gcucggaauugccacgaau

SEQ ID NO: 860597 - RNA, 19 nt, Homo sapiens
augaauggaugcauguaaa

SEQ ID NO: 860598 - RNA, 19 nt, Homo sapiens
gaacaucuuagcccuggau

SEQ ID NO: 860599 - RNA, 19 nt, Homo sapiens
guggaaggcauguuaauag

SEQ ID NO: 860600 - RNA, 19 nt, Homo sapiens
cagaacugccgaaacauug

SEQ ID NO: 860601 - RNA, 19 nt, Homo sapiens
gagucuguguugccugauu

SEQ ID NO: 860602 - RNA, 19 nt, Homo sapiens
ucauccagcucuccauuca

SEQ ID NO: 860603 - RNA, 19 nt, Homo sapiens
gaacuguccgcgacugcaa

SEQ ID NO: 860604 - RNA, 19 nt, Homo sapiens
uugaagaccuuugcacaga

SEQ ID NO: 860605 - RNA, 19 nt, Homo sapiens
aggcuuaaguuaucuguag

SEQ ID NO: 860606 - RNA, 19 nt, Homo sapiens
gaagcucugguguaugcua

SEQ ID NO: 860607 - RNA, 19 nt, Homo sapiens
uguguugccugauuggaaa

SEQ ID NO: 860608 - RNA, 19 nt, Homo sapiens
ccucacagaugccucucuu

SEQ ID NO: 860609 - RNA, 19 nt, Homo sapiens
gaauuacugccaugagcuu

SEQ ID NO: 860610 - RNA, 19 nt, Homo sapiens
gaagaugaagcucugaaac

SEQ ID NO: 860611 - RNA, 19 nt, Homo sapiens
guaaugaauggaugcaugu

SEQ ID NO: 860612 - RNA, 19 nt, Homo sapiens
ccacuuugaagauaaauag

SEQ ID NO: 860613 - RNA, 19 nt, Homo sapiens
auacucagcauuccucaaa

SEQ ID NO: 860614 - RNA, 19 nt, Homo sapiens
aagcaacuggcaaagaaua

SEQ ID NO: 860615 - RNA, 19 nt, Homo sapiens
ucaaagccuugugucaguu

SEQ ID NO: 860616 - RNA, 19 nt, Homo sapiens
acagaugccucucuuacag

SEQ ID NO: 860617 - RNA, 19 nt, Homo sapiens
acugacagcacguguuaua

SEQ ID NO: 860618 - RNA, 19 nt, Homo sapiens
ucacuguccuaaacugcaa

SEQ ID NO: 860619 - RNA, 19 nt, Homo sapiens
uuacaaacagcuccuugaa

SEQ ID NO: 860620 - RNA, 19 nt, Homo sapiens
gcugaaacaucuggaucug

SEQ ID NO: 860621 - RNA, 19 nt, Homo sapiens
aguaaguguugguaccuuu

SEQ ID NO: 860622 - RNA, 19 nt, Homo sapiens
guccaugccucucguaaaa

SEQ ID NO: 860623 - RNA, 19 nt, Homo sapiens
gaagcaacuggcaaagaau

SEQ ID NO: 860624 - RNA, 19 nt, Homo sapiens
gugcaggugcugugucauu

SEQ ID NO: 860625 - RNA, 19 nt, Homo sapiens
gacaacugccuccucauca

SEQ ID NO: 860626 - RNA, 19 nt, Homo sapiens
gaugcucccauuugacuga

SEQ ID NO: 860627 - RNA, 19 nt, Homo sapiens
cgaaacauugaacauuuga

SEQ ID NO: 860628 - RNA, 19 nt, Homo sapiens
caccauagcuacucaaaag

SEQ ID NO: 860629 - RNA, 19 nt, Homo sapiens
uggaacaccuagagaacug

SEQ ID NO: 860630 - RNA, 19 nt, Homo sapiens
gaugugcacagauuuccaa

SEQ ID NO: 860631 - RNA, 19 nt, Homo sapiens
acagaacugccgaaacauu

SEQ ID NO: 860632 - RNA, 19 nt, Homo sapiens
gcuuaaguuaucuguagua

SEQ ID NO: 860633 - RNA, 19 nt, Homo sapiens
uagcacaaacugagcagaa

SEQ ID NO: 860634 - RNA, 19 nt, Homo sapiens
ucaaaucaaagccuugugu

SEQ ID NO: 860635 - RNA, 19 nt, Homo sapiens
gcaacuggcaaagaauaga

SEQ ID NO: 860636 - RNA, 19 nt, Homo sapiens
ccuuuauucugcugugaaa

SEQ ID NO: 860637 - RNA, 19 nt, Homo sapiens
gaacaagucagacaaauaa

SEQ ID NO: 860638 - RNA, 19 nt, Homo sapiens
acacagaccucgccauuga

SEQ ID NO: 860639 - RNA, 19 nt, Homo sapiens
gcaagggucugcaccauca

SEQ ID NO: 860640 - RNA, 19 nt, Homo sapiens
ggauggaccugacuuucaa

SEQ ID NO: 860641 - RNA, 19 nt, Homo sapiens
guaggucugugauaaagaa

SEQ ID NO: 860642 - RNA, 19 nt, Homo sapiens
ggagauggcucagcgacuu

SEQ ID NO: 860643 - RNA, 19 nt, Homo sapiens
caaacuagugagaguaaua

SEQ ID NO: 860644 - RNA, 19 nt, Homo sapiens
ccacugugcuggccaugaa

SEQ ID NO: 860645 - RNA, 19 nt, Homo sapiens
ggacgugguggacaaguuu

SEQ ID NO: 860646 - RNA, 19 nt, Homo sapiens
ggauauugaugaccacaca

SEQ ID NO: 860647 - RNA, 19 nt, Homo sapiens
ugaacaagucagacaaaua

SEQ ID NO: 860648 - RNA, 19 nt, Homo sapiens
gaacugugaacaagucaga

SEQ ID NO: 860649 - RNA, 19 nt, Homo sapiens
gauaaagaacuuagucauc

SEQ ID NO: 860650 - RNA, 19 nt, Homo sapiens
ccaccuacauuucucuuuc

SEQ ID NO: 860651 - RNA, 19 nt, Homo sapiens
caacccagcccggacaaua

SEQ ID NO: 860652 - RNA, 19 nt, Homo sapiens
ccacacagaccucgccauu

SEQ ID NO: 860653 - RNA, 19 nt, Homo sapiens
gggcugaacugugaacaag

SEQ ID NO: 860654 - RNA, 19 nt, Homo sapiens
uggccaagguggauauuga

SEQ ID NO: 860655 - RNA, 19 nt, Homo sapiens
gcugaacugugaacaaguc

SEQ ID NO: 860656 - RNA, 19 nt, Homo sapiens
gaagcugauuggcugacaa

SEQ ID NO: 860657 - RNA, 19 nt, Homo sapiens
ggucugugauaaagaacuu

SEQ ID NO: 860658 - RNA, 19 nt, Homo sapiens
gggccgagguuagagaaga

SEQ ID NO: 860659 - RNA, 19 nt, Homo sapiens
cuagugagaguaauaucua

SEQ ID NO: 860660 - RNA, 19 nt, Homo sapiens
gggacgugguggacaaguu

SEQ ID NO: 860661 - RNA, 19 nt, Homo sapiens
ccugguggccugacuguaa

SEQ ID NO: 860662 - RNA, 19 nt, Homo sapiens
gugaacaagucagacaaau

SEQ ID NO: 860663 - RNA, 19 nt, Homo sapiens
caauauacaccacgaggau

SEQ ID NO: 860664 - RNA, 19 nt, Homo sapiens
aaagaagcccaaacuagug

SEQ ID NO: 860665 - RNA, 19 nt, Homo sapiens
ugucagcggugcccacugu

SEQ ID NO: 860666 - RNA, 19 nt, Homo sapiens
ccaagguggauauugauga

SEQ ID NO: 860667 - RNA, 19 nt, Homo sapiens
ugacaaccuuuaauaucca

SEQ ID NO: 860668 - RNA, 19 nt, Homo sapiens
ucaaggaugaggaucaguu

SEQ ID NO: 860669 - RNA, 19 nt, Homo sapiens
caagguggauauugaugac

SEQ ID NO: 860670 - RNA, 19 nt, Homo sapiens
caaggaugaggaucaguug

SEQ ID NO: 860671 - RNA, 19 nt, Homo sapiens
agaagaugguggccaagca

SEQ ID NO: 860672 - RNA, 19 nt, Homo sapiens
gcccacagcguuccuaguc

SEQ ID NO: 860673 - RNA, 19 nt, Homo sapiens
gcaguucucccaggaugug

SEQ ID NO: 860674 - RNA, 19 nt, Homo sapiens
agaccucgccauugaguau

SEQ ID NO: 860675 - RNA, 19 nt, Homo sapiens
ggaucuccuugacaaccuu

SEQ ID NO: 860676 - RNA, 19 nt, Homo sapiens
cccaaacuagugagaguaa

SEQ ID NO: 860677 - RNA, 19 nt, Homo sapiens
ggccgagguuagagaagau

SEQ ID NO: 860678 - RNA, 19 nt, Homo sapiens
caagucagacaaauaaagc

SEQ ID NO: 860679 - RNA, 19 nt, Homo sapiens
uuagcuggcccguugguuu

SEQ ID NO: 860680 - RNA, 19 nt, Homo sapiens
aagaagcccaaacuaguga

SEQ ID NO: 860681 - RNA, 19 nt, Homo sapiens
ccucugucaucuccaggaa

SEQ ID NO: 860682 - RNA, 19 nt, Homo sapiens
gaagcccaaacuagugaga

SEQ ID NO: 860683 - RNA, 19 nt, Homo sapiens
ccaaacuagugagaguaau

SEQ ID NO: 860684 - RNA, 19 nt, Homo sapiens
gagccucgacuccggaagu

SEQ ID NO: 860685 - RNA, 19 nt, Homo sapiens
gugauaaagaacuuaguca

SEQ ID NO: 860686 - RNA, 19 nt, Homo sapiens
acaccuugguccucaucuu

SEQ ID NO: 860687 - RNA, 19 nt, Homo sapiens
gugcuggccaugaagaaug

SEQ ID NO: 860688 - RNA, 19 nt, Homo sapiens
gcccaaacuagugagagua

SEQ ID NO: 860689 - RNA, 19 nt, Homo sapiens
aaaagaagcccaaacuagu

SEQ ID NO: 860690 - RNA, 19 nt, Homo sapiens
caccuugguccucaucuug

SEQ ID NO: 860691 - RNA, 19 nt, Homo sapiens
uugacaaccuuuaauaucc

SEQ ID NO: 860692 - RNA, 19 nt, Homo sapiens
gcacgggaagguggugaug

SEQ ID NO: 860693 - RNA, 19 nt, Homo sapiens
acaagucagacaaauaaag

SEQ ID NO: 860694 - RNA, 19 nt, Homo sapiens
acacugaaauccccucuag

SEQ ID NO: 860695 - RNA, 19 nt, Homo sapiens
acccagcccggacaauaua

SEQ ID NO: 860696 - RNA, 19 nt, Homo sapiens
cuugacaaccuuuaauauc

SEQ ID NO: 860697 - RNA, 19 nt, Homo sapiens
gcugauuggcugacaagca

SEQ ID NO: 860698 - RNA, 19 nt, Homo sapiens
guuccuggccucugucauc

SEQ ID NO: 860699 - RNA, 19 nt, Homo sapiens
uauacuagcuccugacuua

SEQ ID NO: 860700 - RNA, 19 nt, Homo sapiens
gaggcuagcuugucacuuu

SEQ ID NO: 860701 - RNA, 19 nt, Homo sapiens
ugacagaagugagcaaaua

SEQ ID NO: 860702 - RNA, 19 nt, Homo sapiens
ggagaaaguuccaucaugu

SEQ ID NO: 860703 - RNA, 19 nt, Homo sapiens
ccagaaagccacucuauuu

SEQ ID NO: 860704 - RNA, 19 nt, Homo sapiens
caaauaaagugaggaagaa

SEQ ID NO: 860705 - RNA, 19 nt, Homo sapiens
gaguagcucuuuguacaua

SEQ ID NO: 860706 - RNA, 19 nt, Homo sapiens
gcaaauaaagugaggaaga

SEQ ID NO: 860707 - RNA, 19 nt, Homo sapiens
gaagugagcaaauaaagug

SEQ ID NO: 860708 - RNA, 19 nt, Homo sapiens
caaaguguccuggcauuua

SEQ ID NO: 860709 - RNA, 19 nt, Homo sapiens
ggaagagccucgugucaca

SEQ ID NO: 860710 - RNA, 19 nt, Homo sapiens
cagaaacacucacauguca

SEQ ID NO: 860711 - RNA, 19 nt, Homo sapiens
ggucaaguccgucaucuuu

SEQ ID NO: 860712 - RNA, 19 nt, Homo sapiens
gggcaccgcuucuguugaa

SEQ ID NO: 860713 - RNA, 19 nt, Homo sapiens
ccaugggccuucaggaaua

SEQ ID NO: 860714 - RNA, 19 nt, Homo sapiens
aaaguguccuggcauuuaa

SEQ ID NO: 860715 - RNA, 19 nt, Homo sapiens
cggaagugcuggcgccaua

SEQ ID NO: 860716 - RNA, 19 nt, Homo sapiens
gccaugaguuccaccagaa

SEQ ID NO: 860717 - RNA, 19 nt, Homo sapiens
gacagaagugagcaaauaa

SEQ ID NO: 860718 - RNA, 19 nt, Homo sapiens
gcuugucacuuucugcaaa

SEQ ID NO: 860719 - RNA, 19 nt, Homo sapiens
gcagucaccuggagaagcu

SEQ ID NO: 860720 - RNA, 19 nt, Homo sapiens
gagcaaauaaagugaggaa

SEQ ID NO: 860721 - RNA, 19 nt, Homo sapiens
guagcucuuuguacauaaa

SEQ ID NO: 860722 - RNA, 19 nt, Homo sapiens
ggcaaaguguccuggcauu

SEQ ID NO: 860723 - RNA, 19 nt, Homo sapiens
ggucugagucuccacguuu

SEQ ID NO: 860724 - RNA, 19 nt, Homo sapiens
gcaaaguguccuggcauuu

SEQ ID NO: 860725 - RNA, 19 nt, Homo sapiens
caaggucuaugcugacaag

SEQ ID NO: 860726 - RNA, 19 nt, Homo sapiens
gaguccagcuguauguaug

SEQ ID NO: 860727 - RNA, 19 nt, Homo sapiens
gagggugggugcagacaca

SEQ ID NO: 860728 - RNA, 19 nt, Homo sapiens
cauaaccuaccuugucuuu

SEQ ID NO: 860729 - RNA, 19 nt, Homo sapiens
gcucugaugaugaauucua

SEQ ID NO: 860730 - RNA, 19 nt, Homo sapiens
gaaagccacucuauuuugg

SEQ ID NO: 860731 - RNA, 19 nt, Homo sapiens
ccaaagugcugcugauucc

SEQ ID NO: 860732 - RNA, 19 nt, Homo sapiens
gggcuucucccucccguuu

SEQ ID NO: 860733 - RNA, 19 nt, Homo sapiens
ucacaugccaccagaucua

SEQ ID NO: 860734 - RNA, 19 nt, Homo sapiens
uuaaaugcgugacagaagu

SEQ ID NO: 860735 - RNA, 19 nt, Homo sapiens
cagcucugaugaugaauuc

SEQ ID NO: 860736 - RNA, 19 nt, Homo sapiens
gacagagucuccuaguuuu

SEQ ID NO: 860737 - RNA, 19 nt, Homo sapiens
cagccuguguuccugauga

SEQ ID NO: 860738 - RNA, 19 nt, Homo sapiens
ggagaagcugguaggguaa

SEQ ID NO: 860739 - RNA, 19 nt, Homo sapiens
acacugggagcaaggcuua

SEQ ID NO: 860740 - RNA, 19 nt, Homo sapiens
gaccagaaacacucacaug

SEQ ID NO: 860741 - RNA, 19 nt, Homo sapiens
uaccaggacuucaucaucu

SEQ ID NO: 860742 - RNA, 19 nt, Homo sapiens
ucaaguccgucaucuuucu

SEQ ID NO: 860743 - RNA, 19 nt, Homo sapiens
gcauuuaaaacccagauua

SEQ ID NO: 860744 - RNA, 19 nt, Homo sapiens
aggagaaaguuccaucaug

SEQ ID NO: 860745 - RNA, 19 nt, Homo sapiens
gugccuuagucacauauga

SEQ ID NO: 860746 - RNA, 19 nt, Homo sapiens
ugucggagaucagaggaaa

SEQ ID NO: 860747 - RNA, 19 nt, Homo sapiens
guaccuaggaggagaaagu

SEQ ID NO: 860748 - RNA, 19 nt, Homo sapiens
aaagugaggaagaaaucua

SEQ ID NO: 860749 - RNA, 19 nt, Homo sapiens
gaaacacucacaugucacu

SEQ ID NO: 860750 - RNA, 19 nt, Homo sapiens
gcaguucuguguggugaag

SEQ ID NO: 860751 - RNA, 19 nt, Homo sapiens
ccuuggucaucuauaauuu

SEQ ID NO: 860752 - RNA, 19 nt, Homo sapiens
ccaccuuuguccagugcua

SEQ ID NO: 860753 - RNA, 19 nt, Homo sapiens
aggccuuggucaucuauaa

SEQ ID NO: 860754 - RNA, 19 nt, Homo sapiens
cagauuaucccuggguuug

SEQ ID NO: 860755 - RNA, 19 nt, Homo sapiens
gaugcuggguccucucucu

SEQ ID NO: 860756 - RNA, 19 nt, Homo sapiens
ggaggagaaaguuccauca

SEQ ID NO: 860757 - RNA, 19 nt, Homo sapiens
ccaggcaccaugacaguga

SEQ ID NO: 860758 - RNA, 19 nt, Homo sapiens
ccagaaacacucacauguc

SEQ ID NO: 860759 - RNA, 19 nt, Homo sapiens
gugaggaagaaaucuauau

SEQ ID NO: 860760 - RNA, 19 nt, Homo sapiens
gguccuuccucgauagcuu

SEQ ID NO: 860761 - RNA, 19 nt, Homo sapiens
ugucugaccugggcucuuc

SEQ ID NO: 860762 - RNA, 19 nt, Homo sapiens
gauucccacucccuugguu

SEQ ID NO: 860763 - RNA, 19 nt, Homo sapiens
agacuuauuccaucggauu

SEQ ID NO: 860764 - RNA, 19 nt, Homo sapiens
ucaccaacgaccaguacua

SEQ ID NO: 860765 - RNA, 19 nt, Homo sapiens
acagaagugagcaaauaaa

SEQ ID NO: 860766 - RNA, 19 nt, Homo sapiens
caccagaaagccacucuau

SEQ ID NO: 860767 - RNA, 19 nt, Homo sapiens
gcaggcugggcuuauacua

SEQ ID NO: 860768 - RNA, 19 nt, Homo sapiens
gggccuucaggaauauuua

SEQ ID NO: 860769 - RNA, 19 nt, Homo sapiens
gagaaaguuccaucauguc

SEQ ID NO: 860770 - RNA, 19 nt, Homo sapiens
gccaaagugcugcugauuc

SEQ ID NO: 860771 - RNA, 19 nt, Homo sapiens
cccauugaguccagcugua

SEQ ID NO: 860772 - RNA, 19 nt, Homo sapiens
gaggagaaaguuccaucau

SEQ ID NO: 860773 - RNA, 19 nt, Homo sapiens
gaagagccucgugucacaa

SEQ ID NO: 860774 - RNA, 19 nt, Homo sapiens
gcuucucccucccguuuca

SEQ ID NO: 860775 - RNA, 19 nt, Homo sapiens
gcaggacgccauccacaac

SEQ ID NO: 860776 - RNA, 19 nt, Homo sapiens
gcucagccuccucuucuuc

SEQ ID NO: 860777 - RNA, 19 nt, Homo sapiens
uguaugauguaugagaaga

SEQ ID NO: 860778 - RNA, 19 nt, Homo sapiens
ccauggagcagccuguguu

SEQ ID NO: 860779 - RNA, 19 nt, Homo sapiens
ggacgccauccacaacuuc

SEQ ID NO: 860780 - RNA, 19 nt, Homo sapiens
gaccaucaucuacaacauc

SEQ ID NO: 860781 - RNA, 19 nt, Homo sapiens
cagaagugagcaaauaaag

SEQ ID NO: 860782 - RNA, 19 nt, Homo sapiens
uaugauguaugagaagaca

SEQ ID NO: 860783 - RNA, 19 nt, Homo sapiens
caccguggcuucccuucuc

SEQ ID NO: 860784 - RNA, 19 nt, Homo sapiens
cacaacacgugucccuaca

SEQ ID NO: 860785 - RNA, 19 nt, Homo sapiens
cuuggguccuuccucgaua

SEQ ID NO: 860786 - RNA, 19 nt, Homo sapiens
guguggagauguucuuugc

SEQ ID NO: 860787 - RNA, 19 nt, Homo sapiens
gccuuggucaucuauaauu

SEQ ID NO: 860788 - RNA, 19 nt, Homo sapiens
uuuggucccugugacauuu

SEQ ID NO: 860789 - RNA, 19 nt, Homo sapiens
cagaaagccacucuauuuu

SEQ ID NO: 860790 - RNA, 19 nt, Homo sapiens
uuccuggccuccuuccuuu

SEQ ID NO: 860791 - RNA, 19 nt, Homo sapiens
ccagacaccaggagucaca

SEQ ID NO: 860792 - RNA, 19 nt, Homo sapiens
caucacaugccaccagauc

SEQ ID NO: 860793 - RNA, 19 nt, Homo sapiens
uuucugagguucugcaaac

SEQ ID NO: 860794 - RNA, 19 nt, Homo sapiens
caucaugucggagaucaga

SEQ ID NO: 860795 - RNA, 19 nt, Homo sapiens
ucucuucugugccuuaguc

SEQ ID NO: 860796 - RNA, 19 nt, Homo sapiens
gcuggguccucucucucuu

SEQ ID NO: 860797 - RNA, 19 nt, Homo sapiens
caugggccuucaggaauau

SEQ ID NO: 860798 - RNA, 19 nt, Homo sapiens
caacgagcagcgcuacauc

SEQ ID NO: 860799 - RNA, 19 nt, Homo sapiens
ggauaaagccuguaauaua

SEQ ID NO: 860800 - RNA, 19 nt, Homo sapiens
gagcagaaauuguucacua

SEQ ID NO: 860801 - RNA, 19 nt, Homo sapiens
gaaaugagcagaaauuguu

SEQ ID NO: 860802 - RNA, 19 nt, Homo sapiens
ggacacuuguuuauucuga

SEQ ID NO: 860803 - RNA, 19 nt, Homo sapiens
agaaagaucucaggguuaa

SEQ ID NO: 860804 - RNA, 19 nt, Homo sapiens
ccaauggccuggaccguaa

SEQ ID NO: 860805 - RNA, 19 nt, Homo sapiens
gagggucgcugcuguggaa

SEQ ID NO: 860806 - RNA, 19 nt, Homo sapiens
gagggaggcugcuuucugu

SEQ ID NO: 860807 - RNA, 19 nt, Homo sapiens
gagaucggcuugaugaaca

SEQ ID NO: 860808 - RNA, 19 nt, Homo sapiens
gaugagaucggcuugauga

SEQ ID NO: 860809 - RNA, 19 nt, Homo sapiens
gcagaugcuuaauaguaaa

SEQ ID NO: 860810 - RNA, 19 nt, Homo sapiens
ccacagccuuacuuuguuu

SEQ ID NO: 860811 - RNA, 19 nt, Homo sapiens
ggugaggucuuuauugcuu

SEQ ID NO: 860812 - RNA, 19 nt, Homo sapiens
ugacggaguucacuucuuc

SEQ ID NO: 860813 - RNA, 19 nt, Homo sapiens
ggaagcagcgugugaaaca

SEQ ID NO: 860814 - RNA, 19 nt, Homo sapiens
gagaacagaggaugaguug

SEQ ID NO: 860815 - RNA, 19 nt, Homo sapiens
ugaaacggguguagagaga

SEQ ID NO: 860816 - RNA, 19 nt, Homo sapiens
gaauucugccggagguuua

SEQ ID NO: 860817 - RNA, 19 nt, Homo sapiens
uugcuucacugccuaauuu

SEQ ID NO: 860818 - RNA, 19 nt, Homo sapiens
cgaggcaccuuucaagaau

SEQ ID NO: 860819 - RNA, 19 nt, Homo sapiens
gaaucuggacacuuguuua

SEQ ID NO: 860820 - RNA, 19 nt, Homo sapiens
gcagcugucucgccuuuag

SEQ ID NO: 860821 - RNA, 19 nt, Homo sapiens
gugcuugcuugcaucuuua

SEQ ID NO: 860822 - RNA, 19 nt, Homo sapiens
cuggaaaucuacauaaaug

SEQ ID NO: 860823 - RNA, 19 nt, Homo sapiens
ggaggcugcuuucugugaa

SEQ ID NO: 860824 - RNA, 19 nt, Homo sapiens
gaguugcgcucggaauuug

SEQ ID NO: 860825 - RNA, 19 nt, Homo sapiens
ucucaggguuaacucuuua

SEQ ID NO: 860826 - RNA, 19 nt, Homo sapiens
guaaggauaaagccuguaa

SEQ ID NO: 860827 - RNA, 19 nt, Homo sapiens
uggagcagcuggccagauu

SEQ ID NO: 860828 - RNA, 19 nt, Homo sapiens
gagcaaguacuucgaguuc

SEQ ID NO: 860829 - RNA, 19 nt, Homo sapiens
gccauucuguucucacuug

SEQ ID NO: 860830 - RNA, 19 nt, Homo sapiens
caaccugcaugcucacaau

SEQ ID NO: 860831 - RNA, 19 nt, Homo sapiens
ccucugaccuccacaaugg

SEQ ID NO: 860832 - RNA, 19 nt, Homo sapiens
gcaaguacuucgaguucca

SEQ ID NO: 860833 - RNA, 19 nt, Homo sapiens
gaagugauagccuacuaau

SEQ ID NO: 860834 - RNA, 19 nt, Homo sapiens
uacaaacagucuccacauu

SEQ ID NO: 860835 - RNA, 19 nt, Homo sapiens
cuccaugucugauuacaaa

SEQ ID NO: 860836 - RNA, 19 nt, Homo sapiens
gccggagguuuaugaauga

SEQ ID NO: 860837 - RNA, 19 nt, Homo sapiens
acuccaaggucaucuauau

SEQ ID NO: 860838 - RNA, 19 nt, Homo sapiens
ucauuuauguggcuggaaa

SEQ ID NO: 860839 - RNA, 19 nt, Homo sapiens
gcgggaagauggaggagau

SEQ ID NO: 860840 - RNA, 19 nt, Homo sapiens
aaggauaaagccuguaaua

SEQ ID NO: 860841 - RNA, 19 nt, Homo sapiens
caaacagucuccacauugc

SEQ ID NO: 860842 - RNA, 19 nt, Homo sapiens
guagagagaagcuuguguu

SEQ ID NO: 860843 - RNA, 19 nt, Homo sapiens
caaaaguccuguaugcauu

SEQ ID NO: 860844 - RNA, 19 nt, Homo sapiens
uggaggagaucgccaacuu

SEQ ID NO: 860845 - RNA, 19 nt, Homo sapiens
ucuggacacuuguuuauuc

SEQ ID NO: 860846 - RNA, 19 nt, Homo sapiens
ggaaucuggacacuuguuu

SEQ ID NO: 860847 - RNA, 19 nt, Homo sapiens
aagcagcugucucgccuuu

SEQ ID NO: 860848 - RNA, 19 nt, Homo sapiens
ucucaaguaugaagacaug

SEQ ID NO: 860849 - RNA, 19 nt, Homo sapiens
gguugucugucauuuaugu

SEQ ID NO: 860850 - RNA, 19 nt, Homo sapiens
ucacuggaaaucuacauaa

SEQ ID NO: 860851 - RNA, 19 nt, Homo sapiens
gaguugggcuguggaagga

SEQ ID NO: 860852 - RNA, 19 nt, Homo sapiens
uuacugagcacuacacaug

SEQ ID NO: 860853 - RNA, 19 nt, Homo sapiens
uagaaagaucucaggguua

SEQ ID NO: 860854 - RNA, 19 nt, Homo sapiens
cacuggaaaucuacauaaa

SEQ ID NO: 860855 - RNA, 19 nt, Homo sapiens
ggagggagugugaugauuc

SEQ ID NO: 860856 - RNA, 19 nt, Homo sapiens
gaggcaccuuucaagaauu

SEQ ID NO: 860857 - RNA, 19 nt, Homo sapiens
acaaacagucuccacauug

SEQ ID NO: 860858 - RNA, 19 nt, Homo sapiens
gaucugguggugucuuauu

SEQ ID NO: 860859 - RNA, 19 nt, Homo sapiens
gaggaugaguugggucugu

SEQ ID NO: 860860 - RNA, 19 nt, Homo sapiens
gggcuacggcuccugguuu

SEQ ID NO: 860861 - RNA, 19 nt, Homo sapiens
ggccuggaccguaaggaua

SEQ ID NO: 860862 - RNA, 19 nt, Homo sapiens
ugccggagguuuaugaaug

SEQ ID NO: 860863 - RNA, 19 nt, Homo sapiens
gaaggggucuccguucuug

SEQ ID NO: 860864 - RNA, 19 nt, Homo sapiens
gccucuccaugucugauua

SEQ ID NO: 860865 - RNA, 19 nt, Homo sapiens
ugaccucacguuugacuuu

SEQ ID NO: 860866 - RNA, 19 nt, Homo sapiens
ugacaaggcccagcuggaa

SEQ ID NO: 860867 - RNA, 19 nt, Homo sapiens
cagaaauuguucacuaggu

SEQ ID NO: 860868 - RNA, 19 nt, Homo sapiens
ccugaaaugagcagaaauu

SEQ ID NO: 860869 - RNA, 19 nt, Homo sapiens
gaagaguugggcuguggaa

SEQ ID NO: 860870 - RNA, 19 nt, Homo sapiens
ugugcuugcuugcaucuuu

SEQ ID NO: 860871 - RNA, 19 nt, Homo sapiens
uuuguuuccugaagugaua

SEQ ID NO: 860872 - RNA, 19 nt, Homo sapiens
gcaggagguggucuacuug

SEQ ID NO: 860873 - RNA, 19 nt, Homo sapiens
aguuugacuugguguauaa

SEQ ID NO: 860874 - RNA, 19 nt, Homo sapiens
ugcaggagguggucuacuu

SEQ ID NO: 860875 - RNA, 19 nt, Homo sapiens
gggaggcugcuuucuguga

SEQ ID NO: 860876 - RNA, 19 nt, Homo sapiens
gaauuccacagccuuacuu

SEQ ID NO: 860877 - RNA, 19 nt, Homo sapiens
uaaagccuguaauauaugc

SEQ ID NO: 860878 - RNA, 19 nt, Homo sapiens
ccaccugcccuaccgcuuu

SEQ ID NO: 860879 - RNA, 19 nt, Homo sapiens
aggaucugguggugucuua

SEQ ID NO: 860880 - RNA, 19 nt, Homo sapiens
ccguguaucugagggagua

SEQ ID NO: 860881 - RNA, 19 nt, Homo sapiens
cugaagugauagccuacua

SEQ ID NO: 860882 - RNA, 19 nt, Homo sapiens
gguggugucuuauuaucag

SEQ ID NO: 860883 - RNA, 19 nt, Homo sapiens
ucacuugguucugagauag

SEQ ID NO: 860884 - RNA, 19 nt, Homo sapiens
caggguuaacucuuuauuu

SEQ ID NO: 860885 - RNA, 19 nt, Homo sapiens
ccuguaauauaugcaacua

SEQ ID NO: 860886 - RNA, 19 nt, Homo sapiens
gcaccuugccuguguuucu

SEQ ID NO: 860887 - RNA, 19 nt, Homo sapiens
cacuaggucuucagaaugg

SEQ ID NO: 860888 - RNA, 19 nt, Homo sapiens
ccgaggcaccuuucaagaa

SEQ ID NO: 860889 - RNA, 19 nt, Homo sapiens
gagcuaccgaggcaccuuu

SEQ ID NO: 860890 - RNA, 19 nt, Homo sapiens
gagcggagggagugugaug

SEQ ID NO: 860891 - RNA, 19 nt, Homo sapiens
ggcuacggcuccugguuug

SEQ ID NO: 860892 - RNA, 19 nt, Homo sapiens
ucacuaggucuucagaaug

SEQ ID NO: 860893 - RNA, 19 nt, Homo sapiens
ugaaaugagcagaaauugu

SEQ ID NO: 860894 - RNA, 19 nt, Homo sapiens
gccuggacaucaucaagga

SEQ ID NO: 860895 - RNA, 19 nt, Homo sapiens
ccaugaaugagaaguuuga

SEQ ID NO: 860896 - RNA, 19 nt, Homo sapiens
ggaguaaaggugaggucuu

SEQ ID NO: 860897 - RNA, 19 nt, Homo sapiens
ugaagugauagccuacuaa

SEQ ID NO: 860898 - RNA, 19 nt, Homo sapiens
gagagucggccaccaaagg

SEQ ID NO: 860899 - RNA, 19 nt, Homo sapiens
gagaagagguuucaagaua

SEQ ID NO: 860900 - RNA, 19 nt, Homo sapiens
gcacacagauaucaagaug

SEQ ID NO: 860901 - RNA, 19 nt, Homo sapiens
caacaaugaugguggcaaa

SEQ ID NO: 860902 - RNA, 19 nt, Homo sapiens
cuaggaaacuguugagauu

SEQ ID NO: 860903 - RNA, 19 nt, Homo sapiens
gaaucucacuguuccuaaa

SEQ ID NO: 860904 - RNA, 19 nt, Homo sapiens
gcaaaguaccuguauauag

SEQ ID NO: 860905 - RNA, 19 nt, Homo sapiens
caaaguaccuguauauagc

SEQ ID NO: 860906 - RNA, 19 nt, Homo sapiens
ggaaucaugccuucuauau

SEQ ID NO: 860907 - RNA, 19 nt, Homo sapiens
ucaaggaccugccaugaug

SEQ ID NO: 860908 - RNA, 19 nt, Homo sapiens
agaagagguuucaagauaa

SEQ ID NO: 860909 - RNA, 19 nt, Homo sapiens
ccaaaugucugggcuaaau

SEQ ID NO: 860910 - RNA, 19 nt, Homo sapiens
gaaucaugccuucuauaua

SEQ ID NO: 860911 - RNA, 19 nt, Homo sapiens
gauccaaacugugauugaa

SEQ ID NO: 860912 - RNA, 19 nt, Homo sapiens
ucgaggagcuggagaaguu

SEQ ID NO: 860913 - RNA, 19 nt, Homo sapiens
caaugaugguggcaaagua

SEQ ID NO: 860914 - RNA, 19 nt, Homo sapiens
ccaccuaccuccacugaga

SEQ ID NO: 860915 - RNA, 19 nt, Homo sapiens
uuccagaaaugguaacuua

SEQ ID NO: 860916 - RNA, 19 nt, Homo sapiens
cagcuucacuguggcaaua

SEQ ID NO: 860917 - RNA, 19 nt, Homo sapiens
ggaagaaaaucuccacuau

SEQ ID NO: 860918 - RNA, 19 nt, Homo sapiens
uaccaugccuggaacagua

SEQ ID NO: 860919 - RNA, 19 nt, Homo sapiens
gaagagguuucaagauaac

SEQ ID NO: 860920 - RNA, 19 nt, Homo sapiens
cagccucagugaaguauuu

SEQ ID NO: 860921 - RNA, 19 nt, Homo sapiens
gaaauaccaaagugugaaa

SEQ ID NO: 860922 - RNA, 19 nt, Homo sapiens
caccaaagccuugauguuu

SEQ ID NO: 860923 - RNA, 19 nt, Homo sapiens
aaucaugccuucuauauac

SEQ ID NO: 860924 - RNA, 19 nt, Homo sapiens
ucaaaggaaucucacuguu

SEQ ID NO: 860925 - RNA, 19 nt, Homo sapiens
cuaaugcucuugaaauaca

SEQ ID NO: 860926 - RNA, 19 nt, Homo sapiens
gaaagaaacggaccagcau

SEQ ID NO: 860927 - RNA, 19 nt, Homo sapiens
gauuucaacaggcagauua

SEQ ID NO: 860928 - RNA, 19 nt, Homo sapiens
gggaaucuuuguugacuuc

SEQ ID NO: 860929 - RNA, 19 nt, Homo sapiens
ccagaaaugguaacuuaaa

SEQ ID NO: 860930 - RNA, 19 nt, Homo sapiens
gaacacaagagcaaacaca

SEQ ID NO: 860931 - RNA, 19 nt, Homo sapiens
gagcaaacacacaacaaug

SEQ ID NO: 860932 - RNA, 19 nt, Homo sapiens
ccuaggagcuuaccauuuu

SEQ ID NO: 860933 - RNA, 19 nt, Homo sapiens
ccucucaaguagcggauua

SEQ ID NO: 860934 - RNA, 19 nt, Homo sapiens
auauagcccuuucccauuu

SEQ ID NO: 860935 - RNA, 19 nt, Homo sapiens
gccaggauccucuuuagaa

SEQ ID NO: 860936 - RNA, 19 nt, Homo sapiens
uccuaaugcucuugaaaua

SEQ ID NO: 860937 - RNA, 19 nt, Homo sapiens
ggagugcaguggcaugauc

SEQ ID NO: 860938 - RNA, 19 nt, Homo sapiens
acacagauaucaagaugag

SEQ ID NO: 860939 - RNA, 19 nt, Homo sapiens
caaaggaaucucacuguuc

SEQ ID NO: 860940 - RNA, 19 nt, Homo sapiens
ccuaugcccuugccuucua

SEQ ID NO: 860941 - RNA, 19 nt, Homo sapiens
ggaccagcaucgagaccaa

SEQ ID NO: 860942 - RNA, 19 nt, Homo sapiens
ggaaauaccaaagugugaa

SEQ ID NO: 860943 - RNA, 19 nt, Homo sapiens
uaaaagagcugcccuuggu

SEQ ID NO: 860944 - RNA, 19 nt, Homo sapiens
caaaccaccugucuacaac

SEQ ID NO: 860945 - RNA, 19 nt, Homo sapiens
aaccugagcuucaagaaca

SEQ ID NO: 860946 - RNA, 19 nt, Homo sapiens
caggagugcuuguucuuuc

SEQ ID NO: 860947 - RNA, 19 nt, Homo sapiens
gagaaguggcugaaugaug

SEQ ID NO: 860948 - RNA, 19 nt, Homo sapiens
ucucacuguuccuaaauaa

SEQ ID NO: 860949 - RNA, 19 nt, Homo sapiens
aagaaaaucuccacuauca

SEQ ID NO: 860950 - RNA, 19 nt, Homo sapiens
ggaacauuaucucuagagu

SEQ ID NO: 860951 - RNA, 19 nt, Homo sapiens
gcaaacacacaacaaugau

SEQ ID NO: 860952 - RNA, 19 nt, Homo sapiens
gcccuggguuucucuuuau

SEQ ID NO: 860953 - RNA, 19 nt, Homo sapiens
ucugauaucuccaccaaag

SEQ ID NO: 860954 - RNA, 19 nt, Homo sapiens
caaugaacccagacucuug

SEQ ID NO: 860955 - RNA, 19 nt, Homo sapiens
gaaaaucuccacuaucaau

SEQ ID NO: 860956 - RNA, 19 nt, Homo sapiens
aaucugauaucuccaccaa

SEQ ID NO: 860957 - RNA, 19 nt, Homo sapiens
ggagaagagguuucaagau

SEQ ID NO: 860958 - RNA, 19 nt, Homo sapiens
gggaaauaccaaaguguga

SEQ ID NO: 860959 - RNA, 19 nt, Homo sapiens
ggaagaacacaagagcaaa

SEQ ID NO: 860960 - RNA, 19 nt, Homo sapiens
ggagauccaaacugugauu

SEQ ID NO: 860961 - RNA, 19 nt, Homo sapiens
ucaaaccaccugucuacaa

SEQ ID NO: 860962 - RNA, 19 nt, Homo sapiens
aacauuaucucuagagucu

SEQ ID NO: 860963 - RNA, 19 nt, Homo sapiens
cgcccuggguuucucuuua

SEQ ID NO: 860964 - RNA, 19 nt, Homo sapiens
gaaucuuuguugacuucuu

SEQ ID NO: 860965 - RNA, 19 nt, Homo sapiens
ggcaaaguaccuguauaua

SEQ ID NO: 860966 - RNA, 19 nt, Homo sapiens
gaacugaucccaaaaucug

SEQ ID NO: 860967 - RNA, 19 nt, Homo sapiens
caugaagccauuccagaaa

SEQ ID NO: 860968 - RNA, 19 nt, Homo sapiens
gcucaggagugcuuguucu

SEQ ID NO: 860969 - RNA, 19 nt, Homo sapiens
ugacuucuuugggaacauu

SEQ ID NO: 860970 - RNA, 19 nt, Homo sapiens
gggcugggaaucuuuguug

SEQ ID NO: 860971 - RNA, 19 nt, Homo sapiens
gaagaacacaagagcaaac

SEQ ID NO: 860972 - RNA, 19 nt, Homo sapiens
gggaaucaugccuucuaua

SEQ ID NO: 860973 - RNA, 19 nt, Homo sapiens
aaccaaaugucugggcuaa

SEQ ID NO: 860974 - RNA, 19 nt, Homo sapiens
aggaaacuguugagauuca

SEQ ID NO: 860975 - RNA, 19 nt, Homo sapiens
uauauagcccuuucccauu

SEQ ID NO: 860976 - RNA, 19 nt, Homo sapiens
guggcaaaguaccuguaua

SEQ ID NO: 860977 - RNA, 19 nt, Homo sapiens
caaauccauucauuauugc

SEQ ID NO: 860978 - RNA, 19 nt, Homo sapiens
caucaaaccaccugucuac

SEQ ID NO: 860979 - RNA, 19 nt, Homo sapiens
cagagcaguuguccaugga

SEQ ID NO: 860980 - RNA, 19 nt, Homo sapiens
cuacaugucuaggaaacug

SEQ ID NO: 860981 - RNA, 19 nt, Homo sapiens
ugccucagccucucaagua

SEQ ID NO: 860982 - RNA, 19 nt, Homo sapiens
uggcaaaguaccuguauau

SEQ ID NO: 860983 - RNA, 19 nt, Homo sapiens
ccaccaaagccuugauguu

SEQ ID NO: 860984 - RNA, 19 nt, Homo sapiens
gcagacuccuaaugcucuu

SEQ ID NO: 860985 - RNA, 19 nt, Homo sapiens
cuacaacucccggcuggua

SEQ ID NO: 860986 - RNA, 19 nt, Homo sapiens
ccggagauccaaacuguga

SEQ ID NO: 860987 - RNA, 19 nt, Homo sapiens
gccaguuuguagagaugua

SEQ ID NO: 860988 - RNA, 19 nt, Homo sapiens
ugugcuaccuuccagaguu

SEQ ID NO: 860989 - RNA, 19 nt, Homo sapiens
gcuaaaugccagcccaugu

SEQ ID NO: 860990 - RNA, 19 nt, Homo sapiens
ccuucuaguuccaaauauu

SEQ ID NO: 860991 - RNA, 19 nt, Homo sapiens
caagugcagacuccuaaug

SEQ ID NO: 860992 - RNA, 19 nt, Homo sapiens
aaaccgaagaucucaguga

SEQ ID NO: 860993 - RNA, 19 nt, Homo sapiens
cuggagaaguggcugaaug

SEQ ID NO: 860994 - RNA, 19 nt, Homo sapiens
gaacaugugcaagcucaag

SEQ ID NO: 860995 - RNA, 19 nt, Homo sapiens
gaccaccaucucacgauuu

SEQ ID NO: 860996 - RNA, 19 nt, Homo sapiens
caaacacacaacaaugaug

SEQ ID NO: 860997 - RNA, 19 nt, Homo sapiens
cacaagagcaaacacacaa

SEQ ID NO: 860998 - RNA, 19 nt, Homo sapiens
gccaggaaaugaucgaaaa

SEQ ID NO: 860999 - RNA, 19 nt, Homo sapiens
gcaggaagauuaaugguua

SEQ ID NO: 861000 - RNA, 19 nt, Homo sapiens
gaaguggugucuuuacaua

SEQ ID NO: 861001 - RNA, 19 nt, Homo sapiens
agaauaagcugaaggauga

SEQ ID NO: 861002 - RNA, 19 nt, Homo sapiens
ggaaggacauggucagauu

SEQ ID NO: 861003 - RNA, 19 nt, Homo sapiens
gcaaagggauccagaagau

SEQ ID NO: 861004 - RNA, 19 nt, Homo sapiens
gaaaggcuaucucuacaga

SEQ ID NO: 861005 - RNA, 19 nt, Homo sapiens
gaauaucagucuauagcua

SEQ ID NO: 861006 - RNA, 19 nt, Homo sapiens
caaaaggaauggcuaauua

SEQ ID NO: 861007 - RNA, 19 nt, Homo sapiens
gaaugaaacucuccaucaa

SEQ ID NO: 861008 - RNA, 19 nt, Homo sapiens
ggaaugauaaucugguuua

SEQ ID NO: 861009 - RNA, 19 nt, Homo sapiens
gaagauagagucaaauuuc

SEQ ID NO: 861010 - RNA, 19 nt, Homo sapiens
gaggauauaugucaccaaa

SEQ ID NO: 861011 - RNA, 19 nt, Homo sapiens
ggucagauuuguuguaaga

SEQ ID NO: 861012 - RNA, 19 nt, Homo sapiens
cuagagagcugucacauuc

SEQ ID NO: 861013 - RNA, 19 nt, Homo sapiens
gaaggagacaaacaacuua

SEQ ID NO: 861014 - RNA, 19 nt, Homo sapiens
cagaggauauugccaguuu

SEQ ID NO: 861015 - RNA, 19 nt, Homo sapiens
gaaauuugcgcaccauauu

SEQ ID NO: 861016 - RNA, 19 nt, Homo sapiens
ggagacaaacaacuuauaa

SEQ ID NO: 861017 - RNA, 19 nt, Homo sapiens
gcacaugggcuauuauuca

SEQ ID NO: 861018 - RNA, 19 nt, Homo sapiens
uagcaagguugaagcuuua

SEQ ID NO: 861019 - RNA, 19 nt, Homo sapiens
ggcaauagaucagaggaua

SEQ ID NO: 861020 - RNA, 19 nt, Homo sapiens
gaacugagcccagggaaug

SEQ ID NO: 861021 - RNA, 19 nt, Homo sapiens
ucauagaaguggugucuuu

SEQ ID NO: 861022 - RNA, 19 nt, Homo sapiens
guauauacuuccucaagaa

SEQ ID NO: 861023 - RNA, 19 nt, Homo sapiens
gaaaggguaauaugaaaga

SEQ ID NO: 861024 - RNA, 19 nt, Homo sapiens
gaaguugaauaucagucua

SEQ ID NO: 861025 - RNA, 19 nt, Homo sapiens
ggagacaauguucuaguua

SEQ ID NO: 861026 - RNA, 19 nt, Homo sapiens
gaagaugcaagguauuauu

SEQ ID NO: 861027 - RNA, 19 nt, Homo sapiens
acaguuggguggaaugaua

SEQ ID NO: 861028 - RNA, 19 nt, Homo sapiens
acaaagggacggagaauaa

SEQ ID NO: 861029 - RNA, 19 nt, Homo sapiens
ggaaugaaacucuccauca

SEQ ID NO: 861030 - RNA, 19 nt, Homo sapiens
caaaggagacaauguucua

SEQ ID NO: 861031 - RNA, 19 nt, Homo sapiens
ggaaggagacaaacaacuu

SEQ ID NO: 861032 - RNA, 19 nt, Homo sapiens
uaugacagcgucuuucuua

SEQ ID NO: 861033 - RNA, 19 nt, Homo sapiens
cauuugacauuccugauaa

SEQ ID NO: 861034 - RNA, 19 nt, Homo sapiens
guucauacuuucaaggauu

SEQ ID NO: 861035 - RNA, 19 nt, Homo sapiens
gaagcuuuauccacucuga

SEQ ID NO: 861036 - RNA, 19 nt, Homo sapiens
ggaucugucuuucaaacaa

SEQ ID NO: 861037 - RNA, 19 nt, Homo sapiens
cgucugaaguugaauauca

SEQ ID NO: 861038 - RNA, 19 nt, Homo sapiens
caauggaugggauauguua

SEQ ID NO: 861039 - RNA, 19 nt, Homo sapiens
uaacugccaucaagaaagu

SEQ ID NO: 861040 - RNA, 19 nt, Homo sapiens
uuaagcaucugugggaaua

SEQ ID NO: 861041 - RNA, 19 nt, Homo sapiens
ggaaacuauuuacuugaga

SEQ ID NO: 861042 - RNA, 19 nt, Homo sapiens
gaaagcaauggaugggaua

SEQ ID NO: 861043 - RNA, 19 nt, Homo sapiens
aagcuuggcuacauuggua

SEQ ID NO: 861044 - RNA, 19 nt, Homo sapiens
uagcagacuuuaauucuuc

SEQ ID NO: 861045 - RNA, 19 nt, Homo sapiens
ggaaacauccacacaucaa

SEQ ID NO: 861046 - RNA, 19 nt, Homo sapiens
gaugcaagguauuauuuag

SEQ ID NO: 861047 - RNA, 19 nt, Homo sapiens
cagaagaugcaagguauua

SEQ ID NO: 861048 - RNA, 19 nt, Homo sapiens
ggacggagaauaagcugaa

SEQ ID NO: 861049 - RNA, 19 nt, Homo sapiens
agaaagcgguaucuuacaa

SEQ ID NO: 861050 - RNA, 19 nt, Homo sapiens
gcugucacauuccaagaaa

SEQ ID NO: 861051 - RNA, 19 nt, Homo sapiens
gauuggcuauugacucauu

SEQ ID NO: 861052 - RNA, 19 nt, Homo sapiens
agaaaugccuugugauugg

SEQ ID NO: 861053 - RNA, 19 nt, Homo sapiens
gaacuuguacauugaagau

SEQ ID NO: 861054 - RNA, 19 nt, Homo sapiens
ucgaaaggguaauaugaaa

SEQ ID NO: 861055 - RNA, 19 nt, Homo sapiens
gugauuggcuauugacuca

SEQ ID NO: 861056 - RNA, 19 nt, Homo sapiens
aauccuagauggccuuaaa

SEQ ID NO: 861057 - RNA, 19 nt, Homo sapiens
augaagagcugaaggaaau

SEQ ID NO: 861058 - RNA, 19 nt, Homo sapiens
cucaagaacugauaauuca

SEQ ID NO: 861059 - RNA, 19 nt, Homo sapiens
ggacuucuuagccaauuaa

SEQ ID NO: 861060 - RNA, 19 nt, Homo sapiens
gcaagucuguacaccaaca

SEQ ID NO: 861061 - RNA, 19 nt, Homo sapiens
gaaacucuccaucaaguca

SEQ ID NO: 861062 - RNA, 19 nt, Homo sapiens
caauuggacuuucuucagu

SEQ ID NO: 861063 - RNA, 19 nt, Homo sapiens
gaagaucggcaaaaugaua

SEQ ID NO: 861064 - RNA, 19 nt, Homo sapiens
acaguaguguugaugagua

SEQ ID NO: 861065 - RNA, 19 nt, Homo sapiens
cuacauugguaaacucuau

SEQ ID NO: 861066 - RNA, 19 nt, Homo sapiens
caaauuucguuccaagcaa

SEQ ID NO: 861067 - RNA, 19 nt, Homo sapiens
gaagagcugaaggaaauuu

SEQ ID NO: 861068 - RNA, 19 nt, Homo sapiens
ggacauggucagauuuguu

SEQ ID NO: 861069 - RNA, 19 nt, Homo sapiens
ugaaaugucagguguaaau

SEQ ID NO: 861070 - RNA, 19 nt, Homo sapiens
gaaggacauggucagauuu

SEQ ID NO: 861071 - RNA, 19 nt, Homo sapiens
gagacaauguucuaguuac

SEQ ID NO: 861072 - RNA, 19 nt, Homo sapiens
gcugaaggaugaugauuuu

SEQ ID NO: 861073 - RNA, 19 nt, Homo sapiens
aagcaucugugggaauaua

SEQ ID NO: 861074 - RNA, 19 nt, Homo sapiens
gaugggauauguuaaaaga

SEQ ID NO: 861075 - RNA, 19 nt, Homo sapiens
cuggguaacucuugaauuc

SEQ ID NO: 861076 - RNA, 19 nt, Homo sapiens
ugaagaugauguucgaugu

SEQ ID NO: 861077 - RNA, 19 nt, Homo sapiens
aaggcuaucucuacagaaa

SEQ ID NO: 861078 - RNA, 19 nt, Homo sapiens
gaaagcacagcccugauuc

SEQ ID NO: 861079 - RNA, 19 nt, Homo sapiens
gaagaugauguucgauguu

SEQ ID NO: 861080 - RNA, 19 nt, Homo sapiens
cagaagauagagucaaauu

SEQ ID NO: 861081 - RNA, 19 nt, Homo sapiens
uuacaaugauccagaagau

SEQ ID NO: 861082 - RNA, 19 nt, Homo sapiens
aaagcgguaucuuacaauu

SEQ ID NO: 861083 - RNA, 19 nt, Homo sapiens
gaaggaugaugauuuugaa

SEQ ID NO: 861084 - RNA, 19 nt, Homo sapiens
gguaaacucuaucauucuc

SEQ ID NO: 861085 - RNA, 19 nt, Homo sapiens
ccauaaaugucaccuaucg

SEQ ID NO: 861086 - RNA, 19 nt, Homo sapiens
gaugggaacuggagaucag

SEQ ID NO: 861087 - RNA, 19 nt, Homo sapiens
gaauucagaacgcuauguu

SEQ ID NO: 861088 - RNA, 19 nt, Homo sapiens
aaaaugagaugccugagaa

SEQ ID NO: 861089 - RNA, 19 nt, Homo sapiens
uaucaacgguuucuguaca

SEQ ID NO: 861090 - RNA, 19 nt, Homo sapiens
ucagccagaucacuuguau

SEQ ID NO: 861091 - RNA, 19 nt, Homo sapiens
ccacacaucaacugaauuc

SEQ ID NO: 861092 - RNA, 19 nt, Homo sapiens
auagcaagguugaagcuuu

SEQ ID NO: 861093 - RNA, 19 nt, Homo sapiens
uaacgucugaaguugaaua

SEQ ID NO: 861094 - RNA, 19 nt, Homo sapiens
cucaugaucucccacguuu

SEQ ID NO: 861095 - RNA, 19 nt, Homo sapiens
cauugaagauagcuauguu

SEQ ID NO: 861096 - RNA, 19 nt, Homo sapiens
gaauaccuccucauagaag

SEQ ID NO: 861097 - RNA, 19 nt, Homo sapiens
guacaucuacaaugaauac

SEQ ID NO: 861098 - RNA, 19 nt, Homo sapiens
gcuugaagaugauguucga

SEQ ID NO: 861099 - RNA, 19 nt, Homo sapiens
gaagagccguuguuuauaa

SEQ ID NO: 861100 - RNA, 19 nt, Homo sapiens
gaagaaagcuuguacucaa

SEQ ID NO: 861101 - RNA, 19 nt, Homo sapiens
gauaagaacuccucaguca

SEQ ID NO: 861102 - RNA, 19 nt, Homo sapiens
gcccagagcuuugauauuu

SEQ ID NO: 861103 - RNA, 19 nt, Homo sapiens
ggagagaccuuauuaugga

SEQ ID NO: 861104 - RNA, 19 nt, Homo sapiens
gaaaguagauuagcagaau

SEQ ID NO: 861105 - RNA, 19 nt, Homo sapiens
gaaguucccuuaaaccuau

SEQ ID NO: 861106 - RNA, 19 nt, Homo sapiens
ggauaaagauggcaauguu

SEQ ID NO: 861107 - RNA, 19 nt, Homo sapiens
cagaagaacuuaaacagaa

SEQ ID NO: 861108 - RNA, 19 nt, Homo sapiens
caacagagauggcuuuaag

SEQ ID NO: 861109 - RNA, 19 nt, Homo sapiens
gaaacaaagugaaaguaga

SEQ ID NO: 861110 - RNA, 19 nt, Homo sapiens
gaacuccucagucaauuua

SEQ ID NO: 861111 - RNA, 19 nt, Homo sapiens
agaacgagcugaagccuua

SEQ ID NO: 861112 - RNA, 19 nt, Homo sapiens
ggaaagccaucuacagaga

SEQ ID NO: 861113 - RNA, 19 nt, Homo sapiens
ggagugacauggcuaauuc

SEQ ID NO: 861114 - RNA, 19 nt, Homo sapiens
gaaguacucuccaucugaa

SEQ ID NO: 861115 - RNA, 19 nt, Homo sapiens
agacgagccuuucuuauuu

SEQ ID NO: 861116 - RNA, 19 nt, Homo sapiens
gaaccuauguauauucaga

SEQ ID NO: 861117 - RNA, 19 nt, Homo sapiens
gaaagaauauuggauacug

SEQ ID NO: 861118 - RNA, 19 nt, Homo sapiens
gaaggacucuaaugcagaa

SEQ ID NO: 861119 - RNA, 19 nt, Homo sapiens
ugacuaugcucuuguauau

SEQ ID NO: 861120 - RNA, 19 nt, Homo sapiens
acacucagaugaagaagua

SEQ ID NO: 861121 - RNA, 19 nt, Homo sapiens
ugagacaacuggccaaauu

SEQ ID NO: 861122 - RNA, 19 nt, Homo sapiens
uggauaagcuuucaacuga

SEQ ID NO: 861123 - RNA, 19 nt, Homo sapiens
ugacauggcuaauuccaaa

SEQ ID NO: 861124 - RNA, 19 nt, Homo sapiens
cauaaccacuuuguucuua

SEQ ID NO: 861125 - RNA, 19 nt, Homo sapiens
gaacacaucaugcaaagga

SEQ ID NO: 861126 - RNA, 19 nt, Homo sapiens
gaagagggcauuaagaaau

SEQ ID NO: 861127 - RNA, 19 nt, Homo sapiens
ugauaaagcuugggaauau

SEQ ID NO: 861128 - RNA, 19 nt, Homo sapiens
gaggacaaaucaagaaguu

SEQ ID NO: 861129 - RNA, 19 nt, Homo sapiens
gacagaagaugaugaaagu

SEQ ID NO: 861130 - RNA, 19 nt, Homo sapiens
gagccuuucuuauuucuuu

SEQ ID NO: 861131 - RNA, 19 nt, Homo sapiens
aaccauaccuuaccacuaa

SEQ ID NO: 861132 - RNA, 19 nt, Homo sapiens
cauuaaagaugaacucuga

SEQ ID NO: 861133 - RNA, 19 nt, Homo sapiens
uaacgauacugaagaagaa

SEQ ID NO: 861134 - RNA, 19 nt, Homo sapiens
cagaacaacugaaugcaaa

SEQ ID NO: 861135 - RNA, 19 nt, Homo sapiens
agaagcagcaguagaauua

SEQ ID NO: 861136 - RNA, 19 nt, Homo sapiens
gcaacgagguguucaugga

SEQ ID NO: 861137 - RNA, 19 nt, Homo sapiens
gaacauggcauuaaaucug

SEQ ID NO: 861138 - RNA, 19 nt, Homo sapiens
acacuucacuucuaacaaa

SEQ ID NO: 861139 - RNA, 19 nt, Homo sapiens
caacaauucuucagguuuc

SEQ ID NO: 861140 - RNA, 19 nt, Homo sapiens
gaauaaaccaucaaaguca

SEQ ID NO: 861141 - RNA, 19 nt, Homo sapiens
uaaaggagcuaagccugua

SEQ ID NO: 861142 - RNA, 19 nt, Homo sapiens
gaacuuaaacagaaugaga

SEQ ID NO: 861143 - RNA, 19 nt, Homo sapiens
gcugaacaguauuaugaua

SEQ ID NO: 861144 - RNA, 19 nt, Homo sapiens
gcaaaucaagugccuguuu

SEQ ID NO: 861145 - RNA, 19 nt, Homo sapiens
ggucuaggauuugccuuua

SEQ ID NO: 861146 - RNA, 19 nt, Homo sapiens
caacagcaagguuaacaua

SEQ ID NO: 861147 - RNA, 19 nt, Homo sapiens
gggcuuguuucaauagaua

SEQ ID NO: 861148 - RNA, 19 nt, Homo sapiens
gcaguauucucaagauaug

SEQ ID NO: 861149 - RNA, 19 nt, Homo sapiens
ugaagaagaagaaagguua

SEQ ID NO: 861150 - RNA, 19 nt, Homo sapiens
acauugagauccucuagua

SEQ ID NO: 861151 - RNA, 19 nt, Homo sapiens
gaaauugagcgaauagaga

SEQ ID NO: 861152 - RNA, 19 nt, Homo sapiens
uaucauuggucuaggauuu

SEQ ID NO: 861153 - RNA, 19 nt, Homo sapiens
gcagaagaagauucaaaua

SEQ ID NO: 861154 - RNA, 19 nt, Homo sapiens
gagaaccuauguauauuca

SEQ ID NO: 861155 - RNA, 19 nt, Homo sapiens
gcuaaauguucuacccaua

SEQ ID NO: 861156 - RNA, 19 nt, Homo sapiens
gauaaagauggcaauguua

SEQ ID NO: 861157 - RNA, 19 nt, Homo sapiens
cgauauaaauucagugaug

SEQ ID NO: 861158 - RNA, 19 nt, Homo sapiens
gcaaucaacacaugccuaa

SEQ ID NO: 861159 - RNA, 19 nt, Homo sapiens
gauagagacuggaagaaag

SEQ ID NO: 861160 - RNA, 19 nt, Homo sapiens
gcagagauacuggauauga

SEQ ID NO: 861161 - RNA, 19 nt, Homo sapiens
gaaagcauaugaaccaaaa

SEQ ID NO: 861162 - RNA, 19 nt, Homo sapiens
ugacaguccucguguuaaa

SEQ ID NO: 861163 - RNA, 19 nt, Homo sapiens
gaugaaauguuugccagaa

SEQ ID NO: 861164 - RNA, 19 nt, Homo sapiens
guauauagcagacaaucua

SEQ ID NO: 861165 - RNA, 19 nt, Homo sapiens
caacagggaccuauauaug

SEQ ID NO: 861166 - RNA, 19 nt, Homo sapiens
cauauaaaccugugaagaa

SEQ ID NO: 861167 - RNA, 19 nt, Homo sapiens
uuacuucacuugcaagauu

SEQ ID NO: 861168 - RNA, 19 nt, Homo sapiens
guuagcagcuuaucagaau

SEQ ID NO: 861169 - RNA, 19 nt, Homo sapiens
gagauucacagccucaaua

SEQ ID NO: 861170 - RNA, 19 nt, Homo sapiens
aggcagaauuuccaaguua

SEQ ID NO: 861171 - RNA, 19 nt, Homo sapiens
ggaaacguguagauucaga

SEQ ID NO: 861172 - RNA, 19 nt, Homo sapiens
cagacaaucuagccuguuu

SEQ ID NO: 861173 - RNA, 19 nt, Homo sapiens
ccaaauaacacuucacuuc

SEQ ID NO: 861174 - RNA, 19 nt, Homo sapiens
caaaggaaauugagacaac

SEQ ID NO: 861175 - RNA, 19 nt, Homo sapiens
ggauguaauugaaagaguu

SEQ ID NO: 861176 - RNA, 19 nt, Homo sapiens
gaaaacaucagcuuaauga

SEQ ID NO: 861177 - RNA, 19 nt, Homo sapiens
gagagagaaucagcuauug

SEQ ID NO: 861178 - RNA, 19 nt, Homo sapiens
gaugaugcuugcuugauug

SEQ ID NO: 861179 - RNA, 19 nt, Homo sapiens
gcacugguuuuacaacuua

SEQ ID NO: 861180 - RNA, 19 nt, Homo sapiens
guuagucacugcaguauuc

SEQ ID NO: 861181 - RNA, 19 nt, Homo sapiens
cagauuagauccucaugga

SEQ ID NO: 861182 - RNA, 19 nt, Homo sapiens
caggaugggucaaagcuuu

SEQ ID NO: 861183 - RNA, 19 nt, Homo sapiens
gagcuaagccuguaguugu

SEQ ID NO: 861184 - RNA, 19 nt, Homo sapiens
gacgugaccaugauaauaa

SEQ ID NO: 861185 - RNA, 19 nt, Homo sapiens
aaauucagcuccuuuaauc

SEQ ID NO: 861186 - RNA, 19 nt, Homo sapiens
gacauuacacucucaguuu

SEQ ID NO: 861187 - RNA, 19 nt, Homo sapiens
ucagagacauuuguauuga

SEQ ID NO: 861188 - RNA, 19 nt, Homo sapiens
cauggacgauugauggaua

SEQ ID NO: 861189 - RNA, 19 nt, Homo sapiens
caaaagccaugaaguguuu

SEQ ID NO: 861190 - RNA, 19 nt, Homo sapiens
ccugaagugucuaaacaua

SEQ ID NO: 861191 - RNA, 19 nt, Homo sapiens
gaggaggagucaacguauu

SEQ ID NO: 861192 - RNA, 19 nt, Homo sapiens
ggaagagccguuguuuaua

SEQ ID NO: 861193 - RNA, 19 nt, Homo sapiens
gacgauugauggauaauuc

SEQ ID NO: 861194 - RNA, 19 nt, Homo sapiens
gaagaaucaucugaaggaa

SEQ ID NO: 861195 - RNA, 19 nt, Homo sapiens
uaagcaaggugaagaagau

SEQ ID NO: 861196 - RNA, 19 nt, Homo sapiens
gcaauggguauaauggaua

SEQ ID NO: 861197 - RNA, 19 nt, Homo sapiens
ccaaacagaagaacuuaaa

SEQ ID NO: 861198 - RNA, 19 nt, Homo sapiens
gagagaaucagcuauugaa

SEQ ID NO: 861199 - RNA, 19 nt, Homo sapiens
gaagagccguuguuuauaa

SEQ ID NO: 861200 - RNA, 19 nt, Homo sapiens
gaagaaagcuuguacucaa

SEQ ID NO: 861201 - RNA, 19 nt, Homo sapiens
gauaagaacuccucaguca

SEQ ID NO: 861202 - RNA, 19 nt, Homo sapiens
gcccagagcuuugauauuu

SEQ ID NO: 861203 - RNA, 19 nt, Homo sapiens
ggagagaccuuauuaugga

SEQ ID NO: 861204 - RNA, 19 nt, Homo sapiens
gaaaguagauuagcagaau

SEQ ID NO: 861205 - RNA, 19 nt, Homo sapiens
gaaguucccuuaaaccuau

SEQ ID NO: 861206 - RNA, 19 nt, Homo sapiens
ggauaaagauggcaauguu

SEQ ID NO: 861207 - RNA, 19 nt, Homo sapiens
cagaagaacuuaaacagaa

SEQ ID NO: 861208 - RNA, 19 nt, Homo sapiens
gcuaauaagcugacuaaua

SEQ ID NO: 861209 - RNA, 19 nt, Homo sapiens
guacaaagaucgaccacaa

SEQ ID NO: 861210 - RNA, 19 nt, Homo sapiens
caacagagauggcuuuaag

SEQ ID NO: 861211 - RNA, 19 nt, Homo sapiens
gaaacaaagugaaaguaga

SEQ ID NO: 861212 - RNA, 19 nt, Homo sapiens
gaacuccucagucaauuua

SEQ ID NO: 861213 - RNA, 19 nt, Homo sapiens
agaacgagcugaagccuua

SEQ ID NO: 861214 - RNA, 19 nt, Homo sapiens
ggaaagccaucuacagaga

SEQ ID NO: 861215 - RNA, 19 nt, Homo sapiens
ggagugacauggcuaauuc

SEQ ID NO: 861216 - RNA, 19 nt, Homo sapiens
gaaguacucuccaucugaa

SEQ ID NO: 861217 - RNA, 19 nt, Homo sapiens
agacgagccuuucuuauuu

SEQ ID NO: 861218 - RNA, 19 nt, Homo sapiens
gaaccuauguauauucaga

SEQ ID NO: 861219 - RNA, 19 nt, Homo sapiens
acaauuaacuccaggguuu

SEQ ID NO: 861220 - RNA, 19 nt, Homo sapiens
gaaagaauauuggauacug

SEQ ID NO: 861221 - RNA, 19 nt, Homo sapiens
gaaggacucuaaugcagaa

SEQ ID NO: 861222 - RNA, 19 nt, Homo sapiens
ugacuaugcucuuguauau

SEQ ID NO: 861223 - RNA, 19 nt, Homo sapiens
acacucagaugaagaagua

SEQ ID NO: 861224 - RNA, 19 nt, Homo sapiens
ugagacaacuggccaaauu

SEQ ID NO: 861225 - RNA, 19 nt, Homo sapiens
uggauaagcuuucaacuga

SEQ ID NO: 861226 - RNA, 19 nt, Homo sapiens
gaaaagggauccccaggua

SEQ ID NO: 861227 - RNA, 19 nt, Homo sapiens
ugacauggcuaauuccaaa

SEQ ID NO: 861228 - RNA, 19 nt, Homo sapiens
cauaaccacuuuguucuua

SEQ ID NO: 861229 - RNA, 19 nt, Homo sapiens
gaacacaucaugcaaagga

SEQ ID NO: 861230 - RNA, 19 nt, Homo sapiens
gaagagggcauuaagaaau

SEQ ID NO: 861231 - RNA, 19 nt, Homo sapiens
ugauaaagcuugggaauau

SEQ ID NO: 861232 - RNA, 19 nt, Homo sapiens
gaggacaaaucaagaaguu

SEQ ID NO: 861233 - RNA, 19 nt, Homo sapiens
gacagaagaugaugaaagu

SEQ ID NO: 861234 - RNA, 19 nt, Homo sapiens
gagccuuucuuauuucuuu

SEQ ID NO: 861235 - RNA, 19 nt, Homo sapiens
aaccauaccuuaccacuaa

SEQ ID NO: 861236 - RNA, 19 nt, Homo sapiens
cauuaaagaugaacucuga

SEQ ID NO: 861237 - RNA, 19 nt, Homo sapiens
uaacgauacugaagaagaa

SEQ ID NO: 861238 - RNA, 19 nt, Homo sapiens
cagaacaacugaaugcaaa

SEQ ID NO: 861239 - RNA, 19 nt, Homo sapiens
agaagcagcaguagaauua

SEQ ID NO: 861240 - RNA, 19 nt, Homo sapiens
gcaacgagguguucaugga

SEQ ID NO: 861241 - RNA, 19 nt, Homo sapiens
gaacauggcauuaaaucug

SEQ ID NO: 861242 - RNA, 19 nt, Homo sapiens
guacaugcagccaaauuua

SEQ ID NO: 861243 - RNA, 19 nt, Homo sapiens
acacuucacuucuaacaaa

SEQ ID NO: 861244 - RNA, 19 nt, Homo sapiens
caacaauucuucagguuuc

SEQ ID NO: 861245 - RNA, 19 nt, Homo sapiens
gaauaaaccaucaaaguca

SEQ ID NO: 861246 - RNA, 19 nt, Homo sapiens
uaaaggagcuaagccugua

SEQ ID NO: 861247 - RNA, 19 nt, Homo sapiens
gaacuuaaacagaaugaga

SEQ ID NO: 861248 - RNA, 19 nt, Homo sapiens
ggaugggacuuccagcuaa

SEQ ID NO: 861249 - RNA, 19 nt, Homo sapiens
gcugaacaguauuaugaua

SEQ ID NO: 861250 - RNA, 19 nt, Homo sapiens
gcaaaucaagugccuguuu

SEQ ID NO: 861251 - RNA, 19 nt, Homo sapiens
ggucuaggauuugccuuua

SEQ ID NO: 861252 - RNA, 19 nt, Homo sapiens
caacagcaagguuaacaua

SEQ ID NO: 861253 - RNA, 19 nt, Homo sapiens
ggcagaaucuccuggauau

SEQ ID NO: 861254 - RNA, 19 nt, Homo sapiens
gggcuuguuucaauagaua

SEQ ID NO: 861255 - RNA, 19 nt, Homo sapiens
gcaguauucucaagauaug

SEQ ID NO: 861256 - RNA, 19 nt, Homo sapiens
ugaagaagaagaaagguua

SEQ ID NO: 861257 - RNA, 19 nt, Homo sapiens
acauugagauccucuagua

SEQ ID NO: 861258 - RNA, 19 nt, Homo sapiens
gaaauugagcgaauagaga

SEQ ID NO: 861259 - RNA, 19 nt, Homo sapiens
uaucauuggucuaggauuu

SEQ ID NO: 861260 - RNA, 19 nt, Homo sapiens
gcagaagaagauucaaaua

SEQ ID NO: 861261 - RNA, 19 nt, Homo sapiens
gagaaccuauguauauuca

SEQ ID NO: 861262 - RNA, 19 nt, Homo sapiens
gcuaaauguucuacccaua

SEQ ID NO: 861263 - RNA, 19 nt, Homo sapiens
gauaaagauggcaauguua

SEQ ID NO: 861264 - RNA, 19 nt, Homo sapiens
cgauauaaauucagugaug

SEQ ID NO: 861265 - RNA, 19 nt, Homo sapiens
gcaaucaacacaugccuaa

SEQ ID NO: 861266 - RNA, 19 nt, Homo sapiens
gauagagacuggaagaaag

SEQ ID NO: 861267 - RNA, 19 nt, Homo sapiens
gcagagauacuggauauga

SEQ ID NO: 861268 - RNA, 19 nt, Homo sapiens
gaaagcauaugaaccaaaa

SEQ ID NO: 861269 - RNA, 19 nt, Homo sapiens
ugacaguccucguguuaaa

SEQ ID NO: 861270 - RNA, 19 nt, Homo sapiens
gagcgaauacugcaauaaa

SEQ ID NO: 861271 - RNA, 19 nt, Homo sapiens
gaugaaauguuugccagaa

SEQ ID NO: 861272 - RNA, 19 nt, Homo sapiens
guauauagcagacaaucua

SEQ ID NO: 861273 - RNA, 19 nt, Homo sapiens
caacagggaccuauauaug

SEQ ID NO: 861274 - RNA, 19 nt, Homo sapiens
cauauaaaccugugaagaa

SEQ ID NO: 861275 - RNA, 19 nt, Homo sapiens
uuacuucacuugcaagauu

SEQ ID NO: 861276 - RNA, 19 nt, Homo sapiens
guuagcagcuuaucagaau

SEQ ID NO: 861277 - RNA, 19 nt, Homo sapiens
gagauucacagccucaaua

SEQ ID NO: 861278 - RNA, 19 nt, Homo sapiens
aggcagaauuuccaaguua

SEQ ID NO: 861279 - RNA, 19 nt, Homo sapiens
ggaaacguguagauucaga

SEQ ID NO: 861280 - RNA, 19 nt, Homo sapiens
cagacaaucuagccuguuu

SEQ ID NO: 861281 - RNA, 19 nt, Homo sapiens
ccaaauaacacuucacuuc

SEQ ID NO: 861282 - RNA, 19 nt, Homo sapiens
caaaggaaauugagacaac

SEQ ID NO: 861283 - RNA, 19 nt, Homo sapiens
ggauguaauugaaagaguu

SEQ ID NO: 861284 - RNA, 19 nt, Homo sapiens
gaaaacaucagcuuaauga

SEQ ID NO: 861285 - RNA, 19 nt, Homo sapiens
gagagagaaucagcuauug

SEQ ID NO: 861286 - RNA, 19 nt, Homo sapiens
aagaggguguaaacaauua

SEQ ID NO: 861287 - RNA, 19 nt, Homo sapiens
uguauaggcugacuucuga

SEQ ID NO: 861288 - RNA, 19 nt, Homo sapiens
gaugaugcuugcuugauug

SEQ ID NO: 861289 - RNA, 19 nt, Homo sapiens
gcacugguuuuacaacuua

SEQ ID NO: 861290 - RNA, 19 nt, Homo sapiens
guuagucacugcaguauuc

SEQ ID NO: 861291 - RNA, 19 nt, Homo sapiens
cagauuagauccucaugga

SEQ ID NO: 861292 - RNA, 19 nt, Homo sapiens
caggaugggucaaagcuuu

SEQ ID NO: 861293 - RNA, 19 nt, Homo sapiens
gagcuaagccuguaguugu

SEQ ID NO: 861294 - RNA, 19 nt, Homo sapiens
gacgugaccaugauaauaa

SEQ ID NO: 861295 - RNA, 19 nt, Homo sapiens
gcugacuucugaauaauug

SEQ ID NO: 861296 - RNA, 19 nt, Homo sapiens
ugaccuaucugcagaagga

SEQ ID NO: 861297 - RNA, 19 nt, Homo sapiens
aaauucagcuccuuuaauc

SEQ ID NO: 861298 - RNA, 19 nt, Homo sapiens
gacauuacacucucaguuu

SEQ ID NO: 861299 - RNA, 19 nt, Homo sapiens
gggagaagcuggccaagga

SEQ ID NO: 861300 - RNA, 19 nt, Homo sapiens
ugaccgagauccacgagua

SEQ ID NO: 861301 - RNA, 19 nt, Homo sapiens
ggacguggauggugugaag

SEQ ID NO: 861302 - RNA, 19 nt, Homo sapiens
caggugaggucugugauuu

SEQ ID NO: 861303 - RNA, 19 nt, Homo sapiens
gcuuccggcugcaugauua

SEQ ID NO: 861304 - RNA, 19 nt, Homo sapiens
gauaaaaugugggaaauca

SEQ ID NO: 861305 - RNA, 19 nt, Homo sapiens
ucacagccauagcaaagga

SEQ ID NO: 861306 - RNA, 19 nt, Homo sapiens
ccuguggccuugugauaaa

SEQ ID NO: 861307 - RNA, 19 nt, Homo sapiens
caacuuggccuuuugauug

SEQ ID NO: 861308 - RNA, 19 nt, Homo sapiens
gcacucaacuuggccuuuu

SEQ ID NO: 861309 - RNA, 19 nt, Homo sapiens
ggcauugacuuccggaaca

SEQ ID NO: 861310 - RNA, 19 nt, Homo sapiens
gcaacagucccaacaagca

SEQ ID NO: 861311 - RNA, 19 nt, Homo sapiens
uccaggcccuucugacuuu

SEQ ID NO: 861312 - RNA, 19 nt, Homo sapiens
cagcaacagucccaacaag

SEQ ID NO: 861313 - RNA, 19 nt, Homo sapiens
gcauugacuuccggaacaa

SEQ ID NO: 861314 - RNA, 19 nt, Homo sapiens
ugaagcagcgcuccaugaa

SEQ ID NO: 861315 - RNA, 19 nt, Homo sapiens
gaaaacaccagaaacaaca

SEQ ID NO: 861316 - RNA, 19 nt, Homo sapiens
aaacagcaauagggucuuc

SEQ ID NO: 861317 - RNA, 19 nt, Homo sapiens
gaagcuggccaaggaguau

SEQ ID NO: 861318 - RNA, 19 nt, Homo sapiens
cuaaucacaucgugcaucu

SEQ ID NO: 861319 - RNA, 19 nt, Homo sapiens
ucuacgaugucaccaacaa

SEQ ID NO: 861320 - RNA, 19 nt, Homo sapiens
uagcaaaggaguugaagca

SEQ ID NO: 861321 - RNA, 19 nt, Homo sapiens
ccaccuugcacucaacuug

SEQ ID NO: 861322 - RNA, 19 nt, Homo sapiens
gaguauggacugcccuuca

SEQ ID NO: 861323 - RNA, 19 nt, Homo sapiens
gguggacucugcccaugag

SEQ ID NO: 861324 - RNA, 19 nt, Homo sapiens
cacagugccuaacccuaga

SEQ ID NO: 861325 - RNA, 19 nt, Homo sapiens
ccuagugaauaaaguugug

SEQ ID NO: 861326 - RNA, 19 nt, Homo sapiens
ggaugccuguggccuugug

SEQ ID NO: 861327 - RNA, 19 nt, Homo sapiens
auucaaggauggugcuuuc

SEQ ID NO: 861328 - RNA, 19 nt, Homo sapiens
aggugaagcugcagaugug

SEQ ID NO: 861329 - RNA, 19 nt, Homo sapiens
gaaggugaagcugcagaug

SEQ ID NO: 861330 - RNA, 19 nt, Homo sapiens
gaagcagcgcuccaugaag

SEQ ID NO: 861331 - RNA, 19 nt, Homo sapiens
aaucacaucgugcaucugu

SEQ ID NO: 861332 - RNA, 19 nt, Homo sapiens
gcacaugcucaggcagcua

SEQ ID NO: 861333 - RNA, 19 nt, Homo sapiens
caucuccaccguaggcauu

SEQ ID NO: 861334 - RNA, 19 nt, Homo sapiens
uggauggugugaaggugaa

SEQ ID NO: 861335 - RNA, 19 nt, Homo sapiens
cuaggaggcucuggcucaa

SEQ ID NO: 861336 - RNA, 19 nt, Homo sapiens
cacaugcucaggcagcuaa

SEQ ID NO: 861337 - RNA, 19 nt, Homo sapiens
gcugcaugauuacguuaag

SEQ ID NO: 861338 - RNA, 19 nt, Homo sapiens
aaaguuguguuuucuggaa

SEQ ID NO: 861339 - RNA, 19 nt, Homo sapiens
caccguaggcauugacuuc

SEQ ID NO: 861340 - RNA, 19 nt, Homo sapiens
gccuguggccuugugauaa

SEQ ID NO: 861341 - RNA, 19 nt, Homo sapiens
ccugucugcuggugcgauu

SEQ ID NO: 861342 - RNA, 19 nt, Homo sapiens
ucacagaaaacaccagaaa

SEQ ID NO: 861343 - RNA, 19 nt, Homo sapiens
ggugaggucugugauuucc

SEQ ID NO: 861344 - RNA, 19 nt, Homo sapiens
ucuacgacgucgccuucaa

SEQ ID NO: 861345 - RNA, 19 nt, Homo sapiens
ccauagcaaaggaguugaa

SEQ ID NO: 861346 - RNA, 19 nt, Homo sapiens
gauucaaggauggugcuuu

SEQ ID NO: 861347 - RNA, 19 nt, Homo sapiens
guacaacaguucauccuua

SEQ ID NO: 861348 - RNA, 19 nt, Homo sapiens
gcaagcagguggccaguaa

SEQ ID NO: 861349 - RNA, 19 nt, Homo sapiens
gaaaacaucuccacucuga

SEQ ID NO: 861350 - RNA, 19 nt, Homo sapiens
ucuauacccugaucaaaua

SEQ ID NO: 861351 - RNA, 19 nt, Homo sapiens
gcagagaaguuugccauug

SEQ ID NO: 861352 - RNA, 19 nt, Homo sapiens
gugcugaaauccaccuuua

SEQ ID NO: 861353 - RNA, 19 nt, Homo sapiens
ggagcuaauuggcuuauau

SEQ ID NO: 861354 - RNA, 19 nt, Homo sapiens
ucagggauguucuguguaa

SEQ ID NO: 861355 - RNA, 19 nt, Homo sapiens
uggacaaacuccucaauaa

SEQ ID NO: 861356 - RNA, 19 nt, Homo sapiens
agaacaaccugaugagaaa

SEQ ID NO: 861357 - RNA, 19 nt, Homo sapiens
gagaggcugugauguuuau

SEQ ID NO: 861358 - RNA, 19 nt, Homo sapiens
gagagaagcgggcuccuaa

SEQ ID NO: 861359 - RNA, 19 nt, Homo sapiens
gcagauacacuuacucuuc

SEQ ID NO: 861360 - RNA, 19 nt, Homo sapiens
gggauguucuguguaauaa

SEQ ID NO: 861361 - RNA, 19 nt, Homo sapiens
ugagggagacugucaauaa

SEQ ID NO: 861362 - RNA, 19 nt, Homo sapiens
gcuggaggcuguauacgaa

SEQ ID NO: 861363 - RNA, 19 nt, Homo sapiens
guggaagucugcagugaaa

SEQ ID NO: 861364 - RNA, 19 nt, Homo sapiens
gaggagggauuaagaaggu

SEQ ID NO: 861365 - RNA, 19 nt, Homo sapiens
gagaauguguccagcaaag

SEQ ID NO: 861366 - RNA, 19 nt, Homo sapiens
caguuaggcuugacuuuga

SEQ ID NO: 861367 - RNA, 19 nt, Homo sapiens
gaagcgggcuccuaaugag

SEQ ID NO: 861368 - RNA, 19 nt, Homo sapiens
gaggagaggcugugauguu

SEQ ID NO: 861369 - RNA, 19 nt, Homo sapiens
gcagugagcuauacuuacg

SEQ ID NO: 861370 - RNA, 19 nt, Homo sapiens
cagcaaaguucgucagcuu

SEQ ID NO: 861371 - RNA, 19 nt, Homo sapiens
gcaggaagcugagcaacgu

SEQ ID NO: 861372 - RNA, 19 nt, Homo sapiens
aaaguaagauggucacucu

SEQ ID NO: 861373 - RNA, 19 nt, Homo sapiens
ggaagaauucaaugacuau

SEQ ID NO: 861374 - RNA, 19 nt, Homo sapiens
ggauagacuuccgcaguga

SEQ ID NO: 861375 - RNA, 19 nt, Homo sapiens
uacaacaguucauccuuaa

SEQ ID NO: 861376 - RNA, 19 nt, Homo sapiens
gagggagacugucaauaag

SEQ ID NO: 861377 - RNA, 19 nt, Homo sapiens
gcuuauauguuaccaugga

SEQ ID NO: 861378 - RNA, 19 nt, Homo sapiens
ggagaggcugugauguuua

SEQ ID NO: 861379 - RNA, 19 nt, Homo sapiens
uaaccggccucaugacuag

SEQ ID NO: 861380 - RNA, 19 nt, Homo sapiens
ccaagaaccgccucuauca

SEQ ID NO: 861381 - RNA, 19 nt, Homo sapiens
gcaaaguucgucagcuuga

SEQ ID NO: 861382 - RNA, 19 nt, Homo sapiens
gaauguguccagcaaaguu

SEQ ID NO: 861383 - RNA, 19 nt, Homo sapiens
gagaagcgggcuccuaaug

SEQ ID NO: 861384 - RNA, 19 nt, Homo sapiens
caguaaagcugaggagaau

SEQ ID NO: 861385 - RNA, 19 nt, Homo sapiens
agaaaguggugcugaaauc

SEQ ID NO: 861386 - RNA, 19 nt, Homo sapiens
cagaggaaguaaagcaaga

SEQ ID NO: 861387 - RNA, 19 nt, Homo sapiens
cagaacaaccugaugagaa

SEQ ID NO: 861388 - RNA, 19 nt, Homo sapiens
caaccuggcugagaaugug

SEQ ID NO: 861389 - RNA, 19 nt, Homo sapiens
gcaguuaggcuugacuuug

SEQ ID NO: 861390 - RNA, 19 nt, Homo sapiens
agaaagugguggagagaga

SEQ ID NO: 861391 - RNA, 19 nt, Homo sapiens
gaggaagaauucaaugacu

SEQ ID NO: 861392 - RNA, 19 nt, Homo sapiens
ucggagagcugcagucauc

SEQ ID NO: 861393 - RNA, 19 nt, Homo sapiens
ggagaaaguggugcugaaa

SEQ ID NO: 861394 - RNA, 19 nt, Homo sapiens
gcaaauggcagaguucaag

SEQ ID NO: 861395 - RNA, 19 nt, Homo sapiens
aggaagaauucaaugacua

SEQ ID NO: 861396 - RNA, 19 nt, Homo sapiens
caacaucgaggaggaagaa

SEQ ID NO: 861397 - RNA, 19 nt, Homo sapiens
caugguggaugaugucuuc

SEQ ID NO: 861398 - RNA, 19 nt, Homo sapiens
gcuaauuggcuuauauguu

SEQ ID NO: 861399 - RNA, 19 nt, Homo sapiens
gcuggaaugaucaccuuua

SEQ ID NO: 861400 - RNA, 19 nt, Homo sapiens
ccucaugacuagccuuguu

SEQ ID NO: 861401 - RNA, 19 nt, Homo sapiens
ggacaaacuccucaauaac

SEQ ID NO: 861402 - RNA, 19 nt, Homo sapiens
gagacuccauggccucaga

SEQ ID NO: 861403 - RNA, 19 nt, Homo sapiens
gaagggauugcccgcauug

SEQ ID NO: 861404 - RNA, 19 nt, Homo sapiens
gcacagcagccuccagcaa

SEQ ID NO: 861405 - RNA, 19 nt, Homo sapiens
aggagaggcugugauguuu

SEQ ID NO: 861406 - RNA, 19 nt, Homo sapiens
uugcaggccuguucccuaa

SEQ ID NO: 861407 - RNA, 19 nt, Homo sapiens
gaccauccgagacaaguuu

SEQ ID NO: 861408 - RNA, 19 nt, Homo sapiens
gacaaacuccucaauaacu

SEQ ID NO: 861409 - RNA, 19 nt, Homo sapiens
uggagaaggugguagacaa

SEQ ID NO: 861410 - RNA, 19 nt, Homo sapiens
cagauacacuuacucuucu

SEQ ID NO: 861411 - RNA, 19 nt, Homo sapiens
gagagcugcagucaucuuu

SEQ ID NO: 861412 - RNA, 19 nt, Homo sapiens
caaauuccgagaccucuug

SEQ ID NO: 861413 - RNA, 19 nt, Homo sapiens
gaaggugguagacaaguuc

SEQ ID NO: 861414 - RNA, 19 nt, Homo sapiens
ggacaagucggucauugag

SEQ ID NO: 861415 - RNA, 19 nt, Homo sapiens
caacagcacagccaucaag

SEQ ID NO: 861416 - RNA, 19 nt, Homo sapiens
caaggcaaauuugacacaa

SEQ ID NO: 861417 - RNA, 19 nt, Homo sapiens
gauguucuguguaauaagc

SEQ ID NO: 861418 - RNA, 19 nt, Homo sapiens
gcagguggaaugugacaga

SEQ ID NO: 861419 - RNA, 19 nt, Homo sapiens
cacuuacucuucuguuuga

SEQ ID NO: 861420 - RNA, 19 nt, Homo sapiens
gcaugaggagggauuaaga

SEQ ID NO: 861421 - RNA, 19 nt, Homo sapiens
ccucaaacacuacagcaaa

SEQ ID NO: 861422 - RNA, 19 nt, Homo sapiens
gagaaaguggugcugaaau

SEQ ID NO: 861423 - RNA, 19 nt, Homo sapiens
ggaaugaucaccuuuaccu

SEQ ID NO: 861424 - RNA, 19 nt, Homo sapiens
cuucagggauguucugugu

SEQ ID NO: 861425 - RNA, 19 nt, Homo sapiens
gagcugcagucaucuuugc

SEQ ID NO: 861426 - RNA, 19 nt, Homo sapiens
gagcuaauuggcuuauaug

SEQ ID NO: 861427 - RNA, 19 nt, Homo sapiens
ccgcagugagcuauacuua

SEQ ID NO: 861428 - RNA, 19 nt, Homo sapiens
uacacuuacucuucuguuu

SEQ ID NO: 861429 - RNA, 19 nt, Homo sapiens
ccaguaaagcugaggagaa

SEQ ID NO: 861430 - RNA, 19 nt, Homo sapiens
uaugaucccugaauaaagc

SEQ ID NO: 861431 - RNA, 19 nt, Homo sapiens
acaaacuccucaauaacug

SEQ ID NO: 861432 - RNA, 19 nt, Homo sapiens
agaaggugguagacaaguu

SEQ ID NO: 861433 - RNA, 19 nt, Homo sapiens
acagacagguggagaaggu

SEQ ID NO: 861434 - RNA, 19 nt, Homo sapiens
cagagaaguuugccauugc

SEQ ID NO: 861435 - RNA, 19 nt, Homo sapiens
gcagugaagauaucaagag

SEQ ID NO: 861436 - RNA, 19 nt, Homo sapiens
uggguggucugcaguuuga

SEQ ID NO: 861437 - RNA, 19 nt, Homo sapiens
ccgaauggguccuaaucug

SEQ ID NO: 861438 - RNA, 19 nt, Homo sapiens
gaagaagacacuggagagu

SEQ ID NO: 861439 - RNA, 19 nt, Homo sapiens
gcaaggcaaauuugacaca

SEQ ID NO: 861440 - RNA, 19 nt, Homo sapiens
caagugccgugaacaucau

SEQ ID NO: 861441 - RNA, 19 nt, Homo sapiens
ggagaaagugguggagaga

SEQ ID NO: 861442 - RNA, 19 nt, Homo sapiens
caaaacaccauugaaagua

SEQ ID NO: 861443 - RNA, 19 nt, Homo sapiens
gagaagggccagcugacau

SEQ ID NO: 861444 - RNA, 19 nt, Homo sapiens
gacaaguucaucaagcaaa

SEQ ID NO: 861445 - RNA, 19 nt, Homo sapiens
uagacaaguucaucaagca

SEQ ID NO: 861446 - RNA, 19 nt, Homo sapiens
ugaagggauugcccgcauu

SEQ ID NO: 861447 - RNA, 19 nt, Homo sapiens
gcaaugguuuguaggaauu

SEQ ID NO: 861448 - RNA, 19 nt, Homo sapiens
gaacagauggcaagcaaga

SEQ ID NO: 861449 - RNA, 19 nt, Homo sapiens
gauuguacuugacaguuua

SEQ ID NO: 861450 - RNA, 19 nt, Homo sapiens
guucucaagucuuaagaua

SEQ ID NO: 861451 - RNA, 19 nt, Homo sapiens
cugaauggcucaaagaauu

SEQ ID NO: 861452 - RNA, 19 nt, Homo sapiens
gauaugcugugaaauagug

SEQ ID NO: 861453 - RNA, 19 nt, Homo sapiens
gugagucuguaaagaaaua

SEQ ID NO: 861454 - RNA, 19 nt, Homo sapiens
ucaguaaccugcaggaguu

SEQ ID NO: 861455 - RNA, 19 nt, Homo sapiens
ccauuuacauccugacauu

SEQ ID NO: 861456 - RNA, 19 nt, Homo sapiens
gaaccgacaccugcaguuu

SEQ ID NO: 861457 - RNA, 19 nt, Homo sapiens
agugugagcuggcaguuaa

SEQ ID NO: 861458 - RNA, 19 nt, Homo sapiens
ggaauuacuucuggcaaca

SEQ ID NO: 861459 - RNA, 19 nt, Homo sapiens
ucaagagcauugcagagaa

SEQ ID NO: 861460 - RNA, 19 nt, Homo sapiens
gaauggcucaaagaauuua

SEQ ID NO: 861461 - RNA, 19 nt, Homo sapiens
ggugcaaccugaccagaga

SEQ ID NO: 861462 - RNA, 19 nt, Homo sapiens
cuauggauaugcugugaaa

SEQ ID NO: 861463 - RNA, 19 nt, Homo sapiens
caucacaagugccucugaa

SEQ ID NO: 861464 - RNA, 19 nt, Homo sapiens
agcgggagcucuucaguaa

SEQ ID NO: 861465 - RNA, 19 nt, Homo sapiens
gauauacaacgaacagaug

SEQ ID NO: 861466 - RNA, 19 nt, Homo sapiens
uuccaguucucaagucuua

SEQ ID NO: 861467 - RNA, 19 nt, Homo sapiens
agauuguacuugacaguuu

SEQ ID NO: 861468 - RNA, 19 nt, Homo sapiens
ggugcgcccucauaucuau

SEQ ID NO: 861469 - RNA, 19 nt, Homo sapiens
ccucugaaagcgaguguua

SEQ ID NO: 861470 - RNA, 19 nt, Homo sapiens
gauaaagauuguacuugac

SEQ ID NO: 861471 - RNA, 19 nt, Homo sapiens
ccuggcaccuucuguuuga

SEQ ID NO: 861472 - RNA, 19 nt, Homo sapiens
gaaacucucccugcuggaa

SEQ ID NO: 861473 - RNA, 19 nt, Homo sapiens
caccuugaccuccuaaauu

SEQ ID NO: 861474 - RNA, 19 nt, Homo sapiens
gcagcugaguguucgacuu

SEQ ID NO: 861475 - RNA, 19 nt, Homo sapiens
ugaaagcgaguguuagguu

SEQ ID NO: 861476 - RNA, 19 nt, Homo sapiens
gccgaaauagcucaaguuu

SEQ ID NO: 861477 - RNA, 19 nt, Homo sapiens
gcucaaagaauuuaaagcu

SEQ ID NO: 861478 - RNA, 19 nt, Homo sapiens
gcaguuaagagcugaaugg

SEQ ID NO: 861479 - RNA, 19 nt, Homo sapiens
cuccugggcucaagugauu

SEQ ID NO: 861480 - RNA, 19 nt, Homo sapiens
ccuuguaccugcugaacuu

SEQ ID NO: 861481 - RNA, 19 nt, Homo sapiens
ugaauggcucaaagaauuu

SEQ ID NO: 861482 - RNA, 19 nt, Homo sapiens
gggaggggcuuucuauuuc

SEQ ID NO: 861483 - RNA, 19 nt, Homo sapiens
gagcuuaccaucuuuaucc

SEQ ID NO: 861484 - RNA, 19 nt, Homo sapiens
caagagcauugcagagaac

SEQ ID NO: 861485 - RNA, 19 nt, Homo sapiens
uccugagacuggccauuua

SEQ ID NO: 861486 - RNA, 19 nt, Homo sapiens
gcugaauauuguagauugu

SEQ ID NO: 861487 - RNA, 19 nt, Homo sapiens
gcaccuggccgaaauagcu

SEQ ID NO: 861488 - RNA, 19 nt, Homo sapiens
auggauaugcugugaaaua

SEQ ID NO: 861489 - RNA, 19 nt, Homo sapiens
uauuugaggugguuaaggu

SEQ ID NO: 861490 - RNA, 19 nt, Homo sapiens
gcauuccaguucucaaguc

SEQ ID NO: 861491 - RNA, 19 nt, Homo sapiens
gaacuccugggcucaagug

SEQ ID NO: 861492 - RNA, 19 nt, Homo sapiens
cuaagugggagaagagaaa

SEQ ID NO: 861493 - RNA, 19 nt, Homo sapiens
gcauguggcagcugagugu

SEQ ID NO: 861494 - RNA, 19 nt, Homo sapiens
acgaacagauggcaagcaa

SEQ ID NO: 861495 - RNA, 19 nt, Homo sapiens
gagacuggccauuuacauc

SEQ ID NO: 861496 - RNA, 19 nt, Homo sapiens
cuaguucugcccagcuuua

SEQ ID NO: 861497 - RNA, 19 nt, Homo sapiens
gaguuggugcgcccucaua

SEQ ID NO: 861498 - RNA, 19 nt, Homo sapiens
gaagaaccaggagcggauu

SEQ ID NO: 861499 - RNA, 19 nt, Homo sapiens
gcgaguguuagguugguua

SEQ ID NO: 861500 - RNA, 19 nt, Homo sapiens
accuugaccuccuaaauug

SEQ ID NO: 861501 - RNA, 19 nt, Homo sapiens
uggauaugcugugaaauag

SEQ ID NO: 861502 - RNA, 19 nt, Homo sapiens
gugcugugcucugugaaga

SEQ ID NO: 861503 - RNA, 19 nt, Homo sapiens
cugugagucuguaaagaaa

SEQ ID NO: 861504 - RNA, 19 nt, Homo sapiens
ucacuggucuggcuuucag

SEQ ID NO: 861505 - RNA, 19 nt, Homo sapiens
cagcugaguguucgacuug

SEQ ID NO: 861506 - RNA, 19 nt, Homo sapiens
gcugaguguucgacuugga

SEQ ID NO: 861507 - RNA, 19 nt, Homo sapiens
gguaagagccccuaaacau

SEQ ID NO: 861508 - RNA, 19 nt, Homo sapiens
aaauagcucaaguuucuga

SEQ ID NO: 861509 - RNA, 19 nt, Homo sapiens
caagugauucucccaccuu

SEQ ID NO: 861510 - RNA, 19 nt, Homo sapiens
gcugaauggcucaaagaau

SEQ ID NO: 861511 - RNA, 19 nt, Homo sapiens
accgacaccugcaguuuga

SEQ ID NO: 861512 - RNA, 19 nt, Homo sapiens
gcaaucugugagucuguaa

SEQ ID NO: 861513 - RNA, 19 nt, Homo sapiens
ugcugaauauuguagauug

SEQ ID NO: 861514 - RNA, 19 nt, Homo sapiens
cagugcaccuggccgaaau

SEQ ID NO: 861515 - RNA, 19 nt, Homo sapiens
aguguucgacuuggaauua

SEQ ID NO: 861516 - RNA, 19 nt, Homo sapiens
ucacaagugccucugaaag

SEQ ID NO: 861517 - RNA, 19 nt, Homo sapiens
gcaacuauggaagcuguga

SEQ ID NO: 861518 - RNA, 19 nt, Homo sapiens
ggguucauuuuccuuaaua

SEQ ID NO: 861519 - RNA, 19 nt, Homo sapiens
guucugcccagcuuuaugu

SEQ ID NO: 861520 - RNA, 19 nt, Homo sapiens
ucugugagucuguaaagaa

SEQ ID NO: 861521 - RNA, 19 nt, Homo sapiens
ccaguauuccaccaaaguu

SEQ ID NO: 861522 - RNA, 19 nt, Homo sapiens
cuaaauuguugggauuaca

SEQ ID NO: 861523 - RNA, 19 nt, Homo sapiens
uaagguucuuggguucauu

SEQ ID NO: 861524 - RNA, 19 nt, Homo sapiens
caguauuccaccaaaguuu

SEQ ID NO: 861525 - RNA, 19 nt, Homo sapiens
ccaccuugaccuccuaaau

SEQ ID NO: 861526 - RNA, 19 nt, Homo sapiens
cgacuuggaauuacuucug

SEQ ID NO: 861527 - RNA, 19 nt, Homo sapiens
ugcaaugguuuguaggaau

SEQ ID NO: 861528 - RNA, 19 nt, Homo sapiens
gaauuacuucuggcaacaa

SEQ ID NO: 861529 - RNA, 19 nt, Homo sapiens
uaccaucuuuauccugaga

SEQ ID NO: 861530 - RNA, 19 nt, Homo sapiens
cccuaaacaucaagcaauc

SEQ ID NO: 861531 - RNA, 19 nt, Homo sapiens
cuccuaaauuguugggauu

SEQ ID NO: 861532 - RNA, 19 nt, Homo sapiens
uuucugcaaugguuuguag

SEQ ID NO: 861533 - RNA, 19 nt, Homo sapiens
cugcccagcuuuaugucuu

SEQ ID NO: 861534 - RNA, 19 nt, Homo sapiens
ugggagaagagaaaccuuu

SEQ ID NO: 861535 - RNA, 19 nt, Homo sapiens
gcaguuugagcgcuuugug

SEQ ID NO: 861536 - RNA, 19 nt, Homo sapiens
cugcaaugguuuguaggaa

SEQ ID NO: 861537 - RNA, 19 nt, Homo sapiens
aagcgggagcucuucagua

SEQ ID NO: 861538 - RNA, 19 nt, Homo sapiens
uauggaagcugugaaaauc

SEQ ID NO: 861539 - RNA, 19 nt, Homo sapiens
ggccgaaauagcucaaguu

SEQ ID NO: 861540 - RNA, 19 nt, Homo sapiens
gcuaagugggagaagagaa

SEQ ID NO: 861541 - RNA, 19 nt, Homo sapiens
ggaggggcuuucuauuuca

SEQ ID NO: 861542 - RNA, 19 nt, Homo sapiens
gcugugcucugugaagaac

SEQ ID NO: 861543 - RNA, 19 nt, Homo sapiens
uaagagccccuaaacauca

SEQ ID NO: 861544 - RNA, 19 nt, Homo sapiens
gggcuuguggagcuggaua

SEQ ID NO: 861545 - RNA, 19 nt, Homo sapiens
cuggugcugugcucuguga

SEQ ID NO: 861546 - RNA, 19 nt, Homo sapiens
caacuauggaagcugugaa

SEQ ID NO: 861547 - RNA, 19 nt, Homo sapiens
gaaugaccuugaacaauga

SEQ ID NO: 861548 - RNA, 19 nt, Homo sapiens
acuaugagcuggucaguuu

SEQ ID NO: 861549 - RNA, 19 nt, Homo sapiens
ggacggaccucaucaacca

SEQ ID NO: 861550 - RNA, 19 nt, Homo sapiens
gacaugaaguaccacauuu

SEQ ID NO: 861551 - RNA, 19 nt, Homo sapiens
agaaugaccuugaacaaug

SEQ ID NO: 861552 - RNA, 19 nt, Homo sapiens
ggaauggccucagcucuug

SEQ ID NO: 861553 - RNA, 19 nt, Homo sapiens
gcaacuggcuaccaucuuc

SEQ ID NO: 861554 - RNA, 19 nt, Homo sapiens
ucaaggcgcugucccugua

SEQ ID NO: 861555 - RNA, 19 nt, Homo sapiens
gggcauugauggaagguaa

SEQ ID NO: 861556 - RNA, 19 nt, Homo sapiens
caaaguaaauggguggauu

SEQ ID NO: 861557 - RNA, 19 nt, Homo sapiens
cuacaaauaugccaagauc

SEQ ID NO: 861558 - RNA, 19 nt, Homo sapiens
gaacagaauccauggagau

SEQ ID NO: 861559 - RNA, 19 nt, Homo sapiens
ccagucgucugcaguaauu

SEQ ID NO: 861560 - RNA, 19 nt, Homo sapiens
caggcuagauccacacuuu

SEQ ID NO: 861561 - RNA, 19 nt, Homo sapiens
guacaaagaaauaggcauu

SEQ ID NO: 861562 - RNA, 19 nt, Homo sapiens
agacacuaaugaccaauaa

SEQ ID NO: 861563 - RNA, 19 nt, Homo sapiens
gcucaaacccgaacacugu

SEQ ID NO: 861564 - RNA, 19 nt, Homo sapiens
gugaacaccuacaaauaug

SEQ ID NO: 861565 - RNA, 19 nt, Homo sapiens
ggacagggcauugauggaa

SEQ ID NO: 861566 - RNA, 19 nt, Homo sapiens
auaaggagaugucagaugu

SEQ ID NO: 861567 - RNA, 19 nt, Homo sapiens
cuaccagcuugcucaguua

SEQ ID NO: 861568 - RNA, 19 nt, Homo sapiens
ucaagacacuaaugaccaa

SEQ ID NO: 861569 - RNA, 19 nt, Homo sapiens
ggacuucagcuccaucaga

SEQ ID NO: 861570 - RNA, 19 nt, Homo sapiens
gcacuggaccucacugaca

SEQ ID NO: 861571 - RNA, 19 nt, Homo sapiens
gagaaugaccuugaacaau

SEQ ID NO: 861572 - RNA, 19 nt, Homo sapiens
ucucucggcuccuuuaaug

SEQ ID NO: 861573 - RNA, 19 nt, Homo sapiens
uagacuagguugccuuugu

SEQ ID NO: 861574 - RNA, 19 nt, Homo sapiens
cgacaugaaguaccacauu

SEQ ID NO: 861575 - RNA, 19 nt, Homo sapiens
caauaaaucagaacaggau

SEQ ID NO: 861576 - RNA, 19 nt, Homo sapiens
cgugaacaccuacaaauau

SEQ ID NO: 861577 - RNA, 19 nt, Homo sapiens
gcaagaccaucgagaucag

SEQ ID NO: 861578 - RNA, 19 nt, Homo sapiens
gaaccucaggccuagacua

SEQ ID NO: 861579 - RNA, 19 nt, Homo sapiens
ccagcuugaugguuucuga

SEQ ID NO: 861580 - RNA, 19 nt, Homo sapiens
uagcaaaggcugcccaaau

SEQ ID NO: 861581 - RNA, 19 nt, Homo sapiens
gagaggaggaguacaacga

SEQ ID NO: 861582 - RNA, 19 nt, Homo sapiens
guaugacgccacugaugua

SEQ ID NO: 861583 - RNA, 19 nt, Homo sapiens
guacuacggaggaacagaa

SEQ ID NO: 861584 - RNA, 19 nt, Homo sapiens
caucucaucugcggcaaga

SEQ ID NO: 861585 - RNA, 19 nt, Homo sapiens
acaauaaggagaugucaga

SEQ ID NO: 861586 - RNA, 19 nt, Homo sapiens
cccuagagcuguuuguuca

SEQ ID NO: 861587 - RNA, 19 nt, Homo sapiens
gcagcaagaccaucgagau

SEQ ID NO: 861588 - RNA, 19 nt, Homo sapiens
aaggagaugucagauguga

SEQ ID NO: 861589 - RNA, 19 nt, Homo sapiens
ucagagaggaggaguacaa

SEQ ID NO: 861590 - RNA, 19 nt, Homo sapiens
ccuggaagcugcacaucug

SEQ ID NO: 861591 - RNA, 19 nt, Homo sapiens
agcaaaggcugcccaaauc

SEQ ID NO: 861592 - RNA, 19 nt, Homo sapiens
gcacaugaaggcccuacug

SEQ ID NO: 861593 - RNA, 19 nt, Homo sapiens
gaacaauaaggagauguca

SEQ ID NO: 861594 - RNA, 19 nt, Homo sapiens
gcuugcagcucauguucga

SEQ ID NO: 861595 - RNA, 19 nt, Homo sapiens
ccacacgcucuacuacuuu

SEQ ID NO: 861596 - RNA, 19 nt, Homo sapiens
caaacuuguucuucaaagg

SEQ ID NO: 861597 - RNA, 19 nt, Homo sapiens
ccaaacuuguucuucaaag

SEQ ID NO: 861598 - RNA, 19 nt, Homo sapiens
gguaugacgccacugaugu

SEQ ID NO: 861599 - RNA, 19 nt, Homo sapiens
gaugguuucugagcuaagu

SEQ ID NO: 861600 - RNA, 19 nt, Homo sapiens
cgagcgagccgaugccuau

SEQ ID NO: 861601 - RNA, 19 nt, Homo sapiens
ccgugaacaccuacaaaua

SEQ ID NO: 861602 - RNA, 19 nt, Homo sapiens
ucucggagcugagugacuu

SEQ ID NO: 861603 - RNA, 19 nt, Homo sapiens
gaaggaaagcuguuuuaug

SEQ ID NO: 861604 - RNA, 19 nt, Homo sapiens
gaacugcuucagccacuca

SEQ ID NO: 861605 - RNA, 19 nt, Homo sapiens
gacauucgcugugcugcau

SEQ ID NO: 861606 - RNA, 19 nt, Homo sapiens
cgagaaugaccuugaacaa

SEQ ID NO: 861607 - RNA, 19 nt, Homo sapiens
ucucggcuccuuuaaugua

SEQ ID NO: 861608 - RNA, 19 nt, Homo sapiens
ucaagucucucggcuccuu

SEQ ID NO: 861609 - RNA, 19 nt, Homo sapiens
agacuagguugccuuugug

SEQ ID NO: 861610 - RNA, 19 nt, Homo sapiens
ggccucagcucuuguuuug

SEQ ID NO: 861611 - RNA, 19 nt, Homo sapiens
ggaauccuuaugaauguau

SEQ ID NO: 861612 - RNA, 19 nt, Homo sapiens
agagugccgugaacaccua

SEQ ID NO: 861613 - RNA, 19 nt, Homo sapiens
ggcuggauguacaaagaaa

SEQ ID NO: 861614 - RNA, 19 nt, Homo sapiens
acuaccagcuugcucaguu

SEQ ID NO: 861615 - RNA, 19 nt, Homo sapiens
caucuucacccacugcuau

SEQ ID NO: 861616 - RNA, 19 nt, Homo sapiens
cgccacagcccaucacuug

SEQ ID NO: 861617 - RNA, 19 nt, Homo sapiens
caauaauguugucacuuac

SEQ ID NO: 861618 - RNA, 19 nt, Homo sapiens
gacugugacucuuggagau

SEQ ID NO: 861619 - RNA, 19 nt, Homo sapiens
cuugaugguuucugagcua

SEQ ID NO: 861620 - RNA, 19 nt, Homo sapiens
gagaucagcgacaugaagu

SEQ ID NO: 861621 - RNA, 19 nt, Homo sapiens
ggguuaacaccauggauga

SEQ ID NO: 861622 - RNA, 19 nt, Homo sapiens
ugccuggucuggacuguga

SEQ ID NO: 861623 - RNA, 19 nt, Homo sapiens
gguaagggccaggagaaga

SEQ ID NO: 861624 - RNA, 19 nt, Homo sapiens
cugugacucuuggagauua

SEQ ID NO: 861625 - RNA, 19 nt, Homo sapiens
cuagagcuguuuguucaau

SEQ ID NO: 861626 - RNA, 19 nt, Homo sapiens
gcauggagagugccgugaa

SEQ ID NO: 861627 - RNA, 19 nt, Homo sapiens
ucacggccuugcccucgaa

SEQ ID NO: 861628 - RNA, 19 nt, Homo sapiens
uaaaggacagggcauugau

SEQ ID NO: 861629 - RNA, 19 nt, Homo sapiens
ugacagcuucuaacagguu

SEQ ID NO: 861630 - RNA, 19 nt, Homo sapiens
gauuaaaggacagggcauu

SEQ ID NO: 861631 - RNA, 19 nt, Homo sapiens
gggccucaguaaacucaga

SEQ ID NO: 861632 - RNA, 19 nt, Homo sapiens
guccagaugcugauugaug

SEQ ID NO: 861633 - RNA, 19 nt, Homo sapiens
cuggauguacaaagaaaua

SEQ ID NO: 861634 - RNA, 19 nt, Homo sapiens
uccacacgcucuacuacuu

SEQ ID NO: 861635 - RNA, 19 nt, Homo sapiens
cugcuuggcuggauguaca

SEQ ID NO: 861636 - RNA, 19 nt, Homo sapiens
ggauugagagcugggcaaa

SEQ ID NO: 861637 - RNA, 19 nt, Homo sapiens
gagcuaagucuggcaugga

SEQ ID NO: 861638 - RNA, 19 nt, Homo sapiens
aaggaaagcuguuuuaugc

SEQ ID NO: 861639 - RNA, 19 nt, Homo sapiens
acgaagcgaugguccagau

SEQ ID NO: 861640 - RNA, 19 nt, Homo sapiens
auugagagcugggcaaaca

SEQ ID NO: 861641 - RNA, 19 nt, Homo sapiens
ggaagcugcacaucuggau

SEQ ID NO: 861642 - RNA, 19 nt, Homo sapiens
acgaggacaugaacugcuu

SEQ ID NO: 861643 - RNA, 19 nt, Homo sapiens
uacuguaaauguacuaugg

SEQ ID NO: 861644 - RNA, 19 nt, Homo sapiens
guaagggccaggagaagag

SEQ ID NO: 861645 - RNA, 19 nt, Homo sapiens
gcccaaauccccaaacuug

SEQ ID NO: 861646 - RNA, 19 nt, Homo sapiens
agagcuguuuguucaauca

SEQ ID NO: 861647 - RNA, 19 nt, Homo sapiens
gaacaaauauggcuaauug

SEQ ID NO: 861648 - RNA, 19 nt, Homo sapiens
gagcauuucuugaaucaua

SEQ ID NO: 861649 - RNA, 19 nt, Homo sapiens
gaagacauaugguaucauu

SEQ ID NO: 861650 - RNA, 19 nt, Homo sapiens
gguaagagaagaacaaaua

SEQ ID NO: 861651 - RNA, 19 nt, Homo sapiens
aaacauggauucugaguug

SEQ ID NO: 861652 - RNA, 19 nt, Homo sapiens
gaaggcauauguuuguauu

SEQ ID NO: 861653 - RNA, 19 nt, Homo sapiens
gggcagauuuccauucuuu

SEQ ID NO: 861654 - RNA, 19 nt, Homo sapiens
ggacaagaauuuauuagag

SEQ ID NO: 861655 - RNA, 19 nt, Homo sapiens
ggaaaggaauucauuaacu

SEQ ID NO: 861656 - RNA, 19 nt, Homo sapiens
gcagugccuucauaucuaa

SEQ ID NO: 861657 - RNA, 19 nt, Homo sapiens
gucacaagauuccacauua

SEQ ID NO: 861658 - RNA, 19 nt, Homo sapiens
gcauuugguuuguuuggua

SEQ ID NO: 861659 - RNA, 19 nt, Homo sapiens
ucacaagauuccacauuaa

SEQ ID NO: 861660 - RNA, 19 nt, Homo sapiens
gaaaagggcauuugucuaa

SEQ ID NO: 861661 - RNA, 19 nt, Homo sapiens
gaagaacaaauauggcuaa

SEQ ID NO: 861662 - RNA, 19 nt, Homo sapiens
agaguuggcuauuauguaa

SEQ ID NO: 861663 - RNA, 19 nt, Homo sapiens
gcagagagcaguaauccaa

SEQ ID NO: 861664 - RNA, 19 nt, Homo sapiens
gagcaguaauccaaaucua

SEQ ID NO: 861665 - RNA, 19 nt, Homo sapiens
gcuaauuacuuguaccuau

SEQ ID NO: 861666 - RNA, 19 nt, Homo sapiens
ggauaacccuucuccuuuc

SEQ ID NO: 861667 - RNA, 19 nt, Homo sapiens
gaagaauacgaucaaguuu

SEQ ID NO: 861668 - RNA, 19 nt, Homo sapiens
gacagcauuugguuuguuu

SEQ ID NO: 861669 - RNA, 19 nt, Homo sapiens
uuucuaagcuucaaaggaa

SEQ ID NO: 861670 - RNA, 19 nt, Homo sapiens
uauaauggcucaaauuggu

SEQ ID NO: 861671 - RNA, 19 nt, Homo sapiens
gagguagaauacuuucauu

SEQ ID NO: 861672 - RNA, 19 nt, Homo sapiens
uaucagagcauuucuugaa

SEQ ID NO: 861673 - RNA, 19 nt, Homo sapiens
ggacagcauuugguuuguu

SEQ ID NO: 861674 - RNA, 19 nt, Homo sapiens
gaacuuuaggauccaauuu

SEQ ID NO: 861675 - RNA, 19 nt, Homo sapiens
gagacagaauuaagggaaa

SEQ ID NO: 861676 - RNA, 19 nt, Homo sapiens
agaaugagaucaggcauau

SEQ ID NO: 861677 - RNA, 19 nt, Homo sapiens
ccucuuauggcuacuauua

SEQ ID NO: 861678 - RNA, 19 nt, Homo sapiens
caagauuccacauuaauug

SEQ ID NO: 861679 - RNA, 19 nt, Homo sapiens
ucagaaaacucacuaaaug

SEQ ID NO: 861680 - RNA, 19 nt, Homo sapiens
aaucuacagucacuucuuu

SEQ ID NO: 861681 - RNA, 19 nt, Homo sapiens
ugaagaauacgaucaaguu

SEQ ID NO: 861682 - RNA, 19 nt, Homo sapiens
gcauuugucuaaacaugga

SEQ ID NO: 861683 - RNA, 19 nt, Homo sapiens
aaugagaucaggcauauuu

SEQ ID NO: 861684 - RNA, 19 nt, Homo sapiens
uaccaucccuuuaguacaa

SEQ ID NO: 861685 - RNA, 19 nt, Homo sapiens
gaaaagcaaucuuggaaag

SEQ ID NO: 861686 - RNA, 19 nt, Homo sapiens
gaagaugcagagagcagua

SEQ ID NO: 861687 - RNA, 19 nt, Homo sapiens
guaacuguugugcuaauua

SEQ ID NO: 861688 - RNA, 19 nt, Homo sapiens
gcaggaaggcauauguuug

SEQ ID NO: 861689 - RNA, 19 nt, Homo sapiens
gggcauuugucuaaacaug

SEQ ID NO: 861690 - RNA, 19 nt, Homo sapiens
gcaagacagccauaugaug

SEQ ID NO: 861691 - RNA, 19 nt, Homo sapiens
gacauacucuagauagcuu

SEQ ID NO: 861692 - RNA, 19 nt, Homo sapiens
ugaauuccguaaguacaua

SEQ ID NO: 861693 - RNA, 19 nt, Homo sapiens
gaacuauuucccugaauuc

SEQ ID NO: 861694 - RNA, 19 nt, Homo sapiens
cucacuaaaugucauguua

SEQ ID NO: 861695 - RNA, 19 nt, Homo sapiens
cgaggacaagaauuuauua

SEQ ID NO: 861696 - RNA, 19 nt, Homo sapiens
aggcguaacuguugugcua

SEQ ID NO: 861697 - RNA, 19 nt, Homo sapiens
ucgaggaccugucugaaga

SEQ ID NO: 861698 - RNA, 19 nt, Homo sapiens
guaguacucuuccccauuu

SEQ ID NO: 861699 - RNA, 19 nt, Homo sapiens
agaacuauuucccugaauu

SEQ ID NO: 861700 - RNA, 19 nt, Homo sapiens
ucaaagggaugguccacau

SEQ ID NO: 861701 - RNA, 19 nt, Homo sapiens
cacauuaauugggaagaua

SEQ ID NO: 861702 - RNA, 19 nt, Homo sapiens
cagagcauuucuugaauca

SEQ ID NO: 861703 - RNA, 19 nt, Homo sapiens
ucauuauucuugcagcuaa

SEQ ID NO: 861704 - RNA, 19 nt, Homo sapiens
aaagcaaucuuggaaagga

SEQ ID NO: 861705 - RNA, 19 nt, Homo sapiens
caucauuauuguccaguga

SEQ ID NO: 861706 - RNA, 19 nt, Homo sapiens
gugaagacauaugguauca

SEQ ID NO: 861707 - RNA, 19 nt, Homo sapiens
gucuaaacauggauucuga

SEQ ID NO: 861708 - RNA, 19 nt, Homo sapiens
ccauggauuuagaaaggua

SEQ ID NO: 861709 - RNA, 19 nt, Homo sapiens
ggauuauaauggcucaaau

SEQ ID NO: 861710 - RNA, 19 nt, Homo sapiens
gacagucuuuggaccacua

SEQ ID NO: 861711 - RNA, 19 nt, Homo sapiens
ucacuucuuucaacagaug

SEQ ID NO: 861712 - RNA, 19 nt, Homo sapiens
gcaguaauccaaaucuaca

SEQ ID NO: 861713 - RNA, 19 nt, Homo sapiens
ugccagauguuaaacuuug

SEQ ID NO: 861714 - RNA, 19 nt, Homo sapiens
aaagugaauuugugaagca

SEQ ID NO: 861715 - RNA, 19 nt, Homo sapiens
ugcauuaccuucagcauca

SEQ ID NO: 861716 - RNA, 19 nt, Homo sapiens
uaugugggcucugcagaaa

SEQ ID NO: 861717 - RNA, 19 nt, Homo sapiens
ugaauauacugagacagaa

SEQ ID NO: 861718 - RNA, 19 nt, Homo sapiens
guaaaauacuucugacugu

SEQ ID NO: 861719 - RNA, 19 nt, Homo sapiens
cuagauagcuuuuccaaca

SEQ ID NO: 861720 - RNA, 19 nt, Homo sapiens
uggauaacccuucuccuuu

SEQ ID NO: 861721 - RNA, 19 nt, Homo sapiens
aauacaaacucccuguguu

SEQ ID NO: 861722 - RNA, 19 nt, Homo sapiens
acagaacuauuucccugaa

SEQ ID NO: 861723 - RNA, 19 nt, Homo sapiens
ggaauauuuuggcaucuaa

SEQ ID NO: 861724 - RNA, 19 nt, Homo sapiens
uaacuguugugcuaauuac

SEQ ID NO: 861725 - RNA, 19 nt, Homo sapiens
ggaaggcauauguuuguau

SEQ ID NO: 861726 - RNA, 19 nt, Homo sapiens
uaaaugggguaaaagguuu

SEQ ID NO: 861727 - RNA, 19 nt, Homo sapiens
gaauaucagagcauuucuu

SEQ ID NO: 861728 - RNA, 19 nt, Homo sapiens
gacuuggaauggaaaauua

SEQ ID NO: 861729 - RNA, 19 nt, Homo sapiens
ggucacaagauuccacauu

SEQ ID NO: 861730 - RNA, 19 nt, Homo sapiens
aagcaagacagccauauga

SEQ ID NO: 861731 - RNA, 19 nt, Homo sapiens
cuaauuacuuguaccuauc

SEQ ID NO: 861732 - RNA, 19 nt, Homo sapiens
gugcucccguguaaauaaa

SEQ ID NO: 861733 - RNA, 19 nt, Homo sapiens
cugcagaaagugaagaaua

SEQ ID NO: 861734 - RNA, 19 nt, Homo sapiens
cugaagacuuggaauggaa

SEQ ID NO: 861735 - RNA, 19 nt, Homo sapiens
gauaacccuucuccuuucu

SEQ ID NO: 861736 - RNA, 19 nt, Homo sapiens
cagaaugagaucaggcaua

SEQ ID NO: 861737 - RNA, 19 nt, Homo sapiens
cauguuauuggcaguauuu

SEQ ID NO: 861738 - RNA, 19 nt, Homo sapiens
uagaccagguuguaaagau

SEQ ID NO: 861739 - RNA, 19 nt, Homo sapiens
ccacauuaauugggaagau

SEQ ID NO: 861740 - RNA, 19 nt, Homo sapiens
gccauaugaugcagguuau

SEQ ID NO: 861741 - RNA, 19 nt, Homo sapiens
ucagagcauuucuugaauc

SEQ ID NO: 861742 - RNA, 19 nt, Homo sapiens
gaaacaggaaucauuagac

SEQ ID NO: 861743 - RNA, 19 nt, Homo sapiens
ggaaaauccaccaguaaaa

SEQ ID NO: 861744 - RNA, 19 nt, Homo sapiens
uccauuaacuaguucauag

SEQ ID NO: 861745 - RNA, 19 nt, Homo sapiens
ugcagugccuucauaucua

SEQ ID NO: 861746 - RNA, 19 nt, Homo sapiens
gcauauuugugguugacau

SEQ ID NO: 861747 - RNA, 19 nt, Homo sapiens
gaagacgucugacacuauu

SEQ ID NO: 861748 - RNA, 19 nt, Homo sapiens
cacauugucuugcuaaaua

SEQ ID NO: 861749 - RNA, 19 nt, Homo sapiens
gagaggaggaagacuauua

SEQ ID NO: 861750 - RNA, 19 nt, Homo sapiens
gaggaagacuauuaaagga

SEQ ID NO: 861751 - RNA, 19 nt, Homo sapiens
gaugauaccucaggcucua

SEQ ID NO: 861752 - RNA, 19 nt, Homo sapiens
gaugacauguuucguagau

SEQ ID NO: 861753 - RNA, 19 nt, Homo sapiens
gcagagaggaggaagacua

SEQ ID NO: 861754 - RNA, 19 nt, Homo sapiens
ggagucucauccuucauuu

SEQ ID NO: 861755 - RNA, 19 nt, Homo sapiens
ggaggaagacuauuaaagg

SEQ ID NO: 861756 - RNA, 19 nt, Homo sapiens
caacaucgacauccucaga

SEQ ID NO: 861757 - RNA, 19 nt, Homo sapiens
caagggacauggcaacuac

SEQ ID NO: 861758 - RNA, 19 nt, Homo sapiens
gcugggcuauggccucuuu

SEQ ID NO: 861759 - RNA, 19 nt, Homo sapiens
gcagguggcagaucagaug

SEQ ID NO: 861760 - RNA, 19 nt, Homo sapiens
gcucuagcuucgaggauau

SEQ ID NO: 861761 - RNA, 19 nt, Homo sapiens
ucaccaugcugcagauguu

SEQ ID NO: 861762 - RNA, 19 nt, Homo sapiens
gaaaaugggucagcuccuu

SEQ ID NO: 861763 - RNA, 19 nt, Homo sapiens
gcauugcauuguccuguuc

SEQ ID NO: 861764 - RNA, 19 nt, Homo sapiens
gcucagcugugauugacau

SEQ ID NO: 861765 - RNA, 19 nt, Homo sapiens
guucaucaccuauaauauc

SEQ ID NO: 861766 - RNA, 19 nt, Homo sapiens
gagaguuccugggcaugaa

SEQ ID NO: 861767 - RNA, 19 nt, Homo sapiens
gggagucucauccuucauu

SEQ ID NO: 861768 - RNA, 19 nt, Homo sapiens
ugggucagcuccuuugaga

SEQ ID NO: 861769 - RNA, 19 nt, Homo sapiens
agaggaggauggagaguuc

SEQ ID NO: 861770 - RNA, 19 nt, Homo sapiens
ggagaguuccugggcauga

SEQ ID NO: 861771 - RNA, 19 nt, Homo sapiens
ggcucuagcuucgaggaua

SEQ ID NO: 861772 - RNA, 19 nt, Homo sapiens
cuuuaucucucccacauug

SEQ ID NO: 861773 - RNA, 19 nt, Homo sapiens
ucucauccuucauuuacuu

SEQ ID NO: 861774 - RNA, 19 nt, Homo sapiens
cuaucaagguggucaacuu

SEQ ID NO: 861775 - RNA, 19 nt, Homo sapiens
cagcugugauugacaugga

SEQ ID NO: 861776 - RNA, 19 nt, Homo sapiens
gaaaggcacaaggccaaga

SEQ ID NO: 861777 - RNA, 19 nt, Homo sapiens
gaggaggaagacuauuaaa

SEQ ID NO: 861778 - RNA, 19 nt, Homo sapiens
ggcauugcauuguccuguu

SEQ ID NO: 861779 - RNA, 19 nt, Homo sapiens
ugaagacgucugacacuau

SEQ ID NO: 861780 - RNA, 19 nt, Homo sapiens
ggaagaaguagacgcugau

SEQ ID NO: 861781 - RNA, 19 nt, Homo sapiens
ggauaugggugagcugcau

SEQ ID NO: 861782 - RNA, 19 nt, Homo sapiens
ugauugacauggagaacau

SEQ ID NO: 861783 - RNA, 19 nt, Homo sapiens
gagaaccccuccccaccua

SEQ ID NO: 861784 - RNA, 19 nt, Homo sapiens
ccugaugacauguuucgua

SEQ ID NO: 861785 - RNA, 19 nt, Homo sapiens
agaggaggaagacuauuaa

SEQ ID NO: 861786 - RNA, 19 nt, Homo sapiens
gcgcaugguagcaguguug

SEQ ID NO: 861787 - RNA, 19 nt, Homo sapiens
gagucucauccuucauuua

SEQ ID NO: 861788 - RNA, 19 nt, Homo sapiens
uggagaacauggaugauac

SEQ ID NO: 861789 - RNA, 19 nt, Homo sapiens
ggucagcuccuuugagaac

SEQ ID NO: 861790 - RNA, 19 nt, Homo sapiens
ucucgacccuggacgucua

SEQ ID NO: 861791 - RNA, 19 nt, Homo sapiens
aauugcaggugaacucuau

SEQ ID NO: 861792 - RNA, 19 nt, Homo sapiens
gcuaaauauagacuuggua

SEQ ID NO: 861793 - RNA, 19 nt, Homo sapiens
ccucaacgccacagccaaa

SEQ ID NO: 861794 - RNA, 19 nt, Homo sapiens
cagagaggaggaagacuau

SEQ ID NO: 861795 - RNA, 19 nt, Homo sapiens
ccagggccuucagcuugua

SEQ ID NO: 861796 - RNA, 19 nt, Homo sapiens
gaggcucagcugugauuga

SEQ ID NO: 861797 - RNA, 19 nt, Homo sapiens
ucaagggacauggcaacua

SEQ ID NO: 861798 - RNA, 19 nt, Homo sapiens
agaaguagacgcugaugca

SEQ ID NO: 861799 - RNA, 19 nt, Homo sapiens
gaagaaguagacgcugaug

SEQ ID NO: 861800 - RNA, 19 nt, Homo sapiens
ccacauugucuugcuaaau

SEQ ID NO: 861801 - RNA, 19 nt, Homo sapiens
ggggaggguucgaagaaaa

SEQ ID NO: 861802 - RNA, 19 nt, Homo sapiens
gaugaagacgucugacacu

SEQ ID NO: 861803 - RNA, 19 nt, Homo sapiens
gaaaauugcaggugaacuc

SEQ ID NO: 861804 - RNA, 19 nt, Homo sapiens
cuugcuaaauauagacuug

SEQ ID NO: 861805 - RNA, 19 nt, Homo sapiens
augaagacgucugacacua

SEQ ID NO: 861806 - RNA, 19 nt, Homo sapiens
cuguucaucaccuauaaua

SEQ ID NO: 861807 - RNA, 19 nt, Homo sapiens
gggaugaagacgucugaca

SEQ ID NO: 861808 - RNA, 19 nt, Homo sapiens
ccagaaaauugcaggugaa

SEQ ID NO: 861809 - RNA, 19 nt, Homo sapiens
agacgucugacacuauuau

SEQ ID NO: 861810 - RNA, 19 nt, Homo sapiens
uaucaagguggucaacuuc

SEQ ID NO: 861811 - RNA, 19 nt, Homo sapiens
aaaggcacaaggccaagaa

SEQ ID NO: 861812 - RNA, 19 nt, Homo sapiens
gcaccugcuucggcuacug

SEQ ID NO: 861813 - RNA, 19 nt, Homo sapiens
caguccugaugacauguuu

SEQ ID NO: 861814 - RNA, 19 nt, Homo sapiens
gcauuguccuguucaucac

SEQ ID NO: 861815 - RNA, 19 nt, Homo sapiens
gcaacgcccagaucaccau

SEQ ID NO: 861816 - RNA, 19 nt, Homo sapiens
ggucuucacucugguugcu

SEQ ID NO: 861817 - RNA, 19 nt, Homo sapiens
cggaggcucagcugugauu

SEQ ID NO: 861818 - RNA, 19 nt, Homo sapiens
gauguggcaggcugggaaa

SEQ ID NO: 861819 - RNA, 19 nt, Homo sapiens
gaacucuauggaccucuca

SEQ ID NO: 861820 - RNA, 19 nt, Homo sapiens
gggcaugaagggcuuuaag

SEQ ID NO: 861821 - RNA, 19 nt, Homo sapiens
caacaucucugcuuccuaa

SEQ ID NO: 861822 - RNA, 19 nt, Homo sapiens
ggaaguagaacaugcauua

SEQ ID NO: 861823 - RNA, 19 nt, Homo sapiens
gagaugagcugaguuauag

SEQ ID NO: 861824 - RNA, 19 nt, Homo sapiens
gauaauggcuguaaaaugu

SEQ ID NO: 861825 - RNA, 19 nt, Homo sapiens
aaccauagcuccacuguga

SEQ ID NO: 861826 - RNA, 19 nt, Homo sapiens
gaaaggaaaugagcucuac

SEQ ID NO: 861827 - RNA, 19 nt, Homo sapiens
ccagagaccguuugcuuua

SEQ ID NO: 861828 - RNA, 19 nt, Homo sapiens
gagcugaguuauagagaga

SEQ ID NO: 861829 - RNA, 19 nt, Homo sapiens
ggaugaggauuaacuguuc

SEQ ID NO: 861830 - RNA, 19 nt, Homo sapiens
cuaagaacauuuccauaga

SEQ ID NO: 861831 - RNA, 19 nt, Homo sapiens
caacugguccacugcuuua

SEQ ID NO: 861832 - RNA, 19 nt, Homo sapiens
ccagagauauccacagcuu

SEQ ID NO: 861833 - RNA, 19 nt, Homo sapiens
caacaacccucuguacgau

SEQ ID NO: 861834 - RNA, 19 nt, Homo sapiens
gaucagcagaguugcauuu

SEQ ID NO: 861835 - RNA, 19 nt, Homo sapiens
caagugaucagcagaguug

SEQ ID NO: 861836 - RNA, 19 nt, Homo sapiens
gaggauuaacuguucuuua

SEQ ID NO: 861837 - RNA, 19 nt, Homo sapiens
agagaccguuugcuuuaua

SEQ ID NO: 861838 - RNA, 19 nt, Homo sapiens
gggaacauuucauuugugu

SEQ ID NO: 861839 - RNA, 19 nt, Homo sapiens
caacggcacucacaacaac

SEQ ID NO: 861840 - RNA, 19 nt, Homo sapiens
gaucccagcccacaaguga

SEQ ID NO: 861841 - RNA, 19 nt, Homo sapiens
caucucugcuuccuaagaa

SEQ ID NO: 861842 - RNA, 19 nt, Homo sapiens
uaaaggaugucugcucugu

SEQ ID NO: 861843 - RNA, 19 nt, Homo sapiens
caagugagaaucagcuauu

SEQ ID NO: 861844 - RNA, 19 nt, Homo sapiens
gcacugaguacuucauuag

SEQ ID NO: 861845 - RNA, 19 nt, Homo sapiens
ugagaugagcugaguuaua

SEQ ID NO: 861846 - RNA, 19 nt, Homo sapiens
gaucaugcaggaaguagaa

SEQ ID NO: 861847 - RNA, 19 nt, Homo sapiens
uaugagaugagcugaguua

SEQ ID NO: 861848 - RNA, 19 nt, Homo sapiens
ggaaaggaaaugagcucua

SEQ ID NO: 861849 - RNA, 19 nt, Homo sapiens
cuauuuaucugguuguuuc

SEQ ID NO: 861850 - RNA, 19 nt, Homo sapiens
ggacccacuuugagaagga

SEQ ID NO: 861851 - RNA, 19 nt, Homo sapiens
gaaguagaacaugcauuaa

SEQ ID NO: 861852 - RNA, 19 nt, Homo sapiens
ggaguccacuuaacaacca

SEQ ID NO: 861853 - RNA, 19 nt, Homo sapiens
gcuaugagaugagcugagu

SEQ ID NO: 861854 - RNA, 19 nt, Homo sapiens
agaguugcauuuccaaaga

SEQ ID NO: 861855 - RNA, 19 nt, Homo sapiens
ggccugggaugaggauuaa

SEQ ID NO: 861856 - RNA, 19 nt, Homo sapiens
gaguugcauuuccaaagaa

SEQ ID NO: 861857 - RNA, 19 nt, Homo sapiens
gaugucugcucuguucaaa

SEQ ID NO: 861858 - RNA, 19 nt, Homo sapiens
uaagaacauuuccauagag

SEQ ID NO: 861859 - RNA, 19 nt, Homo sapiens
gcaacugguccacugcuuu

SEQ ID NO: 861860 - RNA, 19 nt, Homo sapiens
gauuuggguuguuuuguua

SEQ ID NO: 861861 - RNA, 19 nt, Homo sapiens
gugcuuauccaguagaauu

SEQ ID NO: 861862 - RNA, 19 nt, Homo sapiens
caggcaaagugauguguga

SEQ ID NO: 861863 - RNA, 19 nt, Homo sapiens
ggaggaggauuuggguugu

SEQ ID NO: 861864 - RNA, 19 nt, Homo sapiens
uuuacugucuguuggauaa

SEQ ID NO: 861865 - RNA, 19 nt, Homo sapiens
gcugaguuauagagagaaa

SEQ ID NO: 861866 - RNA, 19 nt, Homo sapiens
aaggaugucugcucuguuc

SEQ ID NO: 861867 - RNA, 19 nt, Homo sapiens
gcaggacccacuuugagaa

SEQ ID NO: 861868 - RNA, 19 nt, Homo sapiens
ucuguacgaugacuccuaa

SEQ ID NO: 861869 - RNA, 19 nt, Homo sapiens
caucagcuccuuugucugu

SEQ ID NO: 861870 - RNA, 19 nt, Homo sapiens
cagcagaguugcauuucca

SEQ ID NO: 861871 - RNA, 19 nt, Homo sapiens
uacgaugacuccuaacaau

SEQ ID NO: 861872 - RNA, 19 nt, Homo sapiens
acaacccucuguacgauga

SEQ ID NO: 861873 - RNA, 19 nt, Homo sapiens
ccuaagaacauuuccauag

SEQ ID NO: 861874 - RNA, 19 nt, Homo sapiens
guacgaugacuccuaacaa

SEQ ID NO: 861875 - RNA, 19 nt, Homo sapiens
aaucaggcauuccuccuau

SEQ ID NO: 861876 - RNA, 19 nt, Homo sapiens
ggaguugcagccuaccuaa

SEQ ID NO: 861877 - RNA, 19 nt, Homo sapiens
ggagacaccaccaccuuuc

SEQ ID NO: 861878 - RNA, 19 nt, Homo sapiens
uacaucagcuccuuugucu

SEQ ID NO: 861879 - RNA, 19 nt, Homo sapiens
gggcagaaucucucagguu

SEQ ID NO: 861880 - RNA, 19 nt, Homo sapiens
ccaaauaccaggcuaccau

SEQ ID NO: 861881 - RNA, 19 nt, Homo sapiens
gggaugaggauuaacuguu

SEQ ID NO: 861882 - RNA, 19 nt, Homo sapiens
ggaauauggccugggauga

SEQ ID NO: 861883 - RNA, 19 nt, Homo sapiens
aguagaacaugcauuaagu

SEQ ID NO: 861884 - RNA, 19 nt, Homo sapiens
guagaacaugcauuaaguu

SEQ ID NO: 861885 - RNA, 19 nt, Homo sapiens
ugugugagcucauagacau

SEQ ID NO: 861886 - RNA, 19 nt, Homo sapiens
gcccagagaccguuugcuu

SEQ ID NO: 861887 - RNA, 19 nt, Homo sapiens
gaaagggagaggcauguac

SEQ ID NO: 861888 - RNA, 19 nt, Homo sapiens
ggccaccugucucuguaaa

SEQ ID NO: 861889 - RNA, 19 nt, Homo sapiens
ucagcuccuuugucuguuu

SEQ ID NO: 861890 - RNA, 19 nt, Homo sapiens
gaagugggccagccuugca

SEQ ID NO: 861891 - RNA, 19 nt, Homo sapiens
gagaucaccagcccagguu

SEQ ID NO: 861892 - RNA, 19 nt, Homo sapiens
cagagaccguuugcuuuau

SEQ ID NO: 861893 - RNA, 19 nt, Homo sapiens
ggauuuggguuguuuuguu

SEQ ID NO: 861894 - RNA, 19 nt, Homo sapiens
gaggaggauuuggguuguu

SEQ ID NO: 861895 - RNA, 19 nt, Homo sapiens
gguacaagaagaaccauuc

SEQ ID NO: 861896 - RNA, 19 nt, Homo sapiens
caacuuccccuuucuggua

SEQ ID NO: 861897 - RNA, 19 nt, Homo sapiens
gaugacuccuaacaaugga

SEQ ID NO: 861898 - RNA, 19 nt, Homo sapiens
gauggaggguacagagucu

SEQ ID NO: 861899 - RNA, 19 nt, Homo sapiens
guccagcucugaccacaca

SEQ ID NO: 861900 - RNA, 19 nt, Homo sapiens
cgacuaccaucuggacuag

SEQ ID NO: 861901 - RNA, 19 nt, Homo sapiens
gaauauggccugggaugag

SEQ ID NO: 861902 - RNA, 19 nt, Homo sapiens
gaagcaggcguggcagcua

SEQ ID NO: 861903 - RNA, 19 nt, Homo sapiens
ccacugcuuuacugucugu

SEQ ID NO: 861904 - RNA, 19 nt, Homo sapiens
gcagaguugcauuuccaaa

SEQ ID NO: 861905 - RNA, 19 nt, Homo sapiens
aggcuaaccugcacugagu

SEQ ID NO: 861906 - RNA, 19 nt, Homo sapiens
ggugaguggaggcugauuu

SEQ ID NO: 861907 - RNA, 19 nt, Homo sapiens
gagaccguuugcuuuauac

SEQ ID NO: 861908 - RNA, 19 nt, Homo sapiens
acugaguacuucauuagga

SEQ ID NO: 861909 - RNA, 19 nt, Homo sapiens
ugcacugaguacuucauua

SEQ ID NO: 861910 - RNA, 19 nt, Homo sapiens
agugaugugugagcucaua

SEQ ID NO: 861911 - RNA, 19 nt, Homo sapiens
aagaacauuuccauagagu

SEQ ID NO: 861912 - RNA, 19 nt, Homo sapiens
uaaccugcacugaguacuu

SEQ ID NO: 861913 - RNA, 19 nt, Homo sapiens
gagaaagggagaggcaugu

SEQ ID NO: 861914 - RNA, 19 nt, Homo sapiens
ccaccugucucuguaaagg

SEQ ID NO: 861915 - RNA, 19 nt, Homo sapiens
cuguuucucuuccgacaaa

SEQ ID NO: 861916 - RNA, 19 nt, Homo sapiens
gcaggaaguagaacaugca

SEQ ID NO: 861917 - RNA, 19 nt, Homo sapiens
gggaaggcacaaacacaga

SEQ ID NO: 861918 - RNA, 19 nt, Homo sapiens
aaacacugaugcagacacu

SEQ ID NO: 861919 - RNA, 19 nt, Homo sapiens
gcucuuugcaucuuaacug

SEQ ID NO: 861920 - RNA, 19 nt, Homo sapiens
gagcaggguuuucucagau

SEQ ID NO: 861921 - RNA, 19 nt, Homo sapiens
gaaauuaugugcugaagga

SEQ ID NO: 861922 - RNA, 19 nt, Homo sapiens
ucaauaaccuuguccauuu

SEQ ID NO: 861923 - RNA, 19 nt, Homo sapiens
gagcaaagauaacuucuga

SEQ ID NO: 861924 - RNA, 19 nt, Homo sapiens
gguaguggcucaaaccuua

SEQ ID NO: 861925 - RNA, 19 nt, Homo sapiens
gauaaucacugucaaacuu

SEQ ID NO: 861926 - RNA, 19 nt, Homo sapiens
gaaagacccuaugaaugua

SEQ ID NO: 861927 - RNA, 19 nt, Homo sapiens
gggaagaccuuuaguagug

SEQ ID NO: 861928 - RNA, 19 nt, Homo sapiens
ugagaaaccuuauguaugu

SEQ ID NO: 861929 - RNA, 19 nt, Homo sapiens
ugagaaaccuuaugaaugu

SEQ ID NO: 861930 - RNA, 19 nt, Homo sapiens
caacaucacagaauucaua

SEQ ID NO: 861931 - RNA, 19 nt, Homo sapiens
gaaacaaggugugauuaug

SEQ ID NO: 861932 - RNA, 19 nt, Homo sapiens
guaagaaacucugcgaauu

SEQ ID NO: 861933 - RNA, 19 nt, Homo sapiens
caacaucggcggauucaua

SEQ ID NO: 861934 - RNA, 19 nt, Homo sapiens
gaaggacucuaaacauaug

SEQ ID NO: 861935 - RNA, 19 nt, Homo sapiens
gaacaggaguaaagaaugg

SEQ ID NO: 861936 - RNA, 19 nt, Homo sapiens
agagaaaccuuaugaaugu

SEQ ID NO: 861937 - RNA, 19 nt, Homo sapiens
gugagaaacuuuaugaaug

SEQ ID NO: 861938 - RNA, 19 nt, Homo sapiens
gagaaacccuaugaaugua

SEQ ID NO: 861939 - RNA, 19 nt, Homo sapiens
gagaaacccuaugaaugua

SEQ ID NO: 861940 - RNA, 19 nt, Homo sapiens
ggacuugguuaaagacuau

SEQ ID NO: 861941 - RNA, 19 nt, Homo sapiens
gguaguggcucaaaacuua

SEQ ID NO: 861942 - RNA, 19 nt, Homo sapiens
gagagaaaccuuaugaaug

SEQ ID NO: 861943 - RNA, 19 nt, Homo sapiens
guucaaaccuuacucaaca

SEQ ID NO: 861944 - RNA, 19 nt, Homo sapiens
ugaaagacccuaugaaugu

SEQ ID NO: 861945 - RNA, 19 nt, Homo sapiens
caaggcaccugcaagacua

SEQ ID NO: 861946 - RNA, 19 nt, Homo sapiens
uaaccagcccuuaauauuu

SEQ ID NO: 861947 - RNA, 19 nt, Homo sapiens
aggaaggacucuaaacaua

SEQ ID NO: 861948 - RNA, 19 nt, Homo sapiens
gcaagacuaugaaucaaag

SEQ ID NO: 861949 - RNA, 19 nt, Homo sapiens
guucagaccuuacucaaca

SEQ ID NO: 861950 - RNA, 19 nt, Homo sapiens
ugagaaaccuuaugaaugc

SEQ ID NO: 861951 - RNA, 19 nt, Homo sapiens
ugagaaaccuuaugaaugc

SEQ ID NO: 861952 - RNA, 19 nt, Homo sapiens
ggaaaauucuuacuuguga

SEQ ID NO: 861953 - RNA, 19 nt, Homo sapiens
cgacaucagcgaauucaua

SEQ ID NO: 861954 - RNA, 19 nt, Homo sapiens
guacaaaugccuuacuuau

SEQ ID NO: 861955 - RNA, 19 nt, Homo sapiens
ggagagaaaccuuaugaau

SEQ ID NO: 861956 - RNA, 19 nt, Homo sapiens
uggagcaaauccuuuaaua

SEQ ID NO: 861957 - RNA, 19 nt, Homo sapiens
acauaaagcuuggauauca

SEQ ID NO: 861958 - RNA, 19 nt, Homo sapiens
gaaggaaggacucuaaaca

SEQ ID NO: 861959 - RNA, 19 nt, Homo sapiens
gagaaacccuaugagugua

SEQ ID NO: 861960 - RNA, 19 nt, Homo sapiens
gagaaacccuaugagugua

SEQ ID NO: 861961 - RNA, 19 nt, Homo sapiens
agaaacuccuugaauguaa

SEQ ID NO: 861962 - RNA, 19 nt, Homo sapiens
gagaaacuccuugaaugua

SEQ ID NO: 861963 - RNA, 19 nt, Homo sapiens
ggaaggacucuaaacauau

SEQ ID NO: 861964 - RNA, 19 nt, Homo sapiens
cgacaucaaagaauucaua

SEQ ID NO: 861965 - RNA, 19 nt, Homo sapiens
ggugagaaaccauauauau

SEQ ID NO: 861966 - RNA, 19 nt, Homo sapiens
gauguuuccugacugcuuu

SEQ ID NO: 861967 - RNA, 19 nt, Homo sapiens
ggaaacaaggugugauuau

SEQ ID NO: 861968 - RNA, 19 nt, Homo sapiens
gagcaaauccuuuaauacu

SEQ ID NO: 861969 - RNA, 19 nt, Homo sapiens
ugagaaacccuaugaaugu

SEQ ID NO: 861970 - RNA, 19 nt, Homo sapiens
ugagaaacccuaugaaugu

SEQ ID NO: 861971 - RNA, 19 nt, Homo sapiens
ugagaagccuuaugagugu

SEQ ID NO: 861972 - RNA, 19 nt, Homo sapiens
gcaaagauaacuucugaca

SEQ ID NO: 861973 - RNA, 19 nt, Homo sapiens
acaaaugccuuacuuaugc

SEQ ID NO: 861974 - RNA, 19 nt, Homo sapiens
uaagaaacucugcgaauug

SEQ ID NO: 861975 - RNA, 19 nt, Homo sapiens
gaagacaugcccacuuuca

SEQ ID NO: 861976 - RNA, 19 nt, Homo sapiens
cugaagacaugcccacuuu

SEQ ID NO: 861977 - RNA, 19 nt, Homo sapiens
agaaggacuugguuaaaga

SEQ ID NO: 861978 - RNA, 19 nt, Homo sapiens
caacaccagcuaauccaua

SEQ ID NO: 861979 - RNA, 19 nt, Homo sapiens
gaaaccuuaugaaugcaaa

SEQ ID NO: 861980 - RNA, 19 nt, Homo sapiens
gaaaccuuaugaaugcaaa

SEQ ID NO: 861981 - RNA, 19 nt, Homo sapiens
gauaacuucugacauaguc

SEQ ID NO: 861982 - RNA, 19 nt, Homo sapiens
gcccugcccugcuuggaua

SEQ ID NO: 861983 - RNA, 19 nt, Homo sapiens
gagaaaccuuaugaaugua

SEQ ID NO: 861984 - RNA, 19 nt, Homo sapiens
gagaaaccuuauguaugua

SEQ ID NO: 861985 - RNA, 19 nt, Homo sapiens
gagaaaccuuaugaaugua

SEQ ID NO: 861986 - RNA, 19 nt, Homo sapiens
ccaacucccucucagaaga

SEQ ID NO: 861987 - RNA, 19 nt, Homo sapiens
gaaacucugcgaauuggaa

SEQ ID NO: 861988 - RNA, 19 nt, Homo sapiens
gaauguauagauuguggua

SEQ ID NO: 861989 - RNA, 19 nt, Homo sapiens
gaugagaaacuccuugaau

SEQ ID NO: 861990 - RNA, 19 nt, Homo sapiens
ugggagggauucagaguuu

SEQ ID NO: 861991 - RNA, 19 nt, Homo sapiens
ggugagaaaccuuauguau

SEQ ID NO: 861992 - RNA, 19 nt, Homo sapiens
aaacagcuuucccucauca

SEQ ID NO: 861993 - RNA, 19 nt, Homo sapiens
ucacauaaagcuuggauau

SEQ ID NO: 861994 - RNA, 19 nt, Homo sapiens
ggaguuaaaggaugcuaaa

SEQ ID NO: 861995 - RNA, 19 nt, Homo sapiens
ggugaaagacccuaugaau

SEQ ID NO: 861996 - RNA, 19 nt, Homo sapiens
gaugcuaaauuacuaagag

SEQ ID NO: 861997 - RNA, 19 nt, Homo sapiens
gggaaggccuuugguagug

SEQ ID NO: 861998 - RNA, 19 nt, Homo sapiens
gaaugugggaagaccuuua

SEQ ID NO: 861999 - RNA, 19 nt, Homo sapiens
gaaugugggaaguccuuua

SEQ ID NO: 862000 - RNA, 19 nt, Homo sapiens
gggaaggccuuugguagug

SEQ ID NO: 862001 - RNA, 19 nt, Homo sapiens
cagaagaaccugauguuuc

SEQ ID NO: 862002 - RNA, 19 nt, Homo sapiens
guauucaccugucuuuauc

SEQ ID NO: 862003 - RNA, 19 nt, Homo sapiens
ggguuaauccuacuauauu

SEQ ID NO: 862004 - RNA, 19 nt, Homo sapiens
ugagaaacccuaugagugu

SEQ ID NO: 862005 - RNA, 19 nt, Homo sapiens
gguaaggccuuuaguuuug

SEQ ID NO: 862006 - RNA, 19 nt, Homo sapiens
ugagaaacccuaugagugu

SEQ ID NO: 862007 - RNA, 19 nt, Homo sapiens
ccacaaggcaccugcaaga

SEQ ID NO: 862008 - RNA, 19 nt, Homo sapiens
ggauaucaggucaguguuu

SEQ ID NO: 862009 - RNA, 19 nt, Homo sapiens
gcuggagauuuauagcuaa

SEQ ID NO: 862010 - RNA, 19 nt, Homo sapiens
gcucaaaacuuauccaaca

SEQ ID NO: 862011 - RNA, 19 nt, Homo sapiens
gugguaaggccuuuaguuu

SEQ ID NO: 862012 - RNA, 19 nt, Homo sapiens
gugagaaaccuuaugaaug

SEQ ID NO: 862013 - RNA, 19 nt, Homo sapiens
gugagaaaccuuaugaaug

SEQ ID NO: 862014 - RNA, 19 nt, Homo sapiens
gugagaaaccuuaugaaug

SEQ ID NO: 862015 - RNA, 19 nt, Homo sapiens
ggugagaaacuuuaugaau

SEQ ID NO: 862016 - RNA, 19 nt, Homo sapiens
cagcaucagagaauucaua

SEQ ID NO: 862017 - RNA, 19 nt, Homo sapiens
gaaacuccuugaauguaag

SEQ ID NO: 862018 - RNA, 19 nt, Homo sapiens
cagcaucagagaauucaua

SEQ ID NO: 862019 - RNA, 19 nt, Homo sapiens
gauauuuacuccugaagac

SEQ ID NO: 862020 - RNA, 19 nt, Homo sapiens
gcugaaggaaggacucuaa

SEQ ID NO: 862021 - RNA, 19 nt, Homo sapiens
gaaccagccucauuugauu

SEQ ID NO: 862022 - RNA, 19 nt, Homo sapiens
gaacagcuauuccgguuau

SEQ ID NO: 862023 - RNA, 19 nt, Homo sapiens
ggucaucacuucccagaaa

SEQ ID NO: 862024 - RNA, 19 nt, Homo sapiens
caagucaaauggagaagua

SEQ ID NO: 862025 - RNA, 19 nt, Homo sapiens
uaucaaaccucauauggaa

SEQ ID NO: 862026 - RNA, 19 nt, Homo sapiens
guaguucacuuaacaaugu

SEQ ID NO: 862027 - RNA, 19 nt, Homo sapiens
gcaagaugauuguuugaga

SEQ ID NO: 862028 - RNA, 19 nt, Homo sapiens
caaagaacaggauaguuua

SEQ ID NO: 862029 - RNA, 19 nt, Homo sapiens
gguaugagcuuuaaauggu

SEQ ID NO: 862030 - RNA, 19 nt, Homo sapiens
gaauggaauuugggcuuua

SEQ ID NO: 862031 - RNA, 19 nt, Homo sapiens
guagauguuugcacaguuu

SEQ ID NO: 862032 - RNA, 19 nt, Homo sapiens
gcaaauuucauacuaguug

SEQ ID NO: 862033 - RNA, 19 nt, Homo sapiens
gaacaggauaguuuagaaa

SEQ ID NO: 862034 - RNA, 19 nt, Homo sapiens
acaaagaacaggauaguuu

SEQ ID NO: 862035 - RNA, 19 nt, Homo sapiens
gaccaaugaugauauccua

SEQ ID NO: 862036 - RNA, 19 nt, Homo sapiens
aaaguggucugauguaguu

SEQ ID NO: 862037 - RNA, 19 nt, Homo sapiens
gaugauuguuugagaggua

SEQ ID NO: 862038 - RNA, 19 nt, Homo sapiens
gaacccaaauagcauuaga

SEQ ID NO: 862039 - RNA, 19 nt, Homo sapiens
agaccuaccuuucugauga

SEQ ID NO: 862040 - RNA, 19 nt, Homo sapiens
gaacaucaccgauuuuaaa

SEQ ID NO: 862041 - RNA, 19 nt, Homo sapiens
cagaugggcuuacccuuga

SEQ ID NO: 862042 - RNA, 19 nt, Homo sapiens
gaauaugucugugugaaca

SEQ ID NO: 862043 - RNA, 19 nt, Homo sapiens
caucccaccuccuuguuua

SEQ ID NO: 862044 - RNA, 19 nt, Homo sapiens
agaggaagguucacaagaa

SEQ ID NO: 862045 - RNA, 19 nt, Homo sapiens
uuacgaagcuugaguacug

SEQ ID NO: 862046 - RNA, 19 nt, Homo sapiens
caucuuccaugcuguguaa

SEQ ID NO: 862047 - RNA, 19 nt, Homo sapiens
gguaguguuuggauaauau

SEQ ID NO: 862048 - RNA, 19 nt, Homo sapiens
gaaguaaagugaggcaaca

SEQ ID NO: 862049 - RNA, 19 nt, Homo sapiens
gcacguacaugggccagaa

SEQ ID NO: 862050 - RNA, 19 nt, Homo sapiens
gagcuacucggacucuuua

SEQ ID NO: 862051 - RNA, 19 nt, Homo sapiens
gcagauaucagagugcuaa

SEQ ID NO: 862052 - RNA, 19 nt, Homo sapiens
cuacucggacucuuuauua

SEQ ID NO: 862053 - RNA, 19 nt, Homo sapiens
gguaguaauuuccucagaa

SEQ ID NO: 862054 - RNA, 19 nt, Homo sapiens
ggaauuugggcuuuaauga

SEQ ID NO: 862055 - RNA, 19 nt, Homo sapiens
aaacacagacuacaaaugu

SEQ ID NO: 862056 - RNA, 19 nt, Homo sapiens
gaauuugggcuuuaaugaa

SEQ ID NO: 862057 - RNA, 19 nt, Homo sapiens
uagauaugcuugaagugua

SEQ ID NO: 862058 - RNA, 19 nt, Homo sapiens
gcagacacugugcaucuua

SEQ ID NO: 862059 - RNA, 19 nt, Homo sapiens
gaaccaguuuccaggauca

SEQ ID NO: 862060 - RNA, 19 nt, Homo sapiens
uauuuaaccuguugccuuu

SEQ ID NO: 862061 - RNA, 19 nt, Homo sapiens
ggcaacagauucaccauag

SEQ ID NO: 862062 - RNA, 19 nt, Homo sapiens
gagcuacuuuguggauuaa

SEQ ID NO: 862063 - RNA, 19 nt, Homo sapiens
gaaguguacauuagucauu

SEQ ID NO: 862064 - RNA, 19 nt, Homo sapiens
gaaccucaacuuacauaga

SEQ ID NO: 862065 - RNA, 19 nt, Homo sapiens
aggcuuagaucucaaauuc

SEQ ID NO: 862066 - RNA, 19 nt, Homo sapiens
agagcuacuuuguggauua

SEQ ID NO: 862067 - RNA, 19 nt, Homo sapiens
caggugaauucauagagua

SEQ ID NO: 862068 - RNA, 19 nt, Homo sapiens
cugcucaggugaauucaua

SEQ ID NO: 862069 - RNA, 19 nt, Homo sapiens
ccaaauagcauuagaaagc

SEQ ID NO: 862070 - RNA, 19 nt, Homo sapiens
gcaaguacuguuagccuuu

SEQ ID NO: 862071 - RNA, 19 nt, Homo sapiens
aaacuugugcucaaacuaa

SEQ ID NO: 862072 - RNA, 19 nt, Homo sapiens
gcaucaaagggaaauauaa

SEQ ID NO: 862073 - RNA, 19 nt, Homo sapiens
gcuuagaucucaaauucau

SEQ ID NO: 862074 - RNA, 19 nt, Homo sapiens
ggaucaugcuguuuggaaa

SEQ ID NO: 862075 - RNA, 19 nt, Homo sapiens
gcagggagcuguuuugcaa

SEQ ID NO: 862076 - RNA, 19 nt, Homo sapiens
caggauaaauuacgagaca

SEQ ID NO: 862077 - RNA, 19 nt, Homo sapiens
uguguaaucuucuucuuga

SEQ ID NO: 862078 - RNA, 19 nt, Homo sapiens
cauauggaaugaagaggaa

SEQ ID NO: 862079 - RNA, 19 nt, Homo sapiens
ccauauauuuaaccuguug

SEQ ID NO: 862080 - RNA, 19 nt, Homo sapiens
gggaagaguggacauggua

SEQ ID NO: 862081 - RNA, 19 nt, Homo sapiens
gauaucagagugcuaaugu

SEQ ID NO: 862082 - RNA, 19 nt, Homo sapiens
gcagcaaggugaacucaac

SEQ ID NO: 862083 - RNA, 19 nt, Homo sapiens
ggucagaugaauauuugua

SEQ ID NO: 862084 - RNA, 19 nt, Homo sapiens
cacaagaacgccaggauaa

SEQ ID NO: 862085 - RNA, 19 nt, Homo sapiens
gaaugaagggaaauguauu

SEQ ID NO: 862086 - RNA, 19 nt, Homo sapiens
ucagagugcuaaugugaga

SEQ ID NO: 862087 - RNA, 19 nt, Homo sapiens
agaaguugcucuugacugu

SEQ ID NO: 862088 - RNA, 19 nt, Homo sapiens
ggaaccagccucauuugau

SEQ ID NO: 862089 - RNA, 19 nt, Homo sapiens
gaagaguggacaugguauu

SEQ ID NO: 862090 - RNA, 19 nt, Homo sapiens
gcugaaggcccaaugaaau

SEQ ID NO: 862091 - RNA, 19 nt, Homo sapiens
caacaugaccacccaagau

SEQ ID NO: 862092 - RNA, 19 nt, Homo sapiens
uaacuccugucauugguau

SEQ ID NO: 862093 - RNA, 19 nt, Homo sapiens
caauguagauaugcuugaa

SEQ ID NO: 862094 - RNA, 19 nt, Homo sapiens
cauggaaacuugugcucaa

SEQ ID NO: 862095 - RNA, 19 nt, Homo sapiens
ggcuauaguuggccugauu

SEQ ID NO: 862096 - RNA, 19 nt, Homo sapiens
guaguaauuuccucagaag

SEQ ID NO: 862097 - RNA, 19 nt, Homo sapiens
gauauucuacacaaacuga

SEQ ID NO: 862098 - RNA, 19 nt, Homo sapiens
ucacaagaacgccaggaua

SEQ ID NO: 862099 - RNA, 19 nt, Homo sapiens
gaugauauccuacagaaaa

SEQ ID NO: 862100 - RNA, 19 nt, Homo sapiens
ggucugauguaguucacuu

SEQ ID NO: 862101 - RNA, 19 nt, Homo sapiens
cuacaaauguuccucaaaa

SEQ ID NO: 862102 - RNA, 19 nt, Homo sapiens
agaacaggauaguuuagaa

SEQ ID NO: 862103 - RNA, 19 nt, Homo sapiens
ugaauggaauuugggcuuu

SEQ ID NO: 862104 - RNA, 19 nt, Homo sapiens
ccagccaguuuguuugaaa

SEQ ID NO: 862105 - RNA, 19 nt, Homo sapiens
ugauguaguucacuuaaca

SEQ ID NO: 862106 - RNA, 19 nt, Homo sapiens
cgucagguaugagcuuuaa

SEQ ID NO: 862107 - RNA, 19 nt, Homo sapiens
cuuaaacucuguggauaaa

SEQ ID NO: 862108 - RNA, 19 nt, Homo sapiens
cagcaaauuucauacuagu

SEQ ID NO: 862109 - RNA, 19 nt, Homo sapiens
ggaaacuugugcucaaacu

SEQ ID NO: 862110 - RNA, 19 nt, Homo sapiens
gaguggacaugguauugug

SEQ ID NO: 862111 - RNA, 19 nt, Homo sapiens
gaaacuugugcucaaacua

SEQ ID NO: 862112 - RNA, 19 nt, Homo sapiens
gacaugggcaucguagaua

SEQ ID NO: 862113 - RNA, 19 nt, Homo sapiens
caagaacgccaggauaaau

SEQ ID NO: 862114 - RNA, 19 nt, Homo sapiens
gagugaaaauccugcuuua

SEQ ID NO: 862115 - RNA, 19 nt, Homo sapiens
gaaacccaguuaaaagaaa

SEQ ID NO: 862116 - RNA, 19 nt, Homo sapiens
aaguugcucuugacuguuu

SEQ ID NO: 862117 - RNA, 19 nt, Homo sapiens
gagcagacacugugcaucu

SEQ ID NO: 862118 - RNA, 19 nt, Homo sapiens
ugaaugaagggaaauguau

SEQ ID NO: 862119 - RNA, 19 nt, Homo sapiens
uaucagagugcuaauguga

SEQ ID NO: 862120 - RNA, 19 nt, Homo sapiens
gaaacaaagaacaggauag

SEQ ID NO: 862121 - RNA, 19 nt, Homo sapiens
gaugaaaccuggaggaauu

SEQ ID NO: 862122 - RNA, 19 nt, Homo sapiens
gaagagauccuuaguauac

SEQ ID NO: 862123 - RNA, 19 nt, Homo sapiens
guaaugcguuugauuguuu

SEQ ID NO: 862124 - RNA, 19 nt, Homo sapiens
ccaccaaacugccauauug

SEQ ID NO: 862125 - RNA, 19 nt, Homo sapiens
gcuagacccucuucuguaa

SEQ ID NO: 862126 - RNA, 19 nt, Homo sapiens
gugaagagauccuuaguau

SEQ ID NO: 862127 - RNA, 19 nt, Homo sapiens
ggacuagucuguaucuugu

SEQ ID NO: 862128 - RNA, 19 nt, Homo sapiens
gguagugaauggucaguuu

SEQ ID NO: 862129 - RNA, 19 nt, Homo sapiens
uaacaacacugauaauagg

SEQ ID NO: 862130 - RNA, 19 nt, Homo sapiens
cuucgaaccuagagaaaua

SEQ ID NO: 862131 - RNA, 19 nt, Homo sapiens
ggagugaggauuacuugua

SEQ ID NO: 862132 - RNA, 19 nt, Homo sapiens
gaaacuaaccacuggcaaa

SEQ ID NO: 862133 - RNA, 19 nt, Homo sapiens
cauccgagcucagagauuu

SEQ ID NO: 862134 - RNA, 19 nt, Homo sapiens
augcagagauuuacacuaa

SEQ ID NO: 862135 - RNA, 19 nt, Homo sapiens
ucucaagucugcuaagauu

SEQ ID NO: 862136 - RNA, 19 nt, Homo sapiens
guagggcuccuuuauaauu

SEQ ID NO: 862137 - RNA, 19 nt, Homo sapiens
ucaguuuccuuguuucuuu

SEQ ID NO: 862138 - RNA, 19 nt, Homo sapiens
gaagucaggcuacagaaug

SEQ ID NO: 862139 - RNA, 19 nt, Homo sapiens
gcaggcagcugacugugau

SEQ ID NO: 862140 - RNA, 19 nt, Homo sapiens
ccaacagucuugccaucua

SEQ ID NO: 862141 - RNA, 19 nt, Homo sapiens
uagggcuccuuuauaauua

SEQ ID NO: 862142 - RNA, 19 nt, Homo sapiens
gagguagggcuccuuuaua

SEQ ID NO: 862143 - RNA, 19 nt, Homo sapiens
ucucagugguugaaucaua

SEQ ID NO: 862144 - RNA, 19 nt, Homo sapiens
agguagggcuccuuuauaa

SEQ ID NO: 862145 - RNA, 19 nt, Homo sapiens
ggcaaaggcuggcugaauc

SEQ ID NO: 862146 - RNA, 19 nt, Homo sapiens
aaauguagcacuugacuuu

SEQ ID NO: 862147 - RNA, 19 nt, Homo sapiens
gcaaaaugcuggaugcuau

SEQ ID NO: 862148 - RNA, 19 nt, Homo sapiens
gugugaggcucuuguguuu

SEQ ID NO: 862149 - RNA, 19 nt, Homo sapiens
caacagucuugccaucuau

SEQ ID NO: 862150 - RNA, 19 nt, Homo sapiens
ggaaaguaguuagcaggaa

SEQ ID NO: 862151 - RNA, 19 nt, Homo sapiens
gacagcaaguccacccuaa

SEQ ID NO: 862152 - RNA, 19 nt, Homo sapiens
ggagagagaguuucaccuu

SEQ ID NO: 862153 - RNA, 19 nt, Homo sapiens
uaccacagguucuggaauu

SEQ ID NO: 862154 - RNA, 19 nt, Homo sapiens
gcagagauuuacacuaacu

SEQ ID NO: 862155 - RNA, 19 nt, Homo sapiens
gcuauaaacagggaauuaa

SEQ ID NO: 862156 - RNA, 19 nt, Homo sapiens
ugacugugauguccacuug

SEQ ID NO: 862157 - RNA, 19 nt, Homo sapiens
cuucagggcuccauggaaa

SEQ ID NO: 862158 - RNA, 19 nt, Homo sapiens
gggagaaucugaaacuaac

SEQ ID NO: 862159 - RNA, 19 nt, Homo sapiens
ggaauccggucagugaguu

SEQ ID NO: 862160 - RNA, 19 nt, Homo sapiens
gcucuggccuucaacaaca

SEQ ID NO: 862161 - RNA, 19 nt, Homo sapiens
gagcugaauccuucuagaa

SEQ ID NO: 862162 - RNA, 19 nt, Homo sapiens
gguaaugcguuugauuguu

SEQ ID NO: 862163 - RNA, 19 nt, Homo sapiens
gcucccugcuguucuauga

SEQ ID NO: 862164 - RNA, 19 nt, Homo sapiens
uguaauggguaaugcguuu

SEQ ID NO: 862165 - RNA, 19 nt, Homo sapiens
cccuugaacugucuguuua

SEQ ID NO: 862166 - RNA, 19 nt, Homo sapiens
caagccagaucaccaagau

SEQ ID NO: 862167 - RNA, 19 nt, Homo sapiens
aaacagggaauuaagcaaa

SEQ ID NO: 862168 - RNA, 19 nt, Homo sapiens
gcuaagauucacauccaua

SEQ ID NO: 862169 - RNA, 19 nt, Homo sapiens
uuacaugguugcucucaga

SEQ ID NO: 862170 - RNA, 19 nt, Homo sapiens
gcucuggaguuaaugacaa

SEQ ID NO: 862171 - RNA, 19 nt, Homo sapiens
guaagaagggaaauuggaa

SEQ ID NO: 862172 - RNA, 19 nt, Homo sapiens
gugaggcucuuguguuuua

SEQ ID NO: 862173 - RNA, 19 nt, Homo sapiens
acacuaacuuccauucuca

SEQ ID NO: 862174 - RNA, 19 nt, Homo sapiens
guagugaauggucaguuua

SEQ ID NO: 862175 - RNA, 19 nt, Homo sapiens
gcugggcucuggaguuaau

SEQ ID NO: 862176 - RNA, 19 nt, Homo sapiens
cuucauguguggaauauuc

SEQ ID NO: 862177 - RNA, 19 nt, Homo sapiens
uaaaggacauccccaaaga

SEQ ID NO: 862178 - RNA, 19 nt, Homo sapiens
gcugaauccuucuagaaca

SEQ ID NO: 862179 - RNA, 19 nt, Homo sapiens
cuccuacucuguuggcuua

SEQ ID NO: 862180 - RNA, 19 nt, Homo sapiens
cucaagaccugaucugguu

SEQ ID NO: 862181 - RNA, 19 nt, Homo sapiens
cauacaacgucaagucugu

SEQ ID NO: 862182 - RNA, 19 nt, Homo sapiens
gaaugugugucuggcuuau

SEQ ID NO: 862183 - RNA, 19 nt, Homo sapiens
acacaaacccugacaacug

SEQ ID NO: 862184 - RNA, 19 nt, Homo sapiens
ugccaggacugcaaaguga

SEQ ID NO: 862185 - RNA, 19 nt, Homo sapiens
gcaaaggcuggcugaauca

SEQ ID NO: 862186 - RNA, 19 nt, Homo sapiens
ggaggugacagaugauguu

SEQ ID NO: 862187 - RNA, 19 nt, Homo sapiens
ugaacugucuguuuagucu

SEQ ID NO: 862188 - RNA, 19 nt, Homo sapiens
gaaugaaaccagcuacucu

SEQ ID NO: 862189 - RNA, 19 nt, Homo sapiens
aaggcuggcugaaucauga

SEQ ID NO: 862190 - RNA, 19 nt, Homo sapiens
caucaucacugugggaaca

SEQ ID NO: 862191 - RNA, 19 nt, Homo sapiens
acacaaggacuggaucuuu

SEQ ID NO: 862192 - RNA, 19 nt, Homo sapiens
caacaacaagaacaaggaa

SEQ ID NO: 862193 - RNA, 19 nt, Homo sapiens
gcacauaccacagguucug

SEQ ID NO: 862194 - RNA, 19 nt, Homo sapiens
gaaauuaccacugggaaaa

SEQ ID NO: 862195 - RNA, 19 nt, Homo sapiens
gggacuagucuguaucuug

SEQ ID NO: 862196 - RNA, 19 nt, Homo sapiens
uuuaggcacuuaauaggaa

SEQ ID NO: 862197 - RNA, 19 nt, Homo sapiens
augcugggcucuggaguua

SEQ ID NO: 862198 - RNA, 19 nt, Homo sapiens
ggugacagaugauguuuug

SEQ ID NO: 862199 - RNA, 19 nt, Homo sapiens
gacccuuaauaaaguguuu

SEQ ID NO: 862200 - RNA, 19 nt, Homo sapiens
guucuggaauucucaucuu

SEQ ID NO: 862201 - RNA, 19 nt, Homo sapiens
ugaagagauccuuaguaua

SEQ ID NO: 862202 - RNA, 19 nt, Homo sapiens
gaaaauacacuaucuaagc

SEQ ID NO: 862203 - RNA, 19 nt, Homo sapiens
gcagggcugugguauccau

SEQ ID NO: 862204 - RNA, 19 nt, Homo sapiens
caccuugggacccuuaaua

SEQ ID NO: 862205 - RNA, 19 nt, Homo sapiens
ggaagucaggcuacagaau

SEQ ID NO: 862206 - RNA, 19 nt, Homo sapiens
ccucuucuguaauggguaa

SEQ ID NO: 862207 - RNA, 19 nt, Homo sapiens
uagacccucuucuguaaug

SEQ ID NO: 862208 - RNA, 19 nt, Homo sapiens
caugguugcucucagacuu

SEQ ID NO: 862209 - RNA, 19 nt, Homo sapiens
uuucagacauugacuucuu

SEQ ID NO: 862210 - RNA, 19 nt, Homo sapiens
caacacgcuauuugucgua

SEQ ID NO: 862211 - RNA, 19 nt, Homo sapiens
gcuggaugcuauagaucuu

SEQ ID NO: 862212 - RNA, 19 nt, Homo sapiens
uaagaagggaaauuggaaa

SEQ ID NO: 862213 - RNA, 19 nt, Homo sapiens
gguguaagaagggaaauug

SEQ ID NO: 862214 - RNA, 19 nt, Homo sapiens
cuaacaacacugauaauag

SEQ ID NO: 862215 - RNA, 19 nt, Homo sapiens
gcucaaguccuuccucucu

SEQ ID NO: 862216 - RNA, 19 nt, Homo sapiens
cuuccucucucuuuccuuu

SEQ ID NO: 862217 - RNA, 19 nt, Homo sapiens
ccaguggguuuugcuauua

SEQ ID NO: 862218 - RNA, 19 nt, Homo sapiens
acacugauaauaggaagua

SEQ ID NO: 862219 - RNA, 19 nt, Homo sapiens
acuagucuguaucuuguuu

SEQ ID NO: 862220 - RNA, 19 nt, Homo sapiens
uuaccuggagugaggauua

SEQ ID NO: 862221 - RNA, 19 nt, Homo sapiens
gaagacagccgaagucaaa

SEQ ID NO: 862222 - RNA, 19 nt, Homo sapiens
gaagaaggcaccucugguu

SEQ ID NO: 862223 - RNA, 19 nt, Homo sapiens
ggaauaaguacgaauguga

SEQ ID NO: 862224 - RNA, 19 nt, Homo sapiens
gcuccgagauggaugauga

SEQ ID NO: 862225 - RNA, 19 nt, Homo sapiens
gugagaagcugcugcucua

SEQ ID NO: 862226 - RNA, 19 nt, Homo sapiens
ggacuggacagccaucaaa

SEQ ID NO: 862227 - RNA, 19 nt, Homo sapiens
guacaugcuucaagagauc

SEQ ID NO: 862228 - RNA, 19 nt, Homo sapiens
agaagcugcugcucuauga

SEQ ID NO: 862229 - RNA, 19 nt, Homo sapiens
gcaaagacacagaagagau

SEQ ID NO: 862230 - RNA, 19 nt, Homo sapiens
ugagucagaacguugauua

SEQ ID NO: 862231 - RNA, 19 nt, Homo sapiens
gaaggcaccucugguuucu

SEQ ID NO: 862232 - RNA, 19 nt, Homo sapiens
gaucaggaauaaguacgaa

SEQ ID NO: 862233 - RNA, 19 nt, Homo sapiens
cagcggagccucaagauuc

SEQ ID NO: 862234 - RNA, 19 nt, Homo sapiens
caaagacacagaagagaug

SEQ ID NO: 862235 - RNA, 19 nt, Homo sapiens
gaugugaucaggaauaagu

SEQ ID NO: 862236 - RNA, 19 nt, Homo sapiens
ggagccaaguuuccacugu

SEQ ID NO: 862237 - RNA, 19 nt, Homo sapiens
gucagaacguugauuaucu

SEQ ID NO: 862238 - RNA, 19 nt, Homo sapiens
gggcagcucucagggaauc

SEQ ID NO: 862239 - RNA, 19 nt, Homo sapiens
gauggaugaugaggacuau

SEQ ID NO: 862240 - RNA, 19 nt, Homo sapiens
gugagaugcuggaccuaga

SEQ ID NO: 862241 - RNA, 19 nt, Homo sapiens
ggacuggaauuaaaaccuu

SEQ ID NO: 862242 - RNA, 19 nt, Homo sapiens
gagaagcugcugcucuaug

SEQ ID NO: 862243 - RNA, 19 nt, Homo sapiens
uggaugugaucaggaauaa

SEQ ID NO: 862244 - RNA, 19 nt, Homo sapiens
aacagcaccuggagaguga

SEQ ID NO: 862245 - RNA, 19 nt, Homo sapiens
gcagcgagugugucaguga

SEQ ID NO: 862246 - RNA, 19 nt, Homo sapiens
ggaagcagagggugauucu

SEQ ID NO: 862247 - RNA, 19 nt, Homo sapiens
gggaggaggaagagaguga

SEQ ID NO: 862248 - RNA, 19 nt, Homo sapiens
ucaaagccacauccucuug

SEQ ID NO: 862249 - RNA, 19 nt, Homo sapiens
agaggcagcuccaggucuu

SEQ ID NO: 862250 - RNA, 19 nt, Homo sapiens
gagaagacagccgaaguca

SEQ ID NO: 862251 - RNA, 19 nt, Homo sapiens
gcagcggagccucaagauu

SEQ ID NO: 862252 - RNA, 19 nt, Homo sapiens
aagcaguucucggagcuaa

SEQ ID NO: 862253 - RNA, 19 nt, Homo sapiens
caagcaaagacacagaaga

SEQ ID NO: 862254 - RNA, 19 nt, Homo sapiens
gaucuacaagggcuucugu

SEQ ID NO: 862255 - RNA, 19 nt, Homo sapiens
uguccagccuccaagcaaa

SEQ ID NO: 862256 - RNA, 19 nt, Homo sapiens
gcacugcacccaggauucu

SEQ ID NO: 862257 - RNA, 19 nt, Homo sapiens
uaaaggagaaguuguucag

SEQ ID NO: 862258 - RNA, 19 nt, Homo sapiens
uggaugaugaggacuauga

SEQ ID NO: 862259 - RNA, 19 nt, Homo sapiens
gcaaggcugcugucuccau

SEQ ID NO: 862260 - RNA, 19 nt, Homo sapiens
aagaaggcaccucugguuu

SEQ ID NO: 862261 - RNA, 19 nt, Homo sapiens
ugaauggugggacgacaaa

SEQ ID NO: 862262 - RNA, 19 nt, Homo sapiens
ucaggaauaaguacgaaug

SEQ ID NO: 862263 - RNA, 19 nt, Homo sapiens
ggagcuaaaggagaaguug

SEQ ID NO: 862264 - RNA, 19 nt, Homo sapiens
ugauucugcugcugagaug

SEQ ID NO: 862265 - RNA, 19 nt, Homo sapiens
gggccagggagccaaguuu

SEQ ID NO: 862266 - RNA, 19 nt, Homo sapiens
gcagccagacagagucaga

SEQ ID NO: 862267 - RNA, 19 nt, Homo sapiens
ucguguacaugcuucaaga

SEQ ID NO: 862268 - RNA, 19 nt, Homo sapiens
gagcuaaaggagaaguugu

SEQ ID NO: 862269 - RNA, 19 nt, Homo sapiens
ggaccuugacccugcuguu

SEQ ID NO: 862270 - RNA, 19 nt, Homo sapiens
gggcuucugucuggaugug

SEQ ID NO: 862271 - RNA, 19 nt, Homo sapiens
gguugcggcuggaggaagu

SEQ ID NO: 862272 - RNA, 19 nt, Homo sapiens
gcaguucucggagcuaaag

SEQ ID NO: 862273 - RNA, 19 nt, Homo sapiens
ggaccuagagaagcaguuc

SEQ ID NO: 862274 - RNA, 19 nt, Homo sapiens
gcgagugugucagugagau

SEQ ID NO: 862275 - RNA, 19 nt, Homo sapiens
uguacaugcuucaagagau

SEQ ID NO: 862276 - RNA, 19 nt, Homo sapiens
agaaggcaccucugguuuc

SEQ ID NO: 862277 - RNA, 19 nt, Homo sapiens
gucuggaugugaucaggaa

SEQ ID NO: 862278 - RNA, 19 nt, Homo sapiens
ccagacagagucagaagag

SEQ ID NO: 862279 - RNA, 19 nt, Homo sapiens
aaaaucggauggaccuuga

SEQ ID NO: 862280 - RNA, 19 nt, Homo sapiens
aagcaaagacacagaagag

SEQ ID NO: 862281 - RNA, 19 nt, Homo sapiens
cagagaagacagccgaagu

SEQ ID NO: 862282 - RNA, 19 nt, Homo sapiens
gaccuugacccugcuguuc

SEQ ID NO: 862283 - RNA, 19 nt, Homo sapiens
ugagagagccccugaauac

SEQ ID NO: 862284 - RNA, 19 nt, Homo sapiens
gagucagaacguugauuau

SEQ ID NO: 862285 - RNA, 19 nt, Homo sapiens
agacacagaagagauggaa

SEQ ID NO: 862286 - RNA, 19 nt, Homo sapiens
gcuaaaggagaaguuguuc

SEQ ID NO: 862287 - RNA, 19 nt, Homo sapiens
gagaugcuggaccuagaga

SEQ ID NO: 862288 - RNA, 19 nt, Homo sapiens
gauggaagcagagggugau

SEQ ID NO: 862289 - RNA, 19 nt, Homo sapiens
gaagcaguucucggagcua

SEQ ID NO: 862290 - RNA, 19 nt, Homo sapiens
gaugcuggaccuagagaag

SEQ ID NO: 862291 - RNA, 19 nt, Homo sapiens
gcaaagaucuguuucauuc

SEQ ID NO: 862292 - RNA, 19 nt, Homo sapiens
gcaaagauguucccuugua

SEQ ID NO: 862293 - RNA, 19 nt, Homo sapiens
gcagggacuuugacucuua

SEQ ID NO: 862294 - RNA, 19 nt, Homo sapiens
guaagugcccuucuaauaa

SEQ ID NO: 862295 - RNA, 19 nt, Homo sapiens
gaagugagcuauagcacau

SEQ ID NO: 862296 - RNA, 19 nt, Homo sapiens
uaagugcccuucuaauaaa

SEQ ID NO: 862297 - RNA, 19 nt, Homo sapiens
ggacauggauccaaaauga

SEQ ID NO: 862298 - RNA, 19 nt, Homo sapiens
gcacauacguagguagcua

SEQ ID NO: 862299 - RNA, 19 nt, Homo sapiens
gacaguggcuggaagaguu

SEQ ID NO: 862300 - RNA, 19 nt, Homo sapiens
cauaucaugugcuuaguuu

SEQ ID NO: 862301 - RNA, 19 nt, Homo sapiens
cauguaaacuggauugaga

SEQ ID NO: 862302 - RNA, 19 nt, Homo sapiens
gaaacuugccucauguaaa

SEQ ID NO: 862303 - RNA, 19 nt, Homo sapiens
gcgaagcuguacugucuuu

SEQ ID NO: 862304 - RNA, 19 nt, Homo sapiens
gagcaccuguuuaagcauu

SEQ ID NO: 862305 - RNA, 19 nt, Homo sapiens
ggagccaucuauccaagaa

SEQ ID NO: 862306 - RNA, 19 nt, Homo sapiens
aagcagagcaccuguuuaa

SEQ ID NO: 862307 - RNA, 19 nt, Homo sapiens
ggugaaagcauuacagaga

SEQ ID NO: 862308 - RNA, 19 nt, Homo sapiens
gggcuaaacaggcaacuuu

SEQ ID NO: 862309 - RNA, 19 nt, Homo sapiens
uguaagugcccuucuaaua

SEQ ID NO: 862310 - RNA, 19 nt, Homo sapiens
aaacuugccucauguaaac

SEQ ID NO: 862311 - RNA, 19 nt, Homo sapiens
guaaccgucuucacaaugu

SEQ ID NO: 862312 - RNA, 19 nt, Homo sapiens
gcacguauguaaguaaucu

SEQ ID NO: 862313 - RNA, 19 nt, Homo sapiens
uugauuaccuucacuauuc

SEQ ID NO: 862314 - RNA, 19 nt, Homo sapiens
aaagaaacuugccucaugu

SEQ ID NO: 862315 - RNA, 19 nt, Homo sapiens
ggacuuugacucuuaggaa

SEQ ID NO: 862316 - RNA, 19 nt, Homo sapiens
caaagauguucccuuguag

SEQ ID NO: 862317 - RNA, 19 nt, Homo sapiens
caagagagugcacccguuu

SEQ ID NO: 862318 - RNA, 19 nt, Homo sapiens
ggagauguagggagaagaa

SEQ ID NO: 862319 - RNA, 19 nt, Homo sapiens
acagaaagguuugaaguag

SEQ ID NO: 862320 - RNA, 19 nt, Homo sapiens
ccacaaggguccucugaac

SEQ ID NO: 862321 - RNA, 19 nt, Homo sapiens
ggacauauuccaggcuaaa

SEQ ID NO: 862322 - RNA, 19 nt, Homo sapiens
cagagcaccuguuuaagca

SEQ ID NO: 862323 - RNA, 19 nt, Homo sapiens
aauagaacauugacugugu

SEQ ID NO: 862324 - RNA, 19 nt, Homo sapiens
gcacagccaguucugaaug

SEQ ID NO: 862325 - RNA, 19 nt, Homo sapiens
ggaagaagcaaagaucugu

SEQ ID NO: 862326 - RNA, 19 nt, Homo sapiens
gcaugcacguauguaagua

SEQ ID NO: 862327 - RNA, 19 nt, Homo sapiens
aaaagaaacuugccucaug

SEQ ID NO: 862328 - RNA, 19 nt, Homo sapiens
agaaagguuugaaguagug

SEQ ID NO: 862329 - RNA, 19 nt, Homo sapiens
agacagcucugagucaaau

SEQ ID NO: 862330 - RNA, 19 nt, Homo sapiens
aagaggacauggauccaaa

SEQ ID NO: 862331 - RNA, 19 nt, Homo sapiens
gaagcaaagaucuguuuca

SEQ ID NO: 862332 - RNA, 19 nt, Homo sapiens
aaaccaucguuaauacuga

SEQ ID NO: 862333 - RNA, 19 nt, Homo sapiens
ccucgcuucuucccaauuu

SEQ ID NO: 862334 - RNA, 19 nt, Homo sapiens
ggaauagaacauugacugu

SEQ ID NO: 862335 - RNA, 19 nt, Homo sapiens
ugaaagcauuacagagaga

SEQ ID NO: 862336 - RNA, 19 nt, Homo sapiens
gcuggaacaucaucucagu

SEQ ID NO: 862337 - RNA, 19 nt, Homo sapiens
aaagauuuguguccucuca

SEQ ID NO: 862338 - RNA, 19 nt, Homo sapiens
gagcagggacuuugacucu

SEQ ID NO: 862339 - RNA, 19 nt, Homo sapiens
ggccugugcuggaacauca

SEQ ID NO: 862340 - RNA, 19 nt, Homo sapiens
gcagagcaccuguuuaagc

SEQ ID NO: 862341 - RNA, 19 nt, Homo sapiens
aaacuggauugagaaauuc

SEQ ID NO: 862342 - RNA, 19 nt, Homo sapiens
gagcaucagccgcuucuca

SEQ ID NO: 862343 - RNA, 19 nt, Homo sapiens
cagaaagguuugaaguagu

SEQ ID NO: 862344 - RNA, 19 nt, Homo sapiens
uaaccgucuucacaaugua

SEQ ID NO: 862345 - RNA, 19 nt, Homo sapiens
ggaaaccagggcaguucua

SEQ ID NO: 862346 - RNA, 19 nt, Homo sapiens
guccuuauguugucugugu

SEQ ID NO: 862347 - RNA, 19 nt, Homo sapiens
uggcagacgucuccauugu

SEQ ID NO: 862348 - RNA, 19 nt, Homo sapiens
gaagcuguacugucuuugu

SEQ ID NO: 862349 - RNA, 19 nt, Homo sapiens
ggccggagcucagguuaca

SEQ ID NO: 862350 - RNA, 19 nt, Homo sapiens
uguugucuguguuguauuu

SEQ ID NO: 862351 - RNA, 19 nt, Homo sapiens
gggcacagccaguucugaa

SEQ ID NO: 862352 - RNA, 19 nt, Homo sapiens
gaaauucucagugauucug

SEQ ID NO: 862353 - RNA, 19 nt, Homo sapiens
gauccaaaaugaugaugaa

SEQ ID NO: 862354 - RNA, 19 nt, Homo sapiens
gaagaagcaaagaucuguu

SEQ ID NO: 862355 - RNA, 19 nt, Homo sapiens
ccuagaguuuggacauauu

SEQ ID NO: 862356 - RNA, 19 nt, Homo sapiens
uauguugucuguguuguau

SEQ ID NO: 862357 - RNA, 19 nt, Homo sapiens
cggcuguucuggacucuga

SEQ ID NO: 862358 - RNA, 19 nt, Homo sapiens
ucucagugauucugcaaug

SEQ ID NO: 862359 - RNA, 19 nt, Homo sapiens
uaaguaaucuggggaagaa

SEQ ID NO: 862360 - RNA, 19 nt, Homo sapiens
gagugcuggugacuggaua

SEQ ID NO: 862361 - RNA, 19 nt, Homo sapiens
uacagaaagguuugaagua

SEQ ID NO: 862362 - RNA, 19 nt, Homo sapiens
caagacuacagaaagguuu

SEQ ID NO: 862363 - RNA, 19 nt, Homo sapiens
agauuuguguccucucauu

SEQ ID NO: 862364 - RNA, 19 nt, Homo sapiens
caccuucacugcugcuguu

SEQ ID NO: 862365 - RNA, 19 nt, Homo sapiens
aagcaaagaucuguuucau

SEQ ID NO: 862366 - RNA, 19 nt, Homo sapiens
auacugaagugagcuauag

SEQ ID NO: 862367 - RNA, 19 nt, Homo sapiens
ugacuguguugauuaccuu

SEQ ID NO: 862368 - RNA, 19 nt, Homo sapiens
guucuggacucugaugugu

SEQ ID NO: 862369 - RNA, 19 nt, Homo sapiens
ggacccuguuucuuacugu

SEQ ID NO: 862370 - RNA, 19 nt, Homo sapiens
caucucaguuggccaccuu

SEQ ID NO: 862371 - RNA, 19 nt, Homo sapiens
caggcuggcuaaacaagug

SEQ ID NO: 862372 - RNA, 19 nt, Homo sapiens
aaaccauucagacagauaa

SEQ ID NO: 862373 - RNA, 19 nt, Homo sapiens
ucagguaaccgucuucaca

SEQ ID NO: 862374 - RNA, 19 nt, Homo sapiens
aagaagcaaagaucuguuu

SEQ ID NO: 862375 - RNA, 19 nt, Homo sapiens
ccauucagacagauaacua

SEQ ID NO: 862376 - RNA, 19 nt, Homo sapiens
gaggaaaccagggcaguuc

SEQ ID NO: 862377 - RNA, 19 nt, Homo sapiens
caccacuccuucguccuua

SEQ ID NO: 862378 - RNA, 19 nt, Homo sapiens
ucaugugcuuaguuuguuu

SEQ ID NO: 862379 - RNA, 19 nt, Homo sapiens
acacagauccuugucuuca

SEQ ID NO: 862380 - RNA, 19 nt, Homo sapiens
uuaagaaaguuggaaaggu

SEQ ID NO: 862381 - RNA, 19 nt, Homo sapiens
ggagaugaugggcuaaaca

SEQ ID NO: 862382 - RNA, 19 nt, Homo sapiens
cccuggacccuguuucuua

SEQ ID NO: 862383 - RNA, 19 nt, Homo sapiens
uaucaugugcuuaguuugu

SEQ ID NO: 862384 - RNA, 19 nt, Homo sapiens
uaaaccaucguuaauacug

SEQ ID NO: 862385 - RNA, 19 nt, Homo sapiens
uuaggaagagcacacauga

SEQ ID NO: 862386 - RNA, 19 nt, Homo sapiens
acauugacuguguugauua

SEQ ID NO: 862387 - RNA, 19 nt, Homo sapiens
caaggguccucugaaccaa

SEQ ID NO: 862388 - RNA, 19 nt, Homo sapiens
gugauucugcaauggauuu

SEQ ID NO: 862389 - RNA, 19 nt, Homo sapiens
ccaaggagccaacuuuuau

SEQ ID NO: 862390 - RNA, 19 nt, Homo sapiens
gguaaccgucuucacaaug

SEQ ID NO: 862391 - RNA, 19 nt, Homo sapiens
cagcaaaucucagguauua

SEQ ID NO: 862392 - RNA, 19 nt, Homo sapiens
gaacaacacagaugagaua

SEQ ID NO: 862393 - RNA, 19 nt, Homo sapiens
gaagugaugucccauuauu

SEQ ID NO: 862394 - RNA, 19 nt, Homo sapiens
cuaagaagcucaugguaua

SEQ ID NO: 862395 - RNA, 19 nt, Homo sapiens
caaagaaagucacucauga

SEQ ID NO: 862396 - RNA, 19 nt, Homo sapiens
caacaauacucuaaacuga

SEQ ID NO: 862397 - RNA, 19 nt, Homo sapiens
gcaagucauuucauuugua

SEQ ID NO: 862398 - RNA, 19 nt, Homo sapiens
gaauuaagaugaucccaau

SEQ ID NO: 862399 - RNA, 19 nt, Homo sapiens
ggaaucacuuugccucuaa

SEQ ID NO: 862400 - RNA, 19 nt, Homo sapiens
caacacagaugagauauuc

SEQ ID NO: 862401 - RNA, 19 nt, Homo sapiens
ugaaagggcugcacuggaa

SEQ ID NO: 862402 - RNA, 19 nt, Homo sapiens
ucaagcugcucaucuguua

SEQ ID NO: 862403 - RNA, 19 nt, Homo sapiens
gaagccagguuguuagaau

SEQ ID NO: 862404 - RNA, 19 nt, Homo sapiens
gcaaaucucagguauuaga

SEQ ID NO: 862405 - RNA, 19 nt, Homo sapiens
cuucucaucuccuuaauaa

SEQ ID NO: 862406 - RNA, 19 nt, Homo sapiens
gccaaugccucauagugua

SEQ ID NO: 862407 - RNA, 19 nt, Homo sapiens
guucagacccauccuguua

SEQ ID NO: 862408 - RNA, 19 nt, Homo sapiens
gaugcaaugucagcuauuu

SEQ ID NO: 862409 - RNA, 19 nt, Homo sapiens
ucacuuagcuccucauaac

SEQ ID NO: 862410 - RNA, 19 nt, Homo sapiens
uaaggaagccagguuguua

SEQ ID NO: 862411 - RNA, 19 nt, Homo sapiens
gaugagauauucuacacau

SEQ ID NO: 862412 - RNA, 19 nt, Homo sapiens
ccagaaauuucccauagga

SEQ ID NO: 862413 - RNA, 19 nt, Homo sapiens
ggacuuguauuagcagguu

SEQ ID NO: 862414 - RNA, 19 nt, Homo sapiens
aaacaagcccuuuauugaa

SEQ ID NO: 862415 - RNA, 19 nt, Homo sapiens
ugucagaacucaauuacga

SEQ ID NO: 862416 - RNA, 19 nt, Homo sapiens
gaauggaaacuucuaagga

SEQ ID NO: 862417 - RNA, 19 nt, Homo sapiens
caggugacauggauaaaga

SEQ ID NO: 862418 - RNA, 19 nt, Homo sapiens
gaagaugcaaugucagcua

SEQ ID NO: 862419 - RNA, 19 nt, Homo sapiens
aggaagugaugucccauua

SEQ ID NO: 862420 - RNA, 19 nt, Homo sapiens
gaaaacaagcccuuuauug

SEQ ID NO: 862421 - RNA, 19 nt, Homo sapiens
gcucauauuuccuucaucu

SEQ ID NO: 862422 - RNA, 19 nt, Homo sapiens
aauggaaacuucuaaggaa

SEQ ID NO: 862423 - RNA, 19 nt, Homo sapiens
caucaggcccuaucuaaga

SEQ ID NO: 862424 - RNA, 19 nt, Homo sapiens
cuacuuaucuggaaucacu

SEQ ID NO: 862425 - RNA, 19 nt, Homo sapiens
gugcaguccuugcucauau

SEQ ID NO: 862426 - RNA, 19 nt, Homo sapiens
uacauucucugugucaaua

SEQ ID NO: 862427 - RNA, 19 nt, Homo sapiens
caacacagacucccugcuu

SEQ ID NO: 862428 - RNA, 19 nt, Homo sapiens
gcuauaaucuaugaaacug

SEQ ID NO: 862429 - RNA, 19 nt, Homo sapiens
gcugggcuauaaucuauga

SEQ ID NO: 862430 - RNA, 19 nt, Homo sapiens
ccaaagaaagucacucaug

SEQ ID NO: 862431 - RNA, 19 nt, Homo sapiens
gcaaacaagaauuaagaug

SEQ ID NO: 862432 - RNA, 19 nt, Homo sapiens
gcucaucuguuaguaagug

SEQ ID NO: 862433 - RNA, 19 nt, Homo sapiens
guccagaaauuucccauag

SEQ ID NO: 862434 - RNA, 19 nt, Homo sapiens
gggcugcacuggaacaaca

SEQ ID NO: 862435 - RNA, 19 nt, Homo sapiens
gaaucacuuugccucuaaa

SEQ ID NO: 862436 - RNA, 19 nt, Homo sapiens
aacaagcccuuuauugaau

SEQ ID NO: 862437 - RNA, 19 nt, Homo sapiens
acucagagauaacauagau

SEQ ID NO: 862438 - RNA, 19 nt, Homo sapiens
gguauuagagcaacuaugg

SEQ ID NO: 862439 - RNA, 19 nt, Homo sapiens
ucaucacgaucaauuaaug

SEQ ID NO: 862440 - RNA, 19 nt, Homo sapiens
caauucaucaggacuugua

SEQ ID NO: 862441 - RNA, 19 nt, Homo sapiens
caagcccuuuauugaauuu

SEQ ID NO: 862442 - RNA, 19 nt, Homo sapiens
acacagaugagauauucua

SEQ ID NO: 862443 - RNA, 19 nt, Homo sapiens
guuaguaugucaaaucaac

SEQ ID NO: 862444 - RNA, 19 nt, Homo sapiens
caucaggacuuguauuagc

SEQ ID NO: 862445 - RNA, 19 nt, Homo sapiens
ccuuggagcugucacauag

SEQ ID NO: 862446 - RNA, 19 nt, Homo sapiens
ucauucaaguggaagcuuu

SEQ ID NO: 862447 - RNA, 19 nt, Homo sapiens
ccaagaccgucaccagcaa

SEQ ID NO: 862448 - RNA, 19 nt, Homo sapiens
cauucucugugucaauaua

SEQ ID NO: 862449 - RNA, 19 nt, Homo sapiens
ccagaacacauucaugaug

SEQ ID NO: 862450 - RNA, 19 nt, Homo sapiens
ccgcaaacaagaauuaaga

SEQ ID NO: 862451 - RNA, 19 nt, Homo sapiens
gcaucauucucaauucauc

SEQ ID NO: 862452 - RNA, 19 nt, Homo sapiens
augauaaccugaaacaugu

SEQ ID NO: 862453 - RNA, 19 nt, Homo sapiens
acgcugggcuauaaucuau

SEQ ID NO: 862454 - RNA, 19 nt, Homo sapiens
uaaagagccccauuauuuu

SEQ ID NO: 862455 - RNA, 19 nt, Homo sapiens
cacaucaggcccuaucuaa

SEQ ID NO: 862456 - RNA, 19 nt, Homo sapiens
ggaagugaugucccauuau

SEQ ID NO: 862457 - RNA, 19 nt, Homo sapiens
agagccagccaaucacuua

SEQ ID NO: 862458 - RNA, 19 nt, Homo sapiens
gagccaaugccucauagug

SEQ ID NO: 862459 - RNA, 19 nt, Homo sapiens
ucaauuacgacuacauaug

SEQ ID NO: 862460 - RNA, 19 nt, Homo sapiens
gcaguccuugcucauauuu

SEQ ID NO: 862461 - RNA, 19 nt, Homo sapiens
acccugagccaccauaaua

SEQ ID NO: 862462 - RNA, 19 nt, Homo sapiens
acagacaaagccaacaaua

SEQ ID NO: 862463 - RNA, 19 nt, Homo sapiens
acaagcccuuuauugaauu

SEQ ID NO: 862464 - RNA, 19 nt, Homo sapiens
uccauaagcuaauuugucu

SEQ ID NO: 862465 - RNA, 19 nt, Homo sapiens
gggccaagaaugauugcua

SEQ ID NO: 862466 - RNA, 19 nt, Homo sapiens
cuaguaccauuaucuucuu

SEQ ID NO: 862467 - RNA, 19 nt, Homo sapiens
agacaaagccaacaauacu

SEQ ID NO: 862468 - RNA, 19 nt, Homo sapiens
aaaacaagcccuuuauuga

SEQ ID NO: 862469 - RNA, 19 nt, Homo sapiens
gacuacauaugcauuaagg

SEQ ID NO: 862470 - RNA, 19 nt, Homo sapiens
gaacucaauuacgacuaca

SEQ ID NO: 862471 - RNA, 19 nt, Homo sapiens
cagaugagauauucuacac

SEQ ID NO: 862472 - RNA, 19 nt, Homo sapiens
aagaugcaaugucagcuau

SEQ ID NO: 862473 - RNA, 19 nt, Homo sapiens
ucaggcaucauucucaauu

SEQ ID NO: 862474 - RNA, 19 nt, Homo sapiens
ugaaacaaaggaagugaug

SEQ ID NO: 862475 - RNA, 19 nt, Homo sapiens
ccaacaauacucuaaacug

SEQ ID NO: 862476 - RNA, 19 nt, Homo sapiens
uggaaucacuuugccucua

SEQ ID NO: 862477 - RNA, 19 nt, Homo sapiens
ccaaugccucauaguguaa

SEQ ID NO: 862478 - RNA, 19 nt, Homo sapiens
gcaggguauuaacuccauu

SEQ ID NO: 862479 - RNA, 19 nt, Homo sapiens
ugaaaagugucucaaaauc

SEQ ID NO: 862480 - RNA, 19 nt, Homo sapiens
accaagcacugucagcaaa

SEQ ID NO: 862481 - RNA, 19 nt, Homo sapiens
gaucacaucaggcccuauc

SEQ ID NO: 862482 - RNA, 19 nt, Homo sapiens
ugucaucacgaucaauuaa

SEQ ID NO: 862483 - RNA, 19 nt, Homo sapiens
aagccagguuguuagaauu

SEQ ID NO: 862484 - RNA, 19 nt, Homo sapiens
ggaacaacacagaugagau

SEQ ID NO: 862485 - RNA, 19 nt, Homo sapiens
uaagacuggcaggguauua

SEQ ID NO: 862486 - RNA, 19 nt, Homo sapiens
ggccuugccauuuacguaa

SEQ ID NO: 862487 - RNA, 19 nt, Homo sapiens
aaugauugcuagguccaua

SEQ ID NO: 862488 - RNA, 19 nt, Homo sapiens
gccugcaagucauuucauu

SEQ ID NO: 862489 - RNA, 19 nt, Homo sapiens
cagguuguuagaauuguua

SEQ ID NO: 862490 - RNA, 19 nt, Homo sapiens
caaugucagcuauuuagga

SEQ ID NO: 862491 - RNA, 19 nt, Homo sapiens
gaaaggaccucuaguuuau

SEQ ID NO: 862492 - RNA, 19 nt, Homo sapiens
ggaauaauauggaagaaga

SEQ ID NO: 862493 - RNA, 19 nt, Homo sapiens
gaggaaaccuaaccaauga

SEQ ID NO: 862494 - RNA, 19 nt, Homo sapiens
ucaaggagauauuguauga

SEQ ID NO: 862495 - RNA, 19 nt, Homo sapiens
gcaaugagcuaugauuuca

SEQ ID NO: 862496 - RNA, 19 nt, Homo sapiens
gaaagcaguuaaugaucua

SEQ ID NO: 862497 - RNA, 19 nt, Homo sapiens
ggaauucccugaacgcuau

SEQ ID NO: 862498 - RNA, 19 nt, Homo sapiens
caaugacuguggaauaaua

SEQ ID NO: 862499 - RNA, 19 nt, Homo sapiens
gcucacaccuguaauccua

SEQ ID NO: 862500 - RNA, 19 nt, Homo sapiens
gauccugacucaaauaaau

SEQ ID NO: 862501 - RNA, 19 nt, Homo sapiens
ugaaaggaccucuaguuua

SEQ ID NO: 862502 - RNA, 19 nt, Homo sapiens
ccaguuuccuucuugguua

SEQ ID NO: 862503 - RNA, 19 nt, Homo sapiens
guuagaggauauuguagua

SEQ ID NO: 862504 - RNA, 19 nt, Homo sapiens
ggcaacaccugcuacauga

SEQ ID NO: 862505 - RNA, 19 nt, Homo sapiens
gacaugcucuccucucuug

SEQ ID NO: 862506 - RNA, 19 nt, Homo sapiens
ccaaacaggucuuaaaggu

SEQ ID NO: 862507 - RNA, 19 nt, Homo sapiens
gagcuguccuugagaaaug

SEQ ID NO: 862508 - RNA, 19 nt, Homo sapiens
uauaagacauggauagaug

SEQ ID NO: 862509 - RNA, 19 nt, Homo sapiens
gaacugacauguaaaagug

SEQ ID NO: 862510 - RNA, 19 nt, Homo sapiens
aaaaggaacugacauguaa

SEQ ID NO: 862511 - RNA, 19 nt, Homo sapiens
agaggaagcucaccaaaca

SEQ ID NO: 862512 - RNA, 19 nt, Homo sapiens
gaagagcaguugccuacca

SEQ ID NO: 862513 - RNA, 19 nt, Homo sapiens
gcucuccucucuugacaaa

SEQ ID NO: 862514 - RNA, 19 nt, Homo sapiens
ccacggagcuguccuugag

SEQ ID NO: 862515 - RNA, 19 nt, Homo sapiens
uaauaaagccgagaacauu

SEQ ID NO: 862516 - RNA, 19 nt, Homo sapiens
ggucaugcaucacgggaaa

SEQ ID NO: 862517 - RNA, 19 nt, Homo sapiens
gcaguugccuaccacauag

SEQ ID NO: 862518 - RNA, 19 nt, Homo sapiens
ggauagaugcaaacaugua

SEQ ID NO: 862519 - RNA, 19 nt, Homo sapiens
agacauggauagaugcaaa

SEQ ID NO: 862520 - RNA, 19 nt, Homo sapiens
uauuaaccauggaaccuua

SEQ ID NO: 862521 - RNA, 19 nt, Homo sapiens
ucagucaggucacauguau

SEQ ID NO: 862522 - RNA, 19 nt, Homo sapiens
gaagcuagaaagcaguuaa

SEQ ID NO: 862523 - RNA, 19 nt, Homo sapiens
gcuagaaagcaguuaauga

SEQ ID NO: 862524 - RNA, 19 nt, Homo sapiens
ugaacgcuaucacugcaua

SEQ ID NO: 862525 - RNA, 19 nt, Homo sapiens
gucaauaucccacuuaaau

SEQ ID NO: 862526 - RNA, 19 nt, Homo sapiens
ggaccuaucccuggaauuc

SEQ ID NO: 862527 - RNA, 19 nt, Homo sapiens
caauaucccacuuaaauca

SEQ ID NO: 862528 - RNA, 19 nt, Homo sapiens
uaaauaagaagagcaguug

SEQ ID NO: 862529 - RNA, 19 nt, Homo sapiens
ggccgaggguucaagacua

SEQ ID NO: 862530 - RNA, 19 nt, Homo sapiens
gcucacaccuguaauucca

SEQ ID NO: 862531 - RNA, 19 nt, Homo sapiens
gaaccuguguaaccucaag

SEQ ID NO: 862532 - RNA, 19 nt, Homo sapiens
gagauccugacucaaauaa

SEQ ID NO: 862533 - RNA, 19 nt, Homo sapiens
acauaugguuguucuaaga

SEQ ID NO: 862534 - RNA, 19 nt, Homo sapiens
gcagugagccaagauuaug

SEQ ID NO: 862535 - RNA, 19 nt, Homo sapiens
gaccugaagcugcuaagaa

SEQ ID NO: 862536 - RNA, 19 nt, Homo sapiens
caacauagcgagacugcau

SEQ ID NO: 862537 - RNA, 19 nt, Homo sapiens
uuaaugaucuacagacuac

SEQ ID NO: 862538 - RNA, 19 nt, Homo sapiens
agaaagcaguuaaugaucu

SEQ ID NO: 862539 - RNA, 19 nt, Homo sapiens
gcaauuacaaauccaauac

SEQ ID NO: 862540 - RNA, 19 nt, Homo sapiens
gaagaggaaaccuaaccaa

SEQ ID NO: 862541 - RNA, 19 nt, Homo sapiens
cugagaugcuggccaaauu

SEQ ID NO: 862542 - RNA, 19 nt, Homo sapiens
acaaggagccgaguucaaa

SEQ ID NO: 862543 - RNA, 19 nt, Homo sapiens
gggcaacaccugcuacaug

SEQ ID NO: 862544 - RNA, 19 nt, Homo sapiens
ggaccuaggcccugugcaa

SEQ ID NO: 862545 - RNA, 19 nt, Homo sapiens
uggauuaccuagagggaaa

SEQ ID NO: 862546 - RNA, 19 nt, Homo sapiens
accaaugacuguggaauaa

SEQ ID NO: 862547 - RNA, 19 nt, Homo sapiens
cauaguacuuauucaguca

SEQ ID NO: 862548 - RNA, 19 nt, Homo sapiens
ggguugauuuguccacauu

SEQ ID NO: 862549 - RNA, 19 nt, Homo sapiens
uagagaagaggaaaccuaa

SEQ ID NO: 862550 - RNA, 19 nt, Homo sapiens
cuagaaagcaguuaaugau

SEQ ID NO: 862551 - RNA, 19 nt, Homo sapiens
ucagccaccuccagaaguu

SEQ ID NO: 862552 - RNA, 19 nt, Homo sapiens
ggaaagggguugauuuguc

SEQ ID NO: 862553 - RNA, 19 nt, Homo sapiens
ucaccaaacaggucuuaaa

SEQ ID NO: 862554 - RNA, 19 nt, Homo sapiens
caauggcucacaccuguaa

SEQ ID NO: 862555 - RNA, 19 nt, Homo sapiens
gcaggagaaucgcuugaac

SEQ ID NO: 862556 - RNA, 19 nt, Homo sapiens
gagggaaauuacauacauc

SEQ ID NO: 862557 - RNA, 19 nt, Homo sapiens
agagggaaauuacauacau

SEQ ID NO: 862558 - RNA, 19 nt, Homo sapiens
gaacggcagggccuccauu

SEQ ID NO: 862559 - RNA, 19 nt, Homo sapiens
acuacgugcucaaugauaa

SEQ ID NO: 862560 - RNA, 19 nt, Homo sapiens
gggaggugcgugcgcuuua

SEQ ID NO: 862561 - RNA, 19 nt, Homo sapiens
ucuuaaagguggugaauac

SEQ ID NO: 862562 - RNA, 19 nt, Homo sapiens
uuuaauggguugagaaagu

SEQ ID NO: 862563 - RNA, 19 nt, Homo sapiens
gcccaggaguuugaaguug

SEQ ID NO: 862564 - RNA, 19 nt, Homo sapiens
aagagaccuuugccuauga

SEQ ID NO: 862565 - RNA, 19 nt, Homo sapiens
cagucaauaucccacuuaa

SEQ ID NO: 862566 - RNA, 19 nt, Homo sapiens
agcaggaacucgagucuga

SEQ ID NO: 862567 - RNA, 19 nt, Homo sapiens
agaggaaaccuaaccaaug

SEQ ID NO: 862568 - RNA, 19 nt, Homo sapiens
cuuaaaucauuccagguaa

SEQ ID NO: 862569 - RNA, 19 nt, Homo sapiens
gggagaaucuacgcuugug

SEQ ID NO: 862570 - RNA, 19 nt, Homo sapiens
caacaggacgcgcaggaau

SEQ ID NO: 862571 - RNA, 19 nt, Homo sapiens
ucagaaguggugcugcuua

SEQ ID NO: 862572 - RNA, 19 nt, Homo sapiens
gaaguugcaaugagcuaug

SEQ ID NO: 862573 - RNA, 19 nt, Homo sapiens
gaaguuccgagaauguuuc

SEQ ID NO: 862574 - RNA, 19 nt, Homo sapiens
aggacuacgugcucaauga

SEQ ID NO: 862575 - RNA, 19 nt, Homo sapiens
gaaguggugcugcuuagag

SEQ ID NO: 862576 - RNA, 19 nt, Homo sapiens
auggauagaugcaaacaug

SEQ ID NO: 862577 - RNA, 19 nt, Homo sapiens
ccagucaauaucccacuua

SEQ ID NO: 862578 - RNA, 19 nt, Homo sapiens
ggcagggccuccauuaguc

SEQ ID NO: 862579 - RNA, 19 nt, Homo sapiens
cagaaguggugcugcuuag

SEQ ID NO: 862580 - RNA, 19 nt, Homo sapiens
aauaaagccgagaacauuu

SEQ ID NO: 862581 - RNA, 19 nt, Homo sapiens
uguguaaccucaaggagau

SEQ ID NO: 862582 - RNA, 19 nt, Homo sapiens
uugaaaggaccucuaguuu

SEQ ID NO: 862583 - RNA, 19 nt, Homo sapiens
gagaauguuuccucaaccu

SEQ ID NO: 862584 - RNA, 19 nt, Homo sapiens
ccgcaguggucaugcauca

SEQ ID NO: 862585 - RNA, 19 nt, Homo sapiens
guaaucaucgagagaagau

SEQ ID NO: 862586 - RNA, 19 nt, Homo sapiens
aaaccuaaccaaugacugu

SEQ ID NO: 862587 - RNA, 19 nt, Homo sapiens
gguaauagagaagaggaaa

SEQ ID NO: 862588 - RNA, 19 nt, Homo sapiens
ucacuagccgcagcuuaua

SEQ ID NO: 862589 - RNA, 19 nt, Homo sapiens
guacuuauucagucagugu

SEQ ID NO: 862590 - RNA, 19 nt, Homo sapiens
ggaguuugaaguugcaaug

SEQ ID NO: 862591 - RNA, 19 nt, Homo sapiens
ggagacagccucugggauu

SEQ ID NO: 862592 - RNA, 19 nt, Homo sapiens
gagcaauucugggcuguga

SEQ ID NO: 862593 - RNA, 19 nt, Homo sapiens
gcaacucgcccaucuuuua

SEQ ID NO: 862594 - RNA, 19 nt, Homo sapiens
gaccaucuaccuugaacua

SEQ ID NO: 862595 - RNA, 19 nt, Homo sapiens
gugaagacuccaacccuua

SEQ ID NO: 862596 - RNA, 19 nt, Homo sapiens
gagacagccucugggauug

SEQ ID NO: 862597 - RNA, 19 nt, Homo sapiens
cauccuggcucgagaguca

SEQ ID NO: 862598 - RNA, 19 nt, Homo sapiens
gaacuacacccaggagcaa

SEQ ID NO: 862599 - RNA, 19 nt, Homo sapiens
gaacucggcaccuucaaag

SEQ ID NO: 862600 - RNA, 19 nt, Homo sapiens
gguacagaaugccguguug

SEQ ID NO: 862601 - RNA, 19 nt, Homo sapiens
ggaacucggcaccuucaaa

SEQ ID NO: 862602 - RNA, 19 nt, Homo sapiens
ccacaagccgcaagacuuc

SEQ ID NO: 862603 - RNA, 19 nt, Homo sapiens
ccagcuacauggauuugug

SEQ ID NO: 862604 - RNA, 19 nt, Homo sapiens
cuccaacccuuauccugua

SEQ ID NO: 862605 - RNA, 19 nt, Homo sapiens
gcgaggugcucccacucaa

SEQ ID NO: 862606 - RNA, 19 nt, Homo sapiens
caaaggaggcaagcacaga

SEQ ID NO: 862607 - RNA, 19 nt, Homo sapiens
gcucaugcuccuacuguau

SEQ ID NO: 862608 - RNA, 19 nt, Homo sapiens
caucucacagacacaauaa

SEQ ID NO: 862609 - RNA, 19 nt, Homo sapiens
uggcaacucgcccaucuuu

SEQ ID NO: 862610 - RNA, 19 nt, Homo sapiens
gcaauucugggcugugaag

SEQ ID NO: 862611 - RNA, 19 nt, Homo sapiens
ccaccuccacccagaacua

SEQ ID NO: 862612 - RNA, 19 nt, Homo sapiens
ugaagacuccaacccuuau

SEQ ID NO: 862613 - RNA, 19 nt, Homo sapiens
gcaugagcuuggacagucu

SEQ ID NO: 862614 - RNA, 19 nt, Homo sapiens
caacccuuauccuguaugg

SEQ ID NO: 862615 - RNA, 19 nt, Homo sapiens
ccaucuaccuugaacuaac

SEQ ID NO: 862616 - RNA, 19 nt, Homo sapiens
gagguggugcugcuucaug

SEQ ID NO: 862617 - RNA, 19 nt, Homo sapiens
ucaucucacagacacaaua

SEQ ID NO: 862618 - RNA, 19 nt, Homo sapiens
gacagccucugggauugga

SEQ ID NO: 862619 - RNA, 19 nt, Homo sapiens
auggagagcuggaccacau

SEQ ID NO: 862620 - RNA, 19 nt, Homo sapiens
caugagccagucccaggua

SEQ ID NO: 862621 - RNA, 19 nt, Homo sapiens
ggacuccucauuucaucuc

SEQ ID NO: 862622 - RNA, 19 nt, Homo sapiens
guggugaagcuacgcaaug

SEQ ID NO: 862623 - RNA, 19 nt, Homo sapiens
gaagacuccaacccuuauc

SEQ ID NO: 862624 - RNA, 19 nt, Homo sapiens
ccaccagcuacauggauuu

SEQ ID NO: 862625 - RNA, 19 nt, Homo sapiens
ccucauuucaucucacaga

SEQ ID NO: 862626 - RNA, 19 nt, Homo sapiens
ccuugaccaucuaccuuga

SEQ ID NO: 862627 - RNA, 19 nt, Homo sapiens
ccuggcaacucgcccaucu

SEQ ID NO: 862628 - RNA, 19 nt, Homo sapiens
caacagauacuauaaggaa

SEQ ID NO: 862629 - RNA, 19 nt, Homo sapiens
ggacaucaaugaccagauc

SEQ ID NO: 862630 - RNA, 19 nt, Homo sapiens
gcaaagacugcaaguuuaa

SEQ ID NO: 862631 - RNA, 19 nt, Homo sapiens
gaaauuccgcugucagaaa

SEQ ID NO: 862632 - RNA, 19 nt, Homo sapiens
ugagaaagcggcacuauug

SEQ ID NO: 862633 - RNA, 19 nt, Homo sapiens
ccauugagcuggacaagau

SEQ ID NO: 862634 - RNA, 19 nt, Homo sapiens
caucucagcuggagccauu

SEQ ID NO: 862635 - RNA, 19 nt, Homo sapiens
ugaagcagcuggccuguuc

SEQ ID NO: 862636 - RNA, 19 nt, Homo sapiens
gaacaacacgaccaacaga

SEQ ID NO: 862637 - RNA, 19 nt, Homo sapiens
gaaaguguuuguggugaug

SEQ ID NO: 862638 - RNA, 19 nt, Homo sapiens
gcaaguguaucacgcucuu

SEQ ID NO: 862639 - RNA, 19 nt, Homo sapiens
ugagacaccuucacuucaa

SEQ ID NO: 862640 - RNA, 19 nt, Homo sapiens
gaccagaaguucccugagu

SEQ ID NO: 862641 - RNA, 19 nt, Homo sapiens
caagaacauuguccacugu

SEQ ID NO: 862642 - RNA, 19 nt, Homo sapiens
gggaggcccuuaucaaugg

SEQ ID NO: 862643 - RNA, 19 nt, Homo sapiens
aaacugcgcuucccuacca

SEQ ID NO: 862644 - RNA, 19 nt, Homo sapiens
guaucacgcucuuccagaa

SEQ ID NO: 862645 - RNA, 19 nt, Homo sapiens
aggguugggugguucauua

SEQ ID NO: 862646 - RNA, 19 nt, Homo sapiens
caagagcgcccucauggau

SEQ ID NO: 862647 - RNA, 19 nt, Homo sapiens
acagucagauccaagagaa

SEQ ID NO: 862648 - RNA, 19 nt, Homo sapiens
ucaaugaccagauccagaa

SEQ ID NO: 862649 - RNA, 19 nt, Homo sapiens
ggcaucagcagacccauuu

SEQ ID NO: 862650 - RNA, 19 nt, Homo sapiens
aaauuccgcugucagaaau

SEQ ID NO: 862651 - RNA, 19 nt, Homo sapiens
cgaccaacagauacuauaa

SEQ ID NO: 862652 - RNA, 19 nt, Homo sapiens
acaagaugcugcucuccaa

SEQ ID NO: 862653 - RNA, 19 nt, Homo sapiens
ggaggaggccaccgauuuc

SEQ ID NO: 862654 - RNA, 19 nt, Homo sapiens
gccgggacguggcaguuaa

SEQ ID NO: 862655 - RNA, 19 nt, Homo sapiens
acaacacgaccaacagaua

SEQ ID NO: 862656 - RNA, 19 nt, Homo sapiens
caccuucacuucaagaaca

SEQ ID NO: 862657 - RNA, 19 nt, Homo sapiens
acaaggacacgcugagaaa

SEQ ID NO: 862658 - RNA, 19 nt, Homo sapiens
uaaugaggguggugcaauc

SEQ ID NO: 862659 - RNA, 19 nt, Homo sapiens
ccacccgcgucccuaauga

SEQ ID NO: 862660 - RNA, 19 nt, Homo sapiens
gcaccaacccacacugcuu

SEQ ID NO: 862661 - RNA, 19 nt, Homo sapiens
ggaagaugggagagcgaua

SEQ ID NO: 862662 - RNA, 19 nt, Homo sapiens
gcuacagcguggacaaauc

SEQ ID NO: 862663 - RNA, 19 nt, Homo sapiens
ggagggaaacaccggaaga

SEQ ID NO: 862664 - RNA, 19 nt, Homo sapiens
ucagaggacuccgguguca

SEQ ID NO: 862665 - RNA, 19 nt, Homo sapiens
uggaggaggccaccgauuu

SEQ ID NO: 862666 - RNA, 19 nt, Homo sapiens
gcgccugccuucugugauc

SEQ ID NO: 862667 - RNA, 19 nt, Homo sapiens
cgagacgccugagaaagug

SEQ ID NO: 862668 - RNA, 19 nt, Homo sapiens
cgccuggacugcaagugua

SEQ ID NO: 862669 - RNA, 19 nt, Homo sapiens
gaagagcugagccguagca

SEQ ID NO: 862670 - RNA, 19 nt, Homo sapiens
gcggagcgcaucaguguuc

SEQ ID NO: 862671 - RNA, 19 nt, Homo sapiens
gugaagcugugugacuuug

SEQ ID NO: 862672 - RNA, 19 nt, Homo sapiens
caacaaggacacgcugaga

SEQ ID NO: 862673 - RNA, 19 nt, Homo sapiens
cacaggaucccagcaauga

SEQ ID NO: 862674 - RNA, 19 nt, Homo sapiens
cagugggcgugaucaugua

SEQ ID NO: 862675 - RNA, 19 nt, Homo sapiens
caacacgaccaacagauac

SEQ ID NO: 862676 - RNA, 19 nt, Homo sapiens
agcgauacaucacgcauga

SEQ ID NO: 862677 - RNA, 19 nt, Homo sapiens
gaagaugggagagcgauac

SEQ ID NO: 862678 - RNA, 19 nt, Homo sapiens
cagcgguucuucacaggau

SEQ ID NO: 862679 - RNA, 19 nt, Homo sapiens
gacaagauccugcuuuuca

SEQ ID NO: 862680 - RNA, 19 nt, Homo sapiens
gcaccuucccuuucaacga

SEQ ID NO: 862681 - RNA, 19 nt, Homo sapiens
agaacauuguccacuguga

SEQ ID NO: 862682 - RNA, 19 nt, Homo sapiens
gagacaccuucacuucaag

SEQ ID NO: 862683 - RNA, 19 nt, Homo sapiens
agaugauccuguccaguga

SEQ ID NO: 862684 - RNA, 19 nt, Homo sapiens
ugacaagagcgcccucaug

SEQ ID NO: 862685 - RNA, 19 nt, Homo sapiens
uguccacugugacuugaaa

SEQ ID NO: 862686 - RNA, 19 nt, Homo sapiens
caccaacccacacugcuuu

SEQ ID NO: 862687 - RNA, 19 nt, Homo sapiens
ggaguccgcccagaacuuc

SEQ ID NO: 862688 - RNA, 19 nt, Homo sapiens
gcugcgggcugaacuacca

SEQ ID NO: 862689 - RNA, 19 nt, Homo sapiens
cgauacaucacgcaugaga

SEQ ID NO: 862690 - RNA, 19 nt, Homo sapiens
gcugugugacuuuggcuuu

SEQ ID NO: 862691 - RNA, 19 nt, Homo sapiens
ggugaagcugugugacuuu

SEQ ID NO: 862692 - RNA, 19 nt, Homo sapiens
guucgagacgccugagaaa

SEQ ID NO: 862693 - RNA, 19 nt, Homo sapiens
ccaacagucagauccaaga

SEQ ID NO: 862694 - RNA, 19 nt, Homo sapiens
ucucugagcaucucugugu

SEQ ID NO: 862695 - RNA, 19 nt, Homo sapiens
uggcuuugcucgcaucauc

SEQ ID NO: 862696 - RNA, 19 nt, Homo sapiens
cagaacaacacgaccaaca

SEQ ID NO: 862697 - RNA, 19 nt, Homo sapiens
gagaaagcggcacuauugg

SEQ ID NO: 862698 - RNA, 19 nt, Homo sapiens
ucagugggcgugaucaugu

SEQ ID NO: 862699 - RNA, 19 nt, Homo sapiens
agaaaguguuuguggugau

SEQ ID NO: 862700 - RNA, 19 nt, Homo sapiens
ucuucugccucaucguaua

SEQ ID NO: 862701 - RNA, 19 nt, Homo sapiens
ccucuucugccucaucgua

SEQ ID NO: 862702 - RNA, 19 nt, Homo sapiens
ucacaggaucccagcaaug

SEQ ID NO: 862703 - RNA, 19 nt, Homo sapiens
ccagaucuucccugacgaa

SEQ ID NO: 862704 - RNA, 19 nt, Homo sapiens
ucuacggccuuuacgacaa

SEQ ID NO: 862705 - RNA, 19 nt, Homo sapiens
gaccaacagauacuauaag

SEQ ID NO: 862706 - RNA, 19 nt, Homo sapiens
cgacacacgacgcggaaau

SEQ ID NO: 862707 - RNA, 19 nt, Homo sapiens
ucgagacgccugagaaagu

SEQ ID NO: 862708 - RNA, 19 nt, Homo sapiens
aacccacacugcuuugaga

SEQ ID NO: 862709 - RNA, 19 nt, Homo sapiens
ggaggcccuuaucaaugga

SEQ ID NO: 862710 - RNA, 19 nt, Homo sapiens
ccuuaucaauggagaugug

SEQ ID NO: 862711 - RNA, 19 nt, Homo sapiens
gcaguuugcagcagagcau

SEQ ID NO: 862712 - RNA, 19 nt, Homo sapiens
cuacggccuuuacgacaag

SEQ ID NO: 862713 - RNA, 19 nt, Homo sapiens
ccaaggccccucccuguuu

SEQ ID NO: 862714 - RNA, 19 nt, Homo sapiens
uggcggagcgcaucagugu

SEQ ID NO: 862715 - RNA, 19 nt, Homo sapiens
cagcggcaccuucccuuuc

SEQ ID NO: 862716 - RNA, 19 nt, Homo sapiens
ccgaggugcugcucaacca

SEQ ID NO: 862717 - RNA, 19 nt, Homo sapiens
gauccugguggcuuugaga

SEQ ID NO: 862718 - RNA, 19 nt, Homo sapiens
ggacauguuggagaugauc

SEQ ID NO: 862719 - RNA, 19 nt, Homo sapiens
ucacugccaaugccaccua

SEQ ID NO: 862720 - RNA, 19 nt, Homo sapiens
ccagaaguucccugagugu

SEQ ID NO: 862721 - RNA, 19 nt, Homo sapiens
gcugagaaagcggcacuau

SEQ ID NO: 862722 - RNA, 19 nt, Homo sapiens
gaggaggccaccgauuuca

SEQ ID NO: 862723 - RNA, 19 nt, Homo sapiens
gcaguuuggaguggucuau

SEQ ID NO: 862724 - RNA, 19 nt, Homo sapiens
gcgccuggacugcaagugu

SEQ ID NO: 862725 - RNA, 19 nt, Homo sapiens
cuacagcguggacaaaucu

SEQ ID NO: 862726 - RNA, 19 nt, Homo sapiens
gaaaccagaaaacguguug

SEQ ID NO: 862727 - RNA, 19 nt, Homo sapiens
gauccuguccagugagaag

SEQ ID NO: 862728 - RNA, 19 nt, Homo sapiens
gcagacauguaacuauuua

SEQ ID NO: 862729 - RNA, 19 nt, Homo sapiens
gacagaagcugagauguuu

SEQ ID NO: 862730 - RNA, 19 nt, Homo sapiens
caccaugccuggcuaauuu

SEQ ID NO: 862731 - RNA, 19 nt, Homo sapiens
gcaaauaguacuccagaaa

SEQ ID NO: 862732 - RNA, 19 nt, Homo sapiens
ggauggagcuuugucuuug

SEQ ID NO: 862733 - RNA, 19 nt, Homo sapiens
ggacagaagcugagauguu

SEQ ID NO: 862734 - RNA, 19 nt, Homo sapiens
gggcaacacuccagauuca

SEQ ID NO: 862735 - RNA, 19 nt, Homo sapiens
gcaaacagcgcaauuccaa

SEQ ID NO: 862736 - RNA, 19 nt, Homo sapiens
gaugggaucucgcucuguu

SEQ ID NO: 862737 - RNA, 19 nt, Homo sapiens
acaaagauuucagggauuu

SEQ ID NO: 862738 - RNA, 19 nt, Homo sapiens
guaacaggcagacauguaa

SEQ ID NO: 862739 - RNA, 19 nt, Homo sapiens
ggacucagccuccuguguu

SEQ ID NO: 862740 - RNA, 19 nt, Homo sapiens
gaaauggacaggcuacuag

SEQ ID NO: 862741 - RNA, 19 nt, Homo sapiens
agaaccagaugauguacua

SEQ ID NO: 862742 - RNA, 19 nt, Homo sapiens
uguuagaggccaaguauua

SEQ ID NO: 862743 - RNA, 19 nt, Homo sapiens
gaacaacuacgggcucuau

SEQ ID NO: 862744 - RNA, 19 nt, Homo sapiens
ggaacaaauucuccagaca

SEQ ID NO: 862745 - RNA, 19 nt, Homo sapiens
aaauaguacuccagaaaga

SEQ ID NO: 862746 - RNA, 19 nt, Homo sapiens
gggagaaccagaugaugua

SEQ ID NO: 862747 - RNA, 19 nt, Homo sapiens
ggaaauggacaggcuacua

SEQ ID NO: 862748 - RNA, 19 nt, Homo sapiens
gauggagcuuugucuuuga

SEQ ID NO: 862749 - RNA, 19 nt, Homo sapiens
ggaggaagagugggaguuu

SEQ ID NO: 862750 - RNA, 19 nt, Homo sapiens
uaucagaagcuuccuauuc

SEQ ID NO: 862751 - RNA, 19 nt, Homo sapiens
uguacuaggugaagcauug

SEQ ID NO: 862752 - RNA, 19 nt, Homo sapiens
ccaaagugcugggauuaca

SEQ ID NO: 862753 - RNA, 19 nt, Homo sapiens
gggaaucacaaagcaaaua

SEQ ID NO: 862754 - RNA, 19 nt, Homo sapiens
aggcagacauguaacuauu

SEQ ID NO: 862755 - RNA, 19 nt, Homo sapiens
ggugaagcauugcauugug

SEQ ID NO: 862756 - RNA, 19 nt, Homo sapiens
cugaugagcugagaaacaa

SEQ ID NO: 862757 - RNA, 19 nt, Homo sapiens
gacucagccuccuguguuu

SEQ ID NO: 862758 - RNA, 19 nt, Homo sapiens
gaggaagagugggaguuug

SEQ ID NO: 862759 - RNA, 19 nt, Homo sapiens
ccaaugaagucuguacucu

SEQ ID NO: 862760 - RNA, 19 nt, Homo sapiens
gcugagauguuuggaugga

SEQ ID NO: 862761 - RNA, 19 nt, Homo sapiens
ggaaucacaaagcaaauag

SEQ ID NO: 862762 - RNA, 19 nt, Homo sapiens
caaauaguacuccagaaag

SEQ ID NO: 862763 - RNA, 19 nt, Homo sapiens
aaagcacaguucaguccua

SEQ ID NO: 862764 - RNA, 19 nt, Homo sapiens
gagcuucagccucaggaaa

SEQ ID NO: 862765 - RNA, 19 nt, Homo sapiens
gucauucccuggccauguu

SEQ ID NO: 862766 - RNA, 19 nt, Homo sapiens
aagcacaguucaguccuaa

SEQ ID NO: 862767 - RNA, 19 nt, Homo sapiens
ggccagguguuucuguuag

SEQ ID NO: 862768 - RNA, 19 nt, Homo sapiens
acacaggauugcaaacaca

SEQ ID NO: 862769 - RNA, 19 nt, Homo sapiens
gggccagguguuucuguua

SEQ ID NO: 862770 - RNA, 19 nt, Homo sapiens
ccaauaaaaucuccugcaa

SEQ ID NO: 862771 - RNA, 19 nt, Homo sapiens
gcacaguucaguccuaaaa

SEQ ID NO: 862772 - RNA, 19 nt, Homo sapiens
uaaaaucuccugcaauugu

SEQ ID NO: 862773 - RNA, 19 nt, Homo sapiens
ucacaaagcaaauaguacu

SEQ ID NO: 862774 - RNA, 19 nt, Homo sapiens
ggcagacauguaacuauuu

SEQ ID NO: 862775 - RNA, 19 nt, Homo sapiens
uguaacaggcagacaugua

SEQ ID NO: 862776 - RNA, 19 nt, Homo sapiens
gccaguugcuguggaagga

SEQ ID NO: 862777 - RNA, 19 nt, Homo sapiens
uugaggacuuugucucuga

SEQ ID NO: 862778 - RNA, 19 nt, Homo sapiens
gugggaaucacaaagcaaa

SEQ ID NO: 862779 - RNA, 19 nt, Homo sapiens
gccagguguuucuguuaga

SEQ ID NO: 862780 - RNA, 19 nt, Homo sapiens
aacaaagauuucagggauu

SEQ ID NO: 862781 - RNA, 19 nt, Homo sapiens
acaugucccuggagaguag

SEQ ID NO: 862782 - RNA, 19 nt, Homo sapiens
ccaccaugccuggcuaauu

SEQ ID NO: 862783 - RNA, 19 nt, Homo sapiens
uagaggccaaguauuauug

SEQ ID NO: 862784 - RNA, 19 nt, Homo sapiens
acaacuacgggcucuauga

SEQ ID NO: 862785 - RNA, 19 nt, Homo sapiens
gaauuuuccugguucuguu

SEQ ID NO: 862786 - RNA, 19 nt, Homo sapiens
ccuuugccaucgacauauu

SEQ ID NO: 862787 - RNA, 19 nt, Homo sapiens
gcccgugccuacugugcuu

SEQ ID NO: 862788 - RNA, 19 nt, Homo sapiens
uggauggagcuuugucuuu

SEQ ID NO: 862789 - RNA, 19 nt, Homo sapiens
aaacaugucccuggagagu

SEQ ID NO: 862790 - RNA, 19 nt, Homo sapiens
guuagaggccaaguauuau

SEQ ID NO: 862791 - RNA, 19 nt, Homo sapiens
ugacgcccgugccuacugu

SEQ ID NO: 862792 - RNA, 19 nt, Homo sapiens
uagcugggacuacaagugu

SEQ ID NO: 862793 - RNA, 19 nt, Homo sapiens
gcgggaggcgacagugaaa

SEQ ID NO: 862794 - RNA, 19 nt, Homo sapiens
cuacuagcaugguccaacu

SEQ ID NO: 862795 - RNA, 19 nt, Homo sapiens
gacacaggauugcaaacac

SEQ ID NO: 862796 - RNA, 19 nt, Homo sapiens
cccaauguguguugacgau

SEQ ID NO: 862797 - RNA, 19 nt, Homo sapiens
gcuucagccucaggaaaga

SEQ ID NO: 862798 - RNA, 19 nt, Homo sapiens
aaagccacccagccaauga

SEQ ID NO: 862799 - RNA, 19 nt, Homo sapiens
caaagccacccagccaaug

SEQ ID NO: 862800 - RNA, 19 nt, Homo sapiens
gaugagcugagaaacaaag

SEQ ID NO: 862801 - RNA, 19 nt, Homo sapiens
gaagcugagauguuuggau

SEQ ID NO: 862802 - RNA, 19 nt, Homo sapiens
ugaaacccuuugccaucga

SEQ ID NO: 862803 - RNA, 19 nt, Homo sapiens
ugacacaggauugcaaaca

SEQ ID NO: 862804 - RNA, 19 nt, Homo sapiens
uuagaggccaaguauuauu

SEQ ID NO: 862805 - RNA, 19 nt, Homo sapiens
uguggaaggagaaugcuuu

SEQ ID NO: 862806 - RNA, 19 nt, Homo sapiens
ccacccagccaaugaaguc

SEQ ID NO: 862807 - RNA, 19 nt, Homo sapiens
gcauugcauugugggaauc

SEQ ID NO: 862808 - RNA, 19 nt, Homo sapiens
ggacuuugucucugaugag

SEQ ID NO: 862809 - RNA, 19 nt, Homo sapiens
ccaggguggucucgaacuc

SEQ ID NO: 862810 - RNA, 19 nt, Homo sapiens
uaggugaagcauugcauug

SEQ ID NO: 862811 - RNA, 19 nt, Homo sapiens
gaaucacaaagcaaauagu

SEQ ID NO: 862812 - RNA, 19 nt, Homo sapiens
gaugauguacuaggugaag

SEQ ID NO: 862813 - RNA, 19 nt, Homo sapiens
ucuguuagaggccaaguau

SEQ ID NO: 862814 - RNA, 19 nt, Homo sapiens
cagauucagccucagacaa

SEQ ID NO: 862815 - RNA, 19 nt, Homo sapiens
aauaucagaagcuuccuau

SEQ ID NO: 862816 - RNA, 19 nt, Homo sapiens
ugggagaaccagaugaugu

SEQ ID NO: 862817 - RNA, 19 nt, Homo sapiens
ccucugaaggaaacuaguu

SEQ ID NO: 862818 - RNA, 19 nt, Homo sapiens
ggacagcaucaccguacca

SEQ ID NO: 862819 - RNA, 19 nt, Homo sapiens
gaacugaucucuacccuaa

SEQ ID NO: 862820 - RNA, 19 nt, Homo sapiens
gaagaaaccuugcuuggaa

SEQ ID NO: 862821 - RNA, 19 nt, Homo sapiens
cagagaagaucacagaaua

SEQ ID NO: 862822 - RNA, 19 nt, Homo sapiens
guaagcagcucuugaauag

SEQ ID NO: 862823 - RNA, 19 nt, Homo sapiens
gaagaucaauguacagaau

SEQ ID NO: 862824 - RNA, 19 nt, Homo sapiens
ggacggugaugcaaauaaa

SEQ ID NO: 862825 - RNA, 19 nt, Homo sapiens
ucacacaacuuucugaaga

SEQ ID NO: 862826 - RNA, 19 nt, Homo sapiens
gcaaccagcugaaacacaa

SEQ ID NO: 862827 - RNA, 19 nt, Homo sapiens
gcccuuaacuaccaaagua

SEQ ID NO: 862828 - RNA, 19 nt, Homo sapiens
ucaguucagucuacauuua

SEQ ID NO: 862829 - RNA, 19 nt, Homo sapiens
cagaggagcugcuuuagug

SEQ ID NO: 862830 - RNA, 19 nt, Homo sapiens
ggagacagaugacauugau

SEQ ID NO: 862831 - RNA, 19 nt, Homo sapiens
ggacagccaguaaagaaua

SEQ ID NO: 862832 - RNA, 19 nt, Homo sapiens
cagaugacauugaugauau

SEQ ID NO: 862833 - RNA, 19 nt, Homo sapiens
gcagcuaaaggaauaaaua

SEQ ID NO: 862834 - RNA, 19 nt, Homo sapiens
gauguucguucauauguga

SEQ ID NO: 862835 - RNA, 19 nt, Homo sapiens
ucacagaggagcugcuuua

SEQ ID NO: 862836 - RNA, 19 nt, Homo sapiens
uaagggaaauucagcaguu

SEQ ID NO: 862837 - RNA, 19 nt, Homo sapiens
gaagagucaucagaauuug

SEQ ID NO: 862838 - RNA, 19 nt, Homo sapiens
caaagaaacuagagugcau

SEQ ID NO: 862839 - RNA, 19 nt, Homo sapiens
uugcuuggcuuaucucaua

SEQ ID NO: 862840 - RNA, 19 nt, Homo sapiens
guuuguagcuccugacauu

SEQ ID NO: 862841 - RNA, 19 nt, Homo sapiens
gagaagaucacagaauaaa

SEQ ID NO: 862842 - RNA, 19 nt, Homo sapiens
cauugcagcuguaauuaaa

SEQ ID NO: 862843 - RNA, 19 nt, Homo sapiens
caaagaagagucaucagaa

SEQ ID NO: 862844 - RNA, 19 nt, Homo sapiens
agaaugccaucucgucaua

SEQ ID NO: 862845 - RNA, 19 nt, Homo sapiens
aaaggucaauuuggucuua

SEQ ID NO: 862846 - RNA, 19 nt, Homo sapiens
gaauugaucaacaagguuu

SEQ ID NO: 862847 - RNA, 19 nt, Homo sapiens
gaguuuagauguucguuca

SEQ ID NO: 862848 - RNA, 19 nt, Homo sapiens
caaaggaaaccacagagaa

SEQ ID NO: 862849 - RNA, 19 nt, Homo sapiens
gcaaccggcuuaaacaucu

SEQ ID NO: 862850 - RNA, 19 nt, Homo sapiens
aaaguagcauugugucauu

SEQ ID NO: 862851 - RNA, 19 nt, Homo sapiens
gacagccaguaaagaauaa

SEQ ID NO: 862852 - RNA, 19 nt, Homo sapiens
aaagaagagucaucagaau

SEQ ID NO: 862853 - RNA, 19 nt, Homo sapiens
ggauucaaccaaugccuua

SEQ ID NO: 862854 - RNA, 19 nt, Homo sapiens
gcacaggaguucauuucag

SEQ ID NO: 862855 - RNA, 19 nt, Homo sapiens
gaacugcuaagaucuggaa

SEQ ID NO: 862856 - RNA, 19 nt, Homo sapiens
aagcagcucuugaauagug

SEQ ID NO: 862857 - RNA, 19 nt, Homo sapiens
gaucuuggacagccaguaa

SEQ ID NO: 862858 - RNA, 19 nt, Homo sapiens
ggucuuauuggcuccauua

SEQ ID NO: 862859 - RNA, 19 nt, Homo sapiens
ugacuuacuaggcaauuua

SEQ ID NO: 862860 - RNA, 19 nt, Homo sapiens
guuuagauguucguucaua

SEQ ID NO: 862861 - RNA, 19 nt, Homo sapiens
gacuaaagacaaccaagua

SEQ ID NO: 862862 - RNA, 19 nt, Homo sapiens
agaagagucaucagaauuu

SEQ ID NO: 862863 - RNA, 19 nt, Homo sapiens
gaaaaucagcccuuaacua

SEQ ID NO: 862864 - RNA, 19 nt, Homo sapiens
gcauugcagcuguaauuaa

SEQ ID NO: 862865 - RNA, 19 nt, Homo sapiens
gaaacuagagugcauaaaa

SEQ ID NO: 862866 - RNA, 19 nt, Homo sapiens
uaaagacaaccaaguauuc

SEQ ID NO: 862867 - RNA, 19 nt, Homo sapiens
uuacagcaaucacaacaga

SEQ ID NO: 862868 - RNA, 19 nt, Homo sapiens
ggugggagauagcaaggaa

SEQ ID NO: 862869 - RNA, 19 nt, Homo sapiens
caugucagguguuaauaug

SEQ ID NO: 862870 - RNA, 19 nt, Homo sapiens
cugcuaagaucuggaagua

SEQ ID NO: 862871 - RNA, 19 nt, Homo sapiens
gcugaagagccaaaccuua

SEQ ID NO: 862872 - RNA, 19 nt, Homo sapiens
cuucugauaucacugaauu

SEQ ID NO: 862873 - RNA, 19 nt, Homo sapiens
guacaucaggaaccauuaa

SEQ ID NO: 862874 - RNA, 19 nt, Homo sapiens
uaaagugaguuuggaguuc

SEQ ID NO: 862875 - RNA, 19 nt, Homo sapiens
cuuauuggcuccauuauac

SEQ ID NO: 862876 - RNA, 19 nt, Homo sapiens
gauguaauuccuugaguga

SEQ ID NO: 862877 - RNA, 19 nt, Homo sapiens
cauacaaacuaaggagaaa

SEQ ID NO: 862878 - RNA, 19 nt, Homo sapiens
ggagaccaguuuugauuuu

SEQ ID NO: 862879 - RNA, 19 nt, Homo sapiens
ugucagguguuaauaugaa

SEQ ID NO: 862880 - RNA, 19 nt, Homo sapiens
aaaggaaaccacagagaaa

SEQ ID NO: 862881 - RNA, 19 nt, Homo sapiens
guccgccucugaauacuaa

SEQ ID NO: 862882 - RNA, 19 nt, Homo sapiens
uaaugggaguuuagauguu

SEQ ID NO: 862883 - RNA, 19 nt, Homo sapiens
agacagaugacauugauga

SEQ ID NO: 862884 - RNA, 19 nt, Homo sapiens
gaaaguugcagucgacucu

SEQ ID NO: 862885 - RNA, 19 nt, Homo sapiens
ggaaaccacagagaaaguu

SEQ ID NO: 862886 - RNA, 19 nt, Homo sapiens
accaaugccuuacuucaaa

SEQ ID NO: 862887 - RNA, 19 nt, Homo sapiens
gcuaguaagucucugaaaa

SEQ ID NO: 862888 - RNA, 19 nt, Homo sapiens
aaccuuagaugcagaaaca

SEQ ID NO: 862889 - RNA, 19 nt, Homo sapiens
gucauuucaucaacaagua

SEQ ID NO: 862890 - RNA, 19 nt, Homo sapiens
gcucuugaauaguggaguu

SEQ ID NO: 862891 - RNA, 19 nt, Homo sapiens
cggaagagugcuacagaua

SEQ ID NO: 862892 - RNA, 19 nt, Homo sapiens
agacagagaagaucacaga

SEQ ID NO: 862893 - RNA, 19 nt, Homo sapiens
ucaaagaagagucaucaga

SEQ ID NO: 862894 - RNA, 19 nt, Homo sapiens
uauaugagccuuuguuugg

SEQ ID NO: 862895 - RNA, 19 nt, Homo sapiens
caaacagguugagcaaugu

SEQ ID NO: 862896 - RNA, 19 nt, Homo sapiens
cauugugucuugagguaaa

SEQ ID NO: 862897 - RNA, 19 nt, Homo sapiens
gaucucuacccuaacagua

SEQ ID NO: 862898 - RNA, 19 nt, Homo sapiens
caaaugaagaucaauguac

SEQ ID NO: 862899 - RNA, 19 nt, Homo sapiens
caagaggucgcuaggauuc

SEQ ID NO: 862900 - RNA, 19 nt, Homo sapiens
uaaggagacagaugacauu

SEQ ID NO: 862901 - RNA, 19 nt, Homo sapiens
gaauaguggaguuucaaug

SEQ ID NO: 862902 - RNA, 19 nt, Homo sapiens
gaagagugcuacagauacc

SEQ ID NO: 862903 - RNA, 19 nt, Homo sapiens
ugccuuacuucaaagauuu

SEQ ID NO: 862904 - RNA, 19 nt, Homo sapiens
caaccauuauuucucuuca

SEQ ID NO: 862905 - RNA, 19 nt, Homo sapiens
ccugaaaggucaauuuggu

SEQ ID NO: 862906 - RNA, 19 nt, Homo sapiens
uugagaagcagauguaauu

SEQ ID NO: 862907 - RNA, 19 nt, Homo sapiens
aaguagaacugcuaagauc

SEQ ID NO: 862908 - RNA, 19 nt, Homo sapiens
gugcaguccuuuacagcaa

SEQ ID NO: 862909 - RNA, 19 nt, Homo sapiens
gaagcucaagguacuaguu

SEQ ID NO: 862910 - RNA, 19 nt, Homo sapiens
cuaaagacaaccaaguauu

SEQ ID NO: 862911 - RNA, 19 nt, Homo sapiens
cagcuguaauuaaagaaug

SEQ ID NO: 862912 - RNA, 19 nt, Homo sapiens
gcaaggaaacaccugaaag

SEQ ID NO: 862913 - RNA, 19 nt, Homo sapiens
ggaagagugcuacagauac

SEQ ID NO: 862914 - RNA, 19 nt, Homo sapiens
gaaaccacagagaaaguug

SEQ ID NO: 862915 - RNA, 19 nt, Homo sapiens
caaagcaucaucugagaca

SEQ ID NO: 862916 - RNA, 19 nt, Homo sapiens
ccagauggcaguuguaugg

SEQ ID NO: 862917 - RNA, 19 nt, Homo sapiens
gagugaggcuaguaagucu

SEQ ID NO: 862918 - RNA, 19 nt, Homo sapiens
cuacagauaccagugcuaa

SEQ ID NO: 862919 - RNA, 19 nt, Homo sapiens
gaaagcugcugccaagaaa

SEQ ID NO: 862920 - RNA, 19 nt, Homo sapiens
aagaacagcuugacaggaa

SEQ ID NO: 862921 - RNA, 19 nt, Homo sapiens
ggaaagcugcugccaagaa

SEQ ID NO: 862922 - RNA, 19 nt, Homo sapiens
gaaauaaagaacagcuuga

SEQ ID NO: 862923 - RNA, 19 nt, Homo sapiens
caacaagggccacaaagug

SEQ ID NO: 862924 - RNA, 19 nt, Homo sapiens
gcccucaaauuuaucaaga

SEQ ID NO: 862925 - RNA, 19 nt, Homo sapiens
gccacaaagugaccaagaa

SEQ ID NO: 862926 - RNA, 19 nt, Homo sapiens
gaaggucuccaaggacaaa

SEQ ID NO: 862927 - RNA, 19 nt, Homo sapiens
gggaggagcugagcaacgu

SEQ ID NO: 862928 - RNA, 19 nt, Homo sapiens
ugaccaaacacaccaaguu

SEQ ID NO: 862929 - RNA, 19 nt, Homo sapiens
gcccuacgcuacccuaugg

SEQ ID NO: 862930 - RNA, 19 nt, Homo sapiens
gaccaaacacaccaaguuc

SEQ ID NO: 862931 - RNA, 19 nt, Homo sapiens
uacugaaggucuccaagga

SEQ ID NO: 862932 - RNA, 19 nt, Homo sapiens
aacaagggccacaaaguga

SEQ ID NO: 862933 - RNA, 19 nt, Homo sapiens
agaacagcuugacaggaaa

SEQ ID NO: 862934 - RNA, 19 nt, Homo sapiens
ccauggaguuacugaaggu

SEQ ID NO: 862935 - RNA, 19 nt, Homo sapiens
ucaacaagggccacaaagu

SEQ ID NO: 862936 - RNA, 19 nt, Homo sapiens
ugaccaagaacgugagcaa

SEQ ID NO: 862937 - RNA, 19 nt, Homo sapiens
ccucaacaagggccacaaa

SEQ ID NO: 862938 - RNA, 19 nt, Homo sapiens
ggaggagcugagcaacgua

SEQ ID NO: 862939 - RNA, 19 nt, Homo sapiens
ggccacaaagugaccaaga

SEQ ID NO: 862940 - RNA, 19 nt, Homo sapiens
gaacagcuugacaggaaaa

SEQ ID NO: 862941 - RNA, 19 nt, Homo sapiens
aagcugcugccaagaaaga

SEQ ID NO: 862942 - RNA, 19 nt, Homo sapiens
ccaaacacaccaaguucgu

SEQ ID NO: 862943 - RNA, 19 nt, Homo sapiens
ccacaaagugaccaagaac

SEQ ID NO: 862944 - RNA, 19 nt, Homo sapiens
gaaagcugcugccaagaaa

SEQ ID NO: 862945 - RNA, 19 nt, Homo sapiens
aagaacagcuugacaggaa

SEQ ID NO: 862946 - RNA, 19 nt, Homo sapiens
ggaaagcugcugccaagaa

SEQ ID NO: 862947 - RNA, 19 nt, Homo sapiens
gaaauaaagaacagcuuga

SEQ ID NO: 862948 - RNA, 19 nt, Homo sapiens
caacaagggccacaaagug

SEQ ID NO: 862949 - RNA, 19 nt, Homo sapiens
gcccucaaauuuaucaaga

SEQ ID NO: 862950 - RNA, 19 nt, Homo sapiens
gccacaaagugaccaagaa

SEQ ID NO: 862951 - RNA, 19 nt, Homo sapiens
gaaggucuccaaggacaaa

SEQ ID NO: 862952 - RNA, 19 nt, Homo sapiens
gggaggagcugagcaacgu

SEQ ID NO: 862953 - RNA, 19 nt, Homo sapiens
gcccuacgcuacccuaugg

SEQ ID NO: 862954 - RNA, 19 nt, Homo sapiens
ugaccaaacacaccaaguu

SEQ ID NO: 862955 - RNA, 19 nt, Homo sapiens
gaccaaacacaccaaguuc

SEQ ID NO: 862956 - RNA, 19 nt, Homo sapiens
uacugaaggucuccaagga

SEQ ID NO: 862957 - RNA, 19 nt, Homo sapiens
aacaagggccacaaaguga

SEQ ID NO: 862958 - RNA, 19 nt, Homo sapiens
agaacagcuugacaggaaa

SEQ ID NO: 862959 - RNA, 19 nt, Homo sapiens
ccauggaguuacugaaggu

SEQ ID NO: 862960 - RNA, 19 nt, Homo sapiens
ucaacaagggccacaaagu

SEQ ID NO: 862961 - RNA, 19 nt, Homo sapiens
ugaccaagaacgugagcaa

SEQ ID NO: 862962 - RNA, 19 nt, Homo sapiens
ccucaacaagggccacaaa

SEQ ID NO: 862963 - RNA, 19 nt, Homo sapiens
ggaggagcugagcaacgua

SEQ ID NO: 862964 - RNA, 19 nt, Homo sapiens
ggccacaaagugaccaaga

SEQ ID NO: 862965 - RNA, 19 nt, Homo sapiens
gaacagcuugacaggaaaa

SEQ ID NO: 862966 - RNA, 19 nt, Homo sapiens
ccaaacacaccaaguucgu

SEQ ID NO: 862967 - RNA, 19 nt, Homo sapiens
aagcugcugccaagaaaga

SEQ ID NO: 862968 - RNA, 19 nt, Homo sapiens
ccacaaagugaccaagaac

SEQ ID NO: 862969 - RNA, 19 nt, Homo sapiens
ggaccuaguuuauuauuug

SEQ ID NO: 862970 - RNA, 19 nt, Homo sapiens
gcaggagccucucagcuuu

SEQ ID NO: 862971 - RNA, 19 nt, Homo sapiens
aaagcuaacuguguguuua

SEQ ID NO: 862972 - RNA, 19 nt, Homo sapiens
auugggaccuaguuuauua

SEQ ID NO: 862973 - RNA, 19 nt, Homo sapiens
gcaggucccagaacaguuu

SEQ ID NO: 862974 - RNA, 19 nt, Homo sapiens
aaaccauacuugcucguaa

SEQ ID NO: 862975 - RNA, 19 nt, Homo sapiens
caaucuagauguggacaaa

SEQ ID NO: 862976 - RNA, 19 nt, Homo sapiens
gggcuccaauuaugaaaug

SEQ ID NO: 862977 - RNA, 19 nt, Homo sapiens
cuacaugacuuaaggaacu

SEQ ID NO: 862978 - RNA, 19 nt, Homo sapiens
ggagucuguuugcuguuaa

SEQ ID NO: 862979 - RNA, 19 nt, Homo sapiens
gggaccuaguuuauuauuu

SEQ ID NO: 862980 - RNA, 19 nt, Homo sapiens
gagauauaaccaagaacua

SEQ ID NO: 862981 - RNA, 19 nt, Homo sapiens
gcacacaaauaaaagaguu

SEQ ID NO: 862982 - RNA, 19 nt, Homo sapiens
gcuaaagcacacaaauaaa

SEQ ID NO: 862983 - RNA, 19 nt, Homo sapiens
gaaggcacuguaacuggua

SEQ ID NO: 862984 - RNA, 19 nt, Homo sapiens
aagcuaaagcacacaaaua

SEQ ID NO: 862985 - RNA, 19 nt, Homo sapiens
uggagucuguuugcuguua

SEQ ID NO: 862986 - RNA, 19 nt, Homo sapiens
caaagcuaacuguguguuu

SEQ ID NO: 862987 - RNA, 19 nt, Homo sapiens
uaauaacagucucucuaca

SEQ ID NO: 862988 - RNA, 19 nt, Homo sapiens
aaacuuagcacagcucaau

SEQ ID NO: 862989 - RNA, 19 nt, Homo sapiens
uaccauuuguccguaauaa

SEQ ID NO: 862990 - RNA, 19 nt, Homo sapiens
ggagauauaaccaagaacu

SEQ ID NO: 862991 - RNA, 19 nt, Homo sapiens
uuugauggcuacaggguuu

SEQ ID NO: 862992 - RNA, 19 nt, Homo sapiens
uaacagucucucuacauga

SEQ ID NO: 862993 - RNA, 19 nt, Homo sapiens
auaacagucucucuacaug

SEQ ID NO: 862994 - RNA, 19 nt, Homo sapiens
ucuguuugcuguuaauuuc

SEQ ID NO: 862995 - RNA, 19 nt, Homo sapiens
aaccauacuugcucguaaa

SEQ ID NO: 862996 - RNA, 19 nt, Homo sapiens
ggguuuauuuggucaagau

SEQ ID NO: 862997 - RNA, 19 nt, Homo sapiens
gcuacaggguuuauuuggu

SEQ ID NO: 862998 - RNA, 19 nt, Homo sapiens
guuggugugugcuggauug

SEQ ID NO: 862999 - RNA, 19 nt, Homo sapiens
agcuaaagcacacaaauaa

SEQ ID NO: 863000 - RNA, 19 nt, Homo sapiens
gugcuggauuggcugauau

SEQ ID NO: 863001 - RNA, 19 nt, Homo sapiens
guaauaaaccauacuugcu

SEQ ID NO: 863002 - RNA, 19 nt, Homo sapiens
cugaucaccugaacaaucu

SEQ ID NO: 863003 - RNA, 19 nt, Homo sapiens
ccugaacaaucuagaugug

SEQ ID NO: 863004 - RNA, 19 nt, Homo sapiens
agaaauugaggccguugua

SEQ ID NO: 863005 - RNA, 19 nt, Homo sapiens
gcaaagcuaacuguguguu

SEQ ID NO: 863006 - RNA, 19 nt, Homo sapiens
ccauugggaccuaguuuau

SEQ ID NO: 863007 - RNA, 19 nt, Homo sapiens
uaaaccauacuugcucgua

SEQ ID NO: 863008 - RNA, 19 nt, Homo sapiens
gaccuaguuuauuauuugg

SEQ ID NO: 863009 - RNA, 19 nt, Homo sapiens
gaugcugcccgagaaauug

SEQ ID NO: 863010 - RNA, 19 nt, Homo sapiens
gcacuguaacugguagcua

SEQ ID NO: 863011 - RNA, 19 nt, Homo sapiens
gauaaagcaaagcuaacug

SEQ ID NO: 863012 - RNA, 19 nt, Homo sapiens
gaaauugaggccguuguac

SEQ ID NO: 863013 - RNA, 19 nt, Homo sapiens
aaagcaaagcuaacugugu

SEQ ID NO: 863014 - RNA, 19 nt, Homo sapiens
ucgauaaaguggagcugau

SEQ ID NO: 863015 - RNA, 19 nt, Homo sapiens
ccauuuguccguaauaaac

SEQ ID NO: 863016 - RNA, 19 nt, Homo sapiens
gagucuguuugcuguuaau

SEQ ID NO: 863017 - RNA, 19 nt, Homo sapiens
ugugcuggauuggcugaua

SEQ ID NO: 863018 - RNA, 19 nt, Homo sapiens
accaccggcuccucgauaa

SEQ ID NO: 863019 - RNA, 19 nt, Homo sapiens
ccugaucaccugaacaauc

SEQ ID NO: 863020 - RNA, 19 nt, Homo sapiens
guguuuagaaggcacugua

SEQ ID NO: 863021 - RNA, 19 nt, Homo sapiens
ugaugcugcccgagaaauu

SEQ ID NO: 863022 - RNA, 19 nt, Homo sapiens
caccugaacaaucuagaug

SEQ ID NO: 863023 - RNA, 19 nt, Homo sapiens
uaccaccggcuccucgaua

SEQ ID NO: 863024 - RNA, 19 nt, Homo sapiens
aaauugaggccguuguaca

SEQ ID NO: 863025 - RNA, 19 nt, Homo sapiens
gaucaccugaacaaucuag

SEQ ID NO: 863026 - RNA, 19 nt, Homo sapiens
aaagcuaaagcacacaaau

SEQ ID NO: 863027 - RNA, 19 nt, Homo sapiens
accaagaacuaaaagcuaa

SEQ ID NO: 863028 - RNA, 19 nt, Homo sapiens
aauaacagucucucuacau

SEQ ID NO: 863029 - RNA, 19 nt, Homo sapiens
uuaauaacagucucucuac

SEQ ID NO: 863030 - RNA, 19 nt, Homo sapiens
uaaaagaguuccugaucac

SEQ ID NO: 863031 - RNA, 19 nt, Homo sapiens
ggagaggucugcauaguua

SEQ ID NO: 863032 - RNA, 19 nt, Homo sapiens
gaagauaggugucgaacuu

SEQ ID NO: 863033 - RNA, 19 nt, Homo sapiens
gagaauggcugcagauuuc

SEQ ID NO: 863034 - RNA, 19 nt, Homo sapiens
gaacuuggcugggagaaug

SEQ ID NO: 863035 - RNA, 19 nt, Homo sapiens
gaaacaaacccucuugcua

SEQ ID NO: 863036 - RNA, 19 nt, Homo sapiens
gaaaggauugcagauguua

SEQ ID NO: 863037 - RNA, 19 nt, Homo sapiens
gacuuagaguucuguaaua

SEQ ID NO: 863038 - RNA, 19 nt, Homo sapiens
caugauaucuuggcucuga

SEQ ID NO: 863039 - RNA, 19 nt, Homo sapiens
guuaugggcugaugccaaa

SEQ ID NO: 863040 - RNA, 19 nt, Homo sapiens
ggagaauggcugcagauuu

SEQ ID NO: 863041 - RNA, 19 nt, Homo sapiens
gcauuguccugcagucgua

SEQ ID NO: 863042 - RNA, 19 nt, Homo sapiens
ggucaucccucucauuucu

SEQ ID NO: 863043 - RNA, 19 nt, Homo sapiens
ccaacuaccuggucuucuu

SEQ ID NO: 863044 - RNA, 19 nt, Homo sapiens
ggaagcacaauauaaaguu

SEQ ID NO: 863045 - RNA, 19 nt, Homo sapiens
ugaaccaacuccaggcuuu

SEQ ID NO: 863046 - RNA, 19 nt, Homo sapiens
guacacaaucuucaugaaa

SEQ ID NO: 863047 - RNA, 19 nt, Homo sapiens
cugauccacuuccauguua

SEQ ID NO: 863048 - RNA, 19 nt, Homo sapiens
ggacaaggcgcugaaugaa

SEQ ID NO: 863049 - RNA, 19 nt, Homo sapiens
ggccugaauucuacgcaua

SEQ ID NO: 863050 - RNA, 19 nt, Homo sapiens
gccaagacgucaccaagug

SEQ ID NO: 863051 - RNA, 19 nt, Homo sapiens
cuugaugucuuauguggua

SEQ ID NO: 863052 - RNA, 19 nt, Homo sapiens
ugaaaccuguugauggaaa

SEQ ID NO: 863053 - RNA, 19 nt, Homo sapiens
ccaugcuucucacaucuua

SEQ ID NO: 863054 - RNA, 19 nt, Homo sapiens
ggagauggagcauuugaga

SEQ ID NO: 863055 - RNA, 19 nt, Homo sapiens
gacaguggcugccuucucu

SEQ ID NO: 863056 - RNA, 19 nt, Homo sapiens
ugaaaggauugcagauguu

SEQ ID NO: 863057 - RNA, 19 nt, Homo sapiens
gaaaagauaacaggaagua

SEQ ID NO: 863058 - RNA, 19 nt, Homo sapiens
gggacaaggcgcugaauga

SEQ ID NO: 863059 - RNA, 19 nt, Homo sapiens
uaccuggucuucuugcuaa

SEQ ID NO: 863060 - RNA, 19 nt, Homo sapiens
ugugggaacugcagacauu

SEQ ID NO: 863061 - RNA, 19 nt, Homo sapiens
caaagucuguguguacugu

SEQ ID NO: 863062 - RNA, 19 nt, Homo sapiens
guccugcagucguauagua

SEQ ID NO: 863063 - RNA, 19 nt, Homo sapiens
agcaauacaugauaucuug

SEQ ID NO: 863064 - RNA, 19 nt, Homo sapiens
cugcauaguuaguaaguug

SEQ ID NO: 863065 - RNA, 19 nt, Homo sapiens
caaacccucugaacaccuu

SEQ ID NO: 863066 - RNA, 19 nt, Homo sapiens
ggaauccuuauuuggcuua

SEQ ID NO: 863067 - RNA, 19 nt, Homo sapiens
gaagcagucccacccagaa

SEQ ID NO: 863068 - RNA, 19 nt, Homo sapiens
ggcaugggcuaaccacuuc

SEQ ID NO: 863069 - RNA, 19 nt, Homo sapiens
gcuuaggacugauccacuu

SEQ ID NO: 863070 - RNA, 19 nt, Homo sapiens
gcuagaagaauaaagacaa

SEQ ID NO: 863071 - RNA, 19 nt, Homo sapiens
caaaggcagaugugaagaa

SEQ ID NO: 863072 - RNA, 19 nt, Homo sapiens
ucucacagcuagaacugaa

SEQ ID NO: 863073 - RNA, 19 nt, Homo sapiens
cuugaaaccuguugaugga

SEQ ID NO: 863074 - RNA, 19 nt, Homo sapiens
ccauggaucacaccuguaa

SEQ ID NO: 863075 - RNA, 19 nt, Homo sapiens
aggcagaugugaagaacuu

SEQ ID NO: 863076 - RNA, 19 nt, Homo sapiens
guugagacaucguuugaag

SEQ ID NO: 863077 - RNA, 19 nt, Homo sapiens
agacaaauauguggaagca

SEQ ID NO: 863078 - RNA, 19 nt, Homo sapiens
uggguaacuugcaggaaua

SEQ ID NO: 863079 - RNA, 19 nt, Homo sapiens
gcauauuggugaagauagg

SEQ ID NO: 863080 - RNA, 19 nt, Homo sapiens
uaaguuggguuuagcuuuu

SEQ ID NO: 863081 - RNA, 19 nt, Homo sapiens
guaaguuggguuuagcuuu

SEQ ID NO: 863082 - RNA, 19 nt, Homo sapiens
gcagucccacccagaaauu

SEQ ID NO: 863083 - RNA, 19 nt, Homo sapiens
guaacuugcaggaauauuc

SEQ ID NO: 863084 - RNA, 19 nt, Homo sapiens
agaacuugaugucuuaugu

SEQ ID NO: 863085 - RNA, 19 nt, Homo sapiens
guguuucccuccauccuuu

SEQ ID NO: 863086 - RNA, 19 nt, Homo sapiens
ccacuuccauguuacuuac

SEQ ID NO: 863087 - RNA, 19 nt, Homo sapiens
gaacuugaugucuuaugug

SEQ ID NO: 863088 - RNA, 19 nt, Homo sapiens
guauagcagugcaggaaca

SEQ ID NO: 863089 - RNA, 19 nt, Homo sapiens
gaaguaaaaucggcuuguu

SEQ ID NO: 863090 - RNA, 19 nt, Homo sapiens
caggugggaauccuuauuu

SEQ ID NO: 863091 - RNA, 19 nt, Homo sapiens
gugcaucagugacuuagag

SEQ ID NO: 863092 - RNA, 19 nt, Homo sapiens
guuaguaaguuggguuuag

SEQ ID NO: 863093 - RNA, 19 nt, Homo sapiens
uuauuuggcuuaggacuga

SEQ ID NO: 863094 - RNA, 19 nt, Homo sapiens
cagcuagaacugaaacaaa

SEQ ID NO: 863095 - RNA, 19 nt, Homo sapiens
gccaugggcuucacagcau

SEQ ID NO: 863096 - RNA, 19 nt, Homo sapiens
aaguaaagacugcuugaaa

SEQ ID NO: 863097 - RNA, 19 nt, Homo sapiens
uacacaaucuucaugaaag

SEQ ID NO: 863098 - RNA, 19 nt, Homo sapiens
ugacuuagaguucuguaau

SEQ ID NO: 863099 - RNA, 19 nt, Homo sapiens
gaaaacagcacuccuuugg

SEQ ID NO: 863100 - RNA, 19 nt, Homo sapiens
gaaaaggucaucccucuca

SEQ ID NO: 863101 - RNA, 19 nt, Homo sapiens
caacuacugaucaggcauu

SEQ ID NO: 863102 - RNA, 19 nt, Homo sapiens
aaagauaacaggaaguaca

SEQ ID NO: 863103 - RNA, 19 nt, Homo sapiens
ccagcaaagucugugugua

SEQ ID NO: 863104 - RNA, 19 nt, Homo sapiens
gggccaugcuucucacauc

SEQ ID NO: 863105 - RNA, 19 nt, Homo sapiens
caggagaggucugcauagu

SEQ ID NO: 863106 - RNA, 19 nt, Homo sapiens
gcagaugugaagaacuuga

SEQ ID NO: 863107 - RNA, 19 nt, Homo sapiens
gauaacaggaaguacaagu

SEQ ID NO: 863108 - RNA, 19 nt, Homo sapiens
uuauuuccauuccaccuuu

SEQ ID NO: 863109 - RNA, 19 nt, Homo sapiens
accgggagauggagcauuu

SEQ ID NO: 863110 - RNA, 19 nt, Homo sapiens
caucagugacuuagaguuc

SEQ ID NO: 863111 - RNA, 19 nt, Homo sapiens
ggguuuagcuuuugugugu

SEQ ID NO: 863112 - RNA, 19 nt, Homo sapiens
aagucuguguguacuguua

SEQ ID NO: 863113 - RNA, 19 nt, Homo sapiens
cagcaaagucuguguguac

SEQ ID NO: 863114 - RNA, 19 nt, Homo sapiens
cuacgcauauuggugaaga

SEQ ID NO: 863115 - RNA, 19 nt, Homo sapiens
ugacugcucaggaaguaaa

SEQ ID NO: 863116 - RNA, 19 nt, Homo sapiens
ugaagacucauacaacugu

SEQ ID NO: 863117 - RNA, 19 nt, Homo sapiens
caacaaacugauuucuuag

SEQ ID NO: 863118 - RNA, 19 nt, Homo sapiens
caacuaccuggucuucuug

SEQ ID NO: 863119 - RNA, 19 nt, Homo sapiens
gacaucguuugaagacuca

SEQ ID NO: 863120 - RNA, 19 nt, Homo sapiens
augaaaggauugcagaugu

SEQ ID NO: 863121 - RNA, 19 nt, Homo sapiens
gaaccaacuccaggcuuug

SEQ ID NO: 863122 - RNA, 19 nt, Homo sapiens
aguaaagacugcuugaaac

SEQ ID NO: 863123 - RNA, 19 nt, Homo sapiens
ccuccauccuuucugauau

SEQ ID NO: 863124 - RNA, 19 nt, Homo sapiens
gcauguacuuggguguuuc

SEQ ID NO: 863125 - RNA, 19 nt, Homo sapiens
ucaucccucucauuucuga

SEQ ID NO: 863126 - RNA, 19 nt, Homo sapiens
aaggucaucccucucauuu

SEQ ID NO: 863127 - RNA, 19 nt, Homo sapiens
ugagacaguuccgccaaga

SEQ ID NO: 863128 - RNA, 19 nt, Homo sapiens
guguucaguucauguccua

SEQ ID NO: 863129 - RNA, 19 nt, Homo sapiens
uuucuugggucgucauuuc

SEQ ID NO: 863130 - RNA, 19 nt, Homo sapiens
gaaaccuguugauggaaaa

SEQ ID NO: 863131 - RNA, 19 nt, Homo sapiens
gcggaagguuugaagguua

SEQ ID NO: 863132 - RNA, 19 nt, Homo sapiens
ugguggagaugcacaauua

SEQ ID NO: 863133 - RNA, 19 nt, Homo sapiens
guacugaggcggaagguuu

SEQ ID NO: 863134 - RNA, 19 nt, Homo sapiens
uaaagucaguguuguguuc

SEQ ID NO: 863135 - RNA, 19 nt, Homo sapiens
uugcagaggucaucaaguu

SEQ ID NO: 863136 - RNA, 19 nt, Homo sapiens
ccaacucucuccagcagaa

SEQ ID NO: 863137 - RNA, 19 nt, Homo sapiens
gagcuuuccuucuguccuu

SEQ ID NO: 863138 - RNA, 19 nt, Homo sapiens
ggucagcucagguaaagaa

SEQ ID NO: 863139 - RNA, 19 nt, Homo sapiens
gaacaggaagguacugaag

SEQ ID NO: 863140 - RNA, 19 nt, Homo sapiens
gguuggagcuuuccuucug

SEQ ID NO: 863141 - RNA, 19 nt, Homo sapiens
ggauggcaguggcuacaug

SEQ ID NO: 863142 - RNA, 19 nt, Homo sapiens
guaaagaagcugggaguuc

SEQ ID NO: 863143 - RNA, 19 nt, Homo sapiens
ccagaaggcccgaggugaa

SEQ ID NO: 863144 - RNA, 19 nt, Homo sapiens
ugaagaggcugaacuuuuc

SEQ ID NO: 863145 - RNA, 19 nt, Homo sapiens
guagacaacaucccucugu

SEQ ID NO: 863146 - RNA, 19 nt, Homo sapiens
gcaggcagaggcaguuaug

SEQ ID NO: 863147 - RNA, 19 nt, Homo sapiens
ggcggaagguuugaagguu

SEQ ID NO: 863148 - RNA, 19 nt, Homo sapiens
ccaagaugguggagaugca

SEQ ID NO: 863149 - RNA, 19 nt, Homo sapiens
acaggaagguacugaagag

SEQ ID NO: 863150 - RNA, 19 nt, Homo sapiens
cagaggucaucaaguuuua

SEQ ID NO: 863151 - RNA, 19 nt, Homo sapiens
gcagaggucaucaaguuuu

SEQ ID NO: 863152 - RNA, 19 nt, Homo sapiens
ucaagaaugugcggaucga

SEQ ID NO: 863153 - RNA, 19 nt, Homo sapiens
ggagaugcacaauuauguc

SEQ ID NO: 863154 - RNA, 19 nt, Homo sapiens
ccauuaaagucaguguugu

SEQ ID NO: 863155 - RNA, 19 nt, Homo sapiens
gaugggacaggaacucuag

SEQ ID NO: 863156 - RNA, 19 nt, Homo sapiens
ucucagguguaucccagaa

SEQ ID NO: 863157 - RNA, 19 nt, Homo sapiens
aaaccucucccgggacuuu

SEQ ID NO: 863158 - RNA, 19 nt, Homo sapiens
gagauccgggucaggagaa

SEQ ID NO: 863159 - RNA, 19 nt, Homo sapiens
gguccaagccuccgcuaag

SEQ ID NO: 863160 - RNA, 19 nt, Homo sapiens
agucaguguuguguucuaa

SEQ ID NO: 863161 - RNA, 19 nt, Homo sapiens
gagaaaggaagcgccugaa

SEQ ID NO: 863162 - RNA, 19 nt, Homo sapiens
cgugggaucgccaggagua

SEQ ID NO: 863163 - RNA, 19 nt, Homo sapiens
ggaguagggaggacaucga

SEQ ID NO: 863164 - RNA, 19 nt, Homo sapiens
agaaugugcggaucgaaga

SEQ ID NO: 863165 - RNA, 19 nt, Homo sapiens
guggagaugcacaauuaug

SEQ ID NO: 863166 - RNA, 19 nt, Homo sapiens
caggagaauggaccgcuuu

SEQ ID NO: 863167 - RNA, 19 nt, Homo sapiens
ggggucaucugaacaggaa

SEQ ID NO: 863168 - RNA, 19 nt, Homo sapiens
guacugaagaggcugaacu

SEQ ID NO: 863169 - RNA, 19 nt, Homo sapiens
caacuggggucaucugaac

SEQ ID NO: 863170 - RNA, 19 nt, Homo sapiens
cagcagaagcucagcaacu

SEQ ID NO: 863171 - RNA, 19 nt, Homo sapiens
ggaggagaugggacaggaa

SEQ ID NO: 863172 - RNA, 19 nt, Homo sapiens
gggaagcaggagaaugaga

SEQ ID NO: 863173 - RNA, 19 nt, Homo sapiens
guuggagcuuuccuucugu

SEQ ID NO: 863174 - RNA, 19 nt, Homo sapiens
ucaguguuguguucuaaaa

SEQ ID NO: 863175 - RNA, 19 nt, Homo sapiens
cccauuaaagucaguguug

SEQ ID NO: 863176 - RNA, 19 nt, Homo sapiens
ugccuugucucagguguau

SEQ ID NO: 863177 - RNA, 19 nt, Homo sapiens
gaugacgugaugcgcaaga

SEQ ID NO: 863178 - RNA, 19 nt, Homo sapiens
agcagaagcucagcaacug

SEQ ID NO: 863179 - RNA, 19 nt, Homo sapiens
cggaagguuugaagguuac

SEQ ID NO: 863180 - RNA, 19 nt, Homo sapiens
gguaaagaagcugggaguu

SEQ ID NO: 863181 - RNA, 19 nt, Homo sapiens
cacagucauuccuccacuu

SEQ ID NO: 863182 - RNA, 19 nt, Homo sapiens
uggagaugcacaauuaugu

SEQ ID NO: 863183 - RNA, 19 nt, Homo sapiens
caagacaccuuacugauua

SEQ ID NO: 863184 - RNA, 19 nt, Homo sapiens
gaaauaagguuggugauga

SEQ ID NO: 863185 - RNA, 19 nt, Homo sapiens
ggagauaacuuccacugaa

SEQ ID NO: 863186 - RNA, 19 nt, Homo sapiens
cagcagacauggaaauaua

SEQ ID NO: 863187 - RNA, 19 nt, Homo sapiens
ggacaaagaugccggagau

SEQ ID NO: 863188 - RNA, 19 nt, Homo sapiens
ggaaauugauagcauacua

SEQ ID NO: 863189 - RNA, 19 nt, Homo sapiens
ccaaacagaaggauaauua

SEQ ID NO: 863190 - RNA, 19 nt, Homo sapiens
ggagaaaacugcaucauaa

SEQ ID NO: 863191 - RNA, 19 nt, Homo sapiens
gaauaggagcucuuaaaua

SEQ ID NO: 863192 - RNA, 19 nt, Homo sapiens
ccacaauucucaugucuuu

SEQ ID NO: 863193 - RNA, 19 nt, Homo sapiens
caaagaaguuguacaaaca

SEQ ID NO: 863194 - RNA, 19 nt, Homo sapiens
cuacaaagcuggaauugga

SEQ ID NO: 863195 - RNA, 19 nt, Homo sapiens
ggauuucacuuccgaguuu

SEQ ID NO: 863196 - RNA, 19 nt, Homo sapiens
gaggaauucugaaguguaa

SEQ ID NO: 863197 - RNA, 19 nt, Homo sapiens
caaacaagcaguaucauaa

SEQ ID NO: 863198 - RNA, 19 nt, Homo sapiens
gaacgguaccuuagugaua

SEQ ID NO: 863199 - RNA, 19 nt, Homo sapiens
uuaaagagcuugaggaugu

SEQ ID NO: 863200 - RNA, 19 nt, Homo sapiens
gcagcaaccucaaauccua

SEQ ID NO: 863201 - RNA, 19 nt, Homo sapiens
ggaagaauccucuccugua

SEQ ID NO: 863202 - RNA, 19 nt, Homo sapiens
ggauaaacauggcaaacaa

SEQ ID NO: 863203 - RNA, 19 nt, Homo sapiens
guuuacaacuccaagauua

SEQ ID NO: 863204 - RNA, 19 nt, Homo sapiens
ugacauaaaugcaacaguu

SEQ ID NO: 863205 - RNA, 19 nt, Homo sapiens
cagagugacugauauauau

SEQ ID NO: 863206 - RNA, 19 nt, Homo sapiens
gaaccagagugacugauau

SEQ ID NO: 863207 - RNA, 19 nt, Homo sapiens
gaagacgcaucaccuaguu

SEQ ID NO: 863208 - RNA, 19 nt, Homo sapiens
gaagaauccucuccuguag

SEQ ID NO: 863209 - RNA, 19 nt, Homo sapiens
caagauggcacucuccuua

SEQ ID NO: 863210 - RNA, 19 nt, Homo sapiens
agucaccacuguuauauua

SEQ ID NO: 863211 - RNA, 19 nt, Homo sapiens
gcaaacaagcaguaucaua

SEQ ID NO: 863212 - RNA, 19 nt, Homo sapiens
ccgaagaacugaccaauuc

SEQ ID NO: 863213 - RNA, 19 nt, Homo sapiens
ggacaaaccaccaccacua

SEQ ID NO: 863214 - RNA, 19 nt, Homo sapiens
gaaaagcuauggaaauuga

SEQ ID NO: 863215 - RNA, 19 nt, Homo sapiens
gcaaugugcuucaguccaa

SEQ ID NO: 863216 - RNA, 19 nt, Homo sapiens
gcaaugagaucccaagcau

SEQ ID NO: 863217 - RNA, 19 nt, Homo sapiens
caagucaucuuucaguuau

SEQ ID NO: 863218 - RNA, 19 nt, Homo sapiens
gagacuagaaggagaaaua

SEQ ID NO: 863219 - RNA, 19 nt, Homo sapiens
ccacucgacugccuucaua

SEQ ID NO: 863220 - RNA, 19 nt, Homo sapiens
gaaucuagacgaaggauaa

SEQ ID NO: 863221 - RNA, 19 nt, Homo sapiens
gagcaucucuuugaauaug

SEQ ID NO: 863222 - RNA, 19 nt, Homo sapiens
guccaagaauuccucauua

SEQ ID NO: 863223 - RNA, 19 nt, Homo sapiens
gaagcuggguaaugauuga

SEQ ID NO: 863224 - RNA, 19 nt, Homo sapiens
ggcagaagcuggguaauga

SEQ ID NO: 863225 - RNA, 19 nt, Homo sapiens
gcaggaugcugaugaggaa

SEQ ID NO: 863226 - RNA, 19 nt, Homo sapiens
gaacaugguuagaacucuu

SEQ ID NO: 863227 - RNA, 19 nt, Homo sapiens
gaaauggaccgcaugguau

SEQ ID NO: 863228 - RNA, 19 nt, Homo sapiens
ccaagaaggugcuacuuuc

SEQ ID NO: 863229 - RNA, 19 nt, Homo sapiens
gaaacugauugacugcaaa

SEQ ID NO: 863230 - RNA, 19 nt, Homo sapiens
caacaucccugaggcaaga

SEQ ID NO: 863231 - RNA, 19 nt, Homo sapiens
guacaucacaguuauuuga

SEQ ID NO: 863232 - RNA, 19 nt, Homo sapiens
ggaaauaacuacauauccu

SEQ ID NO: 863233 - RNA, 19 nt, Homo sapiens
ugagaagacugaggagaua

SEQ ID NO: 863234 - RNA, 19 nt, Homo sapiens
gcgcugggcugauauuuua

SEQ ID NO: 863235 - RNA, 19 nt, Homo sapiens
caccuuagcuggauucuuc

SEQ ID NO: 863236 - RNA, 19 nt, Homo sapiens
aauaauacacgaccuguua

SEQ ID NO: 863237 - RNA, 19 nt, Homo sapiens
uaggagcucuuaaauaaug

SEQ ID NO: 863238 - RNA, 19 nt, Homo sapiens
cacgggaacuuguuuguuu

SEQ ID NO: 863239 - RNA, 19 nt, Homo sapiens
gaaacuagaccacagaauc

SEQ ID NO: 863240 - RNA, 19 nt, Homo sapiens
caaccacaauggaguuauu

SEQ ID NO: 863241 - RNA, 19 nt, Homo sapiens
uggagcaucucuuugaaua

SEQ ID NO: 863242 - RNA, 19 nt, Homo sapiens
gcacucuccuuauucagaa

SEQ ID NO: 863243 - RNA, 19 nt, Homo sapiens
acaacucucucaagcauaa

SEQ ID NO: 863244 - RNA, 19 nt, Homo sapiens
gaagaauccucagcagaug

SEQ ID NO: 863245 - RNA, 19 nt, Homo sapiens
ugaggaagcucuuuacuac

SEQ ID NO: 863246 - RNA, 19 nt, Homo sapiens
caacuuacauccacgucuu

SEQ ID NO: 863247 - RNA, 19 nt, Homo sapiens
ggaaacugauugacugcaa

SEQ ID NO: 863248 - RNA, 19 nt, Homo sapiens
caagaacgguaccuuagug

SEQ ID NO: 863249 - RNA, 19 nt, Homo sapiens
ccagauacuuuguaacuuc

SEQ ID NO: 863250 - RNA, 19 nt, Homo sapiens
gcaccugacauuaagauuu

SEQ ID NO: 863251 - RNA, 19 nt, Homo sapiens
caacauccaccuugugaaa

SEQ ID NO: 863252 - RNA, 19 nt, Homo sapiens
ugaaagcgcccauggauga

SEQ ID NO: 863253 - RNA, 19 nt, Homo sapiens
ccaaagaaguuguacaaac

SEQ ID NO: 863254 - RNA, 19 nt, Homo sapiens
acaacaagaucgaguuuau

SEQ ID NO: 863255 - RNA, 19 nt, Homo sapiens
aaacuucucugcaguaucu

SEQ ID NO: 863256 - RNA, 19 nt, Homo sapiens
gaacugaccaauucaaugg

SEQ ID NO: 863257 - RNA, 19 nt, Homo sapiens
cagcauuccuaguaaguuu

SEQ ID NO: 863258 - RNA, 19 nt, Homo sapiens
guauacauguugccaaaug

SEQ ID NO: 863259 - RNA, 19 nt, Homo sapiens
gcucuuaaauaauguguca

SEQ ID NO: 863260 - RNA, 19 nt, Homo sapiens
ggaauaggagcucuuaaau

SEQ ID NO: 863261 - RNA, 19 nt, Homo sapiens
gggaauaggagcucuuaaa

SEQ ID NO: 863262 - RNA, 19 nt, Homo sapiens
cuuaggaacugacaacaaa

SEQ ID NO: 863263 - RNA, 19 nt, Homo sapiens
ggaagacgguguggauuca

SEQ ID NO: 863264 - RNA, 19 nt, Homo sapiens
gaugaaaccggccaagauu

SEQ ID NO: 863265 - RNA, 19 nt, Homo sapiens
gugcguagcucgaaauaag

SEQ ID NO: 863266 - RNA, 19 nt, Homo sapiens
acaaagcgcuuccagauac

SEQ ID NO: 863267 - RNA, 19 nt, Homo sapiens
ggagacuucugcauccaaa

SEQ ID NO: 863268 - RNA, 19 nt, Homo sapiens
caagaaacccaguuggaaa

SEQ ID NO: 863269 - RNA, 19 nt, Homo sapiens
gcaagaaacccaguuggaa

SEQ ID NO: 863270 - RNA, 19 nt, Homo sapiens
acuccaagauuaucaagua

SEQ ID NO: 863271 - RNA, 19 nt, Homo sapiens
ccaaacaaacaucgauaua

SEQ ID NO: 863272 - RNA, 19 nt, Homo sapiens
ggaagaggccaaacaaaca

SEQ ID NO: 863273 - RNA, 19 nt, Homo sapiens
caaagacaccacaacagua

SEQ ID NO: 863274 - RNA, 19 nt, Homo sapiens
ccaaucacaucuacaagga

SEQ ID NO: 863275 - RNA, 19 nt, Homo sapiens
gaaagacacagugacaauu

SEQ ID NO: 863276 - RNA, 19 nt, Homo sapiens
caaacaauauccaccaaag

SEQ ID NO: 863277 - RNA, 19 nt, Homo sapiens
gcagagaacaugguuagaa

SEQ ID NO: 863278 - RNA, 19 nt, Homo sapiens
guugaaagcugugcucaga

SEQ ID NO: 863279 - RNA, 19 nt, Homo sapiens
caaaguggauguggugaug

SEQ ID NO: 863280 - RNA, 19 nt, Homo sapiens
caacaaaccggaaauaacu

SEQ ID NO: 863281 - RNA, 19 nt, Homo sapiens
aagaauaucucaagcaucu

SEQ ID NO: 863282 - RNA, 19 nt, Homo sapiens
gcagauguaccucuacuug

SEQ ID NO: 863283 - RNA, 19 nt, Homo sapiens
gccauuacaugcaauauua

SEQ ID NO: 863284 - RNA, 19 nt, Homo sapiens
gaacaaagaacuaauccua

SEQ ID NO: 863285 - RNA, 19 nt, Homo sapiens
gaagagccauuacaugcaa

SEQ ID NO: 863286 - RNA, 19 nt, Homo sapiens
aaacuaugauccugcuuua

SEQ ID NO: 863287 - RNA, 19 nt, Homo sapiens
gaucaucacuggaaagaag

SEQ ID NO: 863288 - RNA, 19 nt, Homo sapiens
uacaauagaugaccugauu

SEQ ID NO: 863289 - RNA, 19 nt, Homo sapiens
aaauagagcucugcuagaa

SEQ ID NO: 863290 - RNA, 19 nt, Homo sapiens
cagagaagcuggcuacugu

SEQ ID NO: 863291 - RNA, 19 nt, Homo sapiens
gagaguuggugaugacaaa

SEQ ID NO: 863292 - RNA, 19 nt, Homo sapiens
caaccgagaugaaggugaa

SEQ ID NO: 863293 - RNA, 19 nt, Homo sapiens
gaugugagcuuggccuuga

SEQ ID NO: 863294 - RNA, 19 nt, Homo sapiens
gaaaugaagcuguccugaa

SEQ ID NO: 863295 - RNA, 19 nt, Homo sapiens
ucauaagucugaauuguga

SEQ ID NO: 863296 - RNA, 19 nt, Homo sapiens
gacaguauaaguaguguua

SEQ ID NO: 863297 - RNA, 19 nt, Homo sapiens
gcucaaaucccaacauguu

SEQ ID NO: 863298 - RNA, 19 nt, Homo sapiens
gaaacuaugauccugcuuu

SEQ ID NO: 863299 - RNA, 19 nt, Homo sapiens
gaggagaggugugugcauu

SEQ ID NO: 863300 - RNA, 19 nt, Homo sapiens
ggauuugacaguauaagua

SEQ ID NO: 863301 - RNA, 19 nt, Homo sapiens
uuaaagacccaaccugaua

SEQ ID NO: 863302 - RNA, 19 nt, Homo sapiens
gaagcuggcuacuguccuu

SEQ ID NO: 863303 - RNA, 19 nt, Homo sapiens
ggagaggugugugcauuug

SEQ ID NO: 863304 - RNA, 19 nt, Homo sapiens
caaacuggaacgaguauuu

SEQ ID NO: 863305 - RNA, 19 nt, Homo sapiens
gaagagcaaccgagaugaa

SEQ ID NO: 863306 - RNA, 19 nt, Homo sapiens
agaauagguuggcaaacua

SEQ ID NO: 863307 - RNA, 19 nt, Homo sapiens
caaguguuaugcucuuaaa

SEQ ID NO: 863308 - RNA, 19 nt, Homo sapiens
gcucauaagucugaauugu

SEQ ID NO: 863309 - RNA, 19 nt, Homo sapiens
gaaagaaaaggcaaucaua

SEQ ID NO: 863310 - RNA, 19 nt, Homo sapiens
gggaagaguuggagauugg

SEQ ID NO: 863311 - RNA, 19 nt, Homo sapiens
aaaugaagcuguccugaag

SEQ ID NO: 863312 - RNA, 19 nt, Homo sapiens
gaaggagcauuggacauca

SEQ ID NO: 863313 - RNA, 19 nt, Homo sapiens
gauuguaaaugaguucuga

SEQ ID NO: 863314 - RNA, 19 nt, Homo sapiens
agagagaaguggcauggaa

SEQ ID NO: 863315 - RNA, 19 nt, Homo sapiens
ggacagcaaguagacauuu

SEQ ID NO: 863316 - RNA, 19 nt, Homo sapiens
guuuaggucugaauuuaga

SEQ ID NO: 863317 - RNA, 19 nt, Homo sapiens
gauacuagaguuaagcauu

SEQ ID NO: 863318 - RNA, 19 nt, Homo sapiens
gagugucugucucuauuau

SEQ ID NO: 863319 - RNA, 19 nt, Homo sapiens
uuacagagaguuccaagaa

SEQ ID NO: 863320 - RNA, 19 nt, Homo sapiens
aaagugcuauccaaauuca

SEQ ID NO: 863321 - RNA, 19 nt, Homo sapiens
uaaagacccaaccugauaa

SEQ ID NO: 863322 - RNA, 19 nt, Homo sapiens
gacagcaaguagacauuug

SEQ ID NO: 863323 - RNA, 19 nt, Homo sapiens
gagauuggccacuacaugu

SEQ ID NO: 863324 - RNA, 19 nt, Homo sapiens
ucaagauggugacgguauu

SEQ ID NO: 863325 - RNA, 19 nt, Homo sapiens
ggaauccggacaauuaugu

SEQ ID NO: 863326 - RNA, 19 nt, Homo sapiens
ggagugucugucucuauua

SEQ ID NO: 863327 - RNA, 19 nt, Homo sapiens
auacuagaguuaagcauug

SEQ ID NO: 863328 - RNA, 19 nt, Homo sapiens
aaugaguucugauaccuuu

SEQ ID NO: 863329 - RNA, 19 nt, Homo sapiens
cuacaggucuagaauaggu

SEQ ID NO: 863330 - RNA, 19 nt, Homo sapiens
gcaaguguuaugcucuuaa

SEQ ID NO: 863331 - RNA, 19 nt, Homo sapiens
gauggagaguuggugauga

SEQ ID NO: 863332 - RNA, 19 nt, Homo sapiens
caagauggugacgguauua

SEQ ID NO: 863333 - RNA, 19 nt, Homo sapiens
cuguuuaggucugaauuua

SEQ ID NO: 863334 - RNA, 19 nt, Homo sapiens
ggagauuggccacuacaug

SEQ ID NO: 863335 - RNA, 19 nt, Homo sapiens
gagagaaguggcauggaaa

SEQ ID NO: 863336 - RNA, 19 nt, Homo sapiens
cuuacucucuggcccuuua

SEQ ID NO: 863337 - RNA, 19 nt, Homo sapiens
guuaaguaauugccacaga

SEQ ID NO: 863338 - RNA, 19 nt, Homo sapiens
uagaauagguuggcaaacu

SEQ ID NO: 863339 - RNA, 19 nt, Homo sapiens
uggagugucugucucuauu

SEQ ID NO: 863340 - RNA, 19 nt, Homo sapiens
uggcagaguuaaguaauug

SEQ ID NO: 863341 - RNA, 19 nt, Homo sapiens
gugucugucucuauuauau

SEQ ID NO: 863342 - RNA, 19 nt, Homo sapiens
gcgcuacaggucuagaaua

SEQ ID NO: 863343 - RNA, 19 nt, Homo sapiens
caucuuccuuccuuauguu

SEQ ID NO: 863344 - RNA, 19 nt, Homo sapiens
ccacgagaauauauaagag

SEQ ID NO: 863345 - RNA, 19 nt, Homo sapiens
gagaccauauggcccacaa

SEQ ID NO: 863346 - RNA, 19 nt, Homo sapiens
gcuuggccuugaggaauua

SEQ ID NO: 863347 - RNA, 19 nt, Homo sapiens
gacccaaccugauaaaaga

SEQ ID NO: 863348 - RNA, 19 nt, Homo sapiens
cacuacaugucgucuguuu

SEQ ID NO: 863349 - RNA, 19 nt, Homo sapiens
uacagagaguuccaagaaa

SEQ ID NO: 863350 - RNA, 19 nt, Homo sapiens
gggaugaacaaagaacuaa

SEQ ID NO: 863351 - RNA, 19 nt, Homo sapiens
gaggaagagccauuacaug

SEQ ID NO: 863352 - RNA, 19 nt, Homo sapiens
uggcaaagcauccagagaa

SEQ ID NO: 863353 - RNA, 19 nt, Homo sapiens
aaagauaggaaguaagguu

SEQ ID NO: 863354 - RNA, 19 nt, Homo sapiens
aaaaggcaaucauagcaua

SEQ ID NO: 863355 - RNA, 19 nt, Homo sapiens
ugaacugcaugguaauuag

SEQ ID NO: 863356 - RNA, 19 nt, Homo sapiens
gcaguuuagucccagauac

SEQ ID NO: 863357 - RNA, 19 nt, Homo sapiens
guaaaugaguucugauacc

SEQ ID NO: 863358 - RNA, 19 nt, Homo sapiens
gaugaacaaagaacuaauc

SEQ ID NO: 863359 - RNA, 19 nt, Homo sapiens
agaagacucaguagggaua

SEQ ID NO: 863360 - RNA, 19 nt, Homo sapiens
aagcuguccugaaggcuaa

SEQ ID NO: 863361 - RNA, 19 nt, Homo sapiens
cuucauguuccauagauua

SEQ ID NO: 863362 - RNA, 19 nt, Homo sapiens
caugcaauauuaggaaaga

SEQ ID NO: 863363 - RNA, 19 nt, Homo sapiens
acagagaguuccaagaaac

SEQ ID NO: 863364 - RNA, 19 nt, Homo sapiens
gugcuaugauggcagaguu

SEQ ID NO: 863365 - RNA, 19 nt, Homo sapiens
ggcaaucauagcauauaua

SEQ ID NO: 863366 - RNA, 19 nt, Homo sapiens
gcaugguaauuaguuauag

SEQ ID NO: 863367 - RNA, 19 nt, Homo sapiens
acucaugccuucaacuuca

SEQ ID NO: 863368 - RNA, 19 nt, Homo sapiens
ggaagagccauuacaugca

SEQ ID NO: 863369 - RNA, 19 nt, Homo sapiens
gauccugcuuuacauccuu

SEQ ID NO: 863370 - RNA, 19 nt, Homo sapiens
uaaauagagcucugcuaga

SEQ ID NO: 863371 - RNA, 19 nt, Homo sapiens
gaacugcaugguaauuagu

SEQ ID NO: 863372 - RNA, 19 nt, Homo sapiens
cuagaguuaagcauuguua

SEQ ID NO: 863373 - RNA, 19 nt, Homo sapiens
ggcaaagcauccagagaag

SEQ ID NO: 863374 - RNA, 19 nt, Homo sapiens
gugauggagucaauugcuu

SEQ ID NO: 863375 - RNA, 19 nt, Homo sapiens
gagcaggaccaaguguaaa

SEQ ID NO: 863376 - RNA, 19 nt, Homo sapiens
gccacuacaugucgucugu

SEQ ID NO: 863377 - RNA, 19 nt, Homo sapiens
uuguugaacugcaugguaa

SEQ ID NO: 863378 - RNA, 19 nt, Homo sapiens
uccaguaaauauagucuug

SEQ ID NO: 863379 - RNA, 19 nt, Homo sapiens
auagagcucugcuagaagu

SEQ ID NO: 863380 - RNA, 19 nt, Homo sapiens
cuacaugucgucuguuuag

SEQ ID NO: 863381 - RNA, 19 nt, Homo sapiens
uaaaugaguucugauaccu

SEQ ID NO: 863382 - RNA, 19 nt, Homo sapiens
uaacccaauugagguaaug

SEQ ID NO: 863383 - RNA, 19 nt, Homo sapiens
guguagagcuuuauuguua

SEQ ID NO: 863384 - RNA, 19 nt, Homo sapiens
gaaaggaagugaaucguau

SEQ ID NO: 863385 - RNA, 19 nt, Homo sapiens
gaacaaagaacuaauccua

SEQ ID NO: 863386 - RNA, 19 nt, Homo sapiens
ggaagugaaucguauuaaa

SEQ ID NO: 863387 - RNA, 19 nt, Homo sapiens
gaagagccauuacauacaa

SEQ ID NO: 863388 - RNA, 19 nt, Homo sapiens
aaacuaugauccugcuuua

SEQ ID NO: 863389 - RNA, 19 nt, Homo sapiens
gaucaucacuggaaagaag

SEQ ID NO: 863390 - RNA, 19 nt, Homo sapiens
gagaauauguaagagcuuu

SEQ ID NO: 863391 - RNA, 19 nt, Homo sapiens
gcaagcuacuccuuugaaa

SEQ ID NO: 863392 - RNA, 19 nt, Homo sapiens
cagagaagcuggcuacugu

SEQ ID NO: 863393 - RNA, 19 nt, Homo sapiens
gaacagcgcaucaugaaag

SEQ ID NO: 863394 - RNA, 19 nt, Homo sapiens
ggagaaauuucagcauuau

SEQ ID NO: 863395 - RNA, 19 nt, Homo sapiens
caaagagaaugcaacaugu

SEQ ID NO: 863396 - RNA, 19 nt, Homo sapiens
gacaguauaaguaguguua

SEQ ID NO: 863397 - RNA, 19 nt, Homo sapiens
gcacuggacacuccuguaa

SEQ ID NO: 863398 - RNA, 19 nt, Homo sapiens
gagaacaaauacaaucugu

SEQ ID NO: 863399 - RNA, 19 nt, Homo sapiens
guaagagcuuuaaaugcua

SEQ ID NO: 863400 - RNA, 19 nt, Homo sapiens
gaaacuaugauccugcuuu

SEQ ID NO: 863401 - RNA, 19 nt, Homo sapiens
ggacuagauuaauugcaaa

SEQ ID NO: 863402 - RNA, 19 nt, Homo sapiens
gggacuagauuaauugcaa

SEQ ID NO: 863403 - RNA, 19 nt, Homo sapiens
gugcuuacaucacgagaaa

SEQ ID NO: 863404 - RNA, 19 nt, Homo sapiens
ggauuugacaguauaagua

SEQ ID NO: 863405 - RNA, 19 nt, Homo sapiens
gaggaagagccauuacaua

SEQ ID NO: 863406 - RNA, 19 nt, Homo sapiens
gcauucuucuuucauugua

SEQ ID NO: 863407 - RNA, 19 nt, Homo sapiens
gaagcuggcuacuguccuu

SEQ ID NO: 863408 - RNA, 19 nt, Homo sapiens
caaauacaaucuguuggaa

SEQ ID NO: 863409 - RNA, 19 nt, Homo sapiens
gaggcaagcuacuccuuug

SEQ ID NO: 863410 - RNA, 19 nt, Homo sapiens
caaacuggaacgaguauuu

SEQ ID NO: 863411 - RNA, 19 nt, Homo sapiens
aggagaaauuucagcauua

SEQ ID NO: 863412 - RNA, 19 nt, Homo sapiens
cgauaaaucuauucgaauc

SEQ ID NO: 863413 - RNA, 19 nt, Homo sapiens
uaacucagcggaauuguau

SEQ ID NO: 863414 - RNA, 19 nt, Homo sapiens
caacauguuaucuguguaa

SEQ ID NO: 863415 - RNA, 19 nt, Homo sapiens
ggaacccuauggaagcuuu

SEQ ID NO: 863416 - RNA, 19 nt, Homo sapiens
cuaacaauccugauguaua

SEQ ID NO: 863417 - RNA, 19 nt, Homo sapiens
cagcagcaaaugaagauua

SEQ ID NO: 863418 - RNA, 19 nt, Homo sapiens
ccauauggaucauguaucu

SEQ ID NO: 863419 - RNA, 19 nt, Homo sapiens
gaagaagaaacacguagug

SEQ ID NO: 863420 - RNA, 19 nt, Homo sapiens
guguggaucugaugaaaug

SEQ ID NO: 863421 - RNA, 19 nt, Homo sapiens
ggacagcaaguagacauuu

SEQ ID NO: 863422 - RNA, 19 nt, Homo sapiens
gacagcaaguauauuaugu

SEQ ID NO: 863423 - RNA, 19 nt, Homo sapiens
aaggagaaauuucagcauu

SEQ ID NO: 863424 - RNA, 19 nt, Homo sapiens
ucugacagcaaguauauua

SEQ ID NO: 863425 - RNA, 19 nt, Homo sapiens
uguaagagcuuuaaaugcu

SEQ ID NO: 863426 - RNA, 19 nt, Homo sapiens
uuacagagaguuccaagaa

SEQ ID NO: 863427 - RNA, 19 nt, Homo sapiens
gaagugaaucguauuaaac

SEQ ID NO: 863428 - RNA, 19 nt, Homo sapiens
cgaaaggaagugaaucgua

SEQ ID NO: 863429 - RNA, 19 nt, Homo sapiens
gaaucuaacucagcggaau

SEQ ID NO: 863430 - RNA, 19 nt, Homo sapiens
gauggagagguuagaauuu

SEQ ID NO: 863431 - RNA, 19 nt, Homo sapiens
caaggauuauaaccagaaa

SEQ ID NO: 863432 - RNA, 19 nt, Homo sapiens
cagcaaguauauuaugugu

SEQ ID NO: 863433 - RNA, 19 nt, Homo sapiens
gacagcaaguagacauuug

SEQ ID NO: 863434 - RNA, 19 nt, Homo sapiens
gaauuuggaaucuaacuca

SEQ ID NO: 863435 - RNA, 19 nt, Homo sapiens
gcaacauguuaucugugua

SEQ ID NO: 863436 - RNA, 19 nt, Homo sapiens
ggaauccggacaauuaugu

SEQ ID NO: 863437 - RNA, 19 nt, Homo sapiens
acaaagagaaugcaacaug

SEQ ID NO: 863438 - RNA, 19 nt, Homo sapiens
aaucuuuccuguagacaaa

SEQ ID NO: 863439 - RNA, 19 nt, Homo sapiens
ucauguaucugcagugcuu

SEQ ID NO: 863440 - RNA, 19 nt, Homo sapiens
ggaagagccauuacauaca

SEQ ID NO: 863441 - RNA, 19 nt, Homo sapiens
aagagaaugcaacauguua

SEQ ID NO: 863442 - RNA, 19 nt, Homo sapiens
gaagcagggagguauauca

SEQ ID NO: 863443 - RNA, 19 nt, Homo sapiens
ugacaggaauauaguacug

SEQ ID NO: 863444 - RNA, 19 nt, Homo sapiens
uaacccaauugagacauuu

SEQ ID NO: 863445 - RNA, 19 nt, Homo sapiens
aggaauauguacucgcuuu

SEQ ID NO: 863446 - RNA, 19 nt, Homo sapiens
gauguuucuuccugugauu

SEQ ID NO: 863447 - RNA, 19 nt, Homo sapiens
ucagcauuauccucauaua

SEQ ID NO: 863448 - RNA, 19 nt, Homo sapiens
ccacuugugucagagaaga

SEQ ID NO: 863449 - RNA, 19 nt, Homo sapiens
gaacauucgccuguggaaa

SEQ ID NO: 863450 - RNA, 19 nt, Homo sapiens
guacaauacaagcacauga

SEQ ID NO: 863451 - RNA, 19 nt, Homo sapiens
gagguuagaauuuggaauc

SEQ ID NO: 863452 - RNA, 19 nt, Homo sapiens
uacagagaguuccaagaaa

SEQ ID NO: 863453 - RNA, 19 nt, Homo sapiens
gggaugaacaaagaacuaa

SEQ ID NO: 863454 - RNA, 19 nt, Homo sapiens
gcacaugaaggcuuuguac

SEQ ID NO: 863455 - RNA, 19 nt, Homo sapiens
uggcaaagcauccagagaa

SEQ ID NO: 863456 - RNA, 19 nt, Homo sapiens
aaagguggccuaguuggua

SEQ ID NO: 863457 - RNA, 19 nt, Homo sapiens
gaugaacaaagaacuaauc

SEQ ID NO: 863458 - RNA, 19 nt, Homo sapiens
gcuuuauuguuacuccuuu

SEQ ID NO: 863459 - RNA, 19 nt, Homo sapiens
acagagaguuccaagaaac

SEQ ID NO: 863460 - RNA, 19 nt, Homo sapiens
ggaacagcgcaucaugaaa

SEQ ID NO: 863461 - RNA, 19 nt, Homo sapiens
aagcagccaaggauuauaa

SEQ ID NO: 863462 - RNA, 19 nt, Homo sapiens
gagaaugcaacauguuauc

SEQ ID NO: 863463 - RNA, 19 nt, Homo sapiens
uaucugcagugcuugaugu

SEQ ID NO: 863464 - RNA, 19 nt, Homo sapiens
ugacagcaaguauauuaug

SEQ ID NO: 863465 - RNA, 19 nt, Homo sapiens
auucgaaucuuuccuguag

SEQ ID NO: 863466 - RNA, 19 nt, Homo sapiens
gaguuugugucugcuaguu

SEQ ID NO: 863467 - RNA, 19 nt, Homo sapiens
gauccugcuuuacauccuu

SEQ ID NO: 863468 - RNA, 19 nt, Homo sapiens
ggcaaagcauccagagaag

SEQ ID NO: 863469 - RNA, 19 nt, Homo sapiens
gugauggagucaauugcuu

SEQ ID NO: 863470 - RNA, 19 nt, Homo sapiens
acacguaguggcaguugua

SEQ ID NO: 863471 - RNA, 19 nt, Homo sapiens
ccaaggauuauaaccagaa

SEQ ID NO: 863472 - RNA, 19 nt, Homo sapiens
gaaugcaacauguuaucug

SEQ ID NO: 863473 - RNA, 19 nt, Homo sapiens
acaaauacaaucuguugga

SEQ ID NO: 863474 - RNA, 19 nt, Homo sapiens
gugauuccacauaacauuu

SEQ ID NO: 863475 - RNA, 19 nt, Homo sapiens
uuucagcauuauccucaua

SEQ ID NO: 863476 - RNA, 19 nt, Homo sapiens
ugauggagagguuagaauu

SEQ ID NO: 863477 - RNA, 19 nt, Homo sapiens
aagguggccuaguugguaa

SEQ ID NO: 863478 - RNA, 19 nt, Homo sapiens
gcugggacuagauuaauug

SEQ ID NO: 863479 - RNA, 19 nt, Homo sapiens
ugucagagaagaagaaaca

SEQ ID NO: 863480 - RNA, 19 nt, Homo sapiens
aaggaagugaaucguauua

SEQ ID NO: 863481 - RNA, 19 nt, Homo sapiens
acuggacacuccuguaaug

SEQ ID NO: 863482 - RNA, 19 nt, Homo sapiens
acauuucucuugggaaguu

SEQ ID NO: 863483 - RNA, 19 nt, Homo sapiens
uuacagcacuuguuuguga

SEQ ID NO: 863484 - RNA, 19 nt, Homo sapiens
gagcugguguacagguuua

SEQ ID NO: 863485 - RNA, 19 nt, Homo sapiens
gggcaaggcugaagaaagg

SEQ ID NO: 863486 - RNA, 19 nt, Homo sapiens
ggacagagagcguuucaca

SEQ ID NO: 863487 - RNA, 19 nt, Homo sapiens
ggcaagagcugguguacag

SEQ ID NO: 863488 - RNA, 19 nt, Homo sapiens
gcaguucacccaucucgaa

SEQ ID NO: 863489 - RNA, 19 nt, Homo sapiens
ggaaacagaccuucuacgu

SEQ ID NO: 863490 - RNA, 19 nt, Homo sapiens
guuauugagucucuuugaa

SEQ ID NO: 863491 - RNA, 19 nt, Homo sapiens
gcacuuguuugugacauuc

SEQ ID NO: 863492 - RNA, 19 nt, Homo sapiens
cgacugaaguuggcacaga

SEQ ID NO: 863493 - RNA, 19 nt, Homo sapiens
ggugugggaauaaacaaua

SEQ ID NO: 863494 - RNA, 19 nt, Homo sapiens
acgcagagacugagaaauu

SEQ ID NO: 863495 - RNA, 19 nt, Homo sapiens
uggaaaguccugcuuguuu

SEQ ID NO: 863496 - RNA, 19 nt, Homo sapiens
guugguauccuguaucuga

SEQ ID NO: 863497 - RNA, 19 nt, Homo sapiens
ccaccaggcuauuacuugu

SEQ ID NO: 863498 - RNA, 19 nt, Homo sapiens
ggaugggugugggaauaaa

SEQ ID NO: 863499 - RNA, 19 nt, Homo sapiens
gaccuggaccucuggguaa

SEQ ID NO: 863500 - RNA, 19 nt, Homo sapiens
ggagucagaagucucaguu

SEQ ID NO: 863501 - RNA, 19 nt, Homo sapiens
gaaagagaaaggcaaagag

SEQ ID NO: 863502 - RNA, 19 nt, Homo sapiens
guucuuacagcacuuguuu

SEQ ID NO: 863503 - RNA, 19 nt, Homo sapiens
gugugggaauaaacaauaa

SEQ ID NO: 863504 - RNA, 19 nt, Homo sapiens
ccauuggugugaaagagaa

SEQ ID NO: 863505 - RNA, 19 nt, Homo sapiens
gauaauggccagaaguuuu

SEQ ID NO: 863506 - RNA, 19 nt, Homo sapiens
cgaaggagaaacuaccaaa

SEQ ID NO: 863507 - RNA, 19 nt, Homo sapiens
ugggaugggugugggaaua

SEQ ID NO: 863508 - RNA, 19 nt, Homo sapiens
ucucaguucugucauuugu

SEQ ID NO: 863509 - RNA, 19 nt, Homo sapiens
uggaugagcuauuucuuac

SEQ ID NO: 863510 - RNA, 19 nt, Homo sapiens
guucacccaucucgaagga

SEQ ID NO: 863511 - RNA, 19 nt, Homo sapiens
cagauaauggccagaaguu

SEQ ID NO: 863512 - RNA, 19 nt, Homo sapiens
acagagagcguuucacaca

SEQ ID NO: 863513 - RNA, 19 nt, Homo sapiens
cuggaugagcuauuucuua

SEQ ID NO: 863514 - RNA, 19 nt, Homo sapiens
ugaaagagaaaggcaaaga

SEQ ID NO: 863515 - RNA, 19 nt, Homo sapiens
gguauccuguaucugaaug

SEQ ID NO: 863516 - RNA, 19 nt, Homo sapiens
gcuggcggcaggacacaua

SEQ ID NO: 863517 - RNA, 19 nt, Homo sapiens
uuacggagacugguuggua

SEQ ID NO: 863518 - RNA, 19 nt, Homo sapiens
uauugagucucuuugaauc

SEQ ID NO: 863519 - RNA, 19 nt, Homo sapiens
ggagauguuugugcguauc

SEQ ID NO: 863520 - RNA, 19 nt, Homo sapiens
aaacgcagagacugagaaa

SEQ ID NO: 863521 - RNA, 19 nt, Homo sapiens
cuggguacuuggagacuuu

SEQ ID NO: 863522 - RNA, 19 nt, Homo sapiens
ggagcagguuauugagucu

SEQ ID NO: 863523 - RNA, 19 nt, Homo sapiens
cgcagagacugagaaauuc

SEQ ID NO: 863524 - RNA, 19 nt, Homo sapiens
agucucaguucugucauuu

SEQ ID NO: 863525 - RNA, 19 nt, Homo sapiens
gugggaaacagaccuucua

SEQ ID NO: 863526 - RNA, 19 nt, Homo sapiens
ugugcuggaugagcuauuu

SEQ ID NO: 863527 - RNA, 19 nt, Homo sapiens
gggaugggugugggaauaa

SEQ ID NO: 863528 - RNA, 19 nt, Homo sapiens
caaggcaagagcuggugua

SEQ ID NO: 863529 - RNA, 19 nt, Homo sapiens
gaaggagaaacuaccaaac

SEQ ID NO: 863530 - RNA, 19 nt, Homo sapiens
uacggagacugguugguau

SEQ ID NO: 863531 - RNA, 19 nt, Homo sapiens
aauggaaaguccugcuugu

SEQ ID NO: 863532 - RNA, 19 nt, Homo sapiens
ucacaucuguaaaauggaa

SEQ ID NO: 863533 - RNA, 19 nt, Homo sapiens
ggguuccugucacgacuga

SEQ ID NO: 863534 - RNA, 19 nt, Homo sapiens
caaacgcagagacugagaa

SEQ ID NO: 863535 - RNA, 19 nt, Homo sapiens
gacgcauccuggacagaga

SEQ ID NO: 863536 - RNA, 19 nt, Homo sapiens
ucccauggcagaugugauu

SEQ ID NO: 863537 - RNA, 19 nt, Homo sapiens
gccaccaggcuauuacuug

SEQ ID NO: 863538 - RNA, 19 nt, Homo sapiens
uaccaaacgcagagacuga

SEQ ID NO: 863539 - RNA, 19 nt, Homo sapiens
gguuauugagucucuuuga

SEQ ID NO: 863540 - RNA, 19 nt, Homo sapiens
agaguccauuggugugaaa

SEQ ID NO: 863541 - RNA, 19 nt, Homo sapiens
ggcagcaguucacccaucu

SEQ ID NO: 863542 - RNA, 19 nt, Homo sapiens
guguacagguuuaggaaaa

SEQ ID NO: 863543 - RNA, 19 nt, Homo sapiens
ugagucucuuugaaucuug

SEQ ID NO: 863544 - RNA, 19 nt, Homo sapiens
uagaguccauuggugugaa

SEQ ID NO: 863545 - RNA, 19 nt, Homo sapiens
gguguacagguuuaggaaa

SEQ ID NO: 863546 - RNA, 19 nt, Homo sapiens
cagaugcucaagugaacaa

SEQ ID NO: 863547 - RNA, 19 nt, Homo sapiens
cagguuauugagucucuuu

SEQ ID NO: 863548 - RNA, 19 nt, Homo sapiens
ggucacccauagaguccau

SEQ ID NO: 863549 - RNA, 19 nt, Homo sapiens
gaaaggggacuggguacuu

SEQ ID NO: 863550 - RNA, 19 nt, Homo sapiens
caccaggcuauuacuugua

SEQ ID NO: 863551 - RNA, 19 nt, Homo sapiens
gauuuggagucagaagucu

SEQ ID NO: 863552 - RNA, 19 nt, Homo sapiens
ugugaaagagaaaggcaaa

SEQ ID NO: 863553 - RNA, 19 nt, Homo sapiens
aaaaggcucuaagcaaguu

SEQ ID NO: 863554 - RNA, 19 nt, Homo sapiens
aagagcugguguacagguu

SEQ ID NO: 863555 - RNA, 19 nt, Homo sapiens
accaugcugugcuggauga

SEQ ID NO: 863556 - RNA, 19 nt, Homo sapiens
ugaccaugcugugcuggau

SEQ ID NO: 863557 - RNA, 19 nt, Homo sapiens
gauaugagcuguauaauug

SEQ ID NO: 863558 - RNA, 19 nt, Homo sapiens
gggaagugcugcaagauuu

SEQ ID NO: 863559 - RNA, 19 nt, Homo sapiens
gcagauaugagcuguauaa

SEQ ID NO: 863560 - RNA, 19 nt, Homo sapiens
uaacaaagaccuaacaguu

SEQ ID NO: 863561 - RNA, 19 nt, Homo sapiens
gcacagagggccagaucua

SEQ ID NO: 863562 - RNA, 19 nt, Homo sapiens
gcaaugcugucccaagugu

SEQ ID NO: 863563 - RNA, 19 nt, Homo sapiens
gaaguugcauuacccucaa

SEQ ID NO: 863564 - RNA, 19 nt, Homo sapiens
gaaggagaaacauaagaaa

SEQ ID NO: 863565 - RNA, 19 nt, Homo sapiens
cagcacaacugucaagauc

SEQ ID NO: 863566 - RNA, 19 nt, Homo sapiens
gaccaagacauaacaaaga

SEQ ID NO: 863567 - RNA, 19 nt, Homo sapiens
gcacaacugucaagaucgu

SEQ ID NO: 863568 - RNA, 19 nt, Homo sapiens
uaagaaagccugugugcau

SEQ ID NO: 863569 - RNA, 19 nt, Homo sapiens
caaagugaccaagacauaa

SEQ ID NO: 863570 - RNA, 19 nt, Homo sapiens
acaaagugaccaagacaua

SEQ ID NO: 863571 - RNA, 19 nt, Homo sapiens
gcugggaagugcugcaaga

SEQ ID NO: 863572 - RNA, 19 nt, Homo sapiens
ccuaacaguugcagauaug

SEQ ID NO: 863573 - RNA, 19 nt, Homo sapiens
gcaggcagcacaacuguca

SEQ ID NO: 863574 - RNA, 19 nt, Homo sapiens
ugaaggagaaacauaagaa

SEQ ID NO: 863575 - RNA, 19 nt, Homo sapiens
ggaagugcugcaagauuug

SEQ ID NO: 863576 - RNA, 19 nt, Homo sapiens
gaucuucagugcccaugag

SEQ ID NO: 863577 - RNA, 19 nt, Homo sapiens
gaccuaacaguugcagaua

SEQ ID NO: 863578 - RNA, 19 nt, Homo sapiens
cuucaucccucgccacuuc

SEQ ID NO: 863579 - RNA, 19 nt, Homo sapiens
gauccauguuccagugaug

SEQ ID NO: 863580 - RNA, 19 nt, Homo sapiens
agacauaacaaagaccuaa

SEQ ID NO: 863581 - RNA, 19 nt, Homo sapiens
aacaaagaccuaacaguug

SEQ ID NO: 863582 - RNA, 19 nt, Homo sapiens
ugaccugucccaccgagua

SEQ ID NO: 863583 - RNA, 19 nt, Homo sapiens
ggccugcuaugcucaguca

SEQ ID NO: 863584 - RNA, 19 nt, Homo sapiens
gcacaacgggaccauguac

SEQ ID NO: 863585 - RNA, 19 nt, Homo sapiens
uugcagauaugagcuguau

SEQ ID NO: 863586 - RNA, 19 nt, Homo sapiens
acagugagaucaguucuac

SEQ ID NO: 863587 - RNA, 19 nt, Homo sapiens
gagcaggcagcacaacugu

SEQ ID NO: 863588 - RNA, 19 nt, Homo sapiens
guaccaacacggagagauc

SEQ ID NO: 863589 - RNA, 19 nt, Homo sapiens
ccagacaaagugaccaaga

SEQ ID NO: 863590 - RNA, 19 nt, Homo sapiens
gcagcacaacugucaagau

SEQ ID NO: 863591 - RNA, 19 nt, Homo sapiens
cagacaaagugaccaagac

SEQ ID NO: 863592 - RNA, 19 nt, Homo sapiens
cagcacaacgggaccaugu

SEQ ID NO: 863593 - RNA, 19 nt, Homo sapiens
ggagcaggcagcacaacug

SEQ ID NO: 863594 - RNA, 19 nt, Homo sapiens
gaucuacugcggccucaca

SEQ ID NO: 863595 - RNA, 19 nt, Homo sapiens
aauaagaaguugcauuacc

SEQ ID NO: 863596 - RNA, 19 nt, Homo sapiens
caacacggagagaucuuca

SEQ ID NO: 863597 - RNA, 19 nt, Homo sapiens
ggauccauguuccagugau

SEQ ID NO: 863598 - RNA, 19 nt, Homo sapiens
ugaccaagacauaacaaag

SEQ ID NO: 863599 - RNA, 19 nt, Homo sapiens
cggacuugguggagaucua

SEQ ID NO: 863600 - RNA, 19 nt, Homo sapiens
gacaaccugcgucgcuuug

SEQ ID NO: 863601 - RNA, 19 nt, Homo sapiens
gacccuggccacagugaga

SEQ ID NO: 863602 - RNA, 19 nt, Homo sapiens
ccucggacuugguggagau

SEQ ID NO: 863603 - RNA, 19 nt, Homo sapiens
caacgggaccauguaccaa

SEQ ID NO: 863604 - RNA, 19 nt, Homo sapiens
uuucauccuuccugccauu

SEQ ID NO: 863605 - RNA, 19 nt, Homo sapiens
ugagcuguauaauuguugu

SEQ ID NO: 863606 - RNA, 19 nt, Homo sapiens
aaacaaagguugaugacua

SEQ ID NO: 863607 - RNA, 19 nt, Homo sapiens
gaacgacgaugaagacaug

SEQ ID NO: 863608 - RNA, 19 nt, Homo sapiens
cugaagagcucaagaaauu

SEQ ID NO: 863609 - RNA, 19 nt, Homo sapiens
ccacugaacuuaucuggaa

SEQ ID NO: 863610 - RNA, 19 nt, Homo sapiens
gaccagauguuuacuaaug

SEQ ID NO: 863611 - RNA, 19 nt, Homo sapiens
caacugaaauugugcagaa

SEQ ID NO: 863612 - RNA, 19 nt, Homo sapiens
gagaccagauguuuacuaa

SEQ ID NO: 863613 - RNA, 19 nt, Homo sapiens
caaguugacuaucacauuu

SEQ ID NO: 863614 - RNA, 19 nt, Homo sapiens
caaacggccuguacgauuu

SEQ ID NO: 863615 - RNA, 19 nt, Homo sapiens
caacgcugcucauaaauau

SEQ ID NO: 863616 - RNA, 19 nt, Homo sapiens
agaaggagcuugugcuaaa

SEQ ID NO: 863617 - RNA, 19 nt, Homo sapiens
caucaaaccuccugaguuc

SEQ ID NO: 863618 - RNA, 19 nt, Homo sapiens
gaacaauacacaacugaaa

SEQ ID NO: 863619 - RNA, 19 nt, Homo sapiens
gaagagcucaagaaauuaa

SEQ ID NO: 863620 - RNA, 19 nt, Homo sapiens
ugaaagcccugaaacuuga

SEQ ID NO: 863621 - RNA, 19 nt, Homo sapiens
gaagaaagaaggccuguuc

SEQ ID NO: 863622 - RNA, 19 nt, Homo sapiens
ucccagagcuauucaagua

SEQ ID NO: 863623 - RNA, 19 nt, Homo sapiens
gcaagucacugcccugcuu

SEQ ID NO: 863624 - RNA, 19 nt, Homo sapiens
gaaaggaacacaacagcaa

SEQ ID NO: 863625 - RNA, 19 nt, Homo sapiens
gaaacaaccaacaauaaga

SEQ ID NO: 863626 - RNA, 19 nt, Homo sapiens
gaggaaagccgaaggaaau

SEQ ID NO: 863627 - RNA, 19 nt, Homo sapiens
ugucaacgcugcucauaaa

SEQ ID NO: 863628 - RNA, 19 nt, Homo sapiens
ucaagcagccucugagaua

SEQ ID NO: 863629 - RNA, 19 nt, Homo sapiens
gcaggagggugaugaggaa

SEQ ID NO: 863630 - RNA, 19 nt, Homo sapiens
gaagaguuaugagaaauca

SEQ ID NO: 863631 - RNA, 19 nt, Homo sapiens
gggaggaauuagaacaaua

SEQ ID NO: 863632 - RNA, 19 nt, Homo sapiens
gcaaacggccuguacgauu

SEQ ID NO: 863633 - RNA, 19 nt, Homo sapiens
aaacggaccuggaggaugu

SEQ ID NO: 863634 - RNA, 19 nt, Homo sapiens
guaaagaacgugugugaga

SEQ ID NO: 863635 - RNA, 19 nt, Homo sapiens
ccacgucaauauuguguuu

SEQ ID NO: 863636 - RNA, 19 nt, Homo sapiens
gaacguaaacacucgaaga

SEQ ID NO: 863637 - RNA, 19 nt, Homo sapiens
gaaaacacaugaugggaaa

SEQ ID NO: 863638 - RNA, 19 nt, Homo sapiens
ggaauuagaacaauacaca

SEQ ID NO: 863639 - RNA, 19 nt, Homo sapiens
agaaggagaucaaggaugu

SEQ ID NO: 863640 - RNA, 19 nt, Homo sapiens
caagaaagcccugaagaga

SEQ ID NO: 863641 - RNA, 19 nt, Homo sapiens
aggaggaagugaaccauua

SEQ ID NO: 863642 - RNA, 19 nt, Homo sapiens
aggaggagguugauuauga

SEQ ID NO: 863643 - RNA, 19 nt, Homo sapiens
gcaaguugacuaucacauu

SEQ ID NO: 863644 - RNA, 19 nt, Homo sapiens
guauaacccucuccucuuc

SEQ ID NO: 863645 - RNA, 19 nt, Homo sapiens
gagcugaggucuccuucug

SEQ ID NO: 863646 - RNA, 19 nt, Homo sapiens
ggagaucaaggauguguuu

SEQ ID NO: 863647 - RNA, 19 nt, Homo sapiens
gagaagaguuaugagaaau

SEQ ID NO: 863648 - RNA, 19 nt, Homo sapiens
cgaaggaaauaccagaaga

SEQ ID NO: 863649 - RNA, 19 nt, Homo sapiens
gguggacacugcugugaaa

SEQ ID NO: 863650 - RNA, 19 nt, Homo sapiens
gcaaggaccagagggauuu

SEQ ID NO: 863651 - RNA, 19 nt, Homo sapiens
ggauguugaucuccaagaa

SEQ ID NO: 863652 - RNA, 19 nt, Homo sapiens
agagaagaguuaugagaaa

SEQ ID NO: 863653 - RNA, 19 nt, Homo sapiens
aaacagagaagaguuauga

SEQ ID NO: 863654 - RNA, 19 nt, Homo sapiens
gccaaagguucaacuguga

SEQ ID NO: 863655 - RNA, 19 nt, Homo sapiens
gaucagcaguaccuuguuc

SEQ ID NO: 863656 - RNA, 19 nt, Homo sapiens
aaugaaggauucuuucuga

SEQ ID NO: 863657 - RNA, 19 nt, Homo sapiens
ggaccuugcugcagcugaa

SEQ ID NO: 863658 - RNA, 19 nt, Homo sapiens
gaaggaaauaccagaagaa

SEQ ID NO: 863659 - RNA, 19 nt, Homo sapiens
ccacaucccacugaacuua

SEQ ID NO: 863660 - RNA, 19 nt, Homo sapiens
ggacaaguacccaggcauu

SEQ ID NO: 863661 - RNA, 19 nt, Homo sapiens
gaaggauucuuucugaacu

SEQ ID NO: 863662 - RNA, 19 nt, Homo sapiens
gaggcgccuucuugaguua

SEQ ID NO: 863663 - RNA, 19 nt, Homo sapiens
uaacaugauugaucugaag

SEQ ID NO: 863664 - RNA, 19 nt, Homo sapiens
gaaagcagugggccucuga

SEQ ID NO: 863665 - RNA, 19 nt, Homo sapiens
gccagaagccgcaucauau

SEQ ID NO: 863666 - RNA, 19 nt, Homo sapiens
cauccugccugaagagaaa

SEQ ID NO: 863667 - RNA, 19 nt, Homo sapiens
caucaacaccaacgaaauu

SEQ ID NO: 863668 - RNA, 19 nt, Homo sapiens
gcccagacauguacaucaa

SEQ ID NO: 863669 - RNA, 19 nt, Homo sapiens
gagauggacaaacuaauga

SEQ ID NO: 863670 - RNA, 19 nt, Homo sapiens
ggaugaugaugguauggaa

SEQ ID NO: 863671 - RNA, 19 nt, Homo sapiens
gaaagacccaagagcaaga

SEQ ID NO: 863672 - RNA, 19 nt, Homo sapiens
ggagguugauuaugagagu

SEQ ID NO: 863673 - RNA, 19 nt, Homo sapiens
aagaaggccuguuccgaaa

SEQ ID NO: 863674 - RNA, 19 nt, Homo sapiens
gggaauggaugaugauggu

SEQ ID NO: 863675 - RNA, 19 nt, Homo sapiens
ccagagcuauucaaguaug

SEQ ID NO: 863676 - RNA, 19 nt, Homo sapiens
agaaagcccugaagagagu

SEQ ID NO: 863677 - RNA, 19 nt, Homo sapiens
uacagcagaugacauuuga

SEQ ID NO: 863678 - RNA, 19 nt, Homo sapiens
gaacgucacccugggcauu

SEQ ID NO: 863679 - RNA, 19 nt, Homo sapiens
ccucaacaccuuccacuuu

SEQ ID NO: 863680 - RNA, 19 nt, Homo sapiens
uaugagaaaucagagcuuu

SEQ ID NO: 863681 - RNA, 19 nt, Homo sapiens
ccagggcaguuccaaguga

SEQ ID NO: 863682 - RNA, 19 nt, Homo sapiens
ucuacgagcuugagagaau

SEQ ID NO: 863683 - RNA, 19 nt, Homo sapiens
cagcagaugacauuugaaa

SEQ ID NO: 863684 - RNA, 19 nt, Homo sapiens
gaaugaaacaaccaacaau

SEQ ID NO: 863685 - RNA, 19 nt, Homo sapiens
gugaaagcccugaaacuug

SEQ ID NO: 863686 - RNA, 19 nt, Homo sapiens
gcuuugagccuuaugaguu

SEQ ID NO: 863687 - RNA, 19 nt, Homo sapiens
ucaacgcugcucauaaaua

SEQ ID NO: 863688 - RNA, 19 nt, Homo sapiens
gacaaguacccaggcauua

SEQ ID NO: 863689 - RNA, 19 nt, Homo sapiens
gaacuugcaggcugucaug

SEQ ID NO: 863690 - RNA, 19 nt, Homo sapiens
ugucagggcugcauuaaac

SEQ ID NO: 863691 - RNA, 19 nt, Homo sapiens
caacguaucauugaagaau

SEQ ID NO: 863692 - RNA, 19 nt, Homo sapiens
ggauguguuugccguguau

SEQ ID NO: 863693 - RNA, 19 nt, Homo sapiens
gugaagcucccucugauga

SEQ ID NO: 863694 - RNA, 19 nt, Homo sapiens
ggaggaggagguugauuau

SEQ ID NO: 863695 - RNA, 19 nt, Homo sapiens
guaaacacucgaagagcua

SEQ ID NO: 863696 - RNA, 19 nt, Homo sapiens
gauggcgucuggcaaguca

SEQ ID NO: 863697 - RNA, 19 nt, Homo sapiens
caggacagcuggccagaag

SEQ ID NO: 863698 - RNA, 19 nt, Homo sapiens
aggcacauaugaaugcuaa

SEQ ID NO: 863699 - RNA, 19 nt, Homo sapiens
ugacaugagcucccuggua

SEQ ID NO: 863700 - RNA, 19 nt, Homo sapiens
gcgaggagaacgacgauga

SEQ ID NO: 863701 - RNA, 19 nt, Homo sapiens
ggaggagguugauuaugag

SEQ ID NO: 863702 - RNA, 19 nt, Homo sapiens
gaggcaacguaucauugaa

SEQ ID NO: 863703 - RNA, 19 nt, Homo sapiens
ggcagauccuggagaagaa

SEQ ID NO: 863704 - RNA, 19 nt, Homo sapiens
ggagaccagauguuuacua

SEQ ID NO: 863705 - RNA, 19 nt, Homo sapiens
gaauggaugaugaugguau

SEQ ID NO: 863706 - RNA, 19 nt, Homo sapiens
gaaauugauugcacauuga

SEQ ID NO: 863707 - RNA, 19 nt, Homo sapiens
gagcagcgguugacacuga

SEQ ID NO: 863708 - RNA, 19 nt, Homo sapiens
gaacaagcccucucaagug

SEQ ID NO: 863709 - RNA, 19 nt, Homo sapiens
gggaauguguccacucgua

SEQ ID NO: 863710 - RNA, 19 nt, Homo sapiens
gcagagagcaacaccauga

SEQ ID NO: 863711 - RNA, 19 nt, Homo sapiens
gcacaggaaucucaaaauu

SEQ ID NO: 863712 - RNA, 19 nt, Homo sapiens
agaaauugauugcacauug

SEQ ID NO: 863713 - RNA, 19 nt, Homo sapiens
ggacuuggguaaauaaagg

SEQ ID NO: 863714 - RNA, 19 nt, Homo sapiens
caacucaucgccagaaauu

SEQ ID NO: 863715 - RNA, 19 nt, Homo sapiens
ucaagugggugguggcuuu

SEQ ID NO: 863716 - RNA, 19 nt, Homo sapiens
guaaaggagccacuugaaa

SEQ ID NO: 863717 - RNA, 19 nt, Homo sapiens
gagaugcaguuaccugugu

SEQ ID NO: 863718 - RNA, 19 nt, Homo sapiens
ggacuucaguaucaacaca

SEQ ID NO: 863719 - RNA, 19 nt, Homo sapiens
gcuccacgaugccuugauu

SEQ ID NO: 863720 - RNA, 19 nt, Homo sapiens
ggaagaguaacuuugauau

SEQ ID NO: 863721 - RNA, 19 nt, Homo sapiens
gagcauggcggcuuuguca

SEQ ID NO: 863722 - RNA, 19 nt, Homo sapiens
gcaggaguguggagucugu

SEQ ID NO: 863723 - RNA, 19 nt, Homo sapiens
gcacacacagccacaguga

SEQ ID NO: 863724 - RNA, 19 nt, Homo sapiens
caugggacuuggguaaaua

SEQ ID NO: 863725 - RNA, 19 nt, Homo sapiens
acacacaaaugaugcuuca

SEQ ID NO: 863726 - RNA, 19 nt, Homo sapiens
gguugacacugacagaaga

SEQ ID NO: 863727 - RNA, 19 nt, Homo sapiens
gugaugguuuggaagagua

SEQ ID NO: 863728 - RNA, 19 nt, Homo sapiens
gaugaacaagugaugguuu

SEQ ID NO: 863729 - RNA, 19 nt, Homo sapiens
cgacaagacagucaaagug

SEQ ID NO: 863730 - RNA, 19 nt, Homo sapiens
gaauguguccacucguauu

SEQ ID NO: 863731 - RNA, 19 nt, Homo sapiens
gacaagagcagccgggaau

SEQ ID NO: 863732 - RNA, 19 nt, Homo sapiens
gccaugguguagaaauuga

SEQ ID NO: 863733 - RNA, 19 nt, Homo sapiens
gagagcaacaccaugauca

SEQ ID NO: 863734 - RNA, 19 nt, Homo sapiens
caagugaugguuuggaaga

SEQ ID NO: 863735 - RNA, 19 nt, Homo sapiens
ccucugccaugguguagaa

SEQ ID NO: 863736 - RNA, 19 nt, Homo sapiens
gaaccagcagcuaaucaug

SEQ ID NO: 863737 - RNA, 19 nt, Homo sapiens
gaacaagugaugguuugga

SEQ ID NO: 863738 - RNA, 19 nt, Homo sapiens
uggaggcucugaugaacaa

SEQ ID NO: 863739 - RNA, 19 nt, Homo sapiens
ggaccagccaccacuguug

SEQ ID NO: 863740 - RNA, 19 nt, Homo sapiens
gcugcagcauuaucaguug

SEQ ID NO: 863741 - RNA, 19 nt, Homo sapiens
uguguggacuucaguauca

SEQ ID NO: 863742 - RNA, 19 nt, Homo sapiens
gacaagacagucaaagugu

SEQ ID NO: 863743 - RNA, 19 nt, Homo sapiens
uaaaggagccacuugaaaa

SEQ ID NO: 863744 - RNA, 19 nt, Homo sapiens
ggagcucgguggauuugca

SEQ ID NO: 863745 - RNA, 19 nt, Homo sapiens
ugagucagguuuguugaga

SEQ ID NO: 863746 - RNA, 19 nt, Homo sapiens
acacaaaugaugcuucaga

SEQ ID NO: 863747 - RNA, 19 nt, Homo sapiens
gaagauccuggaccugaug

SEQ ID NO: 863748 - RNA, 19 nt, Homo sapiens
aaaggugaguccacugugu

SEQ ID NO: 863749 - RNA, 19 nt, Homo sapiens
ugugugaacuucucuccuu

SEQ ID NO: 863750 - RNA, 19 nt, Homo sapiens
gauugcacauugauuggau

SEQ ID NO: 863751 - RNA, 19 nt, Homo sapiens
gauuuucacucaucauuug

SEQ ID NO: 863752 - RNA, 19 nt, Homo sapiens
gagucagguuuguugagaa

SEQ ID NO: 863753 - RNA, 19 nt, Homo sapiens
gggaaucacauccauacug

SEQ ID NO: 863754 - RNA, 19 nt, Homo sapiens
ccaugggacuuggguaaau

SEQ ID NO: 863755 - RNA, 19 nt, Homo sapiens
uggaagaguaacuuugaua

SEQ ID NO: 863756 - RNA, 19 nt, Homo sapiens
gcagugaacgggcucucuu

SEQ ID NO: 863757 - RNA, 19 nt, Homo sapiens
ugugggacgugcggacuua

SEQ ID NO: 863758 - RNA, 19 nt, Homo sapiens
ggaauguguccacucguau

SEQ ID NO: 863759 - RNA, 19 nt, Homo sapiens
guuaagcugugggacaaga

SEQ ID NO: 863760 - RNA, 19 nt, Homo sapiens
gugaugacaagacuguuaa

SEQ ID NO: 863761 - RNA, 19 nt, Homo sapiens
caucgugucugccagugau

SEQ ID NO: 863762 - RNA, 19 nt, Homo sapiens
ugacagaagacaagcugaa

SEQ ID NO: 863763 - RNA, 19 nt, Homo sapiens
gacagccucugacgacaag

SEQ ID NO: 863764 - RNA, 19 nt, Homo sapiens
gagaaccagcagcuaauca

SEQ ID NO: 863765 - RNA, 19 nt, Homo sapiens
aacaagugaugguuuggaa

SEQ ID NO: 863766 - RNA, 19 nt, Homo sapiens
agaacaagcccucucaagu

SEQ ID NO: 863767 - RNA, 19 nt, Homo sapiens
ugaacgggcucucuuucca

SEQ ID NO: 863768 - RNA, 19 nt, Homo sapiens
gguccgcugugccaaguuc

SEQ ID NO: 863769 - RNA, 19 nt, Homo sapiens
caguggcccugauuucugu

SEQ ID NO: 863770 - RNA, 19 nt, Homo sapiens
ucgggaaacuaccugauca

SEQ ID NO: 863771 - RNA, 19 nt, Homo sapiens
ggcaacucaucgccagaaa

SEQ ID NO: 863772 - RNA, 19 nt, Homo sapiens
gcagugauggccaguccuu

SEQ ID NO: 863773 - RNA, 19 nt, Homo sapiens
ugacuaaaggcccaaagug

SEQ ID NO: 863774 - RNA, 19 nt, Homo sapiens
gcacaugaagccgcaguca

SEQ ID NO: 863775 - RNA, 19 nt, Homo sapiens
ugaagauccuggaccugau

SEQ ID NO: 863776 - RNA, 19 nt, Homo sapiens
ccgcuucacuggccacaag

SEQ ID NO: 863777 - RNA, 19 nt, Homo sapiens
cugccaugguguagaaauu

SEQ ID NO: 863778 - RNA, 19 nt, Homo sapiens
gcauggacaacacagugaa

SEQ ID NO: 863779 - RNA, 19 nt, Homo sapiens
ccacucguauugugagcau

SEQ ID NO: 863780 - RNA, 19 nt, Homo sapiens
gcaacucaucgccagaaau

SEQ ID NO: 863781 - RNA, 19 nt, Homo sapiens
cagaagacaagcugaagca

SEQ ID NO: 863782 - RNA, 19 nt, Homo sapiens
uauuguugaucauggagaa

SEQ ID NO: 863783 - RNA, 19 nt, Homo sapiens
augaacaagugaugguuug

SEQ ID NO: 863784 - RNA, 19 nt, Homo sapiens
agccaccacuguugccuuu

SEQ ID NO: 863785 - RNA, 19 nt, Homo sapiens
caagagcagccgggaaugu

SEQ ID NO: 863786 - RNA, 19 nt, Homo sapiens
agugaugacaagacuguua

SEQ ID NO: 863787 - RNA, 19 nt, Homo sapiens
cacaggaaucucaaaauua

SEQ ID NO: 863788 - RNA, 19 nt, Homo sapiens
gaagcagugucuggagaac

SEQ ID NO: 863789 - RNA, 19 nt, Homo sapiens
auacuggagcccuggauuu

SEQ ID NO: 863790 - RNA, 19 nt, Homo sapiens
ggccagggauuuguaccau

SEQ ID NO: 863791 - RNA, 19 nt, Homo sapiens
ggagaaccagcagcuaauc

SEQ ID NO: 863792 - RNA, 19 nt, Homo sapiens
ucauggagaagucacgaaa

SEQ ID NO: 863793 - RNA, 19 nt, Homo sapiens
ccaccgagaugcaguuacc

SEQ ID NO: 863794 - RNA, 19 nt, Homo sapiens
ucaaaggugaguccacugu

SEQ ID NO: 863795 - RNA, 19 nt, Homo sapiens
gaggaccacauuuugcuua

SEQ ID NO: 863796 - RNA, 19 nt, Homo sapiens
gggcaacucaucgccagaa

SEQ ID NO: 863797 - RNA, 19 nt, Homo sapiens
cucuaaaucugacuaaagg

SEQ ID NO: 863798 - RNA, 19 nt, Homo sapiens
uguaaaggagccacuugaa

SEQ ID NO: 863799 - RNA, 19 nt, Homo sapiens
cuagcacgcuggagcacau

SEQ ID NO: 863800 - RNA, 19 nt, Homo sapiens
ucccugagccagcauauca

SEQ ID NO: 863801 - RNA, 19 nt, Homo sapiens
ucacgcgccuaccgcuuca

SEQ ID NO: 863802 - RNA, 19 nt, Homo sapiens
ucaggagcucgguggauuu

SEQ ID NO: 863803 - RNA, 19 nt, Homo sapiens
ugaagcagugucuggagaa

SEQ ID NO: 863804 - RNA, 19 nt, Homo sapiens
auggagaagucacgaaagu

SEQ ID NO: 863805 - RNA, 19 nt, Homo sapiens
gguacccaaugucaaaggu

SEQ ID NO: 863806 - RNA, 19 nt, Homo sapiens
gaaguuauauccagagaaa

SEQ ID NO: 863807 - RNA, 19 nt, Homo sapiens
caaagaagguuauuucaga

SEQ ID NO: 863808 - RNA, 19 nt, Homo sapiens
caaauuaucuucagcaugu

SEQ ID NO: 863809 - RNA, 19 nt, Homo sapiens
guacuuaccuuucaacaug

SEQ ID NO: 863810 - RNA, 19 nt, Homo sapiens
acacugaaaugccuaaaua

SEQ ID NO: 863811 - RNA, 19 nt, Homo sapiens
caaauaaugucacuggaaa

SEQ ID NO: 863812 - RNA, 19 nt, Homo sapiens
ucaacaugcuucaaucuua

SEQ ID NO: 863813 - RNA, 19 nt, Homo sapiens
gcacaaaguuaccuucugu

SEQ ID NO: 863814 - RNA, 19 nt, Homo sapiens
ucaauuauguucaguggua

SEQ ID NO: 863815 - RNA, 19 nt, Homo sapiens
cggaggaguuuaauaguua

SEQ ID NO: 863816 - RNA, 19 nt, Homo sapiens
gagaagaacuggaaaauau

SEQ ID NO: 863817 - RNA, 19 nt, Homo sapiens
guuaagaccucuaugaaug

SEQ ID NO: 863818 - RNA, 19 nt, Homo sapiens
gaagcuggcucccuauuca

SEQ ID NO: 863819 - RNA, 19 nt, Homo sapiens
gagaauagagacagauaua

SEQ ID NO: 863820 - RNA, 19 nt, Homo sapiens
gaaugaauguaucagagaa

SEQ ID NO: 863821 - RNA, 19 nt, Homo sapiens
aaaguuaccuucuguuuca

SEQ ID NO: 863822 - RNA, 19 nt, Homo sapiens
caagaaccuuucacaacua

SEQ ID NO: 863823 - RNA, 19 nt, Homo sapiens
gcaauaaagagauguaguu

SEQ ID NO: 863824 - RNA, 19 nt, Homo sapiens
caacaugcuucaaucuuau

SEQ ID NO: 863825 - RNA, 19 nt, Homo sapiens
gagaguauuuaucagguuu

SEQ ID NO: 863826 - RNA, 19 nt, Homo sapiens
uaagaaagcaagauacuga

SEQ ID NO: 863827 - RNA, 19 nt, Homo sapiens
ccauaaaucucuacuuagu

SEQ ID NO: 863828 - RNA, 19 nt, Homo sapiens
aaacacgaguuaugaauuc

SEQ ID NO: 863829 - RNA, 19 nt, Homo sapiens
uaaucaagcuguauguaga

SEQ ID NO: 863830 - RNA, 19 nt, Homo sapiens
gcggaggaguuuaauaguu

SEQ ID NO: 863831 - RNA, 19 nt, Homo sapiens
ccacacagauuuuauacua

SEQ ID NO: 863832 - RNA, 19 nt, Homo sapiens
gagauugccuaccauuuua

SEQ ID NO: 863833 - RNA, 19 nt, Homo sapiens
gcaacucucucagauacaa

SEQ ID NO: 863834 - RNA, 19 nt, Homo sapiens
caacugaacuagcaaagac

SEQ ID NO: 863835 - RNA, 19 nt, Homo sapiens
ccaagaaccuuucacaacu

SEQ ID NO: 863836 - RNA, 19 nt, Homo sapiens
ggaagugcaggaaucauuu

SEQ ID NO: 863837 - RNA, 19 nt, Homo sapiens
ggcagcaacucacuucuga

SEQ ID NO: 863838 - RNA, 19 nt, Homo sapiens
gcaagauacugauguuaac

SEQ ID NO: 863839 - RNA, 19 nt, Homo sapiens
aacagucccugcuccauua

SEQ ID NO: 863840 - RNA, 19 nt, Homo sapiens
gauguguacucuuccuauu

SEQ ID NO: 863841 - RNA, 19 nt, Homo sapiens
gguagaugcugcacaaagu

SEQ ID NO: 863842 - RNA, 19 nt, Homo sapiens
aagaacaaguccauucaaa

SEQ ID NO: 863843 - RNA, 19 nt, Homo sapiens
gagagaauagagacagaua

SEQ ID NO: 863844 - RNA, 19 nt, Homo sapiens
gggcaaacaauaugucaaa

SEQ ID NO: 863845 - RNA, 19 nt, Homo sapiens
gaacaacugaacuagcaaa

SEQ ID NO: 863846 - RNA, 19 nt, Homo sapiens
aaacacaaccaguuccuaa

SEQ ID NO: 863847 - RNA, 19 nt, Homo sapiens
gaaagcaagauacugaugu

SEQ ID NO: 863848 - RNA, 19 nt, Homo sapiens
ggaagaacaaguccauuca

SEQ ID NO: 863849 - RNA, 19 nt, Homo sapiens
aaagauugcugagaguauu

SEQ ID NO: 863850 - RNA, 19 nt, Homo sapiens
gaaccuuucacaacuaaga

SEQ ID NO: 863851 - RNA, 19 nt, Homo sapiens
ggucacacccaaaucaauu

SEQ ID NO: 863852 - RNA, 19 nt, Homo sapiens
ucucucagauacaagauuu

SEQ ID NO: 863853 - RNA, 19 nt, Homo sapiens
ggaccuuucccuguacuua

SEQ ID NO: 863854 - RNA, 19 nt, Homo sapiens
gugcaacucucucagauac

SEQ ID NO: 863855 - RNA, 19 nt, Homo sapiens
caaacacgaguuaugaauu

SEQ ID NO: 863856 - RNA, 19 nt, Homo sapiens
gaagaacaaguccauucaa

SEQ ID NO: 863857 - RNA, 19 nt, Homo sapiens
aaagcaagauacugauguu

SEQ ID NO: 863858 - RNA, 19 nt, Homo sapiens
ccaaagaggaggccacaga

SEQ ID NO: 863859 - RNA, 19 nt, Homo sapiens
aaugugaagucaagucuga

SEQ ID NO: 863860 - RNA, 19 nt, Homo sapiens
ccaaaucaauuauguucag

SEQ ID NO: 863861 - RNA, 19 nt, Homo sapiens
acucacuucugaccaguua

SEQ ID NO: 863862 - RNA, 19 nt, Homo sapiens
gcgacucccucacaggaaa

SEQ ID NO: 863863 - RNA, 19 nt, Homo sapiens
ugaaaccaaacacgaguua

SEQ ID NO: 863864 - RNA, 19 nt, Homo sapiens
gggaaaagccacuaaauga

SEQ ID NO: 863865 - RNA, 19 nt, Homo sapiens
caacagucccugcuccauu

SEQ ID NO: 863866 - RNA, 19 nt, Homo sapiens
gaauaggacaacuacaaga

SEQ ID NO: 863867 - RNA, 19 nt, Homo sapiens
caaacuaucccuuuaugca

SEQ ID NO: 863868 - RNA, 19 nt, Homo sapiens
uguguacucuuccuauuga

SEQ ID NO: 863869 - RNA, 19 nt, Homo sapiens
ucagagaaugucuuuguaa

SEQ ID NO: 863870 - RNA, 19 nt, Homo sapiens
cugaaaugccuaaauauug

SEQ ID NO: 863871 - RNA, 19 nt, Homo sapiens
gugcaggaaucauuucauc

SEQ ID NO: 863872 - RNA, 19 nt, Homo sapiens
caccacaccugcuccucua

SEQ ID NO: 863873 - RNA, 19 nt, Homo sapiens
ccacaaacacaaccaguuc

SEQ ID NO: 863874 - RNA, 19 nt, Homo sapiens
gucaaacuaucccuuuaug

SEQ ID NO: 863875 - RNA, 19 nt, Homo sapiens
acacccaaaucaauuaugu

SEQ ID NO: 863876 - RNA, 19 nt, Homo sapiens
agagacagauauaaagcaa

SEQ ID NO: 863877 - RNA, 19 nt, Homo sapiens
ccaaauaaugucacuggaa

SEQ ID NO: 863878 - RNA, 19 nt, Homo sapiens
aagaaccuuucacaacuaa

SEQ ID NO: 863879 - RNA, 19 nt, Homo sapiens
ggaagaaacagaccaaucc

SEQ ID NO: 863880 - RNA, 19 nt, Homo sapiens
uuacccaccauaaauguua

SEQ ID NO: 863881 - RNA, 19 nt, Homo sapiens
guacucuuccuauugauga

SEQ ID NO: 863882 - RNA, 19 nt, Homo sapiens
ccgcauucauuuaaagcua

SEQ ID NO: 863883 - RNA, 19 nt, Homo sapiens
uaccuucuguuucaucauu

SEQ ID NO: 863884 - RNA, 19 nt, Homo sapiens
ccaguuaccaaucaaagaa

SEQ ID NO: 863885 - RNA, 19 nt, Homo sapiens
gggaagaacaaguccauuc

SEQ ID NO: 863886 - RNA, 19 nt, Homo sapiens
ccacacaucagaccuguuc

SEQ ID NO: 863887 - RNA, 19 nt, Homo sapiens
uaucagagaaugucuuugu

SEQ ID NO: 863888 - RNA, 19 nt, Homo sapiens
uaagaccucuaugaaugaa

SEQ ID NO: 863889 - RNA, 19 nt, Homo sapiens
caaaguuaccuucuguuuc

SEQ ID NO: 863890 - RNA, 19 nt, Homo sapiens
guuaugaauuccaggugaa

SEQ ID NO: 863891 - RNA, 19 nt, Homo sapiens
uguagagacugaaugugaa

SEQ ID NO: 863892 - RNA, 19 nt, Homo sapiens
ggaguuuaauaguuacaca

SEQ ID NO: 863893 - RNA, 19 nt, Homo sapiens
acaaaguuaccuucuguuu

SEQ ID NO: 863894 - RNA, 19 nt, Homo sapiens
aaaccuuuaccaccaaaua

SEQ ID NO: 863895 - RNA, 19 nt, Homo sapiens
ucacacuguuguaaugaug

SEQ ID NO: 863896 - RNA, 19 nt, Homo sapiens
aaugguagaugcugcacaa

SEQ ID NO: 863897 - RNA, 19 nt, Homo sapiens
cagagcaguucgccaggaa

SEQ ID NO: 863898 - RNA, 19 nt, Homo sapiens
gcucaagcccaacaagaga

SEQ ID NO: 863899 - RNA, 19 nt, Homo sapiens
ugacaagccacacaucaga

SEQ ID NO: 863900 - RNA, 19 nt, Homo sapiens
agucaagucugagcacaaa

SEQ ID NO: 863901 - RNA, 19 nt, Homo sapiens
uagaugcugcacaaaguua

SEQ ID NO: 863902 - RNA, 19 nt, Homo sapiens
gccaguuuguggauucauu

SEQ ID NO: 863903 - RNA, 19 nt, Homo sapiens
gccaguuucugcaggaaga

SEQ ID NO: 863904 - RNA, 19 nt, Homo sapiens
ugaaucagcggacccaaga

SEQ ID NO: 863905 - RNA, 19 nt, Homo sapiens
uaacugacuuuagcucaag

SEQ ID NO: 863906 - RNA, 19 nt, Homo sapiens
gaacaucacugcuccaaag

SEQ ID NO: 863907 - RNA, 19 nt, Homo sapiens
caacuaagauuugucaugu

SEQ ID NO: 863908 - RNA, 19 nt, Homo sapiens
caaagaagaccauauacaa

SEQ ID NO: 863909 - RNA, 19 nt, Homo sapiens
cagcagaccugaaaguugu

SEQ ID NO: 863910 - RNA, 19 nt, Homo sapiens
caagacagcagaccugaaa

SEQ ID NO: 863911 - RNA, 19 nt, Homo sapiens
gaaacagcccaucugcaua

SEQ ID NO: 863912 - RNA, 19 nt, Homo sapiens
ugcaagagcugccgaaaug

SEQ ID NO: 863913 - RNA, 19 nt, Homo sapiens
gcggugcccuggugaauga

SEQ ID NO: 863914 - RNA, 19 nt, Homo sapiens
gagaguacacagucauuaa

SEQ ID NO: 863915 - RNA, 19 nt, Homo sapiens
ggaaacagcccaucugcau

SEQ ID NO: 863916 - RNA, 19 nt, Homo sapiens
agagggaagucguggguua

SEQ ID NO: 863917 - RNA, 19 nt, Homo sapiens
aaacagcccaucugcauaa

SEQ ID NO: 863918 - RNA, 19 nt, Homo sapiens
gcacgugcguccuugacaa

SEQ ID NO: 863919 - RNA, 19 nt, Homo sapiens
gcaggaaugaggagaauga

SEQ ID NO: 863920 - RNA, 19 nt, Homo sapiens
gaucaaggcgucagaagau

SEQ ID NO: 863921 - RNA, 19 nt, Homo sapiens
ggagcagaguggaauauca

SEQ ID NO: 863922 - RNA, 19 nt, Homo sapiens
gaacuugccagcagaaugg

SEQ ID NO: 863923 - RNA, 19 nt, Homo sapiens
ggagugcugugaauaugau

SEQ ID NO: 863924 - RNA, 19 nt, Homo sapiens
ggaaagcuauccccuaaau

SEQ ID NO: 863925 - RNA, 19 nt, Homo sapiens
gaccauggcaucccaguga

SEQ ID NO: 863926 - RNA, 19 nt, Homo sapiens
aauaaggguuggcuucuga

SEQ ID NO: 863927 - RNA, 19 nt, Homo sapiens
ggagaguucuuccgaugca

SEQ ID NO: 863928 - RNA, 19 nt, Homo sapiens
caacggacgccaugcuaaa

SEQ ID NO: 863929 - RNA, 19 nt, Homo sapiens
gcugggaaguccaagauca

SEQ ID NO: 863930 - RNA, 19 nt, Homo sapiens
acuaagauuugucauguug

SEQ ID NO: 863931 - RNA, 19 nt, Homo sapiens
caacuccuauguucuuagu

SEQ ID NO: 863932 - RNA, 19 nt, Homo sapiens
aagacuggauugaaagaaa

SEQ ID NO: 863933 - RNA, 19 nt, Homo sapiens
gagaucugcccaugggaua

SEQ ID NO: 863934 - RNA, 19 nt, Homo sapiens
guaugacuauguugagguu

SEQ ID NO: 863935 - RNA, 19 nt, Homo sapiens
gugaauaugaucagauuga

SEQ ID NO: 863936 - RNA, 19 nt, Homo sapiens
aggguuggcuucugaacua

SEQ ID NO: 863937 - RNA, 19 nt, Homo sapiens
gauuuggccugugaacuug

SEQ ID NO: 863938 - RNA, 19 nt, Homo sapiens
uccgauggcuccaagaauu

SEQ ID NO: 863939 - RNA, 19 nt, Homo sapiens
caaccgcgauggccagauc

SEQ ID NO: 863940 - RNA, 19 nt, Homo sapiens
uaccuuggaugacuucuau

SEQ ID NO: 863941 - RNA, 19 nt, Homo sapiens
gucagaagauucauugucu

SEQ ID NO: 863942 - RNA, 19 nt, Homo sapiens
ccaagagaguacacaguca

SEQ ID NO: 863943 - RNA, 19 nt, Homo sapiens
uuggaugacuucuauguga

SEQ ID NO: 863944 - RNA, 19 nt, Homo sapiens
ugccagggcuucugacuuc

SEQ ID NO: 863945 - RNA, 19 nt, Homo sapiens
uggacucgcugcuguguga

SEQ ID NO: 863946 - RNA, 19 nt, Homo sapiens
caagggagcgugguuccua

SEQ ID NO: 863947 - RNA, 19 nt, Homo sapiens
gguuguaccaucuuugaaa

SEQ ID NO: 863948 - RNA, 19 nt, Homo sapiens
gggaaggucaccaugauca

SEQ ID NO: 863949 - RNA, 19 nt, Homo sapiens
ggcuggaccuuacaagugu

SEQ ID NO: 863950 - RNA, 19 nt, Homo sapiens
ccaagaauuuugacgguuu

SEQ ID NO: 863951 - RNA, 19 nt, Homo sapiens
ucaaagaagaccauauaca

SEQ ID NO: 863952 - RNA, 19 nt, Homo sapiens
agacuggauugaaagaaau

SEQ ID NO: 863953 - RNA, 19 nt, Homo sapiens
auccagagccuacagauuu

SEQ ID NO: 863954 - RNA, 19 nt, Homo sapiens
uuucagaccuggugagaag

SEQ ID NO: 863955 - RNA, 19 nt, Homo sapiens
gaucaucaagcgugucugu

SEQ ID NO: 863956 - RNA, 19 nt, Homo sapiens
ggucagauuuuguuggaaa

SEQ ID NO: 863957 - RNA, 19 nt, Homo sapiens
cuacuaggacagccaauug

SEQ ID NO: 863958 - RNA, 19 nt, Homo sapiens
gaaauucuaccgggaugau

SEQ ID NO: 863959 - RNA, 19 nt, Homo sapiens
gagaaccaaagauuucaga

SEQ ID NO: 863960 - RNA, 19 nt, Homo sapiens
gugugggccugaaguguga

SEQ ID NO: 863961 - RNA, 19 nt, Homo sapiens
gaugaugaccgggaugaga

SEQ ID NO: 863962 - RNA, 19 nt, Homo sapiens
caagggagacaccauuaca

SEQ ID NO: 863963 - RNA, 19 nt, Homo sapiens
gagcagaguggaauaucau

SEQ ID NO: 863964 - RNA, 19 nt, Homo sapiens
uaagauuugucauguugag

SEQ ID NO: 863965 - RNA, 19 nt, Homo sapiens
uaaagacuggauugaaaga

SEQ ID NO: 863966 - RNA, 19 nt, Homo sapiens
ggauaccaacaucugcaua

SEQ ID NO: 863967 - RNA, 19 nt, Homo sapiens
gaguacacagucauuaaug

SEQ ID NO: 863968 - RNA, 19 nt, Homo sapiens
gucaagggagacaccauua

SEQ ID NO: 863969 - RNA, 19 nt, Homo sapiens
cauaaaagccugccgagaa

SEQ ID NO: 863970 - RNA, 19 nt, Homo sapiens
gaagcagugugggccugaa

SEQ ID NO: 863971 - RNA, 19 nt, Homo sapiens
ugacaucgccauccugaag

SEQ ID NO: 863972 - RNA, 19 nt, Homo sapiens
ggguuugucauccaacuaa

SEQ ID NO: 863973 - RNA, 19 nt, Homo sapiens
ugauuuggccugugaacuu

SEQ ID NO: 863974 - RNA, 19 nt, Homo sapiens
cugugaauaugaucagauu

SEQ ID NO: 863975 - RNA, 19 nt, Homo sapiens
cgaugcagguucagucaag

SEQ ID NO: 863976 - RNA, 19 nt, Homo sapiens
gccgagaaccaaagauuuc

SEQ ID NO: 863977 - RNA, 19 nt, Homo sapiens
gugccaguaugacuauguu

SEQ ID NO: 863978 - RNA, 19 nt, Homo sapiens
gacuacaugugccaguaug

SEQ ID NO: 863979 - RNA, 19 nt, Homo sapiens
ccaacuaagauuugucaug

SEQ ID NO: 863980 - RNA, 19 nt, Homo sapiens
gagcugggauguggugcau

SEQ ID NO: 863981 - RNA, 19 nt, Homo sapiens
ugccagggcuugcaagaag

SEQ ID NO: 863982 - RNA, 19 nt, Homo sapiens
ggacagccaauuggaagau

SEQ ID NO: 863983 - RNA, 19 nt, Homo sapiens
gacagcagaccugaaaguu

SEQ ID NO: 863984 - RNA, 19 nt, Homo sapiens
ggaaggucaccaugaucaa

SEQ ID NO: 863985 - RNA, 19 nt, Homo sapiens
ugucauccaacuaagauuu

SEQ ID NO: 863986 - RNA, 19 nt, Homo sapiens
gaaugaggagaaugagugu

SEQ ID NO: 863987 - RNA, 19 nt, Homo sapiens
gugcaugccuuuguguaca

SEQ ID NO: 863988 - RNA, 19 nt, Homo sapiens
ggagcgugguuccuagucu

SEQ ID NO: 863989 - RNA, 19 nt, Homo sapiens
gagaacaucacugcuccaa

SEQ ID NO: 863990 - RNA, 19 nt, Homo sapiens
gagugcaucucacccuucu

SEQ ID NO: 863991 - RNA, 19 nt, Homo sapiens
cauugucuguccuugaaga

SEQ ID NO: 863992 - RNA, 19 nt, Homo sapiens
caugcgauguggccagguu

SEQ ID NO: 863993 - RNA, 19 nt, Homo sapiens
uggaugacuucuaugugaa

SEQ ID NO: 863994 - RNA, 19 nt, Homo sapiens
gggagugcugugaauauga

SEQ ID NO: 863995 - RNA, 19 nt, Homo sapiens
ggagaguggucagggaaac

SEQ ID NO: 863996 - RNA, 19 nt, Homo sapiens
uguugagccuggaguuuga

SEQ ID NO: 863997 - RNA, 19 nt, Homo sapiens
ggauguggugcaugccuuu

SEQ ID NO: 863998 - RNA, 19 nt, Homo sapiens
gcagaguggaauaucaugu

SEQ ID NO: 863999 - RNA, 19 nt, Homo sapiens
agagaguacacagucauua

SEQ ID NO: 864000 - RNA, 19 nt, Homo sapiens
gaaaguuguuuuggggaaa

SEQ ID NO: 864001 - RNA, 19 nt, Homo sapiens
gggcagcgcugugaaaauc

SEQ ID NO: 864002 - RNA, 19 nt, Homo sapiens
gaauaugaucagauugagu

SEQ ID NO: 864003 - RNA, 19 nt, Homo sapiens
gacuggauugaaagaaaua

SEQ ID NO: 864004 - RNA, 19 nt, Homo sapiens
cagguuguaccaucuuuga

SEQ ID NO: 864005 - RNA, 19 nt, Homo sapiens
gaaggucaccaugaucaag

SEQ ID NO: 864006 - RNA, 19 nt, Homo sapiens
ggagggagcucuuaaggaa

SEQ ID NO: 864007 - RNA, 19 nt, Homo sapiens
caacaacccugagcgauuu

SEQ ID NO: 864008 - RNA, 19 nt, Homo sapiens
ugaaggagcuggcggauga

SEQ ID NO: 864009 - RNA, 19 nt, Homo sapiens
gaaacccuaucucuacuaa

SEQ ID NO: 864010 - RNA, 19 nt, Homo sapiens
ggaaaguccucgcugcauu

SEQ ID NO: 864011 - RNA, 19 nt, Homo sapiens
ggucagcacuugauucguu

SEQ ID NO: 864012 - RNA, 19 nt, Homo sapiens
ggagcaaucucaaccucua

SEQ ID NO: 864013 - RNA, 19 nt, Homo sapiens
ucauucaacucguucuuua

SEQ ID NO: 864014 - RNA, 19 nt, Homo sapiens
ggauuucuaugcauucauu

SEQ ID NO: 864015 - RNA, 19 nt, Homo sapiens
gaaagggaaugaguacaug

SEQ ID NO: 864016 - RNA, 19 nt, Homo sapiens
uuacaaagcucauucuucu

SEQ ID NO: 864017 - RNA, 19 nt, Homo sapiens
uuagagccauuccuuuaua

SEQ ID NO: 864018 - RNA, 19 nt, Homo sapiens
agaauggucugauacuauu

SEQ ID NO: 864019 - RNA, 19 nt, Homo sapiens
gaugucuuccuucaaauua

SEQ ID NO: 864020 - RNA, 19 nt, Homo sapiens
gaaguaaggcugucacaag

SEQ ID NO: 864021 - RNA, 19 nt, Homo sapiens
ucacauuuccuaugacuuu

SEQ ID NO: 864022 - RNA, 19 nt, Homo sapiens
gaacuuaugaggaaagagu

SEQ ID NO: 864023 - RNA, 19 nt, Homo sapiens
gaaaguccucgcugcauug

SEQ ID NO: 864024 - RNA, 19 nt, Homo sapiens
ccuaugacuuuacucaauu

SEQ ID NO: 864025 - RNA, 19 nt, Homo sapiens
cuaugaagccggugaaauu

SEQ ID NO: 864026 - RNA, 19 nt, Homo sapiens
caagacacacugccaagaa

SEQ ID NO: 864027 - RNA, 19 nt, Homo sapiens
ggaaggagaaaguggaaau

SEQ ID NO: 864028 - RNA, 19 nt, Homo sapiens
gaucacaagcucaggaguu

SEQ ID NO: 864029 - RNA, 19 nt, Homo sapiens
ucacuaacuccuagacuuu

SEQ ID NO: 864030 - RNA, 19 nt, Homo sapiens
guugcuuccuucuggauua

SEQ ID NO: 864031 - RNA, 19 nt, Homo sapiens
ccauuuaggucagcacuug

SEQ ID NO: 864032 - RNA, 19 nt, Homo sapiens
acaaagcucauucuucuga

SEQ ID NO: 864033 - RNA, 19 nt, Homo sapiens
ucuuaccucuuacuguuua

SEQ ID NO: 864034 - RNA, 19 nt, Homo sapiens
aguaucaccuccuuaauuc

SEQ ID NO: 864035 - RNA, 19 nt, Homo sapiens
agacauggcaauucuuaaa

SEQ ID NO: 864036 - RNA, 19 nt, Homo sapiens
ucaaauuaaugaccuugga

SEQ ID NO: 864037 - RNA, 19 nt, Homo sapiens
gauuggaguuugagaagca

SEQ ID NO: 864038 - RNA, 19 nt, Homo sapiens
caguaucaccuccuuaauu

SEQ ID NO: 864039 - RNA, 19 nt, Homo sapiens
gcaaucucaaccucuauuu

SEQ ID NO: 864040 - RNA, 19 nt, Homo sapiens
ggugaaacccuaucucuac

SEQ ID NO: 864041 - RNA, 19 nt, Homo sapiens
gauccugcuucugauguaa

SEQ ID NO: 864042 - RNA, 19 nt, Homo sapiens
ccaacaacccugagcgauu

SEQ ID NO: 864043 - RNA, 19 nt, Homo sapiens
uuagacauggcaauucuua

SEQ ID NO: 864044 - RNA, 19 nt, Homo sapiens
aagacacacugccaagaaa

SEQ ID NO: 864045 - RNA, 19 nt, Homo sapiens
gcuuccuucuggauuaaua

SEQ ID NO: 864046 - RNA, 19 nt, Homo sapiens
uuucuuaccucuuacuguu

SEQ ID NO: 864047 - RNA, 19 nt, Homo sapiens
guaaauggagcaaucucaa

SEQ ID NO: 864048 - RNA, 19 nt, Homo sapiens
caaagcucauucuucugaa

SEQ ID NO: 864049 - RNA, 19 nt, Homo sapiens
ggaguggggugaaggauau

SEQ ID NO: 864050 - RNA, 19 nt, Homo sapiens
gcauaugggaagauuauag

SEQ ID NO: 864051 - RNA, 19 nt, Homo sapiens
gacaaaagagggaauauga

SEQ ID NO: 864052 - RNA, 19 nt, Homo sapiens
caaaagagggaauaugaaa

SEQ ID NO: 864053 - RNA, 19 nt, Homo sapiens
caacucuucucuggucuuc

SEQ ID NO: 864054 - RNA, 19 nt, Homo sapiens
ggaguccugagcagaagua

SEQ ID NO: 864055 - RNA, 19 nt, Homo sapiens
uagagccauuccuuuauau

SEQ ID NO: 864056 - RNA, 19 nt, Homo sapiens
ucaggugcaucuccgaguu

SEQ ID NO: 864057 - RNA, 19 nt, Homo sapiens
gaaggagaaaguggaaaug

SEQ ID NO: 864058 - RNA, 19 nt, Homo sapiens
cacauuuccuaugacuuua

SEQ ID NO: 864059 - RNA, 19 nt, Homo sapiens
gggaagauuauagagcaua

SEQ ID NO: 864060 - RNA, 19 nt, Homo sapiens
ucauuuagauccugcuucu

SEQ ID NO: 864061 - RNA, 19 nt, Homo sapiens
ugaugcaacuccucuuauc

SEQ ID NO: 864062 - RNA, 19 nt, Homo sapiens
aggcagcgcuucagauugg

SEQ ID NO: 864063 - RNA, 19 nt, Homo sapiens
gcagaggcagcgcuucaga

SEQ ID NO: 864064 - RNA, 19 nt, Homo sapiens
cauaugggaagauuauaga

SEQ ID NO: 864065 - RNA, 19 nt, Homo sapiens
gggaggagggagcucuuaa

SEQ ID NO: 864066 - RNA, 19 nt, Homo sapiens
caacauggugaaacccuau

SEQ ID NO: 864067 - RNA, 19 nt, Homo sapiens
ucaacucguucuuuaaugc

SEQ ID NO: 864068 - RNA, 19 nt, Homo sapiens
uauauggucacauuuccua

SEQ ID NO: 864069 - RNA, 19 nt, Homo sapiens
gaucaucucuaaaauucug

SEQ ID NO: 864070 - RNA, 19 nt, Homo sapiens
agauggcucuggaacuuau

SEQ ID NO: 864071 - RNA, 19 nt, Homo sapiens
gcacccgagucugcucuug

SEQ ID NO: 864072 - RNA, 19 nt, Homo sapiens
ccuucuggauuaauacauu

SEQ ID NO: 864073 - RNA, 19 nt, Homo sapiens
ucucucucguuccuuauuu

SEQ ID NO: 864074 - RNA, 19 nt, Homo sapiens
gacauggcaauucuuaaau

SEQ ID NO: 864075 - RNA, 19 nt, Homo sapiens
uaugaagccggugaaauuu

SEQ ID NO: 864076 - RNA, 19 nt, Homo sapiens
uugcagagcuucucaucag

SEQ ID NO: 864077 - RNA, 19 nt, Homo sapiens
ugaaagggaaugaguacau

SEQ ID NO: 864078 - RNA, 19 nt, Homo sapiens
gaaguuccaagugggugua

SEQ ID NO: 864079 - RNA, 19 nt, Homo sapiens
ccuguaaucccagcacuuu

SEQ ID NO: 864080 - RNA, 19 nt, Homo sapiens
auuuagagccauuccuuua

SEQ ID NO: 864081 - RNA, 19 nt, Homo sapiens
agaggcagcgcuucagauu

SEQ ID NO: 864082 - RNA, 19 nt, Homo sapiens
acucuucucuggucuucuu

SEQ ID NO: 864083 - RNA, 19 nt, Homo sapiens
ggacuaugaagccggugaa

SEQ ID NO: 864084 - RNA, 19 nt, Homo sapiens
aaaagacugucauuuggaa

SEQ ID NO: 864085 - RNA, 19 nt, Homo sapiens
ggcccugcauccuggguuu

SEQ ID NO: 864086 - RNA, 19 nt, Homo sapiens
ugugaugcaacuccucuua

SEQ ID NO: 864087 - RNA, 19 nt, Homo sapiens
cguuguugcugugaaauau

SEQ ID NO: 864088 - RNA, 19 nt, Homo sapiens
gcauugggauuuucuugga

SEQ ID NO: 864089 - RNA, 19 nt, Homo sapiens
gugaaacccuaucucuacu

SEQ ID NO: 864090 - RNA, 19 nt, Homo sapiens
ugaggcggguggaucacaa

SEQ ID NO: 864091 - RNA, 19 nt, Homo sapiens
ccagguaaagcuccagaug

SEQ ID NO: 864092 - RNA, 19 nt, Homo sapiens
uccuuuauauggucacauu

SEQ ID NO: 864093 - RNA, 19 nt, Homo sapiens
uaacagauaccccauuuag

SEQ ID NO: 864094 - RNA, 19 nt, Homo sapiens
ugcaacuccucuuaucuug

SEQ ID NO: 864095 - RNA, 19 nt, Homo sapiens
cuaauaucacuaacuccua

SEQ ID NO: 864096 - RNA, 19 nt, Homo sapiens
uccuaugacuuuacucaau

SEQ ID NO: 864097 - RNA, 19 nt, Homo sapiens
caaauuaaugaccuuggau

SEQ ID NO: 864098 - RNA, 19 nt, Homo sapiens
cuucugauguaagagauga

SEQ ID NO: 864099 - RNA, 19 nt, Homo sapiens
gaggagggagcucuuaagg

SEQ ID NO: 864100 - RNA, 19 nt, Homo sapiens
ggaggagggagcucuuaag

SEQ ID NO: 864101 - RNA, 19 nt, Homo sapiens
aacccuaucucuacuaaaa

SEQ ID NO: 864102 - RNA, 19 nt, Homo sapiens
ugaaacccuaucucuacua

SEQ ID NO: 864103 - RNA, 19 nt, Homo sapiens
auggucacauuuccuauga

SEQ ID NO: 864104 - RNA, 19 nt, Homo sapiens
gcuucagauuggaguuuga

SEQ ID NO: 864105 - RNA, 19 nt, Homo sapiens
aaaauucuguucccaagau

SEQ ID NO: 864106 - RNA, 19 nt, Homo sapiens
gaaggaggaugguaaggua

SEQ ID NO: 864107 - RNA, 19 nt, Homo sapiens
caagaacucuggcgaggua

SEQ ID NO: 864108 - RNA, 19 nt, Homo sapiens
ggagauauaugggauguga

SEQ ID NO: 864109 - RNA, 19 nt, Homo sapiens
gcaauuauuucgagaguca

SEQ ID NO: 864110 - RNA, 19 nt, Homo sapiens
agaaggagcuuauggucua

SEQ ID NO: 864111 - RNA, 19 nt, Homo sapiens
ggacagagagcuucuuuca

SEQ ID NO: 864112 - RNA, 19 nt, Homo sapiens
gcuugaaugugauuucuuu

SEQ ID NO: 864113 - RNA, 19 nt, Homo sapiens
gaagaauacuguaccuagu

SEQ ID NO: 864114 - RNA, 19 nt, Homo sapiens
caacagauauugugcucau

SEQ ID NO: 864115 - RNA, 19 nt, Homo sapiens
ccaaguagcugggacuaga

SEQ ID NO: 864116 - RNA, 19 nt, Homo sapiens
ggacuguaguuucuucaug

SEQ ID NO: 864117 - RNA, 19 nt, Homo sapiens
gaaaggagcacgggacaga

SEQ ID NO: 864118 - RNA, 19 nt, Homo sapiens
caucaugucuucccugcaa

SEQ ID NO: 864119 - RNA, 19 nt, Homo sapiens
ucucuuuacuuacugcuua

SEQ ID NO: 864120 - RNA, 19 nt, Homo sapiens
caucaguccuuccuuccua

SEQ ID NO: 864121 - RNA, 19 nt, Homo sapiens
ccacaaacaugaggaccaa

SEQ ID NO: 864122 - RNA, 19 nt, Homo sapiens
agaggacgaugucauagaa

SEQ ID NO: 864123 - RNA, 19 nt, Homo sapiens
gcccugagccugugcaauu

SEQ ID NO: 864124 - RNA, 19 nt, Homo sapiens
gcauggacauuugugauuc

SEQ ID NO: 864125 - RNA, 19 nt, Homo sapiens
caccacacccggcuaauuu

SEQ ID NO: 864126 - RNA, 19 nt, Homo sapiens
gauaauccucugccugaaa

SEQ ID NO: 864127 - RNA, 19 nt, Homo sapiens
gugguuuacuccugucuaa

SEQ ID NO: 864128 - RNA, 19 nt, Homo sapiens
ggagugcaguggugugauc

SEQ ID NO: 864129 - RNA, 19 nt, Homo sapiens
ggacauuugugauucucau

SEQ ID NO: 864130 - RNA, 19 nt, Homo sapiens
cugcagagcuguccuuugg

SEQ ID NO: 864131 - RNA, 19 nt, Homo sapiens
ucaccaaccacacaaguuu

SEQ ID NO: 864132 - RNA, 19 nt, Homo sapiens
gcacauagucaccuucucu

SEQ ID NO: 864133 - RNA, 19 nt, Homo sapiens
ccauuccuguugcuguuua

SEQ ID NO: 864134 - RNA, 19 nt, Homo sapiens
ugucuucccugcaaacuau

SEQ ID NO: 864135 - RNA, 19 nt, Homo sapiens
gcaagaaccuaacuuuuac

SEQ ID NO: 864136 - RNA, 19 nt, Homo sapiens
gaaggaacuguguaucuca

SEQ ID NO: 864137 - RNA, 19 nt, Homo sapiens
uguaguuucuucaugcuuu

SEQ ID NO: 864138 - RNA, 19 nt, Homo sapiens
ugagagcagugauuguaga

SEQ ID NO: 864139 - RNA, 19 nt, Homo sapiens
ggauuucccuggccucucu

SEQ ID NO: 864140 - RNA, 19 nt, Homo sapiens
gauugaccaucaugucuuc

SEQ ID NO: 864141 - RNA, 19 nt, Homo sapiens
gaaggaagaagccucaaac

SEQ ID NO: 864142 - RNA, 19 nt, Homo sapiens
ucacugaucacuuccauuc

SEQ ID NO: 864143 - RNA, 19 nt, Homo sapiens
cagagaaggaggaugguaa

SEQ ID NO: 864144 - RNA, 19 nt, Homo sapiens
gaagagccaguucuguuuc

SEQ ID NO: 864145 - RNA, 19 nt, Homo sapiens
gcaagaaggagcuuauggu

SEQ ID NO: 864146 - RNA, 19 nt, Homo sapiens
uaugggaccuuaauuuguc

SEQ ID NO: 864147 - RNA, 19 nt, Homo sapiens
gauguacucuuuguucucu

SEQ ID NO: 864148 - RNA, 19 nt, Homo sapiens
caaaauuaccuuccuauug

SEQ ID NO: 864149 - RNA, 19 nt, Homo sapiens
cuaacacaguuccuaaugu

SEQ ID NO: 864150 - RNA, 19 nt, Homo sapiens
gacugucacugaucacuuc

SEQ ID NO: 864151 - RNA, 19 nt, Homo sapiens
gaccuuaauuugucuugca

SEQ ID NO: 864152 - RNA, 19 nt, Homo sapiens
gcuauugccaccugucaaa

SEQ ID NO: 864153 - RNA, 19 nt, Homo sapiens
cgcaaacucuugugaucuu

SEQ ID NO: 864154 - RNA, 19 nt, Homo sapiens
guacuaaguucuuuucauc

SEQ ID NO: 864155 - RNA, 19 nt, Homo sapiens
ucacggaacaucauugugu

SEQ ID NO: 864156 - RNA, 19 nt, Homo sapiens
ugacaucacccuugcuguu

SEQ ID NO: 864157 - RNA, 19 nt, Homo sapiens
gaccaucacgcagaacuuu

SEQ ID NO: 864158 - RNA, 19 nt, Homo sapiens
caaauucucgaacccauuc

SEQ ID NO: 864159 - RNA, 19 nt, Homo sapiens
uacacagaauggacuuuaa

SEQ ID NO: 864160 - RNA, 19 nt, Homo sapiens
ccuaauguguuuugccuua

SEQ ID NO: 864161 - RNA, 19 nt, Homo sapiens
ccaaagugcugggauugca

SEQ ID NO: 864162 - RNA, 19 nt, Homo sapiens
acacagaauggacuuuaaa

SEQ ID NO: 864163 - RNA, 19 nt, Homo sapiens
uggcagcacuaguguuaga

SEQ ID NO: 864164 - RNA, 19 nt, Homo sapiens
uacaaggaaucccagaguu

SEQ ID NO: 864165 - RNA, 19 nt, Homo sapiens
ccaucuaucuggccuccaa

SEQ ID NO: 864166 - RNA, 19 nt, Homo sapiens
ccugaagccuaacacaguu

SEQ ID NO: 864167 - RNA, 19 nt, Homo sapiens
uuaccuuccuauugcauuu

SEQ ID NO: 864168 - RNA, 19 nt, Homo sapiens
ccugaagccuaacacaguu

SEQ ID NO: 864169 - RNA, 19 nt, Homo sapiens
gaucacggaacaucauugu

SEQ ID NO: 864170 - RNA, 19 nt, Homo sapiens
uuacacagaauggacuuua

SEQ ID NO: 864171 - RNA, 19 nt, Homo sapiens
ucuggcagcacuaguguua

SEQ ID NO: 864172 - RNA, 19 nt, Homo sapiens
ugaggugccugcuuacaag

SEQ ID NO: 864173 - RNA, 19 nt, Homo sapiens
cagauauugugcucauuca

SEQ ID NO: 864174 - RNA, 19 nt, Homo sapiens
gcagaagaauacuguaccu

SEQ ID NO: 864175 - RNA, 19 nt, Homo sapiens
gacaggguuucgccauguu

SEQ ID NO: 864176 - RNA, 19 nt, Homo sapiens
gaugugagagcagugauug

SEQ ID NO: 864177 - RNA, 19 nt, Homo sapiens
ugaaggaacuguguaucuc

SEQ ID NO: 864178 - RNA, 19 nt, Homo sapiens
cauaaaauguuacccacaa

SEQ ID NO: 864179 - RNA, 19 nt, Homo sapiens
cauuauucuuugccucuuu

SEQ ID NO: 864180 - RNA, 19 nt, Homo sapiens
guacuuagucuguguccau

SEQ ID NO: 864181 - RNA, 19 nt, Homo sapiens
gcaaacucuugugaucuuc

SEQ ID NO: 864182 - RNA, 19 nt, Homo sapiens
gagccuugaucacggaaca

SEQ ID NO: 864183 - RNA, 19 nt, Homo sapiens
gcuuucacuuccuguagaa

SEQ ID NO: 864184 - RNA, 19 nt, Homo sapiens
guagggcugugguuuacuc

SEQ ID NO: 864185 - RNA, 19 nt, Homo sapiens
uguacucuuuguucucuaa

SEQ ID NO: 864186 - RNA, 19 nt, Homo sapiens
gggcaugugcugaccauca

SEQ ID NO: 864187 - RNA, 19 nt, Homo sapiens
gaaggagcuuauggucuag

SEQ ID NO: 864188 - RNA, 19 nt, Homo sapiens
ggauugaccaucaugucuu

SEQ ID NO: 864189 - RNA, 19 nt, Homo sapiens
uuacucgcuuuguuuaaug

SEQ ID NO: 864190 - RNA, 19 nt, Homo sapiens
gugcaauuauuucgagagu

SEQ ID NO: 864191 - RNA, 19 nt, Homo sapiens
ugaaugugauuucuuucuc

SEQ ID NO: 864192 - RNA, 19 nt, Homo sapiens
aaaauuaccuuccuauugc

SEQ ID NO: 864193 - RNA, 19 nt, Homo sapiens
cccugagccugugcaauua

SEQ ID NO: 864194 - RNA, 19 nt, Homo sapiens
ggaacuguguaucucaaaa

SEQ ID NO: 864195 - RNA, 19 nt, Homo sapiens
ccuccaagaugagaaagga

SEQ ID NO: 864196 - RNA, 19 nt, Homo sapiens
gggcugauaucguguaccu

SEQ ID NO: 864197 - RNA, 19 nt, Homo sapiens
ggacgaugucauagaacaa

SEQ ID NO: 864198 - RNA, 19 nt, Homo sapiens
ugcaagaaccuaacuuuua

SEQ ID NO: 864199 - RNA, 19 nt, Homo sapiens
cuaaaccccugaagccuaa

SEQ ID NO: 864200 - RNA, 19 nt, Homo sapiens
ggguagggcugugguuuac

SEQ ID NO: 864201 - RNA, 19 nt, Homo sapiens
gaggguagggcugugguuu

SEQ ID NO: 864202 - RNA, 19 nt, Homo sapiens
ugacuucuuucacacucuu

SEQ ID NO: 864203 - RNA, 19 nt, Homo sapiens
ugugagagcagugauugua

SEQ ID NO: 864204 - RNA, 19 nt, Homo sapiens
ccuccuucccucuuuguua

SEQ ID NO: 864205 - RNA, 19 nt, Homo sapiens
uaaugaaggaacuguguau

SEQ ID NO: 864206 - RNA, 19 nt, Homo sapiens
caacuuaucuguacuugua

SEQ ID NO: 864207 - RNA, 19 nt, Homo sapiens
gaagaaugaugucuguaua

SEQ ID NO: 864208 - RNA, 19 nt, Homo sapiens
gcagagcuguuuacugaua

SEQ ID NO: 864209 - RNA, 19 nt, Homo sapiens
gaaaguaaggcaguaauua

SEQ ID NO: 864210 - RNA, 19 nt, Homo sapiens
caagagugcuguuaccaua

SEQ ID NO: 864211 - RNA, 19 nt, Homo sapiens
gaauauggaucuacuggaa

SEQ ID NO: 864212 - RNA, 19 nt, Homo sapiens
gaucugaaauuacuugcua

SEQ ID NO: 864213 - RNA, 19 nt, Homo sapiens
gaagaaugcucaucauagu

SEQ ID NO: 864214 - RNA, 19 nt, Homo sapiens
guacaccacugaauccuuu

SEQ ID NO: 864215 - RNA, 19 nt, Homo sapiens
uaaagagacuugcuauuca

SEQ ID NO: 864216 - RNA, 19 nt, Homo sapiens
gaaagaugccaaugguaua

SEQ ID NO: 864217 - RNA, 19 nt, Homo sapiens
gaacuuugcuauccuugga

SEQ ID NO: 864218 - RNA, 19 nt, Homo sapiens
ggacaagacuacaagauac

SEQ ID NO: 864219 - RNA, 19 nt, Homo sapiens
acugauaucucaugcaaua

SEQ ID NO: 864220 - RNA, 19 nt, Homo sapiens
ccaguagacuugaagcuaa

SEQ ID NO: 864221 - RNA, 19 nt, Homo sapiens
ccuaagaucuggcaaacuu

SEQ ID NO: 864222 - RNA, 19 nt, Homo sapiens
ggaagucuggcaucaauaa

SEQ ID NO: 864223 - RNA, 19 nt, Homo sapiens
ggacaaaggccuaagaucu

SEQ ID NO: 864224 - RNA, 19 nt, Homo sapiens
guaaagagacuugcuauuc

SEQ ID NO: 864225 - RNA, 19 nt, Homo sapiens
ucccagaacuaccauauuu

SEQ ID NO: 864226 - RNA, 19 nt, Homo sapiens
ccaaugagauggagcaaag

SEQ ID NO: 864227 - RNA, 19 nt, Homo sapiens
aaagauugcucuaaacugu

SEQ ID NO: 864228 - RNA, 19 nt, Homo sapiens
gcaccaugaugcaaucuug

SEQ ID NO: 864229 - RNA, 19 nt, Homo sapiens
gaggcuauguguucuuaaa

SEQ ID NO: 864230 - RNA, 19 nt, Homo sapiens
guaauagccugaagacaag

SEQ ID NO: 864231 - RNA, 19 nt, Homo sapiens
aaacuucucugcacaguca

SEQ ID NO: 864232 - RNA, 19 nt, Homo sapiens
ucaagacgcugcccggauu

SEQ ID NO: 864233 - RNA, 19 nt, Homo sapiens
caucaaacauuacuucagu

SEQ ID NO: 864234 - RNA, 19 nt, Homo sapiens
ggucgcaucuccaaucaga

SEQ ID NO: 864235 - RNA, 19 nt, Homo sapiens
caagccuucucucaacuua

SEQ ID NO: 864236 - RNA, 19 nt, Homo sapiens
uugcauugcugaaucuuua

SEQ ID NO: 864237 - RNA, 19 nt, Homo sapiens
gaguuuggcuacugugauu

SEQ ID NO: 864238 - RNA, 19 nt, Homo sapiens
ggaagaaugcucaucauag

SEQ ID NO: 864239 - RNA, 19 nt, Homo sapiens
ccauugcuguccagaauaa

SEQ ID NO: 864240 - RNA, 19 nt, Homo sapiens
caucauugcuuugcugaaa

SEQ ID NO: 864241 - RNA, 19 nt, Homo sapiens
gcaauagaagcccugauuu

SEQ ID NO: 864242 - RNA, 19 nt, Homo sapiens
gaguuuagauucacaugau

SEQ ID NO: 864243 - RNA, 19 nt, Homo sapiens
caacaaagugagaaacauu

SEQ ID NO: 864244 - RNA, 19 nt, Homo sapiens
guaggaaucuguaacaaaa

SEQ ID NO: 864245 - RNA, 19 nt, Homo sapiens
uaucaauucugcauuccua

SEQ ID NO: 864246 - RNA, 19 nt, Homo sapiens
gaguaaaucuggacaagac

SEQ ID NO: 864247 - RNA, 19 nt, Homo sapiens
ggaaaguaaggcaguaauu

SEQ ID NO: 864248 - RNA, 19 nt, Homo sapiens
ucaagaccauccuggcuaa

SEQ ID NO: 864249 - RNA, 19 nt, Homo sapiens
caacaugaccaaugagaug

SEQ ID NO: 864250 - RNA, 19 nt, Homo sapiens
aaagaagaaugaugucugu

SEQ ID NO: 864251 - RNA, 19 nt, Homo sapiens
caaacucaacuaagucuuu

SEQ ID NO: 864252 - RNA, 19 nt, Homo sapiens
gccaugaccuuaggaaaug

SEQ ID NO: 864253 - RNA, 19 nt, Homo sapiens
ugacucagguugccucaga

SEQ ID NO: 864254 - RNA, 19 nt, Homo sapiens
gcuauguguucuuaaaguu

SEQ ID NO: 864255 - RNA, 19 nt, Homo sapiens
gaacacacaacauuacagu

SEQ ID NO: 864256 - RNA, 19 nt, Homo sapiens
ggaacuggaugccaacucu

SEQ ID NO: 864257 - RNA, 19 nt, Homo sapiens
gaugccaacucugcccuua

SEQ ID NO: 864258 - RNA, 19 nt, Homo sapiens
caauuucuguugaacuuug

SEQ ID NO: 864259 - RNA, 19 nt, Homo sapiens
gauaucucaugcaauagaa

SEQ ID NO: 864260 - RNA, 19 nt, Homo sapiens
ccaucgccaucaaacauua

SEQ ID NO: 864261 - RNA, 19 nt, Homo sapiens
ucaggccacuuuaaagauu

SEQ ID NO: 864262 - RNA, 19 nt, Homo sapiens
aaagagacuugcuauucaa

SEQ ID NO: 864263 - RNA, 19 nt, Homo sapiens
gguagaguuugcaagcuuu

SEQ ID NO: 864264 - RNA, 19 nt, Homo sapiens
caguguaguucauuuauuc

SEQ ID NO: 864265 - RNA, 19 nt, Homo sapiens
caaauugccagaaacaguu

SEQ ID NO: 864266 - RNA, 19 nt, Homo sapiens
ccaaugguauaguauggaa

SEQ ID NO: 864267 - RNA, 19 nt, Homo sapiens
ggagguagaaucacucaau

SEQ ID NO: 864268 - RNA, 19 nt, Homo sapiens
cagacaggcuuccagaaug

SEQ ID NO: 864269 - RNA, 19 nt, Homo sapiens
gagaaacauuuggagaaga

SEQ ID NO: 864270 - RNA, 19 nt, Homo sapiens
gcccauugcuguccagaau

SEQ ID NO: 864271 - RNA, 19 nt, Homo sapiens
gcaguaaagagacuugcua

SEQ ID NO: 864272 - RNA, 19 nt, Homo sapiens
aaauggugauugugucuuu

SEQ ID NO: 864273 - RNA, 19 nt, Homo sapiens
ugaaagaugccaaugguau

SEQ ID NO: 864274 - RNA, 19 nt, Homo sapiens
aguggaaucuucugugaaa

SEQ ID NO: 864275 - RNA, 19 nt, Homo sapiens
gcagcuggcgcuaaaggua

SEQ ID NO: 864276 - RNA, 19 nt, Homo sapiens
uuacugauaucucaugcaa

SEQ ID NO: 864277 - RNA, 19 nt, Homo sapiens
ucauggagcuguacaaggu

SEQ ID NO: 864278 - RNA, 19 nt, Homo sapiens
gcucaggccacuuuaaaga

SEQ ID NO: 864279 - RNA, 19 nt, Homo sapiens
aaaguuagcugauguuuuc

SEQ ID NO: 864280 - RNA, 19 nt, Homo sapiens
caaacuuggugaacagugu

SEQ ID NO: 864281 - RNA, 19 nt, Homo sapiens
gcaacgcaaugccuacaca

SEQ ID NO: 864282 - RNA, 19 nt, Homo sapiens
ggucauggcgucaaacuca

SEQ ID NO: 864283 - RNA, 19 nt, Homo sapiens
uguaauagccugaagacaa

SEQ ID NO: 864284 - RNA, 19 nt, Homo sapiens
uacaacagcuggucacauc

SEQ ID NO: 864285 - RNA, 19 nt, Homo sapiens
cucaagagaucaaucaaau

SEQ ID NO: 864286 - RNA, 19 nt, Homo sapiens
gagguagaaucacucaauc

SEQ ID NO: 864287 - RNA, 19 nt, Homo sapiens
gcuguuuacugauaucuca

SEQ ID NO: 864288 - RNA, 19 nt, Homo sapiens
gaugaaacaguccauggaa

SEQ ID NO: 864289 - RNA, 19 nt, Homo sapiens
guaaggcaguaauuaagca

SEQ ID NO: 864290 - RNA, 19 nt, Homo sapiens
cauugucuguggaaaguaa

SEQ ID NO: 864291 - RNA, 19 nt, Homo sapiens
cauugcagcucauggaguu

SEQ ID NO: 864292 - RNA, 19 nt, Homo sapiens
cagcuucuguugcaguauu

SEQ ID NO: 864293 - RNA, 19 nt, Homo sapiens
gaaacaguccauggaagaa

SEQ ID NO: 864294 - RNA, 19 nt, Homo sapiens
guucagcacuuucuugcau

SEQ ID NO: 864295 - RNA, 19 nt, Homo sapiens
ccacagacaagcaacaaga

SEQ ID NO: 864296 - RNA, 19 nt, Homo sapiens
gaaugcucaucauaguauu

SEQ ID NO: 864297 - RNA, 19 nt, Homo sapiens
ggaugaauuugugaagaga

SEQ ID NO: 864298 - RNA, 19 nt, Homo sapiens
agaaacauuuggagaagau

SEQ ID NO: 864299 - RNA, 19 nt, Homo sapiens
gaaguauccauucccuauu

SEQ ID NO: 864300 - RNA, 19 nt, Homo sapiens
ucacucaaucggaaauaua

SEQ ID NO: 864301 - RNA, 19 nt, Homo sapiens
gauccagaaucagcaaguu

SEQ ID NO: 864302 - RNA, 19 nt, Homo sapiens
ggguagaguuugcaagcuu

SEQ ID NO: 864303 - RNA, 19 nt, Homo sapiens
gacaaaggccuaagaucug

SEQ ID NO: 864304 - RNA, 19 nt, Homo sapiens
gagaauauucaggcacuuu

SEQ ID NO: 864305 - RNA, 19 nt, Homo sapiens
gaaguugaagcugcuguuu

SEQ ID NO: 864306 - RNA, 19 nt, Homo sapiens
ggacauggaugcacaguug

SEQ ID NO: 864307 - RNA, 19 nt, Homo sapiens
cauaaaugcugcagaauaa

SEQ ID NO: 864308 - RNA, 19 nt, Homo sapiens
gcacaacuuugaaauagaa

SEQ ID NO: 864309 - RNA, 19 nt, Homo sapiens
gcacauacuuagauagaaa

SEQ ID NO: 864310 - RNA, 19 nt, Homo sapiens
aaagacagauuuccugaua

SEQ ID NO: 864311 - RNA, 19 nt, Homo sapiens
gcaaguagauauugaguca

SEQ ID NO: 864312 - RNA, 19 nt, Homo sapiens
gcccagagcuuacguuuga

SEQ ID NO: 864313 - RNA, 19 nt, Homo sapiens
gaagaaaacuugaggcuuu

SEQ ID NO: 864314 - RNA, 19 nt, Homo sapiens
cuacuuaaguuucagguua

SEQ ID NO: 864315 - RNA, 19 nt, Homo sapiens
ccacaucaguguagcauuu

SEQ ID NO: 864316 - RNA, 19 nt, Homo sapiens
uaacacagcuguagacaca

SEQ ID NO: 864317 - RNA, 19 nt, Homo sapiens
gaugaugucuugauggaaa

SEQ ID NO: 864318 - RNA, 19 nt, Homo sapiens
gagcuugccuucagucaaa

SEQ ID NO: 864319 - RNA, 19 nt, Homo sapiens
agacagauuuccugauaua

SEQ ID NO: 864320 - RNA, 19 nt, Homo sapiens
aaagguccauguaugauua

SEQ ID NO: 864321 - RNA, 19 nt, Homo sapiens
gcaaggauguuucaaagca

SEQ ID NO: 864322 - RNA, 19 nt, Homo sapiens
gcaaauggguucagaucga

SEQ ID NO: 864323 - RNA, 19 nt, Homo sapiens
ugaaaccacuaaagagaua

SEQ ID NO: 864324 - RNA, 19 nt, Homo sapiens
ccacauggaucgaauagga

SEQ ID NO: 864325 - RNA, 19 nt, Homo sapiens
gcaaugugguuauauaaag

SEQ ID NO: 864326 - RNA, 19 nt, Homo sapiens
gguguaacguugucuguaa

SEQ ID NO: 864327 - RNA, 19 nt, Homo sapiens
gaugggagcugcaaucaca

SEQ ID NO: 864328 - RNA, 19 nt, Homo sapiens
ggauugaauuugaugauga

SEQ ID NO: 864329 - RNA, 19 nt, Homo sapiens
aaagaacgguacagucuaa

SEQ ID NO: 864330 - RNA, 19 nt, Homo sapiens
acaaauaccucuucugaca

SEQ ID NO: 864331 - RNA, 19 nt, Homo sapiens
gacccugucucaauucuaa

SEQ ID NO: 864332 - RNA, 19 nt, Homo sapiens
cuacagaacauccaugaua

SEQ ID NO: 864333 - RNA, 19 nt, Homo sapiens
gaguuaggauugaauuuga

SEQ ID NO: 864334 - RNA, 19 nt, Homo sapiens
caucaugacuuaaugugaa

SEQ ID NO: 864335 - RNA, 19 nt, Homo sapiens
gaaggaaccaaguaggaua

SEQ ID NO: 864336 - RNA, 19 nt, Homo sapiens
ggauagaaaucucugaaag

SEQ ID NO: 864337 - RNA, 19 nt, Homo sapiens
ucugaaauguguacugaua

SEQ ID NO: 864338 - RNA, 19 nt, Homo sapiens
guucagaaguuucacaguu

SEQ ID NO: 864339 - RNA, 19 nt, Homo sapiens
gauauuaagugaugauguc

SEQ ID NO: 864340 - RNA, 19 nt, Homo sapiens
uaaaagaacugcauagguu

SEQ ID NO: 864341 - RNA, 19 nt, Homo sapiens
ugaagcacauacuuagaua

SEQ ID NO: 864342 - RNA, 19 nt, Homo sapiens
acaagcagauguacagaaa

SEQ ID NO: 864343 - RNA, 19 nt, Homo sapiens
aauacugccuguacuguua

SEQ ID NO: 864344 - RNA, 19 nt, Homo sapiens
gcuaccauuuggauacuua

SEQ ID NO: 864345 - RNA, 19 nt, Homo sapiens
gauaagugguuagugauau

SEQ ID NO: 864346 - RNA, 19 nt, Homo sapiens
ugaagaacaugguaacaau

SEQ ID NO: 864347 - RNA, 19 nt, Homo sapiens
caacaaagcacgaacucaa

SEQ ID NO: 864348 - RNA, 19 nt, Homo sapiens
gaagugccaugguaaacug

SEQ ID NO: 864349 - RNA, 19 nt, Homo sapiens
ggaauacaguggugugauc

SEQ ID NO: 864350 - RNA, 19 nt, Homo sapiens
aaucgugucuccaguagua

SEQ ID NO: 864351 - RNA, 19 nt, Homo sapiens
gcaaacaaauuggagacuu

SEQ ID NO: 864352 - RNA, 19 nt, Homo sapiens
ccuaccagguccauuaaua

SEQ ID NO: 864353 - RNA, 19 nt, Homo sapiens
gcagaauaauuaccacugu

SEQ ID NO: 864354 - RNA, 19 nt, Homo sapiens
gcccauaaaugcugcagaa

SEQ ID NO: 864355 - RNA, 19 nt, Homo sapiens
gaaagaacgguacagucua

SEQ ID NO: 864356 - RNA, 19 nt, Homo sapiens
ucaauaggcucccuguuuc

SEQ ID NO: 864357 - RNA, 19 nt, Homo sapiens
cauaugacagcaacaaaua

SEQ ID NO: 864358 - RNA, 19 nt, Homo sapiens
uaacauucuuccugaggua

SEQ ID NO: 864359 - RNA, 19 nt, Homo sapiens
ucaaagccauccaaauuca

SEQ ID NO: 864360 - RNA, 19 nt, Homo sapiens
caaacaaauuggagacuuc

SEQ ID NO: 864361 - RNA, 19 nt, Homo sapiens
ccacuaaagagauaaguuu

SEQ ID NO: 864362 - RNA, 19 nt, Homo sapiens
ccauaaaugcugcagaaua

SEQ ID NO: 864363 - RNA, 19 nt, Homo sapiens
ggacaaagaaggcaacagu

SEQ ID NO: 864364 - RNA, 19 nt, Homo sapiens
cagauuuccugauauaaug

SEQ ID NO: 864365 - RNA, 19 nt, Homo sapiens
cccauuagguuauaaguau

SEQ ID NO: 864366 - RNA, 19 nt, Homo sapiens
ugaaucauauugcugaaga

SEQ ID NO: 864367 - RNA, 19 nt, Homo sapiens
ggaauugcaaguauugaaa

SEQ ID NO: 864368 - RNA, 19 nt, Homo sapiens
ggauggaauugcaaguauu

SEQ ID NO: 864369 - RNA, 19 nt, Homo sapiens
ugauagcagucuucuguaa

SEQ ID NO: 864370 - RNA, 19 nt, Homo sapiens
gcacggcccagcuggauuu

SEQ ID NO: 864371 - RNA, 19 nt, Homo sapiens
cagaauaauuaccacugua

SEQ ID NO: 864372 - RNA, 19 nt, Homo sapiens
cuacaaauaccucuucuga

SEQ ID NO: 864373 - RNA, 19 nt, Homo sapiens
cauaugcaaugugguuaua

SEQ ID NO: 864374 - RNA, 19 nt, Homo sapiens
ggauaagugguuagugaua

SEQ ID NO: 864375 - RNA, 19 nt, Homo sapiens
gaacuaacacagcuguaga

SEQ ID NO: 864376 - RNA, 19 nt, Homo sapiens
gaucuuguguggauugcuu

SEQ ID NO: 864377 - RNA, 19 nt, Homo sapiens
gaacaugguaacaauggaa

SEQ ID NO: 864378 - RNA, 19 nt, Homo sapiens
gauucucacucuagucauu

SEQ ID NO: 864379 - RNA, 19 nt, Homo sapiens
gaaaaggaguuaggauuga

SEQ ID NO: 864380 - RNA, 19 nt, Homo sapiens
caagaauucucugaaggaa

SEQ ID NO: 864381 - RNA, 19 nt, Homo sapiens
guauggaggugcaaguaga

SEQ ID NO: 864382 - RNA, 19 nt, Homo sapiens
cgagacaaccugagugaaa

SEQ ID NO: 864383 - RNA, 19 nt, Homo sapiens
acgaugugcugcuuauaua

SEQ ID NO: 864384 - RNA, 19 nt, Homo sapiens
agagagagcccagagcuua

SEQ ID NO: 864385 - RNA, 19 nt, Homo sapiens
gaagggcuguguguaaaca

SEQ ID NO: 864386 - RNA, 19 nt, Homo sapiens
caaguaggauauucuuaca

SEQ ID NO: 864387 - RNA, 19 nt, Homo sapiens
gccaugggcugcagucuuc

SEQ ID NO: 864388 - RNA, 19 nt, Homo sapiens
uuaauggccuaguuauuug

SEQ ID NO: 864389 - RNA, 19 nt, Homo sapiens
gguacucuaucuuguuuau

SEQ ID NO: 864390 - RNA, 19 nt, Homo sapiens
ccaaacugcuuccuguuca

SEQ ID NO: 864391 - RNA, 19 nt, Homo sapiens
aagcagauguacagaaaga

SEQ ID NO: 864392 - RNA, 19 nt, Homo sapiens
gaucuucaguccucugcuu

SEQ ID NO: 864393 - RNA, 19 nt, Homo sapiens
guaaacugcauacguuaaa

SEQ ID NO: 864394 - RNA, 19 nt, Homo sapiens
ccauguaugauuagcauua

SEQ ID NO: 864395 - RNA, 19 nt, Homo sapiens
gaaaaugaccgucuggaaa

SEQ ID NO: 864396 - RNA, 19 nt, Homo sapiens
gagcugcaaucacaugaca

SEQ ID NO: 864397 - RNA, 19 nt, Homo sapiens
agucaaagccauccaaauu

SEQ ID NO: 864398 - RNA, 19 nt, Homo sapiens
gggaacaguuagugauaau

SEQ ID NO: 864399 - RNA, 19 nt, Homo sapiens
ggaguuaggauugaauuug

SEQ ID NO: 864400 - RNA, 19 nt, Homo sapiens
caccucagccuuccaagua

SEQ ID NO: 864401 - RNA, 19 nt, Homo sapiens
gaagccacauggaucgaau

SEQ ID NO: 864402 - RNA, 19 nt, Homo sapiens
ggccauagcagguggugua

SEQ ID NO: 864403 - RNA, 19 nt, Homo sapiens
uguguaaacugcauacguu

SEQ ID NO: 864404 - RNA, 19 nt, Homo sapiens
gacagcaacaaauaagaua

SEQ ID NO: 864405 - RNA, 19 nt, Homo sapiens
caaagaaggcaacaguaug

SEQ ID NO: 864406 - RNA, 19 nt, Homo sapiens
ggagacagcuggaugauga

SEQ ID NO: 864407 - RNA, 19 nt, Homo sapiens
gaacaugacuguggauauu

SEQ ID NO: 864408 - RNA, 19 nt, Homo sapiens
uaagggcuguguuauauua

SEQ ID NO: 864409 - RNA, 19 nt, Homo sapiens
gaagaaauguugaaagaag

SEQ ID NO: 864410 - RNA, 19 nt, Homo sapiens
gaaagaaggcuacagaugu

SEQ ID NO: 864411 - RNA, 19 nt, Homo sapiens
cuagaucgcuuuaaaguga

SEQ ID NO: 864412 - RNA, 19 nt, Homo sapiens
gcacauuguuuggagaaua

SEQ ID NO: 864413 - RNA, 19 nt, Homo sapiens
guacuagugucacagcaua

SEQ ID NO: 864414 - RNA, 19 nt, Homo sapiens
ucaacuagaucgcuuuaaa

SEQ ID NO: 864415 - RNA, 19 nt, Homo sapiens
cuacagauguccauuaugu

SEQ ID NO: 864416 - RNA, 19 nt, Homo sapiens
gcacucugcuuuagauaug

SEQ ID NO: 864417 - RNA, 19 nt, Homo sapiens
cauuagaguugauguguuu

SEQ ID NO: 864418 - RNA, 19 nt, Homo sapiens
gaacugcacuuaauuuuca

SEQ ID NO: 864419 - RNA, 19 nt, Homo sapiens
ccaacagacuugugaagaa

SEQ ID NO: 864420 - RNA, 19 nt, Homo sapiens
ugauagaacugcacuuaau

SEQ ID NO: 864421 - RNA, 19 nt, Homo sapiens
gauucagggucucuugaua

SEQ ID NO: 864422 - RNA, 19 nt, Homo sapiens
caacagacuugugaagaau

SEQ ID NO: 864423 - RNA, 19 nt, Homo sapiens
gauauucucugcaaugacu

SEQ ID NO: 864424 - RNA, 19 nt, Homo sapiens
cgauauaugccauuuguuu

SEQ ID NO: 864425 - RNA, 19 nt, Homo sapiens
gauagaacugcacuuaauu

SEQ ID NO: 864426 - RNA, 19 nt, Homo sapiens
uaucaugugucgucaucua

SEQ ID NO: 864427 - RNA, 19 nt, Homo sapiens
ggacaucuuuuacauagaa

SEQ ID NO: 864428 - RNA, 19 nt, Homo sapiens
gcuggaggacguagaauuu

SEQ ID NO: 864429 - RNA, 19 nt, Homo sapiens
acagcuggaugaugaagua

SEQ ID NO: 864430 - RNA, 19 nt, Homo sapiens
uagaacguguuaugaagaa

SEQ ID NO: 864431 - RNA, 19 nt, Homo sapiens
acaaagauaagaagcagua

SEQ ID NO: 864432 - RNA, 19 nt, Homo sapiens
uuuaagggcuguguuauau

SEQ ID NO: 864433 - RNA, 19 nt, Homo sapiens
gcauuagaguugauguguu

SEQ ID NO: 864434 - RNA, 19 nt, Homo sapiens
acacaguacuggagaacuu

SEQ ID NO: 864435 - RNA, 19 nt, Homo sapiens
gauaugaccagguauugga

SEQ ID NO: 864436 - RNA, 19 nt, Homo sapiens
aaagaaggcuacagauguc

SEQ ID NO: 864437 - RNA, 19 nt, Homo sapiens
guucauuucuaguucuuga

SEQ ID NO: 864438 - RNA, 19 nt, Homo sapiens
gauauaugccauuuguuug

SEQ ID NO: 864439 - RNA, 19 nt, Homo sapiens
ggcuacagauguccauuau

SEQ ID NO: 864440 - RNA, 19 nt, Homo sapiens
gaacguguuaugaagaaau

SEQ ID NO: 864441 - RNA, 19 nt, Homo sapiens
uaacuuaugccuagcuaug

SEQ ID NO: 864442 - RNA, 19 nt, Homo sapiens
caacaugcccaacagacuu

SEQ ID NO: 864443 - RNA, 19 nt, Homo sapiens
gcaguaucaucaguucuau

SEQ ID NO: 864444 - RNA, 19 nt, Homo sapiens
gaaguagcacagacuccua

SEQ ID NO: 864445 - RNA, 19 nt, Homo sapiens
caaugauguuugccacuga

SEQ ID NO: 864446 - RNA, 19 nt, Homo sapiens
cacauuguuuggagaauau

SEQ ID NO: 864447 - RNA, 19 nt, Homo sapiens
ggaagccaaugauguuugc

SEQ ID NO: 864448 - RNA, 19 nt, Homo sapiens
cuuuagauaugaccaggua

SEQ ID NO: 864449 - RNA, 19 nt, Homo sapiens
ccacugauacauucauaga

SEQ ID NO: 864450 - RNA, 19 nt, Homo sapiens
ugaaagaaggcuacagaug

SEQ ID NO: 864451 - RNA, 19 nt, Homo sapiens
ggcaguaucaucaguucua

SEQ ID NO: 864452 - RNA, 19 nt, Homo sapiens
gcaaugacgagccuacaca

SEQ ID NO: 864453 - RNA, 19 nt, Homo sapiens
ugaagaucaucaacuagau

SEQ ID NO: 864454 - RNA, 19 nt, Homo sapiens
gcaguucauuucuaguucu

SEQ ID NO: 864455 - RNA, 19 nt, Homo sapiens
gcuuuaaagugaaggaagu

SEQ ID NO: 864456 - RNA, 19 nt, Homo sapiens
caucaacuagaucgcuuua

SEQ ID NO: 864457 - RNA, 19 nt, Homo sapiens
ccacugugcuuguguuuug

SEQ ID NO: 864458 - RNA, 19 nt, Homo sapiens
gguaucguguuaucaugug

SEQ ID NO: 864459 - RNA, 19 nt, Homo sapiens
guuaucaugugucgucauc

SEQ ID NO: 864460 - RNA, 19 nt, Homo sapiens
caacuagaucgcuuuaaag

SEQ ID NO: 864461 - RNA, 19 nt, Homo sapiens
ugacgagccuacacaguac

SEQ ID NO: 864462 - RNA, 19 nt, Homo sapiens
acagauguccauuauguau

SEQ ID NO: 864463 - RNA, 19 nt, Homo sapiens
guugaaagaaggcuacaga

SEQ ID NO: 864464 - RNA, 19 nt, Homo sapiens
uguggaauuuguaggauug

SEQ ID NO: 864465 - RNA, 19 nt, Homo sapiens
uggauauucucugcaauga

SEQ ID NO: 864466 - RNA, 19 nt, Homo sapiens
gcacuaugacagaggaugu

SEQ ID NO: 864467 - RNA, 19 nt, Homo sapiens
ugugaaaacuguggaauuu

SEQ ID NO: 864468 - RNA, 19 nt, Homo sapiens
cuaagacaguccucuggau

SEQ ID NO: 864469 - RNA, 19 nt, Homo sapiens
gcacuuaauuuucaguagu

SEQ ID NO: 864470 - RNA, 19 nt, Homo sapiens
cuugauagaacugcacuua

SEQ ID NO: 864471 - RNA, 19 nt, Homo sapiens
acugauacauucauagaag

SEQ ID NO: 864472 - RNA, 19 nt, Homo sapiens
agacuccuaugccaucaga

SEQ ID NO: 864473 - RNA, 19 nt, Homo sapiens
gcuggaugaugaaguagca

SEQ ID NO: 864474 - RNA, 19 nt, Homo sapiens
uaugcacucugcuuuagau

SEQ ID NO: 864475 - RNA, 19 nt, Homo sapiens
uggaggacauucacacauc

SEQ ID NO: 864476 - RNA, 19 nt, Homo sapiens
gggcuguguuauauuaagu

SEQ ID NO: 864477 - RNA, 19 nt, Homo sapiens
gugcaguucauuucuaguu

SEQ ID NO: 864478 - RNA, 19 nt, Homo sapiens
ugcgauauaugccauuugu

SEQ ID NO: 864479 - RNA, 19 nt, Homo sapiens
acaaguacguaaggauuca

SEQ ID NO: 864480 - RNA, 19 nt, Homo sapiens
ugucgucaucuaugcauua

SEQ ID NO: 864481 - RNA, 19 nt, Homo sapiens
gcuguguuauauuaaguuc

SEQ ID NO: 864482 - RNA, 19 nt, Homo sapiens
gcgugcaguucauuucuag

SEQ ID NO: 864483 - RNA, 19 nt, Homo sapiens
uggaggacguagaauuuca

SEQ ID NO: 864484 - RNA, 19 nt, Homo sapiens
caagcuggaggacguagaa

SEQ ID NO: 864485 - RNA, 19 nt, Homo sapiens
ugaaaacuguggaauuugu

SEQ ID NO: 864486 - RNA, 19 nt, Homo sapiens
gcucuauauugaaugaaag

SEQ ID NO: 864487 - RNA, 19 nt, Homo sapiens
guugauguguuuuguacua

SEQ ID NO: 864488 - RNA, 19 nt, Homo sapiens
uguuguugcucaugucuug

SEQ ID NO: 864489 - RNA, 19 nt, Homo sapiens
gaacuuggcauuuucugau

SEQ ID NO: 864490 - RNA, 19 nt, Homo sapiens
acagacuugugaagaaugu

SEQ ID NO: 864491 - RNA, 19 nt, Homo sapiens
ugccacugauacauucaua

SEQ ID NO: 864492 - RNA, 19 nt, Homo sapiens
cagaauaucagaacaugac

SEQ ID NO: 864493 - RNA, 19 nt, Homo sapiens
guuugccacugauacauuc

SEQ ID NO: 864494 - RNA, 19 nt, Homo sapiens
uuagauaugaccagguauu

SEQ ID NO: 864495 - RNA, 19 nt, Homo sapiens
uuuccuugguaucguguua

SEQ ID NO: 864496 - RNA, 19 nt, Homo sapiens
guggauauucucugcaaug

SEQ ID NO: 864497 - RNA, 19 nt, Homo sapiens
gaaaacuguggaauuugua

SEQ ID NO: 864498 - RNA, 19 nt, Homo sapiens
uguaugcacucugcuuuag

SEQ ID NO: 864499 - RNA, 19 nt, Homo sapiens
uguaacuuaugccuagcua

SEQ ID NO: 864500 - RNA, 19 nt, Homo sapiens
gauguuugccacugauaca

SEQ ID NO: 864501 - RNA, 19 nt, Homo sapiens
augacgagccuacacagua

SEQ ID NO: 864502 - RNA, 19 nt, Homo sapiens
ucucugcaaugacuguaau

SEQ ID NO: 864503 - RNA, 19 nt, Homo sapiens
cagaacaugacuguggaua

SEQ ID NO: 864504 - RNA, 19 nt, Homo sapiens
gcugugacaagcuuuauac

SEQ ID NO: 864505 - RNA, 19 nt, Homo sapiens
guggacaucuuuuacauag

SEQ ID NO: 864506 - RNA, 19 nt, Homo sapiens
uaaugaaacuggcgaguaa

SEQ ID NO: 864507 - RNA, 19 nt, Homo sapiens
cagggucucuguuuaagua

SEQ ID NO: 864508 - RNA, 19 nt, Homo sapiens
ggagaccauugaccagaua

SEQ ID NO: 864509 - RNA, 19 nt, Homo sapiens
gagaaggugauuaaagaua

SEQ ID NO: 864510 - RNA, 19 nt, Homo sapiens
ggaaccggcuguuggagaa

SEQ ID NO: 864511 - RNA, 19 nt, Homo sapiens
gcaaugaccugggcuccaa

SEQ ID NO: 864512 - RNA, 19 nt, Homo sapiens
gaggagacccugcugcuuu

SEQ ID NO: 864513 - RNA, 19 nt, Homo sapiens
gaccugggcuccaacauca

SEQ ID NO: 864514 - RNA, 19 nt, Homo sapiens
uggagaaggugauuaaaga

SEQ ID NO: 864515 - RNA, 19 nt, Homo sapiens
gcacagcccucagcaucaa

SEQ ID NO: 864516 - RNA, 19 nt, Homo sapiens
ccacguaucaggaauguga

SEQ ID NO: 864517 - RNA, 19 nt, Homo sapiens
gcucagggucucuguuuaa

SEQ ID NO: 864518 - RNA, 19 nt, Homo sapiens
gcaagaccguguaaaugag

SEQ ID NO: 864519 - RNA, 19 nt, Homo sapiens
ucaaccagcugagggagua

SEQ ID NO: 864520 - RNA, 19 nt, Homo sapiens
acaccaagauccaggagaa

SEQ ID NO: 864521 - RNA, 19 nt, Homo sapiens
ucaaggggcucaugaguaa

SEQ ID NO: 864522 - RNA, 19 nt, Homo sapiens
ccuggucacugcagaauga

SEQ ID NO: 864523 - RNA, 19 nt, Homo sapiens
gaccgaaagucuccugcuu

SEQ ID NO: 864524 - RNA, 19 nt, Homo sapiens
ggaggugccgugcuuuaaa

SEQ ID NO: 864525 - RNA, 19 nt, Homo sapiens
gcgaggacaugauccagau

SEQ ID NO: 864526 - RNA, 19 nt, Homo sapiens
gaaggugggaagaggagua

SEQ ID NO: 864527 - RNA, 19 nt, Homo sapiens
gcagaaggcgcagccauga

SEQ ID NO: 864528 - RNA, 19 nt, Homo sapiens
gaagguggauauggacauc

SEQ ID NO: 864529 - RNA, 19 nt, Homo sapiens
gauccgcgcucucuacaac

SEQ ID NO: 864530 - RNA, 19 nt, Homo sapiens
ggacuccgaucgcgauguc

SEQ ID NO: 864531 - RNA, 19 nt, Homo sapiens
gagagcagcaggaagauag

SEQ ID NO: 864532 - RNA, 19 nt, Homo sapiens
guuaaaugauaccacaaga

SEQ ID NO: 864533 - RNA, 19 nt, Homo sapiens
gaggugccgugcuuuaaag

SEQ ID NO: 864534 - RNA, 19 nt, Homo sapiens
aggaggagcuggcacugaa

SEQ ID NO: 864535 - RNA, 19 nt, Homo sapiens
ggucucuguuuaaguauca

SEQ ID NO: 864536 - RNA, 19 nt, Homo sapiens
gcgcucagggucucuguuu

SEQ ID NO: 864537 - RNA, 19 nt, Homo sapiens
ggagagcagcaggaagaua

SEQ ID NO: 864538 - RNA, 19 nt, Homo sapiens
ucugacagcuccaugagau

SEQ ID NO: 864539 - RNA, 19 nt, Homo sapiens
gcuacagugucccugauuc

SEQ ID NO: 864540 - RNA, 19 nt, Homo sapiens
ccauggcccuccgcaauga

SEQ ID NO: 864541 - RNA, 19 nt, Homo sapiens
gauacggagucccuguuca

SEQ ID NO: 864542 - RNA, 19 nt, Homo sapiens
ugcaagaccguguaaauga

SEQ ID NO: 864543 - RNA, 19 nt, Homo sapiens
gguauaggaggcuguguug

SEQ ID NO: 864544 - RNA, 19 nt, Homo sapiens
agaaggugauuaaagauac

SEQ ID NO: 864545 - RNA, 19 nt, Homo sapiens
gaggauuucucaggcuaug

SEQ ID NO: 864546 - RNA, 19 nt, Homo sapiens
ggaaaagccuggagaagcu

SEQ ID NO: 864547 - RNA, 19 nt, Homo sapiens
gcugcaagaccguguaaau

SEQ ID NO: 864548 - RNA, 19 nt, Homo sapiens
ggagaaggugauuaaagau

SEQ ID NO: 864549 - RNA, 19 nt, Homo sapiens
caacugcgaggacaugauc

SEQ ID NO: 864550 - RNA, 19 nt, Homo sapiens
ugacuugggaggagacuga

SEQ ID NO: 864551 - RNA, 19 nt, Homo sapiens
aggcugagcugguggucuu

SEQ ID NO: 864552 - RNA, 19 nt, Homo sapiens
uuacaggguuaaaugauac

SEQ ID NO: 864553 - RNA, 19 nt, Homo sapiens
aguaucagcuaaagaugug

SEQ ID NO: 864554 - RNA, 19 nt, Homo sapiens
guggaggugccgugcuuua

SEQ ID NO: 864555 - RNA, 19 nt, Homo sapiens
aagauagccuggagaaggu

SEQ ID NO: 864556 - RNA, 19 nt, Homo sapiens
cagcugagggaguaugauu

SEQ ID NO: 864557 - RNA, 19 nt, Homo sapiens
acaacgugcuggccaaagu

SEQ ID NO: 864558 - RNA, 19 nt, Homo sapiens
uaucaggaaugugaaugug

SEQ ID NO: 864559 - RNA, 19 nt, Homo sapiens
auggagaugugcagcauga

SEQ ID NO: 864560 - RNA, 19 nt, Homo sapiens
gaaggugauuaaagauacg

SEQ ID NO: 864561 - RNA, 19 nt, Homo sapiens
ccgccaagcucugcgaugu

SEQ ID NO: 864562 - RNA, 19 nt, Homo sapiens
gaaugacagagaaggugaa

SEQ ID NO: 864563 - RNA, 19 nt, Homo sapiens
aggagacccugcugcuuug

SEQ ID NO: 864564 - RNA, 19 nt, Homo sapiens
caacaucaacgugcucaag

SEQ ID NO: 864565 - RNA, 19 nt, Homo sapiens
ugacagagaaggugaagcu

SEQ ID NO: 864566 - RNA, 19 nt, Homo sapiens
gcagaaugacagagaaggu

SEQ ID NO: 864567 - RNA, 19 nt, Homo sapiens
ggagaugugcagcaugaag

SEQ ID NO: 864568 - RNA, 19 nt, Homo sapiens
gccuggagaaggugauuaa

SEQ ID NO: 864569 - RNA, 19 nt, Homo sapiens
agaaggcgcagccaugaau

SEQ ID NO: 864570 - RNA, 19 nt, Homo sapiens
gaagguggaacaguugaag

SEQ ID NO: 864571 - RNA, 19 nt, Homo sapiens
ugucauacacugagaccaa

SEQ ID NO: 864572 - RNA, 19 nt, Homo sapiens
ccaccuccaccaccuauuc

SEQ ID NO: 864573 - RNA, 19 nt, Homo sapiens
auaaugaaacuggcgagua

SEQ ID NO: 864574 - RNA, 19 nt, Homo sapiens
gaccaacaggcuacagugu

SEQ ID NO: 864575 - RNA, 19 nt, Homo sapiens
cuguuuaaguaucagcuaa

SEQ ID NO: 864576 - RNA, 19 nt, Homo sapiens
gaaggugaagcuccaugca

SEQ ID NO: 864577 - RNA, 19 nt, Homo sapiens
cgggaugggcacaguguuu

SEQ ID NO: 864578 - RNA, 19 nt, Homo sapiens
ggagcccacucuggugcaa

SEQ ID NO: 864579 - RNA, 19 nt, Homo sapiens
gcacgaguacauggagaug

SEQ ID NO: 864580 - RNA, 19 nt, Homo sapiens
ugugggaccuuuccuccau

SEQ ID NO: 864581 - RNA, 19 nt, Homo sapiens
gcuccucccucaggcuuuc

SEQ ID NO: 864582 - RNA, 19 nt, Homo sapiens
cgcucagggucucuguuua

SEQ ID NO: 864583 - RNA, 19 nt, Homo sapiens
uauaggaggcuguguugag

SEQ ID NO: 864584 - RNA, 19 nt, Homo sapiens
acagugucccugauucuug

SEQ ID NO: 864585 - RNA, 19 nt, Homo sapiens
guaucaggaaugugaaugu

SEQ ID NO: 864586 - RNA, 19 nt, Homo sapiens
ugacagcuccaugagauag

SEQ ID NO: 864587 - RNA, 19 nt, Homo sapiens
caacgugcuggccaaagug

SEQ ID NO: 864588 - RNA, 19 nt, Homo sapiens
gcaccugcacgaguacaug

SEQ ID NO: 864589 - RNA, 19 nt, Homo sapiens
agggagagcagcaggaaga

SEQ ID NO: 864590 - RNA, 19 nt, Homo sapiens
gguuaaaugauaccacaag

SEQ ID NO: 864591 - RNA, 19 nt, Homo sapiens
gagaccaacaggcuacagu

SEQ ID NO: 864592 - RNA, 19 nt, Homo sapiens
gaguaucaggagaccauug

SEQ ID NO: 864593 - RNA, 19 nt, Homo sapiens
gaaggcgcagccaugaauc

SEQ ID NO: 864594 - RNA, 19 nt, Homo sapiens
ggagaagcaacugcagcaa

SEQ ID NO: 864595 - RNA, 19 nt, Homo sapiens
guccagaucgacaccauca

SEQ ID NO: 864596 - RNA, 19 nt, Homo sapiens
aggcuuggcccuaccauuc

SEQ ID NO: 864597 - RNA, 19 nt, Homo sapiens
gccuggacgugcagaugga

SEQ ID NO: 864598 - RNA, 19 nt, Homo sapiens
accggcaccugcacgagua

SEQ ID NO: 864599 - RNA, 19 nt, Homo sapiens
aaacccgggagaaggagua

SEQ ID NO: 864600 - RNA, 19 nt, Homo sapiens
ggaggauuucucaggcuau

SEQ ID NO: 864601 - RNA, 19 nt, Homo sapiens
gcugagggaguaugauuuu

SEQ ID NO: 864602 - RNA, 19 nt, Homo sapiens
cagcugcaagaccguguaa

SEQ ID NO: 864603 - RNA, 19 nt, Homo sapiens
ggagcuggacaccaagauc

SEQ ID NO: 864604 - RNA, 19 nt, Homo sapiens
uaaugaaacuggcgaguaa

SEQ ID NO: 864605 - RNA, 19 nt, Homo sapiens
cagggucucuguuuaagua

SEQ ID NO: 864606 - RNA, 19 nt, Homo sapiens
ggagaccauugaccagaua

SEQ ID NO: 864607 - RNA, 19 nt, Homo sapiens
gagaaggugauuaaagaua

SEQ ID NO: 864608 - RNA, 19 nt, Homo sapiens
ggaaccggcuguuggagaa

SEQ ID NO: 864609 - RNA, 19 nt, Homo sapiens
gcaaugaccugggcuccaa

SEQ ID NO: 864610 - RNA, 19 nt, Homo sapiens
gaggagacccugcugcuuu

SEQ ID NO: 864611 - RNA, 19 nt, Homo sapiens
gaccugggcuccaacauca

SEQ ID NO: 864612 - RNA, 19 nt, Homo sapiens
uggagaaggugauuaaaga

SEQ ID NO: 864613 - RNA, 19 nt, Homo sapiens
gcacagcccucagcaucaa

SEQ ID NO: 864614 - RNA, 19 nt, Homo sapiens
ccacguaucaggaauguga

SEQ ID NO: 864615 - RNA, 19 nt, Homo sapiens
gcucagggucucuguuuaa

SEQ ID NO: 864616 - RNA, 19 nt, Homo sapiens
gcaagaccguguaaaugag

SEQ ID NO: 864617 - RNA, 19 nt, Homo sapiens
ucaaccagcugagggagua

SEQ ID NO: 864618 - RNA, 19 nt, Homo sapiens
acaccaagauccaggagaa

SEQ ID NO: 864619 - RNA, 19 nt, Homo sapiens
ucaaggggcucaugaguaa

SEQ ID NO: 864620 - RNA, 19 nt, Homo sapiens
ccuggucacugcagaauga

SEQ ID NO: 864621 - RNA, 19 nt, Homo sapiens
gaccgaaagucuccugcuu

SEQ ID NO: 864622 - RNA, 19 nt, Homo sapiens
ggaggugccgugcuuuaaa

SEQ ID NO: 864623 - RNA, 19 nt, Homo sapiens
gcgaggacaugauccagau

SEQ ID NO: 864624 - RNA, 19 nt, Homo sapiens
gcagaaggcgcagccauga

SEQ ID NO: 864625 - RNA, 19 nt, Homo sapiens
gaagguggauauggacauc

SEQ ID NO: 864626 - RNA, 19 nt, Homo sapiens
gauccgcgcucucuacaac

SEQ ID NO: 864627 - RNA, 19 nt, Homo sapiens
ggacuccgaucgcgauguc

SEQ ID NO: 864628 - RNA, 19 nt, Homo sapiens
gaggugccgugcuuuaaag

SEQ ID NO: 864629 - RNA, 19 nt, Homo sapiens
aggaggagcuggcacugaa

SEQ ID NO: 864630 - RNA, 19 nt, Homo sapiens
ggucucuguuuaaguauca

SEQ ID NO: 864631 - RNA, 19 nt, Homo sapiens
gcgcucagggucucuguuu

SEQ ID NO: 864632 - RNA, 19 nt, Homo sapiens
ucugacagcuccaugagau

SEQ ID NO: 864633 - RNA, 19 nt, Homo sapiens
gcuacagugucccugauuc

SEQ ID NO: 864634 - RNA, 19 nt, Homo sapiens
ccauggcccuccgcaauga

SEQ ID NO: 864635 - RNA, 19 nt, Homo sapiens
gauacggagucccuguuca

SEQ ID NO: 864636 - RNA, 19 nt, Homo sapiens
ugcaagaccguguaaauga

SEQ ID NO: 864637 - RNA, 19 nt, Homo sapiens
gguauaggaggcuguguug

SEQ ID NO: 864638 - RNA, 19 nt, Homo sapiens
agaaggugauuaaagauac

SEQ ID NO: 864639 - RNA, 19 nt, Homo sapiens
gaggauuucucaggcuaug

SEQ ID NO: 864640 - RNA, 19 nt, Homo sapiens
ggaggugggaagaggagua

SEQ ID NO: 864641 - RNA, 19 nt, Homo sapiens
ggaaaagccuggagaagcu

SEQ ID NO: 864642 - RNA, 19 nt, Homo sapiens
gcugcaagaccguguaaau

SEQ ID NO: 864643 - RNA, 19 nt, Homo sapiens
ggagaaggugauuaaagau

SEQ ID NO: 864644 - RNA, 19 nt, Homo sapiens
caacugcgaggacaugauc

SEQ ID NO: 864645 - RNA, 19 nt, Homo sapiens
ugacuugggaggagacuga

SEQ ID NO: 864646 - RNA, 19 nt, Homo sapiens
aggcugagcugguggucuu

SEQ ID NO: 864647 - RNA, 19 nt, Homo sapiens
aguaucagcuaaagaugug

SEQ ID NO: 864648 - RNA, 19 nt, Homo sapiens
guggaggugccgugcuuua

SEQ ID NO: 864649 - RNA, 19 nt, Homo sapiens
aagauagccuggagaaggu

SEQ ID NO: 864650 - RNA, 19 nt, Homo sapiens
cagcugagggaguaugauu

SEQ ID NO: 864651 - RNA, 19 nt, Homo sapiens
acaacgugcuggccaaagu

SEQ ID NO: 864652 - RNA, 19 nt, Homo sapiens
uaucaggaaugugaaugug

SEQ ID NO: 864653 - RNA, 19 nt, Homo sapiens
auggagaugugcagcauga

SEQ ID NO: 864654 - RNA, 19 nt, Homo sapiens
gaaggugauuaaagauacg

SEQ ID NO: 864655 - RNA, 19 nt, Homo sapiens
ccgccaagcucugcgaugu

SEQ ID NO: 864656 - RNA, 19 nt, Homo sapiens
gaaugacagagaaggugaa

SEQ ID NO: 864657 - RNA, 19 nt, Homo sapiens
aggagacccugcugcuuug

SEQ ID NO: 864658 - RNA, 19 nt, Homo sapiens
ugacagagaaggugaagcu

SEQ ID NO: 864659 - RNA, 19 nt, Homo sapiens
gcagaaugacagagaaggu

SEQ ID NO: 864660 - RNA, 19 nt, Homo sapiens
ggagaugugcagcaugaag

SEQ ID NO: 864661 - RNA, 19 nt, Homo sapiens
gccuggagaaggugauuaa

SEQ ID NO: 864662 - RNA, 19 nt, Homo sapiens
caacaucaacgugcucaag

SEQ ID NO: 864663 - RNA, 19 nt, Homo sapiens
agaaggcgcagccaugaau

SEQ ID NO: 864664 - RNA, 19 nt, Homo sapiens
gaagguggaacaguugaag

SEQ ID NO: 864665 - RNA, 19 nt, Homo sapiens
ugucauacacugagaccaa

SEQ ID NO: 864666 - RNA, 19 nt, Homo sapiens
ccaccuccaccaccuauuc

SEQ ID NO: 864667 - RNA, 19 nt, Homo sapiens
auaaugaaacuggcgagua

SEQ ID NO: 864668 - RNA, 19 nt, Homo sapiens
gaccaacaggcuacagugu

SEQ ID NO: 864669 - RNA, 19 nt, Homo sapiens
cuguuuaaguaucagcuaa

SEQ ID NO: 864670 - RNA, 19 nt, Homo sapiens
gaaggugaagcuccaugca

SEQ ID NO: 864671 - RNA, 19 nt, Homo sapiens
cgggaugggcacaguguuu

SEQ ID NO: 864672 - RNA, 19 nt, Homo sapiens
ggagcccacucuggugcaa

SEQ ID NO: 864673 - RNA, 19 nt, Homo sapiens
gcacgaguacauggagaug

SEQ ID NO: 864674 - RNA, 19 nt, Homo sapiens
ugugggaccuuuccuccau

SEQ ID NO: 864675 - RNA, 19 nt, Homo sapiens
gcuccucccucaggcuuuc

SEQ ID NO: 864676 - RNA, 19 nt, Homo sapiens
cgcucagggucucuguuua

SEQ ID NO: 864677 - RNA, 19 nt, Homo sapiens
uauaggaggcuguguugag

SEQ ID NO: 864678 - RNA, 19 nt, Homo sapiens
acagugucccugauucuug

SEQ ID NO: 864679 - RNA, 19 nt, Homo sapiens
caacgugcuggccaaagug

SEQ ID NO: 864680 - RNA, 19 nt, Homo sapiens
guaucaggaaugugaaugu

SEQ ID NO: 864681 - RNA, 19 nt, Homo sapiens
ugacagcuccaugagauag

SEQ ID NO: 864682 - RNA, 19 nt, Homo sapiens
gcaccugcacgaguacaug

SEQ ID NO: 864683 - RNA, 19 nt, Homo sapiens
gagaccaacaggcuacagu

SEQ ID NO: 864684 - RNA, 19 nt, Homo sapiens
gaguaucaggagaccauug

SEQ ID NO: 864685 - RNA, 19 nt, Homo sapiens
gaaggcgcagccaugaauc

SEQ ID NO: 864686 - RNA, 19 nt, Homo sapiens
agggagagcaggaagauag

SEQ ID NO: 864687 - RNA, 19 nt, Homo sapiens
ggagaagcaacugcagcaa

SEQ ID NO: 864688 - RNA, 19 nt, Homo sapiens
aggcuuggcccuaccauuc

SEQ ID NO: 864689 - RNA, 19 nt, Homo sapiens
gccuggacgugcagaugga

SEQ ID NO: 864690 - RNA, 19 nt, Homo sapiens
cagcugcaagaccguguaa

SEQ ID NO: 864691 - RNA, 19 nt, Homo sapiens
accggcaccugcacgagua

SEQ ID NO: 864692 - RNA, 19 nt, Homo sapiens
aaacccgggagaaggagua

SEQ ID NO: 864693 - RNA, 19 nt, Homo sapiens
ggaggauuucucaggcuau

SEQ ID NO: 864694 - RNA, 19 nt, Homo sapiens
gcugagggaguaugauuuu

SEQ ID NO: 864695 - RNA, 19 nt, Homo sapiens
guccagaucgacaccauca

SEQ ID NO: 864696 - RNA, 19 nt, Homo sapiens
ggagcuggacaccaagauc

SEQ ID NO: 864697 - RNA, 19 nt, Homo sapiens
uaaugaaacuggcgaguaa

SEQ ID NO: 864698 - RNA, 19 nt, Homo sapiens
gcacuugucucccauuaag

SEQ ID NO: 864699 - RNA, 19 nt, Homo sapiens
cagggucucuguuuaagua

SEQ ID NO: 864700 - RNA, 19 nt, Homo sapiens
ggagaccauugaccagaua

SEQ ID NO: 864701 - RNA, 19 nt, Homo sapiens
gagaaggugauuaaagaua

SEQ ID NO: 864702 - RNA, 19 nt, Homo sapiens
gaggagacccugcugcuuu

SEQ ID NO: 864703 - RNA, 19 nt, Homo sapiens
uggagaaggugauuaaaga

SEQ ID NO: 864704 - RNA, 19 nt, Homo sapiens
gcacagcccucagcaucaa

SEQ ID NO: 864705 - RNA, 19 nt, Homo sapiens
ccacguaucaggaauguga

SEQ ID NO: 864706 - RNA, 19 nt, Homo sapiens
gcucagggucucuguuuaa

SEQ ID NO: 864707 - RNA, 19 nt, Homo sapiens
ucaaccagcugagggagua

SEQ ID NO: 864708 - RNA, 19 nt, Homo sapiens
ccuggucacugcagaauga

SEQ ID NO: 864709 - RNA, 19 nt, Homo sapiens
gaccgaaagucuccugcuu

SEQ ID NO: 864710 - RNA, 19 nt, Homo sapiens
ggaggugccgugcuuuaaa

SEQ ID NO: 864711 - RNA, 19 nt, Homo sapiens
ggacuccgaucgcgauguc

SEQ ID NO: 864712 - RNA, 19 nt, Homo sapiens
gaggugccgugcuuuaaag

SEQ ID NO: 864713 - RNA, 19 nt, Homo sapiens
ggucucuguuuaaguauca

SEQ ID NO: 864714 - RNA, 19 nt, Homo sapiens
gcgcucagggucucuguuu

SEQ ID NO: 864715 - RNA, 19 nt, Homo sapiens
ucugacagcuccaugagau

SEQ ID NO: 864716 - RNA, 19 nt, Homo sapiens
gcuacagugucccugauuc

SEQ ID NO: 864717 - RNA, 19 nt, Homo sapiens
gauacggagucccuguuca

SEQ ID NO: 864718 - RNA, 19 nt, Homo sapiens
ccauuaaggucccauccau

SEQ ID NO: 864719 - RNA, 19 nt, Homo sapiens
gguauaggaggcuguguug

SEQ ID NO: 864720 - RNA, 19 nt, Homo sapiens
agaaggugauuaaagauac

SEQ ID NO: 864721 - RNA, 19 nt, Homo sapiens
gaggauuucucaggcuaug

SEQ ID NO: 864722 - RNA, 19 nt, Homo sapiens
ggaaaagccuggagaagcu

SEQ ID NO: 864723 - RNA, 19 nt, Homo sapiens
cugcacuugucucccauua

SEQ ID NO: 864724 - RNA, 19 nt, Homo sapiens
ggagaaggugauuaaagau

SEQ ID NO: 864725 - RNA, 19 nt, Homo sapiens
ugacuugggaggagacuga

SEQ ID NO: 864726 - RNA, 19 nt, Homo sapiens
aguaucagcuaaagaugug

SEQ ID NO: 864727 - RNA, 19 nt, Homo sapiens
guggaggugccgugcuuua

SEQ ID NO: 864728 - RNA, 19 nt, Homo sapiens
aagauagccuggagaaggu

SEQ ID NO: 864729 - RNA, 19 nt, Homo sapiens
cagcugagggaguaugauu

SEQ ID NO: 864730 - RNA, 19 nt, Homo sapiens
ccucgucucuguagucucu

SEQ ID NO: 864731 - RNA, 19 nt, Homo sapiens
cugcucuucuucucgauuu

SEQ ID NO: 864732 - RNA, 19 nt, Homo sapiens
uaucaggaaugugaaugug

SEQ ID NO: 864733 - RNA, 19 nt, Homo sapiens
auggagaugugcagcauga

SEQ ID NO: 864734 - RNA, 19 nt, Homo sapiens
gaaggugauuaaagauacg

SEQ ID NO: 864735 - RNA, 19 nt, Homo sapiens
gaaugacagagaaggugaa

SEQ ID NO: 864736 - RNA, 19 nt, Homo sapiens
aggagacccugcugcuuug

SEQ ID NO: 864737 - RNA, 19 nt, Homo sapiens
guucugccuucucgguuug

SEQ ID NO: 864738 - RNA, 19 nt, Homo sapiens
ugacagagaaggugaagcu

SEQ ID NO: 864739 - RNA, 19 nt, Homo sapiens
gcagaaugacagagaaggu

SEQ ID NO: 864740 - RNA, 19 nt, Homo sapiens
ggagaugugcagcaugaag

SEQ ID NO: 864741 - RNA, 19 nt, Homo sapiens
gccuggagaaggugauuaa

SEQ ID NO: 864742 - RNA, 19 nt, Homo sapiens
uguagucucugcacuuguc

SEQ ID NO: 864743 - RNA, 19 nt, Homo sapiens
ugucauacacugagaccaa

SEQ ID NO: 864744 - RNA, 19 nt, Homo sapiens
ucuguagucucugcacuug

SEQ ID NO: 864745 - RNA, 19 nt, Homo sapiens
auaaugaaacuggcgagua

SEQ ID NO: 864746 - RNA, 19 nt, Homo sapiens
gaccaacaggcuacagugu

SEQ ID NO: 864747 - RNA, 19 nt, Homo sapiens
cuguuuaaguaucagcuaa

SEQ ID NO: 864748 - RNA, 19 nt, Homo sapiens
gaaggugaagcuccaugca

SEQ ID NO: 864749 - RNA, 19 nt, Homo sapiens
gacuguccguguuucuguu

SEQ ID NO: 864750 - RNA, 19 nt, Homo sapiens
cgggaugggcacaguguuu

SEQ ID NO: 864751 - RNA, 19 nt, Homo sapiens
ucuucucgauuucuucuug

SEQ ID NO: 864752 - RNA, 19 nt, Homo sapiens
gcacgaguacauggagaug

SEQ ID NO: 864753 - RNA, 19 nt, Homo sapiens
ugugggaccuuuccuccau

SEQ ID NO: 864754 - RNA, 19 nt, Homo sapiens
gcuccucccucaggcuuuc

SEQ ID NO: 864755 - RNA, 19 nt, Homo sapiens
cgcucagggucucuguuua

SEQ ID NO: 864756 - RNA, 19 nt, Homo sapiens
uauaggaggcuguguugag

SEQ ID NO: 864757 - RNA, 19 nt, Homo sapiens
acagugucccugauucuug

SEQ ID NO: 864758 - RNA, 19 nt, Homo sapiens
guaucaggaaugugaaugu

SEQ ID NO: 864759 - RNA, 19 nt, Homo sapiens
ugacagcuccaugagauag

SEQ ID NO: 864760 - RNA, 19 nt, Homo sapiens
gcaccugcacgaguacaug

SEQ ID NO: 864761 - RNA, 19 nt, Homo sapiens
gagccaucaugcacaucug

SEQ ID NO: 864762 - RNA, 19 nt, Homo sapiens
ucauuguaacugugacuuu

SEQ ID NO: 864763 - RNA, 19 nt, Homo sapiens
gagaccaacaggcuacagu

SEQ ID NO: 864764 - RNA, 19 nt, Homo sapiens
gaguaucaggagaccauug

SEQ ID NO: 864765 - RNA, 19 nt, Homo sapiens
uguucugccuucucgguuu

SEQ ID NO: 864766 - RNA, 19 nt, Homo sapiens
agggagagcaggaagauag

SEQ ID NO: 864767 - RNA, 19 nt, Homo sapiens
cuuggugacuguccguguu

SEQ ID NO: 864768 - RNA, 19 nt, Homo sapiens
aggcuuggcccuaccauuc

SEQ ID NO: 864769 - RNA, 19 nt, Homo sapiens
gccuggacgugcagaugga

SEQ ID NO: 864770 - RNA, 19 nt, Homo sapiens
accggcaccugcacgagua

SEQ ID NO: 864771 - RNA, 19 nt, Homo sapiens
cauuguaacugugacuuuu

SEQ ID NO: 864772 - RNA, 19 nt, Homo sapiens
aaacccgggagaaggagua

SEQ ID NO: 864773 - RNA, 19 nt, Homo sapiens
ggaggauuucucaggcuau

SEQ ID NO: 864774 - RNA, 19 nt, Homo sapiens
gcugagggaguaugauuuu

SEQ ID NO: 864775 - RNA, 19 nt, Homo sapiens
gaaauuagcucgcuugaau

SEQ ID NO: 864776 - RNA, 19 nt, Homo sapiens
guaguuugcuuucuuguga

SEQ ID NO: 864777 - RNA, 19 nt, Homo sapiens
gcacaagauguuccaaaua

SEQ ID NO: 864778 - RNA, 19 nt, Homo sapiens
gaaaugugacgcagagauu

SEQ ID NO: 864779 - RNA, 19 nt, Homo sapiens
ccaauacccuucuucuuca

SEQ ID NO: 864780 - RNA, 19 nt, Homo sapiens
ggccagugauaagaaauua

SEQ ID NO: 864781 - RNA, 19 nt, Homo sapiens
aagcagcagucuuuacuuu

SEQ ID NO: 864782 - RNA, 19 nt, Homo sapiens
gaaaugcauugugcugaug

SEQ ID NO: 864783 - RNA, 19 nt, Homo sapiens
guacucagguugucaaugc

SEQ ID NO: 864784 - RNA, 19 nt, Homo sapiens
cggaaaggguacugcauuu

SEQ ID NO: 864785 - RNA, 19 nt, Homo sapiens
ucacagcgaccaaaguuaa

SEQ ID NO: 864786 - RNA, 19 nt, Homo sapiens
gcauugugcugauguucuu

SEQ ID NO: 864787 - RNA, 19 nt, Homo sapiens
gcagaaucaucuuccacaa

SEQ ID NO: 864788 - RNA, 19 nt, Homo sapiens
cacaagauguuccaaauac

SEQ ID NO: 864789 - RNA, 19 nt, Homo sapiens
ccacugcacccgcuuauug

SEQ ID NO: 864790 - RNA, 19 nt, Homo sapiens
gggaaugcaggagaaauua

SEQ ID NO: 864791 - RNA, 19 nt, Homo sapiens
gcggagggauuucucuuuc

SEQ ID NO: 864792 - RNA, 19 nt, Homo sapiens
uaaagugcaaguucaauga

SEQ ID NO: 864793 - RNA, 19 nt, Homo sapiens
guaauuaaagugcaaguuc

SEQ ID NO: 864794 - RNA, 19 nt, Homo sapiens
agaaucaucuuccacaaca

SEQ ID NO: 864795 - RNA, 19 nt, Homo sapiens
gggcaaaggcgcucaguca

SEQ ID NO: 864796 - RNA, 19 nt, Homo sapiens
gguacugcauuucccguuu

SEQ ID NO: 864797 - RNA, 19 nt, Homo sapiens
ggaguuacagcuaaaggaa

SEQ ID NO: 864798 - RNA, 19 nt, Homo sapiens
caaaggcgcucagucaacu

SEQ ID NO: 864799 - RNA, 19 nt, Homo sapiens
guaaaugugacucgcugua

SEQ ID NO: 864800 - RNA, 19 nt, Homo sapiens
aaauacuucugcuagcuaa

SEQ ID NO: 864801 - RNA, 19 nt, Homo sapiens
caaacuuauuccaguguug

SEQ ID NO: 864802 - RNA, 19 nt, Homo sapiens
ugaaaugcauugugcugau

SEQ ID NO: 864803 - RNA, 19 nt, Homo sapiens
ggauuauacuugaaaugca

SEQ ID NO: 864804 - RNA, 19 nt, Homo sapiens
cuuaugggauuauacuuga

SEQ ID NO: 864805 - RNA, 19 nt, Homo sapiens
caaauacuucugcuagcua

SEQ ID NO: 864806 - RNA, 19 nt, Homo sapiens
ccugagcucaccaaacuua

SEQ ID NO: 864807 - RNA, 19 nt, Homo sapiens
gugcugcugugcuucauau

SEQ ID NO: 864808 - RNA, 19 nt, Homo sapiens
agagagggcugcucagucu

SEQ ID NO: 864809 - RNA, 19 nt, Homo sapiens
guacugcauuucccguuuc

SEQ ID NO: 864810 - RNA, 19 nt, Homo sapiens
gcaaguucaaugaucguuu

SEQ ID NO: 864811 - RNA, 19 nt, Homo sapiens
caagauguuccaaauacuu

SEQ ID NO: 864812 - RNA, 19 nt, Homo sapiens
gagcucaccaaacuuauuc

SEQ ID NO: 864813 - RNA, 19 nt, Homo sapiens
ugacagggcggagggauuu

SEQ ID NO: 864814 - RNA, 19 nt, Homo sapiens
cagcuucaguuuauguuag

SEQ ID NO: 864815 - RNA, 19 nt, Homo sapiens
ccaaacuuauuccaguguu

SEQ ID NO: 864816 - RNA, 19 nt, Homo sapiens
ggaaaugugacgcagagau

SEQ ID NO: 864817 - RNA, 19 nt, Homo sapiens
uaaaugugacucgcuguaa

SEQ ID NO: 864818 - RNA, 19 nt, Homo sapiens
caaguucaaugaucguuuu

SEQ ID NO: 864819 - RNA, 19 nt, Homo sapiens
caaauccaguagcagaauc

SEQ ID NO: 864820 - RNA, 19 nt, Homo sapiens
uugaacagauggaacaugu

SEQ ID NO: 864821 - RNA, 19 nt, Homo sapiens
ucgcuguaauucaccauaa

SEQ ID NO: 864822 - RNA, 19 nt, Homo sapiens
aaaugugacucgcuguaau

SEQ ID NO: 864823 - RNA, 19 nt, Homo sapiens
ccacaacaaggaauuaaag

SEQ ID NO: 864824 - RNA, 19 nt, Homo sapiens
cccaauacccuucuucuuc

SEQ ID NO: 864825 - RNA, 19 nt, Homo sapiens
caaugaucguuuucacuua

SEQ ID NO: 864826 - RNA, 19 nt, Homo sapiens
gcaaaggcgcucagucaac

SEQ ID NO: 864827 - RNA, 19 nt, Homo sapiens
gaagagcggaaagugaaga

SEQ ID NO: 864828 - RNA, 19 nt, Homo sapiens
gaaucaucuuccacaacaa

SEQ ID NO: 864829 - RNA, 19 nt, Homo sapiens
gcagcagucuuuacuuuuc

SEQ ID NO: 864830 - RNA, 19 nt, Homo sapiens
gaagcagcagucuuuacuu

SEQ ID NO: 864831 - RNA, 19 nt, Homo sapiens
gcuugaauuuggagcucua

SEQ ID NO: 864832 - RNA, 19 nt, Homo sapiens
uggaagagcggaaagugaa

SEQ ID NO: 864833 - RNA, 19 nt, Homo sapiens
ccaaauacuucugcuagcu

SEQ ID NO: 864834 - RNA, 19 nt, Homo sapiens
cugcugugcuucauauugu

SEQ ID NO: 864835 - RNA, 19 nt, Homo sapiens
gagaaauuagcucgcuuga

SEQ ID NO: 864836 - RNA, 19 nt, Homo sapiens
aaacuucaagcauuuggaa

SEQ ID NO: 864837 - RNA, 19 nt, Homo sapiens
caacuucacagcgaccaaa

SEQ ID NO: 864838 - RNA, 19 nt, Homo sapiens
uuagcucgcuugaauuugg

SEQ ID NO: 864839 - RNA, 19 nt, Homo sapiens
ggaaugcaggagaaauuag

SEQ ID NO: 864840 - RNA, 19 nt, Homo sapiens
gaagcuggccguggugcaa

SEQ ID NO: 864841 - RNA, 19 nt, Homo sapiens
ccaauggccagugauaaga

SEQ ID NO: 864842 - RNA, 19 nt, Homo sapiens
aauguaguuugcuuucuug

SEQ ID NO: 864843 - RNA, 19 nt, Homo sapiens
ugcacaagauguuccaaau

SEQ ID NO: 864844 - RNA, 19 nt, Homo sapiens
uggaaaacuucaagcauuu

SEQ ID NO: 864845 - RNA, 19 nt, Homo sapiens
ggagggauuucucuuuccu

SEQ ID NO: 864846 - RNA, 19 nt, Homo sapiens
ggagcucuauggggaguua

SEQ ID NO: 864847 - RNA, 19 nt, Homo sapiens
ggagagagggcugcucagu

SEQ ID NO: 864848 - RNA, 19 nt, Homo sapiens
gcacaggguuuucaaaucc

SEQ ID NO: 864849 - RNA, 19 nt, Homo sapiens
caauggccagugauaagaa

SEQ ID NO: 864850 - RNA, 19 nt, Homo sapiens
ccagcuucaguuuauguua

SEQ ID NO: 864851 - RNA, 19 nt, Homo sapiens
aaacuuauuccaguguuga

SEQ ID NO: 864852 - RNA, 19 nt, Homo sapiens
gcugcugugcuucauauug

SEQ ID NO: 864853 - RNA, 19 nt, Homo sapiens
gagaagcagcagucuuuac

SEQ ID NO: 864854 - RNA, 19 nt, Homo sapiens
aauggccagugauaagaaa

SEQ ID NO: 864855 - RNA, 19 nt, Homo sapiens
uagacaaucaguacacaug

SEQ ID NO: 864856 - RNA, 19 nt, Homo sapiens
gcuucauauuguugccuua

SEQ ID NO: 864857 - RNA, 19 nt, Homo sapiens
gcagaugcacaagauguuc

SEQ ID NO: 864858 - RNA, 19 nt, Homo sapiens
uuucaaauccugcaucaca

SEQ ID NO: 864859 - RNA, 19 nt, Homo sapiens
guauuugugagauuugcua

SEQ ID NO: 864860 - RNA, 19 nt, Homo sapiens
uuccugagcucaccaaacu

SEQ ID NO: 864861 - RNA, 19 nt, Homo sapiens
ccagccaaauccaguagca

SEQ ID NO: 864862 - RNA, 19 nt, Homo sapiens
ccggaaaggguacugcauu

SEQ ID NO: 864863 - RNA, 19 nt, Homo sapiens
cuuccucacugaugucuca

SEQ ID NO: 864864 - RNA, 19 nt, Homo sapiens
gacaaucaguacacaugcu

SEQ ID NO: 864865 - RNA, 19 nt, Homo sapiens
guuagacaaucaguacaca

SEQ ID NO: 864866 - RNA, 19 nt, Homo sapiens
caguuuauguuagacaauc

SEQ ID NO: 864867 - RNA, 19 nt, Homo sapiens
ggcggagggauuucucuuu

SEQ ID NO: 864868 - RNA, 19 nt, Homo sapiens
gggauuauacuugaaaugc

SEQ ID NO: 864869 - RNA, 19 nt, Homo sapiens
agauugugcugcugugcuu

SEQ ID NO: 864870 - RNA, 19 nt, Homo sapiens
aaacagccagugacuccaa

SEQ ID NO: 864871 - RNA, 19 nt, Homo sapiens
cgucacuuccguaaacaaa

SEQ ID NO: 864872 - RNA, 19 nt, Homo sapiens
agagggcugcucagucuuu

SEQ ID NO: 864873 - RNA, 19 nt, Homo sapiens
guugaucgcaagcuguuga

SEQ ID NO: 864874 - RNA, 19 nt, Homo sapiens
cgccggaguuacagcuaaa

SEQ ID NO: 864875 - RNA, 19 nt, Homo sapiens
gaagaaggauuuguaguga

SEQ ID NO: 864876 - RNA, 19 nt, Homo sapiens
gaaacugguuggugaagaa

SEQ ID NO: 864877 - RNA, 19 nt, Homo sapiens
gagaagaaacugaauuuga

SEQ ID NO: 864878 - RNA, 19 nt, Homo sapiens
ugaggaagaugaugugauu

SEQ ID NO: 864879 - RNA, 19 nt, Homo sapiens
caagugacauugagauuuc

SEQ ID NO: 864880 - RNA, 19 nt, Homo sapiens
ggagauggcuucgugaaca

SEQ ID NO: 864881 - RNA, 19 nt, Homo sapiens
caaccuagauggaaagaag

SEQ ID NO: 864882 - RNA, 19 nt, Homo sapiens
gccaagggacuucaucuua

SEQ ID NO: 864883 - RNA, 19 nt, Homo sapiens
gagagaggcugcgaguaaa

SEQ ID NO: 864884 - RNA, 19 nt, Homo sapiens
acacgaggauucuucauga

SEQ ID NO: 864885 - RNA, 19 nt, Homo sapiens
ucagaucacucagcucuuu

SEQ ID NO: 864886 - RNA, 19 nt, Homo sapiens
cuggagacguggugaaaua

SEQ ID NO: 864887 - RNA, 19 nt, Homo sapiens
cgaaacagaacaaguuaaa

SEQ ID NO: 864888 - RNA, 19 nt, Homo sapiens
ugagagaggcugcgaguaa

SEQ ID NO: 864889 - RNA, 19 nt, Homo sapiens
gaagaggaagugaguaaau

SEQ ID NO: 864890 - RNA, 19 nt, Homo sapiens
gaaagaagauuuugguagu

SEQ ID NO: 864891 - RNA, 19 nt, Homo sapiens
guuaaaggcuuguucuaag

SEQ ID NO: 864892 - RNA, 19 nt, Homo sapiens
ggaccgacguuuggaguga

SEQ ID NO: 864893 - RNA, 19 nt, Homo sapiens
ucacgaggcugacauugug

SEQ ID NO: 864894 - RNA, 19 nt, Homo sapiens
ccaccaagacugaaagaaa

SEQ ID NO: 864895 - RNA, 19 nt, Homo sapiens
gaaacagacuacucuuugc

SEQ ID NO: 864896 - RNA, 19 nt, Homo sapiens
ggguguggcucuccaagaa

SEQ ID NO: 864897 - RNA, 19 nt, Homo sapiens
ggaagcugcucuacaaugc

SEQ ID NO: 864898 - RNA, 19 nt, Homo sapiens
cauaggcgcuggguucauu

SEQ ID NO: 864899 - RNA, 19 nt, Homo sapiens
gacuucaucuuaccuauca

SEQ ID NO: 864900 - RNA, 19 nt, Homo sapiens
gcuguaaccuccagaagca

SEQ ID NO: 864901 - RNA, 19 nt, Homo sapiens
guuaaaggaucaagcagau

SEQ ID NO: 864902 - RNA, 19 nt, Homo sapiens
gaaauuugcccaucugcau

SEQ ID NO: 864903 - RNA, 19 nt, Homo sapiens
ugaaacagacuacucuuug

SEQ ID NO: 864904 - RNA, 19 nt, Homo sapiens
ucacuugacuggagacauc

SEQ ID NO: 864905 - RNA, 19 nt, Homo sapiens
caacugcucccaugacuuc

SEQ ID NO: 864906 - RNA, 19 nt, Homo sapiens
gaugcagacuccugaaaca

SEQ ID NO: 864907 - RNA, 19 nt, Homo sapiens
gcgcugagauugacuuggu

SEQ ID NO: 864908 - RNA, 19 nt, Homo sapiens
acacagagaagggccauua

SEQ ID NO: 864909 - RNA, 19 nt, Homo sapiens
cagaagaggaagugaguaa

SEQ ID NO: 864910 - RNA, 19 nt, Homo sapiens
auaaucggcugguuccuuu

SEQ ID NO: 864911 - RNA, 19 nt, Homo sapiens
guguggcucuccaagaaua

SEQ ID NO: 864912 - RNA, 19 nt, Homo sapiens
caaaauagaucguuacacu

SEQ ID NO: 864913 - RNA, 19 nt, Homo sapiens
gacaagauaaggaccauug

SEQ ID NO: 864914 - RNA, 19 nt, Homo sapiens
ggugacaggugcuuugaca

SEQ ID NO: 864915 - RNA, 19 nt, Homo sapiens
gaaaacacgcaaacagaua

SEQ ID NO: 864916 - RNA, 19 nt, Homo sapiens
ggaguucaaccuucacuug

SEQ ID NO: 864917 - RNA, 19 nt, Homo sapiens
gcaaagccaaaguacguuu

SEQ ID NO: 864918 - RNA, 19 nt, Homo sapiens
ccaagggacuucaucuuac

SEQ ID NO: 864919 - RNA, 19 nt, Homo sapiens
gauuccaguuccuguauga

SEQ ID NO: 864920 - RNA, 19 nt, Homo sapiens
aagaggaagugaguaaauu

SEQ ID NO: 864921 - RNA, 19 nt, Homo sapiens
gcuugcagaugaaauugaa

SEQ ID NO: 864922 - RNA, 19 nt, Homo sapiens
ugacauagaucuugauacc

SEQ ID NO: 864923 - RNA, 19 nt, Homo sapiens
ggauggugguggccaguga

SEQ ID NO: 864924 - RNA, 19 nt, Homo sapiens
gaagggaagagcacaguca

SEQ ID NO: 864925 - RNA, 19 nt, Homo sapiens
aaacauggaucuagaaacc

SEQ ID NO: 864926 - RNA, 19 nt, Homo sapiens
ggauuaggagugugaacua

SEQ ID NO: 864927 - RNA, 19 nt, Homo sapiens
cgagcacacugacagaaga

SEQ ID NO: 864928 - RNA, 19 nt, Homo sapiens
ugaauggugucagagaauu

SEQ ID NO: 864929 - RNA, 19 nt, Homo sapiens
ggaguuuccauuauuucua

SEQ ID NO: 864930 - RNA, 19 nt, Homo sapiens
caacaggguuuuggaaauu

SEQ ID NO: 864931 - RNA, 19 nt, Homo sapiens
ugaagaaggauuuguagug

SEQ ID NO: 864932 - RNA, 19 nt, Homo sapiens
gauaaggcucuguauaauc

SEQ ID NO: 864933 - RNA, 19 nt, Homo sapiens
gguggagacuucacugcuu

SEQ ID NO: 864934 - RNA, 19 nt, Homo sapiens
uuuggaagcugcucuacaa

SEQ ID NO: 864935 - RNA, 19 nt, Homo sapiens
ggugcgagcucugaagaug

SEQ ID NO: 864936 - RNA, 19 nt, Homo sapiens
gacaggugcuuugacaguu

SEQ ID NO: 864937 - RNA, 19 nt, Homo sapiens
uggcagagaguauuggaua

SEQ ID NO: 864938 - RNA, 19 nt, Homo sapiens
gaggaagugaguaaauuug

SEQ ID NO: 864939 - RNA, 19 nt, Homo sapiens
gaauggugucagagaauuu

SEQ ID NO: 864940 - RNA, 19 nt, Homo sapiens
uagaaagguuaaaggauca

SEQ ID NO: 864941 - RNA, 19 nt, Homo sapiens
ggaccuccaccaagacuga

SEQ ID NO: 864942 - RNA, 19 nt, Homo sapiens
ccaagugacauugagauuu

SEQ ID NO: 864943 - RNA, 19 nt, Homo sapiens
aaaaggaccuccaccaaga

SEQ ID NO: 864944 - RNA, 19 nt, Homo sapiens
aaauagaucguuacacuca

SEQ ID NO: 864945 - RNA, 19 nt, Homo sapiens
gcugguuccuuuagugaau

SEQ ID NO: 864946 - RNA, 19 nt, Homo sapiens
agauaaggcucuguauaau

SEQ ID NO: 864947 - RNA, 19 nt, Homo sapiens
caucaccgcugccaauaac

SEQ ID NO: 864948 - RNA, 19 nt, Homo sapiens
caaggagauuggauugcuu

SEQ ID NO: 864949 - RNA, 19 nt, Homo sapiens
gaguuuccauuauuucuac

SEQ ID NO: 864950 - RNA, 19 nt, Homo sapiens
aaaugucuguuaugcaaug

SEQ ID NO: 864951 - RNA, 19 nt, Homo sapiens
uuaaaggcuuguucuaagu

SEQ ID NO: 864952 - RNA, 19 nt, Homo sapiens
gauguucagguuccaauug

SEQ ID NO: 864953 - RNA, 19 nt, Homo sapiens
cggcugguguuccucuuaa

SEQ ID NO: 864954 - RNA, 19 nt, Homo sapiens
acaggugcuuugacaguuu

SEQ ID NO: 864955 - RNA, 19 nt, Homo sapiens
ggacagccucgcagacaug

SEQ ID NO: 864956 - RNA, 19 nt, Homo sapiens
caccaagacugaaagaaac

SEQ ID NO: 864957 - RNA, 19 nt, Homo sapiens
ggagaagaaacugaauuug

SEQ ID NO: 864958 - RNA, 19 nt, Homo sapiens
aaacagaacaaguuaaagg

SEQ ID NO: 864959 - RNA, 19 nt, Homo sapiens
ccgcacaccugaaugucaa

SEQ ID NO: 864960 - RNA, 19 nt, Homo sapiens
caagaggacaaacuccaaa

SEQ ID NO: 864961 - RNA, 19 nt, Homo sapiens
uggagaagaaacugaauuu

SEQ ID NO: 864962 - RNA, 19 nt, Homo sapiens
caaagauauugaacucucu

SEQ ID NO: 864963 - RNA, 19 nt, Homo sapiens
gaaauucuucaacaucaag

SEQ ID NO: 864964 - RNA, 19 nt, Homo sapiens
cuauggagccaaagauauu

SEQ ID NO: 864965 - RNA, 19 nt, Homo sapiens
aaugaccgauuucuacgaa

SEQ ID NO: 864966 - RNA, 19 nt, Homo sapiens
gggaauaaauaagacugau

SEQ ID NO: 864967 - RNA, 19 nt, Homo sapiens
uuggauugcuugcagauga

SEQ ID NO: 864968 - RNA, 19 nt, Homo sapiens
cuagauggaaagaagauuu

SEQ ID NO: 864969 - RNA, 19 nt, Homo sapiens
agauugacuugguguguga

SEQ ID NO: 864970 - RNA, 19 nt, Homo sapiens
ggugguggccagugacaaa

SEQ ID NO: 864971 - RNA, 19 nt, Homo sapiens
auaaggcucuguauaaucg

SEQ ID NO: 864972 - RNA, 19 nt, Homo sapiens
caaaagcaaagccaaagua

SEQ ID NO: 864973 - RNA, 19 nt, Homo sapiens
gaaaaggguccaugacaau

SEQ ID NO: 864974 - RNA, 19 nt, Homo sapiens
caaugccuguuccagagaa

SEQ ID NO: 864975 - RNA, 19 nt, Homo sapiens
gauaugaguugcuguauaa

SEQ ID NO: 864976 - RNA, 19 nt, Homo sapiens
gaagauggcugcagacaag

SEQ ID NO: 864977 - RNA, 19 nt, Homo sapiens
ccacucagcuguugaagaa

SEQ ID NO: 864978 - RNA, 19 nt, Homo sapiens
gcaauggaauccucuggua

SEQ ID NO: 864979 - RNA, 19 nt, Homo sapiens
ggucaaggcuaucaucgua

SEQ ID NO: 864980 - RNA, 19 nt, Homo sapiens
gagcuuauauccaaaugaa

SEQ ID NO: 864981 - RNA, 19 nt, Homo sapiens
gaaaucaagucagucauga

SEQ ID NO: 864982 - RNA, 19 nt, Homo sapiens
gaaagaaugagacugguaa

SEQ ID NO: 864983 - RNA, 19 nt, Homo sapiens
gccaaaagcuuacuuaaaa

SEQ ID NO: 864984 - RNA, 19 nt, Homo sapiens
gugauaaccucauggcuuu

SEQ ID NO: 864985 - RNA, 19 nt, Homo sapiens
gucaggaucucuuaaguuu

SEQ ID NO: 864986 - RNA, 19 nt, Homo sapiens
gaauucagcuucuucacau

SEQ ID NO: 864987 - RNA, 19 nt, Homo sapiens
caaaugaagucucugaaag

SEQ ID NO: 864988 - RNA, 19 nt, Homo sapiens
ggaacuagcucucgucacu

SEQ ID NO: 864989 - RNA, 19 nt, Homo sapiens
gaaaguggagcucuaauag

SEQ ID NO: 864990 - RNA, 19 nt, Homo sapiens
uaucacagcagaaugaaua

SEQ ID NO: 864991 - RNA, 19 nt, Homo sapiens
ugacaaagcccgaaagugu

SEQ ID NO: 864992 - RNA, 19 nt, Homo sapiens
agaaauggauggauuagau

SEQ ID NO: 864993 - RNA, 19 nt, Homo sapiens
uuagggaucucuucaaaug

SEQ ID NO: 864994 - RNA, 19 nt, Homo sapiens
gagaaagcuuugcaucuuc

SEQ ID NO: 864995 - RNA, 19 nt, Homo sapiens
ugagaaagcuuugcaucuu

SEQ ID NO: 864996 - RNA, 19 nt, Homo sapiens
ggugaaggcuguuaauuuu

SEQ ID NO: 864997 - RNA, 19 nt, Homo sapiens
ggacugugaugcuguucaa

SEQ ID NO: 864998 - RNA, 19 nt, Homo sapiens
ggaauuguacagucuauug

SEQ ID NO: 864999 - RNA, 19 nt, Homo sapiens
gaaugagacugguaauaac

SEQ ID NO: 865000 - RNA, 19 nt, Homo sapiens
ggaccaaggaucagacaaa

SEQ ID NO: 865001 - RNA, 19 nt, Homo sapiens
ucucagaaaugccuuguug

SEQ ID NO: 865002 - RNA, 19 nt, Homo sapiens
gaaaagccgugaagcuauu

SEQ ID NO: 865003 - RNA, 19 nt, Homo sapiens
uggauuagaugauguugaa

SEQ ID NO: 865004 - RNA, 19 nt, Homo sapiens
uuaaccagcugaagaauca

SEQ ID NO: 865005 - RNA, 19 nt, Homo sapiens
gagaaagaagccaguguuu

SEQ ID NO: 865006 - RNA, 19 nt, Homo sapiens
agaaugagacugguaauaa

SEQ ID NO: 865007 - RNA, 19 nt, Homo sapiens
gggaagaacccgagucgaa

SEQ ID NO: 865008 - RNA, 19 nt, Homo sapiens
ggaaagaaugagacuggua

SEQ ID NO: 865009 - RNA, 19 nt, Homo sapiens
gaacugcagaaugguaaua

SEQ ID NO: 865010 - RNA, 19 nt, Homo sapiens
ugaagaaauggauggauua

SEQ ID NO: 865011 - RNA, 19 nt, Homo sapiens
ccucaucucucucgacaga

SEQ ID NO: 865012 - RNA, 19 nt, Homo sapiens
ucaaggcuaucaucguaaa

SEQ ID NO: 865013 - RNA, 19 nt, Homo sapiens
cuaaaggccuucccagcaa

SEQ ID NO: 865014 - RNA, 19 nt, Homo sapiens
gaagacccauguguacguu

SEQ ID NO: 865015 - RNA, 19 nt, Homo sapiens
caagcacaauuugggaaua

SEQ ID NO: 865016 - RNA, 19 nt, Homo sapiens
ggaaaucaagucagucaug

SEQ ID NO: 865017 - RNA, 19 nt, Homo sapiens
ugaaaguggagcucuaaua

SEQ ID NO: 865018 - RNA, 19 nt, Homo sapiens
caacagauaauuugagaca

SEQ ID NO: 865019 - RNA, 19 nt, Homo sapiens
gaaauuaugaugccugucu

SEQ ID NO: 865020 - RNA, 19 nt, Homo sapiens
gcagccauaugucucagaa

SEQ ID NO: 865021 - RNA, 19 nt, Homo sapiens
ggaaaacuguuaccugaga

SEQ ID NO: 865022 - RNA, 19 nt, Homo sapiens
cagcuggccuuacagauca

SEQ ID NO: 865023 - RNA, 19 nt, Homo sapiens
ugagaugcauguucuggaa

SEQ ID NO: 865024 - RNA, 19 nt, Homo sapiens
gaggagcgaauaugacaaa

SEQ ID NO: 865025 - RNA, 19 nt, Homo sapiens
agauaugaguugcuguaua

SEQ ID NO: 865026 - RNA, 19 nt, Homo sapiens
ucaagucagucaugaauac

SEQ ID NO: 865027 - RNA, 19 nt, Homo sapiens
cagaagcccucaucucucu

SEQ ID NO: 865028 - RNA, 19 nt, Homo sapiens
ccaaaugaagucucugaaa

SEQ ID NO: 865029 - RNA, 19 nt, Homo sapiens
ucagccagacuauuaauuu

SEQ ID NO: 865030 - RNA, 19 nt, Homo sapiens
agacaaaggugaaaaugaa

SEQ ID NO: 865031 - RNA, 19 nt, Homo sapiens
ucaauuaggugggaacaca

SEQ ID NO: 865032 - RNA, 19 nt, Homo sapiens
uaaaggccuucccagcaaa

SEQ ID NO: 865033 - RNA, 19 nt, Homo sapiens
aaagggaaaucaagucagu

SEQ ID NO: 865034 - RNA, 19 nt, Homo sapiens
gaaauggauggauuagaug

SEQ ID NO: 865035 - RNA, 19 nt, Homo sapiens
agaugcauguucuggaaua

SEQ ID NO: 865036 - RNA, 19 nt, Homo sapiens
guacgagcuuauauccaaa

SEQ ID NO: 865037 - RNA, 19 nt, Homo sapiens
gcaguauacagaagccaua

SEQ ID NO: 865038 - RNA, 19 nt, Homo sapiens
ccuuagggaucucuucaaa

SEQ ID NO: 865039 - RNA, 19 nt, Homo sapiens
ugucacugaugucuccuua

SEQ ID NO: 865040 - RNA, 19 nt, Homo sapiens
gcaucacagucuauacaga

SEQ ID NO: 865041 - RNA, 19 nt, Homo sapiens
ggaauucagcuucuucaca

SEQ ID NO: 865042 - RNA, 19 nt, Homo sapiens
ccaauaagagauaugaguu

SEQ ID NO: 865043 - RNA, 19 nt, Homo sapiens
cacccucucucuuucuuaa

SEQ ID NO: 865044 - RNA, 19 nt, Homo sapiens
aauagaagcugcaaaauca

SEQ ID NO: 865045 - RNA, 19 nt, Homo sapiens
uugaagaaauggauggauu

SEQ ID NO: 865046 - RNA, 19 nt, Homo sapiens
ucaccacugugcagagaaa

SEQ ID NO: 865047 - RNA, 19 nt, Homo sapiens
cuucaaugauccauccuaa

SEQ ID NO: 865048 - RNA, 19 nt, Homo sapiens
ggaguuugcagccauaugu

SEQ ID NO: 865049 - RNA, 19 nt, Homo sapiens
ggugaaugcuugagaugca

SEQ ID NO: 865050 - RNA, 19 nt, Homo sapiens
aauuucagccagacuauua

SEQ ID NO: 865051 - RNA, 19 nt, Homo sapiens
ccaggcggcuucaaugauc

SEQ ID NO: 865052 - RNA, 19 nt, Homo sapiens
cggagaaugucacugaugu

SEQ ID NO: 865053 - RNA, 19 nt, Homo sapiens
acauuuauaugcugcagaa

SEQ ID NO: 865054 - RNA, 19 nt, Homo sapiens
cuacguggcucuggcuuug

SEQ ID NO: 865055 - RNA, 19 nt, Homo sapiens
ucaggaagacccaugugua

SEQ ID NO: 865056 - RNA, 19 nt, Homo sapiens
aguacgagcuuauauccaa

SEQ ID NO: 865057 - RNA, 19 nt, Homo sapiens
gaccaaggaucagacaaag

SEQ ID NO: 865058 - RNA, 19 nt, Homo sapiens
gcucuggcuuugggugaua

SEQ ID NO: 865059 - RNA, 19 nt, Homo sapiens
caaaguacgagcuuauauc

SEQ ID NO: 865060 - RNA, 19 nt, Homo sapiens
caaagauacaucaguacaa

SEQ ID NO: 865061 - RNA, 19 nt, Homo sapiens
ucacaucuggaaauuauga

SEQ ID NO: 865062 - RNA, 19 nt, Homo sapiens
gagaauuuacuggccauuu

SEQ ID NO: 865063 - RNA, 19 nt, Homo sapiens
auacucagcuggccuuaca

SEQ ID NO: 865064 - RNA, 19 nt, Homo sapiens
ucaaugauccauccuaaag

SEQ ID NO: 865065 - RNA, 19 nt, Homo sapiens
gcacaauuugggaauauuc

SEQ ID NO: 865066 - RNA, 19 nt, Homo sapiens
gaugcauguucuggaauaa

SEQ ID NO: 865067 - RNA, 19 nt, Homo sapiens
gguaauaacaacaacaaag

SEQ ID NO: 865068 - RNA, 19 nt, Homo sapiens
gcuuguagaccuguauaua

SEQ ID NO: 865069 - RNA, 19 nt, Homo sapiens
aagcagucauucuuuauca

SEQ ID NO: 865070 - RNA, 19 nt, Homo sapiens
cagacaagccugcagauca

SEQ ID NO: 865071 - RNA, 19 nt, Homo sapiens
ucacugaugucuccuuagg

SEQ ID NO: 865072 - RNA, 19 nt, Homo sapiens
caucacagucuauacagaa

SEQ ID NO: 865073 - RNA, 19 nt, Homo sapiens
caauaagagauaugaguug

SEQ ID NO: 865074 - RNA, 19 nt, Homo sapiens
guauacagaagccauauca

SEQ ID NO: 865075 - RNA, 19 nt, Homo sapiens
gcacuaugaugacgaggaa

SEQ ID NO: 865076 - RNA, 19 nt, Homo sapiens
ggaagaagaggaugaugaa

SEQ ID NO: 865077 - RNA, 19 nt, Homo sapiens
ucaaugagguggacaugga

SEQ ID NO: 865078 - RNA, 19 nt, Homo sapiens
gcucagagagguuaaguga

SEQ ID NO: 865079 - RNA, 19 nt, Homo sapiens
caucaggccuggcuccaaa

SEQ ID NO: 865080 - RNA, 19 nt, Homo sapiens
ggacauggaaggcaacgaa

SEQ ID NO: 865081 - RNA, 19 nt, Homo sapiens
cgagaugaaugacuacaau

SEQ ID NO: 865082 - RNA, 19 nt, Homo sapiens
gaucaggaccaguggauga

SEQ ID NO: 865083 - RNA, 19 nt, Homo sapiens
ccucagagcacuaugauga

SEQ ID NO: 865084 - RNA, 19 nt, Homo sapiens
agaagaggaugaugaagau

SEQ ID NO: 865085 - RNA, 19 nt, Homo sapiens
gagacucugugguuuaauc

SEQ ID NO: 865086 - RNA, 19 nt, Homo sapiens
uaggagccauguccacuuu

SEQ ID NO: 865087 - RNA, 19 nt, Homo sapiens
ucagagagguuaagugacu

SEQ ID NO: 865088 - RNA, 19 nt, Homo sapiens
ggacauggacgagaugaau

SEQ ID NO: 865089 - RNA, 19 nt, Homo sapiens
ugacugagacucugugguu

SEQ ID NO: 865090 - RNA, 19 nt, Homo sapiens
uggacgagaugaaugacua

SEQ ID NO: 865091 - RNA, 19 nt, Homo sapiens
ugaugaagaugaugaggau

SEQ ID NO: 865092 - RNA, 19 nt, Homo sapiens
ggagccauguccacuuugu

SEQ ID NO: 865093 - RNA, 19 nt, Homo sapiens
uaaagacaaaggagugauu

SEQ ID NO: 865094 - RNA, 19 nt, Homo sapiens
ggucaaacagcuaguaagu

SEQ ID NO: 865095 - RNA, 19 nt, Homo sapiens
ggaucgacccuguguggaa

SEQ ID NO: 865096 - RNA, 19 nt, Homo sapiens
cugagacucugugguuuaa

SEQ ID NO: 865097 - RNA, 19 nt, Homo sapiens
ccaucagucugcacuugaa

SEQ ID NO: 865098 - RNA, 19 nt, Homo sapiens
ggaaggcaacgaacaggau

SEQ ID NO: 865099 - RNA, 19 nt, Homo sapiens
aagaagaggaugaugaaga

SEQ ID NO: 865100 - RNA, 19 nt, Homo sapiens
ggccaucagucugcacuug

SEQ ID NO: 865101 - RNA, 19 nt, Homo sapiens
gacugagacucugugguuu

SEQ ID NO: 865102 - RNA, 19 nt, Homo sapiens
gaaaacaaaaggagacgaa

SEQ ID NO: 865103 - RNA, 19 nt, Homo sapiens
ggucuggucuaaguuucuu

SEQ ID NO: 865104 - RNA, 19 nt, Homo sapiens
acucaaagccagucuagga

SEQ ID NO: 865105 - RNA, 19 nt, Homo sapiens
caaggucaaacagcuagua

SEQ ID NO: 865106 - RNA, 19 nt, Homo sapiens
cagaggaugaugaggauau

SEQ ID NO: 865107 - RNA, 19 nt, Homo sapiens
aaagacaaaggagugauuu

SEQ ID NO: 865108 - RNA, 19 nt, Homo sapiens
acaaugagucaccggauga

SEQ ID NO: 865109 - RNA, 19 nt, Homo sapiens
gagaugaaugacuacaaug

SEQ ID NO: 865110 - RNA, 19 nt, Homo sapiens
agaugaaugacuacaauga

SEQ ID NO: 865111 - RNA, 19 nt, Homo sapiens
gguggagccaggacucaaa

SEQ ID NO: 865112 - RNA, 19 nt, Homo sapiens
ugaagaggacucagaggau

SEQ ID NO: 865113 - RNA, 19 nt, Homo sapiens
aagaugaugaggauaguga

SEQ ID NO: 865114 - RNA, 19 nt, Homo sapiens
aagaggaugaugaagauga

SEQ ID NO: 865115 - RNA, 19 nt, Homo sapiens
gaugaaugacuacaaugag

SEQ ID NO: 865116 - RNA, 19 nt, Homo sapiens
ugaagaugaugaggauagu

SEQ ID NO: 865117 - RNA, 19 nt, Homo sapiens
agaggaugaugaagaugau

SEQ ID NO: 865118 - RNA, 19 nt, Homo sapiens
uccaaagcaucgcggagaa

SEQ ID NO: 865119 - RNA, 19 nt, Homo sapiens
acugagacucugugguuua

SEQ ID NO: 865120 - RNA, 19 nt, Homo sapiens
ccaccuuccuggccaguac

SEQ ID NO: 865121 - RNA, 19 nt, Homo sapiens
aggaagaagaggaugauga

SEQ ID NO: 865122 - RNA, 19 nt, Homo sapiens
ccaaagcaucgcggagaaa

SEQ ID NO: 865123 - RNA, 19 nt, Homo sapiens
gacauggacgagaugaaug

SEQ ID NO: 865124 - RNA, 19 nt, Homo sapiens
acauggacgagaugaauga

SEQ ID NO: 865125 - RNA, 19 nt, Homo sapiens
caaaggagugauuuucaaa

SEQ ID NO: 865126 - RNA, 19 nt, Homo sapiens
acaaaggagugauuuucaa

SEQ ID NO: 865127 - RNA, 19 nt, Homo sapiens
ggauucugguggguucuuc

SEQ ID NO: 865128 - RNA, 19 nt, Homo sapiens
ugaugaggauagugaagag

SEQ ID NO: 865129 - RNA, 19 nt, Homo sapiens
gccaucagucugcacuuga

SEQ ID NO: 865130 - RNA, 19 nt, Homo sapiens
augaaugacuacaaugagu

SEQ ID NO: 865131 - RNA, 19 nt, Homo sapiens
gaagaugaugaggauagug

SEQ ID NO: 865132 - RNA, 19 nt, Homo sapiens
gaagaggaugaugaagaug

SEQ ID NO: 865133 - RNA, 19 nt, Homo sapiens
ucuggucuaaguuucuuua

SEQ ID NO: 865134 - RNA, 19 nt, Homo sapiens
caggaccaguggaugaucu

SEQ ID NO: 865135 - RNA, 19 nt, Homo sapiens
gcaggacauggacgagaug

SEQ ID NO: 865136 - RNA, 19 nt, Homo sapiens
gaagaagaggaugaugaag

SEQ ID NO: 865137 - RNA, 19 nt, Homo sapiens
caaagcaucgcggagaaag

SEQ ID NO: 865138 - RNA, 19 nt, Homo sapiens
caaugagguggacauggaa

SEQ ID NO: 865139 - RNA, 19 nt, Homo sapiens
agaggaugaugaggauaug

SEQ ID NO: 865140 - RNA, 19 nt, Homo sapiens
ugacgaggaagaagaggau

SEQ ID NO: 865141 - RNA, 19 nt, Homo sapiens
gagaagcucuuuguaucug

SEQ ID NO: 865142 - RNA, 19 nt, Homo sapiens
gcuggcggcugaaccguaa

SEQ ID NO: 865143 - RNA, 19 nt, Homo sapiens
gaagcucuuuguaucugaa

SEQ ID NO: 865144 - RNA, 19 nt, Homo sapiens
ggauuuaacaccgauauau

SEQ ID NO: 865145 - RNA, 19 nt, Homo sapiens
aaguugaucuauccaguga

SEQ ID NO: 865146 - RNA, 19 nt, Homo sapiens
gcgagccgcugcauuucug

SEQ ID NO: 865147 - RNA, 19 nt, Homo sapiens
ccgaaaagcagauguuuaa

SEQ ID NO: 865148 - RNA, 19 nt, Homo sapiens
gcugguggccugcuucaug

SEQ ID NO: 865149 - RNA, 19 nt, Homo sapiens
gagggcaugggaaggauuu

SEQ ID NO: 865150 - RNA, 19 nt, Homo sapiens
ggugggcguuucuucuugu

SEQ ID NO: 865151 - RNA, 19 nt, Homo sapiens
ugcuauugcuguaguaaga

SEQ ID NO: 865152 - RNA, 19 nt, Homo sapiens
cugguggccugcuucauga

SEQ ID NO: 865153 - RNA, 19 nt, Homo sapiens
gggcaugggaaggauuuaa

SEQ ID NO: 865154 - RNA, 19 nt, Homo sapiens
gaaggauuuaacaccgaua

SEQ ID NO: 865155 - RNA, 19 nt, Homo sapiens
cuuuguaucugaacauagu

SEQ ID NO: 865156 - RNA, 19 nt, Homo sapiens
gcaugggaaggauuuaaca

SEQ ID NO: 865157 - RNA, 19 nt, Homo sapiens
gggcguuucuucuuguacu

SEQ ID NO: 865158 - RNA, 19 nt, Homo sapiens
agaagcucuuuguaucuga

SEQ ID NO: 865159 - RNA, 19 nt, Homo sapiens
cacgugcccuagauucaug

SEQ ID NO: 865160 - RNA, 19 nt, Homo sapiens
gcugaaccguaagcccauu

SEQ ID NO: 865161 - RNA, 19 nt, Homo sapiens
gugggcguuucuucuugua

SEQ ID NO: 865162 - RNA, 19 nt, Homo sapiens
aaauugcuauugcuguagu

SEQ ID NO: 865163 - RNA, 19 nt, Homo sapiens
ggcagaaaaugaccaaauc

SEQ ID NO: 865164 - RNA, 19 nt, Homo sapiens
gcuucgugcuguaguuauc

SEQ ID NO: 865165 - RNA, 19 nt, Homo sapiens
gugcuucgugcuguaguua

SEQ ID NO: 865166 - RNA, 19 nt, Homo sapiens
cuauugcuguaguaagaga

SEQ ID NO: 865167 - RNA, 19 nt, Homo sapiens
gcguuucuucuuguacuua

SEQ ID NO: 865168 - RNA, 19 nt, Homo sapiens
gugcuguaguuaucguuag

SEQ ID NO: 865169 - RNA, 19 nt, Homo sapiens
agggcgagccgcugcauuu

SEQ ID NO: 865170 - RNA, 19 nt, Homo sapiens
guaucugaacauaguugua

SEQ ID NO: 865171 - RNA, 19 nt, Homo sapiens
gggcuuccagugcgaccua

SEQ ID NO: 865172 - RNA, 19 nt, Homo sapiens
ggagggcaugggaaggauu

SEQ ID NO: 865173 - RNA, 19 nt, Homo sapiens
gggagggcaugggaaggau

SEQ ID NO: 865174 - RNA, 19 nt, Homo sapiens
gaagagaacuggauuauua

SEQ ID NO: 865175 - RNA, 19 nt, Homo sapiens
gaaagaagcucccagcauu

SEQ ID NO: 865176 - RNA, 19 nt, Homo sapiens
ggacagauccuucuuauug

SEQ ID NO: 865177 - RNA, 19 nt, Homo sapiens
ggauuuaucuucucaguuu

SEQ ID NO: 865178 - RNA, 19 nt, Homo sapiens
gaacggcgcuguggaagua

SEQ ID NO: 865179 - RNA, 19 nt, Homo sapiens
gaacaagaauuacagauca

SEQ ID NO: 865180 - RNA, 19 nt, Homo sapiens
ugacuuagcugauaacaaa

SEQ ID NO: 865181 - RNA, 19 nt, Homo sapiens
gaaccaaacucugaagauu

SEQ ID NO: 865182 - RNA, 19 nt, Homo sapiens
gcaggaauguuuagugaaa

SEQ ID NO: 865183 - RNA, 19 nt, Homo sapiens
gaacaggucuuggaaggaa

SEQ ID NO: 865184 - RNA, 19 nt, Homo sapiens
gaagaaccaucuccuauag

SEQ ID NO: 865185 - RNA, 19 nt, Homo sapiens
gaagauggauaacagaaga

SEQ ID NO: 865186 - RNA, 19 nt, Homo sapiens
gaacaagcuugaagaugaa

SEQ ID NO: 865187 - RNA, 19 nt, Homo sapiens
gggaaagccuucuguauau

SEQ ID NO: 865188 - RNA, 19 nt, Homo sapiens
gaaacaagcacaaugacua

SEQ ID NO: 865189 - RNA, 19 nt, Homo sapiens
caaagacacugcugaaugu

SEQ ID NO: 865190 - RNA, 19 nt, Homo sapiens
gagcaggaauguuuaguga

SEQ ID NO: 865191 - RNA, 19 nt, Homo sapiens
gcaauagguugaauauaga

SEQ ID NO: 865192 - RNA, 19 nt, Homo sapiens
gcaauaaguuugugguuuc

SEQ ID NO: 865193 - RNA, 19 nt, Homo sapiens
cagaugaaaugacacauaa

SEQ ID NO: 865194 - RNA, 19 nt, Homo sapiens
gcacauguaugaagucugu

SEQ ID NO: 865195 - RNA, 19 nt, Homo sapiens
ggauggagauaaagaugua

SEQ ID NO: 865196 - RNA, 19 nt, Homo sapiens
agaacaagcuugaagauga

SEQ ID NO: 865197 - RNA, 19 nt, Homo sapiens
gaaacaauaccuuuaguga

SEQ ID NO: 865198 - RNA, 19 nt, Homo sapiens
agaaggagaucuacaagaa

SEQ ID NO: 865199 - RNA, 19 nt, Homo sapiens
cuccagggcuucagaauua

SEQ ID NO: 865200 - RNA, 19 nt, Homo sapiens
gaagaacaguuagaagcua

SEQ ID NO: 865201 - RNA, 19 nt, Homo sapiens
gaacagccguuucaacucu

SEQ ID NO: 865202 - RNA, 19 nt, Homo sapiens
caucucaccuccugcuuua

SEQ ID NO: 865203 - RNA, 19 nt, Homo sapiens
guuaagguuucaucuguua

SEQ ID NO: 865204 - RNA, 19 nt, Homo sapiens
ccacugcacuaacuacuaa

SEQ ID NO: 865205 - RNA, 19 nt, Homo sapiens
gaacugaagcuucucuuug

SEQ ID NO: 865206 - RNA, 19 nt, Homo sapiens
gagaaagugugaugagaga

SEQ ID NO: 865207 - RNA, 19 nt, Homo sapiens
ggaaauaagcaagaugaua

SEQ ID NO: 865208 - RNA, 19 nt, Homo sapiens
ucaggaaaguguugaaauu

SEQ ID NO: 865209 - RNA, 19 nt, Homo sapiens
aagaugaacugaaagauga

SEQ ID NO: 865210 - RNA, 19 nt, Homo sapiens
gaacaguccauucaugaaa

SEQ ID NO: 865211 - RNA, 19 nt, Homo sapiens
gacagaaguuugagcguuu

SEQ ID NO: 865212 - RNA, 19 nt, Homo sapiens
uaacagcuauugaaccuau

SEQ ID NO: 865213 - RNA, 19 nt, Homo sapiens
gacaagcagcugcguauua

SEQ ID NO: 865214 - RNA, 19 nt, Homo sapiens
gaaacugaauggccgaaga

SEQ ID NO: 865215 - RNA, 19 nt, Homo sapiens
gaauggacguggaauaaag

SEQ ID NO: 865216 - RNA, 19 nt, Homo sapiens
guuagaagcuauauuguca

SEQ ID NO: 865217 - RNA, 19 nt, Homo sapiens
gagagaaguuuaaauagag

SEQ ID NO: 865218 - RNA, 19 nt, Homo sapiens
ggagagcgauugucugcuu

SEQ ID NO: 865219 - RNA, 19 nt, Homo sapiens
gaugauaaauccagugaca

SEQ ID NO: 865220 - RNA, 19 nt, Homo sapiens
ggaaacuccucgcucacua

SEQ ID NO: 865221 - RNA, 19 nt, Homo sapiens
gcuugaaacuccucuugua

SEQ ID NO: 865222 - RNA, 19 nt, Homo sapiens
gaaagccuucuguauauuu

SEQ ID NO: 865223 - RNA, 19 nt, Homo sapiens
caggacaaaucuuauauga

SEQ ID NO: 865224 - RNA, 19 nt, Homo sapiens
ggagaaagaaagaaguuaa

SEQ ID NO: 865225 - RNA, 19 nt, Homo sapiens
gaaacuggaugugagcaaa

SEQ ID NO: 865226 - RNA, 19 nt, Homo sapiens
gauggaagauuuacugaag

SEQ ID NO: 865227 - RNA, 19 nt, Homo sapiens
gacaagcccucagauauau

SEQ ID NO: 865228 - RNA, 19 nt, Homo sapiens
ggaguguucucugucuuua

SEQ ID NO: 865229 - RNA, 19 nt, Homo sapiens
gcuugaagaugaacugaaa

SEQ ID NO: 865230 - RNA, 19 nt, Homo sapiens
gaagaacgcacagaugaaa

SEQ ID NO: 865231 - RNA, 19 nt, Homo sapiens
ugacauugcugaaguagau

SEQ ID NO: 865232 - RNA, 19 nt, Homo sapiens
gcuaggaaucuuucauuua

SEQ ID NO: 865233 - RNA, 19 nt, Homo sapiens
gcacuaacuacuaauguaa

SEQ ID NO: 865234 - RNA, 19 nt, Homo sapiens
ccacauggcaucuuggaua

SEQ ID NO: 865235 - RNA, 19 nt, Homo sapiens
ggaaagccuucuguauauu

SEQ ID NO: 865236 - RNA, 19 nt, Homo sapiens
gaagaugaacugaaagaug

SEQ ID NO: 865237 - RNA, 19 nt, Homo sapiens
gcaaauaccucaaaauucu

SEQ ID NO: 865238 - RNA, 19 nt, Homo sapiens
gcacaaugacuaugaaugu

SEQ ID NO: 865239 - RNA, 19 nt, Homo sapiens
cagcuggccuuugguaaua

SEQ ID NO: 865240 - RNA, 19 nt, Homo sapiens
gaucuaaggcuguuaagga

SEQ ID NO: 865241 - RNA, 19 nt, Homo sapiens
acaagcagcugcguauuaa

SEQ ID NO: 865242 - RNA, 19 nt, Homo sapiens
aaacgugaaugucaaauca

SEQ ID NO: 865243 - RNA, 19 nt, Homo sapiens
guaguaaacucuauaacag

SEQ ID NO: 865244 - RNA, 19 nt, Homo sapiens
cugcacagcugaaagaauu

SEQ ID NO: 865245 - RNA, 19 nt, Homo sapiens
gaaaucuccuuuguaccua

SEQ ID NO: 865246 - RNA, 19 nt, Homo sapiens
ggcucgaaauucuauauua

SEQ ID NO: 865247 - RNA, 19 nt, Homo sapiens
caaacacucuauuaccauu

SEQ ID NO: 865248 - RNA, 19 nt, Homo sapiens
cugauagacuuaagcaaua

SEQ ID NO: 865249 - RNA, 19 nt, Homo sapiens
gagagaaguuaguccauca

SEQ ID NO: 865250 - RNA, 19 nt, Homo sapiens
caugaaaucuccuuuguac

SEQ ID NO: 865251 - RNA, 19 nt, Homo sapiens
gaacuguguugacaagauc

SEQ ID NO: 865252 - RNA, 19 nt, Homo sapiens
uggcaacauucaaagauua

SEQ ID NO: 865253 - RNA, 19 nt, Homo sapiens
gagagugguuuggaucuuu

SEQ ID NO: 865254 - RNA, 19 nt, Homo sapiens
gacagauccuucuuauuga

SEQ ID NO: 865255 - RNA, 19 nt, Homo sapiens
ccacuaaauuggucaaauc

SEQ ID NO: 865256 - RNA, 19 nt, Homo sapiens
gaauuucauuuguggaaga

SEQ ID NO: 865257 - RNA, 19 nt, Homo sapiens
agacaagcccucagauaua

SEQ ID NO: 865258 - RNA, 19 nt, Homo sapiens
uauaaucgaugucuuguag

SEQ ID NO: 865259 - RNA, 19 nt, Homo sapiens
agaaggagacuuugacuuu

SEQ ID NO: 865260 - RNA, 19 nt, Homo sapiens
ugaugccacuuguuuguua

SEQ ID NO: 865261 - RNA, 19 nt, Homo sapiens
guacaugagagaaguuuaa

SEQ ID NO: 865262 - RNA, 19 nt, Homo sapiens
caucagaucuugaaguucu

SEQ ID NO: 865263 - RNA, 19 nt, Homo sapiens
gaaacugucuuccuaucca

SEQ ID NO: 865264 - RNA, 19 nt, Homo sapiens
gcaauuagagcaaaugaca

SEQ ID NO: 865265 - RNA, 19 nt, Homo sapiens
acacugagcaggaauguuu

SEQ ID NO: 865266 - RNA, 19 nt, Homo sapiens
caaagauuauucaggcauu

SEQ ID NO: 865267 - RNA, 19 nt, Homo sapiens
gaugauugauggacugguu

SEQ ID NO: 865268 - RNA, 19 nt, Homo sapiens
gcugaaguaccacacauua

SEQ ID NO: 865269 - RNA, 19 nt, Homo sapiens
ggaaccagcaguugaagaa

SEQ ID NO: 865270 - RNA, 19 nt, Homo sapiens
caaaucagcacaacaggaa

SEQ ID NO: 865271 - RNA, 19 nt, Homo sapiens
cauaaugugucccacuaaa

SEQ ID NO: 865272 - RNA, 19 nt, Homo sapiens
uaacacagcaacugaagaa

SEQ ID NO: 865273 - RNA, 19 nt, Homo sapiens
gcaagcaaagaaccuauaa

SEQ ID NO: 865274 - RNA, 19 nt, Homo sapiens
gcaaggaucuacuuuaauu

SEQ ID NO: 865275 - RNA, 19 nt, Homo sapiens
gcacuggucugacuuuaua

SEQ ID NO: 865276 - RNA, 19 nt, Homo sapiens
gcaaagcacucauugauac

SEQ ID NO: 865277 - RNA, 19 nt, Homo sapiens
uugaagagcuuuaaggaua

SEQ ID NO: 865278 - RNA, 19 nt, Homo sapiens
gaacauuggcuaagacuau

SEQ ID NO: 865279 - RNA, 19 nt, Homo sapiens
gaaggacucuugccguaga

SEQ ID NO: 865280 - RNA, 19 nt, Homo sapiens
ggauaacuauaacacauug

SEQ ID NO: 865281 - RNA, 19 nt, Homo sapiens
uggaauaacuuaccuuugu

SEQ ID NO: 865282 - RNA, 19 nt, Homo sapiens
gaaagaggagauugauauu

SEQ ID NO: 865283 - RNA, 19 nt, Homo sapiens
ccagauguguugcagcuuu

SEQ ID NO: 865284 - RNA, 19 nt, Homo sapiens
ucacuugguuucagccaua

SEQ ID NO: 865285 - RNA, 19 nt, Homo sapiens
ugaagagcuuuaaggauaa

SEQ ID NO: 865286 - RNA, 19 nt, Homo sapiens
gcaagaauuuccgcuccua

SEQ ID NO: 865287 - RNA, 19 nt, Homo sapiens
ggaauaacuuaccuuugug

SEQ ID NO: 865288 - RNA, 19 nt, Homo sapiens
ggugagaguuggagugaga

SEQ ID NO: 865289 - RNA, 19 nt, Homo sapiens
ugaaagaggagauugauau

SEQ ID NO: 865290 - RNA, 19 nt, Homo sapiens
cauccaaguucccguugua

SEQ ID NO: 865291 - RNA, 19 nt, Homo sapiens
ccucugagaucccauuuca

SEQ ID NO: 865292 - RNA, 19 nt, Homo sapiens
ggacucuugccguagauua

SEQ ID NO: 865293 - RNA, 19 nt, Homo sapiens
augcaaggaucuacuuuaa

SEQ ID NO: 865294 - RNA, 19 nt, Homo sapiens
uauaacacauuggagagua

SEQ ID NO: 865295 - RNA, 19 nt, Homo sapiens
gaaacacuaguacgccuuu

SEQ ID NO: 865296 - RNA, 19 nt, Homo sapiens
gaucugcgaaacacuagua

SEQ ID NO: 865297 - RNA, 19 nt, Homo sapiens
uccacacucucauuaauaa

SEQ ID NO: 865298 - RNA, 19 nt, Homo sapiens
gcauucggguguuauucuu

SEQ ID NO: 865299 - RNA, 19 nt, Homo sapiens
gauuugcauucggguguua

SEQ ID NO: 865300 - RNA, 19 nt, Homo sapiens
gcuugugucuaaaggguaa

SEQ ID NO: 865301 - RNA, 19 nt, Homo sapiens
gaaaucaaaguugcuacaa

SEQ ID NO: 865302 - RNA, 19 nt, Homo sapiens
gugaauguggaauaacuua

SEQ ID NO: 865303 - RNA, 19 nt, Homo sapiens
guuggugaauguggaauaa

SEQ ID NO: 865304 - RNA, 19 nt, Homo sapiens
uagaguugauugauggaaa

SEQ ID NO: 865305 - RNA, 19 nt, Homo sapiens
gcuccuaccugcuggaucu

SEQ ID NO: 865306 - RNA, 19 nt, Homo sapiens
ccaaugcacuggucugacu

SEQ ID NO: 865307 - RNA, 19 nt, Homo sapiens
ucugagaucccauuucauu

SEQ ID NO: 865308 - RNA, 19 nt, Homo sapiens
ugaugaugcuagacuacua

SEQ ID NO: 865309 - RNA, 19 nt, Homo sapiens
uucaggauaucaaguauga

SEQ ID NO: 865310 - RNA, 19 nt, Homo sapiens
caugcaaggaucuacuuua

SEQ ID NO: 865311 - RNA, 19 nt, Homo sapiens
caaccauccaggugacaua

SEQ ID NO: 865312 - RNA, 19 nt, Homo sapiens
gaaugaguaccuacgcuau

SEQ ID NO: 865313 - RNA, 19 nt, Homo sapiens
ggaaaucaaaguugcuaca

SEQ ID NO: 865314 - RNA, 19 nt, Homo sapiens
gaaacccagggaaaucaaa

SEQ ID NO: 865315 - RNA, 19 nt, Homo sapiens
gcgguuaaagcacgaauug

SEQ ID NO: 865316 - RNA, 19 nt, Homo sapiens
uuucaaggguguacgcaaa

SEQ ID NO: 865317 - RNA, 19 nt, Homo sapiens
guacgcaaagcacucauug

SEQ ID NO: 865318 - RNA, 19 nt, Homo sapiens
gagaucccauuucauucug

SEQ ID NO: 865319 - RNA, 19 nt, Homo sapiens
cagcuuuccugacaugcaa

SEQ ID NO: 865320 - RNA, 19 nt, Homo sapiens
gaauugaagagcuuuaagg

SEQ ID NO: 865321 - RNA, 19 nt, Homo sapiens
gagcuggccacugcgguua

SEQ ID NO: 865322 - RNA, 19 nt, Homo sapiens
aagaggagauugauauucg

SEQ ID NO: 865323 - RNA, 19 nt, Homo sapiens
gaaguuggugaauguggaa

SEQ ID NO: 865324 - RNA, 19 nt, Homo sapiens
ggacuugaaagaggagauu

SEQ ID NO: 865325 - RNA, 19 nt, Homo sapiens
gccaggcuaugugacagua

SEQ ID NO: 865326 - RNA, 19 nt, Homo sapiens
ccuuugugcuccacuuaaa

SEQ ID NO: 865327 - RNA, 19 nt, Homo sapiens
ugggaacuguuuggguuua

SEQ ID NO: 865328 - RNA, 19 nt, Homo sapiens
ucagcgacaucaccaguca

SEQ ID NO: 865329 - RNA, 19 nt, Homo sapiens
cgcaaagcacucauugaua

SEQ ID NO: 865330 - RNA, 19 nt, Homo sapiens
gaagcuggaaggcgucguu

SEQ ID NO: 865331 - RNA, 19 nt, Homo sapiens
agauuaagccagucaguug

SEQ ID NO: 865332 - RNA, 19 nt, Homo sapiens
ggguucaggauaucaagua

SEQ ID NO: 865333 - RNA, 19 nt, Homo sapiens
ccauaucuauaccuuugug

SEQ ID NO: 865334 - RNA, 19 nt, Homo sapiens
gcacucauugauacccuuu

SEQ ID NO: 865335 - RNA, 19 nt, Homo sapiens
ggaaacccagggaaaucaa

SEQ ID NO: 865336 - RNA, 19 nt, Homo sapiens
gacuguauccauccaaguu

SEQ ID NO: 865337 - RNA, 19 nt, Homo sapiens
gagcuuuaaggauaacuau

SEQ ID NO: 865338 - RNA, 19 nt, Homo sapiens
gaagagcuuuaaggauaac

SEQ ID NO: 865339 - RNA, 19 nt, Homo sapiens
ccacuuaaaccagaugugu

SEQ ID NO: 865340 - RNA, 19 nt, Homo sapiens
cagcaggcccagacuguau

SEQ ID NO: 865341 - RNA, 19 nt, Homo sapiens
gccagucaguugcaaugug

SEQ ID NO: 865342 - RNA, 19 nt, Homo sapiens
gccaaagaccuaacucagu

SEQ ID NO: 865343 - RNA, 19 nt, Homo sapiens
ucuccaggguucaggauau

SEQ ID NO: 865344 - RNA, 19 nt, Homo sapiens
gguucaggauaucaaguau

SEQ ID NO: 865345 - RNA, 19 nt, Homo sapiens
uagggcaucuuagaguuga

SEQ ID NO: 865346 - RNA, 19 nt, Homo sapiens
uaguucaccuucccuguuc

SEQ ID NO: 865347 - RNA, 19 nt, Homo sapiens
ggauuugcauucggguguu

SEQ ID NO: 865348 - RNA, 19 nt, Homo sapiens
gcuggccacugcgguuaaa

SEQ ID NO: 865349 - RNA, 19 nt, Homo sapiens
agaugaugaugcuagacua

SEQ ID NO: 865350 - RNA, 19 nt, Homo sapiens
auucggguguuauucuuaa

SEQ ID NO: 865351 - RNA, 19 nt, Homo sapiens
gaugcuagacuacuacaac

SEQ ID NO: 865352 - RNA, 19 nt, Homo sapiens
uuuggcaccugauauaauc

SEQ ID NO: 865353 - RNA, 19 nt, Homo sapiens
uaauguuucugucaaagcu

SEQ ID NO: 865354 - RNA, 19 nt, Homo sapiens
ccccaacccuuccuuauga

SEQ ID NO: 865355 - RNA, 19 nt, Homo sapiens
gacucuugccguagauuaa

SEQ ID NO: 865356 - RNA, 19 nt, Homo sapiens
cagauguguugcagcuuuc

SEQ ID NO: 865357 - RNA, 19 nt, Homo sapiens
ggguuuagggcaucuuaga

SEQ ID NO: 865358 - RNA, 19 nt, Homo sapiens
cggguguuauucuuaaugu

SEQ ID NO: 865359 - RNA, 19 nt, Homo sapiens
aacauuggcuaagacuauu

SEQ ID NO: 865360 - RNA, 19 nt, Homo sapiens
acgcaaagcacucauugau

SEQ ID NO: 865361 - RNA, 19 nt, Homo sapiens
gacaugcaaggaucuacuu

SEQ ID NO: 865362 - RNA, 19 nt, Homo sapiens
uuuagggcaucuuagaguu

SEQ ID NO: 865363 - RNA, 19 nt, Homo sapiens
uguugcagcuuuccugaca

SEQ ID NO: 865364 - RNA, 19 nt, Homo sapiens
guucuuagagcuugugucu

SEQ ID NO: 865365 - RNA, 19 nt, Homo sapiens
ccuccagucagaagaguaa

SEQ ID NO: 865366 - RNA, 19 nt, Homo sapiens
ugagaucccauuucauucu

SEQ ID NO: 865367 - RNA, 19 nt, Homo sapiens
gguaaacccgaacaauucu

SEQ ID NO: 865368 - RNA, 19 nt, Homo sapiens
gcucuggaugccauucgua

SEQ ID NO: 865369 - RNA, 19 nt, Homo sapiens
uuaauuccacacucucauu

SEQ ID NO: 865370 - RNA, 19 nt, Homo sapiens
aaagaggagauugauauuc

SEQ ID NO: 865371 - RNA, 19 nt, Homo sapiens
gucagcagccaaagaccua

SEQ ID NO: 865372 - RNA, 19 nt, Homo sapiens
ccagguuuauuuaauucca

SEQ ID NO: 865373 - RNA, 19 nt, Homo sapiens
ccuuaaugggcaagaauuu

SEQ ID NO: 865374 - RNA, 19 nt, Homo sapiens
uaaauucccugguugauaa

SEQ ID NO: 865375 - RNA, 19 nt, Homo sapiens
guagaagccuuacguguuu

SEQ ID NO: 865376 - RNA, 19 nt, Homo sapiens
gcaaaggaacugauuauug

SEQ ID NO: 865377 - RNA, 19 nt, Homo sapiens
ccacucaccuucccuguuu

SEQ ID NO: 865378 - RNA, 19 nt, Homo sapiens
aaagagaccugcuuaaaca

SEQ ID NO: 865379 - RNA, 19 nt, Homo sapiens
guuaugaccuuuacacuug

SEQ ID NO: 865380 - RNA, 19 nt, Homo sapiens
caaaggaacugauuauugc

SEQ ID NO: 865381 - RNA, 19 nt, Homo sapiens
guacaaagagaccugcuua

SEQ ID NO: 865382 - RNA, 19 nt, Homo sapiens
agaaagaugucaacagcua

SEQ ID NO: 865383 - RNA, 19 nt, Homo sapiens
acagcuaucugcuacaaua

SEQ ID NO: 865384 - RNA, 19 nt, Homo sapiens
gagcaucauuucuucuaaa

SEQ ID NO: 865385 - RNA, 19 nt, Homo sapiens
gauuauugcucaguuguaa

SEQ ID NO: 865386 - RNA, 19 nt, Homo sapiens
ggacaccauuuccaucuug

SEQ ID NO: 865387 - RNA, 19 nt, Homo sapiens
uaacuugccugcucuuuag

SEQ ID NO: 865388 - RNA, 19 nt, Homo sapiens
gaaaauguccuuaccuuaa

SEQ ID NO: 865389 - RNA, 19 nt, Homo sapiens
ggacggagcaucauuucuu

SEQ ID NO: 865390 - RNA, 19 nt, Homo sapiens
ugagauaagugucugauca

SEQ ID NO: 865391 - RNA, 19 nt, Homo sapiens
gacaaauucuuccagauuc

SEQ ID NO: 865392 - RNA, 19 nt, Homo sapiens
gcaagaaguuccacaugag

SEQ ID NO: 865393 - RNA, 19 nt, Homo sapiens
uaucauaccucgcacuuca

SEQ ID NO: 865394 - RNA, 19 nt, Homo sapiens
caagguaaauaauggcuau

SEQ ID NO: 865395 - RNA, 19 nt, Homo sapiens
ccuuaaaucucuuggcuuu

SEQ ID NO: 865396 - RNA, 19 nt, Homo sapiens
uagcauggauaugggauua

SEQ ID NO: 865397 - RNA, 19 nt, Homo sapiens
cgaacaaguuuaauagugu

SEQ ID NO: 865398 - RNA, 19 nt, Homo sapiens
ucucauggauucugacaaa

SEQ ID NO: 865399 - RNA, 19 nt, Homo sapiens
gaacaauacaucacuaugg

SEQ ID NO: 865400 - RNA, 19 nt, Homo sapiens
caacagcuaucugcuacaa

SEQ ID NO: 865401 - RNA, 19 nt, Homo sapiens
ggagcaucauuucuucuaa

SEQ ID NO: 865402 - RNA, 19 nt, Homo sapiens
cuacaauacuuacagauca

SEQ ID NO: 865403 - RNA, 19 nt, Homo sapiens
ggcaagaucucugaagguu

SEQ ID NO: 865404 - RNA, 19 nt, Homo sapiens
gagaaucagacaauguuaa

SEQ ID NO: 865405 - RNA, 19 nt, Homo sapiens
gguagaagccuuacguguu

SEQ ID NO: 865406 - RNA, 19 nt, Homo sapiens
gcucuggcuuugcaucuuu

SEQ ID NO: 865407 - RNA, 19 nt, Homo sapiens
gauguuaucugucaaucag

SEQ ID NO: 865408 - RNA, 19 nt, Homo sapiens
guggucagauuuauaaugu

SEQ ID NO: 865409 - RNA, 19 nt, Homo sapiens
caucguggauuccuucuuc

SEQ ID NO: 865410 - RNA, 19 nt, Homo sapiens
gauaaaacaucguggauuc

SEQ ID NO: 865411 - RNA, 19 nt, Homo sapiens
ugagggcgauuuggauaua

SEQ ID NO: 865412 - RNA, 19 nt, Homo sapiens
ugacaaauucuuccagauu

SEQ ID NO: 865413 - RNA, 19 nt, Homo sapiens
ggagaggacaccacuaugu

SEQ ID NO: 865414 - RNA, 19 nt, Homo sapiens
aacaaguacugcugagaua

SEQ ID NO: 865415 - RNA, 19 nt, Homo sapiens
ucacaaauggaacagauaa

SEQ ID NO: 865416 - RNA, 19 nt, Homo sapiens
aaacuucauugcccuaaau

SEQ ID NO: 865417 - RNA, 19 nt, Homo sapiens
gugcugauacugaugauuu

SEQ ID NO: 865418 - RNA, 19 nt, Homo sapiens
gcauggauaugggauuaga

SEQ ID NO: 865419 - RNA, 19 nt, Homo sapiens
caucauuucuucuaaaggu

SEQ ID NO: 865420 - RNA, 19 nt, Homo sapiens
gcauauccgugguuggaau

SEQ ID NO: 865421 - RNA, 19 nt, Homo sapiens
aaucagcauucagauguua

SEQ ID NO: 865422 - RNA, 19 nt, Homo sapiens
cagacaauguuaaguuuag

SEQ ID NO: 865423 - RNA, 19 nt, Homo sapiens
ugugagaucuggccacgaa

SEQ ID NO: 865424 - RNA, 19 nt, Homo sapiens
ugcaagaaguuccacauga

SEQ ID NO: 865425 - RNA, 19 nt, Homo sapiens
acaaagagaccugcuuaaa

SEQ ID NO: 865426 - RNA, 19 nt, Homo sapiens
gguaaauaauggcuaugga

SEQ ID NO: 865427 - RNA, 19 nt, Homo sapiens
caaauggaacagauaauca

SEQ ID NO: 865428 - RNA, 19 nt, Homo sapiens
cauacaaugucacaaaugg

SEQ ID NO: 865429 - RNA, 19 nt, Homo sapiens
cauggauucugacaaauuc

SEQ ID NO: 865430 - RNA, 19 nt, Homo sapiens
gagcaaaauugaggucaua

SEQ ID NO: 865431 - RNA, 19 nt, Homo sapiens
aaguagaaauggcaaaguu

SEQ ID NO: 865432 - RNA, 19 nt, Homo sapiens
caaagagaccugcuuaaac

SEQ ID NO: 865433 - RNA, 19 nt, Homo sapiens
gcagaagcacuggguauug

SEQ ID NO: 865434 - RNA, 19 nt, Homo sapiens
ucgaacaaguuuaauagug

SEQ ID NO: 865435 - RNA, 19 nt, Homo sapiens
ccaaucagcauucagaugu

SEQ ID NO: 865436 - RNA, 19 nt, Homo sapiens
guccuuaccuuaaaucucu

SEQ ID NO: 865437 - RNA, 19 nt, Homo sapiens
cagcaauguugaugauguu

SEQ ID NO: 865438 - RNA, 19 nt, Homo sapiens
aagccuaucucauggauuc

SEQ ID NO: 865439 - RNA, 19 nt, Homo sapiens
cagaagcacuggguauugu

SEQ ID NO: 865440 - RNA, 19 nt, Homo sapiens
uaccaaacuucaaucaaug

SEQ ID NO: 865441 - RNA, 19 nt, Homo sapiens
cuacagaaucaaugucuuu

SEQ ID NO: 865442 - RNA, 19 nt, Homo sapiens
gcuaucugcuacaauacuu

SEQ ID NO: 865443 - RNA, 19 nt, Homo sapiens
gccaaagacagauauaaau

SEQ ID NO: 865444 - RNA, 19 nt, Homo sapiens
ggaccuuucagcaccauuu

SEQ ID NO: 865445 - RNA, 19 nt, Homo sapiens
uaagcaaaggaacugauua

SEQ ID NO: 865446 - RNA, 19 nt, Homo sapiens
ccagacaaauguaaaacua

SEQ ID NO: 865447 - RNA, 19 nt, Homo sapiens
ggugcaagguaaauaaugg

SEQ ID NO: 865448 - RNA, 19 nt, Homo sapiens
ucagcaauguugaugaugu

SEQ ID NO: 865449 - RNA, 19 nt, Homo sapiens
aacaauacaucacuaugga

SEQ ID NO: 865450 - RNA, 19 nt, Homo sapiens
uaaacuucauugcccuaaa

SEQ ID NO: 865451 - RNA, 19 nt, Homo sapiens
aaauugaggucauauaagc

SEQ ID NO: 865452 - RNA, 19 nt, Homo sapiens
uauacgagguagaaagaug

SEQ ID NO: 865453 - RNA, 19 nt, Homo sapiens
cagagaaucagacaauguu

SEQ ID NO: 865454 - RNA, 19 nt, Homo sapiens
guuugggcaucuacucaua

SEQ ID NO: 865455 - RNA, 19 nt, Homo sapiens
cuaacuugccugcucuuua

SEQ ID NO: 865456 - RNA, 19 nt, Homo sapiens
gagauaagugucugaucaa

SEQ ID NO: 865457 - RNA, 19 nt, Homo sapiens
cagaaucaaugucuuuggu

SEQ ID NO: 865458 - RNA, 19 nt, Homo sapiens
ucuaugguguugugaaguu

SEQ ID NO: 865459 - RNA, 19 nt, Homo sapiens
gagggcgauuuggauauaa

SEQ ID NO: 865460 - RNA, 19 nt, Homo sapiens
caaauuugacagccaauca

SEQ ID NO: 865461 - RNA, 19 nt, Homo sapiens
guuuagaguuucaucuuca

SEQ ID NO: 865462 - RNA, 19 nt, Homo sapiens
ucacauccaucggcuacaa

SEQ ID NO: 865463 - RNA, 19 nt, Homo sapiens
gacggagcaucauuucuuc

SEQ ID NO: 865464 - RNA, 19 nt, Homo sapiens
gagaccugcuuaaacaagu

SEQ ID NO: 865465 - RNA, 19 nt, Homo sapiens
cuaaauucccugguugaua

SEQ ID NO: 865466 - RNA, 19 nt, Homo sapiens
aaaucuaaauucccugguu

SEQ ID NO: 865467 - RNA, 19 nt, Homo sapiens
agaaggagguacacucagu

SEQ ID NO: 865468 - RNA, 19 nt, Homo sapiens
gagaggacaccacuaugug

SEQ ID NO: 865469 - RNA, 19 nt, Homo sapiens
caaugucuaugguguugug

SEQ ID NO: 865470 - RNA, 19 nt, Homo sapiens
cuggaucaguaucauuaua

SEQ ID NO: 865471 - RNA, 19 nt, Homo sapiens
ucuauagccuucauaccaa

SEQ ID NO: 865472 - RNA, 19 nt, Homo sapiens
ggagauauuguucgcuuuc

SEQ ID NO: 865473 - RNA, 19 nt, Homo sapiens
guaaauaauggcuauggau

SEQ ID NO: 865474 - RNA, 19 nt, Homo sapiens
gcaaacagcugcagaugaa

SEQ ID NO: 865475 - RNA, 19 nt, Homo sapiens
gaacauccaugauaaugaa

SEQ ID NO: 865476 - RNA, 19 nt, Homo sapiens
gcacauacauugauagaug

SEQ ID NO: 865477 - RNA, 19 nt, Homo sapiens
gaaugaagaugacuaauag

SEQ ID NO: 865478 - RNA, 19 nt, Homo sapiens
guaaauagcacauacauug

SEQ ID NO: 865479 - RNA, 19 nt, Homo sapiens
gaucaacucuugccuaugg

SEQ ID NO: 865480 - RNA, 19 nt, Homo sapiens
ggagagaaacauugcuuua

SEQ ID NO: 865481 - RNA, 19 nt, Homo sapiens
agugguagcuuaauuagua

SEQ ID NO: 865482 - RNA, 19 nt, Homo sapiens
gcaaagaugagacugauga

SEQ ID NO: 865483 - RNA, 19 nt, Homo sapiens
caaagaggauguaucaaca

SEQ ID NO: 865484 - RNA, 19 nt, Homo sapiens
ggaccaacaaaccaaauua

SEQ ID NO: 865485 - RNA, 19 nt, Homo sapiens
caacagggcaggagagaaa

SEQ ID NO: 865486 - RNA, 19 nt, Homo sapiens
caaaugaggcugcaagaga

SEQ ID NO: 865487 - RNA, 19 nt, Homo sapiens
aaacauugcuuuaccucaa

SEQ ID NO: 865488 - RNA, 19 nt, Homo sapiens
gcagagaacauaauuacau

SEQ ID NO: 865489 - RNA, 19 nt, Homo sapiens
uaacagauuugccauuugg

SEQ ID NO: 865490 - RNA, 19 nt, Homo sapiens
guucaggaguuucaagauu

SEQ ID NO: 865491 - RNA, 19 nt, Homo sapiens
gagagaaacuugggucauc

SEQ ID NO: 865492 - RNA, 19 nt, Homo sapiens
ugaagugguagcuuaauua

SEQ ID NO: 865493 - RNA, 19 nt, Homo sapiens
cagagaccguggcaagaua

SEQ ID NO: 865494 - RNA, 19 nt, Homo sapiens
cuacuaaagugcugugaga

SEQ ID NO: 865495 - RNA, 19 nt, Homo sapiens
gaauagagcagcaaauaac

SEQ ID NO: 865496 - RNA, 19 nt, Homo sapiens
gaggaacucuuuggcaaug

SEQ ID NO: 865497 - RNA, 19 nt, Homo sapiens
aaagugaccucggaaguga

SEQ ID NO: 865498 - RNA, 19 nt, Homo sapiens
cuaaagugcugugagauug

SEQ ID NO: 865499 - RNA, 19 nt, Homo sapiens
gugaauagagcagcaaaua

SEQ ID NO: 865500 - RNA, 19 nt, Homo sapiens
acucuuagaucaacucuug

SEQ ID NO: 865501 - RNA, 19 nt, Homo sapiens
gaugaaagcucaaaagaag

SEQ ID NO: 865502 - RNA, 19 nt, Homo sapiens
gauuaccaguucaaacaaa

SEQ ID NO: 865503 - RNA, 19 nt, Homo sapiens
ucacaagaccuauaggaaa

SEQ ID NO: 865504 - RNA, 19 nt, Homo sapiens
gaaacccugucucuacuag

SEQ ID NO: 865505 - RNA, 19 nt, Homo sapiens
uguaacagauuugccauuu

SEQ ID NO: 865506 - RNA, 19 nt, Homo sapiens
ugaauggucugacuguuuc

SEQ ID NO: 865507 - RNA, 19 nt, Homo sapiens
gagcgaaacucugucucaa

SEQ ID NO: 865508 - RNA, 19 nt, Homo sapiens
ccauauugcuggugauaau

SEQ ID NO: 865509 - RNA, 19 nt, Homo sapiens
gauccucuaccuuaugaua

SEQ ID NO: 865510 - RNA, 19 nt, Homo sapiens
gaacuggcucuguggauau

SEQ ID NO: 865511 - RNA, 19 nt, Homo sapiens
gugcugaaguuuagaguca

SEQ ID NO: 865512 - RNA, 19 nt, Homo sapiens
gaaagugaccucggaagug

SEQ ID NO: 865513 - RNA, 19 nt, Homo sapiens
gaccaacaaaccaaauuaa

SEQ ID NO: 865514 - RNA, 19 nt, Homo sapiens
uuaaagaugccuagugaaa

SEQ ID NO: 865515 - RNA, 19 nt, Homo sapiens
guaacagauuugccauuug

SEQ ID NO: 865516 - RNA, 19 nt, Homo sapiens
uagaucaacucuugccuau

SEQ ID NO: 865517 - RNA, 19 nt, Homo sapiens
caacauuaauaggugauga

SEQ ID NO: 865518 - RNA, 19 nt, Homo sapiens
uucaggaguuucaagauua

SEQ ID NO: 865519 - RNA, 19 nt, Homo sapiens
uaacuuauuuguggugguu

SEQ ID NO: 865520 - RNA, 19 nt, Homo sapiens
gcgaaacucugucucaaaa

SEQ ID NO: 865521 - RNA, 19 nt, Homo sapiens
gagcuguacuacuuacuca

SEQ ID NO: 865522 - RNA, 19 nt, Homo sapiens
gaccaagagccaaauuaaa

SEQ ID NO: 865523 - RNA, 19 nt, Homo sapiens
ccaucugccuaaauauuaa

SEQ ID NO: 865524 - RNA, 19 nt, Homo sapiens
cuuuaaagaugccuaguga

SEQ ID NO: 865525 - RNA, 19 nt, Homo sapiens
gcaaugcaaagaaugaaga

SEQ ID NO: 865526 - RNA, 19 nt, Homo sapiens
agaacuggcucuguggaua

SEQ ID NO: 865527 - RNA, 19 nt, Homo sapiens
ugaccaagagccaaauuaa

SEQ ID NO: 865528 - RNA, 19 nt, Homo sapiens
gugauccucuaccuuauga

SEQ ID NO: 865529 - RNA, 19 nt, Homo sapiens
caacuuugauguggagguu

SEQ ID NO: 865530 - RNA, 19 nt, Homo sapiens
gaauucaaguaaagagaag

SEQ ID NO: 865531 - RNA, 19 nt, Homo sapiens
aaacuacccuggcccaaag

SEQ ID NO: 865532 - RNA, 19 nt, Homo sapiens
gagucgagaucacgccauu

SEQ ID NO: 865533 - RNA, 19 nt, Homo sapiens
caaagaaugaagaugacua

SEQ ID NO: 865534 - RNA, 19 nt, Homo sapiens
gaacguugguggucuucgu

SEQ ID NO: 865535 - RNA, 19 nt, Homo sapiens
ggcgaaagguggauacagu

SEQ ID NO: 865536 - RNA, 19 nt, Homo sapiens
ugaauagagcagcaaauaa

SEQ ID NO: 865537 - RNA, 19 nt, Homo sapiens
gcacagguucauugucuga

SEQ ID NO: 865538 - RNA, 19 nt, Homo sapiens
cacaagaccuauaggaaag

SEQ ID NO: 865539 - RNA, 19 nt, Homo sapiens
gaaugguguucagccuaua

SEQ ID NO: 865540 - RNA, 19 nt, Homo sapiens
cagagaacauaauuacauc

SEQ ID NO: 865541 - RNA, 19 nt, Homo sapiens
ggaagggcagagaacauaa

SEQ ID NO: 865542 - RNA, 19 nt, Homo sapiens
gcauugcauugacugaaga

SEQ ID NO: 865543 - RNA, 19 nt, Homo sapiens
aaacuugggucaucaugca

SEQ ID NO: 865544 - RNA, 19 nt, Homo sapiens
cagcuuugcuaauccaguu

SEQ ID NO: 865545 - RNA, 19 nt, Homo sapiens
caucuuaggccacauuuca

SEQ ID NO: 865546 - RNA, 19 nt, Homo sapiens
gaacaagacggagaaagag

SEQ ID NO: 865547 - RNA, 19 nt, Homo sapiens
uauaauagucgauccaaug

SEQ ID NO: 865548 - RNA, 19 nt, Homo sapiens
ugaagaagccacuaaccaa

SEQ ID NO: 865549 - RNA, 19 nt, Homo sapiens
ccucaagugcugaaguuua

SEQ ID NO: 865550 - RNA, 19 nt, Homo sapiens
gaagugguagcuuaauuag

SEQ ID NO: 865551 - RNA, 19 nt, Homo sapiens
ucugugauccucuaccuua

SEQ ID NO: 865552 - RNA, 19 nt, Homo sapiens
aaaugaggcugcaagagau

SEQ ID NO: 865553 - RNA, 19 nt, Homo sapiens
cagaugaagucagagagaa

SEQ ID NO: 865554 - RNA, 19 nt, Homo sapiens
cuaaccaacuccuagaugu

SEQ ID NO: 865555 - RNA, 19 nt, Homo sapiens
ggccacauuucauucuuug

SEQ ID NO: 865556 - RNA, 19 nt, Homo sapiens
cacuggaaauguuagcaua

SEQ ID NO: 865557 - RNA, 19 nt, Homo sapiens
aauagucgauccaaugugu

SEQ ID NO: 865558 - RNA, 19 nt, Homo sapiens
cgacaguacugcuuuuaaa

SEQ ID NO: 865559 - RNA, 19 nt, Homo sapiens
gcagaugaagucagagaga

SEQ ID NO: 865560 - RNA, 19 nt, Homo sapiens
gggcagagaacauaauuac

SEQ ID NO: 865561 - RNA, 19 nt, Homo sapiens
agaacaagacggagaaaga

SEQ ID NO: 865562 - RNA, 19 nt, Homo sapiens
gcccauagaugcuguucag

SEQ ID NO: 865563 - RNA, 19 nt, Homo sapiens
uaucaaagguacugcaaaa

SEQ ID NO: 865564 - RNA, 19 nt, Homo sapiens
agaccuauaggaaaguuua

SEQ ID NO: 865565 - RNA, 19 nt, Homo sapiens
caagaccuauaggaaaguu

SEQ ID NO: 865566 - RNA, 19 nt, Homo sapiens
ggugaaacccugucucuac

SEQ ID NO: 865567 - RNA, 19 nt, Homo sapiens
gcaaaaggugugaauguaa

SEQ ID NO: 865568 - RNA, 19 nt, Homo sapiens
caagagccaaauuaaagaa

SEQ ID NO: 865569 - RNA, 19 nt, Homo sapiens
ccaagagccaaauuaaaga

SEQ ID NO: 865570 - RNA, 19 nt, Homo sapiens
ggaccuacaacucuuagau

SEQ ID NO: 865571 - RNA, 19 nt, Homo sapiens
caaaaucgaucagagaaau

SEQ ID NO: 865572 - RNA, 19 nt, Homo sapiens
uaggaaaguuuaccaucug

SEQ ID NO: 865573 - RNA, 19 nt, Homo sapiens
uaauccaguugcucaaguu

SEQ ID NO: 865574 - RNA, 19 nt, Homo sapiens
ggaagaacgugaagcugua

SEQ ID NO: 865575 - RNA, 19 nt, Homo sapiens
ugacuacacuuucaaugug

SEQ ID NO: 865576 - RNA, 19 nt, Homo sapiens
caaacacacuucccgaaag

SEQ ID NO: 865577 - RNA, 19 nt, Homo sapiens
auagaaagcgugcucauuu

SEQ ID NO: 865578 - RNA, 19 nt, Homo sapiens
cccgaaagcuucacuaagu

SEQ ID NO: 865579 - RNA, 19 nt, Homo sapiens
ggagaccuuuggcgacuug

SEQ ID NO: 865580 - RNA, 19 nt, Homo sapiens
cggcagaucuggcaagaca

SEQ ID NO: 865581 - RNA, 19 nt, Homo sapiens
ucaaggagcccaagaugga

SEQ ID NO: 865582 - RNA, 19 nt, Homo sapiens
ggaaggcugaggaaaggua

SEQ ID NO: 865583 - RNA, 19 nt, Homo sapiens
gcugcuggccgacgaauuu

SEQ ID NO: 865584 - RNA, 19 nt, Homo sapiens
ccgaaagcuucacuaaguu

SEQ ID NO: 865585 - RNA, 19 nt, Homo sapiens
ccaaacacacuucccgaaa

SEQ ID NO: 865586 - RNA, 19 nt, Homo sapiens
caauguggaucagaaacuu

SEQ ID NO: 865587 - RNA, 19 nt, Homo sapiens
ucaaggccaucgagcaguu

SEQ ID NO: 865588 - RNA, 19 nt, Homo sapiens
ccaagcagaggaacaagaa

SEQ ID NO: 865589 - RNA, 19 nt, Homo sapiens
cgaaagcuucacuaaguuu

SEQ ID NO: 865590 - RNA, 19 nt, Homo sapiens
ccucuucgauggcuucuuc

SEQ ID NO: 865591 - RNA, 19 nt, Homo sapiens
guggaugacuacacuuuca

SEQ ID NO: 865592 - RNA, 19 nt, Homo sapiens
guacagggcagucucucuu

SEQ ID NO: 865593 - RNA, 19 nt, Homo sapiens
gagccucuccuuguacuuu

SEQ ID NO: 865594 - RNA, 19 nt, Homo sapiens
gcugccaucucuucaguca

SEQ ID NO: 865595 - RNA, 19 nt, Homo sapiens
ugaaggagacccugaccaa

SEQ ID NO: 865596 - RNA, 19 nt, Homo sapiens
gcccaagguuccggagaaa

SEQ ID NO: 865597 - RNA, 19 nt, Homo sapiens
cgacgaauuugcccuugag

SEQ ID NO: 865598 - RNA, 19 nt, Homo sapiens
gagcaguuccagacagaga

SEQ ID NO: 865599 - RNA, 19 nt, Homo sapiens
uagaaagcgugcucauuuu

SEQ ID NO: 865600 - RNA, 19 nt, Homo sapiens
gcggagaggcagugaagga

SEQ ID NO: 865601 - RNA, 19 nt, Homo sapiens
guggugaugugcgucauga

SEQ ID NO: 865602 - RNA, 19 nt, Homo sapiens
gguacaagaagcuggaaga

SEQ ID NO: 865603 - RNA, 19 nt, Homo sapiens
ucgaugagcugcgggacaa

SEQ ID NO: 865604 - RNA, 19 nt, Homo sapiens
ggacacacggugagauuuu

SEQ ID NO: 865605 - RNA, 19 nt, Homo sapiens
gagcggagaggcagugaag

SEQ ID NO: 865606 - RNA, 19 nt, Homo sapiens
aaacacacuucccgaaagc

SEQ ID NO: 865607 - RNA, 19 nt, Homo sapiens
cgacauggugcugcaguuu

SEQ ID NO: 865608 - RNA, 19 nt, Homo sapiens
cauagaaagcgugcucauu

SEQ ID NO: 865609 - RNA, 19 nt, Homo sapiens
acagccaggucuucaagga

SEQ ID NO: 865610 - RNA, 19 nt, Homo sapiens
ucgagcaguuccagacaga

SEQ ID NO: 865611 - RNA, 19 nt, Homo sapiens
ucucuguccugcacaacuu

SEQ ID NO: 865612 - RNA, 19 nt, Homo sapiens
gaugacuacacuuucaaug

SEQ ID NO: 865613 - RNA, 19 nt, Homo sapiens
aaacugaagcugguuaugg

SEQ ID NO: 865614 - RNA, 19 nt, Homo sapiens
ccgacgaauuugcccuuga

SEQ ID NO: 865615 - RNA, 19 nt, Homo sapiens
ucaccaagcagaggaacaa

SEQ ID NO: 865616 - RNA, 19 nt, Homo sapiens
caacggcgaggaccugaag

SEQ ID NO: 865617 - RNA, 19 nt, Homo sapiens
ggaugacuacacuuucaau

SEQ ID NO: 865618 - RNA, 19 nt, Homo sapiens
uguccaugauccuguguga

SEQ ID NO: 865619 - RNA, 19 nt, Homo sapiens
agcaguacauccuggagaa

SEQ ID NO: 865620 - RNA, 19 nt, Homo sapiens
gaggugaagcggcagaucu

SEQ ID NO: 865621 - RNA, 19 nt, Homo sapiens
gcugaggaaagguacaaga

SEQ ID NO: 865622 - RNA, 19 nt, Homo sapiens
gaaagccccagucucauau

SEQ ID NO: 865623 - RNA, 19 nt, Homo sapiens
uguccuuccugguggauga

SEQ ID NO: 865624 - RNA, 19 nt, Homo sapiens
ugcccaagguuccggagaa

SEQ ID NO: 865625 - RNA, 19 nt, Homo sapiens
uugcagguguggccuuguu

SEQ ID NO: 865626 - RNA, 19 nt, Homo sapiens
gcagaucuggcaagacaac

SEQ ID NO: 865627 - RNA, 19 nt, Homo sapiens
gcagguguggccuuguuuc

SEQ ID NO: 865628 - RNA, 19 nt, Homo sapiens
aggagacccugaccaacug

SEQ ID NO: 865629 - RNA, 19 nt, Homo sapiens
agucucauauccaaacaca

SEQ ID NO: 865630 - RNA, 19 nt, Homo sapiens
ggacccgugccacaaguuc

SEQ ID NO: 865631 - RNA, 19 nt, Homo sapiens
ugaugugcgucaugaagca

SEQ ID NO: 865632 - RNA, 19 nt, Homo sapiens
aauuugcccuugaggacuu

SEQ ID NO: 865633 - RNA, 19 nt, Homo sapiens
accagucgguauucgauga

SEQ ID NO: 865634 - RNA, 19 nt, Homo sapiens
gcaguuccagacagagaau

SEQ ID NO: 865635 - RNA, 19 nt, Homo sapiens
gaucgacagccaggucuuc

SEQ ID NO: 865636 - RNA, 19 nt, Homo sapiens
gaccuggacgugggugaaa

SEQ ID NO: 865637 - RNA, 19 nt, Homo sapiens
gacauggugcugcaguuuc

SEQ ID NO: 865638 - RNA, 19 nt, Homo sapiens
ucccggaccuggauguaca

SEQ ID NO: 865639 - RNA, 19 nt, Homo sapiens
cgacagccaggucuucaag

SEQ ID NO: 865640 - RNA, 19 nt, Homo sapiens
caagaagcuggaagaccuu

SEQ ID NO: 865641 - RNA, 19 nt, Homo sapiens
ggugaugugcgucaugaag

SEQ ID NO: 865642 - RNA, 19 nt, Homo sapiens
agaaagccccagucucaua

SEQ ID NO: 865643 - RNA, 19 nt, Homo sapiens
cugaggaaagguacaagaa

SEQ ID NO: 865644 - RNA, 19 nt, Homo sapiens
acauggugcugcaguuucu

SEQ ID NO: 865645 - RNA, 19 nt, Homo sapiens
acgugaagcuguacgacau

SEQ ID NO: 865646 - RNA, 19 nt, Homo sapiens
gcacaaagguggcagauga

SEQ ID NO: 865647 - RNA, 19 nt, Homo sapiens
uaacagaaaugacuccuuu

SEQ ID NO: 865648 - RNA, 19 nt, Homo sapiens
ccaaauaagugcaaagauu

SEQ ID NO: 865649 - RNA, 19 nt, Homo sapiens
cagcagcgcuccauguuua

SEQ ID NO: 865650 - RNA, 19 nt, Homo sapiens
uaagugagcugaagcagaa

SEQ ID NO: 865651 - RNA, 19 nt, Homo sapiens
gaacccauaucaaauguau

SEQ ID NO: 865652 - RNA, 19 nt, Homo sapiens
agaaaugacuccuuugaaa

SEQ ID NO: 865653 - RNA, 19 nt, Homo sapiens
gaauuacugucaagagaaa

SEQ ID NO: 865654 - RNA, 19 nt, Homo sapiens
gggaaagggucuugagaaa

SEQ ID NO: 865655 - RNA, 19 nt, Homo sapiens
gaaaggaggcaagagaaua

SEQ ID NO: 865656 - RNA, 19 nt, Homo sapiens
gaucacaucuaaacaaagu

SEQ ID NO: 865657 - RNA, 19 nt, Homo sapiens
acacaagaauugacucuaa

SEQ ID NO: 865658 - RNA, 19 nt, Homo sapiens
caucaucuguguugaguaa

SEQ ID NO: 865659 - RNA, 19 nt, Homo sapiens
aggaagagcugaagaagaa

SEQ ID NO: 865660 - RNA, 19 nt, Homo sapiens
ggacaaacugugcauuuaa

SEQ ID NO: 865661 - RNA, 19 nt, Homo sapiens
agucaaaccuggagaauga

SEQ ID NO: 865662 - RNA, 19 nt, Homo sapiens
ggaggaaggugggaauuau

SEQ ID NO: 865663 - RNA, 19 nt, Homo sapiens
ccacagaaguccugaaagu

SEQ ID NO: 865664 - RNA, 19 nt, Homo sapiens
gaaagucuguccucugaag

SEQ ID NO: 865665 - RNA, 19 nt, Homo sapiens
uggaaugguucuacaauaa

SEQ ID NO: 865666 - RNA, 19 nt, Homo sapiens
gaaaugacuccuuugaaau

SEQ ID NO: 865667 - RNA, 19 nt, Homo sapiens
gaaugguucuacaauaaug

SEQ ID NO: 865668 - RNA, 19 nt, Homo sapiens
uagcagugaucacaucuaa

SEQ ID NO: 865669 - RNA, 19 nt, Homo sapiens
gaacuccagauuucagaua

SEQ ID NO: 865670 - RNA, 19 nt, Homo sapiens
agacagacaucagcaauga

SEQ ID NO: 865671 - RNA, 19 nt, Homo sapiens
gacaaacugugcauuuaau

SEQ ID NO: 865672 - RNA, 19 nt, Homo sapiens
gaagaagaacgacuaagug

SEQ ID NO: 865673 - RNA, 19 nt, Homo sapiens
ggaggcaagagaauaguua

SEQ ID NO: 865674 - RNA, 19 nt, Homo sapiens
gcuacuguauguugacuuu

SEQ ID NO: 865675 - RNA, 19 nt, Homo sapiens
caacagccaucgaguacug

SEQ ID NO: 865676 - RNA, 19 nt, Homo sapiens
cuacauuaaucuuccagua

SEQ ID NO: 865677 - RNA, 19 nt, Homo sapiens
guacugacaccauggaauu

SEQ ID NO: 865678 - RNA, 19 nt, Homo sapiens
gaggacaacaggauaauau

SEQ ID NO: 865679 - RNA, 19 nt, Homo sapiens
gcaagagaauaguuaugau

SEQ ID NO: 865680 - RNA, 19 nt, Homo sapiens
ggaauagccuuagaaaauu

SEQ ID NO: 865681 - RNA, 19 nt, Homo sapiens
ccaaauuuacuucccaaua

SEQ ID NO: 865682 - RNA, 19 nt, Homo sapiens
caacaaacaggacuaagga

SEQ ID NO: 865683 - RNA, 19 nt, Homo sapiens
cgacaauccugcagaagau

SEQ ID NO: 865684 - RNA, 19 nt, Homo sapiens
gauaauggaacugaacuuu

SEQ ID NO: 865685 - RNA, 19 nt, Homo sapiens
gugaucacaucuaaacaaa

SEQ ID NO: 865686 - RNA, 19 nt, Homo sapiens
uguguuaugugucaucuaa

SEQ ID NO: 865687 - RNA, 19 nt, Homo sapiens
uaacuugugugcuaugauc

SEQ ID NO: 865688 - RNA, 19 nt, Homo sapiens
gaaggugggaauuauuauu

SEQ ID NO: 865689 - RNA, 19 nt, Homo sapiens
ggagucagcugugauguac

SEQ ID NO: 865690 - RNA, 19 nt, Homo sapiens
ggaaaggcaccaccaagga

SEQ ID NO: 865691 - RNA, 19 nt, Homo sapiens
ggaacuggguggcccugaa

SEQ ID NO: 865692 - RNA, 19 nt, Homo sapiens
uggcagugauucaacauuu

SEQ ID NO: 865693 - RNA, 19 nt, Homo sapiens
ccaugucugugguuucuuu

SEQ ID NO: 865694 - RNA, 19 nt, Homo sapiens
gcaaaggacccagguacaa

SEQ ID NO: 865695 - RNA, 19 nt, Homo sapiens
ccacgacaauccugcagaa

SEQ ID NO: 865696 - RNA, 19 nt, Homo sapiens
uaucuuugaugacuucuga

SEQ ID NO: 865697 - RNA, 19 nt, Homo sapiens
acaagucccuccugacaga

SEQ ID NO: 865698 - RNA, 19 nt, Homo sapiens
gaugagaugggcuccgaua

SEQ ID NO: 865699 - RNA, 19 nt, Homo sapiens
guguggagauugcaaauuc

SEQ ID NO: 865700 - RNA, 19 nt, Homo sapiens
aggacaaacugugcauuua

SEQ ID NO: 865701 - RNA, 19 nt, Homo sapiens
ucaggugucggaugauuua

SEQ ID NO: 865702 - RNA, 19 nt, Homo sapiens
ggagugaggccuugagcaa

SEQ ID NO: 865703 - RNA, 19 nt, Homo sapiens
aagaauuacugucaagaga

SEQ ID NO: 865704 - RNA, 19 nt, Homo sapiens
agacuucaaucuucgcaaa

SEQ ID NO: 865705 - RNA, 19 nt, Homo sapiens
ggaccugucugguuugacu

SEQ ID NO: 865706 - RNA, 19 nt, Homo sapiens
gggaauagccuuagaaaau

SEQ ID NO: 865707 - RNA, 19 nt, Homo sapiens
gaggagaaacggagaaaca

SEQ ID NO: 865708 - RNA, 19 nt, Homo sapiens
ugcagaagauuauacgaaa

SEQ ID NO: 865709 - RNA, 19 nt, Homo sapiens
ggagcuaacugaggaacug

SEQ ID NO: 865710 - RNA, 19 nt, Homo sapiens
aagccuaacucuguuguuu

SEQ ID NO: 865711 - RNA, 19 nt, Homo sapiens
gggaggaaggugggaauua

SEQ ID NO: 865712 - RNA, 19 nt, Homo sapiens
caaaggacccagguacaaa

SEQ ID NO: 865713 - RNA, 19 nt, Homo sapiens
caagaagacgggaucagaa

SEQ ID NO: 865714 - RNA, 19 nt, Homo sapiens
gauauugagagccggauuu

SEQ ID NO: 865715 - RNA, 19 nt, Homo sapiens
ggcaagagaauaguuauga

SEQ ID NO: 865716 - RNA, 19 nt, Homo sapiens
guaugacuauuuagagugu

SEQ ID NO: 865717 - RNA, 19 nt, Homo sapiens
gcagugaucacaucuaaac

SEQ ID NO: 865718 - RNA, 19 nt, Homo sapiens
gaccaucacuggcucaacu

SEQ ID NO: 865719 - RNA, 19 nt, Homo sapiens
cagcuaguauuccauguca

SEQ ID NO: 865720 - RNA, 19 nt, Homo sapiens
gaaaggcaccaccaaggau

SEQ ID NO: 865721 - RNA, 19 nt, Homo sapiens
cagaagagccaagcaaaga

SEQ ID NO: 865722 - RNA, 19 nt, Homo sapiens
uguuauaguuccagaagaa

SEQ ID NO: 865723 - RNA, 19 nt, Homo sapiens
caacaucuccacagaaguc

SEQ ID NO: 865724 - RNA, 19 nt, Homo sapiens
ggaaugguucuacaauaau

SEQ ID NO: 865725 - RNA, 19 nt, Homo sapiens
cuggaaugguucuacaaua

SEQ ID NO: 865726 - RNA, 19 nt, Homo sapiens
cccaaucucuggaaugguu

SEQ ID NO: 865727 - RNA, 19 nt, Homo sapiens
guguaagccuugcaaacaa

SEQ ID NO: 865728 - RNA, 19 nt, Homo sapiens
caagagaauaguuaugaug

SEQ ID NO: 865729 - RNA, 19 nt, Homo sapiens
aaagaaaggaggcaagaga

SEQ ID NO: 865730 - RNA, 19 nt, Homo sapiens
ggaagaagguaaaagaaag

SEQ ID NO: 865731 - RNA, 19 nt, Homo sapiens
cucaaucacuggagaagaa

SEQ ID NO: 865732 - RNA, 19 nt, Homo sapiens
agaaggacauagugugaug

SEQ ID NO: 865733 - RNA, 19 nt, Homo sapiens
agauuugacuuccgaauag

SEQ ID NO: 865734 - RNA, 19 nt, Homo sapiens
gaugcuguguuauguguca

SEQ ID NO: 865735 - RNA, 19 nt, Homo sapiens
agccacaccuuuaugcuaa

SEQ ID NO: 865736 - RNA, 19 nt, Homo sapiens
cuucucauuugaauccuua

SEQ ID NO: 865737 - RNA, 19 nt, Homo sapiens
ggcauuaacaaccuucuuu

SEQ ID NO: 865738 - RNA, 19 nt, Homo sapiens
guacaaaccauagauacau

SEQ ID NO: 865739 - RNA, 19 nt, Homo sapiens
caacagcagcgcuccaugu

SEQ ID NO: 865740 - RNA, 19 nt, Homo sapiens
ugagacaucuucagugacu

SEQ ID NO: 865741 - RNA, 19 nt, Homo sapiens
uguaagccuugcaaacaaa

SEQ ID NO: 865742 - RNA, 19 nt, Homo sapiens
uuaauggacacaagaauug

SEQ ID NO: 865743 - RNA, 19 nt, Homo sapiens
caaggcuccucaacaaaca

SEQ ID NO: 865744 - RNA, 19 nt, Homo sapiens
gccaggagguggagaagag

SEQ ID NO: 865745 - RNA, 19 nt, Homo sapiens
gcuaacuugugugcuauga

SEQ ID NO: 865746 - RNA, 19 nt, Homo sapiens
aaacagagcugcagaauca

SEQ ID NO: 865747 - RNA, 19 nt, Homo sapiens
gagcagacaucucuuaaga

SEQ ID NO: 865748 - RNA, 19 nt, Homo sapiens
gauaaggcccguauauaua

SEQ ID NO: 865749 - RNA, 19 nt, Homo sapiens
gagaggcacuagauuguaa

SEQ ID NO: 865750 - RNA, 19 nt, Homo sapiens
gcacaccuuugucuucuuu

SEQ ID NO: 865751 - RNA, 19 nt, Homo sapiens
ggagauuacuggaauuguu

SEQ ID NO: 865752 - RNA, 19 nt, Homo sapiens
gaagaaauccagggccuua

SEQ ID NO: 865753 - RNA, 19 nt, Homo sapiens
ggauaaggcccguauauau

SEQ ID NO: 865754 - RNA, 19 nt, Homo sapiens
gaacacaaagucacgcaua

SEQ ID NO: 865755 - RNA, 19 nt, Homo sapiens
gaacaagcauaucaaagag

SEQ ID NO: 865756 - RNA, 19 nt, Homo sapiens
ucacagaacacaagauuaa

SEQ ID NO: 865757 - RNA, 19 nt, Homo sapiens
caucagaccuggagaaagu

SEQ ID NO: 865758 - RNA, 19 nt, Homo sapiens
gcgcuuaaauccaagacua

SEQ ID NO: 865759 - RNA, 19 nt, Homo sapiens
aaacuuugcugcagaauca

SEQ ID NO: 865760 - RNA, 19 nt, Homo sapiens
caaagaaccaguaguagaa

SEQ ID NO: 865761 - RNA, 19 nt, Homo sapiens
gcacuagauuguaagaaga

SEQ ID NO: 865762 - RNA, 19 nt, Homo sapiens
caacagcguucuuaaacug

SEQ ID NO: 865763 - RNA, 19 nt, Homo sapiens
uaucagcgcuuaaauccaa

SEQ ID NO: 865764 - RNA, 19 nt, Homo sapiens
uguauuaugucgucugaua

SEQ ID NO: 865765 - RNA, 19 nt, Homo sapiens
caacaagccauauaaaugu

SEQ ID NO: 865766 - RNA, 19 nt, Homo sapiens
gacaagaucuaugacugua

SEQ ID NO: 865767 - RNA, 19 nt, Homo sapiens
cagccgagaucgccacaua

SEQ ID NO: 865768 - RNA, 19 nt, Homo sapiens
ugaauuauauccacaaugg

SEQ ID NO: 865769 - RNA, 19 nt, Homo sapiens
gaagaagaccuaucaaugc

SEQ ID NO: 865770 - RNA, 19 nt, Homo sapiens
guacaaauucgccaauauu

SEQ ID NO: 865771 - RNA, 19 nt, Homo sapiens
gaguggauguugaagauga

SEQ ID NO: 865772 - RNA, 19 nt, Homo sapiens
acacuuaagccuagaauuu

SEQ ID NO: 865773 - RNA, 19 nt, Homo sapiens
aaacucaucucgacacugu

SEQ ID NO: 865774 - RNA, 19 nt, Homo sapiens
caagcaagaucuggugaaa

SEQ ID NO: 865775 - RNA, 19 nt, Homo sapiens
uuagacagguucauuguga

SEQ ID NO: 865776 - RNA, 19 nt, Homo sapiens
cagguagcaucacuauaua

SEQ ID NO: 865777 - RNA, 19 nt, Homo sapiens
ccaacaagccauauaaaug

SEQ ID NO: 865778 - RNA, 19 nt, Homo sapiens
agacaagacugaagaugga

SEQ ID NO: 865779 - RNA, 19 nt, Homo sapiens
ggauacauuugaagcuuug

SEQ ID NO: 865780 - RNA, 19 nt, Homo sapiens
uauguagacugucaaagaa

SEQ ID NO: 865781 - RNA, 19 nt, Homo sapiens
ccucaacacucuucaggaa

SEQ ID NO: 865782 - RNA, 19 nt, Homo sapiens
caaacugccuuucaaaugc

SEQ ID NO: 865783 - RNA, 19 nt, Homo sapiens
gagauuacuggaauuguuu

SEQ ID NO: 865784 - RNA, 19 nt, Homo sapiens
gaacauguuuuacucuuug

SEQ ID NO: 865785 - RNA, 19 nt, Homo sapiens
gugcgcaucuugccucaaa

SEQ ID NO: 865786 - RNA, 19 nt, Homo sapiens
aaauggagcuuccgagcaa

SEQ ID NO: 865787 - RNA, 19 nt, Homo sapiens
gagcugcaaugccacauca

SEQ ID NO: 865788 - RNA, 19 nt, Homo sapiens
cauguuaccauucacuuua

SEQ ID NO: 865789 - RNA, 19 nt, Homo sapiens
ugaacaagcauaucaaaga

SEQ ID NO: 865790 - RNA, 19 nt, Homo sapiens
caaauucgccaauauucaa

SEQ ID NO: 865791 - RNA, 19 nt, Homo sapiens
gcccauauuugucaguauu

SEQ ID NO: 865792 - RNA, 19 nt, Homo sapiens
uaugaucacuucaacguau

SEQ ID NO: 865793 - RNA, 19 nt, Homo sapiens
gcugaagcauguuaccauu

SEQ ID NO: 865794 - RNA, 19 nt, Homo sapiens
ugaaugugaugcugcguuu

SEQ ID NO: 865795 - RNA, 19 nt, Homo sapiens
caagaucuaugacuguaca

SEQ ID NO: 865796 - RNA, 19 nt, Homo sapiens
ucacaugauugaugaagga

SEQ ID NO: 865797 - RNA, 19 nt, Homo sapiens
gcugcaacguuaaguuuga

SEQ ID NO: 865798 - RNA, 19 nt, Homo sapiens
gaacaggcccauauuuguc

SEQ ID NO: 865799 - RNA, 19 nt, Homo sapiens
uauaaaguguugcacaugu

SEQ ID NO: 865800 - RNA, 19 nt, Homo sapiens
gagaagaagaccuaucaau

SEQ ID NO: 865801 - RNA, 19 nt, Homo sapiens
uggaugaccuucagaaaca

SEQ ID NO: 865802 - RNA, 19 nt, Homo sapiens
acaagcauaucaaagagaa

SEQ ID NO: 865803 - RNA, 19 nt, Homo sapiens
ccaaagaaccaguaguaga

SEQ ID NO: 865804 - RNA, 19 nt, Homo sapiens
ccgauguucucauggauuu

SEQ ID NO: 865805 - RNA, 19 nt, Homo sapiens
gcugagcgauaucacagaa

SEQ ID NO: 865806 - RNA, 19 nt, Homo sapiens
acagguagcaucacuauau

SEQ ID NO: 865807 - RNA, 19 nt, Homo sapiens
ccagucugcuuuacaguau

SEQ ID NO: 865808 - RNA, 19 nt, Homo sapiens
aaagugaacuccagaacca

SEQ ID NO: 865809 - RNA, 19 nt, Homo sapiens
ugacuggucccucgaguaa

SEQ ID NO: 865810 - RNA, 19 nt, Homo sapiens
acuggaaacugccggauuu

SEQ ID NO: 865811 - RNA, 19 nt, Homo sapiens
gaaacacaaccaccuggaa

SEQ ID NO: 865812 - RNA, 19 nt, Homo sapiens
caacguauuacaucuguga

SEQ ID NO: 865813 - RNA, 19 nt, Homo sapiens
uuagguauaucagcgcuua

SEQ ID NO: 865814 - RNA, 19 nt, Homo sapiens
gacaagaagacaagaucua

SEQ ID NO: 865815 - RNA, 19 nt, Homo sapiens
gggaaugggucugcaguuc

SEQ ID NO: 865816 - RNA, 19 nt, Homo sapiens
guccugcccucacucuaua

SEQ ID NO: 865817 - RNA, 19 nt, Homo sapiens
guaagaagaggccggaaga

SEQ ID NO: 865818 - RNA, 19 nt, Homo sapiens
cagaacaggcccauauuug

SEQ ID NO: 865819 - RNA, 19 nt, Homo sapiens
aaaccgagaucccucaaag

SEQ ID NO: 865820 - RNA, 19 nt, Homo sapiens
agaagaagaccuaucaaug

SEQ ID NO: 865821 - RNA, 19 nt, Homo sapiens
ccaaaugcacccugacuug

SEQ ID NO: 865822 - RNA, 19 nt, Homo sapiens
ccacucacaguaagaagua

SEQ ID NO: 865823 - RNA, 19 nt, Homo sapiens
gugacaaacugccuuucaa

SEQ ID NO: 865824 - RNA, 19 nt, Homo sapiens
ggagaggcacuagauugua

SEQ ID NO: 865825 - RNA, 19 nt, Homo sapiens
cacuacaugugcccuauuu

SEQ ID NO: 865826 - RNA, 19 nt, Homo sapiens
aaacugaacaagcauauca

SEQ ID NO: 865827 - RNA, 19 nt, Homo sapiens
ucaacgaccucaacacucu

SEQ ID NO: 865828 - RNA, 19 nt, Homo sapiens
gccauugucuaccagugua

SEQ ID NO: 865829 - RNA, 19 nt, Homo sapiens
ccagaacaggcccauauuu

SEQ ID NO: 865830 - RNA, 19 nt, Homo sapiens
ucacgcagccaaauucuug

SEQ ID NO: 865831 - RNA, 19 nt, Homo sapiens
auaaaguguugcacaugua

SEQ ID NO: 865832 - RNA, 19 nt, Homo sapiens
gauauucagguucauguug

SEQ ID NO: 865833 - RNA, 19 nt, Homo sapiens
gaaacugccggauuugcaa

SEQ ID NO: 865834 - RNA, 19 nt, Homo sapiens
cacaaagucacgcauagua

SEQ ID NO: 865835 - RNA, 19 nt, Homo sapiens
ccaccuaggcccugucaaa

SEQ ID NO: 865836 - RNA, 19 nt, Homo sapiens
ccuacacuauggaaacuuu

SEQ ID NO: 865837 - RNA, 19 nt, Homo sapiens
gcaauucacaucaguggau

SEQ ID NO: 865838 - RNA, 19 nt, Homo sapiens
aaauugaccuguccucagu

SEQ ID NO: 865839 - RNA, 19 nt, Homo sapiens
gaagauccacuuaaagacu

SEQ ID NO: 865840 - RNA, 19 nt, Homo sapiens
cagauggaguggauguuga

SEQ ID NO: 865841 - RNA, 19 nt, Homo sapiens
uguagacugucaaagaauu

SEQ ID NO: 865842 - RNA, 19 nt, Homo sapiens
ucaaagaccccaacuguaa

SEQ ID NO: 865843 - RNA, 19 nt, Homo sapiens
aagaagacaagaucuauga

SEQ ID NO: 865844 - RNA, 19 nt, Homo sapiens
gaucuggugaaacuugaua

SEQ ID NO: 865845 - RNA, 19 nt, Homo sapiens
ugcaauaguuguuauguag

SEQ ID NO: 865846 - RNA, 19 nt, Homo sapiens
gcaaagaggcuacugauaa

SEQ ID NO: 865847 - RNA, 19 nt, Homo sapiens
ggacagucauccucuauaa

SEQ ID NO: 865848 - RNA, 19 nt, Homo sapiens
caaagaggcuacugauaaa

SEQ ID NO: 865849 - RNA, 19 nt, Homo sapiens
aaagaaagauguacaguug

SEQ ID NO: 865850 - RNA, 19 nt, Homo sapiens
aaacgcaugugcuuucuua

SEQ ID NO: 865851 - RNA, 19 nt, Homo sapiens
ggagacaccucaaggaugu

SEQ ID NO: 865852 - RNA, 19 nt, Homo sapiens
gcucaaggcuguuguaucu

SEQ ID NO: 865853 - RNA, 19 nt, Homo sapiens
ucacguaucuuaaccaaau

SEQ ID NO: 865854 - RNA, 19 nt, Homo sapiens
ggucaacucugguauuaug

SEQ ID NO: 865855 - RNA, 19 nt, Homo sapiens
uaauggagauugccuuaaa

SEQ ID NO: 865856 - RNA, 19 nt, Homo sapiens
ggaaagguguaaagcagaa

SEQ ID NO: 865857 - RNA, 19 nt, Homo sapiens
gaaauuacuuugcuuacgu

SEQ ID NO: 865858 - RNA, 19 nt, Homo sapiens
uaacaggacuucuggaaag

SEQ ID NO: 865859 - RNA, 19 nt, Homo sapiens
caacaagauugaaguaagu

SEQ ID NO: 865860 - RNA, 19 nt, Homo sapiens
guggagagguucugcaauu

SEQ ID NO: 865861 - RNA, 19 nt, Homo sapiens
ggaaauucaucucuuugau

SEQ ID NO: 865862 - RNA, 19 nt, Homo sapiens
guaccuggaccaucacuua

SEQ ID NO: 865863 - RNA, 19 nt, Homo sapiens
gcagacaccugacuuucau

SEQ ID NO: 865864 - RNA, 19 nt, Homo sapiens
guggucaacucugguauua

SEQ ID NO: 865865 - RNA, 19 nt, Homo sapiens
uaacugugauuccauacaa

SEQ ID NO: 865866 - RNA, 19 nt, Homo sapiens
uaugaaaccuugauaccaa

SEQ ID NO: 865867 - RNA, 19 nt, Homo sapiens
gaucggaaauucaucucuu

SEQ ID NO: 865868 - RNA, 19 nt, Homo sapiens
caagaacgguguuuuguuu

SEQ ID NO: 865869 - RNA, 19 nt, Homo sapiens
gagaguauguuguuguaca

SEQ ID NO: 865870 - RNA, 19 nt, Homo sapiens
gugaaacaaggucaaauua

SEQ ID NO: 865871 - RNA, 19 nt, Homo sapiens
ugaaccagauuauggauug

SEQ ID NO: 865872 - RNA, 19 nt, Homo sapiens
uaaagcagaaccaucauuu

SEQ ID NO: 865873 - RNA, 19 nt, Homo sapiens
gugaguaccuggaccauca

SEQ ID NO: 865874 - RNA, 19 nt, Homo sapiens
gauuggauaugucuacuuc

SEQ ID NO: 865875 - RNA, 19 nt, Homo sapiens
agaaagauguacaguuguu

SEQ ID NO: 865876 - RNA, 19 nt, Homo sapiens
ucagagcagucaagaagaa

SEQ ID NO: 865877 - RNA, 19 nt, Homo sapiens
gauuauggauuggauaugu

SEQ ID NO: 865878 - RNA, 19 nt, Homo sapiens
gaaagauguacaguuguua

SEQ ID NO: 865879 - RNA, 19 nt, Homo sapiens
gaagauguaaaccuggaua

SEQ ID NO: 865880 - RNA, 19 nt, Homo sapiens
ucuauaagguuucugauca

SEQ ID NO: 865881 - RNA, 19 nt, Homo sapiens
cauaucacgcuguuucuua

SEQ ID NO: 865882 - RNA, 19 nt, Homo sapiens
gaagcagacaccugacuuu

SEQ ID NO: 865883 - RNA, 19 nt, Homo sapiens
gacgaaaacucuguuauaa

SEQ ID NO: 865884 - RNA, 19 nt, Homo sapiens
gugauuaaauggacaaagu

SEQ ID NO: 865885 - RNA, 19 nt, Homo sapiens
gcauauagcgagacauuuc

SEQ ID NO: 865886 - RNA, 19 nt, Homo sapiens
caaaggagagcacuucaug

SEQ ID NO: 865887 - RNA, 19 nt, Homo sapiens
gagcauuggugaugacagu

SEQ ID NO: 865888 - RNA, 19 nt, Homo sapiens
aaacuguuaucucugauga

SEQ ID NO: 865889 - RNA, 19 nt, Homo sapiens
guucuaggcuguggacauu

SEQ ID NO: 865890 - RNA, 19 nt, Homo sapiens
gaggaagaauucacguugu

SEQ ID NO: 865891 - RNA, 19 nt, Homo sapiens
gagcagucaagaagaauuu

SEQ ID NO: 865892 - RNA, 19 nt, Homo sapiens
gaagaagugauuaaaugga

SEQ ID NO: 865893 - RNA, 19 nt, Homo sapiens
ucauuaagcucugaugguu

SEQ ID NO: 865894 - RNA, 19 nt, Homo sapiens
uaucaauucuccuucauag

SEQ ID NO: 865895 - RNA, 19 nt, Homo sapiens
gcaauaacugugaucaaga

SEQ ID NO: 865896 - RNA, 19 nt, Homo sapiens
guaacuggguugauuuuaa

SEQ ID NO: 865897 - RNA, 19 nt, Homo sapiens
gaagcaaagaggcuacuga

SEQ ID NO: 865898 - RNA, 19 nt, Homo sapiens
uggcagcgcuggaggaaga

SEQ ID NO: 865899 - RNA, 19 nt, Homo sapiens
ggaagagcaaacugaaauu

SEQ ID NO: 865900 - RNA, 19 nt, Homo sapiens
caaccauaaugaaagauuc

SEQ ID NO: 865901 - RNA, 19 nt, Homo sapiens
gacugcagguuucacauga

SEQ ID NO: 865902 - RNA, 19 nt, Homo sapiens
ugcuggagcucuucugaua

SEQ ID NO: 865903 - RNA, 19 nt, Homo sapiens
ucacgcuguuucuuaagua

SEQ ID NO: 865904 - RNA, 19 nt, Homo sapiens
caauaacugugaucaagag

SEQ ID NO: 865905 - RNA, 19 nt, Homo sapiens
gaaaaucucuaacugugau

SEQ ID NO: 865906 - RNA, 19 nt, Homo sapiens
uuaaaucacugcugcucaa

SEQ ID NO: 865907 - RNA, 19 nt, Homo sapiens
cgaaaacucuguuauaaag

SEQ ID NO: 865908 - RNA, 19 nt, Homo sapiens
cagcagaaguauauaggau

SEQ ID NO: 865909 - RNA, 19 nt, Homo sapiens
gaagagcaaacugaaauuc

SEQ ID NO: 865910 - RNA, 19 nt, Homo sapiens
acuagcagcuucuaaggaa

SEQ ID NO: 865911 - RNA, 19 nt, Homo sapiens
gaacucagagcagucaaga

SEQ ID NO: 865912 - RNA, 19 nt, Homo sapiens
gguauuauggagaacauuu

SEQ ID NO: 865913 - RNA, 19 nt, Homo sapiens
guuuaacucacguaucuua

SEQ ID NO: 865914 - RNA, 19 nt, Homo sapiens
uguuaucucugaugaagaa

SEQ ID NO: 865915 - RNA, 19 nt, Homo sapiens
caaggaaggugcuguucgu

SEQ ID NO: 865916 - RNA, 19 nt, Homo sapiens
agagcaaacugaaauucuu

SEQ ID NO: 865917 - RNA, 19 nt, Homo sapiens
ugaaguagaaguacggaaa

SEQ ID NO: 865918 - RNA, 19 nt, Homo sapiens
uaaggaaugccucucugua

SEQ ID NO: 865919 - RNA, 19 nt, Homo sapiens
uggagaguauguuguugua

SEQ ID NO: 865920 - RNA, 19 nt, Homo sapiens
cuggagcucuucugauauu

SEQ ID NO: 865921 - RNA, 19 nt, Homo sapiens
auucugagcucaacaagau

SEQ ID NO: 865922 - RNA, 19 nt, Homo sapiens
cagcauauagcgagacauu

SEQ ID NO: 865923 - RNA, 19 nt, Homo sapiens
gaaguagaaguacggaaau

SEQ ID NO: 865924 - RNA, 19 nt, Homo sapiens
acacauugaaguagaagua

SEQ ID NO: 865925 - RNA, 19 nt, Homo sapiens
guuaauauggagucaguuu

SEQ ID NO: 865926 - RNA, 19 nt, Homo sapiens
ugucaaccauaaugaaaga

SEQ ID NO: 865927 - RNA, 19 nt, Homo sapiens
caacuuuugucaaccauaa

SEQ ID NO: 865928 - RNA, 19 nt, Homo sapiens
uugaaacuguuaucucuga

SEQ ID NO: 865929 - RNA, 19 nt, Homo sapiens
gaauacacccaccuaccuu

SEQ ID NO: 865930 - RNA, 19 nt, Homo sapiens
guaacaggacuucuggaaa

SEQ ID NO: 865931 - RNA, 19 nt, Homo sapiens
gcucugaugguuguauaua

SEQ ID NO: 865932 - RNA, 19 nt, Homo sapiens
acagaccaguuucuaguga

SEQ ID NO: 865933 - RNA, 19 nt, Homo sapiens
ggaaauuacuuugcuuacg

SEQ ID NO: 865934 - RNA, 19 nt, Homo sapiens
gcagaaaauugaaacuguu

SEQ ID NO: 865935 - RNA, 19 nt, Homo sapiens
uaccugaaguguagcgaaa

SEQ ID NO: 865936 - RNA, 19 nt, Homo sapiens
gauguaaaccuggauaaag

SEQ ID NO: 865937 - RNA, 19 nt, Homo sapiens
cuacagcaguucccugaca

SEQ ID NO: 865938 - RNA, 19 nt, Homo sapiens
guaaagcagaaccaucauu

SEQ ID NO: 865939 - RNA, 19 nt, Homo sapiens
gaaugccucucuguaugga

SEQ ID NO: 865940 - RNA, 19 nt, Homo sapiens
ggacugcagguuucacaug

SEQ ID NO: 865941 - RNA, 19 nt, Homo sapiens
ggguaggacugcagguuuc

SEQ ID NO: 865942 - RNA, 19 nt, Homo sapiens
agaaacgugucagugagua

SEQ ID NO: 865943 - RNA, 19 nt, Homo sapiens
guauuuguauuuccuguac

SEQ ID NO: 865944 - RNA, 19 nt, Homo sapiens
agucaccugugcuugcuua

SEQ ID NO: 865945 - RNA, 19 nt, Homo sapiens
guauucagacauccuguuu

SEQ ID NO: 865946 - RNA, 19 nt, Homo sapiens
gaaugggacucaaauguug

SEQ ID NO: 865947 - RNA, 19 nt, Homo sapiens
gacaggaguuguaggguua

SEQ ID NO: 865948 - RNA, 19 nt, Homo sapiens
caaacuagaaggacaaaua

SEQ ID NO: 865949 - RNA, 19 nt, Homo sapiens
gaaggaugguaacaaacua

SEQ ID NO: 865950 - RNA, 19 nt, Homo sapiens
caauaucccucacauacaa

SEQ ID NO: 865951 - RNA, 19 nt, Homo sapiens
caagucaaguucuacaauu

SEQ ID NO: 865952 - RNA, 19 nt, Homo sapiens
ggacucaaauguugugcuu

SEQ ID NO: 865953 - RNA, 19 nt, Homo sapiens
ggacagaguuguuuauacg

SEQ ID NO: 865954 - RNA, 19 nt, Homo sapiens
auaaacagcuccgcucuuu

SEQ ID NO: 865955 - RNA, 19 nt, Homo sapiens
gagaauauucccaucugua

SEQ ID NO: 865956 - RNA, 19 nt, Homo sapiens
guuaagugauuccuccuuu

SEQ ID NO: 865957 - RNA, 19 nt, Homo sapiens
cauguaacuugcaguguuu

SEQ ID NO: 865958 - RNA, 19 nt, Homo sapiens
gcauugcuguggaccauug

SEQ ID NO: 865959 - RNA, 19 nt, Homo sapiens
uaaagugacaggaguugua

SEQ ID NO: 865960 - RNA, 19 nt, Homo sapiens
cacuggaacugaagucuaa

SEQ ID NO: 865961 - RNA, 19 nt, Homo sapiens
caaauguugugcuuccuau

SEQ ID NO: 865962 - RNA, 19 nt, Homo sapiens
guaccacucccgagaauau

SEQ ID NO: 865963 - RNA, 19 nt, Homo sapiens
aaacagcuccgcucuuuca

SEQ ID NO: 865964 - RNA, 19 nt, Homo sapiens
gguccucccauguguaaua

SEQ ID NO: 865965 - RNA, 19 nt, Homo sapiens
ggucgagaauauuuccauu

SEQ ID NO: 865966 - RNA, 19 nt, Homo sapiens
gagacaguguggcaaguca

SEQ ID NO: 865967 - RNA, 19 nt, Homo sapiens
ggguacauaugacacagaa

SEQ ID NO: 865968 - RNA, 19 nt, Homo sapiens
gcaagucaaguucuacaau

SEQ ID NO: 865969 - RNA, 19 nt, Homo sapiens
ucacagacauugggaccuu

SEQ ID NO: 865970 - RNA, 19 nt, Homo sapiens
gcauauggaccuguaauca

SEQ ID NO: 865971 - RNA, 19 nt, Homo sapiens
acauguaacuugcaguguu

SEQ ID NO: 865972 - RNA, 19 nt, Homo sapiens
cuacuagcccugguuauuu

SEQ ID NO: 865973 - RNA, 19 nt, Homo sapiens
agguugaggugaagauuaa

SEQ ID NO: 865974 - RNA, 19 nt, Homo sapiens
cuagaaggacaaauaugua

SEQ ID NO: 865975 - RNA, 19 nt, Homo sapiens
ggaaggaugguaacaaacu

SEQ ID NO: 865976 - RNA, 19 nt, Homo sapiens
agggaaggaugguaacaaa

SEQ ID NO: 865977 - RNA, 19 nt, Homo sapiens
ugaaugggacucaaauguu

SEQ ID NO: 865978 - RNA, 19 nt, Homo sapiens
gcagugaaugggacucaaa

SEQ ID NO: 865979 - RNA, 19 nt, Homo sapiens
cugacuaacuuugguguuu

SEQ ID NO: 865980 - RNA, 19 nt, Homo sapiens
ggccagaaccgcaccauca

SEQ ID NO: 865981 - RNA, 19 nt, Homo sapiens
uguguaauaugguaacaug

SEQ ID NO: 865982 - RNA, 19 nt, Homo sapiens
gggacagaguuguuuauac

SEQ ID NO: 865983 - RNA, 19 nt, Homo sapiens
uaacaaacuagaaggacaa

SEQ ID NO: 865984 - RNA, 19 nt, Homo sapiens
ccauuccacugacuaacuu

SEQ ID NO: 865985 - RNA, 19 nt, Homo sapiens
uaaaccagcgcaggccuua

SEQ ID NO: 865986 - RNA, 19 nt, Homo sapiens
ugaugugggugaacaagga

SEQ ID NO: 865987 - RNA, 19 nt, Homo sapiens
ccuacaagguugaggugaa

SEQ ID NO: 865988 - RNA, 19 nt, Homo sapiens
uaugguaacauguaacuug

SEQ ID NO: 865989 - RNA, 19 nt, Homo sapiens
guccugcucuugaccauuc

SEQ ID NO: 865990 - RNA, 19 nt, Homo sapiens
ugacaagcuuccauagucu

SEQ ID NO: 865991 - RNA, 19 nt, Homo sapiens
cacaauaucccucacauac

SEQ ID NO: 865992 - RNA, 19 nt, Homo sapiens
gaccuacuagcccugguua

SEQ ID NO: 865993 - RNA, 19 nt, Homo sapiens
guucuacaauuaccacaag

SEQ ID NO: 865994 - RNA, 19 nt, Homo sapiens
cauauggaccuguaaucaa

SEQ ID NO: 865995 - RNA, 19 nt, Homo sapiens
gugaaugggacucaaaugu

SEQ ID NO: 865996 - RNA, 19 nt, Homo sapiens
ucgagaauauuuccauugg

SEQ ID NO: 865997 - RNA, 19 nt, Homo sapiens
gacacaauaucccucacau

SEQ ID NO: 865998 - RNA, 19 nt, Homo sapiens
uugacaagcuuccauaguc

SEQ ID NO: 865999 - RNA, 19 nt, Homo sapiens
gcuguggaccauuguuaaa

SEQ ID NO: 866000 - RNA, 19 nt, Homo sapiens
gaccauuguuaaagugaca

SEQ ID NO: 866001 - RNA, 19 nt, Homo sapiens
aauguugugcuuccuauaa

SEQ ID NO: 866002 - RNA, 19 nt, Homo sapiens
agaauauucccaucuguau

SEQ ID NO: 866003 - RNA, 19 nt, Homo sapiens
cgagaauauucccaucugu

SEQ ID NO: 866004 - RNA, 19 nt, Homo sapiens
ccacuggaacugaagucua

SEQ ID NO: 866005 - RNA, 19 nt, Homo sapiens
ccgagaauauucccaucug

SEQ ID NO: 866006 - RNA, 19 nt, Homo sapiens
acacaauaucccucacaua

SEQ ID NO: 866007 - RNA, 19 nt, Homo sapiens
caaggcaugccacaccauu

SEQ ID NO: 866008 - RNA, 19 nt, Homo sapiens
cuucagacacgcacauuga

SEQ ID NO: 866009 - RNA, 19 nt, Homo sapiens
gcacgcugcaggucgagaa

SEQ ID NO: 866010 - RNA, 19 nt, Homo sapiens
cagcgcaggccuuaaacaa

SEQ ID NO: 866011 - RNA, 19 nt, Homo sapiens
gaaggacaaauauguacgu

SEQ ID NO: 866012 - RNA, 19 nt, Homo sapiens
gaugguaacaaacuagaag

SEQ ID NO: 866013 - RNA, 19 nt, Homo sapiens
guaauacaaacagcaguga

SEQ ID NO: 866014 - RNA, 19 nt, Homo sapiens
gauguaccacucccgagaa

SEQ ID NO: 866015 - RNA, 19 nt, Homo sapiens
ucaaauguugugcuuccua

SEQ ID NO: 866016 - RNA, 19 nt, Homo sapiens
guuccugcauccaguuguu

SEQ ID NO: 866017 - RNA, 19 nt, Homo sapiens
cugcaggucgagaauauuu

SEQ ID NO: 866018 - RNA, 19 nt, Homo sapiens
ccuacuagcccugguuauu

SEQ ID NO: 866019 - RNA, 19 nt, Homo sapiens
aaggacaaauauguacgua

SEQ ID NO: 866020 - RNA, 19 nt, Homo sapiens
guuuccaaguuaagugauu

SEQ ID NO: 866021 - RNA, 19 nt, Homo sapiens
cuacaagguugaggugaag

SEQ ID NO: 866022 - RNA, 19 nt, Homo sapiens
uguggcaagucaaguucua

SEQ ID NO: 866023 - RNA, 19 nt, Homo sapiens
acuagaaggacaaauaugu

SEQ ID NO: 866024 - RNA, 19 nt, Homo sapiens
aagguugaggugaagauua

SEQ ID NO: 866025 - RNA, 19 nt, Homo sapiens
ggaacugaagucuaaagag

SEQ ID NO: 866026 - RNA, 19 nt, Homo sapiens
gcagucugaugugggugaa

SEQ ID NO: 866027 - RNA, 19 nt, Homo sapiens
guggaccauuguuaaagug

SEQ ID NO: 866028 - RNA, 19 nt, Homo sapiens
ugaccauuccacugacuaa

SEQ ID NO: 866029 - RNA, 19 nt, Homo sapiens
aaccagcgcaggccuuaaa

SEQ ID NO: 866030 - RNA, 19 nt, Homo sapiens
ucaccaugccguucacaga

SEQ ID NO: 866031 - RNA, 19 nt, Homo sapiens
uguggaccauuguuaaagu

SEQ ID NO: 866032 - RNA, 19 nt, Homo sapiens
ggaugguaacaaacuagaa

SEQ ID NO: 866033 - RNA, 19 nt, Homo sapiens
uuuauacggguacauauga

SEQ ID NO: 866034 - RNA, 19 nt, Homo sapiens
cgcugcaggucgagaauau

SEQ ID NO: 866035 - RNA, 19 nt, Homo sapiens
auaaaggcguugaaaauca

SEQ ID NO: 866036 - RNA, 19 nt, Homo sapiens
auauggaccuguaaucaac

SEQ ID NO: 866037 - RNA, 19 nt, Homo sapiens
cgagaauauuuccauuggu

SEQ ID NO: 866038 - RNA, 19 nt, Homo sapiens
gccagaaccgcaccaucaa

SEQ ID NO: 866039 - RNA, 19 nt, Homo sapiens
ccuucucugucauugagua

SEQ ID NO: 866040 - RNA, 19 nt, Homo sapiens
ccaguuguucucggucaua

SEQ ID NO: 866041 - RNA, 19 nt, Homo sapiens
cggcaacccauccagauca

SEQ ID NO: 866042 - RNA, 19 nt, Homo sapiens
gaccuguaaucaacuuuug

SEQ ID NO: 866043 - RNA, 19 nt, Homo sapiens
aauacaaacagcagugaau

SEQ ID NO: 866044 - RNA, 19 nt, Homo sapiens
uaauacaaacagcagugaa

SEQ ID NO: 866045 - RNA, 19 nt, Homo sapiens
caagguugaggugaagauu

SEQ ID NO: 866046 - RNA, 19 nt, Homo sapiens
gaaaagggcuucucagaua

SEQ ID NO: 866047 - RNA, 19 nt, Homo sapiens
gaaagacccugugacauuu

SEQ ID NO: 866048 - RNA, 19 nt, Homo sapiens
ccacagaaauccuuuauuc

SEQ ID NO: 866049 - RNA, 19 nt, Homo sapiens
uuaaugagcuuucacaugu

SEQ ID NO: 866050 - RNA, 19 nt, Homo sapiens
ggcagcagcuaauaaguaa

SEQ ID NO: 866051 - RNA, 19 nt, Homo sapiens
ggaauggaaugccagaaau

SEQ ID NO: 866052 - RNA, 19 nt, Homo sapiens
gcauuuaaauuccacguau

SEQ ID NO: 866053 - RNA, 19 nt, Homo sapiens
ugaaagacccugugacauu

SEQ ID NO: 866054 - RNA, 19 nt, Homo sapiens
ugagugaucuuccuuugaa

SEQ ID NO: 866055 - RNA, 19 nt, Homo sapiens
guagguauauccaugaaug

SEQ ID NO: 866056 - RNA, 19 nt, Homo sapiens
caagcugucuuaaguauca

SEQ ID NO: 866057 - RNA, 19 nt, Homo sapiens
gcaagcacagcaugaguua

SEQ ID NO: 866058 - RNA, 19 nt, Homo sapiens
cgccaaaccucuauggaua

SEQ ID NO: 866059 - RNA, 19 nt, Homo sapiens
gaggaggaauuucacaguu

SEQ ID NO: 866060 - RNA, 19 nt, Homo sapiens
ccaaaccucuauggauaua

SEQ ID NO: 866061 - RNA, 19 nt, Homo sapiens
gcaaucagaaggugucuug

SEQ ID NO: 866062 - RNA, 19 nt, Homo sapiens
gaaauccuuuauucacaug

SEQ ID NO: 866063 - RNA, 19 nt, Homo sapiens
gauuugugguugauuagaa

SEQ ID NO: 866064 - RNA, 19 nt, Homo sapiens
ggaggaggcuauggaacaa

SEQ ID NO: 866065 - RNA, 19 nt, Homo sapiens
aggaggaauuucacaguua

SEQ ID NO: 866066 - RNA, 19 nt, Homo sapiens
gaagcucuacacaacuuua

SEQ ID NO: 866067 - RNA, 19 nt, Homo sapiens
caacuuuacaccugaauga

SEQ ID NO: 866068 - RNA, 19 nt, Homo sapiens
cagaaauccuuuauucaca

SEQ ID NO: 866069 - RNA, 19 nt, Homo sapiens
gcuaauaaguaaagcugau

SEQ ID NO: 866070 - RNA, 19 nt, Homo sapiens
cuaguaaccaucugcuuua

SEQ ID NO: 866071 - RNA, 19 nt, Homo sapiens
gcucuucagucaagcaaau

SEQ ID NO: 866072 - RNA, 19 nt, Homo sapiens
gaacucagacucccauaac

SEQ ID NO: 866073 - RNA, 19 nt, Homo sapiens
cgaguccagucacaacuuu

SEQ ID NO: 866074 - RNA, 19 nt, Homo sapiens
ggaggcaggcauuucagua

SEQ ID NO: 866075 - RNA, 19 nt, Homo sapiens
cagauuugauugcuuggaa

SEQ ID NO: 866076 - RNA, 19 nt, Homo sapiens
uuaaccagcucuucaguca

SEQ ID NO: 866077 - RNA, 19 nt, Homo sapiens
ggaggaauuucacaguuac

SEQ ID NO: 866078 - RNA, 19 nt, Homo sapiens
guauauccaugaaugcaau

SEQ ID NO: 866079 - RNA, 19 nt, Homo sapiens
aguauaugcuuucugcuuu

SEQ ID NO: 866080 - RNA, 19 nt, Homo sapiens
gaggcaggcauuucaguaa

SEQ ID NO: 866081 - RNA, 19 nt, Homo sapiens
gaaucaagccagaaaugga

SEQ ID NO: 866082 - RNA, 19 nt, Homo sapiens
guauaugcuuucugcuuug

SEQ ID NO: 866083 - RNA, 19 nt, Homo sapiens
caugagugaucuuccuuug

SEQ ID NO: 866084 - RNA, 19 nt, Homo sapiens
ccucuaacauguauaaagg

SEQ ID NO: 866085 - RNA, 19 nt, Homo sapiens
ggaccuaaauauuuuccua

SEQ ID NO: 866086 - RNA, 19 nt, Homo sapiens
gcauggcagcagcuaauaa

SEQ ID NO: 866087 - RNA, 19 nt, Homo sapiens
gaauggaaugccagaaaug

SEQ ID NO: 866088 - RNA, 19 nt, Homo sapiens
ucuuuacggucgcauagua

SEQ ID NO: 866089 - RNA, 19 nt, Homo sapiens
aauaagcccuguagcucuu

SEQ ID NO: 866090 - RNA, 19 nt, Homo sapiens
caaauccucuacucaccau

SEQ ID NO: 866091 - RNA, 19 nt, Homo sapiens
uggcagcagcuaauaagua

SEQ ID NO: 866092 - RNA, 19 nt, Homo sapiens
cagcugcagugccaagaug

SEQ ID NO: 866093 - RNA, 19 nt, Homo sapiens
uaagcccuguagcucuuua

SEQ ID NO: 866094 - RNA, 19 nt, Homo sapiens
gauguagguauauccauga

SEQ ID NO: 866095 - RNA, 19 nt, Homo sapiens
gaaaagagccagcaaaucc

SEQ ID NO: 866096 - RNA, 19 nt, Homo sapiens
ccaagccaguccagcauca

SEQ ID NO: 866097 - RNA, 19 nt, Homo sapiens
gaagcuugaggaggaauuu

SEQ ID NO: 866098 - RNA, 19 nt, Homo sapiens
cugaagcucuacacaacuu

SEQ ID NO: 866099 - RNA, 19 nt, Homo sapiens
ucaagcaaauccucuacuc

SEQ ID NO: 866100 - RNA, 19 nt, Homo sapiens
ccacguauccuguaguuuu

SEQ ID NO: 866101 - RNA, 19 nt, Homo sapiens
cuauaugauuugugguuga

SEQ ID NO: 866102 - RNA, 19 nt, Homo sapiens
aagcacagcaugaguuaga

SEQ ID NO: 866103 - RNA, 19 nt, Homo sapiens
gaggcuauggaacaaagua

SEQ ID NO: 866104 - RNA, 19 nt, Homo sapiens
gacccucgcuuggaaugga

SEQ ID NO: 866105 - RNA, 19 nt, Homo sapiens
gagugaucuuccuuugaaa

SEQ ID NO: 866106 - RNA, 19 nt, Homo sapiens
gaacgccaaaccucuaugg

SEQ ID NO: 866107 - RNA, 19 nt, Homo sapiens
uguuuaaucugugcaauca

SEQ ID NO: 866108 - RNA, 19 nt, Homo sapiens
uugcaugcauccuaaugaa

SEQ ID NO: 866109 - RNA, 19 nt, Homo sapiens
cuauaaacaucagugaauc

SEQ ID NO: 866110 - RNA, 19 nt, Homo sapiens
gaauuaaccagcucuucag

SEQ ID NO: 866111 - RNA, 19 nt, Homo sapiens
agaauuaaccagcucuuca

SEQ ID NO: 866112 - RNA, 19 nt, Homo sapiens
ggugaacuuuaucaauagu

SEQ ID NO: 866113 - RNA, 19 nt, Homo sapiens
agcaagcugucuuaaguau

SEQ ID NO: 866114 - RNA, 19 nt, Homo sapiens
uauaugcuuucugcuuuga

SEQ ID NO: 866115 - RNA, 19 nt, Homo sapiens
uauauaaagggaagcuuga

SEQ ID NO: 866116 - RNA, 19 nt, Homo sapiens
gaguggcggugugucaaug

SEQ ID NO: 866117 - RNA, 19 nt, Homo sapiens
gugcagaagcagaagcaaa

SEQ ID NO: 866118 - RNA, 19 nt, Homo sapiens
ggcaggcauuucaguaaca

SEQ ID NO: 866119 - RNA, 19 nt, Homo sapiens
acacaacuuuacaccugaa

SEQ ID NO: 866120 - RNA, 19 nt, Homo sapiens
aaccagcucuucagucaag

SEQ ID NO: 866121 - RNA, 19 nt, Homo sapiens
uuauuguuguugccucuaa

SEQ ID NO: 866122 - RNA, 19 nt, Homo sapiens
gcagcacacgcaccuacaa

SEQ ID NO: 866123 - RNA, 19 nt, Homo sapiens
uuacagugcagaagcagaa

SEQ ID NO: 866124 - RNA, 19 nt, Homo sapiens
uggaauggaaugccagaaa

SEQ ID NO: 866125 - RNA, 19 nt, Homo sapiens
acuaguaaccaucugcuuu

SEQ ID NO: 866126 - RNA, 19 nt, Homo sapiens
ccaccaaauacaucucuga

SEQ ID NO: 866127 - RNA, 19 nt, Homo sapiens
caagcaaauccucuacuca

SEQ ID NO: 866128 - RNA, 19 nt, Homo sapiens
gccaaaccucuauggauau

SEQ ID NO: 866129 - RNA, 19 nt, Homo sapiens
uaaugagcuuucacaugug

SEQ ID NO: 866130 - RNA, 19 nt, Homo sapiens
ggaccuucuuugggaauag

SEQ ID NO: 866131 - RNA, 19 nt, Homo sapiens
cagcacacgcaccuacaaa

SEQ ID NO: 866132 - RNA, 19 nt, Homo sapiens
cagcagcuaauaaguaaag

SEQ ID NO: 866133 - RNA, 19 nt, Homo sapiens
aaugaaagacccugugaca

SEQ ID NO: 866134 - RNA, 19 nt, Homo sapiens
acucagacucccauaacua

SEQ ID NO: 866135 - RNA, 19 nt, Homo sapiens
gcaugcauccuaaugaaaa

SEQ ID NO: 866136 - RNA, 19 nt, Homo sapiens
agaaugaaagacccuguga

SEQ ID NO: 866137 - RNA, 19 nt, Homo sapiens
ggaagcuugaggaggaauu

SEQ ID NO: 866138 - RNA, 19 nt, Homo sapiens
uggugaacuuuaucaauag

SEQ ID NO: 866139 - RNA, 19 nt, Homo sapiens
ucacaguaacauuucagaa

SEQ ID NO: 866140 - RNA, 19 nt, Homo sapiens
cacguauccuguaguuuua

SEQ ID NO: 866141 - RNA, 19 nt, Homo sapiens
ucccauaacuagacuuacu

SEQ ID NO: 866142 - RNA, 19 nt, Homo sapiens
caacuuugagagcauguca

SEQ ID NO: 866143 - RNA, 19 nt, Homo sapiens
caacgaguccagucacaac

SEQ ID NO: 866144 - RNA, 19 nt, Homo sapiens
ggaguggcggugugucaau

SEQ ID NO: 866145 - RNA, 19 nt, Homo sapiens
ggaauuucacaguuacagu

SEQ ID NO: 866146 - RNA, 19 nt, Homo sapiens
gaagauggaucaauagaaa

SEQ ID NO: 866147 - RNA, 19 nt, Homo sapiens
gaacaacuaugaugugaaa

SEQ ID NO: 866148 - RNA, 19 nt, Homo sapiens
ggaauacacucuccauaaa

SEQ ID NO: 866149 - RNA, 19 nt, Homo sapiens
caaugaagauggaucaaua

SEQ ID NO: 866150 - RNA, 19 nt, Homo sapiens
caacaagccuccacagauu

SEQ ID NO: 866151 - RNA, 19 nt, Homo sapiens
caacacagcugguaucuag

SEQ ID NO: 866152 - RNA, 19 nt, Homo sapiens
ccagagagcugaaugaaga

SEQ ID NO: 866153 - RNA, 19 nt, Homo sapiens
cauaaucccuggaagcuua

SEQ ID NO: 866154 - RNA, 19 nt, Homo sapiens
ccagaaaccuuaaucaaga

SEQ ID NO: 866155 - RNA, 19 nt, Homo sapiens
aaacaggccuucagaacua

SEQ ID NO: 866156 - RNA, 19 nt, Homo sapiens
ggacaccaauucaaucaaa

SEQ ID NO: 866157 - RNA, 19 nt, Homo sapiens
gaccuucccuugcuuuaua

SEQ ID NO: 866158 - RNA, 19 nt, Homo sapiens
gggauugucuuacagcaua

SEQ ID NO: 866159 - RNA, 19 nt, Homo sapiens
gguaagggcuggucacaga

SEQ ID NO: 866160 - RNA, 19 nt, Homo sapiens
agaaagagauggccacuau

SEQ ID NO: 866161 - RNA, 19 nt, Homo sapiens
gaggugaacuguugcaaug

SEQ ID NO: 866162 - RNA, 19 nt, Homo sapiens
ccaaacagcuccugcuuca

SEQ ID NO: 866163 - RNA, 19 nt, Homo sapiens
gagaagggauugucuuaca

SEQ ID NO: 866164 - RNA, 19 nt, Homo sapiens
gguauagacccaacuguua

SEQ ID NO: 866165 - RNA, 19 nt, Homo sapiens
gcauaguggugauaauuga

SEQ ID NO: 866166 - RNA, 19 nt, Homo sapiens
caaauugccuguacacaca

SEQ ID NO: 866167 - RNA, 19 nt, Homo sapiens
caaaugguccugauaagaa

SEQ ID NO: 866168 - RNA, 19 nt, Homo sapiens
aagcaaagaucaaaccauu

SEQ ID NO: 866169 - RNA, 19 nt, Homo sapiens
ucagggagcuucaccauca

SEQ ID NO: 866170 - RNA, 19 nt, Homo sapiens
ggagaagccuuugacauca

SEQ ID NO: 866171 - RNA, 19 nt, Homo sapiens
gcaaugggaucucacucaa

SEQ ID NO: 866172 - RNA, 19 nt, Homo sapiens
aaacggcucucucaaccua

SEQ ID NO: 866173 - RNA, 19 nt, Homo sapiens
gaaugaaccggaaguagaa

SEQ ID NO: 866174 - RNA, 19 nt, Homo sapiens
gaagaugugucugcugaug

SEQ ID NO: 866175 - RNA, 19 nt, Homo sapiens
gggcauacggccaagauua

SEQ ID NO: 866176 - RNA, 19 nt, Homo sapiens
gaaagggucucuggcuuca

SEQ ID NO: 866177 - RNA, 19 nt, Homo sapiens
cccaagagcuccuucagaa

SEQ ID NO: 866178 - RNA, 19 nt, Homo sapiens
gauccagacugcaucuauu

SEQ ID NO: 866179 - RNA, 19 nt, Homo sapiens
gaaauacacccucuucagu

SEQ ID NO: 866180 - RNA, 19 nt, Homo sapiens
gaaauacggcaacacgaaa

SEQ ID NO: 866181 - RNA, 19 nt, Homo sapiens
gcugguaucugcuuccuau

SEQ ID NO: 866182 - RNA, 19 nt, Homo sapiens
ggauagagauguaaaaugu

SEQ ID NO: 866183 - RNA, 19 nt, Homo sapiens
gaucaaaccauucgaaucu

SEQ ID NO: 866184 - RNA, 19 nt, Homo sapiens
cuacaaggauggcauagug

SEQ ID NO: 866185 - RNA, 19 nt, Homo sapiens
uagaacggcugcagaguug

SEQ ID NO: 866186 - RNA, 19 nt, Homo sapiens
gcacauaucauaagaagac

SEQ ID NO: 866187 - RNA, 19 nt, Homo sapiens
guacccaucugcuacaaau

SEQ ID NO: 866188 - RNA, 19 nt, Homo sapiens
gggcuacccuguauagaau

SEQ ID NO: 866189 - RNA, 19 nt, Homo sapiens
gaaagcagauggcaaaauc

SEQ ID NO: 866190 - RNA, 19 nt, Homo sapiens
ggcgugaaguccaagguua

SEQ ID NO: 866191 - RNA, 19 nt, Homo sapiens
cuacaucaauggauagaga

SEQ ID NO: 866192 - RNA, 19 nt, Homo sapiens
gaagaaacggacccugaaa

SEQ ID NO: 866193 - RNA, 19 nt, Homo sapiens
ggaaguguacucagccuuu

SEQ ID NO: 866194 - RNA, 19 nt, Homo sapiens
uaacacaccugccaaacag

SEQ ID NO: 866195 - RNA, 19 nt, Homo sapiens
gaaccguccuagaaagaga

SEQ ID NO: 866196 - RNA, 19 nt, Homo sapiens
aaacugaucuguacuaucc

SEQ ID NO: 866197 - RNA, 19 nt, Homo sapiens
gaaaggagagguuauucau

SEQ ID NO: 866198 - RNA, 19 nt, Homo sapiens
cagggaagcuauugcgauu

SEQ ID NO: 866199 - RNA, 19 nt, Homo sapiens
ugauggaaaugaagaagaa

SEQ ID NO: 866200 - RNA, 19 nt, Homo sapiens
gcaaaugguccugauaaga

SEQ ID NO: 866201 - RNA, 19 nt, Homo sapiens
gaaaaggucacuuagaaaa

SEQ ID NO: 866202 - RNA, 19 nt, Homo sapiens
gaagacuguauauacguua

SEQ ID NO: 866203 - RNA, 19 nt, Homo sapiens
caaggaagguugcuuagcu

SEQ ID NO: 866204 - RNA, 19 nt, Homo sapiens
caagagcuccuucagaaau

SEQ ID NO: 866205 - RNA, 19 nt, Homo sapiens
caaggcugcuucucaccua

SEQ ID NO: 866206 - RNA, 19 nt, Homo sapiens
uggaaucgauugauggaaa

SEQ ID NO: 866207 - RNA, 19 nt, Homo sapiens
guauagacccaacuguuaa

SEQ ID NO: 866208 - RNA, 19 nt, Homo sapiens
aaggagagguuauucauag

SEQ ID NO: 866209 - RNA, 19 nt, Homo sapiens
cagcaaaugguccugauaa

SEQ ID NO: 866210 - RNA, 19 nt, Homo sapiens
gaggaugaguugucugcuu

SEQ ID NO: 866211 - RNA, 19 nt, Homo sapiens
gcagcuggcuaccaugugu

SEQ ID NO: 866212 - RNA, 19 nt, Homo sapiens
ccaaagaggagcuucauca

SEQ ID NO: 866213 - RNA, 19 nt, Homo sapiens
ggaaucgauugauggaaau

SEQ ID NO: 866214 - RNA, 19 nt, Homo sapiens
aaucauggcucuuggcaau

SEQ ID NO: 866215 - RNA, 19 nt, Homo sapiens
cauaggcucuuuggccaua

SEQ ID NO: 866216 - RNA, 19 nt, Homo sapiens
aaacagaggaugacaaaca

SEQ ID NO: 866217 - RNA, 19 nt, Homo sapiens
gccagcaccucuuuauaga

SEQ ID NO: 866218 - RNA, 19 nt, Homo sapiens
aaacggacccugaaacuuc

SEQ ID NO: 866219 - RNA, 19 nt, Homo sapiens
acacagagauaaguuggaa

SEQ ID NO: 866220 - RNA, 19 nt, Homo sapiens
aacaaaagguugcuacuua

SEQ ID NO: 866221 - RNA, 19 nt, Homo sapiens
aagagcuccuucagaaaua

SEQ ID NO: 866222 - RNA, 19 nt, Homo sapiens
gagccaguguaaagaagaa

SEQ ID NO: 866223 - RNA, 19 nt, Homo sapiens
gagcgaaugcugaguacuu

SEQ ID NO: 866224 - RNA, 19 nt, Homo sapiens
gaacaucaaguacccaucu

SEQ ID NO: 866225 - RNA, 19 nt, Homo sapiens
cagaaaccuuaaucaagaa

SEQ ID NO: 866226 - RNA, 19 nt, Homo sapiens
ucacuuccaugcaagauca

SEQ ID NO: 866227 - RNA, 19 nt, Homo sapiens
uaagaagacuguauauacg

SEQ ID NO: 866228 - RNA, 19 nt, Homo sapiens
ccacagauuucuagcacau

SEQ ID NO: 866229 - RNA, 19 nt, Homo sapiens
gcuguuacuuucuacauca

SEQ ID NO: 866230 - RNA, 19 nt, Homo sapiens
aaauugcccuuucugaaga

SEQ ID NO: 866231 - RNA, 19 nt, Homo sapiens
gaaauuaccaacgggaaug

SEQ ID NO: 866232 - RNA, 19 nt, Homo sapiens
gcagcugcaugaaagucua

SEQ ID NO: 866233 - RNA, 19 nt, Homo sapiens
aaagugggauuguaugaca

SEQ ID NO: 866234 - RNA, 19 nt, Homo sapiens
aauacacucuccauaaaga

SEQ ID NO: 866235 - RNA, 19 nt, Homo sapiens
gaaguguacucagccuuuc

SEQ ID NO: 866236 - RNA, 19 nt, Homo sapiens
agaagaaggugagcgaaug

SEQ ID NO: 866237 - RNA, 19 nt, Homo sapiens
gaaaggggaucucaaaggu

SEQ ID NO: 866238 - RNA, 19 nt, Homo sapiens
aagaaagcaugaaggagaa

SEQ ID NO: 866239 - RNA, 19 nt, Homo sapiens
uaagaaaggagagguuauu

SEQ ID NO: 866240 - RNA, 19 nt, Homo sapiens
agagaagccagaaaccuua

SEQ ID NO: 866241 - RNA, 19 nt, Homo sapiens
cuugagaacuccuguaaag

SEQ ID NO: 866242 - RNA, 19 nt, Homo sapiens
acauuggucuccucgagua

SEQ ID NO: 866243 - RNA, 19 nt, Homo sapiens
gaaacggacccugaaacuu

SEQ ID NO: 866244 - RNA, 19 nt, Homo sapiens
ucgaguaaaggacuuaaua

SEQ ID NO: 866245 - RNA, 19 nt, Homo sapiens
uagcacauaucauaagaag

SEQ ID NO: 866246 - RNA, 19 nt, Homo sapiens
ggaagaaacuugugcagau

SEQ ID NO: 866247 - RNA, 19 nt, Homo sapiens
gugcacaggugguagauua

SEQ ID NO: 866248 - RNA, 19 nt, Homo sapiens
gaaggaggccggugacuuu

SEQ ID NO: 866249 - RNA, 19 nt, Homo sapiens
gcaagucuguggcccauga

SEQ ID NO: 866250 - RNA, 19 nt, Homo sapiens
acagggagcugaagaagaa

SEQ ID NO: 866251 - RNA, 19 nt, Homo sapiens
gaagaaacuugugcagaug

SEQ ID NO: 866252 - RNA, 19 nt, Homo sapiens
gagcaggccuguauucucu

SEQ ID NO: 866253 - RNA, 19 nt, Homo sapiens
acucagagaugaagaaguu

SEQ ID NO: 866254 - RNA, 19 nt, Homo sapiens
gcgcuucgcuucacuaugg

SEQ ID NO: 866255 - RNA, 19 nt, Homo sapiens
gcaaacagcggaugagcaa

SEQ ID NO: 866256 - RNA, 19 nt, Homo sapiens
gcagaaagugucagucauu

SEQ ID NO: 866257 - RNA, 19 nt, Homo sapiens
gugaagcccuugccaguga

SEQ ID NO: 866258 - RNA, 19 nt, Homo sapiens
gaagaaguuuguccugaag

SEQ ID NO: 866259 - RNA, 19 nt, Homo sapiens
ggacaacgacuucauuuac

SEQ ID NO: 866260 - RNA, 19 nt, Homo sapiens
ugaagaaguuuguccugaa

SEQ ID NO: 866261 - RNA, 19 nt, Homo sapiens
gcaugaaggucuccuguac

SEQ ID NO: 866262 - RNA, 19 nt, Homo sapiens
caaugaagccaucaaguug

SEQ ID NO: 866263 - RNA, 19 nt, Homo sapiens
gagcuuauccagaaagaug

SEQ ID NO: 866264 - RNA, 19 nt, Homo sapiens
ggaggaggaugagcugcua

SEQ ID NO: 866265 - RNA, 19 nt, Homo sapiens
gaagaauuauggagagaac

SEQ ID NO: 866266 - RNA, 19 nt, Homo sapiens
uaaagcgcauccuggcuaa

SEQ ID NO: 866267 - RNA, 19 nt, Homo sapiens
gaugagcaagcauaacuuu

SEQ ID NO: 866268 - RNA, 19 nt, Homo sapiens
ugaagaagcuggaguugcu

SEQ ID NO: 866269 - RNA, 19 nt, Homo sapiens
gcaagcaucagccagaaga

SEQ ID NO: 866270 - RNA, 19 nt, Homo sapiens
ucaaugaagccaucaaguu

SEQ ID NO: 866271 - RNA, 19 nt, Homo sapiens
gcacgcacauuaccugcau

SEQ ID NO: 866272 - RNA, 19 nt, Homo sapiens
gaaagugucagucauuguc

SEQ ID NO: 866273 - RNA, 19 nt, Homo sapiens
gagcagaaagugucaguca

SEQ ID NO: 866274 - RNA, 19 nt, Homo sapiens
ggacaaggccgugcugcaa

SEQ ID NO: 866275 - RNA, 19 nt, Homo sapiens
gagaugauggccaagauug

SEQ ID NO: 866276 - RNA, 19 nt, Homo sapiens
guaguguccuccgcaagua

SEQ ID NO: 866277 - RNA, 19 nt, Homo sapiens
cagaaagugucagucauug

SEQ ID NO: 866278 - RNA, 19 nt, Homo sapiens
agaagucgauguuggacaa

SEQ ID NO: 866279 - RNA, 19 nt, Homo sapiens
gucagguucugcuccuuua

SEQ ID NO: 866280 - RNA, 19 nt, Homo sapiens
gagcaagcauaacuuucug

SEQ ID NO: 866281 - RNA, 19 nt, Homo sapiens
gagaaugggccaaguacau

SEQ ID NO: 866282 - RNA, 19 nt, Homo sapiens
cagaaggacuggaagaaac

SEQ ID NO: 866283 - RNA, 19 nt, Homo sapiens
ccagaagccuacaaugaag

SEQ ID NO: 866284 - RNA, 19 nt, Homo sapiens
ggagcggguugcauacuuc

SEQ ID NO: 866285 - RNA, 19 nt, Homo sapiens
gaacccagaagccuacaau

SEQ ID NO: 866286 - RNA, 19 nt, Homo sapiens
aguuuguccugaagaauua

SEQ ID NO: 866287 - RNA, 19 nt, Homo sapiens
acgcagaucuggagagcaa

SEQ ID NO: 866288 - RNA, 19 nt, Homo sapiens
augaggaccugaugaagaa

SEQ ID NO: 866289 - RNA, 19 nt, Homo sapiens
gggagcggguugcauacuu

SEQ ID NO: 866290 - RNA, 19 nt, Homo sapiens
uuucagcucuuugcuauug

SEQ ID NO: 866291 - RNA, 19 nt, Homo sapiens
gcacagcaccacuucucuu

SEQ ID NO: 866292 - RNA, 19 nt, Homo sapiens
ccacagaccacucagagau

SEQ ID NO: 866293 - RNA, 19 nt, Homo sapiens
ugcgugagcuuauccagaa

SEQ ID NO: 866294 - RNA, 19 nt, Homo sapiens
agaaguuuguccugaagaa

SEQ ID NO: 866295 - RNA, 19 nt, Homo sapiens
gggagaugauggccaagau

SEQ ID NO: 866296 - RNA, 19 nt, Homo sapiens
ggagaugauggccaagauu

SEQ ID NO: 866297 - RNA, 19 nt, Homo sapiens
ggugagcagucccuaugug

SEQ ID NO: 866298 - RNA, 19 nt, Homo sapiens
ccaagaaggacaacgacuu

SEQ ID NO: 866299 - RNA, 19 nt, Homo sapiens
ccgaggagcagcagaaguu

SEQ ID NO: 866300 - RNA, 19 nt, Homo sapiens
cccagaagccuacaaugaa

SEQ ID NO: 866301 - RNA, 19 nt, Homo sapiens
gcccugagccuggcauuga

SEQ ID NO: 866302 - RNA, 19 nt, Homo sapiens
cagcaccacuucucuucug

SEQ ID NO: 866303 - RNA, 19 nt, Homo sapiens
acagaccacucagagauga

SEQ ID NO: 866304 - RNA, 19 nt, Homo sapiens
gacaaggccgugcugcaaa

SEQ ID NO: 866305 - RNA, 19 nt, Homo sapiens
ggucagguucugcuccuuu

SEQ ID NO: 866306 - RNA, 19 nt, Homo sapiens
uggaauugcuggccuccuu

SEQ ID NO: 866307 - RNA, 19 nt, Homo sapiens
uggcuaaggugcaggagau

SEQ ID NO: 866308 - RNA, 19 nt, Homo sapiens
cagcggaugagcaagcaua

SEQ ID NO: 866309 - RNA, 19 nt, Homo sapiens
gcaugcggcagcagagaaa

SEQ ID NO: 866310 - RNA, 19 nt, Homo sapiens
gaagaaccggcaccaggau

SEQ ID NO: 866311 - RNA, 19 nt, Homo sapiens
ggagagugaggcaguggaa

SEQ ID NO: 866312 - RNA, 19 nt, Homo sapiens
ugaaggacaucagagaucu

SEQ ID NO: 866313 - RNA, 19 nt, Homo sapiens
caagugcugucaggugugu

SEQ ID NO: 866314 - RNA, 19 nt, Homo sapiens
agauugaggacaagaauga

SEQ ID NO: 866315 - RNA, 19 nt, Homo sapiens
caagauugaggacaagaau

SEQ ID NO: 866316 - RNA, 19 nt, Homo sapiens
cacaggugguagauuacua

SEQ ID NO: 866317 - RNA, 19 nt, Homo sapiens
cccaugaggacaucaagua

SEQ ID NO: 866318 - RNA, 19 nt, Homo sapiens
ucccauuucugcugccuuu

SEQ ID NO: 866319 - RNA, 19 nt, Homo sapiens
ggacuucuacgcagaucug

SEQ ID NO: 866320 - RNA, 19 nt, Homo sapiens
uaugaggaccugaugaaga

SEQ ID NO: 866321 - RNA, 19 nt, Homo sapiens
ggacacucuucagccugua

SEQ ID NO: 866322 - RNA, 19 nt, Homo sapiens
agaaacuugugcagaugaa

SEQ ID NO: 866323 - RNA, 19 nt, Homo sapiens
ggacaacaggaagagcuuu

SEQ ID NO: 866324 - RNA, 19 nt, Homo sapiens
aauaauaaaccacccuguu

SEQ ID NO: 866325 - RNA, 19 nt, Homo sapiens
gugcaagcaucagccagaa

SEQ ID NO: 866326 - RNA, 19 nt, Homo sapiens
ccacuuggccugaguuagg

SEQ ID NO: 866327 - RNA, 19 nt, Homo sapiens
gcucaggcaaggaugacua

SEQ ID NO: 866328 - RNA, 19 nt, Homo sapiens
uggccaagauugaggacaa

SEQ ID NO: 866329 - RNA, 19 nt, Homo sapiens
aggcugagauggagaagca

SEQ ID NO: 866330 - RNA, 19 nt, Homo sapiens
aagaugcgcaggaacauga

SEQ ID NO: 866331 - RNA, 19 nt, Homo sapiens
ugggagcucuggacacugu

SEQ ID NO: 866332 - RNA, 19 nt, Homo sapiens
gcagaggugaggcgagaau

SEQ ID NO: 866333 - RNA, 19 nt, Homo sapiens
ccuguucuguggcccguaa

SEQ ID NO: 866334 - RNA, 19 nt, Homo sapiens
gaauugcuggccuccuuga

SEQ ID NO: 866335 - RNA, 19 nt, Homo sapiens
gaucuucucaggcaagucu

SEQ ID NO: 866336 - RNA, 19 nt, Homo sapiens
ugaucuggcuggaccugaa

SEQ ID NO: 866337 - RNA, 19 nt, Homo sapiens
acaaugaagaacugaagaa

SEQ ID NO: 866338 - RNA, 19 nt, Homo sapiens
ggacagggagcugaagaag

SEQ ID NO: 866339 - RNA, 19 nt, Homo sapiens
auaauaaaccacccuguuc

SEQ ID NO: 866340 - RNA, 19 nt, Homo sapiens
gcccgcugcuacucacuga

SEQ ID NO: 866341 - RNA, 19 nt, Homo sapiens
gacagggagcugaagaaga

SEQ ID NO: 866342 - RNA, 19 nt, Homo sapiens
gugagcuuauccagaaaga

SEQ ID NO: 866343 - RNA, 19 nt, Homo sapiens
augaagaacugaagaagcu

SEQ ID NO: 866344 - RNA, 19 nt, Homo sapiens
gacaacgacuucauuuacc

SEQ ID NO: 866345 - RNA, 19 nt, Homo sapiens
gcaggccuguauucucuac

SEQ ID NO: 866346 - RNA, 19 nt, Homo sapiens
gaagagagcuuucuacaaa

SEQ ID NO: 866347 - RNA, 19 nt, Homo sapiens
gaacagaauuggaguauuu

SEQ ID NO: 866348 - RNA, 19 nt, Homo sapiens
ccucauagcuuaaaguaua

SEQ ID NO: 866349 - RNA, 19 nt, Homo sapiens
aaacacaggucaccaauuu

SEQ ID NO: 866350 - RNA, 19 nt, Homo sapiens
ggaaagcucucuauucuag

SEQ ID NO: 866351 - RNA, 19 nt, Homo sapiens
gaaauuaaccuaaggaaug

SEQ ID NO: 866352 - RNA, 19 nt, Homo sapiens
gcacgaacaugcaguuauu

SEQ ID NO: 866353 - RNA, 19 nt, Homo sapiens
gcaguacaaugauuaguaa

SEQ ID NO: 866354 - RNA, 19 nt, Homo sapiens
ugacuuagcuauagcagua

SEQ ID NO: 866355 - RNA, 19 nt, Homo sapiens
aaacacagauaccacuuua

SEQ ID NO: 866356 - RNA, 19 nt, Homo sapiens
gcagugagguuuguucuuu

SEQ ID NO: 866357 - RNA, 19 nt, Homo sapiens
caaggaagaugcacuauuc

SEQ ID NO: 866358 - RNA, 19 nt, Homo sapiens
gagcauaguuuaacaucuu

SEQ ID NO: 866359 - RNA, 19 nt, Homo sapiens
gaaauagcauauagugaug

SEQ ID NO: 866360 - RNA, 19 nt, Homo sapiens
ggaguuguauuuaguguga

SEQ ID NO: 866361 - RNA, 19 nt, Homo sapiens
gcucaaaggaguuguauuu

SEQ ID NO: 866362 - RNA, 19 nt, Homo sapiens
gaaagagcauaguuuaaca

SEQ ID NO: 866363 - RNA, 19 nt, Homo sapiens
caaauucucugcauauauc

SEQ ID NO: 866364 - RNA, 19 nt, Homo sapiens
ggaaguuagucaaaugaaa

SEQ ID NO: 866365 - RNA, 19 nt, Homo sapiens
ggagauaccuaacuaaugc

SEQ ID NO: 866366 - RNA, 19 nt, Homo sapiens
guagacaguucaugcagua

SEQ ID NO: 866367 - RNA, 19 nt, Homo sapiens
ucaccaauuucuugcauua

SEQ ID NO: 866368 - RNA, 19 nt, Homo sapiens
gcauguagauagcauuuau

SEQ ID NO: 866369 - RNA, 19 nt, Homo sapiens
caaaugaaauggaaauugg

SEQ ID NO: 866370 - RNA, 19 nt, Homo sapiens
caaaggaguuguauuuagu

SEQ ID NO: 866371 - RNA, 19 nt, Homo sapiens
gaacaucagcaccaguaua

SEQ ID NO: 866372 - RNA, 19 nt, Homo sapiens
cugauacucugucuaaaua

SEQ ID NO: 866373 - RNA, 19 nt, Homo sapiens
gaaacuggaugaauaucug

SEQ ID NO: 866374 - RNA, 19 nt, Homo sapiens
gacaaaagcuagcuaguaa

SEQ ID NO: 866375 - RNA, 19 nt, Homo sapiens
aaaccagacuuucuacgua

SEQ ID NO: 866376 - RNA, 19 nt, Homo sapiens
gaauagcacucugcauguu

SEQ ID NO: 866377 - RNA, 19 nt, Homo sapiens
ggauauguacuaacgaaua

SEQ ID NO: 866378 - RNA, 19 nt, Homo sapiens
aagaugcacuauucaguua

SEQ ID NO: 866379 - RNA, 19 nt, Homo sapiens
gaagaugcacuauucaguu

SEQ ID NO: 866380 - RNA, 19 nt, Homo sapiens
gagcaacacuacauaacug

SEQ ID NO: 866381 - RNA, 19 nt, Homo sapiens
ggauagacaagguauagua

SEQ ID NO: 866382 - RNA, 19 nt, Homo sapiens
cuaaauggaucaacucuag

SEQ ID NO: 866383 - RNA, 19 nt, Homo sapiens
ccaaaagacucaccaagua

SEQ ID NO: 866384 - RNA, 19 nt, Homo sapiens
ugcagaaacuggaugaaua

SEQ ID NO: 866385 - RNA, 19 nt, Homo sapiens
ugauguagaugcagauauu

SEQ ID NO: 866386 - RNA, 19 nt, Homo sapiens
uaauguagaugaccuaaag

SEQ ID NO: 866387 - RNA, 19 nt, Homo sapiens
gcagauauucuauacaguu

SEQ ID NO: 866388 - RNA, 19 nt, Homo sapiens
gaaaggauugcuacuguau

SEQ ID NO: 866389 - RNA, 19 nt, Homo sapiens
ucaaaggaguuguauuuag

SEQ ID NO: 866390 - RNA, 19 nt, Homo sapiens
guuaacuucuguuguguuu

SEQ ID NO: 866391 - RNA, 19 nt, Homo sapiens
uggaucaacucuaggauuu

SEQ ID NO: 866392 - RNA, 19 nt, Homo sapiens
ggccaucccucuaaauguu

SEQ ID NO: 866393 - RNA, 19 nt, Homo sapiens
cauaaugcaugguacaaga

SEQ ID NO: 866394 - RNA, 19 nt, Homo sapiens
ccacaaacuuuucacuuua

SEQ ID NO: 866395 - RNA, 19 nt, Homo sapiens
gaucaaggauagacaaggu

SEQ ID NO: 866396 - RNA, 19 nt, Homo sapiens
gaaacacagauaccacuuu

SEQ ID NO: 866397 - RNA, 19 nt, Homo sapiens
gcagaaacuggaugaauau

SEQ ID NO: 866398 - RNA, 19 nt, Homo sapiens
cugcauauaucaagaauuc

SEQ ID NO: 866399 - RNA, 19 nt, Homo sapiens
acaggcaaaugaaagcuua

SEQ ID NO: 866400 - RNA, 19 nt, Homo sapiens
ugagaaauuugggacauaa

SEQ ID NO: 866401 - RNA, 19 nt, Homo sapiens
cauguuaacuucuguugug

SEQ ID NO: 866402 - RNA, 19 nt, Homo sapiens
gaucaacucuaggauuuag

SEQ ID NO: 866403 - RNA, 19 nt, Homo sapiens
guagaugaccuaaagaaug

SEQ ID NO: 866404 - RNA, 19 nt, Homo sapiens
ugaaaggauugcuacugua

SEQ ID NO: 866405 - RNA, 19 nt, Homo sapiens
gccaaauucucugcauaua

SEQ ID NO: 866406 - RNA, 19 nt, Homo sapiens
ugagcaaucuguauacaau

SEQ ID NO: 866407 - RNA, 19 nt, Homo sapiens
guggaaagagcauaguuua

SEQ ID NO: 866408 - RNA, 19 nt, Homo sapiens
ggaagugcuauuucucaua

SEQ ID NO: 866409 - RNA, 19 nt, Homo sapiens
uauagaggauuguucauuc

SEQ ID NO: 866410 - RNA, 19 nt, Homo sapiens
gaacaugcaguuauugaag

SEQ ID NO: 866411 - RNA, 19 nt, Homo sapiens
ggaaagagcauaguuuaac

SEQ ID NO: 866412 - RNA, 19 nt, Homo sapiens
aaccuugccucauagcuua

SEQ ID NO: 866413 - RNA, 19 nt, Homo sapiens
ccauuuaccuuguauagag

SEQ ID NO: 866414 - RNA, 19 nt, Homo sapiens
ccauucauuuggaacuuua

SEQ ID NO: 866415 - RNA, 19 nt, Homo sapiens
acuuaaagcuuucaccaaa

SEQ ID NO: 866416 - RNA, 19 nt, Homo sapiens
uggcagcuauuguauuaaa

SEQ ID NO: 866417 - RNA, 19 nt, Homo sapiens
gacaguucaugcaguauau

SEQ ID NO: 866418 - RNA, 19 nt, Homo sapiens
gcacuauucaguuaucuau

SEQ ID NO: 866419 - RNA, 19 nt, Homo sapiens
gacaagguauaguaguuau

SEQ ID NO: 866420 - RNA, 19 nt, Homo sapiens
acacagaaauuaaccuaag

SEQ ID NO: 866421 - RNA, 19 nt, Homo sapiens
uagacaagguauaguaguu

SEQ ID NO: 866422 - RNA, 19 nt, Homo sapiens
ugauaaggagguugaaaua

SEQ ID NO: 866423 - RNA, 19 nt, Homo sapiens
caucagcaccaguauauug

SEQ ID NO: 866424 - RNA, 19 nt, Homo sapiens
uacuaggacuguaaacuuu

SEQ ID NO: 866425 - RNA, 19 nt, Homo sapiens
gaaccuugccucauagcuu

SEQ ID NO: 866426 - RNA, 19 nt, Homo sapiens
ggaacuuuauugcauucuu

SEQ ID NO: 866427 - RNA, 19 nt, Homo sapiens
ggcaaaugaaagcuuauua

SEQ ID NO: 866428 - RNA, 19 nt, Homo sapiens
aaagcucucuauucuaguu

SEQ ID NO: 866429 - RNA, 19 nt, Homo sapiens
ucucauaggcuguuucuug

SEQ ID NO: 866430 - RNA, 19 nt, Homo sapiens
agacugugauugugacuau

SEQ ID NO: 866431 - RNA, 19 nt, Homo sapiens
ccaaagacugugauuguga

SEQ ID NO: 866432 - RNA, 19 nt, Homo sapiens
ggaauagcacucugcaugu

SEQ ID NO: 866433 - RNA, 19 nt, Homo sapiens
ugccugaucucacucauug

SEQ ID NO: 866434 - RNA, 19 nt, Homo sapiens
uauggugaguguguauuua

SEQ ID NO: 866435 - RNA, 19 nt, Homo sapiens
caacacuacauaacugauu

SEQ ID NO: 866436 - RNA, 19 nt, Homo sapiens
agaccuuccucaagcauuu

SEQ ID NO: 866437 - RNA, 19 nt, Homo sapiens
ggauggcaaugaaaugaca

SEQ ID NO: 866438 - RNA, 19 nt, Homo sapiens
cccaaguacuuaaagcuuu

SEQ ID NO: 866439 - RNA, 19 nt, Homo sapiens
cagggaaguuagucaaaug

SEQ ID NO: 866440 - RNA, 19 nt, Homo sapiens
uaacaagaggaaagaacua

SEQ ID NO: 866441 - RNA, 19 nt, Homo sapiens
ccuaaaccaggaauuauuu

SEQ ID NO: 866442 - RNA, 19 nt, Homo sapiens
caucugacaccauguagaa

SEQ ID NO: 866443 - RNA, 19 nt, Homo sapiens
gcuacuguaucagaaauau

SEQ ID NO: 866444 - RNA, 19 nt, Homo sapiens
caggagcccucaccauugu

SEQ ID NO: 866445 - RNA, 19 nt, Homo sapiens
cuccuaagcaguauuauuu

SEQ ID NO: 866446 - RNA, 19 nt, Homo sapiens
ggaaaugcuugcccuaaua

SEQ ID NO: 866447 - RNA, 19 nt, Homo sapiens
gaauagcucuucuacugua

SEQ ID NO: 866448 - RNA, 19 nt, Homo sapiens
ggacacggcuggcugcuuu

SEQ ID NO: 866449 - RNA, 19 nt, Homo sapiens
gaaaagacuuguugguuua

SEQ ID NO: 866450 - RNA, 19 nt, Homo sapiens
gaucuugacucuucauuug

SEQ ID NO: 866451 - RNA, 19 nt, Homo sapiens
uauaggaucugucugcuaa

SEQ ID NO: 866452 - RNA, 19 nt, Homo sapiens
ggaaagccuuggccaaaga

SEQ ID NO: 866453 - RNA, 19 nt, Homo sapiens
caagaacaauuccucauuc

SEQ ID NO: 866454 - RNA, 19 nt, Homo sapiens
gaaaugcuugcccuaauaa

SEQ ID NO: 866455 - RNA, 19 nt, Homo sapiens
cccaagagguucucacuuu

SEQ ID NO: 866456 - RNA, 19 nt, Homo sapiens
ucuaugaacuggccacuuu

SEQ ID NO: 866457 - RNA, 19 nt, Homo sapiens
ggacagcucacucugaauu

SEQ ID NO: 866458 - RNA, 19 nt, Homo sapiens
gaacaauuccucauuccaa

SEQ ID NO: 866459 - RNA, 19 nt, Homo sapiens
gugcugaaaugucuuuauu

SEQ ID NO: 866460 - RNA, 19 nt, Homo sapiens
cagaaugaauacaguguuu

SEQ ID NO: 866461 - RNA, 19 nt, Homo sapiens
ugacaacucuuugcuuuau

SEQ ID NO: 866462 - RNA, 19 nt, Homo sapiens
gcaagaacaauuccucauu

SEQ ID NO: 866463 - RNA, 19 nt, Homo sapiens
gcuguuagguccugguauu

SEQ ID NO: 866464 - RNA, 19 nt, Homo sapiens
caucugugcuuuguaagua

SEQ ID NO: 866465 - RNA, 19 nt, Homo sapiens
caaagauacuugagacauc

SEQ ID NO: 866466 - RNA, 19 nt, Homo sapiens
ggaaugagagugcagauag

SEQ ID NO: 866467 - RNA, 19 nt, Homo sapiens
guacggagcacucaacaga

SEQ ID NO: 866468 - RNA, 19 nt, Homo sapiens
gaauuuggaggcagaauga

SEQ ID NO: 866469 - RNA, 19 nt, Homo sapiens
auacuggaguguagaauuu

SEQ ID NO: 866470 - RNA, 19 nt, Homo sapiens
cagugucugucauacauua

SEQ ID NO: 866471 - RNA, 19 nt, Homo sapiens
cuuaagcccucaaagauga

SEQ ID NO: 866472 - RNA, 19 nt, Homo sapiens
ucugacaacucuuugcuuu

SEQ ID NO: 866473 - RNA, 19 nt, Homo sapiens
uaaauucucccaagagguu

SEQ ID NO: 866474 - RNA, 19 nt, Homo sapiens
caaauuuggcucucauuga

SEQ ID NO: 866475 - RNA, 19 nt, Homo sapiens
gauaaggaauggcaagaac

SEQ ID NO: 866476 - RNA, 19 nt, Homo sapiens
guuagguccugguauuaaa

SEQ ID NO: 866477 - RNA, 19 nt, Homo sapiens
gacaacucuuugcuuuaua

SEQ ID NO: 866478 - RNA, 19 nt, Homo sapiens
gaaugagagugcagauagu

SEQ ID NO: 866479 - RNA, 19 nt, Homo sapiens
ggagacauaagucccauga

SEQ ID NO: 866480 - RNA, 19 nt, Homo sapiens
aaauuuggcucucauugau

SEQ ID NO: 866481 - RNA, 19 nt, Homo sapiens
aaacaagagagugagauua

SEQ ID NO: 866482 - RNA, 19 nt, Homo sapiens
cagacaauacgauggaaua

SEQ ID NO: 866483 - RNA, 19 nt, Homo sapiens
gguaccauggugcaaauua

SEQ ID NO: 866484 - RNA, 19 nt, Homo sapiens
agaaaagacuuguugguuu

SEQ ID NO: 866485 - RNA, 19 nt, Homo sapiens
cauuucggauccuguuuaa

SEQ ID NO: 866486 - RNA, 19 nt, Homo sapiens
gcuaauggugcuuaaauuc

SEQ ID NO: 866487 - RNA, 19 nt, Homo sapiens
guaccauggugcaaauuag

SEQ ID NO: 866488 - RNA, 19 nt, Homo sapiens
ggaaagugucaacuaccua

SEQ ID NO: 866489 - RNA, 19 nt, Homo sapiens
gauacuggaguguagaauu

SEQ ID NO: 866490 - RNA, 19 nt, Homo sapiens
uaucaaccuuuccaucaug

SEQ ID NO: 866491 - RNA, 19 nt, Homo sapiens
ccuaguaucucagcagaau

SEQ ID NO: 866492 - RNA, 19 nt, Homo sapiens
ccaugaggaucccagaguu

SEQ ID NO: 866493 - RNA, 19 nt, Homo sapiens
uaaacaagagagugagauu

SEQ ID NO: 866494 - RNA, 19 nt, Homo sapiens
ucacuuacuuggaaaauga

SEQ ID NO: 866495 - RNA, 19 nt, Homo sapiens
guucuuugguggaaugaga

SEQ ID NO: 866496 - RNA, 19 nt, Homo sapiens
ggccaaagauaaggaaugg

SEQ ID NO: 866497 - RNA, 19 nt, Homo sapiens
acucugaauugguuggaua

SEQ ID NO: 866498 - RNA, 19 nt, Homo sapiens
cuugagacauccauuuguu

SEQ ID NO: 866499 - RNA, 19 nt, Homo sapiens
caagagagugagauuacuu

SEQ ID NO: 866500 - RNA, 19 nt, Homo sapiens
ucggacagcucacucugaa

SEQ ID NO: 866501 - RNA, 19 nt, Homo sapiens
ugaaaucuguauggauaug

SEQ ID NO: 866502 - RNA, 19 nt, Homo sapiens
uucauuaacugcuauagga

SEQ ID NO: 866503 - RNA, 19 nt, Homo sapiens
aacaauuccucauuccaaa

SEQ ID NO: 866504 - RNA, 19 nt, Homo sapiens
ucagaggagucucagaaag

SEQ ID NO: 866505 - RNA, 19 nt, Homo sapiens
uggaaaugcuugcccuaau

SEQ ID NO: 866506 - RNA, 19 nt, Homo sapiens
gauaaacaagagagugaga

SEQ ID NO: 866507 - RNA, 19 nt, Homo sapiens
gcagaaugaauacaguguu

SEQ ID NO: 866508 - RNA, 19 nt, Homo sapiens
acgauggaauauucuauga

SEQ ID NO: 866509 - RNA, 19 nt, Homo sapiens
gaaaaccacauugucauuu

SEQ ID NO: 866510 - RNA, 19 nt, Homo sapiens
aagagagugagauuacuua

SEQ ID NO: 866511 - RNA, 19 nt, Homo sapiens
uaaggaauggcaagaacaa

SEQ ID NO: 866512 - RNA, 19 nt, Homo sapiens
aaaccacauugucauuugu

SEQ ID NO: 866513 - RNA, 19 nt, Homo sapiens
cuacgggacccagacaaua

SEQ ID NO: 866514 - RNA, 19 nt, Homo sapiens
gaauuucguucuuauuacc

SEQ ID NO: 866515 - RNA, 19 nt, Homo sapiens
ggaucugucugcuaauggu

SEQ ID NO: 866516 - RNA, 19 nt, Homo sapiens
acaacucuuugcuuuauag

SEQ ID NO: 866517 - RNA, 19 nt, Homo sapiens
uaacugcuauaggaucugu

SEQ ID NO: 866518 - RNA, 19 nt, Homo sapiens
gaggcagaaugaauacagu

SEQ ID NO: 866519 - RNA, 19 nt, Homo sapiens
ucauuucggauccuguuua

SEQ ID NO: 866520 - RNA, 19 nt, Homo sapiens
ugguuuaugugcugaaaug

SEQ ID NO: 866521 - RNA, 19 nt, Homo sapiens
ugcuauguuucuugcauua

SEQ ID NO: 866522 - RNA, 19 nt, Homo sapiens
caagagguucucacuuuua

SEQ ID NO: 866523 - RNA, 19 nt, Homo sapiens
ccaagagguucucacuuuu

SEQ ID NO: 866524 - RNA, 19 nt, Homo sapiens
uaauggugcuuaaauucuc

SEQ ID NO: 866525 - RNA, 19 nt, Homo sapiens
gggaaagugucaacuaccu

SEQ ID NO: 866526 - RNA, 19 nt, Homo sapiens
caaaagaaggagucuauga

SEQ ID NO: 866527 - RNA, 19 nt, Homo sapiens
cuauguuucuugcauuaug

SEQ ID NO: 866528 - RNA, 19 nt, Homo sapiens
gagguucucacuuuuauuu

SEQ ID NO: 866529 - RNA, 19 nt, Homo sapiens
uaggaucugucugcuaaug

SEQ ID NO: 866530 - RNA, 19 nt, Homo sapiens
ucugauuccuacaucguuu

SEQ ID NO: 866531 - RNA, 19 nt, Homo sapiens
gaacuggccacuuuucaga

SEQ ID NO: 866532 - RNA, 19 nt, Homo sapiens
agaggagucucagaaagga

SEQ ID NO: 866533 - RNA, 19 nt, Homo sapiens
guauggauauggaaaugcu

SEQ ID NO: 866534 - RNA, 19 nt, Homo sapiens
ggaaaaugaugcuguuagg

SEQ ID NO: 866535 - RNA, 19 nt, Homo sapiens
ggaaaaccacauugucauu

SEQ ID NO: 866536 - RNA, 19 nt, Homo sapiens
ucuugacucuucauuuguu

SEQ ID NO: 866537 - RNA, 19 nt, Homo sapiens
cauguucuuugguggaaug

SEQ ID NO: 866538 - RNA, 19 nt, Homo sapiens
gagagugagauuacuuauc

SEQ ID NO: 866539 - RNA, 19 nt, Homo sapiens
guuggauacuggaguguag

SEQ ID NO: 866540 - RNA, 19 nt, Homo sapiens
uaccuuaagcccucaaaga

SEQ ID NO: 866541 - RNA, 19 nt, Homo sapiens
uagcucuucuacuguauuc

SEQ ID NO: 866542 - RNA, 19 nt, Homo sapiens
uaguaucucagcagaauau

SEQ ID NO: 866543 - RNA, 19 nt, Homo sapiens
agaaggagucuaugaacug

SEQ ID NO: 866544 - RNA, 19 nt, Homo sapiens
auuuggcucucauugauaa

SEQ ID NO: 866545 - RNA, 19 nt, Homo sapiens
ugcuaauggugcuuaaauu

SEQ ID NO: 866546 - RNA, 19 nt, Homo sapiens
agagagagcuguauaauga

SEQ ID NO: 866547 - RNA, 19 nt, Homo sapiens
gcaggaagcuucagauaau

SEQ ID NO: 866548 - RNA, 19 nt, Homo sapiens
caugagcucuuucuguuua

SEQ ID NO: 866549 - RNA, 19 nt, Homo sapiens
gaaagauccuggaaugugu

SEQ ID NO: 866550 - RNA, 19 nt, Homo sapiens
gagaauaucagcauuaaug

SEQ ID NO: 866551 - RNA, 19 nt, Homo sapiens
caagagaauaucagcauua

SEQ ID NO: 866552 - RNA, 19 nt, Homo sapiens
gaaaaccucugacguggua

SEQ ID NO: 866553 - RNA, 19 nt, Homo sapiens
gcaagagaauaucagcauu

SEQ ID NO: 866554 - RNA, 19 nt, Homo sapiens
uacaugagcucuuucuguu

SEQ ID NO: 866555 - RNA, 19 nt, Homo sapiens
guccuugccugcauuaauu

SEQ ID NO: 866556 - RNA, 19 nt, Homo sapiens
aaagugucauugugguuua

SEQ ID NO: 866557 - RNA, 19 nt, Homo sapiens
caaauuaaugugcugauga

SEQ ID NO: 866558 - RNA, 19 nt, Homo sapiens
gaaaccagaugcuaaaccu

SEQ ID NO: 866559 - RNA, 19 nt, Homo sapiens
ccagaggauucaccaagaa

SEQ ID NO: 866560 - RNA, 19 nt, Homo sapiens
gggaaacaguagcaaagga

SEQ ID NO: 866561 - RNA, 19 nt, Homo sapiens
gcaguggacuuuugaauca

SEQ ID NO: 866562 - RNA, 19 nt, Homo sapiens
gagagagagcuguauaaug

SEQ ID NO: 866563 - RNA, 19 nt, Homo sapiens
uaagugccaucaacucuca

SEQ ID NO: 866564 - RNA, 19 nt, Homo sapiens
gaaaccacaccaacagaga

SEQ ID NO: 866565 - RNA, 19 nt, Homo sapiens
gcaguaccacccuguugua

SEQ ID NO: 866566 - RNA, 19 nt, Homo sapiens
uaggcaccaucaacauuua

SEQ ID NO: 866567 - RNA, 19 nt, Homo sapiens
ccuggaaugugucaucaaa

SEQ ID NO: 866568 - RNA, 19 nt, Homo sapiens
aaagagagagagcuguaua

SEQ ID NO: 866569 - RNA, 19 nt, Homo sapiens
gaaguccuugccugcauua

SEQ ID NO: 866570 - RNA, 19 nt, Homo sapiens
uagcaaaggagaucaguga

SEQ ID NO: 866571 - RNA, 19 nt, Homo sapiens
gagaugcgcaguggacuuu

SEQ ID NO: 866572 - RNA, 19 nt, Homo sapiens
uuacaaaucauuccaguuc

SEQ ID NO: 866573 - RNA, 19 nt, Homo sapiens
agagagcuguauaaugauu

SEQ ID NO: 866574 - RNA, 19 nt, Homo sapiens
gauagaaaccacaccaaca

SEQ ID NO: 866575 - RNA, 19 nt, Homo sapiens
ggcaggaagcuucagauaa

SEQ ID NO: 866576 - RNA, 19 nt, Homo sapiens
caaaguacuugaagaucag

SEQ ID NO: 866577 - RNA, 19 nt, Homo sapiens
gcaacauuacucuuugaaa

SEQ ID NO: 866578 - RNA, 19 nt, Homo sapiens
uauggauucugacaucaaa

SEQ ID NO: 866579 - RNA, 19 nt, Homo sapiens
uaguagauauagccacaaa

SEQ ID NO: 866580 - RNA, 19 nt, Homo sapiens
aaucagcugugcaagagaa

SEQ ID NO: 866581 - RNA, 19 nt, Homo sapiens
ugaaucagcugugcaagag

SEQ ID NO: 866582 - RNA, 19 nt, Homo sapiens
acaaaucauuccaguucaa

SEQ ID NO: 866583 - RNA, 19 nt, Homo sapiens
gugcaacauuacucuuuga

SEQ ID NO: 866584 - RNA, 19 nt, Homo sapiens
caaauucuguuguguuucc

SEQ ID NO: 866585 - RNA, 19 nt, Homo sapiens
gugaagccaugaaguccuu

SEQ ID NO: 866586 - RNA, 19 nt, Homo sapiens
cuagauaagacuucauuug

SEQ ID NO: 866587 - RNA, 19 nt, Homo sapiens
cuugauacaugagcucuuu

SEQ ID NO: 866588 - RNA, 19 nt, Homo sapiens
guaagcaguaucccagaaa

SEQ ID NO: 866589 - RNA, 19 nt, Homo sapiens
ccacaaaacguaagcagua

SEQ ID NO: 866590 - RNA, 19 nt, Homo sapiens
ccugagaacuuuauaacac

SEQ ID NO: 866591 - RNA, 19 nt, Homo sapiens
gcaaaggagaucagugaag

SEQ ID NO: 866592 - RNA, 19 nt, Homo sapiens
caggaagcuucagauaauu

SEQ ID NO: 866593 - RNA, 19 nt, Homo sapiens
ucaaauuaaugugcugaug

SEQ ID NO: 866594 - RNA, 19 nt, Homo sapiens
ugaaguccuugccugcauu

SEQ ID NO: 866595 - RNA, 19 nt, Homo sapiens
uggaacuaaugguuucuuu

SEQ ID NO: 866596 - RNA, 19 nt, Homo sapiens
guuacuccauguucagcua

SEQ ID NO: 866597 - RNA, 19 nt, Homo sapiens
acucucagcucccuuguag

SEQ ID NO: 866598 - RNA, 19 nt, Homo sapiens
gagcucuuucuguuuauuu

SEQ ID NO: 866599 - RNA, 19 nt, Homo sapiens
ccucugacgugguacugaa

SEQ ID NO: 866600 - RNA, 19 nt, Homo sapiens
ucauugugguuuauuggaa

SEQ ID NO: 866601 - RNA, 19 nt, Homo sapiens
caaaucauuccaguucaaa

SEQ ID NO: 866602 - RNA, 19 nt, Homo sapiens
uaggaaaccagaugcuaaa

SEQ ID NO: 866603 - RNA, 19 nt, Homo sapiens
uaauacuggcuuugacuuu

SEQ ID NO: 866604 - RNA, 19 nt, Homo sapiens
ugugggauuuaacaaguaa

SEQ ID NO: 866605 - RNA, 19 nt, Homo sapiens
ugcuaaaccugagaacuuu

SEQ ID NO: 866606 - RNA, 19 nt, Homo sapiens
cguaagcaguaucccagaa

SEQ ID NO: 866607 - RNA, 19 nt, Homo sapiens
ugacuuggaacuaaugguu

SEQ ID NO: 866608 - RNA, 19 nt, Homo sapiens
ccaucaacauuuagauuac

SEQ ID NO: 866609 - RNA, 19 nt, Homo sapiens
aauacuggcuuugacuuug

SEQ ID NO: 866610 - RNA, 19 nt, Homo sapiens
agaaagauccuggaaugug

SEQ ID NO: 866611 - RNA, 19 nt, Homo sapiens
ggauucugacaucaaagua

SEQ ID NO: 866612 - RNA, 19 nt, Homo sapiens
ggaagcuucagauaauugu

SEQ ID NO: 866613 - RNA, 19 nt, Homo sapiens
gagagcuguauaaugauuu

SEQ ID NO: 866614 - RNA, 19 nt, Homo sapiens
gaaaauaggcaccaucaac

SEQ ID NO: 866615 - RNA, 19 nt, Homo sapiens
ugaccgaaaugcuacaacu

SEQ ID NO: 866616 - RNA, 19 nt, Homo sapiens
ugaacaaggagagggauuu

SEQ ID NO: 866617 - RNA, 19 nt, Homo sapiens
ugcauuaauugaacaagga

SEQ ID NO: 866618 - RNA, 19 nt, Homo sapiens
gaagcaguaccacccuguu

SEQ ID NO: 866619 - RNA, 19 nt, Homo sapiens
uaagcaguaucccagaaag

SEQ ID NO: 866620 - RNA, 19 nt, Homo sapiens
aagagagagagcuguauaa

SEQ ID NO: 866621 - RNA, 19 nt, Homo sapiens
uccagaggauucaccaaga

SEQ ID NO: 866622 - RNA, 19 nt, Homo sapiens
gauauagccacaaaacgua

SEQ ID NO: 866623 - RNA, 19 nt, Homo sapiens
ugacuuuguuacuccaugu

SEQ ID NO: 866624 - RNA, 19 nt, Homo sapiens
gauaauacuggcuuugacu

SEQ ID NO: 866625 - RNA, 19 nt, Homo sapiens
caccaucaacauuuagauu

SEQ ID NO: 866626 - RNA, 19 nt, Homo sapiens
auaggaaaccagaugcuaa

SEQ ID NO: 866627 - RNA, 19 nt, Homo sapiens
cauaggaaaccagaugcua

SEQ ID NO: 866628 - RNA, 19 nt, Homo sapiens
gaacaaggagagggauuuu

SEQ ID NO: 866629 - RNA, 19 nt, Homo sapiens
ugugcaacauuacucuuug

SEQ ID NO: 866630 - RNA, 19 nt, Homo sapiens
cugagaacuuuauaacaca

SEQ ID NO: 866631 - RNA, 19 nt, Homo sapiens
uggcaggaagcuucagaua

SEQ ID NO: 866632 - RNA, 19 nt, Homo sapiens
guacuugaagaucaguuug

SEQ ID NO: 866633 - RNA, 19 nt, Homo sapiens
gcauguagccaauguuucc

SEQ ID NO: 866634 - RNA, 19 nt, Homo sapiens
cagcugugcaagagaauau

SEQ ID NO: 866635 - RNA, 19 nt, Homo sapiens
agcagcagaugcaggguuu

SEQ ID NO: 866636 - RNA, 19 nt, Homo sapiens
gaucagugaagccaugaag

SEQ ID NO: 866637 - RNA, 19 nt, Homo sapiens
gacuuggaacuaaugguuu

SEQ ID NO: 866638 - RNA, 19 nt, Homo sapiens
guguuucccugguauacau

SEQ ID NO: 866639 - RNA, 19 nt, Homo sapiens
aauaggcaccaucaacauu

SEQ ID NO: 866640 - RNA, 19 nt, Homo sapiens
uacaaaucauuccaguuca

SEQ ID NO: 866641 - RNA, 19 nt, Homo sapiens
gaugauaauacuggcuuug

SEQ ID NO: 866642 - RNA, 19 nt, Homo sapiens
auaggcaccaucaacauuu

SEQ ID NO: 866643 - RNA, 19 nt, Homo sapiens
gcaguaucccagaaagauc

SEQ ID NO: 866644 - RNA, 19 nt, Homo sapiens
auacuggcuuugacuuugu

SEQ ID NO: 866645 - RNA, 19 nt, Homo sapiens
ugaugauaauacuggcuuu

SEQ ID NO: 866646 - RNA, 19 nt, Homo sapiens
gaacaaacguugacuuagg

SEQ ID NO: 866647 - RNA, 19 nt, Homo sapiens
ugagauccaucacuaauaa

SEQ ID NO: 866648 - RNA, 19 nt, Homo sapiens
gacaugagauccaucacua

SEQ ID NO: 866649 - RNA, 19 nt, Homo sapiens
ccaaugcgcugaccacuca

SEQ ID NO: 866650 - RNA, 19 nt, Homo sapiens
ccgcagggcucaugaguau

SEQ ID NO: 866651 - RNA, 19 nt, Homo sapiens
ucacuaccauuguaacuug

SEQ ID NO: 866652 - RNA, 19 nt, Homo sapiens
ggacaaacacccaugaaca

SEQ ID NO: 866653 - RNA, 19 nt, Homo sapiens
gcccagcacuagcgccuua

SEQ ID NO: 866654 - RNA, 19 nt, Homo sapiens
uguaaucacuaccauugua

SEQ ID NO: 866655 - RNA, 19 nt, Homo sapiens
aauaauagcucagauccuu

SEQ ID NO: 866656 - RNA, 19 nt, Homo sapiens
ggauguagccaugaccuua

SEQ ID NO: 866657 - RNA, 19 nt, Homo sapiens
ggauugauuaugcagaaua

SEQ ID NO: 866658 - RNA, 19 nt, Homo sapiens
ugagauggauacaggagaa

SEQ ID NO: 866659 - RNA, 19 nt, Homo sapiens
gacagauuauacagaauug

SEQ ID NO: 866660 - RNA, 19 nt, Homo sapiens
uaaccuggcuguaaucacu

SEQ ID NO: 866661 - RNA, 19 nt, Homo sapiens
caggauugauuaugcagaa

SEQ ID NO: 866662 - RNA, 19 nt, Homo sapiens
ugugacagauuauacagaa

SEQ ID NO: 866663 - RNA, 19 nt, Homo sapiens
gcucagauccuuuccucaa

SEQ ID NO: 866664 - RNA, 19 nt, Homo sapiens
gcuguaaucacuaccauug

SEQ ID NO: 866665 - RNA, 19 nt, Homo sapiens
aaacacccaugaacaucaa

SEQ ID NO: 866666 - RNA, 19 nt, Homo sapiens
agccaaaucucgugaugaa

SEQ ID NO: 866667 - RNA, 19 nt, Homo sapiens
gaccugauuuacaguuuca

SEQ ID NO: 866668 - RNA, 19 nt, Homo sapiens
guaaucacuaccauuguaa

SEQ ID NO: 866669 - RNA, 19 nt, Homo sapiens
gaacuuuggaaucugaaga

SEQ ID NO: 866670 - RNA, 19 nt, Homo sapiens
guacuuccucaaucacaua

SEQ ID NO: 866671 - RNA, 19 nt, Homo sapiens
cacaggcaguuacuucuga

SEQ ID NO: 866672 - RNA, 19 nt, Homo sapiens
uaggaacuuuggaaucuga

SEQ ID NO: 866673 - RNA, 19 nt, Homo sapiens
aggaacaaacguugacuua

SEQ ID NO: 866674 - RNA, 19 nt, Homo sapiens
ccaaaucucgugaugaauc

SEQ ID NO: 866675 - RNA, 19 nt, Homo sapiens
gacaaacacccaugaacau

SEQ ID NO: 866676 - RNA, 19 nt, Homo sapiens
ccacaacuccggaggacuu

SEQ ID NO: 866677 - RNA, 19 nt, Homo sapiens
ucagauccuuuccucaaug

SEQ ID NO: 866678 - RNA, 19 nt, Homo sapiens
cuuuauggguguuaauuga

SEQ ID NO: 866679 - RNA, 19 nt, Homo sapiens
aaacugcggcuucagagaa

SEQ ID NO: 866680 - RNA, 19 nt, Homo sapiens
cuaggaaggcgaugaauca

SEQ ID NO: 866681 - RNA, 19 nt, Homo sapiens
gcguucuugugacagauua

SEQ ID NO: 866682 - RNA, 19 nt, Homo sapiens
gaacaucaauccccaacag

SEQ ID NO: 866683 - RNA, 19 nt, Homo sapiens
gcaggacaaacacccauga

SEQ ID NO: 866684 - RNA, 19 nt, Homo sapiens
cauggaagcugagacucuu

SEQ ID NO: 866685 - RNA, 19 nt, Homo sapiens
gaaacugcggcuucagaga

SEQ ID NO: 866686 - RNA, 19 nt, Homo sapiens
ccacuucccgccuccauga

SEQ ID NO: 866687 - RNA, 19 nt, Homo sapiens
caaacacccaugaacauca

SEQ ID NO: 866688 - RNA, 19 nt, Homo sapiens
gauugagaguaacuuaagu

SEQ ID NO: 866689 - RNA, 19 nt, Homo sapiens
gccaugaccuuacauuucc

SEQ ID NO: 866690 - RNA, 19 nt, Homo sapiens
cauuguaacuuggauguag

SEQ ID NO: 866691 - RNA, 19 nt, Homo sapiens
aacaaacguugacuuagga

SEQ ID NO: 866692 - RNA, 19 nt, Homo sapiens
guugccaguuuaaucauug

SEQ ID NO: 866693 - RNA, 19 nt, Homo sapiens
ugacuuaggaacuuuggaa

SEQ ID NO: 866694 - RNA, 19 nt, Homo sapiens
ggagggccauaucauucga

SEQ ID NO: 866695 - RNA, 19 nt, Homo sapiens
gagagaaaggauucgaaug

SEQ ID NO: 866696 - RNA, 19 nt, Homo sapiens
gagagagaaaggauucgaa

SEQ ID NO: 866697 - RNA, 19 nt, Homo sapiens
gcacaaaauucgaccugau

SEQ ID NO: 866698 - RNA, 19 nt, Homo sapiens
gcaucuugguccaggaaau

SEQ ID NO: 866699 - RNA, 19 nt, Homo sapiens
gaccacaggcaguuacuuc

SEQ ID NO: 866700 - RNA, 19 nt, Homo sapiens
gauugauuaugcagaauac

SEQ ID NO: 866701 - RNA, 19 nt, Homo sapiens
aauugugucugcaggauug

SEQ ID NO: 866702 - RNA, 19 nt, Homo sapiens
uuucuaaccuggcuguaau

SEQ ID NO: 866703 - RNA, 19 nt, Homo sapiens
gcucguggcggaagaagau

SEQ ID NO: 866704 - RNA, 19 nt, Homo sapiens
gaugacaguaguaccaaau

SEQ ID NO: 866705 - RNA, 19 nt, Homo sapiens
uuuaaucauugccugguuu

SEQ ID NO: 866706 - RNA, 19 nt, Homo sapiens
gccggagucuuucuuuaag

SEQ ID NO: 866707 - RNA, 19 nt, Homo sapiens
cgagggagcagagcacuga

SEQ ID NO: 866708 - RNA, 19 nt, Homo sapiens
ccagccaaaucucgugaug

SEQ ID NO: 866709 - RNA, 19 nt, Homo sapiens
aguaguaccaaaugcuuua

SEQ ID NO: 866710 - RNA, 19 nt, Homo sapiens
caggaaaugugcacaaaau

SEQ ID NO: 866711 - RNA, 19 nt, Homo sapiens
cuuaggaacuuuggaaucu

SEQ ID NO: 866712 - RNA, 19 nt, Homo sapiens
ggaacaaacguugacuuag

SEQ ID NO: 866713 - RNA, 19 nt, Homo sapiens
caauguggaugagauggau

SEQ ID NO: 866714 - RNA, 19 nt, Homo sapiens
gcaauguggaugagaugga

SEQ ID NO: 866715 - RNA, 19 nt, Homo sapiens
ucagcaauguggaugagau

SEQ ID NO: 866716 - RNA, 19 nt, Homo sapiens
cugccggagucuuucuuua

SEQ ID NO: 866717 - RNA, 19 nt, Homo sapiens
cgcaggaccuagacacaga

SEQ ID NO: 866718 - RNA, 19 nt, Homo sapiens
guaaaauucuacuguaugg

SEQ ID NO: 866719 - RNA, 19 nt, Homo sapiens
cgaccugauuuacaguuuc

SEQ ID NO: 866720 - RNA, 19 nt, Homo sapiens
gaauugugucugcaggauu

SEQ ID NO: 866721 - RNA, 19 nt, Homo sapiens
cggagucuuucuuuaagga

SEQ ID NO: 866722 - RNA, 19 nt, Homo sapiens
caugagauccaucacuaau

SEQ ID NO: 866723 - RNA, 19 nt, Homo sapiens
cagaaacugcggcuucaga

SEQ ID NO: 866724 - RNA, 19 nt, Homo sapiens
ggaaaugugcacaaaauuc

SEQ ID NO: 866725 - RNA, 19 nt, Homo sapiens
gacucgugcucccuccuuu

SEQ ID NO: 866726 - RNA, 19 nt, Homo sapiens
gauccaucacuaauaauag

SEQ ID NO: 866727 - RNA, 19 nt, Homo sapiens
cuuccucaaucacauagaa

SEQ ID NO: 866728 - RNA, 19 nt, Homo sapiens
gcagggcucaugaguaugc

SEQ ID NO: 866729 - RNA, 19 nt, Homo sapiens
uaagcuuuauggguguuaa

SEQ ID NO: 866730 - RNA, 19 nt, Homo sapiens
cagauuauacagaauugug

SEQ ID NO: 866731 - RNA, 19 nt, Homo sapiens
cagacccguuucccugauu

SEQ ID NO: 866732 - RNA, 19 nt, Homo sapiens
uaauagcucagauccuuuc

SEQ ID NO: 866733 - RNA, 19 nt, Homo sapiens
gcaguaucccagccaaauc

SEQ ID NO: 866734 - RNA, 19 nt, Homo sapiens
ugacaguaguaccaaaugc

SEQ ID NO: 866735 - RNA, 19 nt, Homo sapiens
ugccggagucuuucuuuaa

SEQ ID NO: 866736 - RNA, 19 nt, Homo sapiens
ugaugacaguaguaccaaa

SEQ ID NO: 866737 - RNA, 19 nt, Homo sapiens
uauguugccaguuuaauca

SEQ ID NO: 866738 - RNA, 19 nt, Homo sapiens
ggagaaaacgcaggacaaa

SEQ ID NO: 866739 - RNA, 19 nt, Homo sapiens
gguacuuccucaaucacau

SEQ ID NO: 866740 - RNA, 19 nt, Homo sapiens
gauggagagagaaaggauu

SEQ ID NO: 866741 - RNA, 19 nt, Homo sapiens
ucgaccugauuuacaguuu

SEQ ID NO: 866742 - RNA, 19 nt, Homo sapiens
uccaggaaaugugcacaaa

SEQ ID NO: 866743 - RNA, 19 nt, Homo sapiens
agacccguuucccugauuu

SEQ ID NO: 866744 - RNA, 19 nt, Homo sapiens
gcugggagaugaccuucac

SEQ ID NO: 866745 - RNA, 19 nt, Homo sapiens
ucacuaauaauagcucaga

SEQ ID NO: 866746 - RNA, 19 nt, Homo sapiens
gaacaaggcucaguuauga

SEQ ID NO: 866747 - RNA, 19 nt, Homo sapiens
caaagcaggugacuacaua

SEQ ID NO: 866748 - RNA, 19 nt, Homo sapiens
guaagaagguggacagaaa

SEQ ID NO: 866749 - RNA, 19 nt, Homo sapiens
cauguuagcuucuauugua

SEQ ID NO: 866750 - RNA, 19 nt, Homo sapiens
caacauggauuauggaaug

SEQ ID NO: 866751 - RNA, 19 nt, Homo sapiens
auacuaagcugacagauaa

SEQ ID NO: 866752 - RNA, 19 nt, Homo sapiens
gacaaugaguugcguauuu

SEQ ID NO: 866753 - RNA, 19 nt, Homo sapiens
gaaagacgcacgagagauu

SEQ ID NO: 866754 - RNA, 19 nt, Homo sapiens
gcaaauuaaugacaacuca

SEQ ID NO: 866755 - RNA, 19 nt, Homo sapiens
gcagauaagugaacgagau

SEQ ID NO: 866756 - RNA, 19 nt, Homo sapiens
gauuacaagcgcuuuauua

SEQ ID NO: 866757 - RNA, 19 nt, Homo sapiens
gaauuaagccugucaugga

SEQ ID NO: 866758 - RNA, 19 nt, Homo sapiens
ggaggugguuacuauguuu

SEQ ID NO: 866759 - RNA, 19 nt, Homo sapiens
ggaacaauauggucucauc

SEQ ID NO: 866760 - RNA, 19 nt, Homo sapiens
ugaaaucacaggcgcauua

SEQ ID NO: 866761 - RNA, 19 nt, Homo sapiens
uuuagaggcuucaaucaua

SEQ ID NO: 866762 - RNA, 19 nt, Homo sapiens
gaaauggacgcaugaacaa

SEQ ID NO: 866763 - RNA, 19 nt, Homo sapiens
gcaggugacuacauagaga

SEQ ID NO: 866764 - RNA, 19 nt, Homo sapiens
gcugggaggugguuacuau

SEQ ID NO: 866765 - RNA, 19 nt, Homo sapiens
caaauugaauaccguaauc

SEQ ID NO: 866766 - RNA, 19 nt, Homo sapiens
uacaagcgcuuuauuaagu

SEQ ID NO: 866767 - RNA, 19 nt, Homo sapiens
gcucaguuaugauguuuga

SEQ ID NO: 866768 - RNA, 19 nt, Homo sapiens
agcauuaccuugccuauuu

SEQ ID NO: 866769 - RNA, 19 nt, Homo sapiens
gaaugucuguagucaguug

SEQ ID NO: 866770 - RNA, 19 nt, Homo sapiens
ggacagaaagaguuuguau

SEQ ID NO: 866771 - RNA, 19 nt, Homo sapiens
gcagccaacaggacaaaua

SEQ ID NO: 866772 - RNA, 19 nt, Homo sapiens
ugaaucaccugucgaagau

SEQ ID NO: 866773 - RNA, 19 nt, Homo sapiens
ggaaaucuguaugacaugu

SEQ ID NO: 866774 - RNA, 19 nt, Homo sapiens
cgacaguacuucaguccaa

SEQ ID NO: 866775 - RNA, 19 nt, Homo sapiens
gcaggauggcgauguuaua

SEQ ID NO: 866776 - RNA, 19 nt, Homo sapiens
gcagcugauucgaguauau

SEQ ID NO: 866777 - RNA, 19 nt, Homo sapiens
ccaauaggcugccaauacu

SEQ ID NO: 866778 - RNA, 19 nt, Homo sapiens
ucagauugcuggacuuugu

SEQ ID NO: 866779 - RNA, 19 nt, Homo sapiens
cacaaucgauuugagcaua

SEQ ID NO: 866780 - RNA, 19 nt, Homo sapiens
gacaacucaugccuuaauu

SEQ ID NO: 866781 - RNA, 19 nt, Homo sapiens
gugaaugucuguagucagu

SEQ ID NO: 866782 - RNA, 19 nt, Homo sapiens
cauguuugauggacgauuu

SEQ ID NO: 866783 - RNA, 19 nt, Homo sapiens
cuacugaucccaaauugaa

SEQ ID NO: 866784 - RNA, 19 nt, Homo sapiens
ggaggacuaugaaucucuu

SEQ ID NO: 866785 - RNA, 19 nt, Homo sapiens
ugaaguagacaaugaguug

SEQ ID NO: 866786 - RNA, 19 nt, Homo sapiens
ugauacaccucaauuucaa

SEQ ID NO: 866787 - RNA, 19 nt, Homo sapiens
uaaggaaguuggaaaucug

SEQ ID NO: 866788 - RNA, 19 nt, Homo sapiens
acaaugaguugcguauuug

SEQ ID NO: 866789 - RNA, 19 nt, Homo sapiens
gaauccaauugaucauguu

SEQ ID NO: 866790 - RNA, 19 nt, Homo sapiens
caacaggacaaauaaagau

SEQ ID NO: 866791 - RNA, 19 nt, Homo sapiens
uacagaugcuuuccucaaa

SEQ ID NO: 866792 - RNA, 19 nt, Homo sapiens
aagcuuccuuuaugagaua

SEQ ID NO: 866793 - RNA, 19 nt, Homo sapiens
aaccagagcugcagauaag

SEQ ID NO: 866794 - RNA, 19 nt, Homo sapiens
uaaagaugacccaauguga

SEQ ID NO: 866795 - RNA, 19 nt, Homo sapiens
gugcuaaacccaaaguauu

SEQ ID NO: 866796 - RNA, 19 nt, Homo sapiens
gagauaaggaaguuggaaa

SEQ ID NO: 866797 - RNA, 19 nt, Homo sapiens
caagcgcuuuauuaaguuu

SEQ ID NO: 866798 - RNA, 19 nt, Homo sapiens
ucucaucccugaagaagau

SEQ ID NO: 866799 - RNA, 19 nt, Homo sapiens
caaccagagcugcagauaa

SEQ ID NO: 866800 - RNA, 19 nt, Homo sapiens
gggaggugguuacuauguu

SEQ ID NO: 866801 - RNA, 19 nt, Homo sapiens
uuaguuauauccagcgauu

SEQ ID NO: 866802 - RNA, 19 nt, Homo sapiens
gauuauggaaugcaagaaa

SEQ ID NO: 866803 - RNA, 19 nt, Homo sapiens
cguaaucuauucaaguaug

SEQ ID NO: 866804 - RNA, 19 nt, Homo sapiens
gaauggaacgacaguacuu

SEQ ID NO: 866805 - RNA, 19 nt, Homo sapiens
gaaacuggaggcugaagau

SEQ ID NO: 866806 - RNA, 19 nt, Homo sapiens
uauaaagggcguccugaaa

SEQ ID NO: 866807 - RNA, 19 nt, Homo sapiens
caaauuguaggaccacuug

SEQ ID NO: 866808 - RNA, 19 nt, Homo sapiens
gagcuucacacaaucgauu

SEQ ID NO: 866809 - RNA, 19 nt, Homo sapiens
uccaggagcuucacacaau

SEQ ID NO: 866810 - RNA, 19 nt, Homo sapiens
uauacuaagcugacagaua

SEQ ID NO: 866811 - RNA, 19 nt, Homo sapiens
gagcuuaucaacacaaagu

SEQ ID NO: 866812 - RNA, 19 nt, Homo sapiens
uugagcaccuuauuaauuc

SEQ ID NO: 866813 - RNA, 19 nt, Homo sapiens
caugaacaaggcucaguua

SEQ ID NO: 866814 - RNA, 19 nt, Homo sapiens
ggaacuccaucccgacuac

SEQ ID NO: 866815 - RNA, 19 nt, Homo sapiens
gcgcauuacugccuugucu

SEQ ID NO: 866816 - RNA, 19 nt, Homo sapiens
gaguuuguaugccgcaaga

SEQ ID NO: 866817 - RNA, 19 nt, Homo sapiens
gagcagcugauucgaguau

SEQ ID NO: 866818 - RNA, 19 nt, Homo sapiens
gccaauaggcugccaauac

SEQ ID NO: 866819 - RNA, 19 nt, Homo sapiens
accguaaucuauucaagua

SEQ ID NO: 866820 - RNA, 19 nt, Homo sapiens
gguaauuaaugauccuauc

SEQ ID NO: 866821 - RNA, 19 nt, Homo sapiens
aggcaaaucuuacuauacu

SEQ ID NO: 866822 - RNA, 19 nt, Homo sapiens
aaagaugacccaaugugaa

SEQ ID NO: 866823 - RNA, 19 nt, Homo sapiens
ucugugaaguagacaauga

SEQ ID NO: 866824 - RNA, 19 nt, Homo sapiens
gauucauuguggccauaua

SEQ ID NO: 866825 - RNA, 19 nt, Homo sapiens
gauaagugaacgagauguu

SEQ ID NO: 866826 - RNA, 19 nt, Homo sapiens
gacaguacuucaguccaaa

SEQ ID NO: 866827 - RNA, 19 nt, Homo sapiens
cagccaacaggacaaauaa

SEQ ID NO: 866828 - RNA, 19 nt, Homo sapiens
gauacaaugauuacagaug

SEQ ID NO: 866829 - RNA, 19 nt, Homo sapiens
ugaaauggacgcaugaaca

SEQ ID NO: 866830 - RNA, 19 nt, Homo sapiens
ugacaacucaugccuuaau

SEQ ID NO: 866831 - RNA, 19 nt, Homo sapiens
gaagguggacagaaagagu

SEQ ID NO: 866832 - RNA, 19 nt, Homo sapiens
caauugaucauguuagcuu

SEQ ID NO: 866833 - RNA, 19 nt, Homo sapiens
gaaaagaauccaauugauc

SEQ ID NO: 866834 - RNA, 19 nt, Homo sapiens
gacuaugaaucucuuccaa

SEQ ID NO: 866835 - RNA, 19 nt, Homo sapiens
gcauuacugccuugucuug

SEQ ID NO: 866836 - RNA, 19 nt, Homo sapiens
gaaguuggaaaucuguaug

SEQ ID NO: 866837 - RNA, 19 nt, Homo sapiens
aauuaagccugucauggaa

SEQ ID NO: 866838 - RNA, 19 nt, Homo sapiens
ugaacaaggcucaguuaug

SEQ ID NO: 866839 - RNA, 19 nt, Homo sapiens
guugauacaaugaagguaa

SEQ ID NO: 866840 - RNA, 19 nt, Homo sapiens
aggcuucaaucauagaauu

SEQ ID NO: 866841 - RNA, 19 nt, Homo sapiens
ucgaguauauuguaagaag

SEQ ID NO: 866842 - RNA, 19 nt, Homo sapiens
gaucauguuagcuucuauu

SEQ ID NO: 866843 - RNA, 19 nt, Homo sapiens
uauaguggauguuaucaac

SEQ ID NO: 866844 - RNA, 19 nt, Homo sapiens
ucgcauuucuacagcaauu

SEQ ID NO: 866845 - RNA, 19 nt, Homo sapiens
ggcaaaucuuacuauacua

SEQ ID NO: 866846 - RNA, 19 nt, Homo sapiens
gcugguagauucuguauua

SEQ ID NO: 866847 - RNA, 19 nt, Homo sapiens
ggacagcacugcauuagaa

SEQ ID NO: 866848 - RNA, 19 nt, Homo sapiens
gcacugcauuagaauauuu

SEQ ID NO: 866849 - RNA, 19 nt, Homo sapiens
acacaaaccugcucacaga

SEQ ID NO: 866850 - RNA, 19 nt, Homo sapiens
gcacaaagauauggaacau

SEQ ID NO: 866851 - RNA, 19 nt, Homo sapiens
ccuuagcacugauugauua

SEQ ID NO: 866852 - RNA, 19 nt, Homo sapiens
gcaaaguguuuaagagcaa

SEQ ID NO: 866853 - RNA, 19 nt, Homo sapiens
gaaaccagcauuagcagaa

SEQ ID NO: 866854 - RNA, 19 nt, Homo sapiens
cagagaagccucacuuuga

SEQ ID NO: 866855 - RNA, 19 nt, Homo sapiens
uaagcuagaucccagcaaa

SEQ ID NO: 866856 - RNA, 19 nt, Homo sapiens
ggaggacgauacacaugaa

SEQ ID NO: 866857 - RNA, 19 nt, Homo sapiens
gcagcuuccuauaaaguuu

SEQ ID NO: 866858 - RNA, 19 nt, Homo sapiens
caugaaaccucucaaguac

SEQ ID NO: 866859 - RNA, 19 nt, Homo sapiens
ccaugaaaccucucaagua

SEQ ID NO: 866860 - RNA, 19 nt, Homo sapiens
guaggccucuuucuaguug

SEQ ID NO: 866861 - RNA, 19 nt, Homo sapiens
gaagagaccgacuccuuug

SEQ ID NO: 866862 - RNA, 19 nt, Homo sapiens
gagaccgacuccuuuguga

SEQ ID NO: 866863 - RNA, 19 nt, Homo sapiens
uauuugagcuggauucaug

SEQ ID NO: 866864 - RNA, 19 nt, Homo sapiens
gcaauuaacagcaucucaa

SEQ ID NO: 866865 - RNA, 19 nt, Homo sapiens
auacugcucuuccucaauu

SEQ ID NO: 866866 - RNA, 19 nt, Homo sapiens
gaauuuggaaucuugugua

SEQ ID NO: 866867 - RNA, 19 nt, Homo sapiens
aaauaagucugagugcuuu

SEQ ID NO: 866868 - RNA, 19 nt, Homo sapiens
caaauaagucugagugcuu

SEQ ID NO: 866869 - RNA, 19 nt, Homo sapiens
caaaccugcucacagaaga

SEQ ID NO: 866870 - RNA, 19 nt, Homo sapiens
gagcuggauucaugcaaug

SEQ ID NO: 866871 - RNA, 19 nt, Homo sapiens
ucauguggcugguagauuc

SEQ ID NO: 866872 - RNA, 19 nt, Homo sapiens
gaccguaggccucuuucua

SEQ ID NO: 866873 - RNA, 19 nt, Homo sapiens
accaauggcuuccacauga

SEQ ID NO: 866874 - RNA, 19 nt, Homo sapiens
gguagauucuguauuagca

SEQ ID NO: 866875 - RNA, 19 nt, Homo sapiens
cugaagaugugaagaacuu

SEQ ID NO: 866876 - RNA, 19 nt, Homo sapiens
guugaugucuucauuggau

SEQ ID NO: 866877 - RNA, 19 nt, Homo sapiens
gcaagaacaagaucguaau

SEQ ID NO: 866878 - RNA, 19 nt, Homo sapiens
ugggaagcauggcaauuaa

SEQ ID NO: 866879 - RNA, 19 nt, Homo sapiens
uguauaaaccuaucaccua

SEQ ID NO: 866880 - RNA, 19 nt, Homo sapiens
gaagaacuuuuaccugaug

SEQ ID NO: 866881 - RNA, 19 nt, Homo sapiens
ucgcucugcucauuucuuu

SEQ ID NO: 866882 - RNA, 19 nt, Homo sapiens
gcaagccgcaccuggagaa

SEQ ID NO: 866883 - RNA, 19 nt, Homo sapiens
caauuaacagcaucucaaa

SEQ ID NO: 866884 - RNA, 19 nt, Homo sapiens
ggaagcauggcaauuaaca

SEQ ID NO: 866885 - RNA, 19 nt, Homo sapiens
ccucucaaguacacaauug

SEQ ID NO: 866886 - RNA, 19 nt, Homo sapiens
cagaagagaccgacuccuu

SEQ ID NO: 866887 - RNA, 19 nt, Homo sapiens
ccagagaagccucacuuug

SEQ ID NO: 866888 - RNA, 19 nt, Homo sapiens
gaacgucauaugauuucuu

SEQ ID NO: 866889 - RNA, 19 nt, Homo sapiens
gcucuuccucaauuaauuu

SEQ ID NO: 866890 - RNA, 19 nt, Homo sapiens
gcugaacgucauaugauuu

SEQ ID NO: 866891 - RNA, 19 nt, Homo sapiens
ccacuuccuccacuucuaa

SEQ ID NO: 866892 - RNA, 19 nt, Homo sapiens
ccgacuccuuugugaauaa

SEQ ID NO: 866893 - RNA, 19 nt, Homo sapiens
agaagagaccgacuccuuu

SEQ ID NO: 866894 - RNA, 19 nt, Homo sapiens
uuguguaagugcccaaaua

SEQ ID NO: 866895 - RNA, 19 nt, Homo sapiens
ccagcaaaguguuuaagag

SEQ ID NO: 866896 - RNA, 19 nt, Homo sapiens
gaaaguuugccuugucuac

SEQ ID NO: 866897 - RNA, 19 nt, Homo sapiens
uuugacccaugaagcauua

SEQ ID NO: 866898 - RNA, 19 nt, Homo sapiens
gagcaagaacaagaucgua

SEQ ID NO: 866899 - RNA, 19 nt, Homo sapiens
gggaaaguuugccuugucu

SEQ ID NO: 866900 - RNA, 19 nt, Homo sapiens
gggcaucacgcgcauccua

SEQ ID NO: 866901 - RNA, 19 nt, Homo sapiens
cacccagucuuccauguau

SEQ ID NO: 866902 - RNA, 19 nt, Homo sapiens
cagcacugcauuagaauau

SEQ ID NO: 866903 - RNA, 19 nt, Homo sapiens
caauugcauuagccacauu

SEQ ID NO: 866904 - RNA, 19 nt, Homo sapiens
gcauuagaacugcauuguu

SEQ ID NO: 866905 - RNA, 19 nt, Homo sapiens
ucugagugcuuuccucuuc

SEQ ID NO: 866906 - RNA, 19 nt, Homo sapiens
gaucccagcaaaguguuua

SEQ ID NO: 866907 - RNA, 19 nt, Homo sapiens
gaccgacuccuuugugaau

SEQ ID NO: 866908 - RNA, 19 nt, Homo sapiens
auaaaccuaucaccuacaa

SEQ ID NO: 866909 - RNA, 19 nt, Homo sapiens
gcaaugguucagcauguau

SEQ ID NO: 866910 - RNA, 19 nt, Homo sapiens
gcauggcaauuaacagcau

SEQ ID NO: 866911 - RNA, 19 nt, Homo sapiens
guaagugcccaaauaaguc

SEQ ID NO: 866912 - RNA, 19 nt, Homo sapiens
uuuggaaucuuguguaagu

SEQ ID NO: 866913 - RNA, 19 nt, Homo sapiens
aagcaaugguucagcaugu

SEQ ID NO: 866914 - RNA, 19 nt, Homo sapiens
acaccuuuacugccuauua

SEQ ID NO: 866915 - RNA, 19 nt, Homo sapiens
caauggcagugggaaaguu

SEQ ID NO: 866916 - RNA, 19 nt, Homo sapiens
uguauucacuuccuaaugc

SEQ ID NO: 866917 - RNA, 19 nt, Homo sapiens
ugaaaccucucaaguacac

SEQ ID NO: 866918 - RNA, 19 nt, Homo sapiens
gugcuuuccucuucuucaa

SEQ ID NO: 866919 - RNA, 19 nt, Homo sapiens
cugggaagcauggcaauua

SEQ ID NO: 866920 - RNA, 19 nt, Homo sapiens
ggagugugaagcuggauga

SEQ ID NO: 866921 - RNA, 19 nt, Homo sapiens
ccaugaagcauuagaacug

SEQ ID NO: 866922 - RNA, 19 nt, Homo sapiens
ggggugaccuccaguuuug

SEQ ID NO: 866923 - RNA, 19 nt, Homo sapiens
ccuaucaccuacaacacaa

SEQ ID NO: 866924 - RNA, 19 nt, Homo sapiens
cagcauguauaaaccuauc

SEQ ID NO: 866925 - RNA, 19 nt, Homo sapiens
gauucuguauuagcacaaa

SEQ ID NO: 866926 - RNA, 19 nt, Homo sapiens
ugugaugccugaagaugug

SEQ ID NO: 866927 - RNA, 19 nt, Homo sapiens
uuggaugggucauaauguu

SEQ ID NO: 866928 - RNA, 19 nt, Homo sapiens
gaccaauggcuuccacaug

SEQ ID NO: 866929 - RNA, 19 nt, Homo sapiens
aggagccacuagucacaua

SEQ ID NO: 866930 - RNA, 19 nt, Homo sapiens
ggaauuuggaaucuugugu

SEQ ID NO: 866931 - RNA, 19 nt, Homo sapiens
ccagaguggugguuuccau

SEQ ID NO: 866932 - RNA, 19 nt, Homo sapiens
caaugguucagcauguaua

SEQ ID NO: 866933 - RNA, 19 nt, Homo sapiens
ugagcuggauucaugcaau

SEQ ID NO: 866934 - RNA, 19 nt, Homo sapiens
uguguaagugcccaaauaa

SEQ ID NO: 866935 - RNA, 19 nt, Homo sapiens
gccugcagguggccagaaa

SEQ ID NO: 866936 - RNA, 19 nt, Homo sapiens
caagaacaagaucguaauc

SEQ ID NO: 866937 - RNA, 19 nt, Homo sapiens
aaaccuaucaccuacaaca

SEQ ID NO: 866938 - RNA, 19 nt, Homo sapiens
gcccacaggccaagcaaug

SEQ ID NO: 866939 - RNA, 19 nt, Homo sapiens
aaguuugucuuccucauca

SEQ ID NO: 866940 - RNA, 19 nt, Homo sapiens
gcuuuccucuucuucaaca

SEQ ID NO: 866941 - RNA, 19 nt, Homo sapiens
caacacaaaccugcucaca

SEQ ID NO: 866942 - RNA, 19 nt, Homo sapiens
aauaugccuucaccagcua

SEQ ID NO: 866943 - RNA, 19 nt, Homo sapiens
ggaaaguuugccuugucua

SEQ ID NO: 866944 - RNA, 19 nt, Homo sapiens
uaaaguuugucuuccucau

SEQ ID NO: 866945 - RNA, 19 nt, Homo sapiens
uagcacugauugauuagag

SEQ ID NO: 866946 - RNA, 19 nt, Homo sapiens
gaaauucccugaguuguuu

SEQ ID NO: 866947 - RNA, 19 nt, Homo sapiens
uaaagcagcugacaucauu

SEQ ID NO: 866948 - RNA, 19 nt, Homo sapiens
gaacaugaauaccuuacaa

SEQ ID NO: 866949 - RNA, 19 nt, Homo sapiens
gaggauauaugcugauaaa

SEQ ID NO: 866950 - RNA, 19 nt, Homo sapiens
gagaaggacuuaauacuca

SEQ ID NO: 866951 - RNA, 19 nt, Homo sapiens
caagaagacucaauaugaa

SEQ ID NO: 866952 - RNA, 19 nt, Homo sapiens
gcagagaaaugccaaggaa

SEQ ID NO: 866953 - RNA, 19 nt, Homo sapiens
uaacaaguaucgugucaaa

SEQ ID NO: 866954 - RNA, 19 nt, Homo sapiens
ggaauucaguacucuguaa

SEQ ID NO: 866955 - RNA, 19 nt, Homo sapiens
gaacauauuuaucguugug

SEQ ID NO: 866956 - RNA, 19 nt, Homo sapiens
ggagauagauuaugcuucu

SEQ ID NO: 866957 - RNA, 19 nt, Homo sapiens
ccaagaagacucaauauga

SEQ ID NO: 866958 - RNA, 19 nt, Homo sapiens
aagcuuggguucuuacuua

SEQ ID NO: 866959 - RNA, 19 nt, Homo sapiens
gcacacacacacacaauuu

SEQ ID NO: 866960 - RNA, 19 nt, Homo sapiens
ggaaguccaugcaagcaaa

SEQ ID NO: 866961 - RNA, 19 nt, Homo sapiens
gcaagaagaccauggagaa

SEQ ID NO: 866962 - RNA, 19 nt, Homo sapiens
ucagacagcugcagcauau

SEQ ID NO: 866963 - RNA, 19 nt, Homo sapiens
gagaaagaaucccuccauu

SEQ ID NO: 866964 - RNA, 19 nt, Homo sapiens
gaagguugauucugugaga

SEQ ID NO: 866965 - RNA, 19 nt, Homo sapiens
aaacuacacuccagcauug

SEQ ID NO: 866966 - RNA, 19 nt, Homo sapiens
gggaucaacuuuaaacaga

SEQ ID NO: 866967 - RNA, 19 nt, Homo sapiens
acaaguaucgugucaaaua

SEQ ID NO: 866968 - RNA, 19 nt, Homo sapiens
uaacugcucuagcuucuug

SEQ ID NO: 866969 - RNA, 19 nt, Homo sapiens
gaaggaaacagcaagaaga

SEQ ID NO: 866970 - RNA, 19 nt, Homo sapiens
ccaagugggcuaccuguua

SEQ ID NO: 866971 - RNA, 19 nt, Homo sapiens
ggauggagaugcauuuaca

SEQ ID NO: 866972 - RNA, 19 nt, Homo sapiens
caaagaaccuauggauguu

SEQ ID NO: 866973 - RNA, 19 nt, Homo sapiens
ccagguugcucgucucuuu

SEQ ID NO: 866974 - RNA, 19 nt, Homo sapiens
caaggaagcuggaggaaac

SEQ ID NO: 866975 - RNA, 19 nt, Homo sapiens
gagaguaucuaugaugaga

SEQ ID NO: 866976 - RNA, 19 nt, Homo sapiens
ggacuccucucuguaaaga

SEQ ID NO: 866977 - RNA, 19 nt, Homo sapiens
ggaggagaaugcuggugua

SEQ ID NO: 866978 - RNA, 19 nt, Homo sapiens
gaaagaaucccuccauugc

SEQ ID NO: 866979 - RNA, 19 nt, Homo sapiens
caucagaagucauccauag

SEQ ID NO: 866980 - RNA, 19 nt, Homo sapiens
caaagggaguuaccauugu

SEQ ID NO: 866981 - RNA, 19 nt, Homo sapiens
gcagagcgcuggucagacu

SEQ ID NO: 866982 - RNA, 19 nt, Homo sapiens
agaaggaggacaaauauaa

SEQ ID NO: 866983 - RNA, 19 nt, Homo sapiens
gaagauuuguugucagagu

SEQ ID NO: 866984 - RNA, 19 nt, Homo sapiens
gaaacuacacuccagcauu

SEQ ID NO: 866985 - RNA, 19 nt, Homo sapiens
ucaaagaaccuauggaugu

SEQ ID NO: 866986 - RNA, 19 nt, Homo sapiens
uauacaaccucuucuaugu

SEQ ID NO: 866987 - RNA, 19 nt, Homo sapiens
ggaggaagaggaagaagaa

SEQ ID NO: 866988 - RNA, 19 nt, Homo sapiens
ucagagaggcuuuaacaaa

SEQ ID NO: 866989 - RNA, 19 nt, Homo sapiens
gggcauugcuauggagaua

SEQ ID NO: 866990 - RNA, 19 nt, Homo sapiens
gccaucaacuauguuaaua

SEQ ID NO: 866991 - RNA, 19 nt, Homo sapiens
gcagucagcuacgggaauu

SEQ ID NO: 866992 - RNA, 19 nt, Homo sapiens
ggaggacaaauauaagaua

SEQ ID NO: 866993 - RNA, 19 nt, Homo sapiens
uacuguggcuucagauuua

SEQ ID NO: 866994 - RNA, 19 nt, Homo sapiens
gcacacaccagcagagcua

SEQ ID NO: 866995 - RNA, 19 nt, Homo sapiens
aagaagagauggauguaga

SEQ ID NO: 866996 - RNA, 19 nt, Homo sapiens
uaucgagccuuaccaaaga

SEQ ID NO: 866997 - RNA, 19 nt, Homo sapiens
ugacagagcaggaggugua

SEQ ID NO: 866998 - RNA, 19 nt, Homo sapiens
aaagggaguuaccauugua

SEQ ID NO: 866999 - RNA, 19 nt, Homo sapiens
gcuuugaugugcuagcaua

SEQ ID NO: 867000 - RNA, 19 nt, Homo sapiens
ugaagaacaagccaaauuu

SEQ ID NO: 867001 - RNA, 19 nt, Homo sapiens
ccaaacugcucaaucugaa

SEQ ID NO: 867002 - RNA, 19 nt, Homo sapiens
ggacaauuccuaccagaug

SEQ ID NO: 867003 - RNA, 19 nt, Homo sapiens
caaucaaccuguggaguuu

SEQ ID NO: 867004 - RNA, 19 nt, Homo sapiens
uggauaagcuggaguguag

SEQ ID NO: 867005 - RNA, 19 nt, Homo sapiens
gggaagugcugggcauaaa

SEQ ID NO: 867006 - RNA, 19 nt, Homo sapiens
agagauggauguagaugaa

SEQ ID NO: 867007 - RNA, 19 nt, Homo sapiens
gaaaagcacuccagaggau

SEQ ID NO: 867008 - RNA, 19 nt, Homo sapiens
cuguacaucuggaaacuua

SEQ ID NO: 867009 - RNA, 19 nt, Homo sapiens
gccaacagcuccgugcuuu

SEQ ID NO: 867010 - RNA, 19 nt, Homo sapiens
gcacacauaucagaaagag

SEQ ID NO: 867011 - RNA, 19 nt, Homo sapiens
gaucaaaucagaggacuau

SEQ ID NO: 867012 - RNA, 19 nt, Homo sapiens
gaagaacaagccaaauuuc

SEQ ID NO: 867013 - RNA, 19 nt, Homo sapiens
uuccuacgcugucuuguua

SEQ ID NO: 867014 - RNA, 19 nt, Homo sapiens
ggagguguaugcccagguu

SEQ ID NO: 867015 - RNA, 19 nt, Homo sapiens
gcaaagccagagcagauaa

SEQ ID NO: 867016 - RNA, 19 nt, Homo sapiens
auacagagacccugcauuu

SEQ ID NO: 867017 - RNA, 19 nt, Homo sapiens
agagagauguucaccauuc

SEQ ID NO: 867018 - RNA, 19 nt, Homo sapiens
ccucaggucuacaaugauu

SEQ ID NO: 867019 - RNA, 19 nt, Homo sapiens
uaagaucacccauuagguu

SEQ ID NO: 867020 - RNA, 19 nt, Homo sapiens
gugaacaucuagcacagaa

SEQ ID NO: 867021 - RNA, 19 nt, Homo sapiens
cagaggauauaugcugaua

SEQ ID NO: 867022 - RNA, 19 nt, Homo sapiens
cagaagucauccauagaaa

SEQ ID NO: 867023 - RNA, 19 nt, Homo sapiens
ccaggaagauuuguuguca

SEQ ID NO: 867024 - RNA, 19 nt, Homo sapiens
guacuguggcuucagauuu

SEQ ID NO: 867025 - RNA, 19 nt, Homo sapiens
gagcaugagcacagaauga

SEQ ID NO: 867026 - RNA, 19 nt, Homo sapiens
cagacuacguggagcgaua

SEQ ID NO: 867027 - RNA, 19 nt, Homo sapiens
ugagagagauguucaccau

SEQ ID NO: 867028 - RNA, 19 nt, Homo sapiens
ggaucaacuuuaaacagaa

SEQ ID NO: 867029 - RNA, 19 nt, Homo sapiens
ccaaagggaguuaccauug

SEQ ID NO: 867030 - RNA, 19 nt, Homo sapiens
uugaucaucuuguggauuu

SEQ ID NO: 867031 - RNA, 19 nt, Homo sapiens
ucagauggauuggaacuau

SEQ ID NO: 867032 - RNA, 19 nt, Homo sapiens
caagugggcuaccuguuag

SEQ ID NO: 867033 - RNA, 19 nt, Homo sapiens
gaauguggauagucuggau

SEQ ID NO: 867034 - RNA, 19 nt, Homo sapiens
aaacugauccagagcauug

SEQ ID NO: 867035 - RNA, 19 nt, Homo sapiens
caacaacaacugguauauu

SEQ ID NO: 867036 - RNA, 19 nt, Homo sapiens
uaagaggaauggaugaagu

SEQ ID NO: 867037 - RNA, 19 nt, Homo sapiens
gaugaaagaggaagaaugg

SEQ ID NO: 867038 - RNA, 19 nt, Homo sapiens
ccgcuugucugcugaagaa

SEQ ID NO: 867039 - RNA, 19 nt, Homo sapiens
agaccaaucuggcaacaau

SEQ ID NO: 867040 - RNA, 19 nt, Homo sapiens
gaugcgcuaucuuaucuug

SEQ ID NO: 867041 - RNA, 19 nt, Homo sapiens
gaugguguaugugaucaaa

SEQ ID NO: 867042 - RNA, 19 nt, Homo sapiens
gaagauucacugagagaga

SEQ ID NO: 867043 - RNA, 19 nt, Homo sapiens
ggauguugauguagaagau

SEQ ID NO: 867044 - RNA, 19 nt, Homo sapiens
agacaggcauucagaagga

SEQ ID NO: 867045 - RNA, 19 nt, Homo sapiens
ccaagguccugaggucuaa

SEQ ID NO: 867046 - RNA, 19 nt, Homo sapiens
ccgauacucuuucauauua

SEQ ID NO: 867047 - RNA, 19 nt, Homo sapiens
aaacgaagaugacuuaguu

SEQ ID NO: 867048 - RNA, 19 nt, Homo sapiens
gaaugaaguuugucaguga

SEQ ID NO: 867049 - RNA, 19 nt, Homo sapiens
ugacuuaguuucacaugua

SEQ ID NO: 867050 - RNA, 19 nt, Homo sapiens
ggaauauucugcuauagga

SEQ ID NO: 867051 - RNA, 19 nt, Homo sapiens
gcgaauuacuuguguugua

SEQ ID NO: 867052 - RNA, 19 nt, Homo sapiens
acaauggccugaugguuua

SEQ ID NO: 867053 - RNA, 19 nt, Homo sapiens
gaacuacauuccaccauca

SEQ ID NO: 867054 - RNA, 19 nt, Homo sapiens
guagaugguuccguaauuu

SEQ ID NO: 867055 - RNA, 19 nt, Homo sapiens
gcuggaauauucugcuaua

SEQ ID NO: 867056 - RNA, 19 nt, Homo sapiens
gaucauugcuaguguagug

SEQ ID NO: 867057 - RNA, 19 nt, Homo sapiens
ggaaauugguuuguaggaa

SEQ ID NO: 867058 - RNA, 19 nt, Homo sapiens
caauauggauucucuguuc

SEQ ID NO: 867059 - RNA, 19 nt, Homo sapiens
cugcaaagcuguuacauuc

SEQ ID NO: 867060 - RNA, 19 nt, Homo sapiens
gacaauggccugaugguuu

SEQ ID NO: 867061 - RNA, 19 nt, Homo sapiens
gcuagaggaaggcgaauua

SEQ ID NO: 867062 - RNA, 19 nt, Homo sapiens
caacaauuacucugcauaa

SEQ ID NO: 867063 - RNA, 19 nt, Homo sapiens
ggagggagugguauguuua

SEQ ID NO: 867064 - RNA, 19 nt, Homo sapiens
gaaaccauaacacagauuu

SEQ ID NO: 867065 - RNA, 19 nt, Homo sapiens
gagacuacuuugccaagaa

SEQ ID NO: 867066 - RNA, 19 nt, Homo sapiens
ggaaggugaucuuggugaa

SEQ ID NO: 867067 - RNA, 19 nt, Homo sapiens
gaaggcgaauuacuugugu

SEQ ID NO: 867068 - RNA, 19 nt, Homo sapiens
gaagauacauggcaaaagu

SEQ ID NO: 867069 - RNA, 19 nt, Homo sapiens
uggaggaaaugaaacagua

SEQ ID NO: 867070 - RNA, 19 nt, Homo sapiens
gauggaaauugguuuguag

SEQ ID NO: 867071 - RNA, 19 nt, Homo sapiens
ugccuuagcuggaccaauu

SEQ ID NO: 867072 - RNA, 19 nt, Homo sapiens
ggaaaugcccaguccucua

SEQ ID NO: 867073 - RNA, 19 nt, Homo sapiens
caauuacucugcauaacau

SEQ ID NO: 867074 - RNA, 19 nt, Homo sapiens
caacuuuggcaacaauuaa

SEQ ID NO: 867075 - RNA, 19 nt, Homo sapiens
uggcaacaauuaaggauga

SEQ ID NO: 867076 - RNA, 19 nt, Homo sapiens
gaaaagguguuaaucucaa

SEQ ID NO: 867077 - RNA, 19 nt, Homo sapiens
gaaaacccguugcacauau

SEQ ID NO: 867078 - RNA, 19 nt, Homo sapiens
gugaugaacauuaugauga

SEQ ID NO: 867079 - RNA, 19 nt, Homo sapiens
acaguaugcuccugaaguu

SEQ ID NO: 867080 - RNA, 19 nt, Homo sapiens
caacgauuaucagccagua

SEQ ID NO: 867081 - RNA, 19 nt, Homo sapiens
gaagaugacuuaguuucac

SEQ ID NO: 867082 - RNA, 19 nt, Homo sapiens
gaccaauggauuauuauga

SEQ ID NO: 867083 - RNA, 19 nt, Homo sapiens
gaaagaccaauggauuauu

SEQ ID NO: 867084 - RNA, 19 nt, Homo sapiens
gaggaaggcgaauuacuug

SEQ ID NO: 867085 - RNA, 19 nt, Homo sapiens
gcaacaauuacucugcaua

SEQ ID NO: 867086 - RNA, 19 nt, Homo sapiens
gauggacaauggccugaug

SEQ ID NO: 867087 - RNA, 19 nt, Homo sapiens
cauccgauacucuuucaua

SEQ ID NO: 867088 - RNA, 19 nt, Homo sapiens
gggccagauucuuuaauug

SEQ ID NO: 867089 - RNA, 19 nt, Homo sapiens
cagacaauacucuucauuu

SEQ ID NO: 867090 - RNA, 19 nt, Homo sapiens
gcaaauccaccacccuuca

SEQ ID NO: 867091 - RNA, 19 nt, Homo sapiens
gaaacggcaacgauuauca

SEQ ID NO: 867092 - RNA, 19 nt, Homo sapiens
gaaaugcccaguccucuac

SEQ ID NO: 867093 - RNA, 19 nt, Homo sapiens
caaaugaaacggcaacgau

SEQ ID NO: 867094 - RNA, 19 nt, Homo sapiens
caacuucuuuuccaaauga

SEQ ID NO: 867095 - RNA, 19 nt, Homo sapiens
uaacauaggauucucugau

SEQ ID NO: 867096 - RNA, 19 nt, Homo sapiens
ugucagugaugaacauuau

SEQ ID NO: 867097 - RNA, 19 nt, Homo sapiens
ggagacuacuuugccaaga

SEQ ID NO: 867098 - RNA, 19 nt, Homo sapiens
caucgaggaucuagcaaca

SEQ ID NO: 867099 - RNA, 19 nt, Homo sapiens
aacauaggauucucugauu

SEQ ID NO: 867100 - RNA, 19 nt, Homo sapiens
uguagaugguuccguaauu

SEQ ID NO: 867101 - RNA, 19 nt, Homo sapiens
gguguuaaucucaaaugua

SEQ ID NO: 867102 - RNA, 19 nt, Homo sapiens
ugauggaaauugguuugua

SEQ ID NO: 867103 - RNA, 19 nt, Homo sapiens
aaugaaacggcaacgauua

SEQ ID NO: 867104 - RNA, 19 nt, Homo sapiens
ggaauccacuacaacuucu

SEQ ID NO: 867105 - RNA, 19 nt, Homo sapiens
ggccagauucuuuaauuga

SEQ ID NO: 867106 - RNA, 19 nt, Homo sapiens
uggauucucuguucaagga

SEQ ID NO: 867107 - RNA, 19 nt, Homo sapiens
ucuguaaagugaccaauuc

SEQ ID NO: 867108 - RNA, 19 nt, Homo sapiens
ggaaggcgaauuacuugug

SEQ ID NO: 867109 - RNA, 19 nt, Homo sapiens
ggacauccgauacucuuuc

SEQ ID NO: 867110 - RNA, 19 nt, Homo sapiens
gaaacaguagcagccauuu

SEQ ID NO: 867111 - RNA, 19 nt, Homo sapiens
ccagauucuuuaauugaug

SEQ ID NO: 867112 - RNA, 19 nt, Homo sapiens
uugaaagaccaauggauua

SEQ ID NO: 867113 - RNA, 19 nt, Homo sapiens
aaauugcccuucccauugu

SEQ ID NO: 867114 - RNA, 19 nt, Homo sapiens
ucgaggaucuagcaacaga

SEQ ID NO: 867115 - RNA, 19 nt, Homo sapiens
caaauguaaugcugaugca

SEQ ID NO: 867116 - RNA, 19 nt, Homo sapiens
gauaugauggaaauugguu

SEQ ID NO: 867117 - RNA, 19 nt, Homo sapiens
gugaacaaucuaauacgua

SEQ ID NO: 867118 - RNA, 19 nt, Homo sapiens
caauuaaggaugacacaau

SEQ ID NO: 867119 - RNA, 19 nt, Homo sapiens
guaacaggauaugauggaa

SEQ ID NO: 867120 - RNA, 19 nt, Homo sapiens
gaaaauacaucugcaaagc

SEQ ID NO: 867121 - RNA, 19 nt, Homo sapiens
ugaaaacgaagaugacuua

SEQ ID NO: 867122 - RNA, 19 nt, Homo sapiens
ccacgaucauugcuagugu

SEQ ID NO: 867123 - RNA, 19 nt, Homo sapiens
guccauccauugacuuuca

SEQ ID NO: 867124 - RNA, 19 nt, Homo sapiens
cagguuggauggacaaugg

SEQ ID NO: 867125 - RNA, 19 nt, Homo sapiens
gacauccgauacucuuuca

SEQ ID NO: 867126 - RNA, 19 nt, Homo sapiens
gagaauaucagggaagagu

SEQ ID NO: 867127 - RNA, 19 nt, Homo sapiens
ggacaauggccugaugguu

SEQ ID NO: 867128 - RNA, 19 nt, Homo sapiens
ccaccacccuucaaaucug

SEQ ID NO: 867129 - RNA, 19 nt, Homo sapiens
gccagauucuuuaauugau

SEQ ID NO: 867130 - RNA, 19 nt, Homo sapiens
gaaaaucucaauagguuug

SEQ ID NO: 867131 - RNA, 19 nt, Homo sapiens
ucaacuuuggcaacaauua

SEQ ID NO: 867132 - RNA, 19 nt, Homo sapiens
gguaacaggauaugaugga

SEQ ID NO: 867133 - RNA, 19 nt, Homo sapiens
gaaggugaucuuggugaaa

SEQ ID NO: 867134 - RNA, 19 nt, Homo sapiens
aggagggagugguauguuu

SEQ ID NO: 867135 - RNA, 19 nt, Homo sapiens
cgaagaugacuuaguuuca

SEQ ID NO: 867136 - RNA, 19 nt, Homo sapiens
aaaugggaaugaaguuugu

SEQ ID NO: 867137 - RNA, 19 nt, Homo sapiens
ggagaagauacauggcaaa

SEQ ID NO: 867138 - RNA, 19 nt, Homo sapiens
aacaggauaugauggaaau

SEQ ID NO: 867139 - RNA, 19 nt, Homo sapiens
uaacaggauaugauggaaa

SEQ ID NO: 867140 - RNA, 19 nt, Homo sapiens
ugaaguuugucagugauga

SEQ ID NO: 867141 - RNA, 19 nt, Homo sapiens
ugaaagaccaauggauuau

SEQ ID NO: 867142 - RNA, 19 nt, Homo sapiens
caauucccuuggucaaaga

SEQ ID NO: 867143 - RNA, 19 nt, Homo sapiens
agaggaaggcgaauuacuu

SEQ ID NO: 867144 - RNA, 19 nt, Homo sapiens
ucagugaugaacauuauga

SEQ ID NO: 867145 - RNA, 19 nt, Homo sapiens
gaaguuugucagugaugaa

SEQ ID NO: 867146 - RNA, 19 nt, Homo sapiens
ccaaggagaugccaccaua

SEQ ID NO: 867147 - RNA, 19 nt, Homo sapiens
ggaccgaacuuuccacugu

SEQ ID NO: 867148 - RNA, 19 nt, Homo sapiens
gauccugggucccucauaa

SEQ ID NO: 867149 - RNA, 19 nt, Homo sapiens
ccaaggagcugcccaaguc

SEQ ID NO: 867150 - RNA, 19 nt, Homo sapiens
guacuaagcacaagacaau

SEQ ID NO: 867151 - RNA, 19 nt, Homo sapiens
gcacauaacaaagguacua

SEQ ID NO: 867152 - RNA, 19 nt, Homo sapiens
gcacugagggugacacuuc

SEQ ID NO: 867153 - RNA, 19 nt, Homo sapiens
caaauccgcuucaauucuc

SEQ ID NO: 867154 - RNA, 19 nt, Homo sapiens
gcacggacccauccucuuc

SEQ ID NO: 867155 - RNA, 19 nt, Homo sapiens
cuacugagccgucacaaga

SEQ ID NO: 867156 - RNA, 19 nt, Homo sapiens
ugugagaucugcaauguca

SEQ ID NO: 867157 - RNA, 19 nt, Homo sapiens
cauaagcacuuugguuuua

SEQ ID NO: 867158 - RNA, 19 nt, Homo sapiens
ugucaaauccgcuucaauu

SEQ ID NO: 867159 - RNA, 19 nt, Homo sapiens
gaggcgcacuacaaaggua

SEQ ID NO: 867160 - RNA, 19 nt, Homo sapiens
gcaaggaagaggaggagaa

SEQ ID NO: 867161 - RNA, 19 nt, Homo sapiens
ccaagcggcugcucuacug

SEQ ID NO: 867162 - RNA, 19 nt, Homo sapiens
uguaauaucugucaaaucc

SEQ ID NO: 867163 - RNA, 19 nt, Homo sapiens
ggagacuggucagggugua

SEQ ID NO: 867164 - RNA, 19 nt, Homo sapiens
caaggaagaggaggagaaa

SEQ ID NO: 867165 - RNA, 19 nt, Homo sapiens
gcuugaggcacauaacaaa

SEQ ID NO: 867166 - RNA, 19 nt, Homo sapiens
cccgucauuuccuguaaua

SEQ ID NO: 867167 - RNA, 19 nt, Homo sapiens
caacugaaacagcacaucu

SEQ ID NO: 867168 - RNA, 19 nt, Homo sapiens
uucccaagcuuuaaucuuc

SEQ ID NO: 867169 - RNA, 19 nt, Homo sapiens
acucggagguccaacugaa

SEQ ID NO: 867170 - RNA, 19 nt, Homo sapiens
ccauggacccugugcagaa

SEQ ID NO: 867171 - RNA, 19 nt, Homo sapiens
gcaacuacagcaccaugga

SEQ ID NO: 867172 - RNA, 19 nt, Homo sapiens
gucauuuccuguaauaucu

SEQ ID NO: 867173 - RNA, 19 nt, Homo sapiens
cucauaagcacuuugguuu

SEQ ID NO: 867174 - RNA, 19 nt, Homo sapiens
ucccggcacucccuaaaug

SEQ ID NO: 867175 - RNA, 19 nt, Homo sapiens
caaagguacuaagcacaag

SEQ ID NO: 867176 - RNA, 19 nt, Homo sapiens
acaaagguacuaagcacaa

SEQ ID NO: 867177 - RNA, 19 nt, Homo sapiens
ggcccgucauuuccuguaa

SEQ ID NO: 867178 - RNA, 19 nt, Homo sapiens
ucaaauccgcuucaauucu

SEQ ID NO: 867179 - RNA, 19 nt, Homo sapiens
ccuguaauaucugucaaau

SEQ ID NO: 867180 - RNA, 19 nt, Homo sapiens
ccucauaagcacuuugguu

SEQ ID NO: 867181 - RNA, 19 nt, Homo sapiens
ucacucacccucugcuuca

SEQ ID NO: 867182 - RNA, 19 nt, Homo sapiens
gcacgcugacuuucuccaa

SEQ ID NO: 867183 - RNA, 19 nt, Homo sapiens
gcauugaggcugccaagac

SEQ ID NO: 867184 - RNA, 19 nt, Homo sapiens
gaacuuuccacugugagau

SEQ ID NO: 867185 - RNA, 19 nt, Homo sapiens
gcaagguggcugugaacuc

SEQ ID NO: 867186 - RNA, 19 nt, Homo sapiens
aguccggguuccauucuuu

SEQ ID NO: 867187 - RNA, 19 nt, Homo sapiens
acugugagaucugcaaugu

SEQ ID NO: 867188 - RNA, 19 nt, Homo sapiens
cacuggaccucaagcagau

SEQ ID NO: 867189 - RNA, 19 nt, Homo sapiens
ccgcaaaacugugagcaaa

SEQ ID NO: 867190 - RNA, 19 nt, Homo sapiens
aaggagaugccaccauaga

SEQ ID NO: 867191 - RNA, 19 nt, Homo sapiens
ccccaaaccuagcacaaaa

SEQ ID NO: 867192 - RNA, 19 nt, Homo sapiens
ugaggcacauaacaaaggu

SEQ ID NO: 867193 - RNA, 19 nt, Homo sapiens
cgucauuuccuguaauauc

SEQ ID NO: 867194 - RNA, 19 nt, Homo sapiens
caacucggagguccaacug

SEQ ID NO: 867195 - RNA, 19 nt, Homo sapiens
ugugcaagguggcugugaa

SEQ ID NO: 867196 - RNA, 19 nt, Homo sapiens
gagggugacacuucugagu

SEQ ID NO: 867197 - RNA, 19 nt, Homo sapiens
gcccgucauuuccuguaau

SEQ ID NO: 867198 - RNA, 19 nt, Homo sapiens
ggcacucccuaaaugaucu

SEQ ID NO: 867199 - RNA, 19 nt, Homo sapiens
ccaaguuccuagaccucau

SEQ ID NO: 867200 - RNA, 19 nt, Homo sapiens
gguacuaagcacaagacaa

SEQ ID NO: 867201 - RNA, 19 nt, Homo sapiens
gucaaauccgcuucaauuc

SEQ ID NO: 867202 - RNA, 19 nt, Homo sapiens
ucuuucugcuugacaaugu

SEQ ID NO: 867203 - RNA, 19 nt, Homo sapiens
caaaagccauguccaucca

SEQ ID NO: 867204 - RNA, 19 nt, Homo sapiens
aagcccaacccacuacuga

SEQ ID NO: 867205 - RNA, 19 nt, Homo sapiens
gaacucccugucccagcuu

SEQ ID NO: 867206 - RNA, 19 nt, Homo sapiens
gaaugaagcucguaaauua

SEQ ID NO: 867207 - RNA, 19 nt, Homo sapiens
caagaaagcugaaagauuc

SEQ ID NO: 867208 - RNA, 19 nt, Homo sapiens
gaucaaaccugacauggaa

SEQ ID NO: 867209 - RNA, 19 nt, Homo sapiens
gcagauaucgacuacauua

SEQ ID NO: 867210 - RNA, 19 nt, Homo sapiens
gaaauacacagcugaaauu

SEQ ID NO: 867211 - RNA, 19 nt, Homo sapiens
gaacagagacugcgcaaau

SEQ ID NO: 867212 - RNA, 19 nt, Homo sapiens
guauauggcuguuuaaucu

SEQ ID NO: 867213 - RNA, 19 nt, Homo sapiens
aaacguauauccuuucaug

SEQ ID NO: 867214 - RNA, 19 nt, Homo sapiens
ggagacguccuuauaauga

SEQ ID NO: 867215 - RNA, 19 nt, Homo sapiens
gauaucgacuacauuaaug

SEQ ID NO: 867216 - RNA, 19 nt, Homo sapiens
ggagaucagugcagaagau

SEQ ID NO: 867217 - RNA, 19 nt, Homo sapiens
cagcugaaauuaaacagaa

SEQ ID NO: 867218 - RNA, 19 nt, Homo sapiens
ggaaugaagcucguaaauu

SEQ ID NO: 867219 - RNA, 19 nt, Homo sapiens
caauaaaugcuugggauua

SEQ ID NO: 867220 - RNA, 19 nt, Homo sapiens
ggaagaagauaaaagacua

SEQ ID NO: 867221 - RNA, 19 nt, Homo sapiens
ggaaauacacagcugaaau

SEQ ID NO: 867222 - RNA, 19 nt, Homo sapiens
gaaagauucuaugggaaau

SEQ ID NO: 867223 - RNA, 19 nt, Homo sapiens
ggacagugaugaggaagau

SEQ ID NO: 867224 - RNA, 19 nt, Homo sapiens
caacaagaaagcugaaaga

SEQ ID NO: 867225 - RNA, 19 nt, Homo sapiens
aaccugacauggaaacaua

SEQ ID NO: 867226 - RNA, 19 nt, Homo sapiens
gagcuauccuuccaugauc

SEQ ID NO: 867227 - RNA, 19 nt, Homo sapiens
uaaggacagugaugaggaa

SEQ ID NO: 867228 - RNA, 19 nt, Homo sapiens
uaugagagacugagagaaa

SEQ ID NO: 867229 - RNA, 19 nt, Homo sapiens
gcaauaaaugcuugggauu

SEQ ID NO: 867230 - RNA, 19 nt, Homo sapiens
guagugaaguuguuuugua

SEQ ID NO: 867231 - RNA, 19 nt, Homo sapiens
ggagaagacuaugagaaag

SEQ ID NO: 867232 - RNA, 19 nt, Homo sapiens
ccaggaaguuguggaagaa

SEQ ID NO: 867233 - RNA, 19 nt, Homo sapiens
cguauauccuuucauguau

SEQ ID NO: 867234 - RNA, 19 nt, Homo sapiens
ugaaagauucuaugggaaa

SEQ ID NO: 867235 - RNA, 19 nt, Homo sapiens
acaagaaagcugaaagauu

SEQ ID NO: 867236 - RNA, 19 nt, Homo sapiens
cagaggaaauugacaggau

SEQ ID NO: 867237 - RNA, 19 nt, Homo sapiens
ggaacuaaaggaagaggaa

SEQ ID NO: 867238 - RNA, 19 nt, Homo sapiens
guccaugccuucucacuca

SEQ ID NO: 867239 - RNA, 19 nt, Homo sapiens
gaggagaagacuaugagaa

SEQ ID NO: 867240 - RNA, 19 nt, Homo sapiens
ugucuaaucccuucaagaa

SEQ ID NO: 867241 - RNA, 19 nt, Homo sapiens
aaacagaauuuggaaagag

SEQ ID NO: 867242 - RNA, 19 nt, Homo sapiens
gagacguccuuauaaugau

SEQ ID NO: 867243 - RNA, 19 nt, Homo sapiens
ggcaagaggagaagacuau

SEQ ID NO: 867244 - RNA, 19 nt, Homo sapiens
gaacuaaaggaagaggaaa

SEQ ID NO: 867245 - RNA, 19 nt, Homo sapiens
ggagugggaacuaaaggaa

SEQ ID NO: 867246 - RNA, 19 nt, Homo sapiens
ggagcuauccuuccaugau

SEQ ID NO: 867247 - RNA, 19 nt, Homo sapiens
ccaaagcuaaggacaguga

SEQ ID NO: 867248 - RNA, 19 nt, Homo sapiens
gugcuuggauauaagaugu

SEQ ID NO: 867249 - RNA, 19 nt, Homo sapiens
gagaagacuaugagaaagu

SEQ ID NO: 867250 - RNA, 19 nt, Homo sapiens
gaaguuguggaagaagaua

SEQ ID NO: 867251 - RNA, 19 nt, Homo sapiens
aagaggaacagcugucuaa

SEQ ID NO: 867252 - RNA, 19 nt, Homo sapiens
ccggagacguccuuauaau

SEQ ID NO: 867253 - RNA, 19 nt, Homo sapiens
gcagaucaaaccugacaug

SEQ ID NO: 867254 - RNA, 19 nt, Homo sapiens
caagaggagaagacuauga

SEQ ID NO: 867255 - RNA, 19 nt, Homo sapiens
uuaugcugcugcccaguua

SEQ ID NO: 867256 - RNA, 19 nt, Homo sapiens
gaggaacagcugucuaauc

SEQ ID NO: 867257 - RNA, 19 nt, Homo sapiens
aauaaaugcuugggauuag

SEQ ID NO: 867258 - RNA, 19 nt, Homo sapiens
guuguguacuccaaagcua

SEQ ID NO: 867259 - RNA, 19 nt, Homo sapiens
gaaagcugaaagauucuau

SEQ ID NO: 867260 - RNA, 19 nt, Homo sapiens
aaaggaaugugcggcaaga

SEQ ID NO: 867261 - RNA, 19 nt, Homo sapiens
ucaguaauccagaauuuag

SEQ ID NO: 867262 - RNA, 19 nt, Homo sapiens
cauggaaacauaugagaga

SEQ ID NO: 867263 - RNA, 19 nt, Homo sapiens
cagaagaugcagaaagaug

SEQ ID NO: 867264 - RNA, 19 nt, Homo sapiens
aggagaagacuaugagaaa

SEQ ID NO: 867265 - RNA, 19 nt, Homo sapiens
uaaaugcuugggauuagaa

SEQ ID NO: 867266 - RNA, 19 nt, Homo sapiens
ucuaaucccuucaagaacu

SEQ ID NO: 867267 - RNA, 19 nt, Homo sapiens
uaaugaugaugcagauauc

SEQ ID NO: 867268 - RNA, 19 nt, Homo sapiens
acguauauccuuucaugua

SEQ ID NO: 867269 - RNA, 19 nt, Homo sapiens
uaaaucaccaggaaguugu

SEQ ID NO: 867270 - RNA, 19 nt, Homo sapiens
gccggagacguccuuauaa

SEQ ID NO: 867271 - RNA, 19 nt, Homo sapiens
agauguauuucuuguagug

SEQ ID NO: 867272 - RNA, 19 nt, Homo sapiens
aacagagacugcgcaaauu

SEQ ID NO: 867273 - RNA, 19 nt, Homo sapiens
agaagacuaugagaaagug

SEQ ID NO: 867274 - RNA, 19 nt, Homo sapiens
aggaacagcugucuaaucc

SEQ ID NO: 867275 - RNA, 19 nt, Homo sapiens
gaaagaggaacagcugucu

SEQ ID NO: 867276 - RNA, 19 nt, Homo sapiens
gcucagaagcgcgaacaga

SEQ ID NO: 867277 - RNA, 19 nt, Homo sapiens
gcuuggauauaagauguau

SEQ ID NO: 867278 - RNA, 19 nt, Homo sapiens
ccuucucacucagcauuua

SEQ ID NO: 867279 - RNA, 19 nt, Homo sapiens
cgacuacauuaaugaaagg

SEQ ID NO: 867280 - RNA, 19 nt, Homo sapiens
caauagucuucuucaugga

SEQ ID NO: 867281 - RNA, 19 nt, Homo sapiens
ugaaguugcuggagaucag

SEQ ID NO: 867282 - RNA, 19 nt, Homo sapiens
agugggaacuaaaggaaga

SEQ ID NO: 867283 - RNA, 19 nt, Homo sapiens
ucagaugcagucauuguug

SEQ ID NO: 867284 - RNA, 19 nt, Homo sapiens
cauaugagagacugagaga

SEQ ID NO: 867285 - RNA, 19 nt, Homo sapiens
gaagcucguaaauuaaauc

SEQ ID NO: 867286 - RNA, 19 nt, Homo sapiens
ggaaguuguggaagaagau

SEQ ID NO: 867287 - RNA, 19 nt, Homo sapiens
cuaucaguguggaauuuga

SEQ ID NO: 867288 - RNA, 19 nt, Homo sapiens
gccagcagcacacaucaga

SEQ ID NO: 867289 - RNA, 19 nt, Homo sapiens
gaauuuggaaagaggaaca

SEQ ID NO: 867290 - RNA, 19 nt, Homo sapiens
ucgacuacauuaaugaaag

SEQ ID NO: 867291 - RNA, 19 nt, Homo sapiens
agacguccuuauaaugaug

SEQ ID NO: 867292 - RNA, 19 nt, Homo sapiens
gacauggaaacauaugaga

SEQ ID NO: 867293 - RNA, 19 nt, Homo sapiens
aaacccugaucugggauuu

SEQ ID NO: 867294 - RNA, 19 nt, Homo sapiens
ucagaagcgcgaacagaga

SEQ ID NO: 867295 - RNA, 19 nt, Homo sapiens
gggaaauacacagcugaaa

SEQ ID NO: 867296 - RNA, 19 nt, Homo sapiens
cagauaucgacuacauuaa

SEQ ID NO: 867297 - RNA, 19 nt, Homo sapiens
agccggagacguccuuaua

SEQ ID NO: 867298 - RNA, 19 nt, Homo sapiens
augcagauaucgacuacau

SEQ ID NO: 867299 - RNA, 19 nt, Homo sapiens
uuaaaucaccaggaaguug

SEQ ID NO: 867300 - RNA, 19 nt, Homo sapiens
gacaggauggucauagauc

SEQ ID NO: 867301 - RNA, 19 nt, Homo sapiens
auaaaugcuugggauuaga

SEQ ID NO: 867302 - RNA, 19 nt, Homo sapiens
accaggaaguuguggaaga

SEQ ID NO: 867303 - RNA, 19 nt, Homo sapiens
uccaauagucuucuucaug

SEQ ID NO: 867304 - RNA, 19 nt, Homo sapiens
agacuaaaauuaccugcaa

SEQ ID NO: 867305 - RNA, 19 nt, Homo sapiens
aggaaguuguggaagaaga

SEQ ID NO: 867306 - RNA, 19 nt, Homo sapiens
ggaaagaaaugcaaagaga

SEQ ID NO: 867307 - RNA, 19 nt, Homo sapiens
gaugauggauuguggauaa

SEQ ID NO: 867308 - RNA, 19 nt, Homo sapiens
ggauauaccucuggaauug

SEQ ID NO: 867309 - RNA, 19 nt, Homo sapiens
ggacucaaguggaaagaaa

SEQ ID NO: 867310 - RNA, 19 nt, Homo sapiens
gagcaaagacuaaauaugu

SEQ ID NO: 867311 - RNA, 19 nt, Homo sapiens
gcauuuagaucacaugaga

SEQ ID NO: 867312 - RNA, 19 nt, Homo sapiens
gaugguaaaugaacacuug

SEQ ID NO: 867313 - RNA, 19 nt, Homo sapiens
caaaguagauguggacuca

SEQ ID NO: 867314 - RNA, 19 nt, Homo sapiens
gauguggacucaaguggaa

SEQ ID NO: 867315 - RNA, 19 nt, Homo sapiens
ggauaacucuuuugcauuu

SEQ ID NO: 867316 - RNA, 19 nt, Homo sapiens
caacgcagagggcccauua

SEQ ID NO: 867317 - RNA, 19 nt, Homo sapiens
gaaagaaaugcaaagagaa

SEQ ID NO: 867318 - RNA, 19 nt, Homo sapiens
cacaaaagcugaaggauuu

SEQ ID NO: 867319 - RNA, 19 nt, Homo sapiens
aaagguuucuggcauuuga

SEQ ID NO: 867320 - RNA, 19 nt, Homo sapiens
guaucucgauuaacucuga

SEQ ID NO: 867321 - RNA, 19 nt, Homo sapiens
ggaaaggcuagguucagua

SEQ ID NO: 867322 - RNA, 19 nt, Homo sapiens
ugagagcaaagacuaaaua

SEQ ID NO: 867323 - RNA, 19 nt, Homo sapiens
gaaacugcaggacuuaaga

SEQ ID NO: 867324 - RNA, 19 nt, Homo sapiens
caauuauccuucaugucua

SEQ ID NO: 867325 - RNA, 19 nt, Homo sapiens
gcaaagacuaaauauguca

SEQ ID NO: 867326 - RNA, 19 nt, Homo sapiens
gaaaggcuagguucaguag

SEQ ID NO: 867327 - RNA, 19 nt, Homo sapiens
uucaguagaugagacauua

SEQ ID NO: 867328 - RNA, 19 nt, Homo sapiens
ggagugguuaauugaaaua

SEQ ID NO: 867329 - RNA, 19 nt, Homo sapiens
ucaauuauccuucaugucu

SEQ ID NO: 867330 - RNA, 19 nt, Homo sapiens
agacaggaaucuuuuagua

SEQ ID NO: 867331 - RNA, 19 nt, Homo sapiens
gauuuaaggcugacaggaa

SEQ ID NO: 867332 - RNA, 19 nt, Homo sapiens
cagcagaaucucaggcaua

SEQ ID NO: 867333 - RNA, 19 nt, Homo sapiens
gaauugguguuccauuugc

SEQ ID NO: 867334 - RNA, 19 nt, Homo sapiens
uaaaguuucucugaagcaa

SEQ ID NO: 867335 - RNA, 19 nt, Homo sapiens
gggagugguuaauugaaau

SEQ ID NO: 867336 - RNA, 19 nt, Homo sapiens
cagaaaaccuccaaaguag

SEQ ID NO: 867337 - RNA, 19 nt, Homo sapiens
gaugggaccguguucagaa

SEQ ID NO: 867338 - RNA, 19 nt, Homo sapiens
ucagaaaaccuccaaagua

SEQ ID NO: 867339 - RNA, 19 nt, Homo sapiens
caacaagcacgaccaugga

SEQ ID NO: 867340 - RNA, 19 nt, Homo sapiens
caggaagacugauguucau

SEQ ID NO: 867341 - RNA, 19 nt, Homo sapiens
gagagcaaagacuaaauau

SEQ ID NO: 867342 - RNA, 19 nt, Homo sapiens
aaugaguacuugauucuuc

SEQ ID NO: 867343 - RNA, 19 nt, Homo sapiens
ggauuguggauaacucuuu

SEQ ID NO: 867344 - RNA, 19 nt, Homo sapiens
caagcacgaccauggauga

SEQ ID NO: 867345 - RNA, 19 nt, Homo sapiens
ccugguaucucgauuaacu

SEQ ID NO: 867346 - RNA, 19 nt, Homo sapiens
gaaaaugauuaguguacug

SEQ ID NO: 867347 - RNA, 19 nt, Homo sapiens
aaacaaaaguacagacaga

SEQ ID NO: 867348 - RNA, 19 nt, Homo sapiens
gaaauggaagacaggaauc

SEQ ID NO: 867349 - RNA, 19 nt, Homo sapiens
caaaagguuucuggcauuu

SEQ ID NO: 867350 - RNA, 19 nt, Homo sapiens
gccagucaauuauccuuca

SEQ ID NO: 867351 - RNA, 19 nt, Homo sapiens
ucuaauguuugccaggaaa

SEQ ID NO: 867352 - RNA, 19 nt, Homo sapiens
cauucuaacuucaggaaca

SEQ ID NO: 867353 - RNA, 19 nt, Homo sapiens
gugguuaauugaaauaguc

SEQ ID NO: 867354 - RNA, 19 nt, Homo sapiens
ugauuaguguacuguuuga

SEQ ID NO: 867355 - RNA, 19 nt, Homo sapiens
gaucacaugagagcaaaga

SEQ ID NO: 867356 - RNA, 19 nt, Homo sapiens
guucagaauucacacaaaa

SEQ ID NO: 867357 - RNA, 19 nt, Homo sapiens
gggaccguguucagaauuc

SEQ ID NO: 867358 - RNA, 19 nt, Homo sapiens
uccauuugccagucaauua

SEQ ID NO: 867359 - RNA, 19 nt, Homo sapiens
gagcaagcagagagccuuu

SEQ ID NO: 867360 - RNA, 19 nt, Homo sapiens
gcaaagagaaaaugauuag

SEQ ID NO: 867361 - RNA, 19 nt, Homo sapiens
cacaugagagcaaagacua

SEQ ID NO: 867362 - RNA, 19 nt, Homo sapiens
ccaguucuguuuuaugaaa

SEQ ID NO: 867363 - RNA, 19 nt, Homo sapiens
ugaaauggaagacaggaau

SEQ ID NO: 867364 - RNA, 19 nt, Homo sapiens
ucgauuaacucugaacagu

SEQ ID NO: 867365 - RNA, 19 nt, Homo sapiens
gcggauauaccucuggaau

SEQ ID NO: 867366 - RNA, 19 nt, Homo sapiens
aaggcuagguucaguagau

SEQ ID NO: 867367 - RNA, 19 nt, Homo sapiens
cggagccuaugguucauga

SEQ ID NO: 867368 - RNA, 19 nt, Homo sapiens
ggaccguguucagaauuca

SEQ ID NO: 867369 - RNA, 19 nt, Homo sapiens
caguagaugagacauuauu

SEQ ID NO: 867370 - RNA, 19 nt, Homo sapiens
gacugauguucauggguaa

SEQ ID NO: 867371 - RNA, 19 nt, Homo sapiens
uagaucacaugagagcaaa

SEQ ID NO: 867372 - RNA, 19 nt, Homo sapiens
gaaaaccuccaaaguagau

SEQ ID NO: 867373 - RNA, 19 nt, Homo sapiens
ugagcugguucucuggauu

SEQ ID NO: 867374 - RNA, 19 nt, Homo sapiens
ugucggagccuaugguuca

SEQ ID NO: 867375 - RNA, 19 nt, Homo sapiens
ggggagugguuaauugaaa

SEQ ID NO: 867376 - RNA, 19 nt, Homo sapiens
acaggaagacugauguuca

SEQ ID NO: 867377 - RNA, 19 nt, Homo sapiens
caugagagcaaagacuaaa

SEQ ID NO: 867378 - RNA, 19 nt, Homo sapiens
gauggauuguggauaacuc

SEQ ID NO: 867379 - RNA, 19 nt, Homo sapiens
gagcugguucucuggauuc

SEQ ID NO: 867380 - RNA, 19 nt, Homo sapiens
ccauuugccagucaauuau

SEQ ID NO: 867381 - RNA, 19 nt, Homo sapiens
caaguggaaagaaaugcaa

SEQ ID NO: 867382 - RNA, 19 nt, Homo sapiens
agcagaaucucaggcauau

SEQ ID NO: 867383 - RNA, 19 nt, Homo sapiens
gugugacugugaaagagaa

SEQ ID NO: 867384 - RNA, 19 nt, Homo sapiens
agucaauuauccuucaugu

SEQ ID NO: 867385 - RNA, 19 nt, Homo sapiens
cugcaggacuuaagaagcu

SEQ ID NO: 867386 - RNA, 19 nt, Homo sapiens
aaacugcaggacuuaagaa

SEQ ID NO: 867387 - RNA, 19 nt, Homo sapiens
acaaaagguuucuggcauu

SEQ ID NO: 867388 - RNA, 19 nt, Homo sapiens
cggauauaccucuggaauu

SEQ ID NO: 867389 - RNA, 19 nt, Homo sapiens
gauuguggauaacucuuuu

SEQ ID NO: 867390 - RNA, 19 nt, Homo sapiens
gacaggaaucuuuuaguaa

SEQ ID NO: 867391 - RNA, 19 nt, Homo sapiens
gcaggacuuaagaagcuuu

SEQ ID NO: 867392 - RNA, 19 nt, Homo sapiens
aaguagauguggacucaag

SEQ ID NO: 867393 - RNA, 19 nt, Homo sapiens
ggauuuauggaugcggaua

SEQ ID NO: 867394 - RNA, 19 nt, Homo sapiens
agacagaaacaaccucaag

SEQ ID NO: 867395 - RNA, 19 nt, Homo sapiens
guacagacagaacacaaaa

SEQ ID NO: 867396 - RNA, 19 nt, Homo sapiens
auuuauggaugcggauaua

SEQ ID NO: 867397 - RNA, 19 nt, Homo sapiens
agacagaugggaccguguu

SEQ ID NO: 867398 - RNA, 19 nt, Homo sapiens
acaaaagccaguucuguuu

SEQ ID NO: 867399 - RNA, 19 nt, Homo sapiens
guagauguggacucaagug

SEQ ID NO: 867400 - RNA, 19 nt, Homo sapiens
cuacagggagacagaaaca

SEQ ID NO: 867401 - RNA, 19 nt, Homo sapiens
guucaguagaugagacauu

SEQ ID NO: 867402 - RNA, 19 nt, Homo sapiens
aggcaucauucuaacuuca

SEQ ID NO: 867403 - RNA, 19 nt, Homo sapiens
agcguuggaugaauuacaa

SEQ ID NO: 867404 - RNA, 19 nt, Homo sapiens
gaaaugcaaagagaaaaug

SEQ ID NO: 867405 - RNA, 19 nt, Homo sapiens
guggaaagaaaugcaaaga

SEQ ID NO: 867406 - RNA, 19 nt, Homo sapiens
ggaaauaaaccaacacaga

SEQ ID NO: 867407 - RNA, 19 nt, Homo sapiens
uaacaaggcuucucauaac

SEQ ID NO: 867408 - RNA, 19 nt, Homo sapiens
ccuaggcuauugacuguua

SEQ ID NO: 867409 - RNA, 19 nt, Homo sapiens
ccaaaggcaaauaaaguua

SEQ ID NO: 867410 - RNA, 19 nt, Homo sapiens
cuaacaaggcuucucauaa

SEQ ID NO: 867411 - RNA, 19 nt, Homo sapiens
gcuaacaaggcuucucaua

SEQ ID NO: 867412 - RNA, 19 nt, Homo sapiens
ggacaaggaccgugugaag

SEQ ID NO: 867413 - RNA, 19 nt, Homo sapiens
gaaaacagagcgcacaaaa

SEQ ID NO: 867414 - RNA, 19 nt, Homo sapiens
guagaaaggaccaacacaa

SEQ ID NO: 867415 - RNA, 19 nt, Homo sapiens
guuauugaguguuuaguag

SEQ ID NO: 867416 - RNA, 19 nt, Homo sapiens
gccaaaggcaaauaaaguu

SEQ ID NO: 867417 - RNA, 19 nt, Homo sapiens
gaugaaggcucggcagaac

SEQ ID NO: 867418 - RNA, 19 nt, Homo sapiens
gaaaggaccaacacaaucc

SEQ ID NO: 867419 - RNA, 19 nt, Homo sapiens
uagaaaggaccaacacaau

SEQ ID NO: 867420 - RNA, 19 nt, Homo sapiens
ggagccagccaaaggcaaa

SEQ ID NO: 867421 - RNA, 19 nt, Homo sapiens
ccaaggagccagccaaagg

SEQ ID NO: 867422 - RNA, 19 nt, Homo sapiens
gccaucggcuucccuugug

SEQ ID NO: 867423 - RNA, 19 nt, Homo sapiens
ccaacacgggcgaguauga

SEQ ID NO: 867424 - RNA, 19 nt, Homo sapiens
uaugagagccagagguuca

SEQ ID NO: 867425 - RNA, 19 nt, Homo sapiens
gggcaaggaggaaccugaa

SEQ ID NO: 867426 - RNA, 19 nt, Homo sapiens
acuguuaaguccucagguu

SEQ ID NO: 867427 - RNA, 19 nt, Homo sapiens
agaaaggaccaacacaauc

SEQ ID NO: 867428 - RNA, 19 nt, Homo sapiens
cggcuucccuugugguauc

SEQ ID NO: 867429 - RNA, 19 nt, Homo sapiens
cagcuaacaaggcuucuca

SEQ ID NO: 867430 - RNA, 19 nt, Homo sapiens
aacaaggcuucucauaaca

SEQ ID NO: 867431 - RNA, 19 nt, Homo sapiens
acaaggaccgugugaagca

SEQ ID NO: 867432 - RNA, 19 nt, Homo sapiens
gcgggacgcacauaauaca

SEQ ID NO: 867433 - RNA, 19 nt, Homo sapiens
aaauaaaccaacacagaca

SEQ ID NO: 867434 - RNA, 19 nt, Homo sapiens
gccagccaaaggcaaauaa

SEQ ID NO: 867435 - RNA, 19 nt, Homo sapiens
guuaaguccucagguuugg

SEQ ID NO: 867436 - RNA, 19 nt, Homo sapiens
gcaggagccacagcuaaca

SEQ ID NO: 867437 - RNA, 19 nt, Homo sapiens
cuccuaggcuauugacugu

SEQ ID NO: 867438 - RNA, 19 nt, Homo sapiens
cggcagaacaugcgguugu

SEQ ID NO: 867439 - RNA, 19 nt, Homo sapiens
gcaagaaccccaugaaagc

SEQ ID NO: 867440 - RNA, 19 nt, Homo sapiens
ggaccaacacaauccaaaa

SEQ ID NO: 867441 - RNA, 19 nt, Homo sapiens
ucgcaggagccacagcuaa

SEQ ID NO: 867442 - RNA, 19 nt, Homo sapiens
ggccaucggcuucccuugu

SEQ ID NO: 867443 - RNA, 19 nt, Homo sapiens
caccaaggagccagccaaa

SEQ ID NO: 867444 - RNA, 19 nt, Homo sapiens
ccucagguuuggcccagau

SEQ ID NO: 867445 - RNA, 19 nt, Homo sapiens
guccaacacgggcgaguau

SEQ ID NO: 867446 - RNA, 19 nt, Homo sapiens
ccagccaaaggcaaauaaa

SEQ ID NO: 867447 - RNA, 19 nt, Homo sapiens
gaaaugaccucaacaguga

SEQ ID NO: 867448 - RNA, 19 nt, Homo sapiens
gcagugaggugguauauaa

SEQ ID NO: 867449 - RNA, 19 nt, Homo sapiens
caggaaaucuacugaauua

SEQ ID NO: 867450 - RNA, 19 nt, Homo sapiens
gagggaagcugguuacuuu

SEQ ID NO: 867451 - RNA, 19 nt, Homo sapiens
gagcaagacuccagaauga

SEQ ID NO: 867452 - RNA, 19 nt, Homo sapiens
ccagggaucuucuauuuaa

SEQ ID NO: 867453 - RNA, 19 nt, Homo sapiens
gagcuacccuccacucuaa

SEQ ID NO: 867454 - RNA, 19 nt, Homo sapiens
ugacauagccacccaguua

SEQ ID NO: 867455 - RNA, 19 nt, Homo sapiens
ggacacagaauauaaguga

SEQ ID NO: 867456 - RNA, 19 nt, Homo sapiens
ggaauuggagccauauuaa

SEQ ID NO: 867457 - RNA, 19 nt, Homo sapiens
gcaacugacuuaaagacaa

SEQ ID NO: 867458 - RNA, 19 nt, Homo sapiens
ccacaugguugaagaguga

SEQ ID NO: 867459 - RNA, 19 nt, Homo sapiens
caacugacuuaaagacaaa

SEQ ID NO: 867460 - RNA, 19 nt, Homo sapiens
gagcaucaguccuugaaga

SEQ ID NO: 867461 - RNA, 19 nt, Homo sapiens
gaaaucuacugaauuacug

SEQ ID NO: 867462 - RNA, 19 nt, Homo sapiens
ggaaggaugugguguguac

SEQ ID NO: 867463 - RNA, 19 nt, Homo sapiens
gcacuggcuuugcuacuga

SEQ ID NO: 867464 - RNA, 19 nt, Homo sapiens
gaaccuaucaucaaaguca

SEQ ID NO: 867465 - RNA, 19 nt, Homo sapiens
gcagugggcuucuggaaag

SEQ ID NO: 867466 - RNA, 19 nt, Homo sapiens
ggaaauauuugagguugau

SEQ ID NO: 867467 - RNA, 19 nt, Homo sapiens
gcagugauguacuuaaugg

SEQ ID NO: 867468 - RNA, 19 nt, Homo sapiens
gcaagacuccagaaugaaa

SEQ ID NO: 867469 - RNA, 19 nt, Homo sapiens
ccagguaugugaugcugua

SEQ ID NO: 867470 - RNA, 19 nt, Homo sapiens
ggagagaggcacuggcuuu

SEQ ID NO: 867471 - RNA, 19 nt, Homo sapiens
ccagcaagcuuuacugcaa

SEQ ID NO: 867472 - RNA, 19 nt, Homo sapiens
gcugggaacucgcauggaa

SEQ ID NO: 867473 - RNA, 19 nt, Homo sapiens
gaggagcgcuuugcugaug

SEQ ID NO: 867474 - RNA, 19 nt, Homo sapiens
gagacaggcugacaagauc

SEQ ID NO: 867475 - RNA, 19 nt, Homo sapiens
uauauaagcuaccaacaca

SEQ ID NO: 867476 - RNA, 19 nt, Homo sapiens
gacaauggcaugcuuauuc

SEQ ID NO: 867477 - RNA, 19 nt, Homo sapiens
agaagaagguggccacaug

SEQ ID NO: 867478 - RNA, 19 nt, Homo sapiens
ggaaggagccugugauugc

SEQ ID NO: 867479 - RNA, 19 nt, Homo sapiens
gcgcuuugcugaugccauu

SEQ ID NO: 867480 - RNA, 19 nt, Homo sapiens
gauagaccaugaagcugaa

SEQ ID NO: 867481 - RNA, 19 nt, Homo sapiens
ccacuucugcuguuacaua

SEQ ID NO: 867482 - RNA, 19 nt, Homo sapiens
gguaaggccugcuucaucu

SEQ ID NO: 867483 - RNA, 19 nt, Homo sapiens
gaugugguguguaccugua

SEQ ID NO: 867484 - RNA, 19 nt, Homo sapiens
guaaagaugagcuucagaa

SEQ ID NO: 867485 - RNA, 19 nt, Homo sapiens
ucagagcccucgacuugaa

SEQ ID NO: 867486 - RNA, 19 nt, Homo sapiens
ggagccauauuaaggaaug

SEQ ID NO: 867487 - RNA, 19 nt, Homo sapiens
ugacugcuguucacccuuu

SEQ ID NO: 867488 - RNA, 19 nt, Homo sapiens
caagagccagcaagcuuua

SEQ ID NO: 867489 - RNA, 19 nt, Homo sapiens
ggccuggcauccugacaua

SEQ ID NO: 867490 - RNA, 19 nt, Homo sapiens
gcacauuggaaauauuuga

SEQ ID NO: 867491 - RNA, 19 nt, Homo sapiens
uggaguaucuauaugagaa

SEQ ID NO: 867492 - RNA, 19 nt, Homo sapiens
cuauuuaaguggcuucuga

SEQ ID NO: 867493 - RNA, 19 nt, Homo sapiens
ggaggccacuucugcuguu

SEQ ID NO: 867494 - RNA, 19 nt, Homo sapiens
ugucagagcccucgacuug

SEQ ID NO: 867495 - RNA, 19 nt, Homo sapiens
cugagaagauggaaaggaa

SEQ ID NO: 867496 - RNA, 19 nt, Homo sapiens
guacuuaauggugcaauaa

SEQ ID NO: 867497 - RNA, 19 nt, Homo sapiens
uggcuuugcuacugacaua

SEQ ID NO: 867498 - RNA, 19 nt, Homo sapiens
ccaugaagcugaaggaacu

SEQ ID NO: 867499 - RNA, 19 nt, Homo sapiens
caagggaaaugaccucaac

SEQ ID NO: 867500 - RNA, 19 nt, Homo sapiens
cagcaagcuuuacugcaaa

SEQ ID NO: 867501 - RNA, 19 nt, Homo sapiens
ggaaaucuacugaauuacu

SEQ ID NO: 867502 - RNA, 19 nt, Homo sapiens
ggcacaagcaccacugaua

SEQ ID NO: 867503 - RNA, 19 nt, Homo sapiens
uaacuugaaugugccaaug

SEQ ID NO: 867504 - RNA, 19 nt, Homo sapiens
gggacacucucaccucaug

SEQ ID NO: 867505 - RNA, 19 nt, Homo sapiens
ggccauuccuucugugaug

SEQ ID NO: 867506 - RNA, 19 nt, Homo sapiens
gggcaaagggugcaaguuc

SEQ ID NO: 867507 - RNA, 19 nt, Homo sapiens
gcacaagcaccacugauac

SEQ ID NO: 867508 - RNA, 19 nt, Homo sapiens
ccaaacacaccacaaagga

SEQ ID NO: 867509 - RNA, 19 nt, Homo sapiens
gggcuaccuucuccgauug

SEQ ID NO: 867510 - RNA, 19 nt, Homo sapiens
guucuucacucucccuaau

SEQ ID NO: 867511 - RNA, 19 nt, Homo sapiens
ccuacagggucacucagua

SEQ ID NO: 867512 - RNA, 19 nt, Homo sapiens
ccucagccuucuuugauga

SEQ ID NO: 867513 - RNA, 19 nt, Homo sapiens
ggaaguccagcauaugaga

SEQ ID NO: 867514 - RNA, 19 nt, Homo sapiens
gcaguugugugggaucuca

SEQ ID NO: 867515 - RNA, 19 nt, Homo sapiens
uggaauuggagccauauua

SEQ ID NO: 867516 - RNA, 19 nt, Homo sapiens
cucauaagcugcuggucua

SEQ ID NO: 867517 - RNA, 19 nt, Homo sapiens
uauaugagaagcucuguga

SEQ ID NO: 867518 - RNA, 19 nt, Homo sapiens
gauuggauuugcauuugug

SEQ ID NO: 867519 - RNA, 19 nt, Homo sapiens
gaauuacugucagaacaag

SEQ ID NO: 867520 - RNA, 19 nt, Homo sapiens
ccgauuggauuugcauuug

SEQ ID NO: 867521 - RNA, 19 nt, Homo sapiens
caccuauguuggagccuua

SEQ ID NO: 867522 - RNA, 19 nt, Homo sapiens
gaaauuucccgagcucugu

SEQ ID NO: 867523 - RNA, 19 nt, Homo sapiens
ucagucaagucaccacaga

SEQ ID NO: 867524 - RNA, 19 nt, Homo sapiens
gcccuugacuccaccuaug

SEQ ID NO: 867525 - RNA, 19 nt, Homo sapiens
aaacuuuggcgcuguuaaa

SEQ ID NO: 867526 - RNA, 19 nt, Homo sapiens
gaggccacuucugcuguua

SEQ ID NO: 867527 - RNA, 19 nt, Homo sapiens
uuugggaucugaauaacuu

SEQ ID NO: 867528 - RNA, 19 nt, Homo sapiens
ucauuugggaucugaauaa

SEQ ID NO: 867529 - RNA, 19 nt, Homo sapiens
ggacaauggcaugcuuauu

SEQ ID NO: 867530 - RNA, 19 nt, Homo sapiens
gaaacuuuggcgcuguuaa

SEQ ID NO: 867531 - RNA, 19 nt, Homo sapiens
gaacaagcugccagagaca

SEQ ID NO: 867532 - RNA, 19 nt, Homo sapiens
gagaggcacuggcuuugcu

SEQ ID NO: 867533 - RNA, 19 nt, Homo sapiens
agauauugauggacuccua

SEQ ID NO: 867534 - RNA, 19 nt, Homo sapiens
caaacacaccacaaaggaa

SEQ ID NO: 867535 - RNA, 19 nt, Homo sapiens
ccucaacagugacagacaa

SEQ ID NO: 867536 - RNA, 19 nt, Homo sapiens
gcaggaggccuugggauca

SEQ ID NO: 867537 - RNA, 19 nt, Homo sapiens
gcaugcuuauucuauacaa

SEQ ID NO: 867538 - RNA, 19 nt, Homo sapiens
gaaccaagagaggaaacuu

SEQ ID NO: 867539 - RNA, 19 nt, Homo sapiens
ccagcugagugccugcuuu

SEQ ID NO: 867540 - RNA, 19 nt, Homo sapiens
gauauugauggacuccuaa

SEQ ID NO: 867541 - RNA, 19 nt, Homo sapiens
gagcuggucccucagaaca

SEQ ID NO: 867542 - RNA, 19 nt, Homo sapiens
uaggauacaguaaagauga

SEQ ID NO: 867543 - RNA, 19 nt, Homo sapiens
gaaggagccugugauugcu

SEQ ID NO: 867544 - RNA, 19 nt, Homo sapiens
ucaucugccggcauuauua

SEQ ID NO: 867545 - RNA, 19 nt, Homo sapiens
ucccuucugugguuuauga

SEQ ID NO: 867546 - RNA, 19 nt, Homo sapiens
gggaucuucuauuuaagug

SEQ ID NO: 867547 - RNA, 19 nt, Homo sapiens
gaagagaacuccaaaugaa

SEQ ID NO: 867548 - RNA, 19 nt, Homo sapiens
gaaauagcauugaaagaga

SEQ ID NO: 867549 - RNA, 19 nt, Homo sapiens
gagaaagaguaucaaauga

SEQ ID NO: 867550 - RNA, 19 nt, Homo sapiens
ggagaggagucgaaguaua

SEQ ID NO: 867551 - RNA, 19 nt, Homo sapiens
gaaaggccaucaucauuca

SEQ ID NO: 867552 - RNA, 19 nt, Homo sapiens
cagcagcuauuacaugaua

SEQ ID NO: 867553 - RNA, 19 nt, Homo sapiens
caagauaugucuacaaugg

SEQ ID NO: 867554 - RNA, 19 nt, Homo sapiens
gcuaagaagccuaaacaua

SEQ ID NO: 867555 - RNA, 19 nt, Homo sapiens
ggagaaagaguaucaaaug

SEQ ID NO: 867556 - RNA, 19 nt, Homo sapiens
ccagaacaaucacaacuuu

SEQ ID NO: 867557 - RNA, 19 nt, Homo sapiens
agaagucgcucaagggaua

SEQ ID NO: 867558 - RNA, 19 nt, Homo sapiens
caaaugauguugcugacaa

SEQ ID NO: 867559 - RNA, 19 nt, Homo sapiens
cgagagagacguagaagua

SEQ ID NO: 867560 - RNA, 19 nt, Homo sapiens
gaucaacguggaaaucuua

SEQ ID NO: 867561 - RNA, 19 nt, Homo sapiens
gaacagcagcuauuacaug

SEQ ID NO: 867562 - RNA, 19 nt, Homo sapiens
gacaacaggcauauauuua

SEQ ID NO: 867563 - RNA, 19 nt, Homo sapiens
gcauaaaggugaggcuaaa

SEQ ID NO: 867564 - RNA, 19 nt, Homo sapiens
ugucacagaugaagaaauu

SEQ ID NO: 867565 - RNA, 19 nt, Homo sapiens
gagaaaggccaucaucauu

SEQ ID NO: 867566 - RNA, 19 nt, Homo sapiens
gaguagaucuccaacaauc

SEQ ID NO: 867567 - RNA, 19 nt, Homo sapiens
gaacaaccaccaggaauga

SEQ ID NO: 867568 - RNA, 19 nt, Homo sapiens
cauaagacaugauucuaga

SEQ ID NO: 867569 - RNA, 19 nt, Homo sapiens
gaaauuggagaaagaaaga

SEQ ID NO: 867570 - RNA, 19 nt, Homo sapiens
gaacagucauaagcauaaa

SEQ ID NO: 867571 - RNA, 19 nt, Homo sapiens
ggaacagucauaagcauaa

SEQ ID NO: 867572 - RNA, 19 nt, Homo sapiens
gauucaaacuucaacagaa

SEQ ID NO: 867573 - RNA, 19 nt, Homo sapiens
gaucaagguaguauacuuu

SEQ ID NO: 867574 - RNA, 19 nt, Homo sapiens
gaaacgagaaagugaaaga

SEQ ID NO: 867575 - RNA, 19 nt, Homo sapiens
acaacaacguucacaauug

SEQ ID NO: 867576 - RNA, 19 nt, Homo sapiens
ucaaaggucugguaagaag

SEQ ID NO: 867577 - RNA, 19 nt, Homo sapiens
caaacaaucaugggaauuu

SEQ ID NO: 867578 - RNA, 19 nt, Homo sapiens
gauccaagccagauugauu

SEQ ID NO: 867579 - RNA, 19 nt, Homo sapiens
ggaaggagcaguucugagu

SEQ ID NO: 867580 - RNA, 19 nt, Homo sapiens
agaagaaauuggagaaaga

SEQ ID NO: 867581 - RNA, 19 nt, Homo sapiens
cuaagaagccuaaacauag

SEQ ID NO: 867582 - RNA, 19 nt, Homo sapiens
auaaacagauggaagaaga

SEQ ID NO: 867583 - RNA, 19 nt, Homo sapiens
ggaagaagaagacacugaa

SEQ ID NO: 867584 - RNA, 19 nt, Homo sapiens
ggagaaagaaagaauggaa

SEQ ID NO: 867585 - RNA, 19 nt, Homo sapiens
aaacagaaaggguuacaaa

SEQ ID NO: 867586 - RNA, 19 nt, Homo sapiens
ugacaacaggcauauauuu

SEQ ID NO: 867587 - RNA, 19 nt, Homo sapiens
ugacacugaugaugaagaa

SEQ ID NO: 867588 - RNA, 19 nt, Homo sapiens
ggaaucugguccaaacaau

SEQ ID NO: 867589 - RNA, 19 nt, Homo sapiens
uaagaagccuaaacauagu

SEQ ID NO: 867590 - RNA, 19 nt, Homo sapiens
caacgaaagcuccugcaaa

SEQ ID NO: 867591 - RNA, 19 nt, Homo sapiens
cacagaagaugcugaagga

SEQ ID NO: 867592 - RNA, 19 nt, Homo sapiens
cgucagcguucaccuauug

SEQ ID NO: 867593 - RNA, 19 nt, Homo sapiens
gagaggagucgaaguauag

SEQ ID NO: 867594 - RNA, 19 nt, Homo sapiens
gaaagagaaagacgacgaa

SEQ ID NO: 867595 - RNA, 19 nt, Homo sapiens
gcuauuacaugauaaacag

SEQ ID NO: 867596 - RNA, 19 nt, Homo sapiens
gaagaagaagacacugaaa

SEQ ID NO: 867597 - RNA, 19 nt, Homo sapiens
gaagaaauuggagaaagaa

SEQ ID NO: 867598 - RNA, 19 nt, Homo sapiens
gaagagaaaggccaucauc

SEQ ID NO: 867599 - RNA, 19 nt, Homo sapiens
ucucaaaggucugguaaga

SEQ ID NO: 867600 - RNA, 19 nt, Homo sapiens
gaagggaugugggaucaag

SEQ ID NO: 867601 - RNA, 19 nt, Homo sapiens
cacugaugaugaagaauua

SEQ ID NO: 867602 - RNA, 19 nt, Homo sapiens
gauuucauccuccuuauug

SEQ ID NO: 867603 - RNA, 19 nt, Homo sapiens
uagucaggaugauagauua

SEQ ID NO: 867604 - RNA, 19 nt, Homo sapiens
gguagucccaguagcaaua

SEQ ID NO: 867605 - RNA, 19 nt, Homo sapiens
gcaaguagugggaaaguca

SEQ ID NO: 867606 - RNA, 19 nt, Homo sapiens
caacaggcauauauuuaac

SEQ ID NO: 867607 - RNA, 19 nt, Homo sapiens
agacguagcaggaguagaa

SEQ ID NO: 867608 - RNA, 19 nt, Homo sapiens
gaagaauuacggcaucgaa

SEQ ID NO: 867609 - RNA, 19 nt, Homo sapiens
ucaguuugguacuugauaa

SEQ ID NO: 867610 - RNA, 19 nt, Homo sapiens
gaaaaguacuaccaaagau

SEQ ID NO: 867611 - RNA, 19 nt, Homo sapiens
gguaaagauuagagauaga

SEQ ID NO: 867612 - RNA, 19 nt, Homo sapiens
ggguaaagauuagagauag

SEQ ID NO: 867613 - RNA, 19 nt, Homo sapiens
caaaugaaaccacaucagu

SEQ ID NO: 867614 - RNA, 19 nt, Homo sapiens
gcacagugacccugagaug

SEQ ID NO: 867615 - RNA, 19 nt, Homo sapiens
ugaaccaguuugacuauca

SEQ ID NO: 867616 - RNA, 19 nt, Homo sapiens
ccucagagaaguaaauuug

SEQ ID NO: 867617 - RNA, 19 nt, Homo sapiens
gagucgaaguauagauaaa

SEQ ID NO: 867618 - RNA, 19 nt, Homo sapiens
gggcuaggguaaagauuag

SEQ ID NO: 867619 - RNA, 19 nt, Homo sapiens
agcaauagcagaacuagua

SEQ ID NO: 867620 - RNA, 19 nt, Homo sapiens
cagcaaacagaaaggguua

SEQ ID NO: 867621 - RNA, 19 nt, Homo sapiens
gaaauucugcuggauguca

SEQ ID NO: 867622 - RNA, 19 nt, Homo sapiens
ggacauuguuccuccuucu

SEQ ID NO: 867623 - RNA, 19 nt, Homo sapiens
gcaaacacaagucuaaguc

SEQ ID NO: 867624 - RNA, 19 nt, Homo sapiens
gcaauagggcuaggguaaa

SEQ ID NO: 867625 - RNA, 19 nt, Homo sapiens
aacagcagcuauuacauga

SEQ ID NO: 867626 - RNA, 19 nt, Homo sapiens
gaggagaaagaguaucaaa

SEQ ID NO: 867627 - RNA, 19 nt, Homo sapiens
gcaaagcaugguagaacaa

SEQ ID NO: 867628 - RNA, 19 nt, Homo sapiens
ggagucgaaguauagauaa

SEQ ID NO: 867629 - RNA, 19 nt, Homo sapiens
gggaacagucauaagcaua

SEQ ID NO: 867630 - RNA, 19 nt, Homo sapiens
caauagggcuaggguaaag

SEQ ID NO: 867631 - RNA, 19 nt, Homo sapiens
cagaaaggguuacaaaaga

SEQ ID NO: 867632 - RNA, 19 nt, Homo sapiens
ggaugucacagaugaagaa

SEQ ID NO: 867633 - RNA, 19 nt, Homo sapiens
gaaagaaagaauggaacaa

SEQ ID NO: 867634 - RNA, 19 nt, Homo sapiens
cagaagaaauuggagaaag

SEQ ID NO: 867635 - RNA, 19 nt, Homo sapiens
gcaaagaaaagaaggcuaa

SEQ ID NO: 867636 - RNA, 19 nt, Homo sapiens
guagucaggaugauagauu

SEQ ID NO: 867637 - RNA, 19 nt, Homo sapiens
agagaaagacgacgaaauc

SEQ ID NO: 867638 - RNA, 19 nt, Homo sapiens
caccaggaaugaugccaaa

SEQ ID NO: 867639 - RNA, 19 nt, Homo sapiens
caaagaugcacaccgcaaa

SEQ ID NO: 867640 - RNA, 19 nt, Homo sapiens
agauaugucuacaauggaa

SEQ ID NO: 867641 - RNA, 19 nt, Homo sapiens
uagacaggauaguaagaaa

SEQ ID NO: 867642 - RNA, 19 nt, Homo sapiens
caaagaaagggaacgugaa

SEQ ID NO: 867643 - RNA, 19 nt, Homo sapiens
agaagagaacuccaaauga

SEQ ID NO: 867644 - RNA, 19 nt, Homo sapiens
aagaagagaacuccaaaug

SEQ ID NO: 867645 - RNA, 19 nt, Homo sapiens
acggugaugugguuaauga

SEQ ID NO: 867646 - RNA, 19 nt, Homo sapiens
gcauauauuuaaccagaac

SEQ ID NO: 867647 - RNA, 19 nt, Homo sapiens
uaaagcaucuggcucguuu

SEQ ID NO: 867648 - RNA, 19 nt, Homo sapiens
gcagagaaccuuccuauag

SEQ ID NO: 867649 - RNA, 19 nt, Homo sapiens
cagagaaccuuccuauaga

SEQ ID NO: 867650 - RNA, 19 nt, Homo sapiens
gaaggucucugaagaucug

SEQ ID NO: 867651 - RNA, 19 nt, Homo sapiens
ggacuuggcuaucguagag

SEQ ID NO: 867652 - RNA, 19 nt, Homo sapiens
cgacagaccugggcuugaa

SEQ ID NO: 867653 - RNA, 19 nt, Homo sapiens
ggagguagcccuggauuug

SEQ ID NO: 867654 - RNA, 19 nt, Homo sapiens
gaaccuuccuauagaaagu

SEQ ID NO: 867655 - RNA, 19 nt, Homo sapiens
gaacacacaugggcuuugg

SEQ ID NO: 867656 - RNA, 19 nt, Homo sapiens
gugcugagcucaaccaaag

SEQ ID NO: 867657 - RNA, 19 nt, Homo sapiens
ccuagaaggucucugaaga

SEQ ID NO: 867658 - RNA, 19 nt, Homo sapiens
ggacuacucccuauuucuu

SEQ ID NO: 867659 - RNA, 19 nt, Homo sapiens
ggacagggccuagaauugg

SEQ ID NO: 867660 - RNA, 19 nt, Homo sapiens
cauuaucccaggaaacuua

SEQ ID NO: 867661 - RNA, 19 nt, Homo sapiens
ggaugcugccugauacaua

SEQ ID NO: 867662 - RNA, 19 nt, Homo sapiens
agagaaccuuccuauagaa

SEQ ID NO: 867663 - RNA, 19 nt, Homo sapiens
ccagagccaucaccuguag

SEQ ID NO: 867664 - RNA, 19 nt, Homo sapiens
caggugacuuugacacuga

SEQ ID NO: 867665 - RNA, 19 nt, Homo sapiens
gugagggucuuuauuggau

SEQ ID NO: 867666 - RNA, 19 nt, Homo sapiens
gcaacauggugucagaucu

SEQ ID NO: 867667 - RNA, 19 nt, Homo sapiens
caacgcaaccuaccucaca

SEQ ID NO: 867668 - RNA, 19 nt, Homo sapiens
gagaaccuuccuauagaaa

SEQ ID NO: 867669 - RNA, 19 nt, Homo sapiens
gaugcugccugauacauac

SEQ ID NO: 867670 - RNA, 19 nt, Homo sapiens
gaagagccccugagcuuuu

SEQ ID NO: 867671 - RNA, 19 nt, Homo sapiens
uggccaagcugcugucuca

SEQ ID NO: 867672 - RNA, 19 nt, Homo sapiens
gacagggccuagaauugga

SEQ ID NO: 867673 - RNA, 19 nt, Homo sapiens
uacauacccugucaccauu

SEQ ID NO: 867674 - RNA, 19 nt, Homo sapiens
gagaccgccuggcucaaug

SEQ ID NO: 867675 - RNA, 19 nt, Homo sapiens
ccauggaugugccagaugu

SEQ ID NO: 867676 - RNA, 19 nt, Homo sapiens
ggaggcagcccauuaaagc

SEQ ID NO: 867677 - RNA, 19 nt, Homo sapiens
uaacgugagggucuuuauu

SEQ ID NO: 867678 - RNA, 19 nt, Homo sapiens
gcucugggccucauuuaag

SEQ ID NO: 867679 - RNA, 19 nt, Homo sapiens
uagaaggucucugaagauc

SEQ ID NO: 867680 - RNA, 19 nt, Homo sapiens
gggacagggccuagaauug

SEQ ID NO: 867681 - RNA, 19 nt, Homo sapiens
gcccuggauuugaguguga

SEQ ID NO: 867682 - RNA, 19 nt, Homo sapiens
gccagcugccggacauuua

SEQ ID NO: 867683 - RNA, 19 nt, Homo sapiens
ccucacgcaugcugaaguu

SEQ ID NO: 867684 - RNA, 19 nt, Homo sapiens
aaagauagacacagaagca

SEQ ID NO: 867685 - RNA, 19 nt, Homo sapiens
ugucaaggcuucccguucu

SEQ ID NO: 867686 - RNA, 19 nt, Homo sapiens
ggagcuggcguccuuguuc

SEQ ID NO: 867687 - RNA, 19 nt, Homo sapiens
ccugauacauacccuguca

SEQ ID NO: 867688 - RNA, 19 nt, Homo sapiens
ugagggucuuuauuggaua

SEQ ID NO: 867689 - RNA, 19 nt, Homo sapiens
gagcuggcguccuuguucu

SEQ ID NO: 867690 - RNA, 19 nt, Homo sapiens
gagguagcccuggauuuga

SEQ ID NO: 867691 - RNA, 19 nt, Homo sapiens
ggagaccgccuggcucaau

SEQ ID NO: 867692 - RNA, 19 nt, Homo sapiens
gggccucauuuaagggauu

SEQ ID NO: 867693 - RNA, 19 nt, Homo sapiens
ggcagagaaccuuccuaua

SEQ ID NO: 867694 - RNA, 19 nt, Homo sapiens
gagggucuuuauuggauag

SEQ ID NO: 867695 - RNA, 19 nt, Homo sapiens
gagaacacacaugggcuuu

SEQ ID NO: 867696 - RNA, 19 nt, Homo sapiens
ugccagugcuguguguaua

SEQ ID NO: 867697 - RNA, 19 nt, Homo sapiens
ggagcugugugagcaagug

SEQ ID NO: 867698 - RNA, 19 nt, Homo sapiens
gcaccucacgcaugcugaa

SEQ ID NO: 867699 - RNA, 19 nt, Homo sapiens
cauacccugucaccauuug

SEQ ID NO: 867700 - RNA, 19 nt, Homo sapiens
caacauggugucagaucug

SEQ ID NO: 867701 - RNA, 19 nt, Homo sapiens
ugaauugacaucagugcuu

SEQ ID NO: 867702 - RNA, 19 nt, Homo sapiens
gaccugggcaagaaacuuc

SEQ ID NO: 867703 - RNA, 19 nt, Homo sapiens
ccuggaggcagcccauuaa

SEQ ID NO: 867704 - RNA, 19 nt, Homo sapiens
caagcucugggccucauuu

SEQ ID NO: 867705 - RNA, 19 nt, Homo sapiens
gagcaugccaagccuacug

SEQ ID NO: 867706 - RNA, 19 nt, Homo sapiens
ccgcuucuguggaccaugu

SEQ ID NO: 867707 - RNA, 19 nt, Homo sapiens
gaggagguagcccuggauu

SEQ ID NO: 867708 - RNA, 19 nt, Homo sapiens
auacauacccugucaccau

SEQ ID NO: 867709 - RNA, 19 nt, Homo sapiens
ggccacaaguccucaagac

SEQ ID NO: 867710 - RNA, 19 nt, Homo sapiens
gcucuguggccuucauguu

SEQ ID NO: 867711 - RNA, 19 nt, Homo sapiens
uggcagcucaguccuagaa

SEQ ID NO: 867712 - RNA, 19 nt, Homo sapiens
auagaaagucuucgugugu

SEQ ID NO: 867713 - RNA, 19 nt, Homo sapiens
cuagaaggucucugaagau

SEQ ID NO: 867714 - RNA, 19 nt, Homo sapiens
gagcuguguccuccucaga

SEQ ID NO: 867715 - RNA, 19 nt, Homo sapiens
acagaugccaugccaagga

SEQ ID NO: 867716 - RNA, 19 nt, Homo sapiens
gccagagccaucaccugua

SEQ ID NO: 867717 - RNA, 19 nt, Homo sapiens
ggaccugggcaagaaacuu

SEQ ID NO: 867718 - RNA, 19 nt, Homo sapiens
aacgugagggucuuuauug

SEQ ID NO: 867719 - RNA, 19 nt, Homo sapiens
ucaggaagccaggcaggaa

SEQ ID NO: 867720 - RNA, 19 nt, Homo sapiens
gaguggcagcucaguccua

SEQ ID NO: 867721 - RNA, 19 nt, Homo sapiens
aaucccggcucguguucuu

SEQ ID NO: 867722 - RNA, 19 nt, Homo sapiens
aggcagagaaccuuccuau

SEQ ID NO: 867723 - RNA, 19 nt, Homo sapiens
ugggcaacauggugucaga

SEQ ID NO: 867724 - RNA, 19 nt, Homo sapiens
gccuucauguuccgaaagu

SEQ ID NO: 867725 - RNA, 19 nt, Homo sapiens
ccuauuucuugccuagaga

SEQ ID NO: 867726 - RNA, 19 nt, Homo sapiens
gacuacucccuauuucuug

SEQ ID NO: 867727 - RNA, 19 nt, Homo sapiens
gucccugugugaugcuauu

SEQ ID NO: 867728 - RNA, 19 nt, Homo sapiens
uggcuaucguagaguggua

SEQ ID NO: 867729 - RNA, 19 nt, Homo sapiens
cuacugcagccauggaugu

SEQ ID NO: 867730 - RNA, 19 nt, Homo sapiens
uagaauuggaggcagagaa

SEQ ID NO: 867731 - RNA, 19 nt, Homo sapiens
gcacagacauauuagaaga

SEQ ID NO: 867732 - RNA, 19 nt, Homo sapiens
gagcgaaacuaccgucuaa

SEQ ID NO: 867733 - RNA, 19 nt, Homo sapiens
gaaugaaagugccaaagaa

SEQ ID NO: 867734 - RNA, 19 nt, Homo sapiens
gaauggguccuguuauuua

SEQ ID NO: 867735 - RNA, 19 nt, Homo sapiens
aaacauaucuggaaacauc

SEQ ID NO: 867736 - RNA, 19 nt, Homo sapiens
gcagaugccucuuguuuua

SEQ ID NO: 867737 - RNA, 19 nt, Homo sapiens
gaaacacgcauaauacauu

SEQ ID NO: 867738 - RNA, 19 nt, Homo sapiens
ggaagaaccaucccaauca

SEQ ID NO: 867739 - RNA, 19 nt, Homo sapiens
ggagggauuccacucauua

SEQ ID NO: 867740 - RNA, 19 nt, Homo sapiens
ggaaugaaagugccaaaga

SEQ ID NO: 867741 - RNA, 19 nt, Homo sapiens
gaagaaccaucccaaucau

SEQ ID NO: 867742 - RNA, 19 nt, Homo sapiens
gcaucacacucaccaacua

SEQ ID NO: 867743 - RNA, 19 nt, Homo sapiens
caugauggauguagucuau

SEQ ID NO: 867744 - RNA, 19 nt, Homo sapiens
gcaagaagguggagaucgu

SEQ ID NO: 867745 - RNA, 19 nt, Homo sapiens
ggaauggguccuguuauuu

SEQ ID NO: 867746 - RNA, 19 nt, Homo sapiens
caugaccucugcugucuuu

SEQ ID NO: 867747 - RNA, 19 nt, Homo sapiens
guuuagaucucuccaacaa

SEQ ID NO: 867748 - RNA, 19 nt, Homo sapiens
uggaauggguccuguuauu

SEQ ID NO: 867749 - RNA, 19 nt, Homo sapiens
gaaccgggcacaacuagga

SEQ ID NO: 867750 - RNA, 19 nt, Homo sapiens
aaaggcagcucuagacauc

SEQ ID NO: 867751 - RNA, 19 nt, Homo sapiens
cgacuaaacauaucuggaa

SEQ ID NO: 867752 - RNA, 19 nt, Homo sapiens
uagcagaugccucuuguuu

SEQ ID NO: 867753 - RNA, 19 nt, Homo sapiens
gaacucggguuuuauacaa

SEQ ID NO: 867754 - RNA, 19 nt, Homo sapiens
caucacagcugcagucaac

SEQ ID NO: 867755 - RNA, 19 nt, Homo sapiens
cgacagacaaucccagaaa

SEQ ID NO: 867756 - RNA, 19 nt, Homo sapiens
cagcacaucucagugaaug

SEQ ID NO: 867757 - RNA, 19 nt, Homo sapiens
gacuaaacauaucuggaaa

SEQ ID NO: 867758 - RNA, 19 nt, Homo sapiens
aaaccaaccaccagcauuu

SEQ ID NO: 867759 - RNA, 19 nt, Homo sapiens
ugaagcaggugauguuaag

SEQ ID NO: 867760 - RNA, 19 nt, Homo sapiens
ugacucagguucccuucuu

SEQ ID NO: 867761 - RNA, 19 nt, Homo sapiens
caaggugucuccguaguca

SEQ ID NO: 867762 - RNA, 19 nt, Homo sapiens
gaaccaucccaaucauuug

SEQ ID NO: 867763 - RNA, 19 nt, Homo sapiens
cccagaaacacgcauaaua

SEQ ID NO: 867764 - RNA, 19 nt, Homo sapiens
cuacaucccuguggcuuug

SEQ ID NO: 867765 - RNA, 19 nt, Homo sapiens
gcacacacaccaccucauc

SEQ ID NO: 867766 - RNA, 19 nt, Homo sapiens
ccagaaacacgcauaauac

SEQ ID NO: 867767 - RNA, 19 nt, Homo sapiens
cgaggaacguggcauugga

SEQ ID NO: 867768 - RNA, 19 nt, Homo sapiens
cuaaacauaucuggaaaca

SEQ ID NO: 867769 - RNA, 19 nt, Homo sapiens
gagagaaaccuacaaaaug

SEQ ID NO: 867770 - RNA, 19 nt, Homo sapiens
ggacuaaggaagagcacuu

SEQ ID NO: 867771 - RNA, 19 nt, Homo sapiens
gagcuagcccagcacauga

SEQ ID NO: 867772 - RNA, 19 nt, Homo sapiens
gagcugaagcguuuagauc

SEQ ID NO: 867773 - RNA, 19 nt, Homo sapiens
agaaccaucccaaucauuu

SEQ ID NO: 867774 - RNA, 19 nt, Homo sapiens
gggcacaacuaggaacaau

SEQ ID NO: 867775 - RNA, 19 nt, Homo sapiens
ccacacacacuccuuggaa

SEQ ID NO: 867776 - RNA, 19 nt, Homo sapiens
gagaagcaguuacuuuuca

SEQ ID NO: 867777 - RNA, 19 nt, Homo sapiens
gaaaggcagcucuagacau

SEQ ID NO: 867778 - RNA, 19 nt, Homo sapiens
cagcaaagcagagaugaga

SEQ ID NO: 867779 - RNA, 19 nt, Homo sapiens
cgucuucacucaccacugu

SEQ ID NO: 867780 - RNA, 19 nt, Homo sapiens
ccacgcacuuccuguacuu

SEQ ID NO: 867781 - RNA, 19 nt, Homo sapiens
ggauuccacucauuaucug

SEQ ID NO: 867782 - RNA, 19 nt, Homo sapiens
cccuaaagcuaguccugua

SEQ ID NO: 867783 - RNA, 19 nt, Homo sapiens
gcacaacuaggaacaaugc

SEQ ID NO: 867784 - RNA, 19 nt, Homo sapiens
gacugucacugcuggagaa

SEQ ID NO: 867785 - RNA, 19 nt, Homo sapiens
gcucaucaccuggaucuau

SEQ ID NO: 867786 - RNA, 19 nt, Homo sapiens
gcucagaugauccagaaau

SEQ ID NO: 867787 - RNA, 19 nt, Homo sapiens
ggacuugggcaccgaguuc

SEQ ID NO: 867788 - RNA, 19 nt, Homo sapiens
cagucaacauccacaacua

SEQ ID NO: 867789 - RNA, 19 nt, Homo sapiens
uggcucagaugauccagaa

SEQ ID NO: 867790 - RNA, 19 nt, Homo sapiens
gcuccacaguagagagaaa

SEQ ID NO: 867791 - RNA, 19 nt, Homo sapiens
gaucuccagcuccacagua

SEQ ID NO: 867792 - RNA, 19 nt, Homo sapiens
uuugaucgcuggagggauu

SEQ ID NO: 867793 - RNA, 19 nt, Homo sapiens
ugauggauguagucuaugu

SEQ ID NO: 867794 - RNA, 19 nt, Homo sapiens
uugcugcacagacauauua

SEQ ID NO: 867795 - RNA, 19 nt, Homo sapiens
cuacaggaccaaauggaaa

SEQ ID NO: 867796 - RNA, 19 nt, Homo sapiens
ccuaugccuuuacuccuuu

SEQ ID NO: 867797 - RNA, 19 nt, Homo sapiens
gaaagcugcaggugguguu

SEQ ID NO: 867798 - RNA, 19 nt, Homo sapiens
ccgaguuccugaccuguga

SEQ ID NO: 867799 - RNA, 19 nt, Homo sapiens
gaaacaucuucuccagucu

SEQ ID NO: 867800 - RNA, 19 nt, Homo sapiens
ggagggagggaaugaaagu

SEQ ID NO: 867801 - RNA, 19 nt, Homo sapiens
gcacuacuccucccuaucc

SEQ ID NO: 867802 - RNA, 19 nt, Homo sapiens
gcccaucaaugccuccaau

SEQ ID NO: 867803 - RNA, 19 nt, Homo sapiens
gagcugacgcugucucaca

SEQ ID NO: 867804 - RNA, 19 nt, Homo sapiens
uuuaagaacucggguuuua

SEQ ID NO: 867805 - RNA, 19 nt, Homo sapiens
gccuaugccuuuacuccuu

SEQ ID NO: 867806 - RNA, 19 nt, Homo sapiens
gaugagagcgugggaacug

SEQ ID NO: 867807 - RNA, 19 nt, Homo sapiens
ggcacaugcugcugaacuu

SEQ ID NO: 867808 - RNA, 19 nt, Homo sapiens
gaucaaagagcugguagag

SEQ ID NO: 867809 - RNA, 19 nt, Homo sapiens
uaagaacucggguuuuaua

SEQ ID NO: 867810 - RNA, 19 nt, Homo sapiens
agagaaaccuacaaaaugu

SEQ ID NO: 867811 - RNA, 19 nt, Homo sapiens
gcccagcacaucucaguga

SEQ ID NO: 867812 - RNA, 19 nt, Homo sapiens
aauggguccuguuauuuau

SEQ ID NO: 867813 - RNA, 19 nt, Homo sapiens
ggagagggcagguggaacu

SEQ ID NO: 867814 - RNA, 19 nt, Homo sapiens
gcacaugaagcaggugaug

SEQ ID NO: 867815 - RNA, 19 nt, Homo sapiens
ucccugcccucuacugauu

SEQ ID NO: 867816 - RNA, 19 nt, Homo sapiens
cagaaacacgcauaauaca

SEQ ID NO: 867817 - RNA, 19 nt, Homo sapiens
gauggugacagccucuauu

SEQ ID NO: 867818 - RNA, 19 nt, Homo sapiens
ucagaugauccagaaauuu

SEQ ID NO: 867819 - RNA, 19 nt, Homo sapiens
caaggcaacgccagcaaga

SEQ ID NO: 867820 - RNA, 19 nt, Homo sapiens
caagacccaucucccuagu

SEQ ID NO: 867821 - RNA, 19 nt, Homo sapiens
gcaggugguguuuggagaa

SEQ ID NO: 867822 - RNA, 19 nt, Homo sapiens
ucagauccacuaugcaaga

SEQ ID NO: 867823 - RNA, 19 nt, Homo sapiens
gacagacaaucccagaaac

SEQ ID NO: 867824 - RNA, 19 nt, Homo sapiens
gcaucacccugcacuacuc

SEQ ID NO: 867825 - RNA, 19 nt, Homo sapiens
ucaccuacauccucaacca

SEQ ID NO: 867826 - RNA, 19 nt, Homo sapiens
gcgguagucugcacaacag

SEQ ID NO: 867827 - RNA, 19 nt, Homo sapiens
gcacaugcugcugaacuug

SEQ ID NO: 867828 - RNA, 19 nt, Homo sapiens
gcuggcacaugcugcugaa

SEQ ID NO: 867829 - RNA, 19 nt, Homo sapiens
ucaucaagccgcacagcua

SEQ ID NO: 867830 - RNA, 19 nt, Homo sapiens
aaugaaagugccaaagaaa

SEQ ID NO: 867831 - RNA, 19 nt, Homo sapiens
ugaaagauaugcagagaua

SEQ ID NO: 867832 - RNA, 19 nt, Homo sapiens
gaagaaagcagaauuuguu

SEQ ID NO: 867833 - RNA, 19 nt, Homo sapiens
ggacauugcacuuaucuua

SEQ ID NO: 867834 - RNA, 19 nt, Homo sapiens
ggagacaucugagagaaua

SEQ ID NO: 867835 - RNA, 19 nt, Homo sapiens
gcaaacaacucagguuauu

SEQ ID NO: 867836 - RNA, 19 nt, Homo sapiens
ccaauucucuaccaaauaa

SEQ ID NO: 867837 - RNA, 19 nt, Homo sapiens
gaucugaaauggaaucuug

SEQ ID NO: 867838 - RNA, 19 nt, Homo sapiens
caacugcacuucugauuau

SEQ ID NO: 867839 - RNA, 19 nt, Homo sapiens
gguaaagguugacuuaauu

SEQ ID NO: 867840 - RNA, 19 nt, Homo sapiens
agaaagaucugaaauggaa

SEQ ID NO: 867841 - RNA, 19 nt, Homo sapiens
gggaacaucuuaacuguau

SEQ ID NO: 867842 - RNA, 19 nt, Homo sapiens
guagugcucugcauaguuu

SEQ ID NO: 867843 - RNA, 19 nt, Homo sapiens
gcaguuaucuggagacauc

SEQ ID NO: 867844 - RNA, 19 nt, Homo sapiens
gaauaucgauaacuugaug

SEQ ID NO: 867845 - RNA, 19 nt, Homo sapiens
gaaagcagaauuuguuuga

SEQ ID NO: 867846 - RNA, 19 nt, Homo sapiens
gcacuuaucuuaccaagcu

SEQ ID NO: 867847 - RNA, 19 nt, Homo sapiens
ggaguacuauuccaaagaa

SEQ ID NO: 867848 - RNA, 19 nt, Homo sapiens
gacaaauucuuaacucuga

SEQ ID NO: 867849 - RNA, 19 nt, Homo sapiens
caaaguugcuccaagaaau

SEQ ID NO: 867850 - RNA, 19 nt, Homo sapiens
gaugaucaguugaaaucua

SEQ ID NO: 867851 - RNA, 19 nt, Homo sapiens
caggagagcuugcaucuuc

SEQ ID NO: 867852 - RNA, 19 nt, Homo sapiens
gcacaagcaugagaccuuu

SEQ ID NO: 867853 - RNA, 19 nt, Homo sapiens
gaagaaccaagacuacuaa

SEQ ID NO: 867854 - RNA, 19 nt, Homo sapiens
ggauagugaugaacagaaa

SEQ ID NO: 867855 - RNA, 19 nt, Homo sapiens
cuucagcgcuuguuacuuu

SEQ ID NO: 867856 - RNA, 19 nt, Homo sapiens
uauuaaugcugcagaguua

SEQ ID NO: 867857 - RNA, 19 nt, Homo sapiens
ggacuacccuucacagagu

SEQ ID NO: 867858 - RNA, 19 nt, Homo sapiens
caaaagagcucauguugug

SEQ ID NO: 867859 - RNA, 19 nt, Homo sapiens
ugagaacuguguuggauuu

SEQ ID NO: 867860 - RNA, 19 nt, Homo sapiens
ggacaugcguguuccuuca

SEQ ID NO: 867861 - RNA, 19 nt, Homo sapiens
ggaagaaccaagacuacua

SEQ ID NO: 867862 - RNA, 19 nt, Homo sapiens
uuagauaucuucacaguca

SEQ ID NO: 867863 - RNA, 19 nt, Homo sapiens
guagaagacuugcaaagca

SEQ ID NO: 867864 - RNA, 19 nt, Homo sapiens
cagaaucucuucagaaucu

SEQ ID NO: 867865 - RNA, 19 nt, Homo sapiens
gaucaggacauugcacuua

SEQ ID NO: 867866 - RNA, 19 nt, Homo sapiens
ucacagaguuacuacuauu

SEQ ID NO: 867867 - RNA, 19 nt, Homo sapiens
cuacaggacucaacacaga

SEQ ID NO: 867868 - RNA, 19 nt, Homo sapiens
gaacaagaggcuccaguug

SEQ ID NO: 867869 - RNA, 19 nt, Homo sapiens
gcauguggaugacuuuguu

SEQ ID NO: 867870 - RNA, 19 nt, Homo sapiens
uauacgaccucaugauauu

SEQ ID NO: 867871 - RNA, 19 nt, Homo sapiens
ucacggacgaugaguauua

SEQ ID NO: 867872 - RNA, 19 nt, Homo sapiens
agagggagcucauacauca

SEQ ID NO: 867873 - RNA, 19 nt, Homo sapiens
gaaggaauggacacguuua

SEQ ID NO: 867874 - RNA, 19 nt, Homo sapiens
gcaucucucuugaagcuuu

SEQ ID NO: 867875 - RNA, 19 nt, Homo sapiens
gguauacgaccucaugaua

SEQ ID NO: 867876 - RNA, 19 nt, Homo sapiens
gaugaaagauaugcagaga

SEQ ID NO: 867877 - RNA, 19 nt, Homo sapiens
gaaccaagacuacuaaagg

SEQ ID NO: 867878 - RNA, 19 nt, Homo sapiens
gaacuguguuggauuugau

SEQ ID NO: 867879 - RNA, 19 nt, Homo sapiens
agaagucaguagcuuauaa

SEQ ID NO: 867880 - RNA, 19 nt, Homo sapiens
ccugagagguggauccuuu

SEQ ID NO: 867881 - RNA, 19 nt, Homo sapiens
gaacuagagaagcuuguuu

SEQ ID NO: 867882 - RNA, 19 nt, Homo sapiens
gucaguagcuuauaauuac

SEQ ID NO: 867883 - RNA, 19 nt, Homo sapiens
ccaacgauggcacgaauua

SEQ ID NO: 867884 - RNA, 19 nt, Homo sapiens
uaacugcaucccaaacuua

SEQ ID NO: 867885 - RNA, 19 nt, Homo sapiens
gaacccugcacaaucuuua

SEQ ID NO: 867886 - RNA, 19 nt, Homo sapiens
caaaguaucacagaagauu

SEQ ID NO: 867887 - RNA, 19 nt, Homo sapiens
acuaaaggauucaaacuug

SEQ ID NO: 867888 - RNA, 19 nt, Homo sapiens
gaaccaucaucuccaggaa

SEQ ID NO: 867889 - RNA, 19 nt, Homo sapiens
aaacaacucagguuauuga

SEQ ID NO: 867890 - RNA, 19 nt, Homo sapiens
aaagaagccuugggugauu

SEQ ID NO: 867891 - RNA, 19 nt, Homo sapiens
aaggaccaauuuagacuua

SEQ ID NO: 867892 - RNA, 19 nt, Homo sapiens
caugagaccuuuauaacgu

SEQ ID NO: 867893 - RNA, 19 nt, Homo sapiens
caauuuagacuuagcaguu

SEQ ID NO: 867894 - RNA, 19 nt, Homo sapiens
gaacauuucacgaggacaa

SEQ ID NO: 867895 - RNA, 19 nt, Homo sapiens
cgaggaaauuacaaugaaa

SEQ ID NO: 867896 - RNA, 19 nt, Homo sapiens
agagcaugauuauggauua

SEQ ID NO: 867897 - RNA, 19 nt, Homo sapiens
ucacagucaucacuucuug

SEQ ID NO: 867898 - RNA, 19 nt, Homo sapiens
agaauuagagcgcucauuu

SEQ ID NO: 867899 - RNA, 19 nt, Homo sapiens
uaaaacagcuucuacaaag

SEQ ID NO: 867900 - RNA, 19 nt, Homo sapiens
cgaguggucagcacauuua

SEQ ID NO: 867901 - RNA, 19 nt, Homo sapiens
ccaacugcacuucugauua

SEQ ID NO: 867902 - RNA, 19 nt, Homo sapiens
ccaaucugaugguguuauu

SEQ ID NO: 867903 - RNA, 19 nt, Homo sapiens
ucaagaggaaaguuuguua

SEQ ID NO: 867904 - RNA, 19 nt, Homo sapiens
ggacacguuuauucgaguu

SEQ ID NO: 867905 - RNA, 19 nt, Homo sapiens
gaaggucuccaaucugaug

SEQ ID NO: 867906 - RNA, 19 nt, Homo sapiens
caaagaagaaaguccagaa

SEQ ID NO: 867907 - RNA, 19 nt, Homo sapiens
guggauccuuugaguuuaa

SEQ ID NO: 867908 - RNA, 19 nt, Homo sapiens
aggaaggucuccaaucuga

SEQ ID NO: 867909 - RNA, 19 nt, Homo sapiens
gaaguuucuugcacaguca

SEQ ID NO: 867910 - RNA, 19 nt, Homo sapiens
ugauuugcacucagaauua

SEQ ID NO: 867911 - RNA, 19 nt, Homo sapiens
gaagagauagauacagauc

SEQ ID NO: 867912 - RNA, 19 nt, Homo sapiens
cugaagagauagauacaga

SEQ ID NO: 867913 - RNA, 19 nt, Homo sapiens
uuauuaaccuccuagaaga

SEQ ID NO: 867914 - RNA, 19 nt, Homo sapiens
cguguucucuguaauguug

SEQ ID NO: 867915 - RNA, 19 nt, Homo sapiens
ugguagaggucgucaugua

SEQ ID NO: 867916 - RNA, 19 nt, Homo sapiens
ucgaggaaauuacaaugaa

SEQ ID NO: 867917 - RNA, 19 nt, Homo sapiens
ggaacaagaggcuccaguu

SEQ ID NO: 867918 - RNA, 19 nt, Homo sapiens
auacagaucuggauuuggu

SEQ ID NO: 867919 - RNA, 19 nt, Homo sapiens
gcguauuuguguucaauug

SEQ ID NO: 867920 - RNA, 19 nt, Homo sapiens
gagacucuggccaauaaua

SEQ ID NO: 867921 - RNA, 19 nt, Homo sapiens
gguggauccuuugaguuua

SEQ ID NO: 867922 - RNA, 19 nt, Homo sapiens
uagaaaggcuuauuaaccu

SEQ ID NO: 867923 - RNA, 19 nt, Homo sapiens
ggaacaucuuaacuguaua

SEQ ID NO: 867924 - RNA, 19 nt, Homo sapiens
caagacuacuaaaggauuc

SEQ ID NO: 867925 - RNA, 19 nt, Homo sapiens
gagacaaauucuuaacucu

SEQ ID NO: 867926 - RNA, 19 nt, Homo sapiens
gagcuugcaucuucauuuu

SEQ ID NO: 867927 - RNA, 19 nt, Homo sapiens
gaccuugccucaccaacug

SEQ ID NO: 867928 - RNA, 19 nt, Homo sapiens
acacaaggaguuaaugaaa

SEQ ID NO: 867929 - RNA, 19 nt, Homo sapiens
cacacucacucuucuuaaa

SEQ ID NO: 867930 - RNA, 19 nt, Homo sapiens
gaucagcuguuggccaugu

SEQ ID NO: 867931 - RNA, 19 nt, Homo sapiens
gaacaaaccuuaccuuuau

SEQ ID NO: 867932 - RNA, 19 nt, Homo sapiens
gaacugcagugaacucuuu

SEQ ID NO: 867933 - RNA, 19 nt, Homo sapiens
ggaacaaaccuuaccuuua

SEQ ID NO: 867934 - RNA, 19 nt, Homo sapiens
ucuacgagcuucuuauuua

SEQ ID NO: 867935 - RNA, 19 nt, Homo sapiens
gaacuguaaugcuucagaa

SEQ ID NO: 867936 - RNA, 19 nt, Homo sapiens
gcagagaggugcuccaagu

SEQ ID NO: 867937 - RNA, 19 nt, Homo sapiens
gggaagauuugcaguuaaa

SEQ ID NO: 867938 - RNA, 19 nt, Homo sapiens
gagaauggaacaaaccuua

SEQ ID NO: 867939 - RNA, 19 nt, Homo sapiens
gacuaucccuugaugauuu

SEQ ID NO: 867940 - RNA, 19 nt, Homo sapiens
aauauaaccugguaucuga

SEQ ID NO: 867941 - RNA, 19 nt, Homo sapiens
cagaagaaguagaguugua

SEQ ID NO: 867942 - RNA, 19 nt, Homo sapiens
gcaaugacauccugaucug

SEQ ID NO: 867943 - RNA, 19 nt, Homo sapiens
gaaguagaguuguauuugg

SEQ ID NO: 867944 - RNA, 19 nt, Homo sapiens
gagaacaucuuacugaaaa

SEQ ID NO: 867945 - RNA, 19 nt, Homo sapiens
gcaggagcccucuaucuuu

SEQ ID NO: 867946 - RNA, 19 nt, Homo sapiens
caagaugcaccauacauuu

SEQ ID NO: 867947 - RNA, 19 nt, Homo sapiens
ggaaauaucaaacaucauc

SEQ ID NO: 867948 - RNA, 19 nt, Homo sapiens
gaaaagcgcugauuguuac

SEQ ID NO: 867949 - RNA, 19 nt, Homo sapiens
cagcauccauuguguuuau

SEQ ID NO: 867950 - RNA, 19 nt, Homo sapiens
gaagcacucuauuucuguu

SEQ ID NO: 867951 - RNA, 19 nt, Homo sapiens
ggugauguguauuguauau

SEQ ID NO: 867952 - RNA, 19 nt, Homo sapiens
ugaccugucuuugaauaua

SEQ ID NO: 867953 - RNA, 19 nt, Homo sapiens
agacugaucuugcuuccuu

SEQ ID NO: 867954 - RNA, 19 nt, Homo sapiens
gcaagaugcaccauacauu

SEQ ID NO: 867955 - RNA, 19 nt, Homo sapiens
uagaggaacuguaaugcuu

SEQ ID NO: 867956 - RNA, 19 nt, Homo sapiens
ggaaauuguuaacuaccuu

SEQ ID NO: 867957 - RNA, 19 nt, Homo sapiens
gaccugucuuugaauauaa

SEQ ID NO: 867958 - RNA, 19 nt, Homo sapiens
gagcaacugccuguaauuu

SEQ ID NO: 867959 - RNA, 19 nt, Homo sapiens
gaacccaauggaaauagua

SEQ ID NO: 867960 - RNA, 19 nt, Homo sapiens
cagauguacuuuaaagaga

SEQ ID NO: 867961 - RNA, 19 nt, Homo sapiens
uaacaaagcacaggaagau

SEQ ID NO: 867962 - RNA, 19 nt, Homo sapiens
ggauguucaugcaacuuaa

SEQ ID NO: 867963 - RNA, 19 nt, Homo sapiens
gaagauuugcaguuaaaga

SEQ ID NO: 867964 - RNA, 19 nt, Homo sapiens
gaagggguccucagaguua

SEQ ID NO: 867965 - RNA, 19 nt, Homo sapiens
gguaucugguauugguuua

SEQ ID NO: 867966 - RNA, 19 nt, Homo sapiens
guaaggaaugggaagauuu

SEQ ID NO: 867967 - RNA, 19 nt, Homo sapiens
cgaaugaucacacacuuug

SEQ ID NO: 867968 - RNA, 19 nt, Homo sapiens
ugaaguggguagaagagaa

SEQ ID NO: 867969 - RNA, 19 nt, Homo sapiens
caagaacccaauggaaaua

SEQ ID NO: 867970 - RNA, 19 nt, Homo sapiens
gagaaguaccaaacaagaa

SEQ ID NO: 867971 - RNA, 19 nt, Homo sapiens
gagccuaugcugaaagaaa

SEQ ID NO: 867972 - RNA, 19 nt, Homo sapiens
ugaagacuaucccuugaug

SEQ ID NO: 867973 - RNA, 19 nt, Homo sapiens
gauuggugcugucaucuuc

SEQ ID NO: 867974 - RNA, 19 nt, Homo sapiens
uaccaugacuguugaagug

SEQ ID NO: 867975 - RNA, 19 nt, Homo sapiens
caugaaccauugcaaacuu

SEQ ID NO: 867976 - RNA, 19 nt, Homo sapiens
acaggaagaugauuugaag

SEQ ID NO: 867977 - RNA, 19 nt, Homo sapiens
augaauaccucacacuuga

SEQ ID NO: 867978 - RNA, 19 nt, Homo sapiens
gaagaaguagaguuguauu

SEQ ID NO: 867979 - RNA, 19 nt, Homo sapiens
cgagaggugucagaacaaa

SEQ ID NO: 867980 - RNA, 19 nt, Homo sapiens
guacggcuccaugggauua

SEQ ID NO: 867981 - RNA, 19 nt, Homo sapiens
ggaaugaaaaugagaagua

SEQ ID NO: 867982 - RNA, 19 nt, Homo sapiens
gcagugaacucuuuaaaac

SEQ ID NO: 867983 - RNA, 19 nt, Homo sapiens
ugggaaauaucaaacauca

SEQ ID NO: 867984 - RNA, 19 nt, Homo sapiens
gaauauaaccugguaucug

SEQ ID NO: 867985 - RNA, 19 nt, Homo sapiens
gacugcugcucguucuuua

SEQ ID NO: 867986 - RNA, 19 nt, Homo sapiens
ggacugcugcucguucuuu

SEQ ID NO: 867987 - RNA, 19 nt, Homo sapiens
uuaaggagccauaguucua

SEQ ID NO: 867988 - RNA, 19 nt, Homo sapiens
ggcgagaggugucagaaca

SEQ ID NO: 867989 - RNA, 19 nt, Homo sapiens
agaaagcuuugaaggaaug

SEQ ID NO: 867990 - RNA, 19 nt, Homo sapiens
guagaguuguauuuggaaa

SEQ ID NO: 867991 - RNA, 19 nt, Homo sapiens
gguguugccugucauucuu

SEQ ID NO: 867992 - RNA, 19 nt, Homo sapiens
aggauggacuguucuggua

SEQ ID NO: 867993 - RNA, 19 nt, Homo sapiens
aaacaagaacccaauggaa

SEQ ID NO: 867994 - RNA, 19 nt, Homo sapiens
uuuauuagccugacucaaa

SEQ ID NO: 867995 - RNA, 19 nt, Homo sapiens
uaugcggaauuucagaaua

SEQ ID NO: 867996 - RNA, 19 nt, Homo sapiens
aaacaguuauugcaugaag

SEQ ID NO: 867997 - RNA, 19 nt, Homo sapiens
gaggaacuguaaugcuuca

SEQ ID NO: 867998 - RNA, 19 nt, Homo sapiens
gcugguggauauuuauuag

SEQ ID NO: 867999 - RNA, 19 nt, Homo sapiens
ucaugcaacuuaagugugu

SEQ ID NO: 868000 - RNA, 19 nt, Homo sapiens
gaacgaaugaucacacacu

SEQ ID NO: 868001 - RNA, 19 nt, Homo sapiens
acaaagcacaggaagauga

SEQ ID NO: 868002 - RNA, 19 nt, Homo sapiens
gaaguuugauggagaaccu

SEQ ID NO: 868003 - RNA, 19 nt, Homo sapiens
gauccucuuugucaucaug

SEQ ID NO: 868004 - RNA, 19 nt, Homo sapiens
gaacccuggucaucauagu

SEQ ID NO: 868005 - RNA, 19 nt, Homo sapiens
ggugaugggauucauuuga

SEQ ID NO: 868006 - RNA, 19 nt, Homo sapiens
guucugguaucugguauug

SEQ ID NO: 868007 - RNA, 19 nt, Homo sapiens
uaaggaaugggaagauuug

SEQ ID NO: 868008 - RNA, 19 nt, Homo sapiens
gaugaggaacgaaugauca

SEQ ID NO: 868009 - RNA, 19 nt, Homo sapiens
guaaaacucucuuuguauc

SEQ ID NO: 868010 - RNA, 19 nt, Homo sapiens
ugugaccugucuuugaaua

SEQ ID NO: 868011 - RNA, 19 nt, Homo sapiens
gaguuaaggagccauaguu

SEQ ID NO: 868012 - RNA, 19 nt, Homo sapiens
cuugugaccugucuuugaa

SEQ ID NO: 868013 - RNA, 19 nt, Homo sapiens
uagccugacucaaacaaug

SEQ ID NO: 868014 - RNA, 19 nt, Homo sapiens
ccucacacuugaagacuau

SEQ ID NO: 868015 - RNA, 19 nt, Homo sapiens
gcacucuauuucuguuuua

SEQ ID NO: 868016 - RNA, 19 nt, Homo sapiens
gcaggguccuuaggcaaug

SEQ ID NO: 868017 - RNA, 19 nt, Homo sapiens
gaagucaagguuacaucuu

SEQ ID NO: 868018 - RNA, 19 nt, Homo sapiens
ugucaucaacaccauaaua

SEQ ID NO: 868019 - RNA, 19 nt, Homo sapiens
ggauucagaugaggaacga

SEQ ID NO: 868020 - RNA, 19 nt, Homo sapiens
gaaguggguagaagagaau

SEQ ID NO: 868021 - RNA, 19 nt, Homo sapiens
caaacaagaacccaaugga

SEQ ID NO: 868022 - RNA, 19 nt, Homo sapiens
aaugagaaguaccaaacaa

SEQ ID NO: 868023 - RNA, 19 nt, Homo sapiens
aaacuucggaggaacauug

SEQ ID NO: 868024 - RNA, 19 nt, Homo sapiens
ugucuucuaugcggaauuu

SEQ ID NO: 868025 - RNA, 19 nt, Homo sapiens
augggaagauuugcaguua

SEQ ID NO: 868026 - RNA, 19 nt, Homo sapiens
ggcagaagaaguagaguug

SEQ ID NO: 868027 - RNA, 19 nt, Homo sapiens
ucagaaauaccacuaucuu

SEQ ID NO: 868028 - RNA, 19 nt, Homo sapiens
cagcaucugugucagucuu

SEQ ID NO: 868029 - RNA, 19 nt, Homo sapiens
aacaagaacccaauggaaa

SEQ ID NO: 868030 - RNA, 19 nt, Homo sapiens
aaaggagccuaugcugaaa

SEQ ID NO: 868031 - RNA, 19 nt, Homo sapiens
gggaagagcugcugaguuu

SEQ ID NO: 868032 - RNA, 19 nt, Homo sapiens
gaagugggcuguagcuauu

SEQ ID NO: 868033 - RNA, 19 nt, Homo sapiens
gcucaaggcugcacaguug

SEQ ID NO: 868034 - RNA, 19 nt, Homo sapiens
guaauucucucaacauuuc

SEQ ID NO: 868035 - RNA, 19 nt, Homo sapiens
gagaacacguuugugguua

SEQ ID NO: 868036 - RNA, 19 nt, Homo sapiens
gaagguccauccgaguaua

SEQ ID NO: 868037 - RNA, 19 nt, Homo sapiens
gagaggacguggaauuugu

SEQ ID NO: 868038 - RNA, 19 nt, Homo sapiens
ccugggaccucauuccuua

SEQ ID NO: 868039 - RNA, 19 nt, Homo sapiens
ggacagggacuaugaagug

SEQ ID NO: 868040 - RNA, 19 nt, Homo sapiens
aagauaacaucgcucauaa

SEQ ID NO: 868041 - RNA, 19 nt, Homo sapiens
caagauaacaucgcucaua

SEQ ID NO: 868042 - RNA, 19 nt, Homo sapiens
gaaacugagucaccagcuu

SEQ ID NO: 868043 - RNA, 19 nt, Homo sapiens
gaagucgccuggaguucuu

SEQ ID NO: 868044 - RNA, 19 nt, Homo sapiens
ggacagaggaggccgaaau

SEQ ID NO: 868045 - RNA, 19 nt, Homo sapiens
gagcuucgguuuccucauc

SEQ ID NO: 868046 - RNA, 19 nt, Homo sapiens
gggaagggcugucaguuac

SEQ ID NO: 868047 - RNA, 19 nt, Homo sapiens
gaagagcugcugaguuuca

SEQ ID NO: 868048 - RNA, 19 nt, Homo sapiens
ggaagugugacaugaauau

SEQ ID NO: 868049 - RNA, 19 nt, Homo sapiens
ccaaagagaggcaagagaa

SEQ ID NO: 868050 - RNA, 19 nt, Homo sapiens
ggagccaucugagcuugua

SEQ ID NO: 868051 - RNA, 19 nt, Homo sapiens
ggagggaucauuagcuuug

SEQ ID NO: 868052 - RNA, 19 nt, Homo sapiens
ggagaacacguuugugguu

SEQ ID NO: 868053 - RNA, 19 nt, Homo sapiens
cacaugaccugucccuuga

SEQ ID NO: 868054 - RNA, 19 nt, Homo sapiens
gaagggauaccaaagaagu

SEQ ID NO: 868055 - RNA, 19 nt, Homo sapiens
gcugucaccuuccaguauu

SEQ ID NO: 868056 - RNA, 19 nt, Homo sapiens
gauuguuucucguugguuu

SEQ ID NO: 868057 - RNA, 19 nt, Homo sapiens
uaaggugguuguuguuguu

SEQ ID NO: 868058 - RNA, 19 nt, Homo sapiens
ccaaagaagugggcuguag

SEQ ID NO: 868059 - RNA, 19 nt, Homo sapiens
ggagauugguuugcacuuc

SEQ ID NO: 868060 - RNA, 19 nt, Homo sapiens
aaacugagucaccagcuua

SEQ ID NO: 868061 - RNA, 19 nt, Homo sapiens
aaagauggacucaccguuu

SEQ ID NO: 868062 - RNA, 19 nt, Homo sapiens
ggaaagguaagauaaccaa

SEQ ID NO: 868063 - RNA, 19 nt, Homo sapiens
ggucagcuuucaagacaau

SEQ ID NO: 868064 - RNA, 19 nt, Homo sapiens
gggaggagcgcuaacaaga

SEQ ID NO: 868065 - RNA, 19 nt, Homo sapiens
ggaauuuguucaagauaac

SEQ ID NO: 868066 - RNA, 19 nt, Homo sapiens
gcuccuccuuucucuaauu

SEQ ID NO: 868067 - RNA, 19 nt, Homo sapiens
ccagugauguuguccuugu

SEQ ID NO: 868068 - RNA, 19 nt, Homo sapiens
gcggagauuucgccacaug

SEQ ID NO: 868069 - RNA, 19 nt, Homo sapiens
ggacguggaauuuguucaa

SEQ ID NO: 868070 - RNA, 19 nt, Homo sapiens
gcucagagaggacguggaa

SEQ ID NO: 868071 - RNA, 19 nt, Homo sapiens
caaagagaggcaagagaaa

SEQ ID NO: 868072 - RNA, 19 nt, Homo sapiens
gagcuguccugccugaauc

SEQ ID NO: 868073 - RNA, 19 nt, Homo sapiens
gaggcaggcucucuaaggu

SEQ ID NO: 868074 - RNA, 19 nt, Homo sapiens
gaagggcugucaguuacau

SEQ ID NO: 868075 - RNA, 19 nt, Homo sapiens
gaacacguuugugguuaag

SEQ ID NO: 868076 - RNA, 19 nt, Homo sapiens
agaacacguuugugguuaa

SEQ ID NO: 868077 - RNA, 19 nt, Homo sapiens
gcugggcccuucucgauca

SEQ ID NO: 868078 - RNA, 19 nt, Homo sapiens
gaccugagccaacccaguu

SEQ ID NO: 868079 - RNA, 19 nt, Homo sapiens
gauaacaucgcucauaagg

SEQ ID NO: 868080 - RNA, 19 nt, Homo sapiens
ucagagaggacguggaauu

SEQ ID NO: 868081 - RNA, 19 nt, Homo sapiens
gggcuccuccuuucucuaa

SEQ ID NO: 868082 - RNA, 19 nt, Homo sapiens
ccaguacuccuucguguga

SEQ ID NO: 868083 - RNA, 19 nt, Homo sapiens
gagauugguuugcacuucu

SEQ ID NO: 868084 - RNA, 19 nt, Homo sapiens
ucagggaaagguaagauaa

SEQ ID NO: 868085 - RNA, 19 nt, Homo sapiens
gcauccauccucauuaaug

SEQ ID NO: 868086 - RNA, 19 nt, Homo sapiens
cugaagggauaccaaagaa

SEQ ID NO: 868087 - RNA, 19 nt, Homo sapiens
gagccaaggguuguaaauu

SEQ ID NO: 868088 - RNA, 19 nt, Homo sapiens
gaauacguccucaccuuca

SEQ ID NO: 868089 - RNA, 19 nt, Homo sapiens
cugcaucuccugauuguuu

SEQ ID NO: 868090 - RNA, 19 nt, Homo sapiens
ggaccucauuccuuacaag

SEQ ID NO: 868091 - RNA, 19 nt, Homo sapiens
ggaagguccauccgaguau

SEQ ID NO: 868092 - RNA, 19 nt, Homo sapiens
ggaaacagcaacuccaacu

SEQ ID NO: 868093 - RNA, 19 nt, Homo sapiens
ggggugaucuggaaaaguu

SEQ ID NO: 868094 - RNA, 19 nt, Homo sapiens
caagugggagccucuagaa

SEQ ID NO: 868095 - RNA, 19 nt, Homo sapiens
augcauccauccucauuaa

SEQ ID NO: 868096 - RNA, 19 nt, Homo sapiens
cagagaggacguggaauuu

SEQ ID NO: 868097 - RNA, 19 nt, Homo sapiens
agccaaggguuguaaauuc

SEQ ID NO: 868098 - RNA, 19 nt, Homo sapiens
ugaggucgcugaggguuug

SEQ ID NO: 868099 - RNA, 19 nt, Homo sapiens
acauuaaggugguuguugu

SEQ ID NO: 868100 - RNA, 19 nt, Homo sapiens
aagguaagauaaccaagug

SEQ ID NO: 868101 - RNA, 19 nt, Homo sapiens
gcucugccacuuucuaguu

SEQ ID NO: 868102 - RNA, 19 nt, Homo sapiens
gaggaagucgccuggaguu

SEQ ID NO: 868103 - RNA, 19 nt, Homo sapiens
gaagugugacaugaauauu

SEQ ID NO: 868104 - RNA, 19 nt, Homo sapiens
gcccuggucugacucaagu

SEQ ID NO: 868105 - RNA, 19 nt, Homo sapiens
ggagcgagugacuguguaa

SEQ ID NO: 868106 - RNA, 19 nt, Homo sapiens
aaucccagcuccucucuag

SEQ ID NO: 868107 - RNA, 19 nt, Homo sapiens
cagaagagaaacugaguca

SEQ ID NO: 868108 - RNA, 19 nt, Homo sapiens
ccauguaauucucucaaca

SEQ ID NO: 868109 - RNA, 19 nt, Homo sapiens
gagaggcucccgucacaca

SEQ ID NO: 868110 - RNA, 19 nt, Homo sapiens
gugggagccucuagaaugg

SEQ ID NO: 868111 - RNA, 19 nt, Homo sapiens
ggaaaacaguagacuugga

SEQ ID NO: 868112 - RNA, 19 nt, Homo sapiens
gggagaagaggaaggugaa

SEQ ID NO: 868113 - RNA, 19 nt, Homo sapiens
caagagccaaggguuguaa

SEQ ID NO: 868114 - RNA, 19 nt, Homo sapiens
gguuugaacaggagucuga

SEQ ID NO: 868115 - RNA, 19 nt, Homo sapiens
ggugguuguuguuguuguu

SEQ ID NO: 868116 - RNA, 19 nt, Homo sapiens
gaggcaagagaaagagaaa

SEQ ID NO: 868117 - RNA, 19 nt, Homo sapiens
ggacccagcgagagcaaug

SEQ ID NO: 868118 - RNA, 19 nt, Homo sapiens
ggagcuguccugccugaau

SEQ ID NO: 868119 - RNA, 19 nt, Homo sapiens
gauccaaagcuaaggaaag

SEQ ID NO: 868120 - RNA, 19 nt, Homo sapiens
gggaucauuagcuuuguuu

SEQ ID NO: 868121 - RNA, 19 nt, Homo sapiens
cagcccugcucgugagauu

SEQ ID NO: 868122 - RNA, 19 nt, Homo sapiens
ggagaaggaggaggaggaa

SEQ ID NO: 868123 - RNA, 19 nt, Homo sapiens
caugaccugucccuugaga

SEQ ID NO: 868124 - RNA, 19 nt, Homo sapiens
ugaaaccucucagggaaag

SEQ ID NO: 868125 - RNA, 19 nt, Homo sapiens
gguuugagcccuggucuga

SEQ ID NO: 868126 - RNA, 19 nt, Homo sapiens
ccaagcaccugcguuuguc

SEQ ID NO: 868127 - RNA, 19 nt, Homo sapiens
gccaagcaccugcguuugu

SEQ ID NO: 868128 - RNA, 19 nt, Homo sapiens
ggaagucgccuggaguucu

SEQ ID NO: 868129 - RNA, 19 nt, Homo sapiens
gugccucucucuuccuuuc

SEQ ID NO: 868130 - RNA, 19 nt, Homo sapiens
uccauggccuuaaccagaa

SEQ ID NO: 868131 - RNA, 19 nt, Homo sapiens
ggaagaacauggaaaguga

SEQ ID NO: 868132 - RNA, 19 nt, Homo sapiens
gaagugaucauuucuugua

SEQ ID NO: 868133 - RNA, 19 nt, Homo sapiens
gcaguuggcuauuauaucu

SEQ ID NO: 868134 - RNA, 19 nt, Homo sapiens
guuauuaggugauucagaa

SEQ ID NO: 868135 - RNA, 19 nt, Homo sapiens
caucguagauaaagaaaga

SEQ ID NO: 868136 - RNA, 19 nt, Homo sapiens
ugaccucccugccaaauaa

SEQ ID NO: 868137 - RNA, 19 nt, Homo sapiens
gcacugggauggaacuuca

SEQ ID NO: 868138 - RNA, 19 nt, Homo sapiens
caucaucccugucucugua

SEQ ID NO: 868139 - RNA, 19 nt, Homo sapiens
ggaacggagucuugaauuc

SEQ ID NO: 868140 - RNA, 19 nt, Homo sapiens
gcgaaacgcuacaaauauc

SEQ ID NO: 868141 - RNA, 19 nt, Homo sapiens
uauuugaccucuucaguaa

SEQ ID NO: 868142 - RNA, 19 nt, Homo sapiens
gcagugcgcugauggaucu

SEQ ID NO: 868143 - RNA, 19 nt, Homo sapiens
gaacuauuccggauguaaa

SEQ ID NO: 868144 - RNA, 19 nt, Homo sapiens
gacaugggauucuuugaga

SEQ ID NO: 868145 - RNA, 19 nt, Homo sapiens
guucaucucuaacaaguau

SEQ ID NO: 868146 - RNA, 19 nt, Homo sapiens
aaucuuggcucuaucacua

SEQ ID NO: 868147 - RNA, 19 nt, Homo sapiens
gguguaaaguuugcaaauu

SEQ ID NO: 868148 - RNA, 19 nt, Homo sapiens
gagcagagacuaugaugug

SEQ ID NO: 868149 - RNA, 19 nt, Homo sapiens
uaaugugguucaucucuaa

SEQ ID NO: 868150 - RNA, 19 nt, Homo sapiens
ugauggaucugugugaaua

SEQ ID NO: 868151 - RNA, 19 nt, Homo sapiens
gugaagugaucauuucuug

SEQ ID NO: 868152 - RNA, 19 nt, Homo sapiens
ccacagagaguuuacagaa

SEQ ID NO: 868153 - RNA, 19 nt, Homo sapiens
ccucagaacuaacugcauu

SEQ ID NO: 868154 - RNA, 19 nt, Homo sapiens
gaaaggacgcccaguuaca

SEQ ID NO: 868155 - RNA, 19 nt, Homo sapiens
gcgauagaguugcggcuaa

SEQ ID NO: 868156 - RNA, 19 nt, Homo sapiens
acagagaguuuacagaaau

SEQ ID NO: 868157 - RNA, 19 nt, Homo sapiens
aggaagauguuaccgagua

SEQ ID NO: 868158 - RNA, 19 nt, Homo sapiens
gagaugacccugcuuucuu

SEQ ID NO: 868159 - RNA, 19 nt, Homo sapiens
gggauucuuugagacaaua

SEQ ID NO: 868160 - RNA, 19 nt, Homo sapiens
gaacuaacugcauuugcuu

SEQ ID NO: 868161 - RNA, 19 nt, Homo sapiens
guauaagcauguccgaaau

SEQ ID NO: 868162 - RNA, 19 nt, Homo sapiens
caacaguauugugaaguga

SEQ ID NO: 868163 - RNA, 19 nt, Homo sapiens
cagagacuaugauguggaa

SEQ ID NO: 868164 - RNA, 19 nt, Homo sapiens
cagaauacguguaaaagaa

SEQ ID NO: 868165 - RNA, 19 nt, Homo sapiens
ggaauuucgagucagauuu

SEQ ID NO: 868166 - RNA, 19 nt, Homo sapiens
gcugaacuauuccggaugu

SEQ ID NO: 868167 - RNA, 19 nt, Homo sapiens
cacagagaguuuacagaaa

SEQ ID NO: 868168 - RNA, 19 nt, Homo sapiens
cagagaguuuacagaaauu

SEQ ID NO: 868169 - RNA, 19 nt, Homo sapiens
acauuugcaucguagauaa

SEQ ID NO: 868170 - RNA, 19 nt, Homo sapiens
gaauuucgagucagauuuc

SEQ ID NO: 868171 - RNA, 19 nt, Homo sapiens
cagacacauuuauuggaua

SEQ ID NO: 868172 - RNA, 19 nt, Homo sapiens
acacacagccggagcgaaa

SEQ ID NO: 868173 - RNA, 19 nt, Homo sapiens
ggagcuggguauucugugu

SEQ ID NO: 868174 - RNA, 19 nt, Homo sapiens
ucaacaguauugugaagug

SEQ ID NO: 868175 - RNA, 19 nt, Homo sapiens
gagugucgguagccaaaug

SEQ ID NO: 868176 - RNA, 19 nt, Homo sapiens
ucagaagggugggcuguug

SEQ ID NO: 868177 - RNA, 19 nt, Homo sapiens
cuuaaaagcuuggugguua

SEQ ID NO: 868178 - RNA, 19 nt, Homo sapiens
ccauuuauuugaccucuuc

SEQ ID NO: 868179 - RNA, 19 nt, Homo sapiens
gcucggaccgguuggauug

SEQ ID NO: 868180 - RNA, 19 nt, Homo sapiens
ggguuguacucauagauug

SEQ ID NO: 868181 - RNA, 19 nt, Homo sapiens
ucagguacauuccuuaaaa

SEQ ID NO: 868182 - RNA, 19 nt, Homo sapiens
ggacaugggauucuuugag

SEQ ID NO: 868183 - RNA, 19 nt, Homo sapiens
agaugacccugcuuucuug

SEQ ID NO: 868184 - RNA, 19 nt, Homo sapiens
aagcauguccgaaauguug

SEQ ID NO: 868185 - RNA, 19 nt, Homo sapiens
ggucagguacauuccuuaa

SEQ ID NO: 868186 - RNA, 19 nt, Homo sapiens
uuaacacuguggucaggua

SEQ ID NO: 868187 - RNA, 19 nt, Homo sapiens
acagacacauuuauuggau

SEQ ID NO: 868188 - RNA, 19 nt, Homo sapiens
cgacagagcagagacuaug

SEQ ID NO: 868189 - RNA, 19 nt, Homo sapiens
ccagagaugacccugcuuu

SEQ ID NO: 868190 - RNA, 19 nt, Homo sapiens
cgauagaguugcggcuaaa

SEQ ID NO: 868191 - RNA, 19 nt, Homo sapiens
gcugauggaucugugugaa

SEQ ID NO: 868192 - RNA, 19 nt, Homo sapiens
aaagugagaagaagauuca

SEQ ID NO: 868193 - RNA, 19 nt, Homo sapiens
cccauacucucuguucuuu

SEQ ID NO: 868194 - RNA, 19 nt, Homo sapiens
uuaaugugguucaucucua

SEQ ID NO: 868195 - RNA, 19 nt, Homo sapiens
gacaauaaagcuucuccuu

SEQ ID NO: 868196 - RNA, 19 nt, Homo sapiens
ggcagaugcucuaccuguu

SEQ ID NO: 868197 - RNA, 19 nt, Homo sapiens
gcauuuaguauaagcaugu

SEQ ID NO: 868198 - RNA, 19 nt, Homo sapiens
cauacucucuguucuuucu

SEQ ID NO: 868199 - RNA, 19 nt, Homo sapiens
gguugcaguuggcuauuau

SEQ ID NO: 868200 - RNA, 19 nt, Homo sapiens
ccuuuggguuguacucaua

SEQ ID NO: 868201 - RNA, 19 nt, Homo sapiens
gcagaugcucuaccuguuc

SEQ ID NO: 868202 - RNA, 19 nt, Homo sapiens
agccaaauguuucuucaga

SEQ ID NO: 868203 - RNA, 19 nt, Homo sapiens
guagccaaauguuucuuca

SEQ ID NO: 868204 - RNA, 19 nt, Homo sapiens
gggaagaacauggaaagug

SEQ ID NO: 868205 - RNA, 19 nt, Homo sapiens
guuaagagcacggaauuuc

SEQ ID NO: 868206 - RNA, 19 nt, Homo sapiens
aggcguuggucuucugaua

SEQ ID NO: 868207 - RNA, 19 nt, Homo sapiens
uauaggauuuggcuuugug

SEQ ID NO: 868208 - RNA, 19 nt, Homo sapiens
cagaugcucuaccuguuca

SEQ ID NO: 868209 - RNA, 19 nt, Homo sapiens
gggaacggagucuugaauu

SEQ ID NO: 868210 - RNA, 19 nt, Homo sapiens
ggaagauguuaccgaguac

SEQ ID NO: 868211 - RNA, 19 nt, Homo sapiens
aaauggagcuggguauucu

SEQ ID NO: 868212 - RNA, 19 nt, Homo sapiens
aaucguaacugugucaaca

SEQ ID NO: 868213 - RNA, 19 nt, Homo sapiens
ucugauagcaacuuuaaug

SEQ ID NO: 868214 - RNA, 19 nt, Homo sapiens
ggacgcccaguuacauuug

SEQ ID NO: 868215 - RNA, 19 nt, Homo sapiens
ggaauggggcuaugcuuuu

SEQ ID NO: 868216 - RNA, 19 nt, Homo sapiens
uagcaacuuuaaugugguu

SEQ ID NO: 868217 - RNA, 19 nt, Homo sapiens
gagaaggcuuuuccgcuuu

SEQ ID NO: 868218 - RNA, 19 nt, Homo sapiens
caaauggagcuggguauuc

SEQ ID NO: 868219 - RNA, 19 nt, Homo sapiens
gagacuaugauguggaaug

SEQ ID NO: 868220 - RNA, 19 nt, Homo sapiens
augaaaggacgcccaguua

SEQ ID NO: 868221 - RNA, 19 nt, Homo sapiens
caguuacauuugcaucgua

SEQ ID NO: 868222 - RNA, 19 nt, Homo sapiens
gaaauaccuuaugguuggu

SEQ ID NO: 868223 - RNA, 19 nt, Homo sapiens
cauguuauccugacagaca

SEQ ID NO: 868224 - RNA, 19 nt, Homo sapiens
gacagacacauuuauugga

SEQ ID NO: 868225 - RNA, 19 nt, Homo sapiens
ugacagacacauuuauugg

SEQ ID NO: 868226 - RNA, 19 nt, Homo sapiens
uaacugcauuugcuuuuga

SEQ ID NO: 868227 - RNA, 19 nt, Homo sapiens
agaacuaacugcauuugcu

SEQ ID NO: 868228 - RNA, 19 nt, Homo sapiens
aguauaagcauguccgaaa

SEQ ID NO: 868229 - RNA, 19 nt, Homo sapiens
gaauggggcuaugcuuuug

SEQ ID NO: 868230 - RNA, 19 nt, Homo sapiens
uguguccacuauaggauuu

SEQ ID NO: 868231 - RNA, 19 nt, Homo sapiens
gcaaagagcugcuaagacu

SEQ ID NO: 868232 - RNA, 19 nt, Homo sapiens
ggacugcucucuccagaaa

SEQ ID NO: 868233 - RNA, 19 nt, Homo sapiens
gaaagucgauguaauuaac

SEQ ID NO: 868234 - RNA, 19 nt, Homo sapiens
caaaugaacugcccugcuu

SEQ ID NO: 868235 - RNA, 19 nt, Homo sapiens
gaaagaugccaacaaguuu

SEQ ID NO: 868236 - RNA, 19 nt, Homo sapiens
ccacugagaucccguucua

SEQ ID NO: 868237 - RNA, 19 nt, Homo sapiens
caagagaccuggcccuguu

SEQ ID NO: 868238 - RNA, 19 nt, Homo sapiens
ggaaacagacugaaagaug

SEQ ID NO: 868239 - RNA, 19 nt, Homo sapiens
agaagaaacuguccuacaa

SEQ ID NO: 868240 - RNA, 19 nt, Homo sapiens
gaaguugggcugagaguau

SEQ ID NO: 868241 - RNA, 19 nt, Homo sapiens
caccaaagauggagucaug

SEQ ID NO: 868242 - RNA, 19 nt, Homo sapiens
gaaguccucucuacagaag

SEQ ID NO: 868243 - RNA, 19 nt, Homo sapiens
cugaugaccugaccuguaa

SEQ ID NO: 868244 - RNA, 19 nt, Homo sapiens
ggaaagucgauguaauuaa

SEQ ID NO: 868245 - RNA, 19 nt, Homo sapiens
ugaaagaugccaacaaguu

SEQ ID NO: 868246 - RNA, 19 nt, Homo sapiens
caaggaaguuucgggauga

SEQ ID NO: 868247 - RNA, 19 nt, Homo sapiens
ggaggacccugcacauuuu

SEQ ID NO: 868248 - RNA, 19 nt, Homo sapiens
uuaauugccucccagaaga

SEQ ID NO: 868249 - RNA, 19 nt, Homo sapiens
gaucuguaacguccuuaua

SEQ ID NO: 868250 - RNA, 19 nt, Homo sapiens
ggaacuagaucuguaacgu

SEQ ID NO: 868251 - RNA, 19 nt, Homo sapiens
aagauggagucauggauuu

SEQ ID NO: 868252 - RNA, 19 nt, Homo sapiens
guauguuccuugcagguuu

SEQ ID NO: 868253 - RNA, 19 nt, Homo sapiens
caaggaauacugcuuagga

SEQ ID NO: 868254 - RNA, 19 nt, Homo sapiens
guuaccaccuccugccaua

SEQ ID NO: 868255 - RNA, 19 nt, Homo sapiens
uguaaagucuggaacuaga

SEQ ID NO: 868256 - RNA, 19 nt, Homo sapiens
gaacuagaucuguaaaguc

SEQ ID NO: 868257 - RNA, 19 nt, Homo sapiens
gaauacugcuuaggaccaa

SEQ ID NO: 868258 - RNA, 19 nt, Homo sapiens
ccauauaccuuuccuuuug

SEQ ID NO: 868259 - RNA, 19 nt, Homo sapiens
gagaucauguuagggaaau

SEQ ID NO: 868260 - RNA, 19 nt, Homo sapiens
agacaggcauggcaaggaa

SEQ ID NO: 868261 - RNA, 19 nt, Homo sapiens
ucauuaacuugaucccuuu

SEQ ID NO: 868262 - RNA, 19 nt, Homo sapiens
gcacagugucucaugaguu

SEQ ID NO: 868263 - RNA, 19 nt, Homo sapiens
ggagggugagaucauguua

SEQ ID NO: 868264 - RNA, 19 nt, Homo sapiens
cacagugucucaugaguuc

SEQ ID NO: 868265 - RNA, 19 nt, Homo sapiens
gaagaaacuguccuacaag

SEQ ID NO: 868266 - RNA, 19 nt, Homo sapiens
gaagggcugcugacaagau

SEQ ID NO: 868267 - RNA, 19 nt, Homo sapiens
gagaucccguucuauugau

SEQ ID NO: 868268 - RNA, 19 nt, Homo sapiens
ugagaucccguucuauuga

SEQ ID NO: 868269 - RNA, 19 nt, Homo sapiens
uggaagggcugcugacaag

SEQ ID NO: 868270 - RNA, 19 nt, Homo sapiens
agaacuagaucuguaaagu

SEQ ID NO: 868271 - RNA, 19 nt, Homo sapiens
gaaaauagaacuagaucug

SEQ ID NO: 868272 - RNA, 19 nt, Homo sapiens
cuagucauuuguucagauu

SEQ ID NO: 868273 - RNA, 19 nt, Homo sapiens
uggaggacccugcacauuu

SEQ ID NO: 868274 - RNA, 19 nt, Homo sapiens
ggaagccauuacggccuua

SEQ ID NO: 868275 - RNA, 19 nt, Homo sapiens
gggcaaagagcugcuaaga

SEQ ID NO: 868276 - RNA, 19 nt, Homo sapiens
gagguuuggugucagaaca

SEQ ID NO: 868277 - RNA, 19 nt, Homo sapiens
ggccugaucuacccagcaa

SEQ ID NO: 868278 - RNA, 19 nt, Homo sapiens
accaaguacucauccauuu

SEQ ID NO: 868279 - RNA, 19 nt, Homo sapiens
ccuacagccugguguguga

SEQ ID NO: 868280 - RNA, 19 nt, Homo sapiens
uggcaaggaauacugcuua

SEQ ID NO: 868281 - RNA, 19 nt, Homo sapiens
gcugcugucucguguguuc

SEQ ID NO: 868282 - RNA, 19 nt, Homo sapiens
ggaccggcuugccaucugu

SEQ ID NO: 868283 - RNA, 19 nt, Homo sapiens
aaagauggagucauggauu

SEQ ID NO: 868284 - RNA, 19 nt, Homo sapiens
uggaaagucgauguaauua

SEQ ID NO: 868285 - RNA, 19 nt, Homo sapiens
ccauugaaguccucucuac

SEQ ID NO: 868286 - RNA, 19 nt, Homo sapiens
aaccaacccuggcugaaau

SEQ ID NO: 868287 - RNA, 19 nt, Homo sapiens
ggagucauggauuuacuga

SEQ ID NO: 868288 - RNA, 19 nt, Homo sapiens
acugaaagaugccaacaag

SEQ ID NO: 868289 - RNA, 19 nt, Homo sapiens
caucggaaacagacugaaa

SEQ ID NO: 868290 - RNA, 19 nt, Homo sapiens
gugccagggugucauggaa

SEQ ID NO: 868291 - RNA, 19 nt, Homo sapiens
cuggaaagucgauguaauu

SEQ ID NO: 868292 - RNA, 19 nt, Homo sapiens
gcuacauucuauccagaga

SEQ ID NO: 868293 - RNA, 19 nt, Homo sapiens
aaacagcacagcucaugga

SEQ ID NO: 868294 - RNA, 19 nt, Homo sapiens
aaaccaacccuggcugaaa

SEQ ID NO: 868295 - RNA, 19 nt, Homo sapiens
ucuguaaagucuggaacua

SEQ ID NO: 868296 - RNA, 19 nt, Homo sapiens
cauguuagggaaaucaauu

SEQ ID NO: 868297 - RNA, 19 nt, Homo sapiens
uaccaccuccugccauaua

SEQ ID NO: 868298 - RNA, 19 nt, Homo sapiens
gacgacaggacccaucuga

SEQ ID NO: 868299 - RNA, 19 nt, Homo sapiens
caagcuagggcugccauuu

SEQ ID NO: 868300 - RNA, 19 nt, Homo sapiens
caagugacaaggaaguuuc

SEQ ID NO: 868301 - RNA, 19 nt, Homo sapiens
gccagggcccauugacuaa

SEQ ID NO: 868302 - RNA, 19 nt, Homo sapiens
cagaagaaacuguccuaca

SEQ ID NO: 868303 - RNA, 19 nt, Homo sapiens
gaucccguucuauugauuu

SEQ ID NO: 868304 - RNA, 19 nt, Homo sapiens
ccuggaaagucgauguaau

SEQ ID NO: 868305 - RNA, 19 nt, Homo sapiens
gucuggaacuagaucugua

SEQ ID NO: 868306 - RNA, 19 nt, Homo sapiens
cuagaucuguaacguccuu

SEQ ID NO: 868307 - RNA, 19 nt, Homo sapiens
aacuagaucuguaaagucu

SEQ ID NO: 868308 - RNA, 19 nt, Homo sapiens
ccaaagauggagucaugga

SEQ ID NO: 868309 - RNA, 19 nt, Homo sapiens
uugaaguccucucuacaga

SEQ ID NO: 868310 - RNA, 19 nt, Homo sapiens
caaugucuguggcaaacca

SEQ ID NO: 868311 - RNA, 19 nt, Homo sapiens
ccaagugacaaggaaguuu

SEQ ID NO: 868312 - RNA, 19 nt, Homo sapiens
ggcaaggaauacugcuuag

SEQ ID NO: 868313 - RNA, 19 nt, Homo sapiens
gggacuugaugggcaaaga

SEQ ID NO: 868314 - RNA, 19 nt, Homo sapiens
aaagaugccaacaaguuug

SEQ ID NO: 868315 - RNA, 19 nt, Homo sapiens
gaugaccugaccuguaaga

SEQ ID NO: 868316 - RNA, 19 nt, Homo sapiens
acugagaucccguucuauu

SEQ ID NO: 868317 - RNA, 19 nt, Homo sapiens
gcugagagcccaccaaccu

SEQ ID NO: 868318 - RNA, 19 nt, Homo sapiens
gaucauguuagggaaauca

SEQ ID NO: 868319 - RNA, 19 nt, Homo sapiens
agaaacagcacagcucaug

SEQ ID NO: 868320 - RNA, 19 nt, Homo sapiens
uuaccaagccugccucauc

SEQ ID NO: 868321 - RNA, 19 nt, Homo sapiens
ucaaugcccaguuuaccaa

SEQ ID NO: 868322 - RNA, 19 nt, Homo sapiens
ucgauguaauuaacugaug

SEQ ID NO: 868323 - RNA, 19 nt, Homo sapiens
ugccagggcccauugacua

SEQ ID NO: 868324 - RNA, 19 nt, Homo sapiens
cauggagacacuagacuug

SEQ ID NO: 868325 - RNA, 19 nt, Homo sapiens
cauucuccauagucuguuu

SEQ ID NO: 868326 - RNA, 19 nt, Homo sapiens
ucugaugaccugaccugua

SEQ ID NO: 868327 - RNA, 19 nt, Homo sapiens
cuagugacuuagauacauc

SEQ ID NO: 868328 - RNA, 19 nt, Homo sapiens
caacauggagacacuagac

SEQ ID NO: 868329 - RNA, 19 nt, Homo sapiens
gcagucugauuccucucau

SEQ ID NO: 868330 - RNA, 19 nt, Homo sapiens
caaagauggagucauggau

SEQ ID NO: 868331 - RNA, 19 nt, Homo sapiens
cgauaugacuguauagaua

SEQ ID NO: 868332 - RNA, 19 nt, Homo sapiens
ggacuucgguguucugcua

SEQ ID NO: 868333 - RNA, 19 nt, Homo sapiens
gaaccuggauguaaguuug

SEQ ID NO: 868334 - RNA, 19 nt, Homo sapiens
agaaagcccugaagaauga

SEQ ID NO: 868335 - RNA, 19 nt, Homo sapiens
gaaagacauuggccgauug

SEQ ID NO: 868336 - RNA, 19 nt, Homo sapiens
gaaugaguguggaaugaaa

SEQ ID NO: 868337 - RNA, 19 nt, Homo sapiens
gcuauuggcuucuauaugg

SEQ ID NO: 868338 - RNA, 19 nt, Homo sapiens
gcagaugcuuuccaggaua

SEQ ID NO: 868339 - RNA, 19 nt, Homo sapiens
gaaguugcuugcucacaaa

SEQ ID NO: 868340 - RNA, 19 nt, Homo sapiens
gaaacaggauagagaagau

SEQ ID NO: 868341 - RNA, 19 nt, Homo sapiens
caacuucuguuugcucuuu

SEQ ID NO: 868342 - RNA, 19 nt, Homo sapiens
gaaacuaugacaucaaaga

SEQ ID NO: 868343 - RNA, 19 nt, Homo sapiens
gauggcgucuugcuuguuu

SEQ ID NO: 868344 - RNA, 19 nt, Homo sapiens
cauaggaccucuggcauuu

SEQ ID NO: 868345 - RNA, 19 nt, Homo sapiens
gcaauggacuucgguguuc

SEQ ID NO: 868346 - RNA, 19 nt, Homo sapiens
gagcuucucucuacaacau

SEQ ID NO: 868347 - RNA, 19 nt, Homo sapiens
ucuguuugcucuuugauua

SEQ ID NO: 868348 - RNA, 19 nt, Homo sapiens
gaagagaaagcccugaaga

SEQ ID NO: 868349 - RNA, 19 nt, Homo sapiens
uaaguaaguugaugagcuu

SEQ ID NO: 868350 - RNA, 19 nt, Homo sapiens
gagaaagcccugaagaaug

SEQ ID NO: 868351 - RNA, 19 nt, Homo sapiens
gaacucucauggagguaaa

SEQ ID NO: 868352 - RNA, 19 nt, Homo sapiens
gcagggauauaaaggcaau

SEQ ID NO: 868353 - RNA, 19 nt, Homo sapiens
aaacaaaugcagaugcuuu

SEQ ID NO: 868354 - RNA, 19 nt, Homo sapiens
uggaaacuaugacaucaaa

SEQ ID NO: 868355 - RNA, 19 nt, Homo sapiens
acagagaaauguuuaacug

SEQ ID NO: 868356 - RNA, 19 nt, Homo sapiens
gggagaagaccacgaguga

SEQ ID NO: 868357 - RNA, 19 nt, Homo sapiens
guaaaugcaagcagggaua

SEQ ID NO: 868358 - RNA, 19 nt, Homo sapiens
gaaugugccucugguaaag

SEQ ID NO: 868359 - RNA, 19 nt, Homo sapiens
gacugcagcuucaaucaug

SEQ ID NO: 868360 - RNA, 19 nt, Homo sapiens
guuucgaacugcaauauau

SEQ ID NO: 868361 - RNA, 19 nt, Homo sapiens
gugaaugaguguggaauga

SEQ ID NO: 868362 - RNA, 19 nt, Homo sapiens
gcagucaagaugugaauga

SEQ ID NO: 868363 - RNA, 19 nt, Homo sapiens
agaaagacauuggccgauu

SEQ ID NO: 868364 - RNA, 19 nt, Homo sapiens
ggaaacaggauagagaaga

SEQ ID NO: 868365 - RNA, 19 nt, Homo sapiens
ucacauugguuucgaacug

SEQ ID NO: 868366 - RNA, 19 nt, Homo sapiens
caaaggaaagcgcuaacuu

SEQ ID NO: 868367 - RNA, 19 nt, Homo sapiens
ggaagcuacuacugcaaau

SEQ ID NO: 868368 - RNA, 19 nt, Homo sapiens
uuucauagccaaacuugua

SEQ ID NO: 868369 - RNA, 19 nt, Homo sapiens
agaaguugcuugcucacaa

SEQ ID NO: 868370 - RNA, 19 nt, Homo sapiens
ggaaaugucaguuuaucuc

SEQ ID NO: 868371 - RNA, 19 nt, Homo sapiens
uggacgauaugacuguaua

SEQ ID NO: 868372 - RNA, 19 nt, Homo sapiens
cuguuugacucuuaugaua

SEQ ID NO: 868373 - RNA, 19 nt, Homo sapiens
ucaaagacagaaucaagaa

SEQ ID NO: 868374 - RNA, 19 nt, Homo sapiens
gcuucucucuacaacauuu

SEQ ID NO: 868375 - RNA, 19 nt, Homo sapiens
gacugaauguuacuaucuu

SEQ ID NO: 868376 - RNA, 19 nt, Homo sapiens
gagaagagaaagcccugaa

SEQ ID NO: 868377 - RNA, 19 nt, Homo sapiens
uugaugagcuucucucuac

SEQ ID NO: 868378 - RNA, 19 nt, Homo sapiens
ucugaaucuuuccacauua

SEQ ID NO: 868379 - RNA, 19 nt, Homo sapiens
ggauagagaagaugauuuu

SEQ ID NO: 868380 - RNA, 19 nt, Homo sapiens
uuaaauaucucgguugacu

SEQ ID NO: 868381 - RNA, 19 nt, Homo sapiens
gcagccaccaugccaauug

SEQ ID NO: 868382 - RNA, 19 nt, Homo sapiens
gauacuucuuggaaacuau

SEQ ID NO: 868383 - RNA, 19 nt, Homo sapiens
guaugucaguucccugguu

SEQ ID NO: 868384 - RNA, 19 nt, Homo sapiens
aaagucaucugucccuaca

SEQ ID NO: 868385 - RNA, 19 nt, Homo sapiens
cuacgugugugaacucuag

SEQ ID NO: 868386 - RNA, 19 nt, Homo sapiens
ggauguaaguuuggugagu

SEQ ID NO: 868387 - RNA, 19 nt, Homo sapiens
uaugucaguucccugguuu

SEQ ID NO: 868388 - RNA, 19 nt, Homo sapiens
ggacagcacccgguaacug

SEQ ID NO: 868389 - RNA, 19 nt, Homo sapiens
ugaaugugccucugguaaa

SEQ ID NO: 868390 - RNA, 19 nt, Homo sapiens
gucuagauauugaugaaug

SEQ ID NO: 868391 - RNA, 19 nt, Homo sapiens
ccaaacaaaugcagaugcu

SEQ ID NO: 868392 - RNA, 19 nt, Homo sapiens
ucauaucacuguaucuucu

SEQ ID NO: 868393 - RNA, 19 nt, Homo sapiens
caaacuggaacauaaagau

SEQ ID NO: 868394 - RNA, 19 nt, Homo sapiens
caucaaagacagaaucaag

SEQ ID NO: 868395 - RNA, 19 nt, Homo sapiens
aagcacagagaaauguuua

SEQ ID NO: 868396 - RNA, 19 nt, Homo sapiens
guggaugacugaauguuac

SEQ ID NO: 868397 - RNA, 19 nt, Homo sapiens
ucaggcuuauguccagaua

SEQ ID NO: 868398 - RNA, 19 nt, Homo sapiens
gaacugaugcuaccaaaag

SEQ ID NO: 868399 - RNA, 19 nt, Homo sapiens
agacauuggccgauugaaa

SEQ ID NO: 868400 - RNA, 19 nt, Homo sapiens
gaauccugcugaucgagau

SEQ ID NO: 868401 - RNA, 19 nt, Homo sapiens
agagaaagcccugaagaau

SEQ ID NO: 868402 - RNA, 19 nt, Homo sapiens
gggaaaaccugcagucaag

SEQ ID NO: 868403 - RNA, 19 nt, Homo sapiens
ugaucgagauaaugcuauu

SEQ ID NO: 868404 - RNA, 19 nt, Homo sapiens
ggaacucucauggagguaa

SEQ ID NO: 868405 - RNA, 19 nt, Homo sapiens
aagacagaaucaagaaguu

SEQ ID NO: 868406 - RNA, 19 nt, Homo sapiens
uggcuuagcugggucuuuc

SEQ ID NO: 868407 - RNA, 19 nt, Homo sapiens
cugaaucuuuccacauuau

SEQ ID NO: 868408 - RNA, 19 nt, Homo sapiens
aaaggaaagcgcuaacuuc

SEQ ID NO: 868409 - RNA, 19 nt, Homo sapiens
aaaagggaaugaagagaaa

SEQ ID NO: 868410 - RNA, 19 nt, Homo sapiens
ggaccaaacaaaugcagau

SEQ ID NO: 868411 - RNA, 19 nt, Homo sapiens
gaugagcuucucucuacaa

SEQ ID NO: 868412 - RNA, 19 nt, Homo sapiens
uguaauguaccaacagaaa

SEQ ID NO: 868413 - RNA, 19 nt, Homo sapiens
uaggaccucuggcauuuua

SEQ ID NO: 868414 - RNA, 19 nt, Homo sapiens
caucacggguuguuagcau

SEQ ID NO: 868415 - RNA, 19 nt, Homo sapiens
aaucgaagaugugugaaca

SEQ ID NO: 868416 - RNA, 19 nt, Homo sapiens
agaugccuuucuuguauaa

SEQ ID NO: 868417 - RNA, 19 nt, Homo sapiens
guaauguaccaacagaaau

SEQ ID NO: 868418 - RNA, 19 nt, Homo sapiens
cgcaguggauggcgucuug

SEQ ID NO: 868419 - RNA, 19 nt, Homo sapiens
gacauuggccgauugaaac

SEQ ID NO: 868420 - RNA, 19 nt, Homo sapiens
gggagucugugaagcuaca

SEQ ID NO: 868421 - RNA, 19 nt, Homo sapiens
gcacagagaaauguuuaac

SEQ ID NO: 868422 - RNA, 19 nt, Homo sapiens
agucauuucugaaucuuuc

SEQ ID NO: 868423 - RNA, 19 nt, Homo sapiens
ggaaaauucaguuguauca

SEQ ID NO: 868424 - RNA, 19 nt, Homo sapiens
cagggaaaauucaguugua

SEQ ID NO: 868425 - RNA, 19 nt, Homo sapiens
gagacaaagucgggaaacu

SEQ ID NO: 868426 - RNA, 19 nt, Homo sapiens
ggaggacccgugcgagaau

SEQ ID NO: 868427 - RNA, 19 nt, Homo sapiens
aagagaaagcccugaagaa

SEQ ID NO: 868428 - RNA, 19 nt, Homo sapiens
caguacagcugugaagaca

SEQ ID NO: 868429 - RNA, 19 nt, Homo sapiens
ugauacuucuuggaaacua

SEQ ID NO: 868430 - RNA, 19 nt, Homo sapiens
ucuccuaccugaccugcaa

SEQ ID NO: 868431 - RNA, 19 nt, Homo sapiens
gcacuuaacucuuguuuag

SEQ ID NO: 868432 - RNA, 19 nt, Homo sapiens
ggacagacuugaggaauaa

SEQ ID NO: 868433 - RNA, 19 nt, Homo sapiens
caaggaaucucaagaaaug

SEQ ID NO: 868434 - RNA, 19 nt, Homo sapiens
ggaaugaccucuaacaucu

SEQ ID NO: 868435 - RNA, 19 nt, Homo sapiens
ugaaagcacuuaacucuug

SEQ ID NO: 868436 - RNA, 19 nt, Homo sapiens
gaaaggaggugcuucuaag

SEQ ID NO: 868437 - RNA, 19 nt, Homo sapiens
gaaggaaguuggagaguca

SEQ ID NO: 868438 - RNA, 19 nt, Homo sapiens
uaaaguguaugcuguauug

SEQ ID NO: 868439 - RNA, 19 nt, Homo sapiens
gaaagcugcuauuauguau

SEQ ID NO: 868440 - RNA, 19 nt, Homo sapiens
guagaacaauuuccuggua

SEQ ID NO: 868441 - RNA, 19 nt, Homo sapiens
ccaggcagcucuauucuug

SEQ ID NO: 868442 - RNA, 19 nt, Homo sapiens
caacuuccuucuccacuaa

SEQ ID NO: 868443 - RNA, 19 nt, Homo sapiens
gaagacugccuauaucaaa

SEQ ID NO: 868444 - RNA, 19 nt, Homo sapiens
gaauggguacuuucuauuu

SEQ ID NO: 868445 - RNA, 19 nt, Homo sapiens
guugaaggguuuagaguuu

SEQ ID NO: 868446 - RNA, 19 nt, Homo sapiens
gcaacuuccuucuccacua

SEQ ID NO: 868447 - RNA, 19 nt, Homo sapiens
gccaagaaaguaucuguua

SEQ ID NO: 868448 - RNA, 19 nt, Homo sapiens
gaaagucuguggaaucacu

SEQ ID NO: 868449 - RNA, 19 nt, Homo sapiens
gggaaagucuguggaauca

SEQ ID NO: 868450 - RNA, 19 nt, Homo sapiens
gcaaguuguucucccacua

SEQ ID NO: 868451 - RNA, 19 nt, Homo sapiens
ggguagauauggagaaaga

SEQ ID NO: 868452 - RNA, 19 nt, Homo sapiens
gaagcccuauuuagcaauu

SEQ ID NO: 868453 - RNA, 19 nt, Homo sapiens
uuucauagcuucuccauca

SEQ ID NO: 868454 - RNA, 19 nt, Homo sapiens
cagaaugacuggacaaucu

SEQ ID NO: 868455 - RNA, 19 nt, Homo sapiens
ccaagaaaguaucuguuau

SEQ ID NO: 868456 - RNA, 19 nt, Homo sapiens
acuaguggaucuuaucaua

SEQ ID NO: 868457 - RNA, 19 nt, Homo sapiens
uuacaugucucuuucuaug

SEQ ID NO: 868458 - RNA, 19 nt, Homo sapiens
guagucuccuucaggcuua

SEQ ID NO: 868459 - RNA, 19 nt, Homo sapiens
gugaauggguacuuucuau

SEQ ID NO: 868460 - RNA, 19 nt, Homo sapiens
gcagauauccuuuuagauu

SEQ ID NO: 868461 - RNA, 19 nt, Homo sapiens
cauucaagcugguuuaugu

SEQ ID NO: 868462 - RNA, 19 nt, Homo sapiens
ggaugguacugguggguaa

SEQ ID NO: 868463 - RNA, 19 nt, Homo sapiens
gaaagcacuuaacucuugu

SEQ ID NO: 868464 - RNA, 19 nt, Homo sapiens
ccacuacucuuuucuguuu

SEQ ID NO: 868465 - RNA, 19 nt, Homo sapiens
gaaguuaggaacccauuuc

SEQ ID NO: 868466 - RNA, 19 nt, Homo sapiens
ggguaaagcaggaaucuga

SEQ ID NO: 868467 - RNA, 19 nt, Homo sapiens
ugaccucaguguuuacaaa

SEQ ID NO: 868468 - RNA, 19 nt, Homo sapiens
guacgagucugugcugugu

SEQ ID NO: 868469 - RNA, 19 nt, Homo sapiens
agaaagcugcuauuaugua

SEQ ID NO: 868470 - RNA, 19 nt, Homo sapiens
gaaauuagaccagccugau

SEQ ID NO: 868471 - RNA, 19 nt, Homo sapiens
cauguuguguucuuuguau

SEQ ID NO: 868472 - RNA, 19 nt, Homo sapiens
ugaagcauggcauuaauuu

SEQ ID NO: 868473 - RNA, 19 nt, Homo sapiens
gaguuugaauuguguaaca

SEQ ID NO: 868474 - RNA, 19 nt, Homo sapiens
guccuuauguuuaguuuca

SEQ ID NO: 868475 - RNA, 19 nt, Homo sapiens
ggguguaucuguaaugaag

SEQ ID NO: 868476 - RNA, 19 nt, Homo sapiens
gugaagcccuauuuagcaa

SEQ ID NO: 868477 - RNA, 19 nt, Homo sapiens
caagauggcgaccgaguug

SEQ ID NO: 868478 - RNA, 19 nt, Homo sapiens
ggcauuggcaggacauuaa

SEQ ID NO: 868479 - RNA, 19 nt, Homo sapiens
ggaagacugccuauaucaa

SEQ ID NO: 868480 - RNA, 19 nt, Homo sapiens
caagaaaguaucuguuauc

SEQ ID NO: 868481 - RNA, 19 nt, Homo sapiens
gaaauggaugcucguccua

SEQ ID NO: 868482 - RNA, 19 nt, Homo sapiens
gcauggcauuaauuuguau

SEQ ID NO: 868483 - RNA, 19 nt, Homo sapiens
ccucaguguuuacaaauuc

SEQ ID NO: 868484 - RNA, 19 nt, Homo sapiens
gggaaugaccucuaacauc

SEQ ID NO: 868485 - RNA, 19 nt, Homo sapiens
aggacagacuugaggaaua

SEQ ID NO: 868486 - RNA, 19 nt, Homo sapiens
uauuugcccuguucuuuga

SEQ ID NO: 868487 - RNA, 19 nt, Homo sapiens
aggaugaaaugggaagaua

SEQ ID NO: 868488 - RNA, 19 nt, Homo sapiens
caguucauguaguucuuua

SEQ ID NO: 868489 - RNA, 19 nt, Homo sapiens
guuuacaugucucuuucua

SEQ ID NO: 868490 - RNA, 19 nt, Homo sapiens
cgaccgaguuggaguacga

SEQ ID NO: 868491 - RNA, 19 nt, Homo sapiens
uagaacaauuuccugguau

SEQ ID NO: 868492 - RNA, 19 nt, Homo sapiens
gaaccuauuuucucaaucu

SEQ ID NO: 868493 - RNA, 19 nt, Homo sapiens
cuauuacaaugcugugaaa

SEQ ID NO: 868494 - RNA, 19 nt, Homo sapiens
gaaugacuggacaaucuuu

SEQ ID NO: 868495 - RNA, 19 nt, Homo sapiens
gaugaaaugggaagauauc

SEQ ID NO: 868496 - RNA, 19 nt, Homo sapiens
guuguucucccacuacuuu

SEQ ID NO: 868497 - RNA, 19 nt, Homo sapiens
ggacuaguggaucuuauca

SEQ ID NO: 868498 - RNA, 19 nt, Homo sapiens
ggaggcaaagucacuauuc

SEQ ID NO: 868499 - RNA, 19 nt, Homo sapiens
uccaaggaaucucaagaaa

SEQ ID NO: 868500 - RNA, 19 nt, Homo sapiens
agaacaauuuccugguauu

SEQ ID NO: 868501 - RNA, 19 nt, Homo sapiens
ggauucucuucuucacuuu

SEQ ID NO: 868502 - RNA, 19 nt, Homo sapiens
uggauucucuucuucacuu

SEQ ID NO: 868503 - RNA, 19 nt, Homo sapiens
guuggagagucacagcuuu

SEQ ID NO: 868504 - RNA, 19 nt, Homo sapiens
gagcagagagguugaaagc

SEQ ID NO: 868505 - RNA, 19 nt, Homo sapiens
gaagcauggcauuaauuug

SEQ ID NO: 868506 - RNA, 19 nt, Homo sapiens
ccaucugguugcugcauuu

SEQ ID NO: 868507 - RNA, 19 nt, Homo sapiens
uguguaacaucuuugauca

SEQ ID NO: 868508 - RNA, 19 nt, Homo sapiens
ccucuuguguguuuacaug

SEQ ID NO: 868509 - RNA, 19 nt, Homo sapiens
gccauagcaggacauguua

SEQ ID NO: 868510 - RNA, 19 nt, Homo sapiens
agauaucauugcuuccuuu

SEQ ID NO: 868511 - RNA, 19 nt, Homo sapiens
uaguggaucuuaucauagu

SEQ ID NO: 868512 - RNA, 19 nt, Homo sapiens
gggaagacugccuauauca

SEQ ID NO: 868513 - RNA, 19 nt, Homo sapiens
ucacauucaagcugguuua

SEQ ID NO: 868514 - RNA, 19 nt, Homo sapiens
ccaaggaaucucaagaaau

SEQ ID NO: 868515 - RNA, 19 nt, Homo sapiens
cauagcaggacauguuaaa

SEQ ID NO: 868516 - RNA, 19 nt, Homo sapiens
ucgggaacauuacaaacaa

SEQ ID NO: 868517 - RNA, 19 nt, Homo sapiens
guugaaagcacuuaacucu

SEQ ID NO: 868518 - RNA, 19 nt, Homo sapiens
aagcauggcauuaauuugu

SEQ ID NO: 868519 - RNA, 19 nt, Homo sapiens
ggaaguuaggaacccauuu

SEQ ID NO: 868520 - RNA, 19 nt, Homo sapiens
gagagucacagcuuuacug

SEQ ID NO: 868521 - RNA, 19 nt, Homo sapiens
guauuugcccuguucuuug

SEQ ID NO: 868522 - RNA, 19 nt, Homo sapiens
guggguguaucuguaauga

SEQ ID NO: 868523 - RNA, 19 nt, Homo sapiens
aagggaagacugccuauau

SEQ ID NO: 868524 - RNA, 19 nt, Homo sapiens
caaaccaucaaguugugua

SEQ ID NO: 868525 - RNA, 19 nt, Homo sapiens
uggagacggugacagauuc

SEQ ID NO: 868526 - RNA, 19 nt, Homo sapiens
ggaugaaaugggaagauau

SEQ ID NO: 868527 - RNA, 19 nt, Homo sapiens
ggacuggucgccuccgaau

SEQ ID NO: 868528 - RNA, 19 nt, Homo sapiens
gcccuguucuuugaccuaa

SEQ ID NO: 868529 - RNA, 19 nt, Homo sapiens
ggcauuaauuuguauuugc

SEQ ID NO: 868530 - RNA, 19 nt, Homo sapiens
gaucaguggguguaucugu

SEQ ID NO: 868531 - RNA, 19 nt, Homo sapiens
ggaaaugacugaagaaaug

SEQ ID NO: 868532 - RNA, 19 nt, Homo sapiens
gaagauggcuggagcaaug

SEQ ID NO: 868533 - RNA, 19 nt, Homo sapiens
uaaggaagcuugcaaaguu

SEQ ID NO: 868534 - RNA, 19 nt, Homo sapiens
gguuucagcugccaaauua

SEQ ID NO: 868535 - RNA, 19 nt, Homo sapiens
ggaacagaaucgagaguua

SEQ ID NO: 868536 - RNA, 19 nt, Homo sapiens
gaagagugcuauuuaaaca

SEQ ID NO: 868537 - RNA, 19 nt, Homo sapiens
gaagaaagccaggauauug

SEQ ID NO: 868538 - RNA, 19 nt, Homo sapiens
gcacagagaaauuauauuc

SEQ ID NO: 868539 - RNA, 19 nt, Homo sapiens
cugaagaaaugaucaauga

SEQ ID NO: 868540 - RNA, 19 nt, Homo sapiens
gaccaugagugaacaguug

SEQ ID NO: 868541 - RNA, 19 nt, Homo sapiens
gcucgaagcuuaccaucug

SEQ ID NO: 868542 - RNA, 19 nt, Homo sapiens
gaagaagaaagccaggaua

SEQ ID NO: 868543 - RNA, 19 nt, Homo sapiens
uaugaugacuugucccuuu

SEQ ID NO: 868544 - RNA, 19 nt, Homo sapiens
gugaugaauucccaaauga

SEQ ID NO: 868545 - RNA, 19 nt, Homo sapiens
ccuaacccauggcuauuua

SEQ ID NO: 868546 - RNA, 19 nt, Homo sapiens
gccaggauauugugaauca

SEQ ID NO: 868547 - RNA, 19 nt, Homo sapiens
caagauugguaauaaggaa

SEQ ID NO: 868548 - RNA, 19 nt, Homo sapiens
ucgagcagcuuuagagaaa

SEQ ID NO: 868549 - RNA, 19 nt, Homo sapiens
aaccguggaugauguaaua

SEQ ID NO: 868550 - RNA, 19 nt, Homo sapiens
uaugagugaugauguguaa

SEQ ID NO: 868551 - RNA, 19 nt, Homo sapiens
gcuguaaguucaaaaguua

SEQ ID NO: 868552 - RNA, 19 nt, Homo sapiens
gaagauggauccacaaaag

SEQ ID NO: 868553 - RNA, 19 nt, Homo sapiens
acagagggcuauaaucaga

SEQ ID NO: 868554 - RNA, 19 nt, Homo sapiens
gaagagaaccguggaugau

SEQ ID NO: 868555 - RNA, 19 nt, Homo sapiens
gcauggcacagagaaauua

SEQ ID NO: 868556 - RNA, 19 nt, Homo sapiens
ugacaaugcuugaccuaca

SEQ ID NO: 868557 - RNA, 19 nt, Homo sapiens
gggccuaauugaaauaugu

SEQ ID NO: 868558 - RNA, 19 nt, Homo sapiens
ugaaaucaaggccucaaua

SEQ ID NO: 868559 - RNA, 19 nt, Homo sapiens
aaauggaaaugacugaaga

SEQ ID NO: 868560 - RNA, 19 nt, Homo sapiens
caaauugaagccauuauuc

SEQ ID NO: 868561 - RNA, 19 nt, Homo sapiens
gaaaugacugaagaaauga

SEQ ID NO: 868562 - RNA, 19 nt, Homo sapiens
aaacaaugcaggcaguuaa

SEQ ID NO: 868563 - RNA, 19 nt, Homo sapiens
gaaaucaaggccucaauac

SEQ ID NO: 868564 - RNA, 19 nt, Homo sapiens
gagcagcuuuagagaaaca

SEQ ID NO: 868565 - RNA, 19 nt, Homo sapiens
acacagagggcuauaauca

SEQ ID NO: 868566 - RNA, 19 nt, Homo sapiens
caugucaguuuauguucua

SEQ ID NO: 868567 - RNA, 19 nt, Homo sapiens
ucagaccuaugaugacuug

SEQ ID NO: 868568 - RNA, 19 nt, Homo sapiens
ugacgguucugaugacgaa

SEQ ID NO: 868569 - RNA, 19 nt, Homo sapiens
gacgagaacuuuugcugua

SEQ ID NO: 868570 - RNA, 19 nt, Homo sapiens
aaucaaggccucaauacaa

SEQ ID NO: 868571 - RNA, 19 nt, Homo sapiens
guacacagagggcuauaau

SEQ ID NO: 868572 - RNA, 19 nt, Homo sapiens
ccaaauugaagccauuauu

SEQ ID NO: 868573 - RNA, 19 nt, Homo sapiens
gaacauucuaguugguaaa

SEQ ID NO: 868574 - RNA, 19 nt, Homo sapiens
gaaugacaaugaugcaaaa

SEQ ID NO: 868575 - RNA, 19 nt, Homo sapiens
aaucgagaguuacgaggua

SEQ ID NO: 868576 - RNA, 19 nt, Homo sapiens
guacuacaacuaugacaau

SEQ ID NO: 868577 - RNA, 19 nt, Homo sapiens
gggaacaguuuggauuuua

SEQ ID NO: 868578 - RNA, 19 nt, Homo sapiens
gccaaagaaugacaaugau

SEQ ID NO: 868579 - RNA, 19 nt, Homo sapiens
aaacagaagacgagaacuu

SEQ ID NO: 868580 - RNA, 19 nt, Homo sapiens
ggaacaguuuggauuuuaa

SEQ ID NO: 868581 - RNA, 19 nt, Homo sapiens
cuugacaccugccuuaaau

SEQ ID NO: 868582 - RNA, 19 nt, Homo sapiens
gauuauguguuaugaccau

SEQ ID NO: 868583 - RNA, 19 nt, Homo sapiens
gaaagccaggauauuguga

SEQ ID NO: 868584 - RNA, 19 nt, Homo sapiens
gcaggcaguuaacaagaag

SEQ ID NO: 868585 - RNA, 19 nt, Homo sapiens
ggaaacagaagacgagaac

SEQ ID NO: 868586 - RNA, 19 nt, Homo sapiens
aaggaagcuugcaaaguuu

SEQ ID NO: 868587 - RNA, 19 nt, Homo sapiens
gacaaugcuugaccuacau

SEQ ID NO: 868588 - RNA, 19 nt, Homo sapiens
uagaacuguuuaugaguga

SEQ ID NO: 868589 - RNA, 19 nt, Homo sapiens
gagaaccguggaugaugua

SEQ ID NO: 868590 - RNA, 19 nt, Homo sapiens
ugacuugucccuuugaugu

SEQ ID NO: 868591 - RNA, 19 nt, Homo sapiens
gaacagaaucgagaguuac

SEQ ID NO: 868592 - RNA, 19 nt, Homo sapiens
gagauugaacggcaacuca

SEQ ID NO: 868593 - RNA, 19 nt, Homo sapiens
uggaugauguaauaaagga

SEQ ID NO: 868594 - RNA, 19 nt, Homo sapiens
guaauaaggaagcuugcaa

SEQ ID NO: 868595 - RNA, 19 nt, Homo sapiens
gcauauugaaucuuccaaa

SEQ ID NO: 868596 - RNA, 19 nt, Homo sapiens
gugcuugacaccugccuua

SEQ ID NO: 868597 - RNA, 19 nt, Homo sapiens
ugccaaagaaugacaauga

SEQ ID NO: 868598 - RNA, 19 nt, Homo sapiens
ucagagaucgagcagcuuu

SEQ ID NO: 868599 - RNA, 19 nt, Homo sapiens
agagaaccguggaugaugu

SEQ ID NO: 868600 - RNA, 19 nt, Homo sapiens
caacuaugacaaugcuuga

SEQ ID NO: 868601 - RNA, 19 nt, Homo sapiens
gaagccauuauucucaauu

SEQ ID NO: 868602 - RNA, 19 nt, Homo sapiens
uagacacgccucuguuaaa

SEQ ID NO: 868603 - RNA, 19 nt, Homo sapiens
acaccugccuuaaauagca

SEQ ID NO: 868604 - RNA, 19 nt, Homo sapiens
caaaggcuacaaucucaga

SEQ ID NO: 868605 - RNA, 19 nt, Homo sapiens
uuacuucuaugucuacaca

SEQ ID NO: 868606 - RNA, 19 nt, Homo sapiens
ccauggcuauuuagaaucu

SEQ ID NO: 868607 - RNA, 19 nt, Homo sapiens
uaauaaggaagcuugcaaa

SEQ ID NO: 868608 - RNA, 19 nt, Homo sapiens
aaacagcuggaauuagaaa

SEQ ID NO: 868609 - RNA, 19 nt, Homo sapiens
agagugcuauuuaaacauc

SEQ ID NO: 868610 - RNA, 19 nt, Homo sapiens
gaugaauucccaaaugaag

SEQ ID NO: 868611 - RNA, 19 nt, Homo sapiens
agugaugaauucccaaaug

SEQ ID NO: 868612 - RNA, 19 nt, Homo sapiens
ggccucaauacaaagauua

SEQ ID NO: 868613 - RNA, 19 nt, Homo sapiens
aucaaggccucaauacaaa

SEQ ID NO: 868614 - RNA, 19 nt, Homo sapiens
gaacuguuuaugagugaug

SEQ ID NO: 868615 - RNA, 19 nt, Homo sapiens
agaaugacaaugaugcaaa

SEQ ID NO: 868616 - RNA, 19 nt, Homo sapiens
gaucgagcagcuuuagaga

SEQ ID NO: 868617 - RNA, 19 nt, Homo sapiens
acccauggcuauuuagaau

SEQ ID NO: 868618 - RNA, 19 nt, Homo sapiens
gcaacucaaggcuuuagga

SEQ ID NO: 868619 - RNA, 19 nt, Homo sapiens
guaauaaaggaacagaauc

SEQ ID NO: 868620 - RNA, 19 nt, Homo sapiens
ucugugggccuaauugaaa

SEQ ID NO: 868621 - RNA, 19 nt, Homo sapiens
gaccuauugugcacaucuu

SEQ ID NO: 868622 - RNA, 19 nt, Homo sapiens
ugacaccugccuuaaauag

SEQ ID NO: 868623 - RNA, 19 nt, Homo sapiens
ccaaagaaugacaaugaug

SEQ ID NO: 868624 - RNA, 19 nt, Homo sapiens
caaugcagaauuuccagaa

SEQ ID NO: 868625 - RNA, 19 nt, Homo sapiens
cuacaacuaugacaaugcu

SEQ ID NO: 868626 - RNA, 19 nt, Homo sapiens
gcuugacaccugccuuaaa

SEQ ID NO: 868627 - RNA, 19 nt, Homo sapiens
aacggcaacucaaggcuuu

SEQ ID NO: 868628 - RNA, 19 nt, Homo sapiens
uucaaaggcuacaaucuca

SEQ ID NO: 868629 - RNA, 19 nt, Homo sapiens
aagaagaaagccaggauau

SEQ ID NO: 868630 - RNA, 19 nt, Homo sapiens
agaagagaaccguggauga

SEQ ID NO: 868631 - RNA, 19 nt, Homo sapiens
gggaaacacuuaaggaaua

SEQ ID NO: 868632 - RNA, 19 nt, Homo sapiens
ggaaucagauguuauguca

SEQ ID NO: 868633 - RNA, 19 nt, Homo sapiens
uagaagagcucaucagaga

SEQ ID NO: 868634 - RNA, 19 nt, Homo sapiens
gauguuaugucaccugaaa

SEQ ID NO: 868635 - RNA, 19 nt, Homo sapiens
ggaaacacuuaaggaauaa

SEQ ID NO: 868636 - RNA, 19 nt, Homo sapiens
gggaaagacugaagaaaca

SEQ ID NO: 868637 - RNA, 19 nt, Homo sapiens
ggaugaaguugauugacua

SEQ ID NO: 868638 - RNA, 19 nt, Homo sapiens
ggaagagucugccgaaggu

SEQ ID NO: 868639 - RNA, 19 nt, Homo sapiens
ggaagaagaagaaagaugu

SEQ ID NO: 868640 - RNA, 19 nt, Homo sapiens
ggaucuagguauggaguua

SEQ ID NO: 868641 - RNA, 19 nt, Homo sapiens
gauccuggcugacuuacug

SEQ ID NO: 868642 - RNA, 19 nt, Homo sapiens
gaacucaccgcuucucaug

SEQ ID NO: 868643 - RNA, 19 nt, Homo sapiens
gugccgagauggaacagua

SEQ ID NO: 868644 - RNA, 19 nt, Homo sapiens
ggaaauccaagaacuccua

SEQ ID NO: 868645 - RNA, 19 nt, Homo sapiens
gaaaagagcggaaauccaa

SEQ ID NO: 868646 - RNA, 19 nt, Homo sapiens
acaccaaccucucuguaaa

SEQ ID NO: 868647 - RNA, 19 nt, Homo sapiens
gauggaacaguaugaaauu

SEQ ID NO: 868648 - RNA, 19 nt, Homo sapiens
gagcggaaauccaagaacu

SEQ ID NO: 868649 - RNA, 19 nt, Homo sapiens
gcggauggaucuagguaug

SEQ ID NO: 868650 - RNA, 19 nt, Homo sapiens
caacccaggcuuucuuuga

SEQ ID NO: 868651 - RNA, 19 nt, Homo sapiens
gcaagaugagcauuccuuu

SEQ ID NO: 868652 - RNA, 19 nt, Homo sapiens
gaaguugauugacuauggu

SEQ ID NO: 868653 - RNA, 19 nt, Homo sapiens
ggaaugcugugguggugau

SEQ ID NO: 868654 - RNA, 19 nt, Homo sapiens
gaagaagaaagaugugauc

SEQ ID NO: 868655 - RNA, 19 nt, Homo sapiens
ggaacaguaugaaauugag

SEQ ID NO: 868656 - RNA, 19 nt, Homo sapiens
ccucagggcugggcaaaga

SEQ ID NO: 868657 - RNA, 19 nt, Homo sapiens
ugaaguugauugacuaugg

SEQ ID NO: 868658 - RNA, 19 nt, Homo sapiens
agacuuuaauggagauuug

SEQ ID NO: 868659 - RNA, 19 nt, Homo sapiens
gagauggaacaguaugaaa

SEQ ID NO: 868660 - RNA, 19 nt, Homo sapiens
gaagagcucaucagagaac

SEQ ID NO: 868661 - RNA, 19 nt, Homo sapiens
gagcugggguuuaacacua

SEQ ID NO: 868662 - RNA, 19 nt, Homo sapiens
ggauggaucuagguaugga

SEQ ID NO: 868663 - RNA, 19 nt, Homo sapiens
caaagaaugugcaaaaguc

SEQ ID NO: 868664 - RNA, 19 nt, Homo sapiens
acuagaaccuuguguccuu

SEQ ID NO: 868665 - RNA, 19 nt, Homo sapiens
ggaggaugaaguugauuga

SEQ ID NO: 868666 - RNA, 19 nt, Homo sapiens
ggacaguugcauuuguuga

SEQ ID NO: 868667 - RNA, 19 nt, Homo sapiens
acaagggacaguugcauuu

SEQ ID NO: 868668 - RNA, 19 nt, Homo sapiens
gaagaagaagaaagaugug

SEQ ID NO: 868669 - RNA, 19 nt, Homo sapiens
gcacuccugcccuccauga

SEQ ID NO: 868670 - RNA, 19 nt, Homo sapiens
gcgggaggaugaaguugau

SEQ ID NO: 868671 - RNA, 19 nt, Homo sapiens
gcacucuuaggcuugcuua

SEQ ID NO: 868672 - RNA, 19 nt, Homo sapiens
ggagguggcccaggauguu

SEQ ID NO: 868673 - RNA, 19 nt, Homo sapiens
gagcauuccuuuucgauca

SEQ ID NO: 868674 - RNA, 19 nt, Homo sapiens
gaaagacugaagaaacaca

SEQ ID NO: 868675 - RNA, 19 nt, Homo sapiens
ucaaacaguaagaguugua

SEQ ID NO: 868676 - RNA, 19 nt, Homo sapiens
uugcauuuguugagacuuu

SEQ ID NO: 868677 - RNA, 19 nt, Homo sapiens
aauccaagaacuccuagua

SEQ ID NO: 868678 - RNA, 19 nt, Homo sapiens
cccaguugcucuaacgaaa

SEQ ID NO: 868679 - RNA, 19 nt, Homo sapiens
gcagugcuuuggcuauguc

SEQ ID NO: 868680 - RNA, 19 nt, Homo sapiens
gggaagaagaagaaagaug

SEQ ID NO: 868681 - RNA, 19 nt, Homo sapiens
ccacaccaaccucucugua

SEQ ID NO: 868682 - RNA, 19 nt, Homo sapiens
ucucaaacaguaagaguug

SEQ ID NO: 868683 - RNA, 19 nt, Homo sapiens
ccugccagcuccuagaaau

SEQ ID NO: 868684 - RNA, 19 nt, Homo sapiens
gaaccuuguguccuuugaa

SEQ ID NO: 868685 - RNA, 19 nt, Homo sapiens
caagaacuccuaguacucu

SEQ ID NO: 868686 - RNA, 19 nt, Homo sapiens
gcacgcaacccaggcuuuc

SEQ ID NO: 868687 - RNA, 19 nt, Homo sapiens
gaggaggcaaggccacauu

SEQ ID NO: 868688 - RNA, 19 nt, Homo sapiens
gggaggaugaaguugauug

SEQ ID NO: 868689 - RNA, 19 nt, Homo sapiens
cuagaaccuuguguccuuu

SEQ ID NO: 868690 - RNA, 19 nt, Homo sapiens
cacaccaaccucucuguaa

SEQ ID NO: 868691 - RNA, 19 nt, Homo sapiens
gggcaaagaaugugcaaaa

SEQ ID NO: 868692 - RNA, 19 nt, Homo sapiens
caagggacaguugcauuug

SEQ ID NO: 868693 - RNA, 19 nt, Homo sapiens
ccuagaagagcucaucaga

SEQ ID NO: 868694 - RNA, 19 nt, Homo sapiens
cauggagacaaacuacuuu

SEQ ID NO: 868695 - RNA, 19 nt, Homo sapiens
agagggucauggagacaaa

SEQ ID NO: 868696 - RNA, 19 nt, Homo sapiens
gcauuuguugagacuuuaa

SEQ ID NO: 868697 - RNA, 19 nt, Homo sapiens
ugccuuccuuggcuguuua

SEQ ID NO: 868698 - RNA, 19 nt, Homo sapiens
gagcucaucagagaacuca

SEQ ID NO: 868699 - RNA, 19 nt, Homo sapiens
acaguugcauuuguugaga

SEQ ID NO: 868700 - RNA, 19 nt, Homo sapiens
uuccuuggcuguuuaucuu

SEQ ID NO: 868701 - RNA, 19 nt, Homo sapiens
agggacaguugcauuuguu

SEQ ID NO: 868702 - RNA, 19 nt, Homo sapiens
uccaagaacuccuaguacu

SEQ ID NO: 868703 - RNA, 19 nt, Homo sapiens
gaugaaguugauugacuau

SEQ ID NO: 868704 - RNA, 19 nt, Homo sapiens
uggaacaguaugaaauuga

SEQ ID NO: 868705 - RNA, 19 nt, Homo sapiens
ccaaggugcagacacacaa

SEQ ID NO: 868706 - RNA, 19 nt, Homo sapiens
aaagagcggaaauccaaga

SEQ ID NO: 868707 - RNA, 19 nt, Homo sapiens
cgagauggaacaguaugaa

SEQ ID NO: 868708 - RNA, 19 nt, Homo sapiens
cagcauaugcagccuccaa

SEQ ID NO: 868709 - RNA, 19 nt, Homo sapiens
ggcaagaugagcauuccuu

SEQ ID NO: 868710 - RNA, 19 nt, Homo sapiens
ggaggcaaggccacauugu

SEQ ID NO: 868711 - RNA, 19 nt, Homo sapiens
ucauggagacaaacuacuu

SEQ ID NO: 868712 - RNA, 19 nt, Homo sapiens
aaccuuguguccuuugaau

SEQ ID NO: 868713 - RNA, 19 nt, Homo sapiens
gcaaagaaugugcaaaagu

SEQ ID NO: 868714 - RNA, 19 nt, Homo sapiens
caguggauguggacaagag

SEQ ID NO: 868715 - RNA, 19 nt, Homo sapiens
agacacacaagccuuacuu

SEQ ID NO: 868716 - RNA, 19 nt, Homo sapiens
aaacaucucaaacaguaag

SEQ ID NO: 868717 - RNA, 19 nt, Homo sapiens
aagggacaguugcauuugu

SEQ ID NO: 868718 - RNA, 19 nt, Homo sapiens
ccaagaacuccuaguacuc

SEQ ID NO: 868719 - RNA, 19 nt, Homo sapiens
gugcaaaagucuucuaugc

SEQ ID NO: 868720 - RNA, 19 nt, Homo sapiens
uaguuucaaucuuggaauc

SEQ ID NO: 868721 - RNA, 19 nt, Homo sapiens
agauggaacaguaugaaau

SEQ ID NO: 868722 - RNA, 19 nt, Homo sapiens
gaggcaaggccacauuguc

SEQ ID NO: 868723 - RNA, 19 nt, Homo sapiens
ggucauggagacaaacuac

SEQ ID NO: 868724 - RNA, 19 nt, Homo sapiens
ugcagacacacaagccuua

SEQ ID NO: 868725 - RNA, 19 nt, Homo sapiens
aggaugaaguugauugacu

SEQ ID NO: 868726 - RNA, 19 nt, Homo sapiens
ccuuguguccuuugaauuc

SEQ ID NO: 868727 - RNA, 19 nt, Homo sapiens
agaaccuuguguccuuuga

SEQ ID NO: 868728 - RNA, 19 nt, Homo sapiens
ggcgggaggaugaaguuga

SEQ ID NO: 868729 - RNA, 19 nt, Homo sapiens
ugcauuuguugagacuuua

SEQ ID NO: 868730 - RNA, 19 nt, Homo sapiens
gaucuagguauggaguuau

SEQ ID NO: 868731 - RNA, 19 nt, Homo sapiens
gaacagaguuugggauuga

SEQ ID NO: 868732 - RNA, 19 nt, Homo sapiens
gcagauggauccugagcua

SEQ ID NO: 868733 - RNA, 19 nt, Homo sapiens
gagaaucccugcugguuga

SEQ ID NO: 868734 - RNA, 19 nt, Homo sapiens
ggaggcagcuggauucaau

SEQ ID NO: 868735 - RNA, 19 nt, Homo sapiens
gagaaggaauugaaccaaa

SEQ ID NO: 868736 - RNA, 19 nt, Homo sapiens
gcaaccauauuuccucuga

SEQ ID NO: 868737 - RNA, 19 nt, Homo sapiens
gcccagagcaggcuucuua

SEQ ID NO: 868738 - RNA, 19 nt, Homo sapiens
gugcuaaccuggcugaauu

SEQ ID NO: 868739 - RNA, 19 nt, Homo sapiens
guccuggccucuccauuua

SEQ ID NO: 868740 - RNA, 19 nt, Homo sapiens
gaaguaggcccucguaugg

SEQ ID NO: 868741 - RNA, 19 nt, Homo sapiens
ccaagcgccucuucuuuga

SEQ ID NO: 868742 - RNA, 19 nt, Homo sapiens
aaagaaagcugaaaaguuc

SEQ ID NO: 868743 - RNA, 19 nt, Homo sapiens
cguauggguuucuuccuua

SEQ ID NO: 868744 - RNA, 19 nt, Homo sapiens
ucaaacuguuguacuauga

SEQ ID NO: 868745 - RNA, 19 nt, Homo sapiens
ggaaguaggcccucguaug

SEQ ID NO: 868746 - RNA, 19 nt, Homo sapiens
acaucaaacuguuguacua

SEQ ID NO: 868747 - RNA, 19 nt, Homo sapiens
gaaagaaagcugaaaaguu

SEQ ID NO: 868748 - RNA, 19 nt, Homo sapiens
gcuaugcccuggagacugu

SEQ ID NO: 868749 - RNA, 19 nt, Homo sapiens
ggaacagaguuugggauug

SEQ ID NO: 868750 - RNA, 19 nt, Homo sapiens
guuccucucuagacaagua

SEQ ID NO: 868751 - RNA, 19 nt, Homo sapiens
ggaucucacucaccaacuu

SEQ ID NO: 868752 - RNA, 19 nt, Homo sapiens
gaagccgucgccagaguua

SEQ ID NO: 868753 - RNA, 19 nt, Homo sapiens
aagcucaccugaccaagaa

SEQ ID NO: 868754 - RNA, 19 nt, Homo sapiens
acugauugcuuguuccaua

SEQ ID NO: 868755 - RNA, 19 nt, Homo sapiens
gagaagccgucgccagagu

SEQ ID NO: 868756 - RNA, 19 nt, Homo sapiens
gccugccucuugcuaaaua

SEQ ID NO: 868757 - RNA, 19 nt, Homo sapiens
ugaaugagaaggaauugaa

SEQ ID NO: 868758 - RNA, 19 nt, Homo sapiens
gcaaagauggagccagaau

SEQ ID NO: 868759 - RNA, 19 nt, Homo sapiens
cuacacggcaaccauauuu

SEQ ID NO: 868760 - RNA, 19 nt, Homo sapiens
cagcugagauaaccaagca

SEQ ID NO: 868761 - RNA, 19 nt, Homo sapiens
ccauauuuccucugaauga

SEQ ID NO: 868762 - RNA, 19 nt, Homo sapiens
ggaagcggcuccugaaccu

SEQ ID NO: 868763 - RNA, 19 nt, Homo sapiens
gccaagcgccucuucuuug

SEQ ID NO: 868764 - RNA, 19 nt, Homo sapiens
ggagcacacucagggaaga

SEQ ID NO: 868765 - RNA, 19 nt, Homo sapiens
aguuugggauugacuauaa

SEQ ID NO: 868766 - RNA, 19 nt, Homo sapiens
acauuaaagucuucgaguu

SEQ ID NO: 868767 - RNA, 19 nt, Homo sapiens
gaacaugcccaagggaaca

SEQ ID NO: 868768 - RNA, 19 nt, Homo sapiens
gaaacaagaaacccuggau

SEQ ID NO: 868769 - RNA, 19 nt, Homo sapiens
ccugauuccuuguguaugu

SEQ ID NO: 868770 - RNA, 19 nt, Homo sapiens
gggaacagaguuugggauu

SEQ ID NO: 868771 - RNA, 19 nt, Homo sapiens
aaagauggagccagaauuc

SEQ ID NO: 868772 - RNA, 19 nt, Homo sapiens
caaagauggagccagaauu

SEQ ID NO: 868773 - RNA, 19 nt, Homo sapiens
ccaagagcauaauguacau

SEQ ID NO: 868774 - RNA, 19 nt, Homo sapiens
uuaaggccuuuacgaaguu

SEQ ID NO: 868775 - RNA, 19 nt, Homo sapiens
cauuaaagucuucgaguug

SEQ ID NO: 868776 - RNA, 19 nt, Homo sapiens
caagggaggcagcuggauu

SEQ ID NO: 868777 - RNA, 19 nt, Homo sapiens
gcaccacacccucuacauc

SEQ ID NO: 868778 - RNA, 19 nt, Homo sapiens
ccacuguucaucaaagaaa

SEQ ID NO: 868779 - RNA, 19 nt, Homo sapiens
cuuaaggccuuuacgaagu

SEQ ID NO: 868780 - RNA, 19 nt, Homo sapiens
gaaagaacugauugcuugu

SEQ ID NO: 868781 - RNA, 19 nt, Homo sapiens
gaugccacccugagaaaga

SEQ ID NO: 868782 - RNA, 19 nt, Homo sapiens
gagccaccgugacuguuuc

SEQ ID NO: 868783 - RNA, 19 nt, Homo sapiens
ccaugaagcacaccaagga

SEQ ID NO: 868784 - RNA, 19 nt, Homo sapiens
aaacaagaaacccuggauu

SEQ ID NO: 868785 - RNA, 19 nt, Homo sapiens
aaccauauuuccucugaau

SEQ ID NO: 868786 - RNA, 19 nt, Homo sapiens
uggaggcccuuccugagaa

SEQ ID NO: 868787 - RNA, 19 nt, Homo sapiens
uaccugugcucuccaugaa

SEQ ID NO: 868788 - RNA, 19 nt, Homo sapiens
gaagcuacagcccgagaau

SEQ ID NO: 868789 - RNA, 19 nt, Homo sapiens
caagcucaccugaccaaga

SEQ ID NO: 868790 - RNA, 19 nt, Homo sapiens
gcuguggcauugagugcaa

SEQ ID NO: 868791 - RNA, 19 nt, Homo sapiens
gaaccaaaaguccaagaaa

SEQ ID NO: 868792 - RNA, 19 nt, Homo sapiens
cagaagcagccaugaugaa

SEQ ID NO: 868793 - RNA, 19 nt, Homo sapiens
guacgaggcauuugagcau

SEQ ID NO: 868794 - RNA, 19 nt, Homo sapiens
gcauccacuuccuccacua

SEQ ID NO: 868795 - RNA, 19 nt, Homo sapiens
cauaugccacccugaagaa

SEQ ID NO: 868796 - RNA, 19 nt, Homo sapiens
ccucccaccuguuccauuc

SEQ ID NO: 868797 - RNA, 19 nt, Homo sapiens
ccgccugccucuugcuaaa

SEQ ID NO: 868798 - RNA, 19 nt, Homo sapiens
caaccauauuuccucugaa

SEQ ID NO: 868799 - RNA, 19 nt, Homo sapiens
gugggacgcuggugucucu

SEQ ID NO: 868800 - RNA, 19 nt, Homo sapiens
ggacuuugcugcggaaccu

SEQ ID NO: 868801 - RNA, 19 nt, Homo sapiens
ugacuucuucguagacauu

SEQ ID NO: 868802 - RNA, 19 nt, Homo sapiens
aagcagccaugaugaagca

SEQ ID NO: 868803 - RNA, 19 nt, Homo sapiens
cugccacccugacaucaaa

SEQ ID NO: 868804 - RNA, 19 nt, Homo sapiens
caacaacaaccagaaaggu

SEQ ID NO: 868805 - RNA, 19 nt, Homo sapiens
aacaagaaacccuggauug

SEQ ID NO: 868806 - RNA, 19 nt, Homo sapiens
uauuuccucugaaugagaa

SEQ ID NO: 868807 - RNA, 19 nt, Homo sapiens
caccacacccucuacauca

SEQ ID NO: 868808 - RNA, 19 nt, Homo sapiens
ugacuuccacuguucauca

SEQ ID NO: 868809 - RNA, 19 nt, Homo sapiens
gcccaagggaacagaguuu

SEQ ID NO: 868810 - RNA, 19 nt, Homo sapiens
aaacuguuguacuaugauc

SEQ ID NO: 868811 - RNA, 19 nt, Homo sapiens
gucagaagcagccaugaug

SEQ ID NO: 868812 - RNA, 19 nt, Homo sapiens
uggagacugugcucaacaa

SEQ ID NO: 868813 - RNA, 19 nt, Homo sapiens
guuguacuaugaucacagu

SEQ ID NO: 868814 - RNA, 19 nt, Homo sapiens
uggcaggguuccucucuag

SEQ ID NO: 868815 - RNA, 19 nt, Homo sapiens
ccuggagagucaacaacaa

SEQ ID NO: 868816 - RNA, 19 nt, Homo sapiens
caccgugacuguuucugau

SEQ ID NO: 868817 - RNA, 19 nt, Homo sapiens
gacuuccacuguucaucaa

SEQ ID NO: 868818 - RNA, 19 nt, Homo sapiens
ucuagcagguggucagcuu

SEQ ID NO: 868819 - RNA, 19 nt, Homo sapiens
agaaggaauugaaccaaaa

SEQ ID NO: 868820 - RNA, 19 nt, Homo sapiens
ccgcugacuucuucguaga

SEQ ID NO: 868821 - RNA, 19 nt, Homo sapiens
ucagaagcagccaugauga

SEQ ID NO: 868822 - RNA, 19 nt, Homo sapiens
gcccgagaaucgacagauc

SEQ ID NO: 868823 - RNA, 19 nt, Homo sapiens
auuaaagucuucgaguuga

SEQ ID NO: 868824 - RNA, 19 nt, Homo sapiens
ggcggcugguucucuguuu

SEQ ID NO: 868825 - RNA, 19 nt, Homo sapiens
ccaccgugacuguuucuga

SEQ ID NO: 868826 - RNA, 19 nt, Homo sapiens
uaaccaagcacagcaugga

SEQ ID NO: 868827 - RNA, 19 nt, Homo sapiens
gcggcugguucucuguuug

SEQ ID NO: 868828 - RNA, 19 nt, Homo sapiens
ccgugacuguuucugauga

SEQ ID NO: 868829 - RNA, 19 nt, Homo sapiens
uuacgucgcgguuuucuua

SEQ ID NO: 868830 - RNA, 19 nt, Homo sapiens
aauaggagcagaggacuug

SEQ ID NO: 868831 - RNA, 19 nt, Homo sapiens
gaagcugugugcauuauga

SEQ ID NO: 868832 - RNA, 19 nt, Homo sapiens
gaaaugaaguucuccaaaa

SEQ ID NO: 868833 - RNA, 19 nt, Homo sapiens
uacaagaggucauuaggua

SEQ ID NO: 868834 - RNA, 19 nt, Homo sapiens
ggaauucagugcagacaga

SEQ ID NO: 868835 - RNA, 19 nt, Homo sapiens
gaugaaggcugcugagauc

SEQ ID NO: 868836 - RNA, 19 nt, Homo sapiens
gggaaugcauuaccaagaa

SEQ ID NO: 868837 - RNA, 19 nt, Homo sapiens
gcuccaagaugaccauuga

SEQ ID NO: 868838 - RNA, 19 nt, Homo sapiens
cagaacggcuccaagauga

SEQ ID NO: 868839 - RNA, 19 nt, Homo sapiens
ugaagcaccucucagaauu

SEQ ID NO: 868840 - RNA, 19 nt, Homo sapiens
gaagaaauccaaggacuga

SEQ ID NO: 868841 - RNA, 19 nt, Homo sapiens
gccaagaaccagcugauua

SEQ ID NO: 868842 - RNA, 19 nt, Homo sapiens
acacagagauggccguuau

SEQ ID NO: 868843 - RNA, 19 nt, Homo sapiens
gcaaaugggucuucuucca

SEQ ID NO: 868844 - RNA, 19 nt, Homo sapiens
ccuaaacucuggugacauu

SEQ ID NO: 868845 - RNA, 19 nt, Homo sapiens
cauagaagcugugugcauu

SEQ ID NO: 868846 - RNA, 19 nt, Homo sapiens
ccuacaagguccucaagua

SEQ ID NO: 868847 - RNA, 19 nt, Homo sapiens
gagaugaugugaagaaggu

SEQ ID NO: 868848 - RNA, 19 nt, Homo sapiens
ggagaacgccauccgcuuu

SEQ ID NO: 868849 - RNA, 19 nt, Homo sapiens
ucaagaacauggagaagga

SEQ ID NO: 868850 - RNA, 19 nt, Homo sapiens
guacaucgauaaugaagag

SEQ ID NO: 868851 - RNA, 19 nt, Homo sapiens
gaucaaagccaaugagaag

SEQ ID NO: 868852 - RNA, 19 nt, Homo sapiens
gacaccaucuccuuugauu

SEQ ID NO: 868853 - RNA, 19 nt, Homo sapiens
ucaacgggcugucggauga

SEQ ID NO: 868854 - RNA, 19 nt, Homo sapiens
ccacaaugcaggcuaagua

SEQ ID NO: 868855 - RNA, 19 nt, Homo sapiens
agaagaaacuggagcugaa

SEQ ID NO: 868856 - RNA, 19 nt, Homo sapiens
gcacccagauccucuucuu

SEQ ID NO: 868857 - RNA, 19 nt, Homo sapiens
caggcacucugcagaauuu

SEQ ID NO: 868858 - RNA, 19 nt, Homo sapiens
gagcagacaaccugaagaa

SEQ ID NO: 868859 - RNA, 19 nt, Homo sapiens
acaaauggaucaagaacau

SEQ ID NO: 868860 - RNA, 19 nt, Homo sapiens
caagaaggcacaagcuauu

SEQ ID NO: 868861 - RNA, 19 nt, Homo sapiens
cugcugaaguccuauagua

SEQ ID NO: 868862 - RNA, 19 nt, Homo sapiens
gcaaauuugucaucuccau

SEQ ID NO: 868863 - RNA, 19 nt, Homo sapiens
gaaacacggugcugaagcu

SEQ ID NO: 868864 - RNA, 19 nt, Homo sapiens
acaaugggcuggauguguu

SEQ ID NO: 868865 - RNA, 19 nt, Homo sapiens
gaucauuggugccuucaag

SEQ ID NO: 868866 - RNA, 19 nt, Homo sapiens
ugauaugccugagaucuuu

SEQ ID NO: 868867 - RNA, 19 nt, Homo sapiens
ucaaugauaugccugagau

SEQ ID NO: 868868 - RNA, 19 nt, Homo sapiens
gcagaacggcuccaagaug

SEQ ID NO: 868869 - RNA, 19 nt, Homo sapiens
gccaacaaauggaucaaga

SEQ ID NO: 868870 - RNA, 19 nt, Homo sapiens
ccucauggcugcuuacaca

SEQ ID NO: 868871 - RNA, 19 nt, Homo sapiens
ugaagaagguccugcucaa

SEQ ID NO: 868872 - RNA, 19 nt, Homo sapiens
gcucaagccucugucauca

SEQ ID NO: 868873 - RNA, 19 nt, Homo sapiens
caaguuugccgaagaaaug

SEQ ID NO: 868874 - RNA, 19 nt, Homo sapiens
cuacaaguuugccgaagaa

SEQ ID NO: 868875 - RNA, 19 nt, Homo sapiens
ccaagaaccagcugauuau

SEQ ID NO: 868876 - RNA, 19 nt, Homo sapiens
caugaggacuucaggaugu

SEQ ID NO: 868877 - RNA, 19 nt, Homo sapiens
ccaaugagaaggccaagaa

SEQ ID NO: 868878 - RNA, 19 nt, Homo sapiens
cuacagaaccuacccauca

SEQ ID NO: 868879 - RNA, 19 nt, Homo sapiens
gcuccgaugucaaguccua

SEQ ID NO: 868880 - RNA, 19 nt, Homo sapiens
ucaaugagaucccagaacu

SEQ ID NO: 868881 - RNA, 19 nt, Homo sapiens
agauugaacuauccaagaa

SEQ ID NO: 868882 - RNA, 19 nt, Homo sapiens
gggaccgacuggugaauga

SEQ ID NO: 868883 - RNA, 19 nt, Homo sapiens
gccaagaaccgcaugaaga

SEQ ID NO: 868884 - RNA, 19 nt, Homo sapiens
ggugauagaggaguacaua

SEQ ID NO: 868885 - RNA, 19 nt, Homo sapiens
ucaagccucugucaucaug

SEQ ID NO: 868886 - RNA, 19 nt, Homo sapiens
ucagccagcucaagauguu

SEQ ID NO: 868887 - RNA, 19 nt, Homo sapiens
gccaggagcugaaggacau

SEQ ID NO: 868888 - RNA, 19 nt, Homo sapiens
gaacgugggcgaggagcua

SEQ ID NO: 868889 - RNA, 19 nt, Homo sapiens
gaagagcggccucgacaag

SEQ ID NO: 868890 - RNA, 19 nt, Homo sapiens
ccaagaagugcaucgagua

SEQ ID NO: 868891 - RNA, 19 nt, Homo sapiens
ccaaguacccagugcugua

SEQ ID NO: 868892 - RNA, 19 nt, Homo sapiens
gaucugcgcaucugcauca

SEQ ID NO: 868893 - RNA, 19 nt, Homo sapiens
gccacaaggugauggaguu

SEQ ID NO: 868894 - RNA, 19 nt, Homo sapiens
gagcagaucaagguggaua

SEQ ID NO: 868895 - RNA, 19 nt, Homo sapiens
gaagaaacuggagcugaaa

SEQ ID NO: 868896 - RNA, 19 nt, Homo sapiens
gggccaaccugcugaaguc

SEQ ID NO: 868897 - RNA, 19 nt, Homo sapiens
gugugaaacuggucauaga

SEQ ID NO: 868898 - RNA, 19 nt, Homo sapiens
uaacaggcacucugcagaa

SEQ ID NO: 868899 - RNA, 19 nt, Homo sapiens
guacgagugcuuccagauu

SEQ ID NO: 868900 - RNA, 19 nt, Homo sapiens
ggacgaggucagcaagaaa

SEQ ID NO: 868901 - RNA, 19 nt, Homo sapiens
ugucagugguguucaaaga

SEQ ID NO: 868902 - RNA, 19 nt, Homo sapiens
ugaagaagcgcaucuccaa

SEQ ID NO: 868903 - RNA, 19 nt, Homo sapiens
gcagacagaggagaucaaa

SEQ ID NO: 868904 - RNA, 19 nt, Homo sapiens
aggaggaccuggagaguau

SEQ ID NO: 868905 - RNA, 19 nt, Homo sapiens
ucaagaaccuaguggacau

SEQ ID NO: 868906 - RNA, 19 nt, Homo sapiens
guacauagaggacuacaac

SEQ ID NO: 868907 - RNA, 19 nt, Homo sapiens
ccaaccugcugaaguccua

SEQ ID NO: 868908 - RNA, 19 nt, Homo sapiens
ccaucucgaucaugacuga

SEQ ID NO: 868909 - RNA, 19 nt, Homo sapiens
gcgcuggacccacuucauu

SEQ ID NO: 868910 - RNA, 19 nt, Homo sapiens
ggaaugcauuaccaagaag

SEQ ID NO: 868911 - RNA, 19 nt, Homo sapiens
gaaggugccuggagaaaag

SEQ ID NO: 868912 - RNA, 19 nt, Homo sapiens
ccaccguguuccucaauga

SEQ ID NO: 868913 - RNA, 19 nt, Homo sapiens
ucaagagccucccacucaa

SEQ ID NO: 868914 - RNA, 19 nt, Homo sapiens
agauguuccuggacgaaua

SEQ ID NO: 868915 - RNA, 19 nt, Homo sapiens
gaaggacaaugggcuggau

SEQ ID NO: 868916 - RNA, 19 nt, Homo sapiens
gaacauggagaaggacaau

SEQ ID NO: 868917 - RNA, 19 nt, Homo sapiens
caacaacguccuaaacucu

SEQ ID NO: 868918 - RNA, 19 nt, Homo sapiens
uacgagugcuuccagauug

SEQ ID NO: 868919 - RNA, 19 nt, Homo sapiens
caacccaaaucaucuucug

SEQ ID NO: 868920 - RNA, 19 nt, Homo sapiens
aagcgcaucuccaacauca

SEQ ID NO: 868921 - RNA, 19 nt, Homo sapiens
ccaagaaggcacaagcuau

SEQ ID NO: 868922 - RNA, 19 nt, Homo sapiens
gcgcacuucugaggaugua

SEQ ID NO: 868923 - RNA, 19 nt, Homo sapiens
acuuggagcugcuucauau

SEQ ID NO: 868924 - RNA, 19 nt, Homo sapiens
gcagcaacauccacauggu

SEQ ID NO: 868925 - RNA, 19 nt, Homo sapiens
guaagaugaugcaggugau

SEQ ID NO: 868926 - RNA, 19 nt, Homo sapiens
aaugaacacaguacuagua

SEQ ID NO: 868927 - RNA, 19 nt, Homo sapiens
ggaaucaaugaacacagua

SEQ ID NO: 868928 - RNA, 19 nt, Homo sapiens
ucucgaaccugccaaccuu

SEQ ID NO: 868929 - RNA, 19 nt, Homo sapiens
gggcaacccuguagaugac

SEQ ID NO: 868930 - RNA, 19 nt, Homo sapiens
agccguacaucgauaauga

SEQ ID NO: 868931 - RNA, 19 nt, Homo sapiens
gaagcaaacugucauauug

SEQ ID NO: 868932 - RNA, 19 nt, Homo sapiens
ggaaagagcucauucucau

SEQ ID NO: 868933 - RNA, 19 nt, Homo sapiens
gaagaagcaucgagacuug

SEQ ID NO: 868934 - RNA, 19 nt, Homo sapiens
gaagguaaaugaacaaugg

SEQ ID NO: 868935 - RNA, 19 nt, Homo sapiens
gaaagauuauucccaguau

SEQ ID NO: 868936 - RNA, 19 nt, Homo sapiens
gcacaaugauacaaucuug

SEQ ID NO: 868937 - RNA, 19 nt, Homo sapiens
aaagauacccuuggaauua

SEQ ID NO: 868938 - RNA, 19 nt, Homo sapiens
gggaagaucugauuaaggu

SEQ ID NO: 868939 - RNA, 19 nt, Homo sapiens
gauaguggaugguaagaug

SEQ ID NO: 868940 - RNA, 19 nt, Homo sapiens
gaaucaaagucgagcauga

SEQ ID NO: 868941 - RNA, 19 nt, Homo sapiens
ggaauuaucagacucagaa

SEQ ID NO: 868942 - RNA, 19 nt, Homo sapiens
gcagaacaaugaauaccaa

SEQ ID NO: 868943 - RNA, 19 nt, Homo sapiens
ggaaguggaagguaaauga

SEQ ID NO: 868944 - RNA, 19 nt, Homo sapiens
agaaagacuuggaaauuga

SEQ ID NO: 868945 - RNA, 19 nt, Homo sapiens
gaccaucaacggaagauua

SEQ ID NO: 868946 - RNA, 19 nt, Homo sapiens
agaaggaaaucaccacgua

SEQ ID NO: 868947 - RNA, 19 nt, Homo sapiens
aaacacaaguugcacaaug

SEQ ID NO: 868948 - RNA, 19 nt, Homo sapiens
aaacuucacggcaagauua

SEQ ID NO: 868949 - RNA, 19 nt, Homo sapiens
gaccaaugcucagauuauu

SEQ ID NO: 868950 - RNA, 19 nt, Homo sapiens
ggaagcaaacugucauauu

SEQ ID NO: 868951 - RNA, 19 nt, Homo sapiens
gaaaguccuugcacagaca

SEQ ID NO: 868952 - RNA, 19 nt, Homo sapiens
gaacaaugaauaccaagug

SEQ ID NO: 868953 - RNA, 19 nt, Homo sapiens
cacgaaaucugcuuuggaa

SEQ ID NO: 868954 - RNA, 19 nt, Homo sapiens
aagaaagacuuggaaauug

SEQ ID NO: 868955 - RNA, 19 nt, Homo sapiens
aaugaacacuccuuuaaga

SEQ ID NO: 868956 - RNA, 19 nt, Homo sapiens
gaugaccaaugcucagauu

SEQ ID NO: 868957 - RNA, 19 nt, Homo sapiens
gcaguaagaaagauuauuc

SEQ ID NO: 868958 - RNA, 19 nt, Homo sapiens
gaaagccgcauccugaaau

SEQ ID NO: 868959 - RNA, 19 nt, Homo sapiens
ggccaggguuguuugguuu

SEQ ID NO: 868960 - RNA, 19 nt, Homo sapiens
caccagacuucucauaaug

SEQ ID NO: 868961 - RNA, 19 nt, Homo sapiens
gcacgcaugagaccaauga

SEQ ID NO: 868962 - RNA, 19 nt, Homo sapiens
gaaaaugaacacuccuuua

SEQ ID NO: 868963 - RNA, 19 nt, Homo sapiens
ggaaagccgcauccugaaa

SEQ ID NO: 868964 - RNA, 19 nt, Homo sapiens
ucaagugaaugaaauccaa

SEQ ID NO: 868965 - RNA, 19 nt, Homo sapiens
gaaagacuuggaaauugaa

SEQ ID NO: 868966 - RNA, 19 nt, Homo sapiens
uaaucaaagugcgaguuua

SEQ ID NO: 868967 - RNA, 19 nt, Homo sapiens
ucaccagacuucucauaau

SEQ ID NO: 868968 - RNA, 19 nt, Homo sapiens
gaggugugcugggaugaaa

SEQ ID NO: 868969 - RNA, 19 nt, Homo sapiens
aaagauaccugagcccaau

SEQ ID NO: 868970 - RNA, 19 nt, Homo sapiens
gaaaggcacccuggaagug

SEQ ID NO: 868971 - RNA, 19 nt, Homo sapiens
ccaaagaucaaggccauaa

SEQ ID NO: 868972 - RNA, 19 nt, Homo sapiens
aaacccaccuggagaagga

SEQ ID NO: 868973 - RNA, 19 nt, Homo sapiens
cggcaagauuagaaagaua

SEQ ID NO: 868974 - RNA, 19 nt, Homo sapiens
gaaguggaagguaaaugaa

SEQ ID NO: 868975 - RNA, 19 nt, Homo sapiens
gaugaaaggcacccuggaa

SEQ ID NO: 868976 - RNA, 19 nt, Homo sapiens
gagcagauaguggauggua

SEQ ID NO: 868977 - RNA, 19 nt, Homo sapiens
ucaaagugcgaguuuauga

SEQ ID NO: 868978 - RNA, 19 nt, Homo sapiens
ggaaacacaaguugcacaa

SEQ ID NO: 868979 - RNA, 19 nt, Homo sapiens
ggacacgggaagaaucaaa

SEQ ID NO: 868980 - RNA, 19 nt, Homo sapiens
ugacgcagcuacgccauga

SEQ ID NO: 868981 - RNA, 19 nt, Homo sapiens
gcacgaaaucugcuuugga

SEQ ID NO: 868982 - RNA, 19 nt, Homo sapiens
ugaacacuccuuuaagaaa

SEQ ID NO: 868983 - RNA, 19 nt, Homo sapiens
ggaaggccaccaugcagaa

SEQ ID NO: 868984 - RNA, 19 nt, Homo sapiens
gaacuggagcggcagaaca

SEQ ID NO: 868985 - RNA, 19 nt, Homo sapiens
ccagggaagaucugauuaa

SEQ ID NO: 868986 - RNA, 19 nt, Homo sapiens
caagaggaaacacaaguug

SEQ ID NO: 868987 - RNA, 19 nt, Homo sapiens
caaagucgagcaugaaagu

SEQ ID NO: 868988 - RNA, 19 nt, Homo sapiens
gaagcaccaugagcaggaa

SEQ ID NO: 868989 - RNA, 19 nt, Homo sapiens
agagagauccuggcaguaa

SEQ ID NO: 868990 - RNA, 19 nt, Homo sapiens
gcuaacaacggcuacauuc

SEQ ID NO: 868991 - RNA, 19 nt, Homo sapiens
gaaauggagaagcaucaug

SEQ ID NO: 868992 - RNA, 19 nt, Homo sapiens
gaaagagcucauucucaug

SEQ ID NO: 868993 - RNA, 19 nt, Homo sapiens
gaacaggagguggaaggaa

SEQ ID NO: 868994 - RNA, 19 nt, Homo sapiens
cagauuauucuucucauug

SEQ ID NO: 868995 - RNA, 19 nt, Homo sapiens
agaaagauuauucccagua

SEQ ID NO: 868996 - RNA, 19 nt, Homo sapiens
gaaauggcaccagcagaga

SEQ ID NO: 868997 - RNA, 19 nt, Homo sapiens
ggacacuugguauaaagaa

SEQ ID NO: 868998 - RNA, 19 nt, Homo sapiens
ggauggcaguggaugacuu

SEQ ID NO: 868999 - RNA, 19 nt, Homo sapiens
aacacaaguugcacaauga

SEQ ID NO: 869000 - RNA, 19 nt, Homo sapiens
caaacugucauauugaugu

SEQ ID NO: 869001 - RNA, 19 nt, Homo sapiens
gaggaagcaaacugucaua

SEQ ID NO: 869002 - RNA, 19 nt, Homo sapiens
ccacagcaaaggccauaaa

SEQ ID NO: 869003 - RNA, 19 nt, Homo sapiens
gacagcccauggcagguuu

SEQ ID NO: 869004 - RNA, 19 nt, Homo sapiens
gaagggaggaagcaaacug

SEQ ID NO: 869005 - RNA, 19 nt, Homo sapiens
uaucagacucagaaacuuu

SEQ ID NO: 869006 - RNA, 19 nt, Homo sapiens
aagauacccuuggaauuau

SEQ ID NO: 869007 - RNA, 19 nt, Homo sapiens
gaagggacacgggaagaau

SEQ ID NO: 869008 - RNA, 19 nt, Homo sapiens
gaacugaagcgcacauucc

SEQ ID NO: 869009 - RNA, 19 nt, Homo sapiens
gagcagacaaggugacauc

SEQ ID NO: 869010 - RNA, 19 nt, Homo sapiens
uuagacaaccugaccauug

SEQ ID NO: 869011 - RNA, 19 nt, Homo sapiens
gagagauccuggcaguaag

SEQ ID NO: 869012 - RNA, 19 nt, Homo sapiens
gguaaaugaacaauggaaa

SEQ ID NO: 869013 - RNA, 19 nt, Homo sapiens
cuucagauucucaucauuu

SEQ ID NO: 869014 - RNA, 19 nt, Homo sapiens
gcucagauuauucuucuca

SEQ ID NO: 869015 - RNA, 19 nt, Homo sapiens
uuaguucuuugucaaguga

SEQ ID NO: 869016 - RNA, 19 nt, Homo sapiens
ugaccaaugcucagauuau

SEQ ID NO: 869017 - RNA, 19 nt, Homo sapiens
aagauuauucccaguauga

SEQ ID NO: 869018 - RNA, 19 nt, Homo sapiens
ggaggaggccaacaugaag

SEQ ID NO: 869019 - RNA, 19 nt, Homo sapiens
cuaaucaaagugcgaguuu

SEQ ID NO: 869020 - RNA, 19 nt, Homo sapiens
caucaacggaagauuaguu

SEQ ID NO: 869021 - RNA, 19 nt, Homo sapiens
gcagauaguggaugguaag

SEQ ID NO: 869022 - RNA, 19 nt, Homo sapiens
ggaagguaaaugaacaaug

SEQ ID NO: 869023 - RNA, 19 nt, Homo sapiens
ugauguggcucuaaacaac

SEQ ID NO: 869024 - RNA, 19 nt, Homo sapiens
uaagauucaucaaccacau

SEQ ID NO: 869025 - RNA, 19 nt, Homo sapiens
caucgagacuuggacacuu

SEQ ID NO: 869026 - RNA, 19 nt, Homo sapiens
ccaagaggaaacacaaguu

SEQ ID NO: 869027 - RNA, 19 nt, Homo sapiens
aaucaaagugcgaguuuau

SEQ ID NO: 869028 - RNA, 19 nt, Homo sapiens
gauuaguucuuugucaagu

SEQ ID NO: 869029 - RNA, 19 nt, Homo sapiens
cagggaagaucugauuaag

SEQ ID NO: 869030 - RNA, 19 nt, Homo sapiens
uggaaggaaugaggaaaga

SEQ ID NO: 869031 - RNA, 19 nt, Homo sapiens
gaagaagcaucgagacuug

SEQ ID NO: 869032 - RNA, 19 nt, Homo sapiens
aaagauacccuuggaauua

SEQ ID NO: 869033 - RNA, 19 nt, Homo sapiens
gggaagaucugauuaaggu

SEQ ID NO: 869034 - RNA, 19 nt, Homo sapiens
gauaguggaugguaagaug

SEQ ID NO: 869035 - RNA, 19 nt, Homo sapiens
gaaucaaagucgagcauga

SEQ ID NO: 869036 - RNA, 19 nt, Homo sapiens
ggaauuaucagacucagaa

SEQ ID NO: 869037 - RNA, 19 nt, Homo sapiens
gcagaacaaugaauaccaa

SEQ ID NO: 869038 - RNA, 19 nt, Homo sapiens
gaccaucaacggaagauua

SEQ ID NO: 869039 - RNA, 19 nt, Homo sapiens
agaaggaaaucaccacgua

SEQ ID NO: 869040 - RNA, 19 nt, Homo sapiens
gaccaaugcucagauuauu

SEQ ID NO: 869041 - RNA, 19 nt, Homo sapiens
aagguucggucauucauua

SEQ ID NO: 869042 - RNA, 19 nt, Homo sapiens
gaaaguccuugcacagaca

SEQ ID NO: 869043 - RNA, 19 nt, Homo sapiens
gaacaaugaauaccaagug

SEQ ID NO: 869044 - RNA, 19 nt, Homo sapiens
cacgaaaucugcuuuggaa

SEQ ID NO: 869045 - RNA, 19 nt, Homo sapiens
gaugaccaaugcucagauu

SEQ ID NO: 869046 - RNA, 19 nt, Homo sapiens
ccacaaaggcaucagauau

SEQ ID NO: 869047 - RNA, 19 nt, Homo sapiens
guacuuuccuucaaacagu

SEQ ID NO: 869048 - RNA, 19 nt, Homo sapiens
ggccaggguuguuugguuu

SEQ ID NO: 869049 - RNA, 19 nt, Homo sapiens
caccagacuucucauaaug

SEQ ID NO: 869050 - RNA, 19 nt, Homo sapiens
gcacgcaugagaccaauga

SEQ ID NO: 869051 - RNA, 19 nt, Homo sapiens
cacccucccuuuagagaua

SEQ ID NO: 869052 - RNA, 19 nt, Homo sapiens
gaccugagauccuguucug

SEQ ID NO: 869053 - RNA, 19 nt, Homo sapiens
ucaagugaaugaaauccaa

SEQ ID NO: 869054 - RNA, 19 nt, Homo sapiens
uaaucaaagugcgaguuua

SEQ ID NO: 869055 - RNA, 19 nt, Homo sapiens
ucaccagacuucucauaau

SEQ ID NO: 869056 - RNA, 19 nt, Homo sapiens
guucggucauucauuaauu

SEQ ID NO: 869057 - RNA, 19 nt, Homo sapiens
gaaaggcacccuggaagug

SEQ ID NO: 869058 - RNA, 19 nt, Homo sapiens
gaggugugcugggaugaaa

SEQ ID NO: 869059 - RNA, 19 nt, Homo sapiens
ccaaagaucaaggccauaa

SEQ ID NO: 869060 - RNA, 19 nt, Homo sapiens
aaacccaccuggagaagga

SEQ ID NO: 869061 - RNA, 19 nt, Homo sapiens
caucuauaauugaggguuu

SEQ ID NO: 869062 - RNA, 19 nt, Homo sapiens
acaaaggcaucagauauuc

SEQ ID NO: 869063 - RNA, 19 nt, Homo sapiens
gaugaaaggcacccuggaa

SEQ ID NO: 869064 - RNA, 19 nt, Homo sapiens
ucaaagugcgaguuuauga

SEQ ID NO: 869065 - RNA, 19 nt, Homo sapiens
ggacacgggaagaaucaaa

SEQ ID NO: 869066 - RNA, 19 nt, Homo sapiens
ugacgcagcuacgccauga

SEQ ID NO: 869067 - RNA, 19 nt, Homo sapiens
gcacgaaaucugcuuugga

SEQ ID NO: 869068 - RNA, 19 nt, Homo sapiens
cacaaaggcaucagauauu

SEQ ID NO: 869069 - RNA, 19 nt, Homo sapiens
gaacuggagcggcagaaca

SEQ ID NO: 869070 - RNA, 19 nt, Homo sapiens
ccagggaagaucugauuaa

SEQ ID NO: 869071 - RNA, 19 nt, Homo sapiens
caaagucgagcaugaaagu

SEQ ID NO: 869072 - RNA, 19 nt, Homo sapiens
gcuaacaacggcuacauuc

SEQ ID NO: 869073 - RNA, 19 nt, Homo sapiens
gaaauggagaagcaucaug

SEQ ID NO: 869074 - RNA, 19 nt, Homo sapiens
cagauuauucuucucauug

SEQ ID NO: 869075 - RNA, 19 nt, Homo sapiens
cagcacagcaagcuuuauu

SEQ ID NO: 869076 - RNA, 19 nt, Homo sapiens
ggacacuugguauaaagaa

SEQ ID NO: 869077 - RNA, 19 nt, Homo sapiens
ugacuucaaccucaagaaa

SEQ ID NO: 869078 - RNA, 19 nt, Homo sapiens
ggauggcaguggaugacuu

SEQ ID NO: 869079 - RNA, 19 nt, Homo sapiens
aauugaggguuuguucuua

SEQ ID NO: 869080 - RNA, 19 nt, Homo sapiens
gacagcccauggcagguuu

SEQ ID NO: 869081 - RNA, 19 nt, Homo sapiens
gcacagcaagcuuuauucu

SEQ ID NO: 869082 - RNA, 19 nt, Homo sapiens
uaagagcgaguccuuugaa

SEQ ID NO: 869083 - RNA, 19 nt, Homo sapiens
uaucagacucagaaacuuu

SEQ ID NO: 869084 - RNA, 19 nt, Homo sapiens
aagauacccuuggaauuau

SEQ ID NO: 869085 - RNA, 19 nt, Homo sapiens
gaagggacacgggaagaau

SEQ ID NO: 869086 - RNA, 19 nt, Homo sapiens
gaacugaagcgcacauucc

SEQ ID NO: 869087 - RNA, 19 nt, Homo sapiens
gagcagacaaggugacauc

SEQ ID NO: 869088 - RNA, 19 nt, Homo sapiens
uagagauaguggaugguaa

SEQ ID NO: 869089 - RNA, 19 nt, Homo sapiens
gaagguucggucauucauu

SEQ ID NO: 869090 - RNA, 19 nt, Homo sapiens
cuucagauucucaucauuu

SEQ ID NO: 869091 - RNA, 19 nt, Homo sapiens
gcucagauuauucuucuca

SEQ ID NO: 869092 - RNA, 19 nt, Homo sapiens
uuaguucuuugucaaguga

SEQ ID NO: 869093 - RNA, 19 nt, Homo sapiens
ugaccaaugcucagauuau

SEQ ID NO: 869094 - RNA, 19 nt, Homo sapiens
cuaaucaaagugcgaguuu

SEQ ID NO: 869095 - RNA, 19 nt, Homo sapiens
caucaacggaagauuaguu

SEQ ID NO: 869096 - RNA, 19 nt, Homo sapiens
uaagauucaucaaccacau

SEQ ID NO: 869097 - RNA, 19 nt, Homo sapiens
caucgagacuuggacacuu

SEQ ID NO: 869098 - RNA, 19 nt, Homo sapiens
aaucaaagugcgaguuuau

SEQ ID NO: 869099 - RNA, 19 nt, Homo sapiens
gauuaguucuuugucaagu

SEQ ID NO: 869100 - RNA, 19 nt, Homo sapiens
cagggaagaucugauuaag

SEQ ID NO: 869101 - RNA, 19 nt, Homo sapiens
gcgcaggccaggguuguuu

SEQ ID NO: 869102 - RNA, 19 nt, Homo sapiens
gcaugagaccaaugaaagu

SEQ ID NO: 869103 - RNA, 19 nt, Homo sapiens
gaggguuuguucuuaagag

SEQ ID NO: 869104 - RNA, 19 nt, Homo sapiens
aagagcgaguccuuugaaa

SEQ ID NO: 869105 - RNA, 19 nt, Homo sapiens
ccucagcacagcaagcuuu

SEQ ID NO: 869106 - RNA, 19 nt, Homo sapiens
gccacaaaggcaucagaua

SEQ ID NO: 869107 - RNA, 19 nt, Homo sapiens
cuacugcagccuucagauu

SEQ ID NO: 869108 - RNA, 19 nt, Homo sapiens
uaauugaggguuuguucuu

SEQ ID NO: 869109 - RNA, 19 nt, Homo sapiens
ggcaguggaugacuucaac

SEQ ID NO: 869110 - RNA, 19 nt, Homo sapiens
ccaaugcucagauuauucu

SEQ ID NO: 869111 - RNA, 19 nt, Homo sapiens
caauaaaacuccgcacuag

SEQ ID NO: 869112 - RNA, 19 nt, Homo sapiens
gcagcuacgccaugaacug

SEQ ID NO: 869113 - RNA, 19 nt, Homo sapiens
gagacuuggacacuuggua

SEQ ID NO: 869114 - RNA, 19 nt, Homo sapiens
auugaggguuuguucuuaa

SEQ ID NO: 869115 - RNA, 19 nt, Homo sapiens
ugaaugaaauccaaaagca

SEQ ID NO: 869116 - RNA, 19 nt, Homo sapiens
caagugaaugaaauccaaa

SEQ ID NO: 869117 - RNA, 19 nt, Homo sapiens
ggacaugcaagagaucauc

SEQ ID NO: 869118 - RNA, 19 nt, Homo sapiens
caaaggcaucagauauuca

SEQ ID NO: 869119 - RNA, 19 nt, Homo sapiens
cucaagaaauggagaagca

SEQ ID NO: 869120 - RNA, 19 nt, Homo sapiens
acuucaaccucaagaaaug

SEQ ID NO: 869121 - RNA, 19 nt, Homo sapiens
gacuuggacacuugguaua

SEQ ID NO: 869122 - RNA, 19 nt, Homo sapiens
ugagcuggcuuucccuucu

SEQ ID NO: 869123 - RNA, 19 nt, Homo sapiens
gaauuaucagacucagaaa

SEQ ID NO: 869124 - RNA, 19 nt, Homo sapiens
aaaguuuccgccuguugua

SEQ ID NO: 869125 - RNA, 19 nt, Homo sapiens
gaaaucugcuuuggaaaac

SEQ ID NO: 869126 - RNA, 19 nt, Homo sapiens
cgaaaucugcuuuggaaaa

SEQ ID NO: 869127 - RNA, 19 nt, Homo sapiens
ugacauccacgaacugaag

SEQ ID NO: 869128 - RNA, 19 nt, Homo sapiens
cuuggacacuugguauaaa

SEQ ID NO: 869129 - RNA, 19 nt, Homo sapiens
cuuaagagcgaguccuuug

SEQ ID NO: 869130 - RNA, 19 nt, Homo sapiens
aguggaagguucggucauu

SEQ ID NO: 869131 - RNA, 19 nt, Homo sapiens
ggagacaugucauuuguaa

SEQ ID NO: 869132 - RNA, 19 nt, Homo sapiens
uaacauagcccuuucuuug

SEQ ID NO: 869133 - RNA, 19 nt, Homo sapiens
ggcaggagcugagguguuu

SEQ ID NO: 869134 - RNA, 19 nt, Homo sapiens
ccaaggaguugcugcaguu

SEQ ID NO: 869135 - RNA, 19 nt, Homo sapiens
uuucuugucuccucuaaua

SEQ ID NO: 869136 - RNA, 19 nt, Homo sapiens
uagaaggaauugcaaagaa

SEQ ID NO: 869137 - RNA, 19 nt, Homo sapiens
ggacuucgaugccaaacca

SEQ ID NO: 869138 - RNA, 19 nt, Homo sapiens
ccaagugccuucccucaug

SEQ ID NO: 869139 - RNA, 19 nt, Homo sapiens
ccaaugcacuuucuugucu

SEQ ID NO: 869140 - RNA, 19 nt, Homo sapiens
ccgaguaacuuauguucaa

SEQ ID NO: 869141 - RNA, 19 nt, Homo sapiens
ggcaagagccucacaagug

SEQ ID NO: 869142 - RNA, 19 nt, Homo sapiens
ggcuggagauggugaauga

SEQ ID NO: 869143 - RNA, 19 nt, Homo sapiens
ucuaaccgguccuugauuu

SEQ ID NO: 869144 - RNA, 19 nt, Homo sapiens
gggcaucaguggccacaug

SEQ ID NO: 869145 - RNA, 19 nt, Homo sapiens
cuauuucccuagaaccuua

SEQ ID NO: 869146 - RNA, 19 nt, Homo sapiens
cggagccucuggaagcuua

SEQ ID NO: 869147 - RNA, 19 nt, Homo sapiens
guggagaccuucggccuuu

SEQ ID NO: 869148 - RNA, 19 nt, Homo sapiens
acccugggcuguuuccuua

SEQ ID NO: 869149 - RNA, 19 nt, Homo sapiens
agaaggaauugcaaagaau

SEQ ID NO: 869150 - RNA, 19 nt, Homo sapiens
gguugcauuuguucacuuu

SEQ ID NO: 869151 - RNA, 19 nt, Homo sapiens
gauggagacaugucauuug

SEQ ID NO: 869152 - RNA, 19 nt, Homo sapiens
ggauggagacaugucauuu

SEQ ID NO: 869153 - RNA, 19 nt, Homo sapiens
uaaccgguccuugauuuaa

SEQ ID NO: 869154 - RNA, 19 nt, Homo sapiens
gaaggaauugcaaagaauc

SEQ ID NO: 869155 - RNA, 19 nt, Homo sapiens
gacguuggcuggccuggau

SEQ ID NO: 869156 - RNA, 19 nt, Homo sapiens
guuccagccuagccaguuu

SEQ ID NO: 869157 - RNA, 19 nt, Homo sapiens
gaaacugaggccuugagaa

SEQ ID NO: 869158 - RNA, 19 nt, Homo sapiens
ugacucggguggauuguag

SEQ ID NO: 869159 - RNA, 19 nt, Homo sapiens
aaacugaggccuugagaag

SEQ ID NO: 869160 - RNA, 19 nt, Homo sapiens
guagaaggaauugcaaaga

SEQ ID NO: 869161 - RNA, 19 nt, Homo sapiens
ucaggucccgaguaacuua

SEQ ID NO: 869162 - RNA, 19 nt, Homo sapiens
ugccucaggucccgaguaa

SEQ ID NO: 869163 - RNA, 19 nt, Homo sapiens
ugcaggagcuggaccuuuc

SEQ ID NO: 869164 - RNA, 19 nt, Homo sapiens
gccugaaccuggccuggaa

SEQ ID NO: 869165 - RNA, 19 nt, Homo sapiens
ccaccugccuagcccauca

SEQ ID NO: 869166 - RNA, 19 nt, Homo sapiens
ggaaacugaggccuugaga

SEQ ID NO: 869167 - RNA, 19 nt, Homo sapiens
acuggaaaccuacccauuu

SEQ ID NO: 869168 - RNA, 19 nt, Homo sapiens
caaguccacccuucucaug

SEQ ID NO: 869169 - RNA, 19 nt, Homo sapiens
cccuagaaccuuaauggua

SEQ ID NO: 869170 - RNA, 19 nt, Homo sapiens
ucccaggaaugccgugaaa

SEQ ID NO: 869171 - RNA, 19 nt, Homo sapiens
cagccuagccaguuucuca

SEQ ID NO: 869172 - RNA, 19 nt, Homo sapiens
cuaaccgguccuugauuua

SEQ ID NO: 869173 - RNA, 19 nt, Homo sapiens
uagcccaucaucuaucuaa

SEQ ID NO: 869174 - RNA, 19 nt, Homo sapiens
gaauugcaaagaaucaagu

SEQ ID NO: 869175 - RNA, 19 nt, Homo sapiens
gggauggagacaugucauu

SEQ ID NO: 869176 - RNA, 19 nt, Homo sapiens
gcccaucccucuggacaca

SEQ ID NO: 869177 - RNA, 19 nt, Homo sapiens
gggcgaguuucuuuucuaa

SEQ ID NO: 869178 - RNA, 19 nt, Homo sapiens
ccaaccggcuggagauggu

SEQ ID NO: 869179 - RNA, 19 nt, Homo sapiens
cgaguaacuuauguucaau

SEQ ID NO: 869180 - RNA, 19 nt, Homo sapiens
gcacgacagcccuucuuac

SEQ ID NO: 869181 - RNA, 19 nt, Homo sapiens
gacccaaugcacuuucuug

SEQ ID NO: 869182 - RNA, 19 nt, Homo sapiens
ggaauugcaaagaaucaag

SEQ ID NO: 869183 - RNA, 19 nt, Homo sapiens
cugccuagcccaucaucua

SEQ ID NO: 869184 - RNA, 19 nt, Homo sapiens
gagcacgacagcccuucuu

SEQ ID NO: 869185 - RNA, 19 nt, Homo sapiens
caaggggccuccuggauuc

SEQ ID NO: 869186 - RNA, 19 nt, Homo sapiens
ugagcgacgugaaccuuag

SEQ ID NO: 869187 - RNA, 19 nt, Homo sapiens
gaccugggagccacaccua

SEQ ID NO: 869188 - RNA, 19 nt, Homo sapiens
accgguccuugauuuaaua

SEQ ID NO: 869189 - RNA, 19 nt, Homo sapiens
cuucuuacccucccaggaa

SEQ ID NO: 869190 - RNA, 19 nt, Homo sapiens
gguagaaggaauugcaaag

SEQ ID NO: 869191 - RNA, 19 nt, Homo sapiens
auggagacaugucauuugu

SEQ ID NO: 869192 - RNA, 19 nt, Homo sapiens
ggaagcuuagggcacauug

SEQ ID NO: 869193 - RNA, 19 nt, Homo sapiens
guccacccuucucauguga

SEQ ID NO: 869194 - RNA, 19 nt, Homo sapiens
cuagaaccuuaaugguaga

SEQ ID NO: 869195 - RNA, 19 nt, Homo sapiens
gcgaguuucuuuucuaaca

SEQ ID NO: 869196 - RNA, 19 nt, Homo sapiens
ggucccgaguaacuuaugu

SEQ ID NO: 869197 - RNA, 19 nt, Homo sapiens
gggcaggagcugagguguu

SEQ ID NO: 869198 - RNA, 19 nt, Homo sapiens
uaucuaaccgguccuugau

SEQ ID NO: 869199 - RNA, 19 nt, Homo sapiens
gcuguuuccuuagucuuca

SEQ ID NO: 869200 - RNA, 19 nt, Homo sapiens
uccgaacccugggcuguuu

SEQ ID NO: 869201 - RNA, 19 nt, Homo sapiens
uugcugcccuugccuguuc

SEQ ID NO: 869202 - RNA, 19 nt, Homo sapiens
ggaacccucuagcugucau

SEQ ID NO: 869203 - RNA, 19 nt, Homo sapiens
gacuggaaaccuacccauu

SEQ ID NO: 869204 - RNA, 19 nt, Homo sapiens
ccacccuucucaugugaca

SEQ ID NO: 869205 - RNA, 19 nt, Homo sapiens
aaccgguccuugauuuaau

SEQ ID NO: 869206 - RNA, 19 nt, Homo sapiens
ccaggaaugccgugaaagg

SEQ ID NO: 869207 - RNA, 19 nt, Homo sapiens
cuggaaaccuacccauuuu

SEQ ID NO: 869208 - RNA, 19 nt, Homo sapiens
gaaucaaguccacccuucu

SEQ ID NO: 869209 - RNA, 19 nt, Homo sapiens
cuaacauagcccuuucuuu

SEQ ID NO: 869210 - RNA, 19 nt, Homo sapiens
gagggacuucgaugccaaa

SEQ ID NO: 869211 - RNA, 19 nt, Homo sapiens
gaguaacuuauguucaaug

SEQ ID NO: 869212 - RNA, 19 nt, Homo sapiens
gcccugcacugcguagaca

SEQ ID NO: 869213 - RNA, 19 nt, Homo sapiens
ccuagcccaucaucuaucu

SEQ ID NO: 869214 - RNA, 19 nt, Homo sapiens
cuuaaugguagaaggaauu

SEQ ID NO: 869215 - RNA, 19 nt, Homo sapiens
gcuucauccuuuucuauuu

SEQ ID NO: 869216 - RNA, 19 nt, Homo sapiens
cagcgucaccacaggaguu

SEQ ID NO: 869217 - RNA, 19 nt, Homo sapiens
gcccaaccuccgagacuug

SEQ ID NO: 869218 - RNA, 19 nt, Homo sapiens
cuaucuaaccgguccuuga

SEQ ID NO: 869219 - RNA, 19 nt, Homo sapiens
gccuggaucucagccacaa

SEQ ID NO: 869220 - RNA, 19 nt, Homo sapiens
gcauugagcguguuuauua

SEQ ID NO: 869221 - RNA, 19 nt, Homo sapiens
ccaaggacuuucaugauua

SEQ ID NO: 869222 - RNA, 19 nt, Homo sapiens
guacaaaugucaugugugu

SEQ ID NO: 869223 - RNA, 19 nt, Homo sapiens
gaagaauucuccugcuugu

SEQ ID NO: 869224 - RNA, 19 nt, Homo sapiens
ugaggacucuggauucuuu

SEQ ID NO: 869225 - RNA, 19 nt, Homo sapiens
ggacaggauuggaggcauu

SEQ ID NO: 869226 - RNA, 19 nt, Homo sapiens
gcaagaagcaccaguucaa

SEQ ID NO: 869227 - RNA, 19 nt, Homo sapiens
ggugugaucuuggcucuuu

SEQ ID NO: 869228 - RNA, 19 nt, Homo sapiens
auaaaugcuuggacucuua

SEQ ID NO: 869229 - RNA, 19 nt, Homo sapiens
ggaaaagcuucaaggaaua

SEQ ID NO: 869230 - RNA, 19 nt, Homo sapiens
gcccaaggauggcauguga

SEQ ID NO: 869231 - RNA, 19 nt, Homo sapiens
caacaauaccaaguucuua

SEQ ID NO: 869232 - RNA, 19 nt, Homo sapiens
caaggacuuucaugauuau

SEQ ID NO: 869233 - RNA, 19 nt, Homo sapiens
cccaaggacuuucaugauu

SEQ ID NO: 869234 - RNA, 19 nt, Homo sapiens
cgacaauccugagugguuu

SEQ ID NO: 869235 - RNA, 19 nt, Homo sapiens
ggauguguguguucuuguu

SEQ ID NO: 869236 - RNA, 19 nt, Homo sapiens
ccagagauccagaugguuu

SEQ ID NO: 869237 - RNA, 19 nt, Homo sapiens
ccgcagagccagaccauuu

SEQ ID NO: 869238 - RNA, 19 nt, Homo sapiens
gcagggcauuauucuagaa

SEQ ID NO: 869239 - RNA, 19 nt, Homo sapiens
gacuacagcugcaagaauc

SEQ ID NO: 869240 - RNA, 19 nt, Homo sapiens
gagcaccuccgcagccaua

SEQ ID NO: 869241 - RNA, 19 nt, Homo sapiens
ucacauccauucccaucuu

SEQ ID NO: 869242 - RNA, 19 nt, Homo sapiens
caccugaaccucccaagua

SEQ ID NO: 869243 - RNA, 19 nt, Homo sapiens
gaacaugaagauggcuaua

SEQ ID NO: 869244 - RNA, 19 nt, Homo sapiens
ggaacgucaucccugauau

SEQ ID NO: 869245 - RNA, 19 nt, Homo sapiens
guacaaggaacaugaagau

SEQ ID NO: 869246 - RNA, 19 nt, Homo sapiens
cauugagcguguuuauuaa

SEQ ID NO: 869247 - RNA, 19 nt, Homo sapiens
gagaauuccuucgacaauc

SEQ ID NO: 869248 - RNA, 19 nt, Homo sapiens
ugauaucccugaccacuuc

SEQ ID NO: 869249 - RNA, 19 nt, Homo sapiens
acaugaagauggcuauaug

SEQ ID NO: 869250 - RNA, 19 nt, Homo sapiens
acaaaugucauguguguga

SEQ ID NO: 869251 - RNA, 19 nt, Homo sapiens
ccaagagauuugccacaga

SEQ ID NO: 869252 - RNA, 19 nt, Homo sapiens
caagucccauuaccgcaaa

SEQ ID NO: 869253 - RNA, 19 nt, Homo sapiens
ggccuggguuugcaucauu

SEQ ID NO: 869254 - RNA, 19 nt, Homo sapiens
gagccaagguacaaauguc

SEQ ID NO: 869255 - RNA, 19 nt, Homo sapiens
cacaugcgcuuucgucaca

SEQ ID NO: 869256 - RNA, 19 nt, Homo sapiens
ccaaggcauugauaaccaa

SEQ ID NO: 869257 - RNA, 19 nt, Homo sapiens
gauguguguguucuuguua

SEQ ID NO: 869258 - RNA, 19 nt, Homo sapiens
gggcauuauucuagaaaca

SEQ ID NO: 869259 - RNA, 19 nt, Homo sapiens
aggcauugauaaccaagua

SEQ ID NO: 869260 - RNA, 19 nt, Homo sapiens
gaacgucaucccugauauc

SEQ ID NO: 869261 - RNA, 19 nt, Homo sapiens
aagaucugcuugacaguga

SEQ ID NO: 869262 - RNA, 19 nt, Homo sapiens
ucuacuaugugcugucuga

SEQ ID NO: 869263 - RNA, 19 nt, Homo sapiens
gcauuauucuagaaacagu

SEQ ID NO: 869264 - RNA, 19 nt, Homo sapiens
gccaauggaugccuuuagg

SEQ ID NO: 869265 - RNA, 19 nt, Homo sapiens
gcucuaucaagucccauua

SEQ ID NO: 869266 - RNA, 19 nt, Homo sapiens
gcucaaccauggaaaaguu

SEQ ID NO: 869267 - RNA, 19 nt, Homo sapiens
auaccaaguucuuagauca

SEQ ID NO: 869268 - RNA, 19 nt, Homo sapiens
ggaggaggaggaagaggaa

SEQ ID NO: 869269 - RNA, 19 nt, Homo sapiens
gcaggaauguggcuuuugu

SEQ ID NO: 869270 - RNA, 19 nt, Homo sapiens
uaaaugcuuggacucuuaa

SEQ ID NO: 869271 - RNA, 19 nt, Homo sapiens
gauaaccaaguagccauuu

SEQ ID NO: 869272 - RNA, 19 nt, Homo sapiens
gccaaggcauugauaacca

SEQ ID NO: 869273 - RNA, 19 nt, Homo sapiens
uuugagaacugcaccuuca

SEQ ID NO: 869274 - RNA, 19 nt, Homo sapiens
uuauugaccuccagaagca

SEQ ID NO: 869275 - RNA, 19 nt, Homo sapiens
cuauaacccucaagaucug

SEQ ID NO: 869276 - RNA, 19 nt, Homo sapiens
uggaaaagcuucaaggaau

SEQ ID NO: 869277 - RNA, 19 nt, Homo sapiens
ccaacaauaccaaguucuu

SEQ ID NO: 869278 - RNA, 19 nt, Homo sapiens
ggaccgcaguaaacuucga

SEQ ID NO: 869279 - RNA, 19 nt, Homo sapiens
gcccaaggccagcaagaga

SEQ ID NO: 869280 - RNA, 19 nt, Homo sapiens
ugggagcacugugagaauu

SEQ ID NO: 869281 - RNA, 19 nt, Homo sapiens
agaggaggaugacccacuu

SEQ ID NO: 869282 - RNA, 19 nt, Homo sapiens
ggaugacccacuugaggaa

SEQ ID NO: 869283 - RNA, 19 nt, Homo sapiens
cacauccauucccaucuuu

SEQ ID NO: 869284 - RNA, 19 nt, Homo sapiens
cggaacgucaucccugaua

SEQ ID NO: 869285 - RNA, 19 nt, Homo sapiens
cauccgccaugucuacuuc

SEQ ID NO: 869286 - RNA, 19 nt, Homo sapiens
gaauguggcuuuuguucuc

SEQ ID NO: 869287 - RNA, 19 nt, Homo sapiens
ggacuuucaugauuauccu

SEQ ID NO: 869288 - RNA, 19 nt, Homo sapiens
cuuaagguuuccucuacaa

SEQ ID NO: 869289 - RNA, 19 nt, Homo sapiens
auaagugcccucuguguga

SEQ ID NO: 869290 - RNA, 19 nt, Homo sapiens
ggcuguaccugcaccuuca

SEQ ID NO: 869291 - RNA, 19 nt, Homo sapiens
uaacuauaacccucaagau

SEQ ID NO: 869292 - RNA, 19 nt, Homo sapiens
gagacucugagccaaggua

SEQ ID NO: 869293 - RNA, 19 nt, Homo sapiens
cgaucccucugcucuauca

SEQ ID NO: 869294 - RNA, 19 nt, Homo sapiens
aaaugugacuguugugacu

SEQ ID NO: 869295 - RNA, 19 nt, Homo sapiens
ugagaauuccuucgacaau

SEQ ID NO: 869296 - RNA, 19 nt, Homo sapiens
aauaaaugcuuggacucuu

SEQ ID NO: 869297 - RNA, 19 nt, Homo sapiens
gcaucauucugcagacucu

SEQ ID NO: 869298 - RNA, 19 nt, Homo sapiens
ggaacaugaagauggcuau

SEQ ID NO: 869299 - RNA, 19 nt, Homo sapiens
ggugcuguguggcuggaaa

SEQ ID NO: 869300 - RNA, 19 nt, Homo sapiens
ggagccaggacguaaggaa

SEQ ID NO: 869301 - RNA, 19 nt, Homo sapiens
ccgcaaaguacaugaagga

SEQ ID NO: 869302 - RNA, 19 nt, Homo sapiens
ugacuacagcugcaagaau

SEQ ID NO: 869303 - RNA, 19 nt, Homo sapiens
gcagccauacccaggagaa

SEQ ID NO: 869304 - RNA, 19 nt, Homo sapiens
gguacaaggaacaugaaga

SEQ ID NO: 869305 - RNA, 19 nt, Homo sapiens
ggaggcauugagcguguuu

SEQ ID NO: 869306 - RNA, 19 nt, Homo sapiens
ucugugcugugaauacgaa

SEQ ID NO: 869307 - RNA, 19 nt, Homo sapiens
gcuuaacuauaacccucaa

SEQ ID NO: 869308 - RNA, 19 nt, Homo sapiens
uguguguguucuuguuaaa

SEQ ID NO: 869309 - RNA, 19 nt, Homo sapiens
ucauccacguggugaauca

SEQ ID NO: 869310 - RNA, 19 nt, Homo sapiens
agaagcaccaguucaagug

SEQ ID NO: 869311 - RNA, 19 nt, Homo sapiens
cuuuaaaugugacuguugu

SEQ ID NO: 869312 - RNA, 19 nt, Homo sapiens
caaggaccgcaguaaacuu

SEQ ID NO: 869313 - RNA, 19 nt, Homo sapiens
uuuguucucuggacaguuc

SEQ ID NO: 869314 - RNA, 19 nt, Homo sapiens
ccagccaaggcauugauaa

SEQ ID NO: 869315 - RNA, 19 nt, Homo sapiens
ugcagacucuaaagacuuc

SEQ ID NO: 869316 - RNA, 19 nt, Homo sapiens
gacguaaggaagaggaaga

SEQ ID NO: 869317 - RNA, 19 nt, Homo sapiens
aauaccaaguucuuagauc

SEQ ID NO: 869318 - RNA, 19 nt, Homo sapiens
ggaagaggaagaggaggau

SEQ ID NO: 869319 - RNA, 19 nt, Homo sapiens
cuucaaggaccgcaguaaa

SEQ ID NO: 869320 - RNA, 19 nt, Homo sapiens
ccagaaagcuuaaacaaua

SEQ ID NO: 869321 - RNA, 19 nt, Homo sapiens
gaaauucucuugucuaauc

SEQ ID NO: 869322 - RNA, 19 nt, Homo sapiens
caauagagcugcauaauag

SEQ ID NO: 869323 - RNA, 19 nt, Homo sapiens
uaaaguaagugacccauga

SEQ ID NO: 869324 - RNA, 19 nt, Homo sapiens
ggauuugguuaaugacuua

SEQ ID NO: 869325 - RNA, 19 nt, Homo sapiens
gaacugaacaaauuaccua

SEQ ID NO: 869326 - RNA, 19 nt, Homo sapiens
gugaaauucucuugucuaa

SEQ ID NO: 869327 - RNA, 19 nt, Homo sapiens
gaucaaaacucauucgaaa

SEQ ID NO: 869328 - RNA, 19 nt, Homo sapiens
ugaaauguccaccuucuua

SEQ ID NO: 869329 - RNA, 19 nt, Homo sapiens
guuaaugacuuaugagcaa

SEQ ID NO: 869330 - RNA, 19 nt, Homo sapiens
ggagcuugcuuuaguuaga

SEQ ID NO: 869331 - RNA, 19 nt, Homo sapiens
uaaagaaucaccaacugua

SEQ ID NO: 869332 - RNA, 19 nt, Homo sapiens
gaaauguccaccuucuuaa

SEQ ID NO: 869333 - RNA, 19 nt, Homo sapiens
uaaagaggcaccauucgua

SEQ ID NO: 869334 - RNA, 19 nt, Homo sapiens
aaagguaaaugaacacguu

SEQ ID NO: 869335 - RNA, 19 nt, Homo sapiens
gacaguauacccaaacuuu

SEQ ID NO: 869336 - RNA, 19 nt, Homo sapiens
ggaggagcuugcuuuaguu

SEQ ID NO: 869337 - RNA, 19 nt, Homo sapiens
ggguuuagaugguaacaug

SEQ ID NO: 869338 - RNA, 19 nt, Homo sapiens
acaauagagcugcauaaua

SEQ ID NO: 869339 - RNA, 19 nt, Homo sapiens
guaaagcuucccacaauug

SEQ ID NO: 869340 - RNA, 19 nt, Homo sapiens
guguuucccuuccuucaua

SEQ ID NO: 869341 - RNA, 19 nt, Homo sapiens
aauauuggcuuccuuucuu

SEQ ID NO: 869342 - RNA, 19 nt, Homo sapiens
ggacuggcuggcucuguua

SEQ ID NO: 869343 - RNA, 19 nt, Homo sapiens
gaagauaacaggccaaucc

SEQ ID NO: 869344 - RNA, 19 nt, Homo sapiens
gaggagcuugcuuuaguua

SEQ ID NO: 869345 - RNA, 19 nt, Homo sapiens
gcccaaggcuuuguuguag

SEQ ID NO: 869346 - RNA, 19 nt, Homo sapiens
uggaggagcuugcuuuagu

SEQ ID NO: 869347 - RNA, 19 nt, Homo sapiens
acagaaggcuaucacacuu

SEQ ID NO: 869348 - RNA, 19 nt, Homo sapiens
ugaagguacucccuguuug

SEQ ID NO: 869349 - RNA, 19 nt, Homo sapiens
gggcaaaaccugagccuua

SEQ ID NO: 869350 - RNA, 19 nt, Homo sapiens
ccaaggcuuuguuguagga

SEQ ID NO: 869351 - RNA, 19 nt, Homo sapiens
cagaaagcuuaaacaauag

SEQ ID NO: 869352 - RNA, 19 nt, Homo sapiens
gacaauauauaugcaugug

SEQ ID NO: 869353 - RNA, 19 nt, Homo sapiens
gcauaagaguccuauuugc

SEQ ID NO: 869354 - RNA, 19 nt, Homo sapiens
ucaaggaagucaaguuaac

SEQ ID NO: 869355 - RNA, 19 nt, Homo sapiens
gagaugcugucuuggucuu

SEQ ID NO: 869356 - RNA, 19 nt, Homo sapiens
gagcaaugacuguugguau

SEQ ID NO: 869357 - RNA, 19 nt, Homo sapiens
gggagauucuucaagcaau

SEQ ID NO: 869358 - RNA, 19 nt, Homo sapiens
uuaaauguguguguugcua

SEQ ID NO: 869359 - RNA, 19 nt, Homo sapiens
gcauggaauauaacuugua

SEQ ID NO: 869360 - RNA, 19 nt, Homo sapiens
ugcagaaugucagauauuu

SEQ ID NO: 869361 - RNA, 19 nt, Homo sapiens
gugcauggaauauaacuug

SEQ ID NO: 869362 - RNA, 19 nt, Homo sapiens
ucaccuaaaugcacuugau

SEQ ID NO: 869363 - RNA, 19 nt, Homo sapiens
aaccugagccuuagaagaa

SEQ ID NO: 869364 - RNA, 19 nt, Homo sapiens
aaagaaucaccaacuguaa

SEQ ID NO: 869365 - RNA, 19 nt, Homo sapiens
caaucacuaugucaacaga

SEQ ID NO: 869366 - RNA, 19 nt, Homo sapiens
gcacucacgcaaagguaaa

SEQ ID NO: 869367 - RNA, 19 nt, Homo sapiens
aaacaauagagcugcauaa

SEQ ID NO: 869368 - RNA, 19 nt, Homo sapiens
uguaaagcuucccacaauu

SEQ ID NO: 869369 - RNA, 19 nt, Homo sapiens
acuuaaacaugucaccuaa

SEQ ID NO: 869370 - RNA, 19 nt, Homo sapiens
gcugcagaaugucagauau

SEQ ID NO: 869371 - RNA, 19 nt, Homo sapiens
ccuguuugcugcagaaugu

SEQ ID NO: 869372 - RNA, 19 nt, Homo sapiens
acgcaaagguaaaugaaca

SEQ ID NO: 869373 - RNA, 19 nt, Homo sapiens
uaaacaauagagcugcaua

SEQ ID NO: 869374 - RNA, 19 nt, Homo sapiens
ccaaauccagaaagcuuaa

SEQ ID NO: 869375 - RNA, 19 nt, Homo sapiens
uaaagcuucccacaauuga

SEQ ID NO: 869376 - RNA, 19 nt, Homo sapiens
uguccaccuucuuaaauuu

SEQ ID NO: 869377 - RNA, 19 nt, Homo sapiens
gaauauuggcuuccuuucu

SEQ ID NO: 869378 - RNA, 19 nt, Homo sapiens
gagcuugcuuuaguuagau

SEQ ID NO: 869379 - RNA, 19 nt, Homo sapiens
gcauguguuuaaaccaaau

SEQ ID NO: 869380 - RNA, 19 nt, Homo sapiens
ccuauaauggauuugguua

SEQ ID NO: 869381 - RNA, 19 nt, Homo sapiens
uugcauaagaguccuauuu

SEQ ID NO: 869382 - RNA, 19 nt, Homo sapiens
aaacaugucaccuaaaugc

SEQ ID NO: 869383 - RNA, 19 nt, Homo sapiens
ucucuugucuaaucugaau

SEQ ID NO: 869384 - RNA, 19 nt, Homo sapiens
guauggguuuagaugguaa

SEQ ID NO: 869385 - RNA, 19 nt, Homo sapiens
agaaggcuaucacacuugu

SEQ ID NO: 869386 - RNA, 19 nt, Homo sapiens
uaaaccaaauccagaaagc

SEQ ID NO: 869387 - RNA, 19 nt, Homo sapiens
guugaaauguccaccuucu

SEQ ID NO: 869388 - RNA, 19 nt, Homo sapiens
auucaaggaagucaaguua

SEQ ID NO: 869389 - RNA, 19 nt, Homo sapiens
uaaauguguguguugcuaa

SEQ ID NO: 869390 - RNA, 19 nt, Homo sapiens
uguuagaacucuguccaaa

SEQ ID NO: 869391 - RNA, 19 nt, Homo sapiens
uaacuaggucauucaagga

SEQ ID NO: 869392 - RNA, 19 nt, Homo sapiens
ccauucaucugauccacau

SEQ ID NO: 869393 - RNA, 19 nt, Homo sapiens
gccagacaguauacccaaa

SEQ ID NO: 869394 - RNA, 19 nt, Homo sapiens
uguauggguuuagauggua

SEQ ID NO: 869395 - RNA, 19 nt, Homo sapiens
gaagguacucccuguuugc

SEQ ID NO: 869396 - RNA, 19 nt, Homo sapiens
gugaccgaauuacuaguga

SEQ ID NO: 869397 - RNA, 19 nt, Homo sapiens
guuggaggagcuugcuuua

SEQ ID NO: 869398 - RNA, 19 nt, Homo sapiens
uuuaagcacucacgcaaag

SEQ ID NO: 869399 - RNA, 19 nt, Homo sapiens
aagaaucaccaacuguaaa

SEQ ID NO: 869400 - RNA, 19 nt, Homo sapiens
caagcaaucacuaugucaa

SEQ ID NO: 869401 - RNA, 19 nt, Homo sapiens
ggagcaaugacuguuggua

SEQ ID NO: 869402 - RNA, 19 nt, Homo sapiens
aaauguguguguugcuaau

SEQ ID NO: 869403 - RNA, 19 nt, Homo sapiens
caacuuucgucugccuguu

SEQ ID NO: 869404 - RNA, 19 nt, Homo sapiens
gcacuugaugguguugaaa

SEQ ID NO: 869405 - RNA, 19 nt, Homo sapiens
gcuuuaguuagaugucuua

SEQ ID NO: 869406 - RNA, 19 nt, Homo sapiens
guaggagcaaugacuguug

SEQ ID NO: 869407 - RNA, 19 nt, Homo sapiens
caguauacccaaacuuuua

SEQ ID NO: 869408 - RNA, 19 nt, Homo sapiens
uggauuugguuaaugacuu

SEQ ID NO: 869409 - RNA, 19 nt, Homo sapiens
guguugaaauguccaccuu

SEQ ID NO: 869410 - RNA, 19 nt, Homo sapiens
gaugcugucuuggucuugu

SEQ ID NO: 869411 - RNA, 19 nt, Homo sapiens
agcaaugacuguugguaug

SEQ ID NO: 869412 - RNA, 19 nt, Homo sapiens
gguguuaacaugguauaug

SEQ ID NO: 869413 - RNA, 19 nt, Homo sapiens
cuuaugagcaagcugguuu

SEQ ID NO: 869414 - RNA, 19 nt, Homo sapiens
caacuguaaacaugagaau

SEQ ID NO: 869415 - RNA, 19 nt, Homo sapiens
auagagcugcauaauagua

SEQ ID NO: 869416 - RNA, 19 nt, Homo sapiens
cugaagguacucccuguuu

SEQ ID NO: 869417 - RNA, 19 nt, Homo sapiens
aaauguccaccuucuuaaa

SEQ ID NO: 869418 - RNA, 19 nt, Homo sapiens
gguuuggccagacaguaua

SEQ ID NO: 869419 - RNA, 19 nt, Homo sapiens
ucacgcaaagguaaaugaa

SEQ ID NO: 869420 - RNA, 19 nt, Homo sapiens
ucaaagagcuucaguuuua

SEQ ID NO: 869421 - RNA, 19 nt, Homo sapiens
gcagacagcacacgaaaua

SEQ ID NO: 869422 - RNA, 19 nt, Homo sapiens
gagauggccugucugauaa

SEQ ID NO: 869423 - RNA, 19 nt, Homo sapiens
gguccuaaccugauuauaa

SEQ ID NO: 869424 - RNA, 19 nt, Homo sapiens
cacagcagcuccuuuguaa

SEQ ID NO: 869425 - RNA, 19 nt, Homo sapiens
guccuaaccugauuauaaa

SEQ ID NO: 869426 - RNA, 19 nt, Homo sapiens
gcagagcaccuucgguuaa

SEQ ID NO: 869427 - RNA, 19 nt, Homo sapiens
gcaggcagaguaugaauuu

SEQ ID NO: 869428 - RNA, 19 nt, Homo sapiens
ugagauggccugucugaua

SEQ ID NO: 869429 - RNA, 19 nt, Homo sapiens
gagaaggaccagauuauug

SEQ ID NO: 869430 - RNA, 19 nt, Homo sapiens
caucaaagagcuucaguuu

SEQ ID NO: 869431 - RNA, 19 nt, Homo sapiens
cuaauaugcuguuuccauu

SEQ ID NO: 869432 - RNA, 19 nt, Homo sapiens
gaauaugaauuugcaccaa

SEQ ID NO: 869433 - RNA, 19 nt, Homo sapiens
gaaggagaguacaauuaca

SEQ ID NO: 869434 - RNA, 19 nt, Homo sapiens
gugaaggagaguacaauua

SEQ ID NO: 869435 - RNA, 19 nt, Homo sapiens
ugacaggauuggacauuga

SEQ ID NO: 869436 - RNA, 19 nt, Homo sapiens
ccagggcucuguccacuug

SEQ ID NO: 869437 - RNA, 19 nt, Homo sapiens
gaauuucuguccuuuguac

SEQ ID NO: 869438 - RNA, 19 nt, Homo sapiens
gauuggacauugagaagga

SEQ ID NO: 869439 - RNA, 19 nt, Homo sapiens
ugugagcacuguuaaagaa

SEQ ID NO: 869440 - RNA, 19 nt, Homo sapiens
gaaguuucuugacaaauac

SEQ ID NO: 869441 - RNA, 19 nt, Homo sapiens
gcaggaaauucaguucaug

SEQ ID NO: 869442 - RNA, 19 nt, Homo sapiens
gagaagaccgugaguugau

SEQ ID NO: 869443 - RNA, 19 nt, Homo sapiens
agaaggaccagauuauuga

SEQ ID NO: 869444 - RNA, 19 nt, Homo sapiens
ugacucugaucucaacauu

SEQ ID NO: 869445 - RNA, 19 nt, Homo sapiens
ccagaagaauaugaauuug

SEQ ID NO: 869446 - RNA, 19 nt, Homo sapiens
ugacacagcagcuccuuug

SEQ ID NO: 869447 - RNA, 19 nt, Homo sapiens
gacagcacacgaaauacua

SEQ ID NO: 869448 - RNA, 19 nt, Homo sapiens
guaugaauuucuguccuuu

SEQ ID NO: 869449 - RNA, 19 nt, Homo sapiens
ggaccagauuauugagaug

SEQ ID NO: 869450 - RNA, 19 nt, Homo sapiens
ucauguccaucccuuggua

SEQ ID NO: 869451 - RNA, 19 nt, Homo sapiens
cagcagcuccuuuguaagu

SEQ ID NO: 869452 - RNA, 19 nt, Homo sapiens
acacagcagcuccuuugua

SEQ ID NO: 869453 - RNA, 19 nt, Homo sapiens
cacgggaggucuggccuua

SEQ ID NO: 869454 - RNA, 19 nt, Homo sapiens
ucugauaacugacucugau

SEQ ID NO: 869455 - RNA, 19 nt, Homo sapiens
gaugugagcacuguuaaag

SEQ ID NO: 869456 - RNA, 19 nt, Homo sapiens
uggccugucugauaacuga

SEQ ID NO: 869457 - RNA, 19 nt, Homo sapiens
guaaguaccaggucauguc

SEQ ID NO: 869458 - RNA, 19 nt, Homo sapiens
gugaguugaugccaguuau

SEQ ID NO: 869459 - RNA, 19 nt, Homo sapiens
uaauugaugugagcacugu

SEQ ID NO: 869460 - RNA, 19 nt, Homo sapiens
uuaccgaaauaacaucuuc

SEQ ID NO: 869461 - RNA, 19 nt, Homo sapiens
gaugacaggauuggacauu

SEQ ID NO: 869462 - RNA, 19 nt, Homo sapiens
acucugaucucaacauuuu

SEQ ID NO: 869463 - RNA, 19 nt, Homo sapiens
ugagaaggaccagauuauu

SEQ ID NO: 869464 - RNA, 19 nt, Homo sapiens
ggcagagcaccuucgguua

SEQ ID NO: 869465 - RNA, 19 nt, Homo sapiens
gaaaauggggaaaaugaga

SEQ ID NO: 869466 - RNA, 19 nt, Homo sapiens
ugaaggagaguacaauuac

SEQ ID NO: 869467 - RNA, 19 nt, Homo sapiens
gcagugaaggagaguacaa

SEQ ID NO: 869468 - RNA, 19 nt, Homo sapiens
uaugcuguuuccauuauga

SEQ ID NO: 869469 - RNA, 19 nt, Homo sapiens
gcagcuccuuuguaaguac

SEQ ID NO: 869470 - RNA, 19 nt, Homo sapiens
acaaauacaugccccaguu

SEQ ID NO: 869471 - RNA, 19 nt, Homo sapiens
gagcacuguuaaagaacug

SEQ ID NO: 869472 - RNA, 19 nt, Homo sapiens
caggaaauucaguucauga

SEQ ID NO: 869473 - RNA, 19 nt, Homo sapiens
uaacugacucugaucucaa

SEQ ID NO: 869474 - RNA, 19 nt, Homo sapiens
cuaguucuauugaaaugca

SEQ ID NO: 869475 - RNA, 19 nt, Homo sapiens
uagggcacuugaugacauu

SEQ ID NO: 869476 - RNA, 19 nt, Homo sapiens
ucucauagggcacuugaug

SEQ ID NO: 869477 - RNA, 19 nt, Homo sapiens
uuauugagauggccugucu

SEQ ID NO: 869478 - RNA, 19 nt, Homo sapiens
caccuucgguuaacuugca

SEQ ID NO: 869479 - RNA, 19 nt, Homo sapiens
gagcaccuucgguuaacuu

SEQ ID NO: 869480 - RNA, 19 nt, Homo sapiens
cgacguuuagcgacuauug

SEQ ID NO: 869481 - RNA, 19 nt, Homo sapiens
gccacuacaucguuaucug

SEQ ID NO: 869482 - RNA, 19 nt, Homo sapiens
agaagaccgugaguugaug

SEQ ID NO: 869483 - RNA, 19 nt, Homo sapiens
uuagugaaagcaucaaaga

SEQ ID NO: 869484 - RNA, 19 nt, Homo sapiens
gacauuagugaaagcauca

SEQ ID NO: 869485 - RNA, 19 nt, Homo sapiens
ugagaagaccgugaguuga

SEQ ID NO: 869486 - RNA, 19 nt, Homo sapiens
gcaucaaagagcuucaguu

SEQ ID NO: 869487 - RNA, 19 nt, Homo sapiens
aguaugaauuucuguccuu

SEQ ID NO: 869488 - RNA, 19 nt, Homo sapiens
gcagcaggcagaguaugaa

SEQ ID NO: 869489 - RNA, 19 nt, Homo sapiens
cauugcagcaggcagagua

SEQ ID NO: 869490 - RNA, 19 nt, Homo sapiens
gcaugucagauugguguaa

SEQ ID NO: 869491 - RNA, 19 nt, Homo sapiens
caagcagacagcacacgaa

SEQ ID NO: 869492 - RNA, 19 nt, Homo sapiens
gaggcaacuucuggugguu

SEQ ID NO: 869493 - RNA, 19 nt, Homo sapiens
ccuaauaugcuguuuccau

SEQ ID NO: 869494 - RNA, 19 nt, Homo sapiens
cuugaugacauuagugaaa

SEQ ID NO: 869495 - RNA, 19 nt, Homo sapiens
augaauuucuguccuuugu

SEQ ID NO: 869496 - RNA, 19 nt, Homo sapiens
uaaaacaaccagaugaguu

SEQ ID NO: 869497 - RNA, 19 nt, Homo sapiens
aagcagacagcacacgaaa

SEQ ID NO: 869498 - RNA, 19 nt, Homo sapiens
gguauccagaagaauauga

SEQ ID NO: 869499 - RNA, 19 nt, Homo sapiens
ucuguccacuugcaggaaa

SEQ ID NO: 869500 - RNA, 19 nt, Homo sapiens
auaacugacucugaucuca

SEQ ID NO: 869501 - RNA, 19 nt, Homo sapiens
ggaggucuggccuuaccaa

SEQ ID NO: 869502 - RNA, 19 nt, Homo sapiens
uagaaaauggggaaaauga

SEQ ID NO: 869503 - RNA, 19 nt, Homo sapiens
ggguggaccuggagaugac

SEQ ID NO: 869504 - RNA, 19 nt, Homo sapiens
cagagcaccuucgguuaac

SEQ ID NO: 869505 - RNA, 19 nt, Homo sapiens
cgugaguugaugccaguua

SEQ ID NO: 869506 - RNA, 19 nt, Homo sapiens
ggcacuugaugacauuagu

SEQ ID NO: 869507 - RNA, 19 nt, Homo sapiens
guauccagaagaauaugaa

SEQ ID NO: 869508 - RNA, 19 nt, Homo sapiens
augagaagaccgugaguug

SEQ ID NO: 869509 - RNA, 19 nt, Homo sapiens
auagggcacuugaugacau

SEQ ID NO: 869510 - RNA, 19 nt, Homo sapiens
gaaggaccagauuauugag

SEQ ID NO: 869511 - RNA, 19 nt, Homo sapiens
aggaccagauuauugagau

SEQ ID NO: 869512 - RNA, 19 nt, Homo sapiens
ugaauuucuguccuuugua

SEQ ID NO: 869513 - RNA, 19 nt, Homo sapiens
gggcucauauguacuauua

SEQ ID NO: 869514 - RNA, 19 nt, Homo sapiens
caauuuagccuccauaaua

SEQ ID NO: 869515 - RNA, 19 nt, Homo sapiens
gaagaggguuggauuauca

SEQ ID NO: 869516 - RNA, 19 nt, Homo sapiens
gacggaaacugacucaaua

SEQ ID NO: 869517 - RNA, 19 nt, Homo sapiens
gcaaccauauuucagauuu

SEQ ID NO: 869518 - RNA, 19 nt, Homo sapiens
guaagcagaugugcaauaa

SEQ ID NO: 869519 - RNA, 19 nt, Homo sapiens
gaccacauauucuccauuu

SEQ ID NO: 869520 - RNA, 19 nt, Homo sapiens
gagcaucaguuauuacuuc

SEQ ID NO: 869521 - RNA, 19 nt, Homo sapiens
guaggagcaucaguuauua

SEQ ID NO: 869522 - RNA, 19 nt, Homo sapiens
gaaacugacucaauauguc

SEQ ID NO: 869523 - RNA, 19 nt, Homo sapiens
gaaccucaauuguauaucu

SEQ ID NO: 869524 - RNA, 19 nt, Homo sapiens
guaccuagauaaauuggaa

SEQ ID NO: 869525 - RNA, 19 nt, Homo sapiens
agaagcagcucuuauuaga

SEQ ID NO: 869526 - RNA, 19 nt, Homo sapiens
gauguuguuugguuuguuu

SEQ ID NO: 869527 - RNA, 19 nt, Homo sapiens
cccagaaacuugacucuaa

SEQ ID NO: 869528 - RNA, 19 nt, Homo sapiens
gagaaucaauugcugaaag

SEQ ID NO: 869529 - RNA, 19 nt, Homo sapiens
uggcaacccugaagaguuu

SEQ ID NO: 869530 - RNA, 19 nt, Homo sapiens
ccagaaacuugacucuaaa

SEQ ID NO: 869531 - RNA, 19 nt, Homo sapiens
ggaaagggaauaagaauac

SEQ ID NO: 869532 - RNA, 19 nt, Homo sapiens
aagaagaacuacaacaaga

SEQ ID NO: 869533 - RNA, 19 nt, Homo sapiens
gagcaugccauacaagauu

SEQ ID NO: 869534 - RNA, 19 nt, Homo sapiens
ccagaaggcaaccauauuu

SEQ ID NO: 869535 - RNA, 19 nt, Homo sapiens
uauaggauguuguuugguu

SEQ ID NO: 869536 - RNA, 19 nt, Homo sapiens
ggaagaggguuggauuauc

SEQ ID NO: 869537 - RNA, 19 nt, Homo sapiens
ccaguaaccuuuauuaagc

SEQ ID NO: 869538 - RNA, 19 nt, Homo sapiens
ggaaacugacucaauaugu

SEQ ID NO: 869539 - RNA, 19 nt, Homo sapiens
ggagacacauaagcaauuc

SEQ ID NO: 869540 - RNA, 19 nt, Homo sapiens
gaagaagaacuacaacaag

SEQ ID NO: 869541 - RNA, 19 nt, Homo sapiens
ggagggcucauauguacua

SEQ ID NO: 869542 - RNA, 19 nt, Homo sapiens
aaaguaggagcaucaguua

SEQ ID NO: 869543 - RNA, 19 nt, Homo sapiens
guuguugcuugacuucuua

SEQ ID NO: 869544 - RNA, 19 nt, Homo sapiens
agauagaguugaguugaua

SEQ ID NO: 869545 - RNA, 19 nt, Homo sapiens
gcaguagaguacaguggaa

SEQ ID NO: 869546 - RNA, 19 nt, Homo sapiens
uaaaguaggagcaucaguu

SEQ ID NO: 869547 - RNA, 19 nt, Homo sapiens
gugcuucaguaccuagaua

SEQ ID NO: 869548 - RNA, 19 nt, Homo sapiens
gaggguuggauuaucauua

SEQ ID NO: 869549 - RNA, 19 nt, Homo sapiens
ugaugaaucuaaaguagga

SEQ ID NO: 869550 - RNA, 19 nt, Homo sapiens
ucaccauucuuguugcuuu

SEQ ID NO: 869551 - RNA, 19 nt, Homo sapiens
ggaaugaauagcauggaaa

SEQ ID NO: 869552 - RNA, 19 nt, Homo sapiens
gaaaagcuguggaaaagag

SEQ ID NO: 869553 - RNA, 19 nt, Homo sapiens
caucuucucugcauucagu

SEQ ID NO: 869554 - RNA, 19 nt, Homo sapiens
gcucauauguacuauuacu

SEQ ID NO: 869555 - RNA, 19 nt, Homo sapiens
ucucugaaccucaauugua

SEQ ID NO: 869556 - RNA, 19 nt, Homo sapiens
gggaauaagaauacugauu

SEQ ID NO: 869557 - RNA, 19 nt, Homo sapiens
ugaagaguuugucauuguu

SEQ ID NO: 869558 - RNA, 19 nt, Homo sapiens
aagcagcucuuauuagaag

SEQ ID NO: 869559 - RNA, 19 nt, Homo sapiens
gcagacauguaagcagaug

SEQ ID NO: 869560 - RNA, 19 nt, Homo sapiens
aacaagauuuggagucauu

SEQ ID NO: 869561 - RNA, 19 nt, Homo sapiens
cugaagaguuugucauugu

SEQ ID NO: 869562 - RNA, 19 nt, Homo sapiens
gacucaauaugucagguuu

SEQ ID NO: 869563 - RNA, 19 nt, Homo sapiens
guaccuauguggaauaagc

SEQ ID NO: 869564 - RNA, 19 nt, Homo sapiens
gcaguaccuauguggaaua

SEQ ID NO: 869565 - RNA, 19 nt, Homo sapiens
gaagcagcucuuauuagaa

SEQ ID NO: 869566 - RNA, 19 nt, Homo sapiens
gaagaacuacaacaagaag

SEQ ID NO: 869567 - RNA, 19 nt, Homo sapiens
ccaagucauuccgggauuu

SEQ ID NO: 869568 - RNA, 19 nt, Homo sapiens
uaauccaccucuuguacaa

SEQ ID NO: 869569 - RNA, 19 nt, Homo sapiens
gggagacacauaagcaauu

SEQ ID NO: 869570 - RNA, 19 nt, Homo sapiens
ccaagagaauagcguuuua

SEQ ID NO: 869571 - RNA, 19 nt, Homo sapiens
gcauugagcaguagaguac

SEQ ID NO: 869572 - RNA, 19 nt, Homo sapiens
ccaugucucuucaaagcuu

SEQ ID NO: 869573 - RNA, 19 nt, Homo sapiens
uggcauugaugaaucuaaa

SEQ ID NO: 869574 - RNA, 19 nt, Homo sapiens
gaccagaaggcaaccauau

SEQ ID NO: 869575 - RNA, 19 nt, Homo sapiens
ugaauagcauggaaacagu

SEQ ID NO: 869576 - RNA, 19 nt, Homo sapiens
ucuaguuucuggaagguaa

SEQ ID NO: 869577 - RNA, 19 nt, Homo sapiens
gagagaaucaauugcugaa

SEQ ID NO: 869578 - RNA, 19 nt, Homo sapiens
gaaagggaauaagaauacu

SEQ ID NO: 869579 - RNA, 19 nt, Homo sapiens
uaauaguugugucaccauu

SEQ ID NO: 869580 - RNA, 19 nt, Homo sapiens
uagaagauuuugccaagua

SEQ ID NO: 869581 - RNA, 19 nt, Homo sapiens
gaagaguuugucauuguug

SEQ ID NO: 869582 - RNA, 19 nt, Homo sapiens
aagcagaugugcaauaaaa

SEQ ID NO: 869583 - RNA, 19 nt, Homo sapiens
cucaauaugucagguuuaa

SEQ ID NO: 869584 - RNA, 19 nt, Homo sapiens
gauaauccaccucuuguac

SEQ ID NO: 869585 - RNA, 19 nt, Homo sapiens
ccaaguauguguuguugcu

SEQ ID NO: 869586 - RNA, 19 nt, Homo sapiens
agaagaagaacuacaacaa

SEQ ID NO: 869587 - RNA, 19 nt, Homo sapiens
ccaaagaguuaaggcuugu

SEQ ID NO: 869588 - RNA, 19 nt, Homo sapiens
gaacaguuuagucccaaga

SEQ ID NO: 869589 - RNA, 19 nt, Homo sapiens
ucauuaauggccagaauuu

SEQ ID NO: 869590 - RNA, 19 nt, Homo sapiens
ggaccagaaggcaaccaua

SEQ ID NO: 869591 - RNA, 19 nt, Homo sapiens
uacaaaagccaaagaguua

SEQ ID NO: 869592 - RNA, 19 nt, Homo sapiens
uggaaagguuaauguucua

SEQ ID NO: 869593 - RNA, 19 nt, Homo sapiens
cuaguucacuguggaguug

SEQ ID NO: 869594 - RNA, 19 nt, Homo sapiens
ugaggagcaugccauacaa

SEQ ID NO: 869595 - RNA, 19 nt, Homo sapiens
gcaauuuagccuccauaau

SEQ ID NO: 869596 - RNA, 19 nt, Homo sapiens
cuagauaaauuggaaaggu

SEQ ID NO: 869597 - RNA, 19 nt, Homo sapiens
aaagauagaguugaguuga

SEQ ID NO: 869598 - RNA, 19 nt, Homo sapiens
ugacggaaacugacucaau

SEQ ID NO: 869599 - RNA, 19 nt, Homo sapiens
ggauuaucauuaccuuuac

SEQ ID NO: 869600 - RNA, 19 nt, Homo sapiens
agaaucaauugcugaaagu

SEQ ID NO: 869601 - RNA, 19 nt, Homo sapiens
gaauagcauggaaacaguu

SEQ ID NO: 869602 - RNA, 19 nt, Homo sapiens
aguaggagcaucaguuauu

SEQ ID NO: 869603 - RNA, 19 nt, Homo sapiens
caguaccuauguggaauaa

SEQ ID NO: 869604 - RNA, 19 nt, Homo sapiens
gauagaguugaguugauaa

SEQ ID NO: 869605 - RNA, 19 nt, Homo sapiens
cauguaagcagaugugcaa

SEQ ID NO: 869606 - RNA, 19 nt, Homo sapiens
gaguugaguugauaaucca

SEQ ID NO: 869607 - RNA, 19 nt, Homo sapiens
uguauaggauguuguuugg

SEQ ID NO: 869608 - RNA, 19 nt, Homo sapiens
ucaauugcugaaaguguua

SEQ ID NO: 869609 - RNA, 19 nt, Homo sapiens
uggaaagggaauaagaaua

SEQ ID NO: 869610 - RNA, 19 nt, Homo sapiens
uuacaucccagaaacuuga

SEQ ID NO: 869611 - RNA, 19 nt, Homo sapiens
gauugaggagcaugccaua

SEQ ID NO: 869612 - RNA, 19 nt, Homo sapiens
cccaaucccuggcuaucuu

SEQ ID NO: 869613 - RNA, 19 nt, Homo sapiens
gggcggagaugcagucuua

SEQ ID NO: 869614 - RNA, 19 nt, Homo sapiens
gaaagagauucccugagua

SEQ ID NO: 869615 - RNA, 19 nt, Homo sapiens
ucagagacuuccuucauua

SEQ ID NO: 869616 - RNA, 19 nt, Homo sapiens
caaaggacauugcaucaga

SEQ ID NO: 869617 - RNA, 19 nt, Homo sapiens
ccuggaaacuggagaauuu

SEQ ID NO: 869618 - RNA, 19 nt, Homo sapiens
agauagagauucccaguaa

SEQ ID NO: 869619 - RNA, 19 nt, Homo sapiens
gagcagauucccagauuaa

SEQ ID NO: 869620 - RNA, 19 nt, Homo sapiens
cuuaaguccucuugaaaua

SEQ ID NO: 869621 - RNA, 19 nt, Homo sapiens
gaacacaaaggcaagaaga

SEQ ID NO: 869622 - RNA, 19 nt, Homo sapiens
agaaagagauucccugagu

SEQ ID NO: 869623 - RNA, 19 nt, Homo sapiens
cagagcagauucccagauu

SEQ ID NO: 869624 - RNA, 19 nt, Homo sapiens
gcaccagcaucccguauuc

SEQ ID NO: 869625 - RNA, 19 nt, Homo sapiens
uaacagauacucccauaau

SEQ ID NO: 869626 - RNA, 19 nt, Homo sapiens
gaaauaaacauaggucaca

SEQ ID NO: 869627 - RNA, 19 nt, Homo sapiens
ccaggaaacccaaucauga

SEQ ID NO: 869628 - RNA, 19 nt, Homo sapiens
uaacaucaguccucucaag

SEQ ID NO: 869629 - RNA, 19 nt, Homo sapiens
caauaaagacguuucuaug

SEQ ID NO: 869630 - RNA, 19 nt, Homo sapiens
ucagaaaccuccccauuaa

SEQ ID NO: 869631 - RNA, 19 nt, Homo sapiens
ccuaaagccuccaucucua

SEQ ID NO: 869632 - RNA, 19 nt, Homo sapiens
gagacuuccuucauuaaca

SEQ ID NO: 869633 - RNA, 19 nt, Homo sapiens
acagauacucccauaauaa

SEQ ID NO: 869634 - RNA, 19 nt, Homo sapiens
aacagauacucccauaaua

SEQ ID NO: 869635 - RNA, 19 nt, Homo sapiens
aagaagaaacccaccauaa

SEQ ID NO: 869636 - RNA, 19 nt, Homo sapiens
guacacacgucccaaacuc

SEQ ID NO: 869637 - RNA, 19 nt, Homo sapiens
ucagagaacuccauuucca

SEQ ID NO: 869638 - RNA, 19 nt, Homo sapiens
caagaagaaacccaccaua

SEQ ID NO: 869639 - RNA, 19 nt, Homo sapiens
gaggagaggaggaagaaga

SEQ ID NO: 869640 - RNA, 19 nt, Homo sapiens
ucuagucacuggccucaaa

SEQ ID NO: 869641 - RNA, 19 nt, Homo sapiens
aagccuccaucucuaauaa

SEQ ID NO: 869642 - RNA, 19 nt, Homo sapiens
uaacaaacacugccccuua

SEQ ID NO: 869643 - RNA, 19 nt, Homo sapiens
gagauagagauucccagua

SEQ ID NO: 869644 - RNA, 19 nt, Homo sapiens
caucagagaacuccauuuc

SEQ ID NO: 869645 - RNA, 19 nt, Homo sapiens
ccaaguccagcacaagaua

SEQ ID NO: 869646 - RNA, 19 nt, Homo sapiens
gaagaaacccaccauaacc

SEQ ID NO: 869647 - RNA, 19 nt, Homo sapiens
ccacuagcaucuccugaca

SEQ ID NO: 869648 - RNA, 19 nt, Homo sapiens
gcagucaggauaugcauuc

SEQ ID NO: 869649 - RNA, 19 nt, Homo sapiens
uaacagauuuccauaucac

SEQ ID NO: 869650 - RNA, 19 nt, Homo sapiens
gaucccaaacccuagagua

SEQ ID NO: 869651 - RNA, 19 nt, Homo sapiens
agacuuccuucauuaacaa

SEQ ID NO: 869652 - RNA, 19 nt, Homo sapiens
agagcagauucccagauua

SEQ ID NO: 869653 - RNA, 19 nt, Homo sapiens
cuaaagccuccaucucuaa

SEQ ID NO: 869654 - RNA, 19 nt, Homo sapiens
gcagauucccagauuaaca

SEQ ID NO: 869655 - RNA, 19 nt, Homo sapiens
ggacauugcaucagagaac

SEQ ID NO: 869656 - RNA, 19 nt, Homo sapiens
ugacacugcuccacuaugc

SEQ ID NO: 869657 - RNA, 19 nt, Homo sapiens
guccauggguuucaagaca

SEQ ID NO: 869658 - RNA, 19 nt, Homo sapiens
auuaacagauacucccaua

SEQ ID NO: 869659 - RNA, 19 nt, Homo sapiens
uaacacauccagaguagag

SEQ ID NO: 869660 - RNA, 19 nt, Homo sapiens
ggaccaugacuaagacaga

SEQ ID NO: 869661 - RNA, 19 nt, Homo sapiens
gugcaucaagugacaauga

SEQ ID NO: 869662 - RNA, 19 nt, Homo sapiens
acaugacacugcuccacua

SEQ ID NO: 869663 - RNA, 19 nt, Homo sapiens
cuccuguccucuucaauaa

SEQ ID NO: 869664 - RNA, 19 nt, Homo sapiens
ccugugcccucaaguccua

SEQ ID NO: 869665 - RNA, 19 nt, Homo sapiens
gaccaugacuaagacagau

SEQ ID NO: 869666 - RNA, 19 nt, Homo sapiens
caggcaaucucaugcuuag

SEQ ID NO: 869667 - RNA, 19 nt, Homo sapiens
guccuggaagugcuaauua

SEQ ID NO: 869668 - RNA, 19 nt, Homo sapiens
uggugacccucuccacaua

SEQ ID NO: 869669 - RNA, 19 nt, Homo sapiens
ccaggcaaucucaugcuua

SEQ ID NO: 869670 - RNA, 19 nt, Homo sapiens
caccgaggaccaugacuaa

SEQ ID NO: 869671 - RNA, 19 nt, Homo sapiens
cagagacuuccuucauuaa

SEQ ID NO: 869672 - RNA, 19 nt, Homo sapiens
agaacuccauuuccagguu

SEQ ID NO: 869673 - RNA, 19 nt, Homo sapiens
ccgaggaccaugacuaaga

SEQ ID NO: 869674 - RNA, 19 nt, Homo sapiens
agccagcccucgaucauug

SEQ ID NO: 869675 - RNA, 19 nt, Homo sapiens
ccaccgaggaccaugacua

SEQ ID NO: 869676 - RNA, 19 nt, Homo sapiens
gcacaagauagacgucauc

SEQ ID NO: 869677 - RNA, 19 nt, Homo sapiens
gccuccaucucuaauaaau

SEQ ID NO: 869678 - RNA, 19 nt, Homo sapiens
caaaucauggaaucccaaa

SEQ ID NO: 869679 - RNA, 19 nt, Homo sapiens
ccucugcacccucaagaaa

SEQ ID NO: 869680 - RNA, 19 nt, Homo sapiens
aaagagauucccugaguag

SEQ ID NO: 869681 - RNA, 19 nt, Homo sapiens
gaucauugaggccccauua

SEQ ID NO: 869682 - RNA, 19 nt, Homo sapiens
aguaacacauccagaguag

SEQ ID NO: 869683 - RNA, 19 nt, Homo sapiens
caguaacacauccagagua

SEQ ID NO: 869684 - RNA, 19 nt, Homo sapiens
ugagucacccugagauaga

SEQ ID NO: 869685 - RNA, 19 nt, Homo sapiens
ucacgcuacccaacuauga

SEQ ID NO: 869686 - RNA, 19 nt, Homo sapiens
ugacuccuguccucuucaa

SEQ ID NO: 869687 - RNA, 19 nt, Homo sapiens
caugacuccuguccucuuc

SEQ ID NO: 869688 - RNA, 19 nt, Homo sapiens
acccaacccuggaucagaa

SEQ ID NO: 869689 - RNA, 19 nt, Homo sapiens
cauugaggccccauuauua

SEQ ID NO: 869690 - RNA, 19 nt, Homo sapiens
gcaaaggccgcagggaaca

SEQ ID NO: 869691 - RNA, 19 nt, Homo sapiens
aauaaagacguuucuaugg

SEQ ID NO: 869692 - RNA, 19 nt, Homo sapiens
gcugucugcccgaggauuu

SEQ ID NO: 869693 - RNA, 19 nt, Homo sapiens
ucaagacaccaaauuccaa

SEQ ID NO: 869694 - RNA, 19 nt, Homo sapiens
cagauuaacagauuuccau

SEQ ID NO: 869695 - RNA, 19 nt, Homo sapiens
gauagagauucccaguaac

SEQ ID NO: 869696 - RNA, 19 nt, Homo sapiens
gcggagaugcagucuuaga

SEQ ID NO: 869697 - RNA, 19 nt, Homo sapiens
ccuaaggacuacgcuuuca

SEQ ID NO: 869698 - RNA, 19 nt, Homo sapiens
ccuguccucuucaauaaag

SEQ ID NO: 869699 - RNA, 19 nt, Homo sapiens
agaagaaacccaccauaac

SEQ ID NO: 869700 - RNA, 19 nt, Homo sapiens
gaucagaaaccuccccauu

SEQ ID NO: 869701 - RNA, 19 nt, Homo sapiens
gcauuacaacagaacauuc

SEQ ID NO: 869702 - RNA, 19 nt, Homo sapiens
gagauucccaguaacacau

SEQ ID NO: 869703 - RNA, 19 nt, Homo sapiens
cacaaaggcaagaagaaga

SEQ ID NO: 869704 - RNA, 19 nt, Homo sapiens
aaucagagacuuccuucau

SEQ ID NO: 869705 - RNA, 19 nt, Homo sapiens
caaaagaguaacagacauu

SEQ ID NO: 869706 - RNA, 19 nt, Homo sapiens
aagaggaggaggaggauga

SEQ ID NO: 869707 - RNA, 19 nt, Homo sapiens
gagguggucccagauccua

SEQ ID NO: 869708 - RNA, 19 nt, Homo sapiens
gcaugacuccuguccucuu

SEQ ID NO: 869709 - RNA, 19 nt, Homo sapiens
cgaggaccaugacuaagac

SEQ ID NO: 869710 - RNA, 19 nt, Homo sapiens
ucaguccucucaagauguc

SEQ ID NO: 869711 - RNA, 19 nt, Homo sapiens
gcaaaagaguaacagacau

SEQ ID NO: 869712 - RNA, 19 nt, Homo sapiens
gugacccucuccacauaau

SEQ ID NO: 869713 - RNA, 19 nt, Homo sapiens
gcaggacgcuuacuucuga

SEQ ID NO: 869714 - RNA, 19 nt, Homo sapiens
ucaaauggcuggacauguu

SEQ ID NO: 869715 - RNA, 19 nt, Homo sapiens
gggcucagauucagagaua

SEQ ID NO: 869716 - RNA, 19 nt, Homo sapiens
ggacaaguauggcuuccuu

SEQ ID NO: 869717 - RNA, 19 nt, Homo sapiens
gcagaacccaggaaaguuu

SEQ ID NO: 869718 - RNA, 19 nt, Homo sapiens
ggcaguaccugucuaauag

SEQ ID NO: 869719 - RNA, 19 nt, Homo sapiens
gacaugcacuggaauagga

SEQ ID NO: 869720 - RNA, 19 nt, Homo sapiens
gcucaaggccggaagcuuu

SEQ ID NO: 869721 - RNA, 19 nt, Homo sapiens
gagagaagcaggagaagga

SEQ ID NO: 869722 - RNA, 19 nt, Homo sapiens
gagagaagcaggagaagga

SEQ ID NO: 869723 - RNA, 19 nt, Homo sapiens
gcacaugccugcggagcaa

SEQ ID NO: 869724 - RNA, 19 nt, Homo sapiens
ggaccuguguuguaauugu

SEQ ID NO: 869725 - RNA, 19 nt, Homo sapiens
aaaagaaccugcuguugua

SEQ ID NO: 869726 - RNA, 19 nt, Homo sapiens
ccaaguggcuggaugugau

SEQ ID NO: 869727 - RNA, 19 nt, Homo sapiens
gcacuggaauaggaaaugu

SEQ ID NO: 869728 - RNA, 19 nt, Homo sapiens
gaaaagaaccugcuguugu

SEQ ID NO: 869729 - RNA, 19 nt, Homo sapiens
ggagaaagagcgagagaag

SEQ ID NO: 869730 - RNA, 19 nt, Homo sapiens
cagcccagcucaagaagug

SEQ ID NO: 869731 - RNA, 19 nt, Homo sapiens
gagcagaacccaggaaagu

SEQ ID NO: 869732 - RNA, 19 nt, Homo sapiens
ggcagaagcaggagaagaa

SEQ ID NO: 869733 - RNA, 19 nt, Homo sapiens
ggcagaagcaggagaaaga

SEQ ID NO: 869734 - RNA, 19 nt, Homo sapiens
gcauugacccugugcucua

SEQ ID NO: 869735 - RNA, 19 nt, Homo sapiens
ggcuggacauguucaguaa

SEQ ID NO: 869736 - RNA, 19 nt, Homo sapiens
ggccagggcucucauucug

SEQ ID NO: 869737 - RNA, 19 nt, Homo sapiens
ugacagaagcacugauuga

SEQ ID NO: 869738 - RNA, 19 nt, Homo sapiens
guacccaguuuauuuaagg

SEQ ID NO: 869739 - RNA, 19 nt, Homo sapiens
guaauuguguacagaggau

SEQ ID NO: 869740 - RNA, 19 nt, Homo sapiens
gcaagacggacaaguaugg

SEQ ID NO: 869741 - RNA, 19 nt, Homo sapiens
ggagucagcaguuucagau

SEQ ID NO: 869742 - RNA, 19 nt, Homo sapiens
gaugggcagcugcaaauga

SEQ ID NO: 869743 - RNA, 19 nt, Homo sapiens
uggcaguaccugucuaaua

SEQ ID NO: 869744 - RNA, 19 nt, Homo sapiens
gcgcaagacggacaaguau

SEQ ID NO: 869745 - RNA, 19 nt, Homo sapiens
gcucagauucagagauaaa

SEQ ID NO: 869746 - RNA, 19 nt, Homo sapiens
ccuguacccaguuuauuua

SEQ ID NO: 869747 - RNA, 19 nt, Homo sapiens
ccauggagcagcugcguaa

SEQ ID NO: 869748 - RNA, 19 nt, Homo sapiens
agaaggagcgggagaagga

SEQ ID NO: 869749 - RNA, 19 nt, Homo sapiens
agaaggagcggcagaaaca

SEQ ID NO: 869750 - RNA, 19 nt, Homo sapiens
agaaggagcggcagaaaca

SEQ ID NO: 869751 - RNA, 19 nt, Homo sapiens
gcagcgcuuugaggaauug

SEQ ID NO: 869752 - RNA, 19 nt, Homo sapiens
caccaggacccauaccuuu

SEQ ID NO: 869753 - RNA, 19 nt, Homo sapiens
ggagaaggagcggcagaaa

SEQ ID NO: 869754 - RNA, 19 nt, Homo sapiens
ggagaaggagcggcagaaa

SEQ ID NO: 869755 - RNA, 19 nt, Homo sapiens
gcaaggagacccggaagca

SEQ ID NO: 869756 - RNA, 19 nt, Homo sapiens
ggugacagaagcacugauu

SEQ ID NO: 869757 - RNA, 19 nt, Homo sapiens
ccuaggugcuguccugaau

SEQ ID NO: 869758 - RNA, 19 nt, Homo sapiens
ggagaaggagcgagagaag

SEQ ID NO: 869759 - RNA, 19 nt, Homo sapiens
agucagcaguuucagauuc

SEQ ID NO: 869760 - RNA, 19 nt, Homo sapiens
agaaagagcgagagaagca

SEQ ID NO: 869761 - RNA, 19 nt, Homo sapiens
ggcuggaugugauugagaa

SEQ ID NO: 869762 - RNA, 19 nt, Homo sapiens
gaccuguguuguaauugug

SEQ ID NO: 869763 - RNA, 19 nt, Homo sapiens
gugaaggcguuaagaucau

SEQ ID NO: 869764 - RNA, 19 nt, Homo sapiens
ugucuucuguccuuugguu

SEQ ID NO: 869765 - RNA, 19 nt, Homo sapiens
cagcaguuucagauucuua

SEQ ID NO: 869766 - RNA, 19 nt, Homo sapiens
ggcagaaacaggagaagga

SEQ ID NO: 869767 - RNA, 19 nt, Homo sapiens
ggcagaaacaggagaagga

SEQ ID NO: 869768 - RNA, 19 nt, Homo sapiens
ugcaugaggugaccaaucu

SEQ ID NO: 869769 - RNA, 19 nt, Homo sapiens
cucaagaaguggcgggaaa

SEQ ID NO: 869770 - RNA, 19 nt, Homo sapiens
cuggaccuguguuguaauu

SEQ ID NO: 869771 - RNA, 19 nt, Homo sapiens
agaaggagcggcagaagca

SEQ ID NO: 869772 - RNA, 19 nt, Homo sapiens
agaaggagcggcagaagca

SEQ ID NO: 869773 - RNA, 19 nt, Homo sapiens
gaaugcagcccagcucaag

SEQ ID NO: 869774 - RNA, 19 nt, Homo sapiens
uggaugugauugagaagga

SEQ ID NO: 869775 - RNA, 19 nt, Homo sapiens
ugaauggcccguugucauc

SEQ ID NO: 869776 - RNA, 19 nt, Homo sapiens
cagaugggcagcugcaaau

SEQ ID NO: 869777 - RNA, 19 nt, Homo sapiens
ccugggaccuggcaucucu

SEQ ID NO: 869778 - RNA, 19 nt, Homo sapiens
cugcugugcucccuccaaa

SEQ ID NO: 869779 - RNA, 19 nt, Homo sapiens
ugaugggagucagcaguuu

SEQ ID NO: 869780 - RNA, 19 nt, Homo sapiens
cggacacgcugaguuacuu

SEQ ID NO: 869781 - RNA, 19 nt, Homo sapiens
aagacuuccuggugcauga

SEQ ID NO: 869782 - RNA, 19 nt, Homo sapiens
ccauaccuuucaccuuguu

SEQ ID NO: 869783 - RNA, 19 nt, Homo sapiens
caaauggcuggacauguuc

SEQ ID NO: 869784 - RNA, 19 nt, Homo sapiens
gcucaaauggcuggacaug

SEQ ID NO: 869785 - RNA, 19 nt, Homo sapiens
ggacacgcugaguuacuug

SEQ ID NO: 869786 - RNA, 19 nt, Homo sapiens
gagaaggagcggcagaaac

SEQ ID NO: 869787 - RNA, 19 nt, Homo sapiens
gagaaggagcggcagaaac

SEQ ID NO: 869788 - RNA, 19 nt, Homo sapiens
gacccugugcucuacauga

SEQ ID NO: 869789 - RNA, 19 nt, Homo sapiens
gguggaacccaauguuuac

SEQ ID NO: 869790 - RNA, 19 nt, Homo sapiens
ccaggacccauaccuuuca

SEQ ID NO: 869791 - RNA, 19 nt, Homo sapiens
ggacaugcacuggaauagg

SEQ ID NO: 869792 - RNA, 19 nt, Homo sapiens
gcuccuguacccaguuuau

SEQ ID NO: 869793 - RNA, 19 nt, Homo sapiens
cagauucuuacacuccaua

SEQ ID NO: 869794 - RNA, 19 nt, Homo sapiens
ugugaaggcguuaagauca

SEQ ID NO: 869795 - RNA, 19 nt, Homo sapiens
caaguggcuggaugugauu

SEQ ID NO: 869796 - RNA, 19 nt, Homo sapiens
uggcuggacauguucagua

SEQ ID NO: 869797 - RNA, 19 nt, Homo sapiens
uaggugcuguccugaaugg

SEQ ID NO: 869798 - RNA, 19 nt, Homo sapiens
agaaggagcgagagaagca

SEQ ID NO: 869799 - RNA, 19 nt, Homo sapiens
gcgcuuugaggaauuggaa

SEQ ID NO: 869800 - RNA, 19 nt, Homo sapiens
agguggagcuggcuuccuu

SEQ ID NO: 869801 - RNA, 19 nt, Homo sapiens
gaugggagucagcaguuuc

SEQ ID NO: 869802 - RNA, 19 nt, Homo sapiens
uggaguccuuggcggauga

SEQ ID NO: 869803 - RNA, 19 nt, Homo sapiens
ccucccagguuacuacagu

SEQ ID NO: 869804 - RNA, 19 nt, Homo sapiens
ggaaaagaaccugcuguug

SEQ ID NO: 869805 - RNA, 19 nt, Homo sapiens
gcagcgggagcucaaaugg

SEQ ID NO: 869806 - RNA, 19 nt, Homo sapiens
ucuaauagcaaggaacuuc

SEQ ID NO: 869807 - RNA, 19 nt, Homo sapiens
ugucucaccaggacccaua

SEQ ID NO: 869808 - RNA, 19 nt, Homo sapiens
cuuugguucuccuuccaua

SEQ ID NO: 869809 - RNA, 19 nt, Homo sapiens
gucagcaguuucagauucu

SEQ ID NO: 869810 - RNA, 19 nt, Homo sapiens
gggagucagcaguuucaga

SEQ ID NO: 869811 - RNA, 19 nt, Homo sapiens
gggagaaggagcggcagaa

SEQ ID NO: 869812 - RNA, 19 nt, Homo sapiens
gacagaagcacugauugag

SEQ ID NO: 869813 - RNA, 19 nt, Homo sapiens
gcuauuaccucaucccuuu

SEQ ID NO: 869814 - RNA, 19 nt, Homo sapiens
ggaaucgacuuaccaaaga

SEQ ID NO: 869815 - RNA, 19 nt, Homo sapiens
ggacgaagaccaagaggaa

SEQ ID NO: 869816 - RNA, 19 nt, Homo sapiens
ccauuugccuggaugaaua

SEQ ID NO: 869817 - RNA, 19 nt, Homo sapiens
gcugaaagcggccugauuu

SEQ ID NO: 869818 - RNA, 19 nt, Homo sapiens
ggaccacccugccucagaa

SEQ ID NO: 869819 - RNA, 19 nt, Homo sapiens
ugaaacagauuccuacaca

SEQ ID NO: 869820 - RNA, 19 nt, Homo sapiens
gaucccgucuguauuuauu

SEQ ID NO: 869821 - RNA, 19 nt, Homo sapiens
ccacuaaacggguuggaua

SEQ ID NO: 869822 - RNA, 19 nt, Homo sapiens
gaacacggcccaccuagca

SEQ ID NO: 869823 - RNA, 19 nt, Homo sapiens
caugggagcaguaaugaua

SEQ ID NO: 869824 - RNA, 19 nt, Homo sapiens
guaaugauagcucguugua

SEQ ID NO: 869825 - RNA, 19 nt, Homo sapiens
ccaaagagcaacugaaaca

SEQ ID NO: 869826 - RNA, 19 nt, Homo sapiens
guaccugcgugcccucuuu

SEQ ID NO: 869827 - RNA, 19 nt, Homo sapiens
uaugaugucugugccauuu

SEQ ID NO: 869828 - RNA, 19 nt, Homo sapiens
caacugaaacagauuccua

SEQ ID NO: 869829 - RNA, 19 nt, Homo sapiens
caaugugaauuccaaugaa

SEQ ID NO: 869830 - RNA, 19 nt, Homo sapiens
gucaaugggucagucuuua

SEQ ID NO: 869831 - RNA, 19 nt, Homo sapiens
gcaagaggagggugaugaa

SEQ ID NO: 869832 - RNA, 19 nt, Homo sapiens
uuggauaucucauucuuug

SEQ ID NO: 869833 - RNA, 19 nt, Homo sapiens
gaaacagauuccuacacau

SEQ ID NO: 869834 - RNA, 19 nt, Homo sapiens
ccacccagcuccacuaaac

SEQ ID NO: 869835 - RNA, 19 nt, Homo sapiens
ggaagucccaccuccuuga

SEQ ID NO: 869836 - RNA, 19 nt, Homo sapiens
aaacagauuccuacacaug

SEQ ID NO: 869837 - RNA, 19 nt, Homo sapiens
gggacugggucuucacuuc

SEQ ID NO: 869838 - RNA, 19 nt, Homo sapiens
gaagggagaccaguaugau

SEQ ID NO: 869839 - RNA, 19 nt, Homo sapiens
gacauuccaucccaagcuu

SEQ ID NO: 869840 - RNA, 19 nt, Homo sapiens
cggaagaccugccccauuu

SEQ ID NO: 869841 - RNA, 19 nt, Homo sapiens
ggucaaugggucagucuuu

SEQ ID NO: 869842 - RNA, 19 nt, Homo sapiens
gaauuccaaugaacuucug

SEQ ID NO: 869843 - RNA, 19 nt, Homo sapiens
gguuggauaucucauucuu

SEQ ID NO: 869844 - RNA, 19 nt, Homo sapiens
aucccaagcuucucccuua

SEQ ID NO: 869845 - RNA, 19 nt, Homo sapiens
uaccaaagagcaacugaaa

SEQ ID NO: 869846 - RNA, 19 nt, Homo sapiens
aagauucgacugcaacuuu

SEQ ID NO: 869847 - RNA, 19 nt, Homo sapiens
aagagcaacugaaacagau

SEQ ID NO: 869848 - RNA, 19 nt, Homo sapiens
gguccuaaaugcccagaag

SEQ ID NO: 869849 - RNA, 19 nt, Homo sapiens
caaugggucagucuuuauu

SEQ ID NO: 869850 - RNA, 19 nt, Homo sapiens
ucacuucuugggcuaauaa

SEQ ID NO: 869851 - RNA, 19 nt, Homo sapiens
aaagagcaacugaaacaga

SEQ ID NO: 869852 - RNA, 19 nt, Homo sapiens
gcagagggacugggucuuc

SEQ ID NO: 869853 - RNA, 19 nt, Homo sapiens
gacugggucuucacuucuu

SEQ ID NO: 869854 - RNA, 19 nt, Homo sapiens
gguguggaauagugaggaa

SEQ ID NO: 869855 - RNA, 19 nt, Homo sapiens
caccuccuuugguuccuua

SEQ ID NO: 869856 - RNA, 19 nt, Homo sapiens
gaaucgacuuaccaaagag

SEQ ID NO: 869857 - RNA, 19 nt, Homo sapiens
acaaugugaauuccaauga

SEQ ID NO: 869858 - RNA, 19 nt, Homo sapiens
cuaaacggguuggauaucu

SEQ ID NO: 869859 - RNA, 19 nt, Homo sapiens
gagcaacugaaacagauuc

SEQ ID NO: 869860 - RNA, 19 nt, Homo sapiens
gcaguaaugauagcucguu

SEQ ID NO: 869861 - RNA, 19 nt, Homo sapiens
ucagaagggagaccaguau

SEQ ID NO: 869862 - RNA, 19 nt, Homo sapiens
uggaucccgucuguauuua

SEQ ID NO: 869863 - RNA, 19 nt, Homo sapiens
cuacacaugacuaucagaa

SEQ ID NO: 869864 - RNA, 19 nt, Homo sapiens
ggccaugggagcaguaaug

SEQ ID NO: 869865 - RNA, 19 nt, Homo sapiens
ccagaaaaggauacauuua

SEQ ID NO: 869866 - RNA, 19 nt, Homo sapiens
ggacugggucuucacuucu

SEQ ID NO: 869867 - RNA, 19 nt, Homo sapiens
ggugaccuauuugcacaga

SEQ ID NO: 869868 - RNA, 19 nt, Homo sapiens
ggcaagaggagggugauga

SEQ ID NO: 869869 - RNA, 19 nt, Homo sapiens
cuggaucccgucuguauuu

SEQ ID NO: 869870 - RNA, 19 nt, Homo sapiens
gaaaaggauacauuuagug

SEQ ID NO: 869871 - RNA, 19 nt, Homo sapiens
cagagggacugggucuuca

SEQ ID NO: 869872 - RNA, 19 nt, Homo sapiens
agaagggagaccaguauga

SEQ ID NO: 869873 - RNA, 19 nt, Homo sapiens
uggauauggugccgcugua

SEQ ID NO: 869874 - RNA, 19 nt, Homo sapiens
agauucgacugcaacuuug

SEQ ID NO: 869875 - RNA, 19 nt, Homo sapiens
cggguuggauaucucauuc

SEQ ID NO: 869876 - RNA, 19 nt, Homo sapiens
uaaacggguuggauaucuc

SEQ ID NO: 869877 - RNA, 19 nt, Homo sapiens
ggacauuccaucccaagcu

SEQ ID NO: 869878 - RNA, 19 nt, Homo sapiens
gaagaccaagaggaagaaa

SEQ ID NO: 869879 - RNA, 19 nt, Homo sapiens
gaaauccagcagcagaucu

SEQ ID NO: 869880 - RNA, 19 nt, Homo sapiens
ggaaauccagcagcagauc

SEQ ID NO: 869881 - RNA, 19 nt, Homo sapiens
ucaaugggucagucuuuau

SEQ ID NO: 869882 - RNA, 19 nt, Homo sapiens
ccaagaggaagaaacucaa

SEQ ID NO: 869883 - RNA, 19 nt, Homo sapiens
gaagauucgacugcaacuu

SEQ ID NO: 869884 - RNA, 19 nt, Homo sapiens
cggaaucgacuuaccaaag

SEQ ID NO: 869885 - RNA, 19 nt, Homo sapiens
ggacuuugcagaccuucca

SEQ ID NO: 869886 - RNA, 19 nt, Homo sapiens
cuucccaccuccuuugguu

SEQ ID NO: 869887 - RNA, 19 nt, Homo sapiens
gggacaagcugcggguacu

SEQ ID NO: 869888 - RNA, 19 nt, Homo sapiens
ggaauagugaggaaaucca

SEQ ID NO: 869889 - RNA, 19 nt, Homo sapiens
gaggagaggaccggaaguc

SEQ ID NO: 869890 - RNA, 19 nt, Homo sapiens
gccaugggagcaguaauga

SEQ ID NO: 869891 - RNA, 19 nt, Homo sapiens
gauauggugccgcuguagu

SEQ ID NO: 869892 - RNA, 19 nt, Homo sapiens
cauggacuuugcagaccuu

SEQ ID NO: 869893 - RNA, 19 nt, Homo sapiens
cgaagaccaagaggaagaa

SEQ ID NO: 869894 - RNA, 19 nt, Homo sapiens
gaccuuccagcucuguuug

SEQ ID NO: 869895 - RNA, 19 nt, Homo sapiens
caagaggaagaaacucaag

SEQ ID NO: 869896 - RNA, 19 nt, Homo sapiens
aaacggcuccagcggaauc

SEQ ID NO: 869897 - RNA, 19 nt, Homo sapiens
cagaaaaggauacauuuag

SEQ ID NO: 869898 - RNA, 19 nt, Homo sapiens
auauggugccgcuguagua

SEQ ID NO: 869899 - RNA, 19 nt, Homo sapiens
gaggaaggcuuaauagaua

SEQ ID NO: 869900 - RNA, 19 nt, Homo sapiens
gagauaaccuaauuacuga

SEQ ID NO: 869901 - RNA, 19 nt, Homo sapiens
ccagagagcugcauacaug

SEQ ID NO: 869902 - RNA, 19 nt, Homo sapiens
guucaaagauggacuaguu

SEQ ID NO: 869903 - RNA, 19 nt, Homo sapiens
ugaaauuacuugccuauga

SEQ ID NO: 869904 - RNA, 19 nt, Homo sapiens
gaaauuacuugccuaugau

SEQ ID NO: 869905 - RNA, 19 nt, Homo sapiens
gcugugaggugacuuauau

SEQ ID NO: 869906 - RNA, 19 nt, Homo sapiens
gaaccugucauuugaagua

SEQ ID NO: 869907 - RNA, 19 nt, Homo sapiens
aaacuggccugacuuaaga

SEQ ID NO: 869908 - RNA, 19 nt, Homo sapiens
gaucugaaccugucauuug

SEQ ID NO: 869909 - RNA, 19 nt, Homo sapiens
ggagauaaccuaauuacug

SEQ ID NO: 869910 - RNA, 19 nt, Homo sapiens
gaucauaggcugaggagaa

SEQ ID NO: 869911 - RNA, 19 nt, Homo sapiens
ggaaggaaaugaaauuacu

SEQ ID NO: 869912 - RNA, 19 nt, Homo sapiens
gcaaguauuccagacauua

SEQ ID NO: 869913 - RNA, 19 nt, Homo sapiens
aaauguagcuggcugcaaa

SEQ ID NO: 869914 - RNA, 19 nt, Homo sapiens
ugacauaaaugacaagagu

SEQ ID NO: 869915 - RNA, 19 nt, Homo sapiens
guauuuagguauccugauu

SEQ ID NO: 869916 - RNA, 19 nt, Homo sapiens
ugaagaguguggagacuuu

SEQ ID NO: 869917 - RNA, 19 nt, Homo sapiens
ucaaaagucucaagcaaua

SEQ ID NO: 869918 - RNA, 19 nt, Homo sapiens
ccucaucucuuaagcuaaa

SEQ ID NO: 869919 - RNA, 19 nt, Homo sapiens
uauaugagguuccagauca

SEQ ID NO: 869920 - RNA, 19 nt, Homo sapiens
gaaaggcacacaaugguau

SEQ ID NO: 869921 - RNA, 19 nt, Homo sapiens
ggaaaggcacacaauggua

SEQ ID NO: 869922 - RNA, 19 nt, Homo sapiens
ggccagaaguucaaagaug

SEQ ID NO: 869923 - RNA, 19 nt, Homo sapiens
gcaucaggcugcgucauuu

SEQ ID NO: 869924 - RNA, 19 nt, Homo sapiens
gaaaauagcacacacacaa

SEQ ID NO: 869925 - RNA, 19 nt, Homo sapiens
gaaagaggcuaugggaaac

SEQ ID NO: 869926 - RNA, 19 nt, Homo sapiens
agcauuaccuccagauaua

SEQ ID NO: 869927 - RNA, 19 nt, Homo sapiens
guuauugaauccugagaaa

SEQ ID NO: 869928 - RNA, 19 nt, Homo sapiens
ccaugaagaugcaggagaa

SEQ ID NO: 869929 - RNA, 19 nt, Homo sapiens
gacaagaguauaacggaua

SEQ ID NO: 869930 - RNA, 19 nt, Homo sapiens
ccaaaucucuguuuuaugu

SEQ ID NO: 869931 - RNA, 19 nt, Homo sapiens
ggacugagguuauuuuaca

SEQ ID NO: 869932 - RNA, 19 nt, Homo sapiens
guacuggccagaugaguuu

SEQ ID NO: 869933 - RNA, 19 nt, Homo sapiens
gagaagcuggucccaagua

SEQ ID NO: 869934 - RNA, 19 nt, Homo sapiens
guccuguccucaucucuua

SEQ ID NO: 869935 - RNA, 19 nt, Homo sapiens
agaaagaggcuaugggaaa

SEQ ID NO: 869936 - RNA, 19 nt, Homo sapiens
caaguggaauucauguguu

SEQ ID NO: 869937 - RNA, 19 nt, Homo sapiens
gaccuggccuuucauuauc

SEQ ID NO: 869938 - RNA, 19 nt, Homo sapiens
gaaggaaaggcacacaaug

SEQ ID NO: 869939 - RNA, 19 nt, Homo sapiens
ugaaaugugucucucauac

SEQ ID NO: 869940 - RNA, 19 nt, Homo sapiens
cacaauggauauaaggaaa

SEQ ID NO: 869941 - RNA, 19 nt, Homo sapiens
cuagaaguccauuaugaua

SEQ ID NO: 869942 - RNA, 19 nt, Homo sapiens
ggagagggcuuuucuuauc

SEQ ID NO: 869943 - RNA, 19 nt, Homo sapiens
uuaaagguccuaugaauuc

SEQ ID NO: 869944 - RNA, 19 nt, Homo sapiens
gaaguucaaagauggacua

SEQ ID NO: 869945 - RNA, 19 nt, Homo sapiens
acaaugguaucaaauguuc

SEQ ID NO: 869946 - RNA, 19 nt, Homo sapiens
uccaucaacuugcuuguuu

SEQ ID NO: 869947 - RNA, 19 nt, Homo sapiens
agaaagacccuauaaagca

SEQ ID NO: 869948 - RNA, 19 nt, Homo sapiens
aaugugagauguuccaaga

SEQ ID NO: 869949 - RNA, 19 nt, Homo sapiens
guccucaucucuuaagcua

SEQ ID NO: 869950 - RNA, 19 nt, Homo sapiens
acacaaugguaucaaaugu

SEQ ID NO: 869951 - RNA, 19 nt, Homo sapiens
cuuccugacuuuaauauug

SEQ ID NO: 869952 - RNA, 19 nt, Homo sapiens
ggaaggaaaggcacacaau

SEQ ID NO: 869953 - RNA, 19 nt, Homo sapiens
aaauagcacacacacaaua

SEQ ID NO: 869954 - RNA, 19 nt, Homo sapiens
uuauauagcucagccaaau

SEQ ID NO: 869955 - RNA, 19 nt, Homo sapiens
cgaccuggccuuucauuau

SEQ ID NO: 869956 - RNA, 19 nt, Homo sapiens
caaguaccaugacuccaau

SEQ ID NO: 869957 - RNA, 19 nt, Homo sapiens
ggaaacauagaaaugguau

SEQ ID NO: 869958 - RNA, 19 nt, Homo sapiens
gagggucacugcacuuugg

SEQ ID NO: 869959 - RNA, 19 nt, Homo sapiens
ugccaaauguuuaagauuc

SEQ ID NO: 869960 - RNA, 19 nt, Homo sapiens
caccaagaguuugcgguua

SEQ ID NO: 869961 - RNA, 19 nt, Homo sapiens
ucuagaauaugccauggaa

SEQ ID NO: 869962 - RNA, 19 nt, Homo sapiens
ccacacccauuuaaaguac

SEQ ID NO: 869963 - RNA, 19 nt, Homo sapiens
cauuagauccgcauuaugu

SEQ ID NO: 869964 - RNA, 19 nt, Homo sapiens
aaacuagugugcuaucuac

SEQ ID NO: 869965 - RNA, 19 nt, Homo sapiens
gcaaauagagaguugaaaa

SEQ ID NO: 869966 - RNA, 19 nt, Homo sapiens
gacuuuaaauugucaccaa

SEQ ID NO: 869967 - RNA, 19 nt, Homo sapiens
uggaugcuaugaauaaguu

SEQ ID NO: 869968 - RNA, 19 nt, Homo sapiens
uugaugcucuacgauauua

SEQ ID NO: 869969 - RNA, 19 nt, Homo sapiens
ucaaagacaggccguguga

SEQ ID NO: 869970 - RNA, 19 nt, Homo sapiens
gcacacaaugguaucaaau

SEQ ID NO: 869971 - RNA, 19 nt, Homo sapiens
ugugcuaucuacagccuua

SEQ ID NO: 869972 - RNA, 19 nt, Homo sapiens
cauuugaaguacagguuaa

SEQ ID NO: 869973 - RNA, 19 nt, Homo sapiens
uaaccuaauuacugagugu

SEQ ID NO: 869974 - RNA, 19 nt, Homo sapiens
gaaaagggaaggaaaugaa

SEQ ID NO: 869975 - RNA, 19 nt, Homo sapiens
gaaaaucuugucacucuuu

SEQ ID NO: 869976 - RNA, 19 nt, Homo sapiens
ggcacacaaugguaucaaa

SEQ ID NO: 869977 - RNA, 19 nt, Homo sapiens
aaagauagagcugagauga

SEQ ID NO: 869978 - RNA, 19 nt, Homo sapiens
ugaggaaggcuuaauagau

SEQ ID NO: 869979 - RNA, 19 nt, Homo sapiens
ccaaguaccaugacuccaa

SEQ ID NO: 869980 - RNA, 19 nt, Homo sapiens
ggguguaaguucugaaugg

SEQ ID NO: 869981 - RNA, 19 nt, Homo sapiens
cuagagcucugucacuauc

SEQ ID NO: 869982 - RNA, 19 nt, Homo sapiens
gaaagauagagcugagaug

SEQ ID NO: 869983 - RNA, 19 nt, Homo sapiens
accaggagauaaccuaauu

SEQ ID NO: 869984 - RNA, 19 nt, Homo sapiens
ugggugagccucuuccaua

SEQ ID NO: 869985 - RNA, 19 nt, Homo sapiens
uaagauuccuguguuccaa

SEQ ID NO: 869986 - RNA, 19 nt, Homo sapiens
gggaaacauagaaauggua

SEQ ID NO: 869987 - RNA, 19 nt, Homo sapiens
gggcugucaugugggaaua

SEQ ID NO: 869988 - RNA, 19 nt, Homo sapiens
cuuuaaagguccuaugaau

SEQ ID NO: 869989 - RNA, 19 nt, Homo sapiens
caccaggagugaaaugugu

SEQ ID NO: 869990 - RNA, 19 nt, Homo sapiens
uccuagaaguccauuauga

SEQ ID NO: 869991 - RNA, 19 nt, Homo sapiens
ccaagaguuugcgguuauu

SEQ ID NO: 869992 - RNA, 19 nt, Homo sapiens
ccuacuacauucuguuuua

SEQ ID NO: 869993 - RNA, 19 nt, Homo sapiens
gcugucaugugggaauaaa

SEQ ID NO: 869994 - RNA, 19 nt, Homo sapiens
ucaaucagguucucuucuc

SEQ ID NO: 869995 - RNA, 19 nt, Homo sapiens
gcacgucuucuuccucuuc

SEQ ID NO: 869996 - RNA, 19 nt, Homo sapiens
cagcauuaccuccagauau

SEQ ID NO: 869997 - RNA, 19 nt, Homo sapiens
ugagaaaacuagugugcua

SEQ ID NO: 869998 - RNA, 19 nt, Homo sapiens
gaauaugccauggaaaaua

SEQ ID NO: 869999 - RNA, 19 nt, Homo sapiens
gaagaucuauucagccuua

SEQ ID NO: 870000 - RNA, 19 nt, Homo sapiens
gaaauaaggugccacaguu

SEQ ID NO: 870001 - RNA, 19 nt, Homo sapiens
gaauccagcuacuacauua

SEQ ID NO: 870002 - RNA, 19 nt, Homo sapiens
gaauuggcgugguauauuu

SEQ ID NO: 870003 - RNA, 19 nt, Homo sapiens
gaaugagucugaagaucua

SEQ ID NO: 870004 - RNA, 19 nt, Homo sapiens
caacauuucuuguacuuug

SEQ ID NO: 870005 - RNA, 19 nt, Homo sapiens
ucagaaagcgcuuguauuu

SEQ ID NO: 870006 - RNA, 19 nt, Homo sapiens
aagcauagauacagcaaua

SEQ ID NO: 870007 - RNA, 19 nt, Homo sapiens
gaaacgcaaacuaucauua

SEQ ID NO: 870008 - RNA, 19 nt, Homo sapiens
agaaagcgcuuguauuuua

SEQ ID NO: 870009 - RNA, 19 nt, Homo sapiens
ggaauugauuuacugaaug

SEQ ID NO: 870010 - RNA, 19 nt, Homo sapiens
gaugguaaguuaacuggaa

SEQ ID NO: 870011 - RNA, 19 nt, Homo sapiens
guaggcauccuguaaauaa

SEQ ID NO: 870012 - RNA, 19 nt, Homo sapiens
caggagagcugcugucuuc

SEQ ID NO: 870013 - RNA, 19 nt, Homo sapiens
ugagucaccuuaacuuuga

SEQ ID NO: 870014 - RNA, 19 nt, Homo sapiens
ccaccucacuaaacuguaa

SEQ ID NO: 870015 - RNA, 19 nt, Homo sapiens
ugacuggacuuucuauuag

SEQ ID NO: 870016 - RNA, 19 nt, Homo sapiens
cauugaaacuguaugugua

SEQ ID NO: 870017 - RNA, 19 nt, Homo sapiens
ccugaagacuuguguuaaa

SEQ ID NO: 870018 - RNA, 19 nt, Homo sapiens
guccagcuguccucaguua

SEQ ID NO: 870019 - RNA, 19 nt, Homo sapiens
ucuccaguaugucuuauua

SEQ ID NO: 870020 - RNA, 19 nt, Homo sapiens
aaacuuaccuggcauugca

SEQ ID NO: 870021 - RNA, 19 nt, Homo sapiens
guaagucguuugcgagaau

SEQ ID NO: 870022 - RNA, 19 nt, Homo sapiens
ggaauuggcgugguauauu

SEQ ID NO: 870023 - RNA, 19 nt, Homo sapiens
gcauagauacagcaauaaa

SEQ ID NO: 870024 - RNA, 19 nt, Homo sapiens
gcagauacagucaugaaug

SEQ ID NO: 870025 - RNA, 19 nt, Homo sapiens
ccacacagugauuauauaa

SEQ ID NO: 870026 - RNA, 19 nt, Homo sapiens
gagcugguuuggagccuuu

SEQ ID NO: 870027 - RNA, 19 nt, Homo sapiens
gccaugggcuccucgcaaa

SEQ ID NO: 870028 - RNA, 19 nt, Homo sapiens
uaccaggucugaugccuuu

SEQ ID NO: 870029 - RNA, 19 nt, Homo sapiens
uguaaacgguaaagagauu

SEQ ID NO: 870030 - RNA, 19 nt, Homo sapiens
cauuggauaugguuauuug

SEQ ID NO: 870031 - RNA, 19 nt, Homo sapiens
gagcagauacagucaugaa

SEQ ID NO: 870032 - RNA, 19 nt, Homo sapiens
caaugacacucuuaaggau

SEQ ID NO: 870033 - RNA, 19 nt, Homo sapiens
gaaagcgcuuguauuuuaa

SEQ ID NO: 870034 - RNA, 19 nt, Homo sapiens
gcaaaaccauugaaacugu

SEQ ID NO: 870035 - RNA, 19 nt, Homo sapiens
ggagugagcauucguuucu

SEQ ID NO: 870036 - RNA, 19 nt, Homo sapiens
guaaaccagucccucacuu

SEQ ID NO: 870037 - RNA, 19 nt, Homo sapiens
guggcuccuuguaguauua

SEQ ID NO: 870038 - RNA, 19 nt, Homo sapiens
uaacugcugcuguugcuuu

SEQ ID NO: 870039 - RNA, 19 nt, Homo sapiens
ugagucgcaucucuacuaa

SEQ ID NO: 870040 - RNA, 19 nt, Homo sapiens
gcugaaagcaaacguugaa

SEQ ID NO: 870041 - RNA, 19 nt, Homo sapiens
gcaucucuacuaagguuua

SEQ ID NO: 870042 - RNA, 19 nt, Homo sapiens
gaagugauuauuacaccaa

SEQ ID NO: 870043 - RNA, 19 nt, Homo sapiens
cgaaacacaugaagcaaaa

SEQ ID NO: 870044 - RNA, 19 nt, Homo sapiens
gaccacacagugauuauau

SEQ ID NO: 870045 - RNA, 19 nt, Homo sapiens
gaaucacucagacaacauu

SEQ ID NO: 870046 - RNA, 19 nt, Homo sapiens
cagaaucacucagacaaca

SEQ ID NO: 870047 - RNA, 19 nt, Homo sapiens
ucacgcaucuuuaacuuuu

SEQ ID NO: 870048 - RNA, 19 nt, Homo sapiens
guaugucacgcaucuuuaa

SEQ ID NO: 870049 - RNA, 19 nt, Homo sapiens
caccugaagacuuguguua

SEQ ID NO: 870050 - RNA, 19 nt, Homo sapiens
guuauugccaccacaagua

SEQ ID NO: 870051 - RNA, 19 nt, Homo sapiens
uuaaggaucugcugaaagc

SEQ ID NO: 870052 - RNA, 19 nt, Homo sapiens
guuuggagccuuucuuuga

SEQ ID NO: 870053 - RNA, 19 nt, Homo sapiens
gugagucgcaucucuacua

SEQ ID NO: 870054 - RNA, 19 nt, Homo sapiens
ugaaaagccuguaaagaug

SEQ ID NO: 870055 - RNA, 19 nt, Homo sapiens
ucgcaucucuacuaagguu

SEQ ID NO: 870056 - RNA, 19 nt, Homo sapiens
ggaaacgcaaacuaucauu

SEQ ID NO: 870057 - RNA, 19 nt, Homo sapiens
cugacuggacuuucuauua

SEQ ID NO: 870058 - RNA, 19 nt, Homo sapiens
ugucgagaagugauuauua

SEQ ID NO: 870059 - RNA, 19 nt, Homo sapiens
gaaagcauagauacagcaa

SEQ ID NO: 870060 - RNA, 19 nt, Homo sapiens
acacgcaacauuucuugua

SEQ ID NO: 870061 - RNA, 19 nt, Homo sapiens
ugauaacugucgagaagug

SEQ ID NO: 870062 - RNA, 19 nt, Homo sapiens
acaaugacacucuuaagga

SEQ ID NO: 870063 - RNA, 19 nt, Homo sapiens
gcuauacugggaaagcaua

SEQ ID NO: 870064 - RNA, 19 nt, Homo sapiens
acuaaacuguaaacgguaa

SEQ ID NO: 870065 - RNA, 19 nt, Homo sapiens
gaacuacaggaauugaaca

SEQ ID NO: 870066 - RNA, 19 nt, Homo sapiens
gcuuaucuauagcagcaaa

SEQ ID NO: 870067 - RNA, 19 nt, Homo sapiens
gaauuccaccugaagacuu

SEQ ID NO: 870068 - RNA, 19 nt, Homo sapiens
gcagaccaccucacuaaac

SEQ ID NO: 870069 - RNA, 19 nt, Homo sapiens
ucacuucugugccaccaau

SEQ ID NO: 870070 - RNA, 19 nt, Homo sapiens
ggcauuggauaugguuauu

SEQ ID NO: 870071 - RNA, 19 nt, Homo sapiens
ccuaggauguggcauugga

SEQ ID NO: 870072 - RNA, 19 nt, Homo sapiens
acugauaacugucgagaag

SEQ ID NO: 870073 - RNA, 19 nt, Homo sapiens
gagccuuucuuugauuuua

SEQ ID NO: 870074 - RNA, 19 nt, Homo sapiens
uaccaacaguaccguuauu

SEQ ID NO: 870075 - RNA, 19 nt, Homo sapiens
acacagacacugauaacug

SEQ ID NO: 870076 - RNA, 19 nt, Homo sapiens
cagcaauaaaguacaguaa

SEQ ID NO: 870077 - RNA, 19 nt, Homo sapiens
ccgaguuccucccgucauu

SEQ ID NO: 870078 - RNA, 19 nt, Homo sapiens
uggcuuaccagaacuugua

SEQ ID NO: 870079 - RNA, 19 nt, Homo sapiens
ccaaugaauccagcuacua

SEQ ID NO: 870080 - RNA, 19 nt, Homo sapiens
gucgagaagugauuauuac

SEQ ID NO: 870081 - RNA, 19 nt, Homo sapiens
caacacagacacugauaac

SEQ ID NO: 870082 - RNA, 19 nt, Homo sapiens
guacaacacagacacugau

SEQ ID NO: 870083 - RNA, 19 nt, Homo sapiens
ugccaaugcuucugaguca

SEQ ID NO: 870084 - RNA, 19 nt, Homo sapiens
acaccuauuacaccucuua

SEQ ID NO: 870085 - RNA, 19 nt, Homo sapiens
gauguggcauuggauaugg

SEQ ID NO: 870086 - RNA, 19 nt, Homo sapiens
caaaaccauugaaacugua

SEQ ID NO: 870087 - RNA, 19 nt, Homo sapiens
caguaugucacgcaucuuu

SEQ ID NO: 870088 - RNA, 19 nt, Homo sapiens
gcucucagaaucacucaga

SEQ ID NO: 870089 - RNA, 19 nt, Homo sapiens
ggcauccuguaaauaauuc

SEQ ID NO: 870090 - RNA, 19 nt, Homo sapiens
accaggaacuacaggaauu

SEQ ID NO: 870091 - RNA, 19 nt, Homo sapiens
gacaaugacacucuuaagg

SEQ ID NO: 870092 - RNA, 19 nt, Homo sapiens
cuauucagccuuaucgaaa

SEQ ID NO: 870093 - RNA, 19 nt, Homo sapiens
ugucacgcaucuuuaacuu

SEQ ID NO: 870094 - RNA, 19 nt, Homo sapiens
ugcuguugcuuucuacaua

SEQ ID NO: 870095 - RNA, 19 nt, Homo sapiens
cagaccaccucacuaaacu

SEQ ID NO: 870096 - RNA, 19 nt, Homo sapiens
gacgcugccuccucacuca

SEQ ID NO: 870097 - RNA, 19 nt, Homo sapiens
ucaguaguguucucaguac

SEQ ID NO: 870098 - RNA, 19 nt, Homo sapiens
ugaaugagucugaagaucu

SEQ ID NO: 870099 - RNA, 19 nt, Homo sapiens
gaacucagccuguuucaga

SEQ ID NO: 870100 - RNA, 19 nt, Homo sapiens
cccaggagcugaucuguua

SEQ ID NO: 870101 - RNA, 19 nt, Homo sapiens
gagcugaucuguuacaagu

SEQ ID NO: 870102 - RNA, 19 nt, Homo sapiens
ccaagaagcuggugaacuc

SEQ ID NO: 870103 - RNA, 19 nt, Homo sapiens
ggaugagccucuccugaaa

SEQ ID NO: 870104 - RNA, 19 nt, Homo sapiens
ggacuaugcuggauucucu

SEQ ID NO: 870105 - RNA, 19 nt, Homo sapiens
ggaagagccaguuauauca

SEQ ID NO: 870106 - RNA, 19 nt, Homo sapiens
uggaagccaugcagaagua

SEQ ID NO: 870107 - RNA, 19 nt, Homo sapiens
ccaccaagcuuccagaacu

SEQ ID NO: 870108 - RNA, 19 nt, Homo sapiens
ggacaggacuaugcuggau

SEQ ID NO: 870109 - RNA, 19 nt, Homo sapiens
caaccuggguggccuguca

SEQ ID NO: 870110 - RNA, 19 nt, Homo sapiens
cagcgucccugguuccaaa

SEQ ID NO: 870111 - RNA, 19 nt, Homo sapiens
gugcugagguggccuuugu

SEQ ID NO: 870112 - RNA, 19 nt, Homo sapiens
gaccaaagcagucaagagu

SEQ ID NO: 870113 - RNA, 19 nt, Homo sapiens
ggacgcuccuuaucgugaa

SEQ ID NO: 870114 - RNA, 19 nt, Homo sapiens
cagcaugcccuuucccuuu

SEQ ID NO: 870115 - RNA, 19 nt, Homo sapiens
cuucagagauaaggcauuu

SEQ ID NO: 870116 - RNA, 19 nt, Homo sapiens
gagccucuccugaaacuga

SEQ ID NO: 870117 - RNA, 19 nt, Homo sapiens
ccgaugagauugugaaacu

SEQ ID NO: 870118 - RNA, 19 nt, Homo sapiens
gcagagcuaggguguguga

SEQ ID NO: 870119 - RNA, 19 nt, Homo sapiens
caccaagcuuccagaacua

SEQ ID NO: 870120 - RNA, 19 nt, Homo sapiens
gaaauccuccaccaagcuu

SEQ ID NO: 870121 - RNA, 19 nt, Homo sapiens
cagcugcucuccaaguugu

SEQ ID NO: 870122 - RNA, 19 nt, Homo sapiens
ggugugaacucagccuguu

SEQ ID NO: 870123 - RNA, 19 nt, Homo sapiens
ggcaaccgccgaugagauu

SEQ ID NO: 870124 - RNA, 19 nt, Homo sapiens
gugcaacggugugaacuca

SEQ ID NO: 870125 - RNA, 19 nt, Homo sapiens
gagguggccuuugucacuu

SEQ ID NO: 870126 - RNA, 19 nt, Homo sapiens
gccggaagagccaguuaua

SEQ ID NO: 870127 - RNA, 19 nt, Homo sapiens
ggcccacccucuaaguuga

SEQ ID NO: 870128 - RNA, 19 nt, Homo sapiens
cggaagagccaguuauauc

SEQ ID NO: 870129 - RNA, 19 nt, Homo sapiens
gaagagcccaggagcugau

SEQ ID NO: 870130 - RNA, 19 nt, Homo sapiens
uggaggagaucgcaaagca

SEQ ID NO: 870131 - RNA, 19 nt, Homo sapiens
gccgaggccaccaagaaua

SEQ ID NO: 870132 - RNA, 19 nt, Homo sapiens
uaagacucccugugaaaug

SEQ ID NO: 870133 - RNA, 19 nt, Homo sapiens
ugcccaugcugguuucaua

SEQ ID NO: 870134 - RNA, 19 nt, Homo sapiens
ccucuaaguugagcaggaa

SEQ ID NO: 870135 - RNA, 19 nt, Homo sapiens
ggccucagcuccucucacu

SEQ ID NO: 870136 - RNA, 19 nt, Homo sapiens
acaggacuaugcuggauuc

SEQ ID NO: 870137 - RNA, 19 nt, Homo sapiens
uggcaauccuaauuugguu

SEQ ID NO: 870138 - RNA, 19 nt, Homo sapiens
cagccgaggccaccaagaa

SEQ ID NO: 870139 - RNA, 19 nt, Homo sapiens
uggaugagccucuccugaa

SEQ ID NO: 870140 - RNA, 19 nt, Homo sapiens
gagccggaagagccaguua

SEQ ID NO: 870141 - RNA, 19 nt, Homo sapiens
gaaacugauagaugcugaa

SEQ ID NO: 870142 - RNA, 19 nt, Homo sapiens
gcuccucaguugugaugau

SEQ ID NO: 870143 - RNA, 19 nt, Homo sapiens
gaagagccaguuauaucag

SEQ ID NO: 870144 - RNA, 19 nt, Homo sapiens
uuacaaguccugaccaaag

SEQ ID NO: 870145 - RNA, 19 nt, Homo sapiens
ggaaauccuccaccaagcu

SEQ ID NO: 870146 - RNA, 19 nt, Homo sapiens
uuaccuggcaauccuaauu

SEQ ID NO: 870147 - RNA, 19 nt, Homo sapiens
ccauuggcccacccucuaa

SEQ ID NO: 870148 - RNA, 19 nt, Homo sapiens
uugcagagcuagggugugu

SEQ ID NO: 870149 - RNA, 19 nt, Homo sapiens
uaccuggcaauccuaauuu

SEQ ID NO: 870150 - RNA, 19 nt, Homo sapiens
cccagcugcucuccaaguu

SEQ ID NO: 870151 - RNA, 19 nt, Homo sapiens
aaacugauagaugcugaaa

SEQ ID NO: 870152 - RNA, 19 nt, Homo sapiens
ccgaggccaccaagaauau

SEQ ID NO: 870153 - RNA, 19 nt, Homo sapiens
gaagccaugcagaaguaug

SEQ ID NO: 870154 - RNA, 19 nt, Homo sapiens
ccaccaacgcgucccaugu

SEQ ID NO: 870155 - RNA, 19 nt, Homo sapiens
gacaggacuaugcuggauu

SEQ ID NO: 870156 - RNA, 19 nt, Homo sapiens
ggacgacagcgccuucacu

SEQ ID NO: 870157 - RNA, 19 nt, Homo sapiens
uuuaagacucccugugaaa

SEQ ID NO: 870158 - RNA, 19 nt, Homo sapiens
caccaugaccuccaagaag

SEQ ID NO: 870159 - RNA, 19 nt, Homo sapiens
agcaugcccuuucccuuug

SEQ ID NO: 870160 - RNA, 19 nt, Homo sapiens
ggaagcuggagccggaaga

SEQ ID NO: 870161 - RNA, 19 nt, Homo sapiens
cugcccagcugcucuccaa

SEQ ID NO: 870162 - RNA, 19 nt, Homo sapiens
guggcuggcugugcugaug

SEQ ID NO: 870163 - RNA, 19 nt, Homo sapiens
acugauagaugcugaaacc

SEQ ID NO: 870164 - RNA, 19 nt, Homo sapiens
caccaacgcgucccaugug

SEQ ID NO: 870165 - RNA, 19 nt, Homo sapiens
ucgcaaagcaggugaacgu

SEQ ID NO: 870166 - RNA, 19 nt, Homo sapiens
ugagguggccuuugucacu

SEQ ID NO: 870167 - RNA, 19 nt, Homo sapiens
cagagccuccacaccauga

SEQ ID NO: 870168 - RNA, 19 nt, Homo sapiens
gaagaaagcagaagaacua

SEQ ID NO: 870169 - RNA, 19 nt, Homo sapiens
gaacaacuauuccucaaga

SEQ ID NO: 870170 - RNA, 19 nt, Homo sapiens
gaaaagaucuaugcaguua

SEQ ID NO: 870171 - RNA, 19 nt, Homo sapiens
gaauagaaguuuccacaga

SEQ ID NO: 870172 - RNA, 19 nt, Homo sapiens
caagauggcugaacucaau

SEQ ID NO: 870173 - RNA, 19 nt, Homo sapiens
gaauggaucuucuaaccaa

SEQ ID NO: 870174 - RNA, 19 nt, Homo sapiens
gaacucagggcagaaauua

SEQ ID NO: 870175 - RNA, 19 nt, Homo sapiens
caacaaagaugcuaaagac

SEQ ID NO: 870176 - RNA, 19 nt, Homo sapiens
gcagaaauggauaaaguua

SEQ ID NO: 870177 - RNA, 19 nt, Homo sapiens
gaaauuacacauccaaaga

SEQ ID NO: 870178 - RNA, 19 nt, Homo sapiens
cagcucaucuugaaauaaa

SEQ ID NO: 870179 - RNA, 19 nt, Homo sapiens
gaacuaaagagacucacua

SEQ ID NO: 870180 - RNA, 19 nt, Homo sapiens
gcaguuagaucaguuguuc

SEQ ID NO: 870181 - RNA, 19 nt, Homo sapiens
gcagugaugucaguccaua

SEQ ID NO: 870182 - RNA, 19 nt, Homo sapiens
uuacacaacugcaucauug

SEQ ID NO: 870183 - RNA, 19 nt, Homo sapiens
gauaucgcgucaugauuaa

SEQ ID NO: 870184 - RNA, 19 nt, Homo sapiens
cauccucucuuaaucauuu

SEQ ID NO: 870185 - RNA, 19 nt, Homo sapiens
ucacuaaccuugccaguca

SEQ ID NO: 870186 - RNA, 19 nt, Homo sapiens
gaaauuaagcacuuuguca

SEQ ID NO: 870187 - RNA, 19 nt, Homo sapiens
gaaaagaggcccaaauauu

SEQ ID NO: 870188 - RNA, 19 nt, Homo sapiens
gggcagaaauuaagcacuu

SEQ ID NO: 870189 - RNA, 19 nt, Homo sapiens
gcccaaauauugagaaauc

SEQ ID NO: 870190 - RNA, 19 nt, Homo sapiens
cagaugaguuggcaaagaa

SEQ ID NO: 870191 - RNA, 19 nt, Homo sapiens
cuagcuugcuucauaauuu

SEQ ID NO: 870192 - RNA, 19 nt, Homo sapiens
gaaagcagaagaacuaaag

SEQ ID NO: 870193 - RNA, 19 nt, Homo sapiens
guccauagauugucuuuag

SEQ ID NO: 870194 - RNA, 19 nt, Homo sapiens
gcucuagcuugcuucauaa

SEQ ID NO: 870195 - RNA, 19 nt, Homo sapiens
gaagcaagauggcugaacu

SEQ ID NO: 870196 - RNA, 19 nt, Homo sapiens
aaacaaaggcggugccaaa

SEQ ID NO: 870197 - RNA, 19 nt, Homo sapiens
aaccaaagacggagauuua

SEQ ID NO: 870198 - RNA, 19 nt, Homo sapiens
cagaaacuauccuuagaug

SEQ ID NO: 870199 - RNA, 19 nt, Homo sapiens
ucaagacuuugcagcauuu

SEQ ID NO: 870200 - RNA, 19 nt, Homo sapiens
caacagaaacuauccuuag

SEQ ID NO: 870201 - RNA, 19 nt, Homo sapiens
caaagaugcuaaagacaag

SEQ ID NO: 870202 - RNA, 19 nt, Homo sapiens
gauugucuuuagagaguua

SEQ ID NO: 870203 - RNA, 19 nt, Homo sapiens
gcaacagaaacuauccuua

SEQ ID NO: 870204 - RNA, 19 nt, Homo sapiens
agauaucgcgucaugauua

SEQ ID NO: 870205 - RNA, 19 nt, Homo sapiens
gcaacaaagaugcuaaaga

SEQ ID NO: 870206 - RNA, 19 nt, Homo sapiens
gaacucaauacucauguga

SEQ ID NO: 870207 - RNA, 19 nt, Homo sapiens
gacccgagcuccagcacuu

SEQ ID NO: 870208 - RNA, 19 nt, Homo sapiens
gaacauugcuguggauucc

SEQ ID NO: 870209 - RNA, 19 nt, Homo sapiens
uaaagaagaagccauggaa

SEQ ID NO: 870210 - RNA, 19 nt, Homo sapiens
gagugucaaucagaauaua

SEQ ID NO: 870211 - RNA, 19 nt, Homo sapiens
uggcugaacucaauacuca

SEQ ID NO: 870212 - RNA, 19 nt, Homo sapiens
gcaacagacuacugcaaca

SEQ ID NO: 870213 - RNA, 19 nt, Homo sapiens
ccaauucgcugccaaaaga

SEQ ID NO: 870214 - RNA, 19 nt, Homo sapiens
cagaagaacuaaagagacu

SEQ ID NO: 870215 - RNA, 19 nt, Homo sapiens
gaaauaaagccagaugagu

SEQ ID NO: 870216 - RNA, 19 nt, Homo sapiens
gaagaucagaggcucaguu

SEQ ID NO: 870217 - RNA, 19 nt, Homo sapiens
aaucauccacucacaauaa

SEQ ID NO: 870218 - RNA, 19 nt, Homo sapiens
gcugaaggcccaaaucaug

SEQ ID NO: 870219 - RNA, 19 nt, Homo sapiens
ucagcgagcguaaauauga

SEQ ID NO: 870220 - RNA, 19 nt, Homo sapiens
uggcagaaauggauaaagu

SEQ ID NO: 870221 - RNA, 19 nt, Homo sapiens
aaauaaagccagaugaguu

SEQ ID NO: 870222 - RNA, 19 nt, Homo sapiens
uagauugucuuuagagagu

SEQ ID NO: 870223 - RNA, 19 nt, Homo sapiens
guugugucauccucucuua

SEQ ID NO: 870224 - RNA, 19 nt, Homo sapiens
cauaacaacaggcuaaaug

SEQ ID NO: 870225 - RNA, 19 nt, Homo sapiens
ucagaaaccaggcugcuuu

SEQ ID NO: 870226 - RNA, 19 nt, Homo sapiens
ccagaugaguuggcaaaga

SEQ ID NO: 870227 - RNA, 19 nt, Homo sapiens
uaaaugggccugccaaguc

SEQ ID NO: 870228 - RNA, 19 nt, Homo sapiens
uaaagagacucacuaaccu

SEQ ID NO: 870229 - RNA, 19 nt, Homo sapiens
uaucauaacaacaggcuaa

SEQ ID NO: 870230 - RNA, 19 nt, Homo sapiens
gcagugcaauucaaguucu

SEQ ID NO: 870231 - RNA, 19 nt, Homo sapiens
ccgaggugcugacccaauu

SEQ ID NO: 870232 - RNA, 19 nt, Homo sapiens
gaagaacuaaagagacuca

SEQ ID NO: 870233 - RNA, 19 nt, Homo sapiens
aggaagaaguggauaguuc

SEQ ID NO: 870234 - RNA, 19 nt, Homo sapiens
aaagaggcccaaauauuga

SEQ ID NO: 870235 - RNA, 19 nt, Homo sapiens
gaacaacagagaggucaga

SEQ ID NO: 870236 - RNA, 19 nt, Homo sapiens
ccuuaucccucgugagaaa

SEQ ID NO: 870237 - RNA, 19 nt, Homo sapiens
ggauggcagugcaauucaa

SEQ ID NO: 870238 - RNA, 19 nt, Homo sapiens
acaaagaugcuaaagacaa

SEQ ID NO: 870239 - RNA, 19 nt, Homo sapiens
aauggaauaugacaggaaa

SEQ ID NO: 870240 - RNA, 19 nt, Homo sapiens
cauagauugucuuuagaga

SEQ ID NO: 870241 - RNA, 19 nt, Homo sapiens
gaugucaguccauagauug

SEQ ID NO: 870242 - RNA, 19 nt, Homo sapiens
ucaauacucaugugaaugu

SEQ ID NO: 870243 - RNA, 19 nt, Homo sapiens
ggccugagcuaggaggaaa

SEQ ID NO: 870244 - RNA, 19 nt, Homo sapiens
ggagaaauuacacauccaa

SEQ ID NO: 870245 - RNA, 19 nt, Homo sapiens
ccagucagauggcagagau

SEQ ID NO: 870246 - RNA, 19 nt, Homo sapiens
ugaugucaguccauagauu

SEQ ID NO: 870247 - RNA, 19 nt, Homo sapiens
gcagggcagugggaaugaa

SEQ ID NO: 870248 - RNA, 19 nt, Homo sapiens
aacagaaacuauccuuaga

SEQ ID NO: 870249 - RNA, 19 nt, Homo sapiens
gaucagaggcucaguuagc

SEQ ID NO: 870250 - RNA, 19 nt, Homo sapiens
aagaucagaggcucaguua

SEQ ID NO: 870251 - RNA, 19 nt, Homo sapiens
aauagaaguuuccacagau

SEQ ID NO: 870252 - RNA, 19 nt, Homo sapiens
ccacgagaauagaaguuuc

SEQ ID NO: 870253 - RNA, 19 nt, Homo sapiens
gguagugucgguaggguuu

SEQ ID NO: 870254 - RNA, 19 nt, Homo sapiens
uaagcccucugaaggcaaa

SEQ ID NO: 870255 - RNA, 19 nt, Homo sapiens
aaaagaggcccaaauauug

SEQ ID NO: 870256 - RNA, 19 nt, Homo sapiens
gaauggaauaugacaggaa

SEQ ID NO: 870257 - RNA, 19 nt, Homo sapiens
ggacacaugcgcuuuugua

SEQ ID NO: 870258 - RNA, 19 nt, Homo sapiens
cuugaucuguugaugcuuu

SEQ ID NO: 870259 - RNA, 19 nt, Homo sapiens
gcagaaauuaagcacuuug

SEQ ID NO: 870260 - RNA, 19 nt, Homo sapiens
ggucacagaaggcaacaga

SEQ ID NO: 870261 - RNA, 19 nt, Homo sapiens
gcccuuaucccucgugaga

SEQ ID NO: 870262 - RNA, 19 nt, Homo sapiens
ggcagaaauuaagcacuuu

SEQ ID NO: 870263 - RNA, 19 nt, Homo sapiens
cugcaucauugacaaagaa

SEQ ID NO: 870264 - RNA, 19 nt, Homo sapiens
caacugcaucauugacaaa

SEQ ID NO: 870265 - RNA, 19 nt, Homo sapiens
gaauuacacaacugcauca

SEQ ID NO: 870266 - RNA, 19 nt, Homo sapiens
guggauaguuccgugaaga

SEQ ID NO: 870267 - RNA, 19 nt, Homo sapiens
gaggucagauggccuacag

SEQ ID NO: 870268 - RNA, 19 nt, Homo sapiens
gagagaagcuguuccagaa

SEQ ID NO: 870269 - RNA, 19 nt, Homo sapiens
gaagcagcauuucuuguua

SEQ ID NO: 870270 - RNA, 19 nt, Homo sapiens
gcaagaagcuggagaggau

SEQ ID NO: 870271 - RNA, 19 nt, Homo sapiens
gauguacgauacccucaua

SEQ ID NO: 870272 - RNA, 19 nt, Homo sapiens
cagcauuucuuguuaacua

SEQ ID NO: 870273 - RNA, 19 nt, Homo sapiens
gaaggaagaggacaugauu

SEQ ID NO: 870274 - RNA, 19 nt, Homo sapiens
ggaagcagcauuucuuguu

SEQ ID NO: 870275 - RNA, 19 nt, Homo sapiens
ccaaaggucaugcucauuu

SEQ ID NO: 870276 - RNA, 19 nt, Homo sapiens
gaugggcugucguguauau

SEQ ID NO: 870277 - RNA, 19 nt, Homo sapiens
agaggaagcugaacgucua

SEQ ID NO: 870278 - RNA, 19 nt, Homo sapiens
cgaagcugcuggacuuuga

SEQ ID NO: 870279 - RNA, 19 nt, Homo sapiens
ucaaagggaagcagcauuu

SEQ ID NO: 870280 - RNA, 19 nt, Homo sapiens
ggacccucaugacuccuua

SEQ ID NO: 870281 - RNA, 19 nt, Homo sapiens
caaaggucaugcucauuuc

SEQ ID NO: 870282 - RNA, 19 nt, Homo sapiens
gcaaacaccugcgcauggu

SEQ ID NO: 870283 - RNA, 19 nt, Homo sapiens
gaacgucauccacaucaug

SEQ ID NO: 870284 - RNA, 19 nt, Homo sapiens
caucaugggcugcuacauu

SEQ ID NO: 870285 - RNA, 19 nt, Homo sapiens
gagggcaccuggcuguguu

SEQ ID NO: 870286 - RNA, 19 nt, Homo sapiens
aagcagcauuucuuguuaa

SEQ ID NO: 870287 - RNA, 19 nt, Homo sapiens
gaagaggacaugauucacu

SEQ ID NO: 870288 - RNA, 19 nt, Homo sapiens
aggaugggcugucguguau

SEQ ID NO: 870289 - RNA, 19 nt, Homo sapiens
acucgaagcugcuggacuu

SEQ ID NO: 870290 - RNA, 19 nt, Homo sapiens
gcccaaggcugaguacauc

SEQ ID NO: 870291 - RNA, 19 nt, Homo sapiens
uacgauacccucauaguga

SEQ ID NO: 870292 - RNA, 19 nt, Homo sapiens
aagaggacaugauucacuu

SEQ ID NO: 870293 - RNA, 19 nt, Homo sapiens
guacgauacccucauagug

SEQ ID NO: 870294 - RNA, 19 nt, Homo sapiens
ccucaugacuccuuauagg

SEQ ID NO: 870295 - RNA, 19 nt, Homo sapiens
ccacccagcacucucauug

SEQ ID NO: 870296 - RNA, 19 nt, Homo sapiens
caccaaaggucaugcucau

SEQ ID NO: 870297 - RNA, 19 nt, Homo sapiens
agacagcaaccacaacuau

SEQ ID NO: 870298 - RNA, 19 nt, Homo sapiens
ccccaucccugcuuacuua

SEQ ID NO: 870299 - RNA, 19 nt, Homo sapiens
gccggaaacgggagaauga

SEQ ID NO: 870300 - RNA, 19 nt, Homo sapiens
gaugaucgagacguacuuu

SEQ ID NO: 870301 - RNA, 19 nt, Homo sapiens
ggagaaggaagaggacaug

SEQ ID NO: 870302 - RNA, 19 nt, Homo sapiens
ggacugggacacugagaag

SEQ ID NO: 870303 - RNA, 19 nt, Homo sapiens
caggaugggcugucgugua

SEQ ID NO: 870304 - RNA, 19 nt, Homo sapiens
ccaaaguggagaaggaaga

SEQ ID NO: 870305 - RNA, 19 nt, Homo sapiens
uugaggagauagagaggaa

SEQ ID NO: 870306 - RNA, 19 nt, Homo sapiens
gccaagaucuggaaaaugc

SEQ ID NO: 870307 - RNA, 19 nt, Homo sapiens
ccacaagggagccaagauc

SEQ ID NO: 870308 - RNA, 19 nt, Homo sapiens
ccucauagugaccauuaaa

SEQ ID NO: 870309 - RNA, 19 nt, Homo sapiens
cagcagcccacauguguuc

SEQ ID NO: 870310 - RNA, 19 nt, Homo sapiens
gcguugaccgugugucuga

SEQ ID NO: 870311 - RNA, 19 nt, Homo sapiens
ugaucgagacguacuuuga

SEQ ID NO: 870312 - RNA, 19 nt, Homo sapiens
gagccaagaucuggaaaau

SEQ ID NO: 870313 - RNA, 19 nt, Homo sapiens
caacuaugcaagcgguguu

SEQ ID NO: 870314 - RNA, 19 nt, Homo sapiens
ucagggcaccucagacguu

SEQ ID NO: 870315 - RNA, 19 nt, Homo sapiens
gguuguaucgccuguggaa

SEQ ID NO: 870316 - RNA, 19 nt, Homo sapiens
cgagacguacuuugacuuc

SEQ ID NO: 870317 - RNA, 19 nt, Homo sapiens
cauugcugcuguugaguuc

SEQ ID NO: 870318 - RNA, 19 nt, Homo sapiens
ccaugaaagccgacacuuc

SEQ ID NO: 870319 - RNA, 19 nt, Homo sapiens
gacagcaaccacaacuaug

SEQ ID NO: 870320 - RNA, 19 nt, Homo sapiens
gaaccucaggacccucaug

SEQ ID NO: 870321 - RNA, 19 nt, Homo sapiens
gagaaggaagaggacauga

SEQ ID NO: 870322 - RNA, 19 nt, Homo sapiens
ucuaucuccucaagaacaa

SEQ ID NO: 870323 - RNA, 19 nt, Homo sapiens
gggugaaggcccagacguu

SEQ ID NO: 870324 - RNA, 19 nt, Homo sapiens
ugucugugcuuucacuuac

SEQ ID NO: 870325 - RNA, 19 nt, Homo sapiens
aggaagaggacaugauuca

SEQ ID NO: 870326 - RNA, 19 nt, Homo sapiens
gcccaagggaagcagauga

SEQ ID NO: 870327 - RNA, 19 nt, Homo sapiens
aucaugggcugcuacauuc

SEQ ID NO: 870328 - RNA, 19 nt, Homo sapiens
cggaaacgggagaaugauu

SEQ ID NO: 870329 - RNA, 19 nt, Homo sapiens
agcagaugaucgagacgua

SEQ ID NO: 870330 - RNA, 19 nt, Homo sapiens
cuuauagggucaccuucga

SEQ ID NO: 870331 - RNA, 19 nt, Homo sapiens
acaccucuaucuccucaag

SEQ ID NO: 870332 - RNA, 19 nt, Homo sapiens
uuggaacgauguacgauac

SEQ ID NO: 870333 - RNA, 19 nt, Homo sapiens
gggaagcagcauuucuugu

SEQ ID NO: 870334 - RNA, 19 nt, Homo sapiens
aagggaagcagcauuucuu

SEQ ID NO: 870335 - RNA, 19 nt, Homo sapiens
caaagggaagcagcauuuc

SEQ ID NO: 870336 - RNA, 19 nt, Homo sapiens
aaugauuccgcgucuguaa

SEQ ID NO: 870337 - RNA, 19 nt, Homo sapiens
agauagagaggaagcugaa

SEQ ID NO: 870338 - RNA, 19 nt, Homo sapiens
gaucgagacguacuuugac

SEQ ID NO: 870339 - RNA, 19 nt, Homo sapiens
ccaauggagagaagcuguu

SEQ ID NO: 870340 - RNA, 19 nt, Homo sapiens
uugccaaaguggagaagga

SEQ ID NO: 870341 - RNA, 19 nt, Homo sapiens
gcugaacgucuaccacaag

SEQ ID NO: 870342 - RNA, 19 nt, Homo sapiens
ccgacugucugugcuuuca

SEQ ID NO: 870343 - RNA, 19 nt, Homo sapiens
ugagccgccugaugagcaa

SEQ ID NO: 870344 - RNA, 19 nt, Homo sapiens
caacaagaauggcuucaaa

SEQ ID NO: 870345 - RNA, 19 nt, Homo sapiens
ggagaaauaucuggaagaa

SEQ ID NO: 870346 - RNA, 19 nt, Homo sapiens
guagugaguuguagauaaa

SEQ ID NO: 870347 - RNA, 19 nt, Homo sapiens
caacugggaugauacuuau

SEQ ID NO: 870348 - RNA, 19 nt, Homo sapiens
ccagugauagucaauauua

SEQ ID NO: 870349 - RNA, 19 nt, Homo sapiens
gaucuugguuccucuaaug

SEQ ID NO: 870350 - RNA, 19 nt, Homo sapiens
acacaaaccuagauguuau

SEQ ID NO: 870351 - RNA, 19 nt, Homo sapiens
cagaacgucuaguauaauu

SEQ ID NO: 870352 - RNA, 19 nt, Homo sapiens
caaagacgaggcaagaaua

SEQ ID NO: 870353 - RNA, 19 nt, Homo sapiens
gcaagaauagucagaguga

SEQ ID NO: 870354 - RNA, 19 nt, Homo sapiens
agaaauaucuggaagaaac

SEQ ID NO: 870355 - RNA, 19 nt, Homo sapiens
ggaagaagccucgccauca

SEQ ID NO: 870356 - RNA, 19 nt, Homo sapiens
uccaaucacuuuaccuaua

SEQ ID NO: 870357 - RNA, 19 nt, Homo sapiens
gaaaugucuuuauguagca

SEQ ID NO: 870358 - RNA, 19 nt, Homo sapiens
acacuaggaccuccaaaua

SEQ ID NO: 870359 - RNA, 19 nt, Homo sapiens
gaucugcaaugccaauauc

SEQ ID NO: 870360 - RNA, 19 nt, Homo sapiens
uaauuacagucaugcauug

SEQ ID NO: 870361 - RNA, 19 nt, Homo sapiens
gaugaggucuucggcuuug

SEQ ID NO: 870362 - RNA, 19 nt, Homo sapiens
gauccaaucacuuuaccua

SEQ ID NO: 870363 - RNA, 19 nt, Homo sapiens
ggaggaauauguagaucca

SEQ ID NO: 870364 - RNA, 19 nt, Homo sapiens
ggaccaagcacgccucuuc

SEQ ID NO: 870365 - RNA, 19 nt, Homo sapiens
gggaugauacuuaugacua

SEQ ID NO: 870366 - RNA, 19 nt, Homo sapiens
gaagaagccucgccaucac

SEQ ID NO: 870367 - RNA, 19 nt, Homo sapiens
gaugauagcaccugucagu

SEQ ID NO: 870368 - RNA, 19 nt, Homo sapiens
accagaacgucuaguauaa

SEQ ID NO: 870369 - RNA, 19 nt, Homo sapiens
gcagagccauugugagcau

SEQ ID NO: 870370 - RNA, 19 nt, Homo sapiens
gcgcuccaguuccggauaa

SEQ ID NO: 870371 - RNA, 19 nt, Homo sapiens
aauuugagcuguuuacugu

SEQ ID NO: 870372 - RNA, 19 nt, Homo sapiens
ccaaguggaccaucgauga

SEQ ID NO: 870373 - RNA, 19 nt, Homo sapiens
ccagaauccuccagaagau

SEQ ID NO: 870374 - RNA, 19 nt, Homo sapiens
gaacgucuaguauaauuac

SEQ ID NO: 870375 - RNA, 19 nt, Homo sapiens
guucacagcucaccauugc

SEQ ID NO: 870376 - RNA, 19 nt, Homo sapiens
ccaaucacuuuaccuauac

SEQ ID NO: 870377 - RNA, 19 nt, Homo sapiens
aguagugaguuguagauaa

SEQ ID NO: 870378 - RNA, 19 nt, Homo sapiens
ggaugauacuuaugacuac

SEQ ID NO: 870379 - RNA, 19 nt, Homo sapiens
uaccagaacgucuaguaua

SEQ ID NO: 870380 - RNA, 19 nt, Homo sapiens
gagccuacaucuucuuguc

SEQ ID NO: 870381 - RNA, 19 nt, Homo sapiens
ggagacaggaguccauuca

SEQ ID NO: 870382 - RNA, 19 nt, Homo sapiens
gcaccagucccucuucaug

SEQ ID NO: 870383 - RNA, 19 nt, Homo sapiens
aggaaggcgugaccgaaua

SEQ ID NO: 870384 - RNA, 19 nt, Homo sapiens
gaauauguagauccaauca

SEQ ID NO: 870385 - RNA, 19 nt, Homo sapiens
caugaaauaccaaauguca

SEQ ID NO: 870386 - RNA, 19 nt, Homo sapiens
gccaaggaguagugaguug

SEQ ID NO: 870387 - RNA, 19 nt, Homo sapiens
caacaggugagaagaagga

SEQ ID NO: 870388 - RNA, 19 nt, Homo sapiens
gaagcaagaagaaggaaag

SEQ ID NO: 870389 - RNA, 19 nt, Homo sapiens
ucacaugaaauaccaaaug

SEQ ID NO: 870390 - RNA, 19 nt, Homo sapiens
acaacugggaugauacuua

SEQ ID NO: 870391 - RNA, 19 nt, Homo sapiens
gcacuuugauggguauucu

SEQ ID NO: 870392 - RNA, 19 nt, Homo sapiens
ggagaagcaagaagaagga

SEQ ID NO: 870393 - RNA, 19 nt, Homo sapiens
guggaaucauugacagaaa

SEQ ID NO: 870394 - RNA, 19 nt, Homo sapiens
ugaaagcggagcugucuga

SEQ ID NO: 870395 - RNA, 19 nt, Homo sapiens
ucucugagccuacaucuuc

SEQ ID NO: 870396 - RNA, 19 nt, Homo sapiens
caaggaguagugaguugua

SEQ ID NO: 870397 - RNA, 19 nt, Homo sapiens
ggaggaccaucggauaaag

SEQ ID NO: 870398 - RNA, 19 nt, Homo sapiens
gagcagaaggccauuacug

SEQ ID NO: 870399 - RNA, 19 nt, Homo sapiens
ucacagcauuauuacugaa

SEQ ID NO: 870400 - RNA, 19 nt, Homo sapiens
ugaaauaccaaaugucaca

SEQ ID NO: 870401 - RNA, 19 nt, Homo sapiens
guacuuacacaaaccuaga

SEQ ID NO: 870402 - RNA, 19 nt, Homo sapiens
gaccuugugugcucagauc

SEQ ID NO: 870403 - RNA, 19 nt, Homo sapiens
ccaagcacgccucuucaaa

SEQ ID NO: 870404 - RNA, 19 nt, Homo sapiens
ggcagucacucacaacaag

SEQ ID NO: 870405 - RNA, 19 nt, Homo sapiens
caauaucaagggccaugua

SEQ ID NO: 870406 - RNA, 19 nt, Homo sapiens
uacacaaaccuagauguua

SEQ ID NO: 870407 - RNA, 19 nt, Homo sapiens
acuaggaccuccaaauaca

SEQ ID NO: 870408 - RNA, 19 nt, Homo sapiens
uuugauggcuggagucaug

SEQ ID NO: 870409 - RNA, 19 nt, Homo sapiens
uuugacaacugggaugaua

SEQ ID NO: 870410 - RNA, 19 nt, Homo sapiens
ucaaacccaugaagaagag

SEQ ID NO: 870411 - RNA, 19 nt, Homo sapiens
ggucagucauaguggagaa

SEQ ID NO: 870412 - RNA, 19 nt, Homo sapiens
ggugggaacacaauaaaca

SEQ ID NO: 870413 - RNA, 19 nt, Homo sapiens
gcaugaacccgucccuugu

SEQ ID NO: 870414 - RNA, 19 nt, Homo sapiens
caccguggcugagguaugu

SEQ ID NO: 870415 - RNA, 19 nt, Homo sapiens
uguagcauauggcugugua

SEQ ID NO: 870416 - RNA, 19 nt, Homo sapiens
uggaaaugaugaaugaauc

SEQ ID NO: 870417 - RNA, 19 nt, Homo sapiens
ucaaagacgaggcaagaau

SEQ ID NO: 870418 - RNA, 19 nt, Homo sapiens
caagaauggcuucaaacug

SEQ ID NO: 870419 - RNA, 19 nt, Homo sapiens
agaggaagcgcagggaaua

SEQ ID NO: 870420 - RNA, 19 nt, Homo sapiens
gagaacuccucaggcucua

SEQ ID NO: 870421 - RNA, 19 nt, Homo sapiens
ggaccaugguuuuaaaugu

SEQ ID NO: 870422 - RNA, 19 nt, Homo sapiens
acuaggcaauucugucauu

SEQ ID NO: 870423 - RNA, 19 nt, Homo sapiens
cauaccagaacgucuagua

SEQ ID NO: 870424 - RNA, 19 nt, Homo sapiens
aaucauaccagaacgucua

SEQ ID NO: 870425 - RNA, 19 nt, Homo sapiens
ucccaguucugucaauuug

SEQ ID NO: 870426 - RNA, 19 nt, Homo sapiens
ucacuccucugcucucuac

SEQ ID NO: 870427 - RNA, 19 nt, Homo sapiens
gaaccagagccggcugaaa

SEQ ID NO: 870428 - RNA, 19 nt, Homo sapiens
gcauauggcuguguaucac

SEQ ID NO: 870429 - RNA, 19 nt, Homo sapiens
gucacagcauuauuacuga

SEQ ID NO: 870430 - RNA, 19 nt, Homo sapiens
aaucaagagccaaggagua

SEQ ID NO: 870431 - RNA, 19 nt, Homo sapiens
cagauauugugauuuacug

SEQ ID NO: 870432 - RNA, 19 nt, Homo sapiens
gcucucuacccacucauuu

SEQ ID NO: 870433 - RNA, 19 nt, Homo sapiens
acagcuuccuggucaauau

SEQ ID NO: 870434 - RNA, 19 nt, Homo sapiens
cccagacccugauaacuuc

SEQ ID NO: 870435 - RNA, 19 nt, Homo sapiens
uggaaucauugacagaaau

SEQ ID NO: 870436 - RNA, 19 nt, Homo sapiens
uuacacaaaccuagauguu

SEQ ID NO: 870437 - RNA, 19 nt, Homo sapiens
ugaaugacacagauauugu

SEQ ID NO: 870438 - RNA, 19 nt, Homo sapiens
ccuccgaaguaucgaaaga

SEQ ID NO: 870439 - RNA, 19 nt, Homo sapiens
guggaggaccaucggauaa

SEQ ID NO: 870440 - RNA, 19 nt, Homo sapiens
gccuacgccugcacuuuga

SEQ ID NO: 870441 - RNA, 19 nt, Homo sapiens
cgauggggauacauucuua

SEQ ID NO: 870442 - RNA, 19 nt, Homo sapiens
gaguauaagccgcugaaca

SEQ ID NO: 870443 - RNA, 19 nt, Homo sapiens
uuaaaucccaguucuguca

SEQ ID NO: 870444 - RNA, 19 nt, Homo sapiens
caacaagaauggcuucaaa

SEQ ID NO: 870445 - RNA, 19 nt, Homo sapiens
ggagaaauaucuggaagaa

SEQ ID NO: 870446 - RNA, 19 nt, Homo sapiens
caacugggaugauacuuau

SEQ ID NO: 870447 - RNA, 19 nt, Homo sapiens
ccagugauagucaauauua

SEQ ID NO: 870448 - RNA, 19 nt, Homo sapiens
gaucuugguuccucuaaug

SEQ ID NO: 870449 - RNA, 19 nt, Homo sapiens
gcaagaauagucagaguga

SEQ ID NO: 870450 - RNA, 19 nt, Homo sapiens
agaaauaucuggaagaaac

SEQ ID NO: 870451 - RNA, 19 nt, Homo sapiens
ggaagaagccucgccauca

SEQ ID NO: 870452 - RNA, 19 nt, Homo sapiens
acacuaggaccuccaaaua

SEQ ID NO: 870453 - RNA, 19 nt, Homo sapiens
gaugaggucuucggcuuug

SEQ ID NO: 870454 - RNA, 19 nt, Homo sapiens
ggaccaagcacgccucuuc

SEQ ID NO: 870455 - RNA, 19 nt, Homo sapiens
gggaugauacuuaugacua

SEQ ID NO: 870456 - RNA, 19 nt, Homo sapiens
gaagaagccucgccaucac

SEQ ID NO: 870457 - RNA, 19 nt, Homo sapiens
gaugauagcaccugucagu

SEQ ID NO: 870458 - RNA, 19 nt, Homo sapiens
ccaaguggaccaucgauga

SEQ ID NO: 870459 - RNA, 19 nt, Homo sapiens
ccagaauccuccagaagau

SEQ ID NO: 870460 - RNA, 19 nt, Homo sapiens
gcgcuccaguuccggauaa

SEQ ID NO: 870461 - RNA, 19 nt, Homo sapiens
guucacagcucaccauugc

SEQ ID NO: 870462 - RNA, 19 nt, Homo sapiens
ggaugauacuuaugacuac

SEQ ID NO: 870463 - RNA, 19 nt, Homo sapiens
ggagacaggaguccauuca

SEQ ID NO: 870464 - RNA, 19 nt, Homo sapiens
gcaccagucccucuucaug

SEQ ID NO: 870465 - RNA, 19 nt, Homo sapiens
aggaaggcgugaccgaaua

SEQ ID NO: 870466 - RNA, 19 nt, Homo sapiens
caacaggugagaagaagga

SEQ ID NO: 870467 - RNA, 19 nt, Homo sapiens
gaagcaagaagaaggaaag

SEQ ID NO: 870468 - RNA, 19 nt, Homo sapiens
acaacugggaugauacuua

SEQ ID NO: 870469 - RNA, 19 nt, Homo sapiens
gcacuuugauggguauucu

SEQ ID NO: 870470 - RNA, 19 nt, Homo sapiens
ggagaagcaagaagaagga

SEQ ID NO: 870471 - RNA, 19 nt, Homo sapiens
ugaaagcggagcugucuga

SEQ ID NO: 870472 - RNA, 19 nt, Homo sapiens
ggaggaccaucggauaaag

SEQ ID NO: 870473 - RNA, 19 nt, Homo sapiens
gagcagaaggccauuacug

SEQ ID NO: 870474 - RNA, 19 nt, Homo sapiens
gaccuugugugcucagauc

SEQ ID NO: 870475 - RNA, 19 nt, Homo sapiens
ccaagcacgccucuucaaa

SEQ ID NO: 870476 - RNA, 19 nt, Homo sapiens
ggcagucacucacaacaag

SEQ ID NO: 870477 - RNA, 19 nt, Homo sapiens
acuaggaccuccaaauaca

SEQ ID NO: 870478 - RNA, 19 nt, Homo sapiens
uuugauggcuggagucaug

SEQ ID NO: 870479 - RNA, 19 nt, Homo sapiens
uuugacaacugggaugaua

SEQ ID NO: 870480 - RNA, 19 nt, Homo sapiens
ucaaacccaugaagaagag

SEQ ID NO: 870481 - RNA, 19 nt, Homo sapiens
ggucagucauaguggagaa

SEQ ID NO: 870482 - RNA, 19 nt, Homo sapiens
gcaugaacccgucccuugu

SEQ ID NO: 870483 - RNA, 19 nt, Homo sapiens
caccguggcugagguaugu

SEQ ID NO: 870484 - RNA, 19 nt, Homo sapiens
caagaauggcuucaaacug

SEQ ID NO: 870485 - RNA, 19 nt, Homo sapiens
agaggaagcgcagggaaua

SEQ ID NO: 870486 - RNA, 19 nt, Homo sapiens
gagaacuccucaggcucua

SEQ ID NO: 870487 - RNA, 19 nt, Homo sapiens
ucacuccucugcucucuac

SEQ ID NO: 870488 - RNA, 19 nt, Homo sapiens
cagcgucacuucugcuaag

SEQ ID NO: 870489 - RNA, 19 nt, Homo sapiens
cagcgucacuucugcuaag

SEQ ID NO: 870490 - RNA, 19 nt, Homo sapiens
gaaccagagccggcugaaa

SEQ ID NO: 870491 - RNA, 19 nt, Homo sapiens
gcucucuacccacucauuu

SEQ ID NO: 870492 - RNA, 19 nt, Homo sapiens
acagcuuccuggucaauau

SEQ ID NO: 870493 - RNA, 19 nt, Homo sapiens
cccagacccugauaacuuc

SEQ ID NO: 870494 - RNA, 19 nt, Homo sapiens
ccuccgaaguaucgaaaga

SEQ ID NO: 870495 - RNA, 19 nt, Homo sapiens
guggaggaccaucggauaa

SEQ ID NO: 870496 - RNA, 19 nt, Homo sapiens
gccuacgccugcacuuuga

SEQ ID NO: 870497 - RNA, 19 nt, Homo sapiens
caagcacgccucuucaaag

SEQ ID NO: 870498 - RNA, 19 nt, Homo sapiens
ggacaacccacugcuagca

SEQ ID NO: 870499 - RNA, 19 nt, Homo sapiens
gaguauaagccgcugaaca

SEQ ID NO: 870500 - RNA, 19 nt, Homo sapiens
uccgaaguaucgaaagauu

SEQ ID NO: 870501 - RNA, 19 nt, Homo sapiens
cccaagcaccuguuuguga

SEQ ID NO: 870502 - RNA, 19 nt, Homo sapiens
caacacccguccauguacu

SEQ ID NO: 870503 - RNA, 19 nt, Homo sapiens
agacaggaguccauucacu

SEQ ID NO: 870504 - RNA, 19 nt, Homo sapiens
cagagugacccauguaucu

SEQ ID NO: 870505 - RNA, 19 nt, Homo sapiens
gagggacaacccacugcua

SEQ ID NO: 870506 - RNA, 19 nt, Homo sapiens
cagaggccauggagaagca

SEQ ID NO: 870507 - RNA, 19 nt, Homo sapiens
caggagcggucagucauag

SEQ ID NO: 870508 - RNA, 19 nt, Homo sapiens
ccaggagcggucagucaua

SEQ ID NO: 870509 - RNA, 19 nt, Homo sapiens
ugccagugauagucaauau

SEQ ID NO: 870510 - RNA, 19 nt, Homo sapiens
uaaggagggacccguguug

SEQ ID NO: 870511 - RNA, 19 nt, Homo sapiens
uaaggagggacccguguug

SEQ ID NO: 870512 - RNA, 19 nt, Homo sapiens
ccucagcccgcaagaagaa

SEQ ID NO: 870513 - RNA, 19 nt, Homo sapiens
gagaaauaucuggaagaaa

SEQ ID NO: 870514 - RNA, 19 nt, Homo sapiens
ggguuuggcugguguagcu

SEQ ID NO: 870515 - RNA, 19 nt, Homo sapiens
gcuaugauuucuggaucga

SEQ ID NO: 870516 - RNA, 19 nt, Homo sapiens
gaggaccaucggauaaaga

SEQ ID NO: 870517 - RNA, 19 nt, Homo sapiens
gggagaaauaucuggaaga

SEQ ID NO: 870518 - RNA, 19 nt, Homo sapiens
gaggagcagaaggccauua

SEQ ID NO: 870519 - RNA, 19 nt, Homo sapiens
ggagcggucagucauagug

SEQ ID NO: 870520 - RNA, 19 nt, Homo sapiens
gggagucgcaauccucaga

SEQ ID NO: 870521 - RNA, 19 nt, Homo sapiens
ccauggagaagcaagaaga

SEQ ID NO: 870522 - RNA, 19 nt, Homo sapiens
ggaauaccagagcccauca

SEQ ID NO: 870523 - RNA, 19 nt, Homo sapiens
ccucaacacccguccaugu

SEQ ID NO: 870524 - RNA, 19 nt, Homo sapiens
caggugagaagaaggaaug

SEQ ID NO: 870525 - RNA, 19 nt, Homo sapiens
gagcuccucaaacccauga

SEQ ID NO: 870526 - RNA, 19 nt, Homo sapiens
gugcagagugggagacaga

SEQ ID NO: 870527 - RNA, 19 nt, Homo sapiens
gugcagagugggagacaga

SEQ ID NO: 870528 - RNA, 19 nt, Homo sapiens
cccagaauccuccagaaga

SEQ ID NO: 870529 - RNA, 19 nt, Homo sapiens
gcucuaccagcgcuucuga

SEQ ID NO: 870530 - RNA, 19 nt, Homo sapiens
gaaguuggaaggcauugac

SEQ ID NO: 870531 - RNA, 19 nt, Homo sapiens
aguauaagccgcugaacau

SEQ ID NO: 870532 - RNA, 19 nt, Homo sapiens
gaaauaucuggaagaaacu

SEQ ID NO: 870533 - RNA, 19 nt, Homo sapiens
gcugcagccucccaaaggu

SEQ ID NO: 870534 - RNA, 19 nt, Homo sapiens
ccauguaucugggaagacu

SEQ ID NO: 870535 - RNA, 19 nt, Homo sapiens
gaccaagcacgccucuuca

SEQ ID NO: 870536 - RNA, 19 nt, Homo sapiens
gugcaccagucccucuuca

SEQ ID NO: 870537 - RNA, 19 nt, Homo sapiens
aaccagagccggcugaaag

SEQ ID NO: 870538 - RNA, 19 nt, Homo sapiens
gcgaguauaagccgcugaa

SEQ ID NO: 870539 - RNA, 19 nt, Homo sapiens
gcagucacucacaacaaga

SEQ ID NO: 870540 - RNA, 19 nt, Homo sapiens
uggcuggagucauggcuau

SEQ ID NO: 870541 - RNA, 19 nt, Homo sapiens
cgccaucacggccgaauug

SEQ ID NO: 870542 - RNA, 19 nt, Homo sapiens
gcugaaagcggagcugucu

SEQ ID NO: 870543 - RNA, 19 nt, Homo sapiens
acccagacccugauaacuu

SEQ ID NO: 870544 - RNA, 19 nt, Homo sapiens
gcagugagcccuaccauua

SEQ ID NO: 870545 - RNA, 19 nt, Homo sapiens
gcacaucacugcugucuug

SEQ ID NO: 870546 - RNA, 19 nt, Homo sapiens
cuaaaugcaucccuucuua

SEQ ID NO: 870547 - RNA, 19 nt, Homo sapiens
gaaaagcccugaagaagaa

SEQ ID NO: 870548 - RNA, 19 nt, Homo sapiens
cgaagaacauuguguccua

SEQ ID NO: 870549 - RNA, 19 nt, Homo sapiens
gaagaacauuguguccuaa

SEQ ID NO: 870550 - RNA, 19 nt, Homo sapiens
ggagugcccucggcugaua

SEQ ID NO: 870551 - RNA, 19 nt, Homo sapiens
ggacagggcaaacuaaaug

SEQ ID NO: 870552 - RNA, 19 nt, Homo sapiens
ugauauagauggaaagaug

SEQ ID NO: 870553 - RNA, 19 nt, Homo sapiens
acuauaagcuucccaauuc

SEQ ID NO: 870554 - RNA, 19 nt, Homo sapiens
ggacgaggaugaagaaugc

SEQ ID NO: 870555 - RNA, 19 nt, Homo sapiens
ucaagaagcugagcaggaa

SEQ ID NO: 870556 - RNA, 19 nt, Homo sapiens
ucacugcugucuugacuaa

SEQ ID NO: 870557 - RNA, 19 nt, Homo sapiens
gcccuccucucucuucuua

SEQ ID NO: 870558 - RNA, 19 nt, Homo sapiens
aagaguggcuuagcuauuu

SEQ ID NO: 870559 - RNA, 19 nt, Homo sapiens
ccaacuuccuggaucauuu

SEQ ID NO: 870560 - RNA, 19 nt, Homo sapiens
gaagaguggcuuagcuauu

SEQ ID NO: 870561 - RNA, 19 nt, Homo sapiens
gaccuaggauaguugauau

SEQ ID NO: 870562 - RNA, 19 nt, Homo sapiens
gcaacccgcuguccugugu

SEQ ID NO: 870563 - RNA, 19 nt, Homo sapiens
gagcacggaugaauaagag

SEQ ID NO: 870564 - RNA, 19 nt, Homo sapiens
gucaauagcuucaucuucu

SEQ ID NO: 870565 - RNA, 19 nt, Homo sapiens
gaccagcugucguuaggaa

SEQ ID NO: 870566 - RNA, 19 nt, Homo sapiens
ucagagaccuaggauaguu

SEQ ID NO: 870567 - RNA, 19 nt, Homo sapiens
aagaauggcugcacaugga

SEQ ID NO: 870568 - RNA, 19 nt, Homo sapiens
gacuauaguucgagaguuc

SEQ ID NO: 870569 - RNA, 19 nt, Homo sapiens
gcuagcaggcagugucuua

SEQ ID NO: 870570 - RNA, 19 nt, Homo sapiens
cagcuugguugcuuucuug

SEQ ID NO: 870571 - RNA, 19 nt, Homo sapiens
ggaaagauggguacguugu

SEQ ID NO: 870572 - RNA, 19 nt, Homo sapiens
gaagaaugcccagcaggaa

SEQ ID NO: 870573 - RNA, 19 nt, Homo sapiens
gauaguugauauagaugga

SEQ ID NO: 870574 - RNA, 19 nt, Homo sapiens
gcucaugcccggaggauug

SEQ ID NO: 870575 - RNA, 19 nt, Homo sapiens
gcuuugacguucccucuga

SEQ ID NO: 870576 - RNA, 19 nt, Homo sapiens
gaugcaggcucgauucagu

SEQ ID NO: 870577 - RNA, 19 nt, Homo sapiens
gccaagggcccaucaguug

SEQ ID NO: 870578 - RNA, 19 nt, Homo sapiens
cagcgucgguucaguguca

SEQ ID NO: 870579 - RNA, 19 nt, Homo sapiens
gaaagaauggcugcacaug

SEQ ID NO: 870580 - RNA, 19 nt, Homo sapiens
gcucagggaucaagaagcu

SEQ ID NO: 870581 - RNA, 19 nt, Homo sapiens
gcagugcaguuggugaaga

SEQ ID NO: 870582 - RNA, 19 nt, Homo sapiens
caacagugcuccaaaaugg

SEQ ID NO: 870583 - RNA, 19 nt, Homo sapiens
gcacuuccagagucaguuu

SEQ ID NO: 870584 - RNA, 19 nt, Homo sapiens
agaguggcuuagcuauuua

SEQ ID NO: 870585 - RNA, 19 nt, Homo sapiens
gcacggcucaugugugugu

SEQ ID NO: 870586 - RNA, 19 nt, Homo sapiens
gcagguuguuugagcuguu

SEQ ID NO: 870587 - RNA, 19 nt, Homo sapiens
uauccagccuuucaacaga

SEQ ID NO: 870588 - RNA, 19 nt, Homo sapiens
gaagagaacauagcaagac

SEQ ID NO: 870589 - RNA, 19 nt, Homo sapiens
cagcaccuccugcacuaua

SEQ ID NO: 870590 - RNA, 19 nt, Homo sapiens
gcacuggcacugcaugugu

SEQ ID NO: 870591 - RNA, 19 nt, Homo sapiens
ucacugcccuccucucucu

SEQ ID NO: 870592 - RNA, 19 nt, Homo sapiens
ggccagggcgguuaccuuu

SEQ ID NO: 870593 - RNA, 19 nt, Homo sapiens
ggaaaagcccugaagaaga

SEQ ID NO: 870594 - RNA, 19 nt, Homo sapiens
gacagcaccuucucuuggu

SEQ ID NO: 870595 - RNA, 19 nt, Homo sapiens
gggauguggugauguugga

SEQ ID NO: 870596 - RNA, 19 nt, Homo sapiens
cugugucccuggaguguua

SEQ ID NO: 870597 - RNA, 19 nt, Homo sapiens
ggagcacggaugaauaaga

SEQ ID NO: 870598 - RNA, 19 nt, Homo sapiens
gggcugaggcauaugaaug

SEQ ID NO: 870599 - RNA, 19 nt, Homo sapiens
augcaucccuucuuaccua

SEQ ID NO: 870600 - RNA, 19 nt, Homo sapiens
uggcacggcucaugugugu

SEQ ID NO: 870601 - RNA, 19 nt, Homo sapiens
ccagggcgguuaccuuuac

SEQ ID NO: 870602 - RNA, 19 nt, Homo sapiens
gcaggaagcccagacuauc

SEQ ID NO: 870603 - RNA, 19 nt, Homo sapiens
gagcaggaagcccagacua

SEQ ID NO: 870604 - RNA, 19 nt, Homo sapiens
uaugaaugcuauaguugug

SEQ ID NO: 870605 - RNA, 19 nt, Homo sapiens
ugaccucuaugccaacuuc

SEQ ID NO: 870606 - RNA, 19 nt, Homo sapiens
ucccuggccugacgucuuu

SEQ ID NO: 870607 - RNA, 19 nt, Homo sapiens
ggcuguggcucaugucaau

SEQ ID NO: 870608 - RNA, 19 nt, Homo sapiens
acacagugccuccugaaga

SEQ ID NO: 870609 - RNA, 19 nt, Homo sapiens
cugcuaaugucaccaagga

SEQ ID NO: 870610 - RNA, 19 nt, Homo sapiens
caacaucugguaagagaag

SEQ ID NO: 870611 - RNA, 19 nt, Homo sapiens
agcaacaucugguaagaga

SEQ ID NO: 870612 - RNA, 19 nt, Homo sapiens
gugaagaguggcuuagcua

SEQ ID NO: 870613 - RNA, 19 nt, Homo sapiens
gaugaggacccagaagaga

SEQ ID NO: 870614 - RNA, 19 nt, Homo sapiens
ccuccucucucuucuuaau

SEQ ID NO: 870615 - RNA, 19 nt, Homo sapiens
ggaugcugguuuccucuuc

SEQ ID NO: 870616 - RNA, 19 nt, Homo sapiens
ggaaggggcucagggauca

SEQ ID NO: 870617 - RNA, 19 nt, Homo sapiens
ucagcaacaucugguaaga

SEQ ID NO: 870618 - RNA, 19 nt, Homo sapiens
cauaugaaugcuauaguug

SEQ ID NO: 870619 - RNA, 19 nt, Homo sapiens
agacacugcuggagagagu

SEQ ID NO: 870620 - RNA, 19 nt, Homo sapiens
caucuuugcccaggaaauu

SEQ ID NO: 870621 - RNA, 19 nt, Homo sapiens
ggucugugcugggagugaa

SEQ ID NO: 870622 - RNA, 19 nt, Homo sapiens
gaaagauggguacguuguc

SEQ ID NO: 870623 - RNA, 19 nt, Homo sapiens
acugcuaccugacucauug

SEQ ID NO: 870624 - RNA, 19 nt, Homo sapiens
cagugcaguuggugaagaa

SEQ ID NO: 870625 - RNA, 19 nt, Homo sapiens
gcaaggaggauagcugaag

SEQ ID NO: 870626 - RNA, 19 nt, Homo sapiens
gcccagugguguugcuuuc

SEQ ID NO: 870627 - RNA, 19 nt, Homo sapiens
cuaggauaguugauauaga

SEQ ID NO: 870628 - RNA, 19 nt, Homo sapiens
gcugcccucuaucauggua

SEQ ID NO: 870629 - RNA, 19 nt, Homo sapiens
gaccuggcccgacaugaug

SEQ ID NO: 870630 - RNA, 19 nt, Homo sapiens
caggcucgauucagucuuc

SEQ ID NO: 870631 - RNA, 19 nt, Homo sapiens
caucacugcugucuugacu

SEQ ID NO: 870632 - RNA, 19 nt, Homo sapiens
gcuauuuacccgcucuuug

SEQ ID NO: 870633 - RNA, 19 nt, Homo sapiens
agaccuaggauaguugaua

SEQ ID NO: 870634 - RNA, 19 nt, Homo sapiens
gaauuacuuccuccagugu

SEQ ID NO: 870635 - RNA, 19 nt, Homo sapiens
ggcuguggcugccuccuau

SEQ ID NO: 870636 - RNA, 19 nt, Homo sapiens
aagcaucuuugcccaggaa

SEQ ID NO: 870637 - RNA, 19 nt, Homo sapiens
gcuauaguugugcauuaaa

SEQ ID NO: 870638 - RNA, 19 nt, Homo sapiens
gggagugaagaguggcuua

SEQ ID NO: 870639 - RNA, 19 nt, Homo sapiens
cagguuguuugagcuguuu

SEQ ID NO: 870640 - RNA, 19 nt, Homo sapiens
cuggagcacggaugaauaa

SEQ ID NO: 870641 - RNA, 19 nt, Homo sapiens
cacccaugcugcccucuau

SEQ ID NO: 870642 - RNA, 19 nt, Homo sapiens
gcuccagccucuuguugag

SEQ ID NO: 870643 - RNA, 19 nt, Homo sapiens
cuugguugcuuucuugaga

SEQ ID NO: 870644 - RNA, 19 nt, Homo sapiens
gaucaaaccacauauguua

SEQ ID NO: 870645 - RNA, 19 nt, Homo sapiens
ggacacaccuugcuccuuu

SEQ ID NO: 870646 - RNA, 19 nt, Homo sapiens
agacaaggcugcagucaaa

SEQ ID NO: 870647 - RNA, 19 nt, Homo sapiens
ggaagccacuugcaacuau

SEQ ID NO: 870648 - RNA, 19 nt, Homo sapiens
ugacguagauauugaaaga

SEQ ID NO: 870649 - RNA, 19 nt, Homo sapiens
ggacaaagacaaagcgaaa

SEQ ID NO: 870650 - RNA, 19 nt, Homo sapiens
uggaaaggauccuaaagaa

SEQ ID NO: 870651 - RNA, 19 nt, Homo sapiens
cuagcagccucuuguauuu

SEQ ID NO: 870652 - RNA, 19 nt, Homo sapiens
uaacggaacagccaccuaa

SEQ ID NO: 870653 - RNA, 19 nt, Homo sapiens
aaaguaagaucguccuugu

SEQ ID NO: 870654 - RNA, 19 nt, Homo sapiens
gguauauucuggaaacaug

SEQ ID NO: 870655 - RNA, 19 nt, Homo sapiens
gaagcuguguacccucauu

SEQ ID NO: 870656 - RNA, 19 nt, Homo sapiens
ucacagcauucuuugaaau

SEQ ID NO: 870657 - RNA, 19 nt, Homo sapiens
aaagucagcuggacgaagu

SEQ ID NO: 870658 - RNA, 19 nt, Homo sapiens
caaaccacauauguuauug

SEQ ID NO: 870659 - RNA, 19 nt, Homo sapiens
caucacagcauucuuugaa

SEQ ID NO: 870660 - RNA, 19 nt, Homo sapiens
gcaaaagucaguuauugua

SEQ ID NO: 870661 - RNA, 19 nt, Homo sapiens
uacagaagauacacccuuu

SEQ ID NO: 870662 - RNA, 19 nt, Homo sapiens
cuaaguuuauccagaggua

SEQ ID NO: 870663 - RNA, 19 nt, Homo sapiens
caaauggaaaggauccuaa

SEQ ID NO: 870664 - RNA, 19 nt, Homo sapiens
gagaagcggcaaauggaaa

SEQ ID NO: 870665 - RNA, 19 nt, Homo sapiens
ugaccaagcggaagaagaa

SEQ ID NO: 870666 - RNA, 19 nt, Homo sapiens
acaccuugcuccuuucuga

SEQ ID NO: 870667 - RNA, 19 nt, Homo sapiens
aaagaaggacaaagacaaa

SEQ ID NO: 870668 - RNA, 19 nt, Homo sapiens
gaauaaugaaggcagaaga

SEQ ID NO: 870669 - RNA, 19 nt, Homo sapiens
ccucuuguauuuacucaga

SEQ ID NO: 870670 - RNA, 19 nt, Homo sapiens
agacacagccugccucuca

SEQ ID NO: 870671 - RNA, 19 nt, Homo sapiens
gaagccacuugcaacuaug

SEQ ID NO: 870672 - RNA, 19 nt, Homo sapiens
gguuguguguguuuccuuu

SEQ ID NO: 870673 - RNA, 19 nt, Homo sapiens
ggaaacauggcuacacaca

SEQ ID NO: 870674 - RNA, 19 nt, Homo sapiens
ggaaaggauccuaaagaag

SEQ ID NO: 870675 - RNA, 19 nt, Homo sapiens
caacuaugcggccuucaga

SEQ ID NO: 870676 - RNA, 19 nt, Homo sapiens
ucacccgaguugcauguaa

SEQ ID NO: 870677 - RNA, 19 nt, Homo sapiens
cgaaacuccuggaagcaau

SEQ ID NO: 870678 - RNA, 19 nt, Homo sapiens
gcaaauggaaaggauccua

SEQ ID NO: 870679 - RNA, 19 nt, Homo sapiens
gaucguccuuguacucagu

SEQ ID NO: 870680 - RNA, 19 nt, Homo sapiens
ggagaagcggcaaauggaa

SEQ ID NO: 870681 - RNA, 19 nt, Homo sapiens
gugugucugugucauguaa

SEQ ID NO: 870682 - RNA, 19 nt, Homo sapiens
gagguaaagcccauugugu

SEQ ID NO: 870683 - RNA, 19 nt, Homo sapiens
ucguuuggauggaaaguuu

SEQ ID NO: 870684 - RNA, 19 nt, Homo sapiens
ggagugaccaagcggaaga

SEQ ID NO: 870685 - RNA, 19 nt, Homo sapiens
ggaucaaaccacauauguu

SEQ ID NO: 870686 - RNA, 19 nt, Homo sapiens
ggagggcugggaucuugua

SEQ ID NO: 870687 - RNA, 19 nt, Homo sapiens
gguaaagcccauugugugu

SEQ ID NO: 870688 - RNA, 19 nt, Homo sapiens
aacgauuucuguugacgua

SEQ ID NO: 870689 - RNA, 19 nt, Homo sapiens
gcugucuucuccuggauga

SEQ ID NO: 870690 - RNA, 19 nt, Homo sapiens
aaugaaggcagaagagaaa

SEQ ID NO: 870691 - RNA, 19 nt, Homo sapiens
ccuagcagccucuuguauu

SEQ ID NO: 870692 - RNA, 19 nt, Homo sapiens
gacagacuccagaggguaa

SEQ ID NO: 870693 - RNA, 19 nt, Homo sapiens
uaaagcccauugugugucu

SEQ ID NO: 870694 - RNA, 19 nt, Homo sapiens
caacagacaccuggacaca

SEQ ID NO: 870695 - RNA, 19 nt, Homo sapiens
gcauuacgacauucccaaa

SEQ ID NO: 870696 - RNA, 19 nt, Homo sapiens
uaaugaaggcagaagagaa

SEQ ID NO: 870697 - RNA, 19 nt, Homo sapiens
cauauguuauugggagaaa

SEQ ID NO: 870698 - RNA, 19 nt, Homo sapiens
guuuggcauuccuaccuua

SEQ ID NO: 870699 - RNA, 19 nt, Homo sapiens
gguuguccuguguaaauua

SEQ ID NO: 870700 - RNA, 19 nt, Homo sapiens
ggguuguccuguguaaauu

SEQ ID NO: 870701 - RNA, 19 nt, Homo sapiens
aaaacgaaguguggaauuu

SEQ ID NO: 870702 - RNA, 19 nt, Homo sapiens
cgauuucuguugacguaga

SEQ ID NO: 870703 - RNA, 19 nt, Homo sapiens
gaggaucaaaccacauaug

SEQ ID NO: 870704 - RNA, 19 nt, Homo sapiens
guugacacaucacacagau

SEQ ID NO: 870705 - RNA, 19 nt, Homo sapiens
gggaagccacuugcaacua

SEQ ID NO: 870706 - RNA, 19 nt, Homo sapiens
gauacacccuuuucguuug

SEQ ID NO: 870707 - RNA, 19 nt, Homo sapiens
uagcagccucuuguauuua

SEQ ID NO: 870708 - RNA, 19 nt, Homo sapiens
cacacacccuugcaucuuc

SEQ ID NO: 870709 - RNA, 19 nt, Homo sapiens
cacggagcauuacgacauu

SEQ ID NO: 870710 - RNA, 19 nt, Homo sapiens
ucacggagcauuacgacau

SEQ ID NO: 870711 - RNA, 19 nt, Homo sapiens
acacacucacggagcauua

SEQ ID NO: 870712 - RNA, 19 nt, Homo sapiens
gcagagaguggaggacuuc

SEQ ID NO: 870713 - RNA, 19 nt, Homo sapiens
gaaacuccuggaagcaaug

SEQ ID NO: 870714 - RNA, 19 nt, Homo sapiens
gacacagccugccucucaa

SEQ ID NO: 870715 - RNA, 19 nt, Homo sapiens
ugaaauggaaccagacaca

SEQ ID NO: 870716 - RNA, 19 nt, Homo sapiens
aaacgaaguguggaauuug

SEQ ID NO: 870717 - RNA, 19 nt, Homo sapiens
acagacaccuggacacacu

SEQ ID NO: 870718 - RNA, 19 nt, Homo sapiens
cugaggaucaaaccacaua

SEQ ID NO: 870719 - RNA, 19 nt, Homo sapiens
agacgcugcuaaugcauca

SEQ ID NO: 870720 - RNA, 19 nt, Homo sapiens
guacucaguuuaggcuucu

SEQ ID NO: 870721 - RNA, 19 nt, Homo sapiens
gcgaaacuccuggaagcaa

SEQ ID NO: 870722 - RNA, 19 nt, Homo sapiens
aagcaaaagucaguuauug

SEQ ID NO: 870723 - RNA, 19 nt, Homo sapiens
guuauugggagaaacgauu

SEQ ID NO: 870724 - RNA, 19 nt, Homo sapiens
gcuccuagcagccucuugu

SEQ ID NO: 870725 - RNA, 19 nt, Homo sapiens
gacagcauagccuggguaa

SEQ ID NO: 870726 - RNA, 19 nt, Homo sapiens
uaugcggccuucagacuuc

SEQ ID NO: 870727 - RNA, 19 nt, Homo sapiens
gcaacauacagaagauaca

SEQ ID NO: 870728 - RNA, 19 nt, Homo sapiens
gcaaugggaacgagcaaaa

SEQ ID NO: 870729 - RNA, 19 nt, Homo sapiens
cuggaaacauggcuacaca

SEQ ID NO: 870730 - RNA, 19 nt, Homo sapiens
guguguguuuccuuuggua

SEQ ID NO: 870731 - RNA, 19 nt, Homo sapiens
caggagaagcggcaaaugg

SEQ ID NO: 870732 - RNA, 19 nt, Homo sapiens
uuggagggcugggaucuug

SEQ ID NO: 870733 - RNA, 19 nt, Homo sapiens
caaagcgaaacuccuggaa

SEQ ID NO: 870734 - RNA, 19 nt, Homo sapiens
uaagaucguccuuguacuc

SEQ ID NO: 870735 - RNA, 19 nt, Homo sapiens
cagcauagccuggguaacg

SEQ ID NO: 870736 - RNA, 19 nt, Homo sapiens
caugguggccugcaguaug

SEQ ID NO: 870737 - RNA, 19 nt, Homo sapiens
uguguuuccuuugguauau

SEQ ID NO: 870738 - RNA, 19 nt, Homo sapiens
aaauggaaaggauccuaaa

SEQ ID NO: 870739 - RNA, 19 nt, Homo sapiens
cacccgaguugcauguaau

SEQ ID NO: 870740 - RNA, 19 nt, Homo sapiens
guaagaucguccuuguacu

SEQ ID NO: 870741 - RNA, 19 nt, Homo sapiens
uuacgacauucccaaaguc

SEQ ID NO: 870742 - RNA, 19 nt, Homo sapiens
uggaggacuucaacagaca

SEQ ID NO: 870743 - RNA, 19 nt, Homo sapiens
gcaucacagcauucuuuga

SEQ ID NO: 870744 - RNA, 19 nt, Homo sapiens
gaaacaagaucaagucugu

SEQ ID NO: 870745 - RNA, 19 nt, Homo sapiens
gaaguguaccucaauaaua

SEQ ID NO: 870746 - RNA, 19 nt, Homo sapiens
gaagggaguuacugagaaa

SEQ ID NO: 870747 - RNA, 19 nt, Homo sapiens
ggaaggccuuggauuuaua

SEQ ID NO: 870748 - RNA, 19 nt, Homo sapiens
gaacaggauucggcugaua

SEQ ID NO: 870749 - RNA, 19 nt, Homo sapiens
ucagguugcuguuuaauuu

SEQ ID NO: 870750 - RNA, 19 nt, Homo sapiens
ggaagaagagugaagagua

SEQ ID NO: 870751 - RNA, 19 nt, Homo sapiens
gaagaagagugaagaguac

SEQ ID NO: 870752 - RNA, 19 nt, Homo sapiens
gguaaaggcugcugguguu

SEQ ID NO: 870753 - RNA, 19 nt, Homo sapiens
ggaaagcgauugagaaagc

SEQ ID NO: 870754 - RNA, 19 nt, Homo sapiens
guaggcaucuucaccauug

SEQ ID NO: 870755 - RNA, 19 nt, Homo sapiens
gccagaagcugcaugaguu

SEQ ID NO: 870756 - RNA, 19 nt, Homo sapiens
gaucugaguuugaacaaca

SEQ ID NO: 870757 - RNA, 19 nt, Homo sapiens
gaagaaagacaaugaaguc

SEQ ID NO: 870758 - RNA, 19 nt, Homo sapiens
gcauugaagugucuuuaau

SEQ ID NO: 870759 - RNA, 19 nt, Homo sapiens
cguaucagguugcuguuua

SEQ ID NO: 870760 - RNA, 19 nt, Homo sapiens
acaccgaaguggacuguua

SEQ ID NO: 870761 - RNA, 19 nt, Homo sapiens
gauggaaggccuuggauuu

SEQ ID NO: 870762 - RNA, 19 nt, Homo sapiens
caagcuaccucucuucuca

SEQ ID NO: 870763 - RNA, 19 nt, Homo sapiens
ggauuuauauugcacuuca

SEQ ID NO: 870764 - RNA, 19 nt, Homo sapiens
aaauaguucuggugccuua

SEQ ID NO: 870765 - RNA, 19 nt, Homo sapiens
uuucagggcuaccuuauuu

SEQ ID NO: 870766 - RNA, 19 nt, Homo sapiens
ucacaggacuuggaucuga

SEQ ID NO: 870767 - RNA, 19 nt, Homo sapiens
ugugaaagagggaguauua

SEQ ID NO: 870768 - RNA, 19 nt, Homo sapiens
gguaagcacauuuagaauu

SEQ ID NO: 870769 - RNA, 19 nt, Homo sapiens
ucagaucuguccaguuuga

SEQ ID NO: 870770 - RNA, 19 nt, Homo sapiens
acgcauggcuggaauuuau

SEQ ID NO: 870771 - RNA, 19 nt, Homo sapiens
caccagauguuccaagcua

SEQ ID NO: 870772 - RNA, 19 nt, Homo sapiens
uuaaagagcuccauaucag

SEQ ID NO: 870773 - RNA, 19 nt, Homo sapiens
gaaacaacaucagcaaacu

SEQ ID NO: 870774 - RNA, 19 nt, Homo sapiens
ccacacggaccgccuauaa

SEQ ID NO: 870775 - RNA, 19 nt, Homo sapiens
aaaccugaguuacaacaaa

SEQ ID NO: 870776 - RNA, 19 nt, Homo sapiens
caggaaguguaccucaaua

SEQ ID NO: 870777 - RNA, 19 nt, Homo sapiens
caaaaggucagaacaguua

SEQ ID NO: 870778 - RNA, 19 nt, Homo sapiens
ucacucaucuguacauagu

SEQ ID NO: 870779 - RNA, 19 nt, Homo sapiens
ugacacaacuggaccucaa

SEQ ID NO: 870780 - RNA, 19 nt, Homo sapiens
guagcuaaccaucuuauga

SEQ ID NO: 870781 - RNA, 19 nt, Homo sapiens
ggacagaaaggaggaaguu

SEQ ID NO: 870782 - RNA, 19 nt, Homo sapiens
gaaugaggguuguuaaucc

SEQ ID NO: 870783 - RNA, 19 nt, Homo sapiens
cgaggaagcuuggguucaa

SEQ ID NO: 870784 - RNA, 19 nt, Homo sapiens
ugaagugucuaacaaaugg

SEQ ID NO: 870785 - RNA, 19 nt, Homo sapiens
ugaagggaguuacugagaa

SEQ ID NO: 870786 - RNA, 19 nt, Homo sapiens
gcugacggcugugaagaaa

SEQ ID NO: 870787 - RNA, 19 nt, Homo sapiens
cgauauaccugugagaugu

SEQ ID NO: 870788 - RNA, 19 nt, Homo sapiens
gcaaggacauccgguuuac

SEQ ID NO: 870789 - RNA, 19 nt, Homo sapiens
ggaaguguaccucaauaau

SEQ ID NO: 870790 - RNA, 19 nt, Homo sapiens
gugaauggcuuuuccuuuu

SEQ ID NO: 870791 - RNA, 19 nt, Homo sapiens
uaccucaguucuugucaua

SEQ ID NO: 870792 - RNA, 19 nt, Homo sapiens
cagccugcaucuucauuaa

SEQ ID NO: 870793 - RNA, 19 nt, Homo sapiens
guaucagguugcuguuuaa

SEQ ID NO: 870794 - RNA, 19 nt, Homo sapiens
ucuuggaucuggaccauaa

SEQ ID NO: 870795 - RNA, 19 nt, Homo sapiens
uguaagagcauucaagcua

SEQ ID NO: 870796 - RNA, 19 nt, Homo sapiens
guuaauccaucacaagcaa

SEQ ID NO: 870797 - RNA, 19 nt, Homo sapiens
ggacaccugggccacauaa

SEQ ID NO: 870798 - RNA, 19 nt, Homo sapiens
acaaugaaguccugaccaa

SEQ ID NO: 870799 - RNA, 19 nt, Homo sapiens
ggaagaaagacaaugaagu

SEQ ID NO: 870800 - RNA, 19 nt, Homo sapiens
gaucaagucuguggcuaag

SEQ ID NO: 870801 - RNA, 19 nt, Homo sapiens
aaauguggccuucucagua

SEQ ID NO: 870802 - RNA, 19 nt, Homo sapiens
aaucuuuagugcaugguua

SEQ ID NO: 870803 - RNA, 19 nt, Homo sapiens
caagagcauucuccacauc

SEQ ID NO: 870804 - RNA, 19 nt, Homo sapiens
ggaagaccgugugguaucu

SEQ ID NO: 870805 - RNA, 19 nt, Homo sapiens
ggcaaggacauccgguuua

SEQ ID NO: 870806 - RNA, 19 nt, Homo sapiens
guacuugcuuguuuccaau

SEQ ID NO: 870807 - RNA, 19 nt, Homo sapiens
caaaagguaagcacauuua

SEQ ID NO: 870808 - RNA, 19 nt, Homo sapiens
ugagagcaauggugugugu

SEQ ID NO: 870809 - RNA, 19 nt, Homo sapiens
gagcgacgcaugcauguca

SEQ ID NO: 870810 - RNA, 19 nt, Homo sapiens
guggaaagcgauugagaaa

SEQ ID NO: 870811 - RNA, 19 nt, Homo sapiens
gaucaucacccagccagaa

SEQ ID NO: 870812 - RNA, 19 nt, Homo sapiens
cgagauuucgggcacaaua

SEQ ID NO: 870813 - RNA, 19 nt, Homo sapiens
gaccuggguucuggguaua

SEQ ID NO: 870814 - RNA, 19 nt, Homo sapiens
gcuaccuuauuucuacuaa

SEQ ID NO: 870815 - RNA, 19 nt, Homo sapiens
aagguaagcacauuuagaa

SEQ ID NO: 870816 - RNA, 19 nt, Homo sapiens
guagaaugaggguuguuaa

SEQ ID NO: 870817 - RNA, 19 nt, Homo sapiens
gcuacagccugcaucuuca

SEQ ID NO: 870818 - RNA, 19 nt, Homo sapiens
gccuaaaccugaguuacaa

SEQ ID NO: 870819 - RNA, 19 nt, Homo sapiens
ggagugaccaagagcauuc

SEQ ID NO: 870820 - RNA, 19 nt, Homo sapiens
ugaccuggguucuggguau

SEQ ID NO: 870821 - RNA, 19 nt, Homo sapiens
aauguggccuucucaguau

SEQ ID NO: 870822 - RNA, 19 nt, Homo sapiens
ugaauggcuuuuccuuuua

SEQ ID NO: 870823 - RNA, 19 nt, Homo sapiens
gggcaaggacauccgguuu

SEQ ID NO: 870824 - RNA, 19 nt, Homo sapiens
guacaacagccugguagaa

SEQ ID NO: 870825 - RNA, 19 nt, Homo sapiens
ggaguacaacagccuggua

SEQ ID NO: 870826 - RNA, 19 nt, Homo sapiens
ugaacaacaucacggaagu

SEQ ID NO: 870827 - RNA, 19 nt, Homo sapiens
caucacaugucgucucucu

SEQ ID NO: 870828 - RNA, 19 nt, Homo sapiens
gcacugcucauguguggau

SEQ ID NO: 870829 - RNA, 19 nt, Homo sapiens
uggaaggccuuggauuuau

SEQ ID NO: 870830 - RNA, 19 nt, Homo sapiens
ccgguucuauuucagcuaa

SEQ ID NO: 870831 - RNA, 19 nt, Homo sapiens
uuagaaguguuagaucuga

SEQ ID NO: 870832 - RNA, 19 nt, Homo sapiens
ggccuaccuuuccuuagaa

SEQ ID NO: 870833 - RNA, 19 nt, Homo sapiens
ucuguaaggcguagaauga

SEQ ID NO: 870834 - RNA, 19 nt, Homo sapiens
uagaaucuguccgucugua

SEQ ID NO: 870835 - RNA, 19 nt, Homo sapiens
gaaggccuuggauuuauau

SEQ ID NO: 870836 - RNA, 19 nt, Homo sapiens
ccaguaaccacgauagaau

SEQ ID NO: 870837 - RNA, 19 nt, Homo sapiens
ccugggcgcugcuucauca

SEQ ID NO: 870838 - RNA, 19 nt, Homo sapiens
gguauaauuugcacuuuug

SEQ ID NO: 870839 - RNA, 19 nt, Homo sapiens
ccaagagcauucuccacau

SEQ ID NO: 870840 - RNA, 19 nt, Homo sapiens
ucaagucuguggcuaagag

SEQ ID NO: 870841 - RNA, 19 nt, Homo sapiens
ucacccagcuuccuguaag

SEQ ID NO: 870842 - RNA, 19 nt, Homo sapiens
ggccuuggauuuauauugc

SEQ ID NO: 870843 - RNA, 19 nt, Homo sapiens
uaacgcauggcuggaauuu

SEQ ID NO: 870844 - RNA, 19 nt, Homo sapiens
gaaaugaacuugagcuuua

SEQ ID NO: 870845 - RNA, 19 nt, Homo sapiens
caacaaagaugauaccaaa

SEQ ID NO: 870846 - RNA, 19 nt, Homo sapiens
gaaaugagaugguucacuu

SEQ ID NO: 870847 - RNA, 19 nt, Homo sapiens
gcagagaaguuuaauuuga

SEQ ID NO: 870848 - RNA, 19 nt, Homo sapiens
gaagagaggaugagaauga

SEQ ID NO: 870849 - RNA, 19 nt, Homo sapiens
gcauguaccuuguguagaa

SEQ ID NO: 870850 - RNA, 19 nt, Homo sapiens
ggaacgagaauucuuaaua

SEQ ID NO: 870851 - RNA, 19 nt, Homo sapiens
ggaacgacaucauuuaaga

SEQ ID NO: 870852 - RNA, 19 nt, Homo sapiens
gaaaggaacuucguagcaa

SEQ ID NO: 870853 - RNA, 19 nt, Homo sapiens
gaacgaaggacaacaagaa

SEQ ID NO: 870854 - RNA, 19 nt, Homo sapiens
gaauauguccggaaacuuu

SEQ ID NO: 870855 - RNA, 19 nt, Homo sapiens
ugacagagguuccaguaaa

SEQ ID NO: 870856 - RNA, 19 nt, Homo sapiens
ggaaaucucgcgaggguua

SEQ ID NO: 870857 - RNA, 19 nt, Homo sapiens
gaauacagauuaccuuaca

SEQ ID NO: 870858 - RNA, 19 nt, Homo sapiens
gaagaacaaucuggaaaug

SEQ ID NO: 870859 - RNA, 19 nt, Homo sapiens
gaagugaaagacuauguua

SEQ ID NO: 870860 - RNA, 19 nt, Homo sapiens
gaauaaagaguccaacaaa

SEQ ID NO: 870861 - RNA, 19 nt, Homo sapiens
gaccauccauuuccuauug

SEQ ID NO: 870862 - RNA, 19 nt, Homo sapiens
ggagacauguggacgguuu

SEQ ID NO: 870863 - RNA, 19 nt, Homo sapiens
cauaguagaugcuuuccua

SEQ ID NO: 870864 - RNA, 19 nt, Homo sapiens
ggcaaauucucaauccuua

SEQ ID NO: 870865 - RNA, 19 nt, Homo sapiens
cagauuaccuuacagauuc

SEQ ID NO: 870866 - RNA, 19 nt, Homo sapiens
caagauugguugcuacauu

SEQ ID NO: 870867 - RNA, 19 nt, Homo sapiens
gaacaugggccuggaauug

SEQ ID NO: 870868 - RNA, 19 nt, Homo sapiens
caacagcccuuccagaauc

SEQ ID NO: 870869 - RNA, 19 nt, Homo sapiens
gauaauuaguccagagaaa

SEQ ID NO: 870870 - RNA, 19 nt, Homo sapiens
gagaauggcagucaagaaa

SEQ ID NO: 870871 - RNA, 19 nt, Homo sapiens
ugaagaggaugaagaagaa

SEQ ID NO: 870872 - RNA, 19 nt, Homo sapiens
gaagauauucgauuaggaa

SEQ ID NO: 870873 - RNA, 19 nt, Homo sapiens
aaagaaacaucaagaggaa

SEQ ID NO: 870874 - RNA, 19 nt, Homo sapiens
gaauggcagucaagaaaug

SEQ ID NO: 870875 - RNA, 19 nt, Homo sapiens
gcacuauucuggacacaug

SEQ ID NO: 870876 - RNA, 19 nt, Homo sapiens
gagaauacagauuaccuua

SEQ ID NO: 870877 - RNA, 19 nt, Homo sapiens
gaagaggaggguucugaua

SEQ ID NO: 870878 - RNA, 19 nt, Homo sapiens
gagcaucuuuucagaauua

SEQ ID NO: 870879 - RNA, 19 nt, Homo sapiens
gaacuugagcuuuaaacuu

SEQ ID NO: 870880 - RNA, 19 nt, Homo sapiens
aaggaucucucuaagguua

SEQ ID NO: 870881 - RNA, 19 nt, Homo sapiens
gaagauagacauaaacagu

SEQ ID NO: 870882 - RNA, 19 nt, Homo sapiens
cagcaggcguaguauauuu

SEQ ID NO: 870883 - RNA, 19 nt, Homo sapiens
gcaggaaaaucuucuagua

SEQ ID NO: 870884 - RNA, 19 nt, Homo sapiens
gaaacggguugugauggua

SEQ ID NO: 870885 - RNA, 19 nt, Homo sapiens
uagauuacaugaucaguga

SEQ ID NO: 870886 - RNA, 19 nt, Homo sapiens
ggaaucagcuguuauuuuc

SEQ ID NO: 870887 - RNA, 19 nt, Homo sapiens
gcaacgaaguggugaaucu

SEQ ID NO: 870888 - RNA, 19 nt, Homo sapiens
uaaaugagccagaagaaga

SEQ ID NO: 870889 - RNA, 19 nt, Homo sapiens
agaagagacuggaagauga

SEQ ID NO: 870890 - RNA, 19 nt, Homo sapiens
gaaaugaggguccuuaguc

SEQ ID NO: 870891 - RNA, 19 nt, Homo sapiens
uaauucagauggcuuagaa

SEQ ID NO: 870892 - RNA, 19 nt, Homo sapiens
gcaagaacaagaagauuau

SEQ ID NO: 870893 - RNA, 19 nt, Homo sapiens
ggcaagaacaagaagauua

SEQ ID NO: 870894 - RNA, 19 nt, Homo sapiens
gauuaggaauggagguuaa

SEQ ID NO: 870895 - RNA, 19 nt, Homo sapiens
gagcaaaugaugagaaaga

SEQ ID NO: 870896 - RNA, 19 nt, Homo sapiens
caaaguauggaaacaagua

SEQ ID NO: 870897 - RNA, 19 nt, Homo sapiens
agaacaaucuggaaaugaa

SEQ ID NO: 870898 - RNA, 19 nt, Homo sapiens
ggacacauguggccaguac

SEQ ID NO: 870899 - RNA, 19 nt, Homo sapiens
guacaaggaucucucuaag

SEQ ID NO: 870900 - RNA, 19 nt, Homo sapiens
ugauauugcuggacuugua

SEQ ID NO: 870901 - RNA, 19 nt, Homo sapiens
gaauuuguuucaagaggaa

SEQ ID NO: 870902 - RNA, 19 nt, Homo sapiens
gaagaaacggguugugaug

SEQ ID NO: 870903 - RNA, 19 nt, Homo sapiens
gauggaguguuagaagaua

SEQ ID NO: 870904 - RNA, 19 nt, Homo sapiens
ugaugacaccuuagaauua

SEQ ID NO: 870905 - RNA, 19 nt, Homo sapiens
aaacuuacaugcaggacaa

SEQ ID NO: 870906 - RNA, 19 nt, Homo sapiens
gaacaagaagagaggauga

SEQ ID NO: 870907 - RNA, 19 nt, Homo sapiens
gaacugcuaagaccaaaga

SEQ ID NO: 870908 - RNA, 19 nt, Homo sapiens
ccugauggcucuccaaguu

SEQ ID NO: 870909 - RNA, 19 nt, Homo sapiens
gaaaugcugcccaaucuuc

SEQ ID NO: 870910 - RNA, 19 nt, Homo sapiens
gcaacaggcagaacaagaa

SEQ ID NO: 870911 - RNA, 19 nt, Homo sapiens
ggaaaugaaagugaaguaa

SEQ ID NO: 870912 - RNA, 19 nt, Homo sapiens
gaugacaccuuagaauuag

SEQ ID NO: 870913 - RNA, 19 nt, Homo sapiens
ggaaaugaacuugagcuuu

SEQ ID NO: 870914 - RNA, 19 nt, Homo sapiens
ccaggaauauguccggaaa

SEQ ID NO: 870915 - RNA, 19 nt, Homo sapiens
gaaagaagcaagcaaugca

SEQ ID NO: 870916 - RNA, 19 nt, Homo sapiens
ugaaaccgaugaagagaau

SEQ ID NO: 870917 - RNA, 19 nt, Homo sapiens
acagggagcuccagaauac

SEQ ID NO: 870918 - RNA, 19 nt, Homo sapiens
gaaggcagaggaagaauca

SEQ ID NO: 870919 - RNA, 19 nt, Homo sapiens
gaauugaacaucccacguu

SEQ ID NO: 870920 - RNA, 19 nt, Homo sapiens
aggaagagaauacagauua

SEQ ID NO: 870921 - RNA, 19 nt, Homo sapiens
ggaugaagaagaagaagaa

SEQ ID NO: 870922 - RNA, 19 nt, Homo sapiens
ccaaagaucaaacucugua

SEQ ID NO: 870923 - RNA, 19 nt, Homo sapiens
acaaggaucucucuaaggu

SEQ ID NO: 870924 - RNA, 19 nt, Homo sapiens
gaaacuucuugaugaacaa

SEQ ID NO: 870925 - RNA, 19 nt, Homo sapiens
ugguaaaccuggagaauau

SEQ ID NO: 870926 - RNA, 19 nt, Homo sapiens
gaacgacaucauuuaagaa

SEQ ID NO: 870927 - RNA, 19 nt, Homo sapiens
gcaggucggucuagagagu

SEQ ID NO: 870928 - RNA, 19 nt, Homo sapiens
ugaagagaauacugaggua

SEQ ID NO: 870929 - RNA, 19 nt, Homo sapiens
ggaagagaauacagauuac

SEQ ID NO: 870930 - RNA, 19 nt, Homo sapiens
gaaccucauugauuugaag

SEQ ID NO: 870931 - RNA, 19 nt, Homo sapiens
gaagggagcaccuaaugca

SEQ ID NO: 870932 - RNA, 19 nt, Homo sapiens
uaaaggcgguggacuuaag

SEQ ID NO: 870933 - RNA, 19 nt, Homo sapiens
gaacaaucuggaaaugaaa

SEQ ID NO: 870934 - RNA, 19 nt, Homo sapiens
gacaaagacucaaaagauu

SEQ ID NO: 870935 - RNA, 19 nt, Homo sapiens
guuggagaaucuagaaauu

SEQ ID NO: 870936 - RNA, 19 nt, Homo sapiens
caccuaacaucaccaaguu

SEQ ID NO: 870937 - RNA, 19 nt, Homo sapiens
gagaagaaacggguuguga

SEQ ID NO: 870938 - RNA, 19 nt, Homo sapiens
ggaggguucugauaaugau

SEQ ID NO: 870939 - RNA, 19 nt, Homo sapiens
ggccuggaauugauauauu

SEQ ID NO: 870940 - RNA, 19 nt, Homo sapiens
cugcagagaaguuuaauuu

SEQ ID NO: 870941 - RNA, 19 nt, Homo sapiens
ucaugucucuguagugauu

SEQ ID NO: 870942 - RNA, 19 nt, Homo sapiens
gaaguggaugagaauauuu

SEQ ID NO: 870943 - RNA, 19 nt, Homo sapiens
cagagagcauuaauucaga

SEQ ID NO: 870944 - RNA, 19 nt, Homo sapiens
gaaaugaacuugagcuuua

SEQ ID NO: 870945 - RNA, 19 nt, Homo sapiens
caacaaagaugauaccaaa

SEQ ID NO: 870946 - RNA, 19 nt, Homo sapiens
gaaaugagaugguucacuu

SEQ ID NO: 870947 - RNA, 19 nt, Homo sapiens
gcagagaaguuuaauuuga

SEQ ID NO: 870948 - RNA, 19 nt, Homo sapiens
gaagagaggaugagaauga

SEQ ID NO: 870949 - RNA, 19 nt, Homo sapiens
gcauguaccuuguguagaa

SEQ ID NO: 870950 - RNA, 19 nt, Homo sapiens
ggaacgagaauucuuaaua

SEQ ID NO: 870951 - RNA, 19 nt, Homo sapiens
ggaacgacaucauuuaaga

SEQ ID NO: 870952 - RNA, 19 nt, Homo sapiens
gaaaggaacuucguagcaa

SEQ ID NO: 870953 - RNA, 19 nt, Homo sapiens
gaacgaaggacaacaagaa

SEQ ID NO: 870954 - RNA, 19 nt, Homo sapiens
gaauauguccggaaacuuu

SEQ ID NO: 870955 - RNA, 19 nt, Homo sapiens
ugacagagguuccaguaaa

SEQ ID NO: 870956 - RNA, 19 nt, Homo sapiens
ggaaaucucgcgaggguua

SEQ ID NO: 870957 - RNA, 19 nt, Homo sapiens
gaauacagauuaccuuaca

SEQ ID NO: 870958 - RNA, 19 nt, Homo sapiens
gaagaacaaucuggaaaug

SEQ ID NO: 870959 - RNA, 19 nt, Homo sapiens
gaagugaaagacuauguua

SEQ ID NO: 870960 - RNA, 19 nt, Homo sapiens
gaauaaagaguccaacaaa

SEQ ID NO: 870961 - RNA, 19 nt, Homo sapiens
gaccauccauuuccuauug

SEQ ID NO: 870962 - RNA, 19 nt, Homo sapiens
ggagacauguggacgguuu

SEQ ID NO: 870963 - RNA, 19 nt, Homo sapiens
cauaguagaugcuuuccua

SEQ ID NO: 870964 - RNA, 19 nt, Homo sapiens
ggcaaauucucaauccuua

SEQ ID NO: 870965 - RNA, 19 nt, Homo sapiens
cagauuaccuuacagauuc

SEQ ID NO: 870966 - RNA, 19 nt, Homo sapiens
caagauugguugcuacauu

SEQ ID NO: 870967 - RNA, 19 nt, Homo sapiens
gaacaugggccuggaauug

SEQ ID NO: 870968 - RNA, 19 nt, Homo sapiens
caacagcccuuccagaauc

SEQ ID NO: 870969 - RNA, 19 nt, Homo sapiens
gauaauuaguccagagaaa

SEQ ID NO: 870970 - RNA, 19 nt, Homo sapiens
gagaauggcagucaagaaa

SEQ ID NO: 870971 - RNA, 19 nt, Homo sapiens
ugaagaggaugaagaagaa

SEQ ID NO: 870972 - RNA, 19 nt, Homo sapiens
gaagauauucgauuaggaa

SEQ ID NO: 870973 - RNA, 19 nt, Homo sapiens
aaagaaacaucaagaggaa

SEQ ID NO: 870974 - RNA, 19 nt, Homo sapiens
gaauggcagucaagaaaug

SEQ ID NO: 870975 - RNA, 19 nt, Homo sapiens
gcacuauucuggacacaug

SEQ ID NO: 870976 - RNA, 19 nt, Homo sapiens
gagaauacagauuaccuua

SEQ ID NO: 870977 - RNA, 19 nt, Homo sapiens
gaagaggaggguucugaua

SEQ ID NO: 870978 - RNA, 19 nt, Homo sapiens
gagcaucuuuucagaauua

SEQ ID NO: 870979 - RNA, 19 nt, Homo sapiens
gaacuugagcuuuaaacuu

SEQ ID NO: 870980 - RNA, 19 nt, Homo sapiens
aaggaucucucuaagguua

SEQ ID NO: 870981 - RNA, 19 nt, Homo sapiens
gaagauagacauaaacagu

SEQ ID NO: 870982 - RNA, 19 nt, Homo sapiens
cagcaggcguaguauauuu

SEQ ID NO: 870983 - RNA, 19 nt, Homo sapiens
gcaggaaaaucuucuagua

SEQ ID NO: 870984 - RNA, 19 nt, Homo sapiens
gaaacggguugugauggua

SEQ ID NO: 870985 - RNA, 19 nt, Homo sapiens
uagauuacaugaucaguga

SEQ ID NO: 870986 - RNA, 19 nt, Homo sapiens
ggaaucagcuguuauuuuc

SEQ ID NO: 870987 - RNA, 19 nt, Homo sapiens
gcaacgaaguggugaaucu

SEQ ID NO: 870988 - RNA, 19 nt, Homo sapiens
uaaaugagccagaagaaga

SEQ ID NO: 870989 - RNA, 19 nt, Homo sapiens
agaagagacuggaagauga

SEQ ID NO: 870990 - RNA, 19 nt, Homo sapiens
gaaaugaggguccuuaguc

SEQ ID NO: 870991 - RNA, 19 nt, Homo sapiens
uaauucagauggcuuagaa

SEQ ID NO: 870992 - RNA, 19 nt, Homo sapiens
gcaagaacaagaagauuau

SEQ ID NO: 870993 - RNA, 19 nt, Homo sapiens
ggcaagaacaagaagauua

SEQ ID NO: 870994 - RNA, 19 nt, Homo sapiens
gauuaggaauggagguuaa

SEQ ID NO: 870995 - RNA, 19 nt, Homo sapiens
gagcaaaugaugagaaaga

SEQ ID NO: 870996 - RNA, 19 nt, Homo sapiens
caaaguauggaaacaagua

SEQ ID NO: 870997 - RNA, 19 nt, Homo sapiens
agaacaaucuggaaaugaa

SEQ ID NO: 870998 - RNA, 19 nt, Homo sapiens
ggacacauguggccaguac

SEQ ID NO: 870999 - RNA, 19 nt, Homo sapiens
guacaaggaucucucuaag

SEQ ID NO: 871000 - RNA, 19 nt, Homo sapiens
ugauauugcuggacuugua

SEQ ID NO: 871001 - RNA, 19 nt, Homo sapiens
gaauuuguuucaagaggaa

SEQ ID NO: 871002 - RNA, 19 nt, Homo sapiens
gaagaaacggguugugaug

SEQ ID NO: 871003 - RNA, 19 nt, Homo sapiens
gauggaguguuagaagaua

SEQ ID NO: 871004 - RNA, 19 nt, Homo sapiens
ugaugacaccuuagaauua

SEQ ID NO: 871005 - RNA, 19 nt, Homo sapiens
aaacuuacaugcaggacaa

SEQ ID NO: 871006 - RNA, 19 nt, Homo sapiens
gaacaagaagagaggauga

SEQ ID NO: 871007 - RNA, 19 nt, Homo sapiens
gaacugcuaagaccaaaga

SEQ ID NO: 871008 - RNA, 19 nt, Homo sapiens
ccugauggcucuccaaguu

SEQ ID NO: 871009 - RNA, 19 nt, Homo sapiens
gaaaugcugcccaaucuuc

SEQ ID NO: 871010 - RNA, 19 nt, Homo sapiens
gcaacaggcagaacaagaa

SEQ ID NO: 871011 - RNA, 19 nt, Homo sapiens
ggaaaugaaagugaaguaa

SEQ ID NO: 871012 - RNA, 19 nt, Homo sapiens
gaugacaccuuagaauuag

SEQ ID NO: 871013 - RNA, 19 nt, Homo sapiens
ggaagacgaucaggacugu

SEQ ID NO: 871014 - RNA, 19 nt, Homo sapiens
ggaaaugaacuugagcuuu

SEQ ID NO: 871015 - RNA, 19 nt, Homo sapiens
ccaggaauauguccggaaa

SEQ ID NO: 871016 - RNA, 19 nt, Homo sapiens
gaaagaagcaagcaaugca

SEQ ID NO: 871017 - RNA, 19 nt, Homo sapiens
ugaaaccgaugaagagaau

SEQ ID NO: 871018 - RNA, 19 nt, Homo sapiens
acagggagcuccagaauac

SEQ ID NO: 871019 - RNA, 19 nt, Homo sapiens
gaaggcagaggaagaauca

SEQ ID NO: 871020 - RNA, 19 nt, Homo sapiens
gaauugaacaucccacguu

SEQ ID NO: 871021 - RNA, 19 nt, Homo sapiens
aggaagagaauacagauua

SEQ ID NO: 871022 - RNA, 19 nt, Homo sapiens
ggaugaagaagaagaagaa

SEQ ID NO: 871023 - RNA, 19 nt, Homo sapiens
ccaaagaucaaacucugua

SEQ ID NO: 871024 - RNA, 19 nt, Homo sapiens
acaaggaucucucuaaggu

SEQ ID NO: 871025 - RNA, 19 nt, Homo sapiens
gaaacuucuugaugaacaa

SEQ ID NO: 871026 - RNA, 19 nt, Homo sapiens
ugguaaaccuggagaauau

SEQ ID NO: 871027 - RNA, 19 nt, Homo sapiens
gaacgacaucauuuaagaa

SEQ ID NO: 871028 - RNA, 19 nt, Homo sapiens
gcaggucggucuagagagu

SEQ ID NO: 871029 - RNA, 19 nt, Homo sapiens
ugaagagaauacugaggua

SEQ ID NO: 871030 - RNA, 19 nt, Homo sapiens
ggaagagaauacagauuac

SEQ ID NO: 871031 - RNA, 19 nt, Homo sapiens
gaaccucauugauuugaag

SEQ ID NO: 871032 - RNA, 19 nt, Homo sapiens
gaagggagcaccuaaugca

SEQ ID NO: 871033 - RNA, 19 nt, Homo sapiens
uaaaggcgguggacuuaag

SEQ ID NO: 871034 - RNA, 19 nt, Homo sapiens
gaacaaucuggaaaugaaa

SEQ ID NO: 871035 - RNA, 19 nt, Homo sapiens
gacaaagacucaaaagauu

SEQ ID NO: 871036 - RNA, 19 nt, Homo sapiens
guuggagaaucuagaaauu

SEQ ID NO: 871037 - RNA, 19 nt, Homo sapiens
caccuaacaucaccaaguu

SEQ ID NO: 871038 - RNA, 19 nt, Homo sapiens
gagaagaaacggguuguga

SEQ ID NO: 871039 - RNA, 19 nt, Homo sapiens
ggaggguucugauaaugau

SEQ ID NO: 871040 - RNA, 19 nt, Homo sapiens
ggccuggaauugauauauu

SEQ ID NO: 871041 - RNA, 19 nt, Homo sapiens
cugcagagaaguuuaauuu

SEQ ID NO: 871042 - RNA, 19 nt, Homo sapiens
ucaugucucuguagugauu

SEQ ID NO: 871043 - RNA, 19 nt, Homo sapiens
gaaguggaugagaauauuu

SEQ ID NO: 871044 - RNA, 19 nt, Homo sapiens
gagagacgcugucggcauu

SEQ ID NO: 871045 - RNA, 19 nt, Homo sapiens
gcaccggaaugccaauuaa

SEQ ID NO: 871046 - RNA, 19 nt, Homo sapiens
cagagaauccuaaugauaa

SEQ ID NO: 871047 - RNA, 19 nt, Homo sapiens
cauuacagcugcagucauu

SEQ ID NO: 871048 - RNA, 19 nt, Homo sapiens
cuacagagaauccuaauga

SEQ ID NO: 871049 - RNA, 19 nt, Homo sapiens
gaggaugagccacugcuua

SEQ ID NO: 871050 - RNA, 19 nt, Homo sapiens
caaaugcuucuauuccaua

SEQ ID NO: 871051 - RNA, 19 nt, Homo sapiens
gaucauaggucuggacacu

SEQ ID NO: 871052 - RNA, 19 nt, Homo sapiens
caaccugcguucucugcua

SEQ ID NO: 871053 - RNA, 19 nt, Homo sapiens
uagaagacuuuccuacaga

SEQ ID NO: 871054 - RNA, 19 nt, Homo sapiens
gcuacggcauugcucagua

SEQ ID NO: 871055 - RNA, 19 nt, Homo sapiens
ugccaaaccucuacccaaa

SEQ ID NO: 871056 - RNA, 19 nt, Homo sapiens
acagagaauccuaaugaua

SEQ ID NO: 871057 - RNA, 19 nt, Homo sapiens
gagaagugcguguaugaga

SEQ ID NO: 871058 - RNA, 19 nt, Homo sapiens
cuacggcauugcucaguaa

SEQ ID NO: 871059 - RNA, 19 nt, Homo sapiens
gauggaggcugagauugug

SEQ ID NO: 871060 - RNA, 19 nt, Homo sapiens
gcaacaaaugcuucuauuc

SEQ ID NO: 871061 - RNA, 19 nt, Homo sapiens
gaaugccaauuaacuagag

SEQ ID NO: 871062 - RNA, 19 nt, Homo sapiens
cggcauugcucaguaaguu

SEQ ID NO: 871063 - RNA, 19 nt, Homo sapiens
ggauggaggcugagauugu

SEQ ID NO: 871064 - RNA, 19 nt, Homo sapiens
ggacugcuccuauguucug

SEQ ID NO: 871065 - RNA, 19 nt, Homo sapiens
aaaggaaucauacaucuca

SEQ ID NO: 871066 - RNA, 19 nt, Homo sapiens
cuagagccaucacuauugu

SEQ ID NO: 871067 - RNA, 19 nt, Homo sapiens
ggacgagaagugcguguau

SEQ ID NO: 871068 - RNA, 19 nt, Homo sapiens
caacaaaugcuucuauucc

SEQ ID NO: 871069 - RNA, 19 nt, Homo sapiens
ggaaugccaauuaacuaga

SEQ ID NO: 871070 - RNA, 19 nt, Homo sapiens
gagugggacugcuccuaug

SEQ ID NO: 871071 - RNA, 19 nt, Homo sapiens
gcauugcucaguaaguuga

SEQ ID NO: 871072 - RNA, 19 nt, Homo sapiens
ugcaacaaaugcuucuauu

SEQ ID NO: 871073 - RNA, 19 nt, Homo sapiens
gaucuuacgccaggauaug

SEQ ID NO: 871074 - RNA, 19 nt, Homo sapiens
gaauccuaaugauaacuca

SEQ ID NO: 871075 - RNA, 19 nt, Homo sapiens
gacgagaagugcguguaug

SEQ ID NO: 871076 - RNA, 19 nt, Homo sapiens
acaaaugcuucuauuccau

SEQ ID NO: 871077 - RNA, 19 nt, Homo sapiens
uaaaguucuuagaggauca

SEQ ID NO: 871078 - RNA, 19 nt, Homo sapiens
uagcugaggcagaggauga

SEQ ID NO: 871079 - RNA, 19 nt, Homo sapiens
ccuagagccaucacuauug

SEQ ID NO: 871080 - RNA, 19 nt, Homo sapiens
ugauggagcagaugagaga

SEQ ID NO: 871081 - RNA, 19 nt, Homo sapiens
agacuuuccuacagagaau

SEQ ID NO: 871082 - RNA, 19 nt, Homo sapiens
gaagacuuuccuacagaga

SEQ ID NO: 871083 - RNA, 19 nt, Homo sapiens
ccaggaguacagcaucuuu

SEQ ID NO: 871084 - RNA, 19 nt, Homo sapiens
uuccauagcuacggcauug

SEQ ID NO: 871085 - RNA, 19 nt, Homo sapiens
gugcaacaaaugcuucuau

SEQ ID NO: 871086 - RNA, 19 nt, Homo sapiens
ggaagaugaggacgaugug

SEQ ID NO: 871087 - RNA, 19 nt, Homo sapiens
ccggaaugccaauuaacua

SEQ ID NO: 871088 - RNA, 19 nt, Homo sapiens
ggaaucauacaucucaaaa

SEQ ID NO: 871089 - RNA, 19 nt, Homo sapiens
gacuuucugugcugaugga

SEQ ID NO: 871090 - RNA, 19 nt, Homo sapiens
gcagugggugggcaagaug

SEQ ID NO: 871091 - RNA, 19 nt, Homo sapiens
uacagagaauccuaaugau

SEQ ID NO: 871092 - RNA, 19 nt, Homo sapiens
caucccaccuguagaagac

SEQ ID NO: 871093 - RNA, 19 nt, Homo sapiens
ucaaugccaccuaccaugu

SEQ ID NO: 871094 - RNA, 19 nt, Homo sapiens
aacaaaugcuucuauucca

SEQ ID NO: 871095 - RNA, 19 nt, Homo sapiens
ugaggacgaugugcuacug

SEQ ID NO: 871096 - RNA, 19 nt, Homo sapiens
ugggacugcuccuauguuc

SEQ ID NO: 871097 - RNA, 19 nt, Homo sapiens
ugagugggacugcuccuau

SEQ ID NO: 871098 - RNA, 19 nt, Homo sapiens
ggcagugggugggcaagau

SEQ ID NO: 871099 - RNA, 19 nt, Homo sapiens
gggagagggcucacagagu

SEQ ID NO: 871100 - RNA, 19 nt, Homo sapiens
ccauuuggguggcuguuuu

SEQ ID NO: 871101 - RNA, 19 nt, Homo sapiens
agagaauccuaaugauaac

SEQ ID NO: 871102 - RNA, 19 nt, Homo sapiens
ccuggaagaugaggacgau

SEQ ID NO: 871103 - RNA, 19 nt, Homo sapiens
ggccagaucccaggucaca

SEQ ID NO: 871104 - RNA, 19 nt, Homo sapiens
acgagaagugcguguauga

SEQ ID NO: 871105 - RNA, 19 nt, Homo sapiens
gcugcaacuaccagacuuu

SEQ ID NO: 871106 - RNA, 19 nt, Homo sapiens
ccaaaccucuacccaaaag

SEQ ID NO: 871107 - RNA, 19 nt, Homo sapiens
ggccucccguugacccuau

SEQ ID NO: 871108 - RNA, 19 nt, Homo sapiens
guucuuagaggaucauagg

SEQ ID NO: 871109 - RNA, 19 nt, Homo sapiens
ccggauggaggcugagauu

SEQ ID NO: 871110 - RNA, 19 nt, Homo sapiens
cagcuuagccuucuacuuu

SEQ ID NO: 871111 - RNA, 19 nt, Homo sapiens
cuacaaaguugaugauuuc

SEQ ID NO: 871112 - RNA, 19 nt, Homo sapiens
ucaagagguuucacauuaa

SEQ ID NO: 871113 - RNA, 19 nt, Homo sapiens
caagagguuucacauuaaa

SEQ ID NO: 871114 - RNA, 19 nt, Homo sapiens
gaagaugccucgggucuca

SEQ ID NO: 871115 - RNA, 19 nt, Homo sapiens
cuagguggauaguaaauuu

SEQ ID NO: 871116 - RNA, 19 nt, Homo sapiens
aucaagagguuucacauua

SEQ ID NO: 871117 - RNA, 19 nt, Homo sapiens
gcaauucugaucugcauuu

SEQ ID NO: 871118 - RNA, 19 nt, Homo sapiens
ggacugucagcuuuauuua

SEQ ID NO: 871119 - RNA, 19 nt, Homo sapiens
caccuggccuguuucauuu

SEQ ID NO: 871120 - RNA, 19 nt, Homo sapiens
ucuaagaaaucaagagguu

SEQ ID NO: 871121 - RNA, 19 nt, Homo sapiens
cagaagaggacaaucaauu

SEQ ID NO: 871122 - RNA, 19 nt, Homo sapiens
uuauuuagcucaccuagug

SEQ ID NO: 871123 - RNA, 19 nt, Homo sapiens
gaguggcagucuaauacua

SEQ ID NO: 871124 - RNA, 19 nt, Homo sapiens
guuugaagcugaggaacua

SEQ ID NO: 871125 - RNA, 19 nt, Homo sapiens
ucucucaccuggccuguuu

SEQ ID NO: 871126 - RNA, 19 nt, Homo sapiens
aaauugagccaccgucuaa

SEQ ID NO: 871127 - RNA, 19 nt, Homo sapiens
ccacugcauugccaucuug

SEQ ID NO: 871128 - RNA, 19 nt, Homo sapiens
gaaugaagacuggaucgaa

SEQ ID NO: 871129 - RNA, 19 nt, Homo sapiens
aggaaugccugccaucuga

SEQ ID NO: 871130 - RNA, 19 nt, Homo sapiens
gagccaccgucuaagaaau

SEQ ID NO: 871131 - RNA, 19 nt, Homo sapiens
ggagauccccgucaguuua

SEQ ID NO: 871132 - RNA, 19 nt, Homo sapiens
guucagcugugugugcaua

SEQ ID NO: 871133 - RNA, 19 nt, Homo sapiens
gccagcagcuagccaugaa

SEQ ID NO: 871134 - RNA, 19 nt, Homo sapiens
ucaccuggccuguuucauu

SEQ ID NO: 871135 - RNA, 19 nt, Homo sapiens
ggugaguggcagucuaaua

SEQ ID NO: 871136 - RNA, 19 nt, Homo sapiens
gaaaacugguggacuguca

SEQ ID NO: 871137 - RNA, 19 nt, Homo sapiens
gaagcuuguugccaugaca

SEQ ID NO: 871138 - RNA, 19 nt, Homo sapiens
cauggagacuguggugauu

SEQ ID NO: 871139 - RNA, 19 nt, Homo sapiens
uggccuguuucauuuauuu

SEQ ID NO: 871140 - RNA, 19 nt, Homo sapiens
cagcagcuuuagcccauga

SEQ ID NO: 871141 - RNA, 19 nt, Homo sapiens
gucagaauguguggcaauu

SEQ ID NO: 871142 - RNA, 19 nt, Homo sapiens
gcagucuaauacuacaguu

SEQ ID NO: 871143 - RNA, 19 nt, Homo sapiens
uggaugauguugugaaguc

SEQ ID NO: 871144 - RNA, 19 nt, Homo sapiens
caggguggaugauguugug

SEQ ID NO: 871145 - RNA, 19 nt, Homo sapiens
gcaagaggaguauugaaaa

SEQ ID NO: 871146 - RNA, 19 nt, Homo sapiens
gcuggugaguggcagucua

SEQ ID NO: 871147 - RNA, 19 nt, Homo sapiens
ggagaguucagcugugugu

SEQ ID NO: 871148 - RNA, 19 nt, Homo sapiens
gcagcgcuaugauucuaag

SEQ ID NO: 871149 - RNA, 19 nt, Homo sapiens
gaagcugaggaacuacaaa

SEQ ID NO: 871150 - RNA, 19 nt, Homo sapiens
cugguggacugucagcuuu

SEQ ID NO: 871151 - RNA, 19 nt, Homo sapiens
cugcagcgcuaugauucua

SEQ ID NO: 871152 - RNA, 19 nt, Homo sapiens
gguggacugucagcuuuau

SEQ ID NO: 871153 - RNA, 19 nt, Homo sapiens
ugcaagaggaguauugaaa

SEQ ID NO: 871154 - RNA, 19 nt, Homo sapiens
gcauggagacuguggugau

SEQ ID NO: 871155 - RNA, 19 nt, Homo sapiens
agucugagcccucugaguu

SEQ ID NO: 871156 - RNA, 19 nt, Homo sapiens
gguggaugauguugugaag

SEQ ID NO: 871157 - RNA, 19 nt, Homo sapiens
ggugauuguugccauaggu

SEQ ID NO: 871158 - RNA, 19 nt, Homo sapiens
gaugugaccgggacugagu

SEQ ID NO: 871159 - RNA, 19 nt, Homo sapiens
ucucaugucccacugcauu

SEQ ID NO: 871160 - RNA, 19 nt, Homo sapiens
gagacuguggugauuguug

SEQ ID NO: 871161 - RNA, 19 nt, Homo sapiens
cuuuaugccugcaauuuua

SEQ ID NO: 871162 - RNA, 19 nt, Homo sapiens
gugaguggcagucuaauac

SEQ ID NO: 871163 - RNA, 19 nt, Homo sapiens
ccuauagaguuaguuguuc

SEQ ID NO: 871164 - RNA, 19 nt, Homo sapiens
aaucaagagguuucacauu

SEQ ID NO: 871165 - RNA, 19 nt, Homo sapiens
uggacugucagcuuuauuu

SEQ ID NO: 871166 - RNA, 19 nt, Homo sapiens
uguggugauuguugccaua

SEQ ID NO: 871167 - RNA, 19 nt, Homo sapiens
cgauguacccuccguugga

SEQ ID NO: 871168 - RNA, 19 nt, Homo sapiens
uggagacuguggugauugu

SEQ ID NO: 871169 - RNA, 19 nt, Homo sapiens
gagaagcuuguugccauga

SEQ ID NO: 871170 - RNA, 19 nt, Homo sapiens
ccaucuuucuggcuucguu

SEQ ID NO: 871171 - RNA, 19 nt, Homo sapiens
gucugagcccucugaguua

SEQ ID NO: 871172 - RNA, 19 nt, Homo sapiens
caggagcccucuggaagca

SEQ ID NO: 871173 - RNA, 19 nt, Homo sapiens
ccuggccuguuucauuuau

SEQ ID NO: 871174 - RNA, 19 nt, Homo sapiens
ggucagaauguguggcaau

SEQ ID NO: 871175 - RNA, 19 nt, Homo sapiens
cuauagaguuaguuguucu

SEQ ID NO: 871176 - RNA, 19 nt, Homo sapiens
gcccugcuccugucuguca

SEQ ID NO: 871177 - RNA, 19 nt, Homo sapiens
ugagcccucugaguuagaa

SEQ ID NO: 871178 - RNA, 19 nt, Homo sapiens
uggcaauucugaucugcau

SEQ ID NO: 871179 - RNA, 19 nt, Homo sapiens
cagucuaauacuacaguua

SEQ ID NO: 871180 - RNA, 19 nt, Homo sapiens
cagcugugugugcauagua

SEQ ID NO: 871181 - RNA, 19 nt, Homo sapiens
gaagacuggaucgaagaug

SEQ ID NO: 871182 - RNA, 19 nt, Homo sapiens
guagggguuucuucuuuug

SEQ ID NO: 871183 - RNA, 19 nt, Homo sapiens
ugagccaccgucuaagaaa

SEQ ID NO: 871184 - RNA, 19 nt, Homo sapiens
uguccuggccaccaucuuu

SEQ ID NO: 871185 - RNA, 19 nt, Homo sapiens
aaguagggguuucuucuuu

SEQ ID NO: 871186 - RNA, 19 nt, Homo sapiens
uuucagaagaggacaauca

SEQ ID NO: 871187 - RNA, 19 nt, Homo sapiens
cuggaagcauggagacugu

SEQ ID NO: 871188 - RNA, 19 nt, Homo sapiens
gcaaacaccugaucaagga

SEQ ID NO: 871189 - RNA, 19 nt, Homo sapiens
gagcacagcuggaacaaug

SEQ ID NO: 871190 - RNA, 19 nt, Homo sapiens
gaaggacggucuacagcuu

SEQ ID NO: 871191 - RNA, 19 nt, Homo sapiens
gaacuacaccuaucucauc

SEQ ID NO: 871192 - RNA, 19 nt, Homo sapiens
aaccagagguggauacuaa

SEQ ID NO: 871193 - RNA, 19 nt, Homo sapiens
gaccugacauucuuuaaca

SEQ ID NO: 871194 - RNA, 19 nt, Homo sapiens
aaauuuggcucccucauga

SEQ ID NO: 871195 - RNA, 19 nt, Homo sapiens
ugaaggacaugaagcagaa

SEQ ID NO: 871196 - RNA, 19 nt, Homo sapiens
ucacagacaugaagaaguc

SEQ ID NO: 871197 - RNA, 19 nt, Homo sapiens
gcaaauccaacacacguuu

SEQ ID NO: 871198 - RNA, 19 nt, Homo sapiens
ccaguacccucccaccuuu

SEQ ID NO: 871199 - RNA, 19 nt, Homo sapiens
ggaaccggagcccaaauua

SEQ ID NO: 871200 - RNA, 19 nt, Homo sapiens
cagaggagaccuucaguuu

SEQ ID NO: 871201 - RNA, 19 nt, Homo sapiens
ucaaggaaaucauccacaa

SEQ ID NO: 871202 - RNA, 19 nt, Homo sapiens
uuaacacgcuggugagaaa

SEQ ID NO: 871203 - RNA, 19 nt, Homo sapiens
cagaaacccuuccuugaca

SEQ ID NO: 871204 - RNA, 19 nt, Homo sapiens
caacggaggaggacaguga

SEQ ID NO: 871205 - RNA, 19 nt, Homo sapiens
gcgcagaccuuaggaugug

SEQ ID NO: 871206 - RNA, 19 nt, Homo sapiens
ggaugugccucgauguguu

SEQ ID NO: 871207 - RNA, 19 nt, Homo sapiens
gaggagaccuucaguuucc

SEQ ID NO: 871208 - RNA, 19 nt, Homo sapiens
gaaccggagcccaaauuau

SEQ ID NO: 871209 - RNA, 19 nt, Homo sapiens
caacacacguuugccaauc

SEQ ID NO: 871210 - RNA, 19 nt, Homo sapiens
cucgagagauuuaaagauu

SEQ ID NO: 871211 - RNA, 19 nt, Homo sapiens
ccgaugcucugaaagaaga

SEQ ID NO: 871212 - RNA, 19 nt, Homo sapiens
acaccuaccuggagaagau

SEQ ID NO: 871213 - RNA, 19 nt, Homo sapiens
acaccgagguuacaucugu

SEQ ID NO: 871214 - RNA, 19 nt, Homo sapiens
gaacagccgcagcguguca

SEQ ID NO: 871215 - RNA, 19 nt, Homo sapiens
gaacggagagaugagcaaa

SEQ ID NO: 871216 - RNA, 19 nt, Homo sapiens
acaguggucuccuuuggaa

SEQ ID NO: 871217 - RNA, 19 nt, Homo sapiens
ggagagaugagcaaaugga

SEQ ID NO: 871218 - RNA, 19 nt, Homo sapiens
gucuacagcuucucacaga

SEQ ID NO: 871219 - RNA, 19 nt, Homo sapiens
aaacuucgagcucaacuug

SEQ ID NO: 871220 - RNA, 19 nt, Homo sapiens
gaagcugaacuacaccuau

SEQ ID NO: 871221 - RNA, 19 nt, Homo sapiens
agaggcagaugcugaagga

SEQ ID NO: 871222 - RNA, 19 nt, Homo sapiens
ggccgaugcucugaaagaa

SEQ ID NO: 871223 - RNA, 19 nt, Homo sapiens
ggaggcugaugacggaugu

SEQ ID NO: 871224 - RNA, 19 nt, Homo sapiens
caaggaaaucauccacaaa

SEQ ID NO: 871225 - RNA, 19 nt, Homo sapiens
acaccuaucucaucagcau

SEQ ID NO: 871226 - RNA, 19 nt, Homo sapiens
caacuacacggugcugauu

SEQ ID NO: 871227 - RNA, 19 nt, Homo sapiens
gaaacaccccguacuggua

SEQ ID NO: 871228 - RNA, 19 nt, Homo sapiens
gcucaugggcugcauccaa

SEQ ID NO: 871229 - RNA, 19 nt, Homo sapiens
gaccugccaccaugccaua

SEQ ID NO: 871230 - RNA, 19 nt, Homo sapiens
gguagaggccgaccugaca

SEQ ID NO: 871231 - RNA, 19 nt, Homo sapiens
cuacaguggucuccuuugg

SEQ ID NO: 871232 - RNA, 19 nt, Homo sapiens
cagcuaccuuuguguguca

SEQ ID NO: 871233 - RNA, 19 nt, Homo sapiens
gaugggagcacagcuggaa

SEQ ID NO: 871234 - RNA, 19 nt, Homo sapiens
acggagagaugagcaaaug

SEQ ID NO: 871235 - RNA, 19 nt, Homo sapiens
caucuacagugcccucauc

SEQ ID NO: 871236 - RNA, 19 nt, Homo sapiens
gcaacccucccacgaagga

SEQ ID NO: 871237 - RNA, 19 nt, Homo sapiens
gagagaugagcaaauggaa

SEQ ID NO: 871238 - RNA, 19 nt, Homo sapiens
cggguuggcuaccugaaga

SEQ ID NO: 871239 - RNA, 19 nt, Homo sapiens
gaagggaagcugguugaag

SEQ ID NO: 871240 - RNA, 19 nt, Homo sapiens
ccugcacacucacauaugu

SEQ ID NO: 871241 - RNA, 19 nt, Homo sapiens
ggaagcugaacuacaccua

SEQ ID NO: 871242 - RNA, 19 nt, Homo sapiens
gaaggacucagcucuacag

SEQ ID NO: 871243 - RNA, 19 nt, Homo sapiens
aagcugaacuacaccuauc

SEQ ID NO: 871244 - RNA, 19 nt, Homo sapiens
aaccggagcccaaauuaug

SEQ ID NO: 871245 - RNA, 19 nt, Homo sapiens
gcaacuacacggugcugau

SEQ ID NO: 871246 - RNA, 19 nt, Homo sapiens
gaacaccuaccuggagaag

SEQ ID NO: 871247 - RNA, 19 nt, Homo sapiens
ccguggagcuggaagucaa

SEQ ID NO: 871248 - RNA, 19 nt, Homo sapiens
acacggcccuguucaacgu

SEQ ID NO: 871249 - RNA, 19 nt, Homo sapiens
auaggccgaugcucugaaa

SEQ ID NO: 871250 - RNA, 19 nt, Homo sapiens
gcccuggaccuguuugaga

SEQ ID NO: 871251 - RNA, 19 nt, Homo sapiens
agaacagggucccggugaa

SEQ ID NO: 871252 - RNA, 19 nt, Homo sapiens
caaggcaggcaaccucaug

SEQ ID NO: 871253 - RNA, 19 nt, Homo sapiens
ggaggaggcgacugugcuu

SEQ ID NO: 871254 - RNA, 19 nt, Homo sapiens
gccaagugcgcagaccuua

SEQ ID NO: 871255 - RNA, 19 nt, Homo sapiens
gcuguugacaccgagguua

SEQ ID NO: 871256 - RNA, 19 nt, Homo sapiens
uaucucaucagcaucuuga

SEQ ID NO: 871257 - RNA, 19 nt, Homo sapiens
uugaagcccuggaccuguu

SEQ ID NO: 871258 - RNA, 19 nt, Homo sapiens
acacacguuugccaaucaa

SEQ ID NO: 871259 - RNA, 19 nt, Homo sapiens
gaacagggucccggugaac

SEQ ID NO: 871260 - RNA, 19 nt, Homo sapiens
ucagaaacccuuccuugac

SEQ ID NO: 871261 - RNA, 19 nt, Homo sapiens
gcucgagagauuuaaagau

SEQ ID NO: 871262 - RNA, 19 nt, Homo sapiens
ggcagaaguuccggaccaa

SEQ ID NO: 871263 - RNA, 19 nt, Homo sapiens
ggaguuugcagcccaguac

SEQ ID NO: 871264 - RNA, 19 nt, Homo sapiens
ggaagggaagcugguugaa

SEQ ID NO: 871265 - RNA, 19 nt, Homo sapiens
ggaaccuucucaggcacuu

SEQ ID NO: 871266 - RNA, 19 nt, Homo sapiens
ucaucagcaucuugaagga

SEQ ID NO: 871267 - RNA, 19 nt, Homo sapiens
caaccucuacaaccagaug

SEQ ID NO: 871268 - RNA, 19 nt, Homo sapiens
aggccgaccugacauucuu

SEQ ID NO: 871269 - RNA, 19 nt, Homo sapiens
gcagugcaaacaccugauc

SEQ ID NO: 871270 - RNA, 19 nt, Homo sapiens
caagugcgcagaccuuagg

SEQ ID NO: 871271 - RNA, 19 nt, Homo sapiens
ggaaggacucagcucuaca

SEQ ID NO: 871272 - RNA, 19 nt, Homo sapiens
aagcaguggcugacaguga

SEQ ID NO: 871273 - RNA, 19 nt, Homo sapiens
ggaacggagagaugagcaa

SEQ ID NO: 871274 - RNA, 19 nt, Homo sapiens
uggaugagcaccagguaga

SEQ ID NO: 871275 - RNA, 19 nt, Homo sapiens
ucaccgcaguggcccugaa

SEQ ID NO: 871276 - RNA, 19 nt, Homo sapiens
uauagggacacaccucaga

SEQ ID NO: 871277 - RNA, 19 nt, Homo sapiens
cagcuucucacagacauga

SEQ ID NO: 871278 - RNA, 19 nt, Homo sapiens
uggaaggacucagcucuac

SEQ ID NO: 871279 - RNA, 19 nt, Homo sapiens
acacgcuggugagaaagaa

SEQ ID NO: 871280 - RNA, 19 nt, Homo sapiens
caaccagagguggauacua

SEQ ID NO: 871281 - RNA, 19 nt, Homo sapiens
gccucgauguguucaagga

SEQ ID NO: 871282 - RNA, 19 nt, Homo sapiens
gcugaaggaggagcgauug

SEQ ID NO: 871283 - RNA, 19 nt, Homo sapiens
cuacagugcccucaucaac

SEQ ID NO: 871284 - RNA, 19 nt, Homo sapiens
gccgaccugacauucuuua

SEQ ID NO: 871285 - RNA, 19 nt, Homo sapiens
aaggaaaucauccacaaag

SEQ ID NO: 871286 - RNA, 19 nt, Homo sapiens
gaugugccucgauguguuc

SEQ ID NO: 871287 - RNA, 19 nt, Homo sapiens
aacacacguuugccaauca

SEQ ID NO: 871288 - RNA, 19 nt, Homo sapiens
ggacaaagcuugacacauc

SEQ ID NO: 871289 - RNA, 19 nt, Homo sapiens
guacugacuucuccuauaa

SEQ ID NO: 871290 - RNA, 19 nt, Homo sapiens
gcaagaaggagaagaagua

SEQ ID NO: 871291 - RNA, 19 nt, Homo sapiens
uaaagacagucauggguua

SEQ ID NO: 871292 - RNA, 19 nt, Homo sapiens
gcagauagcuaggaaugaa

SEQ ID NO: 871293 - RNA, 19 nt, Homo sapiens
gaaaucugcccuuuaaauu

SEQ ID NO: 871294 - RNA, 19 nt, Homo sapiens
ggauuaaacuggcauuuca

SEQ ID NO: 871295 - RNA, 19 nt, Homo sapiens
uaacaggaccaauggauua

SEQ ID NO: 871296 - RNA, 19 nt, Homo sapiens
caagaucaaugcucaaguu

SEQ ID NO: 871297 - RNA, 19 nt, Homo sapiens
gaagagaacgcccagauca

SEQ ID NO: 871298 - RNA, 19 nt, Homo sapiens
ggaaaucugcccuuuaaau

SEQ ID NO: 871299 - RNA, 19 nt, Homo sapiens
gcacgcagcugcuuguagu

SEQ ID NO: 871300 - RNA, 19 nt, Homo sapiens
caaagcagauagcuaggaa

SEQ ID NO: 871301 - RNA, 19 nt, Homo sapiens
gauggaggauaaagugaaa

SEQ ID NO: 871302 - RNA, 19 nt, Homo sapiens
ugaccaagauucugaggaa

SEQ ID NO: 871303 - RNA, 19 nt, Homo sapiens
gggacaauaucaacaauag

SEQ ID NO: 871304 - RNA, 19 nt, Homo sapiens
gccaucaagugucaauuaa

SEQ ID NO: 871305 - RNA, 19 nt, Homo sapiens
gggcaagccuaucguccua

SEQ ID NO: 871306 - RNA, 19 nt, Homo sapiens
ccaaaguccugaucacugu

SEQ ID NO: 871307 - RNA, 19 nt, Homo sapiens
cggaagagcuggagaaagg

SEQ ID NO: 871308 - RNA, 19 nt, Homo sapiens
gaagcucgaagcagguuua

SEQ ID NO: 871309 - RNA, 19 nt, Homo sapiens
gaucaaugcucaaguuuug

SEQ ID NO: 871310 - RNA, 19 nt, Homo sapiens
uaagggacauuaacgacaa

SEQ ID NO: 871311 - RNA, 19 nt, Homo sapiens
cagauacgcuauucaguuc

SEQ ID NO: 871312 - RNA, 19 nt, Homo sapiens
uagaauagccaguagugua

SEQ ID NO: 871313 - RNA, 19 nt, Homo sapiens
gaagugcaagcaauggaua

SEQ ID NO: 871314 - RNA, 19 nt, Homo sapiens
cgacaaugcgccuuacuuu

SEQ ID NO: 871315 - RNA, 19 nt, Homo sapiens
gaacaaucccagaggaguu

SEQ ID NO: 871316 - RNA, 19 nt, Homo sapiens
uaaaugaccaagauucuga

SEQ ID NO: 871317 - RNA, 19 nt, Homo sapiens
ggccaucaagugucaauua

SEQ ID NO: 871318 - RNA, 19 nt, Homo sapiens
guuaagggcagaauugaaa

SEQ ID NO: 871319 - RNA, 19 nt, Homo sapiens
guuccuagcuacaacauca

SEQ ID NO: 871320 - RNA, 19 nt, Homo sapiens
gacauuaauugcccuuuua

SEQ ID NO: 871321 - RNA, 19 nt, Homo sapiens
gagaugcgguucccucuac

SEQ ID NO: 871322 - RNA, 19 nt, Homo sapiens
gcuauucaguuccggaaga

SEQ ID NO: 871323 - RNA, 19 nt, Homo sapiens
gaaaauaauucuggaggaa

SEQ ID NO: 871324 - RNA, 19 nt, Homo sapiens
gggaccaaaugaacagaaa

SEQ ID NO: 871325 - RNA, 19 nt, Homo sapiens
gcucgaagcagguuuagga

SEQ ID NO: 871326 - RNA, 19 nt, Homo sapiens
gcaauggcaacaagaagaa

SEQ ID NO: 871327 - RNA, 19 nt, Homo sapiens
ggaggaagauaagaaugau

SEQ ID NO: 871328 - RNA, 19 nt, Homo sapiens
cguacugacuucuccuaua

SEQ ID NO: 871329 - RNA, 19 nt, Homo sapiens
gacaaagcuugacacauca

SEQ ID NO: 871330 - RNA, 19 nt, Homo sapiens
cagcugaacuccuccaucu

SEQ ID NO: 871331 - RNA, 19 nt, Homo sapiens
gacaacauccuccagauuc

SEQ ID NO: 871332 - RNA, 19 nt, Homo sapiens
aaacucauaucucgcugaa

SEQ ID NO: 871333 - RNA, 19 nt, Homo sapiens
gccauagccugguuaaagu

SEQ ID NO: 871334 - RNA, 19 nt, Homo sapiens
agaaacaagugcccaguca

SEQ ID NO: 871335 - RNA, 19 nt, Homo sapiens
gaagaagucgggcaagaag

SEQ ID NO: 871336 - RNA, 19 nt, Homo sapiens
ggugaucuguuucauccaa

SEQ ID NO: 871337 - RNA, 19 nt, Homo sapiens
ccagauacgcuauucaguu

SEQ ID NO: 871338 - RNA, 19 nt, Homo sapiens
aaauaauucuggaggaaga

SEQ ID NO: 871339 - RNA, 19 nt, Homo sapiens
gaaagucucagcccaggau

SEQ ID NO: 871340 - RNA, 19 nt, Homo sapiens
ggaggaggcucuguauguc

SEQ ID NO: 871341 - RNA, 19 nt, Homo sapiens
ccgcuuauaucccagagaa

SEQ ID NO: 871342 - RNA, 19 nt, Homo sapiens
aaucugcccuuuaaauuag

SEQ ID NO: 871343 - RNA, 19 nt, Homo sapiens
ggacauuaauugcccuuuu

SEQ ID NO: 871344 - RNA, 19 nt, Homo sapiens
gcacccagauacgcuauuc

SEQ ID NO: 871345 - RNA, 19 nt, Homo sapiens
ggaccagucuucuguuuug

SEQ ID NO: 871346 - RNA, 19 nt, Homo sapiens
gcccaacuaugcagacaug

SEQ ID NO: 871347 - RNA, 19 nt, Homo sapiens
gaguuucccucgucucugu

SEQ ID NO: 871348 - RNA, 19 nt, Homo sapiens
gcucugacuucccaacugu

SEQ ID NO: 871349 - RNA, 19 nt, Homo sapiens
guagaaguaagggacauua

SEQ ID NO: 871350 - RNA, 19 nt, Homo sapiens
gaacgacaaugccccagaa

SEQ ID NO: 871351 - RNA, 19 nt, Homo sapiens
gggaguauguggaaacaac

SEQ ID NO: 871352 - RNA, 19 nt, Homo sapiens
ggacagagacgcgcucaag

SEQ ID NO: 871353 - RNA, 19 nt, Homo sapiens
ggacccuucccacuacaua

SEQ ID NO: 871354 - RNA, 19 nt, Homo sapiens
cuacaagccuccuaguucu

SEQ ID NO: 871355 - RNA, 19 nt, Homo sapiens
gaacuccuccaucuuccaa

SEQ ID NO: 871356 - RNA, 19 nt, Homo sapiens
caauggauaaugcaggaua

SEQ ID NO: 871357 - RNA, 19 nt, Homo sapiens
uggaguagaaguagaagua

SEQ ID NO: 871358 - RNA, 19 nt, Homo sapiens
guguugaaguaccaaguaa

SEQ ID NO: 871359 - RNA, 19 nt, Homo sapiens
agacagucauggguuaauu

SEQ ID NO: 871360 - RNA, 19 nt, Homo sapiens
gaccggaugcacccagaua

SEQ ID NO: 871361 - RNA, 19 nt, Homo sapiens
gaccugcccuuacaguagu

SEQ ID NO: 871362 - RNA, 19 nt, Homo sapiens
ugaaguaccaaguaaccua

SEQ ID NO: 871363 - RNA, 19 nt, Homo sapiens
gcugaacuccuccaucuuc

SEQ ID NO: 871364 - RNA, 19 nt, Homo sapiens
gcacccaggccucagaguu

SEQ ID NO: 871365 - RNA, 19 nt, Homo sapiens
caagaaggagaagaaguaa

SEQ ID NO: 871366 - RNA, 19 nt, Homo sapiens
ggaguagaaguagaaguaa

SEQ ID NO: 871367 - RNA, 19 nt, Homo sapiens
ccuauaagcgcuucucuuc

SEQ ID NO: 871368 - RNA, 19 nt, Homo sapiens
ggccauagccugguuaaag

SEQ ID NO: 871369 - RNA, 19 nt, Homo sapiens
ggagaagaaguaacaugga

SEQ ID NO: 871370 - RNA, 19 nt, Homo sapiens
gagcccugcuggacagaga

SEQ ID NO: 871371 - RNA, 19 nt, Homo sapiens
guagugcggugugcuuuua

SEQ ID NO: 871372 - RNA, 19 nt, Homo sapiens
caacaaccaguuugacaca

SEQ ID NO: 871373 - RNA, 19 nt, Homo sapiens
gcggaagagucaccugauc

SEQ ID NO: 871374 - RNA, 19 nt, Homo sapiens
agaacgcccagaucacuua

SEQ ID NO: 871375 - RNA, 19 nt, Homo sapiens
gaccaagauucugaggaaa

SEQ ID NO: 871376 - RNA, 19 nt, Homo sapiens
gaguagaaguagaaguaag

SEQ ID NO: 871377 - RNA, 19 nt, Homo sapiens
gggcauggacaaagcuuga

SEQ ID NO: 871378 - RNA, 19 nt, Homo sapiens
cuuauucccuggcugagaa

SEQ ID NO: 871379 - RNA, 19 nt, Homo sapiens
ucgugaaagugaauuagaa

SEQ ID NO: 871380 - RNA, 19 nt, Homo sapiens
gagcuaacaggaccaaugg

SEQ ID NO: 871381 - RNA, 19 nt, Homo sapiens
gccauaaaccaauaacuag

SEQ ID NO: 871382 - RNA, 19 nt, Homo sapiens
ugacaacauccuccagauu

SEQ ID NO: 871383 - RNA, 19 nt, Homo sapiens
gguguugaaguaccaagua

SEQ ID NO: 871384 - RNA, 19 nt, Homo sapiens
agaaggagaagaaguaaca

SEQ ID NO: 871385 - RNA, 19 nt, Homo sapiens
aagaagaagucgggcaaga

SEQ ID NO: 871386 - RNA, 19 nt, Homo sapiens
gcaccuggcccaacaacca

SEQ ID NO: 871387 - RNA, 19 nt, Homo sapiens
gcagccgucuguccuugau

SEQ ID NO: 871388 - RNA, 19 nt, Homo sapiens
uaaagacagucauggguua

SEQ ID NO: 871389 - RNA, 19 nt, Homo sapiens
gcagauagcuaggaaugaa

SEQ ID NO: 871390 - RNA, 19 nt, Homo sapiens
gaggugaguuuauaucaaa

SEQ ID NO: 871391 - RNA, 19 nt, Homo sapiens
gaaaucugcccuuuaaauu

SEQ ID NO: 871392 - RNA, 19 nt, Homo sapiens
gaagagaacgcccagauca

SEQ ID NO: 871393 - RNA, 19 nt, Homo sapiens
ggaaaucugcccuuuaaau

SEQ ID NO: 871394 - RNA, 19 nt, Homo sapiens
gcacgcagcugcuuguagu

SEQ ID NO: 871395 - RNA, 19 nt, Homo sapiens
caaagcagauagcuaggaa

SEQ ID NO: 871396 - RNA, 19 nt, Homo sapiens
gauggaggauaaagugaaa

SEQ ID NO: 871397 - RNA, 19 nt, Homo sapiens
ugaccaagauucugaggaa

SEQ ID NO: 871398 - RNA, 19 nt, Homo sapiens
gggacaauaucaacaauag

SEQ ID NO: 871399 - RNA, 19 nt, Homo sapiens
gccaucaagugucaauuaa

SEQ ID NO: 871400 - RNA, 19 nt, Homo sapiens
gggcaagccuaucguccua

SEQ ID NO: 871401 - RNA, 19 nt, Homo sapiens
ccaaaguccugaucacugu

SEQ ID NO: 871402 - RNA, 19 nt, Homo sapiens
cggaagagcuggagaaagg

SEQ ID NO: 871403 - RNA, 19 nt, Homo sapiens
uaagggacauuaacgacaa

SEQ ID NO: 871404 - RNA, 19 nt, Homo sapiens
cagauacgcuauucaguuc

SEQ ID NO: 871405 - RNA, 19 nt, Homo sapiens
gaagugcaagcaauggaua

SEQ ID NO: 871406 - RNA, 19 nt, Homo sapiens
cgacaaugcgccuuacuuu

SEQ ID NO: 871407 - RNA, 19 nt, Homo sapiens
gaacaaucccagaggaguu

SEQ ID NO: 871408 - RNA, 19 nt, Homo sapiens
uaaaugaccaagauucuga

SEQ ID NO: 871409 - RNA, 19 nt, Homo sapiens
ggccaucaagugucaauua

SEQ ID NO: 871410 - RNA, 19 nt, Homo sapiens
guuaagggcagaauugaaa

SEQ ID NO: 871411 - RNA, 19 nt, Homo sapiens
guuccuagcuacaacauca

SEQ ID NO: 871412 - RNA, 19 nt, Homo sapiens
gacauuaauugcccuuuua

SEQ ID NO: 871413 - RNA, 19 nt, Homo sapiens
gagaugcgguucccucuac

SEQ ID NO: 871414 - RNA, 19 nt, Homo sapiens
gcuauucaguuccggaaga

SEQ ID NO: 871415 - RNA, 19 nt, Homo sapiens
gaaaauaauucuggaggaa

SEQ ID NO: 871416 - RNA, 19 nt, Homo sapiens
ggaggaagauaagaaugau

SEQ ID NO: 871417 - RNA, 19 nt, Homo sapiens
aaacucauaucucgcugaa

SEQ ID NO: 871418 - RNA, 19 nt, Homo sapiens
ggugaucuguuucauccaa

SEQ ID NO: 871419 - RNA, 19 nt, Homo sapiens
ccagauacgcuauucaguu

SEQ ID NO: 871420 - RNA, 19 nt, Homo sapiens
aaauaauucuggaggaaga

SEQ ID NO: 871421 - RNA, 19 nt, Homo sapiens
ccgcuuauaucccagagaa

SEQ ID NO: 871422 - RNA, 19 nt, Homo sapiens
aaucugcccuuuaaauuag

SEQ ID NO: 871423 - RNA, 19 nt, Homo sapiens
ggacauuaauugcccuuuu

SEQ ID NO: 871424 - RNA, 19 nt, Homo sapiens
gcacccagauacgcuauuc

SEQ ID NO: 871425 - RNA, 19 nt, Homo sapiens
gcccaacuaugcagacaug

SEQ ID NO: 871426 - RNA, 19 nt, Homo sapiens
gaguuucccucgucucugu

SEQ ID NO: 871427 - RNA, 19 nt, Homo sapiens
guagaaguaagggacauua

SEQ ID NO: 871428 - RNA, 19 nt, Homo sapiens
gcucugacuucccaacugu

SEQ ID NO: 871429 - RNA, 19 nt, Homo sapiens
gaacgacaaugccccagaa

SEQ ID NO: 871430 - RNA, 19 nt, Homo sapiens
ggacagagacgcgcucaag

SEQ ID NO: 871431 - RNA, 19 nt, Homo sapiens
gggaguauguggaaacaac

SEQ ID NO: 871432 - RNA, 19 nt, Homo sapiens
caauggauaaugcaggaua

SEQ ID NO: 871433 - RNA, 19 nt, Homo sapiens
uggaguagaaguagaagua

SEQ ID NO: 871434 - RNA, 19 nt, Homo sapiens
ugaggugaguuuauaucaa

SEQ ID NO: 871435 - RNA, 19 nt, Homo sapiens
agacagucauggguuaauu

SEQ ID NO: 871436 - RNA, 19 nt, Homo sapiens
gaccggaugcacccagaua

SEQ ID NO: 871437 - RNA, 19 nt, Homo sapiens
ggaguagaaguagaaguaa

SEQ ID NO: 871438 - RNA, 19 nt, Homo sapiens
gagcccugcuggacagaga

SEQ ID NO: 871439 - RNA, 19 nt, Homo sapiens
gcggaagagucaccugauc

SEQ ID NO: 871440 - RNA, 19 nt, Homo sapiens
agaacgcccagaucacuua

SEQ ID NO: 871441 - RNA, 19 nt, Homo sapiens
gaccaagauucugaggaaa

SEQ ID NO: 871442 - RNA, 19 nt, Homo sapiens
gaguagaaguagaaguaag

SEQ ID NO: 871443 - RNA, 19 nt, Homo sapiens
cuuauucccuggcugagaa

SEQ ID NO: 871444 - RNA, 19 nt, Homo sapiens
ucgugaaagugaauuagaa

SEQ ID NO: 871445 - RNA, 19 nt, Homo sapiens
gucaggugauucgguauuu

SEQ ID NO: 871446 - RNA, 19 nt, Homo sapiens
gaaguaagggacauuaacg

SEQ ID NO: 871447 - RNA, 19 nt, Homo sapiens
gauggaagugcaagcaaug

SEQ ID NO: 871448 - RNA, 19 nt, Homo sapiens
gggcagaauugaaaauaau

SEQ ID NO: 871449 - RNA, 19 nt, Homo sapiens
uaccgacccugacgaagga

SEQ ID NO: 871450 - RNA, 19 nt, Homo sapiens
gugauucgguauuuucuaa

SEQ ID NO: 871451 - RNA, 19 nt, Homo sapiens
gauaaugcaggauauucug

SEQ ID NO: 871452 - RNA, 19 nt, Homo sapiens
ggauaaugcaggauauucu

SEQ ID NO: 871453 - RNA, 19 nt, Homo sapiens
gagccgacgguaguaagua

SEQ ID NO: 871454 - RNA, 19 nt, Homo sapiens
ggaagugcaagcaauggau

SEQ ID NO: 871455 - RNA, 19 nt, Homo sapiens
uggaggaagauaagaauga

SEQ ID NO: 871456 - RNA, 19 nt, Homo sapiens
gguauuccuuccgguaugu

SEQ ID NO: 871457 - RNA, 19 nt, Homo sapiens
gacaaugcgccuuacuuuc

SEQ ID NO: 871458 - RNA, 19 nt, Homo sapiens
guuaauugaggugaguuua

SEQ ID NO: 871459 - RNA, 19 nt, Homo sapiens
ccacgaggagucaggauuc

SEQ ID NO: 871460 - RNA, 19 nt, Homo sapiens
uauauggaguagaaguaga

SEQ ID NO: 871461 - RNA, 19 nt, Homo sapiens
acauucugauggaggauaa

SEQ ID NO: 871462 - RNA, 19 nt, Homo sapiens
ucccaacugucccauucua

SEQ ID NO: 871463 - RNA, 19 nt, Homo sapiens
gacagucauggguuaauug

SEQ ID NO: 871464 - RNA, 19 nt, Homo sapiens
gagaacgcccagaucacuu

SEQ ID NO: 871465 - RNA, 19 nt, Homo sapiens
ccaacugucccauucuaug

SEQ ID NO: 871466 - RNA, 19 nt, Homo sapiens
guaauucagggacaauauc

SEQ ID NO: 871467 - RNA, 19 nt, Homo sapiens
ucaaugcggaagugaggua

SEQ ID NO: 871468 - RNA, 19 nt, Homo sapiens
gaaaaugcagccacugaga

SEQ ID NO: 871469 - RNA, 19 nt, Homo sapiens
uuaacgacaaugcgccuua

SEQ ID NO: 871470 - RNA, 19 nt, Homo sapiens
acgcccagaucacuuauuc

SEQ ID NO: 871471 - RNA, 19 nt, Homo sapiens
gugguuaagggcagaauug

SEQ ID NO: 871472 - RNA, 19 nt, Homo sapiens
caacggaggagcucugacu

SEQ ID NO: 871473 - RNA, 19 nt, Homo sapiens
cagggacaauaucaacaau

SEQ ID NO: 871474 - RNA, 19 nt, Homo sapiens
gagguauuccuuccgguau

SEQ ID NO: 871475 - RNA, 19 nt, Homo sapiens
uagaaguaagggacauuaa

SEQ ID NO: 871476 - RNA, 19 nt, Homo sapiens
agagguaggacgcagcuuu

SEQ ID NO: 871477 - RNA, 19 nt, Homo sapiens
gcugagcuccuucgacuac

SEQ ID NO: 871478 - RNA, 19 nt, Homo sapiens
ucagggacaauaucaacaa

SEQ ID NO: 871479 - RNA, 19 nt, Homo sapiens
gaggaagauaagaaugauu

SEQ ID NO: 871480 - RNA, 19 nt, Homo sapiens
cguccuacguguccaucaa

SEQ ID NO: 871481 - RNA, 19 nt, Homo sapiens
gaacgcccagaucacuuau

SEQ ID NO: 871482 - RNA, 19 nt, Homo sapiens
gugaagagaacgcccagau

SEQ ID NO: 871483 - RNA, 19 nt, Homo sapiens
uaguuuagucacagacaua

SEQ ID NO: 871484 - RNA, 19 nt, Homo sapiens
guaaaugaccaagauucug

SEQ ID NO: 871485 - RNA, 19 nt, Homo sapiens
agauggaagugcaagcaau

SEQ ID NO: 871486 - RNA, 19 nt, Homo sapiens
uguaugcgcugagcuccuu

SEQ ID NO: 871487 - RNA, 19 nt, Homo sapiens
gagccaaaguccugaucac

SEQ ID NO: 871488 - RNA, 19 nt, Homo sapiens
caagacaccugaaaccuua

SEQ ID NO: 871489 - RNA, 19 nt, Homo sapiens
gaacaaugccuucaaacau

SEQ ID NO: 871490 - RNA, 19 nt, Homo sapiens
aacaaugccuucaaacaua

SEQ ID NO: 871491 - RNA, 19 nt, Homo sapiens
gagaagcaguggaaugugu

SEQ ID NO: 871492 - RNA, 19 nt, Homo sapiens
ggacaccugaguacucuua

SEQ ID NO: 871493 - RNA, 19 nt, Homo sapiens
ucaaagccaucgugaacaa

SEQ ID NO: 871494 - RNA, 19 nt, Homo sapiens
ggacaaguggugaauauca

SEQ ID NO: 871495 - RNA, 19 nt, Homo sapiens
gcaaguggcuucuauuccu

SEQ ID NO: 871496 - RNA, 19 nt, Homo sapiens
ggacagaagaggagaagau

SEQ ID NO: 871497 - RNA, 19 nt, Homo sapiens
caucaacagugccuuuaug

SEQ ID NO: 871498 - RNA, 19 nt, Homo sapiens
gacaaguggugaauaucaa

SEQ ID NO: 871499 - RNA, 19 nt, Homo sapiens
gggaccagcugaccaagug

SEQ ID NO: 871500 - RNA, 19 nt, Homo sapiens
ugaguacucuuaaagcaau

SEQ ID NO: 871501 - RNA, 19 nt, Homo sapiens
gcgcgaugauccagaaugu

SEQ ID NO: 871502 - RNA, 19 nt, Homo sapiens
gauccagaaugucggaaau

SEQ ID NO: 871503 - RNA, 19 nt, Homo sapiens
gagcuggucucggcaagug

SEQ ID NO: 871504 - RNA, 19 nt, Homo sapiens
acaauaacgucuccuccuu

SEQ ID NO: 871505 - RNA, 19 nt, Homo sapiens
ugucacagcuuccauggau

SEQ ID NO: 871506 - RNA, 19 nt, Homo sapiens
ccacggaggugcagaugag

SEQ ID NO: 871507 - RNA, 19 nt, Homo sapiens
accaagugcugcuggguua

SEQ ID NO: 871508 - RNA, 19 nt, Homo sapiens
aauaacgucuccuccuuga

SEQ ID NO: 871509 - RNA, 19 nt, Homo sapiens
gccgagagaucaccaaggu

SEQ ID NO: 871510 - RNA, 19 nt, Homo sapiens
gaggaccugugcucugaga

SEQ ID NO: 871511 - RNA, 19 nt, Homo sapiens
ccugaaaccuuaucaugag

SEQ ID NO: 871512 - RNA, 19 nt, Homo sapiens
gggcuuggccucuguguuc

SEQ ID NO: 871513 - RNA, 19 nt, Homo sapiens
gagcgacgguuggaaugga

SEQ ID NO: 871514 - RNA, 19 nt, Homo sapiens
cggaggaccugugcucuga

SEQ ID NO: 871515 - RNA, 19 nt, Homo sapiens
gaggacaccugaguacucu

SEQ ID NO: 871516 - RNA, 19 nt, Homo sapiens
ccacaucaacagugccuuu

SEQ ID NO: 871517 - RNA, 19 nt, Homo sapiens
gcucaaagccaucgugaac

SEQ ID NO: 871518 - RNA, 19 nt, Homo sapiens
gcucugagaagcaguggaa

SEQ ID NO: 871519 - RNA, 19 nt, Homo sapiens
uguacacucuggaggauga

SEQ ID NO: 871520 - RNA, 19 nt, Homo sapiens
uaacgucuccuccuugaag

SEQ ID NO: 871521 - RNA, 19 nt, Homo sapiens
gaagacccguguggagagu

SEQ ID NO: 871522 - RNA, 19 nt, Homo sapiens
cagaagaggagaagaugga

SEQ ID NO: 871523 - RNA, 19 nt, Homo sapiens
ucaagacaccugaaaccuu

SEQ ID NO: 871524 - RNA, 19 nt, Homo sapiens
acaaugccuucaaacauag

SEQ ID NO: 871525 - RNA, 19 nt, Homo sapiens
gugaccagcuugugucucu

SEQ ID NO: 871526 - RNA, 19 nt, Homo sapiens
ucacagcuuccauggauga

SEQ ID NO: 871527 - RNA, 19 nt, Homo sapiens
acaccugaguacucuuaaa

SEQ ID NO: 871528 - RNA, 19 nt, Homo sapiens
ggaggacaccugaguacuc

SEQ ID NO: 871529 - RNA, 19 nt, Homo sapiens
gagaggccagugccagaaa

SEQ ID NO: 871530 - RNA, 19 nt, Homo sapiens
uuggacaaguggugaauau

SEQ ID NO: 871531 - RNA, 19 nt, Homo sapiens
caacagccgauuuggauac

SEQ ID NO: 871532 - RNA, 19 nt, Homo sapiens
ucgggcagcugcucaagug

SEQ ID NO: 871533 - RNA, 19 nt, Homo sapiens
gcauggugccggcugagaa

SEQ ID NO: 871534 - RNA, 19 nt, Homo sapiens
uaccugagcuacaauaacg

SEQ ID NO: 871535 - RNA, 19 nt, Homo sapiens
ccugaguacucuuaaagca

SEQ ID NO: 871536 - RNA, 19 nt, Homo sapiens
ucuggaggaugacaaguuc

SEQ ID NO: 871537 - RNA, 19 nt, Homo sapiens
caccugaaaccuuaucaug

SEQ ID NO: 871538 - RNA, 19 nt, Homo sapiens
cgauuuggauaccuucaag

SEQ ID NO: 871539 - RNA, 19 nt, Homo sapiens
cagccgauuuggauaccuu

SEQ ID NO: 871540 - RNA, 19 nt, Homo sapiens
gcuggaggacaccugagua

SEQ ID NO: 871541 - RNA, 19 nt, Homo sapiens
uggccuggauggagaaugu

SEQ ID NO: 871542 - RNA, 19 nt, Homo sapiens
cagcuuccauggaugacau

SEQ ID NO: 871543 - RNA, 19 nt, Homo sapiens
gagagacgccagaguacag

SEQ ID NO: 871544 - RNA, 19 nt, Homo sapiens
gacagaagaggagaagaug

SEQ ID NO: 871545 - RNA, 19 nt, Homo sapiens
caccauuaguguuggacaa

SEQ ID NO: 871546 - RNA, 19 nt, Homo sapiens
ucaacagccgauuuggaua

SEQ ID NO: 871547 - RNA, 19 nt, Homo sapiens
ggagcuagugcagcaggua

SEQ ID NO: 871548 - RNA, 19 nt, Homo sapiens
aggugaagcugaagcagau

SEQ ID NO: 871549 - RNA, 19 nt, Homo sapiens
cauuaguguuggacaagug

SEQ ID NO: 871550 - RNA, 19 nt, Homo sapiens
ggaccugugcucugagaag

SEQ ID NO: 871551 - RNA, 19 nt, Homo sapiens
ggcagcugcucaaguggau

SEQ ID NO: 871552 - RNA, 19 nt, Homo sapiens
uccagaaugucggaaauca

SEQ ID NO: 871553 - RNA, 19 nt, Homo sapiens
cacaucaacagugccuuua

SEQ ID NO: 871554 - RNA, 19 nt, Homo sapiens
gggcucgaauccaggucaa

SEQ ID NO: 871555 - RNA, 19 nt, Homo sapiens
gccagugccagaaagaaga

SEQ ID NO: 871556 - RNA, 19 nt, Homo sapiens
uggcagacggcgagggaua

SEQ ID NO: 871557 - RNA, 19 nt, Homo sapiens
ggagucaggccuggcuguu

SEQ ID NO: 871558 - RNA, 19 nt, Homo sapiens
cagcugcucaaguggauug

SEQ ID NO: 871559 - RNA, 19 nt, Homo sapiens
ucaccagggcaacaccuuu

SEQ ID NO: 871560 - RNA, 19 nt, Homo sapiens
cggcaaguggcuucuauuc

SEQ ID NO: 871561 - RNA, 19 nt, Homo sapiens
gaguacagacgcggagaga

SEQ ID NO: 871562 - RNA, 19 nt, Homo sapiens
acacaaagccccaggacuu

SEQ ID NO: 871563 - RNA, 19 nt, Homo sapiens
uggagaugguggugcaugu

SEQ ID NO: 871564 - RNA, 19 nt, Homo sapiens
acagugccuuuaugaccuu

SEQ ID NO: 871565 - RNA, 19 nt, Homo sapiens
gcgaccgucuggugcucaa

SEQ ID NO: 871566 - RNA, 19 nt, Homo sapiens
guuccucuccuuccacaug

SEQ ID NO: 871567 - RNA, 19 nt, Homo sapiens
uggagaauguggccaccau

SEQ ID NO: 871568 - RNA, 19 nt, Homo sapiens
caggagcgacgguuggaau

SEQ ID NO: 871569 - RNA, 19 nt, Homo sapiens
accgagagacgccagagua

SEQ ID NO: 871570 - RNA, 19 nt, Homo sapiens
acaaguuccucuccuucca

SEQ ID NO: 871571 - RNA, 19 nt, Homo sapiens
gugcuguccucggagauca

SEQ ID NO: 871572 - RNA, 19 nt, Homo sapiens
aaagccaucgugaacaaug

SEQ ID NO: 871573 - RNA, 19 nt, Homo sapiens
caccagggcaacaccuuug

SEQ ID NO: 871574 - RNA, 19 nt, Homo sapiens
gcacaacucuagcauaucu

SEQ ID NO: 871575 - RNA, 19 nt, Homo sapiens
gaacaaugccuucaaacau

SEQ ID NO: 871576 - RNA, 19 nt, Homo sapiens
guggauggguugcuuuaua

SEQ ID NO: 871577 - RNA, 19 nt, Homo sapiens
gaucaugccuucugugucu

SEQ ID NO: 871578 - RNA, 19 nt, Homo sapiens
aacaaugccuucaaacaua

SEQ ID NO: 871579 - RNA, 19 nt, Homo sapiens
gagaagcaguggaaugugu

SEQ ID NO: 871580 - RNA, 19 nt, Homo sapiens
ggagaaagccaaagaccuu

SEQ ID NO: 871581 - RNA, 19 nt, Homo sapiens
ugaccaagguauccuacua

SEQ ID NO: 871582 - RNA, 19 nt, Homo sapiens
gagcagcuguucccuguag

SEQ ID NO: 871583 - RNA, 19 nt, Homo sapiens
ucaaagccaucgugaacaa

SEQ ID NO: 871584 - RNA, 19 nt, Homo sapiens
ggacaaguggugaauauca

SEQ ID NO: 871585 - RNA, 19 nt, Homo sapiens
uggauggguugcuuuauaa

SEQ ID NO: 871586 - RNA, 19 nt, Homo sapiens
ggacagaagaggagaagau

SEQ ID NO: 871587 - RNA, 19 nt, Homo sapiens
uggcacaacucuagcauau

SEQ ID NO: 871588 - RNA, 19 nt, Homo sapiens
caucaacagugccuuuaug

SEQ ID NO: 871589 - RNA, 19 nt, Homo sapiens
gacaaguggugaauaucaa

SEQ ID NO: 871590 - RNA, 19 nt, Homo sapiens
aaaugugccuggugcauga

SEQ ID NO: 871591 - RNA, 19 nt, Homo sapiens
uguuaagagucccuuguua

SEQ ID NO: 871592 - RNA, 19 nt, Homo sapiens
gggcuccgcuauuugcaaa

SEQ ID NO: 871593 - RNA, 19 nt, Homo sapiens
gcgcgaugauccagaaugu

SEQ ID NO: 871594 - RNA, 19 nt, Homo sapiens
gauccagaaugucggaaau

SEQ ID NO: 871595 - RNA, 19 nt, Homo sapiens
gaccuugccucucuggaau

SEQ ID NO: 871596 - RNA, 19 nt, Homo sapiens
acaauaacgucuccuccuu

SEQ ID NO: 871597 - RNA, 19 nt, Homo sapiens
ugucacagcuuccauggau

SEQ ID NO: 871598 - RNA, 19 nt, Homo sapiens
ccacggaggugcagaugag

SEQ ID NO: 871599 - RNA, 19 nt, Homo sapiens
gcugaggacuggucugaag

SEQ ID NO: 871600 - RNA, 19 nt, Homo sapiens
caggguaugguguaaauaa

SEQ ID NO: 871601 - RNA, 19 nt, Homo sapiens
gauguugccacuuggagua

SEQ ID NO: 871602 - RNA, 19 nt, Homo sapiens
gucaggauguugccacuug

SEQ ID NO: 871603 - RNA, 19 nt, Homo sapiens
ucaacuaugugaccaccaa

SEQ ID NO: 871604 - RNA, 19 nt, Homo sapiens
aauaacgucuccuccuuga

SEQ ID NO: 871605 - RNA, 19 nt, Homo sapiens
gccgagagaucaccaaggu

SEQ ID NO: 871606 - RNA, 19 nt, Homo sapiens
gaggaccugugcucugaga

SEQ ID NO: 871607 - RNA, 19 nt, Homo sapiens
uuucagcucuuggccuuua

SEQ ID NO: 871608 - RNA, 19 nt, Homo sapiens
gggcuuggccucuguguuc

SEQ ID NO: 871609 - RNA, 19 nt, Homo sapiens
ggaccuugccucucuggaa

SEQ ID NO: 871610 - RNA, 19 nt, Homo sapiens
gcaggaucaugccuucugu

SEQ ID NO: 871611 - RNA, 19 nt, Homo sapiens
ggguugugcuccacuguga

SEQ ID NO: 871612 - RNA, 19 nt, Homo sapiens
caagguauccuacuacaac

SEQ ID NO: 871613 - RNA, 19 nt, Homo sapiens
gggaccagcugaccaaggu

SEQ ID NO: 871614 - RNA, 19 nt, Homo sapiens
cggaggaccugugcucuga

SEQ ID NO: 871615 - RNA, 19 nt, Homo sapiens
cagguguucucaacuaugu

SEQ ID NO: 871616 - RNA, 19 nt, Homo sapiens
ccacaucaacagugccuuu

SEQ ID NO: 871617 - RNA, 19 nt, Homo sapiens
gcucaaagccaucgugaac

SEQ ID NO: 871618 - RNA, 19 nt, Homo sapiens
gcucugagaagcaguggaa

SEQ ID NO: 871619 - RNA, 19 nt, Homo sapiens
ccacuuggaguaugaacaa

SEQ ID NO: 871620 - RNA, 19 nt, Homo sapiens
gaaucugucaacccaguuu

SEQ ID NO: 871621 - RNA, 19 nt, Homo sapiens
uguacacucuggaggauga

SEQ ID NO: 871622 - RNA, 19 nt, Homo sapiens
guguuuaggauuuggguua

SEQ ID NO: 871623 - RNA, 19 nt, Homo sapiens
uaacgucuccuccuugaag

SEQ ID NO: 871624 - RNA, 19 nt, Homo sapiens
gaagacccguguggagagu

SEQ ID NO: 871625 - RNA, 19 nt, Homo sapiens
cagaagaggagaagaugga

SEQ ID NO: 871626 - RNA, 19 nt, Homo sapiens
gcccugugcucuugacauc

SEQ ID NO: 871627 - RNA, 19 nt, Homo sapiens
gugaccagcuugugucucu

SEQ ID NO: 871628 - RNA, 19 nt, Homo sapiens
ucacagcuuccauggauga

SEQ ID NO: 871629 - RNA, 19 nt, Homo sapiens
acaaugccuucaaacauag

SEQ ID NO: 871630 - RNA, 19 nt, Homo sapiens
gugagcaguuucucuugga

SEQ ID NO: 871631 - RNA, 19 nt, Homo sapiens
cauccaggguaugguguaa

SEQ ID NO: 871632 - RNA, 19 nt, Homo sapiens
gagaggccagugccagaaa

SEQ ID NO: 871633 - RNA, 19 nt, Homo sapiens
uuggacaaguggugaauau

SEQ ID NO: 871634 - RNA, 19 nt, Homo sapiens
ucgggcagcugcucaagug

SEQ ID NO: 871635 - RNA, 19 nt, Homo sapiens
gcauggugccggcugagaa

SEQ ID NO: 871636 - RNA, 19 nt, Homo sapiens
gauggguugcuuuauaaau

SEQ ID NO: 871637 - RNA, 19 nt, Homo sapiens
uaccugagcuacaauaacg

SEQ ID NO: 871638 - RNA, 19 nt, Homo sapiens
ucuggaggaugacaaguuc

SEQ ID NO: 871639 - RNA, 19 nt, Homo sapiens
caccuugcauccaggguau

SEQ ID NO: 871640 - RNA, 19 nt, Homo sapiens
ccagguggauggguugcuu

SEQ ID NO: 871641 - RNA, 19 nt, Homo sapiens
uggccuggauggagaaugu

SEQ ID NO: 871642 - RNA, 19 nt, Homo sapiens
aggguaugguguaaauaaa

SEQ ID NO: 871643 - RNA, 19 nt, Homo sapiens
cagcuuccauggaugacau

SEQ ID NO: 871644 - RNA, 19 nt, Homo sapiens
auggguugcuuuauaaaug

SEQ ID NO: 871645 - RNA, 19 nt, Homo sapiens
ggauggguugcuuuauaaa

SEQ ID NO: 871646 - RNA, 19 nt, Homo sapiens
caccauuaguguuggacaa

SEQ ID NO: 871647 - RNA, 19 nt, Homo sapiens
uaucauaagguguuaagag

SEQ ID NO: 871648 - RNA, 19 nt, Homo sapiens
guugccacuuggaguauga

SEQ ID NO: 871649 - RNA, 19 nt, Homo sapiens
caacaugagccagcaaguc

SEQ ID NO: 871650 - RNA, 19 nt, Homo sapiens
ggugcucaguuucuaccaa

SEQ ID NO: 871651 - RNA, 19 nt, Homo sapiens
gguguucucaacuauguga

SEQ ID NO: 871652 - RNA, 19 nt, Homo sapiens
gagagacgccagaguacag

SEQ ID NO: 871653 - RNA, 19 nt, Homo sapiens
gacagaagaggagaagaug

SEQ ID NO: 871654 - RNA, 19 nt, Homo sapiens
cauuaguguuggacaagug

SEQ ID NO: 871655 - RNA, 19 nt, Homo sapiens
ggagcuagugcagcaggua

SEQ ID NO: 871656 - RNA, 19 nt, Homo sapiens
aggugaagcugaagcagau

SEQ ID NO: 871657 - RNA, 19 nt, Homo sapiens
uccaggguaugguguaaau

SEQ ID NO: 871658 - RNA, 19 nt, Homo sapiens
gcauccaggguauggugua

SEQ ID NO: 871659 - RNA, 19 nt, Homo sapiens
gcucuugacaucacuguac

SEQ ID NO: 871660 - RNA, 19 nt, Homo sapiens
uggguugcuuuauaaaugu

SEQ ID NO: 871661 - RNA, 19 nt, Homo sapiens
uaggauuuggguuaucaua

SEQ ID NO: 871662 - RNA, 19 nt, Homo sapiens
ggaccugugcucugagaag

SEQ ID NO: 871663 - RNA, 19 nt, Homo sapiens
uccagaaugucggaaauca

SEQ ID NO: 871664 - RNA, 19 nt, Homo sapiens
uaagagucccuuguuaaag

SEQ ID NO: 871665 - RNA, 19 nt, Homo sapiens
ggacaaccggaaugaucug

SEQ ID NO: 871666 - RNA, 19 nt, Homo sapiens
gaccagcugaccaagguau

SEQ ID NO: 871667 - RNA, 19 nt, Homo sapiens
cacaucaacagugccuuua

SEQ ID NO: 871668 - RNA, 19 nt, Homo sapiens
ggcagcugcucaaguggau

SEQ ID NO: 871669 - RNA, 19 nt, Homo sapiens
uggcagacggcgagggaua

SEQ ID NO: 871670 - RNA, 19 nt, Homo sapiens
ccugggugcucaguuucua

SEQ ID NO: 871671 - RNA, 19 nt, Homo sapiens
gccagugccagaaagaaga

SEQ ID NO: 871672 - RNA, 19 nt, Homo sapiens
gguaugguguaaauaaacc

SEQ ID NO: 871673 - RNA, 19 nt, Homo sapiens
cagcugcucaaguggauug

SEQ ID NO: 871674 - RNA, 19 nt, Homo sapiens
gaagcaggcuguagauuua

SEQ ID NO: 871675 - RNA, 19 nt, Homo sapiens
gaucagaaguggcuaauuu

SEQ ID NO: 871676 - RNA, 19 nt, Homo sapiens
gaaccaagguagaauuuaa

SEQ ID NO: 871677 - RNA, 19 nt, Homo sapiens
gaagaucugugucauauug

SEQ ID NO: 871678 - RNA, 19 nt, Homo sapiens
gcagcagucuugaauaaua

SEQ ID NO: 871679 - RNA, 19 nt, Homo sapiens
ggaaauuucuccuuaguga

SEQ ID NO: 871680 - RNA, 19 nt, Homo sapiens
gcuaaucacuguaccauuu

SEQ ID NO: 871681 - RNA, 19 nt, Homo sapiens
gaauugauguucuugcuuu

SEQ ID NO: 871682 - RNA, 19 nt, Homo sapiens
ucagacagcucuugaauug

SEQ ID NO: 871683 - RNA, 19 nt, Homo sapiens
gaaugaaauugccauguuu

SEQ ID NO: 871684 - RNA, 19 nt, Homo sapiens
gcaaugcuauggaauauca

SEQ ID NO: 871685 - RNA, 19 nt, Homo sapiens
gggagaggauauaagauua

SEQ ID NO: 871686 - RNA, 19 nt, Homo sapiens
agaagaagcugaaauacaa

SEQ ID NO: 871687 - RNA, 19 nt, Homo sapiens
ucaagaaccugcaugauga

SEQ ID NO: 871688 - RNA, 19 nt, Homo sapiens
gcaaauccauggaaauugu

SEQ ID NO: 871689 - RNA, 19 nt, Homo sapiens
gaaaguagacucuccauca

SEQ ID NO: 871690 - RNA, 19 nt, Homo sapiens
ggacaagggcuuccaguuu

SEQ ID NO: 871691 - RNA, 19 nt, Homo sapiens
ggaacaaagugaccucuug

SEQ ID NO: 871692 - RNA, 19 nt, Homo sapiens
gagcacaucuaccaucuga

SEQ ID NO: 871693 - RNA, 19 nt, Homo sapiens
cuacauacacuacaaguua

SEQ ID NO: 871694 - RNA, 19 nt, Homo sapiens
ccaggugcauuaagaaaua

SEQ ID NO: 871695 - RNA, 19 nt, Homo sapiens
cagagcauaucgaauguua

SEQ ID NO: 871696 - RNA, 19 nt, Homo sapiens
gcauuguacuaaucuguua

SEQ ID NO: 871697 - RNA, 19 nt, Homo sapiens
acaacuggaugaaacauua

SEQ ID NO: 871698 - RNA, 19 nt, Homo sapiens
gcacgugacuggcauuuua

SEQ ID NO: 871699 - RNA, 19 nt, Homo sapiens
aaccaaagccuaauuguua

SEQ ID NO: 871700 - RNA, 19 nt, Homo sapiens
gcacagcgcucagguuuua

SEQ ID NO: 871701 - RNA, 19 nt, Homo sapiens
aaagaacgcuuacgcagaa

SEQ ID NO: 871702 - RNA, 19 nt, Homo sapiens
gaauguaucgucagaauga

SEQ ID NO: 871703 - RNA, 19 nt, Homo sapiens
gaugaaacauuacgucugu

SEQ ID NO: 871704 - RNA, 19 nt, Homo sapiens
ggaagcaggcuguagauuu

SEQ ID NO: 871705 - RNA, 19 nt, Homo sapiens
uuaaagaugucaagccuaa

SEQ ID NO: 871706 - RNA, 19 nt, Homo sapiens
guagucaucuuauuugaga

SEQ ID NO: 871707 - RNA, 19 nt, Homo sapiens
agacaaauguagagaauug

SEQ ID NO: 871708 - RNA, 19 nt, Homo sapiens
ggacaaaggaaucuugaaa

SEQ ID NO: 871709 - RNA, 19 nt, Homo sapiens
gugauaaucuuuccuuaga

SEQ ID NO: 871710 - RNA, 19 nt, Homo sapiens
ggaaaagaaugcaugauuu

SEQ ID NO: 871711 - RNA, 19 nt, Homo sapiens
gaagggaacuuagaagaag

SEQ ID NO: 871712 - RNA, 19 nt, Homo sapiens
gaaguucuguuaucuccaa

SEQ ID NO: 871713 - RNA, 19 nt, Homo sapiens
ggaaugucccaguuuaaua

SEQ ID NO: 871714 - RNA, 19 nt, Homo sapiens
gaacuuagaagaagcugaa

SEQ ID NO: 871715 - RNA, 19 nt, Homo sapiens
gugcguuucuuuacaauuu

SEQ ID NO: 871716 - RNA, 19 nt, Homo sapiens
gcuggagucugaagaauau

SEQ ID NO: 871717 - RNA, 19 nt, Homo sapiens
gaacaacugcagagagaaa

SEQ ID NO: 871718 - RNA, 19 nt, Homo sapiens
gaugcauccugauauuaua

SEQ ID NO: 871719 - RNA, 19 nt, Homo sapiens
ggaagcauuugaacuuguu

SEQ ID NO: 871720 - RNA, 19 nt, Homo sapiens
gcgcuggaauuaaaugaaa

SEQ ID NO: 871721 - RNA, 19 nt, Homo sapiens
gaagcgaagucccggagaa

SEQ ID NO: 871722 - RNA, 19 nt, Homo sapiens
gaggauaaauguagaaucg

SEQ ID NO: 871723 - RNA, 19 nt, Homo sapiens
gaugaucacuugugcuuag

SEQ ID NO: 871724 - RNA, 19 nt, Homo sapiens
ggaaaccugcgucauguaa

SEQ ID NO: 871725 - RNA, 19 nt, Homo sapiens
uauggaaugucccaguuua

SEQ ID NO: 871726 - RNA, 19 nt, Homo sapiens
caaugcagcuucuccaugu

SEQ ID NO: 871727 - RNA, 19 nt, Homo sapiens
gaagaaccaagguagaauu

SEQ ID NO: 871728 - RNA, 19 nt, Homo sapiens
uagaacaccuugacauuuc

SEQ ID NO: 871729 - RNA, 19 nt, Homo sapiens
acagaaacguggcaucauu

SEQ ID NO: 871730 - RNA, 19 nt, Homo sapiens
guagaaucgugguaauauu

SEQ ID NO: 871731 - RNA, 19 nt, Homo sapiens
gaaugucccaguuuaauau

SEQ ID NO: 871732 - RNA, 19 nt, Homo sapiens
gagagacaguaggaaauuu

SEQ ID NO: 871733 - RNA, 19 nt, Homo sapiens
ggaagggaacuuagaagaa

SEQ ID NO: 871734 - RNA, 19 nt, Homo sapiens
gagagauugucaucaagaa

SEQ ID NO: 871735 - RNA, 19 nt, Homo sapiens
uggcaaagaugcuaaagga

SEQ ID NO: 871736 - RNA, 19 nt, Homo sapiens
ggaaugcagugaucagaag

SEQ ID NO: 871737 - RNA, 19 nt, Homo sapiens
ggugaugcauccugauauu

SEQ ID NO: 871738 - RNA, 19 nt, Homo sapiens
gauuauaacuacugaaagg

SEQ ID NO: 871739 - RNA, 19 nt, Homo sapiens
ucuccaagcucuucagaaa

SEQ ID NO: 871740 - RNA, 19 nt, Homo sapiens
guccagagcuauuggcaaa

SEQ ID NO: 871741 - RNA, 19 nt, Homo sapiens
agaaugaaauugccauguu

SEQ ID NO: 871742 - RNA, 19 nt, Homo sapiens
gauauuaacaccggcauaa

SEQ ID NO: 871743 - RNA, 19 nt, Homo sapiens
ccauuugaguuacauguuu

SEQ ID NO: 871744 - RNA, 19 nt, Homo sapiens
gugguaauauuggcuguua

SEQ ID NO: 871745 - RNA, 19 nt, Homo sapiens
gcuggaagcaagccauuua

SEQ ID NO: 871746 - RNA, 19 nt, Homo sapiens
aagaagaucugugucauau

SEQ ID NO: 871747 - RNA, 19 nt, Homo sapiens
caaagaugcuaaaggaaca

SEQ ID NO: 871748 - RNA, 19 nt, Homo sapiens
gccaagagccaaaccgaua

SEQ ID NO: 871749 - RNA, 19 nt, Homo sapiens
gcaauacuauagcuucaca

SEQ ID NO: 871750 - RNA, 19 nt, Homo sapiens
caagaagaucugugucaua

SEQ ID NO: 871751 - RNA, 19 nt, Homo sapiens
ccagauuuaucaugaguga

SEQ ID NO: 871752 - RNA, 19 nt, Homo sapiens
gcacugucauguggcauuu

SEQ ID NO: 871753 - RNA, 19 nt, Homo sapiens
gguguaugcuuuguucuuu

SEQ ID NO: 871754 - RNA, 19 nt, Homo sapiens
gcugaguccuugagaaguu

SEQ ID NO: 871755 - RNA, 19 nt, Homo sapiens
gcacaaaacacagaucuua

SEQ ID NO: 871756 - RNA, 19 nt, Homo sapiens
ucauguagcuaguugaaug

SEQ ID NO: 871757 - RNA, 19 nt, Homo sapiens
gguccuaacuaaagagaug

SEQ ID NO: 871758 - RNA, 19 nt, Homo sapiens
ggauucugguccuaacuaa

SEQ ID NO: 871759 - RNA, 19 nt, Homo sapiens
caaauaaccaguuggacaa

SEQ ID NO: 871760 - RNA, 19 nt, Homo sapiens
guagaacaccuugacauuu

SEQ ID NO: 871761 - RNA, 19 nt, Homo sapiens
caacggcaccuauuuggaa

SEQ ID NO: 871762 - RNA, 19 nt, Homo sapiens
ggaaauggcaugaaagcau

SEQ ID NO: 871763 - RNA, 19 nt, Homo sapiens
uggaaaggaugguauaugu

SEQ ID NO: 871764 - RNA, 19 nt, Homo sapiens
gcgaggagcuggaguacag

SEQ ID NO: 871765 - RNA, 19 nt, Homo sapiens
ccaaaccgauauagagaga

SEQ ID NO: 871766 - RNA, 19 nt, Homo sapiens
guacuagcaucuauaaagg

SEQ ID NO: 871767 - RNA, 19 nt, Homo sapiens
ggagaggauauaagauuaa

SEQ ID NO: 871768 - RNA, 19 nt, Homo sapiens
gagcaauacuauagcuuca

SEQ ID NO: 871769 - RNA, 19 nt, Homo sapiens
aaaccgagcucuaguucau

SEQ ID NO: 871770 - RNA, 19 nt, Homo sapiens
cagaauguaucgucagaau

SEQ ID NO: 871771 - RNA, 19 nt, Homo sapiens
gcuauggaauaucaaguau

SEQ ID NO: 871772 - RNA, 19 nt, Homo sapiens
gcaccuauuuggaacuuag

SEQ ID NO: 871773 - RNA, 19 nt, Homo sapiens
gcagaggauugaacaacug

SEQ ID NO: 871774 - RNA, 19 nt, Homo sapiens
gaagcaggcuguagauuua

SEQ ID NO: 871775 - RNA, 19 nt, Homo sapiens
gaucagaaguggcuaauuu

SEQ ID NO: 871776 - RNA, 19 nt, Homo sapiens
gaaccaagguagaauuuaa

SEQ ID NO: 871777 - RNA, 19 nt, Homo sapiens
gaagaucugugucauauug

SEQ ID NO: 871778 - RNA, 19 nt, Homo sapiens
gcagcagucuugaauaaua

SEQ ID NO: 871779 - RNA, 19 nt, Homo sapiens
ggaaauuucuccuuaguga

SEQ ID NO: 871780 - RNA, 19 nt, Homo sapiens
gcuaaucacuguaccauuu

SEQ ID NO: 871781 - RNA, 19 nt, Homo sapiens
gaauugauguucuugcuuu

SEQ ID NO: 871782 - RNA, 19 nt, Homo sapiens
ucagacagcucuugaauug

SEQ ID NO: 871783 - RNA, 19 nt, Homo sapiens
gaaugaaauugccauguuu

SEQ ID NO: 871784 - RNA, 19 nt, Homo sapiens
gcaaugcuauggaauauca

SEQ ID NO: 871785 - RNA, 19 nt, Homo sapiens
gggagaggauauaagauua

SEQ ID NO: 871786 - RNA, 19 nt, Homo sapiens
agaagaagcugaaauacaa

SEQ ID NO: 871787 - RNA, 19 nt, Homo sapiens
ucaagaaccugcaugauga

SEQ ID NO: 871788 - RNA, 19 nt, Homo sapiens
gcaaauccauggaaauugu

SEQ ID NO: 871789 - RNA, 19 nt, Homo sapiens
gaaaguagacucuccauca

SEQ ID NO: 871790 - RNA, 19 nt, Homo sapiens
ggacaagggcuuccaguuu

SEQ ID NO: 871791 - RNA, 19 nt, Homo sapiens
ggaacaaagugaccucuug

SEQ ID NO: 871792 - RNA, 19 nt, Homo sapiens
gagcacaucuaccaucuga

SEQ ID NO: 871793 - RNA, 19 nt, Homo sapiens
cuacauacacuacaaguua

SEQ ID NO: 871794 - RNA, 19 nt, Homo sapiens
ccaggugcauuaagaaaua

SEQ ID NO: 871795 - RNA, 19 nt, Homo sapiens
cagagcauaucgaauguua

SEQ ID NO: 871796 - RNA, 19 nt, Homo sapiens
gcauuguacuaaucuguua

SEQ ID NO: 871797 - RNA, 19 nt, Homo sapiens
acaacuggaugaaacauua

SEQ ID NO: 871798 - RNA, 19 nt, Homo sapiens
gcacgugacuggcauuuua

SEQ ID NO: 871799 - RNA, 19 nt, Homo sapiens
aaccaaagccuaauuguua

SEQ ID NO: 871800 - RNA, 19 nt, Homo sapiens
gcacagcgcucagguuuua

SEQ ID NO: 871801 - RNA, 19 nt, Homo sapiens
aaagaacgcuuacgcagaa

SEQ ID NO: 871802 - RNA, 19 nt, Homo sapiens
gaauguaucgucagaauga

SEQ ID NO: 871803 - RNA, 19 nt, Homo sapiens
gaugaaacauuacgucugu

SEQ ID NO: 871804 - RNA, 19 nt, Homo sapiens
ggaagcaggcuguagauuu

SEQ ID NO: 871805 - RNA, 19 nt, Homo sapiens
uuaaagaugucaagccuaa

SEQ ID NO: 871806 - RNA, 19 nt, Homo sapiens
guagucaucuuauuugaga

SEQ ID NO: 871807 - RNA, 19 nt, Homo sapiens
agacaaauguagagaauug

SEQ ID NO: 871808 - RNA, 19 nt, Homo sapiens
ggacaaaggaaucuugaaa

SEQ ID NO: 871809 - RNA, 19 nt, Homo sapiens
gugauaaucuuuccuuaga

SEQ ID NO: 871810 - RNA, 19 nt, Homo sapiens
ggaaaagaaugcaugauuu

SEQ ID NO: 871811 - RNA, 19 nt, Homo sapiens
gaagggaacuuagaagaag

SEQ ID NO: 871812 - RNA, 19 nt, Homo sapiens
gaaguucuguuaucuccaa

SEQ ID NO: 871813 - RNA, 19 nt, Homo sapiens
ggaaugucccaguuuaaua

SEQ ID NO: 871814 - RNA, 19 nt, Homo sapiens
gaacuuagaagaagcugaa

SEQ ID NO: 871815 - RNA, 19 nt, Homo sapiens
gugcguuucuuuacaauuu

SEQ ID NO: 871816 - RNA, 19 nt, Homo sapiens
gcuggagucugaagaauau

SEQ ID NO: 871817 - RNA, 19 nt, Homo sapiens
gaacaacugcagagagaaa

SEQ ID NO: 871818 - RNA, 19 nt, Homo sapiens
gaugcauccugauauuaua

SEQ ID NO: 871819 - RNA, 19 nt, Homo sapiens
ggaagcauuugaacuuguu

SEQ ID NO: 871820 - RNA, 19 nt, Homo sapiens
gcgcuggaauuaaaugaaa

SEQ ID NO: 871821 - RNA, 19 nt, Homo sapiens
gaagcgaagucccggagaa

SEQ ID NO: 871822 - RNA, 19 nt, Homo sapiens
gaggauaaauguagaaucg

SEQ ID NO: 871823 - RNA, 19 nt, Homo sapiens
gaugaucacuugugcuuag

SEQ ID NO: 871824 - RNA, 19 nt, Homo sapiens
ggaaaccugcgucauguaa

SEQ ID NO: 871825 - RNA, 19 nt, Homo sapiens
uauggaaugucccaguuua

SEQ ID NO: 871826 - RNA, 19 nt, Homo sapiens
caaugcagcuucuccaugu

SEQ ID NO: 871827 - RNA, 19 nt, Homo sapiens
gaagaaccaagguagaauu

SEQ ID NO: 871828 - RNA, 19 nt, Homo sapiens
uagaacaccuugacauuuc

SEQ ID NO: 871829 - RNA, 19 nt, Homo sapiens
acagaaacguggcaucauu

SEQ ID NO: 871830 - RNA, 19 nt, Homo sapiens
guagaaucgugguaauauu

SEQ ID NO: 871831 - RNA, 19 nt, Homo sapiens
gaaugucccaguuuaauau

SEQ ID NO: 871832 - RNA, 19 nt, Homo sapiens
gagagacaguaggaaauuu

SEQ ID NO: 871833 - RNA, 19 nt, Homo sapiens
ggaagggaacuuagaagaa

SEQ ID NO: 871834 - RNA, 19 nt, Homo sapiens
gagagauugucaucaagaa

SEQ ID NO: 871835 - RNA, 19 nt, Homo sapiens
ggaaugcagugaucagaag

SEQ ID NO: 871836 - RNA, 19 nt, Homo sapiens
ggugaugcauccugauauu

SEQ ID NO: 871837 - RNA, 19 nt, Homo sapiens
gauuauaacuacugaaagg

SEQ ID NO: 871838 - RNA, 19 nt, Homo sapiens
ucuccaagcucuucagaaa

SEQ ID NO: 871839 - RNA, 19 nt, Homo sapiens
agaaugaaauugccauguu

SEQ ID NO: 871840 - RNA, 19 nt, Homo sapiens
gauauuaacaccggcauaa

SEQ ID NO: 871841 - RNA, 19 nt, Homo sapiens
ccauuugaguuacauguuu

SEQ ID NO: 871842 - RNA, 19 nt, Homo sapiens
gugguaauauuggcuguua

SEQ ID NO: 871843 - RNA, 19 nt, Homo sapiens
gcuggaagcaagccauuua

SEQ ID NO: 871844 - RNA, 19 nt, Homo sapiens
aagaagaucugugucauau

SEQ ID NO: 871845 - RNA, 19 nt, Homo sapiens
gccaagagccaaaccgaua

SEQ ID NO: 871846 - RNA, 19 nt, Homo sapiens
gcaauacuauagcuucaca

SEQ ID NO: 871847 - RNA, 19 nt, Homo sapiens
caagaagaucugugucaua

SEQ ID NO: 871848 - RNA, 19 nt, Homo sapiens
ccagauuuaucaugaguga

SEQ ID NO: 871849 - RNA, 19 nt, Homo sapiens
gcacugucauguggcauuu

SEQ ID NO: 871850 - RNA, 19 nt, Homo sapiens
gguguaugcuuuguucuuu

SEQ ID NO: 871851 - RNA, 19 nt, Homo sapiens
gcugaguccuugagaaguu

SEQ ID NO: 871852 - RNA, 19 nt, Homo sapiens
gcacaaaacacagaucuua

SEQ ID NO: 871853 - RNA, 19 nt, Homo sapiens
ucauguagcuaguugaaug

SEQ ID NO: 871854 - RNA, 19 nt, Homo sapiens
gguccuaacuaaagagaug

SEQ ID NO: 871855 - RNA, 19 nt, Homo sapiens
ggauucugguccuaacuaa

SEQ ID NO: 871856 - RNA, 19 nt, Homo sapiens
caaauaaccaguuggacaa

SEQ ID NO: 871857 - RNA, 19 nt, Homo sapiens
guagaacaccuugacauuu

SEQ ID NO: 871858 - RNA, 19 nt, Homo sapiens
caacggcaccuauuuggaa

SEQ ID NO: 871859 - RNA, 19 nt, Homo sapiens
ggaaauggcaugaaagcau

SEQ ID NO: 871860 - RNA, 19 nt, Homo sapiens
uggaaaggaugguauaugu

SEQ ID NO: 871861 - RNA, 19 nt, Homo sapiens
gcgaggagcuggaguacag

SEQ ID NO: 871862 - RNA, 19 nt, Homo sapiens
ccaaaccgauauagagaga

SEQ ID NO: 871863 - RNA, 19 nt, Homo sapiens
guacuagcaucuauaaagg

SEQ ID NO: 871864 - RNA, 19 nt, Homo sapiens
ggagaggauauaagauuaa

SEQ ID NO: 871865 - RNA, 19 nt, Homo sapiens
gagcaauacuauagcuuca

SEQ ID NO: 871866 - RNA, 19 nt, Homo sapiens
aaaccgagcucuaguucau

SEQ ID NO: 871867 - RNA, 19 nt, Homo sapiens
cagaauguaucgucagaau

SEQ ID NO: 871868 - RNA, 19 nt, Homo sapiens
gcuauggaauaucaaguau

SEQ ID NO: 871869 - RNA, 19 nt, Homo sapiens
gcaccuauuuggaacuuag

SEQ ID NO: 871870 - RNA, 19 nt, Homo sapiens
gcagaggauugaacaacug

SEQ ID NO: 871871 - RNA, 19 nt, Homo sapiens
gcaaaauacuggagcacua

SEQ ID NO: 871872 - RNA, 19 nt, Homo sapiens
gacaagggcuuccaguuuu

SEQ ID NO: 871873 - RNA, 19 nt, Homo sapiens
ggaacaacaucgggaagga

SEQ ID NO: 871874 - RNA, 19 nt, Homo sapiens
gaagcaggcuguagauuua

SEQ ID NO: 871875 - RNA, 19 nt, Homo sapiens
gaucagaaguggcuaauuu

SEQ ID NO: 871876 - RNA, 19 nt, Homo sapiens
gaaccaagguagaauuuaa

SEQ ID NO: 871877 - RNA, 19 nt, Homo sapiens
gaagaucugugucauauug

SEQ ID NO: 871878 - RNA, 19 nt, Homo sapiens
gcagcagucuugaauaaua

SEQ ID NO: 871879 - RNA, 19 nt, Homo sapiens
ggaaauuucuccuuaguga

SEQ ID NO: 871880 - RNA, 19 nt, Homo sapiens
gcuaaucacuguaccauuu

SEQ ID NO: 871881 - RNA, 19 nt, Homo sapiens
gaauugauguucuugcuuu

SEQ ID NO: 871882 - RNA, 19 nt, Homo sapiens
ucagacagcucuugaauug

SEQ ID NO: 871883 - RNA, 19 nt, Homo sapiens
gaaugaaauugccauguuu

SEQ ID NO: 871884 - RNA, 19 nt, Homo sapiens
gcaaugcuauggaauauca

SEQ ID NO: 871885 - RNA, 19 nt, Homo sapiens
gggagaggauauaagauua

SEQ ID NO: 871886 - RNA, 19 nt, Homo sapiens
agaagaagcugaaauacaa

SEQ ID NO: 871887 - RNA, 19 nt, Homo sapiens
ucaagaaccugcaugauga

SEQ ID NO: 871888 - RNA, 19 nt, Homo sapiens
gcaaauccauggaaauugu

SEQ ID NO: 871889 - RNA, 19 nt, Homo sapiens
gaaaguagacucuccauca

SEQ ID NO: 871890 - RNA, 19 nt, Homo sapiens
ggacaagggcuuccaguuu

SEQ ID NO: 871891 - RNA, 19 nt, Homo sapiens
ggaacaaagugaccucuug

SEQ ID NO: 871892 - RNA, 19 nt, Homo sapiens
gagcacaucuaccaucuga

SEQ ID NO: 871893 - RNA, 19 nt, Homo sapiens
cuacauacacuacaaguua

SEQ ID NO: 871894 - RNA, 19 nt, Homo sapiens
ccaggugcauuaagaaaua

SEQ ID NO: 871895 - RNA, 19 nt, Homo sapiens
cagagcauaucgaauguua

SEQ ID NO: 871896 - RNA, 19 nt, Homo sapiens
gcauuguacuaaucuguua

SEQ ID NO: 871897 - RNA, 19 nt, Homo sapiens
acaacuggaugaaacauua

SEQ ID NO: 871898 - RNA, 19 nt, Homo sapiens
gcacgugacuggcauuuua

SEQ ID NO: 871899 - RNA, 19 nt, Homo sapiens
aaccaaagccuaauuguua

SEQ ID NO: 871900 - RNA, 19 nt, Homo sapiens
gcacagcgcucagguuuua

SEQ ID NO: 871901 - RNA, 19 nt, Homo sapiens
gaauguaucgucagaauga

SEQ ID NO: 871902 - RNA, 19 nt, Homo sapiens
gaugaaacauuacgucugu

SEQ ID NO: 871903 - RNA, 19 nt, Homo sapiens
ggaagcaggcuguagauuu

SEQ ID NO: 871904 - RNA, 19 nt, Homo sapiens
uuaaagaugucaagccuaa

SEQ ID NO: 871905 - RNA, 19 nt, Homo sapiens
guagucaucuuauuugaga

SEQ ID NO: 871906 - RNA, 19 nt, Homo sapiens
agacaaauguagagaauug

SEQ ID NO: 871907 - RNA, 19 nt, Homo sapiens
ggacaaaggaaucuugaaa

SEQ ID NO: 871908 - RNA, 19 nt, Homo sapiens
gugauaaucuuuccuuaga

SEQ ID NO: 871909 - RNA, 19 nt, Homo sapiens
ggaaaagaaugcaugauuu

SEQ ID NO: 871910 - RNA, 19 nt, Homo sapiens
gaagggaacuuagaagaag

SEQ ID NO: 871911 - RNA, 19 nt, Homo sapiens
gaaguucuguuaucuccaa

SEQ ID NO: 871912 - RNA, 19 nt, Homo sapiens
ggaaugucccaguuuaaua

SEQ ID NO: 871913 - RNA, 19 nt, Homo sapiens
gaacuuagaagaagcugaa

SEQ ID NO: 871914 - RNA, 19 nt, Homo sapiens
gugcguuucuuuacaauuu

SEQ ID NO: 871915 - RNA, 19 nt, Homo sapiens
gcuggagucugaagaauau

SEQ ID NO: 871916 - RNA, 19 nt, Homo sapiens
gaacaacugcagagagaaa

SEQ ID NO: 871917 - RNA, 19 nt, Homo sapiens
gaugcauccugauauuaua

SEQ ID NO: 871918 - RNA, 19 nt, Homo sapiens
ggaagcauuugaacuuguu

SEQ ID NO: 871919 - RNA, 19 nt, Homo sapiens
gcgcuggaauuaaaugaaa

SEQ ID NO: 871920 - RNA, 19 nt, Homo sapiens
gaagcgaagucccggagaa

SEQ ID NO: 871921 - RNA, 19 nt, Homo sapiens
gaggauaaauguagaaucg

SEQ ID NO: 871922 - RNA, 19 nt, Homo sapiens
gaugaucacuugugcuuag

SEQ ID NO: 871923 - RNA, 19 nt, Homo sapiens
ggaaaccugcgucauguaa

SEQ ID NO: 871924 - RNA, 19 nt, Homo sapiens
uauggaaugucccaguuua

SEQ ID NO: 871925 - RNA, 19 nt, Homo sapiens
caaugcagcuucuccaugu

SEQ ID NO: 871926 - RNA, 19 nt, Homo sapiens
gaagaaccaagguagaauu

SEQ ID NO: 871927 - RNA, 19 nt, Homo sapiens
uagaacaccuugacauuuc

SEQ ID NO: 871928 - RNA, 19 nt, Homo sapiens
acagaaacguggcaucauu

SEQ ID NO: 871929 - RNA, 19 nt, Homo sapiens
guagaaucgugguaauauu

SEQ ID NO: 871930 - RNA, 19 nt, Homo sapiens
gaaugucccaguuuaauau

SEQ ID NO: 871931 - RNA, 19 nt, Homo sapiens
gagagacaguaggaaauuu

SEQ ID NO: 871932 - RNA, 19 nt, Homo sapiens
ggaagggaacuuagaagaa

SEQ ID NO: 871933 - RNA, 19 nt, Homo sapiens
gagagauugucaucaagaa

SEQ ID NO: 871934 - RNA, 19 nt, Homo sapiens
uggcaaagaugcuaaagga

SEQ ID NO: 871935 - RNA, 19 nt, Homo sapiens
ggaaugcagugaucagaag

SEQ ID NO: 871936 - RNA, 19 nt, Homo sapiens
ggugaugcauccugauauu

SEQ ID NO: 871937 - RNA, 19 nt, Homo sapiens
gauuauaacuacugaaagg

SEQ ID NO: 871938 - RNA, 19 nt, Homo sapiens
ucuccaagcucuucagaaa

SEQ ID NO: 871939 - RNA, 19 nt, Homo sapiens
guccagagcuauuggcaaa

SEQ ID NO: 871940 - RNA, 19 nt, Homo sapiens
agaaugaaauugccauguu

SEQ ID NO: 871941 - RNA, 19 nt, Homo sapiens
gauauuaacaccggcauaa

SEQ ID NO: 871942 - RNA, 19 nt, Homo sapiens
ccauuugaguuacauguuu

SEQ ID NO: 871943 - RNA, 19 nt, Homo sapiens
gugguaauauuggcuguua

SEQ ID NO: 871944 - RNA, 19 nt, Homo sapiens
gcuggaagcaagccauuua

SEQ ID NO: 871945 - RNA, 19 nt, Homo sapiens
aagaagaucugugucauau

SEQ ID NO: 871946 - RNA, 19 nt, Homo sapiens
caaagaugcuaaaggaaca

SEQ ID NO: 871947 - RNA, 19 nt, Homo sapiens
gccaagagccaaaccgaua

SEQ ID NO: 871948 - RNA, 19 nt, Homo sapiens
gcaauacuauagcuucaca

SEQ ID NO: 871949 - RNA, 19 nt, Homo sapiens
caagaagaucugugucaua

SEQ ID NO: 871950 - RNA, 19 nt, Homo sapiens
ccagauuuaucaugaguga

SEQ ID NO: 871951 - RNA, 19 nt, Homo sapiens
gcacugucauguggcauuu

SEQ ID NO: 871952 - RNA, 19 nt, Homo sapiens
gguguaugcuuuguucuuu

SEQ ID NO: 871953 - RNA, 19 nt, Homo sapiens
gcugaguccuugagaaguu

SEQ ID NO: 871954 - RNA, 19 nt, Homo sapiens
ucauguagcuaguugaaug

SEQ ID NO: 871955 - RNA, 19 nt, Homo sapiens
gguccuaacuaaagagaug

SEQ ID NO: 871956 - RNA, 19 nt, Homo sapiens
ggauucugguccuaacuaa

SEQ ID NO: 871957 - RNA, 19 nt, Homo sapiens
caaauaaccaguuggacaa

SEQ ID NO: 871958 - RNA, 19 nt, Homo sapiens
guagaacaccuugacauuu

SEQ ID NO: 871959 - RNA, 19 nt, Homo sapiens
caacggcaccuauuuggaa

SEQ ID NO: 871960 - RNA, 19 nt, Homo sapiens
ggaaauggcaugaaagcau

SEQ ID NO: 871961 - RNA, 19 nt, Homo sapiens
uggaaaggaugguauaugu

SEQ ID NO: 871962 - RNA, 19 nt, Homo sapiens
gcgaggagcuggaguacag

SEQ ID NO: 871963 - RNA, 19 nt, Homo sapiens
ccaaaccgauauagagaga

SEQ ID NO: 871964 - RNA, 19 nt, Homo sapiens
guacuagcaucuauaaagg

SEQ ID NO: 871965 - RNA, 19 nt, Homo sapiens
ggagaggauauaagauuaa

SEQ ID NO: 871966 - RNA, 19 nt, Homo sapiens
gagcaauacuauagcuuca

SEQ ID NO: 871967 - RNA, 19 nt, Homo sapiens
aaaccgagcucuaguucau

SEQ ID NO: 871968 - RNA, 19 nt, Homo sapiens
cagaauguaucgucagaau

SEQ ID NO: 871969 - RNA, 19 nt, Homo sapiens
gcuauggaauaucaaguau

SEQ ID NO: 871970 - RNA, 19 nt, Homo sapiens
gcaccuauuuggaacuuag

SEQ ID NO: 871971 - RNA, 19 nt, Homo sapiens
gcagaggauugaacaacug

SEQ ID NO: 871972 - RNA, 19 nt, Homo sapiens
gcaaaauacuggagcacua

SEQ ID NO: 871973 - RNA, 19 nt, Homo sapiens
gacaagggcuuccaguuuu

SEQ ID NO: 871974 - RNA, 19 nt, Homo sapiens
gaagcaggcuguagauuua

SEQ ID NO: 871975 - RNA, 19 nt, Homo sapiens
gaucagaaguggcuaauuu

SEQ ID NO: 871976 - RNA, 19 nt, Homo sapiens
gaaccaagguagaauuuaa

SEQ ID NO: 871977 - RNA, 19 nt, Homo sapiens
gaagaucugugucauauug

SEQ ID NO: 871978 - RNA, 19 nt, Homo sapiens
gcagcagucuugaauaaua

SEQ ID NO: 871979 - RNA, 19 nt, Homo sapiens
ggaaauuucuccuuaguga

SEQ ID NO: 871980 - RNA, 19 nt, Homo sapiens
gcuaaucacuguaccauuu

SEQ ID NO: 871981 - RNA, 19 nt, Homo sapiens
gaauugauguucuugcuuu

SEQ ID NO: 871982 - RNA, 19 nt, Homo sapiens
ucagacagcucuugaauug

SEQ ID NO: 871983 - RNA, 19 nt, Homo sapiens
gaaugaaauugccauguuu

SEQ ID NO: 871984 - RNA, 19 nt, Homo sapiens
gcaaugcuauggaauauca

SEQ ID NO: 871985 - RNA, 19 nt, Homo sapiens
gggagaggauauaagauua

SEQ ID NO: 871986 - RNA, 19 nt, Homo sapiens
agaagaagcugaaauacaa

SEQ ID NO: 871987 - RNA, 19 nt, Homo sapiens
ucaagaaccugcaugauga

SEQ ID NO: 871988 - RNA, 19 nt, Homo sapiens
gcaaauccauggaaauugu

SEQ ID NO: 871989 - RNA, 19 nt, Homo sapiens
gaaaguagacucuccauca

SEQ ID NO: 871990 - RNA, 19 nt, Homo sapiens
ggacaagggcuuccaguuu

SEQ ID NO: 871991 - RNA, 19 nt, Homo sapiens
ggaacaaagugaccucuug

SEQ ID NO: 871992 - RNA, 19 nt, Homo sapiens
gagcacaucuaccaucuga

SEQ ID NO: 871993 - RNA, 19 nt, Homo sapiens
cuacauacacuacaaguua

SEQ ID NO: 871994 - RNA, 19 nt, Homo sapiens
ccaggugcauuaagaaaua

SEQ ID NO: 871995 - RNA, 19 nt, Homo sapiens
cagagcauaucgaauguua

SEQ ID NO: 871996 - RNA, 19 nt, Homo sapiens
gcauuguacuaaucuguua

SEQ ID NO: 871997 - RNA, 19 nt, Homo sapiens
acaacuggaugaaacauua

SEQ ID NO: 871998 - RNA, 19 nt, Homo sapiens
gcacgugacuggcauuuua

SEQ ID NO: 871999 - RNA, 19 nt, Homo sapiens
aaccaaagccuaauuguua

SEQ ID NO: 872000 - RNA, 19 nt, Homo sapiens
gcacagcgcucagguuuua

SEQ ID NO: 872001 - RNA, 19 nt, Homo sapiens
gaauguaucgucagaauga

SEQ ID NO: 872002 - RNA, 19 nt, Homo sapiens
gaugaaacauuacgucugu

SEQ ID NO: 872003 - RNA, 19 nt, Homo sapiens
ggaagcaggcuguagauuu

SEQ ID NO: 872004 - RNA, 19 nt, Homo sapiens
uuaaagaugucaagccuaa

SEQ ID NO: 872005 - RNA, 19 nt, Homo sapiens
guagucaucuuauuugaga

SEQ ID NO: 872006 - RNA, 19 nt, Homo sapiens
agacaaauguagagaauug

SEQ ID NO: 872007 - RNA, 19 nt, Homo sapiens
ggacaaaggaaucuugaaa

SEQ ID NO: 872008 - RNA, 19 nt, Homo sapiens
gugauaaucuuuccuuaga

SEQ ID NO: 872009 - RNA, 19 nt, Homo sapiens
ggaaaagaaugcaugauuu

SEQ ID NO: 872010 - RNA, 19 nt, Homo sapiens
gaagggaacuuagaagaag

SEQ ID NO: 872011 - RNA, 19 nt, Homo sapiens
gaaguucuguuaucuccaa

SEQ ID NO: 872012 - RNA, 19 nt, Homo sapiens
ggaaugucccaguuuaaua

SEQ ID NO: 872013 - RNA, 19 nt, Homo sapiens
gaacuuagaagaagcugaa

SEQ ID NO: 872014 - RNA, 19 nt, Homo sapiens
gugcguuucuuuacaauuu

SEQ ID NO: 872015 - RNA, 19 nt, Homo sapiens
gcuggagucugaagaauau

SEQ ID NO: 872016 - RNA, 19 nt, Homo sapiens
gaacaacugcagagagaaa

SEQ ID NO: 872017 - RNA, 19 nt, Homo sapiens
gaugcauccugauauuaua

SEQ ID NO: 872018 - RNA, 19 nt, Homo sapiens
ggaagcauuugaacuuguu

SEQ ID NO: 872019 - RNA, 19 nt, Homo sapiens
gcgcuggaauuaaaugaaa

SEQ ID NO: 872020 - RNA, 19 nt, Homo sapiens
gaagcgaagucccggagaa

SEQ ID NO: 872021 - RNA, 19 nt, Homo sapiens
gaggauaaauguagaaucg

SEQ ID NO: 872022 - RNA, 19 nt, Homo sapiens
gaugaucacuugugcuuag

SEQ ID NO: 872023 - RNA, 19 nt, Homo sapiens
ggaaaccugcgucauguaa

SEQ ID NO: 872024 - RNA, 19 nt, Homo sapiens
uauggaaugucccaguuua

SEQ ID NO: 872025 - RNA, 19 nt, Homo sapiens
caaugcagcuucuccaugu

SEQ ID NO: 872026 - RNA, 19 nt, Homo sapiens
gaagaaccaagguagaauu

SEQ ID NO: 872027 - RNA, 19 nt, Homo sapiens
uagaacaccuugacauuuc

SEQ ID NO: 872028 - RNA, 19 nt, Homo sapiens
acagaaacguggcaucauu

SEQ ID NO: 872029 - RNA, 19 nt, Homo sapiens
guagaaucgugguaauauu

SEQ ID NO: 872030 - RNA, 19 nt, Homo sapiens
gaaugucccaguuuaauau

SEQ ID NO: 872031 - RNA, 19 nt, Homo sapiens
gagagacaguaggaaauuu

SEQ ID NO: 872032 - RNA, 19 nt, Homo sapiens
ggaagggaacuuagaagaa

SEQ ID NO: 872033 - RNA, 19 nt, Homo sapiens
gagagauugucaucaagaa

SEQ ID NO: 872034 - RNA, 19 nt, Homo sapiens
ggaaugcagugaucagaag

SEQ ID NO: 872035 - RNA, 19 nt, Homo sapiens
ggugaugcauccugauauu

SEQ ID NO: 872036 - RNA, 19 nt, Homo sapiens
gauuauaacuacugaaagg

SEQ ID NO: 872037 - RNA, 19 nt, Homo sapiens
ucuccaagcucuucagaaa

SEQ ID NO: 872038 - RNA, 19 nt, Homo sapiens
agaaugaaauugccauguu

SEQ ID NO: 872039 - RNA, 19 nt, Homo sapiens
gauauuaacaccggcauaa

SEQ ID NO: 872040 - RNA, 19 nt, Homo sapiens
ccauuugaguuacauguuu

SEQ ID NO: 872041 - RNA, 19 nt, Homo sapiens
gugguaauauuggcuguua

SEQ ID NO: 872042 - RNA, 19 nt, Homo sapiens
gcuggaagcaagccauuua

SEQ ID NO: 872043 - RNA, 19 nt, Homo sapiens
aagaagaucugugucauau

SEQ ID NO: 872044 - RNA, 19 nt, Homo sapiens
gccaagagccaaaccgaua

SEQ ID NO: 872045 - RNA, 19 nt, Homo sapiens
gcaauacuauagcuucaca

SEQ ID NO: 872046 - RNA, 19 nt, Homo sapiens
caagaagaucugugucaua

SEQ ID NO: 872047 - RNA, 19 nt, Homo sapiens
ccagauuuaucaugaguga

SEQ ID NO: 872048 - RNA, 19 nt, Homo sapiens
gcacugucauguggcauuu

SEQ ID NO: 872049 - RNA, 19 nt, Homo sapiens
gguguaugcuuuguucuuu

SEQ ID NO: 872050 - RNA, 19 nt, Homo sapiens
gcugaguccuugagaaguu

SEQ ID NO: 872051 - RNA, 19 nt, Homo sapiens
ucauguagcuaguugaaug

SEQ ID NO: 872052 - RNA, 19 nt, Homo sapiens
gguccuaacuaaagagaug

SEQ ID NO: 872053 - RNA, 19 nt, Homo sapiens
ggauucugguccuaacuaa

SEQ ID NO: 872054 - RNA, 19 nt, Homo sapiens
caaauaaccaguuggacaa

SEQ ID NO: 872055 - RNA, 19 nt, Homo sapiens
guagaacaccuugacauuu

SEQ ID NO: 872056 - RNA, 19 nt, Homo sapiens
caacggcaccuauuuggaa

SEQ ID NO: 872057 - RNA, 19 nt, Homo sapiens
ggaaauggcaugaaagcau

SEQ ID NO: 872058 - RNA, 19 nt, Homo sapiens
uggaaaggaugguauaugu

SEQ ID NO: 872059 - RNA, 19 nt, Homo sapiens
gcgaggagcuggaguacag

SEQ ID NO: 872060 - RNA, 19 nt, Homo sapiens
ccaaaccgauauagagaga

SEQ ID NO: 872061 - RNA, 19 nt, Homo sapiens
guacuagcaucuauaaagg

SEQ ID NO: 872062 - RNA, 19 nt, Homo sapiens
ggagaggauauaagauuaa

SEQ ID NO: 872063 - RNA, 19 nt, Homo sapiens
gagcaauacuauagcuuca

SEQ ID NO: 872064 - RNA, 19 nt, Homo sapiens
aaaccgagcucuaguucau

SEQ ID NO: 872065 - RNA, 19 nt, Homo sapiens
cagaauguaucgucagaau

SEQ ID NO: 872066 - RNA, 19 nt, Homo sapiens
gcuauggaauaucaaguau

SEQ ID NO: 872067 - RNA, 19 nt, Homo sapiens
gcaccuauuuggaacuuag

SEQ ID NO: 872068 - RNA, 19 nt, Homo sapiens
gcagaggauugaacaacug

SEQ ID NO: 872069 - RNA, 19 nt, Homo sapiens
gcaaaauacuggagcacua

SEQ ID NO: 872070 - RNA, 19 nt, Homo sapiens
gacaagggcuuccaguuuu

SEQ ID NO: 872071 - RNA, 19 nt, Homo sapiens
ggaacaacaucgggaagga

SEQ ID NO: 872072 - RNA, 19 nt, Homo sapiens
gcaagaagaucugugucau

SEQ ID NO: 872073 - RNA, 19 nt, Homo sapiens
cgaauguuaugaaugaaga

SEQ ID NO: 872074 - RNA, 19 nt, Homo sapiens
gaagcaggcuguagauuua

SEQ ID NO: 872075 - RNA, 19 nt, Homo sapiens
gaucagaaguggcuaauuu

SEQ ID NO: 872076 - RNA, 19 nt, Homo sapiens
gaaccaagguagaauuuaa

SEQ ID NO: 872077 - RNA, 19 nt, Homo sapiens
gaagaucugugucauauug

SEQ ID NO: 872078 - RNA, 19 nt, Homo sapiens
gcagcagucuugaauaaua

SEQ ID NO: 872079 - RNA, 19 nt, Homo sapiens
ggaaauuucuccuuaguga

SEQ ID NO: 872080 - RNA, 19 nt, Homo sapiens
gcuaaucacuguaccauuu

SEQ ID NO: 872081 - RNA, 19 nt, Homo sapiens
gaauugauguucuugcuuu

SEQ ID NO: 872082 - RNA, 19 nt, Homo sapiens
ucagacagcucuugaauug

SEQ ID NO: 872083 - RNA, 19 nt, Homo sapiens
gaaugaaauugccauguuu

SEQ ID NO: 872084 - RNA, 19 nt, Homo sapiens
gcaaugcuauggaauauca

SEQ ID NO: 872085 - RNA, 19 nt, Homo sapiens
gggagaggauauaagauua

SEQ ID NO: 872086 - RNA, 19 nt, Homo sapiens
agaagaagcugaaauacaa

SEQ ID NO: 872087 - RNA, 19 nt, Homo sapiens
ucaagaaccugcaugauga

SEQ ID NO: 872088 - RNA, 19 nt, Homo sapiens
gcaaauccauggaaauugu

SEQ ID NO: 872089 - RNA, 19 nt, Homo sapiens
gaaaguagacucuccauca

SEQ ID NO: 872090 - RNA, 19 nt, Homo sapiens
ggacaagggcuuccaguuu

SEQ ID NO: 872091 - RNA, 19 nt, Homo sapiens
ggaacaaagugaccucuug

SEQ ID NO: 872092 - RNA, 19 nt, Homo sapiens
gagcacaucuaccaucuga

SEQ ID NO: 872093 - RNA, 19 nt, Homo sapiens
cuacauacacuacaaguua

SEQ ID NO: 872094 - RNA, 19 nt, Homo sapiens
ccaggugcauuaagaaaua

SEQ ID NO: 872095 - RNA, 19 nt, Homo sapiens
cagagcauaucgaauguua

SEQ ID NO: 872096 - RNA, 19 nt, Homo sapiens
gcauuguacuaaucuguua

SEQ ID NO: 872097 - RNA, 19 nt, Homo sapiens
acaacuggaugaaacauua

SEQ ID NO: 872098 - RNA, 19 nt, Homo sapiens
gcacgugacuggcauuuua

SEQ ID NO: 872099 - RNA, 19 nt, Homo sapiens
aaccaaagccuaauuguua

SEQ ID NO: 872100 - RNA, 19 nt, Homo sapiens
gcacagcgcucagguuuua

SEQ ID NO: 872101 - RNA, 19 nt, Homo sapiens
aaagaacgcuuacgcagaa

SEQ ID NO: 872102 - RNA, 19 nt, Homo sapiens
gaauguaucgucagaauga

SEQ ID NO: 872103 - RNA, 19 nt, Homo sapiens
gaugaaacauuacgucugu

SEQ ID NO: 872104 - RNA, 19 nt, Homo sapiens
ggaagcaggcuguagauuu

SEQ ID NO: 872105 - RNA, 19 nt, Homo sapiens
uuaaagaugucaagccuaa

SEQ ID NO: 872106 - RNA, 19 nt, Homo sapiens
guagucaucuuauuugaga

SEQ ID NO: 872107 - RNA, 19 nt, Homo sapiens
agacaaauguagagaauug

SEQ ID NO: 872108 - RNA, 19 nt, Homo sapiens
ggacaaaggaaucuugaaa

SEQ ID NO: 872109 - RNA, 19 nt, Homo sapiens
gugauaaucuuuccuuaga

SEQ ID NO: 872110 - RNA, 19 nt, Homo sapiens
ggaaaagaaugcaugauuu

SEQ ID NO: 872111 - RNA, 19 nt, Homo sapiens
gaagggaacuuagaagaag

SEQ ID NO: 872112 - RNA, 19 nt, Homo sapiens
gaaguucuguuaucuccaa

SEQ ID NO: 872113 - RNA, 19 nt, Homo sapiens
ggaaugucccaguuuaaua

SEQ ID NO: 872114 - RNA, 19 nt, Homo sapiens
gaacuuagaagaagcugaa

SEQ ID NO: 872115 - RNA, 19 nt, Homo sapiens
gugcguuucuuuacaauuu

SEQ ID NO: 872116 - RNA, 19 nt, Homo sapiens
gcuggagucugaagaauau

SEQ ID NO: 872117 - RNA, 19 nt, Homo sapiens
gaacaacugcagagagaaa

SEQ ID NO: 872118 - RNA, 19 nt, Homo sapiens
gaugcauccugauauuaua

SEQ ID NO: 872119 - RNA, 19 nt, Homo sapiens
ggaagcauuugaacuuguu

SEQ ID NO: 872120 - RNA, 19 nt, Homo sapiens
gcgcuggaauuaaaugaaa

SEQ ID NO: 872121 - RNA, 19 nt, Homo sapiens
gaagcgaagucccggagaa

SEQ ID NO: 872122 - RNA, 19 nt, Homo sapiens
gaggauaaauguagaaucg

SEQ ID NO: 872123 - RNA, 19 nt, Homo sapiens
gaugaucacuugugcuuag

SEQ ID NO: 872124 - RNA, 19 nt, Homo sapiens
ggaaaccugcgucauguaa

SEQ ID NO: 872125 - RNA, 19 nt, Homo sapiens
uauggaaugucccaguuua

SEQ ID NO: 872126 - RNA, 19 nt, Homo sapiens
caaugcagcuucuccaugu

SEQ ID NO: 872127 - RNA, 19 nt, Homo sapiens
gaagaaccaagguagaauu

SEQ ID NO: 872128 - RNA, 19 nt, Homo sapiens
uagaacaccuugacauuuc

SEQ ID NO: 872129 - RNA, 19 nt, Homo sapiens
acagaaacguggcaucauu

SEQ ID NO: 872130 - RNA, 19 nt, Homo sapiens
guagaaucgugguaauauu

SEQ ID NO: 872131 - RNA, 19 nt, Homo sapiens
gaaugucccaguuuaauau

SEQ ID NO: 872132 - RNA, 19 nt, Homo sapiens
gagagacaguaggaaauuu

SEQ ID NO: 872133 - RNA, 19 nt, Homo sapiens
ggaagggaacuuagaagaa

SEQ ID NO: 872134 - RNA, 19 nt, Homo sapiens
gagagauugucaucaagaa

SEQ ID NO: 872135 - RNA, 19 nt, Homo sapiens
uggcaaagaugcuaaagga

SEQ ID NO: 872136 - RNA, 19 nt, Homo sapiens
ggaaugcagugaucagaag

SEQ ID NO: 872137 - RNA, 19 nt, Homo sapiens
ggugaugcauccugauauu

SEQ ID NO: 872138 - RNA, 19 nt, Homo sapiens
gauuauaacuacugaaagg

SEQ ID NO: 872139 - RNA, 19 nt, Homo sapiens
ucuccaagcucuucagaaa

SEQ ID NO: 872140 - RNA, 19 nt, Homo sapiens
guccagagcuauuggcaaa

SEQ ID NO: 872141 - RNA, 19 nt, Homo sapiens
agaaugaaauugccauguu

SEQ ID NO: 872142 - RNA, 19 nt, Homo sapiens
gauauuaacaccggcauaa

SEQ ID NO: 872143 - RNA, 19 nt, Homo sapiens
ccauuugaguuacauguuu

SEQ ID NO: 872144 - RNA, 19 nt, Homo sapiens
gugguaauauuggcuguua

SEQ ID NO: 872145 - RNA, 19 nt, Homo sapiens
gcuggaagcaagccauuua

SEQ ID NO: 872146 - RNA, 19 nt, Homo sapiens
aagaagaucugugucauau

SEQ ID NO: 872147 - RNA, 19 nt, Homo sapiens
caaagaugcuaaaggaaca

SEQ ID NO: 872148 - RNA, 19 nt, Homo sapiens
gccaagagccaaaccgaua

SEQ ID NO: 872149 - RNA, 19 nt, Homo sapiens
gcaauacuauagcuucaca

SEQ ID NO: 872150 - RNA, 19 nt, Homo sapiens
caagaagaucugugucaua

SEQ ID NO: 872151 - RNA, 19 nt, Homo sapiens
ccagauuuaucaugaguga

SEQ ID NO: 872152 - RNA, 19 nt, Homo sapiens
gcacugucauguggcauuu

SEQ ID NO: 872153 - RNA, 19 nt, Homo sapiens
gguguaugcuuuguucuuu

SEQ ID NO: 872154 - RNA, 19 nt, Homo sapiens
gcugaguccuugagaaguu

SEQ ID NO: 872155 - RNA, 19 nt, Homo sapiens
gcacaaaacacagaucuua

SEQ ID NO: 872156 - RNA, 19 nt, Homo sapiens
ucauguagcuaguugaaug

SEQ ID NO: 872157 - RNA, 19 nt, Homo sapiens
gguccuaacuaaagagaug

SEQ ID NO: 872158 - RNA, 19 nt, Homo sapiens
ggauucugguccuaacuaa

SEQ ID NO: 872159 - RNA, 19 nt, Homo sapiens
caaauaaccaguuggacaa

SEQ ID NO: 872160 - RNA, 19 nt, Homo sapiens
guagaacaccuugacauuu

SEQ ID NO: 872161 - RNA, 19 nt, Homo sapiens
caacggcaccuauuuggaa

SEQ ID NO: 872162 - RNA, 19 nt, Homo sapiens
ggaaauggcaugaaagcau

SEQ ID NO: 872163 - RNA, 19 nt, Homo sapiens
gcgaggagcuggaguacag

SEQ ID NO: 872164 - RNA, 19 nt, Homo sapiens
ccaaaccgauauagagaga

SEQ ID NO: 872165 - RNA, 19 nt, Homo sapiens
guacuagcaucuauaaagg

SEQ ID NO: 872166 - RNA, 19 nt, Homo sapiens
ggagaggauauaagauuaa

SEQ ID NO: 872167 - RNA, 19 nt, Homo sapiens
gagcaauacuauagcuuca

SEQ ID NO: 872168 - RNA, 19 nt, Homo sapiens
aaaccgagcucuaguucau

SEQ ID NO: 872169 - RNA, 19 nt, Homo sapiens
cagaauguaucgucagaau

SEQ ID NO: 872170 - RNA, 19 nt, Homo sapiens
gcuauggaauaucaaguau

SEQ ID NO: 872171 - RNA, 19 nt, Homo sapiens
gcaccuauuuggaacuuag

SEQ ID NO: 872172 - RNA, 19 nt, Homo sapiens
gcagaggauugaacaacug

SEQ ID NO: 872173 - RNA, 19 nt, Homo sapiens
gcaaaauacuggagcacua

SEQ ID NO: 872174 - RNA, 19 nt, Homo sapiens
gaagcaggcuguagauuua

SEQ ID NO: 872175 - RNA, 19 nt, Homo sapiens
gaucagaaguggcuaauuu

SEQ ID NO: 872176 - RNA, 19 nt, Homo sapiens
gaaccaagguagaauuuaa

SEQ ID NO: 872177 - RNA, 19 nt, Homo sapiens
gaagaucugugucauauug

SEQ ID NO: 872178 - RNA, 19 nt, Homo sapiens
gcagcagucuugaauaaua

SEQ ID NO: 872179 - RNA, 19 nt, Homo sapiens
ggaaauuucuccuuaguga

SEQ ID NO: 872180 - RNA, 19 nt, Homo sapiens
gcuaaucacuguaccauuu

SEQ ID NO: 872181 - RNA, 19 nt, Homo sapiens
gaauugauguucuugcuuu

SEQ ID NO: 872182 - RNA, 19 nt, Homo sapiens
ucagacagcucuugaauug

SEQ ID NO: 872183 - RNA, 19 nt, Homo sapiens
gaaugaaauugccauguuu

SEQ ID NO: 872184 - RNA, 19 nt, Homo sapiens
gcaaugcuauggaauauca

SEQ ID NO: 872185 - RNA, 19 nt, Homo sapiens
gggagaggauauaagauua

SEQ ID NO: 872186 - RNA, 19 nt, Homo sapiens
agaagaagcugaaauacaa

SEQ ID NO: 872187 - RNA, 19 nt, Homo sapiens
ucaagaaccugcaugauga

SEQ ID NO: 872188 - RNA, 19 nt, Homo sapiens
gcaaauccauggaaauugu

SEQ ID NO: 872189 - RNA, 19 nt, Homo sapiens
gaaaguagacucuccauca

SEQ ID NO: 872190 - RNA, 19 nt, Homo sapiens
ggacaagggcuuccaguuu

SEQ ID NO: 872191 - RNA, 19 nt, Homo sapiens
ggaacaaagugaccucuug

SEQ ID NO: 872192 - RNA, 19 nt, Homo sapiens
gagcacaucuaccaucuga

SEQ ID NO: 872193 - RNA, 19 nt, Homo sapiens
cuacauacacuacaaguua

SEQ ID NO: 872194 - RNA, 19 nt, Homo sapiens
ccaggugcauuaagaaaua

SEQ ID NO: 872195 - RNA, 19 nt, Homo sapiens
cagagcauaucgaauguua

SEQ ID NO: 872196 - RNA, 19 nt, Homo sapiens
gcauuguacuaaucuguua

SEQ ID NO: 872197 - RNA, 19 nt, Homo sapiens
acaacuggaugaaacauua

SEQ ID NO: 872198 - RNA, 19 nt, Homo sapiens
gcacgugacuggcauuuua

SEQ ID NO: 872199 - RNA, 19 nt, Homo sapiens
aaccaaagccuaauuguua

SEQ ID NO: 872200 - RNA, 19 nt, Homo sapiens
gcacagcgcucagguuuua

SEQ ID NO: 872201 - RNA, 19 nt, Homo sapiens
aaagaacgcuuacgcagaa

SEQ ID NO: 872202 - RNA, 19 nt, Homo sapiens
gaauguaucgucagaauga

SEQ ID NO: 872203 - RNA, 19 nt, Homo sapiens
gaugaaacauuacgucugu

SEQ ID NO: 872204 - RNA, 19 nt, Homo sapiens
ggaagcaggcuguagauuu

SEQ ID NO: 872205 - RNA, 19 nt, Homo sapiens
uuaaagaugucaagccuaa

SEQ ID NO: 872206 - RNA, 19 nt, Homo sapiens
guagucaucuuauuugaga

SEQ ID NO: 872207 - RNA, 19 nt, Homo sapiens
agacaaauguagagaauug

SEQ ID NO: 872208 - RNA, 19 nt, Homo sapiens
ggacaaaggaaucuugaaa

SEQ ID NO: 872209 - RNA, 19 nt, Homo sapiens
gugauaaucuuuccuuaga

SEQ ID NO: 872210 - RNA, 19 nt, Homo sapiens
ggaaaagaaugcaugauuu

SEQ ID NO: 872211 - RNA, 19 nt, Homo sapiens
gaagggaacuuagaagaag

SEQ ID NO: 872212 - RNA, 19 nt, Homo sapiens
gaaguucuguuaucuccaa

SEQ ID NO: 872213 - RNA, 19 nt, Homo sapiens
ggaaugucccaguuuaaua

SEQ ID NO: 872214 - RNA, 19 nt, Homo sapiens
gaacuuagaagaagcugaa

SEQ ID NO: 872215 - RNA, 19 nt, Homo sapiens
gugcguuucuuuacaauuu

SEQ ID NO: 872216 - RNA, 19 nt, Homo sapiens
gcuggagucugaagaauau

SEQ ID NO: 872217 - RNA, 19 nt, Homo sapiens
gaacaacugcagagagaaa

SEQ ID NO: 872218 - RNA, 19 nt, Homo sapiens
gaugcauccugauauuaua

SEQ ID NO: 872219 - RNA, 19 nt, Homo sapiens
ggaagcauuugaacuuguu

SEQ ID NO: 872220 - RNA, 19 nt, Homo sapiens
gcgcuggaauuaaaugaaa

SEQ ID NO: 872221 - RNA, 19 nt, Homo sapiens
gaagcgaagucccggagaa

SEQ ID NO: 872222 - RNA, 19 nt, Homo sapiens
gaggauaaauguagaaucg

SEQ ID NO: 872223 - RNA, 19 nt, Homo sapiens
gaugaucacuugugcuuag

SEQ ID NO: 872224 - RNA, 19 nt, Homo sapiens
ggaaaccugcgucauguaa

SEQ ID NO: 872225 - RNA, 19 nt, Homo sapiens
uauggaaugucccaguuua

SEQ ID NO: 872226 - RNA, 19 nt, Homo sapiens
caaugcagcuucuccaugu

SEQ ID NO: 872227 - RNA, 19 nt, Homo sapiens
gaagaaccaagguagaauu

SEQ ID NO: 872228 - RNA, 19 nt, Homo sapiens
uagaacaccuugacauuuc

SEQ ID NO: 872229 - RNA, 19 nt, Homo sapiens
acagaaacguggcaucauu

SEQ ID NO: 872230 - RNA, 19 nt, Homo sapiens
guagaaucgugguaauauu

SEQ ID NO: 872231 - RNA, 19 nt, Homo sapiens
gaaugucccaguuuaauau

SEQ ID NO: 872232 - RNA, 19 nt, Homo sapiens
gagagacaguaggaaauuu

SEQ ID NO: 872233 - RNA, 19 nt, Homo sapiens
ggaagggaacuuagaagaa

SEQ ID NO: 872234 - RNA, 19 nt, Homo sapiens
gagagauugucaucaagaa

SEQ ID NO: 872235 - RNA, 19 nt, Homo sapiens
ggaaugcagugaucagaag

SEQ ID NO: 872236 - RNA, 19 nt, Homo sapiens
ggugaugcauccugauauu

SEQ ID NO: 872237 - RNA, 19 nt, Homo sapiens
gauuauaacuacugaaagg

SEQ ID NO: 872238 - RNA, 19 nt, Homo sapiens
ucuccaagcucuucagaaa

SEQ ID NO: 872239 - RNA, 19 nt, Homo sapiens
agaaugaaauugccauguu

SEQ ID NO: 872240 - RNA, 19 nt, Homo sapiens
gauauuaacaccggcauaa

SEQ ID NO: 872241 - RNA, 19 nt, Homo sapiens
ccauuugaguuacauguuu

SEQ ID NO: 872242 - RNA, 19 nt, Homo sapiens
gugguaauauuggcuguua

SEQ ID NO: 872243 - RNA, 19 nt, Homo sapiens
gcuggaagcaagccauuua

SEQ ID NO: 872244 - RNA, 19 nt, Homo sapiens
aagaagaucugugucauau

SEQ ID NO: 872245 - RNA, 19 nt, Homo sapiens
gccaagagccaaaccgaua

SEQ ID NO: 872246 - RNA, 19 nt, Homo sapiens
gcaauacuauagcuucaca

SEQ ID NO: 872247 - RNA, 19 nt, Homo sapiens
caagaagaucugugucaua

SEQ ID NO: 872248 - RNA, 19 nt, Homo sapiens
ccagauuuaucaugaguga

SEQ ID NO: 872249 - RNA, 19 nt, Homo sapiens
gcacugucauguggcauuu

SEQ ID NO: 872250 - RNA, 19 nt, Homo sapiens
gguguaugcuuuguucuuu

SEQ ID NO: 872251 - RNA, 19 nt, Homo sapiens
gcugaguccuugagaaguu

SEQ ID NO: 872252 - RNA, 19 nt, Homo sapiens
gcacaaaacacagaucuua

SEQ ID NO: 872253 - RNA, 19 nt, Homo sapiens
ucauguagcuaguugaaug

SEQ ID NO: 872254 - RNA, 19 nt, Homo sapiens
gguccuaacuaaagagaug

SEQ ID NO: 872255 - RNA, 19 nt, Homo sapiens
ggauucugguccuaacuaa

SEQ ID NO: 872256 - RNA, 19 nt, Homo sapiens
caaauaaccaguuggacaa

SEQ ID NO: 872257 - RNA, 19 nt, Homo sapiens
guagaacaccuugacauuu

SEQ ID NO: 872258 - RNA, 19 nt, Homo sapiens
caacggcaccuauuuggaa

SEQ ID NO: 872259 - RNA, 19 nt, Homo sapiens
ggaaauggcaugaaagcau

SEQ ID NO: 872260 - RNA, 19 nt, Homo sapiens
gcgaggagcuggaguacag

SEQ ID NO: 872261 - RNA, 19 nt, Homo sapiens
ccaaaccgauauagagaga

SEQ ID NO: 872262 - RNA, 19 nt, Homo sapiens
guacuagcaucuauaaagg

SEQ ID NO: 872263 - RNA, 19 nt, Homo sapiens
ggagaggauauaagauuaa

SEQ ID NO: 872264 - RNA, 19 nt, Homo sapiens
gagcaauacuauagcuuca

SEQ ID NO: 872265 - RNA, 19 nt, Homo sapiens
aaaccgagcucuaguucau

SEQ ID NO: 872266 - RNA, 19 nt, Homo sapiens
cagaauguaucgucagaau

SEQ ID NO: 872267 - RNA, 19 nt, Homo sapiens
gcuauggaauaucaaguau

SEQ ID NO: 872268 - RNA, 19 nt, Homo sapiens
gcaccuauuuggaacuuag

SEQ ID NO: 872269 - RNA, 19 nt, Homo sapiens
gcagaggauugaacaacug

SEQ ID NO: 872270 - RNA, 19 nt, Homo sapiens
gcaaaauacuggagcacua

SEQ ID NO: 872271 - RNA, 19 nt, Homo sapiens
gacaagggcuuccaguuuu

SEQ ID NO: 872272 - RNA, 19 nt, Homo sapiens
uaaacagguucauuacuca

SEQ ID NO: 872273 - RNA, 19 nt, Homo sapiens
ggaacaacaucgggaagga

SEQ ID NO: 872274 - RNA, 19 nt, Homo sapiens
gaccagaaauccacuauua

SEQ ID NO: 872275 - RNA, 19 nt, Homo sapiens
ggacacugaugcucuauua

SEQ ID NO: 872276 - RNA, 19 nt, Homo sapiens
ggaaagcucuugacaguug

SEQ ID NO: 872277 - RNA, 19 nt, Homo sapiens
gaccuaagcuaucagaaua

SEQ ID NO: 872278 - RNA, 19 nt, Homo sapiens
gauguucccuuucaaguua

SEQ ID NO: 872279 - RNA, 19 nt, Homo sapiens
ccaaauugcuuccuucuuu

SEQ ID NO: 872280 - RNA, 19 nt, Homo sapiens
ucacugagcuggaccuuaa

SEQ ID NO: 872281 - RNA, 19 nt, Homo sapiens
gcaaacauguacagaagaa

SEQ ID NO: 872282 - RNA, 19 nt, Homo sapiens
caucaugacuguuaagaaa

SEQ ID NO: 872283 - RNA, 19 nt, Homo sapiens
aaucaaaccuguacaaguu

SEQ ID NO: 872284 - RNA, 19 nt, Homo sapiens
aaacauugcuucuuacaga

SEQ ID NO: 872285 - RNA, 19 nt, Homo sapiens
ggaaagguaugugaugauu

SEQ ID NO: 872286 - RNA, 19 nt, Homo sapiens
caaacugggugauaacaaa

SEQ ID NO: 872287 - RNA, 19 nt, Homo sapiens
gguagaaggugaaacuuug

SEQ ID NO: 872288 - RNA, 19 nt, Homo sapiens
cgacauaaguagaagacua

SEQ ID NO: 872289 - RNA, 19 nt, Homo sapiens
gcauaugucuggaaagaau

SEQ ID NO: 872290 - RNA, 19 nt, Homo sapiens
cauuguggcuugagaauuu

SEQ ID NO: 872291 - RNA, 19 nt, Homo sapiens
agaagaagcuauuagaaga

SEQ ID NO: 872292 - RNA, 19 nt, Homo sapiens
gaggccagcucauauacua

SEQ ID NO: 872293 - RNA, 19 nt, Homo sapiens
aagaagggcuugucauauu

SEQ ID NO: 872294 - RNA, 19 nt, Homo sapiens
guacaaaugaugcuaguuu

SEQ ID NO: 872295 - RNA, 19 nt, Homo sapiens
gaacaacuacccaagcaaa

SEQ ID NO: 872296 - RNA, 19 nt, Homo sapiens
guaacuggguuguuuaaug

SEQ ID NO: 872297 - RNA, 19 nt, Homo sapiens
acuaaacccucaccacuua

SEQ ID NO: 872298 - RNA, 19 nt, Homo sapiens
agaaaggaguugagaauga

SEQ ID NO: 872299 - RNA, 19 nt, Homo sapiens
caaagcauaugucuggaaa

SEQ ID NO: 872300 - RNA, 19 nt, Homo sapiens
gaucguauuucuacuuguu

SEQ ID NO: 872301 - RNA, 19 nt, Homo sapiens
agaagggcuugucauauua

SEQ ID NO: 872302 - RNA, 19 nt, Homo sapiens
gaaagccuacucaggaaua

SEQ ID NO: 872303 - RNA, 19 nt, Homo sapiens
ggaauuagaagaagcuauu

SEQ ID NO: 872304 - RNA, 19 nt, Homo sapiens
cagaagauguggaauuaga

SEQ ID NO: 872305 - RNA, 19 nt, Homo sapiens
gaauuuauauccacagaag

SEQ ID NO: 872306 - RNA, 19 nt, Homo sapiens
gaaucagucuuacucuauu

SEQ ID NO: 872307 - RNA, 19 nt, Homo sapiens
uaacuggguuguuuaaugu

SEQ ID NO: 872308 - RNA, 19 nt, Homo sapiens
aaagguaacuggguuguuu

SEQ ID NO: 872309 - RNA, 19 nt, Homo sapiens
uaugaugugugccuuguua

SEQ ID NO: 872310 - RNA, 19 nt, Homo sapiens
gugaagauauguuugauuc

SEQ ID NO: 872311 - RNA, 19 nt, Homo sapiens
caaacacaauggguuauaa

SEQ ID NO: 872312 - RNA, 19 nt, Homo sapiens
gcucauggguuacaagaau

SEQ ID NO: 872313 - RNA, 19 nt, Homo sapiens
gagccuagcaccucuuaua

SEQ ID NO: 872314 - RNA, 19 nt, Homo sapiens
ggaauggugucagaauauu

SEQ ID NO: 872315 - RNA, 19 nt, Homo sapiens
gacaguuguuucccaaaua

SEQ ID NO: 872316 - RNA, 19 nt, Homo sapiens
gauaacgaauucuugaguu

SEQ ID NO: 872317 - RNA, 19 nt, Homo sapiens
ccaaauagcauuaguucuu

SEQ ID NO: 872318 - RNA, 19 nt, Homo sapiens
gaaaagaugcugcugauuu

SEQ ID NO: 872319 - RNA, 19 nt, Homo sapiens
gcagaugucuccaaaucau

SEQ ID NO: 872320 - RNA, 19 nt, Homo sapiens
caauaucuuucccaucuuu

SEQ ID NO: 872321 - RNA, 19 nt, Homo sapiens
gccacaaguuucauagaua

SEQ ID NO: 872322 - RNA, 19 nt, Homo sapiens
gaaaggaggaguguucaaa

SEQ ID NO: 872323 - RNA, 19 nt, Homo sapiens
ccuuugagaucuuuguuua

SEQ ID NO: 872324 - RNA, 19 nt, Homo sapiens
ccgcucaacuguaagauuu

SEQ ID NO: 872325 - RNA, 19 nt, Homo sapiens
cacaauggguuauaaaugu

SEQ ID NO: 872326 - RNA, 19 nt, Homo sapiens
ugacuugcauuuauuguug

SEQ ID NO: 872327 - RNA, 19 nt, Homo sapiens
agacugagauaacgaauuc

SEQ ID NO: 872328 - RNA, 19 nt, Homo sapiens
caacaacaauauagagauc

SEQ ID NO: 872329 - RNA, 19 nt, Homo sapiens
gaagaguaguuaagcagau

SEQ ID NO: 872330 - RNA, 19 nt, Homo sapiens
ccagaaagaagaguaguua

SEQ ID NO: 872331 - RNA, 19 nt, Homo sapiens
caaagaaugugacagugau

SEQ ID NO: 872332 - RNA, 19 nt, Homo sapiens
gaaacaggcaauaaacuau

SEQ ID NO: 872333 - RNA, 19 nt, Homo sapiens
gaagaugauuuuccaguaa

SEQ ID NO: 872334 - RNA, 19 nt, Homo sapiens
gaggaguguucaaagcaua

SEQ ID NO: 872335 - RNA, 19 nt, Homo sapiens
aaagggauauuucaucaug

SEQ ID NO: 872336 - RNA, 19 nt, Homo sapiens
gauggacacugaugcucua

SEQ ID NO: 872337 - RNA, 19 nt, Homo sapiens
uaaagggaauggugucaga

SEQ ID NO: 872338 - RNA, 19 nt, Homo sapiens
ggagaaaggaguugagaau

SEQ ID NO: 872339 - RNA, 19 nt, Homo sapiens
gcacagcagcauuuccaua

SEQ ID NO: 872340 - RNA, 19 nt, Homo sapiens
ggucagcagugaugaugaa

SEQ ID NO: 872341 - RNA, 19 nt, Homo sapiens
ccagaaaugucuuaucucu

SEQ ID NO: 872342 - RNA, 19 nt, Homo sapiens
ugacagugaugauaacaug

SEQ ID NO: 872343 - RNA, 19 nt, Homo sapiens
ggagcuagagaaucaauuu

SEQ ID NO: 872344 - RNA, 19 nt, Homo sapiens
aaagguaugugaugauuca

SEQ ID NO: 872345 - RNA, 19 nt, Homo sapiens
gaagagcauuacccagguu

SEQ ID NO: 872346 - RNA, 19 nt, Homo sapiens
uaaccgacaugaacacuca

SEQ ID NO: 872347 - RNA, 19 nt, Homo sapiens
uagcagaugucuccaaauc

SEQ ID NO: 872348 - RNA, 19 nt, Homo sapiens
aagcauuucugagucauua

SEQ ID NO: 872349 - RNA, 19 nt, Homo sapiens
gaaacauuguaccgacauu

SEQ ID NO: 872350 - RNA, 19 nt, Homo sapiens
aaacagcacugcaugucuu

SEQ ID NO: 872351 - RNA, 19 nt, Homo sapiens
caucagcuauuacuguuau

SEQ ID NO: 872352 - RNA, 19 nt, Homo sapiens
gcaaacacaauggguuaua

SEQ ID NO: 872353 - RNA, 19 nt, Homo sapiens
gcagaaaggaggaguguuc

SEQ ID NO: 872354 - RNA, 19 nt, Homo sapiens
gaagaagcuauuagaagaa

SEQ ID NO: 872355 - RNA, 19 nt, Homo sapiens
ggagaagaauuuauaucca

SEQ ID NO: 872356 - RNA, 19 nt, Homo sapiens
ggucggagauaauagaauc

SEQ ID NO: 872357 - RNA, 19 nt, Homo sapiens
cuaagaagggcuugucaua

SEQ ID NO: 872358 - RNA, 19 nt, Homo sapiens
ccuaagcuaucagaauaua

SEQ ID NO: 872359 - RNA, 19 nt, Homo sapiens
ggagcucacugcccauuuc

SEQ ID NO: 872360 - RNA, 19 nt, Homo sapiens
uauaaaggcuagaauuugg

SEQ ID NO: 872361 - RNA, 19 nt, Homo sapiens
guguauaugcuucauguua

SEQ ID NO: 872362 - RNA, 19 nt, Homo sapiens
gacauaaguagaagacuaa

SEQ ID NO: 872363 - RNA, 19 nt, Homo sapiens
aaggaaagcucuugacagu

SEQ ID NO: 872364 - RNA, 19 nt, Homo sapiens
gaggaaacaccaauuggaa

SEQ ID NO: 872365 - RNA, 19 nt, Homo sapiens
ugaaacaggcaauaaacua

SEQ ID NO: 872366 - RNA, 19 nt, Homo sapiens
guaccgacauugccaagau

SEQ ID NO: 872367 - RNA, 19 nt, Homo sapiens
cagcaaacacaauggguua

SEQ ID NO: 872368 - RNA, 19 nt, Homo sapiens
gaaagaagagaagaauaga

SEQ ID NO: 872369 - RNA, 19 nt, Homo sapiens
gaagacgacauucaguuug

SEQ ID NO: 872370 - RNA, 19 nt, Homo sapiens
gagcuagagaaucaauuua

SEQ ID NO: 872371 - RNA, 19 nt, Homo sapiens
cagcagcauuuccauagaa

SEQ ID NO: 872372 - RNA, 19 nt, Homo sapiens
ggcaacagcacagaauuua

SEQ ID NO: 872373 - RNA, 19 nt, Homo sapiens
uauagcagaugucuccaaa

SEQ ID NO: 872374 - RNA, 19 nt, Homo sapiens
guaaugagcuguccauauu

SEQ ID NO: 872375 - RNA, 19 nt, Homo sapiens
gaaagaaagcccucuguua

SEQ ID NO: 872376 - RNA, 19 nt, Homo sapiens
gaacagcaccuucaguaua

SEQ ID NO: 872377 - RNA, 19 nt, Homo sapiens
gaagaugccuccuccagaa

SEQ ID NO: 872378 - RNA, 19 nt, Homo sapiens
gcaaugagcuuguaaugag

SEQ ID NO: 872379 - RNA, 19 nt, Homo sapiens
gaagagauguacaacaaug

SEQ ID NO: 872380 - RNA, 19 nt, Homo sapiens
gagcacagcuugauaccaa

SEQ ID NO: 872381 - RNA, 19 nt, Homo sapiens
aaagggaagugcacauuua

SEQ ID NO: 872382 - RNA, 19 nt, Homo sapiens
caaagaaacuguuguggau

SEQ ID NO: 872383 - RNA, 19 nt, Homo sapiens
gcaccuagauagagugaaa

SEQ ID NO: 872384 - RNA, 19 nt, Homo sapiens
gacgagagcauuuacaaua

SEQ ID NO: 872385 - RNA, 19 nt, Homo sapiens
gcaauacucucuccagcaa

SEQ ID NO: 872386 - RNA, 19 nt, Homo sapiens
gcacagcuccagugaagua

SEQ ID NO: 872387 - RNA, 19 nt, Homo sapiens
ccagauggcuuacaguuau

SEQ ID NO: 872388 - RNA, 19 nt, Homo sapiens
aaagaaagcccucuguuaa

SEQ ID NO: 872389 - RNA, 19 nt, Homo sapiens
gaagauaaccgaucagaag

SEQ ID NO: 872390 - RNA, 19 nt, Homo sapiens
aagaaacuguuguggauua

SEQ ID NO: 872391 - RNA, 19 nt, Homo sapiens
gcacagaggaccugaauuc

SEQ ID NO: 872392 - RNA, 19 nt, Homo sapiens
gagaacagcaccuucagua

SEQ ID NO: 872393 - RNA, 19 nt, Homo sapiens
gaaagugauuaaugcagaa

SEQ ID NO: 872394 - RNA, 19 nt, Homo sapiens
guacaacuaccgaauaauu

SEQ ID NO: 872395 - RNA, 19 nt, Homo sapiens
ugaagguucucaccauaua

SEQ ID NO: 872396 - RNA, 19 nt, Homo sapiens
aagaagagauguacaacaa

SEQ ID NO: 872397 - RNA, 19 nt, Homo sapiens
gguagcacaucuucaauug

SEQ ID NO: 872398 - RNA, 19 nt, Homo sapiens
gcauugacaccaccucuua

SEQ ID NO: 872399 - RNA, 19 nt, Homo sapiens
gcacaagaauauaagaaag

SEQ ID NO: 872400 - RNA, 19 nt, Homo sapiens
gaucaaagagauugucaaa

SEQ ID NO: 872401 - RNA, 19 nt, Homo sapiens
gaacgaggagaauguguuu

SEQ ID NO: 872402 - RNA, 19 nt, Homo sapiens
gggaagauuugaagaagga

SEQ ID NO: 872403 - RNA, 19 nt, Homo sapiens
ggagaugacucugcgaaga

SEQ ID NO: 872404 - RNA, 19 nt, Homo sapiens
gaaauagaaaccucaaguu

SEQ ID NO: 872405 - RNA, 19 nt, Homo sapiens
ccacagaaucucaguagua

SEQ ID NO: 872406 - RNA, 19 nt, Homo sapiens
gaacucuccuagcaacuug

SEQ ID NO: 872407 - RNA, 19 nt, Homo sapiens
cggacaagcugaagaaguu

SEQ ID NO: 872408 - RNA, 19 nt, Homo sapiens
gcacaucuucaauugauaa

SEQ ID NO: 872409 - RNA, 19 nt, Homo sapiens
caaccaagcucagugacuu

SEQ ID NO: 872410 - RNA, 19 nt, Homo sapiens
aaacaagggcauucugaua

SEQ ID NO: 872411 - RNA, 19 nt, Homo sapiens
ggugaagguugucaucauu

SEQ ID NO: 872412 - RNA, 19 nt, Homo sapiens
cagcuuggcuuccauguca

SEQ ID NO: 872413 - RNA, 19 nt, Homo sapiens
gaaaguaggcaucauguac

SEQ ID NO: 872414 - RNA, 19 nt, Homo sapiens
ggaccugaauuccaaagga

SEQ ID NO: 872415 - RNA, 19 nt, Homo sapiens
uuaaagggcuacaaagaug

SEQ ID NO: 872416 - RNA, 19 nt, Homo sapiens
cagaggaccugaauuccaa

SEQ ID NO: 872417 - RNA, 19 nt, Homo sapiens
ggauagcuuugaugaaugu

SEQ ID NO: 872418 - RNA, 19 nt, Homo sapiens
aacagcaccuucaguauaa

SEQ ID NO: 872419 - RNA, 19 nt, Homo sapiens
gaagucaucagaucuugaa

SEQ ID NO: 872420 - RNA, 19 nt, Homo sapiens
guggauagcuuugaugaau

SEQ ID NO: 872421 - RNA, 19 nt, Homo sapiens
ggaguucaccuaaagaaga

SEQ ID NO: 872422 - RNA, 19 nt, Homo sapiens
gaacuagacugccuuuuag

SEQ ID NO: 872423 - RNA, 19 nt, Homo sapiens
caacaaggccauggaacua

SEQ ID NO: 872424 - RNA, 19 nt, Homo sapiens
aaagauacaucguggaaca

SEQ ID NO: 872425 - RNA, 19 nt, Homo sapiens
ucagagcgauggcaaugaa

SEQ ID NO: 872426 - RNA, 19 nt, Homo sapiens
gaacacccagucagauauu

SEQ ID NO: 872427 - RNA, 19 nt, Homo sapiens
gaagguguuucauacgaau

SEQ ID NO: 872428 - RNA, 19 nt, Homo sapiens
gaacuaccagcagaaagua

SEQ ID NO: 872429 - RNA, 19 nt, Homo sapiens
cucagugacuuucucauua

SEQ ID NO: 872430 - RNA, 19 nt, Homo sapiens
agacaaagcucaccuucag

SEQ ID NO: 872431 - RNA, 19 nt, Homo sapiens
ggaacuagacugccuuuua

SEQ ID NO: 872432 - RNA, 19 nt, Homo sapiens
ccagagaugugccuuccuu

SEQ ID NO: 872433 - RNA, 19 nt, Homo sapiens
guacacaacauacaaagau

SEQ ID NO: 872434 - RNA, 19 nt, Homo sapiens
agaauuccuucaacuauug

SEQ ID NO: 872435 - RNA, 19 nt, Homo sapiens
gcacugaagaagagaugua

SEQ ID NO: 872436 - RNA, 19 nt, Homo sapiens
uagcacaucuucaauugau

SEQ ID NO: 872437 - RNA, 19 nt, Homo sapiens
ggaaauagaaaccucaagu

SEQ ID NO: 872438 - RNA, 19 nt, Homo sapiens
uaagaaagcaugggauuau

SEQ ID NO: 872439 - RNA, 19 nt, Homo sapiens
gagcgauggcaaugaaaua

SEQ ID NO: 872440 - RNA, 19 nt, Homo sapiens
gaacucaacagcuauaacu

SEQ ID NO: 872441 - RNA, 19 nt, Homo sapiens
gcgaagaaaugggcuagga

SEQ ID NO: 872442 - RNA, 19 nt, Homo sapiens
cagcgaagcaacagugaua

SEQ ID NO: 872443 - RNA, 19 nt, Homo sapiens
caacagcuauaacuaucug

SEQ ID NO: 872444 - RNA, 19 nt, Homo sapiens
ggacagagcacugaagaag

SEQ ID NO: 872445 - RNA, 19 nt, Homo sapiens
gaaaauggaucuccguaca

SEQ ID NO: 872446 - RNA, 19 nt, Homo sapiens
gaaggaacacuggaacuau

SEQ ID NO: 872447 - RNA, 19 nt, Homo sapiens
cacaauaguugcagaucaa

SEQ ID NO: 872448 - RNA, 19 nt, Homo sapiens
cagaacacccagucagaua

SEQ ID NO: 872449 - RNA, 19 nt, Homo sapiens
gaguucggcucaaaggauu

SEQ ID NO: 872450 - RNA, 19 nt, Homo sapiens
gcagaaaguaggcaucaug

SEQ ID NO: 872451 - RNA, 19 nt, Homo sapiens
auacaagacuggaccauca

SEQ ID NO: 872452 - RNA, 19 nt, Homo sapiens
gaaaagcucuucgcagaau

SEQ ID NO: 872453 - RNA, 19 nt, Homo sapiens
agaaagagccgccaacauc

SEQ ID NO: 872454 - RNA, 19 nt, Homo sapiens
cggaggaguugcucugaaa

SEQ ID NO: 872455 - RNA, 19 nt, Homo sapiens
ccguacaacuaccgaauaa

SEQ ID NO: 872456 - RNA, 19 nt, Homo sapiens
agagagaaccucaggcuuu

SEQ ID NO: 872457 - RNA, 19 nt, Homo sapiens
gggaacaucuggagaaagc

SEQ ID NO: 872458 - RNA, 19 nt, Homo sapiens
cuuauucccuccauagaaa

SEQ ID NO: 872459 - RNA, 19 nt, Homo sapiens
aauccgaacucaacagcua

SEQ ID NO: 872460 - RNA, 19 nt, Homo sapiens
gcaaagaagugaggauagc

SEQ ID NO: 872461 - RNA, 19 nt, Homo sapiens
gcaugccagugauggagua

SEQ ID NO: 872462 - RNA, 19 nt, Homo sapiens
ucaaagagauugucaaaag

SEQ ID NO: 872463 - RNA, 19 nt, Homo sapiens
ggaagcggcacauuggaaa

SEQ ID NO: 872464 - RNA, 19 nt, Homo sapiens
gaggccuucuuacaccuua

SEQ ID NO: 872465 - RNA, 19 nt, Homo sapiens
ccaagucgcucccguugag

SEQ ID NO: 872466 - RNA, 19 nt, Homo sapiens
gagaugacucugcgaagaa

SEQ ID NO: 872467 - RNA, 19 nt, Homo sapiens
gcucauaaaucggagaagu

SEQ ID NO: 872468 - RNA, 19 nt, Homo sapiens
ugccaaaggugaagaacuu

SEQ ID NO: 872469 - RNA, 19 nt, Homo sapiens
cagauggcuuacaguuaua

SEQ ID NO: 872470 - RNA, 19 nt, Homo sapiens
acgccuagcuggcaaagaa

SEQ ID NO: 872471 - RNA, 19 nt, Homo sapiens
gaugaucgaccuccugaga

SEQ ID NO: 872472 - RNA, 19 nt, Homo sapiens
gaagaagagauguacaaca

SEQ ID NO: 872473 - RNA, 19 nt, Homo sapiens
aaggaacacuggaacuauu

SEQ ID NO: 872474 - RNA, 19 nt, Homo sapiens
gaacacguuugucuugaua

SEQ ID NO: 872475 - RNA, 19 nt, Homo sapiens
ggaagaagguucaggaguu

SEQ ID NO: 872476 - RNA, 19 nt, Homo sapiens
ggaaagaccugcccuacga

SEQ ID NO: 872477 - RNA, 19 nt, Homo sapiens
ggaggcagcugaagaguga

SEQ ID NO: 872478 - RNA, 19 nt, Homo sapiens
gcaacuaccuggagaugaa

SEQ ID NO: 872479 - RNA, 19 nt, Homo sapiens
gaagaagguucaggaguuu

SEQ ID NO: 872480 - RNA, 19 nt, Homo sapiens
gcaagcaggucaacuacaa

SEQ ID NO: 872481 - RNA, 19 nt, Homo sapiens
ccaagaggcugcucaagaa

SEQ ID NO: 872482 - RNA, 19 nt, Homo sapiens
gaacaaccaguccaaguuu

SEQ ID NO: 872483 - RNA, 19 nt, Homo sapiens
gcucaaggcugacguguuc

SEQ ID NO: 872484 - RNA, 19 nt, Homo sapiens
gaaauuuccagccacuuua

SEQ ID NO: 872485 - RNA, 19 nt, Homo sapiens
ucagcgggcucacauguua

SEQ ID NO: 872486 - RNA, 19 nt, Homo sapiens
aggaugagcucucugauaa

SEQ ID NO: 872487 - RNA, 19 nt, Homo sapiens
uuaaacagcuacaagauug

SEQ ID NO: 872488 - RNA, 19 nt, Homo sapiens
gaaagaacgacauggauga

SEQ ID NO: 872489 - RNA, 19 nt, Homo sapiens
acaagaaggugaugaucua

SEQ ID NO: 872490 - RNA, 19 nt, Homo sapiens
gcuacaagauugauuacaa

SEQ ID NO: 872491 - RNA, 19 nt, Homo sapiens
gaagugccaccucaucaua

SEQ ID NO: 872492 - RNA, 19 nt, Homo sapiens
ggaagaaggaggacaagaa

SEQ ID NO: 872493 - RNA, 19 nt, Homo sapiens
ccgaggagauggagaauga

SEQ ID NO: 872494 - RNA, 19 nt, Homo sapiens
agacagaccaccaggauua

SEQ ID NO: 872495 - RNA, 19 nt, Homo sapiens
gaucaaaggcuccaaagau

SEQ ID NO: 872496 - RNA, 19 nt, Homo sapiens
guacgaaggcuacaaguau

SEQ ID NO: 872497 - RNA, 19 nt, Homo sapiens
gaagaaguacuacaaguuc

SEQ ID NO: 872498 - RNA, 19 nt, Homo sapiens
ccaagaagcucaaggaaaa

SEQ ID NO: 872499 - RNA, 19 nt, Homo sapiens
caucauaauucaaguguuc

SEQ ID NO: 872500 - RNA, 19 nt, Homo sapiens
ggcaggacauccagaauga

SEQ ID NO: 872501 - RNA, 19 nt, Homo sapiens
ugaagaaacugcgggauga

SEQ ID NO: 872502 - RNA, 19 nt, Homo sapiens
agaagaaacucaaggacaa

SEQ ID NO: 872503 - RNA, 19 nt, Homo sapiens
gagagagaguucuuuguca

SEQ ID NO: 872504 - RNA, 19 nt, Homo sapiens
gaugauggaugcuuaaagg

SEQ ID NO: 872505 - RNA, 19 nt, Homo sapiens
uaaugaugauggaugcuua

SEQ ID NO: 872506 - RNA, 19 nt, Homo sapiens
gaugaggacuuugaagaga

SEQ ID NO: 872507 - RNA, 19 nt, Homo sapiens
ccaagucucuucugugcaa

SEQ ID NO: 872508 - RNA, 19 nt, Homo sapiens
cagcacugaugucucuuua

SEQ ID NO: 872509 - RNA, 19 nt, Homo sapiens
gaaauucaaguucauguuc

SEQ ID NO: 872510 - RNA, 19 nt, Homo sapiens
ggaugaggaugaggacuuu

SEQ ID NO: 872511 - RNA, 19 nt, Homo sapiens
uacagaagaugcugaagaa

SEQ ID NO: 872512 - RNA, 19 nt, Homo sapiens
gaaagaagugcagaucaaa

SEQ ID NO: 872513 - RNA, 19 nt, Homo sapiens
aagaagguauuccguauga

SEQ ID NO: 872514 - RNA, 19 nt, Homo sapiens
agaaagaagugcagaucaa

SEQ ID NO: 872515 - RNA, 19 nt, Homo sapiens
ggaaagggcugcgugaaaa

SEQ ID NO: 872516 - RNA, 19 nt, Homo sapiens
gauaaccagucagaauauu

SEQ ID NO: 872517 - RNA, 19 nt, Homo sapiens
gaagcucccuggucaaguc

SEQ ID NO: 872518 - RNA, 19 nt, Homo sapiens
aaagggcccuaccugguua

SEQ ID NO: 872519 - RNA, 19 nt, Homo sapiens
gcacugcccuguggacuca

SEQ ID NO: 872520 - RNA, 19 nt, Homo sapiens
gaaggacgacgacgaugaa

SEQ ID NO: 872521 - RNA, 19 nt, Homo sapiens
gcaagaagaagaggauuga

SEQ ID NO: 872522 - RNA, 19 nt, Homo sapiens
aagaggaucuggaagagaa

SEQ ID NO: 872523 - RNA, 19 nt, Homo sapiens
gagaaggagcccauugaaa

SEQ ID NO: 872524 - RNA, 19 nt, Homo sapiens
cggaggaacucuucaagga

SEQ ID NO: 872525 - RNA, 19 nt, Homo sapiens
gcaagacggugcagaccau

SEQ ID NO: 872526 - RNA, 19 nt, Homo sapiens
ggaugaggaugauaaugau

SEQ ID NO: 872527 - RNA, 19 nt, Homo sapiens
gaaugaagaggaucuggaa

SEQ ID NO: 872528 - RNA, 19 nt, Homo sapiens
gcucacauguuaugguuca

SEQ ID NO: 872529 - RNA, 19 nt, Homo sapiens
uaaugaggcugucucugaa

SEQ ID NO: 872530 - RNA, 19 nt, Homo sapiens
ggaaggcguuucugagucu

SEQ ID NO: 872531 - RNA, 19 nt, Homo sapiens
ggaacaagccugccaaugc

SEQ ID NO: 872532 - RNA, 19 nt, Homo sapiens
gagcaggcguuggucauug

SEQ ID NO: 872533 - RNA, 19 nt, Homo sapiens
uacagaacaugaacgagua

SEQ ID NO: 872534 - RNA, 19 nt, Homo sapiens
cagaguggaugaugauuca

SEQ ID NO: 872535 - RNA, 19 nt, Homo sapiens
gaagaggauugaugauggu

SEQ ID NO: 872536 - RNA, 19 nt, Homo sapiens
caaacucacuggcguugug

SEQ ID NO: 872537 - RNA, 19 nt, Homo sapiens
gcagaauccugggaauguu

SEQ ID NO: 872538 - RNA, 19 nt, Homo sapiens
gaagaucaaaggcuccaaa

SEQ ID NO: 872539 - RNA, 19 nt, Homo sapiens
gaugacguauggaagauuc

SEQ ID NO: 872540 - RNA, 19 nt, Homo sapiens
cgggagggauugucaacua

SEQ ID NO: 872541 - RNA, 19 nt, Homo sapiens
aaccauagcuuugacaaga

SEQ ID NO: 872542 - RNA, 19 nt, Homo sapiens
gggcucacauguuaugguu

SEQ ID NO: 872543 - RNA, 19 nt, Homo sapiens
gaugugcacuaccugauca

SEQ ID NO: 872544 - RNA, 19 nt, Homo sapiens
uaucgcaacuaccaaagaa

SEQ ID NO: 872545 - RNA, 19 nt, Homo sapiens
aaaguuggaugacguaugg

SEQ ID NO: 872546 - RNA, 19 nt, Homo sapiens
gaaggaguuuagagccuau

SEQ ID NO: 872547 - RNA, 19 nt, Homo sapiens
acacggagcuacagaacau

SEQ ID NO: 872548 - RNA, 19 nt, Homo sapiens
gaagaaagaagugcagauc

SEQ ID NO: 872549 - RNA, 19 nt, Homo sapiens
gaacgcgaguuugagaugu

SEQ ID NO: 872550 - RNA, 19 nt, Homo sapiens
ugaaggcccuggacucugu

SEQ ID NO: 872551 - RNA, 19 nt, Homo sapiens
gaagaaggaggacaagaag

SEQ ID NO: 872552 - RNA, 19 nt, Homo sapiens
gaaggagcccauugaaaca

SEQ ID NO: 872553 - RNA, 19 nt, Homo sapiens
gagaaaagaucugagaaug

SEQ ID NO: 872554 - RNA, 19 nt, Homo sapiens
ggagaaggagcccauugaa

SEQ ID NO: 872555 - RNA, 19 nt, Homo sapiens
gaagagcgagaaggaguuu

SEQ ID NO: 872556 - RNA, 19 nt, Homo sapiens
cagaagaaguacuacaagu

SEQ ID NO: 872557 - RNA, 19 nt, Homo sapiens
gaugagcuaucagagaaug

SEQ ID NO: 872558 - RNA, 19 nt, Homo sapiens
caaagggcccuaccugguu

SEQ ID NO: 872559 - RNA, 19 nt, Homo sapiens
gcucugaggaugaggauga

SEQ ID NO: 872560 - RNA, 19 nt, Homo sapiens
caccgaauccugaaccaua

SEQ ID NO: 872561 - RNA, 19 nt, Homo sapiens
cgagaugucagaagaagaa

SEQ ID NO: 872562 - RNA, 19 nt, Homo sapiens
ggaagcggaagaagaaaga

SEQ ID NO: 872563 - RNA, 19 nt, Homo sapiens
agaagaagaggauugauga

SEQ ID NO: 872564 - RNA, 19 nt, Homo sapiens
gcacugaugucucuuuacc

SEQ ID NO: 872565 - RNA, 19 nt, Homo sapiens
gaaaggcuccucgagugaa

SEQ ID NO: 872566 - RNA, 19 nt, Homo sapiens
ggaaauucaaguucauguu

SEQ ID NO: 872567 - RNA, 19 nt, Homo sapiens
ugagccagaugcagaagaa

SEQ ID NO: 872568 - RNA, 19 nt, Homo sapiens
gaagaagguauuccguaug

SEQ ID NO: 872569 - RNA, 19 nt, Homo sapiens
caaucaccuuuacuuugua

SEQ ID NO: 872570 - RNA, 19 nt, Homo sapiens
acacguuugucuugauaaa

SEQ ID NO: 872571 - RNA, 19 nt, Homo sapiens
gcacuuuccuauugaagac

SEQ ID NO: 872572 - RNA, 19 nt, Homo sapiens
aaagggaaaccuaguaaug

SEQ ID NO: 872573 - RNA, 19 nt, Homo sapiens
gaaccaggacgcuacagau

SEQ ID NO: 872574 - RNA, 19 nt, Homo sapiens
ggucaaauuugucuuguua

SEQ ID NO: 872575 - RNA, 19 nt, Homo sapiens
gaacugaggcacagauuaa

SEQ ID NO: 872576 - RNA, 19 nt, Homo sapiens
gaacagggccaguauggaa

SEQ ID NO: 872577 - RNA, 19 nt, Homo sapiens
gacauuugaucaaccuuua

SEQ ID NO: 872578 - RNA, 19 nt, Homo sapiens
caagagauauccaaugcuu

SEQ ID NO: 872579 - RNA, 19 nt, Homo sapiens
ggagagaaguguuuauuuu

SEQ ID NO: 872580 - RNA, 19 nt, Homo sapiens
gcugacagauuuccaagaa

SEQ ID NO: 872581 - RNA, 19 nt, Homo sapiens
ggauuaagguggacaagau

SEQ ID NO: 872582 - RNA, 19 nt, Homo sapiens
ggauuaagguggacaagau

SEQ ID NO: 872583 - RNA, 19 nt, Homo sapiens
cagaagugcugacaaauuc

SEQ ID NO: 872584 - RNA, 19 nt, Homo sapiens
uauaugaggccuaguaaua

SEQ ID NO: 872585 - RNA, 19 nt, Homo sapiens
ucauaugguuggaguguua

SEQ ID NO: 872586 - RNA, 19 nt, Homo sapiens
gaagcgugcucauuucaug

SEQ ID NO: 872587 - RNA, 19 nt, Homo sapiens
caacaguacucagcauauu

SEQ ID NO: 872588 - RNA, 19 nt, Homo sapiens
uuaauacgcucauaugguu

SEQ ID NO: 872589 - RNA, 19 nt, Homo sapiens
gaauaccaguccuguucua

SEQ ID NO: 872590 - RNA, 19 nt, Homo sapiens
caaguagcauggacauuug

SEQ ID NO: 872591 - RNA, 19 nt, Homo sapiens
ccauuuaaauucuguguga

SEQ ID NO: 872592 - RNA, 19 nt, Homo sapiens
ggacuugccuguguugaau

SEQ ID NO: 872593 - RNA, 19 nt, Homo sapiens
ggauaaaugcugacagauu

SEQ ID NO: 872594 - RNA, 19 nt, Homo sapiens
cggcagcucuggugaauug

SEQ ID NO: 872595 - RNA, 19 nt, Homo sapiens
gacaaacgcguuagcaauu

SEQ ID NO: 872596 - RNA, 19 nt, Homo sapiens
ugagaguucuuaauugcua

SEQ ID NO: 872597 - RNA, 19 nt, Homo sapiens
gguaacaguucccauuuua

SEQ ID NO: 872598 - RNA, 19 nt, Homo sapiens
guacaaagaagacgacugu

SEQ ID NO: 872599 - RNA, 19 nt, Homo sapiens
ccacgcagcacuacuauga

SEQ ID NO: 872600 - RNA, 19 nt, Homo sapiens
aaacuuaggccaacaugaa

SEQ ID NO: 872601 - RNA, 19 nt, Homo sapiens
gaccuaauuugcaaacuca

SEQ ID NO: 872602 - RNA, 19 nt, Homo sapiens
uuaaaggacuugccugugu

SEQ ID NO: 872603 - RNA, 19 nt, Homo sapiens
ccauuaagguuuguuguug

SEQ ID NO: 872604 - RNA, 19 nt, Homo sapiens
gcagguaacaguucccauu

SEQ ID NO: 872605 - RNA, 19 nt, Homo sapiens
ggaccaacaucaacaugca

SEQ ID NO: 872606 - RNA, 19 nt, Homo sapiens
gaacaggucaaauuugucu

SEQ ID NO: 872607 - RNA, 19 nt, Homo sapiens
uaaaggacuugccuguguu

SEQ ID NO: 872608 - RNA, 19 nt, Homo sapiens
gucgggugcuuuagaauuu

SEQ ID NO: 872609 - RNA, 19 nt, Homo sapiens
gcaagcauuucuuuucuuu

SEQ ID NO: 872610 - RNA, 19 nt, Homo sapiens
gccacuucauuucuauuua

SEQ ID NO: 872611 - RNA, 19 nt, Homo sapiens
ccuaagaucugaaaagaaa

SEQ ID NO: 872612 - RNA, 19 nt, Homo sapiens
ucauagaccuaauuugcaa

SEQ ID NO: 872613 - RNA, 19 nt, Homo sapiens
uccaagaacuaccaagaaa

SEQ ID NO: 872614 - RNA, 19 nt, Homo sapiens
acaaagaagacgacuguuu

SEQ ID NO: 872615 - RNA, 19 nt, Homo sapiens
acaaacgcguuagcaauuu

SEQ ID NO: 872616 - RNA, 19 nt, Homo sapiens
gcacuaaggguuucuaaaa

SEQ ID NO: 872617 - RNA, 19 nt, Homo sapiens
ggacauuugaucaaccuuu

SEQ ID NO: 872618 - RNA, 19 nt, Homo sapiens
agaagaugcuggacgagaa

SEQ ID NO: 872619 - RNA, 19 nt, Homo sapiens
ggaccuacuugcucagauc

SEQ ID NO: 872620 - RNA, 19 nt, Homo sapiens
caacccagucuccaugaua

SEQ ID NO: 872621 - RNA, 19 nt, Homo sapiens
gggagagaaguguuuauuu

SEQ ID NO: 872622 - RNA, 19 nt, Homo sapiens
gauauaugaggccuaguaa

SEQ ID NO: 872623 - RNA, 19 nt, Homo sapiens
ggugaauugugacauguug

SEQ ID NO: 872624 - RNA, 19 nt, Homo sapiens
gcaguaagggacacacauu

SEQ ID NO: 872625 - RNA, 19 nt, Homo sapiens
uggacaagaucuccuaaga

SEQ ID NO: 872626 - RNA, 19 nt, Homo sapiens
uggacaagaucuccuaaga

SEQ ID NO: 872627 - RNA, 19 nt, Homo sapiens
gaaggccagugaagaagca

SEQ ID NO: 872628 - RNA, 19 nt, Homo sapiens
acaaguagcauggacauuu

SEQ ID NO: 872629 - RNA, 19 nt, Homo sapiens
aaaguauggucaaaggaaa

SEQ ID NO: 872630 - RNA, 19 nt, Homo sapiens
gcugacaaauucauauugg

SEQ ID NO: 872631 - RNA, 19 nt, Homo sapiens
agucggaguuugacguaua

SEQ ID NO: 872632 - RNA, 19 nt, Homo sapiens
cagcaaaccauccagaaga

SEQ ID NO: 872633 - RNA, 19 nt, Homo sapiens
gaacucaugccaacagucu

SEQ ID NO: 872634 - RNA, 19 nt, Homo sapiens
gguugauggugcuuuguuu

SEQ ID NO: 872635 - RNA, 19 nt, Homo sapiens
gaaagucacauccaguuac

SEQ ID NO: 872636 - RNA, 19 nt, Homo sapiens
caucacccauuaagguuug

SEQ ID NO: 872637 - RNA, 19 nt, Homo sapiens
gagaguucuuaauugcuaa

SEQ ID NO: 872638 - RNA, 19 nt, Homo sapiens
agagugaaauuccgucuca

SEQ ID NO: 872639 - RNA, 19 nt, Homo sapiens
caaagaagacgacuguuuu

SEQ ID NO: 872640 - RNA, 19 nt, Homo sapiens
cauuaagguuuguuguuga

SEQ ID NO: 872641 - RNA, 19 nt, Homo sapiens
caaacgcguuagcaauuuc

SEQ ID NO: 872642 - RNA, 19 nt, Homo sapiens
gaaaucuggaggcagguaa

SEQ ID NO: 872643 - RNA, 19 nt, Homo sapiens
ugaaagucacauccaguua

SEQ ID NO: 872644 - RNA, 19 nt, Homo sapiens
aaacauccuuaucgguuau

SEQ ID NO: 872645 - RNA, 19 nt, Homo sapiens
gcucauucuucuuccuauu

SEQ ID NO: 872646 - RNA, 19 nt, Homo sapiens
ugacagauuuccaagaacu

SEQ ID NO: 872647 - RNA, 19 nt, Homo sapiens
agacggaugucacgcacaa

SEQ ID NO: 872648 - RNA, 19 nt, Homo sapiens
ugauauaugaggccuagua

SEQ ID NO: 872649 - RNA, 19 nt, Homo sapiens
gcucaucacccauuaaggu

SEQ ID NO: 872650 - RNA, 19 nt, Homo sapiens
ucuaucuucugucauauga

SEQ ID NO: 872651 - RNA, 19 nt, Homo sapiens
gaaagugaugccagcaguu

SEQ ID NO: 872652 - RNA, 19 nt, Homo sapiens
gcaggagaauggcuugaac

SEQ ID NO: 872653 - RNA, 19 nt, Homo sapiens
uccaaugcuugauauauga

SEQ ID NO: 872654 - RNA, 19 nt, Homo sapiens
cuucaaaacuguacaaaga

SEQ ID NO: 872655 - RNA, 19 nt, Homo sapiens
uaagugaaccucugauuuu

SEQ ID NO: 872656 - RNA, 19 nt, Homo sapiens
ucauaugaauguugagcaa

SEQ ID NO: 872657 - RNA, 19 nt, Homo sapiens
ugaaagaaaaggacacuua

SEQ ID NO: 872658 - RNA, 19 nt, Homo sapiens
cuaauugacaaacgcguua

SEQ ID NO: 872659 - RNA, 19 nt, Homo sapiens
agagauauccaaugcuuga

SEQ ID NO: 872660 - RNA, 19 nt, Homo sapiens
uacaagagauauccaaugc

SEQ ID NO: 872661 - RNA, 19 nt, Homo sapiens
gcaaaaguauggucaaagg

SEQ ID NO: 872662 - RNA, 19 nt, Homo sapiens
uuaagugaaccucugauuu

SEQ ID NO: 872663 - RNA, 19 nt, Homo sapiens
ugacaaacgcguuagcaau

SEQ ID NO: 872664 - RNA, 19 nt, Homo sapiens
gaagaacugaggcacagau

SEQ ID NO: 872665 - RNA, 19 nt, Homo sapiens
agagucgggugcuuuagaa

SEQ ID NO: 872666 - RNA, 19 nt, Homo sapiens
cagcucuggugaauuguga

SEQ ID NO: 872667 - RNA, 19 nt, Homo sapiens
gaucugaaaagaaaccuua

SEQ ID NO: 872668 - RNA, 19 nt, Homo sapiens
acaguacucagcauauuaa

SEQ ID NO: 872669 - RNA, 19 nt, Homo sapiens
cgaaaugagaguucuuaau

SEQ ID NO: 872670 - RNA, 19 nt, Homo sapiens
gaaaccccgucccuacuaa

SEQ ID NO: 872671 - RNA, 19 nt, Homo sapiens
aaagacagcacacuugcaa

SEQ ID NO: 872672 - RNA, 19 nt, Homo sapiens
aaagucacauccaguuaca

SEQ ID NO: 872673 - RNA, 19 nt, Homo sapiens
gaucuccaagcaagcauuu

SEQ ID NO: 872674 - RNA, 19 nt, Homo sapiens
gaaacacccucaauuagga

SEQ ID NO: 872675 - RNA, 19 nt, Homo sapiens
gaaaugaacccuucgaaug

SEQ ID NO: 872676 - RNA, 19 nt, Homo sapiens
ccagaaagcugccagaaau

SEQ ID NO: 872677 - RNA, 19 nt, Homo sapiens
caacagcacuucugaccaa

SEQ ID NO: 872678 - RNA, 19 nt, Homo sapiens
gaacaagcauaaggagaaa

SEQ ID NO: 872679 - RNA, 19 nt, Homo sapiens
uaacuuacuugcugccuuu

SEQ ID NO: 872680 - RNA, 19 nt, Homo sapiens
ccacaaagcgggcuaagaa

SEQ ID NO: 872681 - RNA, 19 nt, Homo sapiens
gaacaggaauuuucuauca

SEQ ID NO: 872682 - RNA, 19 nt, Homo sapiens
gaaagcauuugacaauaca

SEQ ID NO: 872683 - RNA, 19 nt, Homo sapiens
gcaaauagaguaacugaca

SEQ ID NO: 872684 - RNA, 19 nt, Homo sapiens
ugaaguaguuaacaggaua

SEQ ID NO: 872685 - RNA, 19 nt, Homo sapiens
ccagugaccucaaaggauu

SEQ ID NO: 872686 - RNA, 19 nt, Homo sapiens
agacagcagugcauaguaa

SEQ ID NO: 872687 - RNA, 19 nt, Homo sapiens
gaggagcuaugaaggcuuu

SEQ ID NO: 872688 - RNA, 19 nt, Homo sapiens
gagauuggcucccuaaagg

SEQ ID NO: 872689 - RNA, 19 nt, Homo sapiens
ggucaagaaugcccagaaa

SEQ ID NO: 872690 - RNA, 19 nt, Homo sapiens
guaguuaacaggauacuuu

SEQ ID NO: 872691 - RNA, 19 nt, Homo sapiens
cagaaagcauuugacaaua

SEQ ID NO: 872692 - RNA, 19 nt, Homo sapiens
ggaauugugugaucagaag

SEQ ID NO: 872693 - RNA, 19 nt, Homo sapiens
ugaagacacucaagaggaa

SEQ ID NO: 872694 - RNA, 19 nt, Homo sapiens
gaagguggaauucuaguga

SEQ ID NO: 872695 - RNA, 19 nt, Homo sapiens
ggaagcagcccacccaguu

SEQ ID NO: 872696 - RNA, 19 nt, Homo sapiens
ggaaaugcugagaaaguua

SEQ ID NO: 872697 - RNA, 19 nt, Homo sapiens
aaucagaucuuguccuguu

SEQ ID NO: 872698 - RNA, 19 nt, Homo sapiens
gcuguaacccguuccauuu

SEQ ID NO: 872699 - RNA, 19 nt, Homo sapiens
aaacugggcaagcagauua

SEQ ID NO: 872700 - RNA, 19 nt, Homo sapiens
ggcaggagaugguuuggaa

SEQ ID NO: 872701 - RNA, 19 nt, Homo sapiens
ccagaaagcauuugacaau

SEQ ID NO: 872702 - RNA, 19 nt, Homo sapiens
gaaagaagccacuccaaaa

SEQ ID NO: 872703 - RNA, 19 nt, Homo sapiens
gcgaugaccuccaguuucu

SEQ ID NO: 872704 - RNA, 19 nt, Homo sapiens
ucaauaagaugaagacacu

SEQ ID NO: 872705 - RNA, 19 nt, Homo sapiens
caaauagaguaacugacaa

SEQ ID NO: 872706 - RNA, 19 nt, Homo sapiens
ccaaugacaccaugacaaa

SEQ ID NO: 872707 - RNA, 19 nt, Homo sapiens
gaagaagccagccgcaguu

SEQ ID NO: 872708 - RNA, 19 nt, Homo sapiens
gaaaugcugagaaaguuau

SEQ ID NO: 872709 - RNA, 19 nt, Homo sapiens
gaagguuauuccgcagaua

SEQ ID NO: 872710 - RNA, 19 nt, Homo sapiens
auucaacucuccauuauga

SEQ ID NO: 872711 - RNA, 19 nt, Homo sapiens
ccauuguacuuccauauau

SEQ ID NO: 872712 - RNA, 19 nt, Homo sapiens
aaaugaacccuucgaauga

SEQ ID NO: 872713 - RNA, 19 nt, Homo sapiens
aaacgaagguggacuugca

SEQ ID NO: 872714 - RNA, 19 nt, Homo sapiens
caugagcagugaaguaguu

SEQ ID NO: 872715 - RNA, 19 nt, Homo sapiens
gaccugaaucuuucccuua

SEQ ID NO: 872716 - RNA, 19 nt, Homo sapiens
ggaaacacccucaauuagg

SEQ ID NO: 872717 - RNA, 19 nt, Homo sapiens
gaauccauaucccagcauu

SEQ ID NO: 872718 - RNA, 19 nt, Homo sapiens
gaaaagaucaugccagaga

SEQ ID NO: 872719 - RNA, 19 nt, Homo sapiens
gugagaagaacaagcauaa

SEQ ID NO: 872720 - RNA, 19 nt, Homo sapiens
gcagagcagccaaggauau

SEQ ID NO: 872721 - RNA, 19 nt, Homo sapiens
uggaaugccuuacacauca

SEQ ID NO: 872722 - RNA, 19 nt, Homo sapiens
gaaguuggcccagcuagug

SEQ ID NO: 872723 - RNA, 19 nt, Homo sapiens
gagggaagucugaagcuaa

SEQ ID NO: 872724 - RNA, 19 nt, Homo sapiens
ugugaucacuccagucaaa

SEQ ID NO: 872725 - RNA, 19 nt, Homo sapiens
uagaguaacugacaaacca

SEQ ID NO: 872726 - RNA, 19 nt, Homo sapiens
gcagagcauaggcagaaua

SEQ ID NO: 872727 - RNA, 19 nt, Homo sapiens
caaccaaccauaagaggaa

SEQ ID NO: 872728 - RNA, 19 nt, Homo sapiens
aaacacaaacacaagcaua

SEQ ID NO: 872729 - RNA, 19 nt, Homo sapiens
ucugaacccucccaaggua

SEQ ID NO: 872730 - RNA, 19 nt, Homo sapiens
gggaaacacccucaauuag

SEQ ID NO: 872731 - RNA, 19 nt, Homo sapiens
gcaucgaccugcccagcaa

SEQ ID NO: 872732 - RNA, 19 nt, Homo sapiens
ccaagcggcugcagagaca

SEQ ID NO: 872733 - RNA, 19 nt, Homo sapiens
ggagaggacaaacccauga

SEQ ID NO: 872734 - RNA, 19 nt, Homo sapiens
gcagugaaguaguuaacag

SEQ ID NO: 872735 - RNA, 19 nt, Homo sapiens
gagcauaggcagaauaaaa

SEQ ID NO: 872736 - RNA, 19 nt, Homo sapiens
uguaacccguuccauuuaa

SEQ ID NO: 872737 - RNA, 19 nt, Homo sapiens
ggagaaaagcugcaaauug

SEQ ID NO: 872738 - RNA, 19 nt, Homo sapiens
gcagggagacaccuucaga

SEQ ID NO: 872739 - RNA, 19 nt, Homo sapiens
ggaaugccuuacacaucaa

SEQ ID NO: 872740 - RNA, 19 nt, Homo sapiens
cagcagccauugaaagcaa

SEQ ID NO: 872741 - RNA, 19 nt, Homo sapiens
gaaagcgacgacgcaauuu

SEQ ID NO: 872742 - RNA, 19 nt, Homo sapiens
gcaaaggcccaggguaaga

SEQ ID NO: 872743 - RNA, 19 nt, Homo sapiens
ucaagaagccaaagcacaa

SEQ ID NO: 872744 - RNA, 19 nt, Homo sapiens
agaaagcgacgacgcaauu

SEQ ID NO: 872745 - RNA, 19 nt, Homo sapiens
agaaagcauuugacaauac

SEQ ID NO: 872746 - RNA, 19 nt, Homo sapiens
gagaugguuuggaagaaca

SEQ ID NO: 872747 - RNA, 19 nt, Homo sapiens
acauucaacucuccauuau

SEQ ID NO: 872748 - RNA, 19 nt, Homo sapiens
ggaaagaggaaacacaaac

SEQ ID NO: 872749 - RNA, 19 nt, Homo sapiens
ccaagauccuguccaccaa

SEQ ID NO: 872750 - RNA, 19 nt, Homo sapiens
cggagaaccuggacguguu

SEQ ID NO: 872751 - RNA, 19 nt, Homo sapiens
ucagugcucuuccaaccaa

SEQ ID NO: 872752 - RNA, 19 nt, Homo sapiens
uaagucagaccauaccaaa

SEQ ID NO: 872753 - RNA, 19 nt, Homo sapiens
agaaagaagccacuccaaa

SEQ ID NO: 872754 - RNA, 19 nt, Homo sapiens
gagaagaacaagcauaagg

SEQ ID NO: 872755 - RNA, 19 nt, Homo sapiens
ucaccaaguuccaaguguu

SEQ ID NO: 872756 - RNA, 19 nt, Homo sapiens
uggaggagcuaaucaccaa

SEQ ID NO: 872757 - RNA, 19 nt, Homo sapiens
gcaaaagcaucucauugug

SEQ ID NO: 872758 - RNA, 19 nt, Homo sapiens
uggaaaugcugagaaaguu

SEQ ID NO: 872759 - RNA, 19 nt, Homo sapiens
gggaacacguggagucagu

SEQ ID NO: 872760 - RNA, 19 nt, Homo sapiens
uaaagauucagaccacaaa

SEQ ID NO: 872761 - RNA, 19 nt, Homo sapiens
gcagcuaugcacccacuuu

SEQ ID NO: 872762 - RNA, 19 nt, Homo sapiens
gauccaaccaaccauaaga

SEQ ID NO: 872763 - RNA, 19 nt, Homo sapiens
ugugauaagucagaccaua

SEQ ID NO: 872764 - RNA, 19 nt, Homo sapiens
gaacacguggagucaguug

SEQ ID NO: 872765 - RNA, 19 nt, Homo sapiens
ggaagucugaagcuaaaga

SEQ ID NO: 872766 - RNA, 19 nt, Homo sapiens
gaugucaaccaggcuauuu

SEQ ID NO: 872767 - RNA, 19 nt, Homo sapiens
ggacacaggccaaggaaaa

SEQ ID NO: 872768 - RNA, 19 nt, Homo sapiens
caccucaguuccacacaaa

SEQ ID NO: 872769 - RNA, 19 nt, Homo sapiens
ucaaagaagaagcguggua

SEQ ID NO: 872770 - RNA, 19 nt, Homo sapiens
gcacaagaggaaacggaaa

SEQ ID NO: 872771 - RNA, 19 nt, Homo sapiens
cagagcauaggcagaauaa

SEQ ID NO: 872772 - RNA, 19 nt, Homo sapiens
ccucagacccgcauucaug

SEQ ID NO: 872773 - RNA, 19 nt, Homo sapiens
agaacaagcauaaggagaa

SEQ ID NO: 872774 - RNA, 19 nt, Homo sapiens
gcacagaggugagggauua

SEQ ID NO: 872775 - RNA, 19 nt, Homo sapiens
cagacaagaucacaaauua

SEQ ID NO: 872776 - RNA, 19 nt, Homo sapiens
gcauuaaacugucauugua

SEQ ID NO: 872777 - RNA, 19 nt, Homo sapiens
gaaaugagacugaagcuuu

SEQ ID NO: 872778 - RNA, 19 nt, Homo sapiens
gaaaggaccugcugcugaa

SEQ ID NO: 872779 - RNA, 19 nt, Homo sapiens
guaaaguucucuuguauga

SEQ ID NO: 872780 - RNA, 19 nt, Homo sapiens
gcaacaggcuuaacacuga

SEQ ID NO: 872781 - RNA, 19 nt, Homo sapiens
agaauaagcucaucaaguu

SEQ ID NO: 872782 - RNA, 19 nt, Homo sapiens
ucacagagcucgaaagaga

SEQ ID NO: 872783 - RNA, 19 nt, Homo sapiens
gaaacgaugcccaaucuua

SEQ ID NO: 872784 - RNA, 19 nt, Homo sapiens
gacagaagcugauuuaaca

SEQ ID NO: 872785 - RNA, 19 nt, Homo sapiens
acacuaaggucuccauaua

SEQ ID NO: 872786 - RNA, 19 nt, Homo sapiens
ucagaacccuuuaauguaa

SEQ ID NO: 872787 - RNA, 19 nt, Homo sapiens
caaaggcuccuacauguua

SEQ ID NO: 872788 - RNA, 19 nt, Homo sapiens
ggaaguagaauuucaugua

SEQ ID NO: 872789 - RNA, 19 nt, Homo sapiens
gcacuagguuugaauucua

SEQ ID NO: 872790 - RNA, 19 nt, Homo sapiens
gaacuaguuugaaaucguu

SEQ ID NO: 872791 - RNA, 19 nt, Homo sapiens
gcugaagacugguaaauau

SEQ ID NO: 872792 - RNA, 19 nt, Homo sapiens
acaacuaucuugcugcuua

SEQ ID NO: 872793 - RNA, 19 nt, Homo sapiens
ccacagacaggcugaauua

SEQ ID NO: 872794 - RNA, 19 nt, Homo sapiens
caauggauuugcaggauua

SEQ ID NO: 872795 - RNA, 19 nt, Homo sapiens
ccacuuagaucacaaucaa

SEQ ID NO: 872796 - RNA, 19 nt, Homo sapiens
caacugccauuuacuguau

SEQ ID NO: 872797 - RNA, 19 nt, Homo sapiens
gaaaaggucucauuacaau

SEQ ID NO: 872798 - RNA, 19 nt, Homo sapiens
ugagagagcuucaccuaga

SEQ ID NO: 872799 - RNA, 19 nt, Homo sapiens
acacacaacucugagaaua

SEQ ID NO: 872800 - RNA, 19 nt, Homo sapiens
ggacagcagaggaguauuu

SEQ ID NO: 872801 - RNA, 19 nt, Homo sapiens
gcacagguuugaagauuag

SEQ ID NO: 872802 - RNA, 19 nt, Homo sapiens
gguaauguccuuuaagaaa

SEQ ID NO: 872803 - RNA, 19 nt, Homo sapiens
gguagauccuccaauguaa

SEQ ID NO: 872804 - RNA, 19 nt, Homo sapiens
gagaaagccacuaccauuu

SEQ ID NO: 872805 - RNA, 19 nt, Homo sapiens
caacuaucaugaucaaaga

SEQ ID NO: 872806 - RNA, 19 nt, Homo sapiens
ugauaaggaugccacauuu

SEQ ID NO: 872807 - RNA, 19 nt, Homo sapiens
cagacaggcugaauuagaa

SEQ ID NO: 872808 - RNA, 19 nt, Homo sapiens
gagcuagacuccaucuuuc

SEQ ID NO: 872809 - RNA, 19 nt, Homo sapiens
acacagaacuuuuccauaa

SEQ ID NO: 872810 - RNA, 19 nt, Homo sapiens
gguauucaguuucuuguau

SEQ ID NO: 872811 - RNA, 19 nt, Homo sapiens
ggauuugcaggauuaauua

SEQ ID NO: 872812 - RNA, 19 nt, Homo sapiens
gaucagagcaaucacagaa

SEQ ID NO: 872813 - RNA, 19 nt, Homo sapiens
gcaagccauuuacuaauuc

SEQ ID NO: 872814 - RNA, 19 nt, Homo sapiens
gaugcaagcuacucauuca

SEQ ID NO: 872815 - RNA, 19 nt, Homo sapiens
gugcugcccucccacuuua

SEQ ID NO: 872816 - RNA, 19 nt, Homo sapiens
gaauaagcucaucaaguua

SEQ ID NO: 872817 - RNA, 19 nt, Homo sapiens
gaaaacauguuaaggcuau

SEQ ID NO: 872818 - RNA, 19 nt, Homo sapiens
gacaaacugagucaauuua

SEQ ID NO: 872819 - RNA, 19 nt, Homo sapiens
agagauggguaccuuagua

SEQ ID NO: 872820 - RNA, 19 nt, Homo sapiens
gacaugcucccuccaauuu

SEQ ID NO: 872821 - RNA, 19 nt, Homo sapiens
gcagacaagaucacaaauu

SEQ ID NO: 872822 - RNA, 19 nt, Homo sapiens
aguagaggcuaaauacaua

SEQ ID NO: 872823 - RNA, 19 nt, Homo sapiens
uuacuuggcuccacuuaga

SEQ ID NO: 872824 - RNA, 19 nt, Homo sapiens
gacuccaucuuuccaauaa

SEQ ID NO: 872825 - RNA, 19 nt, Homo sapiens
ccuaacaucucucgguaaa

SEQ ID NO: 872826 - RNA, 19 nt, Homo sapiens
gcucgaaagagaucaauuu

SEQ ID NO: 872827 - RNA, 19 nt, Homo sapiens
ggaugaccauugccauuug

SEQ ID NO: 872828 - RNA, 19 nt, Homo sapiens
cagguuagcuggaguuaca

SEQ ID NO: 872829 - RNA, 19 nt, Homo sapiens
gcuuaacacugauucuuau

SEQ ID NO: 872830 - RNA, 19 nt, Homo sapiens
caaaguccauaucaugaau

SEQ ID NO: 872831 - RNA, 19 nt, Homo sapiens
gacuggaaaugaaaucaaa

SEQ ID NO: 872832 - RNA, 19 nt, Homo sapiens
gcagcaauauaugcaauga

SEQ ID NO: 872833 - RNA, 19 nt, Homo sapiens
cagcacagguuugaagauu

SEQ ID NO: 872834 - RNA, 19 nt, Homo sapiens
gaaugacaguaguaccaaa

SEQ ID NO: 872835 - RNA, 19 nt, Homo sapiens
uaaacagccuugauuccaa

SEQ ID NO: 872836 - RNA, 19 nt, Homo sapiens
ggucaaaggcuccuacaug

SEQ ID NO: 872837 - RNA, 19 nt, Homo sapiens
agagugggcugauaaacuu

SEQ ID NO: 872838 - RNA, 19 nt, Homo sapiens
gaaaagagugggcugauaa

SEQ ID NO: 872839 - RNA, 19 nt, Homo sapiens
aaagcaagccauuuacuaa

SEQ ID NO: 872840 - RNA, 19 nt, Homo sapiens
acaaagaaaucccaacuac

SEQ ID NO: 872841 - RNA, 19 nt, Homo sapiens
gucaaaggcuccuacaugu

SEQ ID NO: 872842 - RNA, 19 nt, Homo sapiens
gaauacagcgacagaccua

SEQ ID NO: 872843 - RNA, 19 nt, Homo sapiens
agacugaagcuuugauuaa

SEQ ID NO: 872844 - RNA, 19 nt, Homo sapiens
caauaaagauacgcauuca

SEQ ID NO: 872845 - RNA, 19 nt, Homo sapiens
caacuaucuugcugcuuaa

SEQ ID NO: 872846 - RNA, 19 nt, Homo sapiens
gaccguauaaugaauauga

SEQ ID NO: 872847 - RNA, 19 nt, Homo sapiens
gaucuuaaacucccugaga

SEQ ID NO: 872848 - RNA, 19 nt, Homo sapiens
caucugccaucaacaaguu

SEQ ID NO: 872849 - RNA, 19 nt, Homo sapiens
ggguagauccuccaaugua

SEQ ID NO: 872850 - RNA, 19 nt, Homo sapiens
caugcucccuccaauuuaa

SEQ ID NO: 872851 - RNA, 19 nt, Homo sapiens
gaggcuaaauacauaucua

SEQ ID NO: 872852 - RNA, 19 nt, Homo sapiens
gaccaaggaccguauaaug

SEQ ID NO: 872853 - RNA, 19 nt, Homo sapiens
gaucucgaguggugaguau

SEQ ID NO: 872854 - RNA, 19 nt, Homo sapiens
ccacagguauucaguuucu

SEQ ID NO: 872855 - RNA, 19 nt, Homo sapiens
gaaaagaaccacagguauu

SEQ ID NO: 872856 - RNA, 19 nt, Homo sapiens
ccaaggagaggauauucua

SEQ ID NO: 872857 - RNA, 19 nt, Homo sapiens
gagacugaagcuuugauua

SEQ ID NO: 872858 - RNA, 19 nt, Homo sapiens
gagcacagcgcccuacuuc

SEQ ID NO: 872859 - RNA, 19 nt, Homo sapiens
agagacagaagcugauuua

SEQ ID NO: 872860 - RNA, 19 nt, Homo sapiens
ccaaggaccguauaaugaa

SEQ ID NO: 872861 - RNA, 19 nt, Homo sapiens
aaacgaugcccaaucuuaa

SEQ ID NO: 872862 - RNA, 19 nt, Homo sapiens
aguuagagguggagaaauu

SEQ ID NO: 872863 - RNA, 19 nt, Homo sapiens
agucaucugugcuuucuuu

SEQ ID NO: 872864 - RNA, 19 nt, Homo sapiens
gaccauaacuggcaaaauc

SEQ ID NO: 872865 - RNA, 19 nt, Homo sapiens
gacaagaucacaaauuaca

SEQ ID NO: 872866 - RNA, 19 nt, Homo sapiens
ugccauaguuaacaaauga

SEQ ID NO: 872867 - RNA, 19 nt, Homo sapiens
aaagaaaucccaacuacug

SEQ ID NO: 872868 - RNA, 19 nt, Homo sapiens
gauccaaccacugaauaua

SEQ ID NO: 872869 - RNA, 19 nt, Homo sapiens
gagauccaaccacugaaua

SEQ ID NO: 872870 - RNA, 19 nt, Homo sapiens
aaucaaagccaucgacuug

SEQ ID NO: 872871 - RNA, 19 nt, Homo sapiens
uuaaucagcugucaucucu

SEQ ID NO: 872872 - RNA, 19 nt, Homo sapiens
gaaugcagccuccaaugug

SEQ ID NO: 872873 - RNA, 19 nt, Homo sapiens
uaacagcugacuuacauga

SEQ ID NO: 872874 - RNA, 19 nt, Homo sapiens
gaaggaugcugguuucuua

SEQ ID NO: 872875 - RNA, 19 nt, Homo sapiens
ggacagacaucaaauuauu

SEQ ID NO: 872876 - RNA, 19 nt, Homo sapiens
gcaaaugccuagagagaua

SEQ ID NO: 872877 - RNA, 19 nt, Homo sapiens
ggaaacaucuucuguguau

SEQ ID NO: 872878 - RNA, 19 nt, Homo sapiens
guaguagccucuuuaaaua

SEQ ID NO: 872879 - RNA, 19 nt, Homo sapiens
gaaaguugguggcugauuu

SEQ ID NO: 872880 - RNA, 19 nt, Homo sapiens
gguacuaucugucuuauuu

SEQ ID NO: 872881 - RNA, 19 nt, Homo sapiens
gaaauggagucaacagaaa

SEQ ID NO: 872882 - RNA, 19 nt, Homo sapiens
gcacagaucccaaguacua

SEQ ID NO: 872883 - RNA, 19 nt, Homo sapiens
guaacuaagugccaaauaa

SEQ ID NO: 872884 - RNA, 19 nt, Homo sapiens
ggaguuacuuuauguauug

SEQ ID NO: 872885 - RNA, 19 nt, Homo sapiens
ggaaaacacugccauauuu

SEQ ID NO: 872886 - RNA, 19 nt, Homo sapiens
gcaaagagaaccuauuauu

SEQ ID NO: 872887 - RNA, 19 nt, Homo sapiens
ggaauauucuugagacuga

SEQ ID NO: 872888 - RNA, 19 nt, Homo sapiens
ccagaaaggcuaccauuua

SEQ ID NO: 872889 - RNA, 19 nt, Homo sapiens
ucagggaucuuucuucuaa

SEQ ID NO: 872890 - RNA, 19 nt, Homo sapiens
ggacuuggacuaugagaua

SEQ ID NO: 872891 - RNA, 19 nt, Homo sapiens
gaacgcaacugcacagauc

SEQ ID NO: 872892 - RNA, 19 nt, Homo sapiens
ccaaauaaaugcuggaaau

SEQ ID NO: 872893 - RNA, 19 nt, Homo sapiens
aaacaagcauccuuuacua

SEQ ID NO: 872894 - RNA, 19 nt, Homo sapiens
aaucacaccucuuaguuua

SEQ ID NO: 872895 - RNA, 19 nt, Homo sapiens
gaucagugguucucccaua

SEQ ID NO: 872896 - RNA, 19 nt, Homo sapiens
gggcaaagagaaccuauua

SEQ ID NO: 872897 - RNA, 19 nt, Homo sapiens
ggacaaggccaagcuauaa

SEQ ID NO: 872898 - RNA, 19 nt, Homo sapiens
ggaaagugcucgcaaacau

SEQ ID NO: 872899 - RNA, 19 nt, Homo sapiens
gcuaggagaugacuuugaa

SEQ ID NO: 872900 - RNA, 19 nt, Homo sapiens
ggucacaucuggguucaua

SEQ ID NO: 872901 - RNA, 19 nt, Homo sapiens
ggagaugacuuugaaugaa

SEQ ID NO: 872902 - RNA, 19 nt, Homo sapiens
guacagagcacauuccaaa

SEQ ID NO: 872903 - RNA, 19 nt, Homo sapiens
accaagagauucacaaaua

SEQ ID NO: 872904 - RNA, 19 nt, Homo sapiens
gaaacuagcgcugacauuu

SEQ ID NO: 872905 - RNA, 19 nt, Homo sapiens
caaacccacuggaagcuua

SEQ ID NO: 872906 - RNA, 19 nt, Homo sapiens
gaaauuagagcccucaaau

SEQ ID NO: 872907 - RNA, 19 nt, Homo sapiens
gguaguagccucuuuaaau

SEQ ID NO: 872908 - RNA, 19 nt, Homo sapiens
cagaaaggcuaccauuuau

SEQ ID NO: 872909 - RNA, 19 nt, Homo sapiens
ggagaaguguaguuaauca

SEQ ID NO: 872910 - RNA, 19 nt, Homo sapiens
uaaauuagguugcguuucu

SEQ ID NO: 872911 - RNA, 19 nt, Homo sapiens
ggauguggcuacgauauaa

SEQ ID NO: 872912 - RNA, 19 nt, Homo sapiens
ccauauagauucagaaaca

SEQ ID NO: 872913 - RNA, 19 nt, Homo sapiens
gaaaggcuaccauuuauca

SEQ ID NO: 872914 - RNA, 19 nt, Homo sapiens
gcaauggaauauaauggaa

SEQ ID NO: 872915 - RNA, 19 nt, Homo sapiens
caaagauguuggugcauuu

SEQ ID NO: 872916 - RNA, 19 nt, Homo sapiens
gagauuacauuaccuugga

SEQ ID NO: 872917 - RNA, 19 nt, Homo sapiens
caccaucaauuaagacaua

SEQ ID NO: 872918 - RNA, 19 nt, Homo sapiens
cgugauagcucuguucuuu

SEQ ID NO: 872919 - RNA, 19 nt, Homo sapiens
gguauuacuucugcacuua

SEQ ID NO: 872920 - RNA, 19 nt, Homo sapiens
aaagagacuuguuacauga

SEQ ID NO: 872921 - RNA, 19 nt, Homo sapiens
gcgcugacauuucuuucua

SEQ ID NO: 872922 - RNA, 19 nt, Homo sapiens
gcacuucucuacuuuccaa

SEQ ID NO: 872923 - RNA, 19 nt, Homo sapiens
gcacgagguucgcuuccua

SEQ ID NO: 872924 - RNA, 19 nt, Homo sapiens
gaaggaaauuauguacgua

SEQ ID NO: 872925 - RNA, 19 nt, Homo sapiens
ucacagagaccauugauga

SEQ ID NO: 872926 - RNA, 19 nt, Homo sapiens
gaagggauguggcuacgau

SEQ ID NO: 872927 - RNA, 19 nt, Homo sapiens
gagaugacuuugaaugaau

SEQ ID NO: 872928 - RNA, 19 nt, Homo sapiens
gaaaccaaacgguggauaa

SEQ ID NO: 872929 - RNA, 19 nt, Homo sapiens
cuucugcacuuaccaaaua

SEQ ID NO: 872930 - RNA, 19 nt, Homo sapiens
aagcagagcucaaucuaug

SEQ ID NO: 872931 - RNA, 19 nt, Homo sapiens
cauagugucucaugacuug

SEQ ID NO: 872932 - RNA, 19 nt, Homo sapiens
ugauggccauguuguauua

SEQ ID NO: 872933 - RNA, 19 nt, Homo sapiens
gggaauaucugggcauuuc

SEQ ID NO: 872934 - RNA, 19 nt, Homo sapiens
ucaagccucuuauacuuaa

SEQ ID NO: 872935 - RNA, 19 nt, Homo sapiens
guaacuaucagcugcaaua

SEQ ID NO: 872936 - RNA, 19 nt, Homo sapiens
ggcaggcaauggaauauaa

SEQ ID NO: 872937 - RNA, 19 nt, Homo sapiens
caaaguggguguucacauc

SEQ ID NO: 872938 - RNA, 19 nt, Homo sapiens
gucauugccuugaacuuua

SEQ ID NO: 872939 - RNA, 19 nt, Homo sapiens
ggaauuagagccagauguu

SEQ ID NO: 872940 - RNA, 19 nt, Homo sapiens
ugacauuucuuucuacuuc

SEQ ID NO: 872941 - RNA, 19 nt, Homo sapiens
gcucuaauacugcauauga

SEQ ID NO: 872942 - RNA, 19 nt, Homo sapiens
ucagucaguuuccaguuua

SEQ ID NO: 872943 - RNA, 19 nt, Homo sapiens
guacguaugccuaauauuc

SEQ ID NO: 872944 - RNA, 19 nt, Homo sapiens
gccaagaugauuaccauua

SEQ ID NO: 872945 - RNA, 19 nt, Homo sapiens
gaccauugaugaaagcaaa

SEQ ID NO: 872946 - RNA, 19 nt, Homo sapiens
ugacaugugugcgaucaua

SEQ ID NO: 872947 - RNA, 19 nt, Homo sapiens
gcaugcagcucauucaagu

SEQ ID NO: 872948 - RNA, 19 nt, Homo sapiens
gagauugaccucacugaaa

SEQ ID NO: 872949 - RNA, 19 nt, Homo sapiens
caacuuugauggccauguu

SEQ ID NO: 872950 - RNA, 19 nt, Homo sapiens
gcacaaguaugcugguagu

SEQ ID NO: 872951 - RNA, 19 nt, Homo sapiens
cgagagccauacaauauug

SEQ ID NO: 872952 - RNA, 19 nt, Homo sapiens
gaauuacagcauccgauua

SEQ ID NO: 872953 - RNA, 19 nt, Homo sapiens
gcaacagcauguaaacuag

SEQ ID NO: 872954 - RNA, 19 nt, Homo sapiens
ugauagcucuguucuuuau

SEQ ID NO: 872955 - RNA, 19 nt, Homo sapiens
aaaggaagauuucaucaag

SEQ ID NO: 872956 - RNA, 19 nt, Homo sapiens
caaaugcacuugugaugag

SEQ ID NO: 872957 - RNA, 19 nt, Homo sapiens
caucagacagcgaccauua

SEQ ID NO: 872958 - RNA, 19 nt, Homo sapiens
gaaacccuaucaucaagau

SEQ ID NO: 872959 - RNA, 19 nt, Homo sapiens
gagauccgcuucagcuuca

SEQ ID NO: 872960 - RNA, 19 nt, Homo sapiens
gaaaugggccaguagagau

SEQ ID NO: 872961 - RNA, 19 nt, Homo sapiens
gaggaaggaugcugguuuc

SEQ ID NO: 872962 - RNA, 19 nt, Homo sapiens
ugacacagcucguuuacag

SEQ ID NO: 872963 - RNA, 19 nt, Homo sapiens
gcaaggagauuacauuacc

SEQ ID NO: 872964 - RNA, 19 nt, Homo sapiens
gcauuggacucagaauuga

SEQ ID NO: 872965 - RNA, 19 nt, Homo sapiens
ggagacauuggaccaguua

SEQ ID NO: 872966 - RNA, 19 nt, Homo sapiens
uagguugcguuucuuauuu

SEQ ID NO: 872967 - RNA, 19 nt, Homo sapiens
ccacguauguagucuuaga

SEQ ID NO: 872968 - RNA, 19 nt, Homo sapiens
ggacaaaguguggaccaua

SEQ ID NO: 872969 - RNA, 19 nt, Homo sapiens
aaaguuuacugcaacauga

SEQ ID NO: 872970 - RNA, 19 nt, Homo sapiens
ccggaaacauuaacucuga

SEQ ID NO: 872971 - RNA, 19 nt, Homo sapiens
gcucuguucuuuaugcauu

SEQ ID NO: 872972 - RNA, 19 nt, Homo sapiens
gaauuagagccagauguua

SEQ ID NO: 872973 - RNA, 19 nt, Homo sapiens
ggaggaaggaugcugguuu

SEQ ID NO: 872974 - RNA, 19 nt, Homo sapiens
ggagagagcuguuuagguu

SEQ ID NO: 872975 - RNA, 19 nt, Homo sapiens
gcacauagcuggagccaau

SEQ ID NO: 872976 - RNA, 19 nt, Homo sapiens
ggacaugccuguugagaau

SEQ ID NO: 872977 - RNA, 19 nt, Homo sapiens
gaagacaggugcacagaug

SEQ ID NO: 872978 - RNA, 19 nt, Homo sapiens
ggacagaccaagagaauaa

SEQ ID NO: 872979 - RNA, 19 nt, Homo sapiens
ggaccaaccuguauaggaa

SEQ ID NO: 872980 - RNA, 19 nt, Homo sapiens
gauaaaccaucccuucuug

SEQ ID NO: 872981 - RNA, 19 nt, Homo sapiens
ggagggagguaacugaauu

SEQ ID NO: 872982 - RNA, 19 nt, Homo sapiens
gaucccagcucuauucuug

SEQ ID NO: 872983 - RNA, 19 nt, Homo sapiens
gaacgacgccgaggaagua

SEQ ID NO: 872984 - RNA, 19 nt, Homo sapiens
ccaaaugcaucucagguuu

SEQ ID NO: 872985 - RNA, 19 nt, Homo sapiens
gagagaggccaguuaauuu

SEQ ID NO: 872986 - RNA, 19 nt, Homo sapiens
gggacaaggucaguauuua

SEQ ID NO: 872987 - RNA, 19 nt, Homo sapiens
ggagagaggccaguuaauu

SEQ ID NO: 872988 - RNA, 19 nt, Homo sapiens
gaagacuguucugcaauuu

SEQ ID NO: 872989 - RNA, 19 nt, Homo sapiens
ggagguaacugaauucacu

SEQ ID NO: 872990 - RNA, 19 nt, Homo sapiens
gcaaugggaccucgguaua

SEQ ID NO: 872991 - RNA, 19 nt, Homo sapiens
gcaagaaaguguccuucga

SEQ ID NO: 872992 - RNA, 19 nt, Homo sapiens
gaacuggacaugccuguug

SEQ ID NO: 872993 - RNA, 19 nt, Homo sapiens
ggauaaaggaggaauaaga

SEQ ID NO: 872994 - RNA, 19 nt, Homo sapiens
gccagaaccucuuggugua

SEQ ID NO: 872995 - RNA, 19 nt, Homo sapiens
ggauggaaguuaagacuca

SEQ ID NO: 872996 - RNA, 19 nt, Homo sapiens
ggauagaauucuccaucaa

SEQ ID NO: 872997 - RNA, 19 nt, Homo sapiens
ggagaccacuuccaaagca

SEQ ID NO: 872998 - RNA, 19 nt, Homo sapiens
gaucugcucuuugucauuc

SEQ ID NO: 872999 - RNA, 19 nt, Homo sapiens
gugaauauccagacuguuu

SEQ ID NO: 873000 - RNA, 19 nt, Homo sapiens
agaauucgcuguuaagagu

SEQ ID NO: 873001 - RNA, 19 nt, Homo sapiens
gauagaauucuccaucaaa

SEQ ID NO: 873002 - RNA, 19 nt, Homo sapiens
uagaggagauggaggagaa

SEQ ID NO: 873003 - RNA, 19 nt, Homo sapiens
gcagauggcagagcuauug

SEQ ID NO: 873004 - RNA, 19 nt, Homo sapiens
gaccuggacuggauagaug

SEQ ID NO: 873005 - RNA, 19 nt, Homo sapiens
cgacaacuuugaggaaauu

SEQ ID NO: 873006 - RNA, 19 nt, Homo sapiens
gcacaugucccuggaguug

SEQ ID NO: 873007 - RNA, 19 nt, Homo sapiens
gcggaucuuugauaucgua

SEQ ID NO: 873008 - RNA, 19 nt, Homo sapiens
gagccaaccuuagcuacaa

SEQ ID NO: 873009 - RNA, 19 nt, Homo sapiens
gaacaggacaggaugaucu

SEQ ID NO: 873010 - RNA, 19 nt, Homo sapiens
gagaaguccucgcuguguu

SEQ ID NO: 873011 - RNA, 19 nt, Homo sapiens
uaacauuugccaccaagua

SEQ ID NO: 873012 - RNA, 19 nt, Homo sapiens
gggcaucacccaagagaaa

SEQ ID NO: 873013 - RNA, 19 nt, Homo sapiens
gaagauccucguucaguau

SEQ ID NO: 873014 - RNA, 19 nt, Homo sapiens
ggaaucaaccaaaucaugu

SEQ ID NO: 873015 - RNA, 19 nt, Homo sapiens
ccaaaaggauggaaguuaa

SEQ ID NO: 873016 - RNA, 19 nt, Homo sapiens
caugggaucugcucuuugu

SEQ ID NO: 873017 - RNA, 19 nt, Homo sapiens
agagaggccaguuaauuua

SEQ ID NO: 873018 - RNA, 19 nt, Homo sapiens
uagaugagauagacacaga

SEQ ID NO: 873019 - RNA, 19 nt, Homo sapiens
gaagcugaauaaacucuag

SEQ ID NO: 873020 - RNA, 19 nt, Homo sapiens
uaaaggagaccacuuccaa

SEQ ID NO: 873021 - RNA, 19 nt, Homo sapiens
agaccaaccuccaaugaau

SEQ ID NO: 873022 - RNA, 19 nt, Homo sapiens
gcucuauucuugguauaaa

SEQ ID NO: 873023 - RNA, 19 nt, Homo sapiens
uggaugagaugccaauaga

SEQ ID NO: 873024 - RNA, 19 nt, Homo sapiens
gaagaaaugggcacaguac

SEQ ID NO: 873025 - RNA, 19 nt, Homo sapiens
guacagagaacacuuaaaa

SEQ ID NO: 873026 - RNA, 19 nt, Homo sapiens
gcucauuuauuacauaguc

SEQ ID NO: 873027 - RNA, 19 nt, Homo sapiens
gcccagcccugcaguuuca

SEQ ID NO: 873028 - RNA, 19 nt, Homo sapiens
guaacugaauucacuucuu

SEQ ID NO: 873029 - RNA, 19 nt, Homo sapiens
gcucagaguuaucccaaag

SEQ ID NO: 873030 - RNA, 19 nt, Homo sapiens
caaucaagagagucuaaua

SEQ ID NO: 873031 - RNA, 19 nt, Homo sapiens
ggucagugccuaccaguau

SEQ ID NO: 873032 - RNA, 19 nt, Homo sapiens
ggacauccacugcaugauc

SEQ ID NO: 873033 - RNA, 19 nt, Homo sapiens
ggauaacauuugccaccaa

SEQ ID NO: 873034 - RNA, 19 nt, Homo sapiens
uaucagcagcuuuguguaa

SEQ ID NO: 873035 - RNA, 19 nt, Homo sapiens
uauaauagcagcuugagau

SEQ ID NO: 873036 - RNA, 19 nt, Homo sapiens
gcaaagugucugcaucuuc

SEQ ID NO: 873037 - RNA, 19 nt, Homo sapiens
gacaggagccgacuucaca

SEQ ID NO: 873038 - RNA, 19 nt, Homo sapiens
gaucuuugauaucguacug

SEQ ID NO: 873039 - RNA, 19 nt, Homo sapiens
acuaaagacuucaggauag

SEQ ID NO: 873040 - RNA, 19 nt, Homo sapiens
uauggcagcuccucauuag

SEQ ID NO: 873041 - RNA, 19 nt, Homo sapiens
ucuggaacuuucagugaua

SEQ ID NO: 873042 - RNA, 19 nt, Homo sapiens
caucagcagucccauucaa

SEQ ID NO: 873043 - RNA, 19 nt, Homo sapiens
cuaaagacuucaggauaga

SEQ ID NO: 873044 - RNA, 19 nt, Homo sapiens
ggaguaaccaggcaaaguc

SEQ ID NO: 873045 - RNA, 19 nt, Homo sapiens
caaggucaguauuuaccaa

SEQ ID NO: 873046 - RNA, 19 nt, Homo sapiens
caacucggaugggaacaug

SEQ ID NO: 873047 - RNA, 19 nt, Homo sapiens
cagaaaagcuguauuuaac

SEQ ID NO: 873048 - RNA, 19 nt, Homo sapiens
ucaccuaccugcucucucu

SEQ ID NO: 873049 - RNA, 19 nt, Homo sapiens
ccgguuugcuggcuuugua

SEQ ID NO: 873050 - RNA, 19 nt, Homo sapiens
gcucugcacuguuuaaucc

SEQ ID NO: 873051 - RNA, 19 nt, Homo sapiens
gauuaaaggagaccacuuc

SEQ ID NO: 873052 - RNA, 19 nt, Homo sapiens
gcggauaaaggaggaauaa

SEQ ID NO: 873053 - RNA, 19 nt, Homo sapiens
ccauggagcuagucucagu

SEQ ID NO: 873054 - RNA, 19 nt, Homo sapiens
caugccagccucuacguua

SEQ ID NO: 873055 - RNA, 19 nt, Homo sapiens
gcccugauuugugcaauga

SEQ ID NO: 873056 - RNA, 19 nt, Homo sapiens
acacacacacacacauaua

SEQ ID NO: 873057 - RNA, 19 nt, Homo sapiens
uaagacagagucaggagaa

SEQ ID NO: 873058 - RNA, 19 nt, Homo sapiens
gagaccaaccuccaaugaa

SEQ ID NO: 873059 - RNA, 19 nt, Homo sapiens
acgcugaaaucccucauga

SEQ ID NO: 873060 - RNA, 19 nt, Homo sapiens
uaagugaggagcuuccauu

SEQ ID NO: 873061 - RNA, 19 nt, Homo sapiens
gaggaacgacgccgaggaa

SEQ ID NO: 873062 - RNA, 19 nt, Homo sapiens
cagcggaccuccaccuaca

SEQ ID NO: 873063 - RNA, 19 nt, Homo sapiens
gaaaagcuguauuuaacuc

SEQ ID NO: 873064 - RNA, 19 nt, Homo sapiens
gcagcuccucauuagauua

SEQ ID NO: 873065 - RNA, 19 nt, Homo sapiens
ugagaucagugucuagaag

SEQ ID NO: 873066 - RNA, 19 nt, Homo sapiens
uagaauccuuagagucuga

SEQ ID NO: 873067 - RNA, 19 nt, Homo sapiens
ucaagucaccugaggcaaa

SEQ ID NO: 873068 - RNA, 19 nt, Homo sapiens
ggucaguauuuaccaaagu

SEQ ID NO: 873069 - RNA, 19 nt, Homo sapiens
ggacaaggucaguauuuac

SEQ ID NO: 873070 - RNA, 19 nt, Homo sapiens
gaaucaaccaaaucauguu

SEQ ID NO: 873071 - RNA, 19 nt, Homo sapiens
acacacacacacacacaua

SEQ ID NO: 873072 - RNA, 19 nt, Homo sapiens
ccgcggucauucauuaauu

SEQ ID NO: 873073 - RNA, 19 nt, Homo sapiens
ggugggcucuucaacaucu

SEQ ID NO: 873074 - RNA, 19 nt, Homo sapiens
gaaagaagauaguguauga

SEQ ID NO: 873075 - RNA, 19 nt, Homo sapiens
ggaauuaccuuugacaaua

SEQ ID NO: 873076 - RNA, 19 nt, Homo sapiens
gauacuaacuccagucuua

SEQ ID NO: 873077 - RNA, 19 nt, Homo sapiens
gaaagaagcccuugggaua

SEQ ID NO: 873078 - RNA, 19 nt, Homo sapiens
gaaauaagcuaugcaauca

SEQ ID NO: 873079 - RNA, 19 nt, Homo sapiens
gaaggaauauacagaagua

SEQ ID NO: 873080 - RNA, 19 nt, Homo sapiens
guacaaagcucauaauuac

SEQ ID NO: 873081 - RNA, 19 nt, Homo sapiens
caaauaaucuucagugaga

SEQ ID NO: 873082 - RNA, 19 nt, Homo sapiens
gcaaaggaauguauacaaa

SEQ ID NO: 873083 - RNA, 19 nt, Homo sapiens
gcugauauauggacucuua

SEQ ID NO: 873084 - RNA, 19 nt, Homo sapiens
gaagcuagcuaaagaaguu

SEQ ID NO: 873085 - RNA, 19 nt, Homo sapiens
gaaggcaucucuacuaaga

SEQ ID NO: 873086 - RNA, 19 nt, Homo sapiens
gaaaugaagucaguagaaa

SEQ ID NO: 873087 - RNA, 19 nt, Homo sapiens
caagauacauacugcauuu

SEQ ID NO: 873088 - RNA, 19 nt, Homo sapiens
gaaaguagcaaacaugauu

SEQ ID NO: 873089 - RNA, 19 nt, Homo sapiens
gcacaucuuugcacucuuu

SEQ ID NO: 873090 - RNA, 19 nt, Homo sapiens
gagagaagcuaucuaauac

SEQ ID NO: 873091 - RNA, 19 nt, Homo sapiens
caaaugagucuucuagaua

SEQ ID NO: 873092 - RNA, 19 nt, Homo sapiens
gcagugacauuggagaaua

SEQ ID NO: 873093 - RNA, 19 nt, Homo sapiens
guauaaagaugaugaggaa

SEQ ID NO: 873094 - RNA, 19 nt, Homo sapiens
gcagucagguucacaagaa

SEQ ID NO: 873095 - RNA, 19 nt, Homo sapiens
gcagaugguucagcaauuu

SEQ ID NO: 873096 - RNA, 19 nt, Homo sapiens
gcugugagcucagaguuua

SEQ ID NO: 873097 - RNA, 19 nt, Homo sapiens
caaaggaggccaacacuaa

SEQ ID NO: 873098 - RNA, 19 nt, Homo sapiens
ggaaaagucugcacuguuu

SEQ ID NO: 873099 - RNA, 19 nt, Homo sapiens
gaaacagauuguaaaguug

SEQ ID NO: 873100 - RNA, 19 nt, Homo sapiens
gaaauggcaugggauaaga

SEQ ID NO: 873101 - RNA, 19 nt, Homo sapiens
gagaaaugauuaugcaguu

SEQ ID NO: 873102 - RNA, 19 nt, Homo sapiens
ugaaugaucugccauaaca

SEQ ID NO: 873103 - RNA, 19 nt, Homo sapiens
gcaugcauauugacuaauu

SEQ ID NO: 873104 - RNA, 19 nt, Homo sapiens
guucuuuacuccuaaguua

SEQ ID NO: 873105 - RNA, 19 nt, Homo sapiens
aagcaaacauccauaguaa

SEQ ID NO: 873106 - RNA, 19 nt, Homo sapiens
ugaaaugucucccuuugaa

SEQ ID NO: 873107 - RNA, 19 nt, Homo sapiens
ggacauagaugggaagaag

SEQ ID NO: 873108 - RNA, 19 nt, Homo sapiens
ccacacguguuaaaucuaa

SEQ ID NO: 873109 - RNA, 19 nt, Homo sapiens
ggacauagcaacauuaaag

SEQ ID NO: 873110 - RNA, 19 nt, Homo sapiens
gguacaaagcucauaauua

SEQ ID NO: 873111 - RNA, 19 nt, Homo sapiens
gcuaacccauuuauaauug

SEQ ID NO: 873112 - RNA, 19 nt, Homo sapiens
ggagguaggucauccacuu

SEQ ID NO: 873113 - RNA, 19 nt, Homo sapiens
gaaccaaugugcaagauac

SEQ ID NO: 873114 - RNA, 19 nt, Homo sapiens
ggacaucaguaggcaagua

SEQ ID NO: 873115 - RNA, 19 nt, Homo sapiens
cauagaacaugaaguagaa

SEQ ID NO: 873116 - RNA, 19 nt, Homo sapiens
uaagagagaagcuaucuaa

SEQ ID NO: 873117 - RNA, 19 nt, Homo sapiens
gcuacuaccuacuccauaa

SEQ ID NO: 873118 - RNA, 19 nt, Homo sapiens
gaagaaggaauauacagaa

SEQ ID NO: 873119 - RNA, 19 nt, Homo sapiens
gaauuuauccuacccuuga

SEQ ID NO: 873120 - RNA, 19 nt, Homo sapiens
caacaaagcugaaaaugau

SEQ ID NO: 873121 - RNA, 19 nt, Homo sapiens
gaaagcuuguccugguaua

SEQ ID NO: 873122 - RNA, 19 nt, Homo sapiens
gaagacccaucaaggaaga

SEQ ID NO: 873123 - RNA, 19 nt, Homo sapiens
gaaaccaguuccugugaug

SEQ ID NO: 873124 - RNA, 19 nt, Homo sapiens
gcagcuaacggauuauaua

SEQ ID NO: 873125 - RNA, 19 nt, Homo sapiens
gaccagguauugcuauuga

SEQ ID NO: 873126 - RNA, 19 nt, Homo sapiens
ccacuugccuugucugcua

SEQ ID NO: 873127 - RNA, 19 nt, Homo sapiens
gcuaacggauuauauacuu

SEQ ID NO: 873128 - RNA, 19 nt, Homo sapiens
caacaaauguauccgagau

SEQ ID NO: 873129 - RNA, 19 nt, Homo sapiens
caacucaagucauuaaucu

SEQ ID NO: 873130 - RNA, 19 nt, Homo sapiens
gauaaccguugcaguaaau

SEQ ID NO: 873131 - RNA, 19 nt, Homo sapiens
agagagaagcuaucuaaua

SEQ ID NO: 873132 - RNA, 19 nt, Homo sapiens
gcaguagggucuguuuauu

SEQ ID NO: 873133 - RNA, 19 nt, Homo sapiens
gaucuuaggcaguaauaaa

SEQ ID NO: 873134 - RNA, 19 nt, Homo sapiens
acagagaacuugccauguu

SEQ ID NO: 873135 - RNA, 19 nt, Homo sapiens
caugguagguuauauugaa

SEQ ID NO: 873136 - RNA, 19 nt, Homo sapiens
cggaaaggauuguugcuaa

SEQ ID NO: 873137 - RNA, 19 nt, Homo sapiens
ggagaucagccaccagaua

SEQ ID NO: 873138 - RNA, 19 nt, Homo sapiens
uuaauuugcugcaguacua

SEQ ID NO: 873139 - RNA, 19 nt, Homo sapiens
gaaguucgccuugagauug

SEQ ID NO: 873140 - RNA, 19 nt, Homo sapiens
uaaaggcauuuccuccaua

SEQ ID NO: 873141 - RNA, 19 nt, Homo sapiens
gcuaugggauaaucacauu

SEQ ID NO: 873142 - RNA, 19 nt, Homo sapiens
ugaaacaggcucaguguaa

SEQ ID NO: 873143 - RNA, 19 nt, Homo sapiens
uaucacaucucuagaagug

SEQ ID NO: 873144 - RNA, 19 nt, Homo sapiens
cuaauuaguuucagaguuc

SEQ ID NO: 873145 - RNA, 19 nt, Homo sapiens
gaguguggaucugguaaua

SEQ ID NO: 873146 - RNA, 19 nt, Homo sapiens
aauaugagccggauacuuu

SEQ ID NO: 873147 - RNA, 19 nt, Homo sapiens
gauaguguaugagacuuaa

SEQ ID NO: 873148 - RNA, 19 nt, Homo sapiens
uugcugagcugaaucuuaa

SEQ ID NO: 873149 - RNA, 19 nt, Homo sapiens
gcaugugucucuguguaua

SEQ ID NO: 873150 - RNA, 19 nt, Homo sapiens
uaaauccucucguaucuca

SEQ ID NO: 873151 - RNA, 19 nt, Homo sapiens
gaccuaagccauacauauu

SEQ ID NO: 873152 - RNA, 19 nt, Homo sapiens
gcauggcaauuaaucacua

SEQ ID NO: 873153 - RNA, 19 nt, Homo sapiens
gaagacaaaggaccaggua

SEQ ID NO: 873154 - RNA, 19 nt, Homo sapiens
gcacuuucaggauuucuua

SEQ ID NO: 873155 - RNA, 19 nt, Homo sapiens
uguaauauaugcacugcua

SEQ ID NO: 873156 - RNA, 19 nt, Homo sapiens
ucaaaugagucuucuagau

SEQ ID NO: 873157 - RNA, 19 nt, Homo sapiens
guaaguauguuucuguaag

SEQ ID NO: 873158 - RNA, 19 nt, Homo sapiens
gagcagauacucauaaagu

SEQ ID NO: 873159 - RNA, 19 nt, Homo sapiens
gagcaaguauucacugagu

SEQ ID NO: 873160 - RNA, 19 nt, Homo sapiens
cuaaagagcuucuccucau

SEQ ID NO: 873161 - RNA, 19 nt, Homo sapiens
gggaugagaugcuucgaau

SEQ ID NO: 873162 - RNA, 19 nt, Homo sapiens
gagaaagaauugcgaagag

SEQ ID NO: 873163 - RNA, 19 nt, Homo sapiens
ggaguucaaugagaaagaa

SEQ ID NO: 873164 - RNA, 19 nt, Homo sapiens
ucaaguagauacccuggaa

SEQ ID NO: 873165 - RNA, 19 nt, Homo sapiens
agggagaacugucugauuu

SEQ ID NO: 873166 - RNA, 19 nt, Homo sapiens
caacagauagcuuugaaug

SEQ ID NO: 873167 - RNA, 19 nt, Homo sapiens
ugauugcucugauauugua

SEQ ID NO: 873168 - RNA, 19 nt, Homo sapiens
gaacccagccuacucuaga

SEQ ID NO: 873169 - RNA, 19 nt, Homo sapiens
auaggcagcuaacggauua

SEQ ID NO: 873170 - RNA, 19 nt, Homo sapiens
caugguaugucaaaccuuu

SEQ ID NO: 873171 - RNA, 19 nt, Homo sapiens
gaauuaaucaacacuguga

SEQ ID NO: 873172 - RNA, 19 nt, Homo sapiens
gaagagaaauaagcuaugc

SEQ ID NO: 873173 - RNA, 19 nt, Homo sapiens
gguuggagguuucacauau

SEQ ID NO: 873174 - RNA, 19 nt, Homo sapiens
aaacaaagauccggaguua

SEQ ID NO: 873175 - RNA, 19 nt, Homo sapiens
gaaagaaagcuucaaguuu

SEQ ID NO: 873176 - RNA, 19 nt, Homo sapiens
aaacgagacucaucuguua

SEQ ID NO: 873177 - RNA, 19 nt, Homo sapiens
ggagaaagauguagcacuu

SEQ ID NO: 873178 - RNA, 19 nt, Homo sapiens
ggacaggacucgcaugaug

SEQ ID NO: 873179 - RNA, 19 nt, Homo sapiens
ccaaacagauccugaaaga

SEQ ID NO: 873180 - RNA, 19 nt, Homo sapiens
ugacagagauagagaugua

SEQ ID NO: 873181 - RNA, 19 nt, Homo sapiens
gaauaugacuuuacuagca

SEQ ID NO: 873182 - RNA, 19 nt, Homo sapiens
gaacuguagugguagcuuu

SEQ ID NO: 873183 - RNA, 19 nt, Homo sapiens
caauauaucuugucuacug

SEQ ID NO: 873184 - RNA, 19 nt, Homo sapiens
aaacagauccugaaagaaa

SEQ ID NO: 873185 - RNA, 19 nt, Homo sapiens
gagaagcacuuaccaaugg

SEQ ID NO: 873186 - RNA, 19 nt, Homo sapiens
aacaagcgcuuacgugaua

SEQ ID NO: 873187 - RNA, 19 nt, Homo sapiens
gcuuaagccucaacaguuu

SEQ ID NO: 873188 - RNA, 19 nt, Homo sapiens
uguaaacugugccauguua

SEQ ID NO: 873189 - RNA, 19 nt, Homo sapiens
gggcucaucugaacacuga

SEQ ID NO: 873190 - RNA, 19 nt, Homo sapiens
gcuaaacccuucaacuaug

SEQ ID NO: 873191 - RNA, 19 nt, Homo sapiens
cuaaagcuguguucccaua

SEQ ID NO: 873192 - RNA, 19 nt, Homo sapiens
agaaagauguagcacuuaa

SEQ ID NO: 873193 - RNA, 19 nt, Homo sapiens
gauguaaggugcacguuuc

SEQ ID NO: 873194 - RNA, 19 nt, Homo sapiens
gcaaaauucuuucagauga

SEQ ID NO: 873195 - RNA, 19 nt, Homo sapiens
agaaacagaugcagucaga

SEQ ID NO: 873196 - RNA, 19 nt, Homo sapiens
agacucaucuguuaguaaa

SEQ ID NO: 873197 - RNA, 19 nt, Homo sapiens
gcagagagaucuauuuuag

SEQ ID NO: 873198 - RNA, 19 nt, Homo sapiens
acacacaggucgccaguga

SEQ ID NO: 873199 - RNA, 19 nt, Homo sapiens
gagcuaaugguucauauau

SEQ ID NO: 873200 - RNA, 19 nt, Homo sapiens
gaacagauccgggcucauc

SEQ ID NO: 873201 - RNA, 19 nt, Homo sapiens
cagcuaaacccuucaacua

SEQ ID NO: 873202 - RNA, 19 nt, Homo sapiens
gccagcaccucccauguuu

SEQ ID NO: 873203 - RNA, 19 nt, Homo sapiens
gauaucgggucuagagaga

SEQ ID NO: 873204 - RNA, 19 nt, Homo sapiens
gggaaaggcucagugauag

SEQ ID NO: 873205 - RNA, 19 nt, Homo sapiens
gagagaauaugacuuuacu

SEQ ID NO: 873206 - RNA, 19 nt, Homo sapiens
guggagccaucgcgaguua

SEQ ID NO: 873207 - RNA, 19 nt, Homo sapiens
cuacauauuuggagagaau

SEQ ID NO: 873208 - RNA, 19 nt, Homo sapiens
gaguuugcaucaaucuuaa

SEQ ID NO: 873209 - RNA, 19 nt, Homo sapiens
gagauugcuucaugagcua

SEQ ID NO: 873210 - RNA, 19 nt, Homo sapiens
ccacacacuuuacuccaaa

SEQ ID NO: 873211 - RNA, 19 nt, Homo sapiens
cauuuggucuucuaguaua

SEQ ID NO: 873212 - RNA, 19 nt, Homo sapiens
gagaauaugacuuuacuag

SEQ ID NO: 873213 - RNA, 19 nt, Homo sapiens
gcuaaugguucauauaugc

SEQ ID NO: 873214 - RNA, 19 nt, Homo sapiens
ggaaggccguguacauagu

SEQ ID NO: 873215 - RNA, 19 nt, Homo sapiens
gaaaggcucagugauaguu

SEQ ID NO: 873216 - RNA, 19 nt, Homo sapiens
gaagaaacgagaagcacuu

SEQ ID NO: 873217 - RNA, 19 nt, Homo sapiens
ugacaacacacaccaauug

SEQ ID NO: 873218 - RNA, 19 nt, Homo sapiens
caagaacgaggaagaagaa

SEQ ID NO: 873219 - RNA, 19 nt, Homo sapiens
gagauagagauguagauaa

SEQ ID NO: 873220 - RNA, 19 nt, Homo sapiens
cacauaagcuggacuuugg

SEQ ID NO: 873221 - RNA, 19 nt, Homo sapiens
ccagggaaguggugugcua

SEQ ID NO: 873222 - RNA, 19 nt, Homo sapiens
ccacccagcugcuccauca

SEQ ID NO: 873223 - RNA, 19 nt, Homo sapiens
aaacugugccauguuauua

SEQ ID NO: 873224 - RNA, 19 nt, Homo sapiens
gcggagccuucuuguguaa

SEQ ID NO: 873225 - RNA, 19 nt, Homo sapiens
aaagcuguguucccauaua

SEQ ID NO: 873226 - RNA, 19 nt, Homo sapiens
gcacggccuucaacuuugu

SEQ ID NO: 873227 - RNA, 19 nt, Homo sapiens
guugacagauccuuucaga

SEQ ID NO: 873228 - RNA, 19 nt, Homo sapiens
cagaagaggacaucauuga

SEQ ID NO: 873229 - RNA, 19 nt, Homo sapiens
uugaagcgcuggagaaaga

SEQ ID NO: 873230 - RNA, 19 nt, Homo sapiens
ugaguuugcaucaaucuua

SEQ ID NO: 873231 - RNA, 19 nt, Homo sapiens
cagcauacuuaaggucaua

SEQ ID NO: 873232 - RNA, 19 nt, Homo sapiens
gcaagaacgaggaagaaga

SEQ ID NO: 873233 - RNA, 19 nt, Homo sapiens
ccaaagagagggagagaga

SEQ ID NO: 873234 - RNA, 19 nt, Homo sapiens
gaaguggugugcuaugcau

SEQ ID NO: 873235 - RNA, 19 nt, Homo sapiens
agugguagcuuucaguauu

SEQ ID NO: 873236 - RNA, 19 nt, Homo sapiens
guugugagcuucagauuuu

SEQ ID NO: 873237 - RNA, 19 nt, Homo sapiens
uacagaccauuguuucuaa

SEQ ID NO: 873238 - RNA, 19 nt, Homo sapiens
ggugaaagauggcagaaaa

SEQ ID NO: 873239 - RNA, 19 nt, Homo sapiens
caaugaauguucgggcuuu

SEQ ID NO: 873240 - RNA, 19 nt, Homo sapiens
ggagaaggacaaacccaaa

SEQ ID NO: 873241 - RNA, 19 nt, Homo sapiens
cgggaaaggcucagugaua

SEQ ID NO: 873242 - RNA, 19 nt, Homo sapiens
uaacuacagaccauuguuu

SEQ ID NO: 873243 - RNA, 19 nt, Homo sapiens
ccucuugucuacauauuug

SEQ ID NO: 873244 - RNA, 19 nt, Homo sapiens
gaacaagcgcuuacgugau

SEQ ID NO: 873245 - RNA, 19 nt, Homo sapiens
gacagucccacacacuuua

SEQ ID NO: 873246 - RNA, 19 nt, Homo sapiens
acacaccaauuggaugaua

SEQ ID NO: 873247 - RNA, 19 nt, Homo sapiens
gagggauccuuaccgagaa

SEQ ID NO: 873248 - RNA, 19 nt, Homo sapiens
gcuccgaggucaaggugaa

SEQ ID NO: 873249 - RNA, 19 nt, Homo sapiens
caaauacccuacaaaaguu

SEQ ID NO: 873250 - RNA, 19 nt, Homo sapiens
gagaaagauguagcacuua

SEQ ID NO: 873251 - RNA, 19 nt, Homo sapiens
aggguaagaugaaagcuuu

SEQ ID NO: 873252 - RNA, 19 nt, Homo sapiens
guaaagaugacaaagaaag

SEQ ID NO: 873253 - RNA, 19 nt, Homo sapiens
ggagccuucuuguguaaug

SEQ ID NO: 873254 - RNA, 19 nt, Homo sapiens
gaacacagucggcuaaagc

SEQ ID NO: 873255 - RNA, 19 nt, Homo sapiens
gaacggacuccucaacaag

SEQ ID NO: 873256 - RNA, 19 nt, Homo sapiens
gauccgggcucaucugaac

SEQ ID NO: 873257 - RNA, 19 nt, Homo sapiens
gaaagucaagaaacagaug

SEQ ID NO: 873258 - RNA, 19 nt, Homo sapiens
caagauaucgggucuagag

SEQ ID NO: 873259 - RNA, 19 nt, Homo sapiens
gcagggacagugacaguga

SEQ ID NO: 873260 - RNA, 19 nt, Homo sapiens
gauccuaugugaaaagaaa

SEQ ID NO: 873261 - RNA, 19 nt, Homo sapiens
cgaguuagagggugaaaga

SEQ ID NO: 873262 - RNA, 19 nt, Homo sapiens
ugugcuauuugcaaacuua

SEQ ID NO: 873263 - RNA, 19 nt, Homo sapiens
gcaaaaggguaagaugaaa

SEQ ID NO: 873264 - RNA, 19 nt, Homo sapiens
caacccugcugcccaccua

SEQ ID NO: 873265 - RNA, 19 nt, Homo sapiens
cacaucgccuggcagauuu

SEQ ID NO: 873266 - RNA, 19 nt, Homo sapiens
ucacaucgccuggcagauu

SEQ ID NO: 873267 - RNA, 19 nt, Homo sapiens
gacccgagguugacagauc

SEQ ID NO: 873268 - RNA, 19 nt, Homo sapiens
gaagacauccaacccuauc

SEQ ID NO: 873269 - RNA, 19 nt, Homo sapiens
aaaguuaacuacagaccau

SEQ ID NO: 873270 - RNA, 19 nt, Homo sapiens
ugacguuguuauccuguuu

SEQ ID NO: 873271 - RNA, 19 nt, Homo sapiens
uaauaucagugaacacagu

SEQ ID NO: 873272 - RNA, 19 nt, Homo sapiens
caacacacaccaauuggau

SEQ ID NO: 873273 - RNA, 19 nt, Homo sapiens
uaaacgagacucaucuguu

SEQ ID NO: 873274 - RNA, 19 nt, Homo sapiens
gaagaaauccgaaacauaa

SEQ ID NO: 873275 - RNA, 19 nt, Homo sapiens
ggacaaaucugcucagugu

SEQ ID NO: 873276 - RNA, 19 nt, Homo sapiens
ggaagacgcugaccgaauu

SEQ ID NO: 873277 - RNA, 19 nt, Homo sapiens
gaaagugacccucguuaua

SEQ ID NO: 873278 - RNA, 19 nt, Homo sapiens
gaucugaaauuguugcuaa

SEQ ID NO: 873279 - RNA, 19 nt, Homo sapiens
gaacgucaauucaucagaa

SEQ ID NO: 873280 - RNA, 19 nt, Homo sapiens
caacuaaucugucaauaca

SEQ ID NO: 873281 - RNA, 19 nt, Homo sapiens
gaagagagcaucaaaggaa

SEQ ID NO: 873282 - RNA, 19 nt, Homo sapiens
gaaguggaaugggaaguua

SEQ ID NO: 873283 - RNA, 19 nt, Homo sapiens
gaaagaguauuaagagcaa

SEQ ID NO: 873284 - RNA, 19 nt, Homo sapiens
cgacagaacuaacagaaga

SEQ ID NO: 873285 - RNA, 19 nt, Homo sapiens
gaggagaaaucaugaaaca

SEQ ID NO: 873286 - RNA, 19 nt, Homo sapiens
agaaacauaugcaguguaa

SEQ ID NO: 873287 - RNA, 19 nt, Homo sapiens
gcacagauaccaguaguaa

SEQ ID NO: 873288 - RNA, 19 nt, Homo sapiens
ugaaggagauacagauaaa

SEQ ID NO: 873289 - RNA, 19 nt, Homo sapiens
uuucaaauaucccguguua

SEQ ID NO: 873290 - RNA, 19 nt, Homo sapiens
gcagacaagcuauuacuuu

SEQ ID NO: 873291 - RNA, 19 nt, Homo sapiens
gagcuuugaucaugaagaa

SEQ ID NO: 873292 - RNA, 19 nt, Homo sapiens
gagaauggccuacagaaug

SEQ ID NO: 873293 - RNA, 19 nt, Homo sapiens
uaauagcucuggugaauuc

SEQ ID NO: 873294 - RNA, 19 nt, Homo sapiens
guagaggacaguuguauuu

SEQ ID NO: 873295 - RNA, 19 nt, Homo sapiens
gaccugcacugucuaaaug

SEQ ID NO: 873296 - RNA, 19 nt, Homo sapiens
gacaagcuauuacuuugaa

SEQ ID NO: 873297 - RNA, 19 nt, Homo sapiens
caucaaagacucagguuaa

SEQ ID NO: 873298 - RNA, 19 nt, Homo sapiens
uaacagaagagaaagcaua

SEQ ID NO: 873299 - RNA, 19 nt, Homo sapiens
gaauugugaugacaguaaa

SEQ ID NO: 873300 - RNA, 19 nt, Homo sapiens
ugaaacaacuaaucuguca

SEQ ID NO: 873301 - RNA, 19 nt, Homo sapiens
gaauaaggaggauaaaguu

SEQ ID NO: 873302 - RNA, 19 nt, Homo sapiens
guaacagccuuucaauuca

SEQ ID NO: 873303 - RNA, 19 nt, Homo sapiens
ccagugaaauggagaguug

SEQ ID NO: 873304 - RNA, 19 nt, Homo sapiens
ugaaauacuuggugcuuga

SEQ ID NO: 873305 - RNA, 19 nt, Homo sapiens
caauuggacuuaacauguu

SEQ ID NO: 873306 - RNA, 19 nt, Homo sapiens
gaucagagucuaagagaga

SEQ ID NO: 873307 - RNA, 19 nt, Homo sapiens
gaacccaagaaauguaaua

SEQ ID NO: 873308 - RNA, 19 nt, Homo sapiens
guaaaaugcuugaagauga

SEQ ID NO: 873309 - RNA, 19 nt, Homo sapiens
guuaauagagccuguaauu

SEQ ID NO: 873310 - RNA, 19 nt, Homo sapiens
ugacugugguguauaugua

SEQ ID NO: 873311 - RNA, 19 nt, Homo sapiens
gaaauaggacaguggcauu

SEQ ID NO: 873312 - RNA, 19 nt, Homo sapiens
cagacaagcuauuacuuug

SEQ ID NO: 873313 - RNA, 19 nt, Homo sapiens
cgaaacaagucugaaaguu

SEQ ID NO: 873314 - RNA, 19 nt, Homo sapiens
agaauggccuacagaauga

SEQ ID NO: 873315 - RNA, 19 nt, Homo sapiens
ccucugaucuaacuaaaug

SEQ ID NO: 873316 - RNA, 19 nt, Homo sapiens
caaagaaauugcagacaag

SEQ ID NO: 873317 - RNA, 19 nt, Homo sapiens
gaagaaagugaaggagaua

SEQ ID NO: 873318 - RNA, 19 nt, Homo sapiens
gagaagaaauccgaaacau

SEQ ID NO: 873319 - RNA, 19 nt, Homo sapiens
gcaucucuguuaccaauga

SEQ ID NO: 873320 - RNA, 19 nt, Homo sapiens
gcuaauggcagacuuguug

SEQ ID NO: 873321 - RNA, 19 nt, Homo sapiens
ggacagaagucacaaaaca

SEQ ID NO: 873322 - RNA, 19 nt, Homo sapiens
gaaauuaagaggaaaguac

SEQ ID NO: 873323 - RNA, 19 nt, Homo sapiens
gcuacaaucugugucauau

SEQ ID NO: 873324 - RNA, 19 nt, Homo sapiens
ccaaaggcguauguauuaa

SEQ ID NO: 873325 - RNA, 19 nt, Homo sapiens
gaggacaguuguauuucuu

SEQ ID NO: 873326 - RNA, 19 nt, Homo sapiens
gaaugauuguaaaggagua

SEQ ID NO: 873327 - RNA, 19 nt, Homo sapiens
guaagugcagcuugaauuu

SEQ ID NO: 873328 - RNA, 19 nt, Homo sapiens
caacuucuaaacccaaaua

SEQ ID NO: 873329 - RNA, 19 nt, Homo sapiens
uccaaaggcguauguauua

SEQ ID NO: 873330 - RNA, 19 nt, Homo sapiens
uauaaacgccuuaaucaga

SEQ ID NO: 873331 - RNA, 19 nt, Homo sapiens
uaagagagauggagguuuu

SEQ ID NO: 873332 - RNA, 19 nt, Homo sapiens
acaguuacauugccaagaa

SEQ ID NO: 873333 - RNA, 19 nt, Homo sapiens
ugacauauuucaugggaau

SEQ ID NO: 873334 - RNA, 19 nt, Homo sapiens
aaagugacccucguuauaa

SEQ ID NO: 873335 - RNA, 19 nt, Homo sapiens
gcauagcuguaauugauuc

SEQ ID NO: 873336 - RNA, 19 nt, Homo sapiens
gcauccaacugcaaaugaa

SEQ ID NO: 873337 - RNA, 19 nt, Homo sapiens
ucacaaacuugaaagaaag

SEQ ID NO: 873338 - RNA, 19 nt, Homo sapiens
ugagucuacuggaccauua

SEQ ID NO: 873339 - RNA, 19 nt, Homo sapiens
ccaagguguugaacguaua

SEQ ID NO: 873340 - RNA, 19 nt, Homo sapiens
cguguuaccuuucucuauu

SEQ ID NO: 873341 - RNA, 19 nt, Homo sapiens
uugcauagcuguaauugau

SEQ ID NO: 873342 - RNA, 19 nt, Homo sapiens
guacaagaaccuaugaaga

SEQ ID NO: 873343 - RNA, 19 nt, Homo sapiens
gcaauucuauuaucaacac

SEQ ID NO: 873344 - RNA, 19 nt, Homo sapiens
uagaggauuugcaaagaaa

SEQ ID NO: 873345 - RNA, 19 nt, Homo sapiens
gaggaaaguacaacagaaa

SEQ ID NO: 873346 - RNA, 19 nt, Homo sapiens
caaguggagccugaaauua

SEQ ID NO: 873347 - RNA, 19 nt, Homo sapiens
gaagaucagagcaaagaga

SEQ ID NO: 873348 - RNA, 19 nt, Homo sapiens
gaaauccgaaacauaauuc

SEQ ID NO: 873349 - RNA, 19 nt, Homo sapiens
gagaggagaaaucaugaaa

SEQ ID NO: 873350 - RNA, 19 nt, Homo sapiens
ggauaaaguuuggaaugau

SEQ ID NO: 873351 - RNA, 19 nt, Homo sapiens
gaagcagcacuaaaugaaa

SEQ ID NO: 873352 - RNA, 19 nt, Homo sapiens
gaaaagguuccaauugaua

SEQ ID NO: 873353 - RNA, 19 nt, Homo sapiens
gaagaugaggauucugaaa

SEQ ID NO: 873354 - RNA, 19 nt, Homo sapiens
guguuaccuuucucuauua

SEQ ID NO: 873355 - RNA, 19 nt, Homo sapiens
gaccauuucuguuacuugu

SEQ ID NO: 873356 - RNA, 19 nt, Homo sapiens
ccuacagaaugaaaguuua

SEQ ID NO: 873357 - RNA, 19 nt, Homo sapiens
gaaucuacaucccagaaag

SEQ ID NO: 873358 - RNA, 19 nt, Homo sapiens
gaaaggcaacccaauugga

SEQ ID NO: 873359 - RNA, 19 nt, Homo sapiens
ggagaaaucaugaaacaac

SEQ ID NO: 873360 - RNA, 19 nt, Homo sapiens
gaaaauucccuuugaagaa

SEQ ID NO: 873361 - RNA, 19 nt, Homo sapiens
gcuauuacuuugaaugagu

SEQ ID NO: 873362 - RNA, 19 nt, Homo sapiens
ucagugaacccaagaaaug

SEQ ID NO: 873363 - RNA, 19 nt, Homo sapiens
guauauguauugcaguaug

SEQ ID NO: 873364 - RNA, 19 nt, Homo sapiens
guguauauguauugcagua

SEQ ID NO: 873365 - RNA, 19 nt, Homo sapiens
gaagggcucuaauccaaaa

SEQ ID NO: 873366 - RNA, 19 nt, Homo sapiens
ggucaaauguugucaaaau

SEQ ID NO: 873367 - RNA, 19 nt, Homo sapiens
uaaaucauacugcgaguga

SEQ ID NO: 873368 - RNA, 19 nt, Homo sapiens
gaagaaagugacccucguu

SEQ ID NO: 873369 - RNA, 19 nt, Homo sapiens
auacagaaauguucaacug

SEQ ID NO: 873370 - RNA, 19 nt, Homo sapiens
ccagaugcuuuagcuuuaa

SEQ ID NO: 873371 - RNA, 19 nt, Homo sapiens
uccagaugcuuuagcuuua

SEQ ID NO: 873372 - RNA, 19 nt, Homo sapiens
caacacaccucugaaacgu

SEQ ID NO: 873373 - RNA, 19 nt, Homo sapiens
caaucugugucauauaguu

SEQ ID NO: 873374 - RNA, 19 nt, Homo sapiens
gaagaaguaugaucuggaa

SEQ ID NO: 873375 - RNA, 19 nt, Homo sapiens
gcuagcacauacuuuauua

SEQ ID NO: 873376 - RNA, 19 nt, Homo sapiens
gcagugcacuuugaaauga

SEQ ID NO: 873377 - RNA, 19 nt, Homo sapiens
gcaguaaucugggacaaga

SEQ ID NO: 873378 - RNA, 19 nt, Homo sapiens
ccauuaagcugcuaucuca

SEQ ID NO: 873379 - RNA, 19 nt, Homo sapiens
ggacagugguggaugaugu

SEQ ID NO: 873380 - RNA, 19 nt, Homo sapiens
gaaggauacuuaacagcuu

SEQ ID NO: 873381 - RNA, 19 nt, Homo sapiens
gaaagccccuguaacguua

SEQ ID NO: 873382 - RNA, 19 nt, Homo sapiens
gugaugaggugcugaagaa

SEQ ID NO: 873383 - RNA, 19 nt, Homo sapiens
gaagaaggauacuuaacag

SEQ ID NO: 873384 - RNA, 19 nt, Homo sapiens
gggcauggauggcuucaga

SEQ ID NO: 873385 - RNA, 19 nt, Homo sapiens
guacgucggugguggagaa

SEQ ID NO: 873386 - RNA, 19 nt, Homo sapiens
gcaacaagcugcgcaaguc

SEQ ID NO: 873387 - RNA, 19 nt, Homo sapiens
gguacaagcugcacuccaa

SEQ ID NO: 873388 - RNA, 19 nt, Homo sapiens
ugaaguaucuguccuuugg

SEQ ID NO: 873389 - RNA, 19 nt, Homo sapiens
guaaguaucuuuucugaga

SEQ ID NO: 873390 - RNA, 19 nt, Homo sapiens
aaacuccacucaucaaauc

SEQ ID NO: 873391 - RNA, 19 nt, Homo sapiens
gcagggagcaggcaugguu

SEQ ID NO: 873392 - RNA, 19 nt, Homo sapiens
gcaagaagaaguaugaucu

SEQ ID NO: 873393 - RNA, 19 nt, Homo sapiens
ggacuuagccauacuagac

SEQ ID NO: 873394 - RNA, 19 nt, Homo sapiens
gcagugggcuggagaagcu

SEQ ID NO: 873395 - RNA, 19 nt, Homo sapiens
ggaggggcuucuaguauua

SEQ ID NO: 873396 - RNA, 19 nt, Homo sapiens
gaaguaugaucuggaaucu

SEQ ID NO: 873397 - RNA, 19 nt, Homo sapiens
ugaccacgcugccuguuug

SEQ ID NO: 873398 - RNA, 19 nt, Homo sapiens
ccaaggacccgacucagaa

SEQ ID NO: 873399 - RNA, 19 nt, Homo sapiens
uaacguuaccuaccuuaaa

SEQ ID NO: 873400 - RNA, 19 nt, Homo sapiens
aaggauacuuaacagcuua

SEQ ID NO: 873401 - RNA, 19 nt, Homo sapiens
cuguuugucuuccuaguua

SEQ ID NO: 873402 - RNA, 19 nt, Homo sapiens
caaccuuccugcugucuuc

SEQ ID NO: 873403 - RNA, 19 nt, Homo sapiens
ugggagacaccuauacuua

SEQ ID NO: 873404 - RNA, 19 nt, Homo sapiens
ugucuggccucaggacuua

SEQ ID NO: 873405 - RNA, 19 nt, Homo sapiens
guugcuagcacauacuuua

SEQ ID NO: 873406 - RNA, 19 nt, Homo sapiens
ccaagcuguucacccauaa

SEQ ID NO: 873407 - RNA, 19 nt, Homo sapiens
gguauuagagaaguaagua

SEQ ID NO: 873408 - RNA, 19 nt, Homo sapiens
ugaagaaggauacuuaaca

SEQ ID NO: 873409 - RNA, 19 nt, Homo sapiens
gaagucaccauccaguuca

SEQ ID NO: 873410 - RNA, 19 nt, Homo sapiens
cuaguuaaggcucuuuaua

SEQ ID NO: 873411 - RNA, 19 nt, Homo sapiens
ggccaagaguagcugguuu

SEQ ID NO: 873412 - RNA, 19 nt, Homo sapiens
caagaugggcaaagccaaa

SEQ ID NO: 873413 - RNA, 19 nt, Homo sapiens
ccaccugccuguuuucaua

SEQ ID NO: 873414 - RNA, 19 nt, Homo sapiens
cccaagcuguucacccaua

SEQ ID NO: 873415 - RNA, 19 nt, Homo sapiens
gcugcaggguuugaacuuu

SEQ ID NO: 873416 - RNA, 19 nt, Homo sapiens
ggugaacuguagcuugaug

SEQ ID NO: 873417 - RNA, 19 nt, Homo sapiens
uuucauaucccucagcuuu

SEQ ID NO: 873418 - RNA, 19 nt, Homo sapiens
gcucuucgcucugugucaa

SEQ ID NO: 873419 - RNA, 19 nt, Homo sapiens
ggauuccucugggcuuuau

SEQ ID NO: 873420 - RNA, 19 nt, Homo sapiens
auacuuaacagcuuaguga

SEQ ID NO: 873421 - RNA, 19 nt, Homo sapiens
ccaggguccuuguugaugu

SEQ ID NO: 873422 - RNA, 19 nt, Homo sapiens
ggaaaccaauuaaaaugug

SEQ ID NO: 873423 - RNA, 19 nt, Homo sapiens
guagcuugaugcaguaauc

SEQ ID NO: 873424 - RNA, 19 nt, Homo sapiens
ugaagggcaagaagaagua

SEQ ID NO: 873425 - RNA, 19 nt, Homo sapiens
cagaggagcgccacacaug

SEQ ID NO: 873426 - RNA, 19 nt, Homo sapiens
ccucugggcuuuauucacu

SEQ ID NO: 873427 - RNA, 19 nt, Homo sapiens
gcugaagaaggauacuuaa

SEQ ID NO: 873428 - RNA, 19 nt, Homo sapiens
ggaucaagccuccaugucu

SEQ ID NO: 873429 - RNA, 19 nt, Homo sapiens
ccugagcgccaguauguuu

SEQ ID NO: 873430 - RNA, 19 nt, Homo sapiens
gagcaggggugaacuguag

SEQ ID NO: 873431 - RNA, 19 nt, Homo sapiens
gucauuggguauuagagaa

SEQ ID NO: 873432 - RNA, 19 nt, Homo sapiens
ggaaagccccuguaacguu

SEQ ID NO: 873433 - RNA, 19 nt, Homo sapiens
ugggacugcuuaugauuug

SEQ ID NO: 873434 - RNA, 19 nt, Homo sapiens
gaggagcgccacacaugga

SEQ ID NO: 873435 - RNA, 19 nt, Homo sapiens
uguuugaccuguccaugaa

SEQ ID NO: 873436 - RNA, 19 nt, Homo sapiens
cagguucugugcacaacuu

SEQ ID NO: 873437 - RNA, 19 nt, Homo sapiens
gcgaugaggccaaccagau

SEQ ID NO: 873438 - RNA, 19 nt, Homo sapiens
caagaucagggacaagaug

SEQ ID NO: 873439 - RNA, 19 nt, Homo sapiens
caucaaaucugagaaaagu

SEQ ID NO: 873440 - RNA, 19 nt, Homo sapiens
ggucauuggguauuagaga

SEQ ID NO: 873441 - RNA, 19 nt, Homo sapiens
aaugaaguaucuguccuuu

SEQ ID NO: 873442 - RNA, 19 nt, Homo sapiens
gggagacaccuauacuuag

SEQ ID NO: 873443 - RNA, 19 nt, Homo sapiens
gcuugggacugcuuaugau

SEQ ID NO: 873444 - RNA, 19 nt, Homo sapiens
ccagggaauuggaacucuu

SEQ ID NO: 873445 - RNA, 19 nt, Homo sapiens
gccaaggacccgacucaga

SEQ ID NO: 873446 - RNA, 19 nt, Homo sapiens
gggcaagccaguccagguu

SEQ ID NO: 873447 - RNA, 19 nt, Homo sapiens
ggggugaacuguagcuuga

SEQ ID NO: 873448 - RNA, 19 nt, Homo sapiens
caaggacccgacucagaaa

SEQ ID NO: 873449 - RNA, 19 nt, Homo sapiens
gggccucguuccacagaug

SEQ ID NO: 873450 - RNA, 19 nt, Homo sapiens
uaaacuccacucaucaaau

SEQ ID NO: 873451 - RNA, 19 nt, Homo sapiens
guucugcuuugcuguuugu

SEQ ID NO: 873452 - RNA, 19 nt, Homo sapiens
gcucaucggcgucgacaag

SEQ ID NO: 873453 - RNA, 19 nt, Homo sapiens
ccucccaccuguugaauac

SEQ ID NO: 873454 - RNA, 19 nt, Homo sapiens
ccagguugccacacccaua

SEQ ID NO: 873455 - RNA, 19 nt, Homo sapiens
cccuaaaguuaaucucuug

SEQ ID NO: 873456 - RNA, 19 nt, Homo sapiens
ggguuggcauggaccuauu

SEQ ID NO: 873457 - RNA, 19 nt, Homo sapiens
uagcugguuuggcuugaga

SEQ ID NO: 873458 - RNA, 19 nt, Homo sapiens
ugaagucaccauccaguuc

SEQ ID NO: 873459 - RNA, 19 nt, Homo sapiens
gaugcugccucccgcucuu

SEQ ID NO: 873460 - RNA, 19 nt, Homo sapiens
ucagcaagaucagggacaa

SEQ ID NO: 873461 - RNA, 19 nt, Homo sapiens
ccucaggacuuagccauac

SEQ ID NO: 873462 - RNA, 19 nt, Homo sapiens
gggacaagacugguugcua

SEQ ID NO: 873463 - RNA, 19 nt, Homo sapiens
agucacaucugggagcauu

SEQ ID NO: 873464 - RNA, 19 nt, Homo sapiens
gccaagaguagcugguuug

SEQ ID NO: 873465 - RNA, 19 nt, Homo sapiens
caagaagaaguaugaucug

SEQ ID NO: 873466 - RNA, 19 nt, Homo sapiens
caggguccuuguugauguu

SEQ ID NO: 873467 - RNA, 19 nt, Homo sapiens
gcaagaucagggacaagau

SEQ ID NO: 873468 - RNA, 19 nt, Homo sapiens
gaggucccacuaugccuuu

SEQ ID NO: 873469 - RNA, 19 nt, Homo sapiens
uguggacagugguggauga

SEQ ID NO: 873470 - RNA, 19 nt, Homo sapiens
gggccagucucugccaugu

SEQ ID NO: 873471 - RNA, 19 nt, Homo sapiens
ccaggaggguuggcaugga

SEQ ID NO: 873472 - RNA, 19 nt, Homo sapiens
agaugaagggcaagaagaa

SEQ ID NO: 873473 - RNA, 19 nt, Homo sapiens
gcccugcucacucucauug

SEQ ID NO: 873474 - RNA, 19 nt, Homo sapiens
ggacauaacuuucuguuga

SEQ ID NO: 873475 - RNA, 19 nt, Homo sapiens
gaaaguaucuguuccauca

SEQ ID NO: 873476 - RNA, 19 nt, Homo sapiens
gaaaguagaacgagaguua

SEQ ID NO: 873477 - RNA, 19 nt, Homo sapiens
gaacaugccugcugauuca

SEQ ID NO: 873478 - RNA, 19 nt, Homo sapiens
ugacauaaaugcucagaua

SEQ ID NO: 873479 - RNA, 19 nt, Homo sapiens
gcagauaaccgcaagauaa

SEQ ID NO: 873480 - RNA, 19 nt, Homo sapiens
gagcaaacacggaaauuua

SEQ ID NO: 873481 - RNA, 19 nt, Homo sapiens
gguuaaagcucaaagaauu

SEQ ID NO: 873482 - RNA, 19 nt, Homo sapiens
gaaggaaacuagaagaaau

SEQ ID NO: 873483 - RNA, 19 nt, Homo sapiens
gcgcagaucuggaacauga

SEQ ID NO: 873484 - RNA, 19 nt, Homo sapiens
gaacacugcccuuacuuua

SEQ ID NO: 873485 - RNA, 19 nt, Homo sapiens
ggaagcagcucgagaagga

SEQ ID NO: 873486 - RNA, 19 nt, Homo sapiens
ggaaagaaguuguaagaag

SEQ ID NO: 873487 - RNA, 19 nt, Homo sapiens
ggauaaaggugcugauguu

SEQ ID NO: 873488 - RNA, 19 nt, Homo sapiens
gaagaaggauggaaagaag

SEQ ID NO: 873489 - RNA, 19 nt, Homo sapiens
gaacaaagaaggaaacuag

SEQ ID NO: 873490 - RNA, 19 nt, Homo sapiens
gagauuaacucuagaacug

SEQ ID NO: 873491 - RNA, 19 nt, Homo sapiens
caaauaaaguggcaucuuc

SEQ ID NO: 873492 - RNA, 19 nt, Homo sapiens
gaacugaagugguuagucu

SEQ ID NO: 873493 - RNA, 19 nt, Homo sapiens
gagcugagauuaacucuag

SEQ ID NO: 873494 - RNA, 19 nt, Homo sapiens
aaagauggcucaacuaugu

SEQ ID NO: 873495 - RNA, 19 nt, Homo sapiens
gaagaacuccuuuaaugaa

SEQ ID NO: 873496 - RNA, 19 nt, Homo sapiens
gaacuugcggcuuuacuua

SEQ ID NO: 873497 - RNA, 19 nt, Homo sapiens
gaauucagcuucagugcaa

SEQ ID NO: 873498 - RNA, 19 nt, Homo sapiens
acaggaauguuucugauua

SEQ ID NO: 873499 - RNA, 19 nt, Homo sapiens
guaauucucuaucuacuug

SEQ ID NO: 873500 - RNA, 19 nt, Homo sapiens
gaauucagcagguucuuua

SEQ ID NO: 873501 - RNA, 19 nt, Homo sapiens
gcaacucaauugauuaaug

SEQ ID NO: 873502 - RNA, 19 nt, Homo sapiens
ggaagaggaggcuguaaua

SEQ ID NO: 873503 - RNA, 19 nt, Homo sapiens
ucaaagaagucaaucaguu

SEQ ID NO: 873504 - RNA, 19 nt, Homo sapiens
gcaaguggauccuguuuua

SEQ ID NO: 873505 - RNA, 19 nt, Homo sapiens
guaagaaggucaaagaaag

SEQ ID NO: 873506 - RNA, 19 nt, Homo sapiens
acuagaagcugcaggaaua

SEQ ID NO: 873507 - RNA, 19 nt, Homo sapiens
cagaagaucuuacuaacug

SEQ ID NO: 873508 - RNA, 19 nt, Homo sapiens
ggaacucacugauaaagau

SEQ ID NO: 873509 - RNA, 19 nt, Homo sapiens
agauacagcuuuaaccaua

SEQ ID NO: 873510 - RNA, 19 nt, Homo sapiens
ggaagaacuccuuuaauga

SEQ ID NO: 873511 - RNA, 19 nt, Homo sapiens
gggaggaucuguuguuuca

SEQ ID NO: 873512 - RNA, 19 nt, Homo sapiens
caaagaacacuauccagua

SEQ ID NO: 873513 - RNA, 19 nt, Homo sapiens
uaaagggcauuacaaauuc

SEQ ID NO: 873514 - RNA, 19 nt, Homo sapiens
uggaagaacuccuuuaaug

SEQ ID NO: 873515 - RNA, 19 nt, Homo sapiens
gaaugacuguuccuccuuu

SEQ ID NO: 873516 - RNA, 19 nt, Homo sapiens
gacaugggcucugacauaa

SEQ ID NO: 873517 - RNA, 19 nt, Homo sapiens
gagaggagcuaguauagag

SEQ ID NO: 873518 - RNA, 19 nt, Homo sapiens
guggcagacuuucuaauua

SEQ ID NO: 873519 - RNA, 19 nt, Homo sapiens
guagcuagguuacuucuug

SEQ ID NO: 873520 - RNA, 19 nt, Homo sapiens
gacaguagauccagaaaca

SEQ ID NO: 873521 - RNA, 19 nt, Homo sapiens
gaauucaacuucagcaaca

SEQ ID NO: 873522 - RNA, 19 nt, Homo sapiens
gaaccacagcuaauaauga

SEQ ID NO: 873523 - RNA, 19 nt, Homo sapiens
ggauggccauguugaagua

SEQ ID NO: 873524 - RNA, 19 nt, Homo sapiens
caucaacagucaacauaaa

SEQ ID NO: 873525 - RNA, 19 nt, Homo sapiens
ggaucagcaucuccaaaua

SEQ ID NO: 873526 - RNA, 19 nt, Homo sapiens
gagguggagucuuucauuu

SEQ ID NO: 873527 - RNA, 19 nt, Homo sapiens
acaagcaacucaauugauu

SEQ ID NO: 873528 - RNA, 19 nt, Homo sapiens
uaaaggugcugauguuaau

SEQ ID NO: 873529 - RNA, 19 nt, Homo sapiens
uggaagaggucaaugauga

SEQ ID NO: 873530 - RNA, 19 nt, Homo sapiens
ggaauccggugcuaguauu

SEQ ID NO: 873531 - RNA, 19 nt, Homo sapiens
gcagaagccuguucagaag

SEQ ID NO: 873532 - RNA, 19 nt, Homo sapiens
gaaguuagaaugacuguuc

SEQ ID NO: 873533 - RNA, 19 nt, Homo sapiens
gaaacagcccuuuggauug

SEQ ID NO: 873534 - RNA, 19 nt, Homo sapiens
gcacacauagauauugaua

SEQ ID NO: 873535 - RNA, 19 nt, Homo sapiens
caucaguucuuguuacauu

SEQ ID NO: 873536 - RNA, 19 nt, Homo sapiens
gggagacuaugcacgguua

SEQ ID NO: 873537 - RNA, 19 nt, Homo sapiens
caauuugucuacaucagua

SEQ ID NO: 873538 - RNA, 19 nt, Homo sapiens
caaagugcuugucagaauu

SEQ ID NO: 873539 - RNA, 19 nt, Homo sapiens
gaucagcaucuccaaauaa

SEQ ID NO: 873540 - RNA, 19 nt, Homo sapiens
ccaccaagguugcccauga

SEQ ID NO: 873541 - RNA, 19 nt, Homo sapiens
gaugauccacuaccaauuu

SEQ ID NO: 873542 - RNA, 19 nt, Homo sapiens
caaagaagucaaucaguuu

SEQ ID NO: 873543 - RNA, 19 nt, Homo sapiens
gcaagcaggugcagaugug

SEQ ID NO: 873544 - RNA, 19 nt, Homo sapiens
gaacuggaacagaggauaa

SEQ ID NO: 873545 - RNA, 19 nt, Homo sapiens
gcauuaauacgcauucuaa

SEQ ID NO: 873546 - RNA, 19 nt, Homo sapiens
cuuacuaacugaccuauuu

SEQ ID NO: 873547 - RNA, 19 nt, Homo sapiens
gaagguggugcgcuacuua

SEQ ID NO: 873548 - RNA, 19 nt, Homo sapiens
gcacaggaauguuucugau

SEQ ID NO: 873549 - RNA, 19 nt, Homo sapiens
aaauagggcuccucgugua

SEQ ID NO: 873550 - RNA, 19 nt, Homo sapiens
agaaggacaugaagaaaug

SEQ ID NO: 873551 - RNA, 19 nt, Homo sapiens
gcaauacagcacuuacaua

SEQ ID NO: 873552 - RNA, 19 nt, Homo sapiens
aaagaacacuauccaguau

SEQ ID NO: 873553 - RNA, 19 nt, Homo sapiens
auaaggagaugcugaagaa

SEQ ID NO: 873554 - RNA, 19 nt, Homo sapiens
cauaaaugcucagauagaa

SEQ ID NO: 873555 - RNA, 19 nt, Homo sapiens
ggaacaaauucagaagaaa

SEQ ID NO: 873556 - RNA, 19 nt, Homo sapiens
caaaccaccugccaauguu

SEQ ID NO: 873557 - RNA, 19 nt, Homo sapiens
ccaagucccucagguauug

SEQ ID NO: 873558 - RNA, 19 nt, Homo sapiens
agaggaggcuguaauauca

SEQ ID NO: 873559 - RNA, 19 nt, Homo sapiens
guacaaacacugcuagaga

SEQ ID NO: 873560 - RNA, 19 nt, Homo sapiens
ugauguagcagaugucuua

SEQ ID NO: 873561 - RNA, 19 nt, Homo sapiens
caacagcagucguaagagu

SEQ ID NO: 873562 - RNA, 19 nt, Homo sapiens
ggauacagcacuaacauau

SEQ ID NO: 873563 - RNA, 19 nt, Homo sapiens
uggcagacuuucuaauuaa

SEQ ID NO: 873564 - RNA, 19 nt, Homo sapiens
gugcgaaaguuacucauug

SEQ ID NO: 873565 - RNA, 19 nt, Homo sapiens
gacauaacuuucuguugaa

SEQ ID NO: 873566 - RNA, 19 nt, Homo sapiens
gcuguaauaucaaugcuau

SEQ ID NO: 873567 - RNA, 19 nt, Homo sapiens
gaauguuucugauuacaca

SEQ ID NO: 873568 - RNA, 19 nt, Homo sapiens
uaaaggugcucuuggaauc

SEQ ID NO: 873569 - RNA, 19 nt, Homo sapiens
ccagcuaccuucgaccuua

SEQ ID NO: 873570 - RNA, 19 nt, Homo sapiens
gaaguuaacaguagcaagu

SEQ ID NO: 873571 - RNA, 19 nt, Homo sapiens
acuggaagcuuuacuagaa

SEQ ID NO: 873572 - RNA, 19 nt, Homo sapiens
ggaagagcaucugcaaugu

SEQ ID NO: 873573 - RNA, 19 nt, Homo sapiens
agaagaaacucaagaaacu

SEQ ID NO: 873574 - RNA, 19 nt, Homo sapiens
gaaagaagcuuaagugucu

SEQ ID NO: 873575 - RNA, 19 nt, Homo sapiens
gcauuuagcugaauaaguu

SEQ ID NO: 873576 - RNA, 19 nt, Homo sapiens
ccaaauggguguaauguuu

SEQ ID NO: 873577 - RNA, 19 nt, Homo sapiens
gcaaugaagucaguagaua

SEQ ID NO: 873578 - RNA, 19 nt, Homo sapiens
gaguggaucuguacaauaa

SEQ ID NO: 873579 - RNA, 19 nt, Homo sapiens
caacacaccugaccucaaa

SEQ ID NO: 873580 - RNA, 19 nt, Homo sapiens
gaugaaaucuguuacucua

SEQ ID NO: 873581 - RNA, 19 nt, Homo sapiens
guaaauaugucuacucuuc

SEQ ID NO: 873582 - RNA, 19 nt, Homo sapiens
gaacagagauuuuacaguu

SEQ ID NO: 873583 - RNA, 19 nt, Homo sapiens
ggaaacugcugcacgagua

SEQ ID NO: 873584 - RNA, 19 nt, Homo sapiens
gacagaaucgcauuuauua

SEQ ID NO: 873585 - RNA, 19 nt, Homo sapiens
gguaaaggcauuugaguua

SEQ ID NO: 873586 - RNA, 19 nt, Homo sapiens
ggaaauggacagugauaua

SEQ ID NO: 873587 - RNA, 19 nt, Homo sapiens
guaaauguguuuccacuau

SEQ ID NO: 873588 - RNA, 19 nt, Homo sapiens
guaauuggcuguguccaua

SEQ ID NO: 873589 - RNA, 19 nt, Homo sapiens
gaucugagucuacaaauuu

SEQ ID NO: 873590 - RNA, 19 nt, Homo sapiens
gaacaaagucgguugauag

SEQ ID NO: 873591 - RNA, 19 nt, Homo sapiens
gcagggaaauggacaguga

SEQ ID NO: 873592 - RNA, 19 nt, Homo sapiens
caaauugucaccucacuua

SEQ ID NO: 873593 - RNA, 19 nt, Homo sapiens
gauugaacuugaugacuua

SEQ ID NO: 873594 - RNA, 19 nt, Homo sapiens
ccacagcuauuuccaacua

SEQ ID NO: 873595 - RNA, 19 nt, Homo sapiens
ccuaagagcuaguauguug

SEQ ID NO: 873596 - RNA, 19 nt, Homo sapiens
ggaagcauuuagcugaaua

SEQ ID NO: 873597 - RNA, 19 nt, Homo sapiens
gagagaaucagaagcauaa

SEQ ID NO: 873598 - RNA, 19 nt, Homo sapiens
gaagacagacgauauuguu

SEQ ID NO: 873599 - RNA, 19 nt, Homo sapiens
agaaagagaucugaaagaa

SEQ ID NO: 873600 - RNA, 19 nt, Homo sapiens
gaucuugggucacugcaaa

SEQ ID NO: 873601 - RNA, 19 nt, Homo sapiens
guagauaggaaaccaguua

SEQ ID NO: 873602 - RNA, 19 nt, Homo sapiens
caacagaaagaacucaaua

SEQ ID NO: 873603 - RNA, 19 nt, Homo sapiens
cacaauagguauauacuga

SEQ ID NO: 873604 - RNA, 19 nt, Homo sapiens
gaagaugccacagcuauuu

SEQ ID NO: 873605 - RNA, 19 nt, Homo sapiens
guaaaggcauuugaguuaa

SEQ ID NO: 873606 - RNA, 19 nt, Homo sapiens
ccacaaaggcaaauaacua

SEQ ID NO: 873607 - RNA, 19 nt, Homo sapiens
gcuuagacauucauggaua

SEQ ID NO: 873608 - RNA, 19 nt, Homo sapiens
gaacucgacuuuaugugau

SEQ ID NO: 873609 - RNA, 19 nt, Homo sapiens
ugaguggguuuaacaauuu

SEQ ID NO: 873610 - RNA, 19 nt, Homo sapiens
caguuaagguuucaaauug

SEQ ID NO: 873611 - RNA, 19 nt, Homo sapiens
caauggaggugaaaucaga

SEQ ID NO: 873612 - RNA, 19 nt, Homo sapiens
gcucagauaaguuucuuua

SEQ ID NO: 873613 - RNA, 19 nt, Homo sapiens
gcagagcaguagugguuaa

SEQ ID NO: 873614 - RNA, 19 nt, Homo sapiens
gaaagaagagagaaucaga

SEQ ID NO: 873615 - RNA, 19 nt, Homo sapiens
aaggaaugcuuucacaaua

SEQ ID NO: 873616 - RNA, 19 nt, Homo sapiens
ugacuuagguuugcauuga

SEQ ID NO: 873617 - RNA, 19 nt, Homo sapiens
aggaggagauuaagcuuua

SEQ ID NO: 873618 - RNA, 19 nt, Homo sapiens
gaaagagaucugaaagaaa

SEQ ID NO: 873619 - RNA, 19 nt, Homo sapiens
uaaagauacugcuauggaa

SEQ ID NO: 873620 - RNA, 19 nt, Homo sapiens
gauuaggauugacaaguaa

SEQ ID NO: 873621 - RNA, 19 nt, Homo sapiens
gaagagagaaucagaagca

SEQ ID NO: 873622 - RNA, 19 nt, Homo sapiens
ccaauacaguuugacauaa

SEQ ID NO: 873623 - RNA, 19 nt, Homo sapiens
caugcaauguuucacuuua

SEQ ID NO: 873624 - RNA, 19 nt, Homo sapiens
gaggguaacuggauucgau

SEQ ID NO: 873625 - RNA, 19 nt, Homo sapiens
gaucaccucuuucgaugga

SEQ ID NO: 873626 - RNA, 19 nt, Homo sapiens
ggacauagacaacuguuca

SEQ ID NO: 873627 - RNA, 19 nt, Homo sapiens
gacaaggucuuuacuaggu

SEQ ID NO: 873628 - RNA, 19 nt, Homo sapiens
cacaggaauuucuacaaua

SEQ ID NO: 873629 - RNA, 19 nt, Homo sapiens
aggaagguguucaucauua

SEQ ID NO: 873630 - RNA, 19 nt, Homo sapiens
caaauggguguaauguuua

SEQ ID NO: 873631 - RNA, 19 nt, Homo sapiens
ggaauuacauuugcucaag

SEQ ID NO: 873632 - RNA, 19 nt, Homo sapiens
aaaguaaucugucaucagu

SEQ ID NO: 873633 - RNA, 19 nt, Homo sapiens
guacacauccagaaagaaa

SEQ ID NO: 873634 - RNA, 19 nt, Homo sapiens
gaagaacucgacuuuaugu

SEQ ID NO: 873635 - RNA, 19 nt, Homo sapiens
gaaguuaugaguggguuua

SEQ ID NO: 873636 - RNA, 19 nt, Homo sapiens
ucacaggaauuucuacaau

SEQ ID NO: 873637 - RNA, 19 nt, Homo sapiens
gaauuacauuugcucaaga

SEQ ID NO: 873638 - RNA, 19 nt, Homo sapiens
ggauugacaaguaaagaua

SEQ ID NO: 873639 - RNA, 19 nt, Homo sapiens
ggaucugagucuacaaauu

SEQ ID NO: 873640 - RNA, 19 nt, Homo sapiens
uugaagaacucgacuuuau

SEQ ID NO: 873641 - RNA, 19 nt, Homo sapiens
caaggaagguguucaucau

SEQ ID NO: 873642 - RNA, 19 nt, Homo sapiens
agauuaggauugacaagua

SEQ ID NO: 873643 - RNA, 19 nt, Homo sapiens
gaucguagggcaucagaaa

SEQ ID NO: 873644 - RNA, 19 nt, Homo sapiens
ccaccaaauuuccuguuaa

SEQ ID NO: 873645 - RNA, 19 nt, Homo sapiens
guacaugcaagcucagaua

SEQ ID NO: 873646 - RNA, 19 nt, Homo sapiens
caaguuugguuuacucuuc

SEQ ID NO: 873647 - RNA, 19 nt, Homo sapiens
gaacagagucccuaaagcu

SEQ ID NO: 873648 - RNA, 19 nt, Homo sapiens
guuauuccuucuaccuuua

SEQ ID NO: 873649 - RNA, 19 nt, Homo sapiens
guaaagauacugcuaugga

SEQ ID NO: 873650 - RNA, 19 nt, Homo sapiens
acagagaauucuacaaguu

SEQ ID NO: 873651 - RNA, 19 nt, Homo sapiens
caaauuuccuguuaaucga

SEQ ID NO: 873652 - RNA, 19 nt, Homo sapiens
ugagagauccuaagagcua

SEQ ID NO: 873653 - RNA, 19 nt, Homo sapiens
ggaagguguucaucauuag

SEQ ID NO: 873654 - RNA, 19 nt, Homo sapiens
auacugcuauggaaugaua

SEQ ID NO: 873655 - RNA, 19 nt, Homo sapiens
gaggaagcauuuagcugaa

SEQ ID NO: 873656 - RNA, 19 nt, Homo sapiens
ggcagaagguaacaacuau

SEQ ID NO: 873657 - RNA, 19 nt, Homo sapiens
gauaugugauucuguugga

SEQ ID NO: 873658 - RNA, 19 nt, Homo sapiens
gacaauagaggauuuggaa

SEQ ID NO: 873659 - RNA, 19 nt, Homo sapiens
agaccaugaugcauuauuu

SEQ ID NO: 873660 - RNA, 19 nt, Homo sapiens
guuaugagcucuacauugc

SEQ ID NO: 873661 - RNA, 19 nt, Homo sapiens
ugacaaggcuucaggaaaa

SEQ ID NO: 873662 - RNA, 19 nt, Homo sapiens
ccauuacuguugaacuaua

SEQ ID NO: 873663 - RNA, 19 nt, Homo sapiens
ugaauuaagugcagcaaca

SEQ ID NO: 873664 - RNA, 19 nt, Homo sapiens
ggaaugcuuucacaauagu

SEQ ID NO: 873665 - RNA, 19 nt, Homo sapiens
uaacaucuuucguaugaca

SEQ ID NO: 873666 - RNA, 19 nt, Homo sapiens
ggccauccauaacaucuuu

SEQ ID NO: 873667 - RNA, 19 nt, Homo sapiens
gaaacuaugcgccaaaucu

SEQ ID NO: 873668 - RNA, 19 nt, Homo sapiens
gaaauggacagugauauag

SEQ ID NO: 873669 - RNA, 19 nt, Homo sapiens
ggugaaguaugaaguaaca

SEQ ID NO: 873670 - RNA, 19 nt, Homo sapiens
uaagucauguucacaggaa

SEQ ID NO: 873671 - RNA, 19 nt, Homo sapiens
gaaaucuguuacucuacaa

SEQ ID NO: 873672 - RNA, 19 nt, Homo sapiens
cauaauuucuccugugugu

SEQ ID NO: 873673 - RNA, 19 nt, Homo sapiens
gggaggugaugaugaaguu

SEQ ID NO: 873674 - RNA, 19 nt, Homo sapiens
gguugaagcuuguagauua

SEQ ID NO: 873675 - RNA, 19 nt, Homo sapiens
ggacugugcuucagaacua

SEQ ID NO: 873676 - RNA, 19 nt, Homo sapiens
guacauauuuggcaucgua

SEQ ID NO: 873677 - RNA, 19 nt, Homo sapiens
ccaaggaacuagcuucuaa

SEQ ID NO: 873678 - RNA, 19 nt, Homo sapiens
ggaaggagacagugcauuu

SEQ ID NO: 873679 - RNA, 19 nt, Homo sapiens
caacuaaaccuucucuuau

SEQ ID NO: 873680 - RNA, 19 nt, Homo sapiens
gcaggugucuggugcuaaa

SEQ ID NO: 873681 - RNA, 19 nt, Homo sapiens
ggaagaugccggacaguaa

SEQ ID NO: 873682 - RNA, 19 nt, Homo sapiens
gaagagaguaucaagaaau

SEQ ID NO: 873683 - RNA, 19 nt, Homo sapiens
gaaagaaaccaagaaacaa

SEQ ID NO: 873684 - RNA, 19 nt, Homo sapiens
gaaaccaucugcagguaca

SEQ ID NO: 873685 - RNA, 19 nt, Homo sapiens
acagauacuuggaaagaaa

SEQ ID NO: 873686 - RNA, 19 nt, Homo sapiens
caaauacuauggacauugg

SEQ ID NO: 873687 - RNA, 19 nt, Homo sapiens
ccaggagucugccuuguug

SEQ ID NO: 873688 - RNA, 19 nt, Homo sapiens
gacccgcucuaauauguaa

SEQ ID NO: 873689 - RNA, 19 nt, Homo sapiens
cagaagagaguaucaagaa

SEQ ID NO: 873690 - RNA, 19 nt, Homo sapiens
acaacuaaaccuucucuua

SEQ ID NO: 873691 - RNA, 19 nt, Homo sapiens
gaacaaugggaguugguuu

SEQ ID NO: 873692 - RNA, 19 nt, Homo sapiens
caagauaucagccagaugu

SEQ ID NO: 873693 - RNA, 19 nt, Homo sapiens
ugacaaccauccauacugu

SEQ ID NO: 873694 - RNA, 19 nt, Homo sapiens
gaucaucuguguggaagga

SEQ ID NO: 873695 - RNA, 19 nt, Homo sapiens
gcaaugaagcugcauccaa

SEQ ID NO: 873696 - RNA, 19 nt, Homo sapiens
aaacauacaugcugucacu

SEQ ID NO: 873697 - RNA, 19 nt, Homo sapiens
guacaacuugccaaucaua

SEQ ID NO: 873698 - RNA, 19 nt, Homo sapiens
ggaguugguuugggauuug

SEQ ID NO: 873699 - RNA, 19 nt, Homo sapiens
ugaaagaaaccaagaaaca

SEQ ID NO: 873700 - RNA, 19 nt, Homo sapiens
uggcugacccgcucuaaua

SEQ ID NO: 873701 - RNA, 19 nt, Homo sapiens
uagagacuguuucguggua

SEQ ID NO: 873702 - RNA, 19 nt, Homo sapiens
uaaauaaagacgccaguug

SEQ ID NO: 873703 - RNA, 19 nt, Homo sapiens
gagcagagccuagcagaca

SEQ ID NO: 873704 - RNA, 19 nt, Homo sapiens
gcaguggucccuccaaugu

SEQ ID NO: 873705 - RNA, 19 nt, Homo sapiens
gaacaacuaccuagagacu

SEQ ID NO: 873706 - RNA, 19 nt, Homo sapiens
gcaaauacuauggacauug

SEQ ID NO: 873707 - RNA, 19 nt, Homo sapiens
gcuguuacuuugcuaggaa

SEQ ID NO: 873708 - RNA, 19 nt, Homo sapiens
gggaguugguuugggauuu

SEQ ID NO: 873709 - RNA, 19 nt, Homo sapiens
gagcaaauacuauggacau

SEQ ID NO: 873710 - RNA, 19 nt, Homo sapiens
aagaacaacuaccuagaga

SEQ ID NO: 873711 - RNA, 19 nt, Homo sapiens
gauaucagccagaugugaa

SEQ ID NO: 873712 - RNA, 19 nt, Homo sapiens
agaagagaguaucaagaaa

SEQ ID NO: 873713 - RNA, 19 nt, Homo sapiens
gcgauuggauaucugacaa

SEQ ID NO: 873714 - RNA, 19 nt, Homo sapiens
ugauacagauacuuggaaa

SEQ ID NO: 873715 - RNA, 19 nt, Homo sapiens
guaagugaaggagcaaaua

SEQ ID NO: 873716 - RNA, 19 nt, Homo sapiens
gcagugagaagcaguaucu

SEQ ID NO: 873717 - RNA, 19 nt, Homo sapiens
gcuuguagauuauauacca

SEQ ID NO: 873718 - RNA, 19 nt, Homo sapiens
ggaguuuccucagguugaa

SEQ ID NO: 873719 - RNA, 19 nt, Homo sapiens
uagaaaccaucugcaggua

SEQ ID NO: 873720 - RNA, 19 nt, Homo sapiens
gcagaagaauuggggaaua

SEQ ID NO: 873721 - RNA, 19 nt, Homo sapiens
gauccagggcuuugcaauu

SEQ ID NO: 873722 - RNA, 19 nt, Homo sapiens
gcagaagagaguaucaaga

SEQ ID NO: 873723 - RNA, 19 nt, Homo sapiens
gaaggagacagugcauuug

SEQ ID NO: 873724 - RNA, 19 nt, Homo sapiens
gguuugggauuugcuauug

SEQ ID NO: 873725 - RNA, 19 nt, Homo sapiens
guuauuuggugccagacua

SEQ ID NO: 873726 - RNA, 19 nt, Homo sapiens
gaagcuauuccuuuuguua

SEQ ID NO: 873727 - RNA, 19 nt, Homo sapiens
cagcugccgugguggcuaa

SEQ ID NO: 873728 - RNA, 19 nt, Homo sapiens
gagaagcaguaucuauggu

SEQ ID NO: 873729 - RNA, 19 nt, Homo sapiens
acaacuaccuagagacugu

SEQ ID NO: 873730 - RNA, 19 nt, Homo sapiens
ugaaguuuauccagguuga

SEQ ID NO: 873731 - RNA, 19 nt, Homo sapiens
guugaagcuuguagauuau

SEQ ID NO: 873732 - RNA, 19 nt, Homo sapiens
gcugccaaauucacauuau

SEQ ID NO: 873733 - RNA, 19 nt, Homo sapiens
caauggaauuuaccaaggu

SEQ ID NO: 873734 - RNA, 19 nt, Homo sapiens
gguagugaauaacaaugga

SEQ ID NO: 873735 - RNA, 19 nt, Homo sapiens
ccaggugcuugcuauguug

SEQ ID NO: 873736 - RNA, 19 nt, Homo sapiens
ggucuugaguuuucucuuu

SEQ ID NO: 873737 - RNA, 19 nt, Homo sapiens
ucagccagaugugaaguuu

SEQ ID NO: 873738 - RNA, 19 nt, Homo sapiens
cggcuucuguuauuaggaa

SEQ ID NO: 873739 - RNA, 19 nt, Homo sapiens
agacagugcauuuggguuu

SEQ ID NO: 873740 - RNA, 19 nt, Homo sapiens
gacggacugugcuucagaa

SEQ ID NO: 873741 - RNA, 19 nt, Homo sapiens
agccagaugugaaguuuau

SEQ ID NO: 873742 - RNA, 19 nt, Homo sapiens
gcaugucaccuccuauuag

SEQ ID NO: 873743 - RNA, 19 nt, Homo sapiens
ggagucugccuuguuguuu

SEQ ID NO: 873744 - RNA, 19 nt, Homo sapiens
cgugguggcuaaagauaga

SEQ ID NO: 873745 - RNA, 19 nt, Homo sapiens
ggacggacugugcuucaga

SEQ ID NO: 873746 - RNA, 19 nt, Homo sapiens
ugaaggagcaaauacuaug

SEQ ID NO: 873747 - RNA, 19 nt, Homo sapiens
auccagggcuuugcaauuu

SEQ ID NO: 873748 - RNA, 19 nt, Homo sapiens
gagaguaucaagaaauugg

SEQ ID NO: 873749 - RNA, 19 nt, Homo sapiens
gugagaagcaguaucuaug

SEQ ID NO: 873750 - RNA, 19 nt, Homo sapiens
aagaaacaaugggagcuuu

SEQ ID NO: 873751 - RNA, 19 nt, Homo sapiens
agacacaacuaaaccuucu

SEQ ID NO: 873752 - RNA, 19 nt, Homo sapiens
gcagacacaacuaaaccuu

SEQ ID NO: 873753 - RNA, 19 nt, Homo sapiens
cgugagugcuuagagcuuu

SEQ ID NO: 873754 - RNA, 19 nt, Homo sapiens
gcaauauaaacugccauuu

SEQ ID NO: 873755 - RNA, 19 nt, Homo sapiens
gaacugcuggcccuugcuu

SEQ ID NO: 873756 - RNA, 19 nt, Homo sapiens
acuaaaccuucucuuauca

SEQ ID NO: 873757 - RNA, 19 nt, Homo sapiens
caagaacaacuaccuagag

SEQ ID NO: 873758 - RNA, 19 nt, Homo sapiens
aaucccugccuaugaauua

SEQ ID NO: 873759 - RNA, 19 nt, Homo sapiens
gagagcaagugguggaaaa

SEQ ID NO: 873760 - RNA, 19 nt, Homo sapiens
ggaaacauacaugcuguca

SEQ ID NO: 873761 - RNA, 19 nt, Homo sapiens
uauuaggaaugccaaacaa

SEQ ID NO: 873762 - RNA, 19 nt, Homo sapiens
ugacauaccagcagauuuu

SEQ ID NO: 873763 - RNA, 19 nt, Homo sapiens
ccaagcagcauagaagcua

SEQ ID NO: 873764 - RNA, 19 nt, Homo sapiens
aaacgcaagauguggagua

SEQ ID NO: 873765 - RNA, 19 nt, Homo sapiens
cagaagaauuggggaauaa

SEQ ID NO: 873766 - RNA, 19 nt, Homo sapiens
ggugguuccucugaaagaa

SEQ ID NO: 873767 - RNA, 19 nt, Homo sapiens
uauggcaaaugcaaacaug

SEQ ID NO: 873768 - RNA, 19 nt, Homo sapiens
gagucugccuuguuguuuc

SEQ ID NO: 873769 - RNA, 19 nt, Homo sapiens
gcuugaugcugguacuuuc

SEQ ID NO: 873770 - RNA, 19 nt, Homo sapiens
gaagaugccggacaguaac

SEQ ID NO: 873771 - RNA, 19 nt, Homo sapiens
cccugccuaugaauuauua

SEQ ID NO: 873772 - RNA, 19 nt, Homo sapiens
ccuauuagcauggcagaaa

SEQ ID NO: 873773 - RNA, 19 nt, Homo sapiens
cacggaaggcccaggauuu

SEQ ID NO: 873774 - RNA, 19 nt, Homo sapiens
gaaagaggauuaaagagaa

SEQ ID NO: 873775 - RNA, 19 nt, Homo sapiens
ucaaagggcugccggauuu

SEQ ID NO: 873776 - RNA, 19 nt, Homo sapiens
gggauuggguuccggauug

SEQ ID NO: 873777 - RNA, 19 nt, Homo sapiens
caaaguggccuucaucaca

SEQ ID NO: 873778 - RNA, 19 nt, Homo sapiens
gaaggaguuuggcagaauc

SEQ ID NO: 873779 - RNA, 19 nt, Homo sapiens
agaaagaggauuaaagaga

SEQ ID NO: 873780 - RNA, 19 nt, Homo sapiens
ggacaaaguggccuucauc

SEQ ID NO: 873781 - RNA, 19 nt, Homo sapiens
cugcuaagcucuaggaauc

SEQ ID NO: 873782 - RNA, 19 nt, Homo sapiens
guggagagcaccaaucuga

SEQ ID NO: 873783 - RNA, 19 nt, Homo sapiens
ccacauggaucccgagacu

SEQ ID NO: 873784 - RNA, 19 nt, Homo sapiens
gaauugcuggugauccuaa

SEQ ID NO: 873785 - RNA, 19 nt, Homo sapiens
gagaauugcuggugauccu

SEQ ID NO: 873786 - RNA, 19 nt, Homo sapiens
caaucuugcuagugcguuu

SEQ ID NO: 873787 - RNA, 19 nt, Homo sapiens
ugaaggaguuuggcagaau

SEQ ID NO: 873788 - RNA, 19 nt, Homo sapiens
gcuaagcucuaggaaucuu

SEQ ID NO: 873789 - RNA, 19 nt, Homo sapiens
aaagagaauugcuggugau

SEQ ID NO: 873790 - RNA, 19 nt, Homo sapiens
ucgcauccuucucugcuaa

SEQ ID NO: 873791 - RNA, 19 nt, Homo sapiens
gcuagugcguuuucuuaaa

SEQ ID NO: 873792 - RNA, 19 nt, Homo sapiens
ugucucgugugcucuauga

SEQ ID NO: 873793 - RNA, 19 nt, Homo sapiens
gaacacucagcuauuacug

SEQ ID NO: 873794 - RNA, 19 nt, Homo sapiens
ggagagcaccaaucugaac

SEQ ID NO: 873795 - RNA, 19 nt, Homo sapiens
gggacaaaguggccuucau

SEQ ID NO: 873796 - RNA, 19 nt, Homo sapiens
ucaagaccgugauggacau

SEQ ID NO: 873797 - RNA, 19 nt, Homo sapiens
acauggaucccgagacuug

SEQ ID NO: 873798 - RNA, 19 nt, Homo sapiens
gacaaaguggccuucauca

SEQ ID NO: 873799 - RNA, 19 nt, Homo sapiens
uguguucucuuggcugaaa

SEQ ID NO: 873800 - RNA, 19 nt, Homo sapiens
gauaccagcggcaccuuca

SEQ ID NO: 873801 - RNA, 19 nt, Homo sapiens
ggaaaagaaagaggauuaa

SEQ ID NO: 873802 - RNA, 19 nt, Homo sapiens
guuccggauugcugagauu

SEQ ID NO: 873803 - RNA, 19 nt, Homo sapiens
gcuggcgccuuguccuuca

SEQ ID NO: 873804 - RNA, 19 nt, Homo sapiens
cugaggugcucccaucugu

SEQ ID NO: 873805 - RNA, 19 nt, Homo sapiens
auacggugauugccaguag

SEQ ID NO: 873806 - RNA, 19 nt, Homo sapiens
cagcggcaccuucaaugug

SEQ ID NO: 873807 - RNA, 19 nt, Homo sapiens
gucaaagggcugccggauu

SEQ ID NO: 873808 - RNA, 19 nt, Homo sapiens
gugccacgcaggugucuga

SEQ ID NO: 873809 - RNA, 19 nt, Homo sapiens
accaggcucugaaggaguu

SEQ ID NO: 873810 - RNA, 19 nt, Homo sapiens
cugaaggaguuuggcagaa

SEQ ID NO: 873811 - RNA, 19 nt, Homo sapiens
guucccaaacggugucaaa

SEQ ID NO: 873812 - RNA, 19 nt, Homo sapiens
gcugauagcuuauuggaua

SEQ ID NO: 873813 - RNA, 19 nt, Homo sapiens
gaaaugaagucucaguauu

SEQ ID NO: 873814 - RNA, 19 nt, Homo sapiens
ggagaaagguacagugauu

SEQ ID NO: 873815 - RNA, 19 nt, Homo sapiens
ccauaaaccucaaagauuu

SEQ ID NO: 873816 - RNA, 19 nt, Homo sapiens
cgaguacucugguuaaaua

SEQ ID NO: 873817 - RNA, 19 nt, Homo sapiens
uaaaugaucucuagaagga

SEQ ID NO: 873818 - RNA, 19 nt, Homo sapiens
ggaggaagauaaagauaaa

SEQ ID NO: 873819 - RNA, 19 nt, Homo sapiens
gaugagcacuauuaacuaa

SEQ ID NO: 873820 - RNA, 19 nt, Homo sapiens
gaugauagaugaacucaau

SEQ ID NO: 873821 - RNA, 19 nt, Homo sapiens
gaugauauguugaucugua

SEQ ID NO: 873822 - RNA, 19 nt, Homo sapiens
uaaaugagaugucgaagga

SEQ ID NO: 873823 - RNA, 19 nt, Homo sapiens
gaacugguaugcuuaaaca

SEQ ID NO: 873824 - RNA, 19 nt, Homo sapiens
ggaugaagauguccagaaa

SEQ ID NO: 873825 - RNA, 19 nt, Homo sapiens
cgaaggaagucaccaaauu

SEQ ID NO: 873826 - RNA, 19 nt, Homo sapiens
ggaagaacuugcagaaaug

SEQ ID NO: 873827 - RNA, 19 nt, Homo sapiens
gaaguaaaguggauuccuu

SEQ ID NO: 873828 - RNA, 19 nt, Homo sapiens
ggaaaucucuagaggaugu

SEQ ID NO: 873829 - RNA, 19 nt, Homo sapiens
ggaaauaaaugugcuaaag

SEQ ID NO: 873830 - RNA, 19 nt, Homo sapiens
caacuucccuuauggcauu

SEQ ID NO: 873831 - RNA, 19 nt, Homo sapiens
uagcaaagcuggagaaaca

SEQ ID NO: 873832 - RNA, 19 nt, Homo sapiens
caaaagagauggaagaaaa

SEQ ID NO: 873833 - RNA, 19 nt, Homo sapiens
gaaacucggucuugucuca

SEQ ID NO: 873834 - RNA, 19 nt, Homo sapiens
aggcugagcuggaggauua

SEQ ID NO: 873835 - RNA, 19 nt, Homo sapiens
ucacuuuacuuucagguua

SEQ ID NO: 873836 - RNA, 19 nt, Homo sapiens
gaggaaaucucuagaggau

SEQ ID NO: 873837 - RNA, 19 nt, Homo sapiens
ugaauaggaugauagauga

SEQ ID NO: 873838 - RNA, 19 nt, Homo sapiens
ccaagaagcccaagaagaa

SEQ ID NO: 873839 - RNA, 19 nt, Homo sapiens
cugaaagcauggauaauua

SEQ ID NO: 873840 - RNA, 19 nt, Homo sapiens
uaaagaaacucagagcaaa

SEQ ID NO: 873841 - RNA, 19 nt, Homo sapiens
gggcagaacugguaugcuu

SEQ ID NO: 873842 - RNA, 19 nt, Homo sapiens
ggaggcugcuucagucuaa

SEQ ID NO: 873843 - RNA, 19 nt, Homo sapiens
gaagguccauucagagguu

SEQ ID NO: 873844 - RNA, 19 nt, Homo sapiens
ggucuugucucaccugaaa

SEQ ID NO: 873845 - RNA, 19 nt, Homo sapiens
gaagaugcacugucugaaa

SEQ ID NO: 873846 - RNA, 19 nt, Homo sapiens
ugaaagaaguccuuagugu

SEQ ID NO: 873847 - RNA, 19 nt, Homo sapiens
guacucugguuaaauauug

SEQ ID NO: 873848 - RNA, 19 nt, Homo sapiens
guuaugaaguaucugcuua

SEQ ID NO: 873849 - RNA, 19 nt, Homo sapiens
ugucacagcuguacaaaga

SEQ ID NO: 873850 - RNA, 19 nt, Homo sapiens
gaccaagucucuaaaauaa

SEQ ID NO: 873851 - RNA, 19 nt, Homo sapiens
cagaaaugcugcagaguau

SEQ ID NO: 873852 - RNA, 19 nt, Homo sapiens
ccucagaacugcuuagaga

SEQ ID NO: 873853 - RNA, 19 nt, Homo sapiens
gaaggaagucaccaaauug

SEQ ID NO: 873854 - RNA, 19 nt, Homo sapiens
ccaaagaaaugugaaagga

SEQ ID NO: 873855 - RNA, 19 nt, Homo sapiens
ggagaaacaacucuuagaa

SEQ ID NO: 873856 - RNA, 19 nt, Homo sapiens
gaccucagccagaaacuua

SEQ ID NO: 873857 - RNA, 19 nt, Homo sapiens
gaaaugcugcagaguauau

SEQ ID NO: 873858 - RNA, 19 nt, Homo sapiens
cauggugucuucagaauug

SEQ ID NO: 873859 - RNA, 19 nt, Homo sapiens
guacugaagcaaauccuua

SEQ ID NO: 873860 - RNA, 19 nt, Homo sapiens
gaagagaaagcugcuauga

SEQ ID NO: 873861 - RNA, 19 nt, Homo sapiens
ucccuuaccuuacacaaua

SEQ ID NO: 873862 - RNA, 19 nt, Homo sapiens
gcagaaugcauuagaagaa

SEQ ID NO: 873863 - RNA, 19 nt, Homo sapiens
gaauaaggagaaagcauuu

SEQ ID NO: 873864 - RNA, 19 nt, Homo sapiens
aaacaacacugagauuuca

SEQ ID NO: 873865 - RNA, 19 nt, Homo sapiens
ggaaaacagcuuuacauua

SEQ ID NO: 873866 - RNA, 19 nt, Homo sapiens
ucaaacagcuccagaacca

SEQ ID NO: 873867 - RNA, 19 nt, Homo sapiens
ccaaagagcaagaaguaaa

SEQ ID NO: 873868 - RNA, 19 nt, Homo sapiens
ucaaagccuucuauuauca

SEQ ID NO: 873869 - RNA, 19 nt, Homo sapiens
gcucagggcugccuucaag

SEQ ID NO: 873870 - RNA, 19 nt, Homo sapiens
gcccauaaaugaucucuag

SEQ ID NO: 873871 - RNA, 19 nt, Homo sapiens
ggucauaucaguuuacaga

SEQ ID NO: 873872 - RNA, 19 nt, Homo sapiens
gcaaauccuuaccaugugu

SEQ ID NO: 873873 - RNA, 19 nt, Homo sapiens
uggaagaacugcucucaug

SEQ ID NO: 873874 - RNA, 19 nt, Homo sapiens
guaaaugaacuucugcaaa

SEQ ID NO: 873875 - RNA, 19 nt, Homo sapiens
ugaaugcacuaaacaugaa

SEQ ID NO: 873876 - RNA, 19 nt, Homo sapiens
ggacacagcgccuuacauc

SEQ ID NO: 873877 - RNA, 19 nt, Homo sapiens
guaaauuguugacauacug

SEQ ID NO: 873878 - RNA, 19 nt, Homo sapiens
aaagcaaguuguccuuaaa

SEQ ID NO: 873879 - RNA, 19 nt, Homo sapiens
ccagcaagcucaggaagaa

SEQ ID NO: 873880 - RNA, 19 nt, Homo sapiens
gcaaauacgaggaggcuau

SEQ ID NO: 873881 - RNA, 19 nt, Homo sapiens
gaucuucucucucuauugc

SEQ ID NO: 873882 - RNA, 19 nt, Homo sapiens
ggauauaaguucugaagcu

SEQ ID NO: 873883 - RNA, 19 nt, Homo sapiens
uacaggugcugauagcuua

SEQ ID NO: 873884 - RNA, 19 nt, Homo sapiens
aaagaaaugccucauaguu

SEQ ID NO: 873885 - RNA, 19 nt, Homo sapiens
agagaaagcugcuaugacu

SEQ ID NO: 873886 - RNA, 19 nt, Homo sapiens
ggaagagugacaccaauga

SEQ ID NO: 873887 - RNA, 19 nt, Homo sapiens
ugucacagcugaauauauc

SEQ ID NO: 873888 - RNA, 19 nt, Homo sapiens
ugaaagaagccaugaauag

SEQ ID NO: 873889 - RNA, 19 nt, Homo sapiens
gagaaagguacagugauua

SEQ ID NO: 873890 - RNA, 19 nt, Homo sapiens
ggaugcauauuuauuacga

SEQ ID NO: 873891 - RNA, 19 nt, Homo sapiens
aggaagaacuugcagaaau

SEQ ID NO: 873892 - RNA, 19 nt, Homo sapiens
aagagaagguccauucaga

SEQ ID NO: 873893 - RNA, 19 nt, Homo sapiens
cagaaugcauuagaagaaa

SEQ ID NO: 873894 - RNA, 19 nt, Homo sapiens
ccaacaagaucuucucucu

SEQ ID NO: 873895 - RNA, 19 nt, Homo sapiens
guugaucuguauuggauaa

SEQ ID NO: 873896 - RNA, 19 nt, Homo sapiens
cuaacacgcuugcaacuuc

SEQ ID NO: 873897 - RNA, 19 nt, Homo sapiens
caaaagaaaugccucauag

SEQ ID NO: 873898 - RNA, 19 nt, Homo sapiens
aaacuugccuccugcuguu

SEQ ID NO: 873899 - RNA, 19 nt, Homo sapiens
agaaaguacugaagcaaau

SEQ ID NO: 873900 - RNA, 19 nt, Homo sapiens
cauaucaguuuacagaaug

SEQ ID NO: 873901 - RNA, 19 nt, Homo sapiens
uaaaggaaucugugaaaga

SEQ ID NO: 873902 - RNA, 19 nt, Homo sapiens
gaacauuugcaagugauaa

SEQ ID NO: 873903 - RNA, 19 nt, Homo sapiens
ucauauugcucuguuauug

SEQ ID NO: 873904 - RNA, 19 nt, Homo sapiens
gaacagccaccaugaaugc

SEQ ID NO: 873905 - RNA, 19 nt, Homo sapiens
gaaggacuguuaguaccaa

SEQ ID NO: 873906 - RNA, 19 nt, Homo sapiens
gaagauguccagaaaguac

SEQ ID NO: 873907 - RNA, 19 nt, Homo sapiens
gagaaacugaugcaauuga

SEQ ID NO: 873908 - RNA, 19 nt, Homo sapiens
gcagaacugguaugcuuaa

SEQ ID NO: 873909 - RNA, 19 nt, Homo sapiens
ccaucugucuuaauacauu

SEQ ID NO: 873910 - RNA, 19 nt, Homo sapiens
uaaauuacaggccaaauca

SEQ ID NO: 873911 - RNA, 19 nt, Homo sapiens
aaacaaagacagacuaagu

SEQ ID NO: 873912 - RNA, 19 nt, Homo sapiens
gagaugaagucuuugaaua

SEQ ID NO: 873913 - RNA, 19 nt, Homo sapiens
gcucugaaauuaugaguuu

SEQ ID NO: 873914 - RNA, 19 nt, Homo sapiens
gacagagaguuucauaaua

SEQ ID NO: 873915 - RNA, 19 nt, Homo sapiens
ugaauucgcuguacauuug

SEQ ID NO: 873916 - RNA, 19 nt, Homo sapiens
gcuguuugcuugcauguua

SEQ ID NO: 873917 - RNA, 19 nt, Homo sapiens
gaacauugauuucagucuu

SEQ ID NO: 873918 - RNA, 19 nt, Homo sapiens
guauagaguucauugcuaa

SEQ ID NO: 873919 - RNA, 19 nt, Homo sapiens
uuaaagaccuuacuguuug

SEQ ID NO: 873920 - RNA, 19 nt, Homo sapiens
gcagaagguuaaguaauuu

SEQ ID NO: 873921 - RNA, 19 nt, Homo sapiens
gagcaacucagaaaugaua

SEQ ID NO: 873922 - RNA, 19 nt, Homo sapiens
ccacaaaucaugauauuga

SEQ ID NO: 873923 - RNA, 19 nt, Homo sapiens
guggaaggcucaucuuaaa

SEQ ID NO: 873924 - RNA, 19 nt, Homo sapiens
guacuuagcuguauuuuca

SEQ ID NO: 873925 - RNA, 19 nt, Homo sapiens
gagaugggccaaugaaauu

SEQ ID NO: 873926 - RNA, 19 nt, Homo sapiens
aaacugcacuguaggagaa

SEQ ID NO: 873927 - RNA, 19 nt, Homo sapiens
ccgcuuaauuucaaagaua

SEQ ID NO: 873928 - RNA, 19 nt, Homo sapiens
ggagaagccuguaaauggu

SEQ ID NO: 873929 - RNA, 19 nt, Homo sapiens
gcacaggcaagcugaagua

SEQ ID NO: 873930 - RNA, 19 nt, Homo sapiens
uauagaaacugcacuguag

SEQ ID NO: 873931 - RNA, 19 nt, Homo sapiens
caaaguugcugcauagucu

SEQ ID NO: 873932 - RNA, 19 nt, Homo sapiens
ugaaggaaaugccgaugaa

SEQ ID NO: 873933 - RNA, 19 nt, Homo sapiens
gaaaugauaacaagagaca

SEQ ID NO: 873934 - RNA, 19 nt, Homo sapiens
ucacuaggcucaucgacuu

SEQ ID NO: 873935 - RNA, 19 nt, Homo sapiens
gaauguacuuagcuguauu

SEQ ID NO: 873936 - RNA, 19 nt, Homo sapiens
gagaauguacuuagcugua

SEQ ID NO: 873937 - RNA, 19 nt, Homo sapiens
gaagugaauucgcuguaca

SEQ ID NO: 873938 - RNA, 19 nt, Homo sapiens
gcucaucgacuucuucauu

SEQ ID NO: 873939 - RNA, 19 nt, Homo sapiens
ccacagaugacucaguaua

SEQ ID NO: 873940 - RNA, 19 nt, Homo sapiens
gaagacagaccgacagauc

SEQ ID NO: 873941 - RNA, 19 nt, Homo sapiens
ucagagugcuagaaauuau

SEQ ID NO: 873942 - RNA, 19 nt, Homo sapiens
gcuggaagcucuuugacau

SEQ ID NO: 873943 - RNA, 19 nt, Homo sapiens
gaugaagucuuugaauaca

SEQ ID NO: 873944 - RNA, 19 nt, Homo sapiens
gaacagaaacaucaaacag

SEQ ID NO: 873945 - RNA, 19 nt, Homo sapiens
gcaaacauacuguguccuu

SEQ ID NO: 873946 - RNA, 19 nt, Homo sapiens
guacuucagugggacuuaa

SEQ ID NO: 873947 - RNA, 19 nt, Homo sapiens
aggaagagauugacagaga

SEQ ID NO: 873948 - RNA, 19 nt, Homo sapiens
aaucacagaugagaaugua

SEQ ID NO: 873949 - RNA, 19 nt, Homo sapiens
uauauuccauugccaaaga

SEQ ID NO: 873950 - RNA, 19 nt, Homo sapiens
agcagaagguuaaguaauu

SEQ ID NO: 873951 - RNA, 19 nt, Homo sapiens
cagaggaggucuugguuuc

SEQ ID NO: 873952 - RNA, 19 nt, Homo sapiens
gaaaugccgaugaagaaga

SEQ ID NO: 873953 - RNA, 19 nt, Homo sapiens
ucuacuugcucugaaauua

SEQ ID NO: 873954 - RNA, 19 nt, Homo sapiens
caucauauuucaagaggau

SEQ ID NO: 873955 - RNA, 19 nt, Homo sapiens
gcuggaugguagagaauuu

SEQ ID NO: 873956 - RNA, 19 nt, Homo sapiens
uggaauagcagaagguuaa

SEQ ID NO: 873957 - RNA, 19 nt, Homo sapiens
ugacagagaguuucauaau

SEQ ID NO: 873958 - RNA, 19 nt, Homo sapiens
guaggagaauuggaauauu

SEQ ID NO: 873959 - RNA, 19 nt, Homo sapiens
gguggaaggcucaucuuaa

SEQ ID NO: 873960 - RNA, 19 nt, Homo sapiens
gccgggaguuugcggauuu

SEQ ID NO: 873961 - RNA, 19 nt, Homo sapiens
ccaaugaaauuugagaaag

SEQ ID NO: 873962 - RNA, 19 nt, Homo sapiens
cagaaaugauaacaagaga

SEQ ID NO: 873963 - RNA, 19 nt, Homo sapiens
caaguaccauggcaauaca

SEQ ID NO: 873964 - RNA, 19 nt, Homo sapiens
aaccugggcugaagaaaga

SEQ ID NO: 873965 - RNA, 19 nt, Homo sapiens
gcucaagcccucaguuaga

SEQ ID NO: 873966 - RNA, 19 nt, Homo sapiens
uguaauaugagguagcuua

SEQ ID NO: 873967 - RNA, 19 nt, Homo sapiens
gcagaggaggucuugguuu

SEQ ID NO: 873968 - RNA, 19 nt, Homo sapiens
gaagauaaacuugagaaac

SEQ ID NO: 873969 - RNA, 19 nt, Homo sapiens
gcaaaugcacaauucaaca

SEQ ID NO: 873970 - RNA, 19 nt, Homo sapiens
caggauacaagaucucuaa

SEQ ID NO: 873971 - RNA, 19 nt, Homo sapiens
gaagcucuuugacauccuu

SEQ ID NO: 873972 - RNA, 19 nt, Homo sapiens
uuaugaagauccaguacuu

SEQ ID NO: 873973 - RNA, 19 nt, Homo sapiens
caaguugccugcagauagg

SEQ ID NO: 873974 - RNA, 19 nt, Homo sapiens
gcugaagaaagaagauuaa

SEQ ID NO: 873975 - RNA, 19 nt, Homo sapiens
gcaaguaccauggcaauac

SEQ ID NO: 873976 - RNA, 19 nt, Homo sapiens
acagaugacucaguauaga

SEQ ID NO: 873977 - RNA, 19 nt, Homo sapiens
caaaugcacaauucaacaa

SEQ ID NO: 873978 - RNA, 19 nt, Homo sapiens
agccauaguuuagacaaua

SEQ ID NO: 873979 - RNA, 19 nt, Homo sapiens
ggauucagagugcuagaaa

SEQ ID NO: 873980 - RNA, 19 nt, Homo sapiens
uauuaugccuggaauuuag

SEQ ID NO: 873981 - RNA, 19 nt, Homo sapiens
ucaguuagacccuuugaga

SEQ ID NO: 873982 - RNA, 19 nt, Homo sapiens
gcgguugguucugccuuua

SEQ ID NO: 873983 - RNA, 19 nt, Homo sapiens
uaggaaagacaacaaaguu

SEQ ID NO: 873984 - RNA, 19 nt, Homo sapiens
gauaacaagagacaaguag

SEQ ID NO: 873985 - RNA, 19 nt, Homo sapiens
ggacccacaaaucaugaua

SEQ ID NO: 873986 - RNA, 19 nt, Homo sapiens
uuaugaaggccauggaaua

SEQ ID NO: 873987 - RNA, 19 nt, Homo sapiens
acccacagaugacucagua

SEQ ID NO: 873988 - RNA, 19 nt, Homo sapiens
gcaaagaaugaagaaguga

SEQ ID NO: 873989 - RNA, 19 nt, Homo sapiens
gcugaaguacacaaaguuu

SEQ ID NO: 873990 - RNA, 19 nt, Homo sapiens
uaaagaccuuacuguuugu

SEQ ID NO: 873991 - RNA, 19 nt, Homo sapiens
gccauaguuuagacaauau

SEQ ID NO: 873992 - RNA, 19 nt, Homo sapiens
uaugaaggccauggaauaa

SEQ ID NO: 873993 - RNA, 19 nt, Homo sapiens
uaugaugacccacagauga

SEQ ID NO: 873994 - RNA, 19 nt, Homo sapiens
uguagcaaauggcauauca

SEQ ID NO: 873995 - RNA, 19 nt, Homo sapiens
ggugcuggaugguagagaa

SEQ ID NO: 873996 - RNA, 19 nt, Homo sapiens
caccguagcccuugccaaa

SEQ ID NO: 873997 - RNA, 19 nt, Homo sapiens
caaggaagagauugacaga

SEQ ID NO: 873998 - RNA, 19 nt, Homo sapiens
cgagaugggccaaugaaau

SEQ ID NO: 873999 - RNA, 19 nt, Homo sapiens
acucagaaaugauaacaag

SEQ ID NO: 874000 - RNA, 19 nt, Homo sapiens
uaacuggcagcauggcaua

SEQ ID NO: 874001 - RNA, 19 nt, Homo sapiens
caacuauguacacacagua

SEQ ID NO: 874002 - RNA, 19 nt, Homo sapiens
accgacagaucguccaaua

SEQ ID NO: 874003 - RNA, 19 nt, Homo sapiens
ugauuucagucuuugcaaa

SEQ ID NO: 874004 - RNA, 19 nt, Homo sapiens
gagcaaguaccauggcaau

SEQ ID NO: 874005 - RNA, 19 nt, Homo sapiens
ccuauuaugccuggaauuu

SEQ ID NO: 874006 - RNA, 19 nt, Homo sapiens
agaauguacuuagcuguau

SEQ ID NO: 874007 - RNA, 19 nt, Homo sapiens
gggccgugauacuguguuu

SEQ ID NO: 874008 - RNA, 19 nt, Homo sapiens
aauagcagaagguuaagua

SEQ ID NO: 874009 - RNA, 19 nt, Homo sapiens
ucaugguccugaacauuga

SEQ ID NO: 874010 - RNA, 19 nt, Homo sapiens
gaauuucuagcucuucaug

SEQ ID NO: 874011 - RNA, 19 nt, Homo sapiens
gcaagcugaaguacacaaa

SEQ ID NO: 874012 - RNA, 19 nt, Homo sapiens
ccuguucucuucugaauuu

SEQ ID NO: 874013 - RNA, 19 nt, Homo sapiens
ccaaaucgaaucucucauu

SEQ ID NO: 874014 - RNA, 19 nt, Homo sapiens
ucccuucccugcucuaaua

SEQ ID NO: 874015 - RNA, 19 nt, Homo sapiens
gcaaccaaaucgaaucucu

SEQ ID NO: 874016 - RNA, 19 nt, Homo sapiens
gcugggcuccuguuacaua

SEQ ID NO: 874017 - RNA, 19 nt, Homo sapiens
gcaagcugggcuccuguua

SEQ ID NO: 874018 - RNA, 19 nt, Homo sapiens
gaaggugacguuccucauc

SEQ ID NO: 874019 - RNA, 19 nt, Homo sapiens
gcguagugcuugccuuugu

SEQ ID NO: 874020 - RNA, 19 nt, Homo sapiens
aagcugggcuccuguuaca

SEQ ID NO: 874021 - RNA, 19 nt, Homo sapiens
gaauccuguucucuucuga

SEQ ID NO: 874022 - RNA, 19 nt, Homo sapiens
ccacagaccuacgcuacca

SEQ ID NO: 874023 - RNA, 19 nt, Homo sapiens
ccagccaacuacaucauuc

SEQ ID NO: 874024 - RNA, 19 nt, Homo sapiens
gugcagacgugcuccuaca

SEQ ID NO: 874025 - RNA, 19 nt, Homo sapiens
cagacgugcuccuacaugu

SEQ ID NO: 874026 - RNA, 19 nt, Homo sapiens
ggaggacgaggacuucuag

SEQ ID NO: 874027 - RNA, 19 nt, Homo sapiens
gcagacgugcuccuacaug

SEQ ID NO: 874028 - RNA, 19 nt, Homo sapiens
aaggugacguuccucauca

SEQ ID NO: 874029 - RNA, 19 nt, Homo sapiens
gacuguggcuccuagugau

SEQ ID NO: 874030 - RNA, 19 nt, Homo sapiens
gggcuccuguuacauacug

SEQ ID NO: 874031 - RNA, 19 nt, Homo sapiens
aaucgaaucucucauuuuc

SEQ ID NO: 874032 - RNA, 19 nt, Homo sapiens
gacgugcuccuacauguuc

SEQ ID NO: 874033 - RNA, 19 nt, Homo sapiens
ggaggaggacgaggacuuc

SEQ ID NO: 874034 - RNA, 19 nt, Homo sapiens
ucccugcucuaauacacua

SEQ ID NO: 874035 - RNA, 19 nt, Homo sapiens
ccagacugccagccaacua

SEQ ID NO: 874036 - RNA, 19 nt, Homo sapiens
cguagugcuugccuuuguu

SEQ ID NO: 874037 - RNA, 19 nt, Homo sapiens
gggaggaggacgaggacuu

SEQ ID NO: 874038 - RNA, 19 nt, Homo sapiens
agacuguggcuccuaguga

SEQ ID NO: 874039 - RNA, 19 nt, Homo sapiens
ccuguggaccaguuaguuu

SEQ ID NO: 874040 - RNA, 19 nt, Homo sapiens
ccacugccaucgccaucca

SEQ ID NO: 874041 - RNA, 19 nt, Homo sapiens
caccgcaucucaccaacag

SEQ ID NO: 874042 - RNA, 19 nt, Homo sapiens
cgagacguuugacggagau

SEQ ID NO: 874043 - RNA, 19 nt, Homo sapiens
ggucgggugcagcugauga

SEQ ID NO: 874044 - RNA, 19 nt, Homo sapiens
guucucuucugaauuugca

SEQ ID NO: 874045 - RNA, 19 nt, Homo sapiens
ccgcguagugcuugccuuu

SEQ ID NO: 874046 - RNA, 19 nt, Homo sapiens
ugaauuugcagcugucucu

SEQ ID NO: 874047 - RNA, 19 nt, Homo sapiens
aaccaaaucgaaucucuca

SEQ ID NO: 874048 - RNA, 19 nt, Homo sapiens
gccagccaacuacaucauu

SEQ ID NO: 874049 - RNA, 19 nt, Homo sapiens
ggacagggaucagauaauu

SEQ ID NO: 874050 - RNA, 19 nt, Homo sapiens
gaauuagugugucagcuua

SEQ ID NO: 874051 - RNA, 19 nt, Homo sapiens
agacauaacuguuggugua

SEQ ID NO: 874052 - RNA, 19 nt, Homo sapiens
ccaagaaacguauacuuua

SEQ ID NO: 874053 - RNA, 19 nt, Homo sapiens
gaaaccaucugcuuguuca

SEQ ID NO: 874054 - RNA, 19 nt, Homo sapiens
ccacaaagcaccucauauu

SEQ ID NO: 874055 - RNA, 19 nt, Homo sapiens
gggaguggcauaauuguua

SEQ ID NO: 874056 - RNA, 19 nt, Homo sapiens
gaaaggagaccucauaguc

SEQ ID NO: 874057 - RNA, 19 nt, Homo sapiens
ccagggcugugaaauauaa

SEQ ID NO: 874058 - RNA, 19 nt, Homo sapiens
gcaaaucucaggcauaugu

SEQ ID NO: 874059 - RNA, 19 nt, Homo sapiens
gauaaauucugucccacaa

SEQ ID NO: 874060 - RNA, 19 nt, Homo sapiens
cuaaagggauuguauuugu

SEQ ID NO: 874061 - RNA, 19 nt, Homo sapiens
aaacacuuguggugaauaa

SEQ ID NO: 874062 - RNA, 19 nt, Homo sapiens
caaaggaauuacaacagaa

SEQ ID NO: 874063 - RNA, 19 nt, Homo sapiens
uuacacacauuugcucuua

SEQ ID NO: 874064 - RNA, 19 nt, Homo sapiens
gggaucagauaauuuguug

SEQ ID NO: 874065 - RNA, 19 nt, Homo sapiens
gugauguucuguagucaua

SEQ ID NO: 874066 - RNA, 19 nt, Homo sapiens
caagacacagcgaauauaa

SEQ ID NO: 874067 - RNA, 19 nt, Homo sapiens
aggcacagaugcuugaaua

SEQ ID NO: 874068 - RNA, 19 nt, Homo sapiens
gagggaaccuuaacauuuu

SEQ ID NO: 874069 - RNA, 19 nt, Homo sapiens
ugagggaaccuuaacauuu

SEQ ID NO: 874070 - RNA, 19 nt, Homo sapiens
acaaaggaauuacaacaga

SEQ ID NO: 874071 - RNA, 19 nt, Homo sapiens
ggugaaaggagaccucaua

SEQ ID NO: 874072 - RNA, 19 nt, Homo sapiens
ggagguuucuggagguuga

SEQ ID NO: 874073 - RNA, 19 nt, Homo sapiens
cacaggagcuggagggauu

SEQ ID NO: 874074 - RNA, 19 nt, Homo sapiens
caacagaaguacuggaaac

SEQ ID NO: 874075 - RNA, 19 nt, Homo sapiens
caacuuuccuugggcaauu

SEQ ID NO: 874076 - RNA, 19 nt, Homo sapiens
guuacagucuuuacucuug

SEQ ID NO: 874077 - RNA, 19 nt, Homo sapiens
uuucagcccugguauauga

SEQ ID NO: 874078 - RNA, 19 nt, Homo sapiens
caacaaaggaauuacaaca

SEQ ID NO: 874079 - RNA, 19 nt, Homo sapiens
aggcauaugucaucaguga

SEQ ID NO: 874080 - RNA, 19 nt, Homo sapiens
ggacaggauacaagauaaa

SEQ ID NO: 874081 - RNA, 19 nt, Homo sapiens
ucaaaagucugcuaaauuc

SEQ ID NO: 874082 - RNA, 19 nt, Homo sapiens
uaaauucugucccacaaag

SEQ ID NO: 874083 - RNA, 19 nt, Homo sapiens
ccagguagguuggaauguu

SEQ ID NO: 874084 - RNA, 19 nt, Homo sapiens
gaaugaugcuuuugaguug

SEQ ID NO: 874085 - RNA, 19 nt, Homo sapiens
cacauuugcucuuaugaga

SEQ ID NO: 874086 - RNA, 19 nt, Homo sapiens
guagaacauuuaggaguga

SEQ ID NO: 874087 - RNA, 19 nt, Homo sapiens
cagggaaacuuaggaucua

SEQ ID NO: 874088 - RNA, 19 nt, Homo sapiens
gcaagugcaaccucagaaa

SEQ ID NO: 874089 - RNA, 19 nt, Homo sapiens
gcaggacagggaucagaua

SEQ ID NO: 874090 - RNA, 19 nt, Homo sapiens
cacaaagcaccucauauuu

SEQ ID NO: 874091 - RNA, 19 nt, Homo sapiens
ugaacuaauucuuccuuga

SEQ ID NO: 874092 - RNA, 19 nt, Homo sapiens
gacaggaguuguuuucuuu

SEQ ID NO: 874093 - RNA, 19 nt, Homo sapiens
gagaacacaaccucaauca

SEQ ID NO: 874094 - RNA, 19 nt, Homo sapiens
uugaugaccaugccaauua

SEQ ID NO: 874095 - RNA, 19 nt, Homo sapiens
gcacagaugcuugaauaag

SEQ ID NO: 874096 - RNA, 19 nt, Homo sapiens
cugcaaaucucaggcauau

SEQ ID NO: 874097 - RNA, 19 nt, Homo sapiens
ggaaagcccucaaaagucu

SEQ ID NO: 874098 - RNA, 19 nt, Homo sapiens
acacacauuugcucuuaug

SEQ ID NO: 874099 - RNA, 19 nt, Homo sapiens
ucagugauguucuguaguc

SEQ ID NO: 874100 - RNA, 19 nt, Homo sapiens
guucagugauguucuguag

SEQ ID NO: 874101 - RNA, 19 nt, Homo sapiens
guuggaauguucagugaug

SEQ ID NO: 874102 - RNA, 19 nt, Homo sapiens
gccaauuauuaacuccuua

SEQ ID NO: 874103 - RNA, 19 nt, Homo sapiens
cccaagaaacguauacuuu

SEQ ID NO: 874104 - RNA, 19 nt, Homo sapiens
gaugauguaaucccaagaa

SEQ ID NO: 874105 - RNA, 19 nt, Homo sapiens
cuucauggcauuugcauuu

SEQ ID NO: 874106 - RNA, 19 nt, Homo sapiens
ugucaauggugauaaacaa

SEQ ID NO: 874107 - RNA, 19 nt, Homo sapiens
uaacuaucuucauggcauu

SEQ ID NO: 874108 - RNA, 19 nt, Homo sapiens
ggagugacaggaguuguuu

SEQ ID NO: 874109 - RNA, 19 nt, Homo sapiens
cauaacuguugguguaaug

SEQ ID NO: 874110 - RNA, 19 nt, Homo sapiens
gcauaauuguuacagucuu

SEQ ID NO: 874111 - RNA, 19 nt, Homo sapiens
aaggagaccucauagucaa

SEQ ID NO: 874112 - RNA, 19 nt, Homo sapiens
ccaagacacagcgaauaua

SEQ ID NO: 874113 - RNA, 19 nt, Homo sapiens
guguuaaagugaauuagug

SEQ ID NO: 874114 - RNA, 19 nt, Homo sapiens
caggauacaagauaaauuc

SEQ ID NO: 874115 - RNA, 19 nt, Homo sapiens
uaggacaggauacaagaua

SEQ ID NO: 874116 - RNA, 19 nt, Homo sapiens
gaacuaauucuuccuugac

SEQ ID NO: 874117 - RNA, 19 nt, Homo sapiens
ggauacaacuuuuggugaa

SEQ ID NO: 874118 - RNA, 19 nt, Homo sapiens
aaagugaauuaguguguca

SEQ ID NO: 874119 - RNA, 19 nt, Homo sapiens
gcagggaaacuuaggaucu

SEQ ID NO: 874120 - RNA, 19 nt, Homo sapiens
ggaaaccaucugcuuguuc

SEQ ID NO: 874121 - RNA, 19 nt, Homo sapiens
gauguucuguagucauauc

SEQ ID NO: 874122 - RNA, 19 nt, Homo sapiens
uuuccucacucucccaaua

SEQ ID NO: 874123 - RNA, 19 nt, Homo sapiens
cauuuguucuugaggguaa

SEQ ID NO: 874124 - RNA, 19 nt, Homo sapiens
uguauuuguuccugcauuu

SEQ ID NO: 874125 - RNA, 19 nt, Homo sapiens
caucugcuuguucaacuua

SEQ ID NO: 874126 - RNA, 19 nt, Homo sapiens
caauagcaguuacccaaac

SEQ ID NO: 874127 - RNA, 19 nt, Homo sapiens
acagggaucagauaauuug

SEQ ID NO: 874128 - RNA, 19 nt, Homo sapiens
gcugugaaauauaauuguc

SEQ ID NO: 874129 - RNA, 19 nt, Homo sapiens
ugaccaugccaauuauuaa

SEQ ID NO: 874130 - RNA, 19 nt, Homo sapiens
cagaaguacuggaaaccau

SEQ ID NO: 874131 - RNA, 19 nt, Homo sapiens
gauguaaucccaagaaacg

SEQ ID NO: 874132 - RNA, 19 nt, Homo sapiens
ggaguggcauaauuguuac

SEQ ID NO: 874133 - RNA, 19 nt, Homo sapiens
gagaccucauagucaagua

SEQ ID NO: 874134 - RNA, 19 nt, Homo sapiens
agacacagcgaauauaauc

SEQ ID NO: 874135 - RNA, 19 nt, Homo sapiens
ugaugaccaugccaauuau

SEQ ID NO: 874136 - RNA, 19 nt, Homo sapiens
cagguagguuggaauguuc

SEQ ID NO: 874137 - RNA, 19 nt, Homo sapiens
ggggaaauauauucugauu

SEQ ID NO: 874138 - RNA, 19 nt, Homo sapiens
gacagggaucagauaauuu

SEQ ID NO: 874139 - RNA, 19 nt, Homo sapiens
gugguaaggauucuugaaa

SEQ ID NO: 874140 - RNA, 19 nt, Homo sapiens
aaaggagaccucauaguca

SEQ ID NO: 874141 - RNA, 19 nt, Homo sapiens
acacuuguggugaauaauu

SEQ ID NO: 874142 - RNA, 19 nt, Homo sapiens
ggaauuacaacagaaguac

SEQ ID NO: 874143 - RNA, 19 nt, Homo sapiens
uuacagucuuuacucuuga

SEQ ID NO: 874144 - RNA, 19 nt, Homo sapiens
ucaggcauaugucaucagu

SEQ ID NO: 874145 - RNA, 19 nt, Homo sapiens
acaaagcaccucauauuuu

SEQ ID NO: 874146 - RNA, 19 nt, Homo sapiens
aggacaggauacaagauaa

SEQ ID NO: 874147 - RNA, 19 nt, Homo sapiens
ccaauagcaguuacccaaa

SEQ ID NO: 874148 - RNA, 19 nt, Homo sapiens
gaaugagggaaccuuaaca

SEQ ID NO: 874149 - RNA, 19 nt, Homo sapiens
gaauagggcuggaaacuuu

SEQ ID NO: 874150 - RNA, 19 nt, Homo sapiens
ggaaacaacugagaacaua

SEQ ID NO: 874151 - RNA, 19 nt, Homo sapiens
ggagacaguugguguguuu

SEQ ID NO: 874152 - RNA, 19 nt, Homo sapiens
gcucgugacugcccacaua

SEQ ID NO: 874153 - RNA, 19 nt, Homo sapiens
cacaaagucugauuaaaga

SEQ ID NO: 874154 - RNA, 19 nt, Homo sapiens
aaucugaccuucauccaua

SEQ ID NO: 874155 - RNA, 19 nt, Homo sapiens
gcugagcaaccaaauauua

SEQ ID NO: 874156 - RNA, 19 nt, Homo sapiens
gccaagaguugcuuucuga

SEQ ID NO: 874157 - RNA, 19 nt, Homo sapiens
gagcggcacuggaggauau

SEQ ID NO: 874158 - RNA, 19 nt, Homo sapiens
caacaugaacucuuugaaa

SEQ ID NO: 874159 - RNA, 19 nt, Homo sapiens
gaccacaaaugcaggaauu

SEQ ID NO: 874160 - RNA, 19 nt, Homo sapiens
aagaguugcuuucugaaua

SEQ ID NO: 874161 - RNA, 19 nt, Homo sapiens
gcccuugacugcuuucuuu

SEQ ID NO: 874162 - RNA, 19 nt, Homo sapiens
ccacaggccuggaggaguu

SEQ ID NO: 874163 - RNA, 19 nt, Homo sapiens
cauccaacaugaacucuuu

SEQ ID NO: 874164 - RNA, 19 nt, Homo sapiens
gguauggauugaugacuaa

SEQ ID NO: 874165 - RNA, 19 nt, Homo sapiens
ccucaggccuucacuggua

SEQ ID NO: 874166 - RNA, 19 nt, Homo sapiens
gcaaccaaauauuacaguu

SEQ ID NO: 874167 - RNA, 19 nt, Homo sapiens
cacagugggucucuuaauu

SEQ ID NO: 874168 - RNA, 19 nt, Homo sapiens
caauaaagaugagaagaca

SEQ ID NO: 874169 - RNA, 19 nt, Homo sapiens
gggcagggaaccaguguua

SEQ ID NO: 874170 - RNA, 19 nt, Homo sapiens
uggagaaccuugacaguga

SEQ ID NO: 874171 - RNA, 19 nt, Homo sapiens
ucagagaucucagacagaa

SEQ ID NO: 874172 - RNA, 19 nt, Homo sapiens
ggaaagcaauaaagaugag

SEQ ID NO: 874173 - RNA, 19 nt, Homo sapiens
gcaaaguguuggagacagu

SEQ ID NO: 874174 - RNA, 19 nt, Homo sapiens
auacuggccuguguuguua

SEQ ID NO: 874175 - RNA, 19 nt, Homo sapiens
ccacuuugauguucggauu

SEQ ID NO: 874176 - RNA, 19 nt, Homo sapiens
ggaguggccuggcucuuag

SEQ ID NO: 874177 - RNA, 19 nt, Homo sapiens
ggaguuuccuggccuguca

SEQ ID NO: 874178 - RNA, 19 nt, Homo sapiens
gugcuggacuggacucuug

SEQ ID NO: 874179 - RNA, 19 nt, Homo sapiens
ucacaaagucugauuaaag

SEQ ID NO: 874180 - RNA, 19 nt, Homo sapiens
ggaccugcgccauccuuua

SEQ ID NO: 874181 - RNA, 19 nt, Homo sapiens
gaacacaaggucagaugau

SEQ ID NO: 874182 - RNA, 19 nt, Homo sapiens
ccugauggcucccacuuug

SEQ ID NO: 874183 - RNA, 19 nt, Homo sapiens
gcagugauuguuagaggua

SEQ ID NO: 874184 - RNA, 19 nt, Homo sapiens
caguaaaccucuccaccaa

SEQ ID NO: 874185 - RNA, 19 nt, Homo sapiens
caacucucaucccacaauu

SEQ ID NO: 874186 - RNA, 19 nt, Homo sapiens
cuaagggccuggcaagaga

SEQ ID NO: 874187 - RNA, 19 nt, Homo sapiens
ggucagaugauaaacagaa

SEQ ID NO: 874188 - RNA, 19 nt, Homo sapiens
ggacauggcagccuguaca

SEQ ID NO: 874189 - RNA, 19 nt, Homo sapiens
ggacuggacucuuguucac

SEQ ID NO: 874190 - RNA, 19 nt, Homo sapiens
cagugggucucuuaauuug

SEQ ID NO: 874191 - RNA, 19 nt, Homo sapiens
gcaaaacucacacuuacua

SEQ ID NO: 874192 - RNA, 19 nt, Homo sapiens
cuucauccauacuuuguuu

SEQ ID NO: 874193 - RNA, 19 nt, Homo sapiens
cgaccuggcuagaacacaa

SEQ ID NO: 874194 - RNA, 19 nt, Homo sapiens
gaccgaccauugccauuuc

SEQ ID NO: 874195 - RNA, 19 nt, Homo sapiens
ugaccuucauccauacuuu

SEQ ID NO: 874196 - RNA, 19 nt, Homo sapiens
cgugagguuugaucaguaa

SEQ ID NO: 874197 - RNA, 19 nt, Homo sapiens
aaacucacacuuacuauca

SEQ ID NO: 874198 - RNA, 19 nt, Homo sapiens
ucuguaccauugaguuuaa

SEQ ID NO: 874199 - RNA, 19 nt, Homo sapiens
gggaaccaguguuauccaa

SEQ ID NO: 874200 - RNA, 19 nt, Homo sapiens
ggagaaccuugacagugau

SEQ ID NO: 874201 - RNA, 19 nt, Homo sapiens
gauuaaagaagcuaagauc

SEQ ID NO: 874202 - RNA, 19 nt, Homo sapiens
gcaugacucugccaagcau

SEQ ID NO: 874203 - RNA, 19 nt, Homo sapiens
gcagggaaccaguguuauc

SEQ ID NO: 874204 - RNA, 19 nt, Homo sapiens
cacuuuaccuucugccaaa

SEQ ID NO: 874205 - RNA, 19 nt, Homo sapiens
cagccugcguuccaguaua

SEQ ID NO: 874206 - RNA, 19 nt, Homo sapiens
gucaaggccugcucacugu

SEQ ID NO: 874207 - RNA, 19 nt, Homo sapiens
acacaaggucagaugauaa

SEQ ID NO: 874208 - RNA, 19 nt, Homo sapiens
gcaauaaagaugagaagac

SEQ ID NO: 874209 - RNA, 19 nt, Homo sapiens
ggucacauaccaaauucaa

SEQ ID NO: 874210 - RNA, 19 nt, Homo sapiens
aacacaaggucagaugaua

SEQ ID NO: 874211 - RNA, 19 nt, Homo sapiens
ggacucuuguucacuuuac

SEQ ID NO: 874212 - RNA, 19 nt, Homo sapiens
gaccagagggcaaaguguu

SEQ ID NO: 874213 - RNA, 19 nt, Homo sapiens
acagugggucucuuaauuu

SEQ ID NO: 874214 - RNA, 19 nt, Homo sapiens
ugaauugugcugcaucuug

SEQ ID NO: 874215 - RNA, 19 nt, Homo sapiens
cggaguggccuggcucuua

SEQ ID NO: 874216 - RNA, 19 nt, Homo sapiens
gugggucucuuaauuugau

SEQ ID NO: 874217 - RNA, 19 nt, Homo sapiens
gcgcuacuguauccguuug

SEQ ID NO: 874218 - RNA, 19 nt, Homo sapiens
gggcagcuuuuccuucaua

SEQ ID NO: 874219 - RNA, 19 nt, Homo sapiens
gcucuguaccauugaguuu

SEQ ID NO: 874220 - RNA, 19 nt, Homo sapiens
cacaaggucagaugauaaa

SEQ ID NO: 874221 - RNA, 19 nt, Homo sapiens
gaggagcagcuuuagguau

SEQ ID NO: 874222 - RNA, 19 nt, Homo sapiens
ucacugugccucucagcua

SEQ ID NO: 874223 - RNA, 19 nt, Homo sapiens
ccuacaccauguuccagua

SEQ ID NO: 874224 - RNA, 19 nt, Homo sapiens
caaggccugcucacuguaa

SEQ ID NO: 874225 - RNA, 19 nt, Homo sapiens
aggagcagcuuuagguaug

SEQ ID NO: 874226 - RNA, 19 nt, Homo sapiens
cacaauugcugcagaacuc

SEQ ID NO: 874227 - RNA, 19 nt, Homo sapiens
uaugagaccgggcagcuuu

SEQ ID NO: 874228 - RNA, 19 nt, Homo sapiens
gggaagaacaacucucauc

SEQ ID NO: 874229 - RNA, 19 nt, Homo sapiens
caagagccagagaugaauu

SEQ ID NO: 874230 - RNA, 19 nt, Homo sapiens
caaagucugauuaaagaag

SEQ ID NO: 874231 - RNA, 19 nt, Homo sapiens
agaguugcuuucugaauag

SEQ ID NO: 874232 - RNA, 19 nt, Homo sapiens
caagaguugcuuucugaau

SEQ ID NO: 874233 - RNA, 19 nt, Homo sapiens
caucuugccccaauucuua

SEQ ID NO: 874234 - RNA, 19 nt, Homo sapiens
ugagggaagcccagaauuc

SEQ ID NO: 874235 - RNA, 19 nt, Homo sapiens
cuguaaacauggcucugua

SEQ ID NO: 874236 - RNA, 19 nt, Homo sapiens
gagaugaauugugcugcau

SEQ ID NO: 874237 - RNA, 19 nt, Homo sapiens
agguauggauugaugacua

SEQ ID NO: 874238 - RNA, 19 nt, Homo sapiens
gguauaacuuuucuucaga

SEQ ID NO: 874239 - RNA, 19 nt, Homo sapiens
gggaaacaacugagaacau

SEQ ID NO: 874240 - RNA, 19 nt, Homo sapiens
gucacaaagucugauuaaa

SEQ ID NO: 874241 - RNA, 19 nt, Homo sapiens
ccaauacuggccuguguug

SEQ ID NO: 874242 - RNA, 19 nt, Homo sapiens
gaggcuggcuggacaucuc

SEQ ID NO: 874243 - RNA, 19 nt, Homo sapiens
gaccugcgccauccuuuag

SEQ ID NO: 874244 - RNA, 19 nt, Homo sapiens
caaggucagaugauaaaca

SEQ ID NO: 874245 - RNA, 19 nt, Homo sapiens
acaguuccagcccuuguua

SEQ ID NO: 874246 - RNA, 19 nt, Homo sapiens
gagcuucucucagauuucc

SEQ ID NO: 874247 - RNA, 19 nt, Homo sapiens
uggaggauauucagucucu

SEQ ID NO: 874248 - RNA, 19 nt, Homo sapiens
ccugcucacuguaaacaug

SEQ ID NO: 874249 - RNA, 19 nt, Homo sapiens
uaacagagauguagagaaa

SEQ ID NO: 874250 - RNA, 19 nt, Homo sapiens
gcaagacccucucucauaa

SEQ ID NO: 874251 - RNA, 19 nt, Homo sapiens
ggaaagauuugcuagguaa

SEQ ID NO: 874252 - RNA, 19 nt, Homo sapiens
gcucauaccugcccaguuu

SEQ ID NO: 874253 - RNA, 19 nt, Homo sapiens
gcacagugguucacauuug

SEQ ID NO: 874254 - RNA, 19 nt, Homo sapiens
gaauaaauaugagcucuga

SEQ ID NO: 874255 - RNA, 19 nt, Homo sapiens
gguaguagaugguaacaga

SEQ ID NO: 874256 - RNA, 19 nt, Homo sapiens
gaaauuaggcaagagauga

SEQ ID NO: 874257 - RNA, 19 nt, Homo sapiens
cauguuagcuuccuccuau

SEQ ID NO: 874258 - RNA, 19 nt, Homo sapiens
gugaaugggugacauauca

SEQ ID NO: 874259 - RNA, 19 nt, Homo sapiens
guauagcccuuagcacaua

SEQ ID NO: 874260 - RNA, 19 nt, Homo sapiens
ccagugacaugaugacauu

SEQ ID NO: 874261 - RNA, 19 nt, Homo sapiens
gggaaagauuugcuaggua

SEQ ID NO: 874262 - RNA, 19 nt, Homo sapiens
ggucuccucuggcuucuaa

SEQ ID NO: 874263 - RNA, 19 nt, Homo sapiens
ggaaaguucugaaaauuga

SEQ ID NO: 874264 - RNA, 19 nt, Homo sapiens
agagaacacuggaugcuuu

SEQ ID NO: 874265 - RNA, 19 nt, Homo sapiens
aaccaccacuucuucauua

SEQ ID NO: 874266 - RNA, 19 nt, Homo sapiens
ggaggcugcuggagaaaga

SEQ ID NO: 874267 - RNA, 19 nt, Homo sapiens
cauauaagccaguccgaua

SEQ ID NO: 874268 - RNA, 19 nt, Homo sapiens
aagaagaggugauaucauc

SEQ ID NO: 874269 - RNA, 19 nt, Homo sapiens
acacaggccucuugccauu

SEQ ID NO: 874270 - RNA, 19 nt, Homo sapiens
ggucugggcagucuaagua

SEQ ID NO: 874271 - RNA, 19 nt, Homo sapiens
cauccuaggucaaacaaga

SEQ ID NO: 874272 - RNA, 19 nt, Homo sapiens
ugacauucauggugagaaa

SEQ ID NO: 874273 - RNA, 19 nt, Homo sapiens
guagagaaaugggaaagau

SEQ ID NO: 874274 - RNA, 19 nt, Homo sapiens
uaagaauucucugcuaguu

SEQ ID NO: 874275 - RNA, 19 nt, Homo sapiens
cauccugacugcuuguuaa

SEQ ID NO: 874276 - RNA, 19 nt, Homo sapiens
gggcuugggaugauuauaa

SEQ ID NO: 874277 - RNA, 19 nt, Homo sapiens
gcagggaugguccagauaa

SEQ ID NO: 874278 - RNA, 19 nt, Homo sapiens
agaaagaaauuaggcaaga

SEQ ID NO: 874279 - RNA, 19 nt, Homo sapiens
ucuaauaccuucacaaacu

SEQ ID NO: 874280 - RNA, 19 nt, Homo sapiens
uuuggcagcuccugacuua

SEQ ID NO: 874281 - RNA, 19 nt, Homo sapiens
gcaaauuucccuuuaaacu

SEQ ID NO: 874282 - RNA, 19 nt, Homo sapiens
acagagauguagagaaaug

SEQ ID NO: 874283 - RNA, 19 nt, Homo sapiens
ggagaaaagugaagagaug

SEQ ID NO: 874284 - RNA, 19 nt, Homo sapiens
gugaaacccugccucuaga

SEQ ID NO: 874285 - RNA, 19 nt, Homo sapiens
caaauuucuuccuuucuuc

SEQ ID NO: 874286 - RNA, 19 nt, Homo sapiens
gaaagaaauuaggcaagag

SEQ ID NO: 874287 - RNA, 19 nt, Homo sapiens
cugcaaauuucccuuuaaa

SEQ ID NO: 874288 - RNA, 19 nt, Homo sapiens
uaacauguauagcccuuag

SEQ ID NO: 874289 - RNA, 19 nt, Homo sapiens
gcacuucuuucuaguacca

SEQ ID NO: 874290 - RNA, 19 nt, Homo sapiens
ccaguccuguuugccauua

SEQ ID NO: 874291 - RNA, 19 nt, Homo sapiens
gaaaguggaggccugaagu

SEQ ID NO: 874292 - RNA, 19 nt, Homo sapiens
uuaggaggcugcuggagaa

SEQ ID NO: 874293 - RNA, 19 nt, Homo sapiens
gaaacccugccucuagaaa

SEQ ID NO: 874294 - RNA, 19 nt, Homo sapiens
gagacuacagguguucuua

SEQ ID NO: 874295 - RNA, 19 nt, Homo sapiens
caagguagaagaaucacuu

SEQ ID NO: 874296 - RNA, 19 nt, Homo sapiens
ccugacugcuuguuaagaa

SEQ ID NO: 874297 - RNA, 19 nt, Homo sapiens
gagaagaagaggugauauc

SEQ ID NO: 874298 - RNA, 19 nt, Homo sapiens
ucuaguaccacuccauaua

SEQ ID NO: 874299 - RNA, 19 nt, Homo sapiens
caaacaagacccagugaca

SEQ ID NO: 874300 - RNA, 19 nt, Homo sapiens
gaggugauaucauccuuuu

SEQ ID NO: 874301 - RNA, 19 nt, Homo sapiens
cggguggucuccuuagaaa

SEQ ID NO: 874302 - RNA, 19 nt, Homo sapiens
gggaucaccuugaguccau

SEQ ID NO: 874303 - RNA, 19 nt, Homo sapiens
caaccaccacuucuucauu

SEQ ID NO: 874304 - RNA, 19 nt, Homo sapiens
cuaauaccuucacaaacuu

SEQ ID NO: 874305 - RNA, 19 nt, Homo sapiens
gaaccugaagaucucaauu

SEQ ID NO: 874306 - RNA, 19 nt, Homo sapiens
cagagaagaagaggugaua

SEQ ID NO: 874307 - RNA, 19 nt, Homo sapiens
cugggaaaguuagaaauuu

SEQ ID NO: 874308 - RNA, 19 nt, Homo sapiens
ccacggaaccugaagaucu

SEQ ID NO: 874309 - RNA, 19 nt, Homo sapiens
gcugcucccuuaacagaug

SEQ ID NO: 874310 - RNA, 19 nt, Homo sapiens
agcaagacccucucucaua

SEQ ID NO: 874311 - RNA, 19 nt, Homo sapiens
ugucaaauuucuuccuuuc

SEQ ID NO: 874312 - RNA, 19 nt, Homo sapiens
ccucuaauaccuucacaaa

SEQ ID NO: 874313 - RNA, 19 nt, Homo sapiens
ggucacaggaucccacuau

SEQ ID NO: 874314 - RNA, 19 nt, Homo sapiens
gaaggccaagguagaagaa

SEQ ID NO: 874315 - RNA, 19 nt, Homo sapiens
ggaaggccaagguagaaga

SEQ ID NO: 874316 - RNA, 19 nt, Homo sapiens
ccuccuagcgcacuucuuu

SEQ ID NO: 874317 - RNA, 19 nt, Homo sapiens
cccuauugcugcucccuua

SEQ ID NO: 874318 - RNA, 19 nt, Homo sapiens
gaagaagaggugauaucau

SEQ ID NO: 874319 - RNA, 19 nt, Homo sapiens
gugacaugaugacauuuau

SEQ ID NO: 874320 - RNA, 19 nt, Homo sapiens
aacuaucucuuccuucaaa

SEQ ID NO: 874321 - RNA, 19 nt, Homo sapiens
gcgcacuucuuucuaguac

SEQ ID NO: 874322 - RNA, 19 nt, Homo sapiens
gaaguccauccuccacaaa

SEQ ID NO: 874323 - RNA, 19 nt, Homo sapiens
gaacacuggaugcuuugug

SEQ ID NO: 874324 - RNA, 19 nt, Homo sapiens
ccagugaaugggugacaua

SEQ ID NO: 874325 - RNA, 19 nt, Homo sapiens
uauaacggguggucuccuu

SEQ ID NO: 874326 - RNA, 19 nt, Homo sapiens
ggugauaucauccuuuuaa

SEQ ID NO: 874327 - RNA, 19 nt, Homo sapiens
cauuauccacugucaaauu

SEQ ID NO: 874328 - RNA, 19 nt, Homo sapiens
gaacuaucucuuccuucaa

SEQ ID NO: 874329 - RNA, 19 nt, Homo sapiens
agaaguccauccuccacaa

SEQ ID NO: 874330 - RNA, 19 nt, Homo sapiens
ggucccaggcccucuguuu

SEQ ID NO: 874331 - RNA, 19 nt, Homo sapiens
uccauccuguagagaauua

SEQ ID NO: 874332 - RNA, 19 nt, Homo sapiens
cacaggaucccacuauguu

SEQ ID NO: 874333 - RNA, 19 nt, Homo sapiens
gcuucuaaguccuuugaau

SEQ ID NO: 874334 - RNA, 19 nt, Homo sapiens
gagugagacuacagguguu

SEQ ID NO: 874335 - RNA, 19 nt, Homo sapiens
aagcagggaugguccagau

SEQ ID NO: 874336 - RNA, 19 nt, Homo sapiens
gaggcgggauugcuugagu

SEQ ID NO: 874337 - RNA, 19 nt, Homo sapiens
aguagaaagugcccaaaca

SEQ ID NO: 874338 - RNA, 19 nt, Homo sapiens
ucugcaaauuucccuuuaa

SEQ ID NO: 874339 - RNA, 19 nt, Homo sapiens
gaaugggugacauaucaug

SEQ ID NO: 874340 - RNA, 19 nt, Homo sapiens
gaauuaucaguaccaguga

SEQ ID NO: 874341 - RNA, 19 nt, Homo sapiens
ggcagcuccugacuuaaga

SEQ ID NO: 874342 - RNA, 19 nt, Homo sapiens
cacagugguucacauuugu

SEQ ID NO: 874343 - RNA, 19 nt, Homo sapiens
caagacccucucucauaaa

SEQ ID NO: 874344 - RNA, 19 nt, Homo sapiens
ggcaugcagagccauauaa

SEQ ID NO: 874345 - RNA, 19 nt, Homo sapiens
gcuccugacuuaagagacu

SEQ ID NO: 874346 - RNA, 19 nt, Homo sapiens
uguuaagaauucucugcua

SEQ ID NO: 874347 - RNA, 19 nt, Homo sapiens
ccugaacuaucucuuccuu

SEQ ID NO: 874348 - RNA, 19 nt, Homo sapiens
gcauacaaggcaacuguuc

SEQ ID NO: 874349 - RNA, 19 nt, Homo sapiens
ccaauaagcuaccaaagua

SEQ ID NO: 874350 - RNA, 19 nt, Homo sapiens
gggaaucagugucucauua

SEQ ID NO: 874351 - RNA, 19 nt, Homo sapiens
uaacaagcauugccuuuaa

SEQ ID NO: 874352 - RNA, 19 nt, Homo sapiens
cugaagagcucacugcuua

SEQ ID NO: 874353 - RNA, 19 nt, Homo sapiens
ggaaggcucugauuucaug

SEQ ID NO: 874354 - RNA, 19 nt, Homo sapiens
ggauauggcucuugucaug

SEQ ID NO: 874355 - RNA, 19 nt, Homo sapiens
ccacaucgcugccuuguuc

SEQ ID NO: 874356 - RNA, 19 nt, Homo sapiens
gcaagucacuguacaacug

SEQ ID NO: 874357 - RNA, 19 nt, Homo sapiens
ugaagaaacuaacaaggaa

SEQ ID NO: 874358 - RNA, 19 nt, Homo sapiens
gaaagaagccagacccaau

SEQ ID NO: 874359 - RNA, 19 nt, Homo sapiens
ggcaguggcucacaaaguu

SEQ ID NO: 874360 - RNA, 19 nt, Homo sapiens
caaaggagccucuaugaag

SEQ ID NO: 874361 - RNA, 19 nt, Homo sapiens
ggaagagccagacccauuu

SEQ ID NO: 874362 - RNA, 19 nt, Homo sapiens
gcacacaggguuccucauu

SEQ ID NO: 874363 - RNA, 19 nt, Homo sapiens
gggagaggcugggugcaua

SEQ ID NO: 874364 - RNA, 19 nt, Homo sapiens
ugaaucaucugaaccugaa

SEQ ID NO: 874365 - RNA, 19 nt, Homo sapiens
aaaggagccucuaugaaga

SEQ ID NO: 874366 - RNA, 19 nt, Homo sapiens
caaaguaggauucccauuc

SEQ ID NO: 874367 - RNA, 19 nt, Homo sapiens
caaaggaacccggaacuga

SEQ ID NO: 874368 - RNA, 19 nt, Homo sapiens
gcaggauaauaggguaaua

SEQ ID NO: 874369 - RNA, 19 nt, Homo sapiens
ggagacagacggcagcaaa

SEQ ID NO: 874370 - RNA, 19 nt, Homo sapiens
ccucagcccucccaaguga

SEQ ID NO: 874371 - RNA, 19 nt, Homo sapiens
guagacaaagugaaacuaa

SEQ ID NO: 874372 - RNA, 19 nt, Homo sapiens
cugcuuaucuggugaauca

SEQ ID NO: 874373 - RNA, 19 nt, Homo sapiens
caacacugauaguaccaaa

SEQ ID NO: 874374 - RNA, 19 nt, Homo sapiens
ggauauaggagguaggauu

SEQ ID NO: 874375 - RNA, 19 nt, Homo sapiens
ggauauguauuugcuggaa

SEQ ID NO: 874376 - RNA, 19 nt, Homo sapiens
gcucaccgcuggcauaaac

SEQ ID NO: 874377 - RNA, 19 nt, Homo sapiens
aaagaagccagacccaaua

SEQ ID NO: 874378 - RNA, 19 nt, Homo sapiens
gauauugaacccacugauu

SEQ ID NO: 874379 - RNA, 19 nt, Homo sapiens
aaaugucucugugucauaa

SEQ ID NO: 874380 - RNA, 19 nt, Homo sapiens
gauaacaagcauugccuuu

SEQ ID NO: 874381 - RNA, 19 nt, Homo sapiens
ugaacccacugauuugaaa

SEQ ID NO: 874382 - RNA, 19 nt, Homo sapiens
ggaaucagugucucauuau

SEQ ID NO: 874383 - RNA, 19 nt, Homo sapiens
gaagaaacuaacaaggaaa

SEQ ID NO: 874384 - RNA, 19 nt, Homo sapiens
caaagugucacagauauug

SEQ ID NO: 874385 - RNA, 19 nt, Homo sapiens
ccaaauggcgggacaguuc

SEQ ID NO: 874386 - RNA, 19 nt, Homo sapiens
uggcauauucgaaguauaa

SEQ ID NO: 874387 - RNA, 19 nt, Homo sapiens
gaaucagugucucauuauc

SEQ ID NO: 874388 - RNA, 19 nt, Homo sapiens
acacaggguuccucauuca

SEQ ID NO: 874389 - RNA, 19 nt, Homo sapiens
cagguucacugcuugauuc

SEQ ID NO: 874390 - RNA, 19 nt, Homo sapiens
gagccagacccauuuguga

SEQ ID NO: 874391 - RNA, 19 nt, Homo sapiens
ccucugcccucuccgauga

SEQ ID NO: 874392 - RNA, 19 nt, Homo sapiens
gaauuggcgugugugcaaa

SEQ ID NO: 874393 - RNA, 19 nt, Homo sapiens
caaaugucucugugucaua

SEQ ID NO: 874394 - RNA, 19 nt, Homo sapiens
ggacaaggaaggucuaugc

SEQ ID NO: 874395 - RNA, 19 nt, Homo sapiens
gauauaggagguaggauuc

SEQ ID NO: 874396 - RNA, 19 nt, Homo sapiens
gaagagccagacccauuug

SEQ ID NO: 874397 - RNA, 19 nt, Homo sapiens
ggccguauuuccauauuca

SEQ ID NO: 874398 - RNA, 19 nt, Homo sapiens
gaucaggcaagucacugua

SEQ ID NO: 874399 - RNA, 19 nt, Homo sapiens
ugaagugcccgauggauau

SEQ ID NO: 874400 - RNA, 19 nt, Homo sapiens
agggagauguggcaggaua

SEQ ID NO: 874401 - RNA, 19 nt, Homo sapiens
aaacuaacaaggaaacaug

SEQ ID NO: 874402 - RNA, 19 nt, Homo sapiens
cggaagacccagugagaaa

SEQ ID NO: 874403 - RNA, 19 nt, Homo sapiens
cccaaagugucacagauau

SEQ ID NO: 874404 - RNA, 19 nt, Homo sapiens
gagauguggcaggauaaua

SEQ ID NO: 874405 - RNA, 19 nt, Homo sapiens
gagccucuaugaagaaacu

SEQ ID NO: 874406 - RNA, 19 nt, Homo sapiens
ucaaaggagccucuaugaa

SEQ ID NO: 874407 - RNA, 19 nt, Homo sapiens
agacugaauuggcgugugu

SEQ ID NO: 874408 - RNA, 19 nt, Homo sapiens
ccacugauuugaaaacuga

SEQ ID NO: 874409 - RNA, 19 nt, Homo sapiens
gaagagcucacugcuuauc

SEQ ID NO: 874410 - RNA, 19 nt, Homo sapiens
gaggaccuguacacccaaa

SEQ ID NO: 874411 - RNA, 19 nt, Homo sapiens
gaaccauggaggaccugua

SEQ ID NO: 874412 - RNA, 19 nt, Homo sapiens
cgauggauauggcucuugu

SEQ ID NO: 874413 - RNA, 19 nt, Homo sapiens
auauugaacccacugauuu

SEQ ID NO: 874414 - RNA, 19 nt, Homo sapiens
cauaaacaagguuaaggaa

SEQ ID NO: 874415 - RNA, 19 nt, Homo sapiens
ggccagaacccaagaggau

SEQ ID NO: 874416 - RNA, 19 nt, Homo sapiens
uggaagagccagacccauu

SEQ ID NO: 874417 - RNA, 19 nt, Homo sapiens
caaacaaaaucaugcacaa

SEQ ID NO: 874418 - RNA, 19 nt, Homo sapiens
uggacaaggugcugaagug

SEQ ID NO: 874419 - RNA, 19 nt, Homo sapiens
cagcaucacacacagaaug

SEQ ID NO: 874420 - RNA, 19 nt, Homo sapiens
gcuauuugcaugucacaga

SEQ ID NO: 874421 - RNA, 19 nt, Homo sapiens
gaaacuaacaaggaaacau

SEQ ID NO: 874422 - RNA, 19 nt, Homo sapiens
auaacaagcauugccuuua

SEQ ID NO: 874423 - RNA, 19 nt, Homo sapiens
ccaggcagcaggaacuauu

SEQ ID NO: 874424 - RNA, 19 nt, Homo sapiens
cuguacaacugggcuauuu

SEQ ID NO: 874425 - RNA, 19 nt, Homo sapiens
uggcgugugugcaaacuga

SEQ ID NO: 874426 - RNA, 19 nt, Homo sapiens
ugaauuggcgugugugcaa

SEQ ID NO: 874427 - RNA, 19 nt, Homo sapiens
ggaccuguacacccaaaga

SEQ ID NO: 874428 - RNA, 19 nt, Homo sapiens
gcccaagucagacgccuuu

SEQ ID NO: 874429 - RNA, 19 nt, Homo sapiens
gcacaacacaaaccaaagc

SEQ ID NO: 874430 - RNA, 19 nt, Homo sapiens
ccaggcaacacugauagua

SEQ ID NO: 874431 - RNA, 19 nt, Homo sapiens
guucaaaggagccucuaug

SEQ ID NO: 874432 - RNA, 19 nt, Homo sapiens
ggugcuaucaggagacauu

SEQ ID NO: 874433 - RNA, 19 nt, Homo sapiens
ccaaagugucacagauauu

SEQ ID NO: 874434 - RNA, 19 nt, Homo sapiens
gaccucagcccucccaagu

SEQ ID NO: 874435 - RNA, 19 nt, Homo sapiens
gaaguauaacccagugagu

SEQ ID NO: 874436 - RNA, 19 nt, Homo sapiens
cuggagacuuggaggauga

SEQ ID NO: 874437 - RNA, 19 nt, Homo sapiens
cucauuaucucuaccaucu

SEQ ID NO: 874438 - RNA, 19 nt, Homo sapiens
acagacggcagcaaacaaa

SEQ ID NO: 874439 - RNA, 19 nt, Homo sapiens
cacacaggguuccucauuc

SEQ ID NO: 874440 - RNA, 19 nt, Homo sapiens
cugaagugcccgauggaua

SEQ ID NO: 874441 - RNA, 19 nt, Homo sapiens
gcaggaacuauucuacauc

SEQ ID NO: 874442 - RNA, 19 nt, Homo sapiens
uaacagcaucugcacaaca

SEQ ID NO: 874443 - RNA, 19 nt, Homo sapiens
aaagggaacgagccaguga

SEQ ID NO: 874444 - RNA, 19 nt, Homo sapiens
gcucacaaaguucaaugga

SEQ ID NO: 874445 - RNA, 19 nt, Homo sapiens
ucauaaacaagguuaagga

SEQ ID NO: 874446 - RNA, 19 nt, Homo sapiens
cauuaucucuaccaucucu

SEQ ID NO: 874447 - RNA, 19 nt, Homo sapiens
auauggcucuugucaugaa

SEQ ID NO: 874448 - RNA, 19 nt, Homo sapiens
gggaacgugacauggcaua

SEQ ID NO: 874449 - RNA, 19 nt, Homo sapiens
gagaugauguacacaauua

SEQ ID NO: 874450 - RNA, 19 nt, Homo sapiens
gaacagaagucagaugaaa

SEQ ID NO: 874451 - RNA, 19 nt, Homo sapiens
gaauuuagauggguucaua

SEQ ID NO: 874452 - RNA, 19 nt, Homo sapiens
ccaaguagcugggauugua

SEQ ID NO: 874453 - RNA, 19 nt, Homo sapiens
gagauaacaugucaagcua

SEQ ID NO: 874454 - RNA, 19 nt, Homo sapiens
gaagaagagugaagaaagu

SEQ ID NO: 874455 - RNA, 19 nt, Homo sapiens
gaaggaaguuagcaaguug

SEQ ID NO: 874456 - RNA, 19 nt, Homo sapiens
gaaaggacaaggaacauuu

SEQ ID NO: 874457 - RNA, 19 nt, Homo sapiens
caaauggccuugccgcuaa

SEQ ID NO: 874458 - RNA, 19 nt, Homo sapiens
ggaaaggacugagaugaug

SEQ ID NO: 874459 - RNA, 19 nt, Homo sapiens
guuacaacgucaaugauua

SEQ ID NO: 874460 - RNA, 19 nt, Homo sapiens
gaagcaagacaucagaaua

SEQ ID NO: 874461 - RNA, 19 nt, Homo sapiens
gggauuaucucagacagua

SEQ ID NO: 874462 - RNA, 19 nt, Homo sapiens
gaaguauugucaaggauug

SEQ ID NO: 874463 - RNA, 19 nt, Homo sapiens
caaaugaagucuaccaaca

SEQ ID NO: 874464 - RNA, 19 nt, Homo sapiens
gaacugagugauacaauga

SEQ ID NO: 874465 - RNA, 19 nt, Homo sapiens
guagaaagccuuacuguag

SEQ ID NO: 874466 - RNA, 19 nt, Homo sapiens
cgucaaugauuauuccuua

SEQ ID NO: 874467 - RNA, 19 nt, Homo sapiens
gagaagagcuuggauacag

SEQ ID NO: 874468 - RNA, 19 nt, Homo sapiens
cccaacggguuacuaauua

SEQ ID NO: 874469 - RNA, 19 nt, Homo sapiens
ccaaggagauaacauguca

SEQ ID NO: 874470 - RNA, 19 nt, Homo sapiens
agaaagggauuaucucaga

SEQ ID NO: 874471 - RNA, 19 nt, Homo sapiens
ggacugagaugauguacac

SEQ ID NO: 874472 - RNA, 19 nt, Homo sapiens
caacaacgaacacuacaaa

SEQ ID NO: 874473 - RNA, 19 nt, Homo sapiens
ugacauaagugacauugug

SEQ ID NO: 874474 - RNA, 19 nt, Homo sapiens
gugacugucucucuuuaua

SEQ ID NO: 874475 - RNA, 19 nt, Homo sapiens
ccacaaugcucuauucaag

SEQ ID NO: 874476 - RNA, 19 nt, Homo sapiens
gcaagacaucagaauaaua

SEQ ID NO: 874477 - RNA, 19 nt, Homo sapiens
cgaaaacacuugccuuuaa

SEQ ID NO: 874478 - RNA, 19 nt, Homo sapiens
ccagccuacuuucuaauua

SEQ ID NO: 874479 - RNA, 19 nt, Homo sapiens
uguaggaacuuacccauga

SEQ ID NO: 874480 - RNA, 19 nt, Homo sapiens
ugacauugauucugaugaa

SEQ ID NO: 874481 - RNA, 19 nt, Homo sapiens
ggacaaggaacauuugaug

SEQ ID NO: 874482 - RNA, 19 nt, Homo sapiens
gacauugacacuugaauuu

SEQ ID NO: 874483 - RNA, 19 nt, Homo sapiens
gucacagccuauuuaauua

SEQ ID NO: 874484 - RNA, 19 nt, Homo sapiens
uguaaagaauguccaguuu

SEQ ID NO: 874485 - RNA, 19 nt, Homo sapiens
ugucacagccuauuuaauu

SEQ ID NO: 874486 - RNA, 19 nt, Homo sapiens
gugaaauacugcacaaaug

SEQ ID NO: 874487 - RNA, 19 nt, Homo sapiens
ccaaagaacagaagucaga

SEQ ID NO: 874488 - RNA, 19 nt, Homo sapiens
gagacaggguuucaucaug

SEQ ID NO: 874489 - RNA, 19 nt, Homo sapiens
uaaccuaagcuaccuuuaa

SEQ ID NO: 874490 - RNA, 19 nt, Homo sapiens
gauaacaugucaagcuaca

SEQ ID NO: 874491 - RNA, 19 nt, Homo sapiens
gaagaacagcuccacaaug

SEQ ID NO: 874492 - RNA, 19 nt, Homo sapiens
cagccuacuuucuaauuaa

SEQ ID NO: 874493 - RNA, 19 nt, Homo sapiens
ggacauugacacuugaauu

SEQ ID NO: 874494 - RNA, 19 nt, Homo sapiens
cagaguagcugagcaguuc

SEQ ID NO: 874495 - RNA, 19 nt, Homo sapiens
cuuaagagaucagcuauug

SEQ ID NO: 874496 - RNA, 19 nt, Homo sapiens
gaaauacugcacaaaugaa

SEQ ID NO: 874497 - RNA, 19 nt, Homo sapiens
acacacagcauccacauuu

SEQ ID NO: 874498 - RNA, 19 nt, Homo sapiens
ugaaaguggugauggaaga

SEQ ID NO: 874499 - RNA, 19 nt, Homo sapiens
ugaaggaaguuagcaaguu

SEQ ID NO: 874500 - RNA, 19 nt, Homo sapiens
gaagucauauccucugaac

SEQ ID NO: 874501 - RNA, 19 nt, Homo sapiens
cuaccaauccuuccuuuaa

SEQ ID NO: 874502 - RNA, 19 nt, Homo sapiens
cuaaagaacugagugauac

SEQ ID NO: 874503 - RNA, 19 nt, Homo sapiens
uuagauggguucauauaug

SEQ ID NO: 874504 - RNA, 19 nt, Homo sapiens
ugaagacuguaggaacuua

SEQ ID NO: 874505 - RNA, 19 nt, Homo sapiens
gaauugacagccuauguug

SEQ ID NO: 874506 - RNA, 19 nt, Homo sapiens
ugaaauacugcacaaauga

SEQ ID NO: 874507 - RNA, 19 nt, Homo sapiens
ggaaugugccaaggagaua

SEQ ID NO: 874508 - RNA, 19 nt, Homo sapiens
aagcaagacaucagaauaa

SEQ ID NO: 874509 - RNA, 19 nt, Homo sapiens
gagaauccuuccgugguuu

SEQ ID NO: 874510 - RNA, 19 nt, Homo sapiens
uaaagaauguccaguuuug

SEQ ID NO: 874511 - RNA, 19 nt, Homo sapiens
gauuauuccuuaagagauc

SEQ ID NO: 874512 - RNA, 19 nt, Homo sapiens
uaaggacucuccgaaguau

SEQ ID NO: 874513 - RNA, 19 nt, Homo sapiens
gaggcuaucuuugaaguca

SEQ ID NO: 874514 - RNA, 19 nt, Homo sapiens
gaaagagacaagaggcuau

SEQ ID NO: 874515 - RNA, 19 nt, Homo sapiens
agucuggccucggaaauua

SEQ ID NO: 874516 - RNA, 19 nt, Homo sapiens
cgagaauccuuccgugguu

SEQ ID NO: 874517 - RNA, 19 nt, Homo sapiens
uggccaggauggucucuua

SEQ ID NO: 874518 - RNA, 19 nt, Homo sapiens
agacaggguuucaucaugu

SEQ ID NO: 874519 - RNA, 19 nt, Homo sapiens
uagauggguucauauaugu

SEQ ID NO: 874520 - RNA, 19 nt, Homo sapiens
gagaaugggacgcuugcua

SEQ ID NO: 874521 - RNA, 19 nt, Homo sapiens
aagaacagcuccacaaugc

SEQ ID NO: 874522 - RNA, 19 nt, Homo sapiens
acucccagcuggaauuuaa

SEQ ID NO: 874523 - RNA, 19 nt, Homo sapiens
ggaaguauugucaaggauu

SEQ ID NO: 874524 - RNA, 19 nt, Homo sapiens
gagcuuggauacagugagu

SEQ ID NO: 874525 - RNA, 19 nt, Homo sapiens
ccuuuaagcuugccagguu

SEQ ID NO: 874526 - RNA, 19 nt, Homo sapiens
gaaaguggagaugcuacua

SEQ ID NO: 874527 - RNA, 19 nt, Homo sapiens
ggaagaacagcuccacaau

SEQ ID NO: 874528 - RNA, 19 nt, Homo sapiens
uaaggugacugucucucuu

SEQ ID NO: 874529 - RNA, 19 nt, Homo sapiens
gcuccacaaugcucuauuc

SEQ ID NO: 874530 - RNA, 19 nt, Homo sapiens
uuaacgaugugcucauuau

SEQ ID NO: 874531 - RNA, 19 nt, Homo sapiens
cgaagaagaagaacagaau

SEQ ID NO: 874532 - RNA, 19 nt, Homo sapiens
ggagauaacaugucaagcu

SEQ ID NO: 874533 - RNA, 19 nt, Homo sapiens
gaucagcuauugguggaau

SEQ ID NO: 874534 - RNA, 19 nt, Homo sapiens
aaaguuacaacgucaauga

SEQ ID NO: 874535 - RNA, 19 nt, Homo sapiens
gaacuuacccaugaucucu

SEQ ID NO: 874536 - RNA, 19 nt, Homo sapiens
uuggagaucuugauacgaa

SEQ ID NO: 874537 - RNA, 19 nt, Homo sapiens
gaagaagaagaacagaaug

SEQ ID NO: 874538 - RNA, 19 nt, Homo sapiens
agagugaggucgauaacga

SEQ ID NO: 874539 - RNA, 19 nt, Homo sapiens
cagcagaucauuccgaaga

SEQ ID NO: 874540 - RNA, 19 nt, Homo sapiens
auaagaauguggagagaau

SEQ ID NO: 874541 - RNA, 19 nt, Homo sapiens
ccagucaccucuuuacucu

SEQ ID NO: 874542 - RNA, 19 nt, Homo sapiens
gcaaguugguucgacuaug

SEQ ID NO: 874543 - RNA, 19 nt, Homo sapiens
gaaguaugaagucugcaaa

SEQ ID NO: 874544 - RNA, 19 nt, Homo sapiens
ggcuaucuuugaagucaua

SEQ ID NO: 874545 - RNA, 19 nt, Homo sapiens
ccaacucucugcggugaaa

SEQ ID NO: 874546 - RNA, 19 nt, Homo sapiens
caaguugguucgacuaugc

SEQ ID NO: 874547 - RNA, 19 nt, Homo sapiens
ucuaaagaacugagugaua

SEQ ID NO: 874548 - RNA, 19 nt, Homo sapiens
gaucuugauacgaauguuu

SEQ ID NO: 874549 - RNA, 19 nt, Homo sapiens
aaagaucacugacaacaug

SEQ ID NO: 874550 - RNA, 19 nt, Homo sapiens
caagauacguccuguggau

SEQ ID NO: 874551 - RNA, 19 nt, Homo sapiens
caggaaagaucacugacaa

SEQ ID NO: 874552 - RNA, 19 nt, Homo sapiens
cagcccaucucaacaauau

SEQ ID NO: 874553 - RNA, 19 nt, Homo sapiens
gcccaggucucucaacuuc

SEQ ID NO: 874554 - RNA, 19 nt, Homo sapiens
ccaggagucuuccaagguu

SEQ ID NO: 874555 - RNA, 19 nt, Homo sapiens
ggaaagaucacugacaaca

SEQ ID NO: 874556 - RNA, 19 nt, Homo sapiens
guugaagggcccacaauaa

SEQ ID NO: 874557 - RNA, 19 nt, Homo sapiens
gggaaguuguccacucuau

SEQ ID NO: 874558 - RNA, 19 nt, Homo sapiens
gaaacaauccgaaaauaug

SEQ ID NO: 874559 - RNA, 19 nt, Homo sapiens
gaaccacgaccaugacauc

SEQ ID NO: 874560 - RNA, 19 nt, Homo sapiens
ccaagguucucaacaccaa

SEQ ID NO: 874561 - RNA, 19 nt, Homo sapiens
ugaaacaucucaacaaccu

SEQ ID NO: 874562 - RNA, 19 nt, Homo sapiens
gaugaggagugucgucaag

SEQ ID NO: 874563 - RNA, 19 nt, Homo sapiens
gagggaaguuguccacucu

SEQ ID NO: 874564 - RNA, 19 nt, Homo sapiens
gcccuucucugcuccuuau

SEQ ID NO: 874565 - RNA, 19 nt, Homo sapiens
cgucaagucuacccaggaa

SEQ ID NO: 874566 - RNA, 19 nt, Homo sapiens
gaaagaucacugacaacau

SEQ ID NO: 874567 - RNA, 19 nt, Homo sapiens
gaaauguaccggcuuccau

SEQ ID NO: 874568 - RNA, 19 nt, Homo sapiens
gcucacaggcuacauccaa

SEQ ID NO: 874569 - RNA, 19 nt, Homo sapiens
ccaggucucucaacuucau

SEQ ID NO: 874570 - RNA, 19 nt, Homo sapiens
gguugaagggcccacaaua

SEQ ID NO: 874571 - RNA, 19 nt, Homo sapiens
gcccaucucaacaauauau

SEQ ID NO: 874572 - RNA, 19 nt, Homo sapiens
caccaugacuuccucacau

SEQ ID NO: 874573 - RNA, 19 nt, Homo sapiens
uugaagggcccacaauaaa

SEQ ID NO: 874574 - RNA, 19 nt, Homo sapiens
gugaaacaauccgaaaaua

SEQ ID NO: 874575 - RNA, 19 nt, Homo sapiens
ggagugucgucaagucuac

SEQ ID NO: 874576 - RNA, 19 nt, Homo sapiens
caucagcccaucucaacaa

SEQ ID NO: 874577 - RNA, 19 nt, Homo sapiens
agugauccauguccugaaa

SEQ ID NO: 874578 - RNA, 19 nt, Homo sapiens
uaugaaacccagcagcaaa

SEQ ID NO: 874579 - RNA, 19 nt, Homo sapiens
guggauccgugaaacaauc

SEQ ID NO: 874580 - RNA, 19 nt, Homo sapiens
ccugaaacaucucaacaac

SEQ ID NO: 874581 - RNA, 19 nt, Homo sapiens
gaaguuguccacucuaucc

SEQ ID NO: 874582 - RNA, 19 nt, Homo sapiens
guggcacauucuuaaauau

SEQ ID NO: 874583 - RNA, 19 nt, Homo sapiens
ccccaaaacucuacaaugu

SEQ ID NO: 874584 - RNA, 19 nt, Homo sapiens
gcccagaucaccaccugaa

SEQ ID NO: 874585 - RNA, 19 nt, Homo sapiens
caaugggaccaguggguuu

SEQ ID NO: 874586 - RNA, 19 nt, Homo sapiens
aggaggggcucaaaguuua

SEQ ID NO: 874587 - RNA, 19 nt, Homo sapiens
ugaccggccuggugucuac

SEQ ID NO: 874588 - RNA, 19 nt, Homo sapiens
ugaggagugucgucaaguc

SEQ ID NO: 874589 - RNA, 19 nt, Homo sapiens
uugcaucccugaaacaucu

SEQ ID NO: 874590 - RNA, 19 nt, Homo sapiens
aaugcucaaucucagcuaa

SEQ ID NO: 874591 - RNA, 19 nt, Homo sapiens
gacaauggcccaggucucu

SEQ ID NO: 874592 - RNA, 19 nt, Homo sapiens
gagcaggugagggaaguug

SEQ ID NO: 874593 - RNA, 19 nt, Homo sapiens
ucaucaguguggcuucuau

SEQ ID NO: 874594 - RNA, 19 nt, Homo sapiens
aaucucagcuaacauucca

SEQ ID NO: 874595 - RNA, 19 nt, Homo sapiens
caaaagaggguggcaaaga

SEQ ID NO: 874596 - RNA, 19 nt, Homo sapiens
cauccaacuucgcucagau

SEQ ID NO: 874597 - RNA, 19 nt, Homo sapiens
ggaaguuguccacucuauc

SEQ ID NO: 874598 - RNA, 19 nt, Homo sapiens
caauggcccaggucucuca

SEQ ID NO: 874599 - RNA, 19 nt, Homo sapiens
caucucaacaaccugaaug

SEQ ID NO: 874600 - RNA, 19 nt, Homo sapiens
ccaggaaagaucacugaca

SEQ ID NO: 874601 - RNA, 19 nt, Homo sapiens
gugagcaggugagggaagu

SEQ ID NO: 874602 - RNA, 19 nt, Homo sapiens
gccgcacacugucuaaagg

SEQ ID NO: 874603 - RNA, 19 nt, Homo sapiens
cucaaucucagcuaacauu

SEQ ID NO: 874604 - RNA, 19 nt, Homo sapiens
ucccaguguuccauuugaa

SEQ ID NO: 874605 - RNA, 19 nt, Homo sapiens
uauucccaguguuccauuu

SEQ ID NO: 874606 - RNA, 19 nt, Homo sapiens
gaagggcccacaauaaaag

SEQ ID NO: 874607 - RNA, 19 nt, Homo sapiens
ucaagucuacccaggaaag

SEQ ID NO: 874608 - RNA, 19 nt, Homo sapiens
ccaauaagcucaucaaaga

SEQ ID NO: 874609 - RNA, 19 nt, Homo sapiens
ggacaaugaugaggccuua

SEQ ID NO: 874610 - RNA, 19 nt, Homo sapiens
gaacaacaaugugaaacug

SEQ ID NO: 874611 - RNA, 19 nt, Homo sapiens
gagcaggaguauuuaugaa

SEQ ID NO: 874612 - RNA, 19 nt, Homo sapiens
ggucgugucucccaaguau

SEQ ID NO: 874613 - RNA, 19 nt, Homo sapiens
ucaacgagcucaucaaggu

SEQ ID NO: 874614 - RNA, 19 nt, Homo sapiens
cggagaaggugaagaacaa

SEQ ID NO: 874615 - RNA, 19 nt, Homo sapiens
ugacggugcuggaaacaug

SEQ ID NO: 874616 - RNA, 19 nt, Homo sapiens
acacagaggacaaugauga

SEQ ID NO: 874617 - RNA, 19 nt, Homo sapiens
ggaggaagcacagcuguug

SEQ ID NO: 874618 - RNA, 19 nt, Homo sapiens
uccgggaccugcagaauaa

SEQ ID NO: 874619 - RNA, 19 nt, Homo sapiens
ggacaucggagaaggugaa

SEQ ID NO: 874620 - RNA, 19 nt, Homo sapiens
ucgaggaggugaacaacaa

SEQ ID NO: 874621 - RNA, 19 nt, Homo sapiens
gcaggaguauuuaugaaaa

SEQ ID NO: 874622 - RNA, 19 nt, Homo sapiens
agugagagcaggaguauuu

SEQ ID NO: 874623 - RNA, 19 nt, Homo sapiens
gcacucuggugugugguuu

SEQ ID NO: 874624 - RNA, 19 nt, Homo sapiens
gaggugaacaacaauguga

SEQ ID NO: 874625 - RNA, 19 nt, Homo sapiens
ccuaccagaugcuaaagaa

SEQ ID NO: 874626 - RNA, 19 nt, Homo sapiens
uggaagaacuugggucaug

SEQ ID NO: 874627 - RNA, 19 nt, Homo sapiens
gcuuaggccuccuccauag

SEQ ID NO: 874628 - RNA, 19 nt, Homo sapiens
ugaaacugcucacggagau

SEQ ID NO: 874629 - RNA, 19 nt, Homo sapiens
gagagcaggaguauuuaug

SEQ ID NO: 874630 - RNA, 19 nt, Homo sapiens
caucggagaaggugaagaa

SEQ ID NO: 874631 - RNA, 19 nt, Homo sapiens
ccaagguuaugaaggugaa

SEQ ID NO: 874632 - RNA, 19 nt, Homo sapiens
cuggaaacaugcaugaaga

SEQ ID NO: 874633 - RNA, 19 nt, Homo sapiens
ugaucaaccuguauaagca

SEQ ID NO: 874634 - RNA, 19 nt, Homo sapiens
gcuacaagcucaccuucac

SEQ ID NO: 874635 - RNA, 19 nt, Homo sapiens
caucaaacccagcaacauc

SEQ ID NO: 874636 - RNA, 19 nt, Homo sapiens
uaucugggcucucggacau

SEQ ID NO: 874637 - RNA, 19 nt, Homo sapiens
agaagcggauggagaagau

SEQ ID NO: 874638 - RNA, 19 nt, Homo sapiens
ggugaacaacaaugugaaa

SEQ ID NO: 874639 - RNA, 19 nt, Homo sapiens
ggguuucccuuugccauug

SEQ ID NO: 874640 - RNA, 19 nt, Homo sapiens
gaugguaccggauggaaca

SEQ ID NO: 874641 - RNA, 19 nt, Homo sapiens
ggaaggcccagccauaacu

SEQ ID NO: 874642 - RNA, 19 nt, Homo sapiens
gccaauaagcucaucaaag

SEQ ID NO: 874643 - RNA, 19 nt, Homo sapiens
gagaaggugaagaacaaga

SEQ ID NO: 874644 - RNA, 19 nt, Homo sapiens
aauaagcucaucaaagaga

SEQ ID NO: 874645 - RNA, 19 nt, Homo sapiens
cgacgaagugggcaaguuc

SEQ ID NO: 874646 - RNA, 19 nt, Homo sapiens
ggcccaagccuggauggua

SEQ ID NO: 874647 - RNA, 19 nt, Homo sapiens
ccagaugacacuaccuuuc

SEQ ID NO: 874648 - RNA, 19 nt, Homo sapiens
ugacacagaggacaaugau

SEQ ID NO: 874649 - RNA, 19 nt, Homo sapiens
gcagcucaacgaggacuuu

SEQ ID NO: 874650 - RNA, 19 nt, Homo sapiens
acgacgagcucaugucucu

SEQ ID NO: 874651 - RNA, 19 nt, Homo sapiens
gaucuuggagcuccucuac

SEQ ID NO: 874652 - RNA, 19 nt, Homo sapiens
gaaggugaagaacaagauc

SEQ ID NO: 874653 - RNA, 19 nt, Homo sapiens
gcaaguuccgcuuucucaa

SEQ ID NO: 874654 - RNA, 19 nt, Homo sapiens
accugucucuuaugccuua

SEQ ID NO: 874655 - RNA, 19 nt, Homo sapiens
ggcaccaccuacccagcua

SEQ ID NO: 874656 - RNA, 19 nt, Homo sapiens
cggugugucuccuucauuc

SEQ ID NO: 874657 - RNA, 19 nt, Homo sapiens
gaaucaauagagccacgaa

SEQ ID NO: 874658 - RNA, 19 nt, Homo sapiens
gcuggaaacaugcaugaag

SEQ ID NO: 874659 - RNA, 19 nt, Homo sapiens
cgauggagccggagacucu

SEQ ID NO: 874660 - RNA, 19 nt, Homo sapiens
gaccuccgcgcagccaaua

SEQ ID NO: 874661 - RNA, 19 nt, Homo sapiens
agagcaggaguauuuauga

SEQ ID NO: 874662 - RNA, 19 nt, Homo sapiens
gugagagcaggaguauuua

SEQ ID NO: 874663 - RNA, 19 nt, Homo sapiens
ggaggugaacaacaaugug

SEQ ID NO: 874664 - RNA, 19 nt, Homo sapiens
gaugaggagaaauccaaga

SEQ ID NO: 874665 - RNA, 19 nt, Homo sapiens
cuuugaagaugaggagaaa

SEQ ID NO: 874666 - RNA, 19 nt, Homo sapiens
ggcaaguuccgcuuucuca

SEQ ID NO: 874667 - RNA, 19 nt, Homo sapiens
cagagggaccggucacugu

SEQ ID NO: 874668 - RNA, 19 nt, Homo sapiens
gagcucccaucccgaagac

SEQ ID NO: 874669 - RNA, 19 nt, Homo sapiens
ugugucuccuucauucauu

SEQ ID NO: 874670 - RNA, 19 nt, Homo sapiens
aagaugaggagaaauccaa

SEQ ID NO: 874671 - RNA, 19 nt, Homo sapiens
cagcuuaggccuccuccau

SEQ ID NO: 874672 - RNA, 19 nt, Homo sapiens
gaggaggugaacaacaaug

SEQ ID NO: 874673 - RNA, 19 nt, Homo sapiens
gaagaugaggagaaaucca

SEQ ID NO: 874674 - RNA, 19 nt, Homo sapiens
ucgcagaggccuaccagau

SEQ ID NO: 874675 - RNA, 19 nt, Homo sapiens
ucuuggagcuccucuacag

SEQ ID NO: 874676 - RNA, 19 nt, Homo sapiens
ugagugagagcaggaguau

SEQ ID NO: 874677 - RNA, 19 nt, Homo sapiens
gugagugagagcaggagua

SEQ ID NO: 874678 - RNA, 19 nt, Homo sapiens
cuggaggcgcgaaucaaua

SEQ ID NO: 874679 - RNA, 19 nt, Homo sapiens
gugcuggaaacaugcauga

SEQ ID NO: 874680 - RNA, 19 nt, Homo sapiens
gggaggaagcacagcuguu

SEQ ID NO: 874681 - RNA, 19 nt, Homo sapiens
gugggcaaguuccgcuuuc

SEQ ID NO: 874682 - RNA, 19 nt, Homo sapiens
ugagagcaggaguauuuau

SEQ ID NO: 874683 - RNA, 19 nt, Homo sapiens
ggucagugugugagugaga

SEQ ID NO: 874684 - RNA, 19 nt, Homo sapiens
cuccgggaccugcagaaua

SEQ ID NO: 874685 - RNA, 19 nt, Homo sapiens
gugaucaaccuguauaagc

SEQ ID NO: 874686 - RNA, 19 nt, Homo sapiens
caaguuccgcuuucucaac

SEQ ID NO: 874687 - RNA, 19 nt, Homo sapiens
cgagugacacagaggacaa

SEQ ID NO: 874688 - RNA, 19 nt, Homo sapiens
ccacggccgaagaauguga

SEQ ID NO: 874689 - RNA, 19 nt, Homo sapiens
gcugcuggcccacaagauc

SEQ ID NO: 874690 - RNA, 19 nt, Homo sapiens
cgcagaggccuaccagaug

SEQ ID NO: 874691 - RNA, 19 nt, Homo sapiens
gcagaaagcucuauagcau

SEQ ID NO: 874692 - RNA, 19 nt, Homo sapiens
caaacuauguccuggaaua

SEQ ID NO: 874693 - RNA, 19 nt, Homo sapiens
gaagaacgcccaaggcaaa

SEQ ID NO: 874694 - RNA, 19 nt, Homo sapiens
gcacuggcguggcgacaaa

SEQ ID NO: 874695 - RNA, 19 nt, Homo sapiens
guacauugccauuccauuu

SEQ ID NO: 874696 - RNA, 19 nt, Homo sapiens
gaacugcccugagcugcaa

SEQ ID NO: 874697 - RNA, 19 nt, Homo sapiens
gcccugagcugcaaaccuu

SEQ ID NO: 874698 - RNA, 19 nt, Homo sapiens
cguaagaguucccuauuuc

SEQ ID NO: 874699 - RNA, 19 nt, Homo sapiens
gcacugaaauaaaacacua

SEQ ID NO: 874700 - RNA, 19 nt, Homo sapiens
caaagucuguaacucuaga

SEQ ID NO: 874701 - RNA, 19 nt, Homo sapiens
cagaugcccuuauauugga

SEQ ID NO: 874702 - RNA, 19 nt, Homo sapiens
cugcaaaccuuacaaaguc

SEQ ID NO: 874703 - RNA, 19 nt, Homo sapiens
gcguggagcuuuacaaggu

SEQ ID NO: 874704 - RNA, 19 nt, Homo sapiens
ggaauacaggccaaacuga

SEQ ID NO: 874705 - RNA, 19 nt, Homo sapiens
gaagauacuuuucuguguu

SEQ ID NO: 874706 - RNA, 19 nt, Homo sapiens
gucuguaacucuagauaaa

SEQ ID NO: 874707 - RNA, 19 nt, Homo sapiens
gugcugaguucccuugguu

SEQ ID NO: 874708 - RNA, 19 nt, Homo sapiens
gaggaagacgugaccauug

SEQ ID NO: 874709 - RNA, 19 nt, Homo sapiens
agaguucccuauuucauug

SEQ ID NO: 874710 - RNA, 19 nt, Homo sapiens
ucgaagagcagcagacaaa

SEQ ID NO: 874711 - RNA, 19 nt, Homo sapiens
cuuccgagauuucaaaguu

SEQ ID NO: 874712 - RNA, 19 nt, Homo sapiens
gcuaagagccauccauuuu

SEQ ID NO: 874713 - RNA, 19 nt, Homo sapiens
ucguaagaguucccuauuu

SEQ ID NO: 874714 - RNA, 19 nt, Homo sapiens
gaauacaggccaaacugau

SEQ ID NO: 874715 - RNA, 19 nt, Homo sapiens
gccauuccauuucucauca

SEQ ID NO: 874716 - RNA, 19 nt, Homo sapiens
gagcugccacggauacuga

SEQ ID NO: 874717 - RNA, 19 nt, Homo sapiens
agugauauaucgauacuuc

SEQ ID NO: 874718 - RNA, 19 nt, Homo sapiens
gcuaacugcacugaaauaa

SEQ ID NO: 874719 - RNA, 19 nt, Homo sapiens
gagcugcaaaccuuacaaa

SEQ ID NO: 874720 - RNA, 19 nt, Homo sapiens
ggaagauacuuuucugugu

SEQ ID NO: 874721 - RNA, 19 nt, Homo sapiens
uaaaccauaccaugugcua

SEQ ID NO: 874722 - RNA, 19 nt, Homo sapiens
guucuuccuugauccuauu

SEQ ID NO: 874723 - RNA, 19 nt, Homo sapiens
ccagaugcccuuauauugg

SEQ ID NO: 874724 - RNA, 19 nt, Homo sapiens
cgagagacgccuccagaug

SEQ ID NO: 874725 - RNA, 19 nt, Homo sapiens
uagauaaaccauaccaugu

SEQ ID NO: 874726 - RNA, 19 nt, Homo sapiens
gccuccagaugcccuuaua

SEQ ID NO: 874727 - RNA, 19 nt, Homo sapiens
guuugaaucacacguguaa

SEQ ID NO: 874728 - RNA, 19 nt, Homo sapiens
gcugcaaaccuuacaaagu

SEQ ID NO: 874729 - RNA, 19 nt, Homo sapiens
cuacaggcacaaauacauu

SEQ ID NO: 874730 - RNA, 19 nt, Homo sapiens
guaagaguucccuauuuca

SEQ ID NO: 874731 - RNA, 19 nt, Homo sapiens
guggagggcaggugaauuc

SEQ ID NO: 874732 - RNA, 19 nt, Homo sapiens
uaauauccgugaagaagcu

SEQ ID NO: 874733 - RNA, 19 nt, Homo sapiens
ccauuucucaucaaacuau

SEQ ID NO: 874734 - RNA, 19 nt, Homo sapiens
gcagacaaaacuaaaacua

SEQ ID NO: 874735 - RNA, 19 nt, Homo sapiens
uuuacaaggugcugaguuc

SEQ ID NO: 874736 - RNA, 19 nt, Homo sapiens
ugaaucacacguguaacua

SEQ ID NO: 874737 - RNA, 19 nt, Homo sapiens
auacaggccaaacugauuu

SEQ ID NO: 874738 - RNA, 19 nt, Homo sapiens
cuaacugcacugaaauaaa

SEQ ID NO: 874739 - RNA, 19 nt, Homo sapiens
uaagagccauccauuuuca

SEQ ID NO: 874740 - RNA, 19 nt, Homo sapiens
gauccuauuacaaguagug

SEQ ID NO: 874741 - RNA, 19 nt, Homo sapiens
ucagugauauaucgauacu

SEQ ID NO: 874742 - RNA, 19 nt, Homo sapiens
gaggaugccuuggcuucca

SEQ ID NO: 874743 - RNA, 19 nt, Homo sapiens
aggaagacgugaccauugg

SEQ ID NO: 874744 - RNA, 19 nt, Homo sapiens
ucacacguguaacuacuac

SEQ ID NO: 874745 - RNA, 19 nt, Homo sapiens
ccaaacugauuuucuugaa

SEQ ID NO: 874746 - RNA, 19 nt, Homo sapiens
ugccaacggugaagaacug

SEQ ID NO: 874747 - RNA, 19 nt, Homo sapiens
gagcagcagacaaaacuaa

SEQ ID NO: 874748 - RNA, 19 nt, Homo sapiens
aagcuaagagccauccauu

SEQ ID NO: 874749 - RNA, 19 nt, Homo sapiens
gaaucacacguguaacuac

SEQ ID NO: 874750 - RNA, 19 nt, Homo sapiens
aagaguucccuauuucauu

SEQ ID NO: 874751 - RNA, 19 nt, Homo sapiens
uaagaguucccuauuucau

SEQ ID NO: 874752 - RNA, 19 nt, Homo sapiens
gcuacaggcacaaauacau

SEQ ID NO: 874753 - RNA, 19 nt, Homo sapiens
ccuauuacaaguaguggaa

SEQ ID NO: 874754 - RNA, 19 nt, Homo sapiens
gccacccuaucauucugua

SEQ ID NO: 874755 - RNA, 19 nt, Homo sapiens
ggcgaaagggcgugugguu

SEQ ID NO: 874756 - RNA, 19 nt, Homo sapiens
aauacaggccaaacugauu

SEQ ID NO: 874757 - RNA, 19 nt, Homo sapiens
ggcagaaagcucuauagca

SEQ ID NO: 874758 - RNA, 19 nt, Homo sapiens
gaagcuaagagccauccau

SEQ ID NO: 874759 - RNA, 19 nt, Homo sapiens
uccagaugcccuuauauug

SEQ ID NO: 874760 - RNA, 19 nt, Homo sapiens
ccugcagucugguggaaga

SEQ ID NO: 874761 - RNA, 19 nt, Homo sapiens
cauuccauuucucaucaaa

SEQ ID NO: 874762 - RNA, 19 nt, Homo sapiens
agauaaaccauaccaugug

SEQ ID NO: 874763 - RNA, 19 nt, Homo sapiens
gacugguucuuccuugauc

SEQ ID NO: 874764 - RNA, 19 nt, Homo sapiens
ccaaggcaaagaccagaug

SEQ ID NO: 874765 - RNA, 19 nt, Homo sapiens
ggaagacgugaccauugga

SEQ ID NO: 874766 - RNA, 19 nt, Homo sapiens
gcccuuucauucagaccuu

SEQ ID NO: 874767 - RNA, 19 nt, Homo sapiens
gguucuuccuugauccuau

SEQ ID NO: 874768 - RNA, 19 nt, Homo sapiens
gauacuucccuggguuuga

SEQ ID NO: 874769 - RNA, 19 nt, Homo sapiens
cuccagaugcccuuauauu

SEQ ID NO: 874770 - RNA, 19 nt, Homo sapiens
gcccagaucccagcaugug

SEQ ID NO: 874771 - RNA, 19 nt, Homo sapiens
cgccugaggaagauacuuu

SEQ ID NO: 874772 - RNA, 19 nt, Homo sapiens
cccaaaggcagcugaaagu

SEQ ID NO: 874773 - RNA, 19 nt, Homo sapiens
gguggugcccuuccagcuu

SEQ ID NO: 874774 - RNA, 19 nt, Homo sapiens
gcccuuauauuggaaucuc

SEQ ID NO: 874775 - RNA, 19 nt, Homo sapiens
agaggaagacgugaccauu

SEQ ID NO: 874776 - RNA, 19 nt, Homo sapiens
aaucacacguguaacuacu

SEQ ID NO: 874777 - RNA, 19 nt, Homo sapiens
ccaaaggcagcugaaagug

SEQ ID NO: 874778 - RNA, 19 nt, Homo sapiens
gagauuucaaaguucaguu

SEQ ID NO: 874779 - RNA, 19 nt, Homo sapiens
uccgagauuucaaaguuca

SEQ ID NO: 874780 - RNA, 19 nt, Homo sapiens
ccuuccagcuuggcagaaa

SEQ ID NO: 874781 - RNA, 19 nt, Homo sapiens
cagccacccuaucauucug

SEQ ID NO: 874782 - RNA, 19 nt, Homo sapiens
gaacauagauuacaagaag

SEQ ID NO: 874783 - RNA, 19 nt, Homo sapiens
ggaagaagaugugaaauuu

SEQ ID NO: 874784 - RNA, 19 nt, Homo sapiens
guauaagccucuuucauua

SEQ ID NO: 874785 - RNA, 19 nt, Homo sapiens
caaguaaucugcccucauu

SEQ ID NO: 874786 - RNA, 19 nt, Homo sapiens
cagaaugucuccucucuuu

SEQ ID NO: 874787 - RNA, 19 nt, Homo sapiens
cuaaugguguuaugaguua

SEQ ID NO: 874788 - RNA, 19 nt, Homo sapiens
gaucauuccuuauucuuug

SEQ ID NO: 874789 - RNA, 19 nt, Homo sapiens
gagguuagcuuguuucagu

SEQ ID NO: 874790 - RNA, 19 nt, Homo sapiens
guugagaguucuuucauuu

SEQ ID NO: 874791 - RNA, 19 nt, Homo sapiens
gauaagauguugguuuguu

SEQ ID NO: 874792 - RNA, 19 nt, Homo sapiens
gaugugaaauuuccuugaa

SEQ ID NO: 874793 - RNA, 19 nt, Homo sapiens
cacaguagcuuuauuguag

SEQ ID NO: 874794 - RNA, 19 nt, Homo sapiens
gcacauaccaugaucacuu

SEQ ID NO: 874795 - RNA, 19 nt, Homo sapiens
gaagauuccaggcucauuu

SEQ ID NO: 874796 - RNA, 19 nt, Homo sapiens
acuguuaggugcuauguua

SEQ ID NO: 874797 - RNA, 19 nt, Homo sapiens
cacauaccaugaucacuua

SEQ ID NO: 874798 - RNA, 19 nt, Homo sapiens
caacuaaggauuaaggaaa

SEQ ID NO: 874799 - RNA, 19 nt, Homo sapiens
ggaagcauuugaucucguu

SEQ ID NO: 874800 - RNA, 19 nt, Homo sapiens
aaaccaaugcucagauuua

SEQ ID NO: 874801 - RNA, 19 nt, Homo sapiens
gaacucagggagaaccaua

SEQ ID NO: 874802 - RNA, 19 nt, Homo sapiens
aaagaagacugcugcaugu

SEQ ID NO: 874803 - RNA, 19 nt, Homo sapiens
gaauaccuguaacuaauag

SEQ ID NO: 874804 - RNA, 19 nt, Homo sapiens
gcucagauuuaucaguauu

SEQ ID NO: 874805 - RNA, 19 nt, Homo sapiens
gaagacugcugcaugugau

SEQ ID NO: 874806 - RNA, 19 nt, Homo sapiens
gguagagguuagcuuguuu

SEQ ID NO: 874807 - RNA, 19 nt, Homo sapiens
gcaaagaacauagauuaca

SEQ ID NO: 874808 - RNA, 19 nt, Homo sapiens
gaacuccugaccucaagua

SEQ ID NO: 874809 - RNA, 19 nt, Homo sapiens
ucagggagaaccauaauaa

SEQ ID NO: 874810 - RNA, 19 nt, Homo sapiens
ggaaagcaaagaacauaga

SEQ ID NO: 874811 - RNA, 19 nt, Homo sapiens
uguauaagccucuuucauu

SEQ ID NO: 874812 - RNA, 19 nt, Homo sapiens
gguauagaauaucugacua

SEQ ID NO: 874813 - RNA, 19 nt, Homo sapiens
cauuugaucucguuaggaa

SEQ ID NO: 874814 - RNA, 19 nt, Homo sapiens
ccaaccaucuaaauuacuu

SEQ ID NO: 874815 - RNA, 19 nt, Homo sapiens
cuggaucccuaacauauaa

SEQ ID NO: 874816 - RNA, 19 nt, Homo sapiens
ggaauuauuggauccuaaa

SEQ ID NO: 874817 - RNA, 19 nt, Homo sapiens
gggaauuauuggauccuaa

SEQ ID NO: 874818 - RNA, 19 nt, Homo sapiens
gguuauauuuguuggagaa

SEQ ID NO: 874819 - RNA, 19 nt, Homo sapiens
uguaggagaugcaauggaa

SEQ ID NO: 874820 - RNA, 19 nt, Homo sapiens
gacaggauuucaccauguu

SEQ ID NO: 874821 - RNA, 19 nt, Homo sapiens
uguccaaccaucuaaauua

SEQ ID NO: 874822 - RNA, 19 nt, Homo sapiens
gcgcccagccuguuccuua

SEQ ID NO: 874823 - RNA, 19 nt, Homo sapiens
uaaugaagguacacaaagu

SEQ ID NO: 874824 - RNA, 19 nt, Homo sapiens
uuagccagaucauuccuua

SEQ ID NO: 874825 - RNA, 19 nt, Homo sapiens
gacuauagcccauuaaucu

SEQ ID NO: 874826 - RNA, 19 nt, Homo sapiens
gaagaagaugugaaauuuc

SEQ ID NO: 874827 - RNA, 19 nt, Homo sapiens
ugauuuaucuaccuuguca

SEQ ID NO: 874828 - RNA, 19 nt, Homo sapiens
guacuggcuuacucuaaug

SEQ ID NO: 874829 - RNA, 19 nt, Homo sapiens
ccaaugcucagauuuauca

SEQ ID NO: 874830 - RNA, 19 nt, Homo sapiens
ugauguuucuggacaguaa

SEQ ID NO: 874831 - RNA, 19 nt, Homo sapiens
uaacuaauagguagagguu

SEQ ID NO: 874832 - RNA, 19 nt, Homo sapiens
gaucaguaaugaagguaca

SEQ ID NO: 874833 - RNA, 19 nt, Homo sapiens
uugauaagauguugguuug

SEQ ID NO: 874834 - RNA, 19 nt, Homo sapiens
caagaagccacucaagguu

SEQ ID NO: 874835 - RNA, 19 nt, Homo sapiens
gaaagcaaagaacauagau

SEQ ID NO: 874836 - RNA, 19 nt, Homo sapiens
guuaggugcuauguuaauu

SEQ ID NO: 874837 - RNA, 19 nt, Homo sapiens
ggagaaccauaauaaaaga

SEQ ID NO: 874838 - RNA, 19 nt, Homo sapiens
caucaugagggaauuauug

SEQ ID NO: 874839 - RNA, 19 nt, Homo sapiens
acaguaaguuugcuuuauc

SEQ ID NO: 874840 - RNA, 19 nt, Homo sapiens
ucacaguagcuuuauugua

SEQ ID NO: 874841 - RNA, 19 nt, Homo sapiens
ccgaagugcuggaauuaca

SEQ ID NO: 874842 - RNA, 19 nt, Homo sapiens
ccaucuaaauuacuucugu

SEQ ID NO: 874843 - RNA, 19 nt, Homo sapiens
gaauaucugacuauaccaa

SEQ ID NO: 874844 - RNA, 19 nt, Homo sapiens
uagaauaucugacuauacc

SEQ ID NO: 874845 - RNA, 19 nt, Homo sapiens
ggugagagauguuaaaagu

SEQ ID NO: 874846 - RNA, 19 nt, Homo sapiens
agagaugguuagccagaaa

SEQ ID NO: 874847 - RNA, 19 nt, Homo sapiens
agaagccacucaagguuau

SEQ ID NO: 874848 - RNA, 19 nt, Homo sapiens
aagaagccacucaagguua

SEQ ID NO: 874849 - RNA, 19 nt, Homo sapiens
uaggaaagcaaagaacaua

SEQ ID NO: 874850 - RNA, 19 nt, Homo sapiens
gggauacuguuaggugcua

SEQ ID NO: 874851 - RNA, 19 nt, Homo sapiens
augcucagauuuaucagua

SEQ ID NO: 874852 - RNA, 19 nt, Homo sapiens
agacggaguuucgcucuug

SEQ ID NO: 874853 - RNA, 19 nt, Homo sapiens
gaagaugugaaauuuccuu

SEQ ID NO: 874854 - RNA, 19 nt, Homo sapiens
ggacuauagcccauuaauc

SEQ ID NO: 874855 - RNA, 19 nt, Homo sapiens
ccagauggcuauugaucag

SEQ ID NO: 874856 - RNA, 19 nt, Homo sapiens
agacaggauuucaccaugu

SEQ ID NO: 874857 - RNA, 19 nt, Homo sapiens
caccacgcccugcuaauuu

SEQ ID NO: 874858 - RNA, 19 nt, Homo sapiens
aacaagaacucagggagaa

SEQ ID NO: 874859 - RNA, 19 nt, Homo sapiens
guacuuuggguagcuauaa

SEQ ID NO: 874860 - RNA, 19 nt, Homo sapiens
ugugaaauuuccuugaaga

SEQ ID NO: 874861 - RNA, 19 nt, Homo sapiens
gcaggucagcggacuauag

SEQ ID NO: 874862 - RNA, 19 nt, Homo sapiens
uauaaacuuuggacuugga

SEQ ID NO: 874863 - RNA, 19 nt, Homo sapiens
ccacucaagguuauauuug

SEQ ID NO: 874864 - RNA, 19 nt, Homo sapiens
ggugcuauguuaauucagu

SEQ ID NO: 874865 - RNA, 19 nt, Homo sapiens
caguaaguuugcuuuauca

SEQ ID NO: 874866 - RNA, 19 nt, Homo sapiens
aauacggcauguuuaggua

SEQ ID NO: 874867 - RNA, 19 nt, Homo sapiens
uggagaagaugcuguggau

SEQ ID NO: 874868 - RNA, 19 nt, Homo sapiens
gugcuauguuaauucagua

SEQ ID NO: 874869 - RNA, 19 nt, Homo sapiens
ccagaucauuccuuauucu

SEQ ID NO: 874870 - RNA, 19 nt, Homo sapiens
gccagaucauuccuuauuc

SEQ ID NO: 874871 - RNA, 19 nt, Homo sapiens
gugaauuuguguaaugcuu

SEQ ID NO: 874872 - RNA, 19 nt, Homo sapiens
guaaugaagguacacaaag

SEQ ID NO: 874873 - RNA, 19 nt, Homo sapiens
guagcuuuauuguagcauu

SEQ ID NO: 874874 - RNA, 19 nt, Homo sapiens
ccaccacgcccugcuaauu

SEQ ID NO: 874875 - RNA, 19 nt, Homo sapiens
cuauaccaacuaaggauua

SEQ ID NO: 874876 - RNA, 19 nt, Homo sapiens
ucaccauuaucuccuauuc

SEQ ID NO: 874877 - RNA, 19 nt, Homo sapiens
ggcagaaugucuccucucu

SEQ ID NO: 874878 - RNA, 19 nt, Homo sapiens
uuaauucaguagcauagga

SEQ ID NO: 874879 - RNA, 19 nt, Homo sapiens
uaggugcuauguuaauuca

SEQ ID NO: 874880 - RNA, 19 nt, Homo sapiens
gcugugcgggauacuguua

SEQ ID NO: 874881 - RNA, 19 nt, Homo sapiens
cuacuggaucccuaacaua

SEQ ID NO: 874882 - RNA, 19 nt, Homo sapiens
gaacauaaguaaugaaagg

SEQ ID NO: 874883 - RNA, 19 nt, Homo sapiens
gaacugagcaauggauuua

SEQ ID NO: 874884 - RNA, 19 nt, Homo sapiens
uauagcagcugaucuguaa

SEQ ID NO: 874885 - RNA, 19 nt, Homo sapiens
cuucaaagauguagccuua

SEQ ID NO: 874886 - RNA, 19 nt, Homo sapiens
gggaggaaauguuacagua

SEQ ID NO: 874887 - RNA, 19 nt, Homo sapiens
uaagauugcucccuaaaug

SEQ ID NO: 874888 - RNA, 19 nt, Homo sapiens
gaacaagucuaggccuaaa

SEQ ID NO: 874889 - RNA, 19 nt, Homo sapiens
gagagaaucauuucaguuu

SEQ ID NO: 874890 - RNA, 19 nt, Homo sapiens
ggacacacccugaagcuuu

SEQ ID NO: 874891 - RNA, 19 nt, Homo sapiens
caaggauucuucauguaua

SEQ ID NO: 874892 - RNA, 19 nt, Homo sapiens
ccacugagauguaguuuag

SEQ ID NO: 874893 - RNA, 19 nt, Homo sapiens
uaacgucuuuccucuagua

SEQ ID NO: 874894 - RNA, 19 nt, Homo sapiens
gaaggucaauuucucugaa

SEQ ID NO: 874895 - RNA, 19 nt, Homo sapiens
gccaaacgaucucaaagaa

SEQ ID NO: 874896 - RNA, 19 nt, Homo sapiens
cgauuuguguccuuucuua

SEQ ID NO: 874897 - RNA, 19 nt, Homo sapiens
gagugaagaucuuguaauc

SEQ ID NO: 874898 - RNA, 19 nt, Homo sapiens
gagauguaguuuagucaaa

SEQ ID NO: 874899 - RNA, 19 nt, Homo sapiens
gaaagaacaaggcaaggaa

SEQ ID NO: 874900 - RNA, 19 nt, Homo sapiens
ucacuaaguuuccugaguu

SEQ ID NO: 874901 - RNA, 19 nt, Homo sapiens
gggcugaguuauuacaauu

SEQ ID NO: 874902 - RNA, 19 nt, Homo sapiens
gcaauggauuuaagaaugg

SEQ ID NO: 874903 - RNA, 19 nt, Homo sapiens
ccacaaacugcaagaauaa

SEQ ID NO: 874904 - RNA, 19 nt, Homo sapiens
gcaacgccauagcaaauau

SEQ ID NO: 874905 - RNA, 19 nt, Homo sapiens
uuaugaaccuuccugauuu

SEQ ID NO: 874906 - RNA, 19 nt, Homo sapiens
gaaaugaagacgcgaagga

SEQ ID NO: 874907 - RNA, 19 nt, Homo sapiens
acaaauugcugaugccuau

SEQ ID NO: 874908 - RNA, 19 nt, Homo sapiens
ggaaaccagucaccaucaa

SEQ ID NO: 874909 - RNA, 19 nt, Homo sapiens
caaauauugugaccaugaa

SEQ ID NO: 874910 - RNA, 19 nt, Homo sapiens
caaacgaucucaaagaaaa

SEQ ID NO: 874911 - RNA, 19 nt, Homo sapiens
aagccaagauagugaauuu

SEQ ID NO: 874912 - RNA, 19 nt, Homo sapiens
aaaaguaggucaauucgua

SEQ ID NO: 874913 - RNA, 19 nt, Homo sapiens
gauuauaugcaguuccuua

SEQ ID NO: 874914 - RNA, 19 nt, Homo sapiens
ugagaauuguucacacuuu

SEQ ID NO: 874915 - RNA, 19 nt, Homo sapiens
gaagagacacuuggaacaa

SEQ ID NO: 874916 - RNA, 19 nt, Homo sapiens
cccacaaacugcaagaaua

SEQ ID NO: 874917 - RNA, 19 nt, Homo sapiens
ugaagggugugaaauguau

SEQ ID NO: 874918 - RNA, 19 nt, Homo sapiens
aaagucaaguucaccaauu

SEQ ID NO: 874919 - RNA, 19 nt, Homo sapiens
guaauuuguuccucuuaga

SEQ ID NO: 874920 - RNA, 19 nt, Homo sapiens
gucauuggcuuugucauuu

SEQ ID NO: 874921 - RNA, 19 nt, Homo sapiens
gagccguauuucucacuua

SEQ ID NO: 874922 - RNA, 19 nt, Homo sapiens
ugaagaagaugaucaagac

SEQ ID NO: 874923 - RNA, 19 nt, Homo sapiens
uuuguucacuugagucuua

SEQ ID NO: 874924 - RNA, 19 nt, Homo sapiens
gaacaaggcaaggaaggaa

SEQ ID NO: 874925 - RNA, 19 nt, Homo sapiens
auucugggcugaguuauua

SEQ ID NO: 874926 - RNA, 19 nt, Homo sapiens
gagaauuguucacacuuuc

SEQ ID NO: 874927 - RNA, 19 nt, Homo sapiens
ccacugcuguucaagaguu

SEQ ID NO: 874928 - RNA, 19 nt, Homo sapiens
gaaaaggggcaucugcuua

SEQ ID NO: 874929 - RNA, 19 nt, Homo sapiens
caaacugauuuaagccaaa

SEQ ID NO: 874930 - RNA, 19 nt, Homo sapiens
ucauuggcuuugucauuua

SEQ ID NO: 874931 - RNA, 19 nt, Homo sapiens
ggaccaggaugcaaaauga

SEQ ID NO: 874932 - RNA, 19 nt, Homo sapiens
ugagagcucuguuaaaggu

SEQ ID NO: 874933 - RNA, 19 nt, Homo sapiens
uauaagaagugagagagaa

SEQ ID NO: 874934 - RNA, 19 nt, Homo sapiens
gcucuacuuugaucuucua

SEQ ID NO: 874935 - RNA, 19 nt, Homo sapiens
ggacagauaaagcuacuca

SEQ ID NO: 874936 - RNA, 19 nt, Homo sapiens
ggauugaugggacagauaa

SEQ ID NO: 874937 - RNA, 19 nt, Homo sapiens
ccucuaagaugcccaagau

SEQ ID NO: 874938 - RNA, 19 nt, Homo sapiens
gugaagaucuuguaaucag

SEQ ID NO: 874939 - RNA, 19 nt, Homo sapiens
ggucaauucguaacaguuu

SEQ ID NO: 874940 - RNA, 19 nt, Homo sapiens
gggcaucugcuuauaagaa

SEQ ID NO: 874941 - RNA, 19 nt, Homo sapiens
ucaaagauguagccuuagu

SEQ ID NO: 874942 - RNA, 19 nt, Homo sapiens
guaccaaggucaagaugag

SEQ ID NO: 874943 - RNA, 19 nt, Homo sapiens
aaacgcagccuucaaagau

SEQ ID NO: 874944 - RNA, 19 nt, Homo sapiens
cuacuuugaucuucuacaa

SEQ ID NO: 874945 - RNA, 19 nt, Homo sapiens
ccagaugaaucaacuuaag

SEQ ID NO: 874946 - RNA, 19 nt, Homo sapiens
cuaccaguauucauaaaug

SEQ ID NO: 874947 - RNA, 19 nt, Homo sapiens
cgucuuuccucuaguacua

SEQ ID NO: 874948 - RNA, 19 nt, Homo sapiens
gugcuaagcucaggauauc

SEQ ID NO: 874949 - RNA, 19 nt, Homo sapiens
acaagaggcuccagugagu

SEQ ID NO: 874950 - RNA, 19 nt, Homo sapiens
ucucaucugucaaaugcua

SEQ ID NO: 874951 - RNA, 19 nt, Homo sapiens
guccugggcuauugaagaa

SEQ ID NO: 874952 - RNA, 19 nt, Homo sapiens
ggaaagaacaaggcaagga

SEQ ID NO: 874953 - RNA, 19 nt, Homo sapiens
gcugaugccuauucuucuu

SEQ ID NO: 874954 - RNA, 19 nt, Homo sapiens
gauaugaagccaccagugu

SEQ ID NO: 874955 - RNA, 19 nt, Homo sapiens
ggugugaguuccuuagcuu

SEQ ID NO: 874956 - RNA, 19 nt, Homo sapiens
agaaaccacugcuguucaa

SEQ ID NO: 874957 - RNA, 19 nt, Homo sapiens
aggagaaacugaagaagau

SEQ ID NO: 874958 - RNA, 19 nt, Homo sapiens
ccaaggauucuucauguau

SEQ ID NO: 874959 - RNA, 19 nt, Homo sapiens
guaauccacugagauguag

SEQ ID NO: 874960 - RNA, 19 nt, Homo sapiens
cacuaaguuuccugaguua

SEQ ID NO: 874961 - RNA, 19 nt, Homo sapiens
ucauuucaguuuccauuga

SEQ ID NO: 874962 - RNA, 19 nt, Homo sapiens
gaaaucagagcuuggaaac

SEQ ID NO: 874963 - RNA, 19 nt, Homo sapiens
cuucacagcucaugauaag

SEQ ID NO: 874964 - RNA, 19 nt, Homo sapiens
cagcugaucuguaaaugac

SEQ ID NO: 874965 - RNA, 19 nt, Homo sapiens
cuaugcacgugauacauuu

SEQ ID NO: 874966 - RNA, 19 nt, Homo sapiens
gccgagaccaugcuuauug

SEQ ID NO: 874967 - RNA, 19 nt, Homo sapiens
gcaggagaauugcuugaac

SEQ ID NO: 874968 - RNA, 19 nt, Homo sapiens
gaagggaggaaauguuaca

SEQ ID NO: 874969 - RNA, 19 nt, Homo sapiens
ggaacaagucuaggccuaa

SEQ ID NO: 874970 - RNA, 19 nt, Homo sapiens
ggaagagacacuuggaaca

SEQ ID NO: 874971 - RNA, 19 nt, Homo sapiens
gccaagauagugaauuuau

SEQ ID NO: 874972 - RNA, 19 nt, Homo sapiens
ucacuugagucuuaagagu

SEQ ID NO: 874973 - RNA, 19 nt, Homo sapiens
uaagaugcccaagauauga

SEQ ID NO: 874974 - RNA, 19 nt, Homo sapiens
aaucagagcuuggaaacca

SEQ ID NO: 874975 - RNA, 19 nt, Homo sapiens
ugacagcauucugaaauca

SEQ ID NO: 874976 - RNA, 19 nt, Homo sapiens
gagaaacugaagaagauga

SEQ ID NO: 874977 - RNA, 19 nt, Homo sapiens
gucaauucguaacaguuua

SEQ ID NO: 874978 - RNA, 19 nt, Homo sapiens
cugaagggaggaaauguua

SEQ ID NO: 874979 - RNA, 19 nt, Homo sapiens
gaauuguucacacuuucua

SEQ ID NO: 874980 - RNA, 19 nt, Homo sapiens
ccaccaguguccaacagaa

SEQ ID NO: 874981 - RNA, 19 nt, Homo sapiens
ccagaaugcagcuguggua

SEQ ID NO: 874982 - RNA, 19 nt, Homo sapiens
ggagaaggaugcugaguug

SEQ ID NO: 874983 - RNA, 19 nt, Homo sapiens
ggaagaggaugaagaaugg

SEQ ID NO: 874984 - RNA, 19 nt, Homo sapiens
uaagaaagcugaacuugag

SEQ ID NO: 874985 - RNA, 19 nt, Homo sapiens
gaagaugaaugaggagaug

SEQ ID NO: 874986 - RNA, 19 nt, Homo sapiens
gaagaccgaugggauguuc

SEQ ID NO: 874987 - RNA, 19 nt, Homo sapiens
gugaagagguggagcugaa

SEQ ID NO: 874988 - RNA, 19 nt, Homo sapiens
gggcagugcuggagacaug

SEQ ID NO: 874989 - RNA, 19 nt, Homo sapiens
ggacauaagugaggaugag

SEQ ID NO: 874990 - RNA, 19 nt, Homo sapiens
uggagaagaucgccgagua

SEQ ID NO: 874991 - RNA, 19 nt, Homo sapiens
guaagaaagcugaacuuga

SEQ ID NO: 874992 - RNA, 19 nt, Homo sapiens
gggaagaggaugaagaaug

SEQ ID NO: 874993 - RNA, 19 nt, Homo sapiens
ggcagaacauugagaagau

SEQ ID NO: 874994 - RNA, 19 nt, Homo sapiens
gcagaacauugagaagaug

SEQ ID NO: 874995 - RNA, 19 nt, Homo sapiens
ugaggaagaccguaagaaa

SEQ ID NO: 874996 - RNA, 19 nt, Homo sapiens
gaagagguggagcugaauu

SEQ ID NO: 874997 - RNA, 19 nt, Homo sapiens
gagaagaaccuggguccuu

SEQ ID NO: 874998 - RNA, 19 nt, Homo sapiens
cagccacacucgauuugaa

SEQ ID NO: 874999 - RNA, 19 nt, Homo sapiens
gaagaucgccgaguaugag

SEQ ID NO: 875000 - RNA, 19 nt, Homo sapiens
gaugaccgcugggagacaa

SEQ ID NO: 875001 - RNA, 19 nt, Homo sapiens
ccgaugggauguucaagga

SEQ ID NO: 875002 - RNA, 19 nt, Homo sapiens
gcaggcagaacauugagaa

SEQ ID NO: 875003 - RNA, 19 nt, Homo sapiens
gaauucacauccuccaaaa

SEQ ID NO: 875004 - RNA, 19 nt, Homo sapiens
uaagugaggaugaggaaga

SEQ ID NO: 875005 - RNA, 19 nt, Homo sapiens
ugaaugaggagauggagaa

SEQ ID NO: 875006 - RNA, 19 nt, Homo sapiens
gcaguggagucggagaaga

SEQ ID NO: 875007 - RNA, 19 nt, Homo sapiens
gcucuucuguacugucaug

SEQ ID NO: 875008 - RNA, 19 nt, Homo sapiens
ggagaucgagguggaagaa

SEQ ID NO: 875009 - RNA, 19 nt, Homo sapiens
ggagaagaucgccgaguau

SEQ ID NO: 875010 - RNA, 19 nt, Homo sapiens
gaggaagaccguaagaaag

SEQ ID NO: 875011 - RNA, 19 nt, Homo sapiens
gaagaaugggaggacauaa

SEQ ID NO: 875012 - RNA, 19 nt, Homo sapiens
gagaagaucgccgaguaug

SEQ ID NO: 875013 - RNA, 19 nt, Homo sapiens
cucaaucucugaccguaaa

SEQ ID NO: 875014 - RNA, 19 nt, Homo sapiens
ugaagaaugggaggacaua

SEQ ID NO: 875015 - RNA, 19 nt, Homo sapiens
cgagugggaugccgagaag

SEQ ID NO: 875016 - RNA, 19 nt, Homo sapiens
gaacauugagaagaugaau

SEQ ID NO: 875017 - RNA, 19 nt, Homo sapiens
cggaguaccugcgcuggaa

SEQ ID NO: 875018 - RNA, 19 nt, Homo sapiens
ugaaaucaaaggaggagaa

SEQ ID NO: 875019 - RNA, 19 nt, Homo sapiens
aaucaaaggaggagaagga

SEQ ID NO: 875020 - RNA, 19 nt, Homo sapiens
accaggagauugaggaaga

SEQ ID NO: 875021 - RNA, 19 nt, Homo sapiens
ccacccagccagcgaaaug

SEQ ID NO: 875022 - RNA, 19 nt, Homo sapiens
agaauucacauccuccaaa

SEQ ID NO: 875023 - RNA, 19 nt, Homo sapiens
gagaagaccgaugggaugu

SEQ ID NO: 875024 - RNA, 19 nt, Homo sapiens
ggaagcaggagagggagaa

SEQ ID NO: 875025 - RNA, 19 nt, Homo sapiens
augaggagauggagaagau

SEQ ID NO: 875026 - RNA, 19 nt, Homo sapiens
gaaaucaaaggaggagaag

SEQ ID NO: 875027 - RNA, 19 nt, Homo sapiens
ccaauaaagaauucacauc

SEQ ID NO: 875028 - RNA, 19 nt, Homo sapiens
ggaggaaccagcccaagac

SEQ ID NO: 875029 - RNA, 19 nt, Homo sapiens
cccagucccugcccaugaa

SEQ ID NO: 875030 - RNA, 19 nt, Homo sapiens
gaugcugaguuggacaaga

SEQ ID NO: 875031 - RNA, 19 nt, Homo sapiens
cccaugcucuucuguacug

SEQ ID NO: 875032 - RNA, 19 nt, Homo sapiens
ggccuacagugaccaugau

SEQ ID NO: 875033 - RNA, 19 nt, Homo sapiens
ucagugcugcgucuagauu

SEQ ID NO: 875034 - RNA, 19 nt, Homo sapiens
cauaagugaggaugaggaa

SEQ ID NO: 875035 - RNA, 19 nt, Homo sapiens
ggaagaccguaagaaagcu

SEQ ID NO: 875036 - RNA, 19 nt, Homo sapiens
gggccuacagugaccauga

SEQ ID NO: 875037 - RNA, 19 nt, Homo sapiens
agaaggaugcugaguugga

SEQ ID NO: 875038 - RNA, 19 nt, Homo sapiens
ccucagugcugcgucuaga

SEQ ID NO: 875039 - RNA, 19 nt, Homo sapiens
gcucaguggagaaggagaa

SEQ ID NO: 875040 - RNA, 19 nt, Homo sapiens
agaaggugaugaggaggaa

SEQ ID NO: 875041 - RNA, 19 nt, Homo sapiens
aaugggaggacauaaguga

SEQ ID NO: 875042 - RNA, 19 nt, Homo sapiens
gaaccaucccaccgcuaug

SEQ ID NO: 875043 - RNA, 19 nt, Homo sapiens
gcgagugggaugccgagaa

SEQ ID NO: 875044 - RNA, 19 nt, Homo sapiens
agaagaucgccgaguauga

SEQ ID NO: 875045 - RNA, 19 nt, Homo sapiens
gagcuggagacaccucaau

SEQ ID NO: 875046 - RNA, 19 nt, Homo sapiens
ccaaggagacacccaugca

SEQ ID NO: 875047 - RNA, 19 nt, Homo sapiens
ugaaccaucccaccgcuau

SEQ ID NO: 875048 - RNA, 19 nt, Homo sapiens
cguaagaaagcugaacuug

SEQ ID NO: 875049 - RNA, 19 nt, Homo sapiens
gaaugggaggacauaagug

SEQ ID NO: 875050 - RNA, 19 nt, Homo sapiens
agaaugggaggacauaagu

SEQ ID NO: 875051 - RNA, 19 nt, Homo sapiens
gcagccacacucgauuuga

SEQ ID NO: 875052 - RNA, 19 nt, Homo sapiens
caguggagucggagaagaa

SEQ ID NO: 875053 - RNA, 19 nt, Homo sapiens
cagaacauugagaagauga

SEQ ID NO: 875054 - RNA, 19 nt, Homo sapiens
ucucugaccguaaauccaa

SEQ ID NO: 875055 - RNA, 19 nt, Homo sapiens
gaucgagguggaagaaggu

SEQ ID NO: 875056 - RNA, 19 nt, Homo sapiens
uagcgcagcccaugcucuu

SEQ ID NO: 875057 - RNA, 19 nt, Homo sapiens
ggcaggaccuuuacuguua

SEQ ID NO: 875058 - RNA, 19 nt, Homo sapiens
ggagagaagugcugaaugu

SEQ ID NO: 875059 - RNA, 19 nt, Homo sapiens
gagaugcucaggaaaguua

SEQ ID NO: 875060 - RNA, 19 nt, Homo sapiens
ggaaauugguuuugacuuu

SEQ ID NO: 875061 - RNA, 19 nt, Homo sapiens
cagcagcucugguuucuau

SEQ ID NO: 875062 - RNA, 19 nt, Homo sapiens
ucacuuggauucccacauu

SEQ ID NO: 875063 - RNA, 19 nt, Homo sapiens
gaccaacagugaugucuug

SEQ ID NO: 875064 - RNA, 19 nt, Homo sapiens
caaaggcguuggaaggaaa

SEQ ID NO: 875065 - RNA, 19 nt, Homo sapiens
ggaaaucuuugccauugau

SEQ ID NO: 875066 - RNA, 19 nt, Homo sapiens
agacauggcuggaaagauc

SEQ ID NO: 875067 - RNA, 19 nt, Homo sapiens
gaacaggaacagaaaugaa

SEQ ID NO: 875068 - RNA, 19 nt, Homo sapiens
ggaagaagacagacggaaa

SEQ ID NO: 875069 - RNA, 19 nt, Homo sapiens
ucaagcaccuuccagaaug

SEQ ID NO: 875070 - RNA, 19 nt, Homo sapiens
gaagaagccaccagcagaa

SEQ ID NO: 875071 - RNA, 19 nt, Homo sapiens
gcagcucugguuucuauua

SEQ ID NO: 875072 - RNA, 19 nt, Homo sapiens
gggacacgcugaacaggaa

SEQ ID NO: 875073 - RNA, 19 nt, Homo sapiens
gaacgauguuaaaguugga

SEQ ID NO: 875074 - RNA, 19 nt, Homo sapiens
cgaccgauuuaaccucaua

SEQ ID NO: 875075 - RNA, 19 nt, Homo sapiens
agaaggagauggagagcaa

SEQ ID NO: 875076 - RNA, 19 nt, Homo sapiens
cagcagaucuccgggauuc

SEQ ID NO: 875077 - RNA, 19 nt, Homo sapiens
caggaaaguuauuugaguu

SEQ ID NO: 875078 - RNA, 19 nt, Homo sapiens
ugaagaagcccagugauga

SEQ ID NO: 875079 - RNA, 19 nt, Homo sapiens
gcacagcccgcucacgauu

SEQ ID NO: 875080 - RNA, 19 nt, Homo sapiens
guacgaaggccacgugaau

SEQ ID NO: 875081 - RNA, 19 nt, Homo sapiens
cagcaucacuguucgucaa

SEQ ID NO: 875082 - RNA, 19 nt, Homo sapiens
aaaagucgcuggcagagua

SEQ ID NO: 875083 - RNA, 19 nt, Homo sapiens
ucaggaaaguuauuugagu

SEQ ID NO: 875084 - RNA, 19 nt, Homo sapiens
gggaaaucuuugccauuga

SEQ ID NO: 875085 - RNA, 19 nt, Homo sapiens
gggccucgcugaaucacuu

SEQ ID NO: 875086 - RNA, 19 nt, Homo sapiens
caucuuccaugcuacgaaa

SEQ ID NO: 875087 - RNA, 19 nt, Homo sapiens
ggauucugcuguuauuauc

SEQ ID NO: 875088 - RNA, 19 nt, Homo sapiens
ccacccgccuguuucauga

SEQ ID NO: 875089 - RNA, 19 nt, Homo sapiens
gcaucacuguucgucaaua

SEQ ID NO: 875090 - RNA, 19 nt, Homo sapiens
agugaacgauguuaaaguu

SEQ ID NO: 875091 - RNA, 19 nt, Homo sapiens
gcucaggaaaguuauuuga

SEQ ID NO: 875092 - RNA, 19 nt, Homo sapiens
cuucagacauggcuggaaa

SEQ ID NO: 875093 - RNA, 19 nt, Homo sapiens
gaucugcguuguggaaauc

SEQ ID NO: 875094 - RNA, 19 nt, Homo sapiens
ccaagagcccauugaagaa

SEQ ID NO: 875095 - RNA, 19 nt, Homo sapiens
ccagagccauguggauuug

SEQ ID NO: 875096 - RNA, 19 nt, Homo sapiens
uggcuccucugcuguuuaa

SEQ ID NO: 875097 - RNA, 19 nt, Homo sapiens
cugaauauccaagcaaaua

SEQ ID NO: 875098 - RNA, 19 nt, Homo sapiens
cgugagauguuuauucagu

SEQ ID NO: 875099 - RNA, 19 nt, Homo sapiens
ucuaaggacugaagauugg

SEQ ID NO: 875100 - RNA, 19 nt, Homo sapiens
gggcaggaccuuuacuguu

SEQ ID NO: 875101 - RNA, 19 nt, Homo sapiens
caauagucacccaggaaua

SEQ ID NO: 875102 - RNA, 19 nt, Homo sapiens
gggauucugcuguuauuau

SEQ ID NO: 875103 - RNA, 19 nt, Homo sapiens
gcacgaggaagaaggaauc

SEQ ID NO: 875104 - RNA, 19 nt, Homo sapiens
caccaauuacugccauuua

SEQ ID NO: 875105 - RNA, 19 nt, Homo sapiens
gaagaagacagacggaaaa

SEQ ID NO: 875106 - RNA, 19 nt, Homo sapiens
gacaguucgugagauguuu

SEQ ID NO: 875107 - RNA, 19 nt, Homo sapiens
gaagaagcccagugaugag

SEQ ID NO: 875108 - RNA, 19 nt, Homo sapiens
uccaagagcccauugaaga

SEQ ID NO: 875109 - RNA, 19 nt, Homo sapiens
guguggagaugcucaggaa

SEQ ID NO: 875110 - RNA, 19 nt, Homo sapiens
ggagauggagagcaagaga

SEQ ID NO: 875111 - RNA, 19 nt, Homo sapiens
cgucaaaggaaauugguuu

SEQ ID NO: 875112 - RNA, 19 nt, Homo sapiens
caagcaccuuccagaaugu

SEQ ID NO: 875113 - RNA, 19 nt, Homo sapiens
cgaagugcguaaggcagua

SEQ ID NO: 875114 - RNA, 19 nt, Homo sapiens
ggaagggacacgcugaaca

SEQ ID NO: 875115 - RNA, 19 nt, Homo sapiens
gugaugagacggugagaug

SEQ ID NO: 875116 - RNA, 19 nt, Homo sapiens
gccauguggauuugacuua

SEQ ID NO: 875117 - RNA, 19 nt, Homo sapiens
gaagggacacgcugaacag

SEQ ID NO: 875118 - RNA, 19 nt, Homo sapiens
cuauuacggugacuugaau

SEQ ID NO: 875119 - RNA, 19 nt, Homo sapiens
aaacuuggccuucucaaac

SEQ ID NO: 875120 - RNA, 19 nt, Homo sapiens
uaaacuuggccuucucaaa

SEQ ID NO: 875121 - RNA, 19 nt, Homo sapiens
gugcggauccuccaagaug

SEQ ID NO: 875122 - RNA, 19 nt, Homo sapiens
caucacuguucgucaauag

SEQ ID NO: 875123 - RNA, 19 nt, Homo sapiens
ccaaguaugguaucaucaa

SEQ ID NO: 875124 - RNA, 19 nt, Homo sapiens
uggcagauaccaacaguga

SEQ ID NO: 875125 - RNA, 19 nt, Homo sapiens
cagaguagaagacgacaug

SEQ ID NO: 875126 - RNA, 19 nt, Homo sapiens
caggaacagaaaugaauaa

SEQ ID NO: 875127 - RNA, 19 nt, Homo sapiens
ccuaucggcugcuacaaca

SEQ ID NO: 875128 - RNA, 19 nt, Homo sapiens
gcaggaccuuuacuguuac

SEQ ID NO: 875129 - RNA, 19 nt, Homo sapiens
ggggaaaucuuugccauug

SEQ ID NO: 875130 - RNA, 19 nt, Homo sapiens
cuaacuggcugacgcuaca

SEQ ID NO: 875131 - RNA, 19 nt, Homo sapiens
ugagauguuuauucagugu

SEQ ID NO: 875132 - RNA, 19 nt, Homo sapiens
gcacagcccagagccaugu

SEQ ID NO: 875133 - RNA, 19 nt, Homo sapiens
cgacaguucgugagauguu

SEQ ID NO: 875134 - RNA, 19 nt, Homo sapiens
ccacggugaugacgagucu

SEQ ID NO: 875135 - RNA, 19 nt, Homo sapiens
gagcgacaguucgugagau

SEQ ID NO: 875136 - RNA, 19 nt, Homo sapiens
ccgggauucugcuguuauu

SEQ ID NO: 875137 - RNA, 19 nt, Homo sapiens
ggaguuuggaauccuuaaa

SEQ ID NO: 875138 - RNA, 19 nt, Homo sapiens
gauuugacuuacgggagua

SEQ ID NO: 875139 - RNA, 19 nt, Homo sapiens
acaggaacagaaaugaaua

SEQ ID NO: 875140 - RNA, 19 nt, Homo sapiens
ccaaaacgcauccaccuaa

SEQ ID NO: 875141 - RNA, 19 nt, Homo sapiens
ucaucaaccugcaaagucu

SEQ ID NO: 875142 - RNA, 19 nt, Homo sapiens
guucaagcaccuuccagaa

SEQ ID NO: 875143 - RNA, 19 nt, Homo sapiens
gaagaaagaccugcauccu

SEQ ID NO: 875144 - RNA, 19 nt, Homo sapiens
gcugagagagcuuggaagu

SEQ ID NO: 875145 - RNA, 19 nt, Homo sapiens
gagagaagugcugaauguu

SEQ ID NO: 875146 - RNA, 19 nt, Homo sapiens
gcccagagccauguggauu

SEQ ID NO: 875147 - RNA, 19 nt, Homo sapiens
caggacugcuacacgagaa

SEQ ID NO: 875148 - RNA, 19 nt, Homo sapiens
gaaggccacgugaaugagu

SEQ ID NO: 875149 - RNA, 19 nt, Homo sapiens
gaauauccaagcaaauaac

SEQ ID NO: 875150 - RNA, 19 nt, Homo sapiens
gcacgaaaaccucuacuuc

SEQ ID NO: 875151 - RNA, 19 nt, Homo sapiens
caaguaugguaucaucaac

SEQ ID NO: 875152 - RNA, 19 nt, Homo sapiens
gccaggaugggauuuaaug

SEQ ID NO: 875153 - RNA, 19 nt, Homo sapiens
ggagcgacaguucgugaga

SEQ ID NO: 875154 - RNA, 19 nt, Homo sapiens
uggaucuucuuacaugcua

SEQ ID NO: 875155 - RNA, 19 nt, Homo sapiens
uuuggaauccuuaaacuug

SEQ ID NO: 875156 - RNA, 19 nt, Homo sapiens
gcuccucugcuguuuaaug

SEQ ID NO: 875157 - RNA, 19 nt, Homo sapiens
gacaagcuauaccuaauua

SEQ ID NO: 875158 - RNA, 19 nt, Homo sapiens
ggagagagcugaggauuuc

SEQ ID NO: 875159 - RNA, 19 nt, Homo sapiens
ggugaucaguguuuacuua

SEQ ID NO: 875160 - RNA, 19 nt, Homo sapiens
gaucaguguuuacuuauug

SEQ ID NO: 875161 - RNA, 19 nt, Homo sapiens
caaaauaacuucccacauu

SEQ ID NO: 875162 - RNA, 19 nt, Homo sapiens
gaaaagauguggccauuau

SEQ ID NO: 875163 - RNA, 19 nt, Homo sapiens
gaacauaaggccaauaauc

SEQ ID NO: 875164 - RNA, 19 nt, Homo sapiens
gaaauuaccaaguggguuu

SEQ ID NO: 875165 - RNA, 19 nt, Homo sapiens
gauugcagcuuggcuauuu

SEQ ID NO: 875166 - RNA, 19 nt, Homo sapiens
gagcagagccuguaaacga

SEQ ID NO: 875167 - RNA, 19 nt, Homo sapiens
cauacaaucugcuuucuug

SEQ ID NO: 875168 - RNA, 19 nt, Homo sapiens
gauacuaacuagaccuuug

SEQ ID NO: 875169 - RNA, 19 nt, Homo sapiens
gagaacauaaggccaauaa

SEQ ID NO: 875170 - RNA, 19 nt, Homo sapiens
gagauauucuuccauuuca

SEQ ID NO: 875171 - RNA, 19 nt, Homo sapiens
gggaagcauuucauggaua

SEQ ID NO: 875172 - RNA, 19 nt, Homo sapiens
caauggagaucagaauauu

SEQ ID NO: 875173 - RNA, 19 nt, Homo sapiens
ggaaacuucugacuuugga

SEQ ID NO: 875174 - RNA, 19 nt, Homo sapiens
aaacagauaccgagauauu

SEQ ID NO: 875175 - RNA, 19 nt, Homo sapiens
aaagauguggccauuauua

SEQ ID NO: 875176 - RNA, 19 nt, Homo sapiens
gcaggaauuuauggcuuua

SEQ ID NO: 875177 - RNA, 19 nt, Homo sapiens
ggaagcauuucauggauag

SEQ ID NO: 875178 - RNA, 19 nt, Homo sapiens
uaacuugccucuuacucuu

SEQ ID NO: 875179 - RNA, 19 nt, Homo sapiens
gaaggagcaguaucacuuu

SEQ ID NO: 875180 - RNA, 19 nt, Homo sapiens
caauagauaugaguguuug

SEQ ID NO: 875181 - RNA, 19 nt, Homo sapiens
gaaucugccuggugaguuc

SEQ ID NO: 875182 - RNA, 19 nt, Homo sapiens
agacagccaucaaggauug

SEQ ID NO: 875183 - RNA, 19 nt, Homo sapiens
caaccaagcaacagagaaa

SEQ ID NO: 875184 - RNA, 19 nt, Homo sapiens
gcucagauucggccauuaa

SEQ ID NO: 875185 - RNA, 19 nt, Homo sapiens
aaacacaccuagaucaaag

SEQ ID NO: 875186 - RNA, 19 nt, Homo sapiens
uacuuagucugcuuuguua

SEQ ID NO: 875187 - RNA, 19 nt, Homo sapiens
ggacuaacuuuggacacaa

SEQ ID NO: 875188 - RNA, 19 nt, Homo sapiens
uauaggacuuugccucgua

SEQ ID NO: 875189 - RNA, 19 nt, Homo sapiens
gaagggcaauaucauuugg

SEQ ID NO: 875190 - RNA, 19 nt, Homo sapiens
gacuuugccucguacaauu

SEQ ID NO: 875191 - RNA, 19 nt, Homo sapiens
cagagccuguaaacgauua

SEQ ID NO: 875192 - RNA, 19 nt, Homo sapiens
acagaugucuauucauguu

SEQ ID NO: 875193 - RNA, 19 nt, Homo sapiens
caaaugagagaacaacguu

SEQ ID NO: 875194 - RNA, 19 nt, Homo sapiens
cgaaggagcaguaucacuu

SEQ ID NO: 875195 - RNA, 19 nt, Homo sapiens
gauauaguggcccaaauga

SEQ ID NO: 875196 - RNA, 19 nt, Homo sapiens
cagauucggccauuaauau

SEQ ID NO: 875197 - RNA, 19 nt, Homo sapiens
aagcagaagacuugaauuu

SEQ ID NO: 875198 - RNA, 19 nt, Homo sapiens
uuacagagcccaauaaagg

SEQ ID NO: 875199 - RNA, 19 nt, Homo sapiens
aaucugcuuucuugguuua

SEQ ID NO: 875200 - RNA, 19 nt, Homo sapiens
aaacgaaggagcaguauca

SEQ ID NO: 875201 - RNA, 19 nt, Homo sapiens
ggauauaguggcccaaaug

SEQ ID NO: 875202 - RNA, 19 nt, Homo sapiens
gauaucaugcaggaauuua

SEQ ID NO: 875203 - RNA, 19 nt, Homo sapiens
gcauuugaauaacccaguu

SEQ ID NO: 875204 - RNA, 19 nt, Homo sapiens
guuacgauauugugcuuga

SEQ ID NO: 875205 - RNA, 19 nt, Homo sapiens
aaacagcagcguaugauau

SEQ ID NO: 875206 - RNA, 19 nt, Homo sapiens
gcagacagccaucaaggau

SEQ ID NO: 875207 - RNA, 19 nt, Homo sapiens
accuuuaacuugccucuua

SEQ ID NO: 875208 - RNA, 19 nt, Homo sapiens
uaucccacccuaacacuua

SEQ ID NO: 875209 - RNA, 19 nt, Homo sapiens
caauaaucaugaccucuuc

SEQ ID NO: 875210 - RNA, 19 nt, Homo sapiens
ggauuacagagcccaauaa

SEQ ID NO: 875211 - RNA, 19 nt, Homo sapiens
ugagggaaaugacucugaa

SEQ ID NO: 875212 - RNA, 19 nt, Homo sapiens
gugacaagcuauaccuaau

SEQ ID NO: 875213 - RNA, 19 nt, Homo sapiens
acaaucugcuuucuugguu

SEQ ID NO: 875214 - RNA, 19 nt, Homo sapiens
ggugacaagcuauaccuaa

SEQ ID NO: 875215 - RNA, 19 nt, Homo sapiens
ugguaucucucauguuuga

SEQ ID NO: 875216 - RNA, 19 nt, Homo sapiens
gauuacagagcccaauaaa

SEQ ID NO: 875217 - RNA, 19 nt, Homo sapiens
gaagggcuuugcuaugcau

SEQ ID NO: 875218 - RNA, 19 nt, Homo sapiens
guuugcaccuccucauaaa

SEQ ID NO: 875219 - RNA, 19 nt, Homo sapiens
uauaguggcccaaaugaga

SEQ ID NO: 875220 - RNA, 19 nt, Homo sapiens
gaguguuuguacaguuuaa

SEQ ID NO: 875221 - RNA, 19 nt, Homo sapiens
cccuaacacuuaacauauu

SEQ ID NO: 875222 - RNA, 19 nt, Homo sapiens
ggacacaaauuggcuucca

SEQ ID NO: 875223 - RNA, 19 nt, Homo sapiens
gggauuacagagcccaaua

SEQ ID NO: 875224 - RNA, 19 nt, Homo sapiens
cgagauauucuuccauuuc

SEQ ID NO: 875225 - RNA, 19 nt, Homo sapiens
guucaacucugggaaucaa

SEQ ID NO: 875226 - RNA, 19 nt, Homo sapiens
ggacuuugccucguacaau

SEQ ID NO: 875227 - RNA, 19 nt, Homo sapiens
gaaacuuccauauucuguu

SEQ ID NO: 875228 - RNA, 19 nt, Homo sapiens
cacccuaacacuuaacaua

SEQ ID NO: 875229 - RNA, 19 nt, Homo sapiens
uuauugaucuugcuagaca

SEQ ID NO: 875230 - RNA, 19 nt, Homo sapiens
agacuucuguugccucuca

SEQ ID NO: 875231 - RNA, 19 nt, Homo sapiens
uucggaaacuucugacuuu

SEQ ID NO: 875232 - RNA, 19 nt, Homo sapiens
caacaucauggauauagug

SEQ ID NO: 875233 - RNA, 19 nt, Homo sapiens
gaauuucccacauaaugau

SEQ ID NO: 875234 - RNA, 19 nt, Homo sapiens
ugacaagcuauaccuaauu

SEQ ID NO: 875235 - RNA, 19 nt, Homo sapiens
ucauacugcugccuuccua

SEQ ID NO: 875236 - RNA, 19 nt, Homo sapiens
ccaauaaucaugaccucuu

SEQ ID NO: 875237 - RNA, 19 nt, Homo sapiens
ccucauaaagaacauguuu

SEQ ID NO: 875238 - RNA, 19 nt, Homo sapiens
gguuugcaccuccucauaa

SEQ ID NO: 875239 - RNA, 19 nt, Homo sapiens
aacaacaugucuucaccua

SEQ ID NO: 875240 - RNA, 19 nt, Homo sapiens
gcaaguauuaccuuuaacu

SEQ ID NO: 875241 - RNA, 19 nt, Homo sapiens
gaacaguccaaaacuaaaa

SEQ ID NO: 875242 - RNA, 19 nt, Homo sapiens
caaucugcuuucuugguuu

SEQ ID NO: 875243 - RNA, 19 nt, Homo sapiens
caaaauuguuucugaagga

SEQ ID NO: 875244 - RNA, 19 nt, Homo sapiens
gcugaaugaguauauuuga

SEQ ID NO: 875245 - RNA, 19 nt, Homo sapiens
ucaauggagaucagaauau

SEQ ID NO: 875246 - RNA, 19 nt, Homo sapiens
uuccagaguuccauuaaau

SEQ ID NO: 875247 - RNA, 19 nt, Homo sapiens
cauauuacuuagucugcuu

SEQ ID NO: 875248 - RNA, 19 nt, Homo sapiens
ugccaugccugaguucuuu

SEQ ID NO: 875249 - RNA, 19 nt, Homo sapiens
ggauuuccaggacuuugua

SEQ ID NO: 875250 - RNA, 19 nt, Homo sapiens
ggaauuuauggcuuuagaa

SEQ ID NO: 875251 - RNA, 19 nt, Homo sapiens
ucagauucggccauuaaua

SEQ ID NO: 875252 - RNA, 19 nt, Homo sapiens
gaaucaaccaagcaacaga

SEQ ID NO: 875253 - RNA, 19 nt, Homo sapiens
gcagugaucccagcaugug

SEQ ID NO: 875254 - RNA, 19 nt, Homo sapiens
ccagaguuccauuaaauca

SEQ ID NO: 875255 - RNA, 19 nt, Homo sapiens
gaaaacacaccuagaucaa

SEQ ID NO: 875256 - RNA, 19 nt, Homo sapiens
uuacuuagucugcuuuguu

SEQ ID NO: 875257 - RNA, 19 nt, Homo sapiens
gaacugagcucgcauacua

SEQ ID NO: 875258 - RNA, 19 nt, Homo sapiens
gaagauggcugcacaguca

SEQ ID NO: 875259 - RNA, 19 nt, Homo sapiens
aaugagcgcuuuacuaaua

SEQ ID NO: 875260 - RNA, 19 nt, Homo sapiens
ggauggaccuaucacaaua

SEQ ID NO: 875261 - RNA, 19 nt, Homo sapiens
gauaacagaugagaagaaa

SEQ ID NO: 875262 - RNA, 19 nt, Homo sapiens
ggacgaggccuacccauaa

SEQ ID NO: 875263 - RNA, 19 nt, Homo sapiens
acaauaggcuguggacuua

SEQ ID NO: 875264 - RNA, 19 nt, Homo sapiens
caacacaucuguaaauaac

SEQ ID NO: 875265 - RNA, 19 nt, Homo sapiens
ccaauuggaugcauauaug

SEQ ID NO: 875266 - RNA, 19 nt, Homo sapiens
ccaccaagaugucucuaaa

SEQ ID NO: 875267 - RNA, 19 nt, Homo sapiens
cgaaugggcuuaagaagag

SEQ ID NO: 875268 - RNA, 19 nt, Homo sapiens
caagaugucucuaaaugag

SEQ ID NO: 875269 - RNA, 19 nt, Homo sapiens
gccaccagcuugugcauuu

SEQ ID NO: 875270 - RNA, 19 nt, Homo sapiens
cuaauaugcugaagaacaa

SEQ ID NO: 875271 - RNA, 19 nt, Homo sapiens
gaggagcacuggcgucugu

SEQ ID NO: 875272 - RNA, 19 nt, Homo sapiens
gucaacacaucuguaaaua

SEQ ID NO: 875273 - RNA, 19 nt, Homo sapiens
uaacagaugagaagaaauc

SEQ ID NO: 875274 - RNA, 19 nt, Homo sapiens
uaaagcagcgccuggguaa

SEQ ID NO: 875275 - RNA, 19 nt, Homo sapiens
ugaguuggaugccuacaug

SEQ ID NO: 875276 - RNA, 19 nt, Homo sapiens
gcauauaugucgaaaacaa

SEQ ID NO: 875277 - RNA, 19 nt, Homo sapiens
gcauuuaguguguuccuuu

SEQ ID NO: 875278 - RNA, 19 nt, Homo sapiens
gcucgcauacuaccgcuua

SEQ ID NO: 875279 - RNA, 19 nt, Homo sapiens
gcagacagaucccgaaacc

SEQ ID NO: 875280 - RNA, 19 nt, Homo sapiens
gggcuucgaugcagcaaca

SEQ ID NO: 875281 - RNA, 19 nt, Homo sapiens
agacagaucccgaaaccaa

SEQ ID NO: 875282 - RNA, 19 nt, Homo sapiens
aagaagaggugguguucga

SEQ ID NO: 875283 - RNA, 19 nt, Homo sapiens
ccaccagcuugugcauuua

SEQ ID NO: 875284 - RNA, 19 nt, Homo sapiens
acaccuggaugcugaguug

SEQ ID NO: 875285 - RNA, 19 nt, Homo sapiens
ccaaggagcagcuggacaa

SEQ ID NO: 875286 - RNA, 19 nt, Homo sapiens
ccaagaugucucuaaauga

SEQ ID NO: 875287 - RNA, 19 nt, Homo sapiens
accaagaugucucuaaaug

SEQ ID NO: 875288 - RNA, 19 nt, Homo sapiens
gacgaggccuacccauaau

SEQ ID NO: 875289 - RNA, 19 nt, Homo sapiens
gcagcuggacaaccaauug

SEQ ID NO: 875290 - RNA, 19 nt, Homo sapiens
caaccgcccaucuagcuaa

SEQ ID NO: 875291 - RNA, 19 nt, Homo sapiens
acaaccaauuggaugcaua

SEQ ID NO: 875292 - RNA, 19 nt, Homo sapiens
ugagauaacagaugagaag

SEQ ID NO: 875293 - RNA, 19 nt, Homo sapiens
cgccgaaaguugugcuaaa

SEQ ID NO: 875294 - RNA, 19 nt, Homo sapiens
caaccaauuggaugcauau

SEQ ID NO: 875295 - RNA, 19 nt, Homo sapiens
ccgaaugggcuuaagaaga

SEQ ID NO: 875296 - RNA, 19 nt, Homo sapiens
cccagcagauggagaauag

SEQ ID NO: 875297 - RNA, 19 nt, Homo sapiens
uuagucaacacaucuguaa

SEQ ID NO: 875298 - RNA, 19 nt, Homo sapiens
ggaugcauauaugucgaaa

SEQ ID NO: 875299 - RNA, 19 nt, Homo sapiens
gcuugugcauuuagugugu

SEQ ID NO: 875300 - RNA, 19 nt, Homo sapiens
gaugcuggauggaccuauc

SEQ ID NO: 875301 - RNA, 19 nt, Homo sapiens
uaaccaaccgcccaucuag

SEQ ID NO: 875302 - RNA, 19 nt, Homo sapiens
gccaccagaacccuacuua

SEQ ID NO: 875303 - RNA, 19 nt, Homo sapiens
aaacagccgacgccaguga

SEQ ID NO: 875304 - RNA, 19 nt, Homo sapiens
ggagcacuggcgucuguuu

SEQ ID NO: 875305 - RNA, 19 nt, Homo sapiens
gcagacgaaaggcaggaaa

SEQ ID NO: 875306 - RNA, 19 nt, Homo sapiens
gcgcagacagaucccgaaa

SEQ ID NO: 875307 - RNA, 19 nt, Homo sapiens
aagcagcgccuggguaaga

SEQ ID NO: 875308 - RNA, 19 nt, Homo sapiens
caggcagcauuaaaacuua

SEQ ID NO: 875309 - RNA, 19 nt, Homo sapiens
gagauaacagaugagaaga

SEQ ID NO: 875310 - RNA, 19 nt, Homo sapiens
agucaacacaucuguaaau

SEQ ID NO: 875311 - RNA, 19 nt, Homo sapiens
cuagacagccaaccagcaa

SEQ ID NO: 875312 - RNA, 19 nt, Homo sapiens
cuaaccaaccgcccaucua

SEQ ID NO: 875313 - RNA, 19 nt, Homo sapiens
agacggaucggccgacuag

SEQ ID NO: 875314 - RNA, 19 nt, Homo sapiens
acuaauaugcugaagaaca

SEQ ID NO: 875315 - RNA, 19 nt, Homo sapiens
gccgaaaguugugcuaaaa

SEQ ID NO: 875316 - RNA, 19 nt, Homo sapiens
acacaucuguaaauaaccu

SEQ ID NO: 875317 - RNA, 19 nt, Homo sapiens
gagcacuggcgucuguuuc

SEQ ID NO: 875318 - RNA, 19 nt, Homo sapiens
aggagcagcuggacaacca

SEQ ID NO: 875319 - RNA, 19 nt, Homo sapiens
gccagugccagaaacagaa

SEQ ID NO: 875320 - RNA, 19 nt, Homo sapiens
cgacgccagugaauauucg

SEQ ID NO: 875321 - RNA, 19 nt, Homo sapiens
cagccgacgccagugaaua

SEQ ID NO: 875322 - RNA, 19 nt, Homo sapiens
gaaacccuuuuguccuuug

SEQ ID NO: 875323 - RNA, 19 nt, Homo sapiens
guuagucaacacaucugua

SEQ ID NO: 875324 - RNA, 19 nt, Homo sapiens
gcccagcagauggagaaua

SEQ ID NO: 875325 - RNA, 19 nt, Homo sapiens
uggauggaccuaucacaau

SEQ ID NO: 875326 - RNA, 19 nt, Homo sapiens
gaucccgaaaccaaugauu

SEQ ID NO: 875327 - RNA, 19 nt, Homo sapiens
caauuggaugcauauaugu

SEQ ID NO: 875328 - RNA, 19 nt, Homo sapiens
ggacaaccaauuggaugca

SEQ ID NO: 875329 - RNA, 19 nt, Homo sapiens
ccuagggcguggagcuaug

SEQ ID NO: 875330 - RNA, 19 nt, Homo sapiens
acgguuaggccgacccaua

SEQ ID NO: 875331 - RNA, 19 nt, Homo sapiens
gcagcaacaacagcagcua

SEQ ID NO: 875332 - RNA, 19 nt, Homo sapiens
gcacagucagcgccgaaag

SEQ ID NO: 875333 - RNA, 19 nt, Homo sapiens
agauaacagaugagaagaa

SEQ ID NO: 875334 - RNA, 19 nt, Homo sapiens
gacagaucccgaaaccaau

SEQ ID NO: 875335 - RNA, 19 nt, Homo sapiens
gacaaccaauuggaugcau

SEQ ID NO: 875336 - RNA, 19 nt, Homo sapiens
agucagcgccgaaaguugu

SEQ ID NO: 875337 - RNA, 19 nt, Homo sapiens
accuugagauaacagauga

SEQ ID NO: 875338 - RNA, 19 nt, Homo sapiens
gcccuguauugaccaagga

SEQ ID NO: 875339 - RNA, 19 nt, Homo sapiens
aggacgaggccuacccaua

SEQ ID NO: 875340 - RNA, 19 nt, Homo sapiens
gcuagccagugccagaaac

SEQ ID NO: 875341 - RNA, 19 nt, Homo sapiens
gaagaaggcuuguauuaua

SEQ ID NO: 875342 - RNA, 19 nt, Homo sapiens
gaagagcgcuguagacuug

SEQ ID NO: 875343 - RNA, 19 nt, Homo sapiens
gaaucaggcugcugcauua

SEQ ID NO: 875344 - RNA, 19 nt, Homo sapiens
gaaagucaacucucuguua

SEQ ID NO: 875345 - RNA, 19 nt, Homo sapiens
gagagcaacugcaaauaaa

SEQ ID NO: 875346 - RNA, 19 nt, Homo sapiens
gcaaagccaugauacuuau

SEQ ID NO: 875347 - RNA, 19 nt, Homo sapiens
agaaggagcuuauagaaga

SEQ ID NO: 875348 - RNA, 19 nt, Homo sapiens
gcaagauuaugcuccguua

SEQ ID NO: 875349 - RNA, 19 nt, Homo sapiens
gaaauacggaagagcauua

SEQ ID NO: 875350 - RNA, 19 nt, Homo sapiens
ucaaaggccuauuauguuu

SEQ ID NO: 875351 - RNA, 19 nt, Homo sapiens
ccaugagucuucagaaaua

SEQ ID NO: 875352 - RNA, 19 nt, Homo sapiens
gaaaugaaauugguguguu

SEQ ID NO: 875353 - RNA, 19 nt, Homo sapiens
gagcacgcauuccagcuua

SEQ ID NO: 875354 - RNA, 19 nt, Homo sapiens
cagaagaaggcuuguauua

SEQ ID NO: 875355 - RNA, 19 nt, Homo sapiens
gagaagaagugaugaaacu

SEQ ID NO: 875356 - RNA, 19 nt, Homo sapiens
caacugauuugucuacaga

SEQ ID NO: 875357 - RNA, 19 nt, Homo sapiens
gaagaugaauccucaagag

SEQ ID NO: 875358 - RNA, 19 nt, Homo sapiens
aaacugcuaucuucaacua

SEQ ID NO: 875359 - RNA, 19 nt, Homo sapiens
gcaguuacacuuucacgua

SEQ ID NO: 875360 - RNA, 19 nt, Homo sapiens
gaagaugacacaauucuca

SEQ ID NO: 875361 - RNA, 19 nt, Homo sapiens
gcacuccaaucccguuaaa

SEQ ID NO: 875362 - RNA, 19 nt, Homo sapiens
aaagguguguucuucauaa

SEQ ID NO: 875363 - RNA, 19 nt, Homo sapiens
ccauuaaacugcuaucuuc

SEQ ID NO: 875364 - RNA, 19 nt, Homo sapiens
gaaggagcuuauagaagaa

SEQ ID NO: 875365 - RNA, 19 nt, Homo sapiens
gaauagcaauguuggaaag

SEQ ID NO: 875366 - RNA, 19 nt, Homo sapiens
cagcacaccuugaagaguu

SEQ ID NO: 875367 - RNA, 19 nt, Homo sapiens
ggaagagcauuacgauaca

SEQ ID NO: 875368 - RNA, 19 nt, Homo sapiens
ggaaggcucaugcggauuu

SEQ ID NO: 875369 - RNA, 19 nt, Homo sapiens
gcaguuuagugacuugaaa

SEQ ID NO: 875370 - RNA, 19 nt, Homo sapiens
cuaaugaaaucuugcaguu

SEQ ID NO: 875371 - RNA, 19 nt, Homo sapiens
caucaaaggccuauuaugu

SEQ ID NO: 875372 - RNA, 19 nt, Homo sapiens
ugaaagcgcuaaggucauu

SEQ ID NO: 875373 - RNA, 19 nt, Homo sapiens
gaagugcuguuguuucucu

SEQ ID NO: 875374 - RNA, 19 nt, Homo sapiens
ugaugaaacuccucaguau

SEQ ID NO: 875375 - RNA, 19 nt, Homo sapiens
caucuacaguguuuccuuu

SEQ ID NO: 875376 - RNA, 19 nt, Homo sapiens
gaaacuccucaguauauuu

SEQ ID NO: 875377 - RNA, 19 nt, Homo sapiens
gaugaaacuccucaguaua

SEQ ID NO: 875378 - RNA, 19 nt, Homo sapiens
gaauuuggccagccuaaga

SEQ ID NO: 875379 - RNA, 19 nt, Homo sapiens
agaacacuauguacaagua

SEQ ID NO: 875380 - RNA, 19 nt, Homo sapiens
guuaugaggcugcuaauga

SEQ ID NO: 875381 - RNA, 19 nt, Homo sapiens
cuacacgggucuaagauau

SEQ ID NO: 875382 - RNA, 19 nt, Homo sapiens
gacgagcuguugugcaauu

SEQ ID NO: 875383 - RNA, 19 nt, Homo sapiens
gggaauuguccacuacuua

SEQ ID NO: 875384 - RNA, 19 nt, Homo sapiens
ccaauaugcuuuccgaagu

SEQ ID NO: 875385 - RNA, 19 nt, Homo sapiens
ugagagcaacugcaaauaa

SEQ ID NO: 875386 - RNA, 19 nt, Homo sapiens
gaacugagcacgcauucca

SEQ ID NO: 875387 - RNA, 19 nt, Homo sapiens
uaugacaguugaucaagaa

SEQ ID NO: 875388 - RNA, 19 nt, Homo sapiens
aaaccaacaagcacauuua

SEQ ID NO: 875389 - RNA, 19 nt, Homo sapiens
caacucuacagcaagauua

SEQ ID NO: 875390 - RNA, 19 nt, Homo sapiens
cuuaaagcuuccacuauuu

SEQ ID NO: 875391 - RNA, 19 nt, Homo sapiens
gcccagaaugcaaauaaua

SEQ ID NO: 875392 - RNA, 19 nt, Homo sapiens
gacuuuauaugacaguuga

SEQ ID NO: 875393 - RNA, 19 nt, Homo sapiens
acuuaaagcuuccacuauu

SEQ ID NO: 875394 - RNA, 19 nt, Homo sapiens
gagcauuacgauacauuaa

SEQ ID NO: 875395 - RNA, 19 nt, Homo sapiens
gcuauguucuagaggguuu

SEQ ID NO: 875396 - RNA, 19 nt, Homo sapiens
guuacacuuucacguauuu

SEQ ID NO: 875397 - RNA, 19 nt, Homo sapiens
gaguacagcuagagagagu

SEQ ID NO: 875398 - RNA, 19 nt, Homo sapiens
agaagcagauggccuuguu

SEQ ID NO: 875399 - RNA, 19 nt, Homo sapiens
ugaaguaugucaagcuaca

SEQ ID NO: 875400 - RNA, 19 nt, Homo sapiens
acagacaaauuacgguuga

SEQ ID NO: 875401 - RNA, 19 nt, Homo sapiens
caucaaaucagacccaguu

SEQ ID NO: 875402 - RNA, 19 nt, Homo sapiens
aaagucaacucucuguuag

SEQ ID NO: 875403 - RNA, 19 nt, Homo sapiens
gagcagcacaccuugaaga

SEQ ID NO: 875404 - RNA, 19 nt, Homo sapiens
acagugggcucccuucaga

SEQ ID NO: 875405 - RNA, 19 nt, Homo sapiens
aagcuucagugcaggauuu

SEQ ID NO: 875406 - RNA, 19 nt, Homo sapiens
gcaaugccguucagugacu

SEQ ID NO: 875407 - RNA, 19 nt, Homo sapiens
ggaaagaaucaacguuauc

SEQ ID NO: 875408 - RNA, 19 nt, Homo sapiens
gaaacugugaauaagguaa

SEQ ID NO: 875409 - RNA, 19 nt, Homo sapiens
gugcuuagcuauguucuag

SEQ ID NO: 875410 - RNA, 19 nt, Homo sapiens
guauaucaguggaaacaca

SEQ ID NO: 875411 - RNA, 19 nt, Homo sapiens
acacggagccgguuuguuc

SEQ ID NO: 875412 - RNA, 19 nt, Homo sapiens
cagcaaugccguucaguga

SEQ ID NO: 875413 - RNA, 19 nt, Homo sapiens
ccagaaggagcuuauagaa

SEQ ID NO: 875414 - RNA, 19 nt, Homo sapiens
uagcaauguuggaaaguug

SEQ ID NO: 875415 - RNA, 19 nt, Homo sapiens
caauaugcuuuccgaagug

SEQ ID NO: 875416 - RNA, 19 nt, Homo sapiens
aagacgagcuguugugcaa

SEQ ID NO: 875417 - RNA, 19 nt, Homo sapiens
acacgggucuaagauauga

SEQ ID NO: 875418 - RNA, 19 nt, Homo sapiens
aaacuuaaagcuuccacua

SEQ ID NO: 875419 - RNA, 19 nt, Homo sapiens
gugaugaaacuccucagua

SEQ ID NO: 875420 - RNA, 19 nt, Homo sapiens
gaacugaaacgugaauuuu

SEQ ID NO: 875421 - RNA, 19 nt, Homo sapiens
caaaucagacccaguugug

SEQ ID NO: 875422 - RNA, 19 nt, Homo sapiens
ugaaacuccucaguauauu

SEQ ID NO: 875423 - RNA, 19 nt, Homo sapiens
uggcagaucuucauuacag

SEQ ID NO: 875424 - RNA, 19 nt, Homo sapiens
uuaugaggcugcuaaugaa

SEQ ID NO: 875425 - RNA, 19 nt, Homo sapiens
gcuguagacuugugcuuag

SEQ ID NO: 875426 - RNA, 19 nt, Homo sapiens
gaagugcuaacaucagaau

SEQ ID NO: 875427 - RNA, 19 nt, Homo sapiens
cacauuuacucccagcuuu

SEQ ID NO: 875428 - RNA, 19 nt, Homo sapiens
guagacuugugcuuagcua

SEQ ID NO: 875429 - RNA, 19 nt, Homo sapiens
ggcuauugauuacuauuug

SEQ ID NO: 875430 - RNA, 19 nt, Homo sapiens
uaauagagcagcacaccuu

SEQ ID NO: 875431 - RNA, 19 nt, Homo sapiens
ucggugcuuuguuucauua

SEQ ID NO: 875432 - RNA, 19 nt, Homo sapiens
uggaaagaaucaacguuau

SEQ ID NO: 875433 - RNA, 19 nt, Homo sapiens
aggagcagauugagaaaga

SEQ ID NO: 875434 - RNA, 19 nt, Homo sapiens
gagaccuccuguacaucua

SEQ ID NO: 875435 - RNA, 19 nt, Homo sapiens
gauauaauggugagaacug

SEQ ID NO: 875436 - RNA, 19 nt, Homo sapiens
gcuggcagaucuucauuac

SEQ ID NO: 875437 - RNA, 19 nt, Homo sapiens
ccagaugacauuacagguu

SEQ ID NO: 875438 - RNA, 19 nt, Homo sapiens
gcuacacgggucuaagaua

SEQ ID NO: 875439 - RNA, 19 nt, Homo sapiens
caguuacacuuucacguau

SEQ ID NO: 875440 - RNA, 19 nt, Homo sapiens
gaaagaaucaacguuaucg

SEQ ID NO: 875441 - RNA, 19 nt, Homo sapiens
gagaagacuuguuuaguau

SEQ ID NO: 875442 - RNA, 19 nt, Homo sapiens
ggaacgaccugacuuacuu

SEQ ID NO: 875443 - RNA, 19 nt, Homo sapiens
agagaagacuuguuuagua

SEQ ID NO: 875444 - RNA, 19 nt, Homo sapiens
cgaguaagauggaagauga

SEQ ID NO: 875445 - RNA, 19 nt, Homo sapiens
gcagacagcuggacuugag

SEQ ID NO: 875446 - RNA, 19 nt, Homo sapiens
ccaauaaugugaucagaca

SEQ ID NO: 875447 - RNA, 19 nt, Homo sapiens
gcaggcagcccaauaaugu

SEQ ID NO: 875448 - RNA, 19 nt, Homo sapiens
gauaaaugcaggcaagaaa

SEQ ID NO: 875449 - RNA, 19 nt, Homo sapiens
ugacuuacuugcacuguga

SEQ ID NO: 875450 - RNA, 19 nt, Homo sapiens
cagcauggcuugaacucuu

SEQ ID NO: 875451 - RNA, 19 nt, Homo sapiens
aagaaaggguaguuuggua

SEQ ID NO: 875452 - RNA, 19 nt, Homo sapiens
gcucauuaauuugggauuu

SEQ ID NO: 875453 - RNA, 19 nt, Homo sapiens
gagggaacgaccugacuua

SEQ ID NO: 875454 - RNA, 19 nt, Homo sapiens
gcagacagcgggcaggaaa

SEQ ID NO: 875455 - RNA, 19 nt, Homo sapiens
caaagugcccauugugauu

SEQ ID NO: 875456 - RNA, 19 nt, Homo sapiens
agacugggcuagcucugua

SEQ ID NO: 875457 - RNA, 19 nt, Homo sapiens
gugcaugucuccaucacuu

SEQ ID NO: 875458 - RNA, 19 nt, Homo sapiens
caguuuaucaugcucauua

SEQ ID NO: 875459 - RNA, 19 nt, Homo sapiens
caaaucuccucccaaagug

SEQ ID NO: 875460 - RNA, 19 nt, Homo sapiens
ggagagaagacuuguuuag

SEQ ID NO: 875461 - RNA, 19 nt, Homo sapiens
gagggaaagcggcgaguaa

SEQ ID NO: 875462 - RNA, 19 nt, Homo sapiens
ccaaaucuccucccaaagu

SEQ ID NO: 875463 - RNA, 19 nt, Homo sapiens
caagggcugucccaaguca

SEQ ID NO: 875464 - RNA, 19 nt, Homo sapiens
gaaagcggcgaguaagaug

SEQ ID NO: 875465 - RNA, 19 nt, Homo sapiens
ggaaagcggcgaguaagau

SEQ ID NO: 875466 - RNA, 19 nt, Homo sapiens
ucugggaaauucacuagaa

SEQ ID NO: 875467 - RNA, 19 nt, Homo sapiens
guacauuuccugugugcaa

SEQ ID NO: 875468 - RNA, 19 nt, Homo sapiens
gcaugucuccaucacuuaa

SEQ ID NO: 875469 - RNA, 19 nt, Homo sapiens
aaacagcgcagauaaaugc

SEQ ID NO: 875470 - RNA, 19 nt, Homo sapiens
ucaaacagcgcagauaaau

SEQ ID NO: 875471 - RNA, 19 nt, Homo sapiens
gcagugcuccaucuccauu

SEQ ID NO: 875472 - RNA, 19 nt, Homo sapiens
gagagaagacuuguuuagu

SEQ ID NO: 875473 - RNA, 19 nt, Homo sapiens
ugccagcaauaacaguuua

SEQ ID NO: 875474 - RNA, 19 nt, Homo sapiens
gacagcaggcagcccaaua

SEQ ID NO: 875475 - RNA, 19 nt, Homo sapiens
gaacgaccugacuuacuug

SEQ ID NO: 875476 - RNA, 19 nt, Homo sapiens
gaaacauuaaccaauagga

SEQ ID NO: 875477 - RNA, 19 nt, Homo sapiens
ccucguauguucagaaggu

SEQ ID NO: 875478 - RNA, 19 nt, Homo sapiens
gaaaggguaguuugguagu

SEQ ID NO: 875479 - RNA, 19 nt, Homo sapiens
ucaagaggcccaccagcaa

SEQ ID NO: 875480 - RNA, 19 nt, Homo sapiens
ccugguacauuuccugugu

SEQ ID NO: 875481 - RNA, 19 nt, Homo sapiens
uaaagccagugccagcaau

SEQ ID NO: 875482 - RNA, 19 nt, Homo sapiens
auccaaaucuccucccaaa

SEQ ID NO: 875483 - RNA, 19 nt, Homo sapiens
gauugcaucccugggcuua

SEQ ID NO: 875484 - RNA, 19 nt, Homo sapiens
ggagauagggaaagugaac

SEQ ID NO: 875485 - RNA, 19 nt, Homo sapiens
gggaaauucacuagaaaca

SEQ ID NO: 875486 - RNA, 19 nt, Homo sapiens
ccaaagugcccauugugau

SEQ ID NO: 875487 - RNA, 19 nt, Homo sapiens
ggucugcagugcuccaucu

SEQ ID NO: 875488 - RNA, 19 nt, Homo sapiens
gcagagugccagggaguga

SEQ ID NO: 875489 - RNA, 19 nt, Homo sapiens
gggaaagcggcgaguaaga

SEQ ID NO: 875490 - RNA, 19 nt, Homo sapiens
cuucaaacagcgcagauaa

SEQ ID NO: 875491 - RNA, 19 nt, Homo sapiens
ggagggaaagcggcgagua

SEQ ID NO: 875492 - RNA, 19 nt, Homo sapiens
caaacagcgcagauaaaug

SEQ ID NO: 875493 - RNA, 19 nt, Homo sapiens
acagcaggcagcccaauaa

SEQ ID NO: 875494 - RNA, 19 nt, Homo sapiens
agcauggcuugaacucuua

SEQ ID NO: 875495 - RNA, 19 nt, Homo sapiens
cugggaaauucacuagaaa

SEQ ID NO: 875496 - RNA, 19 nt, Homo sapiens
acggagagaagacuuguuu

SEQ ID NO: 875497 - RNA, 19 nt, Homo sapiens
ucccugggcuuagaaguga

SEQ ID NO: 875498 - RNA, 19 nt, Homo sapiens
ggaaauucacuagaaacau

SEQ ID NO: 875499 - RNA, 19 nt, Homo sapiens
ggcaggaaauccaaaucuc

SEQ ID NO: 875500 - RNA, 19 nt, Homo sapiens
guaaagccagugccagcaa

SEQ ID NO: 875501 - RNA, 19 nt, Homo sapiens
gcccaauaaugugaucaga

SEQ ID NO: 875502 - RNA, 19 nt, Homo sapiens
gugauuggcacaucgacaa

SEQ ID NO: 875503 - RNA, 19 nt, Homo sapiens
gggcaggaaauccaaaucu

SEQ ID NO: 875504 - RNA, 19 nt, Homo sapiens
cuuagcuucuguauuccua

SEQ ID NO: 875505 - RNA, 19 nt, Homo sapiens
cagauccgcauccucaaga

SEQ ID NO: 875506 - RNA, 19 nt, Homo sapiens
gcagcccaauaaugugauc

SEQ ID NO: 875507 - RNA, 19 nt, Homo sapiens
ugucccaagucaauggaaa

SEQ ID NO: 875508 - RNA, 19 nt, Homo sapiens
gaagugacggagagaagac

SEQ ID NO: 875509 - RNA, 19 nt, Homo sapiens
uaagaaaggguaguuuggu

SEQ ID NO: 875510 - RNA, 19 nt, Homo sapiens
ggucucaaggcuucaaaca

SEQ ID NO: 875511 - RNA, 19 nt, Homo sapiens
aaagccagugccagcaaua

SEQ ID NO: 875512 - RNA, 19 nt, Homo sapiens
cccaaagugcccauuguga

SEQ ID NO: 875513 - RNA, 19 nt, Homo sapiens
ggcccacccuuccagucaa

SEQ ID NO: 875514 - RNA, 19 nt, Homo sapiens
uugcaucccugggcuuaga

SEQ ID NO: 875515 - RNA, 19 nt, Homo sapiens
ugggagauagggaaaguga

SEQ ID NO: 875516 - RNA, 19 nt, Homo sapiens
ccgaggaggagcaggagaa

SEQ ID NO: 875517 - RNA, 19 nt, Homo sapiens
cggagagaagacuuguuua

SEQ ID NO: 875518 - RNA, 19 nt, Homo sapiens
gcgaguaagauggaagaug

SEQ ID NO: 875519 - RNA, 19 nt, Homo sapiens
gccagugccagcaauaaca

SEQ ID NO: 875520 - RNA, 19 nt, Homo sapiens
gcuucaaacagcgcagaua

SEQ ID NO: 875521 - RNA, 19 nt, Homo sapiens
ccaggacucugagccuucu

SEQ ID NO: 875522 - RNA, 19 nt, Homo sapiens
gggagggguuuuagugguu

SEQ ID NO: 875523 - RNA, 19 nt, Homo sapiens
gugccagcaauaacaguuu

SEQ ID NO: 875524 - RNA, 19 nt, Homo sapiens
gggaacgaccugacuuacu

SEQ ID NO: 875525 - RNA, 19 nt, Homo sapiens
gaacugagaucugcaacua

SEQ ID NO: 875526 - RNA, 19 nt, Homo sapiens
caaaugaacuugaaagguu

SEQ ID NO: 875527 - RNA, 19 nt, Homo sapiens
caaggaagcuaaagguuug

SEQ ID NO: 875528 - RNA, 19 nt, Homo sapiens
gaagaugugugcauuguag

SEQ ID NO: 875529 - RNA, 19 nt, Homo sapiens
ccauaacgcugaggaaaua

SEQ ID NO: 875530 - RNA, 19 nt, Homo sapiens
gaacagaucuaugaaugca

SEQ ID NO: 875531 - RNA, 19 nt, Homo sapiens
ggacaacacagaagugaaa

SEQ ID NO: 875532 - RNA, 19 nt, Homo sapiens
gguaguaaguccgguuaua

SEQ ID NO: 875533 - RNA, 19 nt, Homo sapiens
guacuuacgugccuucauc

SEQ ID NO: 875534 - RNA, 19 nt, Homo sapiens
gauggcagagacuuuauua

SEQ ID NO: 875535 - RNA, 19 nt, Homo sapiens
ggaaagcgauuuuguuugu

SEQ ID NO: 875536 - RNA, 19 nt, Homo sapiens
gaucuguucuucuacuuca

SEQ ID NO: 875537 - RNA, 19 nt, Homo sapiens
ugacagaaauguucaacca

SEQ ID NO: 875538 - RNA, 19 nt, Homo sapiens
ccaaggaagcuaaagguuu

SEQ ID NO: 875539 - RNA, 19 nt, Homo sapiens
gaggauggcagagacuuua

SEQ ID NO: 875540 - RNA, 19 nt, Homo sapiens
guaguaaguccgguuauaa

SEQ ID NO: 875541 - RNA, 19 nt, Homo sapiens
cagaggacuuugugcauug

SEQ ID NO: 875542 - RNA, 19 nt, Homo sapiens
uggaacagaucuaugaaug

SEQ ID NO: 875543 - RNA, 19 nt, Homo sapiens
uggauaagcuggaacagau

SEQ ID NO: 875544 - RNA, 19 nt, Homo sapiens
guaaguccgguuauaaauu

SEQ ID NO: 875545 - RNA, 19 nt, Homo sapiens
ggucuucgauaccauuaau

SEQ ID NO: 875546 - RNA, 19 nt, Homo sapiens
ggcagaggcugauaguaug

SEQ ID NO: 875547 - RNA, 19 nt, Homo sapiens
gagcaaaggaaagcgauuu

SEQ ID NO: 875548 - RNA, 19 nt, Homo sapiens
acagcgagguucuuucuga

SEQ ID NO: 875549 - RNA, 19 nt, Homo sapiens
ugacgcaaguggaacuaaa

SEQ ID NO: 875550 - RNA, 19 nt, Homo sapiens
caacgacaacugcuacuug

SEQ ID NO: 875551 - RNA, 19 nt, Homo sapiens
uagcggcacuggccuuuga

SEQ ID NO: 875552 - RNA, 19 nt, Homo sapiens
gugguagucuaacuccaua

SEQ ID NO: 875553 - RNA, 19 nt, Homo sapiens
caacgagacuugccuacac

SEQ ID NO: 875554 - RNA, 19 nt, Homo sapiens
ugaaggugcugcauacgau

SEQ ID NO: 875555 - RNA, 19 nt, Homo sapiens
ggcagcaaaugaacuugaa

SEQ ID NO: 875556 - RNA, 19 nt, Homo sapiens
gagguucuuucugauacua

SEQ ID NO: 875557 - RNA, 19 nt, Homo sapiens
gauuguagugguagucuaa

SEQ ID NO: 875558 - RNA, 19 nt, Homo sapiens
agagaacacuggcuucaca

SEQ ID NO: 875559 - RNA, 19 nt, Homo sapiens
gcaccgauacggaagaugu

SEQ ID NO: 875560 - RNA, 19 nt, Homo sapiens
ggacagcgagguucuuucu

SEQ ID NO: 875561 - RNA, 19 nt, Homo sapiens
gcucugggauuucuuccau

SEQ ID NO: 875562 - RNA, 19 nt, Homo sapiens
gacaugaaggugcugcaua

SEQ ID NO: 875563 - RNA, 19 nt, Homo sapiens
ggaagaugugugcauugua

SEQ ID NO: 875564 - RNA, 19 nt, Homo sapiens
ggaaacgaccaaugagauc

SEQ ID NO: 875565 - RNA, 19 nt, Homo sapiens
acagaggacuuugugcauu

SEQ ID NO: 875566 - RNA, 19 nt, Homo sapiens
ggaccgugauuaggguauu

SEQ ID NO: 875567 - RNA, 19 nt, Homo sapiens
gcaaaugaacuugaaaggu

SEQ ID NO: 875568 - RNA, 19 nt, Homo sapiens
gcgagguucuuucugauac

SEQ ID NO: 875569 - RNA, 19 nt, Homo sapiens
gacugaacuugaccuguga

SEQ ID NO: 875570 - RNA, 19 nt, Homo sapiens
ccaagugacagaaauguuc

SEQ ID NO: 875571 - RNA, 19 nt, Homo sapiens
gugcauugcugcuaugaac

SEQ ID NO: 875572 - RNA, 19 nt, Homo sapiens
gaggacagcgagguucuuu

SEQ ID NO: 875573 - RNA, 19 nt, Homo sapiens
cuaccugccuucccaagug

SEQ ID NO: 875574 - RNA, 19 nt, Homo sapiens
gaccgugauuaggguauuu

SEQ ID NO: 875575 - RNA, 19 nt, Homo sapiens
uuggaucgcucugggauuu

SEQ ID NO: 875576 - RNA, 19 nt, Homo sapiens
gcagagaacacuggcuuca

SEQ ID NO: 875577 - RNA, 19 nt, Homo sapiens
ccacaacauucgggacaug

SEQ ID NO: 875578 - RNA, 19 nt, Homo sapiens
gcaacuacagcuacuccaa

SEQ ID NO: 875579 - RNA, 19 nt, Homo sapiens
cggaagaugugugcauugu

SEQ ID NO: 875580 - RNA, 19 nt, Homo sapiens
gacuucagcugggacagaa

SEQ ID NO: 875581 - RNA, 19 nt, Homo sapiens
gcugaggaaauacaucauu

SEQ ID NO: 875582 - RNA, 19 nt, Homo sapiens
uaguaaguccgguuauaaa

SEQ ID NO: 875583 - RNA, 19 nt, Homo sapiens
ggccaguucugcagugaca

SEQ ID NO: 875584 - RNA, 19 nt, Homo sapiens
cauaaugccgagugcguaa

SEQ ID NO: 875585 - RNA, 19 nt, Homo sapiens
gcauugcugcuaugaacuu

SEQ ID NO: 875586 - RNA, 19 nt, Homo sapiens
caaacucgagacugugaaa

SEQ ID NO: 875587 - RNA, 19 nt, Homo sapiens
ugugugcgcugucaaucaa

SEQ ID NO: 875588 - RNA, 19 nt, Homo sapiens
aggcagaggcugauaguau

SEQ ID NO: 875589 - RNA, 19 nt, Homo sapiens
acacgauucuggcugugaa

SEQ ID NO: 875590 - RNA, 19 nt, Homo sapiens
gaaagcgauuuuguuugua

SEQ ID NO: 875591 - RNA, 19 nt, Homo sapiens
caaccaggacaacacagaa

SEQ ID NO: 875592 - RNA, 19 nt, Homo sapiens
gcaggucuucgauaccauu

SEQ ID NO: 875593 - RNA, 19 nt, Homo sapiens
caacaggcagaggcugaua

SEQ ID NO: 875594 - RNA, 19 nt, Homo sapiens
ggagcuagaagccacuuuc

SEQ ID NO: 875595 - RNA, 19 nt, Homo sapiens
gaggugcaggucuucgaua

SEQ ID NO: 875596 - RNA, 19 nt, Homo sapiens
acaugaaggugcugcauac

SEQ ID NO: 875597 - RNA, 19 nt, Homo sapiens
acugagaucugcaacuaca

SEQ ID NO: 875598 - RNA, 19 nt, Homo sapiens
gguucuuucugauacuaaa

SEQ ID NO: 875599 - RNA, 19 nt, Homo sapiens
gcacagugggucugcuugu

SEQ ID NO: 875600 - RNA, 19 nt, Homo sapiens
ggauggcagagacuuuauu

SEQ ID NO: 875601 - RNA, 19 nt, Homo sapiens
uugcugcuaugaacuuuga

SEQ ID NO: 875602 - RNA, 19 nt, Homo sapiens
acucgagacugugaaagaa

SEQ ID NO: 875603 - RNA, 19 nt, Homo sapiens
gucccuagcuguugguagu

SEQ ID NO: 875604 - RNA, 19 nt, Homo sapiens
cgcaaaaccuccucgcuuu

SEQ ID NO: 875605 - RNA, 19 nt, Homo sapiens
ccaugauucuucggacuga

SEQ ID NO: 875606 - RNA, 19 nt, Homo sapiens
uagccacaauucagaagau

SEQ ID NO: 875607 - RNA, 19 nt, Homo sapiens
gcagcaaaugaacuugaaa

SEQ ID NO: 875608 - RNA, 19 nt, Homo sapiens
gagagcugcaaacaugauu

SEQ ID NO: 875609 - RNA, 19 nt, Homo sapiens
ucggagaggugcaggucuu

SEQ ID NO: 875610 - RNA, 19 nt, Homo sapiens
cagcgagguucuuucugau

SEQ ID NO: 875611 - RNA, 19 nt, Homo sapiens
gaacgugccaagccagcau

SEQ ID NO: 875612 - RNA, 19 nt, Homo sapiens
gaaacgaccaaugagaucu

SEQ ID NO: 875613 - RNA, 19 nt, Homo sapiens
ggacggcagucuggaaacg

SEQ ID NO: 875614 - RNA, 19 nt, Homo sapiens
gaccgugcacaucuucaaa

SEQ ID NO: 875615 - RNA, 19 nt, Homo sapiens
uacggaagaugugugcauu

SEQ ID NO: 875616 - RNA, 19 nt, Homo sapiens
gugcaggucuucgauacca

SEQ ID NO: 875617 - RNA, 19 nt, Homo sapiens
gcaccaaggaagcuaaagg

SEQ ID NO: 875618 - RNA, 19 nt, Homo sapiens
ucauaucuguacauaaugc

SEQ ID NO: 875619 - RNA, 19 nt, Homo sapiens
gcgagugugcccugaugaa

SEQ ID NO: 875620 - RNA, 19 nt, Homo sapiens
ucaacaacgacaacugcua

SEQ ID NO: 875621 - RNA, 19 nt, Homo sapiens
ggaggagucccuguacauc

SEQ ID NO: 875622 - RNA, 19 nt, Homo sapiens
cagcuacuccaacacgauu

SEQ ID NO: 875623 - RNA, 19 nt, Homo sapiens
caagugacagaaauguuca

SEQ ID NO: 875624 - RNA, 19 nt, Homo sapiens
gaccggguacuucgggaaa

SEQ ID NO: 875625 - RNA, 19 nt, Homo sapiens
gaacugagaucugcaacua

SEQ ID NO: 875626 - RNA, 19 nt, Homo sapiens
caaggaagcuaaagguuug

SEQ ID NO: 875627 - RNA, 19 nt, Homo sapiens
gaagaugugugcauuguag

SEQ ID NO: 875628 - RNA, 19 nt, Homo sapiens
guacuucccuuugugauuu

SEQ ID NO: 875629 - RNA, 19 nt, Homo sapiens
ugacagaaauguucaacca

SEQ ID NO: 875630 - RNA, 19 nt, Homo sapiens
ccaaggaagcuaaagguuu

SEQ ID NO: 875631 - RNA, 19 nt, Homo sapiens
gaggauggcagagacuuua

SEQ ID NO: 875632 - RNA, 19 nt, Homo sapiens
cagaggacuuugugcauug

SEQ ID NO: 875633 - RNA, 19 nt, Homo sapiens
ggucuucgauaccauuaau

SEQ ID NO: 875634 - RNA, 19 nt, Homo sapiens
ggcagaggcugauaguaug

SEQ ID NO: 875635 - RNA, 19 nt, Homo sapiens
ugacgcaaguggaacuaaa

SEQ ID NO: 875636 - RNA, 19 nt, Homo sapiens
caacgacaacugcuacuug

SEQ ID NO: 875637 - RNA, 19 nt, Homo sapiens
uagcggcacuggccuuuga

SEQ ID NO: 875638 - RNA, 19 nt, Homo sapiens
ugaaggugcugcauacgau

SEQ ID NO: 875639 - RNA, 19 nt, Homo sapiens
gcauguacuucccuuugug

SEQ ID NO: 875640 - RNA, 19 nt, Homo sapiens
agagaacacuggcuucaca

SEQ ID NO: 875641 - RNA, 19 nt, Homo sapiens
gacaugaaggugcugcaua

SEQ ID NO: 875642 - RNA, 19 nt, Homo sapiens
gcauagccauguggagaug

SEQ ID NO: 875643 - RNA, 19 nt, Homo sapiens
acagaggacuuugugcauu

SEQ ID NO: 875644 - RNA, 19 nt, Homo sapiens
ggaccgugauuaggguauu

SEQ ID NO: 875645 - RNA, 19 nt, Homo sapiens
gacugaacuugaccuguga

SEQ ID NO: 875646 - RNA, 19 nt, Homo sapiens
ccaagugacagaaauguuc

SEQ ID NO: 875647 - RNA, 19 nt, Homo sapiens
gugcauugcugcuaugaac

SEQ ID NO: 875648 - RNA, 19 nt, Homo sapiens
cuaccugccuucccaagug

SEQ ID NO: 875649 - RNA, 19 nt, Homo sapiens
gaccgugauuaggguauuu

SEQ ID NO: 875650 - RNA, 19 nt, Homo sapiens
gcagagaacacuggcuuca

SEQ ID NO: 875651 - RNA, 19 nt, Homo sapiens
gauguucacgcauguacuu

SEQ ID NO: 875652 - RNA, 19 nt, Homo sapiens
ccacaacauucgggacaug

SEQ ID NO: 875653 - RNA, 19 nt, Homo sapiens
gcaacuacagcuacuccaa

SEQ ID NO: 875654 - RNA, 19 nt, Homo sapiens
gcauugcugcuaugaacuu

SEQ ID NO: 875655 - RNA, 19 nt, Homo sapiens
caaacucgagacugugaaa

SEQ ID NO: 875656 - RNA, 19 nt, Homo sapiens
ugugugcgcugucaaucaa

SEQ ID NO: 875657 - RNA, 19 nt, Homo sapiens
aggcagaggcugauaguau

SEQ ID NO: 875658 - RNA, 19 nt, Homo sapiens
acacgauucuggcugugaa

SEQ ID NO: 875659 - RNA, 19 nt, Homo sapiens
gcaggucuucgauaccauu

SEQ ID NO: 875660 - RNA, 19 nt, Homo sapiens
caacaggcagaggcugaua

SEQ ID NO: 875661 - RNA, 19 nt, Homo sapiens
gaggugcaggucuucgaua

SEQ ID NO: 875662 - RNA, 19 nt, Homo sapiens
acaugaaggugcugcauac

SEQ ID NO: 875663 - RNA, 19 nt, Homo sapiens
acugagaucugcaacuaca

SEQ ID NO: 875664 - RNA, 19 nt, Homo sapiens
ggauggcagagacuuuauu

SEQ ID NO: 875665 - RNA, 19 nt, Homo sapiens
uugcugcuaugaacuuuga

SEQ ID NO: 875666 - RNA, 19 nt, Homo sapiens
ccaggcagguguuuguuuu

SEQ ID NO: 875667 - RNA, 19 nt, Homo sapiens
acucgagacugugaaagaa

SEQ ID NO: 875668 - RNA, 19 nt, Homo sapiens
ccaugauucuucggacuga

SEQ ID NO: 875669 - RNA, 19 nt, Homo sapiens
uagccacaauucagaagau

SEQ ID NO: 875670 - RNA, 19 nt, Homo sapiens
gagagcugcaaacaugauu

SEQ ID NO: 875671 - RNA, 19 nt, Homo sapiens
ucggagaggugcaggucuu

SEQ ID NO: 875672 - RNA, 19 nt, Homo sapiens
ggccauccuuagaguggaa

SEQ ID NO: 875673 - RNA, 19 nt, Homo sapiens
ggagauguucacgcaugua

SEQ ID NO: 875674 - RNA, 19 nt, Homo sapiens
gaccgugcacaucuucaaa

SEQ ID NO: 875675 - RNA, 19 nt, Homo sapiens
gugcaggucuucgauacca

SEQ ID NO: 875676 - RNA, 19 nt, Homo sapiens
gcaccaaggaagcuaaagg

SEQ ID NO: 875677 - RNA, 19 nt, Homo sapiens
gcgagugugcccugaugaa

SEQ ID NO: 875678 - RNA, 19 nt, Homo sapiens
ucaacaacgacaacugcua

SEQ ID NO: 875679 - RNA, 19 nt, Homo sapiens
ggaggagucccuguacauc

SEQ ID NO: 875680 - RNA, 19 nt, Homo sapiens
cagcuacuccaacacgauu

SEQ ID NO: 875681 - RNA, 19 nt, Homo sapiens
caagugacagaaauguuca

SEQ ID NO: 875682 - RNA, 19 nt, Homo sapiens
gaccggguacuucgggaaa

SEQ ID NO: 875683 - RNA, 19 nt, Homo sapiens
gagaaggggaccgugauua

SEQ ID NO: 875684 - RNA, 19 nt, Homo sapiens
gcucacgacaguccuuuag

SEQ ID NO: 875685 - RNA, 19 nt, Homo sapiens
cgauaccauuaauuugaga

SEQ ID NO: 875686 - RNA, 19 nt, Homo sapiens
uaugaacuuugaccugagu

SEQ ID NO: 875687 - RNA, 19 nt, Homo sapiens
cggcgcagcugcaggaaaa

SEQ ID NO: 875688 - RNA, 19 nt, Homo sapiens
gcuggacggcagucugaaa

SEQ ID NO: 875689 - RNA, 19 nt, Homo sapiens
gaaaacgaccaaugagauc

SEQ ID NO: 875690 - RNA, 19 nt, Homo sapiens
gccauucugcggccacaaa

SEQ ID NO: 875691 - RNA, 19 nt, Homo sapiens
uaccugccuucccaaguga

SEQ ID NO: 875692 - RNA, 19 nt, Homo sapiens
ucuucaaacucgagacugu

SEQ ID NO: 875693 - RNA, 19 nt, Homo sapiens
gaguuucggagaggaguaa

SEQ ID NO: 875694 - RNA, 19 nt, Homo sapiens
uaagaagggaacugagauc

SEQ ID NO: 875695 - RNA, 19 nt, Homo sapiens
gaugugugcauuguagaga

SEQ ID NO: 875696 - RNA, 19 nt, Homo sapiens
acacugagaccgugcacau

SEQ ID NO: 875697 - RNA, 19 nt, Homo sapiens
ucgauaccauuaauuugag

SEQ ID NO: 875698 - RNA, 19 nt, Homo sapiens
cgcauguacuucccuuugu

SEQ ID NO: 875699 - RNA, 19 nt, Homo sapiens
caacauucgggacaugaag

SEQ ID NO: 875700 - RNA, 19 nt, Homo sapiens
uaaagcaccaaggaagcua

SEQ ID NO: 875701 - RNA, 19 nt, Homo sapiens
cuugaccugugaccucuga

SEQ ID NO: 875702 - RNA, 19 nt, Homo sapiens
gagauguucacgcauguac

SEQ ID NO: 875703 - RNA, 19 nt, Homo sapiens
gagaggugcaggucuucga

SEQ ID NO: 875704 - RNA, 19 nt, Homo sapiens
cauugcugcuaugaacuuu

SEQ ID NO: 875705 - RNA, 19 nt, Homo sapiens
aaacgaccaaugagaucuu

SEQ ID NO: 875706 - RNA, 19 nt, Homo sapiens
cauguacuucccuuuguga

SEQ ID NO: 875707 - RNA, 19 nt, Homo sapiens
gagaggauggcagagacuu

SEQ ID NO: 875708 - RNA, 19 nt, Homo sapiens
gcaggagaaucaaugagua

SEQ ID NO: 875709 - RNA, 19 nt, Homo sapiens
gaaagugcuucaacaagga

SEQ ID NO: 875710 - RNA, 19 nt, Homo sapiens
cagaagcgcugccgaaagu

SEQ ID NO: 875711 - RNA, 19 nt, Homo sapiens
gagaaucaaugaguacuuc

SEQ ID NO: 875712 - RNA, 19 nt, Homo sapiens
caacaaccgcuaacacuug

SEQ ID NO: 875713 - RNA, 19 nt, Homo sapiens
ccaaguauguggcgugugu

SEQ ID NO: 875714 - RNA, 19 nt, Homo sapiens
gaccaucacugggcuguug

SEQ ID NO: 875715 - RNA, 19 nt, Homo sapiens
ggaaggagcaguguguuau

SEQ ID NO: 875716 - RNA, 19 nt, Homo sapiens
guacuucugcugagggaua

SEQ ID NO: 875717 - RNA, 19 nt, Homo sapiens
gaaggagcaguguguuauu

SEQ ID NO: 875718 - RNA, 19 nt, Homo sapiens
guaccugcuuacucagaua

SEQ ID NO: 875719 - RNA, 19 nt, Homo sapiens
acuguuaucuccuugauug

SEQ ID NO: 875720 - RNA, 19 nt, Homo sapiens
aggaggagcugacccuuga

SEQ ID NO: 875721 - RNA, 19 nt, Homo sapiens
gagaacacucagcagcuua

SEQ ID NO: 875722 - RNA, 19 nt, Homo sapiens
gcaacaaccgcuaacacuu

SEQ ID NO: 875723 - RNA, 19 nt, Homo sapiens
gcaagcugcuacugcaaca

SEQ ID NO: 875724 - RNA, 19 nt, Homo sapiens
gcaugugacugccgacucu

SEQ ID NO: 875725 - RNA, 19 nt, Homo sapiens
ugcccacgcuccuucuuua

SEQ ID NO: 875726 - RNA, 19 nt, Homo sapiens
aaggagcaguguguuauuu

SEQ ID NO: 875727 - RNA, 19 nt, Homo sapiens
gggagccucugaaacuguu

SEQ ID NO: 875728 - RNA, 19 nt, Homo sapiens
ggacaguagugugcaacga

SEQ ID NO: 875729 - RNA, 19 nt, Homo sapiens
cucagcagcuuaucaaugu

SEQ ID NO: 875730 - RNA, 19 nt, Homo sapiens
cauugagacugaacugaga

SEQ ID NO: 875731 - RNA, 19 nt, Homo sapiens
caaacuuggccuucauuga

SEQ ID NO: 875732 - RNA, 19 nt, Homo sapiens
ucggguaccugcuuacuca

SEQ ID NO: 875733 - RNA, 19 nt, Homo sapiens
gaaacuguuaucuccuuga

SEQ ID NO: 875734 - RNA, 19 nt, Homo sapiens
uuacucagauacuuacaca

SEQ ID NO: 875735 - RNA, 19 nt, Homo sapiens
ggauaugccuccgcaacuc

SEQ ID NO: 875736 - RNA, 19 nt, Homo sapiens
ucaacaaggacuccacuga

SEQ ID NO: 875737 - RNA, 19 nt, Homo sapiens
cggaaggagcaguguguua

SEQ ID NO: 875738 - RNA, 19 nt, Homo sapiens
aaacuuggccuucauugag

SEQ ID NO: 875739 - RNA, 19 nt, Homo sapiens
aaacuguuaucuccuugau

SEQ ID NO: 875740 - RNA, 19 nt, Homo sapiens
acacgaucacccacucuua

SEQ ID NO: 875741 - RNA, 19 nt, Homo sapiens
ggagaaucaaugaguacuu

SEQ ID NO: 875742 - RNA, 19 nt, Homo sapiens
guuaucuccuugauuguca

SEQ ID NO: 875743 - RNA, 19 nt, Homo sapiens
cagcaaggccaggacagua

SEQ ID NO: 875744 - RNA, 19 nt, Homo sapiens
uuaccuacgucaaccuaga

SEQ ID NO: 875745 - RNA, 19 nt, Homo sapiens
guacagugcaccaggaagu

SEQ ID NO: 875746 - RNA, 19 nt, Homo sapiens
gugcaacgacccugacaug

SEQ ID NO: 875747 - RNA, 19 nt, Homo sapiens
cugaaacuguuaucuccuu

SEQ ID NO: 875748 - RNA, 19 nt, Homo sapiens
gcaacgacccugacaugac

SEQ ID NO: 875749 - RNA, 19 nt, Homo sapiens
cgaauggugaggucuguga

SEQ ID NO: 875750 - RNA, 19 nt, Homo sapiens
ggaaggcaccccaggcuaa

SEQ ID NO: 875751 - RNA, 19 nt, Homo sapiens
ccuggagaccgguaucuuu

SEQ ID NO: 875752 - RNA, 19 nt, Homo sapiens
gguaccugcuuacucagau

SEQ ID NO: 875753 - RNA, 19 nt, Homo sapiens
acacucagcagcuuaucaa

SEQ ID NO: 875754 - RNA, 19 nt, Homo sapiens
accaggaagucuccaguga

SEQ ID NO: 875755 - RNA, 19 nt, Homo sapiens
ucagauacuuacacacaac

SEQ ID NO: 875756 - RNA, 19 nt, Homo sapiens
cugcuuacucagauacuua

SEQ ID NO: 875757 - RNA, 19 nt, Homo sapiens
gauaugccuccgcaacuca

SEQ ID NO: 875758 - RNA, 19 nt, Homo sapiens
ccaggacaguagugugcaa

SEQ ID NO: 875759 - RNA, 19 nt, Homo sapiens
guauguggcgugugucugu

SEQ ID NO: 875760 - RNA, 19 nt, Homo sapiens
ucuccuugauugucacuga

SEQ ID NO: 875761 - RNA, 19 nt, Homo sapiens
cugcucggguaccugcuua

SEQ ID NO: 875762 - RNA, 19 nt, Homo sapiens
gcacuuacuacagacuaga

SEQ ID NO: 875763 - RNA, 19 nt, Homo sapiens
cuacgucaaccuagagaga

SEQ ID NO: 875764 - RNA, 19 nt, Homo sapiens
uugcuacgcuguggagcua

SEQ ID NO: 875765 - RNA, 19 nt, Homo sapiens
gccagcaucaggucccuuu

SEQ ID NO: 875766 - RNA, 19 nt, Homo sapiens
gccgaaagugcuucaacaa

SEQ ID NO: 875767 - RNA, 19 nt, Homo sapiens
cuacagacuagaaaguguu

SEQ ID NO: 875768 - RNA, 19 nt, Homo sapiens
gaaucaaugaguacuucug

SEQ ID NO: 875769 - RNA, 19 nt, Homo sapiens
ggagcaguguguuauuuuc

SEQ ID NO: 875770 - RNA, 19 nt, Homo sapiens
gaauggugaggucugugaa

SEQ ID NO: 875771 - RNA, 19 nt, Homo sapiens
ccgacucuaugaccugguu

SEQ ID NO: 875772 - RNA, 19 nt, Homo sapiens
gcugcagccuccauaucau

SEQ ID NO: 875773 - RNA, 19 nt, Homo sapiens
gagacugaacugagaugug

SEQ ID NO: 875774 - RNA, 19 nt, Homo sapiens
cuacugcaacaaccgcuaa

SEQ ID NO: 875775 - RNA, 19 nt, Homo sapiens
ggcaggagaaucaaugagu

SEQ ID NO: 875776 - RNA, 19 nt, Homo sapiens
uuucaggccuuuggaguca

SEQ ID NO: 875777 - RNA, 19 nt, Homo sapiens
ccaugaggguggcauuagg

SEQ ID NO: 875778 - RNA, 19 nt, Homo sapiens
ggagaccgguaucuuuccu

SEQ ID NO: 875779 - RNA, 19 nt, Homo sapiens
ccacgcuccuucuuuagcu

SEQ ID NO: 875780 - RNA, 19 nt, Homo sapiens
ggacuuucaggccuuugga

SEQ ID NO: 875781 - RNA, 19 nt, Homo sapiens
ugccgaaagugcuucaaca

SEQ ID NO: 875782 - RNA, 19 nt, Homo sapiens
gcagcugcagccuccauau

SEQ ID NO: 875783 - RNA, 19 nt, Homo sapiens
acucagauacuuacacaca

SEQ ID NO: 875784 - RNA, 19 nt, Homo sapiens
acaccugaguacacgauca

SEQ ID NO: 875785 - RNA, 19 nt, Homo sapiens
caguguggccaucgucauu

SEQ ID NO: 875786 - RNA, 19 nt, Homo sapiens
ucaaugugguggugaucag

SEQ ID NO: 875787 - RNA, 19 nt, Homo sapiens
ccugggagccucugaaacu

SEQ ID NO: 875788 - RNA, 19 nt, Homo sapiens
gcaaggccaggacaguagu

SEQ ID NO: 875789 - RNA, 19 nt, Homo sapiens
gcguguccuugguguggaa

SEQ ID NO: 875790 - RNA, 19 nt, Homo sapiens
gcagcaaggccaggacagu

SEQ ID NO: 875791 - RNA, 19 nt, Homo sapiens
ccacaguuaccuacgucaa

SEQ ID NO: 875792 - RNA, 19 nt, Homo sapiens
aacuuggccuucauugaga

SEQ ID NO: 875793 - RNA, 19 nt, Homo sapiens
gaacuaauguccaggagua

SEQ ID NO: 875794 - RNA, 19 nt, Homo sapiens
gaaacccugucucuacuaa

SEQ ID NO: 875795 - RNA, 19 nt, Homo sapiens
ggaaucacauguguacuuu

SEQ ID NO: 875796 - RNA, 19 nt, Homo sapiens
caaggcagcugucagaaga

SEQ ID NO: 875797 - RNA, 19 nt, Homo sapiens
gcgauacacuaguuuauug

SEQ ID NO: 875798 - RNA, 19 nt, Homo sapiens
gcaaagcacaucugcgaua

SEQ ID NO: 875799 - RNA, 19 nt, Homo sapiens
ucaaaggacucuuauguca

SEQ ID NO: 875800 - RNA, 19 nt, Homo sapiens
ucaggaagcuucaugucua

SEQ ID NO: 875801 - RNA, 19 nt, Homo sapiens
gaacagucaaucugcauuu

SEQ ID NO: 875802 - RNA, 19 nt, Homo sapiens
gcacaucugcgauacacua

SEQ ID NO: 875803 - RNA, 19 nt, Homo sapiens
aaucagaucugugacuuaa

SEQ ID NO: 875804 - RNA, 19 nt, Homo sapiens
gaaucuaguucucaucugu

SEQ ID NO: 875805 - RNA, 19 nt, Homo sapiens
gcagaaugcgcuuuagaaa

SEQ ID NO: 875806 - RNA, 19 nt, Homo sapiens
guucagaggugacuguguu

SEQ ID NO: 875807 - RNA, 19 nt, Homo sapiens
ggucaaaggacucuuaugu

SEQ ID NO: 875808 - RNA, 19 nt, Homo sapiens
cuggagagcuuacacuuug

SEQ ID NO: 875809 - RNA, 19 nt, Homo sapiens
ugacuguguuucuccauuu

SEQ ID NO: 875810 - RNA, 19 nt, Homo sapiens
caacauggcaaacagauca

SEQ ID NO: 875811 - RNA, 19 nt, Homo sapiens
gaagggagcuaaguaucca

SEQ ID NO: 875812 - RNA, 19 nt, Homo sapiens
gcacagaugaggaaaccaa

SEQ ID NO: 875813 - RNA, 19 nt, Homo sapiens
ggaaacagugaaagagaaa

SEQ ID NO: 875814 - RNA, 19 nt, Homo sapiens
gagccgaaacuauaagaaa

SEQ ID NO: 875815 - RNA, 19 nt, Homo sapiens
caucugcgauacacuaguu

SEQ ID NO: 875816 - RNA, 19 nt, Homo sapiens
caggaagcuucaugucuaa

SEQ ID NO: 875817 - RNA, 19 nt, Homo sapiens
ucagaucugugacuuaauc

SEQ ID NO: 875818 - RNA, 19 nt, Homo sapiens
gaaaagggguggcuagagu

SEQ ID NO: 875819 - RNA, 19 nt, Homo sapiens
ggacaaaccccgcaaauca

SEQ ID NO: 875820 - RNA, 19 nt, Homo sapiens
gaugaagaaugagcguauu

SEQ ID NO: 875821 - RNA, 19 nt, Homo sapiens
cauaugaacaggagaaaga

SEQ ID NO: 875822 - RNA, 19 nt, Homo sapiens
ccacaccucucaccucaca

SEQ ID NO: 875823 - RNA, 19 nt, Homo sapiens
caagaagggagcuaaguau

SEQ ID NO: 875824 - RNA, 19 nt, Homo sapiens
cacaacagguggagaagga

SEQ ID NO: 875825 - RNA, 19 nt, Homo sapiens
ucacaagguugggagauug

SEQ ID NO: 875826 - RNA, 19 nt, Homo sapiens
ucucagaaccuuuaauaug

SEQ ID NO: 875827 - RNA, 19 nt, Homo sapiens
gaagcuucaugucuaaugg

SEQ ID NO: 875828 - RNA, 19 nt, Homo sapiens
gcaggagccucucaguucu

SEQ ID NO: 875829 - RNA, 19 nt, Homo sapiens
caauguguguggcaaacuu

SEQ ID NO: 875830 - RNA, 19 nt, Homo sapiens
agaaggauauaaccagaau

SEQ ID NO: 875831 - RNA, 19 nt, Homo sapiens
caucagucauucuauagug

SEQ ID NO: 875832 - RNA, 19 nt, Homo sapiens
gagcggcaccagaaggaua

SEQ ID NO: 875833 - RNA, 19 nt, Homo sapiens
gagcuuacacuuugucauc

SEQ ID NO: 875834 - RNA, 19 nt, Homo sapiens
ggagugcugugcugauucu

SEQ ID NO: 875835 - RNA, 19 nt, Homo sapiens
ucucuuuccucgccacaua

SEQ ID NO: 875836 - RNA, 19 nt, Homo sapiens
ccagaauucuccagcaaca

SEQ ID NO: 875837 - RNA, 19 nt, Homo sapiens
gggaaucacauguguacuu

SEQ ID NO: 875838 - RNA, 19 nt, Homo sapiens
uggaaacagugaaagagaa

SEQ ID NO: 875839 - RNA, 19 nt, Homo sapiens
cgagguggguggaucacaa

SEQ ID NO: 875840 - RNA, 19 nt, Homo sapiens
acaagaagggagcuaagua

SEQ ID NO: 875841 - RNA, 19 nt, Homo sapiens
ccugauagucuguggauuu

SEQ ID NO: 875842 - RNA, 19 nt, Homo sapiens
gaucugugacuuaaucuuc

SEQ ID NO: 875843 - RNA, 19 nt, Homo sapiens
gaagaaaugggcacaacag

SEQ ID NO: 875844 - RNA, 19 nt, Homo sapiens
gugaggcccuggagaagga

SEQ ID NO: 875845 - RNA, 19 nt, Homo sapiens
gcguagagcauuugcauca

SEQ ID NO: 875846 - RNA, 19 nt, Homo sapiens
ggccuugaguuacauggaa

SEQ ID NO: 875847 - RNA, 19 nt, Homo sapiens
agaaggaggagcuguugua

SEQ ID NO: 875848 - RNA, 19 nt, Homo sapiens
gaaugaagaggcccugcaa

SEQ ID NO: 875849 - RNA, 19 nt, Homo sapiens
gcaggagaccauagacaga

SEQ ID NO: 875850 - RNA, 19 nt, Homo sapiens
gcuagagcuucgagacaga

SEQ ID NO: 875851 - RNA, 19 nt, Homo sapiens
ugaccugaaugacuucuca

SEQ ID NO: 875852 - RNA, 19 nt, Homo sapiens
ggaagcuucaugucuaaug

SEQ ID NO: 875853 - RNA, 19 nt, Homo sapiens
aaaggacucuuaugucacu

SEQ ID NO: 875854 - RNA, 19 nt, Homo sapiens
ccgacuugcugacuuauca

SEQ ID NO: 875855 - RNA, 19 nt, Homo sapiens
auucugagccgaaacuaua

SEQ ID NO: 875856 - RNA, 19 nt, Homo sapiens
guggguggaucacaagguu

SEQ ID NO: 875857 - RNA, 19 nt, Homo sapiens
caccuaaacagaucaguga

SEQ ID NO: 875858 - RNA, 19 nt, Homo sapiens
caaagcacaucugcgauac

SEQ ID NO: 875859 - RNA, 19 nt, Homo sapiens
ccaggagccucgaggaaag

SEQ ID NO: 875860 - RNA, 19 nt, Homo sapiens
gaaguucagaggugacugu

SEQ ID NO: 875861 - RNA, 19 nt, Homo sapiens
aaacagaucacaggaguca

SEQ ID NO: 875862 - RNA, 19 nt, Homo sapiens
ggagaaggaggagcuguug

SEQ ID NO: 875863 - RNA, 19 nt, Homo sapiens
ggagggaaucacaugugua

SEQ ID NO: 875864 - RNA, 19 nt, Homo sapiens
aauuauaacuccuguucug

SEQ ID NO: 875865 - RNA, 19 nt, Homo sapiens
gaucccaggcccaggcuuu

SEQ ID NO: 875866 - RNA, 19 nt, Homo sapiens
ucacccacuuaguuucuuu

SEQ ID NO: 875867 - RNA, 19 nt, Homo sapiens
gggcacaacagguggagaa

SEQ ID NO: 875868 - RNA, 19 nt, Homo sapiens
cugccgacuugcugacuua

SEQ ID NO: 875869 - RNA, 19 nt, Homo sapiens
ccacugaggucucuuuccu

SEQ ID NO: 875870 - RNA, 19 nt, Homo sapiens
aaucugauauuggaggaaa

SEQ ID NO: 875871 - RNA, 19 nt, Homo sapiens
gcuggagagcuuacacuuu

SEQ ID NO: 875872 - RNA, 19 nt, Homo sapiens
guggcaaacuuacaagaag

SEQ ID NO: 875873 - RNA, 19 nt, Homo sapiens
ggauauaaccagaauucuc

SEQ ID NO: 875874 - RNA, 19 nt, Homo sapiens
caacuuccucuagguguuu

SEQ ID NO: 875875 - RNA, 19 nt, Homo sapiens
cggcugauccucauggaaa

SEQ ID NO: 875876 - RNA, 19 nt, Homo sapiens
ggaaggaaagaaugaagag

SEQ ID NO: 875877 - RNA, 19 nt, Homo sapiens
guugggagauugagaccau

SEQ ID NO: 875878 - RNA, 19 nt, Homo sapiens
gagggaaucacauguguac

SEQ ID NO: 875879 - RNA, 19 nt, Homo sapiens
gcccuaagccagcgucaga

SEQ ID NO: 875880 - RNA, 19 nt, Homo sapiens
acagaucacaggagucaaa

SEQ ID NO: 875881 - RNA, 19 nt, Homo sapiens
gggcaagcuuggugguugu

SEQ ID NO: 875882 - RNA, 19 nt, Homo sapiens
ccagcacucugucccaauc

SEQ ID NO: 875883 - RNA, 19 nt, Homo sapiens
uaagcaagaggagacauuu

SEQ ID NO: 875884 - RNA, 19 nt, Homo sapiens
caacagguggagaaggaaa

SEQ ID NO: 875885 - RNA, 19 nt, Homo sapiens
gugaaacccugucucuacu

SEQ ID NO: 875886 - RNA, 19 nt, Homo sapiens
gugacuguguuucuccauu

SEQ ID NO: 875887 - RNA, 19 nt, Homo sapiens
gcccucacccacuuaguuu

SEQ ID NO: 875888 - RNA, 19 nt, Homo sapiens
gcuggccauuugacauaaa

SEQ ID NO: 875889 - RNA, 19 nt, Homo sapiens
ugaguuggccaagggaaua

SEQ ID NO: 875890 - RNA, 19 nt, Homo sapiens
cucagaaccuuuaauaugc

SEQ ID NO: 875891 - RNA, 19 nt, Homo sapiens
ucaacuuccucuagguguu

SEQ ID NO: 875892 - RNA, 19 nt, Homo sapiens
gugucacgcuggccauuug

SEQ ID NO: 875893 - RNA, 19 nt, Homo sapiens
ggacagaggugacaaacuu

SEQ ID NO: 875894 - RNA, 19 nt, Homo sapiens
gaacuaagaagaacuaaga

SEQ ID NO: 875895 - RNA, 19 nt, Homo sapiens
gaaagaagaagaagaagaa

SEQ ID NO: 875896 - RNA, 19 nt, Homo sapiens
gcacuuuacuguuugaauu

SEQ ID NO: 875897 - RNA, 19 nt, Homo sapiens
caucagcucuuacaacuaa

SEQ ID NO: 875898 - RNA, 19 nt, Homo sapiens
guaguucucuggcuuaauu

SEQ ID NO: 875899 - RNA, 19 nt, Homo sapiens
gaagguagcucggacucua

SEQ ID NO: 875900 - RNA, 19 nt, Homo sapiens
guaaguaagugcccuuuga

SEQ ID NO: 875901 - RNA, 19 nt, Homo sapiens
gaaggaagaagaagaacua

SEQ ID NO: 875902 - RNA, 19 nt, Homo sapiens
gaacuaagaagaaggagaa

SEQ ID NO: 875903 - RNA, 19 nt, Homo sapiens
cagaaccgcucuugucuuu

SEQ ID NO: 875904 - RNA, 19 nt, Homo sapiens
gaagaagaacuaagaagaa

SEQ ID NO: 875905 - RNA, 19 nt, Homo sapiens
gaagaagaacuaagaagaa

SEQ ID NO: 875906 - RNA, 19 nt, Homo sapiens
gaaccgcucuugucuuuua

SEQ ID NO: 875907 - RNA, 19 nt, Homo sapiens
ggaagaagaagaacuaaga

SEQ ID NO: 875908 - RNA, 19 nt, Homo sapiens
ggagaaagaagaagaagaa

SEQ ID NO: 875909 - RNA, 19 nt, Homo sapiens
gaaagaaggagaaggaaga

SEQ ID NO: 875910 - RNA, 19 nt, Homo sapiens
gaagaaagaaggagaagga

SEQ ID NO: 875911 - RNA, 19 nt, Homo sapiens
gaugaaauguguagcucua

SEQ ID NO: 875912 - RNA, 19 nt, Homo sapiens
gaaggaagaggaagaagaa

SEQ ID NO: 875913 - RNA, 19 nt, Homo sapiens
gggagggaaugaauacaua

SEQ ID NO: 875914 - RNA, 19 nt, Homo sapiens
ggaagaagaaggagaaaga

SEQ ID NO: 875915 - RNA, 19 nt, Homo sapiens
gaagagagaaggagaagga

SEQ ID NO: 875916 - RNA, 19 nt, Homo sapiens
gaagaaggaggaagaaaga

SEQ ID NO: 875917 - RNA, 19 nt, Homo sapiens
gaagaacuaagaagaacua

SEQ ID NO: 875918 - RNA, 19 nt, Homo sapiens
gcagugugcauuaggauua

SEQ ID NO: 875919 - RNA, 19 nt, Homo sapiens
uaacugaaguacuggauau

SEQ ID NO: 875920 - RNA, 19 nt, Homo sapiens
caaguuguauguuccauug

SEQ ID NO: 875921 - RNA, 19 nt, Homo sapiens
gagaauucacugagaguua

SEQ ID NO: 875922 - RNA, 19 nt, Homo sapiens
gaugaaacuuacucaauuc

SEQ ID NO: 875923 - RNA, 19 nt, Homo sapiens
gaagggcaguuuccugaau

SEQ ID NO: 875924 - RNA, 19 nt, Homo sapiens
aaacccagauggcgucaua

SEQ ID NO: 875925 - RNA, 19 nt, Homo sapiens
gggaaugaauacauagaaa

SEQ ID NO: 875926 - RNA, 19 nt, Homo sapiens
cugaaguacuggauauuua

SEQ ID NO: 875927 - RNA, 19 nt, Homo sapiens
ccaugugucugguaaguaa

SEQ ID NO: 875928 - RNA, 19 nt, Homo sapiens
caacuaaacaacucaacua

SEQ ID NO: 875929 - RNA, 19 nt, Homo sapiens
gacaaucgcuuucacugau

SEQ ID NO: 875930 - RNA, 19 nt, Homo sapiens
gaaggaagaggaagaagga

SEQ ID NO: 875931 - RNA, 19 nt, Homo sapiens
gaagaaggaagaaggagaa

SEQ ID NO: 875932 - RNA, 19 nt, Homo sapiens
gaagaaggagaaagaagaa

SEQ ID NO: 875933 - RNA, 19 nt, Homo sapiens
gcaaauagcaagacuaacu

SEQ ID NO: 875934 - RNA, 19 nt, Homo sapiens
gagcauucguucucuguug

SEQ ID NO: 875935 - RNA, 19 nt, Homo sapiens
ggacuucaguuucucuugu

SEQ ID NO: 875936 - RNA, 19 nt, Homo sapiens
ggaagaggaggaagaacua

SEQ ID NO: 875937 - RNA, 19 nt, Homo sapiens
ggaagaaggagaaggaaga

SEQ ID NO: 875938 - RNA, 19 nt, Homo sapiens
gaaggaagaaggagaagga

SEQ ID NO: 875939 - RNA, 19 nt, Homo sapiens
ucaggaagaugaaaugugu

SEQ ID NO: 875940 - RNA, 19 nt, Homo sapiens
cuaagcaacugaaacgaaa

SEQ ID NO: 875941 - RNA, 19 nt, Homo sapiens
gagaagaauuaagugcuaa

SEQ ID NO: 875942 - RNA, 19 nt, Homo sapiens
gaucagagagagaagaauu

SEQ ID NO: 875943 - RNA, 19 nt, Homo sapiens
ggagaaggaagaagaagaa

SEQ ID NO: 875944 - RNA, 19 nt, Homo sapiens
ggagugagacccauauguu

SEQ ID NO: 875945 - RNA, 19 nt, Homo sapiens
ccaguggccucucagauug

SEQ ID NO: 875946 - RNA, 19 nt, Homo sapiens
gaagaaaaccccaauauag

SEQ ID NO: 875947 - RNA, 19 nt, Homo sapiens
ugagaauuguggcuauuaa

SEQ ID NO: 875948 - RNA, 19 nt, Homo sapiens
ccaaggaaauuagaugaga

SEQ ID NO: 875949 - RNA, 19 nt, Homo sapiens
gaagaacuaagaagaagga

SEQ ID NO: 875950 - RNA, 19 nt, Homo sapiens
gaagaagaagaacuaagaa

SEQ ID NO: 875951 - RNA, 19 nt, Homo sapiens
gaagaacuaagaagaagga

SEQ ID NO: 875952 - RNA, 19 nt, Homo sapiens
gaagaagaagaacuaagaa

SEQ ID NO: 875953 - RNA, 19 nt, Homo sapiens
cuacuucacugccauggaa

SEQ ID NO: 875954 - RNA, 19 nt, Homo sapiens
caaggaaauuagaugagaa

SEQ ID NO: 875955 - RNA, 19 nt, Homo sapiens
gaaggaagaggaggaagaa

SEQ ID NO: 875956 - RNA, 19 nt, Homo sapiens
gaaggagaaagaagaagaa

SEQ ID NO: 875957 - RNA, 19 nt, Homo sapiens
ggaaugauccgaguacugu

SEQ ID NO: 875958 - RNA, 19 nt, Homo sapiens
gaaaguacuccugcucauu

SEQ ID NO: 875959 - RNA, 19 nt, Homo sapiens
ccuaaggacugcuuucuca

SEQ ID NO: 875960 - RNA, 19 nt, Homo sapiens
gaaagcaaauagcaagacu

SEQ ID NO: 875961 - RNA, 19 nt, Homo sapiens
aaacaaaggagcauucguu

SEQ ID NO: 875962 - RNA, 19 nt, Homo sapiens
ucuugaagcuugucuagaa

SEQ ID NO: 875963 - RNA, 19 nt, Homo sapiens
agagaagaauuaagugcua

SEQ ID NO: 875964 - RNA, 19 nt, Homo sapiens
uaaagaaggagaaggaaga

SEQ ID NO: 875965 - RNA, 19 nt, Homo sapiens
gaagaagagagaaggagaa

SEQ ID NO: 875966 - RNA, 19 nt, Homo sapiens
cuuuacaucuuacuccuua

SEQ ID NO: 875967 - RNA, 19 nt, Homo sapiens
guaaguaaguaaguaagug

SEQ ID NO: 875968 - RNA, 19 nt, Homo sapiens
ucacugauguucuuguugu

SEQ ID NO: 875969 - RNA, 19 nt, Homo sapiens
aaaguacuccugcucauuu

SEQ ID NO: 875970 - RNA, 19 nt, Homo sapiens
ggaaaguacuccugcucau

SEQ ID NO: 875971 - RNA, 19 nt, Homo sapiens
ggaagaaaaccccaauaua

SEQ ID NO: 875972 - RNA, 19 nt, Homo sapiens
gagaggagaagaaggaaga

SEQ ID NO: 875973 - RNA, 19 nt, Homo sapiens
gagagaaggagaaggaaga

SEQ ID NO: 875974 - RNA, 19 nt, Homo sapiens
ggagaaggaagaagagaga

SEQ ID NO: 875975 - RNA, 19 nt, Homo sapiens
agaagaagaagaagaacua

SEQ ID NO: 875976 - RNA, 19 nt, Homo sapiens
ggaagaggaagaagaagga

SEQ ID NO: 875977 - RNA, 19 nt, Homo sapiens
ggccaggacuugucucugu

SEQ ID NO: 875978 - RNA, 19 nt, Homo sapiens
cuaaacaacucaacuaagc

SEQ ID NO: 875979 - RNA, 19 nt, Homo sapiens
gugaaaggcuauaggaagu

SEQ ID NO: 875980 - RNA, 19 nt, Homo sapiens
gaugagaauuguggcuauu

SEQ ID NO: 875981 - RNA, 19 nt, Homo sapiens
gaaaaccccaauauaguua

SEQ ID NO: 875982 - RNA, 19 nt, Homo sapiens
gcagucagccaaggaaauu

SEQ ID NO: 875983 - RNA, 19 nt, Homo sapiens
acagccagcccuuuaaaua

SEQ ID NO: 875984 - RNA, 19 nt, Homo sapiens
aggaagaacuaaagaagga

SEQ ID NO: 875985 - RNA, 19 nt, Homo sapiens
gaagaagaagaagaacuaa

SEQ ID NO: 875986 - RNA, 19 nt, Homo sapiens
gaagaagaaggagaaagaa

SEQ ID NO: 875987 - RNA, 19 nt, Homo sapiens
caaaacaccuaaaauguca

SEQ ID NO: 875988 - RNA, 19 nt, Homo sapiens
gcuggcaucuuuacaucuu

SEQ ID NO: 875989 - RNA, 19 nt, Homo sapiens
caacugaaacgaaacaaag

SEQ ID NO: 875990 - RNA, 19 nt, Homo sapiens
uggcuuaauuucucaugua

SEQ ID NO: 875991 - RNA, 19 nt, Homo sapiens
gagugagacccauauguuu

SEQ ID NO: 875992 - RNA, 19 nt, Homo sapiens
agaagaagaagaacuaaga

SEQ ID NO: 875993 - RNA, 19 nt, Homo sapiens
ggacagagguuuuaaauaa

SEQ ID NO: 875994 - RNA, 19 nt, Homo sapiens
gaagaagaguguagacaga

SEQ ID NO: 875995 - RNA, 19 nt, Homo sapiens
guaguucucuggcuuaauu

SEQ ID NO: 875996 - RNA, 19 nt, Homo sapiens
gaagguagcucggacucua

SEQ ID NO: 875997 - RNA, 19 nt, Homo sapiens
ggaaugcgcccuuuggaua

SEQ ID NO: 875998 - RNA, 19 nt, Homo sapiens
gaagggccaucucucagua

SEQ ID NO: 875999 - RNA, 19 nt, Homo sapiens
caucagaacucacauuaca

SEQ ID NO: 876000 - RNA, 19 nt, Homo sapiens
gggccaagguggaucauuu

SEQ ID NO: 876001 - RNA, 19 nt, Homo sapiens
gagcacagaucaacagcuu

SEQ ID NO: 876002 - RNA, 19 nt, Homo sapiens
gaagagccaugccauccaa

SEQ ID NO: 876003 - RNA, 19 nt, Homo sapiens
gaaaguaugagugucuaua

SEQ ID NO: 876004 - RNA, 19 nt, Homo sapiens
caaggaguauuuaagaaga

SEQ ID NO: 876005 - RNA, 19 nt, Homo sapiens
gacaaucgcuuucacugau

SEQ ID NO: 876006 - RNA, 19 nt, Homo sapiens
gaagacauauacucuguac

SEQ ID NO: 876007 - RNA, 19 nt, Homo sapiens
ggacaaagaaggauugaca

SEQ ID NO: 876008 - RNA, 19 nt, Homo sapiens
ggacuucaguuucucuugu

SEQ ID NO: 876009 - RNA, 19 nt, Homo sapiens
gaggugccaauauuaauua

SEQ ID NO: 876010 - RNA, 19 nt, Homo sapiens
gggaggaucuuaccguuuc

SEQ ID NO: 876011 - RNA, 19 nt, Homo sapiens
ugaagaaguucccuagaga

SEQ ID NO: 876012 - RNA, 19 nt, Homo sapiens
ggagugagacccauauguu

SEQ ID NO: 876013 - RNA, 19 nt, Homo sapiens
gcacagaucaacagcuuug

SEQ ID NO: 876014 - RNA, 19 nt, Homo sapiens
gaggacagggcaaagaaua

SEQ ID NO: 876015 - RNA, 19 nt, Homo sapiens
guggaugccucuucugaaa

SEQ ID NO: 876016 - RNA, 19 nt, Homo sapiens
guaaauaccagucuucaca

SEQ ID NO: 876017 - RNA, 19 nt, Homo sapiens
gaaggccggugcagcaugu

SEQ ID NO: 876018 - RNA, 19 nt, Homo sapiens
caagguggaucauuuggau

SEQ ID NO: 876019 - RNA, 19 nt, Homo sapiens
ggugaggacuugaaaccuu

SEQ ID NO: 876020 - RNA, 19 nt, Homo sapiens
cggaggaauuugcuacuaa

SEQ ID NO: 876021 - RNA, 19 nt, Homo sapiens
ucacugauguucuuguugu

SEQ ID NO: 876022 - RNA, 19 nt, Homo sapiens
gaagaaguucccuagagaa

SEQ ID NO: 876023 - RNA, 19 nt, Homo sapiens
ggaggugccaauauuaauu

SEQ ID NO: 876024 - RNA, 19 nt, Homo sapiens
ccugaugugucgcauuuaa

SEQ ID NO: 876025 - RNA, 19 nt, Homo sapiens
cgaaaucuuaugaagcuua

SEQ ID NO: 876026 - RNA, 19 nt, Homo sapiens
ugagcaaguugaugaaaga

SEQ ID NO: 876027 - RNA, 19 nt, Homo sapiens
cauauacucuguacaggau

SEQ ID NO: 876028 - RNA, 19 nt, Homo sapiens
gugaggacuugaaaccuuu

SEQ ID NO: 876029 - RNA, 19 nt, Homo sapiens
cagcugggcuuguuugaag

SEQ ID NO: 876030 - RNA, 19 nt, Homo sapiens
uggcuuaauuucucaugua

SEQ ID NO: 876031 - RNA, 19 nt, Homo sapiens
gagugagacccauauguuu

SEQ ID NO: 876032 - RNA, 19 nt, Homo sapiens
gaggucaucuggagguugu

SEQ ID NO: 876033 - RNA, 19 nt, Homo sapiens
caacguggaugccucuucu

SEQ ID NO: 876034 - RNA, 19 nt, Homo sapiens
cguggagucuaauguuuaa

SEQ ID NO: 876035 - RNA, 19 nt, Homo sapiens
gaccguucguggagucuaa

SEQ ID NO: 876036 - RNA, 19 nt, Homo sapiens
gccacagcaugaagacaua

SEQ ID NO: 876037 - RNA, 19 nt, Homo sapiens
aaaccgaaaucuuaugaag

SEQ ID NO: 876038 - RNA, 19 nt, Homo sapiens
ggaggaauuugcuacuaag

SEQ ID NO: 876039 - RNA, 19 nt, Homo sapiens
ggaugccucuucugaaagu

SEQ ID NO: 876040 - RNA, 19 nt, Homo sapiens
caucuugguuacacagaaa

SEQ ID NO: 876041 - RNA, 19 nt, Homo sapiens
aaauggagaucccacugaa

SEQ ID NO: 876042 - RNA, 19 nt, Homo sapiens
gaaaucuuaugaagcuuac

SEQ ID NO: 876043 - RNA, 19 nt, Homo sapiens
gcggaggaauuugcuacua

SEQ ID NO: 876044 - RNA, 19 nt, Homo sapiens
gaaagguaaaguaaaggaa

SEQ ID NO: 876045 - RNA, 19 nt, Homo sapiens
uacguucucugguggauaa

SEQ ID NO: 876046 - RNA, 19 nt, Homo sapiens
gcaaggaguauuuaagaag

SEQ ID NO: 876047 - RNA, 19 nt, Homo sapiens
cagcaaggaguauuuaaga

SEQ ID NO: 876048 - RNA, 19 nt, Homo sapiens
gcaagaaacgggccaaggu

SEQ ID NO: 876049 - RNA, 19 nt, Homo sapiens
ccacagaccaugcugacaa

SEQ ID NO: 876050 - RNA, 19 nt, Homo sapiens
ccauggagcugaugucaac

SEQ ID NO: 876051 - RNA, 19 nt, Homo sapiens
gagcugaaaccgaaaucuu

SEQ ID NO: 876052 - RNA, 19 nt, Homo sapiens
ccaaaucuccauuauccaa

SEQ ID NO: 876053 - RNA, 19 nt, Homo sapiens
gaacgggcagugugcuuug

SEQ ID NO: 876054 - RNA, 19 nt, Homo sapiens
gaagaccuaucagugucaa

SEQ ID NO: 876055 - RNA, 19 nt, Homo sapiens
gagccaagauagguuguca

SEQ ID NO: 876056 - RNA, 19 nt, Homo sapiens
ggagccaggacuucaguuu

SEQ ID NO: 876057 - RNA, 19 nt, Homo sapiens
caaauggagaucccacuga

SEQ ID NO: 876058 - RNA, 19 nt, Homo sapiens
gccagucagcauccuauua

SEQ ID NO: 876059 - RNA, 19 nt, Homo sapiens
ccacuagacagaccuauca

SEQ ID NO: 876060 - RNA, 19 nt, Homo sapiens
ucuguaggcucucccacua

SEQ ID NO: 876061 - RNA, 19 nt, Homo sapiens
ccauuggccuccagacaga

SEQ ID NO: 876062 - RNA, 19 nt, Homo sapiens
cuaaggcccuggagcugaa

SEQ ID NO: 876063 - RNA, 19 nt, Homo sapiens
gcagccagcauggguuaua

SEQ ID NO: 876064 - RNA, 19 nt, Homo sapiens
gagguaguucucuggcuua

SEQ ID NO: 876065 - RNA, 19 nt, Homo sapiens
cacuggaucuggcagcuuu

SEQ ID NO: 876066 - RNA, 19 nt, Homo sapiens
ugucaacccuaacgaaauc

SEQ ID NO: 876067 - RNA, 19 nt, Homo sapiens
gcccagauugugagaagua

SEQ ID NO: 876068 - RNA, 19 nt, Homo sapiens
caacucaucagaacucaca

SEQ ID NO: 876069 - RNA, 19 nt, Homo sapiens
acaguucgcagcagccuua

SEQ ID NO: 876070 - RNA, 19 nt, Homo sapiens
ucagaagaccuaucagugu

SEQ ID NO: 876071 - RNA, 19 nt, Homo sapiens
agacccaaaucuccauuau

SEQ ID NO: 876072 - RNA, 19 nt, Homo sapiens
guaugagugucuauagauc

SEQ ID NO: 876073 - RNA, 19 nt, Homo sapiens
gcucaccucuuggcucuca

SEQ ID NO: 876074 - RNA, 19 nt, Homo sapiens
ugaaaccgaaaucuuauga

SEQ ID NO: 876075 - RNA, 19 nt, Homo sapiens
gcagacauccccuaucaaa

SEQ ID NO: 876076 - RNA, 19 nt, Homo sapiens
gggcagacauccccuauca

SEQ ID NO: 876077 - RNA, 19 nt, Homo sapiens
ggccuucgcuucucuccau

SEQ ID NO: 876078 - RNA, 19 nt, Homo sapiens
gaaaccgaaaucuuaugaa

SEQ ID NO: 876079 - RNA, 19 nt, Homo sapiens
agaccaugcugacaagaau

SEQ ID NO: 876080 - RNA, 19 nt, Homo sapiens
cccaugggaugcuggcuaa

SEQ ID NO: 876081 - RNA, 19 nt, Homo sapiens
cagcacggacucagcagua

SEQ ID NO: 876082 - RNA, 19 nt, Homo sapiens
gacgagcugucgccagugu

SEQ ID NO: 876083 - RNA, 19 nt, Homo sapiens
gagaguggaagaagagugu

SEQ ID NO: 876084 - RNA, 19 nt, Homo sapiens
gcugaaaccgaaaucuuau

SEQ ID NO: 876085 - RNA, 19 nt, Homo sapiens
gcagugugcuuugguucau

SEQ ID NO: 876086 - RNA, 19 nt, Homo sapiens
cagcagcaaggaguauuua

SEQ ID NO: 876087 - RNA, 19 nt, Homo sapiens
ucuggagguugucaaguuu

SEQ ID NO: 876088 - RNA, 19 nt, Homo sapiens
ccaauucuauguguucagu

SEQ ID NO: 876089 - RNA, 19 nt, Homo sapiens
gauccaggaccacaccauu

SEQ ID NO: 876090 - RNA, 19 nt, Homo sapiens
gccagugucuccaacucaa

SEQ ID NO: 876091 - RNA, 19 nt, Homo sapiens
gccagagccgguugguuua

SEQ ID NO: 876092 - RNA, 19 nt, Homo sapiens
uggaucauuuggauaagaa

SEQ ID NO: 876093 - RNA, 19 nt, Homo sapiens
ggacagagguuuuaaauaa

SEQ ID NO: 876094 - RNA, 19 nt, Homo sapiens
gcagaaauguaacucauau

SEQ ID NO: 876095 - RNA, 19 nt, Homo sapiens
ggacuuuagugguuucaua

SEQ ID NO: 876096 - RNA, 19 nt, Homo sapiens
gcaauugucuccuccucua

SEQ ID NO: 876097 - RNA, 19 nt, Homo sapiens
gcagagacaugacucguau

SEQ ID NO: 876098 - RNA, 19 nt, Homo sapiens
gaccaccacucuagagaua

SEQ ID NO: 876099 - RNA, 19 nt, Homo sapiens
gagaggaggcaacucauua

SEQ ID NO: 876100 - RNA, 19 nt, Homo sapiens
gaagaugauucucccuauu

SEQ ID NO: 876101 - RNA, 19 nt, Homo sapiens
uuucuuaucuccaguguua

SEQ ID NO: 876102 - RNA, 19 nt, Homo sapiens
gaggaguggucacacguua

SEQ ID NO: 876103 - RNA, 19 nt, Homo sapiens
gaucuuagcugggucuuuc

SEQ ID NO: 876104 - RNA, 19 nt, Homo sapiens
gcacuggcgucuuuacgaa

SEQ ID NO: 876105 - RNA, 19 nt, Homo sapiens
ucucuacacuccaaauaua

SEQ ID NO: 876106 - RNA, 19 nt, Homo sapiens
gaggugccaauauuaauua

SEQ ID NO: 876107 - RNA, 19 nt, Homo sapiens
guacuuaccuuccuuucca

SEQ ID NO: 876108 - RNA, 19 nt, Homo sapiens
cgaaaucucuacacuccaa

SEQ ID NO: 876109 - RNA, 19 nt, Homo sapiens
gagagaagaaggagagaaa

SEQ ID NO: 876110 - RNA, 19 nt, Homo sapiens
cuaccaagcugcucuuuua

SEQ ID NO: 876111 - RNA, 19 nt, Homo sapiens
gagcagaaauguaacucau

SEQ ID NO: 876112 - RNA, 19 nt, Homo sapiens
caagagauccucccacugu

SEQ ID NO: 876113 - RNA, 19 nt, Homo sapiens
guggaugccucuucugaaa

SEQ ID NO: 876114 - RNA, 19 nt, Homo sapiens
gaagcaacaucccaucucu

SEQ ID NO: 876115 - RNA, 19 nt, Homo sapiens
ggcagggucuugcuauauu

SEQ ID NO: 876116 - RNA, 19 nt, Homo sapiens
gaggcagggucuugcuaua

SEQ ID NO: 876117 - RNA, 19 nt, Homo sapiens
ucucagagccuuagaaguu

SEQ ID NO: 876118 - RNA, 19 nt, Homo sapiens
gaacaggaccagacaccuu

SEQ ID NO: 876119 - RNA, 19 nt, Homo sapiens
aaacugcauuuauccguaa

SEQ ID NO: 876120 - RNA, 19 nt, Homo sapiens
aaaccaaauuucucuguga

SEQ ID NO: 876121 - RNA, 19 nt, Homo sapiens
caaaguaguuccuguuucg

SEQ ID NO: 876122 - RNA, 19 nt, Homo sapiens
ugccaaaccuguccuaaga

SEQ ID NO: 876123 - RNA, 19 nt, Homo sapiens
ggugaugccucuccugaau

SEQ ID NO: 876124 - RNA, 19 nt, Homo sapiens
gcucuaagccuuucaugug

SEQ ID NO: 876125 - RNA, 19 nt, Homo sapiens
uaaaagagguguuaaaguc

SEQ ID NO: 876126 - RNA, 19 nt, Homo sapiens
agacacaacuggguuaaau

SEQ ID NO: 876127 - RNA, 19 nt, Homo sapiens
ucccaaagcgcuaggauua

SEQ ID NO: 876128 - RNA, 19 nt, Homo sapiens
agaugauucucccuauuua

SEQ ID NO: 876129 - RNA, 19 nt, Homo sapiens
ccauggcacuggcgucuuu

SEQ ID NO: 876130 - RNA, 19 nt, Homo sapiens
gcagggucuugcuauauug

SEQ ID NO: 876131 - RNA, 19 nt, Homo sapiens
gacguaggccucucaauga

SEQ ID NO: 876132 - RNA, 19 nt, Homo sapiens
caagaaacgggccaaggua

SEQ ID NO: 876133 - RNA, 19 nt, Homo sapiens
caucccaucucuucccuuu

SEQ ID NO: 876134 - RNA, 19 nt, Homo sapiens
caaggugccuguaucucaa

SEQ ID NO: 876135 - RNA, 19 nt, Homo sapiens
ggaggugccaauauuaauu

SEQ ID NO: 876136 - RNA, 19 nt, Homo sapiens
ucacuuaaccucucucaau

SEQ ID NO: 876137 - RNA, 19 nt, Homo sapiens
aauccuguguccauacuua

SEQ ID NO: 876138 - RNA, 19 nt, Homo sapiens
gaauggacaccucuaggaa

SEQ ID NO: 876139 - RNA, 19 nt, Homo sapiens
ugacaucccauucauuuga

SEQ ID NO: 876140 - RNA, 19 nt, Homo sapiens
ucagagccuuagaaguuua

SEQ ID NO: 876141 - RNA, 19 nt, Homo sapiens
acacaguucuaaacccuuu

SEQ ID NO: 876142 - RNA, 19 nt, Homo sapiens
caaggucucuggaucucuu

SEQ ID NO: 876143 - RNA, 19 nt, Homo sapiens
guuaaauccuguguccaua

SEQ ID NO: 876144 - RNA, 19 nt, Homo sapiens
ggaggcaacucauuaaaau

SEQ ID NO: 876145 - RNA, 19 nt, Homo sapiens
ggacaccucuaggaacaau

SEQ ID NO: 876146 - RNA, 19 nt, Homo sapiens
acccagaaaugaucuauug

SEQ ID NO: 876147 - RNA, 19 nt, Homo sapiens
cauaacaacccagaaauga

SEQ ID NO: 876148 - RNA, 19 nt, Homo sapiens
ggacaucacauccucaaag

SEQ ID NO: 876149 - RNA, 19 nt, Homo sapiens
ccaaagcgcuaggauuaca

SEQ ID NO: 876150 - RNA, 19 nt, Homo sapiens
caacguggaugccucuucu

SEQ ID NO: 876151 - RNA, 19 nt, Homo sapiens
cuauugcugucacuucaua

SEQ ID NO: 876152 - RNA, 19 nt, Homo sapiens
guagcucacugcagucuuc

SEQ ID NO: 876153 - RNA, 19 nt, Homo sapiens
ggaugccucuucugaaagu

SEQ ID NO: 876154 - RNA, 19 nt, Homo sapiens
cuacauaacaacccagaaa

SEQ ID NO: 876155 - RNA, 19 nt, Homo sapiens
cgaugcauacucuuucuua

SEQ ID NO: 876156 - RNA, 19 nt, Homo sapiens
gcaagaaacgggccaaggu

SEQ ID NO: 876157 - RNA, 19 nt, Homo sapiens
caucuugguuacacagaaa

SEQ ID NO: 876158 - RNA, 19 nt, Homo sapiens
ugacugccauucaccaaau

SEQ ID NO: 876159 - RNA, 19 nt, Homo sapiens
uuacuccagugcaauauga

SEQ ID NO: 876160 - RNA, 19 nt, Homo sapiens
acaaagagaggaaggagaa

SEQ ID NO: 876161 - RNA, 19 nt, Homo sapiens
uaacaacccagaaaugauc

SEQ ID NO: 876162 - RNA, 19 nt, Homo sapiens
gaugcauacucuuucuuau

SEQ ID NO: 876163 - RNA, 19 nt, Homo sapiens
ucucagagguuuauuuacu

SEQ ID NO: 876164 - RNA, 19 nt, Homo sapiens
ccucuauacuggcuacauu

SEQ ID NO: 876165 - RNA, 19 nt, Homo sapiens
ucucucacguuauuucauu

SEQ ID NO: 876166 - RNA, 19 nt, Homo sapiens
aaacagagccugggcaaca

SEQ ID NO: 876167 - RNA, 19 nt, Homo sapiens
caaccucccuacauucuac

SEQ ID NO: 876168 - RNA, 19 nt, Homo sapiens
gaaaccuaccuaaccuaaa

SEQ ID NO: 876169 - RNA, 19 nt, Homo sapiens
gcgcuaggauuacaagcau

SEQ ID NO: 876170 - RNA, 19 nt, Homo sapiens
ccaccacacucagcuuuau

SEQ ID NO: 876171 - RNA, 19 nt, Homo sapiens
gcacagaaggucuuuccau

SEQ ID NO: 876172 - RNA, 19 nt, Homo sapiens
ccaaaccuguccuaagagu

SEQ ID NO: 876173 - RNA, 19 nt, Homo sapiens
aaaccuaccuaaccuaaaa

SEQ ID NO: 876174 - RNA, 19 nt, Homo sapiens
acaaaccuaugaauguaga

SEQ ID NO: 876175 - RNA, 19 nt, Homo sapiens
cauauguacuucuuucaag

SEQ ID NO: 876176 - RNA, 19 nt, Homo sapiens
gagucuggguagaguauau

SEQ ID NO: 876177 - RNA, 19 nt, Homo sapiens
ccaagcugcucuuuuaaaa

SEQ ID NO: 876178 - RNA, 19 nt, Homo sapiens
gauaagcuuuaggaucaga

SEQ ID NO: 876179 - RNA, 19 nt, Homo sapiens
aagaugauucucccuauuu

SEQ ID NO: 876180 - RNA, 19 nt, Homo sapiens
gaggaggcaacucauuaaa

SEQ ID NO: 876181 - RNA, 19 nt, Homo sapiens
caacccagucuuccuuuga

SEQ ID NO: 876182 - RNA, 19 nt, Homo sapiens
ugugacaucccauucauuu

SEQ ID NO: 876183 - RNA, 19 nt, Homo sapiens
gagcauugaaggcacacua

SEQ ID NO: 876184 - RNA, 19 nt, Homo sapiens
uggcuuaucuggagagaag

SEQ ID NO: 876185 - RNA, 19 nt, Homo sapiens
ucaccucuacuuugccuua

SEQ ID NO: 876186 - RNA, 19 nt, Homo sapiens
ucuuaucaguucuuacgua

SEQ ID NO: 876187 - RNA, 19 nt, Homo sapiens
ugaucgagcucaucucaag

SEQ ID NO: 876188 - RNA, 19 nt, Homo sapiens
gauccuaucacgccucuuc

SEQ ID NO: 876189 - RNA, 19 nt, Homo sapiens
gcucggagguuugcuaaaa

SEQ ID NO: 876190 - RNA, 19 nt, Homo sapiens
agagugcaguggcaugauu

SEQ ID NO: 876191 - RNA, 19 nt, Homo sapiens
ccuuagaaguuuacuguag

SEQ ID NO: 876192 - RNA, 19 nt, Homo sapiens
aaacuuagccauggagaug

SEQ ID NO: 876193 - RNA, 19 nt, Homo sapiens
acacaaaccucaagcuuua

SEQ ID NO: 876194 - RNA, 19 nt, Homo sapiens
gaugguaaauacugacuua

SEQ ID NO: 876195 - RNA, 19 nt, Homo sapiens
gaaagaugauggaaacaug

SEQ ID NO: 876196 - RNA, 19 nt, Homo sapiens
gauauagucuggagucuug

SEQ ID NO: 876197 - RNA, 19 nt, Homo sapiens
gaauccgucuacuguauua

SEQ ID NO: 876198 - RNA, 19 nt, Homo sapiens
cagagucgcuguguaaaua

SEQ ID NO: 876199 - RNA, 19 nt, Homo sapiens
gaaacccugucucuacuaa

SEQ ID NO: 876200 - RNA, 19 nt, Homo sapiens
aaacacugcugcugccuua

SEQ ID NO: 876201 - RNA, 19 nt, Homo sapiens
caagaaauguggucgugaa

SEQ ID NO: 876202 - RNA, 19 nt, Homo sapiens
ugugguagcuugugacuuu

SEQ ID NO: 876203 - RNA, 19 nt, Homo sapiens
gagcuugaaugugacguua

SEQ ID NO: 876204 - RNA, 19 nt, Homo sapiens
gaguuucucucguaucgua

SEQ ID NO: 876205 - RNA, 19 nt, Homo sapiens
ggauaaauacaccaugaua

SEQ ID NO: 876206 - RNA, 19 nt, Homo sapiens
gaacaaugggcguaucaaa

SEQ ID NO: 876207 - RNA, 19 nt, Homo sapiens
gcuacugcaucuuaugaua

SEQ ID NO: 876208 - RNA, 19 nt, Homo sapiens
ugaguuagaugguaaauac

SEQ ID NO: 876209 - RNA, 19 nt, Homo sapiens
ggucagagauuuaacuuuu

SEQ ID NO: 876210 - RNA, 19 nt, Homo sapiens
uggcaucgcuucagauuug

SEQ ID NO: 876211 - RNA, 19 nt, Homo sapiens
acaaggacaucgcacagua

SEQ ID NO: 876212 - RNA, 19 nt, Homo sapiens
gagaauugaugaggauuau

SEQ ID NO: 876213 - RNA, 19 nt, Homo sapiens
ggaaacaugaugaaaguau

SEQ ID NO: 876214 - RNA, 19 nt, Homo sapiens
uaugggaccugaaagauga

SEQ ID NO: 876215 - RNA, 19 nt, Homo sapiens
gugcacaccuguaguccua

SEQ ID NO: 876216 - RNA, 19 nt, Homo sapiens
agacugaucuggaagugaa

SEQ ID NO: 876217 - RNA, 19 nt, Homo sapiens
gauucugccuucccuagua

SEQ ID NO: 876218 - RNA, 19 nt, Homo sapiens
ggagaauugaugaggauua

SEQ ID NO: 876219 - RNA, 19 nt, Homo sapiens
gcuguaaagugcaaggaaa

SEQ ID NO: 876220 - RNA, 19 nt, Homo sapiens
gaaguggucagagauuuaa

SEQ ID NO: 876221 - RNA, 19 nt, Homo sapiens
ccagaugguucauacuuug

SEQ ID NO: 876222 - RNA, 19 nt, Homo sapiens
gaagaauccgucuacugua

SEQ ID NO: 876223 - RNA, 19 nt, Homo sapiens
cugcagauauuaagaaugu

SEQ ID NO: 876224 - RNA, 19 nt, Homo sapiens
acacugaguuagaugguaa

SEQ ID NO: 876225 - RNA, 19 nt, Homo sapiens
gaucagcuacuucuugcua

SEQ ID NO: 876226 - RNA, 19 nt, Homo sapiens
gccaggauauaacuagaaa

SEQ ID NO: 876227 - RNA, 19 nt, Homo sapiens
gcuugaaugugacguuauu

SEQ ID NO: 876228 - RNA, 19 nt, Homo sapiens
acguagagcuugaauguga

SEQ ID NO: 876229 - RNA, 19 nt, Homo sapiens
aguagggacugacagaaua

SEQ ID NO: 876230 - RNA, 19 nt, Homo sapiens
guacagcugugcauucucu

SEQ ID NO: 876231 - RNA, 19 nt, Homo sapiens
gagucgcuguguaaauaua

SEQ ID NO: 876232 - RNA, 19 nt, Homo sapiens
ggaauuugggcaccuguuu

SEQ ID NO: 876233 - RNA, 19 nt, Homo sapiens
gaaauguggucgugaaaau

SEQ ID NO: 876234 - RNA, 19 nt, Homo sapiens
gaaggcagagccaggauau

SEQ ID NO: 876235 - RNA, 19 nt, Homo sapiens
gaugaaacccugucucuac

SEQ ID NO: 876236 - RNA, 19 nt, Homo sapiens
gggaugauauuggugaguu

SEQ ID NO: 876237 - RNA, 19 nt, Homo sapiens
guaaagugcaaggaaauuu

SEQ ID NO: 876238 - RNA, 19 nt, Homo sapiens
gcuacaggguugaacaaug

SEQ ID NO: 876239 - RNA, 19 nt, Homo sapiens
ugaagaauccgucuacugu

SEQ ID NO: 876240 - RNA, 19 nt, Homo sapiens
ggucagcaguuugagacua

SEQ ID NO: 876241 - RNA, 19 nt, Homo sapiens
gaaaacuccuccuuaacuu

SEQ ID NO: 876242 - RNA, 19 nt, Homo sapiens
aagaauccgucuacuguau

SEQ ID NO: 876243 - RNA, 19 nt, Homo sapiens
ggagguggagguugcagua

SEQ ID NO: 876244 - RNA, 19 nt, Homo sapiens
cuacaggguugaacaaugg

SEQ ID NO: 876245 - RNA, 19 nt, Homo sapiens
ucacaccacugcacuccaa

SEQ ID NO: 876246 - RNA, 19 nt, Homo sapiens
gccacaauauguaucuuug

SEQ ID NO: 876247 - RNA, 19 nt, Homo sapiens
uaucugggauccacauaau

SEQ ID NO: 876248 - RNA, 19 nt, Homo sapiens
ugaaguggucagagauuua

SEQ ID NO: 876249 - RNA, 19 nt, Homo sapiens
gcaccaagaauguuaccaa

SEQ ID NO: 876250 - RNA, 19 nt, Homo sapiens
cagaauacacuuaacacaa

SEQ ID NO: 876251 - RNA, 19 nt, Homo sapiens
gccacucucuucucuguug

SEQ ID NO: 876252 - RNA, 19 nt, Homo sapiens
gagccaggauauaacuaga

SEQ ID NO: 876253 - RNA, 19 nt, Homo sapiens
gaaugucauccaagacgua

SEQ ID NO: 876254 - RNA, 19 nt, Homo sapiens
uuaggaaugucauccaaga

SEQ ID NO: 876255 - RNA, 19 nt, Homo sapiens
aaauaagccucgugaacau

SEQ ID NO: 876256 - RNA, 19 nt, Homo sapiens
gcaggagaauugcuugaac

SEQ ID NO: 876257 - RNA, 19 nt, Homo sapiens
guuagaugguaaauacuga

SEQ ID NO: 876258 - RNA, 19 nt, Homo sapiens
gcuuuacugacuucaauua

SEQ ID NO: 876259 - RNA, 19 nt, Homo sapiens
gguacgaucuguaucuuuu

SEQ ID NO: 876260 - RNA, 19 nt, Homo sapiens
gaugauggaaacaugauga

SEQ ID NO: 876261 - RNA, 19 nt, Homo sapiens
ugacuccagugucucguuu

SEQ ID NO: 876262 - RNA, 19 nt, Homo sapiens
caaagaagcaauacagcau

SEQ ID NO: 876263 - RNA, 19 nt, Homo sapiens
caacagagcgagacuccau

SEQ ID NO: 876264 - RNA, 19 nt, Homo sapiens
gcugcuauauguugaaugg

SEQ ID NO: 876265 - RNA, 19 nt, Homo sapiens
uaacacaaaccucaagcuu

SEQ ID NO: 876266 - RNA, 19 nt, Homo sapiens
ucccuagccugcaacauuu

SEQ ID NO: 876267 - RNA, 19 nt, Homo sapiens
gugguugacuccguacuuu

SEQ ID NO: 876268 - RNA, 19 nt, Homo sapiens
uauguugaauggacccuuu

SEQ ID NO: 876269 - RNA, 19 nt, Homo sapiens
agaauggcaucgcuucaga

SEQ ID NO: 876270 - RNA, 19 nt, Homo sapiens
aagaagcaauacagcauau

SEQ ID NO: 876271 - RNA, 19 nt, Homo sapiens
aaagaagcaauacagcaua

SEQ ID NO: 876272 - RNA, 19 nt, Homo sapiens
agacuagccuggcaaacau

SEQ ID NO: 876273 - RNA, 19 nt, Homo sapiens
gagacuagccuggcaaaca

SEQ ID NO: 876274 - RNA, 19 nt, Homo sapiens
caguagagccacaauaugu

SEQ ID NO: 876275 - RNA, 19 nt, Homo sapiens
gaauggacccuuuugcuuu

SEQ ID NO: 876276 - RNA, 19 nt, Homo sapiens
aagccuugcugaugauaaa

SEQ ID NO: 876277 - RNA, 19 nt, Homo sapiens
ccugaaagaugauggaaac

SEQ ID NO: 876278 - RNA, 19 nt, Homo sapiens
gaagcaauacagcauaucu

SEQ ID NO: 876279 - RNA, 19 nt, Homo sapiens
ggaugauauuggugaguug

SEQ ID NO: 876280 - RNA, 19 nt, Homo sapiens
gcaguaagccaagaucaca

SEQ ID NO: 876281 - RNA, 19 nt, Homo sapiens
gaauacacuuaacacaaac

SEQ ID NO: 876282 - RNA, 19 nt, Homo sapiens
gauggaaacaugaugaaag

SEQ ID NO: 876283 - RNA, 19 nt, Homo sapiens
caaggacaucgcacaguaa

SEQ ID NO: 876284 - RNA, 19 nt, Homo sapiens
agacguagagcuugaaugu

SEQ ID NO: 876285 - RNA, 19 nt, Homo sapiens
gacacugaguuagauggua

SEQ ID NO: 876286 - RNA, 19 nt, Homo sapiens
ucucguaucguauuuagaa

SEQ ID NO: 876287 - RNA, 19 nt, Homo sapiens
gcugugccuucucuacuga

SEQ ID NO: 876288 - RNA, 19 nt, Homo sapiens
uagaaggacaucaccauga

SEQ ID NO: 876289 - RNA, 19 nt, Homo sapiens
ggacaagaucagcuacuuc

SEQ ID NO: 876290 - RNA, 19 nt, Homo sapiens
ggucaucaguuccagaaaa

SEQ ID NO: 876291 - RNA, 19 nt, Homo sapiens
aggcagagccaggauauaa

SEQ ID NO: 876292 - RNA, 19 nt, Homo sapiens
gguacagggucuauugucu

SEQ ID NO: 876293 - RNA, 19 nt, Homo sapiens
acacaaaccucaagcuuua

SEQ ID NO: 876294 - RNA, 19 nt, Homo sapiens
gagcuauucugcacaguua

SEQ ID NO: 876295 - RNA, 19 nt, Homo sapiens
gaugguaaauacugacuua

SEQ ID NO: 876296 - RNA, 19 nt, Homo sapiens
agagauaucuuacgucuuu

SEQ ID NO: 876297 - RNA, 19 nt, Homo sapiens
gaaagaugauggaaacaug

SEQ ID NO: 876298 - RNA, 19 nt, Homo sapiens
gauauagucuggagucuug

SEQ ID NO: 876299 - RNA, 19 nt, Homo sapiens
gaauccgucuacuguauua

SEQ ID NO: 876300 - RNA, 19 nt, Homo sapiens
cagagucgcuguguaaaua

SEQ ID NO: 876301 - RNA, 19 nt, Homo sapiens
gaaacccugucucuacuaa

SEQ ID NO: 876302 - RNA, 19 nt, Homo sapiens
caguauagcuuugugguua

SEQ ID NO: 876303 - RNA, 19 nt, Homo sapiens
aaacacugcugcugccuua

SEQ ID NO: 876304 - RNA, 19 nt, Homo sapiens
ccuccaagcucacauuuaa

SEQ ID NO: 876305 - RNA, 19 nt, Homo sapiens
gagauugucuuaggauaaa

SEQ ID NO: 876306 - RNA, 19 nt, Homo sapiens
acacugagcauauucuuua

SEQ ID NO: 876307 - RNA, 19 nt, Homo sapiens
caagaaauguggucgugaa

SEQ ID NO: 876308 - RNA, 19 nt, Homo sapiens
ugugguagcuugugacuuu

SEQ ID NO: 876309 - RNA, 19 nt, Homo sapiens
cuacugaucuuuagaaucu

SEQ ID NO: 876310 - RNA, 19 nt, Homo sapiens
gagcuugaaugugacguua

SEQ ID NO: 876311 - RNA, 19 nt, Homo sapiens
gaguuucucucguaucgua

SEQ ID NO: 876312 - RNA, 19 nt, Homo sapiens
ggauaaauacaccaugaua

SEQ ID NO: 876313 - RNA, 19 nt, Homo sapiens
gaacaaugggcguaucaaa

SEQ ID NO: 876314 - RNA, 19 nt, Homo sapiens
gcuacugcaucuuaugaua

SEQ ID NO: 876315 - RNA, 19 nt, Homo sapiens
gagagauugucuuaggaua

SEQ ID NO: 876316 - RNA, 19 nt, Homo sapiens
ugaguuagaugguaaauac

SEQ ID NO: 876317 - RNA, 19 nt, Homo sapiens
gguguuagcugggcagaaa

SEQ ID NO: 876318 - RNA, 19 nt, Homo sapiens
ggucagagauuuaacuuuu

SEQ ID NO: 876319 - RNA, 19 nt, Homo sapiens
uggcaucgcuucagauuug

SEQ ID NO: 876320 - RNA, 19 nt, Homo sapiens
gauguccacuuucugcuuu

SEQ ID NO: 876321 - RNA, 19 nt, Homo sapiens
gcuggucgauguccacuuu

SEQ ID NO: 876322 - RNA, 19 nt, Homo sapiens
acaaggacaucgcacagua

SEQ ID NO: 876323 - RNA, 19 nt, Homo sapiens
gagaauugaugaggauuau

SEQ ID NO: 876324 - RNA, 19 nt, Homo sapiens
gaggagagauugucuuagg

SEQ ID NO: 876325 - RNA, 19 nt, Homo sapiens
ggaaacaugaugaaaguau

SEQ ID NO: 876326 - RNA, 19 nt, Homo sapiens
uaugggaccugaaagauga

SEQ ID NO: 876327 - RNA, 19 nt, Homo sapiens
gugcacaccuguaguccua

SEQ ID NO: 876328 - RNA, 19 nt, Homo sapiens
agacugaucuggaagugaa

SEQ ID NO: 876329 - RNA, 19 nt, Homo sapiens
gauucugccuucccuagua

SEQ ID NO: 876330 - RNA, 19 nt, Homo sapiens
ggagaauugaugaggauua

SEQ ID NO: 876331 - RNA, 19 nt, Homo sapiens
gcuguaaagugcaaggaaa

SEQ ID NO: 876332 - RNA, 19 nt, Homo sapiens
gaaguggucagagauuuaa

SEQ ID NO: 876333 - RNA, 19 nt, Homo sapiens
ccagaugguucauacuuug

SEQ ID NO: 876334 - RNA, 19 nt, Homo sapiens
gaagaauccgucuacugua

SEQ ID NO: 876335 - RNA, 19 nt, Homo sapiens
ccaauggaguaacaauuug

SEQ ID NO: 876336 - RNA, 19 nt, Homo sapiens
gccaauggaguaacaauuu

SEQ ID NO: 876337 - RNA, 19 nt, Homo sapiens
uaucuuacgucuuugauuc

SEQ ID NO: 876338 - RNA, 19 nt, Homo sapiens
cugcagauauuaagaaugu

SEQ ID NO: 876339 - RNA, 19 nt, Homo sapiens
acacugaguuagaugguaa

SEQ ID NO: 876340 - RNA, 19 nt, Homo sapiens
uugcaugucugccuuaauu

SEQ ID NO: 876341 - RNA, 19 nt, Homo sapiens
gcacacaggcgcacaaugg

SEQ ID NO: 876342 - RNA, 19 nt, Homo sapiens
gaucagcuacuucuugcua

SEQ ID NO: 876343 - RNA, 19 nt, Homo sapiens
gccaggauauaacuagaaa

SEQ ID NO: 876344 - RNA, 19 nt, Homo sapiens
gcuugaaugugacguuauu

SEQ ID NO: 876345 - RNA, 19 nt, Homo sapiens
acguagagcuugaauguga

SEQ ID NO: 876346 - RNA, 19 nt, Homo sapiens
aguagggacugacagaaua

SEQ ID NO: 876347 - RNA, 19 nt, Homo sapiens
aaagggagaugccaaugga

SEQ ID NO: 876348 - RNA, 19 nt, Homo sapiens
guaaacaagugauuaucuc

SEQ ID NO: 876349 - RNA, 19 nt, Homo sapiens
guacagcugugcauucucu

SEQ ID NO: 876350 - RNA, 19 nt, Homo sapiens
gacccaagccuauuguaaa

SEQ ID NO: 876351 - RNA, 19 nt, Homo sapiens
gagucgcuguguaaauaua

SEQ ID NO: 876352 - RNA, 19 nt, Homo sapiens
ggaauuugggcaccuguuu

SEQ ID NO: 876353 - RNA, 19 nt, Homo sapiens
gaaguaaacauuagaaucc

SEQ ID NO: 876354 - RNA, 19 nt, Homo sapiens
gaaauguggucgugaaaau

SEQ ID NO: 876355 - RNA, 19 nt, Homo sapiens
gaaggcagagccaggauau

SEQ ID NO: 876356 - RNA, 19 nt, Homo sapiens
gaugaaacccugucucuac

SEQ ID NO: 876357 - RNA, 19 nt, Homo sapiens
gcaugucugccuuaauuaa

SEQ ID NO: 876358 - RNA, 19 nt, Homo sapiens
ucaaaugacuuaugaucgu

SEQ ID NO: 876359 - RNA, 19 nt, Homo sapiens
gggaugauauuggugaguu

SEQ ID NO: 876360 - RNA, 19 nt, Homo sapiens
guaaagugcaaggaaauuu

SEQ ID NO: 876361 - RNA, 19 nt, Homo sapiens
aguauaagaugugccauuu

SEQ ID NO: 876362 - RNA, 19 nt, Homo sapiens
gcuacaggguugaacaaug

SEQ ID NO: 876363 - RNA, 19 nt, Homo sapiens
ugaagaauccgucuacugu

SEQ ID NO: 876364 - RNA, 19 nt, Homo sapiens
ggucagcaguuugagacua

SEQ ID NO: 876365 - RNA, 19 nt, Homo sapiens
ucauuuggcugugaauauu

SEQ ID NO: 876366 - RNA, 19 nt, Homo sapiens
gaaaacuccuccuuaacuu

SEQ ID NO: 876367 - RNA, 19 nt, Homo sapiens
aagaauccgucuacuguau

SEQ ID NO: 876368 - RNA, 19 nt, Homo sapiens
ggagguggagguugcagua

SEQ ID NO: 876369 - RNA, 19 nt, Homo sapiens
gacaagugaaaccaauuua

SEQ ID NO: 876370 - RNA, 19 nt, Homo sapiens
cuacaggguugaacaaugg

SEQ ID NO: 876371 - RNA, 19 nt, Homo sapiens
ucacaccacugcacuccaa

SEQ ID NO: 876372 - RNA, 19 nt, Homo sapiens
gccacaauauguaucuuug

SEQ ID NO: 876373 - RNA, 19 nt, Homo sapiens
uaucugggauccacauaau

SEQ ID NO: 876374 - RNA, 19 nt, Homo sapiens
ggauuucaguauagcuuug

SEQ ID NO: 876375 - RNA, 19 nt, Homo sapiens
ugaaguggucagagauuua

SEQ ID NO: 876376 - RNA, 19 nt, Homo sapiens
gcaccaagaauguuaccaa

SEQ ID NO: 876377 - RNA, 19 nt, Homo sapiens
cagaauacacuuaacacaa

SEQ ID NO: 876378 - RNA, 19 nt, Homo sapiens
gccacucucuucucuguug

SEQ ID NO: 876379 - RNA, 19 nt, Homo sapiens
agacugaaguaaacauuag

SEQ ID NO: 876380 - RNA, 19 nt, Homo sapiens
gagccaggauauaacuaga

SEQ ID NO: 876381 - RNA, 19 nt, Homo sapiens
gaaugucauccaagacgua

SEQ ID NO: 876382 - RNA, 19 nt, Homo sapiens
uuaggaaugucauccaaga

SEQ ID NO: 876383 - RNA, 19 nt, Homo sapiens
ugacaagugaaaccaauuu

SEQ ID NO: 876384 - RNA, 19 nt, Homo sapiens
aaauaagccucgugaacau

SEQ ID NO: 876385 - RNA, 19 nt, Homo sapiens
gcaggagaauugcuugaac

SEQ ID NO: 876386 - RNA, 19 nt, Homo sapiens
guuagaugguaaauacuga

SEQ ID NO: 876387 - RNA, 19 nt, Homo sapiens
gcuuuacugacuucaauua

SEQ ID NO: 876388 - RNA, 19 nt, Homo sapiens
gguacgaucuguaucuuuu

SEQ ID NO: 876389 - RNA, 19 nt, Homo sapiens
ugacuccagugucucguuu

SEQ ID NO: 876390 - RNA, 19 nt, Homo sapiens
ggaauugggagucugacaa

SEQ ID NO: 876391 - RNA, 19 nt, Homo sapiens
gaugauggaaacaugauga

SEQ ID NO: 876392 - RNA, 19 nt, Homo sapiens
caaagaagcaauacagcau

SEQ ID NO: 876393 - RNA, 19 nt, Homo sapiens
acacaaaccucaagcuuua

SEQ ID NO: 876394 - RNA, 19 nt, Homo sapiens
gaugguaaauacugacuua

SEQ ID NO: 876395 - RNA, 19 nt, Homo sapiens
gaaagaugauggaaacaug

SEQ ID NO: 876396 - RNA, 19 nt, Homo sapiens
gaauccgucuacuguauua

SEQ ID NO: 876397 - RNA, 19 nt, Homo sapiens
gaaacccugucucuacuaa

SEQ ID NO: 876398 - RNA, 19 nt, Homo sapiens
aaacacugcugcugccuua

SEQ ID NO: 876399 - RNA, 19 nt, Homo sapiens
ugugguagcuugugacuuu

SEQ ID NO: 876400 - RNA, 19 nt, Homo sapiens
gagcuugaaugugacguua

SEQ ID NO: 876401 - RNA, 19 nt, Homo sapiens
gaguuucucucguaucgua

SEQ ID NO: 876402 - RNA, 19 nt, Homo sapiens
ggauaaauacaccaugaua

SEQ ID NO: 876403 - RNA, 19 nt, Homo sapiens
gcuacugcaucuuaugaua

SEQ ID NO: 876404 - RNA, 19 nt, Homo sapiens
ugaguuagaugguaaauac

SEQ ID NO: 876405 - RNA, 19 nt, Homo sapiens
ggucagagauuuaacuuuu

SEQ ID NO: 876406 - RNA, 19 nt, Homo sapiens
gagaauugaugaggauuau

SEQ ID NO: 876407 - RNA, 19 nt, Homo sapiens
ggaaacaugaugaaaguau

SEQ ID NO: 876408 - RNA, 19 nt, Homo sapiens
uaugggaccugaaagauga

SEQ ID NO: 876409 - RNA, 19 nt, Homo sapiens
gugcacaccuguaguccua

SEQ ID NO: 876410 - RNA, 19 nt, Homo sapiens
agacugaucuggaagugaa

SEQ ID NO: 876411 - RNA, 19 nt, Homo sapiens
gauucugccuucccuagua

SEQ ID NO: 876412 - RNA, 19 nt, Homo sapiens
ggagaauugaugaggauua

SEQ ID NO: 876413 - RNA, 19 nt, Homo sapiens
gcuguaaagugcaaggaaa

SEQ ID NO: 876414 - RNA, 19 nt, Homo sapiens
gaaguggucagagauuuaa

SEQ ID NO: 876415 - RNA, 19 nt, Homo sapiens
gaagaauccgucuacugua

SEQ ID NO: 876416 - RNA, 19 nt, Homo sapiens
cugcagauauuaagaaugu

SEQ ID NO: 876417 - RNA, 19 nt, Homo sapiens
acacugaguuagaugguaa

SEQ ID NO: 876418 - RNA, 19 nt, Homo sapiens
gccaggauauaacuagaaa

SEQ ID NO: 876419 - RNA, 19 nt, Homo sapiens
gcuugaaugugacguuauu

SEQ ID NO: 876420 - RNA, 19 nt, Homo sapiens
acguagagcuugaauguga

SEQ ID NO: 876421 - RNA, 19 nt, Homo sapiens
aguagggacugacagaaua

SEQ ID NO: 876422 - RNA, 19 nt, Homo sapiens
guacagcugugcauucucu

SEQ ID NO: 876423 - RNA, 19 nt, Homo sapiens
ggaauuugggcaccuguuu

SEQ ID NO: 876424 - RNA, 19 nt, Homo sapiens
gaaggcagagccaggauau

SEQ ID NO: 876425 - RNA, 19 nt, Homo sapiens
gaugaaacccugucucuac

SEQ ID NO: 876426 - RNA, 19 nt, Homo sapiens
gggaugauauuggugaguu

SEQ ID NO: 876427 - RNA, 19 nt, Homo sapiens
guaaagugcaaggaaauuu

SEQ ID NO: 876428 - RNA, 19 nt, Homo sapiens
ugaagaauccgucuacugu

SEQ ID NO: 876429 - RNA, 19 nt, Homo sapiens
ggucagcaguuugagacua

SEQ ID NO: 876430 - RNA, 19 nt, Homo sapiens
gaaaacuccuccuuaacuu

SEQ ID NO: 876431 - RNA, 19 nt, Homo sapiens
aagaauccgucuacuguau

SEQ ID NO: 876432 - RNA, 19 nt, Homo sapiens
ggagguggagguugcagua

SEQ ID NO: 876433 - RNA, 19 nt, Homo sapiens
ucacaccacugcacuccaa

SEQ ID NO: 876434 - RNA, 19 nt, Homo sapiens
gccacaauauguaucuuug

SEQ ID NO: 876435 - RNA, 19 nt, Homo sapiens
uaucugggauccacauaau

SEQ ID NO: 876436 - RNA, 19 nt, Homo sapiens
ugaaguggucagagauuua

SEQ ID NO: 876437 - RNA, 19 nt, Homo sapiens
cagaauacacuuaacacaa

SEQ ID NO: 876438 - RNA, 19 nt, Homo sapiens
gccacucucuucucuguug

SEQ ID NO: 876439 - RNA, 19 nt, Homo sapiens
gagccaggauauaacuaga

SEQ ID NO: 876440 - RNA, 19 nt, Homo sapiens
gaaugucauccaagacgua

SEQ ID NO: 876441 - RNA, 19 nt, Homo sapiens
uuaggaaugucauccaaga

SEQ ID NO: 876442 - RNA, 19 nt, Homo sapiens
ugacuccagugucucguuu

SEQ ID NO: 876443 - RNA, 19 nt, Homo sapiens
gcaggagaauugcuugaac

SEQ ID NO: 876444 - RNA, 19 nt, Homo sapiens
guuagaugguaaauacuga

SEQ ID NO: 876445 - RNA, 19 nt, Homo sapiens
gcuuuacugacuucaauua

SEQ ID NO: 876446 - RNA, 19 nt, Homo sapiens
gguacgaucuguaucuuuu

SEQ ID NO: 876447 - RNA, 19 nt, Homo sapiens
gaugauggaaacaugauga

SEQ ID NO: 876448 - RNA, 19 nt, Homo sapiens
caaagaagcaauacagcau

SEQ ID NO: 876449 - RNA, 19 nt, Homo sapiens
caacagagcgagacuccau

SEQ ID NO: 876450 - RNA, 19 nt, Homo sapiens
gcugcuauauguugaaugg

SEQ ID NO: 876451 - RNA, 19 nt, Homo sapiens
uaacacaaaccucaagcuu

SEQ ID NO: 876452 - RNA, 19 nt, Homo sapiens
ucccuagccugcaacauuu

SEQ ID NO: 876453 - RNA, 19 nt, Homo sapiens
uauguugaauggacccuuu

SEQ ID NO: 876454 - RNA, 19 nt, Homo sapiens
gugguugacuccguacuuu

SEQ ID NO: 876455 - RNA, 19 nt, Homo sapiens
aagaagcaauacagcauau

SEQ ID NO: 876456 - RNA, 19 nt, Homo sapiens
aaagaagcaauacagcaua

SEQ ID NO: 876457 - RNA, 19 nt, Homo sapiens
agacuagccuggcaaacau

SEQ ID NO: 876458 - RNA, 19 nt, Homo sapiens
gagacuagccuggcaaaca

SEQ ID NO: 876459 - RNA, 19 nt, Homo sapiens
caguagagccacaauaugu

SEQ ID NO: 876460 - RNA, 19 nt, Homo sapiens
gaauggacccuuuugcuuu

SEQ ID NO: 876461 - RNA, 19 nt, Homo sapiens
aagccuugcugaugauaaa

SEQ ID NO: 876462 - RNA, 19 nt, Homo sapiens
ccugaaagaugauggaaac

SEQ ID NO: 876463 - RNA, 19 nt, Homo sapiens
gaagcaauacagcauaucu

SEQ ID NO: 876464 - RNA, 19 nt, Homo sapiens
ggaugauauuggugaguug

SEQ ID NO: 876465 - RNA, 19 nt, Homo sapiens
gcaguaagccaagaucaca

SEQ ID NO: 876466 - RNA, 19 nt, Homo sapiens
gaauacacuuaacacaaac

SEQ ID NO: 876467 - RNA, 19 nt, Homo sapiens
gauggaaacaugaugaaag

SEQ ID NO: 876468 - RNA, 19 nt, Homo sapiens
agacguagagcuugaaugu

SEQ ID NO: 876469 - RNA, 19 nt, Homo sapiens
gacacugaguuagauggua

SEQ ID NO: 876470 - RNA, 19 nt, Homo sapiens
ucucguaucguauuuagaa

SEQ ID NO: 876471 - RNA, 19 nt, Homo sapiens
gcugugccuucucuacuga

SEQ ID NO: 876472 - RNA, 19 nt, Homo sapiens
uagaaggacaucaccauga

SEQ ID NO: 876473 - RNA, 19 nt, Homo sapiens
gguacagggucuauugucu

SEQ ID NO: 876474 - RNA, 19 nt, Homo sapiens
aggcagagccaggauauaa

SEQ ID NO: 876475 - RNA, 19 nt, Homo sapiens
guagagccacaauauguau

SEQ ID NO: 876476 - RNA, 19 nt, Homo sapiens
ggacugacagaauacacuu

SEQ ID NO: 876477 - RNA, 19 nt, Homo sapiens
gauaaauacaccaugauac

SEQ ID NO: 876478 - RNA, 19 nt, Homo sapiens
gaguaugggaccugaaaga

SEQ ID NO: 876479 - RNA, 19 nt, Homo sapiens
uguguugccucauacgaaa

SEQ ID NO: 876480 - RNA, 19 nt, Homo sapiens
cuugguagaucauacugaa

SEQ ID NO: 876481 - RNA, 19 nt, Homo sapiens
guugugaauuugaagaauc

SEQ ID NO: 876482 - RNA, 19 nt, Homo sapiens
aagcuuuacugacuucaau

SEQ ID NO: 876483 - RNA, 19 nt, Homo sapiens
ugacagaauacacuuaaca

SEQ ID NO: 876484 - RNA, 19 nt, Homo sapiens
ccaccuacuccaauauuug

SEQ ID NO: 876485 - RNA, 19 nt, Homo sapiens
ggucgccacucucuucucu

SEQ ID NO: 876486 - RNA, 19 nt, Homo sapiens
ccgauuccuuccaagcuuu

SEQ ID NO: 876487 - RNA, 19 nt, Homo sapiens
gucccuagccugcaacauu

SEQ ID NO: 876488 - RNA, 19 nt, Homo sapiens
cagaguaugggaccugaaa

SEQ ID NO: 876489 - RNA, 19 nt, Homo sapiens
caguuuauguacagggaaa

SEQ ID NO: 876490 - RNA, 19 nt, Homo sapiens
gauuauccagugcaaguug

SEQ ID NO: 876491 - RNA, 19 nt, Homo sapiens
gaauuugggcaccuguuuc

SEQ ID NO: 876492 - RNA, 19 nt, Homo sapiens
guaugggaccugaaagaug

SEQ ID NO: 876493 - RNA, 19 nt, Homo sapiens
gagaagcgcugcccuguga

SEQ ID NO: 876494 - RNA, 19 nt, Homo sapiens
ggaagaagcugcagaaggu

SEQ ID NO: 876495 - RNA, 19 nt, Homo sapiens
ccugaaagcuguuggauuu

SEQ ID NO: 876496 - RNA, 19 nt, Homo sapiens
gaaucaugcuguucucuuu

SEQ ID NO: 876497 - RNA, 19 nt, Homo sapiens
gcagcaaucugucuuuaga

SEQ ID NO: 876498 - RNA, 19 nt, Homo sapiens
ggaguaaccggacaccuua

SEQ ID NO: 876499 - RNA, 19 nt, Homo sapiens
ggaauuauccugacagaca

SEQ ID NO: 876500 - RNA, 19 nt, Homo sapiens
cgauacagcuuggcacuuu

SEQ ID NO: 876501 - RNA, 19 nt, Homo sapiens
ggacaaagccagccaagag

SEQ ID NO: 876502 - RNA, 19 nt, Homo sapiens
gauacagcuuggcacuuua

SEQ ID NO: 876503 - RNA, 19 nt, Homo sapiens
cagcagcaaucugucuuua

SEQ ID NO: 876504 - RNA, 19 nt, Homo sapiens
gaauuauccugacagacaa

SEQ ID NO: 876505 - RNA, 19 nt, Homo sapiens
ggacagaccagcagcaauc

SEQ ID NO: 876506 - RNA, 19 nt, Homo sapiens
ucuagucccuucucucuuu

SEQ ID NO: 876507 - RNA, 19 nt, Homo sapiens
gaccaaagcauuucuaguc

SEQ ID NO: 876508 - RNA, 19 nt, Homo sapiens
ggaaccugcuggacuuaga

SEQ ID NO: 876509 - RNA, 19 nt, Homo sapiens
acaccuagauuuauuugga

SEQ ID NO: 876510 - RNA, 19 nt, Homo sapiens
gagaacguguccauauaca

SEQ ID NO: 876511 - RNA, 19 nt, Homo sapiens
gcaccggccucuauuuguc

SEQ ID NO: 876512 - RNA, 19 nt, Homo sapiens
uugagaacguguccauaua

SEQ ID NO: 876513 - RNA, 19 nt, Homo sapiens
caaaagaugccuugaauau

SEQ ID NO: 876514 - RNA, 19 nt, Homo sapiens
gaucguggcuacagcuaag

SEQ ID NO: 876515 - RNA, 19 nt, Homo sapiens
ccugacaccuagauuuauu

SEQ ID NO: 876516 - RNA, 19 nt, Homo sapiens
ggacugugaccaaagcauu

SEQ ID NO: 876517 - RNA, 19 nt, Homo sapiens
cagacaagaugcacgacaa

SEQ ID NO: 876518 - RNA, 19 nt, Homo sapiens
ccugagaacuggacagaca

SEQ ID NO: 876519 - RNA, 19 nt, Homo sapiens
uaucaggacugugaccaaa

SEQ ID NO: 876520 - RNA, 19 nt, Homo sapiens
acgacaagguguuugcaua

SEQ ID NO: 876521 - RNA, 19 nt, Homo sapiens
uaugaccacuuuacagaug

SEQ ID NO: 876522 - RNA, 19 nt, Homo sapiens
cuagcugucucucuuguug

SEQ ID NO: 876523 - RNA, 19 nt, Homo sapiens
gaguagaacccaggucuga

SEQ ID NO: 876524 - RNA, 19 nt, Homo sapiens
gggauuugcagggucauua

SEQ ID NO: 876525 - RNA, 19 nt, Homo sapiens
aaccugacaccuagauuua

SEQ ID NO: 876526 - RNA, 19 nt, Homo sapiens
aaaccugacaccuagauuu

SEQ ID NO: 876527 - RNA, 19 nt, Homo sapiens
gaugaccucuucagcuucu

SEQ ID NO: 876528 - RNA, 19 nt, Homo sapiens
caagguguuugcauacauc

SEQ ID NO: 876529 - RNA, 19 nt, Homo sapiens
uuacagaugaggaaacuga

SEQ ID NO: 876530 - RNA, 19 nt, Homo sapiens
uucagugacuucuggcuua

SEQ ID NO: 876531 - RNA, 19 nt, Homo sapiens
ccaaggaagagaaagagaa

SEQ ID NO: 876532 - RNA, 19 nt, Homo sapiens
gugaaacuuuaaugaggaa

SEQ ID NO: 876533 - RNA, 19 nt, Homo sapiens
caaucugucuuuagaaucg

SEQ ID NO: 876534 - RNA, 19 nt, Homo sapiens
guagaacccaggucugaug

SEQ ID NO: 876535 - RNA, 19 nt, Homo sapiens
gcuguuggauuucagugau

SEQ ID NO: 876536 - RNA, 19 nt, Homo sapiens
gucuugcugugcuuuauuu

SEQ ID NO: 876537 - RNA, 19 nt, Homo sapiens
uuucuaaggacccaaauuu

SEQ ID NO: 876538 - RNA, 19 nt, Homo sapiens
aggaugaccucuucagcuu

SEQ ID NO: 876539 - RNA, 19 nt, Homo sapiens
gacaagguguuugcauaca

SEQ ID NO: 876540 - RNA, 19 nt, Homo sapiens
ucaccaaccagcucauuga

SEQ ID NO: 876541 - RNA, 19 nt, Homo sapiens
cagacaaccucaccaacca

SEQ ID NO: 876542 - RNA, 19 nt, Homo sapiens
cagcccaggacaugcauua

SEQ ID NO: 876543 - RNA, 19 nt, Homo sapiens
gaaagagaagagggacaaa

SEQ ID NO: 876544 - RNA, 19 nt, Homo sapiens
uagaaucgcuuuccuuccu

SEQ ID NO: 876545 - RNA, 19 nt, Homo sapiens
caccuagauuuauuuggaa

SEQ ID NO: 876546 - RNA, 19 nt, Homo sapiens
gugcuuggaaccaguguaa

SEQ ID NO: 876547 - RNA, 19 nt, Homo sapiens
gcaagcugccugagaacug

SEQ ID NO: 876548 - RNA, 19 nt, Homo sapiens
caugugcagugcuguaauc

SEQ ID NO: 876549 - RNA, 19 nt, Homo sapiens
gaaaccugacaccuagauu

SEQ ID NO: 876550 - RNA, 19 nt, Homo sapiens
gaguccagcuuuccuucug

SEQ ID NO: 876551 - RNA, 19 nt, Homo sapiens
gaugauggccuggaugaag

SEQ ID NO: 876552 - RNA, 19 nt, Homo sapiens
gaagcgcugcccugugaga

SEQ ID NO: 876553 - RNA, 19 nt, Homo sapiens
gcagggucauuaucagaac

SEQ ID NO: 876554 - RNA, 19 nt, Homo sapiens
gcuguucucuuugcugaca

SEQ ID NO: 876555 - RNA, 19 nt, Homo sapiens
gggcagcuccugaccaaag

SEQ ID NO: 876556 - RNA, 19 nt, Homo sapiens
uggccuggaugaagcguuu

SEQ ID NO: 876557 - RNA, 19 nt, Homo sapiens
ccugcuagcugucucucuu

SEQ ID NO: 876558 - RNA, 19 nt, Homo sapiens
acgcaaggcugugcucuuc

SEQ ID NO: 876559 - RNA, 19 nt, Homo sapiens
ccauggugcugcauugagu

SEQ ID NO: 876560 - RNA, 19 nt, Homo sapiens
ggcagcuccugaccaaaga

SEQ ID NO: 876561 - RNA, 19 nt, Homo sapiens
ugacagacaaccucaccaa

SEQ ID NO: 876562 - RNA, 19 nt, Homo sapiens
gcacagcagacaagaugca

SEQ ID NO: 876563 - RNA, 19 nt, Homo sapiens
aaaugcaaguguuugaagu

SEQ ID NO: 876564 - RNA, 19 nt, Homo sapiens
acccaggucugaugccaaa

SEQ ID NO: 876565 - RNA, 19 nt, Homo sapiens
gcaaggcugugcucuuccu

SEQ ID NO: 876566 - RNA, 19 nt, Homo sapiens
guggguaucaggacuguga

SEQ ID NO: 876567 - RNA, 19 nt, Homo sapiens
ugacaugugcagugcugua

SEQ ID NO: 876568 - RNA, 19 nt, Homo sapiens
cggccucuauuugucauaa

SEQ ID NO: 876569 - RNA, 19 nt, Homo sapiens
cagaacaugaggauaacuu

SEQ ID NO: 876570 - RNA, 19 nt, Homo sapiens
ggauuugcagggucauuau

SEQ ID NO: 876571 - RNA, 19 nt, Homo sapiens
ccacuuuacagaugaggaa

SEQ ID NO: 876572 - RNA, 19 nt, Homo sapiens
ucuaugaccacuuuacaga

SEQ ID NO: 876573 - RNA, 19 nt, Homo sapiens
gacugugaccaaagcauuu

SEQ ID NO: 876574 - RNA, 19 nt, Homo sapiens
gacaugugcagugcuguaa

SEQ ID NO: 876575 - RNA, 19 nt, Homo sapiens
caaggaagagaaagagaag

SEQ ID NO: 876576 - RNA, 19 nt, Homo sapiens
gcauuaacagcagguguga

SEQ ID NO: 876577 - RNA, 19 nt, Homo sapiens
gcaaucugucuuuagaauc

SEQ ID NO: 876578 - RNA, 19 nt, Homo sapiens
cugucucucuuguugauuu

SEQ ID NO: 876579 - RNA, 19 nt, Homo sapiens
ucaaguaccugggcaugac

SEQ ID NO: 876580 - RNA, 19 nt, Homo sapiens
uuuaagcccugcucuuucu

SEQ ID NO: 876581 - RNA, 19 nt, Homo sapiens
agcaaucugucuuuagaau

SEQ ID NO: 876582 - RNA, 19 nt, Homo sapiens
gcauccugcuuccugaaag

SEQ ID NO: 876583 - RNA, 19 nt, Homo sapiens
uugcugugcuuuauuugug

SEQ ID NO: 876584 - RNA, 19 nt, Homo sapiens
uuccugggaugauguguga

SEQ ID NO: 876585 - RNA, 19 nt, Homo sapiens
ucagugacuucuggcuuau

SEQ ID NO: 876586 - RNA, 19 nt, Homo sapiens
cugggaaccugcuggacuu

SEQ ID NO: 876587 - RNA, 19 nt, Homo sapiens
cgacaagguguuugcauac

SEQ ID NO: 876588 - RNA, 19 nt, Homo sapiens
gcugugcuuuauuugugaa

SEQ ID NO: 876589 - RNA, 19 nt, Homo sapiens
gcaaagccuccagcaucuu

SEQ ID NO: 876590 - RNA, 19 nt, Homo sapiens
acaagguguuugcauacau

SEQ ID NO: 876591 - RNA, 19 nt, Homo sapiens
ggagccucguguccugcua

SEQ ID NO: 876592 - RNA, 19 nt, Homo sapiens
ccuccauggugcugcauug

SEQ ID NO: 876593 - RNA, 19 nt, Homo sapiens
gcucuuagcugaucucgaa

SEQ ID NO: 876594 - RNA, 19 nt, Homo sapiens
gcuacgaacugaaggauga

SEQ ID NO: 876595 - RNA, 19 nt, Homo sapiens
gagcugaacaucauccaua

SEQ ID NO: 876596 - RNA, 19 nt, Homo sapiens
gauaaguacucaaagagau

SEQ ID NO: 876597 - RNA, 19 nt, Homo sapiens
ugaugaagauugaggagua

SEQ ID NO: 876598 - RNA, 19 nt, Homo sapiens
gcaacagccuggacaagug

SEQ ID NO: 876599 - RNA, 19 nt, Homo sapiens
agacacagcuggaucuuuc

SEQ ID NO: 876600 - RNA, 19 nt, Homo sapiens
uaagauguuugcugagauu

SEQ ID NO: 876601 - RNA, 19 nt, Homo sapiens
ucaaagagauucccugaac

SEQ ID NO: 876602 - RNA, 19 nt, Homo sapiens
acacagagguccaguccuu

SEQ ID NO: 876603 - RNA, 19 nt, Homo sapiens
ccaaugcacuggauuacau

SEQ ID NO: 876604 - RNA, 19 nt, Homo sapiens
gagauuaugaugaagauug

SEQ ID NO: 876605 - RNA, 19 nt, Homo sapiens
gagaagaguggccuuaugu

SEQ ID NO: 876606 - RNA, 19 nt, Homo sapiens
gcagguaccgcaagaugaa

SEQ ID NO: 876607 - RNA, 19 nt, Homo sapiens
cagcagauccucaccaaug

SEQ ID NO: 876608 - RNA, 19 nt, Homo sapiens
cgagaagaguggccuuaug

SEQ ID NO: 876609 - RNA, 19 nt, Homo sapiens
cguaugagcuucggagaga

SEQ ID NO: 876610 - RNA, 19 nt, Homo sapiens
ggaagcaggccaaccguau

SEQ ID NO: 876611 - RNA, 19 nt, Homo sapiens
gauguuugcugagauuaug

SEQ ID NO: 876612 - RNA, 19 nt, Homo sapiens
gaagcagagcgucguauau

SEQ ID NO: 876613 - RNA, 19 nt, Homo sapiens
cccaaccuguccaucauua

SEQ ID NO: 876614 - RNA, 19 nt, Homo sapiens
ggauaaguacucaaagaga

SEQ ID NO: 876615 - RNA, 19 nt, Homo sapiens
ggaggaaggaggaagcuau

SEQ ID NO: 876616 - RNA, 19 nt, Homo sapiens
gaaggugggcuacgaacug

SEQ ID NO: 876617 - RNA, 19 nt, Homo sapiens
cgggauaaguacucaaaga

SEQ ID NO: 876618 - RNA, 19 nt, Homo sapiens
uugcugagauuaugaugaa

SEQ ID NO: 876619 - RNA, 19 nt, Homo sapiens
gaugaagauugaggaguau

SEQ ID NO: 876620 - RNA, 19 nt, Homo sapiens
uaacugagaaaggagauuu

SEQ ID NO: 876621 - RNA, 19 nt, Homo sapiens
gcacccaaccuguccauca

SEQ ID NO: 876622 - RNA, 19 nt, Homo sapiens
cgagaucaccgcccaguau

SEQ ID NO: 876623 - RNA, 19 nt, Homo sapiens
gggaggaggccuuggaaga

SEQ ID NO: 876624 - RNA, 19 nt, Homo sapiens
ggccuuauguccaccugaa

SEQ ID NO: 876625 - RNA, 19 nt, Homo sapiens
guaagauguuugcugagau

SEQ ID NO: 876626 - RNA, 19 nt, Homo sapiens
gaggaggccuuggaagagu

SEQ ID NO: 876627 - RNA, 19 nt, Homo sapiens
ucaaggagcugggcaacag

SEQ ID NO: 876628 - RNA, 19 nt, Homo sapiens
ugaacaucauccauaaguu

SEQ ID NO: 876629 - RNA, 19 nt, Homo sapiens
gaugagaucgagcgcaaau

SEQ ID NO: 876630 - RNA, 19 nt, Homo sapiens
gcagaagcagagcgucgua

SEQ ID NO: 876631 - RNA, 19 nt, Homo sapiens
gaagcaggccaaccguaug

SEQ ID NO: 876632 - RNA, 19 nt, Homo sapiens
caaagagauucccugaacu

SEQ ID NO: 876633 - RNA, 19 nt, Homo sapiens
gagcgcaaauucgacaagu

SEQ ID NO: 876634 - RNA, 19 nt, Homo sapiens
ugagaucgagcgcaaauuc

SEQ ID NO: 876635 - RNA, 19 nt, Homo sapiens
aguaagauguuugcugaga

SEQ ID NO: 876636 - RNA, 19 nt, Homo sapiens
gggauucagucaagaccau

SEQ ID NO: 876637 - RNA, 19 nt, Homo sapiens
agaagcagagcgucguaua

SEQ ID NO: 876638 - RNA, 19 nt, Homo sapiens
acaagugcaagaacaauga

SEQ ID NO: 876639 - RNA, 19 nt, Homo sapiens
ggacaagugcaagaacaau

SEQ ID NO: 876640 - RNA, 19 nt, Homo sapiens
gagguccaguccuucugaa

SEQ ID NO: 876641 - RNA, 19 nt, Homo sapiens
uagagcaggucuucaucau

SEQ ID NO: 876642 - RNA, 19 nt, Homo sapiens
gaggaaggaggaagcuaug

SEQ ID NO: 876643 - RNA, 19 nt, Homo sapiens
cagcccguguggacaguuu

SEQ ID NO: 876644 - RNA, 19 nt, Homo sapiens
gcaccgcaucuacgaguau

SEQ ID NO: 876645 - RNA, 19 nt, Homo sapiens
acauggcgcuggagcugaa

SEQ ID NO: 876646 - RNA, 19 nt, Homo sapiens
gaagauugaggaguauauc

SEQ ID NO: 876647 - RNA, 19 nt, Homo sapiens
gcugagauuaugaugaaga

SEQ ID NO: 876648 - RNA, 19 nt, Homo sapiens
gagaucaccgcccaguaug

SEQ ID NO: 876649 - RNA, 19 nt, Homo sapiens
gacaagugcaagaacaaug

SEQ ID NO: 876650 - RNA, 19 nt, Homo sapiens
cgaagaggcagcagaagag

SEQ ID NO: 876651 - RNA, 19 nt, Homo sapiens
ucccugaacuggaguccuu

SEQ ID NO: 876652 - RNA, 19 nt, Homo sapiens
gagacacagcuggaucuuu

SEQ ID NO: 876653 - RNA, 19 nt, Homo sapiens
ggaggaggccuuggaagag

SEQ ID NO: 876654 - RNA, 19 nt, Homo sapiens
caaccuguccaucauuauc

SEQ ID NO: 876655 - RNA, 19 nt, Homo sapiens
aggccaaccagaaguauuu

SEQ ID NO: 876656 - RNA, 19 nt, Homo sapiens
gcaagaacaaugagaaccu

SEQ ID NO: 876657 - RNA, 19 nt, Homo sapiens
gaaaacgagcugaacauca

SEQ ID NO: 876658 - RNA, 19 nt, Homo sapiens
aagcagagcgucguauaug

SEQ ID NO: 876659 - RNA, 19 nt, Homo sapiens
aaagagauucccugaacug

SEQ ID NO: 876660 - RNA, 19 nt, Homo sapiens
caucauccauaaguucauc

SEQ ID NO: 876661 - RNA, 19 nt, Homo sapiens
aaaacgagcugaacaucau

SEQ ID NO: 876662 - RNA, 19 nt, Homo sapiens
ccacaccggcuacaucuac

SEQ ID NO: 876663 - RNA, 19 nt, Homo sapiens
ccaagcaccgcaucuacga

SEQ ID NO: 876664 - RNA, 19 nt, Homo sapiens
gggauaaguacucaaagag

SEQ ID NO: 876665 - RNA, 19 nt, Homo sapiens
caagaccaucgccaagcua

SEQ ID NO: 876666 - RNA, 19 nt, Homo sapiens
ucaagaccaucgccaagcu

SEQ ID NO: 876667 - RNA, 19 nt, Homo sapiens
ucgaagaggcagcagaaga

SEQ ID NO: 876668 - RNA, 19 nt, Homo sapiens
agcugaacaucauccauaa

SEQ ID NO: 876669 - RNA, 19 nt, Homo sapiens
ugaagauugaggaguauau

SEQ ID NO: 876670 - RNA, 19 nt, Homo sapiens
gaagaggaggaaggaggaa

SEQ ID NO: 876671 - RNA, 19 nt, Homo sapiens
aaggugggcuacgaacuga

SEQ ID NO: 876672 - RNA, 19 nt, Homo sapiens
cacccaaccuguccaucau

SEQ ID NO: 876673 - RNA, 19 nt, Homo sapiens
gggcuaggaucggguucug

SEQ ID NO: 876674 - RNA, 19 nt, Homo sapiens
aagcaggccaaccguauga

SEQ ID NO: 876675 - RNA, 19 nt, Homo sapiens
uauguggagucccggaugu

SEQ ID NO: 876676 - RNA, 19 nt, Homo sapiens
gcgagaagaguggccuuau

SEQ ID NO: 876677 - RNA, 19 nt, Homo sapiens
uaucagcaagcaagccaaa

SEQ ID NO: 876678 - RNA, 19 nt, Homo sapiens
gaggccaaccagaaguauu

SEQ ID NO: 876679 - RNA, 19 nt, Homo sapiens
agccagcgaucgaggaugu

SEQ ID NO: 876680 - RNA, 19 nt, Homo sapiens
ggcgagaagaguggccuua

SEQ ID NO: 876681 - RNA, 19 nt, Homo sapiens
uaugggauaguaagauguu

SEQ ID NO: 876682 - RNA, 19 nt, Homo sapiens
ggcaacagccuggacaagu

SEQ ID NO: 876683 - RNA, 19 nt, Homo sapiens
ucucgaagaggcagcagaa

SEQ ID NO: 876684 - RNA, 19 nt, Homo sapiens
ggucaagggcgagaagagu

SEQ ID NO: 876685 - RNA, 19 nt, Homo sapiens
ugcagcagauccucaccaa

SEQ ID NO: 876686 - RNA, 19 nt, Homo sapiens
cugagauuaugaugaagau

SEQ ID NO: 876687 - RNA, 19 nt, Homo sapiens
caccaaugccaccaucaug

SEQ ID NO: 876688 - RNA, 19 nt, Homo sapiens
cugaacaucauccauaagu

SEQ ID NO: 876689 - RNA, 19 nt, Homo sapiens
ggaaagggauggaucgaua

SEQ ID NO: 876690 - RNA, 19 nt, Homo sapiens
gaaagaaucguaagaauga

SEQ ID NO: 876691 - RNA, 19 nt, Homo sapiens
gaaaugggauccugcauca

SEQ ID NO: 876692 - RNA, 19 nt, Homo sapiens
gaugaagccucuuaugaaa

SEQ ID NO: 876693 - RNA, 19 nt, Homo sapiens
gaaaagauguugaaacuga

SEQ ID NO: 876694 - RNA, 19 nt, Homo sapiens
gaaaaucacuaccuuguaa

SEQ ID NO: 876695 - RNA, 19 nt, Homo sapiens
ggaccaagcuaaccauuca

SEQ ID NO: 876696 - RNA, 19 nt, Homo sapiens
ucacaaaguucaagaaugu

SEQ ID NO: 876697 - RNA, 19 nt, Homo sapiens
ccagguauguauugcauua

SEQ ID NO: 876698 - RNA, 19 nt, Homo sapiens
ggaccuaaauggacuauag

SEQ ID NO: 876699 - RNA, 19 nt, Homo sapiens
ggacagugauagugaagaa

SEQ ID NO: 876700 - RNA, 19 nt, Homo sapiens
gcaaccagauuaugauaug

SEQ ID NO: 876701 - RNA, 19 nt, Homo sapiens
aaacgaagaugauuaccuu

SEQ ID NO: 876702 - RNA, 19 nt, Homo sapiens
ccagaaagauugggcuuaa

SEQ ID NO: 876703 - RNA, 19 nt, Homo sapiens
ccaagaagauguauaggau

SEQ ID NO: 876704 - RNA, 19 nt, Homo sapiens
agagugacauuaagcaaua

SEQ ID NO: 876705 - RNA, 19 nt, Homo sapiens
agagcaacgucaacuauua

SEQ ID NO: 876706 - RNA, 19 nt, Homo sapiens
ggaaucggaacaucauuua

SEQ ID NO: 876707 - RNA, 19 nt, Homo sapiens
gaccaaugcuuccaguaaa

SEQ ID NO: 876708 - RNA, 19 nt, Homo sapiens
ggacaugccugaucucaac

SEQ ID NO: 876709 - RNA, 19 nt, Homo sapiens
aaacugagacgagaauuua

SEQ ID NO: 876710 - RNA, 19 nt, Homo sapiens
gaaauuaagccuuugcaau

SEQ ID NO: 876711 - RNA, 19 nt, Homo sapiens
gauccugcaucacuuguuu

SEQ ID NO: 876712 - RNA, 19 nt, Homo sapiens
gcagugagguagccaagga

SEQ ID NO: 876713 - RNA, 19 nt, Homo sapiens
cgaagaugauuaccuuauu

SEQ ID NO: 876714 - RNA, 19 nt, Homo sapiens
cagcaaguguuuagagaaa

SEQ ID NO: 876715 - RNA, 19 nt, Homo sapiens
gcaaguaacggguuggaaa

SEQ ID NO: 876716 - RNA, 19 nt, Homo sapiens
ggcagacugugaacaauaa

SEQ ID NO: 876717 - RNA, 19 nt, Homo sapiens
ggaccaaugcuuccaguaa

SEQ ID NO: 876718 - RNA, 19 nt, Homo sapiens
gcaaggacaugccugaucu

SEQ ID NO: 876719 - RNA, 19 nt, Homo sapiens
gaaacugagacgagaauuu

SEQ ID NO: 876720 - RNA, 19 nt, Homo sapiens
aaacagcaaucucagcauu

SEQ ID NO: 876721 - RNA, 19 nt, Homo sapiens
cugaaaugcugaauaguuu

SEQ ID NO: 876722 - RNA, 19 nt, Homo sapiens
cagcaacucuucauaaugg

SEQ ID NO: 876723 - RNA, 19 nt, Homo sapiens
cagacaacuuucccuguua

SEQ ID NO: 876724 - RNA, 19 nt, Homo sapiens
gcuaggaaaugaaauucuu

SEQ ID NO: 876725 - RNA, 19 nt, Homo sapiens
guggugaaauccuuaauga

SEQ ID NO: 876726 - RNA, 19 nt, Homo sapiens
ccaagccgcugccuaucua

SEQ ID NO: 876727 - RNA, 19 nt, Homo sapiens
gaagugacauaaccuaaaa

SEQ ID NO: 876728 - RNA, 19 nt, Homo sapiens
gaaaucaucacaaaguuca

SEQ ID NO: 876729 - RNA, 19 nt, Homo sapiens
cagcaagaauggcauauca

SEQ ID NO: 876730 - RNA, 19 nt, Homo sapiens
gcagugcaccucaauaaug

SEQ ID NO: 876731 - RNA, 19 nt, Homo sapiens
gaucgauacaugcaaauuu

SEQ ID NO: 876732 - RNA, 19 nt, Homo sapiens
ggaagugacauaaccuaaa

SEQ ID NO: 876733 - RNA, 19 nt, Homo sapiens
cgagaauuauugcacuuaa

SEQ ID NO: 876734 - RNA, 19 nt, Homo sapiens
ccaaaacaguucauucaua

SEQ ID NO: 876735 - RNA, 19 nt, Homo sapiens
guacaaaggagaguuuaaa

SEQ ID NO: 876736 - RNA, 19 nt, Homo sapiens
ggacagagugccaaagguu

SEQ ID NO: 876737 - RNA, 19 nt, Homo sapiens
gaacaauuccugccugaca

SEQ ID NO: 876738 - RNA, 19 nt, Homo sapiens
uaagcacccucaucauuug

SEQ ID NO: 876739 - RNA, 19 nt, Homo sapiens
gggcuuaaauggaauagca

SEQ ID NO: 876740 - RNA, 19 nt, Homo sapiens
cagcucagaugaagaugaa

SEQ ID NO: 876741 - RNA, 19 nt, Homo sapiens
gaaccacgaaccagaaaga

SEQ ID NO: 876742 - RNA, 19 nt, Homo sapiens
ucagacaacuuucccuguu

SEQ ID NO: 876743 - RNA, 19 nt, Homo sapiens
ccacgaaccagaaagauug

SEQ ID NO: 876744 - RNA, 19 nt, Homo sapiens
gcaguuaguucagaugcaa

SEQ ID NO: 876745 - RNA, 19 nt, Homo sapiens
aagaauggcauaucaguaa

SEQ ID NO: 876746 - RNA, 19 nt, Homo sapiens
ugaagaauguaccucaaga

SEQ ID NO: 876747 - RNA, 19 nt, Homo sapiens
ggaaaugauuaagagaaga

SEQ ID NO: 876748 - RNA, 19 nt, Homo sapiens
guagugguguuucagaaug

SEQ ID NO: 876749 - RNA, 19 nt, Homo sapiens
cagcaucuguagcuuuauu

SEQ ID NO: 876750 - RNA, 19 nt, Homo sapiens
aaacuaagcacccucauca

SEQ ID NO: 876751 - RNA, 19 nt, Homo sapiens
gagcaaccagauuaugaua

SEQ ID NO: 876752 - RNA, 19 nt, Homo sapiens
caacuuucccuguuacuug

SEQ ID NO: 876753 - RNA, 19 nt, Homo sapiens
ggaggguuguggcaagauu

SEQ ID NO: 876754 - RNA, 19 nt, Homo sapiens
gcucugaccugugcugaug

SEQ ID NO: 876755 - RNA, 19 nt, Homo sapiens
gaauauccacagaacauga

SEQ ID NO: 876756 - RNA, 19 nt, Homo sapiens
gcagaggcuuugauaacau

SEQ ID NO: 876757 - RNA, 19 nt, Homo sapiens
aagaagaaguacccaaaga

SEQ ID NO: 876758 - RNA, 19 nt, Homo sapiens
gcaacugaauggauuuuaa

SEQ ID NO: 876759 - RNA, 19 nt, Homo sapiens
gcacuugaauuugcaacug

SEQ ID NO: 876760 - RNA, 19 nt, Homo sapiens
gaucacagaguguaacaau

SEQ ID NO: 876761 - RNA, 19 nt, Homo sapiens
guauuaugcuccucguuug

SEQ ID NO: 876762 - RNA, 19 nt, Homo sapiens
uaucagaaccggaagaaga

SEQ ID NO: 876763 - RNA, 19 nt, Homo sapiens
ccugagacauugccuguga

SEQ ID NO: 876764 - RNA, 19 nt, Homo sapiens
gaagaaguacccaaagaag

SEQ ID NO: 876765 - RNA, 19 nt, Homo sapiens
cuaagcacccucaucauuu

SEQ ID NO: 876766 - RNA, 19 nt, Homo sapiens
ugauauggauucagaagau

SEQ ID NO: 876767 - RNA, 19 nt, Homo sapiens
agauugggcuuaaauggaa

SEQ ID NO: 876768 - RNA, 19 nt, Homo sapiens
gaaagauugggcuuaaaug

SEQ ID NO: 876769 - RNA, 19 nt, Homo sapiens
ugcagcaucuguagcuuua

SEQ ID NO: 876770 - RNA, 19 nt, Homo sapiens
gggcagacugugaacaaua

SEQ ID NO: 876771 - RNA, 19 nt, Homo sapiens
gaagaauguaccucaagaa

SEQ ID NO: 876772 - RNA, 19 nt, Homo sapiens
acagauagacccugaaaug

SEQ ID NO: 876773 - RNA, 19 nt, Homo sapiens
uggcagauuuggauaaguu

SEQ ID NO: 876774 - RNA, 19 nt, Homo sapiens
caauaagagugacauuaag

SEQ ID NO: 876775 - RNA, 19 nt, Homo sapiens
gaauuuaguagagccauaa

SEQ ID NO: 876776 - RNA, 19 nt, Homo sapiens
cgaaagaaucguaagaaug

SEQ ID NO: 876777 - RNA, 19 nt, Homo sapiens
cuaaucagcuuguaacacu

SEQ ID NO: 876778 - RNA, 19 nt, Homo sapiens
acaacgagcaaccagauua

SEQ ID NO: 876779 - RNA, 19 nt, Homo sapiens
ggugugcagucauucauau

SEQ ID NO: 876780 - RNA, 19 nt, Homo sapiens
ccaccaauauggcuuuauc

SEQ ID NO: 876781 - RNA, 19 nt, Homo sapiens
cagcauuccucgcaacaga

SEQ ID NO: 876782 - RNA, 19 nt, Homo sapiens
ggugaaauccuuaaugaag

SEQ ID NO: 876783 - RNA, 19 nt, Homo sapiens
agauggaaauuaagccuuu

SEQ ID NO: 876784 - RNA, 19 nt, Homo sapiens
gacagagugccaaagguua

SEQ ID NO: 876785 - RNA, 19 nt, Homo sapiens
acauuauacuccaccaaua

SEQ ID NO: 876786 - RNA, 19 nt, Homo sapiens
ucaagcaccucugacugua

SEQ ID NO: 876787 - RNA, 19 nt, Homo sapiens
uaucagaucaugucgacua

SEQ ID NO: 876788 - RNA, 19 nt, Homo sapiens
ccucaucauuugucuuuga

SEQ ID NO: 876789 - RNA, 19 nt, Homo sapiens
caucauagcucucugcuuu

SEQ ID NO: 876790 - RNA, 19 nt, Homo sapiens
acaccuagcugaauguuua

SEQ ID NO: 876791 - RNA, 19 nt, Homo sapiens
gugaacaacucaaacuuaa

SEQ ID NO: 876792 - RNA, 19 nt, Homo sapiens
gguggaaacuuacuucuga

SEQ ID NO: 876793 - RNA, 19 nt, Homo sapiens
ccagagagcauuuaggaua

SEQ ID NO: 876794 - RNA, 19 nt, Homo sapiens
ccacuuaucuuggcuaaau

SEQ ID NO: 876795 - RNA, 19 nt, Homo sapiens
gagacaaccugcaggaguu

SEQ ID NO: 876796 - RNA, 19 nt, Homo sapiens
agacaacucuguuaucuuc

SEQ ID NO: 876797 - RNA, 19 nt, Homo sapiens
ucaagaaccuggcuaguag

SEQ ID NO: 876798 - RNA, 19 nt, Homo sapiens
gaaacuuacuucugagauc

SEQ ID NO: 876799 - RNA, 19 nt, Homo sapiens
cagagagcauuuaggauaa

SEQ ID NO: 876800 - RNA, 19 nt, Homo sapiens
gaaccucaccugcucauga

SEQ ID NO: 876801 - RNA, 19 nt, Homo sapiens
ugaaugaacucaggaauag

SEQ ID NO: 876802 - RNA, 19 nt, Homo sapiens
gaagugcaguuuggaguga

SEQ ID NO: 876803 - RNA, 19 nt, Homo sapiens
aauggaaguugcucuguua

SEQ ID NO: 876804 - RNA, 19 nt, Homo sapiens
uagaggagcuaacuguuug

SEQ ID NO: 876805 - RNA, 19 nt, Homo sapiens
ucuguuaucuucaggagua

SEQ ID NO: 876806 - RNA, 19 nt, Homo sapiens
gagagcauuuaggauaaua

SEQ ID NO: 876807 - RNA, 19 nt, Homo sapiens
gaugcaagcucagguugaa

SEQ ID NO: 876808 - RNA, 19 nt, Homo sapiens
gacagggacugcuaucuuc

SEQ ID NO: 876809 - RNA, 19 nt, Homo sapiens
gaacaacucaaacuuaaac

SEQ ID NO: 876810 - RNA, 19 nt, Homo sapiens
guagaggagcuaacuguuu

SEQ ID NO: 876811 - RNA, 19 nt, Homo sapiens
cgacuucuuucccuucaaa

SEQ ID NO: 876812 - RNA, 19 nt, Homo sapiens
ggcccuggcugcagaguuu

SEQ ID NO: 876813 - RNA, 19 nt, Homo sapiens
guagacaacucuguuaucu

SEQ ID NO: 876814 - RNA, 19 nt, Homo sapiens
gaaaacugcuggcuguuga

SEQ ID NO: 876815 - RNA, 19 nt, Homo sapiens
ugacugauccacagaauau

SEQ ID NO: 876816 - RNA, 19 nt, Homo sapiens
ucaaugacccucuuacaga

SEQ ID NO: 876817 - RNA, 19 nt, Homo sapiens
gagccuuccuucagccuuu

SEQ ID NO: 876818 - RNA, 19 nt, Homo sapiens
ucagcaaguuacagaagua

SEQ ID NO: 876819 - RNA, 19 nt, Homo sapiens
ggaaguugcucuguuaaaa

SEQ ID NO: 876820 - RNA, 19 nt, Homo sapiens
ggacugcuaucuucuccau

SEQ ID NO: 876821 - RNA, 19 nt, Homo sapiens
caaguggucuguaauaagc

SEQ ID NO: 876822 - RNA, 19 nt, Homo sapiens
gaccagagagcauuuagga

SEQ ID NO: 876823 - RNA, 19 nt, Homo sapiens
cagaguauguugccaucuu

SEQ ID NO: 876824 - RNA, 19 nt, Homo sapiens
gacaugaagugcaguuugg

SEQ ID NO: 876825 - RNA, 19 nt, Homo sapiens
ccaagaagcaugacugauc

SEQ ID NO: 876826 - RNA, 19 nt, Homo sapiens
caacaggcacugcagcauu

SEQ ID NO: 876827 - RNA, 19 nt, Homo sapiens
ugggaauccuggcuauaua

SEQ ID NO: 876828 - RNA, 19 nt, Homo sapiens
uaauggaaguugcucuguu

SEQ ID NO: 876829 - RNA, 19 nt, Homo sapiens
caaccuagagacuauguga

SEQ ID NO: 876830 - RNA, 19 nt, Homo sapiens
gcucauguaucaggaguuc

SEQ ID NO: 876831 - RNA, 19 nt, Homo sapiens
gcuauaaacuguacuuccu

SEQ ID NO: 876832 - RNA, 19 nt, Homo sapiens
aacaggcacugcagcauuu

SEQ ID NO: 876833 - RNA, 19 nt, Homo sapiens
ggaccaggauccucaacag

SEQ ID NO: 876834 - RNA, 19 nt, Homo sapiens
acagaaguaucuuugacaa

SEQ ID NO: 876835 - RNA, 19 nt, Homo sapiens
aauccuggcuauauaguug

SEQ ID NO: 876836 - RNA, 19 nt, Homo sapiens
ggcucugacugaugauaua

SEQ ID NO: 876837 - RNA, 19 nt, Homo sapiens
uaacuucacagucuuaaag

SEQ ID NO: 876838 - RNA, 19 nt, Homo sapiens
aaagcaauccugcagguuu

SEQ ID NO: 876839 - RNA, 19 nt, Homo sapiens
ugugaacaacucaaacuua

SEQ ID NO: 876840 - RNA, 19 nt, Homo sapiens
gcaguucuuucuccucagu

SEQ ID NO: 876841 - RNA, 19 nt, Homo sapiens
caacucuugugaacuuugu

SEQ ID NO: 876842 - RNA, 19 nt, Homo sapiens
cauuucagcuauaaacugu

SEQ ID NO: 876843 - RNA, 19 nt, Homo sapiens
cagguuuccuagagaguaa

SEQ ID NO: 876844 - RNA, 19 nt, Homo sapiens
ccuggagccugcgauauaa

SEQ ID NO: 876845 - RNA, 19 nt, Homo sapiens
ucaaugcugccucuuacua

SEQ ID NO: 876846 - RNA, 19 nt, Homo sapiens
cgacagggacugcuaucuu

SEQ ID NO: 876847 - RNA, 19 nt, Homo sapiens
gaaguaucuuugacaacuc

SEQ ID NO: 876848 - RNA, 19 nt, Homo sapiens
gcaaguuacagaaguaucu

SEQ ID NO: 876849 - RNA, 19 nt, Homo sapiens
cccgcaagcucauguauca

SEQ ID NO: 876850 - RNA, 19 nt, Homo sapiens
agaguauguugccaucuuu

SEQ ID NO: 876851 - RNA, 19 nt, Homo sapiens
aaugcugccucuuacuaua

SEQ ID NO: 876852 - RNA, 19 nt, Homo sapiens
guacaacuugcacucguuu

SEQ ID NO: 876853 - RNA, 19 nt, Homo sapiens
cccaaguggucuguaauaa

SEQ ID NO: 876854 - RNA, 19 nt, Homo sapiens
ggaauccuuguauaugaaa

SEQ ID NO: 876855 - RNA, 19 nt, Homo sapiens
uaucuuggcuaaauagaac

SEQ ID NO: 876856 - RNA, 19 nt, Homo sapiens
uagagacuaugugaagaaa

SEQ ID NO: 876857 - RNA, 19 nt, Homo sapiens
agaaguaucuuugacaacu

SEQ ID NO: 876858 - RNA, 19 nt, Homo sapiens
gcagguuuccuagagagua

SEQ ID NO: 876859 - RNA, 19 nt, Homo sapiens
caaacucaaucaccaccau

SEQ ID NO: 876860 - RNA, 19 nt, Homo sapiens
uuucauggauucuaaugga

SEQ ID NO: 876861 - RNA, 19 nt, Homo sapiens
gcugucaccuugaaugaac

SEQ ID NO: 876862 - RNA, 19 nt, Homo sapiens
agaaagagagaaacacuuc

SEQ ID NO: 876863 - RNA, 19 nt, Homo sapiens
ccuucagccuuucugguua

SEQ ID NO: 876864 - RNA, 19 nt, Homo sapiens
gagcauuuaggauaauaga

SEQ ID NO: 876865 - RNA, 19 nt, Homo sapiens
ggaguucgauuccuauacc

SEQ ID NO: 876866 - RNA, 19 nt, Homo sapiens
gguauugugggcauaugua

SEQ ID NO: 876867 - RNA, 19 nt, Homo sapiens
cugcagcauuucagcuaua

SEQ ID NO: 876868 - RNA, 19 nt, Homo sapiens
gagccugcgauauaaauug

SEQ ID NO: 876869 - RNA, 19 nt, Homo sapiens
uauacaggauucucagcaa

SEQ ID NO: 876870 - RNA, 19 nt, Homo sapiens
gcaggagauuuaucagacu

SEQ ID NO: 876871 - RNA, 19 nt, Homo sapiens
uaaacuauuuccagaagcu

SEQ ID NO: 876872 - RNA, 19 nt, Homo sapiens
cuccucaguuuccaaagua

SEQ ID NO: 876873 - RNA, 19 nt, Homo sapiens
gauuuugucugguuccuuu

SEQ ID NO: 876874 - RNA, 19 nt, Homo sapiens
gcagaaagagagaaacacu

SEQ ID NO: 876875 - RNA, 19 nt, Homo sapiens
ccaagcagaaagagagaaa

SEQ ID NO: 876876 - RNA, 19 nt, Homo sapiens
cagccuuucugguuauguu

SEQ ID NO: 876877 - RNA, 19 nt, Homo sapiens
ggagauuuaucagacucuu

SEQ ID NO: 876878 - RNA, 19 nt, Homo sapiens
gagccaggguaauggaagu

SEQ ID NO: 876879 - RNA, 19 nt, Homo sapiens
gccaggcgcuuccuuacag

SEQ ID NO: 876880 - RNA, 19 nt, Homo sapiens
uacuauaacuucacagucu

SEQ ID NO: 876881 - RNA, 19 nt, Homo sapiens
gaaagcaauccugcagguu

SEQ ID NO: 876882 - RNA, 19 nt, Homo sapiens
gaucugugucugugacuug

SEQ ID NO: 876883 - RNA, 19 nt, Homo sapiens
acucugaggcagccacuua

SEQ ID NO: 876884 - RNA, 19 nt, Homo sapiens
uaucagacucuucauggaa

SEQ ID NO: 876885 - RNA, 19 nt, Homo sapiens
ccacucacucugugucgua

SEQ ID NO: 876886 - RNA, 19 nt, Homo sapiens
uaauaagcuugcugagaca

SEQ ID NO: 876887 - RNA, 19 nt, Homo sapiens
uugaaugaacucaggaaua

SEQ ID NO: 876888 - RNA, 19 nt, Homo sapiens
cuacaguggucccuacucu

SEQ ID NO: 876889 - RNA, 19 nt, Homo sapiens
gaaaugaguugcacaauug

SEQ ID NO: 876890 - RNA, 19 nt, Homo sapiens
gaacgaauauuucaacuug

SEQ ID NO: 876891 - RNA, 19 nt, Homo sapiens
ucaaauaacucgagaauca

SEQ ID NO: 876892 - RNA, 19 nt, Homo sapiens
ggaaagccauugaaauuga

SEQ ID NO: 876893 - RNA, 19 nt, Homo sapiens
gagcagcacuccaagauug

SEQ ID NO: 876894 - RNA, 19 nt, Homo sapiens
caaaguugaugcaaaguuu

SEQ ID NO: 876895 - RNA, 19 nt, Homo sapiens
caagauagguaugguaauu

SEQ ID NO: 876896 - RNA, 19 nt, Homo sapiens
ggaacaagaacgaauauuu

SEQ ID NO: 876897 - RNA, 19 nt, Homo sapiens
gaggaaagccauugaaauu

SEQ ID NO: 876898 - RNA, 19 nt, Homo sapiens
ggaagaaauucaagaacuu

SEQ ID NO: 876899 - RNA, 19 nt, Homo sapiens
aggaagagcugaagaguuu

SEQ ID NO: 876900 - RNA, 19 nt, Homo sapiens
uaacaucaguugaaaccua

SEQ ID NO: 876901 - RNA, 19 nt, Homo sapiens
gaacaagaacgaauauuuc

SEQ ID NO: 876902 - RNA, 19 nt, Homo sapiens
gaaggaauacuacuuucua

SEQ ID NO: 876903 - RNA, 19 nt, Homo sapiens
agagagauccuucaaauaa

SEQ ID NO: 876904 - RNA, 19 nt, Homo sapiens
guacaucucuggaagaaca

SEQ ID NO: 876905 - RNA, 19 nt, Homo sapiens
ggacuaagagcagaauaua

SEQ ID NO: 876906 - RNA, 19 nt, Homo sapiens
ugagagagauccuucaaau

SEQ ID NO: 876907 - RNA, 19 nt, Homo sapiens
caaaguuuauguaccauga

SEQ ID NO: 876908 - RNA, 19 nt, Homo sapiens
ggaauacuacuuucuaaga

SEQ ID NO: 876909 - RNA, 19 nt, Homo sapiens
gaaacaguaucaggaagaa

SEQ ID NO: 876910 - RNA, 19 nt, Homo sapiens
agaaaugaguugcacaauu

SEQ ID NO: 876911 - RNA, 19 nt, Homo sapiens
gaugaugcgucggaaagua

SEQ ID NO: 876912 - RNA, 19 nt, Homo sapiens
uagaagccaugaaacagua

SEQ ID NO: 876913 - RNA, 19 nt, Homo sapiens
ggaagcaaaucagaaugaa

SEQ ID NO: 876914 - RNA, 19 nt, Homo sapiens
gaaggcacuuggaagcaaa

SEQ ID NO: 876915 - RNA, 19 nt, Homo sapiens
ucagagaguugcaacaaga

SEQ ID NO: 876916 - RNA, 19 nt, Homo sapiens
guugaaagauuaagagauc

SEQ ID NO: 876917 - RNA, 19 nt, Homo sapiens
gagagagauccuucaaaua

SEQ ID NO: 876918 - RNA, 19 nt, Homo sapiens
ggguaaagguggaguaauc

SEQ ID NO: 876919 - RNA, 19 nt, Homo sapiens
caaggaacaagaacgaaua

SEQ ID NO: 876920 - RNA, 19 nt, Homo sapiens
acagaaaugugcuuuaaca

SEQ ID NO: 876921 - RNA, 19 nt, Homo sapiens
uaacaaguccgaaggauuc

SEQ ID NO: 876922 - RNA, 19 nt, Homo sapiens
gaugauccggguauaauaa

SEQ ID NO: 876923 - RNA, 19 nt, Homo sapiens
cuaaagcucuuguugaaag

SEQ ID NO: 876924 - RNA, 19 nt, Homo sapiens
gaauuccucuggcucauag

SEQ ID NO: 876925 - RNA, 19 nt, Homo sapiens
caugagacuucuagugauu

SEQ ID NO: 876926 - RNA, 19 nt, Homo sapiens
gaacugcaagcacauguug

SEQ ID NO: 876927 - RNA, 19 nt, Homo sapiens
ucucuucucuggcugauuu

SEQ ID NO: 876928 - RNA, 19 nt, Homo sapiens
gguucaaagucaauaauga

SEQ ID NO: 876929 - RNA, 19 nt, Homo sapiens
ugaaauggcagcaguaaug

SEQ ID NO: 876930 - RNA, 19 nt, Homo sapiens
cucauaaccugcaagauuu

SEQ ID NO: 876931 - RNA, 19 nt, Homo sapiens
ccucauaaccugcaagauu

SEQ ID NO: 876932 - RNA, 19 nt, Homo sapiens
guacuucuuugucagcauu

SEQ ID NO: 876933 - RNA, 19 nt, Homo sapiens
aaacugagccauugccaaa

SEQ ID NO: 876934 - RNA, 19 nt, Homo sapiens
ucugugagcuucuuacaug

SEQ ID NO: 876935 - RNA, 19 nt, Homo sapiens
aacaaaggcuugagagaga

SEQ ID NO: 876936 - RNA, 19 nt, Homo sapiens
gaaauggcagcaguaauga

SEQ ID NO: 876937 - RNA, 19 nt, Homo sapiens
caaauggucaaauaaguga

SEQ ID NO: 876938 - RNA, 19 nt, Homo sapiens
gcaaguaccgagaacaaau

SEQ ID NO: 876939 - RNA, 19 nt, Homo sapiens
acgcuaaauuucauccuua

SEQ ID NO: 876940 - RNA, 19 nt, Homo sapiens
aauagaaacugagccauug

SEQ ID NO: 876941 - RNA, 19 nt, Homo sapiens
uuacauggcuccaaauggu

SEQ ID NO: 876942 - RNA, 19 nt, Homo sapiens
gaccaacagugauuugagu

SEQ ID NO: 876943 - RNA, 19 nt, Homo sapiens
ggagagaaggcacuuggaa

SEQ ID NO: 876944 - RNA, 19 nt, Homo sapiens
gaauauucccaguaaaugu

SEQ ID NO: 876945 - RNA, 19 nt, Homo sapiens
gcgaguagaagccaugaaa

SEQ ID NO: 876946 - RNA, 19 nt, Homo sapiens
cgcuaaagcucuuguugaa

SEQ ID NO: 876947 - RNA, 19 nt, Homo sapiens
gccaaaugguaaagaaaug

SEQ ID NO: 876948 - RNA, 19 nt, Homo sapiens
gcacauguugaccagauaa

SEQ ID NO: 876949 - RNA, 19 nt, Homo sapiens
gagcaaguaccgagaacaa

SEQ ID NO: 876950 - RNA, 19 nt, Homo sapiens
gauacagaaaugugcuuua

SEQ ID NO: 876951 - RNA, 19 nt, Homo sapiens
uguuugauauggcaagaua

SEQ ID NO: 876952 - RNA, 19 nt, Homo sapiens
caacauggacuggagagaa

SEQ ID NO: 876953 - RNA, 19 nt, Homo sapiens
gagagauccuucaaauaac

SEQ ID NO: 876954 - RNA, 19 nt, Homo sapiens
ccacgguccacguuaguua

SEQ ID NO: 876955 - RNA, 19 nt, Homo sapiens
gcuuuaacaucaguugaaa

SEQ ID NO: 876956 - RNA, 19 nt, Homo sapiens
uuuaaaggcuauaggaaug

SEQ ID NO: 876957 - RNA, 19 nt, Homo sapiens
cggaggauuuguacgcuaa

SEQ ID NO: 876958 - RNA, 19 nt, Homo sapiens
cuuucugggugauuaauua

SEQ ID NO: 876959 - RNA, 19 nt, Homo sapiens
gcaaggaacaagaacgaau

SEQ ID NO: 876960 - RNA, 19 nt, Homo sapiens
gagcagaauauaucuuuag

SEQ ID NO: 876961 - RNA, 19 nt, Homo sapiens
ggaauuccucuggcucaua

SEQ ID NO: 876962 - RNA, 19 nt, Homo sapiens
caaagucaauaaugaagac

SEQ ID NO: 876963 - RNA, 19 nt, Homo sapiens
gucauagacuuuauuccaa

SEQ ID NO: 876964 - RNA, 19 nt, Homo sapiens
ggcaagauagguaugguaa

SEQ ID NO: 876965 - RNA, 19 nt, Homo sapiens
cccaguaaauguuugagaa

SEQ ID NO: 876966 - RNA, 19 nt, Homo sapiens
ggucauagacuuuauucca

SEQ ID NO: 876967 - RNA, 19 nt, Homo sapiens
cauaacugauacuuagcua

SEQ ID NO: 876968 - RNA, 19 nt, Homo sapiens
gugcacgggcuaugagaua

SEQ ID NO: 876969 - RNA, 19 nt, Homo sapiens
gcauaggucccgguuggua

SEQ ID NO: 876970 - RNA, 19 nt, Homo sapiens
guaacaaguccgaaggauu

SEQ ID NO: 876971 - RNA, 19 nt, Homo sapiens
uugccuacuuucacauuua

SEQ ID NO: 876972 - RNA, 19 nt, Homo sapiens
guuaauggucauagacuuu

SEQ ID NO: 876973 - RNA, 19 nt, Homo sapiens
cauaguuaauggucauaga

SEQ ID NO: 876974 - RNA, 19 nt, Homo sapiens
gcuccaaauggucaaauaa

SEQ ID NO: 876975 - RNA, 19 nt, Homo sapiens
gauccggguauaauaauga

SEQ ID NO: 876976 - RNA, 19 nt, Homo sapiens
uuaaugaagucgcgagaca

SEQ ID NO: 876977 - RNA, 19 nt, Homo sapiens
gaguagaagccaugaaaca

SEQ ID NO: 876978 - RNA, 19 nt, Homo sapiens
gauacuuagcuaacaauug

SEQ ID NO: 876979 - RNA, 19 nt, Homo sapiens
gaggaagagcugaagaguu

SEQ ID NO: 876980 - RNA, 19 nt, Homo sapiens
gaaagccauugaaauugac

SEQ ID NO: 876981 - RNA, 19 nt, Homo sapiens
agauagguaugguaauuuc

SEQ ID NO: 876982 - RNA, 19 nt, Homo sapiens
ucuagugauugccuacuuu

SEQ ID NO: 876983 - RNA, 19 nt, Homo sapiens
caguaaauguuugagaaug

SEQ ID NO: 876984 - RNA, 19 nt, Homo sapiens
ucaugacgaugcagcagaa

SEQ ID NO: 876985 - RNA, 19 nt, Homo sapiens
aaauagaaacugagccauu

SEQ ID NO: 876986 - RNA, 19 nt, Homo sapiens
ccaaauggucaaauaagug

SEQ ID NO: 876987 - RNA, 19 nt, Homo sapiens
ggcuccaaauggucaaaua

SEQ ID NO: 876988 - RNA, 19 nt, Homo sapiens
cuucuuacauggcuccaaa

SEQ ID NO: 876989 - RNA, 19 nt, Homo sapiens
caacaucauuggaacauua

SEQ ID NO: 876990 - RNA, 19 nt, Homo sapiens
gaaaggaaaugugcaauau

SEQ ID NO: 876991 - RNA, 19 nt, Homo sapiens
gauaaacagucugaacuua

SEQ ID NO: 876992 - RNA, 19 nt, Homo sapiens
gcacaugcuuacuaugaua

SEQ ID NO: 876993 - RNA, 19 nt, Homo sapiens
guaaagagaugguuagucu

SEQ ID NO: 876994 - RNA, 19 nt, Homo sapiens
ggaaauagaaguugagcua

SEQ ID NO: 876995 - RNA, 19 nt, Homo sapiens
agaaagagcuggaaaauuu

SEQ ID NO: 876996 - RNA, 19 nt, Homo sapiens
gcaaggugcuggaucaaau

SEQ ID NO: 876997 - RNA, 19 nt, Homo sapiens
uaggagagcuugaucuuga

SEQ ID NO: 876998 - RNA, 19 nt, Homo sapiens
cuugauagauuccuuguaa

SEQ ID NO: 876999 - RNA, 19 nt, Homo sapiens
cagaagcacuauauaauca

SEQ ID NO: 877000 - RNA, 19 nt, Homo sapiens
gcuaagggauccugauuca

SEQ ID NO: 877001 - RNA, 19 nt, Homo sapiens
uaaacagucugaacuuaga

SEQ ID NO: 877002 - RNA, 19 nt, Homo sapiens
aaggaaaugugcaauauug

SEQ ID NO: 877003 - RNA, 19 nt, Homo sapiens
gagaagugccagagcuuua

SEQ ID NO: 877004 - RNA, 19 nt, Homo sapiens
gaagaagccagagaacuuu

SEQ ID NO: 877005 - RNA, 19 nt, Homo sapiens
gaaacuuacugaacaagag

SEQ ID NO: 877006 - RNA, 19 nt, Homo sapiens
caucagaagcacuauauaa

SEQ ID NO: 877007 - RNA, 19 nt, Homo sapiens
acagacagauccaguuuga

SEQ ID NO: 877008 - RNA, 19 nt, Homo sapiens
caacagacagauccaguuu

SEQ ID NO: 877009 - RNA, 19 nt, Homo sapiens
ugccagagcuuuaucauca

SEQ ID NO: 877010 - RNA, 19 nt, Homo sapiens
gcuaguacuugauagauuc

SEQ ID NO: 877011 - RNA, 19 nt, Homo sapiens
guacuaccagcucuucuua

SEQ ID NO: 877012 - RNA, 19 nt, Homo sapiens
ggaaaugugcaauauugaa

SEQ ID NO: 877013 - RNA, 19 nt, Homo sapiens
uaaggugcuugcauucuuu

SEQ ID NO: 877014 - RNA, 19 nt, Homo sapiens
gaagagaaacuuacugaac

SEQ ID NO: 877015 - RNA, 19 nt, Homo sapiens
caagauggcccugacuuaa

SEQ ID NO: 877016 - RNA, 19 nt, Homo sapiens
gagagacccaaauaaagua

SEQ ID NO: 877017 - RNA, 19 nt, Homo sapiens
agacagauccaguuugaaa

SEQ ID NO: 877018 - RNA, 19 nt, Homo sapiens
ccaagauggcccugacuua

SEQ ID NO: 877019 - RNA, 19 nt, Homo sapiens
gugcuugcauucuuugaaa

SEQ ID NO: 877020 - RNA, 19 nt, Homo sapiens
aagagaaacuuacugaaca

SEQ ID NO: 877021 - RNA, 19 nt, Homo sapiens
aaauagaaguugagcuaga

SEQ ID NO: 877022 - RNA, 19 nt, Homo sapiens
gaugcuuguuuccuauuaa

SEQ ID NO: 877023 - RNA, 19 nt, Homo sapiens
ccaggugagugcaguuuga

SEQ ID NO: 877024 - RNA, 19 nt, Homo sapiens
gauccugauucacacauug

SEQ ID NO: 877025 - RNA, 19 nt, Homo sapiens
ugaagaagccagagaacuu

SEQ ID NO: 877026 - RNA, 19 nt, Homo sapiens
uuaccuagcucaagucuac

SEQ ID NO: 877027 - RNA, 19 nt, Homo sapiens
ccuaaggaacauaaaguua

SEQ ID NO: 877028 - RNA, 19 nt, Homo sapiens
ccagagcuuuaucaucaaa

SEQ ID NO: 877029 - RNA, 19 nt, Homo sapiens
gaagcacuauauaaucagu

SEQ ID NO: 877030 - RNA, 19 nt, Homo sapiens
gcauccaggcgcagaauaa

SEQ ID NO: 877031 - RNA, 19 nt, Homo sapiens
agaaaggaaaugugcaaua

SEQ ID NO: 877032 - RNA, 19 nt, Homo sapiens
ucuuucagauugaugguua

SEQ ID NO: 877033 - RNA, 19 nt, Homo sapiens
cacaaugccuaccauccua

SEQ ID NO: 877034 - RNA, 19 nt, Homo sapiens
gaaggcugcucacuauugc

SEQ ID NO: 877035 - RNA, 19 nt, Homo sapiens
uauauuaccuagcucaagu

SEQ ID NO: 877036 - RNA, 19 nt, Homo sapiens
guuaaagacaugugauuug

SEQ ID NO: 877037 - RNA, 19 nt, Homo sapiens
guaaauugccuuguuaaag

SEQ ID NO: 877038 - RNA, 19 nt, Homo sapiens
gaaaugugcaauauugaag

SEQ ID NO: 877039 - RNA, 19 nt, Homo sapiens
gcccugccauguuagcuaa

SEQ ID NO: 877040 - RNA, 19 nt, Homo sapiens
ggagagacggugcaagaug

SEQ ID NO: 877041 - RNA, 19 nt, Homo sapiens
ggucagcacuaugucuuug

SEQ ID NO: 877042 - RNA, 19 nt, Homo sapiens
agaauaaccuggguaucuu

SEQ ID NO: 877043 - RNA, 19 nt, Homo sapiens
gcaacaucauuggaacauu

SEQ ID NO: 877044 - RNA, 19 nt, Homo sapiens
ccugagagacccaaauaaa

SEQ ID NO: 877045 - RNA, 19 nt, Homo sapiens
ugccaucucugcaguagaa

SEQ ID NO: 877046 - RNA, 19 nt, Homo sapiens
gcugcucacuauugccaua

SEQ ID NO: 877047 - RNA, 19 nt, Homo sapiens
uaaccuauauuaccuagcu

SEQ ID NO: 877048 - RNA, 19 nt, Homo sapiens
gcacaggcuuaccuagagu

SEQ ID NO: 877049 - RNA, 19 nt, Homo sapiens
uaagggauccugauucaca

SEQ ID NO: 877050 - RNA, 19 nt, Homo sapiens
caaggugcuggaucaaaua

SEQ ID NO: 877051 - RNA, 19 nt, Homo sapiens
aaccauacaaguccaaaua

SEQ ID NO: 877052 - RNA, 19 nt, Homo sapiens
aauagaaguugagcuagaa

SEQ ID NO: 877053 - RNA, 19 nt, Homo sapiens
ggaggaaagcauucggaaa

SEQ ID NO: 877054 - RNA, 19 nt, Homo sapiens
agucugaacuuagagcuuu

SEQ ID NO: 877055 - RNA, 19 nt, Homo sapiens
ggagagcuugaucuugaua

SEQ ID NO: 877056 - RNA, 19 nt, Homo sapiens
ggcuaguacuugauagauu

SEQ ID NO: 877057 - RNA, 19 nt, Homo sapiens
gagcuagaacuuaguaaag

SEQ ID NO: 877058 - RNA, 19 nt, Homo sapiens
cugcagaucccaagaaaga

SEQ ID NO: 877059 - RNA, 19 nt, Homo sapiens
aguauucccugagcauaua

SEQ ID NO: 877060 - RNA, 19 nt, Homo sapiens
uuaaggugcuugcauucuu

SEQ ID NO: 877061 - RNA, 19 nt, Homo sapiens
gauagauuccuuguaagaa

SEQ ID NO: 877062 - RNA, 19 nt, Homo sapiens
uuagcuaaguuucgaguug

SEQ ID NO: 877063 - RNA, 19 nt, Homo sapiens
ugagagacccaaauaaagu

SEQ ID NO: 877064 - RNA, 19 nt, Homo sapiens
uaugauggauuugaagguu

SEQ ID NO: 877065 - RNA, 19 nt, Homo sapiens
gagaaggaaccauacaagu

SEQ ID NO: 877066 - RNA, 19 nt, Homo sapiens
gaggaaagcauucggaaaa

SEQ ID NO: 877067 - RNA, 19 nt, Homo sapiens
gcugcuaccuugucacagu

SEQ ID NO: 877068 - RNA, 19 nt, Homo sapiens
gaauaaccuggguaucuug

SEQ ID NO: 877069 - RNA, 19 nt, Homo sapiens
agagaaacuuacugaacaa

SEQ ID NO: 877070 - RNA, 19 nt, Homo sapiens
ccauacaaguccaaauaca

SEQ ID NO: 877071 - RNA, 19 nt, Homo sapiens
agaugcuuguuuccuauua

SEQ ID NO: 877072 - RNA, 19 nt, Homo sapiens
aguauuaucuguuggucaa

SEQ ID NO: 877073 - RNA, 19 nt, Homo sapiens
agaacuagaugaggaggaa

SEQ ID NO: 877074 - RNA, 19 nt, Homo sapiens
ggagaagugccagagcuuu

SEQ ID NO: 877075 - RNA, 19 nt, Homo sapiens
ggagaaggaaccauacaag

SEQ ID NO: 877076 - RNA, 19 nt, Homo sapiens
uuuagaugcuuguuuccua

SEQ ID NO: 877077 - RNA, 19 nt, Homo sapiens
gguaucuuguggucugaaa

SEQ ID NO: 877078 - RNA, 19 nt, Homo sapiens
cagauccaguuugaaauug

SEQ ID NO: 877079 - RNA, 19 nt, Homo sapiens
caacauaggagagcuugau

SEQ ID NO: 877080 - RNA, 19 nt, Homo sapiens
gcuagaacuuaguaaagag

SEQ ID NO: 877081 - RNA, 19 nt, Homo sapiens
gaagaagagaaacuuacug

SEQ ID NO: 877082 - RNA, 19 nt, Homo sapiens
cagaauaaccuggguaucu

SEQ ID NO: 877083 - RNA, 19 nt, Homo sapiens
ggauccugauucacacauu

SEQ ID NO: 877084 - RNA, 19 nt, Homo sapiens
agaccugaauccacaguau

SEQ ID NO: 877085 - RNA, 19 nt, Homo sapiens
cuugagaccuuuagauuuu

SEQ ID NO: 877086 - RNA, 19 nt, Homo sapiens
gaagagaaagugagcuacu

SEQ ID NO: 877087 - RNA, 19 nt, Homo sapiens
guuugacucucaugcagaa

SEQ ID NO: 877088 - RNA, 19 nt, Homo sapiens
aagaagagaaacuuacuga

SEQ ID NO: 877089 - RNA, 19 nt, Homo sapiens
gagaacagcuccugcauca

SEQ ID NO: 877090 - RNA, 19 nt, Homo sapiens
gaaaugauccgacuagaug

SEQ ID NO: 877091 - RNA, 19 nt, Homo sapiens
gggaugugcuccagaguua

SEQ ID NO: 877092 - RNA, 19 nt, Homo sapiens
caaugaagauuaugcauga

SEQ ID NO: 877093 - RNA, 19 nt, Homo sapiens
gaaaccacuuauccaaaua

SEQ ID NO: 877094 - RNA, 19 nt, Homo sapiens
ccacuuauccaaauacuua

SEQ ID NO: 877095 - RNA, 19 nt, Homo sapiens
ccaauuaaauggagacuau

SEQ ID NO: 877096 - RNA, 19 nt, Homo sapiens
ggacaucaccuugaagaua

SEQ ID NO: 877097 - RNA, 19 nt, Homo sapiens
aagaggacauuuagcauua

SEQ ID NO: 877098 - RNA, 19 nt, Homo sapiens
gcacauccuuuacugcauu

SEQ ID NO: 877099 - RNA, 19 nt, Homo sapiens
caacaccgaugcaaaguuc

SEQ ID NO: 877100 - RNA, 19 nt, Homo sapiens
gaagauauuuuggguguua

SEQ ID NO: 877101 - RNA, 19 nt, Homo sapiens
ggacagaaacugaaaauaa

SEQ ID NO: 877102 - RNA, 19 nt, Homo sapiens
caacaucccugagguggaa

SEQ ID NO: 877103 - RNA, 19 nt, Homo sapiens
uauaauaccugugucugua

SEQ ID NO: 877104 - RNA, 19 nt, Homo sapiens
cagcaacccucauugaaga

SEQ ID NO: 877105 - RNA, 19 nt, Homo sapiens
aagaagagcuugaguuugg

SEQ ID NO: 877106 - RNA, 19 nt, Homo sapiens
uaugaaaguugccgaggua

SEQ ID NO: 877107 - RNA, 19 nt, Homo sapiens
gaggaaacuuacccaagaa

SEQ ID NO: 877108 - RNA, 19 nt, Homo sapiens
gcuugaguauccuguauaa

SEQ ID NO: 877109 - RNA, 19 nt, Homo sapiens
gcagauguccuuccucuuc

SEQ ID NO: 877110 - RNA, 19 nt, Homo sapiens
ucccuggacuuaauaauuu

SEQ ID NO: 877111 - RNA, 19 nt, Homo sapiens
gcuaauuucugccggauuc

SEQ ID NO: 877112 - RNA, 19 nt, Homo sapiens
guacagagggaguuacaaa

SEQ ID NO: 877113 - RNA, 19 nt, Homo sapiens
agaggaaacuuacccaaga

SEQ ID NO: 877114 - RNA, 19 nt, Homo sapiens
ggaaauuucuccucuucuc

SEQ ID NO: 877115 - RNA, 19 nt, Homo sapiens
gcugaucccuggacuuaau

SEQ ID NO: 877116 - RNA, 19 nt, Homo sapiens
caaucugaguuccuuagua

SEQ ID NO: 877117 - RNA, 19 nt, Homo sapiens
uuugugaucuuccuguuua

SEQ ID NO: 877118 - RNA, 19 nt, Homo sapiens
gcacacgcuucuugccaaa

SEQ ID NO: 877119 - RNA, 19 nt, Homo sapiens
gacagcaccugccuagaga

SEQ ID NO: 877120 - RNA, 19 nt, Homo sapiens
ggacagcgaguguaaguca

SEQ ID NO: 877121 - RNA, 19 nt, Homo sapiens
agaaaccacuuauccaaau

SEQ ID NO: 877122 - RNA, 19 nt, Homo sapiens
caagaaaccacuuauccaa

SEQ ID NO: 877123 - RNA, 19 nt, Homo sapiens
gagaauggccugccucaca

SEQ ID NO: 877124 - RNA, 19 nt, Homo sapiens
gugaugaaauguccaagga

SEQ ID NO: 877125 - RNA, 19 nt, Homo sapiens
gacaucaccuugaagauac

SEQ ID NO: 877126 - RNA, 19 nt, Homo sapiens
aaucugaguuccuuaguau

SEQ ID NO: 877127 - RNA, 19 nt, Homo sapiens
agaagaagagcuugaguuu

SEQ ID NO: 877128 - RNA, 19 nt, Homo sapiens
agcagcagcucgcuaauuu

SEQ ID NO: 877129 - RNA, 19 nt, Homo sapiens
gaugcaaaguuccagguau

SEQ ID NO: 877130 - RNA, 19 nt, Homo sapiens
gauucuggcugucaccauu

SEQ ID NO: 877131 - RNA, 19 nt, Homo sapiens
gaggcuauggcauuuguua

SEQ ID NO: 877132 - RNA, 19 nt, Homo sapiens
ggacauagacagggacuuc

SEQ ID NO: 877133 - RNA, 19 nt, Homo sapiens
ggacagcaccugccuagag

SEQ ID NO: 877134 - RNA, 19 nt, Homo sapiens
gguggaagcuguccucaac

SEQ ID NO: 877135 - RNA, 19 nt, Homo sapiens
aaucaagccuccauugugu

SEQ ID NO: 877136 - RNA, 19 nt, Homo sapiens
agacaaugcuuuggugcua

SEQ ID NO: 877137 - RNA, 19 nt, Homo sapiens
cagcauuccuggcuuuguu

SEQ ID NO: 877138 - RNA, 19 nt, Homo sapiens
gcauucaagagauucaaua

SEQ ID NO: 877139 - RNA, 19 nt, Homo sapiens
acacauggcuagacaaugc

SEQ ID NO: 877140 - RNA, 19 nt, Homo sapiens
ccucugcucucguuagcua

SEQ ID NO: 877141 - RNA, 19 nt, Homo sapiens
ggaaaugauccgacuagau

SEQ ID NO: 877142 - RNA, 19 nt, Homo sapiens
aaacagcaacccucauuga

SEQ ID NO: 877143 - RNA, 19 nt, Homo sapiens
uaagaggacauuuagcauu

SEQ ID NO: 877144 - RNA, 19 nt, Homo sapiens
gaggaagcauucagcaucu

SEQ ID NO: 877145 - RNA, 19 nt, Homo sapiens
gaagaagagcuugaguuug

SEQ ID NO: 877146 - RNA, 19 nt, Homo sapiens
ccagccaccuccacaguga

SEQ ID NO: 877147 - RNA, 19 nt, Homo sapiens
cagaaugauugcagaguuc

SEQ ID NO: 877148 - RNA, 19 nt, Homo sapiens
ggugcuagaugcccugaug

SEQ ID NO: 877149 - RNA, 19 nt, Homo sapiens
caacagaagaagagcuuga

SEQ ID NO: 877150 - RNA, 19 nt, Homo sapiens
gguaagaggacauuuagca

SEQ ID NO: 877151 - RNA, 19 nt, Homo sapiens
gcccggacaucaccuugaa

SEQ ID NO: 877152 - RNA, 19 nt, Homo sapiens
gaucauguacaaacuggaa

SEQ ID NO: 877153 - RNA, 19 nt, Homo sapiens
cauggaggcuauggcauuu

SEQ ID NO: 877154 - RNA, 19 nt, Homo sapiens
agagguaagaggacauuua

SEQ ID NO: 877155 - RNA, 19 nt, Homo sapiens
agagucgucuuucagguuu

SEQ ID NO: 877156 - RNA, 19 nt, Homo sapiens
acagaaugauugcagaguu

SEQ ID NO: 877157 - RNA, 19 nt, Homo sapiens
ggauggagcacagcaagaa

SEQ ID NO: 877158 - RNA, 19 nt, Homo sapiens
aaccagaacugugacugua

SEQ ID NO: 877159 - RNA, 19 nt, Homo sapiens
aagcugaucccuggacuua

SEQ ID NO: 877160 - RNA, 19 nt, Homo sapiens
gcaaacuggcgacucgaaa

SEQ ID NO: 877161 - RNA, 19 nt, Homo sapiens
agaaugacuuugugaucuu

SEQ ID NO: 877162 - RNA, 19 nt, Homo sapiens
guguugaucuucuuguaga

SEQ ID NO: 877163 - RNA, 19 nt, Homo sapiens
gagguaagaggacauuuag

SEQ ID NO: 877164 - RNA, 19 nt, Homo sapiens
gaaaguugccgagguacug

SEQ ID NO: 877165 - RNA, 19 nt, Homo sapiens
cgacaggaguuuggugugu

SEQ ID NO: 877166 - RNA, 19 nt, Homo sapiens
ugacaaguaagaagacauu

SEQ ID NO: 877167 - RNA, 19 nt, Homo sapiens
gaaugacuuugugaucuuc

SEQ ID NO: 877168 - RNA, 19 nt, Homo sapiens
gccaauuuauuaacagcaa

SEQ ID NO: 877169 - RNA, 19 nt, Homo sapiens
ccagguggauaugaaaguu

SEQ ID NO: 877170 - RNA, 19 nt, Homo sapiens
acaaacagcaacccucauu

SEQ ID NO: 877171 - RNA, 19 nt, Homo sapiens
caacccucauugaagauau

SEQ ID NO: 877172 - RNA, 19 nt, Homo sapiens
guacacauggcuagacaau

SEQ ID NO: 877173 - RNA, 19 nt, Homo sapiens
gcaacccucauugaagaua

SEQ ID NO: 877174 - RNA, 19 nt, Homo sapiens
gacagaaacugaaaauaag

SEQ ID NO: 877175 - RNA, 19 nt, Homo sapiens
gcaccugccuagagaacag

SEQ ID NO: 877176 - RNA, 19 nt, Homo sapiens
gcacaaucaagccuccauu

SEQ ID NO: 877177 - RNA, 19 nt, Homo sapiens
cagaagaagagcuugaguu

SEQ ID NO: 877178 - RNA, 19 nt, Homo sapiens
ggagucagagcacaaucaa

SEQ ID NO: 877179 - RNA, 19 nt, Homo sapiens
guuuggagguguugaucuu

SEQ ID NO: 877180 - RNA, 19 nt, Homo sapiens
gcacagccagcuuccuuca

SEQ ID NO: 877181 - RNA, 19 nt, Homo sapiens
guuccuuaguauccaauuu

SEQ ID NO: 877182 - RNA, 19 nt, Homo sapiens
gaucuuccuguuuacauug

SEQ ID NO: 877183 - RNA, 19 nt, Homo sapiens
gaacgucagcugccucaac

SEQ ID NO: 877184 - RNA, 19 nt, Homo sapiens
augcaaaguuccagguauu

SEQ ID NO: 877185 - RNA, 19 nt, Homo sapiens
cgaaaggugucagagucaa

SEQ ID NO: 877186 - RNA, 19 nt, Homo sapiens
ucucagcauuccuggcuuu

SEQ ID NO: 877187 - RNA, 19 nt, Homo sapiens
gaugcuggcccgacggaaa

SEQ ID NO: 877188 - RNA, 19 nt, Homo sapiens
gggaagaggggcuuauuaa

SEQ ID NO: 877189 - RNA, 19 nt, Homo sapiens
gaaugaaguugaagaggua

SEQ ID NO: 877190 - RNA, 19 nt, Homo sapiens
ccaaacgacuaagaaauua

SEQ ID NO: 877191 - RNA, 19 nt, Homo sapiens
gcaaacagcugcgcaagga

SEQ ID NO: 877192 - RNA, 19 nt, Homo sapiens
caaauaugguagucaguuu

SEQ ID NO: 877193 - RNA, 19 nt, Homo sapiens
cgaauuaacugacuuggau

SEQ ID NO: 877194 - RNA, 19 nt, Homo sapiens
caaaugauauaacgucuca

SEQ ID NO: 877195 - RNA, 19 nt, Homo sapiens
gauuaugcauucuucauga

SEQ ID NO: 877196 - RNA, 19 nt, Homo sapiens
aagaagaccugaucaacaa

SEQ ID NO: 877197 - RNA, 19 nt, Homo sapiens
gaagaagaccugaucaaca

SEQ ID NO: 877198 - RNA, 19 nt, Homo sapiens
gcaaggagucccagaaaga

SEQ ID NO: 877199 - RNA, 19 nt, Homo sapiens
gaagccagcaaaugauaua

SEQ ID NO: 877200 - RNA, 19 nt, Homo sapiens
gaacaguguguaccaguuu

SEQ ID NO: 877201 - RNA, 19 nt, Homo sapiens
guuuaaagcuuucacuuca

SEQ ID NO: 877202 - RNA, 19 nt, Homo sapiens
ugaagaggcucaugcugaa

SEQ ID NO: 877203 - RNA, 19 nt, Homo sapiens
ugacuuggaucaaucaaau

SEQ ID NO: 877204 - RNA, 19 nt, Homo sapiens
gaaggaauaagacgaguug

SEQ ID NO: 877205 - RNA, 19 nt, Homo sapiens
gcucauuagguucaaauua

SEQ ID NO: 877206 - RNA, 19 nt, Homo sapiens
guugauagaccgauuauug

SEQ ID NO: 877207 - RNA, 19 nt, Homo sapiens
ggaauaagacgaguuggaa

SEQ ID NO: 877208 - RNA, 19 nt, Homo sapiens
caaccgauucgaccaguua

SEQ ID NO: 877209 - RNA, 19 nt, Homo sapiens
uggccaauguguaauauuu

SEQ ID NO: 877210 - RNA, 19 nt, Homo sapiens
ggucaacugggacauguua

SEQ ID NO: 877211 - RNA, 19 nt, Homo sapiens
uaaggagaaugaaguugaa

SEQ ID NO: 877212 - RNA, 19 nt, Homo sapiens
uaacugacuuggaucaauc

SEQ ID NO: 877213 - RNA, 19 nt, Homo sapiens
uuucagagauuaugcauuc

SEQ ID NO: 877214 - RNA, 19 nt, Homo sapiens
gggauuuguucuucauaaa

SEQ ID NO: 877215 - RNA, 19 nt, Homo sapiens
acagaaauaucaguacuug

SEQ ID NO: 877216 - RNA, 19 nt, Homo sapiens
ggacauacugguuuuaaua

SEQ ID NO: 877217 - RNA, 19 nt, Homo sapiens
ccaguuauuugacgacgaa

SEQ ID NO: 877218 - RNA, 19 nt, Homo sapiens
gggcaaaaguagaauuuaa

SEQ ID NO: 877219 - RNA, 19 nt, Homo sapiens
caucuuaauuggugaaagu

SEQ ID NO: 877220 - RNA, 19 nt, Homo sapiens
ggagguagcggaucucaca

SEQ ID NO: 877221 - RNA, 19 nt, Homo sapiens
uugcauggcucauuagguu

SEQ ID NO: 877222 - RNA, 19 nt, Homo sapiens
gaacaaauucaaagcacau

SEQ ID NO: 877223 - RNA, 19 nt, Homo sapiens
gguagucaguuuuguauuu

SEQ ID NO: 877224 - RNA, 19 nt, Homo sapiens
uuaacuggaugccauaaga

SEQ ID NO: 877225 - RNA, 19 nt, Homo sapiens
ugauagaucuggccugaag

SEQ ID NO: 877226 - RNA, 19 nt, Homo sapiens
uagcagggauguuuucaua

SEQ ID NO: 877227 - RNA, 19 nt, Homo sapiens
gcuuaaggauuccaaacga

SEQ ID NO: 877228 - RNA, 19 nt, Homo sapiens
ggaaugggccgaggagaug

SEQ ID NO: 877229 - RNA, 19 nt, Homo sapiens
gcacaucgugucaagugaa

SEQ ID NO: 877230 - RNA, 19 nt, Homo sapiens
ucaaagacgaauuaacuga

SEQ ID NO: 877231 - RNA, 19 nt, Homo sapiens
ccgaggagauggauuugau

SEQ ID NO: 877232 - RNA, 19 nt, Homo sapiens
aaauauaggugugaacagu

SEQ ID NO: 877233 - RNA, 19 nt, Homo sapiens
ggccaauguguaauauuua

SEQ ID NO: 877234 - RNA, 19 nt, Homo sapiens
gcagggauguuuucauaau

SEQ ID NO: 877235 - RNA, 19 nt, Homo sapiens
gcgcaaggagucccagaaa

SEQ ID NO: 877236 - RNA, 19 nt, Homo sapiens
ccguggcgcuuaagaaaga

SEQ ID NO: 877237 - RNA, 19 nt, Homo sapiens
ugauuuggccaauguguaa

SEQ ID NO: 877238 - RNA, 19 nt, Homo sapiens
ugaacaguguguaccaguu

SEQ ID NO: 877239 - RNA, 19 nt, Homo sapiens
gggugaaggaggcgaauuu

SEQ ID NO: 877240 - RNA, 19 nt, Homo sapiens
cuccuugcauggcucauua

SEQ ID NO: 877241 - RNA, 19 nt, Homo sapiens
uuuaauaccugcuuugcau

SEQ ID NO: 877242 - RNA, 19 nt, Homo sapiens
gagaugacuuuggaugagu

SEQ ID NO: 877243 - RNA, 19 nt, Homo sapiens
gaacugucaaagacgaauu

SEQ ID NO: 877244 - RNA, 19 nt, Homo sapiens
gggccgaggagauggauuu

SEQ ID NO: 877245 - RNA, 19 nt, Homo sapiens
gcuuaagaaagaaggaaua

SEQ ID NO: 877246 - RNA, 19 nt, Homo sapiens
caggguggguggaauaagu

SEQ ID NO: 877247 - RNA, 19 nt, Homo sapiens
cagagauuaugcauucuuc

SEQ ID NO: 877248 - RNA, 19 nt, Homo sapiens
uccaaacgacuaagaaauu

SEQ ID NO: 877249 - RNA, 19 nt, Homo sapiens
ggaagaagaccugaucaac

SEQ ID NO: 877250 - RNA, 19 nt, Homo sapiens
gguggaauaaguugauuug

SEQ ID NO: 877251 - RNA, 19 nt, Homo sapiens
cgugucaagugaaguaguu

SEQ ID NO: 877252 - RNA, 19 nt, Homo sapiens
caucgugucaagugaagua

SEQ ID NO: 877253 - RNA, 19 nt, Homo sapiens
guaggcacaucgugucaag

SEQ ID NO: 877254 - RNA, 19 nt, Homo sapiens
guggaauacuaacuauaug

SEQ ID NO: 877255 - RNA, 19 nt, Homo sapiens
cuacacagaaguaacaaau

SEQ ID NO: 877256 - RNA, 19 nt, Homo sapiens
cagcaggaccgacaaguca

SEQ ID NO: 877257 - RNA, 19 nt, Homo sapiens
gauucgaccaguuauuuga

SEQ ID NO: 877258 - RNA, 19 nt, Homo sapiens
uggcgugguugacaagaaa

SEQ ID NO: 877259 - RNA, 19 nt, Homo sapiens
ggaagccagcaaaugauau

SEQ ID NO: 877260 - RNA, 19 nt, Homo sapiens
aaaagccacuugaagaaaa

SEQ ID NO: 877261 - RNA, 19 nt, Homo sapiens
uaugcuguguggaauacua

SEQ ID NO: 877262 - RNA, 19 nt, Homo sapiens
ugggacauguuaaacuuug

SEQ ID NO: 877263 - RNA, 19 nt, Homo sapiens
uguaccaguuuaaagcuuu

SEQ ID NO: 877264 - RNA, 19 nt, Homo sapiens
gcccguggcgcuuaagaaa

SEQ ID NO: 877265 - RNA, 19 nt, Homo sapiens
aagacgaguuggaagaaga

SEQ ID NO: 877266 - RNA, 19 nt, Homo sapiens
auucacaccuaaagacuga

SEQ ID NO: 877267 - RNA, 19 nt, Homo sapiens
uuggaucaaucaaauguga

SEQ ID NO: 877268 - RNA, 19 nt, Homo sapiens
gaggagauggauuugauuc

SEQ ID NO: 877269 - RNA, 19 nt, Homo sapiens
gaaaagccacuugaagaaa

SEQ ID NO: 877270 - RNA, 19 nt, Homo sapiens
ccgauucgaccaguuauuu

SEQ ID NO: 877271 - RNA, 19 nt, Homo sapiens
aacaguguguaccaguuua

SEQ ID NO: 877272 - RNA, 19 nt, Homo sapiens
ccagaaagaccgcaagaac

SEQ ID NO: 877273 - RNA, 19 nt, Homo sapiens
gaaggcagcagagaacaag

SEQ ID NO: 877274 - RNA, 19 nt, Homo sapiens
cggaagccagcaaaugaua

SEQ ID NO: 877275 - RNA, 19 nt, Homo sapiens
agggauuuguucuucauaa

SEQ ID NO: 877276 - RNA, 19 nt, Homo sapiens
gaguggaaggcuauucaaa

SEQ ID NO: 877277 - RNA, 19 nt, Homo sapiens
gaggacaaacguggaggua

SEQ ID NO: 877278 - RNA, 19 nt, Homo sapiens
aggcauaguggaagugaua

SEQ ID NO: 877279 - RNA, 19 nt, Homo sapiens
ugucaaagacgaauuaacu

SEQ ID NO: 877280 - RNA, 19 nt, Homo sapiens
gggacauguuaaacuuuga

SEQ ID NO: 877281 - RNA, 19 nt, Homo sapiens
acaccuaaagacugaauuu

SEQ ID NO: 877282 - RNA, 19 nt, Homo sapiens
ucauaccauucacaccuaa

SEQ ID NO: 877283 - RNA, 19 nt, Homo sapiens
aaaugugacugaggaaaca

SEQ ID NO: 877284 - RNA, 19 nt, Homo sapiens
gauuauugaccgaccuauu

SEQ ID NO: 877285 - RNA, 19 nt, Homo sapiens
ucaguugauagaccgauua

SEQ ID NO: 877286 - RNA, 19 nt, Homo sapiens
augcuugaguuucccauuu

SEQ ID NO: 877287 - RNA, 19 nt, Homo sapiens
gagauuaugcauucuucau

SEQ ID NO: 877288 - RNA, 19 nt, Homo sapiens
ggagaaugaaguugaagag

SEQ ID NO: 877289 - RNA, 19 nt, Homo sapiens
ucaaaugucuucacuugua

SEQ ID NO: 877290 - RNA, 19 nt, Homo sapiens
gcacuugccugccaugauu

SEQ ID NO: 877291 - RNA, 19 nt, Homo sapiens
aagaaugucuccaucaaua

SEQ ID NO: 877292 - RNA, 19 nt, Homo sapiens
ucacugaccuuuguaauga

SEQ ID NO: 877293 - RNA, 19 nt, Homo sapiens
ccaaauagcugggauuaca

SEQ ID NO: 877294 - RNA, 19 nt, Homo sapiens
uaucaaaugucuucacuug

SEQ ID NO: 877295 - RNA, 19 nt, Homo sapiens
gauacacagugaauucuuu

SEQ ID NO: 877296 - RNA, 19 nt, Homo sapiens
ccaaagaacauguauaguu

SEQ ID NO: 877297 - RNA, 19 nt, Homo sapiens
gaaaugcaguguaguaugc

SEQ ID NO: 877298 - RNA, 19 nt, Homo sapiens
ucaauacaguuaccuauga

SEQ ID NO: 877299 - RNA, 19 nt, Homo sapiens
ggaagaagcagcuggcaaa

SEQ ID NO: 877300 - RNA, 19 nt, Homo sapiens
cgaaagggcuggcuaugau

SEQ ID NO: 877301 - RNA, 19 nt, Homo sapiens
ggaagaaugagaagcuaua

SEQ ID NO: 877302 - RNA, 19 nt, Homo sapiens
ugaaggagauggagcaguu

SEQ ID NO: 877303 - RNA, 19 nt, Homo sapiens
ccagaaguaucgagccaua

SEQ ID NO: 877304 - RNA, 19 nt, Homo sapiens
aaagagaaaugcaguguag

SEQ ID NO: 877305 - RNA, 19 nt, Homo sapiens
uaaaggaaaccaagagauu

SEQ ID NO: 877306 - RNA, 19 nt, Homo sapiens
aaaguggucugcauuucua

SEQ ID NO: 877307 - RNA, 19 nt, Homo sapiens
gccaugaacuccugguuga

SEQ ID NO: 877308 - RNA, 19 nt, Homo sapiens
ccagagaggugaaggagau

SEQ ID NO: 877309 - RNA, 19 nt, Homo sapiens
gaaagggcuggcuaugaua

SEQ ID NO: 877310 - RNA, 19 nt, Homo sapiens
gggcuuaggucacgagcaa

SEQ ID NO: 877311 - RNA, 19 nt, Homo sapiens
ucuguggccuugaauauuu

SEQ ID NO: 877312 - RNA, 19 nt, Homo sapiens
ccaaggcgcuacguuuauu

SEQ ID NO: 877313 - RNA, 19 nt, Homo sapiens
aagcuuggaucucauuaaa

SEQ ID NO: 877314 - RNA, 19 nt, Homo sapiens
aaacuaaagucagauggaa

SEQ ID NO: 877315 - RNA, 19 nt, Homo sapiens
gcaaugaagaggaucgaaa

SEQ ID NO: 877316 - RNA, 19 nt, Homo sapiens
caaaugucuucacuuguau

SEQ ID NO: 877317 - RNA, 19 nt, Homo sapiens
ccaagccuguccauggaua

SEQ ID NO: 877318 - RNA, 19 nt, Homo sapiens
ccuaauggauccuguuuua

SEQ ID NO: 877319 - RNA, 19 nt, Homo sapiens
ccagagacuaugauuuaua

SEQ ID NO: 877320 - RNA, 19 nt, Homo sapiens
cauuuacucuuuccugauu

SEQ ID NO: 877321 - RNA, 19 nt, Homo sapiens
ucaugucucuauuccauuu

SEQ ID NO: 877322 - RNA, 19 nt, Homo sapiens
guuaugauauugacgaauc

SEQ ID NO: 877323 - RNA, 19 nt, Homo sapiens
gauguccucuugagcaaug

SEQ ID NO: 877324 - RNA, 19 nt, Homo sapiens
ggauauaucaaaugucuuc

SEQ ID NO: 877325 - RNA, 19 nt, Homo sapiens
acccagagacuaugauuua

SEQ ID NO: 877326 - RNA, 19 nt, Homo sapiens
gccuaugcauuuacucuuu

SEQ ID NO: 877327 - RNA, 19 nt, Homo sapiens
gguuuaagcauuugauuug

SEQ ID NO: 877328 - RNA, 19 nt, Homo sapiens
gcaaacugaguaugaaaga

SEQ ID NO: 877329 - RNA, 19 nt, Homo sapiens
gaacucaauauuccugcua

SEQ ID NO: 877330 - RNA, 19 nt, Homo sapiens
agaagcagcuggcaaagca

SEQ ID NO: 877331 - RNA, 19 nt, Homo sapiens
agaagaaugucuccaucaa

SEQ ID NO: 877332 - RNA, 19 nt, Homo sapiens
uaucacauguggcauaaca

SEQ ID NO: 877333 - RNA, 19 nt, Homo sapiens
ggucugcauuucuacugua

SEQ ID NO: 877334 - RNA, 19 nt, Homo sapiens
gaaucacgcuguggugugu

SEQ ID NO: 877335 - RNA, 19 nt, Homo sapiens
aaacacuucugcugcuuug

SEQ ID NO: 877336 - RNA, 19 nt, Homo sapiens
gaaacacuucugcugcuuu

SEQ ID NO: 877337 - RNA, 19 nt, Homo sapiens
gggaguaggagaugucaaa

SEQ ID NO: 877338 - RNA, 19 nt, Homo sapiens
ccauggauauaucaaaugu

SEQ ID NO: 877339 - RNA, 19 nt, Homo sapiens
cgggugaccuauaacaauu

SEQ ID NO: 877340 - RNA, 19 nt, Homo sapiens
gaagaaugucuccaucaau

SEQ ID NO: 877341 - RNA, 19 nt, Homo sapiens
ccaaagugcugggauuaca

SEQ ID NO: 877342 - RNA, 19 nt, Homo sapiens
uacccuaccuucaguauuc

SEQ ID NO: 877343 - RNA, 19 nt, Homo sapiens
gcuuggaucucauuaaacu

SEQ ID NO: 877344 - RNA, 19 nt, Homo sapiens
gaagcuuggaucucauuaa

SEQ ID NO: 877345 - RNA, 19 nt, Homo sapiens
aguaggagaugucaaacuu

SEQ ID NO: 877346 - RNA, 19 nt, Homo sapiens
ggaauucccauguauaaac

SEQ ID NO: 877347 - RNA, 19 nt, Homo sapiens
ucaguggaauguaagaaga

SEQ ID NO: 877348 - RNA, 19 nt, Homo sapiens
ugucaaggaugccacaaug

SEQ ID NO: 877349 - RNA, 19 nt, Homo sapiens
agagaaaugcaguguagua

SEQ ID NO: 877350 - RNA, 19 nt, Homo sapiens
uaccaaggcgcuacguuua

SEQ ID NO: 877351 - RNA, 19 nt, Homo sapiens
ggacccauaggacgcguua

SEQ ID NO: 877352 - RNA, 19 nt, Homo sapiens
caaagagaaaugcagugua

SEQ ID NO: 877353 - RNA, 19 nt, Homo sapiens
guaaugauacacagugaau

SEQ ID NO: 877354 - RNA, 19 nt, Homo sapiens
ccaaaguggucugcauuuc

SEQ ID NO: 877355 - RNA, 19 nt, Homo sapiens
uauacgugauggucaauga

SEQ ID NO: 877356 - RNA, 19 nt, Homo sapiens
caaacugaguaugaaagaa

SEQ ID NO: 877357 - RNA, 19 nt, Homo sapiens
caaaagaacucaauauucc

SEQ ID NO: 877358 - RNA, 19 nt, Homo sapiens
caccacacccagcuaauuu

SEQ ID NO: 877359 - RNA, 19 nt, Homo sapiens
uuuauugccucgucuuauu

SEQ ID NO: 877360 - RNA, 19 nt, Homo sapiens
gaaguucaugccaguagaa

SEQ ID NO: 877361 - RNA, 19 nt, Homo sapiens
ugcaagcccugcuauguga

SEQ ID NO: 877362 - RNA, 19 nt, Homo sapiens
ugacugugauagcauucua

SEQ ID NO: 877363 - RNA, 19 nt, Homo sapiens
gcugcaaacugaguaugaa

SEQ ID NO: 877364 - RNA, 19 nt, Homo sapiens
guccauggauauaucaaau

SEQ ID NO: 877365 - RNA, 19 nt, Homo sapiens
auaacaguauccacacuuu

SEQ ID NO: 877366 - RNA, 19 nt, Homo sapiens
gagaaaugcaguguaguau

SEQ ID NO: 877367 - RNA, 19 nt, Homo sapiens
gauauucagcaaugaguau

SEQ ID NO: 877368 - RNA, 19 nt, Homo sapiens
gaccaggacccuucaaagu

SEQ ID NO: 877369 - RNA, 19 nt, Homo sapiens
aaaggaaaccaagagauuu

SEQ ID NO: 877370 - RNA, 19 nt, Homo sapiens
ucuguucaguggaauguaa

SEQ ID NO: 877371 - RNA, 19 nt, Homo sapiens
ggcuagguauuucuaaugu

SEQ ID NO: 877372 - RNA, 19 nt, Homo sapiens
ugccucagccucccaaaua

SEQ ID NO: 877373 - RNA, 19 nt, Homo sapiens
ggucucaacuuuuaaacuu

SEQ ID NO: 877374 - RNA, 19 nt, Homo sapiens
agccauagcuauccaaagu

SEQ ID NO: 877375 - RNA, 19 nt, Homo sapiens
gcaaguguggccaagaaga

SEQ ID NO: 877376 - RNA, 19 nt, Homo sapiens
guacuucuacacauagcua

SEQ ID NO: 877377 - RNA, 19 nt, Homo sapiens
uaccuucaguauucucuuu

SEQ ID NO: 877378 - RNA, 19 nt, Homo sapiens
uggagcaguuugugaagaa

SEQ ID NO: 877379 - RNA, 19 nt, Homo sapiens
gauauugacgaauccaguu

SEQ ID NO: 877380 - RNA, 19 nt, Homo sapiens
gcuagguauuucuaauguu

SEQ ID NO: 877381 - RNA, 19 nt, Homo sapiens
gaaaacaaagugaagaaga

SEQ ID NO: 877382 - RNA, 19 nt, Homo sapiens
gauucgaacugcacuucug

SEQ ID NO: 877383 - RNA, 19 nt, Homo sapiens
cuuauucacugaccuuugu

SEQ ID NO: 877384 - RNA, 19 nt, Homo sapiens
uaaauuugcccuaauacca

SEQ ID NO: 877385 - RNA, 19 nt, Homo sapiens
ggagcaguuugugaagaaa

SEQ ID NO: 877386 - RNA, 19 nt, Homo sapiens
gagauggagcaguuuguga

SEQ ID NO: 877387 - RNA, 19 nt, Homo sapiens
gaaugucuccaucaauaca

SEQ ID NO: 877388 - RNA, 19 nt, Homo sapiens
auaccacucugauugcaaa

SEQ ID NO: 877389 - RNA, 19 nt, Homo sapiens
ucaaaugucuucacuugua

SEQ ID NO: 877390 - RNA, 19 nt, Homo sapiens
gcacuugccugccaugauu

SEQ ID NO: 877391 - RNA, 19 nt, Homo sapiens
aagaaugucuccaucaaua

SEQ ID NO: 877392 - RNA, 19 nt, Homo sapiens
gaagagguauucuauugau

SEQ ID NO: 877393 - RNA, 19 nt, Homo sapiens
ucacugaccuuuguaauga

SEQ ID NO: 877394 - RNA, 19 nt, Homo sapiens
ccaaauagcugggauuaca

SEQ ID NO: 877395 - RNA, 19 nt, Homo sapiens
uaucaaaugucuucacuug

SEQ ID NO: 877396 - RNA, 19 nt, Homo sapiens
gauacacagugaauucuuu

SEQ ID NO: 877397 - RNA, 19 nt, Homo sapiens
ccaaagaacauguauaguu

SEQ ID NO: 877398 - RNA, 19 nt, Homo sapiens
gaaaugcaguguaguaugc

SEQ ID NO: 877399 - RNA, 19 nt, Homo sapiens
ucaauacaguuaccuauga

SEQ ID NO: 877400 - RNA, 19 nt, Homo sapiens
ggaagaagcagcuggcaaa

SEQ ID NO: 877401 - RNA, 19 nt, Homo sapiens
cgaaagggcuggcuaugau

SEQ ID NO: 877402 - RNA, 19 nt, Homo sapiens
ggaagaaugagaagcuaua

SEQ ID NO: 877403 - RNA, 19 nt, Homo sapiens
ugaaggagauggagcaguu

SEQ ID NO: 877404 - RNA, 19 nt, Homo sapiens
ccagaaguaucgagccaua

SEQ ID NO: 877405 - RNA, 19 nt, Homo sapiens
aaagagaaaugcaguguag

SEQ ID NO: 877406 - RNA, 19 nt, Homo sapiens
uaaaggaaaccaagagauu

SEQ ID NO: 877407 - RNA, 19 nt, Homo sapiens
aaaguggucugcauuucua

SEQ ID NO: 877408 - RNA, 19 nt, Homo sapiens
gccaugaacuccugguuga

SEQ ID NO: 877409 - RNA, 19 nt, Homo sapiens
ccagagaggugaaggagau

SEQ ID NO: 877410 - RNA, 19 nt, Homo sapiens
gggcuuaggucacgagcaa

SEQ ID NO: 877411 - RNA, 19 nt, Homo sapiens
gaaagggcuggcuaugaua

SEQ ID NO: 877412 - RNA, 19 nt, Homo sapiens
ucuguggccuugaauauuu

SEQ ID NO: 877413 - RNA, 19 nt, Homo sapiens
ccaaggcgcuacguuuauu

SEQ ID NO: 877414 - RNA, 19 nt, Homo sapiens
aagcuuggaucucauuaaa

SEQ ID NO: 877415 - RNA, 19 nt, Homo sapiens
aaacuaaagucagauggaa

SEQ ID NO: 877416 - RNA, 19 nt, Homo sapiens
gcaaugaagaggaucgaaa

SEQ ID NO: 877417 - RNA, 19 nt, Homo sapiens
caaaugucuucacuuguau

SEQ ID NO: 877418 - RNA, 19 nt, Homo sapiens
ccaagccuguccauggaua

SEQ ID NO: 877419 - RNA, 19 nt, Homo sapiens
ccuaauggauccuguuuua

SEQ ID NO: 877420 - RNA, 19 nt, Homo sapiens
ccagagacuaugauuuaua

SEQ ID NO: 877421 - RNA, 19 nt, Homo sapiens
cauuuacucuuuccugauu

SEQ ID NO: 877422 - RNA, 19 nt, Homo sapiens
ucaugucucuauuccauuu

SEQ ID NO: 877423 - RNA, 19 nt, Homo sapiens
guuaugauauugacgaauc

SEQ ID NO: 877424 - RNA, 19 nt, Homo sapiens
gauguccucuugagcaaug

SEQ ID NO: 877425 - RNA, 19 nt, Homo sapiens
ggauauaucaaaugucuuc

SEQ ID NO: 877426 - RNA, 19 nt, Homo sapiens
acccagagacuaugauuua

SEQ ID NO: 877427 - RNA, 19 nt, Homo sapiens
gccuaugcauuuacucuuu

SEQ ID NO: 877428 - RNA, 19 nt, Homo sapiens
gguuuaagcauuugauuug

SEQ ID NO: 877429 - RNA, 19 nt, Homo sapiens
gcaaacugaguaugaaaga

SEQ ID NO: 877430 - RNA, 19 nt, Homo sapiens
gaacucaauauuccugcua

SEQ ID NO: 877431 - RNA, 19 nt, Homo sapiens
agaagcagcuggcaaagca

SEQ ID NO: 877432 - RNA, 19 nt, Homo sapiens
agaagaaugucuccaucaa

SEQ ID NO: 877433 - RNA, 19 nt, Homo sapiens
uaucacauguggcauaaca

SEQ ID NO: 877434 - RNA, 19 nt, Homo sapiens
ggucugcauuucuacugua

SEQ ID NO: 877435 - RNA, 19 nt, Homo sapiens
gaaucacgcuguggugugu

SEQ ID NO: 877436 - RNA, 19 nt, Homo sapiens
aaacacuucugcugcuuug

SEQ ID NO: 877437 - RNA, 19 nt, Homo sapiens
gaaacacuucugcugcuuu

SEQ ID NO: 877438 - RNA, 19 nt, Homo sapiens
gggaguaggagaugucaaa

SEQ ID NO: 877439 - RNA, 19 nt, Homo sapiens
ccauggauauaucaaaugu

SEQ ID NO: 877440 - RNA, 19 nt, Homo sapiens
cgggugaccuauaacaauu

SEQ ID NO: 877441 - RNA, 19 nt, Homo sapiens
gaagaaugucuccaucaau

SEQ ID NO: 877442 - RNA, 19 nt, Homo sapiens
ccaaagugcugggauuaca

SEQ ID NO: 877443 - RNA, 19 nt, Homo sapiens
uacccuaccuucaguauuc

SEQ ID NO: 877444 - RNA, 19 nt, Homo sapiens
gcuuggaucucauuaaacu

SEQ ID NO: 877445 - RNA, 19 nt, Homo sapiens
gaagcuuggaucucauuaa

SEQ ID NO: 877446 - RNA, 19 nt, Homo sapiens
aguaggagaugucaaacuu

SEQ ID NO: 877447 - RNA, 19 nt, Homo sapiens
ggaauucccauguauaaac

SEQ ID NO: 877448 - RNA, 19 nt, Homo sapiens
ucaguggaauguaagaaga

SEQ ID NO: 877449 - RNA, 19 nt, Homo sapiens
ugucaaggaugccacaaug

SEQ ID NO: 877450 - RNA, 19 nt, Homo sapiens
agagaaaugcaguguagua

SEQ ID NO: 877451 - RNA, 19 nt, Homo sapiens
uaccaaggcgcuacguuua

SEQ ID NO: 877452 - RNA, 19 nt, Homo sapiens
caaagagaaaugcagugua

SEQ ID NO: 877453 - RNA, 19 nt, Homo sapiens
guaaugauacacagugaau

SEQ ID NO: 877454 - RNA, 19 nt, Homo sapiens
ccaaaguggucugcauuuc

SEQ ID NO: 877455 - RNA, 19 nt, Homo sapiens
uauacgugauggucaauga

SEQ ID NO: 877456 - RNA, 19 nt, Homo sapiens
caaacugaguaugaaagaa

SEQ ID NO: 877457 - RNA, 19 nt, Homo sapiens
caaaagaacucaauauucc

SEQ ID NO: 877458 - RNA, 19 nt, Homo sapiens
caccacacccagcuaauuu

SEQ ID NO: 877459 - RNA, 19 nt, Homo sapiens
uuuauugccucgucuuauu

SEQ ID NO: 877460 - RNA, 19 nt, Homo sapiens
gaaguucaugccaguagaa

SEQ ID NO: 877461 - RNA, 19 nt, Homo sapiens
ugcaagcccugcuauguga

SEQ ID NO: 877462 - RNA, 19 nt, Homo sapiens
ugacugugauagcauucua

SEQ ID NO: 877463 - RNA, 19 nt, Homo sapiens
gcugcaaacugaguaugaa

SEQ ID NO: 877464 - RNA, 19 nt, Homo sapiens
guccauggauauaucaaau

SEQ ID NO: 877465 - RNA, 19 nt, Homo sapiens
auaacaguauccacacuuu

SEQ ID NO: 877466 - RNA, 19 nt, Homo sapiens
gagaaaugcaguguaguau

SEQ ID NO: 877467 - RNA, 19 nt, Homo sapiens
gauauucagcaaugaguau

SEQ ID NO: 877468 - RNA, 19 nt, Homo sapiens
gaccaggacccuucaaagu

SEQ ID NO: 877469 - RNA, 19 nt, Homo sapiens
gaguagaguccacagaaga

SEQ ID NO: 877470 - RNA, 19 nt, Homo sapiens
aaaggaaaccaagagauuu

SEQ ID NO: 877471 - RNA, 19 nt, Homo sapiens
ucuguucaguggaauguaa

SEQ ID NO: 877472 - RNA, 19 nt, Homo sapiens
ggcuagguauuucuaaugu

SEQ ID NO: 877473 - RNA, 19 nt, Homo sapiens
ugccucagccucccaaaua

SEQ ID NO: 877474 - RNA, 19 nt, Homo sapiens
gcaaguguggccaagaaga

SEQ ID NO: 877475 - RNA, 19 nt, Homo sapiens
ggucucaacuuuuaaacuu

SEQ ID NO: 877476 - RNA, 19 nt, Homo sapiens
agccauagcuauccaaagu

SEQ ID NO: 877477 - RNA, 19 nt, Homo sapiens
guacuucuacacauagcua

SEQ ID NO: 877478 - RNA, 19 nt, Homo sapiens
uaccuucaguauucucuuu

SEQ ID NO: 877479 - RNA, 19 nt, Homo sapiens
uggagcaguuugugaagaa

SEQ ID NO: 877480 - RNA, 19 nt, Homo sapiens
gauauugacgaauccaguu

SEQ ID NO: 877481 - RNA, 19 nt, Homo sapiens
gcuagguauuucuaauguu

SEQ ID NO: 877482 - RNA, 19 nt, Homo sapiens
cuuauucacugaccuuugu

SEQ ID NO: 877483 - RNA, 19 nt, Homo sapiens
uaaauuugcccuaauacca

SEQ ID NO: 877484 - RNA, 19 nt, Homo sapiens
gaagacaccaaguauacca

SEQ ID NO: 877485 - RNA, 19 nt, Homo sapiens
auaccacucugauugcaaa

SEQ ID NO: 877486 - RNA, 19 nt, Homo sapiens
gauucgaacugcacuucug

SEQ ID NO: 877487 - RNA, 19 nt, Homo sapiens
ggagcaguuugugaagaaa

SEQ ID NO: 877488 - RNA, 19 nt, Homo sapiens
gagauggagcaguuuguga

SEQ ID NO: 877489 - RNA, 19 nt, Homo sapiens
gcaugugucugacggauaa

SEQ ID NO: 877490 - RNA, 19 nt, Homo sapiens
uaauuuaccugaagaguga

SEQ ID NO: 877491 - RNA, 19 nt, Homo sapiens
gcaaugaaguggagaugga

SEQ ID NO: 877492 - RNA, 19 nt, Homo sapiens
ggauauuccucaugacauu

SEQ ID NO: 877493 - RNA, 19 nt, Homo sapiens
gagaauguuuggagaaugu

SEQ ID NO: 877494 - RNA, 19 nt, Homo sapiens
gcaucaaccuucacaacuu

SEQ ID NO: 877495 - RNA, 19 nt, Homo sapiens
gaaggcaucugaggagaau

SEQ ID NO: 877496 - RNA, 19 nt, Homo sapiens
caucauuacuaacaggaua

SEQ ID NO: 877497 - RNA, 19 nt, Homo sapiens
auacaacccuucuuuacaa

SEQ ID NO: 877498 - RNA, 19 nt, Homo sapiens
ggaggacgauuacgacuac

SEQ ID NO: 877499 - RNA, 19 nt, Homo sapiens
cuucacaacuucagcaauu

SEQ ID NO: 877500 - RNA, 19 nt, Homo sapiens
cuaaauacaacccuucuuu

SEQ ID NO: 877501 - RNA, 19 nt, Homo sapiens
cagaaacccucaccagcaa

SEQ ID NO: 877502 - RNA, 19 nt, Homo sapiens
ccaaugaacaucugcacua

SEQ ID NO: 877503 - RNA, 19 nt, Homo sapiens
agaaugaacucugagaaug

SEQ ID NO: 877504 - RNA, 19 nt, Homo sapiens
gaagaaugaacucugagaa

SEQ ID NO: 877505 - RNA, 19 nt, Homo sapiens
guaguaucuuucucucuuu

SEQ ID NO: 877506 - RNA, 19 nt, Homo sapiens
ggagagaagcaaugaagug

SEQ ID NO: 877507 - RNA, 19 nt, Homo sapiens
gaaugaacucugagaaugu

SEQ ID NO: 877508 - RNA, 19 nt, Homo sapiens
cagcagacccaguuuguga

SEQ ID NO: 877509 - RNA, 19 nt, Homo sapiens
cuacuggccucuaaauaca

SEQ ID NO: 877510 - RNA, 19 nt, Homo sapiens
cuauggcacuagaauuuaa

SEQ ID NO: 877511 - RNA, 19 nt, Homo sapiens
gcacagcuggcaacaccua

SEQ ID NO: 877512 - RNA, 19 nt, Homo sapiens
gcuauggcacuagaauuua

SEQ ID NO: 877513 - RNA, 19 nt, Homo sapiens
gcacggaggggaccacuua

SEQ ID NO: 877514 - RNA, 19 nt, Homo sapiens
caucaaccuucacaacuuc

SEQ ID NO: 877515 - RNA, 19 nt, Homo sapiens
caacacauucacugacaaa

SEQ ID NO: 877516 - RNA, 19 nt, Homo sapiens
acacaggagugagggcaua

SEQ ID NO: 877517 - RNA, 19 nt, Homo sapiens
gcagacaaaccagcuagaa

SEQ ID NO: 877518 - RNA, 19 nt, Homo sapiens
agagugacaccauugauuu

SEQ ID NO: 877519 - RNA, 19 nt, Homo sapiens
aggauuaccuuaucaagca

SEQ ID NO: 877520 - RNA, 19 nt, Homo sapiens
ucagacuugugcagcauaa

SEQ ID NO: 877521 - RNA, 19 nt, Homo sapiens
gcacauguucguacacaca

SEQ ID NO: 877522 - RNA, 19 nt, Homo sapiens
uacgaagaaugaacucuga

SEQ ID NO: 877523 - RNA, 19 nt, Homo sapiens
ggcgucagcuccuccauag

SEQ ID NO: 877524 - RNA, 19 nt, Homo sapiens
gacaagagcguccuacaac

SEQ ID NO: 877525 - RNA, 19 nt, Homo sapiens
cgacaagagcguccuacaa

SEQ ID NO: 877526 - RNA, 19 nt, Homo sapiens
caaugaacaucugcacuag

SEQ ID NO: 877527 - RNA, 19 nt, Homo sapiens
aguaguaucuuucucucuu

SEQ ID NO: 877528 - RNA, 19 nt, Homo sapiens
gcaguucaacgaccacaug

SEQ ID NO: 877529 - RNA, 19 nt, Homo sapiens
ucaagcacauggugacaca

SEQ ID NO: 877530 - RNA, 19 nt, Homo sapiens
guacccagcucuacuuacg

SEQ ID NO: 877531 - RNA, 19 nt, Homo sapiens
gcuacuggccucuaaauac

SEQ ID NO: 877532 - RNA, 19 nt, Homo sapiens
aggcuugggugaauaauag

SEQ ID NO: 877533 - RNA, 19 nt, Homo sapiens
ggcacuagaauuuaagaaa

SEQ ID NO: 877534 - RNA, 19 nt, Homo sapiens
gaggcuugggugaauaaua

SEQ ID NO: 877535 - RNA, 19 nt, Homo sapiens
ggagauggaggacgauuac

SEQ ID NO: 877536 - RNA, 19 nt, Homo sapiens
gaagagugacaccauugau

SEQ ID NO: 877537 - RNA, 19 nt, Homo sapiens
caacagccuucggucaaca

SEQ ID NO: 877538 - RNA, 19 nt, Homo sapiens
cagacaaaccagcuagaaa

SEQ ID NO: 877539 - RNA, 19 nt, Homo sapiens
aaugaacucugagaauguu

SEQ ID NO: 877540 - RNA, 19 nt, Homo sapiens
ccugaagagugacaccauu

SEQ ID NO: 877541 - RNA, 19 nt, Homo sapiens
uucaagagguccacugguu

SEQ ID NO: 877542 - RNA, 19 nt, Homo sapiens
ucaagcacauguucguaca

SEQ ID NO: 877543 - RNA, 19 nt, Homo sapiens
gcaacacgcaggucauugg

SEQ ID NO: 877544 - RNA, 19 nt, Homo sapiens
gaacuacgucaagcacaug

SEQ ID NO: 877545 - RNA, 19 nt, Homo sapiens
gggcgucagcuccuccaua

SEQ ID NO: 877546 - RNA, 19 nt, Homo sapiens
cacauucacugacaaacuc

SEQ ID NO: 877547 - RNA, 19 nt, Homo sapiens
gaccaaaucgagcaguuca

SEQ ID NO: 877548 - RNA, 19 nt, Homo sapiens
ccaaacagaacuacgucaa

SEQ ID NO: 877549 - RNA, 19 nt, Homo sapiens
acaagagcguccuacaaca

SEQ ID NO: 877550 - RNA, 19 nt, Homo sapiens
uacaacccuucuuuacaaa

SEQ ID NO: 877551 - RNA, 19 nt, Homo sapiens
ucuagcuacuggccucuaa

SEQ ID NO: 877552 - RNA, 19 nt, Homo sapiens
gaauguuuggagaauguuu

SEQ ID NO: 877553 - RNA, 19 nt, Homo sapiens
ccacuucugugacguaacg

SEQ ID NO: 877554 - RNA, 19 nt, Homo sapiens
cuuucucucuuucuuauga

SEQ ID NO: 877555 - RNA, 19 nt, Homo sapiens
gugagggcauaccagugua

SEQ ID NO: 877556 - RNA, 19 nt, Homo sapiens
gacaaaccagcuagaaaca

SEQ ID NO: 877557 - RNA, 19 nt, Homo sapiens
ggagugcacggaagacaca

SEQ ID NO: 877558 - RNA, 19 nt, Homo sapiens
cgaagaaugaacucugaga

SEQ ID NO: 877559 - RNA, 19 nt, Homo sapiens
cugguuggaucucuagcua

SEQ ID NO: 877560 - RNA, 19 nt, Homo sapiens
gcugguacauuacauuucc

SEQ ID NO: 877561 - RNA, 19 nt, Homo sapiens
guaucuuucucucuuucuu

SEQ ID NO: 877562 - RNA, 19 nt, Homo sapiens
gaucuacucggcacucuac

SEQ ID NO: 877563 - RNA, 19 nt, Homo sapiens
gcucauugacuucauguac

SEQ ID NO: 877564 - RNA, 19 nt, Homo sapiens
aaauacaacccuucuuuac

SEQ ID NO: 877565 - RNA, 19 nt, Homo sapiens
cgucugcccagcaaaguuu

SEQ ID NO: 877566 - RNA, 19 nt, Homo sapiens
gcacauggugacacacaca

SEQ ID NO: 877567 - RNA, 19 nt, Homo sapiens
ggccacuucugugacguaa

SEQ ID NO: 877568 - RNA, 19 nt, Homo sapiens
ugaagagugacaccauuga

SEQ ID NO: 877569 - RNA, 19 nt, Homo sapiens
gguuggaucucuagcuacu

SEQ ID NO: 877570 - RNA, 19 nt, Homo sapiens
agacaaaccagcuagaaac

SEQ ID NO: 877571 - RNA, 19 nt, Homo sapiens
gaucuuugaccaucagucu

SEQ ID NO: 877572 - RNA, 19 nt, Homo sapiens
gauccuggaacgcaacgaa

SEQ ID NO: 877573 - RNA, 19 nt, Homo sapiens
ggacgauuacgacuacuac

SEQ ID NO: 877574 - RNA, 19 nt, Homo sapiens
aaagcucauugacuucaug

SEQ ID NO: 877575 - RNA, 19 nt, Homo sapiens
ucaacacauucacugacaa

SEQ ID NO: 877576 - RNA, 19 nt, Homo sapiens
acauugcugucugaucuuu

SEQ ID NO: 877577 - RNA, 19 nt, Homo sapiens
gaacuuugaagcuguuuug

SEQ ID NO: 877578 - RNA, 19 nt, Homo sapiens
ugaggaugcaugugucuga

SEQ ID NO: 877579 - RNA, 19 nt, Homo sapiens
ugagaauguuuggagaaug

SEQ ID NO: 877580 - RNA, 19 nt, Homo sapiens
agaacuacgucaagcacau

SEQ ID NO: 877581 - RNA, 19 nt, Homo sapiens
aagagugacaccauugauu

SEQ ID NO: 877582 - RNA, 19 nt, Homo sapiens
caaacagaacuacgucaag

SEQ ID NO: 877583 - RNA, 19 nt, Homo sapiens
gccagcauccugcagauca

SEQ ID NO: 877584 - RNA, 19 nt, Homo sapiens
ugcaaaagcucauugacuu

SEQ ID NO: 877585 - RNA, 19 nt, Homo sapiens
gggaugaccgagcgcauuc

SEQ ID NO: 877586 - RNA, 19 nt, Homo sapiens
cacaccgggucaucugauu

SEQ ID NO: 877587 - RNA, 19 nt, Homo sapiens
uuugccugcugguacauua

SEQ ID NO: 877588 - RNA, 19 nt, Homo sapiens
aagaaugaacucugagaau

SEQ ID NO: 877589 - RNA, 19 nt, Homo sapiens
gauaagagaaggacuuuaa

SEQ ID NO: 877590 - RNA, 19 nt, Homo sapiens
gaaaauaccucuaaaacug

SEQ ID NO: 877591 - RNA, 19 nt, Homo sapiens
gaacagagaauucuuccaa

SEQ ID NO: 877592 - RNA, 19 nt, Homo sapiens
ccaagaagaugugaaacua

SEQ ID NO: 877593 - RNA, 19 nt, Homo sapiens
aaaguuaaguugcugauga

SEQ ID NO: 877594 - RNA, 19 nt, Homo sapiens
cauaugcugucuauaauga

SEQ ID NO: 877595 - RNA, 19 nt, Homo sapiens
caacacugcucuccauaug

SEQ ID NO: 877596 - RNA, 19 nt, Homo sapiens
gccaauagcugggccauga

SEQ ID NO: 877597 - RNA, 19 nt, Homo sapiens
caacugcucugcuccguau

SEQ ID NO: 877598 - RNA, 19 nt, Homo sapiens
agacaaacaucgaagugaa

SEQ ID NO: 877599 - RNA, 19 nt, Homo sapiens
gaccagcccugccaacuuc

SEQ ID NO: 877600 - RNA, 19 nt, Homo sapiens
guaacugcaucuucucuga

SEQ ID NO: 877601 - RNA, 19 nt, Homo sapiens
cuuaagcaaucccugaaua

SEQ ID NO: 877602 - RNA, 19 nt, Homo sapiens
gcuauaaugugccaagaag

SEQ ID NO: 877603 - RNA, 19 nt, Homo sapiens
uaacgaaggcuauaaugug

SEQ ID NO: 877604 - RNA, 19 nt, Homo sapiens
agagaauucuuccaaauca

SEQ ID NO: 877605 - RNA, 19 nt, Homo sapiens
gaggagcagugauauuuac

SEQ ID NO: 877606 - RNA, 19 nt, Homo sapiens
agucugaaaucuacaagaa

SEQ ID NO: 877607 - RNA, 19 nt, Homo sapiens
gugaaacuauucugcuaga

SEQ ID NO: 877608 - RNA, 19 nt, Homo sapiens
gagaauucuuccaaaucaa

SEQ ID NO: 877609 - RNA, 19 nt, Homo sapiens
gcucugcuccguauauuau

SEQ ID NO: 877610 - RNA, 19 nt, Homo sapiens
gaaaacaagacaccucuaa

SEQ ID NO: 877611 - RNA, 19 nt, Homo sapiens
acagagaauucuuccaaau

SEQ ID NO: 877612 - RNA, 19 nt, Homo sapiens
gcaagucaccuaugcacau

SEQ ID NO: 877613 - RNA, 19 nt, Homo sapiens
gcaacacugcucuccauau

SEQ ID NO: 877614 - RNA, 19 nt, Homo sapiens
gacaaacaucgaagugaaa

SEQ ID NO: 877615 - RNA, 19 nt, Homo sapiens
aagaugaggagcagugaua

SEQ ID NO: 877616 - RNA, 19 nt, Homo sapiens
guccuaaguuugugaagau

SEQ ID NO: 877617 - RNA, 19 nt, Homo sapiens
uacuuaauguguccgauaa

SEQ ID NO: 877618 - RNA, 19 nt, Homo sapiens
guagagcaaccaauguuau

SEQ ID NO: 877619 - RNA, 19 nt, Homo sapiens
ggugcugauccaaauauua

SEQ ID NO: 877620 - RNA, 19 nt, Homo sapiens
ugaggagcagugauauuua

SEQ ID NO: 877621 - RNA, 19 nt, Homo sapiens
ggaccagcccugccaacuu

SEQ ID NO: 877622 - RNA, 19 nt, Homo sapiens
ucugaaaucuacaagaaca

SEQ ID NO: 877623 - RNA, 19 nt, Homo sapiens
uaagcaaucccugaauaaa

SEQ ID NO: 877624 - RNA, 19 nt, Homo sapiens
cuccauaugcugucuauaa

SEQ ID NO: 877625 - RNA, 19 nt, Homo sapiens
uuuggaagcuuaagcaauc

SEQ ID NO: 877626 - RNA, 19 nt, Homo sapiens
gaagagaggaccccaguug

SEQ ID NO: 877627 - RNA, 19 nt, Homo sapiens
gaaauccacuuguuuuaac

SEQ ID NO: 877628 - RNA, 19 nt, Homo sapiens
caauguagagcaaccaaug

SEQ ID NO: 877629 - RNA, 19 nt, Homo sapiens
guaccagacuccagaugag

SEQ ID NO: 877630 - RNA, 19 nt, Homo sapiens
caagaagaugugaaacuau

SEQ ID NO: 877631 - RNA, 19 nt, Homo sapiens
gaugaggagcagugauauu

SEQ ID NO: 877632 - RNA, 19 nt, Homo sapiens
gcucagccaucggauuuag

SEQ ID NO: 877633 - RNA, 19 nt, Homo sapiens
uuaagcaaucccugaauaa

SEQ ID NO: 877634 - RNA, 19 nt, Homo sapiens
caaauauuaccgaugucua

SEQ ID NO: 877635 - RNA, 19 nt, Homo sapiens
acaagacaccucuaacgaa

SEQ ID NO: 877636 - RNA, 19 nt, Homo sapiens
caagacaaacaucgaagug

SEQ ID NO: 877637 - RNA, 19 nt, Homo sapiens
uaauguguccgauaagaga

SEQ ID NO: 877638 - RNA, 19 nt, Homo sapiens
gguaccagacuccagauga

SEQ ID NO: 877639 - RNA, 19 nt, Homo sapiens
gggccagacugccuugcuu

SEQ ID NO: 877640 - RNA, 19 nt, Homo sapiens
gaagaugugaaacuauucu

SEQ ID NO: 877641 - RNA, 19 nt, Homo sapiens
cacagaaaaugccagcuua

SEQ ID NO: 877642 - RNA, 19 nt, Homo sapiens
gcaagacuguuuucacaca

SEQ ID NO: 877643 - RNA, 19 nt, Homo sapiens
aaugguagcaagacuguuu

SEQ ID NO: 877644 - RNA, 19 nt, Homo sapiens
cuacaagaacagagaauuc

SEQ ID NO: 877645 - RNA, 19 nt, Homo sapiens
gcagugauggcaaccuuuc

SEQ ID NO: 877646 - RNA, 19 nt, Homo sapiens
uagagcaaccaauguuauu

SEQ ID NO: 877647 - RNA, 19 nt, Homo sapiens
gaaaaugccagcuuaacau

SEQ ID NO: 877648 - RNA, 19 nt, Homo sapiens
gcgauuggccuggcagcua

SEQ ID NO: 877649 - RNA, 19 nt, Homo sapiens
cagcuuaacaucugugaca

SEQ ID NO: 877650 - RNA, 19 nt, Homo sapiens
gauauuuacacuucugcuu

SEQ ID NO: 877651 - RNA, 19 nt, Homo sapiens
uguagagcaaccaauguua

SEQ ID NO: 877652 - RNA, 19 nt, Homo sapiens
uccauaugcugucuauaau

SEQ ID NO: 877653 - RNA, 19 nt, Homo sapiens
gugccaagaagaugugaaa

SEQ ID NO: 877654 - RNA, 19 nt, Homo sapiens
uauaaugugccaagaagau

SEQ ID NO: 877655 - RNA, 19 nt, Homo sapiens
cagagaauucuuccaaauc

SEQ ID NO: 877656 - RNA, 19 nt, Homo sapiens
aacagagaauucuuccaaa

SEQ ID NO: 877657 - RNA, 19 nt, Homo sapiens
aguaguaacugcaucuucu

SEQ ID NO: 877658 - RNA, 19 nt, Homo sapiens
gagcaaccaauguuauuuu

SEQ ID NO: 877659 - RNA, 19 nt, Homo sapiens
uaugcugucuauaaugaga

SEQ ID NO: 877660 - RNA, 19 nt, Homo sapiens
gaggaugucgggaugauac

SEQ ID NO: 877661 - RNA, 19 nt, Homo sapiens
agacguccuuguccgagaa

SEQ ID NO: 877662 - RNA, 19 nt, Homo sapiens
aagcagugauggcaaccuu

SEQ ID NO: 877663 - RNA, 19 nt, Homo sapiens
acacaagacaaacaucgaa

SEQ ID NO: 877664 - RNA, 19 nt, Homo sapiens
ucugcuccguauauuauuu

SEQ ID NO: 877665 - RNA, 19 nt, Homo sapiens
gcugggccaugaagaugau

SEQ ID NO: 877666 - RNA, 19 nt, Homo sapiens
uuugcuauuuggaagcuua

SEQ ID NO: 877667 - RNA, 19 nt, Homo sapiens
uggcaacacugcucuccau

SEQ ID NO: 877668 - RNA, 19 nt, Homo sapiens
gugcugauccaaauauuac

SEQ ID NO: 877669 - RNA, 19 nt, Homo sapiens
cugcucagccaucggauuu

SEQ ID NO: 877670 - RNA, 19 nt, Homo sapiens
acacugcucuccauaugcu

SEQ ID NO: 877671 - RNA, 19 nt, Homo sapiens
auccaaauauuaccgaugu

SEQ ID NO: 877672 - RNA, 19 nt, Homo sapiens
gacgucaccaggagccuaa

SEQ ID NO: 877673 - RNA, 19 nt, Homo sapiens
cucaagaccucgcgcucaa

SEQ ID NO: 877674 - RNA, 19 nt, Homo sapiens
cuaacgaaggcuauaaugu

SEQ ID NO: 877675 - RNA, 19 nt, Homo sapiens
augaggagcagugauauuu

SEQ ID NO: 877676 - RNA, 19 nt, Homo sapiens
cauauguaagggucaguuu

SEQ ID NO: 877677 - RNA, 19 nt, Homo sapiens
uagcaagacuguuuucaca

SEQ ID NO: 877678 - RNA, 19 nt, Homo sapiens
gaauaugucaaugguagca

SEQ ID NO: 877679 - RNA, 19 nt, Homo sapiens
aaacaagacaccucuaacg

SEQ ID NO: 877680 - RNA, 19 nt, Homo sapiens
ggccagacugccuugcuuu

SEQ ID NO: 877681 - RNA, 19 nt, Homo sapiens
auacuuaauguguccgaua

SEQ ID NO: 877682 - RNA, 19 nt, Homo sapiens
ggcucccgcugaagagaaa

SEQ ID NO: 877683 - RNA, 19 nt, Homo sapiens
gaagaugaggagcagugau

SEQ ID NO: 877684 - RNA, 19 nt, Homo sapiens
gcuagaccuuggugcugau

SEQ ID NO: 877685 - RNA, 19 nt, Homo sapiens
aaugccagcuuaacaucug

SEQ ID NO: 877686 - RNA, 19 nt, Homo sapiens
gcacagaaaaugccagcuu

SEQ ID NO: 877687 - RNA, 19 nt, Homo sapiens
uguccuaaguuugugaaga

SEQ ID NO: 877688 - RNA, 19 nt, Homo sapiens
ugaaaucuacaagaacaga

SEQ ID NO: 877689 - RNA, 19 nt, Homo sapiens
ccuuugagcucaucuauaa

SEQ ID NO: 877690 - RNA, 19 nt, Homo sapiens
gcaaguggguggugcagaa

SEQ ID NO: 877691 - RNA, 19 nt, Homo sapiens
gagcuggucucccucagaa

SEQ ID NO: 877692 - RNA, 19 nt, Homo sapiens
cgacagcuauauccgcuuu

SEQ ID NO: 877693 - RNA, 19 nt, Homo sapiens
gagcaaagccucagcuaag

SEQ ID NO: 877694 - RNA, 19 nt, Homo sapiens
gagacaagcagcccaagaa

SEQ ID NO: 877695 - RNA, 19 nt, Homo sapiens
gcagugaauuuagagcaaa

SEQ ID NO: 877696 - RNA, 19 nt, Homo sapiens
cggcuaaggucuucauuuc

SEQ ID NO: 877697 - RNA, 19 nt, Homo sapiens
ugaagaaccuggacaacuc

SEQ ID NO: 877698 - RNA, 19 nt, Homo sapiens
agacagugguuccugguaa

SEQ ID NO: 877699 - RNA, 19 nt, Homo sapiens
gcaagcuggugggcacuaa

SEQ ID NO: 877700 - RNA, 19 nt, Homo sapiens
ggaguaccuuagcaacuug

SEQ ID NO: 877701 - RNA, 19 nt, Homo sapiens
ggucaaggccaaaggcaaa

SEQ ID NO: 877702 - RNA, 19 nt, Homo sapiens
ugacaggccuuaggacaau

SEQ ID NO: 877703 - RNA, 19 nt, Homo sapiens
ggcuauaggugcugucaga

SEQ ID NO: 877704 - RNA, 19 nt, Homo sapiens
gaguugcagugaauuuaga

SEQ ID NO: 877705 - RNA, 19 nt, Homo sapiens
gaagggucaguuucuguaa

SEQ ID NO: 877706 - RNA, 19 nt, Homo sapiens
caugaaggaugcugugauc

SEQ ID NO: 877707 - RNA, 19 nt, Homo sapiens
gucagggccuugugcagua

SEQ ID NO: 877708 - RNA, 19 nt, Homo sapiens
gggccucaguuguauauca

SEQ ID NO: 877709 - RNA, 19 nt, Homo sapiens
gcucugugcuggcgugcaa

SEQ ID NO: 877710 - RNA, 19 nt, Homo sapiens
guauaacuggguucacaua

SEQ ID NO: 877711 - RNA, 19 nt, Homo sapiens
ucaggcaccucgacacuca

SEQ ID NO: 877712 - RNA, 19 nt, Homo sapiens
caaagccucagcuaaguga

SEQ ID NO: 877713 - RNA, 19 nt, Homo sapiens
caacaacuccauccagaag

SEQ ID NO: 877714 - RNA, 19 nt, Homo sapiens
gcaacaacuccauccagaa

SEQ ID NO: 877715 - RNA, 19 nt, Homo sapiens
ggacucuacccacggcuaa

SEQ ID NO: 877716 - RNA, 19 nt, Homo sapiens
gaggggcguucauguauaa

SEQ ID NO: 877717 - RNA, 19 nt, Homo sapiens
ucagagcacugcgauguuc

SEQ ID NO: 877718 - RNA, 19 nt, Homo sapiens
gaagaaccuggacaacuca

SEQ ID NO: 877719 - RNA, 19 nt, Homo sapiens
acaagcagcccaagaaaca

SEQ ID NO: 877720 - RNA, 19 nt, Homo sapiens
gagccaagggcaagugcua

SEQ ID NO: 877721 - RNA, 19 nt, Homo sapiens
gggagugggucuggauuuc

SEQ ID NO: 877722 - RNA, 19 nt, Homo sapiens
cagagccucagguguguua

SEQ ID NO: 877723 - RNA, 19 nt, Homo sapiens
ggaggggcguucauguaua

SEQ ID NO: 877724 - RNA, 19 nt, Homo sapiens
caguuucuguaaucacuuu

SEQ ID NO: 877725 - RNA, 19 nt, Homo sapiens
ugaagggucaguuucugua

SEQ ID NO: 877726 - RNA, 19 nt, Homo sapiens
ggauccaacaccaaauaaa

SEQ ID NO: 877727 - RNA, 19 nt, Homo sapiens
gcaaagccucagcuaagug

SEQ ID NO: 877728 - RNA, 19 nt, Homo sapiens
uaacagugcacacagaagu

SEQ ID NO: 877729 - RNA, 19 nt, Homo sapiens
agaagcaccuggagaacuc

SEQ ID NO: 877730 - RNA, 19 nt, Homo sapiens
ggaaggggaucgcaacauc

SEQ ID NO: 877731 - RNA, 19 nt, Homo sapiens
ggagacaagcagcccaaga

SEQ ID NO: 877732 - RNA, 19 nt, Homo sapiens
uagaguugcagugaauuua

SEQ ID NO: 877733 - RNA, 19 nt, Homo sapiens
ggcagagccucgagugaca

SEQ ID NO: 877734 - RNA, 19 nt, Homo sapiens
gggcagagaggcuauaggu

SEQ ID NO: 877735 - RNA, 19 nt, Homo sapiens
aagaagcugugucagacuu

SEQ ID NO: 877736 - RNA, 19 nt, Homo sapiens
gagugggucuggauuucug

SEQ ID NO: 877737 - RNA, 19 nt, Homo sapiens
caguaacagugcacacaga

SEQ ID NO: 877738 - RNA, 19 nt, Homo sapiens
agucaggucuguagaugug

SEQ ID NO: 877739 - RNA, 19 nt, Homo sapiens
aaggaaggcuugguugugu

SEQ ID NO: 877740 - RNA, 19 nt, Homo sapiens
caccaaguuugaccucaga

SEQ ID NO: 877741 - RNA, 19 nt, Homo sapiens
acauggacaucgacaagga

SEQ ID NO: 877742 - RNA, 19 nt, Homo sapiens
gugcuagaguugcagugaa

SEQ ID NO: 877743 - RNA, 19 nt, Homo sapiens
ugagucaggucuguagaug

SEQ ID NO: 877744 - RNA, 19 nt, Homo sapiens
ccauugcugucucuugugu

SEQ ID NO: 877745 - RNA, 19 nt, Homo sapiens
guagcucuguaucaggauu

SEQ ID NO: 877746 - RNA, 19 nt, Homo sapiens
gauccaacaccaaauaaaa

SEQ ID NO: 877747 - RNA, 19 nt, Homo sapiens
aggaguaccuuagcaacuu

SEQ ID NO: 877748 - RNA, 19 nt, Homo sapiens
gggcguucauguauaacug

SEQ ID NO: 877749 - RNA, 19 nt, Homo sapiens
uaaggguuguagcucugua

SEQ ID NO: 877750 - RNA, 19 nt, Homo sapiens
ucaguuguauaucagaauc

SEQ ID NO: 877751 - RNA, 19 nt, Homo sapiens
uuucugguguguggacuua

SEQ ID NO: 877752 - RNA, 19 nt, Homo sapiens
ccaccgaaccuugauuuca

SEQ ID NO: 877753 - RNA, 19 nt, Homo sapiens
ccagagaccccaugcuuaa

SEQ ID NO: 877754 - RNA, 19 nt, Homo sapiens
ggccaaaggcaaauucaag

SEQ ID NO: 877755 - RNA, 19 nt, Homo sapiens
gacgaggcaucaugugcau

SEQ ID NO: 877756 - RNA, 19 nt, Homo sapiens
ccacauggacaucgacaag

SEQ ID NO: 877757 - RNA, 19 nt, Homo sapiens
agacaagcagcccaagaaa

SEQ ID NO: 877758 - RNA, 19 nt, Homo sapiens
ccucaguuguauaucagaa

SEQ ID NO: 877759 - RNA, 19 nt, Homo sapiens
acagugcacacagaaguua

SEQ ID NO: 877760 - RNA, 19 nt, Homo sapiens
cuuaagaagcugugucaga

SEQ ID NO: 877761 - RNA, 19 nt, Homo sapiens
cuagaguugcagugaauuu

SEQ ID NO: 877762 - RNA, 19 nt, Homo sapiens
ucagggccuugugcaguaa

SEQ ID NO: 877763 - RNA, 19 nt, Homo sapiens
aguggguggugcagaagua

SEQ ID NO: 877764 - RNA, 19 nt, Homo sapiens
uggaggagaugcugaagcu

SEQ ID NO: 877765 - RNA, 19 nt, Homo sapiens
ggcagagccucaggugugu

SEQ ID NO: 877766 - RNA, 19 nt, Homo sapiens
gcaacuuggcccacaugga

SEQ ID NO: 877767 - RNA, 19 nt, Homo sapiens
gguuguagcucuguaucag

SEQ ID NO: 877768 - RNA, 19 nt, Homo sapiens
gcgaggaguaccuuagcaa

SEQ ID NO: 877769 - RNA, 19 nt, Homo sapiens
gacuuaagaagcuguguca

SEQ ID NO: 877770 - RNA, 19 nt, Homo sapiens
cuggauccaacaccaaaua

SEQ ID NO: 877771 - RNA, 19 nt, Homo sapiens
gcucuauggcgcugacuuc

SEQ ID NO: 877772 - RNA, 19 nt, Homo sapiens
acaacuccauccagaagca

SEQ ID NO: 877773 - RNA, 19 nt, Homo sapiens
caacaucuggaucgugaag

SEQ ID NO: 877774 - RNA, 19 nt, Homo sapiens
aagggcaagugcuagaguu

SEQ ID NO: 877775 - RNA, 19 nt, Homo sapiens
caaggccaaaggcaaauuc

SEQ ID NO: 877776 - RNA, 19 nt, Homo sapiens
agugguuccugguaacuga

SEQ ID NO: 877777 - RNA, 19 nt, Homo sapiens
gacagugguuccugguaac

SEQ ID NO: 877778 - RNA, 19 nt, Homo sapiens
ggguggugcagaaguauau

SEQ ID NO: 877779 - RNA, 19 nt, Homo sapiens
gugacaggccuuaggacaa

SEQ ID NO: 877780 - RNA, 19 nt, Homo sapiens
agagcaaagccucagcuaa

SEQ ID NO: 877781 - RNA, 19 nt, Homo sapiens
uugguugugugccaggaua

SEQ ID NO: 877782 - RNA, 19 nt, Homo sapiens
ugcuuaagcuuuuauggua

SEQ ID NO: 877783 - RNA, 19 nt, Homo sapiens
guauaucagaaucuucaga

SEQ ID NO: 877784 - RNA, 19 nt, Homo sapiens
gaggaguaccuuagcaacu

SEQ ID NO: 877785 - RNA, 19 nt, Homo sapiens
auucaaggccagacuguga

SEQ ID NO: 877786 - RNA, 19 nt, Homo sapiens
ccccagaguuuguggauga

SEQ ID NO: 877787 - RNA, 19 nt, Homo sapiens
ugcagugaauuuagagcaa

SEQ ID NO: 877788 - RNA, 19 nt, Homo sapiens
gccaagggcaagugcuaga

SEQ ID NO: 877789 - RNA, 19 nt, Homo sapiens
ucaaguaccucgaauauga

SEQ ID NO: 877790 - RNA, 19 nt, Homo sapiens
gcaaggcacuggcuucuuc

SEQ ID NO: 877791 - RNA, 19 nt, Homo sapiens
ggacacaaguucugcuuuc

SEQ ID NO: 877792 - RNA, 19 nt, Homo sapiens
gagaagggaccuccugaaa

SEQ ID NO: 877793 - RNA, 19 nt, Homo sapiens
gcuggagacaucaaaguua

SEQ ID NO: 877794 - RNA, 19 nt, Homo sapiens
gauacgaguucgagcugaa

SEQ ID NO: 877795 - RNA, 19 nt, Homo sapiens
cuggagacaucaaaguuaa

SEQ ID NO: 877796 - RNA, 19 nt, Homo sapiens
ccugaaaacucgcucuuua

SEQ ID NO: 877797 - RNA, 19 nt, Homo sapiens
gaagggaccuccugaaaac

SEQ ID NO: 877798 - RNA, 19 nt, Homo sapiens
gcagaggaaugcggacugu

SEQ ID NO: 877799 - RNA, 19 nt, Homo sapiens
gaaaacucgcucuuuauaa

SEQ ID NO: 877800 - RNA, 19 nt, Homo sapiens
ugacagggccacaucauca

SEQ ID NO: 877801 - RNA, 19 nt, Homo sapiens
ggagacaucaaaguuaaga

SEQ ID NO: 877802 - RNA, 19 nt, Homo sapiens
gcauggaucaggagaaugg

SEQ ID NO: 877803 - RNA, 19 nt, Homo sapiens
ucaaugugcgcuucaagaa

SEQ ID NO: 877804 - RNA, 19 nt, Homo sapiens
gagaagcagcagaggaaug

SEQ ID NO: 877805 - RNA, 19 nt, Homo sapiens
ugaaaacucgcucuuuaua

SEQ ID NO: 877806 - RNA, 19 nt, Homo sapiens
ccaaagcagugcgggaaca

SEQ ID NO: 877807 - RNA, 19 nt, Homo sapiens
aagagaagcagcagaggaa

SEQ ID NO: 877808 - RNA, 19 nt, Homo sapiens
cauccuugcuggagacauc

SEQ ID NO: 877809 - RNA, 19 nt, Homo sapiens
cgagaucgccaccauccuu

SEQ ID NO: 877810 - RNA, 19 nt, Homo sapiens
cggcauggaucaggagaau

SEQ ID NO: 877811 - RNA, 19 nt, Homo sapiens
caaguaccucgaauaugaa

SEQ ID NO: 877812 - RNA, 19 nt, Homo sapiens
caacggcgaagcagaaguc

SEQ ID NO: 877813 - RNA, 19 nt, Homo sapiens
cuucugcuccuucaauaaa

SEQ ID NO: 877814 - RNA, 19 nt, Homo sapiens
cuucaaguaccucgaauau

SEQ ID NO: 877815 - RNA, 19 nt, Homo sapiens
cuccaugccuggcuugaug

SEQ ID NO: 877816 - RNA, 19 nt, Homo sapiens
ccgcaacggcgaagcagaa

SEQ ID NO: 877817 - RNA, 19 nt, Homo sapiens
gcuucaaguaccucgaaua

SEQ ID NO: 877818 - RNA, 19 nt, Homo sapiens
ggccaggaccgcuaugaca

SEQ ID NO: 877819 - RNA, 19 nt, Homo sapiens
uggcuuugcugcugcuugu

SEQ ID NO: 877820 - RNA, 19 nt, Homo sapiens
cuucuucgggcuucaagua

SEQ ID NO: 877821 - RNA, 19 nt, Homo sapiens
cccuucugcuccuucaaua

SEQ ID NO: 877822 - RNA, 19 nt, Homo sapiens
ugccaccucuaucugugua

SEQ ID NO: 877823 - RNA, 19 nt, Homo sapiens
gagugagcagaaaggcuua

SEQ ID NO: 877824 - RNA, 19 nt, Homo sapiens
cggcgaagcagaagucagu

SEQ ID NO: 877825 - RNA, 19 nt, Homo sapiens
gggcuucaaguaccucgaa

SEQ ID NO: 877826 - RNA, 19 nt, Homo sapiens
ugugcgaccugcccaagau

SEQ ID NO: 877827 - RNA, 19 nt, Homo sapiens
uguacauacucccuucuuc

SEQ ID NO: 877828 - RNA, 19 nt, Homo sapiens
gcuaugacagggccacauc

SEQ ID NO: 877829 - RNA, 19 nt, Homo sapiens
gacaucaaaguuaagaaag

SEQ ID NO: 877830 - RNA, 19 nt, Homo sapiens
aaacgaggcaaaagcauuu

SEQ ID NO: 877831 - RNA, 19 nt, Homo sapiens
ugagaagggaccuccugaa

SEQ ID NO: 877832 - RNA, 19 nt, Homo sapiens
gaacagagagcaugacaaa

SEQ ID NO: 877833 - RNA, 19 nt, Homo sapiens
ugaagaggaugaucaauuu

SEQ ID NO: 877834 - RNA, 19 nt, Homo sapiens
ucaacaagcucucuaguga

SEQ ID NO: 877835 - RNA, 19 nt, Homo sapiens
gaagaagaguccagaguuc

SEQ ID NO: 877836 - RNA, 19 nt, Homo sapiens
caacuaguauuucggauga

SEQ ID NO: 877837 - RNA, 19 nt, Homo sapiens
gaaggaggauaauauuuca

SEQ ID NO: 877838 - RNA, 19 nt, Homo sapiens
gaaggaaggaggauaauau

SEQ ID NO: 877839 - RNA, 19 nt, Homo sapiens
gacaagaucugugcuguga

SEQ ID NO: 877840 - RNA, 19 nt, Homo sapiens
guaagcauguuaaguguau

SEQ ID NO: 877841 - RNA, 19 nt, Homo sapiens
gaugaagucugauaaugug

SEQ ID NO: 877842 - RNA, 19 nt, Homo sapiens
gagaugaagucugauaaug

SEQ ID NO: 877843 - RNA, 19 nt, Homo sapiens
cauagugucuggaauaaau

SEQ ID NO: 877844 - RNA, 19 nt, Homo sapiens
aaauagcgcuuccaaacaa

SEQ ID NO: 877845 - RNA, 19 nt, Homo sapiens
ggaaggaggauaauauuuc

SEQ ID NO: 877846 - RNA, 19 nt, Homo sapiens
ggaauacuggcuaguuaua

SEQ ID NO: 877847 - RNA, 19 nt, Homo sapiens
gccagagacuccagaaauu

SEQ ID NO: 877848 - RNA, 19 nt, Homo sapiens
uagaggagacgcugaaaua

SEQ ID NO: 877849 - RNA, 19 nt, Homo sapiens
gaaacgacaacaucagaaa

SEQ ID NO: 877850 - RNA, 19 nt, Homo sapiens
aaacagagacugagauuuc

SEQ ID NO: 877851 - RNA, 19 nt, Homo sapiens
gaaggaagaauugaaagaa

SEQ ID NO: 877852 - RNA, 19 nt, Homo sapiens
ccaacauccucaagaauga

SEQ ID NO: 877853 - RNA, 19 nt, Homo sapiens
uaacagcaguggaacuaga

SEQ ID NO: 877854 - RNA, 19 nt, Homo sapiens
agacugagauuuccacuag

SEQ ID NO: 877855 - RNA, 19 nt, Homo sapiens
ggagaagcaugguggacuu

SEQ ID NO: 877856 - RNA, 19 nt, Homo sapiens
gaggagacgcugaaauaaa

SEQ ID NO: 877857 - RNA, 19 nt, Homo sapiens
cugauaaugugaaggauaa

SEQ ID NO: 877858 - RNA, 19 nt, Homo sapiens
acacaauucugacaaugaa

SEQ ID NO: 877859 - RNA, 19 nt, Homo sapiens
uggagcagcugaucaaaga

SEQ ID NO: 877860 - RNA, 19 nt, Homo sapiens
ugaagggccucuacacaga

SEQ ID NO: 877861 - RNA, 19 nt, Homo sapiens
ucucaggaauuggauaaua

SEQ ID NO: 877862 - RNA, 19 nt, Homo sapiens
gaaggagcgaucucucuuu

SEQ ID NO: 877863 - RNA, 19 nt, Homo sapiens
caucagaaauaggaacaaa

SEQ ID NO: 877864 - RNA, 19 nt, Homo sapiens
ggaaggaaggaggauaaua

SEQ ID NO: 877865 - RNA, 19 nt, Homo sapiens
ggacagacggagagugaaa

SEQ ID NO: 877866 - RNA, 19 nt, Homo sapiens
gcaugagccugaaagaaca

SEQ ID NO: 877867 - RNA, 19 nt, Homo sapiens
aaagucaccucaguuuaaa

SEQ ID NO: 877868 - RNA, 19 nt, Homo sapiens
cuccagaaauuccuaauga

SEQ ID NO: 877869 - RNA, 19 nt, Homo sapiens
cacuagagcuuccaaguca

SEQ ID NO: 877870 - RNA, 19 nt, Homo sapiens
caagaucugugcugugaag

SEQ ID NO: 877871 - RNA, 19 nt, Homo sapiens
ggagcgaucucucuuugag

SEQ ID NO: 877872 - RNA, 19 nt, Homo sapiens
ggugaacacucaaaaguuu

SEQ ID NO: 877873 - RNA, 19 nt, Homo sapiens
gucagaaauugaaauggua

SEQ ID NO: 877874 - RNA, 19 nt, Homo sapiens
gaaaacagaaggaagaauu

SEQ ID NO: 877875 - RNA, 19 nt, Homo sapiens
gaauacuggcuaguuauaa

SEQ ID NO: 877876 - RNA, 19 nt, Homo sapiens
gaucucaggaauuggauaa

SEQ ID NO: 877877 - RNA, 19 nt, Homo sapiens
ggaaaaugcugucucaaca

SEQ ID NO: 877878 - RNA, 19 nt, Homo sapiens
ggaagaucauggacuacau

SEQ ID NO: 877879 - RNA, 19 nt, Homo sapiens
gagcuuucauccaacauca

SEQ ID NO: 877880 - RNA, 19 nt, Homo sapiens
ggaaagagaaggagagacu

SEQ ID NO: 877881 - RNA, 19 nt, Homo sapiens
ggagagagagagagccaaa

SEQ ID NO: 877882 - RNA, 19 nt, Homo sapiens
agaaggacaucguuuccaa

SEQ ID NO: 877883 - RNA, 19 nt, Homo sapiens
gaaaagucaccucaguuua

SEQ ID NO: 877884 - RNA, 19 nt, Homo sapiens
ucgagaaggugaacacuca

SEQ ID NO: 877885 - RNA, 19 nt, Homo sapiens
gguaacagcaguggaacua

SEQ ID NO: 877886 - RNA, 19 nt, Homo sapiens
gacaacaucagaaauagga

SEQ ID NO: 877887 - RNA, 19 nt, Homo sapiens
gaaggaaggaaggaggaua

SEQ ID NO: 877888 - RNA, 19 nt, Homo sapiens
ggaaacagacacagagaag

SEQ ID NO: 877889 - RNA, 19 nt, Homo sapiens
ucacugaccucaagaucuc

SEQ ID NO: 877890 - RNA, 19 nt, Homo sapiens
cgaagaaagauuaugagaa

SEQ ID NO: 877891 - RNA, 19 nt, Homo sapiens
gaagcaugguggacuugug

SEQ ID NO: 877892 - RNA, 19 nt, Homo sapiens
uaacucaacuaguauuucg

SEQ ID NO: 877893 - RNA, 19 nt, Homo sapiens
cucaagaucucaggaauug

SEQ ID NO: 877894 - RNA, 19 nt, Homo sapiens
ccauagacgugguuguaau

SEQ ID NO: 877895 - RNA, 19 nt, Homo sapiens
ucaaagaccagcaagacaa

SEQ ID NO: 877896 - RNA, 19 nt, Homo sapiens
agacgaagaaagauuauga

SEQ ID NO: 877897 - RNA, 19 nt, Homo sapiens
gaugauaauucagcuaguc

SEQ ID NO: 877898 - RNA, 19 nt, Homo sapiens
gaggauaauauuucagcua

SEQ ID NO: 877899 - RNA, 19 nt, Homo sapiens
ggagaauggcggaaacaga

SEQ ID NO: 877900 - RNA, 19 nt, Homo sapiens
ugauuagaaugacugguuu

SEQ ID NO: 877901 - RNA, 19 nt, Homo sapiens
cucaggaauuggauaauaa

SEQ ID NO: 877902 - RNA, 19 nt, Homo sapiens
ccaaggagauagagaagcu

SEQ ID NO: 877903 - RNA, 19 nt, Homo sapiens
gcauggaggcgcuacaaau

SEQ ID NO: 877904 - RNA, 19 nt, Homo sapiens
ggaaacgacaacaucagaa

SEQ ID NO: 877905 - RNA, 19 nt, Homo sapiens
gaaacagagacugagauuu

SEQ ID NO: 877906 - RNA, 19 nt, Homo sapiens
uggaugccaugcagaauga

SEQ ID NO: 877907 - RNA, 19 nt, Homo sapiens
ggaagaaggagaaggacau

SEQ ID NO: 877908 - RNA, 19 nt, Homo sapiens
gaagaggaugaucaauuug

SEQ ID NO: 877909 - RNA, 19 nt, Homo sapiens
cagcuagucugcgguguga

SEQ ID NO: 877910 - RNA, 19 nt, Homo sapiens
ggagagaagggagaaguga

SEQ ID NO: 877911 - RNA, 19 nt, Homo sapiens
gaagucugauaaugugaag

SEQ ID NO: 877912 - RNA, 19 nt, Homo sapiens
gaaggagaaggacaucguu

SEQ ID NO: 877913 - RNA, 19 nt, Homo sapiens
agacagagagaaagaguga

SEQ ID NO: 877914 - RNA, 19 nt, Homo sapiens
aggaagaauugaaagaaga

SEQ ID NO: 877915 - RNA, 19 nt, Homo sapiens
ggccauagacgugguugua

SEQ ID NO: 877916 - RNA, 19 nt, Homo sapiens
caagaucucaggaauugga

SEQ ID NO: 877917 - RNA, 19 nt, Homo sapiens
auggaauacuggcuaguua

SEQ ID NO: 877918 - RNA, 19 nt, Homo sapiens
gccaacauccucaagaaug

SEQ ID NO: 877919 - RNA, 19 nt, Homo sapiens
caguggaacuagaagaaga

SEQ ID NO: 877920 - RNA, 19 nt, Homo sapiens
gagcaugacaaaccugaga

SEQ ID NO: 877921 - RNA, 19 nt, Homo sapiens
agaaggagacagagagaaa

SEQ ID NO: 877922 - RNA, 19 nt, Homo sapiens
ggauagaggagacgcugaa

SEQ ID NO: 877923 - RNA, 19 nt, Homo sapiens
uaauaagaaugugcgagaa

SEQ ID NO: 877924 - RNA, 19 nt, Homo sapiens
uaaauagcgcuuccaaaca

SEQ ID NO: 877925 - RNA, 19 nt, Homo sapiens
aaggagcgaucucucuuug

SEQ ID NO: 877926 - RNA, 19 nt, Homo sapiens
uggagacgaagaaagauua

SEQ ID NO: 877927 - RNA, 19 nt, Homo sapiens
agaaauuccuaaugagcuu

SEQ ID NO: 877928 - RNA, 19 nt, Homo sapiens
ccacagagaagcagaaagg

SEQ ID NO: 877929 - RNA, 19 nt, Homo sapiens
gagaaggugaacacucaaa

SEQ ID NO: 877930 - RNA, 19 nt, Homo sapiens
ugucagaaauugaaauggu

SEQ ID NO: 877931 - RNA, 19 nt, Homo sapiens
ugaaacagagacugagauu

SEQ ID NO: 877932 - RNA, 19 nt, Homo sapiens
gcagauggguuuccuguua

SEQ ID NO: 877933 - RNA, 19 nt, Homo sapiens
aaaggaagcugcacaagua

SEQ ID NO: 877934 - RNA, 19 nt, Homo sapiens
guucaaagcuuuaucagaa

SEQ ID NO: 877935 - RNA, 19 nt, Homo sapiens
uaagguggguuaccauuua

SEQ ID NO: 877936 - RNA, 19 nt, Homo sapiens
gaagaaauaagguggguua

SEQ ID NO: 877937 - RNA, 19 nt, Homo sapiens
gaaaguaagccaagucgua

SEQ ID NO: 877938 - RNA, 19 nt, Homo sapiens
ggaaggagguggagacguu

SEQ ID NO: 877939 - RNA, 19 nt, Homo sapiens
gcagaaagaugaugagagu

SEQ ID NO: 877940 - RNA, 19 nt, Homo sapiens
gaacaaaucagauaaacug

SEQ ID NO: 877941 - RNA, 19 nt, Homo sapiens
gcaggugucugaaaucuug

SEQ ID NO: 877942 - RNA, 19 nt, Homo sapiens
gcaaggaaaucaccucuca

SEQ ID NO: 877943 - RNA, 19 nt, Homo sapiens
gaacagaugcccuucuuug

SEQ ID NO: 877944 - RNA, 19 nt, Homo sapiens
gcaaggaacaaaucagaua

SEQ ID NO: 877945 - RNA, 19 nt, Homo sapiens
cagaaaguauugcuuguaa

SEQ ID NO: 877946 - RNA, 19 nt, Homo sapiens
gaaccaagaugauaucaac

SEQ ID NO: 877947 - RNA, 19 nt, Homo sapiens
gaacuucccucucugucuu

SEQ ID NO: 877948 - RNA, 19 nt, Homo sapiens
ggaagcaggugucugaaau

SEQ ID NO: 877949 - RNA, 19 nt, Homo sapiens
gaguucagcuuuaguagaa

SEQ ID NO: 877950 - RNA, 19 nt, Homo sapiens
ggagaacaccguaauuuga

SEQ ID NO: 877951 - RNA, 19 nt, Homo sapiens
ggaaaucuauguucagucu

SEQ ID NO: 877952 - RNA, 19 nt, Homo sapiens
gaagagaauuuggacaaga

SEQ ID NO: 877953 - RNA, 19 nt, Homo sapiens
gaaauaagguggguuacca

SEQ ID NO: 877954 - RNA, 19 nt, Homo sapiens
aaaguacagugccuuauuu

SEQ ID NO: 877955 - RNA, 19 nt, Homo sapiens
aagcagaaguucagaguaa

SEQ ID NO: 877956 - RNA, 19 nt, Homo sapiens
gaugauguuugaaagcuaa

SEQ ID NO: 877957 - RNA, 19 nt, Homo sapiens
gcagugaacuucccucucu

SEQ ID NO: 877958 - RNA, 19 nt, Homo sapiens
gaaaguauugcuuguaaga

SEQ ID NO: 877959 - RNA, 19 nt, Homo sapiens
gaacauaugugaggauggu

SEQ ID NO: 877960 - RNA, 19 nt, Homo sapiens
gcugacagaugccuaagaa

SEQ ID NO: 877961 - RNA, 19 nt, Homo sapiens
gcaaauggacacucaagaa

SEQ ID NO: 877962 - RNA, 19 nt, Homo sapiens
gaaagagaauaaagugaag

SEQ ID NO: 877963 - RNA, 19 nt, Homo sapiens
acaaagaagucaaggaguu

SEQ ID NO: 877964 - RNA, 19 nt, Homo sapiens
caagaguacugaaggaaug

SEQ ID NO: 877965 - RNA, 19 nt, Homo sapiens
gccaguacccggauucuua

SEQ ID NO: 877966 - RNA, 19 nt, Homo sapiens
cagauaaacugaaagagau

SEQ ID NO: 877967 - RNA, 19 nt, Homo sapiens
ggaggcggcuggaugcaaa

SEQ ID NO: 877968 - RNA, 19 nt, Homo sapiens
gaugaacagccaaaguuua

SEQ ID NO: 877969 - RNA, 19 nt, Homo sapiens
gcaaagugauuggaaagau

SEQ ID NO: 877970 - RNA, 19 nt, Homo sapiens
gaaacccggucucuaguca

SEQ ID NO: 877971 - RNA, 19 nt, Homo sapiens
ugaagaaccuagcaaggaa

SEQ ID NO: 877972 - RNA, 19 nt, Homo sapiens
aagcugaucuaugugauua

SEQ ID NO: 877973 - RNA, 19 nt, Homo sapiens
gugaagaugucauuucuag

SEQ ID NO: 877974 - RNA, 19 nt, Homo sapiens
gagagcauguauucuaaau

SEQ ID NO: 877975 - RNA, 19 nt, Homo sapiens
ucacggaaauguaggaguu

SEQ ID NO: 877976 - RNA, 19 nt, Homo sapiens
gcagaguucagcuuuagua

SEQ ID NO: 877977 - RNA, 19 nt, Homo sapiens
uaaaaugccugucagaaaa

SEQ ID NO: 877978 - RNA, 19 nt, Homo sapiens
caaagugauuggaaagaug

SEQ ID NO: 877979 - RNA, 19 nt, Homo sapiens
ggugaaagccagcaaagaa

SEQ ID NO: 877980 - RNA, 19 nt, Homo sapiens
cagcaacguuuaaucaaga

SEQ ID NO: 877981 - RNA, 19 nt, Homo sapiens
caaggaagauagaaacagu

SEQ ID NO: 877982 - RNA, 19 nt, Homo sapiens
guucagaugcucuuuauga

SEQ ID NO: 877983 - RNA, 19 nt, Homo sapiens
caaagaagucaaggaguua

SEQ ID NO: 877984 - RNA, 19 nt, Homo sapiens
gacaagagcaagacacaaa

SEQ ID NO: 877985 - RNA, 19 nt, Homo sapiens
gcuaagggaaguuauauau

SEQ ID NO: 877986 - RNA, 19 nt, Homo sapiens
gaugcaaagugauuggaaa

SEQ ID NO: 877987 - RNA, 19 nt, Homo sapiens
aggcaaagcuggacuguuc

SEQ ID NO: 877988 - RNA, 19 nt, Homo sapiens
gaaagaguacucgaggaua

SEQ ID NO: 877989 - RNA, 19 nt, Homo sapiens
gaagauagaaacagucauc

SEQ ID NO: 877990 - RNA, 19 nt, Homo sapiens
gcuuggaacucaggguuua

SEQ ID NO: 877991 - RNA, 19 nt, Homo sapiens
gaaauagucaguagagaag

SEQ ID NO: 877992 - RNA, 19 nt, Homo sapiens
cagaugcucuuuaugacaa

SEQ ID NO: 877993 - RNA, 19 nt, Homo sapiens
gaaagaugguagccaagag

SEQ ID NO: 877994 - RNA, 19 nt, Homo sapiens
cagauggguuuccuguuaa

SEQ ID NO: 877995 - RNA, 19 nt, Homo sapiens
gaagauggcagugauguca

SEQ ID NO: 877996 - RNA, 19 nt, Homo sapiens
gagagaauccugaucaagu

SEQ ID NO: 877997 - RNA, 19 nt, Homo sapiens
aaauggagcuucagagagu

SEQ ID NO: 877998 - RNA, 19 nt, Homo sapiens
gcagaccacuggacaagag

SEQ ID NO: 877999 - RNA, 19 nt, Homo sapiens
guacagugccuuauuuauc

SEQ ID NO: 878000 - RNA, 19 nt, Homo sapiens
ugucugaaaucuugccuaa

SEQ ID NO: 878001 - RNA, 19 nt, Homo sapiens
caagcauccucuucagaaa

SEQ ID NO: 878002 - RNA, 19 nt, Homo sapiens
ugaaugagguagacaacga

SEQ ID NO: 878003 - RNA, 19 nt, Homo sapiens
gaagagccagggcauauuc

SEQ ID NO: 878004 - RNA, 19 nt, Homo sapiens
gaagaggaccugccagaag

SEQ ID NO: 878005 - RNA, 19 nt, Homo sapiens
gaaccuagcaaggaaauca

SEQ ID NO: 878006 - RNA, 19 nt, Homo sapiens
gauaaccagugugauguug

SEQ ID NO: 878007 - RNA, 19 nt, Homo sapiens
gaacugcugacaaagagaa

SEQ ID NO: 878008 - RNA, 19 nt, Homo sapiens
gcugaucuaugugauuaaa

SEQ ID NO: 878009 - RNA, 19 nt, Homo sapiens
gaguaaaacuguucuauag

SEQ ID NO: 878010 - RNA, 19 nt, Homo sapiens
ucugaaaucuugccuaaag

SEQ ID NO: 878011 - RNA, 19 nt, Homo sapiens
gagcaaggaacaaaucaga

SEQ ID NO: 878012 - RNA, 19 nt, Homo sapiens
caacuucaaugcccaguac

SEQ ID NO: 878013 - RNA, 19 nt, Homo sapiens
ggcugaggauaaaugauua

SEQ ID NO: 878014 - RNA, 19 nt, Homo sapiens
guaugcagaggauuuauaa

SEQ ID NO: 878015 - RNA, 19 nt, Homo sapiens
uagaggaagucaaggaaga

SEQ ID NO: 878016 - RNA, 19 nt, Homo sapiens
gaagcucugggccaaauuu

SEQ ID NO: 878017 - RNA, 19 nt, Homo sapiens
ggaguucauuggagaguca

SEQ ID NO: 878018 - RNA, 19 nt, Homo sapiens
gacccacucuugaaggaaa

SEQ ID NO: 878019 - RNA, 19 nt, Homo sapiens
ccagugugauguuguuuau

SEQ ID NO: 878020 - RNA, 19 nt, Homo sapiens
gggcugaggauaaaugauu

SEQ ID NO: 878021 - RNA, 19 nt, Homo sapiens
gauaagggccaguuugauc

SEQ ID NO: 878022 - RNA, 19 nt, Homo sapiens
ggcagcagcccuccagaua

SEQ ID NO: 878023 - RNA, 19 nt, Homo sapiens
ggagaggacggugauguaa

SEQ ID NO: 878024 - RNA, 19 nt, Homo sapiens
gagaagacaacccugaaga

SEQ ID NO: 878025 - RNA, 19 nt, Homo sapiens
aagcagacccuuacaauuc

SEQ ID NO: 878026 - RNA, 19 nt, Homo sapiens
uaacagaaugccacuuuga

SEQ ID NO: 878027 - RNA, 19 nt, Homo sapiens
uaaccagugugauguuguu

SEQ ID NO: 878028 - RNA, 19 nt, Homo sapiens
ccucucaccuuugauguuu

SEQ ID NO: 878029 - RNA, 19 nt, Homo sapiens
cagaugcccuucuuugcaa

SEQ ID NO: 878030 - RNA, 19 nt, Homo sapiens
ggccaaauuucgagagaau

SEQ ID NO: 878031 - RNA, 19 nt, Homo sapiens
caaggaacaaaucagauaa

SEQ ID NO: 878032 - RNA, 19 nt, Homo sapiens
ggagaaaccuuaugaaugu

SEQ ID NO: 878033 - RNA, 19 nt, Homo sapiens
ggagaaauccuaugaaugu

SEQ ID NO: 878034 - RNA, 19 nt, Homo sapiens
ggagaaacccuaugaaugu

SEQ ID NO: 878035 - RNA, 19 nt, Homo sapiens
ggagaaacccuaugaaugu

SEQ ID NO: 878036 - RNA, 19 nt, Homo sapiens
ggagaaacccuaugaaugu

SEQ ID NO: 878037 - RNA, 19 nt, Homo sapiens
ggagaaacccuaugaaugu

SEQ ID NO: 878038 - RNA, 19 nt, Homo sapiens
gagcucagcccauauagua

SEQ ID NO: 878039 - RNA, 19 nt, Homo sapiens
ggagaaacccuaugaaugu

SEQ ID NO: 878040 - RNA, 19 nt, Homo sapiens
ggagaaacccuaugaaugu

SEQ ID NO: 878041 - RNA, 19 nt, Homo sapiens
ggagaaacccuaugaaugu

SEQ ID NO: 878042 - RNA, 19 nt, Homo sapiens
ggagaaacccuaugaaugu

SEQ ID NO: 878043 - RNA, 19 nt, Homo sapiens
gggagaaacucuaugaaug

SEQ ID NO: 878044 - RNA, 19 nt, Homo sapiens
gagaaacucuaugaaugua

SEQ ID NO: 878045 - RNA, 19 nt, Homo sapiens
gaagacaucacaucucaaa

SEQ ID NO: 878046 - RNA, 19 nt, Homo sapiens
ucugagaagucauauguua

SEQ ID NO: 878047 - RNA, 19 nt, Homo sapiens
gcacaucagagaauucaua

SEQ ID NO: 878048 - RNA, 19 nt, Homo sapiens
gaacuuaugugggauucaa

SEQ ID NO: 878049 - RNA, 19 nt, Homo sapiens
gagagcacaucaaagaauu

SEQ ID NO: 878050 - RNA, 19 nt, Homo sapiens
gagaaacccuaugaaugua

SEQ ID NO: 878051 - RNA, 19 nt, Homo sapiens
gagaaacccuaugaaugua

SEQ ID NO: 878052 - RNA, 19 nt, Homo sapiens
gagaaacccuaugaaugua

SEQ ID NO: 878053 - RNA, 19 nt, Homo sapiens
gagaaacccuaugaaugua

SEQ ID NO: 878054 - RNA, 19 nt, Homo sapiens
gagaaacccuaugaaugua

SEQ ID NO: 878055 - RNA, 19 nt, Homo sapiens
gagaaacccuaugaaugua

SEQ ID NO: 878056 - RNA, 19 nt, Homo sapiens
gagaaacccuaugaaugua

SEQ ID NO: 878057 - RNA, 19 nt, Homo sapiens
caaaggacaucagagaauu

SEQ ID NO: 878058 - RNA, 19 nt, Homo sapiens
guaaacaucugagaauuca

SEQ ID NO: 878059 - RNA, 19 nt, Homo sapiens
cagaguacaucaaagaauu

SEQ ID NO: 878060 - RNA, 19 nt, Homo sapiens
ggagaaacccuaugagugu

SEQ ID NO: 878061 - RNA, 19 nt, Homo sapiens
ggagaaacccuaugagugu

SEQ ID NO: 878062 - RNA, 19 nt, Homo sapiens
gggaagacaucacaucuca

SEQ ID NO: 878063 - RNA, 19 nt, Homo sapiens
ggaaaacguuugcugauaa

SEQ ID NO: 878064 - RNA, 19 nt, Homo sapiens
gaaaacagaugcagagaug

SEQ ID NO: 878065 - RNA, 19 nt, Homo sapiens
caaggcacaucaaagaauu

SEQ ID NO: 878066 - RNA, 19 nt, Homo sapiens
aaagagaaaccuugugaua

SEQ ID NO: 878067 - RNA, 19 nt, Homo sapiens
gaaacccuaugaauguauu

SEQ ID NO: 878068 - RNA, 19 nt, Homo sapiens
augcauaccuuaccacaua

SEQ ID NO: 878069 - RNA, 19 nt, Homo sapiens
ggaagccauuugcccauaa

SEQ ID NO: 878070 - RNA, 19 nt, Homo sapiens
ggagaucuuucaccuacaa

SEQ ID NO: 878071 - RNA, 19 nt, Homo sapiens
gagaaacccuaugagugua

SEQ ID NO: 878072 - RNA, 19 nt, Homo sapiens
gagaaauccuaugaaugua

SEQ ID NO: 878073 - RNA, 19 nt, Homo sapiens
ggagaaacccuaugaaugc

SEQ ID NO: 878074 - RNA, 19 nt, Homo sapiens
gggaagacuuucuccaaga

SEQ ID NO: 878075 - RNA, 19 nt, Homo sapiens
gagaaacccuaugagugua

SEQ ID NO: 878076 - RNA, 19 nt, Homo sapiens
cauaaugaauguacagaug

SEQ ID NO: 878077 - RNA, 19 nt, Homo sapiens
ggagaaacucuaugaaugu

SEQ ID NO: 878078 - RNA, 19 nt, Homo sapiens
uaugugggauucaaacuuu

SEQ ID NO: 878079 - RNA, 19 nt, Homo sapiens
gaacaugggaaaugcagaa

SEQ ID NO: 878080 - RNA, 19 nt, Homo sapiens
gacauaggcugggaacuug

SEQ ID NO: 878081 - RNA, 19 nt, Homo sapiens
cauagugcaucaaagaauu

SEQ ID NO: 878082 - RNA, 19 nt, Homo sapiens
gaaacucuaugaauguagu

SEQ ID NO: 878083 - RNA, 19 nt, Homo sapiens
ucccagaaaucacaccuua

SEQ ID NO: 878084 - RNA, 19 nt, Homo sapiens
ggaaagcacaccucauuca

SEQ ID NO: 878085 - RNA, 19 nt, Homo sapiens
gggagaaaccuuaugaaug

SEQ ID NO: 878086 - RNA, 19 nt, Homo sapiens
cagagcacaucauagaauu

SEQ ID NO: 878087 - RNA, 19 nt, Homo sapiens
ucauuaggcucauaguuug

SEQ ID NO: 878088 - RNA, 19 nt, Homo sapiens
gcacaucagagaguucaua

SEQ ID NO: 878089 - RNA, 19 nt, Homo sapiens
gaaacccuaugaauguaau

SEQ ID NO: 878090 - RNA, 19 nt, Homo sapiens
gcacaucacagaauucaca

SEQ ID NO: 878091 - RNA, 19 nt, Homo sapiens
gaaacccuaugaauguaau

SEQ ID NO: 878092 - RNA, 19 nt, Homo sapiens
gaaacccuaugaauguaau

SEQ ID NO: 878093 - RNA, 19 nt, Homo sapiens
gaaacccuaugaauguaau

SEQ ID NO: 878094 - RNA, 19 nt, Homo sapiens
ucagagaauucacacagaa

SEQ ID NO: 878095 - RNA, 19 nt, Homo sapiens
ggagauaaauuuggugaac

SEQ ID NO: 878096 - RNA, 19 nt, Homo sapiens
gcccauaauucagcccuua

SEQ ID NO: 878097 - RNA, 19 nt, Homo sapiens
gagagcacaucagagaauu

SEQ ID NO: 878098 - RNA, 19 nt, Homo sapiens
gggagaaacccuaugaaug

SEQ ID NO: 878099 - RNA, 19 nt, Homo sapiens
gggaagccauuugcccaua

SEQ ID NO: 878100 - RNA, 19 nt, Homo sapiens
gggagaaacccuaugaaug

SEQ ID NO: 878101 - RNA, 19 nt, Homo sapiens
gaauucacacagaagauaa

SEQ ID NO: 878102 - RNA, 19 nt, Homo sapiens
caucucagagcacaucuua

SEQ ID NO: 878103 - RNA, 19 nt, Homo sapiens
gggagaaacccuaugaaug

SEQ ID NO: 878104 - RNA, 19 nt, Homo sapiens
gggagaaacccuaugaaug

SEQ ID NO: 878105 - RNA, 19 nt, Homo sapiens
gggagaaacccuaugaaug

SEQ ID NO: 878106 - RNA, 19 nt, Homo sapiens
gggagaaacccuaugaaug

SEQ ID NO: 878107 - RNA, 19 nt, Homo sapiens
cagaugcccucuaccagaa

SEQ ID NO: 878108 - RNA, 19 nt, Homo sapiens
gggagaaacccuaugaaug

SEQ ID NO: 878109 - RNA, 19 nt, Homo sapiens
gagaaaccuuaugaaugua

SEQ ID NO: 878110 - RNA, 19 nt, Homo sapiens
aacacaagcuggagauaaa

SEQ ID NO: 878111 - RNA, 19 nt, Homo sapiens
gggagaaacccuaugaaug

SEQ ID NO: 878112 - RNA, 19 nt, Homo sapiens
gggagaaacccuaugaaug

SEQ ID NO: 878113 - RNA, 19 nt, Homo sapiens
gacaucacaucucaaagga

SEQ ID NO: 878114 - RNA, 19 nt, Homo sapiens
gauguggugcuaaugauaa

SEQ ID NO: 878115 - RNA, 19 nt, Homo sapiens
gcucauaguuuguggaaaa

SEQ ID NO: 878116 - RNA, 19 nt, Homo sapiens
gaacuuguuucccuuaucc

SEQ ID NO: 878117 - RNA, 19 nt, Homo sapiens
ccaaagaacacaccucugu

SEQ ID NO: 878118 - RNA, 19 nt, Homo sapiens
guaugaauguaacguaugu

SEQ ID NO: 878119 - RNA, 19 nt, Homo sapiens
ugggagaucuuacaaguca

SEQ ID NO: 878120 - RNA, 19 nt, Homo sapiens
ucacacagaagauaaauuc

SEQ ID NO: 878121 - RNA, 19 nt, Homo sapiens
gauaaauucuaccuuucug

SEQ ID NO: 878122 - RNA, 19 nt, Homo sapiens
cagaagacacgccucagua

SEQ ID NO: 878123 - RNA, 19 nt, Homo sapiens
gugagaagcccuaugaaug

SEQ ID NO: 878124 - RNA, 19 nt, Homo sapiens
gagaaacccuaugaaugug

SEQ ID NO: 878125 - RNA, 19 nt, Homo sapiens
ccagagcucagcccauaua

SEQ ID NO: 878126 - RNA, 19 nt, Homo sapiens
gaaaacauuugcccauaau

SEQ ID NO: 878127 - RNA, 19 nt, Homo sapiens
gagaaaacauuugcccaua

SEQ ID NO: 878128 - RNA, 19 nt, Homo sapiens
agagaaaccuugugauaac

SEQ ID NO: 878129 - RNA, 19 nt, Homo sapiens
caucacaccagaaugcaua

SEQ ID NO: 878130 - RNA, 19 nt, Homo sapiens
caagacaucacaucucaga

SEQ ID NO: 878131 - RNA, 19 nt, Homo sapiens
caagacaucacaucucaga

SEQ ID NO: 878132 - RNA, 19 nt, Homo sapiens
agacaaggcugcaguuuga

SEQ ID NO: 878133 - RNA, 19 nt, Homo sapiens
ggaagucgauaaugaggaa

SEQ ID NO: 878134 - RNA, 19 nt, Homo sapiens
gauuuaaacuuccaugaga

SEQ ID NO: 878135 - RNA, 19 nt, Homo sapiens
gaagaacgcccgugcugaa

SEQ ID NO: 878136 - RNA, 19 nt, Homo sapiens
uaucaggaaugcagaaauu

SEQ ID NO: 878137 - RNA, 19 nt, Homo sapiens
gagacuauuucacacaauu

SEQ ID NO: 878138 - RNA, 19 nt, Homo sapiens
gcagucagauaaugauguu

SEQ ID NO: 878139 - RNA, 19 nt, Homo sapiens
ggaauacgauaucaggaau

SEQ ID NO: 878140 - RNA, 19 nt, Homo sapiens
gggagaggauuuaaacuuc

SEQ ID NO: 878141 - RNA, 19 nt, Homo sapiens
gaacgcccgugcugaacaa

SEQ ID NO: 878142 - RNA, 19 nt, Homo sapiens
gaaacucgccgugaauuug

SEQ ID NO: 878143 - RNA, 19 nt, Homo sapiens
uacaggaagucgauaauga

SEQ ID NO: 878144 - RNA, 19 nt, Homo sapiens
gauaaugauguucggaaua

SEQ ID NO: 878145 - RNA, 19 nt, Homo sapiens
gcgccacccugcuguuuga

SEQ ID NO: 878146 - RNA, 19 nt, Homo sapiens
gccagaaacucgccgugaa

SEQ ID NO: 878147 - RNA, 19 nt, Homo sapiens
guucaugaccagaagauaa

SEQ ID NO: 878148 - RNA, 19 nt, Homo sapiens
gccagaaacaggauaauug

SEQ ID NO: 878149 - RNA, 19 nt, Homo sapiens
gggagacuauuucacacaa

SEQ ID NO: 878150 - RNA, 19 nt, Homo sapiens
gaaagcaccaccagaaagg

SEQ ID NO: 878151 - RNA, 19 nt, Homo sapiens
ggaaagcaccaccagaaag

SEQ ID NO: 878152 - RNA, 19 nt, Homo sapiens
gagacaaggcugcaguuug

SEQ ID NO: 878153 - RNA, 19 nt, Homo sapiens
guagggcuaucaaugacuu

SEQ ID NO: 878154 - RNA, 19 nt, Homo sapiens
auaaagaguggcuaccuua

SEQ ID NO: 878155 - RNA, 19 nt, Homo sapiens
uauaaagaguggcuaccuu

SEQ ID NO: 878156 - RNA, 19 nt, Homo sapiens
ggagcagcauuugcagaaa

SEQ ID NO: 878157 - RNA, 19 nt, Homo sapiens
gugcaucugugaaagacuu

SEQ ID NO: 878158 - RNA, 19 nt, Homo sapiens
uaaagaguggcuaccuuaa

SEQ ID NO: 878159 - RNA, 19 nt, Homo sapiens
ggagacuauuucacacaau

SEQ ID NO: 878160 - RNA, 19 nt, Homo sapiens
ccaagcaccuccagaagcu

SEQ ID NO: 878161 - RNA, 19 nt, Homo sapiens
aaacagagaauggucuuug

SEQ ID NO: 878162 - RNA, 19 nt, Homo sapiens
aaagaguggcuaccuuaaa

SEQ ID NO: 878163 - RNA, 19 nt, Homo sapiens
uaauacaggaagucgauaa

SEQ ID NO: 878164 - RNA, 19 nt, Homo sapiens
gagcagcauuugcagaaaa

SEQ ID NO: 878165 - RNA, 19 nt, Homo sapiens
ccaaggagcagcauuugca

SEQ ID NO: 878166 - RNA, 19 nt, Homo sapiens
aaccuuugcugcugaaaug

SEQ ID NO: 878167 - RNA, 19 nt, Homo sapiens
cagcaaagggaauggaaga

SEQ ID NO: 878168 - RNA, 19 nt, Homo sapiens
gauccugcguguucuaaaa

SEQ ID NO: 878169 - RNA, 19 nt, Homo sapiens
gaaaugaggcaaaaugaca

SEQ ID NO: 878170 - RNA, 19 nt, Homo sapiens
gagaggauuuaaacuucca

SEQ ID NO: 878171 - RNA, 19 nt, Homo sapiens
gaaauucaugggagaggau

SEQ ID NO: 878172 - RNA, 19 nt, Homo sapiens
cccuagcccuuaagaaaga

SEQ ID NO: 878173 - RNA, 19 nt, Homo sapiens
ucccgucauucacguauaa

SEQ ID NO: 878174 - RNA, 19 nt, Homo sapiens
aaacucgccgugaauuuga

SEQ ID NO: 878175 - RNA, 19 nt, Homo sapiens
ugaaaccuuugcugcugaa

SEQ ID NO: 878176 - RNA, 19 nt, Homo sapiens
aaaggcaguuugugcaucu

SEQ ID NO: 878177 - RNA, 19 nt, Homo sapiens
gacaaaaucaugugcauau

SEQ ID NO: 878178 - RNA, 19 nt, Homo sapiens
cagccaagcaccuccagaa

SEQ ID NO: 878179 - RNA, 19 nt, Homo sapiens
ggauuuaaacuuccaugag

SEQ ID NO: 878180 - RNA, 19 nt, Homo sapiens
gauguucggaauacgauau

SEQ ID NO: 878181 - RNA, 19 nt, Homo sapiens
auaaugauguucggaauac

SEQ ID NO: 878182 - RNA, 19 nt, Homo sapiens
gauaaaagaagcuacugaa

SEQ ID NO: 878183 - RNA, 19 nt, Homo sapiens
aagaguggcuaccuuaaaa

SEQ ID NO: 878184 - RNA, 19 nt, Homo sapiens
ucgagucaguggaaaggaa

SEQ ID NO: 878185 - RNA, 19 nt, Homo sapiens
gagccaggccaucgaguca

SEQ ID NO: 878186 - RNA, 19 nt, Homo sapiens
gcaguuugugcaucuguga

SEQ ID NO: 878187 - RNA, 19 nt, Homo sapiens
ccagaaacaggauaauugg

SEQ ID NO: 878188 - RNA, 19 nt, Homo sapiens
ccugggauguucaaguuca

SEQ ID NO: 878189 - RNA, 19 nt, Homo sapiens
cggaauacgauaucaggaa

SEQ ID NO: 878190 - RNA, 19 nt, Homo sapiens
agaaacucgccgugaauuu

SEQ ID NO: 878191 - RNA, 19 nt, Homo sapiens
uccaugagaggaagaaauu

SEQ ID NO: 878192 - RNA, 19 nt, Homo sapiens
gauaucaggaaugcagaaa

SEQ ID NO: 878193 - RNA, 19 nt, Homo sapiens
ccagaaacucgccgugaau

SEQ ID NO: 878194 - RNA, 19 nt, Homo sapiens
ggacaacuuggccgagauc

SEQ ID NO: 878195 - RNA, 19 nt, Homo sapiens
agccugggauguucaaguu

SEQ ID NO: 878196 - RNA, 19 nt, Homo sapiens
cagaaacucgccgugaauu

SEQ ID NO: 878197 - RNA, 19 nt, Homo sapiens
ucaaguucaugaccagaag

SEQ ID NO: 878198 - RNA, 19 nt, Homo sapiens
aucaaugacuuccaacaga

SEQ ID NO: 878199 - RNA, 19 nt, Homo sapiens
ggcuaucaaugacuuccaa

SEQ ID NO: 878200 - RNA, 19 nt, Homo sapiens
ucuguagggcuaucaauga

SEQ ID NO: 878201 - RNA, 19 nt, Homo sapiens
gaagcugaggcuccaggaa

SEQ ID NO: 878202 - RNA, 19 nt, Homo sapiens
aggagcagcuggagcagau

SEQ ID NO: 878203 - RNA, 19 nt, Homo sapiens
gcaaagggaauggaagaac

SEQ ID NO: 878204 - RNA, 19 nt, Homo sapiens
agauaaugauguucggaau

SEQ ID NO: 878205 - RNA, 19 nt, Homo sapiens
cgucauucacguauaaaga

SEQ ID NO: 878206 - RNA, 19 nt, Homo sapiens
ggccaucgagucaguggaa

SEQ ID NO: 878207 - RNA, 19 nt, Homo sapiens
gaauacgauaucaggaaug

SEQ ID NO: 878208 - RNA, 19 nt, Homo sapiens
caaaaucaugugcauauug

SEQ ID NO: 878209 - RNA, 19 nt, Homo sapiens
gaggcaaaaugacaaaauc

SEQ ID NO: 878210 - RNA, 19 nt, Homo sapiens
agcuagacaugaaaccuuu

SEQ ID NO: 878211 - RNA, 19 nt, Homo sapiens
uggaaagcaccaccagaaa

SEQ ID NO: 878212 - RNA, 19 nt, Homo sapiens
ugggagaggauuuaaacuu

SEQ ID NO: 878213 - RNA, 19 nt, Homo sapiens
caacgccagaaacaggaua

SEQ ID NO: 878214 - RNA, 19 nt, Homo sapiens
gaacaaaacagagaauggu

SEQ ID NO: 878215 - RNA, 19 nt, Homo sapiens
gggauguucaaguucauga

SEQ ID NO: 878216 - RNA, 19 nt, Homo sapiens
gccaggccaucgagucagu

SEQ ID NO: 878217 - RNA, 19 nt, Homo sapiens
caccagaaaggcaguuugu

SEQ ID NO: 878218 - RNA, 19 nt, Homo sapiens
uggccaaggagcagcauuu

SEQ ID NO: 878219 - RNA, 19 nt, Homo sapiens
gcaagaacaagaggacaac

SEQ ID NO: 878220 - RNA, 19 nt, Homo sapiens
cgagucaguggaaaggaaa

SEQ ID NO: 878221 - RNA, 19 nt, Homo sapiens
caugggagaggauuuaaac

SEQ ID NO: 878222 - RNA, 19 nt, Homo sapiens
aaucaugugcauauuggaa

SEQ ID NO: 878223 - RNA, 19 nt, Homo sapiens
ucauucacguauaaagagu

SEQ ID NO: 878224 - RNA, 19 nt, Homo sapiens
cacgggagacuauuucaca

SEQ ID NO: 878225 - RNA, 19 nt, Homo sapiens
acugggagcccgacggaaa

SEQ ID NO: 878226 - RNA, 19 nt, Homo sapiens
aaaaucaugugcauauugg

SEQ ID NO: 878227 - RNA, 19 nt, Homo sapiens
ggacaggccuuucuccuua

SEQ ID NO: 878228 - RNA, 19 nt, Homo sapiens
gggaaacagucuuagauaa

SEQ ID NO: 878229 - RNA, 19 nt, Homo sapiens
gagccagucuugaguuuaa

SEQ ID NO: 878230 - RNA, 19 nt, Homo sapiens
cagaggagcugcagcguuu

SEQ ID NO: 878231 - RNA, 19 nt, Homo sapiens
ggagguagaucacccuuuc

SEQ ID NO: 878232 - RNA, 19 nt, Homo sapiens
aaacaugccucaguauaaa

SEQ ID NO: 878233 - RNA, 19 nt, Homo sapiens
gcaggaagaugcagacaag

SEQ ID NO: 878234 - RNA, 19 nt, Homo sapiens
gcagacaaguguaccuuca

SEQ ID NO: 878235 - RNA, 19 nt, Homo sapiens
ugaccaaguuugaggcuaa

SEQ ID NO: 878236 - RNA, 19 nt, Homo sapiens
ggagaucgaggucaugauu

SEQ ID NO: 878237 - RNA, 19 nt, Homo sapiens
cccuauggcuuacaaagua

SEQ ID NO: 878238 - RNA, 19 nt, Homo sapiens
uccagaaacuucacuuuga

SEQ ID NO: 878239 - RNA, 19 nt, Homo sapiens
gaaaacaugccucaguaua

SEQ ID NO: 878240 - RNA, 19 nt, Homo sapiens
gaacuugacccgggaacaa

SEQ ID NO: 878241 - RNA, 19 nt, Homo sapiens
agacaaguguaccuucauu

SEQ ID NO: 878242 - RNA, 19 nt, Homo sapiens
uaaggugacuugccuaagg

SEQ ID NO: 878243 - RNA, 19 nt, Homo sapiens
gagaagccuuacagagaug

SEQ ID NO: 878244 - RNA, 19 nt, Homo sapiens
gaagaugcagacaagugua

SEQ ID NO: 878245 - RNA, 19 nt, Homo sapiens
guggcuggcugucaagaaa

SEQ ID NO: 878246 - RNA, 19 nt, Homo sapiens
aagagaagccuuacagaga

SEQ ID NO: 878247 - RNA, 19 nt, Homo sapiens
ggaagaugcagacaagugu

SEQ ID NO: 878248 - RNA, 19 nt, Homo sapiens
uaaaggcauuaguguuaga

SEQ ID NO: 878249 - RNA, 19 nt, Homo sapiens
agagaagccuuacagagau

SEQ ID NO: 878250 - RNA, 19 nt, Homo sapiens
ggaagagaagccuuacaga

SEQ ID NO: 878251 - RNA, 19 nt, Homo sapiens
acuaccagcuuuccugauu

SEQ ID NO: 878252 - RNA, 19 nt, Homo sapiens
ccagaaacuucacuuugag

SEQ ID NO: 878253 - RNA, 19 nt, Homo sapiens
cuaccagcuuuccugauuu

SEQ ID NO: 878254 - RNA, 19 nt, Homo sapiens
ccaugagguugaaucagaa

SEQ ID NO: 878255 - RNA, 19 nt, Homo sapiens
gggcagccacucuguguga

SEQ ID NO: 878256 - RNA, 19 nt, Homo sapiens
gcugauggcugggccuugu

SEQ ID NO: 878257 - RNA, 19 nt, Homo sapiens
gcaggguguugggcccaua

SEQ ID NO: 878258 - RNA, 19 nt, Homo sapiens
gaccaaguuugaggcuaaa

SEQ ID NO: 878259 - RNA, 19 nt, Homo sapiens
accaugagguugaaucaga

SEQ ID NO: 878260 - RNA, 19 nt, Homo sapiens
ccucacagaucuagaagac

SEQ ID NO: 878261 - RNA, 19 nt, Homo sapiens
acgaguggaugaaaucaga

SEQ ID NO: 878262 - RNA, 19 nt, Homo sapiens
ccgaaaacaugccucagua

SEQ ID NO: 878263 - RNA, 19 nt, Homo sapiens
ggagccagucuugaguuua

SEQ ID NO: 878264 - RNA, 19 nt, Homo sapiens
ccuggcacccuauggcuua

SEQ ID NO: 878265 - RNA, 19 nt, Homo sapiens
uggagccagucuugaguuu

SEQ ID NO: 878266 - RNA, 19 nt, Homo sapiens
gcagaccagccacguggaa

SEQ ID NO: 878267 - RNA, 19 nt, Homo sapiens
aaguagaguuggcccaguu

SEQ ID NO: 878268 - RNA, 19 nt, Homo sapiens
aaacaccccucugcugaua

SEQ ID NO: 878269 - RNA, 19 nt, Homo sapiens
ccagccacguggaagagaa

SEQ ID NO: 878270 - RNA, 19 nt, Homo sapiens
gaggagcugcagcguuuga

SEQ ID NO: 878271 - RNA, 19 nt, Homo sapiens
gaguuuaaaggcauuagug

SEQ ID NO: 878272 - RNA, 19 nt, Homo sapiens
caaguguaccuucauugug

SEQ ID NO: 878273 - RNA, 19 nt, Homo sapiens
uuaaaggcauuaguguuag

SEQ ID NO: 878274 - RNA, 19 nt, Homo sapiens
gagaucgaggucaugauug

SEQ ID NO: 878275 - RNA, 19 nt, Homo sapiens
gaaccucuuccucacagau

SEQ ID NO: 878276 - RNA, 19 nt, Homo sapiens
gaacaacuggaaccgaaaa

SEQ ID NO: 878277 - RNA, 19 nt, Homo sapiens
gcagcuugguccucuuguc

SEQ ID NO: 878278 - RNA, 19 nt, Homo sapiens
aaaacaugccucaguauaa

SEQ ID NO: 878279 - RNA, 19 nt, Homo sapiens
ggcaugcuuucuaaacaca

SEQ ID NO: 878280 - RNA, 19 nt, Homo sapiens
gacaggccuuucuccuuag

SEQ ID NO: 878281 - RNA, 19 nt, Homo sapiens
gacaaguguaccuucauug

SEQ ID NO: 878282 - RNA, 19 nt, Homo sapiens
gggcaugcuuucuaaacac

SEQ ID NO: 878283 - RNA, 19 nt, Homo sapiens
gcauuaguguuagauacag

SEQ ID NO: 878284 - RNA, 19 nt, Homo sapiens
ugagugaguccgagcauca

SEQ ID NO: 878285 - RNA, 19 nt, Homo sapiens
ggaguggacaggccuuucu

SEQ ID NO: 878286 - RNA, 19 nt, Homo sapiens
ugggagaugugaaccucuu

SEQ ID NO: 878287 - RNA, 19 nt, Homo sapiens
gacugcaugugaacaacug

SEQ ID NO: 878288 - RNA, 19 nt, Homo sapiens
cagcacccuugaucuugga

SEQ ID NO: 878289 - RNA, 19 nt, Homo sapiens
ggggaaacagucuuagaua

SEQ ID NO: 878290 - RNA, 19 nt, Homo sapiens
cgggcaugcuuucuaaaca

SEQ ID NO: 878291 - RNA, 19 nt, Homo sapiens
gcugcuaccaugagguuga

SEQ ID NO: 878292 - RNA, 19 nt, Homo sapiens
ggugugacccugggaacuu

SEQ ID NO: 878293 - RNA, 19 nt, Homo sapiens
uccaggcacuaccagcuuu

SEQ ID NO: 878294 - RNA, 19 nt, Homo sapiens
aacaggugguccagaguga

SEQ ID NO: 878295 - RNA, 19 nt, Homo sapiens
gcagggauccaugggagau

SEQ ID NO: 878296 - RNA, 19 nt, Homo sapiens
gcccauacacuucaaagac

SEQ ID NO: 878297 - RNA, 19 nt, Homo sapiens
guuuaaaggcauuaguguu

SEQ ID NO: 878298 - RNA, 19 nt, Homo sapiens
gguugaaucagaacaccuu

SEQ ID NO: 878299 - RNA, 19 nt, Homo sapiens
ugggagaugucgggaugaa

SEQ ID NO: 878300 - RNA, 19 nt, Homo sapiens
ucgaggcccuucagacucu

SEQ ID NO: 878301 - RNA, 19 nt, Homo sapiens
ggcauuaguguuagauaca

SEQ ID NO: 878302 - RNA, 19 nt, Homo sapiens
gggcagcuugguccucuug

SEQ ID NO: 878303 - RNA, 19 nt, Homo sapiens
guuccagaaacuucacuuu

SEQ ID NO: 878304 - RNA, 19 nt, Homo sapiens
gguuggaggagguagauca

SEQ ID NO: 878305 - RNA, 19 nt, Homo sapiens
gugugacccugggaacuug

SEQ ID NO: 878306 - RNA, 19 nt, Homo sapiens
gcagugcagcuggcaggaa

SEQ ID NO: 878307 - RNA, 19 nt, Homo sapiens
aaauugggcaaggaaauga

SEQ ID NO: 878308 - RNA, 19 nt, Homo sapiens
ggcacccuauggcuuacaa

SEQ ID NO: 878309 - RNA, 19 nt, Homo sapiens
gaacagagaugccaguuga

SEQ ID NO: 878310 - RNA, 19 nt, Homo sapiens
ggacgaaaguuuagcaaua

SEQ ID NO: 878311 - RNA, 19 nt, Homo sapiens
gaaaagaggucaauguuua

SEQ ID NO: 878312 - RNA, 19 nt, Homo sapiens
ggacgaggcuuuauccaaa

SEQ ID NO: 878313 - RNA, 19 nt, Homo sapiens
gagcgaagcuuuagccaaa

SEQ ID NO: 878314 - RNA, 19 nt, Homo sapiens
ggacgaggcuauaccagua

SEQ ID NO: 878315 - RNA, 19 nt, Homo sapiens
gaagucaaaucuugugaaa

SEQ ID NO: 878316 - RNA, 19 nt, Homo sapiens
gggcgaggcuauacuaaua

SEQ ID NO: 878317 - RNA, 19 nt, Homo sapiens
gggcgaagguuuaacgaua

SEQ ID NO: 878318 - RNA, 19 nt, Homo sapiens
ggagaagccuuucaucugu

SEQ ID NO: 878319 - RNA, 19 nt, Homo sapiens
ggagaagccuuauggaugu

SEQ ID NO: 878320 - RNA, 19 nt, Homo sapiens
gcacuaagcccauggcauu

SEQ ID NO: 878321 - RNA, 19 nt, Homo sapiens
ggagagaaguccuaugugu

SEQ ID NO: 878322 - RNA, 19 nt, Homo sapiens
ggccgaggcuuuagcaaua

SEQ ID NO: 878323 - RNA, 19 nt, Homo sapiens
gacgaaaguuuagcaauaa

SEQ ID NO: 878324 - RNA, 19 nt, Homo sapiens
gggcgaggcuucauccuaa

SEQ ID NO: 878325 - RNA, 19 nt, Homo sapiens
gaagccaaaucucaccaua

SEQ ID NO: 878326 - RNA, 19 nt, Homo sapiens
gagagaagccuuaugaaug

SEQ ID NO: 878327 - RNA, 19 nt, Homo sapiens
gcacuuaaagagacacuua

SEQ ID NO: 878328 - RNA, 19 nt, Homo sapiens
gggcaaggauuuauucaga

SEQ ID NO: 878329 - RNA, 19 nt, Homo sapiens
gaagggaaaucuccucaca

SEQ ID NO: 878330 - RNA, 19 nt, Homo sapiens
gaagucaacccuugugaaa

SEQ ID NO: 878331 - RNA, 19 nt, Homo sapiens
gauaaguccuccuauaaca

SEQ ID NO: 878332 - RNA, 19 nt, Homo sapiens
gagagaagccuuacagaug

SEQ ID NO: 878333 - RNA, 19 nt, Homo sapiens
gagaguaacuuugcuuugu

SEQ ID NO: 878334 - RNA, 19 nt, Homo sapiens
gaaaggccauuuaauugca

SEQ ID NO: 878335 - RNA, 19 nt, Homo sapiens
ggaaaauccuacagaaaua

SEQ ID NO: 878336 - RNA, 19 nt, Homo sapiens
gacaaaguauugaaaggaa

SEQ ID NO: 878337 - RNA, 19 nt, Homo sapiens
gggaaaggccauuuaauug

SEQ ID NO: 878338 - RNA, 19 nt, Homo sapiens
gggcgaggcuuuaccuuga

SEQ ID NO: 878339 - RNA, 19 nt, Homo sapiens
ggagagaggccuuaugaau

SEQ ID NO: 878340 - RNA, 19 nt, Homo sapiens
ggauuuaucuggaagucaa

SEQ ID NO: 878341 - RNA, 19 nt, Homo sapiens
gagaagccuuucaucugua

SEQ ID NO: 878342 - RNA, 19 nt, Homo sapiens
gggauaaguccuccuauaa

SEQ ID NO: 878343 - RNA, 19 nt, Homo sapiens
gauaaguccucauacaaca

SEQ ID NO: 878344 - RNA, 19 nt, Homo sapiens
gagcacauauucuuguugu

SEQ ID NO: 878345 - RNA, 19 nt, Homo sapiens
cccaagagauucagagaaa

SEQ ID NO: 878346 - RNA, 19 nt, Homo sapiens
gagagaggccuuaugaaug

SEQ ID NO: 878347 - RNA, 19 nt, Homo sapiens
gaacaguguaguggaaaua

SEQ ID NO: 878348 - RNA, 19 nt, Homo sapiens
gaggaacaguguaguggaa

SEQ ID NO: 878349 - RNA, 19 nt, Homo sapiens
ucacgaagauagagcuuug

SEQ ID NO: 878350 - RNA, 19 nt, Homo sapiens
agucaaaucuugugaaaca

SEQ ID NO: 878351 - RNA, 19 nt, Homo sapiens
ggagagaagccuuaugaau

SEQ ID NO: 878352 - RNA, 19 nt, Homo sapiens
caccagggcuuuagagaug

SEQ ID NO: 878353 - RNA, 19 nt, Homo sapiens
ggcauuaccugggcuauug

SEQ ID NO: 878354 - RNA, 19 nt, Homo sapiens
ggcgaagguuuaacgauaa

SEQ ID NO: 878355 - RNA, 19 nt, Homo sapiens
gcacauauucuuguuguau

SEQ ID NO: 878356 - RNA, 19 nt, Homo sapiens
gaaggcaucaucuuggaaa

SEQ ID NO: 878357 - RNA, 19 nt, Homo sapiens
cgggauaaguccuccuaua

SEQ ID NO: 878358 - RNA, 19 nt, Homo sapiens
gcaaggauuuauucagaag

SEQ ID NO: 878359 - RNA, 19 nt, Homo sapiens
cuacagaaauagacaaagu

SEQ ID NO: 878360 - RNA, 19 nt, Homo sapiens
gcaacagcaacuacaauuu

SEQ ID NO: 878361 - RNA, 19 nt, Homo sapiens
gaauauaugcagaacaugu

SEQ ID NO: 878362 - RNA, 19 nt, Homo sapiens
gggaucaggugcccuuaug

SEQ ID NO: 878363 - RNA, 19 nt, Homo sapiens
gccaggcugugcuuucuaa

SEQ ID NO: 878364 - RNA, 19 nt, Homo sapiens
uaacagaggcagacagaau

SEQ ID NO: 878365 - RNA, 19 nt, Homo sapiens
aagcgaggcuauaccagua

SEQ ID NO: 878366 - RNA, 19 nt, Homo sapiens
caacugcaccuacugaugu

SEQ ID NO: 878367 - RNA, 19 nt, Homo sapiens
cagagaaccugaauucaac

SEQ ID NO: 878368 - RNA, 19 nt, Homo sapiens
cuacagagaaccugaauuc

SEQ ID NO: 878369 - RNA, 19 nt, Homo sapiens
gggugaggcuucaucuuga

SEQ ID NO: 878370 - RNA, 19 nt, Homo sapiens
gaguguggacgaaaguuua

SEQ ID NO: 878371 - RNA, 19 nt, Homo sapiens
gaaugugggcaaggauuua

SEQ ID NO: 878372 - RNA, 19 nt, Homo sapiens
gaaugugggcaaggauuua

SEQ ID NO: 878373 - RNA, 19 nt, Homo sapiens
agauagagcuuugcgaaug

SEQ ID NO: 878374 - RNA, 19 nt, Homo sapiens
aggcaaaucuucuuagaca

SEQ ID NO: 878375 - RNA, 19 nt, Homo sapiens
ggagagaagccuuacagau

SEQ ID NO: 878376 - RNA, 19 nt, Homo sapiens
uaagucaagucacgaagau

SEQ ID NO: 878377 - RNA, 19 nt, Homo sapiens
gggaagugauuaagucaag

SEQ ID NO: 878378 - RNA, 19 nt, Homo sapiens
guuacaagcuuuaguugag

SEQ ID NO: 878379 - RNA, 19 nt, Homo sapiens
caggagagaagccuuauga

SEQ ID NO: 878380 - RNA, 19 nt, Homo sapiens
gaucaggugcccuuaugaa

SEQ ID NO: 878381 - RNA, 19 nt, Homo sapiens
gaaacaguguaaguauuag

SEQ ID NO: 878382 - RNA, 19 nt, Homo sapiens
gcaaaucuucuuagacauc

SEQ ID NO: 878383 - RNA, 19 nt, Homo sapiens
aaagucaacucuugucuac

SEQ ID NO: 878384 - RNA, 19 nt, Homo sapiens
ggaacaguguaguggaaau

SEQ ID NO: 878385 - RNA, 19 nt, Homo sapiens
gauagagcuuugcgaaugg

SEQ ID NO: 878386 - RNA, 19 nt, Homo sapiens
ggaugucacuguggauuuc

SEQ ID NO: 878387 - RNA, 19 nt, Homo sapiens
caggagagaggccuuauga

SEQ ID NO: 878388 - RNA, 19 nt, Homo sapiens
ggcaaggauuuauucagaa

SEQ ID NO: 878389 - RNA, 19 nt, Homo sapiens
gcuauaccaguaagucaua

SEQ ID NO: 878390 - RNA, 19 nt, Homo sapiens
aagagacacuuacgugaga

SEQ ID NO: 878391 - RNA, 19 nt, Homo sapiens
ccauuuaauugcaaggauu

SEQ ID NO: 878392 - RNA, 19 nt, Homo sapiens
ggaaaggccauuuaauugc

SEQ ID NO: 878393 - RNA, 19 nt, Homo sapiens
caccaaaccuccucuugca

SEQ ID NO: 878394 - RNA, 19 nt, Homo sapiens
gggagaagccuuucaucug

SEQ ID NO: 878395 - RNA, 19 nt, Homo sapiens
caaaucuucuuagacauca

SEQ ID NO: 878396 - RNA, 19 nt, Homo sapiens
gagugugggcgaagguuua

SEQ ID NO: 878397 - RNA, 19 nt, Homo sapiens
agagaagccuuaugaaugc

SEQ ID NO: 878398 - RNA, 19 nt, Homo sapiens
gaaggucaagagaaagaaa

SEQ ID NO: 878399 - RNA, 19 nt, Homo sapiens
gaaacucuacauaaacugu

SEQ ID NO: 878400 - RNA, 19 nt, Homo sapiens
ggggaaauguggucucuuu

SEQ ID NO: 878401 - RNA, 19 nt, Homo sapiens
ggcaaggauuuaucuggaa

SEQ ID NO: 878402 - RNA, 19 nt, Homo sapiens
cuacugagcacauauucuu

SEQ ID NO: 878403 - RNA, 19 nt, Homo sapiens
caccuggucucacuaggaa

SEQ ID NO: 878404 - RNA, 19 nt, Homo sapiens
agucaacccuugugaaaca

SEQ ID NO: 878405 - RNA, 19 nt, Homo sapiens
gaacacacacaggagagaa

SEQ ID NO: 878406 - RNA, 19 nt, Homo sapiens
caacagacaacugcaccua

SEQ ID NO: 878407 - RNA, 19 nt, Homo sapiens
acagagaaccugaauucaa

SEQ ID NO: 878408 - RNA, 19 nt, Homo sapiens
agaguaacuuugcuuuguu

SEQ ID NO: 878409 - RNA, 19 nt, Homo sapiens
ggacaggcuuuauuauuua

SEQ ID NO: 878410 - RNA, 19 nt, Homo sapiens
gggacaggcuuuauuauuu

SEQ ID NO: 878411 - RNA, 19 nt, Homo sapiens
gaacuucccugagaucaaa

SEQ ID NO: 878412 - RNA, 19 nt, Homo sapiens
ggacagugcugcauucaau

SEQ ID NO: 878413 - RNA, 19 nt, Homo sapiens
gcaaagagcggcuggaaga

SEQ ID NO: 878414 - RNA, 19 nt, Homo sapiens
ggacagcucugaggaggaa

SEQ ID NO: 878415 - RNA, 19 nt, Homo sapiens
gaccugaacuucccugaga

SEQ ID NO: 878416 - RNA, 19 nt, Homo sapiens
ggacaggaagcaauuuaaa

SEQ ID NO: 878417 - RNA, 19 nt, Homo sapiens
ggaaagguggcaaaggaua

SEQ ID NO: 878418 - RNA, 19 nt, Homo sapiens
cuccaaagcuguuccauga

SEQ ID NO: 878419 - RNA, 19 nt, Homo sapiens
ggacgacacugagggauuc

SEQ ID NO: 878420 - RNA, 19 nt, Homo sapiens
aaacauaccagucugugua

SEQ ID NO: 878421 - RNA, 19 nt, Homo sapiens
gaggacaggaagcaauuua

SEQ ID NO: 878422 - RNA, 19 nt, Homo sapiens
ggagaucaguggcaaagag

SEQ ID NO: 878423 - RNA, 19 nt, Homo sapiens
ucaaugcucugguuaccuu

SEQ ID NO: 878424 - RNA, 19 nt, Homo sapiens
gcuguuccaugaaguggua

SEQ ID NO: 878425 - RNA, 19 nt, Homo sapiens
gaaggaaacauaccagucu

SEQ ID NO: 878426 - RNA, 19 nt, Homo sapiens
gugcugaggccaacaaauu

SEQ ID NO: 878427 - RNA, 19 nt, Homo sapiens
ccaaagcuguuccaugaag

SEQ ID NO: 878428 - RNA, 19 nt, Homo sapiens
gaccagagccugcuaaacu

SEQ ID NO: 878429 - RNA, 19 nt, Homo sapiens
gcaaauguacaucacguau

SEQ ID NO: 878430 - RNA, 19 nt, Homo sapiens
gauggaagcaggcagcaaa

SEQ ID NO: 878431 - RNA, 19 nt, Homo sapiens
guuccuagcuucgggcuuu

SEQ ID NO: 878432 - RNA, 19 nt, Homo sapiens
guguggacaucaaggcuua

SEQ ID NO: 878433 - RNA, 19 nt, Homo sapiens
ggaaggaugaggacaggaa

SEQ ID NO: 878434 - RNA, 19 nt, Homo sapiens
gcacaaagaccagcucucu

SEQ ID NO: 878435 - RNA, 19 nt, Homo sapiens
gcuccaagcccaucaacuu

SEQ ID NO: 878436 - RNA, 19 nt, Homo sapiens
gcugugggcugcugaaguc

SEQ ID NO: 878437 - RNA, 19 nt, Homo sapiens
caugaaagaccaaacguau

SEQ ID NO: 878438 - RNA, 19 nt, Homo sapiens
gcaugaaagaccaaacgua

SEQ ID NO: 878439 - RNA, 19 nt, Homo sapiens
ggaagauggcugacaggaa

SEQ ID NO: 878440 - RNA, 19 nt, Homo sapiens
ccuagaggcuggcgucugu

SEQ ID NO: 878441 - RNA, 19 nt, Homo sapiens
gagaucaaacgaaggaaga

SEQ ID NO: 878442 - RNA, 19 nt, Homo sapiens
ggagaacucggcauacauc

SEQ ID NO: 878443 - RNA, 19 nt, Homo sapiens
gcacaagaaggacacuuuc

SEQ ID NO: 878444 - RNA, 19 nt, Homo sapiens
agaagcugcuguuuggaaa

SEQ ID NO: 878445 - RNA, 19 nt, Homo sapiens
gaaagguggcaaaggauag

SEQ ID NO: 878446 - RNA, 19 nt, Homo sapiens
gaagcaggcagcaaagcaa

SEQ ID NO: 878447 - RNA, 19 nt, Homo sapiens
acaggaagcaauuuaaaga

SEQ ID NO: 878448 - RNA, 19 nt, Homo sapiens
cacgggacaggcuuuauua

SEQ ID NO: 878449 - RNA, 19 nt, Homo sapiens
caggagaacucggcauaca

SEQ ID NO: 878450 - RNA, 19 nt, Homo sapiens
cgaaaccgaaagaaauaaa

SEQ ID NO: 878451 - RNA, 19 nt, Homo sapiens
ggacagagaccccgaguuc

SEQ ID NO: 878452 - RNA, 19 nt, Homo sapiens
gcaagaaggaaacauacca

SEQ ID NO: 878453 - RNA, 19 nt, Homo sapiens
uuggaaagguggcaaagga

SEQ ID NO: 878454 - RNA, 19 nt, Homo sapiens
gaaacauaccagucugugu

SEQ ID NO: 878455 - RNA, 19 nt, Homo sapiens
cugguuaccuucugcauca

SEQ ID NO: 878456 - RNA, 19 nt, Homo sapiens
uccagaagcugcuguuugg

SEQ ID NO: 878457 - RNA, 19 nt, Homo sapiens
cauccgaaaccgaaagaaa

SEQ ID NO: 878458 - RNA, 19 nt, Homo sapiens
ggcacaagaaggacacuuu

SEQ ID NO: 878459 - RNA, 19 nt, Homo sapiens
cagcugguguccugucugu

SEQ ID NO: 878460 - RNA, 19 nt, Homo sapiens
ggaagcaggcagcaaagca

SEQ ID NO: 878461 - RNA, 19 nt, Homo sapiens
gaaaccgaaagaaauaaag

SEQ ID NO: 878462 - RNA, 19 nt, Homo sapiens
cgggacaggcuuuauuauu

SEQ ID NO: 878463 - RNA, 19 nt, Homo sapiens
gcaagguggccaacuacug

SEQ ID NO: 878464 - RNA, 19 nt, Homo sapiens
uccugaagcuguccaaugu

SEQ ID NO: 878465 - RNA, 19 nt, Homo sapiens
cagaagcugcuguuuggaa

SEQ ID NO: 878466 - RNA, 19 nt, Homo sapiens
caaagcuguuccaugaagu

SEQ ID NO: 878467 - RNA, 19 nt, Homo sapiens
uccgaaaccgaaagaaaua

SEQ ID NO: 878468 - RNA, 19 nt, Homo sapiens
gacaggaagcaauuuaaag

SEQ ID NO: 878469 - RNA, 19 nt, Homo sapiens
gaugaggacaggaagcaau

SEQ ID NO: 878470 - RNA, 19 nt, Homo sapiens
cugaagcuguccaauguca

SEQ ID NO: 878471 - RNA, 19 nt, Homo sapiens
cagcacgccuuccucuaca

SEQ ID NO: 878472 - RNA, 19 nt, Homo sapiens
caaauguacaucacguaug

SEQ ID NO: 878473 - RNA, 19 nt, Homo sapiens
ggauggagcggaggaagga

SEQ ID NO: 878474 - RNA, 19 nt, Homo sapiens
aagcaacgccucacuccaa

SEQ ID NO: 878475 - RNA, 19 nt, Homo sapiens
gguggaagacgaugaagag

SEQ ID NO: 878476 - RNA, 19 nt, Homo sapiens
uugggaagguucaggagaa

SEQ ID NO: 878477 - RNA, 19 nt, Homo sapiens
caagucaucauuggcugua

SEQ ID NO: 878478 - RNA, 19 nt, Homo sapiens
ugaaagaccaaacguaucg

SEQ ID NO: 878479 - RNA, 19 nt, Homo sapiens
acacgggacaggcuuuauu

SEQ ID NO: 878480 - RNA, 19 nt, Homo sapiens
cugaagaggacgacacuga

SEQ ID NO: 878481 - RNA, 19 nt, Homo sapiens
gaccugaacagcucugaag

SEQ ID NO: 878482 - RNA, 19 nt, Homo sapiens
gcuggcgucugugcaguug

SEQ ID NO: 878483 - RNA, 19 nt, Homo sapiens
gaucaaacgaaggaagaug

SEQ ID NO: 878484 - RNA, 19 nt, Homo sapiens
ucacggacagugcugcauu

SEQ ID NO: 878485 - RNA, 19 nt, Homo sapiens
ucggagagagggauacuga

SEQ ID NO: 878486 - RNA, 19 nt, Homo sapiens
gccaugaccacccgcaaga

SEQ ID NO: 878487 - RNA, 19 nt, Homo sapiens
aggacgagcuggaggaucu

SEQ ID NO: 878488 - RNA, 19 nt, Homo sapiens
gaagcuguccaaugucaac

SEQ ID NO: 878489 - RNA, 19 nt, Homo sapiens
cgacugaggcagcccaucu

SEQ ID NO: 878490 - RNA, 19 nt, Homo sapiens
gaaugaccagagccugcua

SEQ ID NO: 878491 - RNA, 19 nt, Homo sapiens
caucauuggcuguaucaag

SEQ ID NO: 878492 - RNA, 19 nt, Homo sapiens
accagagccugcuaaacuu

SEQ ID NO: 878493 - RNA, 19 nt, Homo sapiens
gaagcuucguguggacauc

SEQ ID NO: 878494 - RNA, 19 nt, Homo sapiens
gcagcugcuugggaagguu

SEQ ID NO: 878495 - RNA, 19 nt, Homo sapiens
ucaagcaaauguacaucac

SEQ ID NO: 878496 - RNA, 19 nt, Homo sapiens
gagcggaggaaggagaaga

SEQ ID NO: 878497 - RNA, 19 nt, Homo sapiens
caaaggauagcagcaggau

SEQ ID NO: 878498 - RNA, 19 nt, Homo sapiens
guggacgaguuccuagcuu

SEQ ID NO: 878499 - RNA, 19 nt, Homo sapiens
agacacgggacaggcuuua

SEQ ID NO: 878500 - RNA, 19 nt, Homo sapiens
ccugagaucaaacgaagga

SEQ ID NO: 878501 - RNA, 19 nt, Homo sapiens
ccaagcccaucaacuucuc

SEQ ID NO: 878502 - RNA, 19 nt, Homo sapiens
cacggacagugcugcauuc

SEQ ID NO: 878503 - RNA, 19 nt, Homo sapiens
agcaacgccucacuccaaa

SEQ ID NO: 878504 - RNA, 19 nt, Homo sapiens
gguacaggcguuccaagca

SEQ ID NO: 878505 - RNA, 19 nt, Homo sapiens
ucaucccggugcugccuuu

SEQ ID NO: 878506 - RNA, 19 nt, Homo sapiens
ccgaaaccgaaagaaauaa

SEQ ID NO: 878507 - RNA, 19 nt, Homo sapiens
gaagcugacccgggaagag

SEQ ID NO: 878508 - RNA, 19 nt, Homo sapiens
uccagcaggucgacuucaa

SEQ ID NO: 878509 - RNA, 19 nt, Homo sapiens
gcaguuugcuguuuauuau

SEQ ID NO: 878510 - RNA, 19 nt, Homo sapiens
guaaaggaauucaaacaga

SEQ ID NO: 878511 - RNA, 19 nt, Homo sapiens
guacuacuauuucuacuga

SEQ ID NO: 878512 - RNA, 19 nt, Homo sapiens
gggaucagaugaaagagua

SEQ ID NO: 878513 - RNA, 19 nt, Homo sapiens
uaaaguacauggaaacuca

SEQ ID NO: 878514 - RNA, 19 nt, Homo sapiens
aaacagagccuuauaaagu

SEQ ID NO: 878515 - RNA, 19 nt, Homo sapiens
gggcgaaucugugccuuua

SEQ ID NO: 878516 - RNA, 19 nt, Homo sapiens
uuacagaucccaguuauua

SEQ ID NO: 878517 - RNA, 19 nt, Homo sapiens
gagaacaguuauuagacua

SEQ ID NO: 878518 - RNA, 19 nt, Homo sapiens
gaacuaauggacuguauug

SEQ ID NO: 878519 - RNA, 19 nt, Homo sapiens
gugaagcucuguacaaaga

SEQ ID NO: 878520 - RNA, 19 nt, Homo sapiens
gcaagacuccuagguuaua

SEQ ID NO: 878521 - RNA, 19 nt, Homo sapiens
gaagucauauuugagauuc

SEQ ID NO: 878522 - RNA, 19 nt, Homo sapiens
ggaaauagagagauuguca

SEQ ID NO: 878523 - RNA, 19 nt, Homo sapiens
gagagauugucauuauuga

SEQ ID NO: 878524 - RNA, 19 nt, Homo sapiens
gaaccaaaucauacgauaa

SEQ ID NO: 878525 - RNA, 19 nt, Homo sapiens
ggagccaacuguuucuuug

SEQ ID NO: 878526 - RNA, 19 nt, Homo sapiens
ugugguaccugaagucaua

SEQ ID NO: 878527 - RNA, 19 nt, Homo sapiens
gaacaguuauuagacuaga

SEQ ID NO: 878528 - RNA, 19 nt, Homo sapiens
gcacgacucagauaacaaa

SEQ ID NO: 878529 - RNA, 19 nt, Homo sapiens
acgcaagacuccuagguua

SEQ ID NO: 878530 - RNA, 19 nt, Homo sapiens
gaucugagcugagaaucau

SEQ ID NO: 878531 - RNA, 19 nt, Homo sapiens
gaaucugugccuuuaauaa

SEQ ID NO: 878532 - RNA, 19 nt, Homo sapiens
acacacaauuguccucuuu

SEQ ID NO: 878533 - RNA, 19 nt, Homo sapiens
aacagagccuuauaaagua

SEQ ID NO: 878534 - RNA, 19 nt, Homo sapiens
ugaaccaaaucauacgaua

SEQ ID NO: 878535 - RNA, 19 nt, Homo sapiens
gcgaaucugugccuuuaau

SEQ ID NO: 878536 - RNA, 19 nt, Homo sapiens
ugacacaccagauauguuu

SEQ ID NO: 878537 - RNA, 19 nt, Homo sapiens
gcaauuuauucugcaguuu

SEQ ID NO: 878538 - RNA, 19 nt, Homo sapiens
auacagaggucuaaaugug

SEQ ID NO: 878539 - RNA, 19 nt, Homo sapiens
ggugaucacuauaccaaug

SEQ ID NO: 878540 - RNA, 19 nt, Homo sapiens
gaacaccaauggaccaaaa

SEQ ID NO: 878541 - RNA, 19 nt, Homo sapiens
ucccagaccuugacuaaga

SEQ ID NO: 878542 - RNA, 19 nt, Homo sapiens
gaauucaaacagagccuua

SEQ ID NO: 878543 - RNA, 19 nt, Homo sapiens
guggcucccugauggauua

SEQ ID NO: 878544 - RNA, 19 nt, Homo sapiens
uaccugaagucauauuuga

SEQ ID NO: 878545 - RNA, 19 nt, Homo sapiens
cauggaaacucaaagaagu

SEQ ID NO: 878546 - RNA, 19 nt, Homo sapiens
ucaaacagagccuuauaaa

SEQ ID NO: 878547 - RNA, 19 nt, Homo sapiens
gaagcaagcauuugaaucg

SEQ ID NO: 878548 - RNA, 19 nt, Homo sapiens
guacauggaaacucaaaga

SEQ ID NO: 878549 - RNA, 19 nt, Homo sapiens
gaugaaagaguaaaggaau

SEQ ID NO: 878550 - RNA, 19 nt, Homo sapiens
ggagaucuuuggagaggau

SEQ ID NO: 878551 - RNA, 19 nt, Homo sapiens
gaagcaaacugccuaaaag

SEQ ID NO: 878552 - RNA, 19 nt, Homo sapiens
uacgauaaguuacuguuug

SEQ ID NO: 878553 - RNA, 19 nt, Homo sapiens
gaacaguaaaucaggaaca

SEQ ID NO: 878554 - RNA, 19 nt, Homo sapiens
ucaguuguuucucagauug

SEQ ID NO: 878555 - RNA, 19 nt, Homo sapiens
caaucaggaugaccaagug

SEQ ID NO: 878556 - RNA, 19 nt, Homo sapiens
cagcaugugcaauuuguuu

SEQ ID NO: 878557 - RNA, 19 nt, Homo sapiens
uaauacagaggucuaaaug

SEQ ID NO: 878558 - RNA, 19 nt, Homo sapiens
cagggaagcuggggaaaua

SEQ ID NO: 878559 - RNA, 19 nt, Homo sapiens
ucaggaagcaagcauuuga

SEQ ID NO: 878560 - RNA, 19 nt, Homo sapiens
ccaaaucauacgauaaguu

SEQ ID NO: 878561 - RNA, 19 nt, Homo sapiens
gcaaucaggaugaccaagu

SEQ ID NO: 878562 - RNA, 19 nt, Homo sapiens
ccacaaggaagaccucaau

SEQ ID NO: 878563 - RNA, 19 nt, Homo sapiens
acagaucccaguuauuauu

SEQ ID NO: 878564 - RNA, 19 nt, Homo sapiens
ggaacuaauggacuguauu

SEQ ID NO: 878565 - RNA, 19 nt, Homo sapiens
guuacuguuugcauugaaa

SEQ ID NO: 878566 - RNA, 19 nt, Homo sapiens
uaaguuacuguuugcauug

SEQ ID NO: 878567 - RNA, 19 nt, Homo sapiens
gaucccaguuauuauuuac

SEQ ID NO: 878568 - RNA, 19 nt, Homo sapiens
gcagaucugagcugagaau

SEQ ID NO: 878569 - RNA, 19 nt, Homo sapiens
ugagaacaguuauuagacu

SEQ ID NO: 878570 - RNA, 19 nt, Homo sapiens
uguauucaguuguuucuca

SEQ ID NO: 878571 - RNA, 19 nt, Homo sapiens
gaguaaaggaauucaaaca

SEQ ID NO: 878572 - RNA, 19 nt, Homo sapiens
caaggaagaccucaauggu

SEQ ID NO: 878573 - RNA, 19 nt, Homo sapiens
agagagauugucauuauug

SEQ ID NO: 878574 - RNA, 19 nt, Homo sapiens
gaacgcaagacuccuaggu

SEQ ID NO: 878575 - RNA, 19 nt, Homo sapiens
uugaggaucuguugaugga

SEQ ID NO: 878576 - RNA, 19 nt, Homo sapiens
ccaagugaaggaacuaaug

SEQ ID NO: 878577 - RNA, 19 nt, Homo sapiens
ggaagcaagcauuugaauc

SEQ ID NO: 878578 - RNA, 19 nt, Homo sapiens
cagaucccaguuauuauuu

SEQ ID NO: 878579 - RNA, 19 nt, Homo sapiens
gggagccaacuguuucuuu

SEQ ID NO: 878580 - RNA, 19 nt, Homo sapiens
caauuuauucugcaguuug

SEQ ID NO: 878581 - RNA, 19 nt, Homo sapiens
caaacagagccuuauaaag

SEQ ID NO: 878582 - RNA, 19 nt, Homo sapiens
gauaacaaagcccuaagca

SEQ ID NO: 878583 - RNA, 19 nt, Homo sapiens
caccagauauguuuucuug

SEQ ID NO: 878584 - RNA, 19 nt, Homo sapiens
gaucagaugaaagaguaaa

SEQ ID NO: 878585 - RNA, 19 nt, Homo sapiens
cgaaucugugccuuuaaua

SEQ ID NO: 878586 - RNA, 19 nt, Homo sapiens
ccagauauguuuucuugga

SEQ ID NO: 878587 - RNA, 19 nt, Homo sapiens
gaaauagagagauugucau

SEQ ID NO: 878588 - RNA, 19 nt, Homo sapiens
guucccagaccuugacuaa

SEQ ID NO: 878589 - RNA, 19 nt, Homo sapiens
guaccugaagucauauuug

SEQ ID NO: 878590 - RNA, 19 nt, Homo sapiens
caagacuccuagguuauag

SEQ ID NO: 878591 - RNA, 19 nt, Homo sapiens
cugugaagcucuguacaaa

SEQ ID NO: 878592 - RNA, 19 nt, Homo sapiens
gagccaacuguuucuuuga

SEQ ID NO: 878593 - RNA, 19 nt, Homo sapiens
ggaccaaaaugaacacagu

SEQ ID NO: 878594 - RNA, 19 nt, Homo sapiens
gaaagaguaaaggaauuca

SEQ ID NO: 878595 - RNA, 19 nt, Homo sapiens
uaaaucaggaacaccaaug

SEQ ID NO: 878596 - RNA, 19 nt, Homo sapiens
acacaauuguccucuuuac

SEQ ID NO: 878597 - RNA, 19 nt, Homo sapiens
gccaugggacacacaauug

SEQ ID NO: 878598 - RNA, 19 nt, Homo sapiens
ccugugggaucagaugaaa

SEQ ID NO: 878599 - RNA, 19 nt, Homo sapiens
ccucaggaagcaagcauuu

SEQ ID NO: 878600 - RNA, 19 nt, Homo sapiens
ucagauaacaaagcccuaa

SEQ ID NO: 878601 - RNA, 19 nt, Homo sapiens
cacagagggugaaggagau

SEQ ID NO: 878602 - RNA, 19 nt, Homo sapiens
cuagaacgcaagacuccua

SEQ ID NO: 878603 - RNA, 19 nt, Homo sapiens
gauaaguuacuguuugcau

SEQ ID NO: 878604 - RNA, 19 nt, Homo sapiens
ugauaauucuguggcuuug

SEQ ID NO: 878605 - RNA, 19 nt, Homo sapiens
ugaaagaguaaaggaauuc

SEQ ID NO: 878606 - RNA, 19 nt, Homo sapiens
gaaggaccacugugaagcu

SEQ ID NO: 878607 - RNA, 19 nt, Homo sapiens
uauaagacaacaggacuga

SEQ ID NO: 878608 - RNA, 19 nt, Homo sapiens
ugcaguuugcuguuuauua

SEQ ID NO: 878609 - RNA, 19 nt, Homo sapiens
ggaagaagcugcucucuga

SEQ ID NO: 878610 - RNA, 19 nt, Homo sapiens
aauaugaacuggagaugua

SEQ ID NO: 878611 - RNA, 19 nt, Homo sapiens
gcucauuugugcugauuaa

SEQ ID NO: 878612 - RNA, 19 nt, Homo sapiens
gaacuggagauguaugaaa

SEQ ID NO: 878613 - RNA, 19 nt, Homo sapiens
ggagacgugugccugguaa

SEQ ID NO: 878614 - RNA, 19 nt, Homo sapiens
cgaaggccaccuacaaaua

SEQ ID NO: 878615 - RNA, 19 nt, Homo sapiens
gaaaggcaaccgcuucuuc

SEQ ID NO: 878616 - RNA, 19 nt, Homo sapiens
gaaggccaccuacaaauag

SEQ ID NO: 878617 - RNA, 19 nt, Homo sapiens
gcacagcaaguuaacuaga

SEQ ID NO: 878618 - RNA, 19 nt, Homo sapiens
ccacucagcuccauuugcu

SEQ ID NO: 878619 - RNA, 19 nt, Homo sapiens
cgacugaaugcacccaaua

SEQ ID NO: 878620 - RNA, 19 nt, Homo sapiens
gaagauggagggaguaaaa

SEQ ID NO: 878621 - RNA, 19 nt, Homo sapiens
gcaaucgucgcaaacaaga

SEQ ID NO: 878622 - RNA, 19 nt, Homo sapiens
gaaggagggaggcagaguu

SEQ ID NO: 878623 - RNA, 19 nt, Homo sapiens
gugcacagcaaguuaacua

SEQ ID NO: 878624 - RNA, 19 nt, Homo sapiens
gugcuuccauggcuugcua

SEQ ID NO: 878625 - RNA, 19 nt, Homo sapiens
cuacgaaggccaccuacaa

SEQ ID NO: 878626 - RNA, 19 nt, Homo sapiens
gagaagauggagggaguaa

SEQ ID NO: 878627 - RNA, 19 nt, Homo sapiens
cgugggagaugaguacauu

SEQ ID NO: 878628 - RNA, 19 nt, Homo sapiens
gcagugagccgugauugca

SEQ ID NO: 878629 - RNA, 19 nt, Homo sapiens
ccucugggccucugucuga

SEQ ID NO: 878630 - RNA, 19 nt, Homo sapiens
cacaugggcuggccugaag

SEQ ID NO: 878631 - RNA, 19 nt, Homo sapiens
ggagggaggcagaguugug

SEQ ID NO: 878632 - RNA, 19 nt, Homo sapiens
gugcuugucuguggaggaa

SEQ ID NO: 878633 - RNA, 19 nt, Homo sapiens
ggaacugucagcguuauuc

SEQ ID NO: 878634 - RNA, 19 nt, Homo sapiens
cgaccuggcugcguguuuc

SEQ ID NO: 878635 - RNA, 19 nt, Homo sapiens
caagauugaccucccugaa

SEQ ID NO: 878636 - RNA, 19 nt, Homo sapiens
caacgguggacacgucauu

SEQ ID NO: 878637 - RNA, 19 nt, Homo sapiens
ccacuacgaaggccaccua

SEQ ID NO: 878638 - RNA, 19 nt, Homo sapiens
ucugagaguugaccagcaa

SEQ ID NO: 878639 - RNA, 19 nt, Homo sapiens
guuuaagucuuugcaguca

SEQ ID NO: 878640 - RNA, 19 nt, Homo sapiens
ugaauucggugguuuugaa

SEQ ID NO: 878641 - RNA, 19 nt, Homo sapiens
gguggacacgucauucuga

SEQ ID NO: 878642 - RNA, 19 nt, Homo sapiens
gucugugguuuaagucuuu

SEQ ID NO: 878643 - RNA, 19 nt, Homo sapiens
agacgugugccugguaaua

SEQ ID NO: 878644 - RNA, 19 nt, Homo sapiens
ugucagcguuauucucaga

SEQ ID NO: 878645 - RNA, 19 nt, Homo sapiens
gcgcugccgcuuucucuug

SEQ ID NO: 878646 - RNA, 19 nt, Homo sapiens
gauugaggaccguguuuca

SEQ ID NO: 878647 - RNA, 19 nt, Homo sapiens
ggguuucaguggagaagau

SEQ ID NO: 878648 - RNA, 19 nt, Homo sapiens
gaacugucagcguuauucu

SEQ ID NO: 878649 - RNA, 19 nt, Homo sapiens
cauggaacugucagcguua

SEQ ID NO: 878650 - RNA, 19 nt, Homo sapiens
acacuucucugugcucagu

SEQ ID NO: 878651 - RNA, 19 nt, Homo sapiens
ccgccugcccuccguauuu

SEQ ID NO: 878652 - RNA, 19 nt, Homo sapiens
cacagcaaguuaacuagag

SEQ ID NO: 878653 - RNA, 19 nt, Homo sapiens
ggagaagauggagggagua

SEQ ID NO: 878654 - RNA, 19 nt, Homo sapiens
gcugugagcuuuucuccau

SEQ ID NO: 878655 - RNA, 19 nt, Homo sapiens
gacgugugccugguaauau

SEQ ID NO: 878656 - RNA, 19 nt, Homo sapiens
caagauugaggaccguguu

SEQ ID NO: 878657 - RNA, 19 nt, Homo sapiens
uacgaaggccaccuacaaa

SEQ ID NO: 878658 - RNA, 19 nt, Homo sapiens
uuuccugucugugguuuaa

SEQ ID NO: 878659 - RNA, 19 nt, Homo sapiens
gguauagugaggaguggaa

SEQ ID NO: 878660 - RNA, 19 nt, Homo sapiens
gacugaaugcacccaauau

SEQ ID NO: 878661 - RNA, 19 nt, Homo sapiens
ggaaaggcaaccgcuucuu

SEQ ID NO: 878662 - RNA, 19 nt, Homo sapiens
caaguacugaugcauccaa

SEQ ID NO: 878663 - RNA, 19 nt, Homo sapiens
uuaagucuuugcagucaag

SEQ ID NO: 878664 - RNA, 19 nt, Homo sapiens
ccacaugggcuggccugaa

SEQ ID NO: 878665 - RNA, 19 nt, Homo sapiens
ugggcacgcuggugaagga

SEQ ID NO: 878666 - RNA, 19 nt, Homo sapiens
gggccucugucugagcaaa

SEQ ID NO: 878667 - RNA, 19 nt, Homo sapiens
aaauagcaguggccgacau

SEQ ID NO: 878668 - RNA, 19 nt, Homo sapiens
acacgucauucugagaguu

SEQ ID NO: 878669 - RNA, 19 nt, Homo sapiens
gcauuugacccucgagacu

SEQ ID NO: 878670 - RNA, 19 nt, Homo sapiens
gugcagaccaggguucuca

SEQ ID NO: 878671 - RNA, 19 nt, Homo sapiens
ugucuugcgugggagauga

SEQ ID NO: 878672 - RNA, 19 nt, Homo sapiens
gagccguggacucaaguug

SEQ ID NO: 878673 - RNA, 19 nt, Homo sapiens
gcuucuuccuggccaacaa

SEQ ID NO: 878674 - RNA, 19 nt, Homo sapiens
ugucugugguuuaagucuu

SEQ ID NO: 878675 - RNA, 19 nt, Homo sapiens
gcaugggcaggguauagug

SEQ ID NO: 878676 - RNA, 19 nt, Homo sapiens
cgugugcacagcaaguuaa

SEQ ID NO: 878677 - RNA, 19 nt, Homo sapiens
cgucugagaagagcaguga

SEQ ID NO: 878678 - RNA, 19 nt, Homo sapiens
gcaccaagauucuguguua

SEQ ID NO: 878679 - RNA, 19 nt, Homo sapiens
gaaaggaguuugaaagauu

SEQ ID NO: 878680 - RNA, 19 nt, Homo sapiens
gaaagaagaauucagcuua

SEQ ID NO: 878681 - RNA, 19 nt, Homo sapiens
ggacaccacuugugaaauu

SEQ ID NO: 878682 - RNA, 19 nt, Homo sapiens
gagcaagccuaacaucuaa

SEQ ID NO: 878683 - RNA, 19 nt, Homo sapiens
gcagcaaagucauucauuu

SEQ ID NO: 878684 - RNA, 19 nt, Homo sapiens
gauagaagauacgcuuaua

SEQ ID NO: 878685 - RNA, 19 nt, Homo sapiens
ggaagaauuuaacagauga

SEQ ID NO: 878686 - RNA, 19 nt, Homo sapiens
ggaccaaauugcuuauaaa

SEQ ID NO: 878687 - RNA, 19 nt, Homo sapiens
aaauagagcuggauucuuc

SEQ ID NO: 878688 - RNA, 19 nt, Homo sapiens
gaagauacgcuuauacaga

SEQ ID NO: 878689 - RNA, 19 nt, Homo sapiens
gagcaagcccagaagauua

SEQ ID NO: 878690 - RNA, 19 nt, Homo sapiens
uaaugaugcuccacaauuu

SEQ ID NO: 878691 - RNA, 19 nt, Homo sapiens
aaacuuaaaucaccagcua

SEQ ID NO: 878692 - RNA, 19 nt, Homo sapiens
ggacaaagaugguaaaauc

SEQ ID NO: 878693 - RNA, 19 nt, Homo sapiens
gaaggacaguguguacuuu

SEQ ID NO: 878694 - RNA, 19 nt, Homo sapiens
caauaaaucaccugaagua

SEQ ID NO: 878695 - RNA, 19 nt, Homo sapiens
ggaagccuguggagaguaa

SEQ ID NO: 878696 - RNA, 19 nt, Homo sapiens
gaaauaacuuacagagauc

SEQ ID NO: 878697 - RNA, 19 nt, Homo sapiens
gagcaguuccggagaaaua

SEQ ID NO: 878698 - RNA, 19 nt, Homo sapiens
gggaggaucugacauggaa

SEQ ID NO: 878699 - RNA, 19 nt, Homo sapiens
caagacaauuucaacguuu

SEQ ID NO: 878700 - RNA, 19 nt, Homo sapiens
gguuugaccugcaggcuua

SEQ ID NO: 878701 - RNA, 19 nt, Homo sapiens
ggagaggucagaagagaua

SEQ ID NO: 878702 - RNA, 19 nt, Homo sapiens
agaaagacuuccagcauuu

SEQ ID NO: 878703 - RNA, 19 nt, Homo sapiens
caaaguacaugucagaaag

SEQ ID NO: 878704 - RNA, 19 nt, Homo sapiens
gaauucagcuuaucacaac

SEQ ID NO: 878705 - RNA, 19 nt, Homo sapiens
gaccauauguauuuagaga

SEQ ID NO: 878706 - RNA, 19 nt, Homo sapiens
gaacagaauauugggauaa

SEQ ID NO: 878707 - RNA, 19 nt, Homo sapiens
gaucugacauggaaaauuu

SEQ ID NO: 878708 - RNA, 19 nt, Homo sapiens
ggaaggaguuaggaccaua

SEQ ID NO: 878709 - RNA, 19 nt, Homo sapiens
ggaaaaugguuuacucuuu

SEQ ID NO: 878710 - RNA, 19 nt, Homo sapiens
gaagauaaagguacagaug

SEQ ID NO: 878711 - RNA, 19 nt, Homo sapiens
caaguaagauggagcaagu

SEQ ID NO: 878712 - RNA, 19 nt, Homo sapiens
caaauuggucucacaagua

SEQ ID NO: 878713 - RNA, 19 nt, Homo sapiens
ggaguuaggaccauaugua

SEQ ID NO: 878714 - RNA, 19 nt, Homo sapiens
uuacagagaucgaaaucaa

SEQ ID NO: 878715 - RNA, 19 nt, Homo sapiens
cagcaaagucauucauuua

SEQ ID NO: 878716 - RNA, 19 nt, Homo sapiens
aaauuggucucacaaguaa

SEQ ID NO: 878717 - RNA, 19 nt, Homo sapiens
gagaaagggucaaaguaca

SEQ ID NO: 878718 - RNA, 19 nt, Homo sapiens
ggauggauauugagagguu

SEQ ID NO: 878719 - RNA, 19 nt, Homo sapiens
gaauacagguuagccaaau

SEQ ID NO: 878720 - RNA, 19 nt, Homo sapiens
gcugauagguucaaggaau

SEQ ID NO: 878721 - RNA, 19 nt, Homo sapiens
guaaguggaucucuucauc

SEQ ID NO: 878722 - RNA, 19 nt, Homo sapiens
aagaaacacuucagccuuu

SEQ ID NO: 878723 - RNA, 19 nt, Homo sapiens
uauaaggacuugugccauu

SEQ ID NO: 878724 - RNA, 19 nt, Homo sapiens
ugaaagacauagcagaaga

SEQ ID NO: 878725 - RNA, 19 nt, Homo sapiens
caauggagauuacuaccuu

SEQ ID NO: 878726 - RNA, 19 nt, Homo sapiens
gcaaacaguaucaaccuuu

SEQ ID NO: 878727 - RNA, 19 nt, Homo sapiens
guuaggaccauauguauuu

SEQ ID NO: 878728 - RNA, 19 nt, Homo sapiens
gaacauuuccgucaguuuc

SEQ ID NO: 878729 - RNA, 19 nt, Homo sapiens
aagauacgcuuauacagaa

SEQ ID NO: 878730 - RNA, 19 nt, Homo sapiens
gcaaguccggcaugaauuu

SEQ ID NO: 878731 - RNA, 19 nt, Homo sapiens
gaagaugagaccauuaaug

SEQ ID NO: 878732 - RNA, 19 nt, Homo sapiens
gaacaggagagaauucuuc

SEQ ID NO: 878733 - RNA, 19 nt, Homo sapiens
gagagaagacaagaauaua

SEQ ID NO: 878734 - RNA, 19 nt, Homo sapiens
gaugaaagccugacaaugc

SEQ ID NO: 878735 - RNA, 19 nt, Homo sapiens
gcggagccaccaacuauua

SEQ ID NO: 878736 - RNA, 19 nt, Homo sapiens
cugcagaaaucuuaucaaa

SEQ ID NO: 878737 - RNA, 19 nt, Homo sapiens
gaagagauagaacaaacaa

SEQ ID NO: 878738 - RNA, 19 nt, Homo sapiens
uuagugaucugcuuaacaa

SEQ ID NO: 878739 - RNA, 19 nt, Homo sapiens
gcuggauucuucuuuacua

SEQ ID NO: 878740 - RNA, 19 nt, Homo sapiens
gaggagcaauucagcaaau

SEQ ID NO: 878741 - RNA, 19 nt, Homo sapiens
gaaaucaaaggaaggcaaa

SEQ ID NO: 878742 - RNA, 19 nt, Homo sapiens
gaugagaccauuaauguca

SEQ ID NO: 878743 - RNA, 19 nt, Homo sapiens
aaggcuagcucuucaacua

SEQ ID NO: 878744 - RNA, 19 nt, Homo sapiens
ucaagacaauuucaacguu

SEQ ID NO: 878745 - RNA, 19 nt, Homo sapiens
gaugaaagacauagcagaa

SEQ ID NO: 878746 - RNA, 19 nt, Homo sapiens
gaucuuaugugcggacaga

SEQ ID NO: 878747 - RNA, 19 nt, Homo sapiens
gcuacaggcuuugcauaaa

SEQ ID NO: 878748 - RNA, 19 nt, Homo sapiens
gcaaagucauucauuuaac

SEQ ID NO: 878749 - RNA, 19 nt, Homo sapiens
ccuccuaaaucucccaaua

SEQ ID NO: 878750 - RNA, 19 nt, Homo sapiens
uaccugagauccagaaaga

SEQ ID NO: 878751 - RNA, 19 nt, Homo sapiens
gaguauaccuugaaaagaa

SEQ ID NO: 878752 - RNA, 19 nt, Homo sapiens
gaagaagaggugucuguau

SEQ ID NO: 878753 - RNA, 19 nt, Homo sapiens
ccagcuauuucaucuguuu

SEQ ID NO: 878754 - RNA, 19 nt, Homo sapiens
aagaaagacuuccagcauu

SEQ ID NO: 878755 - RNA, 19 nt, Homo sapiens
gaaaggaaagaaugagguu

SEQ ID NO: 878756 - RNA, 19 nt, Homo sapiens
gagaagcuccagugauuug

SEQ ID NO: 878757 - RNA, 19 nt, Homo sapiens
guauauagaagccuuagaa

SEQ ID NO: 878758 - RNA, 19 nt, Homo sapiens
agagcuggauucuucuuua

SEQ ID NO: 878759 - RNA, 19 nt, Homo sapiens
caaaggagaggucagaaga

SEQ ID NO: 878760 - RNA, 19 nt, Homo sapiens
gacaaugcauuucucaaca

SEQ ID NO: 878761 - RNA, 19 nt, Homo sapiens
ccauuaaugucaacuacaa

SEQ ID NO: 878762 - RNA, 19 nt, Homo sapiens
uaacgucucuaaacgaaca

SEQ ID NO: 878763 - RNA, 19 nt, Homo sapiens
ggcaacagaugauuuccuu

SEQ ID NO: 878764 - RNA, 19 nt, Homo sapiens
gcaauagaaaggaguuuga

SEQ ID NO: 878765 - RNA, 19 nt, Homo sapiens
ugcaaccucucacaaauuu

SEQ ID NO: 878766 - RNA, 19 nt, Homo sapiens
gauccaagaagaacuagaa

SEQ ID NO: 878767 - RNA, 19 nt, Homo sapiens
cagaagaagauuacaacua

SEQ ID NO: 878768 - RNA, 19 nt, Homo sapiens
caacuauuaucaacugcuu

SEQ ID NO: 878769 - RNA, 19 nt, Homo sapiens
cggaccaaauugcuuauaa

SEQ ID NO: 878770 - RNA, 19 nt, Homo sapiens
cagaggcaauuagauuuaa

SEQ ID NO: 878771 - RNA, 19 nt, Homo sapiens
gagcaaguccggcaugaau

SEQ ID NO: 878772 - RNA, 19 nt, Homo sapiens
augagaagcuccagugauu

SEQ ID NO: 878773 - RNA, 19 nt, Homo sapiens
gcucuucaacuaugucuuu

SEQ ID NO: 878774 - RNA, 19 nt, Homo sapiens
gaaucaagcaauaugcaaa

SEQ ID NO: 878775 - RNA, 19 nt, Homo sapiens
ccaccagcuuuacaaauug

SEQ ID NO: 878776 - RNA, 19 nt, Homo sapiens
ucagaggcaauuagauuua

SEQ ID NO: 878777 - RNA, 19 nt, Homo sapiens
ggauaauguuccugcagaa

SEQ ID NO: 878778 - RNA, 19 nt, Homo sapiens
ggaaaucagucaagaaaga

SEQ ID NO: 878779 - RNA, 19 nt, Homo sapiens
cggaauagcuuuggauuaa

SEQ ID NO: 878780 - RNA, 19 nt, Homo sapiens
ggacaacggccaccuguuu

SEQ ID NO: 878781 - RNA, 19 nt, Homo sapiens
ggacaacgguaggaugauu

SEQ ID NO: 878782 - RNA, 19 nt, Homo sapiens
ugaaguuacucaaccauuu

SEQ ID NO: 878783 - RNA, 19 nt, Homo sapiens
ggauuugucuguugaacuu

SEQ ID NO: 878784 - RNA, 19 nt, Homo sapiens
ggacuguguuucccuuaaa

SEQ ID NO: 878785 - RNA, 19 nt, Homo sapiens
gugauaaaccaccuuaaua

SEQ ID NO: 878786 - RNA, 19 nt, Homo sapiens
gcgaaugcauuacaaagga

SEQ ID NO: 878787 - RNA, 19 nt, Homo sapiens
cgaggcaacuccauauuau

SEQ ID NO: 878788 - RNA, 19 nt, Homo sapiens
ggaauagcuuuggauuaaa

SEQ ID NO: 878789 - RNA, 19 nt, Homo sapiens
ugaagccgauuauuccuaa

SEQ ID NO: 878790 - RNA, 19 nt, Homo sapiens
guugguauuuguugugaua

SEQ ID NO: 878791 - RNA, 19 nt, Homo sapiens
gggcgcuggugaagaaaua

SEQ ID NO: 878792 - RNA, 19 nt, Homo sapiens
gcauugucgucuuggauaa

SEQ ID NO: 878793 - RNA, 19 nt, Homo sapiens
agagaacacuggacagaga

SEQ ID NO: 878794 - RNA, 19 nt, Homo sapiens
gaaauuguagccacagaug

SEQ ID NO: 878795 - RNA, 19 nt, Homo sapiens
gaaguuacucaaccauuug

SEQ ID NO: 878796 - RNA, 19 nt, Homo sapiens
caaauucacacuuucaugu

SEQ ID NO: 878797 - RNA, 19 nt, Homo sapiens
cagcccaaauucacacuuu

SEQ ID NO: 878798 - RNA, 19 nt, Homo sapiens
gaguguagccuaugcucua

SEQ ID NO: 878799 - RNA, 19 nt, Homo sapiens
uauaaagaccggcaauuug

SEQ ID NO: 878800 - RNA, 19 nt, Homo sapiens
gcucugaggcaguuaggua

SEQ ID NO: 878801 - RNA, 19 nt, Homo sapiens
gaaaaggcaaguuauguuu

SEQ ID NO: 878802 - RNA, 19 nt, Homo sapiens
gggcuucguucuuguggaa

SEQ ID NO: 878803 - RNA, 19 nt, Homo sapiens
uaauggauuugucuguuga

SEQ ID NO: 878804 - RNA, 19 nt, Homo sapiens
ugacauagguagcaacacu

SEQ ID NO: 878805 - RNA, 19 nt, Homo sapiens
ucaggucgcuggacuacga

SEQ ID NO: 878806 - RNA, 19 nt, Homo sapiens
gaaaaccgagcacaacaua

SEQ ID NO: 878807 - RNA, 19 nt, Homo sapiens
aauuagagaucucgugaug

SEQ ID NO: 878808 - RNA, 19 nt, Homo sapiens
ucuugcagcuugauauaaa

SEQ ID NO: 878809 - RNA, 19 nt, Homo sapiens
guggaaaucagucaagaaa

SEQ ID NO: 878810 - RNA, 19 nt, Homo sapiens
gaggcaacuccauauuaua

SEQ ID NO: 878811 - RNA, 19 nt, Homo sapiens
gaaggacgcauuuuaggua

SEQ ID NO: 878812 - RNA, 19 nt, Homo sapiens
uuaauggauuugucuguug

SEQ ID NO: 878813 - RNA, 19 nt, Homo sapiens
cuauagaagugguggaugu

SEQ ID NO: 878814 - RNA, 19 nt, Homo sapiens
ucgaggcaacuccauauua

SEQ ID NO: 878815 - RNA, 19 nt, Homo sapiens
ccaaggcgaugaaguuacu

SEQ ID NO: 878816 - RNA, 19 nt, Homo sapiens
gcucuugcagcuugauaua

SEQ ID NO: 878817 - RNA, 19 nt, Homo sapiens
ggauaacucagacgccauu

SEQ ID NO: 878818 - RNA, 19 nt, Homo sapiens
aggcaacuccauauuauaa

SEQ ID NO: 878819 - RNA, 19 nt, Homo sapiens
cagcagaaauucgccugaa

SEQ ID NO: 878820 - RNA, 19 nt, Homo sapiens
gcagcucacagauauaaau

SEQ ID NO: 878821 - RNA, 19 nt, Homo sapiens
cgaaugcauuacaaaggaa

SEQ ID NO: 878822 - RNA, 19 nt, Homo sapiens
ccacagaaaaggcaaguua

SEQ ID NO: 878823 - RNA, 19 nt, Homo sapiens
aauuucaccuugagauuga

SEQ ID NO: 878824 - RNA, 19 nt, Homo sapiens
gaucuccccuuucuuuuga

SEQ ID NO: 878825 - RNA, 19 nt, Homo sapiens
gcccaggacuuugacauag

SEQ ID NO: 878826 - RNA, 19 nt, Homo sapiens
gcucacagauauaaaugac

SEQ ID NO: 878827 - RNA, 19 nt, Homo sapiens
uuccagcucuuacuagaaa

SEQ ID NO: 878828 - RNA, 19 nt, Homo sapiens
uagaagugguggaugugaa

SEQ ID NO: 878829 - RNA, 19 nt, Homo sapiens
gauauaaagaccggcaauu

SEQ ID NO: 878830 - RNA, 19 nt, Homo sapiens
gcauuacaaaggaaacaaa

SEQ ID NO: 878831 - RNA, 19 nt, Homo sapiens
gaaaucagucaagaaagau

SEQ ID NO: 878832 - RNA, 19 nt, Homo sapiens
aaacagaaaguggcuauuc

SEQ ID NO: 878833 - RNA, 19 nt, Homo sapiens
uacauagugucauuccaaa

SEQ ID NO: 878834 - RNA, 19 nt, Homo sapiens
uaacucagacgccauuaag

SEQ ID NO: 878835 - RNA, 19 nt, Homo sapiens
ccgacucgcucacugucua

SEQ ID NO: 878836 - RNA, 19 nt, Homo sapiens
gagagagccaagccgagua

SEQ ID NO: 878837 - RNA, 19 nt, Homo sapiens
gcacuguggcuauagaagu

SEQ ID NO: 878838 - RNA, 19 nt, Homo sapiens
gcauuuccagcucuuacua

SEQ ID NO: 878839 - RNA, 19 nt, Homo sapiens
aaaggcaaguuauguuucu

SEQ ID NO: 878840 - RNA, 19 nt, Homo sapiens
uuagagaucucgugaugac

SEQ ID NO: 878841 - RNA, 19 nt, Homo sapiens
gaaaaugcacuguggcuau

SEQ ID NO: 878842 - RNA, 19 nt, Homo sapiens
gcaacuccauauuauaacg

SEQ ID NO: 878843 - RNA, 19 nt, Homo sapiens
gacaacgguaggaugauuu

SEQ ID NO: 878844 - RNA, 19 nt, Homo sapiens
cgagaaaacagcagaaauu

SEQ ID NO: 878845 - RNA, 19 nt, Homo sapiens
gaguacaacaucaccauca

SEQ ID NO: 878846 - RNA, 19 nt, Homo sapiens
aagaucggauucgcgguua

SEQ ID NO: 878847 - RNA, 19 nt, Homo sapiens
auauaaagaccggcaauuu

SEQ ID NO: 878848 - RNA, 19 nt, Homo sapiens
gauuguguacggaguuaaa

SEQ ID NO: 878849 - RNA, 19 nt, Homo sapiens
cggauucgcgguuauuuau

SEQ ID NO: 878850 - RNA, 19 nt, Homo sapiens
ccaugcaugcuguugauuu

SEQ ID NO: 878851 - RNA, 19 nt, Homo sapiens
uuucagaucuagaauucga

SEQ ID NO: 878852 - RNA, 19 nt, Homo sapiens
cuugcuauauuguugcuuu

SEQ ID NO: 878853 - RNA, 19 nt, Homo sapiens
gauucgcgguuauuuaugc

SEQ ID NO: 878854 - RNA, 19 nt, Homo sapiens
cauagugucauuccaaauc

SEQ ID NO: 878855 - RNA, 19 nt, Homo sapiens
gagcuuuuauuucccuuuu

SEQ ID NO: 878856 - RNA, 19 nt, Homo sapiens
ccggaauagcuuuggauua

SEQ ID NO: 878857 - RNA, 19 nt, Homo sapiens
ugucgucgcucuuccucuu

SEQ ID NO: 878858 - RNA, 19 nt, Homo sapiens
gacaacggccaccuguuug

SEQ ID NO: 878859 - RNA, 19 nt, Homo sapiens
aaaaugcacuguggcuaua

SEQ ID NO: 878860 - RNA, 19 nt, Homo sapiens
aaauagcccaggacuuuga

SEQ ID NO: 878861 - RNA, 19 nt, Homo sapiens
gaucggauucgcgguuauu

SEQ ID NO: 878862 - RNA, 19 nt, Homo sapiens
gaaugcauuacaaaggaaa

SEQ ID NO: 878863 - RNA, 19 nt, Homo sapiens
uggauuguguacggaguua

SEQ ID NO: 878864 - RNA, 19 nt, Homo sapiens
ccgauuauuccuaaccuuu

SEQ ID NO: 878865 - RNA, 19 nt, Homo sapiens
gcagaaauucgccugaaaa

SEQ ID NO: 878866 - RNA, 19 nt, Homo sapiens
uuacauagugucauuccaa

SEQ ID NO: 878867 - RNA, 19 nt, Homo sapiens
ggauuaaauuagagaucuc

SEQ ID NO: 878868 - RNA, 19 nt, Homo sapiens
acugcugccuuccggaaua

SEQ ID NO: 878869 - RNA, 19 nt, Homo sapiens
ggaaauuguagccacagau

SEQ ID NO: 878870 - RNA, 19 nt, Homo sapiens
aauucacacuuucauguug

SEQ ID NO: 878871 - RNA, 19 nt, Homo sapiens
gaaacagaaaguggcuauu

SEQ ID NO: 878872 - RNA, 19 nt, Homo sapiens
gaagaaauagggaaaacug

SEQ ID NO: 878873 - RNA, 19 nt, Homo sapiens
acucaaccauuuguaauag

SEQ ID NO: 878874 - RNA, 19 nt, Homo sapiens
guugugauaaaccaccuua

SEQ ID NO: 878875 - RNA, 19 nt, Homo sapiens
ccagaaugaucuccccuuu

SEQ ID NO: 878876 - RNA, 19 nt, Homo sapiens
uguagccuaugcucuauuc

SEQ ID NO: 878877 - RNA, 19 nt, Homo sapiens
uacacaaucagcccaaauu

SEQ ID NO: 878878 - RNA, 19 nt, Homo sapiens
ggacagaacuggcucaaug

SEQ ID NO: 878879 - RNA, 19 nt, Homo sapiens
gagaauacuuguugauuuc

SEQ ID NO: 878880 - RNA, 19 nt, Homo sapiens
ggaggaggaugaagaugaa

SEQ ID NO: 878881 - RNA, 19 nt, Homo sapiens
ugccagaucuucaaacuuu

SEQ ID NO: 878882 - RNA, 19 nt, Homo sapiens
caagucagguggaggguuu

SEQ ID NO: 878883 - RNA, 19 nt, Homo sapiens
cuaagcauauugccaagua

SEQ ID NO: 878884 - RNA, 19 nt, Homo sapiens
gugcauuucuucaauaguu

SEQ ID NO: 878885 - RNA, 19 nt, Homo sapiens
guccugcucuggucaauaa

SEQ ID NO: 878886 - RNA, 19 nt, Homo sapiens
cuggaaagguuacuucaaa

SEQ ID NO: 878887 - RNA, 19 nt, Homo sapiens
ggaagggccugguguugca

SEQ ID NO: 878888 - RNA, 19 nt, Homo sapiens
ggaugcugcucuacucaaa

SEQ ID NO: 878889 - RNA, 19 nt, Homo sapiens
gauccuuuguugauacgua

SEQ ID NO: 878890 - RNA, 19 nt, Homo sapiens
gaagaugaaagagacuaua

SEQ ID NO: 878891 - RNA, 19 nt, Homo sapiens
gagagaauacuuguugauu

SEQ ID NO: 878892 - RNA, 19 nt, Homo sapiens
gcaccucgcugacauucca

SEQ ID NO: 878893 - RNA, 19 nt, Homo sapiens
cagaggcgguaaagaaaga

SEQ ID NO: 878894 - RNA, 19 nt, Homo sapiens
gacgcaccaucaccuauuu

SEQ ID NO: 878895 - RNA, 19 nt, Homo sapiens
gaugaaagagacuauacaa

SEQ ID NO: 878896 - RNA, 19 nt, Homo sapiens
uagagaagcuggaggacau

SEQ ID NO: 878897 - RNA, 19 nt, Homo sapiens
ggagcugugucacugcaaa

SEQ ID NO: 878898 - RNA, 19 nt, Homo sapiens
agaaagaccgacuggauuu

SEQ ID NO: 878899 - RNA, 19 nt, Homo sapiens
cgaauuccuucaaacguau

SEQ ID NO: 878900 - RNA, 19 nt, Homo sapiens
gugaaaagguggaccaaaa

SEQ ID NO: 878901 - RNA, 19 nt, Homo sapiens
acgaauuccuucaaacgua

SEQ ID NO: 878902 - RNA, 19 nt, Homo sapiens
ggagucccuucccaagaaa

SEQ ID NO: 878903 - RNA, 19 nt, Homo sapiens
aaaggugcauuucuucaau

SEQ ID NO: 878904 - RNA, 19 nt, Homo sapiens
auaaggagcuacugcuaau

SEQ ID NO: 878905 - RNA, 19 nt, Homo sapiens
gcacugaugagguaguaga

SEQ ID NO: 878906 - RNA, 19 nt, Homo sapiens
guggacaucuucaauaagg

SEQ ID NO: 878907 - RNA, 19 nt, Homo sapiens
ucaaugaccaggugaugaa

SEQ ID NO: 878908 - RNA, 19 nt, Homo sapiens
aaagaaagaccgacuggau

SEQ ID NO: 878909 - RNA, 19 nt, Homo sapiens
cagcacugaugagguagua

SEQ ID NO: 878910 - RNA, 19 nt, Homo sapiens
caauaaggagcuacugcua

SEQ ID NO: 878911 - RNA, 19 nt, Homo sapiens
acguggacaucuucaauaa

SEQ ID NO: 878912 - RNA, 19 nt, Homo sapiens
caugugaccugcguacaga

SEQ ID NO: 878913 - RNA, 19 nt, Homo sapiens
guacucugcccaacgguuu

SEQ ID NO: 878914 - RNA, 19 nt, Homo sapiens
gaauacuuguugauuucug

SEQ ID NO: 878915 - RNA, 19 nt, Homo sapiens
aaggugcauuucuucaaua

SEQ ID NO: 878916 - RNA, 19 nt, Homo sapiens
gugaagaggaggaagaaga

SEQ ID NO: 878917 - RNA, 19 nt, Homo sapiens
ggcagaggcgguaaagaaa

SEQ ID NO: 878918 - RNA, 19 nt, Homo sapiens
cugaugagguaguagagaa

SEQ ID NO: 878919 - RNA, 19 nt, Homo sapiens
ggaagaugaaagagacuau

SEQ ID NO: 878920 - RNA, 19 nt, Homo sapiens
caagugaagaggaggaaga

SEQ ID NO: 878921 - RNA, 19 nt, Homo sapiens
gacagaacuggcucaauga

SEQ ID NO: 878922 - RNA, 19 nt, Homo sapiens
gagcaucuuggacgaauuc

SEQ ID NO: 878923 - RNA, 19 nt, Homo sapiens
ggaggaggaggaugaagau

SEQ ID NO: 878924 - RNA, 19 nt, Homo sapiens
aggcagaggcgguaaagaa

SEQ ID NO: 878925 - RNA, 19 nt, Homo sapiens
ggcagaauaaugacaguga

SEQ ID NO: 878926 - RNA, 19 nt, Homo sapiens
aagaaagaccgacuggauu

SEQ ID NO: 878927 - RNA, 19 nt, Homo sapiens
aauaaggagcuacugcuaa

SEQ ID NO: 878928 - RNA, 19 nt, Homo sapiens
gcagggagcaggaaaucag

SEQ ID NO: 878929 - RNA, 19 nt, Homo sapiens
gcauauugccaaguaucua

SEQ ID NO: 878930 - RNA, 19 nt, Homo sapiens
cgacgcaccaucaccuauu

SEQ ID NO: 878931 - RNA, 19 nt, Homo sapiens
gcuuccgaguggcuuauaa

SEQ ID NO: 878932 - RNA, 19 nt, Homo sapiens
gguacuggaagaugaaaga

SEQ ID NO: 878933 - RNA, 19 nt, Homo sapiens
ggacaugcccaaacuucgu

SEQ ID NO: 878934 - RNA, 19 nt, Homo sapiens
gaccuuguauggacagaac

SEQ ID NO: 878935 - RNA, 19 nt, Homo sapiens
ggacgaauuccuucaaacg

SEQ ID NO: 878936 - RNA, 19 nt, Homo sapiens
gaaagguuacuucaaaaug

SEQ ID NO: 878937 - RNA, 19 nt, Homo sapiens
aaacguggacaucuucaau

SEQ ID NO: 878938 - RNA, 19 nt, Homo sapiens
cagagcaucuuggacgaau

SEQ ID NO: 878939 - RNA, 19 nt, Homo sapiens
gugcauuggucccucaucu

SEQ ID NO: 878940 - RNA, 19 nt, Homo sapiens
caucuucaauaaggagcua

SEQ ID NO: 878941 - RNA, 19 nt, Homo sapiens
ugcagcugauccagucuua

SEQ ID NO: 878942 - RNA, 19 nt, Homo sapiens
caucuuggacgaauuccuu

SEQ ID NO: 878943 - RNA, 19 nt, Homo sapiens
gucggcagaucuacaagga

SEQ ID NO: 878944 - RNA, 19 nt, Homo sapiens
ucucagccauucagcuuca

SEQ ID NO: 878945 - RNA, 19 nt, Homo sapiens
gaauguggccaggcagaau

SEQ ID NO: 878946 - RNA, 19 nt, Homo sapiens
gcagaggcgguaaagaaag

SEQ ID NO: 878947 - RNA, 19 nt, Homo sapiens
gagaagcuggaggacauuu

SEQ ID NO: 878948 - RNA, 19 nt, Homo sapiens
uaagcauauugccaaguau

SEQ ID NO: 878949 - RNA, 19 nt, Homo sapiens
gcauuggucccucaucucu

SEQ ID NO: 878950 - RNA, 19 nt, Homo sapiens
acucgggccuccuuucaug

SEQ ID NO: 878951 - RNA, 19 nt, Homo sapiens
gguggugggcggacaauag

SEQ ID NO: 878952 - RNA, 19 nt, Homo sapiens
ucugcuaggugcucucaug

SEQ ID NO: 878953 - RNA, 19 nt, Homo sapiens
gaccaggugaugaacaugu

SEQ ID NO: 878954 - RNA, 19 nt, Homo sapiens
ccagcauccucaucagcaa

SEQ ID NO: 878955 - RNA, 19 nt, Homo sapiens
uuugagagaauacuuguug

SEQ ID NO: 878956 - RNA, 19 nt, Homo sapiens
ccacucacuucccuuuggu

SEQ ID NO: 878957 - RNA, 19 nt, Homo sapiens
uggccaggcagaauaauga

SEQ ID NO: 878958 - RNA, 19 nt, Homo sapiens
ccgcugcccuaagcauauu

SEQ ID NO: 878959 - RNA, 19 nt, Homo sapiens
ggcacgugcugaccaugga

SEQ ID NO: 878960 - RNA, 19 nt, Homo sapiens
ccaguuccuuuccucucuu

SEQ ID NO: 878961 - RNA, 19 nt, Homo sapiens
aauguggccaggcagaaua

SEQ ID NO: 878962 - RNA, 19 nt, Homo sapiens
ggaggaggaggaggaugaa

SEQ ID NO: 878963 - RNA, 19 nt, Homo sapiens
accaggugaugaacaugua

SEQ ID NO: 878964 - RNA, 19 nt, Homo sapiens
caggacaugcccaaacuuc

SEQ ID NO: 878965 - RNA, 19 nt, Homo sapiens
gcuggaaagguuacuucaa

SEQ ID NO: 878966 - RNA, 19 nt, Homo sapiens
aggaggaggaugaagauga

SEQ ID NO: 878967 - RNA, 19 nt, Homo sapiens
gcucccggguacuggaaga

SEQ ID NO: 878968 - RNA, 19 nt, Homo sapiens
uuucagggcucagauuugg

SEQ ID NO: 878969 - RNA, 19 nt, Homo sapiens
gcaggacaugcccaaacuu

SEQ ID NO: 878970 - RNA, 19 nt, Homo sapiens
ggaaagguuacuucaaaau

SEQ ID NO: 878971 - RNA, 19 nt, Homo sapiens
uuggacgaauuccuucaaa

SEQ ID NO: 878972 - RNA, 19 nt, Homo sapiens
ggaggaugaagaugaagag

SEQ ID NO: 878973 - RNA, 19 nt, Homo sapiens
gggcuggaaagguuacuuc

SEQ ID NO: 878974 - RNA, 19 nt, Homo sapiens
gugaggcgacgcaccauca

SEQ ID NO: 878975 - RNA, 19 nt, Homo sapiens
gcucaaugaccaggugaug

SEQ ID NO: 878976 - RNA, 19 nt, Homo sapiens
gcaugugaccugcguacag

SEQ ID NO: 878977 - RNA, 19 nt, Homo sapiens
cccggguacuggaagauga

SEQ ID NO: 878978 - RNA, 19 nt, Homo sapiens
cgaauaaacugacagcuuu

SEQ ID NO: 878979 - RNA, 19 nt, Homo sapiens
ggaccuggauugcuacuuu

SEQ ID NO: 878980 - RNA, 19 nt, Homo sapiens
ggacagacagccaguauug

SEQ ID NO: 878981 - RNA, 19 nt, Homo sapiens
ccagugagcucauccucua

SEQ ID NO: 878982 - RNA, 19 nt, Homo sapiens
gcacacaaaugacaagaag

SEQ ID NO: 878983 - RNA, 19 nt, Homo sapiens
aagaagcccucgaccuuua

SEQ ID NO: 878984 - RNA, 19 nt, Homo sapiens
ggagacagcugcguguuca

SEQ ID NO: 878985 - RNA, 19 nt, Homo sapiens
gaccuggauugcuacuuua

SEQ ID NO: 878986 - RNA, 19 nt, Homo sapiens
gaagacaccauccaaagau

SEQ ID NO: 878987 - RNA, 19 nt, Homo sapiens
gcauccagguucacccaua

SEQ ID NO: 878988 - RNA, 19 nt, Homo sapiens
gcagaccaccuuccaagaa

SEQ ID NO: 878989 - RNA, 19 nt, Homo sapiens
gauccucguugccugcuaa

SEQ ID NO: 878990 - RNA, 19 nt, Homo sapiens
cagaagagaugcugaagac

SEQ ID NO: 878991 - RNA, 19 nt, Homo sapiens
ggaagagugugagccagaa

SEQ ID NO: 878992 - RNA, 19 nt, Homo sapiens
ccaagaagcccucgaccuu

SEQ ID NO: 878993 - RNA, 19 nt, Homo sapiens
ucugaggacuuagguauuu

SEQ ID NO: 878994 - RNA, 19 nt, Homo sapiens
gcaacccagugccuuguga

SEQ ID NO: 878995 - RNA, 19 nt, Homo sapiens
ggaggccucugaagcugaa

SEQ ID NO: 878996 - RNA, 19 nt, Homo sapiens
ccacgucgcugccccauuu

SEQ ID NO: 878997 - RNA, 19 nt, Homo sapiens
gcgaauaaacugacagcuu

SEQ ID NO: 878998 - RNA, 19 nt, Homo sapiens
aggaugaucuggaggaaga

SEQ ID NO: 878999 - RNA, 19 nt, Homo sapiens
guccacaccuagugagauu

SEQ ID NO: 879000 - RNA, 19 nt, Homo sapiens
caagaagcccucgaccuuu

SEQ ID NO: 879001 - RNA, 19 nt, Homo sapiens
gcccggagaucaccaacug

SEQ ID NO: 879002 - RNA, 19 nt, Homo sapiens
aagacaccauccaaagaua

SEQ ID NO: 879003 - RNA, 19 nt, Homo sapiens
gcgcaggucccacagaaga

SEQ ID NO: 879004 - RNA, 19 nt, Homo sapiens
cagaaggcauccagguuca

SEQ ID NO: 879005 - RNA, 19 nt, Homo sapiens
ccaccucccugccuuacga

SEQ ID NO: 879006 - RNA, 19 nt, Homo sapiens
gagaucaccaacugcauga

SEQ ID NO: 879007 - RNA, 19 nt, Homo sapiens
aaacugacagcuuugagaa

SEQ ID NO: 879008 - RNA, 19 nt, Homo sapiens
ggacgaugauguggcagau

SEQ ID NO: 879009 - RNA, 19 nt, Homo sapiens
ugaagacaccauccaaaga

SEQ ID NO: 879010 - RNA, 19 nt, Homo sapiens
ccacgcaguuccucucaag

SEQ ID NO: 879011 - RNA, 19 nt, Homo sapiens
gagagcaaacagaggauga

SEQ ID NO: 879012 - RNA, 19 nt, Homo sapiens
gaauaaacugacagcuuug

SEQ ID NO: 879013 - RNA, 19 nt, Homo sapiens
cagcucccgugccaggaua

SEQ ID NO: 879014 - RNA, 19 nt, Homo sapiens
uaaacugacagcuuugaga

SEQ ID NO: 879015 - RNA, 19 nt, Homo sapiens
gcugaagacaccauccaaa

SEQ ID NO: 879016 - RNA, 19 nt, Homo sapiens
ccugagcccuggagagcaa

SEQ ID NO: 879017 - RNA, 19 nt, Homo sapiens
cgacaacacccaguuugga

SEQ ID NO: 879018 - RNA, 19 nt, Homo sapiens
gcuccacggcucugccuuu

SEQ ID NO: 879019 - RNA, 19 nt, Homo sapiens
ccaugaagcccgagagucu

SEQ ID NO: 879020 - RNA, 19 nt, Homo sapiens
ggacagugagggccaagag

SEQ ID NO: 879021 - RNA, 19 nt, Homo sapiens
gaucaccaacugcaugaag

SEQ ID NO: 879022 - RNA, 19 nt, Homo sapiens
cagcagcacacaaaugaca

SEQ ID NO: 879023 - RNA, 19 nt, Homo sapiens
ccaggcaggauacguaugu

SEQ ID NO: 879024 - RNA, 19 nt, Homo sapiens
ccagaagagaugcugaaga

SEQ ID NO: 879025 - RNA, 19 nt, Homo sapiens
cagcagcagcacacaaaug

SEQ ID NO: 879026 - RNA, 19 nt, Homo sapiens
ccaccaccucccugccuua

SEQ ID NO: 879027 - RNA, 19 nt, Homo sapiens
gcagggaaggcugaagaga

SEQ ID NO: 879028 - RNA, 19 nt, Homo sapiens
cccagugccuugugaaguc

SEQ ID NO: 879029 - RNA, 19 nt, Homo sapiens
gcaggucccacagaagaug

SEQ ID NO: 879030 - RNA, 19 nt, Homo sapiens
ccacaccuagugagauuca

SEQ ID NO: 879031 - RNA, 19 nt, Homo sapiens
cauccagguucacccauac

SEQ ID NO: 879032 - RNA, 19 nt, Homo sapiens
cacccaguuuggacaguga

SEQ ID NO: 879033 - RNA, 19 nt, Homo sapiens
gggacagacagccaguauu

SEQ ID NO: 879034 - RNA, 19 nt, Homo sapiens
agcagcagcacacaaauga

SEQ ID NO: 879035 - RNA, 19 nt, Homo sapiens
gagcaaacagaggaugauc

SEQ ID NO: 879036 - RNA, 19 nt, Homo sapiens
aaucaucugaggccaguga

SEQ ID NO: 879037 - RNA, 19 nt, Homo sapiens
guuccuccgccaccacuuu

SEQ ID NO: 879038 - RNA, 19 nt, Homo sapiens
gcagauguauuucaugaua

SEQ ID NO: 879039 - RNA, 19 nt, Homo sapiens
gaaggcagcccuacagaaa

SEQ ID NO: 879040 - RNA, 19 nt, Homo sapiens
gaaaucugcucaucaucuu

SEQ ID NO: 879041 - RNA, 19 nt, Homo sapiens
guucugacguccacuuuaa

SEQ ID NO: 879042 - RNA, 19 nt, Homo sapiens
ggucuugggugauuggaaa

SEQ ID NO: 879043 - RNA, 19 nt, Homo sapiens
caaguuccaucuaccaaga

SEQ ID NO: 879044 - RNA, 19 nt, Homo sapiens
caacgaugggcauguauuu

SEQ ID NO: 879045 - RNA, 19 nt, Homo sapiens
gcagcaaguucaucuccuu

SEQ ID NO: 879046 - RNA, 19 nt, Homo sapiens
gacguccacuuuaauguga

SEQ ID NO: 879047 - RNA, 19 nt, Homo sapiens
gccaucagcugcccacuuc

SEQ ID NO: 879048 - RNA, 19 nt, Homo sapiens
ggccaucugugcugacauu

SEQ ID NO: 879049 - RNA, 19 nt, Homo sapiens
uaccaagagucuauucaaa

SEQ ID NO: 879050 - RNA, 19 nt, Homo sapiens
ggucuuguauccugcuuau

SEQ ID NO: 879051 - RNA, 19 nt, Homo sapiens
ugauaacugugauguaugu

SEQ ID NO: 879052 - RNA, 19 nt, Homo sapiens
ccauuacuaugcaucauug

SEQ ID NO: 879053 - RNA, 19 nt, Homo sapiens
ggaaaucugcucaucaucu

SEQ ID NO: 879054 - RNA, 19 nt, Homo sapiens
uacagaaacucuucagcaa

SEQ ID NO: 879055 - RNA, 19 nt, Homo sapiens
ucuauagucugagaaauug

SEQ ID NO: 879056 - RNA, 19 nt, Homo sapiens
gcaaguucaucuccuuugg

SEQ ID NO: 879057 - RNA, 19 nt, Homo sapiens
agugauaacugugauguau

SEQ ID NO: 879058 - RNA, 19 nt, Homo sapiens
uagccaauuucuacuguga

SEQ ID NO: 879059 - RNA, 19 nt, Homo sapiens
ccaagagucuauucaaagc

SEQ ID NO: 879060 - RNA, 19 nt, Homo sapiens
ccacuucauuacacaacaa

SEQ ID NO: 879061 - RNA, 19 nt, Homo sapiens
ccccaaagaugcagugaua

SEQ ID NO: 879062 - RNA, 19 nt, Homo sapiens
caauuucuacugugacauu

SEQ ID NO: 879063 - RNA, 19 nt, Homo sapiens
gaaaaucaauccuuuaacc

SEQ ID NO: 879064 - RNA, 19 nt, Homo sapiens
gaauaaugucuucuuugug

SEQ ID NO: 879065 - RNA, 19 nt, Homo sapiens
acugugacauuaugccuuu

SEQ ID NO: 879066 - RNA, 19 nt, Homo sapiens
ccaucacacugacuggaaa

SEQ ID NO: 879067 - RNA, 19 nt, Homo sapiens
augcagauguauuucauga

SEQ ID NO: 879068 - RNA, 19 nt, Homo sapiens
gcucccaccucacaguugu

SEQ ID NO: 879069 - RNA, 19 nt, Homo sapiens
gccuaaugcagauguauuu

SEQ ID NO: 879070 - RNA, 19 nt, Homo sapiens
gcaucauugucuccuaugu

SEQ ID NO: 879071 - RNA, 19 nt, Homo sapiens
accaggaaguagccaauuu

SEQ ID NO: 879072 - RNA, 19 nt, Homo sapiens
ucagcugcccacuucauua

SEQ ID NO: 879073 - RNA, 19 nt, Homo sapiens
cagcaagaacagaauaaug

SEQ ID NO: 879074 - RNA, 19 nt, Homo sapiens
gggaguuacuagucagcaa

SEQ ID NO: 879075 - RNA, 19 nt, Homo sapiens
ccacuuuaaugugaagaug

SEQ ID NO: 879076 - RNA, 19 nt, Homo sapiens
gcaagaacagaauaauguc

SEQ ID NO: 879077 - RNA, 19 nt, Homo sapiens
ccuuucaucuauagucuga

SEQ ID NO: 879078 - RNA, 19 nt, Homo sapiens
gccaauuucuacugugaca

SEQ ID NO: 879079 - RNA, 19 nt, Homo sapiens
cugagaaauugggauauga

SEQ ID NO: 879080 - RNA, 19 nt, Homo sapiens
ucuuguauccugcuuauug

SEQ ID NO: 879081 - RNA, 19 nt, Homo sapiens
gcuauaccuuggcugcaau

SEQ ID NO: 879082 - RNA, 19 nt, Homo sapiens
ggccaaggcagacagcuau

SEQ ID NO: 879083 - RNA, 19 nt, Homo sapiens
gaugccuaaugcagaugua

SEQ ID NO: 879084 - RNA, 19 nt, Homo sapiens
cuggaaaucugcucaucau

SEQ ID NO: 879085 - RNA, 19 nt, Homo sapiens
ugagaaauugggauaugaa

SEQ ID NO: 879086 - RNA, 19 nt, Homo sapiens
ucugagaaauugggauaug

SEQ ID NO: 879087 - RNA, 19 nt, Homo sapiens
gcauuaaauccuuucaucu

SEQ ID NO: 879088 - RNA, 19 nt, Homo sapiens
agaacagaauaaugucuuc

SEQ ID NO: 879089 - RNA, 19 nt, Homo sapiens
cuaaggugcuggccaacca

SEQ ID NO: 879090 - RNA, 19 nt, Homo sapiens
gcagugaccccagcauuaa

SEQ ID NO: 879091 - RNA, 19 nt, Homo sapiens
cagauguauuucaugauag

SEQ ID NO: 879092 - RNA, 19 nt, Homo sapiens
ccaaagaugcagugauaac

SEQ ID NO: 879093 - RNA, 19 nt, Homo sapiens
ccaggaaguagccaauuuc

SEQ ID NO: 879094 - RNA, 19 nt, Homo sapiens
ugaaggcagcccuacagaa

SEQ ID NO: 879095 - RNA, 19 nt, Homo sapiens
uuucaucuauagucugaga

SEQ ID NO: 879096 - RNA, 19 nt, Homo sapiens
agcaagaacagaauaaugu

SEQ ID NO: 879097 - RNA, 19 nt, Homo sapiens
caucauugucuccuauguu

SEQ ID NO: 879098 - RNA, 19 nt, Homo sapiens
gccauuacuaugcaucauu

SEQ ID NO: 879099 - RNA, 19 nt, Homo sapiens
uuucuacugugacauuaug

SEQ ID NO: 879100 - RNA, 19 nt, Homo sapiens
agcauuaaauccuuucauc

SEQ ID NO: 879101 - RNA, 19 nt, Homo sapiens
gugcugacauucgccuuca

SEQ ID NO: 879102 - RNA, 19 nt, Homo sapiens
gagaaauugggauaugaag

SEQ ID NO: 879103 - RNA, 19 nt, Homo sapiens
cuaccaagagucuauucaa

SEQ ID NO: 879104 - RNA, 19 nt, Homo sapiens
ugacguccacuuuaaugug

SEQ ID NO: 879105 - RNA, 19 nt, Homo sapiens
uugcugaaguuguccuguu

SEQ ID NO: 879106 - RNA, 19 nt, Homo sapiens
cauuaugccuuugcugaag

SEQ ID NO: 879107 - RNA, 19 nt, Homo sapiens
ucacagcuaguuuguccuu

SEQ ID NO: 879108 - RNA, 19 nt, Homo sapiens
cagcaaguucaucuccuuu

SEQ ID NO: 879109 - RNA, 19 nt, Homo sapiens
caucuauagucugagaaau

SEQ ID NO: 879110 - RNA, 19 nt, Homo sapiens
caaccaggaaguagccaau

SEQ ID NO: 879111 - RNA, 19 nt, Homo sapiens
cuaaugcagauguauuuca

SEQ ID NO: 879112 - RNA, 19 nt, Homo sapiens
agucugagaaauugggaua

SEQ ID NO: 879113 - RNA, 19 nt, Homo sapiens
ggcagugaccccagcauua

SEQ ID NO: 879114 - RNA, 19 nt, Homo sapiens
cuagucagcaagaacagaa

SEQ ID NO: 879115 - RNA, 19 nt, Homo sapiens
caaagaugcagugauaacu

SEQ ID NO: 879116 - RNA, 19 nt, Homo sapiens
caagaacagaauaaugucu

SEQ ID NO: 879117 - RNA, 19 nt, Homo sapiens
cagcuaguuuguccuucug

SEQ ID NO: 879118 - RNA, 19 nt, Homo sapiens
cacacugacuggaaaucug

SEQ ID NO: 879119 - RNA, 19 nt, Homo sapiens
uccacagucuuccaaguuc

SEQ ID NO: 879120 - RNA, 19 nt, Homo sapiens
gacuggaaaucugcucauc

SEQ ID NO: 879121 - RNA, 19 nt, Homo sapiens
ccuuuaaccuggauuuuau

SEQ ID NO: 879122 - RNA, 19 nt, Homo sapiens
uggcugcaauggcauacga

SEQ ID NO: 879123 - RNA, 19 nt, Homo sapiens
aucauugucuccuauguuc

SEQ ID NO: 879124 - RNA, 19 nt, Homo sapiens
gccaaggcagacagcuaua

SEQ ID NO: 879125 - RNA, 19 nt, Homo sapiens
gucagcaagaacagaauaa

SEQ ID NO: 879126 - RNA, 19 nt, Homo sapiens
ucaucuauagucugagaaa

SEQ ID NO: 879127 - RNA, 19 nt, Homo sapiens
ucuccuauguucaggucuu

SEQ ID NO: 879128 - RNA, 19 nt, Homo sapiens
ggucggcguuuucucuuug

SEQ ID NO: 879129 - RNA, 19 nt, Homo sapiens
gaagaaagaaaaucaaucc

SEQ ID NO: 879130 - RNA, 19 nt, Homo sapiens
gaguuacuagucagcaaga

SEQ ID NO: 879131 - RNA, 19 nt, Homo sapiens
gaaaucacauugucuguua

SEQ ID NO: 879132 - RNA, 19 nt, Homo sapiens
ggagagaaaucaacuguaa

SEQ ID NO: 879133 - RNA, 19 nt, Homo sapiens
ggaagaagguuuauuugaa

SEQ ID NO: 879134 - RNA, 19 nt, Homo sapiens
caucaagacuccugagaua

SEQ ID NO: 879135 - RNA, 19 nt, Homo sapiens
gcagacaaauaugagauua

SEQ ID NO: 879136 - RNA, 19 nt, Homo sapiens
gaagaagguuuauuugaag

SEQ ID NO: 879137 - RNA, 19 nt, Homo sapiens
gcuaauugguugccuauga

SEQ ID NO: 879138 - RNA, 19 nt, Homo sapiens
ucaggcaucucuccaauaa

SEQ ID NO: 879139 - RNA, 19 nt, Homo sapiens
ccaaaguucucaccuaaug

SEQ ID NO: 879140 - RNA, 19 nt, Homo sapiens
gcaaagcugugggauguga

SEQ ID NO: 879141 - RNA, 19 nt, Homo sapiens
gcacaaucauuuaucuaug

SEQ ID NO: 879142 - RNA, 19 nt, Homo sapiens
ggacaugccugaacacacu

SEQ ID NO: 879143 - RNA, 19 nt, Homo sapiens
ggacuacaaugaugaacug

SEQ ID NO: 879144 - RNA, 19 nt, Homo sapiens
ggaggaccaugaagccuuu

SEQ ID NO: 879145 - RNA, 19 nt, Homo sapiens
gaaaccucgucauuaauug

SEQ ID NO: 879146 - RNA, 19 nt, Homo sapiens
agacauggcuugauaacau

SEQ ID NO: 879147 - RNA, 19 nt, Homo sapiens
ggacagagagccugauuag

SEQ ID NO: 879148 - RNA, 19 nt, Homo sapiens
gaaguuugaugaacagaag

SEQ ID NO: 879149 - RNA, 19 nt, Homo sapiens
gugcagcggugaaguuuga

SEQ ID NO: 879150 - RNA, 19 nt, Homo sapiens
uuugaaaccucgucauuaa

SEQ ID NO: 879151 - RNA, 19 nt, Homo sapiens
guacaccauugacuucauu

SEQ ID NO: 879152 - RNA, 19 nt, Homo sapiens
ccucuuaagugcagacaaa

SEQ ID NO: 879153 - RNA, 19 nt, Homo sapiens
aaccaaaguucucaccuaa

SEQ ID NO: 879154 - RNA, 19 nt, Homo sapiens
gcucgauccucagacuuua

SEQ ID NO: 879155 - RNA, 19 nt, Homo sapiens
gguccgagcgugccuagua

SEQ ID NO: 879156 - RNA, 19 nt, Homo sapiens
gacauggcuugauaacauu

SEQ ID NO: 879157 - RNA, 19 nt, Homo sapiens
cuacaaagauggacuucuc

SEQ ID NO: 879158 - RNA, 19 nt, Homo sapiens
gagacuacauccucuuaag

SEQ ID NO: 879159 - RNA, 19 nt, Homo sapiens
uuugagacauggcuugaua

SEQ ID NO: 879160 - RNA, 19 nt, Homo sapiens
ugaaaccucgucauuaauu

SEQ ID NO: 879161 - RNA, 19 nt, Homo sapiens
cuaauugguugccuaugaa

SEQ ID NO: 879162 - RNA, 19 nt, Homo sapiens
aaagauggacuucucugua

SEQ ID NO: 879163 - RNA, 19 nt, Homo sapiens
caacgcagcaugcuaaugg

SEQ ID NO: 879164 - RNA, 19 nt, Homo sapiens
ggaaugggucaccaaggua

SEQ ID NO: 879165 - RNA, 19 nt, Homo sapiens
caugcugccucgucucuaa

SEQ ID NO: 879166 - RNA, 19 nt, Homo sapiens
cagcaugccugaccacagu

SEQ ID NO: 879167 - RNA, 19 nt, Homo sapiens
guaugcacuuuacuacaaa

SEQ ID NO: 879168 - RNA, 19 nt, Homo sapiens
ggggagggcuuguuuuauu

SEQ ID NO: 879169 - RNA, 19 nt, Homo sapiens
ggugauaagugccuguaca

SEQ ID NO: 879170 - RNA, 19 nt, Homo sapiens
gcucaggcaucucuccaau

SEQ ID NO: 879171 - RNA, 19 nt, Homo sapiens
guacaggaaaucaaagaga

SEQ ID NO: 879172 - RNA, 19 nt, Homo sapiens
acagagagccugauuaguc

SEQ ID NO: 879173 - RNA, 19 nt, Homo sapiens
uugcuuggcuuuggagaua

SEQ ID NO: 879174 - RNA, 19 nt, Homo sapiens
cuacaaugaugaacuggau

SEQ ID NO: 879175 - RNA, 19 nt, Homo sapiens
accauugacuucauuugua

SEQ ID NO: 879176 - RNA, 19 nt, Homo sapiens
gaacauccuggcugaaugg

SEQ ID NO: 879177 - RNA, 19 nt, Homo sapiens
auuaagauuuggccaauug

SEQ ID NO: 879178 - RNA, 19 nt, Homo sapiens
cugcaaagcugugggaugu

SEQ ID NO: 879179 - RNA, 19 nt, Homo sapiens
gcagugcacaaucauuuau

SEQ ID NO: 879180 - RNA, 19 nt, Homo sapiens
guucagcacuuggucucua

SEQ ID NO: 879181 - RNA, 19 nt, Homo sapiens
uaagugcagacaaauauga

SEQ ID NO: 879182 - RNA, 19 nt, Homo sapiens
gcuggcagauagaugauuc

SEQ ID NO: 879183 - RNA, 19 nt, Homo sapiens
auacaacgcagcaugcuaa

SEQ ID NO: 879184 - RNA, 19 nt, Homo sapiens
gauuaagauuuggccaauu

SEQ ID NO: 879185 - RNA, 19 nt, Homo sapiens
ggaaggagcacggcugaca

SEQ ID NO: 879186 - RNA, 19 nt, Homo sapiens
cgaacauccuggcugaaug

SEQ ID NO: 879187 - RNA, 19 nt, Homo sapiens
cagaguacaggaaaucaaa

SEQ ID NO: 879188 - RNA, 19 nt, Homo sapiens
ggacuuugccaguuaugau

SEQ ID NO: 879189 - RNA, 19 nt, Homo sapiens
agugggacuuugccaguua

SEQ ID NO: 879190 - RNA, 19 nt, Homo sapiens
ggagacuacauccucuuaa

SEQ ID NO: 879191 - RNA, 19 nt, Homo sapiens
gaccaugaagccuuugaaa

SEQ ID NO: 879192 - RNA, 19 nt, Homo sapiens
caccaccgcugacugacuu

SEQ ID NO: 879193 - RNA, 19 nt, Homo sapiens
gacacgggcuuggucuuug

SEQ ID NO: 879194 - RNA, 19 nt, Homo sapiens
gacaaccgcuaccuguaca

SEQ ID NO: 879195 - RNA, 19 nt, Homo sapiens
gcugggacaugccugaaca

SEQ ID NO: 879196 - RNA, 19 nt, Homo sapiens
gugacaggcuccuuugaca

SEQ ID NO: 879197 - RNA, 19 nt, Homo sapiens
ccuaugaaaucacauuguc

SEQ ID NO: 879198 - RNA, 19 nt, Homo sapiens
caagcgggacuuccucaaa

SEQ ID NO: 879199 - RNA, 19 nt, Homo sapiens
gcaacuggaggaccaugaa

SEQ ID NO: 879200 - RNA, 19 nt, Homo sapiens
gauagaugauucuguucag

SEQ ID NO: 879201 - RNA, 19 nt, Homo sapiens
uuucuugaguggaguauug

SEQ ID NO: 879202 - RNA, 19 nt, Homo sapiens
ggguucaucuuucuugagu

SEQ ID NO: 879203 - RNA, 19 nt, Homo sapiens
ugacuucauuuguacuuag

SEQ ID NO: 879204 - RNA, 19 nt, Homo sapiens
gacuuugccaguuaugaua

SEQ ID NO: 879205 - RNA, 19 nt, Homo sapiens
cggaaugggucaccaaggu

SEQ ID NO: 879206 - RNA, 19 nt, Homo sapiens
ucucuaaacaguggaauaa

SEQ ID NO: 879207 - RNA, 19 nt, Homo sapiens
uggaagaagguuuauuuga

SEQ ID NO: 879208 - RNA, 19 nt, Homo sapiens
gauggcaaauacauugucu

SEQ ID NO: 879209 - RNA, 19 nt, Homo sapiens
aagauggacuucucuguac

SEQ ID NO: 879210 - RNA, 19 nt, Homo sapiens
gacuacauccucuuaagug

SEQ ID NO: 879211 - RNA, 19 nt, Homo sapiens
augaugaacuggauaucuu

SEQ ID NO: 879212 - RNA, 19 nt, Homo sapiens
acuggaagaagguuuauuu

SEQ ID NO: 879213 - RNA, 19 nt, Homo sapiens
ccauugacuucauuuguac

SEQ ID NO: 879214 - RNA, 19 nt, Homo sapiens
gaguacaggaaaucaaaga

SEQ ID NO: 879215 - RNA, 19 nt, Homo sapiens
ucuaaacaguggaauaagg

SEQ ID NO: 879216 - RNA, 19 nt, Homo sapiens
gaagugcaaagucaagucu

SEQ ID NO: 879217 - RNA, 19 nt, Homo sapiens
gaugaacagaagcuuguga

SEQ ID NO: 879218 - RNA, 19 nt, Homo sapiens
gcauccagacccacacuug

SEQ ID NO: 879219 - RNA, 19 nt, Homo sapiens
acaguggaauaaggugaua

SEQ ID NO: 879220 - RNA, 19 nt, Homo sapiens
guuauguuggucaguguua

SEQ ID NO: 879221 - RNA, 19 nt, Homo sapiens
ugacacgggcuuggucuuu

SEQ ID NO: 879222 - RNA, 19 nt, Homo sapiens
cuuaagugcagacaaauau

SEQ ID NO: 879223 - RNA, 19 nt, Homo sapiens
ccucagacuuuacucacau

SEQ ID NO: 879224 - RNA, 19 nt, Homo sapiens
caaagauggacuucucugu

SEQ ID NO: 879225 - RNA, 19 nt, Homo sapiens
guucucaccuaaugguauc

SEQ ID NO: 879226 - RNA, 19 nt, Homo sapiens
gcgaacauccuggcugaau

SEQ ID NO: 879227 - RNA, 19 nt, Homo sapiens
gauauucucagggucauca

SEQ ID NO: 879228 - RNA, 19 nt, Homo sapiens
gggagagaaaucaacugua

SEQ ID NO: 879229 - RNA, 19 nt, Homo sapiens
gcaucucuccaauaaccua

SEQ ID NO: 879230 - RNA, 19 nt, Homo sapiens
gcagaagugcaaagucaag

SEQ ID NO: 879231 - RNA, 19 nt, Homo sapiens
cuacaucccucuucucuua

SEQ ID NO: 879232 - RNA, 19 nt, Homo sapiens
gaacagagagucaagcaaa

SEQ ID NO: 879233 - RNA, 19 nt, Homo sapiens
ugaggaagcuggagaauuc

SEQ ID NO: 879234 - RNA, 19 nt, Homo sapiens
uuacauaccuuuaguggaa

SEQ ID NO: 879235 - RNA, 19 nt, Homo sapiens
cguaaugccucuaauguaa

SEQ ID NO: 879236 - RNA, 19 nt, Homo sapiens
gaagcaagauggaacuguu

SEQ ID NO: 879237 - RNA, 19 nt, Homo sapiens
gacaaaggcauuuccaaua

SEQ ID NO: 879238 - RNA, 19 nt, Homo sapiens
ggagucagcuguacuagca

SEQ ID NO: 879239 - RNA, 19 nt, Homo sapiens
uuacuugguucccauaaua

SEQ ID NO: 879240 - RNA, 19 nt, Homo sapiens
ggaguuugccaaugaauuu

SEQ ID NO: 879241 - RNA, 19 nt, Homo sapiens
gaauauaguguccuuauca

SEQ ID NO: 879242 - RNA, 19 nt, Homo sapiens
ggaggaugauuugggaaua

SEQ ID NO: 879243 - RNA, 19 nt, Homo sapiens
gaagaaugguucguuaagu

SEQ ID NO: 879244 - RNA, 19 nt, Homo sapiens
ggacacagaggccuucauu

SEQ ID NO: 879245 - RNA, 19 nt, Homo sapiens
ggaugacaguguucccaua

SEQ ID NO: 879246 - RNA, 19 nt, Homo sapiens
ccaaggagguggacagcaa

SEQ ID NO: 879247 - RNA, 19 nt, Homo sapiens
aauaugaacuggucuacaa

SEQ ID NO: 879248 - RNA, 19 nt, Homo sapiens
acagaggccuucauuaguu

SEQ ID NO: 879249 - RNA, 19 nt, Homo sapiens
gaacaucugaaccaaagaa

SEQ ID NO: 879250 - RNA, 19 nt, Homo sapiens
aaggauagaugaugaaauc

SEQ ID NO: 879251 - RNA, 19 nt, Homo sapiens
acaaaggcauuuccaauag

SEQ ID NO: 879252 - RNA, 19 nt, Homo sapiens
cuuuaggacuucugaaaua

SEQ ID NO: 879253 - RNA, 19 nt, Homo sapiens
gauaauuccugagaacuuc

SEQ ID NO: 879254 - RNA, 19 nt, Homo sapiens
ggauguacguuguuaccaa

SEQ ID NO: 879255 - RNA, 19 nt, Homo sapiens
aagaggaguuugccaauga

SEQ ID NO: 879256 - RNA, 19 nt, Homo sapiens
gaaugguucguuaaguuua

SEQ ID NO: 879257 - RNA, 19 nt, Homo sapiens
caucugaaccaaagaaauu

SEQ ID NO: 879258 - RNA, 19 nt, Homo sapiens
acagauggauguuaucaga

SEQ ID NO: 879259 - RNA, 19 nt, Homo sapiens
uggaaggacugguguuauu

SEQ ID NO: 879260 - RNA, 19 nt, Homo sapiens
ccaagaggaugacaguguu

SEQ ID NO: 879261 - RNA, 19 nt, Homo sapiens
gcuaaaagaugggauaauu

SEQ ID NO: 879262 - RNA, 19 nt, Homo sapiens
ggaauauaguguccuuauc

SEQ ID NO: 879263 - RNA, 19 nt, Homo sapiens
aagaaugguucguuaaguu

SEQ ID NO: 879264 - RNA, 19 nt, Homo sapiens
caccaaauguucccaaauc

SEQ ID NO: 879265 - RNA, 19 nt, Homo sapiens
cuacaucaaugccaacuuc

SEQ ID NO: 879266 - RNA, 19 nt, Homo sapiens
acaccugaaucauuuauug

SEQ ID NO: 879267 - RNA, 19 nt, Homo sapiens
ccucuucucuuauuacaau

SEQ ID NO: 879268 - RNA, 19 nt, Homo sapiens
agagacagauggauguuau

SEQ ID NO: 879269 - RNA, 19 nt, Homo sapiens
cuacaacccuccuggacuu

SEQ ID NO: 879270 - RNA, 19 nt, Homo sapiens
cuacaacuguggcugagaa

SEQ ID NO: 879271 - RNA, 19 nt, Homo sapiens
gaaggacugguguuauuug

SEQ ID NO: 879272 - RNA, 19 nt, Homo sapiens
ggaaggacugguguuauuu

SEQ ID NO: 879273 - RNA, 19 nt, Homo sapiens
uggcaugcauggaguauga

SEQ ID NO: 879274 - RNA, 19 nt, Homo sapiens
gaggaugauuugggaauau

SEQ ID NO: 879275 - RNA, 19 nt, Homo sapiens
gagaaugccaagaauauca

SEQ ID NO: 879276 - RNA, 19 nt, Homo sapiens
acggacaccugaaucauuu

SEQ ID NO: 879277 - RNA, 19 nt, Homo sapiens
gaaccaggagucagcugua

SEQ ID NO: 879278 - RNA, 19 nt, Homo sapiens
caaccaauauuuccucacu

SEQ ID NO: 879279 - RNA, 19 nt, Homo sapiens
gggauguucuaauucuaaa

SEQ ID NO: 879280 - RNA, 19 nt, Homo sapiens
gguguuauuugugcuauug

SEQ ID NO: 879281 - RNA, 19 nt, Homo sapiens
gagggauguucuaauucua

SEQ ID NO: 879282 - RNA, 19 nt, Homo sapiens
uuugagggauguucuaauu

SEQ ID NO: 879283 - RNA, 19 nt, Homo sapiens
caaaggcauuuccaauagu

SEQ ID NO: 879284 - RNA, 19 nt, Homo sapiens
gcccaaagcaagaaaauua

SEQ ID NO: 879285 - RNA, 19 nt, Homo sapiens
ugaauucuccaaccaauau

SEQ ID NO: 879286 - RNA, 19 nt, Homo sapiens
aaaggcauuuccaauaguu

SEQ ID NO: 879287 - RNA, 19 nt, Homo sapiens
auuauucacugccauauga

SEQ ID NO: 879288 - RNA, 19 nt, Homo sapiens
ggagcuaaauuacaguuuu

SEQ ID NO: 879289 - RNA, 19 nt, Homo sapiens
cuaaaucaagcacuucuuu

SEQ ID NO: 879290 - RNA, 19 nt, Homo sapiens
gcccuaagauuggaagaau

SEQ ID NO: 879291 - RNA, 19 nt, Homo sapiens
cuagugcucuugguguaua

SEQ ID NO: 879292 - RNA, 19 nt, Homo sapiens
acacagaggccuucauuag

SEQ ID NO: 879293 - RNA, 19 nt, Homo sapiens
gagagaugcagcuggaauu

SEQ ID NO: 879294 - RNA, 19 nt, Homo sapiens
uauaguguccuuaucauug

SEQ ID NO: 879295 - RNA, 19 nt, Homo sapiens
ggacccaaggcuuauauug

SEQ ID NO: 879296 - RNA, 19 nt, Homo sapiens
gcugagaaugccaagaaua

SEQ ID NO: 879297 - RNA, 19 nt, Homo sapiens
ggaagaaugguucguuaag

SEQ ID NO: 879298 - RNA, 19 nt, Homo sapiens
ggcuuuagaugacauuuag

SEQ ID NO: 879299 - RNA, 19 nt, Homo sapiens
ccucagcugugaagguaaa

SEQ ID NO: 879300 - RNA, 19 nt, Homo sapiens
ccaauaacacggaccaaau

SEQ ID NO: 879301 - RNA, 19 nt, Homo sapiens
ggauaauuccugagaacuu

SEQ ID NO: 879302 - RNA, 19 nt, Homo sapiens
gggaauauaguguccuuau

SEQ ID NO: 879303 - RNA, 19 nt, Homo sapiens
gauuccagcuacaucaaug

SEQ ID NO: 879304 - RNA, 19 nt, Homo sapiens
aaaccuauccuacaacugu

SEQ ID NO: 879305 - RNA, 19 nt, Homo sapiens
gacaaaaccuauccuacaa

SEQ ID NO: 879306 - RNA, 19 nt, Homo sapiens
gcauuguauuccugagaaa

SEQ ID NO: 879307 - RNA, 19 nt, Homo sapiens
cagcauggaccaaagagaa

SEQ ID NO: 879308 - RNA, 19 nt, Homo sapiens
gaacuucaguguuuucagu

SEQ ID NO: 879309 - RNA, 19 nt, Homo sapiens
uuggaagaaugguucguua

SEQ ID NO: 879310 - RNA, 19 nt, Homo sapiens
ugagggauguucuaauucu

SEQ ID NO: 879311 - RNA, 19 nt, Homo sapiens
agauaaacauucuggaaca

SEQ ID NO: 879312 - RNA, 19 nt, Homo sapiens
ccaaugaauuucugaagcu

SEQ ID NO: 879313 - RNA, 19 nt, Homo sapiens
uggaacaucugaaccaaag

SEQ ID NO: 879314 - RNA, 19 nt, Homo sapiens
caaauguucccaaauccuu

SEQ ID NO: 879315 - RNA, 19 nt, Homo sapiens
gguaccaguucuaagaugu

SEQ ID NO: 879316 - RNA, 19 nt, Homo sapiens
cuaaacaccaaauacguaa

SEQ ID NO: 879317 - RNA, 19 nt, Homo sapiens
ggaccaaaucaacuccuuu

SEQ ID NO: 879318 - RNA, 19 nt, Homo sapiens
cuaucuaccaguuucauua

SEQ ID NO: 879319 - RNA, 19 nt, Homo sapiens
agaccaagcaagaguguaa

SEQ ID NO: 879320 - RNA, 19 nt, Homo sapiens
agauggauguuaucagaga

SEQ ID NO: 879321 - RNA, 19 nt, Homo sapiens
aaacgcaggaacaauauga

SEQ ID NO: 879322 - RNA, 19 nt, Homo sapiens
agaauuggccagaccauga

SEQ ID NO: 879323 - RNA, 19 nt, Homo sapiens
caucccucuucucuuauua

SEQ ID NO: 879324 - RNA, 19 nt, Homo sapiens
ggccaugacacacauuuga

SEQ ID NO: 879325 - RNA, 19 nt, Homo sapiens
guaaugccucuaauguaaa

SEQ ID NO: 879326 - RNA, 19 nt, Homo sapiens
ucuaaacaccaaauacgua

SEQ ID NO: 879327 - RNA, 19 nt, Homo sapiens
ucaaccuacuuauagacua

SEQ ID NO: 879328 - RNA, 19 nt, Homo sapiens
gcaggaacaauaugaacug

SEQ ID NO: 879329 - RNA, 19 nt, Homo sapiens
gaugaggcccaaagcaaga

SEQ ID NO: 879330 - RNA, 19 nt, Homo sapiens
ccaguuucauuacaagaau

SEQ ID NO: 879331 - RNA, 19 nt, Homo sapiens
cuacaucccucuucucuua

SEQ ID NO: 879332 - RNA, 19 nt, Homo sapiens
gaacagagagucaagcaaa

SEQ ID NO: 879333 - RNA, 19 nt, Homo sapiens
aaacugcucuugacaauga

SEQ ID NO: 879334 - RNA, 19 nt, Homo sapiens
ugaggaagcuggagaauuc

SEQ ID NO: 879335 - RNA, 19 nt, Homo sapiens
uuacauaccuuuaguggaa

SEQ ID NO: 879336 - RNA, 19 nt, Homo sapiens
cguaaugccucuaauguaa

SEQ ID NO: 879337 - RNA, 19 nt, Homo sapiens
gaagcaagauggaacuguu

SEQ ID NO: 879338 - RNA, 19 nt, Homo sapiens
gaguauaccuuguaaaucu

SEQ ID NO: 879339 - RNA, 19 nt, Homo sapiens
caaguacaccugcaaauaa

SEQ ID NO: 879340 - RNA, 19 nt, Homo sapiens
gcaaguacaccugcaaaua

SEQ ID NO: 879341 - RNA, 19 nt, Homo sapiens
gacaaaggcauuuccaaua

SEQ ID NO: 879342 - RNA, 19 nt, Homo sapiens
guggaaaacuggaauauua

SEQ ID NO: 879343 - RNA, 19 nt, Homo sapiens
gaagauaugcuaauguguu

SEQ ID NO: 879344 - RNA, 19 nt, Homo sapiens
ggagucagcuguacuagca

SEQ ID NO: 879345 - RNA, 19 nt, Homo sapiens
uaagugcucuauaugcaua

SEQ ID NO: 879346 - RNA, 19 nt, Homo sapiens
aaacaagccugcagaaucu

SEQ ID NO: 879347 - RNA, 19 nt, Homo sapiens
ggaguuugccaaugaauuu

SEQ ID NO: 879348 - RNA, 19 nt, Homo sapiens
gaauauaguguccuuauca

SEQ ID NO: 879349 - RNA, 19 nt, Homo sapiens
ggaggaugauuugggaaua

SEQ ID NO: 879350 - RNA, 19 nt, Homo sapiens
ggacacagaggccuucauu

SEQ ID NO: 879351 - RNA, 19 nt, Homo sapiens
ggaugacaguguucccaua

SEQ ID NO: 879352 - RNA, 19 nt, Homo sapiens
ccaaggagguggacagcaa

SEQ ID NO: 879353 - RNA, 19 nt, Homo sapiens
aauaugaacuggucuacaa

SEQ ID NO: 879354 - RNA, 19 nt, Homo sapiens
acagaggccuucauuaguu

SEQ ID NO: 879355 - RNA, 19 nt, Homo sapiens
aaucagaacuacaucaaga

SEQ ID NO: 879356 - RNA, 19 nt, Homo sapiens
gaacaucugaaccaaagaa

SEQ ID NO: 879357 - RNA, 19 nt, Homo sapiens
gaucucaacuaauuucuac

SEQ ID NO: 879358 - RNA, 19 nt, Homo sapiens
gcugagaagcccaagaaua

SEQ ID NO: 879359 - RNA, 19 nt, Homo sapiens
ucaaauaacuccagcucau

SEQ ID NO: 879360 - RNA, 19 nt, Homo sapiens
aaggauagaugaugaaauc

SEQ ID NO: 879361 - RNA, 19 nt, Homo sapiens
acaaaggcauuuccaauag

SEQ ID NO: 879362 - RNA, 19 nt, Homo sapiens
cuuuaggacuucugaaaua

SEQ ID NO: 879363 - RNA, 19 nt, Homo sapiens
gauaauuccugagaacuuc

SEQ ID NO: 879364 - RNA, 19 nt, Homo sapiens
ggauguacguuguuaccaa

SEQ ID NO: 879365 - RNA, 19 nt, Homo sapiens
aagaggaguuugccaauga

SEQ ID NO: 879366 - RNA, 19 nt, Homo sapiens
gagaaacacuuuuagaaug

SEQ ID NO: 879367 - RNA, 19 nt, Homo sapiens
caucugaaccaaagaaauu

SEQ ID NO: 879368 - RNA, 19 nt, Homo sapiens
gauuugggcucuccuuugu

SEQ ID NO: 879369 - RNA, 19 nt, Homo sapiens
acagauggauguuaucaga

SEQ ID NO: 879370 - RNA, 19 nt, Homo sapiens
caaacaagccugcagaauc

SEQ ID NO: 879371 - RNA, 19 nt, Homo sapiens
ucacaaggaguaagaguuu

SEQ ID NO: 879372 - RNA, 19 nt, Homo sapiens
uggaaggacugguguuauu

SEQ ID NO: 879373 - RNA, 19 nt, Homo sapiens
ccaagaggaugacaguguu

SEQ ID NO: 879374 - RNA, 19 nt, Homo sapiens
caacuaauuucuacauugc

SEQ ID NO: 879375 - RNA, 19 nt, Homo sapiens
gcuaaaagaugggauaauu

SEQ ID NO: 879376 - RNA, 19 nt, Homo sapiens
ggaauauaguguccuuauc

SEQ ID NO: 879377 - RNA, 19 nt, Homo sapiens
caccaaauguucccaaauc

SEQ ID NO: 879378 - RNA, 19 nt, Homo sapiens
cuacaucaaugccaacuuc

SEQ ID NO: 879379 - RNA, 19 nt, Homo sapiens
acaccugaaucauuuauug

SEQ ID NO: 879380 - RNA, 19 nt, Homo sapiens
gagcuuauguacagaaugc

SEQ ID NO: 879381 - RNA, 19 nt, Homo sapiens
ccagcucauuucugaauuu

SEQ ID NO: 879382 - RNA, 19 nt, Homo sapiens
cuagaguccuucuuucuug

SEQ ID NO: 879383 - RNA, 19 nt, Homo sapiens
ccucuucucuuauuacaau

SEQ ID NO: 879384 - RNA, 19 nt, Homo sapiens
agagacagauggauguuau

SEQ ID NO: 879385 - RNA, 19 nt, Homo sapiens
cuacaacccuccuggacuu

SEQ ID NO: 879386 - RNA, 19 nt, Homo sapiens
gcccaagaauaucaagaaa

SEQ ID NO: 879387 - RNA, 19 nt, Homo sapiens
cuacaacuguggcugagaa

SEQ ID NO: 879388 - RNA, 19 nt, Homo sapiens
gaaggacugguguuauuug

SEQ ID NO: 879389 - RNA, 19 nt, Homo sapiens
ggaaggacugguguuauuu

SEQ ID NO: 879390 - RNA, 19 nt, Homo sapiens
uggcaugcauggaguauga

SEQ ID NO: 879391 - RNA, 19 nt, Homo sapiens
gaggaugauuugggaauau

SEQ ID NO: 879392 - RNA, 19 nt, Homo sapiens
cccaaucuauagaaacaua

SEQ ID NO: 879393 - RNA, 19 nt, Homo sapiens
gaaccaggagucagcugua

SEQ ID NO: 879394 - RNA, 19 nt, Homo sapiens
acaaacugcucuugacaau

SEQ ID NO: 879395 - RNA, 19 nt, Homo sapiens
acagaaugcuauaugagaa

SEQ ID NO: 879396 - RNA, 19 nt, Homo sapiens
caaccaauauuuccucacu

SEQ ID NO: 879397 - RNA, 19 nt, Homo sapiens
gggauguucuaauucuaaa

SEQ ID NO: 879398 - RNA, 19 nt, Homo sapiens
gguguuauuugugcuauug

SEQ ID NO: 879399 - RNA, 19 nt, Homo sapiens
gagggauguucuaauucua

SEQ ID NO: 879400 - RNA, 19 nt, Homo sapiens
uuugagggauguucuaauu

SEQ ID NO: 879401 - RNA, 19 nt, Homo sapiens
caaaggcauuuccaauagu

SEQ ID NO: 879402 - RNA, 19 nt, Homo sapiens
gagaagcccaagaauauca

SEQ ID NO: 879403 - RNA, 19 nt, Homo sapiens
cugagaagcccaagaauau

SEQ ID NO: 879404 - RNA, 19 nt, Homo sapiens
aaguacaccugcaaauaaa

SEQ ID NO: 879405 - RNA, 19 nt, Homo sapiens
aaacagacacugaagacuu

SEQ ID NO: 879406 - RNA, 19 nt, Homo sapiens
gcccaaagcaagaaaauua

SEQ ID NO: 879407 - RNA, 19 nt, Homo sapiens
ugaauucuccaaccaauau

SEQ ID NO: 879408 - RNA, 19 nt, Homo sapiens
aaaggcauuuccaauaguu

SEQ ID NO: 879409 - RNA, 19 nt, Homo sapiens
guaaaucuucccaaauguu

SEQ ID NO: 879410 - RNA, 19 nt, Homo sapiens
gacuauucccugacaguua

SEQ ID NO: 879411 - RNA, 19 nt, Homo sapiens
auuauucacugccauauga

SEQ ID NO: 879412 - RNA, 19 nt, Homo sapiens
ggagcuaaauuacaguuuu

SEQ ID NO: 879413 - RNA, 19 nt, Homo sapiens
cuaaaucaagcacuucuuu

SEQ ID NO: 879414 - RNA, 19 nt, Homo sapiens
ggaauccaccaccaacuug

SEQ ID NO: 879415 - RNA, 19 nt, Homo sapiens
cuagugcucuugguguaua

SEQ ID NO: 879416 - RNA, 19 nt, Homo sapiens
acacagaggccuucauuag

SEQ ID NO: 879417 - RNA, 19 nt, Homo sapiens
uauaguguccuuaucauug

SEQ ID NO: 879418 - RNA, 19 nt, Homo sapiens
ggacccaaggcuuauauug

SEQ ID NO: 879419 - RNA, 19 nt, Homo sapiens
uuguaaaucuucccaaaug

SEQ ID NO: 879420 - RNA, 19 nt, Homo sapiens
uaaauggaguauaccuugu

SEQ ID NO: 879421 - RNA, 19 nt, Homo sapiens
ccucagcugugaagguaaa

SEQ ID NO: 879422 - RNA, 19 nt, Homo sapiens
ccaauaacacggaccaaau

SEQ ID NO: 879423 - RNA, 19 nt, Homo sapiens
ggauaauuccugagaacuu

SEQ ID NO: 879424 - RNA, 19 nt, Homo sapiens
gggaauauaguguccuuau

SEQ ID NO: 879425 - RNA, 19 nt, Homo sapiens
gacaaaaccuauccuacaa

SEQ ID NO: 879426 - RNA, 19 nt, Homo sapiens
gauuccagcuacaucaaug

SEQ ID NO: 879427 - RNA, 19 nt, Homo sapiens
aaaccuauccuacaacugu

SEQ ID NO: 879428 - RNA, 19 nt, Homo sapiens
gaaucuguucagucaaaua

SEQ ID NO: 879429 - RNA, 19 nt, Homo sapiens
ggcccaaucuauagaaaca

SEQ ID NO: 879430 - RNA, 19 nt, Homo sapiens
gcauuguauuccugagaaa

SEQ ID NO: 879431 - RNA, 19 nt, Homo sapiens
acaaccagcuucagaauua

SEQ ID NO: 879432 - RNA, 19 nt, Homo sapiens
gaacaggguugggaccuuu

SEQ ID NO: 879433 - RNA, 19 nt, Homo sapiens
gcucagaaccugucacuaa

SEQ ID NO: 879434 - RNA, 19 nt, Homo sapiens
gagcuaagcccaaguguga

SEQ ID NO: 879435 - RNA, 19 nt, Homo sapiens
ccaaggagcugaagcacaa

SEQ ID NO: 879436 - RNA, 19 nt, Homo sapiens
gaagggccauguuugaguu

SEQ ID NO: 879437 - RNA, 19 nt, Homo sapiens
cauuggagaugacacauuu

SEQ ID NO: 879438 - RNA, 19 nt, Homo sapiens
gauuagagaugccuuugug

SEQ ID NO: 879439 - RNA, 19 nt, Homo sapiens
ggaagagucagauuuauag

SEQ ID NO: 879440 - RNA, 19 nt, Homo sapiens
gcucaaggaagccguguua

SEQ ID NO: 879441 - RNA, 19 nt, Homo sapiens
aaacagaaccagucacuau

SEQ ID NO: 879442 - RNA, 19 nt, Homo sapiens
gggaguggcucugugcuuu

SEQ ID NO: 879443 - RNA, 19 nt, Homo sapiens
gacaaggucugcuccaaca

SEQ ID NO: 879444 - RNA, 19 nt, Homo sapiens
gagaagauaggauuggauu

SEQ ID NO: 879445 - RNA, 19 nt, Homo sapiens
cuaggaagagucagauuua

SEQ ID NO: 879446 - RNA, 19 nt, Homo sapiens
ugaaaccucuggauccuau

SEQ ID NO: 879447 - RNA, 19 nt, Homo sapiens
uuccaucuguugcuuauua

SEQ ID NO: 879448 - RNA, 19 nt, Homo sapiens
gcaucaaugugaaaugugu

SEQ ID NO: 879449 - RNA, 19 nt, Homo sapiens
gaaccuggaagcugagauu

SEQ ID NO: 879450 - RNA, 19 nt, Homo sapiens
ccagggaaguugcuuggaa

SEQ ID NO: 879451 - RNA, 19 nt, Homo sapiens
guaaucagcccaaaggaau

SEQ ID NO: 879452 - RNA, 19 nt, Homo sapiens
gagaagcccucauccucau

SEQ ID NO: 879453 - RNA, 19 nt, Homo sapiens
gagaggaaguuaauuucag

SEQ ID NO: 879454 - RNA, 19 nt, Homo sapiens
ucaacaacaucgugcagaa

SEQ ID NO: 879455 - RNA, 19 nt, Homo sapiens
ggcugugucuuguuuguuu

SEQ ID NO: 879456 - RNA, 19 nt, Homo sapiens
caaccagcuucagaauuaa

SEQ ID NO: 879457 - RNA, 19 nt, Homo sapiens
caaggaagccguguuagug

SEQ ID NO: 879458 - RNA, 19 nt, Homo sapiens
aagauaacauggagacaga

SEQ ID NO: 879459 - RNA, 19 nt, Homo sapiens
gaagauaggauuggauugg

SEQ ID NO: 879460 - RNA, 19 nt, Homo sapiens
cuacugaggcugugucuug

SEQ ID NO: 879461 - RNA, 19 nt, Homo sapiens
ggucgaggauucccaugug

SEQ ID NO: 879462 - RNA, 19 nt, Homo sapiens
gggcagaggcauaaacaga

SEQ ID NO: 879463 - RNA, 19 nt, Homo sapiens
ggagaggaaguuaauuuca

SEQ ID NO: 879464 - RNA, 19 nt, Homo sapiens
aaacaaaucacgagaagag

SEQ ID NO: 879465 - RNA, 19 nt, Homo sapiens
gaugacacauuuaccuucu

SEQ ID NO: 879466 - RNA, 19 nt, Homo sapiens
ggaaguccacccugaagga

SEQ ID NO: 879467 - RNA, 19 nt, Homo sapiens
ccugguacuuugauuuaaa

SEQ ID NO: 879468 - RNA, 19 nt, Homo sapiens
uggaguagcccuucuguug

SEQ ID NO: 879469 - RNA, 19 nt, Homo sapiens
agaggaaguuaauuucaga

SEQ ID NO: 879470 - RNA, 19 nt, Homo sapiens
aaacucauuuccacucuag

SEQ ID NO: 879471 - RNA, 19 nt, Homo sapiens
gauaacauggagacagaaa

SEQ ID NO: 879472 - RNA, 19 nt, Homo sapiens
uaaacucauuuccacucua

SEQ ID NO: 879473 - RNA, 19 nt, Homo sapiens
ugauguacauacuccguuu

SEQ ID NO: 879474 - RNA, 19 nt, Homo sapiens
ccugagaccuggccuugga

SEQ ID NO: 879475 - RNA, 19 nt, Homo sapiens
gcagaggcauaaacagaac

SEQ ID NO: 879476 - RNA, 19 nt, Homo sapiens
uagugaagauggcugaaga

SEQ ID NO: 879477 - RNA, 19 nt, Homo sapiens
guaucugccugguacuuug

SEQ ID NO: 879478 - RNA, 19 nt, Homo sapiens
gcauagggagaggaaguua

SEQ ID NO: 879479 - RNA, 19 nt, Homo sapiens
cagaaccugucacuaauac

SEQ ID NO: 879480 - RNA, 19 nt, Homo sapiens
cuauggaggucgaggauuc

SEQ ID NO: 879481 - RNA, 19 nt, Homo sapiens
gcuucgagaugcuguacuu

SEQ ID NO: 879482 - RNA, 19 nt, Homo sapiens
cuuuggagcugauuagaga

SEQ ID NO: 879483 - RNA, 19 nt, Homo sapiens
ucagaaccugucacuaaua

SEQ ID NO: 879484 - RNA, 19 nt, Homo sapiens
gccuaggcuucccgaguua

SEQ ID NO: 879485 - RNA, 19 nt, Homo sapiens
cagcagagccaaccucauc

SEQ ID NO: 879486 - RNA, 19 nt, Homo sapiens
ggaagggccauguuugagu

SEQ ID NO: 879487 - RNA, 19 nt, Homo sapiens
gauaggauuggauuggauu

SEQ ID NO: 879488 - RNA, 19 nt, Homo sapiens
ggacgcuccugcugauucu

SEQ ID NO: 879489 - RNA, 19 nt, Homo sapiens
gaacaugcacccggagcuu

SEQ ID NO: 879490 - RNA, 19 nt, Homo sapiens
gcuaagcccaagugugaaa

SEQ ID NO: 879491 - RNA, 19 nt, Homo sapiens
gagaugacacauuuaccuu

SEQ ID NO: 879492 - RNA, 19 nt, Homo sapiens
guacgacgagcauguaauc

SEQ ID NO: 879493 - RNA, 19 nt, Homo sapiens
cugaggcugugucuuguuu

SEQ ID NO: 879494 - RNA, 19 nt, Homo sapiens
caaaucacgagaagagaga

SEQ ID NO: 879495 - RNA, 19 nt, Homo sapiens
gagcacacggccaccauug

SEQ ID NO: 879496 - RNA, 19 nt, Homo sapiens
gaggcugugucuuguuugu

SEQ ID NO: 879497 - RNA, 19 nt, Homo sapiens
aggaagagucagauuuaua

SEQ ID NO: 879498 - RNA, 19 nt, Homo sapiens
cagaaccagucacuaugga

SEQ ID NO: 879499 - RNA, 19 nt, Homo sapiens
caaaacaaaucacgagaag

SEQ ID NO: 879500 - RNA, 19 nt, Homo sapiens
guagcacgguguucaaggu

SEQ ID NO: 879501 - RNA, 19 nt, Homo sapiens
cagggaaguugcuuggaau

SEQ ID NO: 879502 - RNA, 19 nt, Homo sapiens
cggcaucaaugugaaaugu

SEQ ID NO: 879503 - RNA, 19 nt, Homo sapiens
gaagccguguuagugaaga

SEQ ID NO: 879504 - RNA, 19 nt, Homo sapiens
ccucacccaugucaagcua

SEQ ID NO: 879505 - RNA, 19 nt, Homo sapiens
cacaaagauugaccucuca

SEQ ID NO: 879506 - RNA, 19 nt, Homo sapiens
gggagaggaaguuaauuuc

SEQ ID NO: 879507 - RNA, 19 nt, Homo sapiens
gcauaaacagaaccaguca

SEQ ID NO: 879508 - RNA, 19 nt, Homo sapiens
ggcagaggcauaaacagaa

SEQ ID NO: 879509 - RNA, 19 nt, Homo sapiens
agagucagauuuauagcau

SEQ ID NO: 879510 - RNA, 19 nt, Homo sapiens
uaggaagagucagauuuau

SEQ ID NO: 879511 - RNA, 19 nt, Homo sapiens
aaagagaggaaucgccaaa

SEQ ID NO: 879512 - RNA, 19 nt, Homo sapiens
ccuggaagcugagauugug

SEQ ID NO: 879513 - RNA, 19 nt, Homo sapiens
cgacgugagugugcacaug

SEQ ID NO: 879514 - RNA, 19 nt, Homo sapiens
guacauacuccguuuuaaa

SEQ ID NO: 879515 - RNA, 19 nt, Homo sapiens
gacccugagugccagauuc

SEQ ID NO: 879516 - RNA, 19 nt, Homo sapiens
ugccuaggcuucccgaguu

SEQ ID NO: 879517 - RNA, 19 nt, Homo sapiens
aggcauuguugcacaugua

SEQ ID NO: 879518 - RNA, 19 nt, Homo sapiens
cuauggauuugguuucuuc

SEQ ID NO: 879519 - RNA, 19 nt, Homo sapiens
acucaugacuugggagcua

SEQ ID NO: 879520 - RNA, 19 nt, Homo sapiens
gcagaaccaaagagaggaa

SEQ ID NO: 879521 - RNA, 19 nt, Homo sapiens
gcacacggccaccauugag

SEQ ID NO: 879522 - RNA, 19 nt, Homo sapiens
uggaggagguggugguugu

SEQ ID NO: 879523 - RNA, 19 nt, Homo sapiens
ccacaaccagcuucagaau

SEQ ID NO: 879524 - RNA, 19 nt, Homo sapiens
gagucagauuuauagcauu

SEQ ID NO: 879525 - RNA, 19 nt, Homo sapiens
gcagcagugugaugagcau

SEQ ID NO: 879526 - RNA, 19 nt, Homo sapiens
ccauagagaccugugaaga

SEQ ID NO: 879527 - RNA, 19 nt, Homo sapiens
ugagauccaugaggugugu

SEQ ID NO: 879528 - RNA, 19 nt, Homo sapiens
ucuaggaagagucagauuu

SEQ ID NO: 879529 - RNA, 19 nt, Homo sapiens
ugccugguacuuugauuua

SEQ ID NO: 879530 - RNA, 19 nt, Homo sapiens
uuucauggcugccuuuggu

SEQ ID NO: 879531 - RNA, 19 nt, Homo sapiens
caacaaagccucacgacua

SEQ ID NO: 879532 - RNA, 19 nt, Homo sapiens
gaaguuaauucucacugua

SEQ ID NO: 879533 - RNA, 19 nt, Homo sapiens
caaagcagcugcauuaucu

SEQ ID NO: 879534 - RNA, 19 nt, Homo sapiens
gaaagcaggcauuugauuu

SEQ ID NO: 879535 - RNA, 19 nt, Homo sapiens
ccuaugaaccugagaauua

SEQ ID NO: 879536 - RNA, 19 nt, Homo sapiens
ggaaauacacagugaaguu

SEQ ID NO: 879537 - RNA, 19 nt, Homo sapiens
ccaaagcuauguaagagaa

SEQ ID NO: 879538 - RNA, 19 nt, Homo sapiens
gaaauacacagugaaguuu

SEQ ID NO: 879539 - RNA, 19 nt, Homo sapiens
gaggaaagcaggcauuuga

SEQ ID NO: 879540 - RNA, 19 nt, Homo sapiens
ggcuacaacuuccauauaa

SEQ ID NO: 879541 - RNA, 19 nt, Homo sapiens
caaauaggcucugccauca

SEQ ID NO: 879542 - RNA, 19 nt, Homo sapiens
ucccaagacugcuaauuua

SEQ ID NO: 879543 - RNA, 19 nt, Homo sapiens
gaacaggaacccacaagga

SEQ ID NO: 879544 - RNA, 19 nt, Homo sapiens
gacaauaaauccaacucaa

SEQ ID NO: 879545 - RNA, 19 nt, Homo sapiens
cauaaaggguucucucuca

SEQ ID NO: 879546 - RNA, 19 nt, Homo sapiens
gggaggaaguuaauucuca

SEQ ID NO: 879547 - RNA, 19 nt, Homo sapiens
gaucgggucccuaacuaua

SEQ ID NO: 879548 - RNA, 19 nt, Homo sapiens
ggaaguuaauucucacugu

SEQ ID NO: 879549 - RNA, 19 nt, Homo sapiens
caacaagccaauauucaaa

SEQ ID NO: 879550 - RNA, 19 nt, Homo sapiens
gcaacaagccaauauucaa

SEQ ID NO: 879551 - RNA, 19 nt, Homo sapiens
ggaaagcaggcauuugauu

SEQ ID NO: 879552 - RNA, 19 nt, Homo sapiens
ggaaaugggaagcaagaaa

SEQ ID NO: 879553 - RNA, 19 nt, Homo sapiens
ccauacaacgaaucuauua

SEQ ID NO: 879554 - RNA, 19 nt, Homo sapiens
aagggaagcuuaugguuug

SEQ ID NO: 879555 - RNA, 19 nt, Homo sapiens
gacauuaaagggaagcuua

SEQ ID NO: 879556 - RNA, 19 nt, Homo sapiens
ggaagcuuaugguuugcua

SEQ ID NO: 879557 - RNA, 19 nt, Homo sapiens
gcagcugcauuaucuacaa

SEQ ID NO: 879558 - RNA, 19 nt, Homo sapiens
uuaaggaaauacacaguga

SEQ ID NO: 879559 - RNA, 19 nt, Homo sapiens
gucgcgaucuuuagacaua

SEQ ID NO: 879560 - RNA, 19 nt, Homo sapiens
ugccaaagcagcugcauua

SEQ ID NO: 879561 - RNA, 19 nt, Homo sapiens
uaaagcaggcccagugaaa

SEQ ID NO: 879562 - RNA, 19 nt, Homo sapiens
gggcuacaacuuccauaua

SEQ ID NO: 879563 - RNA, 19 nt, Homo sapiens
ccaacucaauaacuucaaa

SEQ ID NO: 879564 - RNA, 19 nt, Homo sapiens
guaguuaucccuaaauagu

SEQ ID NO: 879565 - RNA, 19 nt, Homo sapiens
gaacugcagcuucucaaca

SEQ ID NO: 879566 - RNA, 19 nt, Homo sapiens
acaaccaccuugggaauuu

SEQ ID NO: 879567 - RNA, 19 nt, Homo sapiens
cagaucgggucccuaacua

SEQ ID NO: 879568 - RNA, 19 nt, Homo sapiens
agcaggacauggacaaaua

SEQ ID NO: 879569 - RNA, 19 nt, Homo sapiens
aagacuaucugacuuggaa

SEQ ID NO: 879570 - RNA, 19 nt, Homo sapiens
uugaagaggcuuuacauaa

SEQ ID NO: 879571 - RNA, 19 nt, Homo sapiens
ucaguaacaucaggacauu

SEQ ID NO: 879572 - RNA, 19 nt, Homo sapiens
ggaaagguagggcagaguu

SEQ ID NO: 879573 - RNA, 19 nt, Homo sapiens
gcuuaugguuugcuaugaa

SEQ ID NO: 879574 - RNA, 19 nt, Homo sapiens
gcacuacaacugaccauag

SEQ ID NO: 879575 - RNA, 19 nt, Homo sapiens
ggacauuggacacaccauu

SEQ ID NO: 879576 - RNA, 19 nt, Homo sapiens
gccagugccuccucuacaa

SEQ ID NO: 879577 - RNA, 19 nt, Homo sapiens
gcuggagucugaagaugga

SEQ ID NO: 879578 - RNA, 19 nt, Homo sapiens
gagagggacagguauaugu

SEQ ID NO: 879579 - RNA, 19 nt, Homo sapiens
gcaaguccgcccagcugua

SEQ ID NO: 879580 - RNA, 19 nt, Homo sapiens
aaagggaagcuuaugguuu

SEQ ID NO: 879581 - RNA, 19 nt, Homo sapiens
ccugagaccuucuggauac

SEQ ID NO: 879582 - RNA, 19 nt, Homo sapiens
gcuuugagcccgucuaugu

SEQ ID NO: 879583 - RNA, 19 nt, Homo sapiens
uaucugacuuggaaagaau

SEQ ID NO: 879584 - RNA, 19 nt, Homo sapiens
ccagagagggacagguaua

SEQ ID NO: 879585 - RNA, 19 nt, Homo sapiens
cuagagaggucgggaggaa

SEQ ID NO: 879586 - RNA, 19 nt, Homo sapiens
gcucaggacacuugcacua

SEQ ID NO: 879587 - RNA, 19 nt, Homo sapiens
ggacaauaaauccaacuca

SEQ ID NO: 879588 - RNA, 19 nt, Homo sapiens
ccacacaguuagcaacaag

SEQ ID NO: 879589 - RNA, 19 nt, Homo sapiens
guaauugugccaaagcuau

SEQ ID NO: 879590 - RNA, 19 nt, Homo sapiens
gaaagguagggcagaguug

SEQ ID NO: 879591 - RNA, 19 nt, Homo sapiens
ccaaccaccuggaucaagu

SEQ ID NO: 879592 - RNA, 19 nt, Homo sapiens
caacugggaggaagagaga

SEQ ID NO: 879593 - RNA, 19 nt, Homo sapiens
ucauggagccguccucuga

SEQ ID NO: 879594 - RNA, 19 nt, Homo sapiens
gaaaugggaagcaagaaaa

SEQ ID NO: 879595 - RNA, 19 nt, Homo sapiens
acuaugacaucagaacuuu

SEQ ID NO: 879596 - RNA, 19 nt, Homo sapiens
gcucugccaucaggaaaug

SEQ ID NO: 879597 - RNA, 19 nt, Homo sapiens
ggaguuguuugcugucucu

SEQ ID NO: 879598 - RNA, 19 nt, Homo sapiens
ccaugggagucuuggcuuu

SEQ ID NO: 879599 - RNA, 19 nt, Homo sapiens
ucagggagauucugugacu

SEQ ID NO: 879600 - RNA, 19 nt, Homo sapiens
gggcagaguuguuuuguuc

SEQ ID NO: 879601 - RNA, 19 nt, Homo sapiens
uuagguacuuuccauacaa

SEQ ID NO: 879602 - RNA, 19 nt, Homo sapiens
cagcugcauuaucuacaaa

SEQ ID NO: 879603 - RNA, 19 nt, Homo sapiens
ggaagugggguauggaaua

SEQ ID NO: 879604 - RNA, 19 nt, Homo sapiens
gcuacaacuuccauauaag

SEQ ID NO: 879605 - RNA, 19 nt, Homo sapiens
gacacaccauuccggaaga

SEQ ID NO: 879606 - RNA, 19 nt, Homo sapiens
ccaaggacaauaaauccaa

SEQ ID NO: 879607 - RNA, 19 nt, Homo sapiens
gagauucugugacuuaccu

SEQ ID NO: 879608 - RNA, 19 nt, Homo sapiens
gcucagggagauucuguga

SEQ ID NO: 879609 - RNA, 19 nt, Homo sapiens
guacuuuccauacaacgaa

SEQ ID NO: 879610 - RNA, 19 nt, Homo sapiens
guuagguacuuuccauaca

SEQ ID NO: 879611 - RNA, 19 nt, Homo sapiens
gaagugggguauggaauau

SEQ ID NO: 879612 - RNA, 19 nt, Homo sapiens
cuaccaauugggagaaaua

SEQ ID NO: 879613 - RNA, 19 nt, Homo sapiens
guuguuugcugucucuaug

SEQ ID NO: 879614 - RNA, 19 nt, Homo sapiens
ccaaagcagcugcauuauc

SEQ ID NO: 879615 - RNA, 19 nt, Homo sapiens
ccaauugggagaaauaucu

SEQ ID NO: 879616 - RNA, 19 nt, Homo sapiens
cggcuuuacccacaauaua

SEQ ID NO: 879617 - RNA, 19 nt, Homo sapiens
gugaagccaugcuggagau

SEQ ID NO: 879618 - RNA, 19 nt, Homo sapiens
acacuggcccugacucuga

SEQ ID NO: 879619 - RNA, 19 nt, Homo sapiens
caggacacuugcacuacaa

SEQ ID NO: 879620 - RNA, 19 nt, Homo sapiens
ucaggacacuugcacuaca

SEQ ID NO: 879621 - RNA, 19 nt, Homo sapiens
gcugcauuaucuacaaaga

SEQ ID NO: 879622 - RNA, 19 nt, Homo sapiens
gguaaagcaggcccaguga

SEQ ID NO: 879623 - RNA, 19 nt, Homo sapiens
ccagguaccagcagcagaa

SEQ ID NO: 879624 - RNA, 19 nt, Homo sapiens
uaaagggaagcuuaugguu

SEQ ID NO: 879625 - RNA, 19 nt, Homo sapiens
ggaaacuuuugcccuauga

SEQ ID NO: 879626 - RNA, 19 nt, Homo sapiens
caacaccaguacccuuguc

SEQ ID NO: 879627 - RNA, 19 nt, Homo sapiens
uggcagaucgggucccuaa

SEQ ID NO: 879628 - RNA, 19 nt, Homo sapiens
acacuugcacuacaacuga

SEQ ID NO: 879629 - RNA, 19 nt, Homo sapiens
agggagauucugugacuua

SEQ ID NO: 879630 - RNA, 19 nt, Homo sapiens
gcaagaaaacgguaacuca

SEQ ID NO: 879631 - RNA, 19 nt, Homo sapiens
caacaaagccucacgacua

SEQ ID NO: 879632 - RNA, 19 nt, Homo sapiens
caaagcagcugcauuaucu

SEQ ID NO: 879633 - RNA, 19 nt, Homo sapiens
gaaagcaggcauuugauuu

SEQ ID NO: 879634 - RNA, 19 nt, Homo sapiens
ggaaauacacagugaaguu

SEQ ID NO: 879635 - RNA, 19 nt, Homo sapiens
ccaaagcuauguaagagaa

SEQ ID NO: 879636 - RNA, 19 nt, Homo sapiens
gaaauacacagugaaguuu

SEQ ID NO: 879637 - RNA, 19 nt, Homo sapiens
gaggaaagcaggcauuuga

SEQ ID NO: 879638 - RNA, 19 nt, Homo sapiens
caaauaggcucugccauca

SEQ ID NO: 879639 - RNA, 19 nt, Homo sapiens
gaacaggaacccacaagga

SEQ ID NO: 879640 - RNA, 19 nt, Homo sapiens
gacaauaaauccaacucaa

SEQ ID NO: 879641 - RNA, 19 nt, Homo sapiens
gaucgggucccuaacuaua

SEQ ID NO: 879642 - RNA, 19 nt, Homo sapiens
caacaagccaauauucaaa

SEQ ID NO: 879643 - RNA, 19 nt, Homo sapiens
gcaacaagccaauauucaa

SEQ ID NO: 879644 - RNA, 19 nt, Homo sapiens
ggaaagcaggcauuugauu

SEQ ID NO: 879645 - RNA, 19 nt, Homo sapiens
ggaaaugggaagcaagaaa

SEQ ID NO: 879646 - RNA, 19 nt, Homo sapiens
ccauacaacgaaucuauua

SEQ ID NO: 879647 - RNA, 19 nt, Homo sapiens
aagggaagcuuaugguuug

SEQ ID NO: 879648 - RNA, 19 nt, Homo sapiens
gacauuaaagggaagcuua

SEQ ID NO: 879649 - RNA, 19 nt, Homo sapiens
ggaagcuuaugguuugcua

SEQ ID NO: 879650 - RNA, 19 nt, Homo sapiens
gcagcugcauuaucuacaa

SEQ ID NO: 879651 - RNA, 19 nt, Homo sapiens
uuaaggaaauacacaguga

SEQ ID NO: 879652 - RNA, 19 nt, Homo sapiens
caccacagcugccgacaug

SEQ ID NO: 879653 - RNA, 19 nt, Homo sapiens
ugccaaagcagcugcauua

SEQ ID NO: 879654 - RNA, 19 nt, Homo sapiens
gucgcgaucuuuagacaua

SEQ ID NO: 879655 - RNA, 19 nt, Homo sapiens
uaaagcaggcccagugaaa

SEQ ID NO: 879656 - RNA, 19 nt, Homo sapiens
ccaacucaauaacuucaaa

SEQ ID NO: 879657 - RNA, 19 nt, Homo sapiens
guaguuaucccuaaauagu

SEQ ID NO: 879658 - RNA, 19 nt, Homo sapiens
acaaccaccuugggaauuu

SEQ ID NO: 879659 - RNA, 19 nt, Homo sapiens
cagaucgggucccuaacua

SEQ ID NO: 879660 - RNA, 19 nt, Homo sapiens
agcaggacauggacaaaua

SEQ ID NO: 879661 - RNA, 19 nt, Homo sapiens
aagacuaucugacuuggaa

SEQ ID NO: 879662 - RNA, 19 nt, Homo sapiens
gcuuaugguuugcuaugaa

SEQ ID NO: 879663 - RNA, 19 nt, Homo sapiens
gcacuacaacugaccauag

SEQ ID NO: 879664 - RNA, 19 nt, Homo sapiens
gccagugccuccucuacaa

SEQ ID NO: 879665 - RNA, 19 nt, Homo sapiens
gcuggagucugaagaugga

SEQ ID NO: 879666 - RNA, 19 nt, Homo sapiens
aaagggaagcuuaugguuu

SEQ ID NO: 879667 - RNA, 19 nt, Homo sapiens
gcaaguccgcccagcugua

SEQ ID NO: 879668 - RNA, 19 nt, Homo sapiens
ccugagaccuucuggauac

SEQ ID NO: 879669 - RNA, 19 nt, Homo sapiens
gcuuugagcccgucuaugu

SEQ ID NO: 879670 - RNA, 19 nt, Homo sapiens
uaucugacuuggaaagaau

SEQ ID NO: 879671 - RNA, 19 nt, Homo sapiens
gcucaggacacuugcacua

SEQ ID NO: 879672 - RNA, 19 nt, Homo sapiens
ggacaauaaauccaacuca

SEQ ID NO: 879673 - RNA, 19 nt, Homo sapiens
ccacacaguuagcaacaag

SEQ ID NO: 879674 - RNA, 19 nt, Homo sapiens
guaauugugccaaagcuau

SEQ ID NO: 879675 - RNA, 19 nt, Homo sapiens
ccaaccaccuggaucaagu

SEQ ID NO: 879676 - RNA, 19 nt, Homo sapiens
caacugggaggaagagaga

SEQ ID NO: 879677 - RNA, 19 nt, Homo sapiens
ucauggagccguccucuga

SEQ ID NO: 879678 - RNA, 19 nt, Homo sapiens
gaaaugggaagcaagaaaa

SEQ ID NO: 879679 - RNA, 19 nt, Homo sapiens
ggaguuguuugcugucucu

SEQ ID NO: 879680 - RNA, 19 nt, Homo sapiens
gcucugccaucaggaaaug

SEQ ID NO: 879681 - RNA, 19 nt, Homo sapiens
ccaugggagucuuggcuuu

SEQ ID NO: 879682 - RNA, 19 nt, Homo sapiens
ucagggagauucugugacu

SEQ ID NO: 879683 - RNA, 19 nt, Homo sapiens
uuagguacuuuccauacaa

SEQ ID NO: 879684 - RNA, 19 nt, Homo sapiens
cagcugcauuaucuacaaa

SEQ ID NO: 879685 - RNA, 19 nt, Homo sapiens
ccaaggacaauaaauccaa

SEQ ID NO: 879686 - RNA, 19 nt, Homo sapiens
guuguuugcugucucuaug

SEQ ID NO: 879687 - RNA, 19 nt, Homo sapiens
gagauucugugacuuaccu

SEQ ID NO: 879688 - RNA, 19 nt, Homo sapiens
gcucagggagauucuguga

SEQ ID NO: 879689 - RNA, 19 nt, Homo sapiens
guacuuuccauacaacgaa

SEQ ID NO: 879690 - RNA, 19 nt, Homo sapiens
guuagguacuuuccauaca

SEQ ID NO: 879691 - RNA, 19 nt, Homo sapiens
ccaaagcagcugcauuauc

SEQ ID NO: 879692 - RNA, 19 nt, Homo sapiens
gugaagccaugcuggagau

SEQ ID NO: 879693 - RNA, 19 nt, Homo sapiens
acacuggcccugacucuga

SEQ ID NO: 879694 - RNA, 19 nt, Homo sapiens
caggacacuugcacuacaa

SEQ ID NO: 879695 - RNA, 19 nt, Homo sapiens
ucaggacacuugcacuaca

SEQ ID NO: 879696 - RNA, 19 nt, Homo sapiens
cggcuuuacccacaauaua

SEQ ID NO: 879697 - RNA, 19 nt, Homo sapiens
gcugcauuaucuacaaaga

SEQ ID NO: 879698 - RNA, 19 nt, Homo sapiens
gguaaagcaggcccaguga

SEQ ID NO: 879699 - RNA, 19 nt, Homo sapiens
ccagguaccagcagcagaa

SEQ ID NO: 879700 - RNA, 19 nt, Homo sapiens
uaaagggaagcuuaugguu

SEQ ID NO: 879701 - RNA, 19 nt, Homo sapiens
uggcagaucgggucccuaa

SEQ ID NO: 879702 - RNA, 19 nt, Homo sapiens
acacuugcacuacaacuga

SEQ ID NO: 879703 - RNA, 19 nt, Homo sapiens
agggagauucugugacuua

SEQ ID NO: 879704 - RNA, 19 nt, Homo sapiens
gcaagaaaacgguaacuca

SEQ ID NO: 879705 - RNA, 19 nt, Homo sapiens
ccuuuccgcucuccuaaga

SEQ ID NO: 879706 - RNA, 19 nt, Homo sapiens
cuuaugguuugcuaugaaa

SEQ ID NO: 879707 - RNA, 19 nt, Homo sapiens
gcagaucgggucccuaacu

SEQ ID NO: 879708 - RNA, 19 nt, Homo sapiens
gugccaaagcuauguaaga

SEQ ID NO: 879709 - RNA, 19 nt, Homo sapiens
ggaggaaagcaggcauuug

SEQ ID NO: 879710 - RNA, 19 nt, Homo sapiens
aaacgucuauuggccacuu

SEQ ID NO: 879711 - RNA, 19 nt, Homo sapiens
aaacaaccaccuugggaau

SEQ ID NO: 879712 - RNA, 19 nt, Homo sapiens
uagcaacaagccaauauuc

SEQ ID NO: 879713 - RNA, 19 nt, Homo sapiens
guaaagcaggcccagugaa

SEQ ID NO: 879714 - RNA, 19 nt, Homo sapiens
aacaaagccucacgacuac

SEQ ID NO: 879715 - RNA, 19 nt, Homo sapiens
ccaccaaccaccuggauca

SEQ ID NO: 879716 - RNA, 19 nt, Homo sapiens
gagcucagccccuguauuc

SEQ ID NO: 879717 - RNA, 19 nt, Homo sapiens
guauugcucaggacacuug

SEQ ID NO: 879718 - RNA, 19 nt, Homo sapiens
gucuauguuuccuguauug

SEQ ID NO: 879719 - RNA, 19 nt, Homo sapiens
acaagccaauauucaaauc

SEQ ID NO: 879720 - RNA, 19 nt, Homo sapiens
cgucuauguuuccuguauu

SEQ ID NO: 879721 - RNA, 19 nt, Homo sapiens
guuagcaacaagccaauau

SEQ ID NO: 879722 - RNA, 19 nt, Homo sapiens
ccagcgcccuguucugagu

SEQ ID NO: 879723 - RNA, 19 nt, Homo sapiens
aggaaauacacacuaagua

SEQ ID NO: 879724 - RNA, 19 nt, Homo sapiens
gaggaggaaagcaggcauu

SEQ ID NO: 879725 - RNA, 19 nt, Homo sapiens
caggaaaugggaagcaaga

SEQ ID NO: 879726 - RNA, 19 nt, Homo sapiens
gcaggacauggacaaauag

SEQ ID NO: 879727 - RNA, 19 nt, Homo sapiens
uaccuaaggccacacaguu

SEQ ID NO: 879728 - RNA, 19 nt, Homo sapiens
gguaauugugccaaagcua

SEQ ID NO: 879729 - RNA, 19 nt, Homo sapiens
caccaggaaacgucuauug

SEQ ID NO: 879730 - RNA, 19 nt, Homo sapiens
ugccaaagcuauguaagag

SEQ ID NO: 879731 - RNA, 19 nt, Homo sapiens
gagagaaguuugcuuuauu

SEQ ID NO: 879732 - RNA, 19 nt, Homo sapiens
ggagagagaaguuugcuuu

SEQ ID NO: 879733 - RNA, 19 nt, Homo sapiens
ccaaagacguggagagaga

SEQ ID NO: 879734 - RNA, 19 nt, Homo sapiens
ggcaugcacucuucagaua

SEQ ID NO: 879735 - RNA, 19 nt, Homo sapiens
gauauugccugcgaugaaa

SEQ ID NO: 879736 - RNA, 19 nt, Homo sapiens
ccgaaauucuccauucaua

SEQ ID NO: 879737 - RNA, 19 nt, Homo sapiens
gaauacacauguuccuuuc

SEQ ID NO: 879738 - RNA, 19 nt, Homo sapiens
ggacagcuguacaugauca

SEQ ID NO: 879739 - RNA, 19 nt, Homo sapiens
ggaugaaguccgagaauuu

SEQ ID NO: 879740 - RNA, 19 nt, Homo sapiens
gaacuauuaucccuacaca

SEQ ID NO: 879741 - RNA, 19 nt, Homo sapiens
gaccagaguggaacaauuu

SEQ ID NO: 879742 - RNA, 19 nt, Homo sapiens
ccaaaucugaguaacuuua

SEQ ID NO: 879743 - RNA, 19 nt, Homo sapiens
gagaaggcuuggaacuauu

SEQ ID NO: 879744 - RNA, 19 nt, Homo sapiens
gcccaaaucugaguaacuu

SEQ ID NO: 879745 - RNA, 19 nt, Homo sapiens
gguaugacaugacaaugga

SEQ ID NO: 879746 - RNA, 19 nt, Homo sapiens
agggaaggcuggagagaua

SEQ ID NO: 879747 - RNA, 19 nt, Homo sapiens
gagagagaaguuugcuuua

SEQ ID NO: 879748 - RNA, 19 nt, Homo sapiens
agagaaguuugcuuuauug

SEQ ID NO: 879749 - RNA, 19 nt, Homo sapiens
agagaaggcuuggaacuau

SEQ ID NO: 879750 - RNA, 19 nt, Homo sapiens
ccuacacaauuacagaaua

SEQ ID NO: 879751 - RNA, 19 nt, Homo sapiens
ccagagcgcuacuacaaag

SEQ ID NO: 879752 - RNA, 19 nt, Homo sapiens
ccuacaagcuggugacugu

SEQ ID NO: 879753 - RNA, 19 nt, Homo sapiens
ggaagccaccaacaagaaa

SEQ ID NO: 879754 - RNA, 19 nt, Homo sapiens
agagagaaguuugcuuuau

SEQ ID NO: 879755 - RNA, 19 nt, Homo sapiens
ggguguaucucaacagcaa

SEQ ID NO: 879756 - RNA, 19 nt, Homo sapiens
ugacagagaaggcuuggaa

SEQ ID NO: 879757 - RNA, 19 nt, Homo sapiens
gcaugccgcucaccguaga

SEQ ID NO: 879758 - RNA, 19 nt, Homo sapiens
gaugaaguccgagaauuug

SEQ ID NO: 879759 - RNA, 19 nt, Homo sapiens
ccacagacgcacccgaauu

SEQ ID NO: 879760 - RNA, 19 nt, Homo sapiens
gaugagugguaugacauga

SEQ ID NO: 879761 - RNA, 19 nt, Homo sapiens
cacagacgcacccgaauuu

SEQ ID NO: 879762 - RNA, 19 nt, Homo sapiens
ggacaacaaaggaagcaau

SEQ ID NO: 879763 - RNA, 19 nt, Homo sapiens
gcaaacacagccaugaaca

SEQ ID NO: 879764 - RNA, 19 nt, Homo sapiens
agaaggcuuggaacuauua

SEQ ID NO: 879765 - RNA, 19 nt, Homo sapiens
gcaugcacucuucagauaa

SEQ ID NO: 879766 - RNA, 19 nt, Homo sapiens
cccagaaacucucacacuu

SEQ ID NO: 879767 - RNA, 19 nt, Homo sapiens
agaccagaguggaacaauu

SEQ ID NO: 879768 - RNA, 19 nt, Homo sapiens
agaauacacauguuccuuu

SEQ ID NO: 879769 - RNA, 19 nt, Homo sapiens
cagagaaggcuuggaacua

SEQ ID NO: 879770 - RNA, 19 nt, Homo sapiens
acacagccaugaacagagu

SEQ ID NO: 879771 - RNA, 19 nt, Homo sapiens
ccaaguaugaggacaacaa

SEQ ID NO: 879772 - RNA, 19 nt, Homo sapiens
aaacacagccaugaacaga

SEQ ID NO: 879773 - RNA, 19 nt, Homo sapiens
gagacauucugcugauugg

SEQ ID NO: 879774 - RNA, 19 nt, Homo sapiens
caaggugguccgagacauu

SEQ ID NO: 879775 - RNA, 19 nt, Homo sapiens
gagcgcuacuacaaagaau

SEQ ID NO: 879776 - RNA, 19 nt, Homo sapiens
caaguaugaggacaacaaa

SEQ ID NO: 879777 - RNA, 19 nt, Homo sapiens
cuacacaauuacagaauac

SEQ ID NO: 879778 - RNA, 19 nt, Homo sapiens
ccagaaacucucacacuuc

SEQ ID NO: 879779 - RNA, 19 nt, Homo sapiens
ugaacgagccacucaggaa

SEQ ID NO: 879780 - RNA, 19 nt, Homo sapiens
guugaugagugguaugaca

SEQ ID NO: 879781 - RNA, 19 nt, Homo sapiens
gagaaguuugcuuuauuga

SEQ ID NO: 879782 - RNA, 19 nt, Homo sapiens
uggaugaaguccgagaauu

SEQ ID NO: 879783 - RNA, 19 nt, Homo sapiens
ugagugguaugacaugaca

SEQ ID NO: 879784 - RNA, 19 nt, Homo sapiens
cgaaauucuccauucauau

SEQ ID NO: 879785 - RNA, 19 nt, Homo sapiens
caauuucuaucuccagcau

SEQ ID NO: 879786 - RNA, 19 nt, Homo sapiens
cgagacauucugcugauug

SEQ ID NO: 879787 - RNA, 19 nt, Homo sapiens
gacaacaaaggaagcaaug

SEQ ID NO: 879788 - RNA, 19 nt, Homo sapiens
cagcaaacacagccaugaa

SEQ ID NO: 879789 - RNA, 19 nt, Homo sapiens
caugucggcccaaaucuga

SEQ ID NO: 879790 - RNA, 19 nt, Homo sapiens
uuggacagcuguacaugau

SEQ ID NO: 879791 - RNA, 19 nt, Homo sapiens
caacaaaggaagcaaugac

SEQ ID NO: 879792 - RNA, 19 nt, Homo sapiens
auacacauguuccuuucug

SEQ ID NO: 879793 - RNA, 19 nt, Homo sapiens
acuauuaucccuacacaau

SEQ ID NO: 879794 - RNA, 19 nt, Homo sapiens
caugcacucuucagauaag

SEQ ID NO: 879795 - RNA, 19 nt, Homo sapiens
ggacauagacaggcuuuug

SEQ ID NO: 879796 - RNA, 19 nt, Homo sapiens
ugauauugccugcgaugaa

SEQ ID NO: 879797 - RNA, 19 nt, Homo sapiens
ccauucauauagaaaccaa

SEQ ID NO: 879798 - RNA, 19 nt, Homo sapiens
ccgaggauccuaagcacuu

SEQ ID NO: 879799 - RNA, 19 nt, Homo sapiens
guagacgaguacaaaauug

SEQ ID NO: 879800 - RNA, 19 nt, Homo sapiens
ucaggaagccaccaacaag

SEQ ID NO: 879801 - RNA, 19 nt, Homo sapiens
ccgagaagcggguguaucu

SEQ ID NO: 879802 - RNA, 19 nt, Homo sapiens
agaagcggguguaucucaa

SEQ ID NO: 879803 - RNA, 19 nt, Homo sapiens
caccguagacgaguacaaa

SEQ ID NO: 879804 - RNA, 19 nt, Homo sapiens
uuacagaauacacauguuc

SEQ ID NO: 879805 - RNA, 19 nt, Homo sapiens
caggaagccaccaacaaga

SEQ ID NO: 879806 - RNA, 19 nt, Homo sapiens
ugaaguccgagaauuugaa

SEQ ID NO: 879807 - RNA, 19 nt, Homo sapiens
cugccgaaauucuccauuc

SEQ ID NO: 879808 - RNA, 19 nt, Homo sapiens
gucaucagccuaucaugug

SEQ ID NO: 879809 - RNA, 19 nt, Homo sapiens
guaugaggacaacaaagga

SEQ ID NO: 879810 - RNA, 19 nt, Homo sapiens
agacugcuuugucacucaa

SEQ ID NO: 879811 - RNA, 19 nt, Homo sapiens
cucaugggguuuuauauuu

SEQ ID NO: 879812 - RNA, 19 nt, Homo sapiens
uaguugggcuagagcuguu

SEQ ID NO: 879813 - RNA, 19 nt, Homo sapiens
acaagcuggugacugugaa

SEQ ID NO: 879814 - RNA, 19 nt, Homo sapiens
caaagacguggagagagaa

SEQ ID NO: 879815 - RNA, 19 nt, Homo sapiens
uuucgacagugaagccaaa

SEQ ID NO: 879816 - RNA, 19 nt, Homo sapiens
uaagccaugucggcccaaa

SEQ ID NO: 879817 - RNA, 19 nt, Homo sapiens
ccuaucaugugcuccuaca

SEQ ID NO: 879818 - RNA, 19 nt, Homo sapiens
gagggaaggcuggagagau

SEQ ID NO: 879819 - RNA, 19 nt, Homo sapiens
aaaccaaguaugaggacaa

SEQ ID NO: 879820 - RNA, 19 nt, Homo sapiens
ugccgaaauucuccauuca

SEQ ID NO: 879821 - RNA, 19 nt, Homo sapiens
cauguuccuucgaccuuuc

SEQ ID NO: 879822 - RNA, 19 nt, Homo sapiens
cuauuaucccuacacaauu

SEQ ID NO: 879823 - RNA, 19 nt, Homo sapiens
ugacaugacaauggaugaa

SEQ ID NO: 879824 - RNA, 19 nt, Homo sapiens
aggaagccaccaacaagaa

SEQ ID NO: 879825 - RNA, 19 nt, Homo sapiens
gagcuguuguccccaaaau

SEQ ID NO: 879826 - RNA, 19 nt, Homo sapiens
acaugacaauggaugaagu

SEQ ID NO: 879827 - RNA, 19 nt, Homo sapiens
ccgagacauucugcugauu

SEQ ID NO: 879828 - RNA, 19 nt, Homo sapiens
uaucaugugcuccuacaag

SEQ ID NO: 879829 - RNA, 19 nt, Homo sapiens
uuccagagcgcuacuacaa

SEQ ID NO: 879830 - RNA, 19 nt, Homo sapiens
agacguggagagagaaguu

SEQ ID NO: 879831 - RNA, 19 nt, Homo sapiens
caucaaagcuggcaacuug

SEQ ID NO: 879832 - RNA, 19 nt, Homo sapiens
gaaauucucuggguuaaca

SEQ ID NO: 879833 - RNA, 19 nt, Homo sapiens
gaacagauaaccagacuug

SEQ ID NO: 879834 - RNA, 19 nt, Homo sapiens
gaaguuguucucugucuuu

SEQ ID NO: 879835 - RNA, 19 nt, Homo sapiens
ggcagaaacuauuauggaa

SEQ ID NO: 879836 - RNA, 19 nt, Homo sapiens
gaucaucuccaccauccua

SEQ ID NO: 879837 - RNA, 19 nt, Homo sapiens
gcagaaacuauuauggaaa

SEQ ID NO: 879838 - RNA, 19 nt, Homo sapiens
gaaggaagaaagaaagcuu

SEQ ID NO: 879839 - RNA, 19 nt, Homo sapiens
agacuugggugagugaauu

SEQ ID NO: 879840 - RNA, 19 nt, Homo sapiens
ucaccaaccucucccuugu

SEQ ID NO: 879841 - RNA, 19 nt, Homo sapiens
agacugcuaucaccuuuca

SEQ ID NO: 879842 - RNA, 19 nt, Homo sapiens
cauauccugugaacuccua

SEQ ID NO: 879843 - RNA, 19 nt, Homo sapiens
gggaacagauaaccagacu

SEQ ID NO: 879844 - RNA, 19 nt, Homo sapiens
uagcauuguucuucugaug

SEQ ID NO: 879845 - RNA, 19 nt, Homo sapiens
cauggugucuagcauuguu

SEQ ID NO: 879846 - RNA, 19 nt, Homo sapiens
cagagaaggaagaaagaaa

SEQ ID NO: 879847 - RNA, 19 nt, Homo sapiens
ggacaccuccuccaaugag

SEQ ID NO: 879848 - RNA, 19 nt, Homo sapiens
uggaaauucucuggguuaa

SEQ ID NO: 879849 - RNA, 19 nt, Homo sapiens
acauaaagccaucccauuc

SEQ ID NO: 879850 - RNA, 19 nt, Homo sapiens
ggccuggcagaaacuauua

SEQ ID NO: 879851 - RNA, 19 nt, Homo sapiens
ucucuggguuaacaucaaa

SEQ ID NO: 879852 - RNA, 19 nt, Homo sapiens
uaaccagacuugggugagu

SEQ ID NO: 879853 - RNA, 19 nt, Homo sapiens
caaccucucccuugucgau

SEQ ID NO: 879854 - RNA, 19 nt, Homo sapiens
uaaagauccaguccagaga

SEQ ID NO: 879855 - RNA, 19 nt, Homo sapiens
cugcggugauggccuauga

SEQ ID NO: 879856 - RNA, 19 nt, Homo sapiens
gggccuggcagaaacuauu

SEQ ID NO: 879857 - RNA, 19 nt, Homo sapiens
auuuacagccuaaggaaua

SEQ ID NO: 879858 - RNA, 19 nt, Homo sapiens
gauccaguccagagaagga

SEQ ID NO: 879859 - RNA, 19 nt, Homo sapiens
gcauuguucuucugaugac

SEQ ID NO: 879860 - RNA, 19 nt, Homo sapiens
acacucccauguauuucuu

SEQ ID NO: 879861 - RNA, 19 nt, Homo sapiens
uggcagaaacuauuaugga

SEQ ID NO: 879862 - RNA, 19 nt, Homo sapiens
cccaugauuuacagccuaa

SEQ ID NO: 879863 - RNA, 19 nt, Homo sapiens
caucauggugucuagcauu

SEQ ID NO: 879864 - RNA, 19 nt, Homo sapiens
acucgggucucccuguuug

SEQ ID NO: 879865 - RNA, 19 nt, Homo sapiens
acacucgggucucccuguu

SEQ ID NO: 879866 - RNA, 19 nt, Homo sapiens
acuccacacucccauguau

SEQ ID NO: 879867 - RNA, 19 nt, Homo sapiens
aaagauccaguccagagaa

SEQ ID NO: 879868 - RNA, 19 nt, Homo sapiens
ugggugggauugaguuugu

SEQ ID NO: 879869 - RNA, 19 nt, Homo sapiens
ccuuucagcugcccaugug

SEQ ID NO: 879870 - RNA, 19 nt, Homo sapiens
uuuacagccuaaggaauaa

SEQ ID NO: 879871 - RNA, 19 nt, Homo sapiens
guuguucucugucuuuuau

SEQ ID NO: 879872 - RNA, 19 nt, Homo sapiens
uugggugagugaauuuauu

SEQ ID NO: 879873 - RNA, 19 nt, Homo sapiens
ccuugucgaugucuccuau

SEQ ID NO: 879874 - RNA, 19 nt, Homo sapiens
ccagagaaggaagaaagaa

SEQ ID NO: 879875 - RNA, 19 nt, Homo sapiens
gaacugucucauuguccuu

SEQ ID NO: 879876 - RNA, 19 nt, Homo sapiens
uccacacucccauguauuu

SEQ ID NO: 879877 - RNA, 19 nt, Homo sapiens
uaaggaauaaagaggugaa

SEQ ID NO: 879878 - RNA, 19 nt, Homo sapiens
gauacucggccaucaugca

SEQ ID NO: 879879 - RNA, 19 nt, Homo sapiens
ggacagccgacuccacacu

SEQ ID NO: 879880 - RNA, 19 nt, Homo sapiens
ugauuuacagccuaaggaa

SEQ ID NO: 879881 - RNA, 19 nt, Homo sapiens
guguggccauuuucacuua

SEQ ID NO: 879882 - RNA, 19 nt, Homo sapiens
guccagagaaggaagaaag

SEQ ID NO: 879883 - RNA, 19 nt, Homo sapiens
auaaagccaucccauucca

SEQ ID NO: 879884 - RNA, 19 nt, Homo sapiens
auggaaauucucuggguua

SEQ ID NO: 879885 - RNA, 19 nt, Homo sapiens
gauuuacagccuaaggaau

SEQ ID NO: 879886 - RNA, 19 nt, Homo sapiens
agagaaggaagaaagaaag

SEQ ID NO: 879887 - RNA, 19 nt, Homo sapiens
ucuccaccauccuaaagau

SEQ ID NO: 879888 - RNA, 19 nt, Homo sapiens
cgacuccacacucccaugu

SEQ ID NO: 879889 - RNA, 19 nt, Homo sapiens
aacauaaagccaucccauu

SEQ ID NO: 879890 - RNA, 19 nt, Homo sapiens
ggagaaaguuugaauuuga

SEQ ID NO: 879891 - RNA, 19 nt, Homo sapiens
gaacuggcguugaauuauu

SEQ ID NO: 879892 - RNA, 19 nt, Homo sapiens
gaauugauguugugaguga

SEQ ID NO: 879893 - RNA, 19 nt, Homo sapiens
acacugaagucuccaaaua

SEQ ID NO: 879894 - RNA, 19 nt, Homo sapiens
gaaugaagaggaacaguuu

SEQ ID NO: 879895 - RNA, 19 nt, Homo sapiens
gcacuucuuucuauaugaa

SEQ ID NO: 879896 - RNA, 19 nt, Homo sapiens
gagaacuggcguugaauua

SEQ ID NO: 879897 - RNA, 19 nt, Homo sapiens
caacuguccucgacugauu

SEQ ID NO: 879898 - RNA, 19 nt, Homo sapiens
gggaugcacuuauuaaaca

SEQ ID NO: 879899 - RNA, 19 nt, Homo sapiens
ucucucagcugguaaauug

SEQ ID NO: 879900 - RNA, 19 nt, Homo sapiens
guuaugcacuucuuucuau

SEQ ID NO: 879901 - RNA, 19 nt, Homo sapiens
gauuauagccuagaugaaa

SEQ ID NO: 879902 - RNA, 19 nt, Homo sapiens
gaguuugccucaccaugua

SEQ ID NO: 879903 - RNA, 19 nt, Homo sapiens
gaucuucagccucuugaua

SEQ ID NO: 879904 - RNA, 19 nt, Homo sapiens
uuagagaacuggcguugaa

SEQ ID NO: 879905 - RNA, 19 nt, Homo sapiens
ccaaauaccugggaagagu

SEQ ID NO: 879906 - RNA, 19 nt, Homo sapiens
caacagccaagccaaguuu

SEQ ID NO: 879907 - RNA, 19 nt, Homo sapiens
gaauaaaauuguccaguug

SEQ ID NO: 879908 - RNA, 19 nt, Homo sapiens
caagcgagacucauguuaa

SEQ ID NO: 879909 - RNA, 19 nt, Homo sapiens
gaagcugccugugauauac

SEQ ID NO: 879910 - RNA, 19 nt, Homo sapiens
gcuuuaagguugacaguag

SEQ ID NO: 879911 - RNA, 19 nt, Homo sapiens
caguuuaucuguugagaau

SEQ ID NO: 879912 - RNA, 19 nt, Homo sapiens
gcagugccuucaucagguu

SEQ ID NO: 879913 - RNA, 19 nt, Homo sapiens
gaacacuguacaaaccuaa

SEQ ID NO: 879914 - RNA, 19 nt, Homo sapiens
ggacagauuaaauuucaug

SEQ ID NO: 879915 - RNA, 19 nt, Homo sapiens
ugugaugccucucugguaa

SEQ ID NO: 879916 - RNA, 19 nt, Homo sapiens
guaagacugugugagagaa

SEQ ID NO: 879917 - RNA, 19 nt, Homo sapiens
gaagaggaacaguuuaucu

SEQ ID NO: 879918 - RNA, 19 nt, Homo sapiens
agacucauguuaaccuuga

SEQ ID NO: 879919 - RNA, 19 nt, Homo sapiens
gaguagcuguccucauguu

SEQ ID NO: 879920 - RNA, 19 nt, Homo sapiens
uaacuuccuuuacuagauc

SEQ ID NO: 879921 - RNA, 19 nt, Homo sapiens
gaguaugguucccugaugu

SEQ ID NO: 879922 - RNA, 19 nt, Homo sapiens
cuaagacucccaaagauga

SEQ ID NO: 879923 - RNA, 19 nt, Homo sapiens
caagccaaguuucaugaau

SEQ ID NO: 879924 - RNA, 19 nt, Homo sapiens
gccucaccauguaguauua

SEQ ID NO: 879925 - RNA, 19 nt, Homo sapiens
gaguuaauguuguuaugca

SEQ ID NO: 879926 - RNA, 19 nt, Homo sapiens
ccagucagcuacuucaucu

SEQ ID NO: 879927 - RNA, 19 nt, Homo sapiens
ggaguuugccucaccaugu

SEQ ID NO: 879928 - RNA, 19 nt, Homo sapiens
caguugggaugcacuuauu

SEQ ID NO: 879929 - RNA, 19 nt, Homo sapiens
ugauggaauucuuugugua

SEQ ID NO: 879930 - RNA, 19 nt, Homo sapiens
ucauucagcagaucauuaa

SEQ ID NO: 879931 - RNA, 19 nt, Homo sapiens
aaaguuggguucuacucuu

SEQ ID NO: 879932 - RNA, 19 nt, Homo sapiens
aacuggcguugaauuauua

SEQ ID NO: 879933 - RNA, 19 nt, Homo sapiens
gaaccagucagcuacuuca

SEQ ID NO: 879934 - RNA, 19 nt, Homo sapiens
gaucgggccugugcaucuu

SEQ ID NO: 879935 - RNA, 19 nt, Homo sapiens
cagcaaaugugaaguuagc

SEQ ID NO: 879936 - RNA, 19 nt, Homo sapiens
cuggacagauuaaauuuca

SEQ ID NO: 879937 - RNA, 19 nt, Homo sapiens
guccucauguuucaucuga

SEQ ID NO: 879938 - RNA, 19 nt, Homo sapiens
ugucagcacuuacaguugu

SEQ ID NO: 879939 - RNA, 19 nt, Homo sapiens
caaauaccugggaagagua

SEQ ID NO: 879940 - RNA, 19 nt, Homo sapiens
ccuugaacaucuucgaauu

SEQ ID NO: 879941 - RNA, 19 nt, Homo sapiens
uggagaaaguuugaauuug

SEQ ID NO: 879942 - RNA, 19 nt, Homo sapiens
uugaacaucuucgaauuga

SEQ ID NO: 879943 - RNA, 19 nt, Homo sapiens
agaagcugccugugauaua

SEQ ID NO: 879944 - RNA, 19 nt, Homo sapiens
uauacucucucagcuggua

SEQ ID NO: 879945 - RNA, 19 nt, Homo sapiens
uugcucaucuucaguaugu

SEQ ID NO: 879946 - RNA, 19 nt, Homo sapiens
uguaggagguggaaugaag

SEQ ID NO: 879947 - RNA, 19 nt, Homo sapiens
ugaacacuguacaaaccua

SEQ ID NO: 879948 - RNA, 19 nt, Homo sapiens
guucuacucuucucucaac

SEQ ID NO: 879949 - RNA, 19 nt, Homo sapiens
aaacauuccccuagaguua

SEQ ID NO: 879950 - RNA, 19 nt, Homo sapiens
uagcuguccucauguuuca

SEQ ID NO: 879951 - RNA, 19 nt, Homo sapiens
aagccaaguuucaugaaug

SEQ ID NO: 879952 - RNA, 19 nt, Homo sapiens
gcugaacacuguacaaacc

SEQ ID NO: 879953 - RNA, 19 nt, Homo sapiens
ggugugugcuaaugaucuu

SEQ ID NO: 879954 - RNA, 19 nt, Homo sapiens
ucaagcgagacucauguua

SEQ ID NO: 879955 - RNA, 19 nt, Homo sapiens
gauggaauucuuuguguag

SEQ ID NO: 879956 - RNA, 19 nt, Homo sapiens
gagcagcgaaacagccaaa

SEQ ID NO: 879957 - RNA, 19 nt, Homo sapiens
aagaggaauucgagacguu

SEQ ID NO: 879958 - RNA, 19 nt, Homo sapiens
uaaguccacucauccugau

SEQ ID NO: 879959 - RNA, 19 nt, Homo sapiens
acucuaagacucccaaaga

SEQ ID NO: 879960 - RNA, 19 nt, Homo sapiens
guugggaugcacuuauuaa

SEQ ID NO: 879961 - RNA, 19 nt, Homo sapiens
ggcguugaauuauuacauc

SEQ ID NO: 879962 - RNA, 19 nt, Homo sapiens
ucagcuacuucaucuuuua

SEQ ID NO: 879963 - RNA, 19 nt, Homo sapiens
ucauauuucugaccuuugg

SEQ ID NO: 879964 - RNA, 19 nt, Homo sapiens
cucagcaaaugugaaguua

SEQ ID NO: 879965 - RNA, 19 nt, Homo sapiens
guccucgacugauugaguu

SEQ ID NO: 879966 - RNA, 19 nt, Homo sapiens
ucucucaaccagacucaua

SEQ ID NO: 879967 - RNA, 19 nt, Homo sapiens
agucagcuacuucaucuuu

SEQ ID NO: 879968 - RNA, 19 nt, Homo sapiens
guauguaggagguggaaug

SEQ ID NO: 879969 - RNA, 19 nt, Homo sapiens
agaguaugguucccugaug

SEQ ID NO: 879970 - RNA, 19 nt, Homo sapiens
ggaugcacuuauuaaacau

SEQ ID NO: 879971 - RNA, 19 nt, Homo sapiens
ucgaauugauguugugagu

SEQ ID NO: 879972 - RNA, 19 nt, Homo sapiens
ccugugauauacucucuca

SEQ ID NO: 879973 - RNA, 19 nt, Homo sapiens
uucagccucuugauaauga

SEQ ID NO: 879974 - RNA, 19 nt, Homo sapiens
agaaugaagaggaacaguu

SEQ ID NO: 879975 - RNA, 19 nt, Homo sapiens
gccaagccaaguuucauga

SEQ ID NO: 879976 - RNA, 19 nt, Homo sapiens
acggguaggucucaacugu

SEQ ID NO: 879977 - RNA, 19 nt, Homo sapiens
cgagacucauguuaaccuu

SEQ ID NO: 879978 - RNA, 19 nt, Homo sapiens
cugauggaauucuuugugu

SEQ ID NO: 879979 - RNA, 19 nt, Homo sapiens
ccaaguuucaugaaugugu

SEQ ID NO: 879980 - RNA, 19 nt, Homo sapiens
uagcugcagugccuucauc

SEQ ID NO: 879981 - RNA, 19 nt, Homo sapiens
ggaauucgagacguucuuc

SEQ ID NO: 879982 - RNA, 19 nt, Homo sapiens
cacacacgguucuucuaga

SEQ ID NO: 879983 - RNA, 19 nt, Homo sapiens
aagcgagacucauguuaac

SEQ ID NO: 879984 - RNA, 19 nt, Homo sapiens
agauucuuguggccaauaa

SEQ ID NO: 879985 - RNA, 19 nt, Homo sapiens
guaugucagcuuuaagguu

SEQ ID NO: 879986 - RNA, 19 nt, Homo sapiens
ggauuauagccuagaugaa

SEQ ID NO: 879987 - RNA, 19 nt, Homo sapiens
gccugugcaucuucuguau

SEQ ID NO: 879988 - RNA, 19 nt, Homo sapiens
uucaguaugucagcuuuaa

SEQ ID NO: 879989 - RNA, 19 nt, Homo sapiens
ccucagcaaaugugaaguu

SEQ ID NO: 879990 - RNA, 19 nt, Homo sapiens
gagccaagaucaaauuaaa

SEQ ID NO: 879991 - RNA, 19 nt, Homo sapiens
ucacaacagugguauuaua

SEQ ID NO: 879992 - RNA, 19 nt, Homo sapiens
ggacauuauucuccaagua

SEQ ID NO: 879993 - RNA, 19 nt, Homo sapiens
gacaauaaauggaacagaa

SEQ ID NO: 879994 - RNA, 19 nt, Homo sapiens
cgaccaagcuuuauggauu

SEQ ID NO: 879995 - RNA, 19 nt, Homo sapiens
gcacagaaauuugauaucu

SEQ ID NO: 879996 - RNA, 19 nt, Homo sapiens
caacagugguauuauagaa

SEQ ID NO: 879997 - RNA, 19 nt, Homo sapiens
ggaugaauguucucaaaug

SEQ ID NO: 879998 - RNA, 19 nt, Homo sapiens
gagcugaucaaacagauua

SEQ ID NO: 879999 - RNA, 19 nt, Homo sapiens
agaaggaacugcagagaaa

SEQ ID NO: 880000 - RNA, 19 nt, Homo sapiens
gaagagauagugaccguaa

SEQ ID NO: 880001 - RNA, 19 nt, Homo sapiens
gcagucauaucuccgaauu

SEQ ID NO: 880002 - RNA, 19 nt, Homo sapiens
gaagacccaugaaugaguu

SEQ ID NO: 880003 - RNA, 19 nt, Homo sapiens
ggacagacacacuuccaua

SEQ ID NO: 880004 - RNA, 19 nt, Homo sapiens
gaccaagcuuuauggauuu

SEQ ID NO: 880005 - RNA, 19 nt, Homo sapiens
uaucgcaacuugugaauug

SEQ ID NO: 880006 - RNA, 19 nt, Homo sapiens
uaauauagcucaggaaagu

SEQ ID NO: 880007 - RNA, 19 nt, Homo sapiens
gaauagcaccuuaauuuca

SEQ ID NO: 880008 - RNA, 19 nt, Homo sapiens
caucagacauucacccaaa

SEQ ID NO: 880009 - RNA, 19 nt, Homo sapiens
gcucaugcuucacaaguuu

SEQ ID NO: 880010 - RNA, 19 nt, Homo sapiens
caaaccaucuacaauaugu

SEQ ID NO: 880011 - RNA, 19 nt, Homo sapiens
gcagagaaauccaagaaac

SEQ ID NO: 880012 - RNA, 19 nt, Homo sapiens
uaagagaacuagcccugaa

SEQ ID NO: 880013 - RNA, 19 nt, Homo sapiens
gcauugauguagucaguga

SEQ ID NO: 880014 - RNA, 19 nt, Homo sapiens
gaggacauauuuaaguuca

SEQ ID NO: 880015 - RNA, 19 nt, Homo sapiens
gaugaauguucucaaaugu

SEQ ID NO: 880016 - RNA, 19 nt, Homo sapiens
ggaaugacaugcccuagac

SEQ ID NO: 880017 - RNA, 19 nt, Homo sapiens
ccagcuacaucuuauuuga

SEQ ID NO: 880018 - RNA, 19 nt, Homo sapiens
guaaucugcuaaaccauau

SEQ ID NO: 880019 - RNA, 19 nt, Homo sapiens
caugaugaauagcaccuua

SEQ ID NO: 880020 - RNA, 19 nt, Homo sapiens
cagacacacuuccauacua

SEQ ID NO: 880021 - RNA, 19 nt, Homo sapiens
ccaguggaauacauuaauu

SEQ ID NO: 880022 - RNA, 19 nt, Homo sapiens
gaacauuugcgcauugaug

SEQ ID NO: 880023 - RNA, 19 nt, Homo sapiens
gacaguacauaaucaguuc

SEQ ID NO: 880024 - RNA, 19 nt, Homo sapiens
guaaucagaacacuuagaa

SEQ ID NO: 880025 - RNA, 19 nt, Homo sapiens
acacauacaccuguuauaa

SEQ ID NO: 880026 - RNA, 19 nt, Homo sapiens
gccacuugaugaagaguua

SEQ ID NO: 880027 - RNA, 19 nt, Homo sapiens
ggagaucaguaagcaaaga

SEQ ID NO: 880028 - RNA, 19 nt, Homo sapiens
aaggaaugcuuuacuaguu

SEQ ID NO: 880029 - RNA, 19 nt, Homo sapiens
gaacuaccacuuauugagu

SEQ ID NO: 880030 - RNA, 19 nt, Homo sapiens
uuagaagacugauagaugu

SEQ ID NO: 880031 - RNA, 19 nt, Homo sapiens
ggacugagaaggaaagcuu

SEQ ID NO: 880032 - RNA, 19 nt, Homo sapiens
ugauccaucucucaaagua

SEQ ID NO: 880033 - RNA, 19 nt, Homo sapiens
gaagggaggcaguguuuag

SEQ ID NO: 880034 - RNA, 19 nt, Homo sapiens
caagaaguacuaauagguu

SEQ ID NO: 880035 - RNA, 19 nt, Homo sapiens
aaacugaggacuacaaaug

SEQ ID NO: 880036 - RNA, 19 nt, Homo sapiens
ggcacuguauguaaaguaa

SEQ ID NO: 880037 - RNA, 19 nt, Homo sapiens
guacuaguggccaacaaua

SEQ ID NO: 880038 - RNA, 19 nt, Homo sapiens
aaacgaggaggaagagaua

SEQ ID NO: 880039 - RNA, 19 nt, Homo sapiens
ccaagaaacugaggacuac

SEQ ID NO: 880040 - RNA, 19 nt, Homo sapiens
gaagaguuaauucgcauug

SEQ ID NO: 880041 - RNA, 19 nt, Homo sapiens
uagacugguugaacuagua

SEQ ID NO: 880042 - RNA, 19 nt, Homo sapiens
agacacacuuccauacuau

SEQ ID NO: 880043 - RNA, 19 nt, Homo sapiens
cagcagguauccuuugugu

SEQ ID NO: 880044 - RNA, 19 nt, Homo sapiens
ugacaguuguguucguaaa

SEQ ID NO: 880045 - RNA, 19 nt, Homo sapiens
gaaugugaagucucaugua

SEQ ID NO: 880046 - RNA, 19 nt, Homo sapiens
gcccugaacuaccacuuau

SEQ ID NO: 880047 - RNA, 19 nt, Homo sapiens
guggagauguuuugaauuu

SEQ ID NO: 880048 - RNA, 19 nt, Homo sapiens
gaaacgaggaggaagagau

SEQ ID NO: 880049 - RNA, 19 nt, Homo sapiens
gcaccuuaauuucaagcaa

SEQ ID NO: 880050 - RNA, 19 nt, Homo sapiens
gacaugcccuagacugguu

SEQ ID NO: 880051 - RNA, 19 nt, Homo sapiens
gagcagcuguccucauguc

SEQ ID NO: 880052 - RNA, 19 nt, Homo sapiens
gugauacacucaagcuguu

SEQ ID NO: 880053 - RNA, 19 nt, Homo sapiens
gcaaaaugcauaguacuua

SEQ ID NO: 880054 - RNA, 19 nt, Homo sapiens
gaacugcagagaaauccaa

SEQ ID NO: 880055 - RNA, 19 nt, Homo sapiens
gcgcauugauguagucagu

SEQ ID NO: 880056 - RNA, 19 nt, Homo sapiens
ggagauguuuugaauuuga

SEQ ID NO: 880057 - RNA, 19 nt, Homo sapiens
gcuaaaccauauacauucu

SEQ ID NO: 880058 - RNA, 19 nt, Homo sapiens
gaagaaggaacugcagaga

SEQ ID NO: 880059 - RNA, 19 nt, Homo sapiens
caccuuaauuucaagcaaa

SEQ ID NO: 880060 - RNA, 19 nt, Homo sapiens
agaauuaccugugcuaguc

SEQ ID NO: 880061 - RNA, 19 nt, Homo sapiens
cagaagggaggcaguguuu

SEQ ID NO: 880062 - RNA, 19 nt, Homo sapiens
ggaaaagauuggaugaaug

SEQ ID NO: 880063 - RNA, 19 nt, Homo sapiens
ggucuucaguuacacauac

SEQ ID NO: 880064 - RNA, 19 nt, Homo sapiens
guagugccuuuguugaguu

SEQ ID NO: 880065 - RNA, 19 nt, Homo sapiens
ggaaccagguauuucacau

SEQ ID NO: 880066 - RNA, 19 nt, Homo sapiens
guaaauauugcucagugaa

SEQ ID NO: 880067 - RNA, 19 nt, Homo sapiens
ugauagaugucacaacagu

SEQ ID NO: 880068 - RNA, 19 nt, Homo sapiens
ugugaagucucauguagug

SEQ ID NO: 880069 - RNA, 19 nt, Homo sapiens
gaccguaauucaucagaag

SEQ ID NO: 880070 - RNA, 19 nt, Homo sapiens
ugaccgggcucaugcuuca

SEQ ID NO: 880071 - RNA, 19 nt, Homo sapiens
gacauuauucuccaaguau

SEQ ID NO: 880072 - RNA, 19 nt, Homo sapiens
aaacggauggccuucuuaa

SEQ ID NO: 880073 - RNA, 19 nt, Homo sapiens
uaucaguuguuuccaugaa

SEQ ID NO: 880074 - RNA, 19 nt, Homo sapiens
gaaaugaaaagcuuaccua

SEQ ID NO: 880075 - RNA, 19 nt, Homo sapiens
gauaauacagagccaagau

SEQ ID NO: 880076 - RNA, 19 nt, Homo sapiens
ugucacaacagugguauua

SEQ ID NO: 880077 - RNA, 19 nt, Homo sapiens
aaucagaacacuuagaaga

SEQ ID NO: 880078 - RNA, 19 nt, Homo sapiens
gaugaaacgaggaggaaga

SEQ ID NO: 880079 - RNA, 19 nt, Homo sapiens
uguaauagcagucauaucu

SEQ ID NO: 880080 - RNA, 19 nt, Homo sapiens
ggaagacccaugaaugagu

SEQ ID NO: 880081 - RNA, 19 nt, Homo sapiens
ccacccaucuguacuuugg

SEQ ID NO: 880082 - RNA, 19 nt, Homo sapiens
gaaccagguauuucacaug

SEQ ID NO: 880083 - RNA, 19 nt, Homo sapiens
gagaaauccaagaaacuga

SEQ ID NO: 880084 - RNA, 19 nt, Homo sapiens
aggcuuaucuagauucgaa

SEQ ID NO: 880085 - RNA, 19 nt, Homo sapiens
gaggcaguguuuagcuuug

SEQ ID NO: 880086 - RNA, 19 nt, Homo sapiens
ggaggcaguguuuagcuuu

SEQ ID NO: 880087 - RNA, 19 nt, Homo sapiens
gggaggcaguguuuagcuu

SEQ ID NO: 880088 - RNA, 19 nt, Homo sapiens
gaaaagauuggaugaaugu

SEQ ID NO: 880089 - RNA, 19 nt, Homo sapiens
auccagagcugaucaaaca

SEQ ID NO: 880090 - RNA, 19 nt, Homo sapiens
ccaguuugcuuucucauua

SEQ ID NO: 880091 - RNA, 19 nt, Homo sapiens
aaacaaagaugaagucuca

SEQ ID NO: 880092 - RNA, 19 nt, Homo sapiens
cuacugaccucuucucaua

SEQ ID NO: 880093 - RNA, 19 nt, Homo sapiens
guacauacaucuccuacaa

SEQ ID NO: 880094 - RNA, 19 nt, Homo sapiens
gcacagauauucgaauguu

SEQ ID NO: 880095 - RNA, 19 nt, Homo sapiens
ucgcugagcugcuuguuua

SEQ ID NO: 880096 - RNA, 19 nt, Homo sapiens
guauauaccucaaguucaa

SEQ ID NO: 880097 - RNA, 19 nt, Homo sapiens
ggacuugaauggaugaugu

SEQ ID NO: 880098 - RNA, 19 nt, Homo sapiens
gcagaaaucucccaguuuu

SEQ ID NO: 880099 - RNA, 19 nt, Homo sapiens
gaaguaauguagaagagau

SEQ ID NO: 880100 - RNA, 19 nt, Homo sapiens
acauacaucuccuacaaua

SEQ ID NO: 880101 - RNA, 19 nt, Homo sapiens
uggaugaugucacgacuua

SEQ ID NO: 880102 - RNA, 19 nt, Homo sapiens
gagaggauuucuguaacua

SEQ ID NO: 880103 - RNA, 19 nt, Homo sapiens
gagauaaguauuggcauua

SEQ ID NO: 880104 - RNA, 19 nt, Homo sapiens
gaauacaaaucagcacaga

SEQ ID NO: 880105 - RNA, 19 nt, Homo sapiens
uaauacacguuuccuaaug

SEQ ID NO: 880106 - RNA, 19 nt, Homo sapiens
aaagcuggauugcugauuu

SEQ ID NO: 880107 - RNA, 19 nt, Homo sapiens
ccaaaucgcugagcugcuu

SEQ ID NO: 880108 - RNA, 19 nt, Homo sapiens
uagcagaaaucucccaguu

SEQ ID NO: 880109 - RNA, 19 nt, Homo sapiens
gaggauuucuguaacuaga

SEQ ID NO: 880110 - RNA, 19 nt, Homo sapiens
auacaaaucagcacagaua

SEQ ID NO: 880111 - RNA, 19 nt, Homo sapiens
gaccucuucucauagauuu

SEQ ID NO: 880112 - RNA, 19 nt, Homo sapiens
acacagaguuuguaauagu

SEQ ID NO: 880113 - RNA, 19 nt, Homo sapiens
ugagauaaguauuggcauu

SEQ ID NO: 880114 - RNA, 19 nt, Homo sapiens
ugaaugaaguuguacauac

SEQ ID NO: 880115 - RNA, 19 nt, Homo sapiens
uaaccaaccucccaaaucg

SEQ ID NO: 880116 - RNA, 19 nt, Homo sapiens
cagcacagauauucgaaug

SEQ ID NO: 880117 - RNA, 19 nt, Homo sapiens
ggaaaacuaccauucuuua

SEQ ID NO: 880118 - RNA, 19 nt, Homo sapiens
gagcacaaaguuaucauug

SEQ ID NO: 880119 - RNA, 19 nt, Homo sapiens
caaaucagcacagauauuc

SEQ ID NO: 880120 - RNA, 19 nt, Homo sapiens
agagagaggauuucuguaa

SEQ ID NO: 880121 - RNA, 19 nt, Homo sapiens
uauggagacuguucaauca

SEQ ID NO: 880122 - RNA, 19 nt, Homo sapiens
guacaaagggagaggaaga

SEQ ID NO: 880123 - RNA, 19 nt, Homo sapiens
guagaagagauagugauua

SEQ ID NO: 880124 - RNA, 19 nt, Homo sapiens
guuuaacccucccuaguug

SEQ ID NO: 880125 - RNA, 19 nt, Homo sapiens
gaucucuacugaccucuuc

SEQ ID NO: 880126 - RNA, 19 nt, Homo sapiens
ggauuucuguaacuagaga

SEQ ID NO: 880127 - RNA, 19 nt, Homo sapiens
gagagaggauuucuguaac

SEQ ID NO: 880128 - RNA, 19 nt, Homo sapiens
cuaccauucuuuaccaauu

SEQ ID NO: 880129 - RNA, 19 nt, Homo sapiens
gauuuauguuccagacaaa

SEQ ID NO: 880130 - RNA, 19 nt, Homo sapiens
gugcuggacuuuaccugaa

SEQ ID NO: 880131 - RNA, 19 nt, Homo sapiens
aaagaucaccaguggcaua

SEQ ID NO: 880132 - RNA, 19 nt, Homo sapiens
ggaacacuuacuauacuaa

SEQ ID NO: 880133 - RNA, 19 nt, Homo sapiens
gauaaguauuggcauuagu

SEQ ID NO: 880134 - RNA, 19 nt, Homo sapiens
uaccucaaguucaaguuaa

SEQ ID NO: 880135 - RNA, 19 nt, Homo sapiens
gauauucgaauguuuccaa

SEQ ID NO: 880136 - RNA, 19 nt, Homo sapiens
aaacuaccauucuuuacca

SEQ ID NO: 880137 - RNA, 19 nt, Homo sapiens
ugauuuauguuccagacaa

SEQ ID NO: 880138 - RNA, 19 nt, Homo sapiens
aaagggagaggaagacauu

SEQ ID NO: 880139 - RNA, 19 nt, Homo sapiens
gauguuaaagaaugcauga

SEQ ID NO: 880140 - RNA, 19 nt, Homo sapiens
guguguguauuguguauau

SEQ ID NO: 880141 - RNA, 19 nt, Homo sapiens
ugucacgacuuaagauuag

SEQ ID NO: 880142 - RNA, 19 nt, Homo sapiens
gcaugacuguagcagaaau

SEQ ID NO: 880143 - RNA, 19 nt, Homo sapiens
cacagaguuuguaauaguu

SEQ ID NO: 880144 - RNA, 19 nt, Homo sapiens
gaauauggagacuguucaa

SEQ ID NO: 880145 - RNA, 19 nt, Homo sapiens
gacuuaagauuagaugauc

SEQ ID NO: 880146 - RNA, 19 nt, Homo sapiens
uggaacacuuacuauacua

SEQ ID NO: 880147 - RNA, 19 nt, Homo sapiens
caccaggagcacaaaguua

SEQ ID NO: 880148 - RNA, 19 nt, Homo sapiens
uaaccacaaugagauaagu

SEQ ID NO: 880149 - RNA, 19 nt, Homo sapiens
gacauuguguagccuaugg

SEQ ID NO: 880150 - RNA, 19 nt, Homo sapiens
gaagcugugauugacauuu

SEQ ID NO: 880151 - RNA, 19 nt, Homo sapiens
ggaaguaauguagaagaga

SEQ ID NO: 880152 - RNA, 19 nt, Homo sapiens
acuagaauauggagacugu

SEQ ID NO: 880153 - RNA, 19 nt, Homo sapiens
cacagauauucgaauguuu

SEQ ID NO: 880154 - RNA, 19 nt, Homo sapiens
ggagcacaaaguuaucauu

SEQ ID NO: 880155 - RNA, 19 nt, Homo sapiens
gaugucacgacuuaagauu

SEQ ID NO: 880156 - RNA, 19 nt, Homo sapiens
gaucaccaguggcauaucc

SEQ ID NO: 880157 - RNA, 19 nt, Homo sapiens
augcaugacuguagcagaa

SEQ ID NO: 880158 - RNA, 19 nt, Homo sapiens
uaaagaaugcaugacugua

SEQ ID NO: 880159 - RNA, 19 nt, Homo sapiens
gcuuaagguugugugugua

SEQ ID NO: 880160 - RNA, 19 nt, Homo sapiens
acaaaucagcacagauauu

SEQ ID NO: 880161 - RNA, 19 nt, Homo sapiens
agucucaccuuccaguuug

SEQ ID NO: 880162 - RNA, 19 nt, Homo sapiens
cgacuuaagauuagaugau

SEQ ID NO: 880163 - RNA, 19 nt, Homo sapiens
gaugaugucacgacuuaag

SEQ ID NO: 880164 - RNA, 19 nt, Homo sapiens
gguuguguguguauugugu

SEQ ID NO: 880165 - RNA, 19 nt, Homo sapiens
ucucuucacuagaauaugg

SEQ ID NO: 880166 - RNA, 19 nt, Homo sapiens
aauacacguuuccuaaugu

SEQ ID NO: 880167 - RNA, 19 nt, Homo sapiens
guuauaaccacaaugagau

SEQ ID NO: 880168 - RNA, 19 nt, Homo sapiens
gcuggauaaugcagggaaa

SEQ ID NO: 880169 - RNA, 19 nt, Homo sapiens
aaagaaugcaugacuguag

SEQ ID NO: 880170 - RNA, 19 nt, Homo sapiens
ccucccuaguugaauguua

SEQ ID NO: 880171 - RNA, 19 nt, Homo sapiens
caggcaugcugugcucuaa

SEQ ID NO: 880172 - RNA, 19 nt, Homo sapiens
ccacaaugagauaaguauu

SEQ ID NO: 880173 - RNA, 19 nt, Homo sapiens
acagacagagagaggauuu

SEQ ID NO: 880174 - RNA, 19 nt, Homo sapiens
guacagacagagagaggau

SEQ ID NO: 880175 - RNA, 19 nt, Homo sapiens
gaacacuuacuauacuaac

SEQ ID NO: 880176 - RNA, 19 nt, Homo sapiens
ugggaauucucuucacuag

SEQ ID NO: 880177 - RNA, 19 nt, Homo sapiens
uguguucucuguauuguac

SEQ ID NO: 880178 - RNA, 19 nt, Homo sapiens
uauacuuucucucuguguu

SEQ ID NO: 880179 - RNA, 19 nt, Homo sapiens
acaauaggaaguaauguag

SEQ ID NO: 880180 - RNA, 19 nt, Homo sapiens
caauaggaaguaauguaga

SEQ ID NO: 880181 - RNA, 19 nt, Homo sapiens
gcugagcugcuuguuuaaa

SEQ ID NO: 880182 - RNA, 19 nt, Homo sapiens
guguauauaccucaaguuc

SEQ ID NO: 880183 - RNA, 19 nt, Homo sapiens
uaagguuguguguguauug

SEQ ID NO: 880184 - RNA, 19 nt, Homo sapiens
gaggaagacauuuugaauu

SEQ ID NO: 880185 - RNA, 19 nt, Homo sapiens
acugaccucuucucauaga

SEQ ID NO: 880186 - RNA, 19 nt, Homo sapiens
auaccucaaguucaaguua

SEQ ID NO: 880187 - RNA, 19 nt, Homo sapiens
ccauuaagucagaauacaa

SEQ ID NO: 880188 - RNA, 19 nt, Homo sapiens
gauaaugcagggaaaacua

SEQ ID NO: 880189 - RNA, 19 nt, Homo sapiens
uguagaagagauagugauu

SEQ ID NO: 880190 - RNA, 19 nt, Homo sapiens
gaaagaggcacaaggaaga

SEQ ID NO: 880191 - RNA, 19 nt, Homo sapiens
ggaugaugcuuuguacaua

SEQ ID NO: 880192 - RNA, 19 nt, Homo sapiens
ggaugcagcuagaggauga

SEQ ID NO: 880193 - RNA, 19 nt, Homo sapiens
ggacaaggaggucagguuu

SEQ ID NO: 880194 - RNA, 19 nt, Homo sapiens
gaugaugcuuuguacauau

SEQ ID NO: 880195 - RNA, 19 nt, Homo sapiens
gcuagaggaugaugcuuug

SEQ ID NO: 880196 - RNA, 19 nt, Homo sapiens
gaggugaacuguguggauu

SEQ ID NO: 880197 - RNA, 19 nt, Homo sapiens
guacugggcucaugaacag

SEQ ID NO: 880198 - RNA, 19 nt, Homo sapiens
ggugcuggaugucauauau

SEQ ID NO: 880199 - RNA, 19 nt, Homo sapiens
gcagucagaugcccuggau

SEQ ID NO: 880200 - RNA, 19 nt, Homo sapiens
gcacaaggaagaaaguaug

SEQ ID NO: 880201 - RNA, 19 nt, Homo sapiens
ugaggacguuugccacuuu

SEQ ID NO: 880202 - RNA, 19 nt, Homo sapiens
gaagaaaguaugggaagga

SEQ ID NO: 880203 - RNA, 19 nt, Homo sapiens
ugacacacuuggacagaga

SEQ ID NO: 880204 - RNA, 19 nt, Homo sapiens
ggccauuacucagcucuuu

SEQ ID NO: 880205 - RNA, 19 nt, Homo sapiens
ugacagggacggcuuguug

SEQ ID NO: 880206 - RNA, 19 nt, Homo sapiens
guacauaucccaggcuaau

SEQ ID NO: 880207 - RNA, 19 nt, Homo sapiens
cagugaaggugucucagaa

SEQ ID NO: 880208 - RNA, 19 nt, Homo sapiens
acagguuccuccuucuaua

SEQ ID NO: 880209 - RNA, 19 nt, Homo sapiens
gcaccaguguccggaaaug

SEQ ID NO: 880210 - RNA, 19 nt, Homo sapiens
gggcaaggcggaagaggaa

SEQ ID NO: 880211 - RNA, 19 nt, Homo sapiens
caaaucuggucuguugcua

SEQ ID NO: 880212 - RNA, 19 nt, Homo sapiens
gaacuguguggauugcaaa

SEQ ID NO: 880213 - RNA, 19 nt, Homo sapiens
cgagaggcaucaucaaagg

SEQ ID NO: 880214 - RNA, 19 nt, Homo sapiens
gauuggccuugguaagauu

SEQ ID NO: 880215 - RNA, 19 nt, Homo sapiens
gggaagauuggccuuggua

SEQ ID NO: 880216 - RNA, 19 nt, Homo sapiens
uuacucagcucuuuuguga

SEQ ID NO: 880217 - RNA, 19 nt, Homo sapiens
gcuaucaggccauuacuca

SEQ ID NO: 880218 - RNA, 19 nt, Homo sapiens
cauccagacugaagaccaa

SEQ ID NO: 880219 - RNA, 19 nt, Homo sapiens
gcaccuucgcugccaagua

SEQ ID NO: 880220 - RNA, 19 nt, Homo sapiens
acauaucccaggcuaauuu

SEQ ID NO: 880221 - RNA, 19 nt, Homo sapiens
gugggcagcugaugacaca

SEQ ID NO: 880222 - RNA, 19 nt, Homo sapiens
uauacaccauccagacuga

SEQ ID NO: 880223 - RNA, 19 nt, Homo sapiens
caccuucgcugccaaguac

SEQ ID NO: 880224 - RNA, 19 nt, Homo sapiens
gaagauuggccuugguaag

SEQ ID NO: 880225 - RNA, 19 nt, Homo sapiens
ggaagauuggccuugguaa

SEQ ID NO: 880226 - RNA, 19 nt, Homo sapiens
acacuuggacagagacuuu

SEQ ID NO: 880227 - RNA, 19 nt, Homo sapiens
gaggacguuugccacuuug

SEQ ID NO: 880228 - RNA, 19 nt, Homo sapiens
ggcgagaggcaucaucaaa

SEQ ID NO: 880229 - RNA, 19 nt, Homo sapiens
uagaggaugaugcuuugua

SEQ ID NO: 880230 - RNA, 19 nt, Homo sapiens
gggaagaguacaaggacaa

SEQ ID NO: 880231 - RNA, 19 nt, Homo sapiens
ucuaugcugcgcugucuua

SEQ ID NO: 880232 - RNA, 19 nt, Homo sapiens
ccacagguuccuccuucua

SEQ ID NO: 880233 - RNA, 19 nt, Homo sapiens
ugaacuguguggauugcaa

SEQ ID NO: 880234 - RNA, 19 nt, Homo sapiens
aggaggagaugggaagauu

SEQ ID NO: 880235 - RNA, 19 nt, Homo sapiens
ccaaguacugggcucauga

SEQ ID NO: 880236 - RNA, 19 nt, Homo sapiens
aaguggagaugcagucaga

SEQ ID NO: 880237 - RNA, 19 nt, Homo sapiens
acaaggaggucagguuugg

SEQ ID NO: 880238 - RNA, 19 nt, Homo sapiens
augcugcgcugucuuacaa

SEQ ID NO: 880239 - RNA, 19 nt, Homo sapiens
aaucuggucuguugcuauc

SEQ ID NO: 880240 - RNA, 19 nt, Homo sapiens
gcgagaggcaucaucaaag

SEQ ID NO: 880241 - RNA, 19 nt, Homo sapiens
gggaaagaggcacaaggaa

SEQ ID NO: 880242 - RNA, 19 nt, Homo sapiens
ggaggugaacuguguggau

SEQ ID NO: 880243 - RNA, 19 nt, Homo sapiens
gaggagaugggaagauugg

SEQ ID NO: 880244 - RNA, 19 nt, Homo sapiens
ggaggagaugggaagauug

SEQ ID NO: 880245 - RNA, 19 nt, Homo sapiens
gaaggaaggggaagaggaa

SEQ ID NO: 880246 - RNA, 19 nt, Homo sapiens
gagaggggauucugcugaa

SEQ ID NO: 880247 - RNA, 19 nt, Homo sapiens
gugaaggugucucagaacu

SEQ ID NO: 880248 - RNA, 19 nt, Homo sapiens
gccaaguacugggcucaug

SEQ ID NO: 880249 - RNA, 19 nt, Homo sapiens
aagauuggccuugguaaga

SEQ ID NO: 880250 - RNA, 19 nt, Homo sapiens
ggacguuugccacuuugug

SEQ ID NO: 880251 - RNA, 19 nt, Homo sapiens
ugaccagugucccagugaa

SEQ ID NO: 880252 - RNA, 19 nt, Homo sapiens
gacaaggaggucagguuug

SEQ ID NO: 880253 - RNA, 19 nt, Homo sapiens
gaugacacacuuggacaga

SEQ ID NO: 880254 - RNA, 19 nt, Homo sapiens
caaguacugggcucaugaa

SEQ ID NO: 880255 - RNA, 19 nt, Homo sapiens
ccagugaaggugucucaga

SEQ ID NO: 880256 - RNA, 19 nt, Homo sapiens
ccgcaccaguguccggaaa

SEQ ID NO: 880257 - RNA, 19 nt, Homo sapiens
gcacuucucaccccugaaa

SEQ ID NO: 880258 - RNA, 19 nt, Homo sapiens
agacagauggcaaccacuu

SEQ ID NO: 880259 - RNA, 19 nt, Homo sapiens
cuggccaccucgcauauug

SEQ ID NO: 880260 - RNA, 19 nt, Homo sapiens
ccaaccugaugaccagugu

SEQ ID NO: 880261 - RNA, 19 nt, Homo sapiens
gugcuggccaccucgcaua

SEQ ID NO: 880262 - RNA, 19 nt, Homo sapiens
gcucggcaccaaccugaug

SEQ ID NO: 880263 - RNA, 19 nt, Homo sapiens
cgggaaagaggcacaagga

SEQ ID NO: 880264 - RNA, 19 nt, Homo sapiens
ccaguuccguccagauggu

SEQ ID NO: 880265 - RNA, 19 nt, Homo sapiens
agaggaugaugcuuuguac

SEQ ID NO: 880266 - RNA, 19 nt, Homo sapiens
gccugcaucucaccaccaa

SEQ ID NO: 880267 - RNA, 19 nt, Homo sapiens
gagaggcaucaucaaagga

SEQ ID NO: 880268 - RNA, 19 nt, Homo sapiens
cgaggacacgcccaagaga

SEQ ID NO: 880269 - RNA, 19 nt, Homo sapiens
ccagauggugccagcuuga

SEQ ID NO: 880270 - RNA, 19 nt, Homo sapiens
gacagauggcaaccacuug

SEQ ID NO: 880271 - RNA, 19 nt, Homo sapiens
acaccuauguucgcuacug

SEQ ID NO: 880272 - RNA, 19 nt, Homo sapiens
caacagugggcagcugaug

SEQ ID NO: 880273 - RNA, 19 nt, Homo sapiens
ggcaugaugaggacguuug

SEQ ID NO: 880274 - RNA, 19 nt, Homo sapiens
agauuggccuugguaagau

SEQ ID NO: 880275 - RNA, 19 nt, Homo sapiens
cuccuucuauagcguugua

SEQ ID NO: 880276 - RNA, 19 nt, Homo sapiens
ggcagcugaugacacacuu

SEQ ID NO: 880277 - RNA, 19 nt, Homo sapiens
ggcacaaggaagaaaguau

SEQ ID NO: 880278 - RNA, 19 nt, Homo sapiens
guggagaugcagucagaug

SEQ ID NO: 880279 - RNA, 19 nt, Homo sapiens
gaacagagcugaauggaaa

SEQ ID NO: 880280 - RNA, 19 nt, Homo sapiens
ggaaagugcucaucaguga

SEQ ID NO: 880281 - RNA, 19 nt, Homo sapiens
ggaaauugcuguucaguuc

SEQ ID NO: 880282 - RNA, 19 nt, Homo sapiens
gaacaucccugaagaaugc

SEQ ID NO: 880283 - RNA, 19 nt, Homo sapiens
gcaauaaccgucuaauaaa

SEQ ID NO: 880284 - RNA, 19 nt, Homo sapiens
gaacucacuuguggaauga

SEQ ID NO: 880285 - RNA, 19 nt, Homo sapiens
ggaaagacccugggaauuc

SEQ ID NO: 880286 - RNA, 19 nt, Homo sapiens
ggaagcagcaugugacuga

SEQ ID NO: 880287 - RNA, 19 nt, Homo sapiens
ggaagggcaucuugguuau

SEQ ID NO: 880288 - RNA, 19 nt, Homo sapiens
cgacaggcuugcugaauga

SEQ ID NO: 880289 - RNA, 19 nt, Homo sapiens
gaagaaacccacccacugu

SEQ ID NO: 880290 - RNA, 19 nt, Homo sapiens
gaugaagacuauaggguau

SEQ ID NO: 880291 - RNA, 19 nt, Homo sapiens
gaaagacccugggaauucu

SEQ ID NO: 880292 - RNA, 19 nt, Homo sapiens
caauaaccgucuaauaaag

SEQ ID NO: 880293 - RNA, 19 nt, Homo sapiens
guacagcaauaaccgucua

SEQ ID NO: 880294 - RNA, 19 nt, Homo sapiens
agacuucacuggugucaga

SEQ ID NO: 880295 - RNA, 19 nt, Homo sapiens
gggaggaaauugcuguuca

SEQ ID NO: 880296 - RNA, 19 nt, Homo sapiens
gcagaacucacuuguggaa

SEQ ID NO: 880297 - RNA, 19 nt, Homo sapiens
agcaauaaccgucuaauaa

SEQ ID NO: 880298 - RNA, 19 nt, Homo sapiens
gcacucugacccuguagua

SEQ ID NO: 880299 - RNA, 19 nt, Homo sapiens
caacgcagcugagaaacuc

SEQ ID NO: 880300 - RNA, 19 nt, Homo sapiens
caucaacgcagcugagaaa

SEQ ID NO: 880301 - RNA, 19 nt, Homo sapiens
cagcaauaaccgucuaaua

SEQ ID NO: 880302 - RNA, 19 nt, Homo sapiens
gaucuggccucucugugau

SEQ ID NO: 880303 - RNA, 19 nt, Homo sapiens
cuaagcugcuggugaaaga

SEQ ID NO: 880304 - RNA, 19 nt, Homo sapiens
gcaaaugggagcggaagaa

SEQ ID NO: 880305 - RNA, 19 nt, Homo sapiens
gcaggcggaugugaacuug

SEQ ID NO: 880306 - RNA, 19 nt, Homo sapiens
gaggccaacuccagcaaug

SEQ ID NO: 880307 - RNA, 19 nt, Homo sapiens
gggcugcacuggacguguu

SEQ ID NO: 880308 - RNA, 19 nt, Homo sapiens
ugaacuuggugaacgcuaa

SEQ ID NO: 880309 - RNA, 19 nt, Homo sapiens
agaacucacuuguggaaug

SEQ ID NO: 880310 - RNA, 19 nt, Homo sapiens
acgcuaagcugcuggugaa

SEQ ID NO: 880311 - RNA, 19 nt, Homo sapiens
ugaagacuauaggguauga

SEQ ID NO: 880312 - RNA, 19 nt, Homo sapiens
gaugaaggacggcaaaugg

SEQ ID NO: 880313 - RNA, 19 nt, Homo sapiens
ggacugugaaggccuuauu

SEQ ID NO: 880314 - RNA, 19 nt, Homo sapiens
uagcaaagaggagcugaua

SEQ ID NO: 880315 - RNA, 19 nt, Homo sapiens
ggaacagagcugaauggaa

SEQ ID NO: 880316 - RNA, 19 nt, Homo sapiens
aggaagggcaucuugguua

SEQ ID NO: 880317 - RNA, 19 nt, Homo sapiens
gcaaagaggagcugauagc

SEQ ID NO: 880318 - RNA, 19 nt, Homo sapiens
gcagaaccuuagcaaagag

SEQ ID NO: 880319 - RNA, 19 nt, Homo sapiens
gaagcagcaugugacugaa

SEQ ID NO: 880320 - RNA, 19 nt, Homo sapiens
ggaacaucccugaagaaug

SEQ ID NO: 880321 - RNA, 19 nt, Homo sapiens
gacccuugcugccggaaga

SEQ ID NO: 880322 - RNA, 19 nt, Homo sapiens
ggaggaaauugcuguucag

SEQ ID NO: 880323 - RNA, 19 nt, Homo sapiens
aagggcaucuugguuauga

SEQ ID NO: 880324 - RNA, 19 nt, Homo sapiens
aagcagaaccuuagcaaag

SEQ ID NO: 880325 - RNA, 19 nt, Homo sapiens
cuucuuggcuuagguacuu

SEQ ID NO: 880326 - RNA, 19 nt, Homo sapiens
ccuuugggaugaagacuau

SEQ ID NO: 880327 - RNA, 19 nt, Homo sapiens
ugugaaggccuuauuguuc

SEQ ID NO: 880328 - RNA, 19 nt, Homo sapiens
ccaagcaggcggaugugaa

SEQ ID NO: 880329 - RNA, 19 nt, Homo sapiens
aaugggagcggaagaaguu

SEQ ID NO: 880330 - RNA, 19 nt, Homo sapiens
uugcaaaucugcggaaagu

SEQ ID NO: 880331 - RNA, 19 nt, Homo sapiens
caacuccagcaauggcuuu

SEQ ID NO: 880332 - RNA, 19 nt, Homo sapiens
acgacaggcuugcugaaug

SEQ ID NO: 880333 - RNA, 19 nt, Homo sapiens
agcagaaccuuagcaaaga

SEQ ID NO: 880334 - RNA, 19 nt, Homo sapiens
gaaacccacccacugugau

SEQ ID NO: 880335 - RNA, 19 nt, Homo sapiens
gcugaaugacaacaccuuu

SEQ ID NO: 880336 - RNA, 19 nt, Homo sapiens
caacaaggaagggcaucuu

SEQ ID NO: 880337 - RNA, 19 nt, Homo sapiens
gugaaugcccaggcccuua

SEQ ID NO: 880338 - RNA, 19 nt, Homo sapiens
caggcuugcugaaugacaa

SEQ ID NO: 880339 - RNA, 19 nt, Homo sapiens
cacccacugugaucaauag

SEQ ID NO: 880340 - RNA, 19 nt, Homo sapiens
gagcaaggcuucggggaau

SEQ ID NO: 880341 - RNA, 19 nt, Homo sapiens
ccauccaggugauaacaca

SEQ ID NO: 880342 - RNA, 19 nt, Homo sapiens
uuagguacuucuacucaca

SEQ ID NO: 880343 - RNA, 19 nt, Homo sapiens
cagccucagugccgcagaa

SEQ ID NO: 880344 - RNA, 19 nt, Homo sapiens
gaagggcaucuugguuaug

SEQ ID NO: 880345 - RNA, 19 nt, Homo sapiens
caaggugaccgcugauguc

SEQ ID NO: 880346 - RNA, 19 nt, Homo sapiens
gggccucugacacugcuua

SEQ ID NO: 880347 - RNA, 19 nt, Homo sapiens
ccacccacugugaucaaua

SEQ ID NO: 880348 - RNA, 19 nt, Homo sapiens
agaaacccacccacuguga

SEQ ID NO: 880349 - RNA, 19 nt, Homo sapiens
agcgggagcucgagaauac

SEQ ID NO: 880350 - RNA, 19 nt, Homo sapiens
ggagagaaaauccacauuc

SEQ ID NO: 880351 - RNA, 19 nt, Homo sapiens
gcuuagguacuucuacuca

SEQ ID NO: 880352 - RNA, 19 nt, Homo sapiens
caguuccacuucuaaccuu

SEQ ID NO: 880353 - RNA, 19 nt, Homo sapiens
gaacuuggugaacgcuaag

SEQ ID NO: 880354 - RNA, 19 nt, Homo sapiens
ggacguguuuacggaagag

SEQ ID NO: 880355 - RNA, 19 nt, Homo sapiens
ccaaggugaccgcugaugu

SEQ ID NO: 880356 - RNA, 19 nt, Homo sapiens
ggugauaacacagggaaca

SEQ ID NO: 880357 - RNA, 19 nt, Homo sapiens
gcggaaagugcucaucagu

SEQ ID NO: 880358 - RNA, 19 nt, Homo sapiens
ucuggccucucugugauuu

SEQ ID NO: 880359 - RNA, 19 nt, Homo sapiens
uggaaagacccugggaauu

SEQ ID NO: 880360 - RNA, 19 nt, Homo sapiens
ugcuuacacugcacucuga

SEQ ID NO: 880361 - RNA, 19 nt, Homo sapiens
cauugucggccuccugaaa

SEQ ID NO: 880362 - RNA, 19 nt, Homo sapiens
gggaccauccaggugauaa

SEQ ID NO: 880363 - RNA, 19 nt, Homo sapiens
aaagcagaaccuuagcaaa

SEQ ID NO: 880364 - RNA, 19 nt, Homo sapiens
ucaugggcaucuccuccuu

SEQ ID NO: 880365 - RNA, 19 nt, Homo sapiens
aaagugcucaucagugaca

SEQ ID NO: 880366 - RNA, 19 nt, Homo sapiens
agaucuggccucucuguga

SEQ ID NO: 880367 - RNA, 19 nt, Homo sapiens
cagcuucuuggcuuaggua

SEQ ID NO: 880368 - RNA, 19 nt, Homo sapiens
cuacccggaugcaguccuu

SEQ ID NO: 880369 - RNA, 19 nt, Homo sapiens
gggaacagagcugaaugga

SEQ ID NO: 880370 - RNA, 19 nt, Homo sapiens
caggaaagguuaaagauua

SEQ ID NO: 880371 - RNA, 19 nt, Homo sapiens
caacugagaugcuccagaa

SEQ ID NO: 880372 - RNA, 19 nt, Homo sapiens
ggaaccaacugaagauuau

SEQ ID NO: 880373 - RNA, 19 nt, Homo sapiens
ggacaaaacuacacuauug

SEQ ID NO: 880374 - RNA, 19 nt, Homo sapiens
gaaggagacucgaggaaau

SEQ ID NO: 880375 - RNA, 19 nt, Homo sapiens
uggagaggcuucauucuua

SEQ ID NO: 880376 - RNA, 19 nt, Homo sapiens
gaaggaagauuucauuuug

SEQ ID NO: 880377 - RNA, 19 nt, Homo sapiens
gugguaaccugcagauaua

SEQ ID NO: 880378 - RNA, 19 nt, Homo sapiens
gcacugacauaaguugaaa

SEQ ID NO: 880379 - RNA, 19 nt, Homo sapiens
gaaaagaacugugcgaaau

SEQ ID NO: 880380 - RNA, 19 nt, Homo sapiens
ggagauagacauuccaaga

SEQ ID NO: 880381 - RNA, 19 nt, Homo sapiens
caccugaacaccagaauua

SEQ ID NO: 880382 - RNA, 19 nt, Homo sapiens
gaaagaggcaacugagaug

SEQ ID NO: 880383 - RNA, 19 nt, Homo sapiens
gaaacuacuccaucacuau

SEQ ID NO: 880384 - RNA, 19 nt, Homo sapiens
ggaaagaggcaacugagau

SEQ ID NO: 880385 - RNA, 19 nt, Homo sapiens
gaaguuagagacaugaaau

SEQ ID NO: 880386 - RNA, 19 nt, Homo sapiens
caacagcaguuucucuagu

SEQ ID NO: 880387 - RNA, 19 nt, Homo sapiens
gagcauuacuggacagagu

SEQ ID NO: 880388 - RNA, 19 nt, Homo sapiens
ccacacauugcaugaaaua

SEQ ID NO: 880389 - RNA, 19 nt, Homo sapiens
gagauagacauuccaagaa

SEQ ID NO: 880390 - RNA, 19 nt, Homo sapiens
uaaacugcaugaaguccua

SEQ ID NO: 880391 - RNA, 19 nt, Homo sapiens
aaaggaggauugagacaga

SEQ ID NO: 880392 - RNA, 19 nt, Homo sapiens
gaaagaggaaguacaacug

SEQ ID NO: 880393 - RNA, 19 nt, Homo sapiens
gaaauacaaugugaaagcu

SEQ ID NO: 880394 - RNA, 19 nt, Homo sapiens
gaaucaagcacuacaaagu

SEQ ID NO: 880395 - RNA, 19 nt, Homo sapiens
gaagacagagaacacagaa

SEQ ID NO: 880396 - RNA, 19 nt, Homo sapiens
uuacugcucuaccuuugua

SEQ ID NO: 880397 - RNA, 19 nt, Homo sapiens
aaacuacacuauugaacug

SEQ ID NO: 880398 - RNA, 19 nt, Homo sapiens
gcaaguaauuaaacugcau

SEQ ID NO: 880399 - RNA, 19 nt, Homo sapiens
gaaggaaccaacugaagau

SEQ ID NO: 880400 - RNA, 19 nt, Homo sapiens
gaaauucacccuuguuuug

SEQ ID NO: 880401 - RNA, 19 nt, Homo sapiens
gagacucgaggaaauuuaa

SEQ ID NO: 880402 - RNA, 19 nt, Homo sapiens
guaacacucccaaaccuuu

SEQ ID NO: 880403 - RNA, 19 nt, Homo sapiens
gaaaagaaaaggaggauug

SEQ ID NO: 880404 - RNA, 19 nt, Homo sapiens
gauuacugcucuaccuuug

SEQ ID NO: 880405 - RNA, 19 nt, Homo sapiens
uuaccuagcuggaaguuag

SEQ ID NO: 880406 - RNA, 19 nt, Homo sapiens
ugaaaacacuggucaagaa

SEQ ID NO: 880407 - RNA, 19 nt, Homo sapiens
guagaccucacaugccuua

SEQ ID NO: 880408 - RNA, 19 nt, Homo sapiens
ggugguaaccugcagauau

SEQ ID NO: 880409 - RNA, 19 nt, Homo sapiens
ccauuuauauguucaacug

SEQ ID NO: 880410 - RNA, 19 nt, Homo sapiens
agaaacuacuccaucacua

SEQ ID NO: 880411 - RNA, 19 nt, Homo sapiens
guaauuaaacugcaugaag

SEQ ID NO: 880412 - RNA, 19 nt, Homo sapiens
aaagaacugugcgaaauuc

SEQ ID NO: 880413 - RNA, 19 nt, Homo sapiens
uauauucuccugauacuga

SEQ ID NO: 880414 - RNA, 19 nt, Homo sapiens
gcgaaauucacccuuguuu

SEQ ID NO: 880415 - RNA, 19 nt, Homo sapiens
gaggaaauuuaagaccauu

SEQ ID NO: 880416 - RNA, 19 nt, Homo sapiens
ggagacucgaggaaauuua

SEQ ID NO: 880417 - RNA, 19 nt, Homo sapiens
gcucuaccuuuguacuuug

SEQ ID NO: 880418 - RNA, 19 nt, Homo sapiens
caaauuagacauaguagac

SEQ ID NO: 880419 - RNA, 19 nt, Homo sapiens
uaaucaagcggucaggaua

SEQ ID NO: 880420 - RNA, 19 nt, Homo sapiens
gcuggaaguuagagacaug

SEQ ID NO: 880421 - RNA, 19 nt, Homo sapiens
cacauugcaugaaauacaa

SEQ ID NO: 880422 - RNA, 19 nt, Homo sapiens
ucaagaacccaguauggaa

SEQ ID NO: 880423 - RNA, 19 nt, Homo sapiens
gcaugaaguccuagagaga

SEQ ID NO: 880424 - RNA, 19 nt, Homo sapiens
ggagaggcuucauucuuac

SEQ ID NO: 880425 - RNA, 19 nt, Homo sapiens
ggaaguuagagacaugaaa

SEQ ID NO: 880426 - RNA, 19 nt, Homo sapiens
ccaaaccacacaccaaaga

SEQ ID NO: 880427 - RNA, 19 nt, Homo sapiens
gaacccuucuuugggaaau

SEQ ID NO: 880428 - RNA, 19 nt, Homo sapiens
ccaggaaagguuaaagauu

SEQ ID NO: 880429 - RNA, 19 nt, Homo sapiens
gacuacggcugugguggua

SEQ ID NO: 880430 - RNA, 19 nt, Homo sapiens
cugagaugcuccagaagaa

SEQ ID NO: 880431 - RNA, 19 nt, Homo sapiens
ugaagauuauguggaugua

SEQ ID NO: 880432 - RNA, 19 nt, Homo sapiens
acauaguacuuucuagaug

SEQ ID NO: 880433 - RNA, 19 nt, Homo sapiens
aaacuacuccaucacuauu

SEQ ID NO: 880434 - RNA, 19 nt, Homo sapiens
aaguacaacugaagacaga

SEQ ID NO: 880435 - RNA, 19 nt, Homo sapiens
gaccucacaugccuuacug

SEQ ID NO: 880436 - RNA, 19 nt, Homo sapiens
gagaaggaaccaacugaag

SEQ ID NO: 880437 - RNA, 19 nt, Homo sapiens
cagaguacguccguggaaa

SEQ ID NO: 880438 - RNA, 19 nt, Homo sapiens
gaggagcccuuuuccaaug

SEQ ID NO: 880439 - RNA, 19 nt, Homo sapiens
ucucacagaaggaagauuu

SEQ ID NO: 880440 - RNA, 19 nt, Homo sapiens
cagggaaacuagagacuac

SEQ ID NO: 880441 - RNA, 19 nt, Homo sapiens
acagaaggaagauuucauu

SEQ ID NO: 880442 - RNA, 19 nt, Homo sapiens
gaagugaaaaguugaagaa

SEQ ID NO: 880443 - RNA, 19 nt, Homo sapiens
cagaaggaagauuucauuu

SEQ ID NO: 880444 - RNA, 19 nt, Homo sapiens
agaaggaaccaacugaaga

SEQ ID NO: 880445 - RNA, 19 nt, Homo sapiens
ccaauucacagggaaacua

SEQ ID NO: 880446 - RNA, 19 nt, Homo sapiens
ugcaugaaauacaauguga

SEQ ID NO: 880447 - RNA, 19 nt, Homo sapiens
cgaggaaauuuaagaccau

SEQ ID NO: 880448 - RNA, 19 nt, Homo sapiens
gugaugagcguaggacaaa

SEQ ID NO: 880449 - RNA, 19 nt, Homo sapiens
gcagaguacguccguggaa

SEQ ID NO: 880450 - RNA, 19 nt, Homo sapiens
aaagaggaaguacaacuga

SEQ ID NO: 880451 - RNA, 19 nt, Homo sapiens
gauacugauuaccaaguca

SEQ ID NO: 880452 - RNA, 19 nt, Homo sapiens
guuaaagauuacugcucua

SEQ ID NO: 880453 - RNA, 19 nt, Homo sapiens
acacauaguacuuucuaga

SEQ ID NO: 880454 - RNA, 19 nt, Homo sapiens
ggucaagaacccaguaugg

SEQ ID NO: 880455 - RNA, 19 nt, Homo sapiens
ugaaggagacucgaggaaa

SEQ ID NO: 880456 - RNA, 19 nt, Homo sapiens
acuccuaccugggcaagua

SEQ ID NO: 880457 - RNA, 19 nt, Homo sapiens
gaggaaguacaacugaaga

SEQ ID NO: 880458 - RNA, 19 nt, Homo sapiens
aacagcaguuucucuaguu

SEQ ID NO: 880459 - RNA, 19 nt, Homo sapiens
cccaugcacugacauaagu

SEQ ID NO: 880460 - RNA, 19 nt, Homo sapiens
agacagagaacacagaaag

SEQ ID NO: 880461 - RNA, 19 nt, Homo sapiens
gccgaaagaggaaguacaa

SEQ ID NO: 880462 - RNA, 19 nt, Homo sapiens
uaccuauauucuccugaua

SEQ ID NO: 880463 - RNA, 19 nt, Homo sapiens
guugacaaauuagacauag

SEQ ID NO: 880464 - RNA, 19 nt, Homo sapiens
aggaaccaacugaagauua

SEQ ID NO: 880465 - RNA, 19 nt, Homo sapiens
gaaguccuagagagagaaa

SEQ ID NO: 880466 - RNA, 19 nt, Homo sapiens
cuaccugggcaaguaauua

SEQ ID NO: 880467 - RNA, 19 nt, Homo sapiens
guacaacugaagacagaga

SEQ ID NO: 880468 - RNA, 19 nt, Homo sapiens
ggaaguacaacugaagaca

SEQ ID NO: 880469 - RNA, 19 nt, Homo sapiens
aggcuucauucuuacagua

SEQ ID NO: 880470 - RNA, 19 nt, Homo sapiens
guaacuggguaacuuauug

SEQ ID NO: 880471 - RNA, 19 nt, Homo sapiens
ggacagagaagcccaagau

SEQ ID NO: 880472 - RNA, 19 nt, Homo sapiens
cuuccuaccuccagaauaa

SEQ ID NO: 880473 - RNA, 19 nt, Homo sapiens
ccaaggagucgucuacuuu

SEQ ID NO: 880474 - RNA, 19 nt, Homo sapiens
ccuacuaucuauguuguua

SEQ ID NO: 880475 - RNA, 19 nt, Homo sapiens
gcucagacccagcaauuga

SEQ ID NO: 880476 - RNA, 19 nt, Homo sapiens
cagagaagcccaagaugaa

SEQ ID NO: 880477 - RNA, 19 nt, Homo sapiens
gaacagaaggacagaugga

SEQ ID NO: 880478 - RNA, 19 nt, Homo sapiens
agaaggaucugaggauuuc

SEQ ID NO: 880479 - RNA, 19 nt, Homo sapiens
uaagcccaaugcccaauuu

SEQ ID NO: 880480 - RNA, 19 nt, Homo sapiens
caacugcacucggguacug

SEQ ID NO: 880481 - RNA, 19 nt, Homo sapiens
gagggcagcugaguaacug

SEQ ID NO: 880482 - RNA, 19 nt, Homo sapiens
ugaguaacuggguaacuua

SEQ ID NO: 880483 - RNA, 19 nt, Homo sapiens
gaauaaagaaucucaaccu

SEQ ID NO: 880484 - RNA, 19 nt, Homo sapiens
gggcucagacccagcaauu

SEQ ID NO: 880485 - RNA, 19 nt, Homo sapiens
guacugguguggcauacuc

SEQ ID NO: 880486 - RNA, 19 nt, Homo sapiens
acagagaagcccaagauga

SEQ ID NO: 880487 - RNA, 19 nt, Homo sapiens
gaagcugaagaacguguuu

SEQ ID NO: 880488 - RNA, 19 nt, Homo sapiens
caaggagucgucuacuuug

SEQ ID NO: 880489 - RNA, 19 nt, Homo sapiens
gcaugguccugcugcuuca

SEQ ID NO: 880490 - RNA, 19 nt, Homo sapiens
cugaguaacuggguaacuu

SEQ ID NO: 880491 - RNA, 19 nt, Homo sapiens
ugcccuugcuguuagauaa

SEQ ID NO: 880492 - RNA, 19 nt, Homo sapiens
gagggagggcagcugagua

SEQ ID NO: 880493 - RNA, 19 nt, Homo sapiens
gcccugcccuugcuguuag

SEQ ID NO: 880494 - RNA, 19 nt, Homo sapiens
gcagagcugguacgacugu

SEQ ID NO: 880495 - RNA, 19 nt, Homo sapiens
cuggagagcagucuucuga

SEQ ID NO: 880496 - RNA, 19 nt, Homo sapiens
ggcccugccuacuaucuau

SEQ ID NO: 880497 - RNA, 19 nt, Homo sapiens
gcuguuagauaagcccaau

SEQ ID NO: 880498 - RNA, 19 nt, Homo sapiens
gcccuucccuguggauaug

SEQ ID NO: 880499 - RNA, 19 nt, Homo sapiens
aagcagcccuuguguugag

SEQ ID NO: 880500 - RNA, 19 nt, Homo sapiens
ccaaugcccaauuugauuc

SEQ ID NO: 880501 - RNA, 19 nt, Homo sapiens
cccaaggagucgucuacuu

SEQ ID NO: 880502 - RNA, 19 nt, Homo sapiens
gcccaaugcccaauuugau

SEQ ID NO: 880503 - RNA, 19 nt, Homo sapiens
cuacuuugcugacgaugac

SEQ ID NO: 880504 - RNA, 19 nt, Homo sapiens
acagaaggcagagcuggua

SEQ ID NO: 880505 - RNA, 19 nt, Homo sapiens
cccaaugcccaauuugauu

SEQ ID NO: 880506 - RNA, 19 nt, Homo sapiens
gaaggcagagcugguacga

SEQ ID NO: 880507 - RNA, 19 nt, Homo sapiens
gaguaacuggguaacuuau

SEQ ID NO: 880508 - RNA, 19 nt, Homo sapiens
cagcugaguaacuggguaa

SEQ ID NO: 880509 - RNA, 19 nt, Homo sapiens
ccgagcagcuacggcagaa

SEQ ID NO: 880510 - RNA, 19 nt, Homo sapiens
ggcccugcccuugcuguua

SEQ ID NO: 880511 - RNA, 19 nt, Homo sapiens
ggagggcagcugaguaacu

SEQ ID NO: 880512 - RNA, 19 nt, Homo sapiens
agggagggcagcugaguaa

SEQ ID NO: 880513 - RNA, 19 nt, Homo sapiens
ggcauacucggacagagaa

SEQ ID NO: 880514 - RNA, 19 nt, Homo sapiens
aagaaucucaaccuggaaa

SEQ ID NO: 880515 - RNA, 19 nt, Homo sapiens
gacagagaagcccaagaug

SEQ ID NO: 880516 - RNA, 19 nt, Homo sapiens
uggaacagaaggacagaug

SEQ ID NO: 880517 - RNA, 19 nt, Homo sapiens
gaacugaaauacauucuga

SEQ ID NO: 880518 - RNA, 19 nt, Homo sapiens
aaacagaccuuuccacgua

SEQ ID NO: 880519 - RNA, 19 nt, Homo sapiens
aaagaaagcuuguacugua

SEQ ID NO: 880520 - RNA, 19 nt, Homo sapiens
gaaccuugcuggacucuga

SEQ ID NO: 880521 - RNA, 19 nt, Homo sapiens
caaaugacauggagaaauc

SEQ ID NO: 880522 - RNA, 19 nt, Homo sapiens
gaagaucuaugaggauuau

SEQ ID NO: 880523 - RNA, 19 nt, Homo sapiens
caugggaaauccagacuua

SEQ ID NO: 880524 - RNA, 19 nt, Homo sapiens
gauuugagcugccucuuug

SEQ ID NO: 880525 - RNA, 19 nt, Homo sapiens
caucucagccggauauuua

SEQ ID NO: 880526 - RNA, 19 nt, Homo sapiens
gcacagaguagaagauauu

SEQ ID NO: 880527 - RNA, 19 nt, Homo sapiens
gcacacaacucuacugacu

SEQ ID NO: 880528 - RNA, 19 nt, Homo sapiens
cuaaagacaucgaaauuca

SEQ ID NO: 880529 - RNA, 19 nt, Homo sapiens
ucaaugagaugcagaagau

SEQ ID NO: 880530 - RNA, 19 nt, Homo sapiens
gaggcucuuuccuuuauua

SEQ ID NO: 880531 - RNA, 19 nt, Homo sapiens
gcacuucucccgggaaaua

SEQ ID NO: 880532 - RNA, 19 nt, Homo sapiens
gaacuucaggcgucacaua

SEQ ID NO: 880533 - RNA, 19 nt, Homo sapiens
gaacucagcuaccucaaaa

SEQ ID NO: 880534 - RNA, 19 nt, Homo sapiens
gcugggaagucgugauuaa

SEQ ID NO: 880535 - RNA, 19 nt, Homo sapiens
gagcagagcggaacagaga

SEQ ID NO: 880536 - RNA, 19 nt, Homo sapiens
caacgucccugauaucaca

SEQ ID NO: 880537 - RNA, 19 nt, Homo sapiens
gaugguacauucuggauuc

SEQ ID NO: 880538 - RNA, 19 nt, Homo sapiens
gaucagaaaccuagaugaa

SEQ ID NO: 880539 - RNA, 19 nt, Homo sapiens
gagcugccucuuugaauua

SEQ ID NO: 880540 - RNA, 19 nt, Homo sapiens
auagaagucuuuccacuaa

SEQ ID NO: 880541 - RNA, 19 nt, Homo sapiens
cgaccuaaauucuguucua

SEQ ID NO: 880542 - RNA, 19 nt, Homo sapiens
gaauacagccaaugauuuc

SEQ ID NO: 880543 - RNA, 19 nt, Homo sapiens
ugucugaucuugaccuuaa

SEQ ID NO: 880544 - RNA, 19 nt, Homo sapiens
cugccaagcuguauaguaa

SEQ ID NO: 880545 - RNA, 19 nt, Homo sapiens
gaacugauccauacgaagu

SEQ ID NO: 880546 - RNA, 19 nt, Homo sapiens
gcagaaucuugagaaauuu

SEQ ID NO: 880547 - RNA, 19 nt, Homo sapiens
ggagcagaaucuugagaaa

SEQ ID NO: 880548 - RNA, 19 nt, Homo sapiens
acacaacucuacugacuug

SEQ ID NO: 880549 - RNA, 19 nt, Homo sapiens
gaaaguagcgagccacauc

SEQ ID NO: 880550 - RNA, 19 nt, Homo sapiens
ugaaauacauucugaacca

SEQ ID NO: 880551 - RNA, 19 nt, Homo sapiens
uaagagagccgucauacug

SEQ ID NO: 880552 - RNA, 19 nt, Homo sapiens
ucgaugaacuucugcauau

SEQ ID NO: 880553 - RNA, 19 nt, Homo sapiens
cauggaagaugguacauuc

SEQ ID NO: 880554 - RNA, 19 nt, Homo sapiens
guacuucgguuucaucucu

SEQ ID NO: 880555 - RNA, 19 nt, Homo sapiens
gcagcuagagucuguaauu

SEQ ID NO: 880556 - RNA, 19 nt, Homo sapiens
gcagauggaggcccuguuu

SEQ ID NO: 880557 - RNA, 19 nt, Homo sapiens
gaaacaagaagggaauauu

SEQ ID NO: 880558 - RNA, 19 nt, Homo sapiens
aaagaaaacugcaaacuga

SEQ ID NO: 880559 - RNA, 19 nt, Homo sapiens
uaaaggcaauggagaaagu

SEQ ID NO: 880560 - RNA, 19 nt, Homo sapiens
gggaauauuuucuucguua

SEQ ID NO: 880561 - RNA, 19 nt, Homo sapiens
gaguucuucucugaaauua
